United States Patent 7,655,785 (BIOINFORMATICALLY DETECTABLE GROUP OF NOVEL REGULATORY OLIGONUCLEOTIDES AND USES THEREOF) - sequence listing, part 6

SEQ ID NO: 200263 - RNA, 22 nt, Homo sapiens
cagugaauuucaggucaagagu

SEQ ID NO: 200264 - RNA, 22 nt, Homo sapiens
cagugcaaagccucugcccaga

SEQ ID NO: 200265 - RNA, 22 nt, Homo sapiens
cagugcuuuaucaaguccucca

SEQ ID NO: 200266 - RNA, 22 nt, Homo sapiens
cagugucugcauuuggaacuca

SEQ ID NO: 200267 - RNA, 22 nt, Homo sapiens
caguucaugguaggcaccauag

SEQ ID NO: 200268 - RNA, 22 nt, Homo sapiens
caguuguuuuaugacauaagau

SEQ ID NO: 200269 - RNA, 22 nt, Homo sapiens
cauacagcuaguaaguguaaga

SEQ ID NO: 200270 - RNA, 22 nt, Homo sapiens
cauauaguaggugcucuguguu

SEQ ID NO: 200271 - RNA, 21 nt, Homo sapiens
caucaaauugucauggugggu

SEQ ID NO: 200272 - RNA, 23 nt, Homo sapiens
caucacagagccuuccuugacuc

SEQ ID NO: 200273 - RNA, 22 nt, Homo sapiens
caucagauugagaucaucuaag

SEQ ID NO: 200274 - RNA, 22 nt, Homo sapiens
caugacacauguuuaccuaugu

SEQ ID NO: 200275 - RNA, 22 nt, Homo sapiens
caugcacugagagggucucggc

SEQ ID NO: 200276 - RNA, 22 nt, Homo sapiens
caugcagcacacaugucugugc

SEQ ID NO: 200277 - RNA, 22 nt, Homo sapiens
caugccacugcacgccauccug

SEQ ID NO: 200278 - RNA, 22 nt, Homo sapiens
cauggcacuggugggagugucu

SEQ ID NO: 200279 - RNA, 22 nt, Homo sapiens
cauggcauuugcagaguugaaa

SEQ ID NO: 200280 - RNA, 22 nt, Homo sapiens
cauggcuuuuauaacaagaaau

SEQ ID NO: 200281 - RNA, 22 nt, Homo sapiens
caugggacugucuuggcuauac

SEQ ID NO: 200282 - RNA, 22 nt, Homo sapiens
cauggucaccuuccaaguuauu

SEQ ID NO: 200283 - RNA, 22 nt, Homo sapiens
caugucuuuuauucugugugau

SEQ ID NO: 200284 - RNA, 19 nt, Homo sapiens
caugugcacuacuggcuuc

SEQ ID NO: 200285 - RNA, 20 nt, Homo sapiens
cauuacacuccaaccugggu

SEQ ID NO: 200286 - RNA, 22 nt, Homo sapiens
cauugcacuccaccuuggguaa

SEQ ID NO: 200287 - RNA, 22 nt, Homo sapiens
cauugcacuccagcccagguga

SEQ ID NO: 200288 - RNA, 22 nt, Homo sapiens
cauugcacuccagccuagccaa

SEQ ID NO: 200289 - RNA, 22 nt, Homo sapiens
cauugcacuccagccugaccaa

SEQ ID NO: 200290 - RNA, 22 nt, Homo sapiens
cauugcacuccagccugcugac

SEQ ID NO: 200291 - RNA, 22 nt, Homo sapiens
cauugcacuccagccuggcaac

SEQ ID NO: 200292 - RNA, 20 nt, Homo sapiens
cugaggugggagaaucgcuu

SEQ ID NO: 200293 - RNA, 22 nt, Homo sapiens
cugaggugggaggauuacuuga

SEQ ID NO: 200294 - RNA, 22 nt, Homo sapiens
cugagguuguucuucucagugg

SEQ ID NO: 200295 - RNA, 18 nt, Homo sapiens
cugagucauuccuggguc

SEQ ID NO: 200296 - RNA, 20 nt, Homo sapiens
cugauacagccugagcucuc

SEQ ID NO: 200297 - RNA, 22 nt, Homo sapiens
cugauauuuuaaaauuggcugg

SEQ ID NO: 200298 - RNA, 22 nt, Homo sapiens
cugaucuguagcagccaccaca

SEQ ID NO: 200299 - RNA, 22 nt, Homo sapiens
cugauugucuauuuaguucacu

SEQ ID NO: 200300 - RNA, 21 nt, Homo sapiens
cugcaaaugcugcugccugau

SEQ ID NO: 200301 - RNA, 22 nt, Homo sapiens
cugcaagaugcauaggaauuuu

SEQ ID NO: 200302 - RNA, 20 nt, Homo sapiens
cugcacauccacucuacuuc

SEQ ID NO: 200303 - RNA, 22 nt, Homo sapiens
cugccacugacaccucaaggac

SEQ ID NO: 200304 - RNA, 20 nt, Homo sapiens
cugcuccccuacaaaucuca

SEQ ID NO: 200305 - RNA, 22 nt, Homo sapiens
cuggaagaaaaucacgccaucu

SEQ ID NO: 200306 - RNA, 18 nt, Homo sapiens
cuggaaggcuacuacagu

SEQ ID NO: 200307 - RNA, 22 nt, Homo sapiens
cuggaauguuccuaaagauuca

SEQ ID NO: 200308 - RNA, 22 nt, Homo sapiens
cuggagcaaaggugacucuugu

SEQ ID NO: 200309 - RNA, 22 nt, Homo sapiens
cuggagcauugguggauuuguu

SEQ ID NO: 200310 - RNA, 22 nt, Homo sapiens
cuggaguaugaaccauguauca

SEQ ID NO: 200311 - RNA, 22 nt, Homo sapiens
cuggcaaauguuuucuguaaag

SEQ ID NO: 200312 - RNA, 22 nt, Homo sapiens
cuggcagugcuuguuauccugg

SEQ ID NO: 200313 - RNA, 22 nt, Homo sapiens
cuggccagagacauucauuaaa

SEQ ID NO: 200314 - RNA, 22 nt, Homo sapiens
cugggguaggacuggcuuuuga

SEQ ID NO: 200315 - RNA, 22 nt, Homo sapiens
cugguuguuacaugcuugccag

SEQ ID NO: 200316 - RNA, 22 nt, Homo sapiens
cuguagcuuuuauaugcuuagc

SEQ ID NO: 200317 - RNA, 22 nt, Homo sapiens
cugucacugggaggggcagcag

SEQ ID NO: 200318 - RNA, 22 nt, Homo sapiens
cugugcacaucuggcggcccga

SEQ ID NO: 200319 - RNA, 22 nt, Homo sapiens
cugugcaugcgcggagcugaaa

SEQ ID NO: 200320 - RNA, 22 nt, Homo sapiens
cugugguguaacucuuggggcg

SEQ ID NO: 200321 - RNA, 22 nt, Homo sapiens
cuguuaacauguuguggauaau

SEQ ID NO: 200322 - RNA, 22 nt, Homo sapiens
cuguuugaggguuugcuuucag

SEQ ID NO: 200323 - RNA, 22 nt, Homo sapiens
cuuacagucuaucagccacaac

SEQ ID NO: 200324 - RNA, 19 nt, Homo sapiens
cuuaggugaccaguuccca

SEQ ID NO: 200325 - RNA, 22 nt, Homo sapiens
cuucaccaguuuggcagucuca

SEQ ID NO: 200326 - RNA, 22 nt, Homo sapiens
cuucacggugccuacuuguguc

SEQ ID NO: 200327 - RNA, 22 nt, Homo sapiens
cuucacuuuguuaaacuccaau

SEQ ID NO: 200328 - RNA, 22 nt, Homo sapiens
cuucaugagacuuuuggaaggc

SEQ ID NO: 200329 - RNA, 22 nt, Homo sapiens
cuucaugggagaaccacaggua

SEQ ID NO: 200330 - RNA, 18 nt, Homo sapiens
cuucauugcuguuuugcu

SEQ ID NO: 200331 - RNA, 22 nt, Homo sapiens
cuuccaguggcagccgggcaug

SEQ ID NO: 200332 - RNA, 20 nt, Homo sapiens
cuuccaguggccccaucuuu

SEQ ID NO: 200333 - RNA, 22 nt, Homo sapiens
cuuccauauucuaggacaggcu

SEQ ID NO: 200334 - RNA, 22 nt, Homo sapiens
cuucuguuaguucugauaacuu

SEQ ID NO: 200335 - RNA, 22 nt, Homo sapiens
cuucuugcuguguccucacaug

SEQ ID NO: 200336 - RNA, 22 nt, Homo sapiens
cuugacacugguuuucugaaua

SEQ ID NO: 200337 - RNA, 22 nt, Homo sapiens
cuugagacauuguuuuccaagu

SEQ ID NO: 200338 - RNA, 22 nt, Homo sapiens
cuugaucaaugugguacuugau

SEQ ID NO: 200339 - RNA, 22 nt, Homo sapiens
cuugcacucagaagauucaguu

SEQ ID NO: 200340 - RNA, 22 nt, Homo sapiens
cuugcauagaguuauugcccuu

SEQ ID NO: 200341 - RNA, 22 nt, Homo sapiens
cuugggcagugugcauguguau

SEQ ID NO: 200342 - RNA, 22 nt, Homo sapiens
cuugucacuguuggcuuuagaa

SEQ ID NO: 200343 - RNA, 22 nt, Homo sapiens
cuugugcaugaccccagguggg

SEQ ID NO: 200344 - RNA, 22 nt, Homo sapiens
cuuuacacauccuaaccagugu

SEQ ID NO: 200345 - RNA, 22 nt, Homo sapiens
cuuuaguuaaaauugggguugu

SEQ ID NO: 200346 - RNA, 22 nt, Homo sapiens
cuuuccauuguuggagcauaaa

SEQ ID NO: 200347 - RNA, 22 nt, Homo sapiens
cuuucucagugagacccgagau

SEQ ID NO: 200348 - RNA, 22 nt, Homo sapiens
cuuuggauggaaccucucuuuc

SEQ ID NO: 200349 - RNA, 22 nt, Homo sapiens
cuuuggcaaugucauuuucaau

SEQ ID NO: 200350 - RNA, 23 nt, Homo sapiens
cuuuggucucugguugacuucag

SEQ ID NO: 200351 - RNA, 22 nt, Homo sapiens
cuuugguguauuuucagagacc

SEQ ID NO: 200352 - RNA, 22 nt, Homo sapiens
cuuugguuaauaggauauggca

SEQ ID NO: 200353 - RNA, 22 nt, Homo sapiens
cuuugguucuguuuauaugcug

SEQ ID NO: 200354 - RNA, 22 nt, Homo sapiens
cuuugguugugcucuccacuuu

SEQ ID NO: 200355 - RNA, 23 nt, Homo sapiens
cuuuguacagcuugacuacuggg

SEQ ID NO: 200356 - RNA, 22 nt, Homo sapiens
cuuuguguggacauuucaggca

SEQ ID NO: 200357 - RNA, 22 nt, Homo sapiens
cuuuuacacugcuggugggaau

SEQ ID NO: 200358 - RNA, 22 nt, Homo sapiens
cuuuuacacuguuggcaggauu

SEQ ID NO: 200359 - RNA, 22 nt, Homo sapiens
cuuuuugcaaauacaacucuga

SEQ ID NO: 200360 - RNA, 20 nt, Homo sapiens
cuuuuugcugugcugggagc

SEQ ID NO: 200361 - RNA, 22 nt, Homo sapiens
cuuuuugguagagcaggugugc

SEQ ID NO: 200362 - RNA, 22 nt, Homo sapiens
gaaagacuuucugcuguggaua

SEQ ID NO: 200363 - RNA, 22 nt, Homo sapiens
gaaaugcucauuuuggauccuu

SEQ ID NO: 200364 - RNA, 22 nt, Homo sapiens
gaaauguauuaaugaguugaaa

SEQ ID NO: 200365 - RNA, 18 nt, Homo sapiens
gaagaaguaggcauggca

SEQ ID NO: 200366 - RNA, 19 nt, Homo sapiens
gaaguguuuguucuccaug

SEQ ID NO: 200367 - RNA, 22 nt, Homo sapiens
gaauacugacuauuucaucugg

SEQ ID NO: 200368 - RNA, 22 nt, Homo sapiens
ggcaaggaggggcacuuucacu

SEQ ID NO: 200369 - RNA, 20 nt, Homo sapiens
ggcaagguagcauuucuucu

SEQ ID NO: 200370 - RNA, 22 nt, Homo sapiens
ggcaaggugcuacagacaguga

SEQ ID NO: 200371 - RNA, 22 nt, Homo sapiens
ggcacaaugucagcucacugca

SEQ ID NO: 200372 - RNA, 22 nt, Homo sapiens
ggcacaauugcagcaauaaaca

SEQ ID NO: 200373 - RNA, 19 nt, Homo sapiens
ggcacugugugagugagga

SEQ ID NO: 200374 - RNA, 22 nt, Homo sapiens
ggcagcauugccuuugcaguga

SEQ ID NO: 200375 - RNA, 17 nt, Homo sapiens
ggcaggaauuaauguca

SEQ ID NO: 200376 - RNA, 22 nt, Homo sapiens
ggcauguugauagguagaugua

SEQ ID NO: 200377 - RNA, 21 nt, Homo sapiens
ggcauugugcccuugcucuag

SEQ ID NO: 200378 - RNA, 22 nt, Homo sapiens
ggccagaugcgguggcucacac

SEQ ID NO: 200379 - RNA, 22 nt, Homo sapiens
ggcccaguugcgggugguaccg

SEQ ID NO: 200380 - RNA, 22 nt, Homo sapiens
ggcuagagacaaguugcugaga

SEQ ID NO: 200381 - RNA, 22 nt, Homo sapiens
ggcuagaugcuagagauaucau

SEQ ID NO: 200382 - RNA, 19 nt, Homo sapiens
ggcucagucaacugacugu

SEQ ID NO: 200383 - RNA, 22 nt, Homo sapiens
gggaacaugagaaugugaauga

SEQ ID NO: 200384 - RNA, 18 nt, Homo sapiens
gggaauauggggaguuga

SEQ ID NO: 200385 - RNA, 22 nt, Homo sapiens
gggcgagaaucggcugcucagc

SEQ ID NO: 200386 - RNA, 22 nt, Homo sapiens
gguagacaucgugcucugugau

SEQ ID NO: 200387 - RNA, 22 nt, Homo sapiens
gguaucuuggagagagaaguga

SEQ ID NO: 200388 - RNA, 22 nt, Homo sapiens
gguauguaggucuacgguacaa

SEQ ID NO: 200389 - RNA, 22 nt, Homo sapiens
ggucagaaagacaggcauucag

SEQ ID NO: 200390 - RNA, 22 nt, Homo sapiens
ggucauggagcuuuacuuuaug

SEQ ID NO: 200391 - RNA, 22 nt, Homo sapiens
ggucugguguugaaauucuuca

SEQ ID NO: 200392 - RNA, 22 nt, Homo sapiens
gguggucuuccccuggaguucg

SEQ ID NO: 200393 - RNA, 22 nt, Homo sapiens
guaaagacacaugcacacguau

SEQ ID NO: 200394 - RNA, 22 nt, Homo sapiens
guaaauaccaguuucuggaaca

SEQ ID NO: 200395 - RNA, 22 nt, Homo sapiens
guaaauguccugcuacagagug

SEQ ID NO: 200396 - RNA, 22 nt, Homo sapiens
guaacacaugcugcucucuggu

SEQ ID NO: 200397 - RNA, 22 nt, Homo sapiens
guaacagucucaacaguggucu

SEQ ID NO: 200398 - RNA, 22 nt, Homo sapiens
guaagauaguauguuuaaccca

SEQ ID NO: 200399 - RNA, 22 nt, Homo sapiens
guaaggaguaguguaacagugc

SEQ ID NO: 200400 - RNA, 23 nt, Homo sapiens
guaauacuagucauaguagcagg

SEQ ID NO: 200401 - RNA, 22 nt, Homo sapiens
guaaucucagcuacuugggagc

SEQ ID NO: 200402 - RNA, 22 nt, Homo sapiens
guacacaacaugcagguuuguu

SEQ ID NO: 200403 - RNA, 22 nt, Homo sapiens
guacacauacauauaugugugu

SEQ ID NO: 200404 - RNA, 22 nt, Homo sapiens
guacauagucacacauauacau

SEQ ID NO: 200405 - RNA, 22 nt, Homo sapiens
guagaauguauacaguauacag

SEQ ID NO: 200406 - RNA, 22 nt, Homo sapiens
guagagugcugggcacuggcuc

SEQ ID NO: 200407 - RNA, 22 nt, Homo sapiens
guagaucucaacacuggaagua

SEQ ID NO: 200408 - RNA, 22 nt, Homo sapiens
guagaugcauggauuuacuucu

SEQ ID NO: 200409 - RNA, 22 nt, Homo sapiens
guauacaguugacccuugaacc

SEQ ID NO: 200410 - RNA, 22 nt, Homo sapiens
guauggaagucaguuuguuggc

SEQ ID NO: 200411 - RNA, 22 nt, Homo sapiens
guauggcacuauccucucugau

SEQ ID NO: 200412 - RNA, 22 nt, Homo sapiens
guauggcaugcaugagaauuuc

SEQ ID NO: 200413 - RNA, 21 nt, Homo sapiens
guaugguugaagugacaagcc

SEQ ID NO: 200414 - RNA, 22 nt, Homo sapiens
guaugguugaagugacaagcca

SEQ ID NO: 200415 - RNA, 22 nt, Homo sapiens
guaugucuugucuauggcugcu

SEQ ID NO: 200416 - RNA, 22 nt, Homo sapiens
guaugugacuggaacaguagga

SEQ ID NO: 200417 - RNA, 22 nt, Homo sapiens
guauuugauuauagcaugcuua

SEQ ID NO: 200418 - RNA, 19 nt, Homo sapiens
guauuugguaaacucucca

SEQ ID NO: 200419 - RNA, 22 nt, Homo sapiens
gucaacauauuaauuauguucu

SEQ ID NO: 200420 - RNA, 22 nt, Homo sapiens
gucacggaauguaaguggaagu

SEQ ID NO: 200421 - RNA, 22 nt, Homo sapiens
gucagcaaagaggaauaguuug

SEQ ID NO: 200422 - RNA, 22 nt, Homo sapiens
gucaggcaccgauacaguuuuu

SEQ ID NO: 200423 - RNA, 22 nt, Homo sapiens
gucagggagucucuaucagugg

SEQ ID NO: 200424 - RNA, 22 nt, Homo sapiens
gucaguucuugugguugcauuc

SEQ ID NO: 200425 - RNA, 22 nt, Homo sapiens
gucaguuucacucagcuggaac

SEQ ID NO: 200426 - RNA, 22 nt, Homo sapiens
gucaucaggacgggucaucugc

SEQ ID NO: 200427 - RNA, 22 nt, Homo sapiens
gucauucauucagcaagcacug

SEQ ID NO: 200428 - RNA, 22 nt, Homo sapiens
gucauuguguggacauggagaa

SEQ ID NO: 200429 - RNA, 22 nt, Homo sapiens
guccaaagugggagaggugggg

SEQ ID NO: 200430 - RNA, 22 nt, Homo sapiens
guccauuuguuuccagagcacu

SEQ ID NO: 200431 - RNA, 22 nt, Homo sapiens
guccuggagaagcguggaccgg

SEQ ID NO: 200432 - RNA, 22 nt, Homo sapiens
gucucuuguuaucauuucugag

SEQ ID NO: 200433 - RNA, 22 nt, Homo sapiens
gucuggcuuaucucacuuacca

SEQ ID NO: 200434 - RNA, 22 nt, Homo sapiens
gucugguuccugggagauuucu

SEQ ID NO: 200435 - RNA, 22 nt, Homo sapiens
gucuuugcuuuuaaccagaggu

SEQ ID NO: 200436 - RNA, 22 nt, Homo sapiens
gugaaagcaucugacugugcca

SEQ ID NO: 200437 - RNA, 22 nt, Homo sapiens
gugaaauauuuaacguccaggu

SEQ ID NO: 200438 - RNA, 22 nt, Homo sapiens
gugaacuguuugaggaagagaa

SEQ ID NO: 200439 - RNA, 22 nt, Homo sapiens
gugaagaucccuguccuguucc

SEQ ID NO: 200440 - RNA, 20 nt, Homo sapiens
gugaauacauuugguuucau

SEQ ID NO: 200441 - RNA, 22 nt, Homo sapiens
gugacacagcaagacuccgucu

SEQ ID NO: 200442 - RNA, 22 nt, Homo sapiens
gugacaucagcuccagguauaa

SEQ ID NO: 200443 - RNA, 22 nt, Homo sapiens
guuuggcuuucucucuauccug

SEQ ID NO: 200444 - RNA, 21 nt, Homo sapiens
uaaaacuguaacuuuguccug

SEQ ID NO: 200445 - RNA, 22 nt, Homo sapiens
uaaagcauguaauuagguuaga

SEQ ID NO: 200446 - RNA, 22 nt, Homo sapiens
uaaagccagugauuaugucucu

SEQ ID NO: 200447 - RNA, 22 nt, Homo sapiens
uaaagcuacagagcggaaaauu

SEQ ID NO: 200448 - RNA, 22 nt, Homo sapiens
uaaagcuacaguauaugguauu

SEQ ID NO: 200449 - RNA, 22 nt, Homo sapiens
uaaagcuauuauaguuauguuu

SEQ ID NO: 200450 - RNA, 20 nt, Homo sapiens
uaaagcugcucagggggcuc

SEQ ID NO: 200451 - RNA, 22 nt, Homo sapiens
uaaaguuauugccccucaguua

SEQ ID NO: 200452 - RNA, 22 nt, Homo sapiens
uaaaugcuugagaugauggaua

SEQ ID NO: 200453 - RNA, 22 nt, Homo sapiens
uaaauugcauaaguacaaauga

SEQ ID NO: 200454 - RNA, 22 nt, Homo sapiens
uaacaacauucuaacugacggc

SEQ ID NO: 200455 - RNA, 22 nt, Homo sapiens
uaacacagagcuccuaaucccu

SEQ ID NO: 200456 - RNA, 16 nt, Homo sapiens
uaacacaguucccacc

SEQ ID NO: 200457 - RNA, 21 nt, Homo sapiens
uaacagcuccacuccauucuc

SEQ ID NO: 200458 - RNA, 22 nt, Homo sapiens
uaacagcucuacagcugcucuu

SEQ ID NO: 200459 - RNA, 22 nt, Homo sapiens
uaacaggcuacucuugcauugc

SEQ ID NO: 200460 - RNA, 22 nt, Homo sapiens
uaacaguggucugugguaucug

SEQ ID NO: 200461 - RNA, 22 nt, Homo sapiens
uaacauugcuggacuaccugcu

SEQ ID NO: 200462 - RNA, 22 nt, Homo sapiens
uaacccuuacaacuacacucgu

SEQ ID NO: 200463 - RNA, 22 nt, Homo sapiens
uaacuauagagaauguugagua

SEQ ID NO: 200464 - RNA, 22 nt, Homo sapiens
uaacuguggaaaugacuuuaaa

SEQ ID NO: 200465 - RNA, 22 nt, Homo sapiens
uaacuucaucauaagucaagaa

SEQ ID NO: 200466 - RNA, 22 nt, Homo sapiens
uaagaugaaggcucaccuagaa

SEQ ID NO: 200467 - RNA, 22 nt, Homo sapiens
uaagcaguaaaugaagucuugc

SEQ ID NO: 200468 - RNA, 22 nt, Homo sapiens
uaaggaguagaauaguaaggca

SEQ ID NO: 200469 - RNA, 22 nt, Homo sapiens
uaaggauuuuggugauuacacu

SEQ ID NO: 200470 - RNA, 22 nt, Homo sapiens
uaaggcuagcaagaugagaaua

SEQ ID NO: 200471 - RNA, 22 nt, Homo sapiens
uaaggcuuugcuggacucaguc

SEQ ID NO: 200472 - RNA, 22 nt, Homo sapiens
uaaguagugugcauguauguau

SEQ ID NO: 200473 - RNA, 22 nt, Homo sapiens
uaagugaauuugacagguaaug

SEQ ID NO: 200474 - RNA, 22 nt, Homo sapiens
uaagugacuuugagauuccuca

SEQ ID NO: 200475 - RNA, 22 nt, Homo sapiens
uaagugcuugacuuugauguuu

SEQ ID NO: 200476 - RNA, 22 nt, Homo sapiens
uaaguucauucaugaaacuuag

SEQ ID NO: 200477 - RNA, 20 nt, Homo sapiens
uaaguuguauuugucaugaa

SEQ ID NO: 200478 - RNA, 22 nt, Homo sapiens
uaauaguuucagaaguuguuuu

SEQ ID NO: 200479 - RNA, 22 nt, Homo sapiens
uaauucuguauguaucagaguu

SEQ ID NO: 200480 - RNA, 22 nt, Homo sapiens
uaauugcaguucuguguuauau

SEQ ID NO: 200481 - RNA, 22 nt, Homo sapiens
uacaaagcuacucgagggcagg

SEQ ID NO: 200482 - RNA, 22 nt, Homo sapiens
uacaaagcuuucugcaaaucau

SEQ ID NO: 200483 - RNA, 22 nt, Homo sapiens
uacaacacugguucgacaugug

SEQ ID NO: 200484 - RNA, 22 nt, Homo sapiens
uacaaguauuuuuauuagugcc

SEQ ID NO: 200485 - RNA, 22 nt, Homo sapiens
uacaauagugacaaaucagcau

SEQ ID NO: 200486 - RNA, 22 nt, Homo sapiens
uacacagucaaaaauuuccagg

SEQ ID NO: 200487 - RNA, 22 nt, Homo sapiens
uacaccauuugauucuuuaagc

SEQ ID NO: 200488 - RNA, 22 nt, Homo sapiens
uacagcacaggugcagguguug

SEQ ID NO: 200489 - RNA, 23 nt, Homo sapiens
uacagcugcagaaucaggcuaag

SEQ ID NO: 200490 - RNA, 22 nt, Homo sapiens
uacaggaaugucagguugcugu

SEQ ID NO: 200491 - RNA, 22 nt, Homo sapiens
uacaggauagacaauuuauuaa

SEQ ID NO: 200492 - RNA, 22 nt, Homo sapiens
uacaggcagguguucccugguu

SEQ ID NO: 200493 - RNA, 22 nt, Homo sapiens
uacaggugcuuauguggacaua

SEQ ID NO: 200494 - RNA, 22 nt, Homo sapiens
uacagucauaaugccuagugac

SEQ ID NO: 200495 - RNA, 22 nt, Homo sapiens
uacagugcuugguaucuaguaa

SEQ ID NO: 200496 - RNA, 22 nt, Homo sapiens
uacaguguuuugguauuccaca

SEQ ID NO: 200497 - RNA, 22 nt, Homo sapiens
uaccacagucauuacacuugua

SEQ ID NO: 200498 - RNA, 22 nt, Homo sapiens
uaccacauuguagagggcauuc

SEQ ID NO: 200499 - RNA, 22 nt, Homo sapiens
uaccaguaaugggucaaaggca

SEQ ID NO: 200500 - RNA, 22 nt, Homo sapiens
uaccauguaucugggaugcuuu

SEQ ID NO: 200501 - RNA, 22 nt, Homo sapiens
uaccucuguaaguaaagauuca

SEQ ID NO: 200502 - RNA, 22 nt, Homo sapiens
uaccugagcccucugcugaguu

SEQ ID NO: 200503 - RNA, 22 nt, Homo sapiens
uaccuguagacuacagcuucag

SEQ ID NO: 200504 - RNA, 22 nt, Homo sapiens
uacugcacuccacccuggguga

SEQ ID NO: 200505 - RNA, 22 nt, Homo sapiens
uacugcacuccagccuggguga

SEQ ID NO: 200506 - RNA, 20 nt, Homo sapiens
uacugcacuccauccugggu

SEQ ID NO: 200507 - RNA, 22 nt, Homo sapiens
uacugcaucgaaaugcuuuuau

SEQ ID NO: 200508 - RNA, 21 nt, Homo sapiens
uacuggagauacagucugcaa

SEQ ID NO: 200509 - RNA, 22 nt, Homo sapiens
uacuuuguagagugugagaauu

SEQ ID NO: 200510 - RNA, 22 nt, Homo sapiens
uacuuuguuauagcagcaggaa

SEQ ID NO: 200511 - RNA, 22 nt, Homo sapiens
uagaaagcaugaccuucagaua

SEQ ID NO: 200512 - RNA, 22 nt, Homo sapiens
uagaacauuccaggugauguug

SEQ ID NO: 200513 - RNA, 22 nt, Homo sapiens
uagaagcugagaauguccucag

SEQ ID NO: 200514 - RNA, 22 nt, Homo sapiens
uagaaguaggcuacgugucugg

SEQ ID NO: 200515 - RNA, 22 nt, Homo sapiens
uagacacuagauaugugacuga

SEQ ID NO: 200516 - RNA, 20 nt, Homo sapiens
uagagagauauggggguucc

SEQ ID NO: 200517 - RNA, 22 nt, Homo sapiens
uagagguagccuacuacacacc

SEQ ID NO: 200518 - RNA, 22 nt, Homo sapiens
aaguauuagcuaauugugcuua

SEQ ID NO: 200519 - RNA, 22 nt, Homo sapiens
aagucaaggagagaagcuucag

SEQ ID NO: 200520 - RNA, 22 nt, Homo sapiens
aagucaugaagaggaaaggaca

SEQ ID NO: 200521 - RNA, 23 nt, Homo sapiens
aagucauggaaucaaaugaggug

SEQ ID NO: 200522 - RNA, 20 nt, Homo sapiens
aagugaguguuaaacugaac

SEQ ID NO: 200523 - RNA, 22 nt, Homo sapiens
aagugcucuugugggaagagag

SEQ ID NO: 200524 - RNA, 22 nt, Homo sapiens
aagugcuuacagggaacaugau

SEQ ID NO: 200525 - RNA, 22 nt, Homo sapiens
aagugcuuccuuucagaggguu

SEQ ID NO: 200526 - RNA, 22 nt, Homo sapiens
aagugcuuuguacagggguuga

SEQ ID NO: 200527 - RNA, 22 nt, Homo sapiens
aaguggcauugaggaaaaaaau

SEQ ID NO: 200528 - RNA, 17 nt, Homo sapiens
aaguggcuuguucacca

SEQ ID NO: 200529 - RNA, 23 nt, Homo sapiens
aaguucaugcucaucuguuacac

SEQ ID NO: 200530 - RNA, 22 nt, Homo sapiens
aauaaagcagcuuuuugggacu

SEQ ID NO: 200531 - RNA, 22 nt, Homo sapiens
aauaaagcuuugagcuuugcug

SEQ ID NO: 200532 - RNA, 22 nt, Homo sapiens
aauaagaaguggaagggaccgg

SEQ ID NO: 200533 - RNA, 22 nt, Homo sapiens
aauacugcuuugauguaagcua

SEQ ID NO: 200534 - RNA, 22 nt, Homo sapiens
aauaguggcuuggacuaaauau

SEQ ID NO: 200535 - RNA, 22 nt, Homo sapiens
aauaugguuuuaugaagcaauu

SEQ ID NO: 200536 - RNA, 22 nt, Homo sapiens
aauauguccuugaaauggugcu

SEQ ID NO: 200537 - RNA, 22 nt, Homo sapiens
aauauugucaaaauggauucca

SEQ ID NO: 200538 - RNA, 22 nt, Homo sapiens
aaucacaggucuuggcugcaug

SEQ ID NO: 200539 - RNA, 22 nt, Homo sapiens
aaucaccaugcacuacagccuu

SEQ ID NO: 200540 - RNA, 22 nt, Homo sapiens
aauccauuugccgucuauccau

SEQ ID NO: 200541 - RNA, 22 nt, Homo sapiens
aaucccuuuguccagucucuuu

SEQ ID NO: 200542 - RNA, 22 nt, Homo sapiens
aaucuguagaaggugcacauuc

SEQ ID NO: 200543 - RNA, 22 nt, Homo sapiens
aaucugucuuuuguuauugagg

SEQ ID NO: 200544 - RNA, 22 nt, Homo sapiens
aaugacagccagauucuucucu

SEQ ID NO: 200545 - RNA, 22 nt, Homo sapiens
aaugacagugcuaaagaacccu

SEQ ID NO: 200546 - RNA, 17 nt, Homo sapiens
aaugagacauuucugcu

SEQ ID NO: 200547 - RNA, 22 nt, Homo sapiens
aaugcaagauguuaauuauagg

SEQ ID NO: 200548 - RNA, 22 nt, Homo sapiens
aaugcauaauuuguaugaggua

SEQ ID NO: 200549 - RNA, 22 nt, Homo sapiens
aaugccuagugugugacaggug

SEQ ID NO: 200550 - RNA, 22 nt, Homo sapiens
aaugcuguucuuugcuuaaguu

SEQ ID NO: 200551 - RNA, 22 nt, Homo sapiens
aauggcaagagccacagaggcg

SEQ ID NO: 200552 - RNA, 22 nt, Homo sapiens
aauggcacaagacaugaagaag

SEQ ID NO: 200553 - RNA, 22 nt, Homo sapiens
aauggcacaagaguaaacuguu

SEQ ID NO: 200554 - RNA, 22 nt, Homo sapiens
aauggcuauuucaugugguagg

SEQ ID NO: 200555 - RNA, 22 nt, Homo sapiens
aaugguguuuccguuaagcuga

SEQ ID NO: 200556 - RNA, 22 nt, Homo sapiens
aaugugcacuuggagccuugcu

SEQ ID NO: 200557 - RNA, 22 nt, Homo sapiens
aaugugcuuucuuucacacagu

SEQ ID NO: 200558 - RNA, 22 nt, Homo sapiens
aauuaggcuagaauguuauuaa

SEQ ID NO: 200559 - RNA, 22 nt, Homo sapiens
aauuaguugucgugagaguggu

SEQ ID NO: 200560 - RNA, 22 nt, Homo sapiens
aauucacuucuuuuaggcaggg

SEQ ID NO: 200561 - RNA, 22 nt, Homo sapiens
aauugcacuacugcacucccac

SEQ ID NO: 200562 - RNA, 22 nt, Homo sapiens
aauugcauaugcaguagaucua

SEQ ID NO: 200563 - RNA, 21 nt, Homo sapiens
acaaagcuggagggagacugc

SEQ ID NO: 200564 - RNA, 16 nt, Homo sapiens
acaaagcuggcuaucu

SEQ ID NO: 200565 - RNA, 22 nt, Homo sapiens
acaauguauauuuuacuguagg

SEQ ID NO: 200566 - RNA, 23 nt, Homo sapiens
acacaguaaacuaaaagcuagcu

SEQ ID NO: 200567 - RNA, 22 nt, Homo sapiens
acaccaugucuguuucugguuu

SEQ ID NO: 200568 - RNA, 22 nt, Homo sapiens
acacucuaguguucuuaaucag

SEQ ID NO: 200569 - RNA, 22 nt, Homo sapiens
acacuguccaguuaggcuacau

SEQ ID NO: 200570 - RNA, 22 nt, Homo sapiens
uagcaggaaaccuguguugagg

SEQ ID NO: 200571 - RNA, 22 nt, Homo sapiens
uagcaggaaaggggucagaucu

SEQ ID NO: 200572 - RNA, 20 nt, Homo sapiens
uagcaggugucaggugauau

SEQ ID NO: 200573 - RNA, 22 nt, Homo sapiens
uagcaguauacguacugggucc

SEQ ID NO: 200574 - RNA, 22 nt, Homo sapiens
uagcaguauggagcgaggccca

SEQ ID NO: 200575 - RNA, 22 nt, Homo sapiens
uagcagucaagauagucauuau

SEQ ID NO: 200576 - RNA, 20 nt, Homo sapiens
uagccggguguugugucaug

SEQ ID NO: 200577 - RNA, 22 nt, Homo sapiens
uagccuguggugaauguuucug

SEQ ID NO: 200578 - RNA, 22 nt, Homo sapiens
uagcugcauccugugcacucaa

SEQ ID NO: 200579 - RNA, 22 nt, Homo sapiens
uaggaaguuucuugauuacuua

SEQ ID NO: 200580 - RNA, 22 nt, Homo sapiens
uaggacacagaccuggauggaa

SEQ ID NO: 200581 - RNA, 22 nt, Homo sapiens
uaggcaaaugcaagaguagaac

SEQ ID NO: 200582 - RNA, 22 nt, Homo sapiens
uaggccuuuuuaugucaauauc

SEQ ID NO: 200583 - RNA, 22 nt, Homo sapiens
uaggcuuuuggacccugucucu

SEQ ID NO: 200584 - RNA, 22 nt, Homo sapiens
uagggcuuuaguuugcuugugu

SEQ ID NO: 200585 - RNA, 22 nt, Homo sapiens
uagggcuuuccggccugucaga

SEQ ID NO: 200586 - RNA, 22 nt, Homo sapiens
uagggcuuuuccaagcugccac

SEQ ID NO: 200587 - RNA, 22 nt, Homo sapiens
uagguauguauauacacacaca

SEQ ID NO: 200588 - RNA, 22 nt, Homo sapiens
uaggucccguuucagacugaga

SEQ ID NO: 200589 - RNA, 22 nt, Homo sapiens
uaggugguuugaaauacucaag

SEQ ID NO: 200590 - RNA, 22 nt, Homo sapiens
uagguucuccacagguucucca

SEQ ID NO: 200591 - RNA, 20 nt, Homo sapiens
uagguuuucacagaauugcc

SEQ ID NO: 200592 - RNA, 22 nt, Homo sapiens
uaguaaacaccucagguaauuc

SEQ ID NO: 200593 - RNA, 22 nt, Homo sapiens
uaguaacacauugaacgaucgc

SEQ ID NO: 200594 - RNA, 22 nt, Homo sapiens
uaguaggacaggauuucaguua

SEQ ID NO: 200595 - RNA, 22 nt, Homo sapiens
uagucaaaucugaaggaaauuu

SEQ ID NO: 200596 - RNA, 22 nt, Homo sapiens
uagucccuuucuauuaaugaga

SEQ ID NO: 200597 - RNA, 22 nt, Homo sapiens
uagugaauguuggcuauuaaua

SEQ ID NO: 200598 - RNA, 22 nt, Homo sapiens
uagugacauugcugggaaugcu

SEQ ID NO: 200599 - RNA, 22 nt, Homo sapiens
uagugcugugauuaacauaaug

SEQ ID NO: 200600 - RNA, 18 nt, Homo sapiens
uagugcuguucucaugau

SEQ ID NO: 200601 - RNA, 22 nt, Homo sapiens
uaguuaguagacucugauuauu

SEQ ID NO: 200602 - RNA, 22 nt, Homo sapiens
uaguuauggaguaauuuuaagc

SEQ ID NO: 200603 - RNA, 22 nt, Homo sapiens
uaguucauuuuucuugcuuaga

SEQ ID NO: 200604 - RNA, 22 nt, Homo sapiens
uaguugcaucuuaggucuguga

SEQ ID NO: 200605 - RNA, 22 nt, Homo sapiens
uaguuguugcagguaggaugua

SEQ ID NO: 200606 - RNA, 22 nt, Homo sapiens
aucauacuguuuugauuacugu

SEQ ID NO: 200607 - RNA, 22 nt, Homo sapiens
aucccaguaaaaauggcuucua

SEQ ID NO: 200608 - RNA, 22 nt, Homo sapiens
auccccugcacggggugucauu

SEQ ID NO: 200609 - RNA, 22 nt, Homo sapiens
aucccuguguccagcaccugug

SEQ ID NO: 200610 - RNA, 21 nt, Homo sapiens
auccuucuuuuucaaccugug

SEQ ID NO: 200611 - RNA, 22 nt, Homo sapiens
aucgcugagaaagggacuuuca

SEQ ID NO: 200612 - RNA, 22 nt, Homo sapiens
aucuaaaucucauaugggcaca

SEQ ID NO: 200613 - RNA, 22 nt, Homo sapiens
aucuacagccagucugguuugu

SEQ ID NO: 200614 - RNA, 22 nt, Homo sapiens
aucucauuccuucugggcugau

SEQ ID NO: 200615 - RNA, 20 nt, Homo sapiens
aucucugggcaaaggaaaau

SEQ ID NO: 200616 - RNA, 22 nt, Homo sapiens
aucugauggagagcguguggcu

SEQ ID NO: 200617 - RNA, 22 nt, Homo sapiens
aucugcaaagcugggcugagac

SEQ ID NO: 200618 - RNA, 19 nt, Homo sapiens
aucuggaguuccuggggcu

SEQ ID NO: 200619 - RNA, 22 nt, Homo sapiens
aucugguauuacugcaacugua

SEQ ID NO: 200620 - RNA, 22 nt, Homo sapiens
aucuuugauuagacugauggau

SEQ ID NO: 200621 - RNA, 22 nt, Homo sapiens
aucuuuggucaucacagcuaga

SEQ ID NO: 200622 - RNA, 22 nt, Homo sapiens
aucuuuggugcaugauacuuug

SEQ ID NO: 200623 - RNA, 22 nt, Homo sapiens
augaaaacaugauuugccuguu

SEQ ID NO: 200624 - RNA, 22 nt, Homo sapiens
augaaacuggcuaauuuuugua

SEQ ID NO: 200625 - RNA, 22 nt, Homo sapiens
augaaagguugucuuaagccau

SEQ ID NO: 200626 - RNA, 22 nt, Homo sapiens
augaaaucacugugaugcccua

SEQ ID NO: 200627 - RNA, 22 nt, Homo sapiens
augaaaucuuuccugugaggau

SEQ ID NO: 200628 - RNA, 22 nt, Homo sapiens
augaagagaaaguggaucuugg

SEQ ID NO: 200629 - RNA, 22 nt, Homo sapiens
augaaguauuaggacacauuua

SEQ ID NO: 200630 - RNA, 20 nt, Homo sapiens
augaagugaaguuagggaac

SEQ ID NO: 200631 - RNA, 22 nt, Homo sapiens
augaauacagcuaugcgugcau

SEQ ID NO: 200632 - RNA, 23 nt, Homo sapiens
augaauguaaggaguguaagaaa

SEQ ID NO: 200633 - RNA, 22 nt, Homo sapiens
augaaugucuuauuuugagaaa

SEQ ID NO: 200634 - RNA, 22 nt, Homo sapiens
augacaagagccuucuuuccuu

SEQ ID NO: 200635 - RNA, 22 nt, Homo sapiens
augacagagauaugugaauuuu

SEQ ID NO: 200636 - RNA, 19 nt, Homo sapiens
augaccauggggugguuuu

SEQ ID NO: 200637 - RNA, 22 nt, Homo sapiens
augaccuuguccucagugucau

SEQ ID NO: 200638 - RNA, 22 nt, Homo sapiens
augagauaaaccaucucuuaag

SEQ ID NO: 200639 - RNA, 22 nt, Homo sapiens
augagaugauaggcguucuaac

SEQ ID NO: 200640 - RNA, 17 nt, Homo sapiens
augagcucaucauuuuu

SEQ ID NO: 200641 - RNA, 22 nt, Homo sapiens
augaggaagucaggcccagggg

SEQ ID NO: 200642 - RNA, 22 nt, Homo sapiens
augaggacaucuuccuuaugga

SEQ ID NO: 200643 - RNA, 22 nt, Homo sapiens
augaggugauuucuguucgggu

SEQ ID NO: 200644 - RNA, 22 nt, Homo sapiens
augagucacuuauuauuggggu

SEQ ID NO: 200645 - RNA, 22 nt, Homo sapiens
uauaacacccacauauagucuu

SEQ ID NO: 200646 - RNA, 22 nt, Homo sapiens
uauagcaaugugccacucucug

SEQ ID NO: 200647 - RNA, 22 nt, Homo sapiens
uauauaagcugaugagccacaa

SEQ ID NO: 200648 - RNA, 22 nt, Homo sapiens
uauaugcaacauaguguaugug

SEQ ID NO: 200649 - RNA, 22 nt, Homo sapiens
uauaugcucugggauccugaaa

SEQ ID NO: 200650 - RNA, 22 nt, Homo sapiens
uauauguucuugcacuggaaag

SEQ ID NO: 200651 - RNA, 22 nt, Homo sapiens
uauauguuuucauaaggcuaga

SEQ ID NO: 200652 - RNA, 22 nt, Homo sapiens
uaucacagaggguauccuagag

SEQ ID NO: 200653 - RNA, 22 nt, Homo sapiens
uaucacaggucaggaaccuugu

SEQ ID NO: 200654 - RNA, 21 nt, Homo sapiens
uaucacaguagaauaggaucu

SEQ ID NO: 200655 - RNA, 21 nt, Homo sapiens
uaucacauuggugauuaaguu

SEQ ID NO: 200656 - RNA, 22 nt, Homo sapiens
uaucacugucaggcccucauau

SEQ ID NO: 200657 - RNA, 22 nt, Homo sapiens
uaucacuguuguuuguuuaagg

SEQ ID NO: 200658 - RNA, 21 nt, Homo sapiens
uaucagagacauugagaggca

SEQ ID NO: 200659 - RNA, 22 nt, Homo sapiens
uaucauagacaaucaguuauug

SEQ ID NO: 200660 - RNA, 22 nt, Homo sapiens
uaucauggaaagauguugaaau

SEQ ID NO: 200661 - RNA, 21 nt, Homo sapiens
uauccacuugcaacagagaag

SEQ ID NO: 200662 - RNA, 22 nt, Homo sapiens
uaucccaguggauguaccccau

SEQ ID NO: 200663 - RNA, 22 nt, Homo sapiens
uaucccuuagagcggggugguu

SEQ ID NO: 200664 - RNA, 22 nt, Homo sapiens
uaucucacauauucaguagguu

SEQ ID NO: 200665 - RNA, 22 nt, Homo sapiens
uaucucagaugagacuuguaac

SEQ ID NO: 200666 - RNA, 22 nt, Homo sapiens
uaucucaguguacaggaugaua

SEQ ID NO: 200667 - RNA, 20 nt, Homo sapiens
uaucucaguuuguccuaaac

SEQ ID NO: 200668 - RNA, 22 nt, Homo sapiens
uaucugcacauacacuuauagc

SEQ ID NO: 200669 - RNA, 22 nt, Homo sapiens
uaucugcacuucugucuagguc

SEQ ID NO: 200670 - RNA, 20 nt, Homo sapiens
uaugacaaagccuagugagu

SEQ ID NO: 200671 - RNA, 23 nt, Homo sapiens
uaugacagaggaagggggagcug

SEQ ID NO: 200672 - RNA, 20 nt, Homo sapiens
uaugaccugucuuuucucuc

SEQ ID NO: 200673 - RNA, 22 nt, Homo sapiens
uaugagguagguaugacuauca

SEQ ID NO: 200674 - RNA, 22 nt, Homo sapiens
uaugcacacguguccaugugca

SEQ ID NO: 200675 - RNA, 22 nt, Homo sapiens
uaugcuguuucugauuuaggga

SEQ ID NO: 200676 - RNA, 22 nt, Homo sapiens
uaugcuuauaaacauuugucag

SEQ ID NO: 200677 - RNA, 20 nt, Homo sapiens
uaugguuuuagguauagcau

SEQ ID NO: 200678 - RNA, 22 nt, Homo sapiens
uaugguuuuggaauccugcaga

SEQ ID NO: 200679 - RNA, 22 nt, Homo sapiens
uaugucaugggguuuuugagau

SEQ ID NO: 200680 - RNA, 22 nt, Homo sapiens
uaugucuauuauguagcaggaa

SEQ ID NO: 200681 - RNA, 22 nt, Homo sapiens
uauuacugucaauaucacagaa

SEQ ID NO: 200682 - RNA, 22 nt, Homo sapiens
uauuagugccuaagucuuaggg

SEQ ID NO: 200683 - RNA, 22 nt, Homo sapiens
uauucacaggugugggacaaag

SEQ ID NO: 200684 - RNA, 22 nt, Homo sapiens
uauuccagcccuggugagccag

SEQ ID NO: 200685 - RNA, 22 nt, Homo sapiens
uauugaacuggaucagaaggcc

SEQ ID NO: 200686 - RNA, 22 nt, Homo sapiens
auguggugguagccaggacagg

SEQ ID NO: 200687 - RNA, 22 nt, Homo sapiens
auguguaaagcuuuucuuuguu

SEQ ID NO: 200688 - RNA, 22 nt, Homo sapiens
augugucaaaucuaggccaaag

SEQ ID NO: 200689 - RNA, 22 nt, Homo sapiens
augugugaaucccagaaccugu

SEQ ID NO: 200690 - RNA, 23 nt, Homo sapiens
augugugcuuggagagcaggaug

SEQ ID NO: 200691 - RNA, 22 nt, Homo sapiens
auguuacggaguuuuuauccag

SEQ ID NO: 200692 - RNA, 22 nt, Homo sapiens
auguuagcaucaauauucauca

SEQ ID NO: 200693 - RNA, 22 nt, Homo sapiens
auuaaauguuggacguauacau

SEQ ID NO: 200694 - RNA, 22 nt, Homo sapiens
auuaaggaguggguucauggug

SEQ ID NO: 200695 - RNA, 22 nt, Homo sapiens
auuaagugcuugccagugcugg

SEQ ID NO: 200696 - RNA, 22 nt, Homo sapiens
auuacacuuucuauucaaugag

SEQ ID NO: 200697 - RNA, 22 nt, Homo sapiens
auuaucacaguuuugcauaugg

SEQ ID NO: 200698 - RNA, 22 nt, Homo sapiens
auuauguuguauuuccuugcag

SEQ ID NO: 200699 - RNA, 22 nt, Homo sapiens
auucaaggacuggauugcggga

SEQ ID NO: 200700 - RNA, 22 nt, Homo sapiens
auucaaggagucuucgucccaa

SEQ ID NO: 200701 - RNA, 22 nt, Homo sapiens
auucaagugaugcagcuguuuu

SEQ ID NO: 200702 - RNA, 22 nt, Homo sapiens
auucacuguggcuuucucugau

SEQ ID NO: 200703 - RNA, 22 nt, Homo sapiens
auuccacuuccacuaguuucuc

SEQ ID NO: 200704 - RNA, 21 nt, Homo sapiens
auuccacuuuuccuucaggga

SEQ ID NO: 200705 - RNA, 22 nt, Homo sapiens
auuccaguuugugagaagcugu

SEQ ID NO: 200706 - RNA, 22 nt, Homo sapiens
auuccauaguacagugaugagu

SEQ ID NO: 200707 - RNA, 22 nt, Homo sapiens
auucccuguagaauaaggaugg

SEQ ID NO: 200708 - RNA, 22 nt, Homo sapiens
auucuauaguccuaggauuggg

SEQ ID NO: 200709 - RNA, 22 nt, Homo sapiens
auucuugcuugaacuuggugca

SEQ ID NO: 200710 - RNA, 22 nt, Homo sapiens
auugaacacuucugugugccag

SEQ ID NO: 200711 - RNA, 20 nt, Homo sapiens
auugaacucaguauucugaa

SEQ ID NO: 200712 - RNA, 22 nt, Homo sapiens
auugaacuguuggagagguuuu

SEQ ID NO: 200713 - RNA, 22 nt, Homo sapiens
auugaacuuaaaagacuugcca

SEQ ID NO: 200714 - RNA, 22 nt, Homo sapiens
auugaacuuuugucacugacau

SEQ ID NO: 200715 - RNA, 22 nt, Homo sapiens
auugaauuugguuugcuaagaa

SEQ ID NO: 200716 - RNA, 22 nt, Homo sapiens
ucaaugcaaccuccaccucugg

SEQ ID NO: 200717 - RNA, 18 nt, Homo sapiens
ucaauguggauguucuuu

SEQ ID NO: 200718 - RNA, 22 nt, Homo sapiens
ucacacugaaacuaggguguga

SEQ ID NO: 200719 - RNA, 22 nt, Homo sapiens
ucacacugaauuugaagcaaug

SEQ ID NO: 200720 - RNA, 22 nt, Homo sapiens
ucacacugcaucuguuggaauu

SEQ ID NO: 200721 - RNA, 22 nt, Homo sapiens
ucacaguguuaaaccuuucuuu

SEQ ID NO: 200722 - RNA, 22 nt, Homo sapiens
ucacaucucagguuucuugaca

SEQ ID NO: 200723 - RNA, 22 nt, Homo sapiens
ucacauggaggugauaguugaa

SEQ ID NO: 200724 - RNA, 22 nt, Homo sapiens
ucacaugugacauauauauuug

SEQ ID NO: 200725 - RNA, 22 nt, Homo sapiens
ucacauguguaugagcuuugau

SEQ ID NO: 200726 - RNA, 22 nt, Homo sapiens
ucaccggcagacguggccugau

SEQ ID NO: 200727 - RNA, 22 nt, Homo sapiens
ucacuaggcuggagugcagugg

SEQ ID NO: 200728 - RNA, 22 nt, Homo sapiens
ucacugaaaccuccaccucucg

SEQ ID NO: 200729 - RNA, 22 nt, Homo sapiens
ucacugaaaccuccgccuucug

SEQ ID NO: 200730 - RNA, 22 nt, Homo sapiens
ucacugaaacuguccuggguua

SEQ ID NO: 200731 - RNA, 22 nt, Homo sapiens
ucacugagaaugauguuucuga

SEQ ID NO: 200732 - RNA, 22 nt, Homo sapiens
ucacugagcacaggagaugugc

SEQ ID NO: 200733 - RNA, 22 nt, Homo sapiens
ucacugcgaccuccgccucccg

SEQ ID NO: 200734 - RNA, 22 nt, Homo sapiens
ucacugugcacauaugauaggu

SEQ ID NO: 200735 - RNA, 22 nt, Homo sapiens
ucacuuugacggccaacuucua

SEQ ID NO: 200736 - RNA, 22 nt, Homo sapiens
ucacuuuguuuuuggauaaguu

SEQ ID NO: 200737 - RNA, 22 nt, Homo sapiens
ucagaauguaacuuuaguugga

SEQ ID NO: 200738 - RNA, 22 nt, Homo sapiens
ucagaccauuucauuacagacu

SEQ ID NO: 200739 - RNA, 22 nt, Homo sapiens
ucagaguagaaacacuuccaua

SEQ ID NO: 200740 - RNA, 22 nt, Homo sapiens
ucagaguggagucugcagccuu

SEQ ID NO: 200741 - RNA, 22 nt, Homo sapiens
ucagaucaguuccacaagaacu

SEQ ID NO: 200742 - RNA, 22 nt, Homo sapiens
ucagauguuuuguuuaucugcu

SEQ ID NO: 200743 - RNA, 22 nt, Homo sapiens
ucagcagugugaaaacaaacua

SEQ ID NO: 200744 - RNA, 22 nt, Homo sapiens
ucaggcacucagcuuagagucu

SEQ ID NO: 200745 - RNA, 21 nt, Homo sapiens
ucaggcuuuuugagugccaau

SEQ ID NO: 200746 - RNA, 22 nt, Homo sapiens
ucagguagugccaugauugauu

SEQ ID NO: 200747 - RNA, 22 nt, Homo sapiens
ucagguaucucuauagcaaugu

SEQ ID NO: 200748 - RNA, 22 nt, Homo sapiens
ucaggucauuccaggagggcca

SEQ ID NO: 200749 - RNA, 22 nt, Homo sapiens
ucaggugcagagaagaaauggg

SEQ ID NO: 200750 - RNA, 22 nt, Homo sapiens
ucagguugcuaaguauaauauu

SEQ ID NO: 200751 - RNA, 22 nt, Homo sapiens
ucaguaaauguuaggacauuuc

SEQ ID NO: 200752 - RNA, 22 nt, Homo sapiens
ucagucauugauggaguagguc

SEQ ID NO: 200753 - RNA, 22 nt, Homo sapiens
ucagugauugcuuucauggaaa

SEQ ID NO: 200754 - RNA, 20 nt, Homo sapiens
ucagugauugguuuaguuau

SEQ ID NO: 200755 - RNA, 22 nt, Homo sapiens
ucagugcaggaaucucuagcca

SEQ ID NO: 200756 - RNA, 22 nt, Homo sapiens
ucaguucauggaggugucugcu

SEQ ID NO: 200757 - RNA, 22 nt, Homo sapiens
ucaguuuguauuucagguugca

SEQ ID NO: 200758 - RNA, 22 nt, Homo sapiens
ucauagaucaaguaauaagaca

SEQ ID NO: 200759 - RNA, 22 nt, Homo sapiens
ucauaguacuuuguuuugaaaa

SEQ ID NO: 200760 - RNA, 22 nt, Homo sapiens
ucauaguagucacuuaauaaau

SEQ ID NO: 200761 - RNA, 22 nt, Homo sapiens
gugcaaugagaaggggcucugg

SEQ ID NO: 200762 - RNA, 22 nt, Homo sapiens
gugcacaaaucuuaaauguaca

SEQ ID NO: 200763 - RNA, 22 nt, Homo sapiens
gugcacaacaugcaguuuuguu

SEQ ID NO: 200764 - RNA, 22 nt, Homo sapiens
gugcacaacgugcaaguuuguu

SEQ ID NO: 200765 - RNA, 21 nt, Homo sapiens
gugcacaguaguguuuaauag

SEQ ID NO: 200766 - RNA, 22 nt, Homo sapiens
gugcacauauggugcauaagug

SEQ ID NO: 200767 - RNA, 22 nt, Homo sapiens
gugcacauuguuuaugucuguu

SEQ ID NO: 200768 - RNA, 22 nt, Homo sapiens
gugcacuguagaacccuuuguu

SEQ ID NO: 200769 - RNA, 23 nt, Homo sapiens
gugcaguggcgagauuucggcuc

SEQ ID NO: 200770 - RNA, 22 nt, Homo sapiens
gugcauacgucuuuauaguagc

SEQ ID NO: 200771 - RNA, 22 nt, Homo sapiens
gugcauguccacuaguccauau

SEQ ID NO: 200772 - RNA, 22 nt, Homo sapiens
gugccacugcaccuggccuaag

SEQ ID NO: 200773 - RNA, 23 nt, Homo sapiens
gugccuucugagccuagucucca

SEQ ID NO: 200774 - RNA, 22 nt, Homo sapiens
guggaaagaacacaaaauuagg

SEQ ID NO: 200775 - RNA, 21 nt, Homo sapiens
guggaaauggaauuuacuaau

SEQ ID NO: 200776 - RNA, 22 nt, Homo sapiens
guggaaugaaaacucucucaca

SEQ ID NO: 200777 - RNA, 22 nt, Homo sapiens
guggcagaacagguaggguucu

SEQ ID NO: 200778 - RNA, 22 nt, Homo sapiens
guggcaugaaagcagauaccac

SEQ ID NO: 200779 - RNA, 22 nt, Homo sapiens
guggcauuucccaaaguauucu

SEQ ID NO: 200780 - RNA, 23 nt, Homo sapiens
guggccuuuggccaguccgaguc

SEQ ID NO: 200781 - RNA, 22 nt, Homo sapiens
guggcuauucaccuuuaugaaa

SEQ ID NO: 200782 - RNA, 22 nt, Homo sapiens
guggcuauuguucccugguugc

SEQ ID NO: 200783 - RNA, 22 nt, Homo sapiens
gugguuuuuuucugccuuauag

SEQ ID NO: 200784 - RNA, 22 nt, Homo sapiens
guguaaguccugaguuuggaua

SEQ ID NO: 200785 - RNA, 22 nt, Homo sapiens
guguaauacacacauauaugca

SEQ ID NO: 200786 - RNA, 22 nt, Homo sapiens
guguagagaaauagccugaagg

SEQ ID NO: 200787 - RNA, 22 nt, Homo sapiens
gugucacuguauaauauuuauu

SEQ ID NO: 200788 - RNA, 22 nt, Homo sapiens
gugucacuguugagaaguccac

SEQ ID NO: 200789 - RNA, 22 nt, Homo sapiens
gugucaguggggagugaucuuc

SEQ ID NO: 200790 - RNA, 22 nt, Homo sapiens
gugugacagcuauagacaugau

SEQ ID NO: 200791 - RNA, 22 nt, Homo sapiens
gugugacugcucuauuagggcg

SEQ ID NO: 200792 - RNA, 22 nt, Homo sapiens
gugugcacaaucuggcaugugc

SEQ ID NO: 200793 - RNA, 22 nt, Homo sapiens
gugugcauggagggggcaguga

SEQ ID NO: 200794 - RNA, 22 nt, Homo sapiens
guguggaacucaauacaacgca

SEQ ID NO: 200795 - RNA, 22 nt, Homo sapiens
gugugguaggauugguuacuca

SEQ ID NO: 200796 - RNA, 22 nt, Homo sapiens
guuagcuaguagacaauuuucc

SEQ ID NO: 200797 - RNA, 22 nt, Homo sapiens
guuauggaguauaugugaacug

SEQ ID NO: 200798 - RNA, 22 nt, Homo sapiens
guuauguuauguuauguuaugu

SEQ ID NO: 200799 - RNA, 22 nt, Homo sapiens
guucaaggaauguuggcuucuc

SEQ ID NO: 200800 - RNA, 22 nt, Homo sapiens
guucaagugauagcugggauua

SEQ ID NO: 200801 - RNA, 22 nt, Homo sapiens
guucacaguuucuaaucccagc

SEQ ID NO: 200802 - RNA, 17 nt, Homo sapiens
guucccaguggcauuug

SEQ ID NO: 200803 - RNA, 20 nt, Homo sapiens
guucuugcucguguaucuuc

SEQ ID NO: 200804 - RNA, 22 nt, Homo sapiens
guugaggcaggagaauuacuug

SEQ ID NO: 200805 - RNA, 22 nt, Homo sapiens
guugcaaaguaauugugguuuu

SEQ ID NO: 200806 - RNA, 22 nt, Homo sapiens
guugcucaggcuggagugcagu

SEQ ID NO: 200807 - RNA, 22 nt, Homo sapiens
guuuugguuauauggaucaguu

SEQ ID NO: 200808 - RNA, 22 nt, Homo sapiens
guuuuuggggucacuauuaccg

SEQ ID NO: 200809 - RNA, 22 nt, Homo sapiens
uaaacacucacuucauagccau

SEQ ID NO: 200810 - RNA, 22 nt, Homo sapiens
uaaagcacaaguaaagaauacu

SEQ ID NO: 200811 - RNA, 22 nt, Homo sapiens
uaaagcacuuuuuucugcaugg

SEQ ID NO: 200812 - RNA, 22 nt, Homo sapiens
uaaagcuaucacauuggugauu

SEQ ID NO: 200813 - RNA, 22 nt, Homo sapiens
uaaagcuaugagaacaccguag

SEQ ID NO: 200814 - RNA, 22 nt, Homo sapiens
uaaagugcugagaugaggcugg

SEQ ID NO: 200815 - RNA, 22 nt, Homo sapiens
uaaaugacugucaguagaugaa

SEQ ID NO: 200816 - RNA, 22 nt, Homo sapiens
uaaauggauaaaugaauaccua

SEQ ID NO: 200817 - RNA, 22 nt, Homo sapiens
uaacaccuugcucugucaauaa

SEQ ID NO: 200818 - RNA, 22 nt, Homo sapiens
uaacaggcaaggucacaccuug

SEQ ID NO: 200819 - RNA, 22 nt, Homo sapiens
uaacaguauaugugguaucuau

SEQ ID NO: 200820 - RNA, 22 nt, Homo sapiens
uaacauucacaugcugcaaaaa

SEQ ID NO: 200821 - RNA, 22 nt, Homo sapiens
uaacauugucuugcuuaguuuu

SEQ ID NO: 200822 - RNA, 22 nt, Homo sapiens
uaacugcaaccucugccugcug

SEQ ID NO: 200823 - RNA, 22 nt, Homo sapiens
uaacugucucccuugguccuga

SEQ ID NO: 200824 - RNA, 22 nt, Homo sapiens
uaagacacauguguucccaggc

SEQ ID NO: 200825 - RNA, 19 nt, Homo sapiens
uaagaugaagcugucuggg

SEQ ID NO: 200826 - RNA, 22 nt, Homo sapiens
uaagcagugcaagaauggaaua

SEQ ID NO: 200827 - RNA, 22 nt, Homo sapiens
uaagcuagcauagggguaaauu

SEQ ID NO: 200828 - RNA, 22 nt, Homo sapiens
uaaggaaggcugugugcuuuua

SEQ ID NO: 200829 - RNA, 22 nt, Homo sapiens
uaagggcaugcugcaugagagu

SEQ ID NO: 200830 - RNA, 22 nt, Homo sapiens
uaagguuuuugauaugcugcug

SEQ ID NO: 200831 - RNA, 22 nt, Homo sapiens
uaaguaauuguuaauagggaag

SEQ ID NO: 200832 - RNA, 22 nt, Homo sapiens
uaaguaauuuguauuuuaccca

SEQ ID NO: 200833 - RNA, 22 nt, Homo sapiens
uaaguaguauaagguuuuuuga

SEQ ID NO: 200834 - RNA, 22 nt, Homo sapiens
uugagauggagucucgcugugu

SEQ ID NO: 200835 - RNA, 22 nt, Homo sapiens
uugagauggagucuugcacugu

SEQ ID NO: 200836 - RNA, 22 nt, Homo sapiens
uugguccccacuccccugccaa

SEQ ID NO: 200837 - RNA, 22 nt, Homo sapiens
uuggucucuuaaucacacuuuu

SEQ ID NO: 200838 - RNA, 22 nt, Homo sapiens
uuggucugcucugauguuuucu

SEQ ID NO: 200839 - RNA, 22 nt, Homo sapiens
uuggucuucuaauguaccuguu

SEQ ID NO: 200840 - RNA, 22 nt, Homo sapiens
uugguuaccuucagaaaugagu

SEQ ID NO: 200841 - RNA, 22 nt, Homo sapiens
uugguucucuuuauaugcugga

SEQ ID NO: 200842 - RNA, 22 nt, Homo sapiens
uuguaaagaucauaugcuguuc

SEQ ID NO: 200843 - RNA, 22 nt, Homo sapiens
uaggugauugaagguggaaugu

SEQ ID NO: 200844 - RNA, 22 nt, Homo sapiens
uaguagugucccugacuaucac

SEQ ID NO: 200845 - RNA, 22 nt, Homo sapiens
uagucccauaugauuuagugaa

SEQ ID NO: 200846 - RNA, 22 nt, Homo sapiens
uagugcugagauugagaagccc

SEQ ID NO: 200847 - RNA, 22 nt, Homo sapiens
uagugcugugauaaacauauau

SEQ ID NO: 200848 - RNA, 22 nt, Homo sapiens
uagugcugugauauuuuuggcc

SEQ ID NO: 200849 - RNA, 22 nt, Homo sapiens
uaguguuuuucauuggcagagg

SEQ ID NO: 200850 - RNA, 23 nt, Homo sapiens
uauaacuuuuaauuuacuggccu

SEQ ID NO: 200851 - RNA, 22 nt, Homo sapiens
uauacugucuuuguaugccuag

SEQ ID NO: 200852 - RNA, 22 nt, Homo sapiens
uauagcaaugccccacuccuga

SEQ ID NO: 200853 - RNA, 20 nt, Homo sapiens
uauagcaauuuuuuucuccu

SEQ ID NO: 200854 - RNA, 22 nt, Homo sapiens
uauagcuuaaaguuuagauccu

SEQ ID NO: 200855 - RNA, 21 nt, Homo sapiens
uauaugacuuacuauugccuc

SEQ ID NO: 200856 - RNA, 22 nt, Homo sapiens
uauaugauugguagacccugca

SEQ ID NO: 200857 - RNA, 23 nt, Homo sapiens
uauaugugucuaggagcuauggu

SEQ ID NO: 200858 - RNA, 22 nt, Homo sapiens
uaucaacaggguggccagugua

SEQ ID NO: 200859 - RNA, 22 nt, Homo sapiens
uaucaagaugacaaacuuugcu

SEQ ID NO: 200860 - RNA, 22 nt, Homo sapiens
uaucaaguguuagggagaugug

SEQ ID NO: 200861 - RNA, 22 nt, Homo sapiens
uaucacaguugcauauuuaagg

SEQ ID NO: 200862 - RNA, 22 nt, Homo sapiens
uaucaccuugguagucuugggg

SEQ ID NO: 200863 - RNA, 19 nt, Homo sapiens
uaucacuucccuggaaaca

SEQ ID NO: 200864 - RNA, 22 nt, Homo sapiens
uaucacuuugauaguuuaaaug

SEQ ID NO: 200865 - RNA, 22 nt, Homo sapiens
uaucaucauuggcaggugagaa

SEQ ID NO: 200866 - RNA, 21 nt, Homo sapiens
uaucccagucacaucuaccca

SEQ ID NO: 200867 - RNA, 23 nt, Homo sapiens
uaucucaaugcacagagaggaaa

SEQ ID NO: 200868 - RNA, 22 nt, Homo sapiens
uaucucagagaaucagauuuac

SEQ ID NO: 200869 - RNA, 22 nt, Homo sapiens
uaugaaucugagagaucuggaa

SEQ ID NO: 200870 - RNA, 22 nt, Homo sapiens
uaugaaucuggcuacuccaggg

SEQ ID NO: 200871 - RNA, 22 nt, Homo sapiens
uaugcacacacguguuuaugug

SEQ ID NO: 200872 - RNA, 23 nt, Homo sapiens
uaugccuguuucaaacaaacuuu

SEQ ID NO: 200873 - RNA, 22 nt, Homo sapiens
uaugccuuucucacuaagcuua

SEQ ID NO: 200874 - RNA, 22 nt, Homo sapiens
uauggaaaucuuaccuuauggu

SEQ ID NO: 200875 - RNA, 22 nt, Homo sapiens
uauggcauuauuuugauagaca

SEQ ID NO: 200876 - RNA, 22 nt, Homo sapiens
uaugggucuuaaaucacuuagu

SEQ ID NO: 200877 - RNA, 21 nt, Homo sapiens
uaugguuucuaauucugcagg

SEQ ID NO: 200878 - RNA, 22 nt, Homo sapiens
uaugugcaaauuaauugcuaga

SEQ ID NO: 200879 - RNA, 22 nt, Homo sapiens
uauucacuguaucauugauggg

SEQ ID NO: 200880 - RNA, 22 nt, Homo sapiens
uauuccacaauaugauuuuuaa

SEQ ID NO: 200881 - RNA, 22 nt, Homo sapiens
uauuccacucuguuggagguaa

SEQ ID NO: 200882 - RNA, 22 nt, Homo sapiens
uauuccauuugggucaggauga

SEQ ID NO: 200883 - RNA, 22 nt, Homo sapiens
uauuccauuugugaaaggaagu

SEQ ID NO: 200884 - RNA, 18 nt, Homo sapiens
uauuccucuuccucuauc

SEQ ID NO: 200885 - RNA, 22 nt, Homo sapiens
uauuccuuuugcauuuccacau

SEQ ID NO: 200886 - RNA, 22 nt, Homo sapiens
uauugcacaugaggagacauug

SEQ ID NO: 200887 - RNA, 22 nt, Homo sapiens
uauugcacgccagccugagcaa

SEQ ID NO: 200888 - RNA, 20 nt, Homo sapiens
uauugcacuccagucugggc

SEQ ID NO: 200889 - RNA, 22 nt, Homo sapiens
uauugcagauacccaggaaguu

SEQ ID NO: 200890 - RNA, 22 nt, Homo sapiens
uauugcucaugcauuuaauuuc

SEQ ID NO: 200891 - RNA, 22 nt, Homo sapiens
uauugcugaaaaugcuaaugau

SEQ ID NO: 200892 - RNA, 22 nt, Homo sapiens
uauugcuggcucugucuucauu

SEQ ID NO: 200893 - RNA, 22 nt, Homo sapiens
uauugcuuuacucucuuauccu

SEQ ID NO: 200894 - RNA, 22 nt, Homo sapiens
uauuguacauguuauagauuuu

SEQ ID NO: 200895 - RNA, 22 nt, Homo sapiens
uauuucaguugcguuucccgag

SEQ ID NO: 200896 - RNA, 22 nt, Homo sapiens
uauuucaguugugcagguaguu

SEQ ID NO: 200897 - RNA, 22 nt, Homo sapiens
uauuugauugacuuuagcagga

SEQ ID NO: 200898 - RNA, 22 nt, Homo sapiens
uauuuggauagucuggaaaaaa

SEQ ID NO: 200899 - RNA, 22 nt, Homo sapiens
ucaaaaccucagagaguagagc

SEQ ID NO: 200900 - RNA, 22 nt, Homo sapiens
ucaaaaucucuuagcugugucu

SEQ ID NO: 200901 - RNA, 20 nt, Homo sapiens
ucaaagacauggcugucaga

SEQ ID NO: 200902 - RNA, 22 nt, Homo sapiens
ucaaagugagcuccuucucacu

SEQ ID NO: 200903 - RNA, 22 nt, Homo sapiens
ucaaagugcuauggcucagguu

SEQ ID NO: 200904 - RNA, 18 nt, Homo sapiens
ucaaauacuuugggcagu

SEQ ID NO: 200905 - RNA, 22 nt, Homo sapiens
ucaaaucaucuuuuccaaagcu

SEQ ID NO: 200906 - RNA, 22 nt, Homo sapiens
ucaacaggucaauugcauagaa

SEQ ID NO: 200907 - RNA, 22 nt, Homo sapiens
uuugguuauauauauacacucu

SEQ ID NO: 200908 - RNA, 22 nt, Homo sapiens
uuugguuauuugaaacuagcau

SEQ ID NO: 200909 - RNA, 22 nt, Homo sapiens
uuuguacuaugguuuuucacua

SEQ ID NO: 200910 - RNA, 22 nt, Homo sapiens
uuuguacuucauugguucuacu

SEQ ID NO: 200911 - RNA, 22 nt, Homo sapiens
uuuguagcuacaaagugagaug

SEQ ID NO: 200912 - RNA, 19 nt, Homo sapiens
uuuguauguuuccaguaau

SEQ ID NO: 200913 - RNA, 19 nt, Homo sapiens
uuuguccugcccuuucuca

SEQ ID NO: 200914 - RNA, 23 nt, Homo sapiens
uuugugacacucuccaucuccag

SEQ ID NO: 200915 - RNA, 22 nt, Homo sapiens
uuugugcuaaugcuagauuacu

SEQ ID NO: 200916 - RNA, 22 nt, Homo sapiens
uuuguggaaugcccuuauuuau

SEQ ID NO: 200917 - RNA, 23 nt, Homo sapiens
uuuguguccccacccaaaucuca

SEQ ID NO: 200918 - RNA, 22 nt, Homo sapiens
ugucaugaacucacauucuggg

SEQ ID NO: 200919 - RNA, 22 nt, Homo sapiens
ugucaugucaacuauggaauuu

SEQ ID NO: 200920 - RNA, 22 nt, Homo sapiens
ugucaugucuuuguguaucaau

SEQ ID NO: 200921 - RNA, 22 nt, Homo sapiens
ugucaugugagggaacuuguuc

SEQ ID NO: 200922 - RNA, 22 nt, Homo sapiens
ugucauucaggaaauucuaagu

SEQ ID NO: 200923 - RNA, 21 nt, Homo sapiens
uguccagcuuuuggaauauaa

SEQ ID NO: 200924 - RNA, 22 nt, Homo sapiens
uguccauuuuuaugcuuauggu

SEQ ID NO: 200925 - RNA, 19 nt, Homo sapiens
ugucccagccauagaggca

SEQ ID NO: 200926 - RNA, 22 nt, Homo sapiens
ugucccugagccuggauuccug

SEQ ID NO: 200927 - RNA, 22 nt, Homo sapiens
uguccuguaggaggcagaacaa

SEQ ID NO: 200928 - RNA, 22 nt, Homo sapiens
ugucucaguucccuucucugga

SEQ ID NO: 200929 - RNA, 21 nt, Homo sapiens
ugucuuggagccagacgccag

SEQ ID NO: 200930 - RNA, 22 nt, Homo sapiens
ugucuuggaugaggauuaacag

SEQ ID NO: 200931 - RNA, 22 nt, Homo sapiens
ugugaaaucagauagccuuuuu

SEQ ID NO: 200932 - RNA, 22 nt, Homo sapiens
ugugaacagaauuagucaccua

SEQ ID NO: 200933 - RNA, 20 nt, Homo sapiens
ugugaacuguagauagucuu

SEQ ID NO: 200934 - RNA, 22 nt, Homo sapiens
ugugacuaguggugaaugacgc

SEQ ID NO: 200935 - RNA, 22 nt, Homo sapiens
ugugacugguugucccacuuuc

SEQ ID NO: 200936 - RNA, 22 nt, Homo sapiens
ugugagaaaugcagaaucucag

SEQ ID NO: 200937 - RNA, 19 nt, Homo sapiens
ugugagcauuagcauuuag

SEQ ID NO: 200938 - RNA, 22 nt, Homo sapiens
ugugagcuauggaguuguagag

SEQ ID NO: 200939 - RNA, 22 nt, Homo sapiens
ugugaucaugugugccuuaguc

SEQ ID NO: 200940 - RNA, 22 nt, Homo sapiens
ugugaugguuuggaagcuucuu

SEQ ID NO: 200941 - RNA, 22 nt, Homo sapiens
ugugcacaaccugcagguuugu

SEQ ID NO: 200942 - RNA, 22 nt, Homo sapiens
ugugcacaaugugcagguuuga

SEQ ID NO: 200943 - RNA, 22 nt, Homo sapiens
ugugcacaaugugcagguuugu

SEQ ID NO: 200944 - RNA, 22 nt, Homo sapiens
ugugcacauugugcagguugau

SEQ ID NO: 200945 - RNA, 23 nt, Homo sapiens
ugugcacauuuacauauauacac

SEQ ID NO: 200946 - RNA, 22 nt, Homo sapiens
ugugcaguuuugagugaauuuc

SEQ ID NO: 200947 - RNA, 22 nt, Homo sapiens
ugugcauagugugugcggggcg

SEQ ID NO: 200948 - RNA, 22 nt, Homo sapiens
ugugccuacugauagagccaag

SEQ ID NO: 200949 - RNA, 22 nt, Homo sapiens
ugugcgcaucggggccugcuuc

SEQ ID NO: 200950 - RNA, 22 nt, Homo sapiens
uuauacucgucugaaugauucu

SEQ ID NO: 200951 - RNA, 22 nt, Homo sapiens
uuauauguuacucccucuagca

SEQ ID NO: 200952 - RNA, 22 nt, Homo sapiens
uuauauguuucuguuuggaggc

SEQ ID NO: 200953 - RNA, 22 nt, Homo sapiens
uuaucaaacccuaggagguggu

SEQ ID NO: 200954 - RNA, 21 nt, Homo sapiens
uuaucccagugucucugcagg

SEQ ID NO: 200955 - RNA, 22 nt, Homo sapiens
uuaugcuguuuucuggagauuu

SEQ ID NO: 200956 - RNA, 22 nt, Homo sapiens
uuauggcuauugaugacaauug

SEQ ID NO: 200957 - RNA, 22 nt, Homo sapiens
uuauggcuuugcgguguuagca

SEQ ID NO: 200958 - RNA, 23 nt, Homo sapiens
uuauggcuuuuauuauguugagg

SEQ ID NO: 200959 - RNA, 22 nt, Homo sapiens
uuauuagagauauuugguuagg

SEQ ID NO: 200960 - RNA, 17 nt, Homo sapiens
uuauugcuauaagcuga

SEQ ID NO: 200961 - RNA, 22 nt, Homo sapiens
uuauuugguugcugacuuggaa

SEQ ID NO: 200962 - RNA, 22 nt, Homo sapiens
uucaaaaccucugcuuaagccc

SEQ ID NO: 200963 - RNA, 22 nt, Homo sapiens
uucaaaguuggaggacaaacug

SEQ ID NO: 200964 - RNA, 22 nt, Homo sapiens
uucaaaucuuuggcucccacua

SEQ ID NO: 200965 - RNA, 23 nt, Homo sapiens
uucaaauguucucugguugucag

SEQ ID NO: 200966 - RNA, 22 nt, Homo sapiens
uucaacugcuucagccucccaa

SEQ ID NO: 200967 - RNA, 22 nt, Homo sapiens
uucaagauggcaccagugagug

SEQ ID NO: 200968 - RNA, 22 nt, Homo sapiens
uucaagugaacaaaaugaggag

SEQ ID NO: 200969 - RNA, 22 nt, Homo sapiens
uucaauaugucauuggcaggca

SEQ ID NO: 200970 - RNA, 22 nt, Homo sapiens
uucaauuaauauuauacucuca

SEQ ID NO: 200971 - RNA, 22 nt, Homo sapiens
uucacagucacccuucuccaug

SEQ ID NO: 200972 - RNA, 22 nt, Homo sapiens
uucacaguguguacaccagggg

SEQ ID NO: 200973 - RNA, 20 nt, Homo sapiens
uucacugggcucucuguugg

SEQ ID NO: 200974 - RNA, 22 nt, Homo sapiens
uucacuguuaagcaguuaaacu

SEQ ID NO: 200975 - RNA, 22 nt, Homo sapiens
uucagagagggagggauaccua

SEQ ID NO: 200976 - RNA, 20 nt, Homo sapiens
uucagcaaaggaaugggagu

SEQ ID NO: 200977 - RNA, 22 nt, Homo sapiens
uucaggcaccauggucauugau

SEQ ID NO: 200978 - RNA, 22 nt, Homo sapiens
uucaggcaccauugucauugau

SEQ ID NO: 200979 - RNA, 22 nt, Homo sapiens
uucaggcuuuuauuuacugaua

SEQ ID NO: 200980 - RNA, 22 nt, Homo sapiens
uucagggacuuuagacaagaga

SEQ ID NO: 200981 - RNA, 22 nt, Homo sapiens
uucagggagaaggcaaacguug

SEQ ID NO: 200982 - RNA, 22 nt, Homo sapiens
uucagggcauuggaguuucuga

SEQ ID NO: 200983 - RNA, 22 nt, Homo sapiens
uucaguauugcaccuggagucc

SEQ ID NO: 200984 - RNA, 22 nt, Homo sapiens
uucagugagacgaaaacaacaa

SEQ ID NO: 200985 - RNA, 22 nt, Homo sapiens
uugagauggauagacauagcau

SEQ ID NO: 200986 - RNA, 19 nt, Homo sapiens
uugagaugugaacucacac

SEQ ID NO: 200987 - RNA, 21 nt, Homo sapiens
uugagcaacuaggguuauagg

SEQ ID NO: 200988 - RNA, 22 nt, Homo sapiens
uugagcaaugucacugaggcuu

SEQ ID NO: 200989 - RNA, 22 nt, Homo sapiens
uugagcacaggaguuugagacc

SEQ ID NO: 200990 - RNA, 22 nt, Homo sapiens
uugagcacaggaguuuugagac

SEQ ID NO: 200991 - RNA, 22 nt, Homo sapiens
uugagcaccaugccuggccaug

SEQ ID NO: 200992 - RNA, 22 nt, Homo sapiens
uugagcuaugaguuaauaggac

SEQ ID NO: 200993 - RNA, 22 nt, Homo sapiens
uugaggaaugugauuucaaaua

SEQ ID NO: 200994 - RNA, 22 nt, Homo sapiens
uugaggacugguugaaagcuuu

SEQ ID NO: 200995 - RNA, 22 nt, Homo sapiens
uugaggaggcagucuucccauu

SEQ ID NO: 200996 - RNA, 22 nt, Homo sapiens
uugaggcaaugaggagaagcug

SEQ ID NO: 200997 - RNA, 22 nt, Homo sapiens
uugagggagcacagauucuuau

SEQ ID NO: 200998 - RNA, 22 nt, Homo sapiens
uugagguaauaaacagccauuc

SEQ ID NO: 200999 - RNA, 22 nt, Homo sapiens
uugagguaguacuuauuauugg

SEQ ID NO: 201000 - RNA, 22 nt, Homo sapiens
uugaggugaagggcagagcagc

SEQ ID NO: 201001 - RNA, 20 nt, Homo sapiens
uugaggugugaggggcagag

SEQ ID NO: 201002 - RNA, 22 nt, Homo sapiens
uugaguaguaaggauauuaucu

SEQ ID NO: 201003 - RNA, 22 nt, Homo sapiens
uugaguuugaguauucuaaagc

SEQ ID NO: 201004 - RNA, 22 nt, Homo sapiens
uugauaugacuaucuuuuaugu

SEQ ID NO: 201005 - RNA, 22 nt, Homo sapiens
uugauauguuguuagauucagu

SEQ ID NO: 201006 - RNA, 22 nt, Homo sapiens
uugaucacuguacuaugacuau

SEQ ID NO: 201007 - RNA, 22 nt, Homo sapiens
uugauccucugagaaucuaucg

SEQ ID NO: 201008 - RNA, 22 nt, Homo sapiens
uugauugacaugucucuguuca

SEQ ID NO: 201009 - RNA, 22 nt, Homo sapiens
uugcaaagaccucuucacuucc

SEQ ID NO: 201010 - RNA, 21 nt, Homo sapiens
uugcaaaugcugcugccugau

SEQ ID NO: 201011 - RNA, 22 nt, Homo sapiens
uugcaaggugcagcuuaugcaa

SEQ ID NO: 201012 - RNA, 22 nt, Homo sapiens
uugcacaguguguacagcacca

SEQ ID NO: 201013 - RNA, 22 nt, Homo sapiens
uugcacauggcaggugcucaau

SEQ ID NO: 201014 - RNA, 22 nt, Homo sapiens
uugcacauugauuuuguauccu

SEQ ID NO: 201015 - RNA, 22 nt, Homo sapiens
uugcacauuuuuucuggcagaa

SEQ ID NO: 201016 - RNA, 22 nt, Homo sapiens
uugcacuguaauuuauuuaugu

SEQ ID NO: 201017 - RNA, 22 nt, Homo sapiens
uugcagagccccugcaaggguc

SEQ ID NO: 201018 - RNA, 22 nt, Homo sapiens
uugcaugcacaguucucaauag

SEQ ID NO: 201019 - RNA, 22 nt, Homo sapiens
uugcauuagugugguacauuug

SEQ ID NO: 201020 - RNA, 20 nt, Homo sapiens
ucaaggcacgaauaaaaguu

SEQ ID NO: 201021 - RNA, 20 nt, Homo sapiens
ucaaggcaggaacuguacau

SEQ ID NO: 201022 - RNA, 22 nt, Homo sapiens
ucaaugaaugaugguugguaug

SEQ ID NO: 201023 - RNA, 22 nt, Homo sapiens
ucacaagugagaggaauuagau

SEQ ID NO: 201024 - RNA, 22 nt, Homo sapiens
ucacacugucuugguuacucuu

SEQ ID NO: 201025 - RNA, 22 nt, Homo sapiens
ucacacuguuuugauuauuaua

SEQ ID NO: 201026 - RNA, 22 nt, Homo sapiens
ucacagaugaggcgagaggcag

SEQ ID NO: 201027 - RNA, 18 nt, Homo sapiens
ucacagguaaaguugaca

SEQ ID NO: 201028 - RNA, 22 nt, Homo sapiens
ucacaguaacuuuguugcuuuu

SEQ ID NO: 201029 - RNA, 20 nt, Homo sapiens
ucacagucacacauaauccu

SEQ ID NO: 201030 - RNA, 22 nt, Homo sapiens
ucacagucacugucacguugaa

SEQ ID NO: 201031 - RNA, 22 nt, Homo sapiens
ucacagugcaggaucaguuaau

SEQ ID NO: 201032 - RNA, 23 nt, Homo sapiens
ucacaguggcugcuuaauuguga

SEQ ID NO: 201033 - RNA, 22 nt, Homo sapiens
ucacauagcauaaugucugcaa

SEQ ID NO: 201034 - RNA, 22 nt, Homo sapiens
ucacauaguuuucgggaccuug

SEQ ID NO: 201035 - RNA, 22 nt, Homo sapiens
ucacaugaauugucuuguucca

SEQ ID NO: 201036 - RNA, 22 nt, Homo sapiens
acucagagagaacugucauuug

SEQ ID NO: 201037 - RNA, 22 nt, Homo sapiens
acucagagugggccccuagaua

SEQ ID NO: 201038 - RNA, 18 nt, Homo sapiens
acugcacuccaccuuggg

SEQ ID NO: 201039 - RNA, 22 nt, Homo sapiens
acugcacuccagccugaugaaa

SEQ ID NO: 201040 - RNA, 22 nt, Homo sapiens
acugcacuccagccugcccaac

SEQ ID NO: 201041 - RNA, 22 nt, Homo sapiens
acugcacuccagccugcugaca

SEQ ID NO: 201042 - RNA, 22 nt, Homo sapiens
acugcacuccagccugugagac

SEQ ID NO: 201043 - RNA, 22 nt, Homo sapiens
acugcacuccagccuuggcaac

SEQ ID NO: 201044 - RNA, 22 nt, Homo sapiens
acugcacuccaguuugggcagc

SEQ ID NO: 201045 - RNA, 22 nt, Homo sapiens
acugcacuccggccuggcaaca

SEQ ID NO: 201046 - RNA, 22 nt, Homo sapiens
acugcacugcagccuggccaac

SEQ ID NO: 201047 - RNA, 22 nt, Homo sapiens
acugcacuucagccuguugaca

SEQ ID NO: 201048 - RNA, 20 nt, Homo sapiens
acugcauuuaguccucagga

SEQ ID NO: 201049 - RNA, 22 nt, Homo sapiens
acugcauuugguaaagucaaga

SEQ ID NO: 201050 - RNA, 22 nt, Homo sapiens
acugcauuugucccuuuugaac

SEQ ID NO: 201051 - RNA, 22 nt, Homo sapiens
acugccuaaugacuuauguuuu

SEQ ID NO: 201052 - RNA, 22 nt, Homo sapiens
acuggacuuaaugaugaauugu

SEQ ID NO: 201053 - RNA, 22 nt, Homo sapiens
acuggaguuuguucaagaaaua

SEQ ID NO: 201054 - RNA, 22 nt, Homo sapiens
acuggcaauggcagaaauaguu

SEQ ID NO: 201055 - RNA, 22 nt, Homo sapiens
acuggcuguuaggaauuaccuc

SEQ ID NO: 201056 - RNA, 22 nt, Homo sapiens
acuggcuuaaggaugggccacu

SEQ ID NO: 201057 - RNA, 22 nt, Homo sapiens
acuguacucuacccugggcaac

SEQ ID NO: 201058 - RNA, 22 nt, Homo sapiens
acuguauagauggaguugauuu

SEQ ID NO: 201059 - RNA, 22 nt, Homo sapiens
acuucauucucuggaucagaau

SEQ ID NO: 201060 - RNA, 22 nt, Homo sapiens
acuuugcuuaucccaggcacug

SEQ ID NO: 201061 - RNA, 22 nt, Homo sapiens
agaaacacagguggaauugcuu

SEQ ID NO: 201062 - RNA, 22 nt, Homo sapiens
agaaaugcagcaugaggcggca

SEQ ID NO: 201063 - RNA, 23 nt, Homo sapiens
agaaaugucuauucagggucccu

SEQ ID NO: 201064 - RNA, 19 nt, Homo sapiens
agaaucuaaauuauuucug

SEQ ID NO: 201065 - RNA, 22 nt, Homo sapiens
agaaugugaacaucuugaaagu

SEQ ID NO: 201066 - RNA, 22 nt, Homo sapiens
agacagcugggaaauggagugu

SEQ ID NO: 201067 - RNA, 22 nt, Homo sapiens
agacuagacagaugaacagcac

SEQ ID NO: 201068 - RNA, 22 nt, Homo sapiens
agagaucaauaugaaggaaaug

SEQ ID NO: 201069 - RNA, 22 nt, Homo sapiens
agagauuauccuggcuucucug

SEQ ID NO: 201070 - RNA, 22 nt, Homo sapiens
acagcagugccccacucuacug

SEQ ID NO: 201071 - RNA, 22 nt, Homo sapiens
acagguacaagggauuaggaug

SEQ ID NO: 201072 - RNA, 20 nt, Homo sapiens
acaguagaagggauuucaaa

SEQ ID NO: 201073 - RNA, 22 nt, Homo sapiens
acaguaugcuuuaaacuuuguu

SEQ ID NO: 201074 - RNA, 22 nt, Homo sapiens
acagugacagaaagcugauuau

SEQ ID NO: 201075 - RNA, 18 nt, Homo sapiens
acagugcuggcaugagau

SEQ ID NO: 201076 - RNA, 22 nt, Homo sapiens
acagugcuuggcacacaguaau

SEQ ID NO: 201077 - RNA, 22 nt, Homo sapiens
acaguguuacuugauaguguau

SEQ ID NO: 201078 - RNA, 22 nt, Homo sapiens
acaucacuguuugauugauuga

SEQ ID NO: 201079 - RNA, 22 nt, Homo sapiens
acauccauuugcuuuauuugcu

SEQ ID NO: 201080 - RNA, 22 nt, Homo sapiens
acaucuguacaguggguguggu

SEQ ID NO: 201081 - RNA, 22 nt, Homo sapiens
acaugcaucauuaggugguuua

SEQ ID NO: 201082 - RNA, 22 nt, Homo sapiens
acauguaauugauuuuguguua

SEQ ID NO: 201083 - RNA, 18 nt, Homo sapiens
acauucagcuugaagaua

SEQ ID NO: 201084 - RNA, 22 nt, Homo sapiens
acauugcagauguguuuaaugu

SEQ ID NO: 201085 - RNA, 22 nt, Homo sapiens
accacagugcuuccugcucacg

SEQ ID NO: 201086 - RNA, 19 nt, Homo sapiens
accagauugcauucuugga

SEQ ID NO: 201087 - RNA, 17 nt, Homo sapiens
accagugcaugugcuuu

SEQ ID NO: 201088 - RNA, 22 nt, Homo sapiens
accaguguuuaccaaguagcau

SEQ ID NO: 201089 - RNA, 22 nt, Homo sapiens
acccagaguuccuugucuuuca

SEQ ID NO: 201090 - RNA, 22 nt, Homo sapiens
acccaguaacauaugggaggga

SEQ ID NO: 201091 - RNA, 22 nt, Homo sapiens
acccaguagccagauguagcug

SEQ ID NO: 201092 - RNA, 22 nt, Homo sapiens
acccauguaggugggauuacag

SEQ ID NO: 201093 - RNA, 22 nt, Homo sapiens
acccgcccagguguggccggga

SEQ ID NO: 201094 - RNA, 22 nt, Homo sapiens
acccuggaguaguaggaaucug

SEQ ID NO: 201095 - RNA, 22 nt, Homo sapiens
uuguauguuuguucuuucagau

SEQ ID NO: 201096 - RNA, 22 nt, Homo sapiens
uugucuugcagcuuaggcauca

SEQ ID NO: 201097 - RNA, 22 nt, Homo sapiens
uugugaauggugcugcaguaaa

SEQ ID NO: 201098 - RNA, 22 nt, Homo sapiens
uugugaucauugucaaauagug

SEQ ID NO: 201099 - RNA, 22 nt, Homo sapiens
uugugcaaaaguaauugcgguu

SEQ ID NO: 201100 - RNA, 21 nt, Homo sapiens
uugugccaaacccuggaggga

SEQ ID NO: 201101 - RNA, 22 nt, Homo sapiens
uugugcuuuugagcugagauga

SEQ ID NO: 201102 - RNA, 19 nt, Homo sapiens
uugugggaggacagagggg

SEQ ID NO: 201103 - RNA, 22 nt, Homo sapiens
uugugguugauacacguaggaa

SEQ ID NO: 201104 - RNA, 22 nt, Homo sapiens
uugugucaaauggcaauuagca

SEQ ID NO: 201105 - RNA, 22 nt, Homo sapiens
uuguuuagagacuggaauuaaa

SEQ ID NO: 201106 - RNA, 22 nt, Homo sapiens
uuguuuuggagaugagcuaaaa

SEQ ID NO: 201107 - RNA, 23 nt, Homo sapiens
uuuaagcuucauguccuaacauc

SEQ ID NO: 201108 - RNA, 22 nt, Homo sapiens
uuuaaggcaugccuguacaugc

SEQ ID NO: 201109 - RNA, 22 nt, Homo sapiens
uuuaaguguuuguuccugaaaa

SEQ ID NO: 201110 - RNA, 22 nt, Homo sapiens
uuuaaugcacuaggugguguuc

SEQ ID NO: 201111 - RNA, 22 nt, Homo sapiens
uuuaaugcaucccaaaauguag

SEQ ID NO: 201112 - RNA, 22 nt, Homo sapiens
uuuaauguuacaguauugguau

SEQ ID NO: 201113 - RNA, 22 nt, Homo sapiens
uuuacagucucauagguggaag

SEQ ID NO: 201114 - RNA, 21 nt, Homo sapiens
uuuacuguggacccauugcuu

SEQ ID NO: 201115 - RNA, 22 nt, Homo sapiens
uuuacugugggguuucuuagag

SEQ ID NO: 201116 - RNA, 22 nt, Homo sapiens
uuuagcagcaaagagccaugcu

SEQ ID NO: 201117 - RNA, 22 nt, Homo sapiens
uuuauguggagcacuugacaca

SEQ ID NO: 201118 - RNA, 22 nt, Homo sapiens
uuucacaguguucucccccaga

SEQ ID NO: 201119 - RNA, 22 nt, Homo sapiens
uuucaccguguuggccaggcug

SEQ ID NO: 201120 - RNA, 23 nt, Homo sapiens
uuucaggcaggugaaagaccagc

SEQ ID NO: 201121 - RNA, 23 nt, Homo sapiens
uuucaguaguuguauccuguugc

SEQ ID NO: 201122 - RNA, 22 nt, Homo sapiens
uuucauagccuuugucgucuga

SEQ ID NO: 201123 - RNA, 22 nt, Homo sapiens
uuuccaguuuggaggaugcauu

SEQ ID NO: 201124 - RNA, 22 nt, Homo sapiens
uuucccagugguacaguuuaua

SEQ ID NO: 201125 - RNA, 22 nt, Homo sapiens
uuucccuuacuuaaacuuacuc

SEQ ID NO: 201126 - RNA, 16 nt, Homo sapiens
uuucccuuugguguuu

SEQ ID NO: 201127 - RNA, 22 nt, Homo sapiens
uuuccuggagaaucuuaacaaa

SEQ ID NO: 201128 - RNA, 22 nt, Homo sapiens
uuucuacagugaacgauuucua

SEQ ID NO: 201129 - RNA, 16 nt, Homo sapiens
uuucuauguuuuacua

SEQ ID NO: 201130 - RNA, 22 nt, Homo sapiens
uuucugagaccaaaacuuguaa

SEQ ID NO: 201131 - RNA, 22 nt, Homo sapiens
uuugaaccauuugaagaaugau

SEQ ID NO: 201132 - RNA, 22 nt, Homo sapiens
uuugaaguguggcacugaguuu

SEQ ID NO: 201133 - RNA, 20 nt, Homo sapiens
uuugaauguaaagcauguca

SEQ ID NO: 201134 - RNA, 22 nt, Homo sapiens
uuugacuacugaugguguacgc

SEQ ID NO: 201135 - RNA, 22 nt, Homo sapiens
uuugacuagaguguuuuacaac

SEQ ID NO: 201136 - RNA, 22 nt, Homo sapiens
uuugagcaagaggugacauuau

SEQ ID NO: 201137 - RNA, 22 nt, Homo sapiens
uuugagcaugcagauugccagg

SEQ ID NO: 201138 - RNA, 22 nt, Homo sapiens
uuugagcauguaguuuaacccu

SEQ ID NO: 201139 - RNA, 22 nt, Homo sapiens
uuugagcuugacucagcuggag

SEQ ID NO: 201140 - RNA, 22 nt, Homo sapiens
uuugaggaaaggcauaaguagg

SEQ ID NO: 201141 - RNA, 22 nt, Homo sapiens
uuugaguaggcuuauauuuugg

SEQ ID NO: 201142 - RNA, 22 nt, Homo sapiens
uuugcacucaguaagugggagc

SEQ ID NO: 201143 - RNA, 22 nt, Homo sapiens
uuugcacuggagauucaauggg

SEQ ID NO: 201144 - RNA, 23 nt, Homo sapiens
uuugcacuugcuccuucuauggc

SEQ ID NO: 201145 - RNA, 20 nt, Homo sapiens
uuugcagaaucuaagaagag

SEQ ID NO: 201146 - RNA, 22 nt, Homo sapiens
uccagugcauucagacacuugg

SEQ ID NO: 201147 - RNA, 22 nt, Homo sapiens
uccagugugcaggcaaguuuga

SEQ ID NO: 201148 - RNA, 22 nt, Homo sapiens
uccaguuuggaggcuugaugug

SEQ ID NO: 201149 - RNA, 18 nt, Homo sapiens
uccaguuuucccagcauc

SEQ ID NO: 201150 - RNA, 22 nt, Homo sapiens
uccaguuuucuuuccuagggcu

SEQ ID NO: 201151 - RNA, 22 nt, Homo sapiens
uccauagacauuuuaagguagu

SEQ ID NO: 201152 - RNA, 19 nt, Homo sapiens
ucccaagaugcucauacau

SEQ ID NO: 201153 - RNA, 19 nt, Homo sapiens
ucccaauguuuccaggcag

SEQ ID NO: 201154 - RNA, 16 nt, Homo sapiens
ucccaccauugcuugu

SEQ ID NO: 201155 - RNA, 22 nt, Homo sapiens
ucccagaaacgcauauguucau

SEQ ID NO: 201156 - RNA, 19 nt, Homo sapiens
uccccuguggauaccaaga

SEQ ID NO: 201157 - RNA, 22 nt, Homo sapiens
ucccuggagcaagagaagaagg

SEQ ID NO: 201158 - RNA, 22 nt, Homo sapiens
ucccuugagccuggcuucucac

SEQ ID NO: 201159 - RNA, 22 nt, Homo sapiens
uccugagacucacaggcucccc

SEQ ID NO: 201160 - RNA, 22 nt, Homo sapiens
uccugagacugaggagcuuugg

SEQ ID NO: 201161 - RNA, 22 nt, Homo sapiens
uccugcauucauccugguguug

SEQ ID NO: 201162 - RNA, 22 nt, Homo sapiens
uccuugagaggacagagccaua

SEQ ID NO: 201163 - RNA, 22 nt, Homo sapiens
uccuugagccuuaaauuauaaa

SEQ ID NO: 201164 - RNA, 21 nt, Homo sapiens
uccuuggugaugcccugcagu

SEQ ID NO: 201165 - RNA, 20 nt, Homo sapiens
ucgcaccacuauacuccagc

SEQ ID NO: 201166 - RNA, 22 nt, Homo sapiens
aaggaagcuagcaggaauuggu

SEQ ID NO: 201167 - RNA, 22 nt, Homo sapiens
aaggaauucaaauuuucucugg

SEQ ID NO: 201168 - RNA, 22 nt, Homo sapiens
aaggaguagaauagaugcaccu

SEQ ID NO: 201169 - RNA, 22 nt, Homo sapiens
aaggaguauugaaugaccaagu

SEQ ID NO: 201170 - RNA, 22 nt, Homo sapiens
aaggcaagaaugcgugcuuuca

SEQ ID NO: 201171 - RNA, 22 nt, Homo sapiens
aaggcauggugacuauuuaggc

SEQ ID NO: 201172 - RNA, 22 nt, Homo sapiens
aagggaaugcuuccaguuugug

SEQ ID NO: 201173 - RNA, 22 nt, Homo sapiens
aagggaauguuguagcugguuu

SEQ ID NO: 201174 - RNA, 23 nt, Homo sapiens
aagguaagcuagaaagauguaga

SEQ ID NO: 201175 - RNA, 22 nt, Homo sapiens
aagguaguuuucuuuaaugcug

SEQ ID NO: 201176 - RNA, 22 nt, Homo sapiens
aaggugcucucuuauguagaaa

SEQ ID NO: 201177 - RNA, 21 nt, Homo sapiens
aagguuuuuagugcuugacuu

SEQ ID NO: 201178 - RNA, 22 nt, Homo sapiens
aaguaaauauccgguaguccca

SEQ ID NO: 201179 - RNA, 22 nt, Homo sapiens
aaguauguaucaagucauacuu

SEQ ID NO: 201180 - RNA, 22 nt, Homo sapiens
aagugaaugugcuggaauagcu

SEQ ID NO: 201181 - RNA, 22 nt, Homo sapiens
aagugaccuaacaaugaaggcc

SEQ ID NO: 201182 - RNA, 23 nt, Homo sapiens
aagugagcuccaauugggugaga

SEQ ID NO: 201183 - RNA, 22 nt, Homo sapiens
aagugagugacaaaaacugggc

SEQ ID NO: 201184 - RNA, 22 nt, Homo sapiens
aagugcaaauucccaggcucug

SEQ ID NO: 201185 - RNA, 22 nt, Homo sapiens
aagugcacuguaagugcaggau

SEQ ID NO: 201186 - RNA, 22 nt, Homo sapiens
aagugcauguauuaguguaguc

SEQ ID NO: 201187 - RNA, 22 nt, Homo sapiens
aagugcucuugaaacugccuua

SEQ ID NO: 201188 - RNA, 22 nt, Homo sapiens
aagugcuucagaagacaauauu

SEQ ID NO: 201189 - RNA, 20 nt, Homo sapiens
aagugcuuccuuuuagaggg

SEQ ID NO: 201190 - RNA, 22 nt, Homo sapiens
aagugcuuuacacaugcaugau

SEQ ID NO: 201191 - RNA, 22 nt, Homo sapiens
aagugcuuuuuagauaugguuu

SEQ ID NO: 201192 - RNA, 22 nt, Homo sapiens
aagugguuuuuacaaagacaga

SEQ ID NO: 201193 - RNA, 22 nt, Homo sapiens
ugcaaagucgaaacugcaguuu

SEQ ID NO: 201194 - RNA, 19 nt, Homo sapiens
ugcaaagucuuuuccuauu

SEQ ID NO: 201195 - RNA, 22 nt, Homo sapiens
ugcaagaaucuuucaggcuagc

SEQ ID NO: 201196 - RNA, 22 nt, Homo sapiens
ugcaagacacuguccugggcau

SEQ ID NO: 201197 - RNA, 22 nt, Homo sapiens
ugcaagaggagacuguacucag

SEQ ID NO: 201198 - RNA, 22 nt, Homo sapiens
ugcaagauaggcaguuugcacu

SEQ ID NO: 201199 - RNA, 22 nt, Homo sapiens
ugcaccacugcacuccaggcug

SEQ ID NO: 201200 - RNA, 22 nt, Homo sapiens
ugcagaaucccuucagauccga

SEQ ID NO: 201201 - RNA, 22 nt, Homo sapiens
ugcagagaaacauuuuguauuu

SEQ ID NO: 201202 - RNA, 20 nt, Homo sapiens
ugcagauucaaccaacugug

SEQ ID NO: 201203 - RNA, 22 nt, Homo sapiens
ugcaguagugugaucuuggcuc

SEQ ID NO: 201204 - RNA, 22 nt, Homo sapiens
ugcauacacaagcauacaugua

SEQ ID NO: 201205 - RNA, 19 nt, Homo sapiens
ugcauaggguuacauacuc

SEQ ID NO: 201206 - RNA, 23 nt, Homo sapiens
ugcauaguacccaauacuuuauc

SEQ ID NO: 201207 - RNA, 22 nt, Homo sapiens
ugcauauguauacaugugccau

SEQ ID NO: 201208 - RNA, 22 nt, Homo sapiens
ugcauauguugaaccaggcuug

SEQ ID NO: 201209 - RNA, 22 nt, Homo sapiens
ugcauccauucuagacucaucu

SEQ ID NO: 201210 - RNA, 21 nt, Homo sapiens
ugcauggagaacacugagggu

SEQ ID NO: 201211 - RNA, 22 nt, Homo sapiens
ugcauuguuccgaauguguccu

SEQ ID NO: 201212 - RNA, 22 nt, Homo sapiens
ugccaaaaugggcuuuauaccg

SEQ ID NO: 201213 - RNA, 22 nt, Homo sapiens
ugccaagaacauuuucuguuuu

SEQ ID NO: 201214 - RNA, 22 nt, Homo sapiens
ugccagagacguagggaauauu

SEQ ID NO: 201215 - RNA, 22 nt, Homo sapiens
ugccaguguugccuuucacuag

SEQ ID NO: 201216 - RNA, 22 nt, Homo sapiens
ugccauagagauuuguggaacu

SEQ ID NO: 201217 - RNA, 22 nt, Homo sapiens
ugccaugaagaucccugaaaug

SEQ ID NO: 201218 - RNA, 22 nt, Homo sapiens
ugccauugcacuccagccuggg

SEQ ID NO: 201219 - RNA, 22 nt, Homo sapiens
ugccuaggcuggaaugcagugg

SEQ ID NO: 201220 - RNA, 20 nt, Homo sapiens
ugccugacacucuuugcuuc

SEQ ID NO: 201221 - RNA, 22 nt, Homo sapiens
ugccuggagagcuccuacauau

SEQ ID NO: 201222 - RNA, 22 nt, Homo sapiens
ugccuucuguuaaacgaggaug

SEQ ID NO: 201223 - RNA, 16 nt, Homo sapiens
ugccuucuucuguauu

SEQ ID NO: 201224 - RNA, 22 nt, Homo sapiens
ugcuacccuucgucucucuggu

SEQ ID NO: 201225 - RNA, 22 nt, Homo sapiens
ugcuauguccccacccaaaucu

SEQ ID NO: 201226 - RNA, 18 nt, Homo sapiens
ugcuccccugggugagca

SEQ ID NO: 201227 - RNA, 22 nt, Homo sapiens
ugcugcaaacaugagaggaagu

SEQ ID NO: 201228 - RNA, 20 nt, Homo sapiens
ugcugcacuuaagcaugggc

SEQ ID NO: 201229 - RNA, 22 nt, Homo sapiens
ugcugcauuggggauuaaguuu

SEQ ID NO: 201230 - RNA, 22 nt, Homo sapiens
ugcuggugauuaaauccugaag

SEQ ID NO: 201231 - RNA, 22 nt, Homo sapiens
ugcugguguggucuagccgcuu

SEQ ID NO: 201232 - RNA, 22 nt, Homo sapiens
ugcugguguuuaggaauaagaa

SEQ ID NO: 201233 - RNA, 22 nt, Homo sapiens
ugcuguguugcuggcuuaaaga

SEQ ID NO: 201234 - RNA, 21 nt, Homo sapiens
ugcuuacugaauguuaauuuc

SEQ ID NO: 201235 - RNA, 22 nt, Homo sapiens
uggaaaauuaggggagguuaua

SEQ ID NO: 201236 - RNA, 20 nt, Homo sapiens
uggaaaguaagucaugauau

SEQ ID NO: 201237 - RNA, 22 nt, Homo sapiens
uggaaaguacuugaguuuguau

SEQ ID NO: 201238 - RNA, 22 nt, Homo sapiens
uggaaauaaaugugccaagauc

SEQ ID NO: 201239 - RNA, 22 nt, Homo sapiens
uggaaauuaacagggauugucc

SEQ ID NO: 201240 - RNA, 22 nt, Homo sapiens
uggaagacucuagucucuugag

SEQ ID NO: 201241 - RNA, 22 nt, Homo sapiens
uggaaguauagauaauugaaag

SEQ ID NO: 201242 - RNA, 21 nt, Homo sapiens
uggaaucuauagaggcaguag

SEQ ID NO: 201243 - RNA, 20 nt, Homo sapiens
uggaaucugaagaucucagu

SEQ ID NO: 201244 - RNA, 21 nt, Homo sapiens
uggaaugaauggccaacaugg

SEQ ID NO: 201245 - RNA, 22 nt, Homo sapiens
uggaauguauaucguuuuuugu

SEQ ID NO: 201246 - RNA, 22 nt, Homo sapiens
uggacaugaagggcacaggagg

SEQ ID NO: 201247 - RNA, 22 nt, Homo sapiens
uggacuagagggugggcgaggu

SEQ ID NO: 201248 - RNA, 22 nt, Homo sapiens
uggacuguaauuuuauaggcau

SEQ ID NO: 201249 - RNA, 23 nt, Homo sapiens
uggaggacaagcauggauaguga

SEQ ID NO: 201250 - RNA, 22 nt, Homo sapiens
uggagggcuagucauuucuuuu

SEQ ID NO: 201251 - RNA, 22 nt, Homo sapiens
uggagguagacauugggaagag

SEQ ID NO: 201252 - RNA, 22 nt, Homo sapiens
uggaguauuauguaauuucaau

SEQ ID NO: 201253 - RNA, 22 nt, Homo sapiens
uggagugagaacuucaaugaug

SEQ ID NO: 201254 - RNA, 22 nt, Homo sapiens
uggagugauaugguuauauggg

SEQ ID NO: 201255 - RNA, 22 nt, Homo sapiens
uggagugcgagggugaaacuuu

SEQ ID NO: 201256 - RNA, 20 nt, Homo sapiens
uggagugcuguguugagaag

SEQ ID NO: 201257 - RNA, 22 nt, Homo sapiens
uggaguguaauuagccaucagu

SEQ ID NO: 201258 - RNA, 22 nt, Homo sapiens
uggaguuugacaugccuuuggg

SEQ ID NO: 201259 - RNA, 22 nt, Homo sapiens
uggaucaugcgaggccuccccu

SEQ ID NO: 201260 - RNA, 21 nt, Homo sapiens
uggaugccuaggcagaaguuu

SEQ ID NO: 201261 - RNA, 22 nt, Homo sapiens
uggcaaaugugagaugagaacu

SEQ ID NO: 201262 - RNA, 22 nt, Homo sapiens
uggcaaauuccaaaguuaauuc

SEQ ID NO: 201263 - RNA, 22 nt, Homo sapiens
uggcaagaaccacaguuacuuu

SEQ ID NO: 201264 - RNA, 22 nt, Homo sapiens
uggcaagaacugcaauugcuuu

SEQ ID NO: 201265 - RNA, 19 nt, Homo sapiens
uggcaaugucagcagagau

SEQ ID NO: 201266 - RNA, 22 nt, Homo sapiens
uggcacaaugacccuugugggc

SEQ ID NO: 201267 - RNA, 22 nt, Homo sapiens
uggcaccauccaggugucucua

SEQ ID NO: 201268 - RNA, 22 nt, Homo sapiens
uggcacuaugugacaagguuuu

SEQ ID NO: 201269 - RNA, 22 nt, Homo sapiens
aagcugguguguauuauucacu

SEQ ID NO: 201270 - RNA, 22 nt, Homo sapiens
aagcugguuuuauaucugugag

SEQ ID NO: 201271 - RNA, 22 nt, Homo sapiens
aaggaaguaauuugguuuauag

SEQ ID NO: 201272 - RNA, 22 nt, Homo sapiens
aaggagcagagagcccuguuuc

SEQ ID NO: 201273 - RNA, 22 nt, Homo sapiens
aaggagugugauucuucaguuu

SEQ ID NO: 201274 - RNA, 22 nt, Homo sapiens
aaggauuguaacaccaagguua

SEQ ID NO: 201275 - RNA, 22 nt, Homo sapiens
aaggcaacgugaguuguugauu

SEQ ID NO: 201276 - RNA, 22 nt, Homo sapiens
aaggcaagguggauaaugaagc

SEQ ID NO: 201277 - RNA, 22 nt, Homo sapiens
aaggcauucucaaacuaguucu

SEQ ID NO: 201278 - RNA, 22 nt, Homo sapiens
aaggcucuuucaacguaaauua

SEQ ID NO: 201279 - RNA, 22 nt, Homo sapiens
aaggcuguuguguaauaggauu

SEQ ID NO: 201280 - RNA, 20 nt, Homo sapiens
aaggcuuucgaguuccaggg

SEQ ID NO: 201281 - RNA, 22 nt, Homo sapiens
aaggugcuguaagcauccaugu

SEQ ID NO: 201282 - RNA, 18 nt, Homo sapiens
aaggugcuucuguucuga

SEQ ID NO: 201283 - RNA, 22 nt, Homo sapiens
aagguguagucucuggauaagc

SEQ ID NO: 201284 - RNA, 22 nt, Homo sapiens
aaguacuguuuaaauugcagaa

SEQ ID NO: 201285 - RNA, 19 nt, Homo sapiens
aaguaguugugacagaugc

SEQ ID NO: 201286 - RNA, 18 nt, Homo sapiens
aaguauagagagcccuua

SEQ ID NO: 201287 - RNA, 22 nt, Homo sapiens
aagucaguuugggagaagcuau

SEQ ID NO: 201288 - RNA, 22 nt, Homo sapiens
aagugaaugaugugaaguguaa

SEQ ID NO: 201289 - RNA, 22 nt, Homo sapiens
aagugacauugugcccauuuga

SEQ ID NO: 201290 - RNA, 22 nt, Homo sapiens
aagugcccuauuuggcccuuga

SEQ ID NO: 201291 - RNA, 20 nt, Homo sapiens
aagugcuauuucuuuugugg

SEQ ID NO: 201292 - RNA, 22 nt, Homo sapiens
aagugcucuugaaacugucuua

SEQ ID NO: 201293 - RNA, 22 nt, Homo sapiens
aagugcuggccuacucaaucga

SEQ ID NO: 201294 - RNA, 22 nt, Homo sapiens
aagugcugggauuggccgggca

SEQ ID NO: 201295 - RNA, 22 nt, Homo sapiens
aagugcuucuuuccucgagaag

SEQ ID NO: 201296 - RNA, 22 nt, Homo sapiens
aagugguagggucaggauugga

SEQ ID NO: 201297 - RNA, 22 nt, Homo sapiens
aagugguguuuguauuuaugca

SEQ ID NO: 201298 - RNA, 19 nt, Homo sapiens
aagugguuuaaacuuguau

SEQ ID NO: 201299 - RNA, 22 nt, Homo sapiens
aagugucagaguugcuaaugac

SEQ ID NO: 201300 - RNA, 22 nt, Homo sapiens
aagugucuuaccgggagggagu

SEQ ID NO: 201301 - RNA, 22 nt, Homo sapiens
aaguuguaguuagagaguugcu

SEQ ID NO: 201302 - RNA, 21 nt, Homo sapiens
aauaaagcaaccuuaugccau

SEQ ID NO: 201303 - RNA, 22 nt, Homo sapiens
aauaaagccugucucuuuagag

SEQ ID NO: 201304 - RNA, 22 nt, Homo sapiens
aauacucuauaagggaagcugu

SEQ ID NO: 201305 - RNA, 22 nt, Homo sapiens
aauacugagaugugagguacua

SEQ ID NO: 201306 - RNA, 22 nt, Homo sapiens
aauagcauugaaucuaccaauu

SEQ ID NO: 201307 - RNA, 22 nt, Homo sapiens
aaucacaguguucuugugaggg

SEQ ID NO: 201308 - RNA, 22 nt, Homo sapiens
aaucacuaugccaugaaguaca

SEQ ID NO: 201309 - RNA, 22 nt, Homo sapiens
aaucacuuuggcaccaaccuaa

SEQ ID NO: 201310 - RNA, 22 nt, Homo sapiens
aaugacacugagcaucuuucau

SEQ ID NO: 201311 - RNA, 22 nt, Homo sapiens
aaugacuaagaugguacauuuu

SEQ ID NO: 201312 - RNA, 22 nt, Homo sapiens
aaugauauguuauguuuagguu

SEQ ID NO: 201313 - RNA, 22 nt, Homo sapiens
aaugcacauauauuuccuuauu

SEQ ID NO: 201314 - RNA, 22 nt, Homo sapiens
aaugcuguguuauuucaugacc

SEQ ID NO: 201315 - RNA, 22 nt, Homo sapiens
aauggcaaauguuuucuguuga

SEQ ID NO: 201316 - RNA, 22 nt, Homo sapiens
aauggcagaugaaauugucauu

SEQ ID NO: 201317 - RNA, 22 nt, Homo sapiens
aauggcaucuagaguggugaau

SEQ ID NO: 201318 - RNA, 22 nt, Homo sapiens
aauggcucuuccuggaguugug

SEQ ID NO: 201319 - RNA, 22 nt, Homo sapiens
aauggcuuucagcuuuucccca

SEQ ID NO: 201320 - RNA, 22 nt, Homo sapiens
aaugucacugugguccuccagu

SEQ ID NO: 201321 - RNA, 22 nt, Homo sapiens
aaugugcuguucagaggagucc

SEQ ID NO: 201322 - RNA, 22 nt, Homo sapiens
aauguguuuugaaaucaggaag

SEQ ID NO: 201323 - RNA, 22 nt, Homo sapiens
aauuacucgugucuuuacugcu

SEQ ID NO: 201324 - RNA, 22 nt, Homo sapiens
aauugcacuggaaguaacugag

SEQ ID NO: 201325 - RNA, 23 nt, Homo sapiens
aauugcuuuugaggacuuaguug

SEQ ID NO: 201326 - RNA, 22 nt, Homo sapiens
aauuguacucccaucauuccua

SEQ ID NO: 201327 - RNA, 22 nt, Homo sapiens
acaagacuucuuguauucuagu

SEQ ID NO: 201328 - RNA, 22 nt, Homo sapiens
acacaaugguaaguguuugugu

SEQ ID NO: 201329 - RNA, 22 nt, Homo sapiens
acacaguaaauauguauugaau

SEQ ID NO: 201330 - RNA, 22 nt, Homo sapiens
acacaguaaauauugucuccuc

SEQ ID NO: 201331 - RNA, 22 nt, Homo sapiens
acacaguguuuauugugguuag

SEQ ID NO: 201332 - RNA, 22 nt, Homo sapiens
acacauacacauaugguguaua

SEQ ID NO: 201333 - RNA, 22 nt, Homo sapiens
acacaugugaaaaaaauguuac

SEQ ID NO: 201334 - RNA, 22 nt, Homo sapiens
acaccuguggucccaguaacuu

SEQ ID NO: 201335 - RNA, 22 nt, Homo sapiens
acacuggaguuaaaggugauuu

SEQ ID NO: 201336 - RNA, 22 nt, Homo sapiens
acacugucaugucucacaggca

SEQ ID NO: 201337 - RNA, 22 nt, Homo sapiens
acacugucugaugaaaguaguu

SEQ ID NO: 201338 - RNA, 22 nt, Homo sapiens
acacuguuggugggaguguaaa

SEQ ID NO: 201339 - RNA, 22 nt, Homo sapiens
acacuguuuuaguuauuauagc

SEQ ID NO: 201340 - RNA, 22 nt, Homo sapiens
acagagcaaugagcuacggucu

SEQ ID NO: 201341 - RNA, 19 nt, Homo sapiens
acagauagaauguucuaca

SEQ ID NO: 201342 - RNA, 22 nt, Homo sapiens
acagauagcacuaagggaucug

SEQ ID NO: 201343 - RNA, 22 nt, Homo sapiens
acagaucagagauauuuagguu

SEQ ID NO: 201344 - RNA, 16 nt, Homo sapiens
agcagguguuagguga

SEQ ID NO: 201345 - RNA, 22 nt, Homo sapiens
agcaucagugauuuuguugaag

SEQ ID NO: 201346 - RNA, 21 nt, Homo sapiens
agccaguguuccuuguggcuc

SEQ ID NO: 201347 - RNA, 17 nt, Homo sapiens
agccccauuagcuaguu

SEQ ID NO: 201348 - RNA, 22 nt, Homo sapiens
agccuagagagccacuuugaga

SEQ ID NO: 201349 - RNA, 22 nt, Homo sapiens
agcuaaaucucauguugaauug

SEQ ID NO: 201350 - RNA, 22 nt, Homo sapiens
agcuaacauuuuuccucuucca

SEQ ID NO: 201351 - RNA, 22 nt, Homo sapiens
agcuagugugauucuuuggggu

SEQ ID NO: 201352 - RNA, 22 nt, Homo sapiens
agcucacagccuagcacuguga

SEQ ID NO: 201353 - RNA, 18 nt, Homo sapiens
agcucaguguuugcuuac

SEQ ID NO: 201354 - RNA, 22 nt, Homo sapiens
agcugccagucuuguaaggccu

SEQ ID NO: 201355 - RNA, 22 nt, Homo sapiens
agcuggacuugauaaaugaaua

SEQ ID NO: 201356 - RNA, 22 nt, Homo sapiens
agcuggucuacguguguaugag

SEQ ID NO: 201357 - RNA, 22 nt, Homo sapiens
agcuggucugauacuuaccucc

SEQ ID NO: 201358 - RNA, 22 nt, Homo sapiens
agcuggucuuggggaagaguag

SEQ ID NO: 201359 - RNA, 22 nt, Homo sapiens
agcugguuuauuucucacaaca

SEQ ID NO: 201360 - RNA, 19 nt, Homo sapiens
agcuguguugccugugaga

SEQ ID NO: 201361 - RNA, 22 nt, Homo sapiens
agcuucauuguuaugaauguca

SEQ ID NO: 201362 - RNA, 20 nt, Homo sapiens
agcuugguuuggaugaucac

SEQ ID NO: 201363 - RNA, 22 nt, Homo sapiens
agcuuguagugauuugugguaa

SEQ ID NO: 201364 - RNA, 22 nt, Homo sapiens
aggaaaucuuagcugaggggau

SEQ ID NO: 201365 - RNA, 22 nt, Homo sapiens
aggaagacauauagaacuaaaa

SEQ ID NO: 201366 - RNA, 22 nt, Homo sapiens
aggaagacugaaauugcuguuc

SEQ ID NO: 201367 - RNA, 16 nt, Homo sapiens
aggaagacuuagagau

SEQ ID NO: 201368 - RNA, 22 nt, Homo sapiens
aggaagguaaacuaacuugccu

SEQ ID NO: 201369 - RNA, 23 nt, Homo sapiens
aggaaguaacuaucuuuucuguc

SEQ ID NO: 201370 - RNA, 22 nt, Homo sapiens
aggacacugauagucuuuggca

SEQ ID NO: 201371 - RNA, 22 nt, Homo sapiens
aggagcacaggacuuugauuau

SEQ ID NO: 201372 - RNA, 21 nt, Homo sapiens
aggagcauucucuugcuuugu

SEQ ID NO: 201373 - RNA, 22 nt, Homo sapiens
aggagguagaacauugccauuu

SEQ ID NO: 201374 - RNA, 22 nt, Homo sapiens
aggagguaggaauugugcuagg

SEQ ID NO: 201375 - RNA, 22 nt, Homo sapiens
aggagguagggugugaaacagc

SEQ ID NO: 201376 - RNA, 22 nt, Homo sapiens
aggagguugguaccaucuguuu

SEQ ID NO: 201377 - RNA, 21 nt, Homo sapiens
aggcaagauuacuuacgagca

SEQ ID NO: 201378 - RNA, 22 nt, Homo sapiens
aggcacggugucucaugccugu

SEQ ID NO: 201379 - RNA, 22 nt, Homo sapiens
aggcagcuguuauauacugagu

SEQ ID NO: 201380 - RNA, 22 nt, Homo sapiens
aggcagucugaguuuugaaagg

SEQ ID NO: 201381 - RNA, 22 nt, Homo sapiens
aggcaugauggcuccagaucau

SEQ ID NO: 201382 - RNA, 22 nt, Homo sapiens
aggcauggagacuaaaauuaua

SEQ ID NO: 201383 - RNA, 22 nt, Homo sapiens
aggcaugguggcacauacaugu

SEQ ID NO: 201384 - RNA, 22 nt, Homo sapiens
aggcaugugugcagacugucug

SEQ ID NO: 201385 - RNA, 22 nt, Homo sapiens
aggcuuuauuacagggucucag

SEQ ID NO: 201386 - RNA, 22 nt, Homo sapiens
aggcuuuuggagaacacugcac

SEQ ID NO: 201387 - RNA, 22 nt, Homo sapiens
agggcacuguagguccugccuc

SEQ ID NO: 201388 - RNA, 22 nt, Homo sapiens
agguaaguauguuauuacuuuu

SEQ ID NO: 201389 - RNA, 22 nt, Homo sapiens
agguaauuuucccagagggaaa

SEQ ID NO: 201390 - RNA, 22 nt, Homo sapiens
agguagugugaugcuccuguuu

SEQ ID NO: 201391 - RNA, 22 nt, Homo sapiens
agguaguguuauuugcagcuga

SEQ ID NO: 201392 - RNA, 20 nt, Homo sapiens
agguaguuauacaaaugugu

SEQ ID NO: 201393 - RNA, 22 nt, Homo sapiens
aggugguguuggguuccagccc

SEQ ID NO: 201394 - RNA, 22 nt, Homo sapiens
aggugguuuuaggcagagacau

SEQ ID NO: 201395 - RNA, 22 nt, Homo sapiens
aggugguuuugaugagcaggua

SEQ ID NO: 201396 - RNA, 21 nt, Homo sapiens
aggugucuuggguucccuggc

SEQ ID NO: 201397 - RNA, 22 nt, Homo sapiens
agguuaccuggugauuuugucu

SEQ ID NO: 201398 - RNA, 23 nt, Homo sapiens
agguuaugauuauagagcgagga

SEQ ID NO: 201399 - RNA, 20 nt, Homo sapiens
agguucaaaucccaaucaug

SEQ ID NO: 201400 - RNA, 22 nt, Homo sapiens
agguuuucagccccagccuagg

SEQ ID NO: 201401 - RNA, 22 nt, Homo sapiens
aguaagauggcaacucuccaca

SEQ ID NO: 201402 - RNA, 22 nt, Homo sapiens
aguacacuguugaacagaagug

SEQ ID NO: 201403 - RNA, 22 nt, Homo sapiens
aguagcaauggcucugagcuau

SEQ ID NO: 201404 - RNA, 22 nt, Homo sapiens
aguaucaucuuguuggccaggc

SEQ ID NO: 201405 - RNA, 22 nt, Homo sapiens
aguauugcuaauaagagauuug

SEQ ID NO: 201406 - RNA, 22 nt, Homo sapiens
agucaaaugcuuauguauaaag

SEQ ID NO: 201407 - RNA, 22 nt, Homo sapiens
agucacagccuuuuacuuuaga

SEQ ID NO: 201408 - RNA, 22 nt, Homo sapiens
agucacagguucuugggauuag

SEQ ID NO: 201409 - RNA, 22 nt, Homo sapiens
agucacaugcauuuucuucaau

SEQ ID NO: 201410 - RNA, 22 nt, Homo sapiens
agucagauuggcauuuguuggg

SEQ ID NO: 201411 - RNA, 21 nt, Homo sapiens
agucauaggaguacauaaugc

SEQ ID NO: 201412 - RNA, 19 nt, Homo sapiens
agucaugugaggacccuug

SEQ ID NO: 201413 - RNA, 22 nt, Homo sapiens
aguccaguguuaugaucaguag

SEQ ID NO: 201414 - RNA, 22 nt, Homo sapiens
agucgguguuacugacagaaug

SEQ ID NO: 201415 - RNA, 22 nt, Homo sapiens
agugaauguuggaaaguuauuu

SEQ ID NO: 201416 - RNA, 17 nt, Homo sapiens
agugagaucauggcuua

SEQ ID NO: 201417 - RNA, 22 nt, Homo sapiens
agugagcugcagucuggggucc

SEQ ID NO: 201418 - RNA, 22 nt, Homo sapiens
agugauguggaguuuggaugga

SEQ ID NO: 201419 - RNA, 22 nt, Homo sapiens
agugccaaaucgagggcucuga

SEQ ID NO: 201420 - RNA, 22 nt, Homo sapiens
aucucugagauguucugauuuu

SEQ ID NO: 201421 - RNA, 22 nt, Homo sapiens
aucuggcuccuuuugacaaugc

SEQ ID NO: 201422 - RNA, 22 nt, Homo sapiens
aucuugcauuugcuaaaaugca

SEQ ID NO: 201423 - RNA, 22 nt, Homo sapiens
aucuuuggcgggaauaucacag

SEQ ID NO: 201424 - RNA, 22 nt, Homo sapiens
aucuuuggugaguucuuugguc

SEQ ID NO: 201425 - RNA, 22 nt, Homo sapiens
augaaagugauaaaugucucua

SEQ ID NO: 201426 - RNA, 22 nt, Homo sapiens
augaaaugcauguuaaguccgu

SEQ ID NO: 201427 - RNA, 22 nt, Homo sapiens
augaacagagccuugagaaccu

SEQ ID NO: 201428 - RNA, 18 nt, Homo sapiens
augaacucaucauuuuuu

SEQ ID NO: 201429 - RNA, 22 nt, Homo sapiens
augaagauguugccuuuuuaau

SEQ ID NO: 201430 - RNA, 17 nt, Homo sapiens
augaagucaucauuuuu

SEQ ID NO: 201431 - RNA, 22 nt, Homo sapiens
augacacugcagagauguccca

SEQ ID NO: 201432 - RNA, 23 nt, Homo sapiens
augacacuguccuugaccauuuc

SEQ ID NO: 201433 - RNA, 22 nt, Homo sapiens
augacagcaucugugaaguugu

SEQ ID NO: 201434 - RNA, 22 nt, Homo sapiens
augacagugagugagcucucac

SEQ ID NO: 201435 - RNA, 22 nt, Homo sapiens
augaccauuucaauugauaugg

SEQ ID NO: 201436 - RNA, 22 nt, Homo sapiens
augaccuuggggaaccaugucu

SEQ ID NO: 201437 - RNA, 22 nt, Homo sapiens
augacuaaaggguuuauguuga

SEQ ID NO: 201438 - RNA, 22 nt, Homo sapiens
augacuggaacagcaauuuaca

SEQ ID NO: 201439 - RNA, 17 nt, Homo sapiens
augacuucuucagugug

SEQ ID NO: 201440 - RNA, 22 nt, Homo sapiens
augacuuuucugaaaaccacca

SEQ ID NO: 201441 - RNA, 22 nt, Homo sapiens
augagaaugaagccuggcgugu

SEQ ID NO: 201442 - RNA, 22 nt, Homo sapiens
augagaaugauucuguuauggu

SEQ ID NO: 201443 - RNA, 22 nt, Homo sapiens
augagaauguaaguuaaugaaa

SEQ ID NO: 201444 - RNA, 22 nt, Homo sapiens
augagacauuaaaguguguuug

SEQ ID NO: 201445 - RNA, 22 nt, Homo sapiens
augagauauguuaaaaguuaaa

SEQ ID NO: 201446 - RNA, 22 nt, Homo sapiens
augagaugcaagauuagauggg

SEQ ID NO: 201447 - RNA, 21 nt, Homo sapiens
augagauguuagacuuuagac

SEQ ID NO: 201448 - RNA, 22 nt, Homo sapiens
augagauucuuagagaagucug

SEQ ID NO: 201449 - RNA, 22 nt, Homo sapiens
augagauuguuuguacuccaca

SEQ ID NO: 201450 - RNA, 22 nt, Homo sapiens
augaggaaggagccuuugucug

SEQ ID NO: 201451 - RNA, 22 nt, Homo sapiens
augaggcacugcgcccuacuga

SEQ ID NO: 201452 - RNA, 22 nt, Homo sapiens
augagggagggcaccugaccuu

SEQ ID NO: 201453 - RNA, 22 nt, Homo sapiens
augagggagggguggugccgca

SEQ ID NO: 201454 - RNA, 22 nt, Homo sapiens
augagguaguagaaagucaggu

SEQ ID NO: 201455 - RNA, 22 nt, Homo sapiens
augagguccuagccaacuuuuu

SEQ ID NO: 201456 - RNA, 22 nt, Homo sapiens
augaggugaguaaauaaaugaa

SEQ ID NO: 201457 - RNA, 22 nt, Homo sapiens
augaguaugagaauacauuaag

SEQ ID NO: 201458 - RNA, 19 nt, Homo sapiens
augaguuaggggaaauuuc

SEQ ID NO: 201459 - RNA, 22 nt, Homo sapiens
augauauguuuguagcuaucuc

SEQ ID NO: 201460 - RNA, 22 nt, Homo sapiens
augaucacaccacugcacucca

SEQ ID NO: 201461 - RNA, 22 nt, Homo sapiens
augaucaucugaaagcuuuuac

SEQ ID NO: 201462 - RNA, 22 nt, Homo sapiens
augaugaaguaagugcuuagga

SEQ ID NO: 201463 - RNA, 22 nt, Homo sapiens
augaugcaguacuuugggaaca

SEQ ID NO: 201464 - RNA, 22 nt, Homo sapiens
augauguccacagggguguuca

SEQ ID NO: 201465 - RNA, 22 nt, Homo sapiens
augcaagaaauaucucuuuuuc

SEQ ID NO: 201466 - RNA, 22 nt, Homo sapiens
augcaauucuagauugauagua

SEQ ID NO: 201467 - RNA, 19 nt, Homo sapiens
augcacgugaaaugcauuu

SEQ ID NO: 201468 - RNA, 22 nt, Homo sapiens
augcacuuggcaggaugauucc

SEQ ID NO: 201469 - RNA, 22 nt, Homo sapiens
augcagugugcaacagauuaag

SEQ ID NO: 201470 - RNA, 19 nt, Homo sapiens
augccacagugaggucaga

SEQ ID NO: 201471 - RNA, 20 nt, Homo sapiens
augccacugagcagugguga

SEQ ID NO: 201472 - RNA, 22 nt, Homo sapiens
augccacugcacuucagcuugg

SEQ ID NO: 201473 - RNA, 22 nt, Homo sapiens
augccacugcauaagguuuuca

SEQ ID NO: 201474 - RNA, 22 nt, Homo sapiens
augccacuguuuaugucacuua

SEQ ID NO: 201475 - RNA, 19 nt, Homo sapiens
augccucaguuuuguacuu

SEQ ID NO: 201476 - RNA, 22 nt, Homo sapiens
augcuuguugcagccugagccu

SEQ ID NO: 201477 - RNA, 22 nt, Homo sapiens
auggaaaugaagggcuggcccu

SEQ ID NO: 201478 - RNA, 22 nt, Homo sapiens
auggaacauuauagauguaaaa

SEQ ID NO: 201479 - RNA, 22 nt, Homo sapiens
auggaagaaaguuggguucuug

SEQ ID NO: 201480 - RNA, 22 nt, Homo sapiens
auggaaggagaauggucuuuga

SEQ ID NO: 201481 - RNA, 22 nt, Homo sapiens
auggaaggagaggaaugaauga

SEQ ID NO: 201482 - RNA, 22 nt, Homo sapiens
auggaagucucuguuaaguuuc

SEQ ID NO: 201483 - RNA, 22 nt, Homo sapiens
auggacauuaaagcgauguaga

SEQ ID NO: 201484 - RNA, 22 nt, Homo sapiens
auggagaugaacuuggguaaag

SEQ ID NO: 201485 - RNA, 22 nt, Homo sapiens
auggcaagaagagcaauuauuu

SEQ ID NO: 201486 - RNA, 22 nt, Homo sapiens
auggcacuacugggaaugucuu

SEQ ID NO: 201487 - RNA, 22 nt, Homo sapiens
auggcagcccucuuuauccaug

SEQ ID NO: 201488 - RNA, 22 nt, Homo sapiens
auggcauugaagaguugucccu

SEQ ID NO: 201489 - RNA, 22 nt, Homo sapiens
auggcccugaguucaauauauu

SEQ ID NO: 201490 - RNA, 22 nt, Homo sapiens
auggcccugcuaccacuuuucu

SEQ ID NO: 201491 - RNA, 23 nt, Homo sapiens
auggcccuggugggagugucuuu

SEQ ID NO: 201492 - RNA, 22 nt, Homo sapiens
auggcuguuuaagaguuucauu

SEQ ID NO: 201493 - RNA, 22 nt, Homo sapiens
auggcuuuuauuguguugaggu

SEQ ID NO: 201494 - RNA, 22 nt, Homo sapiens
augguacuagaguaagaauugu

SEQ ID NO: 201495 - RNA, 22 nt, Homo sapiens
uagagguagguguaugaacuag

SEQ ID NO: 201496 - RNA, 22 nt, Homo sapiens
uagagguauguauaguauucuu

SEQ ID NO: 201497 - RNA, 19 nt, Homo sapiens
uagagguuuaagaaaagaa

SEQ ID NO: 201498 - RNA, 21 nt, Homo sapiens
uagauacuguauuaaaccuag

SEQ ID NO: 201499 - RNA, 22 nt, Homo sapiens
uagauuauuggcugauuugauc

SEQ ID NO: 201500 - RNA, 22 nt, Homo sapiens
uagauucaucuguuccuuuuga

SEQ ID NO: 201501 - RNA, 22 nt, Homo sapiens
uagauucauuuuagcaaaaguu

SEQ ID NO: 201502 - RNA, 23 nt, Homo sapiens
uagcaacaguuggaggugaggua

SEQ ID NO: 201503 - RNA, 22 nt, Homo sapiens
uagcaagaugaauuugugcaaa

SEQ ID NO: 201504 - RNA, 17 nt, Homo sapiens
uagcacagugccuggua

SEQ ID NO: 201505 - RNA, 22 nt, Homo sapiens
uagcacagugucauucuaggua

SEQ ID NO: 201506 - RNA, 22 nt, Homo sapiens
uagcaccacaaucaagauacag

SEQ ID NO: 201507 - RNA, 22 nt, Homo sapiens
uagcaccucuuuggccuuucgu

SEQ ID NO: 201508 - RNA, 22 nt, Homo sapiens
uagcaccugugcacaccaggca

SEQ ID NO: 201509 - RNA, 22 nt, Homo sapiens
uagcagaauauaccucuuacuu

SEQ ID NO: 201510 - RNA, 22 nt, Homo sapiens
uagcagcauaaauggacuaaga

SEQ ID NO: 201511 - RNA, 22 nt, Homo sapiens
uagcaguaaagaaugugauguu

SEQ ID NO: 201512 - RNA, 22 nt, Homo sapiens
uagcaguaccccaguauccugg

SEQ ID NO: 201513 - RNA, 22 nt, Homo sapiens
uagcccagugagguugauuugg

SEQ ID NO: 201514 - RNA, 22 nt, Homo sapiens
uagcccauuuguuuagggaaag

SEQ ID NO: 201515 - RNA, 22 nt, Homo sapiens
uagccucacaaagugcuuaaga

SEQ ID NO: 201516 - RNA, 22 nt, Homo sapiens
uagcucagcccagcuaagcuca

SEQ ID NO: 201517 - RNA, 22 nt, Homo sapiens
uagcuccacagcuauauauaau

SEQ ID NO: 201518 - RNA, 18 nt, Homo sapiens
uagcucuuguugguccau

SEQ ID NO: 201519 - RNA, 22 nt, Homo sapiens
uagcugcuguauguacacggau

SEQ ID NO: 201520 - RNA, 22 nt, Homo sapiens
uaggcaguuuuccuuucacagu

SEQ ID NO: 201521 - RNA, 22 nt, Homo sapiens
uaggugaaugcuggaagaaaug

SEQ ID NO: 201522 - RNA, 23 nt, Homo sapiens
uagguuauuugguaaauauaugu

SEQ ID NO: 201523 - RNA, 22 nt, Homo sapiens
uagguucucaggaaugagcuuc

SEQ ID NO: 201524 - RNA, 22 nt, Homo sapiens
uaguaguuuuguguauaauaau

SEQ ID NO: 201525 - RNA, 22 nt, Homo sapiens
uagugcaguggcuccaucucag

SEQ ID NO: 201526 - RNA, 21 nt, Homo sapiens
uagugcagugggguaugacuu

SEQ ID NO: 201527 - RNA, 21 nt, Homo sapiens
uagugcugaggcaguauggga

SEQ ID NO: 201528 - RNA, 22 nt, Homo sapiens
uaguucauuauguguugcucag

SEQ ID NO: 201529 - RNA, 22 nt, Homo sapiens
uaguugcauucaggauaugacg

SEQ ID NO: 201530 - RNA, 22 nt, Homo sapiens
uaguugcauuggcugcuaugcu

SEQ ID NO: 201531 - RNA, 22 nt, Homo sapiens
uaguuuaucuucuggauggaca

SEQ ID NO: 201532 - RNA, 22 nt, Homo sapiens
uauaacaaugcaagaauggccu

SEQ ID NO: 201533 - RNA, 22 nt, Homo sapiens
uauaagacuagcagcugaauug

SEQ ID NO: 201534 - RNA, 22 nt, Homo sapiens
uauacaguaggcacucaguggc

SEQ ID NO: 201535 - RNA, 22 nt, Homo sapiens
uauaggacuugguguaguuucu

SEQ ID NO: 201536 - RNA, 21 nt, Homo sapiens
uauaguaguaugauuuacaau

SEQ ID NO: 201537 - RNA, 22 nt, Homo sapiens
uauaguguuuucaaaaguaugu

SEQ ID NO: 201538 - RNA, 22 nt, Homo sapiens
uauauagcuaugucuguccauu

SEQ ID NO: 201539 - RNA, 22 nt, Homo sapiens
uauaugcauugugggguacuga

SEQ ID NO: 201540 - RNA, 22 nt, Homo sapiens
uauaugucuuuguuauguugag

SEQ ID NO: 201541 - RNA, 22 nt, Homo sapiens
uaucaagauggauaaggauaga

SEQ ID NO: 201542 - RNA, 22 nt, Homo sapiens
uaucaaggccacucauuuuaug

SEQ ID NO: 201543 - RNA, 20 nt, Homo sapiens
uaucacaggucagaaacccu

SEQ ID NO: 201544 - RNA, 22 nt, Homo sapiens
uaucacaggucaggaaucuugc

SEQ ID NO: 201545 - RNA, 22 nt, Homo sapiens
uaucacaguaucuagcacagug

SEQ ID NO: 201546 - RNA, 20 nt, Homo sapiens
uaucacaguucaggaacucu

SEQ ID NO: 201547 - RNA, 22 nt, Homo sapiens
uaucacggaguacauguucugu

SEQ ID NO: 201548 - RNA, 22 nt, Homo sapiens
uaucagauugcugccaucugcu

SEQ ID NO: 201549 - RNA, 22 nt, Homo sapiens
uaucagcagagucauacuucaa

SEQ ID NO: 201550 - RNA, 22 nt, Homo sapiens
uaucauaguuuggacuuucauu

SEQ ID NO: 201551 - RNA, 22 nt, Homo sapiens
uaucaucauguuuuugcugugu

SEQ ID NO: 201552 - RNA, 22 nt, Homo sapiens
uauccugaagcuuuauuuaagu

SEQ ID NO: 201553 - RNA, 22 nt, Homo sapiens
uaucucauccuccuugauccca

SEQ ID NO: 201554 - RNA, 22 nt, Homo sapiens
uaucugcaucccauuuuuauca

SEQ ID NO: 201555 - RNA, 22 nt, Homo sapiens
uaucugguuauugcugcugauu

SEQ ID NO: 201556 - RNA, 22 nt, Homo sapiens
uaugaaacucuaagauucacau

SEQ ID NO: 201557 - RNA, 22 nt, Homo sapiens
uaugacuuuggaaaaauuacuu

SEQ ID NO: 201558 - RNA, 22 nt, Homo sapiens
uaugaugcuguuuagaaucucu

SEQ ID NO: 201559 - RNA, 22 nt, Homo sapiens
uaugauuuuugggagaggucaa

SEQ ID NO: 201560 - RNA, 19 nt, Homo sapiens
uaugcuagagagggaagcu

SEQ ID NO: 201561 - RNA, 22 nt, Homo sapiens
uaugcuuauuaaaacagugugu

SEQ ID NO: 201562 - RNA, 22 nt, Homo sapiens
uauggcaaugcauaggaaggaa

SEQ ID NO: 201563 - RNA, 22 nt, Homo sapiens
uauggucuuugagaggugacug

SEQ ID NO: 201564 - RNA, 17 nt, Homo sapiens
uauguaguacuuauaaa

SEQ ID NO: 201565 - RNA, 22 nt, Homo sapiens
uaugucuuuugcuugcaaauag

SEQ ID NO: 201566 - RNA, 22 nt, Homo sapiens
uaugugguuaauaggaauuugu

SEQ ID NO: 201567 - RNA, 22 nt, Homo sapiens
uauguuaucaaaaagcuaagga

SEQ ID NO: 201568 - RNA, 22 nt, Homo sapiens
uauuacuguuauuccuaucaaa

SEQ ID NO: 201569 - RNA, 22 nt, Homo sapiens
uauuacuugucugugucucaau

SEQ ID NO: 201570 - RNA, 18 nt, Homo sapiens
ucauagaucaugacagug

SEQ ID NO: 201571 - RNA, 22 nt, Homo sapiens
ucauaggucugagaagaaaaua

SEQ ID NO: 201572 - RNA, 22 nt, Homo sapiens
ucauagucuaagguucuuuugc

SEQ ID NO: 201573 - RNA, 22 nt, Homo sapiens
ucaucagaguuuacaagcucag

SEQ ID NO: 201574 - RNA, 22 nt, Homo sapiens
ucaucaggaaacuuaugcagug

SEQ ID NO: 201575 - RNA, 22 nt, Homo sapiens
ucaucaggcucauucaagcuga

SEQ ID NO: 201576 - RNA, 22 nt, Homo sapiens
ucaucaguuuuuuauaugugau

SEQ ID NO: 201577 - RNA, 22 nt, Homo sapiens
ucaugaaguaguuaacugguug

SEQ ID NO: 201578 - RNA, 23 nt, Homo sapiens
ucaugaggccauucaaauccauu

SEQ ID NO: 201579 - RNA, 22 nt, Homo sapiens
ucauggcacugaugagaguuuc

SEQ ID NO: 201580 - RNA, 22 nt, Homo sapiens
ucauguaauuuugugucuauga

SEQ ID NO: 201581 - RNA, 22 nt, Homo sapiens
ucaugugagcaaguugggcuca

SEQ ID NO: 201582 - RNA, 22 nt, Homo sapiens
ucauucauuugcucacuccaca

SEQ ID NO: 201583 - RNA, 22 nt, Homo sapiens
ucauugcauguuaauuaaacag

SEQ ID NO: 201584 - RNA, 22 nt, Homo sapiens
ucauugcuuauuuguuggugga

SEQ ID NO: 201585 - RNA, 22 nt, Homo sapiens
ucauugguucuggguguuguug

SEQ ID NO: 201586 - RNA, 22 nt, Homo sapiens
ucauugguugcguaauuugauu

SEQ ID NO: 201587 - RNA, 19 nt, Homo sapiens
uccacagugguugaacuag

SEQ ID NO: 201588 - RNA, 22 nt, Homo sapiens
uccacagugguugaacuaguuu

SEQ ID NO: 201589 - RNA, 22 nt, Homo sapiens
uccaguguuauaauaugcgucu

SEQ ID NO: 201590 - RNA, 22 nt, Homo sapiens
uccauagugagcagucaaugua

SEQ ID NO: 201591 - RNA, 22 nt, Homo sapiens
uccaugagaauaguuaggcucu

SEQ ID NO: 201592 - RNA, 22 nt, Homo sapiens
uccauguagaugcuauguuguc

SEQ ID NO: 201593 - RNA, 22 nt, Homo sapiens
uccaugugaaaaggucgugaua

SEQ ID NO: 201594 - RNA, 22 nt, Homo sapiens
uccauuugucuauguuucuguu

SEQ ID NO: 201595 - RNA, 22 nt, Homo sapiens
uccauuuguucagcuucaggaa

SEQ ID NO: 201596 - RNA, 22 nt, Homo sapiens
ucccaagaugagaugggggcug

SEQ ID NO: 201597 - RNA, 22 nt, Homo sapiens
ucccaguauucauuuacagaag

SEQ ID NO: 201598 - RNA, 22 nt, Homo sapiens
ucccagugcuaugcaaaagccu

SEQ ID NO: 201599 - RNA, 22 nt, Homo sapiens
ucccaguguguagcuugucucu

SEQ ID NO: 201600 - RNA, 22 nt, Homo sapiens
ucccauguagcuaggauuacag

SEQ ID NO: 201601 - RNA, 17 nt, Homo sapiens
ucccauguuucuucuac

SEQ ID NO: 201602 - RNA, 22 nt, Homo sapiens
uccccugagaccccucagcacu

SEQ ID NO: 201603 - RNA, 20 nt, Homo sapiens
ucccuaagagccuuuccuuc

SEQ ID NO: 201604 - RNA, 22 nt, Homo sapiens
ucccuagacuccugccuuucag

SEQ ID NO: 201605 - RNA, 19 nt, Homo sapiens
ucccugagucuuagcuuga

SEQ ID NO: 201606 - RNA, 22 nt, Homo sapiens
ucccugagugauugaaaauaaa

SEQ ID NO: 201607 - RNA, 22 nt, Homo sapiens
ucccugguguuaguuuguucuu

SEQ ID NO: 201608 - RNA, 22 nt, Homo sapiens
ucccuguguccugggggcaccu

SEQ ID NO: 201609 - RNA, 20 nt, Homo sapiens
uccugagauucccaguucuc

SEQ ID NO: 201610 - RNA, 22 nt, Homo sapiens
uccugcauucugacuugcuuuc

SEQ ID NO: 201611 - RNA, 22 nt, Homo sapiens
uccuucaugcaucaauguaucc

SEQ ID NO: 201612 - RNA, 22 nt, Homo sapiens
uccuugagucuuugcucagaug

SEQ ID NO: 201613 - RNA, 22 nt, Homo sapiens
uccuuuagacugaauccugaga

SEQ ID NO: 201614 - RNA, 22 nt, Homo sapiens
uccuuuggguagcuguucagau

SEQ ID NO: 201615 - RNA, 18 nt, Homo sapiens
uccuuuugggguaggaga

SEQ ID NO: 201616 - RNA, 19 nt, Homo sapiens
ucuaaaucucuugauagac

SEQ ID NO: 201617 - RNA, 22 nt, Homo sapiens
ucuaaugcucugagaacagugc

SEQ ID NO: 201618 - RNA, 22 nt, Homo sapiens
ucuaauguaaccugcaaauauu

SEQ ID NO: 201619 - RNA, 22 nt, Homo sapiens
ucucaaguggucgcaguuagau

SEQ ID NO: 201620 - RNA, 22 nt, Homo sapiens
ucucaauuugauuacauucaua

SEQ ID NO: 201621 - RNA, 18 nt, Homo sapiens
ucucacagcaaucuguca

SEQ ID NO: 201622 - RNA, 19 nt, Homo sapiens
ucucacagcucuacuaugu

SEQ ID NO: 201623 - RNA, 22 nt, Homo sapiens
ucucagugaaauaaauuauuuu

SEQ ID NO: 201624 - RNA, 22 nt, Homo sapiens
ucucaguggcuuccucacuuuu

SEQ ID NO: 201625 - RNA, 22 nt, Homo sapiens
ucucaguggugcuggcagggga

SEQ ID NO: 201626 - RNA, 19 nt, Homo sapiens
ucucaguguuggucaggug

SEQ ID NO: 201627 - RNA, 22 nt, Homo sapiens
ucucauagaggcagagaguaaa

SEQ ID NO: 201628 - RNA, 20 nt, Homo sapiens
ucucauggagggaaagagca

SEQ ID NO: 201629 - RNA, 22 nt, Homo sapiens
ucucuagagagccugguguuca

SEQ ID NO: 201630 - RNA, 22 nt, Homo sapiens
ucucugagaaaaguuucuccca

SEQ ID NO: 201631 - RNA, 22 nt, Homo sapiens
ucucugguuuguggaaucuuag

SEQ ID NO: 201632 - RNA, 22 nt, Homo sapiens
ucucuguuuagagccagcaauu

SEQ ID NO: 201633 - RNA, 22 nt, Homo sapiens
ucucuguuugucuguuacuggu

SEQ ID NO: 201634 - RNA, 22 nt, Homo sapiens
ucugacaaugaacaaucuauag

SEQ ID NO: 201635 - RNA, 22 nt, Homo sapiens
ucugagguuacugcuuuguaga

SEQ ID NO: 201636 - RNA, 22 nt, Homo sapiens
ucugauggaguugccagggaga

SEQ ID NO: 201637 - RNA, 22 nt, Homo sapiens
ucugcaagucuaaacuagccau

SEQ ID NO: 201638 - RNA, 22 nt, Homo sapiens
ucugcauaucaugcagaacuau

SEQ ID NO: 201639 - RNA, 22 nt, Homo sapiens
ucugccuacugagcacacagug

SEQ ID NO: 201640 - RNA, 22 nt, Homo sapiens
ucuggagugugaaguggauaug

SEQ ID NO: 201641 - RNA, 23 nt, Homo sapiens
ucuggaucauucguagugccagc

SEQ ID NO: 201642 - RNA, 22 nt, Homo sapiens
ucuggcaagauauccauugcuu

SEQ ID NO: 201643 - RNA, 22 nt, Homo sapiens
ucuggccuacaaguaauuuuau

SEQ ID NO: 201644 - RNA, 15 nt, Homo sapiens
ucuggcucugucacu

SEQ ID NO: 201645 - RNA, 17 nt, Homo sapiens
ucuggcuuucacaccug

SEQ ID NO: 201646 - RNA, 22 nt, Homo sapiens
ugacugucuagauagagcuugg

SEQ ID NO: 201647 - RNA, 22 nt, Homo sapiens
ugagaacaugugauauuuggug

SEQ ID NO: 201648 - RNA, 22 nt, Homo sapiens
ugagaacauuccucuuccuggc

SEQ ID NO: 201649 - RNA, 22 nt, Homo sapiens
ugagaaccucugugugcccacu

SEQ ID NO: 201650 - RNA, 22 nt, Homo sapiens
ugagaagcauaccagugucugu

SEQ ID NO: 201651 - RNA, 22 nt, Homo sapiens
ugagaagugauauagaaguuaa

SEQ ID NO: 201652 - RNA, 22 nt, Homo sapiens
ugagaauauuuuccaugucuca

SEQ ID NO: 201653 - RNA, 22 nt, Homo sapiens
ugagacaaucucaucucaguga

SEQ ID NO: 201654 - RNA, 22 nt, Homo sapiens
ugagacauauuauacugcuuuu

SEQ ID NO: 201655 - RNA, 22 nt, Homo sapiens
ugagaccuuucauuucucagug

SEQ ID NO: 201656 - RNA, 22 nt, Homo sapiens
ugagacugaguuuccaucuugu

SEQ ID NO: 201657 - RNA, 22 nt, Homo sapiens
ugagagaugaacuauucuugaa

SEQ ID NO: 201658 - RNA, 22 nt, Homo sapiens
ugagagaugaacucugauaugu

SEQ ID NO: 201659 - RNA, 22 nt, Homo sapiens
ugagagaugauaaaauguuugu

SEQ ID NO: 201660 - RNA, 22 nt, Homo sapiens
ugagagcugcauucuugaaagc

SEQ ID NO: 201661 - RNA, 22 nt, Homo sapiens
ugagaggugaauggcaggcuca

SEQ ID NO: 201662 - RNA, 22 nt, Homo sapiens
ugagagucauacaaauaaaaau

SEQ ID NO: 201663 - RNA, 18 nt, Homo sapiens
ugagauacuagaauaggu

SEQ ID NO: 201664 - RNA, 22 nt, Homo sapiens
ugagauaguuguagauguacau

SEQ ID NO: 201665 - RNA, 22 nt, Homo sapiens
ugagaucaagauguuagggacu

SEQ ID NO: 201666 - RNA, 22 nt, Homo sapiens
ugagaucaugccacugcacuuc

SEQ ID NO: 201667 - RNA, 22 nt, Homo sapiens
ugagaucauguguggaccccag

SEQ ID NO: 201668 - RNA, 22 nt, Homo sapiens
ugagaucugucuuuauaguauu

SEQ ID NO: 201669 - RNA, 22 nt, Homo sapiens
ugagaucuuggaggcuuuguga

SEQ ID NO: 201670 - RNA, 22 nt, Homo sapiens
ugagaugaacuugauuguuuua

SEQ ID NO: 201671 - RNA, 22 nt, Homo sapiens
ugagaugagaaucaguucuaau

SEQ ID NO: 201672 - RNA, 22 nt, Homo sapiens
ugagaugagagaaugcuugccu

SEQ ID NO: 201673 - RNA, 22 nt, Homo sapiens
ugagaugagggaagccuaggca

SEQ ID NO: 201674 - RNA, 22 nt, Homo sapiens
ugagaugaguugcuggcucuga

SEQ ID NO: 201675 - RNA, 22 nt, Homo sapiens
ugagaugauagauauguuaauu

SEQ ID NO: 201676 - RNA, 22 nt, Homo sapiens
ugagauggaguuucacuuuugu

SEQ ID NO: 201677 - RNA, 22 nt, Homo sapiens
ugagauggaguuucgcucuugu

SEQ ID NO: 201678 - RNA, 22 nt, Homo sapiens
ugagauggguucugguccccug

SEQ ID NO: 201679 - RNA, 22 nt, Homo sapiens
ugagaugguaaauuuuuguugu

SEQ ID NO: 201680 - RNA, 22 nt, Homo sapiens
ugagaugugaagaucacaugaa

SEQ ID NO: 201681 - RNA, 22 nt, Homo sapiens
ugagauguuuguuucagugccu

SEQ ID NO: 201682 - RNA, 22 nt, Homo sapiens
ugagauuaaucuuuaaguaaga

SEQ ID NO: 201683 - RNA, 22 nt, Homo sapiens
ugagauuaucuugaucuugaaa

SEQ ID NO: 201684 - RNA, 22 nt, Homo sapiens
ugagcaauaaaguuacacaguu

SEQ ID NO: 201685 - RNA, 22 nt, Homo sapiens
ugagcacagcgugugggagagc

SEQ ID NO: 201686 - RNA, 22 nt, Homo sapiens
ugagcagaaagcugcaaggucg

SEQ ID NO: 201687 - RNA, 22 nt, Homo sapiens
ugagcagagggagaaguaaauu

SEQ ID NO: 201688 - RNA, 22 nt, Homo sapiens
ugagccaaguucacaccauugc

SEQ ID NO: 201689 - RNA, 22 nt, Homo sapiens
ugagcuacuacacccagcuugg

SEQ ID NO: 201690 - RNA, 22 nt, Homo sapiens
ugagcugagaucacacuacugu

SEQ ID NO: 201691 - RNA, 22 nt, Homo sapiens
ugagcugguacuaauauuauca

SEQ ID NO: 201692 - RNA, 22 nt, Homo sapiens
ugaggaauguguguuaaagaua

SEQ ID NO: 201693 - RNA, 22 nt, Homo sapiens
ugaggacugagaggcacugugg

SEQ ID NO: 201694 - RNA, 22 nt, Homo sapiens
ugaggucacuuguuuuaugcuu

SEQ ID NO: 201695 - RNA, 22 nt, Homo sapiens
ugaggucauguucugucagguu

SEQ ID NO: 201696 - RNA, 22 nt, Homo sapiens
ugagguguauugggggaaauuc

SEQ ID NO: 201697 - RNA, 22 nt, Homo sapiens
ugaguagaacuccuggagaugu

SEQ ID NO: 201698 - RNA, 22 nt, Homo sapiens
ugaguagagaauucagcuaagg

SEQ ID NO: 201699 - RNA, 22 nt, Homo sapiens
ugaguagcuaagacgauaggca

SEQ ID NO: 201700 - RNA, 19 nt, Homo sapiens
ugaguauauuguauucauu

SEQ ID NO: 201701 - RNA, 22 nt, Homo sapiens
ugaguaucuugaugaauuugaa

SEQ ID NO: 201702 - RNA, 22 nt, Homo sapiens
ugaguauguuuaaugugacaau

SEQ ID NO: 201703 - RNA, 22 nt, Homo sapiens
ugagucaauucuaacaauggca

SEQ ID NO: 201704 - RNA, 22 nt, Homo sapiens
ugagugaaggggcucuguugug

SEQ ID NO: 201705 - RNA, 22 nt, Homo sapiens
ugagugaggcugggcagucccu

SEQ ID NO: 201706 - RNA, 22 nt, Homo sapiens
ugauacuggcuucauagaauga

SEQ ID NO: 201707 - RNA, 22 nt, Homo sapiens
ugauauguaacuacuccuuaua

SEQ ID NO: 201708 - RNA, 22 nt, Homo sapiens
ugauauguagguggcaagcaua

SEQ ID NO: 201709 - RNA, 22 nt, Homo sapiens
ugauauguaugugaccuagaaa

SEQ ID NO: 201710 - RNA, 22 nt, Homo sapiens
ugauauguggcuauugagauug

SEQ ID NO: 201711 - RNA, 22 nt, Homo sapiens
ugauauguguaaacaauguaua

SEQ ID NO: 201712 - RNA, 22 nt, Homo sapiens
ugaucugucacuuaucacauuu

SEQ ID NO: 201713 - RNA, 22 nt, Homo sapiens
ugaucuuuuuaauguccauggg

SEQ ID NO: 201714 - RNA, 22 nt, Homo sapiens
ugaugacacugauuucuucaau

SEQ ID NO: 201715 - RNA, 22 nt, Homo sapiens
ugauggcauuuggaguugggac

SEQ ID NO: 201716 - RNA, 22 nt, Homo sapiens
ugaugguuuuaaaaagaggagu

SEQ ID NO: 201717 - RNA, 22 nt, Homo sapiens
ugaugucuugcaggcacgagau

SEQ ID NO: 201718 - RNA, 22 nt, Homo sapiens
ugauugacauucuuuggaguau

SEQ ID NO: 201719 - RNA, 20 nt, Homo sapiens
ugauugaccagagcaguuuu

SEQ ID NO: 201720 - RNA, 22 nt, Homo sapiens
ugauugucucuccugccccauc

SEQ ID NO: 201721 - RNA, 22 nt, Homo sapiens
ugugagacugguucugaaccca

SEQ ID NO: 201722 - RNA, 20 nt, Homo sapiens
ugugagacugguuuugaacu

SEQ ID NO: 201723 - RNA, 22 nt, Homo sapiens
ugugaugaagaguccaagaaca

SEQ ID NO: 201724 - RNA, 22 nt, Homo sapiens
ugugaugauuugauaaacguau

SEQ ID NO: 201725 - RNA, 20 nt, Homo sapiens
ugugauuauuuaguugcaug

SEQ ID NO: 201726 - RNA, 22 nt, Homo sapiens
ugugcaaggcucucaaccugug

SEQ ID NO: 201727 - RNA, 22 nt, Homo sapiens
ugugcaaucagcuucauuacau

SEQ ID NO: 201728 - RNA, 22 nt, Homo sapiens
ugugcacauaacauuuuuuuag

SEQ ID NO: 201729 - RNA, 22 nt, Homo sapiens
ugugcacaugauauaucacaua

SEQ ID NO: 201730 - RNA, 22 nt, Homo sapiens
ugugcaugacagcauacaaacg

SEQ ID NO: 201731 - RNA, 22 nt, Homo sapiens
ugugccacuguucuguaaagug

SEQ ID NO: 201732 - RNA, 22 nt, Homo sapiens
ugugccuaguaauguguccaga

SEQ ID NO: 201733 - RNA, 22 nt, Homo sapiens
ugugcuugcuucuucuccuagu

SEQ ID NO: 201734 - RNA, 22 nt, Homo sapiens
ugugcuuguaaaggccagagca

SEQ ID NO: 201735 - RNA, 22 nt, Homo sapiens
uguggcuuuacagcaugguuca

SEQ ID NO: 201736 - RNA, 22 nt, Homo sapiens
ugugguagugcuuaccugcagu

SEQ ID NO: 201737 - RNA, 22 nt, Homo sapiens
uguguagagaaauauuacuuau

SEQ ID NO: 201738 - RNA, 22 nt, Homo sapiens
uguguauaucacugcaugagug

SEQ ID NO: 201739 - RNA, 21 nt, Homo sapiens
uguuaacaugcagauuacugg

SEQ ID NO: 201740 - RNA, 22 nt, Homo sapiens
uguuaguuguucauguuaagag

SEQ ID NO: 201741 - RNA, 22 nt, Homo sapiens
uguuauuuuguguuagggcaca

SEQ ID NO: 201742 - RNA, 22 nt, Homo sapiens
uguucacaguguuucuuugaga

SEQ ID NO: 201743 - RNA, 22 nt, Homo sapiens
uguucaugaguucucauuuuua

SEQ ID NO: 201744 - RNA, 22 nt, Homo sapiens
uguucuggagaggcaggccaca

SEQ ID NO: 201745 - RNA, 22 nt, Homo sapiens
uguucuggagaguuuagucugg

SEQ ID NO: 201746 - RNA, 22 nt, Homo sapiens
uguuuaguuaagacauagaauu

SEQ ID NO: 201747 - RNA, 22 nt, Homo sapiens
uguuucuacugucucuguagua

SEQ ID NO: 201748 - RNA, 22 nt, Homo sapiens
uuaaagccauaccugagagagu

SEQ ID NO: 201749 - RNA, 22 nt, Homo sapiens
uuaaagcuggcguuacaguuug

SEQ ID NO: 201750 - RNA, 22 nt, Homo sapiens
uuaaaguguuuucaaaauguca

SEQ ID NO: 201751 - RNA, 22 nt, Homo sapiens
uuaaggcauucuuugucuucau

SEQ ID NO: 201752 - RNA, 22 nt, Homo sapiens
uuaaggcuccuguuggcuuuua

SEQ ID NO: 201753 - RNA, 22 nt, Homo sapiens
uuaaggcuuguacuuguuuucu

SEQ ID NO: 201754 - RNA, 22 nt, Homo sapiens
uuaaguaaucagagaagagaac

SEQ ID NO: 201755 - RNA, 19 nt, Homo sapiens
uuaaguaguuagagggucu

SEQ ID NO: 201756 - RNA, 22 nt, Homo sapiens
uuaagugguagguggugcccaa

SEQ ID NO: 201757 - RNA, 21 nt, Homo sapiens
uuaaugcuaugcagaaaaucu

SEQ ID NO: 201758 - RNA, 22 nt, Homo sapiens
uuaauguaucuaucacaucaca

SEQ ID NO: 201759 - RNA, 22 nt, Homo sapiens
uuaauucugucugcccucaucc

SEQ ID NO: 201760 - RNA, 22 nt, Homo sapiens
uuacaagaugucuguccaacac

SEQ ID NO: 201761 - RNA, 22 nt, Homo sapiens
uuacacaguugguaggggcaga

SEQ ID NO: 201762 - RNA, 22 nt, Homo sapiens
uuacagcugcuccccaucacuc

SEQ ID NO: 201763 - RNA, 22 nt, Homo sapiens
uuacaguggugaccuuguauug

SEQ ID NO: 201764 - RNA, 22 nt, Homo sapiens
uuacaguugugagccaccaugc

SEQ ID NO: 201765 - RNA, 19 nt, Homo sapiens
uuagagaucaucugcuuca

SEQ ID NO: 201766 - RNA, 22 nt, Homo sapiens
uuagaguacaggggaaucaagg

SEQ ID NO: 201767 - RNA, 22 nt, Homo sapiens
uuagaugaagucacagaaccca

SEQ ID NO: 201768 - RNA, 22 nt, Homo sapiens
uuagauguuugacugggccuua

SEQ ID NO: 201769 - RNA, 22 nt, Homo sapiens
uuagcacauuuccagcacaugg

SEQ ID NO: 201770 - RNA, 22 nt, Homo sapiens
uuagcacugagaauggcuugcu

SEQ ID NO: 201771 - RNA, 22 nt, Homo sapiens
uuaggacaauguucguuuuuug

SEQ ID NO: 201772 - RNA, 22 nt, Homo sapiens
uuaggaucacagaaaauccucu

SEQ ID NO: 201773 - RNA, 22 nt, Homo sapiens
uuaggucaucgcuguccuucag

SEQ ID NO: 201774 - RNA, 22 nt, Homo sapiens
uuaguaguugugauagguaccu

SEQ ID NO: 201775 - RNA, 22 nt, Homo sapiens
uuagucaaguguacugugaaug

SEQ ID NO: 201776 - RNA, 20 nt, Homo sapiens
uuauaacuuuuguucugggg

SEQ ID NO: 201777 - RNA, 22 nt, Homo sapiens
uuauacacugugggaguguaaa

SEQ ID NO: 201778 - RNA, 22 nt, Homo sapiens
uuauacuacuauaaagagguag

SEQ ID NO: 201779 - RNA, 19 nt, Homo sapiens
uuauacuguauuguuuagg

SEQ ID NO: 201780 - RNA, 22 nt, Homo sapiens
uuauagcacuaagaagguaaua

SEQ ID NO: 201781 - RNA, 20 nt, Homo sapiens
uuauagcuacaucuugacug

SEQ ID NO: 201782 - RNA, 21 nt, Homo sapiens
uuauaguggcaugauuuauaa

SEQ ID NO: 201783 - RNA, 22 nt, Homo sapiens
uuaucucaguguuuguaaacaa

SEQ ID NO: 201784 - RNA, 22 nt, Homo sapiens
uuauggauuuauauucuguagu

SEQ ID NO: 201785 - RNA, 22 nt, Homo sapiens
uuaugggucuuggaaugcaaua

SEQ ID NO: 201786 - RNA, 22 nt, Homo sapiens
uucaaaggauagauuaagauca

SEQ ID NO: 201787 - RNA, 22 nt, Homo sapiens
uucaagaauuaaaguggcuuuu

SEQ ID NO: 201788 - RNA, 22 nt, Homo sapiens
uucaagauggccccagugagcc

SEQ ID NO: 201789 - RNA, 22 nt, Homo sapiens
uucaaguaguucucaugccuca

SEQ ID NO: 201790 - RNA, 22 nt, Homo sapiens
uucaagucaaggaaagaggucu

SEQ ID NO: 201791 - RNA, 20 nt, Homo sapiens
uucaagugauucucaugccu

SEQ ID NO: 201792 - RNA, 22 nt, Homo sapiens
uucaaguguucaggagcuacag

SEQ ID NO: 201793 - RNA, 22 nt, Homo sapiens
uucaauacuguugauccuuaug

SEQ ID NO: 201794 - RNA, 22 nt, Homo sapiens
uucacacugggccuacucugug

SEQ ID NO: 201795 - RNA, 22 nt, Homo sapiens
uucacagaguuauuuuuaugcu

SEQ ID NO: 201796 - RNA, 22 nt, Homo sapiens
cugauaaguuuuucuuuauaag

SEQ ID NO: 201797 - RNA, 22 nt, Homo sapiens
cugcaagaaucguaguauuuga

SEQ ID NO: 201798 - RNA, 22 nt, Homo sapiens
cugcagaucuuggggcuugcca

SEQ ID NO: 201799 - RNA, 21 nt, Homo sapiens
cugcauccauuucugagugau

SEQ ID NO: 201800 - RNA, 22 nt, Homo sapiens
cugcauuggguuaugcauuuuu

SEQ ID NO: 201801 - RNA, 22 nt, Homo sapiens
cuggaaagcaaagggugcauug

SEQ ID NO: 201802 - RNA, 22 nt, Homo sapiens
cuggaaugugagccccaaaaag

SEQ ID NO: 201803 - RNA, 22 nt, Homo sapiens
cuggagauauuggaagaaagaa

SEQ ID NO: 201804 - RNA, 22 nt, Homo sapiens
cuggcaagagugaaccagcugu

SEQ ID NO: 201805 - RNA, 22 nt, Homo sapiens
cuggcacagugucagaaacaca

SEQ ID NO: 201806 - RNA, 22 nt, Homo sapiens
auacauguucaagggcauauau

SEQ ID NO: 201807 - RNA, 22 nt, Homo sapiens
auagagguagacagaggggaaa

SEQ ID NO: 201808 - RNA, 22 nt, Homo sapiens
auagaucauugucauuuuagau

SEQ ID NO: 201809 - RNA, 22 nt, Homo sapiens
auagcacauggcauccucucuu

SEQ ID NO: 201810 - RNA, 22 nt, Homo sapiens
auagguuuucacuguagauucu

SEQ ID NO: 201811 - RNA, 22 nt, Homo sapiens
auagugcugcaauaaccauggg

SEQ ID NO: 201812 - RNA, 22 nt, Homo sapiens
auagugcugcaaucaacauaca

SEQ ID NO: 201813 - RNA, 22 nt, Homo sapiens
auagugcugcaauuaacauaca

SEQ ID NO: 201814 - RNA, 22 nt, Homo sapiens
auagugcugugaugaacauaca

SEQ ID NO: 201815 - RNA, 19 nt, Homo sapiens
auaguguaggaaaacagcu

SEQ ID NO: 201816 - RNA, 22 nt, Homo sapiens
auaugcaaauccauagagacag

SEQ ID NO: 201817 - RNA, 17 nt, Homo sapiens
auaugucugcuggggga

SEQ ID NO: 201818 - RNA, 22 nt, Homo sapiens
auaugugacuucaugcaaggcu

SEQ ID NO: 201819 - RNA, 21 nt, Homo sapiens
auaugugcuguggaagucagc

SEQ ID NO: 201820 - RNA, 18 nt, Homo sapiens
auauugcauuggauggau

SEQ ID NO: 201821 - RNA, 22 nt, Homo sapiens
aucaaaguaucucaauauggua

SEQ ID NO: 201822 - RNA, 22 nt, Homo sapiens
aucaaaguuucccagaaguugu

SEQ ID NO: 201823 - RNA, 22 nt, Homo sapiens
aucaaaucuccagaaccugucu

SEQ ID NO: 201824 - RNA, 22 nt, Homo sapiens
aucaaauugucauuuuaaggau

SEQ ID NO: 201825 - RNA, 22 nt, Homo sapiens
aucaagcugcuuguuugaaucu

SEQ ID NO: 201826 - RNA, 22 nt, Homo sapiens
aucacacuguuauuuuaguuaa

SEQ ID NO: 201827 - RNA, 22 nt, Homo sapiens
aucacagaacuuugagcagaga

SEQ ID NO: 201828 - RNA, 22 nt, Homo sapiens
aucacagauauggguuuaaauc

SEQ ID NO: 201829 - RNA, 22 nt, Homo sapiens
aucacaguggcucacaagagcc

SEQ ID NO: 201830 - RNA, 22 nt, Homo sapiens
aucacauggccagguaguaauc

SEQ ID NO: 201831 - RNA, 19 nt, Homo sapiens
aucaccagucuuuccacug

SEQ ID NO: 201832 - RNA, 22 nt, Homo sapiens
aucaccugagcaguauacacug

SEQ ID NO: 201833 - RNA, 20 nt, Homo sapiens
aucacuggagaaggaaaccu

SEQ ID NO: 201834 - RNA, 22 nt, Homo sapiens
aucacugggagcagccauuaau

SEQ ID NO: 201835 - RNA, 22 nt, Homo sapiens
aucacuggucaugagagaagua

SEQ ID NO: 201836 - RNA, 22 nt, Homo sapiens
aucacuuucuauuucugugcca

SEQ ID NO: 201837 - RNA, 22 nt, Homo sapiens
aucagaaucucuugagaguguu

SEQ ID NO: 201838 - RNA, 22 nt, Homo sapiens
aucagagccugugugcccugaa

SEQ ID NO: 201839 - RNA, 22 nt, Homo sapiens
aucagauguuuguauaggagua

SEQ ID NO: 201840 - RNA, 22 nt, Homo sapiens
aucagcaugcagaagucggggg

SEQ ID NO: 201841 - RNA, 22 nt, Homo sapiens
aucaggaaccuuuuuggugugu

SEQ ID NO: 201842 - RNA, 22 nt, Homo sapiens
aucagugaaagugaaaucuccg

SEQ ID NO: 201843 - RNA, 22 nt, Homo sapiens
aucagugagugguuagugaaug

SEQ ID NO: 201844 - RNA, 22 nt, Homo sapiens
uacagucacauuccugaccaua

SEQ ID NO: 201845 - RNA, 22 nt, Homo sapiens
uacagucuggaggccuguguug

SEQ ID NO: 201846 - RNA, 22 nt, Homo sapiens
uacagugcuuuuugguggagaa

SEQ ID NO: 201847 - RNA, 22 nt, Homo sapiens
uacauacuucacagacuuuaaa

SEQ ID NO: 201848 - RNA, 20 nt, Homo sapiens
uacauaguaaacugagagca

SEQ ID NO: 201849 - RNA, 22 nt, Homo sapiens
uacaugcaugggcaugugugca

SEQ ID NO: 201850 - RNA, 22 nt, Homo sapiens
uacaugugcaggucuguggggg

SEQ ID NO: 201851 - RNA, 22 nt, Homo sapiens
uacaugugccauguugguuugc

SEQ ID NO: 201852 - RNA, 22 nt, Homo sapiens
uacauugucauauucucucucu

SEQ ID NO: 201853 - RNA, 22 nt, Homo sapiens
uaccacugccgagaaaacagau

SEQ ID NO: 201854 - RNA, 22 nt, Homo sapiens
uaccagcauuucucuuuaagua

SEQ ID NO: 201855 - RNA, 22 nt, Homo sapiens
uaccugagaaagaaagcccucg

SEQ ID NO: 201856 - RNA, 22 nt, Homo sapiens
uaccugagucuagagucuagaa

SEQ ID NO: 201857 - RNA, 22 nt, Homo sapiens
uacuacuuucugacaucuuuaa

SEQ ID NO: 201858 - RNA, 22 nt, Homo sapiens
uacuagaaccuuauucagagug

SEQ ID NO: 201859 - RNA, 22 nt, Homo sapiens
uacugcacucuagccuggguga

SEQ ID NO: 201860 - RNA, 20 nt, Homo sapiens
uacugcacuuuccucauggu

SEQ ID NO: 201861 - RNA, 22 nt, Homo sapiens
uacugcuuaaaagucaauuacu

SEQ ID NO: 201862 - RNA, 22 nt, Homo sapiens
uagaaucuaacucgcaugaaaa

SEQ ID NO: 201863 - RNA, 22 nt, Homo sapiens
uagaauguaacuuccaugucau

SEQ ID NO: 201864 - RNA, 22 nt, Homo sapiens
uagagcaaugacucuggaaacc

SEQ ID NO: 201865 - RNA, 22 nt, Homo sapiens
uagaguguuuuguuaggcagca

SEQ ID NO: 201866 - RNA, 22 nt, Homo sapiens
uagauaguaaagccauuagcuu

SEQ ID NO: 201867 - RNA, 22 nt, Homo sapiens
uagaucaauuaauuguuacuug

SEQ ID NO: 201868 - RNA, 22 nt, Homo sapiens
uagaucauauucagugcuuacu

SEQ ID NO: 201869 - RNA, 22 nt, Homo sapiens
uagauuaucauucauacaggga

SEQ ID NO: 201870 - RNA, 22 nt, Homo sapiens
uagauuaucccugauuugucca

SEQ ID NO: 201871 - RNA, 22 nt, Homo sapiens
uagcaaaucaauggaauugaag

SEQ ID NO: 201872 - RNA, 22 nt, Homo sapiens
uagcaacauucagcucagguac

SEQ ID NO: 201873 - RNA, 22 nt, Homo sapiens
uagcacaucccuaaaaugcugu

SEQ ID NO: 201874 - RNA, 20 nt, Homo sapiens
uagcacaucuggcuguagag

SEQ ID NO: 201875 - RNA, 22 nt, Homo sapiens
uagcaccuuagcauuucuagug

SEQ ID NO: 201876 - RNA, 23 nt, Homo sapiens
uagcacuuuuuacauauggacau

SEQ ID NO: 201877 - RNA, 22 nt, Homo sapiens
uagcagaauaacuugccagccu

SEQ ID NO: 201878 - RNA, 22 nt, Homo sapiens
uagcagcaaagcaggaucugcu

SEQ ID NO: 201879 - RNA, 19 nt, Homo sapiens
uagcagcaugauuuauaau

SEQ ID NO: 201880 - RNA, 22 nt, Homo sapiens
uagcagcauuuuuguagaguau

SEQ ID NO: 201881 - RNA, 22 nt, Homo sapiens
augauaucuuguuuuucaugca

SEQ ID NO: 201882 - RNA, 22 nt, Homo sapiens
augauguguguuuaagaugucu

SEQ ID NO: 201883 - RNA, 22 nt, Homo sapiens
augauugugaauaugugguuuu

SEQ ID NO: 201884 - RNA, 22 nt, Homo sapiens
augauuuuuguaucgccugaug

SEQ ID NO: 201885 - RNA, 22 nt, Homo sapiens
augcaaacaucugaagagacau

SEQ ID NO: 201886 - RNA, 20 nt, Homo sapiens
augcaaacccugcuuugugg

SEQ ID NO: 201887 - RNA, 22 nt, Homo sapiens
augcaagacaccgauuagcuuu

SEQ ID NO: 201888 - RNA, 22 nt, Homo sapiens
augcaagcacacaagaggaaau

SEQ ID NO: 201889 - RNA, 22 nt, Homo sapiens
augcacaguccagcccaugugg

SEQ ID NO: 201890 - RNA, 22 nt, Homo sapiens
augcagagucccagccccuagc

SEQ ID NO: 201891 - RNA, 22 nt, Homo sapiens
augcagauauuuuugugguugc

SEQ ID NO: 201892 - RNA, 22 nt, Homo sapiens
augcauagcaucugcaaauguu

SEQ ID NO: 201893 - RNA, 22 nt, Homo sapiens
augcauaugucuuuauaguggc

SEQ ID NO: 201894 - RNA, 19 nt, Homo sapiens
augccuggagaugguuaua

SEQ ID NO: 201895 - RNA, 22 nt, Homo sapiens
augcuacauucuacaauuaggc

SEQ ID NO: 201896 - RNA, 22 nt, Homo sapiens
augcuacuggauuuguauaaau

SEQ ID NO: 201897 - RNA, 22 nt, Homo sapiens
augcuguuuugaauucucuaga

SEQ ID NO: 201898 - RNA, 22 nt, Homo sapiens
augcuuguguuggggcagugga

SEQ ID NO: 201899 - RNA, 22 nt, Homo sapiens
auggaaacauaagaguauagau

SEQ ID NO: 201900 - RNA, 21 nt, Homo sapiens
auggaaagacugccucuucaa

SEQ ID NO: 201901 - RNA, 22 nt, Homo sapiens
auggaacauaacuauuugggga

SEQ ID NO: 201902 - RNA, 19 nt, Homo sapiens
auggaacugcuggagccac

SEQ ID NO: 201903 - RNA, 22 nt, Homo sapiens
auggaagaaacgauuuucugga

SEQ ID NO: 201904 - RNA, 22 nt, Homo sapiens
auggaagaauugucggggaugu

SEQ ID NO: 201905 - RNA, 22 nt, Homo sapiens
auggaagcugauuagauaguac

SEQ ID NO: 201906 - RNA, 22 nt, Homo sapiens
auggaauguggaaugguaagua

SEQ ID NO: 201907 - RNA, 22 nt, Homo sapiens
auggacagaaaaaaauagaugu

SEQ ID NO: 201908 - RNA, 22 nt, Homo sapiens
auggacagacacuggccuucug

SEQ ID NO: 201909 - RNA, 22 nt, Homo sapiens
auggaguguaauauugagagcu

SEQ ID NO: 201910 - RNA, 22 nt, Homo sapiens
auggaguguggaacugggaauc

SEQ ID NO: 201911 - RNA, 22 nt, Homo sapiens
auggauagucucacucacauac

SEQ ID NO: 201912 - RNA, 22 nt, Homo sapiens
auggauaugcuuccaacugccu

SEQ ID NO: 201913 - RNA, 22 nt, Homo sapiens
auggcaauaugaugcacuguuu

SEQ ID NO: 201914 - RNA, 22 nt, Homo sapiens
auggcacucaaucaaguugaga

SEQ ID NO: 201915 - RNA, 22 nt, Homo sapiens
uauugaauuugagcugucucuu

SEQ ID NO: 201916 - RNA, 22 nt, Homo sapiens
uauugaauuuuuaagcccuuug

SEQ ID NO: 201917 - RNA, 22 nt, Homo sapiens
uauugacauuacagugggucuu

SEQ ID NO: 201918 - RNA, 17 nt, Homo sapiens
uauugaccuuuguaugu

SEQ ID NO: 201919 - RNA, 22 nt, Homo sapiens
uauugcaacagaagaaagaguc

SEQ ID NO: 201920 - RNA, 22 nt, Homo sapiens
uauugcaauuggcagagugcua

SEQ ID NO: 201921 - RNA, 22 nt, Homo sapiens
uauugcaauuggggaaacuggg

SEQ ID NO: 201922 - RNA, 22 nt, Homo sapiens
uauugcacuccagccuuggcaa

SEQ ID NO: 201923 - RNA, 22 nt, Homo sapiens
uauugcacuccucaugcauuug

SEQ ID NO: 201924 - RNA, 22 nt, Homo sapiens
uauugcagugagauccaucugg

SEQ ID NO: 201925 - RNA, 22 nt, Homo sapiens
uauugcauauuauucuaguggc

SEQ ID NO: 201926 - RNA, 22 nt, Homo sapiens
uauugcccugcuuuguucuaaa

SEQ ID NO: 201927 - RNA, 22 nt, Homo sapiens
uauugcuaaauucuuuuccuag

SEQ ID NO: 201928 - RNA, 22 nt, Homo sapiens
uauugcuugaggaaaugguaau

SEQ ID NO: 201929 - RNA, 22 nt, Homo sapiens
uauugcuuuugauucaaggcag

SEQ ID NO: 201930 - RNA, 22 nt, Homo sapiens
uauuguacauauccucccuuca

SEQ ID NO: 201931 - RNA, 22 nt, Homo sapiens
uauuguuuuucccaggagucua

SEQ ID NO: 201932 - RNA, 22 nt, Homo sapiens
uauuucccuuaacuuuccugca

SEQ ID NO: 201933 - RNA, 22 nt, Homo sapiens
ucaaagacacacaaggagaagg

SEQ ID NO: 201934 - RNA, 22 nt, Homo sapiens
ucaaaguaaagccucaggaugg

SEQ ID NO: 201935 - RNA, 22 nt, Homo sapiens
ucaaauuccaagucuagguagg

SEQ ID NO: 201936 - RNA, 22 nt, Homo sapiens
ucaacauugcugucaggcaucu

SEQ ID NO: 201937 - RNA, 21 nt, Homo sapiens
ucaacccuugcgucaccaagc

SEQ ID NO: 201938 - RNA, 22 nt, Homo sapiens
ucaagcaauucuccugccucag

SEQ ID NO: 201939 - RNA, 22 nt, Homo sapiens
ucaagcaauucugcugccucag

SEQ ID NO: 201940 - RNA, 22 nt, Homo sapiens
ucaaggcacauuugacauuuuc

SEQ ID NO: 201941 - RNA, 22 nt, Homo sapiens
ucaaggcacuagcugagcugca

SEQ ID NO: 201942 - RNA, 22 nt, Homo sapiens
ucaaggcaguggccuuccuucu

SEQ ID NO: 201943 - RNA, 22 nt, Homo sapiens
ucaagguacguugccucagauu

SEQ ID NO: 201944 - RNA, 22 nt, Homo sapiens
ucaaguaagaagugggcauaaa

SEQ ID NO: 201945 - RNA, 22 nt, Homo sapiens
ucaaguaauacucccaucuugg

SEQ ID NO: 201946 - RNA, 23 nt, Homo sapiens
ucaagugaugguggccacaaggg

SEQ ID NO: 201947 - RNA, 22 nt, Homo sapiens
auggcagaaucaagccgacagc

SEQ ID NO: 201948 - RNA, 22 nt, Homo sapiens
auggcagagucagaaagucagg

SEQ ID NO: 201949 - RNA, 22 nt, Homo sapiens
auggcagcaccccacucuacug

SEQ ID NO: 201950 - RNA, 22 nt, Homo sapiens
auggcagugagucucuaguauu

SEQ ID NO: 201951 - RNA, 22 nt, Homo sapiens
auggcaguguaugauuauauua

SEQ ID NO: 201952 - RNA, 22 nt, Homo sapiens
auggcaguuucagcuauaguuu

SEQ ID NO: 201953 - RNA, 22 nt, Homo sapiens
auggcauggugaagucuuugga

SEQ ID NO: 201954 - RNA, 22 nt, Homo sapiens
auggccauuacuaagaauguuu

SEQ ID NO: 201955 - RNA, 20 nt, Homo sapiens
auggcccugcugggaguguc

SEQ ID NO: 201956 - RNA, 22 nt, Homo sapiens
auggcccugggaaaggaggcau

SEQ ID NO: 201957 - RNA, 22 nt, Homo sapiens
auggccuuguauaccuggcaaa

SEQ ID NO: 201958 - RNA, 22 nt, Homo sapiens
auggccuuucuggcacauuucc

SEQ ID NO: 201959 - RNA, 22 nt, Homo sapiens
auggcuucuuacucuucugcau

SEQ ID NO: 201960 - RNA, 22 nt, Homo sapiens
auggcuuugggcugcucugccc

SEQ ID NO: 201961 - RNA, 22 nt, Homo sapiens
auggcuuuuccugucuugcaug

SEQ ID NO: 201962 - RNA, 22 nt, Homo sapiens
augggacugggugccguggagc

SEQ ID NO: 201963 - RNA, 22 nt, Homo sapiens
augggagugugguuagagaccu

SEQ ID NO: 201964 - RNA, 21 nt, Homo sapiens
augggguagaagagaaggcuu

SEQ ID NO: 201965 - RNA, 22 nt, Homo sapiens
augggucuccugaauacagcac

SEQ ID NO: 201966 - RNA, 22 nt, Homo sapiens
augggugaguaugaguugacuu

SEQ ID NO: 201967 - RNA, 22 nt, Homo sapiens
auggucuuuucccuggauuaua

SEQ ID NO: 201968 - RNA, 22 nt, Homo sapiens
auggucuuuuuguuaugagaga

SEQ ID NO: 201969 - RNA, 22 nt, Homo sapiens
augguguccuguuuccccagga

SEQ ID NO: 201970 - RNA, 22 nt, Homo sapiens
auguaaacagaugugcagcuug

SEQ ID NO: 201971 - RNA, 22 nt, Homo sapiens
auguaaacuacagauuuugggu

SEQ ID NO: 201972 - RNA, 21 nt, Homo sapiens
auguaaugaagaagccacugg

SEQ ID NO: 201973 - RNA, 22 nt, Homo sapiens
auguaguagcagaaaauauuuu

SEQ ID NO: 201974 - RNA, 22 nt, Homo sapiens
auguaguauuaaugagagauaa

SEQ ID NO: 201975 - RNA, 22 nt, Homo sapiens
augucaacauagacaguagagu

SEQ ID NO: 201976 - RNA, 20 nt, Homo sapiens
augucagaguguggguacgg

SEQ ID NO: 201977 - RNA, 22 nt, Homo sapiens
auguccauggaaucuguagcaa

SEQ ID NO: 201978 - RNA, 22 nt, Homo sapiens
auguccuggacccagacaaagc

SEQ ID NO: 201979 - RNA, 22 nt, Homo sapiens
augugacuuuuuccugugccuu

SEQ ID NO: 201980 - RNA, 22 nt, Homo sapiens
augugaugguuaauuuuaugug

SEQ ID NO: 201981 - RNA, 22 nt, Homo sapiens
augugcaaagcacuguucagca

SEQ ID NO: 201982 - RNA, 22 nt, Homo sapiens
augugcaaaguuaagaucccag

SEQ ID NO: 201983 - RNA, 18 nt, Homo sapiens
augugcaauuuuguauuu

SEQ ID NO: 201984 - RNA, 22 nt, Homo sapiens
augugcacaacgugcagguuug

SEQ ID NO: 201985 - RNA, 22 nt, Homo sapiens
augugcacaugcuuacauguga

SEQ ID NO: 201986 - RNA, 21 nt, Homo sapiens
augugcacuaugucauuuaau

SEQ ID NO: 201987 - RNA, 22 nt, Homo sapiens
augugccaauuaggauuccaag

SEQ ID NO: 201988 - RNA, 22 nt, Homo sapiens
augugcuuuuuaaacagaugcu

SEQ ID NO: 201989 - RNA, 22 nt, Homo sapiens
augugggaggacuuggcuguug

SEQ ID NO: 201990 - RNA, 22 nt, Homo sapiens
ucauauguaugugcaauuuugu

SEQ ID NO: 201991 - RNA, 21 nt, Homo sapiens
ucaucaagcuguagacaugau

SEQ ID NO: 201992 - RNA, 21 nt, Homo sapiens
ucaucagucaaagacaauggu

SEQ ID NO: 201993 - RNA, 22 nt, Homo sapiens
ucaucucaguuucuugccguac

SEQ ID NO: 201994 - RNA, 22 nt, Homo sapiens
ucaugcaaugagucaggaggca

SEQ ID NO: 201995 - RNA, 22 nt, Homo sapiens
ucauggcuuuuauuauguugag

SEQ ID NO: 201996 - RNA, 23 nt, Homo sapiens
ucauguauucccuguaaugggua

SEQ ID NO: 201997 - RNA, 19 nt, Homo sapiens
ucaugugcauacauuuggg

SEQ ID NO: 201998 - RNA, 22 nt, Homo sapiens
ucauucauucauccagcuugag

SEQ ID NO: 201999 - RNA, 22 nt, Homo sapiens
ucauugguagcucauggaaccg

SEQ ID NO: 202000 - RNA, 18 nt, Homo sapiens
ucauuggugagcaccucc

SEQ ID NO: 202001 - RNA, 21 nt, Homo sapiens
ucauugguuggcugcccugua

SEQ ID NO: 202002 - RNA, 22 nt, Homo sapiens
uccacaguggugaggugcagca

SEQ ID NO: 202003 - RNA, 22 nt, Homo sapiens
uccacugagcuagaccacuugg

SEQ ID NO: 202004 - RNA, 22 nt, Homo sapiens
uccagaguggugaugcuggggc

SEQ ID NO: 202005 - RNA, 21 nt, Homo sapiens
uccagcuuugagaguuguggu

SEQ ID NO: 202006 - RNA, 22 nt, Homo sapiens
uccagguuucaugcucuuuauu

SEQ ID NO: 202007 - RNA, 22 nt, Homo sapiens
uccagguuuggcuuuauaacuu

SEQ ID NO: 202008 - RNA, 22 nt, Homo sapiens
uccaguacaggucucucauuuc

SEQ ID NO: 202009 - RNA, 22 nt, Homo sapiens
uccauggagacacauuuuauau

SEQ ID NO: 202010 - RNA, 22 nt, Homo sapiens
uccauugucuagauguaacaca

SEQ ID NO: 202011 - RNA, 23 nt, Homo sapiens
ucccaagauggaccagaccaagg

SEQ ID NO: 202012 - RNA, 22 nt, Homo sapiens
ucccacugucuucucgugcucg

SEQ ID NO: 202013 - RNA, 22 nt, Homo sapiens
ucccaguggucuugaaacaggg

SEQ ID NO: 202014 - RNA, 22 nt, Homo sapiens
ucccaguuuuucugaauaguca

SEQ ID NO: 202015 - RNA, 22 nt, Homo sapiens
uccccgaggcuggagugcagug

SEQ ID NO: 202016 - RNA, 22 nt, Homo sapiens
ucccuagagaagugauuuuuga

SEQ ID NO: 202017 - RNA, 22 nt, Homo sapiens
ucccugaaagcugagauuggaa

SEQ ID NO: 202018 - RNA, 22 nt, Homo sapiens
auugagcaauuccuaugugcuu

SEQ ID NO: 202019 - RNA, 22 nt, Homo sapiens
auugagcacugacucugugcca

SEQ ID NO: 202020 - RNA, 18 nt, Homo sapiens
auugagcaugacagaccu

SEQ ID NO: 202021 - RNA, 21 nt, Homo sapiens
auugcacaauauacccaugua

SEQ ID NO: 202022 - RNA, 22 nt, Homo sapiens
auugcacuccagccuagguaac

SEQ ID NO: 202023 - RNA, 22 nt, Homo sapiens
auugcacuccagccugggcaac

SEQ ID NO: 202024 - RNA, 22 nt, Homo sapiens
auugcacuccagccugggcagc

SEQ ID NO: 202025 - RNA, 22 nt, Homo sapiens
auugcacucugaucugcacucc

SEQ ID NO: 202026 - RNA, 22 nt, Homo sapiens
auugcccaggcuggagugcagu

SEQ ID NO: 202027 - RNA, 21 nt, Homo sapiens
auugcgcuccagccuccuggg

SEQ ID NO: 202028 - RNA, 22 nt, Homo sapiens
auugcugagacauugcuaaucu

SEQ ID NO: 202029 - RNA, 22 nt, Homo sapiens
auugcuuacuaaucaucuucag

SEQ ID NO: 202030 - RNA, 22 nt, Homo sapiens
auugcuuuuacugggagcuuug

SEQ ID NO: 202031 - RNA, 22 nt, Homo sapiens
auuggcuauuuggugagugauu

SEQ ID NO: 202032 - RNA, 22 nt, Homo sapiens
auuggcuuuugaaagucugcga

SEQ ID NO: 202033 - RNA, 22 nt, Homo sapiens
auuuccuguaggggcuugcgaa

SEQ ID NO: 202034 - RNA, 22 nt, Homo sapiens
auuuggcauagaguaucauucu

SEQ ID NO: 202035 - RNA, 22 nt, Homo sapiens
auuuggguuuuacaucaggcua

SEQ ID NO: 202036 - RNA, 22 nt, Homo sapiens
auuugguaauauuuaaggacuu

SEQ ID NO: 202037 - RNA, 22 nt, Homo sapiens
auuugucacuauguggcuaaua

SEQ ID NO: 202038 - RNA, 22 nt, Homo sapiens
auuuuugguugucagcacuagg

SEQ ID NO: 202039 - RNA, 22 nt, Homo sapiens
caaaggcuucugaaacugcaga

SEQ ID NO: 202040 - RNA, 22 nt, Homo sapiens
caaaguaauugugguuuugcca

SEQ ID NO: 202041 - RNA, 22 nt, Homo sapiens
caaagugcuggccgggcgcagu

SEQ ID NO: 202042 - RNA, 22 nt, Homo sapiens
caaauacuuucauguugucuug

SEQ ID NO: 202043 - RNA, 22 nt, Homo sapiens
caaauccucaccucaucaugaa

SEQ ID NO: 202044 - RNA, 22 nt, Homo sapiens
caaaugaucugcuggccucagc

SEQ ID NO: 202045 - RNA, 20 nt, Homo sapiens
caaauugcuuucuugguuuu

SEQ ID NO: 202046 - RNA, 22 nt, Homo sapiens
caacacagugaaacccgucucu

SEQ ID NO: 202047 - RNA, 22 nt, Homo sapiens
caacagucagcccauccacaga

SEQ ID NO: 202048 - RNA, 22 nt, Homo sapiens
caaggcacagccccuacuuccu

SEQ ID NO: 202049 - RNA, 22 nt, Homo sapiens
cacaaaguagauuagucuucca

SEQ ID NO: 202050 - RNA, 22 nt, Homo sapiens
cacaccuaccucauuauggaca

SEQ ID NO: 202051 - RNA, 22 nt, Homo sapiens
cacagagugagacccugucucu

SEQ ID NO: 202052 - RNA, 22 nt, Homo sapiens
cacagcuaacaacuguuucuuc

SEQ ID NO: 202053 - RNA, 22 nt, Homo sapiens
cacagugaacaauauccucugu

SEQ ID NO: 202054 - RNA, 22 nt, Homo sapiens
cacagugaaugucaucauugcc

SEQ ID NO: 202055 - RNA, 22 nt, Homo sapiens
cacaguugccuaucuccugaag

SEQ ID NO: 202056 - RNA, 22 nt, Homo sapiens
cacauagcuagucaguagugaa

SEQ ID NO: 202057 - RNA, 22 nt, Homo sapiens
cacauguucaggagcacuuaga

SEQ ID NO: 202058 - RNA, 22 nt, Homo sapiens
caccacagccauuauugucccc

SEQ ID NO: 202059 - RNA, 22 nt, Homo sapiens
caccacauuccauugaucaggc

SEQ ID NO: 202060 - RNA, 22 nt, Homo sapiens
caccagcuggcauugaauaccu

SEQ ID NO: 202061 - RNA, 22 nt, Homo sapiens
caccuguagucccagcugaggc

SEQ ID NO: 202062 - RNA, 22 nt, Homo sapiens
cacgugcuuucuuuucauuuag

SEQ ID NO: 202063 - RNA, 22 nt, Homo sapiens
cacuaccucuacaggcagcugg

SEQ ID NO: 202064 - RNA, 22 nt, Homo sapiens
cacugcacuccagccuaagagg

SEQ ID NO: 202065 - RNA, 22 nt, Homo sapiens
cacugcacuccagucuggcgac

SEQ ID NO: 202066 - RNA, 22 nt, Homo sapiens
cacugcauggucuagcuggguu

SEQ ID NO: 202067 - RNA, 22 nt, Homo sapiens
cacugcgaccuccaccucccgg

SEQ ID NO: 202068 - RNA, 21 nt, Homo sapiens
cacugguguugcuauaucaaa

SEQ ID NO: 202069 - RNA, 22 nt, Homo sapiens
cacuuugguucaccugaguuuc

SEQ ID NO: 202070 - RNA, 22 nt, Homo sapiens
cagagguauugcaaaagccuag

SEQ ID NO: 202071 - RNA, 22 nt, Homo sapiens
cagauaguuguagauaugcagc

SEQ ID NO: 202072 - RNA, 22 nt, Homo sapiens
cagaugguggucccacagccca

SEQ ID NO: 202073 - RNA, 22 nt, Homo sapiens
cagcacauagcaguugcucagu

SEQ ID NO: 202074 - RNA, 20 nt, Homo sapiens
cagcuagugguaggagucgg

SEQ ID NO: 202075 - RNA, 22 nt, Homo sapiens
cagcucuuguuaaaacuaacua

SEQ ID NO: 202076 - RNA, 22 nt, Homo sapiens
cagcugguggcaagaagacaga

SEQ ID NO: 202077 - RNA, 22 nt, Homo sapiens
cagcuggugggagcuggguucc

SEQ ID NO: 202078 - RNA, 22 nt, Homo sapiens
caggaccucuugccuggaagcc

SEQ ID NO: 202079 - RNA, 22 nt, Homo sapiens
cagguaguauuugguuacauaa

SEQ ID NO: 202080 - RNA, 22 nt, Homo sapiens
caggugaaugccucuccuucug

SEQ ID NO: 202081 - RNA, 22 nt, Homo sapiens
cagucacugggauuauggucau

SEQ ID NO: 202082 - RNA, 22 nt, Homo sapiens
cagugcuuguuauuguucuauu

SEQ ID NO: 202083 - RNA, 22 nt, Homo sapiens
cauaguacuugcauaguacuau

SEQ ID NO: 202084 - RNA, 22 nt, Homo sapiens
cauaugguuuuauguucuucau

SEQ ID NO: 202085 - RNA, 19 nt, Homo sapiens
caucacagagucuuccauu

SEQ ID NO: 202086 - RNA, 22 nt, Homo sapiens
caucacagcaaguagggagugg

SEQ ID NO: 202087 - RNA, 22 nt, Homo sapiens
caucacaugcuuauuuuccuca

SEQ ID NO: 202088 - RNA, 22 nt, Homo sapiens
caucccugucgucaagucucug

SEQ ID NO: 202089 - RNA, 22 nt, Homo sapiens
caucucauugaauugcugagca

SEQ ID NO: 202090 - RNA, 22 nt, Homo sapiens
caugaugcuagguauggaugaa

SEQ ID NO: 202091 - RNA, 22 nt, Homo sapiens
cacugggugagauccauguuua

SEQ ID NO: 202092 - RNA, 17 nt, Homo sapiens
cacugggugcaagagga

SEQ ID NO: 202093 - RNA, 22 nt, Homo sapiens
cacuggguuagaacaugcuccu

SEQ ID NO: 202094 - RNA, 21 nt, Homo sapiens
cacuggguucaggcuugugga

SEQ ID NO: 202095 - RNA, 22 nt, Homo sapiens
cagagaacugaguuauuuucuu

SEQ ID NO: 202096 - RNA, 22 nt, Homo sapiens
cagagaaugucuuuuuuaacca

SEQ ID NO: 202097 - RNA, 20 nt, Homo sapiens
cagagcaaagcaguccuggc

SEQ ID NO: 202098 - RNA, 22 nt, Homo sapiens
cagagcaaugcuuuugcuuuga

SEQ ID NO: 202099 - RNA, 22 nt, Homo sapiens
cagagugcauguuuagaugagu

SEQ ID NO: 202100 - RNA, 22 nt, Homo sapiens
cagauggucuuaaggcagccuu

SEQ ID NO: 202101 - RNA, 22 nt, Homo sapiens
cagcaagucucuaagaguucau

SEQ ID NO: 202102 - RNA, 20 nt, Homo sapiens
cagcacgcacaugagacugu

SEQ ID NO: 202103 - RNA, 22 nt, Homo sapiens
cagccgggugagguggcuuguu

SEQ ID NO: 202104 - RNA, 22 nt, Homo sapiens
cagcuaaauuguuaaauccaag

SEQ ID NO: 202105 - RNA, 22 nt, Homo sapiens
cagcucauugcagucucgaccu

SEQ ID NO: 202106 - RNA, 22 nt, Homo sapiens
cagcugcuuuggaaaauauuuu

SEQ ID NO: 202107 - RNA, 22 nt, Homo sapiens
caggcagucuggcucccaagug

SEQ ID NO: 202108 - RNA, 22 nt, Homo sapiens
caggcagucuggggguguaucc

SEQ ID NO: 202109 - RNA, 20 nt, Homo sapiens
cagggcaaugaggagguaaa

SEQ ID NO: 202110 - RNA, 22 nt, Homo sapiens
caggugcauuggcugacaccug

SEQ ID NO: 202111 - RNA, 22 nt, Homo sapiens
caggugguauuugguuuucugu

SEQ ID NO: 202112 - RNA, 22 nt, Homo sapiens
cagucacagugacaggaugugg

SEQ ID NO: 202113 - RNA, 22 nt, Homo sapiens
cagugcaugacuguauauuauc

SEQ ID NO: 202114 - RNA, 22 nt, Homo sapiens
cagugguuuucucaguucagca

SEQ ID NO: 202115 - RNA, 22 nt, Homo sapiens
caguuacuugacacaaccaauu

SEQ ID NO: 202116 - RNA, 22 nt, Homo sapiens
cauacaugugcuugucuuaugc

SEQ ID NO: 202117 - RNA, 22 nt, Homo sapiens
cauauucacuuuacagagcugu

SEQ ID NO: 202118 - RNA, 22 nt, Homo sapiens
caucagagugagauauaagauc

SEQ ID NO: 202119 - RNA, 22 nt, Homo sapiens
caucauugcacccuauagagaa

SEQ ID NO: 202120 - RNA, 22 nt, Homo sapiens
caugaaagacugaggaauugga

SEQ ID NO: 202121 - RNA, 22 nt, Homo sapiens
caugcacugaguccaccucugg

SEQ ID NO: 202122 - RNA, 19 nt, Homo sapiens
caugccacugcacuugagu

SEQ ID NO: 202123 - RNA, 22 nt, Homo sapiens
cauggagcuaggcuugaucccu

SEQ ID NO: 202124 - RNA, 22 nt, Homo sapiens
cauggcucuuguuuacucccag

SEQ ID NO: 202125 - RNA, 22 nt, Homo sapiens
cauggguuuucucaaguaguca

SEQ ID NO: 202126 - RNA, 22 nt, Homo sapiens
cauguauagauuccauaguggu

SEQ ID NO: 202127 - RNA, 22 nt, Homo sapiens
caugucacuuccucucugaugg

SEQ ID NO: 202128 - RNA, 22 nt, Homo sapiens
caugugcaugagcacauacgug

SEQ ID NO: 202129 - RNA, 22 nt, Homo sapiens
caugugcaugcuuucuuaugug

SEQ ID NO: 202130 - RNA, 22 nt, Homo sapiens
cauugcacacauuuaccuaugu

SEQ ID NO: 202131 - RNA, 19 nt, Homo sapiens
cauugcacuccacccuggg

SEQ ID NO: 202132 - RNA, 22 nt, Homo sapiens
cauugcacuccagcccuggcaa

SEQ ID NO: 202133 - RNA, 22 nt, Homo sapiens
cauugcacuccagccuaggcaa

SEQ ID NO: 202134 - RNA, 22 nt, Homo sapiens
cauugcacuccagccucggcaa

SEQ ID NO: 202135 - RNA, 22 nt, Homo sapiens
cauugcacuccagccuuggcaa

SEQ ID NO: 202136 - RNA, 22 nt, Homo sapiens
cauugcacuccagcuugggcaa

SEQ ID NO: 202137 - RNA, 22 nt, Homo sapiens
cauugcacucuagucuggguga

SEQ ID NO: 202138 - RNA, 22 nt, Homo sapiens
cauugcacucuaucccgguggg

SEQ ID NO: 202139 - RNA, 22 nt, Homo sapiens
cauugcacucugcauuccaguc

SEQ ID NO: 202140 - RNA, 22 nt, Homo sapiens
cauugcacugcuucuugggugu

SEQ ID NO: 202141 - RNA, 22 nt, Homo sapiens
cauugcacuuagacaacuuuug

SEQ ID NO: 202142 - RNA, 22 nt, Homo sapiens
cauugcauuccagucugggcaa

SEQ ID NO: 202143 - RNA, 22 nt, Homo sapiens
cauugcauuuucuuuguaccuu

SEQ ID NO: 202144 - RNA, 22 nt, Homo sapiens
cauugguuuauagauggggaaa

SEQ ID NO: 202145 - RNA, 22 nt, Homo sapiens
cauugguuuuucaggaguauau

SEQ ID NO: 202146 - RNA, 22 nt, Homo sapiens
cauuugcacugagacucagcuu

SEQ ID NO: 202147 - RNA, 22 nt, Homo sapiens
cauuuugcaguuucugucucca

SEQ ID NO: 202148 - RNA, 22 nt, Homo sapiens
ccaaaguauuuucacugauauc

SEQ ID NO: 202149 - RNA, 22 nt, Homo sapiens
ccacaaccucaacagcaucuau

SEQ ID NO: 202150 - RNA, 22 nt, Homo sapiens
ccacagucuaugcaacaagguc

SEQ ID NO: 202151 - RNA, 22 nt, Homo sapiens
ccacccuuccauucuuccucuu

SEQ ID NO: 202152 - RNA, 22 nt, Homo sapiens
ccaccgggucccagcucugcuc

SEQ ID NO: 202153 - RNA, 22 nt, Homo sapiens
ccagaguggagccuuugcgagg

SEQ ID NO: 202154 - RNA, 22 nt, Homo sapiens
ccagauguuuucauucagcaag

SEQ ID NO: 202155 - RNA, 22 nt, Homo sapiens
ccagcaccauuuauuaaauagg

SEQ ID NO: 202156 - RNA, 22 nt, Homo sapiens
ccagcaccauuuguugaauagg

SEQ ID NO: 202157 - RNA, 22 nt, Homo sapiens
ccaggguuccacgccuggcugu

SEQ ID NO: 202158 - RNA, 22 nt, Homo sapiens
ccaggguugagacccacugacu

SEQ ID NO: 202159 - RNA, 22 nt, Homo sapiens
ccagguuucuagaauaauuccu

SEQ ID NO: 202160 - RNA, 21 nt, Homo sapiens
ccagugguuggaaacuauggg

SEQ ID NO: 202161 - RNA, 22 nt, Homo sapiens
ccagugucugacagacacggcg

SEQ ID NO: 202162 - RNA, 22 nt, Homo sapiens
uugagauggagucuugcucugu

SEQ ID NO: 202163 - RNA, 22 nt, Homo sapiens
uugagauggaguuucacucucg

SEQ ID NO: 202164 - RNA, 22 nt, Homo sapiens
uugagauggaguuucacucuug

SEQ ID NO: 202165 - RNA, 22 nt, Homo sapiens
uugagauguaagauguuaauau

SEQ ID NO: 202166 - RNA, 22 nt, Homo sapiens
uugagcaauccuccugccaugu

SEQ ID NO: 202167 - RNA, 22 nt, Homo sapiens
uugagcaucauguuagcacuca

SEQ ID NO: 202168 - RNA, 22 nt, Homo sapiens
uugagcuuuuuacuuguccaau

SEQ ID NO: 202169 - RNA, 22 nt, Homo sapiens
uugaggacugagacagaccaag

SEQ ID NO: 202170 - RNA, 22 nt, Homo sapiens
uugaggacuggaacacaggucu

SEQ ID NO: 202171 - RNA, 22 nt, Homo sapiens
uugaggaguacugauuagguau

SEQ ID NO: 202172 - RNA, 23 nt, Homo sapiens
uugaggcauguaccaucaauauc

SEQ ID NO: 202173 - RNA, 22 nt, Homo sapiens
uugagggaaacauucacaucau

SEQ ID NO: 202174 - RNA, 22 nt, Homo sapiens
uugagggagcauuuguuuugag

SEQ ID NO: 202175 - RNA, 22 nt, Homo sapiens
uugagggaggcagggcuugucu

SEQ ID NO: 202176 - RNA, 22 nt, Homo sapiens
uugagggaggccucaguuuaca

SEQ ID NO: 202177 - RNA, 22 nt, Homo sapiens
uugagguagcuuugauggaggu

SEQ ID NO: 202178 - RNA, 22 nt, Homo sapiens
uugagguauugauaaaacauuu

SEQ ID NO: 202179 - RNA, 22 nt, Homo sapiens
uugaggucagagguucgagacc

SEQ ID NO: 202180 - RNA, 22 nt, Homo sapiens
uugaggucuucaggaucaggcu

SEQ ID NO: 202181 - RNA, 22 nt, Homo sapiens
uugaggugaauuugcaggaugc

SEQ ID NO: 202182 - RNA, 22 nt, Homo sapiens
uugaggugggaggaucacuuga

SEQ ID NO: 202183 - RNA, 22 nt, Homo sapiens
uugaguagauaccuaggaauag

SEQ ID NO: 202184 - RNA, 22 nt, Homo sapiens
uugaguaguaagugguucaccg

SEQ ID NO: 202185 - RNA, 22 nt, Homo sapiens
uugagugaaugaaugauuaaau

SEQ ID NO: 202186 - RNA, 22 nt, Homo sapiens
uugauagaucagggauuugauu

SEQ ID NO: 202187 - RNA, 22 nt, Homo sapiens
uugauauguguauagcaugugg

SEQ ID NO: 202188 - RNA, 22 nt, Homo sapiens
uugaucaaaucugagugagaau

SEQ ID NO: 202189 - RNA, 22 nt, Homo sapiens
uugaucuaugugucuguuuuua

SEQ ID NO: 202190 - RNA, 22 nt, Homo sapiens
uugauuagauccaguugauuga

SEQ ID NO: 202191 - RNA, 20 nt, Homo sapiens
uugauucccucuaaacucgc

SEQ ID NO: 202192 - RNA, 22 nt, Homo sapiens
uugcaaaucucuuguguuuggu

SEQ ID NO: 202193 - RNA, 22 nt, Homo sapiens
uugcacaauggaauuuaucuuu

SEQ ID NO: 202194 - RNA, 22 nt, Homo sapiens
uugcacagugcuuucuuugccc

SEQ ID NO: 202195 - RNA, 22 nt, Homo sapiens
uugcacauugauuuuguaucuu

SEQ ID NO: 202196 - RNA, 22 nt, Homo sapiens
uugcacauugcaccuuuuguau

SEQ ID NO: 202197 - RNA, 22 nt, Homo sapiens
uugcacucugaagaccuacugu

SEQ ID NO: 202198 - RNA, 22 nt, Homo sapiens
uugcagagaaauuucugguuua

SEQ ID NO: 202199 - RNA, 22 nt, Homo sapiens
uugcagaucccacacucacccu

SEQ ID NO: 202200 - RNA, 22 nt, Homo sapiens
uugcagugguuucacuggcaaa

SEQ ID NO: 202201 - RNA, 22 nt, Homo sapiens
uugcauagaccgaugucuugga

SEQ ID NO: 202202 - RNA, 22 nt, Homo sapiens
uugcauauguugaaccaagcgu

SEQ ID NO: 202203 - RNA, 19 nt, Homo sapiens
uugcauauguugaaccagg

SEQ ID NO: 202204 - RNA, 22 nt, Homo sapiens
uugcaucagcaggcauaauugg

SEQ ID NO: 202205 - RNA, 22 nt, Homo sapiens
uugcauguacguacagagagag

SEQ ID NO: 202206 - RNA, 22 nt, Homo sapiens
uugccaucaucucuuacucagu

SEQ ID NO: 202207 - RNA, 22 nt, Homo sapiens
uugccuaggcuggagugcagug

SEQ ID NO: 202208 - RNA, 22 nt, Homo sapiens
uugccugagaagccaagaauaa

SEQ ID NO: 202209 - RNA, 22 nt, Homo sapiens
uugcuccucugccaggaccugu

SEQ ID NO: 202210 - RNA, 22 nt, Homo sapiens
uugcugagucuuucuagguugc

SEQ ID NO: 202211 - RNA, 22 nt, Homo sapiens
uugcugguuuucauaugagcag

SEQ ID NO: 202212 - RNA, 22 nt, Homo sapiens
uuggaaaaauccaccuugaucu

SEQ ID NO: 202213 - RNA, 22 nt, Homo sapiens
uuggaacacauguuuuucuacc

SEQ ID NO: 202214 - RNA, 22 nt, Homo sapiens
uuggaaggcuccuaaugaaugg

SEQ ID NO: 202215 - RNA, 22 nt, Homo sapiens
uuggaauauaaccuguuucuaa

SEQ ID NO: 202216 - RNA, 22 nt, Homo sapiens
uuggaccacuugauuucugguc

SEQ ID NO: 202217 - RNA, 22 nt, Homo sapiens
uuggacuuuuauucugcaggca

SEQ ID NO: 202218 - RNA, 22 nt, Homo sapiens
uuggauuauaaacugagauuug

SEQ ID NO: 202219 - RNA, 22 nt, Homo sapiens
uuggauuuuaacaaacuaggug

SEQ ID NO: 202220 - RNA, 22 nt, Homo sapiens
uuggcaaaugucacaaaucagg

SEQ ID NO: 202221 - RNA, 22 nt, Homo sapiens
uuggcaagcuguuaauuauaaa

SEQ ID NO: 202222 - RNA, 20 nt, Homo sapiens
uuggcagagucuuuagggua

SEQ ID NO: 202223 - RNA, 19 nt, Homo sapiens
uuggcagaguugcccccua

SEQ ID NO: 202224 - RNA, 22 nt, Homo sapiens
uuggccccuccaaaucucaugu

SEQ ID NO: 202225 - RNA, 22 nt, Homo sapiens
uuggccccuuucauccacagcu

SEQ ID NO: 202226 - RNA, 19 nt, Homo sapiens
uuggcccugguucucuucu

SEQ ID NO: 202227 - RNA, 21 nt, Homo sapiens
uuggccuggaggccugaaugu

SEQ ID NO: 202228 - RNA, 22 nt, Homo sapiens
uuggccuuuucaaugccucuuu

SEQ ID NO: 202229 - RNA, 22 nt, Homo sapiens
uuggcuguguuuauaugcugga

SEQ ID NO: 202230 - RNA, 22 nt, Homo sapiens
uugggaaugcuaaaccucuauu

SEQ ID NO: 202231 - RNA, 22 nt, Homo sapiens
uuggguagugaguuccuccagg

SEQ ID NO: 202232 - RNA, 22 nt, Homo sapiens
uuggucagcuagauuauucccu

SEQ ID NO: 202233 - RNA, 22 nt, Homo sapiens
uaagucguggaugauucuucgg

SEQ ID NO: 202234 - RNA, 22 nt, Homo sapiens
uaagugaauuucacuacugagu

SEQ ID NO: 202235 - RNA, 22 nt, Homo sapiens
uaagugguguucauucuuuuga

SEQ ID NO: 202236 - RNA, 22 nt, Homo sapiens
uaaguuguagaacguuuucuua

SEQ ID NO: 202237 - RNA, 22 nt, Homo sapiens
uaauagcaguguuacuaggacu

SEQ ID NO: 202238 - RNA, 22 nt, Homo sapiens
uaaucacagagguuuggccuca

SEQ ID NO: 202239 - RNA, 22 nt, Homo sapiens
uaaugcaucagugguaguucuu

SEQ ID NO: 202240 - RNA, 22 nt, Homo sapiens
uaaugcaucaugguuggcaaac

SEQ ID NO: 202241 - RNA, 22 nt, Homo sapiens
uaaugcuguggucugguuuaaa

SEQ ID NO: 202242 - RNA, 22 nt, Homo sapiens
uacaaaucuagguuuguuacug

SEQ ID NO: 202243 - RNA, 22 nt, Homo sapiens
uacaagcacaggcagcaggcug

SEQ ID NO: 202244 - RNA, 22 nt, Homo sapiens
uacaaguggguuugugcaggag

SEQ ID NO: 202245 - RNA, 22 nt, Homo sapiens
uacaccaauuuaaucaaaagca

SEQ ID NO: 202246 - RNA, 20 nt, Homo sapiens
uacacguguagcauucucua

SEQ ID NO: 202247 - RNA, 19 nt, Homo sapiens
uacaggacugagcugaggu

SEQ ID NO: 202248 - RNA, 22 nt, Homo sapiens
uacaggacuucucagaguuauu

SEQ ID NO: 202249 - RNA, 22 nt, Homo sapiens
uacaguagagaucagcaaacua

SEQ ID NO: 202250 - RNA, 22 nt, Homo sapiens
uacagucuagaggagaaucagg

SEQ ID NO: 202251 - RNA, 22 nt, Homo sapiens
uacaguggugugaucucagcuc

SEQ ID NO: 202252 - RNA, 22 nt, Homo sapiens
uacauacuguaugguucuguuu

SEQ ID NO: 202253 - RNA, 22 nt, Homo sapiens
uacauaguagauauaggguuua

SEQ ID NO: 202254 - RNA, 19 nt, Homo sapiens
uacauaguauuuaguggca

SEQ ID NO: 202255 - RNA, 22 nt, Homo sapiens
uacaucagccugaaagagcucg

SEQ ID NO: 202256 - RNA, 19 nt, Homo sapiens
uacaugcagcaggcacgca

SEQ ID NO: 202257 - RNA, 22 nt, Homo sapiens
uacaugugcacaacgugcaggu

SEQ ID NO: 202258 - RNA, 22 nt, Homo sapiens
uaccaaaguuucggccucuguu

SEQ ID NO: 202259 - RNA, 22 nt, Homo sapiens
uaccacaggcuggguaaucuau

SEQ ID NO: 202260 - RNA, 22 nt, Homo sapiens
uaccagugaauuccaggggcua

SEQ ID NO: 202261 - RNA, 22 nt, Homo sapiens
uaccaucauuauacguagaaau

SEQ ID NO: 202262 - RNA, 22 nt, Homo sapiens
uacccaguaacaaguauuuugg

SEQ ID NO: 202263 - RNA, 22 nt, Homo sapiens
uacccuuuaguauaaaaucaga

SEQ ID NO: 202264 - RNA, 22 nt, Homo sapiens
uacucaauugcagucaccuggc

SEQ ID NO: 202265 - RNA, 22 nt, Homo sapiens
uacucaguagacacucauaugu

SEQ ID NO: 202266 - RNA, 22 nt, Homo sapiens
uacucaguagucuguugcuguc

SEQ ID NO: 202267 - RNA, 22 nt, Homo sapiens
uacuccccuuguucugugagcu

SEQ ID NO: 202268 - RNA, 22 nt, Homo sapiens
uacucugcagagaugcauaaca

SEQ ID NO: 202269 - RNA, 22 nt, Homo sapiens
uacucuuuagcuccuuaaggaa

SEQ ID NO: 202270 - RNA, 18 nt, Homo sapiens
uacugcacucuccagccu

SEQ ID NO: 202271 - RNA, 23 nt, Homo sapiens
uacugcauccuccgccucuaggg

SEQ ID NO: 202272 - RNA, 22 nt, Homo sapiens
uacugcauuucacuguuaaaga

SEQ ID NO: 202273 - RNA, 22 nt, Homo sapiens
uacugcuuaagggcaugggccc

SEQ ID NO: 202274 - RNA, 22 nt, Homo sapiens
uacuucauucuugaccuugcau

SEQ ID NO: 202275 - RNA, 22 nt, Homo sapiens
uagaagcacuaucccuccuagu

SEQ ID NO: 202276 - RNA, 22 nt, Homo sapiens
uagacacugcauauuuuuuuaa

SEQ ID NO: 202277 - RNA, 22 nt, Homo sapiens
uagaccaauuggcauauaguaa

SEQ ID NO: 202278 - RNA, 22 nt, Homo sapiens
uagagcuugacacuuuccaugg

SEQ ID NO: 202279 - RNA, 22 nt, Homo sapiens
uagagguaggucuucgagucuc

SEQ ID NO: 202280 - RNA, 22 nt, Homo sapiens
uagagguauaccaaaaaggcau

SEQ ID NO: 202281 - RNA, 22 nt, Homo sapiens
uagauaguuaugauuugaugau

SEQ ID NO: 202282 - RNA, 21 nt, Homo sapiens
uagauaguugguucugaaucu

SEQ ID NO: 202283 - RNA, 22 nt, Homo sapiens
uagaucacucaggcaauaaaag

SEQ ID NO: 202284 - RNA, 20 nt, Homo sapiens
uagaugcauuuagauucauu

SEQ ID NO: 202285 - RNA, 22 nt, Homo sapiens
uagcacaugucagguaauuugc

SEQ ID NO: 202286 - RNA, 22 nt, Homo sapiens
uagcacugucuugcaccugugc

SEQ ID NO: 202287 - RNA, 22 nt, Homo sapiens
uagcagcagugguguauuuaga

SEQ ID NO: 202288 - RNA, 22 nt, Homo sapiens
uagcagcaucucuggcuucuac

SEQ ID NO: 202289 - RNA, 22 nt, Homo sapiens
uagcagccaggaagggcuggcu

SEQ ID NO: 202290 - RNA, 22 nt, Homo sapiens
uagcagguguuccacaaauauu

SEQ ID NO: 202291 - RNA, 22 nt, Homo sapiens
uagcaguagacagacuuuggcu

SEQ ID NO: 202292 - RNA, 22 nt, Homo sapiens
uagcaguauaugagagcuauug

SEQ ID NO: 202293 - RNA, 22 nt, Homo sapiens
uagcaguaucccaccaucuggu

SEQ ID NO: 202294 - RNA, 22 nt, Homo sapiens
uagcaguauugaaagaugaggg

SEQ ID NO: 202295 - RNA, 22 nt, Homo sapiens
uagcaugacacuuguugaaugc

SEQ ID NO: 202296 - RNA, 22 nt, Homo sapiens
uagccgggugugguggaacucc

SEQ ID NO: 202297 - RNA, 21 nt, Homo sapiens
uagcuacacugugauucaugg

SEQ ID NO: 202298 - RNA, 22 nt, Homo sapiens
uagcugcugcuaggcuaaggau

SEQ ID NO: 202299 - RNA, 22 nt, Homo sapiens
uagcuggaauuacuugcaccug

SEQ ID NO: 202300 - RNA, 17 nt, Homo sapiens
uagcuucacauuaggaa

SEQ ID NO: 202301 - RNA, 22 nt, Homo sapiens
uagcuucuccauagcuccaugu

SEQ ID NO: 202302 - RNA, 23 nt, Homo sapiens
uagcuucucccagaccugcuccc

SEQ ID NO: 202303 - RNA, 22 nt, Homo sapiens
uaggaaguuuucuugcugggcc

SEQ ID NO: 202304 - RNA, 22 nt, Homo sapiens
uaggaaugaacgauuuauuggu

SEQ ID NO: 202305 - RNA, 22 nt, Homo sapiens
uaggacaaugguacagcagaaa

SEQ ID NO: 202306 - RNA, 17 nt, Homo sapiens
ccccugagcgaugcagu

SEQ ID NO: 202307 - RNA, 21 nt, Homo sapiens
cccugguguuuggaguuugag

SEQ ID NO: 202308 - RNA, 22 nt, Homo sapiens
cccuucauucaaggguugugag

SEQ ID NO: 202309 - RNA, 22 nt, Homo sapiens
cccuugcacuucagagcugcau

SEQ ID NO: 202310 - RNA, 22 nt, Homo sapiens
ccuaggcacugggguccagccc

SEQ ID NO: 202311 - RNA, 21 nt, Homo sapiens
ccugaagaagugaccucugag

SEQ ID NO: 202312 - RNA, 22 nt, Homo sapiens
ccugagacugauugacucacaa

SEQ ID NO: 202313 - RNA, 21 nt, Homo sapiens
ccugaugaccucugagaguua

SEQ ID NO: 202314 - RNA, 22 nt, Homo sapiens
ccuggcacugagcaguguucua

SEQ ID NO: 202315 - RNA, 22 nt, Homo sapiens
ccuggcacugggccccguggcu

SEQ ID NO: 202316 - RNA, 22 nt, Homo sapiens
ccuuggcaauggcuggggcuga

SEQ ID NO: 202317 - RNA, 22 nt, Homo sapiens
ccuuggcacuacugacauugua

SEQ ID NO: 202318 - RNA, 22 nt, Homo sapiens
ccuugguggccacaagacauug

SEQ ID NO: 202319 - RNA, 21 nt, Homo sapiens
ccuugguuaucuucccauuca

SEQ ID NO: 202320 - RNA, 19 nt, Homo sapiens
ccuuugguuuccaugacau

SEQ ID NO: 202321 - RNA, 22 nt, Homo sapiens
cgacuggccuagacuaguguuu

SEQ ID NO: 202322 - RNA, 16 nt, Homo sapiens
cuaaaaugucuacuug

SEQ ID NO: 202323 - RNA, 22 nt, Homo sapiens
cuaaaguauugagugguaaaga

SEQ ID NO: 202324 - RNA, 23 nt, Homo sapiens
cuaaagucugucacugaggacuu

SEQ ID NO: 202325 - RNA, 22 nt, Homo sapiens
cuaacacagggcaagucaggcu

SEQ ID NO: 202326 - RNA, 22 nt, Homo sapiens
cuaagauugucuuaguguguug

SEQ ID NO: 202327 - RNA, 20 nt, Homo sapiens
cuaaucaucccagaagaaau

SEQ ID NO: 202328 - RNA, 22 nt, Homo sapiens
cuacacaugcaggcucccugcc

SEQ ID NO: 202329 - RNA, 21 nt, Homo sapiens
cuacccuguauuagagaaaga

SEQ ID NO: 202330 - RNA, 22 nt, Homo sapiens
cuacucugugguguauuugcau

SEQ ID NO: 202331 - RNA, 22 nt, Homo sapiens
cuagaggcacagccuaggcacu

SEQ ID NO: 202332 - RNA, 22 nt, Homo sapiens
cuagguuauacucugaaauggu

SEQ ID NO: 202333 - RNA, 21 nt, Homo sapiens
cuaucucaguguuuacauuug

SEQ ID NO: 202334 - RNA, 22 nt, Homo sapiens
cuauggcagccacggccuggag

SEQ ID NO: 202335 - RNA, 22 nt, Homo sapiens
cuauggguuauaauucauuagu

SEQ ID NO: 202336 - RNA, 22 nt, Homo sapiens
cuauguaccuggaacuguauua

SEQ ID NO: 202337 - RNA, 22 nt, Homo sapiens
cuauucacaggcaauauguaca

SEQ ID NO: 202338 - RNA, 22 nt, Homo sapiens
cucaaagugcugggacuggcug

SEQ ID NO: 202339 - RNA, 22 nt, Homo sapiens
cucaaagugcugggauuggcca

SEQ ID NO: 202340 - RNA, 22 nt, Homo sapiens
cucacaguucuaaaggcaagaa

SEQ ID NO: 202341 - RNA, 22 nt, Homo sapiens
cucacuaguaaggcuguuuagu

SEQ ID NO: 202342 - RNA, 22 nt, Homo sapiens
cucaguggauuagauaaugcac

SEQ ID NO: 202343 - RNA, 22 nt, Homo sapiens
cuccaguuucagaaucccaugu

SEQ ID NO: 202344 - RNA, 22 nt, Homo sapiens
cuccauuuaguccuuuuagaag

SEQ ID NO: 202345 - RNA, 22 nt, Homo sapiens
cuccauuuggaacagauguccu

SEQ ID NO: 202346 - RNA, 22 nt, Homo sapiens
cucccagagccaguuauaggcu

SEQ ID NO: 202347 - RNA, 22 nt, Homo sapiens
cuccuggugauuggagugugaa

SEQ ID NO: 202348 - RNA, 20 nt, Homo sapiens
cucuaguaauaaaguuuccc

SEQ ID NO: 202349 - RNA, 22 nt, Homo sapiens
cucucaagaugcugggauuaca

SEQ ID NO: 202350 - RNA, 22 nt, Homo sapiens
cucucaguugucuaauuaguuu

SEQ ID NO: 202351 - RNA, 22 nt, Homo sapiens
cucucugagccauggcugcccu

SEQ ID NO: 202352 - RNA, 21 nt, Homo sapiens
cucucugcuuaugaauaguga

SEQ ID NO: 202353 - RNA, 22 nt, Homo sapiens
cucucuguuugucuguuauugg

SEQ ID NO: 202354 - RNA, 22 nt, Homo sapiens
cucuuugaguuccuccuggugu

SEQ ID NO: 202355 - RNA, 22 nt, Homo sapiens
cucuuugaugugaaccgugguu

SEQ ID NO: 202356 - RNA, 19 nt, Homo sapiens
cucuuuggugucucuucuu

SEQ ID NO: 202357 - RNA, 22 nt, Homo sapiens
cugaaaucagccaguuaguuuc

SEQ ID NO: 202358 - RNA, 22 nt, Homo sapiens
cugaagugcuugccacauaaaa

SEQ ID NO: 202359 - RNA, 22 nt, Homo sapiens
cugaauagucaacgauggacug

SEQ ID NO: 202360 - RNA, 22 nt, Homo sapiens
cugaauguuucacucugaaaug

SEQ ID NO: 202361 - RNA, 22 nt, Homo sapiens
cugacaucuucaagugaggaga

SEQ ID NO: 202362 - RNA, 22 nt, Homo sapiens
cugaccucugucaaagacaccc

SEQ ID NO: 202363 - RNA, 22 nt, Homo sapiens
cugagcaaagaagugauaauga

SEQ ID NO: 202364 - RNA, 22 nt, Homo sapiens
cugagcaauauagugagaucuu

SEQ ID NO: 202365 - RNA, 22 nt, Homo sapiens
cugaggacaucagggaagcauc

SEQ ID NO: 202366 - RNA, 22 nt, Homo sapiens
cugaggcacggcgaccuuaagu

SEQ ID NO: 202367 - RNA, 22 nt, Homo sapiens
cugagguacugggggccaggau

SEQ ID NO: 202368 - RNA, 22 nt, Homo sapiens
cugagguaggugaucagugcuu

SEQ ID NO: 202369 - RNA, 22 nt, Homo sapiens
cugaggugauauauacauauuu

SEQ ID NO: 202370 - RNA, 22 nt, Homo sapiens
cugaggugggaggauuggcuug

SEQ ID NO: 202371 - RNA, 20 nt, Homo sapiens
cugagguugggguccuuccc

SEQ ID NO: 202372 - RNA, 22 nt, Homo sapiens
cugagugcaagugauccuccca

SEQ ID NO: 202373 - RNA, 22 nt, Homo sapiens
aaaaggcuagcuaguaacagaa

SEQ ID NO: 202374 - RNA, 22 nt, Homo sapiens
aaaagugguguuguuucuaaau

SEQ ID NO: 202375 - RNA, 22 nt, Homo sapiens
aaacugccuuccuuguaggugc

SEQ ID NO: 202376 - RNA, 21 nt, Homo sapiens
aaacuggcccaauuguuccau

SEQ ID NO: 202377 - RNA, 22 nt, Homo sapiens
aaacugucuucugacaguuucc

SEQ ID NO: 202378 - RNA, 22 nt, Homo sapiens
aaaggcacacacuccuuguuau

SEQ ID NO: 202379 - RNA, 22 nt, Homo sapiens
aaagggcuguuucuugacuugg

SEQ ID NO: 202380 - RNA, 22 nt, Homo sapiens
aaaagagcugagagguauucuu

SEQ ID NO: 202381 - RNA, 22 nt, Homo sapiens
aaaccacagugugcugcugggg

SEQ ID NO: 202382 - RNA, 22 nt, Homo sapiens
aaagagaucuaugggcacuaug

SEQ ID NO: 202383 - RNA, 22 nt, Homo sapiens
aaagcaucacuuuuccuacuuu

SEQ ID NO: 202384 - RNA, 22 nt, Homo sapiens
aaagcuacaggaccugcucauu

SEQ ID NO: 202385 - RNA, 22 nt, Homo sapiens
aaaggcacuagaaguuaccuuu

SEQ ID NO: 202386 - RNA, 22 nt, Homo sapiens
aaagggcuugaauacucuuuuu

SEQ ID NO: 202387 - RNA, 22 nt, Homo sapiens
uucauaguauuuuucuccaaau

SEQ ID NO: 202388 - RNA, 22 nt, Homo sapiens
uucauaguuuauacugauauuu

SEQ ID NO: 202389 - RNA, 23 nt, Homo sapiens
uucaucagggauauuggccugaa

SEQ ID NO: 202390 - RNA, 22 nt, Homo sapiens
uucaucuggcaauucagagauu

SEQ ID NO: 202391 - RNA, 22 nt, Homo sapiens
uucauggaguugagaaggcuaa

SEQ ID NO: 202392 - RNA, 22 nt, Homo sapiens
uucauguaauauauuucaggcc

SEQ ID NO: 202393 - RNA, 22 nt, Homo sapiens
uuccacaggguugaacuaguuu

SEQ ID NO: 202394 - RNA, 16 nt, Homo sapiens
uuccacagucgaggug

SEQ ID NO: 202395 - RNA, 22 nt, Homo sapiens
uuccacuuuuuccuugugcucc

SEQ ID NO: 202396 - RNA, 22 nt, Homo sapiens
uuccagagucaccuuucugucg

SEQ ID NO: 202397 - RNA, 22 nt, Homo sapiens
uuccagaugggaguucuauucu

SEQ ID NO: 202398 - RNA, 22 nt, Homo sapiens
uuccaguaauagcacagcauug

SEQ ID NO: 202399 - RNA, 22 nt, Homo sapiens
uuccaguggaguaaauggacaa

SEQ ID NO: 202400 - RNA, 22 nt, Homo sapiens
uuccaguugugagcuauccggg

SEQ ID NO: 202401 - RNA, 22 nt, Homo sapiens
uuccaguuuuauggguauagag

SEQ ID NO: 202402 - RNA, 22 nt, Homo sapiens
uuccauguaguugaacgguuuu

SEQ ID NO: 202403 - RNA, 22 nt, Homo sapiens
uuccauguugauacgugaaguu

SEQ ID NO: 202404 - RNA, 22 nt, Homo sapiens
uuccauuuguucggugucgcca

SEQ ID NO: 202405 - RNA, 22 nt, Homo sapiens
uucccaguaaacucuaucccuc

SEQ ID NO: 202406 - RNA, 22 nt, Homo sapiens
uucccgggguggaaugcaguga

SEQ ID NO: 202407 - RNA, 22 nt, Homo sapiens
uucccucagaaacacacagccc

SEQ ID NO: 202408 - RNA, 20 nt, Homo sapiens
uucccucagccuugagggua

SEQ ID NO: 202409 - RNA, 22 nt, Homo sapiens
uucccugugggcuggugcucca

SEQ ID NO: 202410 - RNA, 23 nt, Homo sapiens
uucccuuagaagaaggggagaaa

SEQ ID NO: 202411 - RNA, 22 nt, Homo sapiens
uucccuuugaaacuaaacuugc

SEQ ID NO: 202412 - RNA, 22 nt, Homo sapiens
uuccuacugcccauuaaaaugg

SEQ ID NO: 202413 - RNA, 22 nt, Homo sapiens
uuccugagagggcugggugcag

SEQ ID NO: 202414 - RNA, 22 nt, Homo sapiens
uuccuggaggggaaguguccaa

SEQ ID NO: 202415 - RNA, 22 nt, Homo sapiens
uucuagcacuuugggagacuga

SEQ ID NO: 202416 - RNA, 22 nt, Homo sapiens
uucuauggucacagaugcuuga

SEQ ID NO: 202417 - RNA, 22 nt, Homo sapiens
uucuaugguuuuuaugguguua

SEQ ID NO: 202418 - RNA, 22 nt, Homo sapiens
uucuauugguaauauuuucugu

SEQ ID NO: 202419 - RNA, 22 nt, Homo sapiens
uucucaaggagccuucguaacu

SEQ ID NO: 202420 - RNA, 22 nt, Homo sapiens
uucucaauggcaacuuguugcu

SEQ ID NO: 202421 - RNA, 21 nt, Homo sapiens
uucucaggguguguccuaccc

SEQ ID NO: 202422 - RNA, 22 nt, Homo sapiens
uucucaguuccuacuuugguga

SEQ ID NO: 202423 - RNA, 22 nt, Homo sapiens
uucucuguggauugggugagag

SEQ ID NO: 202424 - RNA, 22 nt, Homo sapiens
uucugccaaucaacccacaucc

SEQ ID NO: 202425 - RNA, 22 nt, Homo sapiens
uucugugcugaaucaaagacug

SEQ ID NO: 202426 - RNA, 22 nt, Homo sapiens
uucuugcacuuggcccucauua

SEQ ID NO: 202427 - RNA, 22 nt, Homo sapiens
ucgcaccauugcacuccagcca

SEQ ID NO: 202428 - RNA, 22 nt, Homo sapiens
ucguucuugucaguuuauaaag

SEQ ID NO: 202429 - RNA, 22 nt, Homo sapiens
ucuaucacagugauguuccaga

SEQ ID NO: 202430 - RNA, 22 nt, Homo sapiens
ucucacagaguugaacuuucuu

SEQ ID NO: 202431 - RNA, 22 nt, Homo sapiens
ucucacagaguugaauguuucu

SEQ ID NO: 202432 - RNA, 22 nt, Homo sapiens
ucucacagccauuucucccucu

SEQ ID NO: 202433 - RNA, 22 nt, Homo sapiens
ucucagagccuaggguuuuuca

SEQ ID NO: 202434 - RNA, 22 nt, Homo sapiens
ucucagcacaaacaaaauugcu

SEQ ID NO: 202435 - RNA, 22 nt, Homo sapiens
ucucagugacugcugggucccc

SEQ ID NO: 202436 - RNA, 21 nt, Homo sapiens
ucucauagaguuucacuuucu

SEQ ID NO: 202437 - RNA, 22 nt, Homo sapiens
ucucaugaagauagagaauaga

SEQ ID NO: 202438 - RNA, 22 nt, Homo sapiens
ucucauggcucacccugcauag

SEQ ID NO: 202439 - RNA, 21 nt, Homo sapiens
ucucucaaccaggaagugggc

SEQ ID NO: 202440 - RNA, 22 nt, Homo sapiens
ucucugauuauugcauuucauu

SEQ ID NO: 202441 - RNA, 22 nt, Homo sapiens
ucucuguuuauuuuugguguau

SEQ ID NO: 202442 - RNA, 22 nt, Homo sapiens
ucugagaucaugucugugcugu

SEQ ID NO: 202443 - RNA, 22 nt, Homo sapiens
ucugagcaauagauguggauau

SEQ ID NO: 202444 - RNA, 22 nt, Homo sapiens
ucugagcaugcaucuugccugg

SEQ ID NO: 202445 - RNA, 22 nt, Homo sapiens
ucugccuacugguuggaggaac

SEQ ID NO: 202446 - RNA, 22 nt, Homo sapiens
ucuggcauuuucucugcuugca

SEQ ID NO: 202447 - RNA, 22 nt, Homo sapiens
ucuggcuccaaagucuauuuuu

SEQ ID NO: 202448 - RNA, 21 nt, Homo sapiens
ucuggcuuucauuccccuucu

SEQ ID NO: 202449 - RNA, 22 nt, Homo sapiens
ucuggguuuuuccauugccggu

SEQ ID NO: 202450 - RNA, 22 nt, Homo sapiens
ucugguguuacugagccuccca

SEQ ID NO: 202451 - RNA, 23 nt, Homo sapiens
ucugguguugucaaaugcugguu

SEQ ID NO: 202452 - RNA, 22 nt, Homo sapiens
ucugucaaaucuuauguuguag

SEQ ID NO: 202453 - RNA, 22 nt, Homo sapiens
ucugucacugaaucccugucac

SEQ ID NO: 202454 - RNA, 19 nt, Homo sapiens
ucugucacuggggguauuc

SEQ ID NO: 202455 - RNA, 22 nt, Homo sapiens
ucugucuuugccuaaguuuguc

SEQ ID NO: 202456 - RNA, 22 nt, Homo sapiens
ucugugcauuguaggauguuua

SEQ ID NO: 202457 - RNA, 22 nt, Homo sapiens
ucugugguaagaaacgcauguc

SEQ ID NO: 202458 - RNA, 22 nt, Homo sapiens
ucuguuguuaucauaauauuga

SEQ ID NO: 202459 - RNA, 22 nt, Homo sapiens
ucuucuagcggaacccucuugu

SEQ ID NO: 202460 - RNA, 22 nt, Homo sapiens
ucuugcacaaauuauuuuaacu

SEQ ID NO: 202461 - RNA, 22 nt, Homo sapiens
ucuugcaccuacaugcuuuguc

SEQ ID NO: 202462 - RNA, 22 nt, Homo sapiens
ucuugccacuucauccccuuuc

SEQ ID NO: 202463 - RNA, 21 nt, Homo sapiens
ucuuggguugaauucucccag

SEQ ID NO: 202464 - RNA, 22 nt, Homo sapiens
ucuuggguuuguccuucuccua

SEQ ID NO: 202465 - RNA, 22 nt, Homo sapiens
ucuugguuaggggaaauaggca

SEQ ID NO: 202466 - RNA, 23 nt, Homo sapiens
ucuugguuauagaaaaauaguug

SEQ ID NO: 202467 - RNA, 22 nt, Homo sapiens
ucuugguugaaaauucauaaua

SEQ ID NO: 202468 - RNA, 22 nt, Homo sapiens
ucuuuagugacaguugugcaag

SEQ ID NO: 202469 - RNA, 22 nt, Homo sapiens
ucuuucacuuagcaugauguuu

SEQ ID NO: 202470 - RNA, 22 nt, Homo sapiens
ucuuugaguggagcgaggcaga

SEQ ID NO: 202471 - RNA, 22 nt, Homo sapiens
ucuuuggaggcgaucuguuuga

SEQ ID NO: 202472 - RNA, 22 nt, Homo sapiens
ucuuugggauauucugaaaggg

SEQ ID NO: 202473 - RNA, 19 nt, Homo sapiens
ucuuugguacgugcuuuga

SEQ ID NO: 202474 - RNA, 22 nt, Homo sapiens
ucuuugguagaagcuauuuuau

SEQ ID NO: 202475 - RNA, 22 nt, Homo sapiens
ucuuugguauugugaauagugu

SEQ ID NO: 202476 - RNA, 22 nt, Homo sapiens
ucuuugguauuuguggggaauu

SEQ ID NO: 202477 - RNA, 22 nt, Homo sapiens
ugaaaagucuaagauuaagguu

SEQ ID NO: 202478 - RNA, 22 nt, Homo sapiens
ugaaacacacagagaagggaga

SEQ ID NO: 202479 - RNA, 22 nt, Homo sapiens
ugaaacauacacucugaugggg

SEQ ID NO: 202480 - RNA, 22 nt, Homo sapiens
ugaaagacugaaagcuuuucuu

SEQ ID NO: 202481 - RNA, 22 nt, Homo sapiens
ucacaugugcguuuuggcaugu

SEQ ID NO: 202482 - RNA, 22 nt, Homo sapiens
ucacauuguacaaacagguaag

SEQ ID NO: 202483 - RNA, 22 nt, Homo sapiens
ucaccagugucagggaacugcu

SEQ ID NO: 202484 - RNA, 22 nt, Homo sapiens
ucaccuugcacaguuguguggg

SEQ ID NO: 202485 - RNA, 22 nt, Homo sapiens
ucacgugguucauaaggcagaa

SEQ ID NO: 202486 - RNA, 20 nt, Homo sapiens
ucacuauggagcucuuucuu

SEQ ID NO: 202487 - RNA, 22 nt, Homo sapiens
ucacugaaaccgccuccaccuc

SEQ ID NO: 202488 - RNA, 21 nt, Homo sapiens
ucacugagguuaaauaggguu

SEQ ID NO: 202489 - RNA, 22 nt, Homo sapiens
ucacugcacucuccgccuugcg

SEQ ID NO: 202490 - RNA, 22 nt, Homo sapiens
ucacugcgaccuccaccucccg

SEQ ID NO: 202491 - RNA, 22 nt, Homo sapiens
ucacugcgaccuccaccuccug

SEQ ID NO: 202492 - RNA, 22 nt, Homo sapiens
ucacuggacucuagccugggug

SEQ ID NO: 202493 - RNA, 22 nt, Homo sapiens
ucacuggagauagcaaucuggu

SEQ ID NO: 202494 - RNA, 20 nt, Homo sapiens
ucacuggguucuugaagucu

SEQ ID NO: 202495 - RNA, 22 nt, Homo sapiens
ucacuguguauguauaugcagg

SEQ ID NO: 202496 - RNA, 22 nt, Homo sapiens
ucacuguugaugggcaugcagg

SEQ ID NO: 202497 - RNA, 22 nt, Homo sapiens
ucagaacugauacuagaacuuu

SEQ ID NO: 202498 - RNA, 22 nt, Homo sapiens
ucagacacuguggccuuuggac

SEQ ID NO: 202499 - RNA, 22 nt, Homo sapiens
ucagaguaguuccuggcagaaa

SEQ ID NO: 202500 - RNA, 22 nt, Homo sapiens
ucagagugcagggaguagcagc

SEQ ID NO: 202501 - RNA, 22 nt, Homo sapiens
ucagaguggccucucuugaaga

SEQ ID NO: 202502 - RNA, 22 nt, Homo sapiens
ucagaucauauucuucgcugcu

SEQ ID NO: 202503 - RNA, 22 nt, Homo sapiens
ucagaucaugcuuaugauggga

SEQ ID NO: 202504 - RNA, 22 nt, Homo sapiens
ucagaucauuaagguagguuua

SEQ ID NO: 202505 - RNA, 22 nt, Homo sapiens
ucagaugaucugguaagaacuu

SEQ ID NO: 202506 - RNA, 22 nt, Homo sapiens
ucagaugauuccguugacgaga

SEQ ID NO: 202507 - RNA, 22 nt, Homo sapiens
ucagaugcauccauaccccacu

SEQ ID NO: 202508 - RNA, 22 nt, Homo sapiens
ucagcacauucaaggccugccu

SEQ ID NO: 202509 - RNA, 22 nt, Homo sapiens
ucagcaccauguaacaauugau

SEQ ID NO: 202510 - RNA, 19 nt, Homo sapiens
ucagcaguaaucaacuuca

SEQ ID NO: 202511 - RNA, 22 nt, Homo sapiens
ucaggcacuaguaagaaaaagg

SEQ ID NO: 202512 - RNA, 20 nt, Homo sapiens
ucaggcuccgcauuaacuua

SEQ ID NO: 202513 - RNA, 20 nt, Homo sapiens
ucagguagaucuuugagguc

SEQ ID NO: 202514 - RNA, 22 nt, Homo sapiens
ucagguaugucuuuaacagcag

SEQ ID NO: 202515 - RNA, 22 nt, Homo sapiens
ucaggugccuuggcuaauuguu

SEQ ID NO: 202516 - RNA, 22 nt, Homo sapiens
ucaguacuuuggagcucacaua

SEQ ID NO: 202517 - RNA, 22 nt, Homo sapiens
ucaguagagacaggauuucacc

SEQ ID NO: 202518 - RNA, 22 nt, Homo sapiens
ucaguccccucgcugagucuac

SEQ ID NO: 202519 - RNA, 22 nt, Homo sapiens
ucagugcuguaccaucuaagga

SEQ ID NO: 202520 - RNA, 22 nt, Homo sapiens
ucagugcuuuuuguugucauca

SEQ ID NO: 202521 - RNA, 22 nt, Homo sapiens
ucaguggacuuagucuuucccc

SEQ ID NO: 202522 - RNA, 22 nt, Homo sapiens
ucagugucugugcaccgcugga

SEQ ID NO: 202523 - RNA, 22 nt, Homo sapiens
ucaguguuuggaaucucaauuu

SEQ ID NO: 202524 - RNA, 22 nt, Homo sapiens
ucauacaggccaccagggaagu

SEQ ID NO: 202525 - RNA, 22 nt, Homo sapiens
ucauacaguaguccucacuugu

SEQ ID NO: 202526 - RNA, 20 nt, Homo sapiens
ucauacuguggaguaccagg

SEQ ID NO: 202527 - RNA, 20 nt, Homo sapiens
ucauagggugguggcagugg

SEQ ID NO: 202528 - RNA, 22 nt, Homo sapiens
ucauaggucacuguaaccucgu

SEQ ID NO: 202529 - RNA, 16 nt, Homo sapiens
ucauaguaucucuucu

SEQ ID NO: 202530 - RNA, 19 nt, Homo sapiens
ucauagucuaagaugagaa

SEQ ID NO: 202531 - RNA, 22 nt, Homo sapiens
ucaugugaggauaacaauagug

SEQ ID NO: 202532 - RNA, 22 nt, Homo sapiens
ucauuguccaacuucuuucagu

SEQ ID NO: 202533 - RNA, 22 nt, Homo sapiens
uccaauguaaucaucauugaau

SEQ ID NO: 202534 - RNA, 22 nt, Homo sapiens
uccacaguaaggacccugccuu

SEQ ID NO: 202535 - RNA, 22 nt, Homo sapiens
uccacagugguggaauuguuca

SEQ ID NO: 202536 - RNA, 19 nt, Homo sapiens
uccaccgcgugcaccucua

SEQ ID NO: 202537 - RNA, 22 nt, Homo sapiens
uccagcuuuuucuaauucugug

SEQ ID NO: 202538 - RNA, 22 nt, Homo sapiens
uccagguuuugugaguuuaaau

SEQ ID NO: 202539 - RNA, 22 nt, Homo sapiens
cucagcaguggauuuaccacca

SEQ ID NO: 202540 - RNA, 22 nt, Homo sapiens
cucagcuacuugggaagcugag

SEQ ID NO: 202541 - RNA, 22 nt, Homo sapiens
cucaggcacucugauuccagug

SEQ ID NO: 202542 - RNA, 22 nt, Homo sapiens
cucaggguacuucuccuuugcu

SEQ ID NO: 202543 - RNA, 22 nt, Homo sapiens
cucagucuaugauacuuugcua

SEQ ID NO: 202544 - RNA, 22 nt, Homo sapiens
cucagugaagggcaagaggcaa

SEQ ID NO: 202545 - RNA, 20 nt, Homo sapiens
cucagugcacccccauaaaa

SEQ ID NO: 202546 - RNA, 22 nt, Homo sapiens
cucagugucuggcacacagaaa

SEQ ID NO: 202547 - RNA, 22 nt, Homo sapiens
cucaguguuucagcugcucaga

SEQ ID NO: 202548 - RNA, 22 nt, Homo sapiens
cucauggaauacuucacagcca

SEQ ID NO: 202549 - RNA, 22 nt, Homo sapiens
cucauugcaaucuccaccuccc

SEQ ID NO: 202550 - RNA, 22 nt, Homo sapiens
cuccagugcaaagucaugauca

SEQ ID NO: 202551 - RNA, 20 nt, Homo sapiens
cucccugacaaauguggaaa

SEQ ID NO: 202552 - RNA, 22 nt, Homo sapiens
cuccuguagccccaucaucuuu

SEQ ID NO: 202553 - RNA, 22 nt, Homo sapiens
cucugguggaagcagggggcaa

SEQ ID NO: 202554 - RNA, 22 nt, Homo sapiens
cucugguucugcagugcacccu

SEQ ID NO: 202555 - RNA, 21 nt, Homo sapiens
cucugguuugcauuggauuau

SEQ ID NO: 202556 - RNA, 22 nt, Homo sapiens
cucuuuuguuuagcugagaggg

SEQ ID NO: 202557 - RNA, 22 nt, Homo sapiens
cugaaagguauacgcuuguuau

SEQ ID NO: 202558 - RNA, 22 nt, Homo sapiens
cugaaaugaauuauuuucuuuc

SEQ ID NO: 202559 - RNA, 22 nt, Homo sapiens
cugaaauggaaugugugcacag

SEQ ID NO: 202560 - RNA, 22 nt, Homo sapiens
cugacauuguugaucacagcca

SEQ ID NO: 202561 - RNA, 22 nt, Homo sapiens
cugaccauagacuacucugggc

SEQ ID NO: 202562 - RNA, 22 nt, Homo sapiens
cugagacacucuuaucugcaua

SEQ ID NO: 202563 - RNA, 22 nt, Homo sapiens
cugagagugguauguuuaagug

SEQ ID NO: 202564 - RNA, 22 nt, Homo sapiens
cugagaguugaugaaauauggu

SEQ ID NO: 202565 - RNA, 22 nt, Homo sapiens
cugagaucaugggucagguggu

SEQ ID NO: 202566 - RNA, 22 nt, Homo sapiens
cugagcaugacaucaugugacu

SEQ ID NO: 202567 - RNA, 22 nt, Homo sapiens
cugaggaaguucuuuaacaguu

SEQ ID NO: 202568 - RNA, 22 nt, Homo sapiens
cugaggguagaaggaucacuug

SEQ ID NO: 202569 - RNA, 22 nt, Homo sapiens
cugagguaauuuuccagauaau

SEQ ID NO: 202570 - RNA, 22 nt, Homo sapiens
cugagguaggcccugagaauau

SEQ ID NO: 202571 - RNA, 22 nt, Homo sapiens
cugagguauaucccauuagaag

SEQ ID NO: 202572 - RNA, 22 nt, Homo sapiens
cugaggucugaauccagguauc

SEQ ID NO: 202573 - RNA, 22 nt, Homo sapiens
cugaggugggaguuuuucucau

SEQ ID NO: 202574 - RNA, 22 nt, Homo sapiens
cugauaguucucuuuagaguuu

SEQ ID NO: 202575 - RNA, 22 nt, Homo sapiens
cugauaugaugggugauuuuca

SEQ ID NO: 202576 - RNA, 22 nt, Homo sapiens
cugauguagguggucugugauc

SEQ ID NO: 202577 - RNA, 22 nt, Homo sapiens
cugauuguagagccccagggcu

SEQ ID NO: 202578 - RNA, 22 nt, Homo sapiens
cugauugucaucaauauuauua

SEQ ID NO: 202579 - RNA, 22 nt, Homo sapiens
cugcagguaggggcagcuuugg

SEQ ID NO: 202580 - RNA, 22 nt, Homo sapiens
cugcaguaaccacuguaggugu

SEQ ID NO: 202581 - RNA, 22 nt, Homo sapiens
cugcauuugaugacguauggug

SEQ ID NO: 202582 - RNA, 22 nt, Homo sapiens
cugcccuuucuauaugauguaa

SEQ ID NO: 202583 - RNA, 22 nt, Homo sapiens
cugcuggucuuuaaggucuagg

SEQ ID NO: 202584 - RNA, 22 nt, Homo sapiens
cuggaaacaucuuaggaaugca

SEQ ID NO: 202585 - RNA, 22 nt, Homo sapiens
cuggacaaaucuggaaagaacc

SEQ ID NO: 202586 - RNA, 22 nt, Homo sapiens
cuggacguugaggcugcaguga

SEQ ID NO: 202587 - RNA, 22 nt, Homo sapiens
cuggaggccugaacauaaaugg

SEQ ID NO: 202588 - RNA, 22 nt, Homo sapiens
cuggaguaugauguuagcguug

SEQ ID NO: 202589 - RNA, 22 nt, Homo sapiens
cuggagucugacugacacaagg

SEQ ID NO: 202590 - RNA, 22 nt, Homo sapiens
cuggcucauuucauuuagcaua

SEQ ID NO: 202591 - RNA, 22 nt, Homo sapiens
cugggaugugacuguugccccc

SEQ ID NO: 202592 - RNA, 22 nt, Homo sapiens
cugggucaguuucugauuauug

SEQ ID NO: 202593 - RNA, 22 nt, Homo sapiens
cuguaaaguaagagguaaguua

SEQ ID NO: 202594 - RNA, 22 nt, Homo sapiens
cuguaacagaauaaauuuguuu

SEQ ID NO: 202595 - RNA, 19 nt, Homo sapiens
cugucacugaggaagacug

SEQ ID NO: 202596 - RNA, 22 nt, Homo sapiens
cugugcauggauuuuaagauug

SEQ ID NO: 202597 - RNA, 23 nt, Homo sapiens
cuguggugaggcccuagaaucug

SEQ ID NO: 202598 - RNA, 22 nt, Homo sapiens
cuguugguguuuaaucacugca

SEQ ID NO: 202599 - RNA, 22 nt, Homo sapiens
cuucaaaguuggcuaggagaca

SEQ ID NO: 202600 - RNA, 22 nt, Homo sapiens
uaggauaguccuccugagaccu

SEQ ID NO: 202601 - RNA, 22 nt, Homo sapiens
uaggcacacaucuacuacaaau

SEQ ID NO: 202602 - RNA, 22 nt, Homo sapiens
uagggcuugugaucagguguag

SEQ ID NO: 202603 - RNA, 22 nt, Homo sapiens
uagguaaguaugugugaugggg

SEQ ID NO: 202604 - RNA, 22 nt, Homo sapiens
uagguaguuagcauacuacaca

SEQ ID NO: 202605 - RNA, 22 nt, Homo sapiens
uaggucaguuuuggcuuggcuu

SEQ ID NO: 202606 - RNA, 22 nt, Homo sapiens
uaggugauccauuuguauuuua

SEQ ID NO: 202607 - RNA, 19 nt, Homo sapiens
uaggugguuuuccccucac

SEQ ID NO: 202608 - RNA, 22 nt, Homo sapiens
uaguaaacagcucugccacaau

SEQ ID NO: 202609 - RNA, 22 nt, Homo sapiens
uaguaaacauaguucuuuugcu

SEQ ID NO: 202610 - RNA, 22 nt, Homo sapiens
uaguaccauucccaaaccaacu

SEQ ID NO: 202611 - RNA, 22 nt, Homo sapiens
uaguagagauggggcacaugcc

SEQ ID NO: 202612 - RNA, 22 nt, Homo sapiens
uaguccauuuucaugcugcuau

SEQ ID NO: 202613 - RNA, 22 nt, Homo sapiens
uagugaaugucacuggcuguug

SEQ ID NO: 202614 - RNA, 22 nt, Homo sapiens
uagugcuguaauucuaaugaaa

SEQ ID NO: 202615 - RNA, 22 nt, Homo sapiens
uauacacgugugcauauauaca

SEQ ID NO: 202616 - RNA, 22 nt, Homo sapiens
uauaucuguccauggcccugcu

SEQ ID NO: 202617 - RNA, 22 nt, Homo sapiens
uauaugcacucagguguaugug

SEQ ID NO: 202618 - RNA, 19 nt, Homo sapiens
uaucaaguaugcacuguac

SEQ ID NO: 202619 - RNA, 22 nt, Homo sapiens
uaucacagcaaggacccauuau

SEQ ID NO: 202620 - RNA, 22 nt, Homo sapiens
uaucacagcauugucuauaaua

SEQ ID NO: 202621 - RNA, 22 nt, Homo sapiens
uaucacagugcuggaguauucc

SEQ ID NO: 202622 - RNA, 22 nt, Homo sapiens
uaucagagcugucagccuaccu

SEQ ID NO: 202623 - RNA, 21 nt, Homo sapiens
uaucauggugaaacccugucu

SEQ ID NO: 202624 - RNA, 22 nt, Homo sapiens
uaucauuguguuauuucuucca

SEQ ID NO: 202625 - RNA, 23 nt, Homo sapiens
uaucccuugccuuaugaugugag

SEQ ID NO: 202626 - RNA, 22 nt, Homo sapiens
uaucuacauguagguauguaug

SEQ ID NO: 202627 - RNA, 21 nt, Homo sapiens
uaucucaguuuuccuuugugg

SEQ ID NO: 202628 - RNA, 18 nt, Homo sapiens
uaucucauuucuuagguc

SEQ ID NO: 202629 - RNA, 22 nt, Homo sapiens
uaucucuuuucauguguaaaug

SEQ ID NO: 202630 - RNA, 22 nt, Homo sapiens
uaugaaagcuacuucucacaau

SEQ ID NO: 202631 - RNA, 22 nt, Homo sapiens
uaugaccuuggacaaguuacuu

SEQ ID NO: 202632 - RNA, 22 nt, Homo sapiens
uaugaccuuguccccucucgcc

SEQ ID NO: 202633 - RNA, 22 nt, Homo sapiens
uaugacucagaaggcacacaca

SEQ ID NO: 202634 - RNA, 22 nt, Homo sapiens
uaugcacaugcaugcuugaaua

SEQ ID NO: 202635 - RNA, 19 nt, Homo sapiens
uaugcuauuuauuagaagu

SEQ ID NO: 202636 - RNA, 22 nt, Homo sapiens
uauggauuugccuauucuguau

SEQ ID NO: 202637 - RNA, 22 nt, Homo sapiens
uauggcacuaguacuggaaagc

SEQ ID NO: 202638 - RNA, 22 nt, Homo sapiens
uauggcauuguuggugaugaua

SEQ ID NO: 202639 - RNA, 22 nt, Homo sapiens
uauggcuacuacgaauaaugcu

SEQ ID NO: 202640 - RNA, 22 nt, Homo sapiens
uauggcuuuucacuuaaguccu

SEQ ID NO: 202641 - RNA, 19 nt, Homo sapiens
uaugggauuuuuagggugu

SEQ ID NO: 202642 - RNA, 22 nt, Homo sapiens
uaugguuuuaagguuaaggacu

SEQ ID NO: 202643 - RNA, 22 nt, Homo sapiens
uaugguuuucucuuacguguug

SEQ ID NO: 202644 - RNA, 22 nt, Homo sapiens
uaugucuucuuuagagaaaugu

SEQ ID NO: 202645 - RNA, 22 nt, Homo sapiens
uaugugcacaugcccuggugac

SEQ ID NO: 202646 - RNA, 18 nt, Homo sapiens
uauuaagcuagauauuau

SEQ ID NO: 202647 - RNA, 22 nt, Homo sapiens
uauuacacuuuagugucuucca

SEQ ID NO: 202648 - RNA, 22 nt, Homo sapiens
uauuagugucuuuugguuagaa

SEQ ID NO: 202649 - RNA, 22 nt, Homo sapiens
uauuccacuauuaguccagaug

SEQ ID NO: 202650 - RNA, 22 nt, Homo sapiens
uauugccugucuccaaaaauca

SEQ ID NO: 202651 - RNA, 22 nt, Homo sapiens
uauugcuuaugaugcugaauua

SEQ ID NO: 202652 - RNA, 22 nt, Homo sapiens
uauuugguuacuugaauagcua

SEQ ID NO: 202653 - RNA, 22 nt, Homo sapiens
uauuugguuauaugaguaaguu

SEQ ID NO: 202654 - RNA, 22 nt, Homo sapiens
uauuugguuggugcaaaaguaa

SEQ ID NO: 202655 - RNA, 22 nt, Homo sapiens
ucaaaugcucuuugcagagagg

SEQ ID NO: 202656 - RNA, 22 nt, Homo sapiens
ucaaaugguccacgugaacauu

SEQ ID NO: 202657 - RNA, 21 nt, Homo sapiens
ucaaauugaaauuaggucauu

SEQ ID NO: 202658 - RNA, 22 nt, Homo sapiens
ucaacacaguuaaauggggaaa

SEQ ID NO: 202659 - RNA, 18 nt, Homo sapiens
ucaagcuauugucaugcc

SEQ ID NO: 202660 - RNA, 21 nt, Homo sapiens
ucaaggaguauacguaugcca

SEQ ID NO: 202661 - RNA, 22 nt, Homo sapiens
aagggaaugugguagcugguuu

SEQ ID NO: 202662 - RNA, 22 nt, Homo sapiens
aagguaguuagaaaauauaacu

SEQ ID NO: 202663 - RNA, 17 nt, Homo sapiens
aaggugcuucgaccucc

SEQ ID NO: 202664 - RNA, 21 nt, Homo sapiens
aaggugguggugauugagaug

SEQ ID NO: 202665 - RNA, 22 nt, Homo sapiens
aaggugguuuucucuuggaguc

SEQ ID NO: 202666 - RNA, 22 nt, Homo sapiens
aagguucuugcuugcaugacug

SEQ ID NO: 202667 - RNA, 22 nt, Homo sapiens
aaguaaacauugagagacaaga

SEQ ID NO: 202668 - RNA, 22 nt, Homo sapiens
aaguaauugagguuuuugcugu

SEQ ID NO: 202669 - RNA, 22 nt, Homo sapiens
aaguauuaagacuaagaggcuu

SEQ ID NO: 202670 - RNA, 22 nt, Homo sapiens
aagucacugagacuuguggcug

SEQ ID NO: 202671 - RNA, 22 nt, Homo sapiens
aagucauggaggaguaugugag

SEQ ID NO: 202672 - RNA, 22 nt, Homo sapiens
aaguccaugaagucuugugggu

SEQ ID NO: 202673 - RNA, 22 nt, Homo sapiens
aagugacuagacuaugaaaccu

SEQ ID NO: 202674 - RNA, 22 nt, Homo sapiens
aagugaguaauacgucaguugu

SEQ ID NO: 202675 - RNA, 20 nt, Homo sapiens
aagugcaucguugugucugc

SEQ ID NO: 202676 - RNA, 22 nt, Homo sapiens
aagugcuguaugggagccuagg

SEQ ID NO: 202677 - RNA, 22 nt, Homo sapiens
aagugcuguccuaccuuuggga

SEQ ID NO: 202678 - RNA, 22 nt, Homo sapiens
aagugcuuaggauagugugugg

SEQ ID NO: 202679 - RNA, 22 nt, Homo sapiens
aagugguguuugggagcuggac

SEQ ID NO: 202680 - RNA, 22 nt, Homo sapiens
aagugguucuaugaguuugcaa

SEQ ID NO: 202681 - RNA, 22 nt, Homo sapiens
aaguuguuggaguuccauuguu

SEQ ID NO: 202682 - RNA, 22 nt, Homo sapiens
aauaaagucugaagugugcuua

SEQ ID NO: 202683 - RNA, 22 nt, Homo sapiens
aauaaguugagaugaggucaua

SEQ ID NO: 202684 - RNA, 22 nt, Homo sapiens
aauacugaaaguauuuucaaau

SEQ ID NO: 202685 - RNA, 22 nt, Homo sapiens
aauauagcuauguacaugucca

SEQ ID NO: 202686 - RNA, 22 nt, Homo sapiens
aauaucacaggguguacacuca

SEQ ID NO: 202687 - RNA, 22 nt, Homo sapiens
aauaucacaguuggguguacac

SEQ ID NO: 202688 - RNA, 22 nt, Homo sapiens
aaucacauugaaucugcuaccu

SEQ ID NO: 202689 - RNA, 22 nt, Homo sapiens
aaucacuuugcuacaaggcagu

SEQ ID NO: 202690 - RNA, 22 nt, Homo sapiens
cuagccuggagugcaguggugc

SEQ ID NO: 202691 - RNA, 22 nt, Homo sapiens
cuagcuuuuuaugacaaucuug

SEQ ID NO: 202692 - RNA, 22 nt, Homo sapiens
cuaggaaguauguguuauugcu

SEQ ID NO: 202693 - RNA, 22 nt, Homo sapiens
cuauucacaauggugaagauau

SEQ ID NO: 202694 - RNA, 21 nt, Homo sapiens
cucaaaguacugauauuacag

SEQ ID NO: 202695 - RNA, 18 nt, Homo sapiens
cucaaccucaugcagggc

SEQ ID NO: 202696 - RNA, 22 nt, Homo sapiens
cucaaguaauccucccgccuug

SEQ ID NO: 202697 - RNA, 20 nt, Homo sapiens
cucacagacagcuucuuucu

SEQ ID NO: 202698 - RNA, 22 nt, Homo sapiens
cucaccuugugauccuccugcc

SEQ ID NO: 202699 - RNA, 22 nt, Homo sapiens
cucacggugcaggcuucuggga

SEQ ID NO: 202700 - RNA, 22 nt, Homo sapiens
cucacuggguguaaaacaugua

SEQ ID NO: 202701 - RNA, 22 nt, Homo sapiens
cucagagcacaguuuaugacag

SEQ ID NO: 202702 - RNA, 22 nt, Homo sapiens
cucagaguacuuuucccacuuc

SEQ ID NO: 202703 - RNA, 22 nt, Homo sapiens
cucagauacuugggagguugag

SEQ ID NO: 202704 - RNA, 20 nt, Homo sapiens
cucagauuauucugaagcaa

SEQ ID NO: 202705 - RNA, 22 nt, Homo sapiens
auccugagacuuugcugaaguu

SEQ ID NO: 202706 - RNA, 22 nt, Homo sapiens
auccuguaggcuaguagacagu

SEQ ID NO: 202707 - RNA, 22 nt, Homo sapiens
auccuugagaaaauaaaugacc

SEQ ID NO: 202708 - RNA, 16 nt, Homo sapiens
aucucagaccugcuga

SEQ ID NO: 202709 - RNA, 22 nt, Homo sapiens
aucucagagaaaauuacuaaga

SEQ ID NO: 202710 - RNA, 22 nt, Homo sapiens
aucucagcaacuaaagauccuu

SEQ ID NO: 202711 - RNA, 22 nt, Homo sapiens
aucugcaaauaaugaagauugg

SEQ ID NO: 202712 - RNA, 22 nt, Homo sapiens
aucugguguauuggugcugggu

SEQ ID NO: 202713 - RNA, 22 nt, Homo sapiens
aucugguguggcugugauccuc

SEQ ID NO: 202714 - RNA, 22 nt, Homo sapiens
aucuguguuuaaggucccagaa

SEQ ID NO: 202715 - RNA, 22 nt, Homo sapiens
aucuugggugggaacugagaau

SEQ ID NO: 202716 - RNA, 22 nt, Homo sapiens
aucuuuggauacuugauauagu

SEQ ID NO: 202717 - RNA, 22 nt, Homo sapiens
augaaaguguguggaaacuuga

SEQ ID NO: 202718 - RNA, 22 nt, Homo sapiens
augaaaucuuuggcagaucuua

SEQ ID NO: 202719 - RNA, 22 nt, Homo sapiens
augaaauugcuaucgcaguacu

SEQ ID NO: 202720 - RNA, 19 nt, Homo sapiens
augaacucaucauuucuca

SEQ ID NO: 202721 - RNA, 18 nt, Homo sapiens
augaacucaucauuuuua

SEQ ID NO: 202722 - RNA, 22 nt, Homo sapiens
augaaguuagcucauuucuuuu

SEQ ID NO: 202723 - RNA, 22 nt, Homo sapiens
augaauacugcugcaaugaaca

SEQ ID NO: 202724 - RNA, 22 nt, Homo sapiens
augaauagaguuaauugaguac

SEQ ID NO: 202725 - RNA, 22 nt, Homo sapiens
augacaguguggauuauuguaa

SEQ ID NO: 202726 - RNA, 22 nt, Homo sapiens
augacuggauaauggacacaca

SEQ ID NO: 202727 - RNA, 22 nt, Homo sapiens
augagacaguucccuuuaucuu

SEQ ID NO: 202728 - RNA, 22 nt, Homo sapiens
augagauacuacaaaugaguuu

SEQ ID NO: 202729 - RNA, 22 nt, Homo sapiens
augagauaggaacaaacuuaca

SEQ ID NO: 202730 - RNA, 22 nt, Homo sapiens
augagauauuuuauaagaucau

SEQ ID NO: 202731 - RNA, 22 nt, Homo sapiens
augagcugauuuccuuaccaua

SEQ ID NO: 202732 - RNA, 22 nt, Homo sapiens
augagcuguuuggaagacacuu

SEQ ID NO: 202733 - RNA, 22 nt, Homo sapiens
augaggugaggucaguaaggua

SEQ ID NO: 202734 - RNA, 22 nt, Homo sapiens
augaggugauaucuggaaauua

SEQ ID NO: 202735 - RNA, 22 nt, Homo sapiens
augaggugggcggcuuggaaga

SEQ ID NO: 202736 - RNA, 22 nt, Homo sapiens
augagguguuuauuguauccug

SEQ ID NO: 202737 - RNA, 22 nt, Homo sapiens
augaguuccuuccuugccuagg

SEQ ID NO: 202738 - RNA, 22 nt, Homo sapiens
augauacguuacuucacugggg

SEQ ID NO: 202739 - RNA, 22 nt, Homo sapiens
augauacuguucuaagauuuuu

SEQ ID NO: 202740 - RNA, 22 nt, Homo sapiens
augauagucuugagaagcauuu

SEQ ID NO: 202741 - RNA, 22 nt, Homo sapiens
augaucacuguggaaauucagc

SEQ ID NO: 202742 - RNA, 22 nt, Homo sapiens
augauggagguagauuguccau

SEQ ID NO: 202743 - RNA, 22 nt, Homo sapiens
augcaaacagcuaucuggcugg

SEQ ID NO: 202744 - RNA, 22 nt, Homo sapiens
augcaaacaucauagaguguac

SEQ ID NO: 202745 - RNA, 19 nt, Homo sapiens
augcaaugucacaggcugc

SEQ ID NO: 202746 - RNA, 22 nt, Homo sapiens
augcacaugcgaaaacuugugu

SEQ ID NO: 202747 - RNA, 22 nt, Homo sapiens
augcauagugggaugcucugug

SEQ ID NO: 202748 - RNA, 22 nt, Homo sapiens
augcauggcagagucaggguac

SEQ ID NO: 202749 - RNA, 22 nt, Homo sapiens
augccacuguacucuagccuag

SEQ ID NO: 202750 - RNA, 22 nt, Homo sapiens
augccacuguccuccugccuag

SEQ ID NO: 202751 - RNA, 20 nt, Homo sapiens
auguaauguaugauauguac

SEQ ID NO: 202752 - RNA, 22 nt, Homo sapiens
augucaaagaggaaaacuggau

SEQ ID NO: 202753 - RNA, 22 nt, Homo sapiens
augucacagguccuagccaagu

SEQ ID NO: 202754 - RNA, 21 nt, Homo sapiens
augucauggaugacuaauuca

SEQ ID NO: 202755 - RNA, 22 nt, Homo sapiens
augucuguuugcugagcccggc

SEQ ID NO: 202756 - RNA, 22 nt, Homo sapiens
augugaaugugaucggauaguc

SEQ ID NO: 202757 - RNA, 22 nt, Homo sapiens
augugacagugguuuuaagcgu

SEQ ID NO: 202758 - RNA, 22 nt, Homo sapiens
augugacugauguaaucagaca

SEQ ID NO: 202759 - RNA, 22 nt, Homo sapiens
augugacuggaucauggggacg

SEQ ID NO: 202760 - RNA, 22 nt, Homo sapiens
augugcaauguguacguagccc

SEQ ID NO: 202761 - RNA, 22 nt, Homo sapiens
augugcagauguuacaaauugu

SEQ ID NO: 202762 - RNA, 20 nt, Homo sapiens
augugcaguguggcaaccaa

SEQ ID NO: 202763 - RNA, 22 nt, Homo sapiens
augugcaugcuguucugccaga

SEQ ID NO: 202764 - RNA, 22 nt, Homo sapiens
augugcuagguacuguuuagca

SEQ ID NO: 202765 - RNA, 22 nt, Homo sapiens
auguggaaauguauaugugucu

SEQ ID NO: 202766 - RNA, 22 nt, Homo sapiens
auguggcuuuccuagaucuuag

SEQ ID NO: 202767 - RNA, 18 nt, Homo sapiens
auguggcuuuugaaggcu

SEQ ID NO: 202768 - RNA, 22 nt, Homo sapiens
auguuauguucuucucuguaua

SEQ ID NO: 202769 - RNA, 22 nt, Homo sapiens
auguugcuugaaggcauuuugu

SEQ ID NO: 202770 - RNA, 22 nt, Homo sapiens
auuaaguaaugguuccaauaau

SEQ ID NO: 202771 - RNA, 22 nt, Homo sapiens
auuaauguaauuaguaaaguug

SEQ ID NO: 202772 - RNA, 22 nt, Homo sapiens
auuagugaaugugaugucuuga

SEQ ID NO: 202773 - RNA, 22 nt, Homo sapiens
auuauauguguaugugcauacc

SEQ ID NO: 202774 - RNA, 20 nt, Homo sapiens
auucaaguaugccuugagaa

SEQ ID NO: 202775 - RNA, 22 nt, Homo sapiens
auucacugugcuuggccaaauu

SEQ ID NO: 202776 - RNA, 22 nt, Homo sapiens
auucacuuuuauagacaggucu

SEQ ID NO: 202777 - RNA, 22 nt, Homo sapiens
auucagaggggcagcugucuug

SEQ ID NO: 202778 - RNA, 22 nt, Homo sapiens
auucauagugcuaagguguauc

SEQ ID NO: 202779 - RNA, 22 nt, Homo sapiens
auuccacuuagugacucauuug

SEQ ID NO: 202780 - RNA, 22 nt, Homo sapiens
auuccagguggcgccauucaca

SEQ ID NO: 202781 - RNA, 23 nt, Homo sapiens
auuccaguggcaauuggagaaac

SEQ ID NO: 202782 - RNA, 22 nt, Homo sapiens
auuccaguggguuuacauccca

SEQ ID NO: 202783 - RNA, 22 nt, Homo sapiens
auuccauuuguuaucacacccg

SEQ ID NO: 202784 - RNA, 22 nt, Homo sapiens
auucccuuagcugccucagccu

SEQ ID NO: 202785 - RNA, 22 nt, Homo sapiens
auucccuuggucaacggaugca

SEQ ID NO: 202786 - RNA, 23 nt, Homo sapiens
auugaacacuuucauaugugagg

SEQ ID NO: 202787 - RNA, 22 nt, Homo sapiens
auugacacugauuuuucuuuaa

SEQ ID NO: 202788 - RNA, 22 nt, Homo sapiens
auugagacaaauuuguaugcag

SEQ ID NO: 202789 - RNA, 22 nt, Homo sapiens
auugcacaccagucugggcaaa

SEQ ID NO: 202790 - RNA, 22 nt, Homo sapiens
auugcacaucugcacuacagcc

SEQ ID NO: 202791 - RNA, 18 nt, Homo sapiens
auugcacuccugccuggg

SEQ ID NO: 202792 - RNA, 22 nt, Homo sapiens
auugcacugcagccugggcaac

SEQ ID NO: 202793 - RNA, 20 nt, Homo sapiens
auugcagcaugauuuauaau

SEQ ID NO: 202794 - RNA, 22 nt, Homo sapiens
auugcagcccacccugggugau

SEQ ID NO: 202795 - RNA, 22 nt, Homo sapiens
auugcaguuucaacuccagggc

SEQ ID NO: 202796 - RNA, 22 nt, Homo sapiens
auugcauaaacacauuucuuau

SEQ ID NO: 202797 - RNA, 22 nt, Homo sapiens
auugcauuuucagguuggucug

SEQ ID NO: 202798 - RNA, 18 nt, Homo sapiens
auugcccucauggggcuu

SEQ ID NO: 202799 - RNA, 23 nt, Homo sapiens
auugcccuugaaggcuaaacucu

SEQ ID NO: 202800 - RNA, 22 nt, Homo sapiens
auugcuauuauuugaccauugu

SEQ ID NO: 202801 - RNA, 22 nt, Homo sapiens
gcucuuuugggguaauucugag

SEQ ID NO: 202802 - RNA, 22 nt, Homo sapiens
gcugaaauguuuaauuugggag

SEQ ID NO: 202803 - RNA, 22 nt, Homo sapiens
gcugcuguuuaguuucuccugg

SEQ ID NO: 202804 - RNA, 22 nt, Homo sapiens
gcuggugaaggcugaaaagugg

SEQ ID NO: 202805 - RNA, 22 nt, Homo sapiens
gcugucaugagcaacacaugaa

SEQ ID NO: 202806 - RNA, 22 nt, Homo sapiens
gcuguugguaaaaaggacauga

SEQ ID NO: 202807 - RNA, 19 nt, Homo sapiens
gcuucuugaggacgaugac

SEQ ID NO: 202808 - RNA, 22 nt, Homo sapiens
gcuuguguuuacuguaguuacu

SEQ ID NO: 202809 - RNA, 22 nt, Homo sapiens
gcuuguguuugcuccccagaau

SEQ ID NO: 202810 - RNA, 22 nt, Homo sapiens
ggaaagacaccuuacuauguua

SEQ ID NO: 202811 - RNA, 22 nt, Homo sapiens
ggaaagacuauuguaaaggaug

SEQ ID NO: 202812 - RNA, 22 nt, Homo sapiens
ggaaagauguaauauuaucuaa

SEQ ID NO: 202813 - RNA, 22 nt, Homo sapiens
ggaaaucucugaggcucccuuc

SEQ ID NO: 202814 - RNA, 22 nt, Homo sapiens
ggaaauguuggugucaugaguu

SEQ ID NO: 202815 - RNA, 22 nt, Homo sapiens
ggaagugugaguaggauuugga

SEQ ID NO: 202816 - RNA, 22 nt, Homo sapiens
ggaaguuaauacagauagagua

SEQ ID NO: 202817 - RNA, 22 nt, Homo sapiens
ggaaugagaaauauuacacaau

SEQ ID NO: 202818 - RNA, 22 nt, Homo sapiens
ggaaugcuaaaauaggaugcug

SEQ ID NO: 202819 - RNA, 22 nt, Homo sapiens
ggaauguuaaagacuacacuga

SEQ ID NO: 202820 - RNA, 22 nt, Homo sapiens
ggaauguuaaggcgcuguuggu

SEQ ID NO: 202821 - RNA, 20 nt, Homo sapiens
ggaauguuaaucuccaugau

SEQ ID NO: 202822 - RNA, 22 nt, Homo sapiens
ggaauuaaggcaauugaaagcu

SEQ ID NO: 202823 - RNA, 22 nt, Homo sapiens
ggacaagagacugggacacuga

SEQ ID NO: 202824 - RNA, 22 nt, Homo sapiens
ggacaagaucuuccaccauuca

SEQ ID NO: 202825 - RNA, 22 nt, Homo sapiens
ggacauguauauauaugugugu

SEQ ID NO: 202826 - RNA, 22 nt, Homo sapiens
ggacauuaacugcaagauagau

SEQ ID NO: 202827 - RNA, 22 nt, Homo sapiens
ggagaucuuuguuaucuuuuga

SEQ ID NO: 202828 - RNA, 22 nt, Homo sapiens
ggagaugugccugcucugcucu

SEQ ID NO: 202829 - RNA, 22 nt, Homo sapiens
ggagcugugauuugaguccaga

SEQ ID NO: 202830 - RNA, 22 nt, Homo sapiens
ggagggugagaucaauuuggga

SEQ ID NO: 202831 - RNA, 22 nt, Homo sapiens
ggagguagucuuucccuuauca

SEQ ID NO: 202832 - RNA, 22 nt, Homo sapiens
ggaguaggaaggaaauguuaaa

SEQ ID NO: 202833 - RNA, 22 nt, Homo sapiens
ggaguuuaagucuugugcaucu

SEQ ID NO: 202834 - RNA, 22 nt, Homo sapiens
ggaucacuugagaccaggaguu

SEQ ID NO: 202835 - RNA, 22 nt, Homo sapiens
ggauggcauuucuuuagcuuuu

SEQ ID NO: 202836 - RNA, 23 nt, Homo sapiens
ggauucaucuguuuguucgcugu

SEQ ID NO: 202837 - RNA, 22 nt, Homo sapiens
ggcaaaauauugucugguauag

SEQ ID NO: 202838 - RNA, 17 nt, Homo sapiens
ggcaagaaguggaacuc

SEQ ID NO: 202839 - RNA, 22 nt, Homo sapiens
ggcaaggugaugaaugucuaca

SEQ ID NO: 202840 - RNA, 22 nt, Homo sapiens
ggcaagugucagcagcaacacc

SEQ ID NO: 202841 - RNA, 22 nt, Homo sapiens
ggcaaguucuaaugauuagaau

SEQ ID NO: 202842 - RNA, 19 nt, Homo sapiens
ggcaccuuuuccaaaaaug

SEQ ID NO: 202843 - RNA, 23 nt, Homo sapiens
ggcacggaauucaaagaggcauu

SEQ ID NO: 202844 - RNA, 22 nt, Homo sapiens
ggcacgguggcucacgccugua

SEQ ID NO: 202845 - RNA, 22 nt, Homo sapiens
ggcagaguggacauuuaaaugu

SEQ ID NO: 202846 - RNA, 22 nt, Homo sapiens
ggcagcuguguccuucguaagg

SEQ ID NO: 202847 - RNA, 22 nt, Homo sapiens
ggcagguaaggagugggagccu

SEQ ID NO: 202848 - RNA, 22 nt, Homo sapiens
ggcaguguaauaauuuauuaau

SEQ ID NO: 202849 - RNA, 22 nt, Homo sapiens
ggcaugcauuguacuaguaugc

SEQ ID NO: 202850 - RNA, 22 nt, Homo sapiens
ggcaugguggugugugccuaua

SEQ ID NO: 202851 - RNA, 22 nt, Homo sapiens
ggcauguuuaguagaauguggu

SEQ ID NO: 202852 - RNA, 22 nt, Homo sapiens
ggccagaugcaguggcucacac

SEQ ID NO: 202853 - RNA, 18 nt, Homo sapiens
ggcggguguuuuauucac

SEQ ID NO: 202854 - RNA, 22 nt, Homo sapiens
ggcuagagagcucagggauaug

SEQ ID NO: 202855 - RNA, 22 nt, Homo sapiens
aagcaggugucugugucuguaa

SEQ ID NO: 202856 - RNA, 21 nt, Homo sapiens
aagcaugguguaucuuuccau

SEQ ID NO: 202857 - RNA, 22 nt, Homo sapiens
aagcugccuugugaaggcauuc

SEQ ID NO: 202858 - RNA, 22 nt, Homo sapiens
aagcuggauuuaguguggagca

SEQ ID NO: 202859 - RNA, 22 nt, Homo sapiens
aagcugugucuugucagcuacc

SEQ ID NO: 202860 - RNA, 22 nt, Homo sapiens
aagcuguugguggaucuaccau

SEQ ID NO: 202861 - RNA, 22 nt, Homo sapiens
aaggaauacuggugguugcuau

SEQ ID NO: 202862 - RNA, 22 nt, Homo sapiens
aaggagcuaagagaucauacau

SEQ ID NO: 202863 - RNA, 22 nt, Homo sapiens
aaggaguagaggaauagcaaug

SEQ ID NO: 202864 - RNA, 22 nt, Homo sapiens
aaggauuguaaaguugacaaau

SEQ ID NO: 202865 - RNA, 22 nt, Homo sapiens
aaggcagugugcacauaacacu

SEQ ID NO: 202866 - RNA, 22 nt, Homo sapiens
aaggcaugcaaagaacauuuua

SEQ ID NO: 202867 - RNA, 22 nt, Homo sapiens
aaggcuuuuugcugacguccuu

SEQ ID NO: 202868 - RNA, 22 nt, Homo sapiens
aagggagcugcauaaucuugug

SEQ ID NO: 202869 - RNA, 22 nt, Homo sapiens
aagguauuuuugucuauaucuu

SEQ ID NO: 202870 - RNA, 22 nt, Homo sapiens
aaggucauugugguuuuugcca

SEQ ID NO: 202871 - RNA, 22 nt, Homo sapiens
aagguggugucagagagcuuau

SEQ ID NO: 202872 - RNA, 22 nt, Homo sapiens
aaguaaacauuuuguacaauaa

SEQ ID NO: 202873 - RNA, 22 nt, Homo sapiens
aaguaauggaguuauuuuauga

SEQ ID NO: 202874 - RNA, 19 nt, Homo sapiens
aaguacuugucuuuugaag

SEQ ID NO: 202875 - RNA, 22 nt, Homo sapiens
aaguagcuggaugcaguggcac

SEQ ID NO: 202876 - RNA, 22 nt, Homo sapiens
guaagacuuauuuucuuuauca

SEQ ID NO: 202877 - RNA, 22 nt, Homo sapiens
guaagugguagagcugggcuau

SEQ ID NO: 202878 - RNA, 22 nt, Homo sapiens
guaauaacuguggaaaaagguu

SEQ ID NO: 202879 - RNA, 22 nt, Homo sapiens
guaaucucagcuacuugggagu

SEQ ID NO: 202880 - RNA, 22 nt, Homo sapiens
guaaugcacucccaaagaucca

SEQ ID NO: 202881 - RNA, 22 nt, Homo sapiens
guacaaguaagaaaauugccca

SEQ ID NO: 202882 - RNA, 16 nt, Homo sapiens
guacacaguaaguaug

SEQ ID NO: 202883 - RNA, 22 nt, Homo sapiens
guacaggugcaggaugggcagg

SEQ ID NO: 202884 - RNA, 22 nt, Homo sapiens
guacaguauaguaauaggauuu

SEQ ID NO: 202885 - RNA, 22 nt, Homo sapiens
guacaugcaugcaugggugugc

SEQ ID NO: 202886 - RNA, 22 nt, Homo sapiens
guagugcaguuugagaaucagu

SEQ ID NO: 202887 - RNA, 22 nt, Homo sapiens
guaguuuaucagaaagaauagg

SEQ ID NO: 202888 - RNA, 22 nt, Homo sapiens
guauacuucugaaaauagcuau

SEQ ID NO: 202889 - RNA, 22 nt, Homo sapiens
guauaggcuuucaccacgccau

SEQ ID NO: 202890 - RNA, 22 nt, Homo sapiens
guaucucaguucucgugauuag

SEQ ID NO: 202891 - RNA, 22 nt, Homo sapiens
guaugacacaggaagcuuaacc

SEQ ID NO: 202892 - RNA, 22 nt, Homo sapiens
guauggaauuugugaccuuaua

SEQ ID NO: 202893 - RNA, 22 nt, Homo sapiens
guauuagaugguauuugaagau

SEQ ID NO: 202894 - RNA, 18 nt, Homo sapiens
guauuccagccugaguga

SEQ ID NO: 202895 - RNA, 22 nt, Homo sapiens
guauugacuaucaaucaugugc

SEQ ID NO: 202896 - RNA, 22 nt, Homo sapiens
guauugaguaaauguuuauugg

SEQ ID NO: 202897 - RNA, 22 nt, Homo sapiens
guauuuggugaugccuccaaac

SEQ ID NO: 202898 - RNA, 22 nt, Homo sapiens
guauuugguuauugcagccuga

SEQ ID NO: 202899 - RNA, 22 nt, Homo sapiens
guauuuguugcagcagcacuau

SEQ ID NO: 202900 - RNA, 22 nt, Homo sapiens
guauuuuguuagggugugguau

SEQ ID NO: 202901 - RNA, 22 nt, Homo sapiens
gucaagagaacuuucuaucacu

SEQ ID NO: 202902 - RNA, 22 nt, Homo sapiens
gucaagugaagcagugggagua

SEQ ID NO: 202903 - RNA, 22 nt, Homo sapiens
gucacagaggcuaagaccccac

SEQ ID NO: 202904 - RNA, 22 nt, Homo sapiens
gucacaguguuuguucauccca

SEQ ID NO: 202905 - RNA, 22 nt, Homo sapiens
gucacauugaugcccauggugg

SEQ ID NO: 202906 - RNA, 22 nt, Homo sapiens
gucaccauugagucauuuccuc

SEQ ID NO: 202907 - RNA, 22 nt, Homo sapiens
gucacugacaagagagaagaac

SEQ ID NO: 202908 - RNA, 22 nt, Homo sapiens
gucacugagcaauagaaaguuu

SEQ ID NO: 202909 - RNA, 22 nt, Homo sapiens
gucacugccugaggcugaugca

SEQ ID NO: 202910 - RNA, 22 nt, Homo sapiens
gucagaugcagauuccaguucu

SEQ ID NO: 202911 - RNA, 22 nt, Homo sapiens
gucagugauugauuuaaagacg

SEQ ID NO: 202912 - RNA, 22 nt, Homo sapiens
gucagugcauguaaacauaaaa

SEQ ID NO: 202913 - RNA, 22 nt, Homo sapiens
gucaguuugguuaaucauucca

SEQ ID NO: 202914 - RNA, 22 nt, Homo sapiens
gucauccaggcuggagugaagc

SEQ ID NO: 202915 - RNA, 22 nt, Homo sapiens
gucaugcaggguucgccagccc

SEQ ID NO: 202916 - RNA, 22 nt, Homo sapiens
guccagagaagucauuacuuca

SEQ ID NO: 202917 - RNA, 22 nt, Homo sapiens
guccaguuguuuucugagguug

SEQ ID NO: 202918 - RNA, 22 nt, Homo sapiens
guccaugagaugaauccacaca

SEQ ID NO: 202919 - RNA, 18 nt, Homo sapiens
guccauuuguugguacac

SEQ ID NO: 202920 - RNA, 22 nt, Homo sapiens
gucccaguggaaccuccaagcu

SEQ ID NO: 202921 - RNA, 22 nt, Homo sapiens
gucccugaggaacauccagggc

SEQ ID NO: 202922 - RNA, 22 nt, Homo sapiens
gucccugugucuuuauguggcc

SEQ ID NO: 202923 - RNA, 22 nt, Homo sapiens
gucgugcagaccucacagcauu

SEQ ID NO: 202924 - RNA, 22 nt, Homo sapiens
gucucacaggcaugaugccagc

SEQ ID NO: 202925 - RNA, 22 nt, Homo sapiens
acacugucucuugcugaccaug

SEQ ID NO: 202926 - RNA, 22 nt, Homo sapiens
acacuuucuggagcugcacaua

SEQ ID NO: 202927 - RNA, 20 nt, Homo sapiens
acagcauagccuuuuaaagc

SEQ ID NO: 202928 - RNA, 22 nt, Homo sapiens
acagguauagaaagcuaaaggg

SEQ ID NO: 202929 - RNA, 23 nt, Homo sapiens
acagucuaguuugaagucaggua

SEQ ID NO: 202930 - RNA, 18 nt, Homo sapiens
acagugcugucacugcuu

SEQ ID NO: 202931 - RNA, 22 nt, Homo sapiens
acagugcuguuguguuuucacg

SEQ ID NO: 202932 - RNA, 22 nt, Homo sapiens
acagugcuucugauaugaugcc

SEQ ID NO: 202933 - RNA, 22 nt, Homo sapiens
acaguggugcgaucucggcuca

SEQ ID NO: 202934 - RNA, 23 nt, Homo sapiens
acaguggugugaucuuggcucag

SEQ ID NO: 202935 - RNA, 18 nt, Homo sapiens
acagugucauggcucaau

SEQ ID NO: 202936 - RNA, 17 nt, Homo sapiens
acagugucuaugaaaug

SEQ ID NO: 202937 - RNA, 18 nt, Homo sapiens
acagugucuuacaccugu

SEQ ID NO: 202938 - RNA, 21 nt, Homo sapiens
acaucagaguugugaagguag

SEQ ID NO: 202939 - RNA, 22 nt, Homo sapiens
acaucaggcuugugaugauuac

SEQ ID NO: 202940 - RNA, 22 nt, Homo sapiens
acaucccaugccuggguacucc

SEQ ID NO: 202941 - RNA, 22 nt, Homo sapiens
acaugagacuggguuuguaggg

SEQ ID NO: 202942 - RNA, 22 nt, Homo sapiens
acaugcauccaugugaagagac

SEQ ID NO: 202943 - RNA, 22 nt, Homo sapiens
acaugcauggcaugcauuguac

SEQ ID NO: 202944 - RNA, 22 nt, Homo sapiens
acauguauauaaugcauagcga

SEQ ID NO: 202945 - RNA, 22 nt, Homo sapiens
acauucagcuguuguuucaaug

SEQ ID NO: 202946 - RNA, 22 nt, Homo sapiens
accauugcacuccagccugggc

SEQ ID NO: 202947 - RNA, 22 nt, Homo sapiens
accauugcacuccagccuuggc

SEQ ID NO: 202948 - RNA, 22 nt, Homo sapiens
accauugcacuucagccuaggc

SEQ ID NO: 202949 - RNA, 22 nt, Homo sapiens
acccaguguucagacuaccugu

SEQ ID NO: 202950 - RNA, 22 nt, Homo sapiens
accccauuugcacugagcccuu

SEQ ID NO: 202951 - RNA, 17 nt, Homo sapiens
accccuaccucagaagc

SEQ ID NO: 202952 - RNA, 22 nt, Homo sapiens
acccucagaccaguuucccugg

SEQ ID NO: 202953 - RNA, 22 nt, Homo sapiens
acccuggaggucuacagugcag

SEQ ID NO: 202954 - RNA, 22 nt, Homo sapiens
acccugucauccacauggugcu

SEQ ID NO: 202955 - RNA, 22 nt, Homo sapiens
accuggacacuuugggcuccuc

SEQ ID NO: 202956 - RNA, 22 nt, Homo sapiens
accugggugcugaugggcuuua

SEQ ID NO: 202957 - RNA, 23 nt, Homo sapiens
accuucauucauucagcugaagu

SEQ ID NO: 202958 - RNA, 22 nt, Homo sapiens
accuucauuguugccaugucca

SEQ ID NO: 202959 - RNA, 22 nt, Homo sapiens
acgugcaugcacacacaugcgc

SEQ ID NO: 202960 - RNA, 22 nt, Homo sapiens
acuauacuguaacuguauucag

SEQ ID NO: 202961 - RNA, 22 nt, Homo sapiens
acucacagcaaccuccgccucc

SEQ ID NO: 202962 - RNA, 22 nt, Homo sapiens
acucauugcucauaccuuaucu

SEQ ID NO: 202963 - RNA, 22 nt, Homo sapiens
acuccauuucauuuuagcucuu

SEQ ID NO: 202964 - RNA, 22 nt, Homo sapiens
acucugucuaguuguaaaauuu

SEQ ID NO: 202965 - RNA, 22 nt, Homo sapiens
acugagaucuuuaaauaaauaa

SEQ ID NO: 202966 - RNA, 23 nt, Homo sapiens
acugagcaauguuuacauacuug

SEQ ID NO: 202967 - RNA, 19 nt, Homo sapiens
acugagcuaccugggggca

SEQ ID NO: 202968 - RNA, 22 nt, Homo sapiens
acugaucaauguuaaggcuuau

SEQ ID NO: 202969 - RNA, 23 nt, Homo sapiens
acugcaauuacguuugcaccaac

SEQ ID NO: 202970 - RNA, 22 nt, Homo sapiens
acugcacuccacccuuggcagc

SEQ ID NO: 202971 - RNA, 22 nt, Homo sapiens
acugcacuccaccuugggcaac

SEQ ID NO: 202972 - RNA, 22 nt, Homo sapiens
acugcacuccagacucugucuc

SEQ ID NO: 202973 - RNA, 22 nt, Homo sapiens
acugcacuccagccuccugggu

SEQ ID NO: 202974 - RNA, 22 nt, Homo sapiens
acugcacuccagccugccgaca

SEQ ID NO: 202975 - RNA, 22 nt, Homo sapiens
acugcacuccagccuguugaca

SEQ ID NO: 202976 - RNA, 22 nt, Homo sapiens
acugcacuccagccuucaggac

SEQ ID NO: 202977 - RNA, 22 nt, Homo sapiens
acugcacuccagccuugugaca

SEQ ID NO: 202978 - RNA, 22 nt, Homo sapiens
acugcacucuagccuuggcaac

SEQ ID NO: 202979 - RNA, 22 nt, Homo sapiens
acugcacuucagccuugugaca

SEQ ID NO: 202980 - RNA, 20 nt, Homo sapiens
acugggcuaccgaaguaagg

SEQ ID NO: 202981 - RNA, 22 nt, Homo sapiens
acuggguuaauuugaagguuga

SEQ ID NO: 202982 - RNA, 22 nt, Homo sapiens
acugguguaugggaggucccaa

SEQ ID NO: 202983 - RNA, 22 nt, Homo sapiens
acuguguguuugucuagcacag

SEQ ID NO: 202984 - RNA, 22 nt, Homo sapiens
acuuggcaaaguuuuaaacagc

SEQ ID NO: 202985 - RNA, 21 nt, Homo sapiens
acuuuguugggggcugaggca

SEQ ID NO: 202986 - RNA, 22 nt, Homo sapiens
acuuuuguuauacagugugaua

SEQ ID NO: 202987 - RNA, 20 nt, Homo sapiens
acuuuuugaugaggucguuu

SEQ ID NO: 202988 - RNA, 21 nt, Homo sapiens
agaaaaucuuaugggaaacau

SEQ ID NO: 202989 - RNA, 22 nt, Homo sapiens
agaaccaaucccacauggauac

SEQ ID NO: 202990 - RNA, 20 nt, Homo sapiens
agaagcauugcucucuucag

SEQ ID NO: 202991 - RNA, 22 nt, Homo sapiens
agaagugcuggguucaggcugg

SEQ ID NO: 202992 - RNA, 22 nt, Homo sapiens
agaaugucaguauuggcuaaaa

SEQ ID NO: 202993 - RNA, 22 nt, Homo sapiens
agaauucugucauguuuauauu

SEQ ID NO: 202994 - RNA, 22 nt, Homo sapiens
agacacugaaauguauugaaga

SEQ ID NO: 202995 - RNA, 22 nt, Homo sapiens
agacagcuggaguaucauagcu

SEQ ID NO: 202996 - RNA, 22 nt, Homo sapiens
agacccuguauguguuuaguuu

SEQ ID NO: 202997 - RNA, 20 nt, Homo sapiens
agacuagggagcagaaagcc

SEQ ID NO: 202998 - RNA, 22 nt, Homo sapiens
agagaacugauucagggaaaau

SEQ ID NO: 202999 - RNA, 22 nt, Homo sapiens
gagcacugaauacugugguggu

SEQ ID NO: 203000 - RNA, 22 nt, Homo sapiens
gagccauggagaaaacagcuau

SEQ ID NO: 203001 - RNA, 22 nt, Homo sapiens
gagcugaucuuuauguaaauuc

SEQ ID NO: 203002 - RNA, 22 nt, Homo sapiens
gagcugguccuuuaaggaugca

SEQ ID NO: 203003 - RNA, 20 nt, Homo sapiens
gagcugguguacugccgggc

SEQ ID NO: 203004 - RNA, 22 nt, Homo sapiens
gaggaguagggcacaaagccuu

SEQ ID NO: 203005 - RNA, 22 nt, Homo sapiens
gaggcauuauucccaucuuaca

SEQ ID NO: 203006 - RNA, 22 nt, Homo sapiens
gagggcacugcuuuccuuucaa

SEQ ID NO: 203007 - RNA, 22 nt, Homo sapiens
gagguagguacaauugccacca

SEQ ID NO: 203008 - RNA, 22 nt, Homo sapiens
gagguaucauuauguugcccag

SEQ ID NO: 203009 - RNA, 22 nt, Homo sapiens
gagguauggauaucuggagagg

SEQ ID NO: 203010 - RNA, 22 nt, Homo sapiens
gagguaugugggcagacauuua

SEQ ID NO: 203011 - RNA, 22 nt, Homo sapiens
gaggugaaggucucaauaaaua

SEQ ID NO: 203012 - RNA, 22 nt, Homo sapiens
gaguauauuugcacuguuaugu

SEQ ID NO: 203013 - RNA, 22 nt, Homo sapiens
gagugcauaugggccuguguca

SEQ ID NO: 203014 - RNA, 22 nt, Homo sapiens
gagugcuguuagcccuggguuu

SEQ ID NO: 203015 - RNA, 21 nt, Homo sapiens
gaguggcuuuuguuucaccag

SEQ ID NO: 203016 - RNA, 22 nt, Homo sapiens
gaguuagguugucaaugucuua

SEQ ID NO: 203017 - RNA, 22 nt, Homo sapiens
gauacaccauuuucuagcuauu

SEQ ID NO: 203018 - RNA, 22 nt, Homo sapiens
gauagcagccauucuuuuuauu

SEQ ID NO: 203019 - RNA, 22 nt, Homo sapiens
gauagcauucaauuaucuguug

SEQ ID NO: 203020 - RNA, 22 nt, Homo sapiens
gauagugaaccaagggguaauu

SEQ ID NO: 203021 - RNA, 22 nt, Homo sapiens
gauaguugugagaacucuuacu

SEQ ID NO: 203022 - RNA, 22 nt, Homo sapiens
gaucacauguguacucaaugug

SEQ ID NO: 203023 - RNA, 22 nt, Homo sapiens
gaucacauuguuucauacauau

SEQ ID NO: 203024 - RNA, 22 nt, Homo sapiens
gaucucaguggauacugugaug

SEQ ID NO: 203025 - RNA, 22 nt, Homo sapiens
gaucuguuucaauugucuuagu

SEQ ID NO: 203026 - RNA, 22 nt, Homo sapiens
gaugagaucauaaguguggagc

SEQ ID NO: 203027 - RNA, 22 nt, Homo sapiens
gaugccuauugcuaguccuaaa

SEQ ID NO: 203028 - RNA, 22 nt, Homo sapiens
gaugccuuuuuguccucaguua

SEQ ID NO: 203029 - RNA, 22 nt, Homo sapiens
gauggcauuucuggaucugccc

SEQ ID NO: 203030 - RNA, 22 nt, Homo sapiens
gaugguuuuucuccgauuuaua

SEQ ID NO: 203031 - RNA, 22 nt, Homo sapiens
gauuagugacguugagcacugu

SEQ ID NO: 203032 - RNA, 22 nt, Homo sapiens
gauuccacuuacuuagcauucc

SEQ ID NO: 203033 - RNA, 22 nt, Homo sapiens
gauuccauuuguggcuauuuac

SEQ ID NO: 203034 - RNA, 22 nt, Homo sapiens
gauuucaucuuuagaggaagga

SEQ ID NO: 203035 - RNA, 22 nt, Homo sapiens
gcaaaguguuuuccaacuuggu

SEQ ID NO: 203036 - RNA, 22 nt, Homo sapiens
gcaaaguguuuuuaggaagucu

SEQ ID NO: 203037 - RNA, 20 nt, Homo sapiens
gcaacauggccagagugaau

SEQ ID NO: 203038 - RNA, 22 nt, Homo sapiens
gcaauggaaucccuugaucaau

SEQ ID NO: 203039 - RNA, 22 nt, Homo sapiens
gcacacuuacacgaaccuagau

SEQ ID NO: 203040 - RNA, 22 nt, Homo sapiens
gcaccauugacaagaaauaggu

SEQ ID NO: 203041 - RNA, 22 nt, Homo sapiens
gcaccccuuaccgggcuggguu

SEQ ID NO: 203042 - RNA, 22 nt, Homo sapiens
gcacugggccacauuuauuuuc

SEQ ID NO: 203043 - RNA, 22 nt, Homo sapiens
gcagagaaacaggucuaaggag

SEQ ID NO: 203044 - RNA, 22 nt, Homo sapiens
gcaggcaugacauuucacucuu

SEQ ID NO: 203045 - RNA, 22 nt, Homo sapiens
gcagguauuagagagccugaaa

SEQ ID NO: 203046 - RNA, 22 nt, Homo sapiens
gcaguagugugaucuuggcuca

SEQ ID NO: 203047 - RNA, 22 nt, Homo sapiens
gcagucacagggagauggugac

SEQ ID NO: 203048 - RNA, 22 nt, Homo sapiens
gcaguggugugugccagccuag

SEQ ID NO: 203049 - RNA, 16 nt, Homo sapiens
gcaguguguuuaauag

SEQ ID NO: 203050 - RNA, 22 nt, Homo sapiens
gcaguguucaaaucaugcccau

SEQ ID NO: 203051 - RNA, 22 nt, Homo sapiens
gcaguguucugggcaggaagaa

SEQ ID NO: 203052 - RNA, 22 nt, Homo sapiens
gcaguucuguaguugaaauuua

SEQ ID NO: 203053 - RNA, 17 nt, Homo sapiens
gcauaugucgaaccagc

SEQ ID NO: 203054 - RNA, 17 nt, Homo sapiens
gcauauguugaaccagu

SEQ ID NO: 203055 - RNA, 22 nt, Homo sapiens
gcaucacagggagacaggccuc

SEQ ID NO: 203056 - RNA, 22 nt, Homo sapiens
gcaugaugaauaauaucacaag

SEQ ID NO: 203057 - RNA, 22 nt, Homo sapiens
gucucccagccuacaucuuucu

SEQ ID NO: 203058 - RNA, 22 nt, Homo sapiens
gucuccgagccguguggagccg

SEQ ID NO: 203059 - RNA, 22 nt, Homo sapiens
gucugcaugucauaugauagua

SEQ ID NO: 203060 - RNA, 22 nt, Homo sapiens
gucuggcaauggcagacuggca

SEQ ID NO: 203061 - RNA, 22 nt, Homo sapiens
gucuuccagccuccaucuuucu

SEQ ID NO: 203062 - RNA, 22 nt, Homo sapiens
gucuugaaggcugaguaccugu

SEQ ID NO: 203063 - RNA, 22 nt, Homo sapiens
gucuuugagauaggguuauuuu

SEQ ID NO: 203064 - RNA, 22 nt, Homo sapiens
gucuuuguuuggucuguaucag

SEQ ID NO: 203065 - RNA, 22 nt, Homo sapiens
gucuuuguuuugauuuaccaga

SEQ ID NO: 203066 - RNA, 22 nt, Homo sapiens
gugaacagcagaugagugagug

SEQ ID NO: 203067 - RNA, 22 nt, Homo sapiens
gugaauguuuucuuacauggua

SEQ ID NO: 203068 - RNA, 22 nt, Homo sapiens
gugacacuggagcuggcacaau

SEQ ID NO: 203069 - RNA, 22 nt, Homo sapiens
gugacauuuuuacugaugagag

SEQ ID NO: 203070 - RNA, 22 nt, Homo sapiens
gugagagaaugacuauguguuu

SEQ ID NO: 203071 - RNA, 22 nt, Homo sapiens
gugagaugauggguauguuaau

SEQ ID NO: 203072 - RNA, 22 nt, Homo sapiens
gugagauggaguuggugucuuu

SEQ ID NO: 203073 - RNA, 22 nt, Homo sapiens
gugagcaguguccuugggggca

SEQ ID NO: 203074 - RNA, 22 nt, Homo sapiens
gugagccaugauuuuaccacug

SEQ ID NO: 203075 - RNA, 22 nt, Homo sapiens
gugaggcacugcugcuuuccag

SEQ ID NO: 203076 - RNA, 22 nt, Homo sapiens
gugaggcugguccugccuccca

SEQ ID NO: 203077 - RNA, 22 nt, Homo sapiens
gugaggucagggcuguggacag

SEQ ID NO: 203078 - RNA, 22 nt, Homo sapiens
gugauacugcuuauuaauuuaa

SEQ ID NO: 203079 - RNA, 21 nt, Homo sapiens
gugaucaugucacugcacucc

SEQ ID NO: 203080 - RNA, 22 nt, Homo sapiens
gugaucucagcucacuggaacc

SEQ ID NO: 203081 - RNA, 22 nt, Homo sapiens
gugaucucauuuggaauuagag

SEQ ID NO: 203082 - RNA, 22 nt, Homo sapiens
gugauguguuuguucuaucucu

SEQ ID NO: 203083 - RNA, 22 nt, Homo sapiens
gugcaaacuccaggucucuuca

SEQ ID NO: 203084 - RNA, 22 nt, Homo sapiens
gugcacaacaugcagguuuguu

SEQ ID NO: 203085 - RNA, 22 nt, Homo sapiens
gugcacaacgugcaggcuuguu

SEQ ID NO: 203086 - RNA, 22 nt, Homo sapiens
gugcacaacgugcagguuuguu

SEQ ID NO: 203087 - RNA, 22 nt, Homo sapiens
gugcacaacguguagguuuguu

SEQ ID NO: 203088 - RNA, 22 nt, Homo sapiens
gugcacaaucgugcauuccuug

SEQ ID NO: 203089 - RNA, 22 nt, Homo sapiens
gugcacaaugugcagguuuguu

SEQ ID NO: 203090 - RNA, 22 nt, Homo sapiens
gugcacaucuguguuccagcua

SEQ ID NO: 203091 - RNA, 22 nt, Homo sapiens
gugcagugugauccuuccguau

SEQ ID NO: 203092 - RNA, 22 nt, Homo sapiens
gugcaguuugaaaguagaaaca

SEQ ID NO: 203093 - RNA, 22 nt, Homo sapiens
gugcaguuuuaagugaguuucu

SEQ ID NO: 203094 - RNA, 22 nt, Homo sapiens
gugcaguuuugagugaguuucu

SEQ ID NO: 203095 - RNA, 22 nt, Homo sapiens
gugcauaugcaugugcaugcac

SEQ ID NO: 203096 - RNA, 22 nt, Homo sapiens
gugcaugucugugacgacccug

SEQ ID NO: 203097 - RNA, 22 nt, Homo sapiens
gugcuuguauuuaaaucaugug

SEQ ID NO: 203098 - RNA, 22 nt, Homo sapiens
guggaaugauaucucauugugg

SEQ ID NO: 203099 - RNA, 22 nt, Homo sapiens
guggacagagacuaaauguugu

SEQ ID NO: 203100 - RNA, 22 nt, Homo sapiens
guggagacaaaggcugagugag

SEQ ID NO: 203101 - RNA, 22 nt, Homo sapiens
guggaggacuggauaaagaaaa

SEQ ID NO: 203102 - RNA, 22 nt, Homo sapiens
guggcaagaugacuacucacug

SEQ ID NO: 203103 - RNA, 22 nt, Homo sapiens
guggcacaauuaaguagcuauu

SEQ ID NO: 203104 - RNA, 22 nt, Homo sapiens
guggcagaaaagagaagcaaug

SEQ ID NO: 203105 - RNA, 22 nt, Homo sapiens
guggcagugugaggauccugcu

SEQ ID NO: 203106 - RNA, 22 nt, Homo sapiens
guggcuagaaugaagguagcug

SEQ ID NO: 203107 - RNA, 22 nt, Homo sapiens
gugggauggagagaagguauga

SEQ ID NO: 203108 - RNA, 22 nt, Homo sapiens
gugggcaaagcuaguguguaga

SEQ ID NO: 203109 - RNA, 22 nt, Homo sapiens
gugguuuuaucccagaaauuaa

SEQ ID NO: 203110 - RNA, 22 nt, Homo sapiens
gugguuuucaacuccaccugca

SEQ ID NO: 203111 - RNA, 22 nt, Homo sapiens
guguaaaucaaucuguugucuu

SEQ ID NO: 203112 - RNA, 22 nt, Homo sapiens
guguaacaacagcacuccacug

SEQ ID NO: 203113 - RNA, 22 nt, Homo sapiens
guguaugguaggaugacggagu

SEQ ID NO: 203114 - RNA, 22 nt, Homo sapiens
gugucaaggaugccugucaggc

SEQ ID NO: 203115 - RNA, 22 nt, Homo sapiens
gugucacugugaggauauugua

SEQ ID NO: 203116 - RNA, 22 nt, Homo sapiens
gugucaugagggggacaggaag

SEQ ID NO: 203117 - RNA, 18 nt, Homo sapiens
gugucugguuaugggagu

SEQ ID NO: 203118 - RNA, 21 nt, Homo sapiens
gugugcuugaauucagcuguc

SEQ ID NO: 203119 - RNA, 22 nt, Homo sapiens
guguggcaggugggggcucaga

SEQ ID NO: 203120 - RNA, 22 nt, Homo sapiens
guuaaagacauccacauaggag

SEQ ID NO: 203121 - RNA, 23 nt, Homo sapiens
guuaagugaauguguacucuauu

SEQ ID NO: 203122 - RNA, 22 nt, Homo sapiens
guuaugcagcaauugauaaucu

SEQ ID NO: 203123 - RNA, 22 nt, Homo sapiens
guuauguuaaauuguuguaugc

SEQ ID NO: 203124 - RNA, 22 nt, Homo sapiens
guuauguuaguuacaaggcuag

SEQ ID NO: 203125 - RNA, 22 nt, Homo sapiens
guucacacuugcaaccccagca

SEQ ID NO: 203126 - RNA, 22 nt, Homo sapiens
guucucacuggugcugguaagu

SEQ ID NO: 203127 - RNA, 22 nt, Homo sapiens
guugaaaucaucacuuggcaug

SEQ ID NO: 203128 - RNA, 22 nt, Homo sapiens
guugaaauccuaacccccuagu

SEQ ID NO: 203129 - RNA, 22 nt, Homo sapiens
guugguuuccuguaacuggaca

SEQ ID NO: 203130 - RNA, 22 nt, Homo sapiens
agagagcuugggguguuaaauu

SEQ ID NO: 203131 - RNA, 22 nt, Homo sapiens
agagagcuuuugguugcccuaa

SEQ ID NO: 203132 - RNA, 22 nt, Homo sapiens
agagauaauuagguuaaaugag

SEQ ID NO: 203133 - RNA, 18 nt, Homo sapiens
agagcacugaguuuuaga

SEQ ID NO: 203134 - RNA, 22 nt, Homo sapiens
agagcauugaguuaaugguuca

SEQ ID NO: 203135 - RNA, 22 nt, Homo sapiens
agagguguuaaagucucuuuua

SEQ ID NO: 203136 - RNA, 22 nt, Homo sapiens
agaguacaggcaaguuagucau

SEQ ID NO: 203137 - RNA, 22 nt, Homo sapiens
agagucacaugaggcccuucau

SEQ ID NO: 203138 - RNA, 22 nt, Homo sapiens
agagugcaaagguuggggcugg

SEQ ID NO: 203139 - RNA, 22 nt, Homo sapiens
agauacaucuaugugucugugu

SEQ ID NO: 203140 - RNA, 22 nt, Homo sapiens
agauauguuuaguuucaaaaug

SEQ ID NO: 203141 - RNA, 23 nt, Homo sapiens
agaugcaucuggcugcgaggcaa

SEQ ID NO: 203142 - RNA, 18 nt, Homo sapiens
agaugcaugcucacuaca

SEQ ID NO: 203143 - RNA, 23 nt, Homo sapiens
agaugcauucuuguaggauauau

SEQ ID NO: 203144 - RNA, 22 nt, Homo sapiens
agauguuguucaucugauuguu

SEQ ID NO: 203145 - RNA, 23 nt, Homo sapiens
agcaaaugcucuagcacuccaac

SEQ ID NO: 203146 - RNA, 22 nt, Homo sapiens
agcaacauuguucauaauagcu

SEQ ID NO: 203147 - RNA, 22 nt, Homo sapiens
agcaauaugacauugcuacauc

SEQ ID NO: 203148 - RNA, 22 nt, Homo sapiens
agcaccaauaaucagaguucuu

SEQ ID NO: 203149 - RNA, 22 nt, Homo sapiens
agcaccagaaucugaguuauuc

SEQ ID NO: 203150 - RNA, 22 nt, Homo sapiens
agcaccaugggcugaguaagug

SEQ ID NO: 203151 - RNA, 22 nt, Homo sapiens
agcagagcauauucauucgggg

SEQ ID NO: 203152 - RNA, 22 nt, Homo sapiens
agcagcaucgggaaguuggcca

SEQ ID NO: 203153 - RNA, 22 nt, Homo sapiens
agcagcucaagacuuaaauuug

SEQ ID NO: 203154 - RNA, 22 nt, Homo sapiens
agcagcuuugcauggccuguga

SEQ ID NO: 203155 - RNA, 22 nt, Homo sapiens
agcagguguccacaauguuugc

SEQ ID NO: 203156 - RNA, 22 nt, Homo sapiens
agcagguguggcuuauccugaa

SEQ ID NO: 203157 - RNA, 22 nt, Homo sapiens
agcagugucauuuucuggugag

SEQ ID NO: 203158 - RNA, 22 nt, Homo sapiens
agcauagugccuugaaaacaau

SEQ ID NO: 203159 - RNA, 22 nt, Homo sapiens
agcauggucacuuugggcccca

SEQ ID NO: 203160 - RNA, 22 nt, Homo sapiens
guuguggagucuucuguucugg

SEQ ID NO: 203161 - RNA, 22 nt, Homo sapiens
guuugcacuccuaugagaaucu

SEQ ID NO: 203162 - RNA, 22 nt, Homo sapiens
guuuggcucuuguuucugucaa

SEQ ID NO: 203163 - RNA, 15 nt, Homo sapiens
guuuuuggauacaau

SEQ ID NO: 203164 - RNA, 22 nt, Homo sapiens
uaaaccacguuuacauuugaga

SEQ ID NO: 203165 - RNA, 22 nt, Homo sapiens
uaaacugucuuuggagcuuugc

SEQ ID NO: 203166 - RNA, 17 nt, Homo sapiens
uaaagccagucaaguca

SEQ ID NO: 203167 - RNA, 22 nt, Homo sapiens
uaaagccauugucaaguuugua

SEQ ID NO: 203168 - RNA, 16 nt, Homo sapiens
uaaagcuaaucacuuu

SEQ ID NO: 203169 - RNA, 21 nt, Homo sapiens
uaaagcuagaaccuuagcuuu

SEQ ID NO: 203170 - RNA, 22 nt, Homo sapiens
uaaagcuagaauuguuccagca

SEQ ID NO: 203171 - RNA, 22 nt, Homo sapiens
uaaagcuagagcuggaguggca

SEQ ID NO: 203172 - RNA, 22 nt, Homo sapiens
uaaaugcuuaauugaaugugga

SEQ ID NO: 203173 - RNA, 22 nt, Homo sapiens
uaacaagagagucagucagucc

SEQ ID NO: 203174 - RNA, 19 nt, Homo sapiens
uaacacaguuguguuugag

SEQ ID NO: 203175 - RNA, 22 nt, Homo sapiens
uaacagucuccucaagguguug

SEQ ID NO: 203176 - RNA, 22 nt, Homo sapiens
uaacaguguauuccuuuggaca

SEQ ID NO: 203177 - RNA, 22 nt, Homo sapiens
uaacaguguauuuacuacuucc

SEQ ID NO: 203178 - RNA, 22 nt, Homo sapiens
uaacccagugucugugaugggu

SEQ ID NO: 203179 - RNA, 18 nt, Homo sapiens
uaacuggugugagauggu

SEQ ID NO: 203180 - RNA, 23 nt, Homo sapiens
uaagacacuaacuuuaugcuuug

SEQ ID NO: 203181 - RNA, 22 nt, Homo sapiens
uaagacacuuaaaauguuacau

SEQ ID NO: 203182 - RNA, 20 nt, Homo sapiens
uaagacaugguccacaugcc

SEQ ID NO: 203183 - RNA, 22 nt, Homo sapiens
uaagagcuaggauuuuaaauca

SEQ ID NO: 203184 - RNA, 18 nt, Homo sapiens
uaagaugcagccuauucc

SEQ ID NO: 203185 - RNA, 22 nt, Homo sapiens
uaaggcaaucagucaugguguu

SEQ ID NO: 203186 - RNA, 22 nt, Homo sapiens
uaaggcccgugaguuucauauc

SEQ ID NO: 203187 - RNA, 22 nt, Homo sapiens
uaaggcuuugucuuaggacuuu

SEQ ID NO: 203188 - RNA, 22 nt, Homo sapiens
uaaguaauugcagcaauuugcc

SEQ ID NO: 203189 - RNA, 22 nt, Homo sapiens
uaaguagaggaaucauuuugug

SEQ ID NO: 203190 - RNA, 22 nt, Homo sapiens
uaaguaguguugagacaaguuu

SEQ ID NO: 203191 - RNA, 22 nt, Homo sapiens
uaaguaguuucuggauauucuc

SEQ ID NO: 203192 - RNA, 22 nt, Homo sapiens
uaagucuuuuuggaguuuauaa

SEQ ID NO: 203193 - RNA, 22 nt, Homo sapiens
uaagugaaggaaguguguuuac

SEQ ID NO: 203194 - RNA, 22 nt, Homo sapiens
ucccugacagucacagagcuac

SEQ ID NO: 203195 - RNA, 22 nt, Homo sapiens
ucccuuagccaaauccccagcc

SEQ ID NO: 203196 - RNA, 22 nt, Homo sapiens
uccucauggagaaccucugcua

SEQ ID NO: 203197 - RNA, 22 nt, Homo sapiens
uccucugaacuccagacccaua

SEQ ID NO: 203198 - RNA, 22 nt, Homo sapiens
uccugagaauagaguugcaugu

SEQ ID NO: 203199 - RNA, 21 nt, Homo sapiens
uccugagagaggaguaacucu

SEQ ID NO: 203200 - RNA, 22 nt, Homo sapiens
uccugagagcagacccucuaua

SEQ ID NO: 203201 - RNA, 22 nt, Homo sapiens
uccugagucagcauccguuugu

SEQ ID NO: 203202 - RNA, 22 nt, Homo sapiens
uccuucacucuacaucuuuguu

SEQ ID NO: 203203 - RNA, 22 nt, Homo sapiens
uccuugagccugggaguuauag

SEQ ID NO: 203204 - RNA, 22 nt, Homo sapiens
uccuugguugauccugugcaga

SEQ ID NO: 203205 - RNA, 23 nt, Homo sapiens
uccuugguuggcgcccuaugugu

SEQ ID NO: 203206 - RNA, 22 nt, Homo sapiens
uccuuuggcuaacuuucuaagu

SEQ ID NO: 203207 - RNA, 22 nt, Homo sapiens
ucuaaguaguagcuggucagaa

SEQ ID NO: 203208 - RNA, 22 nt, Homo sapiens
ucuacagccaguucaggaagaa

SEQ ID NO: 203209 - RNA, 20 nt, Homo sapiens
ucuaccuguagguaauuggu

SEQ ID NO: 203210 - RNA, 22 nt, Homo sapiens
ucuaucacagccccacacucuc

SEQ ID NO: 203211 - RNA, 22 nt, Homo sapiens
ucucaauggguuguagacaaag

SEQ ID NO: 203212 - RNA, 22 nt, Homo sapiens
ucucacauuucacagggauggg

SEQ ID NO: 203213 - RNA, 22 nt, Homo sapiens
ucucagugaauguggaaaaagc

SEQ ID NO: 203214 - RNA, 22 nt, Homo sapiens
ucucaguggcacccccaacacc

SEQ ID NO: 203215 - RNA, 22 nt, Homo sapiens
ucucagugugguaaaaguuuuu

SEQ ID NO: 203216 - RNA, 22 nt, Homo sapiens
ucucaugaagguggagaguagg

SEQ ID NO: 203217 - RNA, 20 nt, Homo sapiens
ucucauggagguagagaaua

SEQ ID NO: 203218 - RNA, 22 nt, Homo sapiens
ucucauggagucaggagcagaa

SEQ ID NO: 203219 - RNA, 23 nt, Homo sapiens
ucucauuccuugaaaauaaugac

SEQ ID NO: 203220 - RNA, 22 nt, Homo sapiens
ucuccaguuuccuucgucuauc

SEQ ID NO: 203221 - RNA, 22 nt, Homo sapiens
ucuccauugaaauggacauaau

SEQ ID NO: 203222 - RNA, 22 nt, Homo sapiens
ucucccuaccugagccgagcca

SEQ ID NO: 203223 - RNA, 22 nt, Homo sapiens
ucucugaaacucuugacauccu

SEQ ID NO: 203224 - RNA, 22 nt, Homo sapiens
ucucuggauaucuacuuauguu

SEQ ID NO: 203225 - RNA, 19 nt, Homo sapiens
ucucugguguuggagggga

SEQ ID NO: 203226 - RNA, 22 nt, Homo sapiens
ucucugguuaugucauuaagca

SEQ ID NO: 203227 - RNA, 22 nt, Homo sapiens
ucucugguuuucaaagcaguau

SEQ ID NO: 203228 - RNA, 22 nt, Homo sapiens
ucucuuggugacuuaaaauguu

SEQ ID NO: 203229 - RNA, 22 nt, Homo sapiens
ucugacagugagagaaaucuga

SEQ ID NO: 203230 - RNA, 22 nt, Homo sapiens
ucugacuagacaagcaguguac

SEQ ID NO: 203231 - RNA, 22 nt, Homo sapiens
ucugacucuggagucucagguu

SEQ ID NO: 203232 - RNA, 22 nt, Homo sapiens
ucugagaugagacuuugaauuu

SEQ ID NO: 203233 - RNA, 22 nt, Homo sapiens
ucugagguaggugcauggauac

SEQ ID NO: 203234 - RNA, 22 nt, Homo sapiens
ucugagguuaaauuuuauaguu

SEQ ID NO: 203235 - RNA, 22 nt, Homo sapiens
ucugagucaucacaaaugaugc

SEQ ID NO: 203236 - RNA, 22 nt, Homo sapiens
ucuggcaagagccgagggcagu

SEQ ID NO: 203237 - RNA, 22 nt, Homo sapiens
ucuggccuacaucauuuuuccg

SEQ ID NO: 203238 - RNA, 22 nt, Homo sapiens
ucuggccuagaacaauuaauua

SEQ ID NO: 203239 - RNA, 22 nt, Homo sapiens
ucuggccuccuaugagaaucga

SEQ ID NO: 203240 - RNA, 22 nt, Homo sapiens
ucuggcuccacacuuuauuaac

SEQ ID NO: 203241 - RNA, 22 nt, Homo sapiens
ucuggcuuugugaguugccaga

SEQ ID NO: 203242 - RNA, 22 nt, Homo sapiens
ucugggguuuccacuuuuacuu

SEQ ID NO: 203243 - RNA, 20 nt, Homo sapiens
ucuggguuuuggccacgccc

SEQ ID NO: 203244 - RNA, 22 nt, Homo sapiens
gaggaaguuuacaaagcaucug

SEQ ID NO: 203245 - RNA, 21 nt, Homo sapiens
gaggauauuuuuauguuugga

SEQ ID NO: 203246 - RNA, 22 nt, Homo sapiens
gaggaucucuugagcccagaag

SEQ ID NO: 203247 - RNA, 22 nt, Homo sapiens
gaggcaauaugagggaggcuuc

SEQ ID NO: 203248 - RNA, 22 nt, Homo sapiens
gaggcuagauggggaugugucc

SEQ ID NO: 203249 - RNA, 22 nt, Homo sapiens
gagguaagaaagucaguccuuc

SEQ ID NO: 203250 - RNA, 22 nt, Homo sapiens
gagguaaguggauuaugagguc

SEQ ID NO: 203251 - RNA, 22 nt, Homo sapiens
gagguaggaggauugcuuaagg

SEQ ID NO: 203252 - RNA, 22 nt, Homo sapiens
gaggucuuacauuuuaauauuu

SEQ ID NO: 203253 - RNA, 22 nt, Homo sapiens
gaggugguagguucacagcagc

SEQ ID NO: 203254 - RNA, 22 nt, Homo sapiens
gagguggugguggaggcauagc

SEQ ID NO: 203255 - RNA, 22 nt, Homo sapiens
gaguagaacugguuaucuaaua

SEQ ID NO: 203256 - RNA, 22 nt, Homo sapiens
gaguagugcugcaguaaacaua

SEQ ID NO: 203257 - RNA, 22 nt, Homo sapiens
gaguaucuuuaaggugguuugg

SEQ ID NO: 203258 - RNA, 22 nt, Homo sapiens
gagugcaauggcaagaucuugg

SEQ ID NO: 203259 - RNA, 22 nt, Homo sapiens
gagugcaauggcgcgaucuggg

SEQ ID NO: 203260 - RNA, 22 nt, Homo sapiens
gaguucauuuugaaaccuugau

SEQ ID NO: 203261 - RNA, 18 nt, Homo sapiens
gauaacaguggacuaugc

SEQ ID NO: 203262 - RNA, 22 nt, Homo sapiens
gauaugucuauuagcuugauug

SEQ ID NO: 203263 - RNA, 22 nt, Homo sapiens
gauauguguaucuauguacaug

SEQ ID NO: 203264 - RNA, 19 nt, Homo sapiens
gauauguugagcacccuuu

SEQ ID NO: 203265 - RNA, 22 nt, Homo sapiens
gaucuguguuuguaugcauaag

SEQ ID NO: 203266 - RNA, 22 nt, Homo sapiens
gaugaaacaucuuuggaaacug

SEQ ID NO: 203267 - RNA, 22 nt, Homo sapiens
gaugauguuugauaaauaauaa

SEQ ID NO: 203268 - RNA, 22 nt, Homo sapiens
gaugcaguaagaaugcauagcg

SEQ ID NO: 203269 - RNA, 22 nt, Homo sapiens
gauggaguugucgccugggcug

SEQ ID NO: 203270 - RNA, 22 nt, Homo sapiens
gauggauuuuuuaggcagagcu

SEQ ID NO: 203271 - RNA, 22 nt, Homo sapiens
gauggcacuaagccauguagga

SEQ ID NO: 203272 - RNA, 22 nt, Homo sapiens
gauggcacuguagcaacacaaa

SEQ ID NO: 203273 - RNA, 22 nt, Homo sapiens
gauggcagugcagccccuggcu

SEQ ID NO: 203274 - RNA, 22 nt, Homo sapiens
gauuccauugcgaauuuucaga

SEQ ID NO: 203275 - RNA, 22 nt, Homo sapiens
gauugguugaaaguagaauacu

SEQ ID NO: 203276 - RNA, 22 nt, Homo sapiens
gauuuguauuaaaagugugacg

SEQ ID NO: 203277 - RNA, 22 nt, Homo sapiens
gauuuuccaguggcccugauca

SEQ ID NO: 203278 - RNA, 21 nt, Homo sapiens
gcaaaguggcuaccuugcucc

SEQ ID NO: 203279 - RNA, 23 nt, Homo sapiens
gcaaauaucguagagugucccug

SEQ ID NO: 203280 - RNA, 22 nt, Homo sapiens
gcaagaaucugggaguaaaauu

SEQ ID NO: 203281 - RNA, 22 nt, Homo sapiens
gcacacguagaagcaugcauca

SEQ ID NO: 203282 - RNA, 22 nt, Homo sapiens
gcacagaugaggagaggucuca

SEQ ID NO: 203283 - RNA, 22 nt, Homo sapiens
gcacauauguaaauagcugccu

SEQ ID NO: 203284 - RNA, 22 nt, Homo sapiens
gcacauggccccaucgugccga

SEQ ID NO: 203285 - RNA, 22 nt, Homo sapiens
gcacgcauuguccuucuaguca

SEQ ID NO: 203286 - RNA, 22 nt, Homo sapiens
gcacugagagaagccccaagua

SEQ ID NO: 203287 - RNA, 22 nt, Homo sapiens
gcagaucucuucauuucucuua

SEQ ID NO: 203288 - RNA, 22 nt, Homo sapiens
gcagcacauggcagaacauauu

SEQ ID NO: 203289 - RNA, 20 nt, Homo sapiens
gcagcaccauauuucuaaga

SEQ ID NO: 203290 - RNA, 22 nt, Homo sapiens
gcagcagugcccuggauggaaa

SEQ ID NO: 203291 - RNA, 22 nt, Homo sapiens
gcagcauuaccaagacauggca

SEQ ID NO: 203292 - RNA, 22 nt, Homo sapiens
gcaggaaucuugagaaggauuc

SEQ ID NO: 203293 - RNA, 22 nt, Homo sapiens
gcaggaauuucucugcagaccc

SEQ ID NO: 203294 - RNA, 20 nt, Homo sapiens
gcaguacuuuuaguucuaag

SEQ ID NO: 203295 - RNA, 22 nt, Homo sapiens
gcagugaugugaucauagcuca

SEQ ID NO: 203296 - RNA, 22 nt, Homo sapiens
gcagugcaugacgguauauaua

SEQ ID NO: 203297 - RNA, 22 nt, Homo sapiens
gcagugcuggagcccccgugug

SEQ ID NO: 203298 - RNA, 22 nt, Homo sapiens
gcagugugaucacagcuuacug

SEQ ID NO: 203299 - RNA, 22 nt, Homo sapiens
gcaguguuggggccggaggcug

SEQ ID NO: 203300 - RNA, 22 nt, Homo sapiens
gcauaaagcuaauaagacgaag

SEQ ID NO: 203301 - RNA, 22 nt, Homo sapiens
gcauaugucuuuauagcagcau

SEQ ID NO: 203302 - RNA, 20 nt, Homo sapiens
gcauaugucuuuauggcagc

SEQ ID NO: 203303 - RNA, 17 nt, Homo sapiens
gcauauguugaaccagc

SEQ ID NO: 203304 - RNA, 22 nt, Homo sapiens
gcauauguuuggguguguauau

SEQ ID NO: 203305 - RNA, 22 nt, Homo sapiens
uggcaagaacaacaauuacuuu

SEQ ID NO: 203306 - RNA, 22 nt, Homo sapiens
uggcaagaacgaaauguagggu

SEQ ID NO: 203307 - RNA, 22 nt, Homo sapiens
uggcaagaagagcaugagacca

SEQ ID NO: 203308 - RNA, 22 nt, Homo sapiens
uggcaagagauaugugucuaua

SEQ ID NO: 203309 - RNA, 22 nt, Homo sapiens
uggcaagagcaaaauguacagu

SEQ ID NO: 203310 - RNA, 23 nt, Homo sapiens
uggcaagauuuguauugccugga

SEQ ID NO: 203311 - RNA, 18 nt, Homo sapiens
uggcaaguuuaguagcac

SEQ ID NO: 203312 - RNA, 22 nt, Homo sapiens
uggcagauagaaaugugguuaa

SEQ ID NO: 203313 - RNA, 22 nt, Homo sapiens
uggcagcugcuucaugggaugc

SEQ ID NO: 203314 - RNA, 22 nt, Homo sapiens
uggcaggugcacuggcuuugaa

SEQ ID NO: 203315 - RNA, 22 nt, Homo sapiens
gcuaggagaucugcugcucucu

SEQ ID NO: 203316 - RNA, 22 nt, Homo sapiens
gcucaugggcagugugauuguu

SEQ ID NO: 203317 - RNA, 22 nt, Homo sapiens
gcugagaucucuugccugaacu

SEQ ID NO: 203318 - RNA, 22 nt, Homo sapiens
gcugcacuuuaaggcauccccu

SEQ ID NO: 203319 - RNA, 22 nt, Homo sapiens
gcugcuguuauucaucagaacu

SEQ ID NO: 203320 - RNA, 22 nt, Homo sapiens
gcuggaauuaacauagaugugc

SEQ ID NO: 203321 - RNA, 22 nt, Homo sapiens
gcuggguugccagguuacuuaa

SEQ ID NO: 203322 - RNA, 22 nt, Homo sapiens
gcugguauuacaggcaugagcc

SEQ ID NO: 203323 - RNA, 22 nt, Homo sapiens
gcugguguucaggcccucaguc

SEQ ID NO: 203324 - RNA, 22 nt, Homo sapiens
gcuguaguugaggauuuuaaga

SEQ ID NO: 203325 - RNA, 22 nt, Homo sapiens
gcuuggugugcaagugguacua

SEQ ID NO: 203326 - RNA, 22 nt, Homo sapiens
ggaaagaucagcuaaauguaag

SEQ ID NO: 203327 - RNA, 21 nt, Homo sapiens
ggaaaguuaaggaaauacccc

SEQ ID NO: 203328 - RNA, 22 nt, Homo sapiens
ggaaauguaaacaauggggcua

SEQ ID NO: 203329 - RNA, 22 nt, Homo sapiens
ggaagacaguguggugauuccu

SEQ ID NO: 203330 - RNA, 22 nt, Homo sapiens
ggaagagugaauuaucuugacu

SEQ ID NO: 203331 - RNA, 22 nt, Homo sapiens
ggaauauaaaacuuuugacagg

SEQ ID NO: 203332 - RNA, 21 nt, Homo sapiens
ggaauuuagggaaugauuuag

SEQ ID NO: 203333 - RNA, 22 nt, Homo sapiens
ggacagaugggcucccgggucu

SEQ ID NO: 203334 - RNA, 22 nt, Homo sapiens
ggacuggaagcauauuuauuuu

SEQ ID NO: 203335 - RNA, 22 nt, Homo sapiens
ggagauccucugcgggcaaaga

SEQ ID NO: 203336 - RNA, 22 nt, Homo sapiens
ggagaugauuaugaaucacuua

SEQ ID NO: 203337 - RNA, 22 nt, Homo sapiens
ggagcucaucuagcauagaggu

SEQ ID NO: 203338 - RNA, 16 nt, Homo sapiens
ggaggucaucugggaa

SEQ ID NO: 203339 - RNA, 20 nt, Homo sapiens
ggagguguugauuuuucuuu

SEQ ID NO: 203340 - RNA, 20 nt, Homo sapiens
ggagguuguauaaguacauc

SEQ ID NO: 203341 - RNA, 21 nt, Homo sapiens
ggaguauaaggcaaaggagug

SEQ ID NO: 203342 - RNA, 22 nt, Homo sapiens
ggaguguaauggcgccaucuca

SEQ ID NO: 203343 - RNA, 21 nt, Homo sapiens
ggauagaaaacuuggcuguau

SEQ ID NO: 203344 - RNA, 22 nt, Homo sapiens
ggauaucauuauuucuagggcu

SEQ ID NO: 203345 - RNA, 22 nt, Homo sapiens
ggauauguagggcauaucuaca

SEQ ID NO: 203346 - RNA, 22 nt, Homo sapiens
ggaucacagccagcucccagaa

SEQ ID NO: 203347 - RNA, 22 nt, Homo sapiens
ggauugcuuaagaaguuucauu

SEQ ID NO: 203348 - RNA, 22 nt, Homo sapiens
ggcaacaaagacauuucaacau

SEQ ID NO: 203349 - RNA, 22 nt, Homo sapiens
ggcaacaauuccuacuucuuuu

SEQ ID NO: 203350 - RNA, 22 nt, Homo sapiens
ggcaagaaccagggauuugcgu

SEQ ID NO: 203351 - RNA, 22 nt, Homo sapiens
ggcaagaaccucaauuaccuuu

SEQ ID NO: 203352 - RNA, 22 nt, Homo sapiens
ggcaagaagagaguuuaaacau

SEQ ID NO: 203353 - RNA, 19 nt, Homo sapiens
ggcaagaguuguucugugu

SEQ ID NO: 203354 - RNA, 22 nt, Homo sapiens
ggcaaggauguuuuucuggcaa

SEQ ID NO: 203355 - RNA, 22 nt, Homo sapiens
ggcaaggauuagauucuccccu

SEQ ID NO: 203356 - RNA, 22 nt, Homo sapiens
ggcaaguauguuuuaggaugcu

SEQ ID NO: 203357 - RNA, 22 nt, Homo sapiens
ggcaauauuauuaacccucugu

SEQ ID NO: 203358 - RNA, 22 nt, Homo sapiens
ggcacgguggcucacaccugua

SEQ ID NO: 203359 - RNA, 22 nt, Homo sapiens
ggcagaauugcugaggaugcua

SEQ ID NO: 203360 - RNA, 22 nt, Homo sapiens
ggcagaucauuggccucaguuu

SEQ ID NO: 203361 - RNA, 22 nt, Homo sapiens
ggcagcacaauuuucugaugga

SEQ ID NO: 203362 - RNA, 17 nt, Homo sapiens
ggcaggauccaggaucc

SEQ ID NO: 203363 - RNA, 22 nt, Homo sapiens
ggcaguggaagugccaguuucu

SEQ ID NO: 203364 - RNA, 22 nt, Homo sapiens
ggcaguguauuacuuaggguuc

SEQ ID NO: 203365 - RNA, 22 nt, Homo sapiens
ggcaguuuguucuugcuccuuu

SEQ ID NO: 203366 - RNA, 22 nt, Homo sapiens
ggcauugugauccaccagccuu

SEQ ID NO: 203367 - RNA, 22 nt, Homo sapiens
ggcccugauacaaguaaggucu

SEQ ID NO: 203368 - RNA, 22 nt, Homo sapiens
ggcuagagaauagugccacuaa

SEQ ID NO: 203369 - RNA, 22 nt, Homo sapiens
ggcuauagauaugugaacacuu

SEQ ID NO: 203370 - RNA, 22 nt, Homo sapiens
ggcucagugggguccugguucu

SEQ ID NO: 203371 - RNA, 18 nt, Homo sapiens
ggcugguguuuuaguaua

SEQ ID NO: 203372 - RNA, 22 nt, Homo sapiens
ggcugguuuucaguuacugagu

SEQ ID NO: 203373 - RNA, 22 nt, Homo sapiens
ggcuuggaggaaugugagggcu

SEQ ID NO: 203374 - RNA, 22 nt, Homo sapiens
gggaagaaggagugguuuacuc

SEQ ID NO: 203375 - RNA, 22 nt, Homo sapiens
gggagcacaagaaauguuucau

SEQ ID NO: 203376 - RNA, 22 nt, Homo sapiens
gggaggucauuguaaggucuua

SEQ ID NO: 203377 - RNA, 22 nt, Homo sapiens
gggaugauuaugguucacuaca

SEQ ID NO: 203378 - RNA, 20 nt, Homo sapiens
gggaugugagguacacucuu

SEQ ID NO: 203379 - RNA, 22 nt, Homo sapiens
gggcaaaacuguacugccaagg

SEQ ID NO: 203380 - RNA, 22 nt, Homo sapiens
ugagacugaaauuaggaaacug

SEQ ID NO: 203381 - RNA, 22 nt, Homo sapiens
ugagacugagucucccucuguc

SEQ ID NO: 203382 - RNA, 22 nt, Homo sapiens
ugagagacagacauuaucuuau

SEQ ID NO: 203383 - RNA, 22 nt, Homo sapiens
ugagauagaaaacauaggagaa

SEQ ID NO: 203384 - RNA, 22 nt, Homo sapiens
ugagauaguacuuuuuuaaagg

SEQ ID NO: 203385 - RNA, 22 nt, Homo sapiens
ugagauauauauauuugagaca

SEQ ID NO: 203386 - RNA, 22 nt, Homo sapiens
ugagauauugggaguaauguca

SEQ ID NO: 203387 - RNA, 22 nt, Homo sapiens
ugagaucaaggugggcccuggg

SEQ ID NO: 203388 - RNA, 22 nt, Homo sapiens
ugagaucaagguuaauauaauc

SEQ ID NO: 203389 - RNA, 22 nt, Homo sapiens
ugagaucagaaggauuucucug

SEQ ID NO: 203390 - RNA, 20 nt, Homo sapiens
ugagauccacgugaaguaug

SEQ ID NO: 203391 - RNA, 23 nt, Homo sapiens
ugagaucuacagaucucagaucu

SEQ ID NO: 203392 - RNA, 22 nt, Homo sapiens
ugagaucuuaucagaaauggug

SEQ ID NO: 203393 - RNA, 22 nt, Homo sapiens
ugagaucuucgcucuucacaga

SEQ ID NO: 203394 - RNA, 22 nt, Homo sapiens
ugagaucuuugcuguccucacc

SEQ ID NO: 203395 - RNA, 22 nt, Homo sapiens
ugagaugaucaaaguauaggcu

SEQ ID NO: 203396 - RNA, 22 nt, Homo sapiens
ugagaugcauauucuggcuccu

SEQ ID NO: 203397 - RNA, 20 nt, Homo sapiens
ugagaugcauugggauguuu

SEQ ID NO: 203398 - RNA, 22 nt, Homo sapiens
ugagauggaguuucgcccuugu

SEQ ID NO: 203399 - RNA, 22 nt, Homo sapiens
ugagauggaguuucgcuuuugu

SEQ ID NO: 203400 - RNA, 22 nt, Homo sapiens
ugagauggaucuuggauuugaa

SEQ ID NO: 203401 - RNA, 22 nt, Homo sapiens
ugagauggcuuuauugcugaau

SEQ ID NO: 203402 - RNA, 22 nt, Homo sapiens
ugagaugugaucaccugaaggg

SEQ ID NO: 203403 - RNA, 22 nt, Homo sapiens
ugagauguguccagaucuaguu

SEQ ID NO: 203404 - RNA, 22 nt, Homo sapiens
ugagauguugcucugaaacaag

SEQ ID NO: 203405 - RNA, 23 nt, Homo sapiens
ugagauuacccagaaagaguaua

SEQ ID NO: 203406 - RNA, 21 nt, Homo sapiens
ugagauuauauuaacauggua

SEQ ID NO: 203407 - RNA, 22 nt, Homo sapiens
ugagauuaucuguacauaggag

SEQ ID NO: 203408 - RNA, 22 nt, Homo sapiens
ugagauuguaucugcaaugugu

SEQ ID NO: 203409 - RNA, 19 nt, Homo sapiens
ugagauuguaugaggagau

SEQ ID NO: 203410 - RNA, 22 nt, Homo sapiens
ugagcaaaauuuuggacauaga

SEQ ID NO: 203411 - RNA, 22 nt, Homo sapiens
ugagcagugagugugcugcagg

SEQ ID NO: 203412 - RNA, 18 nt, Homo sapiens
ugaggaaaggguuugcua

SEQ ID NO: 203413 - RNA, 22 nt, Homo sapiens
ugaggaucucuaggaauuuauc

SEQ ID NO: 203414 - RNA, 22 nt, Homo sapiens
ugaggcacucccuagcggggug

SEQ ID NO: 203415 - RNA, 22 nt, Homo sapiens
ugaggcuaggauaggcugauuc

SEQ ID NO: 203416 - RNA, 17 nt, Homo sapiens
ugagggaugccugguuc

SEQ ID NO: 203417 - RNA, 22 nt, Homo sapiens
ugagguagaaugauucuaauau

SEQ ID NO: 203418 - RNA, 22 nt, Homo sapiens
ugagguagguaccauuaucacu

SEQ ID NO: 203419 - RNA, 22 nt, Homo sapiens
ugagguaggugaagaaugcacg

SEQ ID NO: 203420 - RNA, 21 nt, Homo sapiens
ugaggucaugaugcugcuucc

SEQ ID NO: 203421 - RNA, 20 nt, Homo sapiens
ugaggucugagaaagaauga

SEQ ID NO: 203422 - RNA, 22 nt, Homo sapiens
ugaggugagauggcuaccccaa

SEQ ID NO: 203423 - RNA, 22 nt, Homo sapiens
ugaggugagggguuaggugcua

SEQ ID NO: 203424 - RNA, 23 nt, Homo sapiens
ugagguguuaagcagacuugucu

SEQ ID NO: 203425 - RNA, 22 nt, Homo sapiens
ugagguuauuuguucaagaagu

SEQ ID NO: 203426 - RNA, 22 nt, Homo sapiens
ugaguaauguugaucuuugaua

SEQ ID NO: 203427 - RNA, 22 nt, Homo sapiens
ugaguagaagugaagauagugg

SEQ ID NO: 203428 - RNA, 22 nt, Homo sapiens
ugaguaggauugguauuucuuc

SEQ ID NO: 203429 - RNA, 22 nt, Homo sapiens
ugaguauguaggaugugucuua

SEQ ID NO: 203430 - RNA, 22 nt, Homo sapiens
ugagucauuuccuuaugcuacu

SEQ ID NO: 203431 - RNA, 22 nt, Homo sapiens
ugagucuguucucacauugcua

SEQ ID NO: 203432 - RNA, 22 nt, Homo sapiens
ugagugaaagaagcacuaagga

SEQ ID NO: 203433 - RNA, 22 nt, Homo sapiens
ugagugaaugugaaggcuaggg

SEQ ID NO: 203434 - RNA, 22 nt, Homo sapiens
ugaguggagaucgcaccauugc

SEQ ID NO: 203435 - RNA, 22 nt, Homo sapiens
ugaguguguaugugcauacaca

SEQ ID NO: 203436 - RNA, 22 nt, Homo sapiens
ugaguuaggagaguguggcucu

SEQ ID NO: 203437 - RNA, 22 nt, Homo sapiens
ugaguuagguguuuuaaauaua

SEQ ID NO: 203438 - RNA, 22 nt, Homo sapiens
ugaguuauuaguagaggcuaug

SEQ ID NO: 203439 - RNA, 22 nt, Homo sapiens
ugaguucaauguuaaugaagca

SEQ ID NO: 203440 - RNA, 22 nt, Homo sapiens
ugaguucaugcuuguaguucua

SEQ ID NO: 203441 - RNA, 22 nt, Homo sapiens
ugaguuccuugugugaccuugc

SEQ ID NO: 203442 - RNA, 22 nt, Homo sapiens
ugaguucuuccuaucucugccu

SEQ ID NO: 203443 - RNA, 22 nt, Homo sapiens
ugaguucuuuguagauucugug

SEQ ID NO: 203444 - RNA, 22 nt, Homo sapiens
ugaguucuuuuagggauauugc

SEQ ID NO: 203445 - RNA, 22 nt, Homo sapiens
ugauaacauuucuucugguaca

SEQ ID NO: 203446 - RNA, 22 nt, Homo sapiens
ugauaauuuugucagguuuugg

SEQ ID NO: 203447 - RNA, 22 nt, Homo sapiens
ugauaggagauuuucaucugua

SEQ ID NO: 203448 - RNA, 22 nt, Homo sapiens
ugauagugccuuuuauaucucu

SEQ ID NO: 203449 - RNA, 22 nt, Homo sapiens
ugauauauugaaugaugaaaca

SEQ ID NO: 203450 - RNA, 22 nt, Homo sapiens
ugauaucucuugccuccaaaug

SEQ ID NO: 203451 - RNA, 22 nt, Homo sapiens
ugauaucugaucauccuugaua

SEQ ID NO: 203452 - RNA, 20 nt, Homo sapiens
ugauaugguuuggcuguguu

SEQ ID NO: 203453 - RNA, 22 nt, Homo sapiens
ucauggcauuguuaaggguuuu

SEQ ID NO: 203454 - RNA, 22 nt, Homo sapiens
ucauggggugagcuacaggcac

SEQ ID NO: 203455 - RNA, 22 nt, Homo sapiens
ucaugguuuuauaacccucuug

SEQ ID NO: 203456 - RNA, 22 nt, Homo sapiens
ucauucacucccuugaaguuag

SEQ ID NO: 203457 - RNA, 22 nt, Homo sapiens
ucauucauucuucaguggguac

SEQ ID NO: 203458 - RNA, 21 nt, Homo sapiens
ucauugggugcagcccacccu

SEQ ID NO: 203459 - RNA, 22 nt, Homo sapiens
ucauugguagcuugaaggggau

SEQ ID NO: 203460 - RNA, 22 nt, Homo sapiens
uccacaauggcugaacuagauu

SEQ ID NO: 203461 - RNA, 22 nt, Homo sapiens
uccacagugguugaacuaguaa

SEQ ID NO: 203462 - RNA, 22 nt, Homo sapiens
uccacuuuugugcugaauugga

SEQ ID NO: 203463 - RNA, 22 nt, Homo sapiens
uccagguacucagggggcugag

SEQ ID NO: 203464 - RNA, 22 nt, Homo sapiens
uccaguuguuauuuuuauaaag

SEQ ID NO: 203465 - RNA, 22 nt, Homo sapiens
uccaguuguucucgaagcuccu

SEQ ID NO: 203466 - RNA, 22 nt, Homo sapiens
uccauaguacuagaaacugacc

SEQ ID NO: 203467 - RNA, 22 nt, Homo sapiens
uccauaguugcacucuggagcc

SEQ ID NO: 203468 - RNA, 19 nt, Homo sapiens
uccaugagcccacagugau

SEQ ID NO: 203469 - RNA, 20 nt, Homo sapiens
ugauauuucuggaaguggag

SEQ ID NO: 203470 - RNA, 17 nt, Homo sapiens
ugauauuuucccagaua

SEQ ID NO: 203471 - RNA, 21 nt, Homo sapiens
ugaugcuuuucuuaaccuugc

SEQ ID NO: 203472 - RNA, 22 nt, Homo sapiens
ugauggcauuucauguuuguaa

SEQ ID NO: 203473 - RNA, 23 nt, Homo sapiens
ugauguccacuuagggucuaggu

SEQ ID NO: 203474 - RNA, 22 nt, Homo sapiens
ugaugucuugagauggagcuua

SEQ ID NO: 203475 - RNA, 18 nt, Homo sapiens
ugauugacuuauuuaggu

SEQ ID NO: 203476 - RNA, 22 nt, Homo sapiens
ugauuggagaacaaacugcaua

SEQ ID NO: 203477 - RNA, 18 nt, Homo sapiens
ugcaaacauguguguguu

SEQ ID NO: 203478 - RNA, 22 nt, Homo sapiens
ugcaaaguccucauucuuaccc

SEQ ID NO: 203479 - RNA, 22 nt, Homo sapiens
ugcaaaucuuguguaguuguga

SEQ ID NO: 203480 - RNA, 22 nt, Homo sapiens
ugcaacauguguaccacucugu

SEQ ID NO: 203481 - RNA, 22 nt, Homo sapiens
ugcaagaaucagccuaucauua

SEQ ID NO: 203482 - RNA, 22 nt, Homo sapiens
ugcaaguggauuuuuccccaga

SEQ ID NO: 203483 - RNA, 18 nt, Homo sapiens
ugcaauggagaugcagcc

SEQ ID NO: 203484 - RNA, 22 nt, Homo sapiens
ugcaccacugcacuccacccug

SEQ ID NO: 203485 - RNA, 16 nt, Homo sapiens
ugcagaguaggugaau

SEQ ID NO: 203486 - RNA, 22 nt, Homo sapiens
ugcagcacugaacuucugggcu

SEQ ID NO: 203487 - RNA, 22 nt, Homo sapiens
ugcagcacuguucacaauagcc

SEQ ID NO: 203488 - RNA, 22 nt, Homo sapiens
ugcagugugauuuucuggcuga

SEQ ID NO: 203489 - RNA, 22 nt, Homo sapiens
ugcaguuuaggaacugguaaca

SEQ ID NO: 203490 - RNA, 18 nt, Homo sapiens
ugcauacuaucugauuuu

SEQ ID NO: 203491 - RNA, 22 nt, Homo sapiens
ugcauagaauguucuguaaaua

SEQ ID NO: 203492 - RNA, 22 nt, Homo sapiens
ugcauaugucuuuauagcagca

SEQ ID NO: 203493 - RNA, 22 nt, Homo sapiens
ugcauaugucuuuauaguagca

SEQ ID NO: 203494 - RNA, 22 nt, Homo sapiens
ugcauauucgaguuauuuuggg

SEQ ID NO: 203495 - RNA, 21 nt, Homo sapiens
ugcauauuggaacuuucucuc

SEQ ID NO: 203496 - RNA, 22 nt, Homo sapiens
ugcauauuuuauaaagauggaa

SEQ ID NO: 203497 - RNA, 22 nt, Homo sapiens
uugcauugacacaugaagcuca

SEQ ID NO: 203498 - RNA, 22 nt, Homo sapiens
uugcauuguacuugguacggcu

SEQ ID NO: 203499 - RNA, 22 nt, Homo sapiens
uugccaauauuuuacugagaag

SEQ ID NO: 203500 - RNA, 22 nt, Homo sapiens
uugccuaggcuggagugcagua

SEQ ID NO: 203501 - RNA, 22 nt, Homo sapiens
uugccuauucacucugaugaua

SEQ ID NO: 203502 - RNA, 20 nt, Homo sapiens
uugcugguguuagaggaggc

SEQ ID NO: 203503 - RNA, 22 nt, Homo sapiens
uugcuucauucaacauugaggg

SEQ ID NO: 203504 - RNA, 22 nt, Homo sapiens
uugcuucuuucgucuggcccca

SEQ ID NO: 203505 - RNA, 22 nt, Homo sapiens
uuggaaacaccuggugagguua

SEQ ID NO: 203506 - RNA, 22 nt, Homo sapiens
uuggaaagagguguuuaugacu

SEQ ID NO: 203507 - RNA, 22 nt, Homo sapiens
uuggaaaugguaaaggguuaau

SEQ ID NO: 203508 - RNA, 20 nt, Homo sapiens
uuggaaaugugaauugggag

SEQ ID NO: 203509 - RNA, 22 nt, Homo sapiens
uuggaagacaaugcugauucuc

SEQ ID NO: 203510 - RNA, 19 nt, Homo sapiens
uuggaauuuuagaguuuga

SEQ ID NO: 203511 - RNA, 22 nt, Homo sapiens
uuggacagaugguuacauuuuu

SEQ ID NO: 203512 - RNA, 22 nt, Homo sapiens
uuggacugagaguuccaccauu

SEQ ID NO: 203513 - RNA, 22 nt, Homo sapiens
uuggagagaaaggcaguuccug

SEQ ID NO: 203514 - RNA, 22 nt, Homo sapiens
uuggagagucacuaguuagugc

SEQ ID NO: 203515 - RNA, 22 nt, Homo sapiens
uuggagcacuggggcacugaca

SEQ ID NO: 203516 - RNA, 22 nt, Homo sapiens
uuggaugauaaagaagccuaag

SEQ ID NO: 203517 - RNA, 22 nt, Homo sapiens
uuggauuuugguggcaacucau

SEQ ID NO: 203518 - RNA, 22 nt, Homo sapiens
uuggcaaauagguuuuauugca

SEQ ID NO: 203519 - RNA, 22 nt, Homo sapiens
uuggcagaauguuagaaacuua

SEQ ID NO: 203520 - RNA, 22 nt, Homo sapiens
uuggcauuguggauggaaucau

SEQ ID NO: 203521 - RNA, 23 nt, Homo sapiens
uuggccuccuugugucuagggcu

SEQ ID NO: 203522 - RNA, 22 nt, Homo sapiens
uuggcuacagauuaugaauuuc

SEQ ID NO: 203523 - RNA, 21 nt, Homo sapiens
uuggcuacugcuucagaggga

SEQ ID NO: 203524 - RNA, 22 nt, Homo sapiens
uuggcucugcgucucgcggacg

SEQ ID NO: 203525 - RNA, 22 nt, Homo sapiens
uuggcuguguuucccuacaaau

SEQ ID NO: 203526 - RNA, 22 nt, Homo sapiens
uuggcuuguaaaaugaaaagcu

SEQ ID NO: 203527 - RNA, 22 nt, Homo sapiens
uugggauggaaauuuguacccc

SEQ ID NO: 203528 - RNA, 21 nt, Homo sapiens
uugguccacaugucauaguua

SEQ ID NO: 203529 - RNA, 23 nt, Homo sapiens
uuggucucccaaaguguugagau

SEQ ID NO: 203530 - RNA, 22 nt, Homo sapiens
uugguucaguuuaacgaguaau

SEQ ID NO: 203531 - RNA, 22 nt, Homo sapiens
uugguucucuuagccaucuuaa

SEQ ID NO: 203532 - RNA, 22 nt, Homo sapiens
uuguaacaugcuuucacuucag

SEQ ID NO: 203533 - RNA, 22 nt, Homo sapiens
uuguaaucaacacaucauuggg

SEQ ID NO: 203534 - RNA, 22 nt, Homo sapiens
uuguaccacagggcaugaagug

SEQ ID NO: 203535 - RNA, 22 nt, Homo sapiens
uuguacccuuucuaugaggcca

SEQ ID NO: 203536 - RNA, 22 nt, Homo sapiens
uuguacuagaaaauuauucuuu

SEQ ID NO: 203537 - RNA, 22 nt, Homo sapiens
uuguacuagucauauuuugaaa

SEQ ID NO: 203538 - RNA, 22 nt, Homo sapiens
uuguagcaaauguguaaacaaa

SEQ ID NO: 203539 - RNA, 22 nt, Homo sapiens
uuucaucaagcacagaguagau

SEQ ID NO: 203540 - RNA, 22 nt, Homo sapiens
uuucauggacgcaaugccuuuu

SEQ ID NO: 203541 - RNA, 22 nt, Homo sapiens
uuucauggcaguuuggggccug

SEQ ID NO: 203542 - RNA, 22 nt, Homo sapiens
uuuccagguggccaacauuuua

SEQ ID NO: 203543 - RNA, 22 nt, Homo sapiens
uuuccaguuggaaagccuguuu

SEQ ID NO: 203544 - RNA, 22 nt, Homo sapiens
uuuccaguuguucuagaaagcu

SEQ ID NO: 203545 - RNA, 22 nt, Homo sapiens
uuucccuuugcuuugucagcca

SEQ ID NO: 203546 - RNA, 21 nt, Homo sapiens
uuuccuggagcguauggcuuc

SEQ ID NO: 203547 - RNA, 22 nt, Homo sapiens
uuuccuguagggggcaaggccu

SEQ ID NO: 203548 - RNA, 17 nt, Homo sapiens
uuucucagcccucuucu

SEQ ID NO: 203549 - RNA, 20 nt, Homo sapiens
uuucuccccuauaaaucuca

SEQ ID NO: 203550 - RNA, 22 nt, Homo sapiens
uuucugcuugagagaauugcug

SEQ ID NO: 203551 - RNA, 22 nt, Homo sapiens
uuucugguuaauuucuaagagc

SEQ ID NO: 203552 - RNA, 22 nt, Homo sapiens
uuugaauguaaugagcaggaag

SEQ ID NO: 203553 - RNA, 22 nt, Homo sapiens
uuugacuaccaggaauguucuu

SEQ ID NO: 203554 - RNA, 22 nt, Homo sapiens
uuugagaaugcuaccagagaag

SEQ ID NO: 203555 - RNA, 23 nt, Homo sapiens
uuugagugugauaaacacuguca

SEQ ID NO: 203556 - RNA, 22 nt, Homo sapiens
uuugaguuugaggugcugauga

SEQ ID NO: 203557 - RNA, 22 nt, Homo sapiens
uuugauguugagacuauaaagc

SEQ ID NO: 203558 - RNA, 22 nt, Homo sapiens
uuugcagugucagcuucugugu

SEQ ID NO: 203559 - RNA, 22 nt, Homo sapiens
uuugccuuugugauauggucua

SEQ ID NO: 203560 - RNA, 22 nt, Homo sapiens
uuugcuuaguaaauguagaaaa

SEQ ID NO: 203561 - RNA, 22 nt, Homo sapiens
uuuggaagaugccacuguauca

SEQ ID NO: 203562 - RNA, 22 nt, Homo sapiens
uuuggcaguuauuuacucagug

SEQ ID NO: 203563 - RNA, 22 nt, Homo sapiens
uuuggccauguuggucaggcug

SEQ ID NO: 203564 - RNA, 22 nt, Homo sapiens
uuuggcucugugucccacccaa

SEQ ID NO: 203565 - RNA, 18 nt, Homo sapiens
uuuggcuguucaugacuc

SEQ ID NO: 203566 - RNA, 22 nt, Homo sapiens
uuuggcuguuucuggacuaaga

SEQ ID NO: 203567 - RNA, 22 nt, Homo sapiens
uuuggcuuaagauugacugcaa

SEQ ID NO: 203568 - RNA, 22 nt, Homo sapiens
uuuggcuuugagaagcagugga

SEQ ID NO: 203569 - RNA, 18 nt, Homo sapiens
uuugguccuuuauaaaca

SEQ ID NO: 203570 - RNA, 18 nt, Homo sapiens
uuuguacuuuuucuaaug

SEQ ID NO: 203571 - RNA, 22 nt, Homo sapiens
uuugugacuugcuucucagaau

SEQ ID NO: 203572 - RNA, 22 nt, Homo sapiens
uuugugaggugauggauauguc

SEQ ID NO: 203573 - RNA, 22 nt, Homo sapiens
uuugugcuauguuauauauucu

SEQ ID NO: 203574 - RNA, 22 nt, Homo sapiens
uuuguggaaugcucauguguag

SEQ ID NO: 203575 - RNA, 22 nt, Homo sapiens
uuugugugugauuauaaaaggu

SEQ ID NO: 203576 - RNA, 22 nt, Homo sapiens
uuuguucaccucaaggauggga

SEQ ID NO: 203577 - RNA, 22 nt, Homo sapiens
uuuuacacuguugguuggaaug

SEQ ID NO: 203578 - RNA, 22 nt, Homo sapiens
uuuuacacuucgguugugugca

SEQ ID NO: 203579 - RNA, 22 nt, Homo sapiens
uuuuaguggacaaagguauuua

SEQ ID NO: 203580 - RNA, 22 nt, Homo sapiens
uuuuauguuuguucccugccaa

SEQ ID NO: 203581 - RNA, 22 nt, Homo sapiens
uuuucacggugucccagagagu

SEQ ID NO: 203582 - RNA, 22 nt, Homo sapiens
uuuuccagugggacucccauua

SEQ ID NO: 203583 - RNA, 22 nt, Homo sapiens
uuuugcaauauguuccugaaua

SEQ ID NO: 203584 - RNA, 22 nt, Homo sapiens
cauugcacuccagcucugggcg

SEQ ID NO: 203585 - RNA, 16 nt, Homo sapiens
cauugcacucuagccu

SEQ ID NO: 203586 - RNA, 22 nt, Homo sapiens
cauugguugaacagauuguguu

SEQ ID NO: 203587 - RNA, 22 nt, Homo sapiens
cauuugguggcuacagaguaac

SEQ ID NO: 203588 - RNA, 22 nt, Homo sapiens
ccaaggcacugauucuguacuc

SEQ ID NO: 203589 - RNA, 23 nt, Homo sapiens
ccacaaugguugaacuagauuac

SEQ ID NO: 203590 - RNA, 22 nt, Homo sapiens
ccacacugucuuggugggaaac

SEQ ID NO: 203591 - RNA, 23 nt, Homo sapiens
ccacacuguuuagaauggcauca

SEQ ID NO: 203592 - RNA, 22 nt, Homo sapiens
ccacugggcuagguguuuugga

SEQ ID NO: 203593 - RNA, 22 nt, Homo sapiens
ccacuguuuaaauggcugagga

SEQ ID NO: 203594 - RNA, 22 nt, Homo sapiens
ccagucuuggugucuguagcac

SEQ ID NO: 203595 - RNA, 21 nt, Homo sapiens
ccaguguaaugauagcaggca

SEQ ID NO: 203596 - RNA, 19 nt, Homo sapiens
ccaguguucugauugcacu

SEQ ID NO: 203597 - RNA, 19 nt, Homo sapiens
ccaguguugccagagcuga

SEQ ID NO: 203598 - RNA, 22 nt, Homo sapiens
ccaguucaaugauauggaaacu

SEQ ID NO: 203599 - RNA, 22 nt, Homo sapiens
ccaguuuucaagauaaugguuu

SEQ ID NO: 203600 - RNA, 22 nt, Homo sapiens
ccaguuuuuggcaaugaugaau

SEQ ID NO: 203601 - RNA, 19 nt, Homo sapiens
ccauggcaaugaucugaug

SEQ ID NO: 203602 - RNA, 22 nt, Homo sapiens
ccauggcaauggucagucuauu

SEQ ID NO: 203603 - RNA, 22 nt, Homo sapiens
cccacaguggccucauauccuu

SEQ ID NO: 203604 - RNA, 21 nt, Homo sapiens
cccagguucucugaggguaga

SEQ ID NO: 203605 - RNA, 22 nt, Homo sapiens
cccaguguguuguggauauuua

SEQ ID NO: 203606 - RNA, 22 nt, Homo sapiens
ccccaguguguaaaggccuugc

SEQ ID NO: 203607 - RNA, 20 nt, Homo sapiens
ccccaguuuuucuauuagcu

SEQ ID NO: 203608 - RNA, 17 nt, Homo sapiens
cccuaguagcugggacu

SEQ ID NO: 203609 - RNA, 22 nt, Homo sapiens
cccucauucauucauccuaugu

SEQ ID NO: 203610 - RNA, 22 nt, Homo sapiens
cccugagagcagggucuuucuc

SEQ ID NO: 203611 - RNA, 22 nt, Homo sapiens
cccuuagaauuuuguaguuauu

SEQ ID NO: 203612 - RNA, 22 nt, Homo sapiens
ccucuguaguccugcaagagga

SEQ ID NO: 203613 - RNA, 22 nt, Homo sapiens
ccugagacuugagggggcuucu

SEQ ID NO: 203614 - RNA, 22 nt, Homo sapiens
ccugguguuuugauggucgggu

SEQ ID NO: 203615 - RNA, 22 nt, Homo sapiens
ccugugguuaaccagcuagaug

SEQ ID NO: 203616 - RNA, 17 nt, Homo sapiens
cuaaggcaagagucugc

SEQ ID NO: 203617 - RNA, 22 nt, Homo sapiens
cuaaugcagucaggagaaggaa

SEQ ID NO: 203618 - RNA, 22 nt, Homo sapiens
cuacagcacugagcugugugca

SEQ ID NO: 203619 - RNA, 22 nt, Homo sapiens
cuacagguaugaaagggaguau

SEQ ID NO: 203620 - RNA, 22 nt, Homo sapiens
cuacauuguagguauucaaacu

SEQ ID NO: 203621 - RNA, 22 nt, Homo sapiens
cuagauuauccaacuuauuagc

SEQ ID NO: 203622 - RNA, 22 nt, Homo sapiens
cuagcacauaguuauucacuca

SEQ ID NO: 203623 - RNA, 22 nt, Homo sapiens
cuagcagacacuuccagagagu

SEQ ID NO: 203624 - RNA, 22 nt, Homo sapiens
cuagcuuuugauguaaagugag

SEQ ID NO: 203625 - RNA, 22 nt, Homo sapiens
cuaugcuucuuaaauuaguuau

SEQ ID NO: 203626 - RNA, 22 nt, Homo sapiens
cuauggugauagaaaucagaau

SEQ ID NO: 203627 - RNA, 22 nt, Homo sapiens
cuaugucuuucauauuuugggg

SEQ ID NO: 203628 - RNA, 19 nt, Homo sapiens
cuauugcacauagcugaag

SEQ ID NO: 203629 - RNA, 22 nt, Homo sapiens
cucacugggaccacucugaagu

SEQ ID NO: 203630 - RNA, 22 nt, Homo sapiens
cucagguaguuccuuauagcaa

SEQ ID NO: 203631 - RNA, 22 nt, Homo sapiens
cucaguagaaaauacauggacu

SEQ ID NO: 203632 - RNA, 21 nt, Homo sapiens
cucauauugcuuuuccauggu

SEQ ID NO: 203633 - RNA, 19 nt, Homo sapiens
cucauggagaaggagaaua

SEQ ID NO: 203634 - RNA, 22 nt, Homo sapiens
cucauggauggucuggcagcca

SEQ ID NO: 203635 - RNA, 22 nt, Homo sapiens
cucauugcaaucucugccuccc

SEQ ID NO: 203636 - RNA, 23 nt, Homo sapiens
cuccaugagccguccagggccug

SEQ ID NO: 203637 - RNA, 22 nt, Homo sapiens
cucccagugacccaggaacagg

SEQ ID NO: 203638 - RNA, 23 nt, Homo sapiens
cucccugaacaugacacaccaga

SEQ ID NO: 203639 - RNA, 22 nt, Homo sapiens
cucccugagccagggcuuugac

SEQ ID NO: 203640 - RNA, 22 nt, Homo sapiens
cucccuuugcugaauguuuuuc

SEQ ID NO: 203641 - RNA, 22 nt, Homo sapiens
cuccuaaccagggcuguuaguc

SEQ ID NO: 203642 - RNA, 22 nt, Homo sapiens
cucugauggagauauacaagga

SEQ ID NO: 203643 - RNA, 20 nt, Homo sapiens
cucugguugugaauugucuu

SEQ ID NO: 203644 - RNA, 22 nt, Homo sapiens
cucugguuucgcaggaaauaga

SEQ ID NO: 203645 - RNA, 22 nt, Homo sapiens
cucuuggguagauuuugcagag

SEQ ID NO: 203646 - RNA, 22 nt, Homo sapiens
cucuuuggaugccuuaggguua

SEQ ID NO: 203647 - RNA, 22 nt, Homo sapiens
cugaaggcagguagaauagaga

SEQ ID NO: 203648 - RNA, 22 nt, Homo sapiens
cugaauguucuauagaagccgc

SEQ ID NO: 203649 - RNA, 22 nt, Homo sapiens
cugacacuucaaaacugccaau

SEQ ID NO: 203650 - RNA, 22 nt, Homo sapiens
cugacagucucauugauuugcu

SEQ ID NO: 203651 - RNA, 17 nt, Homo sapiens
cugaccucauuguguac

SEQ ID NO: 203652 - RNA, 22 nt, Homo sapiens
cugacguguuuuccagaccuuu

SEQ ID NO: 203653 - RNA, 22 nt, Homo sapiens
cugagaaugaugauuuccaguu

SEQ ID NO: 203654 - RNA, 22 nt, Homo sapiens
cugagaucguggggcugcuguc

SEQ ID NO: 203655 - RNA, 22 nt, Homo sapiens
cugagauuaagauauugggagu

SEQ ID NO: 203656 - RNA, 22 nt, Homo sapiens
cugagcacugagauccucuagc

SEQ ID NO: 203657 - RNA, 18 nt, Homo sapiens
cugagcacugcuuuauga

SEQ ID NO: 203658 - RNA, 22 nt, Homo sapiens
cugagcccauucuggggagaag

SEQ ID NO: 203659 - RNA, 22 nt, Homo sapiens
cugagguauuuaggugaaagaa

SEQ ID NO: 203660 - RNA, 22 nt, Homo sapiens
gaauagugcugcaguaaacaua

SEQ ID NO: 203661 - RNA, 22 nt, Homo sapiens
gaaugaauguuuauccuuagau

SEQ ID NO: 203662 - RNA, 22 nt, Homo sapiens
gaauguuuacuuuguuuaauac

SEQ ID NO: 203663 - RNA, 22 nt, Homo sapiens
gacaccauuucaguacuagguu

SEQ ID NO: 203664 - RNA, 22 nt, Homo sapiens
gacaccugguguggaacuggag

SEQ ID NO: 203665 - RNA, 22 nt, Homo sapiens
gacagagcaagacccuauuuaa

SEQ ID NO: 203666 - RNA, 18 nt, Homo sapiens
gacaguguggcaauuccu

SEQ ID NO: 203667 - RNA, 22 nt, Homo sapiens
gacaucauuaugagauuuaaac

SEQ ID NO: 203668 - RNA, 22 nt, Homo sapiens
gacauguuucucucuguuuacu

SEQ ID NO: 203669 - RNA, 22 nt, Homo sapiens
gaccacauuccacacaggcuuu

SEQ ID NO: 203670 - RNA, 22 nt, Homo sapiens
gaccugagagguacauguauuu

SEQ ID NO: 203671 - RNA, 18 nt, Homo sapiens
gacucaguuucuaaggca

SEQ ID NO: 203672 - RNA, 18 nt, Homo sapiens
gacuccauuucagccaga

SEQ ID NO: 203673 - RNA, 22 nt, Homo sapiens
gacucuguagacaaucacaucu

SEQ ID NO: 203674 - RNA, 22 nt, Homo sapiens
gacugcagugcagcuguuaggc

SEQ ID NO: 203675 - RNA, 16 nt, Homo sapiens
gacugggcugaggaau

SEQ ID NO: 203676 - RNA, 22 nt, Homo sapiens
gacuugaagaaucuaagggagg

SEQ ID NO: 203677 - RNA, 18 nt, Homo sapiens
gacuuggaguuuacagug

SEQ ID NO: 203678 - RNA, 22 nt, Homo sapiens
gagaacagagauaauuuuacuu

SEQ ID NO: 203679 - RNA, 22 nt, Homo sapiens
gagaacaguguuguauuuuuuc

SEQ ID NO: 203680 - RNA, 22 nt, Homo sapiens
gagaacuaaugguuugauaagg

SEQ ID NO: 203681 - RNA, 21 nt, Homo sapiens
gagaaucaucauggcugcaua

SEQ ID NO: 203682 - RNA, 22 nt, Homo sapiens
gagacauguuugccaauaauuu

SEQ ID NO: 203683 - RNA, 22 nt, Homo sapiens
gagacauugacuuuguuccaga

SEQ ID NO: 203684 - RNA, 20 nt, Homo sapiens
gagaccugagauucacucaa

SEQ ID NO: 203685 - RNA, 22 nt, Homo sapiens
gagagugcuuuggguguaggcc

SEQ ID NO: 203686 - RNA, 22 nt, Homo sapiens
gagauaggauucacuuucaugu

SEQ ID NO: 203687 - RNA, 22 nt, Homo sapiens
gagaucaaguauucuccacuaa

SEQ ID NO: 203688 - RNA, 22 nt, Homo sapiens
gagaugaaaucuugcucuguca

SEQ ID NO: 203689 - RNA, 22 nt, Homo sapiens
gagaugaaguuaaggaucuuua

SEQ ID NO: 203690 - RNA, 20 nt, Homo sapiens
gagauguugaucagggcuau

SEQ ID NO: 203691 - RNA, 22 nt, Homo sapiens
gagauguuuuguuaucaaagga

SEQ ID NO: 203692 - RNA, 22 nt, Homo sapiens
gagauuaauacacaucaaaugc

SEQ ID NO: 203693 - RNA, 22 nt, Homo sapiens
gagauuauugucucccucacca

SEQ ID NO: 203694 - RNA, 22 nt, Homo sapiens
gagauuauuuaaaaggugauuu

SEQ ID NO: 203695 - RNA, 22 nt, Homo sapiens
gagcaaaaguauguauugguua

SEQ ID NO: 203696 - RNA, 22 nt, Homo sapiens
gagcuagguuuugaauccagac

SEQ ID NO: 203697 - RNA, 22 nt, Homo sapiens
gagcucaccuuaccucuggagc

SEQ ID NO: 203698 - RNA, 20 nt, Homo sapiens
gagcucaucuucuuuaccac

SEQ ID NO: 203699 - RNA, 22 nt, Homo sapiens
gagcuuggguuaaaguugccuu

SEQ ID NO: 203700 - RNA, 22 nt, Homo sapiens
gaggaaguagcuacugucuuuc

SEQ ID NO: 203701 - RNA, 22 nt, Homo sapiens
gaggagauauucugcuggaugg

SEQ ID NO: 203702 - RNA, 22 nt, Homo sapiens
gaggaguauuuugucgaauguc

SEQ ID NO: 203703 - RNA, 22 nt, Homo sapiens
gaggcaagaguaguuaaguuag

SEQ ID NO: 203704 - RNA, 22 nt, Homo sapiens
gaggcaguguguccguucucgg

SEQ ID NO: 203705 - RNA, 22 nt, Homo sapiens
gaggcggugugaugucacaugc

SEQ ID NO: 203706 - RNA, 22 nt, Homo sapiens
gagguaagaguuuuccauuucu

SEQ ID NO: 203707 - RNA, 21 nt, Homo sapiens
gagguaccucauguaagugga

SEQ ID NO: 203708 - RNA, 22 nt, Homo sapiens
gaggucaggacauuuuugcuuu

SEQ ID NO: 203709 - RNA, 22 nt, Homo sapiens
gaggucaugucgggccccagga

SEQ ID NO: 203710 - RNA, 22 nt, Homo sapiens
gagguuuuagugagucccacug

SEQ ID NO: 203711 - RNA, 22 nt, Homo sapiens
gaguaaauguccuagcuucuug

SEQ ID NO: 203712 - RNA, 21 nt, Homo sapiens
gagugcaaauaaagagagggc

SEQ ID NO: 203713 - RNA, 22 nt, Homo sapiens
gagugcaauggcaccgucucgg

SEQ ID NO: 203714 - RNA, 22 nt, Homo sapiens
gagugcaauggcgcgaucucgg

SEQ ID NO: 203715 - RNA, 18 nt, Homo sapiens
gaguggugcuucccuugu

SEQ ID NO: 203716 - RNA, 22 nt, Homo sapiens
gaguucaaaucucagcucuguu

SEQ ID NO: 203717 - RNA, 22 nt, Homo sapiens
gaguucauaucuaugagugugc

SEQ ID NO: 203718 - RNA, 22 nt, Homo sapiens
gaguuccuuugagccugagagg

SEQ ID NO: 203719 - RNA, 19 nt, Homo sapiens
gaguugggguuuacuguaa

SEQ ID NO: 203720 - RNA, 22 nt, Homo sapiens
gauaagagaugauuuugccaug

SEQ ID NO: 203721 - RNA, 22 nt, Homo sapiens
gauaugugauaagaguuaucuu

SEQ ID NO: 203722 - RNA, 22 nt, Homo sapiens
gauauguguuuuagucaggguu

SEQ ID NO: 203723 - RNA, 17 nt, Homo sapiens
gaucacagucgucuccu

SEQ ID NO: 203724 - RNA, 22 nt, Homo sapiens
gaucacaguuccucacgggcau

SEQ ID NO: 203725 - RNA, 22 nt, Homo sapiens
gaucacaugggagaaugagagu

SEQ ID NO: 203726 - RNA, 22 nt, Homo sapiens
gaucacuuugaugccaggaacu

SEQ ID NO: 203727 - RNA, 22 nt, Homo sapiens
gaucagagugaaccuuguuaug

SEQ ID NO: 203728 - RNA, 22 nt, Homo sapiens
gaucugagaaagugucauaaca

SEQ ID NO: 203729 - RNA, 22 nt, Homo sapiens
gaugacacugggucaaaucuca

SEQ ID NO: 203730 - RNA, 22 nt, Homo sapiens
gaugaucucuggugguaaagac

SEQ ID NO: 203731 - RNA, 22 nt, Homo sapiens
gauggcacuuaagagcaagagc

SEQ ID NO: 203732 - RNA, 22 nt, Homo sapiens
gaugguuuucaccugcaugcuu

SEQ ID NO: 203733 - RNA, 22 nt, Homo sapiens
gauguagaaagagugggcugga

SEQ ID NO: 203734 - RNA, 20 nt, Homo sapiens
gauuagagagaggcugugca

SEQ ID NO: 203735 - RNA, 22 nt, Homo sapiens
gauuagucccauuuuacaggug

SEQ ID NO: 203736 - RNA, 22 nt, Homo sapiens
gauuggcauugcugcaccugag

SEQ ID NO: 203737 - RNA, 22 nt, Homo sapiens
gauuugagagaggguguuuaua

SEQ ID NO: 203738 - RNA, 21 nt, Homo sapiens
gcaaaggaauugccuaagcuu

SEQ ID NO: 203739 - RNA, 22 nt, Homo sapiens
gcaaaucuuauguccucacauu

SEQ ID NO: 203740 - RNA, 22 nt, Homo sapiens
gcaacugguuucaguuuuucag

SEQ ID NO: 203741 - RNA, 22 nt, Homo sapiens
gcaagaaugagaaggauuaauu

SEQ ID NO: 203742 - RNA, 22 nt, Homo sapiens
gcaagaauggaacaggagagcc

SEQ ID NO: 203743 - RNA, 22 nt, Homo sapiens
gcaauacugacagcauuaguuu

SEQ ID NO: 203744 - RNA, 22 nt, Homo sapiens
gcacauuacaaguauuagcuca

SEQ ID NO: 203745 - RNA, 22 nt, Homo sapiens
gcaccacugcacucucagcuug

SEQ ID NO: 203746 - RNA, 22 nt, Homo sapiens
gcaccaugguagaauaauggua

SEQ ID NO: 203747 - RNA, 17 nt, Homo sapiens
gcacuggcguaucccac

SEQ ID NO: 203748 - RNA, 22 nt, Homo sapiens
gcagugcaguggcgcgaucucg

SEQ ID NO: 203749 - RNA, 22 nt, Homo sapiens
gcagugugauguuuuaaucuau

SEQ ID NO: 203750 - RNA, 22 nt, Homo sapiens
gcaguguggguagagggcaaga

SEQ ID NO: 203751 - RNA, 22 nt, Homo sapiens
gcagugugugaggaauuugggu

SEQ ID NO: 203752 - RNA, 20 nt, Homo sapiens
gcaguguucugaccugaauc

SEQ ID NO: 203753 - RNA, 22 nt, Homo sapiens
gcaguguugugauccaggucuu

SEQ ID NO: 203754 - RNA, 20 nt, Homo sapiens
gcauaugucuuuauagcaga

SEQ ID NO: 203755 - RNA, 22 nt, Homo sapiens
gcaugauuuuauaucuauguaa

SEQ ID NO: 203756 - RNA, 22 nt, Homo sapiens
gcauugcacuuggcauagacug

SEQ ID NO: 203757 - RNA, 22 nt, Homo sapiens
gccaacauggcgcuccauucuu

SEQ ID NO: 203758 - RNA, 22 nt, Homo sapiens
gccaagaugcugcccacagaca

SEQ ID NO: 203759 - RNA, 22 nt, Homo sapiens
gccaagauugguuuaauauucc

SEQ ID NO: 203760 - RNA, 20 nt, Homo sapiens
gccacaguuaagcuucugcc

SEQ ID NO: 203761 - RNA, 22 nt, Homo sapiens
gccaguguguguuguucuccgc

SEQ ID NO: 203762 - RNA, 22 nt, Homo sapiens
gccccgggugaugcagccguca

SEQ ID NO: 203763 - RNA, 22 nt, Homo sapiens
gcccuuugugucuggcuggggu

SEQ ID NO: 203764 - RNA, 22 nt, Homo sapiens
gcgagcauuguaggaaguucag

SEQ ID NO: 203765 - RNA, 22 nt, Homo sapiens
gcgcagugggcugugccaucca

SEQ ID NO: 203766 - RNA, 22 nt, Homo sapiens
gcgguagcauagacugcaggac

SEQ ID NO: 203767 - RNA, 22 nt, Homo sapiens
gcuaugguuuuuagcuccauca

SEQ ID NO: 203768 - RNA, 22 nt, Homo sapiens
gcucaugagacaagcaggagua

SEQ ID NO: 203769 - RNA, 22 nt, Homo sapiens
gcugagguucaagaagguuaaa

SEQ ID NO: 203770 - RNA, 22 nt, Homo sapiens
gcugauggugcaguucuagccu

SEQ ID NO: 203771 - RNA, 22 nt, Homo sapiens
gcugcuguggcagauuggauuc

SEQ ID NO: 203772 - RNA, 22 nt, Homo sapiens
gcuggcaaguggccuacuuugu

SEQ ID NO: 203773 - RNA, 22 nt, Homo sapiens
gcuggcuuucuccugaucucag

SEQ ID NO: 203774 - RNA, 22 nt, Homo sapiens
gcuggugacuuuaaguugaagc

SEQ ID NO: 203775 - RNA, 22 nt, Homo sapiens
gcugguguugugaaucaggccg

SEQ ID NO: 203776 - RNA, 19 nt, Homo sapiens
gcugguuguccacucucuc

SEQ ID NO: 203777 - RNA, 20 nt, Homo sapiens
gcugugcuuaauacacuuuc

SEQ ID NO: 203778 - RNA, 22 nt, Homo sapiens
gcuguguugugcccagcaucau

SEQ ID NO: 203779 - RNA, 18 nt, Homo sapiens
gcuguugucagagcacau

SEQ ID NO: 203780 - RNA, 22 nt, Homo sapiens
gcuugguccccacccaaaucgc

SEQ ID NO: 203781 - RNA, 22 nt, Homo sapiens
gcuuugguucaaccaggcaauu

SEQ ID NO: 203782 - RNA, 22 nt, Homo sapiens
gcuuuguugauggugagucugu

SEQ ID NO: 203783 - RNA, 22 nt, Homo sapiens
gcuuuguuguugaugggaaauc

SEQ ID NO: 203784 - RNA, 22 nt, Homo sapiens
ggaagacuuagaguagcaucag

SEQ ID NO: 203785 - RNA, 20 nt, Homo sapiens
ggaagagugacacaagguau

SEQ ID NO: 203786 - RNA, 17 nt, Homo sapiens
ggaagccuuugguuuaa

SEQ ID NO: 203787 - RNA, 22 nt, Homo sapiens
ggaagguaauugucagcucaua

SEQ ID NO: 203788 - RNA, 22 nt, Homo sapiens
ggaaugggauuugaagucuggc

SEQ ID NO: 203789 - RNA, 21 nt, Homo sapiens
ggaauguugccagcagccaga

SEQ ID NO: 203790 - RNA, 22 nt, Homo sapiens
ggacaaaguauuuucaaaugua

SEQ ID NO: 203791 - RNA, 22 nt, Homo sapiens
ggacacguagaugccgacuagc

SEQ ID NO: 203792 - RNA, 22 nt, Homo sapiens
ggacuagaggugaaaagaagac

SEQ ID NO: 203793 - RNA, 22 nt, Homo sapiens
ggagagcuaggcagagguuugu

SEQ ID NO: 203794 - RNA, 22 nt, Homo sapiens
ggagaucuuuaggaguuggacu

SEQ ID NO: 203795 - RNA, 22 nt, Homo sapiens
ggagguagguuugugauuugua

SEQ ID NO: 203796 - RNA, 22 nt, Homo sapiens
ggagucugaacuggacaaugac

SEQ ID NO: 203797 - RNA, 22 nt, Homo sapiens
ggagucugauuuuuauguugcu

SEQ ID NO: 203798 - RNA, 22 nt, Homo sapiens
ggagugucagaaacaguguccu

SEQ ID NO: 203799 - RNA, 22 nt, Homo sapiens
ggauacauuuuuccuccucuuc

SEQ ID NO: 203800 - RNA, 22 nt, Homo sapiens
ggaucacagagcuugggaaagg

SEQ ID NO: 203801 - RNA, 21 nt, Homo sapiens
ggauucaucccucaugaauuu

SEQ ID NO: 203802 - RNA, 22 nt, Homo sapiens
ggcaaaaucgcaauuacuuuug

SEQ ID NO: 203803 - RNA, 22 nt, Homo sapiens
ggcaaaauggccagugggucac

SEQ ID NO: 203804 - RNA, 22 nt, Homo sapiens
ggcaagaaaaugcaauuacugu

SEQ ID NO: 203805 - RNA, 21 nt, Homo sapiens
ggcaagaaacacaaucaagua

SEQ ID NO: 203806 - RNA, 22 nt, Homo sapiens
ggcaagaaagaaaucaucuguc

SEQ ID NO: 203807 - RNA, 22 nt, Homo sapiens
ggcaagaaccacaauuacuuuu

SEQ ID NO: 203808 - RNA, 21 nt, Homo sapiens
ggcaagagaauacaacauaaa

SEQ ID NO: 203809 - RNA, 22 nt, Homo sapiens
ggcaagauagauaucaguguca

SEQ ID NO: 203810 - RNA, 22 nt, Homo sapiens
ggcaagaucuuggcucacugaa

SEQ ID NO: 203811 - RNA, 22 nt, Homo sapiens
gugaccaaagauagcucaaguu

SEQ ID NO: 203812 - RNA, 22 nt, Homo sapiens
gugagaacugcuggggccacag

SEQ ID NO: 203813 - RNA, 16 nt, Homo sapiens
gugagagaugacaaac

SEQ ID NO: 203814 - RNA, 22 nt, Homo sapiens
gugagcacugaaagaaggcaag

SEQ ID NO: 203815 - RNA, 21 nt, Homo sapiens
gugaggaguuacuggcuuuga

SEQ ID NO: 203816 - RNA, 22 nt, Homo sapiens
gugagggagcuggaauauuuau

SEQ ID NO: 203817 - RNA, 22 nt, Homo sapiens
gugagguacgugucaagaacca

SEQ ID NO: 203818 - RNA, 22 nt, Homo sapiens
gugagguauacugggaucacua

SEQ ID NO: 203819 - RNA, 21 nt, Homo sapiens
gugaggucauugggcuuucug

SEQ ID NO: 203820 - RNA, 22 nt, Homo sapiens
gugaguuauuauuuauguaaac

SEQ ID NO: 203821 - RNA, 22 nt, Homo sapiens
gugauaucuuacaauucucuuu

SEQ ID NO: 203822 - RNA, 22 nt, Homo sapiens
gugaucuuucaggcuugaccau

SEQ ID NO: 203823 - RNA, 22 nt, Homo sapiens
gugauuauuaugcacugcaugc

SEQ ID NO: 203824 - RNA, 21 nt, Homo sapiens
gugcaacucccucucccuaca

SEQ ID NO: 203825 - RNA, 22 nt, Homo sapiens
gugcaagagugacugcaguuuu

SEQ ID NO: 203826 - RNA, 18 nt, Homo sapiens
gugcaaugaauagcagag

SEQ ID NO: 203827 - RNA, 22 nt, Homo sapiens
gugcacaugguagguauugagu

SEQ ID NO: 203828 - RNA, 19 nt, Homo sapiens
gugcauaguuauuaaagag

SEQ ID NO: 203829 - RNA, 23 nt, Homo sapiens
gugcaugagucuuuauaguagca

SEQ ID NO: 203830 - RNA, 22 nt, Homo sapiens
gugcaugucuaugcgagucuaa

SEQ ID NO: 203831 - RNA, 22 nt, Homo sapiens
gugcccacugucuguccuguag

SEQ ID NO: 203832 - RNA, 22 nt, Homo sapiens
gugccuucuagcuaugguuggc

SEQ ID NO: 203833 - RNA, 22 nt, Homo sapiens
gugcucauuuagagagaagcac

SEQ ID NO: 203834 - RNA, 22 nt, Homo sapiens
gugcuuauccccauucuggagg

SEQ ID NO: 203835 - RNA, 21 nt, Homo sapiens
gugcuuguagccucacuucug

SEQ ID NO: 203836 - RNA, 22 nt, Homo sapiens
gugcuuuguuguggcaguggca

SEQ ID NO: 203837 - RNA, 22 nt, Homo sapiens
guggaaaucucugugugacuua

SEQ ID NO: 203838 - RNA, 22 nt, Homo sapiens
guggaagaaaucagguuauuug

SEQ ID NO: 203839 - RNA, 22 nt, Homo sapiens
guggaagauaguguguuaaugu

SEQ ID NO: 203840 - RNA, 22 nt, Homo sapiens
guggaaggucaugaauguucuu

SEQ ID NO: 203841 - RNA, 22 nt, Homo sapiens
guggaaugcaguguugauucaa

SEQ ID NO: 203842 - RNA, 22 nt, Homo sapiens
guggaauggaaugauuguguau

SEQ ID NO: 203843 - RNA, 22 nt, Homo sapiens
guggacaugaauuuuggaggca

SEQ ID NO: 203844 - RNA, 22 nt, Homo sapiens
guggaggagaaagaagcauuuc

SEQ ID NO: 203845 - RNA, 22 nt, Homo sapiens
guggaguacugagggucacuua

SEQ ID NO: 203846 - RNA, 22 nt, Homo sapiens
guggaguaugaaaacugacuuu

SEQ ID NO: 203847 - RNA, 22 nt, Homo sapiens
guggaucacuugaggucaagag

SEQ ID NO: 203848 - RNA, 22 nt, Homo sapiens
guggcaaguguuccaagaggcg

SEQ ID NO: 203849 - RNA, 22 nt, Homo sapiens
gugggaugaucacaguucacug

SEQ ID NO: 203850 - RNA, 22 nt, Homo sapiens
gugggaugcaaguaaaauuguc

SEQ ID NO: 203851 - RNA, 22 nt, Homo sapiens
gugguagaaaguaccaaacuag

SEQ ID NO: 203852 - RNA, 22 nt, Homo sapiens
gugguuuuaauauucagucuag

SEQ ID NO: 203853 - RNA, 22 nt, Homo sapiens
gugguuuuacaaagagaaagau

SEQ ID NO: 203854 - RNA, 22 nt, Homo sapiens
guguaaaacaauuagaggauuu

SEQ ID NO: 203855 - RNA, 22 nt, Homo sapiens
guguagagaaaaguaccauuuu

SEQ ID NO: 203856 - RNA, 22 nt, Homo sapiens
guguauauccuauuaguucugu

SEQ ID NO: 203857 - RNA, 22 nt, Homo sapiens
guguauguuguccauggaugcg

SEQ ID NO: 203858 - RNA, 21 nt, Homo sapiens
gugucacagacaugacagaug

SEQ ID NO: 203859 - RNA, 22 nt, Homo sapiens
gugucccagugugcauacaggu

SEQ ID NO: 203860 - RNA, 22 nt, Homo sapiens
guguccucgaguacacaucagg

SEQ ID NO: 203861 - RNA, 22 nt, Homo sapiens
gugucucagcccagaccuauuu

SEQ ID NO: 203862 - RNA, 22 nt, Homo sapiens
gugugaacaucauagaguguau

SEQ ID NO: 203863 - RNA, 19 nt, Homo sapiens
gugugcauaucacagagca

SEQ ID NO: 203864 - RNA, 22 nt, Homo sapiens
gugugcauaugucuuuauagua

SEQ ID NO: 203865 - RNA, 22 nt, Homo sapiens
gugugguauuauaacuagguau

SEQ ID NO: 203866 - RNA, 22 nt, Homo sapiens
guuaaugcuggaauaaguuaag

SEQ ID NO: 203867 - RNA, 22 nt, Homo sapiens
guuagaugaagaccaagggcaa

SEQ ID NO: 203868 - RNA, 22 nt, Homo sapiens
guuauccugucuuuacauacaa

SEQ ID NO: 203869 - RNA, 22 nt, Homo sapiens
guuauguaucuugauugggugg

SEQ ID NO: 203870 - RNA, 22 nt, Homo sapiens
guuauguguuuccuuaauugcu

SEQ ID NO: 203871 - RNA, 22 nt, Homo sapiens
guuauuguccauuuauuuagca

SEQ ID NO: 203872 - RNA, 22 nt, Homo sapiens
guucaagcaauucugcugccuc

SEQ ID NO: 203873 - RNA, 22 nt, Homo sapiens
guucaucagggauauuggccug

SEQ ID NO: 203874 - RNA, 22 nt, Homo sapiens
guucccaguugaaaugauuagu

SEQ ID NO: 203875 - RNA, 22 nt, Homo sapiens
guucuauguugggaguucacua

SEQ ID NO: 203876 - RNA, 22 nt, Homo sapiens
guucucacuggacugugaaaau

SEQ ID NO: 203877 - RNA, 22 nt, Homo sapiens
guucuggagauaaagccaaggu

SEQ ID NO: 203878 - RNA, 22 nt, Homo sapiens
guugacuaggagcuacuacuac

SEQ ID NO: 203879 - RNA, 22 nt, Homo sapiens
guugagcaagcuuuggagccua

SEQ ID NO: 203880 - RNA, 22 nt, Homo sapiens
guugcacagucuuuccuggacu

SEQ ID NO: 203881 - RNA, 22 nt, Homo sapiens
guugcccuuagcacuucagccu

SEQ ID NO: 203882 - RNA, 22 nt, Homo sapiens
guugcucaggcugaagugcagu

SEQ ID NO: 203883 - RNA, 22 nt, Homo sapiens
guugggcccauagacugccagu

SEQ ID NO: 203884 - RNA, 22 nt, Homo sapiens
guuuaacugguacuucaagucu

SEQ ID NO: 203885 - RNA, 22 nt, Homo sapiens
guuuaggaaugagaauauuuag

SEQ ID NO: 203886 - RNA, 22 nt, Homo sapiens
ugcccuuugucagaugaguagg

SEQ ID NO: 203887 - RNA, 22 nt, Homo sapiens
ugcuggugauuaaauccugaag

SEQ ID NO: 203888 - RNA, 21 nt, Homo sapiens
ugcuuacugaauguuaauuuc

SEQ ID NO: 203889 - RNA, 22 nt, Homo sapiens
ugcuuaguuguauguuccacau

SEQ ID NO: 203890 - RNA, 20 nt, Homo sapiens
uggaaaguaagucaugauau

SEQ ID NO: 203891 - RNA, 19 nt, Homo sapiens
uggaaugaaauguuagggg

SEQ ID NO: 203892 - RNA, 22 nt, Homo sapiens
uggacugagauuucagcugcca

SEQ ID NO: 203893 - RNA, 22 nt, Homo sapiens
uggaguguguugcagaugaagg

SEQ ID NO: 203894 - RNA, 22 nt, Homo sapiens
uggaugaagagaugguaguugc

SEQ ID NO: 203895 - RNA, 22 nt, Homo sapiens
uggcaaagugugacgugggggu

SEQ ID NO: 203896 - RNA, 22 nt, Homo sapiens
uggcaagaaggauuuauuccuu

SEQ ID NO: 203897 - RNA, 19 nt, Homo sapiens
uggcaaugucagcagagau

SEQ ID NO: 203898 - RNA, 22 nt, Homo sapiens
uggcaauguggaaugguccagg

SEQ ID NO: 203899 - RNA, 22 nt, Homo sapiens
uggcauuuugugugaauuagaa

SEQ ID NO: 203900 - RNA, 18 nt, Homo sapiens
ugggaagaaauucuucuc

SEQ ID NO: 203901 - RNA, 22 nt, Homo sapiens
ugggaagauucuguguuuuucc

SEQ ID NO: 203902 - RNA, 21 nt, Homo sapiens
ugggccccuuccuuacaucau

SEQ ID NO: 203903 - RNA, 22 nt, Homo sapiens
uggucaguugaguccuugccaa

SEQ ID NO: 203904 - RNA, 22 nt, Homo sapiens
uggucauggggcagcugacacu

SEQ ID NO: 203905 - RNA, 20 nt, Homo sapiens
ugguccccugagucuggcuu

SEQ ID NO: 203906 - RNA, 22 nt, Homo sapiens
ugguuaucauagcuaugcuacu

SEQ ID NO: 203907 - RNA, 22 nt, Homo sapiens
uguaauuuaaaugauccuugga

SEQ ID NO: 203908 - RNA, 22 nt, Homo sapiens
uguauaacucacauugaaguuu

SEQ ID NO: 203909 - RNA, 22 nt, Homo sapiens
ugucacagagauuuugguaugu

SEQ ID NO: 203910 - RNA, 22 nt, Homo sapiens
ugucaguggucuggaugcagcc

SEQ ID NO: 203911 - RNA, 22 nt, Homo sapiens
ugucaguguacuguaagaauua

SEQ ID NO: 203912 - RNA, 22 nt, Homo sapiens
uguccaaauugaaucaucuggu

SEQ ID NO: 203913 - RNA, 20 nt, Homo sapiens
ugucccaaccccauggguuc

SEQ ID NO: 203914 - RNA, 19 nt, Homo sapiens
uguccuagaggaguucaca

SEQ ID NO: 203915 - RNA, 22 nt, Homo sapiens
uguccuggugaugcccaaauuc

SEQ ID NO: 203916 - RNA, 22 nt, Homo sapiens
ugucuuggagaauccuggguuu

SEQ ID NO: 203917 - RNA, 22 nt, Homo sapiens
ugugagaucucagaauugaacu

SEQ ID NO: 203918 - RNA, 22 nt, Homo sapiens
ugugcacaacaugcagguuugu

SEQ ID NO: 203919 - RNA, 22 nt, Homo sapiens
ugugcacaaccugcagguuugu

SEQ ID NO: 203920 - RNA, 22 nt, Homo sapiens
ugugcacaaugugcagguuuga

SEQ ID NO: 203921 - RNA, 22 nt, Homo sapiens
ugugcacaaugugcagguuugu

SEQ ID NO: 203922 - RNA, 22 nt, Homo sapiens
ugugcacaugauauaucacaua

SEQ ID NO: 203923 - RNA, 22 nt, Homo sapiens
ugugcguguaagagaucuaggu

SEQ ID NO: 203924 - RNA, 22 nt, Homo sapiens
uguggaguguaugugacagaga

SEQ ID NO: 203925 - RNA, 22 nt, Homo sapiens
uguggcucuucuguucuccacu

SEQ ID NO: 203926 - RNA, 22 nt, Homo sapiens
uguggcuuuguaaccauggguc

SEQ ID NO: 203927 - RNA, 22 nt, Homo sapiens
uguuacagcagaauugauugca

SEQ ID NO: 203928 - RNA, 22 nt, Homo sapiens
uguucaugaguucucauuuuua

SEQ ID NO: 203929 - RNA, 22 nt, Homo sapiens
uguuuuggaguggacuuugcau

SEQ ID NO: 203930 - RNA, 22 nt, Homo sapiens
uguuuugguugucccuggccag

SEQ ID NO: 203931 - RNA, 22 nt, Homo sapiens
uuaaagcuggcguuacaguuug

SEQ ID NO: 203932 - RNA, 22 nt, Homo sapiens
uuaauuguccauuauucuguuc

SEQ ID NO: 203933 - RNA, 22 nt, Homo sapiens
uuacacaguaggucccuaguaa

SEQ ID NO: 203934 - RNA, 22 nt, Homo sapiens
uuacaguguuuguucuguuacu

SEQ ID NO: 203935 - RNA, 22 nt, Homo sapiens
uuagacaguggugcacugcacu

SEQ ID NO: 203936 - RNA, 22 nt, Homo sapiens
uuauacucgucugaaugauucu

SEQ ID NO: 203937 - RNA, 21 nt, Homo sapiens
uuauaguggcaugauuuauaa

SEQ ID NO: 203938 - RNA, 22 nt, Homo sapiens
uuauccugucaguaaauauuuu

SEQ ID NO: 203939 - RNA, 22 nt, Homo sapiens
uuauggcucuuggggaaguaga

SEQ ID NO: 203940 - RNA, 22 nt, Homo sapiens
uuauuacuccuauuuuguagau

SEQ ID NO: 203941 - RNA, 22 nt, Homo sapiens
uuauugcuaaaucaugaccaca

SEQ ID NO: 203942 - RNA, 22 nt, Homo sapiens
uucaaauguucuuucaccaccc

SEQ ID NO: 203943 - RNA, 22 nt, Homo sapiens
uucacagaaaaaggcgaugagg

SEQ ID NO: 203944 - RNA, 22 nt, Homo sapiens
uucacaguggugggagacguca

SEQ ID NO: 203945 - RNA, 22 nt, Homo sapiens
uucacaguguguacaccagggg

SEQ ID NO: 203946 - RNA, 22 nt, Homo sapiens
uucacaugacagggugaagcau

SEQ ID NO: 203947 - RNA, 22 nt, Homo sapiens
uucacaugguugccuuuugauc

SEQ ID NO: 203948 - RNA, 22 nt, Homo sapiens
uucagaucaucccagcuccacu

SEQ ID NO: 203949 - RNA, 22 nt, Homo sapiens
uucagaugcacacuguagucua

SEQ ID NO: 203950 - RNA, 22 nt, Homo sapiens
uucauaguauuuuucuccaaau

SEQ ID NO: 203951 - RNA, 22 nt, Homo sapiens
uucauaguucuuuuagucauua

SEQ ID NO: 203952 - RNA, 21 nt, Homo sapiens
uucaucagccagaaaucaagc

SEQ ID NO: 203953 - RNA, 22 nt, Homo sapiens
uucaucagcuguagaugucaug

SEQ ID NO: 203954 - RNA, 22 nt, Homo sapiens
uucauccccuccaaaucucaug

SEQ ID NO: 203955 - RNA, 22 nt, Homo sapiens
uucaucuggcaauucagagauu

SEQ ID NO: 203956 - RNA, 22 nt, Homo sapiens
uucaugucuuggcuguuagagu

SEQ ID NO: 203957 - RNA, 22 nt, Homo sapiens
uuccaguguguucauccucaga

SEQ ID NO: 203958 - RNA, 22 nt, Homo sapiens
uuccaugugggcuugucaagua

SEQ ID NO: 203959 - RNA, 21 nt, Homo sapiens
uucuaaguaaauguuggacau

SEQ ID NO: 203960 - RNA, 22 nt, Homo sapiens
uucuauguuguuagacccacca

SEQ ID NO: 203961 - RNA, 22 nt, Homo sapiens
uucucacaguacagggagcucu

SEQ ID NO: 203962 - RNA, 22 nt, Homo sapiens
uucucuggucagaggggagguu

SEQ ID NO: 203963 - RNA, 22 nt, Homo sapiens
uucuggaaaucagcagagggug

SEQ ID NO: 203964 - RNA, 19 nt, Homo sapiens
uucugguguuuuaagccaa

SEQ ID NO: 203965 - RNA, 22 nt, Homo sapiens
uucuguguuuaggucacggcua

SEQ ID NO: 203966 - RNA, 22 nt, Homo sapiens
uucuucaguuacaacaaggggg

SEQ ID NO: 203967 - RNA, 22 nt, Homo sapiens
uugaaagucauggcacaggcaa

SEQ ID NO: 203968 - RNA, 22 nt, Homo sapiens
uugaagguagaaguucucaauu

SEQ ID NO: 203969 - RNA, 22 nt, Homo sapiens
uugaaguauagaguuuaagaac

SEQ ID NO: 203970 - RNA, 22 nt, Homo sapiens
uugaaguaugaccgcugagaau

SEQ ID NO: 203971 - RNA, 22 nt, Homo sapiens
uugaaugaaaugaugucauuug

SEQ ID NO: 203972 - RNA, 22 nt, Homo sapiens
uugacaggaugcucagggccca

SEQ ID NO: 203973 - RNA, 22 nt, Homo sapiens
uugacuguaagauggcuauuac

SEQ ID NO: 203974 - RNA, 22 nt, Homo sapiens
ggucccccuccacucucgcaaa

SEQ ID NO: 203975 - RNA, 22 nt, Homo sapiens
ggugauguuugaguugagacag

SEQ ID NO: 203976 - RNA, 22 nt, Homo sapiens
gguggugguauuucagaaaaug

SEQ ID NO: 203977 - RNA, 22 nt, Homo sapiens
guacagugcucacaaugagagc

SEQ ID NO: 203978 - RNA, 22 nt, Homo sapiens
guagagugcugggcacuggcuc

SEQ ID NO: 203979 - RNA, 22 nt, Homo sapiens
guauacaguugacccuugaacc

SEQ ID NO: 203980 - RNA, 19 nt, Homo sapiens
gucaaagucgguauucaaa

SEQ ID NO: 203981 - RNA, 22 nt, Homo sapiens
gucaagauuuguaggacagaga

SEQ ID NO: 203982 - RNA, 22 nt, Homo sapiens
gucacaguguuuguucauccca

SEQ ID NO: 203983 - RNA, 22 nt, Homo sapiens
gucaggcaccgauacaguuuuu

SEQ ID NO: 203984 - RNA, 22 nt, Homo sapiens
uuaauuguccaaguucaucucu

SEQ ID NO: 203985 - RNA, 22 nt, Homo sapiens
uuacaguaugaguaagaguucu

SEQ ID NO: 203986 - RNA, 19 nt, Homo sapiens
uuagguacuggauaugccc

SEQ ID NO: 203987 - RNA, 22 nt, Homo sapiens
uuagguacuuuggagagauuca

SEQ ID NO: 203988 - RNA, 22 nt, Homo sapiens
uuauauguuucuuagggacaga

SEQ ID NO: 203989 - RNA, 22 nt, Homo sapiens
uucaagaauuaaaguggcuuuu

SEQ ID NO: 203990 - RNA, 22 nt, Homo sapiens
uucacagacaacuggucccuua

SEQ ID NO: 203991 - RNA, 22 nt, Homo sapiens
uucacagaguuauuuuuaugcu

SEQ ID NO: 203992 - RNA, 22 nt, Homo sapiens
uucacaguguuucucacgguua

SEQ ID NO: 203993 - RNA, 23 nt, Homo sapiens
uucaccguguuggccaggcuggu

SEQ ID NO: 203994 - RNA, 22 nt, Homo sapiens
uucagaguggacagaaauuaag

SEQ ID NO: 203995 - RNA, 22 nt, Homo sapiens
uucagggacuuuagacaagaga

SEQ ID NO: 203996 - RNA, 22 nt, Homo sapiens
uucaguccauuuccuuggucac

SEQ ID NO: 203997 - RNA, 22 nt, Homo sapiens
uucaguggacuuaguagugcuu

SEQ ID NO: 203998 - RNA, 22 nt, Homo sapiens
uucagugguuauuugugagauu

SEQ ID NO: 203999 - RNA, 22 nt, Homo sapiens
uucaugcaucuguagugguuaa

SEQ ID NO: 204000 - RNA, 22 nt, Homo sapiens
uuccagcugggggcaacucugc

SEQ ID NO: 204001 - RNA, 22 nt, Homo sapiens
uuccauguaguugaacgguuuu

SEQ ID NO: 204002 - RNA, 22 nt, Homo sapiens
uucccaguuggggaaagcgacc

SEQ ID NO: 204003 - RNA, 22 nt, Homo sapiens
uucccuagaacacauggaggga

SEQ ID NO: 204004 - RNA, 22 nt, Homo sapiens
uucccuguaucuucugccaugu

SEQ ID NO: 204005 - RNA, 22 nt, Homo sapiens
uucccuugcaggaugaucugga

SEQ ID NO: 204006 - RNA, 22 nt, Homo sapiens
uuccugaggccuccccagaagc

SEQ ID NO: 204007 - RNA, 22 nt, Homo sapiens
uucuagcacuuugggagacuga

SEQ ID NO: 204008 - RNA, 22 nt, Homo sapiens
uucuauguuugaaaaugccaaa

SEQ ID NO: 204009 - RNA, 22 nt, Homo sapiens
uucuggcucgauucucugaccg

SEQ ID NO: 204010 - RNA, 22 nt, Homo sapiens
uucugugcuuguggaugaagug

SEQ ID NO: 204011 - RNA, 22 nt, Homo sapiens
uugaaagcuaucagagauucca

SEQ ID NO: 204012 - RNA, 22 nt, Homo sapiens
uugaaauguuuagaaguuugga

SEQ ID NO: 204013 - RNA, 22 nt, Homo sapiens
uugaaccauucuuuugauagag

SEQ ID NO: 204014 - RNA, 22 nt, Homo sapiens
uugaaguagguaccguucaauu

SEQ ID NO: 204015 - RNA, 22 nt, Homo sapiens
uugacauguaaguacucuauag

SEQ ID NO: 204016 - RNA, 22 nt, Homo sapiens
uugacugugguaauggaagcug

SEQ ID NO: 204017 - RNA, 22 nt, Homo sapiens
uugacuucagagcugauucaag

SEQ ID NO: 204018 - RNA, 22 nt, Homo sapiens
uugagacugagucucgcccugu

SEQ ID NO: 204019 - RNA, 22 nt, Homo sapiens
uugagauacauaauuaugaaug

SEQ ID NO: 204020 - RNA, 22 nt, Homo sapiens
uugagauaggagcuguuguucu

SEQ ID NO: 204021 - RNA, 22 nt, Homo sapiens
uugagauggagccucacucugc

SEQ ID NO: 204022 - RNA, 22 nt, Homo sapiens
uugagauggagucucacucuuc

SEQ ID NO: 204023 - RNA, 22 nt, Homo sapiens
uugagauggagucucgcacugu

SEQ ID NO: 204024 - RNA, 22 nt, Homo sapiens
uugagauggaguuucacucuug

SEQ ID NO: 204025 - RNA, 22 nt, Homo sapiens
uugagcucuuccagccuggagc

SEQ ID NO: 204026 - RNA, 22 nt, Homo sapiens
uugaggcuuuugaccucaugug

SEQ ID NO: 204027 - RNA, 22 nt, Homo sapiens
uugagguauaaagguagguugu

SEQ ID NO: 204028 - RNA, 22 nt, Homo sapiens
uugaucuaugugucuguuuuua

SEQ ID NO: 204029 - RNA, 22 nt, Homo sapiens
uugcaaaucucuuguguuuggu

SEQ ID NO: 204030 - RNA, 20 nt, Homo sapiens
uugcacagagaaggaggcag

SEQ ID NO: 204031 - RNA, 22 nt, Homo sapiens
uugcacaguguguacagcacca

SEQ ID NO: 204032 - RNA, 22 nt, Homo sapiens
uugcacauuuuuucuggcagaa

SEQ ID NO: 204033 - RNA, 22 nt, Homo sapiens
uuggcauuuuggacacccagga

SEQ ID NO: 204034 - RNA, 22 nt, Homo sapiens
uuggcuguguuucccuacaaau

SEQ ID NO: 204035 - RNA, 22 nt, Homo sapiens
uugggaauguccuaauaucucg

SEQ ID NO: 204036 - RNA, 22 nt, Homo sapiens
uuggucaggcuaaucucgaacg

SEQ ID NO: 204037 - RNA, 22 nt, Homo sapiens
uuggucaucucccuccuuuuag

SEQ ID NO: 204038 - RNA, 22 nt, Homo sapiens
uuguaccacagggcaugaagug

SEQ ID NO: 204039 - RNA, 22 nt, Homo sapiens
uuguccuugagauaguuugcag

SEQ ID NO: 204040 - RNA, 22 nt, Homo sapiens
uugugcacauguacccuagaac

SEQ ID NO: 204041 - RNA, 22 nt, Homo sapiens
uugugcaugaugcauacauggu

SEQ ID NO: 204042 - RNA, 22 nt, Homo sapiens
uugugcuucaucaccuagcaga

SEQ ID NO: 204043 - RNA, 22 nt, Homo sapiens
uugugcuuguaacuacauucag

SEQ ID NO: 204044 - RNA, 17 nt, Homo sapiens
uuguucccauuaaaaag

SEQ ID NO: 204045 - RNA, 23 nt, Homo sapiens
uuguucccuuccacucagucucc

SEQ ID NO: 204046 - RNA, 22 nt, Homo sapiens
uaaguucauucaugaaacuuag

SEQ ID NO: 204047 - RNA, 22 nt, Homo sapiens
uaauacauucaaggugguaguu

SEQ ID NO: 204048 - RNA, 22 nt, Homo sapiens
uaaugugcuucucuaccauagg

SEQ ID NO: 204049 - RNA, 22 nt, Homo sapiens
uacaaaguaacaguuccuguau

SEQ ID NO: 204050 - RNA, 22 nt, Homo sapiens
uacaggugcucuacagacagga

SEQ ID NO: 204051 - RNA, 21 nt, Homo sapiens
uagaugguguucuagagagaa

SEQ ID NO: 204052 - RNA, 22 nt, Homo sapiens
uagcagccaggaagggcuggcu

SEQ ID NO: 204053 - RNA, 22 nt, Homo sapiens
uagcaguuguuguuacuuguau

SEQ ID NO: 204054 - RNA, 22 nt, Homo sapiens
uagcugcauccugugcacucaa

SEQ ID NO: 204055 - RNA, 22 nt, Homo sapiens
uaggaaguuuucuugcugggcc

SEQ ID NO: 204056 - RNA, 22 nt, Homo sapiens
uaggcuuuucugggaugugggc

SEQ ID NO: 204057 - RNA, 22 nt, Homo sapiens
uaggcuuuuggacccugucucu

SEQ ID NO: 204058 - RNA, 22 nt, Homo sapiens
uagguacuuaagaucucagcua

SEQ ID NO: 204059 - RNA, 22 nt, Homo sapiens
uaggugaaugcuggaagaaaug

SEQ ID NO: 204060 - RNA, 22 nt, Homo sapiens
uagucccuuucuauuaaugaga

SEQ ID NO: 204061 - RNA, 22 nt, Homo sapiens
uagugcugagauugagaagccc

SEQ ID NO: 204062 - RNA, 20 nt, Homo sapiens
uaguggcaugcaccuguagc

SEQ ID NO: 204063 - RNA, 22 nt, Homo sapiens
uauacugucuuuguaugccuag

SEQ ID NO: 204064 - RNA, 22 nt, Homo sapiens
uauaggacuugguguaguuucu

SEQ ID NO: 204065 - RNA, 23 nt, Homo sapiens
uauaugugucuaggagcuauggu

SEQ ID NO: 204066 - RNA, 22 nt, Homo sapiens
uaucacagcauugucuauaaua

SEQ ID NO: 204067 - RNA, 22 nt, Homo sapiens
uaucagagcugucagccuaccu

SEQ ID NO: 204068 - RNA, 22 nt, Homo sapiens
uaucccaguggauguaccccau

SEQ ID NO: 204069 - RNA, 22 nt, Homo sapiens
uaucugcaucccauuuuuauca

SEQ ID NO: 204070 - RNA, 22 nt, Homo sapiens
uauggcuucuauaaggaagcuu

SEQ ID NO: 204071 - RNA, 22 nt, Homo sapiens
uauggcuuuguuaacauuuucu

SEQ ID NO: 204072 - RNA, 22 nt, Homo sapiens
uaugggcuuuguuuuguacuag

SEQ ID NO: 204073 - RNA, 22 nt, Homo sapiens
uauggguuuuucauaaauaggu

SEQ ID NO: 204074 - RNA, 22 nt, Homo sapiens
uaugguuuuaagguuaaggacu

SEQ ID NO: 204075 - RNA, 22 nt, Homo sapiens
uauugacuuuuuuguuaggagg

SEQ ID NO: 204076 - RNA, 22 nt, Homo sapiens
uauugcaauuggcagagugcua

SEQ ID NO: 204077 - RNA, 22 nt, Homo sapiens
uauugccucagugacuuugggg

SEQ ID NO: 204078 - RNA, 22 nt, Homo sapiens
ucaaaguauucuucugagaacc

SEQ ID NO: 204079 - RNA, 22 nt, Homo sapiens
ucaaagugagcuccuucucacu

SEQ ID NO: 204080 - RNA, 22 nt, Homo sapiens
ucaagcaauucuccugccucag

SEQ ID NO: 204081 - RNA, 22 nt, Homo sapiens
ucaaguacuuauuugauaauua

SEQ ID NO: 204082 - RNA, 22 nt, Homo sapiens
ucacaaguguauagacaugucc

SEQ ID NO: 204083 - RNA, 22 nt, Homo sapiens
ucacagaggagaagaccuuuaa

SEQ ID NO: 204084 - RNA, 17 nt, Homo sapiens
ucacaguguuaggauga

SEQ ID NO: 204085 - RNA, 22 nt, Homo sapiens
ucaccaccuuccaggaccacug

SEQ ID NO: 204086 - RNA, 22 nt, Homo sapiens
ucacugaaaccacugccuccug

SEQ ID NO: 204087 - RNA, 22 nt, Homo sapiens
ucacugaaaccuccgccuucug

SEQ ID NO: 204088 - RNA, 22 nt, Homo sapiens
ucacuggucuaaguggaggggg

SEQ ID NO: 204089 - RNA, 22 nt, Homo sapiens
ucagaugcauccauaccccacu

SEQ ID NO: 204090 - RNA, 20 nt, Homo sapiens
ucaggcuccgcauuaacuua

SEQ ID NO: 204091 - RNA, 22 nt, Homo sapiens
ucaggugcaguggcucaugcuu

SEQ ID NO: 204092 - RNA, 23 nt, Homo sapiens
ucaguagucauugggaaagugug

SEQ ID NO: 204093 - RNA, 22 nt, Homo sapiens
ucagugaauacauguacucaug

SEQ ID NO: 204094 - RNA, 22 nt, Homo sapiens
ucagugaauauauaacagcgau

SEQ ID NO: 204095 - RNA, 22 nt, Homo sapiens
ucagugcuuggcacagagagcu

SEQ ID NO: 204096 - RNA, 22 nt, Homo sapiens
ucagugucaucuggguuguuug

SEQ ID NO: 204097 - RNA, 22 nt, Homo sapiens
ucagugucugugauggagaggu

SEQ ID NO: 204098 - RNA, 19 nt, Homo sapiens
ucauagucuaagaugagaa

SEQ ID NO: 204099 - RNA, 22 nt, Homo sapiens
ucauucauucuucaguggguac

SEQ ID NO: 204100 - RNA, 22 nt, Homo sapiens
ucauugcacuucuuuaguugca

SEQ ID NO: 204101 - RNA, 22 nt, Homo sapiens
ucauuguccaacuucuuucagu

SEQ ID NO: 204102 - RNA, 19 nt, Homo sapiens
uccaccgcgugcaccucua

SEQ ID NO: 204103 - RNA, 22 nt, Homo sapiens
uccagcuuuuucuaauucugug

SEQ ID NO: 204104 - RNA, 22 nt, Homo sapiens
uccagugcauucagacacuugg

SEQ ID NO: 204105 - RNA, 22 nt, Homo sapiens
uccauuuguagguagugagaca

SEQ ID NO: 204106 - RNA, 22 nt, Homo sapiens
ugaauguuugcuuacuuccaua

SEQ ID NO: 204107 - RNA, 22 nt, Homo sapiens
ugaauucuguccaaaauaacug

SEQ ID NO: 204108 - RNA, 22 nt, Homo sapiens
ugacacagcaagauggaaccau

SEQ ID NO: 204109 - RNA, 23 nt, Homo sapiens
ugacagaccuucuggaagaaguc

SEQ ID NO: 204110 - RNA, 22 nt, Homo sapiens
ugacagcugaagauguugaacc

SEQ ID NO: 204111 - RNA, 22 nt, Homo sapiens
ugacaugaagaaaaacagauuu

SEQ ID NO: 204112 - RNA, 22 nt, Homo sapiens
ugacaugaaggcaccucugucc

SEQ ID NO: 204113 - RNA, 22 nt, Homo sapiens
ugacaugaagucucccucuguu

SEQ ID NO: 204114 - RNA, 22 nt, Homo sapiens
ugacaugagauuugggaggggc

SEQ ID NO: 204115 - RNA, 22 nt, Homo sapiens
ugagaacagauggcuuuauuau

SEQ ID NO: 204116 - RNA, 22 nt, Homo sapiens
ugagaagacaucagcuuucgga

SEQ ID NO: 204117 - RNA, 22 nt, Homo sapiens
ugagaagugacgcagcaggguu

SEQ ID NO: 204118 - RNA, 22 nt, Homo sapiens
ugagaauauuugaagauguuag

SEQ ID NO: 204119 - RNA, 22 nt, Homo sapiens
ugagacacugaauccggccuga

SEQ ID NO: 204120 - RNA, 22 nt, Homo sapiens
ugagacuguuuuggggaacuuc

SEQ ID NO: 204121 - RNA, 22 nt, Homo sapiens
ugagauaauuuacuuguugagg

SEQ ID NO: 204122 - RNA, 22 nt, Homo sapiens
ugagauagcauaagggacagaa

SEQ ID NO: 204123 - RNA, 22 nt, Homo sapiens
ugagauauugggaguaauguca

SEQ ID NO: 204124 - RNA, 22 nt, Homo sapiens
ugagaucacgccacugcacucc

SEQ ID NO: 204125 - RNA, 22 nt, Homo sapiens
ugagaucauguguggaccccag

SEQ ID NO: 204126 - RNA, 22 nt, Homo sapiens
ugagaucugauaggccuggguu

SEQ ID NO: 204127 - RNA, 22 nt, Homo sapiens
ugagaucuuugcuguccucacc

SEQ ID NO: 204128 - RNA, 22 nt, Homo sapiens
ugagaugacgacacaccucagu

SEQ ID NO: 204129 - RNA, 22 nt, Homo sapiens
ugagaugaguugcgcucugucg

SEQ ID NO: 204130 - RNA, 22 nt, Homo sapiens
ugagaugauagauauguuaauu

SEQ ID NO: 204131 - RNA, 22 nt, Homo sapiens
ugagaugaucaaaguauaggcu

SEQ ID NO: 204132 - RNA, 22 nt, Homo sapiens
ugagaugcaaaaugagaauugu

SEQ ID NO: 204133 - RNA, 22 nt, Homo sapiens
ugagauucucugauuguagguc

SEQ ID NO: 204134 - RNA, 22 nt, Homo sapiens
ugagauuguaucugcaaugugu

SEQ ID NO: 204135 - RNA, 22 nt, Homo sapiens
ugagcacauuuacaucaguucc

SEQ ID NO: 204136 - RNA, 21 nt, Homo sapiens
ugagcauuaguacaguaggga

SEQ ID NO: 204137 - RNA, 22 nt, Homo sapiens
ugagggaugccugguuuguuuu

SEQ ID NO: 204138 - RNA, 22 nt, Homo sapiens
ugagguuauuuguucaagaagu

SEQ ID NO: 204139 - RNA, 22 nt, Homo sapiens
ugaguucauggucauuugucac

SEQ ID NO: 204140 - RNA, 22 nt, Homo sapiens
ugauaggucuguuuugaaaagg

SEQ ID NO: 204141 - RNA, 22 nt, Homo sapiens
ugauaguguccugugccacauu

SEQ ID NO: 204142 - RNA, 22 nt, Homo sapiens
ugauauauugaaugaugaaaca

SEQ ID NO: 204143 - RNA, 22 nt, Homo sapiens
ugauaugucacuugaucauggu

SEQ ID NO: 204144 - RNA, 22 nt, Homo sapiens
ugaucuguguaacauaggaguc

SEQ ID NO: 204145 - RNA, 22 nt, Homo sapiens
ugaugucuugcaggcacgagau

SEQ ID NO: 204146 - RNA, 22 nt, Homo sapiens
ugauuugucucucagcccuacu

SEQ ID NO: 204147 - RNA, 22 nt, Homo sapiens
ugcaaaguccucauucuuaccc

SEQ ID NO: 204148 - RNA, 22 nt, Homo sapiens
ugcaauauccucuacuauaggu

SEQ ID NO: 204149 - RNA, 22 nt, Homo sapiens
ugcaaucauuuggaggagaaga

SEQ ID NO: 204150 - RNA, 22 nt, Homo sapiens
ugcagugugcuggggucuccau

SEQ ID NO: 204151 - RNA, 21 nt, Homo sapiens
ugcauggagaacacugagggu

SEQ ID NO: 204152 - RNA, 22 nt, Homo sapiens
ugcauggauguuugaacacacu

SEQ ID NO: 204153 - RNA, 22 nt, Homo sapiens
ugcauggucauacauggcaccc

SEQ ID NO: 204154 - RNA, 22 nt, Homo sapiens
ugcauuaucagauguuugcuuu

SEQ ID NO: 204155 - RNA, 22 nt, Homo sapiens
ugcauuguuuagaaacacuggg

SEQ ID NO: 204156 - RNA, 22 nt, Homo sapiens
ugccaagaacauuuucuguuuu

SEQ ID NO: 204157 - RNA, 22 nt, Homo sapiens
ugccaguauuuuguugaagauu

SEQ ID NO: 204158 - RNA, 22 nt, Homo sapiens
uggaacacauaaauagcauagu

SEQ ID NO: 204159 - RNA, 22 nt, Homo sapiens
uggaacaccaggcuggcguggc

SEQ ID NO: 204160 - RNA, 20 nt, Homo sapiens
uggaagccuggugcuaucuu

SEQ ID NO: 204161 - RNA, 20 nt, Homo sapiens
uggaaucugaagaucucagu

SEQ ID NO: 204162 - RNA, 22 nt, Homo sapiens
uggaauuaauccuccugguuuc

SEQ ID NO: 204163 - RNA, 21 nt, Homo sapiens
uggaccccuacuucucaccau

SEQ ID NO: 204164 - RNA, 18 nt, Homo sapiens
uggauuggaaaaguuccu

SEQ ID NO: 204165 - RNA, 21 nt, Homo sapiens
uggcaacauggauggauucug

SEQ ID NO: 204166 - RNA, 22 nt, Homo sapiens
uggcaagagcugcauucaucug

SEQ ID NO: 204167 - RNA, 22 nt, Homo sapiens
cucauggagaacaucugcuagg

SEQ ID NO: 204168 - RNA, 19 nt, Homo sapiens
cucauggagaaggagaaua

SEQ ID NO: 204169 - RNA, 22 nt, Homo sapiens
cucauugcaaucucugccuccc

SEQ ID NO: 204170 - RNA, 22 nt, Homo sapiens
cuccaggugagguuaagggacu

SEQ ID NO: 204171 - RNA, 22 nt, Homo sapiens
cucccacccucauuuuuaggca

SEQ ID NO: 204172 - RNA, 22 nt, Homo sapiens
cucucaagaugcugggauuaca

SEQ ID NO: 204173 - RNA, 22 nt, Homo sapiens
cugaauguuuucuucuauucug

SEQ ID NO: 204174 - RNA, 22 nt, Homo sapiens
cugacugugcaugcccagcccc

SEQ ID NO: 204175 - RNA, 22 nt, Homo sapiens
cugagaguugaugaaauauggu

SEQ ID NO: 204176 - RNA, 22 nt, Homo sapiens
cugagaucaagucuugcucugu

SEQ ID NO: 204177 - RNA, 22 nt, Homo sapiens
cugcagucaucugaagauuuug

SEQ ID NO: 204178 - RNA, 22 nt, Homo sapiens
cuggcacagugucagaaacaca

SEQ ID NO: 204179 - RNA, 22 nt, Homo sapiens
cuggcucugagguguuuagggc

SEQ ID NO: 204180 - RNA, 22 nt, Homo sapiens
cuggcucuguuagaagaaccag

SEQ ID NO: 204181 - RNA, 19 nt, Homo sapiens
cugucacugaggaagacug

SEQ ID NO: 204182 - RNA, 22 nt, Homo sapiens
cugucucagugaauugguuuua

SEQ ID NO: 204183 - RNA, 18 nt, Homo sapiens
cuuaacauugggaugaua

SEQ ID NO: 204184 - RNA, 22 nt, Homo sapiens
cuugcacuguuguaagggacuu

SEQ ID NO: 204185 - RNA, 22 nt, Homo sapiens
cuugcacuugaaauuccaguuu

SEQ ID NO: 204186 - RNA, 22 nt, Homo sapiens
cuuuguggggucuuuccucaaa

SEQ ID NO: 204187 - RNA, 22 nt, Homo sapiens
cuuuuguggaucuucuguugcu

SEQ ID NO: 204188 - RNA, 22 nt, Homo sapiens
gaaaguaauuaacgauuguugc

SEQ ID NO: 204189 - RNA, 22 nt, Homo sapiens
gaaugcaugaggggaucagaug

SEQ ID NO: 204190 - RNA, 22 nt, Homo sapiens
gacauguuuacaguguugagag

SEQ ID NO: 204191 - RNA, 22 nt, Homo sapiens
gacauguuucucucuguuuacu

SEQ ID NO: 204192 - RNA, 22 nt, Homo sapiens
gagaaugaacagacugccucuu

SEQ ID NO: 204193 - RNA, 22 nt, Homo sapiens
gagacggagucucgcucugucg

SEQ ID NO: 204194 - RNA, 22 nt, Homo sapiens
gagacggagucuugcucuguug

SEQ ID NO: 204195 - RNA, 22 nt, Homo sapiens
gagacugagucuugcucugucg

SEQ ID NO: 204196 - RNA, 22 nt, Homo sapiens
gagagguaguuuuuuggucguc

SEQ ID NO: 204197 - RNA, 22 nt, Homo sapiens
gagauggugugcuguuggaagu

SEQ ID NO: 204198 - RNA, 22 nt, Homo sapiens
gagcucauuaaaguaggaccua

SEQ ID NO: 204199 - RNA, 20 nt, Homo sapiens
gagcugguguacugccgggc

SEQ ID NO: 204200 - RNA, 22 nt, Homo sapiens
gaggcaguguguccguucucgg

SEQ ID NO: 204201 - RNA, 22 nt, Homo sapiens
gagggcacugcuuuccuuucaa

SEQ ID NO: 204202 - RNA, 22 nt, Homo sapiens
gaggguguuguguugcuuaaua

SEQ ID NO: 204203 - RNA, 22 nt, Homo sapiens
gagguagaauguuuuucagcug

SEQ ID NO: 204204 - RNA, 22 nt, Homo sapiens
gagugcuguuagcccuggguuu

SEQ ID NO: 204205 - RNA, 23 nt, Homo sapiens
gaguggagacucauugauuuccu

SEQ ID NO: 204206 - RNA, 22 nt, Homo sapiens
gauauguaguaguugaaaaaga

SEQ ID NO: 204207 - RNA, 22 nt, Homo sapiens
gaucacauggccauuucuagcu

SEQ ID NO: 204208 - RNA, 22 nt, Homo sapiens
gaugagguaggccugcuuugaa

SEQ ID NO: 204209 - RNA, 22 nt, Homo sapiens
gauuccauuuguggcuauuuac

SEQ ID NO: 204210 - RNA, 20 nt, Homo sapiens
gcaaauggaucccacaagcc

SEQ ID NO: 204211 - RNA, 22 nt, Homo sapiens
gcaagaaucugggaguaaaauu

SEQ ID NO: 204212 - RNA, 22 nt, Homo sapiens
gcaagacaugucuaagguuuaa

SEQ ID NO: 204213 - RNA, 19 nt, Homo sapiens
gcaguauugaaggccaguc

SEQ ID NO: 204214 - RNA, 22 nt, Homo sapiens
gcaguguucaaaucaugcccau

SEQ ID NO: 204215 - RNA, 19 nt, Homo sapiens
gcucaccuugcugcuccag

SEQ ID NO: 204216 - RNA, 22 nt, Homo sapiens
gcuccauuuuccauuucucuaa

SEQ ID NO: 204217 - RNA, 22 nt, Homo sapiens
gcuggaauuaacauagaugugc

SEQ ID NO: 204218 - RNA, 22 nt, Homo sapiens
gcuggguucagagugggcugcg

SEQ ID NO: 204219 - RNA, 22 nt, Homo sapiens
gcuguugguaaaaaggacauga

SEQ ID NO: 204220 - RNA, 22 nt, Homo sapiens
ggaaagacaccuuacuauguua

SEQ ID NO: 204221 - RNA, 22 nt, Homo sapiens
ggaaagacuauuguaaaggaug

SEQ ID NO: 204222 - RNA, 22 nt, Homo sapiens
ggaagccuggaaaaaauuguga

SEQ ID NO: 204223 - RNA, 22 nt, Homo sapiens
ggagugcuguuguuacacaagg

SEQ ID NO: 204224 - RNA, 22 nt, Homo sapiens
ggcaagaucuuggcucacugaa

SEQ ID NO: 204225 - RNA, 22 nt, Homo sapiens
ggcaguuucucaggcaggggua

SEQ ID NO: 204226 - RNA, 22 nt, Homo sapiens
ggcaguuuggcaguuucauaaa

SEQ ID NO: 204227 - RNA, 23 nt, Homo sapiens
ggcauuguggcucacaucuguaa

SEQ ID NO: 204228 - RNA, 22 nt, Homo sapiens
ggccggguggccauggcugccc

SEQ ID NO: 204229 - RNA, 22 nt, Homo sapiens
gggaagguaaucauuacuugau

SEQ ID NO: 204230 - RNA, 22 nt, Homo sapiens
ggucagauggcagcugggccug

SEQ ID NO: 204231 - RNA, 22 nt, Homo sapiens
ggucaguguuaucaccgaagga

SEQ ID NO: 204232 - RNA, 20 nt, Homo sapiens
ugcugcacuuaagcaugggc

SEQ ID NO: 204233 - RNA, 22 nt, Homo sapiens
ugcugcacuuauggcucugagg

SEQ ID NO: 204234 - RNA, 22 nt, Homo sapiens
ugcuggugauucagauucaaau

SEQ ID NO: 204235 - RNA, 22 nt, Homo sapiens
ugcuugagacacauaugaauuu

SEQ ID NO: 204236 - RNA, 22 nt, Homo sapiens
uggaaaguacuugaguuuguau

SEQ ID NO: 204237 - RNA, 21 nt, Homo sapiens
uggaacgcaaaugagaugaau

SEQ ID NO: 204238 - RNA, 22 nt, Homo sapiens
uggaaguuaaaugacucuuucu

SEQ ID NO: 204239 - RNA, 22 nt, Homo sapiens
uggaaguuaaauuaguugauga

SEQ ID NO: 204240 - RNA, 19 nt, Homo sapiens
uggaauggauuuaaaugug

SEQ ID NO: 204241 - RNA, 22 nt, Homo sapiens
uggacagacaagguuauagauc

SEQ ID NO: 204242 - RNA, 22 nt, Homo sapiens
uggacaugaagggcacaggagg

SEQ ID NO: 204243 - RNA, 22 nt, Homo sapiens
uggacuguaauagagaacagaa

SEQ ID NO: 204244 - RNA, 22 nt, Homo sapiens
uggagacaaagauagaaaagca

SEQ ID NO: 204245 - RNA, 22 nt, Homo sapiens
uggagcccuaaacuucuaauau

SEQ ID NO: 204246 - RNA, 22 nt, Homo sapiens
uggagcccuaguuccucauaac

SEQ ID NO: 204247 - RNA, 22 nt, Homo sapiens
uggaggacugcagaacugaggc

SEQ ID NO: 204248 - RNA, 19 nt, Homo sapiens
uggagucaucaugcugcua

SEQ ID NO: 204249 - RNA, 22 nt, Homo sapiens
uggagugucaguuuccagaguu

SEQ ID NO: 204250 - RNA, 22 nt, Homo sapiens
uggauaguaauaaacauauagg

SEQ ID NO: 204251 - RNA, 22 nt, Homo sapiens
uggauugaaagcuuuaauauug

SEQ ID NO: 204252 - RNA, 22 nt, Homo sapiens
uggauuuuaauuauucugucau

SEQ ID NO: 204253 - RNA, 22 nt, Homo sapiens
uggcauuuuguuuuagaauuag

SEQ ID NO: 204254 - RNA, 23 nt, Homo sapiens
uggcauuuuuggcaaugccuucu

SEQ ID NO: 204255 - RNA, 22 nt, Homo sapiens
ugggagcauugcauuagaagcc

SEQ ID NO: 204256 - RNA, 22 nt, Homo sapiens
uggggcuuuuucuuguauucuc

SEQ ID NO: 204257 - RNA, 22 nt, Homo sapiens
uggucagaaaauuacuugauau

SEQ ID NO: 204258 - RNA, 19 nt, Homo sapiens
uggucaguucugggagcug

SEQ ID NO: 204259 - RNA, 21 nt, Homo sapiens
uggucaguuuucucacuagga

SEQ ID NO: 204260 - RNA, 20 nt, Homo sapiens
ugguccccaccaaaucucau

SEQ ID NO: 204261 - RNA, 22 nt, Homo sapiens
uguacaugggacaggaggagag

SEQ ID NO: 204262 - RNA, 22 nt, Homo sapiens
uguauguugggucaaaguacau

SEQ ID NO: 204263 - RNA, 22 nt, Homo sapiens
ugucacaguuuguacuuuauag

SEQ ID NO: 204264 - RNA, 22 nt, Homo sapiens
ugucaugguguuaauuuuccug

SEQ ID NO: 204265 - RNA, 22 nt, Homo sapiens
ugucauguugguguacugcacc

SEQ ID NO: 204266 - RNA, 22 nt, Homo sapiens
ugucuuugguucaggcaaggag

SEQ ID NO: 204267 - RNA, 22 nt, Homo sapiens
ugucuuuguuaguuguccuagu

SEQ ID NO: 204268 - RNA, 22 nt, Homo sapiens
ugugaacauuuuguauauauua

SEQ ID NO: 204269 - RNA, 19 nt, Homo sapiens
ugugaagaaaugcugcaag

SEQ ID NO: 204270 - RNA, 22 nt, Homo sapiens
ugugacucuggcacauggugag

SEQ ID NO: 204271 - RNA, 19 nt, Homo sapiens
ugugagcauuagcauuuag

SEQ ID NO: 204272 - RNA, 17 nt, Homo sapiens
ugugaucaucacccuug

SEQ ID NO: 204273 - RNA, 22 nt, Homo sapiens
ugugcaaaaguaauugcgguuu

SEQ ID NO: 204274 - RNA, 22 nt, Homo sapiens
ugugcacaacgugcagguuugu

SEQ ID NO: 204275 - RNA, 22 nt, Homo sapiens
ugugcacauugugcagguugau

SEQ ID NO: 204276 - RNA, 22 nt, Homo sapiens
ugugcuugaaauucaguuuuga

SEQ ID NO: 204277 - RNA, 22 nt, Homo sapiens
ugugguuuuuuucuccaauagg

SEQ ID NO: 204278 - RNA, 22 nt, Homo sapiens
uguuacagugacuaauguuuua

SEQ ID NO: 204279 - RNA, 22 nt, Homo sapiens
uguucauggauccaguggcuuc

SEQ ID NO: 204280 - RNA, 22 nt, Homo sapiens
uguucuggagaguuuagucugg

SEQ ID NO: 204281 - RNA, 22 nt, Homo sapiens
uguuucuacugucucuguagua

SEQ ID NO: 204282 - RNA, 22 nt, Homo sapiens
uguuuuggaggccagaagucca

SEQ ID NO: 204283 - RNA, 22 nt, Homo sapiens
uguuuuggagguccucacuaga

SEQ ID NO: 204284 - RNA, 22 nt, Homo sapiens
uuaaaugucuguagaugugcug

SEQ ID NO: 204285 - RNA, 22 nt, Homo sapiens
uuaacacugccauugauacugu

SEQ ID NO: 204286 - RNA, 22 nt, Homo sapiens
uuaacagcacaugcugucccuu

SEQ ID NO: 204287 - RNA, 22 nt, Homo sapiens
uuaacagcacuacguggggauc

SEQ ID NO: 204288 - RNA, 22 nt, Homo sapiens
uuaauagugacucauuuuccac

SEQ ID NO: 204289 - RNA, 22 nt, Homo sapiens
uuaaugacaucauaggugaagu

SEQ ID NO: 204290 - RNA, 22 nt, Homo sapiens
uuacagucaaguuacauuucuc

SEQ ID NO: 204291 - RNA, 22 nt, Homo sapiens
uuacaguggugaccuuguauug

SEQ ID NO: 204292 - RNA, 22 nt, Homo sapiens
uuacaucaucacauuaguuugc

SEQ ID NO: 204293 - RNA, 22 nt, Homo sapiens
uuacauguuguggguuguggcc

SEQ ID NO: 204294 - RNA, 22 nt, Homo sapiens
uuacauugcuucaaauucagug

SEQ ID NO: 204295 - RNA, 22 nt, Homo sapiens
uuagaacuagaggaguuugagu

SEQ ID NO: 204296 - RNA, 22 nt, Homo sapiens
uuauggcuauugaugacaauug

SEQ ID NO: 204297 - RNA, 22 nt, Homo sapiens
uuaugucuuugagcaaugcugu

SEQ ID NO: 204298 - RNA, 22 nt, Homo sapiens
uucaaaguaaaaauguguucac

SEQ ID NO: 204299 - RNA, 22 nt, Homo sapiens
uucaacugcuucagccucccaa

SEQ ID NO: 204300 - RNA, 22 nt, Homo sapiens
uucacagagagaacucaaacca

SEQ ID NO: 204301 - RNA, 22 nt, Homo sapiens
uucacaguacucccuggaauua

SEQ ID NO: 204302 - RNA, 22 nt, Homo sapiens
uucacagucacccuucuccaug

SEQ ID NO: 204303 - RNA, 22 nt, Homo sapiens
uucacugcacuccagccugagc

SEQ ID NO: 204304 - RNA, 19 nt, Homo sapiens
uucagcagugucugcucuu

SEQ ID NO: 204305 - RNA, 22 nt, Homo sapiens
uucauggaugcauuugaggggu

SEQ ID NO: 204306 - RNA, 22 nt, Homo sapiens
uucauugaaugauuuuuagaag

SEQ ID NO: 204307 - RNA, 21 nt, Homo sapiens
uuccagugagccuagaugccu

SEQ ID NO: 204308 - RNA, 22 nt, Homo sapiens
uuccauuuguucggugucgcca

SEQ ID NO: 204309 - RNA, 22 nt, Homo sapiens
uucccaguaaacucuaucccuc

SEQ ID NO: 204310 - RNA, 22 nt, Homo sapiens
uucccagugccaggcacuggga

SEQ ID NO: 204311 - RNA, 22 nt, Homo sapiens
uuccuacugcccauuaaaaugg

SEQ ID NO: 204312 - RNA, 22 nt, Homo sapiens
uuccuacuguucaucaggaacc

SEQ ID NO: 204313 - RNA, 22 nt, Homo sapiens
uucuaaguaagucuguggggaa

SEQ ID NO: 204314 - RNA, 20 nt, Homo sapiens
uucuaguacuucuguuucca

SEQ ID NO: 204315 - RNA, 22 nt, Homo sapiens
uucuccugguggacccuaaacg

SEQ ID NO: 204316 - RNA, 22 nt, Homo sapiens
uucucugggacauaggucgggu

SEQ ID NO: 204317 - RNA, 19 nt, Homo sapiens
uucucugguuguacuaccc

SEQ ID NO: 204318 - RNA, 22 nt, Homo sapiens
uucugcacaucgaucacaagau

SEQ ID NO: 204319 - RNA, 22 nt, Homo sapiens
gugcacaaucgugcauuccuug

SEQ ID NO: 204320 - RNA, 22 nt, Homo sapiens
gugcacuguagaacccuuuguu

SEQ ID NO: 204321 - RNA, 22 nt, Homo sapiens
guggcaugaaagcaucugugau

SEQ ID NO: 204322 - RNA, 22 nt, Homo sapiens
guggcauuucccaaaguauucu

SEQ ID NO: 204323 - RNA, 18 nt, Homo sapiens
gugucugguuaugggagu

SEQ ID NO: 204324 - RNA, 22 nt, Homo sapiens
gugugucuugaccaggaucgga

SEQ ID NO: 204325 - RNA, 22 nt, Homo sapiens
guguucauggaauuugcaauug

SEQ ID NO: 204326 - RNA, 22 nt, Homo sapiens
uaaaguucuuuuaugggccggg

SEQ ID NO: 204327 - RNA, 22 nt, Homo sapiens
uaacuacuucugcuucagagua

SEQ ID NO: 204328 - RNA, 22 nt, Homo sapiens
uaagagagcuccaucuuuuccu

SEQ ID NO: 204329 - RNA, 22 nt, Homo sapiens
uaaggcaaucagucaugguguu

SEQ ID NO: 204330 - RNA, 22 nt, Homo sapiens
uacauacuucacagacuuuaaa

SEQ ID NO: 204331 - RNA, 22 nt, Homo sapiens
uaccaguaaugguucuagagga

SEQ ID NO: 204332 - RNA, 22 nt, Homo sapiens
uacucugcaguaauuccagccc

SEQ ID NO: 204333 - RNA, 20 nt, Homo sapiens
uagacagcuagauuagauag

SEQ ID NO: 204334 - RNA, 22 nt, Homo sapiens
uagagagcuguuugaaagcagg

SEQ ID NO: 204335 - RNA, 22 nt, Homo sapiens
uagagguagguguaugaacuag

SEQ ID NO: 204336 - RNA, 22 nt, Homo sapiens
uagagguauguauaguauucuu

SEQ ID NO: 204337 - RNA, 23 nt, Homo sapiens
uagaucaucaaguuuacugugcu

SEQ ID NO: 204338 - RNA, 19 nt, Homo sapiens
uagcacagggucccagacu

SEQ ID NO: 204339 - RNA, 22 nt, Homo sapiens
uagcacaucuucuuggccugca

SEQ ID NO: 204340 - RNA, 22 nt, Homo sapiens
uaggcaaaugcaagaguagaac

SEQ ID NO: 204341 - RNA, 21 nt, Homo sapiens
uagugcugaggcaguauggga

SEQ ID NO: 204342 - RNA, 22 nt, Homo sapiens
uaguguuuuucauuggcagagg

SEQ ID NO: 204343 - RNA, 22 nt, Homo sapiens
uauaacaaugcaagaauggccu

SEQ ID NO: 204344 - RNA, 20 nt, Homo sapiens
uauaacaguuuggacccagu

SEQ ID NO: 204345 - RNA, 22 nt, Homo sapiens
uauacuguuuucuauaguggcu

SEQ ID NO: 204346 - RNA, 22 nt, Homo sapiens
uauagcuuaaaguuuagauccu

SEQ ID NO: 204347 - RNA, 22 nt, Homo sapiens
uaucacaggucaggaaucuugc

SEQ ID NO: 204348 - RNA, 19 nt, Homo sapiens
uaucacuucccuggaaaca

SEQ ID NO: 204349 - RNA, 21 nt, Homo sapiens
uaucagagacauugagaggca

SEQ ID NO: 204350 - RNA, 22 nt, Homo sapiens
uaugaauuuuauccaggauaua

SEQ ID NO: 204351 - RNA, 22 nt, Homo sapiens
uaugacuguuugcucauucagg

SEQ ID NO: 204352 - RNA, 21 nt, Homo sapiens
uaugguuucuaauucugcagg

SEQ ID NO: 204353 - RNA, 22 nt, Homo sapiens
uauuacagaccauaucgccggg

SEQ ID NO: 204354 - RNA, 22 nt, Homo sapiens
uauuacauccauaggcucugcu

SEQ ID NO: 204355 - RNA, 22 nt, Homo sapiens
uauuacugucaauaucacagaa

SEQ ID NO: 204356 - RNA, 22 nt, Homo sapiens
uauuacuugucugugucucaau

SEQ ID NO: 204357 - RNA, 22 nt, Homo sapiens
uauuccacaauaugauuuuuaa

SEQ ID NO: 204358 - RNA, 22 nt, Homo sapiens
uauugcaauuggggaaacuggg

SEQ ID NO: 204359 - RNA, 22 nt, Homo sapiens
uauuuguccccuccaaaaguca

SEQ ID NO: 204360 - RNA, 22 nt, Homo sapiens
ucaaaugauucuccugccucag

SEQ ID NO: 204361 - RNA, 22 nt, Homo sapiens
ucaacagugggcacuguaaaug

SEQ ID NO: 204362 - RNA, 22 nt, Homo sapiens
ucaagcaauucugcugccucag

SEQ ID NO: 204363 - RNA, 22 nt, Homo sapiens
ucaauguaucuccaagaauuga

SEQ ID NO: 204364 - RNA, 22 nt, Homo sapiens
ucacagaugcuugacccauuuc

SEQ ID NO: 204365 - RNA, 22 nt, Homo sapiens
ucacaguaaauccagaagaaau

SEQ ID NO: 204366 - RNA, 22 nt, Homo sapiens
ucacaguagcaaauguuagaaa

SEQ ID NO: 204367 - RNA, 22 nt, Homo sapiens
ucaccaguaauaaagagccugc

SEQ ID NO: 204368 - RNA, 20 nt, Homo sapiens
ucacccugacaucugcccag

SEQ ID NO: 204369 - RNA, 22 nt, Homo sapiens
ucacugaaaccuccaccucucg

SEQ ID NO: 204370 - RNA, 22 nt, Homo sapiens
ucacugaaacuguccuggguua

SEQ ID NO: 204371 - RNA, 22 nt, Homo sapiens
ucagagcaaagacacuuuauca

SEQ ID NO: 204372 - RNA, 22 nt, Homo sapiens
ucagauacuggugacaugaaug

SEQ ID NO: 204373 - RNA, 22 nt, Homo sapiens
ucagcaaugaccuaagcaaaua

SEQ ID NO: 204374 - RNA, 22 nt, Homo sapiens
ucaggcaugcagcaaugcagug

SEQ ID NO: 204375 - RNA, 22 nt, Homo sapiens
ucaggugcaguggcucugaccu

SEQ ID NO: 204376 - RNA, 22 nt, Homo sapiens
ucaggugccuuggcuaauuguu

SEQ ID NO: 204377 - RNA, 23 nt, Homo sapiens
ucagugaaggaacaacuaaauag

SEQ ID NO: 204378 - RNA, 22 nt, Homo sapiens
ucagugccucaguuuuuaaaga

SEQ ID NO: 204379 - RNA, 22 nt, Homo sapiens
ucaguuaaugcugccugcugga

SEQ ID NO: 204380 - RNA, 22 nt, Homo sapiens
ucaguuuagguguaacggccac

SEQ ID NO: 204381 - RNA, 22 nt, Homo sapiens
ucauacuguugugaaacaaaac

SEQ ID NO: 204382 - RNA, 22 nt, Homo sapiens
ucauggggugcuuugcuagauu

SEQ ID NO: 204383 - RNA, 22 nt, Homo sapiens
ucaugguuuuauaacccucuug

SEQ ID NO: 204384 - RNA, 22 nt, Homo sapiens
ucauguguugcacugaggaccu

SEQ ID NO: 204385 - RNA, 22 nt, Homo sapiens
ucauugcacucccagacacccu

SEQ ID NO: 204386 - RNA, 22 nt, Homo sapiens
uccacaguaaggacccugccuu

SEQ ID NO: 204387 - RNA, 22 nt, Homo sapiens
uccaguggacagacauaccaug

SEQ ID NO: 204388 - RNA, 22 nt, Homo sapiens
ucccaguggucuugaaacaggg

SEQ ID NO: 204389 - RNA, 22 nt, Homo sapiens
uccccgagcccaggcugugacu

SEQ ID NO: 204390 - RNA, 22 nt, Homo sapiens
uccccugagaacuugcuagaaa

SEQ ID NO: 204391 - RNA, 22 nt, Homo sapiens
ucccugacagucacagagcuac

SEQ ID NO: 204392 - RNA, 22 nt, Homo sapiens
ucccuguguuccuuuugaauug

SEQ ID NO: 204393 - RNA, 19 nt, Homo sapiens
ucccuuuguauggacauac

SEQ ID NO: 204394 - RNA, 22 nt, Homo sapiens
uccugagaauagaguugcaugu

SEQ ID NO: 204395 - RNA, 22 nt, Homo sapiens
uccuugguugauccugugcaga

SEQ ID NO: 204396 - RNA, 22 nt, Homo sapiens
uccuuuggguagcuguucagau

SEQ ID NO: 204397 - RNA, 22 nt, Homo sapiens
uccuuuggucaguauucuuuug

SEQ ID NO: 204398 - RNA, 22 nt, Homo sapiens
uccuuugguucuugucacccca

SEQ ID NO: 204399 - RNA, 22 nt, Homo sapiens
ucgcagcucacuggagccucga

SEQ ID NO: 204400 - RNA, 17 nt, Homo sapiens
ucuaauaauaugcauuu

SEQ ID NO: 204401 - RNA, 22 nt, Homo sapiens
ucuauggaguuugaaugagaaa

SEQ ID NO: 204402 - RNA, 20 nt, Homo sapiens
ucucccaaacagcaggcccu

SEQ ID NO: 204403 - RNA, 22 nt, Homo sapiens
ucucccauccaugaacuucugu

SEQ ID NO: 204404 - RNA, 22 nt, Homo sapiens
ucucccauccguacacggauug

SEQ ID NO: 204405 - RNA, 22 nt, Homo sapiens
ucucugagaccacuccaaacuc

SEQ ID NO: 204406 - RNA, 19 nt, Homo sapiens
ucucugguguuggagggga

SEQ ID NO: 204407 - RNA, 22 nt, Homo sapiens
ucuggaauguaaaguuuauggg

SEQ ID NO: 204408 - RNA, 21 nt, Homo sapiens
ucuggccccuccaaaucucau

SEQ ID NO: 204409 - RNA, 20 nt, Homo sapiens
ucuggccccucuaaaucuca

SEQ ID NO: 204410 - RNA, 22 nt, Homo sapiens
ucuggcuccacacuuuauuaac

SEQ ID NO: 204411 - RNA, 22 nt, Homo sapiens
ucugugcauggcagaggaauga

SEQ ID NO: 204412 - RNA, 22 nt, Homo sapiens
ucuuaguuggaaugggauaagg

SEQ ID NO: 204413 - RNA, 22 nt, Homo sapiens
ucuuaguuugggguggggauag

SEQ ID NO: 204414 - RNA, 22 nt, Homo sapiens
ucuugcacacaguaaguguuuu

SEQ ID NO: 204415 - RNA, 22 nt, Homo sapiens
ucuugcuuguuguucccuucau

SEQ ID NO: 204416 - RNA, 22 nt, Homo sapiens
ucuuuaguaauuucuguaaggc

SEQ ID NO: 204417 - RNA, 22 nt, Homo sapiens
ucuuugggauauucugaaaggg

SEQ ID NO: 204418 - RNA, 22 nt, Homo sapiens
ucuuuggguagauauguagcug

SEQ ID NO: 204419 - RNA, 22 nt, Homo sapiens
ucuuuggguguauuucacagcc

SEQ ID NO: 204420 - RNA, 22 nt, Homo sapiens
ucuuuguguucaggagccacgu

SEQ ID NO: 204421 - RNA, 22 nt, Homo sapiens
ugaaaguuauauugugaaauuc

SEQ ID NO: 204422 - RNA, 22 nt, Homo sapiens
ugaaaugauuauaugguguuug

SEQ ID NO: 204423 - RNA, 21 nt, Homo sapiens
ugaacacuggacugagugucc

SEQ ID NO: 204424 - RNA, 22 nt, Homo sapiens
ugaaguaauguuuuauucuauu

SEQ ID NO: 204425 - RNA, 22 nt, Homo sapiens
ugaaugguaaagaaaagcacug

SEQ ID NO: 204426 - RNA, 22 nt, Homo sapiens
ugaaugguuuuuagagaacaau

SEQ ID NO: 204427 - RNA, 22 nt, Homo sapiens
ugacagaggucuuuuaauagcu

SEQ ID NO: 204428 - RNA, 19 nt, Homo sapiens
ugacaugaaacccaagauc

SEQ ID NO: 204429 - RNA, 21 nt, Homo sapiens
ugacauuauuucaugucagua

SEQ ID NO: 204430 - RNA, 22 nt, Homo sapiens
ugacucaguuucucagguagua

SEQ ID NO: 204431 - RNA, 22 nt, Homo sapiens
ugagaacuaaaaugugguauau

SEQ ID NO: 204432 - RNA, 22 nt, Homo sapiens
ugagaacuaaugaagaauuuau

SEQ ID NO: 204433 - RNA, 22 nt, Homo sapiens
ugagaacugcagggagcugcau

SEQ ID NO: 204434 - RNA, 22 nt, Homo sapiens
ugagaacugguagcacuuguga

SEQ ID NO: 204435 - RNA, 22 nt, Homo sapiens
ugagaacuguuuugguuugggu

SEQ ID NO: 204436 - RNA, 22 nt, Homo sapiens
ugagaacuuugucuuuuacucu

SEQ ID NO: 204437 - RNA, 22 nt, Homo sapiens
ugagacaucucuccugagacag

SEQ ID NO: 204438 - RNA, 22 nt, Homo sapiens
ugagacgucuucucuucuucaa

SEQ ID NO: 204439 - RNA, 22 nt, Homo sapiens
ugagagucauacaaauaaaaau

SEQ ID NO: 204440 - RNA, 22 nt, Homo sapiens
ugagauaggaucuugcucuguu

SEQ ID NO: 204441 - RNA, 22 nt, Homo sapiens
ugagaugaagcuagaagaaugg

SEQ ID NO: 204442 - RNA, 22 nt, Homo sapiens
ugagaugagucucgcucuguca

SEQ ID NO: 204443 - RNA, 21 nt, Homo sapiens
ugagaugauccugcaugcaug

SEQ ID NO: 204444 - RNA, 22 nt, Homo sapiens
ugagaugaugggauaagagggc

SEQ ID NO: 204445 - RNA, 22 nt, Homo sapiens
ugagaugcauauucuggcuccu

SEQ ID NO: 204446 - RNA, 22 nt, Homo sapiens
ugagauguuuguuucagugccu

SEQ ID NO: 204447 - RNA, 19 nt, Homo sapiens
ugagauuguaugaggagau

SEQ ID NO: 204448 - RNA, 22 nt, Homo sapiens
ugagggcguauccuucauuaag

SEQ ID NO: 204449 - RNA, 22 nt, Homo sapiens
ugauaagaaauuguucauguag

SEQ ID NO: 204450 - RNA, 22 nt, Homo sapiens
ugauauguggauucagcucaaa

SEQ ID NO: 204451 - RNA, 22 nt, Homo sapiens
ugaugcugaguggcuauuugaa

SEQ ID NO: 204452 - RNA, 22 nt, Homo sapiens
ugcaaaugcugcuauuucucuu

SEQ ID NO: 204453 - RNA, 22 nt, Homo sapiens
ugcaaauguuauuuugguuucu

SEQ ID NO: 204454 - RNA, 22 nt, Homo sapiens
ugcaaucaucgcuguuggccac

SEQ ID NO: 204455 - RNA, 22 nt, Homo sapiens
ugcacaguccagugcccacuga

SEQ ID NO: 204456 - RNA, 23 nt, Homo sapiens
ugcaguagugagaucuaggcuca

SEQ ID NO: 204457 - RNA, 20 nt, Homo sapiens
ugcaguguccucacuuguca

SEQ ID NO: 204458 - RNA, 21 nt, Homo sapiens
ugcagugugguugcccugcug

SEQ ID NO: 204459 - RNA, 21 nt, Homo sapiens
ugcauaucucuaaugaccagu

SEQ ID NO: 204460 - RNA, 22 nt, Homo sapiens
ugcauauucgaguuauuuuggg

SEQ ID NO: 204461 - RNA, 22 nt, Homo sapiens
ugcauauucuaggauuuuguau

SEQ ID NO: 204462 - RNA, 22 nt, Homo sapiens
ugcauugcacuugcaugagaua

SEQ ID NO: 204463 - RNA, 21 nt, Homo sapiens
ugcauuguugcugagagcagg

SEQ ID NO: 204464 - RNA, 22 nt, Homo sapiens
ugccaguauuuuauugaggauu

SEQ ID NO: 204465 - RNA, 22 nt, Homo sapiens
ugcuaugucagccaggcugguc

SEQ ID NO: 204466 - RNA, 21 nt, Homo sapiens
ugcuauguuguccaggcuggc

SEQ ID NO: 204467 - RNA, 22 nt, Homo sapiens
agucaguguguauugauggcac

SEQ ID NO: 204468 - RNA, 20 nt, Homo sapiens
agucaguuuauuuucucucu

SEQ ID NO: 204469 - RNA, 19 nt, Homo sapiens
auaaaugccuacaagggug

SEQ ID NO: 204470 - RNA, 22 nt, Homo sapiens
auaacauggaguuugucauuua

SEQ ID NO: 204471 - RNA, 19 nt, Homo sapiens
auacacguguauacauaca

SEQ ID NO: 204472 - RNA, 22 nt, Homo sapiens
auacaguaucuucuggcaagca

SEQ ID NO: 204473 - RNA, 20 nt, Homo sapiens
auagcagcaugauuuauaau

SEQ ID NO: 204474 - RNA, 20 nt, Homo sapiens
auaugcauguguuuucacuu

SEQ ID NO: 204475 - RNA, 22 nt, Homo sapiens
auauggcauucagaacuguaua

SEQ ID NO: 204476 - RNA, 22 nt, Homo sapiens
auauucacagguaucagagauu

SEQ ID NO: 204477 - RNA, 22 nt, Homo sapiens
aucacagaacuuugagcagaga

SEQ ID NO: 204478 - RNA, 22 nt, Homo sapiens
aucacagugaaaacagucaauu

SEQ ID NO: 204479 - RNA, 22 nt, Homo sapiens
aucacagugagcauaugucuau

SEQ ID NO: 204480 - RNA, 22 nt, Homo sapiens
aucacaguuaagaggugaugaa

SEQ ID NO: 204481 - RNA, 22 nt, Homo sapiens
aucacaguuauaacauccuuuu

SEQ ID NO: 204482 - RNA, 22 nt, Homo sapiens
aucacauuuauaguggcacgca

SEQ ID NO: 204483 - RNA, 22 nt, Homo sapiens
aucugguguauuggugcugggu

SEQ ID NO: 204484 - RNA, 20 nt, Homo sapiens
augaagugaaguuagggaac

SEQ ID NO: 204485 - RNA, 23 nt, Homo sapiens
augaauguaaggaguguaagaaa

SEQ ID NO: 204486 - RNA, 22 nt, Homo sapiens
augagauuauguaaagagacca

SEQ ID NO: 204487 - RNA, 22 nt, Homo sapiens
augagguguuuauuguauccug

SEQ ID NO: 204488 - RNA, 22 nt, Homo sapiens
augauggaggccgugauggacg

SEQ ID NO: 204489 - RNA, 22 nt, Homo sapiens
augauuguucucacucaagaga

SEQ ID NO: 204490 - RNA, 22 nt, Homo sapiens
augcaaacaucauagaguguac

SEQ ID NO: 204491 - RNA, 20 nt, Homo sapiens
augcaaacccugcuuugugg

SEQ ID NO: 204492 - RNA, 22 nt, Homo sapiens
augcacaguccagcccaugugg

SEQ ID NO: 204493 - RNA, 22 nt, Homo sapiens
auggaacuggagaucauuaugu

SEQ ID NO: 204494 - RNA, 22 nt, Homo sapiens
auggaguuugaacaauuuccug

SEQ ID NO: 204495 - RNA, 22 nt, Homo sapiens
auggauugucuccuugugccau

SEQ ID NO: 204496 - RNA, 22 nt, Homo sapiens
auggcaauguaagucagaaaaa

SEQ ID NO: 204497 - RNA, 22 nt, Homo sapiens
auggcaguuucagcuauaguuu

SEQ ID NO: 204498 - RNA, 22 nt, Homo sapiens
auggcuuuggucucccagugau

SEQ ID NO: 204499 - RNA, 22 nt, Homo sapiens
auggucuuuucccuggauuaua

SEQ ID NO: 204500 - RNA, 22 nt, Homo sapiens
augucuagagcaagagaugcug

SEQ ID NO: 204501 - RNA, 22 nt, Homo sapiens
augugcuuuuggugagagauuu

SEQ ID NO: 204502 - RNA, 22 nt, Homo sapiens
augugugcuugauguaaaaagu

SEQ ID NO: 204503 - RNA, 22 nt, Homo sapiens
augugugcuugugacacagccu

SEQ ID NO: 204504 - RNA, 22 nt, Homo sapiens
auuaagugcuugcagaagucca

SEQ ID NO: 204505 - RNA, 22 nt, Homo sapiens
auuaagugcuugccagugcugg

SEQ ID NO: 204506 - RNA, 22 nt, Homo sapiens
auucagaggggcagcugucuug

SEQ ID NO: 204507 - RNA, 22 nt, Homo sapiens
auucccuuggucaacggaugca

SEQ ID NO: 204508 - RNA, 22 nt, Homo sapiens
auugacaguuggccaguaagug

SEQ ID NO: 204509 - RNA, 22 nt, Homo sapiens
auugaggcauguaccaaugguc

SEQ ID NO: 204510 - RNA, 22 nt, Homo sapiens
auugcaaugggaaacuaugaaa

SEQ ID NO: 204511 - RNA, 22 nt, Homo sapiens
auugcacacagaaucaggguaa

SEQ ID NO: 204512 - RNA, 22 nt, Homo sapiens
auugcauugugaucuucccaga

SEQ ID NO: 204513 - RNA, 22 nt, Homo sapiens
auuguacauacaccggugugua

SEQ ID NO: 204514 - RNA, 22 nt, Homo sapiens
auuuagcaauggagguagugua

SEQ ID NO: 204515 - RNA, 22 nt, Homo sapiens
caagugaauaguugcucucaga

SEQ ID NO: 204516 - RNA, 22 nt, Homo sapiens
caagugcuuucuuggggauuua

SEQ ID NO: 204517 - RNA, 22 nt, Homo sapiens
cacaggaagaggcacggucccu

SEQ ID NO: 204518 - RNA, 22 nt, Homo sapiens
cacauguuuuagcauggcuguu

SEQ ID NO: 204519 - RNA, 22 nt, Homo sapiens
caccacuacaccccaggcuggg

SEQ ID NO: 204520 - RNA, 22 nt, Homo sapiens
caccaggugcccagcacggcca

SEQ ID NO: 204521 - RNA, 22 nt, Homo sapiens
caccagguuggagugcaguggu

SEQ ID NO: 204522 - RNA, 22 nt, Homo sapiens
caccauguguucagaaggauug

SEQ ID NO: 204523 - RNA, 22 nt, Homo sapiens
caccgagguuggagugcagugg

SEQ ID NO: 204524 - RNA, 22 nt, Homo sapiens
cacugcacuccagucugacgac

SEQ ID NO: 204525 - RNA, 22 nt, Homo sapiens
cacugcauccuccaccuccugg

SEQ ID NO: 204526 - RNA, 22 nt, Homo sapiens
cagagaaugucuuuuuuaacca

SEQ ID NO: 204527 - RNA, 22 nt, Homo sapiens
cagagguaagcaagucagcauu

SEQ ID NO: 204528 - RNA, 22 nt, Homo sapiens
cagauggucuuaaggcagccuu

SEQ ID NO: 204529 - RNA, 22 nt, Homo sapiens
cagaugguggucccacagccca

SEQ ID NO: 204530 - RNA, 22 nt, Homo sapiens
cagcgaggucugcgucacauug

SEQ ID NO: 204531 - RNA, 22 nt, Homo sapiens
cagcuaguaauuuauugaagau

SEQ ID NO: 204532 - RNA, 22 nt, Homo sapiens
cagcuguuguugggguauagga

SEQ ID NO: 204533 - RNA, 22 nt, Homo sapiens
cagucacagugacaggaugugg

SEQ ID NO: 204534 - RNA, 22 nt, Homo sapiens
cauagcacugagcucuacccuc

SEQ ID NO: 204535 - RNA, 22 nt, Homo sapiens
caucagagugagauauaagauc

SEQ ID NO: 204536 - RNA, 22 nt, Homo sapiens
caugcacugaguccaccucugg

SEQ ID NO: 204537 - RNA, 22 nt, Homo sapiens
cuagucacauuuucaucaaaua

SEQ ID NO: 204538 - RNA, 22 nt, Homo sapiens
cuauguaccuggaacuguauua

SEQ ID NO: 204539 - RNA, 21 nt, Homo sapiens
cucaaaguacugauauuacag

SEQ ID NO: 204540 - RNA, 22 nt, Homo sapiens
cucacagucagaagggacuugc

SEQ ID NO: 204541 - RNA, 22 nt, Homo sapiens
cucacaguucuaaaggcaagaa

SEQ ID NO: 204542 - RNA, 22 nt, Homo sapiens
cucaguguuaaggccaccucug

SEQ ID NO: 204543 - RNA, 22 nt, Homo sapiens
cucauggagaaccucugcuagg

SEQ ID NO: 204544 - RNA, 22 nt, Homo sapiens
cucauugcaaucuccaccuccc

SEQ ID NO: 204545 - RNA, 22 nt, Homo sapiens
cuccagugcaaagucaugauca

SEQ ID NO: 204546 - RNA, 22 nt, Homo sapiens
cucccauugcaaacaacagaag

SEQ ID NO: 204547 - RNA, 22 nt, Homo sapiens
cucucuguuugucuguuauugg

SEQ ID NO: 204548 - RNA, 22 nt, Homo sapiens
cugaaagagcauguaacacagu

SEQ ID NO: 204549 - RNA, 22 nt, Homo sapiens
cugaggugggaggauuggcuug

SEQ ID NO: 204550 - RNA, 22 nt, Homo sapiens
cugauuguagagccccagggcu

SEQ ID NO: 204551 - RNA, 22 nt, Homo sapiens
cugcagguaggggcagcuuugg

SEQ ID NO: 204552 - RNA, 22 nt, Homo sapiens
cugcaguaaccacuguaggugu

SEQ ID NO: 204553 - RNA, 22 nt, Homo sapiens
cugccuaaagaaaaagacguug

SEQ ID NO: 204554 - RNA, 20 nt, Homo sapiens
cugcuccccuacaaaucuca

SEQ ID NO: 204555 - RNA, 22 nt, Homo sapiens
cuggaagcacaacgcauuuauu

SEQ ID NO: 204556 - RNA, 22 nt, Homo sapiens
cuggacguugaggcugcaguga

SEQ ID NO: 204557 - RNA, 22 nt, Homo sapiens
cuggaguaugaaccauguauca

SEQ ID NO: 204558 - RNA, 22 nt, Homo sapiens
cugugccaagcuugcgaugugc

SEQ ID NO: 204559 - RNA, 22 nt, Homo sapiens
cugugcuugagagaugacacag

SEQ ID NO: 204560 - RNA, 22 nt, Homo sapiens
cuucuugagggccugcugggaa

SEQ ID NO: 204561 - RNA, 22 nt, Homo sapiens
cuuggcuucuuuauguggcuau

SEQ ID NO: 204562 - RNA, 22 nt, Homo sapiens
cuuuggcauuagccuguauaga

SEQ ID NO: 204563 - RNA, 22 nt, Homo sapiens
cuuuuggucuaucagagaagca

SEQ ID NO: 204564 - RNA, 22 nt, Homo sapiens
cuuuuugcaaauacaacucuga

SEQ ID NO: 204565 - RNA, 22 nt, Homo sapiens
gaagaucacacuguagaucuau

SEQ ID NO: 204566 - RNA, 22 nt, Homo sapiens
gacacuggguguuuguuggcgu

SEQ ID NO: 204567 - RNA, 22 nt, Homo sapiens
gacuggagcuguaugugguuac

SEQ ID NO: 204568 - RNA, 22 nt, Homo sapiens
gagacggagucucgcucuguca

SEQ ID NO: 204569 - RNA, 22 nt, Homo sapiens
gagacugagucuugcccuguca

SEQ ID NO: 204570 - RNA, 22 nt, Homo sapiens
gagagaguacuugauauaauuu

SEQ ID NO: 204571 - RNA, 22 nt, Homo sapiens
gagauggagucuuuuucuguca

SEQ ID NO: 204572 - RNA, 22 nt, Homo sapiens
gagaugguguuccacugccagu

SEQ ID NO: 204573 - RNA, 22 nt, Homo sapiens
gagauguuuguuucacugucac

SEQ ID NO: 204574 - RNA, 22 nt, Homo sapiens
gagcuguuuuucacuagaccaa

SEQ ID NO: 204575 - RNA, 22 nt, Homo sapiens
gaggcauugaaauauugcuuau

SEQ ID NO: 204576 - RNA, 22 nt, Homo sapiens
gaggucauucugugguacccag

SEQ ID NO: 204577 - RNA, 22 nt, Homo sapiens
gagguggugguggaggcauagc

SEQ ID NO: 204578 - RNA, 22 nt, Homo sapiens
gauaacagauaaugucaguuau

SEQ ID NO: 204579 - RNA, 18 nt, Homo sapiens
gauaacaguggacuaugc

SEQ ID NO: 204580 - RNA, 22 nt, Homo sapiens
gaugagguaguguaccuagucu

SEQ ID NO: 204581 - RNA, 22 nt, Homo sapiens
gauggauuuuaagugaaugaaa

SEQ ID NO: 204582 - RNA, 22 nt, Homo sapiens
gauggauuuuuuaggcagagcu

SEQ ID NO: 204583 - RNA, 22 nt, Homo sapiens
gauggcaugugcugccaccaag

SEQ ID NO: 204584 - RNA, 22 nt, Homo sapiens
gcaaaaaguagugcugguuagg

SEQ ID NO: 204585 - RNA, 20 nt, Homo sapiens
gcaaaguuuagcucccacua

SEQ ID NO: 204586 - RNA, 22 nt, Homo sapiens
gcccagauguuuggggucaugg

SEQ ID NO: 204587 - RNA, 22 nt, Homo sapiens
gcccaguagcaguacaucccuu

SEQ ID NO: 204588 - RNA, 22 nt, Homo sapiens
gcccuguugcccaggcuggagu

SEQ ID NO: 204589 - RNA, 22 nt, Homo sapiens
gccuagagaguuaucaggcugu

SEQ ID NO: 204590 - RNA, 22 nt, Homo sapiens
gcugauggugcaguucuagccu

SEQ ID NO: 204591 - RNA, 22 nt, Homo sapiens
gcugcuuuugaugacaaaaaca

SEQ ID NO: 204592 - RNA, 22 nt, Homo sapiens
gcugguguugugaaucaggccg

SEQ ID NO: 204593 - RNA, 22 nt, Homo sapiens
gcuguaguugaggauuuuaaga

SEQ ID NO: 204594 - RNA, 20 nt, Homo sapiens
ggaagagugacacaagguau

SEQ ID NO: 204595 - RNA, 22 nt, Homo sapiens
ggaaggucaaagggaaagcaga

SEQ ID NO: 204596 - RNA, 22 nt, Homo sapiens
ggaauauaaaacuuuugacagg

SEQ ID NO: 204597 - RNA, 22 nt, Homo sapiens
ggaaugagaaauauuacacaau

SEQ ID NO: 204598 - RNA, 22 nt, Homo sapiens
ggacagugaaugccacuccucc

SEQ ID NO: 204599 - RNA, 22 nt, Homo sapiens
ggcaagaggagauucugcuccc

SEQ ID NO: 204600 - RNA, 22 nt, Homo sapiens
ggcaugaaguagcccacaggca

SEQ ID NO: 204601 - RNA, 22 nt, Homo sapiens
ggcuagagagcucagggauaug

SEQ ID NO: 204602 - RNA, 22 nt, Homo sapiens
ggcucagugaucuguuucugua

SEQ ID NO: 204603 - RNA, 21 nt, Homo sapiens
ggcucuguggucucagguuuc

SEQ ID NO: 204604 - RNA, 22 nt, Homo sapiens
gggaacaugagaaugugaauga

SEQ ID NO: 204605 - RNA, 22 nt, Homo sapiens
gggaagaaggagugguuuacuc

SEQ ID NO: 204606 - RNA, 22 nt, Homo sapiens
ggggaguguggacaucacccug

SEQ ID NO: 204607 - RNA, 19 nt, Homo sapiens
gggucaguuugaaugauua

SEQ ID NO: 204608 - RNA, 22 nt, Homo sapiens
gggucaguuuugagaaagcgug

SEQ ID NO: 204609 - RNA, 22 nt, Homo sapiens
gguaaacauacugcugucuucu

SEQ ID NO: 204610 - RNA, 22 nt, Homo sapiens
ggucaacaucaucaugguaagu

SEQ ID NO: 204611 - RNA, 22 nt, Homo sapiens
ggugagauguucagacgaacug

SEQ ID NO: 204612 - RNA, 22 nt, Homo sapiens
gguuagaaacagguccucagga

SEQ ID NO: 204613 - RNA, 22 nt, Homo sapiens
guaacacaugcugcucucuggu

SEQ ID NO: 204614 - RNA, 20 nt, Homo sapiens
guaacagcacuuucccaaag

SEQ ID NO: 204615 - RNA, 22 nt, Homo sapiens
guagagagaaauacaaagcugu

SEQ ID NO: 204616 - RNA, 22 nt, Homo sapiens
guaugaaaaucggagauugggu

SEQ ID NO: 204617 - RNA, 22 nt, Homo sapiens
gucacagaaaaagauaugccaa

SEQ ID NO: 204618 - RNA, 22 nt, Homo sapiens
gucacagaggcuaagaccccac

SEQ ID NO: 204619 - RNA, 22 nt, Homo sapiens
gucacugagcagaaggaagcga

SEQ ID NO: 204620 - RNA, 22 nt, Homo sapiens
gucagaugcagauuccaguucu

SEQ ID NO: 204621 - RNA, 22 nt, Homo sapiens
gucaguuucacucagcuggaac

SEQ ID NO: 204622 - RNA, 22 nt, Homo sapiens
gucaguuugguuaaucauucca

SEQ ID NO: 204623 - RNA, 22 nt, Homo sapiens
gucucccaaccccugugcccag

SEQ ID NO: 204624 - RNA, 22 nt, Homo sapiens
gucucccagccuacaucuuucu

SEQ ID NO: 204625 - RNA, 22 nt, Homo sapiens
uggacagaaacauguuuucagu

SEQ ID NO: 204626 - RNA, 22 nt, Homo sapiens
uggaguaggccuaagaaugaca

SEQ ID NO: 204627 - RNA, 21 nt, Homo sapiens
uggagugcaacacuagguaua

SEQ ID NO: 204628 - RNA, 22 nt, Homo sapiens
uggaguguaaauuaguucagcc

SEQ ID NO: 204629 - RNA, 22 nt, Homo sapiens
uggaguguagcggcaccuauua

SEQ ID NO: 204630 - RNA, 22 nt, Homo sapiens
uuguccuggagguucuugcaag

SEQ ID NO: 204631 - RNA, 22 nt, Homo sapiens
uuguggcuuaucucauuuagcg

SEQ ID NO: 204632 - RNA, 22 nt, Homo sapiens
uuguuauguaucucaagauaaa

SEQ ID NO: 204633 - RNA, 22 nt, Homo sapiens
uuuaaaguuagaaggaaagggc

SEQ ID NO: 204634 - RNA, 22 nt, Homo sapiens
uuuaaguguuuguuccugaaaa

SEQ ID NO: 204635 - RNA, 22 nt, Homo sapiens
uuuauagucaggaacuugagga

SEQ ID NO: 204636 - RNA, 22 nt, Homo sapiens
uuucaccguguuggccaggcug

SEQ ID NO: 204637 - RNA, 22 nt, Homo sapiens
uuucauagccuucuaaugaguu

SEQ ID NO: 204638 - RNA, 22 nt, Homo sapiens
uuuccaguuggaagaaggggga

SEQ ID NO: 204639 - RNA, 22 nt, Homo sapiens
uuuccaguuguucuagaaagcu

SEQ ID NO: 204640 - RNA, 22 nt, Homo sapiens
uuucccuuugcuuugucagcca

SEQ ID NO: 204641 - RNA, 17 nt, Homo sapiens
uuucucagcccucuucu

SEQ ID NO: 204642 - RNA, 22 nt, Homo sapiens
uuugagguguauggcaaguuga

SEQ ID NO: 204643 - RNA, 21 nt, Homo sapiens
uuugaucauuaaaagugaauc

SEQ ID NO: 204644 - RNA, 22 nt, Homo sapiens
uuuggcauuaagaugcuguauc

SEQ ID NO: 204645 - RNA, 22 nt, Homo sapiens
uuuguacacuguugguaggauu

SEQ ID NO: 204646 - RNA, 22 nt, Homo sapiens
uuugugagguggauagauugca

SEQ ID NO: 204647 - RNA, 22 nt, Homo sapiens
uuuguggaaugcucauguguag

SEQ ID NO: 204648 - RNA, 22 nt, Homo sapiens
uuuuacacuucgguugugugca

SEQ ID NO: 204649 - RNA, 19 nt, Homo sapiens
uuuugcucuuuauaccuau

SEQ ID NO: 204650 - RNA, 22 nt, Homo sapiens
uuuuguacaacagcucugggga

SEQ ID NO: 204651 - RNA, 22 nt, Homo sapiens
uuuuuggaggagguuagaucau

SEQ ID NO: 204652 - RNA, 22 nt, Homo sapiens
uggaguguuggggcaggaucuc

SEQ ID NO: 204653 - RNA, 22 nt, Homo sapiens
uggcaagaucacaauuacuuuu

SEQ ID NO: 204654 - RNA, 22 nt, Homo sapiens
uggcaggugcacuggcuuugaa

SEQ ID NO: 204655 - RNA, 22 nt, Homo sapiens
uggcaugauccuagauucaaca

SEQ ID NO: 204656 - RNA, 22 nt, Homo sapiens
uggcauuuucucuguucuuaga

SEQ ID NO: 204657 - RNA, 21 nt, Homo sapiens
uggcuuauuugaaucuggcuu

SEQ ID NO: 204658 - RNA, 22 nt, Homo sapiens
uggcuuuuccuugaaucugccu

SEQ ID NO: 204659 - RNA, 22 nt, Homo sapiens
ugggaagagggagcgauuuugg

SEQ ID NO: 204660 - RNA, 22 nt, Homo sapiens
ugggaugaugcuugagaauauc

SEQ ID NO: 204661 - RNA, 22 nt, Homo sapiens
uggucagaugcugaguggaucu

SEQ ID NO: 204662 - RNA, 22 nt, Homo sapiens
uggucaguugugccucaauucc

SEQ ID NO: 204663 - RNA, 22 nt, Homo sapiens
ugguccccaauacuucuauaga

SEQ ID NO: 204664 - RNA, 19 nt, Homo sapiens
uggucccccgcaaucucau

SEQ ID NO: 204665 - RNA, 22 nt, Homo sapiens
uggugcccuguccuucuguggc

SEQ ID NO: 204666 - RNA, 22 nt, Homo sapiens
uguauagaucugauucaucucc

SEQ ID NO: 204667 - RNA, 22 nt, Homo sapiens
ugucaaugggaauuuguuuuag

SEQ ID NO: 204668 - RNA, 22 nt, Homo sapiens
ugucacccuuuauccauuuccu

SEQ ID NO: 204669 - RNA, 22 nt, Homo sapiens
ugucaguuucuugagauggaac

SEQ ID NO: 204670 - RNA, 22 nt, Homo sapiens
ugucaugaacucacauucuggg

SEQ ID NO: 204671 - RNA, 20 nt, Homo sapiens
ugucuauggggguucucugc

SEQ ID NO: 204672 - RNA, 22 nt, Homo sapiens
ugugaagaaagucauugguagc

SEQ ID NO: 204673 - RNA, 22 nt, Homo sapiens
ugugaagauggacuaauauagu

SEQ ID NO: 204674 - RNA, 22 nt, Homo sapiens
ugugcacaauguacagguuagu

SEQ ID NO: 204675 - RNA, 22 nt, Homo sapiens
ugugcaccucuucacacaggga

SEQ ID NO: 204676 - RNA, 22 nt, Homo sapiens
ugugccacuccaggaggcuguu

SEQ ID NO: 204677 - RNA, 22 nt, Homo sapiens
ugugcgugugccuguaagaauu

SEQ ID NO: 204678 - RNA, 22 nt, Homo sapiens
ugugcuugcuucuucuccuagu

SEQ ID NO: 204679 - RNA, 22 nt, Homo sapiens
uguggcauuuucagaaaggaug

SEQ ID NO: 204680 - RNA, 22 nt, Homo sapiens
uguuacaguguaggccuugggu

SEQ ID NO: 204681 - RNA, 22 nt, Homo sapiens
uguuugcuguguggaguagcag

SEQ ID NO: 204682 - RNA, 22 nt, Homo sapiens
uuaacagugucaaucuguagua

SEQ ID NO: 204683 - RNA, 22 nt, Homo sapiens
uuaagagugggaguuggccaca

SEQ ID NO: 204684 - RNA, 22 nt, Homo sapiens
uuaagugguagguggugcccaa

SEQ ID NO: 204685 - RNA, 22 nt, Homo sapiens
uuacaguugugagccaccaugc

SEQ ID NO: 204686 - RNA, 22 nt, Homo sapiens
uuauaacagagacuccugugcu

SEQ ID NO: 204687 - RNA, 21 nt, Homo sapiens
uuauccagcacuguuucggac

SEQ ID NO: 204688 - RNA, 22 nt, Homo sapiens
uuauggccauucuuguaggagu

SEQ ID NO: 204689 - RNA, 22 nt, Homo sapiens
uucacacugggccuacucugug

SEQ ID NO: 204690 - RNA, 22 nt, Homo sapiens
uucacagugugaucuaugggca

SEQ ID NO: 204691 - RNA, 22 nt, Homo sapiens
uucagauugcauaccgaaagua

SEQ ID NO: 204692 - RNA, 22 nt, Homo sapiens
uucaguggagaggcugaguggu

SEQ ID NO: 204693 - RNA, 22 nt, Homo sapiens
uucaguggguggaugaauauga

SEQ ID NO: 204694 - RNA, 22 nt, Homo sapiens
uucagugucauuaacacaguag

SEQ ID NO: 204695 - RNA, 18 nt, Homo sapiens
uucaucaguccucagcug

SEQ ID NO: 204696 - RNA, 22 nt, Homo sapiens
uucauguaauauuucacagcuu

SEQ ID NO: 204697 - RNA, 22 nt, Homo sapiens
uucccagagagggacuucuaau

SEQ ID NO: 204698 - RNA, 22 nt, Homo sapiens
uucccagagccugggagugagg

SEQ ID NO: 204699 - RNA, 23 nt, Homo sapiens
uucccuuagaagaaggggagaaa

SEQ ID NO: 204700 - RNA, 22 nt, Homo sapiens
uuccuacugugcaaaguugcaa

SEQ ID NO: 204701 - RNA, 22 nt, Homo sapiens
uuccugagaucagaauucaaau

SEQ ID NO: 204702 - RNA, 20 nt, Homo sapiens
uuccuuaggcauuggaagaa

SEQ ID NO: 204703 - RNA, 23 nt, Homo sapiens
uucuaucaggcccaggagcccug

SEQ ID NO: 204704 - RNA, 22 nt, Homo sapiens
uucucaguuccuacuuugguga

SEQ ID NO: 204705 - RNA, 22 nt, Homo sapiens
uucucaguucgguggcagugcu

SEQ ID NO: 204706 - RNA, 22 nt, Homo sapiens
uucugugguugaaaggagagau

SEQ ID NO: 204707 - RNA, 22 nt, Homo sapiens
uucugugguuucauuuaccugu

SEQ ID NO: 204708 - RNA, 20 nt, Homo sapiens
uucuugaguuaacaaguuac

SEQ ID NO: 204709 - RNA, 22 nt, Homo sapiens
uucuuuaguucacuugcuccag

SEQ ID NO: 204710 - RNA, 23 nt, Homo sapiens
uugaaaagucaguagccucugau

SEQ ID NO: 204711 - RNA, 22 nt, Homo sapiens
uugaaagucuaggcuuacagua

SEQ ID NO: 204712 - RNA, 22 nt, Homo sapiens
uugacaguugggcagggaaguu

SEQ ID NO: 204713 - RNA, 22 nt, Homo sapiens
uugagauggagcuucacucuug

SEQ ID NO: 204714 - RNA, 22 nt, Homo sapiens
uugagauggagucucacucugu

SEQ ID NO: 204715 - RNA, 22 nt, Homo sapiens
uugagauggaguuucacucugu

SEQ ID NO: 204716 - RNA, 22 nt, Homo sapiens
uugagauggugccacuguacuc

SEQ ID NO: 204717 - RNA, 22 nt, Homo sapiens
uugagauguaguuucacuccug

SEQ ID NO: 204718 - RNA, 22 nt, Homo sapiens
uugagauguggguuggugacuu

SEQ ID NO: 204719 - RNA, 22 nt, Homo sapiens
uugagcacaguagguuguggcu

SEQ ID NO: 204720 - RNA, 21 nt, Homo sapiens
uugagguaaaauccuauggga

SEQ ID NO: 204721 - RNA, 22 nt, Homo sapiens
uugagguaggaggagcuuggau

SEQ ID NO: 204722 - RNA, 22 nt, Homo sapiens
uugaggugaauuugcaggaugc

SEQ ID NO: 204723 - RNA, 20 nt, Homo sapiens
uugaguauugccagggaggc

SEQ ID NO: 204724 - RNA, 22 nt, Homo sapiens
uugaguuugaguauucuaaagc

SEQ ID NO: 204725 - RNA, 22 nt, Homo sapiens
uugauaguuuuaaaauuaaucu

SEQ ID NO: 204726 - RNA, 22 nt, Homo sapiens
uugcaaaguugccaaggaagga

SEQ ID NO: 204727 - RNA, 21 nt, Homo sapiens
uugcaaaugcugcugccugau

SEQ ID NO: 204728 - RNA, 18 nt, Homo sapiens
uugcaaauucuucccugu

SEQ ID NO: 204729 - RNA, 22 nt, Homo sapiens
uugcacagugguuuagagccug

SEQ ID NO: 204730 - RNA, 22 nt, Homo sapiens
uugcaugucauaacugauggaa

SEQ ID NO: 204731 - RNA, 22 nt, Homo sapiens
uugccuuuguuggaaacaagug

SEQ ID NO: 204732 - RNA, 22 nt, Homo sapiens
uugcuuuguuacugcaguuucc

SEQ ID NO: 204733 - RNA, 22 nt, Homo sapiens
uuggaaggcugaauggccucuc

SEQ ID NO: 204734 - RNA, 23 nt, Homo sapiens
uugacuguggguacaaugugaua

SEQ ID NO: 204735 - RNA, 22 nt, Homo sapiens
uugagaaucuuucgaauguucu

SEQ ID NO: 204736 - RNA, 22 nt, Homo sapiens
uugagacggagucuugcucuuu

SEQ ID NO: 204737 - RNA, 22 nt, Homo sapiens
uugagacggaguuuugcucuug

SEQ ID NO: 204738 - RNA, 22 nt, Homo sapiens
uugagauggagucucacucugc

SEQ ID NO: 204739 - RNA, 22 nt, Homo sapiens
uugagauggaguucauuuuugu

SEQ ID NO: 204740 - RNA, 22 nt, Homo sapiens
uugagggagcauuuguuuugag

SEQ ID NO: 204741 - RNA, 22 nt, Homo sapiens
uugaggucagagguucgagacc

SEQ ID NO: 204742 - RNA, 20 nt, Homo sapiens
uugaggugugaggggcagag

SEQ ID NO: 204743 - RNA, 22 nt, Homo sapiens
uugcacagucuagcuccaccuu

SEQ ID NO: 204744 - RNA, 22 nt, Homo sapiens
uugcacagugcuuucuuugccc

SEQ ID NO: 204745 - RNA, 22 nt, Homo sapiens
uugcacuugcugaggagugauu

SEQ ID NO: 204746 - RNA, 22 nt, Homo sapiens
uugcuucauucaacauugaggg

SEQ ID NO: 204747 - RNA, 22 nt, Homo sapiens
uuggaaacaccuggugagguua

SEQ ID NO: 204748 - RNA, 22 nt, Homo sapiens
uuggaauuaagagauauuuucu

SEQ ID NO: 204749 - RNA, 22 nt, Homo sapiens
uuggacugggauggccgaggcu

SEQ ID NO: 204750 - RNA, 22 nt, Homo sapiens
uuggcauugccaaacugucaac

SEQ ID NO: 204751 - RNA, 21 nt, Homo sapiens
uuggggaauggagagguuuuc

SEQ ID NO: 204752 - RNA, 22 nt, Homo sapiens
uugguccccuucaaccagcugu

SEQ ID NO: 204753 - RNA, 22 nt, Homo sapiens
uuguacuuuuaguagagacggg

SEQ ID NO: 204754 - RNA, 22 nt, Homo sapiens
uugucaaacucauucuccaucc

SEQ ID NO: 204755 - RNA, 22 nt, Homo sapiens
uugucacuauaaauaagcauuu

SEQ ID NO: 204756 - RNA, 22 nt, Homo sapiens
uugugagggagcuaagaugagu

SEQ ID NO: 204757 - RNA, 22 nt, Homo sapiens
uugugggaggugauuagaucau

SEQ ID NO: 204758 - RNA, 22 nt, Homo sapiens
uuuaacauuggaugagaucguc

SEQ ID NO: 204759 - RNA, 22 nt, Homo sapiens
uuuacugugggguuucuuagag

SEQ ID NO: 204760 - RNA, 22 nt, Homo sapiens
uuucaguagagacacgguuuug

SEQ ID NO: 204761 - RNA, 16 nt, Homo sapiens
uuucccuuugguguuu

SEQ ID NO: 204762 - RNA, 22 nt, Homo sapiens
uuucugaggccucaccagaagc

SEQ ID NO: 204763 - RNA, 22 nt, Homo sapiens
uuugagcuugacucagcuggag

SEQ ID NO: 204764 - RNA, 22 nt, Homo sapiens
uuugauugguguaccugaaagu

SEQ ID NO: 204765 - RNA, 22 nt, Homo sapiens
uuugcugagucauuccaugcug

SEQ ID NO: 204766 - RNA, 22 nt, Homo sapiens
uuugguuuuuguuaucacucau

SEQ ID NO: 204767 - RNA, 22 nt, Homo sapiens
uuuguacacuguuggugguuau

SEQ ID NO: 204768 - RNA, 22 nt, Homo sapiens
gucagggagucucuaucagugg

SEQ ID NO: 204769 - RNA, 22 nt, Homo sapiens
gucagugcauguaaacauaaaa

SEQ ID NO: 204770 - RNA, 22 nt, Homo sapiens
gucagugcuuuaguucaggaug

SEQ ID NO: 204771 - RNA, 22 nt, Homo sapiens
guccaaauccaugggauguaca

SEQ ID NO: 204772 - RNA, 22 nt, Homo sapiens
gucccaguggaaccuccaagcu

SEQ ID NO: 204773 - RNA, 22 nt, Homo sapiens
gucuuugagauaggguuauuuu

SEQ ID NO: 204774 - RNA, 22 nt, Homo sapiens
gucuuuguuauuaugaaucaac

SEQ ID NO: 204775 - RNA, 22 nt, Homo sapiens
gucuuuguuuggucuguaucag

SEQ ID NO: 204776 - RNA, 22 nt, Homo sapiens
gugacugcauauaaguguaugu

SEQ ID NO: 204777 - RNA, 22 nt, Homo sapiens
gugagguaagaguugcuuugcu

SEQ ID NO: 204778 - RNA, 20 nt, Homo sapiens
gugagguagaggguuaccug

SEQ ID NO: 204779 - RNA, 21 nt, Homo sapiens
gugcaaacaucauagaaugua

SEQ ID NO: 204780 - RNA, 22 nt, Homo sapiens
gugcacauuguuuaugucuguu

SEQ ID NO: 204781 - RNA, 22 nt, Homo sapiens
guggaauuauagagacaucuug

SEQ ID NO: 204782 - RNA, 22 nt, Homo sapiens
guggacagagacuaaauguugu

SEQ ID NO: 204783 - RNA, 22 nt, Homo sapiens
gugggaagcuggaacucccucc

SEQ ID NO: 204784 - RNA, 22 nt, Homo sapiens
guggguaaaucucuggggcucu

SEQ ID NO: 204785 - RNA, 22 nt, Homo sapiens
gugguuuuaauauucagucuag

SEQ ID NO: 204786 - RNA, 22 nt, Homo sapiens
gugguuuuuagauuucuacagu

SEQ ID NO: 204787 - RNA, 22 nt, Homo sapiens
gugucccagugugcauacaggu

SEQ ID NO: 204788 - RNA, 22 nt, Homo sapiens
guguggcaggugggggcucaga

SEQ ID NO: 204789 - RNA, 22 nt, Homo sapiens
guucacagugguugccuuccag

SEQ ID NO: 204790 - RNA, 22 nt, Homo sapiens
guucacaguuaggacaacugcu

SEQ ID NO: 204791 - RNA, 20 nt, Homo sapiens
guucauguaauuaguucagg

SEQ ID NO: 204792 - RNA, 22 nt, Homo sapiens
guuggaauguauugcuacuucu

SEQ ID NO: 204793 - RNA, 22 nt, Homo sapiens
uaaagcuuagauccaugguggc

SEQ ID NO: 204794 - RNA, 20 nt, Homo sapiens
uaaaugccucaugcuuuauu

SEQ ID NO: 204795 - RNA, 21 nt, Homo sapiens
uaaaugucauacaaagcaaug

SEQ ID NO: 204796 - RNA, 22 nt, Homo sapiens
uaaauugcauaaguacaaauga

SEQ ID NO: 204797 - RNA, 21 nt, Homo sapiens
uaacagcuccacuccauucuc

SEQ ID NO: 204798 - RNA, 22 nt, Homo sapiens
uaacauagucauauacuugcuu

SEQ ID NO: 204799 - RNA, 22 nt, Homo sapiens
uaacauugucuugcuuaguuuu

SEQ ID NO: 204800 - RNA, 22 nt, Homo sapiens
uaaggaaggcugugugcuuuua

SEQ ID NO: 204801 - RNA, 22 nt, Homo sapiens
uaaggcuuuuguucagcguggg

SEQ ID NO: 204802 - RNA, 19 nt, Homo sapiens
uaaguagaugacugaugcu

SEQ ID NO: 204803 - RNA, 22 nt, Homo sapiens
uaagugaaggaaguguguuuac

SEQ ID NO: 204804 - RNA, 22 nt, Homo sapiens
uaagugaauuucacuacugagu

SEQ ID NO: 204805 - RNA, 22 nt, Homo sapiens
uaauagagucauuauuauuguu

SEQ ID NO: 204806 - RNA, 16 nt, Homo sapiens
uacaauguagaaaaca

SEQ ID NO: 204807 - RNA, 22 nt, Homo sapiens
uacaguaauguuaaucuuugug

SEQ ID NO: 204808 - RNA, 22 nt, Homo sapiens
uacaucagccugaaagagcucg

SEQ ID NO: 204809 - RNA, 22 nt, Homo sapiens
uaccugagucuagagucuagaa

SEQ ID NO: 204810 - RNA, 22 nt, Homo sapiens
uaccuuugucaguuacucaccu

SEQ ID NO: 204811 - RNA, 22 nt, Homo sapiens
uacugaccugucauucagaguu

SEQ ID NO: 204812 - RNA, 22 nt, Homo sapiens
uagaaagcaugaccuucagaua

SEQ ID NO: 204813 - RNA, 20 nt, Homo sapiens
uagaaaguagaguggugguu

SEQ ID NO: 204814 - RNA, 22 nt, Homo sapiens
uagaaugaaacaagcugugccu

SEQ ID NO: 204815 - RNA, 22 nt, Homo sapiens
uagaggaaugaauuuggccaga

SEQ ID NO: 204816 - RNA, 22 nt, Homo sapiens
uagagguauaccaaaaaggcau

SEQ ID NO: 204817 - RNA, 22 nt, Homo sapiens
uagagguauuaacaguagaaga

SEQ ID NO: 204818 - RNA, 22 nt, Homo sapiens
uagaucauauacuugccaugac

SEQ ID NO: 204819 - RNA, 22 nt, Homo sapiens
uagaucauauucagugcuuacu

SEQ ID NO: 204820 - RNA, 22 nt, Homo sapiens
uagaugauucacuuuacuucca

SEQ ID NO: 204821 - RNA, 22 nt, Homo sapiens
uagcaguucauuguugugugaa

SEQ ID NO: 204822 - RNA, 22 nt, Homo sapiens
uagcugcaaaauauagacuucu

SEQ ID NO: 204823 - RNA, 22 nt, Homo sapiens
uagcuggaauuacuugcaccug

SEQ ID NO: 204824 - RNA, 22 nt, Homo sapiens
uagggaguuuuggggugcagaa

SEQ ID NO: 204825 - RNA, 22 nt, Homo sapiens
uagucacacacucaacuuuuca

SEQ ID NO: 204826 - RNA, 22 nt, Homo sapiens
uaucacagaggguauccuagag

SEQ ID NO: 204827 - RNA, 21 nt, Homo sapiens
uaucacaguagaauaggaucu

SEQ ID NO: 204828 - RNA, 22 nt, Homo sapiens
uaucacuuugauaguuuaaaug

SEQ ID NO: 204829 - RNA, 22 nt, Homo sapiens
uaucagcagagucauacuucaa

SEQ ID NO: 204830 - RNA, 21 nt, Homo sapiens
uaucauggccauccucuucuc

SEQ ID NO: 204831 - RNA, 22 nt, Homo sapiens
uaucucuguggguagugcugaa

SEQ ID NO: 204832 - RNA, 22 nt, Homo sapiens
uaugagaugaggccacugggua

SEQ ID NO: 204833 - RNA, 22 nt, Homo sapiens
uaugaucauuauguuauugcag

SEQ ID NO: 204834 - RNA, 22 nt, Homo sapiens
uaugcacacguguccaugugca

SEQ ID NO: 204835 - RNA, 22 nt, Homo sapiens
uaugucacagguuuuggugaaa

SEQ ID NO: 204836 - RNA, 20 nt, Homo sapiens
uauuacagaguaauggugga

SEQ ID NO: 204837 - RNA, 22 nt, Homo sapiens
uauuacuguuauuccuaucaaa

SEQ ID NO: 204838 - RNA, 22 nt, Homo sapiens
uauuccacucuguuggagguaa

SEQ ID NO: 204839 - RNA, 18 nt, Homo sapiens
uauuccucuuccucuauc

SEQ ID NO: 204840 - RNA, 22 nt, Homo sapiens
ucaaaugguccacgugaacauu

SEQ ID NO: 204841 - RNA, 22 nt, Homo sapiens
ucaaggcacuagcugagcugca

SEQ ID NO: 204842 - RNA, 22 nt, Homo sapiens
ucacagaugaggcgagaggcag

SEQ ID NO: 204843 - RNA, 22 nt, Homo sapiens
ucacagccuaguuuuauacauu

SEQ ID NO: 204844 - RNA, 22 nt, Homo sapiens
ucacagugaguggaguggggug

SEQ ID NO: 204845 - RNA, 23 nt, Homo sapiens
ucacaguggcugcuuaauuguga

SEQ ID NO: 204846 - RNA, 22 nt, Homo sapiens
ucacaguguuaaaccuuucuuu

SEQ ID NO: 204847 - RNA, 22 nt, Homo sapiens
ucacaguucagcauggcugagg

SEQ ID NO: 204848 - RNA, 22 nt, Homo sapiens
ucacaugugaagauugggagua

SEQ ID NO: 204849 - RNA, 22 nt, Homo sapiens
ucaccuggagccuucacauucu

SEQ ID NO: 204850 - RNA, 22 nt, Homo sapiens
ucacuaaagaaaauggcaugga

SEQ ID NO: 204851 - RNA, 23 nt, Homo sapiens
ucacuagaguccuggaguuugag

SEQ ID NO: 204852 - RNA, 22 nt, Homo sapiens
ucacugaaaccgccuccaccuc

SEQ ID NO: 204853 - RNA, 21 nt, Homo sapiens
ucacugagguuaaauaggguu

SEQ ID NO: 204854 - RNA, 20 nt, Homo sapiens
ucacugagugguccacagua

SEQ ID NO: 204855 - RNA, 19 nt, Homo sapiens
ucagaugcauuagggguua

SEQ ID NO: 204856 - RNA, 22 nt, Homo sapiens
ucagcagugagagaccucaccc

SEQ ID NO: 204857 - RNA, 22 nt, Homo sapiens
ucagcagugccccacucuacug

SEQ ID NO: 204858 - RNA, 22 nt, Homo sapiens
ucagcaguggacagaaugguag

SEQ ID NO: 204859 - RNA, 22 nt, Homo sapiens
ucagguccuuacugugcucccu

SEQ ID NO: 204860 - RNA, 22 nt, Homo sapiens
ucaguacuuuggagcucacaua

SEQ ID NO: 204861 - RNA, 22 nt, Homo sapiens
ucagugcuuuuuguugucauca

SEQ ID NO: 204862 - RNA, 22 nt, Homo sapiens
ucauagaucaaguaauaagaca

SEQ ID NO: 204863 - RNA, 20 nt, Homo sapiens
ucaucaguuggugcucgcug

SEQ ID NO: 204864 - RNA, 22 nt, Homo sapiens
ucauccauacaguuagcaaagg

SEQ ID NO: 204865 - RNA, 22 nt, Homo sapiens
ucaugaaguaguuaacugguug

SEQ ID NO: 204866 - RNA, 22 nt, Homo sapiens
ucauugcauguuaauuaaacag

SEQ ID NO: 204867 - RNA, 18 nt, Homo sapiens
uccauuuguaugggaugg

SEQ ID NO: 204868 - RNA, 22 nt, Homo sapiens
ucccaguguguagcuugucucu

SEQ ID NO: 204869 - RNA, 17 nt, Homo sapiens
ucccauguuucuucuac

SEQ ID NO: 204870 - RNA, 22 nt, Homo sapiens
uccccgaggcuggagugcagug

SEQ ID NO: 204871 - RNA, 22 nt, Homo sapiens
uccucauggagaaccucugcua

SEQ ID NO: 204872 - RNA, 22 nt, Homo sapiens
uccuugaaacaggaagaauuca

SEQ ID NO: 204873 - RNA, 22 nt, Homo sapiens
uccuugagccucccagacucag

SEQ ID NO: 204874 - RNA, 22 nt, Homo sapiens
uccuugagucuuugcucagaug

SEQ ID NO: 204875 - RNA, 22 nt, Homo sapiens
ucuaguaaugagaggcaggaga

SEQ ID NO: 204876 - RNA, 22 nt, Homo sapiens
ucucaauggguuguagacaaag

SEQ ID NO: 204877 - RNA, 22 nt, Homo sapiens
ucucagugaauugguuuugucu

SEQ ID NO: 204878 - RNA, 23 nt, Homo sapiens
ucucauuccuugaaaauaaugac

SEQ ID NO: 204879 - RNA, 22 nt, Homo sapiens
ucuccauuuguaaggguuucuc

SEQ ID NO: 204880 - RNA, 22 nt, Homo sapiens
ucugaaucguucccaugcagga

SEQ ID NO: 204881 - RNA, 22 nt, Homo sapiens
ucugacaaugaacaaucuauag

SEQ ID NO: 204882 - RNA, 21 nt, Homo sapiens
ucuggcccccucaaaucucau

SEQ ID NO: 204883 - RNA, 22 nt, Homo sapiens
ucuggccccucccaaaucucau

SEQ ID NO: 204884 - RNA, 22 nt, Homo sapiens
ucuguacuccuugaguagugcu

SEQ ID NO: 204885 - RNA, 22 nt, Homo sapiens
ucuguacugccaaguuucuuua

SEQ ID NO: 204886 - RNA, 22 nt, Homo sapiens
ucuguguugaucacacugggag

SEQ ID NO: 204887 - RNA, 17 nt, Homo sapiens
ucuugugguucuugaau

SEQ ID NO: 204888 - RNA, 22 nt, Homo sapiens
ucuuuaguuaagggacauuuua

SEQ ID NO: 204889 - RNA, 22 nt, Homo sapiens
ucuuucacuuagcaugauguuu

SEQ ID NO: 204890 - RNA, 22 nt, Homo sapiens
ucuuugaguggagcgaggcaga

SEQ ID NO: 204891 - RNA, 22 nt, Homo sapiens
ucuuuggaggcgaucuguuuga

SEQ ID NO: 204892 - RNA, 21 nt, Homo sapiens
ucuuuggucaccaguuuucau

SEQ ID NO: 204893 - RNA, 22 nt, Homo sapiens
ugaaaugaucaguuugguuacu

SEQ ID NO: 204894 - RNA, 22 nt, Homo sapiens
ugaagacucaauuauuaugaac

SEQ ID NO: 204895 - RNA, 18 nt, Homo sapiens
ugaauacagcguugggaa

SEQ ID NO: 204896 - RNA, 22 nt, Homo sapiens
ugaauagacacuaaagacugua

SEQ ID NO: 204897 - RNA, 22 nt, Homo sapiens
ugacaguaaacagucuugauua

SEQ ID NO: 204898 - RNA, 22 nt, Homo sapiens
ugacaguaucuacagcuucuua

SEQ ID NO: 204899 - RNA, 22 nt, Homo sapiens
ugacaugaugagcaauaauggc

SEQ ID NO: 204900 - RNA, 22 nt, Homo sapiens
ugacaugauuguauauuuagaa

SEQ ID NO: 204901 - RNA, 22 nt, Homo sapiens
ugagaacuagagaacaagguga

SEQ ID NO: 204902 - RNA, 22 nt, Homo sapiens
ugagaacucaugggucugcugg

SEQ ID NO: 204903 - RNA, 22 nt, Homo sapiens
ugagaacugccuguauuuaucu

SEQ ID NO: 204904 - RNA, 22 nt, Homo sapiens
ugagaacuuauggugauuuuuu

SEQ ID NO: 204905 - RNA, 22 nt, Homo sapiens
ugagaagcauaccagugucugu

SEQ ID NO: 204906 - RNA, 22 nt, Homo sapiens
ugagacgaagucuugcucuguu

SEQ ID NO: 204907 - RNA, 22 nt, Homo sapiens
ugagacggagucuugcucuguc

SEQ ID NO: 204908 - RNA, 22 nt, Homo sapiens
ugagacugagucucccucuguc

SEQ ID NO: 204909 - RNA, 22 nt, Homo sapiens
ugagagcuuuuuugccugguga

SEQ ID NO: 204910 - RNA, 22 nt, Homo sapiens
ugagagucacugaccugguaua

SEQ ID NO: 204911 - RNA, 22 nt, Homo sapiens
ugagaucaugccacugcacuuc

SEQ ID NO: 204912 - RNA, 22 nt, Homo sapiens
ugagaucuuaccuuccugccuu

SEQ ID NO: 204913 - RNA, 22 nt, Homo sapiens
ugagaugaggucucgcucuguc

SEQ ID NO: 204914 - RNA, 22 nt, Homo sapiens
ugagaugaguucucgcucuguc

SEQ ID NO: 204915 - RNA, 21 nt, Homo sapiens
ugagaugcaaucaccagggag

SEQ ID NO: 204916 - RNA, 22 nt, Homo sapiens
ugagauuguuagaucaaauggu

SEQ ID NO: 204917 - RNA, 18 nt, Homo sapiens
ugaggaaaggguuugcua

SEQ ID NO: 204918 - RNA, 22 nt, Homo sapiens
ugagguagaggugaacuugacc

SEQ ID NO: 204919 - RNA, 22 nt, Homo sapiens
ugaguaguauucuaugguaugu

SEQ ID NO: 204920 - RNA, 22 nt, Homo sapiens
ugagugagguucuacucuguga

SEQ ID NO: 204921 - RNA, 22 nt, Homo sapiens
ugauaugucccucgacaucagg

SEQ ID NO: 204922 - RNA, 22 nt, Homo sapiens
ugaugacauugucacagucuga

SEQ ID NO: 204923 - RNA, 18 nt, Homo sapiens
ugcaaacauguguguguu

SEQ ID NO: 204924 - RNA, 22 nt, Homo sapiens
ugcaaagucgaaacugcaguuu

SEQ ID NO: 204925 - RNA, 22 nt, Homo sapiens
ugcaaauguuaggugucauuau

SEQ ID NO: 204926 - RNA, 22 nt, Homo sapiens
ugcaagaggagacuguacucag

SEQ ID NO: 204927 - RNA, 22 nt, Homo sapiens
ugcaguagugugaucuuggcuc

SEQ ID NO: 204928 - RNA, 22 nt, Homo sapiens
ugcaguuuaggaacugguaaca

SEQ ID NO: 204929 - RNA, 21 nt, Homo sapiens
ugcaugguagucacaugauuc

SEQ ID NO: 204930 - RNA, 22 nt, Homo sapiens
ugccaguauuuuauugaagauu

SEQ ID NO: 204931 - RNA, 22 nt, Homo sapiens
ugccaguauuuuguugaggauu

SEQ ID NO: 204932 - RNA, 22 nt, Homo sapiens
ugccuggagagcuccuacauau

SEQ ID NO: 204933 - RNA, 21 nt, Homo sapiens
ugcuccauuuucuagccugaa

SEQ ID NO: 204934 - RNA, 22 nt, Homo sapiens
ugcugcaaacaugagaggaagu

SEQ ID NO: 204935 - RNA, 22 nt, Homo sapiens
ugcugguggucccauaugauua

SEQ ID NO: 204936 - RNA, 22 nt, Homo sapiens
uggaaaguaguucuaaucuaag

SEQ ID NO: 204937 - RNA, 22 nt, Homo sapiens
uggaacacaucuaaggaagcag

SEQ ID NO: 204938 - RNA, 22 nt, Homo sapiens
uggaagacaggcuguauuuuaa

SEQ ID NO: 204939 - RNA, 22 nt, Homo sapiens
uggaagccuagauucuuuucuu

SEQ ID NO: 204940 - RNA, 22 nt, Homo sapiens
uggaaugguaucuuguuggggu

SEQ ID NO: 204941 - RNA, 21 nt, Homo sapiens
uggaauuaauggagagguguu

SEQ ID NO: 204942 - RNA, 20 nt, Homo sapiens
acugggcuaccgaaguaagg

SEQ ID NO: 204943 - RNA, 22 nt, Homo sapiens
acuucauucucuggaucagaau

SEQ ID NO: 204944 - RNA, 22 nt, Homo sapiens
agacagcuggaguaucauagcu

SEQ ID NO: 204945 - RNA, 19 nt, Homo sapiens
agagacucauuguagcauu

SEQ ID NO: 204946 - RNA, 22 nt, Homo sapiens
agaggucuuaucaaacaugcuu

SEQ ID NO: 204947 - RNA, 22 nt, Homo sapiens
agaguacaggcaaguuagucau

SEQ ID NO: 204948 - RNA, 22 nt, Homo sapiens
agauauguuauugauguuaaug

SEQ ID NO: 204949 - RNA, 23 nt, Homo sapiens
agauggcauuucaguucuuuagg

SEQ ID NO: 204950 - RNA, 22 nt, Homo sapiens
agaugguauuauagguuucugu

SEQ ID NO: 204951 - RNA, 22 nt, Homo sapiens
agcagagcauauucauucgggg

SEQ ID NO: 204952 - RNA, 22 nt, Homo sapiens
agcagcaucgggaaguuggcca

SEQ ID NO: 204953 - RNA, 20 nt, Homo sapiens
agcagccacagauuccucag

SEQ ID NO: 204954 - RNA, 16 nt, Homo sapiens
agcagguguuagguga

SEQ ID NO: 204955 - RNA, 19 nt, Homo sapiens
agcaguguggagauuucuc

SEQ ID NO: 204956 - RNA, 23 nt, Homo sapiens
agccugguuucccugcuucuccc

SEQ ID NO: 204957 - RNA, 22 nt, Homo sapiens
agcuaguguucaccagagguca

SEQ ID NO: 204958 - RNA, 20 nt, Homo sapiens
agcuccauuccugaaggcug

SEQ ID NO: 204959 - RNA, 22 nt, Homo sapiens
agcuccauuguaaucaccuggu

SEQ ID NO: 204960 - RNA, 22 nt, Homo sapiens
agcugcauuuacuuuugcacaa

SEQ ID NO: 204961 - RNA, 22 nt, Homo sapiens
agcuggauguggaugacccugu

SEQ ID NO: 204962 - RNA, 22 nt, Homo sapiens
aaaaugcugauauugggcccca

SEQ ID NO: 204963 - RNA, 22 nt, Homo sapiens
aaacucuguagcagagacagau

SEQ ID NO: 204964 - RNA, 20 nt, Homo sapiens
aaacucugucuucuuuauca

SEQ ID NO: 204965 - RNA, 22 nt, Homo sapiens
aaacugcuuuccaugguggcug

SEQ ID NO: 204966 - RNA, 22 nt, Homo sapiens
aaagaagucagccuguccuuug

SEQ ID NO: 204967 - RNA, 22 nt, Homo sapiens
aaaguaguagcaguuucugcca

SEQ ID NO: 204968 - RNA, 22 nt, Homo sapiens
aaagugcuuccuuuuugagggu

SEQ ID NO: 204969 - RNA, 20 nt, Homo sapiens
aaaugcuguaauguuuggga

SEQ ID NO: 204970 - RNA, 22 nt, Homo sapiens
aaaugcuguuccaggaccuauc

SEQ ID NO: 204971 - RNA, 22 nt, Homo sapiens
aaaugucauggaguguuucccc

SEQ ID NO: 204972 - RNA, 22 nt, Homo sapiens
aacaggcuccuaggggugcacc

SEQ ID NO: 204973 - RNA, 22 nt, Homo sapiens
aacuccauuuuagacccuagau

SEQ ID NO: 204974 - RNA, 22 nt, Homo sapiens
aacugcacauauuuguaugggu

SEQ ID NO: 204975 - RNA, 22 nt, Homo sapiens
aagagguagcagucacaaaaga

SEQ ID NO: 204976 - RNA, 22 nt, Homo sapiens
aaggagcuuaagugacuuguac

SEQ ID NO: 204977 - RNA, 22 nt, Homo sapiens
aaggcucuuucaacguaaauua

SEQ ID NO: 204978 - RNA, 20 nt, Homo sapiens
aaggcuuucgaguuccaggg

SEQ ID NO: 204979 - RNA, 22 nt, Homo sapiens
aagggagcugcauaaucuugug

SEQ ID NO: 204980 - RNA, 17 nt, Homo sapiens
aaggugcuucgaccucc

SEQ ID NO: 204981 - RNA, 22 nt, Homo sapiens
aaguauuaugaguccuuguuuu

SEQ ID NO: 204982 - RNA, 20 nt, Homo sapiens
aagugcuuccuuuuagaggg

SEQ ID NO: 204983 - RNA, 20 nt, Homo sapiens
aauaacagccccagggaggu

SEQ ID NO: 204984 - RNA, 22 nt, Homo sapiens
aauaagcauaguaccugauagg

SEQ ID NO: 204985 - RNA, 22 nt, Homo sapiens
aauaauggcaccaaagcacaag

SEQ ID NO: 204986 - RNA, 21 nt, Homo sapiens
aauacucuagguuaagagagc

SEQ ID NO: 204987 - RNA, 22 nt, Homo sapiens
aauacuuccaaaucuagucauu

SEQ ID NO: 204988 - RNA, 22 nt, Homo sapiens
aaucauauugucugccaagagg

SEQ ID NO: 204989 - RNA, 22 nt, Homo sapiens
aaucccuuuguccagucucuuu

SEQ ID NO: 204990 - RNA, 22 nt, Homo sapiens
aaugacugugauauuuuucuuc

SEQ ID NO: 204991 - RNA, 22 nt, Homo sapiens
aaugaucaauguuugaggugau

SEQ ID NO: 204992 - RNA, 22 nt, Homo sapiens
aaugucacugugguccuccagu

SEQ ID NO: 204993 - RNA, 22 nt, Homo sapiens
acaagugcuuuuccuggagaca

SEQ ID NO: 204994 - RNA, 22 nt, Homo sapiens
acacuguaacucuuugagggca

SEQ ID NO: 204995 - RNA, 18 nt, Homo sapiens
acagugcuggcaugagau

SEQ ID NO: 204996 - RNA, 19 nt, Homo sapiens
acauugcauuuguaggcuu

SEQ ID NO: 204997 - RNA, 22 nt, Homo sapiens
accacagugcuuccugcucacg

SEQ ID NO: 204998 - RNA, 21 nt, Homo sapiens
acccccacaccuccuuaguuc

SEQ ID NO: 204999 - RNA, 22 nt, Homo sapiens
acccugucacucccaucaauuu

SEQ ID NO: 205000 - RNA, 22 nt, Homo sapiens
acccugucagcuggccugggca

SEQ ID NO: 205001 - RNA, 23 nt, Homo sapiens
accugugguuauuuuacucuucc

SEQ ID NO: 205002 - RNA, 22 nt, Homo sapiens
acucagagugggccccuagaua

SEQ ID NO: 205003 - RNA, 22 nt, Homo sapiens
acuccauuuggacucugggagg

SEQ ID NO: 205004 - RNA, 22 nt, Homo sapiens
acugcacuccagccuccugggu

SEQ ID NO: 205005 - RNA, 22 nt, Homo sapiens
acuggcucugcuuuacaaacag

SEQ ID NO: 205006 - RNA, 22 nt, Homo sapiens
acugggucaaaguagaaaacua

SEQ ID NO: 205007 - RNA, 22 nt, Homo sapiens
agaaccaaucccacauggauac

SEQ ID NO: 205008 - RNA, 22 nt, Homo sapiens
agagcacuguggguccaaauau

SEQ ID NO: 205009 - RNA, 22 nt, Homo sapiens
agagccacauuaaauaugggaa

SEQ ID NO: 205010 - RNA, 22 nt, Homo sapiens
agaggaguacuacuccaagucu

SEQ ID NO: 205011 - RNA, 22 nt, Homo sapiens
agaguaguaggaugaauggacu

SEQ ID NO: 205012 - RNA, 22 nt, Homo sapiens
agagugcuauagauuagauuuc

SEQ ID NO: 205013 - RNA, 22 nt, Homo sapiens
agcagcaugaggggacuucugc

SEQ ID NO: 205014 - RNA, 21 nt, Homo sapiens
agcagcuuugguugaagcaga

SEQ ID NO: 205015 - RNA, 21 nt, Homo sapiens
agccaguguuccuuguggcuc

SEQ ID NO: 205016 - RNA, 22 nt, Homo sapiens
agcccauguggcugaggcuucu

SEQ ID NO: 205017 - RNA, 23 nt, Homo sapiens
agcuagagaggcuggggauacag

SEQ ID NO: 205018 - RNA, 22 nt, Homo sapiens
agcuccaucuucagggguucag

SEQ ID NO: 205019 - RNA, 20 nt, Homo sapiens
agcugcagauauaaauccgc

SEQ ID NO: 205020 - RNA, 20 nt, Homo sapiens
agcuguuguuaugagguuua

SEQ ID NO: 205021 - RNA, 22 nt, Homo sapiens
agcuguuguucucagaggcuuu

SEQ ID NO: 205022 - RNA, 23 nt, Homo sapiens
aggaauggaaaaccaaguaucau

SEQ ID NO: 205023 - RNA, 22 nt, Homo sapiens
aggaauggaaacuuuugauggu

SEQ ID NO: 205024 - RNA, 22 nt, Homo sapiens
aggacacugauguaugcugugg

SEQ ID NO: 205025 - RNA, 22 nt, Homo sapiens
aggagcacaauggucaugugga

SEQ ID NO: 205026 - RNA, 21 nt, Homo sapiens
aggcaagguguuauuauugaa

SEQ ID NO: 205027 - RNA, 22 nt, Homo sapiens
aggcacggugucucaugccugu

SEQ ID NO: 205028 - RNA, 21 nt, Homo sapiens
aggcuguuguuuugggaugga

SEQ ID NO: 205029 - RNA, 22 nt, Homo sapiens
aguacaauguugaguagaagug

SEQ ID NO: 205030 - RNA, 22 nt, Homo sapiens
agucaagaugagauuugggugg

SEQ ID NO: 205031 - RNA, 22 nt, Homo sapiens
agucacagguucuugggauuag

SEQ ID NO: 205032 - RNA, 22 nt, Homo sapiens
agucacagugaccuugucugac

SEQ ID NO: 205033 - RNA, 22 nt, Homo sapiens
aguccagguuuuguaauggcaa

SEQ ID NO: 205034 - RNA, 22 nt, Homo sapiens
agugaacaaagaagugcagaua

SEQ ID NO: 205035 - RNA, 21 nt, Homo sapiens
agugagucauuuggaaagcaa

SEQ ID NO: 205036 - RNA, 22 nt, Homo sapiens
agugcaauggugccaucauagc

SEQ ID NO: 205037 - RNA, 22 nt, Homo sapiens
aguggaguguaaagcgucuuuu

SEQ ID NO: 205038 - RNA, 22 nt, Homo sapiens
aguggcaaugugauguccugaa

SEQ ID NO: 205039 - RNA, 22 nt, Homo sapiens
aguguuuuucaugggauacuuu

SEQ ID NO: 205040 - RNA, 22 nt, Homo sapiens
auaaaagcaggucuaggucagg

SEQ ID NO: 205041 - RNA, 22 nt, Homo sapiens
auaaaguucugcuggcauauau

SEQ ID NO: 205042 - RNA, 22 nt, Homo sapiens
auaaaugcaaugguauuuuuga

SEQ ID NO: 205043 - RNA, 20 nt, Homo sapiens
auaaauguauagguguacau

SEQ ID NO: 205044 - RNA, 22 nt, Homo sapiens
auacauguucaagggcauauau

SEQ ID NO: 205045 - RNA, 22 nt, Homo sapiens
auacugguuuuugucaugugga

SEQ ID NO: 205046 - RNA, 22 nt, Homo sapiens
auacuguauaggauuguagccu

SEQ ID NO: 205047 - RNA, 19 nt, Homo sapiens
auauaacauccaggagcag

SEQ ID NO: 205048 - RNA, 23 nt, Homo sapiens
auauaguagaugugcaguaacau

SEQ ID NO: 205049 - RNA, 22 nt, Homo sapiens
auauaguguuuuuugguacgcu

SEQ ID NO: 205050 - RNA, 17 nt, Homo sapiens
auaugaauuuuggagau

SEQ ID NO: 205051 - RNA, 22 nt, Homo sapiens
aucacagagucacgggcaacuu

SEQ ID NO: 205052 - RNA, 22 nt, Homo sapiens
aucacaguggcucacaagagcc

SEQ ID NO: 205053 - RNA, 22 nt, Homo sapiens
aucagagccugugugcccugaa

SEQ ID NO: 205054 - RNA, 22 nt, Homo sapiens
aucccaguaaaaauggcuucua

SEQ ID NO: 205055 - RNA, 20 nt, Homo sapiens
aucccauuccugaagauacu

SEQ ID NO: 205056 - RNA, 22 nt, Homo sapiens
aucccuguaacuagcagccccu

SEQ ID NO: 205057 - RNA, 22 nt, Homo sapiens
auccucugagaucuaggcagag

SEQ ID NO: 205058 - RNA, 21 nt, Homo sapiens
auccuucuuuuucaaccugug

SEQ ID NO: 205059 - RNA, 22 nt, Homo sapiens
augaaagugauaaaugucucua

SEQ ID NO: 205060 - RNA, 22 nt, Homo sapiens
augaacacuccaauuguacucc

SEQ ID NO: 205061 - RNA, 22 nt, Homo sapiens
augacaguguggauuauuguaa

SEQ ID NO: 205062 - RNA, 22 nt, Homo sapiens
augacucagaucuguuccuggu

SEQ ID NO: 205063 - RNA, 22 nt, Homo sapiens
augacugucagggcagucauug

SEQ ID NO: 205064 - RNA, 22 nt, Homo sapiens
augacugucuugcagaggcuau

SEQ ID NO: 205065 - RNA, 22 nt, Homo sapiens
augagauuguuugugugaaaua

SEQ ID NO: 205066 - RNA, 22 nt, Homo sapiens
augagggcggacgcccuggaga

SEQ ID NO: 205067 - RNA, 22 nt, Homo sapiens
augagguaguagaaagucaggu

SEQ ID NO: 205068 - RNA, 22 nt, Homo sapiens
augaggugggcggcuuggaaga

SEQ ID NO: 205069 - RNA, 22 nt, Homo sapiens
augauauguuuguagcuaucuc

SEQ ID NO: 205070 - RNA, 22 nt, Homo sapiens
augaucuguuuggugaucuugu

SEQ ID NO: 205071 - RNA, 22 nt, Homo sapiens
augaugaaguaagugcuuagga

SEQ ID NO: 205072 - RNA, 22 nt, Homo sapiens
augcaaacagcuaucuggcugg

SEQ ID NO: 205073 - RNA, 22 nt, Homo sapiens
augcaaacaucugaagagacau

SEQ ID NO: 205074 - RNA, 22 nt, Homo sapiens
augcuaugugugacuucuuaug

SEQ ID NO: 205075 - RNA, 22 nt, Homo sapiens
auggaacuggagaugguuauau

SEQ ID NO: 205076 - RNA, 22 nt, Homo sapiens
auggaaggagaggaaugaauga

SEQ ID NO: 205077 - RNA, 22 nt, Homo sapiens
auggagguguggggagugaguu

SEQ ID NO: 205078 - RNA, 22 nt, Homo sapiens
auggcacuccagccugggcaac

SEQ ID NO: 205079 - RNA, 22 nt, Homo sapiens
auggcagaaucaagccgacagc

SEQ ID NO: 205080 - RNA, 22 nt, Homo sapiens
auggcucuguuuuuuaugcucu

SEQ ID NO: 205081 - RNA, 22 nt, Homo sapiens
auggcuuuaagagugucugaau

SEQ ID NO: 205082 - RNA, 22 nt, Homo sapiens
auggcuuuguguucagagcuga

SEQ ID NO: 205083 - RNA, 22 nt, Homo sapiens
augguauuuugugauaccuugu

SEQ ID NO: 205084 - RNA, 21 nt, Homo sapiens
auggugagaaaguagugucaa

SEQ ID NO: 205085 - RNA, 22 nt, Homo sapiens
augguuuuacugcaaaauggga

SEQ ID NO: 205086 - RNA, 22 nt, Homo sapiens
auguaacaguauuuggagaugu

SEQ ID NO: 205087 - RNA, 22 nt, Homo sapiens
auguccaugagcacauguauca

SEQ ID NO: 205088 - RNA, 22 nt, Homo sapiens
augugcacaacgugcagguuug

SEQ ID NO: 205089 - RNA, 21 nt, Homo sapiens
augugcacuaugucauuuaau

SEQ ID NO: 205090 - RNA, 22 nt, Homo sapiens
auguggcacuugacuuucucgc

SEQ ID NO: 205091 - RNA, 22 nt, Homo sapiens
auguggcauuucucauucauuu

SEQ ID NO: 205092 - RNA, 22 nt, Homo sapiens
auuacauagucaaggugucuca

SEQ ID NO: 205093 - RNA, 20 nt, Homo sapiens
auuccacuuguuugagguac

SEQ ID NO: 205094 - RNA, 22 nt, Homo sapiens
auuccaguggguuuacauccca

SEQ ID NO: 205095 - RNA, 22 nt, Homo sapiens
auuccauuuguuaucacacccg

SEQ ID NO: 205096 - RNA, 22 nt, Homo sapiens
auucccuuagcugccucagccu

SEQ ID NO: 205097 - RNA, 23 nt, Homo sapiens
auugcagaaucacagagguagug

SEQ ID NO: 205098 - RNA, 22 nt, Homo sapiens
auugcaguuagaacagaagucu

SEQ ID NO: 205099 - RNA, 22 nt, Homo sapiens
auuuggcauagaguaucauucu

SEQ ID NO: 205100 - RNA, 22 nt, Homo sapiens
caaugugcuuggggcacaugag

SEQ ID NO: 205101 - RNA, 22 nt, Homo sapiens
cacauguucaggagcacuuaga

SEQ ID NO: 205102 - RNA, 22 nt, Homo sapiens
cacauguuugcuacauuuuucu

SEQ ID NO: 205103 - RNA, 21 nt, Homo sapiens
cacugcacuugccuucugggu

SEQ ID NO: 205104 - RNA, 22 nt, Homo sapiens
cacuggucucauggcaugagag

SEQ ID NO: 205105 - RNA, 22 nt, Homo sapiens
cagagagcuugcccuuguauau

SEQ ID NO: 205106 - RNA, 22 nt, Homo sapiens
cagcaguuguuucggauuggga

SEQ ID NO: 205107 - RNA, 22 nt, Homo sapiens
caggaccucuugccuggaagcc

SEQ ID NO: 205108 - RNA, 22 nt, Homo sapiens
caggcuuuuccacacauggguu

SEQ ID NO: 205109 - RNA, 19 nt, Homo sapiens
cagguagugugcugacaug

SEQ ID NO: 205110 - RNA, 22 nt, Homo sapiens
caggugcauuggcugacaccug

SEQ ID NO: 205111 - RNA, 22 nt, Homo sapiens
cagugaauuucaggucaagagu

SEQ ID NO: 205112 - RNA, 22 nt, Homo sapiens
cagugcaaagccucugcccaga

SEQ ID NO: 205113 - RNA, 22 nt, Homo sapiens
cauggccuuuggaaugugucua

SEQ ID NO: 205114 - RNA, 22 nt, Homo sapiens
ccagugauuguauggugaaggu

SEQ ID NO: 205115 - RNA, 22 nt, Homo sapiens
ccauggcuauucuguaaggguu

SEQ ID NO: 205116 - RNA, 22 nt, Homo sapiens
cccaguaaucuugccaguuuuc

SEQ ID NO: 205117 - RNA, 22 nt, Homo sapiens
cccaguguuacgugacagccug

SEQ ID NO: 205118 - RNA, 22 nt, Homo sapiens
ccccauuugaacuccuucaacu

SEQ ID NO: 205119 - RNA, 22 nt, Homo sapiens
cccugaagaaagccuaggacau

SEQ ID NO: 205120 - RNA, 19 nt, Homo sapiens
cccuggcacauggaaaaug

SEQ ID NO: 205121 - RNA, 22 nt, Homo sapiens
ccucauggagaacaucugcuag

SEQ ID NO: 205122 - RNA, 21 nt, Homo sapiens
ccugaagaagugaccucugag

SEQ ID NO: 205123 - RNA, 19 nt, Homo sapiens
ccuuugguuuccaugacau

SEQ ID NO: 205124 - RNA, 22 nt, Homo sapiens
cgcuggugaucuagacccccaa

SEQ ID NO: 205125 - RNA, 22 nt, Homo sapiens
cuaagugaguauaauuuuaaga

SEQ ID NO: 205126 - RNA, 22 nt, Homo sapiens
cuagccuggagugcaguggugc

SEQ ID NO: 205127 - RNA, 22 nt, Homo sapiens
cuauuacuuuuauugaacucag

SEQ ID NO: 205128 - RNA, 22 nt, Homo sapiens
cucaaguaauccucccgccuug

SEQ ID NO: 205129 - RNA, 22 nt, Homo sapiens
cucaaguacaugggauuacagg

SEQ ID NO: 205130 - RNA, 22 nt, Homo sapiens
cucacagugacacgaaccccca

SEQ ID NO: 205131 - RNA, 22 nt, Homo sapiens
cucagugaagggcaagaggcaa

SEQ ID NO: 205132 - RNA, 22 nt, Homo sapiens
cucaguguuucagcugcucaga

SEQ ID NO: 205133 - RNA, 22 nt, Homo sapiens
cuccaggugucauccaccuccu

SEQ ID NO: 205134 - RNA, 22 nt, Homo sapiens
cuccuggugauuggagugugaa

SEQ ID NO: 205135 - RNA, 22 nt, Homo sapiens
cucugacagugguuagcacugu

SEQ ID NO: 205136 - RNA, 22 nt, Homo sapiens
cugagaucguggggcugcuguc

SEQ ID NO: 205137 - RNA, 20 nt, Homo sapiens
cugaggugggagaaucgcuu

SEQ ID NO: 205138 - RNA, 19 nt, Homo sapiens
cugcacugagaaaaggagg

SEQ ID NO: 205139 - RNA, 22 nt, Homo sapiens
cuggaaaguagacaaucuaaaa

SEQ ID NO: 205140 - RNA, 18 nt, Homo sapiens
cuggaaggcuacuacagu

SEQ ID NO: 205141 - RNA, 22 nt, Homo sapiens
cuggcaccauacacuguuguug

SEQ ID NO: 205142 - RNA, 22 nt, Homo sapiens
cuggcucugggcuaaagaaaua

SEQ ID NO: 205143 - RNA, 21 nt, Homo sapiens
cugguccccuuuauguaugug

SEQ ID NO: 205144 - RNA, 22 nt, Homo sapiens
cuguaaagaucacagagcuggu

SEQ ID NO: 205145 - RNA, 22 nt, Homo sapiens
cuguacucaucccauaugcacu

SEQ ID NO: 205146 - RNA, 22 nt, Homo sapiens
cugugcuugauuauaugagugu

SEQ ID NO: 205147 - RNA, 22 nt, Homo sapiens
cuguugguuaaauuccaugcag

SEQ ID NO: 205148 - RNA, 22 nt, Homo sapiens
cuugccuuugucuucaaaggcu

SEQ ID NO: 205149 - RNA, 22 nt, Homo sapiens
cuuggcuuguuguccccugcuc

SEQ ID NO: 205150 - RNA, 22 nt, Homo sapiens
cuuuaugagguuggauggaucu

SEQ ID NO: 205151 - RNA, 22 nt, Homo sapiens
cuuucucagugagacccgagau

SEQ ID NO: 205152 - RNA, 22 nt, Homo sapiens
cuuuggucaauugcugcgggga

SEQ ID NO: 205153 - RNA, 18 nt, Homo sapiens
cuuugguccccgcacccu

SEQ ID NO: 205154 - RNA, 19 nt, Homo sapiens
cuuugguugagcguguugg

SEQ ID NO: 205155 - RNA, 22 nt, Homo sapiens
cuuuugcugggucagcgguggu

SEQ ID NO: 205156 - RNA, 22 nt, Homo sapiens
gaaagacuuucugcuguggaua

SEQ ID NO: 205157 - RNA, 22 nt, Homo sapiens
gaaagugcugcaaggccaugca

SEQ ID NO: 205158 - RNA, 22 nt, Homo sapiens
gaaaugucugagauguggcuca

SEQ ID NO: 205159 - RNA, 23 nt, Homo sapiens
gaaaugucuuagugaaauugcuu

SEQ ID NO: 205160 - RNA, 22 nt, Homo sapiens
gaauggaacugacuauagcuga

SEQ ID NO: 205161 - RNA, 22 nt, Homo sapiens
gaauucugucgcuuacuagaug

SEQ ID NO: 205162 - RNA, 22 nt, Homo sapiens
gacaucauuaugagauuuaaac

SEQ ID NO: 205163 - RNA, 17 nt, Homo sapiens
gacgaucaucaggaggc

SEQ ID NO: 205164 - RNA, 18 nt, Homo sapiens
gacuccauuucagccaga

SEQ ID NO: 205165 - RNA, 22 nt, Homo sapiens
gagaaugagaggggaaggccac

SEQ ID NO: 205166 - RNA, 22 nt, Homo sapiens
gagacugagucuugcucuguca

SEQ ID NO: 205167 - RNA, 22 nt, Homo sapiens
gagauggagacuuggccuuaaa

SEQ ID NO: 205168 - RNA, 22 nt, Homo sapiens
gagaugguacacauacgauucu

SEQ ID NO: 205169 - RNA, 22 nt, Homo sapiens
gaggaaguagcuacugucuuuc

SEQ ID NO: 205170 - RNA, 22 nt, Homo sapiens
gaggcauuauucccaucuuaca

SEQ ID NO: 205171 - RNA, 22 nt, Homo sapiens
gagguaagaaagucaguccuuc

SEQ ID NO: 205172 - RNA, 22 nt, Homo sapiens
gagguaucauuauguugcccag

SEQ ID NO: 205173 - RNA, 22 nt, Homo sapiens
gaggucauguggcaggcagcca

SEQ ID NO: 205174 - RNA, 22 nt, Homo sapiens
gagucagugucuugcucuguca

SEQ ID NO: 205175 - RNA, 22 nt, Homo sapiens
gagugcugagcccacuuccuug

SEQ ID NO: 205176 - RNA, 22 nt, Homo sapiens
gauauuacuuccaauauugcaa

SEQ ID NO: 205177 - RNA, 22 nt, Homo sapiens
gaucacauuguuucauacauau

SEQ ID NO: 205178 - RNA, 22 nt, Homo sapiens
gauuccauugcgaauuuucaga

SEQ ID NO: 205179 - RNA, 22 nt, Homo sapiens
gauuggcauugcugcaccugag

SEQ ID NO: 205180 - RNA, 22 nt, Homo sapiens
gcaagaaugagaaggauuaauu

SEQ ID NO: 205181 - RNA, 22 nt, Homo sapiens
gcaaugcugucugugcacagau

SEQ ID NO: 205182 - RNA, 22 nt, Homo sapiens
gcacagaugaggagaggucuca

SEQ ID NO: 205183 - RNA, 22 nt, Homo sapiens
gcacauggccccaucgugccga

SEQ ID NO: 205184 - RNA, 22 nt, Homo sapiens
gcaccaugguagaauaauggua

SEQ ID NO: 205185 - RNA, 22 nt, Homo sapiens
gcacccugucaaaauggaccaa

SEQ ID NO: 205186 - RNA, 22 nt, Homo sapiens
gcacgugcucauuugaggucuu

SEQ ID NO: 205187 - RNA, 22 nt, Homo sapiens
gcagcaucaaaucacacaagau

SEQ ID NO: 205188 - RNA, 22 nt, Homo sapiens
gcagguauuagagagccugaaa

SEQ ID NO: 205189 - RNA, 22 nt, Homo sapiens
gcaguauuguugaaauguccau

SEQ ID NO: 205190 - RNA, 22 nt, Homo sapiens
gcagugugaucacagcuuacug

SEQ ID NO: 205191 - RNA, 20 nt, Homo sapiens
gccacaguuaagcuucugcc

SEQ ID NO: 205192 - RNA, 22 nt, Homo sapiens
gccugagaggauaugauccccu

SEQ ID NO: 205193 - RNA, 22 nt, Homo sapiens
gcuacugucuaucugugcuucu

SEQ ID NO: 205194 - RNA, 22 nt, Homo sapiens
gcuccuuugaguagcuucugug

SEQ ID NO: 205195 - RNA, 17 nt, Homo sapiens
gcugcauucauguagaa

SEQ ID NO: 205196 - RNA, 22 nt, Homo sapiens
gcuggcaagaugcugaugcaac

SEQ ID NO: 205197 - RNA, 22 nt, Homo sapiens
ggaaaguccuucuguaggcucc

SEQ ID NO: 205198 - RNA, 18 nt, Homo sapiens
ggaagccuauuuaguaac

SEQ ID NO: 205199 - RNA, 22 nt, Homo sapiens
ggaguaggcuguccggcaccca

SEQ ID NO: 205200 - RNA, 22 nt, Homo sapiens
ggaguguuccauuugucacauu

SEQ ID NO: 205201 - RNA, 22 nt, Homo sapiens
ggaucacagagcuugggaaagg

SEQ ID NO: 205202 - RNA, 22 nt, Homo sapiens
ggcaaggugcuacagacaguga

SEQ ID NO: 205203 - RNA, 22 nt, Homo sapiens
ggcagguaaggagugggagccu

SEQ ID NO: 205204 - RNA, 22 nt, Homo sapiens
ggcaguuuguuugugaggucca

SEQ ID NO: 205205 - RNA, 22 nt, Homo sapiens
ggcuagauauucacauauggcu

SEQ ID NO: 205206 - RNA, 22 nt, Homo sapiens
gggaagugugcagaguucucuu

SEQ ID NO: 205207 - RNA, 22 nt, Homo sapiens
gggggagugugguacccagcau

SEQ ID NO: 205208 - RNA, 22 nt, Homo sapiens
ggugaggaaaguugaguuucua

SEQ ID NO: 205209 - RNA, 23 nt, Homo sapiens
ggugaggaguacagagucuucau

SEQ ID NO: 205210 - RNA, 22 nt, Homo sapiens
guaaauguccccugugauauug

SEQ ID NO: 205211 - RNA, 22 nt, Homo sapiens
guaagugguagagcugggcuau

SEQ ID NO: 205212 - RNA, 22 nt, Homo sapiens
guacauagucacacauauacau

SEQ ID NO: 205213 - RNA, 22 nt, Homo sapiens
guauggaagucaguuuguuggc

SEQ ID NO: 205214 - RNA, 22 nt, Homo sapiens
gucacaguggccagugauguuc

SEQ ID NO: 205215 - RNA, 22 nt, Homo sapiens
gucacauugaugcccauggugg

SEQ ID NO: 205216 - RNA, 22 nt, Homo sapiens
gucagggagggauagaugauua

SEQ ID NO: 205217 - RNA, 22 nt, Homo sapiens
guccaagacuaggaguuggcag

SEQ ID NO: 205218 - RNA, 22 nt, Homo sapiens
guccugaagaccuuccucugga

SEQ ID NO: 205219 - RNA, 22 nt, Homo sapiens
gucgugcagaccucacagcauu

SEQ ID NO: 205220 - RNA, 22 nt, Homo sapiens
gucucccagccuacauauuucu

SEQ ID NO: 205221 - RNA, 22 nt, Homo sapiens
gucuuccagccuccaucuuucu

SEQ ID NO: 205222 - RNA, 22 nt, Homo sapiens
gucuugaaggcugaguaccugu

SEQ ID NO: 205223 - RNA, 22 nt, Homo sapiens
gugacagucaaagacaugacuu

SEQ ID NO: 205224 - RNA, 22 nt, Homo sapiens
gugacugcauccauccaggcuu

SEQ ID NO: 205225 - RNA, 22 nt, Homo sapiens
gugagacugaguuucgcucuug

SEQ ID NO: 205226 - RNA, 22 nt, Homo sapiens
gugagaugugacuucugccucu

SEQ ID NO: 205227 - RNA, 22 nt, Homo sapiens
gugagauuagcugagauccuug

SEQ ID NO: 205228 - RNA, 22 nt, Homo sapiens
gugaggucguagucauaggcaa

SEQ ID NO: 205229 - RNA, 22 nt, Homo sapiens
gugaucuuucaggcuugaccau

SEQ ID NO: 205230 - RNA, 22 nt, Homo sapiens
gugcacaaaucuuaaauguaca

SEQ ID NO: 205231 - RNA, 21 nt, Homo sapiens
gugcacaguaguguuuaauag

SEQ ID NO: 205232 - RNA, 22 nt, Homo sapiens
gugcacauauggugcauaagug

SEQ ID NO: 205233 - RNA, 22 nt, Homo sapiens
gugcacaugcgugcgcacauau

SEQ ID NO: 205234 - RNA, 22 nt, Homo sapiens
gugcauacucuggagacauugu

SEQ ID NO: 205235 - RNA, 22 nt, Homo sapiens
guggaguaugaaaacugacuuu

SEQ ID NO: 205236 - RNA, 22 nt, Homo sapiens
guggagucaucacucagagugg

SEQ ID NO: 205237 - RNA, 22 nt, Homo sapiens
guggucagaaaucucaguggca

SEQ ID NO: 205238 - RNA, 22 nt, Homo sapiens
gugguuuuaucccagaaauuaa

SEQ ID NO: 205239 - RNA, 22 nt, Homo sapiens
gugucucagcccagaccuauuu

SEQ ID NO: 205240 - RNA, 22 nt, Homo sapiens
guuagaugaagaccaagggcaa

SEQ ID NO: 205241 - RNA, 22 nt, Homo sapiens
guuauguaucuugauugggugg

SEQ ID NO: 205242 - RNA, 17 nt, Homo sapiens
guucccaguggcauuug

SEQ ID NO: 205243 - RNA, 22 nt, Homo sapiens
guugcugagucccaucaccaga

SEQ ID NO: 205244 - RNA, 22 nt, Homo sapiens
guuggaguuaagcaguaaugaa

SEQ ID NO: 205245 - RNA, 19 nt, Homo sapiens
uaacacaguuguguuugag

SEQ ID NO: 205246 - RNA, 22 nt, Homo sapiens
uaacagcauuugugucuaguag

SEQ ID NO: 205247 - RNA, 22 nt, Homo sapiens
uaaggcuagcaagaugagaaua

SEQ ID NO: 205248 - RNA, 22 nt, Homo sapiens
uaagucuuuuuggaguuuauaa

SEQ ID NO: 205249 - RNA, 23 nt, Homo sapiens
uaaguucaucucuaauaggugga

SEQ ID NO: 205250 - RNA, 22 nt, Homo sapiens
uacaaagugggaaacgaagguu

SEQ ID NO: 205251 - RNA, 22 nt, Homo sapiens
uacaagcacaggcagcaggcug

SEQ ID NO: 205252 - RNA, 23 nt, Homo sapiens
uacagcugcagaaucaggcuaag

SEQ ID NO: 205253 - RNA, 19 nt, Homo sapiens
uacaggacugagcugaggu

SEQ ID NO: 205254 - RNA, 22 nt, Homo sapiens
uacagguaugugucuauauaca

SEQ ID NO: 205255 - RNA, 22 nt, Homo sapiens
uaccagugucagcuuccugugu

SEQ ID NO: 205256 - RNA, 22 nt, Homo sapiens
uacuccccuuguucugugagcu

SEQ ID NO: 205257 - RNA, 18 nt, Homo sapiens
uagaauauaggucauucu

SEQ ID NO: 205258 - RNA, 22 nt, Homo sapiens
uagagguagagugacuucccca

SEQ ID NO: 205259 - RNA, 22 nt, Homo sapiens
uagagguaggucuucgagucuc

SEQ ID NO: 205260 - RNA, 22 nt, Homo sapiens
uagcccagugagguugauuugg

SEQ ID NO: 205261 - RNA, 22 nt, Homo sapiens
uagcuccacagcuauauauaau

SEQ ID NO: 205262 - RNA, 21 nt, Homo sapiens
uagcugcacccaggccuccuu

SEQ ID NO: 205263 - RNA, 22 nt, Homo sapiens
uagcugcacuuacaagugagaa

SEQ ID NO: 205264 - RNA, 22 nt, Homo sapiens
uaggcacugagaauaugaggau

SEQ ID NO: 205265 - RNA, 22 nt, Homo sapiens
uaggucaguuuuggcuuggcuu

SEQ ID NO: 205266 - RNA, 22 nt, Homo sapiens
uaguaaacauaguucuuuugcu

SEQ ID NO: 205267 - RNA, 22 nt, Homo sapiens
uauauagcuaugucuguccauu

SEQ ID NO: 205268 - RNA, 22 nt, Homo sapiens
uaucaugucuguguguaccuag

SEQ ID NO: 205269 - RNA, 22 nt, Homo sapiens
uaugacugagacuuaaauugug

SEQ ID NO: 205270 - RNA, 22 nt, Homo sapiens
uauggcuacuacgaauaaugcu

SEQ ID NO: 205271 - RNA, 22 nt, Homo sapiens
uauggcuucuuauucuuucccg

SEQ ID NO: 205272 - RNA, 22 nt, Homo sapiens
uaugucuauuauguagcaggaa

SEQ ID NO: 205273 - RNA, 22 nt, Homo sapiens
uauuucaguugugcagguaguu

SEQ ID NO: 205274 - RNA, 22 nt, Homo sapiens
ucaagcaauucuccucucagcc

SEQ ID NO: 205275 - RNA, 22 nt, Homo sapiens
ucacacucucaccaacauuugg

SEQ ID NO: 205276 - RNA, 22 nt, Homo sapiens
ucacagauaaauaaagaugauu

SEQ ID NO: 205277 - RNA, 22 nt, Homo sapiens
ucacauggaaaaguccaguaaa

SEQ ID NO: 205278 - RNA, 22 nt, Homo sapiens
ucacaugucagccguggggaag

SEQ ID NO: 205279 - RNA, 22 nt, Homo sapiens
ucacuagggaucacuuuacccg

SEQ ID NO: 205280 - RNA, 22 nt, Homo sapiens
ucacugugcaugaaggaugcug

SEQ ID NO: 205281 - RNA, 22 nt, Homo sapiens
ucacuguguauguauaugcagg

SEQ ID NO: 205282 - RNA, 21 nt, Homo sapiens
ucagaagcucccagggaggac

SEQ ID NO: 205283 - RNA, 22 nt, Homo sapiens
ucaggugcagagaagaaauggg

SEQ ID NO: 205284 - RNA, 22 nt, Homo sapiens
ucaguaaaugcuguucucuuuu

SEQ ID NO: 205285 - RNA, 22 nt, Homo sapiens
ucagugccauugccauaugagu

SEQ ID NO: 205286 - RNA, 21 nt, Homo sapiens
ucagugcugugggcaaggugc

SEQ ID NO: 205287 - RNA, 22 nt, Homo sapiens
ucauaugucauaguaugaucuu

SEQ ID NO: 205288 - RNA, 22 nt, Homo sapiens
ucauucauucauccagcuugag

SEQ ID NO: 205289 - RNA, 22 nt, Homo sapiens
ucauucauuugcucacuccaca

SEQ ID NO: 205290 - RNA, 22 nt, Homo sapiens
ucauugcauuccagcccaagca

SEQ ID NO: 205291 - RNA, 22 nt, Homo sapiens
uccacuuuugugcugaauugga

SEQ ID NO: 205292 - RNA, 22 nt, Homo sapiens
uccagaguggugaugcuggggc

SEQ ID NO: 205293 - RNA, 22 nt, Homo sapiens
uccagugugcaggcaaguuuga

SEQ ID NO: 205294 - RNA, 22 nt, Homo sapiens
uccaguguuauaauaugcgucu

SEQ ID NO: 205295 - RNA, 22 nt, Homo sapiens
uccaguguuucuuccacuauuu

SEQ ID NO: 205296 - RNA, 22 nt, Homo sapiens
uccauggagacacauuuuauau

SEQ ID NO: 205297 - RNA, 19 nt, Homo sapiens
ucccaauguuuccaggcag

SEQ ID NO: 205298 - RNA, 22 nt, Homo sapiens
ucccaguauucauuuacagaag

SEQ ID NO: 205299 - RNA, 22 nt, Homo sapiens
ucccauguagcuaggauuacag

SEQ ID NO: 205300 - RNA, 22 nt, Homo sapiens
ucccuguguccugggggcaccu

SEQ ID NO: 205301 - RNA, 22 nt, Homo sapiens
uccgcagugucccucagaguga

SEQ ID NO: 205302 - RNA, 22 nt, Homo sapiens
uccuucaguccaguggguuuug

SEQ ID NO: 205303 - RNA, 22 nt, Homo sapiens
ucgcaccauugcacuccagcca

SEQ ID NO: 205304 - RNA, 22 nt, Homo sapiens
ucgcauuucccucuguagcuuc

SEQ ID NO: 205305 - RNA, 22 nt, Homo sapiens
ucuauggauaaaaugcccucau

SEQ ID NO: 205306 - RNA, 18 nt, Homo sapiens
ucucacagcaaucuguca

SEQ ID NO: 205307 - RNA, 22 nt, Homo sapiens
ucucagcacaaacaaaauugcu

SEQ ID NO: 205308 - RNA, 22 nt, Homo sapiens
ucucaguguuaucuaucugccu

SEQ ID NO: 205309 - RNA, 22 nt, Homo sapiens
ucucauggagucaggagcagaa

SEQ ID NO: 205310 - RNA, 22 nt, Homo sapiens
ucuccauuguccagaugaggaa

SEQ ID NO: 205311 - RNA, 17 nt, Homo sapiens
ucucccaucccuuucuc

SEQ ID NO: 205312 - RNA, 22 nt, Homo sapiens
ucucuagagagccugguguuca

SEQ ID NO: 205313 - RNA, 22 nt, Homo sapiens
ucucugaaacucuugacauccu

SEQ ID NO: 205314 - RNA, 22 nt, Homo sapiens
ucucugguuuguggaaucuuag

SEQ ID NO: 205315 - RNA, 22 nt, Homo sapiens
ucugauggaguugccagggaga

SEQ ID NO: 205316 - RNA, 22 nt, Homo sapiens
ucuggccccucucaaaucucau

SEQ ID NO: 205317 - RNA, 22 nt, Homo sapiens
ucugguggugaugagagacagu

SEQ ID NO: 205318 - RNA, 22 nt, Homo sapiens
ucugugcauuguaggauguuua

SEQ ID NO: 205319 - RNA, 21 nt, Homo sapiens
ucuguguugaucucacuggga

SEQ ID NO: 205320 - RNA, 22 nt, Homo sapiens
ucuuuagguguuauaguucaag

SEQ ID NO: 205321 - RNA, 23 nt, Homo sapiens
ucuuuggcucuaauauaccuugu

SEQ ID NO: 205322 - RNA, 22 nt, Homo sapiens
ucuuuguguaggucaaucuggc

SEQ ID NO: 205323 - RNA, 22 nt, Homo sapiens
ugaaggacauaaggcagaguga

SEQ ID NO: 205324 - RNA, 22 nt, Homo sapiens
ugaaggccgggcaugguggcuc

SEQ ID NO: 205325 - RNA, 22 nt, Homo sapiens
ugaaugguaauuuaguaggcac

SEQ ID NO: 205326 - RNA, 21 nt, Homo sapiens
ugaaugucuaggcagaaguuu

SEQ ID NO: 205327 - RNA, 22 nt, Homo sapiens
ugaauuguuucauucuuuacau

SEQ ID NO: 205328 - RNA, 22 nt, Homo sapiens
ugacaagaguagagagggugcc

SEQ ID NO: 205329 - RNA, 18 nt, Homo sapiens
ugacaucauuuagaaagg

SEQ ID NO: 205330 - RNA, 22 nt, Homo sapiens
ugacaugauguuccuacacugu

SEQ ID NO: 205331 - RNA, 22 nt, Homo sapiens
ugacauguugcauuauauuucc

SEQ ID NO: 205332 - RNA, 22 nt, Homo sapiens
ugacauugggagugaagugaag

SEQ ID NO: 205333 - RNA, 19 nt, Homo sapiens
ugaccagggacagaaacca

SEQ ID NO: 205334 - RNA, 22 nt, Homo sapiens
ugacccauagaaauguggauaa

SEQ ID NO: 205335 - RNA, 22 nt, Homo sapiens
ugacuauaggauaacaugcauu

SEQ ID NO: 205336 - RNA, 22 nt, Homo sapiens
ugacuggagaccucaguagggu

SEQ ID NO: 205337 - RNA, 22 nt, Homo sapiens
ugagaacucaugaaucuuucca

SEQ ID NO: 205338 - RNA, 22 nt, Homo sapiens
ugagaagugauauagaaguuaa

SEQ ID NO: 205339 - RNA, 22 nt, Homo sapiens
ugagacaucacaaaauccucaa

SEQ ID NO: 205340 - RNA, 22 nt, Homo sapiens
ugagacugguaauguguagggc

SEQ ID NO: 205341 - RNA, 22 nt, Homo sapiens
ugagagcugcauucuugaaagc

SEQ ID NO: 205342 - RNA, 22 nt, Homo sapiens
ugagaucgagucucgcucuguc

SEQ ID NO: 205343 - RNA, 22 nt, Homo sapiens
ugagaugaguugcuggcucuga

SEQ ID NO: 205344 - RNA, 22 nt, Homo sapiens
ugagcagaaguuuugauuggcg

SEQ ID NO: 205345 - RNA, 22 nt, Homo sapiens
ugagcagugagugugcugcagg

SEQ ID NO: 205346 - RNA, 22 nt, Homo sapiens
ugagggaugcguacccuaugcc

SEQ ID NO: 205347 - RNA, 22 nt, Homo sapiens
ugagguaacaaacuaugaguua

SEQ ID NO: 205348 - RNA, 22 nt, Homo sapiens
ugagguugguauuacugucucu

SEQ ID NO: 205349 - RNA, 22 nt, Homo sapiens
ugagucagucucacucugcugc

SEQ ID NO: 205350 - RNA, 22 nt, Homo sapiens
ugagugaggcugggcagucccu

SEQ ID NO: 205351 - RNA, 22 nt, Homo sapiens
ugaucuguccaccucagcuucc

SEQ ID NO: 205352 - RNA, 22 nt, Homo sapiens
ugaugcugaugccugccagaag

SEQ ID NO: 205353 - RNA, 22 nt, Homo sapiens
ugaugguccauaguucauggua

SEQ ID NO: 205354 - RNA, 22 nt, Homo sapiens
ugaugguuuuaaaaagaggagu

SEQ ID NO: 205355 - RNA, 22 nt, Homo sapiens
ugcaagauaggcaguuugcacu

SEQ ID NO: 205356 - RNA, 22 nt, Homo sapiens
ugcagagaaacauuuuguauuu

SEQ ID NO: 205357 - RNA, 22 nt, Homo sapiens
ugcagugugauuuucuggcuga

SEQ ID NO: 205358 - RNA, 22 nt, Homo sapiens
ugcauccauucuagacucaucu

SEQ ID NO: 205359 - RNA, 22 nt, Homo sapiens
ugccagagacguagggaauauu

SEQ ID NO: 205360 - RNA, 22 nt, Homo sapiens
ugccaguauuuuauugagcauu

SEQ ID NO: 205361 - RNA, 22 nt, Homo sapiens
auaacagcauuauugcauacgu

SEQ ID NO: 205362 - RNA, 22 nt, Homo sapiens
auaacagcugcaaggcaaaagc

SEQ ID NO: 205363 - RNA, 22 nt, Homo sapiens
auaacauccuuucuuaucguug

SEQ ID NO: 205364 - RNA, 22 nt, Homo sapiens
auaagauaguggaagugggauu

SEQ ID NO: 205365 - RNA, 22 nt, Homo sapiens
auagcaauuugggaaucagacu

SEQ ID NO: 205366 - RNA, 22 nt, Homo sapiens
auagcacaguguguguacacca

SEQ ID NO: 205367 - RNA, 22 nt, Homo sapiens
auagcagugugaaaauguacua

SEQ ID NO: 205368 - RNA, 22 nt, Homo sapiens
auagcagugugaaaauugacug

SEQ ID NO: 205369 - RNA, 22 nt, Homo sapiens
auagcagugugagaaugaacua

SEQ ID NO: 205370 - RNA, 22 nt, Homo sapiens
auauaugcuaagugcuaauaaa

SEQ ID NO: 205371 - RNA, 22 nt, Homo sapiens
auaucagugucuuacuguuuuu

SEQ ID NO: 205372 - RNA, 22 nt, Homo sapiens
auauguaguauggaaacauugu

SEQ ID NO: 205373 - RNA, 22 nt, Homo sapiens
auauuacuggcuauaucgcaag

SEQ ID NO: 205374 - RNA, 22 nt, Homo sapiens
aucacagaguuaaaacuuucuu

SEQ ID NO: 205375 - RNA, 22 nt, Homo sapiens
aucagauggcuaaaacagaaga

SEQ ID NO: 205376 - RNA, 22 nt, Homo sapiens
aucagauguuuguauaggagua

SEQ ID NO: 205377 - RNA, 22 nt, Homo sapiens
auccugagacuuuucugaaguu

SEQ ID NO: 205378 - RNA, 22 nt, Homo sapiens
aucugguguccucgugggaguc

SEQ ID NO: 205379 - RNA, 22 nt, Homo sapiens
aucuuguccugagguuuuauug

SEQ ID NO: 205380 - RNA, 22 nt, Homo sapiens
augaaugucuuauuuugagaaa

SEQ ID NO: 205381 - RNA, 22 nt, Homo sapiens
augacauugaugcucuggcugg

SEQ ID NO: 205382 - RNA, 17 nt, Homo sapiens
augacuucuucagugug

SEQ ID NO: 205383 - RNA, 22 nt, Homo sapiens
augagauacuacaaaugaguuu

SEQ ID NO: 205384 - RNA, 22 nt, Homo sapiens
augagauauuuuauaagaucau

SEQ ID NO: 205385 - RNA, 22 nt, Homo sapiens
augaggcacugcgcccuacuga

SEQ ID NO: 205386 - RNA, 22 nt, Homo sapiens
augaggcaggaaaggcguaucu

SEQ ID NO: 205387 - RNA, 22 nt, Homo sapiens
augaucauggaagugcacccau

SEQ ID NO: 205388 - RNA, 22 nt, Homo sapiens
augauugaccaucugcugggcu

SEQ ID NO: 205389 - RNA, 19 nt, Homo sapiens
augauugucuauggaggaa

SEQ ID NO: 205390 - RNA, 22 nt, Homo sapiens
augcaaaucuuaaguaugugug

SEQ ID NO: 205391 - RNA, 22 nt, Homo sapiens
augcauauuccugggccucacu

SEQ ID NO: 205392 - RNA, 22 nt, Homo sapiens
auggacagaaaaaaauagaugu

SEQ ID NO: 205393 - RNA, 22 nt, Homo sapiens
ucccagugaaaccccaccuuca

SEQ ID NO: 205394 - RNA, 22 nt, Homo sapiens
ucccagugcuaugcaaaagccu

SEQ ID NO: 205395 - RNA, 19 nt, Homo sapiens
uccccgggucuagugcagc

SEQ ID NO: 205396 - RNA, 22 nt, Homo sapiens
ucccgaggacaucugggggcaa

SEQ ID NO: 205397 - RNA, 18 nt, Homo sapiens
ucccucagaauuauagaa

SEQ ID NO: 205398 - RNA, 22 nt, Homo sapiens
ucccuggagcaagagaagaagg

SEQ ID NO: 205399 - RNA, 22 nt, Homo sapiens
ucccuugagccuggcuucucac

SEQ ID NO: 205400 - RNA, 22 nt, Homo sapiens
uccugagacucacaggcucccc

SEQ ID NO: 205401 - RNA, 22 nt, Homo sapiens
uccuugagaggacagagccaua

SEQ ID NO: 205402 - RNA, 19 nt, Homo sapiens
uccuugauugcaccacugc

SEQ ID NO: 205403 - RNA, 22 nt, Homo sapiens
uccuuggugacauuucuugucu

SEQ ID NO: 205404 - RNA, 21 nt, Homo sapiens
uccuuggugaugcccugcagu

SEQ ID NO: 205405 - RNA, 22 nt, Homo sapiens
uccuuuggcuaacuuucuaagu

SEQ ID NO: 205406 - RNA, 22 nt, Homo sapiens
ucgcugggaagacugaaguguc

SEQ ID NO: 205407 - RNA, 19 nt, Homo sapiens
ucugacagccccagucaac

SEQ ID NO: 205408 - RNA, 22 nt, Homo sapiens
ucugacagugagagaaaucuga

SEQ ID NO: 205409 - RNA, 20 nt, Homo sapiens
ucuggccccuccaaaucuca

SEQ ID NO: 205410 - RNA, 16 nt, Homo sapiens
ucuggcucuacaguuc

SEQ ID NO: 205411 - RNA, 22 nt, Homo sapiens
ucuguacuuccguaccuaaagu

SEQ ID NO: 205412 - RNA, 22 nt, Homo sapiens
ucugugcauuacacuuuucuca

SEQ ID NO: 205413 - RNA, 22 nt, Homo sapiens
ucugugcauuuucuuuuagacu

SEQ ID NO: 205414 - RNA, 22 nt, Homo sapiens
ucuuaguuuagauuagcaauuc

SEQ ID NO: 205415 - RNA, 23 nt, Homo sapiens
ucuuguacuuugagugagcaugg

SEQ ID NO: 205416 - RNA, 22 nt, Homo sapiens
ugaaauacuuuggcucuuuguu

SEQ ID NO: 205417 - RNA, 22 nt, Homo sapiens
ugaauacagcacacccaugggu

SEQ ID NO: 205418 - RNA, 22 nt, Homo sapiens
ugaauguccauugauguuuuga

SEQ ID NO: 205419 - RNA, 22 nt, Homo sapiens
ugaauguuugcagcuuauacca

SEQ ID NO: 205420 - RNA, 20 nt, Homo sapiens
uggcaugaaauuuuccaagc

SEQ ID NO: 205421 - RNA, 23 nt, Homo sapiens
uggcauuuuaguuagcuucagug

SEQ ID NO: 205422 - RNA, 22 nt, Homo sapiens
uggccagugucggaggccagga

SEQ ID NO: 205423 - RNA, 22 nt, Homo sapiens
ugggaagaagguuuacuugcca

SEQ ID NO: 205424 - RNA, 22 nt, Homo sapiens
ugggaagaugcugcuucuuccu

SEQ ID NO: 205425 - RNA, 22 nt, Homo sapiens
uggucucuuugcuuuagucauc

SEQ ID NO: 205426 - RNA, 22 nt, Homo sapiens
uguaauguuucaucauuauuaa

SEQ ID NO: 205427 - RNA, 22 nt, Homo sapiens
uguauaggcaaauuuccucaug

SEQ ID NO: 205428 - RNA, 22 nt, Homo sapiens
ugucaauauguaauaacugaau

SEQ ID NO: 205429 - RNA, 23 nt, Homo sapiens
ugucaucaagaugaggucacacu

SEQ ID NO: 205430 - RNA, 22 nt, Homo sapiens
ugucauggucacaggcauuuca

SEQ ID NO: 205431 - RNA, 22 nt, Homo sapiens
ugucucaguuacggcaauucca

SEQ ID NO: 205432 - RNA, 22 nt, Homo sapiens
ugucuugagagaggacaugacu

SEQ ID NO: 205433 - RNA, 22 nt, Homo sapiens
ugugcaaaaacaauugcgguuu

SEQ ID NO: 205434 - RNA, 22 nt, Homo sapiens
ugugcaaauguuaaacuaacuu

SEQ ID NO: 205435 - RNA, 22 nt, Homo sapiens
ugugcacauaacauuuuuuuag

SEQ ID NO: 205436 - RNA, 23 nt, Homo sapiens
ugugcacauuuacauauauacac

SEQ ID NO: 205437 - RNA, 22 nt, Homo sapiens
uguggcauugaauaaccuugga

SEQ ID NO: 205438 - RNA, 18 nt, Homo sapiens
uguggcuguuuuccaaua

SEQ ID NO: 205439 - RNA, 22 nt, Homo sapiens
ugugucuuguuuuuucccaggc

SEQ ID NO: 205440 - RNA, 22 nt, Homo sapiens
uguuacagcagcacaaaaugga

SEQ ID NO: 205441 - RNA, 22 nt, Homo sapiens
uguucuugagccuuuagaccua

SEQ ID NO: 205442 - RNA, 22 nt, Homo sapiens
uguucuugaguugggaguacaa

SEQ ID NO: 205443 - RNA, 18 nt, Homo sapiens
uguugguguucacucacu

SEQ ID NO: 205444 - RNA, 22 nt, Homo sapiens
uguuuaguuaagacauagaauu

SEQ ID NO: 205445 - RNA, 22 nt, Homo sapiens
uguuugcuuaacguggagccag

SEQ ID NO: 205446 - RNA, 22 nt, Homo sapiens
guauacuucugaaaauagcuau

SEQ ID NO: 205447 - RNA, 22 nt, Homo sapiens
guaugacacaggaagcuuaacc

SEQ ID NO: 205448 - RNA, 22 nt, Homo sapiens
guaugucuugucuauggcugcu

SEQ ID NO: 205449 - RNA, 22 nt, Homo sapiens
gucagaaucucagaugacaacg

SEQ ID NO: 205450 - RNA, 22 nt, Homo sapiens
gucagguaccugaaagcagcca

SEQ ID NO: 205451 - RNA, 22 nt, Homo sapiens
gucaggugcuuacgcggagauc

SEQ ID NO: 205452 - RNA, 22 nt, Homo sapiens
gucagugauugauuuaaagacg

SEQ ID NO: 205453 - RNA, 22 nt, Homo sapiens
gucaguggagaaaaggacaugu

SEQ ID NO: 205454 - RNA, 22 nt, Homo sapiens
gucaguggauacugucucuguc

SEQ ID NO: 205455 - RNA, 22 nt, Homo sapiens
gucauccaggcuggagugaagc

SEQ ID NO: 205456 - RNA, 22 nt, Homo sapiens
gucccugaggaacauccagggc

SEQ ID NO: 205457 - RNA, 22 nt, Homo sapiens
gucuaugguucaggguggagug

SEQ ID NO: 205458 - RNA, 22 nt, Homo sapiens
gucucugguugcuuuuguacca

SEQ ID NO: 205459 - RNA, 22 nt, Homo sapiens
gucucuugguuuagagcauuua

SEQ ID NO: 205460 - RNA, 22 nt, Homo sapiens
gucuuugcauguauguucauga

SEQ ID NO: 205461 - RNA, 22 nt, Homo sapiens
gugaaagacagcauuaauggcu

SEQ ID NO: 205462 - RNA, 22 nt, Homo sapiens
gugaaguuuuuugcugagaguc

SEQ ID NO: 205463 - RNA, 22 nt, Homo sapiens
gugaauguuuucuuacauggua

SEQ ID NO: 205464 - RNA, 22 nt, Homo sapiens
gugagguauacugggaucacua

SEQ ID NO: 205465 - RNA, 17 nt, Homo sapiens
gugagguauccucaaaa

SEQ ID NO: 205466 - RNA, 22 nt, Homo sapiens
gugagguguuaaccaaccugug

SEQ ID NO: 205467 - RNA, 22 nt, Homo sapiens
gugagucagucuguguagggcu

SEQ ID NO: 205468 - RNA, 20 nt, Homo sapiens
gugagucauuaguaaccaaa

SEQ ID NO: 205469 - RNA, 21 nt, Homo sapiens
gugaucaugucacugcacucc

SEQ ID NO: 205470 - RNA, 22 nt, Homo sapiens
gugauugugaaaacauuaagaa

SEQ ID NO: 205471 - RNA, 22 nt, Homo sapiens
gugcaaacuccaggucucuuca

SEQ ID NO: 205472 - RNA, 22 nt, Homo sapiens
uucuugcacugaucccauaagc

SEQ ID NO: 205473 - RNA, 19 nt, Homo sapiens
uucuuuguugugggggcug

SEQ ID NO: 205474 - RNA, 22 nt, Homo sapiens
uugaaguagcauuucaugucua

SEQ ID NO: 205475 - RNA, 22 nt, Homo sapiens
uugagauggagucucacuccuu

SEQ ID NO: 205476 - RNA, 22 nt, Homo sapiens
uugagauggagucucacucuug

SEQ ID NO: 205477 - RNA, 22 nt, Homo sapiens
uugagauggagucucacucuuu

SEQ ID NO: 205478 - RNA, 22 nt, Homo sapiens
uugagauggaguuucacucucg

SEQ ID NO: 205479 - RNA, 19 nt, Homo sapiens
uugagaugugaacucacac

SEQ ID NO: 205480 - RNA, 22 nt, Homo sapiens
uugagguagcuuugauggaggu

SEQ ID NO: 205481 - RNA, 22 nt, Homo sapiens
uugaucaaaucugagugagaau

SEQ ID NO: 205482 - RNA, 22 nt, Homo sapiens
uugcaaacaucuuguuucacau

SEQ ID NO: 205483 - RNA, 22 nt, Homo sapiens
uugcaucagcuccugauguacu

SEQ ID NO: 205484 - RNA, 22 nt, Homo sapiens
uugccaucaucucuuacucagu

SEQ ID NO: 205485 - RNA, 22 nt, Homo sapiens
uuggagugugcucauaacugcu

SEQ ID NO: 205486 - RNA, 23 nt, Homo sapiens
uuggcaucugggacacaagcuga

SEQ ID NO: 205487 - RNA, 22 nt, Homo sapiens
uuggcauugaguuucaaaucau

SEQ ID NO: 205488 - RNA, 22 nt, Homo sapiens
uuggcucuggcugggcuccagc

SEQ ID NO: 205489 - RNA, 22 nt, Homo sapiens
uuggucagcuagauuauucccu

SEQ ID NO: 205490 - RNA, 22 nt, Homo sapiens
uuggucagcucaauggagaggg

SEQ ID NO: 205491 - RNA, 22 nt, Homo sapiens
uugguuuccuuccugcuuaacu

SEQ ID NO: 205492 - RNA, 22 nt, Homo sapiens
uugucccauggggucuuccuuu

SEQ ID NO: 205493 - RNA, 22 nt, Homo sapiens
uuguccuugagauaguuugcug

SEQ ID NO: 205494 - RNA, 22 nt, Homo sapiens
uugucucacuggaguuuaguaa

SEQ ID NO: 205495 - RNA, 22 nt, Homo sapiens
uugucuccuagacgaccaggcg

SEQ ID NO: 205496 - RNA, 22 nt, Homo sapiens
uugugauugagugauccuuguu

SEQ ID NO: 205497 - RNA, 22 nt, Homo sapiens
uuuaaacugucuuggguuugga

SEQ ID NO: 205498 - RNA, 22 nt, Homo sapiens
uuuaaagcacggaguuuguggc

SEQ ID NO: 205499 - RNA, 22 nt, Homo sapiens
uuuaaugcaucccaaaauguag

SEQ ID NO: 205500 - RNA, 22 nt, Homo sapiens
uuuacagucuuuugugugaguc

SEQ ID NO: 205501 - RNA, 22 nt, Homo sapiens
uuuauggagagauauuuauggu

SEQ ID NO: 205502 - RNA, 22 nt, Homo sapiens
uuucacagcaauugccuauugu

SEQ ID NO: 205503 - RNA, 22 nt, Homo sapiens
uuucauccggcuguguauuaug

SEQ ID NO: 205504 - RNA, 19 nt, Homo sapiens
uuuccaguaaucuuaugug

SEQ ID NO: 205505 - RNA, 22 nt, Homo sapiens
uuucccuuacuuaaacuuacuc

SEQ ID NO: 205506 - RNA, 22 nt, Homo sapiens
uuucccuuuagcuuagugauuu

SEQ ID NO: 205507 - RNA, 22 nt, Homo sapiens
uuucucaguguuucaggguagg

SEQ ID NO: 205508 - RNA, 21 nt, Homo sapiens
uuucugggggagcauggcagg

SEQ ID NO: 205509 - RNA, 22 nt, Homo sapiens
uuucugggggugcugauggaaa

SEQ ID NO: 205510 - RNA, 22 nt, Homo sapiens
uuugaagugugaugccuugaug

SEQ ID NO: 205511 - RNA, 22 nt, Homo sapiens
uuugcugagucugacuucaugg

SEQ ID NO: 205512 - RNA, 22 nt, Homo sapiens
uuuggcuuugagaagcagugga

SEQ ID NO: 205513 - RNA, 22 nt, Homo sapiens
uuuguacacgugggugaauugu

SEQ ID NO: 205514 - RNA, 22 nt, Homo sapiens
uuuguacuucauugguucuacu

SEQ ID NO: 205515 - RNA, 22 nt, Homo sapiens
uuuguacuugguguucuggaaa

SEQ ID NO: 205516 - RNA, 22 nt, Homo sapiens
uuuguuugaagucgagacaacu

SEQ ID NO: 205517 - RNA, 19 nt, Homo sapiens
uuuuguacucugugacuug

SEQ ID NO: 205518 - RNA, 22 nt, Homo sapiens
uuuuuggauaaugguacaugua

SEQ ID NO: 205519 - RNA, 22 nt, Homo sapiens
cauggcucuuugcugcuaaagu

SEQ ID NO: 205520 - RNA, 22 nt, Homo sapiens
cauugcaaugaggucuugcagu

SEQ ID NO: 205521 - RNA, 22 nt, Homo sapiens
cauuguacauaaguauggagua

SEQ ID NO: 205522 - RNA, 22 nt, Homo sapiens
ccacuguuuaaauggcugagga

SEQ ID NO: 205523 - RNA, 22 nt, Homo sapiens
ccagugguugggccggagacgg

SEQ ID NO: 205524 - RNA, 22 nt, Homo sapiens
ccagugucugacagacacggcg

SEQ ID NO: 205525 - RNA, 22 nt, Homo sapiens
ccaguuuucccagcaccauuaa

SEQ ID NO: 205526 - RNA, 23 nt, Homo sapiens
ccauugcacuccagccucaguga

SEQ ID NO: 205527 - RNA, 22 nt, Homo sapiens
cccagaguucuuaaauacugag

SEQ ID NO: 205528 - RNA, 17 nt, Homo sapiens
cccuaguagcugggacu

SEQ ID NO: 205529 - RNA, 22 nt, Homo sapiens
ccucauggagaaccucugcuag

SEQ ID NO: 205530 - RNA, 22 nt, Homo sapiens
cuaaaugucucuacuaaguuua

SEQ ID NO: 205531 - RNA, 22 nt, Homo sapiens
cuauaacagugugguuuggaga

SEQ ID NO: 205532 - RNA, 22 nt, Homo sapiens
cuauggcagccacggccuggag

SEQ ID NO: 205533 - RNA, 22 nt, Homo sapiens
cuauggcucugguuauggcugu

SEQ ID NO: 205534 - RNA, 22 nt, Homo sapiens
cuauggcuguaaggauaguaac

SEQ ID NO: 205535 - RNA, 22 nt, Homo sapiens
cuaugguuucucaaacuccuga

SEQ ID NO: 205536 - RNA, 22 nt, Homo sapiens
cucacagucucucccuaauuuu

SEQ ID NO: 205537 - RNA, 22 nt, Homo sapiens
cucagagcacaguuuaugacag

SEQ ID NO: 205538 - RNA, 22 nt, Homo sapiens
cucagcuacuugggaagcugag

SEQ ID NO: 205539 - RNA, 22 nt, Homo sapiens
cucaguggauuagauaaugcac

SEQ ID NO: 205540 - RNA, 22 nt, Homo sapiens
cucagugguugauuuauuuauc

SEQ ID NO: 205541 - RNA, 22 nt, Homo sapiens
agcaagauugauggccugcagg

SEQ ID NO: 205542 - RNA, 22 nt, Homo sapiens
agcacaguuaaaugaggcuucu

SEQ ID NO: 205543 - RNA, 19 nt, Homo sapiens
agcagaacaaauguguggg

SEQ ID NO: 205544 - RNA, 17 nt, Homo sapiens
agcagcccauaucccca

SEQ ID NO: 205545 - RNA, 22 nt, Homo sapiens
agcagguguccacaauguuugc

SEQ ID NO: 205546 - RNA, 22 nt, Homo sapiens
agccccauuuguugaaaagacg

SEQ ID NO: 205547 - RNA, 18 nt, Homo sapiens
agcucaguguuugcuuac

SEQ ID NO: 205548 - RNA, 22 nt, Homo sapiens
agcuccaugauaguaugucugu

SEQ ID NO: 205549 - RNA, 22 nt, Homo sapiens
agcugccagucuuguaaggccu

SEQ ID NO: 205550 - RNA, 22 nt, Homo sapiens
agcuggaauuuaagguagauag

SEQ ID NO: 205551 - RNA, 22 nt, Homo sapiens
agcuggauguauguuaagugaa

SEQ ID NO: 205552 - RNA, 22 nt, Homo sapiens
aggaucauugacuauuauaagg

SEQ ID NO: 205553 - RNA, 19 nt, Homo sapiens
aggcauugugcucaucugu

SEQ ID NO: 205554 - RNA, 22 nt, Homo sapiens
agggcuuaucuguguagaguuc

SEQ ID NO: 205555 - RNA, 22 nt, Homo sapiens
aggugaaugcucacauucuaau

SEQ ID NO: 205556 - RNA, 20 nt, Homo sapiens
aguauucacuuuuuucaugg

SEQ ID NO: 205557 - RNA, 22 nt, Homo sapiens
agucagucuguccugugcugag

SEQ ID NO: 205558 - RNA, 22 nt, Homo sapiens
gucuggcuccugucuaaucacu

SEQ ID NO: 205559 - RNA, 22 nt, Homo sapiens
gucuguuuggggaccuguggcc

SEQ ID NO: 205560 - RNA, 22 nt, Homo sapiens
gucuuuguuuugauuuaccaga

SEQ ID NO: 205561 - RNA, 22 nt, Homo sapiens
gucuuuugcuagccagagagcu

SEQ ID NO: 205562 - RNA, 22 nt, Homo sapiens
gugagaugaggucucacucugu

SEQ ID NO: 205563 - RNA, 22 nt, Homo sapiens
gugaggcugguccugccuccca

SEQ ID NO: 205564 - RNA, 22 nt, Homo sapiens
gugagguacgugucaagaacca

SEQ ID NO: 205565 - RNA, 22 nt, Homo sapiens
gugaucuucauggaaggugaaa

SEQ ID NO: 205566 - RNA, 22 nt, Homo sapiens
gugccacaguguuaagggauuc

SEQ ID NO: 205567 - RNA, 22 nt, Homo sapiens
gugccuuuucugagcaaugagc

SEQ ID NO: 205568 - RNA, 22 nt, Homo sapiens
guggaagguaaugcagcuuacu

SEQ ID NO: 205569 - RNA, 22 nt, Homo sapiens
guggaaggucaugaauguucuu

SEQ ID NO: 205570 - RNA, 22 nt, Homo sapiens
gugggauggaaaugggcuucag

SEQ ID NO: 205571 - RNA, 22 nt, Homo sapiens
gugggauggagagaagguauga

SEQ ID NO: 205572 - RNA, 22 nt, Homo sapiens
gugugcacaaucuggcaugugc

SEQ ID NO: 205573 - RNA, 23 nt, Homo sapiens
guuaagugaauguguacucuauu

SEQ ID NO: 205574 - RNA, 22 nt, Homo sapiens
guuggcuguuucccccaaguga

SEQ ID NO: 205575 - RNA, 22 nt, Homo sapiens
guuguggcuugugauuaagcac

SEQ ID NO: 205576 - RNA, 22 nt, Homo sapiens
uaacaagagagucagucagucc

SEQ ID NO: 205577 - RNA, 22 nt, Homo sapiens
uaacagcucuacagcugcucuu

SEQ ID NO: 205578 - RNA, 22 nt, Homo sapiens
uaacaggcaaggucacaccuug

SEQ ID NO: 205579 - RNA, 22 nt, Homo sapiens
uaaggcaaaccuuggcugcagu

SEQ ID NO: 205580 - RNA, 22 nt, Homo sapiens
uaaggcaaguuuuuaguggaca

SEQ ID NO: 205581 - RNA, 22 nt, Homo sapiens
uaaggcauuuuuuugaguugca

SEQ ID NO: 205582 - RNA, 22 nt, Homo sapiens
uaagugaauauggacaguuagc

SEQ ID NO: 205583 - RNA, 22 nt, Homo sapiens
uaagugaauguuggcuacugaa

SEQ ID NO: 205584 - RNA, 22 nt, Homo sapiens
uaagugaauuugacagguaaug

SEQ ID NO: 205585 - RNA, 22 nt, Homo sapiens
uaagugcaugauuacaugcaua

SEQ ID NO: 205586 - RNA, 21 nt, Homo sapiens
cccugguguuuggaguuugag

SEQ ID NO: 205587 - RNA, 22 nt, Homo sapiens
ccuuggcaauggcuggggcuga

SEQ ID NO: 205588 - RNA, 22 nt, Homo sapiens
cuaaaguucuucugagagaaca

SEQ ID NO: 205589 - RNA, 22 nt, Homo sapiens
cuacucuggagagugacaauca

SEQ ID NO: 205590 - RNA, 22 nt, Homo sapiens
cuauggauuuacuguauagggu

SEQ ID NO: 205591 - RNA, 22 nt, Homo sapiens
cuauggcuguagucccugugua

SEQ ID NO: 205592 - RNA, 20 nt, Homo sapiens
cucacagacagcuucuuucu

SEQ ID NO: 205593 - RNA, 22 nt, Homo sapiens
cucccagagccaguuauaggcu

SEQ ID NO: 205594 - RNA, 20 nt, Homo sapiens
cucccugacaaauguggaaa

SEQ ID NO: 205595 - RNA, 22 nt, Homo sapiens
cugagaagaaacagguaaggac

SEQ ID NO: 205596 - RNA, 22 nt, Homo sapiens
cugagacuggugauuuaugaag

SEQ ID NO: 205597 - RNA, 22 nt, Homo sapiens
cugagagugguauguuuaagug

SEQ ID NO: 205598 - RNA, 22 nt, Homo sapiens
cugaggugauauauacauauuu

SEQ ID NO: 205599 - RNA, 21 nt, Homo sapiens
cugcauccauuucugagugau

SEQ ID NO: 205600 - RNA, 22 nt, Homo sapiens
cugcccuuucuauaugauguaa

SEQ ID NO: 205601 - RNA, 22 nt, Homo sapiens
cuggacaaaucuggaaagaacc

SEQ ID NO: 205602 - RNA, 22 nt, Homo sapiens
cuggaguuugaggcugcaguga

SEQ ID NO: 205603 - RNA, 22 nt, Homo sapiens
cugggauggaggagaauuagag

SEQ ID NO: 205604 - RNA, 22 nt, Homo sapiens
cugguuuguaaaguuccugaga

SEQ ID NO: 205605 - RNA, 22 nt, Homo sapiens
cugucacugggaggggcagcag

SEQ ID NO: 205606 - RNA, 22 nt, Homo sapiens
cugucucagccucuccaguagc

SEQ ID NO: 205607 - RNA, 22 nt, Homo sapiens
cugugcacaucuggcggcccga

SEQ ID NO: 205608 - RNA, 22 nt, Homo sapiens
cuuaacagugguauugaugacc

SEQ ID NO: 205609 - RNA, 22 nt, Homo sapiens
cuucacuggagucccuggauuc

SEQ ID NO: 205610 - RNA, 22 nt, Homo sapiens
cuucugauugaaaauggaguag

SEQ ID NO: 205611 - RNA, 22 nt, Homo sapiens
cuucuugagacuuaggcuuugg

SEQ ID NO: 205612 - RNA, 22 nt, Homo sapiens
cuugcacuccacuguucuccug

SEQ ID NO: 205613 - RNA, 19 nt, Homo sapiens
cuugugccugaagcuuggg

SEQ ID NO: 205614 - RNA, 22 nt, Homo sapiens
cuuuggucaauugcugugggga

SEQ ID NO: 205615 - RNA, 23 nt, Homo sapiens
cuuuguccccacccaaaucucau

SEQ ID NO: 205616 - RNA, 22 nt, Homo sapiens
gaaagugcugcuugacugggau

SEQ ID NO: 205617 - RNA, 22 nt, Homo sapiens
gaaaugcucagggguuuuccag

SEQ ID NO: 205618 - RNA, 22 nt, Homo sapiens
gaagguaguuuauagauguggu

SEQ ID NO: 205619 - RNA, 22 nt, Homo sapiens
gaaucccuugcauuaucccuuu

SEQ ID NO: 205620 - RNA, 20 nt, Homo sapiens
gacauguugguuugcugcac

SEQ ID NO: 205621 - RNA, 22 nt, Homo sapiens
gagagugcuuuggguguaggcc

SEQ ID NO: 205622 - RNA, 22 nt, Homo sapiens
gagaucaucuaaucuggccucu

SEQ ID NO: 205623 - RNA, 22 nt, Homo sapiens
gagaugauuugccccauguauu

SEQ ID NO: 205624 - RNA, 22 nt, Homo sapiens
gagauuaauacacaucaaaugc

SEQ ID NO: 205625 - RNA, 22 nt, Homo sapiens
gagcaguugagagugcuggcca

SEQ ID NO: 205626 - RNA, 22 nt, Homo sapiens
gaggcagucuguccauucucag

SEQ ID NO: 205627 - RNA, 22 nt, Homo sapiens
gagguaaguggauuaugagguc

SEQ ID NO: 205628 - RNA, 21 nt, Homo sapiens
gagguaccucauguaagugga

SEQ ID NO: 205629 - RNA, 22 nt, Homo sapiens
gaggugaaggucucaauaaaua

SEQ ID NO: 205630 - RNA, 22 nt, Homo sapiens
gaggugguagguucacagcagc

SEQ ID NO: 205631 - RNA, 22 nt, Homo sapiens
gaguauauuugcacuguuaugu

SEQ ID NO: 205632 - RNA, 22 nt, Homo sapiens
gaguuagguugucaaugucuua

SEQ ID NO: 205633 - RNA, 22 nt, Homo sapiens
gaguuguuuuaaggcacugacu

SEQ ID NO: 205634 - RNA, 22 nt, Homo sapiens
gauauguaaaaauuauaucuga

SEQ ID NO: 205635 - RNA, 22 nt, Homo sapiens
gauauguacagcucucuaggau

SEQ ID NO: 205636 - RNA, 22 nt, Homo sapiens
gaucagagugaaccuuguuaug

SEQ ID NO: 205637 - RNA, 22 nt, Homo sapiens
gaugaggcuagagacaugugua

SEQ ID NO: 205638 - RNA, 22 nt, Homo sapiens
gauggaauuaaaaucagaauca

SEQ ID NO: 205639 - RNA, 22 nt, Homo sapiens
gcaagaauggaacaggagagcc

SEQ ID NO: 205640 - RNA, 23 nt, Homo sapiens
gcagcaaugucacagggguccgg

SEQ ID NO: 205641 - RNA, 22 nt, Homo sapiens
gcauugcacuuggcauagacug

SEQ ID NO: 205642 - RNA, 22 nt, Homo sapiens
gccaguguuuuauugagaauuu

SEQ ID NO: 205643 - RNA, 22 nt, Homo sapiens
gccauggaggauuuauagaggc

SEQ ID NO: 205644 - RNA, 22 nt, Homo sapiens
gccccaguacaggcuccuuaga

SEQ ID NO: 205645 - RNA, 22 nt, Homo sapiens
gccuagagaaguaaauauuauc

SEQ ID NO: 205646 - RNA, 22 nt, Homo sapiens
gcguugcacuccagccugggua

SEQ ID NO: 205647 - RNA, 22 nt, Homo sapiens
gcuaaggcaggagcauugcuug

SEQ ID NO: 205648 - RNA, 17 nt, Homo sapiens
gcugauguuugcauuuu

SEQ ID NO: 205649 - RNA, 22 nt, Homo sapiens
gcugucaugagcaacacaugaa

SEQ ID NO: 205650 - RNA, 22 nt, Homo sapiens
gcuguuugccgccaucgcagac

SEQ ID NO: 205651 - RNA, 21 nt, Homo sapiens
ggaaaguuaaggaaauacccc

SEQ ID NO: 205652 - RNA, 22 nt, Homo sapiens
ggaagacaguguggugauuccu

SEQ ID NO: 205653 - RNA, 22 nt, Homo sapiens
ggaagccugcacucgggcaggg

SEQ ID NO: 205654 - RNA, 22 nt, Homo sapiens
ggagagcuaggcagagguuugu

SEQ ID NO: 205655 - RNA, 22 nt, Homo sapiens
ggagggugagaucaauuuggga

SEQ ID NO: 205656 - RNA, 22 nt, Homo sapiens
ggaguguguaggagaaagguaa

SEQ ID NO: 205657 - RNA, 23 nt, Homo sapiens
ggcaagaucucagcucacugcaa

SEQ ID NO: 205658 - RNA, 22 nt, Homo sapiens
ggcaguuuguucuugcuccuuu

SEQ ID NO: 205659 - RNA, 22 nt, Homo sapiens
gggagugugcacacaugguaua

SEQ ID NO: 205660 - RNA, 22 nt, Homo sapiens
gggaugaagcccuaggguuggu

SEQ ID NO: 205661 - RNA, 19 nt, Homo sapiens
ggucacagggguuacaagg

SEQ ID NO: 205662 - RNA, 22 nt, Homo sapiens
ggucacauugcuagcauggguu

SEQ ID NO: 205663 - RNA, 18 nt, Homo sapiens
aggaaugguaauacuuca

SEQ ID NO: 205664 - RNA, 22 nt, Homo sapiens
aggcaggugaaagauaguuuua

SEQ ID NO: 205665 - RNA, 22 nt, Homo sapiens
aggcaugguggcacauacaugu

SEQ ID NO: 205666 - RNA, 23 nt, Homo sapiens
aggcauuguacaguaauggaaaa

SEQ ID NO: 205667 - RNA, 22 nt, Homo sapiens
agggaauguaaguuuuaugaga

SEQ ID NO: 205668 - RNA, 22 nt, Homo sapiens
agguccauuauuuucauucaug

SEQ ID NO: 205669 - RNA, 22 nt, Homo sapiens
aggugcugagcagagaauccug

SEQ ID NO: 205670 - RNA, 22 nt, Homo sapiens
agucacagccuuuuacuuuaga

SEQ ID NO: 205671 - RNA, 22 nt, Homo sapiens
agucagauuggcauuuguuggg

SEQ ID NO: 205672 - RNA, 22 nt, Homo sapiens
agugcaguggcacaaucuuggc

SEQ ID NO: 205673 - RNA, 22 nt, Homo sapiens
agugcuuaauagauguccagca

SEQ ID NO: 205674 - RNA, 22 nt, Homo sapiens
agugucaggagacagguagcug

SEQ ID NO: 205675 - RNA, 22 nt, Homo sapiens
auaaguagaaugauggucaaaa

SEQ ID NO: 205676 - RNA, 20 nt, Homo sapiens
auagcagcaugauuuauagu

SEQ ID NO: 205677 - RNA, 22 nt, Homo sapiens
auaucacaaacaagucuguacu

SEQ ID NO: 205678 - RNA, 22 nt, Homo sapiens
auaucacucccaauaucgcagg

SEQ ID NO: 205679 - RNA, 22 nt, Homo sapiens
auaugcuaauuuuuagucgagc

SEQ ID NO: 205680 - RNA, 19 nt, Homo sapiens
auaugggguuugaacugug

SEQ ID NO: 205681 - RNA, 22 nt, Homo sapiens
auauguaguuucagaaguggaa

SEQ ID NO: 205682 - RNA, 22 nt, Homo sapiens
auauuacuggccauaucgcagg

SEQ ID NO: 205683 - RNA, 22 nt, Homo sapiens
auauugacuuucucuuagauca

SEQ ID NO: 205684 - RNA, 22 nt, Homo sapiens
aucaaaguaucucaauauggua

SEQ ID NO: 205685 - RNA, 22 nt, Homo sapiens
aucaagccaaagaaaguccuug

SEQ ID NO: 205686 - RNA, 22 nt, Homo sapiens
aucacagauauggguuuaaauc

SEQ ID NO: 205687 - RNA, 22 nt, Homo sapiens
aucacaguggucagguauagau

SEQ ID NO: 205688 - RNA, 22 nt, Homo sapiens
aucacaguuuuaccauuuggua

SEQ ID NO: 205689 - RNA, 20 nt, Homo sapiens
aucagagccggugaaagggc

SEQ ID NO: 205690 - RNA, 22 nt, Homo sapiens
aucccaguucagccucugacac

SEQ ID NO: 205691 - RNA, 22 nt, Homo sapiens
aucccugugacgagcaucccua

SEQ ID NO: 205692 - RNA, 22 nt, Homo sapiens
aucccugugauccaaucacuuc

SEQ ID NO: 205693 - RNA, 22 nt, Homo sapiens
aucccuguguccagcaccugug

SEQ ID NO: 205694 - RNA, 22 nt, Homo sapiens
auccucugagagaguuucauaa

SEQ ID NO: 205695 - RNA, 22 nt, Homo sapiens
aucucaguucaggcuggccaca

SEQ ID NO: 205696 - RNA, 20 nt, Homo sapiens
augaaggcaggugugaguuu

SEQ ID NO: 205697 - RNA, 22 nt, Homo sapiens
augacugagacuaacuuacuuu

SEQ ID NO: 205698 - RNA, 22 nt, Homo sapiens
augagguaauaaguccuuggaa

SEQ ID NO: 205699 - RNA, 20 nt, Homo sapiens
augagguguaugacacugaa

SEQ ID NO: 205700 - RNA, 15 nt, Homo sapiens
augaguuuuauggag

SEQ ID NO: 205701 - RNA, 18 nt, Homo sapiens
augcauauuuuaaguugu

SEQ ID NO: 205702 - RNA, 22 nt, Homo sapiens
augcauggucugaagucaaccu

SEQ ID NO: 205703 - RNA, 22 nt, Homo sapiens
augcuacuggauuuguauaaau

SEQ ID NO: 205704 - RNA, 22 nt, Homo sapiens
augcuuguguuggggcagugga

SEQ ID NO: 205705 - RNA, 22 nt, Homo sapiens
auggagcaaaacagauuuggga

SEQ ID NO: 205706 - RNA, 22 nt, Homo sapiens
auggaggaggaagcugaaacaa

SEQ ID NO: 205707 - RNA, 22 nt, Homo sapiens
auggcaaaauguuccuaguggu

SEQ ID NO: 205708 - RNA, 22 nt, Homo sapiens
auggccuuucuggcacauuucc

SEQ ID NO: 205709 - RNA, 22 nt, Homo sapiens
auggucccuguuccaugcuccu

SEQ ID NO: 205710 - RNA, 22 nt, Homo sapiens
augugcaaagcacuguucagca

SEQ ID NO: 205711 - RNA, 22 nt, Homo sapiens
augugcauaugaagcacagaca

SEQ ID NO: 205712 - RNA, 22 nt, Homo sapiens
auuaagugaaugaaguuguucc

SEQ ID NO: 205713 - RNA, 22 nt, Homo sapiens
auuauugacucauagaaaggau

SEQ ID NO: 205714 - RNA, 22 nt, Homo sapiens
auugccuagccuggucucaaaa

SEQ ID NO: 205715 - RNA, 22 nt, Homo sapiens
caaaccuguaggggccaagagg

SEQ ID NO: 205716 - RNA, 22 nt, Homo sapiens
caacacuguuuauuggauagcc

SEQ ID NO: 205717 - RNA, 22 nt, Homo sapiens
caacauccaccuccuggguuca

SEQ ID NO: 205718 - RNA, 22 nt, Homo sapiens
caagagagcugaugguuuuaaa

SEQ ID NO: 205719 - RNA, 22 nt, Homo sapiens
cacagcgacuuccgccuaccgg

SEQ ID NO: 205720 - RNA, 22 nt, Homo sapiens
cacaguagaauagagcacuagg

SEQ ID NO: 205721 - RNA, 22 nt, Homo sapiens
cacagucuugcaauauugagau

SEQ ID NO: 205722 - RNA, 22 nt, Homo sapiens
cacaguguuccagcuauuugaa

SEQ ID NO: 205723 - RNA, 21 nt, Homo sapiens
cacauggaggcagagagugua

SEQ ID NO: 205724 - RNA, 22 nt, Homo sapiens
cacauugaauuucugaugacaa

SEQ ID NO: 205725 - RNA, 22 nt, Homo sapiens
cacccgugcucccuccagcugc

SEQ ID NO: 205726 - RNA, 22 nt, Homo sapiens
cacccuugcagggacagcuuug

SEQ ID NO: 205727 - RNA, 22 nt, Homo sapiens
cacuaggcuggagugcaguggc

SEQ ID NO: 205728 - RNA, 21 nt, Homo sapiens
cacugguguugcuauaucaaa

SEQ ID NO: 205729 - RNA, 22 nt, Homo sapiens
cagagguauugcaaaagccuag

SEQ ID NO: 205730 - RNA, 22 nt, Homo sapiens
cagcucauugcagucucgaccu

SEQ ID NO: 205731 - RNA, 23 nt, Homo sapiens
cagcucauuuggguccccuuguc

SEQ ID NO: 205732 - RNA, 22 nt, Homo sapiens
uuggaugauaaagaagccuaag

SEQ ID NO: 205733 - RNA, 22 nt, Homo sapiens
uuggcagucugaggcacagacu

SEQ ID NO: 205734 - RNA, 22 nt, Homo sapiens
uuggcauuguggauggaaucau

SEQ ID NO: 205735 - RNA, 22 nt, Homo sapiens
uuggcccugcugaccauucccu

SEQ ID NO: 205736 - RNA, 22 nt, Homo sapiens
uugggcuugagggugcccaguc

SEQ ID NO: 205737 - RNA, 22 nt, Homo sapiens
uuggucaggagccucccucuuu

SEQ ID NO: 205738 - RNA, 22 nt, Homo sapiens
uuggucaggcuagaguguggug

SEQ ID NO: 205739 - RNA, 22 nt, Homo sapiens
uuggucugcucugauguuuucu

SEQ ID NO: 205740 - RNA, 22 nt, Homo sapiens
uugucacccuacauaacaggga

SEQ ID NO: 205741 - RNA, 22 nt, Homo sapiens
uugucaguguucacucaaagcu

SEQ ID NO: 205742 - RNA, 18 nt, Homo sapiens
aaaaagugcucaggccua

SEQ ID NO: 205743 - RNA, 22 nt, Homo sapiens
aaagugauguccaggcuuucag

SEQ ID NO: 205744 - RNA, 22 nt, Homo sapiens
aaagugcuaggauuaccugggg

SEQ ID NO: 205745 - RNA, 22 nt, Homo sapiens
aaagugcugggaucacacugaa

SEQ ID NO: 205746 - RNA, 22 nt, Homo sapiens
aaaguggugggauuccaggcau

SEQ ID NO: 205747 - RNA, 19 nt, Homo sapiens
aaaugugcacuguuuucca

SEQ ID NO: 205748 - RNA, 22 nt, Homo sapiens
aaauugcauugagcugcuuauu

SEQ ID NO: 205749 - RNA, 22 nt, Homo sapiens
aaauugcuuuugaagacuuagu

SEQ ID NO: 205750 - RNA, 22 nt, Homo sapiens
aacacuaucugccuuacaggga

SEQ ID NO: 205751 - RNA, 22 nt, Homo sapiens
aacugcuguuuggguacuggug

SEQ ID NO: 205752 - RNA, 23 nt, Homo sapiens
aagagguaugacuaugaagugga

SEQ ID NO: 205753 - RNA, 22 nt, Homo sapiens
aagaucauucagggaaggcuga

SEQ ID NO: 205754 - RNA, 22 nt, Homo sapiens
aagaugguauuucauuaguuuu

SEQ ID NO: 205755 - RNA, 22 nt, Homo sapiens
aagccacuguaccugucucuua

SEQ ID NO: 205756 - RNA, 22 nt, Homo sapiens
aagcugccuugcugaggagaaa

SEQ ID NO: 205757 - RNA, 22 nt, Homo sapiens
aagcuguuguucauccugaauu

SEQ ID NO: 205758 - RNA, 22 nt, Homo sapiens
aaggcaugcaaagaacauuuua

SEQ ID NO: 205759 - RNA, 22 nt, Homo sapiens
aaggcaugcugaguccuaaaag

SEQ ID NO: 205760 - RNA, 22 nt, Homo sapiens
aaggcuguuguguaauaggauu

SEQ ID NO: 205761 - RNA, 22 nt, Homo sapiens
aaggugcucucuuauguagaaa

SEQ ID NO: 205762 - RNA, 22 nt, Homo sapiens
aaggugcuguaagcauccaugu

SEQ ID NO: 205763 - RNA, 18 nt, Homo sapiens
aaggugcuucuguucuga

SEQ ID NO: 205764 - RNA, 22 nt, Homo sapiens
aaguacuguuuaaauugcagaa

SEQ ID NO: 205765 - RNA, 20 nt, Homo sapiens
aagugcuauuucuuuugugg

SEQ ID NO: 205766 - RNA, 22 nt, Homo sapiens
aagugcucuugaaacugccuua

SEQ ID NO: 205767 - RNA, 22 nt, Homo sapiens
aagugcugggauuggccgggca

SEQ ID NO: 205768 - RNA, 22 nt, Homo sapiens
aagugcuguaugggagccuagg

SEQ ID NO: 205769 - RNA, 22 nt, Homo sapiens
aagugcuuuguacagggguuga

SEQ ID NO: 205770 - RNA, 22 nt, Homo sapiens
aaguuaauguuuaagacuccua

SEQ ID NO: 205771 - RNA, 22 nt, Homo sapiens
aaucagagcccucugagcuuca

SEQ ID NO: 205772 - RNA, 22 nt, Homo sapiens
aaucagcacacugugcuuucca

SEQ ID NO: 205773 - RNA, 22 nt, Homo sapiens
aauggcacuuuauaaauguuaa

SEQ ID NO: 205774 - RNA, 22 nt, Homo sapiens
acaaagugccuccuuuuagagu

SEQ ID NO: 205775 - RNA, 22 nt, Homo sapiens
acaauguauauuuuacuguagg

SEQ ID NO: 205776 - RNA, 22 nt, Homo sapiens
acaccaugucuguuucugguuu

SEQ ID NO: 205777 - RNA, 22 nt, Homo sapiens
acacuguagcugagggcaugcg

SEQ ID NO: 205778 - RNA, 22 nt, Homo sapiens
acacuguauccuucuguccuuu

SEQ ID NO: 205779 - RNA, 22 nt, Homo sapiens
acagaacugggcuugcuuuugg

SEQ ID NO: 205780 - RNA, 22 nt, Homo sapiens
acagguacaagggauuaggaug

SEQ ID NO: 205781 - RNA, 22 nt, Homo sapiens
acagugcuuucaauguucagua

SEQ ID NO: 205782 - RNA, 17 nt, Homo sapiens
acagugcuuugcuuucc

SEQ ID NO: 205783 - RNA, 22 nt, Homo sapiens
acauggcacugcgggcuucuug

SEQ ID NO: 205784 - RNA, 22 nt, Homo sapiens
acccucagaccaguuucccugg

SEQ ID NO: 205785 - RNA, 22 nt, Homo sapiens
acccuguugagcaacuggccau

SEQ ID NO: 205786 - RNA, 22 nt, Homo sapiens
acuacaugugaugucaguauau

SEQ ID NO: 205787 - RNA, 22 nt, Homo sapiens
acucagagaacauucccagucu

SEQ ID NO: 205788 - RNA, 22 nt, Homo sapiens
acuguauagauggaguugauuu

SEQ ID NO: 205789 - RNA, 23 nt, Homo sapiens
agaaaugucuauucagggucccu

SEQ ID NO: 205790 - RNA, 22 nt, Homo sapiens
agaaauguuuauucaaacccgu

SEQ ID NO: 205791 - RNA, 22 nt, Homo sapiens
agacagcugggaaauggagugu

SEQ ID NO: 205792 - RNA, 22 nt, Homo sapiens
agagcaaugggugaauauuaaa

SEQ ID NO: 205793 - RNA, 23 nt, Homo sapiens
agagugcaauggugccaucucgg

SEQ ID NO: 205794 - RNA, 20 nt, Homo sapiens
agagugcuggacugaggagc

SEQ ID NO: 205795 - RNA, 22 nt, Homo sapiens
agagugcuuuauuagauguagc

SEQ ID NO: 205796 - RNA, 22 nt, Homo sapiens
agaugauguuuacugagcauca

SEQ ID NO: 205797 - RNA, 22 nt, Homo sapiens
agauggucuucauaaguuuuaa

SEQ ID NO: 205798 - RNA, 22 nt, Homo sapiens
agcaagauccagucgcacagga

SEQ ID NO: 205799 - RNA, 22 nt, Homo sapiens
uuucaacuaauuuuuuggugag

SEQ ID NO: 205800 - RNA, 22 nt, Homo sapiens
uuucaucaagcacagaguagau

SEQ ID NO: 205801 - RNA, 22 nt, Homo sapiens
uuucaucagccagggucagucu

SEQ ID NO: 205802 - RNA, 22 nt, Homo sapiens
uuucugugguccucuugaaggu

SEQ ID NO: 205803 - RNA, 22 nt, Homo sapiens
uuugaagacuacugggagugaa

SEQ ID NO: 205804 - RNA, 22 nt, Homo sapiens
uuugacuuuuagaauaugaguu

SEQ ID NO: 205805 - RNA, 22 nt, Homo sapiens
uuuggcagaaaacuaaaaggua

SEQ ID NO: 205806 - RNA, 22 nt, Homo sapiens
uuugguccuccuacagggcagg

SEQ ID NO: 205807 - RNA, 22 nt, Homo sapiens
uuuguacucccuuuagauaaaa

SEQ ID NO: 205808 - RNA, 18 nt, Homo sapiens
uuuguacuuuuucuaaug

SEQ ID NO: 205809 - RNA, 21 nt, Homo sapiens
uuuguccaccuguguucacca

SEQ ID NO: 205810 - RNA, 22 nt, Homo sapiens
uuuuaugggcuauuugcauuag

SEQ ID NO: 205811 - RNA, 22 nt, Homo sapiens
uuuuccagugggacucccauua

SEQ ID NO: 205812 - RNA, 22 nt, Homo sapiens
uuuuguacgccuguguccauca

SEQ ID NO: 205813 - RNA, 22 nt, Homo sapiens
aaaaguucuuugagccuugaca

SEQ ID NO: 205814 - RNA, 18 nt, Homo sapiens
aaacugcuuccuuggccu

SEQ ID NO: 205815 - RNA, 22 nt, Homo sapiens
aaagugaauguaucccguaagu

SEQ ID NO: 205816 - RNA, 22 nt, Homo sapiens
aaagugcaguacuucguauauu

SEQ ID NO: 205817 - RNA, 22 nt, Homo sapiens
aaagugccugacucauaguuag

SEQ ID NO: 205818 - RNA, 22 nt, Homo sapiens
aaaugcugcuuuggccucuucu

SEQ ID NO: 205819 - RNA, 22 nt, Homo sapiens
aaaugcugucaaauuguguucu

SEQ ID NO: 205820 - RNA, 22 nt, Homo sapiens
aaaugcuuucuuggaccauuug

SEQ ID NO: 205821 - RNA, 22 nt, Homo sapiens
aaaugguguuaguagaucuuua

SEQ ID NO: 205822 - RNA, 22 nt, Homo sapiens
aaauugcaguuaggaugauggu

SEQ ID NO: 205823 - RNA, 19 nt, Homo sapiens
aacuggugugagaugguau

SEQ ID NO: 205824 - RNA, 22 nt, Homo sapiens
aagagagccagcugguauauuu

SEQ ID NO: 205825 - RNA, 22 nt, Homo sapiens
aagagguaauaacaaagcuucu

SEQ ID NO: 205826 - RNA, 22 nt, Homo sapiens
aagagguagucugucccuuagc

SEQ ID NO: 205827 - RNA, 22 nt, Homo sapiens
aagauagcuaagcuucuucuaa

SEQ ID NO: 205828 - RNA, 22 nt, Homo sapiens
aagcuccauuucugccaugaga

SEQ ID NO: 205829 - RNA, 22 nt, Homo sapiens
aagcugcauuuucuagaugcuu

SEQ ID NO: 205830 - RNA, 23 nt, Homo sapiens
aaguucaugcucaucuguuacac

SEQ ID NO: 205831 - RNA, 22 nt, Homo sapiens
aauagcuguuuuuaauuccugc

SEQ ID NO: 205832 - RNA, 20 nt, Homo sapiens
aaucuacuugcccauuuagc

SEQ ID NO: 205833 - RNA, 22 nt, Homo sapiens
aaugcuaucuggaacauuguug

SEQ ID NO: 205834 - RNA, 22 nt, Homo sapiens
aauuacauggcaauugggaaau

SEQ ID NO: 205835 - RNA, 22 nt, Homo sapiens
aauugcuucuguauuuuggaca

SEQ ID NO: 205836 - RNA, 17 nt, Homo sapiens
acaaauugccagcuagg

SEQ ID NO: 205837 - RNA, 19 nt, Homo sapiens
acagauagaauguucuaca

SEQ ID NO: 205838 - RNA, 20 nt, Homo sapiens
acagcauagccuuuuaaagc

SEQ ID NO: 205839 - RNA, 20 nt, Homo sapiens
acaguauguuuggaugcaua

SEQ ID NO: 205840 - RNA, 22 nt, Homo sapiens
acaucuguacaguggguguggu

SEQ ID NO: 205841 - RNA, 22 nt, Homo sapiens
acaugagacuggguuuguaggg

SEQ ID NO: 205842 - RNA, 22 nt, Homo sapiens
accacuguuucaagaagcuugu

SEQ ID NO: 205843 - RNA, 17 nt, Homo sapiens
accagugcaugugcuuu

SEQ ID NO: 205844 - RNA, 22 nt, Homo sapiens
accauugcacuccagcccaggc

SEQ ID NO: 205845 - RNA, 22 nt, Homo sapiens
acccagaguuccuugucuuuca

SEQ ID NO: 205846 - RNA, 22 nt, Homo sapiens
acccggagagcaggcgagaagg

SEQ ID NO: 205847 - RNA, 22 nt, Homo sapiens
acccugucauccacauggugcu

SEQ ID NO: 205848 - RNA, 22 nt, Homo sapiens
accugugguuacagucugucuc

SEQ ID NO: 205849 - RNA, 20 nt, Homo sapiens
acuggcacugguaggugugg

SEQ ID NO: 205850 - RNA, 22 nt, Homo sapiens
acuggcuuuugagaaaaacacu

SEQ ID NO: 205851 - RNA, 22 nt, Homo sapiens
cagcugguggcaagaagacaga

SEQ ID NO: 205852 - RNA, 22 nt, Homo sapiens
cagugcaaccuccaucucucgg

SEQ ID NO: 205853 - RNA, 22 nt, Homo sapiens
cauacagcuaguaaguguaaga

SEQ ID NO: 205854 - RNA, 22 nt, Homo sapiens
cauagcacugcacuucagccug

SEQ ID NO: 205855 - RNA, 22 nt, Homo sapiens
cauggagcuaggcuugaucccu

SEQ ID NO: 205856 - RNA, 22 nt, Homo sapiens
cauggcauuugcagaguugaaa

SEQ ID NO: 205857 - RNA, 22 nt, Homo sapiens
cauggcucuuguuuacucccag

SEQ ID NO: 205858 - RNA, 21 nt, Homo sapiens
caugucacugcacucuagccu

SEQ ID NO: 205859 - RNA, 20 nt, Homo sapiens
cauuccacuuuccugucagu

SEQ ID NO: 205860 - RNA, 22 nt, Homo sapiens
cauugcaacuucugccucccag

SEQ ID NO: 205861 - RNA, 22 nt, Homo sapiens
cauugcaugcauauggcuuggu

SEQ ID NO: 205862 - RNA, 22 nt, Homo sapiens
ccacccuuccauucuuccucuu

SEQ ID NO: 205863 - RNA, 22 nt, Homo sapiens
ccagugcugugcaguguaugag

SEQ ID NO: 205864 - RNA, 22 nt, Homo sapiens
ccaguuuuucauuuauacuagu

SEQ ID NO: 205865 - RNA, 22 nt, Homo sapiens
ccaucccuuucugagcaguucc

SEQ ID NO: 205866 - RNA, 22 nt, Homo sapiens
ccccagguuucaauaaagccca

SEQ ID NO: 205867 - RNA, 22 nt, Homo sapiens
ccccagugguugcaacagcaga

SEQ ID NO: 205868 - RNA, 22 nt, Homo sapiens
ccccaguguguaaaggccuugc

SEQ ID NO: 205869 - RNA, 22 nt, Homo sapiens
aaagaguucagguagauuucaa

SEQ ID NO: 205870 - RNA, 22 nt, Homo sapiens
aaaguacugggauuggccgggu

SEQ ID NO: 205871 - RNA, 22 nt, Homo sapiens
aaagugcugagacagacuggga

SEQ ID NO: 205872 - RNA, 22 nt, Homo sapiens
aaaugacuuuuuaugcagagua

SEQ ID NO: 205873 - RNA, 22 nt, Homo sapiens
aaaugcugucugugagccucau

SEQ ID NO: 205874 - RNA, 22 nt, Homo sapiens
aaaugcuucuauguggcauguu

SEQ ID NO: 205875 - RNA, 22 nt, Homo sapiens
aagaggcuguaggauaaugccu

SEQ ID NO: 205876 - RNA, 22 nt, Homo sapiens
aagagguagaagcuugccuucu

SEQ ID NO: 205877 - RNA, 22 nt, Homo sapiens
aagagguaggaaauggucauuu

SEQ ID NO: 205878 - RNA, 22 nt, Homo sapiens
aagaucaucauagagggcauga

SEQ ID NO: 205879 - RNA, 22 nt, Homo sapiens
aaggcagucacuaaauagugag

SEQ ID NO: 205880 - RNA, 22 nt, Homo sapiens
aaggcaguggcagaagauguca

SEQ ID NO: 205881 - RNA, 22 nt, Homo sapiens
aaggcaugcaguacguuucuau

SEQ ID NO: 205882 - RNA, 22 nt, Homo sapiens
aaggcauggugacuauuuaggc

SEQ ID NO: 205883 - RNA, 22 nt, Homo sapiens
aaggcuuuuugcugacguccuu

SEQ ID NO: 205884 - RNA, 22 nt, Homo sapiens
aagggaaugcuuccaguuugug

SEQ ID NO: 205885 - RNA, 22 nt, Homo sapiens
aaggugguuuucucuuggaguc

SEQ ID NO: 205886 - RNA, 22 nt, Homo sapiens
aaguaauggaguuauuuuauga

SEQ ID NO: 205887 - RNA, 22 nt, Homo sapiens
aaguccccugacagaggggagg

SEQ ID NO: 205888 - RNA, 22 nt, Homo sapiens
aagugaaugaugugaaguguaa

SEQ ID NO: 205889 - RNA, 22 nt, Homo sapiens
aagugcuuaggauagugugugg

SEQ ID NO: 205890 - RNA, 22 nt, Homo sapiens
aagugcuuuacacaugcaugau

SEQ ID NO: 205891 - RNA, 22 nt, Homo sapiens
aauaucacaggguguacacuca

SEQ ID NO: 205892 - RNA, 22 nt, Homo sapiens
aaucaacauuguuuuaagucaa

SEQ ID NO: 205893 - RNA, 22 nt, Homo sapiens
aaugaaguuagauguugagaag

SEQ ID NO: 205894 - RNA, 22 nt, Homo sapiens
aaugccacugugccugccaagg

SEQ ID NO: 205895 - RNA, 22 nt, Homo sapiens
aauggcaaauguuuucuguuga

SEQ ID NO: 205896 - RNA, 22 nt, Homo sapiens
acaagacuucuuguauucuagu

SEQ ID NO: 205897 - RNA, 22 nt, Homo sapiens
acacauacacauaugguguaua

SEQ ID NO: 205898 - RNA, 22 nt, Homo sapiens
acacuggaguuaaaggugauuu

SEQ ID NO: 205899 - RNA, 22 nt, Homo sapiens
acacuguacuuauguuuugcag

SEQ ID NO: 205900 - RNA, 18 nt, Homo sapiens
acagugcugucacugcuu

SEQ ID NO: 205901 - RNA, 22 nt, Homo sapiens
acagugcuguggucaugggucu

SEQ ID NO: 205902 - RNA, 22 nt, Homo sapiens
acagugcuucugauaugaugcc

SEQ ID NO: 205903 - RNA, 22 nt, Homo sapiens
acagugcuuggcacacaguaau

SEQ ID NO: 205904 - RNA, 22 nt, Homo sapiens
acagugcuuuuguuccucuccu

SEQ ID NO: 205905 - RNA, 22 nt, Homo sapiens
acaucacuguuugauugauuga

SEQ ID NO: 205906 - RNA, 22 nt, Homo sapiens
acaucccaugccuggguacucc

SEQ ID NO: 205907 - RNA, 18 nt, Homo sapiens
acaucccaugcuggggug

SEQ ID NO: 205908 - RNA, 22 nt, Homo sapiens
acccaguagucauucaggagca

SEQ ID NO: 205909 - RNA, 22 nt, Homo sapiens
accucagcccggggaaguugag

SEQ ID NO: 205910 - RNA, 22 nt, Homo sapiens
acuacauaugacaucuucuuua

SEQ ID NO: 205911 - RNA, 18 nt, Homo sapiens
acucuguauguggagugg

SEQ ID NO: 205912 - RNA, 22 nt, Homo sapiens
agaaccauuagagggagauauu

SEQ ID NO: 205913 - RNA, 20 nt, Homo sapiens
agaagcauugcucucuucag

SEQ ID NO: 205914 - RNA, 22 nt, Homo sapiens
agaaugucaguauuggcuaaaa

SEQ ID NO: 205915 - RNA, 22 nt, Homo sapiens
agagagguggguggagccccca

SEQ ID NO: 205916 - RNA, 22 nt, Homo sapiens
agagauaaagauuuuaauuuug

SEQ ID NO: 205917 - RNA, 22 nt, Homo sapiens
agaguacugacguuugcaaauu

SEQ ID NO: 205918 - RNA, 22 nt, Homo sapiens
agaguaguuuauuaugcuaagg

SEQ ID NO: 205919 - RNA, 22 nt, Homo sapiens
agagugaagcuuuuuauauucu

SEQ ID NO: 205920 - RNA, 22 nt, Homo sapiens
agaugcuguuaucaacuguagc

SEQ ID NO: 205921 - RNA, 22 nt, Homo sapiens
agauggguuuucacauguuggc

SEQ ID NO: 205922 - RNA, 22 nt, Homo sapiens
agcaauaugacauugcuacauc

SEQ ID NO: 205923 - RNA, 22 nt, Homo sapiens
agcacagugguuaaguuucuua

SEQ ID NO: 205924 - RNA, 22 nt, Homo sapiens
agcagguguggcuuauccugaa

SEQ ID NO: 205925 - RNA, 20 nt, Homo sapiens
agcaucagugguaguguugc

SEQ ID NO: 205926 - RNA, 22 nt, Homo sapiens
agccuucauucugacaguagga

SEQ ID NO: 205927 - RNA, 21 nt, Homo sapiens
agcuaaauuggaaauuucugu

SEQ ID NO: 205928 - RNA, 22 nt, Homo sapiens
agcugcaaagggagagaugauu

SEQ ID NO: 205929 - RNA, 22 nt, Homo sapiens
agcugcaauguuuaguauaaua

SEQ ID NO: 205930 - RNA, 22 nt, Homo sapiens
agcugcacaaauggaugugagg

SEQ ID NO: 205931 - RNA, 22 nt, Homo sapiens
agcugcacugguauaggagaaa

SEQ ID NO: 205932 - RNA, 22 nt, Homo sapiens
agcugcauucguaucauauugu

SEQ ID NO: 205933 - RNA, 22 nt, Homo sapiens
agcugguauuuugucgaggacu

SEQ ID NO: 205934 - RNA, 22 nt, Homo sapiens
agcuguguugucugaagucaga

SEQ ID NO: 205935 - RNA, 22 nt, Homo sapiens
aggaauuuaauguaugauaaua

SEQ ID NO: 205936 - RNA, 22 nt, Homo sapiens
aggaccccucaucagcaccagu

SEQ ID NO: 205937 - RNA, 21 nt, Homo sapiens
aggucaguaagaaugcagcac

SEQ ID NO: 205938 - RNA, 22 nt, Homo sapiens
aggugcugacaggauagguuuc

SEQ ID NO: 205939 - RNA, 22 nt, Homo sapiens
agucagugcauaagaaugaagu

SEQ ID NO: 205940 - RNA, 22 nt, Homo sapiens
agucaguggaguaaauguaauu

SEQ ID NO: 205941 - RNA, 23 nt, Homo sapiens
agucuguguuuacaggcucucug

SEQ ID NO: 205942 - RNA, 22 nt, Homo sapiens
agugagcuguuuuuacuuucug

SEQ ID NO: 205943 - RNA, 22 nt, Homo sapiens
agugcaaagccgagguuucuug

SEQ ID NO: 205944 - RNA, 22 nt, Homo sapiens
agugcauugcaucucugcuuca

SEQ ID NO: 205945 - RNA, 22 nt, Homo sapiens
auaaagcuauuccucucuuuuu

SEQ ID NO: 205946 - RNA, 22 nt, Homo sapiens
auggcccccuguuugugaacau

SEQ ID NO: 205947 - RNA, 22 nt, Homo sapiens
auggcccuguguggagcugcug

SEQ ID NO: 205948 - RNA, 22 nt, Homo sapiens
auggccuuguauaccuggcaaa

SEQ ID NO: 205949 - RNA, 22 nt, Homo sapiens
auggcuuugggcugcucugccc

SEQ ID NO: 205950 - RNA, 21 nt, Homo sapiens
auguaacugggaaugugagag

SEQ ID NO: 205951 - RNA, 17 nt, Homo sapiens
augugaauguucaaaua

SEQ ID NO: 205952 - RNA, 22 nt, Homo sapiens
augugcacaugcuuacauguga

SEQ ID NO: 205953 - RNA, 22 nt, Homo sapiens
augugcacauucugguaaauau

SEQ ID NO: 205954 - RNA, 23 nt, Homo sapiens
augugugcuuggagagcaggaug

SEQ ID NO: 205955 - RNA, 22 nt, Homo sapiens
auuaagagcacauguucugggu

SEQ ID NO: 205956 - RNA, 22 nt, Homo sapiens
auuauaguguauacuugaaauu

SEQ ID NO: 205957 - RNA, 22 nt, Homo sapiens
auucaagugaugcagcuguuuu

SEQ ID NO: 205958 - RNA, 22 nt, Homo sapiens
auucaucagggauauuggucug

SEQ ID NO: 205959 - RNA, 22 nt, Homo sapiens
auuccacuuccacuaguuucuc

SEQ ID NO: 205960 - RNA, 21 nt, Homo sapiens
auuccacuuuuccuucaggga

SEQ ID NO: 205961 - RNA, 22 nt, Homo sapiens
auugacuugauauauagcugau

SEQ ID NO: 205962 - RNA, 22 nt, Homo sapiens
auugcccaggcuggagugcagu

SEQ ID NO: 205963 - RNA, 22 nt, Homo sapiens
auugccuaacauagauguucag

SEQ ID NO: 205964 - RNA, 22 nt, Homo sapiens
auugugauggucaaaggaaaua

SEQ ID NO: 205965 - RNA, 22 nt, Homo sapiens
auuugucacuuaacagccauua

SEQ ID NO: 205966 - RNA, 22 nt, Homo sapiens
caaaagugguucuuauccuuuu

SEQ ID NO: 205967 - RNA, 22 nt, Homo sapiens
caaauugcuugucuguagugga

SEQ ID NO: 205968 - RNA, 22 nt, Homo sapiens
caaauugcuuguggaggauaau

SEQ ID NO: 205969 - RNA, 22 nt, Homo sapiens
caagggguggaaaugguagugu

SEQ ID NO: 205970 - RNA, 22 nt, Homo sapiens
cacaaaguagauuagucuucca

SEQ ID NO: 205971 - RNA, 22 nt, Homo sapiens
cacagggcuaacauuuuugccc

SEQ ID NO: 205972 - RNA, 22 nt, Homo sapiens
cacagugaaugucaucauugcc

SEQ ID NO: 205973 - RNA, 23 nt, Homo sapiens
caccaguauaauuagcuuuuaaa

SEQ ID NO: 205974 - RNA, 22 nt, Homo sapiens
cacccaguaagcaugaggcccu

SEQ ID NO: 205975 - RNA, 22 nt, Homo sapiens
cacugaaugugagguuggggag

SEQ ID NO: 205976 - RNA, 22 nt, Homo sapiens
cacugcacuccagcuugugggc

SEQ ID NO: 205977 - RNA, 22 nt, Homo sapiens
cacugcacuccagucuggcgac

SEQ ID NO: 205978 - RNA, 22 nt, Homo sapiens
cacugcacuccaguuuggauga

SEQ ID NO: 205979 - RNA, 22 nt, Homo sapiens
cagcuaaauuguuaaauccaag

SEQ ID NO: 205980 - RNA, 22 nt, Homo sapiens
cagguacauuuuaaagggcuca

SEQ ID NO: 205981 - RNA, 22 nt, Homo sapiens
cagguacuucugggcugagcag

SEQ ID NO: 205982 - RNA, 22 nt, Homo sapiens
caggugcuuacuuaauagccau

SEQ ID NO: 205983 - RNA, 22 nt, Homo sapiens
caucacauucugagauacugag

SEQ ID NO: 205984 - RNA, 22 nt, Homo sapiens
cauggucaccuuccaaguuauu

SEQ ID NO: 205985 - RNA, 22 nt, Homo sapiens
caugucacuuccucucugaugg

SEQ ID NO: 205986 - RNA, 22 nt, Homo sapiens
cauuacacuuguaagguuuuuc

SEQ ID NO: 205987 - RNA, 22 nt, Homo sapiens
cauuccacauguaggacaauuu

SEQ ID NO: 205988 - RNA, 22 nt, Homo sapiens
cauugcaauccagccugggcaa

SEQ ID NO: 205989 - RNA, 22 nt, Homo sapiens
cauuugguggcuacagaguaac

SEQ ID NO: 205990 - RNA, 22 nt, Homo sapiens
ccaagccucaguuucccucugu

SEQ ID NO: 205991 - RNA, 22 nt, Homo sapiens
ccaccgggucccagcucugcuc

SEQ ID NO: 205992 - RNA, 22 nt, Homo sapiens
cccagagacagaaugauaaacu

SEQ ID NO: 205993 - RNA, 21 nt, Homo sapiens
cccagguucucugaggguaga

SEQ ID NO: 205994 - RNA, 22 nt, Homo sapiens
cccagugguuacauaaggagua

SEQ ID NO: 205995 - RNA, 19 nt, Homo sapiens
cccagugucagagaagggu

SEQ ID NO: 205996 - RNA, 22 nt, Homo sapiens
cccagugugcugggugacagcu

SEQ ID NO: 205997 - RNA, 22 nt, Homo sapiens
ccgugcacggaaaggcauauuu

SEQ ID NO: 205998 - RNA, 21 nt, Homo sapiens
ccuccauuuguauucuugccc

SEQ ID NO: 205999 - RNA, 22 nt, Homo sapiens
ccucccuuuguugcaagggaaa

SEQ ID NO: 206000 - RNA, 22 nt, Homo sapiens
ccugagacgaauggagugaaca

SEQ ID NO: 206001 - RNA, 22 nt, Homo sapiens
ccugucuugaagagauccuccu

SEQ ID NO: 206002 - RNA, 22 nt, Homo sapiens
cuagaguacuuaccacagcaug

SEQ ID NO: 206003 - RNA, 22 nt, Homo sapiens
cuagucacaggaguugaaggau

SEQ ID NO: 206004 - RNA, 22 nt, Homo sapiens
uaccacccuuuuuccagaagcc

SEQ ID NO: 206005 - RNA, 22 nt, Homo sapiens
uacuguguaguuagaccucaga

SEQ ID NO: 206006 - RNA, 22 nt, Homo sapiens
uagcagccaggaagggcuggcu

SEQ ID NO: 206007 - RNA, 22 nt, Homo sapiens
uagcaggaaaccuguguugagg

SEQ ID NO: 206008 - RNA, 22 nt, Homo sapiens
uagcaucagauuccauauucua

SEQ ID NO: 206009 - RNA, 22 nt, Homo sapiens
uaggacaaugguacagcagaaa

SEQ ID NO: 206010 - RNA, 22 nt, Homo sapiens
uaggagcacaaaccccauugug

SEQ ID NO: 206011 - RNA, 22 nt, Homo sapiens
uaggagcacaaacccuacugug

SEQ ID NO: 206012 - RNA, 22 nt, Homo sapiens
uaggagcacagcagcauguggg

SEQ ID NO: 206013 - RNA, 22 nt, Homo sapiens
uagggaguuuuggggugcagaa

SEQ ID NO: 206014 - RNA, 22 nt, Homo sapiens
uaggugauccauuuguauuuua

SEQ ID NO: 206015 - RNA, 22 nt, Homo sapiens
uagguuguguucugagccucag

SEQ ID NO: 206016 - RNA, 22 nt, Homo sapiens
uagugaaugucacuggcuguug

SEQ ID NO: 206017 - RNA, 21 nt, Homo sapiens
uagugcugaggcaguauggga

SEQ ID NO: 206018 - RNA, 22 nt, Homo sapiens
uaucacagguggacugcacacc

SEQ ID NO: 206019 - RNA, 22 nt, Homo sapiens
uaucacugucaggcccucauau

SEQ ID NO: 206020 - RNA, 22 nt, Homo sapiens
uaucucacauauucaguagguu

SEQ ID NO: 206021 - RNA, 22 nt, Homo sapiens
uaucucuguggguagugcugaa

SEQ ID NO: 206022 - RNA, 22 nt, Homo sapiens
uaugagagcugguagguagaga

SEQ ID NO: 206023 - RNA, 22 nt, Homo sapiens
uauugauuaauugugauuaggc

SEQ ID NO: 206024 - RNA, 22 nt, Homo sapiens
uuuggauagugugguccuuuua

SEQ ID NO: 206025 - RNA, 22 nt, Homo sapiens
uuuggcauuaagaugcuguauc

SEQ ID NO: 206026 - RNA, 22 nt, Homo sapiens
uuugugcuccucucaguaugug

SEQ ID NO: 206027 - RNA, 21 nt, Homo sapiens
uuuugcacacuaugcagcuuu

SEQ ID NO: 206028 - RNA, 22 nt, Homo sapiens
uuuugggggugauucacacagu

SEQ ID NO: 206029 - RNA, 22 nt, Homo sapiens
uuuuugugguauauugcaacaa

SEQ ID NO: 206030 - RNA, 22 nt, Homo sapiens
uuuuuugcuguaugcaaacauc

SEQ ID NO: 206031 - RNA, 22 nt, Homo sapiens
uauugauuuucaguguucagcu

SEQ ID NO: 206032 - RNA, 22 nt, Homo sapiens
uauugcacuccucaugcauuug

SEQ ID NO: 206033 - RNA, 18 nt, Homo sapiens
uauugcuugguuuggaga

SEQ ID NO: 206034 - RNA, 22 nt, Homo sapiens
uauuugguuauaugaguaaguu

SEQ ID NO: 206035 - RNA, 20 nt, Homo sapiens
ucaaauucuuggccuccagc

SEQ ID NO: 206036 - RNA, 22 nt, Homo sapiens
ucaacagugggcacuguaaaug

SEQ ID NO: 206037 - RNA, 22 nt, Homo sapiens
ucaacugcuugagaucacaaau

SEQ ID NO: 206038 - RNA, 22 nt, Homo sapiens
ucacaaguguauagacaugucc

SEQ ID NO: 206039 - RNA, 19 nt, Homo sapiens
ucacacuguggcuucuuua

SEQ ID NO: 206040 - RNA, 22 nt, Homo sapiens
ucacaugcacaucucuggaacc

SEQ ID NO: 206041 - RNA, 22 nt, Homo sapiens
ucacgugcucuuguguguucug

SEQ ID NO: 206042 - RNA, 22 nt, Homo sapiens
ucacugaaaccacugccuccug

SEQ ID NO: 206043 - RNA, 22 nt, Homo sapiens
ucacugaaaccuccaccucucg

SEQ ID NO: 206044 - RNA, 22 nt, Homo sapiens
ucacugaaacuguccuggguua

SEQ ID NO: 206045 - RNA, 22 nt, Homo sapiens
ucacugcgaccuccaccucccg

SEQ ID NO: 206046 - RNA, 22 nt, Homo sapiens
ucacuuuggguacuauggaaau

SEQ ID NO: 206047 - RNA, 22 nt, Homo sapiens
ucacuuuguuuuuggauaaguu

SEQ ID NO: 206048 - RNA, 22 nt, Homo sapiens
ucagacacuguggccuuuggac

SEQ ID NO: 206049 - RNA, 21 nt, Homo sapiens
ucagcucaucacugccuggag

SEQ ID NO: 206050 - RNA, 21 nt, Homo sapiens
ucaggaccucuaguuagccag

SEQ ID NO: 206051 - RNA, 22 nt, Homo sapiens
ucagguaaucuauuugucuuuu

SEQ ID NO: 206052 - RNA, 23 nt, Homo sapiens
ucagguaguuucagaggaccuug

SEQ ID NO: 206053 - RNA, 22 nt, Homo sapiens
ucagguaucuuuauagcgaugc

SEQ ID NO: 206054 - RNA, 22 nt, Homo sapiens
ucagugacugcugcuuguauac

SEQ ID NO: 206055 - RNA, 22 nt, Homo sapiens
ucagugauugcuuucauggaaa

SEQ ID NO: 206056 - RNA, 19 nt, Homo sapiens
ucagugcuauguaauguag

SEQ ID NO: 206057 - RNA, 22 nt, Homo sapiens
ucagugucugugauggagaggu

SEQ ID NO: 206058 - RNA, 22 nt, Homo sapiens
ucauacaggccaccagggaagu

SEQ ID NO: 206059 - RNA, 18 nt, Homo sapiens
ucauagaucaugacagug

SEQ ID NO: 206060 - RNA, 22 nt, Homo sapiens
ucaugaaguaguuaacugguug

SEQ ID NO: 206061 - RNA, 22 nt, Homo sapiens
uccaguguuccucagucacccc

SEQ ID NO: 206062 - RNA, 22 nt, Homo sapiens
ucccaguuuuucugaauaguca

SEQ ID NO: 206063 - RNA, 22 nt, Homo sapiens
uccuucaugcaucaauguaucc

SEQ ID NO: 206064 - RNA, 22 nt, Homo sapiens
uccuuggugacauuucuugucu

SEQ ID NO: 206065 - RNA, 22 nt, Homo sapiens
ucgcagcucacuggagccucga

SEQ ID NO: 206066 - RNA, 22 nt, Homo sapiens
ucuaaguaguagcuggucagaa

SEQ ID NO: 206067 - RNA, 22 nt, Homo sapiens
ucucaaccuccacacuacaaua

SEQ ID NO: 206068 - RNA, 22 nt, Homo sapiens
ucucaaccucccaaguagcugg

SEQ ID NO: 206069 - RNA, 22 nt, Homo sapiens
ucucaauuugauuacauucaua

SEQ ID NO: 206070 - RNA, 22 nt, Homo sapiens
ucucagugaaauaaauuauuuu

SEQ ID NO: 206071 - RNA, 22 nt, Homo sapiens
ucucagugaauguggaaaaagc

SEQ ID NO: 206072 - RNA, 22 nt, Homo sapiens
ucucaguggcacccccaacacc

SEQ ID NO: 206073 - RNA, 22 nt, Homo sapiens
ucucaguggugcuggcagggga

SEQ ID NO: 206074 - RNA, 19 nt, Homo sapiens
ucucaguguuggucaggug

SEQ ID NO: 206075 - RNA, 22 nt, Homo sapiens
ucucauggcucacccugcauag

SEQ ID NO: 206076 - RNA, 22 nt, Homo sapiens
ucuccauuguccagaugaggaa

SEQ ID NO: 206077 - RNA, 22 nt, Homo sapiens
ucucugagaaaaguuucuccca

SEQ ID NO: 206078 - RNA, 22 nt, Homo sapiens
ucugugcauuacacuuuucuca

SEQ ID NO: 206079 - RNA, 22 nt, Homo sapiens
ucuguggucagaguccuuggcc

SEQ ID NO: 206080 - RNA, 22 nt, Homo sapiens
ucugugguuguugcauggaaug

SEQ ID NO: 206081 - RNA, 22 nt, Homo sapiens
ucuguguugaugcucauuaauu

SEQ ID NO: 206082 - RNA, 22 nt, Homo sapiens
ucuuaggugaugauugauguga

SEQ ID NO: 206083 - RNA, 22 nt, Homo sapiens
ucuuugauuaugcagauggguu

SEQ ID NO: 206084 - RNA, 22 nt, Homo sapiens
ugaaaagucuaagauuaagguu

SEQ ID NO: 206085 - RNA, 20 nt, Homo sapiens
ugaaacacauggacuggggu

SEQ ID NO: 206086 - RNA, 22 nt, Homo sapiens
ugaaauaguuaaguugccuagu

SEQ ID NO: 206087 - RNA, 22 nt, Homo sapiens
ugaaauuauucuuaccaaggug

SEQ ID NO: 206088 - RNA, 22 nt, Homo sapiens
ugaacacuggauaaggagucag

SEQ ID NO: 206089 - RNA, 22 nt, Homo sapiens
ugaacagcaccuccuagaguug

SEQ ID NO: 206090 - RNA, 22 nt, Homo sapiens
ugaagacucaauuauuaugaac

SEQ ID NO: 206091 - RNA, 22 nt, Homo sapiens
ugaauacuucguucaaagauaa

SEQ ID NO: 206092 - RNA, 22 nt, Homo sapiens
ugaccacagaaagugagggagc

SEQ ID NO: 206093 - RNA, 22 nt, Homo sapiens
ugacuuaugcaacucugaugug

SEQ ID NO: 206094 - RNA, 22 nt, Homo sapiens
ugagacugagucucgcucuauu

SEQ ID NO: 206095 - RNA, 22 nt, Homo sapiens
ugagacugagucuugcucuugu

SEQ ID NO: 206096 - RNA, 22 nt, Homo sapiens
ugagacugaguuucacuuuugu

SEQ ID NO: 206097 - RNA, 22 nt, Homo sapiens
ugagacugaguuucucucuugu

SEQ ID NO: 206098 - RNA, 22 nt, Homo sapiens
ugagacugguuaauugauaaag

SEQ ID NO: 206099 - RNA, 22 nt, Homo sapiens
ugagauagcauaagggacagaa

SEQ ID NO: 206100 - RNA, 22 nt, Homo sapiens
ugagauaggaucuugcucuguu

SEQ ID NO: 206101 - RNA, 22 nt, Homo sapiens
ugagaucagugaagaaguguuu

SEQ ID NO: 206102 - RNA, 19 nt, Homo sapiens
ugagaucuuuacuggguuu

SEQ ID NO: 206103 - RNA, 22 nt, Homo sapiens
ugagaugaaagcagaaagacuu

SEQ ID NO: 206104 - RNA, 22 nt, Homo sapiens
ugagaugaacuugauuguuuua

SEQ ID NO: 206105 - RNA, 22 nt, Homo sapiens
ugagaugaagcuagaagaaugg

SEQ ID NO: 206106 - RNA, 22 nt, Homo sapiens
ugagaugaagucucacucuguc

SEQ ID NO: 206107 - RNA, 22 nt, Homo sapiens
ugagaugaagugauguaaaaca

SEQ ID NO: 206108 - RNA, 22 nt, Homo sapiens
ugagaugaguucucgcucuguc

SEQ ID NO: 206109 - RNA, 22 nt, Homo sapiens
ugagaugaguugcuggcucuga

SEQ ID NO: 206110 - RNA, 22 nt, Homo sapiens
ugagaugauaucuuauuguaau

SEQ ID NO: 206111 - RNA, 21 nt, Homo sapiens
ugagaugauccugcaugcaug

SEQ ID NO: 206112 - RNA, 22 nt, Homo sapiens
ugaggaguauguucuguagacc

SEQ ID NO: 206113 - RNA, 22 nt, Homo sapiens
ugagggaugccugguuuguuuu

SEQ ID NO: 206114 - RNA, 22 nt, Homo sapiens
ugagggaugcguacccuaugcc

SEQ ID NO: 206115 - RNA, 22 nt, Homo sapiens
ugaguaggauugguauuucuuc

SEQ ID NO: 206116 - RNA, 22 nt, Homo sapiens
ugaguuaguguggugcuuggaa

SEQ ID NO: 206117 - RNA, 22 nt, Homo sapiens
ugaguucuuccuaucucugccu

SEQ ID NO: 206118 - RNA, 22 nt, Homo sapiens
ugauaugacagcucugcugcca

SEQ ID NO: 206119 - RNA, 22 nt, Homo sapiens
ugauaugaucgcccuagcuuga

SEQ ID NO: 206120 - RNA, 21 nt, Homo sapiens
ugauaugguagaagagagaca

SEQ ID NO: 206121 - RNA, 22 nt, Homo sapiens
ugcaaagucgaaacugcaguuu

SEQ ID NO: 206122 - RNA, 22 nt, Homo sapiens
ugcaccacugcacuccagcuug

SEQ ID NO: 206123 - RNA, 19 nt, Homo sapiens
ugccaagaaagucagcuua

SEQ ID NO: 206124 - RNA, 22 nt, Homo sapiens
ugcuauagcuauaucaucuccu

SEQ ID NO: 206125 - RNA, 21 nt, Homo sapiens
ugcuccauuuucuagccugaa

SEQ ID NO: 206126 - RNA, 22 nt, Homo sapiens
ugcuguuguuugaugaaguaau

SEQ ID NO: 206127 - RNA, 22 nt, Homo sapiens
uggaaauuaacagggauugucc

SEQ ID NO: 206128 - RNA, 22 nt, Homo sapiens
uggaacacaucuaaggaagcag

SEQ ID NO: 206129 - RNA, 23 nt, Homo sapiens
uggaacugaauuucuuagcauuu

SEQ ID NO: 206130 - RNA, 22 nt, Homo sapiens
uggaacugauauugauggaaaa

SEQ ID NO: 206131 - RNA, 23 nt, Homo sapiens
uggaagacuccucucuuggcugc

SEQ ID NO: 206132 - RNA, 22 nt, Homo sapiens
uggaagguaaguuuugagcauu

SEQ ID NO: 206133 - RNA, 22 nt, Homo sapiens
uggacagaaacauguuuucagu

SEQ ID NO: 206134 - RNA, 22 nt, Homo sapiens
uggacagacaagguuauagauc

SEQ ID NO: 206135 - RNA, 21 nt, Homo sapiens
uggaccccuuccuuacaucau

SEQ ID NO: 206136 - RNA, 22 nt, Homo sapiens
uggagacugaucccucuuuccu

SEQ ID NO: 206137 - RNA, 22 nt, Homo sapiens
uggagcccuaguuccucauaac

SEQ ID NO: 206138 - RNA, 23 nt, Homo sapiens
uggaggacaagcauggauaguga

SEQ ID NO: 206139 - RNA, 22 nt, Homo sapiens
uggagucuugcucuguugccca

SEQ ID NO: 206140 - RNA, 21 nt, Homo sapiens
uggauugagaaccccaggagg

SEQ ID NO: 206141 - RNA, 22 nt, Homo sapiens
uggauuuuaauuauucugucau

SEQ ID NO: 206142 - RNA, 22 nt, Homo sapiens
uggcacaaugacccuugugggc

SEQ ID NO: 206143 - RNA, 22 nt, Homo sapiens
uggcaugggguaguagcgcugg

SEQ ID NO: 206144 - RNA, 22 nt, Homo sapiens
uggcaugucagguuucuggguu

SEQ ID NO: 206145 - RNA, 22 nt, Homo sapiens
ugggaaugaaauuacauagcuu

SEQ ID NO: 206146 - RNA, 22 nt, Homo sapiens
uggguagagaaucaggaucuua

SEQ ID NO: 206147 - RNA, 23 nt, Homo sapiens
ugggucaguuuuucugacaucau

SEQ ID NO: 206148 - RNA, 22 nt, Homo sapiens
ugguccuuuccauuggagacac

SEQ ID NO: 206149 - RNA, 22 nt, Homo sapiens
uggugagaaacuagauauuuuu

SEQ ID NO: 206150 - RNA, 22 nt, Homo sapiens
uggugcaaugaagugaucucaa

SEQ ID NO: 206151 - RNA, 22 nt, Homo sapiens
ugguuccauauuaauuuuagga

SEQ ID NO: 206152 - RNA, 22 nt, Homo sapiens
ugucaacauuuaucaaguuauu

SEQ ID NO: 206153 - RNA, 20 nt, Homo sapiens
ugucaagaaacauuacuuau

SEQ ID NO: 206154 - RNA, 22 nt, Homo sapiens
ugucagaaucuagaggcugcua

SEQ ID NO: 206155 - RNA, 22 nt, Homo sapiens
ugucaguggucuggaugcagcc

SEQ ID NO: 206156 - RNA, 22 nt, Homo sapiens
ugucuuuguuaguuguccuagu

SEQ ID NO: 206157 - RNA, 22 nt, Homo sapiens
ugugaaacauggauagaacugg

SEQ ID NO: 206158 - RNA, 22 nt, Homo sapiens
ugugaguguguacuaguuauca

SEQ ID NO: 206159 - RNA, 22 nt, Homo sapiens
ugugauagagaaugguggagaa

SEQ ID NO: 206160 - RNA, 22 nt, Homo sapiens
ugugucuugcuggugccugcau

SEQ ID NO: 206161 - RNA, 22 nt, Homo sapiens
uguuacaguguaggccuugggu

SEQ ID NO: 206162 - RNA, 22 nt, Homo sapiens
uguuuguuugugauacgguaca

SEQ ID NO: 206163 - RNA, 22 nt, Homo sapiens
uuaaagccauaccugagagagu

SEQ ID NO: 206164 - RNA, 18 nt, Homo sapiens
uuaaggcaggacuuuaag

SEQ ID NO: 206165 - RNA, 22 nt, Homo sapiens
uuaaggcagugucuaugccagu

SEQ ID NO: 206166 - RNA, 22 nt, Homo sapiens
uuaaucaggccguuuccuaaga

SEQ ID NO: 206167 - RNA, 22 nt, Homo sapiens
uuacaguggugaccuuguauug

SEQ ID NO: 206168 - RNA, 22 nt, Homo sapiens
uuagguuguuucuggucuuagg

SEQ ID NO: 206169 - RNA, 22 nt, Homo sapiens
uuaguaguagcugcaugucagu

SEQ ID NO: 206170 - RNA, 22 nt, Homo sapiens
uuauauguuagacauggugggu

SEQ ID NO: 206171 - RNA, 22 nt, Homo sapiens
uucaaguaagaaagacaucagg

SEQ ID NO: 206172 - RNA, 22 nt, Homo sapiens
uucaagucaacaagcacuugag

SEQ ID NO: 206173 - RNA, 22 nt, Homo sapiens
uucacaaugccuuguugauggu

SEQ ID NO: 206174 - RNA, 22 nt, Homo sapiens
uucaccagggaagucucaacuc

SEQ ID NO: 206175 - RNA, 22 nt, Homo sapiens
uucagcacaguguggaucauuc

SEQ ID NO: 206176 - RNA, 23 nt, Homo sapiens
uucaguauugaaugauggcgcug

SEQ ID NO: 206177 - RNA, 22 nt, Homo sapiens
uucauuggacuuguguucuuga

SEQ ID NO: 206178 - RNA, 22 nt, Homo sapiens
uuccaguggaguaaauggacaa

SEQ ID NO: 206179 - RNA, 22 nt, Homo sapiens
uuccaguguguucauccucaga

SEQ ID NO: 206180 - RNA, 22 nt, Homo sapiens
uucccagagccugggagugagg

SEQ ID NO: 206181 - RNA, 23 nt, Homo sapiens
uucccuuagaagaaggggagaaa

SEQ ID NO: 206182 - RNA, 22 nt, Homo sapiens
uuccuggaggggaaguguccaa

SEQ ID NO: 206183 - RNA, 22 nt, Homo sapiens
uuccuuguagcaaaugcgauga

SEQ ID NO: 206184 - RNA, 22 nt, Homo sapiens
uucgucaugagacagaugcuga

SEQ ID NO: 206185 - RNA, 22 nt, Homo sapiens
uucucagugcuaucuuuuaugc

SEQ ID NO: 206186 - RNA, 22 nt, Homo sapiens
uucugugguagaaaucucaaau

SEQ ID NO: 206187 - RNA, 22 nt, Homo sapiens
uucuugcugaauugugcccuuc

SEQ ID NO: 206188 - RNA, 23 nt, Homo sapiens
uugaaaagucaguagccucugau

SEQ ID NO: 206189 - RNA, 22 nt, Homo sapiens
uugaagacuaauuuagauaaug

SEQ ID NO: 206190 - RNA, 18 nt, Homo sapiens
uugaauaguguccaaucu

SEQ ID NO: 206191 - RNA, 22 nt, Homo sapiens
uugacacuaauuauuauaggug

SEQ ID NO: 206192 - RNA, 21 nt, Homo sapiens
uugagaagaauuagcucuucc

SEQ ID NO: 206193 - RNA, 22 nt, Homo sapiens
uugaggucuucaggaucaggcu

SEQ ID NO: 206194 - RNA, 22 nt, Homo sapiens
uugagguggugucuugcucugu

SEQ ID NO: 206195 - RNA, 21 nt, Homo sapiens
uugaguugaagcaaggaggga

SEQ ID NO: 206196 - RNA, 22 nt, Homo sapiens
uugauauucuuucuggauccca

SEQ ID NO: 206197 - RNA, 22 nt, Homo sapiens
uugauguccaucucuagguaaa

SEQ ID NO: 206198 - RNA, 22 nt, Homo sapiens
uugcaccacugcguuccagccu

SEQ ID NO: 206199 - RNA, 22 nt, Homo sapiens
uugcuagaugaaaaugguaccu

SEQ ID NO: 206200 - RNA, 22 nt, Homo sapiens
uuggaaagagguguuuaugacu

SEQ ID NO: 206201 - RNA, 20 nt, Homo sapiens
uuggaaaugugaauugggag

SEQ ID NO: 206202 - RNA, 22 nt, Homo sapiens
uuggcaauucagauucuuuuau

SEQ ID NO: 206203 - RNA, 22 nt, Homo sapiens
uuguauguuuguucuuucagau

SEQ ID NO: 206204 - RNA, 22 nt, Homo sapiens
uuguccccacccaaaugucauc

SEQ ID NO: 206205 - RNA, 23 nt, Homo sapiens
uuguccccuccaaagcucauguu

SEQ ID NO: 206206 - RNA, 22 nt, Homo sapiens
uuguccucuccaaaucucaugu

SEQ ID NO: 206207 - RNA, 22 nt, Homo sapiens
uuguccuggagguucuugcaag

SEQ ID NO: 206208 - RNA, 22 nt, Homo sapiens
uugucuugcagcuuaggcauca

SEQ ID NO: 206209 - RNA, 22 nt, Homo sapiens
uugugaguggugccgcaauaaa

SEQ ID NO: 206210 - RNA, 18 nt, Homo sapiens
uugugccugagaaggugg

SEQ ID NO: 206211 - RNA, 22 nt, Homo sapiens
uuuacagucuuuugugugaguc

SEQ ID NO: 206212 - RNA, 20 nt, Homo sapiens
uuucaguacuuucuacuggc

SEQ ID NO: 206213 - RNA, 22 nt, Homo sapiens
uuucaguagagacacgguuuug

SEQ ID NO: 206214 - RNA, 23 nt, Homo sapiens
uuucauggggauuuacucauucc

SEQ ID NO: 206215 - RNA, 22 nt, Homo sapiens
uuucauguuuuucugugaggca

SEQ ID NO: 206216 - RNA, 22 nt, Homo sapiens
uuucuauguugaccagucuaga

SEQ ID NO: 206217 - RNA, 22 nt, Homo sapiens
uuucugagaccaaaacuuguaa

SEQ ID NO: 206218 - RNA, 21 nt, Homo sapiens
uucucaggguguguccuaccc

SEQ ID NO: 206219 - RNA, 22 nt, Homo sapiens
uucucagugaacuccagcuugu

SEQ ID NO: 206220 - RNA, 22 nt, Homo sapiens
uucucaguucgguggcagugcu

SEQ ID NO: 206221 - RNA, 22 nt, Homo sapiens
uucugagguuauauucucucaa

SEQ ID NO: 206222 - RNA, 22 nt, Homo sapiens
uucuggcucaggucaacacuuc

SEQ ID NO: 206223 - RNA, 22 nt, Homo sapiens
uucugugguuucauuuaccugu

SEQ ID NO: 206224 - RNA, 22 nt, Homo sapiens
uucuugguguaguaguugaaaa

SEQ ID NO: 206225 - RNA, 22 nt, Homo sapiens
uugagcucuuccagccuggagc

SEQ ID NO: 206226 - RNA, 22 nt, Homo sapiens
uugagggaagccagaggucugc

SEQ ID NO: 206227 - RNA, 22 nt, Homo sapiens
uugaggugaagggcagagcagc

SEQ ID NO: 206228 - RNA, 22 nt, Homo sapiens
uugaggugaauuugcaggaugc

SEQ ID NO: 206229 - RNA, 22 nt, Homo sapiens
uugaggugggaggaucacuuga

SEQ ID NO: 206230 - RNA, 22 nt, Homo sapiens
uugagugaaugaaugauuaaau

SEQ ID NO: 206231 - RNA, 22 nt, Homo sapiens
uugcauaagugcauucugugau

SEQ ID NO: 206232 - RNA, 22 nt, Homo sapiens
uuggaaaugguaaaggguuaau

SEQ ID NO: 206233 - RNA, 22 nt, Homo sapiens
uuggcaaauagguuuuauugca

SEQ ID NO: 206234 - RNA, 23 nt, Homo sapiens
uuggccuccuugugucuagggcu

SEQ ID NO: 206235 - RNA, 22 nt, Homo sapiens
uuggcuuaguugaccacagucu

SEQ ID NO: 206236 - RNA, 22 nt, Homo sapiens
uugggcuugagggugcccaguc

SEQ ID NO: 206237 - RNA, 22 nt, Homo sapiens
uugggcuuuuagguccuuaaca

SEQ ID NO: 206238 - RNA, 22 nt, Homo sapiens
uuggguagugaguuccuccagg

SEQ ID NO: 206239 - RNA, 22 nt, Homo sapiens
uuguacuauuuuuaucagugau

SEQ ID NO: 206240 - RNA, 22 nt, Homo sapiens
uugucaacaugaaacuguguuu

SEQ ID NO: 206241 - RNA, 22 nt, Homo sapiens
uugucauuuucagaguguuacg

SEQ ID NO: 206242 - RNA, 22 nt, Homo sapiens
uuguccauggacagcaccacag

SEQ ID NO: 206243 - RNA, 22 nt, Homo sapiens
uuguccccaucugcugccagaa

SEQ ID NO: 206244 - RNA, 22 nt, Homo sapiens
uuguccccuuccaaaucucaug

SEQ ID NO: 206245 - RNA, 22 nt, Homo sapiens
uuguccuugagauaguuugcag

SEQ ID NO: 206246 - RNA, 22 nt, Homo sapiens
uugugcuucaucaccuagcaga

SEQ ID NO: 206247 - RNA, 22 nt, Homo sapiens
uugugguuuuagcacuguggau

SEQ ID NO: 206248 - RNA, 22 nt, Homo sapiens
uuguuauguuaaacuacugaaa

SEQ ID NO: 206249 - RNA, 22 nt, Homo sapiens
uuuaaaguuagaaggaaagggc

SEQ ID NO: 206250 - RNA, 23 nt, Homo sapiens
uuuaagcuucauguccuaacauc

SEQ ID NO: 206251 - RNA, 22 nt, Homo sapiens
uuuaauguuacaguauugguau

SEQ ID NO: 206252 - RNA, 18 nt, Homo sapiens
uuuacaguagaaggacuu

SEQ ID NO: 206253 - RNA, 22 nt, Homo sapiens
uuuacagucucauagguggaag

SEQ ID NO: 206254 - RNA, 22 nt, Homo sapiens
uuuacaguuuucuaggcuacca

SEQ ID NO: 206255 - RNA, 22 nt, Homo sapiens
uuuaguacugcuuuaugugugu

SEQ ID NO: 206256 - RNA, 19 nt, Homo sapiens
uuucaauguaaggauggag

SEQ ID NO: 206257 - RNA, 23 nt, Homo sapiens
uuucaguaguuguauccuguugc

SEQ ID NO: 206258 - RNA, 22 nt, Homo sapiens
uuucauagaucaugcuuuugga

SEQ ID NO: 206259 - RNA, 22 nt, Homo sapiens
uauggccugaauuagaaaagug

SEQ ID NO: 206260 - RNA, 22 nt, Homo sapiens
uaugucauggguaaagugcccu

SEQ ID NO: 206261 - RNA, 22 nt, Homo sapiens
uaugucuggaguuacugagcug

SEQ ID NO: 206262 - RNA, 22 nt, Homo sapiens
uauugaacuggaucagaaggcc

SEQ ID NO: 206263 - RNA, 22 nt, Homo sapiens
uauugcuuaugaugcugaauua

SEQ ID NO: 206264 - RNA, 22 nt, Homo sapiens
uauugcuuuacucucuuauccu

SEQ ID NO: 206265 - RNA, 22 nt, Homo sapiens
uauugcuuuugauucaaggcag

SEQ ID NO: 206266 - RNA, 22 nt, Homo sapiens
ucaacagugauggaaaguuaua

SEQ ID NO: 206267 - RNA, 22 nt, Homo sapiens
ucaacauugcugucaggcaucu

SEQ ID NO: 206268 - RNA, 21 nt, Homo sapiens
ucaacccuugcgucaccaagc

SEQ ID NO: 206269 - RNA, 22 nt, Homo sapiens
ucaaugcaugugacaaagagua

SEQ ID NO: 206270 - RNA, 18 nt, Homo sapiens
ucaauguggauguucuuu

SEQ ID NO: 206271 - RNA, 22 nt, Homo sapiens
ucacacuguuuugauuauuaua

SEQ ID NO: 206272 - RNA, 22 nt, Homo sapiens
ucacagcuaaaaugaaaguagu

SEQ ID NO: 206273 - RNA, 22 nt, Homo sapiens
ucacaggguguuauuagaauua

SEQ ID NO: 206274 - RNA, 22 nt, Homo sapiens
ucacagucggugacuucuugcu

SEQ ID NO: 206275 - RNA, 23 nt, Homo sapiens
ucacggagaccugcaagaccaau

SEQ ID NO: 206276 - RNA, 22 nt, Homo sapiens
ucacucagaccuggugauaugc

SEQ ID NO: 206277 - RNA, 22 nt, Homo sapiens
ucacugcacuagguaaugccac

SEQ ID NO: 206278 - RNA, 22 nt, Homo sapiens
ucacugcacucuccgccuugcg

SEQ ID NO: 206279 - RNA, 22 nt, Homo sapiens
ucacuuuguauagcgacuggcu

SEQ ID NO: 206280 - RNA, 22 nt, Homo sapiens
ucagaacugaacaaaccagucu

SEQ ID NO: 206281 - RNA, 22 nt, Homo sapiens
ucagacacugagcaaacgacua

SEQ ID NO: 206282 - RNA, 22 nt, Homo sapiens
ucagacacugcccuccaccugu

SEQ ID NO: 206283 - RNA, 22 nt, Homo sapiens
ucagaguggagucugcagccuu

SEQ ID NO: 206284 - RNA, 22 nt, Homo sapiens
ucagaucaugcuuaugauggga

SEQ ID NO: 206285 - RNA, 22 nt, Homo sapiens
ucagaucauuaagguagguuua

SEQ ID NO: 206286 - RNA, 22 nt, Homo sapiens
ucagcacauucaaggccugccu

SEQ ID NO: 206287 - RNA, 23 nt, Homo sapiens
ucagugucuggauccugcucagu

SEQ ID NO: 206288 - RNA, 22 nt, Homo sapiens
ucaucaguggggaugugguuga

SEQ ID NO: 206289 - RNA, 22 nt, Homo sapiens
uccagugugcaggcaaguuuga

SEQ ID NO: 206290 - RNA, 22 nt, Homo sapiens
uccaguguuauaauaugcgucu

SEQ ID NO: 206291 - RNA, 22 nt, Homo sapiens
ucccagugaaaccccaccuuca

SEQ ID NO: 206292 - RNA, 22 nt, Homo sapiens
ucccagugcuaugcaaaagccu

SEQ ID NO: 206293 - RNA, 22 nt, Homo sapiens
ucccauguagcuaggauuacag

SEQ ID NO: 206294 - RNA, 22 nt, Homo sapiens
uccuggcuccacuguuuauucc

SEQ ID NO: 206295 - RNA, 22 nt, Homo sapiens
uccuuuguuacaguuggcucug

SEQ ID NO: 206296 - RNA, 22 nt, Homo sapiens
ucguucuugucaguuuauaaag

SEQ ID NO: 206297 - RNA, 22 nt, Homo sapiens
ucuauggaguuugaaugagaaa

SEQ ID NO: 206298 - RNA, 22 nt, Homo sapiens
ucucacacugaauguguguggg

SEQ ID NO: 206299 - RNA, 19 nt, Homo sapiens
ucucacagcucuacuaugu

SEQ ID NO: 206300 - RNA, 22 nt, Homo sapiens
ucucacauuucacagggauggg

SEQ ID NO: 206301 - RNA, 22 nt, Homo sapiens
ucucagugaauugguuuugucu

SEQ ID NO: 206302 - RNA, 22 nt, Homo sapiens
ucucagugugguaaaaguuuuu

SEQ ID NO: 206303 - RNA, 20 nt, Homo sapiens
ucucccaaacagcaggcccu

SEQ ID NO: 206304 - RNA, 22 nt, Homo sapiens
ucucccuaccugagccgagcca

SEQ ID NO: 206305 - RNA, 22 nt, Homo sapiens
ucucuuggugacuuaaaauguu

SEQ ID NO: 206306 - RNA, 22 nt, Homo sapiens
ucuggcaagagccgagggcagu

SEQ ID NO: 206307 - RNA, 21 nt, Homo sapiens
ucuguguugaucucacuggga

SEQ ID NO: 206308 - RNA, 22 nt, Homo sapiens
ucuguuguuaucauaauauuga

SEQ ID NO: 206309 - RNA, 22 nt, Homo sapiens
ucuuagugcggcugcugcagcc

SEQ ID NO: 206310 - RNA, 22 nt, Homo sapiens
ucuugcuuguuguucccuucau

SEQ ID NO: 206311 - RNA, 22 nt, Homo sapiens
ucuuggccaugaauggcaaggc

SEQ ID NO: 206312 - RNA, 22 nt, Homo sapiens
ucuuucacuuagcaugauguuu

SEQ ID NO: 206313 - RNA, 22 nt, Homo sapiens
ucuuuguuagaacccucuccuu

SEQ ID NO: 206314 - RNA, 22 nt, Homo sapiens
ugaaacacacagagaagggaga

SEQ ID NO: 206315 - RNA, 18 nt, Homo sapiens
ugaaacacauuuuuuccu

SEQ ID NO: 206316 - RNA, 22 nt, Homo sapiens
ugaagaucuuaggagcugaggg

SEQ ID NO: 206317 - RNA, 22 nt, Homo sapiens
ugaauaggcaguuaaguuuaug

SEQ ID NO: 206318 - RNA, 20 nt, Homo sapiens
ugacaaggugcaaagaauca

SEQ ID NO: 206319 - RNA, 22 nt, Homo sapiens
ugacagugaacagguuaccacu

SEQ ID NO: 206320 - RNA, 22 nt, Homo sapiens
ugacaguguccuccuccugaga

SEQ ID NO: 206321 - RNA, 22 nt, Homo sapiens
ugacucgaggcgccuccagucc

SEQ ID NO: 206322 - RNA, 22 nt, Homo sapiens
ugagaacuguuuugguuugggu

SEQ ID NO: 206323 - RNA, 22 nt, Homo sapiens
ugagaagaugaacuccuugguc

SEQ ID NO: 206324 - RNA, 18 nt, Homo sapiens
gacaguguggugauuccu

SEQ ID NO: 206325 - RNA, 22 nt, Homo sapiens
gacuauguuaccuuacacauca

SEQ ID NO: 206326 - RNA, 18 nt, Homo sapiens
gacuccauuucagccaga

SEQ ID NO: 206327 - RNA, 22 nt, Homo sapiens
gacugaggaagcgcucucuccu

SEQ ID NO: 206328 - RNA, 22 nt, Homo sapiens
gagaacuaaugguuugauaagg

SEQ ID NO: 206329 - RNA, 22 nt, Homo sapiens
gagaaugagaggggaaggccac

SEQ ID NO: 206330 - RNA, 22 nt, Homo sapiens
gagacucuuagauuggaaaucu

SEQ ID NO: 206331 - RNA, 22 nt, Homo sapiens
gagagugcuuuggguguaggcc

SEQ ID NO: 206332 - RNA, 22 nt, Homo sapiens
gagaucaaugccuauggcuuuc

SEQ ID NO: 206333 - RNA, 22 nt, Homo sapiens
gagauuuucagcuugacuggga

SEQ ID NO: 206334 - RNA, 22 nt, Homo sapiens
gagcuaguagauuuuaaauauu

SEQ ID NO: 206335 - RNA, 22 nt, Homo sapiens
gagcuguuuuucacuagaccaa

SEQ ID NO: 206336 - RNA, 22 nt, Homo sapiens
gaggaaguuuacaaagcaucug

SEQ ID NO: 206337 - RNA, 23 nt, Homo sapiens
gagugcaaugacaugaucucgga

SEQ ID NO: 206338 - RNA, 22 nt, Homo sapiens
gagugcaauggcgcgaucuggg

SEQ ID NO: 206339 - RNA, 22 nt, Homo sapiens
gagugcuguuagcccuggguuu

SEQ ID NO: 206340 - RNA, 22 nt, Homo sapiens
gaguucaauuuccagcuguucu

SEQ ID NO: 206341 - RNA, 22 nt, Homo sapiens
gauacuguauccuaaaagcuuu

SEQ ID NO: 206342 - RNA, 19 nt, Homo sapiens
gauagacaucacagugcca

SEQ ID NO: 206343 - RNA, 22 nt, Homo sapiens
gauauuacuuccaauauugcaa

SEQ ID NO: 206344 - RNA, 22 nt, Homo sapiens
gaucucaguggauacugugaug

SEQ ID NO: 206345 - RNA, 22 nt, Homo sapiens
gauggugucccaggcucaggcu

SEQ ID NO: 206346 - RNA, 22 nt, Homo sapiens
gccauugcacuacagccuaggc

SEQ ID NO: 206347 - RNA, 22 nt, Homo sapiens
gcccugagauucuuggauucug

SEQ ID NO: 206348 - RNA, 22 nt, Homo sapiens
gcuaugucuguugcucuugggc

SEQ ID NO: 206349 - RNA, 22 nt, Homo sapiens
gcugcguguagaguucucacug

SEQ ID NO: 206350 - RNA, 22 nt, Homo sapiens
gcuguugugaacuauacaucua

SEQ ID NO: 206351 - RNA, 21 nt, Homo sapiens
gcuuuuucggaagucuuuggc

SEQ ID NO: 206352 - RNA, 17 nt, Homo sapiens
ggaaugaauuccagccc

SEQ ID NO: 206353 - RNA, 22 nt, Homo sapiens
ggaaugagaaauauuacacaau

SEQ ID NO: 206354 - RNA, 22 nt, Homo sapiens
ggaauguuaaggcgcuguuggu

SEQ ID NO: 206355 - RNA, 22 nt, Homo sapiens
ggacuagggacauggggagcug

SEQ ID NO: 206356 - RNA, 22 nt, Homo sapiens
ggaguaggcuguccggcaccca

SEQ ID NO: 206357 - RNA, 22 nt, Homo sapiens
ggagucugacuuauaggaaccu

SEQ ID NO: 206358 - RNA, 22 nt, Homo sapiens
ggagucugauuuuuauguugcu

SEQ ID NO: 206359 - RNA, 22 nt, Homo sapiens
ggauacauuuuuccuccucuuc

SEQ ID NO: 206360 - RNA, 23 nt, Homo sapiens
ggauggaaaguuuugagggccac

SEQ ID NO: 206361 - RNA, 22 nt, Homo sapiens
ggcacaaugucagcucacugca

SEQ ID NO: 206362 - RNA, 22 nt, Homo sapiens
ggcacgguggcucacgccugua

SEQ ID NO: 206363 - RNA, 22 nt, Homo sapiens
ggcauugaguggguaggaguca

SEQ ID NO: 206364 - RNA, 22 nt, Homo sapiens
ggcauugugauccaccagccuu

SEQ ID NO: 206365 - RNA, 21 nt, Homo sapiens
ggcauugugcccuugcucuag

SEQ ID NO: 206366 - RNA, 22 nt, Homo sapiens
ggcucagugggguccugguucu

SEQ ID NO: 206367 - RNA, 22 nt, Homo sapiens
gggaaaaugucuauugaaugaa

SEQ ID NO: 206368 - RNA, 22 nt, Homo sapiens
ggugucaguuggccccuacugg

SEQ ID NO: 206369 - RNA, 23 nt, Homo sapiens
guaauacuagucauaguagcagg

SEQ ID NO: 206370 - RNA, 22 nt, Homo sapiens
guaauacuuuugggauauuaga

SEQ ID NO: 206371 - RNA, 22 nt, Homo sapiens
guacaggugcaggaugggcagg

SEQ ID NO: 206372 - RNA, 22 nt, Homo sapiens
guacauggaaugaaauucaaaa

SEQ ID NO: 206373 - RNA, 22 nt, Homo sapiens
guaugugacuggaacaguagga

SEQ ID NO: 206374 - RNA, 22 nt, Homo sapiens
gucaaggaauuuauccauuucu

SEQ ID NO: 206375 - RNA, 22 nt, Homo sapiens
gucauaugcucggaaaauguua

SEQ ID NO: 206376 - RNA, 22 nt, Homo sapiens
gucugugguuccuaugucaccu

SEQ ID NO: 206377 - RNA, 22 nt, Homo sapiens
gucuuccagccuccaucuuucu

SEQ ID NO: 206378 - RNA, 22 nt, Homo sapiens
gugagaggaggcagcuuuuaca

SEQ ID NO: 206379 - RNA, 22 nt, Homo sapiens
gugagauggagucuugcuuugu

SEQ ID NO: 206380 - RNA, 22 nt, Homo sapiens
gugagcacugaaagaaggcaag

SEQ ID NO: 206381 - RNA, 17 nt, Homo sapiens
gugagguggguaguauc

SEQ ID NO: 206382 - RNA, 22 nt, Homo sapiens
gugaggugguacaauauuaacu

SEQ ID NO: 206383 - RNA, 22 nt, Homo sapiens
gugagguguuaaccaaccugug

SEQ ID NO: 206384 - RNA, 22 nt, Homo sapiens
gugauagguugucacugucacu

SEQ ID NO: 206385 - RNA, 20 nt, Homo sapiens
gugauuggucacugguuguu

SEQ ID NO: 206386 - RNA, 22 nt, Homo sapiens
gugccacugcacuccggccugg

SEQ ID NO: 206387 - RNA, 22 nt, Homo sapiens
gugcuuguguuaauauguagcu

SEQ ID NO: 206388 - RNA, 22 nt, Homo sapiens
gugcuuuguuguggcaguggca

SEQ ID NO: 206389 - RNA, 22 nt, Homo sapiens
guggaaaacauaugcuuguuga

SEQ ID NO: 206390 - RNA, 22 nt, Homo sapiens
guggaucacuugaggucaagag

SEQ ID NO: 206391 - RNA, 22 nt, Homo sapiens
gugucacugugaggauauugua

SEQ ID NO: 206392 - RNA, 18 nt, Homo sapiens
gugucugguuaugggagu

SEQ ID NO: 206393 - RNA, 22 nt, Homo sapiens
gugugauguaaagaacugggga

SEQ ID NO: 206394 - RNA, 22 nt, Homo sapiens
guuacagucuuguguaagguua

SEQ ID NO: 206395 - RNA, 22 nt, Homo sapiens
aucacagcccuccucuuggaug

SEQ ID NO: 206396 - RNA, 22 nt, Homo sapiens
aucacaguuuuaccauuuggua

SEQ ID NO: 206397 - RNA, 22 nt, Homo sapiens
aucagagccugugugcccugaa

SEQ ID NO: 206398 - RNA, 22 nt, Homo sapiens
aucauccagccccagaagggag

SEQ ID NO: 206399 - RNA, 22 nt, Homo sapiens
aucucaguucaggcuggccaca

SEQ ID NO: 206400 - RNA, 22 nt, Homo sapiens
aucugggguuggcaaaguuugg

SEQ ID NO: 206401 - RNA, 22 nt, Homo sapiens
aucugugguuguaugcauauua

SEQ ID NO: 206402 - RNA, 22 nt, Homo sapiens
augaaaugcauguuaaguccgu

SEQ ID NO: 206403 - RNA, 22 nt, Homo sapiens
augagaauguaaguuaaugaaa

SEQ ID NO: 206404 - RNA, 22 nt, Homo sapiens
augagaugauaggcguucuaac

SEQ ID NO: 206405 - RNA, 22 nt, Homo sapiens
augagaugcaagauuagauggg

SEQ ID NO: 206406 - RNA, 22 nt, Homo sapiens
augaggugauaucuggaaauua

SEQ ID NO: 206407 - RNA, 22 nt, Homo sapiens
augaggugcagaggaaaugagu

SEQ ID NO: 206408 - RNA, 22 nt, Homo sapiens
augaggugggcggcuuggaaga

SEQ ID NO: 206409 - RNA, 21 nt, Homo sapiens
augagguguacuguggugaaa

SEQ ID NO: 206410 - RNA, 22 nt, Homo sapiens
augagguguuuauuguauccug

SEQ ID NO: 206411 - RNA, 22 nt, Homo sapiens
augcacaucagcuccagggacc

SEQ ID NO: 206412 - RNA, 22 nt, Homo sapiens
augcacuuggcaggaugauucc

SEQ ID NO: 206413 - RNA, 22 nt, Homo sapiens
auggaggacaaugucaccuuca

SEQ ID NO: 206414 - RNA, 22 nt, Homo sapiens
augucauagaagccugugaacc

SEQ ID NO: 206415 - RNA, 22 nt, Homo sapiens
augucauagauaaggaagugga

SEQ ID NO: 206416 - RNA, 22 nt, Homo sapiens
auguccaugagcacauguauca

SEQ ID NO: 206417 - RNA, 22 nt, Homo sapiens
augugcaacugcuggaacaguc

SEQ ID NO: 206418 - RNA, 22 nt, Homo sapiens
auuaauguaauuaguaaaguug

SEQ ID NO: 206419 - RNA, 22 nt, Homo sapiens
auuacauagucaaggugucuca

SEQ ID NO: 206420 - RNA, 22 nt, Homo sapiens
auuagguuggugcaaaaguaau

SEQ ID NO: 206421 - RNA, 22 nt, Homo sapiens
auuaucacaguuuugcauaugg

SEQ ID NO: 206422 - RNA, 22 nt, Homo sapiens
auucaagugaugcagcuguuuu

SEQ ID NO: 206423 - RNA, 22 nt, Homo sapiens
auugcauugugaucuucccaga

SEQ ID NO: 206424 - RNA, 22 nt, Homo sapiens
auugccucaauuccaagacugc

SEQ ID NO: 206425 - RNA, 19 nt, Homo sapiens
auuugaucaucaggcacag

SEQ ID NO: 206426 - RNA, 22 nt, Homo sapiens
caaaggcuguuauaggccagga

SEQ ID NO: 206427 - RNA, 22 nt, Homo sapiens
caaauacuuucauguugucuug

SEQ ID NO: 206428 - RNA, 22 nt, Homo sapiens
caagacuguccaacauauuggg

SEQ ID NO: 206429 - RNA, 22 nt, Homo sapiens
caauacuguguugaauaagagu

SEQ ID NO: 206430 - RNA, 21 nt, Homo sapiens
caauggcacgaucuuggcuca

SEQ ID NO: 206431 - RNA, 22 nt, Homo sapiens
cacaguagaauagagcacuagg

SEQ ID NO: 206432 - RNA, 22 nt, Homo sapiens
cacagucuugcaauauugagau

SEQ ID NO: 206433 - RNA, 22 nt, Homo sapiens
cacagugaacaauauccucugu

SEQ ID NO: 206434 - RNA, 22 nt, Homo sapiens
cacagugaaugucaucauugcc

SEQ ID NO: 206435 - RNA, 22 nt, Homo sapiens
cacaguguucauagccaucagg

SEQ ID NO: 206436 - RNA, 22 nt, Homo sapiens
cacugcacuccagccuaagagg

SEQ ID NO: 206437 - RNA, 21 nt, Homo sapiens
cacugcacuugccuucugggu

SEQ ID NO: 206438 - RNA, 22 nt, Homo sapiens
cacugcgaccuccaccucccgg

SEQ ID NO: 206439 - RNA, 23 nt, Homo sapiens
cacugggcagcagguguucccag

SEQ ID NO: 206440 - RNA, 22 nt, Homo sapiens
cacuguggauggaacuauguga

SEQ ID NO: 206441 - RNA, 22 nt, Homo sapiens
cagagguaagcaagucagcauu

SEQ ID NO: 206442 - RNA, 22 nt, Homo sapiens
cagcuguuguuaugucugcagg

SEQ ID NO: 206443 - RNA, 22 nt, Homo sapiens
caggcacgcuugggagacacac

SEQ ID NO: 206444 - RNA, 22 nt, Homo sapiens
cagucacagugacaggaugugg

SEQ ID NO: 206445 - RNA, 23 nt, Homo sapiens
cagugcauuguggcauucagcau

SEQ ID NO: 206446 - RNA, 22 nt, Homo sapiens
caguggaugaacaagaagugau

SEQ ID NO: 206447 - RNA, 23 nt, Homo sapiens
caucacagagccuuccuugacuc

SEQ ID NO: 206448 - RNA, 22 nt, Homo sapiens
caucacaguacuaaucgucaua

SEQ ID NO: 206449 - RNA, 22 nt, Homo sapiens
caucagcaauguaugaggguuc

SEQ ID NO: 206450 - RNA, 22 nt, Homo sapiens
cauggcacauauauaucuaggu

SEQ ID NO: 206451 - RNA, 22 nt, Homo sapiens
cauugcacuccaucccgggaaa

SEQ ID NO: 206452 - RNA, 22 nt, Homo sapiens
ccaaauccauccaaaucauaga

SEQ ID NO: 206453 - RNA, 22 nt, Homo sapiens
ccacugggcaguuuauuaucag

SEQ ID NO: 206454 - RNA, 20 nt, Homo sapiens
ccaucaguccucucuuguuc

SEQ ID NO: 206455 - RNA, 22 nt, Homo sapiens
ccccuguaaacuggcuucccug

SEQ ID NO: 206456 - RNA, 17 nt, Homo sapiens
cccuaguagcugggacu

SEQ ID NO: 206457 - RNA, 22 nt, Homo sapiens
cccugagcagccugaguuuccc

SEQ ID NO: 206458 - RNA, 22 nt, Homo sapiens
ccuggcacugggccccguggcu

SEQ ID NO: 206459 - RNA, 22 nt, Homo sapiens
ccuucuuuuguaaggcugaaua

SEQ ID NO: 206460 - RNA, 22 nt, Homo sapiens
cuaaaacuuucugagugcagca

SEQ ID NO: 206461 - RNA, 22 nt, Homo sapiens
cuaaggaaggacugaaaggaca

SEQ ID NO: 206462 - RNA, 22 nt, Homo sapiens
cuaugcuucuuaaauuaguuau

SEQ ID NO: 206463 - RNA, 22 nt, Homo sapiens
cuauggcuguaugacgugcaug

SEQ ID NO: 206464 - RNA, 22 nt, Homo sapiens
cucaaguacaugggauuacagg

SEQ ID NO: 206465 - RNA, 22 nt, Homo sapiens
cucacaugcucaccugguguuc

SEQ ID NO: 206466 - RNA, 22 nt, Homo sapiens
cucaguguucccauucuaccuu

SEQ ID NO: 206467 - RNA, 22 nt, Homo sapiens
cuccacugagcaggugggaggc

SEQ ID NO: 206468 - RNA, 22 nt, Homo sapiens
cuccaugagauuguugaaguag

SEQ ID NO: 206469 - RNA, 22 nt, Homo sapiens
cucccagagccaguuauaggcu

SEQ ID NO: 206470 - RNA, 22 nt, Homo sapiens
cucucaagaugcugggauuaca

SEQ ID NO: 206471 - RNA, 21 nt, Homo sapiens
aaacuggcccaauuguuccau

SEQ ID NO: 206472 - RNA, 22 nt, Homo sapiens
aaagagaucuaugggcacuaug

SEQ ID NO: 206473 - RNA, 22 nt, Homo sapiens
aaagugcugagaguucuaacuu

SEQ ID NO: 206474 - RNA, 22 nt, Homo sapiens
aaaugcuucuauguggcauguu

SEQ ID NO: 206475 - RNA, 22 nt, Homo sapiens
aaauggcuuugaggguaggaca

SEQ ID NO: 206476 - RNA, 22 nt, Homo sapiens
aaauggcuuuuugggcaaggug

SEQ ID NO: 206477 - RNA, 22 nt, Homo sapiens
aacaggguggugccugguccau

SEQ ID NO: 206478 - RNA, 22 nt, Homo sapiens
aacccugacacaagcagaauuu

SEQ ID NO: 206479 - RNA, 22 nt, Homo sapiens
aaggcuauuugagaaugugugu

SEQ ID NO: 206480 - RNA, 22 nt, Homo sapiens
aaggcuguucauuuagcacagu

SEQ ID NO: 206481 - RNA, 22 nt, Homo sapiens
aaggcuguuguguaauaggauu

SEQ ID NO: 206482 - RNA, 22 nt, Homo sapiens
auggcuagaaccuguauauuca

SEQ ID NO: 206483 - RNA, 22 nt, Homo sapiens
augggcacugauguauucugug

SEQ ID NO: 206484 - RNA, 22 nt, Homo sapiens
auggugugugaauuaaauguua

SEQ ID NO: 206485 - RNA, 22 nt, Homo sapiens
augguuuuacugcaaaauggga

SEQ ID NO: 206486 - RNA, 22 nt, Homo sapiens
augucuggcagaagacuucuca

SEQ ID NO: 206487 - RNA, 22 nt, Homo sapiens
augugccaauuaggauuccaag

SEQ ID NO: 206488 - RNA, 22 nt, Homo sapiens
auguggcuuuucaacuguguga

SEQ ID NO: 206489 - RNA, 22 nt, Homo sapiens
auguuagcaucaauauucauca

SEQ ID NO: 206490 - RNA, 22 nt, Homo sapiens
auuaaucaggcaaugcuugcua

SEQ ID NO: 206491 - RNA, 22 nt, Homo sapiens
auuagguuaggcaaacuucugu

SEQ ID NO: 206492 - RNA, 22 nt, Homo sapiens
auuagguuagugcaaaaguaau

SEQ ID NO: 206493 - RNA, 22 nt, Homo sapiens
auuagguuguugcaaaaguaau

SEQ ID NO: 206494 - RNA, 22 nt, Homo sapiens
auucaagugaugugauucuucu

SEQ ID NO: 206495 - RNA, 22 nt, Homo sapiens
auuccagguggcgccauucaca

SEQ ID NO: 206496 - RNA, 18 nt, Homo sapiens
auugcacaccagccuggg

SEQ ID NO: 206497 - RNA, 22 nt, Homo sapiens
auugcaguuucaacuccagggc

SEQ ID NO: 206498 - RNA, 22 nt, Homo sapiens
auuugacacugagagccucagu

SEQ ID NO: 206499 - RNA, 22 nt, Homo sapiens
caaagucuucucauuaugucuu

SEQ ID NO: 206500 - RNA, 22 nt, Homo sapiens
caacacuguuuauuggauagcc

SEQ ID NO: 206501 - RNA, 23 nt, Homo sapiens
caauacugaccucacguuaauag

SEQ ID NO: 206502 - RNA, 22 nt, Homo sapiens
cacaggccugucucuuucuaac

SEQ ID NO: 206503 - RNA, 22 nt, Homo sapiens
cacagugaacugguggguuuuu

SEQ ID NO: 206504 - RNA, 22 nt, Homo sapiens
cacugggccaucacuuaauauu

SEQ ID NO: 206505 - RNA, 22 nt, Homo sapiens
cacugggugagauccauguuua

SEQ ID NO: 206506 - RNA, 22 nt, Homo sapiens
cacugggugccauauguuugcu

SEQ ID NO: 206507 - RNA, 22 nt, Homo sapiens
cacuggguuagaacaugcuccu

SEQ ID NO: 206508 - RNA, 21 nt, Homo sapiens
cacuggguucaggcuugugga

SEQ ID NO: 206509 - RNA, 22 nt, Homo sapiens
cacuggucucauggcaugagag

SEQ ID NO: 206510 - RNA, 22 nt, Homo sapiens
cagacagugucccgagucccug

SEQ ID NO: 206511 - RNA, 22 nt, Homo sapiens
cagaugcaugaccugggcuugg

SEQ ID NO: 206512 - RNA, 22 nt, Homo sapiens
cagcacauagcaguugcucagu

SEQ ID NO: 206513 - RNA, 22 nt, Homo sapiens
cagcuguuguuccagucuuuua

SEQ ID NO: 206514 - RNA, 22 nt, Homo sapiens
caggcauuguccaugcugaagg

SEQ ID NO: 206515 - RNA, 22 nt, Homo sapiens
cagggaauguuauuuaauagca

SEQ ID NO: 206516 - RNA, 22 nt, Homo sapiens
cagugcauccauguucagcagu

SEQ ID NO: 206517 - RNA, 22 nt, Homo sapiens
cagugguuuucucaguucagca

SEQ ID NO: 206518 - RNA, 22 nt, Homo sapiens
cagugucugcauuuggaacuca

SEQ ID NO: 206519 - RNA, 22 nt, Homo sapiens
caucacagcaaguagggagugg

SEQ ID NO: 206520 - RNA, 22 nt, Homo sapiens
caucccugucgucaagucucug

SEQ ID NO: 206521 - RNA, 22 nt, Homo sapiens
caugaaagacugaggaauugga

SEQ ID NO: 206522 - RNA, 22 nt, Homo sapiens
cauggcacagagaauguguucu

SEQ ID NO: 206523 - RNA, 22 nt, Homo sapiens
cauggcccuggguccauaggaa

SEQ ID NO: 206524 - RNA, 22 nt, Homo sapiens
caugguguuaggcacugggaau

SEQ ID NO: 206525 - RNA, 22 nt, Homo sapiens
cauugcacacauuuaccuaugu

SEQ ID NO: 206526 - RNA, 22 nt, Homo sapiens
ccaaaucucauguugaaaugug

SEQ ID NO: 206527 - RNA, 22 nt, Homo sapiens
ccagugauuguauggugaaggu

SEQ ID NO: 206528 - RNA, 22 nt, Homo sapiens
ccagugucugacagacacggcg

SEQ ID NO: 206529 - RNA, 22 nt, Homo sapiens
ccaguguuuuugaauuccagga

SEQ ID NO: 206530 - RNA, 22 nt, Homo sapiens
cccucauucauucauccuaugu

SEQ ID NO: 206531 - RNA, 22 nt, Homo sapiens
cccuguguuguucaaggaucug

SEQ ID NO: 206532 - RNA, 22 nt, Homo sapiens
cccuguguuuagcugaagguuu

SEQ ID NO: 206533 - RNA, 22 nt, Homo sapiens
ccuguguuaugguuucuaaugu

SEQ ID NO: 206534 - RNA, 19 nt, Homo sapiens
ccuuugguuuccaugacau

SEQ ID NO: 206535 - RNA, 22 nt, Homo sapiens
cgccugagcugaggaagcugca

SEQ ID NO: 206536 - RNA, 18 nt, Homo sapiens
cuaauacuauucaacaag

SEQ ID NO: 206537 - RNA, 22 nt, Homo sapiens
cuaggcacgccugggucuccag

SEQ ID NO: 206538 - RNA, 22 nt, Homo sapiens
cuauggcucugucuuuuaaguu

SEQ ID NO: 206539 - RNA, 22 nt, Homo sapiens
cucacuaguaaggcuguuuagu

SEQ ID NO: 206540 - RNA, 22 nt, Homo sapiens
cucaguagaaaauacauggacu

SEQ ID NO: 206541 - RNA, 21 nt, Homo sapiens
cucauauugcuuuuccauggu

SEQ ID NO: 206542 - RNA, 22 nt, Homo sapiens
cucauugcaaucuccaccuccc

SEQ ID NO: 206543 - RNA, 22 nt, Homo sapiens
cuccaggugucauccaccuccu

SEQ ID NO: 206544 - RNA, 22 nt, Homo sapiens
cucucaguguggaggccagaaa

SEQ ID NO: 206545 - RNA, 22 nt, Homo sapiens
cucuuagauuagccauccuaau

SEQ ID NO: 206546 - RNA, 22 nt, Homo sapiens
cugagcacugagauccucuagc

SEQ ID NO: 206547 - RNA, 20 nt, Homo sapiens
cugaggugggagaaucgcuu

SEQ ID NO: 206548 - RNA, 22 nt, Homo sapiens
cugaggugggaguuuuucucau

SEQ ID NO: 206549 - RNA, 22 nt, Homo sapiens
cugcaagaaucguaguauuuga

SEQ ID NO: 206550 - RNA, 22 nt, Homo sapiens
cugccugagaaaauggagggca

SEQ ID NO: 206551 - RNA, 22 nt, Homo sapiens
cuggcucauuucauuuagcaua

SEQ ID NO: 206552 - RNA, 22 nt, Homo sapiens
caucacuguugguacaaguaau

SEQ ID NO: 206553 - RNA, 22 nt, Homo sapiens
cauugcacuccagccuugguga

SEQ ID NO: 206554 - RNA, 22 nt, Homo sapiens
cauugcacuuagacaacuuuug

SEQ ID NO: 206555 - RNA, 22 nt, Homo sapiens
cauuugcacugagacucagcuu

SEQ ID NO: 206556 - RNA, 22 nt, Homo sapiens
ccacaguggauuaaaguuacug

SEQ ID NO: 206557 - RNA, 22 nt, Homo sapiens
cccagagacagaaugauaaacu

SEQ ID NO: 206558 - RNA, 20 nt, Homo sapiens
ccccuggaguggggcugcuu

SEQ ID NO: 206559 - RNA, 22 nt, Homo sapiens
cuacagaguaucuaaagaggua

SEQ ID NO: 206560 - RNA, 22 nt, Homo sapiens
cuagauuauccaacuuauuagc

SEQ ID NO: 206561 - RNA, 22 nt, Homo sapiens
cuagcaggcaagauaagauuca

SEQ ID NO: 206562 - RNA, 22 nt, Homo sapiens
cucaaagucaagggaaagcagg

SEQ ID NO: 206563 - RNA, 18 nt, Homo sapiens
cucacacccuaaucagga

SEQ ID NO: 206564 - RNA, 22 nt, Homo sapiens
cucacugugguguccuuaggua

SEQ ID NO: 206565 - RNA, 22 nt, Homo sapiens
cucaguguuucagcugcucaga

SEQ ID NO: 206566 - RNA, 23 nt, Homo sapiens
cuccaugagccguccagggccug

SEQ ID NO: 206567 - RNA, 22 nt, Homo sapiens
cucccagugacccaggaacagg

SEQ ID NO: 206568 - RNA, 22 nt, Homo sapiens
cuccuguagccccaucaucuuu

SEQ ID NO: 206569 - RNA, 22 nt, Homo sapiens
cugacagaugacugccacugua

SEQ ID NO: 206570 - RNA, 22 nt, Homo sapiens
cugagaauguaaaugaagcuuu

SEQ ID NO: 206571 - RNA, 22 nt, Homo sapiens
cugaggugggaggauuacuuga

SEQ ID NO: 206572 - RNA, 22 nt, Homo sapiens
cugagugcaagugauccuccca

SEQ ID NO: 206573 - RNA, 22 nt, Homo sapiens
cugcaguaaccacuguaggugu

SEQ ID NO: 206574 - RNA, 22 nt, Homo sapiens
cuggaauguuccuaaagauuca

SEQ ID NO: 206575 - RNA, 22 nt, Homo sapiens
cuggagucugacugacacaagg

SEQ ID NO: 206576 - RNA, 22 nt, Homo sapiens
cuggauagagauugaugaugcu

SEQ ID NO: 206577 - RNA, 22 nt, Homo sapiens
cuggucaugggggcacccucug

SEQ ID NO: 206578 - RNA, 22 nt, Homo sapiens
cuguaugugagaaauaauaagu

SEQ ID NO: 206579 - RNA, 22 nt, Homo sapiens
cugucuggaggccugcaaauaa

SEQ ID NO: 206580 - RNA, 22 nt, Homo sapiens
cugugcauuggaugucucccug

SEQ ID NO: 206581 - RNA, 22 nt, Homo sapiens
cugugcuugagagaugacacag

SEQ ID NO: 206582 - RNA, 22 nt, Homo sapiens
cuguggauguauugcacagucu

SEQ ID NO: 206583 - RNA, 22 nt, Homo sapiens
cugugguuacguucuuugugcu

SEQ ID NO: 206584 - RNA, 22 nt, Homo sapiens
cugugguugagcuuugccauga

SEQ ID NO: 206585 - RNA, 22 nt, Homo sapiens
cuguguaguacuagauugagca

SEQ ID NO: 206586 - RNA, 22 nt, Homo sapiens
cuguuugguuaucuuuuccugu

SEQ ID NO: 206587 - RNA, 22 nt, Homo sapiens
cuuacagucuaucagccacaac

SEQ ID NO: 206588 - RNA, 22 nt, Homo sapiens
cuucaugggagaaccacaggua

SEQ ID NO: 206589 - RNA, 22 nt, Homo sapiens
cuugcacucagaagauucaguu

SEQ ID NO: 206590 - RNA, 22 nt, Homo sapiens
cuuggcuccgacuccccuccaa

SEQ ID NO: 206591 - RNA, 22 nt, Homo sapiens
cuuggcuuguuguccccugcuc

SEQ ID NO: 206592 - RNA, 22 nt, Homo sapiens
cuuugguugugcucuccacuuu

SEQ ID NO: 206593 - RNA, 21 nt, Homo sapiens
cuuuuuacucguucauaugca

SEQ ID NO: 206594 - RNA, 22 nt, Homo sapiens
gaaaacugcuucucuggguuuc

SEQ ID NO: 206595 - RNA, 22 nt, Homo sapiens
gugagaugugacuucugccucu

SEQ ID NO: 206596 - RNA, 22 nt, Homo sapiens
gugauauguuaggaucuaaguc

SEQ ID NO: 206597 - RNA, 22 nt, Homo sapiens
gugcaaugagaaggggcucugg

SEQ ID NO: 206598 - RNA, 22 nt, Homo sapiens
gugccuagugcuauugugcccu

SEQ ID NO: 206599 - RNA, 23 nt, Homo sapiens
gugccuucugagccuagucucca

SEQ ID NO: 206600 - RNA, 22 nt, Homo sapiens
guggcuuuauuuagaagcaggg

SEQ ID NO: 206601 - RNA, 22 nt, Homo sapiens
gugucacuguauaauauuuauu

SEQ ID NO: 206602 - RNA, 22 nt, Homo sapiens
gugucucagcccagaccuauuu

SEQ ID NO: 206603 - RNA, 22 nt, Homo sapiens
gugugucuugaccaggaucgga

SEQ ID NO: 206604 - RNA, 22 nt, Homo sapiens
guuaaugcuggaauaaguuaag

SEQ ID NO: 206605 - RNA, 22 nt, Homo sapiens
guucaagugauagcugggauua

SEQ ID NO: 206606 - RNA, 21 nt, Homo sapiens
guucaagugauccuccugucu

SEQ ID NO: 206607 - RNA, 22 nt, Homo sapiens
guugccuaggcuggagugcagu

SEQ ID NO: 206608 - RNA, 22 nt, Homo sapiens
guuuaggaaugagaauauuuag

SEQ ID NO: 206609 - RNA, 22 nt, Homo sapiens
guuuggcuuucucucuauccug

SEQ ID NO: 206610 - RNA, 22 nt, Homo sapiens
uaaagcuacaguauaugguauu

SEQ ID NO: 206611 - RNA, 22 nt, Homo sapiens
uaacaguguauuuacuacuucc

SEQ ID NO: 206612 - RNA, 22 nt, Homo sapiens
uaacccuuacaacuacacucgu

SEQ ID NO: 206613 - RNA, 22 nt, Homo sapiens
uaacccuuaguaucuguggguu

SEQ ID NO: 206614 - RNA, 22 nt, Homo sapiens
uaaggcuagcaagaugagaaua

SEQ ID NO: 206615 - RNA, 22 nt, Homo sapiens
uaagguuuuugauaugcugcug

SEQ ID NO: 206616 - RNA, 22 nt, Homo sapiens
uaaugcauguaaugggcugaua

SEQ ID NO: 206617 - RNA, 22 nt, Homo sapiens
uaaugcuguggucugguuuaaa

SEQ ID NO: 206618 - RNA, 22 nt, Homo sapiens
uacaaguaauaagggaagaauu

SEQ ID NO: 206619 - RNA, 22 nt, Homo sapiens
uacaccugcacucuagccuggg

SEQ ID NO: 206620 - RNA, 19 nt, Homo sapiens
uacaggacugagcugaggu

SEQ ID NO: 206621 - RNA, 22 nt, Homo sapiens
uacaguaguaucuucauuuguu

SEQ ID NO: 206622 - RNA, 23 nt, Homo sapiens
uaccacauuccuucuuuccuguu

SEQ ID NO: 206623 - RNA, 22 nt, Homo sapiens
uacucagugacugguggaucaa

SEQ ID NO: 206624 - RNA, 22 nt, Homo sapiens
uagaagcacuaucccuccuagu

SEQ ID NO: 206625 - RNA, 22 nt, Homo sapiens
uagaggaaugaauuuggccaga

SEQ ID NO: 206626 - RNA, 20 nt, Homo sapiens
uagcacacauguagaauagu

SEQ ID NO: 206627 - RNA, 22 nt, Homo sapiens
uagcacagugucauucuaggua

SEQ ID NO: 206628 - RNA, 18 nt, Homo sapiens
uagcucuuguugguccau

SEQ ID NO: 206629 - RNA, 22 nt, Homo sapiens
uagcuguuggugggaagucaga

SEQ ID NO: 206630 - RNA, 22 nt, Homo sapiens
uagggagugucuucauuuugua

SEQ ID NO: 206631 - RNA, 22 nt, Homo sapiens
uagggcuuuuccaagcugccac

SEQ ID NO: 206632 - RNA, 22 nt, Homo sapiens
uagguugucaucagucuccacu

SEQ ID NO: 206633 - RNA, 20 nt, Homo sapiens
uagguuuucacagaauugcc

SEQ ID NO: 206634 - RNA, 22 nt, Homo sapiens
uaguauguuuauagcauugagu

SEQ ID NO: 206635 - RNA, 20 nt, Homo sapiens
uaguggaaaucagguccucu

SEQ ID NO: 206636 - RNA, 22 nt, Homo sapiens
uaucacagaggguauccuagag

SEQ ID NO: 206637 - RNA, 22 nt, Homo sapiens
uauugcuugaggaaaugguaau

SEQ ID NO: 206638 - RNA, 22 nt, Homo sapiens
uauugcuuuuaacccaaucucu

SEQ ID NO: 206639 - RNA, 22 nt, Homo sapiens
ucaaaguauucuucugagaacc

SEQ ID NO: 206640 - RNA, 22 nt, Homo sapiens
ucaacacaguuaaauggggaaa

SEQ ID NO: 206641 - RNA, 22 nt, Homo sapiens
ucacaaagcuuggccugcuucu

SEQ ID NO: 206642 - RNA, 22 nt, Homo sapiens
ucacagaugaggcgagaggcag

SEQ ID NO: 206643 - RNA, 22 nt, Homo sapiens
ucacaguucagcauggcugagg

SEQ ID NO: 206644 - RNA, 22 nt, Homo sapiens
ucacaguugauugaaacacagc

SEQ ID NO: 206645 - RNA, 20 nt, Homo sapiens
ucacauccucucccaacaug

SEQ ID NO: 206646 - RNA, 22 nt, Homo sapiens
ucacaugugcguuuuggcaugu

SEQ ID NO: 206647 - RNA, 22 nt, Homo sapiens
ucacugaaaccgccuccaccuc

SEQ ID NO: 206648 - RNA, 22 nt, Homo sapiens
ucacugaaaccuccgccuucug

SEQ ID NO: 206649 - RNA, 22 nt, Homo sapiens
ucacugagaaugauguuucuga

SEQ ID NO: 206650 - RNA, 20 nt, Homo sapiens
ucacugugaacuucuugagg

SEQ ID NO: 206651 - RNA, 22 nt, Homo sapiens
ucacugugagaguuuauccugu

SEQ ID NO: 206652 - RNA, 22 nt, Homo sapiens
ucagaguaguuccuggcagaaa

SEQ ID NO: 206653 - RNA, 22 nt, Homo sapiens
ucagagugcagggaguagcagc

SEQ ID NO: 206654 - RNA, 22 nt, Homo sapiens
ucagaucacuggcgcuggcgga

SEQ ID NO: 206655 - RNA, 19 nt, Homo sapiens
ucagaucagcccaagggau

SEQ ID NO: 206656 - RNA, 22 nt, Homo sapiens
ucaggcaccuuccucuuaucug

SEQ ID NO: 206657 - RNA, 22 nt, Homo sapiens
ucagguagugccaugauugauu

SEQ ID NO: 206658 - RNA, 22 nt, Homo sapiens
ucaguaccugagagugggcaga

SEQ ID NO: 206659 - RNA, 22 nt, Homo sapiens
ucaguauaugaaucuggggcag

SEQ ID NO: 206660 - RNA, 22 nt, Homo sapiens
ucagugccauugccauaugagu

SEQ ID NO: 206661 - RNA, 21 nt, Homo sapiens
ucagugcugugggcaaggugc

SEQ ID NO: 206662 - RNA, 22 nt, Homo sapiens
ucagugcuuggcacagagagcu

SEQ ID NO: 206663 - RNA, 22 nt, Homo sapiens
ucagugcuuuuuguugucauca

SEQ ID NO: 206664 - RNA, 22 nt, Homo sapiens
ucagugucugcauucuuauugu

SEQ ID NO: 206665 - RNA, 22 nt, Homo sapiens
ucauacgucuccuugugccacc

SEQ ID NO: 206666 - RNA, 22 nt, Homo sapiens
ucauaguagucacuuaauaaau

SEQ ID NO: 206667 - RNA, 22 nt, Homo sapiens
ucauauguaugugcaauuuugu

SEQ ID NO: 206668 - RNA, 22 nt, Homo sapiens
ucaucagguaugucagcggagu

SEQ ID NO: 206669 - RNA, 22 nt, Homo sapiens
ucaucucaguuucuugccguac

SEQ ID NO: 206670 - RNA, 22 nt, Homo sapiens
ucauuguccaacuucuuucagu

SEQ ID NO: 206671 - RNA, 22 nt, Homo sapiens
uccaguacaggucucucauuuc

SEQ ID NO: 206672 - RNA, 22 nt, Homo sapiens
uccagugcauucagacacuugg

SEQ ID NO: 206673 - RNA, 22 nt, Homo sapiens
uccaguguuucuuccacuauuu

SEQ ID NO: 206674 - RNA, 20 nt, Homo sapiens
uccaguuuuggagacauucu

SEQ ID NO: 206675 - RNA, 22 nt, Homo sapiens
uccauuuguucagcuucaggaa

SEQ ID NO: 206676 - RNA, 22 nt, Homo sapiens
uccccugagaacuugcuagaaa

SEQ ID NO: 206677 - RNA, 22 nt, Homo sapiens
ucccuacuggggcacugccuag

SEQ ID NO: 206678 - RNA, 22 nt, Homo sapiens
ucccuacugggguacugccuag

SEQ ID NO: 206679 - RNA, 22 nt, Homo sapiens
ucccuuaaugaugaacaaugag

SEQ ID NO: 206680 - RNA, 22 nt, Homo sapiens
ucucaagaugguagaugggaau

SEQ ID NO: 206681 - RNA, 22 nt, Homo sapiens
ucucagagccuaggguuuuuca

SEQ ID NO: 206682 - RNA, 22 nt, Homo sapiens
ucucagcacagucagggcgccu

SEQ ID NO: 206683 - RNA, 22 nt, Homo sapiens
ucucaguguuaucuaucugccu

SEQ ID NO: 206684 - RNA, 22 nt, Homo sapiens
ucucccauccguacacggauug

SEQ ID NO: 206685 - RNA, 22 nt, Homo sapiens
ucucuuggcggaaguugcagug

SEQ ID NO: 206686 - RNA, 22 nt, Homo sapiens
ucugacucuggagucucagguu

SEQ ID NO: 206687 - RNA, 22 nt, Homo sapiens
ucuggguuuuuacaauguuuac

SEQ ID NO: 206688 - RNA, 22 nt, Homo sapiens
ucugugcuugucauaugcuuug

SEQ ID NO: 206689 - RNA, 22 nt, Homo sapiens
ucuguggugggcuccacccagu

SEQ ID NO: 206690 - RNA, 22 nt, Homo sapiens
ucuguguugaucacacugggag

SEQ ID NO: 206691 - RNA, 22 nt, Homo sapiens
ucuguuguuguuuuaagagaca

SEQ ID NO: 206692 - RNA, 22 nt, Homo sapiens
ucuuggcaaagaauuuuuggcu

SEQ ID NO: 206693 - RNA, 22 nt, Homo sapiens
ugaaaugauuauaugguguuug

SEQ ID NO: 206694 - RNA, 22 nt, Homo sapiens
ugaaggacauaaggcagaguga

SEQ ID NO: 206695 - RNA, 23 nt, Homo sapiens
ugaauguaucgaaugugggaaag

SEQ ID NO: 206696 - RNA, 22 nt, Homo sapiens
ugaauguccugacgcugcaguu

SEQ ID NO: 206697 - RNA, 22 nt, Homo sapiens
ugacagaggucuuuuaauagcu

SEQ ID NO: 206698 - RNA, 22 nt, Homo sapiens
ugacagcugaggcccagaguac

SEQ ID NO: 206699 - RNA, 22 nt, Homo sapiens
ugacuaaaacugaguuucauua

SEQ ID NO: 206700 - RNA, 22 nt, Homo sapiens
ugacuccagagacugugcuguc

SEQ ID NO: 206701 - RNA, 22 nt, Homo sapiens
ugacugugcagcuccaucaggg

SEQ ID NO: 206702 - RNA, 22 nt, Homo sapiens
ugacuucauuuuuggccaugag

SEQ ID NO: 206703 - RNA, 22 nt, Homo sapiens
ugagaacugcagggagcugcau

SEQ ID NO: 206704 - RNA, 22 nt, Homo sapiens
ugagacugaaauuaggaaacug

SEQ ID NO: 206705 - RNA, 22 nt, Homo sapiens
ugagacugagucucgcucuugu

SEQ ID NO: 206706 - RNA, 22 nt, Homo sapiens
ugagacugagucuugcucuauu

SEQ ID NO: 206707 - RNA, 22 nt, Homo sapiens
ugagacugaguuuugcucguug

SEQ ID NO: 206708 - RNA, 22 nt, Homo sapiens
ugagacugaguuuugcucuugu

SEQ ID NO: 206709 - RNA, 22 nt, Homo sapiens
ugagacuguuuuggggaacuuc

SEQ ID NO: 206710 - RNA, 22 nt, Homo sapiens
ugagaugagaaucaguucuaau

SEQ ID NO: 206711 - RNA, 22 nt, Homo sapiens
ugagaugagucucgcucuguca

SEQ ID NO: 206712 - RNA, 22 nt, Homo sapiens
ugagaugguaaauuuuuguugu

SEQ ID NO: 206713 - RNA, 22 nt, Homo sapiens
ugagccauggcaccuugucuaa

SEQ ID NO: 206714 - RNA, 22 nt, Homo sapiens
ugagcugguacuaauauuauca

SEQ ID NO: 206715 - RNA, 22 nt, Homo sapiens
ugaggauaguguugaaggcagg

SEQ ID NO: 206716 - RNA, 22 nt, Homo sapiens
ugagguguuauccagaguucuu

SEQ ID NO: 206717 - RNA, 22 nt, Homo sapiens
ugagguugaaggacauuuuuau

SEQ ID NO: 206718 - RNA, 22 nt, Homo sapiens
ugaguagaacuccuggagaugu

SEQ ID NO: 206719 - RNA, 22 nt, Homo sapiens
ugagucaugcuggagucauggc

SEQ ID NO: 206720 - RNA, 22 nt, Homo sapiens
ugagugaacgcugagaccaaau

SEQ ID NO: 206721 - RNA, 22 nt, Homo sapiens
ugagugaaggggcucuguugug

SEQ ID NO: 206722 - RNA, 22 nt, Homo sapiens
ugagugaggcugggcagucccu

SEQ ID NO: 206723 - RNA, 22 nt, Homo sapiens
ugaguuaggagaguguggcucu

SEQ ID NO: 206724 - RNA, 22 nt, Homo sapiens
ugaguuagguguuuuaaauaua

SEQ ID NO: 206725 - RNA, 22 nt, Homo sapiens
ugaguucuuuguagauucugug

SEQ ID NO: 206726 - RNA, 22 nt, Homo sapiens
ugaguucuuuuagggauauugc

SEQ ID NO: 206727 - RNA, 22 nt, Homo sapiens
ugauccagugcucaguuggagu

SEQ ID NO: 206728 - RNA, 22 nt, Homo sapiens
ugcaccacugcacuccaggcug

SEQ ID NO: 206729 - RNA, 22 nt, Homo sapiens
ugcaccacugcacugccugggu

SEQ ID NO: 206730 - RNA, 22 nt, Homo sapiens
ugcauauguugaaccaggcuug

SEQ ID NO: 206731 - RNA, 22 nt, Homo sapiens
ugcauauucuaggauuuuguau

SEQ ID NO: 206732 - RNA, 22 nt, Homo sapiens
ugcauuguuccgaauguguccu

SEQ ID NO: 206733 - RNA, 21 nt, Homo sapiens
ugcauuguugcugagagcagg

SEQ ID NO: 206734 - RNA, 22 nt, Homo sapiens
ugcauuguuuuugguucccagg

SEQ ID NO: 206735 - RNA, 22 nt, Homo sapiens
ugccuacugguuguucugggca

SEQ ID NO: 206736 - RNA, 22 nt, Homo sapiens
ugccuaggcuggaaugcaaugg

SEQ ID NO: 206737 - RNA, 22 nt, Homo sapiens
ugccugagcccagcccuguagu

SEQ ID NO: 206738 - RNA, 22 nt, Homo sapiens
ugcuauguaacacauuaccuuu

SEQ ID NO: 206739 - RNA, 22 nt, Homo sapiens
ugcuaugucuucucucacagag

SEQ ID NO: 206740 - RNA, 22 nt, Homo sapiens
auagugcugcaacaaauauacg

SEQ ID NO: 206741 - RNA, 22 nt, Homo sapiens
auagugcugcaagaaacauacg

SEQ ID NO: 206742 - RNA, 22 nt, Homo sapiens
auagugcugcaauaaccauggg

SEQ ID NO: 206743 - RNA, 22 nt, Homo sapiens
auagugcugcaaucaacauaca

SEQ ID NO: 206744 - RNA, 22 nt, Homo sapiens
auagugcugcaauuaacauaca

SEQ ID NO: 206745 - RNA, 22 nt, Homo sapiens
auagugcugcagucaauguacg

SEQ ID NO: 206746 - RNA, 22 nt, Homo sapiens
auagugcugcauuaaacauacg

SEQ ID NO: 206747 - RNA, 22 nt, Homo sapiens
auagugcuguauuaaacauacg

SEQ ID NO: 206748 - RNA, 22 nt, Homo sapiens
auagugcugugaugaacauaca

SEQ ID NO: 206749 - RNA, 19 nt, Homo sapiens
auauaacauccaggagcag

SEQ ID NO: 206750 - RNA, 22 nt, Homo sapiens
auauuacuggccauaucgcagg

SEQ ID NO: 206751 - RNA, 22 nt, Homo sapiens
aucacuguaaguuuacacuuug

SEQ ID NO: 206752 - RNA, 22 nt, Homo sapiens
aucagaguugucagggagcuuu

SEQ ID NO: 206753 - RNA, 22 nt, Homo sapiens
aucagcacugaucauacagcuu

SEQ ID NO: 206754 - RNA, 22 nt, Homo sapiens
aucauguaguaagacacauuua

SEQ ID NO: 206755 - RNA, 19 nt, Homo sapiens
aucuggaguuccuggggcu

SEQ ID NO: 206756 - RNA, 17 nt, Homo sapiens
augacuucuucagugug

SEQ ID NO: 206757 - RNA, 22 nt, Homo sapiens
augagggaagcucacgugucca

SEQ ID NO: 206758 - RNA, 22 nt, Homo sapiens
augaggugaguaaauaaaugaa

SEQ ID NO: 206759 - RNA, 22 nt, Homo sapiens
augaucauggaagugcacccau

SEQ ID NO: 206760 - RNA, 22 nt, Homo sapiens
augccucugacaauuggauucu

SEQ ID NO: 206761 - RNA, 19 nt, Homo sapiens
augcugguguugcucaaac

SEQ ID NO: 206762 - RNA, 22 nt, Homo sapiens
auggagguguggggagugaguu

SEQ ID NO: 206763 - RNA, 22 nt, Homo sapiens
auggagugagaauggagguucc

SEQ ID NO: 206764 - RNA, 22 nt, Homo sapiens
auggauuuuggggccagaggca

SEQ ID NO: 206765 - RNA, 22 nt, Homo sapiens
aaaaggcuagcuaguaacagaa

SEQ ID NO: 206766 - RNA, 18 nt, Homo sapiens
aaacagugucucuuucug

SEQ ID NO: 206767 - RNA, 22 nt, Homo sapiens
aaaggcaucauuaguaccaagu

SEQ ID NO: 206768 - RNA, 22 nt, Homo sapiens
aaagugcugagacagacuggga

SEQ ID NO: 206769 - RNA, 22 nt, Homo sapiens
aaagugcugagauuguaggcau

SEQ ID NO: 206770 - RNA, 22 nt, Homo sapiens
aaauaguagcugaaugagggaa

SEQ ID NO: 206771 - RNA, 22 nt, Homo sapiens
aacuaugucaaauaaaaugagg

SEQ ID NO: 206772 - RNA, 22 nt, Homo sapiens
aacugggcaagcauuacauggu

SEQ ID NO: 206773 - RNA, 22 nt, Homo sapiens
aagauaguaaacauuuucugcu

SEQ ID NO: 206774 - RNA, 22 nt, Homo sapiens
aagcaucacauaauggaucaug

SEQ ID NO: 206775 - RNA, 22 nt, Homo sapiens
aaggauuguaacaccaagguua

SEQ ID NO: 206776 - RNA, 22 nt, Homo sapiens
aagggaaugcgcugccuguguu

SEQ ID NO: 206777 - RNA, 22 nt, Homo sapiens
aagggaaugugguagcugguuu

SEQ ID NO: 206778 - RNA, 22 nt, Homo sapiens
aagugaccuaacaaugaaggcc

SEQ ID NO: 206779 - RNA, 22 nt, Homo sapiens
aagugcuggccuacucaaucga

SEQ ID NO: 206780 - RNA, 22 nt, Homo sapiens
aauaguggcuuggacuaaauau

SEQ ID NO: 206781 - RNA, 22 nt, Homo sapiens
aaugcaucuagaaaggugaauu

SEQ ID NO: 206782 - RNA, 22 nt, Homo sapiens
aaugcuguucuuugcuuaaguu

SEQ ID NO: 206783 - RNA, 22 nt, Homo sapiens
aaugucaugaguccaaccagaa

SEQ ID NO: 206784 - RNA, 23 nt, Homo sapiens
aauugcacauuccuugcuggcag

SEQ ID NO: 206785 - RNA, 22 nt, Homo sapiens
aauugcuuuuauuuagggccag

SEQ ID NO: 206786 - RNA, 22 nt, Homo sapiens
acacaguaaauauugucuccuc

SEQ ID NO: 206787 - RNA, 22 nt, Homo sapiens
acacagucaaauccacuuggcu

SEQ ID NO: 206788 - RNA, 22 nt, Homo sapiens
acacugcugaguaaauaauuuu

SEQ ID NO: 206789 - RNA, 22 nt, Homo sapiens
acacugucaugucucacaggca

SEQ ID NO: 206790 - RNA, 22 nt, Homo sapiens
acacuguuuuaguuauuauagc

SEQ ID NO: 206791 - RNA, 22 nt, Homo sapiens
acagaucagagauauuuagguu

SEQ ID NO: 206792 - RNA, 22 nt, Homo sapiens
acaguguguguguucaccuaga

SEQ ID NO: 206793 - RNA, 22 nt, Homo sapiens
acaucacuguuugauugauuga

SEQ ID NO: 206794 - RNA, 22 nt, Homo sapiens
acaucccaugccuggguacucc

SEQ ID NO: 206795 - RNA, 19 nt, Homo sapiens
acauggauuuugugcaaac

SEQ ID NO: 206796 - RNA, 22 nt, Homo sapiens
acccuggauucguggccuugaa

SEQ ID NO: 206797 - RNA, 22 nt, Homo sapiens
acccugucaaaacggaccaauc

SEQ ID NO: 206798 - RNA, 22 nt, Homo sapiens
acccugucaaaauggaccaauc

SEQ ID NO: 206799 - RNA, 22 nt, Homo sapiens
acccugucauccacauggugcu

SEQ ID NO: 206800 - RNA, 22 nt, Homo sapiens
accuucauuguugccaugucca

SEQ ID NO: 206801 - RNA, 22 nt, Homo sapiens
acucagagagaacugucauuug

SEQ ID NO: 206802 - RNA, 22 nt, Homo sapiens
acuccauuucauuuuagcucuu

SEQ ID NO: 206803 - RNA, 22 nt, Homo sapiens
acugcacucccgcccgggugac

SEQ ID NO: 206804 - RNA, 22 nt, Homo sapiens
acugcacuccuccuugggugac

SEQ ID NO: 206805 - RNA, 20 nt, Homo sapiens
acugggcuaccgaaguaagg

SEQ ID NO: 206806 - RNA, 22 nt, Homo sapiens
agaaauguuuacucacccccuu

SEQ ID NO: 206807 - RNA, 22 nt, Homo sapiens
agaauaauguccccccaaggga

SEQ ID NO: 206808 - RNA, 22 nt, Homo sapiens
agaaugugaccuuauuuggaga

SEQ ID NO: 206809 - RNA, 22 nt, Homo sapiens
agacuguaaugcauaauuuacu

SEQ ID NO: 206810 - RNA, 18 nt, Homo sapiens
agagcuaugaacauaugc

SEQ ID NO: 206811 - RNA, 21 nt, Homo sapiens
agaggacugaccacagcccua

SEQ ID NO: 206812 - RNA, 22 nt, Homo sapiens
agagugcuuuauuagauguagc

SEQ ID NO: 206813 - RNA, 22 nt, Homo sapiens
agaucacucagguuucucccug

SEQ ID NO: 206814 - RNA, 22 nt, Homo sapiens
agcaacauuguucauaauagcu

SEQ ID NO: 206815 - RNA, 22 nt, Homo sapiens
agcacagccuuguguuuucuug

SEQ ID NO: 206816 - RNA, 22 nt, Homo sapiens
agcaccacauacuacagagaua

SEQ ID NO: 206817 - RNA, 22 nt, Homo sapiens
agcaccaccguugcucuauccc

SEQ ID NO: 206818 - RNA, 22 nt, Homo sapiens
agcaggacaauaugggaucagg

SEQ ID NO: 206819 - RNA, 22 nt, Homo sapiens
agcagguauucgggucaugggg

SEQ ID NO: 206820 - RNA, 22 nt, Homo sapiens
agcaguguggccuuagacccgg

SEQ ID NO: 206821 - RNA, 22 nt, Homo sapiens
agcccauuuugcacugagaugc

SEQ ID NO: 206822 - RNA, 19 nt, Homo sapiens
agcuguguugccugugaga

SEQ ID NO: 206823 - RNA, 22 nt, Homo sapiens
agcuucauuccaacuuccuucu

SEQ ID NO: 206824 - RNA, 22 nt, Homo sapiens
aggagguugguaccaucuguuu

SEQ ID NO: 206825 - RNA, 22 nt, Homo sapiens
aggcacacaacccuggaccuga

SEQ ID NO: 206826 - RNA, 22 nt, Homo sapiens
agguccauuauuuucauucaug

SEQ ID NO: 206827 - RNA, 22 nt, Homo sapiens
agguuguguuugugauuagaua

SEQ ID NO: 206828 - RNA, 22 nt, Homo sapiens
aguaacaggauccaaagaaugu

SEQ ID NO: 206829 - RNA, 22 nt, Homo sapiens
aguaagauggcaacucuccaca

SEQ ID NO: 206830 - RNA, 22 nt, Homo sapiens
aguccagguuuuguaauggcaa

SEQ ID NO: 206831 - RNA, 22 nt, Homo sapiens
agugcaauggcgugaucuuggc

SEQ ID NO: 206832 - RNA, 22 nt, Homo sapiens
agugggccccuagaggugaggu

SEQ ID NO: 206833 - RNA, 22 nt, Homo sapiens
aguguuuuuaacaagaaagggu

SEQ ID NO: 206834 - RNA, 22 nt, Homo sapiens
aguguuuuuaucaugaaagggu

SEQ ID NO: 206835 - RNA, 22 nt, Homo sapiens
auaaaagcaggucuaggucagg

SEQ ID NO: 206836 - RNA, 22 nt, Homo sapiens
auacaguaaugucuuaggcugu

SEQ ID NO: 206837 - RNA, 21 nt, Homo sapiens
auagcacaucagauuuuauua

SEQ ID NO: 206838 - RNA, 22 nt, Homo sapiens
auagcacauggcauccucucuu

SEQ ID NO: 206839 - RNA, 22 nt, Homo sapiens
auagcaggagaauggucauggg

SEQ ID NO: 206840 - RNA, 22 nt, Homo sapiens
auagugcugcaaaaaacauacg

SEQ ID NO: 206841 - RNA, 22 nt, Homo sapiens
auagugcugcaauaaacacacg

SEQ ID NO: 206842 - RNA, 22 nt, Homo sapiens
auagugcugcacuaaacauaca

SEQ ID NO: 206843 - RNA, 22 nt, Homo sapiens
auagugcugccauaaacauacg

SEQ ID NO: 206844 - RNA, 20 nt, Homo sapiens
aucagagacuaggauugcca

SEQ ID NO: 206845 - RNA, 22 nt, Homo sapiens
aucagagugaaacaugggagau

SEQ ID NO: 206846 - RNA, 19 nt, Homo sapiens
aucagcacaagugugcuuu

SEQ ID NO: 206847 - RNA, 22 nt, Homo sapiens
aucagugcagugggaacuagaa

SEQ ID NO: 206848 - RNA, 22 nt, Homo sapiens
uuaaugacaucauaggugaagu

SEQ ID NO: 206849 - RNA, 22 nt, Homo sapiens
uuacagauggcacacucaaggg

SEQ ID NO: 206850 - RNA, 22 nt, Homo sapiens
uuacagcugggugugucuggua

SEQ ID NO: 206851 - RNA, 22 nt, Homo sapiens
uuacagucaaguuacauuucuc

SEQ ID NO: 206852 - RNA, 22 nt, Homo sapiens
uuaccagucuagggcucaguuu

SEQ ID NO: 206853 - RNA, 22 nt, Homo sapiens
uuauauguuucuuagggacaga

SEQ ID NO: 206854 - RNA, 22 nt, Homo sapiens
uuaugacaggcucaggagcccc

SEQ ID NO: 206855 - RNA, 22 nt, Homo sapiens
uucaaaaccucugcuuaagccc

SEQ ID NO: 206856 - RNA, 22 nt, Homo sapiens
uucaaggacuaaggauuuuugg

SEQ ID NO: 206857 - RNA, 22 nt, Homo sapiens
uucacaguguuucucacgguua

SEQ ID NO: 206858 - RNA, 22 nt, Homo sapiens
uucagagugguaugaagugaug

SEQ ID NO: 206859 - RNA, 18 nt, Homo sapiens
uucauaguagcaugauuu

SEQ ID NO: 206860 - RNA, 21 nt, Homo sapiens
uucaucuggccguauuccagg

SEQ ID NO: 206861 - RNA, 22 nt, Homo sapiens
uucaugugagucuguauuaacu

SEQ ID NO: 206862 - RNA, 22 nt, Homo sapiens
uuccugagccuuguaucuagua

SEQ ID NO: 206863 - RNA, 22 nt, Homo sapiens
uuccuugaaacagucaagagaa

SEQ ID NO: 206864 - RNA, 22 nt, Homo sapiens
uuccuugagaaaguacaaggcu

SEQ ID NO: 206865 - RNA, 22 nt, Homo sapiens
uuccuugugacuaguagugacc

SEQ ID NO: 206866 - RNA, 22 nt, Homo sapiens
uuccuuguuuauuuacaggagg

SEQ ID NO: 206867 - RNA, 22 nt, Homo sapiens
uucuaugguuaccaggcuaguc

SEQ ID NO: 206868 - RNA, 22 nt, Homo sapiens
uucucaguuccuacuuugguga

SEQ ID NO: 206869 - RNA, 22 nt, Homo sapiens
uucucuaguuacuuuaauggag

SEQ ID NO: 206870 - RNA, 22 nt, Homo sapiens
uucugugcugaaucaaagacug

SEQ ID NO: 206871 - RNA, 22 nt, Homo sapiens
uucuucugguuaugaaauuuga

SEQ ID NO: 206872 - RNA, 18 nt, Homo sapiens
uucuuguguugauauuuu

SEQ ID NO: 206873 - RNA, 22 nt, Homo sapiens
uugagguaguacuuauuauugg

SEQ ID NO: 206874 - RNA, 20 nt, Homo sapiens
uugcagagcccaacccugga

SEQ ID NO: 206875 - RNA, 22 nt, Homo sapiens
uugccuaggcuggagugcagug

SEQ ID NO: 206876 - RNA, 22 nt, Homo sapiens
uugccuaguuuaggucugugcu

SEQ ID NO: 206877 - RNA, 22 nt, Homo sapiens
uuggaaauguguuugcauucag

SEQ ID NO: 206878 - RNA, 22 nt, Homo sapiens
uuggaacuguucguauugaaau

SEQ ID NO: 206879 - RNA, 22 nt, Homo sapiens
uuggaagacauucugucugcua

SEQ ID NO: 206880 - RNA, 22 nt, Homo sapiens
uuggauuuuaacaaacuaggug

SEQ ID NO: 206881 - RNA, 22 nt, Homo sapiens
uuggcaauugcuaugauuugaa

SEQ ID NO: 206882 - RNA, 22 nt, Homo sapiens
uuggcagugcccgaugcugggg

SEQ ID NO: 206883 - RNA, 22 nt, Homo sapiens
uuggcauagaggcucucaagcu

SEQ ID NO: 206884 - RNA, 22 nt, Homo sapiens
uuggccccuccaaaucucaugu

SEQ ID NO: 206885 - RNA, 22 nt, Homo sapiens
uugguacuaaaaaguagggugu

SEQ ID NO: 206886 - RNA, 19 nt, Homo sapiens
uuggucccuuuggguucuu

SEQ ID NO: 206887 - RNA, 22 nt, Homo sapiens
uugguuaucaucauuucagcaa

SEQ ID NO: 206888 - RNA, 22 nt, Homo sapiens
uuguauguuguuugucagagaa

SEQ ID NO: 206889 - RNA, 22 nt, Homo sapiens
uuguccuccacauuugaucagu

SEQ ID NO: 206890 - RNA, 22 nt, Homo sapiens
uuguccuugagauaguuugcug

SEQ ID NO: 206891 - RNA, 19 nt, Homo sapiens
uugugggaggacagagggg

SEQ ID NO: 206892 - RNA, 22 nt, Homo sapiens
uuguguuuuuaguagggaaggg

SEQ ID NO: 206893 - RNA, 22 nt, Homo sapiens
uuguuaugggguggcuugaaag

SEQ ID NO: 206894 - RNA, 22 nt, Homo sapiens
uuguuauguuggucaguaaugu

SEQ ID NO: 206895 - RNA, 22 nt, Homo sapiens
uuuacugugggguuucuuagag

SEQ ID NO: 206896 - RNA, 22 nt, Homo sapiens
uuuauggagagauauuuauggu

SEQ ID NO: 206897 - RNA, 22 nt, Homo sapiens
uuucacuagccagcccuuuauu

SEQ ID NO: 206898 - RNA, 22 nt, Homo sapiens
uuucaggcaagggugacccuga

SEQ ID NO: 206899 - RNA, 22 nt, Homo sapiens
uuuccaguuuggaggaugcauu

SEQ ID NO: 206900 - RNA, 22 nt, Homo sapiens
uuucccagugguacaguuuaua

SEQ ID NO: 206901 - RNA, 22 nt, Homo sapiens
uuucccauuguucugcucugug

SEQ ID NO: 206902 - RNA, 22 nt, Homo sapiens
uuugaauguaaugagcaggaag

SEQ ID NO: 206903 - RNA, 22 nt, Homo sapiens
uuugcacuggagauucaauggg

SEQ ID NO: 206904 - RNA, 22 nt, Homo sapiens
gagugcaauggcaugaucuugg

SEQ ID NO: 206905 - RNA, 22 nt, Homo sapiens
gagugcaauggcgcgaucucgg

SEQ ID NO: 206906 - RNA, 22 nt, Homo sapiens
gaguuuguaaacuauucacuaa

SEQ ID NO: 206907 - RNA, 22 nt, Homo sapiens
gauggaguaauguaaucuugag

SEQ ID NO: 206908 - RNA, 22 nt, Homo sapiens
gauguuguuuagccuuugaugu

SEQ ID NO: 206909 - RNA, 22 nt, Homo sapiens
gauuuguuggccugugagcuag

SEQ ID NO: 206910 - RNA, 22 nt, Homo sapiens
gcaaaauugagaagggaauaua

SEQ ID NO: 206911 - RNA, 21 nt, Homo sapiens
gcaaaggaauugccuaagcuu

SEQ ID NO: 206912 - RNA, 22 nt, Homo sapiens
gcacaggguuacauucuaaggu

SEQ ID NO: 206913 - RNA, 22 nt, Homo sapiens
gcacgugcucauuugaggucuu

SEQ ID NO: 206914 - RNA, 22 nt, Homo sapiens
gcagagaaacaggucuaaggag

SEQ ID NO: 206915 - RNA, 22 nt, Homo sapiens
gcagcacauggcagaacauauu

SEQ ID NO: 206916 - RNA, 17 nt, Homo sapiens
gcauaugucgaaccagc

SEQ ID NO: 206917 - RNA, 17 nt, Homo sapiens
gcauauguugaaccagu

SEQ ID NO: 206918 - RNA, 22 nt, Homo sapiens
gccauugcacuccagccuagcg

SEQ ID NO: 206919 - RNA, 22 nt, Homo sapiens
gccauugcacuccagccuaggc

SEQ ID NO: 206920 - RNA, 22 nt, Homo sapiens
gccauugcacuccagccugagc

SEQ ID NO: 206921 - RNA, 22 nt, Homo sapiens
gccauugcacucuagccuaggu

SEQ ID NO: 206922 - RNA, 22 nt, Homo sapiens
gccauugcacucuagccugagc

SEQ ID NO: 206923 - RNA, 22 nt, Homo sapiens
gccucaguuguggccagggauu

SEQ ID NO: 206924 - RNA, 22 nt, Homo sapiens
gcucugguuacaaaggcaaauu

SEQ ID NO: 206925 - RNA, 22 nt, Homo sapiens
gcugauguugaccuugaucacc

SEQ ID NO: 206926 - RNA, 22 nt, Homo sapiens
gcugcuguuucucuuucagcau

SEQ ID NO: 206927 - RNA, 22 nt, Homo sapiens
gcuguaguugaggauuuuaaga

SEQ ID NO: 206928 - RNA, 22 nt, Homo sapiens
gcugucaugagcaacacaugaa

SEQ ID NO: 206929 - RNA, 22 nt, Homo sapiens
gcuguguugugcccagcaucau

SEQ ID NO: 206930 - RNA, 22 nt, Homo sapiens
ggacaaaguauuuucaaaugua

SEQ ID NO: 206931 - RNA, 22 nt, Homo sapiens
ggacaagagacugggacacuga

SEQ ID NO: 206932 - RNA, 22 nt, Homo sapiens
ggacugagaggacuacagugua

SEQ ID NO: 206933 - RNA, 20 nt, Homo sapiens
ggagagugacauaauucugg

SEQ ID NO: 206934 - RNA, 22 nt, Homo sapiens
ggagucugaacuggacaaugac

SEQ ID NO: 206935 - RNA, 22 nt, Homo sapiens
ggaucacagagcuugggaaagg

SEQ ID NO: 206936 - RNA, 17 nt, Homo sapiens
ggcaggauccaggaucc

SEQ ID NO: 206937 - RNA, 23 nt, Homo sapiens
ggcauuguggcucacaucuguaa

SEQ ID NO: 206938 - RNA, 22 nt, Homo sapiens
ggccagaugcaguggcucacac

SEQ ID NO: 206939 - RNA, 22 nt, Homo sapiens
ggccagaugcgguggcucacac

SEQ ID NO: 206940 - RNA, 20 nt, Homo sapiens
gggaaugcaaauucucaucc

SEQ ID NO: 206941 - RNA, 22 nt, Homo sapiens
gggaggucauuguaaggucuua

SEQ ID NO: 206942 - RNA, 22 nt, Homo sapiens
guacaugugcacagugugcagg

SEQ ID NO: 206943 - RNA, 17 nt, Homo sapiens
guacucagugaccaugg

SEQ ID NO: 206944 - RNA, 22 nt, Homo sapiens
guagagagaaauacaaagcugu

SEQ ID NO: 206945 - RNA, 22 nt, Homo sapiens
guauacaguugacccuugaacc

SEQ ID NO: 206946 - RNA, 22 nt, Homo sapiens
gucacugccugaggcugaugca

SEQ ID NO: 206947 - RNA, 22 nt, Homo sapiens
gucagugucuuugcagcucaga

SEQ ID NO: 206948 - RNA, 22 nt, Homo sapiens
gucaugcaggguucgccagccc

SEQ ID NO: 206949 - RNA, 22 nt, Homo sapiens
gucauggagggacauaacuaac

SEQ ID NO: 206950 - RNA, 22 nt, Homo sapiens
gucaugucuugaaauucaguuu

SEQ ID NO: 206951 - RNA, 22 nt, Homo sapiens
gucguggagcucacagugugcc

SEQ ID NO: 206952 - RNA, 22 nt, Homo sapiens
gugacagaguaagacccuguau

SEQ ID NO: 206953 - RNA, 22 nt, Homo sapiens
gugaggcugguccugccuccca

SEQ ID NO: 206954 - RNA, 22 nt, Homo sapiens
gugccacaguguuaagggauuc

SEQ ID NO: 206955 - RNA, 22 nt, Homo sapiens
gugcuauguuauccagcaagau

SEQ ID NO: 206956 - RNA, 22 nt, Homo sapiens
guggaaaaguaguugcgguuuu

SEQ ID NO: 206957 - RNA, 22 nt, Homo sapiens
guggaaaauuauugcuguuuuu

SEQ ID NO: 206958 - RNA, 21 nt, Homo sapiens
guggaaauggaauuuacuaau

SEQ ID NO: 206959 - RNA, 22 nt, Homo sapiens
guggacugggagagauaguucc

SEQ ID NO: 206960 - RNA, 22 nt, Homo sapiens
guggcaugaaagcaucugugau

SEQ ID NO: 206961 - RNA, 22 nt, Homo sapiens
guggcuuuaaguacgauugagg

SEQ ID NO: 206962 - RNA, 22 nt, Homo sapiens
gugggauaauuuuuggugcugu

SEQ ID NO: 206963 - RNA, 22 nt, Homo sapiens
gugguuuuaauauucagucuag

SEQ ID NO: 206964 - RNA, 22 nt, Homo sapiens
gugucaugaagguuuuaugcag

SEQ ID NO: 206965 - RNA, 22 nt, Homo sapiens
guuauguaucuugauugggugg

SEQ ID NO: 206966 - RNA, 22 nt, Homo sapiens
guugccuaggcuggcgugcagu

SEQ ID NO: 206967 - RNA, 22 nt, Homo sapiens
guuuacagucgacuugggaaua

SEQ ID NO: 206968 - RNA, 17 nt, Homo sapiens
uaaagccagucaaguca

SEQ ID NO: 206969 - RNA, 22 nt, Homo sapiens
uaaagccagugauuaugucucu

SEQ ID NO: 206970 - RNA, 22 nt, Homo sapiens
uaaagccauugucaaguuugua

SEQ ID NO: 206971 - RNA, 21 nt, Homo sapiens
uaaaggcuccaauuauacccc

SEQ ID NO: 206972 - RNA, 22 nt, Homo sapiens
uaacaccuugcucugucaauaa

SEQ ID NO: 206973 - RNA, 22 nt, Homo sapiens
uaacaguguauuccuuuggaca

SEQ ID NO: 206974 - RNA, 22 nt, Homo sapiens
uaaggaaccagaaguggguagc

SEQ ID NO: 206975 - RNA, 22 nt, Homo sapiens
uaaguagcugggaguacaggca

SEQ ID NO: 206976 - RNA, 22 nt, Homo sapiens
uacaggacuucucagaguuauu

SEQ ID NO: 206977 - RNA, 22 nt, Homo sapiens
uacaguggcaugucaggugcuu

SEQ ID NO: 206978 - RNA, 22 nt, Homo sapiens
cucugguuaaggcugaacuaua

SEQ ID NO: 206979 - RNA, 22 nt, Homo sapiens
cugaauagucaacgauggacug

SEQ ID NO: 206980 - RNA, 22 nt, Homo sapiens
cugagcucauuucuuuugcuac

SEQ ID NO: 206981 - RNA, 22 nt, Homo sapiens
cugaggugauauauacauauuu

SEQ ID NO: 206982 - RNA, 22 nt, Homo sapiens
cugaggugggaggauuggcuug

SEQ ID NO: 206983 - RNA, 22 nt, Homo sapiens
cugcaagaugcauaggaauuuu

SEQ ID NO: 206984 - RNA, 22 nt, Homo sapiens
cugggauggaggagaauuagag

SEQ ID NO: 206985 - RNA, 22 nt, Homo sapiens
cugucaucauuucuaugugcca

SEQ ID NO: 206986 - RNA, 22 nt, Homo sapiens
cuuagguuaugauaaauuuagu

SEQ ID NO: 206987 - RNA, 22 nt, Homo sapiens
cuuccagcuggguucagucagu

SEQ ID NO: 206988 - RNA, 22 nt, Homo sapiens
cuucuguuaguucugauaacuu

SEQ ID NO: 206989 - RNA, 22 nt, Homo sapiens
cuucuugagggccugcugggaa

SEQ ID NO: 206990 - RNA, 22 nt, Homo sapiens
cuugagcuugagauccuuucug

SEQ ID NO: 206991 - RNA, 22 nt, Homo sapiens
cuuggacaccucaugcccaccu

SEQ ID NO: 206992 - RNA, 22 nt, Homo sapiens
cuuuacaguuggacucacgagg

SEQ ID NO: 206993 - RNA, 22 nt, Homo sapiens
cuuuuggcuuaagauugucuug

SEQ ID NO: 206994 - RNA, 22 nt, Homo sapiens
cuuuuggcuuagaauugucuug

SEQ ID NO: 206995 - RNA, 22 nt, Homo sapiens
gaaggcaugcugcauggccaga

SEQ ID NO: 206996 - RNA, 22 nt, Homo sapiens
gaagguaguuuauagauguggu

SEQ ID NO: 206997 - RNA, 22 nt, Homo sapiens
gaauguuuacuuuguuuaauac

SEQ ID NO: 206998 - RNA, 22 nt, Homo sapiens
gacacugucuucugcucuuaaa

SEQ ID NO: 206999 - RNA, 22 nt, Homo sapiens
gacagugagaugucaugugaaa

SEQ ID NO: 207000 - RNA, 22 nt, Homo sapiens
gacaguguggcgauuccucaag

SEQ ID NO: 207001 - RNA, 22 nt, Homo sapiens
agguagcauagcgggaauauca

SEQ ID NO: 207002 - RNA, 22 nt, Homo sapiens
agguagguugagaugggcauca

SEQ ID NO: 207003 - RNA, 22 nt, Homo sapiens
agguauguaugucuguacagcg

SEQ ID NO: 207004 - RNA, 22 nt, Homo sapiens
aggugguuuugaugagcaggua

SEQ ID NO: 207005 - RNA, 22 nt, Homo sapiens
agguguuguugaggagauuuca

SEQ ID NO: 207006 - RNA, 22 nt, Homo sapiens
aguagguguugguagagguuuc

SEQ ID NO: 207007 - RNA, 22 nt, Homo sapiens
agucgguguuacugacagaaug

SEQ ID NO: 207008 - RNA, 17 nt, Homo sapiens
agugagaucauggcuua

SEQ ID NO: 207009 - RNA, 22 nt, Homo sapiens
aguggauuuuagacugagauuu

SEQ ID NO: 207010 - RNA, 22 nt, Homo sapiens
aguuuuugcugauagcaugcuu

SEQ ID NO: 207011 - RNA, 22 nt, Homo sapiens
auacagacacagucagaggggu

SEQ ID NO: 207012 - RNA, 22 nt, Homo sapiens
auagaguuagaaagaaauguuu

SEQ ID NO: 207013 - RNA, 22 nt, Homo sapiens
auagaucauugucauuuuagau

SEQ ID NO: 207014 - RNA, 22 nt, Homo sapiens
auagcagacauuucaaggcagg

SEQ ID NO: 207015 - RNA, 21 nt, Homo sapiens
auagggcuuguugauaguuaa

SEQ ID NO: 207016 - RNA, 22 nt, Homo sapiens
auagugcugcaauaaacauaca

SEQ ID NO: 207017 - RNA, 22 nt, Homo sapiens
auagugcuggaauaaauauacg

SEQ ID NO: 207018 - RNA, 22 nt, Homo sapiens
aaacugcuuuccaugguggcug

SEQ ID NO: 207019 - RNA, 22 nt, Homo sapiens
aaagcgcuguuaagaagacuga

SEQ ID NO: 207020 - RNA, 22 nt, Homo sapiens
aaauccauuuguucagcuaugc

SEQ ID NO: 207021 - RNA, 22 nt, Homo sapiens
aaaugcauggacagcuggucuu

SEQ ID NO: 207022 - RNA, 22 nt, Homo sapiens
aaaugucauggaguguuucccc

SEQ ID NO: 207023 - RNA, 22 nt, Homo sapiens
aacaggguguuugcaguuucuu

SEQ ID NO: 207024 - RNA, 22 nt, Homo sapiens
aacaucaaccaugaggguugga

SEQ ID NO: 207025 - RNA, 22 nt, Homo sapiens
aacuugcacuugauugagagcu

SEQ ID NO: 207026 - RNA, 22 nt, Homo sapiens
aagccacuguaccugucucuua

SEQ ID NO: 207027 - RNA, 22 nt, Homo sapiens
aagcugguguguauuauucacu

SEQ ID NO: 207028 - RNA, 22 nt, Homo sapiens
aagcuguuguucauccugaauu

SEQ ID NO: 207029 - RNA, 22 nt, Homo sapiens
aagggaauguuguggcugguuu

SEQ ID NO: 207030 - RNA, 22 nt, Homo sapiens
aaggugcuguaagcauccaugu

SEQ ID NO: 207031 - RNA, 22 nt, Homo sapiens
aagugaaugaugugaaguguaa

SEQ ID NO: 207032 - RNA, 23 nt, Homo sapiens
aagugagcuccaauugggugaga

SEQ ID NO: 207033 - RNA, 22 nt, Homo sapiens
aagugauguuauugggugacuc

SEQ ID NO: 207034 - RNA, 22 nt, Homo sapiens
aagugccauguggaugggcccu

SEQ ID NO: 207035 - RNA, 20 nt, Homo sapiens
aauaacagccccagggaggu

SEQ ID NO: 207036 - RNA, 22 nt, Homo sapiens
aauaaguugagaugaggucaua

SEQ ID NO: 207037 - RNA, 22 nt, Homo sapiens
aaucacaggucuuggcugcaug

SEQ ID NO: 207038 - RNA, 22 nt, Homo sapiens
aaucacaguguucuugugaggg

SEQ ID NO: 207039 - RNA, 22 nt, Homo sapiens
aaugauauguuauguuuagguu

SEQ ID NO: 207040 - RNA, 22 nt, Homo sapiens
aaugcuaucuggaacauuguug

SEQ ID NO: 207041 - RNA, 22 nt, Homo sapiens
aauggccuuuuucauuauacug

SEQ ID NO: 207042 - RNA, 22 nt, Homo sapiens
aauggcucuuccuggaguugug

SEQ ID NO: 207043 - RNA, 22 nt, Homo sapiens
aauugcacuggaaguaacugag

SEQ ID NO: 207044 - RNA, 22 nt, Homo sapiens
acacaguguuuauugugguuag

SEQ ID NO: 207045 - RNA, 22 nt, Homo sapiens
acagcacugccaagugacccau

SEQ ID NO: 207046 - RNA, 22 nt, Homo sapiens
acaggagugggauuugaguccu

SEQ ID NO: 207047 - RNA, 18 nt, Homo sapiens
acagugcuggcaugagau

SEQ ID NO: 207048 - RNA, 22 nt, Homo sapiens
acccagaguuccuugucuuuca

SEQ ID NO: 207049 - RNA, 22 nt, Homo sapiens
acccugucagcuggccugggca

SEQ ID NO: 207050 - RNA, 19 nt, Homo sapiens
acccuguccccaccuuuac

SEQ ID NO: 207051 - RNA, 22 nt, Homo sapiens
acuaaggcacaauuuucucaua

SEQ ID NO: 207052 - RNA, 22 nt, Homo sapiens
acugaauguaaacacggagugu

SEQ ID NO: 207053 - RNA, 22 nt, Homo sapiens
acugcacuccagcccgggugac

SEQ ID NO: 207054 - RNA, 22 nt, Homo sapiens
acugcacuccagccucggggac

SEQ ID NO: 207055 - RNA, 22 nt, Homo sapiens
agacacugaaauguauugaaga

SEQ ID NO: 207056 - RNA, 22 nt, Homo sapiens
agacaucauuugauggugggag

SEQ ID NO: 207057 - RNA, 22 nt, Homo sapiens
agacuagaaaucauuuguugag

SEQ ID NO: 207058 - RNA, 21 nt, Homo sapiens
agagaacugaaacaugugacu

SEQ ID NO: 207059 - RNA, 22 nt, Homo sapiens
agaucaauugcugauucgcucu

SEQ ID NO: 207060 - RNA, 22 nt, Homo sapiens
agcgccauugcacuccagccuu

SEQ ID NO: 207061 - RNA, 22 nt, Homo sapiens
agcucacagccuagcacuguga

SEQ ID NO: 207062 - RNA, 22 nt, Homo sapiens
aggcaagagugacuacgugaaa

SEQ ID NO: 207063 - RNA, 22 nt, Homo sapiens
aggcaguuucagugagagguga

SEQ ID NO: 207064 - RNA, 22 nt, Homo sapiens
aggcaugauggcuccagaucau

SEQ ID NO: 207065 - RNA, 22 nt, Homo sapiens
aggccaguuuuuggagggaaac

SEQ ID NO: 207066 - RNA, 22 nt, Homo sapiens
agguaaacauggggacugcuac

SEQ ID NO: 207067 - RNA, 22 nt, Homo sapiens
aggucccauguccucccugacc

SEQ ID NO: 207068 - RNA, 22 nt, Homo sapiens
aggugcucuuccuguaggucac

SEQ ID NO: 207069 - RNA, 22 nt, Homo sapiens
aggugguuuuaggcagagacau

SEQ ID NO: 207070 - RNA, 23 nt, Homo sapiens
aguacuguaguaauugaggggaa

SEQ ID NO: 207071 - RNA, 20 nt, Homo sapiens
aguauucacuuuuuucaugg

SEQ ID NO: 207072 - RNA, 22 nt, Homo sapiens
agucacagguucuugggauuag

SEQ ID NO: 207073 - RNA, 22 nt, Homo sapiens
agucugguguucucacacuagu

SEQ ID NO: 207074 - RNA, 22 nt, Homo sapiens
agugacaugggaucaaaucuga

SEQ ID NO: 207075 - RNA, 19 nt, Homo sapiens
agugagccaagauccuacc

SEQ ID NO: 207076 - RNA, 21 nt, Homo sapiens
cuacccuguauuagagaaaga

SEQ ID NO: 207077 - RNA, 22 nt, Homo sapiens
cuagcagacacuuccagagagu

SEQ ID NO: 207078 - RNA, 22 nt, Homo sapiens
cuagccuggagugcaguggugc

SEQ ID NO: 207079 - RNA, 22 nt, Homo sapiens
cuaggaaguauguguuauugcu

SEQ ID NO: 207080 - RNA, 22 nt, Homo sapiens
cuauguaccuggaacuguauua

SEQ ID NO: 207081 - RNA, 22 nt, Homo sapiens
cucacugcauuucaguuuuguu

SEQ ID NO: 207082 - RNA, 22 nt, Homo sapiens
cucaguguuaaggccaccucug

SEQ ID NO: 207083 - RNA, 22 nt, Homo sapiens
cucaugcugucuucugggguaa

SEQ ID NO: 207084 - RNA, 22 nt, Homo sapiens
cucccauugcaaacaacagaag

SEQ ID NO: 207085 - RNA, 20 nt, Homo sapiens
cucccugacaaauguggaaa

SEQ ID NO: 207086 - RNA, 22 nt, Homo sapiens
cuccuugauuagaguauagagu

SEQ ID NO: 207087 - RNA, 22 nt, Homo sapiens
cucucuguuugucuguuauugg

SEQ ID NO: 207088 - RNA, 22 nt, Homo sapiens
cucuuggguagauuuugcagag

SEQ ID NO: 207089 - RNA, 22 nt, Homo sapiens
cucuuugaguuccuccuggugu

SEQ ID NO: 207090 - RNA, 19 nt, Homo sapiens
cugaaacacagagagggcu

SEQ ID NO: 207091 - RNA, 22 nt, Homo sapiens
cugagcuaugccuggaaaggca

SEQ ID NO: 207092 - RNA, 22 nt, Homo sapiens
cugagguauaucccauuagaag

SEQ ID NO: 207093 - RNA, 22 nt, Homo sapiens
cugaggugggagaaucacauaa

SEQ ID NO: 207094 - RNA, 22 nt, Homo sapiens
cugcacugagacccucuuugcu

SEQ ID NO: 207095 - RNA, 22 nt, Homo sapiens
cugccacugacaccucaaggac

SEQ ID NO: 207096 - RNA, 22 nt, Homo sapiens
cuggcuaagugcuugagugugc

SEQ ID NO: 207097 - RNA, 22 nt, Homo sapiens
cugguaagaaggucuaagucaa

SEQ ID NO: 207098 - RNA, 22 nt, Homo sapiens
cuguaauguaaugagacuacau

SEQ ID NO: 207099 - RNA, 22 nt, Homo sapiens
cugugcaaguuauaggccaggu

SEQ ID NO: 207100 - RNA, 22 nt, Homo sapiens
cuguuugguaaggaugccucag

SEQ ID NO: 207101 - RNA, 22 nt, Homo sapiens
cuuagguuaaucaugaaccuuu

SEQ ID NO: 207102 - RNA, 22 nt, Homo sapiens
cuucaguucuguaaggacagca

SEQ ID NO: 207103 - RNA, 22 nt, Homo sapiens
cuucaucugguuugugaacuuu

SEQ ID NO: 207104 - RNA, 22 nt, Homo sapiens
cuuccauauucuaggacaggcu

SEQ ID NO: 207105 - RNA, 22 nt, Homo sapiens
cuuggcacucuguggaguuagg

SEQ ID NO: 207106 - RNA, 22 nt, Homo sapiens
cuuggcuucuuuauguggcuau

SEQ ID NO: 207107 - RNA, 22 nt, Homo sapiens
cuuguuguggaggggagugcag

SEQ ID NO: 207108 - RNA, 22 nt, Homo sapiens
cuuuggucaauugcugugggga

SEQ ID NO: 207109 - RNA, 22 nt, Homo sapiens
gaaaguguugagauuacaggca

SEQ ID NO: 207110 - RNA, 22 nt, Homo sapiens
gaaauggaucagagcaagcuuu

SEQ ID NO: 207111 - RNA, 22 nt, Homo sapiens
gaauagugcugcaagaaacaua

SEQ ID NO: 207112 - RNA, 22 nt, Homo sapiens
gaauagugcugcaguaaacaua

SEQ ID NO: 207113 - RNA, 22 nt, Homo sapiens
gaauggaacugacuauagcuga

SEQ ID NO: 207114 - RNA, 22 nt, Homo sapiens
gacagagcaagacccuauuuaa

SEQ ID NO: 207115 - RNA, 16 nt, Homo sapiens
gacuaauacaaaggaa

SEQ ID NO: 207116 - RNA, 22 nt, Homo sapiens
gacucagaacuaaggguguuuc

SEQ ID NO: 207117 - RNA, 22 nt, Homo sapiens
gacugaguaagcagaagcaauu

SEQ ID NO: 207118 - RNA, 22 nt, Homo sapiens
gacuucaucauacuaugugugg

SEQ ID NO: 207119 - RNA, 22 nt, Homo sapiens
gacuuugguaaacucgguggca

SEQ ID NO: 207120 - RNA, 22 nt, Homo sapiens
gagaacuaaugauguacuaggc

SEQ ID NO: 207121 - RNA, 22 nt, Homo sapiens
gagaucaauucauggcauaguu

SEQ ID NO: 207122 - RNA, 22 nt, Homo sapiens
gagaugaagugucaauaaggau

SEQ ID NO: 207123 - RNA, 22 nt, Homo sapiens
gagaugugguucaaggguguuu

SEQ ID NO: 207124 - RNA, 22 nt, Homo sapiens
gagguauggauaucuggagagg

SEQ ID NO: 207125 - RNA, 22 nt, Homo sapiens
gagguguagucaugccaagauc

SEQ ID NO: 207126 - RNA, 22 nt, Homo sapiens
gagugcaauggcaagaucuugg

SEQ ID NO: 207127 - RNA, 22 nt, Homo sapiens
gagugcaauggugcuaucucgg

SEQ ID NO: 207128 - RNA, 22 nt, Homo sapiens
gaugguuuuucuccgauuuaua

SEQ ID NO: 207129 - RNA, 22 nt, Homo sapiens
gauguaggugcauuugcacgug

SEQ ID NO: 207130 - RNA, 22 nt, Homo sapiens
gcaccacugcacucucagcuug

SEQ ID NO: 207131 - RNA, 22 nt, Homo sapiens
gcacugagagaagccccaagua

SEQ ID NO: 207132 - RNA, 22 nt, Homo sapiens
gcagcacaugacuguauguaua

SEQ ID NO: 207133 - RNA, 20 nt, Homo sapiens
gcagcaccauauuucuaaga

SEQ ID NO: 207134 - RNA, 22 nt, Homo sapiens
gcaggcaugacauuucacucuu

SEQ ID NO: 207135 - RNA, 22 nt, Homo sapiens
gcaucacagcuccugugcuggc

SEQ ID NO: 207136 - RNA, 22 nt, Homo sapiens
gcaugcacuguauuuaaguauc

SEQ ID NO: 207137 - RNA, 22 nt, Homo sapiens
gcugagaucucuugccugaacu

SEQ ID NO: 207138 - RNA, 19 nt, Homo sapiens
gcugauguuacauucuugc

SEQ ID NO: 207139 - RNA, 22 nt, Homo sapiens
gcuuuguuaaaacacagccaca

SEQ ID NO: 207140 - RNA, 22 nt, Homo sapiens
ggaagacuggcuuguuuaccca

SEQ ID NO: 207141 - RNA, 22 nt, Homo sapiens
ggaagacuuagaguagcaucag

SEQ ID NO: 207142 - RNA, 22 nt, Homo sapiens
ggaauggaacaaagucuugaaa

SEQ ID NO: 207143 - RNA, 20 nt, Homo sapiens
ggaauguuaaucuccaugau

SEQ ID NO: 207144 - RNA, 22 nt, Homo sapiens
ggacaagaucuuccaccauuca

SEQ ID NO: 207145 - RNA, 22 nt, Homo sapiens
ggacaucauuaccauggaccca

SEQ ID NO: 207146 - RNA, 22 nt, Homo sapiens
ggagucugauguucuaaggcag

SEQ ID NO: 207147 - RNA, 23 nt, Homo sapiens
ggcaagaucucagcucacugcaa

SEQ ID NO: 207148 - RNA, 22 nt, Homo sapiens
ggcacgguggcucacaccugua

SEQ ID NO: 207149 - RNA, 22 nt, Homo sapiens
ggcuuggaggaaugugagggcu

SEQ ID NO: 207150 - RNA, 22 nt, Homo sapiens
gguaggcacuggugggaagaga

SEQ ID NO: 207151 - RNA, 22 nt, Homo sapiens
ggucaacaucaucaugguaagu

SEQ ID NO: 207152 - RNA, 22 nt, Homo sapiens
ggucauagagaauucaccagga

SEQ ID NO: 207153 - RNA, 22 nt, Homo sapiens
guacaguauaguaauaggauuu

SEQ ID NO: 207154 - RNA, 23 nt, Homo sapiens
guaguuugaugcaauccacuugu

SEQ ID NO: 207155 - RNA, 22 nt, Homo sapiens
guauuaguuuccuguugcugcu

SEQ ID NO: 207156 - RNA, 22 nt, Homo sapiens
gucagugugauaucugcagggg

SEQ ID NO: 207157 - RNA, 22 nt, Homo sapiens
gucauggacaguuugcuaauug

SEQ ID NO: 207158 - RNA, 22 nt, Homo sapiens
gucucugguugcuuuuguacca

SEQ ID NO: 207159 - RNA, 22 nt, Homo sapiens
gucuggcuuaucucacuuacca

SEQ ID NO: 207160 - RNA, 22 nt, Homo sapiens
gucuggguuuguuuguacuugc

SEQ ID NO: 207161 - RNA, 22 nt, Homo sapiens
gucugguugacagcauguggcc

SEQ ID NO: 207162 - RNA, 22 nt, Homo sapiens
gugagcauucaaggaaggagcu

SEQ ID NO: 207163 - RNA, 22 nt, Homo sapiens
gugagcuccucuucugcugcag

SEQ ID NO: 207164 - RNA, 22 nt, Homo sapiens
gugagggagcuggaauauuuau

SEQ ID NO: 207165 - RNA, 22 nt, Homo sapiens
gugagggaugugaaaaagguca

SEQ ID NO: 207166 - RNA, 22 nt, Homo sapiens
gugaguggacgugaccaauaaa

SEQ ID NO: 207167 - RNA, 22 nt, Homo sapiens
gugcacaaucgugcauuccuug

SEQ ID NO: 207168 - RNA, 22 nt, Homo sapiens
guggaaaucucugugugacuua

SEQ ID NO: 207169 - RNA, 22 nt, Homo sapiens
gugguaggaaagugcaaaugua

SEQ ID NO: 207170 - RNA, 22 nt, Homo sapiens
guguauguuucucccugucccu

SEQ ID NO: 207171 - RNA, 22 nt, Homo sapiens
ugaagacucaguuugagggaca

SEQ ID NO: 207172 - RNA, 22 nt, Homo sapiens
ugaaggaguauggauaagucgu

SEQ ID NO: 207173 - RNA, 22 nt, Homo sapiens
ugaagugggaaaugaguauuaa

SEQ ID NO: 207174 - RNA, 22 nt, Homo sapiens
ugaauacagcacacccaugggu

SEQ ID NO: 207175 - RNA, 22 nt, Homo sapiens
ugaauacugugcaaaggauuug

SEQ ID NO: 207176 - RNA, 21 nt, Homo sapiens
ugaaugcuuuaaauauuagaa

SEQ ID NO: 207177 - RNA, 22 nt, Homo sapiens
ugacaagaaagcgucuucuuuu

SEQ ID NO: 207178 - RNA, 22 nt, Homo sapiens
ugacacagugggggauccuuuu

SEQ ID NO: 207179 - RNA, 22 nt, Homo sapiens
ugacacuugcccuuagaaacau

SEQ ID NO: 207180 - RNA, 17 nt, Homo sapiens
ugacagaaacuuguugu

SEQ ID NO: 207181 - RNA, 22 nt, Homo sapiens
ugacuaggaggcuggaggauga

SEQ ID NO: 207182 - RNA, 20 nt, Homo sapiens
ugacuggauacccuuuggcu

SEQ ID NO: 207183 - RNA, 22 nt, Homo sapiens
ugacuugauccauggggcucca

SEQ ID NO: 207184 - RNA, 22 nt, Homo sapiens
ugagacauacuuacaggggaug

SEQ ID NO: 207185 - RNA, 22 nt, Homo sapiens
ugagacugagucucccucuguc

SEQ ID NO: 207186 - RNA, 22 nt, Homo sapiens
ugagacugaguuucgcucuugu

SEQ ID NO: 207187 - RNA, 22 nt, Homo sapiens
ugagacugaguuuugccuuugu

SEQ ID NO: 207188 - RNA, 22 nt, Homo sapiens
ugagacugauaggacauuuucu

SEQ ID NO: 207189 - RNA, 22 nt, Homo sapiens
ugagacugguaauguguagggc

SEQ ID NO: 207190 - RNA, 22 nt, Homo sapiens
ugagauagaaaacauaggagaa

SEQ ID NO: 207191 - RNA, 19 nt, Homo sapiens
ugagaugaagacagggguu

SEQ ID NO: 207192 - RNA, 22 nt, Homo sapiens
ugagaugaagucuugcucuguu

SEQ ID NO: 207193 - RNA, 22 nt, Homo sapiens
ugagaugacgacacaccucagu

SEQ ID NO: 207194 - RNA, 22 nt, Homo sapiens
ugagaugaggucucacucuguu

SEQ ID NO: 207195 - RNA, 22 nt, Homo sapiens
ugagaugaguugcgcucugucg

SEQ ID NO: 207196 - RNA, 22 nt, Homo sapiens
ugagaugaucaaaguauaggcu

SEQ ID NO: 207197 - RNA, 22 nt, Homo sapiens
ugagaugaugggauaagagggc

SEQ ID NO: 207198 - RNA, 17 nt, Homo sapiens
ugagggaugccugguuc

SEQ ID NO: 207199 - RNA, 23 nt, Homo sapiens
ugagguguuaagcagacuugucu

SEQ ID NO: 207200 - RNA, 22 nt, Homo sapiens
ugagguguuugugcaccaucug

SEQ ID NO: 207201 - RNA, 23 nt, Homo sapiens
ugaguaggcaguuuuccccucac

SEQ ID NO: 207202 - RNA, 23 nt, Homo sapiens
ugaguaggugguuuuccccucac

SEQ ID NO: 207203 - RNA, 22 nt, Homo sapiens
ugaguauguuuagaaguaaagg

SEQ ID NO: 207204 - RNA, 22 nt, Homo sapiens
ugaguggagacuguguguagag

SEQ ID NO: 207205 - RNA, 18 nt, Homo sapiens
ugauugacuuauuuaggu

SEQ ID NO: 207206 - RNA, 23 nt, Homo sapiens
ugcaccacuacacacucuugggu

SEQ ID NO: 207207 - RNA, 22 nt, Homo sapiens
ugcaccacuacacuccaggcug

SEQ ID NO: 207208 - RNA, 22 nt, Homo sapiens
ugcaccacugcaccccagucug

SEQ ID NO: 207209 - RNA, 22 nt, Homo sapiens
ugcaccacuguacuccagucug

SEQ ID NO: 207210 - RNA, 22 nt, Homo sapiens
ugcagaaucccuucagauccga

SEQ ID NO: 207211 - RNA, 21 nt, Homo sapiens
ugcagccauucagcccuaugc

SEQ ID NO: 207212 - RNA, 19 nt, Homo sapiens
ugcauaggguuacauacuc

SEQ ID NO: 207213 - RNA, 22 nt, Homo sapiens
ugcauuaucagauguuugcuuu

SEQ ID NO: 207214 - RNA, 22 nt, Homo sapiens
ugcauuguaggauguuuagcag

SEQ ID NO: 207215 - RNA, 22 nt, Homo sapiens
ugccaacaugccuggcuguuuu

SEQ ID NO: 207216 - RNA, 23 nt, Homo sapiens
ugcuauguaagcauuuauuaaau

SEQ ID NO: 207217 - RNA, 22 nt, Homo sapiens
ugcuauguccccacccaaaucu

SEQ ID NO: 207218 - RNA, 16 nt, Homo sapiens
ugcuauguuggccagg

SEQ ID NO: 207219 - RNA, 21 nt, Homo sapiens
ugcuauguuguccaggcuggc

SEQ ID NO: 207220 - RNA, 22 nt, Homo sapiens
uggaaauuaagucuuuccugag

SEQ ID NO: 207221 - RNA, 22 nt, Homo sapiens
uggaagcauagcagcgugugug

SEQ ID NO: 207222 - RNA, 22 nt, Homo sapiens
uggauagauacuauccaggacu

SEQ ID NO: 207223 - RNA, 18 nt, Homo sapiens
uggauuggaaaaguuccu

SEQ ID NO: 207224 - RNA, 23 nt, Homo sapiens
uggcauuuuuggcaaugccuucu

SEQ ID NO: 207225 - RNA, 22 nt, Homo sapiens
uggccaguugaagacaaugcuc

SEQ ID NO: 207226 - RNA, 22 nt, Homo sapiens
uggccaguuuuuaauugggucu

SEQ ID NO: 207227 - RNA, 22 nt, Homo sapiens
uggccuuuuccaagaacuacua

SEQ ID NO: 207228 - RNA, 22 nt, Homo sapiens
uggcuaaguuaaucaaggagau

SEQ ID NO: 207229 - RNA, 22 nt, Homo sapiens
uggcuuucuggggcuucuguuc

SEQ ID NO: 207230 - RNA, 19 nt, Homo sapiens
uggucaguucugggagcug

SEQ ID NO: 207231 - RNA, 22 nt, Homo sapiens
uggucaguugugccucaauucc

SEQ ID NO: 207232 - RNA, 22 nt, Homo sapiens
uggucuccuuuguacccugggc

SEQ ID NO: 207233 - RNA, 20 nt, Homo sapiens
uguaacacauggagaacucu

SEQ ID NO: 207234 - RNA, 21 nt, Homo sapiens
uguagcagcauaauuuauaau

SEQ ID NO: 207235 - RNA, 21 nt, Homo sapiens
uguagcagcaugauucauagu

SEQ ID NO: 207236 - RNA, 22 nt, Homo sapiens
uguagcagccauaaacacagug

SEQ ID NO: 207237 - RNA, 22 nt, Homo sapiens
ugucaaauucuggguuaaaaca

SEQ ID NO: 207238 - RNA, 22 nt, Homo sapiens
ugucaagaugguuugauguugu

SEQ ID NO: 207239 - RNA, 22 nt, Homo sapiens
ugucaugagucuccuccaucuu

SEQ ID NO: 207240 - RNA, 22 nt, Homo sapiens
ugucaugucuuuguguaucaau

SEQ ID NO: 207241 - RNA, 22 nt, Homo sapiens
ugucucaguuacggcaauucca

SEQ ID NO: 207242 - RNA, 22 nt, Homo sapiens
ugucuuguagacugaaggcuuc

SEQ ID NO: 207243 - RNA, 20 nt, Homo sapiens
ugugaacuguagauagucuu

SEQ ID NO: 207244 - RNA, 23 nt, Homo sapiens
ugugacacuuccgucaguucauu

SEQ ID NO: 207245 - RNA, 22 nt, Homo sapiens
ugugauaguugcuguucugggc

SEQ ID NO: 207246 - RNA, 17 nt, Homo sapiens
uguggcucuuaugcuga

SEQ ID NO: 207247 - RNA, 22 nt, Homo sapiens
uguuacagcagaauugaaagag

SEQ ID NO: 207248 - RNA, 22 nt, Homo sapiens
uguuugcuguuuucuccaauga

SEQ ID NO: 207249 - RNA, 22 nt, Homo sapiens
uuacagugguugcuauugugaa

SEQ ID NO: 207250 - RNA, 22 nt, Homo sapiens
uuaggcuuuauugaaaacaaua

SEQ ID NO: 207251 - RNA, 22 nt, Homo sapiens
uuagguuauuacugacaauaau

SEQ ID NO: 207252 - RNA, 22 nt, Homo sapiens
uuaguaguugugauagguaccu

SEQ ID NO: 207253 - RNA, 22 nt, Homo sapiens
uuaguaguuugauaggaauagc

SEQ ID NO: 207254 - RNA, 22 nt, Homo sapiens
uuaguggaugcugaauaaagaa

SEQ ID NO: 207255 - RNA, 22 nt, Homo sapiens
uuauagcacuaagaagguaaua

SEQ ID NO: 207256 - RNA, 22 nt, Homo sapiens
uuauauguuacucccucuagca

SEQ ID NO: 207257 - RNA, 22 nt, Homo sapiens
uuaucacauugacugauuugca

SEQ ID NO: 207258 - RNA, 22 nt, Homo sapiens
uuaugucacuguucagucuccc

SEQ ID NO: 207259 - RNA, 22 nt, Homo sapiens
uuaugucuuugagcaaugcugu

SEQ ID NO: 207260 - RNA, 22 nt, Homo sapiens
uucaagucaauuuuugaaugac

SEQ ID NO: 207261 - RNA, 22 nt, Homo sapiens
uucacaguacucccuggaauua

SEQ ID NO: 207262 - RNA, 22 nt, Homo sapiens
uucagcuacuuggaaacagcaa

SEQ ID NO: 207263 - RNA, 22 nt, Homo sapiens
uucauagucuaauuuuuuccac

SEQ ID NO: 207264 - RNA, 22 nt, Homo sapiens
uucauaguguuuccuuccagug

SEQ ID NO: 207265 - RNA, 22 nt, Homo sapiens
uuccagcugggggcaacucugc

SEQ ID NO: 207266 - RNA, 22 nt, Homo sapiens
guucuggagauaaagccaaggu

SEQ ID NO: 207267 - RNA, 19 nt, Homo sapiens
uaacacaguuguguuugag

SEQ ID NO: 207268 - RNA, 22 nt, Homo sapiens
uaacaccuuugauagcacuuuu

SEQ ID NO: 207269 - RNA, 22 nt, Homo sapiens
uaacugucucaggccaugggcg

SEQ ID NO: 207270 - RNA, 22 nt, Homo sapiens
uaagccaccgugccuggccuaa

SEQ ID NO: 207271 - RNA, 22 nt, Homo sapiens
uaaggcuaggaauucucugaag

SEQ ID NO: 207272 - RNA, 22 nt, Homo sapiens
uacagaguauccauuugaguuc

SEQ ID NO: 207273 - RNA, 22 nt, Homo sapiens
uacaguagaaugucuuucaaaa

SEQ ID NO: 207274 - RNA, 22 nt, Homo sapiens
uacaguggugugaucucagcuc

SEQ ID NO: 207275 - RNA, 22 nt, Homo sapiens
uacguguauuguuuucacaaga

SEQ ID NO: 207276 - RNA, 22 nt, Homo sapiens
uacuagaggaauugcuauaacu

SEQ ID NO: 207277 - RNA, 22 nt, Homo sapiens
uacuggguguucugagaaaaua

SEQ ID NO: 207278 - RNA, 22 nt, Homo sapiens
uagaucaacuuugguaagagaa

SEQ ID NO: 207279 - RNA, 22 nt, Homo sapiens
uagauuaucauucauacaggga

SEQ ID NO: 207280 - RNA, 22 nt, Homo sapiens
uagcaccucuuuggccuuucgu

SEQ ID NO: 207281 - RNA, 22 nt, Homo sapiens
uagcaggaaaggggucagaucu

SEQ ID NO: 207282 - RNA, 22 nt, Homo sapiens
uaggacacaggacauauguaga

SEQ ID NO: 207283 - RNA, 20 nt, Homo sapiens
uaggagcaaugagaguagaa

SEQ ID NO: 207284 - RNA, 22 nt, Homo sapiens
uaggcuguguggccguggggcu

SEQ ID NO: 207285 - RNA, 19 nt, Homo sapiens
uagggcacgaggcagaguc

SEQ ID NO: 207286 - RNA, 22 nt, Homo sapiens
uagguugucuguucacucugau

SEQ ID NO: 207287 - RNA, 22 nt, Homo sapiens
uagguugucuucccagaguuuu

SEQ ID NO: 207288 - RNA, 22 nt, Homo sapiens
uagguuguucuauuaucuuaca

SEQ ID NO: 207289 - RNA, 22 nt, Homo sapiens
uaguaguuuuguguauaauaau

SEQ ID NO: 207290 - RNA, 22 nt, Homo sapiens
uaguggauguucagagauuuga

SEQ ID NO: 207291 - RNA, 22 nt, Homo sapiens
uauaugucugagacugggggau

SEQ ID NO: 207292 - RNA, 22 nt, Homo sapiens
uaugaaagcuacuucucacaau

SEQ ID NO: 207293 - RNA, 23 nt, Homo sapiens
uaugacagaggaagggggagcug

SEQ ID NO: 207294 - RNA, 22 nt, Homo sapiens
uauggaaaucuuaccuuauggu

SEQ ID NO: 207295 - RNA, 22 nt, Homo sapiens
uuugcacuugaaaacacucuca

SEQ ID NO: 207296 - RNA, 22 nt, Homo sapiens
uuuggcuuaagauugacugcaa

SEQ ID NO: 207297 - RNA, 22 nt, Homo sapiens
uuugguuuuuguuaucacucau

SEQ ID NO: 207298 - RNA, 22 nt, Homo sapiens
uuuuaguugcucagguauucuc

SEQ ID NO: 207299 - RNA, 22 nt, Homo sapiens
uuuugcuugugaauagccacau

SEQ ID NO: 207300 - RNA, 22 nt, Homo sapiens
uuuugguguauuguauaaggua

SEQ ID NO: 207301 - RNA, 22 nt, Homo sapiens
aaagcaucacuuuuccuacuuu

SEQ ID NO: 207302 - RNA, 20 nt, Homo sapiens
aaaggcugugagaacgagau

SEQ ID NO: 207303 - RNA, 19 nt, Homo sapiens
aaagguaguaaccucugau

SEQ ID NO: 207304 - RNA, 22 nt, Homo sapiens
aaagugcugggaucacacugaa

SEQ ID NO: 207305 - RNA, 22 nt, Homo sapiens
aaaugcaucauuaggugauuuu

SEQ ID NO: 207306 - RNA, 22 nt, Homo sapiens
aaaugcaugaauaagcucgugu

SEQ ID NO: 207307 - RNA, 22 nt, Homo sapiens
aaaugcucuuuaugaaguugga

SEQ ID NO: 207308 - RNA, 22 nt, Homo sapiens
aagcagauguguugaaaguacu

SEQ ID NO: 207309 - RNA, 22 nt, Homo sapiens
aagcugguguugcugcucuguu

SEQ ID NO: 207310 - RNA, 22 nt, Homo sapiens
aagcugguuuuauaucugugag

SEQ ID NO: 207311 - RNA, 22 nt, Homo sapiens
aaggcaugcaaagaacauuuua

SEQ ID NO: 207312 - RNA, 21 nt, Homo sapiens
aagguuuuuagugcuugacuu

SEQ ID NO: 207313 - RNA, 22 nt, Homo sapiens
aaguagcagaggcaagacuuga

SEQ ID NO: 207314 - RNA, 22 nt, Homo sapiens
aaguagcuggaugcaguggcac

SEQ ID NO: 207315 - RNA, 22 nt, Homo sapiens
aagugcuguaugggagccuagg

SEQ ID NO: 207316 - RNA, 22 nt, Homo sapiens
aauaauggcaccaaagcacaag

SEQ ID NO: 207317 - RNA, 22 nt, Homo sapiens
aauacuuccaaaucuagucauu

SEQ ID NO: 207318 - RNA, 22 nt, Homo sapiens
aauagugcugcaaaaacauacg

SEQ ID NO: 207319 - RNA, 21 nt, Homo sapiens
aaucacaguuguucugccuuc

SEQ ID NO: 207320 - RNA, 22 nt, Homo sapiens
aaucacuaugccaugaaguaca

SEQ ID NO: 207321 - RNA, 22 nt, Homo sapiens
aaucucaacacuuugggaggcu

SEQ ID NO: 207322 - RNA, 22 nt, Homo sapiens
aaucucagagauaucugugucc

SEQ ID NO: 207323 - RNA, 22 nt, Homo sapiens
aaucucagcauuuugggcugag

SEQ ID NO: 207324 - RNA, 22 nt, Homo sapiens
aaugaucaauguuugaggugau

SEQ ID NO: 207325 - RNA, 22 nt, Homo sapiens
aauggcucuuuaggcaauagau

SEQ ID NO: 207326 - RNA, 22 nt, Homo sapiens
aaugucaucuucaguuguacag

SEQ ID NO: 207327 - RNA, 22 nt, Homo sapiens
aauuaguaaccuaauuccaucu

SEQ ID NO: 207328 - RNA, 22 nt, Homo sapiens
aauucacuucuuuuaggcaggg

SEQ ID NO: 207329 - RNA, 23 nt, Homo sapiens
aauugcuuuugaggacuuaguug

SEQ ID NO: 207330 - RNA, 22 nt, Homo sapiens
acacauuggcaauucuggagca

SEQ ID NO: 207331 - RNA, 22 nt, Homo sapiens
acacuauugagguuuguuugca

SEQ ID NO: 207332 - RNA, 22 nt, Homo sapiens
acacuguaacucuuugagggca

SEQ ID NO: 207333 - RNA, 20 nt, Homo sapiens
acaguagaagggauuucaaa

SEQ ID NO: 207334 - RNA, 22 nt, Homo sapiens
acagugucaugucguguucccc

SEQ ID NO: 207335 - RNA, 22 nt, Homo sapiens
acaucuguacaguggguguggu

SEQ ID NO: 207336 - RNA, 22 nt, Homo sapiens
acccugguagcuaugaagucuu

SEQ ID NO: 207337 - RNA, 22 nt, Homo sapiens
acucagagauuagcacauguuu

SEQ ID NO: 207338 - RNA, 22 nt, Homo sapiens
acucagagugggccccuagaua

SEQ ID NO: 207339 - RNA, 22 nt, Homo sapiens
acugcacucuagcuugggugac

SEQ ID NO: 207340 - RNA, 22 nt, Homo sapiens
acuggcuguuaggaauuaccuc

SEQ ID NO: 207341 - RNA, 23 nt, Homo sapiens
agacugaaguaucugagacucag

SEQ ID NO: 207342 - RNA, 22 nt, Homo sapiens
agagacauugcuccaacucacc

SEQ ID NO: 207343 - RNA, 22 nt, Homo sapiens
agagaucaacugaauuacugga

SEQ ID NO: 207344 - RNA, 22 nt, Homo sapiens
agagugaagcuuuuuauauucu

SEQ ID NO: 207345 - RNA, 22 nt, Homo sapiens
agaucauaugcaguaaugaacu

SEQ ID NO: 207346 - RNA, 22 nt, Homo sapiens
agcacagugaaugguuuacuca

SEQ ID NO: 207347 - RNA, 22 nt, Homo sapiens
agcaccacaauuuccugccuaa

SEQ ID NO: 207348 - RNA, 17 nt, Homo sapiens
agcaccacacucucuug

SEQ ID NO: 207349 - RNA, 20 nt, Homo sapiens
agcagccacagauuccucag

SEQ ID NO: 207350 - RNA, 22 nt, Homo sapiens
agcuccuuucugcagguagguu

SEQ ID NO: 207351 - RNA, 22 nt, Homo sapiens
agcuguuguacacuuuaccuuu

SEQ ID NO: 207352 - RNA, 22 nt, Homo sapiens
agcuguuguuaauuaacucauu

SEQ ID NO: 207353 - RNA, 22 nt, Homo sapiens
agcuugugauuuagagugagag

SEQ ID NO: 207354 - RNA, 22 nt, Homo sapiens
aggaaaucuuagcugaggggau

SEQ ID NO: 207355 - RNA, 22 nt, Homo sapiens
aggaaugcuaaguuuuccuccu

SEQ ID NO: 207356 - RNA, 22 nt, Homo sapiens
aggauaguaaugauagagaggc

SEQ ID NO: 207357 - RNA, 22 nt, Homo sapiens
aggcuguguggauaauauuggg

SEQ ID NO: 207358 - RNA, 22 nt, Homo sapiens
agggcuuguuuaacuaucauua

SEQ ID NO: 207359 - RNA, 22 nt, Homo sapiens
agggcuuuugagcugagauggu

SEQ ID NO: 207360 - RNA, 22 nt, Homo sapiens
auccacagugucaauguuguga

SEQ ID NO: 207361 - RNA, 22 nt, Homo sapiens
aucgcgccauuguacuccagcc

SEQ ID NO: 207362 - RNA, 22 nt, Homo sapiens
aucucaguuaauuccaucuuuc

SEQ ID NO: 207363 - RNA, 22 nt, Homo sapiens
aucugguguuuuucucccucgu

SEQ ID NO: 207364 - RNA, 22 nt, Homo sapiens
aucuugcauuugcuaaaaugca

SEQ ID NO: 207365 - RNA, 22 nt, Homo sapiens
aucuugggugggaacugagaau

SEQ ID NO: 207366 - RNA, 22 nt, Homo sapiens
augaccauuucaauugauaugg

SEQ ID NO: 207367 - RNA, 22 nt, Homo sapiens
augagauaaaccaucucuuaag

SEQ ID NO: 207368 - RNA, 22 nt, Homo sapiens
augagauacuacaaaugaguuu

SEQ ID NO: 207369 - RNA, 22 nt, Homo sapiens
augagaugaauaccgacgaugu

SEQ ID NO: 207370 - RNA, 22 nt, Homo sapiens
augagaugaggaauggcccucc

SEQ ID NO: 207371 - RNA, 22 nt, Homo sapiens
augagauuguuuguacuccaca

SEQ ID NO: 207372 - RNA, 22 nt, Homo sapiens
augaggugaggucaguaaggua

SEQ ID NO: 207373 - RNA, 22 nt, Homo sapiens
augaggugggagaaucacuuga

SEQ ID NO: 207374 - RNA, 22 nt, Homo sapiens
augauacuggcuucauagaaug

SEQ ID NO: 207375 - RNA, 22 nt, Homo sapiens
augaucauggaaguuuuccugu

SEQ ID NO: 207376 - RNA, 22 nt, Homo sapiens
augauguccacagggguguuca

SEQ ID NO: 207377 - RNA, 19 nt, Homo sapiens
augccacagugaggucaga

SEQ ID NO: 207378 - RNA, 22 nt, Homo sapiens
auggaaaugaagggcuggcccu

SEQ ID NO: 207379 - RNA, 22 nt, Homo sapiens
auggacagacacuggccuucug

SEQ ID NO: 207380 - RNA, 22 nt, Homo sapiens
auggcaucgucaccuuuucagu

SEQ ID NO: 207381 - RNA, 22 nt, Homo sapiens
auggcucaauucuuucccugaa

SEQ ID NO: 207382 - RNA, 22 nt, Homo sapiens
auggcucuuauuauuugaggua

SEQ ID NO: 207383 - RNA, 22 nt, Homo sapiens
auggcuguuuaagaguuucauu

SEQ ID NO: 207384 - RNA, 22 nt, Homo sapiens
augucaacauagacaguagagu

SEQ ID NO: 207385 - RNA, 22 nt, Homo sapiens
augucugguagccaccuggagg

SEQ ID NO: 207386 - RNA, 22 nt, Homo sapiens
augugugcuugugacacagccu

SEQ ID NO: 207387 - RNA, 22 nt, Homo sapiens
auugcucuuagaaauauuucuu

SEQ ID NO: 207388 - RNA, 22 nt, Homo sapiens
auugcuucugauuuuaaaugag

SEQ ID NO: 207389 - RNA, 22 nt, Homo sapiens
auuggcuuuugaaagucugcga

SEQ ID NO: 207390 - RNA, 22 nt, Homo sapiens
auugucacccgggcaguaagca

SEQ ID NO: 207391 - RNA, 22 nt, Homo sapiens
auugucauuuauaacuguguag

SEQ ID NO: 207392 - RNA, 21 nt, Homo sapiens
auuugguguuagaaauaaauu

SEQ ID NO: 207393 - RNA, 22 nt, Homo sapiens
auuugguuauucaguuguucag

SEQ ID NO: 207394 - RNA, 22 nt, Homo sapiens
caaaugcuucuauggacugucu

SEQ ID NO: 207395 - RNA, 22 nt, Homo sapiens
caacacagugaaacccgucucu

SEQ ID NO: 207396 - RNA, 19 nt, Homo sapiens
caacccugcagagaaagga

SEQ ID NO: 207397 - RNA, 22 nt, Homo sapiens
cacagcuaacaacuguuucuuc

SEQ ID NO: 207398 - RNA, 22 nt, Homo sapiens
cacaguguuccagcuauuugaa

SEQ ID NO: 207399 - RNA, 22 nt, Homo sapiens
cacauguuuuagcauggcuguu

SEQ ID NO: 207400 - RNA, 22 nt, Homo sapiens
cacugaaugugagguuggggag

SEQ ID NO: 207401 - RNA, 18 nt, Homo sapiens
cacugagcccuucacucu

SEQ ID NO: 207402 - RNA, 22 nt, Homo sapiens
cacugcacuccagcuugugggc

SEQ ID NO: 207403 - RNA, 22 nt, Homo sapiens
cacugcacucuucuucugggca

SEQ ID NO: 207404 - RNA, 22 nt, Homo sapiens
cacugcauggucuagcuggguu

SEQ ID NO: 207405 - RNA, 17 nt, Homo sapiens
cacugggugcaagagga

SEQ ID NO: 207406 - RNA, 22 nt, Homo sapiens
cagagaacauucagagcuguag

SEQ ID NO: 207407 - RNA, 22 nt, Homo sapiens
cagagaacugaguuauuuucuu

SEQ ID NO: 207408 - RNA, 22 nt, Homo sapiens
cagcccguaaucccagcacuuu

SEQ ID NO: 207409 - RNA, 23 nt, Homo sapiens
cagcucauuuggguccccuuguc

SEQ ID NO: 207410 - RNA, 22 nt, Homo sapiens
cagcugaugucgaaugcacucu

SEQ ID NO: 207411 - RNA, 22 nt, Homo sapiens
caguacaauguugauuagaagu

SEQ ID NO: 207412 - RNA, 23 nt, Homo sapiens
cagugcaugacuguauaugcaaa

SEQ ID NO: 207413 - RNA, 22 nt, Homo sapiens
cagugcauguggcacucuccag

SEQ ID NO: 207414 - RNA, 22 nt, Homo sapiens
gaaauguugauagugggcauug

SEQ ID NO: 207415 - RNA, 22 nt, Homo sapiens
gaaauguuuuucaugugggcaa

SEQ ID NO: 207416 - RNA, 22 nt, Homo sapiens
gaauagugcugcaauaaacaua

SEQ ID NO: 207417 - RNA, 22 nt, Homo sapiens
gaauagugcugcaaugaacaua

SEQ ID NO: 207418 - RNA, 22 nt, Homo sapiens
gaauagugcugcagcaaacaua

SEQ ID NO: 207419 - RNA, 22 nt, Homo sapiens
gacagugugauacuuagucuca

SEQ ID NO: 207420 - RNA, 22 nt, Homo sapiens
gacccuguugggguuuagggcu

SEQ ID NO: 207421 - RNA, 19 nt, Homo sapiens
gacuccagaguugugugcu

SEQ ID NO: 207422 - RNA, 22 nt, Homo sapiens
gacuggagcuguaugugguuac

SEQ ID NO: 207423 - RNA, 16 nt, Homo sapiens
gacugggcugaggaau

SEQ ID NO: 207424 - RNA, 22 nt, Homo sapiens
gacuuugguagaggaaaaaucu

SEQ ID NO: 207425 - RNA, 22 nt, Homo sapiens
gagaucaaguauucuccacuaa

SEQ ID NO: 207426 - RNA, 22 nt, Homo sapiens
gagaugaaaucuugcucuguca

SEQ ID NO: 207427 - RNA, 22 nt, Homo sapiens
gagcacauaugacauuuucuuc

SEQ ID NO: 207428 - RNA, 22 nt, Homo sapiens
gagcccauuucacuuguccagc

SEQ ID NO: 207429 - RNA, 22 nt, Homo sapiens
gagcucaccuuaccucuggagc

SEQ ID NO: 207430 - RNA, 22 nt, Homo sapiens
gaggcacucuguacaaaucugc

SEQ ID NO: 207431 - RNA, 22 nt, Homo sapiens
gagugcaagguuuuucugagug

SEQ ID NO: 207432 - RNA, 22 nt, Homo sapiens
gagugcaauggcaugaucuggg

SEQ ID NO: 207433 - RNA, 22 nt, Homo sapiens
gaucaguuucuggagauacgua

SEQ ID NO: 207434 - RNA, 22 nt, Homo sapiens
gaugcaaauuaagcuugggaca

SEQ ID NO: 207435 - RNA, 17 nt, Homo sapiens
gcauauguugaaccagc

SEQ ID NO: 207436 - RNA, 22 nt, Homo sapiens
gccauugcacuccagccuaggu

SEQ ID NO: 207437 - RNA, 22 nt, Homo sapiens
gcuagcacauugucaccucuca

SEQ ID NO: 207438 - RNA, 22 nt, Homo sapiens
gcugucuggagucuguucaaug

SEQ ID NO: 207439 - RNA, 22 nt, Homo sapiens
ggaaggucaaagggaaagcaga

SEQ ID NO: 207440 - RNA, 21 nt, Homo sapiens
ggaauuuagggaaugauuuag

SEQ ID NO: 207441 - RNA, 22 nt, Homo sapiens
ggagaucuuuaggaguuggacu

SEQ ID NO: 207442 - RNA, 22 nt, Homo sapiens
ggauacaucuggacagccgaau

SEQ ID NO: 207443 - RNA, 22 nt, Homo sapiens
ggcaagaucuuggcucacugaa

SEQ ID NO: 207444 - RNA, 22 nt, Homo sapiens
ggcagacuguggaguucuuucu

SEQ ID NO: 207445 - RNA, 22 nt, Homo sapiens
ggcaugguggugugugccuaua

SEQ ID NO: 207446 - RNA, 22 nt, Homo sapiens
ggcuauagauaugugaacacuu

SEQ ID NO: 207447 - RNA, 22 nt, Homo sapiens
ggcucaguuuccuccgucugcu

SEQ ID NO: 207448 - RNA, 22 nt, Homo sapiens
gggaagugugcagaguucucuu

SEQ ID NO: 207449 - RNA, 22 nt, Homo sapiens
gggaauggaagacauuaugaug

SEQ ID NO: 207450 - RNA, 22 nt, Homo sapiens
gggaugaagcccuaggguuggu

SEQ ID NO: 207451 - RNA, 22 nt, Homo sapiens
gggguauguaagugagugagug

SEQ ID NO: 207452 - RNA, 21 nt, Homo sapiens
ggugagaaaggagacauagac

SEQ ID NO: 207453 - RNA, 22 nt, Homo sapiens
guaccucaguuggaaaugcaga

SEQ ID NO: 207454 - RNA, 22 nt, Homo sapiens
guauacaugucaaaacucacau

SEQ ID NO: 207455 - RNA, 22 nt, Homo sapiens
guauuaguuaucuacugcugug

SEQ ID NO: 207456 - RNA, 22 nt, Homo sapiens
guauuugauuauagcaugcuua

SEQ ID NO: 207457 - RNA, 22 nt, Homo sapiens
gucaggaugauuuggggaggug

SEQ ID NO: 207458 - RNA, 22 nt, Homo sapiens
gucagugucuuaacagagauua

SEQ ID NO: 207459 - RNA, 22 nt, Homo sapiens
gucaguucuugugguugcauuc

SEQ ID NO: 207460 - RNA, 22 nt, Homo sapiens
gucauccaggcuggagugaagc

SEQ ID NO: 207461 - RNA, 22 nt, Homo sapiens
gucauggaacaacuuaaaguca

SEQ ID NO: 207462 - RNA, 22 nt, Homo sapiens
gucauucauucagcaagcacug

SEQ ID NO: 207463 - RNA, 22 nt, Homo sapiens
guccaugagaugaauccacaca

SEQ ID NO: 207464 - RNA, 22 nt, Homo sapiens
gucucacagcuagcugcuuuau

SEQ ID NO: 207465 - RNA, 22 nt, Homo sapiens
aagggaaugcuuccaguuugug

SEQ ID NO: 207466 - RNA, 22 nt, Homo sapiens
aagggaauguuguagcugguuu

SEQ ID NO: 207467 - RNA, 22 nt, Homo sapiens
aagggaauguuguggcugguug

SEQ ID NO: 207468 - RNA, 22 nt, Homo sapiens
aagggaauguugugguugguuu

SEQ ID NO: 207469 - RNA, 22 nt, Homo sapiens
aauaaagcagcuuuuugggacu

SEQ ID NO: 207470 - RNA, 22 nt, Homo sapiens
aauagugcugugcagugagugg

SEQ ID NO: 207471 - RNA, 22 nt, Homo sapiens
aaucacaguuaguaagggagaa

SEQ ID NO: 207472 - RNA, 22 nt, Homo sapiens
aaucugggguuguuuggggagu

SEQ ID NO: 207473 - RNA, 22 nt, Homo sapiens
aauggcauuugccagggcaaag

SEQ ID NO: 207474 - RNA, 22 nt, Homo sapiens
aaugugcacuauuagggugaua

SEQ ID NO: 207475 - RNA, 22 nt, Homo sapiens
aauugcacuaagcauaguccag

SEQ ID NO: 207476 - RNA, 22 nt, Homo sapiens
aauugcuucuguauuuuggaca

SEQ ID NO: 207477 - RNA, 22 nt, Homo sapiens
acaaaguauggaauguuggugu

SEQ ID NO: 207478 - RNA, 22 nt, Homo sapiens
acacaugugcguagacucuuua

SEQ ID NO: 207479 - RNA, 22 nt, Homo sapiens
acacucucucauuacuuguuug

SEQ ID NO: 207480 - RNA, 21 nt, Homo sapiens
acaguaguaauaguguagcca

SEQ ID NO: 207481 - RNA, 18 nt, Homo sapiens
acagugcugucacugcuu

SEQ ID NO: 207482 - RNA, 23 nt, Homo sapiens
acaguggugugaucuuggcucag

SEQ ID NO: 207483 - RNA, 22 nt, Homo sapiens
acaguguagugacugccaacuu

SEQ ID NO: 207484 - RNA, 18 nt, Homo sapiens
acagugucauggcucaau

SEQ ID NO: 207485 - RNA, 22 nt, Homo sapiens
acaugccucccugguccgcugu

SEQ ID NO: 207486 - RNA, 22 nt, Homo sapiens
acccugucaaaauagaccaauc

SEQ ID NO: 207487 - RNA, 22 nt, Homo sapiens
acccugucacucccaucaauuu

SEQ ID NO: 207488 - RNA, 22 nt, Homo sapiens
acucagagaacauucccagucu

SEQ ID NO: 207489 - RNA, 22 nt, Homo sapiens
acugagccuuuaaaugacuuca

SEQ ID NO: 207490 - RNA, 22 nt, Homo sapiens
acugcacuccagccucggugac

SEQ ID NO: 207491 - RNA, 22 nt, Homo sapiens
acugcacuccagccucguggac

SEQ ID NO: 207492 - RNA, 22 nt, Homo sapiens
acugcacuccagcuugggugac

SEQ ID NO: 207493 - RNA, 22 nt, Homo sapiens
agaaaugcagcaugaggcggca

SEQ ID NO: 207494 - RNA, 22 nt, Homo sapiens
agacagcuggaguaucauagcu

SEQ ID NO: 207495 - RNA, 22 nt, Homo sapiens
agagaucacugaaucacggggg

SEQ ID NO: 207496 - RNA, 18 nt, Homo sapiens
agagcacugaguuuuaga

SEQ ID NO: 207497 - RNA, 22 nt, Homo sapiens
agagugcaaagguuggggcugg

SEQ ID NO: 207498 - RNA, 22 nt, Homo sapiens
agaucacagucuuugguuuuag

SEQ ID NO: 207499 - RNA, 22 nt, Homo sapiens
agcaaccagaggagaugaggcu

SEQ ID NO: 207500 - RNA, 22 nt, Homo sapiens
agcaagauugauggccugcagg

SEQ ID NO: 207501 - RNA, 22 nt, Homo sapiens
agcccagagacuguguaaauuu

SEQ ID NO: 207502 - RNA, 17 nt, Homo sapiens
agccccauuagcuaguu

SEQ ID NO: 207503 - RNA, 22 nt, Homo sapiens
agcuaugucugaugccugauua

SEQ ID NO: 207504 - RNA, 22 nt, Homo sapiens
agcucuuguuaguauuagcagu

SEQ ID NO: 207505 - RNA, 22 nt, Homo sapiens
agcuggauuguuuaccuggggc

SEQ ID NO: 207506 - RNA, 22 nt, Homo sapiens
agcuguguugucugaagucaga

SEQ ID NO: 207507 - RNA, 22 nt, Homo sapiens
agcuucauuguuaugaauguca

SEQ ID NO: 207508 - RNA, 22 nt, Homo sapiens
agcuuguuuuauagaaagucaa

SEQ ID NO: 207509 - RNA, 22 nt, Homo sapiens
aggaacuguaacuaugucucug

SEQ ID NO: 207510 - RNA, 22 nt, Homo sapiens
aggaagacugaaauugcuguuc

SEQ ID NO: 207511 - RNA, 22 nt, Homo sapiens
aggaauggaaacuuuugauggu

SEQ ID NO: 207512 - RNA, 21 nt, Homo sapiens
aggcaagacuuuuagguuugu

SEQ ID NO: 207513 - RNA, 22 nt, Homo sapiens
aggcuaagaugacuccaccccc

SEQ ID NO: 207514 - RNA, 22 nt, Homo sapiens
aggcuuuuggagaacacugcac

SEQ ID NO: 207515 - RNA, 22 nt, Homo sapiens
agggaauguaaguuuuaugaga

SEQ ID NO: 207516 - RNA, 22 nt, Homo sapiens
aggguaguaggcuugggauugg

SEQ ID NO: 207517 - RNA, 22 nt, Homo sapiens
agguagucuuuuccuauuguca

SEQ ID NO: 207518 - RNA, 22 nt, Homo sapiens
agucaacaucaugaaguggaaa

SEQ ID NO: 207519 - RNA, 22 nt, Homo sapiens
agucacagccuuuuacuuuaga

SEQ ID NO: 207520 - RNA, 22 nt, Homo sapiens
agucacagugaccuugucugac

SEQ ID NO: 207521 - RNA, 22 nt, Homo sapiens
agucagucuguccugugcugag

SEQ ID NO: 207522 - RNA, 22 nt, Homo sapiens
agugauggagccaggauuuaau

SEQ ID NO: 207523 - RNA, 22 nt, Homo sapiens
agugauuuuaacuuccagcaau

SEQ ID NO: 207524 - RNA, 22 nt, Homo sapiens
agugcaguggcacaaucuuggc

SEQ ID NO: 207525 - RNA, 22 nt, Homo sapiens
aguggauuuuauuugacaacua

SEQ ID NO: 207526 - RNA, 22 nt, Homo sapiens
aguguuuuucaugggauacuuu

SEQ ID NO: 207527 - RNA, 22 nt, Homo sapiens
aguucaaugcucuuucuacuau

SEQ ID NO: 207528 - RNA, 22 nt, Homo sapiens
aguucaauggguuuucacucau

SEQ ID NO: 207529 - RNA, 22 nt, Homo sapiens
auagacacugaaaucccugcca

SEQ ID NO: 207530 - RNA, 22 nt, Homo sapiens
auagcagcucacuuauuuaugg

SEQ ID NO: 207531 - RNA, 22 nt, Homo sapiens
auagcucuugcuuacccacugu

SEQ ID NO: 207532 - RNA, 22 nt, Homo sapiens
auagucaguagucucauaauga

SEQ ID NO: 207533 - RNA, 21 nt, Homo sapiens
auagugcuagagaguagcagg

SEQ ID NO: 207534 - RNA, 22 nt, Homo sapiens
cuggucguuauuuaucuucuca

SEQ ID NO: 207535 - RNA, 22 nt, Homo sapiens
cugucuggaguccuucgugugc

SEQ ID NO: 207536 - RNA, 22 nt, Homo sapiens
cugugguuuaaggaauuuugac

SEQ ID NO: 207537 - RNA, 22 nt, Homo sapiens
cuucaaaguuggcuaggagaca

SEQ ID NO: 207538 - RNA, 22 nt, Homo sapiens
cuuccaaguggggcacgugcca

SEQ ID NO: 207539 - RNA, 22 nt, Homo sapiens
cuugucuugcacacgguugcca

SEQ ID NO: 207540 - RNA, 22 nt, Homo sapiens
cuuuguguggacauuucaggca

SEQ ID NO: 207541 - RNA, 22 nt, Homo sapiens
gaaaugcucagggguuuuccag

SEQ ID NO: 207542 - RNA, 23 nt, Homo sapiens
gaaauguaagugaugccccacag

SEQ ID NO: 207543 - RNA, 22 nt, Homo sapiens
gaauagugcugcgauaaacaua

SEQ ID NO: 207544 - RNA, 22 nt, Homo sapiens
gacaaguuugauuuauuccaag

SEQ ID NO: 207545 - RNA, 22 nt, Homo sapiens
gacacagugaagucucuacuug

SEQ ID NO: 207546 - RNA, 22 nt, Homo sapiens
gaccacagacuggaaagagggc

SEQ ID NO: 207547 - RNA, 22 nt, Homo sapiens
gacuggguuaguuugaaagacu

SEQ ID NO: 207548 - RNA, 22 nt, Homo sapiens
gagaacugagugugcuggcgga

SEQ ID NO: 207549 - RNA, 22 nt, Homo sapiens
gagaaugaacagacugccucuu

SEQ ID NO: 207550 - RNA, 22 nt, Homo sapiens
gagagugcuuggcaucugcuga

SEQ ID NO: 207551 - RNA, 22 nt, Homo sapiens
gagaucaaugggauggaauuga

SEQ ID NO: 207552 - RNA, 22 nt, Homo sapiens
gagaugaaguuaaggaucuuua

SEQ ID NO: 207553 - RNA, 22 nt, Homo sapiens
gagguaugauugacauauaaaa

SEQ ID NO: 207554 - RNA, 22 nt, Homo sapiens
gagguuuuagugagucccacug

SEQ ID NO: 207555 - RNA, 22 nt, Homo sapiens
gaguaacauugacaacuucaug

SEQ ID NO: 207556 - RNA, 22 nt, Homo sapiens
gagugcaauggcaccgucucgg

SEQ ID NO: 207557 - RNA, 22 nt, Homo sapiens
ugcuauguuuucccuccuuauc

SEQ ID NO: 207558 - RNA, 22 nt, Homo sapiens
ugcuuugguagaaaucuuuggu

SEQ ID NO: 207559 - RNA, 22 nt, Homo sapiens
uggaaauaaaauagaguuugcc

SEQ ID NO: 207560 - RNA, 22 nt, Homo sapiens
uggaaaucuaaguuuggauuga

SEQ ID NO: 207561 - RNA, 19 nt, Homo sapiens
uggaacugauucaguucug

SEQ ID NO: 207562 - RNA, 22 nt, Homo sapiens
uggaagccuagauucuuuucuu

SEQ ID NO: 207563 - RNA, 20 nt, Homo sapiens
uggaagccuggugcuaucuu

SEQ ID NO: 207564 - RNA, 22 nt, Homo sapiens
uggaaggucauuguucauuuga

SEQ ID NO: 207565 - RNA, 18 nt, Homo sapiens
uggacagugauuauccau

SEQ ID NO: 207566 - RNA, 21 nt, Homo sapiens
uggaccccuacuucucaccau

SEQ ID NO: 207567 - RNA, 21 nt, Homo sapiens
uggaccccuuucuuacaccgu

SEQ ID NO: 207568 - RNA, 22 nt, Homo sapiens
uggagugagaacuucaaugaug

SEQ ID NO: 207569 - RNA, 22 nt, Homo sapiens
uggagugcaauggcaccaucuu

SEQ ID NO: 207570 - RNA, 22 nt, Homo sapiens
uggauggagaggcuugugaugc

SEQ ID NO: 207571 - RNA, 22 nt, Homo sapiens
uggcaagagggaugcaagguuu

SEQ ID NO: 207572 - RNA, 22 nt, Homo sapiens
uggcauauaaagauguguucaa

SEQ ID NO: 207573 - RNA, 22 nt, Homo sapiens
uggcaugauguguucauugaaa

SEQ ID NO: 207574 - RNA, 22 nt, Homo sapiens
uggcauggaaagcuuuucauac

SEQ ID NO: 207575 - RNA, 22 nt, Homo sapiens
uggcauggggcagaacauuaca

SEQ ID NO: 207576 - RNA, 22 nt, Homo sapiens
uggccagugucggaggccagga

SEQ ID NO: 207577 - RNA, 22 nt, Homo sapiens
uggcuguguccucucccaaauc

SEQ ID NO: 207578 - RNA, 22 nt, Homo sapiens
ugggaacugaggugaaaagaca

SEQ ID NO: 207579 - RNA, 22 nt, Homo sapiens
ugguucaguugcacaggcuguu

SEQ ID NO: 207580 - RNA, 22 nt, Homo sapiens
uguaauguuugguagguuaggu

SEQ ID NO: 207581 - RNA, 22 nt, Homo sapiens
uguagcacauuugaagagaagc

SEQ ID NO: 207582 - RNA, 22 nt, Homo sapiens
uguauguugggucaaaguacau

SEQ ID NO: 207583 - RNA, 22 nt, Homo sapiens
ugucaccauuuguaggugagga

SEQ ID NO: 207584 - RNA, 23 nt, Homo sapiens
ugucaucaagaugaggucacacu

SEQ ID NO: 207585 - RNA, 22 nt, Homo sapiens
ugucaugguagcaaggacgagg

SEQ ID NO: 207586 - RNA, 22 nt, Homo sapiens
ugucauguggcuaacgauucau

SEQ ID NO: 207587 - RNA, 22 nt, Homo sapiens
uguccuagagggaugucacccc

SEQ ID NO: 207588 - RNA, 22 nt, Homo sapiens
ugugacaaauuuaguggacugu

SEQ ID NO: 207589 - RNA, 22 nt, Homo sapiens
ugugacagcacagcaucucuuu

SEQ ID NO: 207590 - RNA, 22 nt, Homo sapiens
ugugcaguuuugagugaauuuc

SEQ ID NO: 207591 - RNA, 22 nt, Homo sapiens
uguggccuuuguuucaguuggg

SEQ ID NO: 207592 - RNA, 22 nt, Homo sapiens
uguguuugauaaguccauaguu

SEQ ID NO: 207593 - RNA, 22 nt, Homo sapiens
uguuacagugacuaauguuuua

SEQ ID NO: 207594 - RNA, 19 nt, Homo sapiens
uguugcacauaucaauaug

SEQ ID NO: 207595 - RNA, 21 nt, Homo sapiens
uguuuuugcuguguaucucuc

SEQ ID NO: 207596 - RNA, 21 nt, Homo sapiens
uuaacagacaagugucuuccc

SEQ ID NO: 207597 - RNA, 22 nt, Homo sapiens
uuaacagugucaaucuguagua

SEQ ID NO: 207598 - RNA, 22 nt, Homo sapiens
uuaaguuguagcuacaaauaca

SEQ ID NO: 207599 - RNA, 22 nt, Homo sapiens
uuucaucaagcacagaguagau

SEQ ID NO: 207600 - RNA, 18 nt, Homo sapiens
uuucauugagugugauau

SEQ ID NO: 207601 - RNA, 22 nt, Homo sapiens
uuucccuuacuuaaacuuacuc

SEQ ID NO: 207602 - RNA, 16 nt, Homo sapiens
uuucccuuugguguuu

SEQ ID NO: 207603 - RNA, 22 nt, Homo sapiens
uuugacaaugugugcuuguauu

SEQ ID NO: 207604 - RNA, 22 nt, Homo sapiens
uuugaggaaaggcauaaguagg

SEQ ID NO: 207605 - RNA, 22 nt, Homo sapiens
uuugauguugauacuaccuuca

SEQ ID NO: 207606 - RNA, 22 nt, Homo sapiens
uuugcuuaguaaauguagaaaa

SEQ ID NO: 207607 - RNA, 22 nt, Homo sapiens
uuuggcauuagagagacuugca

SEQ ID NO: 207608 - RNA, 23 nt, Homo sapiens
uuuggcauuccagaaauuuucau

SEQ ID NO: 207609 - RNA, 22 nt, Homo sapiens
uuuggcauuuaaauaugcaugg

SEQ ID NO: 207610 - RNA, 22 nt, Homo sapiens
uuugggaaaugaaguugguaga

SEQ ID NO: 207611 - RNA, 19 nt, Homo sapiens
uuuguccugcccuuucuca

SEQ ID NO: 207612 - RNA, 20 nt, Homo sapiens
uuuuagcuuuuauugaaagc

SEQ ID NO: 207613 - RNA, 22 nt, Homo sapiens
uuuuagcuuuucccaggacucc

SEQ ID NO: 207614 - RNA, 22 nt, Homo sapiens
uuuugcucuugguaaugaaaga

SEQ ID NO: 207615 - RNA, 22 nt, Homo sapiens
ugagacugaguuuccaucuugu

SEQ ID NO: 207616 - RNA, 22 nt, Homo sapiens
ugagaugagagaaugcuugccu

SEQ ID NO: 207617 - RNA, 22 nt, Homo sapiens
ugagaugagggaagccuaggca

SEQ ID NO: 207618 - RNA, 22 nt, Homo sapiens
ugagaugagggcugcacucaaa

SEQ ID NO: 207619 - RNA, 22 nt, Homo sapiens
ugagaugaggucucgcucuguc

SEQ ID NO: 207620 - RNA, 22 nt, Homo sapiens
ugagaugauagauauguuaauu

SEQ ID NO: 207621 - RNA, 22 nt, Homo sapiens
ugagaugauuuaauggagccca

SEQ ID NO: 207622 - RNA, 22 nt, Homo sapiens
ugagauguuuguuucagugccu

SEQ ID NO: 207623 - RNA, 23 nt, Homo sapiens
ugagauuauaaucuuuuacuucu

SEQ ID NO: 207624 - RNA, 22 nt, Homo sapiens
ugagccaaguucacaccauugc

SEQ ID NO: 207625 - RNA, 22 nt, Homo sapiens
ugagcugagauuaagcugcugc

SEQ ID NO: 207626 - RNA, 22 nt, Homo sapiens
ugagguaugugaugucuuuuag

SEQ ID NO: 207627 - RNA, 22 nt, Homo sapiens
ugagucgagauugcgccacugu

SEQ ID NO: 207628 - RNA, 22 nt, Homo sapiens
ugagucuguuccaaagaaauaa

SEQ ID NO: 207629 - RNA, 22 nt, Homo sapiens
ugagucuguucucacauugcua

SEQ ID NO: 207630 - RNA, 22 nt, Homo sapiens
ugagugaaugugaaggcuaggg

SEQ ID NO: 207631 - RNA, 22 nt, Homo sapiens
ugaucucagcucacugguugaa

SEQ ID NO: 207632 - RNA, 20 nt, Homo sapiens
ugauuaguccacuuggcucu

SEQ ID NO: 207633 - RNA, 22 nt, Homo sapiens
ugcaagaaucuuucaggcuagc

SEQ ID NO: 207634 - RNA, 22 nt, Homo sapiens
ugcaagucaucuguccuucaga

SEQ ID NO: 207635 - RNA, 22 nt, Homo sapiens
ugcaccacugcacuucagccug

SEQ ID NO: 207636 - RNA, 22 nt, Homo sapiens
ugcauauucgaguuauuuuggg

SEQ ID NO: 207637 - RNA, 20 nt, Homo sapiens
ugccaagaaaugaggguauu

SEQ ID NO: 207638 - RNA, 22 nt, Homo sapiens
ugccagaugcuggugugagggg

SEQ ID NO: 207639 - RNA, 22 nt, Homo sapiens
ugccuacagaaggggcucagca

SEQ ID NO: 207640 - RNA, 22 nt, Homo sapiens
ugccuaggcuggagugcagugg

SEQ ID NO: 207641 - RNA, 22 nt, Homo sapiens
ugccugagccagguuuuaggag

SEQ ID NO: 207642 - RNA, 21 nt, Homo sapiens
ugccuuuguaguaggugucuu

SEQ ID NO: 207643 - RNA, 22 nt, Homo sapiens
ugcuacccuucgucucucuggu

SEQ ID NO: 207644 - RNA, 22 nt, Homo sapiens
ugcuaugucagccaggcugguc

SEQ ID NO: 207645 - RNA, 21 nt, Homo sapiens
uggaaacuucuagcuuacgua

SEQ ID NO: 207646 - RNA, 22 nt, Homo sapiens
uggaaauaaaugugccaagauc

SEQ ID NO: 207647 - RNA, 22 nt, Homo sapiens
uggaagaugggaccucaguuuu

SEQ ID NO: 207648 - RNA, 22 nt, Homo sapiens
uggacaagauagguucuauauu

SEQ ID NO: 207649 - RNA, 22 nt, Homo sapiens
uggacagagagaccggcauuuu

SEQ ID NO: 207650 - RNA, 19 nt, Homo sapiens
uggaccccuuccuuacacc

SEQ ID NO: 207651 - RNA, 22 nt, Homo sapiens
uggaccccuucuccuauuaaaa

SEQ ID NO: 207652 - RNA, 22 nt, Homo sapiens
uggagcccuaaacuucuaauau

SEQ ID NO: 207653 - RNA, 22 nt, Homo sapiens
uggagucgugcccuugcauuua

SEQ ID NO: 207654 - RNA, 22 nt, Homo sapiens
uggcaguuucacauggcucaac

SEQ ID NO: 207655 - RNA, 22 nt, Homo sapiens
uggcauggucugcccaaguuuc

SEQ ID NO: 207656 - RNA, 22 nt, Homo sapiens
uggcauguagucugggaccugg

SEQ ID NO: 207657 - RNA, 22 nt, Homo sapiens
uggcuagaccugcauaacagcu

SEQ ID NO: 207658 - RNA, 21 nt, Homo sapiens
uggucaguuuucucacuagga

SEQ ID NO: 207659 - RNA, 20 nt, Homo sapiens
uggugucuuggaaagagcuc

SEQ ID NO: 207660 - RNA, 22 nt, Homo sapiens
uguagcaaauaaaagucuggau

SEQ ID NO: 207661 - RNA, 21 nt, Homo sapiens
uguagcagcaugauuuauaau

SEQ ID NO: 207662 - RNA, 22 nt, Homo sapiens
uguauguugauguuauauucug

SEQ ID NO: 207663 - RNA, 22 nt, Homo sapiens
uguauuuguuguuaaauggaga

SEQ ID NO: 207664 - RNA, 22 nt, Homo sapiens
ugucauguagaaauuguccauu

SEQ ID NO: 207665 - RNA, 22 nt, Homo sapiens
ugucaugucaacuauggaauuu

SEQ ID NO: 207666 - RNA, 22 nt, Homo sapiens
ugucauguugguguacugcacc

SEQ ID NO: 207667 - RNA, 22 nt, Homo sapiens
ugucauucaggaaauucuaagu

SEQ ID NO: 207668 - RNA, 19 nt, Homo sapiens
uguccuagaggaguucaca

SEQ ID NO: 207669 - RNA, 22 nt, Homo sapiens
ugucuggaaggguggccuccug

SEQ ID NO: 207670 - RNA, 22 nt, Homo sapiens
ugucuuggacuugaaucucauu

SEQ ID NO: 207671 - RNA, 22 nt, Homo sapiens
ugucuuggagaauccuggguuu

SEQ ID NO: 207672 - RNA, 22 nt, Homo sapiens
ugugaacagaauuagucaccua

SEQ ID NO: 207673 - RNA, 22 nt, Homo sapiens
ugugaacauuuuguauauauua

SEQ ID NO: 207674 - RNA, 21 nt, Homo sapiens
ugugaccucugucucugaguc

SEQ ID NO: 207675 - RNA, 19 nt, Homo sapiens
ugugagcauuagcauuuag

SEQ ID NO: 207676 - RNA, 22 nt, Homo sapiens
uguggcucuucuguucuccacu

SEQ ID NO: 207677 - RNA, 22 nt, Homo sapiens
ugugucuuguuuauagcuuucu

SEQ ID NO: 207678 - RNA, 22 nt, Homo sapiens
ugugucuuguuuuuucccaggc

SEQ ID NO: 207679 - RNA, 22 nt, Homo sapiens
uguguuuuuauguaaaauggaa

SEQ ID NO: 207680 - RNA, 21 nt, Homo sapiens
uguuaacaugcagauuacugg

SEQ ID NO: 207681 - RNA, 22 nt, Homo sapiens
uguucauggauccaguggcuuc

SEQ ID NO: 207682 - RNA, 19 nt, Homo sapiens
uguugcacuccagcuuggg

SEQ ID NO: 207683 - RNA, 22 nt, Homo sapiens
uuaaggcauucuuugucuucau

SEQ ID NO: 207684 - RNA, 22 nt, Homo sapiens
uuaaguguaaguggugugggac

SEQ ID NO: 207685 - RNA, 19 nt, Homo sapiens
uuaagugugauaucucagu

SEQ ID NO: 207686 - RNA, 22 nt, Homo sapiens
uuacaccuguaauccagcacuu

SEQ ID NO: 207687 - RNA, 19 nt, Homo sapiens
uuacagugugcccuuuuag

SEQ ID NO: 207688 - RNA, 22 nt, Homo sapiens
uuacugcuuaagugauucaaca

SEQ ID NO: 207689 - RNA, 22 nt, Homo sapiens
uuagacaguggugcacugcacu

SEQ ID NO: 207690 - RNA, 22 nt, Homo sapiens
uuagauguuuagaagugggcca

SEQ ID NO: 207691 - RNA, 22 nt, Homo sapiens
uuagauuauugguguuuugcaa

SEQ ID NO: 207692 - RNA, 22 nt, Homo sapiens
uuaugacauugacaguuuuuag

SEQ ID NO: 207693 - RNA, 22 nt, Homo sapiens
uuaugucauuuuuggauguuaa

SEQ ID NO: 207694 - RNA, 22 nt, Homo sapiens
uuaugucuuuuguguucagcua

SEQ ID NO: 207695 - RNA, 22 nt, Homo sapiens
uucaagucuuggcuuugccacc

SEQ ID NO: 207696 - RNA, 20 nt, Homo sapiens
uucacaggcagcuucuuucu

SEQ ID NO: 207697 - RNA, 22 nt, Homo sapiens
uucaccaguuuugucacgaaug

SEQ ID NO: 207698 - RNA, 22 nt, Homo sapiens
uucacugcacuccagccugagc

SEQ ID NO: 207699 - RNA, 22 nt, Homo sapiens
uucacugcacuccagccugggu

SEQ ID NO: 207700 - RNA, 22 nt, Homo sapiens
uucacugcaugaaaaggacagc

SEQ ID NO: 207701 - RNA, 22 nt, Homo sapiens
uucacugcauuucagccugggc

SEQ ID NO: 207702 - RNA, 22 nt, Homo sapiens
uucacuguagcuuggauguuua

SEQ ID NO: 207703 - RNA, 22 nt, Homo sapiens
uucagagagggagggauaccua

SEQ ID NO: 207704 - RNA, 22 nt, Homo sapiens
uucagcacugaaaauaugucau

SEQ ID NO: 207705 - RNA, 22 nt, Homo sapiens
uucaggcuuuuauuuacugaua

SEQ ID NO: 207706 - RNA, 22 nt, Homo sapiens
uucaguccauuuccuuggucac

SEQ ID NO: 207707 - RNA, 22 nt, Homo sapiens
uucagugucauuaacacaguag

SEQ ID NO: 207708 - RNA, 22 nt, Homo sapiens
uucauccccuccaaaucucaug

SEQ ID NO: 207709 - RNA, 22 nt, Homo sapiens
agugcauuuguucugugucagg

SEQ ID NO: 207710 - RNA, 22 nt, Homo sapiens
agugccauggcugcuagauggc

SEQ ID NO: 207711 - RNA, 22 nt, Homo sapiens
agugcuuaauagauguccagca

SEQ ID NO: 207712 - RNA, 22 nt, Homo sapiens
agugguuugaucacagcucacu

SEQ ID NO: 207713 - RNA, 22 nt, Homo sapiens
aguuuugguugaguuacuagca

SEQ ID NO: 207714 - RNA, 22 nt, Homo sapiens
auaaacagcuuauccucuauuc

SEQ ID NO: 207715 - RNA, 22 nt, Homo sapiens
auaaggcugguauagacauuca

SEQ ID NO: 207716 - RNA, 22 nt, Homo sapiens
auacagugaauaucuggggcag

SEQ ID NO: 207717 - RNA, 22 nt, Homo sapiens
auagcuguugaauggaauauuc

SEQ ID NO: 207718 - RNA, 22 nt, Homo sapiens
auagugcugcaauaaacauacg

SEQ ID NO: 207719 - RNA, 22 nt, Homo sapiens
auagugcugcaauaaacauaug

SEQ ID NO: 207720 - RNA, 22 nt, Homo sapiens
auagugcugcaaugaacauaca

SEQ ID NO: 207721 - RNA, 22 nt, Homo sapiens
auaugcaaauccauagagacag

SEQ ID NO: 207722 - RNA, 22 nt, Homo sapiens
auauuacuggcuauaucgcaag

SEQ ID NO: 207723 - RNA, 22 nt, Homo sapiens
aucacagcuacuccucugucuu

SEQ ID NO: 207724 - RNA, 22 nt, Homo sapiens
aucacagguacuauggcugaca

SEQ ID NO: 207725 - RNA, 22 nt, Homo sapiens
aucacuuugcucuccagugugg

SEQ ID NO: 207726 - RNA, 21 nt, Homo sapiens
aucagagacccaggcuuccuc

SEQ ID NO: 207727 - RNA, 22 nt, Homo sapiens
aucagugauugauuuaaagacg

SEQ ID NO: 207728 - RNA, 22 nt, Homo sapiens
aucagugcauguuuguugagcu

SEQ ID NO: 207729 - RNA, 18 nt, Homo sapiens
aucauugcacugucuugc

SEQ ID NO: 207730 - RNA, 21 nt, Homo sapiens
auccuucuuuuucaaccugug

SEQ ID NO: 207731 - RNA, 21 nt, Homo sapiens
aucucacuugaauguaaaagc

SEQ ID NO: 207732 - RNA, 22 nt, Homo sapiens
aucuguagauucagcacaagcu

SEQ ID NO: 207733 - RNA, 22 nt, Homo sapiens
aucuuggauuaccugggugggu

SEQ ID NO: 207734 - RNA, 22 nt, Homo sapiens
augaaauguaugagucuggguu

SEQ ID NO: 207735 - RNA, 21 nt, Homo sapiens
augagauguuagacuuuagac

SEQ ID NO: 207736 - RNA, 22 nt, Homo sapiens
augaggugauuucuguucgggu

SEQ ID NO: 207737 - RNA, 20 nt, Homo sapiens
augagguguaugacacugaa

SEQ ID NO: 207738 - RNA, 22 nt, Homo sapiens
augauagucuugagaagcauuu

SEQ ID NO: 207739 - RNA, 22 nt, Homo sapiens
augauucugaucuagagcuugg

SEQ ID NO: 207740 - RNA, 22 nt, Homo sapiens
augcacauggcuaacuuuuuuc

SEQ ID NO: 207741 - RNA, 19 nt, Homo sapiens
augccucaguuuuguacuu

SEQ ID NO: 207742 - RNA, 22 nt, Homo sapiens
auggaagaaaguuggguucuug

SEQ ID NO: 207743 - RNA, 22 nt, Homo sapiens
auggaaucauccuccugggagc

SEQ ID NO: 207744 - RNA, 22 nt, Homo sapiens
auggaguguaauauugagagcu

SEQ ID NO: 207745 - RNA, 22 nt, Homo sapiens
auggauuuguaguacaugguug

SEQ ID NO: 207746 - RNA, 22 nt, Homo sapiens
auggauuuuaggauacaguuga

SEQ ID NO: 207747 - RNA, 22 nt, Homo sapiens
auggauuuugaacuugagaguu

SEQ ID NO: 207748 - RNA, 22 nt, Homo sapiens
auggcuguuccugggaguucua

SEQ ID NO: 207749 - RNA, 22 nt, Homo sapiens
augggauaguaucaguggaaua

SEQ ID NO: 207750 - RNA, 22 nt, Homo sapiens
auguaauugagguuuuugccau

SEQ ID NO: 207751 - RNA, 22 nt, Homo sapiens
augucaaggugggugauaguuu

SEQ ID NO: 207752 - RNA, 20 nt, Homo sapiens
augucaggaagggagucagg

SEQ ID NO: 207753 - RNA, 22 nt, Homo sapiens
augucuuucauagagacccaga

SEQ ID NO: 207754 - RNA, 22 nt, Homo sapiens
augugaacaucauagaaugcac

SEQ ID NO: 207755 - RNA, 22 nt, Homo sapiens
augugcaauggugucaccacau

SEQ ID NO: 207756 - RNA, 22 nt, Homo sapiens
auguggauaucuauaucuggau

SEQ ID NO: 207757 - RNA, 22 nt, Homo sapiens
auguggcauuucucauucauuu

SEQ ID NO: 207758 - RNA, 22 nt, Homo sapiens
auguggcuuuccuagaucuuag

SEQ ID NO: 207759 - RNA, 22 nt, Homo sapiens
auguugcaguuuaauuauccua

SEQ ID NO: 207760 - RNA, 22 nt, Homo sapiens
auguugcuugaaggcauuuugu

SEQ ID NO: 207761 - RNA, 22 nt, Homo sapiens
auuagguuggugcaaaacuuuc

SEQ ID NO: 207762 - RNA, 22 nt, Homo sapiens
auuagugaaugugaugucuuga

SEQ ID NO: 207763 - RNA, 22 nt, Homo sapiens
auucaagucaucucuccgcauu

SEQ ID NO: 207764 - RNA, 22 nt, Homo sapiens
auucccuguagaauaaggaugg

SEQ ID NO: 207765 - RNA, 22 nt, Homo sapiens
auugaacuuuugucacugacau

SEQ ID NO: 207766 - RNA, 22 nt, Homo sapiens
auugcacaucugcacuacagcc

SEQ ID NO: 207767 - RNA, 22 nt, Homo sapiens
auugcauaaacacauuucuuau

SEQ ID NO: 207768 - RNA, 22 nt, Homo sapiens
auugcuuuuacugggagcuuug

SEQ ID NO: 207769 - RNA, 22 nt, Homo sapiens
caaaggcuuccacugcauccuu

SEQ ID NO: 207770 - RNA, 22 nt, Homo sapiens
caaaggcuucugaaacugcaga

SEQ ID NO: 207771 - RNA, 22 nt, Homo sapiens
caaagucuauucuacccuuacc

SEQ ID NO: 207772 - RNA, 22 nt, Homo sapiens
caauggcaaugaaauagugaga

SEQ ID NO: 207773 - RNA, 22 nt, Homo sapiens
caccacagccauuauugucccc

SEQ ID NO: 207774 - RNA, 22 nt, Homo sapiens
cacugcacuccagcuuugguga

SEQ ID NO: 207775 - RNA, 22 nt, Homo sapiens
cacugcauucuccaccucccag

SEQ ID NO: 207776 - RNA, 22 nt, Homo sapiens
cacuuugguucaccugaguuuc

SEQ ID NO: 207777 - RNA, 22 nt, Homo sapiens
cagcacauuacaaguacuuggu

SEQ ID NO: 207778 - RNA, 22 nt, Homo sapiens
cagcagguuuuuaucaguuaag

SEQ ID NO: 207779 - RNA, 22 nt, Homo sapiens
cagcuaguuuuugguuuacagu

SEQ ID NO: 207780 - RNA, 22 nt, Homo sapiens
caggaccucuugccuggaagcc

SEQ ID NO: 207781 - RNA, 22 nt, Homo sapiens
cagguacuucugggcugagcag

SEQ ID NO: 207782 - RNA, 22 nt, Homo sapiens
cagugaauuucaggucaagagu

SEQ ID NO: 207783 - RNA, 22 nt, Homo sapiens
cagugauaggugguuguuggca

SEQ ID NO: 207784 - RNA, 22 nt, Homo sapiens
cagugcaaccuccaucucucgg

SEQ ID NO: 207785 - RNA, 22 nt, Homo sapiens
cagugcauagaugugccacauu

SEQ ID NO: 207786 - RNA, 22 nt, Homo sapiens
caguggaugauguuuucugugg

SEQ ID NO: 207787 - RNA, 22 nt, Homo sapiens
caguggauuggauggauaaugc

SEQ ID NO: 207788 - RNA, 22 nt, Homo sapiens
cauacaguaggcacuauuugua

SEQ ID NO: 207789 - RNA, 22 nt, Homo sapiens
cauauaguaggugcucuguguu

SEQ ID NO: 207790 - RNA, 19 nt, Homo sapiens
caucccugagcugaagugg

SEQ ID NO: 207791 - RNA, 22 nt, Homo sapiens
cauugcaaugaggucuugcagu

SEQ ID NO: 207792 - RNA, 22 nt, Homo sapiens
cauugcuuuuggugguuuagac

SEQ ID NO: 207793 - RNA, 22 nt, Homo sapiens
cauugguuccaguuuguccuua

SEQ ID NO: 207794 - RNA, 22 nt, Homo sapiens
ccacccuggagaauuugagguc

SEQ ID NO: 207795 - RNA, 22 nt, Homo sapiens
ccacccuuccauucuuccucuu

SEQ ID NO: 207796 - RNA, 22 nt, Homo sapiens
ccaucacaggccucagugggaa

SEQ ID NO: 207797 - RNA, 22 nt, Homo sapiens
ccccagugguugcaacagcaga

SEQ ID NO: 207798 - RNA, 22 nt, Homo sapiens
ccccauuugaacuccuucaacu

SEQ ID NO: 207799 - RNA, 22 nt, Homo sapiens
ccucaguguuuaucauuauuuu

SEQ ID NO: 207800 - RNA, 22 nt, Homo sapiens
ccucuuuguugagacuucacca

SEQ ID NO: 207801 - RNA, 22 nt, Homo sapiens
ccugucuugaagagauccuccu

SEQ ID NO: 207802 - RNA, 22 nt, Homo sapiens
ccuucauccuccagcaggcuag

SEQ ID NO: 207803 - RNA, 22 nt, Homo sapiens
ccuugguaauguguuuuauucu

SEQ ID NO: 207804 - RNA, 22 nt, Homo sapiens
gugucuccugccuucaugcagc

SEQ ID NO: 207805 - RNA, 22 nt, Homo sapiens
gugucuccuguggagcuaugua

SEQ ID NO: 207806 - RNA, 22 nt, Homo sapiens
guguggcaggugggggcucaga

SEQ ID NO: 207807 - RNA, 22 nt, Homo sapiens
guuaugacacucuuuuuaucau

SEQ ID NO: 207808 - RNA, 20 nt, Homo sapiens
guucauguaauuaguucagg

SEQ ID NO: 207809 - RNA, 22 nt, Homo sapiens
guugcuuauuccuguaauccca

SEQ ID NO: 207810 - RNA, 22 nt, Homo sapiens
guuguggcuugugauuaagcac

SEQ ID NO: 207811 - RNA, 22 nt, Homo sapiens
guuugccuuuuagauaggaaug

SEQ ID NO: 207812 - RNA, 22 nt, Homo sapiens
guuuggcucuuguuucugucaa

SEQ ID NO: 207813 - RNA, 22 nt, Homo sapiens
uaacaacauucuaacugacggc

SEQ ID NO: 207814 - RNA, 22 nt, Homo sapiens
uaacaguggucugugguaucug

SEQ ID NO: 207815 - RNA, 22 nt, Homo sapiens
uaacuaguggaauuugauuuca

SEQ ID NO: 207816 - RNA, 22 nt, Homo sapiens
uaagugaauauggacaguuagc

SEQ ID NO: 207817 - RNA, 22 nt, Homo sapiens
uaauaauguuaggcuuacucaa

SEQ ID NO: 207818 - RNA, 22 nt, Homo sapiens
uaauaguguuaaugcuagagcu

SEQ ID NO: 207819 - RNA, 22 nt, Homo sapiens
uaaucucagcuacucaggaggc

SEQ ID NO: 207820 - RNA, 22 nt, Homo sapiens
uaaugcucauuagcaggccaau

SEQ ID NO: 207821 - RNA, 22 nt, Homo sapiens
uacaagcacaggcagcaggcug

SEQ ID NO: 207822 - RNA, 22 nt, Homo sapiens
uacaauagugacaaaucagcau

SEQ ID NO: 207823 - RNA, 20 nt, Homo sapiens
uacacguguagcauucucua

SEQ ID NO: 207824 - RNA, 18 nt, Homo sapiens
uacagaacuggaguagaa

SEQ ID NO: 207825 - RNA, 22 nt, Homo sapiens
uacagccacauaauguaugauu

SEQ ID NO: 207826 - RNA, 22 nt, Homo sapiens
uacaguguuuugguauuccaca

SEQ ID NO: 207827 - RNA, 22 nt, Homo sapiens
uacaugugcacaacgugcaggu

SEQ ID NO: 207828 - RNA, 22 nt, Homo sapiens
uacugcugucagugccaaguag

SEQ ID NO: 207829 - RNA, 22 nt, Homo sapiens
uagaggaaggauuggaaacgca

SEQ ID NO: 207830 - RNA, 22 nt, Homo sapiens
uagaucaauuaauuguuacuug

SEQ ID NO: 207831 - RNA, 22 nt, Homo sapiens
uagcacagggaauugguucucu

SEQ ID NO: 207832 - RNA, 18 nt, Homo sapiens
uagcaugaugcugagugc

SEQ ID NO: 207833 - RNA, 22 nt, Homo sapiens
uaggcagccagcuguggauuga

SEQ ID NO: 207834 - RNA, 22 nt, Homo sapiens
uaggcauuuuucugauaaacua

SEQ ID NO: 207835 - RNA, 22 nt, Homo sapiens
uagggaguguccuuucgggaaa

SEQ ID NO: 207836 - RNA, 22 nt, Homo sapiens
uagguuguccaucucuagaagc

SEQ ID NO: 207837 - RNA, 22 nt, Homo sapiens
uagguugucucuucacucugau

SEQ ID NO: 207838 - RNA, 22 nt, Homo sapiens
uagucccauaugauuuagugaa

SEQ ID NO: 207839 - RNA, 22 nt, Homo sapiens
uauaacacccacauauagucuu

SEQ ID NO: 207840 - RNA, 22 nt, Homo sapiens
uaucacaaacuuagcaguuuaa

SEQ ID NO: 207841 - RNA, 22 nt, Homo sapiens
uaucacagauucuccaggguuu

SEQ ID NO: 207842 - RNA, 22 nt, Homo sapiens
uaucacaguagaacucuuucca

SEQ ID NO: 207843 - RNA, 22 nt, Homo sapiens
uaugaaacucuaagauucacau

SEQ ID NO: 207844 - RNA, 20 nt, Homo sapiens
uaugacaaagccuagugagu

SEQ ID NO: 207845 - RNA, 21 nt, Homo sapiens
uaugguuucuaauucugcagg

SEQ ID NO: 207846 - RNA, 17 nt, Homo sapiens
uauguaguacuuauaaa

SEQ ID NO: 207847 - RNA, 22 nt, Homo sapiens
uaugucaugggguuuuugagau

SEQ ID NO: 207848 - RNA, 22 nt, Homo sapiens
ucaaagacacacaaggagaagg

SEQ ID NO: 207849 - RNA, 22 nt, Homo sapiens
ucacaauucacuacaggcuuga

SEQ ID NO: 207850 - RNA, 19 nt, Homo sapiens
ucacaggguugacuugagg

SEQ ID NO: 207851 - RNA, 18 nt, Homo sapiens
ucacagguaauuaggauu

SEQ ID NO: 207852 - RNA, 22 nt, Homo sapiens
ucacaguagcaaauguuagaaa

SEQ ID NO: 207853 - RNA, 22 nt, Homo sapiens
ucacugagcacaggagaugugc

SEQ ID NO: 207854 - RNA, 22 nt, Homo sapiens
ucacugcgaccuccaccuccug

SEQ ID NO: 207855 - RNA, 22 nt, Homo sapiens
ucacugugugucucuguaucug

SEQ ID NO: 207856 - RNA, 22 nt, Homo sapiens
ucacuuggccgcagccuucucu

SEQ ID NO: 207857 - RNA, 22 nt, Homo sapiens
ucacuuugacggccaacuucua

SEQ ID NO: 207858 - RNA, 21 nt, Homo sapiens
ucagaagcucccagggaggac

SEQ ID NO: 207859 - RNA, 22 nt, Homo sapiens
ucagaucauauucuucgcugcu

SEQ ID NO: 207860 - RNA, 22 nt, Homo sapiens
ucagcaucacaggcagugagug

SEQ ID NO: 207861 - RNA, 22 nt, Homo sapiens
ucaggcaugcagcaaugcagug

SEQ ID NO: 207862 - RNA, 21 nt, Homo sapiens
ucaggcuuuuugagugccaau

SEQ ID NO: 207863 - RNA, 23 nt, Homo sapiens
ucagguaggccuagaguauucuu

SEQ ID NO: 207864 - RNA, 22 nt, Homo sapiens
ucaggucauuccaggagggcca

SEQ ID NO: 207865 - RNA, 22 nt, Homo sapiens
ucaguccccucgcugagucuac

SEQ ID NO: 207866 - RNA, 22 nt, Homo sapiens
ucagugaacgaggaggagggug

SEQ ID NO: 207867 - RNA, 22 nt, Homo sapiens
ucagugcuguuugcccucguuu

SEQ ID NO: 207868 - RNA, 22 nt, Homo sapiens
ucagugucaucuggguuguuug

SEQ ID NO: 207869 - RNA, 22 nt, Homo sapiens
ucagugucugugcaccgcugga

SEQ ID NO: 207870 - RNA, 20 nt, Homo sapiens
ucauagggugguggcagugg

SEQ ID NO: 207871 - RNA, 19 nt, Homo sapiens
ucauagucuaagaugagaa

SEQ ID NO: 207872 - RNA, 22 nt, Homo sapiens
ucaucagaaucccuuagggaug

SEQ ID NO: 207873 - RNA, 22 nt, Homo sapiens
ucauugguugcguaauuugauu

SEQ ID NO: 207874 - RNA, 22 nt, Homo sapiens
uccagguacucagggggcugag

SEQ ID NO: 207875 - RNA, 22 nt, Homo sapiens
ucccaguguguagcuugucucu

SEQ ID NO: 207876 - RNA, 17 nt, Homo sapiens
ucccauguuucuucuac

SEQ ID NO: 207877 - RNA, 22 nt, Homo sapiens
uccccugagaccccucagcacu

SEQ ID NO: 207878 - RNA, 22 nt, Homo sapiens
ucccugacagggucugagcuuu

SEQ ID NO: 207879 - RNA, 22 nt, Homo sapiens
ucccuggacagccuugccuggg

SEQ ID NO: 207880 - RNA, 22 nt, Homo sapiens
ucccuguguccugggggcaccu

SEQ ID NO: 207881 - RNA, 22 nt, Homo sapiens
ucgcugcgaccuccaccucccg

SEQ ID NO: 207882 - RNA, 22 nt, Homo sapiens
ucucagcggacaggccggccag

SEQ ID NO: 207883 - RNA, 22 nt, Homo sapiens
ucucagugacugcugggucccc

SEQ ID NO: 207884 - RNA, 22 nt, Homo sapiens
ucucaguggcuuccucacuuuu

SEQ ID NO: 207885 - RNA, 22 nt, Homo sapiens
ucucugacacugaccccaaaaa

SEQ ID NO: 207886 - RNA, 22 nt, Homo sapiens
ucugaguggcagaaugagcuga

SEQ ID NO: 207887 - RNA, 22 nt, Homo sapiens
ucuggcuuuagcaugugggaag

SEQ ID NO: 207888 - RNA, 22 nt, Homo sapiens
ucuggcuuuuaacaucuauaaa

SEQ ID NO: 207889 - RNA, 22 nt, Homo sapiens
ucugugcugagaguugaaaguu

SEQ ID NO: 207890 - RNA, 22 nt, Homo sapiens
ucuugcuuuugcagagcuucuc

SEQ ID NO: 207891 - RNA, 22 nt, Homo sapiens
ucuuugauaagauccagaagaa

SEQ ID NO: 207892 - RNA, 22 nt, Homo sapiens
ucuuugauguucugaaagaugg

SEQ ID NO: 207893 - RNA, 22 nt, Homo sapiens
ucuuuggguagauauguagcug

SEQ ID NO: 207894 - RNA, 22 nt, Homo sapiens
ucuuugucuacauccuguuaaa

SEQ ID NO: 207895 - RNA, 22 nt, Homo sapiens
ugaaacacacauugcccuuuau

SEQ ID NO: 207896 - RNA, 22 nt, Homo sapiens
ugaaacacaccuccucuccauc

SEQ ID NO: 207897 - RNA, 22 nt, Homo sapiens
ugaaaugaucaguuugguuacu

SEQ ID NO: 207898 - RNA, 22 nt, Homo sapiens
ugaacagcacguuuauucagaa

SEQ ID NO: 207899 - RNA, 22 nt, Homo sapiens
uuccaguguuugacucaccuuu

SEQ ID NO: 207900 - RNA, 22 nt, Homo sapiens
uuccaugagaugcaucaaagcu

SEQ ID NO: 207901 - RNA, 22 nt, Homo sapiens
uucccagagagggacuucuaau

SEQ ID NO: 207902 - RNA, 22 nt, Homo sapiens
uuccugucuuccaagagagauu

SEQ ID NO: 207903 - RNA, 17 nt, Homo sapiens
uucucaguucugaucuc

SEQ ID NO: 207904 - RNA, 22 nt, Homo sapiens
uucugcuugaucuaguguguug

SEQ ID NO: 207905 - RNA, 22 nt, Homo sapiens
uucuggcuuauaaacgugacuu

SEQ ID NO: 207906 - RNA, 22 nt, Homo sapiens
uucuggcuuuuaaagaaauguu

SEQ ID NO: 207907 - RNA, 22 nt, Homo sapiens
uucugugguugaaaggagagau

SEQ ID NO: 207908 - RNA, 22 nt, Homo sapiens
uucuuagguuaaggcugagaga

SEQ ID NO: 207909 - RNA, 22 nt, Homo sapiens
uucuuagucauguaauagucca

SEQ ID NO: 207910 - RNA, 22 nt, Homo sapiens
uugacugggccagacagagauc

SEQ ID NO: 207911 - RNA, 22 nt, Homo sapiens
uugaggaguacugauuagguau

SEQ ID NO: 207912 - RNA, 22 nt, Homo sapiens
uugagggaggcagggcuugucu

SEQ ID NO: 207913 - RNA, 22 nt, Homo sapiens
uugagguguauuguacagcaca

SEQ ID NO: 207914 - RNA, 20 nt, Homo sapiens
uugaggugugaggggcagag

SEQ ID NO: 207915 - RNA, 22 nt, Homo sapiens
uugaguauuggacugguaucuu

SEQ ID NO: 207916 - RNA, 22 nt, Homo sapiens
uugcacaauggaauuuaucuuu

SEQ ID NO: 207917 - RNA, 22 nt, Homo sapiens
uugcacauugcaccuuuuguau

SEQ ID NO: 207918 - RNA, 22 nt, Homo sapiens
uugcacuccagcucgggugaca

SEQ ID NO: 207919 - RNA, 22 nt, Homo sapiens
uugcagugguuucacuggcaaa

SEQ ID NO: 207920 - RNA, 22 nt, Homo sapiens
uugccuaggcuggagugcagua

SEQ ID NO: 207921 - RNA, 22 nt, Homo sapiens
uuggaaauauguuaagugucau

SEQ ID NO: 207922 - RNA, 22 nt, Homo sapiens
uuggauuuugguggcaacucau

SEQ ID NO: 207923 - RNA, 22 nt, Homo sapiens
uuggcauugccaaacugucaac

SEQ ID NO: 207924 - RNA, 22 nt, Homo sapiens
uuggccagugucuuuuuuuccu

SEQ ID NO: 207925 - RNA, 22 nt, Homo sapiens
uugggagugucucuggacugca

SEQ ID NO: 207926 - RNA, 22 nt, Homo sapiens
uuggguaguauagaagcaacaa

SEQ ID NO: 207927 - RNA, 22 nt, Homo sapiens
uugguccucccaugcucaagag

SEQ ID NO: 207928 - RNA, 22 nt, Homo sapiens
uuguauguaaccauuuggcaaa

SEQ ID NO: 207929 - RNA, 22 nt, Homo sapiens
uuguauguuucugugcacauga

SEQ ID NO: 207930 - RNA, 22 nt, Homo sapiens
uugucaccucuaaaucucauau

SEQ ID NO: 207931 - RNA, 19 nt, Homo sapiens
uugucuuagaguugucauu

SEQ ID NO: 207932 - RNA, 22 nt, Homo sapiens
uugugcuccagagacgggcucg

SEQ ID NO: 207933 - RNA, 22 nt, Homo sapiens
uuguguuugaugcugacacgca

SEQ ID NO: 207934 - RNA, 22 nt, Homo sapiens
uuuagguagucaaagguuaguc

SEQ ID NO: 207935 - RNA, 22 nt, Homo sapiens
uuuagguuacauauaauccaaa

SEQ ID NO: 207936 - RNA, 22 nt, Homo sapiens
uuuaugucuguacaucgggcgg

SEQ ID NO: 207937 - RNA, 22 nt, Homo sapiens
uuuauguggagcacuugacaca

SEQ ID NO: 207938 - RNA, 22 nt, Homo sapiens
uuucaucagccagggucagucu

SEQ ID NO: 207939 - RNA, 22 nt, Homo sapiens
uuuccacauggacuuaccuucg

SEQ ID NO: 207940 - RNA, 22 nt, Homo sapiens
uuuccagguggccaacauuuua

SEQ ID NO: 207941 - RNA, 22 nt, Homo sapiens
uuucccuuuagcuuagugauuu

SEQ ID NO: 207942 - RNA, 22 nt, Homo sapiens
uuucccuuugcuuugucagcca

SEQ ID NO: 207943 - RNA, 22 nt, Homo sapiens
uuuccuguagggggcaaggccu

SEQ ID NO: 207944 - RNA, 22 nt, Homo sapiens
uuucucaguguuucaggguagg

SEQ ID NO: 207945 - RNA, 22 nt, Homo sapiens
uuucugcuugagagaauugcug

SEQ ID NO: 207946 - RNA, 21 nt, Homo sapiens
uuucugggggagcauggcagg

SEQ ID NO: 207947 - RNA, 22 nt, Homo sapiens
uuugaaccauuugaagaaugau

SEQ ID NO: 207948 - RNA, 22 nt, Homo sapiens
uuugagugugauaucgauugga

SEQ ID NO: 207949 - RNA, 18 nt, Homo sapiens
uuugccacuucccagaaa

SEQ ID NO: 207950 - RNA, 22 nt, Homo sapiens
uuuggcaugggcuauuugcuuu

SEQ ID NO: 207951 - RNA, 22 nt, Homo sapiens
uuuggcucugugucccacccaa

SEQ ID NO: 207952 - RNA, 22 nt, Homo sapiens
uuugucaauaacuaccaacagg

SEQ ID NO: 207953 - RNA, 22 nt, Homo sapiens
uuugugcuaaugcuagauuacu

SEQ ID NO: 207954 - RNA, 22 nt, Homo sapiens
uuuuacagaggagguugcugau

SEQ ID NO: 207955 - RNA, 17 nt, Homo sapiens
uuuuggauuagaaaucc

SEQ ID NO: 207956 - RNA, 22 nt, Homo sapiens
uuuuggcucugucuguaucuuu

SEQ ID NO: 207957 - RNA, 22 nt, Homo sapiens
uuuuggcuuaaagagaauguau

SEQ ID NO: 207958 - RNA, 22 nt, Homo sapiens
uuuugguguacaauucuaugga

SEQ ID NO: 207959 - RNA, 22 nt, Homo sapiens
uuuuucacuuaaguuaggcuca

SEQ ID NO: 207960 - RNA, 22 nt, Homo sapiens
aaaagcauucagagugcugggc

SEQ ID NO: 207961 - RNA, 22 nt, Homo sapiens
aaaagucuguagugaaagguga

SEQ ID NO: 207962 - RNA, 22 nt, Homo sapiens
aaaaguucuuugagccuugaca

SEQ ID NO: 207963 - RNA, 22 nt, Homo sapiens
aaaccacagugugcugcugggg

SEQ ID NO: 207964 - RNA, 18 nt, Homo sapiens
aaacugcuuccuuggccu

SEQ ID NO: 207965 - RNA, 22 nt, Homo sapiens
aaacugucuggaugcuugugga

SEQ ID NO: 207966 - RNA, 22 nt, Homo sapiens
aaacuugucuaauuauaagcau

SEQ ID NO: 207967 - RNA, 22 nt, Homo sapiens
aaagagcugagaccugguggag

SEQ ID NO: 207968 - RNA, 22 nt, Homo sapiens
aaagcacuggagucaucaucua

SEQ ID NO: 207969 - RNA, 22 nt, Homo sapiens
aaagcaucacuuuuccuacuuu

SEQ ID NO: 207970 - RNA, 22 nt, Homo sapiens
aaagcuacaggaccugcucauu

SEQ ID NO: 207971 - RNA, 22 nt, Homo sapiens
aaagcuaccagauucuguugga

SEQ ID NO: 207972 - RNA, 22 nt, Homo sapiens
aaaggauucuaauggaaaugcu

SEQ ID NO: 207973 - RNA, 22 nt, Homo sapiens
aaaggcacuagaaguuaccuuu

SEQ ID NO: 207974 - RNA, 22 nt, Homo sapiens
aaaggcuucggaucagaaggua

SEQ ID NO: 207975 - RNA, 22 nt, Homo sapiens
aaagguaguacuucuagaaggg

SEQ ID NO: 207976 - RNA, 22 nt, Homo sapiens
aaaguaauugcaguuuuugcaa

SEQ ID NO: 207977 - RNA, 19 nt, Homo sapiens
aaaguacucugaugccucu

SEQ ID NO: 207978 - RNA, 20 nt, Homo sapiens
aaaguaggcuaauaccaaaa

SEQ ID NO: 207979 - RNA, 22 nt, Homo sapiens
aaaguaguagcaguuucugcca

SEQ ID NO: 207980 - RNA, 17 nt, Homo sapiens
aaaguccuuugcuaucu

SEQ ID NO: 207981 - RNA, 18 nt, Homo sapiens
aaagugaugucauucuuu

SEQ ID NO: 207982 - RNA, 22 nt, Homo sapiens
aaagugauguccaggcuuucag

SEQ ID NO: 207983 - RNA, 22 nt, Homo sapiens
aaagugcuguagacugggcgca

SEQ ID NO: 207984 - RNA, 22 nt, Homo sapiens
aaagugcuucucuuuggugggu

SEQ ID NO: 207985 - RNA, 19 nt, Homo sapiens
aaaguguuuuaaagaggau

SEQ ID NO: 207986 - RNA, 22 nt, Homo sapiens
aaaguucuugcugaaggauuau

SEQ ID NO: 207987 - RNA, 22 nt, Homo sapiens
aaaugcacaaagauuuugcacu

SEQ ID NO: 207988 - RNA, 22 nt, Homo sapiens
aaaugcacgcuacccagcuaga

SEQ ID NO: 207989 - RNA, 22 nt, Homo sapiens
aaaugcagcacucaagugggaa

SEQ ID NO: 207990 - RNA, 22 nt, Homo sapiens
aaaugcagucuuuguucugggc

SEQ ID NO: 207991 - RNA, 22 nt, Homo sapiens
aaaugcauaucaagauugcccu

SEQ ID NO: 207992 - RNA, 22 nt, Homo sapiens
aaaugcccuaaaauggagcauc

SEQ ID NO: 207993 - RNA, 22 nt, Homo sapiens
aaaugcucuguggguaguaaug

SEQ ID NO: 207994 - RNA, 22 nt, Homo sapiens
aaaugcugcuuuggccucuucu

SEQ ID NO: 207995 - RNA, 22 nt, Homo sapiens
aaaugcuucuauguggcauguu

SEQ ID NO: 207996 - RNA, 22 nt, Homo sapiens
uauggauuuuuuugacaagagc

SEQ ID NO: 207997 - RNA, 22 nt, Homo sapiens
uauggcaaugcauaggaaggaa

SEQ ID NO: 207998 - RNA, 22 nt, Homo sapiens
uauggccacugucuuugaguca

SEQ ID NO: 207999 - RNA, 22 nt, Homo sapiens
uauggcuacuacgaauaaugcu

SEQ ID NO: 208000 - RNA, 22 nt, Homo sapiens
uauggcuucuuauucuuucccg

SEQ ID NO: 208001 - RNA, 22 nt, Homo sapiens
uauggcuucuuuaaauugaggu

SEQ ID NO: 208002 - RNA, 22 nt, Homo sapiens
uauggcuuuuaacugucguaug

SEQ ID NO: 208003 - RNA, 22 nt, Homo sapiens
uauggcuuuuauuauguuguag

SEQ ID NO: 208004 - RNA, 19 nt, Homo sapiens
uaugggauuuuuagggugu

SEQ ID NO: 208005 - RNA, 22 nt, Homo sapiens
uaugucuauuauguagcaggaa

SEQ ID NO: 208006 - RNA, 22 nt, Homo sapiens
uaugucuucuuuagagaaaugu

SEQ ID NO: 208007 - RNA, 22 nt, Homo sapiens
uaugugcacaugcccuggugac

SEQ ID NO: 208008 - RNA, 22 nt, Homo sapiens
uaugugcuuuguuaaacagaug

SEQ ID NO: 208009 - RNA, 22 nt, Homo sapiens
uauuaagcuaguugucagugcu

SEQ ID NO: 208010 - RNA, 22 nt, Homo sapiens
uauuagguuggugcaacaguaa

SEQ ID NO: 208011 - RNA, 22 nt, Homo sapiens
uauuaguuguaugauucccaag

SEQ ID NO: 208012 - RNA, 22 nt, Homo sapiens
uauuaugcacuuuauaaaaauu

SEQ ID NO: 208013 - RNA, 22 nt, Homo sapiens
uauuauuguccuucuauaccca

SEQ ID NO: 208014 - RNA, 22 nt, Homo sapiens
uauuccacaauaugauuuuuaa

SEQ ID NO: 208015 - RNA, 22 nt, Homo sapiens
uauuccacuggcacugcauuug

SEQ ID NO: 208016 - RNA, 22 nt, Homo sapiens
uauugacauuacagugggucuu

SEQ ID NO: 208017 - RNA, 22 nt, Homo sapiens
uauugacuugagaagggauuag

SEQ ID NO: 208018 - RNA, 22 nt, Homo sapiens
uauugacuugaugagggagggu

SEQ ID NO: 208019 - RNA, 22 nt, Homo sapiens
uauugauuuucaguguucagcu

SEQ ID NO: 208020 - RNA, 22 nt, Homo sapiens
uauugcaaauggugaucccagg

SEQ ID NO: 208021 - RNA, 22 nt, Homo sapiens
uauugcacuccucaugcauuug

SEQ ID NO: 208022 - RNA, 22 nt, Homo sapiens
uauugcagaaugugaguuggca

SEQ ID NO: 208023 - RNA, 22 nt, Homo sapiens
uauugcucaugcauuuaauuuc

SEQ ID NO: 208024 - RNA, 22 nt, Homo sapiens
uauuguccaauaggauguuccu

SEQ ID NO: 208025 - RNA, 22 nt, Homo sapiens
uauuguuaaagauguuaaugau

SEQ ID NO: 208026 - RNA, 22 nt, Homo sapiens
uauuucccuuaacuuuccugca

SEQ ID NO: 208027 - RNA, 22 nt, Homo sapiens
uauuugauugacuuuagcagga

SEQ ID NO: 208028 - RNA, 22 nt, Homo sapiens
ucaaaaucucuuagcugugucu

SEQ ID NO: 208029 - RNA, 22 nt, Homo sapiens
ucaaacugcuugaggccauuua

SEQ ID NO: 208030 - RNA, 22 nt, Homo sapiens
ucaaacugucagguugaccaga

SEQ ID NO: 208031 - RNA, 20 nt, Homo sapiens
ucaaaguaugcucugcacua

SEQ ID NO: 208032 - RNA, 22 nt, Homo sapiens
ucaaaucaucuuuuccaaagcu

SEQ ID NO: 208033 - RNA, 22 nt, Homo sapiens
ucaaaugauucacccaccuuug

SEQ ID NO: 208034 - RNA, 22 nt, Homo sapiens
ucaacguauuuauauagcagag

SEQ ID NO: 208035 - RNA, 22 nt, Homo sapiens
ucaagcaauucugcugccucag

SEQ ID NO: 208036 - RNA, 18 nt, Homo sapiens
ucaagcaauugucaugcc

SEQ ID NO: 208037 - RNA, 21 nt, Homo sapiens
ucaaggaguauacguaugcca

SEQ ID NO: 208038 - RNA, 20 nt, Homo sapiens
ucaaggcaggaacuguacau

SEQ ID NO: 208039 - RNA, 22 nt, Homo sapiens
ucaaguacuuauuugauaauua

SEQ ID NO: 208040 - RNA, 22 nt, Homo sapiens
ucaaugaaugaugguugguaug

SEQ ID NO: 208041 - RNA, 22 nt, Homo sapiens
ucaaugcaaccuccaccucugg

SEQ ID NO: 208042 - RNA, 18 nt, Homo sapiens
ucaauguggauguucuuu

SEQ ID NO: 208043 - RNA, 22 nt, Homo sapiens
ucaauugcaucaacaguguaca

SEQ ID NO: 208044 - RNA, 22 nt, Homo sapiens
ucacaagugagaggaauuagau

SEQ ID NO: 208045 - RNA, 22 nt, Homo sapiens
ucacaauggcugaacuaauuua

SEQ ID NO: 208046 - RNA, 22 nt, Homo sapiens
ucacaccauucuucuacuucag

SEQ ID NO: 208047 - RNA, 22 nt, Homo sapiens
ucacacgugaacucaucacaga

SEQ ID NO: 208048 - RNA, 22 nt, Homo sapiens
ucacacugaauuugaagcaaug

SEQ ID NO: 208049 - RNA, 22 nt, Homo sapiens
ucacacugucuugguuacucuu

SEQ ID NO: 208050 - RNA, 19 nt, Homo sapiens
ucacacuguggcuucuuua

SEQ ID NO: 208051 - RNA, 23 nt, Homo sapiens
ucacacuuaagagaaaugcagcu

SEQ ID NO: 208052 - RNA, 22 nt, Homo sapiens
ucacagacugagccaaauagag

SEQ ID NO: 208053 - RNA, 22 nt, Homo sapiens
ucacagaugcuugacccauuuc

SEQ ID NO: 208054 - RNA, 19 nt, Homo sapiens
ucacaggguugacuugagg

SEQ ID NO: 208055 - RNA, 20 nt, Homo sapiens
ucacagucacacauaauccu

SEQ ID NO: 208056 - RNA, 22 nt, Homo sapiens
ucacagucggugacuucuugcu

SEQ ID NO: 208057 - RNA, 22 nt, Homo sapiens
ucacagugcaggaucaguuaau

SEQ ID NO: 208058 - RNA, 22 nt, Homo sapiens
ucacaguucagcauggcugagg

SEQ ID NO: 208059 - RNA, 22 nt, Homo sapiens
ucacaguugauugaaacacagc

SEQ ID NO: 208060 - RNA, 22 nt, Homo sapiens
ucacaguuggccuggccuuuua

SEQ ID NO: 208061 - RNA, 22 nt, Homo sapiens
ucacaugaauugucuuguucca

SEQ ID NO: 208062 - RNA, 22 nt, Homo sapiens
ucacauggaggugauaguugaa

SEQ ID NO: 208063 - RNA, 22 nt, Homo sapiens
ucacauggcagagaagaagcuc

SEQ ID NO: 208064 - RNA, 22 nt, Homo sapiens
ucacaugugaagauugggagua

SEQ ID NO: 208065 - RNA, 22 nt, Homo sapiens
ucacaugugcguuuuggcaugu

SEQ ID NO: 208066 - RNA, 22 nt, Homo sapiens
ucacauuaagcuguuauuucuu

SEQ ID NO: 208067 - RNA, 22 nt, Homo sapiens
ucacauuguuauguaaauguuu

SEQ ID NO: 208068 - RNA, 22 nt, Homo sapiens
ucaccagugucagggaacugcu

SEQ ID NO: 208069 - RNA, 16 nt, Homo sapiens
ucaccccuagagaucc

SEQ ID NO: 208070 - RNA, 21 nt, Homo sapiens
ucaccuguugcgaugaagcug

SEQ ID NO: 208071 - RNA, 19 nt, Homo sapiens
ucaccuugcccugcacaca

SEQ ID NO: 208072 - RNA, 22 nt, Homo sapiens
ucacgugguucauaaggcagaa

SEQ ID NO: 208073 - RNA, 22 nt, Homo sapiens
ucacuaggcuggagugcagugg

SEQ ID NO: 208074 - RNA, 22 nt, Homo sapiens
ucacuauugacaacagugugga

SEQ ID NO: 208075 - RNA, 22 nt, Homo sapiens
ucacucggugaugauucuuaaa

SEQ ID NO: 208076 - RNA, 22 nt, Homo sapiens
ucacugaaaccuccgccuucug

SEQ ID NO: 208077 - RNA, 22 nt, Homo sapiens
ucacugagaaugauguuucuga

SEQ ID NO: 208078 - RNA, 22 nt, Homo sapiens
ucacugagcuagaucacuugac

SEQ ID NO: 208079 - RNA, 22 nt, Homo sapiens
ucacugcacuagguaaugccac

SEQ ID NO: 208080 - RNA, 22 nt, Homo sapiens
ucacugcacucuccgccuugcg

SEQ ID NO: 208081 - RNA, 22 nt, Homo sapiens
ucacuggagauagcaaucuggu

SEQ ID NO: 208082 - RNA, 20 nt, Homo sapiens
ucacuggagcucauuugauu

SEQ ID NO: 208083 - RNA, 22 nt, Homo sapiens
ucacuggaggagaggaagugga

SEQ ID NO: 208084 - RNA, 22 nt, Homo sapiens
ucacuggagguuccugaaguuc

SEQ ID NO: 208085 - RNA, 22 nt, Homo sapiens
ucacuggccaaauucuggguga

SEQ ID NO: 208086 - RNA, 22 nt, Homo sapiens
ucacugggagcauuugagccuu

SEQ ID NO: 208087 - RNA, 22 nt, Homo sapiens
ucacugugagaguuuauccugu

SEQ ID NO: 208088 - RNA, 22 nt, Homo sapiens
ucacugugcacauaugauaggu

SEQ ID NO: 208089 - RNA, 22 nt, Homo sapiens
ucacugugugucucuguaucug

SEQ ID NO: 208090 - RNA, 18 nt, Homo sapiens
ucacugugugucuugggu

SEQ ID NO: 208091 - RNA, 22 nt, Homo sapiens
ucacuuugacggccaacuucua

SEQ ID NO: 208092 - RNA, 22 nt, Homo sapiens
ucagaacugauacuagaacuuu

SEQ ID NO: 208093 - RNA, 22 nt, Homo sapiens
ucagaccauuucauuacagacu

SEQ ID NO: 208094 - RNA, 22 nt, Homo sapiens
ucagaguagaaacacuuccaua

SEQ ID NO: 208095 - RNA, 22 nt, Homo sapiens
ucagaucaugcuuaugauggga

SEQ ID NO: 208096 - RNA, 22 nt, Homo sapiens
ucagauguuuuguuuaucugcu

SEQ ID NO: 208097 - RNA, 22 nt, Homo sapiens
ucagauugaugcauacuuaaau

SEQ ID NO: 208098 - RNA, 22 nt, Homo sapiens
ucucccuaccugagccgagcca

SEQ ID NO: 208099 - RNA, 22 nt, Homo sapiens
ucucugagaaaaguuucuccca

SEQ ID NO: 208100 - RNA, 22 nt, Homo sapiens
ucucugagaccacuccaaacuc

SEQ ID NO: 208101 - RNA, 22 nt, Homo sapiens
ucucuguuuagagccagcaauu

SEQ ID NO: 208102 - RNA, 22 nt, Homo sapiens
ucucuguuugucuguuacuggu

SEQ ID NO: 208103 - RNA, 22 nt, Homo sapiens
ucucuuggcggaaguugcagug

SEQ ID NO: 208104 - RNA, 22 nt, Homo sapiens
ucucuuggugacuuaaaauguu

SEQ ID NO: 208105 - RNA, 22 nt, Homo sapiens
ucugacaaugaacaaucuauag

SEQ ID NO: 208106 - RNA, 22 nt, Homo sapiens
ucugacacuucugcagaauuga

SEQ ID NO: 208107 - RNA, 22 nt, Homo sapiens
ucugacagugagagaaaucuga

SEQ ID NO: 208108 - RNA, 22 nt, Homo sapiens
ucugagcaauagauguggauau

SEQ ID NO: 208109 - RNA, 21 nt, Homo sapiens
ucugagucauucaguggccug

SEQ ID NO: 208110 - RNA, 22 nt, Homo sapiens
ucugccuacugguuggaggaac

SEQ ID NO: 208111 - RNA, 23 nt, Homo sapiens
ucuggaucauucguagugccagc

SEQ ID NO: 208112 - RNA, 21 nt, Homo sapiens
ucuggcccccucaaaucucau

SEQ ID NO: 208113 - RNA, 22 nt, Homo sapiens
ucuggcuccacacuuuauuaac

SEQ ID NO: 208114 - RNA, 17 nt, Homo sapiens
ucuggcuuucacaccug

SEQ ID NO: 208115 - RNA, 22 nt, Homo sapiens
ucuggcuuucuuuacuuaaugu

SEQ ID NO: 208116 - RNA, 22 nt, Homo sapiens
ucuggcuuugugaguugccaga

SEQ ID NO: 208117 - RNA, 22 nt, Homo sapiens
ucugggguuagucaaagguaug

SEQ ID NO: 208118 - RNA, 22 nt, Homo sapiens
ucugggguuuccacuuuuacuu

SEQ ID NO: 208119 - RNA, 20 nt, Homo sapiens
ucuggguuuuggccacgccc

SEQ ID NO: 208120 - RNA, 22 nt, Homo sapiens
ucuggucccugcacauauuuuc

SEQ ID NO: 208121 - RNA, 22 nt, Homo sapiens
ucugguggugaugagagacagu

SEQ ID NO: 208122 - RNA, 22 nt, Homo sapiens
ucuggugugcucuggacuugca

SEQ ID NO: 208123 - RNA, 22 nt, Homo sapiens
ucugguguuauucauguaguuu

SEQ ID NO: 208124 - RNA, 22 nt, Homo sapiens
ucuguacugccaaguuucuuua

SEQ ID NO: 208125 - RNA, 22 nt, Homo sapiens
ucugucaaaucuuauguuguag

SEQ ID NO: 208126 - RNA, 22 nt, Homo sapiens
ucugucuuugccuaaguuuguc

SEQ ID NO: 208127 - RNA, 22 nt, Homo sapiens
ucuguggucagaguccuuggcc

SEQ ID NO: 208128 - RNA, 22 nt, Homo sapiens
ucugugguucaggcuggagugc

SEQ ID NO: 208129 - RNA, 22 nt, Homo sapiens
ucuguguugaugcucauuaauu

SEQ ID NO: 208130 - RNA, 22 nt, Homo sapiens
ucuuaguuggaaugggauaagg

SEQ ID NO: 208131 - RNA, 22 nt, Homo sapiens
ucuuaguuuagauuagcaauuc

SEQ ID NO: 208132 - RNA, 22 nt, Homo sapiens
ucuuaguuugggguggggauag

SEQ ID NO: 208133 - RNA, 22 nt, Homo sapiens
ucuucagucauauuggccugga

SEQ ID NO: 208134 - RNA, 22 nt, Homo sapiens
ucuucuagcggaacccucuugu

SEQ ID NO: 208135 - RNA, 22 nt, Homo sapiens
ucuugcaccuacaugcuuuguc

SEQ ID NO: 208136 - RNA, 22 nt, Homo sapiens
ucuugcuuguuguucccuucau

SEQ ID NO: 208137 - RNA, 22 nt, Homo sapiens
ucuugggugaguuugugaauaa

SEQ ID NO: 208138 - RNA, 22 nt, Homo sapiens
ucuuggguuguuggcuucuccu

SEQ ID NO: 208139 - RNA, 22 nt, Homo sapiens
ucuugguaaugucacauuuccu

SEQ ID NO: 208140 - RNA, 21 nt, Homo sapiens
ucuugguauguauuuaggagg

SEQ ID NO: 208141 - RNA, 22 nt, Homo sapiens
ucuugucacugcauccccagcu

SEQ ID NO: 208142 - RNA, 22 nt, Homo sapiens
ucuuugagugcccugagucccu

SEQ ID NO: 208143 - RNA, 22 nt, Homo sapiens
ucuuugaguguauacuuagauu

SEQ ID NO: 208144 - RNA, 22 nt, Homo sapiens
ucuuugauaagauccagaagaa

SEQ ID NO: 208145 - RNA, 22 nt, Homo sapiens
ucuuuggcugugaagaauaaug

SEQ ID NO: 208146 - RNA, 22 nt, Homo sapiens
ucuuuggguagauauguagcug

SEQ ID NO: 208147 - RNA, 22 nt, Homo sapiens
ucuuugguaauggaugucugau

SEQ ID NO: 208148 - RNA, 22 nt, Homo sapiens
ucuuugguaugugcaugugcuu

SEQ ID NO: 208149 - RNA, 22 nt, Homo sapiens
ucuuuggucagaaagauuacac

SEQ ID NO: 208150 - RNA, 22 nt, Homo sapiens
ucuuuggucaucaugggaagca

SEQ ID NO: 208151 - RNA, 22 nt, Homo sapiens
ucuuugguuguuuagggugcau

SEQ ID NO: 208152 - RNA, 22 nt, Homo sapiens
ucuuugucuacauccuguuaaa

SEQ ID NO: 208153 - RNA, 22 nt, Homo sapiens
ucuuuguguaggucaaucuggc

SEQ ID NO: 208154 - RNA, 22 nt, Homo sapiens
ucuuuguuagaacccucuccuu

SEQ ID NO: 208155 - RNA, 22 nt, Homo sapiens
ucuuuguucaggagccaacucc

SEQ ID NO: 208156 - RNA, 22 nt, Homo sapiens
ucuuuguugcauaggcuuguuc

SEQ ID NO: 208157 - RNA, 22 nt, Homo sapiens
ucuuuugugagucagccucucc

SEQ ID NO: 208158 - RNA, 22 nt, Homo sapiens
ucuuuuguucuauucaggccuu

SEQ ID NO: 208159 - RNA, 22 nt, Homo sapiens
ugaaaagucuaagauuaagguu

SEQ ID NO: 208160 - RNA, 18 nt, Homo sapiens
ugaaacacauuuuuuccu

SEQ ID NO: 208161 - RNA, 22 nt, Homo sapiens
ugaaagguuuaauucugugaga

SEQ ID NO: 208162 - RNA, 22 nt, Homo sapiens
ugaaaguuauauugugaaauuc

SEQ ID NO: 208163 - RNA, 22 nt, Homo sapiens
ugaaauacuuaauuucuccaug

SEQ ID NO: 208164 - RNA, 20 nt, Homo sapiens
ugaaaucuucacuaagucuc

SEQ ID NO: 208165 - RNA, 22 nt, Homo sapiens
ugaaaugcagaacuuuaggucu

SEQ ID NO: 208166 - RNA, 22 nt, Homo sapiens
ugaaaugcuaauucguagcuaa

SEQ ID NO: 208167 - RNA, 22 nt, Homo sapiens
ugaaauguuaaacaaguggcuc

SEQ ID NO: 208168 - RNA, 22 nt, Homo sapiens
ugaaauuguuugcaaggauagg

SEQ ID NO: 208169 - RNA, 22 nt, Homo sapiens
ugaacagcacguuuauucagaa

SEQ ID NO: 208170 - RNA, 22 nt, Homo sapiens
ugaacucagcauccagggccaa

SEQ ID NO: 208171 - RNA, 22 nt, Homo sapiens
ugaacugagacuagacuuguuc

SEQ ID NO: 208172 - RNA, 20 nt, Homo sapiens
ugaacugguuacuuucuguc

SEQ ID NO: 208173 - RNA, 22 nt, Homo sapiens
ugaacuguaagguauaggugau

SEQ ID NO: 208174 - RNA, 22 nt, Homo sapiens
ugaagacauuuuugggugugua

SEQ ID NO: 208175 - RNA, 22 nt, Homo sapiens
ugaaggaguauggauaagucgu

SEQ ID NO: 208176 - RNA, 22 nt, Homo sapiens
ugaaguaauguuuuauucuauu

SEQ ID NO: 208177 - RNA, 22 nt, Homo sapiens
ugaaguaggcauaaguuaagcu

SEQ ID NO: 208178 - RNA, 22 nt, Homo sapiens
ugaagugcugugggccaggcgu

SEQ ID NO: 208179 - RNA, 22 nt, Homo sapiens
ugaauagacacuaaagacugua

SEQ ID NO: 208180 - RNA, 21 nt, Homo sapiens
ugaauauuuggguugugucca

SEQ ID NO: 208181 - RNA, 22 nt, Homo sapiens
ugaaucauuucuugucuucagu

SEQ ID NO: 208182 - RNA, 19 nt, Homo sapiens
ugaaugacaucuaaagucc

SEQ ID NO: 208183 - RNA, 22 nt, Homo sapiens
ugaaugcauggggccaagaagg

SEQ ID NO: 208184 - RNA, 22 nt, Homo sapiens
ugaaugcuucaugucugggcug

SEQ ID NO: 208185 - RNA, 22 nt, Homo sapiens
ugaauggauccaauucuuagua

SEQ ID NO: 208186 - RNA, 22 nt, Homo sapiens
ugaaugguuuuuagagaacaau

SEQ ID NO: 208187 - RNA, 20 nt, Homo sapiens
ugaauguaauuacagaugua

SEQ ID NO: 208188 - RNA, 22 nt, Homo sapiens
ugaauguacacgcguacuuguu

SEQ ID NO: 208189 - RNA, 22 nt, Homo sapiens
ugaauguccugacgcugcaguu

SEQ ID NO: 208190 - RNA, 22 nt, Homo sapiens
ugaauguuguugguugagauau

SEQ ID NO: 208191 - RNA, 22 nt, Homo sapiens
ugaauugucucucacuggguuc

SEQ ID NO: 208192 - RNA, 23 nt, Homo sapiens
ugacaagagcgagacuuggucuc

SEQ ID NO: 208193 - RNA, 22 nt, Homo sapiens
ugacaagggaaaugcaaaaugu

SEQ ID NO: 208194 - RNA, 21 nt, Homo sapiens
ugacagaaaauugaguuugcu

SEQ ID NO: 208195 - RNA, 22 nt, Homo sapiens
ugacagagcaggacuucaucuc

SEQ ID NO: 208196 - RNA, 18 nt, Homo sapiens
ugacagcacaugugggga

SEQ ID NO: 208197 - RNA, 22 nt, Homo sapiens
ugacagcaucaggauuggagag

SEQ ID NO: 208198 - RNA, 22 nt, Homo sapiens
ugacaggucuaauuuacugaca

SEQ ID NO: 208199 - RNA, 22 nt, Homo sapiens
ugacaguaucuacagcuucuua

SEQ ID NO: 208200 - RNA, 22 nt, Homo sapiens
ugaguagaacuagucuagagcu

SEQ ID NO: 208201 - RNA, 22 nt, Homo sapiens
ugaguagaacuccuggagaugu

SEQ ID NO: 208202 - RNA, 20 nt, Homo sapiens
ugaguagaggaguucuauca

SEQ ID NO: 208203 - RNA, 23 nt, Homo sapiens
ugaguagguccacguaugugagu

SEQ ID NO: 208204 - RNA, 22 nt, Homo sapiens
ugaguagugcugcaauaaacau

SEQ ID NO: 208205 - RNA, 19 nt, Homo sapiens
ugaguaucuuuacacaucu

SEQ ID NO: 208206 - RNA, 22 nt, Homo sapiens
ugagucaauucuaacaauggca

SEQ ID NO: 208207 - RNA, 22 nt, Homo sapiens
ugagucagucucacucugcugc

SEQ ID NO: 208208 - RNA, 22 nt, Homo sapiens
ugagucauguaauaaugcugcu

SEQ ID NO: 208209 - RNA, 22 nt, Homo sapiens
ugagucuguuccaaagaaauaa

SEQ ID NO: 208210 - RNA, 22 nt, Homo sapiens
ugagugaacgcugagaccaaau

SEQ ID NO: 208211 - RNA, 22 nt, Homo sapiens
ugagugaaggggcucuguugug

SEQ ID NO: 208212 - RNA, 22 nt, Homo sapiens
ugaguuaaucucuacgauagaa

SEQ ID NO: 208213 - RNA, 22 nt, Homo sapiens
ugaguucaauguuaaugaagca

SEQ ID NO: 208214 - RNA, 22 nt, Homo sapiens
ugaguucaauuguauuuuauua

SEQ ID NO: 208215 - RNA, 23 nt, Homo sapiens
ugauaacagcauaugaagauucu

SEQ ID NO: 208216 - RNA, 22 nt, Homo sapiens
ugauaagugaaagugcucuauc

SEQ ID NO: 208217 - RNA, 22 nt, Homo sapiens
ugauaggagauuuucaucugua

SEQ ID NO: 208218 - RNA, 22 nt, Homo sapiens
ugauaguguccugugccacauu

SEQ ID NO: 208219 - RNA, 22 nt, Homo sapiens
ugauaucugaauagauacacaa

SEQ ID NO: 208220 - RNA, 21 nt, Homo sapiens
ugauaugguuuggauaugugu

SEQ ID NO: 208221 - RNA, 22 nt, Homo sapiens
ugauauguguaaacaauguaua

SEQ ID NO: 208222 - RNA, 22 nt, Homo sapiens
ugauccagugcucaguuggagu

SEQ ID NO: 208223 - RNA, 22 nt, Homo sapiens
ugaucuguccaccucagcuucc

SEQ ID NO: 208224 - RNA, 22 nt, Homo sapiens
ugaugacacugauuucuucaau

SEQ ID NO: 208225 - RNA, 20 nt, Homo sapiens
ugaugcaaaucuuuaaaagu

SEQ ID NO: 208226 - RNA, 22 nt, Homo sapiens
ugaugcuacuaccugggcugaa

SEQ ID NO: 208227 - RNA, 22 nt, Homo sapiens
ugauggcacagugaguuccagg

SEQ ID NO: 208228 - RNA, 22 nt, Homo sapiens
ugaugguccauaguucauggua

SEQ ID NO: 208229 - RNA, 22 nt, Homo sapiens
ugaugguuuuaaaaagaggagu

SEQ ID NO: 208230 - RNA, 22 nt, Homo sapiens
ugaugguuuuauuaauaggacc

SEQ ID NO: 208231 - RNA, 20 nt, Homo sapiens
ugauuaguccacuuggcucu

SEQ ID NO: 208232 - RNA, 22 nt, Homo sapiens
ugauuuccaugagaacaugccu

SEQ ID NO: 208233 - RNA, 22 nt, Homo sapiens
ugcaaagaaauuuuggugacca

SEQ ID NO: 208234 - RNA, 19 nt, Homo sapiens
ugcaaagucagugaagggu

SEQ ID NO: 208235 - RNA, 22 nt, Homo sapiens
ugcaaauguuaguaacaccacu

SEQ ID NO: 208236 - RNA, 22 nt, Homo sapiens
ugcaaauuauugggccccaacu

SEQ ID NO: 208237 - RNA, 22 nt, Homo sapiens
ugcaacacauugccccugcucu

SEQ ID NO: 208238 - RNA, 22 nt, Homo sapiens
ugcaaccauuguuaagugugca

SEQ ID NO: 208239 - RNA, 22 nt, Homo sapiens
ugcaagaaucagccuaucauua

SEQ ID NO: 208240 - RNA, 22 nt, Homo sapiens
ugcaagaaucuuucaggcuagc

SEQ ID NO: 208241 - RNA, 22 nt, Homo sapiens
ugcaagcacacccagggauugu

SEQ ID NO: 208242 - RNA, 22 nt, Homo sapiens
ugcaaucaucgcuguuggccac

SEQ ID NO: 208243 - RNA, 18 nt, Homo sapiens
ugcaauggagaugcagcc

SEQ ID NO: 208244 - RNA, 22 nt, Homo sapiens
ugcaaugugaaauaagcacauc

SEQ ID NO: 208245 - RNA, 22 nt, Homo sapiens
ugcaccacugcaccccagucug

SEQ ID NO: 208246 - RNA, 22 nt, Homo sapiens
ugcaccacugcacuccagcuug

SEQ ID NO: 208247 - RNA, 18 nt, Homo sapiens
ugcaccaguuuacacuuc

SEQ ID NO: 208248 - RNA, 22 nt, Homo sapiens
ugcaccauggcacuccaggcug

SEQ ID NO: 208249 - RNA, 22 nt, Homo sapiens
ugcaccauuacacuccaggcug

SEQ ID NO: 208250 - RNA, 22 nt, Homo sapiens
ugcaccauugcauacuuaauua

SEQ ID NO: 208251 - RNA, 22 nt, Homo sapiens
ugcaccauugucaccuggguga

SEQ ID NO: 208252 - RNA, 22 nt, Homo sapiens
ugcagagucuguccugccugcc

SEQ ID NO: 208253 - RNA, 20 nt, Homo sapiens
ugcagauucaaccaacugug

SEQ ID NO: 208254 - RNA, 19 nt, Homo sapiens
ugcagcaauguaaaagaca

SEQ ID NO: 208255 - RNA, 17 nt, Homo sapiens
ugcagcacacugauggg

SEQ ID NO: 208256 - RNA, 23 nt, Homo sapiens
ugcagcacacugaugggucuuga

SEQ ID NO: 208257 - RNA, 22 nt, Homo sapiens
ugcagcacaguagguuugcaau

SEQ ID NO: 208258 - RNA, 20 nt, Homo sapiens
ugcagcacugggaaugcagu

SEQ ID NO: 208259 - RNA, 22 nt, Homo sapiens
ugcagcacuguucacaauagcc

SEQ ID NO: 208260 - RNA, 22 nt, Homo sapiens
ugcagcauguaggcacguuauu

SEQ ID NO: 208261 - RNA, 22 nt, Homo sapiens
ugcagcauugcacuccagccug

SEQ ID NO: 208262 - RNA, 23 nt, Homo sapiens
ugcagcuacauguggccaugugc

SEQ ID NO: 208263 - RNA, 22 nt, Homo sapiens
ugcagcucaaauuccuaacaag

SEQ ID NO: 208264 - RNA, 22 nt, Homo sapiens
ugcaguacuuugaaauauacug

SEQ ID NO: 208265 - RNA, 22 nt, Homo sapiens
ugcaguagugugaucuuggcuc

SEQ ID NO: 208266 - RNA, 20 nt, Homo sapiens
ugcaguguccucacuuguca

SEQ ID NO: 208267 - RNA, 21 nt, Homo sapiens
ugcagugugguugcccugcug

SEQ ID NO: 208268 - RNA, 21 nt, Homo sapiens
ugcauacuucucagaugauua

SEQ ID NO: 208269 - RNA, 22 nt, Homo sapiens
ugcauagcaaaauaggauuaga

SEQ ID NO: 208270 - RNA, 22 nt, Homo sapiens
ugcauaggagcagggucuaugu

SEQ ID NO: 208271 - RNA, 22 nt, Homo sapiens
ugcauaggcuaaaauccuggcc

SEQ ID NO: 208272 - RNA, 17 nt, Homo sapiens
ugcauagugggaggaga

SEQ ID NO: 208273 - RNA, 22 nt, Homo sapiens
ugcauaucuucuuuugagaaau

SEQ ID NO: 208274 - RNA, 22 nt, Homo sapiens
ugcauaugucuuuauagcagca

SEQ ID NO: 208275 - RNA, 18 nt, Homo sapiens
ugcauauguugaaccagc

SEQ ID NO: 208276 - RNA, 22 nt, Homo sapiens
ugcauauguugaaccaggcuug

SEQ ID NO: 208277 - RNA, 22 nt, Homo sapiens
ugcauauucaaggcaggccauu

SEQ ID NO: 208278 - RNA, 22 nt, Homo sapiens
ugcauauucgaguuauuuuggg

SEQ ID NO: 208279 - RNA, 22 nt, Homo sapiens
ugcauguucuuacucauacaug

SEQ ID NO: 208280 - RNA, 22 nt, Homo sapiens
ugcauuaguaaguaauuuuaau

SEQ ID NO: 208281 - RNA, 22 nt, Homo sapiens
ugcauuguuccgaauguguccu

SEQ ID NO: 208282 - RNA, 19 nt, Homo sapiens
ugccaagaaagucagcuua

SEQ ID NO: 208283 - RNA, 22 nt, Homo sapiens
ugccagaugugcccucuccacc

SEQ ID NO: 208284 - RNA, 22 nt, Homo sapiens
ugccaggaugaggucaauguuu

SEQ ID NO: 208285 - RNA, 22 nt, Homo sapiens
ugccaguauuuuauugaagauu

SEQ ID NO: 208286 - RNA, 22 nt, Homo sapiens
ugccaguauuuuauugaggauu

SEQ ID NO: 208287 - RNA, 22 nt, Homo sapiens
ugccaguauuuuguugaagauu

SEQ ID NO: 208288 - RNA, 22 nt, Homo sapiens
ugccaguauuuuguugaggauu

SEQ ID NO: 208289 - RNA, 22 nt, Homo sapiens
ugccaugaagagaggaagcagu

SEQ ID NO: 208290 - RNA, 22 nt, Homo sapiens
ugccaugaagaucccugaaaug

SEQ ID NO: 208291 - RNA, 21 nt, Homo sapiens
ugcccaguggcuuggggucag

SEQ ID NO: 208292 - RNA, 22 nt, Homo sapiens
ugcccguaauuccagcacuuug

SEQ ID NO: 208293 - RNA, 22 nt, Homo sapiens
ugccuacugaauuuaccuggcu

SEQ ID NO: 208294 - RNA, 22 nt, Homo sapiens
ugccuaggcuggaaugcagugg

SEQ ID NO: 208295 - RNA, 22 nt, Homo sapiens
ugccuaggcuggaguguagugg

SEQ ID NO: 208296 - RNA, 22 nt, Homo sapiens
ugccuaguagaaggugaacaug

SEQ ID NO: 208297 - RNA, 22 nt, Homo sapiens
ugccuuauuccaacugagcucu

SEQ ID NO: 208298 - RNA, 22 nt, Homo sapiens
ugcgccauugcacuccagccug

SEQ ID NO: 208299 - RNA, 21 nt, Homo sapiens
ugcuacugucacuuccuuugu

SEQ ID NO: 208300 - RNA, 23 nt, Homo sapiens
ugcuauguaagcauuuauuaaau

SEQ ID NO: 208301 - RNA, 22 nt, Homo sapiens
ugcuaugucuucucucacagag

SEQ ID NO: 208302 - RNA, 22 nt, Homo sapiens
uggucccucugaaaauugggug

SEQ ID NO: 208303 - RNA, 22 nt, Homo sapiens
ugguccucugcuuccagaauuc

SEQ ID NO: 208304 - RNA, 22 nt, Homo sapiens
uggucguggagucccuggcuuc

SEQ ID NO: 208305 - RNA, 22 nt, Homo sapiens
uggucucuuugcuuuagucauc

SEQ ID NO: 208306 - RNA, 22 nt, Homo sapiens
uggucuuuucaacaaaugguau

SEQ ID NO: 208307 - RNA, 22 nt, Homo sapiens
uggugcaaugaagugaucucaa

SEQ ID NO: 208308 - RNA, 19 nt, Homo sapiens
uggugccuuguucuuggau

SEQ ID NO: 208309 - RNA, 17 nt, Homo sapiens
uggugcuugaaaguugc

SEQ ID NO: 208310 - RNA, 22 nt, Homo sapiens
uggugcuugaugaggguggagc

SEQ ID NO: 208311 - RNA, 15 nt, Homo sapiens
uggugguguugagac

SEQ ID NO: 208312 - RNA, 22 nt, Homo sapiens
ugguguccugucucugcgcuug

SEQ ID NO: 208313 - RNA, 20 nt, Homo sapiens
ugguguuugaacagugaaug

SEQ ID NO: 208314 - RNA, 22 nt, Homo sapiens
ugguguuugagaagcugauguc

SEQ ID NO: 208315 - RNA, 22 nt, Homo sapiens
uguaaaucugguuaauuggaua

SEQ ID NO: 208316 - RNA, 20 nt, Homo sapiens
uguaacacauggagaacucu

SEQ ID NO: 208317 - RNA, 20 nt, Homo sapiens
uguacacaguguacccacau

SEQ ID NO: 208318 - RNA, 22 nt, Homo sapiens
uguacacauaugugggguacau

SEQ ID NO: 208319 - RNA, 19 nt, Homo sapiens
uguaccagcaagucuuuuc

SEQ ID NO: 208320 - RNA, 22 nt, Homo sapiens
uguagauauucuuucaguuuuu

SEQ ID NO: 208321 - RNA, 22 nt, Homo sapiens
uguagcacauuugaagagaagc

SEQ ID NO: 208322 - RNA, 21 nt, Homo sapiens
uguagcagcaugauuuauaau

SEQ ID NO: 208323 - RNA, 23 nt, Homo sapiens
uguauacacccugugcaucuggg

SEQ ID NO: 208324 - RNA, 22 nt, Homo sapiens
uguauacauauguauguuuugu

SEQ ID NO: 208325 - RNA, 22 nt, Homo sapiens
uguaugagagugaaagcauuuc

SEQ ID NO: 208326 - RNA, 22 nt, Homo sapiens
uguauguugauguuauauucug

SEQ ID NO: 208327 - RNA, 22 nt, Homo sapiens
uguauguuguaagacuuagacc

SEQ ID NO: 208328 - RNA, 22 nt, Homo sapiens
ugucaaagagacaucugcacuc

SEQ ID NO: 208329 - RNA, 22 nt, Homo sapiens
ugucaaaugcagugauauuuga

SEQ ID NO: 208330 - RNA, 22 nt, Homo sapiens
ugucaauauguaauaacugaau

SEQ ID NO: 208331 - RNA, 22 nt, Homo sapiens
ugucacccuuuauccauuuccu

SEQ ID NO: 208332 - RNA, 22 nt, Homo sapiens
ugucaccuugcucauccucgga

SEQ ID NO: 208333 - RNA, 22 nt, Homo sapiens
ugucagcacaacucagguuccu

SEQ ID NO: 208334 - RNA, 22 nt, Homo sapiens
ugucagggaggcucggccgcac

SEQ ID NO: 208335 - RNA, 22 nt, Homo sapiens
ugucaguguacuguaagaauua

SEQ ID NO: 208336 - RNA, 22 nt, Homo sapiens
ugucaguuucuugagauggaac

SEQ ID NO: 208337 - RNA, 22 nt, Homo sapiens
ugucaguuuuaacuagggaaua

SEQ ID NO: 208338 - RNA, 22 nt, Homo sapiens
ugucaugaacucacauucuggg

SEQ ID NO: 208339 - RNA, 22 nt, Homo sapiens
ugucaugagucuccuccaucuu

SEQ ID NO: 208340 - RNA, 22 nt, Homo sapiens
ugucauggggaaaauaacagac

SEQ ID NO: 208341 - RNA, 22 nt, Homo sapiens
ugucauguugagaaacuuggau

SEQ ID NO: 208342 - RNA, 22 nt, Homo sapiens
ugucauuggacuucuuucaugg

SEQ ID NO: 208343 - RNA, 16 nt, Homo sapiens
uguccaaauaaauaca

SEQ ID NO: 208344 - RNA, 22 nt, Homo sapiens
uguccaaauugaaucaucuggu

SEQ ID NO: 208345 - RNA, 22 nt, Homo sapiens
ugucccugagccuggauuccug

SEQ ID NO: 208346 - RNA, 22 nt, Homo sapiens
uguccugcagagguguuugccu

SEQ ID NO: 208347 - RNA, 22 nt, Homo sapiens
uguccuggugaugcccaaauuc

SEQ ID NO: 208348 - RNA, 22 nt, Homo sapiens
ugucuaaagaauggcagacuca

SEQ ID NO: 208349 - RNA, 22 nt, Homo sapiens
ugucucaguucccuucucugga

SEQ ID NO: 208350 - RNA, 22 nt, Homo sapiens
ugucuggaaggguggccuccug

SEQ ID NO: 208351 - RNA, 22 nt, Homo sapiens
ugucuuggagaauccuggguuu

SEQ ID NO: 208352 - RNA, 21 nt, Homo sapiens
ugucuuggagccagacgccag

SEQ ID NO: 208353 - RNA, 22 nt, Homo sapiens
ugucuuuguuaguuguccuagu

SEQ ID NO: 208354 - RNA, 21 nt, Homo sapiens
ugugaaaucuaggcagagguu

SEQ ID NO: 208355 - RNA, 22 nt, Homo sapiens
ugugaaauguuaucccgucgug

SEQ ID NO: 208356 - RNA, 22 nt, Homo sapiens
ugugaagauguuucuuaauuga

SEQ ID NO: 208357 - RNA, 22 nt, Homo sapiens
ugugaaugauggagugucgaau

SEQ ID NO: 208358 - RNA, 22 nt, Homo sapiens
ugugacacugaauggcagaacu

SEQ ID NO: 208359 - RNA, 22 nt, Homo sapiens
ugugacagcacgguucaacugc

SEQ ID NO: 208360 - RNA, 22 nt, Homo sapiens
ugugacagguagguaauuuuug

SEQ ID NO: 208361 - RNA, 22 nt, Homo sapiens
ugugacagguauccuguguucu

SEQ ID NO: 208362 - RNA, 22 nt, Homo sapiens
ugugaccaaaaucaacauaccu

SEQ ID NO: 208363 - RNA, 22 nt, Homo sapiens
ugugacuaguggugaaugacgc

SEQ ID NO: 208364 - RNA, 21 nt, Homo sapiens
ugugacuguugcauuugucgu

SEQ ID NO: 208365 - RNA, 22 nt, Homo sapiens
ugugagaaaugcagaaucucag

SEQ ID NO: 208366 - RNA, 22 nt, Homo sapiens
ugugagaucucagaauugaacu

SEQ ID NO: 208367 - RNA, 22 nt, Homo sapiens
ugugagcuauggaguuguagag

SEQ ID NO: 208368 - RNA, 22 nt, Homo sapiens
ugugauaguuggcuaaagcagu

SEQ ID NO: 208369 - RNA, 22 nt, Homo sapiens
ugugaucauuucaggaauuuug

SEQ ID NO: 208370 - RNA, 22 nt, Homo sapiens
ugugaugcagggccugggccuc

SEQ ID NO: 208371 - RNA, 22 nt, Homo sapiens
ugugaugugaugagaaguuccu

SEQ ID NO: 208372 - RNA, 22 nt, Homo sapiens
ugugcaaaaacaauugcgguuu

SEQ ID NO: 208373 - RNA, 22 nt, Homo sapiens
ugugcaaauguuaaacuaacuu

SEQ ID NO: 208374 - RNA, 22 nt, Homo sapiens
ugugcacaaccugcagguuugu

SEQ ID NO: 208375 - RNA, 22 nt, Homo sapiens
ugugcacaaugugcagguuuga

SEQ ID NO: 208376 - RNA, 22 nt, Homo sapiens
ugugcacauugugcagguugau

SEQ ID NO: 208377 - RNA, 22 nt, Homo sapiens
ugugcacuggaccuugucuucu

SEQ ID NO: 208378 - RNA, 22 nt, Homo sapiens
ugugcaguuuugagugaauuuc

SEQ ID NO: 208379 - RNA, 22 nt, Homo sapiens
ugugcaugaaauuuaccuuuaa

SEQ ID NO: 208380 - RNA, 22 nt, Homo sapiens
ugugccacuccaggaggcuguu

SEQ ID NO: 208381 - RNA, 22 nt, Homo sapiens
ugugccacugcacuccugccug

SEQ ID NO: 208382 - RNA, 22 nt, Homo sapiens
ugugccacugcacucuggccug

SEQ ID NO: 208383 - RNA, 22 nt, Homo sapiens
ugugccugagguuaacauuguu

SEQ ID NO: 208384 - RNA, 22 nt, Homo sapiens
ugugccuucuaagaaggagucu

SEQ ID NO: 208385 - RNA, 22 nt, Homo sapiens
ugugcuauguuauucacauggg

SEQ ID NO: 208386 - RNA, 22 nt, Homo sapiens
ugugcugaucgggcacgguguc

SEQ ID NO: 208387 - RNA, 22 nt, Homo sapiens
ugugcuugaaauucaguuuuga

SEQ ID NO: 208388 - RNA, 22 nt, Homo sapiens
ugugcuugaauuuaguagcuua

SEQ ID NO: 208389 - RNA, 22 nt, Homo sapiens
ugugcuuguaaaggccagagca

SEQ ID NO: 208390 - RNA, 22 nt, Homo sapiens
uguggaaauggugcuacgaaca

SEQ ID NO: 208391 - RNA, 22 nt, Homo sapiens
uguggcaaauggucaggaagaa

SEQ ID NO: 208392 - RNA, 22 nt, Homo sapiens
uguggcauugaauaaccuugga

SEQ ID NO: 208393 - RNA, 18 nt, Homo sapiens
uguggcuguuuuccaaua

SEQ ID NO: 208394 - RNA, 22 nt, Homo sapiens
uguggcuuuguaaccauggguc

SEQ ID NO: 208395 - RNA, 22 nt, Homo sapiens
ugugggaggugcuaauguaaau

SEQ ID NO: 208396 - RNA, 19 nt, Homo sapiens
uguggucauccugggacga

SEQ ID NO: 208397 - RNA, 22 nt, Homo sapiens
uguguaaauauauacacacgug

SEQ ID NO: 208398 - RNA, 22 nt, Homo sapiens
uguguaaauaugauagaggaau

SEQ ID NO: 208399 - RNA, 22 nt, Homo sapiens
uguguaauacucuaaugaugca

SEQ ID NO: 208400 - RNA, 22 nt, Homo sapiens
ugugucacugcacuccagcgug

SEQ ID NO: 208401 - RNA, 22 nt, Homo sapiens
ugugucuugaauuuuguaugua

SEQ ID NO: 208402 - RNA, 22 nt, Homo sapiens
ugugucuuguuuuuucccaggc

SEQ ID NO: 208403 - RNA, 22 nt, Homo sapiens
uguuacacugugcacuaaauuu

SEQ ID NO: 208404 - RNA, 20 nt, Homo sapiens
uggaaggcaucugcauuauu

SEQ ID NO: 208405 - RNA, 22 nt, Homo sapiens
uggaagguaaguuuugagcauu

SEQ ID NO: 208406 - RNA, 22 nt, Homo sapiens
uggaaggucauuguucauuuga

SEQ ID NO: 208407 - RNA, 22 nt, Homo sapiens
uggaaguaaccaugaauggaau

SEQ ID NO: 208408 - RNA, 20 nt, Homo sapiens
uggaaguaagaauauaggug

SEQ ID NO: 208409 - RNA, 22 nt, Homo sapiens
uggaaguagauagauuguguca

SEQ ID NO: 208410 - RNA, 22 nt, Homo sapiens
uggaagucaugcugcaagaaca

SEQ ID NO: 208411 - RNA, 22 nt, Homo sapiens
uggaagucauugagguguguua

SEQ ID NO: 208412 - RNA, 22 nt, Homo sapiens
uggaagugucugugcccagcuc

SEQ ID NO: 208413 - RNA, 22 nt, Homo sapiens
uggaauacuauucugugcugga

SEQ ID NO: 208414 - RNA, 22 nt, Homo sapiens
uggaauaucaugagaguuuguu

SEQ ID NO: 208415 - RNA, 17 nt, Homo sapiens
uggaaugucuaagccug

SEQ ID NO: 208416 - RNA, 22 nt, Homo sapiens
uggaaugucuauguuuuugauu

SEQ ID NO: 208417 - RNA, 22 nt, Homo sapiens
uggaauguuuaucaaaacagua

SEQ ID NO: 208418 - RNA, 22 nt, Homo sapiens
uggaauuaauuaaaauauacug

SEQ ID NO: 208419 - RNA, 22 nt, Homo sapiens
uggaauuuagguugauaguaua

SEQ ID NO: 208420 - RNA, 22 nt, Homo sapiens
uggacaagugcccuccaccuca

SEQ ID NO: 208421 - RNA, 22 nt, Homo sapiens
uggacagacaagguuauagauc

SEQ ID NO: 208422 - RNA, 22 nt, Homo sapiens
uggacauguacauauguguaug

SEQ ID NO: 208423 - RNA, 21 nt, Homo sapiens
uggaccccuuccuuacaucau

SEQ ID NO: 208424 - RNA, 22 nt, Homo sapiens
uggaccccuucuccuauuaaaa

SEQ ID NO: 208425 - RNA, 22 nt, Homo sapiens
uggacuuuaauaaaagggaaau

SEQ ID NO: 208426 - RNA, 22 nt, Homo sapiens
uggagaacauucauuugcaaga

SEQ ID NO: 208427 - RNA, 22 nt, Homo sapiens
uggagguagagaugggaucucc

SEQ ID NO: 208428 - RNA, 22 nt, Homo sapiens
uggagguagggccuaggaaucu

SEQ ID NO: 208429 - RNA, 20 nt, Homo sapiens
uggaggucaucugucacuac

SEQ ID NO: 208430 - RNA, 19 nt, Homo sapiens
uggagucaucaugcugcua

SEQ ID NO: 208431 - RNA, 22 nt, Homo sapiens
uggagucgugcccuugcauuua

SEQ ID NO: 208432 - RNA, 22 nt, Homo sapiens
uggagucuugaugauuuucaaa

SEQ ID NO: 208433 - RNA, 20 nt, Homo sapiens
uggagugaagguucuggacc

SEQ ID NO: 208434 - RNA, 22 nt, Homo sapiens
uggagugauaugguuauauggg

SEQ ID NO: 208435 - RNA, 21 nt, Homo sapiens
uggagugcaacacuagguaua

SEQ ID NO: 208436 - RNA, 22 nt, Homo sapiens
uggagugcaauggugagaucuu

SEQ ID NO: 208437 - RNA, 22 nt, Homo sapiens
uggagugcgagggugaaacuuu

SEQ ID NO: 208438 - RNA, 22 nt, Homo sapiens
uggagugcgugucugaguuuuu

SEQ ID NO: 208439 - RNA, 22 nt, Homo sapiens
uggagugucaguuuccagaguu

SEQ ID NO: 208440 - RNA, 22 nt, Homo sapiens
uggaguguguugcagaugaagg

SEQ ID NO: 208441 - RNA, 16 nt, Homo sapiens
uggaguguuuguuaga

SEQ ID NO: 208442 - RNA, 20 nt, Homo sapiens
uggaguuugaguucuuggag

SEQ ID NO: 208443 - RNA, 22 nt, Homo sapiens
uggauagaaauguacuguuuuc

SEQ ID NO: 208444 - RNA, 22 nt, Homo sapiens
uggauagauacuauccaggacu

SEQ ID NO: 208445 - RNA, 18 nt, Homo sapiens
uggauaguuguuggcaga

SEQ ID NO: 208446 - RNA, 22 nt, Homo sapiens
uggauauguuuauauguugucu

SEQ ID NO: 208447 - RNA, 21 nt, Homo sapiens
uggaugccuaggcagaaguuu

SEQ ID NO: 208448 - RNA, 22 nt, Homo sapiens
uggauggugauuggaucaugga

SEQ ID NO: 208449 - RNA, 22 nt, Homo sapiens
uggauugaaagcuuuaauauug

SEQ ID NO: 208450 - RNA, 18 nt, Homo sapiens
uggauuggaaaaguuccu

SEQ ID NO: 208451 - RNA, 22 nt, Homo sapiens
uggauuuuaauuauucugucau

SEQ ID NO: 208452 - RNA, 22 nt, Homo sapiens
uggcaaaaaaccgcaguugccu

SEQ ID NO: 208453 - RNA, 22 nt, Homo sapiens
uggcaaaaaucacaaguaccuu

SEQ ID NO: 208454 - RNA, 22 nt, Homo sapiens
uggcaaaauauuuugguuucug

SEQ ID NO: 208455 - RNA, 21 nt, Homo sapiens
uggcaaaaugggcaguggguu

SEQ ID NO: 208456 - RNA, 22 nt, Homo sapiens
uggcaaauagcaauaggagggu

SEQ ID NO: 208457 - RNA, 22 nt, Homo sapiens
uggcaaauauuuuguuuuguaa

SEQ ID NO: 208458 - RNA, 23 nt, Homo sapiens
uggcaagaauucuuaccgugugg

SEQ ID NO: 208459 - RNA, 22 nt, Homo sapiens
uggcaagaccccaucucuacaa

SEQ ID NO: 208460 - RNA, 22 nt, Homo sapiens
uggcaagagaacaacaucucuc

SEQ ID NO: 208461 - RNA, 22 nt, Homo sapiens
uggcaagcuuuaauugacucuu

SEQ ID NO: 208462 - RNA, 18 nt, Homo sapiens
uggcaauaugguucuacc

SEQ ID NO: 208463 - RNA, 22 nt, Homo sapiens
uggcaauguggaaugguccagg

SEQ ID NO: 208464 - RNA, 22 nt, Homo sapiens
uggcaccauccaggugucucua

SEQ ID NO: 208465 - RNA, 20 nt, Homo sapiens
uggcaccugacagauagcca

SEQ ID NO: 208466 - RNA, 21 nt, Homo sapiens
uggcacuauucacaauagcaa

SEQ ID NO: 208467 - RNA, 22 nt, Homo sapiens
uggcagauggugacaccauuag

SEQ ID NO: 208468 - RNA, 22 nt, Homo sapiens
uggcaguuucauaugguucaac

SEQ ID NO: 208469 - RNA, 22 nt, Homo sapiens
uggcaguuuugauguggagaga

SEQ ID NO: 208470 - RNA, 22 nt, Homo sapiens
uggcauauaauauagaagacua

SEQ ID NO: 208471 - RNA, 22 nt, Homo sapiens
uggcaucuguucuacacauaaa

SEQ ID NO: 208472 - RNA, 22 nt, Homo sapiens
uggcaugaagaccccauccuuu

SEQ ID NO: 208473 - RNA, 17 nt, Homo sapiens
uggcaugaggguguggg

SEQ ID NO: 208474 - RNA, 22 nt, Homo sapiens
uggcauggaguggauggcccca

SEQ ID NO: 208475 - RNA, 22 nt, Homo sapiens
uggcauggggcagaacauuaca

SEQ ID NO: 208476 - RNA, 22 nt, Homo sapiens
uggcaugucagguuucuggguu

SEQ ID NO: 208477 - RNA, 22 nt, Homo sapiens
uggcauuuuguuuuagaauuag

SEQ ID NO: 208478 - RNA, 23 nt, Homo sapiens
uggccaagauaaucucaguuuuc

SEQ ID NO: 208479 - RNA, 23 nt, Homo sapiens
uggccagaaacuucuuuucaucc

SEQ ID NO: 208480 - RNA, 22 nt, Homo sapiens
uggccuuuuccaagaacuacua

SEQ ID NO: 208481 - RNA, 22 nt, Homo sapiens
uggcgagaugcucgugugcaga

SEQ ID NO: 208482 - RNA, 18 nt, Homo sapiens
uggcuacugaacuagaug

SEQ ID NO: 208483 - RNA, 22 nt, Homo sapiens
uggcuacugaccugcuaggggg

SEQ ID NO: 208484 - RNA, 23 nt, Homo sapiens
uggcuagacguccuuuccugaug

SEQ ID NO: 208485 - RNA, 19 nt, Homo sapiens
uggcuagaggccaggcguu

SEQ ID NO: 208486 - RNA, 22 nt, Homo sapiens
uggcucauuucuaaacccagcu

SEQ ID NO: 208487 - RNA, 21 nt, Homo sapiens
ucuggccccuccaaaucucau

SEQ ID NO: 208488 - RNA, 20 nt, Homo sapiens
ucuggccccucuaaaucuca

SEQ ID NO: 208489 - RNA, 22 nt, Homo sapiens
ucuggccccucucaaaucucau

SEQ ID NO: 208490 - RNA, 22 nt, Homo sapiens
ucuggccuacaaguaauuuuau

SEQ ID NO: 208491 - RNA, 22 nt, Homo sapiens
ucuggccuagaacaauuaauua

SEQ ID NO: 208492 - RNA, 22 nt, Homo sapiens
ucuggccuccuaugagaaucga

SEQ ID NO: 208493 - RNA, 22 nt, Homo sapiens
ucuggcuccaaagucuauuuuu

SEQ ID NO: 208494 - RNA, 16 nt, Homo sapiens
ucuggcucuacaguuc

SEQ ID NO: 208495 - RNA, 15 nt, Homo sapiens
ucuggcucugucacu

SEQ ID NO: 208496 - RNA, 22 nt, Homo sapiens
ucuggcuuuuaacaucuauaaa

SEQ ID NO: 208497 - RNA, 22 nt, Homo sapiens
ucuggguuuuuccauugccggu

SEQ ID NO: 208498 - RNA, 22 nt, Homo sapiens
ucugguuccugcauucauucaa

SEQ ID NO: 208499 - RNA, 22 nt, Homo sapiens
ucugucacugguggacgaucac

SEQ ID NO: 208500 - RNA, 22 nt, Homo sapiens
ucugucuuguccucacccuaga

SEQ ID NO: 208501 - RNA, 22 nt, Homo sapiens
ucugugaaugugaccuuauuug

SEQ ID NO: 208502 - RNA, 22 nt, Homo sapiens
ucugugcauuacacuuuucuca

SEQ ID NO: 208503 - RNA, 22 nt, Homo sapiens
ucugugcauuguaggauguuua

SEQ ID NO: 208504 - RNA, 22 nt, Homo sapiens
ucugugcugagaguugaaaguu

SEQ ID NO: 208505 - RNA, 22 nt, Homo sapiens
ucuguggucagcauccgccacu

SEQ ID NO: 208506 - RNA, 22 nt, Homo sapiens
ucugugguucuagcuacuuugg

SEQ ID NO: 208507 - RNA, 22 nt, Homo sapiens
ucugugguuguugcauggaaug

SEQ ID NO: 208508 - RNA, 22 nt, Homo sapiens
ucuguguuugaucaagauugua

SEQ ID NO: 208509 - RNA, 22 nt, Homo sapiens
ucuguguuugguuggcaauuuc

SEQ ID NO: 208510 - RNA, 22 nt, Homo sapiens
ucuugcaauuuccuuaguggug

SEQ ID NO: 208511 - RNA, 22 nt, Homo sapiens
ucuugcacaaauuauuuuaacu

SEQ ID NO: 208512 - RNA, 22 nt, Homo sapiens
ucuugcauuuuuaaauagugcu

SEQ ID NO: 208513 - RNA, 22 nt, Homo sapiens
ucuuggacuuuugugagaaauc

SEQ ID NO: 208514 - RNA, 21 nt, Homo sapiens
ucuuggguugaauucucccag

SEQ ID NO: 208515 - RNA, 22 nt, Homo sapiens
ucuuggguuugccuugcugcug

SEQ ID NO: 208516 - RNA, 22 nt, Homo sapiens
ucuugguuaggggaaauaggca

SEQ ID NO: 208517 - RNA, 22 nt, Homo sapiens
ucuuuaguaauuucuguaaggc

SEQ ID NO: 208518 - RNA, 22 nt, Homo sapiens
ucuuuaguuaagggacauuuua

SEQ ID NO: 208519 - RNA, 22 nt, Homo sapiens
ucuuucacuuagcaugauguuu

SEQ ID NO: 208520 - RNA, 22 nt, Homo sapiens
ucuuugaguggagcgaggcaga

SEQ ID NO: 208521 - RNA, 22 nt, Homo sapiens
ucuuugccuaacccaaggucau

SEQ ID NO: 208522 - RNA, 23 nt, Homo sapiens
ucuuuggcucuaauauaccuugu

SEQ ID NO: 208523 - RNA, 22 nt, Homo sapiens
ucuuuggguguauuucacagcc

SEQ ID NO: 208524 - RNA, 22 nt, Homo sapiens
ucuuugguagaagcuauuuuau

SEQ ID NO: 208525 - RNA, 22 nt, Homo sapiens
ucuuugguaggaguaggaggcc

SEQ ID NO: 208526 - RNA, 22 nt, Homo sapiens
ucuuugguuagguuuaguugau

SEQ ID NO: 208527 - RNA, 22 nt, Homo sapiens
ucuuugguucuguuuauguaau

SEQ ID NO: 208528 - RNA, 22 nt, Homo sapiens
ucuuugguuucugucucuguaa

SEQ ID NO: 208529 - RNA, 22 nt, Homo sapiens
ucuuuguuuucugauccugaag

SEQ ID NO: 208530 - RNA, 22 nt, Homo sapiens
ucuuuuugagucaguuucggua

SEQ ID NO: 208531 - RNA, 20 nt, Homo sapiens
ucuuuuuguggccccagagu

SEQ ID NO: 208532 - RNA, 22 nt, Homo sapiens
ugaaaaguuguugaaggcuuca

SEQ ID NO: 208533 - RNA, 22 nt, Homo sapiens
ugaaacauacacucugaugggg

SEQ ID NO: 208534 - RNA, 22 nt, Homo sapiens
ugaaagacugaaagcuuuucuu

SEQ ID NO: 208535 - RNA, 22 nt, Homo sapiens
ugaaagacugaagaauaggcau

SEQ ID NO: 208536 - RNA, 22 nt, Homo sapiens
ugaaauaguuaaguugccuagu

SEQ ID NO: 208537 - RNA, 22 nt, Homo sapiens
ugaaaugaucaguuugguuacu

SEQ ID NO: 208538 - RNA, 22 nt, Homo sapiens
ugaaaugauuauaugguguuug

SEQ ID NO: 208539 - RNA, 22 nt, Homo sapiens
ugaaaugccuuuaaugaauuua

SEQ ID NO: 208540 - RNA, 22 nt, Homo sapiens
ugaaaugcugucuaggggaaau

SEQ ID NO: 208541 - RNA, 22 nt, Homo sapiens
ugaaauguaaguugucuagucu

SEQ ID NO: 208542 - RNA, 22 nt, Homo sapiens
ugaaaugucuuuaggaggcuuc

SEQ ID NO: 208543 - RNA, 22 nt, Homo sapiens
ugaaauguguuaucugggccug

SEQ ID NO: 208544 - RNA, 22 nt, Homo sapiens
ugaaauuauucuuaccaaggug

SEQ ID NO: 208545 - RNA, 22 nt, Homo sapiens
ugaacacagccugccucugcca

SEQ ID NO: 208546 - RNA, 22 nt, Homo sapiens
ugaacacaucuccugguaccug

SEQ ID NO: 208547 - RNA, 21 nt, Homo sapiens
ugaacacuggacugagugucc

SEQ ID NO: 208548 - RNA, 16 nt, Homo sapiens
ugaacagagaggauuc

SEQ ID NO: 208549 - RNA, 22 nt, Homo sapiens
ugaacagcuaucuugucagugu

SEQ ID NO: 208550 - RNA, 21 nt, Homo sapiens
ugaaccccugcucucaagaaa

SEQ ID NO: 208551 - RNA, 22 nt, Homo sapiens
ugaacuaguaguuuacuugaug

SEQ ID NO: 208552 - RNA, 22 nt, Homo sapiens
ugaagaucauacugguggaggg

SEQ ID NO: 208553 - RNA, 22 nt, Homo sapiens
ugaagcuaacuugauugugaug

SEQ ID NO: 208554 - RNA, 22 nt, Homo sapiens
ugaagcuaggauuaauuuucau

SEQ ID NO: 208555 - RNA, 22 nt, Homo sapiens
ugaaggcaggagggagaaaagu

SEQ ID NO: 208556 - RNA, 19 nt, Homo sapiens
ugaaguauagggcuucuga

SEQ ID NO: 208557 - RNA, 22 nt, Homo sapiens
ugaagugaagcaguaguguggg

SEQ ID NO: 208558 - RNA, 22 nt, Homo sapiens
ugaaguguuuauuuuggccuuc

SEQ ID NO: 208559 - RNA, 22 nt, Homo sapiens
ugaauagugucacaauaaacau

SEQ ID NO: 208560 - RNA, 22 nt, Homo sapiens
ugaaugcaucauguagggcuca

SEQ ID NO: 208561 - RNA, 22 nt, Homo sapiens
ugaaugcaucuagaaauuuauu

SEQ ID NO: 208562 - RNA, 22 nt, Homo sapiens
ugaaugcuaaaggaaaacagua

SEQ ID NO: 208563 - RNA, 22 nt, Homo sapiens
ugaauguaacuaaaccugugaa

SEQ ID NO: 208564 - RNA, 22 nt, Homo sapiens
ugaauguucuuaaaacccuugu

SEQ ID NO: 208565 - RNA, 22 nt, Homo sapiens
ugaauguuugcagcuuauacca

SEQ ID NO: 208566 - RNA, 22 nt, Homo sapiens
ugaauuguuuacgagaugugag

SEQ ID NO: 208567 - RNA, 22 nt, Homo sapiens
ugaauuguuucauucuuuacau

SEQ ID NO: 208568 - RNA, 22 nt, Homo sapiens
ugacaagagaccccuccgcagg

SEQ ID NO: 208569 - RNA, 20 nt, Homo sapiens
ugacaaggugcaaagaauca

SEQ ID NO: 208570 - RNA, 22 nt, Homo sapiens
ugacaaguaaacagucagcacc

SEQ ID NO: 208571 - RNA, 18 nt, Homo sapiens
ugacaaugcuaguccugg

SEQ ID NO: 208572 - RNA, 22 nt, Homo sapiens
ugacacagcaagauggaaccau

SEQ ID NO: 208573 - RNA, 22 nt, Homo sapiens
ugacacuugcccuuagaaacau

SEQ ID NO: 208574 - RNA, 22 nt, Homo sapiens
ugacagagaagcauugaguuca

SEQ ID NO: 208575 - RNA, 18 nt, Homo sapiens
uuucaggguggacaugag

SEQ ID NO: 208576 - RNA, 22 nt, Homo sapiens
uuucagguauuuaagggccguu

SEQ ID NO: 208577 - RNA, 22 nt, Homo sapiens
uuucauagaucaugcuuuugga

SEQ ID NO: 208578 - RNA, 22 nt, Homo sapiens
uuucauagccuucuaaugaguu

SEQ ID NO: 208579 - RNA, 16 nt, Homo sapiens
uuucaucaguuuuaau

SEQ ID NO: 208580 - RNA, 22 nt, Homo sapiens
uuucauggaauauagucauuuu

SEQ ID NO: 208581 - RNA, 22 nt, Homo sapiens
uuucauggcaguuuggggccug

SEQ ID NO: 208582 - RNA, 22 nt, Homo sapiens
uuucauguuuuucugugaggca

SEQ ID NO: 208583 - RNA, 19 nt, Homo sapiens
uuucauguuuuuggugaga

SEQ ID NO: 208584 - RNA, 22 nt, Homo sapiens
uuuccaguuggaagaaggggga

SEQ ID NO: 208585 - RNA, 22 nt, Homo sapiens
uuuccaguuuggaggaugcauu

SEQ ID NO: 208586 - RNA, 19 nt, Homo sapiens
uuucccugcagaccuacua

SEQ ID NO: 208587 - RNA, 22 nt, Homo sapiens
uuucccuuuagcuuagugauuu

SEQ ID NO: 208588 - RNA, 22 nt, Homo sapiens
uuucccuuugcuuugucagcca

SEQ ID NO: 208589 - RNA, 21 nt, Homo sapiens
uuuccuggagcguauggcuuc

SEQ ID NO: 208590 - RNA, 22 nt, Homo sapiens
uuucgguuaucuagcuuuauga

SEQ ID NO: 208591 - RNA, 22 nt, Homo sapiens
uuucuauguugaccagucuaga

SEQ ID NO: 208592 - RNA, 22 nt, Homo sapiens
uuucucaguguuucaggguagg

SEQ ID NO: 208593 - RNA, 22 nt, Homo sapiens
uuucugaggccucaccagaagc

SEQ ID NO: 208594 - RNA, 22 nt, Homo sapiens
uuucugguuaauuucuaagagc

SEQ ID NO: 208595 - RNA, 22 nt, Homo sapiens
uuucugugguccucuugaaggu

SEQ ID NO: 208596 - RNA, 22 nt, Homo sapiens
uuugaaaguaauuugguuggug

SEQ ID NO: 208597 - RNA, 22 nt, Homo sapiens
uuugacuacugaugguguacgc

SEQ ID NO: 208598 - RNA, 22 nt, Homo sapiens
uuugagaucuuuagaaucaggc

SEQ ID NO: 208599 - RNA, 22 nt, Homo sapiens
uuugagcaggcuaaucaauaua

SEQ ID NO: 208600 - RNA, 22 nt, Homo sapiens
uuugagcauguaguuuaacccu

SEQ ID NO: 208601 - RNA, 22 nt, Homo sapiens
uuugaggaaaggcauaaguagg

SEQ ID NO: 208602 - RNA, 22 nt, Homo sapiens
uuugaguaggcuuauauuuugg

SEQ ID NO: 208603 - RNA, 22 nt, Homo sapiens
uuugcaauguugugauggugaa

SEQ ID NO: 208604 - RNA, 22 nt, Homo sapiens
uuugcacuggagauucaauggg

SEQ ID NO: 208605 - RNA, 22 nt, Homo sapiens
uuugcagagacuuguuaggaau

SEQ ID NO: 208606 - RNA, 22 nt, Homo sapiens
uuugcagagucuuucgcugggc

SEQ ID NO: 208607 - RNA, 22 nt, Homo sapiens
uuugcauauguugaaccagccu

SEQ ID NO: 208608 - RNA, 22 nt, Homo sapiens
uuugcaucuuuugcuuccugga

SEQ ID NO: 208609 - RNA, 22 nt, Homo sapiens
uuugccaaugggaauuuuccua

SEQ ID NO: 208610 - RNA, 22 nt, Homo sapiens
uuugccacugcaggcuguuuaa

SEQ ID NO: 208611 - RNA, 18 nt, Homo sapiens
uuugccacuucccagaaa

SEQ ID NO: 208612 - RNA, 22 nt, Homo sapiens
uuugcugagucauuccaugcug

SEQ ID NO: 208613 - RNA, 22 nt, Homo sapiens
uuugcuuaaaguccuuguggga

SEQ ID NO: 208614 - RNA, 22 nt, Homo sapiens
uuugcuugaggucuagcuaccc

SEQ ID NO: 208615 - RNA, 22 nt, Homo sapiens
uuuggaaugaaacagcagagcc

SEQ ID NO: 208616 - RNA, 22 nt, Homo sapiens
uuuggacuucuagccuccagag

SEQ ID NO: 208617 - RNA, 22 nt, Homo sapiens
uuuggcaacguuggaucccuca

SEQ ID NO: 208618 - RNA, 22 nt, Homo sapiens
uuuggcagaugacccucaaguu

SEQ ID NO: 208619 - RNA, 22 nt, Homo sapiens
uuuggcauuagagagacuugca

SEQ ID NO: 208620 - RNA, 23 nt, Homo sapiens
uuuggcauuccagaaauuuucau

SEQ ID NO: 208621 - RNA, 22 nt, Homo sapiens
uuuggcauuuaaauaugcaugg

SEQ ID NO: 208622 - RNA, 22 nt, Homo sapiens
uuuggccauguuggucaggcug

SEQ ID NO: 208623 - RNA, 22 nt, Homo sapiens
uuuggcuuaagauugacugcaa

SEQ ID NO: 208624 - RNA, 22 nt, Homo sapiens
uuuggcuuuuguaauaacugcc

SEQ ID NO: 208625 - RNA, 22 nt, Homo sapiens
uuuggcuuuugugauacguaau

SEQ ID NO: 208626 - RNA, 22 nt, Homo sapiens
uuugggaaugguuugucuccca

SEQ ID NO: 208627 - RNA, 22 nt, Homo sapiens
uuugggccaugcuucccgguca

SEQ ID NO: 208628 - RNA, 22 nt, Homo sapiens
uuuggucacugccgccgccagc

SEQ ID NO: 208629 - RNA, 22 nt, Homo sapiens
uuuggucagcugcgggucagcu

SEQ ID NO: 208630 - RNA, 22 nt, Homo sapiens
uuugguccuccuacagggcagg

SEQ ID NO: 208631 - RNA, 22 nt, Homo sapiens
uuugguugccucuaugagccug

SEQ ID NO: 208632 - RNA, 22 nt, Homo sapiens
uuuguaagaugcauagauugca

SEQ ID NO: 208633 - RNA, 23 nt, Homo sapiens
uuuguacuaugucaguuuagaua

SEQ ID NO: 208634 - RNA, 22 nt, Homo sapiens
uuuguacuugaagaaucuuuau

SEQ ID NO: 208635 - RNA, 22 nt, Homo sapiens
uuuguagcucacucugagcuga

SEQ ID NO: 208636 - RNA, 23 nt, Homo sapiens
uuuguaguagcaugauuuauaau

SEQ ID NO: 208637 - RNA, 19 nt, Homo sapiens
uuuguauguuuccaguaau

SEQ ID NO: 208638 - RNA, 22 nt, Homo sapiens
uuugucaauaacuaccaacagg

SEQ ID NO: 208639 - RNA, 22 nt, Homo sapiens
uuugucacucuuggagguuguu

SEQ ID NO: 208640 - RNA, 21 nt, Homo sapiens
uuuguccaccuguguucacca

SEQ ID NO: 208641 - RNA, 22 nt, Homo sapiens
uuugucccuuugcaguggcaca

SEQ ID NO: 208642 - RNA, 22 nt, Homo sapiens
uuuguccugccaugguuuauuu

SEQ ID NO: 208643 - RNA, 23 nt, Homo sapiens
uuugugacacucuccaucuccag

SEQ ID NO: 208644 - RNA, 22 nt, Homo sapiens
uuugugacucauggucuagugc

SEQ ID NO: 208645 - RNA, 22 nt, Homo sapiens
uuugugcuauguuauauauucu

SEQ ID NO: 208646 - RNA, 22 nt, Homo sapiens
uuugugcuccuaugagaaucua

SEQ ID NO: 208647 - RNA, 22 nt, Homo sapiens
uuugugcuccugugagaaucua

SEQ ID NO: 208648 - RNA, 21 nt, Homo sapiens
uuugugguuacugugugagcu

SEQ ID NO: 208649 - RNA, 22 nt, Homo sapiens
uuuguguggccuuggccuggca

SEQ ID NO: 208650 - RNA, 22 nt, Homo sapiens
uuuuaacagccaggggacggcc

SEQ ID NO: 208651 - RNA, 22 nt, Homo sapiens
uuuuacacuucgguugugugca

SEQ ID NO: 208652 - RNA, 22 nt, Homo sapiens
uuuuagcaaagagacugguggc

SEQ ID NO: 208653 - RNA, 22 nt, Homo sapiens
uuuuaguggaauauuuacaguu

SEQ ID NO: 208654 - RNA, 19 nt, Homo sapiens
uuuuccccuuucuuaagac

SEQ ID NO: 208655 - RNA, 22 nt, Homo sapiens
uuuugcauuggcugaggagugu

SEQ ID NO: 208656 - RNA, 22 nt, Homo sapiens
uuuugcucuucggaagagcuug

SEQ ID NO: 208657 - RNA, 22 nt, Homo sapiens
uuuugcucuugguaaugaaaga

SEQ ID NO: 208658 - RNA, 19 nt, Homo sapiens
uuuugcucuuuauaccuau

SEQ ID NO: 208659 - RNA, 22 nt, Homo sapiens
uuuugcuuuuccucggucccac

SEQ ID NO: 208660 - RNA, 17 nt, Homo sapiens
uuuuggauuagaaaucc

SEQ ID NO: 208661 - RNA, 22 nt, Homo sapiens
uuuuggcacuuugucugauucu

SEQ ID NO: 208662 - RNA, 22 nt, Homo sapiens
uuuuggcuagaaauauaccucc

SEQ ID NO: 208663 - RNA, 22 nt, Homo sapiens
uuuuggcucuugguaggucaga

SEQ ID NO: 208664 - RNA, 22 nt, Homo sapiens
uuuuggcuuaaagagaauguau

SEQ ID NO: 208665 - RNA, 22 nt, Homo sapiens
uuuugguuguuggguaagagua

SEQ ID NO: 208666 - RNA, 22 nt, Homo sapiens
uuuugugacuauuguaaauggg

SEQ ID NO: 208667 - RNA, 21 nt, Homo sapiens
uuuuugggcuuucauaguguu

SEQ ID NO: 208668 - RNA, 22 nt, Homo sapiens
uuuuugugguauauugcaacaa

SEQ ID NO: 208669 - RNA, 22 nt, Homo sapiens
uuuuuuaguuagcugggcauga

SEQ ID NO: 208670 - RNA, 22 nt, Homo sapiens
uggcucuuucuagacuuaauua

SEQ ID NO: 208671 - RNA, 20 nt, Homo sapiens
uggcucuuugcugcuaaagu

SEQ ID NO: 208672 - RNA, 22 nt, Homo sapiens
uggcuguuguuacuaacaguuc

SEQ ID NO: 208673 - RNA, 22 nt, Homo sapiens
uggcuguuuauuucaccugggc

SEQ ID NO: 208674 - RNA, 22 nt, Homo sapiens
uggcuguuuauuucaccugggu

SEQ ID NO: 208675 - RNA, 20 nt, Homo sapiens
uggcuucuuaauugcaggca

SEQ ID NO: 208676 - RNA, 20 nt, Homo sapiens
ugggaaauguccaggacaua

SEQ ID NO: 208677 - RNA, 22 nt, Homo sapiens
ugggaacaugaagguuaaagag

SEQ ID NO: 208678 - RNA, 22 nt, Homo sapiens
ugggaacugaggugaaaagaca

SEQ ID NO: 208679 - RNA, 22 nt, Homo sapiens
ugggaagagggagcgauuuugg

SEQ ID NO: 208680 - RNA, 22 nt, Homo sapiens
ugggaauaugauacaggucuuu

SEQ ID NO: 208681 - RNA, 22 nt, Homo sapiens
ugggaaugaaauuacauagcuu

SEQ ID NO: 208682 - RNA, 22 nt, Homo sapiens
ugggagacuacauuuuuaacaa

SEQ ID NO: 208683 - RNA, 22 nt, Homo sapiens
ugggaugaaaauagcuucuucc

SEQ ID NO: 208684 - RNA, 22 nt, Homo sapiens
ugggaugauguuaaacguacuc

SEQ ID NO: 208685 - RNA, 22 nt, Homo sapiens
ugggauguagccuucuauuuuc

SEQ ID NO: 208686 - RNA, 22 nt, Homo sapiens
ugggcagugggacagcuuugug

SEQ ID NO: 208687 - RNA, 22 nt, Homo sapiens
ugggccgcugcaggaugguccc

SEQ ID NO: 208688 - RNA, 22 nt, Homo sapiens
ugggguagaauagaauugauau

SEQ ID NO: 208689 - RNA, 22 nt, Homo sapiens
uggguagagaaucaggaucuua

SEQ ID NO: 208690 - RNA, 22 nt, Homo sapiens
uggguagagcacugggggcgag

SEQ ID NO: 208691 - RNA, 22 nt, Homo sapiens
uggguagauaucauaguugccc

SEQ ID NO: 208692 - RNA, 21 nt, Homo sapiens
uggguaguuuucaaggccccg

SEQ ID NO: 208693 - RNA, 22 nt, Homo sapiens
ugauaugugaguauaugguuau

SEQ ID NO: 208694 - RNA, 22 nt, Homo sapiens
ugaucaaagugcuggaauuaca

SEQ ID NO: 208695 - RNA, 22 nt, Homo sapiens
ugaucuguguauauugaaccag

SEQ ID NO: 208696 - RNA, 22 nt, Homo sapiens
ugaucuuuuuaauguccauggg

SEQ ID NO: 208697 - RNA, 21 nt, Homo sapiens
ugaugcuuuucuuaaccuugc

SEQ ID NO: 208698 - RNA, 22 nt, Homo sapiens
ugauggcaauggcauucauuuu

SEQ ID NO: 208699 - RNA, 22 nt, Homo sapiens
ugauggccuguucuccauaugu

SEQ ID NO: 208700 - RNA, 22 nt, Homo sapiens
ugaugguaguucagucaaugua

SEQ ID NO: 208701 - RNA, 22 nt, Homo sapiens
ugaugguguuaccaucuuuacu

SEQ ID NO: 208702 - RNA, 22 nt, Homo sapiens
ugaugguuuuauaagggagagu

SEQ ID NO: 208703 - RNA, 22 nt, Homo sapiens
ugauguaggcauuuaagguuau

SEQ ID NO: 208704 - RNA, 20 nt, Homo sapiens
ugauguccaggcagagguuu

SEQ ID NO: 208705 - RNA, 22 nt, Homo sapiens
ugaugucuugagauggagcuua

SEQ ID NO: 208706 - RNA, 22 nt, Homo sapiens
ugaugucuugcaggcacgagau

SEQ ID NO: 208707 - RNA, 22 nt, Homo sapiens
ugauuguucuguccccaggggc

SEQ ID NO: 208708 - RNA, 22 nt, Homo sapiens
ugauuuguuucaggaguuuucu

SEQ ID NO: 208709 - RNA, 22 nt, Homo sapiens
ugcaaaguccucauucuuaccc

SEQ ID NO: 208710 - RNA, 22 nt, Homo sapiens
ugcaaaucuuguguaguuguga

SEQ ID NO: 208711 - RNA, 22 nt, Homo sapiens
ugcaaauguuaggugucauuau

SEQ ID NO: 208712 - RNA, 22 nt, Homo sapiens
ugcaacauguguaccacucugu

SEQ ID NO: 208713 - RNA, 22 nt, Homo sapiens
ugcaagacuaaaccuuccccuc

SEQ ID NO: 208714 - RNA, 22 nt, Homo sapiens
ugcaagaugauuucaauugaua

SEQ ID NO: 208715 - RNA, 22 nt, Homo sapiens
ugcaauauccucuacuauaggu

SEQ ID NO: 208716 - RNA, 22 nt, Homo sapiens
ugcaaugucuucugaggggagc

SEQ ID NO: 208717 - RNA, 17 nt, Homo sapiens
ugcaauuuaagcuagau

SEQ ID NO: 208718 - RNA, 22 nt, Homo sapiens
ugcaauuuaaugugucccaauu

SEQ ID NO: 208719 - RNA, 22 nt, Homo sapiens
ugcaccacacuccauccugggc

SEQ ID NO: 208720 - RNA, 23 nt, Homo sapiens
ugcaccacuacacacucuugggu

SEQ ID NO: 208721 - RNA, 22 nt, Homo sapiens
ugcaccacugcuagccugggua

SEQ ID NO: 208722 - RNA, 22 nt, Homo sapiens
ugcaccacuguacuccagucug

SEQ ID NO: 208723 - RNA, 22 nt, Homo sapiens
ugcaccauugcauuccagccug

SEQ ID NO: 208724 - RNA, 22 nt, Homo sapiens
ugcagaaucccuucagauccga

SEQ ID NO: 208725 - RNA, 16 nt, Homo sapiens
ugcagaguaggugaau

SEQ ID NO: 208726 - RNA, 22 nt, Homo sapiens
ugcagcacugaacuucugggcu

SEQ ID NO: 208727 - RNA, 18 nt, Homo sapiens
ugcagcaucaguacccag

SEQ ID NO: 208728 - RNA, 22 nt, Homo sapiens
ugcagcucagcugcggaguuuu

SEQ ID NO: 208729 - RNA, 22 nt, Homo sapiens
ugcaggguccauugucccaagu

SEQ ID NO: 208730 - RNA, 22 nt, Homo sapiens
ugcagguacuugacaacuuggg

SEQ ID NO: 208731 - RNA, 22 nt, Homo sapiens
ugcagugucaauaauaauuagu

SEQ ID NO: 208732 - RNA, 22 nt, Homo sapiens
ugcauacugaaauauuuuagag

SEQ ID NO: 208733 - RNA, 22 nt, Homo sapiens
ugcauagaauguucuguaaaua

SEQ ID NO: 208734 - RNA, 23 nt, Homo sapiens
ugcauaguacccaauacuuuauc

SEQ ID NO: 208735 - RNA, 21 nt, Homo sapiens
ugcauaucucuaaugaccagu

SEQ ID NO: 208736 - RNA, 22 nt, Homo sapiens
ugcauaugcagcauuuaugauu

SEQ ID NO: 208737 - RNA, 22 nt, Homo sapiens
ugcauauguauacaugugccau

SEQ ID NO: 208738 - RNA, 22 nt, Homo sapiens
ugcauaugucuuuauaguagca

SEQ ID NO: 208739 - RNA, 22 nt, Homo sapiens
ugcauauguugagaugcauauu

SEQ ID NO: 208740 - RNA, 21 nt, Homo sapiens
ugcauauuggaacuuucucuc

SEQ ID NO: 208741 - RNA, 22 nt, Homo sapiens
ugcaucacaguacuccagccug

SEQ ID NO: 208742 - RNA, 22 nt, Homo sapiens
ugcauggagauauacaguuuuu

SEQ ID NO: 208743 - RNA, 22 nt, Homo sapiens
ugcauggauguuugaacacacu

SEQ ID NO: 208744 - RNA, 22 nt, Homo sapiens
ugcauggucauacauggcaccc

SEQ ID NO: 208745 - RNA, 22 nt, Homo sapiens
ugcauuagucuguucucacacu

SEQ ID NO: 208746 - RNA, 20 nt, Homo sapiens
ugccaagaaaugaggguauu

SEQ ID NO: 208747 - RNA, 20 nt, Homo sapiens
ugccaagaugacuauagcuc

SEQ ID NO: 208748 - RNA, 22 nt, Homo sapiens
ugccaagauuucaggaauuaag

SEQ ID NO: 208749 - RNA, 22 nt, Homo sapiens
ugccaaggagucagucccuaga

SEQ ID NO: 208750 - RNA, 22 nt, Homo sapiens
ugccagaugcuggugugagggg

SEQ ID NO: 208751 - RNA, 22 nt, Homo sapiens
ugccaguguuuuguugaagauu

SEQ ID NO: 208752 - RNA, 22 nt, Homo sapiens
ugccaguuuuuacauuuccugu

SEQ ID NO: 208753 - RNA, 22 nt, Homo sapiens
ugcccuuugucagaugaguagg

SEQ ID NO: 208754 - RNA, 22 nt, Homo sapiens
ugccuacagaaggggcucagca

SEQ ID NO: 208755 - RNA, 22 nt, Homo sapiens
ugccuacugagacuggguggcc

SEQ ID NO: 208756 - RNA, 22 nt, Homo sapiens
ugccuacuuugcaucugucagg

SEQ ID NO: 208757 - RNA, 22 nt, Homo sapiens
ugccuaggcccaguccucagaa

SEQ ID NO: 208758 - RNA, 22 nt, Homo sapiens
ugccuaguggaaggagagcaaa

SEQ ID NO: 208759 - RNA, 22 nt, Homo sapiens
ugccuaguguguugagaguuuu

SEQ ID NO: 208760 - RNA, 22 nt, Homo sapiens
ugccugagcccagcccuguagu

SEQ ID NO: 208761 - RNA, 22 nt, Homo sapiens
ugccugauacccucugucucuc

SEQ ID NO: 208762 - RNA, 22 nt, Homo sapiens
ugccugcugucuaauauauucu

SEQ ID NO: 208763 - RNA, 22 nt, Homo sapiens
ugcgccauugcauuccagccug

SEQ ID NO: 208764 - RNA, 22 nt, Homo sapiens
ugcuacccuucgucucucuggu

SEQ ID NO: 208765 - RNA, 22 nt, Homo sapiens
ugcuauguccccacccaaaucu

SEQ ID NO: 208766 - RNA, 16 nt, Homo sapiens
ugcuauguuggccagg

SEQ ID NO: 208767 - RNA, 21 nt, Homo sapiens
ugcucaugaguaaugcaguga

SEQ ID NO: 208768 - RNA, 21 nt, Homo sapiens
ugcuccauuuucuagccugaa

SEQ ID NO: 208769 - RNA, 22 nt, Homo sapiens
ugcugcaaacaugagaggaagu

SEQ ID NO: 208770 - RNA, 20 nt, Homo sapiens
ugcugcacuuaagcaugggc

SEQ ID NO: 208771 - RNA, 22 nt, Homo sapiens
ugcuggcguuacucuccaucag

SEQ ID NO: 208772 - RNA, 22 nt, Homo sapiens
ugcugguaguuuaugacuaauu

SEQ ID NO: 208773 - RNA, 22 nt, Homo sapiens
ugcugguauuauguuauccaga

SEQ ID NO: 208774 - RNA, 22 nt, Homo sapiens
ugcugguauuuggaccagccug

SEQ ID NO: 208775 - RNA, 22 nt, Homo sapiens
ugcugguuuucaucaucagugg

SEQ ID NO: 208776 - RNA, 22 nt, Homo sapiens
ugcuguuguuugaugaaguaau

SEQ ID NO: 208777 - RNA, 22 nt, Homo sapiens
uuuccuggagaaucuuaacaaa

SEQ ID NO: 208778 - RNA, 22 nt, Homo sapiens
uuuccuguagggggcaaggccu

SEQ ID NO: 208779 - RNA, 22 nt, Homo sapiens
uuucugagaccaaaacuuguaa

SEQ ID NO: 208780 - RNA, 22 nt, Homo sapiens
uuucuuggagcucuuagggucg

SEQ ID NO: 208781 - RNA, 22 nt, Homo sapiens
uuucuugguuguauuuagacuu

SEQ ID NO: 208782 - RNA, 22 nt, Homo sapiens
uuugaagugugaugccuugaug

SEQ ID NO: 208783 - RNA, 22 nt, Homo sapiens
uuugaauggaaguuuugugaaa

SEQ ID NO: 208784 - RNA, 20 nt, Homo sapiens
uuugaauguaaagcauguca

SEQ ID NO: 208785 - RNA, 22 nt, Homo sapiens
uuugacuaccaggaauguucuu

SEQ ID NO: 208786 - RNA, 22 nt, Homo sapiens
uuugacuagaguguuuuacaac

SEQ ID NO: 208787 - RNA, 22 nt, Homo sapiens
uuugacucacagccuggcugcc

SEQ ID NO: 208788 - RNA, 22 nt, Homo sapiens
uuugacuuuuagaauaugaguu

SEQ ID NO: 208789 - RNA, 22 nt, Homo sapiens
uuugagaaugcuaccagagaag

SEQ ID NO: 208790 - RNA, 22 nt, Homo sapiens
uuugagauaucuuccaucagua

SEQ ID NO: 208791 - RNA, 22 nt, Homo sapiens
uuugaugcaucucuacuuuguu

SEQ ID NO: 208792 - RNA, 22 nt, Homo sapiens
uuugauguugagacuauaaagc

SEQ ID NO: 208793 - RNA, 22 nt, Homo sapiens
uuugauguugauacuaccuuca

SEQ ID NO: 208794 - RNA, 22 nt, Homo sapiens
uuugauuguacuaaaauuguac

SEQ ID NO: 208795 - RNA, 22 nt, Homo sapiens
uuugcacucaguaagugggagc

SEQ ID NO: 208796 - RNA, 22 nt, Homo sapiens
uuugcacuuuaauauaauguga

SEQ ID NO: 208797 - RNA, 20 nt, Homo sapiens
uuugcagaaucuaagaagag

SEQ ID NO: 208798 - RNA, 22 nt, Homo sapiens
uuugcaguguaguuggccagca

SEQ ID NO: 208799 - RNA, 22 nt, Homo sapiens
uuugcaguuuauuccuggggcu

SEQ ID NO: 208800 - RNA, 22 nt, Homo sapiens
uuugcauaauaagauuagggug

SEQ ID NO: 208801 - RNA, 22 nt, Homo sapiens
uuugcaucuuagaaaguucucc

SEQ ID NO: 208802 - RNA, 19 nt, Homo sapiens
uuugccuaggcacauggcc

SEQ ID NO: 208803 - RNA, 22 nt, Homo sapiens
uuugcuuaguaaauguagaaaa

SEQ ID NO: 208804 - RNA, 22 nt, Homo sapiens
uuugcuuguguaaaaaucugga

SEQ ID NO: 208805 - RNA, 22 nt, Homo sapiens
uuuggcaaagaucaacauguua

SEQ ID NO: 208806 - RNA, 22 nt, Homo sapiens
uuuggcaauaaacuccccuaac

SEQ ID NO: 208807 - RNA, 22 nt, Homo sapiens
uuuggcagaaaacaagaaucug

SEQ ID NO: 208808 - RNA, 22 nt, Homo sapiens
uuuggcaugggcuauuugcuuu

SEQ ID NO: 208809 - RNA, 22 nt, Homo sapiens
uuuggcuauguuguaucuuucc

SEQ ID NO: 208810 - RNA, 18 nt, Homo sapiens
uuuggcuguucaugacuc

SEQ ID NO: 208811 - RNA, 22 nt, Homo sapiens
uuuggcuguuucuggacuaaga

SEQ ID NO: 208812 - RNA, 21 nt, Homo sapiens
uuuggcuucucugcugcagcc

SEQ ID NO: 208813 - RNA, 22 nt, Homo sapiens
uuugggaaaugaaguugguaga

SEQ ID NO: 208814 - RNA, 22 nt, Homo sapiens
uuugggaaugaguuuaucauuu

SEQ ID NO: 208815 - RNA, 22 nt, Homo sapiens
uucuggcucgauucucugaccg

SEQ ID NO: 208816 - RNA, 22 nt, Homo sapiens
uucugugcugaaucaaagacug

SEQ ID NO: 208817 - RNA, 22 nt, Homo sapiens
uucugugguugaaaggagagau

SEQ ID NO: 208818 - RNA, 22 nt, Homo sapiens
uucuguguuuaggucacggcua

SEQ ID NO: 208819 - RNA, 22 nt, Homo sapiens
uucuuagucauguaauagucca

SEQ ID NO: 208820 - RNA, 22 nt, Homo sapiens
uucuucaggcauucccagaagc

SEQ ID NO: 208821 - RNA, 22 nt, Homo sapiens
uucuugaggcaugccgcuggga

SEQ ID NO: 208822 - RNA, 20 nt, Homo sapiens
uucuugaguuaacaaguuac

SEQ ID NO: 208823 - RNA, 22 nt, Homo sapiens
uucuugcuguauccucacaugg

SEQ ID NO: 208824 - RNA, 22 nt, Homo sapiens
uucuuugcuuggaagcggggga

SEQ ID NO: 208825 - RNA, 22 nt, Homo sapiens
uucuuuggauaaaguuuuaugc

SEQ ID NO: 208826 - RNA, 23 nt, Homo sapiens
uugaaaagucaguagccucugau

SEQ ID NO: 208827 - RNA, 22 nt, Homo sapiens
uugaaagucauggcacaggcaa

SEQ ID NO: 208828 - RNA, 22 nt, Homo sapiens
uugaacuagaaccugcaaauuu

SEQ ID NO: 208829 - RNA, 22 nt, Homo sapiens
uugaaguagguaccguucaauu

SEQ ID NO: 208830 - RNA, 22 nt, Homo sapiens
uugaaguaugaccgcugagaau

SEQ ID NO: 208831 - RNA, 22 nt, Homo sapiens
uugaaguguguauacauugugg

SEQ ID NO: 208832 - RNA, 22 nt, Homo sapiens
uugaauagaagguuuuuuguuc

SEQ ID NO: 208833 - RNA, 22 nt, Homo sapiens
uugaauagaaguguugaaagug

SEQ ID NO: 208834 - RNA, 22 nt, Homo sapiens
uugaauagcauguuuagugcau

SEQ ID NO: 208835 - RNA, 22 nt, Homo sapiens
uugaauaguggugaaaguuuga

SEQ ID NO: 208836 - RNA, 22 nt, Homo sapiens
uugaaugucuauuaaguuguuu

SEQ ID NO: 208837 - RNA, 22 nt, Homo sapiens
uugacaaguuguccaguaugag

SEQ ID NO: 208838 - RNA, 22 nt, Homo sapiens
uugacacuaauuauuauaggug

SEQ ID NO: 208839 - RNA, 22 nt, Homo sapiens
uugacacuuuguaagaaagggg

SEQ ID NO: 208840 - RNA, 22 nt, Homo sapiens
uugacaguugggcagggaaguu

SEQ ID NO: 208841 - RNA, 22 nt, Homo sapiens
uugacauauuugugcuuaagaa

SEQ ID NO: 208842 - RNA, 22 nt, Homo sapiens
uugacauguaaguacucuauag

SEQ ID NO: 208843 - RNA, 22 nt, Homo sapiens
uugacauguaggcagggaaugg

SEQ ID NO: 208844 - RNA, 22 nt, Homo sapiens
uugaccccuucuaauagccuca

SEQ ID NO: 208845 - RNA, 22 nt, Homo sapiens
uugggauggaacuuuucaguga

SEQ ID NO: 208846 - RNA, 22 nt, Homo sapiens
uugggcaaguggcaugaccaug

SEQ ID NO: 208847 - RNA, 22 nt, Homo sapiens
uugggcauugggcuaaacuccc

SEQ ID NO: 208848 - RNA, 22 nt, Homo sapiens
uugggcuuuuagguccuuaaca

SEQ ID NO: 208849 - RNA, 22 nt, Homo sapiens
uuggguagugaguuccuccagg

SEQ ID NO: 208850 - RNA, 22 nt, Homo sapiens
uugguccucccaugcucaagag

SEQ ID NO: 208851 - RNA, 22 nt, Homo sapiens
uugguucucuuagccaucuuaa

SEQ ID NO: 208852 - RNA, 22 nt, Homo sapiens
uugguuuccuuccugcuuaacu

SEQ ID NO: 208853 - RNA, 22 nt, Homo sapiens
uuguaacaguucugcgagcagc

SEQ ID NO: 208854 - RNA, 22 nt, Homo sapiens
uuguaacaugcuuucacuucag

SEQ ID NO: 208855 - RNA, 22 nt, Homo sapiens
uuguaauguuaggguguccaug

SEQ ID NO: 208856 - RNA, 23 nt, Homo sapiens
uuguacacuaagaaucgcagaug

SEQ ID NO: 208857 - RNA, 22 nt, Homo sapiens
uuguacuauuuuuaucagugau

SEQ ID NO: 208858 - RNA, 20 nt, Homo sapiens
uuguacuccugggcucaagc

SEQ ID NO: 208859 - RNA, 22 nt, Homo sapiens
uuguacuucagacaugccaaag

SEQ ID NO: 208860 - RNA, 22 nt, Homo sapiens
uuguagcuuuuuaaugugcugc

SEQ ID NO: 208861 - RNA, 22 nt, Homo sapiens
uuguaguagucucguucuuuua

SEQ ID NO: 208862 - RNA, 22 nt, Homo sapiens
uuguaugucuucauuugaaaaa

SEQ ID NO: 208863 - RNA, 22 nt, Homo sapiens
uugucaacaugaaacuguguuu

SEQ ID NO: 208864 - RNA, 22 nt, Homo sapiens
uugucauggucuugauccauua

SEQ ID NO: 208865 - RNA, 21 nt, Homo sapiens
uuguccccacccaaaucucau

SEQ ID NO: 208866 - RNA, 19 nt, Homo sapiens
uuguccccucuaaaucuca

SEQ ID NO: 208867 - RNA, 22 nt, Homo sapiens
uuguccuccacauuugaucagu

SEQ ID NO: 208868 - RNA, 21 nt, Homo sapiens
uugucuagagaaauauaucuc

SEQ ID NO: 208869 - RNA, 22 nt, Homo sapiens
uugugcaaaguugugguuucug

SEQ ID NO: 208870 - RNA, 22 nt, Homo sapiens
uugugcacauguacccuagaac

SEQ ID NO: 208871 - RNA, 22 nt, Homo sapiens
uugugccauucuucugccucag

SEQ ID NO: 208872 - RNA, 22 nt, Homo sapiens
uugugcuugcuguguucuaugc

SEQ ID NO: 208873 - RNA, 22 nt, Homo sapiens
uugugcuuguaacuacauucag

SEQ ID NO: 208874 - RNA, 22 nt, Homo sapiens
uugugcuuuacuuacuaccaga

SEQ ID NO: 208875 - RNA, 22 nt, Homo sapiens
uugugcuuuugagcugagauga

SEQ ID NO: 208876 - RNA, 22 nt, Homo sapiens
uugugguuuuaucuaccuuugg

SEQ ID NO: 208877 - RNA, 22 nt, Homo sapiens
uugugguuuucagcuuauauau

SEQ ID NO: 208878 - RNA, 22 nt, Homo sapiens
uugugucccuacccaaaucuca

SEQ ID NO: 208879 - RNA, 22 nt, Homo sapiens
uugugucccugcggcugaggag

SEQ ID NO: 208880 - RNA, 22 nt, Homo sapiens
uuguuauguuaaacuacugaaa

SEQ ID NO: 208881 - RNA, 22 nt, Homo sapiens
uuguucaggagguuggggaugc

SEQ ID NO: 208882 - RNA, 22 nt, Homo sapiens
uuguuugguuagaugggcaagu

SEQ ID NO: 208883 - RNA, 22 nt, Homo sapiens
uuguuugguugaguauggaagu

SEQ ID NO: 208884 - RNA, 22 nt, Homo sapiens
uuuaaagcuaaaauauguuuau

SEQ ID NO: 208885 - RNA, 22 nt, Homo sapiens
uuuaaaguuagaaggaaagggc

SEQ ID NO: 208886 - RNA, 20 nt, Homo sapiens
uuuaagacaugcugaauuga

SEQ ID NO: 208887 - RNA, 22 nt, Homo sapiens
uuuaagccaggugcaguggcuc

SEQ ID NO: 208888 - RNA, 23 nt, Homo sapiens
uuuaagcuucauguccuaacauc

SEQ ID NO: 208889 - RNA, 22 nt, Homo sapiens
uuuaaggcaugccuguacaugc

SEQ ID NO: 208890 - RNA, 22 nt, Homo sapiens
uuuaauacugcaucuuuacucu

SEQ ID NO: 208891 - RNA, 22 nt, Homo sapiens
uuuacagucuuuugugugaguc

SEQ ID NO: 208892 - RNA, 22 nt, Homo sapiens
uuuacaguuuucuaggcuacca

SEQ ID NO: 208893 - RNA, 22 nt, Homo sapiens
uuuacugugggguuucuuagag

SEQ ID NO: 208894 - RNA, 19 nt, Homo sapiens
uuuagaucuuuuaugcagc

SEQ ID NO: 208895 - RNA, 22 nt, Homo sapiens
uuuaggcaugcaguucuauuua

SEQ ID NO: 208896 - RNA, 22 nt, Homo sapiens
uuuagggcaggccuggugguga

SEQ ID NO: 208897 - RNA, 22 nt, Homo sapiens
uuuauagucaggaacuugagga

SEQ ID NO: 208898 - RNA, 22 nt, Homo sapiens
uuuaugagguagagugguuuau

SEQ ID NO: 208899 - RNA, 22 nt, Homo sapiens
uuuaugucuguacaucgggcgg

SEQ ID NO: 208900 - RNA, 22 nt, Homo sapiens
uuuauucggcuaggagcuucgg

SEQ ID NO: 208901 - RNA, 18 nt, Homo sapiens
uuucaagucuuaggugac

SEQ ID NO: 208902 - RNA, 19 nt, Homo sapiens
uuucaauguaaggauggag

SEQ ID NO: 208903 - RNA, 22 nt, Homo sapiens
uuucagagucaucugcccaagu

SEQ ID NO: 208904 - RNA, 22 nt, Homo sapiens
uuucagcguggggugcugaaga

SEQ ID NO: 208905 - RNA, 15 nt, Homo sapiens
uuucaguacagauuc

SEQ ID NO: 208906 - RNA, 22 nt, Homo sapiens
uuucauaguuugcauagggcau

SEQ ID NO: 208907 - RNA, 22 nt, Homo sapiens
uuucaucagccagggucagucu

SEQ ID NO: 208908 - RNA, 22 nt, Homo sapiens
uuucauggaggauuugcuucuu

SEQ ID NO: 208909 - RNA, 19 nt, Homo sapiens
uuuccaguaaucuuaugug

SEQ ID NO: 208910 - RNA, 22 nt, Homo sapiens
uuucccagugguacaguuuaua

SEQ ID NO: 208911 - RNA, 22 nt, Homo sapiens
uuucccuuacuuaaacuuacuc

SEQ ID NO: 208912 - RNA, 22 nt, Homo sapiens
ugacagcugaagauguugaacc

SEQ ID NO: 208913 - RNA, 23 nt, Homo sapiens
ugacagucucccgauggcuaggc

SEQ ID NO: 208914 - RNA, 18 nt, Homo sapiens
ugacaguuucuuuauauu

SEQ ID NO: 208915 - RNA, 20 nt, Homo sapiens
ugacaucagcaauguaauaa

SEQ ID NO: 208916 - RNA, 18 nt, Homo sapiens
ugacaucauuuagaaagg

SEQ ID NO: 208917 - RNA, 19 nt, Homo sapiens
ugacaugaaacccaagauc

SEQ ID NO: 208918 - RNA, 22 nt, Homo sapiens
ugacaugaugagcaauaauggc

SEQ ID NO: 208919 - RNA, 23 nt, Homo sapiens
ugacauguaauucaguccagcag

SEQ ID NO: 208920 - RNA, 22 nt, Homo sapiens
ugacauguagagaacuucucau

SEQ ID NO: 208921 - RNA, 21 nt, Homo sapiens
ugacauguuggugugcugcac

SEQ ID NO: 208922 - RNA, 21 nt, Homo sapiens
ugacauuauuucaugucagua

SEQ ID NO: 208923 - RNA, 22 nt, Homo sapiens
ugaccacagaaagugagggagc

SEQ ID NO: 208924 - RNA, 22 nt, Homo sapiens
ugaccagaaaacaaauuaguuu

SEQ ID NO: 208925 - RNA, 22 nt, Homo sapiens
ugacccauagaaauguggauaa

SEQ ID NO: 208926 - RNA, 22 nt, Homo sapiens
aaaagcuuagaugggcuuguau

SEQ ID NO: 208927 - RNA, 22 nt, Homo sapiens
aaaagugguguuguuucuaaau

SEQ ID NO: 208928 - RNA, 18 nt, Homo sapiens
aaacagugucucuuucug

SEQ ID NO: 208929 - RNA, 22 nt, Homo sapiens
aaaccaccauuacuuuugcacc

SEQ ID NO: 208930 - RNA, 22 nt, Homo sapiens
aaacugccuuccuuguaggugc

SEQ ID NO: 208931 - RNA, 22 nt, Homo sapiens
aaacugcuuuccaugguggcug

SEQ ID NO: 208932 - RNA, 22 nt, Homo sapiens
aaagaagucagccuguccuuug

SEQ ID NO: 208933 - RNA, 22 nt, Homo sapiens
aaagaguucagguagauuucaa

SEQ ID NO: 208934 - RNA, 22 nt, Homo sapiens
aaaggaccacauauaugguggc

SEQ ID NO: 208935 - RNA, 22 nt, Homo sapiens
aaaggcacacacuccuuguuau

SEQ ID NO: 208936 - RNA, 22 nt, Homo sapiens
aaaggcacugugacuuuauagg

SEQ ID NO: 208937 - RNA, 22 nt, Homo sapiens
aaagggcuuuguaaacuucaag

SEQ ID NO: 208938 - RNA, 22 nt, Homo sapiens
aaagugauuguaguuuuugcca

SEQ ID NO: 208939 - RNA, 22 nt, Homo sapiens
aaagugcaguacuucguauauu

SEQ ID NO: 208940 - RNA, 22 nt, Homo sapiens
aaagugcaguauuugggcagga

SEQ ID NO: 208941 - RNA, 22 nt, Homo sapiens
aaagugccugacucauaguuag

SEQ ID NO: 208942 - RNA, 22 nt, Homo sapiens
aaagugccuucuauuuuaguga

SEQ ID NO: 208943 - RNA, 22 nt, Homo sapiens
aaagugcuaggauuaccugggg

SEQ ID NO: 208944 - RNA, 22 nt, Homo sapiens
aaagugcugggauuggcugggc

SEQ ID NO: 208945 - RNA, 22 nt, Homo sapiens
aaagugcugggauuuuaggcau

SEQ ID NO: 208946 - RNA, 22 nt, Homo sapiens
aaagugcuuacuaaguugccaa

SEQ ID NO: 208947 - RNA, 22 nt, Homo sapiens
aaagugcuuccuuuuugagggu

SEQ ID NO: 208948 - RNA, 22 nt, Homo sapiens
aaaguggacuaagugaauauga

SEQ ID NO: 208949 - RNA, 22 nt, Homo sapiens
aaagugguuuuucagacuuuga

SEQ ID NO: 208950 - RNA, 22 nt, Homo sapiens
aaaguguuucugcaguagguuu

SEQ ID NO: 208951 - RNA, 22 nt, Homo sapiens
aaauaacugucagguucuggaa

SEQ ID NO: 208952 - RNA, 22 nt, Homo sapiens
aaauaguagcugaaugagggaa

SEQ ID NO: 208953 - RNA, 15 nt, Homo sapiens
aaauaugucaguucu

SEQ ID NO: 208954 - RNA, 22 nt, Homo sapiens
aaaucccuugcucucucagacc

SEQ ID NO: 208955 - RNA, 21 nt, Homo sapiens
aaaugcacauuacugcuggug

SEQ ID NO: 208956 - RNA, 22 nt, Homo sapiens
aaaugcagauuccuaggcccca

SEQ ID NO: 208957 - RNA, 22 nt, Homo sapiens
aaaugcaugaauaagcucgugu

SEQ ID NO: 208958 - RNA, 22 nt, Homo sapiens
aaaugcauugagggaaaaggca

SEQ ID NO: 208959 - RNA, 18 nt, Homo sapiens
aaaugcucuucuggaaua

SEQ ID NO: 208960 - RNA, 22 nt, Homo sapiens
aaaugcugucaaauuguguucu

SEQ ID NO: 208961 - RNA, 22 nt, Homo sapiens
aaaugcuguuccaggaccuauc

SEQ ID NO: 208962 - RNA, 22 nt, Homo sapiens
aaauggcuuugaggguaggaca

SEQ ID NO: 208963 - RNA, 22 nt, Homo sapiens
aaauugcaaugcgaggcagagg

SEQ ID NO: 208964 - RNA, 22 nt, Homo sapiens
aaauugcacaaguggugauuug

SEQ ID NO: 208965 - RNA, 23 nt, Homo sapiens
aaauuugccuauuauuccuaugg

SEQ ID NO: 208966 - RNA, 22 nt, Homo sapiens
aguucaauggguuuucacucau

SEQ ID NO: 208967 - RNA, 21 nt, Homo sapiens
aguucacauggcuccuguguu

SEQ ID NO: 208968 - RNA, 22 nt, Homo sapiens
aguuggcacugagcugugauug

SEQ ID NO: 208969 - RNA, 22 nt, Homo sapiens
aguuuuugcugauagcaugcuu

SEQ ID NO: 208970 - RNA, 22 nt, Homo sapiens
auaaaccuacauuuucacuucu

SEQ ID NO: 208971 - RNA, 17 nt, Homo sapiens
auaaacucaucauuuuu

SEQ ID NO: 208972 - RNA, 22 nt, Homo sapiens
auaaagacacuuggcaugauuu

SEQ ID NO: 208973 - RNA, 22 nt, Homo sapiens
auaaagcaagucucuggccuca

SEQ ID NO: 208974 - RNA, 22 nt, Homo sapiens
auaaagcuauuccucucuuuuu

SEQ ID NO: 208975 - RNA, 22 nt, Homo sapiens
auaaaguagaggugaggugcau

SEQ ID NO: 208976 - RNA, 22 nt, Homo sapiens
auaaaugcuuagaucuguauau

SEQ ID NO: 208977 - RNA, 22 nt, Homo sapiens
auaaaugcuuccagucauuaaa

SEQ ID NO: 208978 - RNA, 22 nt, Homo sapiens
auaacauccuuucuuaucguug

SEQ ID NO: 208979 - RNA, 22 nt, Homo sapiens
auaacucuguuuuuuucaugca

SEQ ID NO: 208980 - RNA, 22 nt, Homo sapiens
auaagaagugaaccagacgucu

SEQ ID NO: 208981 - RNA, 22 nt, Homo sapiens
auaagguuagcucugagaaagu

SEQ ID NO: 208982 - RNA, 22 nt, Homo sapiens
auaaguaguaaagcagugacua

SEQ ID NO: 208983 - RNA, 22 nt, Homo sapiens
auaauacuuuuauuuugaggaa

SEQ ID NO: 208984 - RNA, 22 nt, Homo sapiens
auaauaucagguugugaugaug

SEQ ID NO: 208985 - RNA, 22 nt, Homo sapiens
gucccugaggaacauccagggc

SEQ ID NO: 208986 - RNA, 22 nt, Homo sapiens
gucccugugucuuuauguggcc

SEQ ID NO: 208987 - RNA, 22 nt, Homo sapiens
guccuguuuuuaagguucauag

SEQ ID NO: 208988 - RNA, 22 nt, Homo sapiens
gucucauugcaguuagaccugu

SEQ ID NO: 208989 - RNA, 22 nt, Homo sapiens
gucucccaaccccugugcccag

SEQ ID NO: 208990 - RNA, 22 nt, Homo sapiens
gucugcaugucauaugauagua

SEQ ID NO: 208991 - RNA, 22 nt, Homo sapiens
gucuggcaauggcagacuggca

SEQ ID NO: 208992 - RNA, 21 nt, Homo sapiens
gucugguguuuuaaugaggac

SEQ ID NO: 208993 - RNA, 22 nt, Homo sapiens
gucugguuccugggagauuucu

SEQ ID NO: 208994 - RNA, 22 nt, Homo sapiens
gucugguugacagcauguggcc

SEQ ID NO: 208995 - RNA, 22 nt, Homo sapiens
gucugguuggaguaguuuucag

SEQ ID NO: 208996 - RNA, 22 nt, Homo sapiens
gucugguuuuuuauauccucac

SEQ ID NO: 208997 - RNA, 22 nt, Homo sapiens
gucugugguuccuaugucaccu

SEQ ID NO: 208998 - RNA, 22 nt, Homo sapiens
gucuguuugauccagaucaaaa

SEQ ID NO: 208999 - RNA, 21 nt, Homo sapiens
gucuuacagccagaugccucu

SEQ ID NO: 209000 - RNA, 22 nt, Homo sapiens
gucuugcacuuaccuaagaacu

SEQ ID NO: 209001 - RNA, 20 nt, Homo sapiens
gucuugcuccguugcccagg

SEQ ID NO: 209002 - RNA, 22 nt, Homo sapiens
gucuuggcaugugcagcuggga

SEQ ID NO: 209003 - RNA, 22 nt, Homo sapiens
gucuuuggaaaaaaugucuguu

SEQ ID NO: 209004 - RNA, 22 nt, Homo sapiens
gucuuuguuauuaugaaucaac

SEQ ID NO: 209005 - RNA, 22 nt, Homo sapiens
gugaaagcaucugacugugcca

SEQ ID NO: 209006 - RNA, 22 nt, Homo sapiens
gugaaaugaaacgcuaugucuu

SEQ ID NO: 209007 - RNA, 22 nt, Homo sapiens
gugaacaauguuuuauccuggg

SEQ ID NO: 209008 - RNA, 22 nt, Homo sapiens
gugacagaguaagacccuguau

SEQ ID NO: 209009 - RNA, 22 nt, Homo sapiens
gugacauuuuuacugaugagag

SEQ ID NO: 209010 - RNA, 22 nt, Homo sapiens
gugagaagaaaaauauggcugu

SEQ ID NO: 209011 - RNA, 22 nt, Homo sapiens
gugagagaaugacuauguguuu

SEQ ID NO: 209012 - RNA, 16 nt, Homo sapiens
gugagagaugacaaac

SEQ ID NO: 209013 - RNA, 22 nt, Homo sapiens
gugagaggaggcagcuuuuaca

SEQ ID NO: 209014 - RNA, 19 nt, Homo sapiens
gugagcaaugcauugcacu

SEQ ID NO: 209015 - RNA, 22 nt, Homo sapiens
gugagcacugaaagaaggcaag

SEQ ID NO: 209016 - RNA, 22 nt, Homo sapiens
gugagcauauuaguauugcacu

SEQ ID NO: 209017 - RNA, 22 nt, Homo sapiens
gugagcauuacucaugggauca

SEQ ID NO: 209018 - RNA, 22 nt, Homo sapiens
gugagccaugauuuuaccacug

SEQ ID NO: 209019 - RNA, 22 nt, Homo sapiens
gugaggcuuuuccuguuagacu

SEQ ID NO: 209020 - RNA, 22 nt, Homo sapiens
gugagggaugugaaaaagguca

SEQ ID NO: 209021 - RNA, 22 nt, Homo sapiens
gugagguaauuagcucccuuag

SEQ ID NO: 209022 - RNA, 17 nt, Homo sapiens
gugagguggguaguauc

SEQ ID NO: 209023 - RNA, 22 nt, Homo sapiens
gugaguuauuauuuauguaaac

SEQ ID NO: 209024 - RNA, 22 nt, Homo sapiens
gugauauguuaggaucuaaguc

SEQ ID NO: 209025 - RNA, 21 nt, Homo sapiens
gugaucaugucacugcacucc

SEQ ID NO: 209026 - RNA, 22 nt, Homo sapiens
caucccugaaccccagaaaucu

SEQ ID NO: 209027 - RNA, 19 nt, Homo sapiens
caucccugagcugaagugg

SEQ ID NO: 209028 - RNA, 22 nt, Homo sapiens
caucgcacuccagccugggcaa

SEQ ID NO: 209029 - RNA, 22 nt, Homo sapiens
caugacacauguuuaccuaugu

SEQ ID NO: 209030 - RNA, 22 nt, Homo sapiens
caugcagcacacaugucugugc

SEQ ID NO: 209031 - RNA, 22 nt, Homo sapiens
caugccacugcacuccaaccug

SEQ ID NO: 209032 - RNA, 22 nt, Homo sapiens
cauggcacagagaauguguucu

SEQ ID NO: 209033 - RNA, 22 nt, Homo sapiens
cauggcacaucuuuucugacua

SEQ ID NO: 209034 - RNA, 22 nt, Homo sapiens
cauggcacuggugggagugucu

SEQ ID NO: 209035 - RNA, 22 nt, Homo sapiens
cauggcacuguaugaaaugugc

SEQ ID NO: 209036 - RNA, 22 nt, Homo sapiens
cauggcauuugcagaguugaaa

SEQ ID NO: 209037 - RNA, 22 nt, Homo sapiens
cauggcccugggcugggcgaac

SEQ ID NO: 209038 - RNA, 22 nt, Homo sapiens
cauggcucuuugcugcuaaagu

SEQ ID NO: 209039 - RNA, 22 nt, Homo sapiens
cauggcuuuaagcaacaccaag

SEQ ID NO: 209040 - RNA, 22 nt, Homo sapiens
cauggcuuucacaguaaagccu

SEQ ID NO: 209041 - RNA, 22 nt, Homo sapiens
caugggcacugacuugcauucg

SEQ ID NO: 209042 - RNA, 22 nt, Homo sapiens
cauguauagauuccauaguggu

SEQ ID NO: 209043 - RNA, 22 nt, Homo sapiens
caugucuuuuauucugugugau

SEQ ID NO: 209044 - RNA, 22 nt, Homo sapiens
caugugcaugagcacauacgug

SEQ ID NO: 209045 - RNA, 22 nt, Homo sapiens
cauuacacuccagccuggguga

SEQ ID NO: 209046 - RNA, 22 nt, Homo sapiens
cauuccacauguaggacaauuu

SEQ ID NO: 209047 - RNA, 22 nt, Homo sapiens
cauugcacuccaccuuggguaa

SEQ ID NO: 209048 - RNA, 22 nt, Homo sapiens
cauugcacuccagccuaggcaa

SEQ ID NO: 209049 - RNA, 22 nt, Homo sapiens
cauugcacuccagccucggcaa

SEQ ID NO: 209050 - RNA, 22 nt, Homo sapiens
cauugcacuccagccugaccaa

SEQ ID NO: 209051 - RNA, 22 nt, Homo sapiens
cauugcacuccagccugcacga

SEQ ID NO: 209052 - RNA, 20 nt, Homo sapiens
cauugcacuccagcuugggc

SEQ ID NO: 209053 - RNA, 17 nt, Homo sapiens
uauagcacuucucacau

SEQ ID NO: 209054 - RNA, 22 nt, Homo sapiens
uauaguguuuucaaaaguaugu

SEQ ID NO: 209055 - RNA, 22 nt, Homo sapiens
uauaugucugagacugggggau

SEQ ID NO: 209056 - RNA, 22 nt, Homo sapiens
uauaugucuucuuguaauuggc

SEQ ID NO: 209057 - RNA, 22 nt, Homo sapiens
uauauguucuugcacuggaaag

SEQ ID NO: 209058 - RNA, 22 nt, Homo sapiens
uaucaaggccacucauuuuaug

SEQ ID NO: 209059 - RNA, 19 nt, Homo sapiens
uaucaaguaugcacuguac

SEQ ID NO: 209060 - RNA, 22 nt, Homo sapiens
uaucacagaggguauccuagag

SEQ ID NO: 209061 - RNA, 22 nt, Homo sapiens
uaucacagugcuggaguauucc

SEQ ID NO: 209062 - RNA, 21 nt, Homo sapiens
uaucacauuggugauuaaguu

SEQ ID NO: 209063 - RNA, 22 nt, Homo sapiens
uaucacccuuucauuguucuuc

SEQ ID NO: 209064 - RNA, 22 nt, Homo sapiens
uaucaccuugcaggagcuauga

SEQ ID NO: 209065 - RNA, 19 nt, Homo sapiens
uaucacuucccuggaaaca

SEQ ID NO: 209066 - RNA, 22 nt, Homo sapiens
uaucacuuugauaguuuaaaug

SEQ ID NO: 209067 - RNA, 22 nt, Homo sapiens
uaucauaguuuggacuuucauu

SEQ ID NO: 209068 - RNA, 22 nt, Homo sapiens
uaucauggaaagauguugaaau

SEQ ID NO: 209069 - RNA, 21 nt, Homo sapiens
uaucauggugaaacccugucu

SEQ ID NO: 209070 - RNA, 22 nt, Homo sapiens
uaucauugccucaaucuguauu

SEQ ID NO: 209071 - RNA, 21 nt, Homo sapiens
uaucccagucacaucuaccca

SEQ ID NO: 209072 - RNA, 22 nt, Homo sapiens
uauccugaagcuuuauuuaagu

SEQ ID NO: 209073 - RNA, 22 nt, Homo sapiens
uaucucaguguacaggaugaua

SEQ ID NO: 209074 - RNA, 22 nt, Homo sapiens
uaucucuuuucauguguaaaug

SEQ ID NO: 209075 - RNA, 22 nt, Homo sapiens
uaucugcacauacacuuauagc

SEQ ID NO: 209076 - RNA, 22 nt, Homo sapiens
uaucugcaucccauuuuuauca

SEQ ID NO: 209077 - RNA, 22 nt, Homo sapiens
uaugaaacucuaagauucacau

SEQ ID NO: 209078 - RNA, 22 nt, Homo sapiens
uaugaaagcuacuucucacaau

SEQ ID NO: 209079 - RNA, 22 nt, Homo sapiens
uaugaacacuuuugggaggcau

SEQ ID NO: 209080 - RNA, 22 nt, Homo sapiens
uaugaaccuguuaucuagguuu

SEQ ID NO: 209081 - RNA, 22 nt, Homo sapiens
uaugaagccaggauuuauuauu

SEQ ID NO: 209082 - RNA, 22 nt, Homo sapiens
uaugaaucuggcuacuccaggg

SEQ ID NO: 209083 - RNA, 22 nt, Homo sapiens
acccuuugucaaucaguacuaa

SEQ ID NO: 209084 - RNA, 22 nt, Homo sapiens
accgaguguucucccgcagcgg

SEQ ID NO: 209085 - RNA, 22 nt, Homo sapiens
accgggcugagcgcaggccccg

SEQ ID NO: 209086 - RNA, 22 nt, Homo sapiens
accugcacagccgaacauagac

SEQ ID NO: 209087 - RNA, 22 nt, Homo sapiens
accuggcacuuagcaaaucuga

SEQ ID NO: 209088 - RNA, 22 nt, Homo sapiens
accuguauaacaagugggaaau

SEQ ID NO: 209089 - RNA, 22 nt, Homo sapiens
accugugguuacagucugucuc

SEQ ID NO: 209090 - RNA, 22 nt, Homo sapiens
accuucauuguugccaugucca

SEQ ID NO: 209091 - RNA, 22 nt, Homo sapiens
acguaguagguuuauaauauua

SEQ ID NO: 209092 - RNA, 22 nt, Homo sapiens
acgugcaugcacacacaugcgc

SEQ ID NO: 209093 - RNA, 20 nt, Homo sapiens
acuaaaucucauuuuaugca

SEQ ID NO: 209094 - RNA, 22 nt, Homo sapiens
acuagguaguaaucugcagaga

SEQ ID NO: 209095 - RNA, 22 nt, Homo sapiens
acuaugagacgaaugcaucagu

SEQ ID NO: 209096 - RNA, 22 nt, Homo sapiens
acucacagcaaccuccgccucc

SEQ ID NO: 209097 - RNA, 22 nt, Homo sapiens
acucagagauuagcacauguuu

SEQ ID NO: 209098 - RNA, 22 nt, Homo sapiens
acuccacuuucaccacagcgga

SEQ ID NO: 209099 - RNA, 22 nt, Homo sapiens
acuccauuuggacucugggagg

SEQ ID NO: 209100 - RNA, 22 nt, Homo sapiens
acugaaucaucagguguguuug

SEQ ID NO: 209101 - RNA, 20 nt, Homo sapiens
acugauauguuccuguucuc

SEQ ID NO: 209102 - RNA, 21 nt, Homo sapiens
acugcacuccaaccucaacag

SEQ ID NO: 209103 - RNA, 19 nt, Homo sapiens
acugcacuccaaccuccug

SEQ ID NO: 209104 - RNA, 22 nt, Homo sapiens
acugcacuccaaccuguugggc

SEQ ID NO: 209105 - RNA, 20 nt, Homo sapiens
acugcacuccaaccuuugug

SEQ ID NO: 209106 - RNA, 18 nt, Homo sapiens
acugcacuccaccuuggg

SEQ ID NO: 209107 - RNA, 22 nt, Homo sapiens
acugcacuccagccuccugaca

SEQ ID NO: 209108 - RNA, 22 nt, Homo sapiens
acugcacuccagccucggugac

SEQ ID NO: 209109 - RNA, 22 nt, Homo sapiens
acugcacuccagccuggacgac

SEQ ID NO: 209110 - RNA, 22 nt, Homo sapiens
acugcacuccagccuucaggac

SEQ ID NO: 209111 - RNA, 22 nt, Homo sapiens
acugcacuccagccuugagagc

SEQ ID NO: 209112 - RNA, 22 nt, Homo sapiens
acugcacuccagccuuggcaac

SEQ ID NO: 209113 - RNA, 22 nt, Homo sapiens
acugcacuccagccuuggccac

SEQ ID NO: 209114 - RNA, 22 nt, Homo sapiens
aagugcacuguaagugcaggau

SEQ ID NO: 209115 - RNA, 22 nt, Homo sapiens
aagugcugggauuggccgggca

SEQ ID NO: 209116 - RNA, 22 nt, Homo sapiens
aagugcuguaugggagccuagg

SEQ ID NO: 209117 - RNA, 22 nt, Homo sapiens
aagugcuucagaagacaauauu

SEQ ID NO: 209118 - RNA, 20 nt, Homo sapiens
aagugcuuccuuuuagaggg

SEQ ID NO: 209119 - RNA, 22 nt, Homo sapiens
aagugcuuuacacaugcaugau

SEQ ID NO: 209120 - RNA, 22 nt, Homo sapiens
aagugguguuuguauuuaugca

SEQ ID NO: 209121 - RNA, 23 nt, Homo sapiens
aagugguuuugaacccggacccu

SEQ ID NO: 209122 - RNA, 22 nt, Homo sapiens
aaguguaaguuaauguuuaggu

SEQ ID NO: 209123 - RNA, 22 nt, Homo sapiens
aaguguaugaaacaguccaugg

SEQ ID NO: 209124 - RNA, 22 nt, Homo sapiens
aauaaagcagcuuuuugggacu

SEQ ID NO: 209125 - RNA, 22 nt, Homo sapiens
aauaaagcauggcuacuccaua

SEQ ID NO: 209126 - RNA, 22 nt, Homo sapiens
aauaaagccugucucuuuagag

SEQ ID NO: 209127 - RNA, 22 nt, Homo sapiens
aauaaagcugaauccuuccuga

SEQ ID NO: 209128 - RNA, 22 nt, Homo sapiens
aauaagcugagagaauucuaca

SEQ ID NO: 209129 - RNA, 22 nt, Homo sapiens
aauacagcacacagaugggucu

SEQ ID NO: 209130 - RNA, 22 nt, Homo sapiens
aauacucaguccuggugaggcu

SEQ ID NO: 209131 - RNA, 22 nt, Homo sapiens
aauacugagaugugagguacua

SEQ ID NO: 209132 - RNA, 22 nt, Homo sapiens
aauagcuguuuuuaauuccugc

SEQ ID NO: 209133 - RNA, 22 nt, Homo sapiens
aauagugcugugcagugagugg

SEQ ID NO: 209134 - RNA, 22 nt, Homo sapiens
aauaucuguguauagauggggg

SEQ ID NO: 209135 - RNA, 22 nt, Homo sapiens
aauaugucugcuaauuguuucu

SEQ ID NO: 209136 - RNA, 22 nt, Homo sapiens
aauauugucaaaauggauucca

SEQ ID NO: 209137 - RNA, 22 nt, Homo sapiens
aaucauauugucugccaagagg

SEQ ID NO: 209138 - RNA, 22 nt, Homo sapiens
aauccugucuugccauccaaua

SEQ ID NO: 209139 - RNA, 22 nt, Homo sapiens
aaucucaacacuuugggaggcu

SEQ ID NO: 209140 - RNA, 22 nt, Homo sapiens
aaucucagcauuuugggcugag

SEQ ID NO: 209141 - RNA, 22 nt, Homo sapiens
aaucuguagaaggugcacauuc

SEQ ID NO: 209142 - RNA, 17 nt, Homo sapiens
aaugagacauuucugcu

SEQ ID NO: 209143 - RNA, 22 nt, Homo sapiens
aaugauauguuauguuuagguu

SEQ ID NO: 209144 - RNA, 22 nt, Homo sapiens
aaugcaucuagaaaggugaauu

SEQ ID NO: 209145 - RNA, 22 nt, Homo sapiens
aauggcaaauguuuucuguuga

SEQ ID NO: 209146 - RNA, 22 nt, Homo sapiens
aauggcaagagccacagaggcg

SEQ ID NO: 209147 - RNA, 22 nt, Homo sapiens
aauggcacaccuagcccuaacc

SEQ ID NO: 209148 - RNA, 22 nt, Homo sapiens
aauggcagaugaaauugucauu

SEQ ID NO: 209149 - RNA, 22 nt, Homo sapiens
aauggccacugaccuguguuga

SEQ ID NO: 209150 - RNA, 22 nt, Homo sapiens
gugaucucagcucacuggaacc

SEQ ID NO: 209151 - RNA, 22 nt, Homo sapiens
gugaucuguccuucauagccug

SEQ ID NO: 209152 - RNA, 22 nt, Homo sapiens
gugauguguuucaacagcuccu

SEQ ID NO: 209153 - RNA, 22 nt, Homo sapiens
gugauuauuaugcacugcaugc

SEQ ID NO: 209154 - RNA, 20 nt, Homo sapiens
gugauuggucacugguuguu

SEQ ID NO: 209155 - RNA, 22 nt, Homo sapiens
gugauugucuaaucaagauaca

SEQ ID NO: 209156 - RNA, 21 nt, Homo sapiens
gugcaaacaucauagaaugua

SEQ ID NO: 209157 - RNA, 22 nt, Homo sapiens
gugcaaaucucugaguaucuuu

SEQ ID NO: 209158 - RNA, 22 nt, Homo sapiens
gugcaagagugacugcaguuuu

SEQ ID NO: 209159 - RNA, 22 nt, Homo sapiens
gugcaaugucaggagaugcagc

SEQ ID NO: 209160 - RNA, 22 nt, Homo sapiens
gugcacaacgugcaaguuuguu

SEQ ID NO: 209161 - RNA, 22 nt, Homo sapiens
gugcacaacgugcagguuaguu

SEQ ID NO: 209162 - RNA, 22 nt, Homo sapiens
gugcacaacgugcagguuuguu

SEQ ID NO: 209163 - RNA, 22 nt, Homo sapiens
gugcacaacguguagguuuguu

SEQ ID NO: 209164 - RNA, 22 nt, Homo sapiens
gugcacaugguagguauugagu

SEQ ID NO: 209165 - RNA, 22 nt, Homo sapiens
gugcagugugauccuuccguau

SEQ ID NO: 209166 - RNA, 22 nt, Homo sapiens
gugcaguuugaaaguagaaaca

SEQ ID NO: 209167 - RNA, 22 nt, Homo sapiens
gugcauacucuggagacauugu

SEQ ID NO: 209168 - RNA, 19 nt, Homo sapiens
gugcauaguuauuaaagag

SEQ ID NO: 209169 - RNA, 22 nt, Homo sapiens
gugcauauaaguuguuucuagu

SEQ ID NO: 209170 - RNA, 23 nt, Homo sapiens
gugcaugagucuuuauaguagca

SEQ ID NO: 209171 - RNA, 22 nt, Homo sapiens
gugccuucuagcuaugguuggc

SEQ ID NO: 209172 - RNA, 21 nt, Homo sapiens
gugcuuguagccucacuucug

SEQ ID NO: 209173 - RNA, 22 nt, Homo sapiens
gugcuuguauuuaaaucaugug

SEQ ID NO: 209174 - RNA, 22 nt, Homo sapiens
gugcuuuguuguggcaguggca

SEQ ID NO: 209175 - RNA, 22 nt, Homo sapiens
guggaagguaaugcagcuuacu

SEQ ID NO: 209176 - RNA, 22 nt, Homo sapiens
guggaaguguaaaagcucuugg

SEQ ID NO: 209177 - RNA, 22 nt, Homo sapiens
guggagacaaaggcugagugag

SEQ ID NO: 209178 - RNA, 22 nt, Homo sapiens
guggcaaagaugccuucuccaa

SEQ ID NO: 209179 - RNA, 22 nt, Homo sapiens
guggcagugugaggauccugcu

SEQ ID NO: 209180 - RNA, 22 nt, Homo sapiens
gugggaugaucgcuugagccca

SEQ ID NO: 209181 - RNA, 22 nt, Homo sapiens
gugggcaagucacuucaguucu

SEQ ID NO: 209182 - RNA, 22 nt, Homo sapiens
gugggguaggaggaguacuucc

SEQ ID NO: 209183 - RNA, 22 nt, Homo sapiens
gugggguaggcaauuccuagug

SEQ ID NO: 209184 - RNA, 22 nt, Homo sapiens
guggggucaucucauuugugga

SEQ ID NO: 209185 - RNA, 22 nt, Homo sapiens
gugguagaaauguagaugcuag

SEQ ID NO: 209186 - RNA, 22 nt, Homo sapiens
guggugucuuguuuaauauaua

SEQ ID NO: 209187 - RNA, 22 nt, Homo sapiens
guggugucuuuuuugauuagga

SEQ ID NO: 209188 - RNA, 22 nt, Homo sapiens
gugguucuagagggacagaaug

SEQ ID NO: 209189 - RNA, 22 nt, Homo sapiens
guguaauacauuagcaaaccaa

SEQ ID NO: 209190 - RNA, 22 nt, Homo sapiens
guguagagaaauagccugaagg

SEQ ID NO: 209191 - RNA, 22 nt, Homo sapiens
guguauauccuauuaguucugu

SEQ ID NO: 209192 - RNA, 22 nt, Homo sapiens
guguaugguuguuguagagaga

SEQ ID NO: 209193 - RNA, 22 nt, Homo sapiens
gugucacagcuuccaucucggu

SEQ ID NO: 209194 - RNA, 22 nt, Homo sapiens
gugucacuguauaauauuuauu

SEQ ID NO: 209195 - RNA, 22 nt, Homo sapiens
gugucacugugaggauauugua

SEQ ID NO: 209196 - RNA, 22 nt, Homo sapiens
gugucacuguugagaaguccac

SEQ ID NO: 209197 - RNA, 22 nt, Homo sapiens
gugucccagugugcauacaggu

SEQ ID NO: 209198 - RNA, 22 nt, Homo sapiens
gugugacuagucaugccugaau

SEQ ID NO: 209199 - RNA, 22 nt, Homo sapiens
gugugauguaaagaacugggga

SEQ ID NO: 209200 - RNA, 22 nt, Homo sapiens
gugugauuauuucaauugaugc

SEQ ID NO: 209201 - RNA, 22 nt, Homo sapiens
gugugauuguuaauuuuaggug

SEQ ID NO: 209202 - RNA, 22 nt, Homo sapiens
gugugcaacuuucauuaauauu

SEQ ID NO: 209203 - RNA, 19 nt, Homo sapiens
gugugcauaucacagagca

SEQ ID NO: 209204 - RNA, 22 nt, Homo sapiens
gugugcauaugucuuuauagua

SEQ ID NO: 209205 - RNA, 22 nt, Homo sapiens
gugugcaugucuuuuuaguagg

SEQ ID NO: 209206 - RNA, 21 nt, Homo sapiens
gugugcuugagugaugggauu

SEQ ID NO: 209207 - RNA, 22 nt, Homo sapiens
gugugguauuauaacuagguau

SEQ ID NO: 209208 - RNA, 22 nt, Homo sapiens
guguuaaucucaaguacucuca

SEQ ID NO: 209209 - RNA, 22 nt, Homo sapiens
guguuauggagccaaacuacua

SEQ ID NO: 209210 - RNA, 22 nt, Homo sapiens
guguucaaauucugacagagag

SEQ ID NO: 209211 - RNA, 22 nt, Homo sapiens
guguugcacauucuguggaugu

SEQ ID NO: 209212 - RNA, 23 nt, Homo sapiens
guuaagugaauguguacucuauu

SEQ ID NO: 209213 - RNA, 22 nt, Homo sapiens
guuauauguuuggaaugaggaa

SEQ ID NO: 209214 - RNA, 22 nt, Homo sapiens
guuaugcagcaauugauaaucu

SEQ ID NO: 209215 - RNA, 22 nt, Homo sapiens
guuauguuaguuacaaggcuag

SEQ ID NO: 209216 - RNA, 22 nt, Homo sapiens
acccucagaccaguuucccugg

SEQ ID NO: 209217 - RNA, 22 nt, Homo sapiens
accucagcccggggaaguugag

SEQ ID NO: 209218 - RNA, 22 nt, Homo sapiens
accugagauuacaggugcuggc

SEQ ID NO: 209219 - RNA, 22 nt, Homo sapiens
accugggugcugaugggcuuua

SEQ ID NO: 209220 - RNA, 18 nt, Homo sapiens
accuucauuccuuugccu

SEQ ID NO: 209221 - RNA, 22 nt, Homo sapiens
acuacauaugacaucuucuuua

SEQ ID NO: 209222 - RNA, 22 nt, Homo sapiens
acuacugucagacugccacuga

SEQ ID NO: 209223 - RNA, 22 nt, Homo sapiens
acuauacugaagcaaauuaaca

SEQ ID NO: 209224 - RNA, 22 nt, Homo sapiens
acucagagugggccccuagaua

SEQ ID NO: 209225 - RNA, 22 nt, Homo sapiens
acugcacuccaaccuuggugac

SEQ ID NO: 209226 - RNA, 22 nt, Homo sapiens
acugcacuccacccuuggcagc

SEQ ID NO: 209227 - RNA, 22 nt, Homo sapiens
acugcacuccagacucugucuc

SEQ ID NO: 209228 - RNA, 22 nt, Homo sapiens
acugcacuccagccucaugaca

SEQ ID NO: 209229 - RNA, 22 nt, Homo sapiens
acugcacuccagccugagccug

SEQ ID NO: 209230 - RNA, 22 nt, Homo sapiens
acugcacuccagccuggaccac

SEQ ID NO: 209231 - RNA, 22 nt, Homo sapiens
acugcacuccagccuggcggac

SEQ ID NO: 209232 - RNA, 22 nt, Homo sapiens
acugcacuccagccugugcgua

SEQ ID NO: 209233 - RNA, 22 nt, Homo sapiens
acugcacuccagccuucggaca

SEQ ID NO: 209234 - RNA, 22 nt, Homo sapiens
acugcacuccagccuugauggc

SEQ ID NO: 209235 - RNA, 22 nt, Homo sapiens
acugcacuccagccuuggagac

SEQ ID NO: 209236 - RNA, 22 nt, Homo sapiens
acugcacuccagcuuuggguga

SEQ ID NO: 209237 - RNA, 22 nt, Homo sapiens
acugcacuccagcuuuggugac

SEQ ID NO: 209238 - RNA, 18 nt, Homo sapiens
acugcacuccauccuagg

SEQ ID NO: 209239 - RNA, 22 nt, Homo sapiens
acugcacucccgcccgggugac

SEQ ID NO: 209240 - RNA, 22 nt, Homo sapiens
acugcacuccggccuggcaaca

SEQ ID NO: 209241 - RNA, 22 nt, Homo sapiens
acugcacuccuccuugggugac

SEQ ID NO: 209242 - RNA, 22 nt, Homo sapiens
acugcacucuagcauggguaau

SEQ ID NO: 209243 - RNA, 22 nt, Homo sapiens
acugcacucuagccccugcgac

SEQ ID NO: 209244 - RNA, 22 nt, Homo sapiens
acuggaguuuguucaagaaaua

SEQ ID NO: 209245 - RNA, 22 nt, Homo sapiens
acuggcauagggcgggcacagu

SEQ ID NO: 209246 - RNA, 22 nt, Homo sapiens
acuguacuccagccugggcaac

SEQ ID NO: 209247 - RNA, 22 nt, Homo sapiens
acuucauucucuggaucagaau

SEQ ID NO: 209248 - RNA, 21 nt, Homo sapiens
acuuucuguggcaguccauuc

SEQ ID NO: 209249 - RNA, 22 nt, Homo sapiens
acuuugcuuaucccaggcacug

SEQ ID NO: 209250 - RNA, 22 nt, Homo sapiens
acuuugguuaucauacuuucag

SEQ ID NO: 209251 - RNA, 22 nt, Homo sapiens
cuaaaugucucuacuaaguuua

SEQ ID NO: 209252 - RNA, 22 nt, Homo sapiens
cuaacaacacagcagauuagaa

SEQ ID NO: 209253 - RNA, 18 nt, Homo sapiens
cuaagacacuuggcagag

SEQ ID NO: 209254 - RNA, 22 nt, Homo sapiens
cuaaggaaggacugaaaggaca

SEQ ID NO: 209255 - RNA, 22 nt, Homo sapiens
cuaagguacuguuaacauugua

SEQ ID NO: 209256 - RNA, 22 nt, Homo sapiens
cuaauacaguuguccaagcugg

SEQ ID NO: 209257 - RNA, 22 nt, Homo sapiens
cuaauccugugguagcacucaa

SEQ ID NO: 209258 - RNA, 22 nt, Homo sapiens
cuacaguaugaaaccuuuacuc

SEQ ID NO: 209259 - RNA, 22 nt, Homo sapiens
cuacccuuaaguuucugugggg

SEQ ID NO: 209260 - RNA, 22 nt, Homo sapiens
cuaccuggguggcucaugacuu

SEQ ID NO: 209261 - RNA, 22 nt, Homo sapiens
cuagaacuagaacugcuggggu

SEQ ID NO: 209262 - RNA, 22 nt, Homo sapiens
cuagauuauccaacuuauuagc

SEQ ID NO: 209263 - RNA, 22 nt, Homo sapiens
cuagcacauuuaucuuuauaca

SEQ ID NO: 209264 - RNA, 22 nt, Homo sapiens
cuagcugcacuuccugcuacug

SEQ ID NO: 209265 - RNA, 22 nt, Homo sapiens
cuaggaaguauguguuauugcu

SEQ ID NO: 209266 - RNA, 22 nt, Homo sapiens
cuaggugauccacugcucucuu

SEQ ID NO: 209267 - RNA, 22 nt, Homo sapiens
cuagguuauacucugaaauggu

SEQ ID NO: 209268 - RNA, 21 nt, Homo sapiens
cuaucucaguguuuacauuug

SEQ ID NO: 209269 - RNA, 22 nt, Homo sapiens
cuauggcuguaugacgugcaug

SEQ ID NO: 209270 - RNA, 22 nt, Homo sapiens
cuauuugcauucagaggcaugu

SEQ ID NO: 209271 - RNA, 22 nt, Homo sapiens
cucaaagugcugggauuggcca

SEQ ID NO: 209272 - RNA, 22 nt, Homo sapiens
cucaaguacaugggauuacagg

SEQ ID NO: 209273 - RNA, 22 nt, Homo sapiens
cucacaaccuuaugaagcauga

SEQ ID NO: 209274 - RNA, 20 nt, Homo sapiens
cucacagacagcuucuuucu

SEQ ID NO: 209275 - RNA, 22 nt, Homo sapiens
cucaccuugugauccaccggcc

SEQ ID NO: 209276 - RNA, 22 nt, Homo sapiens
cucaccuugugauccuccugcc

SEQ ID NO: 209277 - RNA, 22 nt, Homo sapiens
cucacuaguaaggcuguuuagu

SEQ ID NO: 209278 - RNA, 17 nt, Homo sapiens
cucacugagaacagcua

SEQ ID NO: 209279 - RNA, 22 nt, Homo sapiens
cucagauacuugggagguugag

SEQ ID NO: 209280 - RNA, 22 nt, Homo sapiens
cucagcuacuugggaagcugag

SEQ ID NO: 209281 - RNA, 22 nt, Homo sapiens
cucagggugguggacucuaaua

SEQ ID NO: 209282 - RNA, 20 nt, Homo sapiens
cucagguauuugaggcugca

SEQ ID NO: 209283 - RNA, 22 nt, Homo sapiens
cucaguagaaaauacauggacu

SEQ ID NO: 209284 - RNA, 22 nt, Homo sapiens
cucaguggauuagauaaugcac

SEQ ID NO: 209285 - RNA, 19 nt, Homo sapiens
cucauggagaaggagaaua

SEQ ID NO: 209286 - RNA, 22 nt, Homo sapiens
cucauggauggucuggcagcca

SEQ ID NO: 209287 - RNA, 22 nt, Homo sapiens
cucauuggcuacugaggcuugu

SEQ ID NO: 209288 - RNA, 22 nt, Homo sapiens
cuccacugagcaggugggaggc

SEQ ID NO: 209289 - RNA, 22 nt, Homo sapiens
cuccaggugucauccaccuccu

SEQ ID NO: 209290 - RNA, 22 nt, Homo sapiens
cuccaguacagagagguuccuc

SEQ ID NO: 209291 - RNA, 22 nt, Homo sapiens
cuccauguggcuaacuuuuaaa

SEQ ID NO: 209292 - RNA, 22 nt, Homo sapiens
cuccauuuaucugaaauuuuau

SEQ ID NO: 209293 - RNA, 22 nt, Homo sapiens
cucccauugcaaacaacagaag

SEQ ID NO: 209294 - RNA, 22 nt, Homo sapiens
cuccccuuuaguuucuuaauaa

SEQ ID NO: 209295 - RNA, 23 nt, Homo sapiens
cucccugaacaugacacaccaga

SEQ ID NO: 209296 - RNA, 22 nt, Homo sapiens
cucccuuugcugaauguuuuuc

SEQ ID NO: 209297 - RNA, 22 nt, Homo sapiens
cucucaguguggaggccagaaa

SEQ ID NO: 209298 - RNA, 22 nt, Homo sapiens
cucucugagccauggcugcccu

SEQ ID NO: 209299 - RNA, 22 nt, Homo sapiens
cucugagccugagguuccuacu

SEQ ID NO: 209300 - RNA, 22 nt, Homo sapiens
cucugcuuaaugucccacuuga

SEQ ID NO: 209301 - RNA, 22 nt, Homo sapiens
cucugguggaagcagggggcaa

SEQ ID NO: 209302 - RNA, 22 nt, Homo sapiens
cucugguuucgcaggaaauaga

SEQ ID NO: 209303 - RNA, 22 nt, Homo sapiens
cucuuagauuagccauccuaau

SEQ ID NO: 209304 - RNA, 22 nt, Homo sapiens
cucuuuuguuuagcugagaggg

SEQ ID NO: 209305 - RNA, 19 nt, Homo sapiens
cugaaacacagagagggcu

SEQ ID NO: 209306 - RNA, 22 nt, Homo sapiens
cugaaagagcauuugaaugggu

SEQ ID NO: 209307 - RNA, 22 nt, Homo sapiens
cugaaaguuauucaggggcaag

SEQ ID NO: 209308 - RNA, 22 nt, Homo sapiens
cugaauagagcacacugauggg

SEQ ID NO: 209309 - RNA, 22 nt, Homo sapiens
cugaaucauugcauuaucaagg

SEQ ID NO: 209310 - RNA, 20 nt, Homo sapiens
cugaaugucaaggcagaggu

SEQ ID NO: 209311 - RNA, 22 nt, Homo sapiens
cugaauguuucacucugaaaug

SEQ ID NO: 209312 - RNA, 22 nt, Homo sapiens
cugacaagugaucacagcagca

SEQ ID NO: 209313 - RNA, 22 nt, Homo sapiens
cugacauuguugaucacagcca

SEQ ID NO: 209314 - RNA, 22 nt, Homo sapiens
cugacuaguuuuaaugcagauu

SEQ ID NO: 209315 - RNA, 22 nt, Homo sapiens
cugacugugcaugcccagcccc

SEQ ID NO: 209316 - RNA, 22 nt, Homo sapiens
cugagcaagucauuuuguuaaa

SEQ ID NO: 209317 - RNA, 22 nt, Homo sapiens
cugagcacugagauccucuagc

SEQ ID NO: 209318 - RNA, 18 nt, Homo sapiens
cugagcacugcuuuauga

SEQ ID NO: 209319 - RNA, 22 nt, Homo sapiens
cugagcaugacaucaugugacu

SEQ ID NO: 209320 - RNA, 22 nt, Homo sapiens
cugaggugggaguuuuucucau

SEQ ID NO: 209321 - RNA, 20 nt, Homo sapiens
cugagguugggguccuuccc

SEQ ID NO: 209322 - RNA, 22 nt, Homo sapiens
cugagugcaagugauccuccca

SEQ ID NO: 209323 - RNA, 20 nt, Homo sapiens
cugauacagccugagcucuc

SEQ ID NO: 209324 - RNA, 22 nt, Homo sapiens
cugaucuguagcagccaccaca

SEQ ID NO: 209325 - RNA, 22 nt, Homo sapiens
cugaucuguuauacuuuucuau

SEQ ID NO: 209326 - RNA, 22 nt, Homo sapiens
cugauuguuugccucuaaaauc

SEQ ID NO: 209327 - RNA, 22 nt, Homo sapiens
cugcaaauacuugugggauuuu

SEQ ID NO: 209328 - RNA, 22 nt, Homo sapiens
cugcacugagacccucuuugcu

SEQ ID NO: 209329 - RNA, 22 nt, Homo sapiens
cugcaguaaacuuucccauuca

SEQ ID NO: 209330 - RNA, 22 nt, Homo sapiens
cugccacugacaccucaaggac

SEQ ID NO: 209331 - RNA, 20 nt, Homo sapiens
cugcuccccuacaaaucuca

SEQ ID NO: 209332 - RNA, 22 nt, Homo sapiens
cuggaaagcaaagggugcauug

SEQ ID NO: 209333 - RNA, 22 nt, Homo sapiens
cuggaaagcaaguccauugcuc

SEQ ID NO: 209334 - RNA, 22 nt, Homo sapiens
cuggaagaaaaucacgccaucu

SEQ ID NO: 209335 - RNA, 22 nt, Homo sapiens
cuggaaggaaaaacaaccacag

SEQ ID NO: 209336 - RNA, 18 nt, Homo sapiens
cuggaaggcuacuacagu

SEQ ID NO: 209337 - RNA, 22 nt, Homo sapiens
cuggaauuacaggguugagcua

SEQ ID NO: 209338 - RNA, 22 nt, Homo sapiens
cuggagauauuggaagaaagaa

SEQ ID NO: 209339 - RNA, 22 nt, Homo sapiens
cuggaggccugaacauaaaugg

SEQ ID NO: 209340 - RNA, 22 nt, Homo sapiens
cuggaguaugaaccauguauca

SEQ ID NO: 209341 - RNA, 22 nt, Homo sapiens
cuggauguaaaugaaacuacag

SEQ ID NO: 209342 - RNA, 20 nt, Homo sapiens
cuggaugucgaggcagaggu

SEQ ID NO: 209343 - RNA, 19 nt, Homo sapiens
cuggcaaaugcuuuggcca

SEQ ID NO: 209344 - RNA, 22 nt, Homo sapiens
cuggcaagagugaaccagcugu

SEQ ID NO: 209345 - RNA, 22 nt, Homo sapiens
cuggcaauaggcagugucccaa

SEQ ID NO: 209346 - RNA, 22 nt, Homo sapiens
cuggcaccauacacuguuguug

SEQ ID NO: 209347 - RNA, 22 nt, Homo sapiens
cuggcaucuaaauacuugaugu

SEQ ID NO: 209348 - RNA, 22 nt, Homo sapiens
cuggcucauuucauuuagcaua

SEQ ID NO: 209349 - RNA, 22 nt, Homo sapiens
cuggcucugggcuaaagaaaua

SEQ ID NO: 209350 - RNA, 22 nt, Homo sapiens
cuggcugagugguaaguagagg

SEQ ID NO: 209351 - RNA, 22 nt, Homo sapiens
cuggucaagagcaaaggccagg

SEQ ID NO: 209352 - RNA, 21 nt, Homo sapiens
cugguccccuuuauguaugug

SEQ ID NO: 209353 - RNA, 22 nt, Homo sapiens
uacauugcacuuuauuagauac

SEQ ID NO: 209354 - RNA, 22 nt, Homo sapiens
uaccaaaguuucggccucuguu

SEQ ID NO: 209355 - RNA, 22 nt, Homo sapiens
uaccaaguauuuucacaugaac

SEQ ID NO: 209356 - RNA, 22 nt, Homo sapiens
uaccacagucauuacacuugua

SEQ ID NO: 209357 - RNA, 22 nt, Homo sapiens
uaccacauuguagagggcauuc

SEQ ID NO: 209358 - RNA, 22 nt, Homo sapiens
uaccagcauuucucuuuaagua

SEQ ID NO: 209359 - RNA, 22 nt, Homo sapiens
uaccagugucagcuuccugugu

SEQ ID NO: 209360 - RNA, 22 nt, Homo sapiens
uacccucuggauacccuuguuc

SEQ ID NO: 209361 - RNA, 22 nt, Homo sapiens
uacccuuauguaaucauuauac

SEQ ID NO: 209362 - RNA, 22 nt, Homo sapiens
uaccugagaaagaaagcccucg

SEQ ID NO: 209363 - RNA, 22 nt, Homo sapiens
uaccugagacaacuuugaggaa

SEQ ID NO: 209364 - RNA, 22 nt, Homo sapiens
uaccugagcccucugcugaguu

SEQ ID NO: 209365 - RNA, 23 nt, Homo sapiens
uacuacacuuuucccaagguuuu

SEQ ID NO: 209366 - RNA, 22 nt, Homo sapiens
uacuagaggcgggguuucgcca

SEQ ID NO: 209367 - RNA, 22 nt, Homo sapiens
uacucaguaagugcuggcugcu

SEQ ID NO: 209368 - RNA, 22 nt, Homo sapiens
uacucuuuagcuccuuaaggaa

SEQ ID NO: 209369 - RNA, 22 nt, Homo sapiens
uacugcacuccagccucgguga

SEQ ID NO: 209370 - RNA, 22 nt, Homo sapiens
uacugcacuccagccugccaac

SEQ ID NO: 209371 - RNA, 19 nt, Homo sapiens
uacugcacuccagucuggg

SEQ ID NO: 209372 - RNA, 22 nt, Homo sapiens
uacugcacucuagccuggguga

SEQ ID NO: 209373 - RNA, 22 nt, Homo sapiens
uacugcacuggaggccucagau

SEQ ID NO: 209374 - RNA, 22 nt, Homo sapiens
uacugcagucagacuccugggc

SEQ ID NO: 209375 - RNA, 23 nt, Homo sapiens
uacugcauccuccgccucuaggg

SEQ ID NO: 209376 - RNA, 22 nt, Homo sapiens
uacugcaucuacuuagagccag

SEQ ID NO: 209377 - RNA, 22 nt, Homo sapiens
uacugcauuccaaucugggcga

SEQ ID NO: 209378 - RNA, 22 nt, Homo sapiens
uacugcauuucacuguuaaaga

SEQ ID NO: 209379 - RNA, 22 nt, Homo sapiens
uacuggguguucugagaaaaua

SEQ ID NO: 209380 - RNA, 22 nt, Homo sapiens
uacuguguaguuagaccucaga

SEQ ID NO: 209381 - RNA, 22 nt, Homo sapiens
uacuuuguagagugugagaauu

SEQ ID NO: 209382 - RNA, 22 nt, Homo sapiens
uagaaguaggcuacgugucugg

SEQ ID NO: 209383 - RNA, 22 nt, Homo sapiens
uagaaucuaacucgcaugaaaa

SEQ ID NO: 209384 - RNA, 22 nt, Homo sapiens
uagaauggaaggcauguuugcc

SEQ ID NO: 209385 - RNA, 22 nt, Homo sapiens
aggacacugauguaugcugugg

SEQ ID NO: 209386 - RNA, 22 nt, Homo sapiens
aggaccccucaucagcaccagu

SEQ ID NO: 209387 - RNA, 22 nt, Homo sapiens
aggagcacaauggucaugugga

SEQ ID NO: 209388 - RNA, 18 nt, Homo sapiens
aggagcauagugcuauga

SEQ ID NO: 209389 - RNA, 21 nt, Homo sapiens
aggagcauuguugugguggag

SEQ ID NO: 209390 - RNA, 20 nt, Homo sapiens
aggagcauuuacauuggcuc

SEQ ID NO: 209391 - RNA, 22 nt, Homo sapiens
aggagguaggaauugugcuagg

SEQ ID NO: 209392 - RNA, 22 nt, Homo sapiens
aggaucauugacuauuauaagg

SEQ ID NO: 209393 - RNA, 16 nt, Homo sapiens
aggcaagaauugaggu

SEQ ID NO: 209394 - RNA, 21 nt, Homo sapiens
aggcaagguguuauuauugaa

SEQ ID NO: 209395 - RNA, 22 nt, Homo sapiens
aggcagaugagguccucagcug

SEQ ID NO: 209396 - RNA, 22 nt, Homo sapiens
aggcaggugaaagauaguuuua

SEQ ID NO: 209397 - RNA, 22 nt, Homo sapiens
aggcaugaaauacaugcauuga

SEQ ID NO: 209398 - RNA, 22 nt, Homo sapiens
aggcaugguggcacauacaugu

SEQ ID NO: 209399 - RNA, 22 nt, Homo sapiens
aggcauguggcucuguucugac

SEQ ID NO: 209400 - RNA, 23 nt, Homo sapiens
aggcauuguacaguaauggaaaa

SEQ ID NO: 209401 - RNA, 22 nt, Homo sapiens
aggccaguuuuuggagggaaac

SEQ ID NO: 209402 - RNA, 22 nt, Homo sapiens
aggcuagaaucuuccaucuugg

SEQ ID NO: 209403 - RNA, 21 nt, Homo sapiens
aggcuguuguuuugggaugga

SEQ ID NO: 209404 - RNA, 22 nt, Homo sapiens
agggaauguaaguuuuaugaga

SEQ ID NO: 209405 - RNA, 22 nt, Homo sapiens
agggcaagacuuguuaagaaca

SEQ ID NO: 209406 - RNA, 22 nt, Homo sapiens
agggccuuuguagauguacuca

SEQ ID NO: 209407 - RNA, 22 nt, Homo sapiens
agguaagaugugacuugguguu

SEQ ID NO: 209408 - RNA, 22 nt, Homo sapiens
agguaaguauguuauuacuuuu

SEQ ID NO: 209409 - RNA, 22 nt, Homo sapiens
agguaauuuuaucauuauguga

SEQ ID NO: 209410 - RNA, 22 nt, Homo sapiens
agguacuugagauucugaacug

SEQ ID NO: 209411 - RNA, 22 nt, Homo sapiens
agguacuuucccaaccauacug

SEQ ID NO: 209412 - RNA, 22 nt, Homo sapiens
agguauguauguaugggagaaa

SEQ ID NO: 209413 - RNA, 22 nt, Homo sapiens
agguauuuuuuauccuccagca

SEQ ID NO: 209414 - RNA, 21 nt, Homo sapiens
aggucaugaagauguucuaau

SEQ ID NO: 209415 - RNA, 22 nt, Homo sapiens
agguccacuuacuacuccuguu

SEQ ID NO: 209416 - RNA, 22 nt, Homo sapiens
aggugaaugcucacauucuaau

SEQ ID NO: 209417 - RNA, 22 nt, Homo sapiens
aggugcaauggugguuuugugg

SEQ ID NO: 209418 - RNA, 22 nt, Homo sapiens
aggugcacucagaaaacagaua

SEQ ID NO: 209419 - RNA, 22 nt, Homo sapiens
aggugcaugcuucacuggauau

SEQ ID NO: 209420 - RNA, 22 nt, Homo sapiens
agguuaacaucuauuuuggaug

SEQ ID NO: 209421 - RNA, 22 nt, Homo sapiens
aguacacuguugaacagaagug

SEQ ID NO: 209422 - RNA, 23 nt, Homo sapiens
aguacuguaguaauugaggggaa

SEQ ID NO: 209423 - RNA, 22 nt, Homo sapiens
aguagcaauggcucugagcuau

SEQ ID NO: 209424 - RNA, 22 nt, Homo sapiens
aguagcacaugccacccugucu

SEQ ID NO: 209425 - RNA, 22 nt, Homo sapiens
aguagguguugguagagguuuc

SEQ ID NO: 209426 - RNA, 16 nt, Homo sapiens
aguaguuuuacagauu

SEQ ID NO: 209427 - RNA, 22 nt, Homo sapiens
aguaucacaggcaaaacagaau

SEQ ID NO: 209428 - RNA, 22 nt, Homo sapiens
aguauguagugcaaucagucag

SEQ ID NO: 209429 - RNA, 22 nt, Homo sapiens
aguauuaggugaguguauuuca

SEQ ID NO: 209430 - RNA, 22 nt, Homo sapiens
agucaagaaucucagcaucuuu

SEQ ID NO: 209431 - RNA, 22 nt, Homo sapiens
agucaagauggcaagguaaggc

SEQ ID NO: 209432 - RNA, 22 nt, Homo sapiens
agucacaugcauuuucuucaau

SEQ ID NO: 209433 - RNA, 22 nt, Homo sapiens
agucacaugccagcacacccag

SEQ ID NO: 209434 - RNA, 22 nt, Homo sapiens
agucagucuguccugugcugag

SEQ ID NO: 209435 - RNA, 20 nt, Homo sapiens
agucaguuuauuuucucucu

SEQ ID NO: 209436 - RNA, 22 nt, Homo sapiens
agucauagaguuugcccuucuc

SEQ ID NO: 209437 - RNA, 22 nt, Homo sapiens
agucauuguugagaugguguca

SEQ ID NO: 209438 - RNA, 22 nt, Homo sapiens
aguccaguguuaugaucaguag

SEQ ID NO: 209439 - RNA, 22 nt, Homo sapiens
agugacaugggaucaaaucuga

SEQ ID NO: 209440 - RNA, 17 nt, Homo sapiens
agugagaucauggcuua

SEQ ID NO: 209441 - RNA, 19 nt, Homo sapiens
agugagccaagauccuacc

SEQ ID NO: 209442 - RNA, 22 nt, Homo sapiens
agugagcugcagucuggggucc

SEQ ID NO: 209443 - RNA, 22 nt, Homo sapiens
agugcaaugauccggugcuggg

SEQ ID NO: 209444 - RNA, 22 nt, Homo sapiens
agugcaguggugccaucauaac

SEQ ID NO: 209445 - RNA, 22 nt, Homo sapiens
agugcaguugucacgugccuuc

SEQ ID NO: 209446 - RNA, 22 nt, Homo sapiens
agugcauuugcaucucaauaua

SEQ ID NO: 209447 - RNA, 22 nt, Homo sapiens
agugccacugcacucuagccug

SEQ ID NO: 209448 - RNA, 22 nt, Homo sapiens
agugccuauugauggaaagaua

SEQ ID NO: 209449 - RNA, 22 nt, Homo sapiens
aguggauuuuagacugagauuu

SEQ ID NO: 209450 - RNA, 22 nt, Homo sapiens
aguggcacaauuuugacucccc

SEQ ID NO: 209451 - RNA, 19 nt, Homo sapiens
agugggcuagaaaucaggg

SEQ ID NO: 209452 - RNA, 22 nt, Homo sapiens
agugguguugccuguugaccua

SEQ ID NO: 209453 - RNA, 22 nt, Homo sapiens
agugguuuuaaguagagcauac

SEQ ID NO: 209454 - RNA, 20 nt, Homo sapiens
agugguuuucaaauaugucu

SEQ ID NO: 209455 - RNA, 22 nt, Homo sapiens
aguuuugguugaguuacuagca

SEQ ID NO: 209456 - RNA, 22 nt, Homo sapiens
auaaaagcaggucuaggucagg

SEQ ID NO: 209457 - RNA, 22 nt, Homo sapiens
auaaacagcuuauccucuauuc

SEQ ID NO: 209458 - RNA, 22 nt, Homo sapiens
auaaagcaaauaggacuauugc

SEQ ID NO: 209459 - RNA, 22 nt, Homo sapiens
auaaagccaugagcuugagaug

SEQ ID NO: 209460 - RNA, 22 nt, Homo sapiens
auaaagguaagcacuauccuga

SEQ ID NO: 209461 - RNA, 22 nt, Homo sapiens
auaaaguguuuaguauaggcaa

SEQ ID NO: 209462 - RNA, 22 nt, Homo sapiens
ucccuguuguuucauaauuuua

SEQ ID NO: 209463 - RNA, 22 nt, Homo sapiens
ucccuugguaauucuguuccuu

SEQ ID NO: 209464 - RNA, 22 nt, Homo sapiens
uccugauacgguugcaguucuc

SEQ ID NO: 209465 - RNA, 22 nt, Homo sapiens
uccugcauucugaaauacaagu

SEQ ID NO: 209466 - RNA, 22 nt, Homo sapiens
uccugcauucugacuugcuuuc

SEQ ID NO: 209467 - RNA, 22 nt, Homo sapiens
uccuucaugcaucaauguaucc

SEQ ID NO: 209468 - RNA, 22 nt, Homo sapiens
uccuugagccucccagacucag

SEQ ID NO: 209469 - RNA, 22 nt, Homo sapiens
uccuugagucugaacuuuggau

SEQ ID NO: 209470 - RNA, 22 nt, Homo sapiens
uccuuggucauggaagagacag

SEQ ID NO: 209471 - RNA, 22 nt, Homo sapiens
uccuugguugauccugugcaga

SEQ ID NO: 209472 - RNA, 23 nt, Homo sapiens
uccuugguuggcgcccuaugugu

SEQ ID NO: 209473 - RNA, 22 nt, Homo sapiens
uccuuuagacugaauccugaga

SEQ ID NO: 209474 - RNA, 22 nt, Homo sapiens
uccuuugguucuugucacccca

SEQ ID NO: 209475 - RNA, 22 nt, Homo sapiens
ucgcugcgaccuccaccucccg

SEQ ID NO: 209476 - RNA, 22 nt, Homo sapiens
ucgcugggaagacugaaguguc

SEQ ID NO: 209477 - RNA, 22 nt, Homo sapiens
ucggcucagugcaagcucugcc

SEQ ID NO: 209478 - RNA, 22 nt, Homo sapiens
ucgugcugugucaucuuguggc

SEQ ID NO: 209479 - RNA, 22 nt, Homo sapiens
ucguucuugucaguuuauaaag

SEQ ID NO: 209480 - RNA, 22 nt, Homo sapiens
ucuaaaacuagauugugaugau

SEQ ID NO: 209481 - RNA, 17 nt, Homo sapiens
ucuaauaauaugcauuu

SEQ ID NO: 209482 - RNA, 22 nt, Homo sapiens
ucuaaugcucugagaacagugc

SEQ ID NO: 209483 - RNA, 22 nt, Homo sapiens
ucuaugguuuauuuccaagugu

SEQ ID NO: 209484 - RNA, 22 nt, Homo sapiens
ucucaaccucccaaguagcugg

SEQ ID NO: 209485 - RNA, 22 nt, Homo sapiens
ucucaauuugauuacauucaua

SEQ ID NO: 209486 - RNA, 22 nt, Homo sapiens
agcccugugauuacuuuuauaa

SEQ ID NO: 209487 - RNA, 22 nt, Homo sapiens
agccuguagugagcugugauug

SEQ ID NO: 209488 - RNA, 23 nt, Homo sapiens
agccuguugccuaggcagcucau

SEQ ID NO: 209489 - RNA, 22 nt, Homo sapiens
agcggcuguuccccuggucuau

SEQ ID NO: 209490 - RNA, 20 nt, Homo sapiens
agcuaguauuuccaugguua

SEQ ID NO: 209491 - RNA, 22 nt, Homo sapiens
agcucauugcaaccuccgccuc

SEQ ID NO: 209492 - RNA, 22 nt, Homo sapiens
agcuccaucuucagggguucag

SEQ ID NO: 209493 - RNA, 22 nt, Homo sapiens
agcuccaugauaguaugucugu

SEQ ID NO: 209494 - RNA, 20 nt, Homo sapiens
agcuccauuccugaaggcug

SEQ ID NO: 209495 - RNA, 22 nt, Homo sapiens
agcugcaauguuuaguauaaua

SEQ ID NO: 209496 - RNA, 20 nt, Homo sapiens
agcugcagauauaaauccgc

SEQ ID NO: 209497 - RNA, 22 nt, Homo sapiens
agcugcauuuacuuuugcacaa

SEQ ID NO: 209498 - RNA, 22 nt, Homo sapiens
agcugccagucuuguaaggccu

SEQ ID NO: 209499 - RNA, 21 nt, Homo sapiens
agcugcguuuaggcauuuucc

SEQ ID NO: 209500 - RNA, 16 nt, Homo sapiens
agcuggaauuacaggc

SEQ ID NO: 209501 - RNA, 22 nt, Homo sapiens
agcuggacuugauaaaugaaua

SEQ ID NO: 209502 - RNA, 22 nt, Homo sapiens
agcugguauuuugucaaggaua

SEQ ID NO: 209503 - RNA, 22 nt, Homo sapiens
agcugguccugugacuugcuuc

SEQ ID NO: 209504 - RNA, 22 nt, Homo sapiens
agcugugucuucuuaaagauuu

SEQ ID NO: 209505 - RNA, 22 nt, Homo sapiens
agcuucacaaugcagagggcag

SEQ ID NO: 209506 - RNA, 20 nt, Homo sapiens
agcuugguuuggaugaucac

SEQ ID NO: 209507 - RNA, 22 nt, Homo sapiens
agcuuguccuccacccacacug

SEQ ID NO: 209508 - RNA, 22 nt, Homo sapiens
agcuugugauucuccaucaugu

SEQ ID NO: 209509 - RNA, 22 nt, Homo sapiens
agcuugugcuguaugaagggcc

SEQ ID NO: 209510 - RNA, 22 nt, Homo sapiens
agcuuuuugggcagcuauugac

SEQ ID NO: 209511 - RNA, 22 nt, Homo sapiens
aggaacuguaacuaugucucug

SEQ ID NO: 209512 - RNA, 22 nt, Homo sapiens
aggaagcuagcauuuguucagu

SEQ ID NO: 209513 - RNA, 22 nt, Homo sapiens
aggaaugucaaugguaguuuaa

SEQ ID NO: 209514 - RNA, 22 nt, Homo sapiens
agucacggugguuugcacuugu

SEQ ID NO: 209515 - RNA, 23 nt, Homo sapiens
agucuguguuuacaggcucucug

SEQ ID NO: 209516 - RNA, 22 nt, Homo sapiens
agugaaaucugaagaaggucau

SEQ ID NO: 209517 - RNA, 22 nt, Homo sapiens
agugaacaaagaagugcagaua

SEQ ID NO: 209518 - RNA, 22 nt, Homo sapiens
agugaacacagcuucuuugguu

SEQ ID NO: 209519 - RNA, 22 nt, Homo sapiens
agugaauguuggaaaguuauuu

SEQ ID NO: 209520 - RNA, 22 nt, Homo sapiens
agugagcuguuuuuacuuucug

SEQ ID NO: 209521 - RNA, 22 nt, Homo sapiens
agugauuuuaacuuccagcaau

SEQ ID NO: 209522 - RNA, 22 nt, Homo sapiens
agugcaguggcucaaaaugccu

SEQ ID NO: 209523 - RNA, 22 nt, Homo sapiens
agugccaaaucgagggcucuga

SEQ ID NO: 209524 - RNA, 22 nt, Homo sapiens
aguggaauuaagaaacugaauu

SEQ ID NO: 209525 - RNA, 22 nt, Homo sapiens
aguggauguuguggccugggag

SEQ ID NO: 209526 - RNA, 22 nt, Homo sapiens
aguggauuuuauuugacaacua

SEQ ID NO: 209527 - RNA, 22 nt, Homo sapiens
aguggcuuuuuaguggcagaug

SEQ ID NO: 209528 - RNA, 22 nt, Homo sapiens
aguguuuuucaugggauacuuu

SEQ ID NO: 209529 - RNA, 22 nt, Homo sapiens
uuauugcuaaaucaugaccaca

SEQ ID NO: 209530 - RNA, 22 nt, Homo sapiens
uuauugcuuuugugcaggugag

SEQ ID NO: 209531 - RNA, 22 nt, Homo sapiens
uuauuguccaaguuucccuuug

SEQ ID NO: 209532 - RNA, 22 nt, Homo sapiens
uucaaaaccucugcuuaagccc

SEQ ID NO: 209533 - RNA, 22 nt, Homo sapiens
uucaaaguaaagggauggagac

SEQ ID NO: 209534 - RNA, 23 nt, Homo sapiens
uucaaauguucucugguugucag

SEQ ID NO: 209535 - RNA, 23 nt, Homo sapiens
uucaacagguagacccucccugc

SEQ ID NO: 209536 - RNA, 22 nt, Homo sapiens
uucaagaauuaaaguggcuuuu

SEQ ID NO: 209537 - RNA, 22 nt, Homo sapiens
uucaaguagguaggaccacagg

SEQ ID NO: 209538 - RNA, 22 nt, Homo sapiens
uucaagucaaggaaagaggucu

SEQ ID NO: 209539 - RNA, 22 nt, Homo sapiens
uucaagucaauuuuugaaugac

SEQ ID NO: 209540 - RNA, 22 nt, Homo sapiens
uucaagugaacaaaaugaggag

SEQ ID NO: 209541 - RNA, 20 nt, Homo sapiens
uucaagugauucucaugccu

SEQ ID NO: 209542 - RNA, 22 nt, Homo sapiens
uucaauaugucauuggcaggca

SEQ ID NO: 209543 - RNA, 19 nt, Homo sapiens
uucaaugcagcauugccac

SEQ ID NO: 209544 - RNA, 22 nt, Homo sapiens
uucaauuaauauuauacucuca

SEQ ID NO: 209545 - RNA, 22 nt, Homo sapiens
uucacaaugccuuguugauggu

SEQ ID NO: 209546 - RNA, 22 nt, Homo sapiens
uucaccaguuuugucacgaaug

SEQ ID NO: 209547 - RNA, 23 nt, Homo sapiens
uucaccguguuggccaggcuggu

SEQ ID NO: 209548 - RNA, 22 nt, Homo sapiens
uucaccuugggucccacuugcu

SEQ ID NO: 209549 - RNA, 22 nt, Homo sapiens
uucacugagccagacuaagaca

SEQ ID NO: 209550 - RNA, 22 nt, Homo sapiens
uucacugcacuccagccugggu

SEQ ID NO: 209551 - RNA, 22 nt, Homo sapiens
uucacugcauuucagccugggc

SEQ ID NO: 209552 - RNA, 22 nt, Homo sapiens
uucacuggagcccaggaguugg

SEQ ID NO: 209553 - RNA, 20 nt, Homo sapiens
uucacugggcucucuguugg

SEQ ID NO: 209554 - RNA, 22 nt, Homo sapiens
uucacuguagccucagccucuu

SEQ ID NO: 209555 - RNA, 22 nt, Homo sapiens
uucacugugaauaaaggcuccc

SEQ ID NO: 209556 - RNA, 22 nt, Homo sapiens
uucacuguuaagcaguuaaacu

SEQ ID NO: 209557 - RNA, 22 nt, Homo sapiens
uucagacugggugaagagggua

SEQ ID NO: 209558 - RNA, 22 nt, Homo sapiens
uucagcaaugacagccuauaua

SEQ ID NO: 209559 - RNA, 22 nt, Homo sapiens
uucagcacugaaaauaugucau

SEQ ID NO: 209560 - RNA, 22 nt, Homo sapiens
uucagcaggccaggcccugacu

SEQ ID NO: 209561 - RNA, 19 nt, Homo sapiens
uucagcagugucugcucuu

SEQ ID NO: 209562 - RNA, 22 nt, Homo sapiens
uucaggcaccauggucauugau

SEQ ID NO: 209563 - RNA, 22 nt, Homo sapiens
uucagggacuuuagacaagaga

SEQ ID NO: 209564 - RNA, 22 nt, Homo sapiens
uucaguaguacauucccguguu

SEQ ID NO: 209565 - RNA, 22 nt, Homo sapiens
uucagugagacgaaaacaacaa

SEQ ID NO: 209566 - RNA, 22 nt, Homo sapiens
uucagugucauuaacacaguag

SEQ ID NO: 209567 - RNA, 22 nt, Homo sapiens
uucaguucugcacugaucuuag

SEQ ID NO: 209568 - RNA, 19 nt, Homo sapiens
uucauacagugagagcagc

SEQ ID NO: 209569 - RNA, 22 nt, Homo sapiens
uucauaguaacaguaacuaugg

SEQ ID NO: 209570 - RNA, 22 nt, Homo sapiens
uucauaguucuuuuagucauua

SEQ ID NO: 209571 - RNA, 22 nt, Homo sapiens
uucauaguuuauacugauauuu

SEQ ID NO: 209572 - RNA, 18 nt, Homo sapiens
uucauauguugaaccaga

SEQ ID NO: 209573 - RNA, 22 nt, Homo sapiens
uucaucacagucuccgaugccc

SEQ ID NO: 209574 - RNA, 21 nt, Homo sapiens
uucaucagccagaaaucaagc

SEQ ID NO: 209575 - RNA, 18 nt, Homo sapiens
uucaucaguccucagcug

SEQ ID NO: 209576 - RNA, 22 nt, Homo sapiens
uucauccccuccaaaucucaug

SEQ ID NO: 209577 - RNA, 22 nt, Homo sapiens
uucaucuggcaauucagagauu

SEQ ID NO: 209578 - RNA, 21 nt, Homo sapiens
uucaucuggccguauuccagg

SEQ ID NO: 209579 - RNA, 22 nt, Homo sapiens
uucauguaaucaaggcagcuaa

SEQ ID NO: 209580 - RNA, 22 nt, Homo sapiens
uuccacagggauuugcauugau

SEQ ID NO: 209581 - RNA, 22 nt, Homo sapiens
uuccacuuuuuccuugugcucc

SEQ ID NO: 209582 - RNA, 22 nt, Homo sapiens
uuccagugggacgagaugugga

SEQ ID NO: 209583 - RNA, 22 nt, Homo sapiens
uuccaguguuugacucaccuuu

SEQ ID NO: 209584 - RNA, 22 nt, Homo sapiens
uuccauagucauagugcugaug

SEQ ID NO: 209585 - RNA, 22 nt, Homo sapiens
uuccauuuguucggugucgcca

SEQ ID NO: 209586 - RNA, 22 nt, Homo sapiens
uucccagagaaaaggguuucuu

SEQ ID NO: 209587 - RNA, 22 nt, Homo sapiens
uucccaguaaacucuaucccuc

SEQ ID NO: 209588 - RNA, 22 nt, Homo sapiens
uucccaguuggggaaagcgacc

SEQ ID NO: 209589 - RNA, 22 nt, Homo sapiens
uucccauuguuggccagcaugu

SEQ ID NO: 209590 - RNA, 22 nt, Homo sapiens
uucccugaguaucuuaccaugg

SEQ ID NO: 209591 - RNA, 22 nt, Homo sapiens
uucccuguaucuucugccaugu

SEQ ID NO: 209592 - RNA, 22 nt, Homo sapiens
uucccugugggcuggugcucca

SEQ ID NO: 209593 - RNA, 22 nt, Homo sapiens
uucccuuugugcauaggauuug

SEQ ID NO: 209594 - RNA, 22 nt, Homo sapiens
uucccuuuguuaaauuggaaga

SEQ ID NO: 209595 - RNA, 22 nt, Homo sapiens
uuccuacugugcaaaguugcaa

SEQ ID NO: 209596 - RNA, 22 nt, Homo sapiens
uuccugagaucagaauucaaau

SEQ ID NO: 209597 - RNA, 22 nt, Homo sapiens
uuccuguagcgauuuuaguaau

SEQ ID NO: 209598 - RNA, 20 nt, Homo sapiens
uuccuuaggcauuggaagaa

SEQ ID NO: 209599 - RNA, 22 nt, Homo sapiens
uuccuugagagcuugauaucac

SEQ ID NO: 209600 - RNA, 22 nt, Homo sapiens
uuccuugagucuuuuuccugag

SEQ ID NO: 209601 - RNA, 22 nt, Homo sapiens
uuccuuguagcaaaugcgauga

SEQ ID NO: 209602 - RNA, 22 nt, Homo sapiens
uucgagagaaaaggcauauaug

SEQ ID NO: 209603 - RNA, 22 nt, Homo sapiens
uucuaaguaauuuugcaugccu

SEQ ID NO: 209604 - RNA, 22 nt, Homo sapiens
uucuacaggcuguucaagaagc

SEQ ID NO: 209605 - RNA, 22 nt, Homo sapiens
uucuagcacuuugggagacuga

SEQ ID NO: 209606 - RNA, 20 nt, Homo sapiens
uucuaguacuucuguuucca

SEQ ID NO: 209607 - RNA, 23 nt, Homo sapiens
uucuaucaggcccaggagcccug

SEQ ID NO: 209608 - RNA, 22 nt, Homo sapiens
uucuauguuguuagacccacca

SEQ ID NO: 209609 - RNA, 22 nt, Homo sapiens
uucuauguuugaaaaugccaaa

SEQ ID NO: 209610 - RNA, 22 nt, Homo sapiens
uucucaauggaugugggaccag

SEQ ID NO: 209611 - RNA, 22 nt, Homo sapiens
uucucaauggcaacuuguugcu

SEQ ID NO: 209612 - RNA, 22 nt, Homo sapiens
uucucacaguacagggagcucu

SEQ ID NO: 209613 - RNA, 22 nt, Homo sapiens
uucucaguaauuccagauuuuu

SEQ ID NO: 209614 - RNA, 22 nt, Homo sapiens
uucucaguuccuacuuugguga

SEQ ID NO: 209615 - RNA, 22 nt, Homo sapiens
uucucauggugauggcaaaauc

SEQ ID NO: 209616 - RNA, 22 nt, Homo sapiens
cuggauauguugcaacauuucc

SEQ ID NO: 209617 - RNA, 20 nt, Homo sapiens
cuggaucaucaguaaaguua

SEQ ID NO: 209618 - RNA, 18 nt, Homo sapiens
cuggaugucgaguguguu

SEQ ID NO: 209619 - RNA, 22 nt, Homo sapiens
cuggcaaaaagagggcaauaau

SEQ ID NO: 209620 - RNA, 22 nt, Homo sapiens
cuggcacagugucagaaacaca

SEQ ID NO: 209621 - RNA, 22 nt, Homo sapiens
cuggcagucugccucuucacug

SEQ ID NO: 209622 - RNA, 22 nt, Homo sapiens
cuggcaguguuucuugugggcu

SEQ ID NO: 209623 - RNA, 22 nt, Homo sapiens
cuggcgagacagcuccaucacu

SEQ ID NO: 209624 - RNA, 22 nt, Homo sapiens
cuggcuaagugcuugagugugc

SEQ ID NO: 209625 - RNA, 22 nt, Homo sapiens
cugggaugauguaaauaggcua

SEQ ID NO: 209626 - RNA, 22 nt, Homo sapiens
cuggguacccuuuaaacaggaa

SEQ ID NO: 209627 - RNA, 22 nt, Homo sapiens
cuguaaagaucacagagcuggu

SEQ ID NO: 209628 - RNA, 22 nt, Homo sapiens
cuguaagcauuauaaagagaua

SEQ ID NO: 209629 - RNA, 22 nt, Homo sapiens
cuguaugugagaaauaauaagu

SEQ ID NO: 209630 - RNA, 22 nt, Homo sapiens
cugucuguuucaaaagugguua

SEQ ID NO: 209631 - RNA, 22 nt, Homo sapiens
cugugaucuuuuuucauguggu

SEQ ID NO: 209632 - RNA, 22 nt, Homo sapiens
cugugcaaagcgcucucggggu

SEQ ID NO: 209633 - RNA, 22 nt, Homo sapiens
cugugcauguaugcgugaguuc

SEQ ID NO: 209634 - RNA, 22 nt, Homo sapiens
cugugcauucuuaaaucaggaa

SEQ ID NO: 209635 - RNA, 22 nt, Homo sapiens
cugugcauuggaugucucccug

SEQ ID NO: 209636 - RNA, 22 nt, Homo sapiens
cugugcuaggcaaugugguaga

SEQ ID NO: 209637 - RNA, 22 nt, Homo sapiens
cugugcuugauuauaugagugu

SEQ ID NO: 209638 - RNA, 22 nt, Homo sapiens
cugugguguaacucuuggggcg

SEQ ID NO: 209639 - RNA, 22 nt, Homo sapiens
cuguugguguuuaaucacugca

SEQ ID NO: 209640 - RNA, 22 nt, Homo sapiens
cuguuugguuaucuuuuccugu

SEQ ID NO: 209641 - RNA, 22 nt, Homo sapiens
cuuaggguacuuuggugcauca

SEQ ID NO: 209642 - RNA, 17 nt, Homo sapiens
cuucaaauaauuucccc

SEQ ID NO: 209643 - RNA, 22 nt, Homo sapiens
cuucaaguguggccaccugacc

SEQ ID NO: 209644 - RNA, 20 nt, Homo sapiens
cuucacagaaguggaaucau

SEQ ID NO: 209645 - RNA, 22 nt, Homo sapiens
cuucacuggagucccuggauuc

SEQ ID NO: 209646 - RNA, 22 nt, Homo sapiens
cuucaugggagaaccacaggua

SEQ ID NO: 209647 - RNA, 22 nt, Homo sapiens
cuucaugucuucaauggggggg

SEQ ID NO: 209648 - RNA, 18 nt, Homo sapiens
cuucauugcuguuuugcu

SEQ ID NO: 209649 - RNA, 20 nt, Homo sapiens
cuuccaguggccccaucuuu

SEQ ID NO: 209650 - RNA, 20 nt, Homo sapiens
cuugaagacuaugcugcuga

SEQ ID NO: 209651 - RNA, 22 nt, Homo sapiens
cuugaauguaaauaauguacag

SEQ ID NO: 209652 - RNA, 22 nt, Homo sapiens
cuugagcaaacaaaggugguag

SEQ ID NO: 209653 - RNA, 22 nt, Homo sapiens
cuugcacauuacagaucugcau

SEQ ID NO: 209654 - RNA, 22 nt, Homo sapiens
cuugcacuguuguaagggacuu

SEQ ID NO: 209655 - RNA, 22 nt, Homo sapiens
cuugcagaggcccuggggagag

SEQ ID NO: 209656 - RNA, 22 nt, Homo sapiens
cuugcagagucauucuaauuuc

SEQ ID NO: 209657 - RNA, 22 nt, Homo sapiens
cuuggcacgugauagguguuga

SEQ ID NO: 209658 - RNA, 22 nt, Homo sapiens
cuuggcacugcucacccuccuu

SEQ ID NO: 209659 - RNA, 22 nt, Homo sapiens
cuuggcuucuuuauguggcuau

SEQ ID NO: 209660 - RNA, 22 nt, Homo sapiens
cuuggcuugguaucaaauaacc

SEQ ID NO: 209661 - RNA, 22 nt, Homo sapiens
cuugggccccacccaaaucuua

SEQ ID NO: 209662 - RNA, 22 nt, Homo sapiens
cuugguuacauuuuccuagaaa

SEQ ID NO: 209663 - RNA, 19 nt, Homo sapiens
cuugugccugaagcuuggg

SEQ ID NO: 209664 - RNA, 22 nt, Homo sapiens
cuuguuguggaggggagugcag

SEQ ID NO: 209665 - RNA, 22 nt, Homo sapiens
cuuuacaguuggacucacgagg

SEQ ID NO: 209666 - RNA, 22 nt, Homo sapiens
cuuuagcaauugauuaugccau

SEQ ID NO: 209667 - RNA, 22 nt, Homo sapiens
cuuucugaggagaauagagaac

SEQ ID NO: 209668 - RNA, 22 nt, Homo sapiens
cuuugcaaaacauugagaccuc

SEQ ID NO: 209669 - RNA, 22 nt, Homo sapiens
cuuugggaccgcgguuuauacu

SEQ ID NO: 209670 - RNA, 22 nt, Homo sapiens
cuuugguguauuuucagagacc

SEQ ID NO: 209671 - RNA, 19 nt, Homo sapiens
cuuugguugagcguguugg

SEQ ID NO: 209672 - RNA, 20 nt, Homo sapiens
cuuuguccuccugcugugcu

SEQ ID NO: 209673 - RNA, 22 nt, Homo sapiens
cuuuuacacuguuagugggaau

SEQ ID NO: 209674 - RNA, 22 nt, Homo sapiens
cuuuuggcuuaagauugucuug

SEQ ID NO: 209675 - RNA, 22 nt, Homo sapiens
cuuuuggugguucugaugcagg

SEQ ID NO: 209676 - RNA, 22 nt, Homo sapiens
cuuuuugcaaauacaacucuga

SEQ ID NO: 209677 - RNA, 20 nt, Homo sapiens
cuuuuugcugugcugggagc

SEQ ID NO: 209678 - RNA, 22 nt, Homo sapiens
gaaagauuuccugagcuagaaa

SEQ ID NO: 209679 - RNA, 22 nt, Homo sapiens
gaaagguaggaacagggugcag

SEQ ID NO: 209680 - RNA, 22 nt, Homo sapiens
gaaagugcugcuugacugggau

SEQ ID NO: 209681 - RNA, 22 nt, Homo sapiens
gaaaguguugagauuacaggca

SEQ ID NO: 209682 - RNA, 23 nt, Homo sapiens
gaaauguaagugaugccccacag

SEQ ID NO: 209683 - RNA, 22 nt, Homo sapiens
gaaauguauuaaugaguugaaa

SEQ ID NO: 209684 - RNA, 22 nt, Homo sapiens
gaacacaucuuugguuagagga

SEQ ID NO: 209685 - RNA, 22 nt, Homo sapiens
gaaccagcagacuuugacaggu

SEQ ID NO: 209686 - RNA, 22 nt, Homo sapiens
gaagcagcauucugguuuuugg

SEQ ID NO: 209687 - RNA, 23 nt, Homo sapiens
gaaguaauaaauggauucuuaac

SEQ ID NO: 209688 - RNA, 22 nt, Homo sapiens
gaagugcaguggcacagucaug

SEQ ID NO: 209689 - RNA, 22 nt, Homo sapiens
gaagugcuuuuggacuaacagu

SEQ ID NO: 209690 - RNA, 22 nt, Homo sapiens
gaauaaacuagagaggacugag

SEQ ID NO: 209691 - RNA, 22 nt, Homo sapiens
gaauacugacuauuucaucugg

SEQ ID NO: 209692 - RNA, 22 nt, Homo sapiens
gaauagugcugcaagaaacaua

SEQ ID NO: 209693 - RNA, 22 nt, Homo sapiens
gaauagugcugcaaugaacaua

SEQ ID NO: 209694 - RNA, 22 nt, Homo sapiens
gaauagugcugcaguaaacaua

SEQ ID NO: 209695 - RNA, 22 nt, Homo sapiens
gaaucacagauuaugaguaucu

SEQ ID NO: 209696 - RNA, 22 nt, Homo sapiens
gaaucauuggguugauucaaga

SEQ ID NO: 209697 - RNA, 22 nt, Homo sapiens
gaaugauacuguuaacgaaaga

SEQ ID NO: 209698 - RNA, 22 nt, Homo sapiens
gaaugcaugaggggaucagaug

SEQ ID NO: 209699 - RNA, 22 nt, Homo sapiens
gaaugcuaagcaugugggaguu

SEQ ID NO: 209700 - RNA, 22 nt, Homo sapiens
gaaugugcuguuggcugggcgu

SEQ ID NO: 209701 - RNA, 22 nt, Homo sapiens
gaauuguacugcaaucagggga

SEQ ID NO: 209702 - RNA, 20 nt, Homo sapiens
gacaaaccuagaugguacag

SEQ ID NO: 209703 - RNA, 22 nt, Homo sapiens
gacaaguuugauuuauuccaag

SEQ ID NO: 209704 - RNA, 22 nt, Homo sapiens
gacagugagaugucaugugaaa

SEQ ID NO: 209705 - RNA, 22 nt, Homo sapiens
gacagugugauacuuagucuca

SEQ ID NO: 209706 - RNA, 22 nt, Homo sapiens
gacaguguggcgauuccucaag

SEQ ID NO: 209707 - RNA, 17 nt, Homo sapiens
gacauaggaaaaggaga

SEQ ID NO: 209708 - RNA, 22 nt, Homo sapiens
gacaucauuaugagauuuaaac

SEQ ID NO: 209709 - RNA, 20 nt, Homo sapiens
gacauggaggaggauuauua

SEQ ID NO: 209710 - RNA, 21 nt, Homo sapiens
gacauggcgauacuccgucuc

SEQ ID NO: 209711 - RNA, 22 nt, Homo sapiens
gaccuguaguuuaguugccugu

SEQ ID NO: 209712 - RNA, 19 nt, Homo sapiens
ucagcaguaaucaacuuca

SEQ ID NO: 209713 - RNA, 22 nt, Homo sapiens
ucagcaucacgugggcucccgu

SEQ ID NO: 209714 - RNA, 22 nt, Homo sapiens
ucagcgcauggucgugcggcau

SEQ ID NO: 209715 - RNA, 21 nt, Homo sapiens
ucaggcuuuuugagugccaau

SEQ ID NO: 209716 - RNA, 22 nt, Homo sapiens
ucagguaaucuauuugucuuuu

SEQ ID NO: 209717 - RNA, 22 nt, Homo sapiens
ucagguagcuagauuaugugag

SEQ ID NO: 209718 - RNA, 23 nt, Homo sapiens
ucagguaggccuagaguauucuu

SEQ ID NO: 209719 - RNA, 20 nt, Homo sapiens
ucagguagggcuucaacauu

SEQ ID NO: 209720 - RNA, 22 nt, Homo sapiens
ucagguaguuugugggagauga

SEQ ID NO: 209721 - RNA, 22 nt, Homo sapiens
ucagguaucucuauagcaaugu

SEQ ID NO: 209722 - RNA, 22 nt, Homo sapiens
ucagguaucuucauagcaaugc

SEQ ID NO: 209723 - RNA, 22 nt, Homo sapiens
ucaguaaaugcuguucucuuuu

SEQ ID NO: 209724 - RNA, 22 nt, Homo sapiens
ucaguaaauguuaggacauuuc

SEQ ID NO: 209725 - RNA, 22 nt, Homo sapiens
ucaguagagacaggauuucacc

SEQ ID NO: 209726 - RNA, 22 nt, Homo sapiens
ucaguagcauugcuuauacagu

SEQ ID NO: 209727 - RNA, 20 nt, Homo sapiens
ucaguauauuguuuccacag

SEQ ID NO: 209728 - RNA, 22 nt, Homo sapiens
ucagucauguuuaccagacgua

SEQ ID NO: 209729 - RNA, 22 nt, Homo sapiens
ucagucauugauggaguagguc

SEQ ID NO: 209730 - RNA, 22 nt, Homo sapiens
ucaguccccucgcugagucuac

SEQ ID NO: 209731 - RNA, 23 nt, Homo sapiens
ucagugaaggaacaacuaaauag

SEQ ID NO: 209732 - RNA, 22 nt, Homo sapiens
ucagugauugcuuucauggaaa

SEQ ID NO: 209733 - RNA, 20 nt, Homo sapiens
ucagugauugguuuaguuau

SEQ ID NO: 209734 - RNA, 22 nt, Homo sapiens
ucagugccauugccauaugagu

SEQ ID NO: 209735 - RNA, 22 nt, Homo sapiens
ucagugccucaguuuuuaaaga

SEQ ID NO: 209736 - RNA, 22 nt, Homo sapiens
ucaguggacuuagucuuucccc

SEQ ID NO: 209737 - RNA, 22 nt, Homo sapiens
ucaguggagccucacucugugg

SEQ ID NO: 209738 - RNA, 22 nt, Homo sapiens
ucaguggauuuaaccugaauca

SEQ ID NO: 209739 - RNA, 23 nt, Homo sapiens
ucagugucuggauccugcucagu

SEQ ID NO: 209740 - RNA, 22 nt, Homo sapiens
ucagugucugugcaccgcugga

SEQ ID NO: 209741 - RNA, 22 nt, Homo sapiens
ucaguguugauggcugcugacu

SEQ ID NO: 209742 - RNA, 21 nt, Homo sapiens
ucaguuacugagagagaagug

SEQ ID NO: 209743 - RNA, 22 nt, Homo sapiens
ucaguucauggaggugucugcu

SEQ ID NO: 209744 - RNA, 22 nt, Homo sapiens
ucauacaguaguccucacuugu

SEQ ID NO: 209745 - RNA, 20 nt, Homo sapiens
ucauacuguggaguaccagg

SEQ ID NO: 209746 - RNA, 22 nt, Homo sapiens
ucauacuguugugaaacaaaac

SEQ ID NO: 209747 - RNA, 22 nt, Homo sapiens
ucauagucuaagguucuuuugc

SEQ ID NO: 209748 - RNA, 21 nt, Homo sapiens
ucauauguaucuuugugccuc

SEQ ID NO: 209749 - RNA, 21 nt, Homo sapiens
ucaucaagcuguagacaugau

SEQ ID NO: 209750 - RNA, 22 nt, Homo sapiens
ucaucaguggggaugugguuga

SEQ ID NO: 209751 - RNA, 22 nt, Homo sapiens
ucaucucaguuucuugccguac

SEQ ID NO: 209752 - RNA, 20 nt, Homo sapiens
ucaugccacugcgcuccagc

SEQ ID NO: 209753 - RNA, 22 nt, Homo sapiens
ucauggcuuuuauuauguugag

SEQ ID NO: 209754 - RNA, 22 nt, Homo sapiens
ucaugggagcccccaucaugag

SEQ ID NO: 209755 - RNA, 22 nt, Homo sapiens
ucaugugaggauaacaauagug

SEQ ID NO: 209756 - RNA, 19 nt, Homo sapiens
ucaugugcauacauuuggg

SEQ ID NO: 209757 - RNA, 22 nt, Homo sapiens
ucauugcacuucuuuaguugca

SEQ ID NO: 209758 - RNA, 22 nt, Homo sapiens
uccaaaucucuggcacugggau

SEQ ID NO: 209759 - RNA, 22 nt, Homo sapiens
uccaagaugcuggcagcuacag

SEQ ID NO: 209760 - RNA, 22 nt, Homo sapiens
uccacaauggagaagaguauga

SEQ ID NO: 209761 - RNA, 22 nt, Homo sapiens
uccacagugguugaacuaguuu

SEQ ID NO: 209762 - RNA, 22 nt, Homo sapiens
uccaccgugggcugcggggcuc

SEQ ID NO: 209763 - RNA, 22 nt, Homo sapiens
uccacguggucuaucuguccuu

SEQ ID NO: 209764 - RNA, 22 nt, Homo sapiens
uccagguuucaugcucuuuauu

SEQ ID NO: 209765 - RNA, 22 nt, Homo sapiens
uccaguacaggucucucauuuc

SEQ ID NO: 209766 - RNA, 22 nt, Homo sapiens
uccaguggacagacauaccaug

SEQ ID NO: 209767 - RNA, 22 nt, Homo sapiens
uccagugugcaggcaaguuuga

SEQ ID NO: 209768 - RNA, 22 nt, Homo sapiens
uccaguguuauaauaugcgucu

SEQ ID NO: 209769 - RNA, 22 nt, Homo sapiens
uccaguguuccucagucacccc

SEQ ID NO: 209770 - RNA, 22 nt, Homo sapiens
uccaguuuggaggcuugaugug

SEQ ID NO: 209771 - RNA, 18 nt, Homo sapiens
uccaguuuucccagcauc

SEQ ID NO: 209772 - RNA, 22 nt, Homo sapiens
uccaugaggcuacaguaaucuc

SEQ ID NO: 209773 - RNA, 18 nt, Homo sapiens
uccauugcagcauuauuu

SEQ ID NO: 209774 - RNA, 22 nt, Homo sapiens
uccauuuguagguagugagaca

SEQ ID NO: 209775 - RNA, 23 nt, Homo sapiens
ucccaagauggaccagaccaagg

SEQ ID NO: 209776 - RNA, 17 nt, Homo sapiens
ucccauguuucuucuac

SEQ ID NO: 209777 - RNA, 22 nt, Homo sapiens
uccccgagcccaggcugugacu

SEQ ID NO: 209778 - RNA, 19 nt, Homo sapiens
uccccuguggauaccaaga

SEQ ID NO: 209779 - RNA, 22 nt, Homo sapiens
ucccgaggacaucugggggcaa

SEQ ID NO: 209780 - RNA, 22 nt, Homo sapiens
ucccuagagaagugauuuuuga

SEQ ID NO: 209781 - RNA, 22 nt, Homo sapiens
ucccugaaaauuagcauuuuaa

SEQ ID NO: 209782 - RNA, 22 nt, Homo sapiens
ucccugagguccuggauuauug

SEQ ID NO: 209783 - RNA, 22 nt, Homo sapiens
ucccugaguaucuaauguguuu

SEQ ID NO: 209784 - RNA, 22 nt, Homo sapiens
ucccuguguccugggggcaccu

SEQ ID NO: 209785 - RNA, 19 nt, Homo sapiens
ucccuuuguagguaaccug

SEQ ID NO: 209786 - RNA, 19 nt, Homo sapiens
ucccuuuguauggacauac

SEQ ID NO: 209787 - RNA, 22 nt, Homo sapiens
uccucauggagaaccucugcua

SEQ ID NO: 209788 - RNA, 22 nt, Homo sapiens
uccucugaacuccagacccaua

SEQ ID NO: 209789 - RNA, 22 nt, Homo sapiens
uccugagacucacaggcucccc

SEQ ID NO: 209790 - RNA, 22 nt, Homo sapiens
uccugagacugaggagcuuugg

SEQ ID NO: 209791 - RNA, 21 nt, Homo sapiens
uccugagagaggaguaacucu

SEQ ID NO: 209792 - RNA, 20 nt, Homo sapiens
uccugagauucccaguucuc

SEQ ID NO: 209793 - RNA, 22 nt, Homo sapiens
uccuggcuccacuguuuauucc

SEQ ID NO: 209794 - RNA, 22 nt, Homo sapiens
uccuugagaggacagagccaua

SEQ ID NO: 209795 - RNA, 22 nt, Homo sapiens
uccuugagccuuaaauuauaaa

SEQ ID NO: 209796 - RNA, 19 nt, Homo sapiens
uccuugauugcaccacugc

SEQ ID NO: 209797 - RNA, 22 nt, Homo sapiens
uccuuugguggagucuuuaggg

SEQ ID NO: 209798 - RNA, 20 nt, Homo sapiens
ucgcaccacuauacuccagc

SEQ ID NO: 209799 - RNA, 22 nt, Homo sapiens
ucgcaccauugcacuccagcca

SEQ ID NO: 209800 - RNA, 22 nt, Homo sapiens
ucgcagcacgagcaugcaaggu

SEQ ID NO: 209801 - RNA, 23 nt, Homo sapiens
ucgcagcauucaauaccaggcag

SEQ ID NO: 209802 - RNA, 22 nt, Homo sapiens
ucgugccacugcacuccagccu

SEQ ID NO: 209803 - RNA, 22 nt, Homo sapiens
ucguggccugugaguccucccc

SEQ ID NO: 209804 - RNA, 22 nt, Homo sapiens
ucuaagaauucauuuauaagcc

SEQ ID NO: 209805 - RNA, 22 nt, Homo sapiens
ucuaauguaaccugcaaauauu

SEQ ID NO: 209806 - RNA, 18 nt, Homo sapiens
ucuagacacugugucuau

SEQ ID NO: 209807 - RNA, 22 nt, Homo sapiens
ucuaucacagugauguuccaga

SEQ ID NO: 209808 - RNA, 22 nt, Homo sapiens
ucuauggaguuugaaugagaaa

SEQ ID NO: 209809 - RNA, 22 nt, Homo sapiens
ucucaaguggucgcaguuagau

SEQ ID NO: 209810 - RNA, 22 nt, Homo sapiens
ucucaguggcuuccucacuuuu

SEQ ID NO: 209811 - RNA, 22 nt, Homo sapiens
ucucaguggugcuggcagggga

SEQ ID NO: 209812 - RNA, 22 nt, Homo sapiens
ucucagugugguaaaaguuuuu

SEQ ID NO: 209813 - RNA, 22 nt, Homo sapiens
ucucaguguuaucuaucugccu

SEQ ID NO: 209814 - RNA, 22 nt, Homo sapiens
gagacagugucagccauugaaa

SEQ ID NO: 209815 - RNA, 22 nt, Homo sapiens
gagacauguuugcuuaucugag

SEQ ID NO: 209816 - RNA, 22 nt, Homo sapiens
gagagcauuaagccaucaucau

SEQ ID NO: 209817 - RNA, 22 nt, Homo sapiens
gagagguaguuuuuuggucguc

SEQ ID NO: 209818 - RNA, 22 nt, Homo sapiens
gagauacacccagugcagaggc

SEQ ID NO: 209819 - RNA, 21 nt, Homo sapiens
gagauagguaccgaagcuuag

SEQ ID NO: 209820 - RNA, 22 nt, Homo sapiens
gagauauuuagaaauguguucu

SEQ ID NO: 209821 - RNA, 22 nt, Homo sapiens
gagaucaaugccuauggcuuuc

SEQ ID NO: 209822 - RNA, 22 nt, Homo sapiens
gagaugguacacauacgauucu

SEQ ID NO: 209823 - RNA, 22 nt, Homo sapiens
gagaugguguuccacugccagu

SEQ ID NO: 209824 - RNA, 22 nt, Homo sapiens
gagaugugguucaaggguguuu

SEQ ID NO: 209825 - RNA, 22 nt, Homo sapiens
gagauuaauacacaucaaaugc

SEQ ID NO: 209826 - RNA, 22 nt, Homo sapiens
gagauuauuagauguucugcuu

SEQ ID NO: 209827 - RNA, 22 nt, Homo sapiens
gagauuauuuaaaaggugauuu

SEQ ID NO: 209828 - RNA, 22 nt, Homo sapiens
gagauucaucuagguccagaga

SEQ ID NO: 209829 - RNA, 22 nt, Homo sapiens
gagcaacaguggcagugguggg

SEQ ID NO: 209830 - RNA, 22 nt, Homo sapiens
gagcacauaugacauuuucuuc

SEQ ID NO: 209831 - RNA, 22 nt, Homo sapiens
gagcacauguggagagucuggg

SEQ ID NO: 209832 - RNA, 22 nt, Homo sapiens
gagcacugauuuauuuuugucu

SEQ ID NO: 209833 - RNA, 20 nt, Homo sapiens
gagcaucacaggccucugcu

SEQ ID NO: 209834 - RNA, 22 nt, Homo sapiens
gagcccauuucacuuguccagc

SEQ ID NO: 209835 - RNA, 22 nt, Homo sapiens
gagccuguaggaggagaggugg

SEQ ID NO: 209836 - RNA, 22 nt, Homo sapiens
gagcuagguuuugaauccagac

SEQ ID NO: 209837 - RNA, 22 nt, Homo sapiens
gagcucauuaaaaauguagaau

SEQ ID NO: 209838 - RNA, 22 nt, Homo sapiens
gagcuccuccccuuggcuuuca

SEQ ID NO: 209839 - RNA, 22 nt, Homo sapiens
gagcugaucuuuauguaaauuc

SEQ ID NO: 209840 - RNA, 22 nt, Homo sapiens
gagcugccuugccuaugcaaga

SEQ ID NO: 209841 - RNA, 22 nt, Homo sapiens
gagcugguccuuuaaggaugca

SEQ ID NO: 209842 - RNA, 20 nt, Homo sapiens
gagcugguguacugccgggc

SEQ ID NO: 209843 - RNA, 22 nt, Homo sapiens
gagcuuggguuaaaguugccuu

SEQ ID NO: 209844 - RNA, 22 nt, Homo sapiens
gagcuuguggucuucguguuau

SEQ ID NO: 209845 - RNA, 22 nt, Homo sapiens
gaggaaguaauuuuaggccugu

SEQ ID NO: 209846 - RNA, 22 nt, Homo sapiens
gaggaaguuuacaaagcaucug

SEQ ID NO: 209847 - RNA, 22 nt, Homo sapiens
gaggcauugaaauauugcuuau

SEQ ID NO: 209848 - RNA, 22 nt, Homo sapiens
gagguaagagaauaaacaguuu

SEQ ID NO: 209849 - RNA, 22 nt, Homo sapiens
gagguagggucccacuauguug

SEQ ID NO: 209850 - RNA, 22 nt, Homo sapiens
gagguagugagcagcugaacua

SEQ ID NO: 209851 - RNA, 22 nt, Homo sapiens
gagguauaauugacaagcaaaa

SEQ ID NO: 209852 - RNA, 22 nt, Homo sapiens
gaggucaugucgggccccagga

SEQ ID NO: 209853 - RNA, 22 nt, Homo sapiens
gaggucuuacauuuuaauauuu

SEQ ID NO: 209854 - RNA, 22 nt, Homo sapiens
gaggugguagguucacagcagc

SEQ ID NO: 209855 - RNA, 22 nt, Homo sapiens
gagguggugguggaggcauagc

SEQ ID NO: 209856 - RNA, 22 nt, Homo sapiens
gagguguaaggacaacagagac

SEQ ID NO: 209857 - RNA, 23 nt, Homo sapiens
gaguacauuaaaagcccagacug

SEQ ID NO: 209858 - RNA, 22 nt, Homo sapiens
gaguagaacugguuaucuaaua

SEQ ID NO: 209859 - RNA, 22 nt, Homo sapiens
gaguauauuugcacuguuaugu

SEQ ID NO: 209860 - RNA, 22 nt, Homo sapiens
gagucagugucuugcucuguca

SEQ ID NO: 209861 - RNA, 22 nt, Homo sapiens
auggcagcugacacuuccgucu

SEQ ID NO: 209862 - RNA, 22 nt, Homo sapiens
auggcauggugaagucuuugga

SEQ ID NO: 209863 - RNA, 22 nt, Homo sapiens
auggcauugaagaguugucccu

SEQ ID NO: 209864 - RNA, 22 nt, Homo sapiens
auggccauuacuaagaauguuu

SEQ ID NO: 209865 - RNA, 22 nt, Homo sapiens
auggcccaguuugcuaucccua

SEQ ID NO: 209866 - RNA, 22 nt, Homo sapiens
auggcccugggaaaggaggcau

SEQ ID NO: 209867 - RNA, 22 nt, Homo sapiens
auggcuagauuguaugguaguu

SEQ ID NO: 209868 - RNA, 22 nt, Homo sapiens
auggcucuguuuuuuaugcucu

SEQ ID NO: 209869 - RNA, 22 nt, Homo sapiens
aauugcacuaagcauaguccag

SEQ ID NO: 209870 - RNA, 22 nt, Homo sapiens
aauugcauugaauuuguagcuu

SEQ ID NO: 209871 - RNA, 22 nt, Homo sapiens
aauugguuaagauaagaucaua

SEQ ID NO: 209872 - RNA, 22 nt, Homo sapiens
aauugugcuuguaggccaggca

SEQ ID NO: 209873 - RNA, 21 nt, Homo sapiens
acaaagcuggagggagacugc

SEQ ID NO: 209874 - RNA, 22 nt, Homo sapiens
acaaaguauggaauguuggugu

SEQ ID NO: 209875 - RNA, 22 nt, Homo sapiens
acaaccauuguaagggcuuugg

SEQ ID NO: 209876 - RNA, 22 nt, Homo sapiens
acaagugaauacaggauucucu

SEQ ID NO: 209877 - RNA, 22 nt, Homo sapiens
acacaaugguaaguguuugugu

SEQ ID NO: 209878 - RNA, 22 nt, Homo sapiens
acacaguaaauauugucuccuc

SEQ ID NO: 209879 - RNA, 22 nt, Homo sapiens
acacagucaaauccacuuggcu

SEQ ID NO: 209880 - RNA, 22 nt, Homo sapiens
acacaguguuuauugugguuag

SEQ ID NO: 209881 - RNA, 22 nt, Homo sapiens
acacaugugaaaaaaauguuac

SEQ ID NO: 209882 - RNA, 22 nt, Homo sapiens
acacauuggcaauucuggagca

SEQ ID NO: 209883 - RNA, 22 nt, Homo sapiens
acacuauugagguuuguuugca

SEQ ID NO: 209884 - RNA, 20 nt, Homo sapiens
acacuggaguaucaaggccc

SEQ ID NO: 209885 - RNA, 22 nt, Homo sapiens
acacuggaguuaaaggugauuu

SEQ ID NO: 209886 - RNA, 20 nt, Homo sapiens
acacuggcuuugagauuuag

SEQ ID NO: 209887 - RNA, 22 nt, Homo sapiens
acacuguacuuauguuuugcag

SEQ ID NO: 209888 - RNA, 22 nt, Homo sapiens
acacuguccaguuaggcuacau

SEQ ID NO: 209889 - RNA, 22 nt, Homo sapiens
acacugucugaugaaaguaguu

SEQ ID NO: 209890 - RNA, 22 nt, Homo sapiens
acacuguuggugggaguguaaa

SEQ ID NO: 209891 - RNA, 22 nt, Homo sapiens
acacuguuuuguggagaaugua

SEQ ID NO: 209892 - RNA, 22 nt, Homo sapiens
acagaauucucagaacugggag

SEQ ID NO: 209893 - RNA, 19 nt, Homo sapiens
acagauagaauguucuaca

SEQ ID NO: 209894 - RNA, 22 nt, Homo sapiens
acagcacugccaagugacccau

SEQ ID NO: 209895 - RNA, 20 nt, Homo sapiens
acagcauagccuuuuaaagc

SEQ ID NO: 209896 - RNA, 22 nt, Homo sapiens
acaggagugggauuugaguccu

SEQ ID NO: 209897 - RNA, 22 nt, Homo sapiens
acagguacacagaauauccaga

SEQ ID NO: 209898 - RNA, 22 nt, Homo sapiens
acagguauagaaagcuaaaggg

SEQ ID NO: 209899 - RNA, 21 nt, Homo sapiens
acaguacuugagaucuuuuga

SEQ ID NO: 209900 - RNA, 20 nt, Homo sapiens
acaguagaagggauuucaaa

SEQ ID NO: 209901 - RNA, 21 nt, Homo sapiens
acaguaguaauaguguagcca

SEQ ID NO: 209902 - RNA, 22 nt, Homo sapiens
acaguauaaugcuguagggaga

SEQ ID NO: 209903 - RNA, 19 nt, Homo sapiens
acaguauugugcacagguu

SEQ ID NO: 209904 - RNA, 22 nt, Homo sapiens
acagucauagcagccuuuguua

SEQ ID NO: 209905 - RNA, 18 nt, Homo sapiens
acagugcugucacugcuu

SEQ ID NO: 209906 - RNA, 22 nt, Homo sapiens
acagugcuguuguguuuucacg

SEQ ID NO: 209907 - RNA, 22 nt, Homo sapiens
acagugcuuucaauguucagua

SEQ ID NO: 209908 - RNA, 22 nt, Homo sapiens
acaguggaauguaggguuugag

SEQ ID NO: 209909 - RNA, 23 nt, Homo sapiens
acaguggugugaucuuggcucag

SEQ ID NO: 209910 - RNA, 22 nt, Homo sapiens
acaguguagugacugccaacuu

SEQ ID NO: 209911 - RNA, 18 nt, Homo sapiens
acagugucauggcucaau

SEQ ID NO: 209912 - RNA, 22 nt, Homo sapiens
acaguguguguguucaccuaga

SEQ ID NO: 209913 - RNA, 22 nt, Homo sapiens
acauaaagaagcaggacauugu

SEQ ID NO: 209914 - RNA, 22 nt, Homo sapiens
acaucccaugccuggguacucc

SEQ ID NO: 209915 - RNA, 22 nt, Homo sapiens
acauguagacaacggacaaagu

SEQ ID NO: 209916 - RNA, 22 nt, Homo sapiens
accacaggguaaaguuagauau

SEQ ID NO: 209917 - RNA, 22 nt, Homo sapiens
accacagugcuuccugcucacg

SEQ ID NO: 209918 - RNA, 22 nt, Homo sapiens
accacuguuucaagaagcuugu

SEQ ID NO: 209919 - RNA, 19 nt, Homo sapiens
accagauugcauucuugga

SEQ ID NO: 209920 - RNA, 17 nt, Homo sapiens
accagugcaugugcuuu

SEQ ID NO: 209921 - RNA, 22 nt, Homo sapiens
accauugcacuccagcccaggc

SEQ ID NO: 209922 - RNA, 22 nt, Homo sapiens
accauugcacuccagcccgggc

SEQ ID NO: 209923 - RNA, 22 nt, Homo sapiens
acccagaagucauucaggaaca

SEQ ID NO: 209924 - RNA, 22 nt, Homo sapiens
acccaguaacauaugggaggga

SEQ ID NO: 209925 - RNA, 22 nt, Homo sapiens
acccaguagucauucaggagca

SEQ ID NO: 209926 - RNA, 17 nt, Homo sapiens
acccagucuuuuugcac

SEQ ID NO: 209927 - RNA, 22 nt, Homo sapiens
acccaguguucagacuaccugu

SEQ ID NO: 209928 - RNA, 22 nt, Homo sapiens
acccaguguugggcagaacugu

SEQ ID NO: 209929 - RNA, 22 nt, Homo sapiens
accccauuugcacugagcccuu

SEQ ID NO: 209930 - RNA, 23 nt, Homo sapiens
accccuacaggcuuguguccugc

SEQ ID NO: 209931 - RNA, 22 nt, Homo sapiens
acccgcccagguguggccggga

SEQ ID NO: 209932 - RNA, 22 nt, Homo sapiens
acccgggaggcaggagucauag

SEQ ID NO: 209933 - RNA, 22 nt, Homo sapiens
acccgugcugaauauguaggug

SEQ ID NO: 209934 - RNA, 22 nt, Homo sapiens
acccguuacuuagcagaccagg

SEQ ID NO: 209935 - RNA, 22 nt, Homo sapiens
acccucaagggacugacagaau

SEQ ID NO: 209936 - RNA, 22 nt, Homo sapiens
aucucaguuaaugacccuaugc

SEQ ID NO: 209937 - RNA, 22 nt, Homo sapiens
aucugcaaagcugggcugagac

SEQ ID NO: 209938 - RNA, 22 nt, Homo sapiens
aucugcauuagggugaagaccu

SEQ ID NO: 209939 - RNA, 22 nt, Homo sapiens
aucuggcuccuuuugacaaugc

SEQ ID NO: 209940 - RNA, 22 nt, Homo sapiens
aucugguguauuggugcugggu

SEQ ID NO: 209941 - RNA, 22 nt, Homo sapiens
aucugguguggcugugauccuc

SEQ ID NO: 209942 - RNA, 22 nt, Homo sapiens
aucugguguuuuucucccucgu

SEQ ID NO: 209943 - RNA, 22 nt, Homo sapiens
aucuucucuugaagggugggga

SEQ ID NO: 209944 - RNA, 22 nt, Homo sapiens
aucuuggauuaccugggugggu

SEQ ID NO: 209945 - RNA, 22 nt, Homo sapiens
aucuuguguugaauggugcaga

SEQ ID NO: 209946 - RNA, 22 nt, Homo sapiens
aucuuugcugagaugcauggca

SEQ ID NO: 209947 - RNA, 22 nt, Homo sapiens
aucuuuggcgggaauaucacag

SEQ ID NO: 209948 - RNA, 22 nt, Homo sapiens
aucuuuggucaucacagcuaga

SEQ ID NO: 209949 - RNA, 22 nt, Homo sapiens
augaaagguauguuuucuguga

SEQ ID NO: 209950 - RNA, 22 nt, Homo sapiens
augaaaucuuuccugugaggau

SEQ ID NO: 209951 - RNA, 22 nt, Homo sapiens
augaaaucuuuggcagaucuua

SEQ ID NO: 209952 - RNA, 22 nt, Homo sapiens
augaacacuccaauuguacucc

SEQ ID NO: 209953 - RNA, 21 nt, Homo sapiens
augaacucaucauuuuuuaug

SEQ ID NO: 209954 - RNA, 19 nt, Homo sapiens
augaacucauucuuuuuau

SEQ ID NO: 209955 - RNA, 22 nt, Homo sapiens
augaagcuagcugauugcugau

SEQ ID NO: 209956 - RNA, 18 nt, Homo sapiens
augaagucaucacuuuua

SEQ ID NO: 209957 - RNA, 22 nt, Homo sapiens
augaauccauuccugccacaga

SEQ ID NO: 209958 - RNA, 22 nt, Homo sapiens
augaaugcagcacuguuuuucu

SEQ ID NO: 209959 - RNA, 23 nt, Homo sapiens
augaauguaaagaaugugggaag

SEQ ID NO: 209960 - RNA, 20 nt, Homo sapiens
augaauguccuugauggcau

SEQ ID NO: 209961 - RNA, 22 nt, Homo sapiens
augaaugucuuauuuugagaaa

SEQ ID NO: 209962 - RNA, 22 nt, Homo sapiens
augaauucaucugguuuuggga

SEQ ID NO: 209963 - RNA, 22 nt, Homo sapiens
augacaguguggauuauuguaa

SEQ ID NO: 209964 - RNA, 22 nt, Homo sapiens
augaccaaagaaaugcuauagg

SEQ ID NO: 209965 - RNA, 22 nt, Homo sapiens
augacugagacuaacuuacuuu

SEQ ID NO: 209966 - RNA, 22 nt, Homo sapiens
augacuggauaauggacacaca

SEQ ID NO: 209967 - RNA, 17 nt, Homo sapiens
augacuucuucagugug

SEQ ID NO: 209968 - RNA, 22 nt, Homo sapiens
augagaacauaucaagugauug

SEQ ID NO: 209969 - RNA, 22 nt, Homo sapiens
augagaauguaaguuaaugaaa

SEQ ID NO: 209970 - RNA, 22 nt, Homo sapiens
augagacaguucccuuuaucuu

SEQ ID NO: 209971 - RNA, 22 nt, Homo sapiens
augagacauuaaaguguguuug

SEQ ID NO: 209972 - RNA, 22 nt, Homo sapiens
augagauacuacaaaugaguuu

SEQ ID NO: 209973 - RNA, 22 nt, Homo sapiens
augagauauuuuauaagaucau

SEQ ID NO: 209974 - RNA, 22 nt, Homo sapiens
augagaucaaauuuaagcuguu

SEQ ID NO: 209975 - RNA, 22 nt, Homo sapiens
augagaugauaggcguucuaac

SEQ ID NO: 209976 - RNA, 22 nt, Homo sapiens
augagauucuuagagaagucug

SEQ ID NO: 209977 - RNA, 22 nt, Homo sapiens
augagauuguuugugugaaaua

SEQ ID NO: 209978 - RNA, 22 nt, Homo sapiens
augagcagaugcuccugccucu

SEQ ID NO: 209979 - RNA, 22 nt, Homo sapiens
augagcuguuuggaagacacuu

SEQ ID NO: 209980 - RNA, 22 nt, Homo sapiens
augaggagguaugauuuucuga

SEQ ID NO: 209981 - RNA, 22 nt, Homo sapiens
augaggcaggaaaggcguaucu

SEQ ID NO: 209982 - RNA, 22 nt, Homo sapiens
augagguaauaaguccuuggaa

SEQ ID NO: 209983 - RNA, 22 nt, Homo sapiens
augagguaguagaaagucaggu

SEQ ID NO: 209984 - RNA, 22 nt, Homo sapiens
augaggugaguaaauaaaugaa

SEQ ID NO: 209985 - RNA, 22 nt, Homo sapiens
augaggugauaucuggaaauua

SEQ ID NO: 209986 - RNA, 22 nt, Homo sapiens
augaggugggcggcuuggaaga

SEQ ID NO: 209987 - RNA, 22 nt, Homo sapiens
augagguguuuauuguauccug

SEQ ID NO: 209988 - RNA, 22 nt, Homo sapiens
augaguaugagaauacauuaag

SEQ ID NO: 209989 - RNA, 22 nt, Homo sapiens
augaguauguucuguauuuuca

SEQ ID NO: 209990 - RNA, 22 nt, Homo sapiens
augauauggucacccuuaugaa

SEQ ID NO: 209991 - RNA, 22 nt, Homo sapiens
augauauguuuguagcuaucuc

SEQ ID NO: 209992 - RNA, 22 nt, Homo sapiens
augaucacaccacugcacucca

SEQ ID NO: 209993 - RNA, 22 nt, Homo sapiens
augaucuguuuggugaucuugu

SEQ ID NO: 209994 - RNA, 22 nt, Homo sapiens
augaugaaguaagugcuuagga

SEQ ID NO: 209995 - RNA, 22 nt, Homo sapiens
augauguaggccauggguuucu

SEQ ID NO: 209996 - RNA, 22 nt, Homo sapiens
augauguguguuuaagaugucu

SEQ ID NO: 209997 - RNA, 22 nt, Homo sapiens
augcaaacagcuaucuggcugg

SEQ ID NO: 209998 - RNA, 20 nt, Homo sapiens
augcaaacccugcuuugugg

SEQ ID NO: 209999 - RNA, 22 nt, Homo sapiens
augcaagacaccacgugagaau

SEQ ID NO: 210000 - RNA, 22 nt, Homo sapiens
augcaagacaccgauuagcuuu

SEQ ID NO: 210001 - RNA, 22 nt, Homo sapiens
augcacauggcuaacuuuuuuc

SEQ ID NO: 210002 - RNA, 22 nt, Homo sapiens
augcagacacaaguuauaguaa

SEQ ID NO: 210003 - RNA, 22 nt, Homo sapiens
augcagaucacauuuuucuguc

SEQ ID NO: 210004 - RNA, 22 nt, Homo sapiens
augcagugugcaacagauuaag

SEQ ID NO: 210005 - RNA, 22 nt, Homo sapiens
augcauagcaucugcaaauguu

SEQ ID NO: 210006 - RNA, 22 nt, Homo sapiens
augcauauuccugggccucacu

SEQ ID NO: 210007 - RNA, 18 nt, Homo sapiens
augcauauuuuaaguugu

SEQ ID NO: 210008 - RNA, 22 nt, Homo sapiens
augcauggcagagucaggguac

SEQ ID NO: 210009 - RNA, 22 nt, Homo sapiens
augcauggucugaagucaaccu

SEQ ID NO: 210010 - RNA, 22 nt, Homo sapiens
augcaugucaaauuuguagguu

SEQ ID NO: 210011 - RNA, 22 nt, Homo sapiens
augccaagaugagcacgcgucu

SEQ ID NO: 210012 - RNA, 20 nt, Homo sapiens
augccacugagcagugguga

SEQ ID NO: 210013 - RNA, 22 nt, Homo sapiens
augcuacugaccccuacuuaca

SEQ ID NO: 210014 - RNA, 22 nt, Homo sapiens
augcuacuggauuuguauaaau

SEQ ID NO: 210015 - RNA, 22 nt, Homo sapiens
augcuauguagaugagggccca

SEQ ID NO: 210016 - RNA, 19 nt, Homo sapiens
augcugguguugcucaaac

SEQ ID NO: 210017 - RNA, 22 nt, Homo sapiens
augcuuguguuggggcagugga

SEQ ID NO: 210018 - RNA, 22 nt, Homo sapiens
auggaacugaagugcugcccuu

SEQ ID NO: 210019 - RNA, 22 nt, Homo sapiens
auggaagaaaguuggguucuug

SEQ ID NO: 210020 - RNA, 22 nt, Homo sapiens
auggaagaauugucggggaugu

SEQ ID NO: 210021 - RNA, 22 nt, Homo sapiens
auggaaggagaauggucuuuga

SEQ ID NO: 210022 - RNA, 22 nt, Homo sapiens
auggaaggagaggaaugaauga

SEQ ID NO: 210023 - RNA, 22 nt, Homo sapiens
auggaauggcacuuugaagauu

SEQ ID NO: 210024 - RNA, 22 nt, Homo sapiens
auggaaugguugggucauaagg

SEQ ID NO: 210025 - RNA, 22 nt, Homo sapiens
auggaauguaaguuauguuugc

SEQ ID NO: 210026 - RNA, 22 nt, Homo sapiens
auggaauguauagucauguagg

SEQ ID NO: 210027 - RNA, 22 nt, Homo sapiens
auggacguagauucucaaggau

SEQ ID NO: 210028 - RNA, 22 nt, Homo sapiens
auggagaugaauaucaucuguu

SEQ ID NO: 210029 - RNA, 22 nt, Homo sapiens
auggagguguggggagugaguu

SEQ ID NO: 210030 - RNA, 22 nt, Homo sapiens
auggaucuuucugcuuuugaau

SEQ ID NO: 210031 - RNA, 22 nt, Homo sapiens
auggauugucuccuugugccau

SEQ ID NO: 210032 - RNA, 22 nt, Homo sapiens
auggcaaaaaaugcaauuacuu

SEQ ID NO: 210033 - RNA, 22 nt, Homo sapiens
auggcacagacucuuggucaag

SEQ ID NO: 210034 - RNA, 22 nt, Homo sapiens
auggcacuccagccugggcaac

SEQ ID NO: 210035 - RNA, 22 nt, Homo sapiens
auggcacugaagcguauugaca

SEQ ID NO: 210036 - RNA, 22 nt, Homo sapiens
auggcacugccuggcuucaugg

SEQ ID NO: 210037 - RNA, 18 nt, Homo sapiens
auggcagaacaauuuaca

SEQ ID NO: 210038 - RNA, 22 nt, Homo sapiens
aacaccauucucuguaacaaga

SEQ ID NO: 210039 - RNA, 22 nt, Homo sapiens
aacacuggcugcucgaguucuc

SEQ ID NO: 210040 - RNA, 22 nt, Homo sapiens
aacacuguuuccagucaugauc

SEQ ID NO: 210041 - RNA, 22 nt, Homo sapiens
aacagaccuagauaguauaguc

SEQ ID NO: 210042 - RNA, 22 nt, Homo sapiens
aacagcacacccgcugcuucca

SEQ ID NO: 210043 - RNA, 22 nt, Homo sapiens
aaccuacauucuuaacuguugc

SEQ ID NO: 210044 - RNA, 22 nt, Homo sapiens
aaccuuuagucagcucuuagga

SEQ ID NO: 210045 - RNA, 22 nt, Homo sapiens
aacuaugucaaauaaaaugagg

SEQ ID NO: 210046 - RNA, 22 nt, Homo sapiens
aacugcacauauuuguaugggu

SEQ ID NO: 210047 - RNA, 22 nt, Homo sapiens
aacugccucugacauaggcagg

SEQ ID NO: 210048 - RNA, 22 nt, Homo sapiens
aacugcucuaauguggugggag

SEQ ID NO: 210049 - RNA, 22 nt, Homo sapiens
aacuggcauauucugguugcgg

SEQ ID NO: 210050 - RNA, 22 nt, Homo sapiens
aacuggccuggcgugcagaggg

SEQ ID NO: 210051 - RNA, 22 nt, Homo sapiens
aacuggucuuaugcaagcacua

SEQ ID NO: 210052 - RNA, 21 nt, Homo sapiens
aagaaagcuggacuugccgcu

SEQ ID NO: 210053 - RNA, 22 nt, Homo sapiens
aagagcucucuguagcauguga

SEQ ID NO: 210054 - RNA, 22 nt, Homo sapiens
aagagguaauaacaaagcuucu

SEQ ID NO: 210055 - RNA, 22 nt, Homo sapiens
aagagguagcagucacaaaaga

SEQ ID NO: 210056 - RNA, 22 nt, Homo sapiens
aagagugucuuugugcuggccc

SEQ ID NO: 210057 - RNA, 22 nt, Homo sapiens
aagauagcuaagcuucuucuaa

SEQ ID NO: 210058 - RNA, 20 nt, Homo sapiens
aagcaagcauuugcaaucau

SEQ ID NO: 210059 - RNA, 22 nt, Homo sapiens
aagcaccaauaggagauuuguc

SEQ ID NO: 210060 - RNA, 22 nt, Homo sapiens
aagcaccguugccuccccugca

SEQ ID NO: 210061 - RNA, 22 nt, Homo sapiens
aagcagacauguucauuuugaa

SEQ ID NO: 210062 - RNA, 23 nt, Homo sapiens
aagcaugcacagcuguuuguggu

SEQ ID NO: 210063 - RNA, 22 nt, Homo sapiens
aagccacuguaccugucucuua

SEQ ID NO: 210064 - RNA, 22 nt, Homo sapiens
aagccagugugacaggaaacuu

SEQ ID NO: 210065 - RNA, 22 nt, Homo sapiens
aagcuagugagacagugguacu

SEQ ID NO: 210066 - RNA, 22 nt, Homo sapiens
aagcugcauuuucuagaugcuu

SEQ ID NO: 210067 - RNA, 22 nt, Homo sapiens
aagcuggauuucgcauccuguu

SEQ ID NO: 210068 - RNA, 22 nt, Homo sapiens
aagcuguguguaagcucucaca

SEQ ID NO: 210069 - RNA, 22 nt, Homo sapiens
aagcuguugguggauguaccau

SEQ ID NO: 210070 - RNA, 22 nt, Homo sapiens
aaggaaguaauuugguuuauag

SEQ ID NO: 210071 - RNA, 22 nt, Homo sapiens
aaggaauacuggugguugcuau

SEQ ID NO: 210072 - RNA, 22 nt, Homo sapiens
aaggagcuuaagugacuuguac

SEQ ID NO: 210073 - RNA, 22 nt, Homo sapiens
aaggaguagaauagaugcaccu

SEQ ID NO: 210074 - RNA, 22 nt, Homo sapiens
aaggaguagacaacauggcgcc

SEQ ID NO: 210075 - RNA, 22 nt, Homo sapiens
aaggaguagaggaauagcaaug

SEQ ID NO: 210076 - RNA, 22 nt, Homo sapiens
aaggaguaucuguuuucucacc

SEQ ID NO: 210077 - RNA, 22 nt, Homo sapiens
aaggcaagaagagaaccaucgg

SEQ ID NO: 210078 - RNA, 22 nt, Homo sapiens
aaggcaagauacugguugcuga

SEQ ID NO: 210079 - RNA, 22 nt, Homo sapiens
aaggcagucacuaaauagugag

SEQ ID NO: 210080 - RNA, 22 nt, Homo sapiens
aaggcaguggcagaagauguca

SEQ ID NO: 210081 - RNA, 22 nt, Homo sapiens
aaggcaugcaaagaacauuuua

SEQ ID NO: 210082 - RNA, 23 nt, Homo sapiens
aagguaagcuagaaagauguaga

SEQ ID NO: 210083 - RNA, 22 nt, Homo sapiens
aagguagcugagugaagugguu

SEQ ID NO: 210084 - RNA, 22 nt, Homo sapiens
aagguagguuccaaaauaccua

SEQ ID NO: 210085 - RNA, 22 nt, Homo sapiens
aagguaguuuucuuuaaugcug

SEQ ID NO: 210086 - RNA, 17 nt, Homo sapiens
aaggugcuucgaccucc

SEQ ID NO: 210087 - RNA, 22 nt, Homo sapiens
aagguuguauuuaauauacugu

SEQ ID NO: 210088 - RNA, 22 nt, Homo sapiens
aaguaaauauccgguaguccca

SEQ ID NO: 210089 - RNA, 22 nt, Homo sapiens
aaguaauggaguuauuuuauga

SEQ ID NO: 210090 - RNA, 22 nt, Homo sapiens
aaguaauugagguuuuugcugu

SEQ ID NO: 210091 - RNA, 19 nt, Homo sapiens
aaguacuugucuuuugaag

SEQ ID NO: 210092 - RNA, 22 nt, Homo sapiens
aaguagcagaggcaagacuuga

SEQ ID NO: 210093 - RNA, 19 nt, Homo sapiens
aaguaguugugacagaugc

SEQ ID NO: 210094 - RNA, 22 nt, Homo sapiens
gacugcagugcagcuguuaggc

SEQ ID NO: 210095 - RNA, 22 nt, Homo sapiens
gacuggagcuguaugugguuac

SEQ ID NO: 210096 - RNA, 22 nt, Homo sapiens
gacuuugguagaggaaaaaucu

SEQ ID NO: 210097 - RNA, 22 nt, Homo sapiens
gagaaccauuuggagaaaaagu

SEQ ID NO: 210098 - RNA, 22 nt, Homo sapiens
gagaacugagauaagugauauu

SEQ ID NO: 210099 - RNA, 21 nt, Homo sapiens
gagaaucaucauggcugcaua

SEQ ID NO: 210100 - RNA, 22 nt, Homo sapiens
gagacauguuugccaauaauuu

SEQ ID NO: 210101 - RNA, 22 nt, Homo sapiens
gagacauugacuuuguuccaga

SEQ ID NO: 210102 - RNA, 23 nt, Homo sapiens
gagaccagcuucagaaagcacga

SEQ ID NO: 210103 - RNA, 22 nt, Homo sapiens
gagacugagucucacucuguca

SEQ ID NO: 210104 - RNA, 22 nt, Homo sapiens
gagacugagucucgcucugccg

SEQ ID NO: 210105 - RNA, 22 nt, Homo sapiens
gagacugagucuugcucugucg

SEQ ID NO: 210106 - RNA, 22 nt, Homo sapiens
gagacugagucuugcuuuguca

SEQ ID NO: 210107 - RNA, 22 nt, Homo sapiens
gagacugaguuuugcucuuguu

SEQ ID NO: 210108 - RNA, 22 nt, Homo sapiens
gagagaguacuugauauaauuu

SEQ ID NO: 210109 - RNA, 22 nt, Homo sapiens
gagagcuaggccacuggggcuu

SEQ ID NO: 210110 - RNA, 22 nt, Homo sapiens
gagaggucguauaugauuucug

SEQ ID NO: 210111 - RNA, 22 nt, Homo sapiens
gagagucacagugaauguggca

SEQ ID NO: 210112 - RNA, 22 nt, Homo sapiens
gagagugcuuggcaucugcuga

SEQ ID NO: 210113 - RNA, 22 nt, Homo sapiens
gagagugcuuuggguguaggcc

SEQ ID NO: 210114 - RNA, 22 nt, Homo sapiens
gagauaaauaggucacaguucu

SEQ ID NO: 210115 - RNA, 22 nt, Homo sapiens
gagauaauagcuauaggaucuu

SEQ ID NO: 210116 - RNA, 22 nt, Homo sapiens
gagauaggauucacuuucaugu

SEQ ID NO: 210117 - RNA, 22 nt, Homo sapiens
gagauauguuggcagcugguau

SEQ ID NO: 210118 - RNA, 22 nt, Homo sapiens
gagauauucugguuuacuaaau

SEQ ID NO: 210119 - RNA, 22 nt, Homo sapiens
gagaucaaugggauggaauuga

SEQ ID NO: 210120 - RNA, 22 nt, Homo sapiens
gagaucaauucauggcauaguu

SEQ ID NO: 210121 - RNA, 22 nt, Homo sapiens
gagaucauuaugucagggguca

SEQ ID NO: 210122 - RNA, 22 nt, Homo sapiens
gagaucuuggccaaguuucuua

SEQ ID NO: 210123 - RNA, 22 nt, Homo sapiens
gagaugaaaucuugcucuguca

SEQ ID NO: 210124 - RNA, 22 nt, Homo sapiens
gagaugaagugucaauaaggau

SEQ ID NO: 210125 - RNA, 22 nt, Homo sapiens
gagcaucaauggcaugugggaa

SEQ ID NO: 210126 - RNA, 22 nt, Homo sapiens
gagcuagcauuuagacaucugg

SEQ ID NO: 210127 - RNA, 22 nt, Homo sapiens
gagcuagugcuuaugcaccacu

SEQ ID NO: 210128 - RNA, 22 nt, Homo sapiens
gagcugaaguuuccauuuguac

SEQ ID NO: 210129 - RNA, 22 nt, Homo sapiens
gagcuguuuuucacuagaccaa

SEQ ID NO: 210130 - RNA, 22 nt, Homo sapiens
gaggacauuaugcuaaguggaa

SEQ ID NO: 210131 - RNA, 22 nt, Homo sapiens
gaggcaagaguaguuaaguuag

SEQ ID NO: 210132 - RNA, 22 nt, Homo sapiens
gaggcaaguggccaccgagucu

SEQ ID NO: 210133 - RNA, 22 nt, Homo sapiens
gaggcaauaugagggaggcuuc

SEQ ID NO: 210134 - RNA, 22 nt, Homo sapiens
gaggcaaugugcccggcccaca

SEQ ID NO: 210135 - RNA, 22 nt, Homo sapiens
gaggcggugugaugucacaugc

SEQ ID NO: 210136 - RNA, 22 nt, Homo sapiens
gagggcacugcuuuccuuucaa

SEQ ID NO: 210137 - RNA, 22 nt, Homo sapiens
gagguaagaaagucaguccuuc

SEQ ID NO: 210138 - RNA, 22 nt, Homo sapiens
gagguaaguaagaauggcaagc

SEQ ID NO: 210139 - RNA, 21 nt, Homo sapiens
gagguagggauuaaagaccuc

SEQ ID NO: 210140 - RNA, 22 nt, Homo sapiens
gagguagguacaauugccacca

SEQ ID NO: 210141 - RNA, 22 nt, Homo sapiens
gagguagguuugguuacaaaag

SEQ ID NO: 210142 - RNA, 22 nt, Homo sapiens
gaggucauguggcaggcagcca

SEQ ID NO: 210143 - RNA, 22 nt, Homo sapiens
gaggugauaucucauugugguu

SEQ ID NO: 210144 - RNA, 22 nt, Homo sapiens
gagguggauacauuaaauaaug

SEQ ID NO: 210145 - RNA, 22 nt, Homo sapiens
gagguguagagauauaccugaa

SEQ ID NO: 210146 - RNA, 22 nt, Homo sapiens
gaguaaaugucaaguacuuagg

SEQ ID NO: 210147 - RNA, 22 nt, Homo sapiens
gaguaaauguccuagcuucuug

SEQ ID NO: 210148 - RNA, 22 nt, Homo sapiens
gaguaacauugacaacuucaug

SEQ ID NO: 210149 - RNA, 22 nt, Homo sapiens
gagugcaaagguccugaggugg

SEQ ID NO: 210150 - RNA, 23 nt, Homo sapiens
gagugcaaugacaugaucucgga

SEQ ID NO: 210151 - RNA, 22 nt, Homo sapiens
gagugcaauggcagaucuccgc

SEQ ID NO: 210152 - RNA, 22 nt, Homo sapiens
gagugcaauggcgcgaucuggg

SEQ ID NO: 210153 - RNA, 22 nt, Homo sapiens
gagugcaauggugccaucucgg

SEQ ID NO: 210154 - RNA, 22 nt, Homo sapiens
gagugcugagcccacuuccuug

SEQ ID NO: 210155 - RNA, 23 nt, Homo sapiens
gaguggagacucauugauuuccu

SEQ ID NO: 210156 - RNA, 21 nt, Homo sapiens
gaguggcuuuuguuucaccag

SEQ ID NO: 210157 - RNA, 22 nt, Homo sapiens
gagugguuuugauuuauagcug

SEQ ID NO: 210158 - RNA, 22 nt, Homo sapiens
gaguuuguacuaauuuguugua

SEQ ID NO: 210159 - RNA, 22 nt, Homo sapiens
gauaaauccagauucugaugua

SEQ ID NO: 210160 - RNA, 22 nt, Homo sapiens
gauaaaucuuggcuagucuaag

SEQ ID NO: 210161 - RNA, 22 nt, Homo sapiens
gauaacagauaaugucaguuau

SEQ ID NO: 210162 - RNA, 22 nt, Homo sapiens
gauacaguaugcaugugguauu

SEQ ID NO: 210163 - RNA, 22 nt, Homo sapiens
gauauguacagcucucuaggau

SEQ ID NO: 210164 - RNA, 22 nt, Homo sapiens
gauauguuagggggagaaguua

SEQ ID NO: 210165 - RNA, 22 nt, Homo sapiens
gaucccauuggcugccaugugg

SEQ ID NO: 210166 - RNA, 22 nt, Homo sapiens
gaucugucuuuccuuauagucu

SEQ ID NO: 210167 - RNA, 22 nt, Homo sapiens
gaucugugugauuggaugcauu

SEQ ID NO: 210168 - RNA, 22 nt, Homo sapiens
gaucuguuuuccuauuguuugu

SEQ ID NO: 210169 - RNA, 22 nt, Homo sapiens
gaugagaucauaaguguggagc

SEQ ID NO: 210170 - RNA, 22 nt, Homo sapiens
gaugagauguucucauggauug

SEQ ID NO: 210171 - RNA, 22 nt, Homo sapiens
gaugagcuaaguucucacagca

SEQ ID NO: 210172 - RNA, 22 nt, Homo sapiens
gaugagguagaagacucagcaa

SEQ ID NO: 210173 - RNA, 22 nt, Homo sapiens
gaugauguuggaaacuuggugc

SEQ ID NO: 210174 - RNA, 22 nt, Homo sapiens
gaugauguuugauaaauaauaa

SEQ ID NO: 210175 - RNA, 19 nt, Homo sapiens
gaugcaaugcacugagguc

SEQ ID NO: 210176 - RNA, 22 nt, Homo sapiens
gauggauuuuaagugaaugaaa

SEQ ID NO: 210177 - RNA, 22 nt, Homo sapiens
gauggauuuuuuaggcagagcu

SEQ ID NO: 210178 - RNA, 22 nt, Homo sapiens
gauggcucugcaggugagggua

SEQ ID NO: 210179 - RNA, 22 nt, Homo sapiens
gaugguuuuucuccgauuuaua

SEQ ID NO: 210180 - RNA, 18 nt, Homo sapiens
gauguaguauggugugga

SEQ ID NO: 210181 - RNA, 22 nt, Homo sapiens
gaugugaaaucauaguuucuag

SEQ ID NO: 210182 - RNA, 22 nt, Homo sapiens
gauguguuuccaggauuuguuu

SEQ ID NO: 210183 - RNA, 22 nt, Homo sapiens
gauuauagaaguaauggguuua

SEQ ID NO: 210184 - RNA, 22 nt, Homo sapiens
gauuccacuuacuuagcauucc

SEQ ID NO: 210185 - RNA, 22 nt, Homo sapiens
gauugcaauuuaggugagagag

SEQ ID NO: 210186 - RNA, 22 nt, Homo sapiens
gauugcuaaauuguccuucugu

SEQ ID NO: 210187 - RNA, 22 nt, Homo sapiens
gauuguguucauaggcauguua

SEQ ID NO: 210188 - RNA, 22 nt, Homo sapiens
gauuuuccaguggcccugauca

SEQ ID NO: 210189 - RNA, 21 nt, Homo sapiens
gcaaacauccuuugaugccag

SEQ ID NO: 210190 - RNA, 22 nt, Homo sapiens
gcaaaguguuuuuaggaagucu

SEQ ID NO: 210191 - RNA, 20 nt, Homo sapiens
gcaaaguuuagcucccacua

SEQ ID NO: 210192 - RNA, 22 nt, Homo sapiens
gcaaaucuuauguccucacauu

SEQ ID NO: 210193 - RNA, 20 nt, Homo sapiens
gcaaauggaucccacaagcc

SEQ ID NO: 210194 - RNA, 20 nt, Homo sapiens
gcaacauggccagagugaau

SEQ ID NO: 210195 - RNA, 22 nt, Homo sapiens
gccauugcacuacagccuaggc

SEQ ID NO: 210196 - RNA, 22 nt, Homo sapiens
gccauugcacuccagccuaggu

SEQ ID NO: 210197 - RNA, 22 nt, Homo sapiens
gccauugcacucuagccugagc

SEQ ID NO: 210198 - RNA, 22 nt, Homo sapiens
gccgagagauuuggaaugggga

SEQ ID NO: 210199 - RNA, 22 nt, Homo sapiens
gccuuuggugacaggcaugugu

SEQ ID NO: 210200 - RNA, 22 nt, Homo sapiens
gcgcagugggcugugccaucca

SEQ ID NO: 210201 - RNA, 22 nt, Homo sapiens
gcuaaaugcaugaggcgaugug

SEQ ID NO: 210202 - RNA, 22 nt, Homo sapiens
gcuaggagaucugcugcucucu

SEQ ID NO: 210203 - RNA, 22 nt, Homo sapiens
gcuccauuuuccauuucucuaa

SEQ ID NO: 210204 - RNA, 22 nt, Homo sapiens
gcugacacugggcuauagaucu

SEQ ID NO: 210205 - RNA, 22 nt, Homo sapiens
gcugacagugguuauacuuaga

SEQ ID NO: 210206 - RNA, 22 nt, Homo sapiens
gcugcuguuauucaucagaacu

SEQ ID NO: 210207 - RNA, 22 nt, Homo sapiens
gcugcuuuugaugacaaaaaca

SEQ ID NO: 210208 - RNA, 22 nt, Homo sapiens
gcuggcaaaugguuauaaggcc

SEQ ID NO: 210209 - RNA, 22 nt, Homo sapiens
gcuggcaaguggccuacuuugu

SEQ ID NO: 210210 - RNA, 22 nt, Homo sapiens
gcugguauuacaggcaugagcc

SEQ ID NO: 210211 - RNA, 22 nt, Homo sapiens
gcugguguugugaaucaggccg

SEQ ID NO: 210212 - RNA, 19 nt, Homo sapiens
gcugguuguccacucucuc

SEQ ID NO: 210213 - RNA, 22 nt, Homo sapiens
gcugucaugagcaacacaugaa

SEQ ID NO: 210214 - RNA, 22 nt, Homo sapiens
gcugugguuuaguagaaagaag

SEQ ID NO: 210215 - RNA, 22 nt, Homo sapiens
gcuguguguuaucagaaauugc

SEQ ID NO: 210216 - RNA, 22 nt, Homo sapiens
gcuguugcuauuauuccgagaa

SEQ ID NO: 210217 - RNA, 22 nt, Homo sapiens
gcuguugguaaaaaggacauga

SEQ ID NO: 210218 - RNA, 18 nt, Homo sapiens
gcuguugucagagcacau

SEQ ID NO: 210219 - RNA, 19 nt, Homo sapiens
gcuuguccacgugagauaa

SEQ ID NO: 210220 - RNA, 22 nt, Homo sapiens
gcuuguguucaagucacccuua

SEQ ID NO: 210221 - RNA, 19 nt, Homo sapiens
gcuuuguggggaaggagcc

SEQ ID NO: 210222 - RNA, 23 nt, Homo sapiens
ggaaacauccagucuuucaccau

SEQ ID NO: 210223 - RNA, 22 nt, Homo sapiens
ggaaaguaacccauucucuuac

SEQ ID NO: 210224 - RNA, 21 nt, Homo sapiens
ggaaaguuaaggaaauacccc

SEQ ID NO: 210225 - RNA, 23 nt, Homo sapiens
ggaaauguuuaagggguugggag

SEQ ID NO: 210226 - RNA, 22 nt, Homo sapiens
ggaaauguuuagcauccacuuu

SEQ ID NO: 210227 - RNA, 22 nt, Homo sapiens
ggaagguaauuggguaaugaga

SEQ ID NO: 210228 - RNA, 22 nt, Homo sapiens
ggaagguaauugucagcucaua

SEQ ID NO: 210229 - RNA, 22 nt, Homo sapiens
ggaaggucaaagggaaagcaga

SEQ ID NO: 210230 - RNA, 20 nt, Homo sapiens
ggaauagucuacacucugac

SEQ ID NO: 210231 - RNA, 23 nt, Homo sapiens
ggaaugaaaccugguuaugauau

SEQ ID NO: 210232 - RNA, 19 nt, Homo sapiens
ggaaugcaccaguccuugc

SEQ ID NO: 210233 - RNA, 22 nt, Homo sapiens
ggaaugcuaaaauaggaugcug

SEQ ID NO: 210234 - RNA, 22 nt, Homo sapiens
ggaauggaacaaagucuugaaa

SEQ ID NO: 210235 - RNA, 22 nt, Homo sapiens
ggaaugugugucaugcuuuugc

SEQ ID NO: 210236 - RNA, 21 nt, Homo sapiens
ggaauuuagggaaugauuuag

SEQ ID NO: 210237 - RNA, 22 nt, Homo sapiens
ggacagaugggcucccgggucu

SEQ ID NO: 210238 - RNA, 22 nt, Homo sapiens
ggacaucauuaccauggaccca

SEQ ID NO: 210239 - RNA, 22 nt, Homo sapiens
ggacuaggagcuaggaagaucu

SEQ ID NO: 210240 - RNA, 19 nt, Homo sapiens
ggacugucauggaguaguu

SEQ ID NO: 210241 - RNA, 22 nt, Homo sapiens
ggagaguaauuagacugaaaga

SEQ ID NO: 210242 - RNA, 22 nt, Homo sapiens
ggagaucacucuuuguagcgug

SEQ ID NO: 210243 - RNA, 22 nt, Homo sapiens
ggagaucauuuccuauuugaag

SEQ ID NO: 210244 - RNA, 22 nt, Homo sapiens
ggagaucuuguuaaaguacaga

SEQ ID NO: 210245 - RNA, 20 nt, Homo sapiens
ggagguuguauaaguacauc

SEQ ID NO: 210246 - RNA, 22 nt, Homo sapiens
ggagugcuguuguuacacaagg

SEQ ID NO: 210247 - RNA, 23 nt, Homo sapiens
ggaguguaaauuauuucaaccau

SEQ ID NO: 210248 - RNA, 21 nt, Homo sapiens
ggauagaaaacuuggcuguau

SEQ ID NO: 210249 - RNA, 22 nt, Homo sapiens
ggauauguagggcauaucuaca

SEQ ID NO: 210250 - RNA, 22 nt, Homo sapiens
ggaucacagagcuugggaaagg

SEQ ID NO: 210251 - RNA, 22 nt, Homo sapiens
ggaucgauuccaaauguagauc

SEQ ID NO: 210252 - RNA, 23 nt, Homo sapiens
ggauggaaaguuuugagggccac

SEQ ID NO: 210253 - RNA, 21 nt, Homo sapiens
ggauucaucccucaugaauuu

SEQ ID NO: 210254 - RNA, 23 nt, Homo sapiens
ggauucaucuguuuguucgcugu

SEQ ID NO: 210255 - RNA, 22 nt, Homo sapiens
ggauuuguuggcauuagugaug

SEQ ID NO: 210256 - RNA, 22 nt, Homo sapiens
ggcaaagagacaugcaucgggg

SEQ ID NO: 210257 - RNA, 22 nt, Homo sapiens
ggcaacaaagacauuucaacau

SEQ ID NO: 210258 - RNA, 22 nt, Homo sapiens
ggcaagaaccagggauuugcgu

SEQ ID NO: 210259 - RNA, 22 nt, Homo sapiens
ggcaagaacuucacucacuuuu

SEQ ID NO: 210260 - RNA, 17 nt, Homo sapiens
ggcaagaaguggaacuc

SEQ ID NO: 210261 - RNA, 23 nt, Homo sapiens
ggcaagaucucagcucacugcaa

SEQ ID NO: 210262 - RNA, 22 nt, Homo sapiens
ggcaaggaggggcacuuucacu

SEQ ID NO: 210263 - RNA, 22 nt, Homo sapiens
ggcaagugucagcagcaacacc

SEQ ID NO: 210264 - RNA, 22 nt, Homo sapiens
ggcaaugaggcggaccagcagg

SEQ ID NO: 210265 - RNA, 22 nt, Homo sapiens
ggcaaugucagcuaaugaugga

SEQ ID NO: 210266 - RNA, 22 nt, Homo sapiens
ggcacaauugcagcaauaaaca

SEQ ID NO: 210267 - RNA, 22 nt, Homo sapiens
ggcaccauggaaggacgggagc

SEQ ID NO: 210268 - RNA, 22 nt, Homo sapiens
ggcacgguggcucacaccugua

SEQ ID NO: 210269 - RNA, 19 nt, Homo sapiens
ggcacugugugagugagga

SEQ ID NO: 210270 - RNA, 22 nt, Homo sapiens
ggcagaguggacauuuaaaugu

SEQ ID NO: 210271 - RNA, 22 nt, Homo sapiens
ggcagcauugccuuugcaguga

SEQ ID NO: 210272 - RNA, 22 nt, Homo sapiens
ggcagcgugcacuuucgccacu

SEQ ID NO: 210273 - RNA, 17 nt, Homo sapiens
ggcaggaauuaauguca

SEQ ID NO: 210274 - RNA, 17 nt, Homo sapiens
ggcaggauccaggaucc

SEQ ID NO: 210275 - RNA, 22 nt, Homo sapiens
ggcaguguggcugcauauagca

SEQ ID NO: 210276 - RNA, 22 nt, Homo sapiens
ggcaguguuauuauauuuuugg

SEQ ID NO: 210277 - RNA, 22 nt, Homo sapiens
ggcaguuuguucuugcuccuuu

SEQ ID NO: 210278 - RNA, 22 nt, Homo sapiens
ggcaugaaguagcccacaggca

SEQ ID NO: 210279 - RNA, 22 nt, Homo sapiens
ggccagaugaucuaugaaggaa

SEQ ID NO: 210280 - RNA, 22 nt, Homo sapiens
ggccagaugcaguggcucacac

SEQ ID NO: 210281 - RNA, 22 nt, Homo sapiens
ggcccugauacaaguaaggucu

SEQ ID NO: 210282 - RNA, 22 nt, Homo sapiens
ggccggguggccauggcugccc

SEQ ID NO: 210283 - RNA, 22 nt, Homo sapiens
ggccuguaaacuagagacccug

SEQ ID NO: 210284 - RNA, 22 nt, Homo sapiens
ggccuguaggguauugguaggg

SEQ ID NO: 210285 - RNA, 22 nt, Homo sapiens
ggcuacauuguuacaauuagua

SEQ ID NO: 210286 - RNA, 22 nt, Homo sapiens
ggcuagagacaaguugcugaga

SEQ ID NO: 210287 - RNA, 22 nt, Homo sapiens
ggcugguuuucaguuacugagu

SEQ ID NO: 210288 - RNA, 22 nt, Homo sapiens
ggcuguguguuaaaauaggcuu

SEQ ID NO: 210289 - RNA, 22 nt, Homo sapiens
ggcuuggaggaaugugagggcu

SEQ ID NO: 210290 - RNA, 22 nt, Homo sapiens
gggaagaaggagugguuuacuc

SEQ ID NO: 210291 - RNA, 22 nt, Homo sapiens
gggaauguagcaaaucugcaau

SEQ ID NO: 210292 - RNA, 22 nt, Homo sapiens
gggagcacaagaaauguuucau

SEQ ID NO: 210293 - RNA, 22 nt, Homo sapiens
gggagugugcacacaugguaua

SEQ ID NO: 210294 - RNA, 22 nt, Homo sapiens
gggauguaaaagugggcacauu

SEQ ID NO: 210295 - RNA, 20 nt, Homo sapiens
gggaugugagguacacucuu

SEQ ID NO: 210296 - RNA, 22 nt, Homo sapiens
gggauuauugugauuucauguu

SEQ ID NO: 210297 - RNA, 22 nt, Homo sapiens
uaaagcacaaguaaagaauacu

SEQ ID NO: 210298 - RNA, 22 nt, Homo sapiens
uaaagccuagaacuuucagccc

SEQ ID NO: 210299 - RNA, 22 nt, Homo sapiens
uaaagcuacaguauaugguauu

SEQ ID NO: 210300 - RNA, 22 nt, Homo sapiens
uaaagcuaugagaacaccguag

SEQ ID NO: 210301 - RNA, 21 nt, Homo sapiens
uaaaugucauacaaagcaaug

SEQ ID NO: 210302 - RNA, 22 nt, Homo sapiens
uaaauugcauaaguacaaauga

SEQ ID NO: 210303 - RNA, 18 nt, Homo sapiens
uaaauugcuucaccugag

SEQ ID NO: 210304 - RNA, 22 nt, Homo sapiens
uaacauucacaugcugcaaaaa

SEQ ID NO: 210305 - RNA, 22 nt, Homo sapiens
uaacccacgcagaauggacaag

SEQ ID NO: 210306 - RNA, 22 nt, Homo sapiens
uaacuauagagaauguugagua

SEQ ID NO: 210307 - RNA, 22 nt, Homo sapiens
uaacucugccuagugacauggu

SEQ ID NO: 210308 - RNA, 22 nt, Homo sapiens
uaacuguggaaaugacuuuaaa

SEQ ID NO: 210309 - RNA, 22 nt, Homo sapiens
uaagacuguguaauuuaugaag

SEQ ID NO: 210310 - RNA, 22 nt, Homo sapiens
uaagagcuaggauuuuaaauca

SEQ ID NO: 210311 - RNA, 18 nt, Homo sapiens
uaagaugcagccuauucc

SEQ ID NO: 210312 - RNA, 22 nt, Homo sapiens
uaagcagugcaagaauggaaua

SEQ ID NO: 210313 - RNA, 22 nt, Homo sapiens
uaagccuaggucugugcucuuc

SEQ ID NO: 210314 - RNA, 22 nt, Homo sapiens
uaagcuaauguguuuucucuua

SEQ ID NO: 210315 - RNA, 22 nt, Homo sapiens
uaagcucauuccagccaugucc

SEQ ID NO: 210316 - RNA, 22 nt, Homo sapiens
uaaggaaccagaaguggguagc

SEQ ID NO: 210317 - RNA, 22 nt, Homo sapiens
uaaggcacucuucugugugccu

SEQ ID NO: 210318 - RNA, 22 nt, Homo sapiens
uaaggcuagcaagaugagaaua

SEQ ID NO: 210319 - RNA, 22 nt, Homo sapiens
uaaggcuuugucuuaggacuuu

SEQ ID NO: 210320 - RNA, 22 nt, Homo sapiens
uaagggacgcccccuucucucu

SEQ ID NO: 210321 - RNA, 22 nt, Homo sapiens
uaagguuuuugauaugcugcug

SEQ ID NO: 210322 - RNA, 22 nt, Homo sapiens
uaaguagugugcauguauguau

SEQ ID NO: 210323 - RNA, 22 nt, Homo sapiens
uaaguauagguaacagaagcaa

SEQ ID NO: 210324 - RNA, 22 nt, Homo sapiens
uaaguaucaguuuagcuaugau

SEQ ID NO: 210325 - RNA, 22 nt, Homo sapiens
uaagugaugucuuuuugugugc

SEQ ID NO: 210326 - RNA, 22 nt, Homo sapiens
uaagugcaacauaaguguuaaa

SEQ ID NO: 210327 - RNA, 20 nt, Homo sapiens
uaagugcauaggauauuucu

SEQ ID NO: 210328 - RNA, 20 nt, Homo sapiens
uaagugcuuuauauugauua

SEQ ID NO: 210329 - RNA, 22 nt, Homo sapiens
uaagugguguucauucuuuuga

SEQ ID NO: 210330 - RNA, 22 nt, Homo sapiens
uaaguuagugugagaauuuugc

SEQ ID NO: 210331 - RNA, 22 nt, Homo sapiens
uaaguuguagaacguuuucuua

SEQ ID NO: 210332 - RNA, 20 nt, Homo sapiens
uaaguuguauuugucaugaa

SEQ ID NO: 210333 - RNA, 22 nt, Homo sapiens
uaaucacagagguuuggccuca

SEQ ID NO: 210334 - RNA, 22 nt, Homo sapiens
uaaugcuugguuguuuggaaaa

SEQ ID NO: 210335 - RNA, 22 nt, Homo sapiens
uaauucacauaaagcacuuaga

SEQ ID NO: 210336 - RNA, 22 nt, Homo sapiens
uaauucuguauguaucagaguu

SEQ ID NO: 210337 - RNA, 22 nt, Homo sapiens
uaauuggaucucaaaaaagugu

SEQ ID NO: 210338 - RNA, 22 nt, Homo sapiens
uacaaagugggaaacgaagguu

SEQ ID NO: 210339 - RNA, 22 nt, Homo sapiens
uacaagguaucagugaccguaa

SEQ ID NO: 210340 - RNA, 22 nt, Homo sapiens
uacaccauuugauucuuuaagc

SEQ ID NO: 210341 - RNA, 22 nt, Homo sapiens
uacaccugaguuugugguuuuc

SEQ ID NO: 210342 - RNA, 22 nt, Homo sapiens
uacaccugcacucuagccuggg

SEQ ID NO: 210343 - RNA, 22 nt, Homo sapiens
uacagaauucugucccuugagu

SEQ ID NO: 210344 - RNA, 22 nt, Homo sapiens
uacagcacaggugcagguguug

SEQ ID NO: 210345 - RNA, 22 nt, Homo sapiens
uacagcacugugcauagugguu

SEQ ID NO: 210346 - RNA, 20 nt, Homo sapiens
uacaggacugagaaucugug

SEQ ID NO: 210347 - RNA, 22 nt, Homo sapiens
uacaggcaccuggcuaauuuuu

SEQ ID NO: 210348 - RNA, 22 nt, Homo sapiens
uacagguauagauguguguucu

SEQ ID NO: 210349 - RNA, 22 nt, Homo sapiens
uacaggugcucuacagacagga

SEQ ID NO: 210350 - RNA, 22 nt, Homo sapiens
uacaguacacagguaccaagcu

SEQ ID NO: 210351 - RNA, 22 nt, Homo sapiens
uacaguagaaugucuuucaaaa

SEQ ID NO: 210352 - RNA, 22 nt, Homo sapiens
uacaguagagaucagcaaacua

SEQ ID NO: 210353 - RNA, 22 nt, Homo sapiens
uacaguggcaugucaggugcuu

SEQ ID NO: 210354 - RNA, 22 nt, Homo sapiens
uacagugggcacuggcgcccug

SEQ ID NO: 210355 - RNA, 19 nt, Homo sapiens
uacauaguauuuaguggca

SEQ ID NO: 210356 - RNA, 22 nt, Homo sapiens
uacauguauacaggguuuacuu

SEQ ID NO: 210357 - RNA, 22 nt, Homo sapiens
uacaugugcaggucuguggggg

SEQ ID NO: 210358 - RNA, 22 nt, Homo sapiens
uaccacaggcuggguaaucuau

SEQ ID NO: 210359 - RNA, 22 nt, Homo sapiens
uaccacugccgagaaaacagau

SEQ ID NO: 210360 - RNA, 22 nt, Homo sapiens
uacccaguaacaaguauuuugg

SEQ ID NO: 210361 - RNA, 22 nt, Homo sapiens
uacccugaaggaaaguauguuu

SEQ ID NO: 210362 - RNA, 22 nt, Homo sapiens
uacccuguaaucugaaacauga

SEQ ID NO: 210363 - RNA, 22 nt, Homo sapiens
uacccuuuaguauaaaaucaga

SEQ ID NO: 210364 - RNA, 22 nt, Homo sapiens
uaccucaguucaauaacagaua

SEQ ID NO: 210365 - RNA, 22 nt, Homo sapiens
uaccugagucuagagucuagaa

SEQ ID NO: 210366 - RNA, 22 nt, Homo sapiens
uacuacuuucugacaucuuuaa

SEQ ID NO: 210367 - RNA, 18 nt, Homo sapiens
uacuaguaaggcuucuga

SEQ ID NO: 210368 - RNA, 22 nt, Homo sapiens
uacucugcagagaugcauaaca

SEQ ID NO: 210369 - RNA, 22 nt, Homo sapiens
uacucugcagccauaaaacaga

SEQ ID NO: 210370 - RNA, 20 nt, Homo sapiens
uacugcacuccaaccuaggc

SEQ ID NO: 210371 - RNA, 22 nt, Homo sapiens
uacugcacuccagccuugccaa

SEQ ID NO: 210372 - RNA, 22 nt, Homo sapiens
uacugcacuccagcuuaggaga

SEQ ID NO: 210373 - RNA, 22 nt, Homo sapiens
uacugcacuccaggcucaccug

SEQ ID NO: 210374 - RNA, 22 nt, Homo sapiens
uacuggccuugaacucuggugu

SEQ ID NO: 210375 - RNA, 19 nt, Homo sapiens
uacuggcucgggaauuuuc

SEQ ID NO: 210376 - RNA, 22 nt, Homo sapiens
uacuuagagauuccaggaacuc

SEQ ID NO: 210377 - RNA, 22 nt, Homo sapiens
uacuuuguagauuguuuccuuu

SEQ ID NO: 210378 - RNA, 22 nt, Homo sapiens
uagaagcugagaauguccucag

SEQ ID NO: 210379 - RNA, 22 nt, Homo sapiens
uagaaugucagcuucuugaggg

SEQ ID NO: 210380 - RNA, 22 nt, Homo sapiens
uagacaacugaaacacugugca

SEQ ID NO: 210381 - RNA, 22 nt, Homo sapiens
uagacacuagauaugugacuga

SEQ ID NO: 210382 - RNA, 18 nt, Homo sapiens
uagagcacaagcuuuggc

SEQ ID NO: 210383 - RNA, 22 nt, Homo sapiens
uagagguaggucuucgagucuc

SEQ ID NO: 210384 - RNA, 22 nt, Homo sapiens
uagagguauaccaaaaaggcau

SEQ ID NO: 210385 - RNA, 22 nt, Homo sapiens
uagauaguuaugauuugaugau

SEQ ID NO: 210386 - RNA, 22 nt, Homo sapiens
uagaucauauacuugccaugac

SEQ ID NO: 210387 - RNA, 20 nt, Homo sapiens
uagaugcauuuagauucauu

SEQ ID NO: 210388 - RNA, 21 nt, Homo sapiens
uagaugguguucuagagagaa

SEQ ID NO: 210389 - RNA, 19 nt, Homo sapiens
uagaugucuuugcauagau

SEQ ID NO: 210390 - RNA, 22 nt, Homo sapiens
uagauuaucccugauuugucca

SEQ ID NO: 210391 - RNA, 22 nt, Homo sapiens
uagauuaucuguaugugcucuu

SEQ ID NO: 210392 - RNA, 22 nt, Homo sapiens
uagcaagaugaauuugugcaaa

SEQ ID NO: 210393 - RNA, 22 nt, Homo sapiens
uagcacagggaauugguucucu

SEQ ID NO: 210394 - RNA, 19 nt, Homo sapiens
uagcacagggucccagacu

SEQ ID NO: 210395 - RNA, 22 nt, Homo sapiens
uagcaccacaaucaagauacag

SEQ ID NO: 210396 - RNA, 22 nt, Homo sapiens
uagcaccaggguugacugaccu

SEQ ID NO: 210397 - RNA, 22 nt, Homo sapiens
uagcagaauaacuugccagccu

SEQ ID NO: 210398 - RNA, 22 nt, Homo sapiens
uagcagacuauuuugugauaau

SEQ ID NO: 210399 - RNA, 16 nt, Homo sapiens
uugaggcaugucucag

SEQ ID NO: 210400 - RNA, 22 nt, Homo sapiens
uugaggccugauaacacacuga

SEQ ID NO: 210401 - RNA, 22 nt, Homo sapiens
uugagggagccuguuagucccg

SEQ ID NO: 210402 - RNA, 22 nt, Homo sapiens
uugagggaggcagggcuugucu

SEQ ID NO: 210403 - RNA, 22 nt, Homo sapiens
uugagggaggccucaguuuaca

SEQ ID NO: 210404 - RNA, 22 nt, Homo sapiens
uugagguagcuuugauggaggu

SEQ ID NO: 210405 - RNA, 22 nt, Homo sapiens
uugagguauugauaaaacauuu

SEQ ID NO: 210406 - RNA, 22 nt, Homo sapiens
uugaggucagagguucgagacc

SEQ ID NO: 210407 - RNA, 22 nt, Homo sapiens
uugagguggugucuugcucugu

SEQ ID NO: 210408 - RNA, 22 nt, Homo sapiens
uugaguaguaagugguucaccg

SEQ ID NO: 210409 - RNA, 22 nt, Homo sapiens
uugauaacauucugcauccuau

SEQ ID NO: 210410 - RNA, 22 nt, Homo sapiens
uugauaagaaaugccaguuugg

SEQ ID NO: 210411 - RNA, 22 nt, Homo sapiens
uugauagacaucugaguuguug

SEQ ID NO: 210412 - RNA, 22 nt, Homo sapiens
uugauaguuuaauuaaugcuag

SEQ ID NO: 210413 - RNA, 22 nt, Homo sapiens
uugauaguuuuaaaauuaaucu

SEQ ID NO: 210414 - RNA, 22 nt, Homo sapiens
uugauauucugagaagcugaag

SEQ ID NO: 210415 - RNA, 22 nt, Homo sapiens
uugaucaauagaauacaacaga

SEQ ID NO: 210416 - RNA, 22 nt, Homo sapiens
uugaucuguguuagaagcuaag

SEQ ID NO: 210417 - RNA, 22 nt, Homo sapiens
uugaugauguuucugccuugcc

SEQ ID NO: 210418 - RNA, 22 nt, Homo sapiens
uugauguugaggacauaaaccu

SEQ ID NO: 210419 - RNA, 22 nt, Homo sapiens
uugauuuguagaaugccccaac

SEQ ID NO: 210420 - RNA, 23 nt, Homo sapiens
uugcaaagccugaaacucuucag

SEQ ID NO: 210421 - RNA, 21 nt, Homo sapiens
uugcaaaugcugcugccugau

SEQ ID NO: 210422 - RNA, 22 nt, Homo sapiens
uugcaacuuagaaaaaucauuu

SEQ ID NO: 210423 - RNA, 22 nt, Homo sapiens
uugcaagaaaucagagccuucc

SEQ ID NO: 210424 - RNA, 22 nt, Homo sapiens
uugcaaggugcucgaagggcuc

SEQ ID NO: 210425 - RNA, 22 nt, Homo sapiens
uugcacaauggaauuuaucuuu

SEQ ID NO: 210426 - RNA, 22 nt, Homo sapiens
uugcacagugguuuagagccug

SEQ ID NO: 210427 - RNA, 22 nt, Homo sapiens
uugcacauugauuuuguaucuu

SEQ ID NO: 210428 - RNA, 22 nt, Homo sapiens
uugcaccuuaugucuguucucu

SEQ ID NO: 210429 - RNA, 22 nt, Homo sapiens
uugcacuauaggaaaauguguc

SEQ ID NO: 210430 - RNA, 22 nt, Homo sapiens
uugcacuccagccuuggggaga

SEQ ID NO: 210431 - RNA, 22 nt, Homo sapiens
uugcacuccagcucgggugaca

SEQ ID NO: 210432 - RNA, 22 nt, Homo sapiens
uugcacuccauccuggguugac

SEQ ID NO: 210433 - RNA, 22 nt, Homo sapiens
uugcacucuagccugggugaca

SEQ ID NO: 210434 - RNA, 22 nt, Homo sapiens
uugcacuguaauuuauuuaugu

SEQ ID NO: 210435 - RNA, 22 nt, Homo sapiens
uugcacuugcugaggagugauu

SEQ ID NO: 210436 - RNA, 20 nt, Homo sapiens
uugcagagcccaacccugga

SEQ ID NO: 210437 - RNA, 22 nt, Homo sapiens
uugcagagccccugcaaggguc

SEQ ID NO: 210438 - RNA, 22 nt, Homo sapiens
uugcagagucaguuauuuugcc

SEQ ID NO: 210439 - RNA, 22 nt, Homo sapiens
uugcagaucccacacucacccu

SEQ ID NO: 210440 - RNA, 22 nt, Homo sapiens
uugcagcaaauaggaaugagga

SEQ ID NO: 210441 - RNA, 22 nt, Homo sapiens
uugcaggcaugagccaccgugc

SEQ ID NO: 210442 - RNA, 22 nt, Homo sapiens
uugcaguagucugaaagcaaua

SEQ ID NO: 210443 - RNA, 22 nt, Homo sapiens
uugcagugguuucacuggcaaa

SEQ ID NO: 210444 - RNA, 22 nt, Homo sapiens
uugcagugugacgacuauauuu

SEQ ID NO: 210445 - RNA, 18 nt, Homo sapiens
uugcaucauuuuguuguu

SEQ ID NO: 210446 - RNA, 22 nt, Homo sapiens
uugcaugcacaguucucaauag

SEQ ID NO: 210447 - RNA, 22 nt, Homo sapiens
uugcaugguuuuuaucugaaau

SEQ ID NO: 210448 - RNA, 22 nt, Homo sapiens
uugccauggaguagaauugaag

SEQ ID NO: 210449 - RNA, 22 nt, Homo sapiens
uugcuacauugauugccucuuu

SEQ ID NO: 210450 - RNA, 22 nt, Homo sapiens
uugcucaccugagaagaauaga

SEQ ID NO: 210451 - RNA, 22 nt, Homo sapiens
uugcuuaggcuggagugcagug

SEQ ID NO: 210452 - RNA, 22 nt, Homo sapiens
uugcuuagucaugaaucacuga

SEQ ID NO: 210453 - RNA, 22 nt, Homo sapiens
uugcuucuuucgucuggcccca

SEQ ID NO: 210454 - RNA, 22 nt, Homo sapiens
uuggaaacauuuaugguaacag

SEQ ID NO: 210455 - RNA, 22 nt, Homo sapiens
uuggaaaccucugcagguguuu

SEQ ID NO: 210456 - RNA, 22 nt, Homo sapiens
uuggaaagagguguuuaugacu

SEQ ID NO: 210457 - RNA, 22 nt, Homo sapiens
uuggaacacauguuuuucuacc

SEQ ID NO: 210458 - RNA, 22 nt, Homo sapiens
uuggaagacauucugucugcua

SEQ ID NO: 210459 - RNA, 22 nt, Homo sapiens
uuggaagcacauuguuuaauua

SEQ ID NO: 210460 - RNA, 22 nt, Homo sapiens
uuggaaggcuccuaaugaaugg

SEQ ID NO: 210461 - RNA, 22 nt, Homo sapiens
uuggaaggcugaauggccucuc

SEQ ID NO: 210462 - RNA, 22 nt, Homo sapiens
uuggaauguacucuagccuaug

SEQ ID NO: 210463 - RNA, 22 nt, Homo sapiens
uuggaauguauggcaucuugcg

SEQ ID NO: 210464 - RNA, 22 nt, Homo sapiens
uuggaauuaaccuggugcugga

SEQ ID NO: 210465 - RNA, 22 nt, Homo sapiens
uuggaauuaagagauauuuucu

SEQ ID NO: 210466 - RNA, 22 nt, Homo sapiens
uuggaauuuuaaaauaggcaac

SEQ ID NO: 210467 - RNA, 22 nt, Homo sapiens
uuggaauuuuacuucuguaaga

SEQ ID NO: 210468 - RNA, 22 nt, Homo sapiens
uuggacuuuuauucugcaggca

SEQ ID NO: 210469 - RNA, 22 nt, Homo sapiens
uuggagagagaggacucccggc

SEQ ID NO: 210470 - RNA, 22 nt, Homo sapiens
uuggagagugauauucagaugc

SEQ ID NO: 210471 - RNA, 22 nt, Homo sapiens
uuggagcccuaacucucaguac

SEQ ID NO: 210472 - RNA, 22 nt, Homo sapiens
uuggagucaucucuguacugua

SEQ ID NO: 210473 - RNA, 22 nt, Homo sapiens
uuggauccauccugucuucucu

SEQ ID NO: 210474 - RNA, 22 nt, Homo sapiens
uuggauggugauaugguuugga

SEQ ID NO: 210475 - RNA, 22 nt, Homo sapiens
uuggcaagaaccuucuuccaag

SEQ ID NO: 210476 - RNA, 22 nt, Homo sapiens
uuggcaagcuguuaauuauaaa

SEQ ID NO: 210477 - RNA, 22 nt, Homo sapiens
uuggcaaguccccaccucucuc

SEQ ID NO: 210478 - RNA, 22 nt, Homo sapiens
uuggcacuugauaauauucugg

SEQ ID NO: 210479 - RNA, 22 nt, Homo sapiens
uuggcagaauguuagaaacuua

SEQ ID NO: 210480 - RNA, 19 nt, Homo sapiens
uuggcagaguugcccccua

SEQ ID NO: 210481 - RNA, 22 nt, Homo sapiens
uuggcagcacgcaguccagagg

SEQ ID NO: 210482 - RNA, 22 nt, Homo sapiens
uuggcauaguugcacuuacuag

SEQ ID NO: 210483 - RNA, 22 nt, Homo sapiens
uuggcauugaguuucaaaucau

SEQ ID NO: 210484 - RNA, 22 nt, Homo sapiens
uuggccauaugacuugcuuugg

SEQ ID NO: 210485 - RNA, 22 nt, Homo sapiens
uuggccuccuggucauauccag

SEQ ID NO: 210486 - RNA, 22 nt, Homo sapiens
uuggccuuuucaaugccucuuu

SEQ ID NO: 210487 - RNA, 22 nt, Homo sapiens
uuggcuguguuuauaugcugga

SEQ ID NO: 210488 - RNA, 22 nt, Homo sapiens
uuggcuguguuucccuacaaau

SEQ ID NO: 210489 - RNA, 22 nt, Homo sapiens
uuggcuucuggacuauugugca

SEQ ID NO: 210490 - RNA, 22 nt, Homo sapiens
uugggaauguccuaauaucucg

SEQ ID NO: 210491 - RNA, 22 nt, Homo sapiens
uugggacuggaaggaguaaggg

SEQ ID NO: 210492 - RNA, 23 nt, Homo sapiens
uugggcaaaucacuaacgucucc

SEQ ID NO: 210493 - RNA, 22 nt, Homo sapiens
uugguaaaaugaccacagacau

SEQ ID NO: 210494 - RNA, 22 nt, Homo sapiens
uugguaaugggcugguauaacc

SEQ ID NO: 210495 - RNA, 22 nt, Homo sapiens
uugguaccccugguguacuaau

SEQ ID NO: 210496 - RNA, 22 nt, Homo sapiens
uugguacuagcugaucgcagag

SEQ ID NO: 210497 - RNA, 22 nt, Homo sapiens
uuggucaggcuaaucucgaacg

SEQ ID NO: 210498 - RNA, 21 nt, Homo sapiens
uugguccacaugucauaguua

SEQ ID NO: 210499 - RNA, 22 nt, Homo sapiens
uugguccauuacauugaugaca

SEQ ID NO: 210500 - RNA, 22 nt, Homo sapiens
uugguccccacuccccugccaa

SEQ ID NO: 210501 - RNA, 22 nt, Homo sapiens
gcauggagaaggggacugauuc

SEQ ID NO: 210502 - RNA, 22 nt, Homo sapiens
gcauggagcauacauuucuguu

SEQ ID NO: 210503 - RNA, 22 nt, Homo sapiens
gcauguaguagauguugaauaa

SEQ ID NO: 210504 - RNA, 22 nt, Homo sapiens
gcaugugaauguguaagaaaau

SEQ ID NO: 210505 - RNA, 22 nt, Homo sapiens
gcccagauguuuggggucaugg

SEQ ID NO: 210506 - RNA, 22 nt, Homo sapiens
gccccaguacaggcuccuuaga

SEQ ID NO: 210507 - RNA, 22 nt, Homo sapiens
gcccugauacauucuucugccu

SEQ ID NO: 210508 - RNA, 22 nt, Homo sapiens
gcccuguguuuggguaugguca

SEQ ID NO: 210509 - RNA, 22 nt, Homo sapiens
gcccuguugcccaggcuggagu

SEQ ID NO: 210510 - RNA, 17 nt, Homo sapiens
gcccuuugugccucuuc

SEQ ID NO: 210511 - RNA, 22 nt, Homo sapiens
gccucaguuguggccagggauu

SEQ ID NO: 210512 - RNA, 22 nt, Homo sapiens
gcggguguuuuacccuugcaga

SEQ ID NO: 210513 - RNA, 22 nt, Homo sapiens
gcgugguguuagaaugagaagu

SEQ ID NO: 210514 - RNA, 20 nt, Homo sapiens
gcuaaggcacgggaauuacu

SEQ ID NO: 210515 - RNA, 19 nt, Homo sapiens
gcucaccuugcugcuccag

SEQ ID NO: 210516 - RNA, 22 nt, Homo sapiens
gcucaguuuccucagcugcaaa

SEQ ID NO: 210517 - RNA, 22 nt, Homo sapiens
gcucuuuugggguaauucugag

SEQ ID NO: 210518 - RNA, 22 nt, Homo sapiens
gcugaaauguuuaauuugggag

SEQ ID NO: 210519 - RNA, 22 nt, Homo sapiens
gcugagaucucuugccugaacu

SEQ ID NO: 210520 - RNA, 22 nt, Homo sapiens
gcugagcuaugccauauaugcc

SEQ ID NO: 210521 - RNA, 22 nt, Homo sapiens
gcugagguucaagaagguuaaa

SEQ ID NO: 210522 - RNA, 22 nt, Homo sapiens
gcugauguugaccuugaucacc

SEQ ID NO: 210523 - RNA, 22 nt, Homo sapiens
gcugcuguaccagaugugguua

SEQ ID NO: 210524 - RNA, 22 nt, Homo sapiens
gcuggguugccagguuacuuaa

SEQ ID NO: 210525 - RNA, 22 nt, Homo sapiens
gcuggucugccguaguaggugc

SEQ ID NO: 210526 - RNA, 22 nt, Homo sapiens
gcuggugacuuuaaguugaagc

SEQ ID NO: 210527 - RNA, 22 nt, Homo sapiens
gcugucuggagucuguucaaug

SEQ ID NO: 210528 - RNA, 22 nt, Homo sapiens
gcuguguucucgaggcggggga

SEQ ID NO: 210529 - RNA, 22 nt, Homo sapiens
gcuguugugaacuauacaucua

SEQ ID NO: 210530 - RNA, 22 nt, Homo sapiens
gcuuggugugcaagugguacua

SEQ ID NO: 210531 - RNA, 22 nt, Homo sapiens
gcuuguguuugcuccccagaau

SEQ ID NO: 210532 - RNA, 22 nt, Homo sapiens
gcuuuguuaaaacacagccaca

SEQ ID NO: 210533 - RNA, 22 nt, Homo sapiens
ggaaagacaccuuacuauguua

SEQ ID NO: 210534 - RNA, 22 nt, Homo sapiens
ggaaagacuauuguaaaggaug

SEQ ID NO: 210535 - RNA, 22 nt, Homo sapiens
ggaaagaucagcuaaauguaag

SEQ ID NO: 210536 - RNA, 22 nt, Homo sapiens
ggaaagcuagguguggguguac

SEQ ID NO: 210537 - RNA, 18 nt, Homo sapiens
ggaagccuauuuaguaac

SEQ ID NO: 210538 - RNA, 22 nt, Homo sapiens
ggacaagagacugggacacuga

SEQ ID NO: 210539 - RNA, 22 nt, Homo sapiens
ggacaagaucuuccaccauuca

SEQ ID NO: 210540 - RNA, 22 nt, Homo sapiens
ggacagaaaggguucaccaaac

SEQ ID NO: 210541 - RNA, 22 nt, Homo sapiens
ggacugagaggacuacagugua

SEQ ID NO: 210542 - RNA, 22 nt, Homo sapiens
ggacuggaagcauauuuauuuu

SEQ ID NO: 210543 - RNA, 22 nt, Homo sapiens
ggacugucagggcuauuaguca

SEQ ID NO: 210544 - RNA, 22 nt, Homo sapiens
ggagaauugcuuggacccggga

SEQ ID NO: 210545 - RNA, 22 nt, Homo sapiens
ggagagugacauauuucuaggc

SEQ ID NO: 210546 - RNA, 22 nt, Homo sapiens
ggagaucuuuaggaguuggacu

SEQ ID NO: 210547 - RNA, 22 nt, Homo sapiens
ggagaugaaaugagcuacuuaa

SEQ ID NO: 210548 - RNA, 22 nt, Homo sapiens
ggagaugauuaugaaucacuua

SEQ ID NO: 210549 - RNA, 22 nt, Homo sapiens
ggagauuauuaguguuucaugc

SEQ ID NO: 210550 - RNA, 22 nt, Homo sapiens
ggaggcuaguaaaaagguagaa

SEQ ID NO: 210551 - RNA, 22 nt, Homo sapiens
ggagggugagaucaauuuggga

SEQ ID NO: 210552 - RNA, 23 nt, Homo sapiens
ggaguguauuggcacgaucucag

SEQ ID NO: 210553 - RNA, 22 nt, Homo sapiens
ggagugugauuguucucuguua

SEQ ID NO: 210554 - RNA, 22 nt, Homo sapiens
ggaguguguaggagaaagguaa

SEQ ID NO: 210555 - RNA, 22 nt, Homo sapiens
ggaguuuaagucuugugcaucu

SEQ ID NO: 210556 - RNA, 22 nt, Homo sapiens
gagugcaagguuuuucugagug

SEQ ID NO: 210557 - RNA, 22 nt, Homo sapiens
gagugcaauggcaagaucuugg

SEQ ID NO: 210558 - RNA, 22 nt, Homo sapiens
gagugcaauggcaugaucuggg

SEQ ID NO: 210559 - RNA, 22 nt, Homo sapiens
gaguucauaucuaugagugugc

SEQ ID NO: 210560 - RNA, 22 nt, Homo sapiens
gaguuccuuugagccugagagg

SEQ ID NO: 210561 - RNA, 22 nt, Homo sapiens
gauaaaguauuggguacuaugc

SEQ ID NO: 210562 - RNA, 22 nt, Homo sapiens
gauaauucuagcagauacaggc

SEQ ID NO: 210563 - RNA, 19 nt, Homo sapiens
gauagacaucacagugcca

SEQ ID NO: 210564 - RNA, 19 nt, Homo sapiens
gauaucuagggggagguuc

SEQ ID NO: 210565 - RNA, 22 nt, Homo sapiens
gauaugucuauuagcuugauug

SEQ ID NO: 210566 - RNA, 22 nt, Homo sapiens
gauauguguaucuauguacaug

SEQ ID NO: 210567 - RNA, 22 nt, Homo sapiens
gauauguucuuucacguuggug

SEQ ID NO: 210568 - RNA, 19 nt, Homo sapiens
gauauguugagcacccuuu

SEQ ID NO: 210569 - RNA, 22 nt, Homo sapiens
gauauguugaguagaguuuuug

SEQ ID NO: 210570 - RNA, 22 nt, Homo sapiens
gauauugacuuauucuauguuu

SEQ ID NO: 210571 - RNA, 17 nt, Homo sapiens
gaucacagucgucuccu

SEQ ID NO: 210572 - RNA, 22 nt, Homo sapiens
gaucaguuucuggagauacgua

SEQ ID NO: 210573 - RNA, 22 nt, Homo sapiens
gaucuggagguuuuccucauga

SEQ ID NO: 210574 - RNA, 22 nt, Homo sapiens
gaugagguaggccugcuuugaa

SEQ ID NO: 210575 - RNA, 22 nt, Homo sapiens
gaugaucaugaccuacagaugg

SEQ ID NO: 210576 - RNA, 22 nt, Homo sapiens
gaugaucucuggugguaaagac

SEQ ID NO: 210577 - RNA, 22 nt, Homo sapiens
gaugauguuacucuuuuuccuu

SEQ ID NO: 210578 - RNA, 22 nt, Homo sapiens
gaugcaguaagaaugcauagcg

SEQ ID NO: 210579 - RNA, 22 nt, Homo sapiens
gauggaguugacuaagacaaca

SEQ ID NO: 210580 - RNA, 22 nt, Homo sapiens
gauggguuuuuugaagacagca

SEQ ID NO: 210581 - RNA, 22 nt, Homo sapiens
gauuggccaaacuaaagaacug

SEQ ID NO: 210582 - RNA, 22 nt, Homo sapiens
gauuucaucuuuagaggaagga

SEQ ID NO: 210583 - RNA, 22 nt, Homo sapiens
gauuugguguucuggcucaaga

SEQ ID NO: 210584 - RNA, 22 nt, Homo sapiens
gcaaagaaugcagauuugccuc

SEQ ID NO: 210585 - RNA, 21 nt, Homo sapiens
gcaaaguggcuaccuugcucc

SEQ ID NO: 210586 - RNA, 23 nt, Homo sapiens
gcaaauaucguagagugucccug

SEQ ID NO: 210587 - RNA, 22 nt, Homo sapiens
gcaacugguuucaguuuuucag

SEQ ID NO: 210588 - RNA, 22 nt, Homo sapiens
gcaagaaucugggaguaaaauu

SEQ ID NO: 210589 - RNA, 22 nt, Homo sapiens
gcaagaaugagaaggauuaauu

SEQ ID NO: 210590 - RNA, 22 nt, Homo sapiens
gcaauguuacugaauguguuuu

SEQ ID NO: 210591 - RNA, 22 nt, Homo sapiens
gcacaguguuacuugauauauu

SEQ ID NO: 210592 - RNA, 22 nt, Homo sapiens
gcacauggccacuaggaauaaa

SEQ ID NO: 210593 - RNA, 22 nt, Homo sapiens
gcaccaugguagaauaauggua

SEQ ID NO: 210594 - RNA, 22 nt, Homo sapiens
gcacccugucaaaauggaccaa

SEQ ID NO: 210595 - RNA, 22 nt, Homo sapiens
gcagaauugacucuguuuuuuc

SEQ ID NO: 210596 - RNA, 23 nt, Homo sapiens
gcagcaaugucacagggguccgg

SEQ ID NO: 210597 - RNA, 20 nt, Homo sapiens
gcagcaccauauuucuaaga

SEQ ID NO: 210598 - RNA, 22 nt, Homo sapiens
gcagguauuagagagccugaaa

SEQ ID NO: 210599 - RNA, 22 nt, Homo sapiens
gcaguacacuguugguaggaau

SEQ ID NO: 210600 - RNA, 22 nt, Homo sapiens
gcaguagugcgaucucagcuca

SEQ ID NO: 210601 - RNA, 22 nt, Homo sapiens
gcaguauuguugaaauguccau

SEQ ID NO: 210602 - RNA, 22 nt, Homo sapiens
gcagugacaugugccaguuuau

SEQ ID NO: 210603 - RNA, 20 nt, Homo sapiens
gcaguguucacuguauuccu

SEQ ID NO: 210604 - RNA, 22 nt, Homo sapiens
gcauaaagcuaauaagacgaag

SEQ ID NO: 210605 - RNA, 22 nt, Homo sapiens
gcauauuuuaaaguguaaccug

SEQ ID NO: 210606 - RNA, 22 nt, Homo sapiens
gcaucacagcuccugugcuggc

SEQ ID NO: 210607 - RNA, 22 nt, Homo sapiens
gcaugacaaugauugcucuuca

SEQ ID NO: 210608 - RNA, 22 nt, Homo sapiens
gcaugcacaugugaaaaaauga

SEQ ID NO: 210609 - RNA, 22 nt, Homo sapiens
gcaugcacuguauuuaaguauc

SEQ ID NO: 210610 - RNA, 22 nt, Homo sapiens
gcauggaaggcgcuuugugacu

SEQ ID NO: 210611 - RNA, 22 nt, Homo sapiens
auggcucuuauuauuuugaggu

SEQ ID NO: 210612 - RNA, 22 nt, Homo sapiens
auggcugagugauuucaaacag

SEQ ID NO: 210613 - RNA, 22 nt, Homo sapiens
auggcugugaaaugguaggugg

SEQ ID NO: 210614 - RNA, 22 nt, Homo sapiens
auggcuuuuauuguguugaggu

SEQ ID NO: 210615 - RNA, 22 nt, Homo sapiens
auggcuuuuccugucuugcaug

SEQ ID NO: 210616 - RNA, 22 nt, Homo sapiens
auggcuuuugcccuaaauggau

SEQ ID NO: 210617 - RNA, 22 nt, Homo sapiens
auggcuuuuuucuugggcacuc

SEQ ID NO: 210618 - RNA, 21 nt, Homo sapiens
augggacuaacugaugggucu

SEQ ID NO: 210619 - RNA, 22 nt, Homo sapiens
augggauaguaucaguggaaua

SEQ ID NO: 210620 - RNA, 22 nt, Homo sapiens
augggcacugauguauucugug

SEQ ID NO: 210621 - RNA, 21 nt, Homo sapiens
augggguagaagagaaggcuu

SEQ ID NO: 210622 - RNA, 22 nt, Homo sapiens
augguaagcugaaaauaucgaa

SEQ ID NO: 210623 - RNA, 22 nt, Homo sapiens
augguaguagaugugugguuuu

SEQ ID NO: 210624 - RNA, 22 nt, Homo sapiens
auggucccuguuccaugcuccu

SEQ ID NO: 210625 - RNA, 22 nt, Homo sapiens
auggucuuuauuguguugagug

SEQ ID NO: 210626 - RNA, 22 nt, Homo sapiens
auggucuuuuuguuaugagaga

SEQ ID NO: 210627 - RNA, 22 nt, Homo sapiens
augguugguuaaaucuguguau

SEQ ID NO: 210628 - RNA, 20 nt, Homo sapiens
auguaauguaugauauguac

SEQ ID NO: 210629 - RNA, 22 nt, Homo sapiens
auguaauugagguuuuugccau

SEQ ID NO: 210630 - RNA, 22 nt, Homo sapiens
auguaguagcagaaaauauuuu

SEQ ID NO: 210631 - RNA, 22 nt, Homo sapiens
auguaguauuaaugagagauaa

SEQ ID NO: 210632 - RNA, 22 nt, Homo sapiens
auguauacauagauacgugugu

SEQ ID NO: 210633 - RNA, 22 nt, Homo sapiens
auguauacaugcaggucacagg

SEQ ID NO: 210634 - RNA, 22 nt, Homo sapiens
augucaacauagacaguagagu

SEQ ID NO: 210635 - RNA, 22 nt, Homo sapiens
augucaaggugggugauaguuu

SEQ ID NO: 210636 - RNA, 22 nt, Homo sapiens
augucauagauaaggaagugga

SEQ ID NO: 210637 - RNA, 22 nt, Homo sapiens
auguccuggacccagacaaagc

SEQ ID NO: 210638 - RNA, 22 nt, Homo sapiens
augucuagagugauacugaagc

SEQ ID NO: 210639 - RNA, 22 nt, Homo sapiens
augucuguuugcugagcccggc

SEQ ID NO: 210640 - RNA, 22 nt, Homo sapiens
augugacagcaacccccagccc

SEQ ID NO: 210641 - RNA, 22 nt, Homo sapiens
augugccauucucauggcgcuu

SEQ ID NO: 210642 - RNA, 20 nt, Homo sapiens
augugcuaauauuaauaugu

SEQ ID NO: 210643 - RNA, 22 nt, Homo sapiens
augugcuuuuuaaacagaugcu

SEQ ID NO: 210644 - RNA, 22 nt, Homo sapiens
auguggcauuucucauucauuu

SEQ ID NO: 210645 - RNA, 22 nt, Homo sapiens
augugggaggaauguguuucca

SEQ ID NO: 210646 - RNA, 22 nt, Homo sapiens
augugugaaucccagaaccugu

SEQ ID NO: 210647 - RNA, 22 nt, Homo sapiens
augugugcuugugacacagccu

SEQ ID NO: 210648 - RNA, 22 nt, Homo sapiens
auguugcaguuuaauuauccua

SEQ ID NO: 210649 - RNA, 22 nt, Homo sapiens
auuaagagcacauguucugggu

SEQ ID NO: 210650 - RNA, 22 nt, Homo sapiens
auuaaggaguggguucauggug

SEQ ID NO: 210651 - RNA, 22 nt, Homo sapiens
auuaaguuaggauuuugagaua

SEQ ID NO: 210652 - RNA, 22 nt, Homo sapiens
auuacauagucaaggugucuca

SEQ ID NO: 210653 - RNA, 20 nt, Homo sapiens
auuagagcuacauggcuaca

SEQ ID NO: 210654 - RNA, 22 nt, Homo sapiens
auuagguaauauaaucauggca

SEQ ID NO: 210655 - RNA, 22 nt, Homo sapiens
auuauaugucaucacagacacc

SEQ ID NO: 210656 - RNA, 22 nt, Homo sapiens
auuauguuguauuuccuugcag

SEQ ID NO: 210657 - RNA, 22 nt, Homo sapiens
auucaaagugcauguucccacu

SEQ ID NO: 210658 - RNA, 22 nt, Homo sapiens
auucaaggagucuucgucccaa

SEQ ID NO: 210659 - RNA, 22 nt, Homo sapiens
auucacagcuuuaaaaggcgug

SEQ ID NO: 210660 - RNA, 22 nt, Homo sapiens
auucacagggggagaaggguau

SEQ ID NO: 210661 - RNA, 22 nt, Homo sapiens
auucacugugcuuggccaaauu

SEQ ID NO: 210662 - RNA, 22 nt, Homo sapiens
auucacuguggguccuuuggau

SEQ ID NO: 210663 - RNA, 22 nt, Homo sapiens
auucauagugcuaagguguauc

SEQ ID NO: 210664 - RNA, 22 nt, Homo sapiens
auuccacagccgauaccaugac

SEQ ID NO: 210665 - RNA, 22 nt, Homo sapiens
auuccacuuagugacucauuug

SEQ ID NO: 210666 - RNA, 22 nt, Homo sapiens
auuccaguggguuuacauccca

SEQ ID NO: 210667 - RNA, 22 nt, Homo sapiens
auuccauagugucuguggcaga

SEQ ID NO: 210668 - RNA, 22 nt, Homo sapiens
auuccauuuguuaucacacccg

SEQ ID NO: 210669 - RNA, 22 nt, Homo sapiens
auuccuuaggcccuuugguuag

SEQ ID NO: 210670 - RNA, 18 nt, Homo sapiens
auucuacaggccuuuuga

SEQ ID NO: 210671 - RNA, 22 nt, Homo sapiens
auucuugcuugaacuuggugca

SEQ ID NO: 210672 - RNA, 22 nt, Homo sapiens
auugaacacuucugugugccag

SEQ ID NO: 210673 - RNA, 22 nt, Homo sapiens
auugaauuugguuugcuaagaa

SEQ ID NO: 210674 - RNA, 22 nt, Homo sapiens
auugagacaaauuuguaugcag

SEQ ID NO: 210675 - RNA, 21 nt, Homo sapiens
auugagcacaugaaacauggc

SEQ ID NO: 210676 - RNA, 22 nt, Homo sapiens
auugagcuuuuuaaaauauagu

SEQ ID NO: 210677 - RNA, 22 nt, Homo sapiens
auugcaauuaguccauagaguu

SEQ ID NO: 210678 - RNA, 22 nt, Homo sapiens
auugcacaaagagggaaacuga

SEQ ID NO: 210679 - RNA, 22 nt, Homo sapiens
auugcacuccagccccggggac

SEQ ID NO: 210680 - RNA, 22 nt, Homo sapiens
auugcacuccagccuagucaac

SEQ ID NO: 210681 - RNA, 22 nt, Homo sapiens
auugcacuccagccuggaugac

SEQ ID NO: 210682 - RNA, 22 nt, Homo sapiens
auugcacuccagccuggcaaua

SEQ ID NO: 210683 - RNA, 22 nt, Homo sapiens
auugcacuccagccuggccaac

SEQ ID NO: 210684 - RNA, 22 nt, Homo sapiens
auugcacuccagccuggggaac

SEQ ID NO: 210685 - RNA, 22 nt, Homo sapiens
auugcacuccagccuggugaca

SEQ ID NO: 210686 - RNA, 22 nt, Homo sapiens
auugcacuccagccuuggggau

SEQ ID NO: 210687 - RNA, 22 nt, Homo sapiens
auugcacuccagucucaccagg

SEQ ID NO: 210688 - RNA, 22 nt, Homo sapiens
auugcacuccauccuaggugac

SEQ ID NO: 210689 - RNA, 22 nt, Homo sapiens
auugcacuccauccugggcaau

SEQ ID NO: 210690 - RNA, 22 nt, Homo sapiens
auugcacugcagccugggcaac

SEQ ID NO: 210691 - RNA, 22 nt, Homo sapiens
auugcuuacccuguauuagauc

SEQ ID NO: 210692 - RNA, 22 nt, Homo sapiens
auuggaacugaaauaauaacuu

SEQ ID NO: 210693 - RNA, 22 nt, Homo sapiens
auuggcaauccauauauuuucu

SEQ ID NO: 210694 - RNA, 22 nt, Homo sapiens
auuggcaaucgucuccauuuuu

SEQ ID NO: 210695 - RNA, 22 nt, Homo sapiens
auuggcagaaaucuuuauagua

SEQ ID NO: 210696 - RNA, 22 nt, Homo sapiens
auuggccaaugggacgucagca

SEQ ID NO: 210697 - RNA, 22 nt, Homo sapiens
auuggcuuuauacauaagaaua

SEQ ID NO: 210698 - RNA, 22 nt, Homo sapiens
auuggggaaugguggcuuuagu

SEQ ID NO: 210699 - RNA, 22 nt, Homo sapiens
auuggguuaaaggauaugaaca

SEQ ID NO: 210700 - RNA, 22 nt, Homo sapiens
auuguacauacaccggugugua

SEQ ID NO: 210701 - RNA, 22 nt, Homo sapiens
auuguacuccagccugggcaag

SEQ ID NO: 210702 - RNA, 22 nt, Homo sapiens
auuguacuccagccuuggggac

SEQ ID NO: 210703 - RNA, 22 nt, Homo sapiens
auugucccucuuaaucccagca

SEQ ID NO: 210704 - RNA, 22 nt, Homo sapiens
aaguaucaggaauaguuauugg

SEQ ID NO: 210705 - RNA, 22 nt, Homo sapiens
aagugaaugaugugaaguguaa

SEQ ID NO: 210706 - RNA, 22 nt, Homo sapiens
aagugaguaauacgucaguugu

SEQ ID NO: 210707 - RNA, 22 nt, Homo sapiens
aagugagugacaaaaacugggc

SEQ ID NO: 210708 - RNA, 22 nt, Homo sapiens
aagugcuggccuacucaaucga

SEQ ID NO: 210709 - RNA, 22 nt, Homo sapiens
aagugcuguccuaccuuuggga

SEQ ID NO: 210710 - RNA, 22 nt, Homo sapiens
aagugcuuuuuagauaugguuu

SEQ ID NO: 210711 - RNA, 22 nt, Homo sapiens
aagugguuuuaaucuggugagu

SEQ ID NO: 210712 - RNA, 22 nt, Homo sapiens
aagugguuuuuacaaagacaga

SEQ ID NO: 210713 - RNA, 22 nt, Homo sapiens
aagugucuuaccgggagggagu

SEQ ID NO: 210714 - RNA, 22 nt, Homo sapiens
aauaaagcuuugagcuuugcug

SEQ ID NO: 210715 - RNA, 20 nt, Homo sapiens
aauaacagccccagggaggu

SEQ ID NO: 210716 - RNA, 22 nt, Homo sapiens
aauaagcauaguaccugauagg

SEQ ID NO: 210717 - RNA, 19 nt, Homo sapiens
aauaaugccagaugucugu

SEQ ID NO: 210718 - RNA, 22 nt, Homo sapiens
aauaauggcaccaaagcacaag

SEQ ID NO: 210719 - RNA, 21 nt, Homo sapiens
aauacucuagguuaagagagc

SEQ ID NO: 210720 - RNA, 22 nt, Homo sapiens
aauacugugauaucgagcgauu

SEQ ID NO: 210721 - RNA, 22 nt, Homo sapiens
aauauguccuugaaauggugcu

SEQ ID NO: 210722 - RNA, 22 nt, Homo sapiens
aaucaacauuguuuuaagucaa

SEQ ID NO: 210723 - RNA, 22 nt, Homo sapiens
aaucacaggucuuggcugcaug

SEQ ID NO: 210724 - RNA, 22 nt, Homo sapiens
aaucacaguuaguaagggagaa

SEQ ID NO: 210725 - RNA, 22 nt, Homo sapiens
aaucacuuugcuacaaggcagu

SEQ ID NO: 210726 - RNA, 22 nt, Homo sapiens
aaucccugagcuagacacaaag

SEQ ID NO: 210727 - RNA, 22 nt, Homo sapiens
aaucucagagauaucugugucc

SEQ ID NO: 210728 - RNA, 22 nt, Homo sapiens
aaucugauguuaucagcuuaag

SEQ ID NO: 210729 - RNA, 22 nt, Homo sapiens
aaugacagccagauucuucucu

SEQ ID NO: 210730 - RNA, 22 nt, Homo sapiens
aaugacagugcuaaagaacccu

SEQ ID NO: 210731 - RNA, 22 nt, Homo sapiens
aaugacuaagaugguacauuuu

SEQ ID NO: 210732 - RNA, 22 nt, Homo sapiens
aaugcacauauauuuccuuauu

SEQ ID NO: 210733 - RNA, 22 nt, Homo sapiens
aaugccuagugugugacaggug

SEQ ID NO: 210734 - RNA, 22 nt, Homo sapiens
aauggcacaagaguaaacuguu

SEQ ID NO: 210735 - RNA, 22 nt, Homo sapiens
aauggcacuuuauaaauguuaa

SEQ ID NO: 210736 - RNA, 22 nt, Homo sapiens
aauggcaucuagaguggugaau

SEQ ID NO: 210737 - RNA, 20 nt, Homo sapiens
aauggcauguuggacaacug

SEQ ID NO: 210738 - RNA, 22 nt, Homo sapiens
aauggcauugguccuuuuggau

SEQ ID NO: 210739 - RNA, 22 nt, Homo sapiens
aauggcucuuuaggcaauagau

SEQ ID NO: 210740 - RNA, 22 nt, Homo sapiens
aauggcuucuuauugugguuca

SEQ ID NO: 210741 - RNA, 22 nt, Homo sapiens
aauggcuuuuaauauccauaau

SEQ ID NO: 210742 - RNA, 21 nt, Homo sapiens
aaugguguugccaacaaggug

SEQ ID NO: 210743 - RNA, 22 nt, Homo sapiens
aaugguguuuccguuaagcuga

SEQ ID NO: 210744 - RNA, 22 nt, Homo sapiens
aaugucaugaguccaaccagaa

SEQ ID NO: 210745 - RNA, 22 nt, Homo sapiens
aauuacauggcaauugggaaau

SEQ ID NO: 210746 - RNA, 22 nt, Homo sapiens
aauuacucgugucuuuacugcu

SEQ ID NO: 210747 - RNA, 22 nt, Homo sapiens
aauuaguaaccuaauuccaucu

SEQ ID NO: 210748 - RNA, 22 nt, Homo sapiens
aauucacuucuuuuaggcaggg

SEQ ID NO: 210749 - RNA, 22 nt, Homo sapiens
aauugcaauggacaaugcagca

SEQ ID NO: 210750 - RNA, 19 nt, Homo sapiens
aucuggaguuccuggggcu

SEQ ID NO: 210751 - RNA, 22 nt, Homo sapiens
aucugggguuggcaaaguuugg

SEQ ID NO: 210752 - RNA, 21 nt, Homo sapiens
aucugugagaccuuggggguu

SEQ ID NO: 210753 - RNA, 22 nt, Homo sapiens
aucugugguuguaugcauauua

SEQ ID NO: 210754 - RNA, 22 nt, Homo sapiens
aucuguguuuaaggucccagaa

SEQ ID NO: 210755 - RNA, 22 nt, Homo sapiens
aucuugcauuugcuaaaaugca

SEQ ID NO: 210756 - RNA, 21 nt, Homo sapiens
aucuugguauagucuuauugg

SEQ ID NO: 210757 - RNA, 22 nt, Homo sapiens
aucuuuaguggcuguuuucaga

SEQ ID NO: 210758 - RNA, 22 nt, Homo sapiens
aucuuugauuagacugauggau

SEQ ID NO: 210759 - RNA, 22 nt, Homo sapiens
aucuuugauugaagggacccug

SEQ ID NO: 210760 - RNA, 22 nt, Homo sapiens
augaaacuggcuaauuuuugua

SEQ ID NO: 210761 - RNA, 22 nt, Homo sapiens
augaaaguguguggaaacuuga

SEQ ID NO: 210762 - RNA, 22 nt, Homo sapiens
augaaaugcauguuaaguccgu

SEQ ID NO: 210763 - RNA, 22 nt, Homo sapiens
augaaauguaugagucuggguu

SEQ ID NO: 210764 - RNA, 22 nt, Homo sapiens
augaacagagccuugagaaccu

SEQ ID NO: 210765 - RNA, 22 nt, Homo sapiens
augaacuaugugggauguuuua

SEQ ID NO: 210766 - RNA, 19 nt, Homo sapiens
augaacucaucauuucuca

SEQ ID NO: 210767 - RNA, 18 nt, Homo sapiens
augaacucaucauuuuua

SEQ ID NO: 210768 - RNA, 23 nt, Homo sapiens
augaacucaucauuuuuuauggc

SEQ ID NO: 210769 - RNA, 22 nt, Homo sapiens
augaagaucaugaagacggcuu

SEQ ID NO: 210770 - RNA, 17 nt, Homo sapiens
augaagucaucauuuuu

SEQ ID NO: 210771 - RNA, 22 nt, Homo sapiens
augaagugcaugauaguugguu

SEQ ID NO: 210772 - RNA, 22 nt, Homo sapiens
augaauacugcugcaaugaaca

SEQ ID NO: 210773 - RNA, 22 nt, Homo sapiens
augaauagaguuaauugaguac

SEQ ID NO: 210774 - RNA, 22 nt, Homo sapiens
augaauuuucugauguugggua

SEQ ID NO: 210775 - RNA, 22 nt, Homo sapiens
ucagagucuagaucacucacug

SEQ ID NO: 210776 - RNA, 22 nt, Homo sapiens
ucagaucuucagcaggggcccc

SEQ ID NO: 210777 - RNA, 22 nt, Homo sapiens
ucagaugaucugguaagaacuu

SEQ ID NO: 210778 - RNA, 22 nt, Homo sapiens
ucagaugaugucccuguucuaa

SEQ ID NO: 210779 - RNA, 22 nt, Homo sapiens
ucagaugauuccguugacgaga

SEQ ID NO: 210780 - RNA, 22 nt, Homo sapiens
ucagauguuugagaaguauacu

SEQ ID NO: 210781 - RNA, 22 nt, Homo sapiens
ucagcagugagagaccucaccc

SEQ ID NO: 210782 - RNA, 22 nt, Homo sapiens
ucagcaguggacagaaugguag

SEQ ID NO: 210783 - RNA, 22 nt, Homo sapiens
ucagcagugugaaaauggacua

SEQ ID NO: 210784 - RNA, 22 nt, Homo sapiens
ucagcaucacaggcagugagug

SEQ ID NO: 210785 - RNA, 21 nt, Homo sapiens
ucaggaccucuaguuagccag

SEQ ID NO: 210786 - RNA, 22 nt, Homo sapiens
ucaggcaccuuccucuuaucug

SEQ ID NO: 210787 - RNA, 22 nt, Homo sapiens
ucagguagugccaugauugauu

SEQ ID NO: 210788 - RNA, 23 nt, Homo sapiens
ucagguaguuucagaggaccuug

SEQ ID NO: 210789 - RNA, 22 nt, Homo sapiens
ucagguaucuuuauagcgaugc

SEQ ID NO: 210790 - RNA, 22 nt, Homo sapiens
ucagguccuuacugugcucccu

SEQ ID NO: 210791 - RNA, 22 nt, Homo sapiens
ucaggugcaguggcucaugcuu

SEQ ID NO: 210792 - RNA, 22 nt, Homo sapiens
ucaguaaucuuagcugugcaga

SEQ ID NO: 210793 - RNA, 23 nt, Homo sapiens
ucaguacuccacuuucaauagug

SEQ ID NO: 210794 - RNA, 22 nt, Homo sapiens
ucaguacuuuggagcucacaua

SEQ ID NO: 210795 - RNA, 18 nt, Homo sapiens
ucagucacugccuggcuu

SEQ ID NO: 210796 - RNA, 22 nt, Homo sapiens
ucagucauucacucacucggac

SEQ ID NO: 210797 - RNA, 22 nt, Homo sapiens
ucagucuuuuuuuggcaagcau

SEQ ID NO: 210798 - RNA, 22 nt, Homo sapiens
ucagugaacgaggaggagggug

SEQ ID NO: 210799 - RNA, 22 nt, Homo sapiens
ucagugacugcugcuuguauac

SEQ ID NO: 210800 - RNA, 17 nt, Homo sapiens
ucagugcauuuaagaga

SEQ ID NO: 210801 - RNA, 21 nt, Homo sapiens
ucagugcugugggcaaggugc

SEQ ID NO: 210802 - RNA, 22 nt, Homo sapiens
ucagugcuuuuuguugucauca

SEQ ID NO: 210803 - RNA, 22 nt, Homo sapiens
ucaguggauuauuaaagucacc

SEQ ID NO: 210804 - RNA, 22 nt, Homo sapiens
ucagugguuaaaagauucuaga

SEQ ID NO: 210805 - RNA, 22 nt, Homo sapiens
ucaguuuagguguaacggccac

SEQ ID NO: 210806 - RNA, 22 nt, Homo sapiens
ucauaaaguuguuuuaauggga

SEQ ID NO: 210807 - RNA, 22 nt, Homo sapiens
ucauacuguccaauucuagugg

SEQ ID NO: 210808 - RNA, 22 nt, Homo sapiens
ucauacuguuaaaugguuuagu

SEQ ID NO: 210809 - RNA, 22 nt, Homo sapiens
ucauagaucaaguaauaagaca

SEQ ID NO: 210810 - RNA, 20 nt, Homo sapiens
ucauagggugguggcagugg

SEQ ID NO: 210811 - RNA, 16 nt, Homo sapiens
ucauaguaucucuucu

SEQ ID NO: 210812 - RNA, 19 nt, Homo sapiens
ucauagucuaagaugagaa

SEQ ID NO: 210813 - RNA, 22 nt, Homo sapiens
ucauaucauuagaucuacugua

SEQ ID NO: 210814 - RNA, 22 nt, Homo sapiens
ucaucagguaugucagcggagu

SEQ ID NO: 210815 - RNA, 20 nt, Homo sapiens
ucaucaguuggugcucgcug

SEQ ID NO: 210816 - RNA, 22 nt, Homo sapiens
ucaucaguuuuuuauaugugau

SEQ ID NO: 210817 - RNA, 22 nt, Homo sapiens
ucaugacacagcauacugacuu

SEQ ID NO: 210818 - RNA, 22 nt, Homo sapiens
ucaugacacuggcaggagcuaa

SEQ ID NO: 210819 - RNA, 22 nt, Homo sapiens
ucaugagacacacuggaaagga

SEQ ID NO: 210820 - RNA, 22 nt, Homo sapiens
ucaugcaucuuguggaauuuga

SEQ ID NO: 210821 - RNA, 22 nt, Homo sapiens
ucauggcauuguuaaggguuuu

SEQ ID NO: 210822 - RNA, 22 nt, Homo sapiens
ucaugguuuuauaacccucuug

SEQ ID NO: 210823 - RNA, 22 nt, Homo sapiens
ucauguaauuuugugucuauga

SEQ ID NO: 210824 - RNA, 22 nt, Homo sapiens
ucaugucuuguuguauuuauuu

SEQ ID NO: 210825 - RNA, 22 nt, Homo sapiens
ucaugugagcacagagcaagau

SEQ ID NO: 210826 - RNA, 22 nt, Homo sapiens
ucauuggaugucugaaaugauu

SEQ ID NO: 210827 - RNA, 22 nt, Homo sapiens
ucauugguagcucauggaaccg

SEQ ID NO: 210828 - RNA, 22 nt, Homo sapiens
uccaauguaaucaucauugaau

SEQ ID NO: 210829 - RNA, 22 nt, Homo sapiens
uccacaguaaggacccugccuu

SEQ ID NO: 210830 - RNA, 22 nt, Homo sapiens
uccacaguggugaggugcagca

SEQ ID NO: 210831 - RNA, 22 nt, Homo sapiens
uccacagugguggaauuguuca

SEQ ID NO: 210832 - RNA, 19 nt, Homo sapiens
uccaccgcgugcaccucua

SEQ ID NO: 210833 - RNA, 20 nt, Homo sapiens
uccacugagcgucacggcag

SEQ ID NO: 210834 - RNA, 22 nt, Homo sapiens
uccauaguacuagaaacugacc

SEQ ID NO: 210835 - RNA, 22 nt, Homo sapiens
uccaugagaauaguuaggcucu

SEQ ID NO: 210836 - RNA, 22 nt, Homo sapiens
uccauuuguuguaggguauagu

SEQ ID NO: 210837 - RNA, 22 nt, Homo sapiens
ucccaagaugagaugggggcug

SEQ ID NO: 210838 - RNA, 19 nt, Homo sapiens
ucccaagaugcucauacau

SEQ ID NO: 210839 - RNA, 16 nt, Homo sapiens
ucccaccauugcuugu

SEQ ID NO: 210840 - RNA, 22 nt, Homo sapiens
ucccagugaaaccccaccuuca

SEQ ID NO: 210841 - RNA, 22 nt, Homo sapiens
ucccagugcuaugcaaaagccu

SEQ ID NO: 210842 - RNA, 19 nt, Homo sapiens
uccccaguuuuccguucag

SEQ ID NO: 210843 - RNA, 22 nt, Homo sapiens
uccccgaggcuggagugcagug

SEQ ID NO: 210844 - RNA, 22 nt, Homo sapiens
uccccugauaccaaccaccaug

SEQ ID NO: 210845 - RNA, 22 nt, Homo sapiens
ucccuagacuccugccuuucag

SEQ ID NO: 210846 - RNA, 22 nt, Homo sapiens
ucccugaaucucagguucugua

SEQ ID NO: 210847 - RNA, 22 nt, Homo sapiens
ucccugacagucacagagcuac

SEQ ID NO: 210848 - RNA, 18 nt, Homo sapiens
ucccugacucaaauucuu

SEQ ID NO: 210849 - RNA, 19 nt, Homo sapiens
ucccugagucuuagcuuga

SEQ ID NO: 210850 - RNA, 22 nt, Homo sapiens
ucccuggacagccuugccuggg

SEQ ID NO: 210851 - RNA, 22 nt, Homo sapiens
ucccuguagugccuagaucaga

SEQ ID NO: 210852 - RNA, 16 nt, Homo sapiens
ucccugugacaugugc

SEQ ID NO: 210853 - RNA, 22 nt, Homo sapiens
cuugggcagugugcauguguau

SEQ ID NO: 210854 - RNA, 18 nt, Homo sapiens
cuugucaaaucuuuccuc

SEQ ID NO: 210855 - RNA, 22 nt, Homo sapiens
cuugugauugcacggcugccug

SEQ ID NO: 210856 - RNA, 22 nt, Homo sapiens
cuuguggugcuuuuacgugggc

SEQ ID NO: 210857 - RNA, 22 nt, Homo sapiens
cuuguguuacauauuuaagaga

SEQ ID NO: 210858 - RNA, 17 nt, Homo sapiens
cuuguugugguaguuug

SEQ ID NO: 210859 - RNA, 22 nt, Homo sapiens
cuuuaguuaaaauugggguugu

SEQ ID NO: 210860 - RNA, 22 nt, Homo sapiens
cuuuccauuguuggagcauaaa

SEQ ID NO: 210861 - RNA, 22 nt, Homo sapiens
cuuucucagugagacccgagau

SEQ ID NO: 210862 - RNA, 22 nt, Homo sapiens
cuuugaugagaaaauacuuugu

SEQ ID NO: 210863 - RNA, 21 nt, Homo sapiens
cuuugcacugcuccucagcuc

SEQ ID NO: 210864 - RNA, 18 nt, Homo sapiens
cuuugcagcuuccagagg

SEQ ID NO: 210865 - RNA, 22 nt, Homo sapiens
cuuuggucaaaauaaguaaguu

SEQ ID NO: 210866 - RNA, 20 nt, Homo sapiens
cuuuggugagucaacuccuu

SEQ ID NO: 210867 - RNA, 22 nt, Homo sapiens
cuuuggugauagauaccccaua

SEQ ID NO: 210868 - RNA, 20 nt, Homo sapiens
agcagccacagauuccucag

SEQ ID NO: 210869 - RNA, 22 nt, Homo sapiens
agcagcucaagacuuaaauuug

SEQ ID NO: 210870 - RNA, 22 nt, Homo sapiens
agcagcuuugcauggccuguga

SEQ ID NO: 210871 - RNA, 22 nt, Homo sapiens
agcaggacaauaugggaucagg

SEQ ID NO: 210872 - RNA, 22 nt, Homo sapiens
agcaggauuguuacaauaguaa

SEQ ID NO: 210873 - RNA, 22 nt, Homo sapiens
agcagguauucgggucaugggg

SEQ ID NO: 210874 - RNA, 22 nt, Homo sapiens
agcagguguccacaauguuugc

SEQ ID NO: 210875 - RNA, 22 nt, Homo sapiens
agcagugucauuuucuggugag

SEQ ID NO: 210876 - RNA, 22 nt, Homo sapiens
agcagugugaaaauggacuaau

SEQ ID NO: 210877 - RNA, 22 nt, Homo sapiens
agcagugugaaaugauuuaagg

SEQ ID NO: 210878 - RNA, 19 nt, Homo sapiens
agcaguguggagauuucuc

SEQ ID NO: 210879 - RNA, 20 nt, Homo sapiens
agcaucagugguaguguugc

SEQ ID NO: 210880 - RNA, 22 nt, Homo sapiens
agcaucauaccaaucugguccu

SEQ ID NO: 210881 - RNA, 22 nt, Homo sapiens
agcauuacaugguacagagaag

SEQ ID NO: 210882 - RNA, 21 nt, Homo sapiens
agccaguguuccuuguggcuc

SEQ ID NO: 210883 - RNA, 23 nt, Homo sapiens
agccugguuucccugcuucuccc

SEQ ID NO: 210884 - RNA, 22 nt, Homo sapiens
agccuucauucugacaguagga

SEQ ID NO: 210885 - RNA, 21 nt, Homo sapiens
agcuaaauuggaaauuucugu

SEQ ID NO: 210886 - RNA, 22 nt, Homo sapiens
agcuaacauuuuuccucuucca

SEQ ID NO: 210887 - RNA, 22 nt, Homo sapiens
agcuacguuggggaaguucuca

SEQ ID NO: 210888 - RNA, 22 nt, Homo sapiens
agcuauauugaggaugccauuc

SEQ ID NO: 210889 - RNA, 18 nt, Homo sapiens
agcucaguguuugcuuac

SEQ ID NO: 210890 - RNA, 22 nt, Homo sapiens
agcucauugcuguccuggagga

SEQ ID NO: 210891 - RNA, 22 nt, Homo sapiens
agcugauggucuuguaugaugu

SEQ ID NO: 210892 - RNA, 22 nt, Homo sapiens
agcugcacgugguaaauguaaa

SEQ ID NO: 210893 - RNA, 22 nt, Homo sapiens
agcuggauguggaugacccugu

SEQ ID NO: 210894 - RNA, 22 nt, Homo sapiens
agcuggauuguuuaccuggggc

SEQ ID NO: 210895 - RNA, 23 nt, Homo sapiens
agcugguacuagaggcuugcgcc

SEQ ID NO: 210896 - RNA, 22 nt, Homo sapiens
agcugguaguuuucuaguguuu

SEQ ID NO: 210897 - RNA, 22 nt, Homo sapiens
agcugguaugaaaaucucccca

SEQ ID NO: 210898 - RNA, 22 nt, Homo sapiens
agcuggucugauacuuaccucc

SEQ ID NO: 210899 - RNA, 22 nt, Homo sapiens
agcugguucuuugccuuguaga

SEQ ID NO: 210900 - RNA, 22 nt, Homo sapiens
agcugguuuauuucucacaaca

SEQ ID NO: 210901 - RNA, 21 nt, Homo sapiens
agcugguuucuucuuacuccu

SEQ ID NO: 210902 - RNA, 22 nt, Homo sapiens
agcuguuguacacuuuaccuuu

SEQ ID NO: 210903 - RNA, 20 nt, Homo sapiens
agcuguuguuaaaaaggagg

SEQ ID NO: 210904 - RNA, 20 nt, Homo sapiens
agcuguuguuaugagguuua

SEQ ID NO: 210905 - RNA, 22 nt, Homo sapiens
agcuucauuccaacuuccuucu

SEQ ID NO: 210906 - RNA, 22 nt, Homo sapiens
agcuucauuguuaugaauguca

SEQ ID NO: 210907 - RNA, 22 nt, Homo sapiens
agcuuguagugauuugugguaa

SEQ ID NO: 210908 - RNA, 19 nt, Homo sapiens
agcuuuggcuaacuuucuc

SEQ ID NO: 210909 - RNA, 22 nt, Homo sapiens
aggaaaucuuagcugaggggau

SEQ ID NO: 210910 - RNA, 22 nt, Homo sapiens
aggaagguaaacuaacuugccu

SEQ ID NO: 210911 - RNA, 22 nt, Homo sapiens
aggaaguaauaaguuugguucu

SEQ ID NO: 210912 - RNA, 22 nt, Homo sapiens
aggaagugucuucuuuuaggca

SEQ ID NO: 210913 - RNA, 22 nt, Homo sapiens
aggaaucuaagguaucagguua

SEQ ID NO: 210914 - RNA, 22 nt, Homo sapiens
aggaaugcuaaguuuuccuccu

SEQ ID NO: 210915 - RNA, 22 nt, Homo sapiens
aggaccauuguguagcagacau

SEQ ID NO: 210916 - RNA, 22 nt, Homo sapiens
aggagaugaagcuuuaucuaaa

SEQ ID NO: 210917 - RNA, 22 nt, Homo sapiens
aggagcacaggacuuugauuau

SEQ ID NO: 210918 - RNA, 21 nt, Homo sapiens
aggagcauucucuugcuuugu

SEQ ID NO: 210919 - RNA, 22 nt, Homo sapiens
aggaguguguauuaaugaaauu

SEQ ID NO: 210920 - RNA, 22 nt, Homo sapiens
aggauuagagacuucucuaccu

SEQ ID NO: 210921 - RNA, 22 nt, Homo sapiens
aggcaacgcuucuuucucaggu

SEQ ID NO: 210922 - RNA, 21 nt, Homo sapiens
aggcaagauuacuuacgagca

SEQ ID NO: 210923 - RNA, 22 nt, Homo sapiens
aggcaaguugcucaaaugcaaa

SEQ ID NO: 210924 - RNA, 22 nt, Homo sapiens
aggcacacaacccuggaccuga

SEQ ID NO: 210925 - RNA, 22 nt, Homo sapiens
aggcacggugucucaugccugu

SEQ ID NO: 210926 - RNA, 22 nt, Homo sapiens
aggcagucugaguuuugaaagg

SEQ ID NO: 210927 - RNA, 22 nt, Homo sapiens
aggcaugaguucagaggguaug

SEQ ID NO: 210928 - RNA, 22 nt, Homo sapiens
aggcaugauggcuccagaucau

SEQ ID NO: 210929 - RNA, 22 nt, Homo sapiens
aggcauggagacuaaaauuaua

SEQ ID NO: 210930 - RNA, 22 nt, Homo sapiens
aggcaugugugcagacugucug

SEQ ID NO: 210931 - RNA, 20 nt, Homo sapiens
aggcauguugguuugcgugu

SEQ ID NO: 210932 - RNA, 22 nt, Homo sapiens
aggcuaagaugacuccaccccc

SEQ ID NO: 210933 - RNA, 22 nt, Homo sapiens
aggcuagacuuugagaauuuuu

SEQ ID NO: 210934 - RNA, 22 nt, Homo sapiens
agggcuuuugagcugagauggu

SEQ ID NO: 210935 - RNA, 22 nt, Homo sapiens
aggguuuuuauuuauguggcau

SEQ ID NO: 210936 - RNA, 22 nt, Homo sapiens
agguaaacauggggacugcuac

SEQ ID NO: 210937 - RNA, 22 nt, Homo sapiens
agguagcauagcgggaauauca

SEQ ID NO: 210938 - RNA, 22 nt, Homo sapiens
agguauguaugucuguacagcg

SEQ ID NO: 210939 - RNA, 21 nt, Homo sapiens
aggucaguaagaaugcagcac

SEQ ID NO: 210940 - RNA, 22 nt, Homo sapiens
aggucccauguccucccugacc

SEQ ID NO: 210941 - RNA, 21 nt, Homo sapiens
aggugucuuggguucccuggc

SEQ ID NO: 210942 - RNA, 20 nt, Homo sapiens
agguucaaaucccaaucaug

SEQ ID NO: 210943 - RNA, 22 nt, Homo sapiens
agguuuucagccccagccuagg

SEQ ID NO: 210944 - RNA, 22 nt, Homo sapiens
aguaaagccagaccuguuaauu

SEQ ID NO: 210945 - RNA, 22 nt, Homo sapiens
aguaacauuucuaguagagagu

SEQ ID NO: 210946 - RNA, 22 nt, Homo sapiens
aguacacuguuaaaaagaagug

SEQ ID NO: 210947 - RNA, 22 nt, Homo sapiens
aguaccauuagauuaggaugac

SEQ ID NO: 210948 - RNA, 21 nt, Homo sapiens
aguagcacugugucuuacaaa

SEQ ID NO: 210949 - RNA, 22 nt, Homo sapiens
aguauuaguuuaugggugugga

SEQ ID NO: 210950 - RNA, 20 nt, Homo sapiens
aguauucacuuuuuucaugg

SEQ ID NO: 210951 - RNA, 22 nt, Homo sapiens
agucaaaugcuuauguauaaag

SEQ ID NO: 210952 - RNA, 22 nt, Homo sapiens
agucaacaucaugaaguggaaa

SEQ ID NO: 210953 - RNA, 22 nt, Homo sapiens
agucaagaugagauuugggugg

SEQ ID NO: 210954 - RNA, 22 nt, Homo sapiens
agucacagguucuugggauuag

SEQ ID NO: 210955 - RNA, 22 nt, Homo sapiens
gaggaaguagcuacugucuuuc

SEQ ID NO: 210956 - RNA, 22 nt, Homo sapiens
gaggagauauucugcuggaugg

SEQ ID NO: 210957 - RNA, 22 nt, Homo sapiens
gaggaguagggcacaaagccuu

SEQ ID NO: 210958 - RNA, 22 nt, Homo sapiens
gaggcaguguguccguucucgg

SEQ ID NO: 210959 - RNA, 22 nt, Homo sapiens
gaggcuagauggggaugugucc

SEQ ID NO: 210960 - RNA, 22 nt, Homo sapiens
gagguaagaugauucguguccu

SEQ ID NO: 210961 - RNA, 22 nt, Homo sapiens
gagguagagacuauguauuaga

SEQ ID NO: 210962 - RNA, 22 nt, Homo sapiens
gagguaggaauaaacauuugaa

SEQ ID NO: 210963 - RNA, 22 nt, Homo sapiens
gagguaggggccuuaaagaugc

SEQ ID NO: 210964 - RNA, 22 nt, Homo sapiens
gagguauggauaucuggagagg

SEQ ID NO: 210965 - RNA, 22 nt, Homo sapiens
gaggucaggacauuuuugcuuu

SEQ ID NO: 210966 - RNA, 22 nt, Homo sapiens
gaggucauucugugguacccag

SEQ ID NO: 210967 - RNA, 22 nt, Homo sapiens
gaggugaaggucucaauaaaua

SEQ ID NO: 210968 - RNA, 22 nt, Homo sapiens
gagguguagucaugccaagauc

SEQ ID NO: 210969 - RNA, 22 nt, Homo sapiens
gagguugggaugagggauacag

SEQ ID NO: 210970 - RNA, 22 nt, Homo sapiens
aguucaaaucgagccuggccau

SEQ ID NO: 210971 - RNA, 22 nt, Homo sapiens
aguuccuacuggcuguaaagaa

SEQ ID NO: 210972 - RNA, 18 nt, Homo sapiens
aguuguuuuauccugccc

SEQ ID NO: 210973 - RNA, 22 nt, Homo sapiens
auaaauaguaguugugguggcc

SEQ ID NO: 210974 - RNA, 22 nt, Homo sapiens
auaaaugcaaugguauuuuuga

SEQ ID NO: 210975 - RNA, 22 nt, Homo sapiens
auaaaugcauugagaacugcug

SEQ ID NO: 210976 - RNA, 22 nt, Homo sapiens
auaacaggaaauacagggcuuu

SEQ ID NO: 210977 - RNA, 18 nt, Homo sapiens
auaaccuggugcuuucaa

SEQ ID NO: 210978 - RNA, 22 nt, Homo sapiens
auaaggaguaucauauuaaaac

SEQ ID NO: 210979 - RNA, 22 nt, Homo sapiens
auaaggcuaaggacuugaguua

SEQ ID NO: 210980 - RNA, 22 nt, Homo sapiens
auaaguagaaugauggucaaaa

SEQ ID NO: 210981 - RNA, 22 nt, Homo sapiens
auaaguauuuggacuuuacugu

SEQ ID NO: 210982 - RNA, 22 nt, Homo sapiens
auaagucaauggaacagauuaa

SEQ ID NO: 210983 - RNA, 22 nt, Homo sapiens
auaagugcuuguugaauaauag

SEQ ID NO: 210984 - RNA, 22 nt, Homo sapiens
auaauaccugccacauuugaau

SEQ ID NO: 210985 - RNA, 19 nt, Homo sapiens
auaauuagcagugaggaca

SEQ ID NO: 210986 - RNA, 22 nt, Homo sapiens
auaauugcuaagugaagauggu

SEQ ID NO: 210987 - RNA, 22 nt, Homo sapiens
auacacgguaggcacauauuua

SEQ ID NO: 210988 - RNA, 22 nt, Homo sapiens
auacacuggagcaaaccuggag

SEQ ID NO: 210989 - RNA, 22 nt, Homo sapiens
auacaguaucuucuggcaagca

SEQ ID NO: 210990 - RNA, 22 nt, Homo sapiens
auacagugaauacuuacagugu

SEQ ID NO: 210991 - RNA, 22 nt, Homo sapiens
auacaguugccauuucuugugc

SEQ ID NO: 210992 - RNA, 22 nt, Homo sapiens
auacaugugccaugcuggugug

SEQ ID NO: 210993 - RNA, 22 nt, Homo sapiens
auacaugugccauggugguuug

SEQ ID NO: 210994 - RNA, 22 nt, Homo sapiens
auacaugugccauguugguuug

SEQ ID NO: 210995 - RNA, 22 nt, Homo sapiens
auaccugguagucuugcuacac

SEQ ID NO: 210996 - RNA, 22 nt, Homo sapiens
auacuagucaagaauguaugag

SEQ ID NO: 210997 - RNA, 22 nt, Homo sapiens
auacuaugagauaauaaagacu

SEQ ID NO: 210998 - RNA, 22 nt, Homo sapiens
auacuccugucucagcugagau

SEQ ID NO: 210999 - RNA, 22 nt, Homo sapiens
auacugcacauuuagggaggga

SEQ ID NO: 211000 - RNA, 22 nt, Homo sapiens
auacugccuuuagcaaaacagu

SEQ ID NO: 211001 - RNA, 22 nt, Homo sapiens
auacuggcuuuccaauugugau

SEQ ID NO: 211002 - RNA, 22 nt, Homo sapiens
auacuguacugaaguacccauu

SEQ ID NO: 211003 - RNA, 15 nt, Homo sapiens
auagaaugaaaggga

SEQ ID NO: 211004 - RNA, 22 nt, Homo sapiens
auagaauguaauguaccuccuu

SEQ ID NO: 211005 - RNA, 22 nt, Homo sapiens
auagacacugaaaucccugcca

SEQ ID NO: 211006 - RNA, 22 nt, Homo sapiens
auagagugcuucaucaguagua

SEQ ID NO: 211007 - RNA, 22 nt, Homo sapiens
auagcaagaugauugauccauu

SEQ ID NO: 211008 - RNA, 22 nt, Homo sapiens
auagcacaguguguguacacca

SEQ ID NO: 211009 - RNA, 22 nt, Homo sapiens
auagcacuuaccacaggcugca

SEQ ID NO: 211010 - RNA, 22 nt, Homo sapiens
auagcagaacagugucucacug

SEQ ID NO: 211011 - RNA, 22 nt, Homo sapiens
auagcagacauuucaaggcagg

SEQ ID NO: 211012 - RNA, 22 nt, Homo sapiens
auagcagcaccccacuaccuca

SEQ ID NO: 211013 - RNA, 22 nt, Homo sapiens
auagcaggagaauggucauggg

SEQ ID NO: 211014 - RNA, 22 nt, Homo sapiens
auagcccauuuguugguccugg

SEQ ID NO: 211015 - RNA, 22 nt, Homo sapiens
auagcuguccuuacuagcuagg

SEQ ID NO: 211016 - RNA, 22 nt, Homo sapiens
auagcuguugaauggaauauuc

SEQ ID NO: 211017 - RNA, 22 nt, Homo sapiens
auaggagcacaaacuauuguga

SEQ ID NO: 211018 - RNA, 22 nt, Homo sapiens
auaggagcacgaacucuagugu

SEQ ID NO: 211019 - RNA, 22 nt, Homo sapiens
auagugaacuuugugagaacaa

SEQ ID NO: 211020 - RNA, 22 nt, Homo sapiens
auagugcagugaugaaccuagg

SEQ ID NO: 211021 - RNA, 22 nt, Homo sapiens
auagugcugcaauaaccauggg

SEQ ID NO: 211022 - RNA, 22 nt, Homo sapiens
auagugcugcaauuaacauaca

SEQ ID NO: 211023 - RNA, 22 nt, Homo sapiens
auagugcugcagucaauguacg

SEQ ID NO: 211024 - RNA, 22 nt, Homo sapiens
auagugcugugaugaacauaca

SEQ ID NO: 211025 - RNA, 19 nt, Homo sapiens
auaguguaggaaaacagcu

SEQ ID NO: 211026 - RNA, 22 nt, Homo sapiens
auaucacagguguuuaccugau

SEQ ID NO: 211027 - RNA, 22 nt, Homo sapiens
auaucagugucuuacuguuuuu

SEQ ID NO: 211028 - RNA, 22 nt, Homo sapiens
auauccguacaguggaauauua

SEQ ID NO: 211029 - RNA, 22 nt, Homo sapiens
auaugcacaguggaguacuauu

SEQ ID NO: 211030 - RNA, 22 nt, Homo sapiens
auaugcacgugcauacacacuu

SEQ ID NO: 211031 - RNA, 20 nt, Homo sapiens
auaugcauguguuuucacuu

SEQ ID NO: 211032 - RNA, 22 nt, Homo sapiens
auaugccacugaacuguaccca

SEQ ID NO: 211033 - RNA, 22 nt, Homo sapiens
auaugcuuauuagcaagaaaua

SEQ ID NO: 211034 - RNA, 21 nt, Homo sapiens
auauggaacuggugacguguu

SEQ ID NO: 211035 - RNA, 19 nt, Homo sapiens
auaugggguuugaacugug

SEQ ID NO: 211036 - RNA, 22 nt, Homo sapiens
auaugguacuuaugcucaaacu

SEQ ID NO: 211037 - RNA, 22 nt, Homo sapiens
auaugguguuugcuauucagcu

SEQ ID NO: 211038 - RNA, 22 nt, Homo sapiens
auauguaguuucagaaguggaa

SEQ ID NO: 211039 - RNA, 22 nt, Homo sapiens
auaugucuauuauuagggcagg

SEQ ID NO: 211040 - RNA, 22 nt, Homo sapiens
auaugugacuucaugcaaggcu

SEQ ID NO: 211041 - RNA, 22 nt, Homo sapiens
auauuacuggccauaucgcagg

SEQ ID NO: 211042 - RNA, 22 nt, Homo sapiens
auauuagcacuaaugucacgau

SEQ ID NO: 211043 - RNA, 22 nt, Homo sapiens
auauucacagguaucagagauu

SEQ ID NO: 211044 - RNA, 22 nt, Homo sapiens
auauucacuauaugcagaacca

SEQ ID NO: 211045 - RNA, 22 nt, Homo sapiens
auauugcuccuaauaccacggu

SEQ ID NO: 211046 - RNA, 22 nt, Homo sapiens
aucaaacugcaaggcagcagca

SEQ ID NO: 211047 - RNA, 22 nt, Homo sapiens
aucaaagcagcauggcccaguc

SEQ ID NO: 211048 - RNA, 22 nt, Homo sapiens
aucaaaguaggcauauguuuuu

SEQ ID NO: 211049 - RNA, 22 nt, Homo sapiens
aucaagccaaagaaaguccuug

SEQ ID NO: 211050 - RNA, 22 nt, Homo sapiens
aucaagcuacacccuuuggaaa

SEQ ID NO: 211051 - RNA, 22 nt, Homo sapiens
aucaaguaaucugaguaagagu

SEQ ID NO: 211052 - RNA, 22 nt, Homo sapiens
aucaaguaguuauacguaaagg

SEQ ID NO: 211053 - RNA, 22 nt, Homo sapiens
aucacacucaccuucuguccuu

SEQ ID NO: 211054 - RNA, 22 nt, Homo sapiens
aucacacuguuauuuuaguuaa

SEQ ID NO: 211055 - RNA, 22 nt, Homo sapiens
aucacagauauggguuuaaauc

SEQ ID NO: 211056 - RNA, 22 nt, Homo sapiens
aucacagcuacuccucugucuu

SEQ ID NO: 211057 - RNA, 17 nt, Homo sapiens
gacgaucaucaggaggc

SEQ ID NO: 211058 - RNA, 22 nt, Homo sapiens
gacuagaaauuauuuagugagc

SEQ ID NO: 211059 - RNA, 22 nt, Homo sapiens
gacuaggagagcagcugcccau

SEQ ID NO: 211060 - RNA, 22 nt, Homo sapiens
gacucagucuuggauuuuuaau

SEQ ID NO: 211061 - RNA, 22 nt, Homo sapiens
gacucuguagacaaucacaucu

SEQ ID NO: 211062 - RNA, 22 nt, Homo sapiens
gacugaguaagcagaagcaauu

SEQ ID NO: 211063 - RNA, 18 nt, Homo sapiens
aaaaagugcucaggccua

SEQ ID NO: 211064 - RNA, 22 nt, Homo sapiens
aaaacgcauccucacaggucug

SEQ ID NO: 211065 - RNA, 22 nt, Homo sapiens
aaaagagcugagagguauucuu

SEQ ID NO: 211066 - RNA, 22 nt, Homo sapiens
aaaaggcuagcuaguaacagaa

SEQ ID NO: 211067 - RNA, 22 nt, Homo sapiens
aaaaugcugauauugggcccca

SEQ ID NO: 211068 - RNA, 22 nt, Homo sapiens
aaacaccacgcggucccucgga

SEQ ID NO: 211069 - RNA, 22 nt, Homo sapiens
aaacagucuucuccugagggac

SEQ ID NO: 211070 - RNA, 22 nt, Homo sapiens
aaacccauauaccagcugugcu

SEQ ID NO: 211071 - RNA, 22 nt, Homo sapiens
aaacucuguagcagagacagau

SEQ ID NO: 211072 - RNA, 20 nt, Homo sapiens
aaacucugucuucuuuauca

SEQ ID NO: 211073 - RNA, 22 nt, Homo sapiens
aaacugucuucugacaguuucc

SEQ ID NO: 211074 - RNA, 23 nt, Homo sapiens
aaagacuagucaggugcaguggu

SEQ ID NO: 211075 - RNA, 22 nt, Homo sapiens
aaagagaucuaugggcacuaug

SEQ ID NO: 211076 - RNA, 22 nt, Homo sapiens
aaagcacugaauaaauuugcuu

SEQ ID NO: 211077 - RNA, 22 nt, Homo sapiens
aaagcuaagguagcauuggaga

SEQ ID NO: 211078 - RNA, 22 nt, Homo sapiens
aaagcugucaaggcaggaggcu

SEQ ID NO: 211079 - RNA, 22 nt, Homo sapiens
aaaggcacugaucuuauccagu

SEQ ID NO: 211080 - RNA, 22 nt, Homo sapiens
aaaggcaucauuaguaccaagu

SEQ ID NO: 211081 - RNA, 22 nt, Homo sapiens
aaaggcaucugcucggcucccu

SEQ ID NO: 211082 - RNA, 22 nt, Homo sapiens
aaagggcuguuucuugacuugg

SEQ ID NO: 211083 - RNA, 22 nt, Homo sapiens
aaaguacucaguucaguuccgu

SEQ ID NO: 211084 - RNA, 22 nt, Homo sapiens
aaaguacugggauuggccgggu

SEQ ID NO: 211085 - RNA, 22 nt, Homo sapiens
aaagugaauguaucccguaagu

SEQ ID NO: 211086 - RNA, 22 nt, Homo sapiens
aaagugcugagacagacuggga

SEQ ID NO: 211087 - RNA, 22 nt, Homo sapiens
aaagugcugagucuaggcgggg

SEQ ID NO: 211088 - RNA, 22 nt, Homo sapiens
aaagugcugggauuaggccagg

SEQ ID NO: 211089 - RNA, 22 nt, Homo sapiens
aaagugucuguuccuagcauga

SEQ ID NO: 211090 - RNA, 22 nt, Homo sapiens
aaaguucugcguuagggcuaaa

SEQ ID NO: 211091 - RNA, 22 nt, Homo sapiens
aaauccaucucuuggggcauug

SEQ ID NO: 211092 - RNA, 22 nt, Homo sapiens
aaaugacuuuuuaugcagagua

SEQ ID NO: 211093 - RNA, 22 nt, Homo sapiens
aaaugcaccacucuggugcagg

SEQ ID NO: 211094 - RNA, 22 nt, Homo sapiens
aaaugcagauucugcuuagguu

SEQ ID NO: 211095 - RNA, 22 nt, Homo sapiens
aaaugcaugaggugggaagaaa

SEQ ID NO: 211096 - RNA, 22 nt, Homo sapiens
aaaugcauggacagcuggucuu

SEQ ID NO: 211097 - RNA, 22 nt, Homo sapiens
aaaugcucuuuaugaaguugga

SEQ ID NO: 211098 - RNA, 22 nt, Homo sapiens
aaaugcuuucuuggaccauuug

SEQ ID NO: 211099 - RNA, 22 nt, Homo sapiens
aaauggcaccggcucuucccuc

SEQ ID NO: 211100 - RNA, 22 nt, Homo sapiens
aaaugguguuaguagaucuuua

SEQ ID NO: 211101 - RNA, 21 nt, Homo sapiens
aaaugugcuuuaguacccuca

SEQ ID NO: 211102 - RNA, 22 nt, Homo sapiens
aaauucaucaaaugguuuguau

SEQ ID NO: 211103 - RNA, 22 nt, Homo sapiens
aaauucaugucaccucuaggua

SEQ ID NO: 211104 - RNA, 22 nt, Homo sapiens
aaauucauuucagcucugggua

SEQ ID NO: 211105 - RNA, 22 nt, Homo sapiens
aaauugcaguuaggaugauggu

SEQ ID NO: 211106 - RNA, 22 nt, Homo sapiens
aaauugcauugagcugcuuauu

SEQ ID NO: 211107 - RNA, 22 nt, Homo sapiens
aaauuguccuauugguuuaagc

SEQ ID NO: 211108 - RNA, 22 nt, Homo sapiens
aacaccauuuuucugcagccuu

SEQ ID NO: 211109 - RNA, 22 nt, Homo sapiens
aacacggcccgcagagcaagcu

SEQ ID NO: 211110 - RNA, 22 nt, Homo sapiens
aacacuaucugccuuacaggga

SEQ ID NO: 211111 - RNA, 22 nt, Homo sapiens
aacagauugcugagccccaccc

SEQ ID NO: 211112 - RNA, 22 nt, Homo sapiens
aacaggguguuugcaguuucuu

SEQ ID NO: 211113 - RNA, 22 nt, Homo sapiens
aacagucuccaguuguauccau

SEQ ID NO: 211114 - RNA, 22 nt, Homo sapiens
aacaguguuuuggguuuucugg

SEQ ID NO: 211115 - RNA, 22 nt, Homo sapiens
aacccugacacaagcagaauuu

SEQ ID NO: 211116 - RNA, 22 nt, Homo sapiens
aacccugagucaugagucuaga

SEQ ID NO: 211117 - RNA, 22 nt, Homo sapiens
aacucugucuccuucaaguuca

SEQ ID NO: 211118 - RNA, 22 nt, Homo sapiens
aacugcauuuucugauugugug

SEQ ID NO: 211119 - RNA, 22 nt, Homo sapiens
aacuggcauagccagacuucuc

SEQ ID NO: 211120 - RNA, 22 nt, Homo sapiens
aacuggcauaugaacuuguucu

SEQ ID NO: 211121 - RNA, 22 nt, Homo sapiens
aacuggcauguuuuaaggcuua

SEQ ID NO: 211122 - RNA, 21 nt, Homo sapiens
aacuggugugagaugguaugu

SEQ ID NO: 211123 - RNA, 22 nt, Homo sapiens
aacuugcacuugauugagagcu

SEQ ID NO: 211124 - RNA, 20 nt, Homo sapiens
aagacacuguccccacugga

SEQ ID NO: 211125 - RNA, 22 nt, Homo sapiens
aagaccuaugcaggaagaaaug

SEQ ID NO: 211126 - RNA, 22 nt, Homo sapiens
aagacuguaauccaucuugagu

SEQ ID NO: 211127 - RNA, 22 nt, Homo sapiens
aagagcauuauuuaguaauuuc

SEQ ID NO: 211128 - RNA, 22 nt, Homo sapiens
aagagcgcugauaacauguuug

SEQ ID NO: 211129 - RNA, 22 nt, Homo sapiens
aagagguagucugucccuuagc

SEQ ID NO: 211130 - RNA, 22 nt, Homo sapiens
aagaguaguaguggcacucucu

SEQ ID NO: 211131 - RNA, 22 nt, Homo sapiens
aagauaguaaacauuuucugcu

SEQ ID NO: 211132 - RNA, 19 nt, Homo sapiens
aagaugauguuugggcuaa

SEQ ID NO: 211133 - RNA, 22 nt, Homo sapiens
aagaugcagaagcccagauguu

SEQ ID NO: 211134 - RNA, 22 nt, Homo sapiens
aagcaaacaucagcuugguuaa

SEQ ID NO: 211135 - RNA, 22 nt, Homo sapiens
aagcacccagccucacgccugc

SEQ ID NO: 211136 - RNA, 22 nt, Homo sapiens
aagcaggugugggaggaaaugg

SEQ ID NO: 211137 - RNA, 22 nt, Homo sapiens
aagcaucacuggaggcagccau

SEQ ID NO: 211138 - RNA, 22 nt, Homo sapiens
aagcaucauuuggaauuugaga

SEQ ID NO: 211139 - RNA, 20 nt, Homo sapiens
aagcauggguuuuaggguca

SEQ ID NO: 211140 - RNA, 21 nt, Homo sapiens
aagcaugguguaucuuuccau

SEQ ID NO: 211141 - RNA, 22 nt, Homo sapiens
cauggguuuucucaaguaguca

SEQ ID NO: 211142 - RNA, 22 nt, Homo sapiens
cauguaguagaaggagccagac

SEQ ID NO: 211143 - RNA, 21 nt, Homo sapiens
caugucacugcacucuagccu

SEQ ID NO: 211144 - RNA, 22 nt, Homo sapiens
caugucacuuccucucugaugg

SEQ ID NO: 211145 - RNA, 19 nt, Homo sapiens
caugugcacuacuggcuuc

SEQ ID NO: 211146 - RNA, 22 nt, Homo sapiens
cauuaguugaagugcagggaga

SEQ ID NO: 211147 - RNA, 20 nt, Homo sapiens
cauuccacuuuccugucagu

SEQ ID NO: 211148 - RNA, 22 nt, Homo sapiens
cauugcaacuucugccucccag

SEQ ID NO: 211149 - RNA, 22 nt, Homo sapiens
cauugcacuccagcccuggcaa

SEQ ID NO: 211150 - RNA, 22 nt, Homo sapiens
cauugcacuccagccuggccaa

SEQ ID NO: 211151 - RNA, 22 nt, Homo sapiens
cauugcacuccagccuuggcaa

SEQ ID NO: 211152 - RNA, 22 nt, Homo sapiens
cauugcacuccagcucugggcg

SEQ ID NO: 211153 - RNA, 22 nt, Homo sapiens
cauugcacuccagcuugggcaa

SEQ ID NO: 211154 - RNA, 22 nt, Homo sapiens
cauugcacuccaucccgggaaa

SEQ ID NO: 211155 - RNA, 22 nt, Homo sapiens
cauugcacucuagccucggcaa

SEQ ID NO: 211156 - RNA, 22 nt, Homo sapiens
cauugcacugcauucugggcaa

SEQ ID NO: 211157 - RNA, 22 nt, Homo sapiens
cauugcacugcuucuugggugu

SEQ ID NO: 211158 - RNA, 22 nt, Homo sapiens
ugcuuguguucagguaaccuuu

SEQ ID NO: 211159 - RNA, 22 nt, Homo sapiens
uggaaaacaugcacauuggauu

SEQ ID NO: 211160 - RNA, 22 nt, Homo sapiens
uggaaaauuaggggagguuaua

SEQ ID NO: 211161 - RNA, 20 nt, Homo sapiens
uggaaaguaagucaugauau

SEQ ID NO: 211162 - RNA, 22 nt, Homo sapiens
uggaaauuaagucuuuccugag

SEQ ID NO: 211163 - RNA, 22 nt, Homo sapiens
uggaacacauaaauagcauagu

SEQ ID NO: 211164 - RNA, 22 nt, Homo sapiens
uggaacugauauugauggaaaa

SEQ ID NO: 211165 - RNA, 19 nt, Homo sapiens
uggaacugauucaguucug

SEQ ID NO: 211166 - RNA, 20 nt, Homo sapiens
uggaacuuaauugauggaca

SEQ ID NO: 211167 - RNA, 22 nt, Homo sapiens
uggaagacacauaccugauaac

SEQ ID NO: 211168 - RNA, 22 nt, Homo sapiens
uggaagacauuuuggaccuugg

SEQ ID NO: 211169 - RNA, 22 nt, Homo sapiens
uggaagacucuagucucuugag

SEQ ID NO: 211170 - RNA, 22 nt, Homo sapiens
uggaagcaugcaaucugugggg

SEQ ID NO: 211171 - RNA, 22 nt, Homo sapiens
uggaaggcuucauauguaaaga

SEQ ID NO: 211172 - RNA, 22 nt, Homo sapiens
uggaaguaaucaugagguagca

SEQ ID NO: 211173 - RNA, 22 nt, Homo sapiens
uggaaguauagauaauugaaag

SEQ ID NO: 211174 - RNA, 22 nt, Homo sapiens
uggaaguuaaaugacucuuucu

SEQ ID NO: 211175 - RNA, 22 nt, Homo sapiens
uggaaucuacuaaagcaaaauc

SEQ ID NO: 211176 - RNA, 22 nt, Homo sapiens
uggaaucuagagaaaugcaaac

SEQ ID NO: 211177 - RNA, 21 nt, Homo sapiens
uggaaucuauuauuccaguuu

SEQ ID NO: 211178 - RNA, 20 nt, Homo sapiens
uggaaucugaagaucucagu

SEQ ID NO: 211179 - RNA, 22 nt, Homo sapiens
uggaaucuuaggugaaggcuuu

SEQ ID NO: 211180 - RNA, 22 nt, Homo sapiens
uggaauguagcguugacacgag

SEQ ID NO: 211181 - RNA, 22 nt, Homo sapiens
uggaauguauaucguuuuuugu

SEQ ID NO: 211182 - RNA, 22 nt, Homo sapiens
uggaaugugaauaacuuccuuc

SEQ ID NO: 211183 - RNA, 21 nt, Homo sapiens
uggaauguucugacuucaggg

SEQ ID NO: 211184 - RNA, 22 nt, Homo sapiens
uggaauuaauccuccugguuuc

SEQ ID NO: 211185 - RNA, 21 nt, Homo sapiens
uggaauuaauggagagguguu

SEQ ID NO: 211186 - RNA, 22 nt, Homo sapiens
uggacaagauagguucuauauu

SEQ ID NO: 211187 - RNA, 22 nt, Homo sapiens
uggacacugguggauauggaau

SEQ ID NO: 211188 - RNA, 22 nt, Homo sapiens
uggacagaaacauguuuucagu

SEQ ID NO: 211189 - RNA, 22 nt, Homo sapiens
uggacagagagaccggcauuuu

SEQ ID NO: 211190 - RNA, 22 nt, Homo sapiens
uggacaugaagggcacaggagg

SEQ ID NO: 211191 - RNA, 20 nt, Homo sapiens
uggaccagagagguggggac

SEQ ID NO: 211192 - RNA, 22 nt, Homo sapiens
uggagacaaagauagaaaagca

SEQ ID NO: 211193 - RNA, 22 nt, Homo sapiens
uggagacugaucccucuuuccu

SEQ ID NO: 211194 - RNA, 22 nt, Homo sapiens
uggagagucauuuauaguauuu

SEQ ID NO: 211195 - RNA, 22 nt, Homo sapiens
uggagagugauaaguaaaugga

SEQ ID NO: 211196 - RNA, 19 nt, Homo sapiens
uggagauauccccuucaca

SEQ ID NO: 211197 - RNA, 22 nt, Homo sapiens
uggagcaaaguugaggccaagc

SEQ ID NO: 211198 - RNA, 22 nt, Homo sapiens
uggaggacugcagaacugaggc

SEQ ID NO: 211199 - RNA, 22 nt, Homo sapiens
uggagguaggacgaagaacucu

SEQ ID NO: 211200 - RNA, 22 nt, Homo sapiens
uggagguaggugauauguagca

SEQ ID NO: 211201 - RNA, 22 nt, Homo sapiens
uggaguaggccuaagaaugaca

SEQ ID NO: 211202 - RNA, 22 nt, Homo sapiens
uggaguguaauuagccaucagu

SEQ ID NO: 211203 - RNA, 22 nt, Homo sapiens
uggaguguagaagccagccucc

SEQ ID NO: 211204 - RNA, 22 nt, Homo sapiens
uggauagaacuaagugcuuaga

SEQ ID NO: 211205 - RNA, 18 nt, Homo sapiens
uggauaugaaauucugga

SEQ ID NO: 211206 - RNA, 22 nt, Homo sapiens
uggaugaagagaugguaguugc

SEQ ID NO: 211207 - RNA, 22 nt, Homo sapiens
uggaugacauccuuguaugcag

SEQ ID NO: 211208 - RNA, 19 nt, Homo sapiens
uggaugacugucugggucu

SEQ ID NO: 211209 - RNA, 22 nt, Homo sapiens
uggaugacuguuauaugcauau

SEQ ID NO: 211210 - RNA, 21 nt, Homo sapiens
uggauugagaaccccaggagg

SEQ ID NO: 211211 - RNA, 22 nt, Homo sapiens
uggcaaagugugacgugggggu

SEQ ID NO: 211212 - RNA, 22 nt, Homo sapiens
uggcaaauuccaaaguuaauuc

SEQ ID NO: 211213 - RNA, 22 nt, Homo sapiens
uggcaacaucuggggacauguu

SEQ ID NO: 211214 - RNA, 22 nt, Homo sapiens
uggcaacuugcaaccucauucu

SEQ ID NO: 211215 - RNA, 22 nt, Homo sapiens
uggcaagaacaacaauuacuuu

SEQ ID NO: 211216 - RNA, 22 nt, Homo sapiens
uggcaagagauaugugucuaua

SEQ ID NO: 211217 - RNA, 22 nt, Homo sapiens
uggcaagagcaaaauguacagu

SEQ ID NO: 211218 - RNA, 22 nt, Homo sapiens
uggcaagagggaugcaagguuu

SEQ ID NO: 211219 - RNA, 20 nt, Homo sapiens
uggcaagauggcagaauaga

SEQ ID NO: 211220 - RNA, 22 nt, Homo sapiens
uggcaagauuguuccgguuugg

SEQ ID NO: 211221 - RNA, 18 nt, Homo sapiens
uggcaagugccauacggu

SEQ ID NO: 211222 - RNA, 22 nt, Homo sapiens
uggcaaguuucaauccgaggga

SEQ ID NO: 211223 - RNA, 22 nt, Homo sapiens
uggcaauaaggacuccuuaggu

SEQ ID NO: 211224 - RNA, 22 nt, Homo sapiens
uggcacaaugacccuugugggc

SEQ ID NO: 211225 - RNA, 19 nt, Homo sapiens
uggcacauguauacauaug

SEQ ID NO: 211226 - RNA, 22 nt, Homo sapiens
uggcaccugacuccgagaugca

SEQ ID NO: 211227 - RNA, 22 nt, Homo sapiens
uggcacuaugugacaagguuuu

SEQ ID NO: 211228 - RNA, 22 nt, Homo sapiens
uggcagauaggauacaggacua

SEQ ID NO: 211229 - RNA, 22 nt, Homo sapiens
uggcagaugcucuuggugccca

SEQ ID NO: 211230 - RNA, 22 nt, Homo sapiens
uggcagaugggugagcuggaga

SEQ ID NO: 211231 - RNA, 22 nt, Homo sapiens
uggcagcgcaguugaaaaagaa

SEQ ID NO: 211232 - RNA, 22 nt, Homo sapiens
uggcaguuuuaugugguucaac

SEQ ID NO: 211233 - RNA, 22 nt, Homo sapiens
uggcaugauguguucauugaaa

SEQ ID NO: 211234 - RNA, 22 nt, Homo sapiens
uggcaugggguaguagcgcugg

SEQ ID NO: 211235 - RNA, 22 nt, Homo sapiens
uggcauguaaugcagaaguugc

SEQ ID NO: 211236 - RNA, 22 nt, Homo sapiens
uggcaugugugaagugcccagc

SEQ ID NO: 211237 - RNA, 22 nt, Homo sapiens
uggcauuguccaauaaaauuuu

SEQ ID NO: 211238 - RNA, 22 nt, Homo sapiens
uggcauuuugugugaauuagaa

SEQ ID NO: 211239 - RNA, 22 nt, Homo sapiens
uggccagugucggaggccagga

SEQ ID NO: 211240 - RNA, 22 nt, Homo sapiens
uggcgagaaucacauucuaauu

SEQ ID NO: 211241 - RNA, 22 nt, Homo sapiens
uggcggagacauggacuucaga

SEQ ID NO: 211242 - RNA, 22 nt, Homo sapiens
uggcuaagaugcacacuucacu

SEQ ID NO: 211243 - RNA, 22 nt, Homo sapiens
acaguagugggcuacagaauca

SEQ ID NO: 211244 - RNA, 22 nt, Homo sapiens
acagugcuucugauaugaugcc

SEQ ID NO: 211245 - RNA, 19 nt, Homo sapiens
acagugcuuugucagaagc

SEQ ID NO: 211246 - RNA, 22 nt, Homo sapiens
acaguguacaauagccuuuuaa

SEQ ID NO: 211247 - RNA, 17 nt, Homo sapiens
acagugucuaugaaaug

SEQ ID NO: 211248 - RNA, 19 nt, Homo sapiens
acagugucucuauaaugau

SEQ ID NO: 211249 - RNA, 22 nt, Homo sapiens
acaguguuacuugauaguguau

SEQ ID NO: 211250 - RNA, 22 nt, Homo sapiens
acaguguuccuuuguugugacu

SEQ ID NO: 211251 - RNA, 22 nt, Homo sapiens
acauaguagacacugaaaauau

SEQ ID NO: 211252 - RNA, 22 nt, Homo sapiens
acaucacuguuugauugauuga

SEQ ID NO: 211253 - RNA, 22 nt, Homo sapiens
acaucccuuucccacccuucac

SEQ ID NO: 211254 - RNA, 22 nt, Homo sapiens
acaugacauugggguggggaua

SEQ ID NO: 211255 - RNA, 22 nt, Homo sapiens
acaugcauauguuggaagaaag

SEQ ID NO: 211256 - RNA, 22 nt, Homo sapiens
acaugcauggcaugcauuguac

SEQ ID NO: 211257 - RNA, 22 nt, Homo sapiens
acaugccucccugguccgcugu

SEQ ID NO: 211258 - RNA, 19 nt, Homo sapiens
acauggauuuugugcaaac

SEQ ID NO: 211259 - RNA, 22 nt, Homo sapiens
accaccacucccgcauucuaaa

SEQ ID NO: 211260 - RNA, 22 nt, Homo sapiens
cauugcaguaagagugggcucu

SEQ ID NO: 211261 - RNA, 22 nt, Homo sapiens
cauugcaugcauauggcuuggu

SEQ ID NO: 211262 - RNA, 22 nt, Homo sapiens
cauugcaugccagccugggcaa

SEQ ID NO: 211263 - RNA, 22 nt, Homo sapiens
cauugcuaaaagucauauauaa

SEQ ID NO: 211264 - RNA, 22 nt, Homo sapiens
cauugguuuuucaggaguauau

SEQ ID NO: 211265 - RNA, 22 nt, Homo sapiens
cauuugcacugagacucagcuu

SEQ ID NO: 211266 - RNA, 22 nt, Homo sapiens
ccaagugcuuaaaauuucauuu

SEQ ID NO: 211267 - RNA, 22 nt, Homo sapiens
ccacaaccuccauauccugggu

SEQ ID NO: 211268 - RNA, 23 nt, Homo sapiens
ccacaaugguugaacuagauuac

SEQ ID NO: 211269 - RNA, 22 nt, Homo sapiens
ccacaguggauuaaaguuacug

SEQ ID NO: 211270 - RNA, 22 nt, Homo sapiens
ccacaguugaaauuuugacugu

SEQ ID NO: 211271 - RNA, 22 nt, Homo sapiens
ccacccuuccacacccugggua

SEQ ID NO: 211272 - RNA, 22 nt, Homo sapiens
ccacugggcaguuuauuaucag

SEQ ID NO: 211273 - RNA, 22 nt, Homo sapiens
ccacuguuuaaauggcugagga

SEQ ID NO: 211274 - RNA, 22 nt, Homo sapiens
ccagaguugccucagguuucug

SEQ ID NO: 211275 - RNA, 22 nt, Homo sapiens
ccagauguuuucauucagcaag

SEQ ID NO: 211276 - RNA, 22 nt, Homo sapiens
ccagucuuggugucuguagcac

SEQ ID NO: 211277 - RNA, 22 nt, Homo sapiens
ccagugaacugcaagguuuuuc

SEQ ID NO: 211278 - RNA, 17 nt, Homo sapiens
ccagugaucccuuuugu

SEQ ID NO: 211279 - RNA, 22 nt, Homo sapiens
ccagugauuguauggugaaggu

SEQ ID NO: 211280 - RNA, 18 nt, Homo sapiens
ccagugcaaggaaagccc

SEQ ID NO: 211281 - RNA, 22 nt, Homo sapiens
ccagugcauggaucccaggggg

SEQ ID NO: 211282 - RNA, 21 nt, Homo sapiens
ccagugguuggaaacuauggg

SEQ ID NO: 211283 - RNA, 22 nt, Homo sapiens
ccaguuuucucacuguugcagu

SEQ ID NO: 211284 - RNA, 22 nt, Homo sapiens
ccauacugucaaauagauuucc

SEQ ID NO: 211285 - RNA, 22 nt, Homo sapiens
ccauugcacuccagccucggca

SEQ ID NO: 211286 - RNA, 22 nt, Homo sapiens
ccauugcacuucagccuaggug

SEQ ID NO: 211287 - RNA, 22 nt, Homo sapiens
ccauuucacucuuccugaagga

SEQ ID NO: 211288 - RNA, 22 nt, Homo sapiens
cccagaguucuuaaauacugag

SEQ ID NO: 211289 - RNA, 21 nt, Homo sapiens
cccagguucucugaggguaga

SEQ ID NO: 211290 - RNA, 22 nt, Homo sapiens
cccaguuuugccacuuacuagc

SEQ ID NO: 211291 - RNA, 20 nt, Homo sapiens
ccccuggaguggggcugcuu

SEQ ID NO: 211292 - RNA, 22 nt, Homo sapiens
cccugagagcagggucuuucuc

SEQ ID NO: 211293 - RNA, 22 nt, Homo sapiens
cccugagaugugaauuucagag

SEQ ID NO: 211294 - RNA, 22 nt, Homo sapiens
cccuguguuguucaaggaucug

SEQ ID NO: 211295 - RNA, 22 nt, Homo sapiens
cccuucauucaaggguugugag

SEQ ID NO: 211296 - RNA, 22 nt, Homo sapiens
ccuaggcacugggguccagccc

SEQ ID NO: 211297 - RNA, 19 nt, Homo sapiens
ccucaaguacuaauauguu

SEQ ID NO: 211298 - RNA, 22 nt, Homo sapiens
ccucauggagaaccucugcuag

SEQ ID NO: 211299 - RNA, 21 nt, Homo sapiens
ccuccauuuguauucuugccc

SEQ ID NO: 211300 - RNA, 22 nt, Homo sapiens
ccucuguaguccugcaagagga

SEQ ID NO: 211301 - RNA, 21 nt, Homo sapiens
ccugaagaagugaccucugag

SEQ ID NO: 211302 - RNA, 22 nt, Homo sapiens
ccugucuugaagagauccuccu

SEQ ID NO: 211303 - RNA, 22 nt, Homo sapiens
ccuucacaggcacugguucaga

SEQ ID NO: 211304 - RNA, 22 nt, Homo sapiens
ccuucauugcaucuuuaagaga

SEQ ID NO: 211305 - RNA, 22 nt, Homo sapiens
ccuugcacuucccaagugaggc

SEQ ID NO: 211306 - RNA, 22 nt, Homo sapiens
ccuugguggccacaagacauug

SEQ ID NO: 211307 - RNA, 22 nt, Homo sapiens
ccuugguugugcuucaacuucu

SEQ ID NO: 211308 - RNA, 22 nt, Homo sapiens
cgcaguguuugugucccugggu

SEQ ID NO: 211309 - RNA, 22 nt, Homo sapiens
cggcaguggguaagccaagcuu

SEQ ID NO: 211310 - RNA, 22 nt, Homo sapiens
cggugcaauucuccugucucag

SEQ ID NO: 211311 - RNA, 22 nt, Homo sapiens
cuaaagugcugagauuauaggu

SEQ ID NO: 211312 - RNA, 22 nt, Homo sapiens
cuaaagugcuuaaaaucucauu

SEQ ID NO: 211313 - RNA, 22 nt, Homo sapiens
cuaacuaugucucaggaugucc

SEQ ID NO: 211314 - RNA, 22 nt, Homo sapiens
cuaagcaccuuaguggggaauc

SEQ ID NO: 211315 - RNA, 22 nt, Homo sapiens
cuaaggcaguagccugaauaau

SEQ ID NO: 211316 - RNA, 20 nt, Homo sapiens
cuaaucaucccagaagaaau

SEQ ID NO: 211317 - RNA, 22 nt, Homo sapiens
cuaauucuguaccuggcacaua

SEQ ID NO: 211318 - RNA, 22 nt, Homo sapiens
cuacacaugcaggcucccugcc

SEQ ID NO: 211319 - RNA, 23 nt, Homo sapiens
cuacagugccugucucuuuggcc

SEQ ID NO: 211320 - RNA, 22 nt, Homo sapiens
cuacaguuauguuuuaaaugug

SEQ ID NO: 211321 - RNA, 22 nt, Homo sapiens
cuacaguucucaggaguuggcc

SEQ ID NO: 211322 - RNA, 22 nt, Homo sapiens
cuacucuggagagugacaauca

SEQ ID NO: 211323 - RNA, 22 nt, Homo sapiens
cuacugcacaucaucugaguua

SEQ ID NO: 211324 - RNA, 22 nt, Homo sapiens
cuagaagcauauucagaacaga

SEQ ID NO: 211325 - RNA, 22 nt, Homo sapiens
cuagaagguaagagcuggaugc

SEQ ID NO: 211326 - RNA, 22 nt, Homo sapiens
cuagaauguauaaaaccaagcu

SEQ ID NO: 211327 - RNA, 22 nt, Homo sapiens
cuagcagcauaagaaucaccaa

SEQ ID NO: 211328 - RNA, 22 nt, Homo sapiens
cuagcagcaugagaauggacca

SEQ ID NO: 211329 - RNA, 22 nt, Homo sapiens
cuagccuggagugcaguggugc

SEQ ID NO: 211330 - RNA, 22 nt, Homo sapiens
cuagcuuuuuaugacaaucuug

SEQ ID NO: 211331 - RNA, 22 nt, Homo sapiens
cuaggcacgccugggucuccag

SEQ ID NO: 211332 - RNA, 22 nt, Homo sapiens
cuaggcuguagagaaguucagu

SEQ ID NO: 211333 - RNA, 22 nt, Homo sapiens
cuagguagcuuuucugucaugu

SEQ ID NO: 211334 - RNA, 22 nt, Homo sapiens
cuauauacugccugcugauuag

SEQ ID NO: 211335 - RNA, 22 nt, Homo sapiens
cuaucucaggcccaggcccuug

SEQ ID NO: 211336 - RNA, 19 nt, Homo sapiens
cuaugaccaugugauuuuu

SEQ ID NO: 211337 - RNA, 22 nt, Homo sapiens
cuaugcauuuuggaggagggaa

SEQ ID NO: 211338 - RNA, 22 nt, Homo sapiens
cuauguaccuggaacuguauua

SEQ ID NO: 211339 - RNA, 22 nt, Homo sapiens
cuaugucuuucauauuuugggg

SEQ ID NO: 211340 - RNA, 19 nt, Homo sapiens
cuauugcacauagcugaag

SEQ ID NO: 211341 - RNA, 22 nt, Homo sapiens
cuauuugguuggugaaaaaagu

SEQ ID NO: 211342 - RNA, 22 nt, Homo sapiens
cucaaaguguggucuguggguu

SEQ ID NO: 211343 - RNA, 18 nt, Homo sapiens
cucaaccucaugcagggc

SEQ ID NO: 211344 - RNA, 22 nt, Homo sapiens
cucaaguagugguuuucauuga

SEQ ID NO: 211345 - RNA, 22 nt, Homo sapiens
ugugcacauaacauuuuuuuag

SEQ ID NO: 211346 - RNA, 22 nt, Homo sapiens
ugugcacaugauauaucacaua

SEQ ID NO: 211347 - RNA, 22 nt, Homo sapiens
ugugcaccucuucacacaggga

SEQ ID NO: 211348 - RNA, 22 nt, Homo sapiens
ugugcauagugugugcggggcg

SEQ ID NO: 211349 - RNA, 22 nt, Homo sapiens
ugugcauauaaguguguauaua

SEQ ID NO: 211350 - RNA, 22 nt, Homo sapiens
ugugcaugacagcauacaaacg

SEQ ID NO: 211351 - RNA, 22 nt, Homo sapiens
ugugccaaucauagggcuuggu

SEQ ID NO: 211352 - RNA, 22 nt, Homo sapiens
ugugccacuccaaccuggguga

SEQ ID NO: 211353 - RNA, 22 nt, Homo sapiens
ugugccacuccagcucuagcuu

SEQ ID NO: 211354 - RNA, 22 nt, Homo sapiens
ugugccacugcacucugggcaa

SEQ ID NO: 211355 - RNA, 22 nt, Homo sapiens
ugugccacuguucuguaaagug

SEQ ID NO: 211356 - RNA, 22 nt, Homo sapiens
ugugccuacugugggagcguca

SEQ ID NO: 211357 - RNA, 22 nt, Homo sapiens
ugugcucaucucagucaacugu

SEQ ID NO: 211358 - RNA, 22 nt, Homo sapiens
uguggaaauaaaagaaagguua

SEQ ID NO: 211359 - RNA, 20 nt, Homo sapiens
uguggcacuguaucucucag

SEQ ID NO: 211360 - RNA, 22 nt, Homo sapiens
accauugcacuccaaccugggc

SEQ ID NO: 211361 - RNA, 22 nt, Homo sapiens
accauugcacuccuuucugggc

SEQ ID NO: 211362 - RNA, 22 nt, Homo sapiens
acccacuagaugccaguggcac

SEQ ID NO: 211363 - RNA, 22 nt, Homo sapiens
acccagaauucagucuuaggcc

SEQ ID NO: 211364 - RNA, 22 nt, Homo sapiens
acccagaguuccuugucuuuca

SEQ ID NO: 211365 - RNA, 22 nt, Homo sapiens
acccaguagccagauguagcug

SEQ ID NO: 211366 - RNA, 21 nt, Homo sapiens
acccccacaccuccuuaguuc

SEQ ID NO: 211367 - RNA, 22 nt, Homo sapiens
accccgagacugccaagaaucc

SEQ ID NO: 211368 - RNA, 22 nt, Homo sapiens
accccuuacaucagcucuggua

SEQ ID NO: 211369 - RNA, 22 nt, Homo sapiens
acccugaagccaugaguggaac

SEQ ID NO: 211370 - RNA, 22 nt, Homo sapiens
acccuggagagugcuguaguaa

SEQ ID NO: 211371 - RNA, 22 nt, Homo sapiens
acccugucauccacauggugcu

SEQ ID NO: 211372 - RNA, 22 nt, Homo sapiens
acgcagcacauucacagcuaug

SEQ ID NO: 211373 - RNA, 22 nt, Homo sapiens
acuacaugugaugucaguauau

SEQ ID NO: 211374 - RNA, 22 nt, Homo sapiens
acuacuucuaaguuuuggaaga

SEQ ID NO: 211375 - RNA, 22 nt, Homo sapiens
acucagagagaacugucauuug

SEQ ID NO: 211376 - RNA, 22 nt, Homo sapiens
acucauugcucauaccuuaucu

SEQ ID NO: 211377 - RNA, 22 nt, Homo sapiens
acuccauuuccagagcagcccc

SEQ ID NO: 211378 - RNA, 22 nt, Homo sapiens
acucugucuaguuguaaaauuu

SEQ ID NO: 211379 - RNA, 22 nt, Homo sapiens
acugaauguaaacacggagugu

SEQ ID NO: 211380 - RNA, 22 nt, Homo sapiens
acugagacugagaauguuucuu

SEQ ID NO: 211381 - RNA, 22 nt, Homo sapiens
acugaguguugauuuagauuaa

SEQ ID NO: 211382 - RNA, 22 nt, Homo sapiens
acugaucaauguuaaggcuuau

SEQ ID NO: 211383 - RNA, 23 nt, Homo sapiens
acugcaauuacguuugcaccaac

SEQ ID NO: 211384 - RNA, 22 nt, Homo sapiens
acugcacuccagccucccgucu

SEQ ID NO: 211385 - RNA, 22 nt, Homo sapiens
acugcacuccagccugaugaaa

SEQ ID NO: 211386 - RNA, 22 nt, Homo sapiens
acugcacuccagccugcugaca

SEQ ID NO: 211387 - RNA, 22 nt, Homo sapiens
acugcacuccagccugcugggu

SEQ ID NO: 211388 - RNA, 22 nt, Homo sapiens
acugcacuccagccugugagac

SEQ ID NO: 211389 - RNA, 22 nt, Homo sapiens
acugcacuccagccuuagugac

SEQ ID NO: 211390 - RNA, 22 nt, Homo sapiens
acugcacuccagccuuggcggc

SEQ ID NO: 211391 - RNA, 20 nt, Homo sapiens
acugcacuccagucucuggg

SEQ ID NO: 211392 - RNA, 22 nt, Homo sapiens
acugcacuccaguuccgggcaa

SEQ ID NO: 211393 - RNA, 22 nt, Homo sapiens
acugcacuccaucuuagguggc

SEQ ID NO: 211394 - RNA, 22 nt, Homo sapiens
acugcacucuagcuugggugac

SEQ ID NO: 211395 - RNA, 22 nt, Homo sapiens
acugcacuuauccuccaauguu

SEQ ID NO: 211396 - RNA, 22 nt, Homo sapiens
acugcacuucagccuguugaca

SEQ ID NO: 211397 - RNA, 22 nt, Homo sapiens
acugcacuucagccuugugaca

SEQ ID NO: 211398 - RNA, 22 nt, Homo sapiens
acugcauuugguaaagucaaga

SEQ ID NO: 211399 - RNA, 22 nt, Homo sapiens
acugcauuugucccuuuugaac

SEQ ID NO: 211400 - RNA, 21 nt, Homo sapiens
acuggaccccuuccauacacc

SEQ ID NO: 211401 - RNA, 22 nt, Homo sapiens
acuggacuuaaugaugaauugu

SEQ ID NO: 211402 - RNA, 22 nt, Homo sapiens
acuggauguuagggauuuuauu

SEQ ID NO: 211403 - RNA, 20 nt, Homo sapiens
acuggcacugguaggugugg

SEQ ID NO: 211404 - RNA, 22 nt, Homo sapiens
acuggcuguuaggaauuaccuc

SEQ ID NO: 211405 - RNA, 22 nt, Homo sapiens
acuggcuuuugagaaaaacacu

SEQ ID NO: 211406 - RNA, 22 nt, Homo sapiens
acugggauauuauugguaauau

SEQ ID NO: 211407 - RNA, 20 nt, Homo sapiens
acugggcuaccgaaguaagg

SEQ ID NO: 211408 - RNA, 22 nt, Homo sapiens
acugguguaugggaggucccaa

SEQ ID NO: 211409 - RNA, 22 nt, Homo sapiens
acuguacuccagccugggugac

SEQ ID NO: 211410 - RNA, 22 nt, Homo sapiens
acuguacucuacccugggcaac

SEQ ID NO: 211411 - RNA, 22 nt, Homo sapiens
acuuggcaaaguuuuaaacagc

SEQ ID NO: 211412 - RNA, 19 nt, Homo sapiens
acuuuggugauuagaggga

SEQ ID NO: 211413 - RNA, 21 nt, Homo sapiens
acuuuguugggggcugaggca

SEQ ID NO: 211414 - RNA, 21 nt, Homo sapiens
agaaaaucuuaugggaaacau

SEQ ID NO: 211415 - RNA, 22 nt, Homo sapiens
agaaacacagguggaauugcuu

SEQ ID NO: 211416 - RNA, 22 nt, Homo sapiens
agaaauguuuauucaaacccgu

SEQ ID NO: 211417 - RNA, 22 nt, Homo sapiens
agaaccaaucccacauggauac

SEQ ID NO: 211418 - RNA, 19 nt, Homo sapiens
agaagugcauggucuagag

SEQ ID NO: 211419 - RNA, 22 nt, Homo sapiens
agaauguuuuagaccaauacaa

SEQ ID NO: 211420 - RNA, 22 nt, Homo sapiens
agacagcuggaguaucauagcu

SEQ ID NO: 211421 - RNA, 22 nt, Homo sapiens
agacagcugggaaauggagugu

SEQ ID NO: 211422 - RNA, 22 nt, Homo sapiens
agacagcugguagcacuuccug

SEQ ID NO: 211423 - RNA, 22 nt, Homo sapiens
agacaucauuugauggugggag

SEQ ID NO: 211424 - RNA, 22 nt, Homo sapiens
agaccacuuuagagauuguuca

SEQ ID NO: 211425 - RNA, 21 nt, Homo sapiens
agagaacugaaacaugugacu

SEQ ID NO: 211426 - RNA, 22 nt, Homo sapiens
agagauaauuagguuaaaugag

SEQ ID NO: 211427 - RNA, 22 nt, Homo sapiens
agagaucaacugaauuacugga

SEQ ID NO: 211428 - RNA, 22 nt, Homo sapiens
agaggucuuaucaaacaugcuu

SEQ ID NO: 211429 - RNA, 22 nt, Homo sapiens
agagguuuugcccucgagauaa

SEQ ID NO: 211430 - RNA, 22 nt, Homo sapiens
agagugaagcuuuuuauauucu

SEQ ID NO: 211431 - RNA, 22 nt, Homo sapiens
agagugcaauggcaccaucucg

SEQ ID NO: 211432 - RNA, 22 nt, Homo sapiens
agagugcuuuauuagauguagc

SEQ ID NO: 211433 - RNA, 22 nt, Homo sapiens
agauauguuuaguuucaaaaug

SEQ ID NO: 211434 - RNA, 22 nt, Homo sapiens
agaucacucagguuucucccug

SEQ ID NO: 211435 - RNA, 22 nt, Homo sapiens
agaugauguuuacugagcauca

SEQ ID NO: 211436 - RNA, 18 nt, Homo sapiens
agaugcaugcucacuaca

SEQ ID NO: 211437 - RNA, 22 nt, Homo sapiens
agaugcauugguggcauauuca

SEQ ID NO: 211438 - RNA, 23 nt, Homo sapiens
agauggcauuucaguucuuuagg

SEQ ID NO: 211439 - RNA, 22 nt, Homo sapiens
agauggugugcuaggaaaugua

SEQ ID NO: 211440 - RNA, 22 nt, Homo sapiens
agaugguguuggcugaguguau

SEQ ID NO: 211441 - RNA, 22 nt, Homo sapiens
agauguuguucaucugauuguu

SEQ ID NO: 211442 - RNA, 22 nt, Homo sapiens
agcaagaaugaacucucccaga

SEQ ID NO: 211443 - RNA, 22 nt, Homo sapiens
agcaagacauggcuuccaaaug

SEQ ID NO: 211444 - RNA, 22 nt, Homo sapiens
agcaagauccagucgcacagga

SEQ ID NO: 211445 - RNA, 22 nt, Homo sapiens
agcaagaugaaguugagcuagg

SEQ ID NO: 211446 - RNA, 22 nt, Homo sapiens
agcaagauuguucccauuuucu

SEQ ID NO: 211447 - RNA, 22 nt, Homo sapiens
augccagggagaauuguucaag

SEQ ID NO: 211448 - RNA, 22 nt, Homo sapiens
augccauugcacuccagccuag

SEQ ID NO: 211449 - RNA, 22 nt, Homo sapiens
augccauugcacuccagccugg

SEQ ID NO: 211450 - RNA, 19 nt, Homo sapiens
augccucaguuuuguacuu

SEQ ID NO: 211451 - RNA, 22 nt, Homo sapiens
augcuacauucuacaauuaggc

SEQ ID NO: 211452 - RNA, 22 nt, Homo sapiens
auggaaacauaagaguauagau

SEQ ID NO: 211453 - RNA, 21 nt, Homo sapiens
auggaaagacugccucuucaa

SEQ ID NO: 211454 - RNA, 22 nt, Homo sapiens
auggaaaugaagggcuggcccu

SEQ ID NO: 211455 - RNA, 22 nt, Homo sapiens
auggaacauaacuauuugggga

SEQ ID NO: 211456 - RNA, 22 nt, Homo sapiens
auggaacuggagaucauuaugu

SEQ ID NO: 211457 - RNA, 20 nt, Homo sapiens
auggaacugugagccaauua

SEQ ID NO: 211458 - RNA, 22 nt, Homo sapiens
auggaagucucuguuaaguuuc

SEQ ID NO: 211459 - RNA, 21 nt, Homo sapiens
auggacaugguuaggcuuugu

SEQ ID NO: 211460 - RNA, 20 nt, Homo sapiens
auggaccuggauuaacagca

SEQ ID NO: 211461 - RNA, 22 nt, Homo sapiens
auggagagaauuauucucucag

SEQ ID NO: 211462 - RNA, 22 nt, Homo sapiens
uucuuuggaaacaguacuaauu

SEQ ID NO: 211463 - RNA, 22 nt, Homo sapiens
uucuuugguacaagggccgacc

SEQ ID NO: 211464 - RNA, 22 nt, Homo sapiens
uugaaaguaaacaucacaaaga

SEQ ID NO: 211465 - RNA, 22 nt, Homo sapiens
uugaacuguaagggucugugug

SEQ ID NO: 211466 - RNA, 22 nt, Homo sapiens
uugaagacuaaguuaucaggau

SEQ ID NO: 211467 - RNA, 22 nt, Homo sapiens
uugaaggaggugcucacucucg

SEQ ID NO: 211468 - RNA, 22 nt, Homo sapiens
uugaaguaguacuuuauuauag

SEQ ID NO: 211469 - RNA, 22 nt, Homo sapiens
uugaauaggcucaugcuuauca

SEQ ID NO: 211470 - RNA, 18 nt, Homo sapiens
uugaauaguguccaaucu

SEQ ID NO: 211471 - RNA, 17 nt, Homo sapiens
uugaaugcauuacuugg

SEQ ID NO: 211472 - RNA, 18 nt, Homo sapiens
uugaaugcgucccagaga

SEQ ID NO: 211473 - RNA, 23 nt, Homo sapiens
uugaauguuuccccucccaaauu

SEQ ID NO: 211474 - RNA, 22 nt, Homo sapiens
uugacaaugcacugugcuaagu

SEQ ID NO: 211475 - RNA, 22 nt, Homo sapiens
uugacauaaucauuucacagug

SEQ ID NO: 211476 - RNA, 22 nt, Homo sapiens
uugacuuuuaggaggaaaauga

SEQ ID NO: 211477 - RNA, 22 nt, Homo sapiens
uugagacggaguuuugcucuug

SEQ ID NO: 211478 - RNA, 22 nt, Homo sapiens
uugagacugaacauuuguguac

SEQ ID NO: 211479 - RNA, 22 nt, Homo sapiens
uugagaguggaggcuauaucuu

SEQ ID NO: 211480 - RNA, 22 nt, Homo sapiens
uugagaugaagucuugcucucu

SEQ ID NO: 211481 - RNA, 22 nt, Homo sapiens
uugagaugaaguuuugcucuuu

SEQ ID NO: 211482 - RNA, 22 nt, Homo sapiens
uugagauggagucucacuccuu

SEQ ID NO: 211483 - RNA, 22 nt, Homo sapiens
uugagauggagucucacucuug

SEQ ID NO: 211484 - RNA, 22 nt, Homo sapiens
uugagauggagucucacugugu

SEQ ID NO: 211485 - RNA, 22 nt, Homo sapiens
uugagauggagucucgcugugu

SEQ ID NO: 211486 - RNA, 22 nt, Homo sapiens
uugagauggagucuugcucucu

SEQ ID NO: 211487 - RNA, 22 nt, Homo sapiens
uugagauggagucuugcucuug

SEQ ID NO: 211488 - RNA, 22 nt, Homo sapiens
uugagauggaguguugcucugu

SEQ ID NO: 211489 - RNA, 22 nt, Homo sapiens
uugagauggaguuucaauauug

SEQ ID NO: 211490 - RNA, 22 nt, Homo sapiens
uugagauggaguuucacucucg

SEQ ID NO: 211491 - RNA, 22 nt, Homo sapiens
uugagauggaguuucacucuug

SEQ ID NO: 211492 - RNA, 22 nt, Homo sapiens
uugagauggaguuucgcucuug

SEQ ID NO: 211493 - RNA, 22 nt, Homo sapiens
uugagauggaguuuugcucuug

SEQ ID NO: 211494 - RNA, 22 nt, Homo sapiens
uugagcaauccuccugccaugu

SEQ ID NO: 211495 - RNA, 22 nt, Homo sapiens
uugagcacaggaguuugagacc

SEQ ID NO: 211496 - RNA, 22 nt, Homo sapiens
uugagcacugucugugugcagu

SEQ ID NO: 211497 - RNA, 22 nt, Homo sapiens
uugagcaucauguuagcacuca

SEQ ID NO: 211498 - RNA, 22 nt, Homo sapiens
uugagccaaggauugucuuucc

SEQ ID NO: 211499 - RNA, 22 nt, Homo sapiens
uugagcccuggaggcagaggcu

SEQ ID NO: 211500 - RNA, 22 nt, Homo sapiens
uugagcccuggagguggaggcu

SEQ ID NO: 211501 - RNA, 22 nt, Homo sapiens
uugagcucaucuucagggguga

SEQ ID NO: 211502 - RNA, 22 nt, Homo sapiens
uugaggaagugguuccccagag

SEQ ID NO: 211503 - RNA, 22 nt, Homo sapiens
uugaggaaugugauuucaaaua

SEQ ID NO: 211504 - RNA, 23 nt, Homo sapiens
uugaggcauguaccaucaauauc

SEQ ID NO: 211505 - RNA, 22 nt, Homo sapiens
uugagggaaacauucacaucau

SEQ ID NO: 211506 - RNA, 22 nt, Homo sapiens
uugagggaagccagaggucugc

SEQ ID NO: 211507 - RNA, 22 nt, Homo sapiens
uugagguauaaagguagguugu

SEQ ID NO: 211508 - RNA, 22 nt, Homo sapiens
uugaggucuucaggaucaggcu

SEQ ID NO: 211509 - RNA, 22 nt, Homo sapiens
uugaguaguaagaagaugauag

SEQ ID NO: 211510 - RNA, 22 nt, Homo sapiens
uugaguauuggacugguaucuu

SEQ ID NO: 211511 - RNA, 21 nt, Homo sapiens
uugaguugaagcaaggaggga

SEQ ID NO: 211512 - RNA, 22 nt, Homo sapiens
uugauaugcuugucaguccauu

SEQ ID NO: 211513 - RNA, 22 nt, Homo sapiens
uugauauggcugcuuaccauaa

SEQ ID NO: 211514 - RNA, 22 nt, Homo sapiens
uugauauguuguuagauucagu

SEQ ID NO: 211515 - RNA, 22 nt, Homo sapiens
uugauauuacucaguaacagau

SEQ ID NO: 211516 - RNA, 22 nt, Homo sapiens
uugauauucuuucuggauccca

SEQ ID NO: 211517 - RNA, 22 nt, Homo sapiens
uugaucaucagcuuugucaucu

SEQ ID NO: 211518 - RNA, 22 nt, Homo sapiens
uugaucugugucccugcccaau

SEQ ID NO: 211519 - RNA, 22 nt, Homo sapiens
uugauuagugacuggcuacacg

SEQ ID NO: 211520 - RNA, 22 nt, Homo sapiens
uugauugacaugucucuguuca

SEQ ID NO: 211521 - RNA, 22 nt, Homo sapiens
uugcaaagaccucuucacuucc

SEQ ID NO: 211522 - RNA, 22 nt, Homo sapiens
uugcaaaguugccaaggaagga

SEQ ID NO: 211523 - RNA, 22 nt, Homo sapiens
uugcaaaguuugccuccuguag

SEQ ID NO: 211524 - RNA, 18 nt, Homo sapiens
uugcaaauucuucccugu

SEQ ID NO: 211525 - RNA, 22 nt, Homo sapiens
uugcaacauguauucuggugau

SEQ ID NO: 211526 - RNA, 22 nt, Homo sapiens
uugcaagaaaugcagauucuca

SEQ ID NO: 211527 - RNA, 22 nt, Homo sapiens
uugcaagauguucaugggcugu

SEQ ID NO: 211528 - RNA, 22 nt, Homo sapiens
uugcacauggcaggugcucaau

SEQ ID NO: 211529 - RNA, 22 nt, Homo sapiens
uugcacauguugaaccagcaaa

SEQ ID NO: 211530 - RNA, 22 nt, Homo sapiens
uugcacauugauuuuguauccu

SEQ ID NO: 211531 - RNA, 22 nt, Homo sapiens
uugcaccacugcguuccagccu

SEQ ID NO: 211532 - RNA, 22 nt, Homo sapiens
uugcacucuccagccucggcaa

SEQ ID NO: 211533 - RNA, 22 nt, Homo sapiens
uugcagcaacauggaugaaacu

SEQ ID NO: 211534 - RNA, 19 nt, Homo sapiens
uugcaguauccuauauguu

SEQ ID NO: 211535 - RNA, 22 nt, Homo sapiens
uugcauaaguugaaccagccuu

SEQ ID NO: 211536 - RNA, 22 nt, Homo sapiens
uugcauaauaagagggauacgu

SEQ ID NO: 211537 - RNA, 22 nt, Homo sapiens
uugcauagaggugaguauagua

SEQ ID NO: 211538 - RNA, 22 nt, Homo sapiens
uugcauagugcugagguucggg

SEQ ID NO: 211539 - RNA, 18 nt, Homo sapiens
uugcauaguguauccaaa

SEQ ID NO: 211540 - RNA, 22 nt, Homo sapiens
uugcauauguugaaccagccuu

SEQ ID NO: 211541 - RNA, 22 nt, Homo sapiens
uugcaugggagcugggugaggc

SEQ ID NO: 211542 - RNA, 22 nt, Homo sapiens
uugcaugguggaacuuggagcu

SEQ ID NO: 211543 - RNA, 22 nt, Homo sapiens
uugcaugucauaacugauggaa

SEQ ID NO: 211544 - RNA, 22 nt, Homo sapiens
uugcauuagugugguacauuug

SEQ ID NO: 211545 - RNA, 22 nt, Homo sapiens
uugcauugacacaugaagcuca

SEQ ID NO: 211546 - RNA, 22 nt, Homo sapiens
uugccauagugcugccagauau

SEQ ID NO: 211547 - RNA, 22 nt, Homo sapiens
uugccgggugcaguggcucaug

SEQ ID NO: 211548 - RNA, 22 nt, Homo sapiens
uugccuaggcuggagugcagug

SEQ ID NO: 211549 - RNA, 22 nt, Homo sapiens
uugccuaggcuggaguguggug

SEQ ID NO: 211550 - RNA, 22 nt, Homo sapiens
uugccugagaagccaagaauaa

SEQ ID NO: 211551 - RNA, 22 nt, Homo sapiens
uugcgaugaagacaaaacaugc

SEQ ID NO: 211552 - RNA, 22 nt, Homo sapiens
uugcuaagucaagagaaaugau

SEQ ID NO: 211553 - RNA, 22 nt, Homo sapiens
uugcuagagaugagggaugugu

SEQ ID NO: 211554 - RNA, 22 nt, Homo sapiens
uugcuauguugcccagucugga

SEQ ID NO: 211555 - RNA, 22 nt, Homo sapiens
uugcucaggcuggaguacaaug

SEQ ID NO: 211556 - RNA, 22 nt, Homo sapiens
uugcugagucuuucuagguugc

SEQ ID NO: 211557 - RNA, 20 nt, Homo sapiens
uugcugguguuagaggaggc

SEQ ID NO: 211558 - RNA, 22 nt, Homo sapiens
uugcuucauucaacauugaggg

SEQ ID NO: 211559 - RNA, 22 nt, Homo sapiens
uuggaaaaauccaccuugaucu

SEQ ID NO: 211560 - RNA, 22 nt, Homo sapiens
uuggaacuguucguauugaaau

SEQ ID NO: 211561 - RNA, 22 nt, Homo sapiens
uuggaaugcaacagaaggauaa

SEQ ID NO: 211562 - RNA, 22 nt, Homo sapiens
uuggaauuagacaagugguggu

SEQ ID NO: 211563 - RNA, 19 nt, Homo sapiens
uuggaauuuuagaguuuga

SEQ ID NO: 211564 - RNA, 22 nt, Homo sapiens
gcuggugaaggcugaaaagugg

SEQ ID NO: 211565 - RNA, 22 nt, Homo sapiens
gcugguguagagugcagaaagg

SEQ ID NO: 211566 - RNA, 22 nt, Homo sapiens
gcugguguucaggcccucaguc

SEQ ID NO: 211567 - RNA, 22 nt, Homo sapiens
gcuguaguugaggauuuuaaga

SEQ ID NO: 211568 - RNA, 22 nt, Homo sapiens
gcuguuugccgccaucgcagac

SEQ ID NO: 211569 - RNA, 22 nt, Homo sapiens
gcuugguccccacccaaaucgc

SEQ ID NO: 211570 - RNA, 22 nt, Homo sapiens
gcuuguguauuaaaccuugcag

SEQ ID NO: 211571 - RNA, 22 nt, Homo sapiens
gcuuuggauaaaugucaguuua

SEQ ID NO: 211572 - RNA, 22 nt, Homo sapiens
gcuuuguugauggugagucugu

SEQ ID NO: 211573 - RNA, 22 nt, Homo sapiens
gcuuuguuguugaugggaaauc

SEQ ID NO: 211574 - RNA, 22 nt, Homo sapiens
gcuuuugcaggaaaggaagaau

SEQ ID NO: 211575 - RNA, 21 nt, Homo sapiens
gcuuuuucggaagucuuuggc

SEQ ID NO: 211576 - RNA, 18 nt, Homo sapiens
ggaaaacuuuucuaagua

SEQ ID NO: 211577 - RNA, 22 nt, Homo sapiens
ggaaagauguaauauuaucuaa

SEQ ID NO: 211578 - RNA, 22 nt, Homo sapiens
ggaaaucaucauucucgguaua

SEQ ID NO: 211579 - RNA, 22 nt, Homo sapiens
ggaacaccauuuuuccugccuu

SEQ ID NO: 211580 - RNA, 22 nt, Homo sapiens
ggaagaauauuaggggauuucg

SEQ ID NO: 211581 - RNA, 20 nt, Homo sapiens
ggaagagugacacaagguau

SEQ ID NO: 211582 - RNA, 22 nt, Homo sapiens
ggaagccugcacucgggcaggg

SEQ ID NO: 211583 - RNA, 22 nt, Homo sapiens
ggaaguauaaacuuaguggagu

SEQ ID NO: 211584 - RNA, 22 nt, Homo sapiens
ggaagugugaguaggauuugga

SEQ ID NO: 211585 - RNA, 22 nt, Homo sapiens
ggaauauaaaaagccccagaau

SEQ ID NO: 211586 - RNA, 19 nt, Homo sapiens
ggaaugcuauucaaccuuu

SEQ ID NO: 211587 - RNA, 22 nt, Homo sapiens
ggaaugggauuugaagucuggc

SEQ ID NO: 211588 - RNA, 22 nt, Homo sapiens
ggaauguauuaaggcauugggc

SEQ ID NO: 211589 - RNA, 22 nt, Homo sapiens
ggaauuaaggcaauugaaagcu

SEQ ID NO: 211590 - RNA, 22 nt, Homo sapiens
ggacaaaguauuuucaaaugua

SEQ ID NO: 211591 - RNA, 22 nt, Homo sapiens
ggacagugaaugccacuccucc

SEQ ID NO: 211592 - RNA, 20 nt, Homo sapiens
ggagagugacauaauucugg

SEQ ID NO: 211593 - RNA, 22 nt, Homo sapiens
ggagaugugccugcucugcucu

SEQ ID NO: 211594 - RNA, 22 nt, Homo sapiens
ggagauguuuaaccuuuuaucu

SEQ ID NO: 211595 - RNA, 22 nt, Homo sapiens
ggagauuauugaaucaugaggg

SEQ ID NO: 211596 - RNA, 22 nt, Homo sapiens
ggagcucaucuagcauagaggu

SEQ ID NO: 211597 - RNA, 22 nt, Homo sapiens
ggagguagucuuucccuuauca

SEQ ID NO: 211598 - RNA, 22 nt, Homo sapiens
ggaguaaaagaguaggaggaau

SEQ ID NO: 211599 - RNA, 22 nt, Homo sapiens
ggaguaggaaggaaauguuaaa

SEQ ID NO: 211600 - RNA, 22 nt, Homo sapiens
ggaguaggcuguccggcaccca

SEQ ID NO: 211601 - RNA, 22 nt, Homo sapiens
ggaguaugaaacccacuccaau

SEQ ID NO: 211602 - RNA, 22 nt, Homo sapiens
ggagucugauuuuuauguugcu

SEQ ID NO: 211603 - RNA, 22 nt, Homo sapiens
ggaguguaauggcgccaucuca

SEQ ID NO: 211604 - RNA, 22 nt, Homo sapiens
ggagugugauucaguauaauau

SEQ ID NO: 211605 - RNA, 22 nt, Homo sapiens
ggaguucaucaggugaggggua

SEQ ID NO: 211606 - RNA, 22 nt, Homo sapiens
ggaucacagccagcucccagaa

SEQ ID NO: 211607 - RNA, 22 nt, Homo sapiens
ggaucacuugagaccaggaguu

SEQ ID NO: 211608 - RNA, 22 nt, Homo sapiens
ggaugcauucaacuuccaguuc

SEQ ID NO: 211609 - RNA, 22 nt, Homo sapiens
ggcaaaauauugucugguauag

SEQ ID NO: 211610 - RNA, 22 nt, Homo sapiens
ggcaaaauggccagugggucac

SEQ ID NO: 211611 - RNA, 22 nt, Homo sapiens
ggcaaagaugaccauuacuuuu

SEQ ID NO: 211612 - RNA, 22 nt, Homo sapiens
ggcaaauucuuguaugccuacu

SEQ ID NO: 211613 - RNA, 22 nt, Homo sapiens
ggcaacauggugaaacucuguc

SEQ ID NO: 211614 - RNA, 21 nt, Homo sapiens
ggcaagugugagguuuggggu

SEQ ID NO: 211615 - RNA, 22 nt, Homo sapiens
ggcaaguugcuauucuuuaaug

SEQ ID NO: 211616 - RNA, 22 nt, Homo sapiens
ggcaauauauucugaauucagu

SEQ ID NO: 211617 - RNA, 23 nt, Homo sapiens
ggcacggaauucaaagaggcauu

SEQ ID NO: 211618 - RNA, 22 nt, Homo sapiens
ggcacugugaugugagggggua

SEQ ID NO: 211619 - RNA, 22 nt, Homo sapiens
ggcagcaugggugccuuuguga

SEQ ID NO: 211620 - RNA, 22 nt, Homo sapiens
ggcagcucaggccccgcgcuga

SEQ ID NO: 211621 - RNA, 23 nt, Homo sapiens
ggcagguuggucuaggucuauuc

SEQ ID NO: 211622 - RNA, 22 nt, Homo sapiens
ggcaguguauuacuuaggguuc

SEQ ID NO: 211623 - RNA, 22 nt, Homo sapiens
ggcaguuucucaggcaggggua

SEQ ID NO: 211624 - RNA, 22 nt, Homo sapiens
ggcaguuuggcaguuucauaaa

SEQ ID NO: 211625 - RNA, 22 nt, Homo sapiens
ggcaugaggccauaaaaguaag

SEQ ID NO: 211626 - RNA, 21 nt, Homo sapiens
ggcauugugcccuugcucuag

SEQ ID NO: 211627 - RNA, 23 nt, Homo sapiens
ggcauuguggcucacaucuguaa

SEQ ID NO: 211628 - RNA, 22 nt, Homo sapiens
ggcuagaugcuagagauaucau

SEQ ID NO: 211629 - RNA, 19 nt, Homo sapiens
ggcucagucaacugacugu

SEQ ID NO: 211630 - RNA, 22 nt, Homo sapiens
ggcucagugaucuguuucugua

SEQ ID NO: 211631 - RNA, 22 nt, Homo sapiens
ggcucagugggguccugguucu

SEQ ID NO: 211632 - RNA, 22 nt, Homo sapiens
ggcucguguuuucuguccaguu

SEQ ID NO: 211633 - RNA, 21 nt, Homo sapiens
ggcucuguggucucagguuuc

SEQ ID NO: 211634 - RNA, 22 nt, Homo sapiens
ggcucuguugcuaccaauuaag

SEQ ID NO: 211635 - RNA, 18 nt, Homo sapiens
ggcugguguuuuaguaua

SEQ ID NO: 211636 - RNA, 22 nt, Homo sapiens
gggaagguaaucauuacuugau

SEQ ID NO: 211637 - RNA, 22 nt, Homo sapiens
gggaagugugcagaguucucuu

SEQ ID NO: 211638 - RNA, 22 nt, Homo sapiens
gggaggucauuguucaaugcug

SEQ ID NO: 211639 - RNA, 22 nt, Homo sapiens
gggaguagagaguuucucugac

SEQ ID NO: 211640 - RNA, 22 nt, Homo sapiens
gggauuguaauacugaguuggu

SEQ ID NO: 211641 - RNA, 20 nt, Homo sapiens
gggcaaguaugugggaaguc

SEQ ID NO: 211642 - RNA, 22 nt, Homo sapiens
gggcacgugugugcugugcuca

SEQ ID NO: 211643 - RNA, 22 nt, Homo sapiens
gggcauaucacuugaggucagg

SEQ ID NO: 211644 - RNA, 22 nt, Homo sapiens
gggcgagaaucggcugcucagc

SEQ ID NO: 211645 - RNA, 22 nt, Homo sapiens
ggggaguguggacaucacccug

SEQ ID NO: 211646 - RNA, 22 nt, Homo sapiens
gggguaggcuacacugaguucc

SEQ ID NO: 211647 - RNA, 22 nt, Homo sapiens
gggguaguuacuguuguucuuu

SEQ ID NO: 211648 - RNA, 22 nt, Homo sapiens
gggguauguaagugagugagug

SEQ ID NO: 211649 - RNA, 22 nt, Homo sapiens
ggguaggcaagcggaugucaga

SEQ ID NO: 211650 - RNA, 22 nt, Homo sapiens
ggguucccugaugagaguuagu

SEQ ID NO: 211651 - RNA, 22 nt, Homo sapiens
gguaacaguggggcuaugcuua

SEQ ID NO: 211652 - RNA, 22 nt, Homo sapiens
gguauguuuagaccauuuacau

SEQ ID NO: 211653 - RNA, 22 nt, Homo sapiens
gguauuauuugccuuuuacuga

SEQ ID NO: 211654 - RNA, 22 nt, Homo sapiens
ggucauagagaauucaccagga

SEQ ID NO: 211655 - RNA, 22 nt, Homo sapiens
ggucauggauugucuuuucuug

SEQ ID NO: 211656 - RNA, 22 nt, Homo sapiens
gguccgccugccuuggccuccc

SEQ ID NO: 211657 - RNA, 22 nt, Homo sapiens
ggucuagagagagggguggacu

SEQ ID NO: 211658 - RNA, 22 nt, Homo sapiens
ggucuuggagaauuguccuggg

SEQ ID NO: 211659 - RNA, 22 nt, Homo sapiens
ggugagaaagggauuccuguuc

SEQ ID NO: 211660 - RNA, 19 nt, Homo sapiens
ggugagaaauuaugggucu

SEQ ID NO: 211661 - RNA, 22 nt, Homo sapiens
ggugaggaaaguugaguuucua

SEQ ID NO: 211662 - RNA, 19 nt, Homo sapiens
ggugcuugaauauuccucc

SEQ ID NO: 211663 - RNA, 22 nt, Homo sapiens
gguggcaaaucugaguggcgcu

SEQ ID NO: 211664 - RNA, 22 nt, Homo sapiens
ggugucaguuggccccuacugg

SEQ ID NO: 211665 - RNA, 22 nt, Homo sapiens
gguguguaaauuacuuaucucu

SEQ ID NO: 211666 - RNA, 19 nt, Homo sapiens
auggauacauuuucugcua

SEQ ID NO: 211667 - RNA, 22 nt, Homo sapiens
auggauauugccuaggguagua

SEQ ID NO: 211668 - RNA, 22 nt, Homo sapiens
auggauuuugaacuugagaguu

SEQ ID NO: 211669 - RNA, 22 nt, Homo sapiens
auggcaaugcgaugaugacuga

SEQ ID NO: 211670 - RNA, 22 nt, Homo sapiens
auggcaauguaagucagaaaaa

SEQ ID NO: 211671 - RNA, 22 nt, Homo sapiens
auggcacucaaucaaguugaga

SEQ ID NO: 211672 - RNA, 22 nt, Homo sapiens
auggcacugauggaaguaccuu

SEQ ID NO: 211673 - RNA, 22 nt, Homo sapiens
auggcacuguguccugggguca

SEQ ID NO: 211674 - RNA, 22 nt, Homo sapiens
auggcacuuuggacugcuagau

SEQ ID NO: 211675 - RNA, 22 nt, Homo sapiens
auggcagaaucaagccgacagc

SEQ ID NO: 211676 - RNA, 22 nt, Homo sapiens
auggcagagucagaaagucagg

SEQ ID NO: 211677 - RNA, 22 nt, Homo sapiens
auggcaguuuggucucugugcu

SEQ ID NO: 211678 - RNA, 22 nt, Homo sapiens
auggcaucgucaccuuuucagu

SEQ ID NO: 211679 - RNA, 22 nt, Homo sapiens
auggcauuuuuagggcugggug

SEQ ID NO: 211680 - RNA, 22 nt, Homo sapiens
auggcccccuguuugugaacau

SEQ ID NO: 211681 - RNA, 23 nt, Homo sapiens
auggcccuggugggagugucuuu

SEQ ID NO: 211682 - RNA, 22 nt, Homo sapiens
auggcccuguguggagcugcug

SEQ ID NO: 211683 - RNA, 22 nt, Homo sapiens
auggcggugugaucuuggcuca

SEQ ID NO: 211684 - RNA, 22 nt, Homo sapiens
auggcucuggauagaaugcagg

SEQ ID NO: 211685 - RNA, 22 nt, Homo sapiens
auggcuguuuaagaguuucauu

SEQ ID NO: 211686 - RNA, 22 nt, Homo sapiens
auggcuucuucuaaaagugggg

SEQ ID NO: 211687 - RNA, 22 nt, Homo sapiens
auggcuuuugaccugguaggau

SEQ ID NO: 211688 - RNA, 22 nt, Homo sapiens
augggagugugguuagagaccu

SEQ ID NO: 211689 - RNA, 22 nt, Homo sapiens
augggucuccugaauacagcac

SEQ ID NO: 211690 - RNA, 22 nt, Homo sapiens
auggugugugaauuaaauguua

SEQ ID NO: 211691 - RNA, 22 nt, Homo sapiens
augguuugugcuccuauaagaa

SEQ ID NO: 211692 - RNA, 22 nt, Homo sapiens
augguuuuacugcaaaauggga

SEQ ID NO: 211693 - RNA, 22 nt, Homo sapiens
auguaacugggacacaagccuc

SEQ ID NO: 211694 - RNA, 17 nt, Homo sapiens
auguaauccucaucucu

SEQ ID NO: 211695 - RNA, 22 nt, Homo sapiens
augucaaggugaagaaagauca

SEQ ID NO: 211696 - RNA, 22 nt, Homo sapiens
augucacugcacuccugccugg

SEQ ID NO: 211697 - RNA, 20 nt, Homo sapiens
augucagaguguggguacgg

SEQ ID NO: 211698 - RNA, 22 nt, Homo sapiens
auguccaugagcacauguauca

SEQ ID NO: 211699 - RNA, 22 nt, Homo sapiens
auguccauggaaucuguagcaa

SEQ ID NO: 211700 - RNA, 22 nt, Homo sapiens
augucuagagcaagagaugcug

SEQ ID NO: 211701 - RNA, 22 nt, Homo sapiens
augucuggcagaagacuucuca

SEQ ID NO: 211702 - RNA, 22 nt, Homo sapiens
augugacagugguuuuaagcgu

SEQ ID NO: 211703 - RNA, 22 nt, Homo sapiens
augugacuugugaaaaguucag

SEQ ID NO: 211704 - RNA, 22 nt, Homo sapiens
augugcaaaguuaagaucccag

SEQ ID NO: 211705 - RNA, 22 nt, Homo sapiens
augugcaaauuuccaaacucuu

SEQ ID NO: 211706 - RNA, 22 nt, Homo sapiens
augugcaagaucauuaaagcuc

SEQ ID NO: 211707 - RNA, 18 nt, Homo sapiens
augugcaauuuuguauuu

SEQ ID NO: 211708 - RNA, 22 nt, Homo sapiens
augugcacaacgugcagguuug

SEQ ID NO: 211709 - RNA, 22 nt, Homo sapiens
augugcacaugcuuacauguga

SEQ ID NO: 211710 - RNA, 20 nt, Homo sapiens
augugcaguguggcaaccaa

SEQ ID NO: 211711 - RNA, 22 nt, Homo sapiens
augugcauaugaagcacagaca

SEQ ID NO: 211712 - RNA, 22 nt, Homo sapiens
augugcuuauagguguauguuu

SEQ ID NO: 211713 - RNA, 22 nt, Homo sapiens
auguggaaagcagcaugauaug

SEQ ID NO: 211714 - RNA, 22 nt, Homo sapiens
auguggcacuugacuuucucgc

SEQ ID NO: 211715 - RNA, 22 nt, Homo sapiens
auguggcuuuccuagaucuuag

SEQ ID NO: 211716 - RNA, 22 nt, Homo sapiens
augugguaggcccaugagucau

SEQ ID NO: 211717 - RNA, 22 nt, Homo sapiens
auguguauuaccucgauuguga

SEQ ID NO: 211718 - RNA, 22 nt, Homo sapiens
augugugcuugauguaaaaagu

SEQ ID NO: 211719 - RNA, 22 nt, Homo sapiens
auguuagcaucuggcacuaugg

SEQ ID NO: 211720 - RNA, 22 nt, Homo sapiens
auguugcuugaaggcauuuugu

SEQ ID NO: 211721 - RNA, 22 nt, Homo sapiens
auguuguaguaugagucaaaau

SEQ ID NO: 211722 - RNA, 22 nt, Homo sapiens
auguuuagagagggugucaaau

SEQ ID NO: 211723 - RNA, 22 nt, Homo sapiens
auguuugguaagaauauuguua

SEQ ID NO: 211724 - RNA, 22 nt, Homo sapiens
auguuugguagugaauauggua

SEQ ID NO: 211725 - RNA, 22 nt, Homo sapiens
auuaaauguuggacguauacau

SEQ ID NO: 211726 - RNA, 22 nt, Homo sapiens
auuacuuugcaccaaccuaaua

SEQ ID NO: 211727 - RNA, 20 nt, Homo sapiens
auuagacuugccuuauccuu

SEQ ID NO: 211728 - RNA, 22 nt, Homo sapiens
auuagaugguuauaggugugag

SEQ ID NO: 211729 - RNA, 22 nt, Homo sapiens
auuagguagggaauauggaggu

SEQ ID NO: 211730 - RNA, 22 nt, Homo sapiens
auuagugaaugugaugucuuga

SEQ ID NO: 211731 - RNA, 22 nt, Homo sapiens
auuaucacaguuuugcauaugg

SEQ ID NO: 211732 - RNA, 22 nt, Homo sapiens
auuauuaguuguugaaugaagu

SEQ ID NO: 211733 - RNA, 22 nt, Homo sapiens
auucaaggacuggauugcggga

SEQ ID NO: 211734 - RNA, 22 nt, Homo sapiens
auucaagggauuucaggaggcu

SEQ ID NO: 211735 - RNA, 22 nt, Homo sapiens
auucaagucaucucuccgcauu

SEQ ID NO: 211736 - RNA, 22 nt, Homo sapiens
auucaagugaugugauucuucu

SEQ ID NO: 211737 - RNA, 22 nt, Homo sapiens
auucaccauggcuaccaagggu

SEQ ID NO: 211738 - RNA, 22 nt, Homo sapiens
auucaucagggauacuggccug

SEQ ID NO: 211739 - RNA, 22 nt, Homo sapiens
auuccacaguuaacacagaccg

SEQ ID NO: 211740 - RNA, 22 nt, Homo sapiens
auuccauaguacagugaugagu

SEQ ID NO: 211741 - RNA, 22 nt, Homo sapiens
auucccuguagaauaaggaugg

SEQ ID NO: 211742 - RNA, 22 nt, Homo sapiens
auugaacacagaguagcuuucc

SEQ ID NO: 211743 - RNA, 22 nt, Homo sapiens
auugaacuguuggagagguuuu

SEQ ID NO: 211744 - RNA, 22 nt, Homo sapiens
auugacuugauauauagcugau

SEQ ID NO: 211745 - RNA, 22 nt, Homo sapiens
auugagcacugacucugugcca

SEQ ID NO: 211746 - RNA, 22 nt, Homo sapiens
auugaguaaaugaaaauugccu

SEQ ID NO: 211747 - RNA, 22 nt, Homo sapiens
auugcaaucuccgccuccgggg

SEQ ID NO: 211748 - RNA, 21 nt, Homo sapiens
auugcacaauauacccaugua

SEQ ID NO: 211749 - RNA, 22 nt, Homo sapiens
auugcaccacugcccuccagcc

SEQ ID NO: 211750 - RNA, 22 nt, Homo sapiens
auugcacuccagccuggccgag

SEQ ID NO: 211751 - RNA, 22 nt, Homo sapiens
auugcacuccagccugggcaac

SEQ ID NO: 211752 - RNA, 22 nt, Homo sapiens
auugcacuccagccugggcagc

SEQ ID NO: 211753 - RNA, 22 nt, Homo sapiens
auugcacuccagccugggcuag

SEQ ID NO: 211754 - RNA, 22 nt, Homo sapiens
auugcacuccagccugggugac

SEQ ID NO: 211755 - RNA, 22 nt, Homo sapiens
auugcacuccagccuugacaca

SEQ ID NO: 211756 - RNA, 22 nt, Homo sapiens
auugcacuccagccuugggcaa

SEQ ID NO: 211757 - RNA, 22 nt, Homo sapiens
auugcacuccagcuuaggcgac

SEQ ID NO: 211758 - RNA, 22 nt, Homo sapiens
auugcacuccagcuugggugac

SEQ ID NO: 211759 - RNA, 22 nt, Homo sapiens
auugcacucuagccugggugac

SEQ ID NO: 211760 - RNA, 22 nt, Homo sapiens
auugcacucuagccuuggcgac

SEQ ID NO: 211761 - RNA, 22 nt, Homo sapiens
auugcaguuagaacagaagucu

SEQ ID NO: 211762 - RNA, 22 nt, Homo sapiens
auugcauaaacacauuucuuau

SEQ ID NO: 211763 - RNA, 22 nt, Homo sapiens
auugcaugucauguuuagugua

SEQ ID NO: 211764 - RNA, 22 nt, Homo sapiens
auugcauugugaucuucccaga

SEQ ID NO: 211765 - RNA, 22 nt, Homo sapiens
auugcauuuucagguuggucug

SEQ ID NO: 211766 - RNA, 22 nt, Homo sapiens
auugcccaggcuggagugcagu

SEQ ID NO: 211767 - RNA, 22 nt, Homo sapiens
gguguuccccuuaccucuuggc

SEQ ID NO: 211768 - RNA, 22 nt, Homo sapiens
guaaauguccccugugauauug

SEQ ID NO: 211769 - RNA, 22 nt, Homo sapiens
guaaccuauaguuaccaauagu

SEQ ID NO: 211770 - RNA, 22 nt, Homo sapiens
guaagagaauggguuacuuucc

SEQ ID NO: 211771 - RNA, 22 nt, Homo sapiens
guaagauaguauguuuaaccca

SEQ ID NO: 211772 - RNA, 22 nt, Homo sapiens
guaaucucagcuacucaggagg

SEQ ID NO: 211773 - RNA, 22 nt, Homo sapiens
guaaucucagcuacucgggagg

SEQ ID NO: 211774 - RNA, 22 nt, Homo sapiens
guaaucucagcuacuugggagc

SEQ ID NO: 211775 - RNA, 22 nt, Homo sapiens
guacaguaguaaaagugaauga

SEQ ID NO: 211776 - RNA, 22 nt, Homo sapiens
guacauagucacacauauacau

SEQ ID NO: 211777 - RNA, 22 nt, Homo sapiens
guacauggaaugaaauucaaaa

SEQ ID NO: 211778 - RNA, 22 nt, Homo sapiens
guacaugugcacagugugcagg

SEQ ID NO: 211779 - RNA, 22 nt, Homo sapiens
guagaagcacagggccuguauu

SEQ ID NO: 211780 - RNA, 22 nt, Homo sapiens
guagcagaacauguuccuugua

SEQ ID NO: 211781 - RNA, 22 nt, Homo sapiens
guagcagaauaucagauaauuu

SEQ ID NO: 211782 - RNA, 22 nt, Homo sapiens
guauacacccugugauauuauu

SEQ ID NO: 211783 - RNA, 22 nt, Homo sapiens
guauacaugucaaaacucacau

SEQ ID NO: 211784 - RNA, 22 nt, Homo sapiens
guauagcacauaauacuugaug

SEQ ID NO: 211785 - RNA, 22 nt, Homo sapiens
guauggaagucaguuuguuggc

SEQ ID NO: 211786 - RNA, 22 nt, Homo sapiens
guauggcaugcaugagaauuuc

SEQ ID NO: 211787 - RNA, 18 nt, Homo sapiens
guauuccagccugaguga

SEQ ID NO: 211788 - RNA, 22 nt, Homo sapiens
guauugaguaaauguuuauugg

SEQ ID NO: 211789 - RNA, 22 nt, Homo sapiens
gucaagugaagaccugacucuu

SEQ ID NO: 211790 - RNA, 22 nt, Homo sapiens
gucacagcacuuuuaguaagug

SEQ ID NO: 211791 - RNA, 22 nt, Homo sapiens
gucacggaauguaaguggaagu

SEQ ID NO: 211792 - RNA, 22 nt, Homo sapiens
gucacugacaagagagaagaac

SEQ ID NO: 211793 - RNA, 22 nt, Homo sapiens
gucacugagaagguuaguuugu

SEQ ID NO: 211794 - RNA, 22 nt, Homo sapiens
gucacuggcugucuuguaugau

SEQ ID NO: 211795 - RNA, 22 nt, Homo sapiens
gucagcaucaccaugucuauga

SEQ ID NO: 211796 - RNA, 22 nt, Homo sapiens
gucagcuuuuccuuacuuuagg

SEQ ID NO: 211797 - RNA, 22 nt, Homo sapiens
gucagugccugucccaggcuuu

SEQ ID NO: 211798 - RNA, 22 nt, Homo sapiens
gucagugugauaucugcagggg

SEQ ID NO: 211799 - RNA, 22 nt, Homo sapiens
gucaguuugguuaaucauucca

SEQ ID NO: 211800 - RNA, 22 nt, Homo sapiens
gucauauaggguuuaccuguau

SEQ ID NO: 211801 - RNA, 21 nt, Homo sapiens
gucauaugucucugauuagug

SEQ ID NO: 211802 - RNA, 22 nt, Homo sapiens
gucaucaucaguccucugugca

SEQ ID NO: 211803 - RNA, 22 nt, Homo sapiens
gucauccaggcuggagugaagc

SEQ ID NO: 211804 - RNA, 22 nt, Homo sapiens
gucaugggguacuacacauggg

SEQ ID NO: 211805 - RNA, 22 nt, Homo sapiens
guccaagacuaggaguuggcag

SEQ ID NO: 211806 - RNA, 22 nt, Homo sapiens
guccagagaagucauuacuuca

SEQ ID NO: 211807 - RNA, 22 nt, Homo sapiens
guccaguuguuuucugagguug

SEQ ID NO: 211808 - RNA, 22 nt, Homo sapiens
gucccagagauauugugucuuu

SEQ ID NO: 211809 - RNA, 22 nt, Homo sapiens
gucccaguggaaccuccaagcu

SEQ ID NO: 211810 - RNA, 22 nt, Homo sapiens
gucguggagucucuggcuugua

SEQ ID NO: 211811 - RNA, 22 nt, Homo sapiens
gucuaugagucccugaauuuaa

SEQ ID NO: 211812 - RNA, 22 nt, Homo sapiens
gucucacagcuagcugcuuuau

SEQ ID NO: 211813 - RNA, 22 nt, Homo sapiens
gucugagcauggggccggcagg

SEQ ID NO: 211814 - RNA, 22 nt, Homo sapiens
gucuggcuuaucucacuuacca

SEQ ID NO: 211815 - RNA, 22 nt, Homo sapiens
gucugugcauuaauacgugcug

SEQ ID NO: 211816 - RNA, 22 nt, Homo sapiens
gucuguuuggggaccuguggcc

SEQ ID NO: 211817 - RNA, 22 nt, Homo sapiens
gucuuggagaacucagcuuggc

SEQ ID NO: 211818 - RNA, 22 nt, Homo sapiens
gucuuuaguugaaacauguggu

SEQ ID NO: 211819 - RNA, 22 nt, Homo sapiens
gucuuugagauaggguuauuuu

SEQ ID NO: 211820 - RNA, 22 nt, Homo sapiens
gucuuugaugucuaugugcuuc

SEQ ID NO: 211821 - RNA, 22 nt, Homo sapiens
gucuuugcauguauguucauga

SEQ ID NO: 211822 - RNA, 22 nt, Homo sapiens
gugaaagauuaaaccagugugu

SEQ ID NO: 211823 - RNA, 22 nt, Homo sapiens
gugaaauguguagaggaucugg

SEQ ID NO: 211824 - RNA, 22 nt, Homo sapiens
gugaagaugugcaucagaucca

SEQ ID NO: 211825 - RNA, 22 nt, Homo sapiens
gugaaguuuuugugaggccuaa

SEQ ID NO: 211826 - RNA, 22 nt, Homo sapiens
gugaauagggaauaaugggauc

SEQ ID NO: 211827 - RNA, 22 nt, Homo sapiens
gugaaucauaugccagucaugc

SEQ ID NO: 211828 - RNA, 22 nt, Homo sapiens
gugaauugagagaacuguguua

SEQ ID NO: 211829 - RNA, 22 nt, Homo sapiens
gugacacagcaagacuccgucu

SEQ ID NO: 211830 - RNA, 22 nt, Homo sapiens
gugacagucaaagacaugacuu

SEQ ID NO: 211831 - RNA, 22 nt, Homo sapiens
gugaccaaagauagcucaaguu

SEQ ID NO: 211832 - RNA, 22 nt, Homo sapiens
gugaccagaugggcaggggugu

SEQ ID NO: 211833 - RNA, 22 nt, Homo sapiens
gugaccauuugacauauccuug

SEQ ID NO: 211834 - RNA, 22 nt, Homo sapiens
gugacuaagauucuuugauaug

SEQ ID NO: 211835 - RNA, 22 nt, Homo sapiens
gugacugcauauaaguguaugu

SEQ ID NO: 211836 - RNA, 22 nt, Homo sapiens
gugacugcauccauccaggcuu

SEQ ID NO: 211837 - RNA, 20 nt, Homo sapiens
gugagaacaugugguauuug

SEQ ID NO: 211838 - RNA, 22 nt, Homo sapiens
gugagaacugcuggggccacag

SEQ ID NO: 211839 - RNA, 22 nt, Homo sapiens
gugagaacugugucuuauaaac

SEQ ID NO: 211840 - RNA, 22 nt, Homo sapiens
gugagaaucaaacuacauaaau

SEQ ID NO: 211841 - RNA, 22 nt, Homo sapiens
gugagaauugacacccuugucu

SEQ ID NO: 211842 - RNA, 22 nt, Homo sapiens
gugagaccaauguacuaccuuc

SEQ ID NO: 211843 - RNA, 22 nt, Homo sapiens
gugagauacuagagauauagug

SEQ ID NO: 211844 - RNA, 22 nt, Homo sapiens
gugagauggaguuggugucuuu

SEQ ID NO: 211845 - RNA, 22 nt, Homo sapiens
gugagaugguaucucauugugg

SEQ ID NO: 211846 - RNA, 22 nt, Homo sapiens
gugagauuaccauuuaaaucag

SEQ ID NO: 211847 - RNA, 22 nt, Homo sapiens
gugagauuagcugagauccuug

SEQ ID NO: 211848 - RNA, 22 nt, Homo sapiens
gugagauuuucuccagguucag

SEQ ID NO: 211849 - RNA, 22 nt, Homo sapiens
gugagcaaacuuaccuaagguu

SEQ ID NO: 211850 - RNA, 22 nt, Homo sapiens
gugagcagagaucgcgugauug

SEQ ID NO: 211851 - RNA, 22 nt, Homo sapiens
gugagcaguguccuugggggca

SEQ ID NO: 211852 - RNA, 22 nt, Homo sapiens
gugagcuccucucuauguguca

SEQ ID NO: 211853 - RNA, 22 nt, Homo sapiens
gugagcuccucuucugcugcag

SEQ ID NO: 211854 - RNA, 21 nt, Homo sapiens
gugaggaguuacuggcuuuga

SEQ ID NO: 211855 - RNA, 22 nt, Homo sapiens
gugaggcugguccugccuccca

SEQ ID NO: 211856 - RNA, 22 nt, Homo sapiens
gugagguagagcaugugaaaga

SEQ ID NO: 211857 - RNA, 22 nt, Homo sapiens
gugagguauacugggaucacua

SEQ ID NO: 211858 - RNA, 22 nt, Homo sapiens
gugaggucguagucauaggcaa

SEQ ID NO: 211859 - RNA, 22 nt, Homo sapiens
gugagguguuaaccaaccugug

SEQ ID NO: 211860 - RNA, 22 nt, Homo sapiens
gugagucagucuguguagggcu

SEQ ID NO: 211861 - RNA, 22 nt, Homo sapiens
gugaucuuucaggcuugaccau

SEQ ID NO: 211862 - RNA, 22 nt, Homo sapiens
gugaugguaguuuguauuucug

SEQ ID NO: 211863 - RNA, 22 nt, Homo sapiens
gugauguguuuguucuaucucu

SEQ ID NO: 211864 - RNA, 22 nt, Homo sapiens
gugauuuaguagaugcuaguua

SEQ ID NO: 211865 - RNA, 22 nt, Homo sapiens
gugcaacaugccuggcuaauuu

SEQ ID NO: 211866 - RNA, 22 nt, Homo sapiens
gugcaaccaucaccacugacuc

SEQ ID NO: 211867 - RNA, 22 nt, Homo sapiens
gugcaaguguaauacagcuagg

SEQ ID NO: 211868 - RNA, 22 nt, Homo sapiens
uuggacuucucaaggcaauaaa

SEQ ID NO: 211869 - RNA, 22 nt, Homo sapiens
uuggagugugagagcagccugg

SEQ ID NO: 211870 - RNA, 22 nt, Homo sapiens
uuggauaguuuaugaaaaaugg

SEQ ID NO: 211871 - RNA, 22 nt, Homo sapiens
uuggauauucaguuuuuccauc

SEQ ID NO: 211872 - RNA, 22 nt, Homo sapiens
uuggaugauaaagaagccuaag

SEQ ID NO: 211873 - RNA, 22 nt, Homo sapiens
uuggauggucuuuauauaguau

SEQ ID NO: 211874 - RNA, 22 nt, Homo sapiens
uuggauuauaaacugagauuug

SEQ ID NO: 211875 - RNA, 22 nt, Homo sapiens
uuggcaaagaggaaugccacuu

SEQ ID NO: 211876 - RNA, 22 nt, Homo sapiens
uuggcaagaauguaugccgauc

SEQ ID NO: 211877 - RNA, 22 nt, Homo sapiens
uuggcacgugguggggcucgga

SEQ ID NO: 211878 - RNA, 20 nt, Homo sapiens
uuggcagagucuuuagggua

SEQ ID NO: 211879 - RNA, 22 nt, Homo sapiens
uuggcagcuguggaaucugggc

SEQ ID NO: 211880 - RNA, 22 nt, Homo sapiens
uuggcagucugaggcacagacu

SEQ ID NO: 211881 - RNA, 22 nt, Homo sapiens
uuggcauagaggcucucaagcu

SEQ ID NO: 211882 - RNA, 22 nt, Homo sapiens
uuggcauugccaaacugucaac

SEQ ID NO: 211883 - RNA, 22 nt, Homo sapiens
uuggcauuuauucuaaggucaa

SEQ ID NO: 211884 - RNA, 22 nt, Homo sapiens
uuggcauuuuggacacccagga

SEQ ID NO: 211885 - RNA, 22 nt, Homo sapiens
uuggcauuuuuagucaugggaa

SEQ ID NO: 211886 - RNA, 22 nt, Homo sapiens
uuggccccuuucauccacagcu

SEQ ID NO: 211887 - RNA, 22 nt, Homo sapiens
uuggcccugcugaccauucccu

SEQ ID NO: 211888 - RNA, 22 nt, Homo sapiens
uuggcuacagauuaugaauuuc

SEQ ID NO: 211889 - RNA, 22 nt, Homo sapiens
uuggcucuggcugggcuccagc

SEQ ID NO: 211890 - RNA, 22 nt, Homo sapiens
uuggcuguguuccucaaggagu

SEQ ID NO: 211891 - RNA, 22 nt, Homo sapiens
uugggacccuguccuguaacaa

SEQ ID NO: 211892 - RNA, 23 nt, Homo sapiens
uugggcaaaucacugagggcaga

SEQ ID NO: 211893 - RNA, 22 nt, Homo sapiens
uugggcauugcuauaaauucuu

SEQ ID NO: 211894 - RNA, 22 nt, Homo sapiens
uugggccacuuuaguuuccuua

SEQ ID NO: 211895 - RNA, 22 nt, Homo sapiens
uugggcuugagggugcccaguc

SEQ ID NO: 211896 - RNA, 21 nt, Homo sapiens
uuggggaauggagagguuuuc

SEQ ID NO: 211897 - RNA, 22 nt, Homo sapiens
uuggggcacggccucuguugcc

SEQ ID NO: 211898 - RNA, 22 nt, Homo sapiens
uuggguccucugguccuugguu

SEQ ID NO: 211899 - RNA, 22 nt, Homo sapiens
uugguacuacacuucuaaucuu

SEQ ID NO: 211900 - RNA, 22 nt, Homo sapiens
uugguaguaaucccucacaaaa

SEQ ID NO: 211901 - RNA, 22 nt, Homo sapiens
uugguauguaauuuauauugua

SEQ ID NO: 211902 - RNA, 22 nt, Homo sapiens
uuggucacugacauguuugaaa

SEQ ID NO: 211903 - RNA, 22 nt, Homo sapiens
uuggucagcuagauuauucccu

SEQ ID NO: 211904 - RNA, 22 nt, Homo sapiens
uuggucagcucaauggagaggg

SEQ ID NO: 211905 - RNA, 22 nt, Homo sapiens
uugguccccuucaaccagcugu

SEQ ID NO: 211906 - RNA, 21 nt, Homo sapiens
uuggucuucucugugauucuu

SEQ ID NO: 211907 - RNA, 20 nt, Homo sapiens
uuggugaccuacagaugugg

SEQ ID NO: 211908 - RNA, 22 nt, Homo sapiens
uuguaaacaucuguacauugcu

SEQ ID NO: 211909 - RNA, 22 nt, Homo sapiens
uuguaaaguucuuaggaagcuc

SEQ ID NO: 211910 - RNA, 23 nt, Homo sapiens
uuguaacuggagaguaacauucc

SEQ ID NO: 211911 - RNA, 22 nt, Homo sapiens
uuguaaucaacacaucauuggg

SEQ ID NO: 211912 - RNA, 22 nt, Homo sapiens
uuguaauggagcaaacagguug

SEQ ID NO: 211913 - RNA, 22 nt, Homo sapiens
uuguacaggaguguaagcuuca

SEQ ID NO: 211914 - RNA, 22 nt, Homo sapiens
uuguaccacagggcaugaagug

SEQ ID NO: 211915 - RNA, 22 nt, Homo sapiens
uuguacuagucauauuuugaaa

SEQ ID NO: 211916 - RNA, 22 nt, Homo sapiens
uuguacuccagccugggugaca

SEQ ID NO: 211917 - RNA, 22 nt, Homo sapiens
uuguagaucuucaguugcuaca

SEQ ID NO: 211918 - RNA, 22 nt, Homo sapiens
uugucacauggggcggcugccc

SEQ ID NO: 211919 - RNA, 22 nt, Homo sapiens
uuguccccaucugcugccagaa

SEQ ID NO: 211920 - RNA, 22 nt, Homo sapiens
uuguccccuuccaaaucucaug

SEQ ID NO: 211921 - RNA, 16 nt, Homo sapiens
uugucccuucccaaau

SEQ ID NO: 211922 - RNA, 22 nt, Homo sapiens
uuguccucuccaaaucucaugu

SEQ ID NO: 211923 - RNA, 22 nt, Homo sapiens
uugucuagugaauacauuaaug

SEQ ID NO: 211924 - RNA, 22 nt, Homo sapiens
uugucucacuggaguuuaguaa

SEQ ID NO: 211925 - RNA, 22 nt, Homo sapiens
uugucuccuagacgaccaggcg

SEQ ID NO: 211926 - RNA, 22 nt, Homo sapiens
uugucuugcagcuuaggcauca

SEQ ID NO: 211927 - RNA, 22 nt, Homo sapiens
uugugaaaucuaggcagagguu

SEQ ID NO: 211928 - RNA, 22 nt, Homo sapiens
uugugaaugaugccgcaauaaa

SEQ ID NO: 211929 - RNA, 22 nt, Homo sapiens
uugugaaugaugucgcaauaaa

SEQ ID NO: 211930 - RNA, 22 nt, Homo sapiens
uugugaauggugccacaauaaa

SEQ ID NO: 211931 - RNA, 22 nt, Homo sapiens
uugugaauggugccgcaguaaa

SEQ ID NO: 211932 - RNA, 22 nt, Homo sapiens
uugugaauggugcugcaguaaa

SEQ ID NO: 211933 - RNA, 22 nt, Homo sapiens
uugugagggagcuaagaugagu

SEQ ID NO: 211934 - RNA, 21 nt, Homo sapiens
uugugccaaacccuggaggga

SEQ ID NO: 211935 - RNA, 22 nt, Homo sapiens
uugugcuuaauaaaaaguggua

SEQ ID NO: 211936 - RNA, 22 nt, Homo sapiens
uugugcuucaucaccuagcaga

SEQ ID NO: 211937 - RNA, 22 nt, Homo sapiens
uugugcuuuuuaaauagcuucc

SEQ ID NO: 211938 - RNA, 22 nt, Homo sapiens
uugugggaggugauuagaucau

SEQ ID NO: 211939 - RNA, 22 nt, Homo sapiens
uugugguugauacacguaggaa

SEQ ID NO: 211940 - RNA, 22 nt, Homo sapiens
uugugguuuuuaaaacuaggug

SEQ ID NO: 211941 - RNA, 19 nt, Homo sapiens
uuguguccccacaaaauuc

SEQ ID NO: 211942 - RNA, 22 nt, Homo sapiens
uuguguuuuuaguagggaaggg

SEQ ID NO: 211943 - RNA, 17 nt, Homo sapiens
uuguucccauuaaaaag

SEQ ID NO: 211944 - RNA, 22 nt, Homo sapiens
uuguuuuggagaugagcuaaaa

SEQ ID NO: 211945 - RNA, 22 nt, Homo sapiens
uuuaaagcacggaguuuguggc

SEQ ID NO: 211946 - RNA, 22 nt, Homo sapiens
uuuaaagcuccaagcaugucug

SEQ ID NO: 211947 - RNA, 22 nt, Homo sapiens
uuuaaggcacuucaugguuuca

SEQ ID NO: 211948 - RNA, 22 nt, Homo sapiens
uuuaaguguuuguuccugaaaa

SEQ ID NO: 211949 - RNA, 22 nt, Homo sapiens
uuuaaugcaucccaaaauguag

SEQ ID NO: 211950 - RNA, 22 nt, Homo sapiens
uuuaaugcgucucugaguuuug

SEQ ID NO: 211951 - RNA, 17 nt, Homo sapiens
uuuaaugcuaggacucu

SEQ ID NO: 211952 - RNA, 22 nt, Homo sapiens
uuuaauguuacaguauugguau

SEQ ID NO: 211953 - RNA, 22 nt, Homo sapiens
uuuacagucucauagguggaag

SEQ ID NO: 211954 - RNA, 21 nt, Homo sapiens
uuuacuguggacccauugcuu

SEQ ID NO: 211955 - RNA, 22 nt, Homo sapiens
uuuagcaaugcuguggggaagu

SEQ ID NO: 211956 - RNA, 22 nt, Homo sapiens
uuuagcacugugauugacaaaa

SEQ ID NO: 211957 - RNA, 22 nt, Homo sapiens
uuuagcagcaaagagcuguguu

SEQ ID NO: 211958 - RNA, 22 nt, Homo sapiens
uuuaguacugcuuuaugugugu

SEQ ID NO: 211959 - RNA, 22 nt, Homo sapiens
uuuaucuguuuaaaacuguuca

SEQ ID NO: 211960 - RNA, 22 nt, Homo sapiens
uuuaugcuacauguguuggaaa

SEQ ID NO: 211961 - RNA, 22 nt, Homo sapiens
uuuauggagagauauuuauggu

SEQ ID NO: 211962 - RNA, 22 nt, Homo sapiens
uuucacagagggcuucuuucua

SEQ ID NO: 211963 - RNA, 22 nt, Homo sapiens
uuucacagcaauugccuauugu

SEQ ID NO: 211964 - RNA, 22 nt, Homo sapiens
uuucacagcugucuuccgucuc

SEQ ID NO: 211965 - RNA, 22 nt, Homo sapiens
uuucacaguguucucccccaga

SEQ ID NO: 211966 - RNA, 22 nt, Homo sapiens
uuucacuagccagcccuuuauu

SEQ ID NO: 211967 - RNA, 20 nt, Homo sapiens
uuucaguacuuucuacuggc

SEQ ID NO: 211968 - RNA, 22 nt, Homo sapiens
uuucaguagagacacgguuuug

SEQ ID NO: 211969 - RNA, 22 nt, Homo sapiens
uuucauagccuuugucgucuga

SEQ ID NO: 211970 - RNA, 22 nt, Homo sapiens
auugcuaauaugcuucaggcaa

SEQ ID NO: 211971 - RNA, 22 nt, Homo sapiens
auugcuauuauuugaccauugu

SEQ ID NO: 211972 - RNA, 22 nt, Homo sapiens
auugcucagucagggagcucgg

SEQ ID NO: 211973 - RNA, 22 nt, Homo sapiens
auugcugagacauugcuaaucu

SEQ ID NO: 211974 - RNA, 22 nt, Homo sapiens
auugcuuacuaaucaucuucag

SEQ ID NO: 211975 - RNA, 22 nt, Homo sapiens
auugcuucugauuuuaaaugag

SEQ ID NO: 211976 - RNA, 16 nt, Homo sapiens
auuggcaagaugccuu

SEQ ID NO: 211977 - RNA, 22 nt, Homo sapiens
auuggcaauguacauaucuugc

SEQ ID NO: 211978 - RNA, 22 nt, Homo sapiens
auuggucuauuaaaccuaaguu

SEQ ID NO: 211979 - RNA, 22 nt, Homo sapiens
auuguaccccaauguacaauau

SEQ ID NO: 211980 - RNA, 22 nt, Homo sapiens
auuguacuccagccugggcaaa

SEQ ID NO: 211981 - RNA, 22 nt, Homo sapiens
auuguacuccagccugggcuaa

SEQ ID NO: 211982 - RNA, 22 nt, Homo sapiens
auugucacccgggcaguaagca

SEQ ID NO: 211983 - RNA, 22 nt, Homo sapiens
auugucacuuaaaagugcaugu

SEQ ID NO: 211984 - RNA, 22 nt, Homo sapiens
auugucauuuucugagaaguaa

SEQ ID NO: 211985 - RNA, 22 nt, Homo sapiens
auuguccuacuaggguuccagu

SEQ ID NO: 211986 - RNA, 22 nt, Homo sapiens
auugugucuuguagagagauau

SEQ ID NO: 211987 - RNA, 22 nt, Homo sapiens
auuguucuuacaugcugucauc

SEQ ID NO: 211988 - RNA, 22 nt, Homo sapiens
auuucacugagacaugugccca

SEQ ID NO: 211989 - RNA, 22 nt, Homo sapiens
auuugacacugagagccucagu

SEQ ID NO: 211990 - RNA, 21 nt, Homo sapiens
auuugcacugagcuccugugc

SEQ ID NO: 211991 - RNA, 22 nt, Homo sapiens
auuuggcaacguagggaggcau

SEQ ID NO: 211992 - RNA, 22 nt, Homo sapiens
auuuggcaguauaaugcuuugg

SEQ ID NO: 211993 - RNA, 22 nt, Homo sapiens
auuuggcauagaguaucauucu

SEQ ID NO: 211994 - RNA, 22 nt, Homo sapiens
auuuggguaaugagugcaaggg

SEQ ID NO: 211995 - RNA, 22 nt, Homo sapiens
auuugguguuguuuggagccua

SEQ ID NO: 211996 - RNA, 22 nt, Homo sapiens
auuugguuauucaguuguucag

SEQ ID NO: 211997 - RNA, 22 nt, Homo sapiens
auuugucaauacacuucuucca

SEQ ID NO: 211998 - RNA, 22 nt, Homo sapiens
auuuugcauugcuguaaaggaa

SEQ ID NO: 211999 - RNA, 18 nt, Homo sapiens
auuuuugcaguccacaug

SEQ ID NO: 212000 - RNA, 22 nt, Homo sapiens
caaaggauucauuuccaggagu

SEQ ID NO: 212001 - RNA, 22 nt, Homo sapiens
caaaggcuucugaaacugcaga

SEQ ID NO: 212002 - RNA, 22 nt, Homo sapiens
caaagugguuuauacaugauug

SEQ ID NO: 212003 - RNA, 22 nt, Homo sapiens
caaaugaucugcuggccucagc

SEQ ID NO: 212004 - RNA, 22 nt, Homo sapiens
caaaugcuucuauggacugucu

SEQ ID NO: 212005 - RNA, 20 nt, Homo sapiens
caaauugcuuucuugguuuu

SEQ ID NO: 212006 - RNA, 22 nt, Homo sapiens
caagaggcuguguauaaagcca

SEQ ID NO: 212007 - RNA, 21 nt, Homo sapiens
caagugaugcuucugcuuuaa

SEQ ID NO: 212008 - RNA, 22 nt, Homo sapiens
caagugcuugaugaaugaucaa

SEQ ID NO: 212009 - RNA, 23 nt, Homo sapiens
caauacugaccucacguuaauag

SEQ ID NO: 212010 - RNA, 19 nt, Homo sapiens
caauacuucuuggcauaca

SEQ ID NO: 212011 - RNA, 22 nt, Homo sapiens
caaucugucuuuuagggggcca

SEQ ID NO: 212012 - RNA, 21 nt, Homo sapiens
caauggcacgaucuuggcuca

SEQ ID NO: 212013 - RNA, 22 nt, Homo sapiens
cacaaccuccgccuccuggguu

SEQ ID NO: 212014 - RNA, 22 nt, Homo sapiens
cacacugucuucaauggguggu

SEQ ID NO: 212015 - RNA, 22 nt, Homo sapiens
cacacuguuuuccauggggguu

SEQ ID NO: 212016 - RNA, 22 nt, Homo sapiens
cacagagugagacccugucucu

SEQ ID NO: 212017 - RNA, 22 nt, Homo sapiens
cacagucuugcaauauugagau

SEQ ID NO: 212018 - RNA, 22 nt, Homo sapiens
cacagugaaugucaucauugcc

SEQ ID NO: 212019 - RNA, 22 nt, Homo sapiens
caccagguuggagugcaguggu

SEQ ID NO: 212020 - RNA, 23 nt, Homo sapiens
caccaguauaauuagcuuuuaaa

SEQ ID NO: 212021 - RNA, 22 nt, Homo sapiens
cacccuuagaguuggaaguggg

SEQ ID NO: 212022 - RNA, 22 nt, Homo sapiens
cacccuugcagggacagcuuug

SEQ ID NO: 212023 - RNA, 22 nt, Homo sapiens
caccuagacuggagugcagugg

SEQ ID NO: 212024 - RNA, 22 nt, Homo sapiens
cacugcacuccagucugacgac

SEQ ID NO: 212025 - RNA, 22 nt, Homo sapiens
cacugcacuccaguuuggauga

SEQ ID NO: 212026 - RNA, 21 nt, Homo sapiens
cacugcacuugccuucugggu

SEQ ID NO: 212027 - RNA, 22 nt, Homo sapiens
cacugcaguaaauugcgucggu

SEQ ID NO: 212028 - RNA, 22 nt, Homo sapiens
cacugcaguguaauuaagguug

SEQ ID NO: 212029 - RNA, 22 nt, Homo sapiens
cacugcauccuccaccuccugg

SEQ ID NO: 212030 - RNA, 22 nt, Homo sapiens
cacugcauccuccaccugccag

SEQ ID NO: 212031 - RNA, 22 nt, Homo sapiens
cacugcauggucuagcuggguu

SEQ ID NO: 212032 - RNA, 22 nt, Homo sapiens
cacugcauuggaugguuccucc

SEQ ID NO: 212033 - RNA, 22 nt, Homo sapiens
cacuggcacuguguuuagaugg

SEQ ID NO: 212034 - RNA, 17 nt, Homo sapiens
cacugggugcaagagga

SEQ ID NO: 212035 - RNA, 22 nt, Homo sapiens
cacuggucucauggcaugagag

SEQ ID NO: 212036 - RNA, 22 nt, Homo sapiens
cacuguggauggaacuauguga

SEQ ID NO: 212037 - RNA, 22 nt, Homo sapiens
cagagaucaugcaacugcucgc

SEQ ID NO: 212038 - RNA, 20 nt, Homo sapiens
cagagcaaagcaguccuggc

SEQ ID NO: 212039 - RNA, 22 nt, Homo sapiens
cagagguaagcaagucagcauu

SEQ ID NO: 212040 - RNA, 22 nt, Homo sapiens
cagagucaagcucuuguuccau

SEQ ID NO: 212041 - RNA, 22 nt, Homo sapiens
cagagugcauguuuagaugagu

SEQ ID NO: 212042 - RNA, 22 nt, Homo sapiens
cagauacuggaguccugaaguu

SEQ ID NO: 212043 - RNA, 22 nt, Homo sapiens
cagaugcaugaccugggcuugg

SEQ ID NO: 212044 - RNA, 22 nt, Homo sapiens
cagcagguuuuuaucaguuaag

SEQ ID NO: 212045 - RNA, 22 nt, Homo sapiens
cagcgaggucugcgucacauug

SEQ ID NO: 212046 - RNA, 22 nt, Homo sapiens
cagcuaguuuuugguuuacagu

SEQ ID NO: 212047 - RNA, 23 nt, Homo sapiens
cagcucauuuggguccccuuguc

SEQ ID NO: 212048 - RNA, 22 nt, Homo sapiens
cagcugguggcaagaagacaga

SEQ ID NO: 212049 - RNA, 22 nt, Homo sapiens
cagcugguguuacaaaccagag

SEQ ID NO: 212050 - RNA, 22 nt, Homo sapiens
caggaaugugaggguucccugc

SEQ ID NO: 212051 - RNA, 22 nt, Homo sapiens
caggcagucuggggguguaucc

SEQ ID NO: 212052 - RNA, 22 nt, Homo sapiens
cagggcaugugggucuauuggc

SEQ ID NO: 212053 - RNA, 22 nt, Homo sapiens
cagggcauuggcugguaccugg

SEQ ID NO: 212054 - RNA, 22 nt, Homo sapiens
cagggcauugucuucuuaguac

SEQ ID NO: 212055 - RNA, 22 nt, Homo sapiens
cagguaguauuugguuacauaa

SEQ ID NO: 212056 - RNA, 23 nt, Homo sapiens
cagguaguucuuuauaguagugu

SEQ ID NO: 212057 - RNA, 22 nt, Homo sapiens
caggugguauuugguuuucugu

SEQ ID NO: 212058 - RNA, 22 nt, Homo sapiens
caguaaauaucugagcgagguc

SEQ ID NO: 212059 - RNA, 22 nt, Homo sapiens
cagugcaaagccucugcccaga

SEQ ID NO: 212060 - RNA, 22 nt, Homo sapiens
cagugcauagaugugccacauu

SEQ ID NO: 212061 - RNA, 22 nt, Homo sapiens
cagugcauaggaucuaaaauuu

SEQ ID NO: 212062 - RNA, 22 nt, Homo sapiens
cagugcaugacuguauauuauc

SEQ ID NO: 212063 - RNA, 23 nt, Homo sapiens
cagugcauuguggcauucagcau

SEQ ID NO: 212064 - RNA, 22 nt, Homo sapiens
cagugcuuuaucaaguccucca

SEQ ID NO: 212065 - RNA, 22 nt, Homo sapiens
caucacaugcuuauuuuccuca

SEQ ID NO: 212066 - RNA, 21 nt, Homo sapiens
caucacauuacucaaaguccu

SEQ ID NO: 212067 - RNA, 22 nt, Homo sapiens
caucacauucugagauacugag

SEQ ID NO: 212068 - RNA, 20 nt, Homo sapiens
caucaccuggcaggauuugu

SEQ ID NO: 212069 - RNA, 22 nt, Homo sapiens
caucacuuuuccuuuuacagau

SEQ ID NO: 212070 - RNA, 22 nt, Homo sapiens
caugaaagacugaggaauugga

SEQ ID NO: 212071 - RNA, 22 nt, Homo sapiens
caugacacuggcauguuucuuu

SEQ ID NO: 212072 - RNA, 22 nt, Homo sapiens
uuucauccggcuguguauuaug

SEQ ID NO: 212073 - RNA, 22 nt, Homo sapiens
uuucauggagaaucuucuuacu

SEQ ID NO: 212074 - RNA, 22 nt, Homo sapiens
uuucauggaggcauuuuagauu

SEQ ID NO: 212075 - RNA, 22 nt, Homo sapiens
uuucauggcgaggcuucauggg

SEQ ID NO: 212076 - RNA, 18 nt, Homo sapiens
uuucauugagugugauau

SEQ ID NO: 212077 - RNA, 22 nt, Homo sapiens
uuuccaagaugcuuacuuucuc

SEQ ID NO: 212078 - RNA, 22 nt, Homo sapiens
uuuccacauggacuuaccuucg

SEQ ID NO: 212079 - RNA, 22 nt, Homo sapiens
uuuccauguuggugaaaugagg

SEQ ID NO: 212080 - RNA, 22 nt, Homo sapiens
uuucccugaaggcucugaaguc

SEQ ID NO: 212081 - RNA, 16 nt, Homo sapiens
uuucccuuugguguuu

SEQ ID NO: 212082 - RNA, 22 nt, Homo sapiens
uuuccuguaggaaggaaauaga

SEQ ID NO: 212083 - RNA, 20 nt, Homo sapiens
uuucuccccuauaaaucuca

SEQ ID NO: 212084 - RNA, 21 nt, Homo sapiens
uuucugggggagcauggcagg

SEQ ID NO: 212085 - RNA, 22 nt, Homo sapiens
uuucugggggugcugauggaaa

SEQ ID NO: 212086 - RNA, 19 nt, Homo sapiens
uuugaauauaaugcagcua

SEQ ID NO: 212087 - RNA, 22 nt, Homo sapiens
uuugaaugcaacaaaugcggga

SEQ ID NO: 212088 - RNA, 22 nt, Homo sapiens
uuugacaaugugugcuuguauu

SEQ ID NO: 212089 - RNA, 18 nt, Homo sapiens
uuugacugguguccuuau

SEQ ID NO: 212090 - RNA, 22 nt, Homo sapiens
uuugacuguggagucgaugcuu

SEQ ID NO: 212091 - RNA, 22 nt, Homo sapiens
uuugagcaagaggugacauuau

SEQ ID NO: 212092 - RNA, 22 nt, Homo sapiens
uuugagcaugcagauugccagg

SEQ ID NO: 212093 - RNA, 22 nt, Homo sapiens
uuugagcauggaaauggcauga

SEQ ID NO: 212094 - RNA, 22 nt, Homo sapiens
uuugagcauuagggcaaaggca

SEQ ID NO: 212095 - RNA, 22 nt, Homo sapiens
uuugagcuugacucagcuggag

SEQ ID NO: 212096 - RNA, 23 nt, Homo sapiens
uuugagugugauaaacacuguca

SEQ ID NO: 212097 - RNA, 21 nt, Homo sapiens
uuugaucauuaaaagugaauc

SEQ ID NO: 212098 - RNA, 22 nt, Homo sapiens
uuugauugguguaccugaaagu

SEQ ID NO: 212099 - RNA, 22 nt, Homo sapiens
uuugcaagaugaaaaaguucua

SEQ ID NO: 212100 - RNA, 22 nt, Homo sapiens
uuugcaauagguuguggggagg

SEQ ID NO: 212101 - RNA, 22 nt, Homo sapiens
uuugcacauauuugggcaaaag

SEQ ID NO: 212102 - RNA, 22 nt, Homo sapiens
uuugcacuugaaaacacucuca

SEQ ID NO: 212103 - RNA, 23 nt, Homo sapiens
uuugcacuugcuccuucuauggc

SEQ ID NO: 212104 - RNA, 22 nt, Homo sapiens
uuugcacuuuuguaauaugguu

SEQ ID NO: 212105 - RNA, 21 nt, Homo sapiens
uuugcauauguugaaccagcc

SEQ ID NO: 212106 - RNA, 22 nt, Homo sapiens
uuugcaugcuccuuaugagaau

SEQ ID NO: 212107 - RNA, 23 nt, Homo sapiens
uuugccacuuauuagcugggagg

SEQ ID NO: 212108 - RNA, 22 nt, Homo sapiens
uuugccuuugugauauggucua

SEQ ID NO: 212109 - RNA, 22 nt, Homo sapiens
uuugcuaaucaacacuggccug

SEQ ID NO: 212110 - RNA, 22 nt, Homo sapiens
uuugcugagucugacuucaugg

SEQ ID NO: 212111 - RNA, 22 nt, Homo sapiens
uuugcuucacuguuuggcaaaa

SEQ ID NO: 212112 - RNA, 22 nt, Homo sapiens
uuuggaagaugccacuguauca

SEQ ID NO: 212113 - RNA, 22 nt, Homo sapiens
uuuggcagaaaacuaaaaggua

SEQ ID NO: 212114 - RNA, 22 nt, Homo sapiens
uuuggcauuaagaugcuguauc

SEQ ID NO: 212115 - RNA, 22 nt, Homo sapiens
uuuggcauuuuacuacucaaau

SEQ ID NO: 212116 - RNA, 22 nt, Homo sapiens
uuuggcccugagggauggcaua

SEQ ID NO: 212117 - RNA, 22 nt, Homo sapiens
uuuggcuuugagaagcagugga

SEQ ID NO: 212118 - RNA, 22 nt, Homo sapiens
uuugggccauggcuuuuccacg

SEQ ID NO: 212119 - RNA, 22 nt, Homo sapiens
uuuggguuuuauguaacagcua

SEQ ID NO: 212120 - RNA, 22 nt, Homo sapiens
uuugguaguuuguugggaccca

SEQ ID NO: 212121 - RNA, 22 nt, Homo sapiens
uuuggucuuuuauuuaaagcag

SEQ ID NO: 212122 - RNA, 22 nt, Homo sapiens
uuugguguauauguaaacuaug

SEQ ID NO: 212123 - RNA, 22 nt, Homo sapiens
uuugguuauauauauacacucu

SEQ ID NO: 212124 - RNA, 22 nt, Homo sapiens
uuuguacacuguuggugguuau

SEQ ID NO: 212125 - RNA, 22 nt, Homo sapiens
uuuguacugagccaagauggua

SEQ ID NO: 212126 - RNA, 22 nt, Homo sapiens
uuuguacuucauugguucuacu

SEQ ID NO: 212127 - RNA, 22 nt, Homo sapiens
uuuguacuugaaacccagggcc

SEQ ID NO: 212128 - RNA, 18 nt, Homo sapiens
uuuguacuuuuucuaaug

SEQ ID NO: 212129 - RNA, 22 nt, Homo sapiens
uuugucuccuaagacucugugg

SEQ ID NO: 212130 - RNA, 22 nt, Homo sapiens
uuugugaaugucauaagcucca

SEQ ID NO: 212131 - RNA, 22 nt, Homo sapiens
uuugugacacaaacacauauau

SEQ ID NO: 212132 - RNA, 22 nt, Homo sapiens
uuugugacuugcuucucagaau

SEQ ID NO: 212133 - RNA, 22 nt, Homo sapiens
uuugugcuaacuuuaacucuua

SEQ ID NO: 212134 - RNA, 22 nt, Homo sapiens
uuugugcuaaugcuagauuacu

SEQ ID NO: 212135 - RNA, 22 nt, Homo sapiens
uuugugugugauuauaaaaggu

SEQ ID NO: 212136 - RNA, 22 nt, Homo sapiens
uuuuacacaucaccgcucgugu

SEQ ID NO: 212137 - RNA, 22 nt, Homo sapiens
uuuuaguugcucagguauucuc

SEQ ID NO: 212138 - RNA, 22 nt, Homo sapiens
uuuuaugggcuauuugcauuag

SEQ ID NO: 212139 - RNA, 22 nt, Homo sapiens
uuuucaguuuuccagguagccg

SEQ ID NO: 212140 - RNA, 20 nt, Homo sapiens
uuuugaacuuggcaaccugu

SEQ ID NO: 212141 - RNA, 22 nt, Homo sapiens
uuuugcaccauccuaauaguau

SEQ ID NO: 212142 - RNA, 20 nt, Homo sapiens
uuuugcacuccuacuaaggu

SEQ ID NO: 212143 - RNA, 22 nt, Homo sapiens
uuuugcaggcauuggaaguuua

SEQ ID NO: 212144 - RNA, 22 nt, Homo sapiens
uuuugcaggucaggggcagaga

SEQ ID NO: 212145 - RNA, 22 nt, Homo sapiens
uuuugcuccuggcaaacucaua

SEQ ID NO: 212146 - RNA, 19 nt, Homo sapiens
uuuuggaaaugugaacagc

SEQ ID NO: 212147 - RNA, 22 nt, Homo sapiens
uuuuggcucugucuguaucuuu

SEQ ID NO: 212148 - RNA, 22 nt, Homo sapiens
uuuuggcuuuuccucagcaagc

SEQ ID NO: 212149 - RNA, 22 nt, Homo sapiens
uuuugggggugauucacacagu

SEQ ID NO: 212150 - RNA, 22 nt, Homo sapiens
uuuugguauaugcaggggucuu

SEQ ID NO: 212151 - RNA, 21 nt, Homo sapiens
uuuuggucauucaggaagaaa

SEQ ID NO: 212152 - RNA, 22 nt, Homo sapiens
uuuugguguauuguauaaggua

SEQ ID NO: 212153 - RNA, 22 nt, Homo sapiens
uuuuguacgccuguguccauca

SEQ ID NO: 212154 - RNA, 22 nt, Homo sapiens
uuuuucacuuaaguuaggcuca

SEQ ID NO: 212155 - RNA, 22 nt, Homo sapiens
uuuuugagaauuggugaaacac

SEQ ID NO: 212156 - RNA, 18 nt, Homo sapiens
uuuuugaggcacagggga

SEQ ID NO: 212157 - RNA, 22 nt, Homo sapiens
uuuuuggguaaugauuaucaau

SEQ ID NO: 212158 - RNA, 22 nt, Homo sapiens
uuuuugguugguaggcuauuaa

SEQ ID NO: 212159 - RNA, 22 nt, Homo sapiens
uuuuuugcuguaugcaaacauc

SEQ ID NO: 212160 - RNA, 22 nt, Homo sapiens
gugcacaaaucuuaaauguaca

SEQ ID NO: 212161 - RNA, 22 nt, Homo sapiens
gugcacaacaugcagguuuguu

SEQ ID NO: 212162 - RNA, 22 nt, Homo sapiens
gugcacaacaugcaguuuuguu

SEQ ID NO: 212163 - RNA, 22 nt, Homo sapiens
gugcacaacgugcaggcuuguu

SEQ ID NO: 212164 - RNA, 22 nt, Homo sapiens
gugcacaaugugcagguuuguu

SEQ ID NO: 212165 - RNA, 22 nt, Homo sapiens
gugcaguguuugcauggaauca

SEQ ID NO: 212166 - RNA, 22 nt, Homo sapiens
gugcaguuuacaguuacccagu

SEQ ID NO: 212167 - RNA, 22 nt, Homo sapiens
gugcaguuuugagugaguuucu

SEQ ID NO: 212168 - RNA, 22 nt, Homo sapiens
gugcauaucugugguuggcuga

SEQ ID NO: 212169 - RNA, 22 nt, Homo sapiens
gugcauguccacuaguccauau

SEQ ID NO: 212170 - RNA, 22 nt, Homo sapiens
gugccacugcacuccggccugg

SEQ ID NO: 212171 - RNA, 23 nt, Homo sapiens
gugccuucugagccuagucucca

SEQ ID NO: 212172 - RNA, 22 nt, Homo sapiens
gugcuuauccccauucuggagg

SEQ ID NO: 212173 - RNA, 22 nt, Homo sapiens
guggaaaacauaugcuuguuga

SEQ ID NO: 212174 - RNA, 22 nt, Homo sapiens
guggaaaauuauugcuguuuuu

SEQ ID NO: 212175 - RNA, 22 nt, Homo sapiens
guggaagauaguguguuaaugu

SEQ ID NO: 212176 - RNA, 22 nt, Homo sapiens
guggaagucuuugguauuggua

SEQ ID NO: 212177 - RNA, 22 nt, Homo sapiens
guggaagugucuggggccaggg

SEQ ID NO: 212178 - RNA, 22 nt, Homo sapiens
guggaaguuaagugacuuucug

SEQ ID NO: 212179 - RNA, 22 nt, Homo sapiens
guggaauggaaugauuguguau

SEQ ID NO: 212180 - RNA, 17 nt, Homo sapiens
guggaaugucaugucaa

SEQ ID NO: 212181 - RNA, 22 nt, Homo sapiens
guggacagagacuaaauguugu

SEQ ID NO: 212182 - RNA, 22 nt, Homo sapiens
guggaucacuugaggucaagag

SEQ ID NO: 212183 - RNA, 22 nt, Homo sapiens
guggaucacuugagguuagaag

SEQ ID NO: 212184 - RNA, 22 nt, Homo sapiens
guggcagagucagagggaaaug

SEQ ID NO: 212185 - RNA, 22 nt, Homo sapiens
guggcgagaucauagcucauug

SEQ ID NO: 212186 - RNA, 22 nt, Homo sapiens
guggcuuuauuuagaagcaggg

SEQ ID NO: 212187 - RNA, 22 nt, Homo sapiens
gugggcucguucguguuagaca

SEQ ID NO: 212188 - RNA, 22 nt, Homo sapiens
guggguaaaucucuguuugagg

SEQ ID NO: 212189 - RNA, 22 nt, Homo sapiens
gugguaguagaauuucggaaau

SEQ ID NO: 212190 - RNA, 22 nt, Homo sapiens
guggucagaaaucucaguggca

SEQ ID NO: 212191 - RNA, 22 nt, Homo sapiens
gugguuuuacaaagagaaagau

SEQ ID NO: 212192 - RNA, 22 nt, Homo sapiens
gugguuuuuaaaguaccugugg

SEQ ID NO: 212193 - RNA, 22 nt, Homo sapiens
gugguuuuuuucugccuuauag

SEQ ID NO: 212194 - RNA, 22 nt, Homo sapiens
guguaaaucaaucuguugucuu

SEQ ID NO: 212195 - RNA, 22 nt, Homo sapiens
guguaacaacagcacuccacug

SEQ ID NO: 212196 - RNA, 22 nt, Homo sapiens
guguaaguccugaguuuggaua

SEQ ID NO: 212197 - RNA, 22 nt, Homo sapiens
guguaauacacacauauaugca

SEQ ID NO: 212198 - RNA, 18 nt, Homo sapiens
guguauggauggaggcca

SEQ ID NO: 212199 - RNA, 22 nt, Homo sapiens
guguaugguaggaugacggagu

SEQ ID NO: 212200 - RNA, 22 nt, Homo sapiens
gugucaaggaugccugucaggc

SEQ ID NO: 212201 - RNA, 22 nt, Homo sapiens
gugucaguggggagugaucuuc

SEQ ID NO: 212202 - RNA, 22 nt, Homo sapiens
gugucucagcccagaccuauuu

SEQ ID NO: 212203 - RNA, 18 nt, Homo sapiens
gugucugguuaugggagu

SEQ ID NO: 212204 - RNA, 22 nt, Homo sapiens
gugugaacaucauagaguguau

SEQ ID NO: 212205 - RNA, 22 nt, Homo sapiens
gugugacagcuauagacaugau

SEQ ID NO: 212206 - RNA, 22 nt, Homo sapiens
gugugacugcucuauuagggcg

SEQ ID NO: 212207 - RNA, 22 nt, Homo sapiens
gugugcacaaucuggcaugugc

SEQ ID NO: 212208 - RNA, 20 nt, Homo sapiens
gugugcauuucagauuuugg

SEQ ID NO: 212209 - RNA, 22 nt, Homo sapiens
guguggaacucaauacaacgca

SEQ ID NO: 212210 - RNA, 22 nt, Homo sapiens
guguggcaggugggggcucaga

SEQ ID NO: 212211 - RNA, 22 nt, Homo sapiens
guguucaaacccaggucugucu

SEQ ID NO: 212212 - RNA, 22 nt, Homo sapiens
guguucaaagcugauugagauu

SEQ ID NO: 212213 - RNA, 22 nt, Homo sapiens
guguuugguugauagagccacu

SEQ ID NO: 212214 - RNA, 22 nt, Homo sapiens
guuauccugucuuuacauacaa

SEQ ID NO: 212215 - RNA, 22 nt, Homo sapiens
guuauguaucuugauugggugg

SEQ ID NO: 212216 - RNA, 22 nt, Homo sapiens
guuauguuaaauuguuguaugc

SEQ ID NO: 212217 - RNA, 22 nt, Homo sapiens
guucacaguuucuaaucccagc

SEQ ID NO: 212218 - RNA, 22 nt, Homo sapiens
guucaucagggauauuggccug

SEQ ID NO: 212219 - RNA, 23 nt, Homo sapiens
guucaucagggauauuggccuga

SEQ ID NO: 212220 - RNA, 22 nt, Homo sapiens
guuccuuguagaugcuggauau

SEQ ID NO: 212221 - RNA, 22 nt, Homo sapiens
guugaacaauagauucauauca

SEQ ID NO: 212222 - RNA, 22 nt, Homo sapiens
guugacuaggagcuacuacuac

SEQ ID NO: 212223 - RNA, 18 nt, Homo sapiens
guugagcuuuuccuuuag

SEQ ID NO: 212224 - RNA, 22 nt, Homo sapiens
guugcaaaguaauugugguuuu

SEQ ID NO: 212225 - RNA, 22 nt, Homo sapiens
guugcaauugauguaugucuga

SEQ ID NO: 212226 - RNA, 22 nt, Homo sapiens
guugcagcacacaggcugucag

SEQ ID NO: 212227 - RNA, 22 nt, Homo sapiens
guugccuaggcuggucuugaac

SEQ ID NO: 212228 - RNA, 22 nt, Homo sapiens
guugcucaggccggagugcagu

SEQ ID NO: 212229 - RNA, 22 nt, Homo sapiens
guugcuuauuccuguaauccca

SEQ ID NO: 212230 - RNA, 22 nt, Homo sapiens
guuggcaagaggugcuguacac

SEQ ID NO: 212231 - RNA, 22 nt, Homo sapiens
guugguuuccuguaacuggaca

SEQ ID NO: 212232 - RNA, 22 nt, Homo sapiens
guuguggagucuucuguucugg

SEQ ID NO: 212233 - RNA, 22 nt, Homo sapiens
guuuacagucgacuugggaaua

SEQ ID NO: 212234 - RNA, 22 nt, Homo sapiens
guuuaggaaugagaauauuuag

SEQ ID NO: 212235 - RNA, 22 nt, Homo sapiens
guuugccuuuuagauaggaaug

SEQ ID NO: 212236 - RNA, 22 nt, Homo sapiens
guuuggauuuucuaauuucugu

SEQ ID NO: 212237 - RNA, 17 nt, Homo sapiens
guuuggguacuggguaa

SEQ ID NO: 212238 - RNA, 15 nt, Homo sapiens
guuuuuggauacaau

SEQ ID NO: 212239 - RNA, 22 nt, Homo sapiens
uaaacugcuugaaaugguguca

SEQ ID NO: 212240 - RNA, 22 nt, Homo sapiens
uaaacugucuuuggagcuuugc

SEQ ID NO: 212241 - RNA, 22 nt, Homo sapiens
uaaagagcuuuugaggugucau

SEQ ID NO: 212242 - RNA, 22 nt, Homo sapiens
uaaagccagugauuaugucucu

SEQ ID NO: 212243 - RNA, 22 nt, Homo sapiens
uaaagccauugucaaguuugua

SEQ ID NO: 212244 - RNA, 16 nt, Homo sapiens
uaaagcuaaucacuuu

SEQ ID NO: 212245 - RNA, 22 nt, Homo sapiens
uaaaguuauugccccucaguua

SEQ ID NO: 212246 - RNA, 20 nt, Homo sapiens
uaaaugccucaugcuuuauu

SEQ ID NO: 212247 - RNA, 22 nt, Homo sapiens
uaacaagagagucagucagucc

SEQ ID NO: 212248 - RNA, 22 nt, Homo sapiens
uaacaccuugcucugucaauaa

SEQ ID NO: 212249 - RNA, 22 nt, Homo sapiens
uaacaccuuugauagcacuuuu

SEQ ID NO: 212250 - RNA, 22 nt, Homo sapiens
uaacagcauuugugucuaguag

SEQ ID NO: 212251 - RNA, 22 nt, Homo sapiens
cuaagggaggaagcugugcagg

SEQ ID NO: 212252 - RNA, 22 nt, Homo sapiens
cuaagugaguauaauuuuaaga

SEQ ID NO: 212253 - RNA, 22 nt, Homo sapiens
cuaaucuagccuuauaaguauu

SEQ ID NO: 212254 - RNA, 22 nt, Homo sapiens
cuaaugcagucaggagaaggaa

SEQ ID NO: 212255 - RNA, 22 nt, Homo sapiens
cuaauucuggccaaagggauaa

SEQ ID NO: 212256 - RNA, 22 nt, Homo sapiens
cuacagaguaucuaaagaggua

SEQ ID NO: 212257 - RNA, 22 nt, Homo sapiens
cuacagcagcccaguccccgaa

SEQ ID NO: 212258 - RNA, 22 nt, Homo sapiens
cuacaguagagaggauguagaa

SEQ ID NO: 212259 - RNA, 22 nt, Homo sapiens
cuacagugggucuguaguccuu

SEQ ID NO: 212260 - RNA, 22 nt, Homo sapiens
cuacauuguagguauucaaacu

SEQ ID NO: 212261 - RNA, 21 nt, Homo sapiens
cuacccuguauuagagaaaga

SEQ ID NO: 212262 - RNA, 20 nt, Homo sapiens
uaagacaugguccacaugcc

SEQ ID NO: 212263 - RNA, 21 nt, Homo sapiens
uaagacugccaguagggcugu

SEQ ID NO: 212264 - RNA, 22 nt, Homo sapiens
uaagacuguuggcaauuuuugc

SEQ ID NO: 212265 - RNA, 22 nt, Homo sapiens
uaagacuuuuugggaauauaga

SEQ ID NO: 212266 - RNA, 22 nt, Homo sapiens
uaagaugaaggcucaccuagaa

SEQ ID NO: 212267 - RNA, 22 nt, Homo sapiens
uaagcaguguggauccaccuug

SEQ ID NO: 212268 - RNA, 16 nt, Homo sapiens
uaagccccacgugcau

SEQ ID NO: 212269 - RNA, 22 nt, Homo sapiens
uaagcuauagugaauaaauugc

SEQ ID NO: 212270 - RNA, 22 nt, Homo sapiens
uaaggcaaguuuuuaguggaca

SEQ ID NO: 212271 - RNA, 22 nt, Homo sapiens
uaaggcacuacuuuaggcuuuc

SEQ ID NO: 212272 - RNA, 22 nt, Homo sapiens
uaaggcauuuuuuugaguugca

SEQ ID NO: 212273 - RNA, 22 nt, Homo sapiens
uaaggcccggccuuuccaagca

SEQ ID NO: 212274 - RNA, 22 nt, Homo sapiens
uaaggcucuuguuauuuugagg

SEQ ID NO: 212275 - RNA, 22 nt, Homo sapiens
uaagguacuuuggagaaaacug

SEQ ID NO: 212276 - RNA, 22 nt, Homo sapiens
uaagguauuuacauuucuguuu

SEQ ID NO: 212277 - RNA, 22 nt, Homo sapiens
uaaguaauugcagcaauuugcc

SEQ ID NO: 212278 - RNA, 22 nt, Homo sapiens
uaaguacaugcuagauggaaug

SEQ ID NO: 212279 - RNA, 22 nt, Homo sapiens
uaaguauuaugugcugcauuuu

SEQ ID NO: 212280 - RNA, 22 nt, Homo sapiens
uaagugaauauggacaguuagc

SEQ ID NO: 212281 - RNA, 22 nt, Homo sapiens
uaagugaauguuggcuacugaa

SEQ ID NO: 212282 - RNA, 22 nt, Homo sapiens
uaagugacuuugagauuccuca

SEQ ID NO: 212283 - RNA, 22 nt, Homo sapiens
uaagugcuugacuuugauguuu

SEQ ID NO: 212284 - RNA, 22 nt, Homo sapiens
uaaguugcagguugugauucca

SEQ ID NO: 212285 - RNA, 21 nt, Homo sapiens
uaauaaugucucagacaccua

SEQ ID NO: 212286 - RNA, 22 nt, Homo sapiens
uaauacauucaaggugguaguu

SEQ ID NO: 212287 - RNA, 22 nt, Homo sapiens
uaauaguuggcacuggagaaag

SEQ ID NO: 212288 - RNA, 22 nt, Homo sapiens
uaauaugugguugcuugggcac

SEQ ID NO: 212289 - RNA, 22 nt, Homo sapiens
uaauauguuuugaaaucaggaa

SEQ ID NO: 212290 - RNA, 22 nt, Homo sapiens
uaaucucagcugagcugagauu

SEQ ID NO: 212291 - RNA, 22 nt, Homo sapiens
uaaugcacauuuauuuuaccuu

SEQ ID NO: 212292 - RNA, 22 nt, Homo sapiens
uaaugcacucgaaucauggaau

SEQ ID NO: 212293 - RNA, 22 nt, Homo sapiens
uaaugcuccauggguuauuaaa

SEQ ID NO: 212294 - RNA, 22 nt, Homo sapiens
uaaugguuuugcaccaucccuc

SEQ ID NO: 212295 - RNA, 22 nt, Homo sapiens
uaaugugaauagugcuguaaug

SEQ ID NO: 212296 - RNA, 22 nt, Homo sapiens
uacaaagcuacucgagggcagg

SEQ ID NO: 212297 - RNA, 22 nt, Homo sapiens
uacaaaucuagguuuguuacug

SEQ ID NO: 212298 - RNA, 22 nt, Homo sapiens
uacaaguaauaagggaagaauu

SEQ ID NO: 212299 - RNA, 22 nt, Homo sapiens
uacaaguauuuuuauuagugcc

SEQ ID NO: 212300 - RNA, 16 nt, Homo sapiens
uacaauguagaaaaca

SEQ ID NO: 212301 - RNA, 22 nt, Homo sapiens
uacacacguguguauauauaca

SEQ ID NO: 212302 - RNA, 22 nt, Homo sapiens
uacacagucaaaaauuuccagg

SEQ ID NO: 212303 - RNA, 22 nt, Homo sapiens
uacagaauugcagguguggcag

SEQ ID NO: 212304 - RNA, 22 nt, Homo sapiens
uacagaucaguuauuuuguaga

SEQ ID NO: 212305 - RNA, 22 nt, Homo sapiens
uacagccacauaauguaugauu

SEQ ID NO: 212306 - RNA, 23 nt, Homo sapiens
uacagcugcagaaucaggcuaag

SEQ ID NO: 212307 - RNA, 22 nt, Homo sapiens
uacaggacuucucagaguuauu

SEQ ID NO: 212308 - RNA, 22 nt, Homo sapiens
uacagguaugugucuauauaca

SEQ ID NO: 212309 - RNA, 22 nt, Homo sapiens
uacaguaauguuaaucuuugug

SEQ ID NO: 212310 - RNA, 22 nt, Homo sapiens
uacaguaggauuuucagggucu

SEQ ID NO: 212311 - RNA, 22 nt, Homo sapiens
uacagugcuugguaucuaguaa

SEQ ID NO: 212312 - RNA, 22 nt, Homo sapiens
uacaguguuuugguauuccaca

SEQ ID NO: 212313 - RNA, 22 nt, Homo sapiens
uacauaguaagcacuaugccaa

SEQ ID NO: 212314 - RNA, 22 nt, Homo sapiens
uacaugcaugggcaugugugca

SEQ ID NO: 212315 - RNA, 22 nt, Homo sapiens
uacaugugcacaacgugcaggu

SEQ ID NO: 212316 - RNA, 22 nt, Homo sapiens
uacauuggcuagguuuggaggc

SEQ ID NO: 212317 - RNA, 22 nt, Homo sapiens
uaccacccuuuuuccagaagcc

SEQ ID NO: 212318 - RNA, 22 nt, Homo sapiens
uaccaguaaugguucuagagga

SEQ ID NO: 212319 - RNA, 22 nt, Homo sapiens
uaccagugaauuccaggggcua

SEQ ID NO: 212320 - RNA, 22 nt, Homo sapiens
uaccauguaucugggaugcuuu

SEQ ID NO: 212321 - RNA, 22 nt, Homo sapiens
uaccauguauguuucuccauug

SEQ ID NO: 212322 - RNA, 19 nt, Homo sapiens
uacccagaagcagcauugu

SEQ ID NO: 212323 - RNA, 22 nt, Homo sapiens
uaccucagccaaugcccagaag

SEQ ID NO: 212324 - RNA, 23 nt, Homo sapiens
uaccugagacuggguaauuaaua

SEQ ID NO: 212325 - RNA, 22 nt, Homo sapiens
uaccuuugucaguuacucaccu

SEQ ID NO: 212326 - RNA, 22 nt, Homo sapiens
uacgccuguaauaucagcauuu

SEQ ID NO: 212327 - RNA, 22 nt, Homo sapiens
uacguguauuguuuucacaaga

SEQ ID NO: 212328 - RNA, 22 nt, Homo sapiens
uacuagaaccuuauucagagug

SEQ ID NO: 212329 - RNA, 23 nt, Homo sapiens
uacuaguaagcguguucuuugca

SEQ ID NO: 212330 - RNA, 22 nt, Homo sapiens
uacucacauucuguuucuugcu

SEQ ID NO: 212331 - RNA, 22 nt, Homo sapiens
uacucaguagacacucauaugu

SEQ ID NO: 212332 - RNA, 22 nt, Homo sapiens
uacucaguagucuguugcuguc

SEQ ID NO: 212333 - RNA, 22 nt, Homo sapiens
uacucugcaguaauuccagccc

SEQ ID NO: 212334 - RNA, 22 nt, Homo sapiens
uacugcacuccaaccugagaga

SEQ ID NO: 212335 - RNA, 22 nt, Homo sapiens
uacugcacuccacccuggguga

SEQ ID NO: 212336 - RNA, 20 nt, Homo sapiens
uacugcacuccauccugggu

SEQ ID NO: 212337 - RNA, 20 nt, Homo sapiens
uacugcacuuuccucauggu

SEQ ID NO: 212338 - RNA, 22 nt, Homo sapiens
uacugcaguugcagcuugagga

SEQ ID NO: 212339 - RNA, 22 nt, Homo sapiens
uacugcaucgaaaugcuuuuau

SEQ ID NO: 212340 - RNA, 22 nt, Homo sapiens
uacugcuaccuccagcuucugg

SEQ ID NO: 212341 - RNA, 22 nt, Homo sapiens
uacugcuuaaaagucaauuacu

SEQ ID NO: 212342 - RNA, 21 nt, Homo sapiens
uacuggagauacagucugcaa

SEQ ID NO: 212343 - RNA, 22 nt, Homo sapiens
uacuguacugcaguucugcaaa

SEQ ID NO: 212344 - RNA, 20 nt, Homo sapiens
uagaaaguagaguggugguu

SEQ ID NO: 212345 - RNA, 22 nt, Homo sapiens
uagaagcacuaucccuccuagu

SEQ ID NO: 212346 - RNA, 18 nt, Homo sapiens
uagaauauaggucauucu

SEQ ID NO: 212347 - RNA, 22 nt, Homo sapiens
uagacacugcauauuuuuuuaa

SEQ ID NO: 212348 - RNA, 22 nt, Homo sapiens
uagaccauucuauuuccuaugc

SEQ ID NO: 212349 - RNA, 22 nt, Homo sapiens
uagacccauuguucagagagug

SEQ ID NO: 212350 - RNA, 22 nt, Homo sapiens
uagacuguaagauccaggagag

SEQ ID NO: 212351 - RNA, 22 nt, Homo sapiens
uagagcaaugacucuggaaacc

SEQ ID NO: 212352 - RNA, 22 nt, Homo sapiens
uagagcacauuaucauuuccaa

SEQ ID NO: 212353 - RNA, 22 nt, Homo sapiens
uagagcaugugccauacguaca

SEQ ID NO: 212354 - RNA, 22 nt, Homo sapiens
uagagcuagggacucgcaaugu

SEQ ID NO: 212355 - RNA, 22 nt, Homo sapiens
uagaggaaggauuggaaacgca

SEQ ID NO: 212356 - RNA, 22 nt, Homo sapiens
uagaguguuuuguuaggcagca

SEQ ID NO: 212357 - RNA, 21 nt, Homo sapiens
uagauacuguauuaaaccuag

SEQ ID NO: 212358 - RNA, 22 nt, Homo sapiens
uagaucaacuuugguaagagaa

SEQ ID NO: 212359 - RNA, 22 nt, Homo sapiens
uagaugauucacuuuacuucca

SEQ ID NO: 212360 - RNA, 22 nt, Homo sapiens
uagauuauuggcugauuugauc

SEQ ID NO: 212361 - RNA, 21 nt, Homo sapiens
uagcaaauugcuauuaaggca

SEQ ID NO: 212362 - RNA, 23 nt, Homo sapiens
uagcaacaguuggaggugaggua

SEQ ID NO: 212363 - RNA, 22 nt, Homo sapiens
uagcacaucccuaaaaugcugu

SEQ ID NO: 212364 - RNA, 22 nt, Homo sapiens
cuacugacacuacugcaaucau

SEQ ID NO: 212365 - RNA, 22 nt, Homo sapiens
cuagagagaagcugugugaccu

SEQ ID NO: 212366 - RNA, 22 nt, Homo sapiens
cuagaggcacagccuaggcacu

SEQ ID NO: 212367 - RNA, 22 nt, Homo sapiens
cuagaguacuuaccacagcaug

SEQ ID NO: 212368 - RNA, 22 nt, Homo sapiens
cuagaguagaguuuccuuagga

SEQ ID NO: 212369 - RNA, 22 nt, Homo sapiens
cuagcacauaguuauucacuca

SEQ ID NO: 212370 - RNA, 22 nt, Homo sapiens
cuagcagacacuuccagagagu

SEQ ID NO: 212371 - RNA, 22 nt, Homo sapiens
cuagcuuuugauguaaagugag

SEQ ID NO: 212372 - RNA, 22 nt, Homo sapiens
cuagucacauuuucaucaaaua

SEQ ID NO: 212373 - RNA, 22 nt, Homo sapiens
cuauaugucuguuuugguacca

SEQ ID NO: 212374 - RNA, 22 nt, Homo sapiens
cuaucucauugguuuuugaaag

SEQ ID NO: 212375 - RNA, 22 nt, Homo sapiens
cuaugagcuuuuuuaagccuca

SEQ ID NO: 212376 - RNA, 22 nt, Homo sapiens
cuauggcagccacggccuggag

SEQ ID NO: 212377 - RNA, 22 nt, Homo sapiens
cuaugguuucuccauaucauca

SEQ ID NO: 212378 - RNA, 22 nt, Homo sapiens
cuauucacaggcaauauguaca

SEQ ID NO: 212379 - RNA, 20 nt, Homo sapiens
cuauugacauuuggggcuag

SEQ ID NO: 212380 - RNA, 21 nt, Homo sapiens
cucaaaguacugauauuacag

SEQ ID NO: 212381 - RNA, 22 nt, Homo sapiens
cucaaagugcuaagauuaggcu

SEQ ID NO: 212382 - RNA, 19 nt, Homo sapiens
cucaaagugguauuuggag

SEQ ID NO: 212383 - RNA, 22 nt, Homo sapiens
cucaauuuggaauugucaguaa

SEQ ID NO: 212384 - RNA, 22 nt, Homo sapiens
cucacaguucuaaaggcaagaa

SEQ ID NO: 212385 - RNA, 20 nt, Homo sapiens
cucaccagguguaggcugag

SEQ ID NO: 212386 - RNA, 22 nt, Homo sapiens
cucaccuugugauccacccacc

SEQ ID NO: 212387 - RNA, 22 nt, Homo sapiens
cucacuaggaaguaaaguuugu

SEQ ID NO: 212388 - RNA, 22 nt, Homo sapiens
cucacugggaccacucugaagu

SEQ ID NO: 212389 - RNA, 22 nt, Homo sapiens
cucacuggguguaaaacaugua

SEQ ID NO: 212390 - RNA, 22 nt, Homo sapiens
cucagagcacaguuuaugacag

SEQ ID NO: 212391 - RNA, 20 nt, Homo sapiens
cucagauuauucugaagcaa

SEQ ID NO: 212392 - RNA, 22 nt, Homo sapiens
cucagcaguggauuuaccacca

SEQ ID NO: 212393 - RNA, 22 nt, Homo sapiens
cucaggcacucugauuccagug

SEQ ID NO: 212394 - RNA, 22 nt, Homo sapiens
cucaggguacuucuccuuugcu

SEQ ID NO: 212395 - RNA, 22 nt, Homo sapiens
cucagugguugauuuauuuauc

SEQ ID NO: 212396 - RNA, 22 nt, Homo sapiens
cucagugucuggcacacagaaa

SEQ ID NO: 212397 - RNA, 22 nt, Homo sapiens
cucaguguuucagcugcucaga

SEQ ID NO: 212398 - RNA, 21 nt, Homo sapiens
cucauauugcuuuuccauggu

SEQ ID NO: 212399 - RNA, 22 nt, Homo sapiens
cucaugcugucuucugggguaa

SEQ ID NO: 212400 - RNA, 22 nt, Homo sapiens
cucauggaauacuucacagcca

SEQ ID NO: 212401 - RNA, 22 nt, Homo sapiens
cucauggagaacaucugcuagg

SEQ ID NO: 212402 - RNA, 22 nt, Homo sapiens
cucauggagauagagaauagaa

SEQ ID NO: 212403 - RNA, 22 nt, Homo sapiens
cuccaggugagguuaagggacu

SEQ ID NO: 212404 - RNA, 22 nt, Homo sapiens
cuccaguuucagaaucccaugu

SEQ ID NO: 212405 - RNA, 22 nt, Homo sapiens
cuccaugagauuguugaaguag

SEQ ID NO: 212406 - RNA, 23 nt, Homo sapiens
cuccaugagccguccagggccug

SEQ ID NO: 212407 - RNA, 22 nt, Homo sapiens
cuccuugauuagaguauagagu

SEQ ID NO: 212408 - RNA, 22 nt, Homo sapiens
cucgagagaaaaugcuucacug

SEQ ID NO: 212409 - RNA, 22 nt, Homo sapiens
cucgcuccauuucggugaucaa

SEQ ID NO: 212410 - RNA, 22 nt, Homo sapiens
cucucaagaugcugggauuaca

SEQ ID NO: 212411 - RNA, 22 nt, Homo sapiens
cucucaguugucuaauuaguuu

SEQ ID NO: 212412 - RNA, 22 nt, Homo sapiens
cucucugagccccagacaccuu

SEQ ID NO: 212413 - RNA, 22 nt, Homo sapiens
cucugacagugguuagcacugu

SEQ ID NO: 212414 - RNA, 22 nt, Homo sapiens
cucugguuaaggcugaacuaua

SEQ ID NO: 212415 - RNA, 20 nt, Homo sapiens
cucugguugugaauugucuu

SEQ ID NO: 212416 - RNA, 22 nt, Homo sapiens
cucuuugcuucuggcaucauug

SEQ ID NO: 212417 - RNA, 22 nt, Homo sapiens
cucuuuuguuccuaguuugauc

SEQ ID NO: 212418 - RNA, 22 nt, Homo sapiens
cugaaagagcauguaacacagu

SEQ ID NO: 212419 - RNA, 22 nt, Homo sapiens
cugaaagguauacgcuuguuau

SEQ ID NO: 212420 - RNA, 22 nt, Homo sapiens
cugaaauggaaugugugcacag

SEQ ID NO: 212421 - RNA, 22 nt, Homo sapiens
cugaaauguccaucgacugaug

SEQ ID NO: 212422 - RNA, 22 nt, Homo sapiens
cugaaggcagguagaauagaga

SEQ ID NO: 212423 - RNA, 22 nt, Homo sapiens
cugaagugcuugccacauaaaa

SEQ ID NO: 212424 - RNA, 22 nt, Homo sapiens
cugaauguccaggcagagguuu

SEQ ID NO: 212425 - RNA, 22 nt, Homo sapiens
cugaauguucuggauggaagag

SEQ ID NO: 212426 - RNA, 22 nt, Homo sapiens
cugacacuucaaaacugccaau

SEQ ID NO: 212427 - RNA, 22 nt, Homo sapiens
cugacagucucauugauuugcu

SEQ ID NO: 212428 - RNA, 17 nt, Homo sapiens
cugaccucauuguguac

SEQ ID NO: 212429 - RNA, 22 nt, Homo sapiens
cugacguguuuuccagaccuuu

SEQ ID NO: 212430 - RNA, 22 nt, Homo sapiens
cugacucagacacauguauaug

SEQ ID NO: 212431 - RNA, 22 nt, Homo sapiens
cugacuuauguggacuauuuca

SEQ ID NO: 212432 - RNA, 22 nt, Homo sapiens
cugagaagaaacagguaaggac

SEQ ID NO: 212433 - RNA, 22 nt, Homo sapiens
cugagaaugaugauuuccaguu

SEQ ID NO: 212434 - RNA, 22 nt, Homo sapiens
cugagagaugagaccucucacu

SEQ ID NO: 212435 - RNA, 22 nt, Homo sapiens
cugagagugguauguuuaagug

SEQ ID NO: 212436 - RNA, 22 nt, Homo sapiens
cugagaucugaaccaggagugu

SEQ ID NO: 212437 - RNA, 22 nt, Homo sapiens
cugagaucuuauuagaaaugca

SEQ ID NO: 212438 - RNA, 22 nt, Homo sapiens
cugagauggagucucgcauugu

SEQ ID NO: 212439 - RNA, 22 nt, Homo sapiens
cugagcaaaaugaagacacgau

SEQ ID NO: 212440 - RNA, 22 nt, Homo sapiens
cugagcaaaguucuauuuaugg

SEQ ID NO: 212441 - RNA, 22 nt, Homo sapiens
cugagcccauucuggggagaag

SEQ ID NO: 212442 - RNA, 22 nt, Homo sapiens
cugagcucauuucuuuugcuac

SEQ ID NO: 212443 - RNA, 22 nt, Homo sapiens
cugagguaauuuguugccagua

SEQ ID NO: 212444 - RNA, 22 nt, Homo sapiens
cugagguacccacuucaucuca

SEQ ID NO: 212445 - RNA, 22 nt, Homo sapiens
cugagguacugggggccaggau

SEQ ID NO: 212446 - RNA, 22 nt, Homo sapiens
cugagguagcucaggguauugc

SEQ ID NO: 212447 - RNA, 22 nt, Homo sapiens
cugagguaggugaucagugcuu

SEQ ID NO: 212448 - RNA, 22 nt, Homo sapiens
cugaggugggagaaucacauaa

SEQ ID NO: 212449 - RNA, 22 nt, Homo sapiens
cugagguuaggaguuugagacc

SEQ ID NO: 212450 - RNA, 22 nt, Homo sapiens
cugauauuuuucuggcuugugu

SEQ ID NO: 212451 - RNA, 22 nt, Homo sapiens
cugauguagguggucugugauc

SEQ ID NO: 212452 - RNA, 22 nt, Homo sapiens
cugauuguagagccccagggcu

SEQ ID NO: 212453 - RNA, 22 nt, Homo sapiens
cugauugucaucaauauuauua

SEQ ID NO: 212454 - RNA, 22 nt, Homo sapiens
cugcaagaugcauaggaauuuu

SEQ ID NO: 212455 - RNA, 22 nt, Homo sapiens
ugccagaugcaguguucaacaa

SEQ ID NO: 212456 - RNA, 22 nt, Homo sapiens
ugccaguguugccuuucacuag

SEQ ID NO: 212457 - RNA, 22 nt, Homo sapiens
ugcccuguaucccacuguuuca

SEQ ID NO: 212458 - RNA, 20 nt, Homo sapiens
ugccugacacucuuugcuuc

SEQ ID NO: 212459 - RNA, 21 nt, Homo sapiens
ugccuuuguaguaggugucuu

SEQ ID NO: 212460 - RNA, 22 nt, Homo sapiens
ugccuuuguucuggaaugggaa

SEQ ID NO: 212461 - RNA, 21 nt, Homo sapiens
ugcgauccucaauccucuguu

SEQ ID NO: 212462 - RNA, 21 nt, Homo sapiens
ugcuauguuguccaggcuggc

SEQ ID NO: 212463 - RNA, 18 nt, Homo sapiens
ugcuccccugggugagca

SEQ ID NO: 212464 - RNA, 23 nt, Homo sapiens
ugcucgguguugacagucacauc

SEQ ID NO: 212465 - RNA, 22 nt, Homo sapiens
ugcugaguguuaccggacaccg

SEQ ID NO: 212466 - RNA, 22 nt, Homo sapiens
ugcugcacaguucuuaagauua

SEQ ID NO: 212467 - RNA, 22 nt, Homo sapiens
ugcugcacuuauggcucugagg

SEQ ID NO: 212468 - RNA, 22 nt, Homo sapiens
ugcugcauuggggauuaaguuu

SEQ ID NO: 212469 - RNA, 19 nt, Homo sapiens
ugcugcauugugaccuugc

SEQ ID NO: 212470 - RNA, 22 nt, Homo sapiens
ugcugguggucccauaugauua

SEQ ID NO: 212471 - RNA, 22 nt, Homo sapiens
ugcuggugucaucaaggcuuug

SEQ ID NO: 212472 - RNA, 22 nt, Homo sapiens
ugcuguguugcuggcuuaaaga

SEQ ID NO: 212473 - RNA, 21 nt, Homo sapiens
uaugagucugcaagaaccaca

SEQ ID NO: 212474 - RNA, 22 nt, Homo sapiens
uaugcacuauggaaguagcuca

SEQ ID NO: 212475 - RNA, 19 nt, Homo sapiens
uaugcuauuuauuagaagu

SEQ ID NO: 212476 - RNA, 22 nt, Homo sapiens
uauggauauuacuccacaaaga

SEQ ID NO: 212477 - RNA, 22 nt, Homo sapiens
uauggauuuucagauucuuauc

SEQ ID NO: 212478 - RNA, 22 nt, Homo sapiens
uauggcauuuuguaagggcuug

SEQ ID NO: 212479 - RNA, 17 nt, Homo sapiens
uauggcuauguuuagau

SEQ ID NO: 212480 - RNA, 22 nt, Homo sapiens
uaugggcuuuguuuuguacuag

SEQ ID NO: 212481 - RNA, 22 nt, Homo sapiens
ugaguauguuuaaugugacaau

SEQ ID NO: 212482 - RNA, 23 nt, Homo sapiens
ugagucacuuugcuggggucucu

SEQ ID NO: 212483 - RNA, 22 nt, Homo sapiens
ugagucuguucucacauugcua

SEQ ID NO: 212484 - RNA, 22 nt, Homo sapiens
ugagugaaagaagcacuaagga

SEQ ID NO: 212485 - RNA, 22 nt, Homo sapiens
ugagugaggcugggcagucccu

SEQ ID NO: 212486 - RNA, 21 nt, Homo sapiens
ugagugcugagugaggguuga

SEQ ID NO: 212487 - RNA, 22 nt, Homo sapiens
ugaguggagacuguguguagag

SEQ ID NO: 212488 - RNA, 22 nt, Homo sapiens
ugaguguccaaguaaggugaaa

SEQ ID NO: 212489 - RNA, 22 nt, Homo sapiens
ugaguuccuugugugaccuugc

SEQ ID NO: 212490 - RNA, 20 nt, Homo sapiens
ugaguuccuuguucagaagc

SEQ ID NO: 212491 - RNA, 22 nt, Homo sapiens
ugaguucuuccaccgggaccag

SEQ ID NO: 212492 - RNA, 22 nt, Homo sapiens
ugauaagugagauagcaaguga

SEQ ID NO: 212493 - RNA, 22 nt, Homo sapiens
ugauagaucugggcaaaguaaa

SEQ ID NO: 212494 - RNA, 22 nt, Homo sapiens
ugauauauugaaugaugaaaca

SEQ ID NO: 212495 - RNA, 22 nt, Homo sapiens
ugauaucucuugccuccaaaug

SEQ ID NO: 212496 - RNA, 22 nt, Homo sapiens
ugauaucugaucauccuugaua

SEQ ID NO: 212497 - RNA, 22 nt, Homo sapiens
ugauaugaaucaaucacucuuc

SEQ ID NO: 212498 - RNA, 22 nt, Homo sapiens
ugauaugcuuugaacucucugg

SEQ ID NO: 212499 - RNA, 22 nt, Homo sapiens
ugacuaaaacugaguuucauua

SEQ ID NO: 212500 - RNA, 22 nt, Homo sapiens
ugacuaaggaaggauuaugugc

SEQ ID NO: 212501 - RNA, 22 nt, Homo sapiens
ugacuacacacaauuugucaag

SEQ ID NO: 212502 - RNA, 22 nt, Homo sapiens
ugacuacaccacacgguuaagg

SEQ ID NO: 212503 - RNA, 22 nt, Homo sapiens
ugacuaggaggcuggaggauga

SEQ ID NO: 212504 - RNA, 22 nt, Homo sapiens
ugacuauaguaaucacuucaca

SEQ ID NO: 212505 - RNA, 22 nt, Homo sapiens
ugacucaagagccugacucauc

SEQ ID NO: 212506 - RNA, 22 nt, Homo sapiens
ugacuggaaacaguguuauuug

SEQ ID NO: 212507 - RNA, 22 nt, Homo sapiens
ugacuggagucuugcucugucg

SEQ ID NO: 212508 - RNA, 20 nt, Homo sapiens
ugacuggauacccuuuggcu

SEQ ID NO: 212509 - RNA, 22 nt, Homo sapiens
ugacuuaugcaacucugaugug

SEQ ID NO: 212510 - RNA, 22 nt, Homo sapiens
ugacuucauuugguaauugggu

SEQ ID NO: 212511 - RNA, 22 nt, Homo sapiens
ugacuugaaacgugaacagauc

SEQ ID NO: 212512 - RNA, 22 nt, Homo sapiens
ugacuugaacuucuaugucacc

SEQ ID NO: 212513 - RNA, 16 nt, Homo sapiens
ugagaacaugugauau

SEQ ID NO: 212514 - RNA, 18 nt, Homo sapiens
ugagaacauguguacaca

SEQ ID NO: 212515 - RNA, 19 nt, Homo sapiens
ugagaaccucuacagaguc

SEQ ID NO: 212516 - RNA, 22 nt, Homo sapiens
ugagaaccucugugugcccacu

SEQ ID NO: 212517 - RNA, 22 nt, Homo sapiens
ugagaacuaaaaugugguauau

SEQ ID NO: 212518 - RNA, 22 nt, Homo sapiens
ugagaacugcagggagcugcau

SEQ ID NO: 212519 - RNA, 22 nt, Homo sapiens
ugagaaugacugggcaugcugc

SEQ ID NO: 212520 - RNA, 22 nt, Homo sapiens
ugagaaugaugauuuccaguuu

SEQ ID NO: 212521 - RNA, 19 nt, Homo sapiens
ugagaauguuaccaggucc

SEQ ID NO: 212522 - RNA, 21 nt, Homo sapiens
ugagacaauccuggucaauau

SEQ ID NO: 212523 - RNA, 22 nt, Homo sapiens
ugagacaaucucaucucaguga

SEQ ID NO: 212524 - RNA, 22 nt, Homo sapiens
ugagacauauuauacugcuuuu

SEQ ID NO: 212525 - RNA, 22 nt, Homo sapiens
ugagacaucacaaaauccucaa

SEQ ID NO: 212526 - RNA, 22 nt, Homo sapiens
ugagacaucucuccugagacag

SEQ ID NO: 212527 - RNA, 23 nt, Homo sapiens
ugagacauuggaaaguuaggcag

SEQ ID NO: 212528 - RNA, 22 nt, Homo sapiens
ugagaccaacagauuccaguuc

SEQ ID NO: 212529 - RNA, 22 nt, Homo sapiens
ugagacggagucucgcucucua

SEQ ID NO: 212530 - RNA, 22 nt, Homo sapiens
ugagacggagucucgcuguguc

SEQ ID NO: 212531 - RNA, 22 nt, Homo sapiens
ugagacgucuucucuucuucaa

SEQ ID NO: 212532 - RNA, 22 nt, Homo sapiens
ugagacugaaauuaggaaacug

SEQ ID NO: 212533 - RNA, 22 nt, Homo sapiens
ugagagacagacauuaucuuau

SEQ ID NO: 212534 - RNA, 22 nt, Homo sapiens
ugagagcugcauucuugaaagc

SEQ ID NO: 212535 - RNA, 22 nt, Homo sapiens
ugagaggugauaaagcaagggu

SEQ ID NO: 212536 - RNA, 22 nt, Homo sapiens
ugagauaaagcauguacugugu

SEQ ID NO: 212537 - RNA, 22 nt, Homo sapiens
ugagauaaggaaauugaggcuc

SEQ ID NO: 212538 - RNA, 22 nt, Homo sapiens
ugagauaauuuacuuguugagg

SEQ ID NO: 212539 - RNA, 18 nt, Homo sapiens
ugagauacuagaauaggu

SEQ ID NO: 212540 - RNA, 22 nt, Homo sapiens
ugagauagggucucacucuguc

SEQ ID NO: 212541 - RNA, 22 nt, Homo sapiens
ugagaucaagguuaauauaauc

SEQ ID NO: 212542 - RNA, 20 nt, Homo sapiens
ugagauccacgugaaguaug

SEQ ID NO: 212543 - RNA, 22 nt, Homo sapiens
ugagaucguugcgugagcgugu

SEQ ID NO: 212544 - RNA, 23 nt, Homo sapiens
ugagaucuacagaucucagaucu

SEQ ID NO: 212545 - RNA, 19 nt, Homo sapiens
ugagaucuuuacuggguuu

SEQ ID NO: 212546 - RNA, 22 nt, Homo sapiens
ugagaucuuuuguggcugagaa

SEQ ID NO: 212547 - RNA, 22 nt, Homo sapiens
ugagaugaagcuagaagaaugg

SEQ ID NO: 212548 - RNA, 22 nt, Homo sapiens
ugagaugaagugauguaaaaca

SEQ ID NO: 212549 - RNA, 22 nt, Homo sapiens
ugagaugacgacacaccucagu

SEQ ID NO: 212550 - RNA, 22 nt, Homo sapiens
ugagaugagucucgcucuguca

SEQ ID NO: 212551 - RNA, 22 nt, Homo sapiens
ugagaugauagauauguuaauu

SEQ ID NO: 212552 - RNA, 22 nt, Homo sapiens
ugagaugauuuaauggagccca

SEQ ID NO: 212553 - RNA, 22 nt, Homo sapiens
ugagaugcuccucuugcaaagc

SEQ ID NO: 212554 - RNA, 22 nt, Homo sapiens
ugagaugcucgccggccagcau

SEQ ID NO: 212555 - RNA, 22 nt, Homo sapiens
ugagauggguaauuaaauggug

SEQ ID NO: 212556 - RNA, 21 nt, Homo sapiens
ugagaugugaccagggcauca

SEQ ID NO: 212557 - RNA, 22 nt, Homo sapiens
ugagauuauauuucuuaacaga

SEQ ID NO: 212558 - RNA, 22 nt, Homo sapiens
ugagauuaucguaauguaucuc

SEQ ID NO: 212559 - RNA, 22 nt, Homo sapiens
ugagauuaucuguacauaggag

SEQ ID NO: 212560 - RNA, 20 nt, Homo sapiens
ugagauuggugugguauaag

SEQ ID NO: 212561 - RNA, 22 nt, Homo sapiens
ugagcaacauuucaaaacucca

SEQ ID NO: 212562 - RNA, 23 nt, Homo sapiens
ugagcaauauucuacuauugagu

SEQ ID NO: 212563 - RNA, 22 nt, Homo sapiens
ugagcacuguacuuuaucaggu

SEQ ID NO: 212564 - RNA, 22 nt, Homo sapiens
ugagcagaaguuuugauuggcg

SEQ ID NO: 212565 - RNA, 22 nt, Homo sapiens
ugagcagagaagugcccugcgc

SEQ ID NO: 212566 - RNA, 22 nt, Homo sapiens
ugagcagagggagaaguaaauu

SEQ ID NO: 212567 - RNA, 21 nt, Homo sapiens
ugagcauuaguacaguaggga

SEQ ID NO: 212568 - RNA, 22 nt, Homo sapiens
ugagccaaguucacaccauugc

SEQ ID NO: 212569 - RNA, 22 nt, Homo sapiens
ugagcuacuacacccagcuugg

SEQ ID NO: 212570 - RNA, 22 nt, Homo sapiens
ugagcucaugcauucuugagga

SEQ ID NO: 212571 - RNA, 22 nt, Homo sapiens
ugagcugagacaauaaguuuuu

SEQ ID NO: 212572 - RNA, 22 nt, Homo sapiens
ugagcuguuugaagaagcauuu

SEQ ID NO: 212573 - RNA, 22 nt, Homo sapiens
ugaggaaugaccccgugugguc

SEQ ID NO: 212574 - RNA, 22 nt, Homo sapiens
ugaggaguauguucuguagacc

SEQ ID NO: 212575 - RNA, 22 nt, Homo sapiens
ugaggauaguguugaaggcagg

SEQ ID NO: 212576 - RNA, 17 nt, Homo sapiens
ugagggaugccugguuc

SEQ ID NO: 212577 - RNA, 22 nt, Homo sapiens
ugagguaacaaacuaugaguua

SEQ ID NO: 212578 - RNA, 22 nt, Homo sapiens
ugagguaugugaugucuuuuag

SEQ ID NO: 212579 - RNA, 22 nt, Homo sapiens
ugaggucacuuguuuuaugcuu

SEQ ID NO: 212580 - RNA, 22 nt, Homo sapiens
ugaggucauucaugugggcgca

SEQ ID NO: 212581 - RNA, 22 nt, Homo sapiens
ugagguuauuuguucaagaagu

SEQ ID NO: 212582 - RNA, 22 nt, Homo sapiens
ugaguagaaauaaacgcaaacu

SEQ ID NO: 212583 - RNA, 22 nt, Homo sapiens
ugaguagaacaucaagucauac

SEQ ID NO: 212584 - RNA, 22 nt, Homo sapiens
ugaguagcuaauguuuacugag

SEQ ID NO: 212585 - RNA, 22 nt, Homo sapiens
ugaguaugaguucaggaaaggc

SEQ ID NO: 212586 - RNA, 22 nt, Homo sapiens
ugaguauguaggaugugucuua

SEQ ID NO: 212587 - RNA, 22 nt, Homo sapiens
uuuggguuaguuuuccaaucuu

SEQ ID NO: 212588 - RNA, 22 nt, Homo sapiens
uuugguccaguguucagguccu

SEQ ID NO: 212589 - RNA, 22 nt, Homo sapiens
uuuggucccaaugugauaaggu

SEQ ID NO: 212590 - RNA, 18 nt, Homo sapiens
uuugguccuuuauaaaca

SEQ ID NO: 212591 - RNA, 22 nt, Homo sapiens
uuugguugcauucacauauuuc

SEQ ID NO: 212592 - RNA, 22 nt, Homo sapiens
uuugguugucacaacuggggga

SEQ ID NO: 212593 - RNA, 22 nt, Homo sapiens
uuuguacacuguugguaggauu

SEQ ID NO: 212594 - RNA, 22 nt, Homo sapiens
uuuguauguuggagauuggaga

SEQ ID NO: 212595 - RNA, 22 nt, Homo sapiens
uuugucacccugaauguaagau

SEQ ID NO: 212596 - RNA, 22 nt, Homo sapiens
uuugugaggugauggauauguc

SEQ ID NO: 212597 - RNA, 22 nt, Homo sapiens
uuugugagguggauagauugca

SEQ ID NO: 212598 - RNA, 22 nt, Homo sapiens
uuugugcaugaagagggggugc

SEQ ID NO: 212599 - RNA, 22 nt, Homo sapiens
uuugugcuccucucaguaugug

SEQ ID NO: 212600 - RNA, 22 nt, Homo sapiens
uuugugcuccuguugagaaucu

SEQ ID NO: 212601 - RNA, 22 nt, Homo sapiens
uuuguguccccacccacaucuc

SEQ ID NO: 212602 - RNA, 22 nt, Homo sapiens
uuuguucaccucaaggauggga

SEQ ID NO: 212603 - RNA, 22 nt, Homo sapiens
uuuguucuucguuccugagcca

SEQ ID NO: 212604 - RNA, 22 nt, Homo sapiens
uuuuacagaggagguugcugau

SEQ ID NO: 212605 - RNA, 20 nt, Homo sapiens
uuuuagcacuuguuauggug

SEQ ID NO: 212606 - RNA, 22 nt, Homo sapiens
uuuuagcagccaugacaaagau

SEQ ID NO: 212607 - RNA, 22 nt, Homo sapiens
uuuuagcuuuucccaggacucc

SEQ ID NO: 212608 - RNA, 22 nt, Homo sapiens
uuuuauguuuguucccugccaa

SEQ ID NO: 212609 - RNA, 22 nt, Homo sapiens
uuuucaguggccauaguggaga

SEQ ID NO: 212610 - RNA, 22 nt, Homo sapiens
uuuugcaauauguuccugaaua

SEQ ID NO: 212611 - RNA, 22 nt, Homo sapiens
uuuugcucuucauagguccugu

SEQ ID NO: 212612 - RNA, 18 nt, Homo sapiens
uuuugcuuaacugcgcca

SEQ ID NO: 212613 - RNA, 22 nt, Homo sapiens
uuuugguaaugaacuuaggaag

SEQ ID NO: 212614 - RNA, 22 nt, Homo sapiens
uuuugguuuuauccagggucuc

SEQ ID NO: 212615 - RNA, 22 nt, Homo sapiens
uuuuguacaacagcucugggga

SEQ ID NO: 212616 - RNA, 22 nt, Homo sapiens
uuuuuauggccaauccucagaa

SEQ ID NO: 212617 - RNA, 22 nt, Homo sapiens
uuuuugauuaauggguagacca

SEQ ID NO: 212618 - RNA, 16 nt, Homo sapiens
uuuuugcagaaaugac

SEQ ID NO: 212619 - RNA, 22 nt, Homo sapiens
uuuuuggaggagguuagaucau

SEQ ID NO: 212620 - RNA, 22 nt, Homo sapiens
uuuuuugguaauugaacaauga

SEQ ID NO: 212621 - RNA, 22 nt, Homo sapiens
ugggucaguagcauguaugucu

SEQ ID NO: 212622 - RNA, 22 nt, Homo sapiens
uggguccccuacucuuuccaca

SEQ ID NO: 212623 - RNA, 22 nt, Homo sapiens
ugggugugaccgcucaaggggg

SEQ ID NO: 212624 - RNA, 22 nt, Homo sapiens
ugguaaguuuaacaugcauccc

SEQ ID NO: 212625 - RNA, 22 nt, Homo sapiens
ugguacugucucuauuuuguag

SEQ ID NO: 212626 - RNA, 22 nt, Homo sapiens
ugguauuuaauauaugagaguu

SEQ ID NO: 212627 - RNA, 22 nt, Homo sapiens
uggucaaaugccaaucuguagu

SEQ ID NO: 212628 - RNA, 22 nt, Homo sapiens
uggucagaugcugaguggaucu

SEQ ID NO: 212629 - RNA, 21 nt, Homo sapiens
uggucaguuuucucacuagga

SEQ ID NO: 212630 - RNA, 22 nt, Homo sapiens
ugguccacuaacccucaguauc

SEQ ID NO: 212631 - RNA, 22 nt, Homo sapiens
ugguccaguucugugauauugc

SEQ ID NO: 212632 - RNA, 21 nt, Homo sapiens
uggucccauaagauuacaaug

SEQ ID NO: 212633 - RNA, 22 nt, Homo sapiens
uggucccaugaacuuuagguca

SEQ ID NO: 212634 - RNA, 22 nt, Homo sapiens
uggucuccuuuguacccugggc

SEQ ID NO: 212635 - RNA, 22 nt, Homo sapiens
uggucuucuggccuccagaacc

SEQ ID NO: 212636 - RNA, 22 nt, Homo sapiens
uggugagaaaagaugucuuugu

SEQ ID NO: 212637 - RNA, 22 nt, Homo sapiens
uggugagaaaugagaugcuuuu

SEQ ID NO: 212638 - RNA, 22 nt, Homo sapiens
ugguggcuuuucguagguucac

SEQ ID NO: 212639 - RNA, 22 nt, Homo sapiens
ugguuaucacuuuccuuccauc

SEQ ID NO: 212640 - RNA, 22 nt, Homo sapiens
ugguuaucauagcuaugcuacu

SEQ ID NO: 212641 - RNA, 22 nt, Homo sapiens
uguaaaaagcccagccgcugag

SEQ ID NO: 212642 - RNA, 22 nt, Homo sapiens
uguaaacauguauguguuuaug

SEQ ID NO: 212643 - RNA, 22 nt, Homo sapiens
uguaaacuaugagcugauuauu

SEQ ID NO: 212644 - RNA, 22 nt, Homo sapiens
uguaaagaaagcuguuguugua

SEQ ID NO: 212645 - RNA, 20 nt, Homo sapiens
uguaaaggagauugcagcug

SEQ ID NO: 212646 - RNA, 22 nt, Homo sapiens
uguaaaucuauuuuuaguguuu

SEQ ID NO: 212647 - RNA, 20 nt, Homo sapiens
uguaacaaucuggauguugc

SEQ ID NO: 212648 - RNA, 21 nt, Homo sapiens
uguaacugcaaaccucagauu

SEQ ID NO: 212649 - RNA, 22 nt, Homo sapiens
uguaagcauugggcaugcaguc

SEQ ID NO: 212650 - RNA, 22 nt, Homo sapiens
uguaagugugcaauucagugau

SEQ ID NO: 212651 - RNA, 22 nt, Homo sapiens
uguacaaaacaagaugggggua

SEQ ID NO: 212652 - RNA, 22 nt, Homo sapiens
uguacaugggacaggaggagag

SEQ ID NO: 212653 - RNA, 22 nt, Homo sapiens
uguagauaucuaucaggucaau

SEQ ID NO: 212654 - RNA, 22 nt, Homo sapiens
uguagggagagggaguugcacc

SEQ ID NO: 212655 - RNA, 22 nt, Homo sapiens
uguagguguacauacaugguua

SEQ ID NO: 212656 - RNA, 21 nt, Homo sapiens
uguauacauauguuaggugca

SEQ ID NO: 212657 - RNA, 22 nt, Homo sapiens
uguauaggcaaauuuccucaug

SEQ ID NO: 212658 - RNA, 22 nt, Homo sapiens
uguaugguuauuuguggauggu

SEQ ID NO: 212659 - RNA, 22 nt, Homo sapiens
uguauguuuaaggccaguggaa

SEQ ID NO: 212660 - RNA, 22 nt, Homo sapiens
uguauguuucuuaggccugaga

SEQ ID NO: 212661 - RNA, 22 nt, Homo sapiens
ugucaaacauuaugaugcucua

SEQ ID NO: 212662 - RNA, 22 nt, Homo sapiens
ugucaagaaaucaaggugugag

SEQ ID NO: 212663 - RNA, 21 nt, Homo sapiens
ugucaagaugacugcugcggc

SEQ ID NO: 212664 - RNA, 21 nt, Homo sapiens
ugucaagugggaaaacaugua

SEQ ID NO: 212665 - RNA, 22 nt, Homo sapiens
ugucacaguuuguacuuuauag

SEQ ID NO: 212666 - RNA, 22 nt, Homo sapiens
ugucacauccaagaaggugcag

SEQ ID NO: 212667 - RNA, 22 nt, Homo sapiens
ugucaggaguuuuagaaucuua

SEQ ID NO: 212668 - RNA, 22 nt, Homo sapiens
ugucaguguaugagccccggau

SEQ ID NO: 212669 - RNA, 22 nt, Homo sapiens
ugucaguuucaguguuagccuu

SEQ ID NO: 212670 - RNA, 22 nt, Homo sapiens
ugucauagaugauuuuuuucgg

SEQ ID NO: 212671 - RNA, 22 nt, Homo sapiens
ugucauauagaauguucuauga

SEQ ID NO: 212672 - RNA, 22 nt, Homo sapiens
ugucaucauuccaucagggcuu

SEQ ID NO: 212673 - RNA, 22 nt, Homo sapiens
ugucaucauuugagagaagaaa

SEQ ID NO: 212674 - RNA, 22 nt, Homo sapiens
ugucaucuagguauuaagcccc

SEQ ID NO: 212675 - RNA, 22 nt, Homo sapiens
ugucaugaaauauguuuuucua

SEQ ID NO: 212676 - RNA, 22 nt, Homo sapiens
ugucauggcauuuguaaacugc

SEQ ID NO: 212677 - RNA, 22 nt, Homo sapiens
ugucaugguagcaaggacgagg

SEQ ID NO: 212678 - RNA, 22 nt, Homo sapiens
ugucauguauauaccacuucca

SEQ ID NO: 212679 - RNA, 22 nt, Homo sapiens
ugucaugucuuuguguaucaau

SEQ ID NO: 212680 - RNA, 22 nt, Homo sapiens
ugucauguuucuacugaccaaa

SEQ ID NO: 212681 - RNA, 20 nt, Homo sapiens
ugucccaaccccauggguuc

SEQ ID NO: 212682 - RNA, 19 nt, Homo sapiens
ugucccagccauagaggca

SEQ ID NO: 212683 - RNA, 22 nt, Homo sapiens
uguccugaagcuuuguuaugua

SEQ ID NO: 212684 - RNA, 22 nt, Homo sapiens
ugucuagaucugaauguaauug

SEQ ID NO: 212685 - RNA, 20 nt, Homo sapiens
ugucuauggggguucucugc

SEQ ID NO: 212686 - RNA, 22 nt, Homo sapiens
ugucugagacuguuuuacuuuc

SEQ ID NO: 212687 - RNA, 22 nt, Homo sapiens
ugucuugagagaggacaugacu

SEQ ID NO: 212688 - RNA, 22 nt, Homo sapiens
ugucuuggaugaggauuaacag

SEQ ID NO: 212689 - RNA, 22 nt, Homo sapiens
ugucuuguagacugaaggcuuc

SEQ ID NO: 212690 - RNA, 22 nt, Homo sapiens
ugugaacagcagcugggcuuug

SEQ ID NO: 212691 - RNA, 22 nt, Homo sapiens
ugugaacagcuccaaaugugga

SEQ ID NO: 212692 - RNA, 22 nt, Homo sapiens
ugugaacaugacagugggcuag

SEQ ID NO: 212693 - RNA, 22 nt, Homo sapiens
ugugaacauuuuguauauauua

SEQ ID NO: 212694 - RNA, 19 nt, Homo sapiens
ugugaagaaaugcugcaag

SEQ ID NO: 212695 - RNA, 22 nt, Homo sapiens
ugugaagauggacuaauauagu

SEQ ID NO: 212696 - RNA, 22 nt, Homo sapiens
ugugaaugaagaaugcuaaccu

SEQ ID NO: 212697 - RNA, 22 nt, Homo sapiens
ugugaauggugcugcaaugaac

SEQ ID NO: 212698 - RNA, 22 nt, Homo sapiens
ugugaauguaaccuuauuugga

SEQ ID NO: 212699 - RNA, 22 nt, Homo sapiens
ugugaauguaagaaaauccaac

SEQ ID NO: 212700 - RNA, 22 nt, Homo sapiens
aaauggauuaaguucacuugcu

SEQ ID NO: 212701 - RNA, 22 nt, Homo sapiens
aaauggcacaguaagggcauuu

SEQ ID NO: 212702 - RNA, 22 nt, Homo sapiens
aaaugggacugggguccuuuga

SEQ ID NO: 212703 - RNA, 19 nt, Homo sapiens
aaaugugcacuguuuucca

SEQ ID NO: 212704 - RNA, 18 nt, Homo sapiens
aaauucugucccuucuuc

SEQ ID NO: 212705 - RNA, 22 nt, Homo sapiens
aacagagcuggugacuccaggu

SEQ ID NO: 212706 - RNA, 22 nt, Homo sapiens
aacaggcuccuaggggugcacc

SEQ ID NO: 212707 - RNA, 22 nt, Homo sapiens
aacaggguggugccugguccau

SEQ ID NO: 212708 - RNA, 22 nt, Homo sapiens
aacaguaucuaacgagugauga

SEQ ID NO: 212709 - RNA, 22 nt, Homo sapiens
aacagucaauugcugaugaccu

SEQ ID NO: 212710 - RNA, 22 nt, Homo sapiens
aacagugcuguuauaaauguac

SEQ ID NO: 212711 - RNA, 20 nt, Homo sapiens
aacaguguguaaguuuccuu

SEQ ID NO: 212712 - RNA, 22 nt, Homo sapiens
aacauugaacuuggcacaccca

SEQ ID NO: 212713 - RNA, 22 nt, Homo sapiens
aaccuguggauuuugguaucug

SEQ ID NO: 212714 - RNA, 22 nt, Homo sapiens
aacuacaucucuuugaggcagg

SEQ ID NO: 212715 - RNA, 22 nt, Homo sapiens
aacucacauucuuucuugguac

SEQ ID NO: 212716 - RNA, 22 nt, Homo sapiens
aacugcacuaggacagguuuuu

SEQ ID NO: 212717 - RNA, 22 nt, Homo sapiens
aacugcuguuuggguacuggug

SEQ ID NO: 212718 - RNA, 19 nt, Homo sapiens
aacuggugugagaugguau

SEQ ID NO: 212719 - RNA, 22 nt, Homo sapiens
aagagaacugacaguaccuggg

SEQ ID NO: 212720 - RNA, 22 nt, Homo sapiens
aagagaugaagguccugacugu

SEQ ID NO: 212721 - RNA, 22 nt, Homo sapiens
aagagcucauccauaguuguca

SEQ ID NO: 212722 - RNA, 22 nt, Homo sapiens
aagaggcuguaggauaaugccu

SEQ ID NO: 212723 - RNA, 22 nt, Homo sapiens
aagagguaggaaauggucauuu

SEQ ID NO: 212724 - RNA, 22 nt, Homo sapiens
aagagguuguaccuaaaguguu

SEQ ID NO: 212725 - RNA, 22 nt, Homo sapiens
aagaugauguucuuuuucuuag

SEQ ID NO: 212726 - RNA, 22 nt, Homo sapiens
aagaugcagucauacuggagga

SEQ ID NO: 212727 - RNA, 22 nt, Homo sapiens
aagcacaauuucaccuucuugu

SEQ ID NO: 212728 - RNA, 22 nt, Homo sapiens
aagcacccuuugucuggacaug

SEQ ID NO: 212729 - RNA, 20 nt, Homo sapiens
aagcagacauuuggaugaaa

SEQ ID NO: 212730 - RNA, 22 nt, Homo sapiens
aagcagauguguugaaaguacu

SEQ ID NO: 212731 - RNA, 22 nt, Homo sapiens
aagcaggugaugagugggugug

SEQ ID NO: 212732 - RNA, 22 nt, Homo sapiens
aagcaggugucugugucuguaa

SEQ ID NO: 212733 - RNA, 22 nt, Homo sapiens
aagcaguguggacuaaugggaa

SEQ ID NO: 212734 - RNA, 22 nt, Homo sapiens
aagcccauuguaaguugaggag

SEQ ID NO: 212735 - RNA, 22 nt, Homo sapiens
aagcgguguugaauuuuguuga

SEQ ID NO: 212736 - RNA, 22 nt, Homo sapiens
aagcuacauuuuauuuauguca

SEQ ID NO: 212737 - RNA, 22 nt, Homo sapiens
aagcugccaggcaugguggcug

SEQ ID NO: 212738 - RNA, 22 nt, Homo sapiens
aagcuggauuuaguguggagca

SEQ ID NO: 212739 - RNA, 22 nt, Homo sapiens
aagcuguugguggaucuaccau

SEQ ID NO: 212740 - RNA, 22 nt, Homo sapiens
aagcuuucaacuguuugccauu

SEQ ID NO: 212741 - RNA, 22 nt, Homo sapiens
aaggagcuaagagaucauacau

SEQ ID NO: 212742 - RNA, 22 nt, Homo sapiens
aaggaguauugaaugaccaagu

SEQ ID NO: 212743 - RNA, 22 nt, Homo sapiens
aaggagugugauucuucaguuu

SEQ ID NO: 212744 - RNA, 22 nt, Homo sapiens
aaggcaagagaaaauuucgagu

SEQ ID NO: 212745 - RNA, 22 nt, Homo sapiens
aaggcagugugcacauaacacu

SEQ ID NO: 212746 - RNA, 22 nt, Homo sapiens
aaggcaugcaguacguuucuau

SEQ ID NO: 212747 - RNA, 22 nt, Homo sapiens
aaggcucuuucaacguaaauua

SEQ ID NO: 212748 - RNA, 22 nt, Homo sapiens
aaggcuguucauuuagcacagu

SEQ ID NO: 212749 - RNA, 22 nt, Homo sapiens
aaggcuuuuugcugacguccuu

SEQ ID NO: 212750 - RNA, 22 nt, Homo sapiens
aagggagcugcauaaucuugug

SEQ ID NO: 212751 - RNA, 22 nt, Homo sapiens
aaggucauugugguuuuugcca

SEQ ID NO: 212752 - RNA, 22 nt, Homo sapiens
aagguucuugcuugcaugacug

SEQ ID NO: 212753 - RNA, 22 nt, Homo sapiens
aaguaaacauuuuguacaauaa

SEQ ID NO: 212754 - RNA, 22 nt, Homo sapiens
aaguaguuaggaacauucucuc

SEQ ID NO: 212755 - RNA, 22 nt, Homo sapiens
aaguauuagcuaauugugcuua

SEQ ID NO: 212756 - RNA, 22 nt, Homo sapiens
aaguauuaugaguccuuguuuu

SEQ ID NO: 212757 - RNA, 22 nt, Homo sapiens
aagugaaugugcuggaauagcu

SEQ ID NO: 212758 - RNA, 22 nt, Homo sapiens
aagugaauguuugguagcagug

SEQ ID NO: 212759 - RNA, 20 nt, Homo sapiens
aagugaguguuaaacugaac

SEQ ID NO: 212760 - RNA, 22 nt, Homo sapiens
aagugauguuauugggugacuc

SEQ ID NO: 212761 - RNA, 22 nt, Homo sapiens
aagugcauguauuaguguaguc

SEQ ID NO: 212762 - RNA, 22 nt, Homo sapiens
aagugcucuugaaacugucuua

SEQ ID NO: 212763 - RNA, 22 nt, Homo sapiens
aagugcuuccuuucagaggguu

SEQ ID NO: 212764 - RNA, 19 nt, Homo sapiens
aagugguuuaaacuuguau

SEQ ID NO: 212765 - RNA, 23 nt, Homo sapiens
aaguucaugcucaucuguuacac

SEQ ID NO: 212766 - RNA, 22 nt, Homo sapiens
aaguuguaguuagagaguugcu

SEQ ID NO: 212767 - RNA, 22 nt, Homo sapiens
aaguuguuggaguuccauuguu

SEQ ID NO: 212768 - RNA, 22 nt, Homo sapiens
aauaagaaguggaagggaccgg

SEQ ID NO: 212769 - RNA, 22 nt, Homo sapiens
aauacugaaaguauuuucaaau

SEQ ID NO: 212770 - RNA, 22 nt, Homo sapiens
aauacugcuuugauguaagcua

SEQ ID NO: 212771 - RNA, 22 nt, Homo sapiens
aauacuuccaaaucuagucauu

SEQ ID NO: 212772 - RNA, 22 nt, Homo sapiens
aauagcacugcuaugguuugaa

SEQ ID NO: 212773 - RNA, 22 nt, Homo sapiens
aauagcacuguagauggaggaa

SEQ ID NO: 212774 - RNA, 22 nt, Homo sapiens
aauagcauugaaucuaccaauu

SEQ ID NO: 212775 - RNA, 22 nt, Homo sapiens
aauagcuguccuuagaagugug

SEQ ID NO: 212776 - RNA, 22 nt, Homo sapiens
aauagugcugcaaaaacauacg

SEQ ID NO: 212777 - RNA, 22 nt, Homo sapiens
aauauagcuauguacaugucca

SEQ ID NO: 212778 - RNA, 22 nt, Homo sapiens
aauaucacaggguguacacuca

SEQ ID NO: 212779 - RNA, 22 nt, Homo sapiens
aauaucacaguggguguacacc

SEQ ID NO: 212780 - RNA, 23 nt, Homo sapiens
aauaucacaguggguguacaccc

SEQ ID NO: 212781 - RNA, 22 nt, Homo sapiens
aauaucacaguuggguguacac

SEQ ID NO: 212782 - RNA, 22 nt, Homo sapiens
aauaugucuugaaauuggguaa

SEQ ID NO: 212783 - RNA, 22 nt, Homo sapiens
aaucacaguguucuugugaggg

SEQ ID NO: 212784 - RNA, 22 nt, Homo sapiens
aaucacauuaaugcucccucag

SEQ ID NO: 212785 - RNA, 22 nt, Homo sapiens
aaucacuaugccaugaaguaca

SEQ ID NO: 212786 - RNA, 22 nt, Homo sapiens
aaucacuuuggcaccaaccuaa

SEQ ID NO: 212787 - RNA, 22 nt, Homo sapiens
aaucagcacacugugcuuucca

SEQ ID NO: 212788 - RNA, 22 nt, Homo sapiens
aaucauggaguauuuguccuug

SEQ ID NO: 212789 - RNA, 22 nt, Homo sapiens
aaucccuggacuuucggaggcu

SEQ ID NO: 212790 - RNA, 22 nt, Homo sapiens
aauccuguagauucuaauuccu

SEQ ID NO: 212791 - RNA, 22 nt, Homo sapiens
aaucugggguuguuuggggagu

SEQ ID NO: 212792 - RNA, 22 nt, Homo sapiens
aaucugucuuuuguuauugagg

SEQ ID NO: 212793 - RNA, 22 nt, Homo sapiens
aaugaaguuagauguugagaag

SEQ ID NO: 212794 - RNA, 22 nt, Homo sapiens
aaugacugugauauuuuucuuc

SEQ ID NO: 212795 - RNA, 22 nt, Homo sapiens
aaugcaagauguuaauuauagg

SEQ ID NO: 212796 - RNA, 22 nt, Homo sapiens
aaugcacauaaaauccuccagg

SEQ ID NO: 212797 - RNA, 22 nt, Homo sapiens
aaugcacuccagccugggcgac

SEQ ID NO: 212798 - RNA, 22 nt, Homo sapiens
aaugcuaucuggaacauuguug

SEQ ID NO: 212799 - RNA, 22 nt, Homo sapiens
aaugcuguguuauuucaugacc

SEQ ID NO: 212800 - RNA, 22 nt, Homo sapiens
aaugcuguucuuugcuuaaguu

SEQ ID NO: 212801 - RNA, 22 nt, Homo sapiens
aauggcaucuacguuaaauguc

SEQ ID NO: 212802 - RNA, 22 nt, Homo sapiens
ucagcaaugaccuaagcaaaua

SEQ ID NO: 212803 - RNA, 22 nt, Homo sapiens
ucagcacauucaaggccugccu

SEQ ID NO: 212804 - RNA, 22 nt, Homo sapiens
ucagcagugccccacucuacug

SEQ ID NO: 212805 - RNA, 21 nt, Homo sapiens
ucagcucaucacugccuggag

SEQ ID NO: 212806 - RNA, 22 nt, Homo sapiens
ucaggcacucagcuuagagucu

SEQ ID NO: 212807 - RNA, 20 nt, Homo sapiens
ucaggcuccgcauuaacuua

SEQ ID NO: 212808 - RNA, 22 nt, Homo sapiens
ucaggcuuuucccagagugaug

SEQ ID NO: 212809 - RNA, 22 nt, Homo sapiens
ucagggacuuacaaaccagaag

SEQ ID NO: 212810 - RNA, 22 nt, Homo sapiens
ucagguagcauuuuggaaacag

SEQ ID NO: 212811 - RNA, 22 nt, Homo sapiens
ucagguauuucuuuuagcugug

SEQ ID NO: 212812 - RNA, 22 nt, Homo sapiens
ucaggugccuuggcuaauuguu

SEQ ID NO: 212813 - RNA, 23 nt, Homo sapiens
ucaguacucuauaagugccagcu

SEQ ID NO: 212814 - RNA, 22 nt, Homo sapiens
ucaguagcaugaaaacagacua

SEQ ID NO: 212815 - RNA, 22 nt, Homo sapiens
ucaguaguaaauggauuuggaa

SEQ ID NO: 212816 - RNA, 22 nt, Homo sapiens
ucagucauucaauuguugaaug

SEQ ID NO: 212817 - RNA, 22 nt, Homo sapiens
ucagugaauauauaacagcgau

SEQ ID NO: 212818 - RNA, 22 nt, Homo sapiens
ucagugaauguuggccacuacu

SEQ ID NO: 212819 - RNA, 22 nt, Homo sapiens
ucagugacuggguauuaaauca

SEQ ID NO: 212820 - RNA, 22 nt, Homo sapiens
ucagugcaggaauuuccuuaga

SEQ ID NO: 212821 - RNA, 22 nt, Homo sapiens
ucagugcuguuugcccucguuu

SEQ ID NO: 212822 - RNA, 22 nt, Homo sapiens
ucaguggagagcuuccaggauu

SEQ ID NO: 212823 - RNA, 22 nt, Homo sapiens
ucaguggagcuacaauucuggg

SEQ ID NO: 212824 - RNA, 22 nt, Homo sapiens
ucagugggcuauguaauuaacu

SEQ ID NO: 212825 - RNA, 22 nt, Homo sapiens
ucagugucugugauggagaggu

SEQ ID NO: 212826 - RNA, 22 nt, Homo sapiens
ucaguguuuuauccuccagagc

SEQ ID NO: 212827 - RNA, 22 nt, Homo sapiens
ucaguuaaugcugccugcugga

SEQ ID NO: 212828 - RNA, 22 nt, Homo sapiens
ucauacaggccaccagggaagu

SEQ ID NO: 212829 - RNA, 18 nt, Homo sapiens
ucauagaucaugacagug

SEQ ID NO: 212830 - RNA, 20 nt, Homo sapiens
ucauagcuuuuuccacuuua

SEQ ID NO: 212831 - RNA, 22 nt, Homo sapiens
ucauaggucugagaagaaaaua

SEQ ID NO: 212832 - RNA, 22 nt, Homo sapiens
ucauaugucauaguaugaucuu

SEQ ID NO: 212833 - RNA, 22 nt, Homo sapiens
ucauauugcgguucauugacuu

SEQ ID NO: 212834 - RNA, 22 nt, Homo sapiens
ucauauugguuaaaauaguggg

SEQ ID NO: 212835 - RNA, 23 nt, Homo sapiens
ucaucacagcauuuccugguauu

SEQ ID NO: 212836 - RNA, 21 nt, Homo sapiens
ucaucagucaaagacaauggu

SEQ ID NO: 212837 - RNA, 22 nt, Homo sapiens
ucauccauacaguuagcaaagg

SEQ ID NO: 212838 - RNA, 22 nt, Homo sapiens
ucaugaaguaguuaacugguug

SEQ ID NO: 212839 - RNA, 21 nt, Homo sapiens
ucaugccacugcacuuuagcc

SEQ ID NO: 212840 - RNA, 22 nt, Homo sapiens
ucauggcacugaugagaguuuc

SEQ ID NO: 212841 - RNA, 22 nt, Homo sapiens
ucauguguugcacugaggaccu

SEQ ID NO: 212842 - RNA, 22 nt, Homo sapiens
ucauucauuugcucacuccaca

SEQ ID NO: 212843 - RNA, 22 nt, Homo sapiens
ucauugcacuccagccugggug

SEQ ID NO: 212844 - RNA, 22 nt, Homo sapiens
ucauugcacucccagacacccu

SEQ ID NO: 212845 - RNA, 22 nt, Homo sapiens
ucauugcauguuaauuaaacag

SEQ ID NO: 212846 - RNA, 21 nt, Homo sapiens
ucauugguuggcugcccugua

SEQ ID NO: 212847 - RNA, 22 nt, Homo sapiens
ucauuguccaacuucuuucagu

SEQ ID NO: 212848 - RNA, 22 nt, Homo sapiens
uccacagugguugaacuaguaa

SEQ ID NO: 212849 - RNA, 18 nt, Homo sapiens
uccacgugcuuuccagau

SEQ ID NO: 212850 - RNA, 22 nt, Homo sapiens
uccagaguggugaugcuggggc

SEQ ID NO: 212851 - RNA, 17 nt, Homo sapiens
uccagauuucaauugaa

SEQ ID NO: 212852 - RNA, 21 nt, Homo sapiens
uccagcuuugagaguuguggu

SEQ ID NO: 212853 - RNA, 22 nt, Homo sapiens
uccagguacucagggggcugag

SEQ ID NO: 212854 - RNA, 22 nt, Homo sapiens
uccaguuuucuuuccuagggcu

SEQ ID NO: 212855 - RNA, 20 nt, Homo sapiens
uccaguuuuggagacauucu

SEQ ID NO: 212856 - RNA, 22 nt, Homo sapiens
uccaguuuuguuaacauauggu

SEQ ID NO: 212857 - RNA, 19 nt, Homo sapiens
uccaugagcccacagugau

SEQ ID NO: 212858 - RNA, 22 nt, Homo sapiens
uccaugaguccauuagaaaaaa

SEQ ID NO: 212859 - RNA, 19 nt, Homo sapiens
ucccaauguuuccaggcag

SEQ ID NO: 212860 - RNA, 20 nt, Homo sapiens
ucccaguaggagaaggaagg

SEQ ID NO: 212861 - RNA, 22 nt, Homo sapiens
ucccaguauucauuuacagaag

SEQ ID NO: 212862 - RNA, 22 nt, Homo sapiens
ucccaguguguagcuugucucu

SEQ ID NO: 212863 - RNA, 22 nt, Homo sapiens
ucccauugucucugaccuugcc

SEQ ID NO: 212864 - RNA, 22 nt, Homo sapiens
uccccaguaggcaauuaacacc

SEQ ID NO: 212865 - RNA, 23 nt, Homo sapiens
uccccgggagcaccagcuuguug

SEQ ID NO: 212866 - RNA, 22 nt, Homo sapiens
uccccgucacacgcaggcuuac

SEQ ID NO: 212867 - RNA, 20 nt, Homo sapiens
ucccuaagagccuuuccuuc

SEQ ID NO: 212868 - RNA, 22 nt, Homo sapiens
ucccuacuggggcacugccuag

SEQ ID NO: 212869 - RNA, 20 nt, Homo sapiens
ucccucaaacuuuuccacug

SEQ ID NO: 212870 - RNA, 18 nt, Homo sapiens
ucccucagaauuauagaa

SEQ ID NO: 212871 - RNA, 22 nt, Homo sapiens
ucccugaagcugcagcaacaca

SEQ ID NO: 212872 - RNA, 22 nt, Homo sapiens
ucccugagcaaaguuuucugua

SEQ ID NO: 212873 - RNA, 22 nt, Homo sapiens
ucccuggagcaagagaagaagg

SEQ ID NO: 212874 - RNA, 22 nt, Homo sapiens
ucccuguuaggcacagauuuau

SEQ ID NO: 212875 - RNA, 22 nt, Homo sapiens
ucccuuucuggaguuucccaag

SEQ ID NO: 212876 - RNA, 22 nt, Homo sapiens
ucccuuuguccaacggauccac

SEQ ID NO: 212877 - RNA, 22 nt, Homo sapiens
uccgaguguuagagagcugugu

SEQ ID NO: 212878 - RNA, 22 nt, Homo sapiens
uccuacaugcaguacauucaaa

SEQ ID NO: 212879 - RNA, 22 nt, Homo sapiens
uccuacugucuucggggcacug

SEQ ID NO: 212880 - RNA, 22 nt, Homo sapiens
uccugagucagcauccguuugu

SEQ ID NO: 212881 - RNA, 22 nt, Homo sapiens
uccugcauucauccugguguug

SEQ ID NO: 212882 - RNA, 22 nt, Homo sapiens
uccuucacucuacaucuuuguu

SEQ ID NO: 212883 - RNA, 22 nt, Homo sapiens
uccuugagucuuugcucagaug

SEQ ID NO: 212884 - RNA, 22 nt, Homo sapiens
uccuugcacuaacuuaaggagg

SEQ ID NO: 212885 - RNA, 22 nt, Homo sapiens
uccuuggugacauuucuugucu

SEQ ID NO: 212886 - RNA, 22 nt, Homo sapiens
uccuuuaguuaauaaagacaag

SEQ ID NO: 212887 - RNA, 22 nt, Homo sapiens
ucgcugggaaccagagguaaag

SEQ ID NO: 212888 - RNA, 19 nt, Homo sapiens
ucuaaaucucuugauagac

SEQ ID NO: 212889 - RNA, 22 nt, Homo sapiens
ucuaaguaguagcuggucagaa

SEQ ID NO: 212890 - RNA, 22 nt, Homo sapiens
ucuacagccaguucaggaagaa

SEQ ID NO: 212891 - RNA, 22 nt, Homo sapiens
ucuacccugugagggacacagu

SEQ ID NO: 212892 - RNA, 22 nt, Homo sapiens
ucuauggauaaaaugcccucau

SEQ ID NO: 212893 - RNA, 22 nt, Homo sapiens
ucucaaccuccacacuacaaua

SEQ ID NO: 212894 - RNA, 22 nt, Homo sapiens
ucucaauggguuguagacaaag

SEQ ID NO: 212895 - RNA, 22 nt, Homo sapiens
ucucacacugaauguguguggg

SEQ ID NO: 212896 - RNA, 22 nt, Homo sapiens
ucucacagaguugaauguuucu

SEQ ID NO: 212897 - RNA, 18 nt, Homo sapiens
ucucacagcaaucuguca

SEQ ID NO: 212898 - RNA, 22 nt, Homo sapiens
ucucagagccuaggguuuuuca

SEQ ID NO: 212899 - RNA, 22 nt, Homo sapiens
ucucagcacagucagggcgccu

SEQ ID NO: 212900 - RNA, 22 nt, Homo sapiens
ucucauagaggcagagaguaaa

SEQ ID NO: 212901 - RNA, 20 nt, Homo sapiens
ucucauagagguagagaaua

SEQ ID NO: 212902 - RNA, 22 nt, Homo sapiens
ucucaugaagauagagaauaga

SEQ ID NO: 212903 - RNA, 23 nt, Homo sapiens
ucucauuccuugaaaauaaugac

SEQ ID NO: 212904 - RNA, 22 nt, Homo sapiens
ugacaguguccucauucccaac

SEQ ID NO: 212905 - RNA, 22 nt, Homo sapiens
ugacagugugagauccugucuc

SEQ ID NO: 212906 - RNA, 22 nt, Homo sapiens
ugacaguuuccagggcugucuc

SEQ ID NO: 212907 - RNA, 22 nt, Homo sapiens
ugacaugaagucucccucuguu

SEQ ID NO: 212908 - RNA, 22 nt, Homo sapiens
ugacaugagauuugggaggggc

SEQ ID NO: 212909 - RNA, 22 nt, Homo sapiens
ugacaugauguuccuacacugu

SEQ ID NO: 212910 - RNA, 22 nt, Homo sapiens
ugacauggaaguagguauacau

SEQ ID NO: 212911 - RNA, 22 nt, Homo sapiens
ugacauggagguggaggaagau

SEQ ID NO: 212912 - RNA, 22 nt, Homo sapiens
ugacauugggagugaagugaag

SEQ ID NO: 212913 - RNA, 22 nt, Homo sapiens
ugaccacugucuaagauaggug

SEQ ID NO: 212914 - RNA, 22 nt, Homo sapiens
ugacccuguggcagcgucuaag

SEQ ID NO: 212915 - RNA, 22 nt, Homo sapiens
ugacuacaaccuccaccucccg

SEQ ID NO: 212916 - RNA, 22 nt, Homo sapiens
ugacuacauaaguaaucucaaa

SEQ ID NO: 212917 - RNA, 22 nt, Homo sapiens
ugacuagggacauucuuccacg

SEQ ID NO: 212918 - RNA, 22 nt, Homo sapiens
ugacuauaguuuucuugacaca

SEQ ID NO: 212919 - RNA, 22 nt, Homo sapiens
ugacuauugauuuagacgugcu

SEQ ID NO: 212920 - RNA, 22 nt, Homo sapiens
ugacucaguuguuagucuucau

SEQ ID NO: 212921 - RNA, 22 nt, Homo sapiens
ugacugaguaguauuccacuau

SEQ ID NO: 212922 - RNA, 23 nt, Homo sapiens
ugacugaguauauguuuggugcu

SEQ ID NO: 212923 - RNA, 22 nt, Homo sapiens
ugacuggagaccucaguagggu

SEQ ID NO: 212924 - RNA, 22 nt, Homo sapiens
ugacugguguuuaaugagucaa

SEQ ID NO: 212925 - RNA, 22 nt, Homo sapiens
ugacugucuagauagagcuugg

SEQ ID NO: 212926 - RNA, 22 nt, Homo sapiens
ugacugugcagcuccaucaggg

SEQ ID NO: 212927 - RNA, 22 nt, Homo sapiens
ugacuugagcuggagccugccu

SEQ ID NO: 212928 - RNA, 22 nt, Homo sapiens
ugacuugaucauuacacauucu

SEQ ID NO: 212929 - RNA, 22 nt, Homo sapiens
ugagaacaugcacuugagguug

SEQ ID NO: 212930 - RNA, 22 nt, Homo sapiens
ugagaacaugugauauuuggug

SEQ ID NO: 212931 - RNA, 17 nt, Homo sapiens
ugagaacaugugguauu

SEQ ID NO: 212932 - RNA, 22 nt, Homo sapiens
ugagaacuguuuugguuugggu

SEQ ID NO: 212933 - RNA, 22 nt, Homo sapiens
ugagaagaugaacuccuugguc

SEQ ID NO: 212934 - RNA, 22 nt, Homo sapiens
ugagaagugauauagaaguuaa

SEQ ID NO: 212935 - RNA, 22 nt, Homo sapiens
ugagaauauuugaagauguuag

SEQ ID NO: 212936 - RNA, 22 nt, Homo sapiens
ugagacgaagucucguucugua

SEQ ID NO: 212937 - RNA, 22 nt, Homo sapiens
ugagacggagucuggcacuguc

SEQ ID NO: 212938 - RNA, 22 nt, Homo sapiens
ugagacggaguuuugcucuugu

SEQ ID NO: 212939 - RNA, 22 nt, Homo sapiens
ugagacugagucucccucuguc

SEQ ID NO: 212940 - RNA, 22 nt, Homo sapiens
ugagacugagucuugcucuauu

SEQ ID NO: 212941 - RNA, 22 nt, Homo sapiens
ugagacugagucuugcucuugu

SEQ ID NO: 212942 - RNA, 22 nt, Homo sapiens
ugagacugaguuuugccuuugu

SEQ ID NO: 212943 - RNA, 22 nt, Homo sapiens
ugagacugguaauguguagggc

SEQ ID NO: 212944 - RNA, 22 nt, Homo sapiens
ugagacugguuaauugauaaag

SEQ ID NO: 212945 - RNA, 22 nt, Homo sapiens
ugagagacaguuuguuaaaauu

SEQ ID NO: 212946 - RNA, 22 nt, Homo sapiens
ugagagacauuuguuguagagu

SEQ ID NO: 212947 - RNA, 22 nt, Homo sapiens
ugagagaugaacuauucuugaa

SEQ ID NO: 212948 - RNA, 22 nt, Homo sapiens
ugagagaugaacucugauaugu

SEQ ID NO: 212949 - RNA, 22 nt, Homo sapiens
ugagagaugauaaaauguuugu

SEQ ID NO: 212950 - RNA, 19 nt, Homo sapiens
ugagagcacaacugaacaa

SEQ ID NO: 212951 - RNA, 22 nt, Homo sapiens
ugagagcuuuuuugccugguga

SEQ ID NO: 212952 - RNA, 22 nt, Homo sapiens
ugagaggugaauggcaggcuca

SEQ ID NO: 212953 - RNA, 22 nt, Homo sapiens
ugagauaacuaaaaacauuuug

SEQ ID NO: 212954 - RNA, 22 nt, Homo sapiens
ugagauaaucaugugauuucau

SEQ ID NO: 212955 - RNA, 22 nt, Homo sapiens
ugagauaggaucuugcucuguu

SEQ ID NO: 212956 - RNA, 22 nt, Homo sapiens
ugagauauugggaguaauguca

SEQ ID NO: 212957 - RNA, 22 nt, Homo sapiens
ugagaucaaggugggcccuggg

SEQ ID NO: 212958 - RNA, 22 nt, Homo sapiens
ugagaucacuaagagguaaugg

SEQ ID NO: 212959 - RNA, 22 nt, Homo sapiens
ugagaucagaaggauuucucug

SEQ ID NO: 212960 - RNA, 18 nt, Homo sapiens
ugagaucagcaucaaggg

SEQ ID NO: 212961 - RNA, 22 nt, Homo sapiens
ugagaucauguguggaccccag

SEQ ID NO: 212962 - RNA, 22 nt, Homo sapiens
ugagaucugauaggccuggguu

SEQ ID NO: 212963 - RNA, 22 nt, Homo sapiens
ugagaugaaagcagaaagacuu

SEQ ID NO: 212964 - RNA, 22 nt, Homo sapiens
ugagaugaagucuugcucuguu

SEQ ID NO: 212965 - RNA, 22 nt, Homo sapiens
ugagaugagggcugcacucaaa

SEQ ID NO: 212966 - RNA, 21 nt, Homo sapiens
ugagaugauccugcaugcaug

SEQ ID NO: 212967 - RNA, 22 nt, Homo sapiens
ugagaugaugggauaagagggc

SEQ ID NO: 212968 - RNA, 22 nt, Homo sapiens
ugagauggaguuucgcccuugu

SEQ ID NO: 212969 - RNA, 22 nt, Homo sapiens
ugagauggaguuucgcucuugu

SEQ ID NO: 212970 - RNA, 22 nt, Homo sapiens
ugagauggaguuucgcuuuugu

SEQ ID NO: 212971 - RNA, 22 nt, Homo sapiens
ugagauggcugaauucagaaua

SEQ ID NO: 212972 - RNA, 22 nt, Homo sapiens
ugagauggcuuuauugcugaau

SEQ ID NO: 212973 - RNA, 22 nt, Homo sapiens
ugagauggguucugguccccug

SEQ ID NO: 212974 - RNA, 22 nt, Homo sapiens
ugagaugugaucaccugaaggg

SEQ ID NO: 212975 - RNA, 22 nt, Homo sapiens
ugagauguugcucugaaacaag

SEQ ID NO: 212976 - RNA, 22 nt, Homo sapiens
ugagauucucugauuguagguc

SEQ ID NO: 212977 - RNA, 22 nt, Homo sapiens
ugagauuguuagaucaaauggu

SEQ ID NO: 212978 - RNA, 22 nt, Homo sapiens
ugagcaaaauuuuggacauaga

SEQ ID NO: 212979 - RNA, 22 nt, Homo sapiens
ugagcacagagccugggguggc

SEQ ID NO: 212980 - RNA, 22 nt, Homo sapiens
ugagcacagcgugugggagagc

SEQ ID NO: 212981 - RNA, 22 nt, Homo sapiens
ugagcagaaagcugcaaggucg

SEQ ID NO: 212982 - RNA, 22 nt, Homo sapiens
ugagcagaguuguuucuccuga

SEQ ID NO: 212983 - RNA, 22 nt, Homo sapiens
ugagccaaugauuugaauagag

SEQ ID NO: 212984 - RNA, 22 nt, Homo sapiens
ugagccauggcaccuugucuaa

SEQ ID NO: 212985 - RNA, 22 nt, Homo sapiens
ugagccaugggguaaaugugau

SEQ ID NO: 212986 - RNA, 20 nt, Homo sapiens
ugagccccuggacucaagcg

SEQ ID NO: 212987 - RNA, 22 nt, Homo sapiens
ugagcucagcuaguugaggugu

SEQ ID NO: 212988 - RNA, 22 nt, Homo sapiens
ugagcucagcuuucuuuuucac

SEQ ID NO: 212989 - RNA, 22 nt, Homo sapiens
ugagcuccuucauaaaaaggca

SEQ ID NO: 212990 - RNA, 22 nt, Homo sapiens
ugagcugagaucaugcuauugu

SEQ ID NO: 212991 - RNA, 22 nt, Homo sapiens
ugagcugagaucgugccauugu

SEQ ID NO: 212992 - RNA, 22 nt, Homo sapiens
ugagcugagauuaagcugcugc

SEQ ID NO: 212993 - RNA, 20 nt, Homo sapiens
ugagcuuguaaacacuguuu

SEQ ID NO: 212994 - RNA, 18 nt, Homo sapiens
ugaggaaaggguuugcua

SEQ ID NO: 212995 - RNA, 22 nt, Homo sapiens
ugaggaacuagcuacccuaaua

SEQ ID NO: 212996 - RNA, 22 nt, Homo sapiens
ugaggcaaggcugaaugaaggc

SEQ ID NO: 212997 - RNA, 22 nt, Homo sapiens
ugaggcuagucagaucagauga

SEQ ID NO: 212998 - RNA, 22 nt, Homo sapiens
ugaggguauagccagcccuuag

SEQ ID NO: 212999 - RNA, 22 nt, Homo sapiens
ugagguaauagauaauauuuuu

SEQ ID NO: 213000 - RNA, 22 nt, Homo sapiens
ugaggucauguucugucagguu

SEQ ID NO: 213001 - RNA, 22 nt, Homo sapiens
ugaggucuuuauuuagugcuca

SEQ ID NO: 213002 - RNA, 22 nt, Homo sapiens
ugaggugaaguaauauucuaag

SEQ ID NO: 213003 - RNA, 22 nt, Homo sapiens
ugagguguuugugcaccaucug

SEQ ID NO: 213004 - RNA, 22 nt, Homo sapiens
ugagguuggguaauuuaugaag

SEQ ID NO: 213005 - RNA, 22 nt, Homo sapiens
ugagguugguauuacugucucu

SEQ ID NO: 213006 - RNA, 22 nt, Homo sapiens
ugcucaccugcugcucaccucc

SEQ ID NO: 213007 - RNA, 22 nt, Homo sapiens
ugcucaguuuaaaacuuuugag

SEQ ID NO: 213008 - RNA, 22 nt, Homo sapiens
ugcugcaaacaggcaucugugg

SEQ ID NO: 213009 - RNA, 21 nt, Homo sapiens
ugcugcacuucuuuugcugug

SEQ ID NO: 213010 - RNA, 22 nt, Homo sapiens
ugcugcuguuguuguuacuagc

SEQ ID NO: 213011 - RNA, 22 nt, Homo sapiens
ugcuggugauuaaauccugaag

SEQ ID NO: 213012 - RNA, 22 nt, Homo sapiens
ugcugguuuaaaaugcaaauuc

SEQ ID NO: 213013 - RNA, 22 nt, Homo sapiens
ugcuucauuggccaccaggaag

SEQ ID NO: 213014 - RNA, 22 nt, Homo sapiens
uggaaaguaguucuaaucuaag

SEQ ID NO: 213015 - RNA, 22 nt, Homo sapiens
uggaaaguccaagccaaccggg

SEQ ID NO: 213016 - RNA, 22 nt, Homo sapiens
uggaacacaucuaaggaagcag

SEQ ID NO: 213017 - RNA, 19 nt, Homo sapiens
uggaacauaaaaguugguu

SEQ ID NO: 213018 - RNA, 22 nt, Homo sapiens
uggaagaugggaccucaguuuu

SEQ ID NO: 213019 - RNA, 22 nt, Homo sapiens
uggaagugaacaaccaaggcag

SEQ ID NO: 213020 - RNA, 20 nt, Homo sapiens
uggaaucuaggcggagguuu

SEQ ID NO: 213021 - RNA, 21 nt, Homo sapiens
uggaaucuauagaggcaguag

SEQ ID NO: 213022 - RNA, 19 nt, Homo sapiens
uggaauggauuuaaaugug

SEQ ID NO: 213023 - RNA, 22 nt, Homo sapiens
uggaaugucagcuacaagaggg

SEQ ID NO: 213024 - RNA, 21 nt, Homo sapiens
uggaccccuacuucucaccau

SEQ ID NO: 213025 - RNA, 22 nt, Homo sapiens
uggaccccugcucgggagcccu

SEQ ID NO: 213026 - RNA, 21 nt, Homo sapiens
uggaccccuuccuugcaccau

SEQ ID NO: 213027 - RNA, 21 nt, Homo sapiens
uggaccccuuucuuacaccgu

SEQ ID NO: 213028 - RNA, 22 nt, Homo sapiens
uggacuguaauuuuauaggcau

SEQ ID NO: 213029 - RNA, 22 nt, Homo sapiens
uggagaacugaugucuccaaga

SEQ ID NO: 213030 - RNA, 22 nt, Homo sapiens
uggagagcaaaaucaauccaaa

SEQ ID NO: 213031 - RNA, 22 nt, Homo sapiens
uggagagcaaagaauuuguuag

SEQ ID NO: 213032 - RNA, 22 nt, Homo sapiens
uggagagugagggccuccuuaa

SEQ ID NO: 213033 - RNA, 18 nt, Homo sapiens
uggagauaagaagaacuu

SEQ ID NO: 213034 - RNA, 22 nt, Homo sapiens
uggagcccuaaacuucuaauau

SEQ ID NO: 213035 - RNA, 22 nt, Homo sapiens
uggagcccuaguuccucauaac

SEQ ID NO: 213036 - RNA, 23 nt, Homo sapiens
uggaggacaagcauggauaguga

SEQ ID NO: 213037 - RNA, 22 nt, Homo sapiens
uggagguagacauugggaagag

SEQ ID NO: 213038 - RNA, 22 nt, Homo sapiens
uggagucuugcucuguugccca

SEQ ID NO: 213039 - RNA, 20 nt, Homo sapiens
uggagugcuguguugagaag

SEQ ID NO: 213040 - RNA, 20 nt, Homo sapiens
uggaguuguggcaguuugga

SEQ ID NO: 213041 - RNA, 22 nt, Homo sapiens
uggauaguaaagucagauuccc

SEQ ID NO: 213042 - RNA, 22 nt, Homo sapiens
uggauaguucuucuacuagagu

SEQ ID NO: 213043 - RNA, 22 nt, Homo sapiens
uggauauguuuauuacccugaa

SEQ ID NO: 213044 - RNA, 22 nt, Homo sapiens
uggaucuguucuauuuaucuga

SEQ ID NO: 213045 - RNA, 22 nt, Homo sapiens
uggaugccuaauaaaugcagac

SEQ ID NO: 213046 - RNA, 22 nt, Homo sapiens
uggauggagaggcuugugaugc

SEQ ID NO: 213047 - RNA, 22 nt, Homo sapiens
uggauguaauugauucauguug

SEQ ID NO: 213048 - RNA, 22 nt, Homo sapiens
uggcaagaaccacaauuacuuu

SEQ ID NO: 213049 - RNA, 22 nt, Homo sapiens
uggcaagaacugcaauugcuuu

SEQ ID NO: 213050 - RNA, 22 nt, Homo sapiens
uggcaagaaggauuuauuccuu

SEQ ID NO: 213051 - RNA, 22 nt, Homo sapiens
uggcaagcaggacuaaagcacc

SEQ ID NO: 213052 - RNA, 22 nt, Homo sapiens
uggcaauaaaaugcaguuacuu

SEQ ID NO: 213053 - RNA, 22 nt, Homo sapiens
uggcaauauccacaauuacuuu

SEQ ID NO: 213054 - RNA, 19 nt, Homo sapiens
uggcacauguauacuuaug

SEQ ID NO: 213055 - RNA, 22 nt, Homo sapiens
uggcagauagaaaugugguuaa

SEQ ID NO: 213056 - RNA, 22 nt, Homo sapiens
uggcagcgugaauguggcugaa

SEQ ID NO: 213057 - RNA, 22 nt, Homo sapiens
uggcagcugcuucaugggaugc

SEQ ID NO: 213058 - RNA, 22 nt, Homo sapiens
uggcaggugcacuggcuuugaa

SEQ ID NO: 213059 - RNA, 22 nt, Homo sapiens
uggcagugggagauauuuuauu

SEQ ID NO: 213060 - RNA, 22 nt, Homo sapiens
uggcaguuuacagcuuuaggag

SEQ ID NO: 213061 - RNA, 22 nt, Homo sapiens
uggcaguuuuugccuucaauac

SEQ ID NO: 213062 - RNA, 22 nt, Homo sapiens
uggcauauaaagauguguucaa

SEQ ID NO: 213063 - RNA, 20 nt, Homo sapiens
uggcaugaaauuuuccaagc

SEQ ID NO: 213064 - RNA, 19 nt, Homo sapiens
uggcaugaaugugaacuaa

SEQ ID NO: 213065 - RNA, 22 nt, Homo sapiens
uggcaugucguuuuucauagga

SEQ ID NO: 213066 - RNA, 22 nt, Homo sapiens
uggcauguguuugaaugaguau

SEQ ID NO: 213067 - RNA, 23 nt, Homo sapiens
uggcauuuuuggcaaugccuucu

SEQ ID NO: 213068 - RNA, 22 nt, Homo sapiens
uggccaagagcacagauauugg

SEQ ID NO: 213069 - RNA, 22 nt, Homo sapiens
uggccagagggcaauuagcugu

SEQ ID NO: 213070 - RNA, 22 nt, Homo sapiens
uggccaguguuuuuccugggcu

SEQ ID NO: 213071 - RNA, 22 nt, Homo sapiens
uggccaguugaagacaaugcuc

SEQ ID NO: 213072 - RNA, 22 nt, Homo sapiens
uggccuguaacgcugucucagc

SEQ ID NO: 213073 - RNA, 23 nt, Homo sapiens
uggcgagacagaaaacuuuuaga

SEQ ID NO: 213074 - RNA, 22 nt, Homo sapiens
uggcuacugacugaugauuaua

SEQ ID NO: 213075 - RNA, 21 nt, Homo sapiens
uggcuauuucuguggcauaca

SEQ ID NO: 213076 - RNA, 22 nt, Homo sapiens
uggcuccguuguacaggcugga

SEQ ID NO: 213077 - RNA, 22 nt, Homo sapiens
uggcuguguccucucccaaauc

SEQ ID NO: 213078 - RNA, 22 nt, Homo sapiens
uggcuguuuauuucacaugggu

SEQ ID NO: 213079 - RNA, 22 nt, Homo sapiens
uggcuguuuauuucaccuggau

SEQ ID NO: 213080 - RNA, 22 nt, Homo sapiens
uggcuuucuggggcuucuguuc

SEQ ID NO: 213081 - RNA, 22 nt, Homo sapiens
uggcuuuuccuugaaucugccu

SEQ ID NO: 213082 - RNA, 22 nt, Homo sapiens
ugggaaacauccagcacauacu

SEQ ID NO: 213083 - RNA, 22 nt, Homo sapiens
ugggaaauguagccuagcugug

SEQ ID NO: 213084 - RNA, 22 nt, Homo sapiens
ugggaagaagguuuacuugcca

SEQ ID NO: 213085 - RNA, 22 nt, Homo sapiens
ugggaucauuaugcauagugua

SEQ ID NO: 213086 - RNA, 22 nt, Homo sapiens
ugggaucgucaagugaggcucg

SEQ ID NO: 213087 - RNA, 22 nt, Homo sapiens
ugggaugaauacaaugggauca

SEQ ID NO: 213088 - RNA, 22 nt, Homo sapiens
ugggaugaugaaaaggcuuucu

SEQ ID NO: 213089 - RNA, 22 nt, Homo sapiens
ugggcaaaugcuuuuuagucaa

SEQ ID NO: 213090 - RNA, 22 nt, Homo sapiens
ugggcaagugacuuggcuucuc

SEQ ID NO: 213091 - RNA, 22 nt, Homo sapiens
ugggcaguauggucauuuucgu

SEQ ID NO: 213092 - RNA, 22 nt, Homo sapiens
ugggcauuguuccuaguuaucu

SEQ ID NO: 213093 - RNA, 21 nt, Homo sapiens
ugggccccuuccuuacaucau

SEQ ID NO: 213094 - RNA, 22 nt, Homo sapiens
uggggucguaggugcccgccag

SEQ ID NO: 213095 - RNA, 22 nt, Homo sapiens
uggguaauggagaaauaaaucu

SEQ ID NO: 213096 - RNA, 19 nt, Homo sapiens
uggguagugaugagacaua

SEQ ID NO: 213097 - RNA, 23 nt, Homo sapiens
ugggucaguuuuucugacaucau

SEQ ID NO: 213098 - RNA, 22 nt, Homo sapiens
ugguaagaucagaacuggaguc

SEQ ID NO: 213099 - RNA, 22 nt, Homo sapiens
ugguaagaucugugagccaggc

SEQ ID NO: 213100 - RNA, 22 nt, Homo sapiens
ugguauguugucucuuuguucu

SEQ ID NO: 213101 - RNA, 22 nt, Homo sapiens
ugguauguuuauaaguauagga

SEQ ID NO: 213102 - RNA, 22 nt, Homo sapiens
uggucagaaaauuacuugauau

SEQ ID NO: 213103 - RNA, 22 nt, Homo sapiens
uggucaguugugccucaauucc

SEQ ID NO: 213104 - RNA, 22 nt, Homo sapiens
uggucauggaaauagaaugcac

SEQ ID NO: 213105 - RNA, 21 nt, Homo sapiens
uggucccauaagauuauaaug

SEQ ID NO: 213106 - RNA, 19 nt, Homo sapiens
uggucccccgcaaucucau

SEQ ID NO: 213107 - RNA, 20 nt, Homo sapiens
ugguccccugagucuggcuu

SEQ ID NO: 213108 - RNA, 22 nt, Homo sapiens
uguuacagcagaauugaaagag

SEQ ID NO: 213109 - RNA, 22 nt, Homo sapiens
uguuaguuguucauguuaagag

SEQ ID NO: 213110 - RNA, 22 nt, Homo sapiens
uguucuggagaggcaggccaca

SEQ ID NO: 213111 - RNA, 22 nt, Homo sapiens
uguucuggagaguuuagucugg

SEQ ID NO: 213112 - RNA, 22 nt, Homo sapiens
uguucuugaguugggaguacaa

SEQ ID NO: 213113 - RNA, 19 nt, Homo sapiens
uguugcacauaucaauaug

SEQ ID NO: 213114 - RNA, 22 nt, Homo sapiens
uguugcacuccagccuggguga

SEQ ID NO: 213115 - RNA, 20 nt, Homo sapiens
uguugcacucuagccugggu

SEQ ID NO: 213116 - RNA, 22 nt, Homo sapiens
uguuggcauugcugcugacccu

SEQ ID NO: 213117 - RNA, 18 nt, Homo sapiens
uguugguguucacucacu

SEQ ID NO: 213118 - RNA, 22 nt, Homo sapiens
uguuugcuguguggaguagcag

SEQ ID NO: 213119 - RNA, 22 nt, Homo sapiens
uguuugcuguuuucuccaauga

SEQ ID NO: 213120 - RNA, 22 nt, Homo sapiens
uguuugguggucucuucacaug

SEQ ID NO: 213121 - RNA, 22 nt, Homo sapiens
uguuuguuugugauacgguaca

SEQ ID NO: 213122 - RNA, 22 nt, Homo sapiens
uguuuuggaguggacuuugcau

SEQ ID NO: 213123 - RNA, 22 nt, Homo sapiens
uguuuuguuagcacucugggaa

SEQ ID NO: 213124 - RNA, 22 nt, Homo sapiens
uuaaagcgacucucaugccuca

SEQ ID NO: 213125 - RNA, 22 nt, Homo sapiens
uuaaagugaucauaaggauagu

SEQ ID NO: 213126 - RNA, 22 nt, Homo sapiens
uuaaagugcacacgggucaggc

SEQ ID NO: 213127 - RNA, 22 nt, Homo sapiens
uuaacacugccauugauacugu

SEQ ID NO: 213128 - RNA, 22 nt, Homo sapiens
uuaacagcacuacguggggauc

SEQ ID NO: 213129 - RNA, 22 nt, Homo sapiens
uuaacaguugcaugagacugag

SEQ ID NO: 213130 - RNA, 22 nt, Homo sapiens
uuaagagcauggugccagguug

SEQ ID NO: 213131 - RNA, 22 nt, Homo sapiens
uuaagaucagugcaaacuggag

SEQ ID NO: 213132 - RNA, 22 nt, Homo sapiens
uuaagcaaagguaacaugagaa

SEQ ID NO: 213133 - RNA, 22 nt, Homo sapiens
uuaagcaguggauuagaauuuu

SEQ ID NO: 213134 - RNA, 22 nt, Homo sapiens
uuaaggaaagcauuuaauucag

SEQ ID NO: 213135 - RNA, 22 nt, Homo sapiens
uuaaggaaggagucuuaaaugg

SEQ ID NO: 213136 - RNA, 22 nt, Homo sapiens
uuaaggcagugucuaugccagu

SEQ ID NO: 213137 - RNA, 19 nt, Homo sapiens
uuaagguacuuagaugugu

SEQ ID NO: 213138 - RNA, 22 nt, Homo sapiens
uuaaguaaucagagaagagaac

SEQ ID NO: 213139 - RNA, 22 nt, Homo sapiens
uuaaguagaugaaugugaaugu

SEQ ID NO: 213140 - RNA, 22 nt, Homo sapiens
uuaaguagcugggcaugguggu

SEQ ID NO: 213141 - RNA, 22 nt, Homo sapiens
uuaaucacagcugaacucaaac

SEQ ID NO: 213142 - RNA, 22 nt, Homo sapiens
uuaauguaauugauugauugac

SEQ ID NO: 213143 - RNA, 22 nt, Homo sapiens
uuaauuguccaaguucaucucu

SEQ ID NO: 213144 - RNA, 22 nt, Homo sapiens
uuacaacugucuuacugguuau

SEQ ID NO: 213145 - RNA, 22 nt, Homo sapiens
uuacaaguggcaucucucugga

SEQ ID NO: 213146 - RNA, 22 nt, Homo sapiens
uuacaguaugaguaagaguucu

SEQ ID NO: 213147 - RNA, 23 nt, Homo sapiens
uuacaguggcaugaucucugcuc

SEQ ID NO: 213148 - RNA, 22 nt, Homo sapiens
uuacaguugugagccaccaugc

SEQ ID NO: 213149 - RNA, 22 nt, Homo sapiens
uuaccaguggugcuguaaacuu

SEQ ID NO: 213150 - RNA, 22 nt, Homo sapiens
uuacccauuagagaauuuaaga

SEQ ID NO: 213151 - RNA, 22 nt, Homo sapiens
uuacuagaacauuuagggaacu

SEQ ID NO: 213152 - RNA, 22 nt, Homo sapiens
uuacugcauaauuccugggaag

SEQ ID NO: 213153 - RNA, 22 nt, Homo sapiens
uuacugcuagcugugugcucuu

SEQ ID NO: 213154 - RNA, 22 nt, Homo sapiens
uuacugcuuaagugauucaaca

SEQ ID NO: 213155 - RNA, 22 nt, Homo sapiens
uuagaacaguguuugccucgcu

SEQ ID NO: 213156 - RNA, 22 nt, Homo sapiens
uuagaacuagaggaguuugagu

SEQ ID NO: 213157 - RNA, 22 nt, Homo sapiens
uuagacacacauacauuuaucu

SEQ ID NO: 213158 - RNA, 17 nt, Homo sapiens
uuagacagacauccugc

SEQ ID NO: 213159 - RNA, 22 nt, Homo sapiens
uuagaucaacauggaacucuau

SEQ ID NO: 213160 - RNA, 18 nt, Homo sapiens
uuagaugguuuuaaaacu

SEQ ID NO: 213161 - RNA, 22 nt, Homo sapiens
uuagauuauugagcauccacug

SEQ ID NO: 213162 - RNA, 22 nt, Homo sapiens
uuagcacaucuuucuauguaag

SEQ ID NO: 213163 - RNA, 22 nt, Homo sapiens
uuagcacuaauucguuggggca

SEQ ID NO: 213164 - RNA, 22 nt, Homo sapiens
uuagcacuugggaguauuuauu

SEQ ID NO: 213165 - RNA, 22 nt, Homo sapiens
uuagcagcacaaaagcagacua

SEQ ID NO: 213166 - RNA, 22 nt, Homo sapiens
uuagcagcaugaaaauggacug

SEQ ID NO: 213167 - RNA, 22 nt, Homo sapiens
uuagcagcaugagaauggacua

SEQ ID NO: 213168 - RNA, 22 nt, Homo sapiens
uuagcagugugagcacagacua

SEQ ID NO: 213169 - RNA, 21 nt, Homo sapiens
uuagccuguaagcacuuugca

SEQ ID NO: 213170 - RNA, 22 nt, Homo sapiens
uuaggacacuguggguggguca

SEQ ID NO: 213171 - RNA, 22 nt, Homo sapiens
uuaggcuuuauugaaaacaaua

SEQ ID NO: 213172 - RNA, 22 nt, Homo sapiens
uuaggcuuuuuaaccaguuguu

SEQ ID NO: 213173 - RNA, 22 nt, Homo sapiens
uuagggaguaaucuaaaaaugg

SEQ ID NO: 213174 - RNA, 22 nt, Homo sapiens
uuagguauuaggaaauaugcuu

SEQ ID NO: 213175 - RNA, 22 nt, Homo sapiens
uuaguaguaguuugcauuuacc

SEQ ID NO: 213176 - RNA, 22 nt, Homo sapiens
uuagugcugaguggaauguucu

SEQ ID NO: 213177 - RNA, 22 nt, Homo sapiens
uuaguggaugcugaauaaagaa

SEQ ID NO: 213178 - RNA, 22 nt, Homo sapiens
uuaguucccucauucuugacuu

SEQ ID NO: 213179 - RNA, 22 nt, Homo sapiens
uuauacacugugggaguguaaa

SEQ ID NO: 213180 - RNA, 18 nt, Homo sapiens
uuauacuccccaggcaau

SEQ ID NO: 213181 - RNA, 22 nt, Homo sapiens
uuauacucgucugaaugauucu

SEQ ID NO: 213182 - RNA, 18 nt, Homo sapiens
uuauaugcauguguagga

SEQ ID NO: 213183 - RNA, 22 nt, Homo sapiens
uuauauguuucuguuuggaggc

SEQ ID NO: 213184 - RNA, 22 nt, Homo sapiens
uuaucagcagcaugaaaauaga

SEQ ID NO: 213185 - RNA, 22 nt, Homo sapiens
uuaucccacuuucuguuccugu

SEQ ID NO: 213186 - RNA, 22 nt, Homo sapiens
uuaucucaguguuuguaaacaa

SEQ ID NO: 213187 - RNA, 22 nt, Homo sapiens
uuauggauuuauauucuguagu

SEQ ID NO: 213188 - RNA, 22 nt, Homo sapiens
uuauggccauucuuguaggagu

SEQ ID NO: 213189 - RNA, 22 nt, Homo sapiens
uuauggcuuugcgguguuagca

SEQ ID NO: 213190 - RNA, 22 nt, Homo sapiens
uuauuagagauauuugguuagg

SEQ ID NO: 213191 - RNA, 22 nt, Homo sapiens
uuauugcacuccagccugggua

SEQ ID NO: 213192 - RNA, 22 nt, Homo sapiens
uuauuugguuauuguaauuggg

SEQ ID NO: 213193 - RNA, 22 nt, Homo sapiens
uucaaaggauagauuaagauca

SEQ ID NO: 213194 - RNA, 22 nt, Homo sapiens
uucaaaggauuuagauuagcua

SEQ ID NO: 213195 - RNA, 22 nt, Homo sapiens
uucaaaucuuuggcucccacua

SEQ ID NO: 213196 - RNA, 22 nt, Homo sapiens
uucacagagagaacucaaacca

SEQ ID NO: 213197 - RNA, 22 nt, Homo sapiens
uucacagaguuauuuuuaugcu

SEQ ID NO: 213198 - RNA, 22 nt, Homo sapiens
uucacagcuuaauaaggcucag

SEQ ID NO: 213199 - RNA, 22 nt, Homo sapiens
uucacagucacccuucuccaug

SEQ ID NO: 213200 - RNA, 22 nt, Homo sapiens
uucacaguggugggagacguca

SEQ ID NO: 213201 - RNA, 22 nt, Homo sapiens
uucacagugugaucuaugggca

SEQ ID NO: 213202 - RNA, 22 nt, Homo sapiens
uucacaugguugccuuuugauc

SEQ ID NO: 213203 - RNA, 21 nt, Homo sapiens
uucaccauggcuccacacucu

SEQ ID NO: 213204 - RNA, 22 nt, Homo sapiens
uucaccuguagcaugcccuugg

SEQ ID NO: 213205 - RNA, 22 nt, Homo sapiens
uucacugugaacucauauucag

SEQ ID NO: 213206 - RNA, 22 nt, Homo sapiens
uucacugugcuuaaauucugcu

SEQ ID NO: 213207 - RNA, 22 nt, Homo sapiens
uucagagugguaugaagugaug

SEQ ID NO: 213208 - RNA, 22 nt, Homo sapiens
uucagaugcacacuguagucua

SEQ ID NO: 213209 - RNA, 20 nt, Homo sapiens
uucagcaaaggaaugggagu

SEQ ID NO: 213210 - RNA, 17 nt, Homo sapiens
ugcuuagagagccucag

SEQ ID NO: 213211 - RNA, 22 nt, Homo sapiens
ugcuuaguguugacccucugcc

SEQ ID NO: 213212 - RNA, 22 nt, Homo sapiens
ugcuuaguuguauguuccacau

SEQ ID NO: 213213 - RNA, 22 nt, Homo sapiens
ugcuuugguagaaaucuuuggu

SEQ ID NO: 213214 - RNA, 21 nt, Homo sapiens
ugcuuuggucauacuucuucc

SEQ ID NO: 213215 - RNA, 22 nt, Homo sapiens
uggaaaguacugagguccaccu

SEQ ID NO: 213216 - RNA, 22 nt, Homo sapiens
uggaaaguacuugaguuuguau

SEQ ID NO: 213217 - RNA, 22 nt, Homo sapiens
uggaaauaaaauagaguuugcc

SEQ ID NO: 213218 - RNA, 22 nt, Homo sapiens
uggaaauaaaugugccaagauc

SEQ ID NO: 213219 - RNA, 22 nt, Homo sapiens
uggaaaucuaaguuuggauuga

SEQ ID NO: 213220 - RNA, 20 nt, Homo sapiens
uggaaauuaaccuuucaggu

SEQ ID NO: 213221 - RNA, 23 nt, Homo sapiens
uggaacugaauuucuuagcauuu

SEQ ID NO: 213222 - RNA, 22 nt, Homo sapiens
uggaagacauugggugaagggu

SEQ ID NO: 213223 - RNA, 22 nt, Homo sapiens
uggaagacucaagguggugaau

SEQ ID NO: 213224 - RNA, 23 nt, Homo sapiens
uggaagacuccucucuuggcugc

SEQ ID NO: 213225 - RNA, 22 nt, Homo sapiens
uggaagacuuuagaggcuuaua

SEQ ID NO: 213226 - RNA, 22 nt, Homo sapiens
uggaagauggaguuuuaucauu

SEQ ID NO: 213227 - RNA, 22 nt, Homo sapiens
uggaagcauagcagcgugugug

SEQ ID NO: 213228 - RNA, 20 nt, Homo sapiens
uggaagccuggugcuaucuu

SEQ ID NO: 213229 - RNA, 21 nt, Homo sapiens
agcuuguguguaucacagugu

SEQ ID NO: 213230 - RNA, 22 nt, Homo sapiens
agcuuguguuugucugccuggg

SEQ ID NO: 213231 - RNA, 22 nt, Homo sapiens
agcuuguuuuauagaaagucaa

SEQ ID NO: 213232 - RNA, 22 nt, Homo sapiens
agcuuguuuucccauaacuaga

SEQ ID NO: 213233 - RNA, 22 nt, Homo sapiens
agcuuguuuuccugcaacuaga

SEQ ID NO: 213234 - RNA, 22 nt, Homo sapiens
agcuuuuugggaggccuuagga

SEQ ID NO: 213235 - RNA, 21 nt, Homo sapiens
aggaagacuaugaucaauugg

SEQ ID NO: 213236 - RNA, 22 nt, Homo sapiens
aggaagacugaaauugcuguuc

SEQ ID NO: 213237 - RNA, 16 nt, Homo sapiens
aggaagacuuagagau

SEQ ID NO: 213238 - RNA, 23 nt, Homo sapiens
aggaaguaacuaucuuuucuguc

SEQ ID NO: 213239 - RNA, 22 nt, Homo sapiens
aggaagugugcaauuaauuucu

SEQ ID NO: 213240 - RNA, 23 nt, Homo sapiens
aggaauggaaaaccaaguaucau

SEQ ID NO: 213241 - RNA, 18 nt, Homo sapiens
aggaaugguaauacuuca

SEQ ID NO: 213242 - RNA, 22 nt, Homo sapiens
aggaauuuaauguaugauaaua

SEQ ID NO: 213243 - RNA, 22 nt, Homo sapiens
aggacacugagcaugggagguu

SEQ ID NO: 213244 - RNA, 19 nt, Homo sapiens
aggacuaaagacuagaagu

SEQ ID NO: 213245 - RNA, 21 nt, Homo sapiens
aggagauguuuguccuuuuag

SEQ ID NO: 213246 - RNA, 22 nt, Homo sapiens
aggagcacuggccuuggaguca

SEQ ID NO: 213247 - RNA, 22 nt, Homo sapiens
aggagcuuuggggaaaacagau

SEQ ID NO: 213248 - RNA, 22 nt, Homo sapiens
aggaggauugcuuucaucuuuu

SEQ ID NO: 213249 - RNA, 22 nt, Homo sapiens
aggagguugguaccaucuguuu

SEQ ID NO: 213250 - RNA, 22 nt, Homo sapiens
aggcaaaugccagcaaucacac

SEQ ID NO: 213251 - RNA, 22 nt, Homo sapiens
aggcaacaugguaaaacccugu

SEQ ID NO: 213252 - RNA, 21 nt, Homo sapiens
aggcaagacuuuuagguuugu

SEQ ID NO: 213253 - RNA, 22 nt, Homo sapiens
aggcaaugugagaguuuauuca

SEQ ID NO: 213254 - RNA, 22 nt, Homo sapiens
aggcacgguggcucacaccugu

SEQ ID NO: 213255 - RNA, 22 nt, Homo sapiens
aggcagcuguuauauacugagu

SEQ ID NO: 213256 - RNA, 23 nt, Homo sapiens
aggccaguuuuuccugcuugcug

SEQ ID NO: 213257 - RNA, 22 nt, Homo sapiens
aggcugguauuuacaaaagcuc

SEQ ID NO: 213258 - RNA, 22 nt, Homo sapiens
aggcuuuauuacagggucucag

SEQ ID NO: 213259 - RNA, 22 nt, Homo sapiens
agggcuuaucuguguagaguuc

SEQ ID NO: 213260 - RNA, 22 nt, Homo sapiens
aggguaguaggcuugggauugg

SEQ ID NO: 213261 - RNA, 22 nt, Homo sapiens
agguaagucucuaauuaugaau

SEQ ID NO: 213262 - RNA, 22 nt, Homo sapiens
agguaauagcacaugauaccuu

SEQ ID NO: 213263 - RNA, 20 nt, Homo sapiens
agguagauagaugauagaua

SEQ ID NO: 213264 - RNA, 22 nt, Homo sapiens
agguagugugaugcuccuguuu

SEQ ID NO: 213265 - RNA, 20 nt, Homo sapiens
agguaguuauacaaaugugu

SEQ ID NO: 213266 - RNA, 21 nt, Homo sapiens
agguaguuuuccuuuuggagu

SEQ ID NO: 213267 - RNA, 22 nt, Homo sapiens
agguauuuucaacuuagaaugg

SEQ ID NO: 213268 - RNA, 22 nt, Homo sapiens
aggugcucuuccuguaggucac

SEQ ID NO: 213269 - RNA, 22 nt, Homo sapiens
aggugcugacaggauagguuuc

SEQ ID NO: 213270 - RNA, 22 nt, Homo sapiens
aggugcuugaaucuaugagcuc

SEQ ID NO: 213271 - RNA, 22 nt, Homo sapiens
aggugcuugagggaagaaauua

SEQ ID NO: 213272 - RNA, 22 nt, Homo sapiens
aggugguuuugaugagcaggua

SEQ ID NO: 213273 - RNA, 22 nt, Homo sapiens
agguguuguugaggagauuuca

SEQ ID NO: 213274 - RNA, 22 nt, Homo sapiens
agguuaugauuauagagcgagg

SEQ ID NO: 213275 - RNA, 22 nt, Homo sapiens
agguuaugauuguagagcgagg

SEQ ID NO: 213276 - RNA, 20 nt, Homo sapiens
agguuauuauaauuagaaga

SEQ ID NO: 213277 - RNA, 21 nt, Homo sapiens
agguuguguuuccucuuacuu

SEQ ID NO: 213278 - RNA, 22 nt, Homo sapiens
aguaacacaccugcauggugug

SEQ ID NO: 213279 - RNA, 22 nt, Homo sapiens
aguaacaggauccaaagaaugu

SEQ ID NO: 213280 - RNA, 22 nt, Homo sapiens
aguauugcuaauaagagauuug

SEQ ID NO: 213281 - RNA, 22 nt, Homo sapiens
aguauuuguuggaauaccuguu

SEQ ID NO: 213282 - RNA, 22 nt, Homo sapiens
agucaaggaggccuuucagaug

SEQ ID NO: 213283 - RNA, 22 nt, Homo sapiens
agucaaguuuuuucagagaaua

SEQ ID NO: 213284 - RNA, 22 nt, Homo sapiens
agucagauuggcauuuguuggg

SEQ ID NO: 213285 - RNA, 17 nt, Homo sapiens
agucaguaguuuguauu

SEQ ID NO: 213286 - RNA, 22 nt, Homo sapiens
agucaguggaguaaauguaauu

SEQ ID NO: 213287 - RNA, 22 nt, Homo sapiens
agucagugucuguaaggagaac

SEQ ID NO: 213288 - RNA, 22 nt, Homo sapiens
agucauaggagagauaucacug

SEQ ID NO: 213289 - RNA, 19 nt, Homo sapiens
agucaugugaggacccuug

SEQ ID NO: 213290 - RNA, 22 nt, Homo sapiens
aguccagguuuuguaauggcaa

SEQ ID NO: 213291 - RNA, 22 nt, Homo sapiens
aguccauuugaugaugauucca

SEQ ID NO: 213292 - RNA, 22 nt, Homo sapiens
agucgguguuacugacagaaug

SEQ ID NO: 213293 - RNA, 22 nt, Homo sapiens
agucugguguucucacacuagu

SEQ ID NO: 213294 - RNA, 22 nt, Homo sapiens
agugaaaugucaccuuuuagga

SEQ ID NO: 213295 - RNA, 22 nt, Homo sapiens
agugaauuguucaacaggagga

SEQ ID NO: 213296 - RNA, 22 nt, Homo sapiens
agugagcuggagaaaagaaacu

SEQ ID NO: 213297 - RNA, 22 nt, Homo sapiens
agugauauguuugccuugaggg

SEQ ID NO: 213298 - RNA, 22 nt, Homo sapiens
agugaucauuugaauugaugau

SEQ ID NO: 213299 - RNA, 22 nt, Homo sapiens
agugcaauggcgugaucuuggc

SEQ ID NO: 213300 - RNA, 22 nt, Homo sapiens
agugcacuccagccugggcaac

SEQ ID NO: 213301 - RNA, 22 nt, Homo sapiens
agugcaguggcacaaucuuggc

SEQ ID NO: 213302 - RNA, 22 nt, Homo sapiens
agugcaguggcauggucauaac

SEQ ID NO: 213303 - RNA, 22 nt, Homo sapiens
agugcagugguuaggagccagg

SEQ ID NO: 213304 - RNA, 22 nt, Homo sapiens
agugcauaugucuuuuuggaag

SEQ ID NO: 213305 - RNA, 22 nt, Homo sapiens
agugcauuuguucugugucagg

SEQ ID NO: 213306 - RNA, 23 nt, Homo sapiens
aguggucuccugggcccagcugu

SEQ ID NO: 213307 - RNA, 22 nt, Homo sapiens
aguggugucugaguggccaggg

SEQ ID NO: 213308 - RNA, 22 nt, Homo sapiens
agugguuugaucacagcucacu

SEQ ID NO: 213309 - RNA, 22 nt, Homo sapiens
agugguuuuggaauggaauuca

SEQ ID NO: 213310 - RNA, 19 nt, Homo sapiens
agugucauggucauuauuu

SEQ ID NO: 213311 - RNA, 22 nt, Homo sapiens
aguguuuuuacaagcacucugg

SEQ ID NO: 213312 - RNA, 22 nt, Homo sapiens
agaaagcgcuucccuuugcugg

SEQ ID NO: 213313 - RNA, 22 nt, Homo sapiens
agaaagugcuucccuuugguga

SEQ ID NO: 213314 - RNA, 23 nt, Homo sapiens
agaaaugucuauucagggucccu

SEQ ID NO: 213315 - RNA, 22 nt, Homo sapiens
agaacacugaguucagggucag

SEQ ID NO: 213316 - RNA, 20 nt, Homo sapiens
agaagcauugcucucuucag

SEQ ID NO: 213317 - RNA, 22 nt, Homo sapiens
agaaugucagcuggauucagcu

SEQ ID NO: 213318 - RNA, 22 nt, Homo sapiens
agaaugugaccuuauuuggaga

SEQ ID NO: 213319 - RNA, 22 nt, Homo sapiens
agacacuguugaaaaggcccca

SEQ ID NO: 213320 - RNA, 21 nt, Homo sapiens
agacacuuggaagguuuuaga

SEQ ID NO: 213321 - RNA, 20 nt, Homo sapiens
agacagcugcagcccacauc

SEQ ID NO: 213322 - RNA, 20 nt, Homo sapiens
agacaguguggagauuccuu

SEQ ID NO: 213323 - RNA, 22 nt, Homo sapiens
agacuagacagaugaacagcac

SEQ ID NO: 213324 - RNA, 20 nt, Homo sapiens
agacuagggagcagaaagcc

SEQ ID NO: 213325 - RNA, 22 nt, Homo sapiens
agagaacugauuggaugugggc

SEQ ID NO: 213326 - RNA, 22 nt, Homo sapiens
agagaccuguaaaguucaggca

SEQ ID NO: 213327 - RNA, 19 nt, Homo sapiens
agagacucauuguagcauu

SEQ ID NO: 213328 - RNA, 22 nt, Homo sapiens
agagaucaauaugaaggaaaug

SEQ ID NO: 213329 - RNA, 20 nt, Homo sapiens
agagaucaguaauucaucaa

SEQ ID NO: 213330 - RNA, 22 nt, Homo sapiens
agagaucauuuuguuucaaauc

SEQ ID NO: 213331 - RNA, 22 nt, Homo sapiens
agagaugaagauggggcucccg

SEQ ID NO: 213332 - RNA, 22 nt, Homo sapiens
agagaugauuaacauuuuggua

SEQ ID NO: 213333 - RNA, 22 nt, Homo sapiens
agagauuauccuggcuucucug

SEQ ID NO: 213334 - RNA, 22 nt, Homo sapiens
agagcaauguuaucagucucug

SEQ ID NO: 213335 - RNA, 22 nt, Homo sapiens
agagcacuguggguccaaauau

SEQ ID NO: 213336 - RNA, 22 nt, Homo sapiens
agagccacauuaaauaugggaa

SEQ ID NO: 213337 - RNA, 22 nt, Homo sapiens
agagcuaguauuuacggagcau

SEQ ID NO: 213338 - RNA, 18 nt, Homo sapiens
agagcuaugaacauaugc

SEQ ID NO: 213339 - RNA, 22 nt, Homo sapiens
agagcuguguuuuaacuuuuua

SEQ ID NO: 213340 - RNA, 22 nt, Homo sapiens
agagguagaagauaggcuacag

SEQ ID NO: 213341 - RNA, 22 nt, Homo sapiens
agagguauacauuugagagcca

SEQ ID NO: 213342 - RNA, 22 nt, Homo sapiens
agagguaugccugggcuggagc

SEQ ID NO: 213343 - RNA, 22 nt, Homo sapiens
agagguauuggaaggaguguca

SEQ ID NO: 213344 - RNA, 22 nt, Homo sapiens
agagguuuaacuggcuuauggu

SEQ ID NO: 213345 - RNA, 23 nt, Homo sapiens
agagguuuaaucaggcaguugcu

SEQ ID NO: 213346 - RNA, 20 nt, Homo sapiens
agagguuuugauagguucug

SEQ ID NO: 213347 - RNA, 22 nt, Homo sapiens
agaguaguuuauuaugcuaagg

SEQ ID NO: 213348 - RNA, 22 nt, Homo sapiens
agaguaguuucuauauucuuca

SEQ ID NO: 213349 - RNA, 22 nt, Homo sapiens
agaguauacaugugagugagau

SEQ ID NO: 213350 - RNA, 19 nt, Homo sapiens
agaguauuguuacuucucu

SEQ ID NO: 213351 - RNA, 22 nt, Homo sapiens
agagucacaugaggcccuucau

SEQ ID NO: 213352 - RNA, 22 nt, Homo sapiens
agagugcaaagguuggggcugg

SEQ ID NO: 213353 - RNA, 22 nt, Homo sapiens
agagugcuauagauuagauuuc

SEQ ID NO: 213354 - RNA, 22 nt, Homo sapiens
agauacaucuaugugucugugu

SEQ ID NO: 213355 - RNA, 22 nt, Homo sapiens
agaugccucauguucuagguuc

SEQ ID NO: 213356 - RNA, 22 nt, Homo sapiens
agaugcuguuaucaacuguagc

SEQ ID NO: 213357 - RNA, 22 nt, Homo sapiens
agaugguuuuguucacagcucu

SEQ ID NO: 213358 - RNA, 22 nt, Homo sapiens
agcaaaucuaugaauguauauu

SEQ ID NO: 213359 - RNA, 22 nt, Homo sapiens
agcaacauggaguuugugcgca

SEQ ID NO: 213360 - RNA, 22 nt, Homo sapiens
agcaacauuguucauaauagcu

SEQ ID NO: 213361 - RNA, 22 nt, Homo sapiens
agcaaccagaggagaugaggcu

SEQ ID NO: 213362 - RNA, 22 nt, Homo sapiens
agcacagccuuguguuuucuug

SEQ ID NO: 213363 - RNA, 22 nt, Homo sapiens
agcaccaauaacaguuucuagc

SEQ ID NO: 213364 - RNA, 22 nt, Homo sapiens
agcaccacaauuuccugccuaa

SEQ ID NO: 213365 - RNA, 23 nt, Homo sapiens
agcaccaccccaggucacaagug

SEQ ID NO: 213366 - RNA, 22 nt, Homo sapiens
agcaccagaaucugaguuauuc

SEQ ID NO: 213367 - RNA, 22 nt, Homo sapiens
agcaccaugggcugaguaagug

SEQ ID NO: 213368 - RNA, 22 nt, Homo sapiens
agcacgaaaccaaauucuguga

SEQ ID NO: 213369 - RNA, 22 nt, Homo sapiens
agcacgauggggucacgaugag

SEQ ID NO: 213370 - RNA, 22 nt, Homo sapiens
agcagagcaguggauuuuguga

SEQ ID NO: 213371 - RNA, 22 nt, Homo sapiens
agcagauguuuagugagcgccu

SEQ ID NO: 213372 - RNA, 22 nt, Homo sapiens
agcagcaauuuuguaugguuua

SEQ ID NO: 213373 - RNA, 22 nt, Homo sapiens
agcagcauauuuuuauaaugua

SEQ ID NO: 213374 - RNA, 22 nt, Homo sapiens
agcagcauggguauaaaucucc

SEQ ID NO: 213375 - RNA, 22 nt, Homo sapiens
agcagcucaugccuuugggagg

SEQ ID NO: 213376 - RNA, 22 nt, Homo sapiens
agcagcuuugcauggccugugg

SEQ ID NO: 213377 - RNA, 22 nt, Homo sapiens
agcagguauuuaagaaacucag

SEQ ID NO: 213378 - RNA, 22 nt, Homo sapiens
agcagguguggcuuauccugaa

SEQ ID NO: 213379 - RNA, 22 nt, Homo sapiens
agcauagugccuugaaaacaau

SEQ ID NO: 213380 - RNA, 22 nt, Homo sapiens
agcaucacacacuacagggaaa

SEQ ID NO: 213381 - RNA, 22 nt, Homo sapiens
agcaucagugauuuuguugaag

SEQ ID NO: 213382 - RNA, 22 nt, Homo sapiens
agcaucaugcaguugcuauuca

SEQ ID NO: 213383 - RNA, 22 nt, Homo sapiens
agcaugauugggguugggcaca

SEQ ID NO: 213384 - RNA, 16 nt, Homo sapiens
agccaccauuuacuug

SEQ ID NO: 213385 - RNA, 22 nt, Homo sapiens
agccaguauuuccacagagugg

SEQ ID NO: 213386 - RNA, 22 nt, Homo sapiens
agcccagagacuguguaaauuu

SEQ ID NO: 213387 - RNA, 22 nt, Homo sapiens
auagcaaugcaagaauggcuua

SEQ ID NO: 213388 - RNA, 21 nt, Homo sapiens
auagcacuucacuugguuaga

SEQ ID NO: 213389 - RNA, 22 nt, Homo sapiens
auagcagcuugucagggcagac

SEQ ID NO: 213390 - RNA, 22 nt, Homo sapiens
auagcagugccccaaacuccug

SEQ ID NO: 213391 - RNA, 22 nt, Homo sapiens
auagcagugucccacuccuugg

SEQ ID NO: 213392 - RNA, 22 nt, Homo sapiens
auagcagugugaaaacagacug

SEQ ID NO: 213393 - RNA, 22 nt, Homo sapiens
auagcagugugaaaauggacua

SEQ ID NO: 213394 - RNA, 20 nt, Homo sapiens
auagcauugauggacucaaa

SEQ ID NO: 213395 - RNA, 22 nt, Homo sapiens
auagccaguagagagcuguuag

SEQ ID NO: 213396 - RNA, 22 nt, Homo sapiens
auagguaguugaggagauuuca

SEQ ID NO: 213397 - RNA, 22 nt, Homo sapiens
auagguuauuagagcaaagcuu

SEQ ID NO: 213398 - RNA, 22 nt, Homo sapiens
auagguuuucacuguagauucu

SEQ ID NO: 213399 - RNA, 22 nt, Homo sapiens
auaguagcaugcacuggugcug

SEQ ID NO: 213400 - RNA, 22 nt, Homo sapiens
auagugcugcaauaaacauaca

SEQ ID NO: 213401 - RNA, 22 nt, Homo sapiens
auagugcugcaauaaacauaug

SEQ ID NO: 213402 - RNA, 22 nt, Homo sapiens
auagugcugcauuaaacauacg

SEQ ID NO: 213403 - RNA, 22 nt, Homo sapiens
auagugcuggaauaaauauacg

SEQ ID NO: 213404 - RNA, 22 nt, Homo sapiens
auagugcuuuugaaucuuguug

SEQ ID NO: 213405 - RNA, 22 nt, Homo sapiens
auagugcuuuuuagaaccugga

SEQ ID NO: 213406 - RNA, 19 nt, Homo sapiens
auauaacauccaggagcag

SEQ ID NO: 213407 - RNA, 23 nt, Homo sapiens
auauaguagaugugcaguaacau

SEQ ID NO: 213408 - RNA, 22 nt, Homo sapiens
auauaugcuaagugcuaauaaa

SEQ ID NO: 213409 - RNA, 22 nt, Homo sapiens
auauauguuuucugggaagaaa

SEQ ID NO: 213410 - RNA, 22 nt, Homo sapiens
auaucaacaugguaggguuggu

SEQ ID NO: 213411 - RNA, 22 nt, Homo sapiens
auaucacaggaaaggaagauac

SEQ ID NO: 213412 - RNA, 22 nt, Homo sapiens
auauccaugccauagguuuuga

SEQ ID NO: 213413 - RNA, 22 nt, Homo sapiens
auaugcauacccucaccaacua

SEQ ID NO: 213414 - RNA, 22 nt, Homo sapiens
auauggguuuuauauuaggcuc

SEQ ID NO: 213415 - RNA, 22 nt, Homo sapiens
auaugguuuuuggaagcauauc

SEQ ID NO: 213416 - RNA, 22 nt, Homo sapiens
auauguauuuuaacguguaagg

SEQ ID NO: 213417 - RNA, 22 nt, Homo sapiens
auaugucuguuuagucuguaau

SEQ ID NO: 213418 - RNA, 22 nt, Homo sapiens
auauguucucauucauaugugg

SEQ ID NO: 213419 - RNA, 22 nt, Homo sapiens
auauuggacucugugcuaggaa

SEQ ID NO: 213420 - RNA, 22 nt, Homo sapiens
auauuguacugcuacugguucu

SEQ ID NO: 213421 - RNA, 19 nt, Homo sapiens
aucaaacugcucuuugagg

SEQ ID NO: 213422 - RNA, 22 nt, Homo sapiens
aucaaagugaaauauuaguuau

SEQ ID NO: 213423 - RNA, 22 nt, Homo sapiens
aucacagaacuuugagcagaga

SEQ ID NO: 213424 - RNA, 22 nt, Homo sapiens
aucacagaguuaaaacuuucuu

SEQ ID NO: 213425 - RNA, 22 nt, Homo sapiens
aucacagcccuccucuuggaug

SEQ ID NO: 213426 - RNA, 22 nt, Homo sapiens
aucaccagaugcuucaagcaga

SEQ ID NO: 213427 - RNA, 22 nt, Homo sapiens
aucaccugagcaguauacacug

SEQ ID NO: 213428 - RNA, 22 nt, Homo sapiens
aucacuagaucauagguaaaca

SEQ ID NO: 213429 - RNA, 22 nt, Homo sapiens
aucacuggucaugagagaagua

SEQ ID NO: 213430 - RNA, 22 nt, Homo sapiens
aucacuguaaguuuacacuuug

SEQ ID NO: 213431 - RNA, 23 nt, Homo sapiens
aucacuguuaacaauuucuuccu

SEQ ID NO: 213432 - RNA, 16 nt, Homo sapiens
aucacuugcuucuuuu

SEQ ID NO: 213433 - RNA, 22 nt, Homo sapiens
aucacuuucuauuucugugcca

SEQ ID NO: 213434 - RNA, 22 nt, Homo sapiens
aucacuuugcucuccagugugg

SEQ ID NO: 213435 - RNA, 22 nt, Homo sapiens
aucagaaucucuagaggacugu

SEQ ID NO: 213436 - RNA, 22 nt, Homo sapiens
aucagaaucucuagugggacca

SEQ ID NO: 213437 - RNA, 22 nt, Homo sapiens
aucagaaucucuugagaguguu

SEQ ID NO: 213438 - RNA, 22 nt, Homo sapiens
aucagagugaaacaugggagau

SEQ ID NO: 213439 - RNA, 22 nt, Homo sapiens
aucagagugaugguuuaaguau

SEQ ID NO: 213440 - RNA, 22 nt, Homo sapiens
aucagaguggguuuuaaaagug

SEQ ID NO: 213441 - RNA, 23 nt, Homo sapiens
aucagauaguuguagguaugugg

SEQ ID NO: 213442 - RNA, 22 nt, Homo sapiens
aucagauuccagaggcagcacc

SEQ ID NO: 213443 - RNA, 22 nt, Homo sapiens
aucagcagcaugaaaacaggcu

SEQ ID NO: 213444 - RNA, 22 nt, Homo sapiens
aucagcauucccaaaugaugug

SEQ ID NO: 213445 - RNA, 22 nt, Homo sapiens
aucaggaaccuuuuuggugugu

SEQ ID NO: 213446 - RNA, 22 nt, Homo sapiens
aucagucuguuggaauaucgcu

SEQ ID NO: 213447 - RNA, 22 nt, Homo sapiens
aucagugauugauuuaaagacg

SEQ ID NO: 213448 - RNA, 22 nt, Homo sapiens
aucagugcauguuuguugagcu

SEQ ID NO: 213449 - RNA, 22 nt, Homo sapiens
aucauaucaucugcaaacaaag

SEQ ID NO: 213450 - RNA, 22 nt, Homo sapiens
aucaucaugcacuacagccugg

SEQ ID NO: 213451 - RNA, 22 nt, Homo sapiens
aucaugucuucccagugauucu

SEQ ID NO: 213452 - RNA, 22 nt, Homo sapiens
aucauuaguuguggaauucuug

SEQ ID NO: 213453 - RNA, 22 nt, Homo sapiens
auccccugcacggggugucauu

SEQ ID NO: 213454 - RNA, 22 nt, Homo sapiens
aucccuguguccagcaccugug

SEQ ID NO: 213455 - RNA, 22 nt, Homo sapiens
auccucaguggcuuaaguauag

SEQ ID NO: 213456 - RNA, 22 nt, Homo sapiens
auccucugagaucuaggcagag

SEQ ID NO: 213457 - RNA, 22 nt, Homo sapiens
auccugaugacacagugcugca

SEQ ID NO: 213458 - RNA, 22 nt, Homo sapiens
auccuguacuaagguuuuccca

SEQ ID NO: 213459 - RNA, 22 nt, Homo sapiens
aucgcacuccauccugggcaac

SEQ ID NO: 213460 - RNA, 22 nt, Homo sapiens
aucuaaaucucauaugggcaca

SEQ ID NO: 213461 - RNA, 22 nt, Homo sapiens
aucuagagacauaguaaagaau

SEQ ID NO: 213462 - RNA, 22 nt, Homo sapiens
aucucaaugcuuuuguaggcca

SEQ ID NO: 213463 - RNA, 22 nt, Homo sapiens
aucucagcaacuaaagauccuu

SEQ ID NO: 213464 - RNA, 22 nt, Homo sapiens
aucucaguuaauuccaucuuuc

SEQ ID NO: 213465 - RNA, 22 nt, Homo sapiens
aucucaguucaggcuggccaca

SEQ ID NO: 213466 - RNA, 22 nt, Homo sapiens
aucucauuccuucugggcugau

SEQ ID NO: 213467 - RNA, 22 nt, Homo sapiens
aucucugagauguucugauuuu

SEQ ID NO: 213468 - RNA, 20 nt, Homo sapiens
aucucugggcaaaggaaaau

SEQ ID NO: 213469 - RNA, 22 nt, Homo sapiens
aucucuugccagucagaauggu

SEQ ID NO: 213470 - RNA, 22 nt, Homo sapiens
aucugauggagagcguguggcu

SEQ ID NO: 213471 - RNA, 22 nt, Homo sapiens
aucugcacaucuguguuuuugu

SEQ ID NO: 213472 - RNA, 22 nt, Homo sapiens
aucuggcuucuuuuaguccaca

SEQ ID NO: 213473 - RNA, 22 nt, Homo sapiens
aucugugaaugaaguuauuuug

SEQ ID NO: 213474 - RNA, 22 nt, Homo sapiens
aucuuguccugagguuuuauug

SEQ ID NO: 213475 - RNA, 22 nt, Homo sapiens
aucuuugauuguagguacaaug

SEQ ID NO: 213476 - RNA, 23 nt, Homo sapiens
augaaagcccuugcaaaugcugg

SEQ ID NO: 213477 - RNA, 22 nt, Homo sapiens
augaaagguugucuuaagccau

SEQ ID NO: 213478 - RNA, 22 nt, Homo sapiens
augaaagugauaaaugucucua

SEQ ID NO: 213479 - RNA, 22 nt, Homo sapiens
augaaauugcuaucgcaguacu

SEQ ID NO: 213480 - RNA, 22 nt, Homo sapiens
augaacucaucauuuuuauggc

SEQ ID NO: 213481 - RNA, 18 nt, Homo sapiens
augaacucaucauuuuuu

SEQ ID NO: 213482 - RNA, 22 nt, Homo sapiens
augaacucaucauuuuuuaugg

SEQ ID NO: 213483 - RNA, 17 nt, Homo sapiens
augaacucaucguucuu

SEQ ID NO: 213484 - RNA, 22 nt, Homo sapiens
augaagagaaaguggaucuugg

SEQ ID NO: 213485 - RNA, 22 nt, Homo sapiens
augaagaucucugccuuguguc

SEQ ID NO: 213486 - RNA, 22 nt, Homo sapiens
augaagauguugccuuuuuaau

SEQ ID NO: 213487 - RNA, 20 nt, Homo sapiens
augaaggcaggugugaguuu

SEQ ID NO: 213488 - RNA, 22 nt, Homo sapiens
augaauacagcuaugcgugcau

SEQ ID NO: 213489 - RNA, 22 nt, Homo sapiens
auggucccauucauucacguau

SEQ ID NO: 213490 - RNA, 21 nt, Homo sapiens
auggugagaaaguagugucaa

SEQ ID NO: 213491 - RNA, 22 nt, Homo sapiens
auguaaacagaugugcagcuug

SEQ ID NO: 213492 - RNA, 22 nt, Homo sapiens
auguaacaguauuuggagaugu

SEQ ID NO: 213493 - RNA, 22 nt, Homo sapiens
auguaacuaucugagccauggg

SEQ ID NO: 213494 - RNA, 22 nt, Homo sapiens
auguaguagauauuuauggaaa

SEQ ID NO: 213495 - RNA, 22 nt, Homo sapiens
auguaguaugaagaagaugcuu

SEQ ID NO: 213496 - RNA, 22 nt, Homo sapiens
augucaaagaggaaaacuggau

SEQ ID NO: 213497 - RNA, 20 nt, Homo sapiens
augucaggaagggagucagg

SEQ ID NO: 213498 - RNA, 22 nt, Homo sapiens
augucauagaagccugugaacc

SEQ ID NO: 213499 - RNA, 22 nt, Homo sapiens
augugaacaucauagaaugcac

SEQ ID NO: 213500 - RNA, 22 nt, Homo sapiens
augugaacugaauuaauucaca

SEQ ID NO: 213501 - RNA, 17 nt, Homo sapiens
augugaauguucaaaua

SEQ ID NO: 213502 - RNA, 22 nt, Homo sapiens
augugacugauguaaucagaca

SEQ ID NO: 213503 - RNA, 21 nt, Homo sapiens
augugcacuaugucauuuaau

SEQ ID NO: 213504 - RNA, 22 nt, Homo sapiens
augugccaauuaggauuccaag

SEQ ID NO: 213505 - RNA, 22 nt, Homo sapiens
augugcuaguaucaaacgagac

SEQ ID NO: 213506 - RNA, 22 nt, Homo sapiens
augugcuuuuggugagagauuu

SEQ ID NO: 213507 - RNA, 22 nt, Homo sapiens
auguggaaauguauaugugucu

SEQ ID NO: 213508 - RNA, 22 nt, Homo sapiens
augugggaggacuuggcuguug

SEQ ID NO: 213509 - RNA, 22 nt, Homo sapiens
augugguaguuauagugauaag

SEQ ID NO: 213510 - RNA, 19 nt, Homo sapiens
augugguuagcaugacugc

SEQ ID NO: 213511 - RNA, 22 nt, Homo sapiens
augugucaaaucuaggccaaag

SEQ ID NO: 213512 - RNA, 23 nt, Homo sapiens
augugugcuuggagagcaggaug

SEQ ID NO: 213513 - RNA, 20 nt, Homo sapiens
auguucuggaggacagaagc

SEQ ID NO: 213514 - RNA, 22 nt, Homo sapiens
auuaacaucuagaguuuuggug

SEQ ID NO: 213515 - RNA, 23 nt, Homo sapiens
auuaagguuacuacaguaugagg

SEQ ID NO: 213516 - RNA, 22 nt, Homo sapiens
auuaagugcuugcagaagucca

SEQ ID NO: 213517 - RNA, 22 nt, Homo sapiens
auuaagugcuugccagugcugg

SEQ ID NO: 213518 - RNA, 22 nt, Homo sapiens
auuaaguugugccugaaaacuu

SEQ ID NO: 213519 - RNA, 22 nt, Homo sapiens
auuacacuuucuauucaaugag

SEQ ID NO: 213520 - RNA, 22 nt, Homo sapiens
auuagguauuuucuggacaggg

SEQ ID NO: 213521 - RNA, 22 nt, Homo sapiens
auuagguuaggcaaacuucugu

SEQ ID NO: 213522 - RNA, 22 nt, Homo sapiens
auuauaguguauacuugaaauu

SEQ ID NO: 213523 - RNA, 22 nt, Homo sapiens
auuauauguguaugugcauacc

SEQ ID NO: 213524 - RNA, 22 nt, Homo sapiens
auuauuagucggccagcuguua

SEQ ID NO: 213525 - RNA, 22 nt, Homo sapiens
auucaagugaugcagcuguuuu

SEQ ID NO: 213526 - RNA, 22 nt, Homo sapiens
auucacuguggcuuucucugau

SEQ ID NO: 213527 - RNA, 22 nt, Homo sapiens
auucaucagggauauuggucug

SEQ ID NO: 213528 - RNA, 22 nt, Homo sapiens
auuccaguuugugagaagcugu

SEQ ID NO: 213529 - RNA, 22 nt, Homo sapiens
auucccuuagcugccucagccu

SEQ ID NO: 213530 - RNA, 20 nt, Homo sapiens
auugaacucaguauucugaa

SEQ ID NO: 213531 - RNA, 22 nt, Homo sapiens
auugaacuuaaaagacuugcca

SEQ ID NO: 213532 - RNA, 22 nt, Homo sapiens
auugaaucuaaaaugagucucu

SEQ ID NO: 213533 - RNA, 22 nt, Homo sapiens
auugacacugauuuuucuuuaa

SEQ ID NO: 213534 - RNA, 22 nt, Homo sapiens
auugagcaaggucuccuaguau

SEQ ID NO: 213535 - RNA, 18 nt, Homo sapiens
auugagcaugacagaccu

SEQ ID NO: 213536 - RNA, 22 nt, Homo sapiens
auugaguaaaaaauagugaugu

SEQ ID NO: 213537 - RNA, 22 nt, Homo sapiens
auugaguaacaauuuuguucaa

SEQ ID NO: 213538 - RNA, 22 nt, Homo sapiens
auugauagaucauaugguaggu

SEQ ID NO: 213539 - RNA, 22 nt, Homo sapiens
auugcaaagcguagacucuaaa

SEQ ID NO: 213540 - RNA, 22 nt, Homo sapiens
auugcaacuuccgccuccuggg

SEQ ID NO: 213541 - RNA, 22 nt, Homo sapiens
auugcacaucugcacuacagcc

SEQ ID NO: 213542 - RNA, 19 nt, Homo sapiens
auugcacuccaaccugggu

SEQ ID NO: 213543 - RNA, 22 nt, Homo sapiens
auugcacuccagcccgggugac

SEQ ID NO: 213544 - RNA, 23 nt, Homo sapiens
auugcacuccagccuaccugggc

SEQ ID NO: 213545 - RNA, 22 nt, Homo sapiens
auugcacuccagccugcggaac

SEQ ID NO: 213546 - RNA, 22 nt, Homo sapiens
auugcacuccagccugggcgac

SEQ ID NO: 213547 - RNA, 22 nt, Homo sapiens
auugcacuccagccugggugag

SEQ ID NO: 213548 - RNA, 22 nt, Homo sapiens
auugcacuccagccuugugaca

SEQ ID NO: 213549 - RNA, 22 nt, Homo sapiens
auugcacuccagucugggcaac

SEQ ID NO: 213550 - RNA, 23 nt, Homo sapiens
auugcagaaucacagagguagug

SEQ ID NO: 213551 - RNA, 22 nt, Homo sapiens
auugcagauucgcuuuguguug

SEQ ID NO: 213552 - RNA, 20 nt, Homo sapiens
auugcagcaugauuuauaau

SEQ ID NO: 213553 - RNA, 23 nt, Homo sapiens
auugcagucuugaacuccugggc

SEQ ID NO: 213554 - RNA, 19 nt, Homo sapiens
auugcaguguaaaacuauu

SEQ ID NO: 213555 - RNA, 22 nt, Homo sapiens
auugccacaucucagaggcaga

SEQ ID NO: 213556 - RNA, 22 nt, Homo sapiens
auugcuaacugaaauaagacca

SEQ ID NO: 213557 - RNA, 22 nt, Homo sapiens
auugcucaaaucaguacuugag

SEQ ID NO: 213558 - RNA, 22 nt, Homo sapiens
auugcucuuagaaauauuucuu

SEQ ID NO: 213559 - RNA, 22 nt, Homo sapiens
auugcuuuuacugggagcuuug

SEQ ID NO: 213560 - RNA, 22 nt, Homo sapiens
auuggcaagauagcauaugagg

SEQ ID NO: 213561 - RNA, 22 nt, Homo sapiens
auuggcaauagcuuucuuacua

SEQ ID NO: 213562 - RNA, 22 nt, Homo sapiens
auuggucuugaaaccagagaga

SEQ ID NO: 213563 - RNA, 22 nt, Homo sapiens
auuggugaccugcggcaguaug

SEQ ID NO: 213564 - RNA, 18 nt, Homo sapiens
auuguaagauguauggga

SEQ ID NO: 213565 - RNA, 22 nt, Homo sapiens
auuguaauuuuagagaaagugg

SEQ ID NO: 213566 - RNA, 22 nt, Homo sapiens
auuguacuccagccugggcgac

SEQ ID NO: 213567 - RNA, 22 nt, Homo sapiens
auuguacuccagccugggcugc

SEQ ID NO: 213568 - RNA, 22 nt, Homo sapiens
auuguacuuauugccagaauuu

SEQ ID NO: 213569 - RNA, 22 nt, Homo sapiens
auugucacugugcuccaccagu

SEQ ID NO: 213570 - RNA, 22 nt, Homo sapiens
auugugcuaaaguaauaaguca

SEQ ID NO: 213571 - RNA, 22 nt, Homo sapiens
auuguucuuguguccuuuuccu

SEQ ID NO: 213572 - RNA, 19 nt, Homo sapiens
auuuccuggagcuggucuc

SEQ ID NO: 213573 - RNA, 22 nt, Homo sapiens
auuugguaauauuuaaggacuu

SEQ ID NO: 213574 - RNA, 22 nt, Homo sapiens
auuugguuauggucauggacac

SEQ ID NO: 213575 - RNA, 22 nt, Homo sapiens
auuugucacuuaacagccauua

SEQ ID NO: 213576 - RNA, 22 nt, Homo sapiens
auuuguccugccuuuuccuccu

SEQ ID NO: 213577 - RNA, 22 nt, Homo sapiens
auuuugguuacauaguugagcu

SEQ ID NO: 213578 - RNA, 21 nt, Homo sapiens
auuuuugcagagcugguagug

SEQ ID NO: 213579 - RNA, 22 nt, Homo sapiens
auuuuuggauauagggaaggau

SEQ ID NO: 213580 - RNA, 22 nt, Homo sapiens
caaaccuguaggggccaagagg

SEQ ID NO: 213581 - RNA, 22 nt, Homo sapiens
caaagcuauagcaccagaggga

SEQ ID NO: 213582 - RNA, 22 nt, Homo sapiens
caaaggcuguuauaggccagga

SEQ ID NO: 213583 - RNA, 22 nt, Homo sapiens
caaaguaauuacgguuuuggcc

SEQ ID NO: 213584 - RNA, 22 nt, Homo sapiens
caaagucuauucuacccuuacc

SEQ ID NO: 213585 - RNA, 22 nt, Homo sapiens
caaagugcugaaagaggccagg

SEQ ID NO: 213586 - RNA, 22 nt, Homo sapiens
caaagugcugggaugggccagg

SEQ ID NO: 213587 - RNA, 22 nt, Homo sapiens
caacacuguuuauuggauagcc

SEQ ID NO: 213588 - RNA, 22 nt, Homo sapiens
caacugcucacuccuggguuca

SEQ ID NO: 213589 - RNA, 22 nt, Homo sapiens
caaggaauucucaauagaguua

SEQ ID NO: 213590 - RNA, 22 nt, Homo sapiens
caaggcacagccccuacuuccu

SEQ ID NO: 213591 - RNA, 22 nt, Homo sapiens
cauugguugaacagauuguguu

SEQ ID NO: 213592 - RNA, 22 nt, Homo sapiens
cauugguuggacaguucucucu

SEQ ID NO: 213593 - RNA, 22 nt, Homo sapiens
cauuguacauaaguauggagua

SEQ ID NO: 213594 - RNA, 22 nt, Homo sapiens
cauuugguggcuacagaguaac

SEQ ID NO: 213595 - RNA, 22 nt, Homo sapiens
cauuuugcaguuucugucucca

SEQ ID NO: 213596 - RNA, 22 nt, Homo sapiens
ccaaggcacugauucuguacuc

SEQ ID NO: 213597 - RNA, 19 nt, Homo sapiens
ccacaaugguugaacuaga

SEQ ID NO: 213598 - RNA, 22 nt, Homo sapiens
ccacacugucuuggugggaaac

SEQ ID NO: 213599 - RNA, 22 nt, Homo sapiens
ccacaguagucuugggaugggc

SEQ ID NO: 213600 - RNA, 22 nt, Homo sapiens
ccaccgggucccagcucugcuc

SEQ ID NO: 213601 - RNA, 22 nt, Homo sapiens
ccaccuguacuuaagucacuuu

SEQ ID NO: 213602 - RNA, 22 nt, Homo sapiens
ccagccgggugcaguggcucac

SEQ ID NO: 213603 - RNA, 22 nt, Homo sapiens
ccaggguugagacccacugacu

SEQ ID NO: 213604 - RNA, 22 nt, Homo sapiens
ccaguauuuuauugaggguuuu

SEQ ID NO: 213605 - RNA, 22 nt, Homo sapiens
ccagugcugugcaguguaugag

SEQ ID NO: 213606 - RNA, 22 nt, Homo sapiens
ccagugucugacagacacggcg

SEQ ID NO: 213607 - RNA, 22 nt, Homo sapiens
ccaguguucuggaaggcugagu

SEQ ID NO: 213608 - RNA, 19 nt, Homo sapiens
ccaguguugccagagcuga

SEQ ID NO: 213609 - RNA, 22 nt, Homo sapiens
ccaguguuuuugaauuccagga

SEQ ID NO: 213610 - RNA, 22 nt, Homo sapiens
ccaguuuucaagauaaugguuu

SEQ ID NO: 213611 - RNA, 22 nt, Homo sapiens
ccaguuuuucauuuauacuagu

SEQ ID NO: 213612 - RNA, 22 nt, Homo sapiens
ccaguuuuuggcaaugaugaau

SEQ ID NO: 213613 - RNA, 22 nt, Homo sapiens
ccaucacacugugauuauuauc

SEQ ID NO: 213614 - RNA, 22 nt, Homo sapiens
ccaucacgugcaguggccccac

SEQ ID NO: 213615 - RNA, 20 nt, Homo sapiens
ccaucaguccucucuuguuc

SEQ ID NO: 213616 - RNA, 22 nt, Homo sapiens
ccaucccuuucugagcaguucc

SEQ ID NO: 213617 - RNA, 21 nt, Homo sapiens
ccauggcaaugguaaacugac

SEQ ID NO: 213618 - RNA, 22 nt, Homo sapiens
ccauggcuucugcauucuguca

SEQ ID NO: 213619 - RNA, 22 nt, Homo sapiens
ccauugaacaugaaggaaugug

SEQ ID NO: 213620 - RNA, 22 nt, Homo sapiens
ccauugcacuccagccuaggca

SEQ ID NO: 213621 - RNA, 22 nt, Homo sapiens
ccauugcacucuggccuaggug

SEQ ID NO: 213622 - RNA, 22 nt, Homo sapiens
cccagcguucggcauggcugag

SEQ ID NO: 213623 - RNA, 22 nt, Homo sapiens
cccagugguuacauaaggagua

SEQ ID NO: 213624 - RNA, 19 nt, Homo sapiens
cccagugucagagaagggu

SEQ ID NO: 213625 - RNA, 22 nt, Homo sapiens
cccagugugaacuuggcauuuu

SEQ ID NO: 213626 - RNA, 22 nt, Homo sapiens
cccaguguuuauuuugagccaa

SEQ ID NO: 213627 - RNA, 22 nt, Homo sapiens
ccccagguuucaauaaagccca

SEQ ID NO: 213628 - RNA, 22 nt, Homo sapiens
ccccagugguugcaacagcaga

SEQ ID NO: 213629 - RNA, 22 nt, Homo sapiens
ccccauguucucucugcagcuc

SEQ ID NO: 213630 - RNA, 22 nt, Homo sapiens
ccccauuguugugguuuuaucu

SEQ ID NO: 213631 - RNA, 22 nt, Homo sapiens
cccgggcugaaaucagauuugu

SEQ ID NO: 213632 - RNA, 23 nt, Homo sapiens
cccucagaagugcagggagagaa

SEQ ID NO: 213633 - RNA, 22 nt, Homo sapiens
cccucgagaaaccaucugcuga

SEQ ID NO: 213634 - RNA, 22 nt, Homo sapiens
cccugaagaaagccuaggacau

SEQ ID NO: 213635 - RNA, 22 nt, Homo sapiens
cccugagcagccugaguuuccc

SEQ ID NO: 213636 - RNA, 19 nt, Homo sapiens
cccuggcacauggaaaaug

SEQ ID NO: 213637 - RNA, 22 nt, Homo sapiens
cccuuagacuacuaauaugagc

SEQ ID NO: 213638 - RNA, 22 nt, Homo sapiens
ccggcugugugacugugggcag

SEQ ID NO: 213639 - RNA, 22 nt, Homo sapiens
ccucccuuuguugcaagggaaa

SEQ ID NO: 213640 - RNA, 22 nt, Homo sapiens
ccugagacgaauggagugaaca

SEQ ID NO: 213641 - RNA, 22 nt, Homo sapiens
ccuggaucauugucauucccaa

SEQ ID NO: 213642 - RNA, 18 nt, Homo sapiens
ccuuaguuauagagaguc

SEQ ID NO: 213643 - RNA, 22 nt, Homo sapiens
ccuucauucauuaauuuagccc

SEQ ID NO: 213644 - RNA, 22 nt, Homo sapiens
ccuucuuuuguaaggcugaaua

SEQ ID NO: 213645 - RNA, 22 nt, Homo sapiens
ccuugcacuucccaggugaggc

SEQ ID NO: 213646 - RNA, 22 nt, Homo sapiens
ccuuggcaauggcuggggcuga

SEQ ID NO: 213647 - RNA, 19 nt, Homo sapiens
ccuuugguuuccaugacau

SEQ ID NO: 213648 - RNA, 22 nt, Homo sapiens
cgcccuguagcuagcuagaggu

SEQ ID NO: 213649 - RNA, 22 nt, Homo sapiens
cgccugagcugaggaagcugca

SEQ ID NO: 213650 - RNA, 22 nt, Homo sapiens
cgcuggugaucuagacccccaa

SEQ ID NO: 213651 - RNA, 16 nt, Homo sapiens
cuaaaaugucuacuug

SEQ ID NO: 213652 - RNA, 22 nt, Homo sapiens
cuaaagauagugacaugauuug

SEQ ID NO: 213653 - RNA, 22 nt, Homo sapiens
cuaaaugcacugucaaaggaag

SEQ ID NO: 213654 - RNA, 22 nt, Homo sapiens
cuaacacagggcaagucaggcu

SEQ ID NO: 213655 - RNA, 17 nt, Homo sapiens
cuaaggcaagagucugc

SEQ ID NO: 213656 - RNA, 22 nt, Homo sapiens
cuaagugaacugucacugagaa

SEQ ID NO: 213657 - RNA, 22 nt, Homo sapiens
cuacagcacugagcugugugca

SEQ ID NO: 213658 - RNA, 22 nt, Homo sapiens
cuacagguaugaaagggaguau

SEQ ID NO: 213659 - RNA, 22 nt, Homo sapiens
cuacaguguauuuauggagggu

SEQ ID NO: 213660 - RNA, 22 nt, Homo sapiens
cuacaguucuuaauuaaguagu

SEQ ID NO: 213661 - RNA, 22 nt, Homo sapiens
cuacuauguagagauauugaau

SEQ ID NO: 213662 - RNA, 22 nt, Homo sapiens
cuagauuguuuccauaaugaca

SEQ ID NO: 213663 - RNA, 22 nt, Homo sapiens
cuagcagacaggcugggagcag

SEQ ID NO: 213664 - RNA, 22 nt, Homo sapiens
cuagcccagugcuccuggauca

SEQ ID NO: 213665 - RNA, 22 nt, Homo sapiens
cuagcccugagauaaaugucau

SEQ ID NO: 213666 - RNA, 22 nt, Homo sapiens
cuagcuccauauaaagcaggau

SEQ ID NO: 213667 - RNA, 22 nt, Homo sapiens
cuaggcacugauaguuguauuu

SEQ ID NO: 213668 - RNA, 22 nt, Homo sapiens
cuaguaaugucugucuuaugga

SEQ ID NO: 213669 - RNA, 22 nt, Homo sapiens
cuagucacaggaguugaaggau

SEQ ID NO: 213670 - RNA, 22 nt, Homo sapiens
cuauaacagugugguuuggaga

SEQ ID NO: 213671 - RNA, 22 nt, Homo sapiens
cuauaguauaguuugaagucag

SEQ ID NO: 213672 - RNA, 22 nt, Homo sapiens
cuaucugcacaggguggaaauu

SEQ ID NO: 213673 - RNA, 22 nt, Homo sapiens
cuaugagucugcagaucuauua

SEQ ID NO: 213674 - RNA, 22 nt, Homo sapiens
cuaugcuucuuaaauuaguuau

SEQ ID NO: 213675 - RNA, 22 nt, Homo sapiens
cuaugcuuucugggcccugggu

SEQ ID NO: 213676 - RNA, 22 nt, Homo sapiens
cuauggcuguagucccugugua

SEQ ID NO: 213677 - RNA, 22 nt, Homo sapiens
cuauggugauagaaaucagaau

SEQ ID NO: 213678 - RNA, 22 nt, Homo sapiens
cuaugguuucucaaacuccuga

SEQ ID NO: 213679 - RNA, 22 nt, Homo sapiens
cucaaagucaagggaaagcagg

SEQ ID NO: 213680 - RNA, 22 nt, Homo sapiens
cucaaaugguccagcuaguggu

SEQ ID NO: 213681 - RNA, 22 nt, Homo sapiens
cucaaguaauccucccgccuug

SEQ ID NO: 213682 - RNA, 18 nt, Homo sapiens
cucacacccuaaucagga

SEQ ID NO: 213683 - RNA, 22 nt, Homo sapiens
cucacagucagaagggacuugc

SEQ ID NO: 213684 - RNA, 22 nt, Homo sapiens
cucacagucucucccuaauuuu

SEQ ID NO: 213685 - RNA, 22 nt, Homo sapiens
cucacugugguguccuuaggua

SEQ ID NO: 213686 - RNA, 22 nt, Homo sapiens
cucagguaguuccuuauagcaa

SEQ ID NO: 213687 - RNA, 22 nt, Homo sapiens
cucagugaagggcaagaggcaa

SEQ ID NO: 213688 - RNA, 20 nt, Homo sapiens
cucagugcacccccauaaaa

SEQ ID NO: 213689 - RNA, 22 nt, Homo sapiens
cucaguguuaaggccaccucug

SEQ ID NO: 213690 - RNA, 22 nt, Homo sapiens
cucauugcaaucuccaccuccc

SEQ ID NO: 213691 - RNA, 22 nt, Homo sapiens
cuccagugcaaagucaugauca

SEQ ID NO: 213692 - RNA, 20 nt, Homo sapiens
cucccugacaaauguggaaa

SEQ ID NO: 213693 - RNA, 22 nt, Homo sapiens
cuuggguaagucauuaaaauua

SEQ ID NO: 213694 - RNA, 22 nt, Homo sapiens
cuugucuugcacacgguugcca

SEQ ID NO: 213695 - RNA, 22 nt, Homo sapiens
cuuguucuccuaagaugaaugc

SEQ ID NO: 213696 - RNA, 21 nt, Homo sapiens
cuuuaugcuguguuagaaaag

SEQ ID NO: 213697 - RNA, 22 nt, Homo sapiens
cuuugcacaucucugcuuuccc

SEQ ID NO: 213698 - RNA, 22 nt, Homo sapiens
cuuuggagaaaaguucuugggc

SEQ ID NO: 213699 - RNA, 22 nt, Homo sapiens
cuuuggcaaugucauuuucaau

SEQ ID NO: 213700 - RNA, 22 nt, Homo sapiens
cuuuggguauucucccuugggg

SEQ ID NO: 213701 - RNA, 22 nt, Homo sapiens
cuuuggucaauugcugcgggga

SEQ ID NO: 213702 - RNA, 22 nt, Homo sapiens
cuuuggucaauugcugugggga

SEQ ID NO: 213703 - RNA, 18 nt, Homo sapiens
cuuugguccccgcacccu

SEQ ID NO: 213704 - RNA, 23 nt, Homo sapiens
cuuuggucucugguugacuucag

SEQ ID NO: 213705 - RNA, 22 nt, Homo sapiens
cuuugguuaauaggauauggca

SEQ ID NO: 213706 - RNA, 22 nt, Homo sapiens
cuuugguucuguuuauaugcug

SEQ ID NO: 213707 - RNA, 23 nt, Homo sapiens
cuuuguacagcuugacuacuggg

SEQ ID NO: 213708 - RNA, 22 nt, Homo sapiens
cuuuguaugucaugacaacugu

SEQ ID NO: 213709 - RNA, 23 nt, Homo sapiens
cuuuguccccacccaaaucucau

SEQ ID NO: 213710 - RNA, 22 nt, Homo sapiens
cuuuguguggacauuucaggca

SEQ ID NO: 213711 - RNA, 22 nt, Homo sapiens
cuuuuacacuguuggugggaau

SEQ ID NO: 213712 - RNA, 22 nt, Homo sapiens
cuuuugcugggucagcgguggu

SEQ ID NO: 213713 - RNA, 22 nt, Homo sapiens
cuuuuggcuuagaauugucuug

SEQ ID NO: 213714 - RNA, 22 nt, Homo sapiens
cuuuuggucuaucagagaagca

SEQ ID NO: 213715 - RNA, 22 nt, Homo sapiens
cuuuuguggaucuucuguugcu

SEQ ID NO: 213716 - RNA, 22 nt, Homo sapiens
cuuuuugcuagagucuaggguc

SEQ ID NO: 213717 - RNA, 22 nt, Homo sapiens
gaaacugcauuucuaacaagcu

SEQ ID NO: 213718 - RNA, 22 nt, Homo sapiens
gaaagacuuucugcuguggaua

SEQ ID NO: 213719 - RNA, 22 nt, Homo sapiens
gaaagauuuuaacugggagacu

SEQ ID NO: 213720 - RNA, 21 nt, Homo sapiens
gaaauacugccuuaggagcug

SEQ ID NO: 213721 - RNA, 22 nt, Homo sapiens
gaaaugcucauuuuggauccuu

SEQ ID NO: 213722 - RNA, 23 nt, Homo sapiens
gaaaugucuuagugaaauugcuu

SEQ ID NO: 213723 - RNA, 22 nt, Homo sapiens
gaacugggguuggguugcgaua

SEQ ID NO: 213724 - RNA, 22 nt, Homo sapiens
gaacuguaaagaaauucuaagg

SEQ ID NO: 213725 - RNA, 22 nt, Homo sapiens
gaacuguuucuggugaaagagu

SEQ ID NO: 213726 - RNA, 22 nt, Homo sapiens
gaagagacagguucccacaaaa

SEQ ID NO: 213727 - RNA, 22 nt, Homo sapiens
gaagcauugauccacaggcgug

SEQ ID NO: 213728 - RNA, 22 nt, Homo sapiens
gaaggcacugugugccacccug

SEQ ID NO: 213729 - RNA, 22 nt, Homo sapiens
gaaggugcuuggugaaugcauu

SEQ ID NO: 213730 - RNA, 22 nt, Homo sapiens
gaaguaauaaauggauucuuaa

SEQ ID NO: 213731 - RNA, 19 nt, Homo sapiens
gaaguguuguccuccagua

SEQ ID NO: 213732 - RNA, 17 nt, Homo sapiens
gaaguguuucagcagcu

SEQ ID NO: 213733 - RNA, 19 nt, Homo sapiens
gaaguguuuguucuccaug

SEQ ID NO: 213734 - RNA, 22 nt, Homo sapiens
gaauagugcugcaauaaacaua

SEQ ID NO: 213735 - RNA, 22 nt, Homo sapiens
gaauagugcugcagcaaacaua

SEQ ID NO: 213736 - RNA, 22 nt, Homo sapiens
gaauagugcugcgauaaacaua

SEQ ID NO: 213737 - RNA, 22 nt, Homo sapiens
gaaucaauugaucuaugugucu

SEQ ID NO: 213738 - RNA, 22 nt, Homo sapiens
gaaugaauguuuauccuuagau

SEQ ID NO: 213739 - RNA, 22 nt, Homo sapiens
gaaugucuuauugcucguugua

SEQ ID NO: 213740 - RNA, 22 nt, Homo sapiens
gaauucugucgcuuacuagaug

SEQ ID NO: 213741 - RNA, 22 nt, Homo sapiens
gaauugcacaaaaacugcuugu

SEQ ID NO: 213742 - RNA, 18 nt, Homo sapiens
gacaguguggcaauuccu

SEQ ID NO: 213743 - RNA, 18 nt, Homo sapiens
gacaguguggcgauuccu

SEQ ID NO: 213744 - RNA, 18 nt, Homo sapiens
gacaguguggugauuccu

SEQ ID NO: 213745 - RNA, 22 nt, Homo sapiens
gacaguuucucaggcuuccuua

SEQ ID NO: 213746 - RNA, 19 nt, Homo sapiens
gacaugagauuuggugggg

SEQ ID NO: 213747 - RNA, 22 nt, Homo sapiens
gacauguaaggcucucucuguu

SEQ ID NO: 213748 - RNA, 22 nt, Homo sapiens
gacauguuuucaagauuuauaa

SEQ ID NO: 213749 - RNA, 22 nt, Homo sapiens
gaccacagacuggaaagagggc

SEQ ID NO: 213750 - RNA, 21 nt, Homo sapiens
gaccacagcagggaaugucag

SEQ ID NO: 213751 - RNA, 22 nt, Homo sapiens
gacccuuagaaugugaucuuau

SEQ ID NO: 213752 - RNA, 22 nt, Homo sapiens
gaccugagagguacauguauuu

SEQ ID NO: 213753 - RNA, 22 nt, Homo sapiens
gaccuuguagaaucucaugauu

SEQ ID NO: 213754 - RNA, 22 nt, Homo sapiens
gacgauaucaaggaaaugaagu

SEQ ID NO: 213755 - RNA, 22 nt, Homo sapiens
gacuagggaccaugagcaaucc

SEQ ID NO: 213756 - RNA, 22 nt, Homo sapiens
gacuaguuaggucucucacaga

SEQ ID NO: 213757 - RNA, 18 nt, Homo sapiens
gacucaguuucuaaggca

SEQ ID NO: 213758 - RNA, 19 nt, Homo sapiens
gacuccagaguugugugcu

SEQ ID NO: 213759 - RNA, 18 nt, Homo sapiens
gacuccauuucagccaga

SEQ ID NO: 213760 - RNA, 22 nt, Homo sapiens
gacugcauuugccccaucgaau

SEQ ID NO: 213761 - RNA, 22 nt, Homo sapiens
gacuggccauugauacagaggu

SEQ ID NO: 213762 - RNA, 22 nt, Homo sapiens
gacuggccuauaauggcgaauu

SEQ ID NO: 213763 - RNA, 22 nt, Homo sapiens
gacuggcuguuuucuuuauuau

SEQ ID NO: 213764 - RNA, 22 nt, Homo sapiens
gacuggguuaguuugaaagacu

SEQ ID NO: 213765 - RNA, 20 nt, Homo sapiens
gacuucagaagcuucagagu

SEQ ID NO: 213766 - RNA, 22 nt, Homo sapiens
gagaacaguguuguauuuuuuc

SEQ ID NO: 213767 - RNA, 22 nt, Homo sapiens
gagaacugagugugcuggcgga

SEQ ID NO: 213768 - RNA, 22 nt, Homo sapiens
gagaaguaaauuuauuugcaaa

SEQ ID NO: 213769 - RNA, 22 nt, Homo sapiens
gagaagugcgucguuugaugau

SEQ ID NO: 213770 - RNA, 22 nt, Homo sapiens
gagaaugaacagacugccucuu

SEQ ID NO: 213771 - RNA, 22 nt, Homo sapiens
gagaaugagaggggaaggccac

SEQ ID NO: 213772 - RNA, 22 nt, Homo sapiens
gagaaugagauuaugguuacau

SEQ ID NO: 213773 - RNA, 22 nt, Homo sapiens
gagacggagucacgcccuguca

SEQ ID NO: 213774 - RNA, 22 nt, Homo sapiens
gagacggagucucgcucugucg

SEQ ID NO: 213775 - RNA, 22 nt, Homo sapiens
gagacggagucuugcucuguug

SEQ ID NO: 213776 - RNA, 22 nt, Homo sapiens
gagacugagucuugcucuguca

SEQ ID NO: 213777 - RNA, 21 nt, Homo sapiens
gagaggauucgccagccucuu

SEQ ID NO: 213778 - RNA, 22 nt, Homo sapiens
gagagugaaguuugcuaccugu

SEQ ID NO: 213779 - RNA, 22 nt, Homo sapiens
gagauauuauuucccuuucaca

SEQ ID NO: 213780 - RNA, 22 nt, Homo sapiens
gagaucaugcugguucucucau

SEQ ID NO: 213781 - RNA, 22 nt, Homo sapiens
gagauggagacuuggccuuaaa

SEQ ID NO: 213782 - RNA, 22 nt, Homo sapiens
gagauggugugcuguuggaagu

SEQ ID NO: 213783 - RNA, 22 nt, Homo sapiens
gagaugucuauuucagagaugu

SEQ ID NO: 213784 - RNA, 22 nt, Homo sapiens
gagaugugugugauuauauaau

SEQ ID NO: 213785 - RNA, 22 nt, Homo sapiens
gagauguuuguuucacugucac

SEQ ID NO: 213786 - RNA, 22 nt, Homo sapiens
gagauguuuuguuaucaaagga

SEQ ID NO: 213787 - RNA, 22 nt, Homo sapiens
gagauuaacauuugaggagcug

SEQ ID NO: 213788 - RNA, 22 nt, Homo sapiens
gagauucuucaauauuuauucu

SEQ ID NO: 213789 - RNA, 22 nt, Homo sapiens
gagauugucaugauuacauugu

SEQ ID NO: 213790 - RNA, 22 nt, Homo sapiens
gagcaaaaguauguauugguua

SEQ ID NO: 213791 - RNA, 22 nt, Homo sapiens
gagcaaugauugagccacugua

SEQ ID NO: 213792 - RNA, 21 nt, Homo sapiens
gagcacauuguccucuaacgc

SEQ ID NO: 213793 - RNA, 22 nt, Homo sapiens
gagcaccagucccugucagugc

SEQ ID NO: 213794 - RNA, 22 nt, Homo sapiens
gagcaguugagagugcuggcca

SEQ ID NO: 213795 - RNA, 21 nt, Homo sapiens
gggcaaaucuuuauccuaagc

SEQ ID NO: 213796 - RNA, 22 nt, Homo sapiens
gggcaacauugaguacccugaa

SEQ ID NO: 213797 - RNA, 22 nt, Homo sapiens
gggcaagaagucuuguaguuuu

SEQ ID NO: 213798 - RNA, 18 nt, Homo sapiens
gggcaaguugccuggcuu

SEQ ID NO: 213799 - RNA, 22 nt, Homo sapiens
gggcaugaugucuuaugccuau

SEQ ID NO: 213800 - RNA, 22 nt, Homo sapiens
gggggagugugguacccagcau

SEQ ID NO: 213801 - RNA, 22 nt, Homo sapiens
ggggucauuaaauuccgcuggu

SEQ ID NO: 213802 - RNA, 19 nt, Homo sapiens
gggucaguuugaaugauua

SEQ ID NO: 213803 - RNA, 22 nt, Homo sapiens
gggucaguuuugagaaagcgug

SEQ ID NO: 213804 - RNA, 22 nt, Homo sapiens
gggucauggaugugaagcuaga

SEQ ID NO: 213805 - RNA, 22 nt, Homo sapiens
gguaaacauaagagagcugacu

SEQ ID NO: 213806 - RNA, 22 nt, Homo sapiens
gguacagcuaguuaaacauuug

SEQ ID NO: 213807 - RNA, 22 nt, Homo sapiens
gguaggcacuggugggaagaga

SEQ ID NO: 213808 - RNA, 22 nt, Homo sapiens
gguauguagugugaaguaggga

SEQ ID NO: 213809 - RNA, 22 nt, Homo sapiens
ggucacccugaugcuggugguc

SEQ ID NO: 213810 - RNA, 19 nt, Homo sapiens
ggucagcaaagucuagcug

SEQ ID NO: 213811 - RNA, 22 nt, Homo sapiens
ggucaguguuaucaccgaagga

SEQ ID NO: 213812 - RNA, 19 nt, Homo sapiens
ggucauggagguuguguga

SEQ ID NO: 213813 - RNA, 22 nt, Homo sapiens
ggucauguguccaggagguagc

SEQ ID NO: 213814 - RNA, 19 nt, Homo sapiens
ggucccucucaagucauuc

SEQ ID NO: 213815 - RNA, 22 nt, Homo sapiens
ggugaauuguaccccauaggau

SEQ ID NO: 213816 - RNA, 22 nt, Homo sapiens
ggugacagugguuaaaauuugu

SEQ ID NO: 213817 - RNA, 22 nt, Homo sapiens
ggugagaaaaacauagucucag

SEQ ID NO: 213818 - RNA, 23 nt, Homo sapiens
ggugaggaguacagagucuucau

SEQ ID NO: 213819 - RNA, 22 nt, Homo sapiens
ggugagguaggaaaaguuagga

SEQ ID NO: 213820 - RNA, 22 nt, Homo sapiens
ggugagguaguaagguacaaua

SEQ ID NO: 213821 - RNA, 22 nt, Homo sapiens
ggugaguggugcuuaaguucag

SEQ ID NO: 213822 - RNA, 22 nt, Homo sapiens
ggugaucauugucucuaguaug

SEQ ID NO: 213823 - RNA, 22 nt, Homo sapiens
gguggcuuuuugugauggcuga

SEQ ID NO: 213824 - RNA, 22 nt, Homo sapiens
guaaaugcagaugcaugaccuu

SEQ ID NO: 213825 - RNA, 22 nt, Homo sapiens
guaacacaugcugcucucuggu

SEQ ID NO: 213826 - RNA, 22 nt, Homo sapiens
guaacaccaguuauaucaguuc

SEQ ID NO: 213827 - RNA, 20 nt, Homo sapiens
guaacagcacuuucccaaag

SEQ ID NO: 213828 - RNA, 22 nt, Homo sapiens
guaauacuuuugggauauuaga

SEQ ID NO: 213829 - RNA, 22 nt, Homo sapiens
guaauagucucaaacuccugga

SEQ ID NO: 213830 - RNA, 22 nt, Homo sapiens
guaaucucagcuacucgggaga

SEQ ID NO: 213831 - RNA, 19 nt, Homo sapiens
guaaucucaguacuuuggu

SEQ ID NO: 213832 - RNA, 22 nt, Homo sapiens
guacaggugcaggaugggcagg

SEQ ID NO: 213833 - RNA, 22 nt, Homo sapiens
guacaguacugaaugaauguau

SEQ ID NO: 213834 - RNA, 22 nt, Homo sapiens
guacaguuuucaguguucacug

SEQ ID NO: 213835 - RNA, 22 nt, Homo sapiens
guacaugcauacaugcacaucu

SEQ ID NO: 213836 - RNA, 22 nt, Homo sapiens
guacauguaugcaugcaugcau

SEQ ID NO: 213837 - RNA, 22 nt, Homo sapiens
guagaagcacaggugaguuggu

SEQ ID NO: 213838 - RNA, 22 nt, Homo sapiens
guagagagaaauacaaagcugu

SEQ ID NO: 213839 - RNA, 22 nt, Homo sapiens
guagcaccagugcucuucucaa

SEQ ID NO: 213840 - RNA, 22 nt, Homo sapiens
guagcagcaauuuacuccauac

SEQ ID NO: 213841 - RNA, 22 nt, Homo sapiens
guagcagccacacuugauaacu

SEQ ID NO: 213842 - RNA, 22 nt, Homo sapiens
guaggcacuggcucagcuuauc

SEQ ID NO: 213843 - RNA, 22 nt, Homo sapiens
guaguggcaugaucuuggcuca

SEQ ID NO: 213844 - RNA, 22 nt, Homo sapiens
guauacaguugacccuugaacc

SEQ ID NO: 213845 - RNA, 22 nt, Homo sapiens
guauacuucugaaaauagcuau

SEQ ID NO: 213846 - RNA, 22 nt, Homo sapiens
guauagaucguagaccaauaaa

SEQ ID NO: 213847 - RNA, 22 nt, Homo sapiens
guaucauugccuaaugcucuca

SEQ ID NO: 213848 - RNA, 22 nt, Homo sapiens
guaugaaaaucggagauugggu

SEQ ID NO: 213849 - RNA, 22 nt, Homo sapiens
guaugaguuuucugaugugugg

SEQ ID NO: 213850 - RNA, 22 nt, Homo sapiens
guauggaauuugugaccuuaua

SEQ ID NO: 213851 - RNA, 22 nt, Homo sapiens
guaugguuguaugaggacccau

SEQ ID NO: 213852 - RNA, 22 nt, Homo sapiens
guaugugacuggaacaguagga

SEQ ID NO: 213853 - RNA, 22 nt, Homo sapiens
guauuagaugguauuugaagau

SEQ ID NO: 213854 - RNA, 22 nt, Homo sapiens
guauuagguuggggcaaaagua

SEQ ID NO: 213855 - RNA, 19 nt, Homo sapiens
guauuugacuuucuuguuu

SEQ ID NO: 213856 - RNA, 22 nt, Homo sapiens
guauuuggugaugccuccaaac

SEQ ID NO: 213857 - RNA, 22 nt, Homo sapiens
guauuuguugcagcagcacuau

SEQ ID NO: 213858 - RNA, 22 nt, Homo sapiens
gucaaagugauuguaauuaggu

SEQ ID NO: 213859 - RNA, 22 nt, Homo sapiens
gucaaaugcacagaaccauuaa

SEQ ID NO: 213860 - RNA, 22 nt, Homo sapiens
gucaagagaacuuucuaucacu

SEQ ID NO: 213861 - RNA, 22 nt, Homo sapiens
gucaaggaauuuauccauuucu

SEQ ID NO: 213862 - RNA, 22 nt, Homo sapiens
gucacagaggcuaagaccccac

SEQ ID NO: 213863 - RNA, 22 nt, Homo sapiens
gucacaguggccagugauguuc

SEQ ID NO: 213864 - RNA, 22 nt, Homo sapiens
gucacaguguuuguucauccca

SEQ ID NO: 213865 - RNA, 22 nt, Homo sapiens
gucacugagcaauagaaaguuu

SEQ ID NO: 213866 - RNA, 22 nt, Homo sapiens
gucacugccugaggcugaugca

SEQ ID NO: 213867 - RNA, 21 nt, Homo sapiens
gucacuggggcuggauaauuc

SEQ ID NO: 213868 - RNA, 22 nt, Homo sapiens
gucacuguuuccuauuauauuu

SEQ ID NO: 213869 - RNA, 22 nt, Homo sapiens
gucagagcacugaguugugggc

SEQ ID NO: 213870 - RNA, 22 nt, Homo sapiens
gucagcaaagaggaauaguuug

SEQ ID NO: 213871 - RNA, 22 nt, Homo sapiens
gucaggaccucgguggcauucu

SEQ ID NO: 213872 - RNA, 22 nt, Homo sapiens
gucaggaugauuuggggaggug

SEQ ID NO: 213873 - RNA, 22 nt, Homo sapiens
gucagggagggauagaugauua

SEQ ID NO: 213874 - RNA, 22 nt, Homo sapiens
gucagguauguuccaaaggcgg

SEQ ID NO: 213875 - RNA, 22 nt, Homo sapiens
gucagugauugauuuaaagacg

SEQ ID NO: 213876 - RNA, 22 nt, Homo sapiens
gucagugucuuaacagagauua

SEQ ID NO: 213877 - RNA, 22 nt, Homo sapiens
gucaguuucacucagcuggaac

SEQ ID NO: 213878 - RNA, 22 nt, Homo sapiens
gucauggugcuagcgggaaugu

SEQ ID NO: 213879 - RNA, 22 nt, Homo sapiens
gucauucauucagcaagcacug

SEQ ID NO: 213880 - RNA, 22 nt, Homo sapiens
gucauugagucagggaguaucu

SEQ ID NO: 213881 - RNA, 22 nt, Homo sapiens
gucauugcacuccagccuggac

SEQ ID NO: 213882 - RNA, 21 nt, Homo sapiens
guccaaaacaguguccaaugc

SEQ ID NO: 213883 - RNA, 22 nt, Homo sapiens
guccaaauccaugggauguaca

SEQ ID NO: 213884 - RNA, 20 nt, Homo sapiens
guccauuugcugccauugcu

SEQ ID NO: 213885 - RNA, 18 nt, Homo sapiens
guccauuuguugguacac

SEQ ID NO: 213886 - RNA, 22 nt, Homo sapiens
gucccugcgauugugggauccu

SEQ ID NO: 213887 - RNA, 22 nt, Homo sapiens
gucguggagcucacagugugcc

SEQ ID NO: 213888 - RNA, 22 nt, Homo sapiens
gucucacaggcaugaugccagc

SEQ ID NO: 213889 - RNA, 18 nt, Homo sapiens
gucucacaugguggaagc

SEQ ID NO: 213890 - RNA, 22 nt, Homo sapiens
gucucccagccuacauauuucu

SEQ ID NO: 213891 - RNA, 22 nt, Homo sapiens
gucucugguugcuuuuguacca

SEQ ID NO: 213892 - RNA, 22 nt, Homo sapiens
gucuggagacuugggucaucaa

SEQ ID NO: 213893 - RNA, 22 nt, Homo sapiens
gucuggcacagggaaaguacaa

SEQ ID NO: 213894 - RNA, 22 nt, Homo sapiens
gucuggcuccugucuaaucacu

SEQ ID NO: 213895 - RNA, 22 nt, Homo sapiens
gucuuagguuuaaucacuucua

SEQ ID NO: 213896 - RNA, 22 nt, Homo sapiens
gucuuccagccuccaucuuucu

SEQ ID NO: 213897 - RNA, 22 nt, Homo sapiens
gucuuuggaaagacaaaguuca

SEQ ID NO: 213898 - RNA, 17 nt, Homo sapiens
gucuuugguugaguuua

SEQ ID NO: 213899 - RNA, 22 nt, Homo sapiens
gugaaaagaugagcaccauaca

SEQ ID NO: 213900 - RNA, 22 nt, Homo sapiens
gugaaagacagcauuaauggcu

SEQ ID NO: 213901 - RNA, 22 nt, Homo sapiens
gugaaagacauauaugguuuga

SEQ ID NO: 213902 - RNA, 22 nt, Homo sapiens
gugaaauacauaaucccaagug

SEQ ID NO: 213903 - RNA, 22 nt, Homo sapiens
gugaaauauuuaacguccaggu

SEQ ID NO: 213904 - RNA, 22 nt, Homo sapiens
gugaaaugaaucuggaaauauu

SEQ ID NO: 213905 - RNA, 22 nt, Homo sapiens
gugaacagaaccugggaucgaa

SEQ ID NO: 213906 - RNA, 22 nt, Homo sapiens
gugaagugugaccucagcaucu

SEQ ID NO: 213907 - RNA, 22 nt, Homo sapiens
gugaaugaaugggugaauacau

SEQ ID NO: 213908 - RNA, 22 nt, Homo sapiens
gugaauguuuucuuacauggua

SEQ ID NO: 213909 - RNA, 22 nt, Homo sapiens
gugacacuggagcuggcacaau

SEQ ID NO: 213910 - RNA, 22 nt, Homo sapiens
gugacaucagcuccagguauaa

SEQ ID NO: 213911 - RNA, 22 nt, Homo sapiens
gugaccucuguugcugucacua

SEQ ID NO: 213912 - RNA, 22 nt, Homo sapiens
gugagacugaguuucgcucuug

SEQ ID NO: 213913 - RNA, 22 nt, Homo sapiens
gugagauaaugucucauugugg

SEQ ID NO: 213914 - RNA, 22 nt, Homo sapiens
gugagaugaggucucacucugu

SEQ ID NO: 213915 - RNA, 22 nt, Homo sapiens
gugagaugugacuucugccucu

SEQ ID NO: 213916 - RNA, 22 nt, Homo sapiens
gugagcauaggaggcuucuguu

SEQ ID NO: 213917 - RNA, 22 nt, Homo sapiens
gugagguacgugucaagaacca

SEQ ID NO: 213918 - RNA, 22 nt, Homo sapiens
gugaggugguacaauauuaacu

SEQ ID NO: 213919 - RNA, 22 nt, Homo sapiens
gugagucaugucccaucugauu

SEQ ID NO: 213920 - RNA, 20 nt, Homo sapiens
gugagucauuaguaaccaaa

SEQ ID NO: 213921 - RNA, 22 nt, Homo sapiens
gugauagaucugggauucagaa

SEQ ID NO: 213922 - RNA, 22 nt, Homo sapiens
gugauaguucuuacuccaaagu

SEQ ID NO: 213923 - RNA, 22 nt, Homo sapiens
gugaugacauucagagaugaag

SEQ ID NO: 213924 - RNA, 22 nt, Homo sapiens
gugaugguccagggaaucucuu

SEQ ID NO: 213925 - RNA, 22 nt, Homo sapiens
gugauuauccacgucuuuguga

SEQ ID NO: 213926 - RNA, 22 nt, Homo sapiens
gugcaaacuccaggucucuuca

SEQ ID NO: 213927 - RNA, 22 nt, Homo sapiens
gugcaaauuccagcucaacucc

SEQ ID NO: 213928 - RNA, 22 nt, Homo sapiens
gugcaagagugauugcaguuuu

SEQ ID NO: 213929 - RNA, 22 nt, Homo sapiens
gugcaaugagaaggggcucugg

SEQ ID NO: 213930 - RNA, 22 nt, Homo sapiens
gugcaauucacuguuaugucug

SEQ ID NO: 213931 - RNA, 22 nt, Homo sapiens
gugcacauauggugcauaagug

SEQ ID NO: 213932 - RNA, 22 nt, Homo sapiens
gugcacaucgugcagguuuguu

SEQ ID NO: 213933 - RNA, 21 nt, Homo sapiens
gugcagaugccacagucacuc

SEQ ID NO: 213934 - RNA, 22 nt, Homo sapiens
gugcagaugucuuuauaguagc

SEQ ID NO: 213935 - RNA, 22 nt, Homo sapiens
gugcauaugcaugugcaugcac

SEQ ID NO: 213936 - RNA, 22 nt, Homo sapiens
gugccacugcaccuggccuaag

SEQ ID NO: 213937 - RNA, 22 nt, Homo sapiens
gugcccacugucuguccuguag

SEQ ID NO: 213938 - RNA, 22 nt, Homo sapiens
gugcgggaggcgcgccuaggug

SEQ ID NO: 213939 - RNA, 22 nt, Homo sapiens
gugcucauuuagagagaagcac

SEQ ID NO: 213940 - RNA, 22 nt, Homo sapiens
guggaaaaguaguugcgguuuu

SEQ ID NO: 213941 - RNA, 22 nt, Homo sapiens
guggaaagaacacaaaauuagg

SEQ ID NO: 213942 - RNA, 22 nt, Homo sapiens
guggaaaucucugugugacuua

SEQ ID NO: 213943 - RNA, 22 nt, Homo sapiens
guggaagaccagacuuuccaac

SEQ ID NO: 213944 - RNA, 20 nt, Homo sapiens
guggaagauaaguagccuga

SEQ ID NO: 213945 - RNA, 22 nt, Homo sapiens
guggaauuauagagacaucuug

SEQ ID NO: 213946 - RNA, 22 nt, Homo sapiens
guggaggacuggauaaagaaaa

SEQ ID NO: 213947 - RNA, 22 nt, Homo sapiens
guggaggagaaagaagcauuuc

SEQ ID NO: 213948 - RNA, 22 nt, Homo sapiens
guggagucaucacucagagugg

SEQ ID NO: 213949 - RNA, 22 nt, Homo sapiens
guggcaaacucagcaugcccca

SEQ ID NO: 213950 - RNA, 22 nt, Homo sapiens
guggcaaggaaaugcugcucac

SEQ ID NO: 213951 - RNA, 22 nt, Homo sapiens
guggcacgaugaucugggcuca

SEQ ID NO: 213952 - RNA, 22 nt, Homo sapiens
guggcaugaaagcaucugugau

SEQ ID NO: 213953 - RNA, 22 nt, Homo sapiens
gugggaagcuggaacucccucc

SEQ ID NO: 213954 - RNA, 22 nt, Homo sapiens
gugggauggaaaugggcuucag

SEQ ID NO: 213955 - RNA, 22 nt, Homo sapiens
gugggauggagagaagguauga

SEQ ID NO: 213956 - RNA, 22 nt, Homo sapiens
gugggguagcaggcuccuaucu

SEQ ID NO: 213957 - RNA, 22 nt, Homo sapiens
gugguaaaauggcauagagcua

SEQ ID NO: 213958 - RNA, 22 nt, Homo sapiens
gugguguccugcaccuauaguc

SEQ ID NO: 213959 - RNA, 22 nt, Homo sapiens
gugguguuugagcugccaggga

SEQ ID NO: 213960 - RNA, 21 nt, Homo sapiens
gugguucuagagaaacagaau

SEQ ID NO: 213961 - RNA, 22 nt, Homo sapiens
gugguuuuaauauucagucuag

SEQ ID NO: 213962 - RNA, 22 nt, Homo sapiens
gugguuuuaucccagaaauuaa

SEQ ID NO: 213963 - RNA, 22 nt, Homo sapiens
gugguuuuuagauuucuacagu

SEQ ID NO: 213964 - RNA, 22 nt, Homo sapiens
guguaaaacaauuagaggauuu

SEQ ID NO: 213965 - RNA, 22 nt, Homo sapiens
guguauacauagaauuguguau

SEQ ID NO: 213966 - RNA, 21 nt, Homo sapiens
gugucacagacaugacagaug

SEQ ID NO: 213967 - RNA, 22 nt, Homo sapiens
gugucaugagggggacaggaag

SEQ ID NO: 213968 - RNA, 21 nt, Homo sapiens
gugucaugguugacuuuggca

SEQ ID NO: 213969 - RNA, 22 nt, Homo sapiens
gugucuccuguggagcuaugua

SEQ ID NO: 213970 - RNA, 22 nt, Homo sapiens
gugugauggcgcacacagggug

SEQ ID NO: 213971 - RNA, 22 nt, Homo sapiens
gugugcaaauguguaccuacau

SEQ ID NO: 213972 - RNA, 21 nt, Homo sapiens
gugugcuugaauucagcuguc

SEQ ID NO: 213973 - RNA, 23 nt, Homo sapiens
gugugguaggcuauaccaucuag

SEQ ID NO: 213974 - RNA, 22 nt, Homo sapiens
guguucauggaauuugcaauug

SEQ ID NO: 213975 - RNA, 22 nt, Homo sapiens
guguuugauugcaaauaaucua

SEQ ID NO: 213976 - RNA, 22 nt, Homo sapiens
guuaugcagcuuagaaaaugaa

SEQ ID NO: 213977 - RNA, 22 nt, Homo sapiens
guucaagcaauucugcugccuc

SEQ ID NO: 213978 - RNA, 20 nt, Homo sapiens
guucacagagguuaugauua

SEQ ID NO: 213979 - RNA, 22 nt, Homo sapiens
guucagguauucuggaacagag

SEQ ID NO: 213980 - RNA, 22 nt, Homo sapiens
guucaucaggaauauuggccua

SEQ ID NO: 213981 - RNA, 20 nt, Homo sapiens
guucauguaauuaguucagg

SEQ ID NO: 213982 - RNA, 22 nt, Homo sapiens
guucccaguugaaaugauuagu

SEQ ID NO: 213983 - RNA, 22 nt, Homo sapiens
guugaaaucaucacuuggcaug

SEQ ID NO: 213984 - RNA, 22 nt, Homo sapiens
guugaaauccuaacccccuagu

SEQ ID NO: 213985 - RNA, 22 nt, Homo sapiens
guugagcaagcuuuggagccua

SEQ ID NO: 213986 - RNA, 22 nt, Homo sapiens
guugaggcaggagaauuacuug

SEQ ID NO: 213987 - RNA, 22 nt, Homo sapiens
guugcaugucugggaggccagc

SEQ ID NO: 213988 - RNA, 22 nt, Homo sapiens
guugccuaggcuggagugcagu

SEQ ID NO: 213989 - RNA, 22 nt, Homo sapiens
guuggaguuaagcaguaaugaa

SEQ ID NO: 213990 - RNA, 22 nt, Homo sapiens
guuggcaaguggcugagcuggg

SEQ ID NO: 213991 - RNA, 22 nt, Homo sapiens
guuuaacugguacuucaagucu

SEQ ID NO: 213992 - RNA, 22 nt, Homo sapiens
guuugcacuccuaugagaaucu

SEQ ID NO: 213993 - RNA, 22 nt, Homo sapiens
guuuggauauuaggcaagagua

SEQ ID NO: 213994 - RNA, 22 nt, Homo sapiens
guuuggcuuucucucuauccug

SEQ ID NO: 213995 - RNA, 22 nt, Homo sapiens
guuuguaacucuagugacuaga

SEQ ID NO: 213996 - RNA, 22 nt, Homo sapiens
guuugugcuccuaugagaaucu

SEQ ID NO: 213997 - RNA, 22 nt, Homo sapiens
guuuugguuauauggaucaguu

SEQ ID NO: 213998 - RNA, 22 nt, Homo sapiens
uaaaccacguuuacauuugaga

SEQ ID NO: 213999 - RNA, 22 nt, Homo sapiens
uucagcaguggccaguggaaau

SEQ ID NO: 214000 - RNA, 22 nt, Homo sapiens
uucagcuacuugggaggcugaa

SEQ ID NO: 214001 - RNA, 22 nt, Homo sapiens
uucaggcuccgugccagcuccg

SEQ ID NO: 214002 - RNA, 22 nt, Homo sapiens
uucaggcuccugugagaaucua

SEQ ID NO: 214003 - RNA, 22 nt, Homo sapiens
uucaggcuuuuauuuacugaua

SEQ ID NO: 214004 - RNA, 22 nt, Homo sapiens
uucagggcauuggaguuucuga

SEQ ID NO: 214005 - RNA, 22 nt, Homo sapiens
uucagguaauuaugguuugucu

SEQ ID NO: 214006 - RNA, 22 nt, Homo sapiens
uucagguacuauaggcuguugg

SEQ ID NO: 214007 - RNA, 22 nt, Homo sapiens
uucaguagucaaaagauaaggg

SEQ ID NO: 214008 - RNA, 22 nt, Homo sapiens
uucaguauugcaccuggagucc

SEQ ID NO: 214009 - RNA, 22 nt, Homo sapiens
uucaguccauuuccuuggucac

SEQ ID NO: 214010 - RNA, 18 nt, Homo sapiens
uucagugaauucuuuuga

SEQ ID NO: 214011 - RNA, 22 nt, Homo sapiens
uucaguggacuuaguagugcuu

SEQ ID NO: 214012 - RNA, 22 nt, Homo sapiens
uucaguggguggaugaauauga

SEQ ID NO: 214013 - RNA, 21 nt, Homo sapiens
uucauaaggcuucucuccugu

SEQ ID NO: 214014 - RNA, 18 nt, Homo sapiens
uucauaguagcaugauuu

SEQ ID NO: 214015 - RNA, 22 nt, Homo sapiens
uucauagucuaauuuuuuccac

SEQ ID NO: 214016 - RNA, 22 nt, Homo sapiens
uucauaguguuuccuuccagug

SEQ ID NO: 214017 - RNA, 22 nt, Homo sapiens
uucaucagcuguagaugucaug

SEQ ID NO: 214018 - RNA, 20 nt, Homo sapiens
uucaucaggauauuggucua

SEQ ID NO: 214019 - RNA, 22 nt, Homo sapiens
uucaucaguuauauuggccuga

SEQ ID NO: 214020 - RNA, 22 nt, Homo sapiens
uucaucaguugagcugguugcu

SEQ ID NO: 214021 - RNA, 22 nt, Homo sapiens
uucauggaugcauuugaggggu

SEQ ID NO: 214022 - RNA, 22 nt, Homo sapiens
uucauguaauauuucacagcuu

SEQ ID NO: 214023 - RNA, 22 nt, Homo sapiens
uucauugaaugauuuuuagaag

SEQ ID NO: 214024 - RNA, 22 nt, Homo sapiens
uucauuggacuuguguucuuga

SEQ ID NO: 214025 - RNA, 22 nt, Homo sapiens
uucauuggauguuacacugugu

SEQ ID NO: 214026 - RNA, 22 nt, Homo sapiens
uuccaagugggaaacaaaaaug

SEQ ID NO: 214027 - RNA, 22 nt, Homo sapiens
uuccacaauggcugaacuaguu

SEQ ID NO: 214028 - RNA, 22 nt, Homo sapiens
uuccacaaugguugaacuaguu

SEQ ID NO: 214029 - RNA, 23 nt, Homo sapiens
uuccaccauugacuaguuacaua

SEQ ID NO: 214030 - RNA, 22 nt, Homo sapiens
uuccacgugaaguauucuaaag

SEQ ID NO: 214031 - RNA, 22 nt, Homo sapiens
uuccagcugggggcaacucugc

SEQ ID NO: 214032 - RNA, 21 nt, Homo sapiens
uuccagugagccuagaugccu

SEQ ID NO: 214033 - RNA, 22 nt, Homo sapiens
uuccaugagaugcaucaaagcu

SEQ ID NO: 214034 - RNA, 22 nt, Homo sapiens
uuccauguugauacgugaaguu

SEQ ID NO: 214035 - RNA, 22 nt, Homo sapiens
uucccagagagggacuucuaau

SEQ ID NO: 214036 - RNA, 22 nt, Homo sapiens
uucccagucaaacgaaggacuu

SEQ ID NO: 214037 - RNA, 22 nt, Homo sapiens
uucccagugccaggcacuggga

SEQ ID NO: 214038 - RNA, 22 nt, Homo sapiens
uucccgggguggaaugcaguga

SEQ ID NO: 214039 - RNA, 22 nt, Homo sapiens
uucccuagaacacauggaggga

SEQ ID NO: 214040 - RNA, 22 nt, Homo sapiens
uucccucagaaacacacagccc

SEQ ID NO: 214041 - RNA, 22 nt, Homo sapiens
uucccugaaguguuacucuaga

SEQ ID NO: 214042 - RNA, 22 nt, Homo sapiens
uucccuuuuuucuaguagguag

SEQ ID NO: 214043 - RNA, 22 nt, Homo sapiens
uuccguguaguugagcaguuuu

SEQ ID NO: 214044 - RNA, 22 nt, Homo sapiens
uuccuggaggggaaguguccaa

SEQ ID NO: 214045 - RNA, 22 nt, Homo sapiens
uuccugugacccccaagcccac

SEQ ID NO: 214046 - RNA, 22 nt, Homo sapiens
uuccuugagaaaggcacaaguu

SEQ ID NO: 214047 - RNA, 22 nt, Homo sapiens
uuccuugugacuaguagugacc

SEQ ID NO: 214048 - RNA, 22 nt, Homo sapiens
uuccuuguuuauuuacaggagg

SEQ ID NO: 214049 - RNA, 22 nt, Homo sapiens
uucgcagcucaguucaacuagg

SEQ ID NO: 214050 - RNA, 22 nt, Homo sapiens
uucgucaugagacagaugcuga

SEQ ID NO: 214051 - RNA, 21 nt, Homo sapiens
uucuaaguaaauguuggacau

SEQ ID NO: 214052 - RNA, 20 nt, Homo sapiens
uucuacagucacaggaagau

SEQ ID NO: 214053 - RNA, 22 nt, Homo sapiens
uucuagagagaagacuuaagcu

SEQ ID NO: 214054 - RNA, 20 nt, Homo sapiens
uucuauggugaugaguccug

SEQ ID NO: 214055 - RNA, 21 nt, Homo sapiens
uucucagaggcaggggauaaa

SEQ ID NO: 214056 - RNA, 22 nt, Homo sapiens
uucucagugcuaucuuuuaugc

SEQ ID NO: 214057 - RNA, 22 nt, Homo sapiens
uucucaguucgguggcagugcu

SEQ ID NO: 214058 - RNA, 22 nt, Homo sapiens
uucucuaguuacuuuaauggag

SEQ ID NO: 214059 - RNA, 22 nt, Homo sapiens
uucucuguggauugggugagag

SEQ ID NO: 214060 - RNA, 23 nt, Homo sapiens
uucugccacugaaaaugccucag

SEQ ID NO: 214061 - RNA, 22 nt, Homo sapiens
uucugcuagucugucagaucuu

SEQ ID NO: 214062 - RNA, 22 nt, Homo sapiens
uucuggcuuauaaacgugacuu

SEQ ID NO: 214063 - RNA, 22 nt, Homo sapiens
uucuggcuuuuaaagaaauguu

SEQ ID NO: 214064 - RNA, 22 nt, Homo sapiens
uucuucugguuaugaaauuuga

SEQ ID NO: 214065 - RNA, 22 nt, Homo sapiens
uucuugcugaauugugcccuuc

SEQ ID NO: 214066 - RNA, 22 nt, Homo sapiens
uucuuugcaugaucucaaaguc

SEQ ID NO: 214067 - RNA, 22 nt, Homo sapiens
uugaaagcuaucucaaaucgcu

SEQ ID NO: 214068 - RNA, 22 nt, Homo sapiens
uugaaagucauuucuucuaagu

SEQ ID NO: 214069 - RNA, 22 nt, Homo sapiens
uugaaauguguaagcuccgaaa

SEQ ID NO: 214070 - RNA, 22 nt, Homo sapiens
uugaacugguaguuggaaaucu

SEQ ID NO: 214071 - RNA, 22 nt, Homo sapiens
uugaagagaaccgcggcuuauu

SEQ ID NO: 214072 - RNA, 22 nt, Homo sapiens
uugaaggaacgcuguucccuug

SEQ ID NO: 214073 - RNA, 22 nt, Homo sapiens
uugaaguagaaagacgaaauuu

SEQ ID NO: 214074 - RNA, 22 nt, Homo sapiens
uugaaguagcauuucaugucua

SEQ ID NO: 214075 - RNA, 22 nt, Homo sapiens
uugaaguauagaguuuaagaac

SEQ ID NO: 214076 - RNA, 22 nt, Homo sapiens
uugaauagugacuuugauucug

SEQ ID NO: 214077 - RNA, 22 nt, Homo sapiens
uugaauguacuuguucucacua

SEQ ID NO: 214078 - RNA, 22 nt, Homo sapiens
uugaauguguugggaagcccuu

SEQ ID NO: 214079 - RNA, 22 nt, Homo sapiens
uugacagaccuuggucauaucc

SEQ ID NO: 214080 - RNA, 22 nt, Homo sapiens
uugagacgaagucucacucuug

SEQ ID NO: 214081 - RNA, 22 nt, Homo sapiens
uugagacggagucucacucugu

SEQ ID NO: 214082 - RNA, 22 nt, Homo sapiens
uugagacggagucuugcucuuu

SEQ ID NO: 214083 - RNA, 22 nt, Homo sapiens
uugagauaggagcuguuguucu

SEQ ID NO: 214084 - RNA, 22 nt, Homo sapiens
uugagauccuuuugcucaucag

SEQ ID NO: 214085 - RNA, 22 nt, Homo sapiens
uugagaugauggauaugcuaau

SEQ ID NO: 214086 - RNA, 22 nt, Homo sapiens
uugagauggagcuucacucuug

SEQ ID NO: 214087 - RNA, 22 nt, Homo sapiens
uugagauggagucucacucuuu

SEQ ID NO: 214088 - RNA, 22 nt, Homo sapiens
uugagauggagucucgcucuuu

SEQ ID NO: 214089 - RNA, 22 nt, Homo sapiens
uugagauggaguucauuuuugu

SEQ ID NO: 214090 - RNA, 22 nt, Homo sapiens
uugagauggaguuucgcucuuu

SEQ ID NO: 214091 - RNA, 22 nt, Homo sapiens
uugagauguaagauguuaauau

SEQ ID NO: 214092 - RNA, 19 nt, Homo sapiens
uugagaugugaacucacac

SEQ ID NO: 214093 - RNA, 22 nt, Homo sapiens
uugagcaaaacauuaauauuag

SEQ ID NO: 214094 - RNA, 22 nt, Homo sapiens
uugagcacaggaguuuugagac

SEQ ID NO: 214095 - RNA, 19 nt, Homo sapiens
uugagcacugccggaguua

SEQ ID NO: 214096 - RNA, 22 nt, Homo sapiens
uugagcucuuccagccuggagc

SEQ ID NO: 214097 - RNA, 21 nt, Homo sapiens
uugagcuuuuaguacagacag

SEQ ID NO: 214098 - RNA, 22 nt, Homo sapiens
uugagcuuuuuacuuguccaau

SEQ ID NO: 214099 - RNA, 22 nt, Homo sapiens
uugaggaaugucauuuguguuu

SEQ ID NO: 214100 - RNA, 22 nt, Homo sapiens
uugaggaucauuguuuucggag

SEQ ID NO: 214101 - RNA, 22 nt, Homo sapiens
uuuggcauuugaguuuguagga

SEQ ID NO: 214102 - RNA, 22 nt, Homo sapiens
uuuggcucugugucccacccaa

SEQ ID NO: 214103 - RNA, 22 nt, Homo sapiens
uuugggccaugguuuguguaua

SEQ ID NO: 214104 - RNA, 22 nt, Homo sapiens
uuugggccucugauuucuuugg

SEQ ID NO: 214105 - RNA, 22 nt, Homo sapiens
uuuggucuuuuguaaguuaucu

SEQ ID NO: 214106 - RNA, 22 nt, Homo sapiens
uuugguuuuuguuaucacucau

SEQ ID NO: 214107 - RNA, 22 nt, Homo sapiens
uuuguaauaccugaggcugggu

SEQ ID NO: 214108 - RNA, 22 nt, Homo sapiens
uuuguaauccuauuccaaagga

SEQ ID NO: 214109 - RNA, 22 nt, Homo sapiens
uuuguacacgugggugaauugu

SEQ ID NO: 214110 - RNA, 22 nt, Homo sapiens
uuuguacuaugguuuuucacua

SEQ ID NO: 214111 - RNA, 22 nt, Homo sapiens
uuuguacucccuuuagauaaaa

SEQ ID NO: 214112 - RNA, 22 nt, Homo sapiens
uuuguacuucauacaauaacuc

SEQ ID NO: 214113 - RNA, 22 nt, Homo sapiens
uuuguacuugguguucuggaaa

SEQ ID NO: 214114 - RNA, 22 nt, Homo sapiens
uuuguagcuacaaagugagaug

SEQ ID NO: 214115 - RNA, 21 nt, Homo sapiens
uuuguaguagcaugauuuaua

SEQ ID NO: 214116 - RNA, 22 nt, Homo sapiens
uuugucauagcagcaggaaugg

SEQ ID NO: 214117 - RNA, 22 nt, Homo sapiens
uuuguccccgcccagaucucau

SEQ ID NO: 214118 - RNA, 19 nt, Homo sapiens
uuuguccugcccuuucuca

SEQ ID NO: 214119 - RNA, 22 nt, Homo sapiens
uuugugauugcacacucaagau

SEQ ID NO: 214120 - RNA, 23 nt, Homo sapiens
uuugugcuaauuuaugggcucuu

SEQ ID NO: 214121 - RNA, 18 nt, Homo sapiens
uuugugcuccacaaagga

SEQ ID NO: 214122 - RNA, 22 nt, Homo sapiens
uuugugcugcaauuaauuuccc

SEQ ID NO: 214123 - RNA, 22 nt, Homo sapiens
uuuguggaaugcccuuauuuau

SEQ ID NO: 214124 - RNA, 22 nt, Homo sapiens
uuuguggaaugcucauguguag

SEQ ID NO: 214125 - RNA, 22 nt, Homo sapiens
uuuuaagcuacaagagacauau

SEQ ID NO: 214126 - RNA, 22 nt, Homo sapiens
uuuuacacuguugguuggaaug

SEQ ID NO: 214127 - RNA, 20 nt, Homo sapiens
uuuuagcuuuuauugaaagc

SEQ ID NO: 214128 - RNA, 22 nt, Homo sapiens
uuuuaguggacaaagguauuua

SEQ ID NO: 214129 - RNA, 22 nt, Homo sapiens
uuuuccagugggacucccauua

SEQ ID NO: 214130 - RNA, 22 nt, Homo sapiens
uuuugcaaauuccaguggccau

SEQ ID NO: 214131 - RNA, 23 nt, Homo sapiens
uuuugcaauaagucacuggaaua

SEQ ID NO: 214132 - RNA, 22 nt, Homo sapiens
uuuugcacuguuuuaucugaca

SEQ ID NO: 214133 - RNA, 22 nt, Homo sapiens
uuuugcaguuacagagagugag

SEQ ID NO: 214134 - RNA, 22 nt, Homo sapiens
uuuugcuugugaauagccacau

SEQ ID NO: 214135 - RNA, 20 nt, Homo sapiens
uuuuggacuaaaggcauccc

SEQ ID NO: 214136 - RNA, 22 nt, Homo sapiens
uuuuggacuucaauuugacacu

SEQ ID NO: 214137 - RNA, 22 nt, Homo sapiens
uuuuggacuugcuccccugucc

SEQ ID NO: 214138 - RNA, 20 nt, Homo sapiens
uuuuggcuuaaagcagucug

SEQ ID NO: 214139 - RNA, 22 nt, Homo sapiens
uuuugguauacacaaggguccu

SEQ ID NO: 214140 - RNA, 22 nt, Homo sapiens
uuuugguauauacggggguccu

SEQ ID NO: 214141 - RNA, 22 nt, Homo sapiens
uuuugguguacaauucuaugga

SEQ ID NO: 214142 - RNA, 22 nt, Homo sapiens
uuuugguuaggauggguggcau

SEQ ID NO: 214143 - RNA, 22 nt, Homo sapiens
uuuugguucaauuaauuugcua

SEQ ID NO: 214144 - RNA, 19 nt, Homo sapiens
uuuuguacucugugacuug

SEQ ID NO: 214145 - RNA, 21 nt, Homo sapiens
uuuugugcaugugcagccugc

SEQ ID NO: 214146 - RNA, 22 nt, Homo sapiens
uuuuugagguauaguguggcua

SEQ ID NO: 214147 - RNA, 22 nt, Homo sapiens
uuuuugaguaaauauaaauugu

SEQ ID NO: 214148 - RNA, 22 nt, Homo sapiens
uuuuugaguagcuggagagcag

SEQ ID NO: 214149 - RNA, 22 nt, Homo sapiens
uuuuuggauaaugguacaugua

SEQ ID NO: 214150 - RNA, 21 nt, Homo sapiens
uuuuugguggucauggauaga

SEQ ID NO: 214151 - RNA, 23 nt, Homo sapiens
uuuuuguguuucauggaaauagg

SEQ ID NO: 214152 - RNA, 20 nt, Homo sapiens
uagcacaucuggcuguagag

SEQ ID NO: 214153 - RNA, 22 nt, Homo sapiens
uagcacaucuucuuggccugca

SEQ ID NO: 214154 - RNA, 22 nt, Homo sapiens
uagcacugucuugcaccugugc

SEQ ID NO: 214155 - RNA, 23 nt, Homo sapiens
uagcacuuuuuacauauggacau

SEQ ID NO: 214156 - RNA, 22 nt, Homo sapiens
uagcagaauauaccucuuacuu

SEQ ID NO: 214157 - RNA, 18 nt, Homo sapiens
uagcagacaucauugggg

SEQ ID NO: 214158 - RNA, 22 nt, Homo sapiens
uagcagcaaagcaggaucugcu

SEQ ID NO: 214159 - RNA, 22 nt, Homo sapiens
uagcaggaaaggggucagaucu

SEQ ID NO: 214160 - RNA, 22 nt, Homo sapiens
uagcagguguuccacaaauauu

SEQ ID NO: 214161 - RNA, 22 nt, Homo sapiens
uagcaguaaagaaugugauguu

SEQ ID NO: 214162 - RNA, 22 nt, Homo sapiens
uagcaguaagaaacugacauug

SEQ ID NO: 214163 - RNA, 22 nt, Homo sapiens
uagcaguagacagacuuuggcu

SEQ ID NO: 214164 - RNA, 22 nt, Homo sapiens
uagcaguaucccaccaucuggu

SEQ ID NO: 214165 - RNA, 22 nt, Homo sapiens
uagcaguauugaaagaugaggg

SEQ ID NO: 214166 - RNA, 22 nt, Homo sapiens
uagcaucaauucauguuaugau

SEQ ID NO: 214167 - RNA, 22 nt, Homo sapiens
uagcaugacacuuguugaaugc

SEQ ID NO: 214168 - RNA, 22 nt, Homo sapiens
uagccuguggugaauguuucug

SEQ ID NO: 214169 - RNA, 17 nt, Homo sapiens
uagcucuauuucuagcc

SEQ ID NO: 214170 - RNA, 18 nt, Homo sapiens
uagcucuuguugguccau

SEQ ID NO: 214171 - RNA, 21 nt, Homo sapiens
uagcugcacccaggccuccuu

SEQ ID NO: 214172 - RNA, 22 nt, Homo sapiens
uagcuggaauuacuugcaccug

SEQ ID NO: 214173 - RNA, 22 nt, Homo sapiens
uagcugguucuccaggagcuag

SEQ ID NO: 214174 - RNA, 23 nt, Homo sapiens
uagcuucucccagaccugcuccc

SEQ ID NO: 214175 - RNA, 22 nt, Homo sapiens
uaggaaguuucuugauuacuua

SEQ ID NO: 214176 - RNA, 22 nt, Homo sapiens
uaggacaaugguacagcagaaa

SEQ ID NO: 214177 - RNA, 22 nt, Homo sapiens
uaggagcacaaaccccauugug

SEQ ID NO: 214178 - RNA, 22 nt, Homo sapiens
uaggagcacaaacccuacugug

SEQ ID NO: 214179 - RNA, 22 nt, Homo sapiens
uaggagugugaacccuaugaac

SEQ ID NO: 214180 - RNA, 22 nt, Homo sapiens
uaggcaauguggcgaaacucug

SEQ ID NO: 214181 - RNA, 22 nt, Homo sapiens
uaggcacacaucuacuacaaau

SEQ ID NO: 214182 - RNA, 22 nt, Homo sapiens
uaggcaguguucucacuuguaa

SEQ ID NO: 214183 - RNA, 22 nt, Homo sapiens
uaggcuuuuggacccugucucu

SEQ ID NO: 214184 - RNA, 22 nt, Homo sapiens
uagggaguguccuuucgggaaa

SEQ ID NO: 214185 - RNA, 22 nt, Homo sapiens
uagggcaaggaacaguuaaaaa

SEQ ID NO: 214186 - RNA, 22 nt, Homo sapiens
uagggcauugaacugaauucuu

SEQ ID NO: 214187 - RNA, 22 nt, Homo sapiens
uaggggcacacuucgguuagca

SEQ ID NO: 214188 - RNA, 22 nt, Homo sapiens
uagguagaaucuugaagccauu

SEQ ID NO: 214189 - RNA, 22 nt, Homo sapiens
uagguaggacguaguccuuuug

SEQ ID NO: 214190 - RNA, 22 nt, Homo sapiens
uagguaggauagucuuuauuuu

SEQ ID NO: 214191 - RNA, 22 nt, Homo sapiens
uagguaucuuuauagcaguagc

SEQ ID NO: 214192 - RNA, 22 nt, Homo sapiens
uagguauguauauacacacaca

SEQ ID NO: 214193 - RNA, 22 nt, Homo sapiens
uaggucaguuuuggcuuggcuu

SEQ ID NO: 214194 - RNA, 22 nt, Homo sapiens
uaggucuccuuuuugccuaaau

SEQ ID NO: 214195 - RNA, 22 nt, Homo sapiens
uaggugaauguaguaagguguu

SEQ ID NO: 214196 - RNA, 22 nt, Homo sapiens
uaggugauugaagguggaaugu

SEQ ID NO: 214197 - RNA, 22 nt, Homo sapiens
uaggugguuugaaauacucaag

SEQ ID NO: 214198 - RNA, 20 nt, Homo sapiens
uagguuuucacagaauugcc

SEQ ID NO: 214199 - RNA, 22 nt, Homo sapiens
uaguaaacaccucagguaauuc

SEQ ID NO: 214200 - RNA, 22 nt, Homo sapiens
uaguagcaccucucaugagcuu

SEQ ID NO: 214201 - RNA, 22 nt, Homo sapiens
uaguagcauaccuaaguauacu

SEQ ID NO: 214202 - RNA, 20 nt, Homo sapiens
uagucaugagauucuccaag

SEQ ID NO: 214203 - RNA, 22 nt, Homo sapiens
uagugaaugucacuggcuguug

SEQ ID NO: 214204 - RNA, 22 nt, Homo sapiens
uagugaauguuggcuauuaaua

SEQ ID NO: 214205 - RNA, 21 nt, Homo sapiens
uagugcagugggguaugacuu

SEQ ID NO: 214206 - RNA, 22 nt, Homo sapiens
uaguuguugcagguaggaugua

SEQ ID NO: 214207 - RNA, 22 nt, Homo sapiens
uauaaaguaauuucuaggggcu

SEQ ID NO: 214208 - RNA, 20 nt, Homo sapiens
uauaacaguuuggacccagu

SEQ ID NO: 214209 - RNA, 23 nt, Homo sapiens
uauaacuuuuaauuuacuggccu

SEQ ID NO: 214210 - RNA, 22 nt, Homo sapiens
uauaagguuaggaaaaauuucu

SEQ ID NO: 214211 - RNA, 22 nt, Homo sapiens
uauagcacaucuguguguacau

SEQ ID NO: 214212 - RNA, 21 nt, Homo sapiens
uauagcagcacgauuuauagu

SEQ ID NO: 214213 - RNA, 22 nt, Homo sapiens
uauagcauuuugauccuguaga

SEQ ID NO: 214214 - RNA, 22 nt, Homo sapiens
uauagcuagucacugcuggauu

SEQ ID NO: 214215 - RNA, 22 nt, Homo sapiens
uauaggacuugguguaguuucu

SEQ ID NO: 214216 - RNA, 21 nt, Homo sapiens
uauaguaguaugauuuacaau

SEQ ID NO: 214217 - RNA, 22 nt, Homo sapiens
uauaguuuuuccugggaggaaa

SEQ ID NO: 214218 - RNA, 22 nt, Homo sapiens
uauauaagcugaugagccacaa

SEQ ID NO: 214219 - RNA, 22 nt, Homo sapiens
uauaucacaugcacucauuuuc

SEQ ID NO: 214220 - RNA, 22 nt, Homo sapiens
uauaugcaacauaguguaugug

SEQ ID NO: 214221 - RNA, 22 nt, Homo sapiens
uauaugucuuuguuauguugag

SEQ ID NO: 214222 - RNA, 23 nt, Homo sapiens
uauaugugucuaggagcuauggu

SEQ ID NO: 214223 - RNA, 22 nt, Homo sapiens
uaucaaguuggaagagaaguaa

SEQ ID NO: 214224 - RNA, 22 nt, Homo sapiens
uaucacacaucaugguaaaucu

SEQ ID NO: 214225 - RNA, 22 nt, Homo sapiens
uaucacagcauugucuauaaua

SEQ ID NO: 214226 - RNA, 20 nt, Homo sapiens
uaucacaguucaggaacucu

SEQ ID NO: 214227 - RNA, 22 nt, Homo sapiens
uaucaccacccugggaaacaua

SEQ ID NO: 214228 - RNA, 22 nt, Homo sapiens
uaucaccauguccguuuuaaaa

SEQ ID NO: 214229 - RNA, 22 nt, Homo sapiens
uaucacuauucauccuagcucc

SEQ ID NO: 214230 - RNA, 22 nt, Homo sapiens
uaucagaguuacacugaagacu

SEQ ID NO: 214231 - RNA, 22 nt, Homo sapiens
uaucagauugcugccaucugcu

SEQ ID NO: 214232 - RNA, 22 nt, Homo sapiens
uaucagcagagucauacuucaa

SEQ ID NO: 214233 - RNA, 22 nt, Homo sapiens
uaucaucauuggcaggugagaa

SEQ ID NO: 214234 - RNA, 22 nt, Homo sapiens
uaucccaguggauguaccccau

SEQ ID NO: 214235 - RNA, 22 nt, Homo sapiens
uaucccuguggacuucccaaca

SEQ ID NO: 214236 - RNA, 23 nt, Homo sapiens
uaucccuugccuuaugaugugag

SEQ ID NO: 214237 - RNA, 22 nt, Homo sapiens
uaucucagaugagacuuguaac

SEQ ID NO: 214238 - RNA, 21 nt, Homo sapiens
uaucucaguuuuccuuugugg

SEQ ID NO: 214239 - RNA, 18 nt, Homo sapiens
uaucucauuucuuagguc

SEQ ID NO: 214240 - RNA, 22 nt, Homo sapiens
uaucugguuauugcugcugauu

SEQ ID NO: 214241 - RNA, 20 nt, Homo sapiens
uaugaaacaguguagagcaa

SEQ ID NO: 214242 - RNA, 22 nt, Homo sapiens
uaugaauuuuauccaggauaua

SEQ ID NO: 214243 - RNA, 22 nt, Homo sapiens
uaugacauaguccuuaacccuc

SEQ ID NO: 214244 - RNA, 20 nt, Homo sapiens
uaugaccugucuuuucucuc

SEQ ID NO: 214245 - RNA, 22 nt, Homo sapiens
uaugagacugguuaauuuuugu

SEQ ID NO: 214246 - RNA, 22 nt, Homo sapiens
ucucugguuuguggaaucuuag

SEQ ID NO: 214247 - RNA, 22 nt, Homo sapiens
ucucuugguugaacaguuugga

SEQ ID NO: 214248 - RNA, 22 nt, Homo sapiens
ucugagaucaugucugugcugu

SEQ ID NO: 214249 - RNA, 22 nt, Homo sapiens
ucugagaugagacuuugaauuu

SEQ ID NO: 214250 - RNA, 22 nt, Homo sapiens
ucugaguggcagaaugagcuga

SEQ ID NO: 214251 - RNA, 22 nt, Homo sapiens
ucugauggaguugccagggaga

SEQ ID NO: 214252 - RNA, 23 nt, Homo sapiens
ucugauguuauaaaauucuuugg

SEQ ID NO: 214253 - RNA, 20 nt, Homo sapiens
ucugauugcaacugcaugag

SEQ ID NO: 214254 - RNA, 22 nt, Homo sapiens
ucugcauaucaugcagaacuau

SEQ ID NO: 214255 - RNA, 22 nt, Homo sapiens
ucugcauauucuagggcaccaa

SEQ ID NO: 214256 - RNA, 22 nt, Homo sapiens
ucugccaaccacaaaauuuauu

SEQ ID NO: 214257 - RNA, 22 nt, Homo sapiens
ucugccuuuucaugugggaugg

SEQ ID NO: 214258 - RNA, 22 nt, Homo sapiens
ucuggcaagagccgagggcagu

SEQ ID NO: 214259 - RNA, 22 nt, Homo sapiens
ucuggcacugaugugggaugcu

SEQ ID NO: 214260 - RNA, 18 nt, Homo sapiens
uuaccagcauaccuacac

SEQ ID NO: 214261 - RNA, 22 nt, Homo sapiens
uuaccucagaccugcucugugu

SEQ ID NO: 214262 - RNA, 22 nt, Homo sapiens
uuaccuugcacugagucugaaa

SEQ ID NO: 214263 - RNA, 22 nt, Homo sapiens
uuacguaguuuuggagaucaua

SEQ ID NO: 214264 - RNA, 22 nt, Homo sapiens
uuacuugagaugaguuggacaa

SEQ ID NO: 214265 - RNA, 22 nt, Homo sapiens
uuagacucauuuuggucaagga

SEQ ID NO: 214266 - RNA, 22 nt, Homo sapiens
uuagagguaggauuucaccaug

SEQ ID NO: 214267 - RNA, 23 nt, Homo sapiens
uuagaucuuuaaggaaucuccac

SEQ ID NO: 214268 - RNA, 22 nt, Homo sapiens
aaauuguccuacugguuugagu

SEQ ID NO: 214269 - RNA, 22 nt, Homo sapiens
aacaccaucccuuugaugcuuu

SEQ ID NO: 214270 - RNA, 22 nt, Homo sapiens
aacagaauccucuuuuccuggg

SEQ ID NO: 214271 - RNA, 22 nt, Homo sapiens
aacagacugucacauaaaauug

SEQ ID NO: 214272 - RNA, 20 nt, Homo sapiens
aacagcacugucugaagcuu

SEQ ID NO: 214273 - RNA, 22 nt, Homo sapiens
aacagcuaguaccaauccacua

SEQ ID NO: 214274 - RNA, 22 nt, Homo sapiens
aacagugcauucagggauauau

SEQ ID NO: 214275 - RNA, 21 nt, Homo sapiens
aacagugcugaacagacaccu

SEQ ID NO: 214276 - RNA, 22 nt, Homo sapiens
aacagugcuucauucacacauu

SEQ ID NO: 214277 - RNA, 22 nt, Homo sapiens
aacauagucaugggguaauguu

SEQ ID NO: 214278 - RNA, 22 nt, Homo sapiens
aacaucaaccaugaggguugga

SEQ ID NO: 214279 - RNA, 22 nt, Homo sapiens
aacauguuuagcagauaccugu

SEQ ID NO: 214280 - RNA, 22 nt, Homo sapiens
aaccacauggcucaguggacau

SEQ ID NO: 214281 - RNA, 22 nt, Homo sapiens
aaccuauaguauugaaaucaag

SEQ ID NO: 214282 - RNA, 22 nt, Homo sapiens
aaccuucauuccuuucccugcc

SEQ ID NO: 214283 - RNA, 22 nt, Homo sapiens
aacuggcacuacaucaagagcu

SEQ ID NO: 214284 - RNA, 22 nt, Homo sapiens
aacuggucuuuggaggaggagg

SEQ ID NO: 214285 - RNA, 22 nt, Homo sapiens
aagagccgcaagggugaagggu

SEQ ID NO: 214286 - RNA, 20 nt, Homo sapiens
aagagcucaccagaauaucu

SEQ ID NO: 214287 - RNA, 18 nt, Homo sapiens
aagagcucagcacagguu

SEQ ID NO: 214288 - RNA, 22 nt, Homo sapiens
aagaggccuaggaaucuguauu

SEQ ID NO: 214289 - RNA, 23 nt, Homo sapiens
aagagguaugacuaugaagugga

SEQ ID NO: 214290 - RNA, 22 nt, Homo sapiens
aagagguuauagaguguauacu

SEQ ID NO: 214291 - RNA, 22 nt, Homo sapiens
aagagguuuaacugacucacag

SEQ ID NO: 214292 - RNA, 22 nt, Homo sapiens
aagagugcucgugggacucagc

SEQ ID NO: 214293 - RNA, 22 nt, Homo sapiens
aagauauguuaguuauaaacuc

SEQ ID NO: 214294 - RNA, 22 nt, Homo sapiens
aagaugauguuguguuuucacu

SEQ ID NO: 214295 - RNA, 22 nt, Homo sapiens
aagaugcagucauacuggagua

SEQ ID NO: 214296 - RNA, 22 nt, Homo sapiens
aagaugguauuucauuaguuuu

SEQ ID NO: 214297 - RNA, 22 nt, Homo sapiens
aagcaacacaucugccccgguu

SEQ ID NO: 214298 - RNA, 21 nt, Homo sapiens
aagcacauugaguguguguga

SEQ ID NO: 214299 - RNA, 22 nt, Homo sapiens
aagcaucacauaauggaucaug

SEQ ID NO: 214300 - RNA, 22 nt, Homo sapiens
aagcuccauuucugccaugaga

SEQ ID NO: 214301 - RNA, 22 nt, Homo sapiens
aagcuggagugcaguggugcaa

SEQ ID NO: 214302 - RNA, 22 nt, Homo sapiens
aagcuggcauucauucguucuu

SEQ ID NO: 214303 - RNA, 22 nt, Homo sapiens
aagcuguuguucauccugaauu

SEQ ID NO: 214304 - RNA, 22 nt, Homo sapiens
aaggaacuggaauauuuugaac

SEQ ID NO: 214305 - RNA, 22 nt, Homo sapiens
aaggaauucaaauuuucucugg

SEQ ID NO: 214306 - RNA, 23 nt, Homo sapiens
aaggacacugaacacuucccagc

SEQ ID NO: 214307 - RNA, 22 nt, Homo sapiens
aaggagcaguggacggguccua

SEQ ID NO: 214308 - RNA, 22 nt, Homo sapiens
aaggcaacgugaguuguugauu

SEQ ID NO: 214309 - RNA, 22 nt, Homo sapiens
aaggcaagaaaauggauucucc

SEQ ID NO: 214310 - RNA, 22 nt, Homo sapiens
aaggcaagaaugcgugcuuuca

SEQ ID NO: 214311 - RNA, 22 nt, Homo sapiens
aaggcaauuuguugugaggauu

SEQ ID NO: 214312 - RNA, 22 nt, Homo sapiens
aaggcauggugacuauuuaggc

SEQ ID NO: 214313 - RNA, 22 nt, Homo sapiens
aagggaaugcgcugccuguguu

SEQ ID NO: 214314 - RNA, 22 nt, Homo sapiens
aagggaauguuguggcugguug

SEQ ID NO: 214315 - RNA, 22 nt, Homo sapiens
aagggaauguuguggcugguuu

SEQ ID NO: 214316 - RNA, 22 nt, Homo sapiens
aagguauuucuaugggaauaga

SEQ ID NO: 214317 - RNA, 21 nt, Homo sapiens
aaggugguggugauugagaug

SEQ ID NO: 214318 - RNA, 22 nt, Homo sapiens
aagguggugucagagagcuuau

SEQ ID NO: 214319 - RNA, 22 nt, Homo sapiens
aaggugguuuucucuuggaguc

SEQ ID NO: 214320 - RNA, 22 nt, Homo sapiens
aagguguagucucuggauaagc

SEQ ID NO: 214321 - RNA, 21 nt, Homo sapiens
aagguuuuuagugcuugacuu

SEQ ID NO: 214322 - RNA, 22 nt, Homo sapiens
aaguaaaucuuaugucagggag

SEQ ID NO: 214323 - RNA, 22 nt, Homo sapiens
aaguaagcauccaauaaauguu

SEQ ID NO: 214324 - RNA, 22 nt, Homo sapiens
aaguacuguuuaaauugcagaa

SEQ ID NO: 214325 - RNA, 22 nt, Homo sapiens
aaguagcuggaugcaguggcac

SEQ ID NO: 214326 - RNA, 22 nt, Homo sapiens
aaguauuaagacuaagaggcuu

SEQ ID NO: 214327 - RNA, 23 nt, Homo sapiens
aagucauggaaucaaaugaggug

SEQ ID NO: 214328 - RNA, 22 nt, Homo sapiens
aaguccaugaagucuugugggu

SEQ ID NO: 214329 - RNA, 19 nt, Homo sapiens
aagugaaugcuuuguucac

SEQ ID NO: 214330 - RNA, 22 nt, Homo sapiens
aagugaccuaacaaugaaggcc

SEQ ID NO: 214331 - RNA, 22 nt, Homo sapiens
aagugacuagacuaugaaaccu

SEQ ID NO: 214332 - RNA, 22 nt, Homo sapiens
aagugcaaaucuguggcugaaa

SEQ ID NO: 214333 - RNA, 22 nt, Homo sapiens
uagaauggaagguugagaagaa

SEQ ID NO: 214334 - RNA, 22 nt, Homo sapiens
uagaauguaacaguuaaaagca

SEQ ID NO: 214335 - RNA, 23 nt, Homo sapiens
uagaauguuuuuccauguuucuu

SEQ ID NO: 214336 - RNA, 22 nt, Homo sapiens
uagacugguuuagcacugaaua

SEQ ID NO: 214337 - RNA, 22 nt, Homo sapiens
uagagagcuguuugaaagcagg

SEQ ID NO: 214338 - RNA, 22 nt, Homo sapiens
uagagguagccuacuacacacc

SEQ ID NO: 214339 - RNA, 22 nt, Homo sapiens
uagagguagguguaugaacuag

SEQ ID NO: 214340 - RNA, 22 nt, Homo sapiens
uagagguauguauaguauucuu

SEQ ID NO: 214341 - RNA, 22 nt, Homo sapiens
uagagguauuaacaguagaaga

SEQ ID NO: 214342 - RNA, 22 nt, Homo sapiens
uagaguguaaaccacauaguga

SEQ ID NO: 214343 - RNA, 22 nt, Homo sapiens
uagauaguaaagccauuagcuu

SEQ ID NO: 214344 - RNA, 21 nt, Homo sapiens
uagauaguugguucugaaucu

SEQ ID NO: 214345 - RNA, 22 nt, Homo sapiens
uagaucaauuaauuguuacuug

SEQ ID NO: 214346 - RNA, 22 nt, Homo sapiens
uagaucacucaggcaauaaaag

SEQ ID NO: 214347 - RNA, 23 nt, Homo sapiens
uagaucaucaaguuuacugugcu

SEQ ID NO: 214348 - RNA, 22 nt, Homo sapiens
uagaucuuuaaaaggugcuaga

SEQ ID NO: 214349 - RNA, 22 nt, Homo sapiens
uagauuaucucaccacucgagu

SEQ ID NO: 214350 - RNA, 22 nt, Homo sapiens
uagauuaucuuaaggagcauca

SEQ ID NO: 214351 - RNA, 22 nt, Homo sapiens
uagauuauuccuuugaauggcc

SEQ ID NO: 214352 - RNA, 22 nt, Homo sapiens
uagauuguaauaugcagaaugg

SEQ ID NO: 214353 - RNA, 22 nt, Homo sapiens
uagcaaguguuuaagcacuuuu

SEQ ID NO: 214354 - RNA, 20 nt, Homo sapiens
uagcacacauguagaauagu

SEQ ID NO: 214355 - RNA, 17 nt, Homo sapiens
uagcacagugccuggua

SEQ ID NO: 214356 - RNA, 22 nt, Homo sapiens
uagcacagugucauucuaggua

SEQ ID NO: 214357 - RNA, 22 nt, Homo sapiens
uagcacuauguuaucacauacu

SEQ ID NO: 214358 - RNA, 22 nt, Homo sapiens
uagcacuauuuauugaaaagga

SEQ ID NO: 214359 - RNA, 22 nt, Homo sapiens
uagcagcaccccacucuacugg

SEQ ID NO: 214360 - RNA, 22 nt, Homo sapiens
uagcagcagugguguauuuaga

SEQ ID NO: 214361 - RNA, 19 nt, Homo sapiens
uagcagcaugauuuauaau

SEQ ID NO: 214362 - RNA, 22 nt, Homo sapiens
uagcagcauuuuuguagaguau

SEQ ID NO: 214363 - RNA, 22 nt, Homo sapiens
uagcaguauggagcgaggccca

SEQ ID NO: 214364 - RNA, 22 nt, Homo sapiens
uagcagugugaaaacagacuaa

SEQ ID NO: 214365 - RNA, 22 nt, Homo sapiens
uagcauccuucucuaaacagga

SEQ ID NO: 214366 - RNA, 22 nt, Homo sapiens
uagcccagugagguugauuugg

SEQ ID NO: 214367 - RNA, 21 nt, Homo sapiens
uagcucagugguguugccaua

SEQ ID NO: 214368 - RNA, 22 nt, Homo sapiens
uagcugcugcuaggcuaaggau

SEQ ID NO: 214369 - RNA, 22 nt, Homo sapiens
uagcugcuguauguacacggau

SEQ ID NO: 214370 - RNA, 22 nt, Homo sapiens
uagcuucuccauagcuccaugu

SEQ ID NO: 214371 - RNA, 18 nt, Homo sapiens
uaggaacauugauuggag

SEQ ID NO: 214372 - RNA, 22 nt, Homo sapiens
uaggaaugaacgauuuauuggu

SEQ ID NO: 214373 - RNA, 22 nt, Homo sapiens
uaggacacucucuccaccagua

SEQ ID NO: 214374 - RNA, 22 nt, Homo sapiens
uaggacauugcccuuguggaga

SEQ ID NO: 214375 - RNA, 22 nt, Homo sapiens
uaggagcacagcagcauguggg

SEQ ID NO: 214376 - RNA, 22 nt, Homo sapiens
uaggcaauguacauaucggccc

SEQ ID NO: 214377 - RNA, 22 nt, Homo sapiens
uaggcgagauguguguuucaug

SEQ ID NO: 214378 - RNA, 22 nt, Homo sapiens
uaggcuguguggccguggggcu

SEQ ID NO: 214379 - RNA, 22 nt, Homo sapiens
uaggcuuuucugggaugugggc

SEQ ID NO: 214380 - RNA, 22 nt, Homo sapiens
uagggcaugugggaaguuauaa

SEQ ID NO: 214381 - RNA, 22 nt, Homo sapiens
uagggcuuuaguuugcuugugu

SEQ ID NO: 214382 - RNA, 19 nt, Homo sapiens
uagguacauucaagucucc

SEQ ID NO: 214383 - RNA, 22 nt, Homo sapiens
uagguacuuaagaucucagcua

SEQ ID NO: 214384 - RNA, 22 nt, Homo sapiens
uagguaggaaguguuguuuuua

SEQ ID NO: 214385 - RNA, 22 nt, Homo sapiens
uagguagguggaaaaguaauug

SEQ ID NO: 214386 - RNA, 22 nt, Homo sapiens
uagguaggugucauaauccaug

SEQ ID NO: 214387 - RNA, 22 nt, Homo sapiens
uagguaucuugguauaucagga

SEQ ID NO: 214388 - RNA, 22 nt, Homo sapiens
uagguuguccaucucuagaagc

SEQ ID NO: 214389 - RNA, 22 nt, Homo sapiens
uaguaccauucccaaaccaacu

SEQ ID NO: 214390 - RNA, 18 nt, Homo sapiens
uaguacuguucucaugau

SEQ ID NO: 214391 - RNA, 22 nt, Homo sapiens
uagucaaaucugaaggaaauuu

SEQ ID NO: 214392 - RNA, 22 nt, Homo sapiens
uagugcugagauugagaagccc

SEQ ID NO: 214393 - RNA, 22 nt, Homo sapiens
uagugcugugauaaacauauau

SEQ ID NO: 214394 - RNA, 22 nt, Homo sapiens
uagugcugugauauuuuuggcc

SEQ ID NO: 214395 - RNA, 22 nt, Homo sapiens
uaguguuuuucauuggcagagg

SEQ ID NO: 214396 - RNA, 22 nt, Homo sapiens
uaguuaguagacucugauuauu

SEQ ID NO: 214397 - RNA, 22 nt, Homo sapiens
uaguucauuauguguugcucag

SEQ ID NO: 214398 - RNA, 22 nt, Homo sapiens
uaguucauuuuucuugcuuaga

SEQ ID NO: 214399 - RNA, 22 nt, Homo sapiens
uaguugcauucaggauaugacg

SEQ ID NO: 214400 - RNA, 22 nt, Homo sapiens
uaguugcauuggcugcuaugcu

SEQ ID NO: 214401 - RNA, 22 nt, Homo sapiens
uaguuuaucuucuggauggaca

SEQ ID NO: 214402 - RNA, 22 nt, Homo sapiens
uauacaugugccauguuggugu

SEQ ID NO: 214403 - RNA, 22 nt, Homo sapiens
uauacuguuuucuauaguggcu

SEQ ID NO: 214404 - RNA, 22 nt, Homo sapiens
uauagagguagguuaauuggaa

SEQ ID NO: 214405 - RNA, 22 nt, Homo sapiens
aauggcucuuccuggaguugug

SEQ ID NO: 214406 - RNA, 22 nt, Homo sapiens
aauggcuuucagcuuuucccca

SEQ ID NO: 214407 - RNA, 19 nt, Homo sapiens
aauggcuuuuccuguuccc

SEQ ID NO: 214408 - RNA, 22 nt, Homo sapiens
aaugugcacuuggagccuugcu

SEQ ID NO: 214409 - RNA, 22 nt, Homo sapiens
aaugugcuguucagaggagucc

SEQ ID NO: 214410 - RNA, 22 nt, Homo sapiens
aauuaguuggcugccuaugauu

SEQ ID NO: 214411 - RNA, 22 nt, Homo sapiens
aauuaguuggcugggugcggug

SEQ ID NO: 214412 - RNA, 22 nt, Homo sapiens
aauucuguauuguuuagggacu

SEQ ID NO: 214413 - RNA, 22 nt, Homo sapiens
aauugaaucaugugggcagacu

SEQ ID NO: 214414 - RNA, 22 nt, Homo sapiens
aauugcaccaucuagaucaaga

SEQ ID NO: 214415 - RNA, 22 nt, Homo sapiens
aauuugucaccucucucccuuu

SEQ ID NO: 214416 - RNA, 22 nt, Homo sapiens
acaaaguaggcagugggcugga

SEQ ID NO: 214417 - RNA, 22 nt, Homo sapiens
acaaaguguuuucugaaggccu

SEQ ID NO: 214418 - RNA, 20 nt, Homo sapiens
acaaaugcauucugugacau

SEQ ID NO: 214419 - RNA, 17 nt, Homo sapiens
acaaauugccagcuagg

SEQ ID NO: 214420 - RNA, 22 nt, Homo sapiens
acaagcacaaauuuaauccugu

SEQ ID NO: 214421 - RNA, 22 nt, Homo sapiens
acaagugcuuuuccuggagaca

SEQ ID NO: 214422 - RNA, 22 nt, Homo sapiens
acaauggaauggaguggaaagu

SEQ ID NO: 214423 - RNA, 22 nt, Homo sapiens
acacauacacauaugguguaua

SEQ ID NO: 214424 - RNA, 22 nt, Homo sapiens
acaccaguacuuuauacaagca

SEQ ID NO: 214425 - RNA, 22 nt, Homo sapiens
acaccaucuccuuauuucucuu

SEQ ID NO: 214426 - RNA, 22 nt, Homo sapiens
acacucucucauuacuuguuug

SEQ ID NO: 214427 - RNA, 22 nt, Homo sapiens
acacugcugaguaaauaauuuu

SEQ ID NO: 214428 - RNA, 22 nt, Homo sapiens
acacuggguaacauaucuguua

SEQ ID NO: 214429 - RNA, 22 nt, Homo sapiens
acacugucaugucucacaggca

SEQ ID NO: 214430 - RNA, 20 nt, Homo sapiens
acacugugcuaaggauuuuc

SEQ ID NO: 214431 - RNA, 22 nt, Homo sapiens
acacuguugacauuuuguagug

SEQ ID NO: 214432 - RNA, 16 nt, Homo sapiens
acacuguuuagggaca

SEQ ID NO: 214433 - RNA, 22 nt, Homo sapiens
acacuugcuugcaauagccucc

SEQ ID NO: 214434 - RNA, 22 nt, Homo sapiens
acagaaccauucacuccccugg

SEQ ID NO: 214435 - RNA, 22 nt, Homo sapiens
acagagcaaugagcuacggucu

SEQ ID NO: 214436 - RNA, 22 nt, Homo sapiens
acagauagcacuaagggaucug

SEQ ID NO: 214437 - RNA, 19 nt, Homo sapiens
acagcugguuuugguuucu

SEQ ID NO: 214438 - RNA, 22 nt, Homo sapiens
acaggguuauuguaauaaugua

SEQ ID NO: 214439 - RNA, 22 nt, Homo sapiens
acaggugaaguauuacacuaag

SEQ ID NO: 214440 - RNA, 22 nt, Homo sapiens
acaguaaugggccccuuuuccu

SEQ ID NO: 214441 - RNA, 22 nt, Homo sapiens
acaguacucugcucuuuugauu

SEQ ID NO: 214442 - RNA, 22 nt, Homo sapiens
acagucuggagaaugggugcuc

SEQ ID NO: 214443 - RNA, 22 nt, Homo sapiens
acagugacagaaagcugauuau

SEQ ID NO: 214444 - RNA, 18 nt, Homo sapiens
acagugcuggcaugagau

SEQ ID NO: 214445 - RNA, 22 nt, Homo sapiens
acagugcugucugcuuuggcua

SEQ ID NO: 214446 - RNA, 22 nt, Homo sapiens
acagugcuguggucaugggucu

SEQ ID NO: 214447 - RNA, 22 nt, Homo sapiens
acagugucaugucguguucccc

SEQ ID NO: 214448 - RNA, 18 nt, Homo sapiens
acagugucuuacaccugu

SEQ ID NO: 214449 - RNA, 22 nt, Homo sapiens
acauacacuagggauguggugu

SEQ ID NO: 214450 - RNA, 22 nt, Homo sapiens
acauagaguagcuaccuguaga

SEQ ID NO: 214451 - RNA, 22 nt, Homo sapiens
acauauaaggagacuagggcau

SEQ ID NO: 214452 - RNA, 22 nt, Homo sapiens
acauaugaguacaugugccaug

SEQ ID NO: 214453 - RNA, 21 nt, Homo sapiens
acaucagaguugugaagguag

SEQ ID NO: 214454 - RNA, 18 nt, Homo sapiens
acaucccaugcuggggug

SEQ ID NO: 214455 - RNA, 22 nt, Homo sapiens
acaugcauccaugugaagagac

SEQ ID NO: 214456 - RNA, 22 nt, Homo sapiens
acauggcacugcgggcuucuug

SEQ ID NO: 214457 - RNA, 22 nt, Homo sapiens
acauggcuuaugaauuuggaga

SEQ ID NO: 214458 - RNA, 22 nt, Homo sapiens
acauguaauugauuuuguguua

SEQ ID NO: 214459 - RNA, 22 nt, Homo sapiens
acauucagcuguuguuucaaug

SEQ ID NO: 214460 - RNA, 22 nt, Homo sapiens
acauugcagauguguuuaaugu

SEQ ID NO: 214461 - RNA, 22 nt, Homo sapiens
acauugcauauggcacccucuu

SEQ ID NO: 214462 - RNA, 19 nt, Homo sapiens
acauugcauuuguaggcuu

SEQ ID NO: 214463 - RNA, 22 nt, Homo sapiens
accauugcacuccagccugggc

SEQ ID NO: 214464 - RNA, 22 nt, Homo sapiens
accauugcacuucagccuaggc

SEQ ID NO: 214465 - RNA, 22 nt, Homo sapiens
accccugagaucgaaucaugcu

SEQ ID NO: 214466 - RNA, 22 nt, Homo sapiens
acccgugcucacugccucugcc

SEQ ID NO: 214467 - RNA, 22 nt, Homo sapiens
acccuacauaguagauccuaca

SEQ ID NO: 214468 - RNA, 22 nt, Homo sapiens
acccugacacgauucuucacuu

SEQ ID NO: 214469 - RNA, 22 nt, Homo sapiens
acccugcuaaacagcccccugc

SEQ ID NO: 214470 - RNA, 22 nt, Homo sapiens
acccuggauucguggccuugaa

SEQ ID NO: 214471 - RNA, 22 nt, Homo sapiens
acccuguaacauacaagugguu

SEQ ID NO: 214472 - RNA, 22 nt, Homo sapiens
acccuguaggacuauucuaauc

SEQ ID NO: 214473 - RNA, 22 nt, Homo sapiens
acccugugagagaguuaauauu

SEQ ID NO: 214474 - RNA, 22 nt, Homo sapiens
acccuguugagcaacuggccau

SEQ ID NO: 214475 - RNA, 22 nt, Homo sapiens
acccuguugguggaucagauug

SEQ ID NO: 214476 - RNA, 22 nt, Homo sapiens
cuguacucaucccauaugcacu

SEQ ID NO: 214477 - RNA, 22 nt, Homo sapiens
cugucacaguuuuggaggccag

SEQ ID NO: 214478 - RNA, 19 nt, Homo sapiens
cugucacugaggaagacug

SEQ ID NO: 214479 - RNA, 22 nt, Homo sapiens
cugucacuggggcacauguccc

SEQ ID NO: 214480 - RNA, 22 nt, Homo sapiens
cuguccugcagagucagaauga

SEQ ID NO: 214481 - RNA, 22 nt, Homo sapiens
cugucuaugagccaggaagcca

SEQ ID NO: 214482 - RNA, 22 nt, Homo sapiens
cugucuggaggccugcaaauaa

SEQ ID NO: 214483 - RNA, 22 nt, Homo sapiens
cugugauuauauaguuaaggua

SEQ ID NO: 214484 - RNA, 22 nt, Homo sapiens
cugugcaaacaagugaaccccu

SEQ ID NO: 214485 - RNA, 22 nt, Homo sapiens
cugugcacaucuggcggcccga

SEQ ID NO: 214486 - RNA, 22 nt, Homo sapiens
cugugcauggauuuuaagauug

SEQ ID NO: 214487 - RNA, 22 nt, Homo sapiens
cuguggguuuuacuguuuuacu

SEQ ID NO: 214488 - RNA, 22 nt, Homo sapiens
cugugguuacguucuuugugcu

SEQ ID NO: 214489 - RNA, 22 nt, Homo sapiens
cugugguugagcuuugccauga

SEQ ID NO: 214490 - RNA, 22 nt, Homo sapiens
cugugguuuaaggaauuuugac

SEQ ID NO: 214491 - RNA, 22 nt, Homo sapiens
cuguguaguacuagauugagca

SEQ ID NO: 214492 - RNA, 19 nt, Homo sapiens
cuguuguacuccaggcauu

SEQ ID NO: 214493 - RNA, 22 nt, Homo sapiens
cuguuugguaaggaugccucag

SEQ ID NO: 214494 - RNA, 22 nt, Homo sapiens
cuguuuguuuaggguacucaga

SEQ ID NO: 214495 - RNA, 18 nt, Homo sapiens
cuuaacauugggaugaua

SEQ ID NO: 214496 - RNA, 22 nt, Homo sapiens
cuuaagcauugacuuuggacag

SEQ ID NO: 214497 - RNA, 22 nt, Homo sapiens
cuuaaggccagauaauuucuau

SEQ ID NO: 214498 - RNA, 22 nt, Homo sapiens
cuuaaguaguuguggaaugaau

SEQ ID NO: 214499 - RNA, 22 nt, Homo sapiens
cuuacagucuaucagccacaac

SEQ ID NO: 214500 - RNA, 19 nt, Homo sapiens
cuuaggugaccaguuccca

SEQ ID NO: 214501 - RNA, 22 nt, Homo sapiens
cuucaaaguuggcuaggagaca

SEQ ID NO: 214502 - RNA, 22 nt, Homo sapiens
cuucaccaguuuggcagucuca

SEQ ID NO: 214503 - RNA, 22 nt, Homo sapiens
cuucaucugguuugugaacuuu

SEQ ID NO: 214504 - RNA, 22 nt, Homo sapiens
cuucaugagacuuuuggaaggc

SEQ ID NO: 214505 - RNA, 22 nt, Homo sapiens
cuuccauaguuacacccaggga

SEQ ID NO: 214506 - RNA, 22 nt, Homo sapiens
cuucucagugcucaucuuauuu

SEQ ID NO: 214507 - RNA, 22 nt, Homo sapiens
cuucugauugaaaauggaguag

SEQ ID NO: 214508 - RNA, 22 nt, Homo sapiens
cuugaacaaagagauuccauua

SEQ ID NO: 214509 - RNA, 22 nt, Homo sapiens
cuugagcauauucuauauuaaa

SEQ ID NO: 214510 - RNA, 22 nt, Homo sapiens
cuugcacucagaagauucaguu

SEQ ID NO: 214511 - RNA, 22 nt, Homo sapiens
cuugcagagcccauggauguca

SEQ ID NO: 214512 - RNA, 22 nt, Homo sapiens
cuuggcauugccccuggaauuu

SEQ ID NO: 214513 - RNA, 22 nt, Homo sapiens
cuugggauauguguuacucugu

SEQ ID NO: 214514 - RNA, 22 nt, Homo sapiens
cuuggguugauugauaaugcca

SEQ ID NO: 214515 - RNA, 22 nt, Homo sapiens
cuuguacacuguuggugggaau

SEQ ID NO: 214516 - RNA, 22 nt, Homo sapiens
cuuguaccccugagucccauaa

SEQ ID NO: 214517 - RNA, 22 nt, Homo sapiens
cuugucacuguuggcuuuagaa

SEQ ID NO: 214518 - RNA, 21 nt, Homo sapiens
cuugucuugcuuagaauagac

SEQ ID NO: 214519 - RNA, 22 nt, Homo sapiens
cuuuacacauccuaaccagugu

SEQ ID NO: 214520 - RNA, 22 nt, Homo sapiens
cuuuaguugucuccucaagggu

SEQ ID NO: 214521 - RNA, 22 nt, Homo sapiens
cuuuaugagguuggauggaucu

SEQ ID NO: 214522 - RNA, 22 nt, Homo sapiens
cuuucacacuguuggugggaau

SEQ ID NO: 214523 - RNA, 22 nt, Homo sapiens
cuuugcaaauggccuuuccaag

SEQ ID NO: 214524 - RNA, 22 nt, Homo sapiens
cuuuggauggaaccucucuuuc

SEQ ID NO: 214525 - RNA, 23 nt, Homo sapiens
cuuugguaggaaauuugaauuau

SEQ ID NO: 214526 - RNA, 22 nt, Homo sapiens
cuuugguggagucuuuagguuc

SEQ ID NO: 214527 - RNA, 22 nt, Homo sapiens
cuuugugcccuucugcccauca

SEQ ID NO: 214528 - RNA, 22 nt, Homo sapiens
cuuuuacacugguggugggaau

SEQ ID NO: 214529 - RNA, 21 nt, Homo sapiens
cuuuugcacuccagccugggu

SEQ ID NO: 214530 - RNA, 22 nt, Homo sapiens
cuuuugugauucuucaguuacu

SEQ ID NO: 214531 - RNA, 22 nt, Homo sapiens
cuuuugugauucuucaguugcu

SEQ ID NO: 214532 - RNA, 21 nt, Homo sapiens
cuuuuuacucguucauaugca

SEQ ID NO: 214533 - RNA, 22 nt, Homo sapiens
cuuuuugguagagcaggugugc

SEQ ID NO: 214534 - RNA, 22 nt, Homo sapiens
gaaagcuaaugacuuuggguga

SEQ ID NO: 214535 - RNA, 22 nt, Homo sapiens
gaaagcugguauagauacauua

SEQ ID NO: 214536 - RNA, 22 nt, Homo sapiens
gaaaguaauuaacgauuguugc

SEQ ID NO: 214537 - RNA, 22 nt, Homo sapiens
gaaagugcugcaaggccaugca

SEQ ID NO: 214538 - RNA, 22 nt, Homo sapiens
gaaaugcucagggguuuuccag

SEQ ID NO: 214539 - RNA, 22 nt, Homo sapiens
gaaauguugauagugggcauug

SEQ ID NO: 214540 - RNA, 22 nt, Homo sapiens
gaaauguuuuucaugugggcaa

SEQ ID NO: 214541 - RNA, 22 nt, Homo sapiens
gaagaaguacaagacaaauuuu

SEQ ID NO: 214542 - RNA, 18 nt, Homo sapiens
gaagaaguaggcauggca

SEQ ID NO: 214543 - RNA, 22 nt, Homo sapiens
gaagacauuugcugcacguccu

SEQ ID NO: 214544 - RNA, 22 nt, Homo sapiens
gaagauaucuaguaccauuguc

SEQ ID NO: 214545 - RNA, 22 nt, Homo sapiens
gaagauguugcuuaccuuggag

SEQ ID NO: 214546 - RNA, 22 nt, Homo sapiens
gaaggagcuuaucugccauuuc

SEQ ID NO: 214547 - RNA, 22 nt, Homo sapiens
gaagguacgcuuaggaaaugau

SEQ ID NO: 214548 - RNA, 22 nt, Homo sapiens
gaagguaguuuauagauguggu

SEQ ID NO: 214549 - RNA, 22 nt, Homo sapiens
gaagguauauucuguuaaugcu

SEQ ID NO: 214550 - RNA, 22 nt, Homo sapiens
gaaguaggugcuguuauuaucu

SEQ ID NO: 214551 - RNA, 23 nt, Homo sapiens
gaaguauagcaugcacauggaaa

SEQ ID NO: 214552 - RNA, 22 nt, Homo sapiens
gaagugguaggauugcuuuuga

SEQ ID NO: 214553 - RNA, 17 nt, Homo sapiens
gaaguguuucuucauga

SEQ ID NO: 214554 - RNA, 22 nt, Homo sapiens
gaaugcagcagugacagggcug

SEQ ID NO: 214555 - RNA, 22 nt, Homo sapiens
gaaugcuaccagcaucuagugg

SEQ ID NO: 214556 - RNA, 22 nt, Homo sapiens
gaauggaacugacuauagcuga

SEQ ID NO: 214557 - RNA, 22 nt, Homo sapiens
gaauguuuacuuuguuuaauac

SEQ ID NO: 214558 - RNA, 22 nt, Homo sapiens
gacaagagaacacugcuauauu

SEQ ID NO: 214559 - RNA, 22 nt, Homo sapiens
gacacagugaagucucuacuug

SEQ ID NO: 214560 - RNA, 22 nt, Homo sapiens
gacaccugguguggaacuggag

SEQ ID NO: 214561 - RNA, 22 nt, Homo sapiens
gacacugucuucugcucuuaaa

SEQ ID NO: 214562 - RNA, 20 nt, Homo sapiens
gacaugacuaggagauagcc

SEQ ID NO: 214563 - RNA, 22 nt, Homo sapiens
gacauguuuucauguauuugga

SEQ ID NO: 214564 - RNA, 22 nt, Homo sapiens
gacauguuuuuuaagguuuaug

SEQ ID NO: 214565 - RNA, 22 nt, Homo sapiens
gacauuaucagguuuguuuucu

SEQ ID NO: 214566 - RNA, 22 nt, Homo sapiens
gaccacauuccacacaggcuuu

SEQ ID NO: 214567 - RNA, 22 nt, Homo sapiens
gacccucuagagggaagcgcuu

SEQ ID NO: 214568 - RNA, 22 nt, Homo sapiens
gacccuguugggguuuagggcu

SEQ ID NO: 214569 - RNA, 22 nt, Homo sapiens
gacuaaugaaagagugugauau

SEQ ID NO: 214570 - RNA, 21 nt, Homo sapiens
gacuacaccaggaugcuaguu

SEQ ID NO: 214571 - RNA, 22 nt, Homo sapiens
gacuaggagauauguuuucuuc

SEQ ID NO: 214572 - RNA, 22 nt, Homo sapiens
gacucagaacuaaggguguuuc

SEQ ID NO: 214573 - RNA, 22 nt, Homo sapiens
gacugaggaagcgcucucuccu

SEQ ID NO: 214574 - RNA, 22 nt, Homo sapiens
gagaacagagauaauuuuacuu

SEQ ID NO: 214575 - RNA, 22 nt, Homo sapiens
gagaaccuccagcaagguagua

SEQ ID NO: 214576 - RNA, 21 nt, Homo sapiens
gagaaucuuuucagggcaaac

SEQ ID NO: 214577 - RNA, 22 nt, Homo sapiens
gagaaugaugauuuccaauuuc

SEQ ID NO: 214578 - RNA, 22 nt, Homo sapiens
cauugcacuccauccuuggcaa

SEQ ID NO: 214579 - RNA, 22 nt, Homo sapiens
cauugcacucugcauuccaguc

SEQ ID NO: 214580 - RNA, 22 nt, Homo sapiens
cauugcacuuagacaacuuuug

SEQ ID NO: 214581 - RNA, 22 nt, Homo sapiens
cauugcagauccuucaaaugac

SEQ ID NO: 214582 - RNA, 22 nt, Homo sapiens
cauugcaguggaguggggaaga

SEQ ID NO: 214583 - RNA, 22 nt, Homo sapiens
cauugcaguuuuugguguaucu

SEQ ID NO: 214584 - RNA, 22 nt, Homo sapiens
cauugcauuccagucugggcaa

SEQ ID NO: 214585 - RNA, 22 nt, Homo sapiens
cauugggugagaacaugcuccu

SEQ ID NO: 214586 - RNA, 22 nt, Homo sapiens
cauugguuaguuaacuuuaaga

SEQ ID NO: 214587 - RNA, 22 nt, Homo sapiens
ccaaaguauuuucacugauauc

SEQ ID NO: 214588 - RNA, 22 nt, Homo sapiens
ccaaaucucauguugaaaugug

SEQ ID NO: 214589 - RNA, 22 nt, Homo sapiens
ccaagccucaguuucccucugu

SEQ ID NO: 214590 - RNA, 22 nt, Homo sapiens
ccaaggaauacccucccuuuuu

SEQ ID NO: 214591 - RNA, 22 nt, Homo sapiens
ccaaguguucucauuguucaau

SEQ ID NO: 214592 - RNA, 22 nt, Homo sapiens
ccacccuggagaauuugagguc

SEQ ID NO: 214593 - RNA, 22 nt, Homo sapiens
ccacugcacuccagcccggcaa

SEQ ID NO: 214594 - RNA, 22 nt, Homo sapiens
ccacugggcuagguguuuugga

SEQ ID NO: 214595 - RNA, 22 nt, Homo sapiens
ccagaguggagccuuugcgagg

SEQ ID NO: 214596 - RNA, 22 nt, Homo sapiens
ccagaguuucugauucagcagg

SEQ ID NO: 214597 - RNA, 22 nt, Homo sapiens
ccagcaccauuuguugaauagg

SEQ ID NO: 214598 - RNA, 22 nt, Homo sapiens
ccagguuucuagaauaauuccu

SEQ ID NO: 214599 - RNA, 22 nt, Homo sapiens
ccaguauugaacacaaugaaag

SEQ ID NO: 214600 - RNA, 22 nt, Homo sapiens
ccagugguucccuguggccuga

SEQ ID NO: 214601 - RNA, 22 nt, Homo sapiens
ccagugguugggccggagacgg

SEQ ID NO: 214602 - RNA, 21 nt, Homo sapiens
ccaguguaaugauagcaggca

SEQ ID NO: 214603 - RNA, 22 nt, Homo sapiens
ccaguguauuuuugggaccugc

SEQ ID NO: 214604 - RNA, 19 nt, Homo sapiens
ccaguguucugauugcacu

SEQ ID NO: 214605 - RNA, 22 nt, Homo sapiens
ccaguuuucccagcaccauuaa

SEQ ID NO: 214606 - RNA, 22 nt, Homo sapiens
ccaucacaggccucagugggaa

SEQ ID NO: 214607 - RNA, 19 nt, Homo sapiens
ccauggcaaugaucugaug

SEQ ID NO: 214608 - RNA, 21 nt, Homo sapiens
ccaugggacggaaugaauaca

SEQ ID NO: 214609 - RNA, 18 nt, Homo sapiens
ccauucaacagauuuguc

SEQ ID NO: 214610 - RNA, 23 nt, Homo sapiens
ccauugcacuccagccucaguga

SEQ ID NO: 214611 - RNA, 22 nt, Homo sapiens
cccagagacagaaugauaaacu

SEQ ID NO: 214612 - RNA, 22 nt, Homo sapiens
cccaguguguuguggauauuua

SEQ ID NO: 214613 - RNA, 22 nt, Homo sapiens
cccaguguuacgugacagccug

SEQ ID NO: 214614 - RNA, 22 nt, Homo sapiens
ccccaguguguaaaggccuugc

SEQ ID NO: 214615 - RNA, 20 nt, Homo sapiens
ccccguguuuagcauaucau

SEQ ID NO: 214616 - RNA, 22 nt, Homo sapiens
ccccugaaacucacucauuauc

SEQ ID NO: 214617 - RNA, 17 nt, Homo sapiens
ccccugagcgaugcagu

SEQ ID NO: 214618 - RNA, 22 nt, Homo sapiens
cccuaagacagugaggggugca

SEQ ID NO: 214619 - RNA, 22 nt, Homo sapiens
cccugaagacuccaccgucaug

SEQ ID NO: 214620 - RNA, 22 nt, Homo sapiens
cccugacauucggagauguagu

SEQ ID NO: 214621 - RNA, 22 nt, Homo sapiens
cccugagaaaacuuuguccuua

SEQ ID NO: 214622 - RNA, 22 nt, Homo sapiens
cccugagaugcuguuaaucugu

SEQ ID NO: 214623 - RNA, 22 nt, Homo sapiens
cccuguagcagcauucuuaaau

SEQ ID NO: 214624 - RNA, 22 nt, Homo sapiens
cccugugaauauuaccuuauuu

SEQ ID NO: 214625 - RNA, 22 nt, Homo sapiens
cccuguguuuagcugaagguuu

SEQ ID NO: 214626 - RNA, 22 nt, Homo sapiens
cccuugcacuucagagcugcau

SEQ ID NO: 214627 - RNA, 22 nt, Homo sapiens
ccgagguaggaggaucacuuga

SEQ ID NO: 214628 - RNA, 22 nt, Homo sapiens
ccuaaguaauggcaguuuuugc

SEQ ID NO: 214629 - RNA, 22 nt, Homo sapiens
ccucacaaccuuuauugaagag

SEQ ID NO: 214630 - RNA, 21 nt, Homo sapiens
ccucuuugagggaagaaaggg

SEQ ID NO: 214631 - RNA, 22 nt, Homo sapiens
ccugagacuugagggggcuucu

SEQ ID NO: 214632 - RNA, 21 nt, Homo sapiens
ccugaugaccucugagaguua

SEQ ID NO: 214633 - RNA, 22 nt, Homo sapiens
ccugaugacuaaugguuuugag

SEQ ID NO: 214634 - RNA, 22 nt, Homo sapiens
ccuggaagaaaggugcuaaaua

SEQ ID NO: 214635 - RNA, 22 nt, Homo sapiens
ccuggcaagagacugaagauag

SEQ ID NO: 214636 - RNA, 22 nt, Homo sapiens
ccuggcacugggccccguggcu

SEQ ID NO: 214637 - RNA, 21 nt, Homo sapiens
ccuugagaacaucaauuugcu

SEQ ID NO: 214638 - RNA, 22 nt, Homo sapiens
ccuuggcacuacugacauugua

SEQ ID NO: 214639 - RNA, 22 nt, Homo sapiens
ccuuggcacuuugccacagugc

SEQ ID NO: 214640 - RNA, 22 nt, Homo sapiens
ccuugguaauguguuuuauucu

SEQ ID NO: 214641 - RNA, 19 nt, Homo sapiens
ccuugguuagguauauucc

SEQ ID NO: 214642 - RNA, 21 nt, Homo sapiens
ccuugguuaucuucccauuca

SEQ ID NO: 214643 - RNA, 22 nt, Homo sapiens
ccuuuguggggcgguggguaau

SEQ ID NO: 214644 - RNA, 22 nt, Homo sapiens
ccuuuuuguaguggaaguagga

SEQ ID NO: 214645 - RNA, 22 nt, Homo sapiens
cgaggaguaucuuugugguguu

SEQ ID NO: 214646 - RNA, 22 nt, Homo sapiens
cgcuggugucuaagcgacagcu

SEQ ID NO: 214647 - RNA, 22 nt, Homo sapiens
cggaaugaaaauguccuucagu

SEQ ID NO: 214648 - RNA, 22 nt, Homo sapiens
cgugaggaaaacagaggguguu

SEQ ID NO: 214649 - RNA, 22 nt, Homo sapiens
cuaaaacuuucugagugcagca

SEQ ID NO: 214650 - RNA, 22 nt, Homo sapiens
cuaaaguauugagugguaaaga

SEQ ID NO: 214651 - RNA, 22 nt, Homo sapiens
cuaaagucacgauuugugggua

SEQ ID NO: 214652 - RNA, 19 nt, Homo sapiens
cuaaaugggucccuagugg

SEQ ID NO: 214653 - RNA, 22 nt, Homo sapiens
caaagugcuggaauuggccggg

SEQ ID NO: 214654 - RNA, 22 nt, Homo sapiens
caaagugcugggacuggccggg

SEQ ID NO: 214655 - RNA, 19 nt, Homo sapiens
caaaguguucuucuuugcc

SEQ ID NO: 214656 - RNA, 22 nt, Homo sapiens
caaauccucaccucaucaugaa

SEQ ID NO: 214657 - RNA, 22 nt, Homo sapiens
caaauugcuuguggaggauaau

SEQ ID NO: 214658 - RNA, 19 nt, Homo sapiens
caacccugcagagaaagga

SEQ ID NO: 214659 - RNA, 22 nt, Homo sapiens
caacugguuuuauacaguuuag

SEQ ID NO: 214660 - RNA, 22 nt, Homo sapiens
caagaucauuuaugcuaaaauu

SEQ ID NO: 214661 - RNA, 22 nt, Homo sapiens
caagugcucuaggauccugagu

SEQ ID NO: 214662 - RNA, 22 nt, Homo sapiens
caagugcuuucuuggggauuua

SEQ ID NO: 214663 - RNA, 22 nt, Homo sapiens
caaguguuggcuuguauacaaa

SEQ ID NO: 214664 - RNA, 22 nt, Homo sapiens
caaguguuuccuuaaauacuug

SEQ ID NO: 214665 - RNA, 21 nt, Homo sapiens
caaugacacuguagcugugcu

SEQ ID NO: 214666 - RNA, 22 nt, Homo sapiens
caaugcagcuuuuggagagaaa

SEQ ID NO: 214667 - RNA, 22 nt, Homo sapiens
caauggcaaugaaauagugaga

SEQ ID NO: 214668 - RNA, 22 nt, Homo sapiens
caaugguacuagauaucuucag

SEQ ID NO: 214669 - RNA, 22 nt, Homo sapiens
caaugguuuuuuaguauaagua

SEQ ID NO: 214670 - RNA, 22 nt, Homo sapiens
caaugugcuuggggcacaugag

SEQ ID NO: 214671 - RNA, 22 nt, Homo sapiens
cacacugucuucauuacuguag

SEQ ID NO: 214672 - RNA, 22 nt, Homo sapiens
cacagaauucauuggauuaccu

SEQ ID NO: 214673 - RNA, 22 nt, Homo sapiens
cacagcgacuuccgccuaccgg

SEQ ID NO: 214674 - RNA, 22 nt, Homo sapiens
cacagcuagucaaugguagaca

SEQ ID NO: 214675 - RNA, 22 nt, Homo sapiens
cacaggccugucucuuucuaac

SEQ ID NO: 214676 - RNA, 22 nt, Homo sapiens
cacagggcuaacauuuuugccc

SEQ ID NO: 214677 - RNA, 23 nt, Homo sapiens
cacagggugaacaccccuaaucc

SEQ ID NO: 214678 - RNA, 22 nt, Homo sapiens
cacagucugggcuuguuuguac

SEQ ID NO: 214679 - RNA, 22 nt, Homo sapiens
cacagugaacaauauccucugu

SEQ ID NO: 214680 - RNA, 22 nt, Homo sapiens
cacaguugccuaucuccugaag

SEQ ID NO: 214681 - RNA, 22 nt, Homo sapiens
cacauagucccugcuaaucuuc

SEQ ID NO: 214682 - RNA, 22 nt, Homo sapiens
cacauguuugcuacauuuuucu

SEQ ID NO: 214683 - RNA, 22 nt, Homo sapiens
cacauguuuuagcauggcuguu

SEQ ID NO: 214684 - RNA, 22 nt, Homo sapiens
caccauguguucagaaggauug

SEQ ID NO: 214685 - RNA, 22 nt, Homo sapiens
caccgagguuggagugcagugg

SEQ ID NO: 214686 - RNA, 22 nt, Homo sapiens
caccuguacauggcaguguccu

SEQ ID NO: 214687 - RNA, 22 nt, Homo sapiens
caccuugugauccacccgccuu

SEQ ID NO: 214688 - RNA, 22 nt, Homo sapiens
cacuagagaauagguaguucug

SEQ ID NO: 214689 - RNA, 22 nt, Homo sapiens
cacugcaauuacuuuugcacca

SEQ ID NO: 214690 - RNA, 22 nt, Homo sapiens
cacugcacuccagccuaagagg

SEQ ID NO: 214691 - RNA, 22 nt, Homo sapiens
cacugcacuccagucuggcgac

SEQ ID NO: 214692 - RNA, 22 nt, Homo sapiens
cacugcacuccaguuucgguaa

SEQ ID NO: 214693 - RNA, 22 nt, Homo sapiens
cacugcauccucugccuggcgg

SEQ ID NO: 214694 - RNA, 22 nt, Homo sapiens
cacugcgaccuccaccucccgg

SEQ ID NO: 214695 - RNA, 22 nt, Homo sapiens
cacugcgaccucugccuaccgg

SEQ ID NO: 214696 - RNA, 22 nt, Homo sapiens
cacugcgacguccgccucccgg

SEQ ID NO: 214697 - RNA, 22 nt, Homo sapiens
cacugggccaucacuuaauauu

SEQ ID NO: 214698 - RNA, 22 nt, Homo sapiens
cacugggugagauccauguuua

SEQ ID NO: 214699 - RNA, 22 nt, Homo sapiens
cacugggugccauauguuugcu

SEQ ID NO: 214700 - RNA, 22 nt, Homo sapiens
cagaaguauugguaugcucugu

SEQ ID NO: 214701 - RNA, 22 nt, Homo sapiens
cagacaugucuuguggccgugg

SEQ ID NO: 214702 - RNA, 22 nt, Homo sapiens
cagagaacugaguuauuuucuu

SEQ ID NO: 214703 - RNA, 21 nt, Homo sapiens
cagagaucaucucuguuuuaa

SEQ ID NO: 214704 - RNA, 22 nt, Homo sapiens
cagagcaaugcuuuugcuuuga

SEQ ID NO: 214705 - RNA, 22 nt, Homo sapiens
cagagcacuaaagguaaaaggc

SEQ ID NO: 214706 - RNA, 22 nt, Homo sapiens
cagaugguggucccacagccca

SEQ ID NO: 214707 - RNA, 20 nt, Homo sapiens
cagcaaccugcucucuuccu

SEQ ID NO: 214708 - RNA, 22 nt, Homo sapiens
cagcaguuguuucggauuggga

SEQ ID NO: 214709 - RNA, 22 nt, Homo sapiens
cagcccuacacagacugacuca

SEQ ID NO: 214710 - RNA, 22 nt, Homo sapiens
cagccgggugagguggcuuguu

SEQ ID NO: 214711 - RNA, 22 nt, Homo sapiens
cagccggguggcuccuagggua

SEQ ID NO: 214712 - RNA, 20 nt, Homo sapiens
cagcuagugguaggagucgg

SEQ ID NO: 214713 - RNA, 22 nt, Homo sapiens
cagcugaugucgaaugcacucu

SEQ ID NO: 214714 - RNA, 22 nt, Homo sapiens
cagcuguguuauaaacuaccau

SEQ ID NO: 214715 - RNA, 22 nt, Homo sapiens
cagcuguuguuaugucugcagg

SEQ ID NO: 214716 - RNA, 22 nt, Homo sapiens
cagcuguuguugggguauagga

SEQ ID NO: 214717 - RNA, 23 nt, Homo sapiens
cagcuucauugaacauaacuccu

SEQ ID NO: 214718 - RNA, 22 nt, Homo sapiens
cagcuugugguauugcugguug

SEQ ID NO: 214719 - RNA, 22 nt, Homo sapiens
cagggaauguuauuuaauagca

SEQ ID NO: 214720 - RNA, 22 nt, Homo sapiens
caggucaucugaguuuaguucu

SEQ ID NO: 214721 - RNA, 22 nt, Homo sapiens
caggugcauuggcugacaccug

SEQ ID NO: 214722 - RNA, 19 nt, Homo sapiens
caguaucauugcacauagu

SEQ ID NO: 214723 - RNA, 22 nt, Homo sapiens
cagugcaaccuccaucucucgg

SEQ ID NO: 214724 - RNA, 22 nt, Homo sapiens
caguggaugaacaagaagugau

SEQ ID NO: 214725 - RNA, 22 nt, Homo sapiens
cagugguuuuuagcuugcuggg

SEQ ID NO: 214726 - RNA, 22 nt, Homo sapiens
caguuguuuuaugacauaagau

SEQ ID NO: 214727 - RNA, 22 nt, Homo sapiens
cauacaagcuacaaucacaaag

SEQ ID NO: 214728 - RNA, 22 nt, Homo sapiens
cauacaugugcuugucuuaugc

SEQ ID NO: 214729 - RNA, 18 nt, Homo sapiens
cauagcacuucagcacau

SEQ ID NO: 214730 - RNA, 22 nt, Homo sapiens
cauaguacuugcauaguacuau

SEQ ID NO: 214731 - RNA, 19 nt, Homo sapiens
caucacagagucuuccauu

SEQ ID NO: 214732 - RNA, 22 nt, Homo sapiens
caucacagcaaguagggagugg

SEQ ID NO: 214733 - RNA, 22 nt, Homo sapiens
caucacaucugcaugguaagua

SEQ ID NO: 214734 - RNA, 22 nt, Homo sapiens
caucacuuugccuccgucucua

SEQ ID NO: 214735 - RNA, 22 nt, Homo sapiens
caucagagugagauauaagauc

SEQ ID NO: 214736 - RNA, 22 nt, Homo sapiens
caucagauugagaucaucuaag

SEQ ID NO: 214737 - RNA, 22 nt, Homo sapiens
cauccccugcaccaaccuuuac

SEQ ID NO: 214738 - RNA, 22 nt, Homo sapiens
uaacugcaaccucugccugcug

SEQ ID NO: 214739 - RNA, 18 nt, Homo sapiens
uaacugugggaacuaacu

SEQ ID NO: 214740 - RNA, 22 nt, Homo sapiens
uaacuucaucauaagucaagaa

SEQ ID NO: 214741 - RNA, 22 nt, Homo sapiens
uaagagagcuccaucuuuuccu

SEQ ID NO: 214742 - RNA, 19 nt, Homo sapiens
uaagaugaagcugucuggg

SEQ ID NO: 214743 - RNA, 22 nt, Homo sapiens
uaagaugcagauuugggcgggg

SEQ ID NO: 214744 - RNA, 20 nt, Homo sapiens
uaagccacacagucuaaggu

SEQ ID NO: 214745 - RNA, 21 nt, Homo sapiens
uaagcuaaacauucaguuaac

SEQ ID NO: 214746 - RNA, 22 nt, Homo sapiens
uaaggaacucugauaucuggaa

SEQ ID NO: 214747 - RNA, 22 nt, Homo sapiens
uaaggcaaaccuuggcugcagu

SEQ ID NO: 214748 - RNA, 22 nt, Homo sapiens
uaaggcacauaggccuggaaac

SEQ ID NO: 214749 - RNA, 22 nt, Homo sapiens
uaaggcuucuuggaauacugca

SEQ ID NO: 214750 - RNA, 22 nt, Homo sapiens
uaagggcacuaaucccauuuau

SEQ ID NO: 214751 - RNA, 22 nt, Homo sapiens
uaagggcaugcugcaugagagu

SEQ ID NO: 214752 - RNA, 22 nt, Homo sapiens
uaagguccuuaaauguguaacc

SEQ ID NO: 214753 - RNA, 22 nt, Homo sapiens
uaagguguagacuggucacaag

SEQ ID NO: 214754 - RNA, 22 nt, Homo sapiens
uaaguaaaugaaagguugauuu

SEQ ID NO: 214755 - RNA, 22 nt, Homo sapiens
uaaguaauugugguuuuugcca

SEQ ID NO: 214756 - RNA, 22 nt, Homo sapiens
uaaguacugucagaauuggacu

SEQ ID NO: 214757 - RNA, 22 nt, Homo sapiens
uaaguagaggaaucauuuugug

SEQ ID NO: 214758 - RNA, 19 nt, Homo sapiens
uaaguagaugacugaugcu

SEQ ID NO: 214759 - RNA, 22 nt, Homo sapiens
uaaguaguuucuggauauucuc

SEQ ID NO: 214760 - RNA, 22 nt, Homo sapiens
uaaguauuuuaauuccuggcau

SEQ ID NO: 214761 - RNA, 22 nt, Homo sapiens
uaagugaaggaaguguguuuac

SEQ ID NO: 214762 - RNA, 22 nt, Homo sapiens
uaagugaauuucacuacugagu

SEQ ID NO: 214763 - RNA, 22 nt, Homo sapiens
uaagugaauuugacagguaaug

SEQ ID NO: 214764 - RNA, 22 nt, Homo sapiens
uaagugcaugauuacaugcaua

SEQ ID NO: 214765 - RNA, 20 nt, Homo sapiens
uaagugcuugagacuucuga

SEQ ID NO: 214766 - RNA, 20 nt, Homo sapiens
uaagugcuugaugaaugaac

SEQ ID NO: 214767 - RNA, 18 nt, Homo sapiens
uaagugcuuuaaacacau

SEQ ID NO: 214768 - RNA, 22 nt, Homo sapiens
uaaguggugcauuguuaaaugg

SEQ ID NO: 214769 - RNA, 22 nt, Homo sapiens
uaaguuguugacauuaggggaa

SEQ ID NO: 214770 - RNA, 22 nt, Homo sapiens
uaauacuugucauaaaggcauu

SEQ ID NO: 214771 - RNA, 22 nt, Homo sapiens
uaauagcaguguuacuaggacu

SEQ ID NO: 214772 - RNA, 22 nt, Homo sapiens
uaauaguguuaaugcuagagcu

SEQ ID NO: 214773 - RNA, 22 nt, Homo sapiens
uaauccugucuugaccaucagg

SEQ ID NO: 214774 - RNA, 22 nt, Homo sapiens
uaaucucagcuacucaggaggc

SEQ ID NO: 214775 - RNA, 22 nt, Homo sapiens
uaaugcauacagaagguguuuu

SEQ ID NO: 214776 - RNA, 22 nt, Homo sapiens
uaaugcaucaugguuggcaaac

SEQ ID NO: 214777 - RNA, 22 nt, Homo sapiens
uaaugcauguaaugggcugaua

SEQ ID NO: 214778 - RNA, 22 nt, Homo sapiens
uaaugcucauuagcaggccaau

SEQ ID NO: 214779 - RNA, 21 nt, Homo sapiens
uaauggcaugaucucggcuca

SEQ ID NO: 214780 - RNA, 22 nt, Homo sapiens
uaaugugcuucucuaccauagg

SEQ ID NO: 214781 - RNA, 22 nt, Homo sapiens
uaauugcaguucuguguuauau

SEQ ID NO: 214782 - RNA, 22 nt, Homo sapiens
uacaaagcuuucugcaaaucau

SEQ ID NO: 214783 - RNA, 22 nt, Homo sapiens
uacaaccucugccucccaaguu

SEQ ID NO: 214784 - RNA, 22 nt, Homo sapiens
uacaagcaggaaaugguauaug

SEQ ID NO: 214785 - RNA, 22 nt, Homo sapiens
uacaagcuaaaauggaagauca

SEQ ID NO: 214786 - RNA, 21 nt, Homo sapiens
uacaaugcacaggagagccuc

SEQ ID NO: 214787 - RNA, 20 nt, Homo sapiens
uacacguaugagcacaugug

SEQ ID NO: 214788 - RNA, 21 nt, Homo sapiens
uacacuacugguggaaaugca

SEQ ID NO: 214789 - RNA, 18 nt, Homo sapiens
uacagaacuggaguagaa

SEQ ID NO: 214790 - RNA, 22 nt, Homo sapiens
uacagaauauuucugcccugag

SEQ ID NO: 214791 - RNA, 22 nt, Homo sapiens
uacagcuaugugcaugcaugcu

SEQ ID NO: 214792 - RNA, 22 nt, Homo sapiens
uacaggaaugucagguugcugu

SEQ ID NO: 214793 - RNA, 22 nt, Homo sapiens
uacaggacuauagaacuuuccc

SEQ ID NO: 214794 - RNA, 22 nt, Homo sapiens
uacaggauagacaauuuauuaa

SEQ ID NO: 214795 - RNA, 22 nt, Homo sapiens
uacaggcagguguucccugguu

SEQ ID NO: 214796 - RNA, 22 nt, Homo sapiens
uacaggugcuuauguggacaua

SEQ ID NO: 214797 - RNA, 19 nt, Homo sapiens
uacaguacacaacaccuuu

SEQ ID NO: 214798 - RNA, 22 nt, Homo sapiens
uacaguacagugacaccauuau

SEQ ID NO: 214799 - RNA, 22 nt, Homo sapiens
uacaguauuaugagugauugaa

SEQ ID NO: 214800 - RNA, 22 nt, Homo sapiens
uacagucacauuccugaccaua

SEQ ID NO: 214801 - RNA, 22 nt, Homo sapiens
uacagucuagaggagaaucagg

SEQ ID NO: 214802 - RNA, 22 nt, Homo sapiens
uacaguggugugaucucagcuc

SEQ ID NO: 214803 - RNA, 22 nt, Homo sapiens
uacauacuguaugguucuguuu

SEQ ID NO: 214804 - RNA, 22 nt, Homo sapiens
uacauagucuucuuuugguuau

SEQ ID NO: 214805 - RNA, 22 nt, Homo sapiens
uacauccauccugcugggcagu

SEQ ID NO: 214806 - RNA, 19 nt, Homo sapiens
uacaugcagcaggcacgca

SEQ ID NO: 214807 - RNA, 22 nt, Homo sapiens
uacauguauccauuguuuuugg

SEQ ID NO: 214808 - RNA, 21 nt, Homo sapiens
uaacagcuccacuccauucuc

SEQ ID NO: 214809 - RNA, 22 nt, Homo sapiens
uaacagcucuacagcugcucuu

SEQ ID NO: 214810 - RNA, 22 nt, Homo sapiens
uaacaggcuacucuugcauugc

SEQ ID NO: 214811 - RNA, 22 nt, Homo sapiens
uaacaguauaugugguaucuau

SEQ ID NO: 214812 - RNA, 22 nt, Homo sapiens
uaacccagugucugugaugggu

SEQ ID NO: 214813 - RNA, 22 nt, Homo sapiens
uaacuacuucugcuucagagua

SEQ ID NO: 214814 - RNA, 22 nt, Homo sapiens
uaacuaguagauggcugacaua

SEQ ID NO: 214815 - RNA, 22 nt, Homo sapiens
uaacuccauuuggacucaguau

SEQ ID NO: 214816 - RNA, 22 nt, Homo sapiens
uaacugucucaggccaugggcg

SEQ ID NO: 214817 - RNA, 20 nt, Homo sapiens
uaacuguggcuucuuuuggc

SEQ ID NO: 214818 - RNA, 23 nt, Homo sapiens
uaagacacuaacuuuaugcuuug

SEQ ID NO: 214819 - RNA, 22 nt, Homo sapiens
caugcacugagagggucucggc

SEQ ID NO: 214820 - RNA, 22 nt, Homo sapiens
caugcauagccauucauucguu

SEQ ID NO: 214821 - RNA, 22 nt, Homo sapiens
caugccacugcacgccauccug

SEQ ID NO: 214822 - RNA, 19 nt, Homo sapiens
caugccacugcacuugagu

SEQ ID NO: 214823 - RNA, 22 nt, Homo sapiens
caugccacuguggacaaagaca

SEQ ID NO: 214824 - RNA, 22 nt, Homo sapiens
cauggcacugagcagguaugca

SEQ ID NO: 214825 - RNA, 22 nt, Homo sapiens
cauggcccuggguccauaggaa

SEQ ID NO: 214826 - RNA, 22 nt, Homo sapiens
cauggcuacugcagauguaggg

SEQ ID NO: 214827 - RNA, 19 nt, Homo sapiens
cauggcuuauaauuuuaau

SEQ ID NO: 214828 - RNA, 22 nt, Homo sapiens
cauggcuuguauaagauucuca

SEQ ID NO: 214829 - RNA, 22 nt, Homo sapiens
caugguguuaggcacugggaau

SEQ ID NO: 214830 - RNA, 22 nt, Homo sapiens
caugugcaugcuuucuuaugug

SEQ ID NO: 214831 - RNA, 20 nt, Homo sapiens
cauuacacuccaaccugggu

SEQ ID NO: 214832 - RNA, 22 nt, Homo sapiens
cauuacacuuguaagguuuuuc

SEQ ID NO: 214833 - RNA, 22 nt, Homo sapiens
cauuccacuggauaaacaaggu

SEQ ID NO: 214834 - RNA, 22 nt, Homo sapiens
cauugcacacauuuaccuaugu

SEQ ID NO: 214835 - RNA, 19 nt, Homo sapiens
cauugcacuccacccuggg

SEQ ID NO: 214836 - RNA, 22 nt, Homo sapiens
cauugcacuccagcccagguga

SEQ ID NO: 214837 - RNA, 22 nt, Homo sapiens
cauugcacuccagccugccugg

SEQ ID NO: 214838 - RNA, 22 nt, Homo sapiens
cauugcacuccagccugcugac

SEQ ID NO: 214839 - RNA, 22 nt, Homo sapiens
cauugcacuccagccuugguga

SEQ ID NO: 214840 - RNA, 22 nt, Homo sapiens
cauugcacuccagcuugggcga

SEQ ID NO: 214841 - RNA, 22 nt, Homo sapiens
cauugcacuccagucugggcaa

SEQ ID NO: 214842 - RNA, 22 nt, Homo sapiens
cauugcacuccaucuugggcaa

SEQ ID NO: 214843 - RNA, 22 nt, Homo sapiens
cauugcacucuagucuggguga

SEQ ID NO: 214844 - RNA, 22 nt, Homo sapiens
cauugcacugcagcccgggcaa

SEQ ID NO: 214845 - RNA, 20 nt, Homo sapiens
cauugcccuccagccugggc

SEQ ID NO: 214846 - RNA, 22 nt, Homo sapiens
cauugcccuccagccugggcaa

SEQ ID NO: 214847 - RNA, 22 nt, Homo sapiens
cauugcuuuuggugguuuagac

SEQ ID NO: 214848 - RNA, 22 nt, Homo sapiens
cauuggugauuagugaaugaac

SEQ ID NO: 214849 - RNA, 22 nt, Homo sapiens
cauugucccucaaugucuauga

SEQ ID NO: 214850 - RNA, 22 nt, Homo sapiens
cauuuugguuaaauagguagcu

SEQ ID NO: 214851 - RNA, 22 nt, Homo sapiens
ccaaauccauccaaaucauaga

SEQ ID NO: 214852 - RNA, 22 nt, Homo sapiens
ccacaaccucaacagcaucuau

SEQ ID NO: 214853 - RNA, 23 nt, Homo sapiens
ccacacuguuuagaauggcauca

SEQ ID NO: 214854 - RNA, 22 nt, Homo sapiens
ccacagucuaugcaacaagguc

SEQ ID NO: 214855 - RNA, 22 nt, Homo sapiens
ccacauuaccuugcuugcucca

SEQ ID NO: 214856 - RNA, 22 nt, Homo sapiens
ccacccuuccauucuuccucuu

SEQ ID NO: 214857 - RNA, 22 nt, Homo sapiens
ccacugugguaucugauacugg

SEQ ID NO: 214858 - RNA, 22 nt, Homo sapiens
ccagcaccauuuauuaaauagg

SEQ ID NO: 214859 - RNA, 20 nt, Homo sapiens
ccagcaucauuagauucugg

SEQ ID NO: 214860 - RNA, 22 nt, Homo sapiens
ccaggguuccacgccuggcugu

SEQ ID NO: 214861 - RNA, 22 nt, Homo sapiens
ccaggguugcuuuagauucuga

SEQ ID NO: 214862 - RNA, 22 nt, Homo sapiens
ccagugauggcugccucauuug

SEQ ID NO: 214863 - RNA, 20 nt, Homo sapiens
ccaguguuauuuauguucua

SEQ ID NO: 214864 - RNA, 22 nt, Homo sapiens
ccaguguuuggauuagggaugc

SEQ ID NO: 214865 - RNA, 22 nt, Homo sapiens
ccaguucaaugauauggaaacu

SEQ ID NO: 214866 - RNA, 17 nt, Homo sapiens
ccaguuuucccucagug

SEQ ID NO: 214867 - RNA, 22 nt, Homo sapiens
ccaugaacuagaauagaacaug

SEQ ID NO: 214868 - RNA, 22 nt, Homo sapiens
ccauggcaauggucagucuauu

SEQ ID NO: 214869 - RNA, 22 nt, Homo sapiens
ccauggcuauucuguaaggguu

SEQ ID NO: 214870 - RNA, 22 nt, Homo sapiens
ccauugcacuccauccugggca

SEQ ID NO: 214871 - RNA, 22 nt, Homo sapiens
cccacaguggccucauauccuu

SEQ ID NO: 214872 - RNA, 22 nt, Homo sapiens
cccaguaaucuugccaguuuuc

SEQ ID NO: 214873 - RNA, 22 nt, Homo sapiens
cccagugaagagaaccuuacga

SEQ ID NO: 214874 - RNA, 22 nt, Homo sapiens
cccagugugcugggugacagcu

SEQ ID NO: 214875 - RNA, 22 nt, Homo sapiens
cccauuguuaaguugaguaucu

SEQ ID NO: 214876 - RNA, 22 nt, Homo sapiens
ccccggguucugucugcccuug

SEQ ID NO: 214877 - RNA, 22 nt, Homo sapiens
ccccuguaaacuggcuucccug

SEQ ID NO: 214878 - RNA, 19 nt, Homo sapiens
ccccuguggauaccgaggg

SEQ ID NO: 214879 - RNA, 18 nt, Homo sapiens
cccgggugggcuguuccc

SEQ ID NO: 214880 - RNA, 17 nt, Homo sapiens
cccuaguagcugggacu

SEQ ID NO: 214881 - RNA, 22 nt, Homo sapiens
cccucauucauucauccuaugu

SEQ ID NO: 214882 - RNA, 22 nt, Homo sapiens
cccugaagauacagaguuuggg

SEQ ID NO: 214883 - RNA, 21 nt, Homo sapiens
cccugguguuuggaguuugag

SEQ ID NO: 214884 - RNA, 22 nt, Homo sapiens
cccuuagaauuuuguaguuauu

SEQ ID NO: 214885 - RNA, 22 nt, Homo sapiens
ccggcuguguggagaggccccu

SEQ ID NO: 214886 - RNA, 22 nt, Homo sapiens
ccucauggagaacaucugcuag

SEQ ID NO: 214887 - RNA, 22 nt, Homo sapiens
ccucauggagaacuucugcuag

SEQ ID NO: 214888 - RNA, 22 nt, Homo sapiens
ccucauugcuaucccaggcuga

SEQ ID NO: 214889 - RNA, 22 nt, Homo sapiens
ccuccauuugugucaggaaguc

SEQ ID NO: 214890 - RNA, 22 nt, Homo sapiens
ccucuuuguugagacuucacca

SEQ ID NO: 214891 - RNA, 22 nt, Homo sapiens
ccugagaucauacuguuaguaa

SEQ ID NO: 214892 - RNA, 21 nt, Homo sapiens
ccugaguacaacccacuccac

SEQ ID NO: 214893 - RNA, 21 nt, Homo sapiens
ccugauguucacuuggccuuc

SEQ ID NO: 214894 - RNA, 19 nt, Homo sapiens
ccugcuguucuuuugcacc

SEQ ID NO: 214895 - RNA, 22 nt, Homo sapiens
ccuggcacugagcaguguucua

SEQ ID NO: 214896 - RNA, 22 nt, Homo sapiens
ccuggguuacaggugugagcca

SEQ ID NO: 214897 - RNA, 22 nt, Homo sapiens
ccugguguuuugauggucgggu

SEQ ID NO: 214898 - RNA, 22 nt, Homo sapiens
ccugucuugauuaaauuacuua

SEQ ID NO: 214899 - RNA, 22 nt, Homo sapiens
ccugugguuaaccagcuagaug

SEQ ID NO: 214900 - RNA, 22 nt, Homo sapiens
ccuguguuaugguuucuaaugu

SEQ ID NO: 214901 - RNA, 22 nt, Homo sapiens
ccuucauccuccagcaggcuag

SEQ ID NO: 214902 - RNA, 22 nt, Homo sapiens
ccuuuuugaguugccagaguuc

SEQ ID NO: 214903 - RNA, 22 nt, Homo sapiens
cgaguagcacaaugugugugau

SEQ ID NO: 214904 - RNA, 22 nt, Homo sapiens
cgaguguaguaggccauaugaa

SEQ ID NO: 214905 - RNA, 22 nt, Homo sapiens
cgccgggggaugggcaccagcg

SEQ ID NO: 214906 - RNA, 20 nt, Homo sapiens
cguugcacuccagccugggc

SEQ ID NO: 214907 - RNA, 22 nt, Homo sapiens
cguugcacuccagccugggcaa

SEQ ID NO: 214908 - RNA, 22 nt, Homo sapiens
cuaaaguagccaggacugcagg

SEQ ID NO: 214909 - RNA, 22 nt, Homo sapiens
cuaagauugucuuaguguguug

SEQ ID NO: 214910 - RNA, 22 nt, Homo sapiens
cugcaauggagaaagugagacu

SEQ ID NO: 214911 - RNA, 19 nt, Homo sapiens
cugcacugagaaaaggagg

SEQ ID NO: 214912 - RNA, 22 nt, Homo sapiens
cugcauaaucaucucucugcau

SEQ ID NO: 214913 - RNA, 22 nt, Homo sapiens
cugcuguuguuaacuuuuggag

SEQ ID NO: 214914 - RNA, 22 nt, Homo sapiens
cuggaagcacaacgcauuuauu

SEQ ID NO: 214915 - RNA, 22 nt, Homo sapiens
cuggagaucuugacauugaagu

SEQ ID NO: 214916 - RNA, 22 nt, Homo sapiens
cuggagcauugguggauuuguu

SEQ ID NO: 214917 - RNA, 22 nt, Homo sapiens
cuggaguaugauguuagcguug

SEQ ID NO: 214918 - RNA, 22 nt, Homo sapiens
cuggaguuugaggcugcaguga

SEQ ID NO: 214919 - RNA, 22 nt, Homo sapiens
cuggauagagauugaugaugcu

SEQ ID NO: 214920 - RNA, 22 nt, Homo sapiens
cuggauagucaggagauauaua

SEQ ID NO: 214921 - RNA, 19 nt, Homo sapiens
ugauuguaagcuuggugag

SEQ ID NO: 214922 - RNA, 22 nt, Homo sapiens
ugauuugucucucagcccuacu

SEQ ID NO: 214923 - RNA, 19 nt, Homo sapiens
ugcaaagucuuuuccuauu

SEQ ID NO: 214924 - RNA, 22 nt, Homo sapiens
ugcaaaugcugcuauuucucuu

SEQ ID NO: 214925 - RNA, 22 nt, Homo sapiens
ugcaagaaacauauuccacaag

SEQ ID NO: 214926 - RNA, 21 nt, Homo sapiens
ugcaagaaucaggaagcugcc

SEQ ID NO: 214927 - RNA, 22 nt, Homo sapiens
ugcaagacugcaguuacuuuug

SEQ ID NO: 214928 - RNA, 22 nt, Homo sapiens
ugcaagaggagacuguacucag

SEQ ID NO: 214929 - RNA, 22 nt, Homo sapiens
ugcaagauaggcaguuugcacu

SEQ ID NO: 214930 - RNA, 22 nt, Homo sapiens
ugcaaguaauuccagcuacuga

SEQ ID NO: 214931 - RNA, 22 nt, Homo sapiens
ugcaaguggauuuuuccccaga

SEQ ID NO: 214932 - RNA, 22 nt, Homo sapiens
ugcaaucauuuggaggagaaga

SEQ ID NO: 214933 - RNA, 22 nt, Homo sapiens
ugcacacucuguaugagaaucu

SEQ ID NO: 214934 - RNA, 22 nt, Homo sapiens
ugcaccacuacacuccaggcug

SEQ ID NO: 214935 - RNA, 22 nt, Homo sapiens
ugcaccacugcacugccugggu

SEQ ID NO: 214936 - RNA, 22 nt, Homo sapiens
ugcaccacugcacuucagccug

SEQ ID NO: 214937 - RNA, 17 nt, Homo sapiens
ugcaccauuugauuuuu

SEQ ID NO: 214938 - RNA, 22 nt, Homo sapiens
ugcacuguggucugagagacag

SEQ ID NO: 214939 - RNA, 20 nt, Homo sapiens
ugcagcacgggcccuuucca

SEQ ID NO: 214940 - RNA, 21 nt, Homo sapiens
ugcagccauucagcccuaugc

SEQ ID NO: 214941 - RNA, 22 nt, Homo sapiens
ugcagguaggcaguaucauuua

SEQ ID NO: 214942 - RNA, 23 nt, Homo sapiens
ugcaguagugagaucuaggcuca

SEQ ID NO: 214943 - RNA, 22 nt, Homo sapiens
ugcagugugaaagagccugaca

SEQ ID NO: 214944 - RNA, 22 nt, Homo sapiens
ugcagugugauuuucuggcuga

SEQ ID NO: 214945 - RNA, 22 nt, Homo sapiens
ugcaguguucuuuagaggaaau

SEQ ID NO: 214946 - RNA, 18 nt, Homo sapiens
ugcauacuaucugauuuu

SEQ ID NO: 214947 - RNA, 19 nt, Homo sapiens
ugcauaggguuacauacuc

SEQ ID NO: 214948 - RNA, 22 nt, Homo sapiens
ugcauauguugaaccagccuug

SEQ ID NO: 214949 - RNA, 22 nt, Homo sapiens
ugcauauucuaggauuuuguau

SEQ ID NO: 214950 - RNA, 22 nt, Homo sapiens
ugcauugcacuugcaugagaua

SEQ ID NO: 214951 - RNA, 22 nt, Homo sapiens
ugcauuguggaucuaaaugcau

SEQ ID NO: 214952 - RNA, 21 nt, Homo sapiens
ugcauuguugcugagagcagg

SEQ ID NO: 214953 - RNA, 22 nt, Homo sapiens
ugcauuguuuagaaacacuggg

SEQ ID NO: 214954 - RNA, 22 nt, Homo sapiens
ugccaguauuuuauugagcauu

SEQ ID NO: 214955 - RNA, 20 nt, Homo sapiens
ugccagugugucaauuuaua

SEQ ID NO: 214956 - RNA, 22 nt, Homo sapiens
ugccauagcaaugguaagcuga

SEQ ID NO: 214957 - RNA, 22 nt, Homo sapiens
ugccaugaaguaauggcaaaaa

SEQ ID NO: 214958 - RNA, 19 nt, Homo sapiens
ugccauguagcacaugguc

SEQ ID NO: 214959 - RNA, 22 nt, Homo sapiens
ugccauugcacuccagccuggg

SEQ ID NO: 214960 - RNA, 22 nt, Homo sapiens
ugcccaguggacagaaagucau

SEQ ID NO: 214961 - RNA, 22 nt, Homo sapiens
ugccuacucucugccaggaaug

SEQ ID NO: 214962 - RNA, 22 nt, Homo sapiens
ugccuacugguuguucugggca

SEQ ID NO: 214963 - RNA, 22 nt, Homo sapiens
ugccuaggcuggagugcagugg

SEQ ID NO: 214964 - RNA, 22 nt, Homo sapiens
ugccugagccagguuuuaggag

SEQ ID NO: 214965 - RNA, 22 nt, Homo sapiens
ugcgccauugcacucuagccug

SEQ ID NO: 214966 - RNA, 22 nt, Homo sapiens
ugcuagaagaucacacacauca

SEQ ID NO: 214967 - RNA, 22 nt, Homo sapiens
ugcuagagaaauauauuugggg

SEQ ID NO: 214968 - RNA, 22 nt, Homo sapiens
ugcuagaugaaguuugaguuuu

SEQ ID NO: 214969 - RNA, 22 nt, Homo sapiens
ugcuagaugcuguagggauuua

SEQ ID NO: 214970 - RNA, 22 nt, Homo sapiens
ugcuauagcuauaucaucuccu

SEQ ID NO: 214971 - RNA, 18 nt, Homo sapiens
ugcuaugagauuauuuua

SEQ ID NO: 214972 - RNA, 22 nt, Homo sapiens
ugcuaugucagccaggcugguc

SEQ ID NO: 214973 - RNA, 23 nt, Homo sapiens
ugcuccccucauggaugaauaaa

SEQ ID NO: 214974 - RNA, 23 nt, Homo sapiens
ugcugagaccuagauccuaaaga

SEQ ID NO: 214975 - RNA, 22 nt, Homo sapiens
ugcugcaaucucggcacuuugg

SEQ ID NO: 214976 - RNA, 22 nt, Homo sapiens
ugcuggugauucagauucaaau

SEQ ID NO: 214977 - RNA, 22 nt, Homo sapiens
ugcugguguggucuagccgcuu

SEQ ID NO: 214978 - RNA, 22 nt, Homo sapiens
ugcugguguuuaggaauaagaa

SEQ ID NO: 214979 - RNA, 21 nt, Homo sapiens
ugcuuacugaauguuaauuuc

SEQ ID NO: 214980 - RNA, 22 nt, Homo sapiens
ugcuuaggcuaacaaaaauagc

SEQ ID NO: 214981 - RNA, 22 nt, Homo sapiens
ugcuuagucuugcuuuagcuau

SEQ ID NO: 214982 - RNA, 22 nt, Homo sapiens
ugcuugagacacauaugaauuu

SEQ ID NO: 214983 - RNA, 22 nt, Homo sapiens
ugcuuuguugaaaaucauuugg

SEQ ID NO: 214984 - RNA, 22 nt, Homo sapiens
uggaaacuuauguucuucugug

SEQ ID NO: 214985 - RNA, 22 nt, Homo sapiens
uggaacaccaggcuggcguggc

SEQ ID NO: 214986 - RNA, 22 nt, Homo sapiens
uggaagacaggcuguauuuuaa

SEQ ID NO: 214987 - RNA, 22 nt, Homo sapiens
uggaagauucuagaagauucca

SEQ ID NO: 214988 - RNA, 23 nt, Homo sapiens
uggaaguauggaggaggcagaau

SEQ ID NO: 214989 - RNA, 22 nt, Homo sapiens
uggaaguuaaauuaguugauga

SEQ ID NO: 214990 - RNA, 19 nt, Homo sapiens
uggaaugaaauguuagggg

SEQ ID NO: 214991 - RNA, 21 nt, Homo sapiens
uggaaugaauggccaacaugg

SEQ ID NO: 214992 - RNA, 20 nt, Homo sapiens
uggaaugcagccuccuucug

SEQ ID NO: 214993 - RNA, 22 nt, Homo sapiens
uggaauggagagagggugcacg

SEQ ID NO: 214994 - RNA, 22 nt, Homo sapiens
uggaaugguaucuuguuggggu

SEQ ID NO: 214995 - RNA, 22 nt, Homo sapiens
uggaauguggacucuuaugggg

SEQ ID NO: 214996 - RNA, 18 nt, Homo sapiens
uggaauguuuggguuaau

SEQ ID NO: 214997 - RNA, 22 nt, Homo sapiens
uggacacuggagauucgucagu

SEQ ID NO: 214998 - RNA, 21 nt, Homo sapiens
uggaccccuuccagucaucau

SEQ ID NO: 214999 - RNA, 19 nt, Homo sapiens
uggaccccuuccuuacacc

SEQ ID NO: 215000 - RNA, 22 nt, Homo sapiens
uggacuagagggugggcgaggu

SEQ ID NO: 215001 - RNA, 22 nt, Homo sapiens
uggacuguaagugccuugagua

SEQ ID NO: 215002 - RNA, 22 nt, Homo sapiens
uggacuguaauagagaacagaa

SEQ ID NO: 215003 - RNA, 22 nt, Homo sapiens
uggagauguuuaaaauccacug

SEQ ID NO: 215004 - RNA, 22 nt, Homo sapiens
uggagggcuagucauuucuuuu

SEQ ID NO: 215005 - RNA, 22 nt, Homo sapiens
uggaggucauuggaucaugggg

SEQ ID NO: 215006 - RNA, 21 nt, Homo sapiens
uggagugaagaguuuauugac

SEQ ID NO: 215007 - RNA, 22 nt, Homo sapiens
uggagugagaacuucaaugaug

SEQ ID NO: 215008 - RNA, 22 nt, Homo sapiens
uggagugcaauggcaccaucuu

SEQ ID NO: 215009 - RNA, 22 nt, Homo sapiens
uggaguguaaauuaguucagcc

SEQ ID NO: 215010 - RNA, 22 nt, Homo sapiens
uggaguguagcggcaccuauua

SEQ ID NO: 215011 - RNA, 22 nt, Homo sapiens
uggaguguguuaacuuuacaag

SEQ ID NO: 215012 - RNA, 22 nt, Homo sapiens
uggaguguuggggcaggaucuc

SEQ ID NO: 215013 - RNA, 22 nt, Homo sapiens
uggauaguuuacugaagagugg

SEQ ID NO: 215014 - RNA, 22 nt, Homo sapiens
uggaucauucuuucuugcaggg

SEQ ID NO: 215015 - RNA, 22 nt, Homo sapiens
uggauguacagucaguauuugu

SEQ ID NO: 215016 - RNA, 22 nt, Homo sapiens
uggcaaaaaaacgcaauuacgu

SEQ ID NO: 215017 - RNA, 22 nt, Homo sapiens
uggcaaaauggaauauguuggg

SEQ ID NO: 215018 - RNA, 22 nt, Homo sapiens
uggcaaaucagaggcauggaca

SEQ ID NO: 215019 - RNA, 22 nt, Homo sapiens
uggcaaaugaaagaaagccagu

SEQ ID NO: 215020 - RNA, 22 nt, Homo sapiens
uggcaaaugugagaugagaacu

SEQ ID NO: 215021 - RNA, 21 nt, Homo sapiens
uggcaacauggauggauucug

SEQ ID NO: 215022 - RNA, 22 nt, Homo sapiens
uggcaagaaccacaguuacuuu

SEQ ID NO: 215023 - RNA, 22 nt, Homo sapiens
guggcuuuaaguacgauugagg

SEQ ID NO: 215024 - RNA, 22 nt, Homo sapiens
gugggaugcaaguaaaauuguc

SEQ ID NO: 215025 - RNA, 22 nt, Homo sapiens
guggguaaaucucuggggcucu

SEQ ID NO: 215026 - RNA, 22 nt, Homo sapiens
guggguaaaucucuguucgagg

SEQ ID NO: 215027 - RNA, 22 nt, Homo sapiens
gugguacccucaggcccuuuuc

SEQ ID NO: 215028 - RNA, 22 nt, Homo sapiens
gugguagaaaguaccaaacuag

SEQ ID NO: 215029 - RNA, 19 nt, Homo sapiens
gugguauuaccuuuugauu

SEQ ID NO: 215030 - RNA, 22 nt, Homo sapiens
gugguucuaaaccuuuuuuggu

SEQ ID NO: 215031 - RNA, 22 nt, Homo sapiens
gugguucuagaauugaguaucc

SEQ ID NO: 215032 - RNA, 22 nt, Homo sapiens
gugguuuucaacuccaccugca

SEQ ID NO: 215033 - RNA, 22 nt, Homo sapiens
guguaaaucugcugugaacauu

SEQ ID NO: 215034 - RNA, 22 nt, Homo sapiens
guguaaaugagugcugaaggag

SEQ ID NO: 215035 - RNA, 22 nt, Homo sapiens
guguaauaaucguggacuaugu

SEQ ID NO: 215036 - RNA, 22 nt, Homo sapiens
guguaugugagaaugcucaugu

SEQ ID NO: 215037 - RNA, 22 nt, Homo sapiens
guguauguuucucccugucccu

SEQ ID NO: 215038 - RNA, 22 nt, Homo sapiens
guguauucaucuggcugaggua

SEQ ID NO: 215039 - RNA, 22 nt, Homo sapiens
guguccucgaguacacaucagg

SEQ ID NO: 215040 - RNA, 22 nt, Homo sapiens
gugugcaauuuugugggaggca

SEQ ID NO: 215041 - RNA, 22 nt, Homo sapiens
gugugcauggagggggcaguga

SEQ ID NO: 215042 - RNA, 22 nt, Homo sapiens
guuaaagacauccacauaggag

SEQ ID NO: 215043 - RNA, 22 nt, Homo sapiens
guuaagaaguguaacuuaaguu

SEQ ID NO: 215044 - RNA, 22 nt, Homo sapiens
guuaaugcuggaauaaguuaag

SEQ ID NO: 215045 - RNA, 22 nt, Homo sapiens
guuauuguccauuuauuuagca

SEQ ID NO: 215046 - RNA, 22 nt, Homo sapiens
guucaaggaauguuggcuucuc

SEQ ID NO: 215047 - RNA, 22 nt, Homo sapiens
guucaagugauagcugggauua

SEQ ID NO: 215048 - RNA, 21 nt, Homo sapiens
guucaagugauccuccugucu

SEQ ID NO: 215049 - RNA, 22 nt, Homo sapiens
guucaagugauucuacugccuc

SEQ ID NO: 215050 - RNA, 22 nt, Homo sapiens
guucaaguuuucucuugugggu

SEQ ID NO: 215051 - RNA, 20 nt, Homo sapiens
guucacaggcuuccuuucag

SEQ ID NO: 215052 - RNA, 22 nt, Homo sapiens
guucacagugguugccuuccag

SEQ ID NO: 215053 - RNA, 22 nt, Homo sapiens
guucacaguucagccuguaaca

SEQ ID NO: 215054 - RNA, 22 nt, Homo sapiens
guucaucaggcuuucucuagag

SEQ ID NO: 215055 - RNA, 17 nt, Homo sapiens
guucccaguggcauuug

SEQ ID NO: 215056 - RNA, 22 nt, Homo sapiens
guucucacuggugcugguaagu

SEQ ID NO: 215057 - RNA, 22 nt, Homo sapiens
guucuggagauaaagccaaggu

SEQ ID NO: 215058 - RNA, 22 nt, Homo sapiens
guugcagaguucuuccuccuga

SEQ ID NO: 215059 - RNA, 22 nt, Homo sapiens
guugcucaggcuggagugcagu

SEQ ID NO: 215060 - RNA, 22 nt, Homo sapiens
guuggaauuaaaaggcaaguau

SEQ ID NO: 215061 - RNA, 22 nt, Homo sapiens
guugggcccauagacugccagu

SEQ ID NO: 215062 - RNA, 22 nt, Homo sapiens
guuggguaauggggcgcaccgu

SEQ ID NO: 215063 - RNA, 22 nt, Homo sapiens
guuggugaccugaagagaguaa

SEQ ID NO: 215064 - RNA, 22 nt, Homo sapiens
guuugcagaucaugaagaaccc

SEQ ID NO: 215065 - RNA, 22 nt, Homo sapiens
guuugguugcauggaaaauuua

SEQ ID NO: 215066 - RNA, 22 nt, Homo sapiens
guuugugguuaaagccuuucau

SEQ ID NO: 215067 - RNA, 22 nt, Homo sapiens
uaaaagucaucacaacuggagu

SEQ ID NO: 215068 - RNA, 22 nt, Homo sapiens
uaaacacucacuucauagccau

SEQ ID NO: 215069 - RNA, 22 nt, Homo sapiens
uaaacugucuugcaguuacaug

SEQ ID NO: 215070 - RNA, 22 nt, Homo sapiens
uaaagaugcugggaaggcuagg

SEQ ID NO: 215071 - RNA, 22 nt, Homo sapiens
uaaagcauguaauuagguuaga

SEQ ID NO: 215072 - RNA, 21 nt, Homo sapiens
uaaagcuagaaccuuagcuuu

SEQ ID NO: 215073 - RNA, 22 nt, Homo sapiens
uaaagcuagaauuguuccagca

SEQ ID NO: 215074 - RNA, 22 nt, Homo sapiens
uaaagcuagagcuggaguggca

SEQ ID NO: 215075 - RNA, 22 nt, Homo sapiens
uaaagcuaucacauuggugauu

SEQ ID NO: 215076 - RNA, 22 nt, Homo sapiens
uaaagcuauuauaguuauguuu

SEQ ID NO: 215077 - RNA, 20 nt, Homo sapiens
uaaagcugcucagggggcuc

SEQ ID NO: 215078 - RNA, 22 nt, Homo sapiens
uaaagcuuagauccaugguggc

SEQ ID NO: 215079 - RNA, 21 nt, Homo sapiens
uaaagcuuagcuauaguggcu

SEQ ID NO: 215080 - RNA, 18 nt, Homo sapiens
uaaaggcacuguguuguu

SEQ ID NO: 215081 - RNA, 21 nt, Homo sapiens
uaaaggcuccaauuauacccc

SEQ ID NO: 215082 - RNA, 22 nt, Homo sapiens
uaaagugaggauggcaguaggu

SEQ ID NO: 215083 - RNA, 22 nt, Homo sapiens
uaaagugcugagaugaggcugg

SEQ ID NO: 215084 - RNA, 22 nt, Homo sapiens
uaaaugcucuuuaaaagugcuu

SEQ ID NO: 215085 - RNA, 22 nt, Homo sapiens
uaaaugcuuaauugaaugugga

SEQ ID NO: 215086 - RNA, 22 nt, Homo sapiens
uaaauggauaaaugaauaccua

SEQ ID NO: 215087 - RNA, 22 nt, Homo sapiens
uaacaaugucuuaugggcuuaa

SEQ ID NO: 215088 - RNA, 16 nt, Homo sapiens
uaacacaguucccacc

SEQ ID NO: 215089 - RNA, 19 nt, Homo sapiens
uaacacaguuguguuugag

SEQ ID NO: 215090 - RNA, 22 nt, Homo sapiens
uaacaguauauuuaccaaaccu

SEQ ID NO: 215091 - RNA, 22 nt, Homo sapiens
uaacaguguagaggccuauugg

SEQ ID NO: 215092 - RNA, 22 nt, Homo sapiens
uaacaguguauuuacuacuucc

SEQ ID NO: 215093 - RNA, 23 nt, Homo sapiens
uaacauugcaugauuaccugcau

SEQ ID NO: 215094 - RNA, 22 nt, Homo sapiens
uaacauugcuggacuaccugcu

SEQ ID NO: 215095 - RNA, 22 nt, Homo sapiens
uaacauugucuugcuuaguuuu

SEQ ID NO: 215096 - RNA, 22 nt, Homo sapiens
uaacauuguugauuauacuaag

SEQ ID NO: 215097 - RNA, 21 nt, Homo sapiens
uaacccugaaggagcucugga

SEQ ID NO: 215098 - RNA, 22 nt, Homo sapiens
uaacccugaggggcuuggggac

SEQ ID NO: 215099 - RNA, 22 nt, Homo sapiens
uaacuaaagagaagucaauguc

SEQ ID NO: 215100 - RNA, 22 nt, Homo sapiens
uaacuagaaaggagacaguugc

SEQ ID NO: 215101 - RNA, 22 nt, Homo sapiens
uaacugcaaccuccgccucccg

SEQ ID NO: 215102 - RNA, 22 nt, Homo sapiens
uaacugucucccuugguccuga

SEQ ID NO: 215103 - RNA, 22 nt, Homo sapiens
uaagaauucuguccgguauacu

SEQ ID NO: 215104 - RNA, 22 nt, Homo sapiens
uaagacacuuaaaauguuacau

SEQ ID NO: 215105 - RNA, 22 nt, Homo sapiens
uaagacucuggacucuaauguu

SEQ ID NO: 215106 - RNA, 22 nt, Homo sapiens
uaagacugccccagacagcaag

SEQ ID NO: 215107 - RNA, 22 nt, Homo sapiens
uaagcaguaaaugaagucuugc

SEQ ID NO: 215108 - RNA, 22 nt, Homo sapiens
uaagccaccgugccuggccuaa

SEQ ID NO: 215109 - RNA, 22 nt, Homo sapiens
uaaggaaggcugugugcuuuua

SEQ ID NO: 215110 - RNA, 22 nt, Homo sapiens
uaaggauuuuggugauuacacu

SEQ ID NO: 215111 - RNA, 22 nt, Homo sapiens
uaaggcaaucagucaugguguu

SEQ ID NO: 215112 - RNA, 22 nt, Homo sapiens
uaaggcacccuucugaguagag

SEQ ID NO: 215113 - RNA, 18 nt, Homo sapiens
uaaggcacuauaggcauu

SEQ ID NO: 215114 - RNA, 20 nt, Homo sapiens
uaaggcacugugcuuuuagg

SEQ ID NO: 215115 - RNA, 22 nt, Homo sapiens
uaaggcuuaugguaaaguccug

SEQ ID NO: 215116 - RNA, 22 nt, Homo sapiens
uaaguaauugugguuucugcca

SEQ ID NO: 215117 - RNA, 22 nt, Homo sapiens
uaaguaauuguuaauagggaag

SEQ ID NO: 215118 - RNA, 22 nt, Homo sapiens
uaaguaauuuguauuuuaccca

SEQ ID NO: 215119 - RNA, 22 nt, Homo sapiens
uaaguacuuuacagacauuauc

SEQ ID NO: 215120 - RNA, 22 nt, Homo sapiens
uaaguagcugggaguacaggca

SEQ ID NO: 215121 - RNA, 23 nt, Homo sapiens
uaagucacacagauuaauuuauu

SEQ ID NO: 215122 - RNA, 22 nt, Homo sapiens
uaagucacuccagguuaaagug

SEQ ID NO: 215123 - RNA, 22 nt, Homo sapiens
uaagucuuuuuggaguuuauaa

SEQ ID NO: 215124 - RNA, 22 nt, Homo sapiens
uaagugcuguguuguuaccuaa

SEQ ID NO: 215125 - RNA, 22 nt, Homo sapiens
uggcaagaacgaaauguagggu

SEQ ID NO: 215126 - RNA, 22 nt, Homo sapiens
uggcaagaagagcaugagacca

SEQ ID NO: 215127 - RNA, 22 nt, Homo sapiens
uggcaagagcugcauucaucug

SEQ ID NO: 215128 - RNA, 22 nt, Homo sapiens
uggcaagaucacaauuacuuuu

SEQ ID NO: 215129 - RNA, 23 nt, Homo sapiens
uggcaagauuuguauugccugga

SEQ ID NO: 215130 - RNA, 22 nt, Homo sapiens
uggcaauaauucagugugggcu

SEQ ID NO: 215131 - RNA, 22 nt, Homo sapiens
uggcacuggagauacauuaaua

SEQ ID NO: 215132 - RNA, 19 nt, Homo sapiens
uggcacuugacguccggau

SEQ ID NO: 215133 - RNA, 22 nt, Homo sapiens
uggcagcgugaaagacuuuuuc

SEQ ID NO: 215134 - RNA, 22 nt, Homo sapiens
uggcaguuucacauggcucaac

SEQ ID NO: 215135 - RNA, 22 nt, Homo sapiens
uggcaugaaguguguuuuaucu

SEQ ID NO: 215136 - RNA, 22 nt, Homo sapiens
uggcaugauauauauucguuug

SEQ ID NO: 215137 - RNA, 22 nt, Homo sapiens
uggcaugauccuagauucaaca

SEQ ID NO: 215138 - RNA, 22 nt, Homo sapiens
uggcauggaaagcuuuucauac

SEQ ID NO: 215139 - RNA, 22 nt, Homo sapiens
uggcauggucugcccaaguuuc

SEQ ID NO: 215140 - RNA, 22 nt, Homo sapiens
uggcauguagucugggaccugg

SEQ ID NO: 215141 - RNA, 23 nt, Homo sapiens
uggcauuuuaguuagcuucagug

SEQ ID NO: 215142 - RNA, 22 nt, Homo sapiens
uggcauuuucucuguucuuaga

SEQ ID NO: 215143 - RNA, 18 nt, Homo sapiens
uggccaauggcaaacaga

SEQ ID NO: 215144 - RNA, 22 nt, Homo sapiens
uggcccccucccaaaucucaua

SEQ ID NO: 215145 - RNA, 22 nt, Homo sapiens
uggccuguaacccucucauagg

SEQ ID NO: 215146 - RNA, 22 nt, Homo sapiens
uggcgagaaaccauaugcuuuc

SEQ ID NO: 215147 - RNA, 22 nt, Homo sapiens
uggcgggaaaguugggagaaga

SEQ ID NO: 215148 - RNA, 20 nt, Homo sapiens
uggcuaaaugaaugauagca

SEQ ID NO: 215149 - RNA, 22 nt, Homo sapiens
uggcuaaguuaaucaaggagau

SEQ ID NO: 215150 - RNA, 22 nt, Homo sapiens
uggcuacagaaaguacuaguga

SEQ ID NO: 215151 - RNA, 22 nt, Homo sapiens
uggcuacuguacuugagcuauu

SEQ ID NO: 215152 - RNA, 19 nt, Homo sapiens
uggcuagagcagauauccu

SEQ ID NO: 215153 - RNA, 22 nt, Homo sapiens
uggcuagauauccagaguucug

SEQ ID NO: 215154 - RNA, 22 nt, Homo sapiens
uggcuauuucgucaugcucccc

SEQ ID NO: 215155 - RNA, 22 nt, Homo sapiens
uggcucuguuuguuaacuagac

SEQ ID NO: 215156 - RNA, 21 nt, Homo sapiens
uggcuguuuucaugcuagaac

SEQ ID NO: 215157 - RNA, 21 nt, Homo sapiens
uggcuuauuugaaucuggcuu

SEQ ID NO: 215158 - RNA, 22 nt, Homo sapiens
uggcuuuguaagguuucauuuu

SEQ ID NO: 215159 - RNA, 22 nt, Homo sapiens
uggcuuuucauccugggacauu

SEQ ID NO: 215160 - RNA, 20 nt, Homo sapiens
ugggaacaugugguauaugg

SEQ ID NO: 215161 - RNA, 22 nt, Homo sapiens
ugggaagaugcugcuucuuccu

SEQ ID NO: 215162 - RNA, 22 nt, Homo sapiens
ugggaagcugcauuuuaacaag

SEQ ID NO: 215163 - RNA, 22 nt, Homo sapiens
ugggagcauugcauuagaagcc

SEQ ID NO: 215164 - RNA, 22 nt, Homo sapiens
ugggaucauucaaugacgaaau

SEQ ID NO: 215165 - RNA, 22 nt, Homo sapiens
ugggaucuuuccuauuagcgag

SEQ ID NO: 215166 - RNA, 22 nt, Homo sapiens
ugggaugaugcuugagaauauc

SEQ ID NO: 215167 - RNA, 22 nt, Homo sapiens
ugggcaaauugugagggaggua

SEQ ID NO: 215168 - RNA, 22 nt, Homo sapiens
ugggcggagacgugcagccgcc

SEQ ID NO: 215169 - RNA, 22 nt, Homo sapiens
uggggcaaugaacauuuuugca

SEQ ID NO: 215170 - RNA, 22 nt, Homo sapiens
uggggcuuuuucuuguauucuc

SEQ ID NO: 215171 - RNA, 22 nt, Homo sapiens
uggggugugagggagaaagaaa

SEQ ID NO: 215172 - RNA, 22 nt, Homo sapiens
uggguaaaucucuguucagggc

SEQ ID NO: 215173 - RNA, 22 nt, Homo sapiens
uggguaaaucuguuuggggcuc

SEQ ID NO: 215174 - RNA, 22 nt, Homo sapiens
uggguaggaccagaaaugcacu

SEQ ID NO: 215175 - RNA, 22 nt, Homo sapiens
uggguaggcccucauuggacag

SEQ ID NO: 215176 - RNA, 22 nt, Homo sapiens
uggguaguguaaagcacuccag

SEQ ID NO: 215177 - RNA, 23 nt, Homo sapiens
uggguucccuaagcgcaugcugc

SEQ ID NO: 215178 - RNA, 22 nt, Homo sapiens
uggguucccugucuguccuuga

SEQ ID NO: 215179 - RNA, 22 nt, Homo sapiens
ugguaaaaugucauuuaccaga

SEQ ID NO: 215180 - RNA, 22 nt, Homo sapiens
ugguaagaggcccugaguuugu

SEQ ID NO: 215181 - RNA, 22 nt, Homo sapiens
ugguagugugagucuaaauugg

SEQ ID NO: 215182 - RNA, 22 nt, Homo sapiens
ugguaucuaagaugcacguugu

SEQ ID NO: 215183 - RNA, 22 nt, Homo sapiens
ugguauguauacuagcgacacu

SEQ ID NO: 215184 - RNA, 22 nt, Homo sapiens
ugguauguaugauuaacaugga

SEQ ID NO: 215185 - RNA, 22 nt, Homo sapiens
ugguaugucuuucuuccuguag

SEQ ID NO: 215186 - RNA, 19 nt, Homo sapiens
uggucaguucugggagcug

SEQ ID NO: 215187 - RNA, 22 nt, Homo sapiens
uggucaugaggugaggcuucuc

SEQ ID NO: 215188 - RNA, 22 nt, Homo sapiens
ugguccccaauacuucuauaga

SEQ ID NO: 215189 - RNA, 20 nt, Homo sapiens
ugguccccaccaaaucucau

SEQ ID NO: 215190 - RNA, 23 nt, Homo sapiens
uggucccguguucuggcuuuagg

SEQ ID NO: 215191 - RNA, 22 nt, Homo sapiens
uggugcaaauguaauugugguu

SEQ ID NO: 215192 - RNA, 22 nt, Homo sapiens
ugguuccauauuaauuuuagga

SEQ ID NO: 215193 - RNA, 21 nt, Homo sapiens
ugguugauccuccuagugccu

SEQ ID NO: 215194 - RNA, 22 nt, Homo sapiens
ugguuguuuuaaaugucgucug

SEQ ID NO: 215195 - RNA, 22 nt, Homo sapiens
uguaaacuuuugagauugacuu

SEQ ID NO: 215196 - RNA, 22 nt, Homo sapiens
uguaacaggaggaaaaugugaa

SEQ ID NO: 215197 - RNA, 22 nt, Homo sapiens
uguaacaguaguuacuauucuu

SEQ ID NO: 215198 - RNA, 22 nt, Homo sapiens
uguaagcauuauauaauuguug

SEQ ID NO: 215199 - RNA, 22 nt, Homo sapiens
uguaauaguaggcucacauuug

SEQ ID NO: 215200 - RNA, 22 nt, Homo sapiens
uguaaugaucaaaucagaguaa

SEQ ID NO: 215201 - RNA, 22 nt, Homo sapiens
uguaauuuaaaugauccuugga

SEQ ID NO: 215202 - RNA, 22 nt, Homo sapiens
uguagacaccaaagacagcaua

SEQ ID NO: 215203 - RNA, 22 nt, Homo sapiens
uguagacagcacguaguugagu

SEQ ID NO: 215204 - RNA, 22 nt, Homo sapiens
uguagauaucauuagugcugug

SEQ ID NO: 215205 - RNA, 18 nt, Homo sapiens
uguagcaccuuucuugug

SEQ ID NO: 215206 - RNA, 21 nt, Homo sapiens
uguagcagcaugauucauagu

SEQ ID NO: 215207 - RNA, 22 nt, Homo sapiens
uguagcuuuugagauuuauauu

SEQ ID NO: 215208 - RNA, 22 nt, Homo sapiens
uguagguagggucuguuuuuga

SEQ ID NO: 215209 - RNA, 22 nt, Homo sapiens
uguaguuugaaagcucccucug

SEQ ID NO: 215210 - RNA, 22 nt, Homo sapiens
uguauaacucacauugaaguuu

SEQ ID NO: 215211 - RNA, 21 nt, Homo sapiens
uguauacauggaagaaugguc

SEQ ID NO: 215212 - RNA, 22 nt, Homo sapiens
uguauacugucuaauauguugu

SEQ ID NO: 215213 - RNA, 22 nt, Homo sapiens
uguauagaucugauucaucucc

SEQ ID NO: 215214 - RNA, 22 nt, Homo sapiens
uguauguugggucaaaguacau

SEQ ID NO: 215215 - RNA, 22 nt, Homo sapiens
uguauuuguuguuaaauggaga

SEQ ID NO: 215216 - RNA, 20 nt, Homo sapiens
ugucaagaaacauuacuuau

SEQ ID NO: 215217 - RNA, 22 nt, Homo sapiens
ugucaagaugguuugauguugu

SEQ ID NO: 215218 - RNA, 22 nt, Homo sapiens
ugucaaguugugguucaauuuu

SEQ ID NO: 215219 - RNA, 22 nt, Homo sapiens
ugucacagagauuuugguaugu

SEQ ID NO: 215220 - RNA, 22 nt, Homo sapiens
ugucacguugcuuuucuguugu

SEQ ID NO: 215221 - RNA, 22 nt, Homo sapiens
ugucacugugcagucaugcauu

SEQ ID NO: 215222 - RNA, 22 nt, Homo sapiens
ugucagaaucugagacgacaac

SEQ ID NO: 215223 - RNA, 18 nt, Homo sapiens
ugucagaguggauuguaa

SEQ ID NO: 215224 - RNA, 22 nt, Homo sapiens
ugucaggaggguccagagaaaa

SEQ ID NO: 215225 - RNA, 22 nt, Homo sapiens
ugucaguuucccuccucuuccu

SEQ ID NO: 215226 - RNA, 22 nt, Homo sapiens
ugucauagauugcuuggaaaaa

SEQ ID NO: 215227 - RNA, 22 nt, Homo sapiens
uaaguguaaugucugaaguuug

SEQ ID NO: 215228 - RNA, 23 nt, Homo sapiens
uaaguucaucucuaauaggugga

SEQ ID NO: 215229 - RNA, 22 nt, Homo sapiens
uaaguucauucaugaaacuuag

SEQ ID NO: 215230 - RNA, 18 nt, Homo sapiens
uaauaacugugaccuuga

SEQ ID NO: 215231 - RNA, 22 nt, Homo sapiens
uaauaauguuaggcuuacucaa

SEQ ID NO: 215232 - RNA, 22 nt, Homo sapiens
uaauacuagugaauagcaggau

SEQ ID NO: 215233 - RNA, 22 nt, Homo sapiens
uaauacuguaauggugguuccg

SEQ ID NO: 215234 - RNA, 22 nt, Homo sapiens
uaauagcucggauaaacaugau

SEQ ID NO: 215235 - RNA, 22 nt, Homo sapiens
uaauaguuucagaaguuguuuu

SEQ ID NO: 215236 - RNA, 22 nt, Homo sapiens
uaauauguauacagacagauac

SEQ ID NO: 215237 - RNA, 22 nt, Homo sapiens
uaauccuagcacuuuggaagac

SEQ ID NO: 215238 - RNA, 22 nt, Homo sapiens
uaauccuggcacuuugggaggc

SEQ ID NO: 215239 - RNA, 22 nt, Homo sapiens
uaaugcacuuuccuccaaggcu

SEQ ID NO: 215240 - RNA, 22 nt, Homo sapiens
uaaugcaucagugguaguucuu

SEQ ID NO: 215241 - RNA, 19 nt, Homo sapiens
uaaugccacugccuggcau

SEQ ID NO: 215242 - RNA, 22 nt, Homo sapiens
uaaugcuguggucuaaugggga

SEQ ID NO: 215243 - RNA, 22 nt, Homo sapiens
uaaugcuguggucugguuuaaa

SEQ ID NO: 215244 - RNA, 22 nt, Homo sapiens
uaauucugacaacaguggcguu

SEQ ID NO: 215245 - RNA, 22 nt, Homo sapiens
uaauugaaugcagacaccaggg

SEQ ID NO: 215246 - RNA, 22 nt, Homo sapiens
uacaaagcuuugaugugucuuu

SEQ ID NO: 215247 - RNA, 22 nt, Homo sapiens
uacaaaguaacaguuccuguau

SEQ ID NO: 215248 - RNA, 22 nt, Homo sapiens
uacaacacugguucgacaugug

SEQ ID NO: 215249 - RNA, 16 nt, Homo sapiens
uacaacagugaguaug

SEQ ID NO: 215250 - RNA, 22 nt, Homo sapiens
uacaagcacaggcagcaggcug

SEQ ID NO: 215251 - RNA, 21 nt, Homo sapiens
uacaagcuguagcacaugcca

SEQ ID NO: 215252 - RNA, 22 nt, Homo sapiens
uacaauagugacaaaucagcau

SEQ ID NO: 215253 - RNA, 22 nt, Homo sapiens
uacacaugugaguucuuuucua

SEQ ID NO: 215254 - RNA, 22 nt, Homo sapiens
uacaccaauuuaaucaaaagca

SEQ ID NO: 215255 - RNA, 22 nt, Homo sapiens
uacacgugcacaacgugcacgu

SEQ ID NO: 215256 - RNA, 22 nt, Homo sapiens
uacagaguagaagauuugcaga

SEQ ID NO: 215257 - RNA, 22 nt, Homo sapiens
uacagaguauccauuugaguuc

SEQ ID NO: 215258 - RNA, 19 nt, Homo sapiens
uacaggacugagcugaggu

SEQ ID NO: 215259 - RNA, 22 nt, Homo sapiens
uacaguaguaucuucauuuguu

SEQ ID NO: 215260 - RNA, 22 nt, Homo sapiens
uacagucauaaugccuagugac

SEQ ID NO: 215261 - RNA, 22 nt, Homo sapiens
uacaguggaaguuaaccccauu

SEQ ID NO: 215262 - RNA, 20 nt, Homo sapiens
uacauaguaaacugagagca

SEQ ID NO: 215263 - RNA, 22 nt, Homo sapiens
uacauaguaagcaucuccugug

SEQ ID NO: 215264 - RNA, 22 nt, Homo sapiens
uacauaguagauauaggguuua

SEQ ID NO: 215265 - RNA, 22 nt, Homo sapiens
uacauaguuacuuccauuucca

SEQ ID NO: 215266 - RNA, 22 nt, Homo sapiens
uacaucagccugaaagagcucg

SEQ ID NO: 215267 - RNA, 22 nt, Homo sapiens
uacauguauguguuuauggcug

SEQ ID NO: 215268 - RNA, 22 nt, Homo sapiens
uacaugugccauguugguuugc

SEQ ID NO: 215269 - RNA, 22 nt, Homo sapiens
uacauugucauauucucucucu

SEQ ID NO: 215270 - RNA, 16 nt, Homo sapiens
uacauuuguuacaugg

SEQ ID NO: 215271 - RNA, 19 nt, Homo sapiens
uaccagcacaguguuugag

SEQ ID NO: 215272 - RNA, 22 nt, Homo sapiens
uaccaugcagguguauguuugu

SEQ ID NO: 215273 - RNA, 22 nt, Homo sapiens
uacguuaucagguaugcaagag

SEQ ID NO: 215274 - RNA, 22 nt, Homo sapiens
uacuacagccugagcgacugag

SEQ ID NO: 215275 - RNA, 22 nt, Homo sapiens
uacucagugacugguggaucaa

SEQ ID NO: 215276 - RNA, 22 nt, Homo sapiens
uacuccccuuguucugugagcu

SEQ ID NO: 215277 - RNA, 22 nt, Homo sapiens
uacugagagaggaauauugaaa

SEQ ID NO: 215278 - RNA, 22 nt, Homo sapiens
uacugcacauaugaagguuccc

SEQ ID NO: 215279 - RNA, 19 nt, Homo sapiens
uacugcaccucaaccuggg

SEQ ID NO: 215280 - RNA, 22 nt, Homo sapiens
uacugcacuccagccugggaga

SEQ ID NO: 215281 - RNA, 22 nt, Homo sapiens
uacugcacuccagccuggguga

SEQ ID NO: 215282 - RNA, 18 nt, Homo sapiens
uacugcacucuccagccu

SEQ ID NO: 215283 - RNA, 22 nt, Homo sapiens
uacugcacuugaccuccugggc

SEQ ID NO: 215284 - RNA, 22 nt, Homo sapiens
uacugcauucuccgccuccggg

SEQ ID NO: 215285 - RNA, 22 nt, Homo sapiens
uacugcugucagugccaaguag

SEQ ID NO: 215286 - RNA, 22 nt, Homo sapiens
uacugguuuuauauauuucucc

SEQ ID NO: 215287 - RNA, 22 nt, Homo sapiens
uagaaagcaugaccuucagaua

SEQ ID NO: 215288 - RNA, 22 nt, Homo sapiens
uagaaaguagggaagguaggau

SEQ ID NO: 215289 - RNA, 22 nt, Homo sapiens
uagaacauuccaggugauguug

SEQ ID NO: 215290 - RNA, 22 nt, Homo sapiens
uagaagcuacucuucuuguggc

SEQ ID NO: 215291 - RNA, 22 nt, Homo sapiens
uagaauguaaauuccaagggca

SEQ ID NO: 215292 - RNA, 22 nt, Homo sapiens
uagaauguaacuuccaugucau

SEQ ID NO: 215293 - RNA, 22 nt, Homo sapiens
uagaauguauaauauuuuacuu

SEQ ID NO: 215294 - RNA, 20 nt, Homo sapiens
uagacagcuagauuagauag

SEQ ID NO: 215295 - RNA, 20 nt, Homo sapiens
uagagagauauggggguucc

SEQ ID NO: 215296 - RNA, 21 nt, Homo sapiens
uagagcaacacacgcccucuc

SEQ ID NO: 215297 - RNA, 22 nt, Homo sapiens
uagagcacaagguagauuucua

SEQ ID NO: 215298 - RNA, 22 nt, Homo sapiens
uagagcacagugauuagaccua

SEQ ID NO: 215299 - RNA, 22 nt, Homo sapiens
uagagccauugcagauguuuga

SEQ ID NO: 215300 - RNA, 22 nt, Homo sapiens
uagagcuaguuuuuaaucuaac

SEQ ID NO: 215301 - RNA, 22 nt, Homo sapiens
uagagcuugacacuuuccaugg

SEQ ID NO: 215302 - RNA, 21 nt, Homo sapiens
uagagcuuggcacagaguaga

SEQ ID NO: 215303 - RNA, 22 nt, Homo sapiens
uagaggaaugaauuuggccaga

SEQ ID NO: 215304 - RNA, 19 nt, Homo sapiens
uagagguuuaagaaaagaa

SEQ ID NO: 215305 - RNA, 22 nt, Homo sapiens
uagaguaguggcgugaucucgg

SEQ ID NO: 215306 - RNA, 22 nt, Homo sapiens
uagauuaucauucauacaggga

SEQ ID NO: 215307 - RNA, 22 nt, Homo sapiens
uagauuauccggcugggacaau

SEQ ID NO: 215308 - RNA, 22 nt, Homo sapiens
uagauuaucuaugaggcuucca

SEQ ID NO: 215309 - RNA, 22 nt, Homo sapiens
uagauucaucuguuccuuuuga

SEQ ID NO: 215310 - RNA, 22 nt, Homo sapiens
uagcaaaucaauggaauugaag

SEQ ID NO: 215311 - RNA, 22 nt, Homo sapiens
uagcaacauucagcucagguac

SEQ ID NO: 215312 - RNA, 22 nt, Homo sapiens
uagcacaguucacccucgauuu

SEQ ID NO: 215313 - RNA, 22 nt, Homo sapiens
uagcacaugucagguaauuugc

SEQ ID NO: 215314 - RNA, 22 nt, Homo sapiens
uagcaccaaacauauacucagu

SEQ ID NO: 215315 - RNA, 22 nt, Homo sapiens
uagcaccugugcacaccaggca

SEQ ID NO: 215316 - RNA, 22 nt, Homo sapiens
uagcaccuuagcauuucuagug

SEQ ID NO: 215317 - RNA, 22 nt, Homo sapiens
uagcacuauuuuucacuauccu

SEQ ID NO: 215318 - RNA, 22 nt, Homo sapiens
uagcagcaucucuggcuucuac

SEQ ID NO: 215319 - RNA, 22 nt, Homo sapiens
uagcagccaggaagggcuggcu

SEQ ID NO: 215320 - RNA, 22 nt, Homo sapiens
uagcagcuuuauugagguaaau

SEQ ID NO: 215321 - RNA, 22 nt, Homo sapiens
uagcaggaaaccuguguugagg

SEQ ID NO: 215322 - RNA, 22 nt, Homo sapiens
uagcagguggugaccacauuuu

SEQ ID NO: 215323 - RNA, 22 nt, Homo sapiens
uagcaguauaugagagcuauug

SEQ ID NO: 215324 - RNA, 22 nt, Homo sapiens
uagcaguucauuguugugugaa

SEQ ID NO: 215325 - RNA, 22 nt, Homo sapiens
uagcauaauuuguagaaaauca

SEQ ID NO: 215326 - RNA, 21 nt, Homo sapiens
uagcauacauuuugcaucuua

SEQ ID NO: 215327 - RNA, 22 nt, Homo sapiens
uagcaucagauuccauauucua

SEQ ID NO: 215328 - RNA, 22 nt, Homo sapiens
uagcuccacagcuauauauaau

SEQ ID NO: 215329 - RNA, 22 nt, Homo sapiens
ugucaucauuggaaucugccuc

SEQ ID NO: 215330 - RNA, 22 nt, Homo sapiens
ugucaugucaacuauggaauuu

SEQ ID NO: 215331 - RNA, 22 nt, Homo sapiens
ugucauguggcuaacgauucau

SEQ ID NO: 215332 - RNA, 22 nt, Homo sapiens
ugucauucaggaaauucuaagu

SEQ ID NO: 215333 - RNA, 22 nt, Homo sapiens
uguccauuuuuaugcuuauggu

SEQ ID NO: 215334 - RNA, 22 nt, Homo sapiens
ugucccaguuggguauugaauu

SEQ ID NO: 215335 - RNA, 22 nt, Homo sapiens
ugucuacugaugauguaguuaa

SEQ ID NO: 215336 - RNA, 22 nt, Homo sapiens
ugucucaguuacggcaauucca

SEQ ID NO: 215337 - RNA, 21 nt, Homo sapiens
ugucugagagaggagaucuac

SEQ ID NO: 215338 - RNA, 22 nt, Homo sapiens
ugucuuugguucaggcaaggag

SEQ ID NO: 215339 - RNA, 22 nt, Homo sapiens
ugugaaacacgaaagucuaaaa

SEQ ID NO: 215340 - RNA, 22 nt, Homo sapiens
ugugaaaucagauagccuuuuu

SEQ ID NO: 215341 - RNA, 22 nt, Homo sapiens
ugugaacacagaggcuauggca

SEQ ID NO: 215342 - RNA, 22 nt, Homo sapiens
ugugaaccucuggccaagauga

SEQ ID NO: 215343 - RNA, 20 nt, Homo sapiens
ugugaacuguagauagucuu

SEQ ID NO: 215344 - RNA, 22 nt, Homo sapiens
ugugaauggugcugccgugaag

SEQ ID NO: 215345 - RNA, 22 nt, Homo sapiens
ugugacaguguuacauuucaug

SEQ ID NO: 215346 - RNA, 18 nt, Homo sapiens
ugugacauugagcauguc

SEQ ID NO: 215347 - RNA, 17 nt, Homo sapiens
ugugacccugggcuacc

SEQ ID NO: 215348 - RNA, 22 nt, Homo sapiens
ugugacucuggcacauggugag

SEQ ID NO: 215349 - RNA, 19 nt, Homo sapiens
ugugagcauuagcauuuag

SEQ ID NO: 215350 - RNA, 22 nt, Homo sapiens
ugugaguguguacuaguuauca

SEQ ID NO: 215351 - RNA, 22 nt, Homo sapiens
ugugaucaauuagugaugucug

SEQ ID NO: 215352 - RNA, 22 nt, Homo sapiens
ugugaugaagaguccaagaaca

SEQ ID NO: 215353 - RNA, 22 nt, Homo sapiens
ugugaugauuugauaaacguau

SEQ ID NO: 215354 - RNA, 22 nt, Homo sapiens
ugugaugguuuagcauuuucuu

SEQ ID NO: 215355 - RNA, 22 nt, Homo sapiens
ugugaugguuuggaagcuucuu

SEQ ID NO: 215356 - RNA, 22 nt, Homo sapiens
ugugauuauuuauagacaguca

SEQ ID NO: 215357 - RNA, 18 nt, Homo sapiens
ugugcaauauuaaccacc

SEQ ID NO: 215358 - RNA, 22 nt, Homo sapiens
ugugcaauucgauggagcucau

SEQ ID NO: 215359 - RNA, 22 nt, Homo sapiens
ugugcacaacaugcagguuugu

SEQ ID NO: 215360 - RNA, 22 nt, Homo sapiens
ugugcaguuuuagcguauuuua

SEQ ID NO: 215361 - RNA, 22 nt, Homo sapiens
ugugcauaugucuuuauaguag

SEQ ID NO: 215362 - RNA, 22 nt, Homo sapiens
ugugccacugcacucccgccug

SEQ ID NO: 215363 - RNA, 22 nt, Homo sapiens
ugugccacugcacuccugggug

SEQ ID NO: 215364 - RNA, 22 nt, Homo sapiens
uguggaaauuguuguauuuaau

SEQ ID NO: 215365 - RNA, 22 nt, Homo sapiens
uguggaguguaugugacagaga

SEQ ID NO: 215366 - RNA, 22 nt, Homo sapiens
uguggcaaagucuugugaauau

SEQ ID NO: 215367 - RNA, 22 nt, Homo sapiens
uguggcacuguguccagagaaa

SEQ ID NO: 215368 - RNA, 22 nt, Homo sapiens
uguggcucuucuguucuccacu

SEQ ID NO: 215369 - RNA, 22 nt, Homo sapiens
uguggcugguggcaccuuuucc

SEQ ID NO: 215370 - RNA, 22 nt, Homo sapiens
ugugguagugcuuaccugcagu

SEQ ID NO: 215371 - RNA, 23 nt, Homo sapiens
ugugguauuauuccauuuauagg

SEQ ID NO: 215372 - RNA, 22 nt, Homo sapiens
uguggucaucacuugaagguaa

SEQ ID NO: 215373 - RNA, 22 nt, Homo sapiens
ugugguuuuauaaacgugaccu

SEQ ID NO: 215374 - RNA, 22 nt, Homo sapiens
ugugguuuuuuucuccaauagg

SEQ ID NO: 215375 - RNA, 22 nt, Homo sapiens
uguguaaauagcuacggaucug

SEQ ID NO: 215376 - RNA, 22 nt, Homo sapiens
uguguacaucucuacacacaug

SEQ ID NO: 215377 - RNA, 22 nt, Homo sapiens
uguguagagaaauauuacuuau

SEQ ID NO: 215378 - RNA, 22 nt, Homo sapiens
ugugucuugcuggugccugcau

SEQ ID NO: 215379 - RNA, 22 nt, Homo sapiens
ugugucuuuuaucacacaaugu

SEQ ID NO: 215380 - RNA, 22 nt, Homo sapiens
uguguuugauaaguccauaguu

SEQ ID NO: 215381 - RNA, 22 nt, Homo sapiens
uguguuuuuauguaaaauggaa

SEQ ID NO: 215382 - RNA, 22 nt, Homo sapiens
uguuaagaugucaauuuuccac

SEQ ID NO: 215383 - RNA, 22 nt, Homo sapiens
uguuacagcagaauugauugca

SEQ ID NO: 215384 - RNA, 22 nt, Homo sapiens
uguuacagcagcacaaaaugga

SEQ ID NO: 215385 - RNA, 22 nt, Homo sapiens
uguuacaguguaggccuugggu

SEQ ID NO: 215386 - RNA, 22 nt, Homo sapiens
uguuagguuggugcaaaaguga

SEQ ID NO: 215387 - RNA, 22 nt, Homo sapiens
uguuaucauuacguucuuaguu

SEQ ID NO: 215388 - RNA, 22 nt, Homo sapiens
uguucacaguguuucuuugaga

SEQ ID NO: 215389 - RNA, 22 nt, Homo sapiens
uguucaugaguucucauuuuua

SEQ ID NO: 215390 - RNA, 22 nt, Homo sapiens
uguugcaccugccuugcuuuag

SEQ ID NO: 215391 - RNA, 19 nt, Homo sapiens
uguugcacuccagcuuggg

SEQ ID NO: 215392 - RNA, 22 nt, Homo sapiens
uguugcacucuagccugggcaa

SEQ ID NO: 215393 - RNA, 22 nt, Homo sapiens
uguugcauuugucaaggucaag

SEQ ID NO: 215394 - RNA, 22 nt, Homo sapiens
uguugccacuguuauuaaccua

SEQ ID NO: 215395 - RNA, 22 nt, Homo sapiens
uguuuugguugucccuggccag

SEQ ID NO: 215396 - RNA, 22 nt, Homo sapiens
uuaaaguauaguuccucugguu

SEQ ID NO: 215397 - RNA, 22 nt, Homo sapiens
uuaaaugucuguagaugugcug

SEQ ID NO: 215398 - RNA, 22 nt, Homo sapiens
uuaacagugucaaucuguagua

SEQ ID NO: 215399 - RNA, 22 nt, Homo sapiens
uuaagaagugauuuuccucauu

SEQ ID NO: 215400 - RNA, 22 nt, Homo sapiens
uuaagagugggaguuggccaca

SEQ ID NO: 215401 - RNA, 22 nt, Homo sapiens
uuaagaugcauuuugaaguuaa

SEQ ID NO: 215402 - RNA, 22 nt, Homo sapiens
uuaagcuaguuuauucaggaaa

SEQ ID NO: 215403 - RNA, 22 nt, Homo sapiens
uuaaggcauucuuugucuucau

SEQ ID NO: 215404 - RNA, 22 nt, Homo sapiens
uuaaggccugaagcucauaaag

SEQ ID NO: 215405 - RNA, 22 nt, Homo sapiens
uuaagggaggagcuucaagaug

SEQ ID NO: 215406 - RNA, 22 nt, Homo sapiens
uuaagguaugugggcauuuugu

SEQ ID NO: 215407 - RNA, 21 nt, Homo sapiens
uuaaguaauuacccaacucuc

SEQ ID NO: 215408 - RNA, 22 nt, Homo sapiens
uuaagugguagguggugcccaa

SEQ ID NO: 215409 - RNA, 19 nt, Homo sapiens
uuaagugugauaucucagu

SEQ ID NO: 215410 - RNA, 22 nt, Homo sapiens
uuaauacucuucuaaguagucc

SEQ ID NO: 215411 - RNA, 22 nt, Homo sapiens
uuaaucacagugucuuccuuca

SEQ ID NO: 215412 - RNA, 22 nt, Homo sapiens
uuaaucaggccguuuccuaaga

SEQ ID NO: 215413 - RNA, 22 nt, Homo sapiens
uuaaucucaggaguuugggacc

SEQ ID NO: 215414 - RNA, 22 nt, Homo sapiens
uuaaugaacuuuauuuuguaga

SEQ ID NO: 215415 - RNA, 22 nt, Homo sapiens
uuaaugcuuuugggauauuucu

SEQ ID NO: 215416 - RNA, 22 nt, Homo sapiens
uuaauggagaguuucauuggug

SEQ ID NO: 215417 - RNA, 22 nt, Homo sapiens
uuaauucugucugcccucaucc

SEQ ID NO: 215418 - RNA, 22 nt, Homo sapiens
uuaauuguaucuauagauguca

SEQ ID NO: 215419 - RNA, 22 nt, Homo sapiens
uuacaccuguaauccagcacuu

SEQ ID NO: 215420 - RNA, 22 nt, Homo sapiens
uuacagauggcacacucaaggg

SEQ ID NO: 215421 - RNA, 22 nt, Homo sapiens
uuacaggacuaagcagcuuugc

SEQ ID NO: 215422 - RNA, 22 nt, Homo sapiens
uuacaguagaugaggguauaau

SEQ ID NO: 215423 - RNA, 22 nt, Homo sapiens
uuacaguauugcaaggacuagg

SEQ ID NO: 215424 - RNA, 22 nt, Homo sapiens
uuacagucaaguuacauuucuc

SEQ ID NO: 215425 - RNA, 20 nt, Homo sapiens
uuacagugggaccuuccuga

SEQ ID NO: 215426 - RNA, 22 nt, Homo sapiens
uuacaguggugaccuuguauug

SEQ ID NO: 215427 - RNA, 19 nt, Homo sapiens
uuacagugugcccuuuuag

SEQ ID NO: 215428 - RNA, 22 nt, Homo sapiens
uuacaguguuuguucuguuacu

SEQ ID NO: 215429 - RNA, 22 nt, Homo sapiens
uuacauguggugugaagaagag

SEQ ID NO: 215430 - RNA, 22 nt, Homo sapiens
uuaccacagugccugucuaaug

SEQ ID NO: 215431 - RNA, 22 nt, Homo sapiens
uagcugaucuuuuaaagaauga

SEQ ID NO: 215432 - RNA, 22 nt, Homo sapiens
uagcugcauccugugcacucaa

SEQ ID NO: 215433 - RNA, 22 nt, Homo sapiens
uagcuggaguuuuuguuauagg

SEQ ID NO: 215434 - RNA, 17 nt, Homo sapiens
uagcuucacauuaggaa

SEQ ID NO: 215435 - RNA, 22 nt, Homo sapiens
uaggaaguuuucuugcugggcc

SEQ ID NO: 215436 - RNA, 22 nt, Homo sapiens
uaggauaguccuccugagaccu

SEQ ID NO: 215437 - RNA, 22 nt, Homo sapiens
uaggcaaaugcaagaguagaac

SEQ ID NO: 215438 - RNA, 22 nt, Homo sapiens
uaggcaauggagauagaggaug

SEQ ID NO: 215439 - RNA, 22 nt, Homo sapiens
uaggcacugagaauaugaggau

SEQ ID NO: 215440 - RNA, 22 nt, Homo sapiens
uaggcagccagcuguggauuga

SEQ ID NO: 215441 - RNA, 22 nt, Homo sapiens
uaggcaguggagaaauaaacag

SEQ ID NO: 215442 - RNA, 22 nt, Homo sapiens
uaggcaguuuuccuuucacagu

SEQ ID NO: 215443 - RNA, 22 nt, Homo sapiens
uagggagugucuucauuuugua

SEQ ID NO: 215444 - RNA, 22 nt, Homo sapiens
uagggcauuuagaggcuauuaa

SEQ ID NO: 215445 - RNA, 22 nt, Homo sapiens
uagggcuuuuccaagcugccac

SEQ ID NO: 215446 - RNA, 22 nt, Homo sapiens
uaggguaguaauaguuguuuca

SEQ ID NO: 215447 - RNA, 22 nt, Homo sapiens
uagguagauuuaaagauuuucu

SEQ ID NO: 215448 - RNA, 22 nt, Homo sapiens
uagguagugugugcaugagagg

SEQ ID NO: 215449 - RNA, 22 nt, Homo sapiens
uagguaguuuucccguauccaa

SEQ ID NO: 215450 - RNA, 22 nt, Homo sapiens
uaggucccguuucagacugaga

SEQ ID NO: 215451 - RNA, 22 nt, Homo sapiens
uaggucuuuuagcauaggagcu

SEQ ID NO: 215452 - RNA, 22 nt, Homo sapiens
uaggucuuuuaugaaauauauu

SEQ ID NO: 215453 - RNA, 22 nt, Homo sapiens
uaggugaaugcuggaagaaaug

SEQ ID NO: 215454 - RNA, 22 nt, Homo sapiens
uaggugauccauuuguauuuua

SEQ ID NO: 215455 - RNA, 22 nt, Homo sapiens
uaggugcacaguaaauauaugu

SEQ ID NO: 215456 - RNA, 19 nt, Homo sapiens
uaggugguuuuccccucac

SEQ ID NO: 215457 - RNA, 22 nt, Homo sapiens
uaguaaacagcucugccacaau

SEQ ID NO: 215458 - RNA, 22 nt, Homo sapiens
uaguagagauggggcacaugcc

SEQ ID NO: 215459 - RNA, 22 nt, Homo sapiens
uaguaggacaggauuucaguua

SEQ ID NO: 215460 - RNA, 22 nt, Homo sapiens
uaguaucacauggucuuaauua

SEQ ID NO: 215461 - RNA, 22 nt, Homo sapiens
uagucacacacucaacuuuuca

SEQ ID NO: 215462 - RNA, 22 nt, Homo sapiens
uagucagcaauguucauguucu

SEQ ID NO: 215463 - RNA, 22 nt, Homo sapiens
uagugcaguggcuccaucucag

SEQ ID NO: 215464 - RNA, 22 nt, Homo sapiens
uaguuauggaguaauuuuaagc

SEQ ID NO: 215465 - RNA, 22 nt, Homo sapiens
uaguugcaucuuaggucuguga

SEQ ID NO: 215466 - RNA, 20 nt, Homo sapiens
uaguuggugauacagugcau

SEQ ID NO: 215467 - RNA, 22 nt, Homo sapiens
uauaacacccacauauagucuu

SEQ ID NO: 215468 - RNA, 22 nt, Homo sapiens
uauacaguaggcacucaguggc

SEQ ID NO: 215469 - RNA, 22 nt, Homo sapiens
uauacugucuuuguaugccuag

SEQ ID NO: 215470 - RNA, 22 nt, Homo sapiens
uauagcaaugugccacucucug

SEQ ID NO: 215471 - RNA, 21 nt, Homo sapiens
uauagcagcacgauuuauaau

SEQ ID NO: 215472 - RNA, 22 nt, Homo sapiens
uauagcagccugaacaaaguaa

SEQ ID NO: 215473 - RNA, 22 nt, Homo sapiens
uauagcuagugauuguguguau

SEQ ID NO: 215474 - RNA, 22 nt, Homo sapiens
uauagcuaugggauguauuugc

SEQ ID NO: 215475 - RNA, 22 nt, Homo sapiens
uauagcuuaaaguuuagauccu

SEQ ID NO: 215476 - RNA, 22 nt, Homo sapiens
uauagcuuuuuagggaauuugg

SEQ ID NO: 215477 - RNA, 22 nt, Homo sapiens
uauaugcacucagguguaugug

SEQ ID NO: 215478 - RNA, 22 nt, Homo sapiens
uauaugcuaaacaagggguggg

SEQ ID NO: 215479 - RNA, 22 nt, Homo sapiens
uauaugcucugggauccugaaa

SEQ ID NO: 215480 - RNA, 22 nt, Homo sapiens
uauauguuuucauaaggcuaga

SEQ ID NO: 215481 - RNA, 22 nt, Homo sapiens
uaucaacaggguggccagugua

SEQ ID NO: 215482 - RNA, 22 nt, Homo sapiens
uaucacaaacuuagcaguuuaa

SEQ ID NO: 215483 - RNA, 22 nt, Homo sapiens
uaucacacgccuugcuucauuu

SEQ ID NO: 215484 - RNA, 22 nt, Homo sapiens
uaucacagcaaggacccauuau

SEQ ID NO: 215485 - RNA, 22 nt, Homo sapiens
uaucacaggucaggaaucuugc

SEQ ID NO: 215486 - RNA, 22 nt, Homo sapiens
uaucacagguggacugcacacc

SEQ ID NO: 215487 - RNA, 22 nt, Homo sapiens
uaucacaguagaacucuuucca

SEQ ID NO: 215488 - RNA, 22 nt, Homo sapiens
uaucacaguugcauauuuaagg

SEQ ID NO: 215489 - RNA, 22 nt, Homo sapiens
uaucacuguuguuuguuuaagg

SEQ ID NO: 215490 - RNA, 21 nt, Homo sapiens
uaucagagacauugagaggca

SEQ ID NO: 215491 - RNA, 22 nt, Homo sapiens
uaucauggaaugagguuggaca

SEQ ID NO: 215492 - RNA, 22 nt, Homo sapiens
uaucaugggggguguacacucc

SEQ ID NO: 215493 - RNA, 22 nt, Homo sapiens
uaucaugucuguguguaccuag

SEQ ID NO: 215494 - RNA, 22 nt, Homo sapiens
uaucauuguguuauuucuucca

SEQ ID NO: 215495 - RNA, 22 nt, Homo sapiens
uaucccaauguaauaucacaaa

SEQ ID NO: 215496 - RNA, 23 nt, Homo sapiens
uaucucaaugcacagagaggaaa

SEQ ID NO: 215497 - RNA, 22 nt, Homo sapiens
uaucucacauauucaguagguu

SEQ ID NO: 215498 - RNA, 22 nt, Homo sapiens
uaucuuggaguuugacaaccaa

SEQ ID NO: 215499 - RNA, 20 nt, Homo sapiens
uaugacaaagccuagugagu

SEQ ID NO: 215500 - RNA, 22 nt, Homo sapiens
uaugacucagaaggcacacaca

SEQ ID NO: 215501 - RNA, 22 nt, Homo sapiens
uaugacuguuugcucauucagg

SEQ ID NO: 215502 - RNA, 22 nt, Homo sapiens
uaugagcacauauguaucuaug

SEQ ID NO: 215503 - RNA, 22 nt, Homo sapiens
uaugaugcuguuuagaaucucu

SEQ ID NO: 215504 - RNA, 22 nt, Homo sapiens
uaugauuuuugggagaggucaa

SEQ ID NO: 215505 - RNA, 22 nt, Homo sapiens
uaugcacacacguguuuaugug

SEQ ID NO: 215506 - RNA, 22 nt, Homo sapiens
uaugcacuaggcacuguguuug

SEQ ID NO: 215507 - RNA, 22 nt, Homo sapiens
uaugcccauuuaaauugaacaa

SEQ ID NO: 215508 - RNA, 22 nt, Homo sapiens
uaugccuuuuggcucaagaaac

SEQ ID NO: 215509 - RNA, 19 nt, Homo sapiens
uaugcuagagagggaagcu

SEQ ID NO: 215510 - RNA, 22 nt, Homo sapiens
uauggaaaucuuaccuuauggu

SEQ ID NO: 215511 - RNA, 22 nt, Homo sapiens
uauggauuugcauuccccaugu

SEQ ID NO: 215512 - RNA, 22 nt, Homo sapiens
uauggauuugccuauucuguau

SEQ ID NO: 215513 - RNA, 22 nt, Homo sapiens
uauggcauuauuuugauagaca

SEQ ID NO: 215514 - RNA, 22 nt, Homo sapiens
uauggccccuacaugugcaaaa

SEQ ID NO: 215515 - RNA, 22 nt, Homo sapiens
uauggcccuuaaguauugguug

SEQ ID NO: 215516 - RNA, 22 nt, Homo sapiens
uauggcuuuguuaacauuuucu

SEQ ID NO: 215517 - RNA, 22 nt, Homo sapiens
uauggcuuuguucaacagccuc

SEQ ID NO: 215518 - RNA, 21 nt, Homo sapiens
uaugguuucuaauucugcagg

SEQ ID NO: 215519 - RNA, 22 nt, Homo sapiens
uaugguuuuaagguuaaggacu

SEQ ID NO: 215520 - RNA, 22 nt, Homo sapiens
uaugguuuuggaauccugcaga

SEQ ID NO: 215521 - RNA, 22 nt, Homo sapiens
uaugucaugggguuuuugagau

SEQ ID NO: 215522 - RNA, 22 nt, Homo sapiens
uaugucuggaguuacugagcug

SEQ ID NO: 215523 - RNA, 22 nt, Homo sapiens
uaugucuuuugcuugcaaauag

SEQ ID NO: 215524 - RNA, 22 nt, Homo sapiens
uauguuaucaaaaagcuaagga

SEQ ID NO: 215525 - RNA, 22 nt, Homo sapiens
uauuagugccuaagucuuaggg

SEQ ID NO: 215526 - RNA, 22 nt, Homo sapiens
uauucacaggugugggacaaag

SEQ ID NO: 215527 - RNA, 22 nt, Homo sapiens
uauuccacuauuaguccagaug

SEQ ID NO: 215528 - RNA, 22 nt, Homo sapiens
uauuccacucuguuggagguaa

SEQ ID NO: 215529 - RNA, 22 nt, Homo sapiens
uauuccauuugggucaggauga

SEQ ID NO: 215530 - RNA, 22 nt, Homo sapiens
uauugauuaauugugauuaggc

SEQ ID NO: 215531 - RNA, 22 nt, Homo sapiens
uauugcaauuggcagagugcua

SEQ ID NO: 215532 - RNA, 21 nt, Homo sapiens
ucucucaaccaggaagugggc

SEQ ID NO: 215533 - RNA, 22 nt, Homo sapiens
ucucugauuauugcauuucauu

SEQ ID NO: 215534 - RNA, 22 nt, Homo sapiens
ucucugguuaugucauuaagca

SEQ ID NO: 215535 - RNA, 22 nt, Homo sapiens
ucucugguuuucaaagcaguau

SEQ ID NO: 215536 - RNA, 22 nt, Homo sapiens
ucucuguuuauuuuugguguau

SEQ ID NO: 215537 - RNA, 22 nt, Homo sapiens
ucugacacagugauuaguaaau

SEQ ID NO: 215538 - RNA, 22 nt, Homo sapiens
ucugacucuggagucucagguu

SEQ ID NO: 215539 - RNA, 22 nt, Homo sapiens
ucugagcaauaaacaacauauu

SEQ ID NO: 215540 - RNA, 22 nt, Homo sapiens
ucugagguaggugcauggauac

SEQ ID NO: 215541 - RNA, 22 nt, Homo sapiens
ucuggagugugaaguggauaug

SEQ ID NO: 215542 - RNA, 22 nt, Homo sapiens
ucuggauuuuugaggcaauaua

SEQ ID NO: 215543 - RNA, 22 nt, Homo sapiens
ucuggcaagauauccauugcuu

SEQ ID NO: 215544 - RNA, 20 nt, Homo sapiens
ucuggccccuccaaaucuca

SEQ ID NO: 215545 - RNA, 21 nt, Homo sapiens
ucuggcuuucauuccccuucu

SEQ ID NO: 215546 - RNA, 23 nt, Homo sapiens
ucuggcuuugggaugcucaaggg

SEQ ID NO: 215547 - RNA, 22 nt, Homo sapiens
ucuggguuuuguaccgugcucg

SEQ ID NO: 215548 - RNA, 22 nt, Homo sapiens
ucugguuccuuggcuucggguc

SEQ ID NO: 215549 - RNA, 22 nt, Homo sapiens
ucuguaguuaacagcuucagcu

SEQ ID NO: 215550 - RNA, 22 nt, Homo sapiens
ucugucacugaaucccugucac

SEQ ID NO: 215551 - RNA, 22 nt, Homo sapiens
ucugugcauggcagaggaauga

SEQ ID NO: 215552 - RNA, 22 nt, Homo sapiens
ucugugcauuguaacaacuaaa

SEQ ID NO: 215553 - RNA, 22 nt, Homo sapiens
ucugugcuugucauaugcuuug

SEQ ID NO: 215554 - RNA, 22 nt, Homo sapiens
ucuguggugggcuccacccagu

SEQ ID NO: 215555 - RNA, 22 nt, Homo sapiens
ucuguugguucuuugaggagga

SEQ ID NO: 215556 - RNA, 22 nt, Homo sapiens
ucuguuguuguuuuaagagaca

SEQ ID NO: 215557 - RNA, 22 nt, Homo sapiens
ucuuaggugaugauugauguga

SEQ ID NO: 215558 - RNA, 22 nt, Homo sapiens
ucuucguuuaaagcaguggaag

SEQ ID NO: 215559 - RNA, 20 nt, Homo sapiens
ucuugaacuuagucaacagg

SEQ ID NO: 215560 - RNA, 22 nt, Homo sapiens
ucuugaacuucauaggucuaga

SEQ ID NO: 215561 - RNA, 22 nt, Homo sapiens
ucuugaacuucugcacacucag

SEQ ID NO: 215562 - RNA, 22 nt, Homo sapiens
ucuuggccaugaauggcaaggc

SEQ ID NO: 215563 - RNA, 20 nt, Homo sapiens
ucuugggaauguagccuagg

SEQ ID NO: 215564 - RNA, 23 nt, Homo sapiens
ucuugguuauagaaaaauaguug

SEQ ID NO: 215565 - RNA, 22 nt, Homo sapiens
ucuugguugaaaauucauaaua

SEQ ID NO: 215566 - RNA, 20 nt, Homo sapiens
ucuugguuggaggucuuuua

SEQ ID NO: 215567 - RNA, 23 nt, Homo sapiens
ucuuguacuuugagugagcaugg

SEQ ID NO: 215568 - RNA, 17 nt, Homo sapiens
ucuugugguucuugaau

SEQ ID NO: 215569 - RNA, 22 nt, Homo sapiens
ucuuuagguguuauaguucaag

SEQ ID NO: 215570 - RNA, 22 nt, Homo sapiens
ucuuuagugacaguugugcaag

SEQ ID NO: 215571 - RNA, 15 nt, Homo sapiens
ucuuuaguuuuucuu

SEQ ID NO: 215572 - RNA, 22 nt, Homo sapiens
ucuuugaguuauugugcagacu

SEQ ID NO: 215573 - RNA, 22 nt, Homo sapiens
ucuuugauguucugaaagaugg

SEQ ID NO: 215574 - RNA, 22 nt, Homo sapiens
ucuuugggauauucugaaaggg

SEQ ID NO: 215575 - RNA, 22 nt, Homo sapiens
ucuuugguauuuguggggaauu

SEQ ID NO: 215576 - RNA, 21 nt, Homo sapiens
ucuuuggucaccaguuuucau

SEQ ID NO: 215577 - RNA, 22 nt, Homo sapiens
ucuuuguuggaguccaaggaua

SEQ ID NO: 215578 - RNA, 22 nt, Homo sapiens
ugaaacacacagagaagggaga

SEQ ID NO: 215579 - RNA, 20 nt, Homo sapiens
ugaaacacauggacuggggu

SEQ ID NO: 215580 - RNA, 22 nt, Homo sapiens
ugaaagcuacaggaaaguauuu

SEQ ID NO: 215581 - RNA, 22 nt, Homo sapiens
ugaaaucauguaguuauugcaa

SEQ ID NO: 215582 - RNA, 22 nt, Homo sapiens
ugaaauggugcggucugcagca

SEQ ID NO: 215583 - RNA, 22 nt, Homo sapiens
ugaacagucaucucucuuguau

SEQ ID NO: 215584 - RNA, 22 nt, Homo sapiens
ugaagacucaauuauuaugaac

SEQ ID NO: 215585 - RNA, 22 nt, Homo sapiens
ugaagagucuaaaucugucuuc

SEQ ID NO: 215586 - RNA, 22 nt, Homo sapiens
ugaaggacauucuaugguagau

SEQ ID NO: 215587 - RNA, 22 nt, Homo sapiens
ugaaggccgggcaugguggcuc

SEQ ID NO: 215588 - RNA, 21 nt, Homo sapiens
ugaaguagcauaggaugucaa

SEQ ID NO: 215589 - RNA, 22 nt, Homo sapiens
ugaagugaagacucacagaagg

SEQ ID NO: 215590 - RNA, 22 nt, Homo sapiens
ugaagugaaugguaaguaugcc

SEQ ID NO: 215591 - RNA, 22 nt, Homo sapiens
ugaauacuucaaaaaaauagcu

SEQ ID NO: 215592 - RNA, 22 nt, Homo sapiens
ugaauacuucguucaaagauaa

SEQ ID NO: 215593 - RNA, 22 nt, Homo sapiens
ugaauagaaguggcaggaguag

SEQ ID NO: 215594 - RNA, 22 nt, Homo sapiens
ugaauagaaguuuacuccuuuu

SEQ ID NO: 215595 - RNA, 22 nt, Homo sapiens
ugaauaguuugacagaacucuu

SEQ ID NO: 215596 - RNA, 22 nt, Homo sapiens
ugaauauagacagggguagaga

SEQ ID NO: 215597 - RNA, 22 nt, Homo sapiens
ugaauauguuaaauaauguucu

SEQ ID NO: 215598 - RNA, 23 nt, Homo sapiens
ugaauguaucgaaugugggaaag

SEQ ID NO: 215599 - RNA, 22 nt, Homo sapiens
ugaauguccauugauguuuuga

SEQ ID NO: 215600 - RNA, 22 nt, Homo sapiens
ugaaugugauggguuucaugug

SEQ ID NO: 215601 - RNA, 22 nt, Homo sapiens
ugaauucaucucacagaguuaa

SEQ ID NO: 215602 - RNA, 22 nt, Homo sapiens
ugaauucuguccaaaauaacug

SEQ ID NO: 215603 - RNA, 22 nt, Homo sapiens
ugacacagugggggauccuuuu

SEQ ID NO: 215604 - RNA, 22 nt, Homo sapiens
ugacacauguagacaucuggug

SEQ ID NO: 215605 - RNA, 23 nt, Homo sapiens
ugacagaccuucuggaagaaguc

SEQ ID NO: 215606 - RNA, 22 nt, Homo sapiens
ugacagaggucuuuuaauagcu

SEQ ID NO: 215607 - RNA, 22 nt, Homo sapiens
ugacagcuguugaggcauuuau

SEQ ID NO: 215608 - RNA, 22 nt, Homo sapiens
ugacaguaaacagucuugauua

SEQ ID NO: 215609 - RNA, 22 nt, Homo sapiens
ugacagugaacagguuaccacu

SEQ ID NO: 215610 - RNA, 23 nt, Homo sapiens
ugacagugcuugaaauugcucuu

SEQ ID NO: 215611 - RNA, 22 nt, Homo sapiens
ugacaguguccuccuccugaga

SEQ ID NO: 215612 - RNA, 20 nt, Homo sapiens
ugacaguuaagggauagaag

SEQ ID NO: 215613 - RNA, 22 nt, Homo sapiens
ugacaugaagaaaaacagauuu

SEQ ID NO: 215614 - RNA, 21 nt, Homo sapiens
ugacauguugguguucugcac

SEQ ID NO: 215615 - RNA, 21 nt, Homo sapiens
ugacauguugguuugcugcac

SEQ ID NO: 215616 - RNA, 19 nt, Homo sapiens
ugaccagggacagaaacca

SEQ ID NO: 215617 - RNA, 22 nt, Homo sapiens
ugaccucugauagcaguaggug

SEQ ID NO: 215618 - RNA, 22 nt, Homo sapiens
ugacuacagauuugcugccaga

SEQ ID NO: 215619 - RNA, 22 nt, Homo sapiens
ugacuagagacagaaacuaaaa

SEQ ID NO: 215620 - RNA, 22 nt, Homo sapiens
ugacuaggaaauuagaacuuuu

SEQ ID NO: 215621 - RNA, 22 nt, Homo sapiens
ugacuauaggauaacaugcauu

SEQ ID NO: 215622 - RNA, 22 nt, Homo sapiens
ugacucagauagguguguauuc

SEQ ID NO: 215623 - RNA, 22 nt, Homo sapiens
ugacucaguuucucagguagua

SEQ ID NO: 215624 - RNA, 22 nt, Homo sapiens
ugacucgaggcgccuccagucc

SEQ ID NO: 215625 - RNA, 23 nt, Homo sapiens
ugacuuaggccucaacuaugacu

SEQ ID NO: 215626 - RNA, 22 nt, Homo sapiens
ugacuucagacugaaaugauuc

SEQ ID NO: 215627 - RNA, 22 nt, Homo sapiens
ugacuugaaguuaccauaugca

SEQ ID NO: 215628 - RNA, 22 nt, Homo sapiens
ugacuugauccauggggcucca

SEQ ID NO: 215629 - RNA, 20 nt, Homo sapiens
ugagaacaugugguauuugg

SEQ ID NO: 215630 - RNA, 22 nt, Homo sapiens
ugagaacauuccucuuccuggc

SEQ ID NO: 215631 - RNA, 22 nt, Homo sapiens
ugagaacucaugggucugcugg

SEQ ID NO: 215632 - RNA, 22 nt, Homo sapiens
ugagaacugccuguauuuaucu

SEQ ID NO: 215633 - RNA, 22 nt, Homo sapiens
ugagaacugguagcacuuguga

SEQ ID NO: 215634 - RNA, 22 nt, Homo sapiens
ggagugucagaaacaguguccu

SEQ ID NO: 215635 - RNA, 22 nt, Homo sapiens
ggagugucugugcuggucaaag

SEQ ID NO: 215636 - RNA, 22 nt, Homo sapiens
ggaguguguuuuccaacuuggu

SEQ ID NO: 215637 - RNA, 22 nt, Homo sapiens
ggaguguuccauuugucacauu

SEQ ID NO: 215638 - RNA, 22 nt, Homo sapiens
ggauaacagccaggucaaacaa

SEQ ID NO: 215639 - RNA, 22 nt, Homo sapiens
ggaugcauuuuugguugucaca

SEQ ID NO: 215640 - RNA, 22 nt, Homo sapiens
ggauugcuuaagaaguuucauu

SEQ ID NO: 215641 - RNA, 22 nt, Homo sapiens
ggcaaaaucgcaauuacuuuug

SEQ ID NO: 215642 - RNA, 22 nt, Homo sapiens
ggcaacaauuccuacuucuuuu

SEQ ID NO: 215643 - RNA, 22 nt, Homo sapiens
ggcaacaugaugaaaugccauc

SEQ ID NO: 215644 - RNA, 22 nt, Homo sapiens
ggcaacaugccgaaaccacguc

SEQ ID NO: 215645 - RNA, 22 nt, Homo sapiens
ggcaagaaaaugcaauuacugu

SEQ ID NO: 215646 - RNA, 21 nt, Homo sapiens
ggcaagaaacacaaucaagua

SEQ ID NO: 215647 - RNA, 22 nt, Homo sapiens
ggcaagaaagaaaucaucuguc

SEQ ID NO: 215648 - RNA, 22 nt, Homo sapiens
ggcaagaaccacaauuacuuuu

SEQ ID NO: 215649 - RNA, 22 nt, Homo sapiens
ggcaagaaccucaauuaccuuu

SEQ ID NO: 215650 - RNA, 22 nt, Homo sapiens
ggcaagaagagaguuuaaacau

SEQ ID NO: 215651 - RNA, 20 nt, Homo sapiens
ggcaagacccaaagugugug

SEQ ID NO: 215652 - RNA, 22 nt, Homo sapiens
ggcaaggauguuuuucuggcaa

SEQ ID NO: 215653 - RNA, 22 nt, Homo sapiens
ggcaaggugaugaaugucuaca

SEQ ID NO: 215654 - RNA, 22 nt, Homo sapiens
ggcaagugggagggaguguuuc

SEQ ID NO: 215655 - RNA, 22 nt, Homo sapiens
ggcacaaugucagcucacugca

SEQ ID NO: 215656 - RNA, 22 nt, Homo sapiens
ggcacaguuaagugcuaccuaa

SEQ ID NO: 215657 - RNA, 22 nt, Homo sapiens
ggcaccauuuuacuccuucccu

SEQ ID NO: 215658 - RNA, 19 nt, Homo sapiens
ggcaccuuuuccaaaaaug

SEQ ID NO: 215659 - RNA, 22 nt, Homo sapiens
ggcacuguugccggccugaauu

SEQ ID NO: 215660 - RNA, 22 nt, Homo sapiens
ggcagaauugcugaggaugcua

SEQ ID NO: 215661 - RNA, 22 nt, Homo sapiens
ggcagagucuugcaucuuuaga

SEQ ID NO: 215662 - RNA, 22 nt, Homo sapiens
ggcagcuguguccuucguaagg

SEQ ID NO: 215663 - RNA, 22 nt, Homo sapiens
ggcagguaaggagugggagccu

SEQ ID NO: 215664 - RNA, 21 nt, Homo sapiens
ggcaugaauggaaaagugaga

SEQ ID NO: 215665 - RNA, 22 nt, Homo sapiens
ggcaugaugcgcacgccuguag

SEQ ID NO: 215666 - RNA, 22 nt, Homo sapiens
ggcauguugauagguagaugua

SEQ ID NO: 215667 - RNA, 22 nt, Homo sapiens
ggcauguuuaguagaauguggu

SEQ ID NO: 215668 - RNA, 22 nt, Homo sapiens
ggcauuguccaauuucugcccu

SEQ ID NO: 215669 - RNA, 22 nt, Homo sapiens
ggccagaugcgguggcucacac

SEQ ID NO: 215670 - RNA, 22 nt, Homo sapiens
ggcuagaauagggauagaccuu

SEQ ID NO: 215671 - RNA, 22 nt, Homo sapiens
ggcuagagaauagugccacuaa

SEQ ID NO: 215672 - RNA, 22 nt, Homo sapiens
ggcucaguugcaaaucaguuca

SEQ ID NO: 215673 - RNA, 22 nt, Homo sapiens
ggcuuuggucacacaggggcaa

SEQ ID NO: 215674 - RNA, 22 nt, Homo sapiens
gggaaaaugucuauugaaugaa

SEQ ID NO: 215675 - RNA, 22 nt, Homo sapiens
gggaaauguaaagucauaagau

SEQ ID NO: 215676 - RNA, 22 nt, Homo sapiens
gggaacaugagaaugugaauga

SEQ ID NO: 215677 - RNA, 22 nt, Homo sapiens
gggaacauggaaauucugcucu

SEQ ID NO: 215678 - RNA, 22 nt, Homo sapiens
gggaagauauaggcugggcacc

SEQ ID NO: 215679 - RNA, 22 nt, Homo sapiens
gggaaugaagagaaccuuccca

SEQ ID NO: 215680 - RNA, 22 nt, Homo sapiens
gggagcaaaaaugaugcccaag

SEQ ID NO: 215681 - RNA, 19 nt, Homo sapiens
gggaggaugcgucuucagg

SEQ ID NO: 215682 - RNA, 22 nt, Homo sapiens
gggagguaggaguuauuauuuu

SEQ ID NO: 215683 - RNA, 22 nt, Homo sapiens
gggaggucauuguaaggucuua

SEQ ID NO: 215684 - RNA, 22 nt, Homo sapiens
gggaguguguaggacccagugu

SEQ ID NO: 215685 - RNA, 22 nt, Homo sapiens
gggaugaagcccuaggguuggu

SEQ ID NO: 215686 - RNA, 22 nt, Homo sapiens
gggaugaaguugauguagaaag

SEQ ID NO: 215687 - RNA, 23 nt, Homo sapiens
gggauuguaaaauaugagggcag

SEQ ID NO: 215688 - RNA, 22 nt, Homo sapiens
gggcaaaacuguacugccaagg

SEQ ID NO: 215689 - RNA, 16 nt, Homo sapiens
gggcaugugaagccua

SEQ ID NO: 215690 - RNA, 22 nt, Homo sapiens
gggcauugugggcagagggcag

SEQ ID NO: 215691 - RNA, 22 nt, Homo sapiens
gggcuagaauccgcgucucuug

SEQ ID NO: 215692 - RNA, 23 nt, Homo sapiens
gggcuagaugagagcuuccuggg

SEQ ID NO: 215693 - RNA, 22 nt, Homo sapiens
ggggaauguuaaagaauuugca

SEQ ID NO: 215694 - RNA, 22 nt, Homo sapiens
ggggcaaaaugccacgagucuc

SEQ ID NO: 215695 - RNA, 15 nt, Homo sapiens
ggguccucucccaaa

SEQ ID NO: 215696 - RNA, 22 nt, Homo sapiens
ggguucccuucuggcucagggu

SEQ ID NO: 215697 - RNA, 22 nt, Homo sapiens
gguauguaggucuacgguacaa

SEQ ID NO: 215698 - RNA, 19 nt, Homo sapiens
ggucacagggguuacaagg

SEQ ID NO: 215699 - RNA, 22 nt, Homo sapiens
ggucacauuggacuaucaaguu

SEQ ID NO: 215700 - RNA, 22 nt, Homo sapiens
ggucagauggcagcugggccug

SEQ ID NO: 215701 - RNA, 22 nt, Homo sapiens
ggucagugcauucuaaaggcaa

SEQ ID NO: 215702 - RNA, 22 nt, Homo sapiens
ggucccccuccacucucgcaaa

SEQ ID NO: 215703 - RNA, 22 nt, Homo sapiens
ggugacugguuuaucuggcagu

SEQ ID NO: 215704 - RNA, 22 nt, Homo sapiens
ggugagcacagaaugcccugag

SEQ ID NO: 215705 - RNA, 22 nt, Homo sapiens
ggugcuugaggaacggaggcug

SEQ ID NO: 215706 - RNA, 20 nt, Homo sapiens
guaaacucucagcauagaug

SEQ ID NO: 215707 - RNA, 22 nt, Homo sapiens
guaaacuuccccucaugaauga

SEQ ID NO: 215708 - RNA, 22 nt, Homo sapiens
guaaagacacaugcacacguau

SEQ ID NO: 215709 - RNA, 22 nt, Homo sapiens
guaaaguaaagcacaucaaggu

SEQ ID NO: 215710 - RNA, 22 nt, Homo sapiens
guaaaucucuguuuucauggac

SEQ ID NO: 215711 - RNA, 18 nt, Homo sapiens
guaaauguaucuauugcc

SEQ ID NO: 215712 - RNA, 22 nt, Homo sapiens
guaaauguccugcuacagagug

SEQ ID NO: 215713 - RNA, 22 nt, Homo sapiens
guaacacucuaaagggaugcac

SEQ ID NO: 215714 - RNA, 22 nt, Homo sapiens
guaacagucucaacaguggucu

SEQ ID NO: 215715 - RNA, 22 nt, Homo sapiens
guaaggaguaguguaacagugc

SEQ ID NO: 215716 - RNA, 22 nt, Homo sapiens
guaaggcuucuggucaacagca

SEQ ID NO: 215717 - RNA, 22 nt, Homo sapiens
guaagugguagagcugggcuau

SEQ ID NO: 215718 - RNA, 23 nt, Homo sapiens
guaauacuagucauaguagcagg

SEQ ID NO: 215719 - RNA, 22 nt, Homo sapiens
guaaucucagcuacuugggagg

SEQ ID NO: 215720 - RNA, 22 nt, Homo sapiens
guaaucucagcuacuugggagu

SEQ ID NO: 215721 - RNA, 22 nt, Homo sapiens
guaaucucagcuucuugggagg

SEQ ID NO: 215722 - RNA, 19 nt, Homo sapiens
guaaugugcuucaguagca

SEQ ID NO: 215723 - RNA, 22 nt, Homo sapiens
guacaaguaagaaaauugccca

SEQ ID NO: 215724 - RNA, 22 nt, Homo sapiens
guacacaacaugcagguuuguu

SEQ ID NO: 215725 - RNA, 17 nt, Homo sapiens
guacacuucuucuguga

SEQ ID NO: 215726 - RNA, 22 nt, Homo sapiens
guacagugcucacaaugagagc

SEQ ID NO: 215727 - RNA, 22 nt, Homo sapiens
guaccugggugacaggauuauu

SEQ ID NO: 215728 - RNA, 22 nt, Homo sapiens
guacucuggaguaggccuaauu

SEQ ID NO: 215729 - RNA, 22 nt, Homo sapiens
guacuuuguuauaacccacagg

SEQ ID NO: 215730 - RNA, 22 nt, Homo sapiens
guagcagcuacuaaguugcugu

SEQ ID NO: 215731 - RNA, 22 nt, Homo sapiens
guagcagucacauagcagauug

SEQ ID NO: 215732 - RNA, 22 nt, Homo sapiens
guaguagcacgagcucugucuc

SEQ ID NO: 215733 - RNA, 22 nt, Homo sapiens
guaguuuaucagaaagaauagg

SEQ ID NO: 215734 - RNA, 22 nt, Homo sapiens
guaugcaagugauaugacauau

SEQ ID NO: 215735 - RNA, 22 nt, Homo sapiens
guauggcacuauccucucugau

SEQ ID NO: 215736 - RNA, 22 nt, Homo sapiens
ugagaacuuauggugauuuuuu

SEQ ID NO: 215737 - RNA, 22 nt, Homo sapiens
ugagaacuuugucuuuuacucu

SEQ ID NO: 215738 - RNA, 22 nt, Homo sapiens
ugagaagacaucagcuuucgga

SEQ ID NO: 215739 - RNA, 22 nt, Homo sapiens
ugagaagcauaccagugucugu

SEQ ID NO: 215740 - RNA, 22 nt, Homo sapiens
ugagaagugacgcagcaggguu

SEQ ID NO: 215741 - RNA, 22 nt, Homo sapiens
ugagaauauuuuccaugucuca

SEQ ID NO: 215742 - RNA, 22 nt, Homo sapiens
ugagaaugaugauugguaaacc

SEQ ID NO: 215743 - RNA, 22 nt, Homo sapiens
ugagaaugcagaaucucgugca

SEQ ID NO: 215744 - RNA, 22 nt, Homo sapiens
ugagacaaaguuguuggauguu

SEQ ID NO: 215745 - RNA, 22 nt, Homo sapiens
ugagaccugaucuugguacugc

SEQ ID NO: 215746 - RNA, 22 nt, Homo sapiens
ugagacgaagucuugcucuguu

SEQ ID NO: 215747 - RNA, 22 nt, Homo sapiens
ugagacugaguuuccaucuugu

SEQ ID NO: 215748 - RNA, 22 nt, Homo sapiens
ugagacugauaggacauuuucu

SEQ ID NO: 215749 - RNA, 22 nt, Homo sapiens
ugagagcuuugaugcacuguuu

SEQ ID NO: 215750 - RNA, 22 nt, Homo sapiens
ugagaguauaaauugaugcagc

SEQ ID NO: 215751 - RNA, 22 nt, Homo sapiens
ugagagucauacaaauaaaaau

SEQ ID NO: 215752 - RNA, 21 nt, Homo sapiens
ugagauaauauguuucugaug

SEQ ID NO: 215753 - RNA, 22 nt, Homo sapiens
ugagauaaucaugugguuuuug

SEQ ID NO: 215754 - RNA, 22 nt, Homo sapiens
ugagauagaaaacauaggagaa

SEQ ID NO: 215755 - RNA, 22 nt, Homo sapiens
ugagauaguuguagauguacau

SEQ ID NO: 215756 - RNA, 22 nt, Homo sapiens
ugagaucaacugagucagagca

SEQ ID NO: 215757 - RNA, 22 nt, Homo sapiens
ugagaucaagauguuagggacu

SEQ ID NO: 215758 - RNA, 22 nt, Homo sapiens
ugagaucacgccacugcacucc

SEQ ID NO: 215759 - RNA, 22 nt, Homo sapiens
ugagaucaguuguuauaauucu

SEQ ID NO: 215760 - RNA, 22 nt, Homo sapiens
ugagaucaugccacugcacuuc

SEQ ID NO: 215761 - RNA, 22 nt, Homo sapiens
ugagaucaugucauuugcacuc

SEQ ID NO: 215762 - RNA, 22 nt, Homo sapiens
ugagaucgagucucgcucuguc

SEQ ID NO: 215763 - RNA, 22 nt, Homo sapiens
ugagaucucauuaugguuuuaa

SEQ ID NO: 215764 - RNA, 22 nt, Homo sapiens
ugagaucuuaccuuccugccuu

SEQ ID NO: 215765 - RNA, 22 nt, Homo sapiens
ugagaugaacuugauuguuuua

SEQ ID NO: 215766 - RNA, 19 nt, Homo sapiens
ugagaugaagacagggguu

SEQ ID NO: 215767 - RNA, 22 nt, Homo sapiens
ugagaugaagucucacucuguc

SEQ ID NO: 215768 - RNA, 22 nt, Homo sapiens
ugagaugagggaagccuaggca

SEQ ID NO: 215769 - RNA, 22 nt, Homo sapiens
ugagaugaggucucacucuguu

SEQ ID NO: 215770 - RNA, 22 nt, Homo sapiens
ugagaugaggucucgcucuguc

SEQ ID NO: 215771 - RNA, 22 nt, Homo sapiens
ugagaugaguucucgcucuguc

SEQ ID NO: 215772 - RNA, 22 nt, Homo sapiens
ugagaugaguugcgcucugucg

SEQ ID NO: 215773 - RNA, 22 nt, Homo sapiens
ugagaugauaucuuauuguaau

SEQ ID NO: 215774 - RNA, 22 nt, Homo sapiens
ugagaugaucaaaguauaggcu

SEQ ID NO: 215775 - RNA, 21 nt, Homo sapiens
ugagaugcaaucaccagggag

SEQ ID NO: 215776 - RNA, 22 nt, Homo sapiens
ugagauggagucuugucgccua

SEQ ID NO: 215777 - RNA, 22 nt, Homo sapiens
ugagauggaguuucacuuuugu

SEQ ID NO: 215778 - RNA, 22 nt, Homo sapiens
ugagauggaucuuggauuugaa

SEQ ID NO: 215779 - RNA, 22 nt, Homo sapiens
ugagauguaaucucgcucuguc

SEQ ID NO: 215780 - RNA, 23 nt, Homo sapiens
ugagaugucugauugcgaggguc

SEQ ID NO: 215781 - RNA, 22 nt, Homo sapiens
ugagaugugaagaucacaugaa

SEQ ID NO: 215782 - RNA, 22 nt, Homo sapiens
ugagauguguccagaucuaguu

SEQ ID NO: 215783 - RNA, 22 nt, Homo sapiens
ugagauguuuguuucagugccu

SEQ ID NO: 215784 - RNA, 21 nt, Homo sapiens
ugagauuaaguuguuuagaag

SEQ ID NO: 215785 - RNA, 23 nt, Homo sapiens
ugagauuacccagaaagaguaua

SEQ ID NO: 215786 - RNA, 22 nt, Homo sapiens
ugagauuacguucggcccacuu

SEQ ID NO: 215787 - RNA, 21 nt, Homo sapiens
ugagauuauauuaacauggua

SEQ ID NO: 215788 - RNA, 19 nt, Homo sapiens
ugagauuguaugaggagau

SEQ ID NO: 215789 - RNA, 22 nt, Homo sapiens
ugagcaagaucuuuauaauuag

SEQ ID NO: 215790 - RNA, 22 nt, Homo sapiens
ugagcaauaaaguuacacaguu

SEQ ID NO: 215791 - RNA, 22 nt, Homo sapiens
ugagcacaggugcgcgguuacu

SEQ ID NO: 215792 - RNA, 22 nt, Homo sapiens
ugagcauuguuuggacuuggau

SEQ ID NO: 215793 - RNA, 23 nt, Homo sapiens
ugagccaugggacuccaagggag

SEQ ID NO: 215794 - RNA, 17 nt, Homo sapiens
ugagcuaugauccuguc

SEQ ID NO: 215795 - RNA, 22 nt, Homo sapiens
ugagcucaguauuucauaaaca

SEQ ID NO: 215796 - RNA, 20 nt, Homo sapiens
ugagcucaugacauuuuucu

SEQ ID NO: 215797 - RNA, 22 nt, Homo sapiens
ugagcugagaaaugcagcagcu

SEQ ID NO: 215798 - RNA, 22 nt, Homo sapiens
ugagcugagaucuuaccacugc

SEQ ID NO: 215799 - RNA, 22 nt, Homo sapiens
ugagcugguacuaauauuauca

SEQ ID NO: 215800 - RNA, 22 nt, Homo sapiens
ugaggaauguguguuaaagaua

SEQ ID NO: 215801 - RNA, 22 nt, Homo sapiens
ugaggagugagaaauugguuuc

SEQ ID NO: 215802 - RNA, 22 nt, Homo sapiens
ugaggcacucccuagcggggug

SEQ ID NO: 215803 - RNA, 22 nt, Homo sapiens
ugaggcaggagaacggcuugaa

SEQ ID NO: 215804 - RNA, 22 nt, Homo sapiens
ugagggaugccugguuuguuuu

SEQ ID NO: 215805 - RNA, 22 nt, Homo sapiens
ugagguaacagaagcgagcauu

SEQ ID NO: 215806 - RNA, 22 nt, Homo sapiens
ugagguagaggugaacuugacc

SEQ ID NO: 215807 - RNA, 22 nt, Homo sapiens
ugagguaggugaagaaugcacg

SEQ ID NO: 215808 - RNA, 20 nt, Homo sapiens
ugaggucaggaguuacagac

SEQ ID NO: 215809 - RNA, 21 nt, Homo sapiens
ugaggucaugaugcugcuucc

SEQ ID NO: 215810 - RNA, 22 nt, Homo sapiens
ugagguguauugggggaaauuc

SEQ ID NO: 215811 - RNA, 22 nt, Homo sapiens
ugagguguuaacuuuacuuuua

SEQ ID NO: 215812 - RNA, 22 nt, Homo sapiens
ugagguguuauccagaguucuu

SEQ ID NO: 215813 - RNA, 22 nt, Homo sapiens
ugagguuggggucagggcuagc

SEQ ID NO: 215814 - RNA, 22 nt, Homo sapiens
ugaguacugauuuaagauacac

SEQ ID NO: 215815 - RNA, 23 nt, Homo sapiens
ugaguaggugguuuuccccucac

SEQ ID NO: 215816 - RNA, 22 nt, Homo sapiens
ugaguaguauucuaugguaugu

SEQ ID NO: 215817 - RNA, 22 nt, Homo sapiens
ugaguagucagugggcaggaag

SEQ ID NO: 215818 - RNA, 22 nt, Homo sapiens
ugaguagugccacaauaagcau

SEQ ID NO: 215819 - RNA, 22 nt, Homo sapiens
ugaguaucuugaugaauuugaa

SEQ ID NO: 215820 - RNA, 22 nt, Homo sapiens
ugagugaaugugaaggcuaggg

SEQ ID NO: 215821 - RNA, 22 nt, Homo sapiens
ugagugugacuuagcagaagga

SEQ ID NO: 215822 - RNA, 22 nt, Homo sapiens
ugaguuaauuuuuguaucaugu

SEQ ID NO: 215823 - RNA, 22 nt, Homo sapiens
ugaguucuuccuaucucugccu

SEQ ID NO: 215824 - RNA, 22 nt, Homo sapiens
ugaguucuuuguagauucugug

SEQ ID NO: 215825 - RNA, 22 nt, Homo sapiens
ugaguucuuuuacauuuugaau

SEQ ID NO: 215826 - RNA, 22 nt, Homo sapiens
ugauaauguuaggcuuuauuca

SEQ ID NO: 215827 - RNA, 22 nt, Homo sapiens
ugauaauuuugucagguuuugg

SEQ ID NO: 215828 - RNA, 22 nt, Homo sapiens
ugauaggucagaugauauugaa

SEQ ID NO: 215829 - RNA, 18 nt, Homo sapiens
ugauaucaaugauagcca

SEQ ID NO: 215830 - RNA, 22 nt, Homo sapiens
ugauauguuagaaucuugcaag

SEQ ID NO: 215831 - RNA, 22 nt, Homo sapiens
ugaucacagcuugacuaaagga

SEQ ID NO: 215832 - RNA, 21 nt, Homo sapiens
ugaucacaugaaaaccaugca

SEQ ID NO: 215833 - RNA, 22 nt, Homo sapiens
ugaucucagcucacugguugaa

SEQ ID NO: 215834 - RNA, 22 nt, Homo sapiens
ugaugaaguauaggaagggcuu

SEQ ID NO: 215835 - RNA, 22 nt, Homo sapiens
ugaugcugaguggcuauuugaa

SEQ ID NO: 215836 - RNA, 22 nt, Homo sapiens
ugauggcauuucauguuuguaa

SEQ ID NO: 215837 - RNA, 23 nt, Homo sapiens
ugauguccacuuagggucuaggu

SEQ ID NO: 215838 - RNA, 21 nt, Homo sapiens
guaugguugaagugacaagcc

SEQ ID NO: 215839 - RNA, 22 nt, Homo sapiens
guaugguugaagugacaagcca

SEQ ID NO: 215840 - RNA, 22 nt, Homo sapiens
guaugguuuauagggaaauugu

SEQ ID NO: 215841 - RNA, 22 nt, Homo sapiens
guauugcuugagcccaggaguu

SEQ ID NO: 215842 - RNA, 22 nt, Homo sapiens
guauuguacuacaagcucuuua

SEQ ID NO: 215843 - RNA, 22 nt, Homo sapiens
guauuugauuauagcaugcuua

SEQ ID NO: 215844 - RNA, 22 nt, Homo sapiens
gucaacauauuaauuauguucu

SEQ ID NO: 215845 - RNA, 22 nt, Homo sapiens
gucaagauuuguaggacagaga

SEQ ID NO: 215846 - RNA, 22 nt, Homo sapiens
gucaaguaaauguuaugguuau

SEQ ID NO: 215847 - RNA, 22 nt, Homo sapiens
gucaaguguuuucaaggcuucc

SEQ ID NO: 215848 - RNA, 22 nt, Homo sapiens
gucaaugcauccaugaauggcu

SEQ ID NO: 215849 - RNA, 22 nt, Homo sapiens
gucacagcuggcauugucugca

SEQ ID NO: 215850 - RNA, 22 nt, Homo sapiens
gucacaggaaacuaauaugcgc

SEQ ID NO: 215851 - RNA, 22 nt, Homo sapiens
gucaccauugagucauuuccuc

SEQ ID NO: 215852 - RNA, 22 nt, Homo sapiens
gucacugggugcugcgccuguc

SEQ ID NO: 215853 - RNA, 22 nt, Homo sapiens
gucaggcaccgauacaguuuuu

SEQ ID NO: 215854 - RNA, 22 nt, Homo sapiens
gucagggagucucuaucagugg

SEQ ID NO: 215855 - RNA, 22 nt, Homo sapiens
gucaggugcuuacgcggagauc

SEQ ID NO: 215856 - RNA, 22 nt, Homo sapiens
gucagugcuuuaguucaggaug

SEQ ID NO: 215857 - RNA, 22 nt, Homo sapiens
gucaguggagaaaaggacaugu

SEQ ID NO: 215858 - RNA, 22 nt, Homo sapiens
gucaguggauacugucucuguc

SEQ ID NO: 215859 - RNA, 22 nt, Homo sapiens
gucauggaaaucuacauuguua

SEQ ID NO: 215860 - RNA, 22 nt, Homo sapiens
gucauggacaaggugugagcca

SEQ ID NO: 215861 - RNA, 22 nt, Homo sapiens
gucauggaggaugaauggccaa

SEQ ID NO: 215862 - RNA, 22 nt, Homo sapiens
gucauggguuaaagguggauac

SEQ ID NO: 215863 - RNA, 22 nt, Homo sapiens
gucauuguguggacauggagaa

SEQ ID NO: 215864 - RNA, 22 nt, Homo sapiens
guccaaagugggagaggugggg

SEQ ID NO: 215865 - RNA, 22 nt, Homo sapiens
guccuggagaagcguggaccgg

SEQ ID NO: 215866 - RNA, 22 nt, Homo sapiens
gucuagaacuucugaccuuagg

SEQ ID NO: 215867 - RNA, 22 nt, Homo sapiens
gucucccagccuacaucuuucu

SEQ ID NO: 215868 - RNA, 22 nt, Homo sapiens
gucuccggcuguccuuugaggu

SEQ ID NO: 215869 - RNA, 22 nt, Homo sapiens
gucucugagaugucaacaccua

SEQ ID NO: 215870 - RNA, 22 nt, Homo sapiens
gucucuugguuuagagcauuua

SEQ ID NO: 215871 - RNA, 22 nt, Homo sapiens
gucucuuguuaucauuucugag

SEQ ID NO: 215872 - RNA, 22 nt, Homo sapiens
gucuggcuccuucuacuacaug

SEQ ID NO: 215873 - RNA, 22 nt, Homo sapiens
gucugguacuuguuuguaaggg

SEQ ID NO: 215874 - RNA, 23 nt, Homo sapiens
gucuggucccugguuggaaacca

SEQ ID NO: 215875 - RNA, 20 nt, Homo sapiens
gucugucuccgaguagaauu

SEQ ID NO: 215876 - RNA, 22 nt, Homo sapiens
gucugucuuuugucuuugaaau

SEQ ID NO: 215877 - RNA, 22 nt, Homo sapiens
gucuugaaggcugaguaccugu

SEQ ID NO: 215878 - RNA, 22 nt, Homo sapiens
gucuuggagacauugccauuga

SEQ ID NO: 215879 - RNA, 20 nt, Homo sapiens
gucuuguagcucaaguuauu

SEQ ID NO: 215880 - RNA, 22 nt, Homo sapiens
gucuuuguuuggucuguaucag

SEQ ID NO: 215881 - RNA, 22 nt, Homo sapiens
gucuuuguuuugauuuaccaga

SEQ ID NO: 215882 - RNA, 22 nt, Homo sapiens
gucuuuugcuagccagagagcu

SEQ ID NO: 215883 - RNA, 17 nt, Homo sapiens
gugaaaucaucauuuuu

SEQ ID NO: 215884 - RNA, 15 nt, Homo sapiens
gugaaauguuucaga

SEQ ID NO: 215885 - RNA, 22 nt, Homo sapiens
gugaacaagcaaaggcaggagg

SEQ ID NO: 215886 - RNA, 22 nt, Homo sapiens
gugaacuguuugaggaagagaa

SEQ ID NO: 215887 - RNA, 22 nt, Homo sapiens
gugaauguaaagucaugugacu

SEQ ID NO: 215888 - RNA, 22 nt, Homo sapiens
gugacugggaguggugaagaua

SEQ ID NO: 215889 - RNA, 18 nt, Homo sapiens
gugagaaugacuguucug

SEQ ID NO: 215890 - RNA, 22 nt, Homo sapiens
gugagcaauugauacuugaagu

SEQ ID NO: 215891 - RNA, 22 nt, Homo sapiens
gugagcauaacaacagaguuua

SEQ ID NO: 215892 - RNA, 22 nt, Homo sapiens
gugagcauucaaggaaggagcu

SEQ ID NO: 215893 - RNA, 22 nt, Homo sapiens
gugagcuauguccugguuuggg

SEQ ID NO: 215894 - RNA, 22 nt, Homo sapiens
gugaggaaggaaaccugcuagc

SEQ ID NO: 215895 - RNA, 22 nt, Homo sapiens
gugaggcacugcugcuuuccag

SEQ ID NO: 215896 - RNA, 22 nt, Homo sapiens
gugagggagcuggaauauuuau

SEQ ID NO: 215897 - RNA, 22 nt, Homo sapiens
gugaggucagggcuguggacag

SEQ ID NO: 215898 - RNA, 22 nt, Homo sapiens
gugagucaaucugagggguuca

SEQ ID NO: 215899 - RNA, 22 nt, Homo sapiens
gugauaucacuguaucacucca

SEQ ID NO: 215900 - RNA, 22 nt, Homo sapiens
gugauauuuagggggccgggau

SEQ ID NO: 215901 - RNA, 22 nt, Homo sapiens
gugauuguuaaacugccucucu

SEQ ID NO: 215902 - RNA, 22 nt, Homo sapiens
gugcaacaucccuccauaauuu

SEQ ID NO: 215903 - RNA, 22 nt, Homo sapiens
gugcacaaucgugcauuccuug

SEQ ID NO: 215904 - RNA, 21 nt, Homo sapiens
gugcacaguaguguuuaauag

SEQ ID NO: 215905 - RNA, 22 nt, Homo sapiens
gugcacauuguuuaugucuguu

SEQ ID NO: 215906 - RNA, 22 nt, Homo sapiens
gugcacuguagaacccuuuguu

SEQ ID NO: 215907 - RNA, 21 nt, Homo sapiens
gugcagacacacauauaggcu

SEQ ID NO: 215908 - RNA, 23 nt, Homo sapiens
gugcaguggcgagauuucggcuc

SEQ ID NO: 215909 - RNA, 22 nt, Homo sapiens
gugcaguuuuaagugaguuucu

SEQ ID NO: 215910 - RNA, 18 nt, Homo sapiens
gugcauagccauggcagc

SEQ ID NO: 215911 - RNA, 22 nt, Homo sapiens
gugcaugucuaugcgagucuaa

SEQ ID NO: 215912 - RNA, 22 nt, Homo sapiens
gugccacaguguuaagggauuc

SEQ ID NO: 215913 - RNA, 22 nt, Homo sapiens
gugccuuuucugagcaaugagc

SEQ ID NO: 215914 - RNA, 22 nt, Homo sapiens
gugcuauguuauccagcaagau

SEQ ID NO: 215915 - RNA, 16 nt, Homo sapiens
gugcuguguuguuagg

SEQ ID NO: 215916 - RNA, 22 nt, Homo sapiens
gugcuuguguuaauauguagcu

SEQ ID NO: 215917 - RNA, 21 nt, Homo sapiens
guggaaauggaauuuacuaau

SEQ ID NO: 215918 - RNA, 22 nt, Homo sapiens
guggaaggucaugaauguucuu

SEQ ID NO: 215919 - RNA, 22 nt, Homo sapiens
guggaaucuagagaggcaguag

SEQ ID NO: 215920 - RNA, 22 nt, Homo sapiens
guggaaugaaaacucucucaca

SEQ ID NO: 215921 - RNA, 22 nt, Homo sapiens
guggaaugauaucucauugugg

SEQ ID NO: 215922 - RNA, 22 nt, Homo sapiens
guggaaugcaguguugauucaa

SEQ ID NO: 215923 - RNA, 22 nt, Homo sapiens
guggacggagguugcagugagc

SEQ ID NO: 215924 - RNA, 22 nt, Homo sapiens
guggagcuguguggccuugggc

SEQ ID NO: 215925 - RNA, 18 nt, Homo sapiens
guggagugucuuccugga

SEQ ID NO: 215926 - RNA, 17 nt, Homo sapiens
guggauagaacaaugaa

SEQ ID NO: 215927 - RNA, 22 nt, Homo sapiens
guggcaagaauguacaaaaggu

SEQ ID NO: 215928 - RNA, 22 nt, Homo sapiens
guggcaagaugacuacucacug

SEQ ID NO: 215929 - RNA, 22 nt, Homo sapiens
guggcaaguguuccaagaggcg

SEQ ID NO: 215930 - RNA, 22 nt, Homo sapiens
guggcacaauuaaguagcuauu

SEQ ID NO: 215931 - RNA, 22 nt, Homo sapiens
guggcagaaaagagaagcaaug

SEQ ID NO: 215932 - RNA, 22 nt, Homo sapiens
guggcagaacagguaggguucu

SEQ ID NO: 215933 - RNA, 22 nt, Homo sapiens
guggcaugaaagcagauaccac

SEQ ID NO: 215934 - RNA, 22 nt, Homo sapiens
guggcauuucccaaaguauucu

SEQ ID NO: 215935 - RNA, 21 nt, Homo sapiens
guggccuuuggagcaugucag

SEQ ID NO: 215936 - RNA, 22 nt, Homo sapiens
guggcuaaagauuuggaaucug

SEQ ID NO: 215937 - RNA, 22 nt, Homo sapiens
guggcuagaaugaagguagcug

SEQ ID NO: 215938 - RNA, 22 nt, Homo sapiens
guggcuauucaccuuuaugaaa

SEQ ID NO: 215939 - RNA, 22 nt, Homo sapiens
guggcuuguaggggucaaggga

SEQ ID NO: 215940 - RNA, 22 nt, Homo sapiens
uaugacuuguuuucuggucugc

SEQ ID NO: 215941 - RNA, 22 nt, Homo sapiens
uaugagagcugguagguagaga

SEQ ID NO: 215942 - RNA, 22 nt, Homo sapiens
uaugcacaugcaugcuugaaua

SEQ ID NO: 215943 - RNA, 22 nt, Homo sapiens
uaugcuuauugucucauccacu

SEQ ID NO: 215944 - RNA, 22 nt, Homo sapiens
uauggcacuaguacuggaaagc

SEQ ID NO: 215945 - RNA, 22 nt, Homo sapiens
uauggccuuuuuaaugauauug

SEQ ID NO: 215946 - RNA, 22 nt, Homo sapiens
uauggcuauggcuguggcuaug

SEQ ID NO: 215947 - RNA, 22 nt, Homo sapiens
uauggcucuauuuccuugucua

SEQ ID NO: 215948 - RNA, 22 nt, Homo sapiens
uauggcugcuuucacacuacaa

SEQ ID NO: 215949 - RNA, 22 nt, Homo sapiens
uauggcugugacuuaucuuguu

SEQ ID NO: 215950 - RNA, 21 nt, Homo sapiens
uauggcuuagucaguguuucc

SEQ ID NO: 215951 - RNA, 22 nt, Homo sapiens
uauggcuucuauaaggaagcuu

SEQ ID NO: 215952 - RNA, 22 nt, Homo sapiens
uauggcuuucuacuugaguucu

SEQ ID NO: 215953 - RNA, 22 nt, Homo sapiens
uauggcuuuucacuuaaguccu

SEQ ID NO: 215954 - RNA, 22 nt, Homo sapiens
uauggguuucagagggugauag

SEQ ID NO: 215955 - RNA, 19 nt, Homo sapiens
uauguaguuuucucaauau

SEQ ID NO: 215956 - RNA, 22 nt, Homo sapiens
uaugucacagguuuuggugaaa

SEQ ID NO: 215957 - RNA, 22 nt, Homo sapiens
uaugucacuggacauaaguucu

SEQ ID NO: 215958 - RNA, 22 nt, Homo sapiens
uauuacacuuuagugucuucca

SEQ ID NO: 215959 - RNA, 22 nt, Homo sapiens
uauuacauccauaggcucugcu

SEQ ID NO: 215960 - RNA, 22 nt, Homo sapiens
uauuacugucaauaucacagaa

SEQ ID NO: 215961 - RNA, 22 nt, Homo sapiens
uauuacuugucugugucucaau

SEQ ID NO: 215962 - RNA, 22 nt, Homo sapiens
uauuagugucuuuugguuagaa

SEQ ID NO: 215963 - RNA, 22 nt, Homo sapiens
uauucaagccaaauucaagcca

SEQ ID NO: 215964 - RNA, 20 nt, Homo sapiens
uauucacucuccagucuugc

SEQ ID NO: 215965 - RNA, 22 nt, Homo sapiens
uauucacuguaucauugauggg

SEQ ID NO: 215966 - RNA, 22 nt, Homo sapiens
uauuccacuuacaugagguauc

SEQ ID NO: 215967 - RNA, 22 nt, Homo sapiens
uauuccauuugugaaaggaagu

SEQ ID NO: 215968 - RNA, 18 nt, Homo sapiens
uauuccucuuccucuauc

SEQ ID NO: 215969 - RNA, 22 nt, Homo sapiens
uauugcaauuggggaaacuggg

SEQ ID NO: 215970 - RNA, 22 nt, Homo sapiens
uauugcacaugaggagacauug

SEQ ID NO: 215971 - RNA, 22 nt, Homo sapiens
uauugcacuccagccuuggcaa

SEQ ID NO: 215972 - RNA, 22 nt, Homo sapiens
uauugcauauuauucuaguggc

SEQ ID NO: 215973 - RNA, 22 nt, Homo sapiens
uauugccugucuccaaaaauca

SEQ ID NO: 215974 - RNA, 22 nt, Homo sapiens
uauugcuccuaauaucacggug

SEQ ID NO: 215975 - RNA, 22 nt, Homo sapiens
uauugcuugaggaaaugguaau

SEQ ID NO: 215976 - RNA, 22 nt, Homo sapiens
uauugcuuuuaacccaaucucu

SEQ ID NO: 215977 - RNA, 22 nt, Homo sapiens
uauugucaccaucccuguuuua

SEQ ID NO: 215978 - RNA, 22 nt, Homo sapiens
uauuugcacucccaucauggug

SEQ ID NO: 215979 - RNA, 22 nt, Homo sapiens
ucaaagacacacaaggagaagg

SEQ ID NO: 215980 - RNA, 20 nt, Homo sapiens
ucaaagacauggcugucaga

SEQ ID NO: 215981 - RNA, 22 nt, Homo sapiens
ucaaaguaaagccucaggaugg

SEQ ID NO: 215982 - RNA, 22 nt, Homo sapiens
ucaaaguagaaaaggggcaauu

SEQ ID NO: 215983 - RNA, 22 nt, Homo sapiens
ucaaagucuucucaaguaacau

SEQ ID NO: 215984 - RNA, 22 nt, Homo sapiens
ucaaagugagcuccuucucacu

SEQ ID NO: 215985 - RNA, 22 nt, Homo sapiens
ucaaaugaucugcccgccuugg

SEQ ID NO: 215986 - RNA, 22 nt, Homo sapiens
ucaaaugcacguagagaaaaua

SEQ ID NO: 215987 - RNA, 17 nt, Homo sapiens
ucaaaugcucccaguga

SEQ ID NO: 215988 - RNA, 22 nt, Homo sapiens
ucaaauguucccuguacuggcc

SEQ ID NO: 215989 - RNA, 22 nt, Homo sapiens
ucaagcaauucuccugccucag

SEQ ID NO: 215990 - RNA, 22 nt, Homo sapiens
ucaaggcacauuugacauuuuc

SEQ ID NO: 215991 - RNA, 22 nt, Homo sapiens
ucaagguacguugccucagauu

SEQ ID NO: 215992 - RNA, 22 nt, Homo sapiens
ucaaguaauacucccaucuugg

SEQ ID NO: 215993 - RNA, 22 nt, Homo sapiens
ucaaguacuuugcauagugccg

SEQ ID NO: 215994 - RNA, 22 nt, Homo sapiens
ucaauguaucuccaagaauuga

SEQ ID NO: 215995 - RNA, 19 nt, Homo sapiens
ucaauucugucaauggcuu

SEQ ID NO: 215996 - RNA, 16 nt, Homo sapiens
ucacaaacucuagcag

SEQ ID NO: 215997 - RNA, 22 nt, Homo sapiens
ucacaaagcuuggccugcuucu

SEQ ID NO: 215998 - RNA, 22 nt, Homo sapiens
ucacagaggagaagaccuuuaa

SEQ ID NO: 215999 - RNA, 22 nt, Homo sapiens
ucacagaugaggcgagaggcag

SEQ ID NO: 216000 - RNA, 18 nt, Homo sapiens
ucacagguaaaguugaca

SEQ ID NO: 216001 - RNA, 22 nt, Homo sapiens
ucacaguauucaugaacaugga

SEQ ID NO: 216002 - RNA, 22 nt, Homo sapiens
ucacagucacugucacguugaa

SEQ ID NO: 216003 - RNA, 22 nt, Homo sapiens
ucacaguccuguuuaggagagg

SEQ ID NO: 216004 - RNA, 22 nt, Homo sapiens
ucacaguguuaaaccuuucuuu

SEQ ID NO: 216005 - RNA, 22 nt, Homo sapiens
ucacauagcugaguaaaaugga

SEQ ID NO: 216006 - RNA, 22 nt, Homo sapiens
ucacauaguuuucgggaccuug

SEQ ID NO: 216007 - RNA, 22 nt, Homo sapiens
ucacaucucagguuucuugaca

SEQ ID NO: 216008 - RNA, 22 nt, Homo sapiens
ucacaugaagauuuuaguauac

SEQ ID NO: 216009 - RNA, 22 nt, Homo sapiens
ucacaugcacaucucuggaacc

SEQ ID NO: 216010 - RNA, 21 nt, Homo sapiens
ucacauggccagaguaggaac

SEQ ID NO: 216011 - RNA, 18 nt, Homo sapiens
ucacauggccgagagaga

SEQ ID NO: 216012 - RNA, 22 nt, Homo sapiens
ucacaugggugcaauauaauca

SEQ ID NO: 216013 - RNA, 22 nt, Homo sapiens
ucaccaccugcugaucauagag

SEQ ID NO: 216014 - RNA, 22 nt, Homo sapiens
ucaccaccuuccaggaccacug

SEQ ID NO: 216015 - RNA, 22 nt, Homo sapiens
auaaaguucugcuggcauauau

SEQ ID NO: 216016 - RNA, 22 nt, Homo sapiens
auaaaugccuguuguuuuaagc

SEQ ID NO: 216017 - RNA, 22 nt, Homo sapiens
auaacagcauuauugcauacgu

SEQ ID NO: 216018 - RNA, 22 nt, Homo sapiens
auaaccuauggaucuacucggg

SEQ ID NO: 216019 - RNA, 22 nt, Homo sapiens
auaagagcaggcuucuggccag

SEQ ID NO: 216020 - RNA, 22 nt, Homo sapiens
auaagaguaguacauaugagac

SEQ ID NO: 216021 - RNA, 22 nt, Homo sapiens
auaagaucauuugcuaagaggg

SEQ ID NO: 216022 - RNA, 22 nt, Homo sapiens
auaagaugaaggaagccauauc

SEQ ID NO: 216023 - RNA, 22 nt, Homo sapiens
auaaggcagcugcuaaaaggca

SEQ ID NO: 216024 - RNA, 22 nt, Homo sapiens
auaagugagugauucaguguua

SEQ ID NO: 216025 - RNA, 22 nt, Homo sapiens
auaauagcugaucauuuagaag

SEQ ID NO: 216026 - RNA, 23 nt, Homo sapiens
auaaugcaaguggugguaaucug

SEQ ID NO: 216027 - RNA, 22 nt, Homo sapiens
auacacauuccugggccucacc

SEQ ID NO: 216028 - RNA, 22 nt, Homo sapiens
auacacguguauauguguaucu

SEQ ID NO: 216029 - RNA, 22 nt, Homo sapiens
auacagguauacaaugcauaau

SEQ ID NO: 216030 - RNA, 22 nt, Homo sapiens
auacaguauggagggcccagcu

SEQ ID NO: 216031 - RNA, 22 nt, Homo sapiens
auacaugcauuugcacgagagu

SEQ ID NO: 216032 - RNA, 22 nt, Homo sapiens
auacaugugccauguucgugug

SEQ ID NO: 216033 - RNA, 22 nt, Homo sapiens
auacaugugucauguugguuug

SEQ ID NO: 216034 - RNA, 22 nt, Homo sapiens
auacuguauaggauuguagccu

SEQ ID NO: 216035 - RNA, 22 nt, Homo sapiens
auacuguuuuacaucauugccu

SEQ ID NO: 216036 - RNA, 22 nt, Homo sapiens
auagaaucaucugugcacuagu

SEQ ID NO: 216037 - RNA, 22 nt, Homo sapiens
auagaauguauuaguaaauuug

SEQ ID NO: 216038 - RNA, 22 nt, Homo sapiens
auagacugaguggcuuaaacca

SEQ ID NO: 216039 - RNA, 22 nt, Homo sapiens
auagaguuagaaagaaauguuu

SEQ ID NO: 216040 - RNA, 22 nt, Homo sapiens
auagcaauuugggaaucagacu

SEQ ID NO: 216041 - RNA, 22 nt, Homo sapiens
auagcacacuauagcuucaaac

SEQ ID NO: 216042 - RNA, 22 nt, Homo sapiens
auagcacauggcauccucucuu

SEQ ID NO: 216043 - RNA, 22 nt, Homo sapiens
auagcacaugugcaaauggcug

SEQ ID NO: 216044 - RNA, 22 nt, Homo sapiens
auagcagaagaagggacaauuc

SEQ ID NO: 216045 - RNA, 22 nt, Homo sapiens
auagcagcagcuaguagugaua

SEQ ID NO: 216046 - RNA, 22 nt, Homo sapiens
auagcagcauauguaauguuga

SEQ ID NO: 216047 - RNA, 22 nt, Homo sapiens
auagcagcucacuuauuuaugg

SEQ ID NO: 216048 - RNA, 22 nt, Homo sapiens
auagcagugugagaaugaacua

SEQ ID NO: 216049 - RNA, 22 nt, Homo sapiens
auagcagugugaggacagacua

SEQ ID NO: 216050 - RNA, 22 nt, Homo sapiens
auaggacuauugugaggauuaa

SEQ ID NO: 216051 - RNA, 22 nt, Homo sapiens
auaggagcagaaaccguauuuu

SEQ ID NO: 216052 - RNA, 22 nt, Homo sapiens
auaggaguacaaacccuauugg

SEQ ID NO: 216053 - RNA, 22 nt, Homo sapiens
auagggcacgagaugugagccu

SEQ ID NO: 216054 - RNA, 21 nt, Homo sapiens
auagggcuuguugauaguuaa

SEQ ID NO: 216055 - RNA, 22 nt, Homo sapiens
auagguagcauagcaggaauau

SEQ ID NO: 216056 - RNA, 22 nt, Homo sapiens
auagguaguuuuucaauccuca

SEQ ID NO: 216057 - RNA, 22 nt, Homo sapiens
auagguauuuuuaaaugacugu

SEQ ID NO: 216058 - RNA, 22 nt, Homo sapiens
auaguagagagggcaaaaugcu

SEQ ID NO: 216059 - RNA, 22 nt, Homo sapiens
auagucaaaucucauuaccccc

SEQ ID NO: 216060 - RNA, 22 nt, Homo sapiens
auagugcuauggcagaccuuga

SEQ ID NO: 216061 - RNA, 22 nt, Homo sapiens
auagugcugcaaaaaacauacg

SEQ ID NO: 216062 - RNA, 22 nt, Homo sapiens
auagugcugcaauaaacacacg

SEQ ID NO: 216063 - RNA, 22 nt, Homo sapiens
auagugcugcaaucaacauaca

SEQ ID NO: 216064 - RNA, 22 nt, Homo sapiens
auagugcugcacuaaacauaca

SEQ ID NO: 216065 - RNA, 22 nt, Homo sapiens
auagugcugccauaaacauacg

SEQ ID NO: 216066 - RNA, 22 nt, Homo sapiens
auauaccuaggcuacaugguuu

SEQ ID NO: 216067 - RNA, 22 nt, Homo sapiens
auaucaacaucgugucauuagu

SEQ ID NO: 216068 - RNA, 22 nt, Homo sapiens
auaucaaggccauuuucuaaau

SEQ ID NO: 216069 - RNA, 22 nt, Homo sapiens
auaucacucccaauaucgcagg

SEQ ID NO: 216070 - RNA, 17 nt, Homo sapiens
auaugaauuuuggagau

SEQ ID NO: 216071 - RNA, 22 nt, Homo sapiens
auaugacuuuccucuacuuccu

SEQ ID NO: 216072 - RNA, 22 nt, Homo sapiens
auaugcauacauguaugcagga

SEQ ID NO: 216073 - RNA, 22 nt, Homo sapiens
auauggcuuuuauuauguugag

SEQ ID NO: 216074 - RNA, 22 nt, Homo sapiens
auauguaguauggaaacauugu

SEQ ID NO: 216075 - RNA, 21 nt, Homo sapiens
auaugugcuguggaagucagc

SEQ ID NO: 216076 - RNA, 22 nt, Homo sapiens
auauucaagugaggauggcuaa

SEQ ID NO: 216077 - RNA, 22 nt, Homo sapiens
auauugacuuucucuuagauca

SEQ ID NO: 216078 - RNA, 18 nt, Homo sapiens
auauugcauuggauggau

SEQ ID NO: 216079 - RNA, 18 nt, Homo sapiens
auauugccuucagacuag

SEQ ID NO: 216080 - RNA, 22 nt, Homo sapiens
auauugcuuagugaugaagucu

SEQ ID NO: 216081 - RNA, 22 nt, Homo sapiens
auauuggacugugcuaguuaga

SEQ ID NO: 216082 - RNA, 22 nt, Homo sapiens
auauuguuggcugcuggcugau

SEQ ID NO: 216083 - RNA, 20 nt, Homo sapiens
aucaaagacuuagaggggga

SEQ ID NO: 216084 - RNA, 22 nt, Homo sapiens
aucaaaucuccagaaccugucu

SEQ ID NO: 216085 - RNA, 22 nt, Homo sapiens
aucaaaugcuggcagagugccu

SEQ ID NO: 216086 - RNA, 22 nt, Homo sapiens
aucaaauugucauuuuaaggau

SEQ ID NO: 216087 - RNA, 22 nt, Homo sapiens
aucaagcuggcauauguaguuc

SEQ ID NO: 216088 - RNA, 22 nt, Homo sapiens
aucacagagucacgggcaacuu

SEQ ID NO: 216089 - RNA, 22 nt, Homo sapiens
aucacagugaaaacagucaauu

SEQ ID NO: 216090 - RNA, 22 nt, Homo sapiens
aucacaguggucagguauagau

SEQ ID NO: 216091 - RNA, 22 nt, Homo sapiens
aucacauggccuagccuaaccu

SEQ ID NO: 216092 - RNA, 22 nt, Homo sapiens
aucaccauguguacauuagacc

SEQ ID NO: 216093 - RNA, 21 nt, Homo sapiens
aucaccgugcaguucuccagg

SEQ ID NO: 216094 - RNA, 20 nt, Homo sapiens
aucacuggagaaggaaaccu

SEQ ID NO: 216095 - RNA, 22 nt, Homo sapiens
aucacuguuuugaugcucggac

SEQ ID NO: 216096 - RNA, 20 nt, Homo sapiens
aucagagccggugaaagggc

SEQ ID NO: 216097 - RNA, 22 nt, Homo sapiens
aucagcagcaugaaaacggacu

SEQ ID NO: 216098 - RNA, 22 nt, Homo sapiens
aucaggcacacauuggaguuug

SEQ ID NO: 216099 - RNA, 18 nt, Homo sapiens
aucagggugaagagagga

SEQ ID NO: 216100 - RNA, 22 nt, Homo sapiens
aucauauccuagauauaacuuc

SEQ ID NO: 216101 - RNA, 21 nt, Homo sapiens
aucauaugcucacuccuagaa

SEQ ID NO: 216102 - RNA, 22 nt, Homo sapiens
aucauguaguaagacacauuua

SEQ ID NO: 216103 - RNA, 22 nt, Homo sapiens
auccaagagacugaugacuucc

SEQ ID NO: 216104 - RNA, 23 nt, Homo sapiens
auccacauucuaguccuuuaugc

SEQ ID NO: 216105 - RNA, 22 nt, Homo sapiens
auccauguggauaaauguguau

SEQ ID NO: 216106 - RNA, 22 nt, Homo sapiens
auccccuugcagugaccggggc

SEQ ID NO: 216107 - RNA, 22 nt, Homo sapiens
aucccugaggaauuucugcacu

SEQ ID NO: 216108 - RNA, 22 nt, Homo sapiens
aucccuguaguaauauucuagc

SEQ ID NO: 216109 - RNA, 22 nt, Homo sapiens
auccuacaguccauucuuugug

SEQ ID NO: 216110 - RNA, 22 nt, Homo sapiens
auccuagguuagagaacaaaac

SEQ ID NO: 216111 - RNA, 22 nt, Homo sapiens
auccuugagaaaauaaaugacc

SEQ ID NO: 216112 - RNA, 22 nt, Homo sapiens
aucuacuugcugggucucugga

SEQ ID NO: 216113 - RNA, 22 nt, Homo sapiens
aucuagagaggcagucuggccg

SEQ ID NO: 216114 - RNA, 22 nt, Homo sapiens
aucucagagaaaauuacuaaga

SEQ ID NO: 216115 - RNA, 22 nt, Homo sapiens
aucucauggagguagagaguaa

SEQ ID NO: 216116 - RNA, 22 nt, Homo sapiens
aucugacuuuuaauuugaaaac

SEQ ID NO: 216117 - RNA, 21 nt, Homo sapiens
uuauaguggcaugauuuauaa

SEQ ID NO: 216118 - RNA, 22 nt, Homo sapiens
uuauauguuagacauggugggu

SEQ ID NO: 216119 - RNA, 22 nt, Homo sapiens
uuauauguuuguacuuaggccu

SEQ ID NO: 216120 - RNA, 22 nt, Homo sapiens
uuaucaaacccuaggagguggu

SEQ ID NO: 216121 - RNA, 21 nt, Homo sapiens
uuaucccagugucucugcagg

SEQ ID NO: 216122 - RNA, 22 nt, Homo sapiens
uuaugacauugacaguuuuuag

SEQ ID NO: 216123 - RNA, 22 nt, Homo sapiens
uuaugcagcaaagugcuugaaa

SEQ ID NO: 216124 - RNA, 22 nt, Homo sapiens
uuaugcuuauugguguacggua

SEQ ID NO: 216125 - RNA, 23 nt, Homo sapiens
uuauggcuuuuauuauguugagg

SEQ ID NO: 216126 - RNA, 22 nt, Homo sapiens
uuaugguuuuuagcagaguaau

SEQ ID NO: 216127 - RNA, 22 nt, Homo sapiens
uuauguaaaucaaucuggaauc

SEQ ID NO: 216128 - RNA, 22 nt, Homo sapiens
uuauguccuuuaacuucaucac

SEQ ID NO: 216129 - RNA, 20 nt, Homo sapiens
uuaugucguuucuugcuuau

SEQ ID NO: 216130 - RNA, 22 nt, Homo sapiens
uuauuacuccuauuuuguagau

SEQ ID NO: 216131 - RNA, 16 nt, Homo sapiens
uuauugcauucuucuc

SEQ ID NO: 216132 - RNA, 22 nt, Homo sapiens
cucugauggagauauacaagga

SEQ ID NO: 216133 - RNA, 21 nt, Homo sapiens
cucugguuugcauuggauuau

SEQ ID NO: 216134 - RNA, 22 nt, Homo sapiens
cucugguuuuucuuccauuaag

SEQ ID NO: 216135 - RNA, 22 nt, Homo sapiens
cucuuacaguguguggugaaag

SEQ ID NO: 216136 - RNA, 22 nt, Homo sapiens
cucuuggguagauuuugcagag

SEQ ID NO: 216137 - RNA, 22 nt, Homo sapiens
cucuuugaguuccuccuggugu

SEQ ID NO: 216138 - RNA, 19 nt, Homo sapiens
cucuuuggugucucuucuu

SEQ ID NO: 216139 - RNA, 22 nt, Homo sapiens
cugaaaagcaucugcauagcug

SEQ ID NO: 216140 - RNA, 22 nt, Homo sapiens
cugaaaugaauuauuuucuuuc

SEQ ID NO: 216141 - RNA, 22 nt, Homo sapiens
cugaauagucaacgauggacug

SEQ ID NO: 216142 - RNA, 22 nt, Homo sapiens
cugaauguuuucuucuauucug

SEQ ID NO: 216143 - RNA, 22 nt, Homo sapiens
cugacaagauucaucacucagu

SEQ ID NO: 216144 - RNA, 22 nt, Homo sapiens
cugagacacucuuaucugcaua

SEQ ID NO: 216145 - RNA, 22 nt, Homo sapiens
cugagagaggagcuaaaacugc

SEQ ID NO: 216146 - RNA, 22 nt, Homo sapiens
cugagaguugaugaaauauggu

SEQ ID NO: 216147 - RNA, 22 nt, Homo sapiens
cugagaucaugggucagguggu

SEQ ID NO: 216148 - RNA, 22 nt, Homo sapiens
cugagauuuuuagauccuggcg

SEQ ID NO: 216149 - RNA, 22 nt, Homo sapiens
cugagcaaagaagugauaauga

SEQ ID NO: 216150 - RNA, 22 nt, Homo sapiens
cugagcaauauagugagaucuu

SEQ ID NO: 216151 - RNA, 22 nt, Homo sapiens
cugagcaucauggcagaaucuu

SEQ ID NO: 216152 - RNA, 22 nt, Homo sapiens
cugaggaaguucuuuaacaguu

SEQ ID NO: 216153 - RNA, 22 nt, Homo sapiens
cugaggacaucagggaagcauc

SEQ ID NO: 216154 - RNA, 22 nt, Homo sapiens
cugaggguagaaggaucacuug

SEQ ID NO: 216155 - RNA, 22 nt, Homo sapiens
cugagguauuuaggugaaagaa

SEQ ID NO: 216156 - RNA, 22 nt, Homo sapiens
cugaggucugaauccagguauc

SEQ ID NO: 216157 - RNA, 22 nt, Homo sapiens
cugaggugggaggauuacuuga

SEQ ID NO: 216158 - RNA, 22 nt, Homo sapiens
cugaggugggaggauuggcuug

SEQ ID NO: 216159 - RNA, 22 nt, Homo sapiens
cugauaaguuuuucuuuauaag

SEQ ID NO: 216160 - RNA, 22 nt, Homo sapiens
cugauacugagaccuuggguua

SEQ ID NO: 216161 - RNA, 22 nt, Homo sapiens
cugauaugaugggugauuuuca

SEQ ID NO: 216162 - RNA, 22 nt, Homo sapiens
cugauugugcagagguguaauu

SEQ ID NO: 216163 - RNA, 22 nt, Homo sapiens
cugauuuguccccagccucaug

SEQ ID NO: 216164 - RNA, 20 nt, Homo sapiens
cugcaaaugcugcugcugau

SEQ ID NO: 216165 - RNA, 22 nt, Homo sapiens
cugcagucaucugaagauuuug

SEQ ID NO: 216166 - RNA, 21 nt, Homo sapiens
cugcauccauuucugagugau

SEQ ID NO: 216167 - RNA, 19 nt, Homo sapiens
cugcaugagacaguugguu

SEQ ID NO: 216168 - RNA, 22 nt, Homo sapiens
cugcauuagucuguuuaguguu

SEQ ID NO: 216169 - RNA, 22 nt, Homo sapiens
cugcccuuucuauaugauguaa

SEQ ID NO: 216170 - RNA, 22 nt, Homo sapiens
cugccugagaaaauggagggca

SEQ ID NO: 216171 - RNA, 22 nt, Homo sapiens
cugcuggucuuuaaggucuagg

SEQ ID NO: 216172 - RNA, 22 nt, Homo sapiens
cuggaaacaucuuaggaaugca

SEQ ID NO: 216173 - RNA, 22 nt, Homo sapiens
cuggaaagaaucaggcuaaacu

SEQ ID NO: 216174 - RNA, 22 nt, Homo sapiens
cuggagucugacugacacaagg

SEQ ID NO: 216175 - RNA, 22 nt, Homo sapiens
cuggauauuaacauugaugaaa

SEQ ID NO: 216176 - RNA, 22 nt, Homo sapiens
cuggcaaauaguagagccagga

SEQ ID NO: 216177 - RNA, 22 nt, Homo sapiens
cuggcaccauuuugaucaaagg

SEQ ID NO: 216178 - RNA, 22 nt, Homo sapiens
cuggcagugcuuguuauccugg

SEQ ID NO: 216179 - RNA, 22 nt, Homo sapiens
cuggccagagacauucauuaaa

SEQ ID NO: 216180 - RNA, 22 nt, Homo sapiens
cuggcccaguucugcguuuugc

SEQ ID NO: 216181 - RNA, 22 nt, Homo sapiens
cugggcaaugcggcuggauaga

SEQ ID NO: 216182 - RNA, 22 nt, Homo sapiens
cugggguaggacuggcuuuuga

SEQ ID NO: 216183 - RNA, 22 nt, Homo sapiens
cugggucaguuucugauuauug

SEQ ID NO: 216184 - RNA, 22 nt, Homo sapiens
cuguaaaguucucauuguagcc

SEQ ID NO: 216185 - RNA, 22 nt, Homo sapiens
cuguauguuucuaugaauguga

SEQ ID NO: 216186 - RNA, 22 nt, Homo sapiens
cugucuagagggcacaugaugc

SEQ ID NO: 216187 - RNA, 22 nt, Homo sapiens
cugugauagguuagucaugaau

SEQ ID NO: 216188 - RNA, 17 nt, Homo sapiens
cugugaugaucuugucu

SEQ ID NO: 216189 - RNA, 22 nt, Homo sapiens
cugugcaaguuauaggccaggu

SEQ ID NO: 216190 - RNA, 22 nt, Homo sapiens
cugugcaugcgcggagcugaaa

SEQ ID NO: 216191 - RNA, 22 nt, Homo sapiens
cugugcauguuguccaauucuu

SEQ ID NO: 216192 - RNA, 22 nt, Homo sapiens
cugugccaagcuugcgaugugc

SEQ ID NO: 216193 - RNA, 22 nt, Homo sapiens
cugugcuugagagaugacacag

SEQ ID NO: 216194 - RNA, 23 nt, Homo sapiens
cuguggauaugaguuguaaaugg

SEQ ID NO: 216195 - RNA, 22 nt, Homo sapiens
cuguggauguauugcacagucu

SEQ ID NO: 216196 - RNA, 23 nt, Homo sapiens
cuguggugaggcccuagaaucug

SEQ ID NO: 216197 - RNA, 22 nt, Homo sapiens
cuguucaaauuguuugugaagu

SEQ ID NO: 216198 - RNA, 22 nt, Homo sapiens
cuguugguuaaauuccaugcag

SEQ ID NO: 216199 - RNA, 22 nt, Homo sapiens
cuguuugaggguuugcuuucag

SEQ ID NO: 216200 - RNA, 22 nt, Homo sapiens
cuguuugauuaagugguggaaa

SEQ ID NO: 216201 - RNA, 22 nt, Homo sapiens
cuuagguaggugccagguuuuu

SEQ ID NO: 216202 - RNA, 22 nt, Homo sapiens
cuucacuuuguuaaacuccaau

SEQ ID NO: 216203 - RNA, 22 nt, Homo sapiens
cuucaguucuguaaggacagca

SEQ ID NO: 216204 - RNA, 22 nt, Homo sapiens
cuuccaaguggggcacgugcca

SEQ ID NO: 216205 - RNA, 22 nt, Homo sapiens
cuuccaguggcagccgggcaug

SEQ ID NO: 216206 - RNA, 22 nt, Homo sapiens
cuucggugaguagauggguuaa

SEQ ID NO: 216207 - RNA, 22 nt, Homo sapiens
cuugacaaugcuucaggcugaa

SEQ ID NO: 216208 - RNA, 22 nt, Homo sapiens
cuugacacugucacucaggcca

SEQ ID NO: 216209 - RNA, 23 nt, Homo sapiens
cuugagacaaaugcgugugugca

SEQ ID NO: 216210 - RNA, 22 nt, Homo sapiens
cuugagacauuguuuuccaagu

SEQ ID NO: 216211 - RNA, 22 nt, Homo sapiens
cuugauagugguaaucauuuuu

SEQ ID NO: 216212 - RNA, 22 nt, Homo sapiens
cuugcacuagugcagaggcgcu

SEQ ID NO: 216213 - RNA, 22 nt, Homo sapiens
cuugcacuccacuguucuccug

SEQ ID NO: 216214 - RNA, 22 nt, Homo sapiens
cuugcacuugaaauuccaguuu

SEQ ID NO: 216215 - RNA, 22 nt, Homo sapiens
cuugcauuuuggagaaugcuga

SEQ ID NO: 216216 - RNA, 19 nt, Homo sapiens
cuugccccauucauccucu

SEQ ID NO: 216217 - RNA, 22 nt, Homo sapiens
cuuggcacucuguggaguuagg

SEQ ID NO: 216218 - RNA, 18 nt, Homo sapiens
cuuggcgaugccaacaua

SEQ ID NO: 216219 - RNA, 22 nt, Homo sapiens
aucacaggcaaaauuccuucuc

SEQ ID NO: 216220 - RNA, 22 nt, Homo sapiens
aucacagguacuauggcugaca

SEQ ID NO: 216221 - RNA, 22 nt, Homo sapiens
aucacagugagcauaugucuau

SEQ ID NO: 216222 - RNA, 22 nt, Homo sapiens
aucacaguggcucacaagagcc

SEQ ID NO: 216223 - RNA, 22 nt, Homo sapiens
aucacauuuauaguggcacgca

SEQ ID NO: 216224 - RNA, 22 nt, Homo sapiens
aucacugggagcagccauuaau

SEQ ID NO: 216225 - RNA, 22 nt, Homo sapiens
aucacugggauggaacugcuga

SEQ ID NO: 216226 - RNA, 22 nt, Homo sapiens
aucacugggcaagauaucauga

SEQ ID NO: 216227 - RNA, 22 nt, Homo sapiens
aucacugugauuucuacugugc

SEQ ID NO: 216228 - RNA, 20 nt, Homo sapiens
aucagagacuaggauugcca

SEQ ID NO: 216229 - RNA, 22 nt, Homo sapiens
aucagagccugugugcccugaa

SEQ ID NO: 216230 - RNA, 22 nt, Homo sapiens
aucagagugaauaaugacaaaa

SEQ ID NO: 216231 - RNA, 22 nt, Homo sapiens
aucagcacugaucauacagcuu

SEQ ID NO: 216232 - RNA, 22 nt, Homo sapiens
aucagcaguguaaaaacggacu

SEQ ID NO: 216233 - RNA, 23 nt, Homo sapiens
aucagguuguagaauguguuugc

SEQ ID NO: 216234 - RNA, 22 nt, Homo sapiens
gaguaaaugucacuguugcugu

SEQ ID NO: 216235 - RNA, 22 nt, Homo sapiens
gaguaacagcauaaauuuguga

SEQ ID NO: 216236 - RNA, 22 nt, Homo sapiens
gaguaucuuuaaggugguuugg

SEQ ID NO: 216237 - RNA, 22 nt, Homo sapiens
gagugcaauggcgcgaucucgg

SEQ ID NO: 216238 - RNA, 22 nt, Homo sapiens
gagugguucuauauguaauugg

SEQ ID NO: 216239 - RNA, 22 nt, Homo sapiens
gaguuacauuguaauugccgag

SEQ ID NO: 216240 - RNA, 22 nt, Homo sapiens
gaguucaauuuccagcuguucu

SEQ ID NO: 216241 - RNA, 19 nt, Homo sapiens
gaguugggguuuacuguaa

SEQ ID NO: 216242 - RNA, 21 nt, Homo sapiens
gauaaguuggcagccagcacc

SEQ ID NO: 216243 - RNA, 22 nt, Homo sapiens
gauacuguauccuaaaagcuuu

SEQ ID NO: 216244 - RNA, 22 nt, Homo sapiens
gauaguugugagaacucuuacu

SEQ ID NO: 216245 - RNA, 21 nt, Homo sapiens
gauaucuuuauucccaagagc

SEQ ID NO: 216246 - RNA, 22 nt, Homo sapiens
gauauguaaaaauuauaucuga

SEQ ID NO: 216247 - RNA, 22 nt, Homo sapiens
gauauguaguaguugaaaaaga

SEQ ID NO: 216248 - RNA, 22 nt, Homo sapiens
gauauguguuuuagucaggguu

SEQ ID NO: 216249 - RNA, 22 nt, Homo sapiens
gauauguuucuucaauaccuag

SEQ ID NO: 216250 - RNA, 22 nt, Homo sapiens
gaucaauuggcugaagacacgu

SEQ ID NO: 216251 - RNA, 22 nt, Homo sapiens
gaucacauguguacucaaugug

SEQ ID NO: 216252 - RNA, 22 nt, Homo sapiens
gaucacauuguuucauacauau

SEQ ID NO: 216253 - RNA, 22 nt, Homo sapiens
gaucacuuugaugccaggaacu

SEQ ID NO: 216254 - RNA, 22 nt, Homo sapiens
gaucucaguggauacugugaug

SEQ ID NO: 216255 - RNA, 22 nt, Homo sapiens
gaucugagaaagugucauaaca

SEQ ID NO: 216256 - RNA, 22 nt, Homo sapiens
gaucuguguuuguaugcauaag

SEQ ID NO: 216257 - RNA, 22 nt, Homo sapiens
gaucuguuguuuggaaguauca

SEQ ID NO: 216258 - RNA, 22 nt, Homo sapiens
gaugacacugggucaaaucuca

SEQ ID NO: 216259 - RNA, 22 nt, Homo sapiens
gaugacagcugacucccuugcu

SEQ ID NO: 216260 - RNA, 22 nt, Homo sapiens
gauggaauuaaaaucagaauca

SEQ ID NO: 216261 - RNA, 22 nt, Homo sapiens
gauggaguaauguaaucuugag

SEQ ID NO: 216262 - RNA, 22 nt, Homo sapiens
gauggaguugucgccugggcug

SEQ ID NO: 216263 - RNA, 22 nt, Homo sapiens
gauggcacuuaagagcaagagc

SEQ ID NO: 216264 - RNA, 22 nt, Homo sapiens
gauggcagugcagccccuggcu

SEQ ID NO: 216265 - RNA, 22 nt, Homo sapiens
gauggcaucugagaguguuaga

SEQ ID NO: 216266 - RNA, 22 nt, Homo sapiens
gauggcaugugcugccaccaag

SEQ ID NO: 216267 - RNA, 22 nt, Homo sapiens
gauggcauuucuggaucugaca

SEQ ID NO: 216268 - RNA, 22 nt, Homo sapiens
gaugguggucuacccuuucccu

SEQ ID NO: 216269 - RNA, 20 nt, Homo sapiens
gauuagagagaggcugugca

SEQ ID NO: 216270 - RNA, 22 nt, Homo sapiens
gauuagcacuucaguuacagua

SEQ ID NO: 216271 - RNA, 22 nt, Homo sapiens
gauuagugacguugagcacugu

SEQ ID NO: 216272 - RNA, 22 nt, Homo sapiens
gauuccauugcgaauuuucaga

SEQ ID NO: 216273 - RNA, 22 nt, Homo sapiens
gauuucacuuucuggaugugca

SEQ ID NO: 216274 - RNA, 22 nt, Homo sapiens
gauuuguauuaaaagugugacg

SEQ ID NO: 216275 - RNA, 22 nt, Homo sapiens
gauuuuuggggaagccucuuau

SEQ ID NO: 216276 - RNA, 21 nt, Homo sapiens
gcaaaggaauugccuaagcuu

SEQ ID NO: 216277 - RNA, 22 nt, Homo sapiens
gcaaaguaauuguuguuuuugc

SEQ ID NO: 216278 - RNA, 22 nt, Homo sapiens
gcaagauuguguggcugaagua

SEQ ID NO: 216279 - RNA, 22 nt, Homo sapiens
gcaauacugacagcauuaguuu

SEQ ID NO: 216280 - RNA, 22 nt, Homo sapiens
gcaauggaaucccuugaucaau

SEQ ID NO: 216281 - RNA, 22 nt, Homo sapiens
gcacacguagaagcaugcauca

SEQ ID NO: 216282 - RNA, 22 nt, Homo sapiens
gcacaguggcucccgucuauaa

SEQ ID NO: 216283 - RNA, 22 nt, Homo sapiens
gcacaguuaaagggucauguga

SEQ ID NO: 216284 - RNA, 22 nt, Homo sapiens
gcacauauguaaauagcugccu

SEQ ID NO: 216285 - RNA, 22 nt, Homo sapiens
gcacugggccacauuuauuuuc

SEQ ID NO: 216286 - RNA, 22 nt, Homo sapiens
gcagaguauagagggcugggcc

SEQ ID NO: 216287 - RNA, 22 nt, Homo sapiens
gcagaucucuucauuucucuua

SEQ ID NO: 216288 - RNA, 22 nt, Homo sapiens
gcagcacaugacuguauguaua

SEQ ID NO: 216289 - RNA, 22 nt, Homo sapiens
gcaggaauuucucugcagaccc

SEQ ID NO: 216290 - RNA, 22 nt, Homo sapiens
gcaguacuuuauguccuaauua

SEQ ID NO: 216291 - RNA, 20 nt, Homo sapiens
gcaguacuuuuaguucuaag

SEQ ID NO: 216292 - RNA, 19 nt, Homo sapiens
gcaguauugaaggccaguc

SEQ ID NO: 216293 - RNA, 22 nt, Homo sapiens
gcagugcaugacgguauauaua

SEQ ID NO: 216294 - RNA, 22 nt, Homo sapiens
gcagugcuggagcccccgugug

SEQ ID NO: 216295 - RNA, 22 nt, Homo sapiens
gcagugugaucacagcuuacug

SEQ ID NO: 216296 - RNA, 22 nt, Homo sapiens
gcagugugauguuuuaaucuau

SEQ ID NO: 216297 - RNA, 22 nt, Homo sapiens
gcaguguggguagagggcaaga

SEQ ID NO: 216298 - RNA, 22 nt, Homo sapiens
gcaguguucaaaucaugcccau

SEQ ID NO: 216299 - RNA, 22 nt, Homo sapiens
gcaguguugugauccaggucuu

SEQ ID NO: 216300 - RNA, 22 nt, Homo sapiens
gcaguucuguaguugaaauuua

SEQ ID NO: 216301 - RNA, 17 nt, Homo sapiens
gcauaugucgaaccagc

SEQ ID NO: 216302 - RNA, 20 nt, Homo sapiens
gcauaugucuuuauagcaga

SEQ ID NO: 216303 - RNA, 17 nt, Homo sapiens
gcauauguugaaccagu

SEQ ID NO: 216304 - RNA, 22 nt, Homo sapiens
gcaucacagggagacaggccuc

SEQ ID NO: 216305 - RNA, 19 nt, Homo sapiens
gcaucauuaguugcuuuuc

SEQ ID NO: 216306 - RNA, 22 nt, Homo sapiens
gcaugcauuuuccuaacuagaa

SEQ ID NO: 216307 - RNA, 22 nt, Homo sapiens
gcauggccuuuaaaugucacag

SEQ ID NO: 216308 - RNA, 22 nt, Homo sapiens
gcaugguaguaaccuacauuug

SEQ ID NO: 216309 - RNA, 22 nt, Homo sapiens
gcauugcacuuggcauagacug

SEQ ID NO: 216310 - RNA, 22 nt, Homo sapiens
gccaacauggcgcuccauucuu

SEQ ID NO: 216311 - RNA, 18 nt, Homo sapiens
gccaacauguaaacaggu

SEQ ID NO: 216312 - RNA, 22 nt, Homo sapiens
gccaagaagugucuaagcagga

SEQ ID NO: 216313 - RNA, 22 nt, Homo sapiens
gccaguguguguuguucuccgc

SEQ ID NO: 216314 - RNA, 22 nt, Homo sapiens
gccauugcacuccagccucggc

SEQ ID NO: 216315 - RNA, 22 nt, Homo sapiens
gccauugcacuccagcuugggc

SEQ ID NO: 216316 - RNA, 22 nt, Homo sapiens
gccauugcacuccgcccugggc

SEQ ID NO: 216317 - RNA, 22 nt, Homo sapiens
gcccagcguucagggaggggcu

SEQ ID NO: 216318 - RNA, 22 nt, Homo sapiens
gcccaguagcaguacaucccuu

SEQ ID NO: 216319 - RNA, 22 nt, Homo sapiens
gccccgggugaugcagccguca

SEQ ID NO: 216320 - RNA, 22 nt, Homo sapiens
gccuagauccaaauauggugca

SEQ ID NO: 216321 - RNA, 23 nt, Homo sapiens
uauugcacuaugguaacccuuuu

SEQ ID NO: 216322 - RNA, 22 nt, Homo sapiens
uauugcagauacccaggaaguu

SEQ ID NO: 216323 - RNA, 22 nt, Homo sapiens
uauugcagugagauccaucugg

SEQ ID NO: 216324 - RNA, 22 nt, Homo sapiens
uauugcuacuuugccuuccaaa

SEQ ID NO: 216325 - RNA, 22 nt, Homo sapiens
uauugcuccccauaucgcagug

SEQ ID NO: 216326 - RNA, 22 nt, Homo sapiens
uauugcugaaaaugcuaaugau

SEQ ID NO: 216327 - RNA, 22 nt, Homo sapiens
uauugcuggauguauuacaugu

SEQ ID NO: 216328 - RNA, 22 nt, Homo sapiens
uauugcuggcucugucuucauu

SEQ ID NO: 216329 - RNA, 18 nt, Homo sapiens
uauugcuugguuuggaga

SEQ ID NO: 216330 - RNA, 22 nt, Homo sapiens
uauugcuuuacucucuuauccu

SEQ ID NO: 216331 - RNA, 22 nt, Homo sapiens
uauuguacauguuauagauuuu

SEQ ID NO: 216332 - RNA, 22 nt, Homo sapiens
uauuguuuuucccaggagucua

SEQ ID NO: 216333 - RNA, 22 nt, Homo sapiens
uauuucaguugugcagguaguu

SEQ ID NO: 216334 - RNA, 22 nt, Homo sapiens
uauuugguagcuauuuugcagu

SEQ ID NO: 216335 - RNA, 22 nt, Homo sapiens
uauuuggugaaugaaugcaugu

SEQ ID NO: 216336 - RNA, 22 nt, Homo sapiens
uauuugguuauaugaguaaguu

SEQ ID NO: 216337 - RNA, 22 nt, Homo sapiens
uauuugguuggugcaaaaguaa

SEQ ID NO: 216338 - RNA, 22 nt, Homo sapiens
ucaaagugcuauggcucagguu

SEQ ID NO: 216339 - RNA, 21 nt, Homo sapiens
ucaaaguguucuuuuguugaa

SEQ ID NO: 216340 - RNA, 22 nt, Homo sapiens
ucaaaugauucagaagccaccu

SEQ ID NO: 216341 - RNA, 22 nt, Homo sapiens
ucaaaugcucuuugcagagagg

SEQ ID NO: 216342 - RNA, 22 nt, Homo sapiens
ucaaaugcuguauuguaguaau

SEQ ID NO: 216343 - RNA, 22 nt, Homo sapiens
ucaaauguuuguuuaaggcuua

SEQ ID NO: 216344 - RNA, 20 nt, Homo sapiens
ucaaauucuuggccuccagc

SEQ ID NO: 216345 - RNA, 22 nt, Homo sapiens
ucaacacaguuaaauggggaaa

SEQ ID NO: 216346 - RNA, 22 nt, Homo sapiens
ucaacagugggcacuguaaaug

SEQ ID NO: 216347 - RNA, 22 nt, Homo sapiens
ucaacauugcugucaggcaucu

SEQ ID NO: 216348 - RNA, 21 nt, Homo sapiens
ucaacccuugcgucaccaagc

SEQ ID NO: 216349 - RNA, 18 nt, Homo sapiens
ucaagcuauugucaugcc

SEQ ID NO: 216350 - RNA, 22 nt, Homo sapiens
ucaaggcacuagcugagcugca

SEQ ID NO: 216351 - RNA, 22 nt, Homo sapiens
ucaaggcaguggccuuccuucu

SEQ ID NO: 216352 - RNA, 22 nt, Homo sapiens
ucaaguacugccuugcucuggc

SEQ ID NO: 216353 - RNA, 23 nt, Homo sapiens
ucaagugaugguggccacaaggg

SEQ ID NO: 216354 - RNA, 22 nt, Homo sapiens
ucaagugauucuugugccuuag

SEQ ID NO: 216355 - RNA, 18 nt, Homo sapiens
ucacaaccacagugcugu

SEQ ID NO: 216356 - RNA, 22 nt, Homo sapiens
ucacaaggcaggaaugaaaggg

SEQ ID NO: 216357 - RNA, 22 nt, Homo sapiens
ucacaaguguauagacaugucc

SEQ ID NO: 216358 - RNA, 21 nt, Homo sapiens
ucacaaugaacagcagcagaa

SEQ ID NO: 216359 - RNA, 22 nt, Homo sapiens
ucacacuguuuugauuauuaua

SEQ ID NO: 216360 - RNA, 21 nt, Homo sapiens
ucacagccuaggaccugaaga

SEQ ID NO: 216361 - RNA, 22 nt, Homo sapiens
ucacaguaaauccagaagaaau

SEQ ID NO: 216362 - RNA, 22 nt, Homo sapiens
ucacaguaacuuuguugcuuuu

SEQ ID NO: 216363 - RNA, 22 nt, Homo sapiens
ucacaguagagcuucuuucaga

SEQ ID NO: 216364 - RNA, 22 nt, Homo sapiens
ucacaguagggaacugacaaag

SEQ ID NO: 216365 - RNA, 22 nt, Homo sapiens
ucacaguaucaugggggacaga

SEQ ID NO: 216366 - RNA, 22 nt, Homo sapiens
ucacaguauggggggugguuau

SEQ ID NO: 216367 - RNA, 22 nt, Homo sapiens
ucacagucugcgugaugagaca

SEQ ID NO: 216368 - RNA, 17 nt, Homo sapiens
ucacaguguuaggauga

SEQ ID NO: 216369 - RNA, 22 nt, Homo sapiens
ucacauggggaagggacuagcu

SEQ ID NO: 216370 - RNA, 22 nt, Homo sapiens
ucacaugucagccguggggaag

SEQ ID NO: 216371 - RNA, 22 nt, Homo sapiens
ucacaugugacauauauauuug

SEQ ID NO: 216372 - RNA, 22 nt, Homo sapiens
ucacauguguaaauugguguaa

SEQ ID NO: 216373 - RNA, 22 nt, Homo sapiens
ucacauuguacaaacagguaag

SEQ ID NO: 216374 - RNA, 22 nt, Homo sapiens
ucaccaccugcugauuguagag

SEQ ID NO: 216375 - RNA, 22 nt, Homo sapiens
ucaccuggagaagauggaucau

SEQ ID NO: 216376 - RNA, 22 nt, Homo sapiens
ucaccuggagccuucacauucu

SEQ ID NO: 216377 - RNA, 22 nt, Homo sapiens
ucaccuggggaucuuguuuaca

SEQ ID NO: 216378 - RNA, 23 nt, Homo sapiens
ucacggagaccugcaagaccaau

SEQ ID NO: 216379 - RNA, 23 nt, Homo sapiens
ucacuagaguccuggaguuugag

SEQ ID NO: 216380 - RNA, 22 nt, Homo sapiens
ucacuagaucaagggagagaaa

SEQ ID NO: 216381 - RNA, 22 nt, Homo sapiens
ucacugaaaccacugccuccug

SEQ ID NO: 216382 - RNA, 22 nt, Homo sapiens
ucacugagcacaggagaugugc

SEQ ID NO: 216383 - RNA, 21 nt, Homo sapiens
ucacugagcaucaugguuuca

SEQ ID NO: 216384 - RNA, 22 nt, Homo sapiens
ucacugaggucugagcuuuaug

SEQ ID NO: 216385 - RNA, 22 nt, Homo sapiens
ucacugcgaccuccaccucccg

SEQ ID NO: 216386 - RNA, 22 nt, Homo sapiens
ucacugcgaccucugccucccg

SEQ ID NO: 216387 - RNA, 22 nt, Homo sapiens
ucacuggacucuagccugggug

SEQ ID NO: 216388 - RNA, 22 nt, Homo sapiens
ucacugggagaccaaagccauc

SEQ ID NO: 216389 - RNA, 20 nt, Homo sapiens
ucacugugaacuucuugagg

SEQ ID NO: 216390 - RNA, 22 nt, Homo sapiens
ucacuguugaugggcaugcagg

SEQ ID NO: 216391 - RNA, 21 nt, Homo sapiens
ucagaagcucccagggaggac

SEQ ID NO: 216392 - RNA, 22 nt, Homo sapiens
ucagacacugcccuccaccugu

SEQ ID NO: 216393 - RNA, 22 nt, Homo sapiens
ucagagugcagggaguagcagc

SEQ ID NO: 216394 - RNA, 22 nt, Homo sapiens
ucagaucaguuccacaagaacu

SEQ ID NO: 216395 - RNA, 22 nt, Homo sapiens
ucagaugcauccauaccccacu

SEQ ID NO: 216396 - RNA, 22 nt, Homo sapiens
ucagcagucacuccuaugacaa

SEQ ID NO: 216397 - RNA, 20 nt, Homo sapiens
ucagcagucuggagcagagg

SEQ ID NO: 216398 - RNA, 22 nt, Homo sapiens
ucagcagugugaaaacaaacua

SEQ ID NO: 216399 - RNA, 16 nt, Homo sapiens
ucagcgagggagccag

SEQ ID NO: 216400 - RNA, 22 nt, Homo sapiens
ucaggcacuaguaagaaaaagg

SEQ ID NO: 216401 - RNA, 22 nt, Homo sapiens
ucaggcaugcagcaaugcagug

SEQ ID NO: 216402 - RNA, 21 nt, Homo sapiens
ucagggaccugcuguacugau

SEQ ID NO: 216403 - RNA, 22 nt, Homo sapiens
ucagggacgcuugacacaagcc

SEQ ID NO: 216404 - RNA, 20 nt, Homo sapiens
ucagguagaucuuugagguc

SEQ ID NO: 216405 - RNA, 22 nt, Homo sapiens
ucagguauuuuaucacaugaag

SEQ ID NO: 216406 - RNA, 22 nt, Homo sapiens
ucaggucauuccaggagggcca

SEQ ID NO: 216407 - RNA, 22 nt, Homo sapiens
ucaggugcagagaagaaauggg

SEQ ID NO: 216408 - RNA, 22 nt, Homo sapiens
ucaggugcaguggcucugaccu

SEQ ID NO: 216409 - RNA, 22 nt, Homo sapiens
ucagguugcuaaguauaauauu

SEQ ID NO: 216410 - RNA, 23 nt, Homo sapiens
ucaguagucauugggaaagugug

SEQ ID NO: 216411 - RNA, 19 nt, Homo sapiens
ucaguagugcacauaagcc

SEQ ID NO: 216412 - RNA, 22 nt, Homo sapiens
ucaguauaugaaucuggggcag

SEQ ID NO: 216413 - RNA, 22 nt, Homo sapiens
ucagucuuuuaccauuaaguau

SEQ ID NO: 216414 - RNA, 22 nt, Homo sapiens
ucagugauugguuauuuuaggc

SEQ ID NO: 216415 - RNA, 21 nt, Homo sapiens
ucagugcaauucuauggggaa

SEQ ID NO: 216416 - RNA, 20 nt, Homo sapiens
ucagugcagauuguccaagu

SEQ ID NO: 216417 - RNA, 22 nt, Homo sapiens
ucagugcaggaaucucuagcca

SEQ ID NO: 216418 - RNA, 19 nt, Homo sapiens
ucagugcuauguaauguag

SEQ ID NO: 216419 - RNA, 22 nt, Homo sapiens
ucagugcuguaccaucuaagga

SEQ ID NO: 216420 - RNA, 22 nt, Homo sapiens
ucagugcuuggcacagagagcu

SEQ ID NO: 216421 - RNA, 22 nt, Homo sapiens
ucagugucugcauucuuauugu

SEQ ID NO: 216422 - RNA, 22 nt, Homo sapiens
ucaguguuuggaaucucaauuu

SEQ ID NO: 216423 - RNA, 22 nt, Homo sapiens
uuccugucuuccaagagagauu

SEQ ID NO: 216424 - RNA, 22 nt, Homo sapiens
uucuaaacaucuuacaaugcau

SEQ ID NO: 216425 - RNA, 22 nt, Homo sapiens
uucuagcaauggcagagugucu

SEQ ID NO: 216426 - RNA, 22 nt, Homo sapiens
uucuaguacucccuggagcugg

SEQ ID NO: 216427 - RNA, 22 nt, Homo sapiens
uucucaaggagccuucguaacu

SEQ ID NO: 216428 - RNA, 22 nt, Homo sapiens
uucucagcccccugacagucag

SEQ ID NO: 216429 - RNA, 21 nt, Homo sapiens
uucucaggguguguccuaccc

SEQ ID NO: 216430 - RNA, 22 nt, Homo sapiens
uucucauggaacaucuguacug

SEQ ID NO: 216431 - RNA, 22 nt, Homo sapiens
uucucgcuuuuuccaccuguau

SEQ ID NO: 216432 - RNA, 22 nt, Homo sapiens
uucugacuggugugagauggua

SEQ ID NO: 216433 - RNA, 22 nt, Homo sapiens
uuagaugaagucacagaaccca

SEQ ID NO: 216434 - RNA, 22 nt, Homo sapiens
uuagauuauugguguuuugcaa

SEQ ID NO: 216435 - RNA, 22 nt, Homo sapiens
uuagcacugagaauggcuugcu

SEQ ID NO: 216436 - RNA, 20 nt, Homo sapiens
uuagcagcaugauuuauaau

SEQ ID NO: 216437 - RNA, 22 nt, Homo sapiens
uuagcagcucuaauaacugcua

SEQ ID NO: 216438 - RNA, 22 nt, Homo sapiens
uuagcagugugaaaaaagacua

SEQ ID NO: 216439 - RNA, 22 nt, Homo sapiens
uuaggacaauguucguuuuuug

SEQ ID NO: 216440 - RNA, 22 nt, Homo sapiens
uuaggagacuggauaucucuuu

SEQ ID NO: 216441 - RNA, 22 nt, Homo sapiens
uuaggcaguuuauugauuuuca

SEQ ID NO: 216442 - RNA, 22 nt, Homo sapiens
uuagguauuuuguuaugucagc

SEQ ID NO: 216443 - RNA, 22 nt, Homo sapiens
uuaguagcacagaguaucagca

SEQ ID NO: 216444 - RNA, 22 nt, Homo sapiens
uuaguaguagugcuguaauuuu

SEQ ID NO: 216445 - RNA, 21 nt, Homo sapiens
uuagugcucaguuugacaaaa

SEQ ID NO: 216446 - RNA, 20 nt, Homo sapiens
uuauaacuuuuguucugggg

SEQ ID NO: 216447 - RNA, 22 nt, Homo sapiens
uuauaugcuaaacaaggggugg

SEQ ID NO: 216448 - RNA, 22 nt, Homo sapiens
uuauauguuacucccucuagca

SEQ ID NO: 216449 - RNA, 22 nt, Homo sapiens
uuauauguuucuuagggacaga

SEQ ID NO: 216450 - RNA, 22 nt, Homo sapiens
uuaucagcagcaugaaacugga

SEQ ID NO: 216451 - RNA, 22 nt, Homo sapiens
uuaugacaggcucaggagcccc

SEQ ID NO: 216452 - RNA, 17 nt, Homo sapiens
uuaugagacuucuuagc

SEQ ID NO: 216453 - RNA, 22 nt, Homo sapiens
uuaugcuguuuucuggagauuu

SEQ ID NO: 216454 - RNA, 22 nt, Homo sapiens
uuaugcuugugugaauuuuccc

SEQ ID NO: 216455 - RNA, 22 nt, Homo sapiens
uuaugguuguuaucuugguucg

SEQ ID NO: 216456 - RNA, 22 nt, Homo sapiens
uuaugucuuugagcaaugcugu

SEQ ID NO: 216457 - RNA, 22 nt, Homo sapiens
uuaugucuuuuguguucagcua

SEQ ID NO: 216458 - RNA, 22 nt, Homo sapiens
uuauguguuuaauguuucugaa

SEQ ID NO: 216459 - RNA, 22 nt, Homo sapiens
uuauuagcacccuaccaugugg

SEQ ID NO: 216460 - RNA, 22 nt, Homo sapiens
uuauuagguuaaccuauagcua

SEQ ID NO: 216461 - RNA, 22 nt, Homo sapiens
uuauuauguuggugcaaaggua

SEQ ID NO: 216462 - RNA, 22 nt, Homo sapiens
uuauugaguaaaaagaaugguu

SEQ ID NO: 216463 - RNA, 17 nt, Homo sapiens
uuauugcuauaagcuga

SEQ ID NO: 216464 - RNA, 22 nt, Homo sapiens
uuauugcuccagaggcugauuu

SEQ ID NO: 216465 - RNA, 22 nt, Homo sapiens
uuauugcuuaugauuagguguu

SEQ ID NO: 216466 - RNA, 23 nt, Homo sapiens
uucaaaggaugcuuuauggaauu

SEQ ID NO: 216467 - RNA, 22 nt, Homo sapiens
uucaaaguaaaaauguguucac

SEQ ID NO: 216468 - RNA, 22 nt, Homo sapiens
uucaaaguguugguuuugggcu

SEQ ID NO: 216469 - RNA, 22 nt, Homo sapiens
uucaaaucuucguuuugccaua

SEQ ID NO: 216470 - RNA, 22 nt, Homo sapiens
uucaaauguucuuucaccaccc

SEQ ID NO: 216471 - RNA, 22 nt, Homo sapiens
uucaacagugauggccuuugua

SEQ ID NO: 216472 - RNA, 22 nt, Homo sapiens
uucaagauggccccagugagcc

SEQ ID NO: 216473 - RNA, 22 nt, Homo sapiens
uucaaggacuaaggauuuuugg

SEQ ID NO: 216474 - RNA, 22 nt, Homo sapiens
uucaaguaagaaagacaucagg

SEQ ID NO: 216475 - RNA, 22 nt, Homo sapiens
uucaaguaguucucaugccuca

SEQ ID NO: 216476 - RNA, 22 nt, Homo sapiens
uucaagucaacaagcacuugag

SEQ ID NO: 216477 - RNA, 22 nt, Homo sapiens
uucaagugguucagaagucuga

SEQ ID NO: 216478 - RNA, 22 nt, Homo sapiens
uucaaguguucaggagcuacag

SEQ ID NO: 216479 - RNA, 22 nt, Homo sapiens
uucacaauuaaaugugguuauu

SEQ ID NO: 216480 - RNA, 22 nt, Homo sapiens
uucacacuagccacucugguag

SEQ ID NO: 216481 - RNA, 22 nt, Homo sapiens
uucacacugggccuacucugug

SEQ ID NO: 216482 - RNA, 22 nt, Homo sapiens
uucacagaaaaaggcgaugagg

SEQ ID NO: 216483 - RNA, 22 nt, Homo sapiens
uucacagacaacuggucccuua

SEQ ID NO: 216484 - RNA, 22 nt, Homo sapiens
uucacaugacagggugaagcau

SEQ ID NO: 216485 - RNA, 22 nt, Homo sapiens
uucaccagggaagucucaacuc

SEQ ID NO: 216486 - RNA, 22 nt, Homo sapiens
uucaccuggguuggccaucauu

SEQ ID NO: 216487 - RNA, 23 nt, Homo sapiens
uucaccugguuauuaauagccuc

SEQ ID NO: 216488 - RNA, 20 nt, Homo sapiens
uucacggaggccgcgccccc

SEQ ID NO: 216489 - RNA, 19 nt, Homo sapiens
uucacguaggagaaagaag

SEQ ID NO: 216490 - RNA, 22 nt, Homo sapiens
uucacugcacuccagccugagc

SEQ ID NO: 216491 - RNA, 22 nt, Homo sapiens
uucacugcaugaaaaggacagc

SEQ ID NO: 216492 - RNA, 21 nt, Homo sapiens
uucacuggucuauuucccuuu

SEQ ID NO: 216493 - RNA, 22 nt, Homo sapiens
uucacuguagcuuggauguuua

SEQ ID NO: 216494 - RNA, 22 nt, Homo sapiens
uucagcuacuuggaaacagcaa

SEQ ID NO: 216495 - RNA, 22 nt, Homo sapiens
uucaggcaccauugucauugau

SEQ ID NO: 216496 - RNA, 22 nt, Homo sapiens
uucaggguggagaguaugaggu

SEQ ID NO: 216497 - RNA, 22 nt, Homo sapiens
uucagguaucccuugucuauag

SEQ ID NO: 216498 - RNA, 22 nt, Homo sapiens
uucaguacacguguucucauuu

SEQ ID NO: 216499 - RNA, 22 nt, Homo sapiens
uucaguagucuccauagaaccg

SEQ ID NO: 216500 - RNA, 20 nt, Homo sapiens
uucagugcagguaacaaucc

SEQ ID NO: 216501 - RNA, 22 nt, Homo sapiens
uucagugccuggaagucgugcu

SEQ ID NO: 216502 - RNA, 22 nt, Homo sapiens
uucaguggagaggcugaguggu

SEQ ID NO: 216503 - RNA, 22 nt, Homo sapiens
uucagugguuauuugugagauu

SEQ ID NO: 216504 - RNA, 22 nt, Homo sapiens
uucauacaguggcugcacucca

SEQ ID NO: 216505 - RNA, 22 nt, Homo sapiens
uucauagucacauucgaugucu

SEQ ID NO: 216506 - RNA, 22 nt, Homo sapiens
uucauagucuaugcaaguaaga

SEQ ID NO: 216507 - RNA, 22 nt, Homo sapiens
uucauaguguaccugaaggcac

SEQ ID NO: 216508 - RNA, 22 nt, Homo sapiens
uucaucagggagaaauaauuuc

SEQ ID NO: 216509 - RNA, 20 nt, Homo sapiens
uucaugggagcaaagaggcc

SEQ ID NO: 216510 - RNA, 22 nt, Homo sapiens
uucauggguuaauuuguucgau

SEQ ID NO: 216511 - RNA, 22 nt, Homo sapiens
uucauggugguacaaaagcaau

SEQ ID NO: 216512 - RNA, 22 nt, Homo sapiens
uucauguaauauauuucaggcc

SEQ ID NO: 216513 - RNA, 22 nt, Homo sapiens
uucauguagucaucauccugcu

SEQ ID NO: 216514 - RNA, 22 nt, Homo sapiens
uuccaauguuccguguugcagu

SEQ ID NO: 216515 - RNA, 22 nt, Homo sapiens
uuccacaggguugaacuaguuu

SEQ ID NO: 216516 - RNA, 16 nt, Homo sapiens
uuccacagucgaggug

SEQ ID NO: 216517 - RNA, 22 nt, Homo sapiens
uuccaggugggcgugggccugg

SEQ ID NO: 216518 - RNA, 22 nt, Homo sapiens
uuccaguauuugggcaagcgca

SEQ ID NO: 216519 - RNA, 22 nt, Homo sapiens
uuccaguguguucauccucaga

SEQ ID NO: 216520 - RNA, 22 nt, Homo sapiens
uuccaguugugagcuauccggg

SEQ ID NO: 216521 - RNA, 22 nt, Homo sapiens
uuccaugugggcuugucaagua

SEQ ID NO: 216522 - RNA, 22 nt, Homo sapiens
uucccaguggaacauguaguca

SEQ ID NO: 216523 - RNA, 22 nt, Homo sapiens
uucccuugcaggaugaucugga

SEQ ID NO: 216524 - RNA, 22 nt, Homo sapiens
uucccuuugaaacuaaacuugc

SEQ ID NO: 216525 - RNA, 19 nt, Homo sapiens
uuccugagaacaagggcuu

SEQ ID NO: 216526 - RNA, 22 nt, Homo sapiens
uuccugagagggcugggugcag

SEQ ID NO: 216527 - RNA, 22 nt, Homo sapiens
uauggguguuauugcaugggag

SEQ ID NO: 216528 - RNA, 22 nt, Homo sapiens
uauggguuuauuucuggucuca

SEQ ID NO: 216529 - RNA, 22 nt, Homo sapiens
uauggguuuuucauaaauaggu

SEQ ID NO: 216530 - RNA, 22 nt, Homo sapiens
uauggguuuuugucuguuuacu

SEQ ID NO: 216531 - RNA, 17 nt, Homo sapiens
uauguaguacuuauaaa

SEQ ID NO: 216532 - RNA, 22 nt, Homo sapiens
uaugucauggguaaagugcccu

SEQ ID NO: 216533 - RNA, 22 nt, Homo sapiens
uaugugcaaauuaauugcuaga

SEQ ID NO: 216534 - RNA, 22 nt, Homo sapiens
uauuacagaccauaucgccggg

SEQ ID NO: 216535 - RNA, 20 nt, Homo sapiens
uauuacagaguaauggugga

SEQ ID NO: 216536 - RNA, 22 nt, Homo sapiens
uauuacuguuauuccuaucaaa

SEQ ID NO: 216537 - RNA, 22 nt, Homo sapiens
uauuaguuuucuguggauuaca

SEQ ID NO: 216538 - RNA, 22 nt, Homo sapiens
uauuauagugauaggucuacug

SEQ ID NO: 216539 - RNA, 22 nt, Homo sapiens
uauucaucuuaagcuuuggcuu

SEQ ID NO: 216540 - RNA, 22 nt, Homo sapiens
uauuccacacuguuggugggau

SEQ ID NO: 216541 - RNA, 22 nt, Homo sapiens
uauuccucuuuguugagguuau

SEQ ID NO: 216542 - RNA, 22 nt, Homo sapiens
uauuccuuuugcauuuccacau

SEQ ID NO: 216543 - RNA, 22 nt, Homo sapiens
uauugaauuugagcugucucuu

SEQ ID NO: 216544 - RNA, 17 nt, Homo sapiens
uauugaccuuuguaugu

SEQ ID NO: 216545 - RNA, 22 nt, Homo sapiens
uauugacuuuuuuguuaggagg

SEQ ID NO: 216546 - RNA, 22 nt, Homo sapiens
uauugcaacagaagaaagaguc

SEQ ID NO: 216547 - RNA, 20 nt, Homo sapiens
uauugcacuccagucugggc

SEQ ID NO: 216548 - RNA, 20 nt, Homo sapiens
uauugccuaaauaccagaau

SEQ ID NO: 216549 - RNA, 22 nt, Homo sapiens
uauugcugaugcugaagggaag

SEQ ID NO: 216550 - RNA, 22 nt, Homo sapiens
uauugcuuaugaugcugaauua

SEQ ID NO: 216551 - RNA, 22 nt, Homo sapiens
uauugucacuaaaggaagcugg

SEQ ID NO: 216552 - RNA, 22 nt, Homo sapiens
uauuucaguugcguuucccgag

SEQ ID NO: 216553 - RNA, 22 nt, Homo sapiens
uauuugauuaacaagagccuaa

SEQ ID NO: 216554 - RNA, 22 nt, Homo sapiens
uauuuggauagucuggaaaaaa

SEQ ID NO: 216555 - RNA, 22 nt, Homo sapiens
uauuugguuacuugaauagcua

SEQ ID NO: 216556 - RNA, 20 nt, Homo sapiens
uauuugguuauuuccauggu

SEQ ID NO: 216557 - RNA, 22 nt, Homo sapiens
ucaaaaccucagagaguagagc

SEQ ID NO: 216558 - RNA, 22 nt, Homo sapiens
ucaaacacuccauaucgcgauu

SEQ ID NO: 216559 - RNA, 22 nt, Homo sapiens
ucaaacauccccaccagggacu

SEQ ID NO: 216560 - RNA, 22 nt, Homo sapiens
ucaaaguauucuucugagaacc

SEQ ID NO: 216561 - RNA, 22 nt, Homo sapiens
ucaaagugacaaaguugcagca

SEQ ID NO: 216562 - RNA, 22 nt, Homo sapiens
ucaaaugauucuccugccucag

SEQ ID NO: 216563 - RNA, 22 nt, Homo sapiens
ucaaaugguccacgugaacauu

SEQ ID NO: 216564 - RNA, 22 nt, Homo sapiens
ucaaauuccaagucuagguagg

SEQ ID NO: 216565 - RNA, 22 nt, Homo sapiens
ucaacaggucaauugcauagaa

SEQ ID NO: 216566 - RNA, 22 nt, Homo sapiens
ucaacagugauggaaaguuaua

SEQ ID NO: 216567 - RNA, 22 nt, Homo sapiens
ucaaccggugagagcuuccucc

SEQ ID NO: 216568 - RNA, 22 nt, Homo sapiens
ucaagaccucacauagaggaga

SEQ ID NO: 216569 - RNA, 22 nt, Homo sapiens
ucaagcaauucgccugucucag

SEQ ID NO: 216570 - RNA, 22 nt, Homo sapiens
ucaagcaauucuccucucagcc

SEQ ID NO: 216571 - RNA, 19 nt, Homo sapiens
ucaagcuauucuccugccu

SEQ ID NO: 216572 - RNA, 22 nt, Homo sapiens
ucaaggacucagagagggauua

SEQ ID NO: 216573 - RNA, 20 nt, Homo sapiens
ucaaggcacgaauaaaaguu

SEQ ID NO: 216574 - RNA, 22 nt, Homo sapiens
ucaaguaagaagugggcauaaa

SEQ ID NO: 216575 - RNA, 22 nt, Homo sapiens
ucaaguaguaacuaacugugac

SEQ ID NO: 216576 - RNA, 22 nt, Homo sapiens
ucaagugcauugauucaguauu

SEQ ID NO: 216577 - RNA, 22 nt, Homo sapiens
ucaaugcaugugacaaagagua

SEQ ID NO: 216578 - RNA, 22 nt, Homo sapiens
ucacaagcuccugccuuugcuu

SEQ ID NO: 216579 - RNA, 22 nt, Homo sapiens
ucacaauucucaauuugugaaa

SEQ ID NO: 216580 - RNA, 22 nt, Homo sapiens
ucacacucucaccaacauuugg

SEQ ID NO: 216581 - RNA, 22 nt, Homo sapiens
ucacacugaaacuaggguguga

SEQ ID NO: 216582 - RNA, 22 nt, Homo sapiens
ucacacugcaucuguuggaauu

SEQ ID NO: 216583 - RNA, 22 nt, Homo sapiens
ucacagauaaauaaagaugauu

SEQ ID NO: 216584 - RNA, 22 nt, Homo sapiens
ucacagccuaguuuuauacauu

SEQ ID NO: 216585 - RNA, 22 nt, Homo sapiens
ucacagcuaaaaugaaaguagu

SEQ ID NO: 216586 - RNA, 22 nt, Homo sapiens
ucacaggguguuauuagaauua

SEQ ID NO: 216587 - RNA, 22 nt, Homo sapiens
ucacaguagcaaauguuagaaa

SEQ ID NO: 216588 - RNA, 22 nt, Homo sapiens
ucacaguagccccucccaucau

SEQ ID NO: 216589 - RNA, 22 nt, Homo sapiens
ucacagucaaaguaaucauaga

SEQ ID NO: 216590 - RNA, 22 nt, Homo sapiens
ucacagugaguggaguggggug

SEQ ID NO: 216591 - RNA, 23 nt, Homo sapiens
ucacaguggcugcuuaauuguga

SEQ ID NO: 216592 - RNA, 23 nt, Homo sapiens
ucacaguuacuuuugcaucaacc

SEQ ID NO: 216593 - RNA, 20 nt, Homo sapiens
ucacauccucucccaacaug

SEQ ID NO: 216594 - RNA, 22 nt, Homo sapiens
ucacauggaaaaguccaguaaa

SEQ ID NO: 216595 - RNA, 22 nt, Homo sapiens
ucacauggauuaacucauuuau

SEQ ID NO: 216596 - RNA, 22 nt, Homo sapiens
ucacauguguaugagcuuugau

SEQ ID NO: 216597 - RNA, 22 nt, Homo sapiens
ucacauucaauuguaauccccg

SEQ ID NO: 216598 - RNA, 22 nt, Homo sapiens
ucaccaguacuccaaauugagg

SEQ ID NO: 216599 - RNA, 20 nt, Homo sapiens
ucacccugacaucugcccag

SEQ ID NO: 216600 - RNA, 22 nt, Homo sapiens
ucacccugacaugcggccgaac

SEQ ID NO: 216601 - RNA, 22 nt, Homo sapiens
ucaccuggagacaugaagacug

SEQ ID NO: 216602 - RNA, 22 nt, Homo sapiens
ucaccuggggcacagcugaaga

SEQ ID NO: 216603 - RNA, 22 nt, Homo sapiens
ucaccuuacuugcuucugaacu

SEQ ID NO: 216604 - RNA, 22 nt, Homo sapiens
ucaccuugcacaguuguguggg

SEQ ID NO: 216605 - RNA, 22 nt, Homo sapiens
ucacugaaaccgccuccaccuc

SEQ ID NO: 216606 - RNA, 21 nt, Homo sapiens
ucacugagguuaaauaggguu

SEQ ID NO: 216607 - RNA, 20 nt, Homo sapiens
ucacugaguaucuacgauua

SEQ ID NO: 216608 - RNA, 20 nt, Homo sapiens
ucacugagugguccacagua

SEQ ID NO: 216609 - RNA, 22 nt, Homo sapiens
ucacugcgaccuccaccuccug

SEQ ID NO: 216610 - RNA, 22 nt, Homo sapiens
ucacugcgcuucagccugggug

SEQ ID NO: 216611 - RNA, 20 nt, Homo sapiens
ucacuggguucuugaagucu

SEQ ID NO: 216612 - RNA, 22 nt, Homo sapiens
ucacugugguuggaaggcuuaa

SEQ ID NO: 216613 - RNA, 22 nt, Homo sapiens
ucacugugguuugggaaagugc

SEQ ID NO: 216614 - RNA, 22 nt, Homo sapiens
ucacuuggugaacacauuaugu

SEQ ID NO: 216615 - RNA, 22 nt, Homo sapiens
ucacuuuguauagcgacuggcu

SEQ ID NO: 216616 - RNA, 22 nt, Homo sapiens
ucagacacugagcaaacgacua

SEQ ID NO: 216617 - RNA, 22 nt, Homo sapiens
ucagaguagcugucugaggugc

SEQ ID NO: 216618 - RNA, 22 nt, Homo sapiens
ucagaguaguuccuggcagaaa

SEQ ID NO: 216619 - RNA, 22 nt, Homo sapiens
ucagaguggagucugcagccuu

SEQ ID NO: 216620 - RNA, 22 nt, Homo sapiens
ucagaguggccucucuugaaga

SEQ ID NO: 216621 - RNA, 22 nt, Homo sapiens
ucagauacuggugacaugaaug

SEQ ID NO: 216622 - RNA, 19 nt, Homo sapiens
ucagaugcauuagggguua

SEQ ID NO: 216623 - RNA, 22 nt, Homo sapiens
ucagcaaugcugcacucuacug

SEQ ID NO: 216624 - RNA, 22 nt, Homo sapiens
ucagcaccauguaacaauugau

SEQ ID NO: 216625 - RNA, 22 nt, Homo sapiens
uucagauugcauaccgaaagua

SEQ ID NO: 216626 - RNA, 22 nt, Homo sapiens
uucagcacaguguggaucauuc

SEQ ID NO: 216627 - RNA, 22 nt, Homo sapiens
uucagggagaaggcaaacguug

SEQ ID NO: 216628 - RNA, 22 nt, Homo sapiens
uucagguacugggggaguaugg

SEQ ID NO: 216629 - RNA, 22 nt, Homo sapiens
uucagguaguuuaacuguucca

SEQ ID NO: 216630 - RNA, 22 nt, Homo sapiens
uucaguaaauguucuuacuaua

SEQ ID NO: 216631 - RNA, 22 nt, Homo sapiens
uucaguaguaaguuggaacucu

SEQ ID NO: 216632 - RNA, 22 nt, Homo sapiens
uucaguucugcucugaucuuag

SEQ ID NO: 216633 - RNA, 18 nt, Homo sapiens
uucaguuuguaucugggg

SEQ ID NO: 216634 - RNA, 22 nt, Homo sapiens
uucauaguauuuuucuccaaau

SEQ ID NO: 216635 - RNA, 22 nt, Homo sapiens
uucauagugaaaaauucaaagu

SEQ ID NO: 216636 - RNA, 23 nt, Homo sapiens
uucaucagggauauuggccugaa

SEQ ID NO: 216637 - RNA, 22 nt, Homo sapiens
uucaugcaucuguagugguuaa

SEQ ID NO: 216638 - RNA, 22 nt, Homo sapiens
uucauggaauauugaccauuuu

SEQ ID NO: 216639 - RNA, 22 nt, Homo sapiens
uucauggacucaauaguuucgc

SEQ ID NO: 216640 - RNA, 22 nt, Homo sapiens
uucauggauggaaaugauuuug

SEQ ID NO: 216641 - RNA, 22 nt, Homo sapiens
uucauguaauuccauaagguaa

SEQ ID NO: 216642 - RNA, 22 nt, Homo sapiens
uucaugucuuggcuguuagagu

SEQ ID NO: 216643 - RNA, 22 nt, Homo sapiens
uucaugugagucuguauuaacu

SEQ ID NO: 216644 - RNA, 22 nt, Homo sapiens
uucauugcugcuuaucuccaga

SEQ ID NO: 216645 - RNA, 22 nt, Homo sapiens
uuccacaaugguugaacuaauu

SEQ ID NO: 216646 - RNA, 22 nt, Homo sapiens
uuccacaaugguugaacuagcu

SEQ ID NO: 216647 - RNA, 22 nt, Homo sapiens
uuccagagucaccuuucugucg

SEQ ID NO: 216648 - RNA, 22 nt, Homo sapiens
uuccagaugggaguucuauucu

SEQ ID NO: 216649 - RNA, 20 nt, Homo sapiens
uuccagcacauuagggaagc

SEQ ID NO: 216650 - RNA, 22 nt, Homo sapiens
uuccaguaauagcacagcauug

SEQ ID NO: 216651 - RNA, 22 nt, Homo sapiens
uuccaguggacuacuucauccu

SEQ ID NO: 216652 - RNA, 22 nt, Homo sapiens
uuccaguggaguaaauggacaa

SEQ ID NO: 216653 - RNA, 22 nt, Homo sapiens
uuccaguuauuauaccucuuaa

SEQ ID NO: 216654 - RNA, 22 nt, Homo sapiens
uuccaguuuuauggguauagag

SEQ ID NO: 216655 - RNA, 22 nt, Homo sapiens
uuccauaggcuagaucaaccag

SEQ ID NO: 216656 - RNA, 22 nt, Homo sapiens
uuccauguaguugaacgguuuu

SEQ ID NO: 216657 - RNA, 22 nt, Homo sapiens
uuccauguaguugagcaguuuu

SEQ ID NO: 216658 - RNA, 22 nt, Homo sapiens
uucccagagccugggagugagg

SEQ ID NO: 216659 - RNA, 22 nt, Homo sapiens
uucccagugguuagcucugguc

SEQ ID NO: 216660 - RNA, 20 nt, Homo sapiens
uucccucagccuugagggua

SEQ ID NO: 216661 - RNA, 22 nt, Homo sapiens
uucccugaaauauucacuuuca

SEQ ID NO: 216662 - RNA, 22 nt, Homo sapiens
uucccugagcaucuguugagcc

SEQ ID NO: 216663 - RNA, 22 nt, Homo sapiens
uucccugugggaguaggaaagu

SEQ ID NO: 216664 - RNA, 22 nt, Homo sapiens
uucccugugguauagaagccgu

SEQ ID NO: 216665 - RNA, 22 nt, Homo sapiens
uucccugugugcagaugggugu

SEQ ID NO: 216666 - RNA, 22 nt, Homo sapiens
uucccuuucugccuugaaucuu

SEQ ID NO: 216667 - RNA, 22 nt, Homo sapiens
uucccuuucuuaaagaguuagg

SEQ ID NO: 216668 - RNA, 22 nt, Homo sapiens
uuccuacugcccauuaaaaugg

SEQ ID NO: 216669 - RNA, 22 nt, Homo sapiens
uuccuacuguucaucaggaacc

SEQ ID NO: 216670 - RNA, 22 nt, Homo sapiens
uuccuaguccugagucucugcg

SEQ ID NO: 216671 - RNA, 19 nt, Homo sapiens
uuccuagugguugggaagu

SEQ ID NO: 216672 - RNA, 22 nt, Homo sapiens
uuccugagccuuguaucuagua

SEQ ID NO: 216673 - RNA, 22 nt, Homo sapiens
uuccugaggccuccccagaagc

SEQ ID NO: 216674 - RNA, 22 nt, Homo sapiens
uuccugcacuugcuugccuaug

SEQ ID NO: 216675 - RNA, 22 nt, Homo sapiens
uuccugugacuguguggcaccc

SEQ ID NO: 216676 - RNA, 22 nt, Homo sapiens
uuccuuaguuauuugguccccu

SEQ ID NO: 216677 - RNA, 22 nt, Homo sapiens
uuccuucaugcuugaaggguau

SEQ ID NO: 216678 - RNA, 22 nt, Homo sapiens
uuccuugaaacagucaagagaa

SEQ ID NO: 216679 - RNA, 22 nt, Homo sapiens
uuccuugagaaaguacaaggcu

SEQ ID NO: 216680 - RNA, 22 nt, Homo sapiens
uuccuugguucagggaaggucc

SEQ ID NO: 216681 - RNA, 22 nt, Homo sapiens
uucuaaguaagucuguggggaa

SEQ ID NO: 216682 - RNA, 22 nt, Homo sapiens
uucuacagugacugcagccaua

SEQ ID NO: 216683 - RNA, 22 nt, Homo sapiens
uucuacaugggucgucggugag

SEQ ID NO: 216684 - RNA, 22 nt, Homo sapiens
uucuacuccucauggcagguug

SEQ ID NO: 216685 - RNA, 22 nt, Homo sapiens
uucuacuucauuaggaggauug

SEQ ID NO: 216686 - RNA, 22 nt, Homo sapiens
uucuauggucacagaugcuuga

SEQ ID NO: 216687 - RNA, 22 nt, Homo sapiens
uucuaugguuuaauaguuuggg

SEQ ID NO: 216688 - RNA, 22 nt, Homo sapiens
uucuauugguaauauuuucugu

SEQ ID NO: 216689 - RNA, 22 nt, Homo sapiens
uucucagugaaguuuagaacau

SEQ ID NO: 216690 - RNA, 17 nt, Homo sapiens
uucucaguucugaucuc

SEQ ID NO: 216691 - RNA, 22 nt, Homo sapiens
uucuccugguggacccuaaacg

SEQ ID NO: 216692 - RNA, 19 nt, Homo sapiens
uucucugguuguacuaccc

SEQ ID NO: 216693 - RNA, 22 nt, Homo sapiens
uucugaguggcuuucaacacug

SEQ ID NO: 216694 - RNA, 22 nt, Homo sapiens
uucugcacaucgaucacaagau

SEQ ID NO: 216695 - RNA, 22 nt, Homo sapiens
uucugcuugaucuaguguguug

SEQ ID NO: 216696 - RNA, 22 nt, Homo sapiens
uucuggaaaucagcagagggug

SEQ ID NO: 216697 - RNA, 22 nt, Homo sapiens
uucuggcuaugggauacuaaau

SEQ ID NO: 216698 - RNA, 23 nt, Homo sapiens
ugugacacuuccgucaguucauu

SEQ ID NO: 216699 - RNA, 22 nt, Homo sapiens
ugugacagcacagcaucucuuu

SEQ ID NO: 216700 - RNA, 22 nt, Homo sapiens
ugugacucugcauuuuggguuc

SEQ ID NO: 216701 - RNA, 19 nt, Homo sapiens
ugugacugggccagccuag

SEQ ID NO: 216702 - RNA, 16 nt, Homo sapiens
ugugaucuuuuuucuu

SEQ ID NO: 216703 - RNA, 22 nt, Homo sapiens
ugugauguggagggcagaucca

SEQ ID NO: 216704 - RNA, 20 nt, Homo sapiens
ugugauuauuuaguugcaug

SEQ ID NO: 216705 - RNA, 17 nt, Homo sapiens
ugugauugaagucaucc

SEQ ID NO: 216706 - RNA, 22 nt, Homo sapiens
ugugauugauuaaugugugcua

SEQ ID NO: 216707 - RNA, 22 nt, Homo sapiens
ugugcaaucuuccauuuuuagg

SEQ ID NO: 216708 - RNA, 22 nt, Homo sapiens
ugugcacaacgugcagguuugu

SEQ ID NO: 216709 - RNA, 23 nt, Homo sapiens
ugugcacauuuacauauauacac

SEQ ID NO: 216710 - RNA, 22 nt, Homo sapiens
ugugccacugcacuucagccug

SEQ ID NO: 216711 - RNA, 22 nt, Homo sapiens
ugugccuacugauagagccaag

SEQ ID NO: 216712 - RNA, 22 nt, Homo sapiens
ugugccuaguaauguguccaga

SEQ ID NO: 216713 - RNA, 22 nt, Homo sapiens
ugugcgcaucggggccugcuuc

SEQ ID NO: 216714 - RNA, 22 nt, Homo sapiens
ugugcguguaagagaucuaggu

SEQ ID NO: 216715 - RNA, 22 nt, Homo sapiens
uguggcagugcuuuaugaaacc

SEQ ID NO: 216716 - RNA, 22 nt, Homo sapiens
uguggcuuuacagcaugguuca

SEQ ID NO: 216717 - RNA, 22 nt, Homo sapiens
uguggcuuuuucuuggcugagg

SEQ ID NO: 216718 - RNA, 22 nt, Homo sapiens
uguguacugcagaguauucugu

SEQ ID NO: 216719 - RNA, 22 nt, Homo sapiens
uguguauaucacugcaugagug

SEQ ID NO: 216720 - RNA, 22 nt, Homo sapiens
ugugucuugagagucucgagaa

SEQ ID NO: 216721 - RNA, 22 nt, Homo sapiens
ugugucuuguuuauagcuuucu

SEQ ID NO: 216722 - RNA, 21 nt, Homo sapiens
uguuaacaugcagauuacugg

SEQ ID NO: 216723 - RNA, 22 nt, Homo sapiens
uguuauuuuguguuagggcaca

SEQ ID NO: 216724 - RNA, 22 nt, Homo sapiens
uguucaauucccaccuaugagu

SEQ ID NO: 216725 - RNA, 22 nt, Homo sapiens
uguucauggauccaguggcuuc

SEQ ID NO: 216726 - RNA, 22 nt, Homo sapiens
uguucuugagccuuuagaccua

SEQ ID NO: 216727 - RNA, 22 nt, Homo sapiens
uguugcacacacugaaauacac

SEQ ID NO: 216728 - RNA, 22 nt, Homo sapiens
uguugcacuccagccugggcaa

SEQ ID NO: 216729 - RNA, 22 nt, Homo sapiens
uguugcacugguaauguacuga

SEQ ID NO: 216730 - RNA, 22 nt, Homo sapiens
uguuggacuuacuuggcagauu

SEQ ID NO: 216731 - RNA, 22 nt, Homo sapiens
uguuucuacugucucuguagua

SEQ ID NO: 216732 - RNA, 22 nt, Homo sapiens
uguuugcuuaacguggagccag

SEQ ID NO: 216733 - RNA, 19 nt, Homo sapiens
uguuuggcuauaggucuaa

SEQ ID NO: 216734 - RNA, 22 nt, Homo sapiens
uguuuguuugagauggagucuc

SEQ ID NO: 216735 - RNA, 22 nt, Homo sapiens
uguuuuggaggccagaagucca

SEQ ID NO: 216736 - RNA, 22 nt, Homo sapiens
uuaaaggcaugguuagacaugg

SEQ ID NO: 216737 - RNA, 22 nt, Homo sapiens
uuaaaggcauguacacuagagu

SEQ ID NO: 216738 - RNA, 22 nt, Homo sapiens
uuaaaguaauugaaauggccuu

SEQ ID NO: 216739 - RNA, 22 nt, Homo sapiens
uuaaagugcuguuuuugccggg

SEQ ID NO: 216740 - RNA, 22 nt, Homo sapiens
uuaaaguguuugcagacaggug

SEQ ID NO: 216741 - RNA, 22 nt, Homo sapiens
uuaaaguguuuucaaaauguca

SEQ ID NO: 216742 - RNA, 22 nt, Homo sapiens
uuaaauacagcaugguguuucu

SEQ ID NO: 216743 - RNA, 22 nt, Homo sapiens
uuaaaugcacauacuugagaaa

SEQ ID NO: 216744 - RNA, 22 nt, Homo sapiens
uuaaaugcucacauaaagguag

SEQ ID NO: 216745 - RNA, 21 nt, Homo sapiens
uuaacagacaagugucuuccc

SEQ ID NO: 216746 - RNA, 22 nt, Homo sapiens
uuaacagcacaugcugucccuu

SEQ ID NO: 216747 - RNA, 22 nt, Homo sapiens
uuaacaguuaauucuuuggcaa

SEQ ID NO: 216748 - RNA, 22 nt, Homo sapiens
uuaagacaccaaucauuggauu

SEQ ID NO: 216749 - RNA, 22 nt, Homo sapiens
uuaagcaguaguuaaggagagg

SEQ ID NO: 216750 - RNA, 22 nt, Homo sapiens
uuaagcucauuuccauucuaca

SEQ ID NO: 216751 - RNA, 19 nt, Homo sapiens
uuaaguaguuagagggucu

SEQ ID NO: 216752 - RNA, 22 nt, Homo sapiens
uuaaguuaggcuucagcagucu

SEQ ID NO: 216753 - RNA, 22 nt, Homo sapiens
uuaaguuguagcuacaaauaca

SEQ ID NO: 216754 - RNA, 22 nt, Homo sapiens
uuaauacugcuuaacuuuagga

SEQ ID NO: 216755 - RNA, 22 nt, Homo sapiens
uuaauagcaaagaguuuagacu

SEQ ID NO: 216756 - RNA, 22 nt, Homo sapiens
uuaauagugacucauuuuccac

SEQ ID NO: 216757 - RNA, 21 nt, Homo sapiens
uuaaugcuaugcagaaaaucu

SEQ ID NO: 216758 - RNA, 22 nt, Homo sapiens
uuaauuguccauuauucuguuc

SEQ ID NO: 216759 - RNA, 22 nt, Homo sapiens
uuacaaccucagcagugcaaag

SEQ ID NO: 216760 - RNA, 22 nt, Homo sapiens
uuacaagaugucuguccaacac

SEQ ID NO: 216761 - RNA, 22 nt, Homo sapiens
uuacacaguaggucccuaguaa

SEQ ID NO: 216762 - RNA, 22 nt, Homo sapiens
uuacacaguugguaggggcaga

SEQ ID NO: 216763 - RNA, 22 nt, Homo sapiens
uuacagauggauggcagcuggc

SEQ ID NO: 216764 - RNA, 22 nt, Homo sapiens
uuacagucucaagagugcugca

SEQ ID NO: 216765 - RNA, 22 nt, Homo sapiens
uuacagugguugcuauugugaa

SEQ ID NO: 216766 - RNA, 22 nt, Homo sapiens
uuacaugcaugacaaggugcca

SEQ ID NO: 216767 - RNA, 22 nt, Homo sapiens
uuacaugucuugguaagguuag

SEQ ID NO: 216768 - RNA, 22 nt, Homo sapiens
uuacauguuguggguuguggcc

SEQ ID NO: 216769 - RNA, 22 nt, Homo sapiens
uuacauugcuucaaauucagug

SEQ ID NO: 216770 - RNA, 22 nt, Homo sapiens
uuacccuuuaacccuuuaaagu

SEQ ID NO: 216771 - RNA, 20 nt, Homo sapiens
uuacuauguaguauuggcuc

SEQ ID NO: 216772 - RNA, 22 nt, Homo sapiens
uuacuguagugucauaucguau

SEQ ID NO: 216773 - RNA, 22 nt, Homo sapiens
uuacuugagauggggugucacu

SEQ ID NO: 216774 - RNA, 22 nt, Homo sapiens
uuagauaguacugaaugguucu

SEQ ID NO: 216775 - RNA, 22 nt, Homo sapiens
uuagauaguacuuagggaaaua

SEQ ID NO: 216776 - RNA, 22 nt, Homo sapiens
uuagcacaguucauucauguua

SEQ ID NO: 216777 - RNA, 22 nt, Homo sapiens
uuagcacugucuacucuggauu

SEQ ID NO: 216778 - RNA, 22 nt, Homo sapiens
uuagcagcaccccacucuacug

SEQ ID NO: 216779 - RNA, 22 nt, Homo sapiens
uuagcagccuucaagcuccaag

SEQ ID NO: 216780 - RNA, 22 nt, Homo sapiens
uuagccggguguguuggcgggc

SEQ ID NO: 216781 - RNA, 22 nt, Homo sapiens
uuaggcaggauaguuacauauu

SEQ ID NO: 216782 - RNA, 22 nt, Homo sapiens
uuaggcuaguuucuuaaacucu

SEQ ID NO: 216783 - RNA, 22 nt, Homo sapiens
uuagguuauuacugacaauaau

SEQ ID NO: 216784 - RNA, 23 nt, Homo sapiens
uuaguaaacucaaugacaccaca

SEQ ID NO: 216785 - RNA, 22 nt, Homo sapiens
uuaguagagacgagcguuccac

SEQ ID NO: 216786 - RNA, 20 nt, Homo sapiens
uuagucuccucugcccuguc

SEQ ID NO: 216787 - RNA, 22 nt, Homo sapiens
uuagugaaugcaccacuucuga

SEQ ID NO: 216788 - RNA, 22 nt, Homo sapiens
uuaguuuaucagugguuucuga

SEQ ID NO: 216789 - RNA, 22 nt, Homo sapiens
uuauaacagagacuccugugcu

SEQ ID NO: 216790 - RNA, 22 nt, Homo sapiens
uuauaacucugcagccugguau

SEQ ID NO: 216791 - RNA, 22 nt, Homo sapiens
uuauacuacuauaaagagguag

SEQ ID NO: 216792 - RNA, 22 nt, Homo sapiens
uuauagcuaacaucugugaaaa

SEQ ID NO: 216793 - RNA, 22 nt, Homo sapiens
uuaucacauugacugauuugca

SEQ ID NO: 216794 - RNA, 22 nt, Homo sapiens
uuaucagcagugcgaaaacaga

SEQ ID NO: 216795 - RNA, 22 nt, Homo sapiens
uuaucauagugcaguuuucuga

SEQ ID NO: 216796 - RNA, 22 nt, Homo sapiens
uuauccucuagacauagguuua

SEQ ID NO: 216797 - RNA, 22 nt, Homo sapiens
uuaucucagugaacugagugga

SEQ ID NO: 216798 - RNA, 22 nt, Homo sapiens
uuaugaaguagguuaagagcag

SEQ ID NO: 216799 - RNA, 22 nt, Homo sapiens
uuaugcaucuuccacacucauu

SEQ ID NO: 216800 - RNA, 22 nt, Homo sapiens
aauggcauuugccagggcaaag

SEQ ID NO: 216801 - RNA, 22 nt, Homo sapiens
aauggcucuguuggcccaagac

SEQ ID NO: 216802 - RNA, 18 nt, Homo sapiens
aaugggacuacaaagcca

SEQ ID NO: 216803 - RNA, 22 nt, Homo sapiens
aauggguaguacugugguaaca

SEQ ID NO: 216804 - RNA, 22 nt, Homo sapiens
aaugucaucuucaguuguacag

SEQ ID NO: 216805 - RNA, 22 nt, Homo sapiens
aaugugccuacagugggcuguu

SEQ ID NO: 216806 - RNA, 22 nt, Homo sapiens
aaugugccuacuggagcuugca

SEQ ID NO: 216807 - RNA, 22 nt, Homo sapiens
aaugugcuuugaaaagagcuga

SEQ ID NO: 216808 - RNA, 22 nt, Homo sapiens
aauguguuuugaaaucaggaag

SEQ ID NO: 216809 - RNA, 22 nt, Homo sapiens
aauucacuuguggcagauccuu

SEQ ID NO: 216810 - RNA, 23 nt, Homo sapiens
aauugcacauuccuugcuggcag

SEQ ID NO: 216811 - RNA, 22 nt, Homo sapiens
aauugcauaaaauucaacucug

SEQ ID NO: 216812 - RNA, 22 nt, Homo sapiens
aauugcuucuguauuuuggaca

SEQ ID NO: 216813 - RNA, 23 nt, Homo sapiens
aauugcuuuugaggacuuaguug

SEQ ID NO: 216814 - RNA, 22 nt, Homo sapiens
acaacaguuuuaucaccccaga

SEQ ID NO: 216815 - RNA, 22 nt, Homo sapiens
acaagacuucuuguauucuagu

SEQ ID NO: 216816 - RNA, 22 nt, Homo sapiens
acaagcacaaaugcauagaugg

SEQ ID NO: 216817 - RNA, 22 nt, Homo sapiens
acacacgugcauguaugcguau

SEQ ID NO: 216818 - RNA, 23 nt, Homo sapiens
acacaguaaacuaaaagcuagcu

SEQ ID NO: 216819 - RNA, 22 nt, Homo sapiens
acacaguauaugacaaugcuuu

SEQ ID NO: 216820 - RNA, 22 nt, Homo sapiens
acacaugugcguagacucuuua

SEQ ID NO: 216821 - RNA, 22 nt, Homo sapiens
acacauuagcaagugcuguuau

SEQ ID NO: 216822 - RNA, 22 nt, Homo sapiens
acaccaugucuguuucugguuu

SEQ ID NO: 216823 - RNA, 22 nt, Homo sapiens
acaccuguggucccaguaacuu

SEQ ID NO: 216824 - RNA, 22 nt, Homo sapiens
acacucuaguguucuuaaucag

SEQ ID NO: 216825 - RNA, 22 nt, Homo sapiens
acacuggaggagagcuguugcu

SEQ ID NO: 216826 - RNA, 22 nt, Homo sapiens
acacugucucuugcugaccaug

SEQ ID NO: 216827 - RNA, 22 nt, Homo sapiens
acacuguuuuaguuauuauagc

SEQ ID NO: 216828 - RNA, 22 nt, Homo sapiens
acacuuucuagacaagggaaua

SEQ ID NO: 216829 - RNA, 22 nt, Homo sapiens
acagaccuauuucaaucauuua

SEQ ID NO: 216830 - RNA, 22 nt, Homo sapiens
acagauagacauauauagcuca

SEQ ID NO: 216831 - RNA, 22 nt, Homo sapiens
acagaucagagauauuuagguu

SEQ ID NO: 216832 - RNA, 22 nt, Homo sapiens
acaguacuguuguuugcugcca

SEQ ID NO: 216833 - RNA, 22 nt, Homo sapiens
acaguagaaaacaauggauuug

SEQ ID NO: 216834 - RNA, 22 nt, Homo sapiens
acaguagcgcaaucucggcuca

SEQ ID NO: 216835 - RNA, 23 nt, Homo sapiens
acaguauguggauguggcuaagu

SEQ ID NO: 216836 - RNA, 22 nt, Homo sapiens
acagucacaauuuguaccuuuu

SEQ ID NO: 216837 - RNA, 23 nt, Homo sapiens
acagucuaguuugaagucaggua

SEQ ID NO: 216838 - RNA, 22 nt, Homo sapiens
acagugcuuggcacacaguaau

SEQ ID NO: 216839 - RNA, 22 nt, Homo sapiens
acagugcuuuuguuccucuccu

SEQ ID NO: 216840 - RNA, 22 nt, Homo sapiens
acaguggugcgaucucggcuca

SEQ ID NO: 216841 - RNA, 22 nt, Homo sapiens
acagugucugacacguaggaag

SEQ ID NO: 216842 - RNA, 18 nt, Homo sapiens
acaguguguaaggguucu

SEQ ID NO: 216843 - RNA, 22 nt, Homo sapiens
acaucaggcuugugaugauuac

SEQ ID NO: 216844 - RNA, 22 nt, Homo sapiens
acaucauugggggcuacaggug

SEQ ID NO: 216845 - RNA, 22 nt, Homo sapiens
acauccauuugcuuuauuugcu

SEQ ID NO: 216846 - RNA, 22 nt, Homo sapiens
acaugagacuggguuuguaggg

SEQ ID NO: 216847 - RNA, 22 nt, Homo sapiens
acaugcaucauuaggugguuua

SEQ ID NO: 216848 - RNA, 22 nt, Homo sapiens
acaugguacugauuuacgaaau

SEQ ID NO: 216849 - RNA, 21 nt, Homo sapiens
acauguacacauguaugcaca

SEQ ID NO: 216850 - RNA, 22 nt, Homo sapiens
acauguauauaaugcauagcga

SEQ ID NO: 216851 - RNA, 22 nt, Homo sapiens
acauugcucuuaccaaguuugu

SEQ ID NO: 216852 - RNA, 22 nt, Homo sapiens
accaccauugcacugaacuuuc

SEQ ID NO: 216853 - RNA, 22 nt, Homo sapiens
accagucucagguaugucuuua

SEQ ID NO: 216854 - RNA, 22 nt, Homo sapiens
accaguuuuuuauacaucuucu

SEQ ID NO: 216855 - RNA, 22 nt, Homo sapiens
accaugcaguccaauaugcaca

SEQ ID NO: 216856 - RNA, 22 nt, Homo sapiens
accauugcacuccagccuuggc

SEQ ID NO: 216857 - RNA, 22 nt, Homo sapiens
acccaguguucaacauucacau

SEQ ID NO: 216858 - RNA, 22 nt, Homo sapiens
acccauacacacauauuuaugu

SEQ ID NO: 216859 - RNA, 22 nt, Homo sapiens
accccguagagucugcagcuac

SEQ ID NO: 216860 - RNA, 22 nt, Homo sapiens
acccggagagcaggcgagaagg

SEQ ID NO: 216861 - RNA, 22 nt, Homo sapiens
acccggcaguaauccugcgcgc

SEQ ID NO: 216862 - RNA, 20 nt, Homo sapiens
acccucuaggaugauuucuu

SEQ ID NO: 216863 - RNA, 22 nt, Homo sapiens
acccuggaggucuacagugcag

SEQ ID NO: 216864 - RNA, 22 nt, Homo sapiens
acccuggaguaguaggaaucug

SEQ ID NO: 216865 - RNA, 22 nt, Homo sapiens
acccuguaggugcuggcagaga

SEQ ID NO: 216866 - RNA, 22 nt, Homo sapiens
acccugucagcuggccugggca

SEQ ID NO: 216867 - RNA, 22 nt, Homo sapiens
acccugugaauauuuaaacuuc

SEQ ID NO: 216868 - RNA, 18 nt, Homo sapiens
acccuucagcacugggcc

SEQ ID NO: 216869 - RNA, 22 nt, Homo sapiens
acccuuuagguuggaugaggau

SEQ ID NO: 216870 - RNA, 22 nt, Homo sapiens
accugagacuaggcauuuuaua

SEQ ID NO: 216871 - RNA, 23 nt, Homo sapiens
accugauguuucuguggggagcc

SEQ ID NO: 216872 - RNA, 22 nt, Homo sapiens
accuggguguauguucaguuug

SEQ ID NO: 216873 - RNA, 22 nt, Homo sapiens
accugguuuucucacaguggcu

SEQ ID NO: 216874 - RNA, 19 nt, Homo sapiens
accuguagaaaguacaaca

SEQ ID NO: 216875 - RNA, 23 nt, Homo sapiens
accugugguuauuuuacucuucc

SEQ ID NO: 216876 - RNA, 23 nt, Homo sapiens
accuucauucauucagcugaagu

SEQ ID NO: 216877 - RNA, 22 nt, Homo sapiens
acgugccuuguuguucauauga

SEQ ID NO: 216878 - RNA, 22 nt, Homo sapiens
acuauacuguaacuguauucag

SEQ ID NO: 216879 - RNA, 22 nt, Homo sapiens
acucagagaacauucccagucu

SEQ ID NO: 216880 - RNA, 22 nt, Homo sapiens
acuccauuucauuuuagcucuu

SEQ ID NO: 216881 - RNA, 22 nt, Homo sapiens
acugacaugaucaggcauguuc

SEQ ID NO: 216882 - RNA, 21 nt, Homo sapiens
acugagagaucuggggcacau

SEQ ID NO: 216883 - RNA, 22 nt, Homo sapiens
acugagaucuuuaaauaaauaa

SEQ ID NO: 216884 - RNA, 23 nt, Homo sapiens
acugagcaauguuuacauacuug

SEQ ID NO: 216885 - RNA, 22 nt, Homo sapiens
acugagucauugggugcccaga

SEQ ID NO: 216886 - RNA, 21 nt, Homo sapiens
acugauguuugaaauucgcug

SEQ ID NO: 216887 - RNA, 22 nt, Homo sapiens
acugcacuccaccuugggcaac

SEQ ID NO: 216888 - RNA, 22 nt, Homo sapiens
acugcacuccagcccaggugac

SEQ ID NO: 216889 - RNA, 22 nt, Homo sapiens
acugcacuccagcccgggugac

SEQ ID NO: 216890 - RNA, 22 nt, Homo sapiens
acugcacuccagccuaggcgac

SEQ ID NO: 216891 - RNA, 22 nt, Homo sapiens
acugcacuccagccuccugggu

SEQ ID NO: 216892 - RNA, 22 nt, Homo sapiens
acugcacuccagccucgcaaca

SEQ ID NO: 216893 - RNA, 22 nt, Homo sapiens
acugcacuccagccucggcaau

SEQ ID NO: 216894 - RNA, 22 nt, Homo sapiens
acugcacuccagccucgugaca

SEQ ID NO: 216895 - RNA, 22 nt, Homo sapiens
acugcacuccagccucguggac

SEQ ID NO: 216896 - RNA, 22 nt, Homo sapiens
acugcacuccagccugcccaac

SEQ ID NO: 216897 - RNA, 22 nt, Homo sapiens
acugcacuccagccugccgaca

SEQ ID NO: 216898 - RNA, 22 nt, Homo sapiens
acugcacuccagccugcuggau

SEQ ID NO: 216899 - RNA, 22 nt, Homo sapiens
acugcacuccagccugcuggca

SEQ ID NO: 216900 - RNA, 22 nt, Homo sapiens
acugcacuccagccuggacgaa

SEQ ID NO: 216901 - RNA, 22 nt, Homo sapiens
acugcacuccagccuguugaca

SEQ ID NO: 216902 - RNA, 20 nt, Homo sapiens
acugcacuccagccuuccag

SEQ ID NO: 216903 - RNA, 22 nt, Homo sapiens
acugcacuccagccuucgugac

SEQ ID NO: 216904 - RNA, 22 nt, Homo sapiens
acugcacuccagccuugcgaca

SEQ ID NO: 216905 - RNA, 22 nt, Homo sapiens
acugcacuccagccuugugaca

SEQ ID NO: 216906 - RNA, 22 nt, Homo sapiens
acugcacuccagccuuugcgau

SEQ ID NO: 216907 - RNA, 22 nt, Homo sapiens
acugcacuccagcuccagggug

SEQ ID NO: 216908 - RNA, 22 nt, Homo sapiens
acugcacuccagcuugggugac

SEQ ID NO: 216909 - RNA, 20 nt, Homo sapiens
acugcacuccaggcugccca

SEQ ID NO: 216910 - RNA, 22 nt, Homo sapiens
acugcacuccggccucgugaca

SEQ ID NO: 216911 - RNA, 22 nt, Homo sapiens
acugcacugcagccuggccaac

SEQ ID NO: 216912 - RNA, 22 nt, Homo sapiens
acugcacugucaaccuccuggg

SEQ ID NO: 216913 - RNA, 22 nt, Homo sapiens
acugcacuguccuagaguccuc

SEQ ID NO: 216914 - RNA, 22 nt, Homo sapiens
acugcacuucaaccucauugac

SEQ ID NO: 216915 - RNA, 20 nt, Homo sapiens
acugcacuucagccugcugg

SEQ ID NO: 216916 - RNA, 22 nt, Homo sapiens
acugcacuucagccuugggaaa

SEQ ID NO: 216917 - RNA, 22 nt, Homo sapiens
acugcauaaauauguguaauau

SEQ ID NO: 216918 - RNA, 22 nt, Homo sapiens
acuggcucugcuuuacaaacag

SEQ ID NO: 216919 - RNA, 22 nt, Homo sapiens
acuggcuuaaggaugggccacu

SEQ ID NO: 216920 - RNA, 22 nt, Homo sapiens
acugggucaaaguagaaaacua

SEQ ID NO: 216921 - RNA, 22 nt, Homo sapiens
acuguacuacagccugggugac

SEQ ID NO: 216922 - RNA, 19 nt, Homo sapiens
acuguacuccagucugggc

SEQ ID NO: 216923 - RNA, 22 nt, Homo sapiens
acuguacuccauccugggugac

SEQ ID NO: 216924 - RNA, 22 nt, Homo sapiens
acuuaguauggggcuuuugaga

SEQ ID NO: 216925 - RNA, 22 nt, Homo sapiens
acuuugguuuauagaauuuagg

SEQ ID NO: 216926 - RNA, 22 nt, Homo sapiens
acuuuguguuacccagcaagga

SEQ ID NO: 216927 - RNA, 17 nt, Homo sapiens
acuuuuugaggaggcau

SEQ ID NO: 216928 - RNA, 22 nt, Homo sapiens
acuuuuugaugaggucguuugu

SEQ ID NO: 216929 - RNA, 22 nt, Homo sapiens
acuuuuugauggggagaacauu

SEQ ID NO: 216930 - RNA, 22 nt, Homo sapiens
agaaauguuuacucacccccuu

SEQ ID NO: 216931 - RNA, 20 nt, Homo sapiens
agaaccuguaguguagaggg

SEQ ID NO: 216932 - RNA, 22 nt, Homo sapiens
agaacuguccauucagcaugaa

SEQ ID NO: 216933 - RNA, 22 nt, Homo sapiens
agaagaacauagggugacugaa

SEQ ID NO: 216934 - RNA, 22 nt, Homo sapiens
agaauaauguccccccaaggga

SEQ ID NO: 216935 - RNA, 22 nt, Homo sapiens
agaauacugucuauucauggua

SEQ ID NO: 216936 - RNA, 22 nt, Homo sapiens
agaauguaaacagaauagagga

SEQ ID NO: 216937 - RNA, 22 nt, Homo sapiens
agaauguaacucuaugaaggca

SEQ ID NO: 216938 - RNA, 22 nt, Homo sapiens
agaauguauauucuguaguugu

SEQ ID NO: 216939 - RNA, 22 nt, Homo sapiens
agaaugugaacaucuugaaagu

SEQ ID NO: 216940 - RNA, 22 nt, Homo sapiens
agaauucugucauguuuauauu

SEQ ID NO: 216941 - RNA, 22 nt, Homo sapiens
agacccuguauguguuuaguuu

SEQ ID NO: 216942 - RNA, 22 nt, Homo sapiens
agagaacugauuggaguugggc

SEQ ID NO: 216943 - RNA, 22 nt, Homo sapiens
agagagcuuuaacuacccauuu

SEQ ID NO: 216944 - RNA, 22 nt, Homo sapiens
agagagguggguggagccccca

SEQ ID NO: 216945 - RNA, 22 nt, Homo sapiens
agagcaaugacaugcuaugugg

SEQ ID NO: 216946 - RNA, 22 nt, Homo sapiens
agagcaaugggugaauauuaaa

SEQ ID NO: 216947 - RNA, 22 nt, Homo sapiens
agagccacacucuccuaacuca

SEQ ID NO: 216948 - RNA, 22 nt, Homo sapiens
agagguaagaauaguaguugga

SEQ ID NO: 216949 - RNA, 22 nt, Homo sapiens
agagguguuaaagucucuuuua

SEQ ID NO: 216950 - RNA, 22 nt, Homo sapiens
agagguuuaauugauucacagu

SEQ ID NO: 216951 - RNA, 22 nt, Homo sapiens
agaguacugacguuugcaaauu

SEQ ID NO: 216952 - RNA, 22 nt, Homo sapiens
agaguauagcaacuuaguaaaa

SEQ ID NO: 216953 - RNA, 21 nt, Homo sapiens
agagucaucucuaucuguacc

SEQ ID NO: 216954 - RNA, 22 nt, Homo sapiens
agagugcuaaggaaguaauuua

SEQ ID NO: 216955 - RNA, 22 nt, Homo sapiens
agauauuuguuaggucugucag

SEQ ID NO: 216956 - RNA, 22 nt, Homo sapiens
agaucacagucuuugguuuuag

SEQ ID NO: 216957 - RNA, 23 nt, Homo sapiens
agaugcaucuggcugcgaggcaa

SEQ ID NO: 216958 - RNA, 20 nt, Homo sapiens
agaugcaugcacauaaacac

SEQ ID NO: 216959 - RNA, 22 nt, Homo sapiens
agaugcauuuuuauuggaauac

SEQ ID NO: 216960 - RNA, 22 nt, Homo sapiens
agaugccuaugaagagaaauua

SEQ ID NO: 216961 - RNA, 22 nt, Homo sapiens
agauggguuuucacauguuggc

SEQ ID NO: 216962 - RNA, 22 nt, Homo sapiens
agauggugauaaaugugguacc

SEQ ID NO: 216963 - RNA, 22 nt, Homo sapiens
agaugguguuuucucaccagau

SEQ ID NO: 216964 - RNA, 22 nt, Homo sapiens
agcaacauagaaauuugggugg

SEQ ID NO: 216965 - RNA, 22 nt, Homo sapiens
agcaacaucagcagcaggaaaa

SEQ ID NO: 216966 - RNA, 22 nt, Homo sapiens
agcaacauugagacugcaguug

SEQ ID NO: 216967 - RNA, 22 nt, Homo sapiens
agcaacauuuuugaccuuucuu

SEQ ID NO: 216968 - RNA, 22 nt, Homo sapiens
agcaagauugauggccugcagg

SEQ ID NO: 216969 - RNA, 22 nt, Homo sapiens
agcaccacauacuacagagaua

SEQ ID NO: 216970 - RNA, 22 nt, Homo sapiens
agcagagcauauucauucgggg

SEQ ID NO: 216971 - RNA, 22 nt, Homo sapiens
agcagcaccaaacagacuaaga

SEQ ID NO: 216972 - RNA, 22 nt, Homo sapiens
agcagcaucgggaaguuggcca

SEQ ID NO: 216973 - RNA, 22 nt, Homo sapiens
agcagcauuaugauauaucuua

SEQ ID NO: 216974 - RNA, 21 nt, Homo sapiens
agcagcuuugguugaagcaga

SEQ ID NO: 216975 - RNA, 22 nt, Homo sapiens
agcaguguggccuuagacccgg

SEQ ID NO: 216976 - RNA, 20 nt, Homo sapiens
agcaucacagagccgggugu

SEQ ID NO: 216977 - RNA, 18 nt, Homo sapiens
agcaucacugaucauccu

SEQ ID NO: 216978 - RNA, 19 nt, Homo sapiens
agcaucauuauuguuuugg

SEQ ID NO: 216979 - RNA, 20 nt, Homo sapiens
agcaucauugcaauuuguca

SEQ ID NO: 216980 - RNA, 20 nt, Homo sapiens
agcaucguuguguuauagcc

SEQ ID NO: 216981 - RNA, 20 nt, Homo sapiens
agcauugguuagaacaguag

SEQ ID NO: 216982 - RNA, 22 nt, Homo sapiens
agccgauguugacaccagggga

SEQ ID NO: 216983 - RNA, 22 nt, Homo sapiens
agccgguguccacgaagaagag

SEQ ID NO: 216984 - RNA, 22 nt, Homo sapiens
agccuagagagccacuuugaga

SEQ ID NO: 216985 - RNA, 22 nt, Homo sapiens
agcuaaaucucauguugaauug

SEQ ID NO: 216986 - RNA, 22 nt, Homo sapiens
agcugauuuuaaguccuugucc

SEQ ID NO: 216987 - RNA, 22 nt, Homo sapiens
agcugcacaaauggaugugagg

SEQ ID NO: 216988 - RNA, 22 nt, Homo sapiens
agcugcacugguauaggagaaa

SEQ ID NO: 216989 - RNA, 22 nt, Homo sapiens
agcuggcuguagcugcaagucu

SEQ ID NO: 216990 - RNA, 22 nt, Homo sapiens
agcuggcuguggagaaaccccu

SEQ ID NO: 216991 - RNA, 22 nt, Homo sapiens
agcugguauuuguuagggaguu

SEQ ID NO: 216992 - RNA, 22 nt, Homo sapiens
agcugguauuuugucgaggacu

SEQ ID NO: 216993 - RNA, 22 nt, Homo sapiens
agcuggucuacguguguaugag

SEQ ID NO: 216994 - RNA, 22 nt, Homo sapiens
agcuggucucaggugcccugcu

SEQ ID NO: 216995 - RNA, 22 nt, Homo sapiens
agcugguuuauuucuauauccu

SEQ ID NO: 216996 - RNA, 19 nt, Homo sapiens
agcuguguugccugugaga

SEQ ID NO: 216997 - RNA, 22 nt, Homo sapiens
agcuguuguuaauuaacucauu

SEQ ID NO: 216998 - RNA, 22 nt, Homo sapiens
agcuguuuuugugggcauguga

SEQ ID NO: 216999 - RNA, 22 nt, Homo sapiens
agcuucauucugaauagguuga

SEQ ID NO: 217000 - RNA, 22 nt, Homo sapiens
agcuuguguuuuucuaaguauc

SEQ ID NO: 217001 - RNA, 22 nt, Homo sapiens
agcuuuggauaccugcuguucc

SEQ ID NO: 217002 - RNA, 22 nt, Homo sapiens
aggaaauguuggucccauuucu

SEQ ID NO: 217003 - RNA, 22 nt, Homo sapiens
aggaauggaaacuuuugauggu

SEQ ID NO: 217004 - RNA, 22 nt, Homo sapiens
aggaauguuaguacuucuuagu

SEQ ID NO: 217005 - RNA, 22 nt, Homo sapiens
aggacacugauagucuuuggca

SEQ ID NO: 217006 - RNA, 22 nt, Homo sapiens
aggagaauugguucuucuugau

SEQ ID NO: 217007 - RNA, 22 nt, Homo sapiens
aggagaucagccucccugcaac

SEQ ID NO: 217008 - RNA, 23 nt, Homo sapiens
aggagcuuagaaguugccauugc

SEQ ID NO: 217009 - RNA, 22 nt, Homo sapiens
aggagguagaacauugccauuu

SEQ ID NO: 217010 - RNA, 22 nt, Homo sapiens
aggagguagggugugaaacagc

SEQ ID NO: 217011 - RNA, 22 nt, Homo sapiens
aggagguagucugucccuuagc

SEQ ID NO: 217012 - RNA, 22 nt, Homo sapiens
aggcaacgugcauuucuggugu

SEQ ID NO: 217013 - RNA, 22 nt, Homo sapiens
aggcaagaaugcuuguuucacc

SEQ ID NO: 217014 - RNA, 22 nt, Homo sapiens
aggcaagagugacuacgugaaa

SEQ ID NO: 217015 - RNA, 22 nt, Homo sapiens
aggcaagcaucuugcucccuuc

SEQ ID NO: 217016 - RNA, 22 nt, Homo sapiens
aggcaagugauagcugcguaau

SEQ ID NO: 217017 - RNA, 22 nt, Homo sapiens
aggcaagugggagacagcauuu

SEQ ID NO: 217018 - RNA, 22 nt, Homo sapiens
aggcagucucugccggcugagg

SEQ ID NO: 217019 - RNA, 22 nt, Homo sapiens
aggcaguuucagugagagguga

SEQ ID NO: 217020 - RNA, 22 nt, Homo sapiens
aggcaugauuguauuuugcucu

SEQ ID NO: 217021 - RNA, 19 nt, Homo sapiens
aggcauugugcucaucugu

SEQ ID NO: 217022 - RNA, 22 nt, Homo sapiens
aggcuguguggauaauauuggg

SEQ ID NO: 217023 - RNA, 22 nt, Homo sapiens
aggcuuauuaagauucccuuau

SEQ ID NO: 217024 - RNA, 22 nt, Homo sapiens
aggcuuuuggagaacacugcac

SEQ ID NO: 217025 - RNA, 22 nt, Homo sapiens
aggcuuuuggagguggcuuucu

SEQ ID NO: 217026 - RNA, 22 nt, Homo sapiens
aggcuuuuguuuuggucucagg

SEQ ID NO: 217027 - RNA, 22 nt, Homo sapiens
agggagcaaaguggucuuucuc

SEQ ID NO: 217028 - RNA, 22 nt, Homo sapiens
agggcacuguagguccugccuc

SEQ ID NO: 217029 - RNA, 22 nt, Homo sapiens
agggcaguguuaggacugucug

SEQ ID NO: 217030 - RNA, 22 nt, Homo sapiens
agggcuuguuuaacuaucauua

SEQ ID NO: 217031 - RNA, 20 nt, Homo sapiens
agguacacugacaugccuuc

SEQ ID NO: 217032 - RNA, 22 nt, Homo sapiens
agguagaguguuuuguucuucu

SEQ ID NO: 217033 - RNA, 22 nt, Homo sapiens
agguagucuuuuccuauuguca

SEQ ID NO: 217034 - RNA, 22 nt, Homo sapiens
agguauauuggacagauguaaa

SEQ ID NO: 217035 - RNA, 22 nt, Homo sapiens
aggugacugguuuaucuggcag

SEQ ID NO: 217036 - RNA, 22 nt, Homo sapiens
aggugcugagcagagaauccug

SEQ ID NO: 217037 - RNA, 22 nt, Homo sapiens
aggugguguuggguuccagccc

SEQ ID NO: 217038 - RNA, 22 nt, Homo sapiens
aggugguuuuaggcagagacau

SEQ ID NO: 217039 - RNA, 23 nt, Homo sapiens
agguuaugauuauagagcgagga

SEQ ID NO: 217040 - RNA, 22 nt, Homo sapiens
agguucccuuuuggccugggau

SEQ ID NO: 217041 - RNA, 22 nt, Homo sapiens
agguuguguuugugauuagaua

SEQ ID NO: 217042 - RNA, 22 nt, Homo sapiens
agguuguugcaugcuccuuagg

SEQ ID NO: 217043 - RNA, 22 nt, Homo sapiens
aguaaacuucagaguucuuccu

SEQ ID NO: 217044 - RNA, 22 nt, Homo sapiens
aguaaagcuacucacugugggc

SEQ ID NO: 217045 - RNA, 22 nt, Homo sapiens
aguaaauuucugugcuuucaua

SEQ ID NO: 217046 - RNA, 22 nt, Homo sapiens
aguaagucucaagguaggguag

SEQ ID NO: 217047 - RNA, 22 nt, Homo sapiens
aguaaucaucugagggcagaaa

SEQ ID NO: 217048 - RNA, 22 nt, Homo sapiens
aguacugucugguuaccugaca

SEQ ID NO: 217049 - RNA, 22 nt, Homo sapiens
aguaucaagccacacaugguca

SEQ ID NO: 217050 - RNA, 22 nt, Homo sapiens
agucaagugggguuagauaguu

SEQ ID NO: 217051 - RNA, 22 nt, Homo sapiens
agucaagugguuucugaguugg

SEQ ID NO: 217052 - RNA, 22 nt, Homo sapiens
agucacagccuuuuacuuuaga

SEQ ID NO: 217053 - RNA, 22 nt, Homo sapiens
agucacagugaccuugucugac

SEQ ID NO: 217054 - RNA, 23 nt, Homo sapiens
agucaguaugcuccuuggauccc

SEQ ID NO: 217055 - RNA, 22 nt, Homo sapiens
agucaguguguauugauggcac

SEQ ID NO: 217056 - RNA, 21 nt, Homo sapiens
agucauaggaguacauaaugc

SEQ ID NO: 217057 - RNA, 22 nt, Homo sapiens
agucauggcagaaggcaccucu

SEQ ID NO: 217058 - RNA, 22 nt, Homo sapiens
agugauggagccaggauuuaau

SEQ ID NO: 217059 - RNA, 22 nt, Homo sapiens
agugauguggaguuuggaugga

SEQ ID NO: 217060 - RNA, 22 nt, Homo sapiens
agugcaaagccgagguuucuug

SEQ ID NO: 217061 - RNA, 22 nt, Homo sapiens
agugcaauggugccaucauagc

SEQ ID NO: 217062 - RNA, 22 nt, Homo sapiens
agugcauugagacuugugaguu

SEQ ID NO: 217063 - RNA, 22 nt, Homo sapiens
agugcauugcaucucugcuuca

SEQ ID NO: 217064 - RNA, 23 nt, Homo sapiens
agugccuaguauauaggaggcgc

SEQ ID NO: 217065 - RNA, 22 nt, Homo sapiens
agugcuuaauagauguccagca

SEQ ID NO: 217066 - RNA, 22 nt, Homo sapiens
aguggaaucuguuauacuaacu

SEQ ID NO: 217067 - RNA, 22 nt, Homo sapiens
aguggaguguaaagcgucuuuu

SEQ ID NO: 217068 - RNA, 22 nt, Homo sapiens
aguggcacuauucucagaguca

SEQ ID NO: 217069 - RNA, 22 nt, Homo sapiens
agugggccccuagaggugaggu

SEQ ID NO: 217070 - RNA, 22 nt, Homo sapiens
aguggguguuccauuggauaaa

SEQ ID NO: 217071 - RNA, 19 nt, Homo sapiens
aguggguguuuucuguuug

SEQ ID NO: 217072 - RNA, 22 nt, Homo sapiens
agugucaggagacagguagcug

SEQ ID NO: 217073 - RNA, 22 nt, Homo sapiens
aguguuuuuaacaagaaagggu

SEQ ID NO: 217074 - RNA, 22 nt, Homo sapiens
aguguuuuuaucaugaaagggu

SEQ ID NO: 217075 - RNA, 22 nt, Homo sapiens
aguucaaugcucuuucuacuau

SEQ ID NO: 217076 - RNA, 22 nt, Homo sapiens
aguuccauuuauucucgucucu

SEQ ID NO: 217077 - RNA, 22 nt, Homo sapiens
aguugcaagucuugaguaaaga

SEQ ID NO: 217078 - RNA, 22 nt, Homo sapiens
aguuggccccuacugggaggug

SEQ ID NO: 217079 - RNA, 19 nt, Homo sapiens
auaaacuagaacugucccc

SEQ ID NO: 217080 - RNA, 18 nt, Homo sapiens
auaaacucaucauuuuua

SEQ ID NO: 217081 - RNA, 22 nt, Homo sapiens
auaaacugucaguggagaguaa

SEQ ID NO: 217082 - RNA, 19 nt, Homo sapiens
auaaaugccuacaagggug

SEQ ID NO: 217083 - RNA, 20 nt, Homo sapiens
auaaauguauagguguacau

SEQ ID NO: 217084 - RNA, 22 nt, Homo sapiens
auaaauucauuuaagcuccuua

SEQ ID NO: 217085 - RNA, 22 nt, Homo sapiens
auaacagcugcaaggcaaaagc

SEQ ID NO: 217086 - RNA, 22 nt, Homo sapiens
auaacauggaguuugucauuua

SEQ ID NO: 217087 - RNA, 19 nt, Homo sapiens
auaagugaaucacgggggc

SEQ ID NO: 217088 - RNA, 22 nt, Homo sapiens
auaauagguugauugacauugc

SEQ ID NO: 217089 - RNA, 22 nt, Homo sapiens
auaaucaugucugaaaccuuug

SEQ ID NO: 217090 - RNA, 22 nt, Homo sapiens
auaauguuugauugagcagaua

SEQ ID NO: 217091 - RNA, 18 nt, Homo sapiens
auacaagcagcagagauu

SEQ ID NO: 217092 - RNA, 22 nt, Homo sapiens
auacaagugccauguuggugug

SEQ ID NO: 217093 - RNA, 22 nt, Homo sapiens
auacagcuaaaauauuaaguua

SEQ ID NO: 217094 - RNA, 22 nt, Homo sapiens
auacaguguauguauaguacau

SEQ ID NO: 217095 - RNA, 22 nt, Homo sapiens
auacauguucaagggcauauau

SEQ ID NO: 217096 - RNA, 22 nt, Homo sapiens
auacccauacauauuggugacu

SEQ ID NO: 217097 - RNA, 22 nt, Homo sapiens
auacguacauaugcacauaugg

SEQ ID NO: 217098 - RNA, 22 nt, Homo sapiens
auacugguuuuugucaugugga

SEQ ID NO: 217099 - RNA, 22 nt, Homo sapiens
auacugucucuugcuccugccc

SEQ ID NO: 217100 - RNA, 20 nt, Homo sapiens
auagaagacuagugcagcag

SEQ ID NO: 217101 - RNA, 22 nt, Homo sapiens
auagaagcuauguauaggggcc

SEQ ID NO: 217102 - RNA, 22 nt, Homo sapiens
auagaagcugccaacguuucag

SEQ ID NO: 217103 - RNA, 22 nt, Homo sapiens
auagagcuggcagacacccuua

SEQ ID NO: 217104 - RNA, 22 nt, Homo sapiens
auagaggacugaggugaucuuu

SEQ ID NO: 217105 - RNA, 22 nt, Homo sapiens
auagaguccugcucgaguugcu

SEQ ID NO: 217106 - RNA, 21 nt, Homo sapiens
augaauguaaagaauguggga

SEQ ID NO: 217107 - RNA, 23 nt, Homo sapiens
augaauguaaggaguguaagaaa

SEQ ID NO: 217108 - RNA, 22 nt, Homo sapiens
augacaagagccuucuuuccuu

SEQ ID NO: 217109 - RNA, 22 nt, Homo sapiens
augacaaugaaucccuguuuca

SEQ ID NO: 217110 - RNA, 22 nt, Homo sapiens
augacauagcauggugccugcu

SEQ ID NO: 217111 - RNA, 22 nt, Homo sapiens
augacauguauuuccaggauuu

SEQ ID NO: 217112 - RNA, 22 nt, Homo sapiens
augacauugaaaagcaagugga

SEQ ID NO: 217113 - RNA, 22 nt, Homo sapiens
augaccaaugggcagagcuaga

SEQ ID NO: 217114 - RNA, 22 nt, Homo sapiens
augacguugugggcucucaagc

SEQ ID NO: 217115 - RNA, 22 nt, Homo sapiens
augacuagaggagggauggcca

SEQ ID NO: 217116 - RNA, 22 nt, Homo sapiens
augacuauugcacuuuccuggu

SEQ ID NO: 217117 - RNA, 18 nt, Homo sapiens
augacucuggguguuccu

SEQ ID NO: 217118 - RNA, 22 nt, Homo sapiens
augagaacugucaaugagagcu

SEQ ID NO: 217119 - RNA, 22 nt, Homo sapiens
augagaaucauuucagcuugua

SEQ ID NO: 217120 - RNA, 22 nt, Homo sapiens
augagagcuaacuguggguaca

SEQ ID NO: 217121 - RNA, 22 nt, Homo sapiens
augagauaggaacaaacuuaca

SEQ ID NO: 217122 - RNA, 22 nt, Homo sapiens
augagauuguuuguacuccaca

SEQ ID NO: 217123 - RNA, 22 nt, Homo sapiens
augagcaaagagaugagacccu

SEQ ID NO: 217124 - RNA, 22 nt, Homo sapiens
augagcaucaccagaaucaaua

SEQ ID NO: 217125 - RNA, 22 nt, Homo sapiens
augagcuauggagcucccaccu

SEQ ID NO: 217126 - RNA, 22 nt, Homo sapiens
augagcucauugggugacuggg

SEQ ID NO: 217127 - RNA, 22 nt, Homo sapiens
augagcugauuuccuuaccaua

SEQ ID NO: 217128 - RNA, 22 nt, Homo sapiens
augaggcacugcgcccuacuga

SEQ ID NO: 217129 - RNA, 22 nt, Homo sapiens
augagggagggguggugccgca

SEQ ID NO: 217130 - RNA, 22 nt, Homo sapiens
augaggugauuucuguucgggu

SEQ ID NO: 217131 - RNA, 21 nt, Homo sapiens
augagguguacuguggugaaa

SEQ ID NO: 217132 - RNA, 20 nt, Homo sapiens
augagguguaugacacugaa

SEQ ID NO: 217133 - RNA, 22 nt, Homo sapiens
augaguaguugcuaaauauuga

SEQ ID NO: 217134 - RNA, 22 nt, Homo sapiens
augauaaguuauuagaagaaga

SEQ ID NO: 217135 - RNA, 22 nt, Homo sapiens
augauacuguucuaagauuuuu

SEQ ID NO: 217136 - RNA, 22 nt, Homo sapiens
augauagucuugagaagcauuu

SEQ ID NO: 217137 - RNA, 22 nt, Homo sapiens
augauauuauucuagcccagag

SEQ ID NO: 217138 - RNA, 22 nt, Homo sapiens
augaucauggaagugcacccau

SEQ ID NO: 217139 - RNA, 22 nt, Homo sapiens
augaucuagaguaggaaacaga

SEQ ID NO: 217140 - RNA, 22 nt, Homo sapiens
augaucuguagaacuaguccuu

SEQ ID NO: 217141 - RNA, 22 nt, Homo sapiens
augauggagguagauuguccau

SEQ ID NO: 217142 - RNA, 22 nt, Homo sapiens
augauucugaucuagagcuugg

SEQ ID NO: 217143 - RNA, 22 nt, Homo sapiens
augauuguucucacucaagaga

SEQ ID NO: 217144 - RNA, 22 nt, Homo sapiens
augcaaacaucugaagagacau

SEQ ID NO: 217145 - RNA, 19 nt, Homo sapiens
augcaaugucacaggcugc

SEQ ID NO: 217146 - RNA, 22 nt, Homo sapiens
augcaauucuagauugauagua

SEQ ID NO: 217147 - RNA, 22 nt, Homo sapiens
augcacauauguacugcccuau

SEQ ID NO: 217148 - RNA, 22 nt, Homo sapiens
augcacaugcgaaaacuugugu

SEQ ID NO: 217149 - RNA, 22 nt, Homo sapiens
augcacuguauaggaucuugcg

SEQ ID NO: 217150 - RNA, 22 nt, Homo sapiens
augcacuguuuucuugaugaga

SEQ ID NO: 217151 - RNA, 22 nt, Homo sapiens
augcagguguuuugcacugagu

SEQ ID NO: 217152 - RNA, 22 nt, Homo sapiens
augcauagugggaugcucugug

SEQ ID NO: 217153 - RNA, 22 nt, Homo sapiens
augccaagagacaaagggaauc

SEQ ID NO: 217154 - RNA, 22 nt, Homo sapiens
augccacagaaauaaccaaaau

SEQ ID NO: 217155 - RNA, 19 nt, Homo sapiens
augccacagugaggucaga

SEQ ID NO: 217156 - RNA, 22 nt, Homo sapiens
augccacugcacuucagccugg

SEQ ID NO: 217157 - RNA, 22 nt, Homo sapiens
augccacugcacuucagcuugg

SEQ ID NO: 217158 - RNA, 22 nt, Homo sapiens
augccacuucucuaagucaugu

SEQ ID NO: 217159 - RNA, 22 nt, Homo sapiens
augccaguguccagaguggguu

SEQ ID NO: 217160 - RNA, 22 nt, Homo sapiens
augcccauuuguuuucugaaag

SEQ ID NO: 217161 - RNA, 19 nt, Homo sapiens
augccuggagaugguuaua

SEQ ID NO: 217162 - RNA, 22 nt, Homo sapiens
augcuaugugugacuucuuaug

SEQ ID NO: 217163 - RNA, 22 nt, Homo sapiens
augcuggugcuagaaacuggaa

SEQ ID NO: 217164 - RNA, 22 nt, Homo sapiens
augcuguuuugaauucucuaga

SEQ ID NO: 217165 - RNA, 22 nt, Homo sapiens
augcuguuuuguagcucccucu

SEQ ID NO: 217166 - RNA, 22 nt, Homo sapiens
auggaaagcuguuccuacacaa

SEQ ID NO: 217167 - RNA, 19 nt, Homo sapiens
auggaacugcuggagccac

SEQ ID NO: 217168 - RNA, 22 nt, Homo sapiens
auggaagcauaguauucuauug

SEQ ID NO: 217169 - RNA, 22 nt, Homo sapiens
auggaagcugauuagauaguac

SEQ ID NO: 217170 - RNA, 22 nt, Homo sapiens
auggaauguggaaugguaagua

SEQ ID NO: 217171 - RNA, 22 nt, Homo sapiens
auggaggacaaugucaccuuca

SEQ ID NO: 217172 - RNA, 22 nt, Homo sapiens
auggaggaggaagcugaaacaa

SEQ ID NO: 217173 - RNA, 22 nt, Homo sapiens
auggaggccuacagaauuuugg

SEQ ID NO: 217174 - RNA, 22 nt, Homo sapiens
auggauauuuuuugaacauaga

SEQ ID NO: 217175 - RNA, 22 nt, Homo sapiens
auggauguucuagggaugugau

SEQ ID NO: 217176 - RNA, 22 nt, Homo sapiens
auggauuuguaguacaugguug

SEQ ID NO: 217177 - RNA, 22 nt, Homo sapiens
auggauuuuggggccagaggca

SEQ ID NO: 217178 - RNA, 22 nt, Homo sapiens
auggcaauaauagcuaccauuu

SEQ ID NO: 217179 - RNA, 22 nt, Homo sapiens
auggcacuguguauuuuucugu

SEQ ID NO: 217180 - RNA, 22 nt, Homo sapiens
auggcagcaccccacucuacug

SEQ ID NO: 217181 - RNA, 22 nt, Homo sapiens
auggcagcccucuuuauccaug

SEQ ID NO: 217182 - RNA, 22 nt, Homo sapiens
auggcagugagucucuaguauu

SEQ ID NO: 217183 - RNA, 22 nt, Homo sapiens
auggcauggugcaggguuuaag

SEQ ID NO: 217184 - RNA, 22 nt, Homo sapiens
auggcccugaguucaauauauu

SEQ ID NO: 217185 - RNA, 22 nt, Homo sapiens
auggcccugcuaccacuuuucu

SEQ ID NO: 217186 - RNA, 22 nt, Homo sapiens
auggccuuucuggcacauuucc

SEQ ID NO: 217187 - RNA, 22 nt, Homo sapiens
auggccuuuuuaucucaccaag

SEQ ID NO: 217188 - RNA, 22 nt, Homo sapiens
auggcguggagauauggucagc

SEQ ID NO: 217189 - RNA, 22 nt, Homo sapiens
auggcguguggcuuggaggcug

SEQ ID NO: 217190 - RNA, 22 nt, Homo sapiens
auggcucaguguguaucuauca

SEQ ID NO: 217191 - RNA, 22 nt, Homo sapiens
auggcugugagaucgacuuauu

SEQ ID NO: 217192 - RNA, 22 nt, Homo sapiens
auggcuguuccugggaguucua

SEQ ID NO: 217193 - RNA, 22 nt, Homo sapiens
auggcuguuucugcaaugucua

SEQ ID NO: 217194 - RNA, 22 nt, Homo sapiens
auggcuguuuuuuauguuacag

SEQ ID NO: 217195 - RNA, 22 nt, Homo sapiens
auggcuucuuacucuucugcau

SEQ ID NO: 217196 - RNA, 22 nt, Homo sapiens
auggcuugugacccaugcuuca

SEQ ID NO: 217197 - RNA, 22 nt, Homo sapiens
auggcuuuaagagugucugaau

SEQ ID NO: 217198 - RNA, 22 nt, Homo sapiens
auggcuuucaggacguggcgag

SEQ ID NO: 217199 - RNA, 22 nt, Homo sapiens
auggcuuugggcugcucugccc

SEQ ID NO: 217200 - RNA, 22 nt, Homo sapiens
auggcuuuggucucccagugau

SEQ ID NO: 217201 - RNA, 22 nt, Homo sapiens
augggacugggugccguggagc

SEQ ID NO: 217202 - RNA, 22 nt, Homo sapiens
augggcuaguaaagacaaacuu

SEQ ID NO: 217203 - RNA, 22 nt, Homo sapiens
augggguaggcuugcuguagua

SEQ ID NO: 217204 - RNA, 22 nt, Homo sapiens
augggguaggcuuugcugcagu

SEQ ID NO: 217205 - RNA, 22 nt, Homo sapiens
augggguagguagcucggggaa

SEQ ID NO: 217206 - RNA, 17 nt, Homo sapiens
augggguuguagcccca

SEQ ID NO: 217207 - RNA, 22 nt, Homo sapiens
augguagacucucgggucaugg

SEQ ID NO: 217208 - RNA, 22 nt, Homo sapiens
caagggguggaaaugguagugu

SEQ ID NO: 217209 - RNA, 22 nt, Homo sapiens
caaggugcugagacaggagccc

SEQ ID NO: 217210 - RNA, 22 nt, Homo sapiens
caaguacugggcuauggauauu

SEQ ID NO: 217211 - RNA, 22 nt, Homo sapiens
caaugcauuauucucccacuuc

SEQ ID NO: 217212 - RNA, 21 nt, Homo sapiens
caauggcacaaucucugcuca

SEQ ID NO: 217213 - RNA, 22 nt, Homo sapiens
caauggcacuauuggaaaaggu

SEQ ID NO: 217214 - RNA, 22 nt, Homo sapiens
caauugcacucuuagguguaca

SEQ ID NO: 217215 - RNA, 22 nt, Homo sapiens
cacaaaguagauuagucuucca

SEQ ID NO: 217216 - RNA, 22 nt, Homo sapiens
cacaaugucuaagauguuucua

SEQ ID NO: 217217 - RNA, 22 nt, Homo sapiens
cacaaugucugguaggccacuu

SEQ ID NO: 217218 - RNA, 22 nt, Homo sapiens
cacaggaagaggcacggucccu

SEQ ID NO: 217219 - RNA, 22 nt, Homo sapiens
cacaguagaauagagcacuagg

SEQ ID NO: 217220 - RNA, 22 nt, Homo sapiens
cacagugaacugguggguuuuu

SEQ ID NO: 217221 - RNA, 22 nt, Homo sapiens
cacaguguuacugguaugaagu

SEQ ID NO: 217222 - RNA, 21 nt, Homo sapiens
cacauggaggcagagagugua

SEQ ID NO: 217223 - RNA, 22 nt, Homo sapiens
cacauugaauuucugaugacaa

SEQ ID NO: 217224 - RNA, 22 nt, Homo sapiens
caccaaccucaguagcaucugu

SEQ ID NO: 217225 - RNA, 22 nt, Homo sapiens
caccacagccauuauugucccc

SEQ ID NO: 217226 - RNA, 22 nt, Homo sapiens
caccacauuccauugaucaggc

SEQ ID NO: 217227 - RNA, 22 nt, Homo sapiens
caccacuacaccccaggcuggg

SEQ ID NO: 217228 - RNA, 22 nt, Homo sapiens
caccagguggcugaggccauga

SEQ ID NO: 217229 - RNA, 19 nt, Homo sapiens
caccagugcaugcuacuau

SEQ ID NO: 217230 - RNA, 22 nt, Homo sapiens
cacccaguaagcaugaggcccu

SEQ ID NO: 217231 - RNA, 22 nt, Homo sapiens
caccccuaccugagucaggagu

SEQ ID NO: 217232 - RNA, 19 nt, Homo sapiens
caccgccugcccccugcug

SEQ ID NO: 217233 - RNA, 22 nt, Homo sapiens
caccugagcgggaugcucgccu

SEQ ID NO: 217234 - RNA, 22 nt, Homo sapiens
cacuaccucuacaggcagcugg

SEQ ID NO: 217235 - RNA, 22 nt, Homo sapiens
cacuaggcuggagugcaguggc

SEQ ID NO: 217236 - RNA, 22 nt, Homo sapiens
cacugcacuccagcuuugguga

SEQ ID NO: 217237 - RNA, 22 nt, Homo sapiens
cacugcacucuucuucugggca

SEQ ID NO: 217238 - RNA, 21 nt, Homo sapiens
cacugcaucacaggacagcau

SEQ ID NO: 217239 - RNA, 22 nt, Homo sapiens
cacugcauuacucaugagcaug

SEQ ID NO: 217240 - RNA, 22 nt, Homo sapiens
cacuggguuagaacaugcuccu

SEQ ID NO: 217241 - RNA, 18 nt, Homo sapiens
cacuuggcuuugccccuc

SEQ ID NO: 217242 - RNA, 22 nt, Homo sapiens
cagacagugucccgagucccug

SEQ ID NO: 217243 - RNA, 22 nt, Homo sapiens
cagagaacauucagagcuguag

SEQ ID NO: 217244 - RNA, 22 nt, Homo sapiens
cagagguauugcaaaagccuag

SEQ ID NO: 217245 - RNA, 22 nt, Homo sapiens
cagauggucuuaaggcagccuu

SEQ ID NO: 217246 - RNA, 22 nt, Homo sapiens
cagcacauuacaaguacuuggu

SEQ ID NO: 217247 - RNA, 22 nt, Homo sapiens
cagcuaaauuguuaaauccaag

SEQ ID NO: 217248 - RNA, 22 nt, Homo sapiens
cagcuaguaauuuauugaagau

SEQ ID NO: 217249 - RNA, 22 nt, Homo sapiens
caggcaacauggcgaaacucug

SEQ ID NO: 217250 - RNA, 22 nt, Homo sapiens
caggcacgcuugggagacacac

SEQ ID NO: 217251 - RNA, 22 nt, Homo sapiens
caggcagucuggcucccaagug

SEQ ID NO: 217252 - RNA, 22 nt, Homo sapiens
cagguacauuuuaaagggcuca

SEQ ID NO: 217253 - RNA, 22 nt, Homo sapiens
cagguagucaacgggucuugga

SEQ ID NO: 217254 - RNA, 19 nt, Homo sapiens
cagguagugugcugacaug

SEQ ID NO: 217255 - RNA, 22 nt, Homo sapiens
caguacaauguggaaaaggagu

SEQ ID NO: 217256 - RNA, 22 nt, Homo sapiens
caguacaauguugauuagaagu

SEQ ID NO: 217257 - RNA, 22 nt, Homo sapiens
caguagcaugccucagaaugag

SEQ ID NO: 217258 - RNA, 22 nt, Homo sapiens
caguaguagccccuuagaugga

SEQ ID NO: 217259 - RNA, 22 nt, Homo sapiens
cagugacacugaaaaguucggg

SEQ ID NO: 217260 - RNA, 22 nt, Homo sapiens
cagugauaggugguuguuggca

SEQ ID NO: 217261 - RNA, 20 nt, Homo sapiens
cagugcacuuucccacuggu

SEQ ID NO: 217262 - RNA, 22 nt, Homo sapiens
cagugcauccauguucagcagu

SEQ ID NO: 217263 - RNA, 22 nt, Homo sapiens
cagugcauguggcacucuccag

SEQ ID NO: 217264 - RNA, 22 nt, Homo sapiens
caguggacuaaauggggaauau

SEQ ID NO: 217265 - RNA, 22 nt, Homo sapiens
cagugguuuucaacccugguug

SEQ ID NO: 217266 - RNA, 22 nt, Homo sapiens
cagugguuuucucaguucagca

SEQ ID NO: 217267 - RNA, 22 nt, Homo sapiens
caguguuuuuaacaggugcccg

SEQ ID NO: 217268 - RNA, 22 nt, Homo sapiens
caguuacuugacacaaccaauu

SEQ ID NO: 217269 - RNA, 22 nt, Homo sapiens
caguuacuuuugcaccaaccua

SEQ ID NO: 217270 - RNA, 22 nt, Homo sapiens
caguugcacuagccccguuuca

SEQ ID NO: 217271 - RNA, 22 nt, Homo sapiens
caguugguguacauauauguau

SEQ ID NO: 217272 - RNA, 22 nt, Homo sapiens
cauaaagauggaggaggccagg

SEQ ID NO: 217273 - RNA, 22 nt, Homo sapiens
cauaaaucuuguugaauagcac

SEQ ID NO: 217274 - RNA, 22 nt, Homo sapiens
cauacagcuaguaaguguaaga

SEQ ID NO: 217275 - RNA, 22 nt, Homo sapiens
cauacaguaggcacuauuugua

SEQ ID NO: 217276 - RNA, 22 nt, Homo sapiens
cauagcacacauuuaccuaugu

SEQ ID NO: 217277 - RNA, 22 nt, Homo sapiens
cauagcacacguauaccuaugu

SEQ ID NO: 217278 - RNA, 22 nt, Homo sapiens
cauagcacugagcucuacccuc

SEQ ID NO: 217279 - RNA, 22 nt, Homo sapiens
cauagcacugcacuucagccug

SEQ ID NO: 217280 - RNA, 21 nt, Homo sapiens
caucaaauugucauggugggu

SEQ ID NO: 217281 - RNA, 22 nt, Homo sapiens
caucacacuuggauguaagaca

SEQ ID NO: 217282 - RNA, 22 nt, Homo sapiens
caucacaguacuaaucgucaua

SEQ ID NO: 217283 - RNA, 22 nt, Homo sapiens
caucacuguugguacaaguaau

SEQ ID NO: 217284 - RNA, 22 nt, Homo sapiens
caucagcaauguaugaggguuc

SEQ ID NO: 217285 - RNA, 22 nt, Homo sapiens
caucaggugaggauucaaugca

SEQ ID NO: 217286 - RNA, 22 nt, Homo sapiens
caucauugcacccuauagagaa

SEQ ID NO: 217287 - RNA, 22 nt, Homo sapiens
caucccauucgaggggcacagc

SEQ ID NO: 217288 - RNA, 22 nt, Homo sapiens
caucgcacuccagcuugggcaa

SEQ ID NO: 217289 - RNA, 22 nt, Homo sapiens
caucucauugaauugcugagca

SEQ ID NO: 217290 - RNA, 23 nt, Homo sapiens
caugaacuaguuugcagccauga

SEQ ID NO: 217291 - RNA, 22 nt, Homo sapiens
caugcacugaguccaccucugg

SEQ ID NO: 217292 - RNA, 22 nt, Homo sapiens
caugcauuggucuauuauguga

SEQ ID NO: 217293 - RNA, 22 nt, Homo sapiens
cauggccuuuggaaugugucua

SEQ ID NO: 217294 - RNA, 22 nt, Homo sapiens
cauggcucuuguuuacucccag

SEQ ID NO: 217295 - RNA, 22 nt, Homo sapiens
cauggcuuuuauaacaagaaau

SEQ ID NO: 217296 - RNA, 22 nt, Homo sapiens
cauggucaccuuccaaguuauu

SEQ ID NO: 217297 - RNA, 22 nt, Homo sapiens
cauguaacaucccgcuguagga

SEQ ID NO: 217298 - RNA, 22 nt, Homo sapiens
caugucuuuuaaacauucaacu

SEQ ID NO: 217299 - RNA, 22 nt, Homo sapiens
cauugcaauccagccugggcaa

SEQ ID NO: 217300 - RNA, 22 nt, Homo sapiens
cauugcaaugaggucuugcagu

SEQ ID NO: 217301 - RNA, 22 nt, Homo sapiens
cauugcacuccacuccugaaca

SEQ ID NO: 217302 - RNA, 22 nt, Homo sapiens
cauugcacuccagccuagccaa

SEQ ID NO: 217303 - RNA, 22 nt, Homo sapiens
cauugcacuccagccugaggga

SEQ ID NO: 217304 - RNA, 22 nt, Homo sapiens
cauugcacuccagccugaguga

SEQ ID NO: 217305 - RNA, 20 nt, Homo sapiens
cauugcacuccagccugcug

SEQ ID NO: 217306 - RNA, 22 nt, Homo sapiens
cauugcacuccagccuggcaac

SEQ ID NO: 217307 - RNA, 16 nt, Homo sapiens
cauugcacucuagccu

SEQ ID NO: 217308 - RNA, 22 nt, Homo sapiens
cauugcacucuaucccgguggg

SEQ ID NO: 217309 - RNA, 22 nt, Homo sapiens
cauugguuccaguuuguccuua

SEQ ID NO: 217310 - RNA, 22 nt, Homo sapiens
cucccugagccagggcuuugac

SEQ ID NO: 217311 - RNA, 20 nt, Homo sapiens
cuccuucauuccuuuggacc

SEQ ID NO: 217312 - RNA, 21 nt, Homo sapiens
cucucugcuuaugaauaguga

SEQ ID NO: 217313 - RNA, 22 nt, Homo sapiens
cucuggauauuccugucuaaaa

SEQ ID NO: 217314 - RNA, 22 nt, Homo sapiens
cucugguucugcagugcacccu

SEQ ID NO: 217315 - RNA, 22 nt, Homo sapiens
cucuuuaguaagcaguugauga

SEQ ID NO: 217316 - RNA, 22 nt, Homo sapiens
cucuuugaggugagcugcccau

SEQ ID NO: 217317 - RNA, 22 nt, Homo sapiens
cucuuugaugugaaccgugguu

SEQ ID NO: 217318 - RNA, 22 nt, Homo sapiens
cucuuuggaugccuuaggguua

SEQ ID NO: 217319 - RNA, 22 nt, Homo sapiens
cugaagugugaaagucuuuuuu

SEQ ID NO: 217320 - RNA, 22 nt, Homo sapiens
cugaaucauugguuaugaguac

SEQ ID NO: 217321 - RNA, 22 nt, Homo sapiens
cugaauguucuauagaagccgc

SEQ ID NO: 217322 - RNA, 22 nt, Homo sapiens
cugacagaugacugccacugua

SEQ ID NO: 217323 - RNA, 22 nt, Homo sapiens
cugacaucuucaagugaggaga

SEQ ID NO: 217324 - RNA, 22 nt, Homo sapiens
cugacaugcagccacugcaccu

SEQ ID NO: 217325 - RNA, 22 nt, Homo sapiens
cugaccuaugauuuggcucaaa

SEQ ID NO: 217326 - RNA, 22 nt, Homo sapiens
cugacuuuagaacccaaaaagu

SEQ ID NO: 217327 - RNA, 22 nt, Homo sapiens
cugagaacaucauucagauauu

SEQ ID NO: 217328 - RNA, 22 nt, Homo sapiens
cugagauaggacucugcuggcu

SEQ ID NO: 217329 - RNA, 22 nt, Homo sapiens
cugagaucaagucuugcucugu

SEQ ID NO: 217330 - RNA, 22 nt, Homo sapiens
cugagauuaagauauugggagu

SEQ ID NO: 217331 - RNA, 22 nt, Homo sapiens
cugaggauauucagccucugug

SEQ ID NO: 217332 - RNA, 22 nt, Homo sapiens
cugaggcacggcgaccuuaagu

SEQ ID NO: 217333 - RNA, 22 nt, Homo sapiens
cugagguaauuuuccagauaau

SEQ ID NO: 217334 - RNA, 22 nt, Homo sapiens
cugagguaggcccugagaauau

SEQ ID NO: 217335 - RNA, 22 nt, Homo sapiens
cugagguauaucccauuagaag

SEQ ID NO: 217336 - RNA, 22 nt, Homo sapiens
cugaggugauauauacauauuu

SEQ ID NO: 217337 - RNA, 22 nt, Homo sapiens
cugagguuguucuucucagugg

SEQ ID NO: 217338 - RNA, 18 nt, Homo sapiens
cugagucauuccuggguc

SEQ ID NO: 217339 - RNA, 22 nt, Homo sapiens
cugauauuuuaaaauuggcugg

SEQ ID NO: 217340 - RNA, 21 nt, Homo sapiens
cugaucacaggugagcugccu

SEQ ID NO: 217341 - RNA, 22 nt, Homo sapiens
cugaucuggaggugucugggga

SEQ ID NO: 217342 - RNA, 22 nt, Homo sapiens
cugaugaaguauuuguucugga

SEQ ID NO: 217343 - RNA, 22 nt, Homo sapiens
cugauugucuauuuaguucacu

SEQ ID NO: 217344 - RNA, 21 nt, Homo sapiens
cugcaaaugcugcugccugau

SEQ ID NO: 217345 - RNA, 22 nt, Homo sapiens
cugcaagaaucguaguauuuga

SEQ ID NO: 217346 - RNA, 19 nt, Homo sapiens
cugcaagguaauaggucag

SEQ ID NO: 217347 - RNA, 20 nt, Homo sapiens
cugcacauccacucuacuuc

SEQ ID NO: 217348 - RNA, 22 nt, Homo sapiens
cugcagguaggggcagcuuugg

SEQ ID NO: 217349 - RNA, 22 nt, Homo sapiens
cugcaguaaccacuguaggugu

SEQ ID NO: 217350 - RNA, 22 nt, Homo sapiens
cugcauuugaugacguauggug

SEQ ID NO: 217351 - RNA, 18 nt, Homo sapiens
cugccagugugcucuccg

SEQ ID NO: 217352 - RNA, 22 nt, Homo sapiens
cugccaguuugauucgggccac

SEQ ID NO: 217353 - RNA, 22 nt, Homo sapiens
cugcccguaauccucuccccag

SEQ ID NO: 217354 - RNA, 22 nt, Homo sapiens
cugccuaaagaaaaagacguug

SEQ ID NO: 217355 - RNA, 22 nt, Homo sapiens
cugccuagaucugaaccuggcu

SEQ ID NO: 217356 - RNA, 22 nt, Homo sapiens
cugccuagauguuguagggggu

SEQ ID NO: 217357 - RNA, 22 nt, Homo sapiens
cuggaaagaaacccuuaauucu

SEQ ID NO: 217358 - RNA, 22 nt, Homo sapiens
cuggaaaguagacaaucuaaaa

SEQ ID NO: 217359 - RNA, 22 nt, Homo sapiens
cuggaauauuagcuggucuuaa

SEQ ID NO: 217360 - RNA, 22 nt, Homo sapiens
cuggaaugugagccccaaaaag

SEQ ID NO: 217361 - RNA, 22 nt, Homo sapiens
cuggaauguuccuaaagauuca

SEQ ID NO: 217362 - RNA, 22 nt, Homo sapiens
cuggaauucaaaaucugaauuu

SEQ ID NO: 217363 - RNA, 22 nt, Homo sapiens
cuggacaaaucuggaaagaacc

SEQ ID NO: 217364 - RNA, 22 nt, Homo sapiens
cuggacguugaggcugcaguga

SEQ ID NO: 217365 - RNA, 22 nt, Homo sapiens
cuggagauuaaccaauugccau

SEQ ID NO: 217366 - RNA, 22 nt, Homo sapiens
cuggagcaaaggugacucuugu

SEQ ID NO: 217367 - RNA, 22 nt, Homo sapiens
cuggcaaauguuuucuguaaag

SEQ ID NO: 217368 - RNA, 22 nt, Homo sapiens
cuggcaagaggauaaaguccua

SEQ ID NO: 217369 - RNA, 22 nt, Homo sapiens
cuggcucugagguguuuagggc

SEQ ID NO: 217370 - RNA, 22 nt, Homo sapiens
cuggcucuguuagaagaaccag

SEQ ID NO: 217371 - RNA, 22 nt, Homo sapiens
cugggaucaguucuagucagaa

SEQ ID NO: 217372 - RNA, 22 nt, Homo sapiens
cugggauggaggagaauuagag

SEQ ID NO: 217373 - RNA, 22 nt, Homo sapiens
cugggaugugacuguugccccc

SEQ ID NO: 217374 - RNA, 22 nt, Homo sapiens
cugguaugcuucauaugcaaac

SEQ ID NO: 217375 - RNA, 22 nt, Homo sapiens
cuggugugugacuuuucauuau

SEQ ID NO: 217376 - RNA, 21 nt, Homo sapiens
cugguguuagcacuucuuccc

SEQ ID NO: 217377 - RNA, 22 nt, Homo sapiens
cugguuuguaaaguuccugaga

SEQ ID NO: 217378 - RNA, 22 nt, Homo sapiens
cuguaacagaauaaauuuguuu

SEQ ID NO: 217379 - RNA, 22 nt, Homo sapiens
cuguaaggcacuaagcauaugu

SEQ ID NO: 217380 - RNA, 22 nt, Homo sapiens
cuguaauguaaugagacuacau

SEQ ID NO: 217381 - RNA, 23 nt, Homo sapiens
cuguacacauauacaucuaagua

SEQ ID NO: 217382 - RNA, 22 nt, Homo sapiens
cuguagcuuuuauaugcuuagc

SEQ ID NO: 217383 - RNA, 22 nt, Homo sapiens
cuguaguuagcagaugaugaau

SEQ ID NO: 217384 - RNA, 22 nt, Homo sapiens
cugucucagccucuccaguagc

SEQ ID NO: 217385 - RNA, 22 nt, Homo sapiens
cugucucagugaauugguuuua

SEQ ID NO: 217386 - RNA, 22 nt, Homo sapiens
cugucuggaguccuucgugugc

SEQ ID NO: 217387 - RNA, 22 nt, Homo sapiens
cugugaagaaagucauugguag

SEQ ID NO: 217388 - RNA, 22 nt, Homo sapiens
cugugcauaucuuggacugugu

SEQ ID NO: 217389 - RNA, 22 nt, Homo sapiens
cuguugcaguuauggcugcagg

SEQ ID NO: 217390 - RNA, 22 nt, Homo sapiens
cuuaaagcgaauauugguggua

SEQ ID NO: 217391 - RNA, 22 nt, Homo sapiens
cuuagcaaugucguguacucac

SEQ ID NO: 217392 - RNA, 20 nt, Homo sapiens
cuuaucaguggcaaguauaa

SEQ ID NO: 217393 - RNA, 22 nt, Homo sapiens
cuucaaguaauucugauggcua

SEQ ID NO: 217394 - RNA, 22 nt, Homo sapiens
cuucaagucuuuggauaauuag

SEQ ID NO: 217395 - RNA, 22 nt, Homo sapiens
cuucaaguuggaagggaccuaa

SEQ ID NO: 217396 - RNA, 22 nt, Homo sapiens
cuucagcaauauauccccuggg

SEQ ID NO: 217397 - RNA, 22 nt, Homo sapiens
cuuccagcuggguucagucagu

SEQ ID NO: 217398 - RNA, 22 nt, Homo sapiens
cuuccauaguauuuuuacaaaa

SEQ ID NO: 217399 - RNA, 22 nt, Homo sapiens
cuuccugaguccugggcucaca

SEQ ID NO: 217400 - RNA, 18 nt, Homo sapiens
cuuccuuagucugguuaa

SEQ ID NO: 217401 - RNA, 22 nt, Homo sapiens
cuucuguuaguucugauaacuu

SEQ ID NO: 217402 - RNA, 22 nt, Homo sapiens
cuucuugagggccugcugggaa

SEQ ID NO: 217403 - RNA, 21 nt, Homo sapiens
cuucuuggggcagggcagggu

SEQ ID NO: 217404 - RNA, 22 nt, Homo sapiens
cuugacacugguuuucugaaua

SEQ ID NO: 217405 - RNA, 22 nt, Homo sapiens
cuugaccaauauggugaaaccc

SEQ ID NO: 217406 - RNA, 22 nt, Homo sapiens
cuugaccuauggaucuguuuuu

SEQ ID NO: 217407 - RNA, 22 nt, Homo sapiens
cuugagcuugagauccuuucug

SEQ ID NO: 217408 - RNA, 22 nt, Homo sapiens
cuugccuuugucuucaaaggcu

SEQ ID NO: 217409 - RNA, 22 nt, Homo sapiens
cuuggauuauaauggaauauuu

SEQ ID NO: 217410 - RNA, 22 nt, Homo sapiens
cuuggcuccgacuccccuccaa

SEQ ID NO: 217411 - RNA, 20 nt, Homo sapiens
cuuggcuuucuugguguuaa

SEQ ID NO: 217412 - RNA, 22 nt, Homo sapiens
gagcaucaguggccucaucuca

SEQ ID NO: 217413 - RNA, 22 nt, Homo sapiens
gagcaucauucaacaaaagucu

SEQ ID NO: 217414 - RNA, 22 nt, Homo sapiens
gagcuagaauauuuuguauagu

SEQ ID NO: 217415 - RNA, 22 nt, Homo sapiens
gagcuagggucaugcuacugca

SEQ ID NO: 217416 - RNA, 21 nt, Homo sapiens
gagcuaggugaggcuguaaug

SEQ ID NO: 217417 - RNA, 22 nt, Homo sapiens
gagcuaguguaauauuuugggg

SEQ ID NO: 217418 - RNA, 22 nt, Homo sapiens
gagcugaauugcugccauuugc

SEQ ID NO: 217419 - RNA, 22 nt, Homo sapiens
gagcugaucuuuucugauucca

SEQ ID NO: 217420 - RNA, 22 nt, Homo sapiens
gaggagucagacugugcaaggu

SEQ ID NO: 217421 - RNA, 22 nt, Homo sapiens
gaggaucucuugagcccagaag

SEQ ID NO: 217422 - RNA, 22 nt, Homo sapiens
gaggcagucugacccuuagcag

SEQ ID NO: 217423 - RNA, 22 nt, Homo sapiens
gaggcagucuguccauucucag

SEQ ID NO: 217424 - RNA, 22 nt, Homo sapiens
gaggcagucugucccuuagcag

SEQ ID NO: 217425 - RNA, 22 nt, Homo sapiens
gaggcauuauucccaucuuaca

SEQ ID NO: 217426 - RNA, 22 nt, Homo sapiens
gaggcauugaagauauggaagu

SEQ ID NO: 217427 - RNA, 22 nt, Homo sapiens
gagguaagaguuuuccauuucu

SEQ ID NO: 217428 - RNA, 22 nt, Homo sapiens
gagguaaguggauuaugagguc

SEQ ID NO: 217429 - RNA, 22 nt, Homo sapiens
gagguagaauguuuuucagcug

SEQ ID NO: 217430 - RNA, 22 nt, Homo sapiens
gagguaggaggauugcuuaagg

SEQ ID NO: 217431 - RNA, 22 nt, Homo sapiens
gagguaguuaaugcauucacua

SEQ ID NO: 217432 - RNA, 22 nt, Homo sapiens
gagguauagaacaccuuucaag

SEQ ID NO: 217433 - RNA, 22 nt, Homo sapiens
gaguauguauaugagugugucu

SEQ ID NO: 217434 - RNA, 21 nt, Homo sapiens
gagugcaaauaaagagagggc

SEQ ID NO: 217435 - RNA, 22 nt, Homo sapiens
gagugcaauggcaccgucucgg

SEQ ID NO: 217436 - RNA, 22 nt, Homo sapiens
gagugcaauggcaugaucuugg

SEQ ID NO: 217437 - RNA, 22 nt, Homo sapiens
gagugcaauggugcuaucucgg

SEQ ID NO: 217438 - RNA, 22 nt, Homo sapiens
gagugcuguuagcccuggguuu

SEQ ID NO: 217439 - RNA, 22 nt, Homo sapiens
gaguuagguugucaaugucuua

SEQ ID NO: 217440 - RNA, 22 nt, Homo sapiens
gaguucaaaucucagcucuguu

SEQ ID NO: 217441 - RNA, 22 nt, Homo sapiens
gaguucauuuugaaaccuugau

SEQ ID NO: 217442 - RNA, 22 nt, Homo sapiens
gaguuuguaaacuauucacuaa

SEQ ID NO: 217443 - RNA, 22 nt, Homo sapiens
gauaaagauagcaauagggaca

SEQ ID NO: 217444 - RNA, 18 nt, Homo sapiens
gauaacaguggacuaugc

SEQ ID NO: 217445 - RNA, 22 nt, Homo sapiens
gauaagagaugauuuugccaug

SEQ ID NO: 217446 - RNA, 22 nt, Homo sapiens
gauagcagccauucuuuuuauu

SEQ ID NO: 217447 - RNA, 22 nt, Homo sapiens
gauagcauucaauuaucuguug

SEQ ID NO: 217448 - RNA, 22 nt, Homo sapiens
gauagguucuaagcagguguug

SEQ ID NO: 217449 - RNA, 22 nt, Homo sapiens
gauaucuuuuguauggugagcu

SEQ ID NO: 217450 - RNA, 22 nt, Homo sapiens
gauaugugauaagaguuaucuu

SEQ ID NO: 217451 - RNA, 22 nt, Homo sapiens
gauauguucugagaaaugcauu

SEQ ID NO: 217452 - RNA, 22 nt, Homo sapiens
gauauguuguuggauucgguua

SEQ ID NO: 217453 - RNA, 22 nt, Homo sapiens
gaucacaguuccucacgggcau

SEQ ID NO: 217454 - RNA, 22 nt, Homo sapiens
gaucacauggccauuucuagcu

SEQ ID NO: 217455 - RNA, 22 nt, Homo sapiens
gaucacaugggagaaugagagu

SEQ ID NO: 217456 - RNA, 19 nt, Homo sapiens
gaucuguugaucaaugugu

SEQ ID NO: 217457 - RNA, 22 nt, Homo sapiens
gaucuguuucaauugucuuagu

SEQ ID NO: 217458 - RNA, 22 nt, Homo sapiens
gaugacagugaguaaccccaac

SEQ ID NO: 217459 - RNA, 22 nt, Homo sapiens
gaugaggcuagagacaugugua

SEQ ID NO: 217460 - RNA, 22 nt, Homo sapiens
gaugagguaguguaccuagucu

SEQ ID NO: 217461 - RNA, 22 nt, Homo sapiens
gaugauauuugagucauuagaa

SEQ ID NO: 217462 - RNA, 22 nt, Homo sapiens
gaugauguugaauguucucacc

SEQ ID NO: 217463 - RNA, 22 nt, Homo sapiens
gaugcaaauuaagcuugggaca

SEQ ID NO: 217464 - RNA, 22 nt, Homo sapiens
gaugcagcuaggauuugugaca

SEQ ID NO: 217465 - RNA, 22 nt, Homo sapiens
gaugccuuuuuguccucaguua

SEQ ID NO: 217466 - RNA, 22 nt, Homo sapiens
gauggcacuaagccauguagga

SEQ ID NO: 217467 - RNA, 22 nt, Homo sapiens
gauggcacuguagcaacacaaa

SEQ ID NO: 217468 - RNA, 22 nt, Homo sapiens
gauggugucccaggcucaggcu

SEQ ID NO: 217469 - RNA, 22 nt, Homo sapiens
gaugguuuuuuaagaagagccu

SEQ ID NO: 217470 - RNA, 22 nt, Homo sapiens
gauguagaaagagugggcugga

SEQ ID NO: 217471 - RNA, 22 nt, Homo sapiens
gauguguugggaagauuucaag

SEQ ID NO: 217472 - RNA, 22 nt, Homo sapiens
gauguguuuguuucuggaggag

SEQ ID NO: 217473 - RNA, 22 nt, Homo sapiens
gauguuguuuagccuuugaugu

SEQ ID NO: 217474 - RNA, 22 nt, Homo sapiens
gauuagaacagaagucagauua

SEQ ID NO: 217475 - RNA, 22 nt, Homo sapiens
gauuccacuuucugucucuaug

SEQ ID NO: 217476 - RNA, 22 nt, Homo sapiens
gauuccauuuguggcuauuuac

SEQ ID NO: 217477 - RNA, 22 nt, Homo sapiens
gauuggcauugcugcaccugag

SEQ ID NO: 217478 - RNA, 22 nt, Homo sapiens
gauugguugaaaguagaauacu

SEQ ID NO: 217479 - RNA, 22 nt, Homo sapiens
gauuuguuggccugugagcuag

SEQ ID NO: 217480 - RNA, 22 nt, Homo sapiens
gcaaaaaguagugcugguuagg

SEQ ID NO: 217481 - RNA, 22 nt, Homo sapiens
gcaaaauugagaagggaauaua

SEQ ID NO: 217482 - RNA, 22 nt, Homo sapiens
gcaaaguguuuuccaacuuggu

SEQ ID NO: 217483 - RNA, 22 nt, Homo sapiens
gcaaaugcuaugccauuuuaua

SEQ ID NO: 217484 - RNA, 22 nt, Homo sapiens
gcaagaauggaacaggagagcc

SEQ ID NO: 217485 - RNA, 22 nt, Homo sapiens
gcaagagguaucuuauuuuccc

SEQ ID NO: 217486 - RNA, 22 nt, Homo sapiens
gcaagaguauuucaaggaagau

SEQ ID NO: 217487 - RNA, 22 nt, Homo sapiens
gcaaugcugucugugcacagau

SEQ ID NO: 217488 - RNA, 22 nt, Homo sapiens
gcacaaugccugacgaguccug

SEQ ID NO: 217489 - RNA, 22 nt, Homo sapiens
gcacacuuacacgaaccuagau

SEQ ID NO: 217490 - RNA, 22 nt, Homo sapiens
gcacaggguuacauucuaaggu

SEQ ID NO: 217491 - RNA, 22 nt, Homo sapiens
gcaccccuuaccgggcuggguu

SEQ ID NO: 217492 - RNA, 22 nt, Homo sapiens
gcacugagagaagccccaagua

SEQ ID NO: 217493 - RNA, 22 nt, Homo sapiens
gcagaauugguuucuucuaagg

SEQ ID NO: 217494 - RNA, 19 nt, Homo sapiens
gcagagaugugguagcuug

SEQ ID NO: 217495 - RNA, 22 nt, Homo sapiens
gcagcagugcccuggauggaaa

SEQ ID NO: 217496 - RNA, 22 nt, Homo sapiens
gcagcaucaaaucacacaagau

SEQ ID NO: 217497 - RNA, 22 nt, Homo sapiens
gcagguaguuucugacuuuuac

SEQ ID NO: 217498 - RNA, 22 nt, Homo sapiens
gcaguagugugaucuuggcuca

SEQ ID NO: 217499 - RNA, 22 nt, Homo sapiens
gcagucacagggagauggugac

SEQ ID NO: 217500 - RNA, 22 nt, Homo sapiens
gcagucaucugaaggcuuaacu

SEQ ID NO: 217501 - RNA, 22 nt, Homo sapiens
gcaguggugugugccagccuag

SEQ ID NO: 217502 - RNA, 20 nt, Homo sapiens
gcaguguucugaccugaauc

SEQ ID NO: 217503 - RNA, 22 nt, Homo sapiens
gcaguguucugggcaggaagaa

SEQ ID NO: 217504 - RNA, 22 nt, Homo sapiens
gcaguguuggggccggaggcug

SEQ ID NO: 217505 - RNA, 22 nt, Homo sapiens
gcauaugucuuuauagcagcau

SEQ ID NO: 217506 - RNA, 20 nt, Homo sapiens
gcauaugucuuuauggcagc

SEQ ID NO: 217507 - RNA, 17 nt, Homo sapiens
gcauauguugaaccagc

SEQ ID NO: 217508 - RNA, 22 nt, Homo sapiens
gccaaaaugcugggauuacagg

SEQ ID NO: 217509 - RNA, 22 nt, Homo sapiens
gccaagauuuaauucaucaguu

SEQ ID NO: 217510 - RNA, 22 nt, Homo sapiens
gccagugugaugugaucauggc

SEQ ID NO: 217511 - RNA, 21 nt, Homo sapiens
gccaguguggcaauuuuucaa

SEQ ID NO: 217512 - RNA, 22 nt, Homo sapiens
gccaguguuuuauugagaauuu

SEQ ID NO: 217513 - RNA, 22 nt, Homo sapiens
gccauggaggauuuauagaggc

SEQ ID NO: 217514 - RNA, 20 nt, Homo sapiens
uagcagcagacagagggagg

SEQ ID NO: 217515 - RNA, 22 nt, Homo sapiens
uagcagcauaaauggacuaaga

SEQ ID NO: 217516 - RNA, 20 nt, Homo sapiens
uagcaggugucaggugauau

SEQ ID NO: 217517 - RNA, 22 nt, Homo sapiens
uagcaguaccccaguauccugg

SEQ ID NO: 217518 - RNA, 22 nt, Homo sapiens
uagcaguauacguacugggucc

SEQ ID NO: 217519 - RNA, 22 nt, Homo sapiens
uagcagugugaaaacggacuaa

SEQ ID NO: 217520 - RNA, 22 nt, Homo sapiens
uagcaguuguuguuacuuguau

SEQ ID NO: 217521 - RNA, 22 nt, Homo sapiens
uagccucacaaagugcuuaaga

SEQ ID NO: 217522 - RNA, 22 nt, Homo sapiens
uagcucagcccagcuaagcuca

SEQ ID NO: 217523 - RNA, 22 nt, Homo sapiens
uagcuccagugggguuacugcu

SEQ ID NO: 217524 - RNA, 22 nt, Homo sapiens
uagcugagacuacaguaggugc

SEQ ID NO: 217525 - RNA, 22 nt, Homo sapiens
uagcugcaaaauauagacuucu

SEQ ID NO: 217526 - RNA, 22 nt, Homo sapiens
uagcugcacuuacaagugagaa

SEQ ID NO: 217527 - RNA, 22 nt, Homo sapiens
uagcuguuggugggaagucaga

SEQ ID NO: 217528 - RNA, 22 nt, Homo sapiens
uaggaaguacaucucagaaucu

SEQ ID NO: 217529 - RNA, 19 nt, Homo sapiens
uaggacccugguggccccc

SEQ ID NO: 217530 - RNA, 20 nt, Homo sapiens
uaggagcaaugagaguagaa

SEQ ID NO: 217531 - RNA, 22 nt, Homo sapiens
uaggagcauaggauuguuugag

SEQ ID NO: 217532 - RNA, 22 nt, Homo sapiens
uaggagugugaacccuguuuug

SEQ ID NO: 217533 - RNA, 22 nt, Homo sapiens
uaggaucauuuuauguugccca

SEQ ID NO: 217534 - RNA, 22 nt, Homo sapiens
uaggcacuguguuuguaggagu

SEQ ID NO: 217535 - RNA, 22 nt, Homo sapiens
uagggaguuuuggggugcagaa

SEQ ID NO: 217536 - RNA, 22 nt, Homo sapiens
uagggcauguguggaguguaug

SEQ ID NO: 217537 - RNA, 22 nt, Homo sapiens
uagggcuugugaucagguguag

SEQ ID NO: 217538 - RNA, 22 nt, Homo sapiens
uagggcuuuccggccugucaga

SEQ ID NO: 217539 - RNA, 22 nt, Homo sapiens
uagguaagauguuaacagcuga

SEQ ID NO: 217540 - RNA, 22 nt, Homo sapiens
uagguaaguaauauacagauga

SEQ ID NO: 217541 - RNA, 22 nt, Homo sapiens
uagguaaguaugugugaugggg

SEQ ID NO: 217542 - RNA, 22 nt, Homo sapiens
uagguaguaaauugauagagga

SEQ ID NO: 217543 - RNA, 22 nt, Homo sapiens
uagguaguugugggcuugaaug

SEQ ID NO: 217544 - RNA, 22 nt, Homo sapiens
uagguuauucauucaucauuua

SEQ ID NO: 217545 - RNA, 22 nt, Homo sapiens
uaguaaacauuuuucuaucauu

SEQ ID NO: 217546 - RNA, 22 nt, Homo sapiens
uaguaacacauugaacgaucgc

SEQ ID NO: 217547 - RNA, 22 nt, Homo sapiens
uaguauguuuauagcauugagu

SEQ ID NO: 217548 - RNA, 22 nt, Homo sapiens
uagugcccuuauaagagcagga

SEQ ID NO: 217549 - RNA, 21 nt, Homo sapiens
uagugcugaggcaguauggga

SEQ ID NO: 217550 - RNA, 22 nt, Homo sapiens
uagugcuguaauucuaaugaaa

SEQ ID NO: 217551 - RNA, 22 nt, Homo sapiens
uagugcugugauuaacauaaug

SEQ ID NO: 217552 - RNA, 18 nt, Homo sapiens
uagugcuguucucaugau

SEQ ID NO: 217553 - RNA, 20 nt, Homo sapiens
uaguggcaugcaccuguagc

SEQ ID NO: 217554 - RNA, 22 nt, Homo sapiens
uaguucguguuugaacuagauc

SEQ ID NO: 217555 - RNA, 22 nt, Homo sapiens
uauaacaaugcaagaauggccu

SEQ ID NO: 217556 - RNA, 22 nt, Homo sapiens
uauaaccauuucuucucucuuc

SEQ ID NO: 217557 - RNA, 22 nt, Homo sapiens
uauaagacuagcagcugaauug

SEQ ID NO: 217558 - RNA, 22 nt, Homo sapiens
uauacagcaaguuacugugcug

SEQ ID NO: 217559 - RNA, 22 nt, Homo sapiens
uauacaugugggcaucaggaga

SEQ ID NO: 217560 - RNA, 22 nt, Homo sapiens
uauagcaaugccccacuccuga

SEQ ID NO: 217561 - RNA, 20 nt, Homo sapiens
uauagcaauuuuuuucuccu

SEQ ID NO: 217562 - RNA, 22 nt, Homo sapiens
uauagcacugaaagaggugauu

SEQ ID NO: 217563 - RNA, 22 nt, Homo sapiens
uauagcacugaccuuccaggac

SEQ ID NO: 217564 - RNA, 22 nt, Homo sapiens
uauagcacugagaauguaauuc

SEQ ID NO: 217565 - RNA, 22 nt, Homo sapiens
uauagcacugcaauauuucccu

SEQ ID NO: 217566 - RNA, 22 nt, Homo sapiens
uauagcagugaguauugacuaa

SEQ ID NO: 217567 - RNA, 22 nt, Homo sapiens
uauagcuauuguuaauggaacu

SEQ ID NO: 217568 - RNA, 22 nt, Homo sapiens
uauagcuugaaggaauggucau

SEQ ID NO: 217569 - RNA, 22 nt, Homo sapiens
uauagcuugauuauggugaugg

SEQ ID NO: 217570 - RNA, 22 nt, Homo sapiens
uauaugcauugugggguacuga

SEQ ID NO: 217571 - RNA, 22 nt, Homo sapiens
uauauguucugugucccuuucg

SEQ ID NO: 217572 - RNA, 22 nt, Homo sapiens
uaucaagaugacaaacuuugcu

SEQ ID NO: 217573 - RNA, 22 nt, Homo sapiens
uaucaagauggauaaggauaga

SEQ ID NO: 217574 - RNA, 22 nt, Homo sapiens
uaucaaguguuagggagaugug

SEQ ID NO: 217575 - RNA, 22 nt, Homo sapiens
uaucacacuggaagaaguuaag

SEQ ID NO: 217576 - RNA, 22 nt, Homo sapiens
uaucacagcgggguguacaccc

SEQ ID NO: 217577 - RNA, 20 nt, Homo sapiens
uaucacaggucagaaacccu

SEQ ID NO: 217578 - RNA, 22 nt, Homo sapiens
uaucacaggucaggaaccuugu

SEQ ID NO: 217579 - RNA, 22 nt, Homo sapiens
uaucacaguaaaucugggugca

SEQ ID NO: 217580 - RNA, 21 nt, Homo sapiens
uaucacaguagaauaggaucu

SEQ ID NO: 217581 - RNA, 22 nt, Homo sapiens
uaucacaguaucuagcacagug

SEQ ID NO: 217582 - RNA, 20 nt, Homo sapiens
uaucacauggggagaaaccu

SEQ ID NO: 217583 - RNA, 22 nt, Homo sapiens
uaucaccuugguagucuugggg

SEQ ID NO: 217584 - RNA, 22 nt, Homo sapiens
uaucagcacaguggguucaugg

SEQ ID NO: 217585 - RNA, 22 nt, Homo sapiens
uaucagcagcaggggcugcaga

SEQ ID NO: 217586 - RNA, 22 nt, Homo sapiens
uaucagugaaucuuauuuugcc

SEQ ID NO: 217587 - RNA, 22 nt, Homo sapiens
uaucauagacaaucaguuauug

SEQ ID NO: 217588 - RNA, 22 nt, Homo sapiens
uaucauagucacuuccaguuug

SEQ ID NO: 217589 - RNA, 22 nt, Homo sapiens
uaucaucauguuuuugcugugu

SEQ ID NO: 217590 - RNA, 22 nt, Homo sapiens
uaucauggggacugcagccuag

SEQ ID NO: 217591 - RNA, 22 nt, Homo sapiens
uauccuguagcucauccaccgc

SEQ ID NO: 217592 - RNA, 22 nt, Homo sapiens
uaucuacauguagguauguaug

SEQ ID NO: 217593 - RNA, 20 nt, Homo sapiens
uaucuacuugcaaaugccau

SEQ ID NO: 217594 - RNA, 22 nt, Homo sapiens
uaucucagagaaucagauuuac

SEQ ID NO: 217595 - RNA, 22 nt, Homo sapiens
uaucucagaguguacaagauua

SEQ ID NO: 217596 - RNA, 22 nt, Homo sapiens
uaucucauccuccuugauccca

SEQ ID NO: 217597 - RNA, 22 nt, Homo sapiens
uaucucuguggguagugcugaa

SEQ ID NO: 217598 - RNA, 22 nt, Homo sapiens
uaugaaucugagagaucuggaa

SEQ ID NO: 217599 - RNA, 20 nt, Homo sapiens
uaugacacugucauaaaaau

SEQ ID NO: 217600 - RNA, 23 nt, Homo sapiens
uaugacagaggaagggggagcug

SEQ ID NO: 217601 - RNA, 22 nt, Homo sapiens
uaugaccuuguccccucucgcc

SEQ ID NO: 217602 - RNA, 22 nt, Homo sapiens
uaugacugagacuuaaauugug

SEQ ID NO: 217603 - RNA, 22 nt, Homo sapiens
uaugacuuuugaauacagaugg

SEQ ID NO: 217604 - RNA, 22 nt, Homo sapiens
uaugagcaaaaugaggguuagu

SEQ ID NO: 217605 - RNA, 22 nt, Homo sapiens
uaugcacacguguccaugugca

SEQ ID NO: 217606 - RNA, 22 nt, Homo sapiens
uaugcacacucucccaggaggg

SEQ ID NO: 217607 - RNA, 22 nt, Homo sapiens
uaugcagacauuguuccaacca

SEQ ID NO: 217608 - RNA, 22 nt, Homo sapiens
uaugcaugucucuguacacgug

SEQ ID NO: 217609 - RNA, 22 nt, Homo sapiens
uaugccuuucucacuaagcuua

SEQ ID NO: 217610 - RNA, 22 nt, Homo sapiens
uaugccuuugaccauuuuguga

SEQ ID NO: 217611 - RNA, 22 nt, Homo sapiens
uaugccuuuugguucaagcaac

SEQ ID NO: 217612 - RNA, 22 nt, Homo sapiens
uaugcuuauaaacauuugucag

SEQ ID NO: 217613 - RNA, 22 nt, Homo sapiens
uaugcuuauuaaaacagugugu

SEQ ID NO: 217614 - RNA, 22 nt, Homo sapiens
uauggauguuaagguucacagc

SEQ ID NO: 217615 - RNA, 21 nt, Homo sapiens
uauggauuugccuauucugga

SEQ ID NO: 217616 - RNA, 19 nt, Homo sapiens
uuggucccuuuggguucuu

SEQ ID NO: 217617 - RNA, 23 nt, Homo sapiens
uuggucucccaaaguguugagau

SEQ ID NO: 217618 - RNA, 22 nt, Homo sapiens
uuggucuucuaauguaccuguu

SEQ ID NO: 217619 - RNA, 22 nt, Homo sapiens
uugguuaucaucauuucagcaa

SEQ ID NO: 217620 - RNA, 22 nt, Homo sapiens
uugguuccauuuuaccagcucu

SEQ ID NO: 217621 - RNA, 21 nt, Homo sapiens
uugguucccucugacaggucu

SEQ ID NO: 217622 - RNA, 22 nt, Homo sapiens
uugguuccuuagccuaggacua

SEQ ID NO: 217623 - RNA, 22 nt, Homo sapiens
uuguaaagaucauaugcuguuc

SEQ ID NO: 217624 - RNA, 22 nt, Homo sapiens
uuguaaagucugucucagucag

SEQ ID NO: 217625 - RNA, 22 nt, Homo sapiens
uuguaacaguuuauugacucga

SEQ ID NO: 217626 - RNA, 22 nt, Homo sapiens
uuguacuagaaaauuauucuuu

SEQ ID NO: 217627 - RNA, 22 nt, Homo sapiens
uuguacucucaccguaucccag

SEQ ID NO: 217628 - RNA, 22 nt, Homo sapiens
uuguacuuuuaguagagacggg

SEQ ID NO: 217629 - RNA, 22 nt, Homo sapiens
uuguagcaaauguguaaacaaa

SEQ ID NO: 217630 - RNA, 22 nt, Homo sapiens
uuguaguguuuauucugucaac

SEQ ID NO: 217631 - RNA, 22 nt, Homo sapiens
uuguauaguucuauguguuuug

SEQ ID NO: 217632 - RNA, 21 nt, Homo sapiens
uuguaugguugaacuugauac

SEQ ID NO: 217633 - RNA, 22 nt, Homo sapiens
uuguauguuguuugucagagaa

SEQ ID NO: 217634 - RNA, 22 nt, Homo sapiens
uuguauguuucugugcacauga

SEQ ID NO: 217635 - RNA, 22 nt, Homo sapiens
uuguauguuuguucuuucagau

SEQ ID NO: 217636 - RNA, 22 nt, Homo sapiens
uuguauugucuugaugaguuga

SEQ ID NO: 217637 - RNA, 22 nt, Homo sapiens
uugucaaugggugagugcagag

SEQ ID NO: 217638 - RNA, 22 nt, Homo sapiens
uugucacccuacauaacaggga

SEQ ID NO: 217639 - RNA, 22 nt, Homo sapiens
uugucacccucucuuggugucu

SEQ ID NO: 217640 - RNA, 22 nt, Homo sapiens
uugucauuuucagaguguuacg

SEQ ID NO: 217641 - RNA, 22 nt, Homo sapiens
uuguccaagucccauuuguuga

SEQ ID NO: 217642 - RNA, 23 nt, Homo sapiens
uuguccccuccaaagcucauguu

SEQ ID NO: 217643 - RNA, 22 nt, Homo sapiens
uuguccuggagguucuugcaag

SEQ ID NO: 217644 - RNA, 22 nt, Homo sapiens
uuguccuugagauaguuugcag

SEQ ID NO: 217645 - RNA, 19 nt, Homo sapiens
uugucuuagaguugucauu

SEQ ID NO: 217646 - RNA, 22 nt, Homo sapiens
uugugaagaaaccagaaaaguu

SEQ ID NO: 217647 - RNA, 22 nt, Homo sapiens
uugugaagaugugaagcaagca

SEQ ID NO: 217648 - RNA, 22 nt, Homo sapiens
uugugaaugaugucgcaguaaa

SEQ ID NO: 217649 - RNA, 22 nt, Homo sapiens
uugugaauggugccgcaauaaa

SEQ ID NO: 217650 - RNA, 22 nt, Homo sapiens
uugugaauggugccgcgauaaa

SEQ ID NO: 217651 - RNA, 22 nt, Homo sapiens
uugugaauggugccucaguaaa

SEQ ID NO: 217652 - RNA, 22 nt, Homo sapiens
uugugaucauugucaaauagug

SEQ ID NO: 217653 - RNA, 22 nt, Homo sapiens
uugugauugagugauccuuguu

SEQ ID NO: 217654 - RNA, 22 nt, Homo sapiens
uugugcaaaaguaauugcgguu

SEQ ID NO: 217655 - RNA, 22 nt, Homo sapiens
uugugcaugaugcauacauggu

SEQ ID NO: 217656 - RNA, 22 nt, Homo sapiens
uugugcauguauauuaguucac

SEQ ID NO: 217657 - RNA, 22 nt, Homo sapiens
uugugccugguacauggagaaa

SEQ ID NO: 217658 - RNA, 22 nt, Homo sapiens
uugugcuugauuugccuagcug

SEQ ID NO: 217659 - RNA, 22 nt, Homo sapiens
uuguggcuuaucucauuuagcg

SEQ ID NO: 217660 - RNA, 16 nt, Homo sapiens
uuguggcuuuugcaca

SEQ ID NO: 217661 - RNA, 19 nt, Homo sapiens
uugugggaggacagagggg

SEQ ID NO: 217662 - RNA, 22 nt, Homo sapiens
uugugguagugaaugagucuca

SEQ ID NO: 217663 - RNA, 22 nt, Homo sapiens
uugugguugacuaaauuuguaa

SEQ ID NO: 217664 - RNA, 22 nt, Homo sapiens
uugugucaaauggcaauuagca

SEQ ID NO: 217665 - RNA, 23 nt, Homo sapiens
uugugucccuacccaaaucucau

SEQ ID NO: 217666 - RNA, 22 nt, Homo sapiens
uugugucccugcccaaaucuca

SEQ ID NO: 217667 - RNA, 22 nt, Homo sapiens
uuguuaugggguggcuugaaag

SEQ ID NO: 217668 - RNA, 22 nt, Homo sapiens
uuguuauguaucucaagauaaa

SEQ ID NO: 217669 - RNA, 22 nt, Homo sapiens
uuguuauguuggucaguaaugu

SEQ ID NO: 217670 - RNA, 23 nt, Homo sapiens
uuguucccuuccacucagucucc

SEQ ID NO: 217671 - RNA, 22 nt, Homo sapiens
uuguucccuucuggcuuuuaug

SEQ ID NO: 217672 - RNA, 22 nt, Homo sapiens
uuuaaagcaugacgagaagaag

SEQ ID NO: 217673 - RNA, 22 nt, Homo sapiens
uuuaagguauguggugaaaauu

SEQ ID NO: 217674 - RNA, 18 nt, Homo sapiens
uuuacaguagaaggacuu

SEQ ID NO: 217675 - RNA, 22 nt, Homo sapiens
uuuagcaaagcaauuuacacca

SEQ ID NO: 217676 - RNA, 22 nt, Homo sapiens
uuuagcaauggagggugacuuu

SEQ ID NO: 217677 - RNA, 22 nt, Homo sapiens
uuuagcaauucauuuugugucu

SEQ ID NO: 217678 - RNA, 22 nt, Homo sapiens
uuuaggcaauauauucaugucu

SEQ ID NO: 217679 - RNA, 22 nt, Homo sapiens
uuuagggcagggacaguucuuc

SEQ ID NO: 217680 - RNA, 22 nt, Homo sapiens
uuuagguagucaaagguuaguc

SEQ ID NO: 217681 - RNA, 22 nt, Homo sapiens
uuuagguuacauauaauccaaa

SEQ ID NO: 217682 - RNA, 22 nt, Homo sapiens
uuuaucaggccuuuggaaaaau

SEQ ID NO: 217683 - RNA, 22 nt, Homo sapiens
uuucaacaggucuggggugguc

SEQ ID NO: 217684 - RNA, 21 nt, Homo sapiens
uuucacugugaguuuuucugu

SEQ ID NO: 217685 - RNA, 17 nt, Homo sapiens
uuucagaguggaagugu

SEQ ID NO: 217686 - RNA, 23 nt, Homo sapiens
uuucaggcaggugaaagaccagc

SEQ ID NO: 217687 - RNA, 23 nt, Homo sapiens
uuucaguaguuguauccuguugc

SEQ ID NO: 217688 - RNA, 22 nt, Homo sapiens
uuucaucaagcacagaguagau

SEQ ID NO: 217689 - RNA, 22 nt, Homo sapiens
uuucauggacgcaaugccuuuu

SEQ ID NO: 217690 - RNA, 23 nt, Homo sapiens
uuucauggggauuuacucauucc

SEQ ID NO: 217691 - RNA, 22 nt, Homo sapiens
uuuccaguuggaaagccuguuu

SEQ ID NO: 217692 - RNA, 22 nt, Homo sapiens
uuuccaguuguucuagaaagcu

SEQ ID NO: 217693 - RNA, 22 nt, Homo sapiens
uuucccauuguucugcucugug

SEQ ID NO: 217694 - RNA, 22 nt, Homo sapiens
uuucgugucuggucugugaugg

SEQ ID NO: 217695 - RNA, 17 nt, Homo sapiens
uuucucagcccucuucu

SEQ ID NO: 217696 - RNA, 22 nt, Homo sapiens
uuucugcuugagagaauugcug

SEQ ID NO: 217697 - RNA, 23 nt, Homo sapiens
uuucuugggcaugcuaugucagu

SEQ ID NO: 217698 - RNA, 22 nt, Homo sapiens
uuugaaccauuugaagaaugau

SEQ ID NO: 217699 - RNA, 22 nt, Homo sapiens
uuugaagacuacugggagugaa

SEQ ID NO: 217700 - RNA, 22 nt, Homo sapiens
uuugaagcaauugugaauggga

SEQ ID NO: 217701 - RNA, 22 nt, Homo sapiens
uuugaagcuaaggugcuugguu

SEQ ID NO: 217702 - RNA, 22 nt, Homo sapiens
uuugaaguguggcacugaguuu

SEQ ID NO: 217703 - RNA, 22 nt, Homo sapiens
uuugaauguaaugagcaggaag

SEQ ID NO: 217704 - RNA, 22 nt, Homo sapiens
uuugaguuugaggugcugauga

SEQ ID NO: 217705 - RNA, 22 nt, Homo sapiens
uuugauguccaccucagcccac

SEQ ID NO: 217706 - RNA, 22 nt, Homo sapiens
uuugcacuucugagugugacau

SEQ ID NO: 217707 - RNA, 21 nt, Homo sapiens
uuugcacuuugcaaaucccua

SEQ ID NO: 217708 - RNA, 22 nt, Homo sapiens
uuugcagugucagcuucugugu

SEQ ID NO: 217709 - RNA, 19 nt, Homo sapiens
uuugcauagugagaauaua

SEQ ID NO: 217710 - RNA, 22 nt, Homo sapiens
uuugccaauauuuuacugagga

SEQ ID NO: 217711 - RNA, 22 nt, Homo sapiens
uuugccaauauuuuauugagga

SEQ ID NO: 217712 - RNA, 22 nt, Homo sapiens
uuugcuuaaaucuuaaucagau

SEQ ID NO: 217713 - RNA, 22 nt, Homo sapiens
uuuggaaugugcacucagauug

SEQ ID NO: 217714 - RNA, 20 nt, Homo sapiens
uuuggcaauaggguuuuugu

SEQ ID NO: 217715 - RNA, 22 nt, Homo sapiens
uuuggcaauuugacuguauagg

SEQ ID NO: 217716 - RNA, 22 nt, Homo sapiens
uuuggcacuguaaauuucucuu

SEQ ID NO: 217717 - RNA, 22 nt, Homo sapiens
uuuggcauuagauaauugugua

SEQ ID NO: 217718 - RNA, 22 nt, Homo sapiens
ggauccaucuggaaauguggga

SEQ ID NO: 217719 - RNA, 22 nt, Homo sapiens
ggaucuauuucaugauaaccuu

SEQ ID NO: 217720 - RNA, 22 nt, Homo sapiens
ggcaaaugaagauggagaggcu

SEQ ID NO: 217721 - RNA, 22 nt, Homo sapiens
ggcaagaagaacuauaacuuuu

SEQ ID NO: 217722 - RNA, 21 nt, Homo sapiens
ggcaagagaauacaacauaaa

SEQ ID NO: 217723 - RNA, 22 nt, Homo sapiens
ggcaagaggagauucugcuccc

SEQ ID NO: 217724 - RNA, 19 nt, Homo sapiens
ggcaagaguuguucugugu

SEQ ID NO: 217725 - RNA, 22 nt, Homo sapiens
ggcaagauagauaucaguguca

SEQ ID NO: 217726 - RNA, 22 nt, Homo sapiens
ggcaagaucuuggcucacugaa

SEQ ID NO: 217727 - RNA, 22 nt, Homo sapiens
ggcaaggauuagauucuccccu

SEQ ID NO: 217728 - RNA, 22 nt, Homo sapiens
ggcaaggugcuacagacaguga

SEQ ID NO: 217729 - RNA, 22 nt, Homo sapiens
ggcaaguauguuuuaggaugcu

SEQ ID NO: 217730 - RNA, 22 nt, Homo sapiens
ggcaauauuauuaacccucugu

SEQ ID NO: 217731 - RNA, 22 nt, Homo sapiens
ggcaccacagacgccaggcgug

SEQ ID NO: 217732 - RNA, 22 nt, Homo sapiens
ggcacuguggcucaagccugua

SEQ ID NO: 217733 - RNA, 22 nt, Homo sapiens
ggcagacuguggaguucuuucu

SEQ ID NO: 217734 - RNA, 22 nt, Homo sapiens
ggcagaucauuggccucaguuu

SEQ ID NO: 217735 - RNA, 22 nt, Homo sapiens
ggcagcacaauuuucugaugga

SEQ ID NO: 217736 - RNA, 22 nt, Homo sapiens
ggcagcgugguggauugaaaau

SEQ ID NO: 217737 - RNA, 22 nt, Homo sapiens
ggcaguggaagugccaguuucu

SEQ ID NO: 217738 - RNA, 22 nt, Homo sapiens
ggcaguguaauaauuuauuaau

SEQ ID NO: 217739 - RNA, 22 nt, Homo sapiens
ggcaguuuguuugugaggucca

SEQ ID NO: 217740 - RNA, 22 nt, Homo sapiens
ggcaugauguauuugagguuug

SEQ ID NO: 217741 - RNA, 22 nt, Homo sapiens
ggcaugguggugugugccuaua

SEQ ID NO: 217742 - RNA, 22 nt, Homo sapiens
ggcauguaauuauucaaagugg

SEQ ID NO: 217743 - RNA, 22 nt, Homo sapiens
ggcauugaguggguaggaguca

SEQ ID NO: 217744 - RNA, 22 nt, Homo sapiens
ggcccaguugcgggugguaccg

SEQ ID NO: 217745 - RNA, 22 nt, Homo sapiens
ggcccugagacaggaaaaagcu

SEQ ID NO: 217746 - RNA, 22 nt, Homo sapiens
ggcgguguccuccaagugcuuc

SEQ ID NO: 217747 - RNA, 22 nt, Homo sapiens
ggcgguguugauggcccccaca

SEQ ID NO: 217748 - RNA, 22 nt, Homo sapiens
ggcuagagagcucagggauaug

SEQ ID NO: 217749 - RNA, 18 nt, Homo sapiens
gggaauauggggaguuga

SEQ ID NO: 217750 - RNA, 22 nt, Homo sapiens
gggagguagguauuagcuuuuc

SEQ ID NO: 217751 - RNA, 22 nt, Homo sapiens
gggagugucuaaccuguuaaca

SEQ ID NO: 217752 - RNA, 22 nt, Homo sapiens
gggaugaauuagguauguuuau

SEQ ID NO: 217753 - RNA, 22 nt, Homo sapiens
gggauguaugauauauguuggu

SEQ ID NO: 217754 - RNA, 22 nt, Homo sapiens
gggauguuuuauacugagccug

SEQ ID NO: 217755 - RNA, 22 nt, Homo sapiens
gggcaaauuauguaucucucag

SEQ ID NO: 217756 - RNA, 22 nt, Homo sapiens
gggcagaugucuggacaccuca

SEQ ID NO: 217757 - RNA, 22 nt, Homo sapiens
gggcaugauggugcacacaugu

SEQ ID NO: 217758 - RNA, 22 nt, Homo sapiens
ggggcauugugacauaucucug

SEQ ID NO: 217759 - RNA, 22 nt, Homo sapiens
ggguaaaucucuuuucauggcu

SEQ ID NO: 217760 - RNA, 22 nt, Homo sapiens
gguagacaucgugcucugugau

SEQ ID NO: 217761 - RNA, 22 nt, Homo sapiens
gguagacucuguaagugaucau

SEQ ID NO: 217762 - RNA, 22 nt, Homo sapiens
gguauguagcaaaagaggugcu

SEQ ID NO: 217763 - RNA, 22 nt, Homo sapiens
gguauuuaaaguaccugucugc

SEQ ID NO: 217764 - RNA, 22 nt, Homo sapiens
ggucaacaucaucaugguaagu

SEQ ID NO: 217765 - RNA, 22 nt, Homo sapiens
auugugauggucaaaggaaaua

SEQ ID NO: 217766 - RNA, 22 nt, Homo sapiens
auugugauugcugcuaggccua

SEQ ID NO: 217767 - RNA, 22 nt, Homo sapiens
auuguguuugaaugaggcucca

SEQ ID NO: 217768 - RNA, 22 nt, Homo sapiens
auuuagcaauggagguagugua

SEQ ID NO: 217769 - RNA, 22 nt, Homo sapiens
auuuaugguuaauauaggaagu

SEQ ID NO: 217770 - RNA, 15 nt, Homo sapiens
auuucacuuagcaug

SEQ ID NO: 217771 - RNA, 22 nt, Homo sapiens
auuuccuguaggggcuugcgaa

SEQ ID NO: 217772 - RNA, 22 nt, Homo sapiens
auuuggguuuuacaucaggcua

SEQ ID NO: 217773 - RNA, 21 nt, Homo sapiens
auuugguggcugugugacacu

SEQ ID NO: 217774 - RNA, 21 nt, Homo sapiens
auuugguguuagaaauaaauu

SEQ ID NO: 217775 - RNA, 22 nt, Homo sapiens
auuugguugggugcgguggcuu

SEQ ID NO: 217776 - RNA, 22 nt, Homo sapiens
auuuuugguugucagcacuagg

SEQ ID NO: 217777 - RNA, 22 nt, Homo sapiens
caaaagugauugcgguuuuugc

SEQ ID NO: 217778 - RNA, 22 nt, Homo sapiens
caaaagugguucuuauccuuuu

SEQ ID NO: 217779 - RNA, 22 nt, Homo sapiens
caaaggugcuuuccagguccaa

SEQ ID NO: 217780 - RNA, 22 nt, Homo sapiens
caaaguaauugcuguuuugcca

SEQ ID NO: 217781 - RNA, 22 nt, Homo sapiens
caaagucuucucauuaugucuu

SEQ ID NO: 217782 - RNA, 22 nt, Homo sapiens
agcaauaugacauugcuacauc

SEQ ID NO: 217783 - RNA, 22 nt, Homo sapiens
agcacagugaaugguuuacuca

SEQ ID NO: 217784 - RNA, 22 nt, Homo sapiens
agcacagugguuaaguuucuua

SEQ ID NO: 217785 - RNA, 22 nt, Homo sapiens
agcacaguuaaaugaggcuucu

SEQ ID NO: 217786 - RNA, 22 nt, Homo sapiens
agcaccaauaaucagaguucuu

SEQ ID NO: 217787 - RNA, 17 nt, Homo sapiens
agcaccacacucucuug

SEQ ID NO: 217788 - RNA, 22 nt, Homo sapiens
agcaccauugcacuccagccug

SEQ ID NO: 217789 - RNA, 22 nt, Homo sapiens
agcaccauuuauugaaaagaca

SEQ ID NO: 217790 - RNA, 22 nt, Homo sapiens
agcaccguucaaacccagguua

SEQ ID NO: 217791 - RNA, 23 nt, Homo sapiens
agcaccuuuccuccacuaucugc

SEQ ID NO: 217792 - RNA, 19 nt, Homo sapiens
agcagaacaaauguguggg

SEQ ID NO: 217793 - RNA, 22 nt, Homo sapiens
agcagcacaucccuuucuggcc

SEQ ID NO: 217794 - RNA, 22 nt, Homo sapiens
agcagcaugaggggacuucugc

SEQ ID NO: 217795 - RNA, 22 nt, Homo sapiens
agcagcauuaguggaaucuugu

SEQ ID NO: 217796 - RNA, 22 nt, Homo sapiens
agcagcauuccaaaaaucugcu

SEQ ID NO: 217797 - RNA, 22 nt, Homo sapiens
uguggcauuuucagaaaggaug

SEQ ID NO: 217798 - RNA, 22 nt, Homo sapiens
uguggcuucuuugguucaguau

SEQ ID NO: 217799 - RNA, 22 nt, Homo sapiens
ugugggugguaaaauacaauga

SEQ ID NO: 217800 - RNA, 22 nt, Homo sapiens
ugugguccucugaaggcuuuuc

SEQ ID NO: 217801 - RNA, 22 nt, Homo sapiens
ugugguuuuaguaaaacuaugu

SEQ ID NO: 217802 - RNA, 22 nt, Homo sapiens
ugugguuuuucacauuuagaga

SEQ ID NO: 217803 - RNA, 22 nt, Homo sapiens
uguguaaauacaagugcuugaa

SEQ ID NO: 217804 - RNA, 22 nt, Homo sapiens
uguguaauaccuuugacuauau

SEQ ID NO: 217805 - RNA, 22 nt, Homo sapiens
ugugucacugaggguuagugua

SEQ ID NO: 217806 - RNA, 22 nt, Homo sapiens
ugugucacugcacuccagccug

SEQ ID NO: 217807 - RNA, 22 nt, Homo sapiens
ugugucuacugagaugaucaug

SEQ ID NO: 217808 - RNA, 22 nt, Homo sapiens
uguuacagugacuaauguuuua

SEQ ID NO: 217809 - RNA, 22 nt, Homo sapiens
uguuauguauggagugauccca

SEQ ID NO: 217810 - RNA, 22 nt, Homo sapiens
uguuauguuguuugagaaaguc

SEQ ID NO: 217811 - RNA, 22 nt, Homo sapiens
uguugcacuccagccuagguga

SEQ ID NO: 217812 - RNA, 22 nt, Homo sapiens
uguugcacuccauccugggcga

SEQ ID NO: 217813 - RNA, 22 nt, Homo sapiens
uguugcuuaagccacccagucu

SEQ ID NO: 217814 - RNA, 22 nt, Homo sapiens
uguugguuaaaucagguuuuaa

SEQ ID NO: 217815 - RNA, 22 nt, Homo sapiens
uguuuaguuaagacauagaauu

SEQ ID NO: 217816 - RNA, 22 nt, Homo sapiens
uguuuguuugauaugggauaaa

SEQ ID NO: 217817 - RNA, 22 nt, Homo sapiens
uguuuuggagguccucacuaga

SEQ ID NO: 217818 - RNA, 21 nt, Homo sapiens
uguuuuugcuguguaucucuc

SEQ ID NO: 217819 - RNA, 22 nt, Homo sapiens
uuaaaagcuaucuccaagguca

SEQ ID NO: 217820 - RNA, 22 nt, Homo sapiens
uuaaaaguauaggccuggcaua

SEQ ID NO: 217821 - RNA, 22 nt, Homo sapiens
uuaaacucaucacccagguagu

SEQ ID NO: 217822 - RNA, 22 nt, Homo sapiens
uuaaagccauaccugagagagu

SEQ ID NO: 217823 - RNA, 22 nt, Homo sapiens
uuaaagcuggcguuacaguuug

SEQ ID NO: 217824 - RNA, 22 nt, Homo sapiens
uuaaaugcauagaauguguagu

SEQ ID NO: 217825 - RNA, 22 nt, Homo sapiens
uuaaaugcuagaauuuucuuug

SEQ ID NO: 217826 - RNA, 22 nt, Homo sapiens
uuaacagucacuuagcucauuu

SEQ ID NO: 217827 - RNA, 22 nt, Homo sapiens
uuaacagugaccccugguggcc

SEQ ID NO: 217828 - RNA, 23 nt, Homo sapiens
uuaagcaacggcugcuuuucaga

SEQ ID NO: 217829 - RNA, 22 nt, Homo sapiens
uuaagccacucaagagauagag

SEQ ID NO: 217830 - RNA, 22 nt, Homo sapiens
uuaagccaggugugguggcaca

SEQ ID NO: 217831 - RNA, 22 nt, Homo sapiens
uuaagcugaauuuaagcuucgg

SEQ ID NO: 217832 - RNA, 18 nt, Homo sapiens
uuaaggcaggacuuuaag

SEQ ID NO: 217833 - RNA, 22 nt, Homo sapiens
uuaaggcuccuguuggcuuuua

SEQ ID NO: 217834 - RNA, 22 nt, Homo sapiens
uuaaggcuuguacuuguuuucu

SEQ ID NO: 217835 - RNA, 22 nt, Homo sapiens
uuaaggcuuuaaguaaacacag

SEQ ID NO: 217836 - RNA, 22 nt, Homo sapiens
uuaaggugaaguucucagaugc

SEQ ID NO: 217837 - RNA, 22 nt, Homo sapiens
uuaagucacacuagacaacuga

SEQ ID NO: 217838 - RNA, 22 nt, Homo sapiens
uuaagugaauuaucuaacaugu

SEQ ID NO: 217839 - RNA, 22 nt, Homo sapiens
uuaaucuguucucuguauucua

SEQ ID NO: 217840 - RNA, 22 nt, Homo sapiens
uuaaugacaucauaggugaagu

SEQ ID NO: 217841 - RNA, 22 nt, Homo sapiens
uuaaugcuuggggaguaguucu

SEQ ID NO: 217842 - RNA, 22 nt, Homo sapiens
uuaauguaucuaucacaucaca

SEQ ID NO: 217843 - RNA, 21 nt, Homo sapiens
uuacaauggcuccuugaaggu

SEQ ID NO: 217844 - RNA, 22 nt, Homo sapiens
uuacagcugcuccccaucacuc

SEQ ID NO: 217845 - RNA, 17 nt, Homo sapiens
uuacaggugcugagagu

SEQ ID NO: 217846 - RNA, 22 nt, Homo sapiens
uuacagguggagaaguaaggcu

SEQ ID NO: 217847 - RNA, 22 nt, Homo sapiens
uuacaguucugguggagaggua

SEQ ID NO: 217848 - RNA, 21 nt, Homo sapiens
uuacaguugguugugaggugg

SEQ ID NO: 217849 - RNA, 22 nt, Homo sapiens
uuacauaguguguggguucggg

SEQ ID NO: 217850 - RNA, 22 nt, Homo sapiens
uuacaucaucacauuaguuugc

SEQ ID NO: 217851 - RNA, 19 nt, Homo sapiens
uuacauccauugcauuuca

SEQ ID NO: 217852 - RNA, 22 nt, Homo sapiens
uuaccagagaagacgaggggga

SEQ ID NO: 217853 - RNA, 22 nt, Homo sapiens
uuaccagucugauaaacagaaa

SEQ ID NO: 217854 - RNA, 22 nt, Homo sapiens
uuaccucuguggcucucggacu

SEQ ID NO: 217855 - RNA, 22 nt, Homo sapiens
uuaccugagaaggugacauuug

SEQ ID NO: 217856 - RNA, 22 nt, Homo sapiens
uuacuggcuuucacugguguua

SEQ ID NO: 217857 - RNA, 22 nt, Homo sapiens
uuacuguauagaaucaucuuga

SEQ ID NO: 217858 - RNA, 22 nt, Homo sapiens
uuagaaaguagaaaagcugguu

SEQ ID NO: 217859 - RNA, 22 nt, Homo sapiens
uuagaacagugcucaccacaaa

SEQ ID NO: 217860 - RNA, 20 nt, Homo sapiens
uuagaguaguaugauuuaua

SEQ ID NO: 217861 - RNA, 22 nt, Homo sapiens
uuagaugaaugucucuuaaaca

SEQ ID NO: 217862 - RNA, 22 nt, Homo sapiens
uuagcaauugauucucauaagc

SEQ ID NO: 217863 - RNA, 22 nt, Homo sapiens
uuagcacauuuccagcacaugg

SEQ ID NO: 217864 - RNA, 22 nt, Homo sapiens
uuagcaccacacacuuuagagg

SEQ ID NO: 217865 - RNA, 22 nt, Homo sapiens
uuagcagcaucccuggccugua

SEQ ID NO: 217866 - RNA, 22 nt, Homo sapiens
uuagcagcucuggugacaaggu

SEQ ID NO: 217867 - RNA, 22 nt, Homo sapiens
uuagcaguggauggguggagaa

SEQ ID NO: 217868 - RNA, 22 nt, Homo sapiens
uuagcucaguuggugagagcgu

SEQ ID NO: 217869 - RNA, 22 nt, Homo sapiens
uuaggaucacagaaaauccucu

SEQ ID NO: 217870 - RNA, 21 nt, Homo sapiens
uuaggcagugucagaggugag

SEQ ID NO: 217871 - RNA, 16 nt, Homo sapiens
uuaggcagugugauac

SEQ ID NO: 217872 - RNA, 22 nt, Homo sapiens
uuagggaggcucaggacaagag

SEQ ID NO: 217873 - RNA, 18 nt, Homo sapiens
uuagguaggucuuugugu

SEQ ID NO: 217874 - RNA, 22 nt, Homo sapiens
uuagguaggugcuuuuuucaca

SEQ ID NO: 217875 - RNA, 22 nt, Homo sapiens
uuagguagucucugucagaggg

SEQ ID NO: 217876 - RNA, 22 nt, Homo sapiens
uuaguaguuugauaggaauagc

SEQ ID NO: 217877 - RNA, 22 nt, Homo sapiens
uuaguaucauccuucugcauuc

SEQ ID NO: 217878 - RNA, 22 nt, Homo sapiens
uuagugaaugggugugauuugu

SEQ ID NO: 217879 - RNA, 22 nt, Homo sapiens
uuagugcuuacgaugagcuaag

SEQ ID NO: 217880 - RNA, 22 nt, Homo sapiens
uuaguucauugugacuggacuc

SEQ ID NO: 217881 - RNA, 22 nt, Homo sapiens
uuauaaacaugaagauuugggg

SEQ ID NO: 217882 - RNA, 19 nt, Homo sapiens
uuauacuguauuguuuagg

SEQ ID NO: 217883 - RNA, 22 nt, Homo sapiens
uuauagcacuaagaagguaaua

SEQ ID NO: 217884 - RNA, 22 nt, Homo sapiens
uucucugggacauaggucgggu

SEQ ID NO: 217885 - RNA, 22 nt, Homo sapiens
uucucuggucagaggggagguu

SEQ ID NO: 217886 - RNA, 22 nt, Homo sapiens
uucugauggaguaguccacaga

SEQ ID NO: 217887 - RNA, 22 nt, Homo sapiens
uucugccaaucaacccacaucc

SEQ ID NO: 217888 - RNA, 22 nt, Homo sapiens
uucuggccccucccaaucucau

SEQ ID NO: 217889 - RNA, 22 nt, Homo sapiens
uucuggcucaggucaacacuuc

SEQ ID NO: 217890 - RNA, 22 nt, Homo sapiens
uucugguuaauacuugcaaaaa

SEQ ID NO: 217891 - RNA, 22 nt, Homo sapiens
uucugugcuuguggaugaagug

SEQ ID NO: 217892 - RNA, 22 nt, Homo sapiens
uucuuagguuaaggcugagaga

SEQ ID NO: 217893 - RNA, 22 nt, Homo sapiens
uucuuagucaaguuguauuuca

SEQ ID NO: 217894 - RNA, 21 nt, Homo sapiens
uucuucaggcagaaggauuau

SEQ ID NO: 217895 - RNA, 22 nt, Homo sapiens
uucuucaggccacaaaaauggu

SEQ ID NO: 217896 - RNA, 22 nt, Homo sapiens
uucuucaguuacaacaaggggg

SEQ ID NO: 217897 - RNA, 22 nt, Homo sapiens
uucuuccagccuugaggggccc

SEQ ID NO: 217898 - RNA, 22 nt, Homo sapiens
uucuuuaguucacuugcuccag

SEQ ID NO: 217899 - RNA, 22 nt, Homo sapiens
cuuugguugugcucuccacuuu

SEQ ID NO: 217900 - RNA, 22 nt, Homo sapiens
cuuugguuuacuuggugcuagu

SEQ ID NO: 217901 - RNA, 21 nt, Homo sapiens
cuuugguuucugacuugcaua

SEQ ID NO: 217902 - RNA, 22 nt, Homo sapiens
cuuuguggggucuuuccucaaa

SEQ ID NO: 217903 - RNA, 22 nt, Homo sapiens
cuuuguguaggugccucuggcu

SEQ ID NO: 217904 - RNA, 22 nt, Homo sapiens
cuuugugugggccaagggcugg

SEQ ID NO: 217905 - RNA, 22 nt, Homo sapiens
cuuuuacacugcuggugggaau

SEQ ID NO: 217906 - RNA, 20 nt, Homo sapiens
cuuuuagcagcagcaagaga

SEQ ID NO: 217907 - RNA, 23 nt, Homo sapiens
cuuuugcaaugugaucuugccac

SEQ ID NO: 217908 - RNA, 22 nt, Homo sapiens
cuuuuggugugaagaagcucuu

SEQ ID NO: 217909 - RNA, 22 nt, Homo sapiens
cuuuugugauuccucaguuacu

SEQ ID NO: 217910 - RNA, 22 nt, Homo sapiens
cuuuuugcugcagcaauacugg

SEQ ID NO: 217911 - RNA, 22 nt, Homo sapiens
gaaaacugcuucucuggguuuc

SEQ ID NO: 217912 - RNA, 22 nt, Homo sapiens
gaaaauccauccccagggagua

SEQ ID NO: 217913 - RNA, 20 nt, Homo sapiens
gaaacaucuauccucuccuu

SEQ ID NO: 217914 - RNA, 18 nt, Homo sapiens
gaaaugccucuugcuuac

SEQ ID NO: 217915 - RNA, 22 nt, Homo sapiens
gaaaugucugagauguggcuca

SEQ ID NO: 217916 - RNA, 22 nt, Homo sapiens
gaacccuggaggcggagguugc

SEQ ID NO: 217917 - RNA, 22 nt, Homo sapiens
gaacuuguguugcuucacaugu

SEQ ID NO: 217918 - RNA, 22 nt, Homo sapiens
gaagaacuaggugagaucuaga

SEQ ID NO: 217919 - RNA, 22 nt, Homo sapiens
gaagacauuuacaugggagacc

SEQ ID NO: 217920 - RNA, 22 nt, Homo sapiens
gaagauucaaccaaaccagaac

SEQ ID NO: 217921 - RNA, 22 nt, Homo sapiens
gaagcgaggugauuagcagaca

SEQ ID NO: 217922 - RNA, 22 nt, Homo sapiens
gaauacuguccaagagugaugg

SEQ ID NO: 217923 - RNA, 22 nt, Homo sapiens
gaaucacaguuauuagagcagc

SEQ ID NO: 217924 - RNA, 22 nt, Homo sapiens
gaaucacugugguaucccaugc

SEQ ID NO: 217925 - RNA, 22 nt, Homo sapiens
gaaucauuguuucuaaguuugu

SEQ ID NO: 217926 - RNA, 22 nt, Homo sapiens
gaaucccuugcauuaucccuuu

SEQ ID NO: 217927 - RNA, 21 nt, Homo sapiens
gaauggcaccauuagcauaua

SEQ ID NO: 217928 - RNA, 22 nt, Homo sapiens
gacaccauuucaguacuagguu

SEQ ID NO: 217929 - RNA, 22 nt, Homo sapiens
gacacuggguguuuguuggcgu

SEQ ID NO: 217930 - RNA, 22 nt, Homo sapiens
gacagacacaauugauccauga

SEQ ID NO: 217931 - RNA, 22 nt, Homo sapiens
gacagagcaagacccuauuuaa

SEQ ID NO: 217932 - RNA, 18 nt, Homo sapiens
gacagugugaagauuccu

SEQ ID NO: 217933 - RNA, 20 nt, Homo sapiens
gacauagagacucucaaaaa

SEQ ID NO: 217934 - RNA, 16 nt, Homo sapiens
gacaugaucuuguuua

SEQ ID NO: 217935 - RNA, 20 nt, Homo sapiens
gacauguugguuugcugcac

SEQ ID NO: 217936 - RNA, 22 nt, Homo sapiens
gacauguuuacaguguugagag

SEQ ID NO: 217937 - RNA, 22 nt, Homo sapiens
gacauguuucucucuguuuacu

SEQ ID NO: 217938 - RNA, 20 nt, Homo sapiens
gacauguuuuguggccuaac

SEQ ID NO: 217939 - RNA, 22 nt, Homo sapiens
gacccucuagauggaagcacug

SEQ ID NO: 217940 - RNA, 16 nt, Homo sapiens
gacuaauacaaaggaa

SEQ ID NO: 217941 - RNA, 22 nt, Homo sapiens
gacuacaacuucuauuauucag

SEQ ID NO: 217942 - RNA, 22 nt, Homo sapiens
gacuauaucaggaauggggauu

SEQ ID NO: 217943 - RNA, 22 nt, Homo sapiens
gacuauguuaccuuacacauca

SEQ ID NO: 217944 - RNA, 22 nt, Homo sapiens
gacuucaucauacuaugugugg

SEQ ID NO: 217945 - RNA, 20 nt, Homo sapiens
gacuugagagugggagagua

SEQ ID NO: 217946 - RNA, 18 nt, Homo sapiens
gacuuggaguuuacagug

SEQ ID NO: 217947 - RNA, 22 nt, Homo sapiens
gacuuugguaaacucgguggca

SEQ ID NO: 217948 - RNA, 22 nt, Homo sapiens
gagaacagaagcauuccuaauu

SEQ ID NO: 217949 - RNA, 22 nt, Homo sapiens
gagaacauacggcauuugguuu

SEQ ID NO: 217950 - RNA, 22 nt, Homo sapiens
gagaacauuaauaguuaauuuu

SEQ ID NO: 217951 - RNA, 22 nt, Homo sapiens
gagaacauuuaagccacucagg

SEQ ID NO: 217952 - RNA, 22 nt, Homo sapiens
gagaacuaaugauguacuaggc

SEQ ID NO: 217953 - RNA, 22 nt, Homo sapiens
gagaacuaaugguuugauaagg

SEQ ID NO: 217954 - RNA, 22 nt, Homo sapiens
gagaacugacauuaucguguau

SEQ ID NO: 217955 - RNA, 20 nt, Homo sapiens
gagaccugagauucacucaa

SEQ ID NO: 217956 - RNA, 22 nt, Homo sapiens
gagacggagucucgcucuguca

SEQ ID NO: 217957 - RNA, 22 nt, Homo sapiens
gagacuaaagagcuugcccugg

SEQ ID NO: 217958 - RNA, 22 nt, Homo sapiens
gagacucuuagauuggaaaucu

SEQ ID NO: 217959 - RNA, 22 nt, Homo sapiens
gagacugagucuugcccuguca

SEQ ID NO: 217960 - RNA, 22 nt, Homo sapiens
gagagcaugugcuggcaucagu

SEQ ID NO: 217961 - RNA, 22 nt, Homo sapiens
gagagugugucagaggcugcga

SEQ ID NO: 217962 - RNA, 22 nt, Homo sapiens
gagauagguauuucauuuaccc

SEQ ID NO: 217963 - RNA, 22 nt, Homo sapiens
gagaucaaguauucuccacuaa

SEQ ID NO: 217964 - RNA, 22 nt, Homo sapiens
gagaucaguuaaugaagugagc

SEQ ID NO: 217965 - RNA, 22 nt, Homo sapiens
gagaucuauuccucacccuucu

SEQ ID NO: 217966 - RNA, 22 nt, Homo sapiens
gagaucuuuaagaacuacugcu

SEQ ID NO: 217967 - RNA, 22 nt, Homo sapiens
gagaugaaguuaaggaucuuua

SEQ ID NO: 217968 - RNA, 22 nt, Homo sapiens
gagaugcaccuugucacguuuc

SEQ ID NO: 217969 - RNA, 22 nt, Homo sapiens
gagauggagucuuuuucuguca

SEQ ID NO: 217970 - RNA, 22 nt, Homo sapiens
gagauggaguuucacuucgcuc

SEQ ID NO: 217971 - RNA, 22 nt, Homo sapiens
gagauguaagaauuuauuuguu

SEQ ID NO: 217972 - RNA, 22 nt, Homo sapiens
gagauguagucuugcccuguca

SEQ ID NO: 217973 - RNA, 20 nt, Homo sapiens
gagauguugaucagggcuau

SEQ ID NO: 217974 - RNA, 22 nt, Homo sapiens
gagauuauugucucccucacca

SEQ ID NO: 217975 - RNA, 22 nt, Homo sapiens
gagauuuucagcuugacuggga

SEQ ID NO: 217976 - RNA, 22 nt, Homo sapiens
gagcaaugagcugccugcugag

SEQ ID NO: 217977 - RNA, 22 nt, Homo sapiens
gagcacccuuuguugauugcaa

SEQ ID NO: 217978 - RNA, 22 nt, Homo sapiens
gagcacugaauacugugguggu

SEQ ID NO: 217979 - RNA, 22 nt, Homo sapiens
gagcagacaugaggaccgcugg

SEQ ID NO: 217980 - RNA, 22 nt, Homo sapiens
gagcaucauggggccaaagcgc

SEQ ID NO: 217981 - RNA, 22 nt, Homo sapiens
gagccauggagaaaacagcuau

SEQ ID NO: 217982 - RNA, 22 nt, Homo sapiens
gagcucaccuuaccucuggagc

SEQ ID NO: 217983 - RNA, 22 nt, Homo sapiens
gagcuggacuucuuaccuuuuc

SEQ ID NO: 217984 - RNA, 22 nt, Homo sapiens
gagcuguugguuugaaagaauu

SEQ ID NO: 217985 - RNA, 22 nt, Homo sapiens
gagcuuguagugugaaugguau

SEQ ID NO: 217986 - RNA, 22 nt, Homo sapiens
gccugagaggauaugauccccu

SEQ ID NO: 217987 - RNA, 22 nt, Homo sapiens
gcgagcauuguaggaaguucag

SEQ ID NO: 217988 - RNA, 22 nt, Homo sapiens
gcguugcacuccagccugggua

SEQ ID NO: 217989 - RNA, 22 nt, Homo sapiens
gcuacugucuaucugugcuucu

SEQ ID NO: 217990 - RNA, 23 nt, Homo sapiens
gcuaggagagaugaaacacaggu

SEQ ID NO: 217991 - RNA, 22 nt, Homo sapiens
gcuaggagauccacugcucucu

SEQ ID NO: 217992 - RNA, 22 nt, Homo sapiens
gcucaugagacaagcaggagua

SEQ ID NO: 217993 - RNA, 22 nt, Homo sapiens
gcucugguuacaaaggcaaauu

SEQ ID NO: 217994 - RNA, 22 nt, Homo sapiens
gcugagacauugguuuucuccu

SEQ ID NO: 217995 - RNA, 19 nt, Homo sapiens
gcugauguuacauucuugc

SEQ ID NO: 217996 - RNA, 22 nt, Homo sapiens
gcugauguuuucagguaauucu

SEQ ID NO: 217997 - RNA, 17 nt, Homo sapiens
gcugcauucauguagaa

SEQ ID NO: 217998 - RNA, 22 nt, Homo sapiens
gcugcuguuucucuuucagcau

SEQ ID NO: 217999 - RNA, 22 nt, Homo sapiens
gcuggaauuaacauagaugugc

SEQ ID NO: 218000 - RNA, 22 nt, Homo sapiens
gcuggguucagagugggcugcg

SEQ ID NO: 218001 - RNA, 22 nt, Homo sapiens
aucauacuguuuugauuacugu

SEQ ID NO: 218002 - RNA, 22 nt, Homo sapiens
aucauagcucacugcagccucg

SEQ ID NO: 218003 - RNA, 22 nt, Homo sapiens
aucaucacaguuguguguaaug

SEQ ID NO: 218004 - RNA, 22 nt, Homo sapiens
aucauccugucaggagcuguga

SEQ ID NO: 218005 - RNA, 22 nt, Homo sapiens
aucauguuuauguguaggauau

SEQ ID NO: 218006 - RNA, 22 nt, Homo sapiens
auccacagugucaauguuguga

SEQ ID NO: 218007 - RNA, 22 nt, Homo sapiens
auccacauucauggaccagucc

SEQ ID NO: 218008 - RNA, 22 nt, Homo sapiens
auccauugucuaaugcuaagau

SEQ ID NO: 218009 - RNA, 22 nt, Homo sapiens
aucccaguaaaaauggcuucua

SEQ ID NO: 218010 - RNA, 22 nt, Homo sapiens
aucccaguucagccucugacac

SEQ ID NO: 218011 - RNA, 20 nt, Homo sapiens
aucccauuccugaagauacu

SEQ ID NO: 218012 - RNA, 22 nt, Homo sapiens
aucccgagacuuugcugaaguu

SEQ ID NO: 218013 - RNA, 22 nt, Homo sapiens
aucccuagaaaaaucagcacau

SEQ ID NO: 218014 - RNA, 22 nt, Homo sapiens
aucccugagaacuuuuaauguu

SEQ ID NO: 218015 - RNA, 22 nt, Homo sapiens
aucccugagccugacucucaga

SEQ ID NO: 218016 - RNA, 22 nt, Homo sapiens
aucccuguaacuagcagccccu

SEQ ID NO: 218017 - RNA, 22 nt, Homo sapiens
aucccugugauccaaucacuuc

SEQ ID NO: 218018 - RNA, 22 nt, Homo sapiens
aucccuuccuagcacuuggugu

SEQ ID NO: 218019 - RNA, 22 nt, Homo sapiens
aucccuugacguggagucucug

SEQ ID NO: 218020 - RNA, 22 nt, Homo sapiens
aucccuuucucuggcuaggggg

SEQ ID NO: 218021 - RNA, 22 nt, Homo sapiens
aucccuuucugauacuuucccu

SEQ ID NO: 218022 - RNA, 22 nt, Homo sapiens
auccugaagcuuuacugaauuc

SEQ ID NO: 218023 - RNA, 22 nt, Homo sapiens
auccugagacuuugcugaaguu

SEQ ID NO: 218024 - RNA, 22 nt, Homo sapiens
auccuuuagacuguccaguuga

SEQ ID NO: 218025 - RNA, 22 nt, Homo sapiens
aucgcaccauugcacuccagca

SEQ ID NO: 218026 - RNA, 22 nt, Homo sapiens
aucgcgccauuguacuccagcc

SEQ ID NO: 218027 - RNA, 22 nt, Homo sapiens
aucuacagccagucugguuugu

SEQ ID NO: 218028 - RNA, 22 nt, Homo sapiens
aucugcaaauaaugaagauugg

SEQ ID NO: 218029 - RNA, 22 nt, Homo sapiens
aucugcauucccauguuuauug

SEQ ID NO: 218030 - RNA, 22 nt, Homo sapiens
aucugguguccucgugggaguc

SEQ ID NO: 218031 - RNA, 22 nt, Homo sapiens
aucugguguuuccuucacauug

SEQ ID NO: 218032 - RNA, 22 nt, Homo sapiens
aucuguagauucagcacaagcu

SEQ ID NO: 218033 - RNA, 22 nt, Homo sapiens
aucuugggugggaacugagaau

SEQ ID NO: 218034 - RNA, 22 nt, Homo sapiens
aucuuuggauacuugauauagu

SEQ ID NO: 218035 - RNA, 22 nt, Homo sapiens
aucuuuggugaguucuuugguc

SEQ ID NO: 218036 - RNA, 22 nt, Homo sapiens
aucuuuggugcaugauacuuug

SEQ ID NO: 218037 - RNA, 22 nt, Homo sapiens
augaaaacaugauuugccuguu

SEQ ID NO: 218038 - RNA, 22 nt, Homo sapiens
augaaaagcauaaacgcugaag

SEQ ID NO: 218039 - RNA, 22 nt, Homo sapiens
augaaacuggagcgccuggagg

SEQ ID NO: 218040 - RNA, 22 nt, Homo sapiens
augaaagucaauccccaagugu

SEQ ID NO: 218041 - RNA, 22 nt, Homo sapiens
augaacucaucaucuagguuuu

SEQ ID NO: 218042 - RNA, 22 nt, Homo sapiens
augaaguauuaggacacauuua

SEQ ID NO: 218043 - RNA, 22 nt, Homo sapiens
augaagucguuacuaccaauug

SEQ ID NO: 218044 - RNA, 20 nt, Homo sapiens
augaagugaaguuagggaac

SEQ ID NO: 218045 - RNA, 22 nt, Homo sapiens
augaaugcuuuuggauguaucu

SEQ ID NO: 218046 - RNA, 22 nt, Homo sapiens
augaauguaaagaaugugggaa

SEQ ID NO: 218047 - RNA, 22 nt, Homo sapiens
augacagagauaugugaauuuu

SEQ ID NO: 218048 - RNA, 22 nt, Homo sapiens
augacaguaugacuccaaaagu

SEQ ID NO: 218049 - RNA, 22 nt, Homo sapiens
augacagugagugagcucucac

SEQ ID NO: 218050 - RNA, 22 nt, Homo sapiens
augacauugaugcucuggcugg

SEQ ID NO: 218051 - RNA, 21 nt, Homo sapiens
augacccuggguguccuuucc

SEQ ID NO: 218052 - RNA, 18 nt, Homo sapiens
augaccugcggguuauau

SEQ ID NO: 218053 - RNA, 22 nt, Homo sapiens
augacucagaucuguuccuggu

SEQ ID NO: 218054 - RNA, 22 nt, Homo sapiens
augacugaguagcauuccauua

SEQ ID NO: 218055 - RNA, 22 nt, Homo sapiens
augacugucagggcagucauug

SEQ ID NO: 218056 - RNA, 19 nt, Homo sapiens
augagaacagacuccauuu

SEQ ID NO: 218057 - RNA, 22 nt, Homo sapiens
augagacuguucuuccucauug

SEQ ID NO: 218058 - RNA, 22 nt, Homo sapiens
augagauauguuaaaaguuaaa

SEQ ID NO: 218059 - RNA, 22 nt, Homo sapiens
augagauuauguaaagagacca

SEQ ID NO: 218060 - RNA, 19 nt, Homo sapiens
augagcaauaguuuuaauc

SEQ ID NO: 218061 - RNA, 22 nt, Homo sapiens
augagcucauaaagagugauuu

SEQ ID NO: 218062 - RNA, 17 nt, Homo sapiens
augagcucaucauuuuu

SEQ ID NO: 218063 - RNA, 22 nt, Homo sapiens
augaggaaggagccuuugucug

SEQ ID NO: 218064 - RNA, 22 nt, Homo sapiens
augaggaagucaggcccagggg

SEQ ID NO: 218065 - RNA, 22 nt, Homo sapiens
augaggagauauuaaauaccau

SEQ ID NO: 218066 - RNA, 22 nt, Homo sapiens
augaggauagguuucuauuagg

SEQ ID NO: 218067 - RNA, 22 nt, Homo sapiens
augaggcuauaauuuuuaugua

SEQ ID NO: 218068 - RNA, 22 nt, Homo sapiens
augagggaagcucacgugucca

SEQ ID NO: 218069 - RNA, 22 nt, Homo sapiens
augagguccuagccaacuuuuu

SEQ ID NO: 218070 - RNA, 22 nt, Homo sapiens
augaggugaggucaguaaggua

SEQ ID NO: 218071 - RNA, 22 nt, Homo sapiens
augaggugcagaggaaaugagu

SEQ ID NO: 218072 - RNA, 22 nt, Homo sapiens
augagucacuuauuauuggggu

SEQ ID NO: 218073 - RNA, 22 nt, Homo sapiens
augauagguuuagguuuagaca

SEQ ID NO: 218074 - RNA, 22 nt, Homo sapiens
augauauggguugucaguugua

SEQ ID NO: 218075 - RNA, 22 nt, Homo sapiens
augaucaucugaaagcuuuuac

SEQ ID NO: 218076 - RNA, 22 nt, Homo sapiens
augaucauggaaguuuuccugu

SEQ ID NO: 218077 - RNA, 22 nt, Homo sapiens
augaugcugcaguuguugccaa

SEQ ID NO: 218078 - RNA, 22 nt, Homo sapiens
augcaaacaucauagaguguac

SEQ ID NO: 218079 - RNA, 22 nt, Homo sapiens
augcaaaucuuaaguaugugug

SEQ ID NO: 218080 - RNA, 22 nt, Homo sapiens
augcaacugcacuccagccugg

SEQ ID NO: 218081 - RNA, 22 nt, Homo sapiens
augcaagaaauaucucuuuuuc

SEQ ID NO: 218082 - RNA, 22 nt, Homo sapiens
augcaaggaugguuagauauau

SEQ ID NO: 218083 - RNA, 22 nt, Homo sapiens
augcacaguccagcccaugugg

SEQ ID NO: 218084 - RNA, 22 nt, Homo sapiens
augcauaugucuuuauaguggc

SEQ ID NO: 218085 - RNA, 22 nt, Homo sapiens
augcauggagucuuucacaagu

SEQ ID NO: 218086 - RNA, 22 nt, Homo sapiens
augccacugcacuucagccugc

SEQ ID NO: 218087 - RNA, 22 nt, Homo sapiens
augccacuguuuaugucacuua

SEQ ID NO: 218088 - RNA, 22 nt, Homo sapiens
ucucaguuuucaagcugucgau

SEQ ID NO: 218089 - RNA, 20 nt, Homo sapiens
ucucauggagggaaagagca

SEQ ID NO: 218090 - RNA, 20 nt, Homo sapiens
ucucccaaacagcaggcccu

SEQ ID NO: 218091 - RNA, 17 nt, Homo sapiens
ucucccaucccuuucuc

SEQ ID NO: 218092 - RNA, 22 nt, Homo sapiens
acugcacuccaguuugggcagc

SEQ ID NO: 218093 - RNA, 19 nt, Homo sapiens
acugcacuccuccuugggu

SEQ ID NO: 218094 - RNA, 22 nt, Homo sapiens
acugcacucuagccuuggcaac

SEQ ID NO: 218095 - RNA, 22 nt, Homo sapiens
acugcacuucagccuuggcuac

SEQ ID NO: 218096 - RNA, 22 nt, Homo sapiens
acugcacuucagccuuggggac

SEQ ID NO: 218097 - RNA, 22 nt, Homo sapiens
acugcauuugucugucucaauu

SEQ ID NO: 218098 - RNA, 22 nt, Homo sapiens
acugccuaaugacuuauguuuu

SEQ ID NO: 218099 - RNA, 18 nt, Homo sapiens
acuggaauuaaacuuuuu

SEQ ID NO: 218100 - RNA, 22 nt, Homo sapiens
acuggcaauggcagaaauaguu

SEQ ID NO: 218101 - RNA, 22 nt, Homo sapiens
acuggguuaauuugaagguuga

SEQ ID NO: 218102 - RNA, 22 nt, Homo sapiens
acuguauagauggaguugauuu

SEQ ID NO: 218103 - RNA, 22 nt, Homo sapiens
acuguguguuugucuagcacag

SEQ ID NO: 218104 - RNA, 20 nt, Homo sapiens
acuuuuugaugaggucguuu

SEQ ID NO: 218105 - RNA, 22 nt, Homo sapiens
acuuuuugcaaccauuuggacc

SEQ ID NO: 218106 - RNA, 22 nt, Homo sapiens
agaaacauucucuugccuccuu

SEQ ID NO: 218107 - RNA, 22 nt, Homo sapiens
agaaccauuagagggagauauu

SEQ ID NO: 218108 - RNA, 22 nt, Homo sapiens
agaagacuauucuggguugggc

SEQ ID NO: 218109 - RNA, 22 nt, Homo sapiens
agaagugcuggguucaggcugg

SEQ ID NO: 218110 - RNA, 19 nt, Homo sapiens
agaaucuaaauuauuucug

SEQ ID NO: 218111 - RNA, 22 nt, Homo sapiens
agaaugauccuucucagaggca

SEQ ID NO: 218112 - RNA, 22 nt, Homo sapiens
agaaugucaguauuggcuaaaa

SEQ ID NO: 218113 - RNA, 22 nt, Homo sapiens
agacaagauggcuugagguuca

SEQ ID NO: 218114 - RNA, 22 nt, Homo sapiens
agacacugaaauguauugaaga

SEQ ID NO: 218115 - RNA, 22 nt, Homo sapiens
agacaguauuggcaaagugugu

SEQ ID NO: 218116 - RNA, 22 nt, Homo sapiens
agacaguguguguauauauggu

SEQ ID NO: 218117 - RNA, 23 nt, Homo sapiens
agacugaaguaucugagacucag

SEQ ID NO: 218118 - RNA, 19 nt, Homo sapiens
agacuggcccaggcgggug

SEQ ID NO: 218119 - RNA, 22 nt, Homo sapiens
agacuguaaugcauaauuuacu

SEQ ID NO: 218120 - RNA, 22 nt, Homo sapiens
agagaacugauucagggaaaau

SEQ ID NO: 218121 - RNA, 22 nt, Homo sapiens
agagaacuggcuucaccauucu

SEQ ID NO: 218122 - RNA, 22 nt, Homo sapiens
agagacauugcuccaacucacc

SEQ ID NO: 218123 - RNA, 22 nt, Homo sapiens
agagagcuugggguguuaaauu

SEQ ID NO: 218124 - RNA, 22 nt, Homo sapiens
agagauaaagauuuuaauuuug

SEQ ID NO: 218125 - RNA, 22 nt, Homo sapiens
agagauacauucugagaagugc

SEQ ID NO: 218126 - RNA, 20 nt, Homo sapiens
agagcaaagccgcaccccua

SEQ ID NO: 218127 - RNA, 22 nt, Homo sapiens
agagcaccauuuagcaagguga

SEQ ID NO: 218128 - RNA, 18 nt, Homo sapiens
agagcacugaguuuuaga

SEQ ID NO: 218129 - RNA, 22 nt, Homo sapiens
agagcacugcugcaggguucug

SEQ ID NO: 218130 - RNA, 22 nt, Homo sapiens
agagcauugaguuaaugguuca

SEQ ID NO: 218131 - RNA, 22 nt, Homo sapiens
agagguuuugcacugguucuuu

SEQ ID NO: 218132 - RNA, 22 nt, Homo sapiens
agagguuuuggggcugagagcu

SEQ ID NO: 218133 - RNA, 22 nt, Homo sapiens
agaguaguaggaugaauggacu

SEQ ID NO: 218134 - RNA, 23 nt, Homo sapiens
agagugcaauggugccaucucgg

SEQ ID NO: 218135 - RNA, 20 nt, Homo sapiens
agagugcuggacugaggagc

SEQ ID NO: 218136 - RNA, 20 nt, Homo sapiens
agagugcugucuguccugag

SEQ ID NO: 218137 - RNA, 22 nt, Homo sapiens
agauacauuggauaaugguggg

SEQ ID NO: 218138 - RNA, 22 nt, Homo sapiens
agauauguuauugauguuaaug

SEQ ID NO: 218139 - RNA, 22 nt, Homo sapiens
agaugauguuucuggcacauga

SEQ ID NO: 218140 - RNA, 22 nt, Homo sapiens
agaugguauuauagguuucugu

SEQ ID NO: 218141 - RNA, 22 nt, Homo sapiens
agauggucuucauaaguuuuaa

SEQ ID NO: 218142 - RNA, 18 nt, Homo sapiens
agaugguguugcuucugu

SEQ ID NO: 218143 - RNA, 22 nt, Homo sapiens
agauucauccaaguuguugcau

SEQ ID NO: 218144 - RNA, 23 nt, Homo sapiens
agcaaaugcucuagcacuccaac

SEQ ID NO: 218145 - RNA, 22 nt, Homo sapiens
agcaacauagugagacccccau

SEQ ID NO: 218146 - RNA, 22 nt, Homo sapiens
agcacauauauuucccaaaaca

SEQ ID NO: 218147 - RNA, 22 nt, Homo sapiens
agcacauuaguaucuaagaaca

SEQ ID NO: 218148 - RNA, 22 nt, Homo sapiens
agcaccaccguugcucuauccc

SEQ ID NO: 218149 - RNA, 22 nt, Homo sapiens
agcaccauuguacuccagccug

SEQ ID NO: 218150 - RNA, 22 nt, Homo sapiens
agcaccauuucucuaaagcacu

SEQ ID NO: 218151 - RNA, 21 nt, Homo sapiens
agcagaguggcagcucuuuug

SEQ ID NO: 218152 - RNA, 22 nt, Homo sapiens
agcagcaugcaaauggacuaau

SEQ ID NO: 218153 - RNA, 17 nt, Homo sapiens
agcagcccauaucccca

SEQ ID NO: 218154 - RNA, 22 nt, Homo sapiens
agcagcuuugaucugaaugauu

SEQ ID NO: 218155 - RNA, 16 nt, Homo sapiens
agcagguguuagguga

SEQ ID NO: 218156 - RNA, 22 nt, Homo sapiens
agcaguacauaaaaagcauccu

SEQ ID NO: 218157 - RNA, 22 nt, Homo sapiens
agcaguagaauuccugcaucac

SEQ ID NO: 218158 - RNA, 22 nt, Homo sapiens
agcaguagugaaaguagacuua

SEQ ID NO: 218159 - RNA, 22 nt, Homo sapiens
agcagugugagaauggacuaau

SEQ ID NO: 218160 - RNA, 17 nt, Homo sapiens
agcauguguuugagauu

SEQ ID NO: 218161 - RNA, 22 nt, Homo sapiens
agccaagacucuguuccccuug

SEQ ID NO: 218162 - RNA, 22 nt, Homo sapiens
agccaguuuggcuaauuuuggc

SEQ ID NO: 218163 - RNA, 19 nt, Homo sapiens
agccaguuuucccagcacc

SEQ ID NO: 218164 - RNA, 22 nt, Homo sapiens
agccauacaacguaugcaugua

SEQ ID NO: 218165 - RNA, 22 nt, Homo sapiens
agcccauuuugcacugagaugc

SEQ ID NO: 218166 - RNA, 19 nt, Homo sapiens
ucaccaguacacaauacaa

SEQ ID NO: 218167 - RNA, 22 nt, Homo sapiens
ucaccaguggcacuccagccug

SEQ ID NO: 218168 - RNA, 22 nt, Homo sapiens
ucacccuguguuuugcguuugc

SEQ ID NO: 218169 - RNA, 22 nt, Homo sapiens
ucaccuggagagcuugcuaaua

SEQ ID NO: 218170 - RNA, 21 nt, Homo sapiens
ucaccuguagcugcauguucu

SEQ ID NO: 218171 - RNA, 18 nt, Homo sapiens
ucaccuugaugcuggguc

SEQ ID NO: 218172 - RNA, 18 nt, Homo sapiens
ucaccuugugagagagag

SEQ ID NO: 218173 - RNA, 22 nt, Homo sapiens
ucacuaaagaaaauggcaugga

SEQ ID NO: 218174 - RNA, 22 nt, Homo sapiens
ucacuagggaucacuuuacccg

SEQ ID NO: 218175 - RNA, 20 nt, Homo sapiens
ucacuauggagcucuuucuu

SEQ ID NO: 218176 - RNA, 22 nt, Homo sapiens
ucacucagaccuggugauaugc

SEQ ID NO: 218177 - RNA, 22 nt, Homo sapiens
ucacugaaaccuccaccucucg

SEQ ID NO: 218178 - RNA, 22 nt, Homo sapiens
ucacugaaacuguccuggguua

SEQ ID NO: 218179 - RNA, 22 nt, Homo sapiens
ucacugcacuucaggcuuucuc

SEQ ID NO: 218180 - RNA, 22 nt, Homo sapiens
ucacuggacagaaauaaaggug

SEQ ID NO: 218181 - RNA, 19 nt, Homo sapiens
ucacuggacagcacacuca

SEQ ID NO: 218182 - RNA, 22 nt, Homo sapiens
ucacuggcaaauauauccguug

SEQ ID NO: 218183 - RNA, 22 nt, Homo sapiens
ucacuggucuaaguggaggggg

SEQ ID NO: 218184 - RNA, 22 nt, Homo sapiens
ucacugugcaugaaggaugcug

SEQ ID NO: 218185 - RNA, 22 nt, Homo sapiens
ucacugugguuuugaugugcau

SEQ ID NO: 218186 - RNA, 22 nt, Homo sapiens
ucacuguguauguauaugcagg

SEQ ID NO: 218187 - RNA, 22 nt, Homo sapiens
ucacuugguggcaaaguuuaug

SEQ ID NO: 218188 - RNA, 22 nt, Homo sapiens
ucacuuuggguacuauggaaau

SEQ ID NO: 218189 - RNA, 22 nt, Homo sapiens
ucacuuuguuuuuggauaaguu

SEQ ID NO: 218190 - RNA, 22 nt, Homo sapiens
ucagaacugaacaaaccagucu

SEQ ID NO: 218191 - RNA, 22 nt, Homo sapiens
ucagagcaaagacacuuuauca

SEQ ID NO: 218192 - RNA, 22 nt, Homo sapiens
ucagaguagagcgacuucuccu

SEQ ID NO: 218193 - RNA, 22 nt, Homo sapiens
gcaagacaugucuaagguuuaa

SEQ ID NO: 218194 - RNA, 22 nt, Homo sapiens
gcacagaugaggagaggucuca

SEQ ID NO: 218195 - RNA, 22 nt, Homo sapiens
gcacaguaggugguaggacuuu

SEQ ID NO: 218196 - RNA, 22 nt, Homo sapiens
gcacauggccccaucgugccga

SEQ ID NO: 218197 - RNA, 22 nt, Homo sapiens
gcacauuacaaguauuagcuca

SEQ ID NO: 218198 - RNA, 22 nt, Homo sapiens
gcaccacugcacucucagcuug

SEQ ID NO: 218199 - RNA, 22 nt, Homo sapiens
gcaccauugacaagaaauaggu

SEQ ID NO: 218200 - RNA, 22 nt, Homo sapiens
gcacgcauuguccuucuaguca

SEQ ID NO: 218201 - RNA, 22 nt, Homo sapiens
gcacgugcucauuugaggucuu

SEQ ID NO: 218202 - RNA, 17 nt, Homo sapiens
gcacuggcguaucccac

SEQ ID NO: 218203 - RNA, 22 nt, Homo sapiens
gcagagaaacaggucuaaggag

SEQ ID NO: 218204 - RNA, 22 nt, Homo sapiens
gcagaucuucgcgguaaguguu

SEQ ID NO: 218205 - RNA, 22 nt, Homo sapiens
gcagcacauggcagaacauauu

SEQ ID NO: 218206 - RNA, 22 nt, Homo sapiens
gcagcaguggcaguuaauauuu

SEQ ID NO: 218207 - RNA, 22 nt, Homo sapiens
gcagcagugugggcugaaccua

SEQ ID NO: 218208 - RNA, 22 nt, Homo sapiens
gcagcauuaccaagacauggca

SEQ ID NO: 218209 - RNA, 22 nt, Homo sapiens
gcaggaaucuugagaaggauuc

SEQ ID NO: 218210 - RNA, 22 nt, Homo sapiens
gcaggauuggagccucucugaa

SEQ ID NO: 218211 - RNA, 22 nt, Homo sapiens
gcaggcaugacauuucacucuu

SEQ ID NO: 218212 - RNA, 22 nt, Homo sapiens
gcagguguuaugcaaacaacug

SEQ ID NO: 218213 - RNA, 17 nt, Homo sapiens
gcaguacuuaguaagga

SEQ ID NO: 218214 - RNA, 23 nt, Homo sapiens
gcagucauuuggaaaagguugaa

SEQ ID NO: 218215 - RNA, 22 nt, Homo sapiens
gcagugaugugaucauagcuca

SEQ ID NO: 218216 - RNA, 22 nt, Homo sapiens
gcagugcaguggcgcgaucucg

SEQ ID NO: 218217 - RNA, 16 nt, Homo sapiens
gcaguguguuuaauag

SEQ ID NO: 218218 - RNA, 22 nt, Homo sapiens
gcauauguuuggguguguauau

SEQ ID NO: 218219 - RNA, 20 nt, Homo sapiens
gcaugagucuuuauaguaga

SEQ ID NO: 218220 - RNA, 22 nt, Homo sapiens
gcaugauuuuauaucuauguaa

SEQ ID NO: 218221 - RNA, 22 nt, Homo sapiens
gcauggaguggaaauucuuggg

SEQ ID NO: 218222 - RNA, 22 nt, Homo sapiens
gcauggauguugauggcugcug

SEQ ID NO: 218223 - RNA, 20 nt, Homo sapiens
gccacaguuaagcuucugcc

SEQ ID NO: 218224 - RNA, 19 nt, Homo sapiens
gccaccuggugcguguucu

SEQ ID NO: 218225 - RNA, 22 nt, Homo sapiens
gccaguauuuuauugagaauuu

SEQ ID NO: 218226 - RNA, 22 nt, Homo sapiens
gccaguauuuuguugagaauuu

SEQ ID NO: 218227 - RNA, 22 nt, Homo sapiens
gccauggugucuuauuuuugug

SEQ ID NO: 218228 - RNA, 22 nt, Homo sapiens
gccauugcacuccagccuagcg

SEQ ID NO: 218229 - RNA, 22 nt, Homo sapiens
gccauugcacuccagccuaggc

SEQ ID NO: 218230 - RNA, 22 nt, Homo sapiens
gccauugcacuccagccucggg

SEQ ID NO: 218231 - RNA, 22 nt, Homo sapiens
gccauugcacuccagccugagc

SEQ ID NO: 218232 - RNA, 22 nt, Homo sapiens
gccauugcacucuagccuaggu

SEQ ID NO: 218233 - RNA, 22 nt, Homo sapiens
gcccacuguuaaauuuguuuua

SEQ ID NO: 218234 - RNA, 22 nt, Homo sapiens
gccccugagacuugccucgggc

SEQ ID NO: 218235 - RNA, 22 nt, Homo sapiens
gcccgugagacuggaagcaaga

SEQ ID NO: 218236 - RNA, 22 nt, Homo sapiens
gcccugagauucuuggauucug

SEQ ID NO: 218237 - RNA, 22 nt, Homo sapiens
gcccuuugugucuggcuggggu

SEQ ID NO: 218238 - RNA, 22 nt, Homo sapiens
gccuagagaguuaucaggcugu

SEQ ID NO: 218239 - RNA, 22 nt, Homo sapiens
gccuguagaagaguagaugacc

SEQ ID NO: 218240 - RNA, 22 nt, Homo sapiens
gcgguagcauagacugcaggac

SEQ ID NO: 218241 - RNA, 22 nt, Homo sapiens
gcuaaggcaggagcauugcuug

SEQ ID NO: 218242 - RNA, 22 nt, Homo sapiens
gcuagcacauugucaccucuca

SEQ ID NO: 218243 - RNA, 22 nt, Homo sapiens
gcucaugggcagugugauuguu

SEQ ID NO: 218244 - RNA, 22 nt, Homo sapiens
gcuccuuugaguagcuucugug

SEQ ID NO: 218245 - RNA, 22 nt, Homo sapiens
gcugaguaguauuucauuguau

SEQ ID NO: 218246 - RNA, 22 nt, Homo sapiens
gcugauggugcaguucuagccu

SEQ ID NO: 218247 - RNA, 22 nt, Homo sapiens
gcugauguuggccucugggcuu

SEQ ID NO: 218248 - RNA, 17 nt, Homo sapiens
gcugauguuugcauuuu

SEQ ID NO: 218249 - RNA, 22 nt, Homo sapiens
gcugcacuuuaaggcauccccu

SEQ ID NO: 218250 - RNA, 22 nt, Homo sapiens
gcugcuguuuaguuucuccugg

SEQ ID NO: 218251 - RNA, 22 nt, Homo sapiens
gcuggcaagaugcugaugcaac

SEQ ID NO: 218252 - RNA, 22 nt, Homo sapiens
gcuggcuuucuccugaucucag

SEQ ID NO: 218253 - RNA, 22 nt, Homo sapiens
gcuguauugacuuuguaucaua

SEQ ID NO: 218254 - RNA, 22 nt, Homo sapiens
gcuguauuguugaaggaaaugu

SEQ ID NO: 218255 - RNA, 20 nt, Homo sapiens
gcugugcuuaauacacuuuc

SEQ ID NO: 218256 - RNA, 22 nt, Homo sapiens
gcuguguugugcccagcaucau

SEQ ID NO: 218257 - RNA, 19 nt, Homo sapiens
gcuucuugaggacgaugac

SEQ ID NO: 218258 - RNA, 22 nt, Homo sapiens
gcuuguguucaaggaacaccua

SEQ ID NO: 218259 - RNA, 22 nt, Homo sapiens
gcuuguguuuacuguaguuacu

SEQ ID NO: 218260 - RNA, 22 nt, Homo sapiens
gcuuugcaauggcauugaccau

SEQ ID NO: 218261 - RNA, 22 nt, Homo sapiens
gcuuuggcauguagauguaugg

SEQ ID NO: 218262 - RNA, 22 nt, Homo sapiens
gcuuugguucaaccaggcaauu

SEQ ID NO: 218263 - RNA, 22 nt, Homo sapiens
gcuuuuggaggaacuuaagauu

SEQ ID NO: 218264 - RNA, 22 nt, Homo sapiens
ggaaauguaaacaauggggcua

SEQ ID NO: 218265 - RNA, 19 nt, Homo sapiens
ggaaaugucuauuaagauc

SEQ ID NO: 218266 - RNA, 22 nt, Homo sapiens
ggaaauguuggugucaugaguu

SEQ ID NO: 218267 - RNA, 22 nt, Homo sapiens
ggaagaauaaugggccuuagag

SEQ ID NO: 218268 - RNA, 22 nt, Homo sapiens
ggaagacaguguggugauuccu

SEQ ID NO: 218269 - RNA, 22 nt, Homo sapiens
ggaagacuggcuuguuuaccca

SEQ ID NO: 218270 - RNA, 22 nt, Homo sapiens
ggaagacuuagaguagcaucag

SEQ ID NO: 218271 - RNA, 22 nt, Homo sapiens
ggaagguaauuggcuaaugaga

SEQ ID NO: 218272 - RNA, 22 nt, Homo sapiens
ggaagugcuguguggaagucug

SEQ ID NO: 218273 - RNA, 22 nt, Homo sapiens
ggaaguuaauacagauagagua

SEQ ID NO: 218274 - RNA, 22 nt, Homo sapiens
ggaauauaaaacuuuugacagg

SEQ ID NO: 218275 - RNA, 22 nt, Homo sapiens
ggaaugagaaauauuacacaau

SEQ ID NO: 218276 - RNA, 22 nt, Homo sapiens
ggaaugcagugagcauuagaua

SEQ ID NO: 218277 - RNA, 21 nt, Homo sapiens
ggaauguugccagcagccaga

SEQ ID NO: 218278 - RNA, 22 nt, Homo sapiens
ggacacaucaugugaccaaggu

SEQ ID NO: 218279 - RNA, 22 nt, Homo sapiens
ggacauguauauauaugugugu

SEQ ID NO: 218280 - RNA, 22 nt, Homo sapiens
ggacauuaacugcaagauagau

SEQ ID NO: 218281 - RNA, 22 nt, Homo sapiens
ggacuagaggugaaaagaagac

SEQ ID NO: 218282 - RNA, 22 nt, Homo sapiens
ggacuagggacauggggagcug

SEQ ID NO: 218283 - RNA, 22 nt, Homo sapiens
ggagaauguaauugguauuuug

SEQ ID NO: 218284 - RNA, 22 nt, Homo sapiens
ggagagcuaggcagagguuugu

SEQ ID NO: 218285 - RNA, 22 nt, Homo sapiens
ggagauaauccagggagggacu

SEQ ID NO: 218286 - RNA, 22 nt, Homo sapiens
ggagcugugauuugaguccaga

SEQ ID NO: 218287 - RNA, 16 nt, Homo sapiens
ggaggucaucugggaa

SEQ ID NO: 218288 - RNA, 21 nt, Homo sapiens
ggaguauaaggcaaaggagug

SEQ ID NO: 218289 - RNA, 22 nt, Homo sapiens
ggagucugaacuggacaaugac

SEQ ID NO: 218290 - RNA, 22 nt, Homo sapiens
ggagucugacuuauaggaaccu

SEQ ID NO: 218291 - RNA, 22 nt, Homo sapiens
ggagucugauguucuaaggcag

SEQ ID NO: 218292 - RNA, 22 nt, Homo sapiens
ggagucuugcuauguugccaag

SEQ ID NO: 218293 - RNA, 23 nt, Homo sapiens
ggaguguaaugacucgaucucgg

SEQ ID NO: 218294 - RNA, 22 nt, Homo sapiens
ggaguguaguggcuccaucucg

SEQ ID NO: 218295 - RNA, 22 nt, Homo sapiens
uucugagguuauauucucucaa

SEQ ID NO: 218296 - RNA, 22 nt, Homo sapiens
uucuggccuccauuuuucuccu

SEQ ID NO: 218297 - RNA, 22 nt, Homo sapiens
uucuuaguggcaccacuuuuuu

SEQ ID NO: 218298 - RNA, 18 nt, Homo sapiens
uucuuguguugauauuuu

SEQ ID NO: 218299 - RNA, 21 nt, Homo sapiens
uucuuugcucaguguuagagu

SEQ ID NO: 218300 - RNA, 19 nt, Homo sapiens
uucuuuguugugggggcug

SEQ ID NO: 218301 - RNA, 22 nt, Homo sapiens
uugaaagaaaggagacugaguu

SEQ ID NO: 218302 - RNA, 22 nt, Homo sapiens
uugaaagacagaggggcaaguu

SEQ ID NO: 218303 - RNA, 22 nt, Homo sapiens
uugaaagacaucaccuacugcu

SEQ ID NO: 218304 - RNA, 22 nt, Homo sapiens
uugaaagaugaacuggauugga

SEQ ID NO: 218305 - RNA, 22 nt, Homo sapiens
uugaaagcuaucagagauucca

SEQ ID NO: 218306 - RNA, 22 nt, Homo sapiens
uugaaagucuaggcuuacagua

SEQ ID NO: 218307 - RNA, 22 nt, Homo sapiens
uugaaaguguucacaaugguau

SEQ ID NO: 218308 - RNA, 22 nt, Homo sapiens
uugaaauguuuagaaguuugga

SEQ ID NO: 218309 - RNA, 22 nt, Homo sapiens
uugaagacuauaugauucuuca

SEQ ID NO: 218310 - RNA, 22 nt, Homo sapiens
uugaagugaagaacaauaucac

SEQ ID NO: 218311 - RNA, 22 nt, Homo sapiens
uugaaugaaaugaugucauuug

SEQ ID NO: 218312 - RNA, 22 nt, Homo sapiens
uugaaugaauggaaagaagggu

SEQ ID NO: 218313 - RNA, 22 nt, Homo sapiens
uugaauguaugcuggguuuacu

SEQ ID NO: 218314 - RNA, 22 nt, Homo sapiens
uugacagagaaaagugugacuu

SEQ ID NO: 218315 - RNA, 20 nt, Homo sapiens
uugacagagggaaaguugcu

SEQ ID NO: 218316 - RNA, 22 nt, Homo sapiens
uugacauaguuucugaaauaga

SEQ ID NO: 218317 - RNA, 22 nt, Homo sapiens
uugacauugcuguaguguccag

SEQ ID NO: 218318 - RNA, 22 nt, Homo sapiens
uugacuacaccaugccaggaac

SEQ ID NO: 218319 - RNA, 22 nt, Homo sapiens
uugacuccagagugaguaaaug

SEQ ID NO: 218320 - RNA, 22 nt, Homo sapiens
uugacuguaagauggcuauuac

SEQ ID NO: 218321 - RNA, 23 nt, Homo sapiens
uugacuguggguacaaugugaua

SEQ ID NO: 218322 - RNA, 22 nt, Homo sapiens
uugacuucagagcugauucaag

SEQ ID NO: 218323 - RNA, 22 nt, Homo sapiens
uugagaaucuuucgaauguucu

SEQ ID NO: 218324 - RNA, 22 nt, Homo sapiens
uugagaaucuuugcuaaaggaa

SEQ ID NO: 218325 - RNA, 22 nt, Homo sapiens
uugagacugagucucgcccugu

SEQ ID NO: 218326 - RNA, 22 nt, Homo sapiens
uugagagaaaaaauuuauuggu

SEQ ID NO: 218327 - RNA, 22 nt, Homo sapiens
uugagagaaaaggccaugccuu

SEQ ID NO: 218328 - RNA, 22 nt, Homo sapiens
uugagaguggcagagguggaac

SEQ ID NO: 218329 - RNA, 22 nt, Homo sapiens
uugagauggaaucucgcuuugu

SEQ ID NO: 218330 - RNA, 22 nt, Homo sapiens
uugagauggagccucacucugc

SEQ ID NO: 218331 - RNA, 22 nt, Homo sapiens
uugagauggagucucacucugc

SEQ ID NO: 218332 - RNA, 22 nt, Homo sapiens
uugagauggagucucacucuuc

SEQ ID NO: 218333 - RNA, 22 nt, Homo sapiens
uugagauggagucuugcucugu

SEQ ID NO: 218334 - RNA, 22 nt, Homo sapiens
uugagauggagucuuguucucu

SEQ ID NO: 218335 - RNA, 22 nt, Homo sapiens
uugagauggagucuuguucuuu

SEQ ID NO: 218336 - RNA, 22 nt, Homo sapiens
uugagauguauguauauaaugu

SEQ ID NO: 218337 - RNA, 22 nt, Homo sapiens
uugagauuauuguguuccuuua

SEQ ID NO: 218338 - RNA, 22 nt, Homo sapiens
uugagauuuuccucaaauauuu

SEQ ID NO: 218339 - RNA, 22 nt, Homo sapiens
uugagcaacauagugagacugu

SEQ ID NO: 218340 - RNA, 22 nt, Homo sapiens
uugagcaaugaacgauucaggg

SEQ ID NO: 218341 - RNA, 22 nt, Homo sapiens
uugagcaccaugccuggccaug

SEQ ID NO: 218342 - RNA, 22 nt, Homo sapiens
uugagcauugguauagguuuua

SEQ ID NO: 218343 - RNA, 22 nt, Homo sapiens
uugagcuagggagaucgagguc

SEQ ID NO: 218344 - RNA, 22 nt, Homo sapiens
uugagcuaugaguuaauaggac

SEQ ID NO: 218345 - RNA, 22 nt, Homo sapiens
uugaggcaaugaggagaagcug

SEQ ID NO: 218346 - RNA, 22 nt, Homo sapiens
uugagggagcauuuguuuugag

SEQ ID NO: 218347 - RNA, 22 nt, Homo sapiens
uugaggugggaggaucacuuga

SEQ ID NO: 218348 - RNA, 20 nt, Homo sapiens
uugaggugugaggggcagag

SEQ ID NO: 218349 - RNA, 22 nt, Homo sapiens
uugaguagugugaugcaugucu

SEQ ID NO: 218350 - RNA, 22 nt, Homo sapiens
uugaguccauucgaugcugauu

SEQ ID NO: 218351 - RNA, 22 nt, Homo sapiens
uugaguuugaguauucuaaagc

SEQ ID NO: 218352 - RNA, 22 nt, Homo sapiens
uugauaauguuaacuuugguca

SEQ ID NO: 218353 - RNA, 22 nt, Homo sapiens
uugauagacacauauccaugug

SEQ ID NO: 218354 - RNA, 22 nt, Homo sapiens
uugauaugaauggcuguuugug

SEQ ID NO: 218355 - RNA, 22 nt, Homo sapiens
uugauauguggaauauuuaucu

SEQ ID NO: 218356 - RNA, 22 nt, Homo sapiens
uugauauuaaguacugaagugg

SEQ ID NO: 218357 - RNA, 22 nt, Homo sapiens
uugcaaacaucuuguuucacau

SEQ ID NO: 218358 - RNA, 22 nt, Homo sapiens
uugcaacauuguaaguuuauau

SEQ ID NO: 218359 - RNA, 22 nt, Homo sapiens
uugcaaguggagcuuccagggc

SEQ ID NO: 218360 - RNA, 22 nt, Homo sapiens
uugcaaugugaugugauuugga

SEQ ID NO: 218361 - RNA, 22 nt, Homo sapiens
uugcacagucuagcuccaccuu

SEQ ID NO: 218362 - RNA, 22 nt, Homo sapiens
uugcacauuuuuucuggcagaa

SEQ ID NO: 218363 - RNA, 22 nt, Homo sapiens
uugcaccacugcacuccacccu

SEQ ID NO: 218364 - RNA, 22 nt, Homo sapiens
uugcacuccagcucuaggugac

SEQ ID NO: 218365 - RNA, 22 nt, Homo sapiens
uugcacuccagucuggggggca

SEQ ID NO: 218366 - RNA, 22 nt, Homo sapiens
uugcacuccggccuggguaaca

SEQ ID NO: 218367 - RNA, 22 nt, Homo sapiens
uugcacucugaagaccuacugu

SEQ ID NO: 218368 - RNA, 22 nt, Homo sapiens
uugcacuucauguaggccaaag

SEQ ID NO: 218369 - RNA, 22 nt, Homo sapiens
uugcagagaaauuucugguuua

SEQ ID NO: 218370 - RNA, 22 nt, Homo sapiens
uugcagagccccacacugggcu

SEQ ID NO: 218371 - RNA, 22 nt, Homo sapiens
uugcaggugguuuaugcaagac

SEQ ID NO: 218372 - RNA, 22 nt, Homo sapiens
uugcaguacuucuggcuuuaca

SEQ ID NO: 218373 - RNA, 22 nt, Homo sapiens
uugcauaagugcauucugugau

SEQ ID NO: 218374 - RNA, 22 nt, Homo sapiens
uugcauagaccgaugucuugga

SEQ ID NO: 218375 - RNA, 22 nt, Homo sapiens
uugcauauguugaaccaagcgu

SEQ ID NO: 218376 - RNA, 22 nt, Homo sapiens
uugcauauucucugaggcagga

SEQ ID NO: 218377 - RNA, 22 nt, Homo sapiens
uugcaucagcaggcauaauugg

SEQ ID NO: 218378 - RNA, 22 nt, Homo sapiens
uugcaugggagcugggugaagc

SEQ ID NO: 218379 - RNA, 22 nt, Homo sapiens
uugcaugucugcuucuccuccu

SEQ ID NO: 218380 - RNA, 22 nt, Homo sapiens
uugccaauauuuuacugagaag

SEQ ID NO: 218381 - RNA, 22 nt, Homo sapiens
uugccuaggcuggagugcagua

SEQ ID NO: 218382 - RNA, 22 nt, Homo sapiens
uugccuaggcuggaguucagug

SEQ ID NO: 218383 - RNA, 22 nt, Homo sapiens
uugccuuuguuggaaacaagug

SEQ ID NO: 218384 - RNA, 22 nt, Homo sapiens
uugcuacuuggauguacaugug

SEQ ID NO: 218385 - RNA, 22 nt, Homo sapiens
uugcuccccaggaaaggaagca

SEQ ID NO: 218386 - RNA, 21 nt, Homo sapiens
ucauaagcucaacaucuguag

SEQ ID NO: 218387 - RNA, 22 nt, Homo sapiens
ucauaggucacuguaaccucgu

SEQ ID NO: 218388 - RNA, 22 nt, Homo sapiens
ucauaguacuuuguuuugaaaa

SEQ ID NO: 218389 - RNA, 22 nt, Homo sapiens
ucauauguaugugcaauuuugu

SEQ ID NO: 218390 - RNA, 22 nt, Homo sapiens
ucaucagaaucccuuagggaug

SEQ ID NO: 218391 - RNA, 22 nt, Homo sapiens
ucaucagaguuuacaagcucag

SEQ ID NO: 218392 - RNA, 22 nt, Homo sapiens
ucaucaggaaacuuaugcagug

SEQ ID NO: 218393 - RNA, 22 nt, Homo sapiens
ucaucagugcuugcaaauuauu

SEQ ID NO: 218394 - RNA, 22 nt, Homo sapiens
ucaucuggcgaaugugaagagu

SEQ ID NO: 218395 - RNA, 22 nt, Homo sapiens
ucaugcaaugagucaggaggca

SEQ ID NO: 218396 - RNA, 22 nt, Homo sapiens
ucaugcaaugcaaggggaaauu

SEQ ID NO: 218397 - RNA, 19 nt, Homo sapiens
ucauggcuuuuucagcugu

SEQ ID NO: 218398 - RNA, 22 nt, Homo sapiens
ucauggggugagcuacaggcac

SEQ ID NO: 218399 - RNA, 22 nt, Homo sapiens
ucauggggugcuuugcuagauu

SEQ ID NO: 218400 - RNA, 22 nt, Homo sapiens
ucauggguuuugguccaagcaa

SEQ ID NO: 218401 - RNA, 22 nt, Homo sapiens
ucauucacucccuugaaguuag

SEQ ID NO: 218402 - RNA, 22 nt, Homo sapiens
ucauucauucauccagcuugag

SEQ ID NO: 218403 - RNA, 22 nt, Homo sapiens
ucauucauucuucaguggguac

SEQ ID NO: 218404 - RNA, 22 nt, Homo sapiens
ucauucuuucuguggaggggcu

SEQ ID NO: 218405 - RNA, 22 nt, Homo sapiens
ucauugcaaucucugccucccg

SEQ ID NO: 218406 - RNA, 22 nt, Homo sapiens
ucauugcauuccagcccaagca

SEQ ID NO: 218407 - RNA, 22 nt, Homo sapiens
ucauugcuuauuuguuggugga

SEQ ID NO: 218408 - RNA, 22 nt, Homo sapiens
ucauuggcuaagcuuguuacac

SEQ ID NO: 218409 - RNA, 21 nt, Homo sapiens
ucauugggugcagcccacccu

SEQ ID NO: 218410 - RNA, 18 nt, Homo sapiens
ucauuggugagcaccucc

SEQ ID NO: 218411 - RNA, 22 nt, Homo sapiens
ucauugguugcguaauuugauu

SEQ ID NO: 218412 - RNA, 22 nt, Homo sapiens
uccacaauggcugaacuagauu

SEQ ID NO: 218413 - RNA, 19 nt, Homo sapiens
uccacagugguugaacuag

SEQ ID NO: 218414 - RNA, 22 nt, Homo sapiens
uccacuuuugugcugaauugga

SEQ ID NO: 218415 - RNA, 22 nt, Homo sapiens
uccaguagaauuuuauucaaca

SEQ ID NO: 218416 - RNA, 22 nt, Homo sapiens
uccagugcauucagacacuugg

SEQ ID NO: 218417 - RNA, 22 nt, Homo sapiens
uccaguguuucuuccacuauuu

SEQ ID NO: 218418 - RNA, 22 nt, Homo sapiens
uccauagugagcagucaaugua

SEQ ID NO: 218419 - RNA, 22 nt, Homo sapiens
uccauggagacacauuuuauau

SEQ ID NO: 218420 - RNA, 22 nt, Homo sapiens
uccauguaguugagcggcuuug

SEQ ID NO: 218421 - RNA, 22 nt, Homo sapiens
uccaugugaaaaggucgugaua

SEQ ID NO: 218422 - RNA, 22 nt, Homo sapiens
uccaugugaaaucuaugaggac

SEQ ID NO: 218423 - RNA, 22 nt, Homo sapiens
uccauugucuagauguaacaca

SEQ ID NO: 218424 - RNA, 22 nt, Homo sapiens
uccauuuguucagcuucaggaa

SEQ ID NO: 218425 - RNA, 22 nt, Homo sapiens
ucccagaaacgcauauguucau

SEQ ID NO: 218426 - RNA, 22 nt, Homo sapiens
ucccaguggucuugaaacaggg

SEQ ID NO: 218427 - RNA, 22 nt, Homo sapiens
ucccaguuuuucugaauaguca

SEQ ID NO: 218428 - RNA, 22 nt, Homo sapiens
ucccauguagcuaggauuacag

SEQ ID NO: 218429 - RNA, 19 nt, Homo sapiens
uccccgggucuagugcagc

SEQ ID NO: 218430 - RNA, 22 nt, Homo sapiens
uccccugagaacuugcuagaaa

SEQ ID NO: 218431 - RNA, 22 nt, Homo sapiens
uccccugagaccccucagcacu

SEQ ID NO: 218432 - RNA, 22 nt, Homo sapiens
uccccugagucaccugcuucuc

SEQ ID NO: 218433 - RNA, 22 nt, Homo sapiens
uccccuuuguaagauggaaacg

SEQ ID NO: 218434 - RNA, 22 nt, Homo sapiens
ucccuacugggguacugccuag

SEQ ID NO: 218435 - RNA, 22 nt, Homo sapiens
ucccugacagggucugagcuuu

SEQ ID NO: 218436 - RNA, 22 nt, Homo sapiens
ucccugagugauugaaaauaaa

SEQ ID NO: 218437 - RNA, 22 nt, Homo sapiens
ucccugguguuaguuuguucuu

SEQ ID NO: 218438 - RNA, 22 nt, Homo sapiens
ucccuguguuccuuuugaauug

SEQ ID NO: 218439 - RNA, 17 nt, Homo sapiens
ucccuguuuuuucaguc

SEQ ID NO: 218440 - RNA, 22 nt, Homo sapiens
ucccuuaaugaugaacaaugag

SEQ ID NO: 218441 - RNA, 22 nt, Homo sapiens
ucccuuagccaaauccccagcc

SEQ ID NO: 218442 - RNA, 22 nt, Homo sapiens
ucccuugagccuggcuucucac

SEQ ID NO: 218443 - RNA, 18 nt, Homo sapiens
ucccuuuguagaugaccc

SEQ ID NO: 218444 - RNA, 22 nt, Homo sapiens
uccucaguggauuggauggugc

SEQ ID NO: 218445 - RNA, 22 nt, Homo sapiens
uccugagaauagaguugcaugu

SEQ ID NO: 218446 - RNA, 22 nt, Homo sapiens
uccugagagcagacccucuaua

SEQ ID NO: 218447 - RNA, 22 nt, Homo sapiens
uccuguaaucccagcuaccaga

SEQ ID NO: 218448 - RNA, 22 nt, Homo sapiens
uccuucaguccaguggguuuug

SEQ ID NO: 218449 - RNA, 22 nt, Homo sapiens
uccuucauuugucaacucuagu

SEQ ID NO: 218450 - RNA, 22 nt, Homo sapiens
uccuugaaacaggaagaauuca

SEQ ID NO: 218451 - RNA, 22 nt, Homo sapiens
uccuugagccugggaguuauag

SEQ ID NO: 218452 - RNA, 22 nt, Homo sapiens
uccuuggucaaaaagaaagugu

SEQ ID NO: 218453 - RNA, 21 nt, Homo sapiens
uccuuggugaugcccugcagu

SEQ ID NO: 218454 - RNA, 22 nt, Homo sapiens
uccuuuggcuaacuuucuaagu

SEQ ID NO: 218455 - RNA, 22 nt, Homo sapiens
uccuuuggucaguauucuuuug

SEQ ID NO: 218456 - RNA, 22 nt, Homo sapiens
uccuuugguuauaggcaccucu

SEQ ID NO: 218457 - RNA, 22 nt, Homo sapiens
ucgcagcucacuggagccucga

SEQ ID NO: 218458 - RNA, 22 nt, Homo sapiens
ucgcaguuaauaaugaugugcg

SEQ ID NO: 218459 - RNA, 22 nt, Homo sapiens
ucgcauuucccucuguagcuuc

SEQ ID NO: 218460 - RNA, 23 nt, Homo sapiens
ucgguccccuuggcugcccucgg

SEQ ID NO: 218461 - RNA, 22 nt, Homo sapiens
ucuaaaguacuacuacuguugg

SEQ ID NO: 218462 - RNA, 22 nt, Homo sapiens
ucuaaggcaccuagagucauca

SEQ ID NO: 218463 - RNA, 20 nt, Homo sapiens
ucuaccuguagguaauuggu

SEQ ID NO: 218464 - RNA, 22 nt, Homo sapiens
ucuaguaaugagaggcaggaga

SEQ ID NO: 218465 - RNA, 15 nt, Homo sapiens
ucuaguuuugaagac

SEQ ID NO: 218466 - RNA, 22 nt, Homo sapiens
ucuaucacagccccacacucuc

SEQ ID NO: 218467 - RNA, 22 nt, Homo sapiens
ucuauguuuuugcuaguagugu

SEQ ID NO: 218468 - RNA, 22 nt, Homo sapiens
ucuauuugggguaccuguggua

SEQ ID NO: 218469 - RNA, 22 nt, Homo sapiens
ucucaagaugguagaugggaau

SEQ ID NO: 218470 - RNA, 22 nt, Homo sapiens
ucucaaguaacugggacaauaa

SEQ ID NO: 218471 - RNA, 22 nt, Homo sapiens
ucucacaccccucucauauacc

SEQ ID NO: 218472 - RNA, 22 nt, Homo sapiens
ucucacagaguugaacuuucuu

SEQ ID NO: 218473 - RNA, 22 nt, Homo sapiens
ucucacagccauuucucccucu

SEQ ID NO: 218474 - RNA, 22 nt, Homo sapiens
ucucagcacaaacaaaauugcu

SEQ ID NO: 218475 - RNA, 22 nt, Homo sapiens
ucucagugaauugguuuugucu

SEQ ID NO: 218476 - RNA, 22 nt, Homo sapiens
ucucagugacugcugggucccc

SEQ ID NO: 218477 - RNA, 22 nt, Homo sapiens
ucucaguuuucuggggaagaaa

SEQ ID NO: 218478 - RNA, 21 nt, Homo sapiens
ucucauagaguuucacuuucu

SEQ ID NO: 218479 - RNA, 22 nt, Homo sapiens
ucucaugaagguggagaguagg

SEQ ID NO: 218480 - RNA, 22 nt, Homo sapiens
ucucauggcucacccugcauag

SEQ ID NO: 218481 - RNA, 22 nt, Homo sapiens
ucucauugauucuggggugaug

SEQ ID NO: 218482 - RNA, 22 nt, Homo sapiens
ucucauuggucugagucaccug

SEQ ID NO: 218483 - RNA, 21 nt, Homo sapiens
ucucauugugguuuuaauugg

SEQ ID NO: 218484 - RNA, 22 nt, Homo sapiens
ucucccauccaugaacuucugu

SEQ ID NO: 218485 - RNA, 22 nt, Homo sapiens
ucuccggguggcggcgaaggga

SEQ ID NO: 218486 - RNA, 22 nt, Homo sapiens
ucucuggauaucuacuuauguu

SEQ ID NO: 218487 - RNA, 19 nt, Homo sapiens
ucucugguguuggagggga

SEQ ID NO: 218488 - RNA, 22 nt, Homo sapiens
uugcuggugguucgagcaacac

SEQ ID NO: 218489 - RNA, 22 nt, Homo sapiens
uugcugguuuucauaugagcag

SEQ ID NO: 218490 - RNA, 22 nt, Homo sapiens
uugcuuagagccaaucuugauu

SEQ ID NO: 218491 - RNA, 22 nt, Homo sapiens
uuggaaacgucaccuuuuccuu

SEQ ID NO: 218492 - RNA, 22 nt, Homo sapiens
uuggaaaugguaaaggguuaau

SEQ ID NO: 218493 - RNA, 22 nt, Homo sapiens
uuggaagacaaugcugauucuc

SEQ ID NO: 218494 - RNA, 22 nt, Homo sapiens
uuggaagguaaucaaaaguucu

SEQ ID NO: 218495 - RNA, 22 nt, Homo sapiens
uuggaauacucaaaagguuggg

SEQ ID NO: 218496 - RNA, 22 nt, Homo sapiens
uuggaauacuuguuaaagucca

SEQ ID NO: 218497 - RNA, 23 nt, Homo sapiens
uuggaaugagaccuaagaguuuu

SEQ ID NO: 218498 - RNA, 22 nt, Homo sapiens
uuggacaagauugcagagaauu

SEQ ID NO: 218499 - RNA, 22 nt, Homo sapiens
uuggacugugagguuucguggg

SEQ ID NO: 218500 - RNA, 22 nt, Homo sapiens
uuggacuucuaacugacaugga

SEQ ID NO: 218501 - RNA, 22 nt, Homo sapiens
uuggagagaaaggcaguuccug

SEQ ID NO: 218502 - RNA, 22 nt, Homo sapiens
uuggagugugcucauaacugcu

SEQ ID NO: 218503 - RNA, 22 nt, Homo sapiens
uuggagugugucuuauuccauu

SEQ ID NO: 218504 - RNA, 22 nt, Homo sapiens
uuggauagugcaaugccuccag

SEQ ID NO: 218505 - RNA, 22 nt, Homo sapiens
uuggauugugaaaguauucucu

SEQ ID NO: 218506 - RNA, 22 nt, Homo sapiens
uuggauuguuucuagauugggg

SEQ ID NO: 218507 - RNA, 22 nt, Homo sapiens
uuggauuuuaacaaacuaggug

SEQ ID NO: 218508 - RNA, 22 nt, Homo sapiens
uuggauuuugguggcaacucau

SEQ ID NO: 218509 - RNA, 22 nt, Homo sapiens
uuggcaaagugucuggcauuua

SEQ ID NO: 218510 - RNA, 22 nt, Homo sapiens
uuggcaaauagguuuuauugca

SEQ ID NO: 218511 - RNA, 22 nt, Homo sapiens
uuggcaaaugucacaaaucagg

SEQ ID NO: 218512 - RNA, 22 nt, Homo sapiens
uuggcaacauagugagaccccc

SEQ ID NO: 218513 - RNA, 22 nt, Homo sapiens
uuggcaaguuucugucagcaaa

SEQ ID NO: 218514 - RNA, 22 nt, Homo sapiens
uuggcaauugcuaugauuugaa

SEQ ID NO: 218515 - RNA, 21 nt, Homo sapiens
uuggcacucuucucuccuuau

SEQ ID NO: 218516 - RNA, 22 nt, Homo sapiens
uuggcagaaaaggucggggguu

SEQ ID NO: 218517 - RNA, 22 nt, Homo sapiens
uuggcagugcccgaugcugggg

SEQ ID NO: 218518 - RNA, 23 nt, Homo sapiens
uuggcaucugggacacaagcuga

SEQ ID NO: 218519 - RNA, 20 nt, Homo sapiens
uuggcauuuagacaagaguu

SEQ ID NO: 218520 - RNA, 22 nt, Homo sapiens
uuggccaauggugauucccggc

SEQ ID NO: 218521 - RNA, 21 nt, Homo sapiens
uuggcuacugcuucagaggga

SEQ ID NO: 218522 - RNA, 22 nt, Homo sapiens
uuggcuauagauacauggauua

SEQ ID NO: 218523 - RNA, 22 nt, Homo sapiens
uuggcuaugaguccuaugugca

SEQ ID NO: 218524 - RNA, 22 nt, Homo sapiens
uuggcucugcgucucgcggacg

SEQ ID NO: 218525 - RNA, 22 nt, Homo sapiens
uuggcuuaguugaccacagucu

SEQ ID NO: 218526 - RNA, 22 nt, Homo sapiens
uuggcuuggagaguugaaaugu

SEQ ID NO: 218527 - RNA, 22 nt, Homo sapiens
uuggcuuuuaugcagcuuaggu

SEQ ID NO: 218528 - RNA, 22 nt, Homo sapiens
uugggaaugcuaaaccucuauu

SEQ ID NO: 218529 - RNA, 22 nt, Homo sapiens
uugggcaauaggaagcaggugg

SEQ ID NO: 218530 - RNA, 22 nt, Homo sapiens
uugguaagguggaugaugaaua

SEQ ID NO: 218531 - RNA, 22 nt, Homo sapiens
uugguaaucccuagugucuaga

SEQ ID NO: 218532 - RNA, 22 nt, Homo sapiens
uugguaguuucugucuuuagau

SEQ ID NO: 218533 - RNA, 22 nt, Homo sapiens
uuggucaaaucugaugggagaa

SEQ ID NO: 218534 - RNA, 22 nt, Homo sapiens
uuggucaggagccucccucuuu

SEQ ID NO: 218535 - RNA, 22 nt, Homo sapiens
uuggucaggcuagaguguggug

SEQ ID NO: 218536 - RNA, 22 nt, Homo sapiens
uuggucaucucccuccuuuuag

SEQ ID NO: 218537 - RNA, 22 nt, Homo sapiens
uugguccacugugaaauuggga

SEQ ID NO: 218538 - RNA, 22 nt, Homo sapiens
uuggucucaucaagagcagcuu

SEQ ID NO: 218539 - RNA, 22 nt, Homo sapiens
uuggucucuuaaucacacuuuu

SEQ ID NO: 218540 - RNA, 22 nt, Homo sapiens
uugguucaguuuaacgaguaau

SEQ ID NO: 218541 - RNA, 22 nt, Homo sapiens
uugguucucuuuauaugcugga

SEQ ID NO: 218542 - RNA, 22 nt, Homo sapiens
uuguaacucugaauacauccua

SEQ ID NO: 218543 - RNA, 22 nt, Homo sapiens
uuguaauguuaccaaauggugu

SEQ ID NO: 218544 - RNA, 22 nt, Homo sapiens
uuguacuggguuuucuggaauu

SEQ ID NO: 218545 - RNA, 22 nt, Homo sapiens
uuguagcaaauauauuuuggaa

SEQ ID NO: 218546 - RNA, 21 nt, Homo sapiens
uuguagcagcauaaucccaga

SEQ ID NO: 218547 - RNA, 22 nt, Homo sapiens
uuguauacucuauuuuagcagu

SEQ ID NO: 218548 - RNA, 22 nt, Homo sapiens
uuguauccaucuuucaggcaac

SEQ ID NO: 218549 - RNA, 22 nt, Homo sapiens
uuguauguugaaugaugguaua

SEQ ID NO: 218550 - RNA, 22 nt, Homo sapiens
uugucaaacucauucuccaucc

SEQ ID NO: 218551 - RNA, 22 nt, Homo sapiens
uugucaccucuaaaucucauau

SEQ ID NO: 218552 - RNA, 22 nt, Homo sapiens
uugucacuauaaauaagcauuu

SEQ ID NO: 218553 - RNA, 22 nt, Homo sapiens
uugucacugcacuccagucugg

SEQ ID NO: 218554 - RNA, 22 nt, Homo sapiens
uugucaguguucacucaaagcu

SEQ ID NO: 218555 - RNA, 22 nt, Homo sapiens
uuguccauggacagcaccacag

SEQ ID NO: 218556 - RNA, 22 nt, Homo sapiens
uuguccuugagauaguuugcug

SEQ ID NO: 218557 - RNA, 22 nt, Homo sapiens
uugugaaaaaccucucguggaa

SEQ ID NO: 218558 - RNA, 22 nt, Homo sapiens
uugugaauggaguagcaggauc

SEQ ID NO: 218559 - RNA, 22 nt, Homo sapiens
uugugcauaucagagguuugcu

SEQ ID NO: 218560 - RNA, 22 nt, Homo sapiens
uugugccacugaagcccuccag

SEQ ID NO: 218561 - RNA, 22 nt, Homo sapiens
uugugccccuucucagucgggc

SEQ ID NO: 218562 - RNA, 18 nt, Homo sapiens
uugugccugagaaggugg

SEQ ID NO: 218563 - RNA, 22 nt, Homo sapiens
uugugcuuaaugaguguaaggu

SEQ ID NO: 218564 - RNA, 18 nt, Homo sapiens
uuguggccccuacaaauu

SEQ ID NO: 218565 - RNA, 22 nt, Homo sapiens
uugugguaggaguugccauguu

SEQ ID NO: 218566 - RNA, 22 nt, Homo sapiens
uugugguaggaugaagagauga

SEQ ID NO: 218567 - RNA, 22 nt, Homo sapiens
uugugguaggcauguaagauga

SEQ ID NO: 218568 - RNA, 22 nt, Homo sapiens
uugugguuauagagucucccug

SEQ ID NO: 218569 - RNA, 22 nt, Homo sapiens
uugugguugaugaagacugucu

SEQ ID NO: 218570 - RNA, 22 nt, Homo sapiens
uugugguuuuagcacuguggau

SEQ ID NO: 218571 - RNA, 22 nt, Homo sapiens
uuguguccccacccaaaucuca

SEQ ID NO: 218572 - RNA, 22 nt, Homo sapiens
uuguguuugaugcugacacgca

SEQ ID NO: 218573 - RNA, 22 nt, Homo sapiens
uuguuaagaugcagauucugga

SEQ ID NO: 218574 - RNA, 22 nt, Homo sapiens
uuguuuagagacuggaauuaaa

SEQ ID NO: 218575 - RNA, 22 nt, Homo sapiens
uuuaaacugucuuggguuugga

SEQ ID NO: 218576 - RNA, 22 nt, Homo sapiens
uuuaacauuggaugagaucguc

SEQ ID NO: 218577 - RNA, 22 nt, Homo sapiens
uuuaauagcagggacuuccggg

SEQ ID NO: 218578 - RNA, 22 nt, Homo sapiens
uuuaaugcugcccagucauggg

SEQ ID NO: 218579 - RNA, 22 nt, Homo sapiens
uuuagcagcaaagagccaugcu

SEQ ID NO: 218580 - RNA, 22 nt, Homo sapiens
uuuagcucauucaauuucaguc

SEQ ID NO: 218581 - RNA, 22 nt, Homo sapiens
uuuagguaauauuaaguagcug

SEQ ID NO: 218582 - RNA, 22 nt, Homo sapiens
uuuagguauuugguauagcagu

SEQ ID NO: 218583 - RNA, 22 nt, Homo sapiens
uuuauccagccucuagcaaggu

SEQ ID NO: 218584 - RNA, 22 nt, Homo sapiens
uuuaugguuuucugggagauug

SEQ ID NO: 218585 - RNA, 22 nt, Homo sapiens
uuuauugcucuaaaguugccau

SEQ ID NO: 218586 - RNA, 22 nt, Homo sapiens
uuucaagugcugucuuagcugu

SEQ ID NO: 218587 - RNA, 23 nt, Homo sapiens
uuucacagaaggauuguagggcc

SEQ ID NO: 218588 - RNA, 23 nt, Homo sapiens
uuucacaguagcuggaucagccu

SEQ ID NO: 218589 - RNA, 22 nt, Homo sapiens
uuaugguuuauuagcaggguua

SEQ ID NO: 218590 - RNA, 22 nt, Homo sapiens
uuaugguuuucucucacgcagg

SEQ ID NO: 218591 - RNA, 22 nt, Homo sapiens
uuaugguuuuucugugagaugg

SEQ ID NO: 218592 - RNA, 22 nt, Homo sapiens
uuaugucacuguucagucuccc

SEQ ID NO: 218593 - RNA, 22 nt, Homo sapiens
uuaugucauuuuuggauguuaa

SEQ ID NO: 218594 - RNA, 22 nt, Homo sapiens
uuauucagcaccugcuguguuc

SEQ ID NO: 218595 - RNA, 22 nt, Homo sapiens
uuauucauuaauugcuaagguu

SEQ ID NO: 218596 - RNA, 22 nt, Homo sapiens
uuauucugucuuuggucucaau

SEQ ID NO: 218597 - RNA, 22 nt, Homo sapiens
uucaaaguuggaggacaaacug

SEQ ID NO: 218598 - RNA, 22 nt, Homo sapiens
uucaagauggcaccagugagug

SEQ ID NO: 218599 - RNA, 22 nt, Homo sapiens
uucaagcuacaguggcaggguu

SEQ ID NO: 218600 - RNA, 22 nt, Homo sapiens
uucaagcuauggugaucuuuuc

SEQ ID NO: 218601 - RNA, 22 nt, Homo sapiens
uucaagucuuggcuuugccacc

SEQ ID NO: 218602 - RNA, 22 nt, Homo sapiens
uucaauacuguugauccuuaug

SEQ ID NO: 218603 - RNA, 21 nt, Homo sapiens
uucacaagggaaguagggggc

SEQ ID NO: 218604 - RNA, 22 nt, Homo sapiens
uucacagccgcaccccaucacu

SEQ ID NO: 218605 - RNA, 20 nt, Homo sapiens
uucacaggcagcuucuuucu

SEQ ID NO: 218606 - RNA, 22 nt, Homo sapiens
uucacaguacucccuggaauua

SEQ ID NO: 218607 - RNA, 22 nt, Homo sapiens
uucacaguguguacaccagggg

SEQ ID NO: 218608 - RNA, 22 nt, Homo sapiens
uucacaguguuucucacgguua

SEQ ID NO: 218609 - RNA, 22 nt, Homo sapiens
uucacccugguuguagauggac

SEQ ID NO: 218610 - RNA, 22 nt, Homo sapiens
uucaccuggaguucaggauaag

SEQ ID NO: 218611 - RNA, 22 nt, Homo sapiens
uucaccuugcccacagcagucu

SEQ ID NO: 218612 - RNA, 22 nt, Homo sapiens
uucacugggugugguggcucac

SEQ ID NO: 218613 - RNA, 22 nt, Homo sapiens
uucacuguaaaaugaagagggu

SEQ ID NO: 218614 - RNA, 22 nt, Homo sapiens
uucacugugugacccugggcca

SEQ ID NO: 218615 - RNA, 22 nt, Homo sapiens
uucagagagggagggauaccua

SEQ ID NO: 218616 - RNA, 22 nt, Homo sapiens
uucagagugaggcucucggaac

SEQ ID NO: 218617 - RNA, 22 nt, Homo sapiens
uucagaguggacagaaauuaag

SEQ ID NO: 218618 - RNA, 22 nt, Homo sapiens
agcccauguggcugaggcuucu

SEQ ID NO: 218619 - RNA, 23 nt, Homo sapiens
agcccugugacucgaacgaggag

SEQ ID NO: 218620 - RNA, 22 nt, Homo sapiens
agccucauucuacauguuaaug

SEQ ID NO: 218621 - RNA, 21 nt, Homo sapiens
agccugugggucauaguugcc

SEQ ID NO: 218622 - RNA, 22 nt, Homo sapiens
agcgccacugcacuccagccug

SEQ ID NO: 218623 - RNA, 22 nt, Homo sapiens
agcuagcauucauaguuugagg

SEQ ID NO: 218624 - RNA, 22 nt, Homo sapiens
agcucacagccuagcacuguga

SEQ ID NO: 218625 - RNA, 21 nt, Homo sapiens
agcuccacucguucccaaagc

SEQ ID NO: 218626 - RNA, 22 nt, Homo sapiens
agcuccauuguaaucaccuggu

SEQ ID NO: 218627 - RNA, 22 nt, Homo sapiens
agcuccuuucugcaggcagguc

SEQ ID NO: 218628 - RNA, 22 nt, Homo sapiens
agcuccuuucugcagguagguu

SEQ ID NO: 218629 - RNA, 22 nt, Homo sapiens
agcuccuuugcuuuuuccagga

SEQ ID NO: 218630 - RNA, 22 nt, Homo sapiens
agcucuuguuaguauuagcagu

SEQ ID NO: 218631 - RNA, 22 nt, Homo sapiens
agcugaguguuccaagagcgag

SEQ ID NO: 218632 - RNA, 22 nt, Homo sapiens
agcugcaaagggagagaugauu

SEQ ID NO: 218633 - RNA, 22 nt, Homo sapiens
agcugcauucguaucauauugu

SEQ ID NO: 218634 - RNA, 17 nt, Homo sapiens
agcuggaauuacgggag

SEQ ID NO: 218635 - RNA, 22 nt, Homo sapiens
agcuggaauuuaagguagauag

SEQ ID NO: 218636 - RNA, 20 nt, Homo sapiens
agcuggguguguuggugcau

SEQ ID NO: 218637 - RNA, 22 nt, Homo sapiens
agcugguuuaauaugcugucug

SEQ ID NO: 218638 - RNA, 22 nt, Homo sapiens
agcuguguugucugaagucaga

SEQ ID NO: 218639 - RNA, 22 nt, Homo sapiens
agcuguuguucucagaggcuuu

SEQ ID NO: 218640 - RNA, 22 nt, Homo sapiens
agcuguuguuuuaagauacuaa

SEQ ID NO: 218641 - RNA, 22 nt, Homo sapiens
agcuuguauuuguagccuguug

SEQ ID NO: 218642 - RNA, 22 nt, Homo sapiens
agcuugucuuauacuacuucau

SEQ ID NO: 218643 - RNA, 22 nt, Homo sapiens
agcuugugauuuagagugagag

SEQ ID NO: 218644 - RNA, 22 nt, Homo sapiens
agcuuguggugaauacugcuag

SEQ ID NO: 218645 - RNA, 22 nt, Homo sapiens
augugcaauguguacguagccc

SEQ ID NO: 218646 - RNA, 22 nt, Homo sapiens
augugcacauucugguaaauau

SEQ ID NO: 218647 - RNA, 22 nt, Homo sapiens
augugcagauguuacaaauugu

SEQ ID NO: 218648 - RNA, 22 nt, Homo sapiens
augugcaugcuguucugccaga

SEQ ID NO: 218649 - RNA, 22 nt, Homo sapiens
augugcuuaaaaaugcagagaa

SEQ ID NO: 218650 - RNA, 22 nt, Homo sapiens
augugcuugagggaaaucaguu

SEQ ID NO: 218651 - RNA, 22 nt, Homo sapiens
auguggcuuuucaacuguguga

SEQ ID NO: 218652 - RNA, 18 nt, Homo sapiens
auguggcuuuugaaggcu

SEQ ID NO: 218653 - RNA, 22 nt, Homo sapiens
auguggugguagccaggacagg

SEQ ID NO: 218654 - RNA, 22 nt, Homo sapiens
auguguaaagcuuuucuuuguu

SEQ ID NO: 218655 - RNA, 22 nt, Homo sapiens
auguguucaucacagcacaauu

SEQ ID NO: 218656 - RNA, 22 nt, Homo sapiens
auguuagcaucaauauucauca

SEQ ID NO: 218657 - RNA, 22 nt, Homo sapiens
auguuauguuaaugauaaugga

SEQ ID NO: 218658 - RNA, 22 nt, Homo sapiens
auguuauguucuucucuguaua

SEQ ID NO: 218659 - RNA, 18 nt, Homo sapiens
auguuauguuuguagaag

SEQ ID NO: 218660 - RNA, 22 nt, Homo sapiens
auuaagugaaugaaguuguucc

SEQ ID NO: 218661 - RNA, 22 nt, Homo sapiens
auuaaucaggcaaugcuugcua

SEQ ID NO: 218662 - RNA, 22 nt, Homo sapiens
auuaauguaauuaguaaaguug

SEQ ID NO: 218663 - RNA, 22 nt, Homo sapiens
auuacaugucuauccaugaaca

SEQ ID NO: 218664 - RNA, 22 nt, Homo sapiens
auuagguagugagaugcugcug

SEQ ID NO: 218665 - RNA, 22 nt, Homo sapiens
auucaacuaauuauugaagaug

SEQ ID NO: 218666 - RNA, 23 nt, Homo sapiens
auucaaguagugagagugguuau

SEQ ID NO: 218667 - RNA, 20 nt, Homo sapiens
auucaaguaugccuugagaa

SEQ ID NO: 218668 - RNA, 22 nt, Homo sapiens
auucaccauggaccaggggccu

SEQ ID NO: 218669 - RNA, 22 nt, Homo sapiens
auucacuuuuauagacaggucu

SEQ ID NO: 218670 - RNA, 22 nt, Homo sapiens
auucagaggggcagcugucuug

SEQ ID NO: 218671 - RNA, 22 nt, Homo sapiens
auucaucagggauauugguuga

SEQ ID NO: 218672 - RNA, 22 nt, Homo sapiens
auucaugggagcuacuuuaaaa

SEQ ID NO: 218673 - RNA, 20 nt, Homo sapiens
auucauggugguacguuguc

SEQ ID NO: 218674 - RNA, 22 nt, Homo sapiens
auuccacuuacaugaaguaccu

SEQ ID NO: 218675 - RNA, 22 nt, Homo sapiens
auuccacuuauaugagguaucu

SEQ ID NO: 218676 - RNA, 22 nt, Homo sapiens
auuccacuuccacuaguuucuc

SEQ ID NO: 218677 - RNA, 21 nt, Homo sapiens
auuccacuuuuccuucaggga

SEQ ID NO: 218678 - RNA, 22 nt, Homo sapiens
auuccagauggaguugaggguu

SEQ ID NO: 218679 - RNA, 22 nt, Homo sapiens
auuccagguggcgccauucaca

SEQ ID NO: 218680 - RNA, 23 nt, Homo sapiens
auuccaguggcaauuggagaaac

SEQ ID NO: 218681 - RNA, 22 nt, Homo sapiens
auuccaguuguaagguuuuuca

SEQ ID NO: 218682 - RNA, 22 nt, Homo sapiens
auucuauaguccuaggauuggg

SEQ ID NO: 218683 - RNA, 23 nt, Homo sapiens
auugaacacuuucauaugugagg

SEQ ID NO: 218684 - RNA, 22 nt, Homo sapiens
auugaacaugccauauguacca

SEQ ID NO: 218685 - RNA, 22 nt, Homo sapiens
auugagcaauuccuaugugcuu

SEQ ID NO: 218686 - RNA, 22 nt, Homo sapiens
auugaggcauguaccaaugguc

SEQ ID NO: 218687 - RNA, 23 nt, Homo sapiens
auugauagugccuuugugcuaau

SEQ ID NO: 218688 - RNA, 22 nt, Homo sapiens
auugauaguuuaauaggaauug

SEQ ID NO: 218689 - RNA, 19 nt, Homo sapiens
auugauuaaguuugcuguc

SEQ ID NO: 218690 - RNA, 22 nt, Homo sapiens
auugcaacaguguugagaggug

SEQ ID NO: 218691 - RNA, 22 nt, Homo sapiens
auugcaaugggaaacuaugaaa

SEQ ID NO: 218692 - RNA, 22 nt, Homo sapiens
auugcacacagaaucaggguaa

SEQ ID NO: 218693 - RNA, 18 nt, Homo sapiens
auugcacaccagccuggg

SEQ ID NO: 218694 - RNA, 22 nt, Homo sapiens
auugcacaccagucugggcaaa

SEQ ID NO: 218695 - RNA, 22 nt, Homo sapiens
auugcacuccacccugggcaac

SEQ ID NO: 218696 - RNA, 22 nt, Homo sapiens
auugcacuccagcccugcugac

SEQ ID NO: 218697 - RNA, 22 nt, Homo sapiens
auugcacuccagccuaggcaac

SEQ ID NO: 218698 - RNA, 22 nt, Homo sapiens
auugcacuccagccuagguaac

SEQ ID NO: 218699 - RNA, 22 nt, Homo sapiens
auugcacuccagccucggugac

SEQ ID NO: 218700 - RNA, 22 nt, Homo sapiens
auugcacuccagccugagcaaa

SEQ ID NO: 218701 - RNA, 22 nt, Homo sapiens
auugcacuccagccuggcagca

SEQ ID NO: 218702 - RNA, 21 nt, Homo sapiens
auugcacuccagccugggcga

SEQ ID NO: 218703 - RNA, 22 nt, Homo sapiens
auugcacuccagccugggggac

SEQ ID NO: 218704 - RNA, 22 nt, Homo sapiens
auugcacuccggccugggugac

SEQ ID NO: 218705 - RNA, 18 nt, Homo sapiens
auugcacuccugccuggg

SEQ ID NO: 218706 - RNA, 22 nt, Homo sapiens
auugcacucuaaccuaggugac

SEQ ID NO: 218707 - RNA, 22 nt, Homo sapiens
auugcacucugaucugcacucc

SEQ ID NO: 218708 - RNA, 22 nt, Homo sapiens
auugcacuggggguuagaauuu

SEQ ID NO: 218709 - RNA, 22 nt, Homo sapiens
auugcagaaaugacagagcgcc

SEQ ID NO: 218710 - RNA, 22 nt, Homo sapiens
auugcaguuucaacuccagggc

SEQ ID NO: 218711 - RNA, 18 nt, Homo sapiens
auugcccucauggggcuu

SEQ ID NO: 218712 - RNA, 23 nt, Homo sapiens
auugcccuugaaggcuaaacucu

SEQ ID NO: 218713 - RNA, 22 nt, Homo sapiens
auugccucaauuccaagacugc

SEQ ID NO: 218714 - RNA, 22 nt, Homo sapiens
auugcucacacaaagccuguuu

SEQ ID NO: 218715 - RNA, 22 nt, Homo sapiens
auuggcaauggcaaagcagagu

SEQ ID NO: 218716 - RNA, 22 nt, Homo sapiens
auuggcauauccacgacaaugc

SEQ ID NO: 218717 - RNA, 22 nt, Homo sapiens
auuggccccguuuuaaauguca

SEQ ID NO: 218718 - RNA, 22 nt, Homo sapiens
auuggcuuuugaaagucugcga

SEQ ID NO: 218719 - RNA, 22 nt, Homo sapiens
auuguacuccagccugggcagc

SEQ ID NO: 218720 - RNA, 22 nt, Homo sapiens
auuguacugccccccuguugcu

SEQ ID NO: 218721 - RNA, 21 nt, Homo sapiens
auuguauguaaaccaaaugag

SEQ ID NO: 218722 - RNA, 22 nt, Homo sapiens
auugucauuuauaacuguguag

SEQ ID NO: 218723 - RNA, 20 nt, Homo sapiens
auuguccuugauuacacaga

SEQ ID NO: 218724 - RNA, 22 nt, Homo sapiens
auuguuccccggucauuuuugu

SEQ ID NO: 218725 - RNA, 22 nt, Homo sapiens
auuucacuucgcaugguguccg

SEQ ID NO: 218726 - RNA, 22 nt, Homo sapiens
auuuggcaauuuugaagaugcc

SEQ ID NO: 218727 - RNA, 20 nt, Homo sapiens
auuuggcauaguuuaagcaa

SEQ ID NO: 218728 - RNA, 22 nt, Homo sapiens
auuuggccuuuguaugcaguau

SEQ ID NO: 218729 - RNA, 22 nt, Homo sapiens
auuugucacuauguggcuaaua

SEQ ID NO: 218730 - RNA, 22 nt, Homo sapiens
auuuuugguugguaggcuauua

SEQ ID NO: 218731 - RNA, 22 nt, Homo sapiens
auuuuugguuucaccugcacgc

SEQ ID NO: 218732 - RNA, 22 nt, Homo sapiens
caaagcacuuggcuuggaagau

SEQ ID NO: 218733 - RNA, 22 nt, Homo sapiens
caaaggcuuccacugcauccuu

SEQ ID NO: 218734 - RNA, 22 nt, Homo sapiens
caaaguaauugugguuuugcca

SEQ ID NO: 218735 - RNA, 22 nt, Homo sapiens
caaagucuucaguugauucuga

SEQ ID NO: 218736 - RNA, 22 nt, Homo sapiens
caaagugcuggccgggcgcagu

SEQ ID NO: 218737 - RNA, 22 nt, Homo sapiens
caaauacuuucauguugucuug

SEQ ID NO: 218738 - RNA, 22 nt, Homo sapiens
caaaugacaucauuucauucaa

SEQ ID NO: 218739 - RNA, 22 nt, Homo sapiens
caaauugcuugucuguagugga

SEQ ID NO: 218740 - RNA, 22 nt, Homo sapiens
caacacagugaaacccgucucu

SEQ ID NO: 218741 - RNA, 22 nt, Homo sapiens
caacaguaaagcauuuuuaagu

SEQ ID NO: 218742 - RNA, 22 nt, Homo sapiens
caaccaguagcugaguucaaaa

SEQ ID NO: 218743 - RNA, 22 nt, Homo sapiens
caacucuguaggauccaggugg

SEQ ID NO: 218744 - RNA, 22 nt, Homo sapiens
caagacuguccaacauauuggg

SEQ ID NO: 218745 - RNA, 22 nt, Homo sapiens
caagagaccugagugucauucu

SEQ ID NO: 218746 - RNA, 22 nt, Homo sapiens
caagagagcugaugguuuuaaa

SEQ ID NO: 218747 - RNA, 22 nt, Homo sapiens
ugagguaucauugcccaggcug

SEQ ID NO: 218748 - RNA, 22 nt, Homo sapiens
ugaggugagggguuaggugcua

SEQ ID NO: 218749 - RNA, 22 nt, Homo sapiens
ugaggugcagcaauccucaugu

SEQ ID NO: 218750 - RNA, 23 nt, Homo sapiens
ugagguguuaagcagacuugucu

SEQ ID NO: 218751 - RNA, 22 nt, Homo sapiens
ugagguugaaggacauuuuuau

SEQ ID NO: 218752 - RNA, 22 nt, Homo sapiens
ugaguaauguugaucuuugaua

SEQ ID NO: 218753 - RNA, 22 nt, Homo sapiens
ugaguacuacuaguuacugcua

SEQ ID NO: 218754 - RNA, 22 nt, Homo sapiens
ugaguagagaauucagcuaagg

SEQ ID NO: 218755 - RNA, 22 nt, Homo sapiens
ugaguagcuaagacgauaggca

SEQ ID NO: 218756 - RNA, 23 nt, Homo sapiens
ugaguaggcaguuuuccccucac

SEQ ID NO: 218757 - RNA, 22 nt, Homo sapiens
ugaguauguuuagaaguaaagg

SEQ ID NO: 218758 - RNA, 22 nt, Homo sapiens
ugagucaugcuggagucauggc

SEQ ID NO: 218759 - RNA, 22 nt, Homo sapiens
ugagucauuuccuuaugcuacu

SEQ ID NO: 218760 - RNA, 22 nt, Homo sapiens
ugagugccuggagggcagggac

SEQ ID NO: 218761 - RNA, 22 nt, Homo sapiens
ugagugugaggaagaauuagaa

SEQ ID NO: 218762 - RNA, 22 nt, Homo sapiens
ugaguguguaugugcauacaca

SEQ ID NO: 218763 - RNA, 17 nt, Homo sapiens
ugaguuaaucuuugugc

SEQ ID NO: 218764 - RNA, 22 nt, Homo sapiens
ugaguuagguaauaauaaauau

SEQ ID NO: 218765 - RNA, 22 nt, Homo sapiens
ugaguucaugcuuguaguucua

SEQ ID NO: 218766 - RNA, 22 nt, Homo sapiens
ugaguuccuuucccaguccagu

SEQ ID NO: 218767 - RNA, 22 nt, Homo sapiens
ugauaacauuucuucugguaca

SEQ ID NO: 218768 - RNA, 22 nt, Homo sapiens
ugauacuggcuucauagaauga

SEQ ID NO: 218769 - RNA, 22 nt, Homo sapiens
ugauacugugcauuagaggcua

SEQ ID NO: 218770 - RNA, 22 nt, Homo sapiens
ugauaggucacucaacagugag

SEQ ID NO: 218771 - RNA, 22 nt, Homo sapiens
ugauaugaaagggaaauaagug

SEQ ID NO: 218772 - RNA, 22 nt, Homo sapiens
ugauaugaaguuagcuggcugu

SEQ ID NO: 218773 - RNA, 22 nt, Homo sapiens
ugauaugaaguucaaaccaggu

SEQ ID NO: 218774 - RNA, 22 nt, Homo sapiens
ugauaugacagcucugcugcca

SEQ ID NO: 218775 - RNA, 22 nt, Homo sapiens
ugauaugaucgcccuagcuuga

SEQ ID NO: 218776 - RNA, 21 nt, Homo sapiens
ugauaugguagaagagagaca

SEQ ID NO: 218777 - RNA, 22 nt, Homo sapiens
ugauaugucacuugaucauggu

SEQ ID NO: 218778 - RNA, 22 nt, Homo sapiens
ugauaugucccucgacaucagg

SEQ ID NO: 218779 - RNA, 22 nt, Homo sapiens
ugauauguggcuauugagauug

SEQ ID NO: 218780 - RNA, 17 nt, Homo sapiens
ugauauuuucccagaua

SEQ ID NO: 218781 - RNA, 22 nt, Homo sapiens
ugaucugucacuuaucacauuu

SEQ ID NO: 218782 - RNA, 22 nt, Homo sapiens
ugaucugucucggguuaucagu

SEQ ID NO: 218783 - RNA, 22 nt, Homo sapiens
ugaugacauugucacagucuga

SEQ ID NO: 218784 - RNA, 22 nt, Homo sapiens
ugaugacucuguggccccaggc

SEQ ID NO: 218785 - RNA, 22 nt, Homo sapiens
ugaugaugaaugaucuuuuaca

SEQ ID NO: 218786 - RNA, 21 nt, Homo sapiens
ugaugcaauccgcuaggucgc

SEQ ID NO: 218787 - RNA, 22 nt, Homo sapiens
ugaugcugaugccugccagaag

SEQ ID NO: 218788 - RNA, 22 nt, Homo sapiens
ugauguccaguucauagaaacu

SEQ ID NO: 218789 - RNA, 22 nt, Homo sapiens
ugaugugucaucugagagagug

SEQ ID NO: 218790 - RNA, 20 nt, Homo sapiens
ugauugaccagagcaguuuu

SEQ ID NO: 218791 - RNA, 22 nt, Homo sapiens
ugauugcacaccugcacucaag

SEQ ID NO: 218792 - RNA, 18 nt, Homo sapiens
ugcaaacauguguguguu

SEQ ID NO: 218793 - RNA, 22 nt, Homo sapiens
ugcaaacuuccuugggcagcau

SEQ ID NO: 218794 - RNA, 22 nt, Homo sapiens
ugcaaagucgaaacugcaguuu

SEQ ID NO: 218795 - RNA, 22 nt, Homo sapiens
ugcaaaugucaaggguuagugu

SEQ ID NO: 218796 - RNA, 19 nt, Homo sapiens
ugcaaauucuaaaaacuga

SEQ ID NO: 218797 - RNA, 22 nt, Homo sapiens
ugcaagacacuguccugggcau

SEQ ID NO: 218798 - RNA, 22 nt, Homo sapiens
ugcaagacaucguauuuugguc

SEQ ID NO: 218799 - RNA, 22 nt, Homo sapiens
ugcaagucaucuguccuucaga

SEQ ID NO: 218800 - RNA, 20 nt, Homo sapiens
ugcaaguugccuuuggaggc

SEQ ID NO: 218801 - RNA, 22 nt, Homo sapiens
ugcacaguccagugcccacuga

SEQ ID NO: 218802 - RNA, 22 nt, Homo sapiens
ugcaccaauucuaaacaguucu

SEQ ID NO: 218803 - RNA, 22 nt, Homo sapiens
ugcaccacugcacuccacccug

SEQ ID NO: 218804 - RNA, 22 nt, Homo sapiens
ugcaccacugcacuccaggcug

SEQ ID NO: 218805 - RNA, 22 nt, Homo sapiens
ugcaccaucuugcuucuguggu

SEQ ID NO: 218806 - RNA, 22 nt, Homo sapiens
ugcaccauugcacuccagccug

SEQ ID NO: 218807 - RNA, 22 nt, Homo sapiens
ugcagagaaacauuuuguauuu

SEQ ID NO: 218808 - RNA, 18 nt, Homo sapiens
ugcagcuuugugauuggc

SEQ ID NO: 218809 - RNA, 22 nt, Homo sapiens
ugcaggauguucaguaauuucc

SEQ ID NO: 218810 - RNA, 22 nt, Homo sapiens
ugcaguaggcccagcgggaggc

SEQ ID NO: 218811 - RNA, 22 nt, Homo sapiens
ugcagugcaugacuguguuaug

SEQ ID NO: 218812 - RNA, 22 nt, Homo sapiens
ugcagugugcuggggucuccau

SEQ ID NO: 218813 - RNA, 22 nt, Homo sapiens
ugcaguguggcucacgccugua

SEQ ID NO: 218814 - RNA, 22 nt, Homo sapiens
ugcaguuuaggaacugguaaca

SEQ ID NO: 218815 - RNA, 22 nt, Homo sapiens
ugcauaauuccuugcaccagaa

SEQ ID NO: 218816 - RNA, 22 nt, Homo sapiens
ugcauacacaagcauacaugua

SEQ ID NO: 218817 - RNA, 22 nt, Homo sapiens
ugcauacuguaugcgugcauac

SEQ ID NO: 218818 - RNA, 22 nt, Homo sapiens
ugcauagcauauauuguagagu

SEQ ID NO: 218819 - RNA, 17 nt, Homo sapiens
ugcauaggcaggcucag

SEQ ID NO: 218820 - RNA, 22 nt, Homo sapiens
ugcaucaggcugcuuauuacaa

SEQ ID NO: 218821 - RNA, 22 nt, Homo sapiens
ugcauccauucuagacucaucu

SEQ ID NO: 218822 - RNA, 22 nt, Homo sapiens
ugcaugaugcugagauuuggga

SEQ ID NO: 218823 - RNA, 21 nt, Homo sapiens
ugcauggagaacacugagggu

SEQ ID NO: 218824 - RNA, 21 nt, Homo sapiens
ugcaugguagucacaugauuc

SEQ ID NO: 218825 - RNA, 20 nt, Homo sapiens
ugcauguccucacuuacuug

SEQ ID NO: 218826 - RNA, 22 nt, Homo sapiens
ugcauuaucagauguuugcuuu

SEQ ID NO: 218827 - RNA, 19 nt, Homo sapiens
ugcauugucugggaaaugg

SEQ ID NO: 218828 - RNA, 21 nt, Homo sapiens
ugcauugucuugaguuuaaau

SEQ ID NO: 218829 - RNA, 22 nt, Homo sapiens
ugccaagaacauuuucuguuuu

SEQ ID NO: 218830 - RNA, 22 nt, Homo sapiens
ugccagagacguagggaauauu

SEQ ID NO: 218831 - RNA, 20 nt, Homo sapiens
aagcugaguguuuuuuuaau

SEQ ID NO: 218832 - RNA, 22 nt, Homo sapiens
aagcugccuugcugaggagaaa

SEQ ID NO: 218833 - RNA, 22 nt, Homo sapiens
aagcuggagugcaguggugcga

SEQ ID NO: 218834 - RNA, 22 nt, Homo sapiens
aagcugugucuugucagcuacc

SEQ ID NO: 218835 - RNA, 22 nt, Homo sapiens
aaggaagcuagcaggaauuggu

SEQ ID NO: 218836 - RNA, 22 nt, Homo sapiens
aaggagcagagagcccuguuuc

SEQ ID NO: 218837 - RNA, 22 nt, Homo sapiens
aaggaguguggugaucuugggc

SEQ ID NO: 218838 - RNA, 22 nt, Homo sapiens
aaggauuguaaaguugacaaau

SEQ ID NO: 218839 - RNA, 22 nt, Homo sapiens
aaggauuguaacaccaagguua

SEQ ID NO: 218840 - RNA, 22 nt, Homo sapiens
aaggcaagguggauaaugaagc

SEQ ID NO: 218841 - RNA, 22 nt, Homo sapiens
aaggcacugaacuuaaauucug

SEQ ID NO: 218842 - RNA, 22 nt, Homo sapiens
aaggcauucucaaacuaguucu

SEQ ID NO: 218843 - RNA, 22 nt, Homo sapiens
aaggcuagagaagaagggcauc

SEQ ID NO: 218844 - RNA, 22 nt, Homo sapiens
aaggcuauuugagaaugugugu

SEQ ID NO: 218845 - RNA, 22 nt, Homo sapiens
aaggcuguuguguaauaggauu

SEQ ID NO: 218846 - RNA, 20 nt, Homo sapiens
aaggcuuucgaguuccaggg

SEQ ID NO: 218847 - RNA, 22 nt, Homo sapiens
aagguacuggaaagaggaaugg

SEQ ID NO: 218848 - RNA, 22 nt, Homo sapiens
caagugaauaguugcucucaga

SEQ ID NO: 218849 - RNA, 22 nt, Homo sapiens
caagugacugagccgccucggc

SEQ ID NO: 218850 - RNA, 22 nt, Homo sapiens
caagugcuacagagaaaucuuu

SEQ ID NO: 218851 - RNA, 22 nt, Homo sapiens
caauacuguguugaauaagagu

SEQ ID NO: 218852 - RNA, 22 nt, Homo sapiens
caauacuguuaccugaaauagg

SEQ ID NO: 218853 - RNA, 22 nt, Homo sapiens
caauggcacgaucucgucucac

SEQ ID NO: 218854 - RNA, 22 nt, Homo sapiens
cacagcacaggcaugaguguca

SEQ ID NO: 218855 - RNA, 22 nt, Homo sapiens
cacagcuaacaacuguuucuuc

SEQ ID NO: 218856 - RNA, 22 nt, Homo sapiens
cacaguguucauagccaucagg

SEQ ID NO: 218857 - RNA, 22 nt, Homo sapiens
cacaguguuccagcuauuugaa

SEQ ID NO: 218858 - RNA, 22 nt, Homo sapiens
cacauguucaggagcacuuaga

SEQ ID NO: 218859 - RNA, 22 nt, Homo sapiens
caccaggugcccagcacggcca

SEQ ID NO: 218860 - RNA, 22 nt, Homo sapiens
cacccagucaucuuggguuuuu

SEQ ID NO: 218861 - RNA, 22 nt, Homo sapiens
cacccuaucagauguccagaga

SEQ ID NO: 218862 - RNA, 22 nt, Homo sapiens
cacugaaugugagguuggggag

SEQ ID NO: 218863 - RNA, 18 nt, Homo sapiens
cacugagcccuucacucu

SEQ ID NO: 218864 - RNA, 22 nt, Homo sapiens
cacugcacuccagcuugugggc

SEQ ID NO: 218865 - RNA, 22 nt, Homo sapiens
cacugcacuccagucccgucuc

SEQ ID NO: 218866 - RNA, 22 nt, Homo sapiens
cacugcaguggaagauuaagaa

SEQ ID NO: 218867 - RNA, 22 nt, Homo sapiens
cacugcauccuccauauccugg

SEQ ID NO: 218868 - RNA, 22 nt, Homo sapiens
cacugcauccuugaccuucugg

SEQ ID NO: 218869 - RNA, 22 nt, Homo sapiens
cacugcauggccacccauguua

SEQ ID NO: 218870 - RNA, 22 nt, Homo sapiens
cacugcauucuccaccucccag

SEQ ID NO: 218871 - RNA, 23 nt, Homo sapiens
cacugggcagcagguguucccag

SEQ ID NO: 218872 - RNA, 21 nt, Homo sapiens
cacuggguucaggcuugugga

SEQ ID NO: 218873 - RNA, 22 nt, Homo sapiens
cacuggucagugaaacaguauu

SEQ ID NO: 218874 - RNA, 21 nt, Homo sapiens
cacugguguugcuauaucaaa

SEQ ID NO: 218875 - RNA, 22 nt, Homo sapiens
cacuuugguucaccugaguuuc

SEQ ID NO: 218876 - RNA, 22 nt, Homo sapiens
cagagaaugucuuuuuuaacca

SEQ ID NO: 218877 - RNA, 22 nt, Homo sapiens
cagagagcuugcccuuguauau

SEQ ID NO: 218878 - RNA, 22 nt, Homo sapiens
cagagcacugauacuggguucu

SEQ ID NO: 218879 - RNA, 22 nt, Homo sapiens
cagauacuccuggucucaggag

SEQ ID NO: 218880 - RNA, 22 nt, Homo sapiens
cagauacuggccuggagcugug

SEQ ID NO: 218881 - RNA, 22 nt, Homo sapiens
cagauguaguauuuuagugaaa

SEQ ID NO: 218882 - RNA, 22 nt, Homo sapiens
cagcaaaucauccuauuugagc

SEQ ID NO: 218883 - RNA, 22 nt, Homo sapiens
cagcaagucucuaagaguucau

SEQ ID NO: 218884 - RNA, 20 nt, Homo sapiens
cagcacgcacaugagacugu

SEQ ID NO: 218885 - RNA, 22 nt, Homo sapiens
cagcaucauucaucugggguaa

SEQ ID NO: 218886 - RNA, 22 nt, Homo sapiens
cagcccguaaucccagcacuuu

SEQ ID NO: 218887 - RNA, 22 nt, Homo sapiens
cagcucauugcagucucgaccu

SEQ ID NO: 218888 - RNA, 22 nt, Homo sapiens
cagcugcuuuggaaaauauuuu

SEQ ID NO: 218889 - RNA, 22 nt, Homo sapiens
cagcuggugcugcaccaguggg

SEQ ID NO: 218890 - RNA, 22 nt, Homo sapiens
cagcuguuguuccagucuuuua

SEQ ID NO: 218891 - RNA, 22 nt, Homo sapiens
caggaccucuugccuggaagcc

SEQ ID NO: 218892 - RNA, 22 nt, Homo sapiens
caggcaaggugaaguguacugg

SEQ ID NO: 218893 - RNA, 22 nt, Homo sapiens
caggcagugggagacaaaacug

SEQ ID NO: 218894 - RNA, 22 nt, Homo sapiens
caggcauagucuugaguuuuau

SEQ ID NO: 218895 - RNA, 22 nt, Homo sapiens
caggcauuguccaugcugaagg

SEQ ID NO: 218896 - RNA, 20 nt, Homo sapiens
cagggcaaugaggagguaaa

SEQ ID NO: 218897 - RNA, 22 nt, Homo sapiens
caggguccccuaccuuuugaug

SEQ ID NO: 218898 - RNA, 22 nt, Homo sapiens
cagguaagaugcuuucucuuau

SEQ ID NO: 218899 - RNA, 22 nt, Homo sapiens
cagguacaugcaugugugugca

SEQ ID NO: 218900 - RNA, 22 nt, Homo sapiens
cagguacuucugggcugagcag

SEQ ID NO: 218901 - RNA, 22 nt, Homo sapiens
cagguaggccaauguuuuccaa

SEQ ID NO: 218902 - RNA, 21 nt, Homo sapiens
cagguagugucugaagccaga

SEQ ID NO: 218903 - RNA, 22 nt, Homo sapiens
cagguaguguguagcacagcag

SEQ ID NO: 218904 - RNA, 22 nt, Homo sapiens
caggugaaugccucuccuucug

SEQ ID NO: 218905 - RNA, 22 nt, Homo sapiens
cagucacagugacaggaugugg

SEQ ID NO: 218906 - RNA, 22 nt, Homo sapiens
cagucacugggauuauggucau

SEQ ID NO: 218907 - RNA, 20 nt, Homo sapiens
cagucauagacaucagaguc

SEQ ID NO: 218908 - RNA, 22 nt, Homo sapiens
cagugaauuucaggucaagagu

SEQ ID NO: 218909 - RNA, 18 nt, Homo sapiens
cagugcaauacaggagag

SEQ ID NO: 218910 - RNA, 23 nt, Homo sapiens
cagugcaugacuguauaugcaaa

SEQ ID NO: 218911 - RNA, 22 nt, Homo sapiens
cagugcuuguuauuguucuauu

SEQ ID NO: 218912 - RNA, 22 nt, Homo sapiens
caguggaugauguuuucugugg

SEQ ID NO: 218913 - RNA, 23 nt, Homo sapiens
cagugguguuagagaaaucuuuu

SEQ ID NO: 218914 - RNA, 22 nt, Homo sapiens
cagugucugcauuuggaacuca

SEQ ID NO: 218915 - RNA, 22 nt, Homo sapiens
caguucaugguaggcaccauag

SEQ ID NO: 218916 - RNA, 21 nt, Homo sapiens
cauaaugcuacuuauuuuaug

SEQ ID NO: 218917 - RNA, 22 nt, Homo sapiens
cauauaguaggugcucuguguu

SEQ ID NO: 218918 - RNA, 22 nt, Homo sapiens
cauauucacuuuacagagcugu

SEQ ID NO: 218919 - RNA, 22 nt, Homo sapiens
caucaaaguggagggaaggacc

SEQ ID NO: 218920 - RNA, 23 nt, Homo sapiens
caucacagagccuuccuugacuc

SEQ ID NO: 218921 - RNA, 21 nt, Homo sapiens
cauccccugccauuguggucu

SEQ ID NO: 218922 - RNA, 22 nt, Homo sapiens
caucccugucgucaagucucug

SEQ ID NO: 218923 - RNA, 22 nt, Homo sapiens
caugaaagugagaaacuccugg

SEQ ID NO: 218924 - RNA, 22 nt, Homo sapiens
caugauauugcagaauguuggu

SEQ ID NO: 218925 - RNA, 22 nt, Homo sapiens
caugaugcuagguauggaugaa

SEQ ID NO: 218926 - RNA, 22 nt, Homo sapiens
caugccauugcucuccugggug

SEQ ID NO: 218927 - RNA, 22 nt, Homo sapiens
cauggagcuaggcuugaucccu

SEQ ID NO: 218928 - RNA, 22 nt, Homo sapiens
cauggcacauauauaucuaggu

SEQ ID NO: 218929 - RNA, 22 nt, Homo sapiens
cauggcaucuguguggccucca

SEQ ID NO: 218930 - RNA, 23 nt, Homo sapiens
cauggcuguuaacacuguuugag

SEQ ID NO: 218931 - RNA, 22 nt, Homo sapiens
cauggcuuuauuuucagcuucu

SEQ ID NO: 218932 - RNA, 22 nt, Homo sapiens
caugggacugucuuggcuauac

SEQ ID NO: 218933 - RNA, 22 nt, Homo sapiens
uggcuguuuauuucacgugggu

SEQ ID NO: 218934 - RNA, 22 nt, Homo sapiens
uggcuuuuguuauuuggaagcu

SEQ ID NO: 218935 - RNA, 18 nt, Homo sapiens
ugggaagaaauucuucuc

SEQ ID NO: 218936 - RNA, 22 nt, Homo sapiens
ugggaagauucuguguuuuucc

SEQ ID NO: 218937 - RNA, 22 nt, Homo sapiens
ugggaccccuacucuuuccaca

SEQ ID NO: 218938 - RNA, 22 nt, Homo sapiens
ugggagugugcacaauuucagc

SEQ ID NO: 218939 - RNA, 22 nt, Homo sapiens
ugggauauaaaaaacgcuauuc

SEQ ID NO: 218940 - RNA, 22 nt, Homo sapiens
ugggaucagcugggcucucugu

SEQ ID NO: 218941 - RNA, 23 nt, Homo sapiens
ugggauguuuuuggaaacuucug

SEQ ID NO: 218942 - RNA, 22 nt, Homo sapiens
ugggcaaaacuaagagcugugg

SEQ ID NO: 218943 - RNA, 22 nt, Homo sapiens
ugggcaagagagcaugacccug

SEQ ID NO: 218944 - RNA, 22 nt, Homo sapiens
ugggcauggaguggccuuaugu

SEQ ID NO: 218945 - RNA, 22 nt, Homo sapiens
ugggguaggcuguauacucugu

SEQ ID NO: 218946 - RNA, 22 nt, Homo sapiens
uggguagaugaauccauuccaa

SEQ ID NO: 218947 - RNA, 22 nt, Homo sapiens
uggguagugucagcugauccau

SEQ ID NO: 218948 - RNA, 22 nt, Homo sapiens
uggguaguuucuuacaacucug

SEQ ID NO: 218949 - RNA, 22 nt, Homo sapiens
ugggugaguaucuauuauucag

SEQ ID NO: 218950 - RNA, 22 nt, Homo sapiens
aagguauuuuugucuauaucuu

SEQ ID NO: 218951 - RNA, 22 nt, Homo sapiens
aaggugcucucuuauguagaaa

SEQ ID NO: 218952 - RNA, 18 nt, Homo sapiens
aaggugcuucuguucuga

SEQ ID NO: 218953 - RNA, 22 nt, Homo sapiens
aaguaaacauugagagacaaga

SEQ ID NO: 218954 - RNA, 22 nt, Homo sapiens
aaguagugcuugugcucaucuc

SEQ ID NO: 218955 - RNA, 22 nt, Homo sapiens
aaguauagcuaugauaaacauu

SEQ ID NO: 218956 - RNA, 22 nt, Homo sapiens
aaguauuagugaggauauggaa

SEQ ID NO: 218957 - RNA, 22 nt, Homo sapiens
aagucaaggagagaagcuucag

SEQ ID NO: 218958 - RNA, 22 nt, Homo sapiens
aagucacugagacuuguggcug

SEQ ID NO: 218959 - RNA, 22 nt, Homo sapiens
aagucaguuugggagaagcuau

SEQ ID NO: 218960 - RNA, 22 nt, Homo sapiens
aagucaugaagaggaaaggaca

SEQ ID NO: 218961 - RNA, 22 nt, Homo sapiens
aagucauggaggaguaugugag

SEQ ID NO: 218962 - RNA, 22 nt, Homo sapiens
aaguccccugacagaggggagg

SEQ ID NO: 218963 - RNA, 22 nt, Homo sapiens
aagugaauucauuguguuauau

SEQ ID NO: 218964 - RNA, 22 nt, Homo sapiens
aagugacauugugcccauuuga

SEQ ID NO: 218965 - RNA, 22 nt, Homo sapiens
aagugagaugcaguggaguucc

SEQ ID NO: 218966 - RNA, 23 nt, Homo sapiens
aagugagcuccaauugggugaga

SEQ ID NO: 218967 - RNA, 22 nt, Homo sapiens
aagugcaaauucccaggcucug

SEQ ID NO: 218968 - RNA, 20 nt, Homo sapiens
aagugcaucguugugucugc

SEQ ID NO: 218969 - RNA, 22 nt, Homo sapiens
aagugccauguggaugggcccu

SEQ ID NO: 218970 - RNA, 22 nt, Homo sapiens
aagugcccuauuuggcccuuga

SEQ ID NO: 218971 - RNA, 22 nt, Homo sapiens
aagugcucuugaaacugccuua

SEQ ID NO: 218972 - RNA, 22 nt, Homo sapiens
aagugcuuacagggaacaugau

SEQ ID NO: 218973 - RNA, 22 nt, Homo sapiens
aagugcuuaggauagugugugg

SEQ ID NO: 218974 - RNA, 22 nt, Homo sapiens
aagugcuucuuuccucgagaag

SEQ ID NO: 218975 - RNA, 22 nt, Homo sapiens
aaguggaauguuuguggcacaa

SEQ ID NO: 218976 - RNA, 17 nt, Homo sapiens
aaguggcuuguucacca

SEQ ID NO: 218977 - RNA, 22 nt, Homo sapiens
aagugguagggucaggauugga

SEQ ID NO: 218978 - RNA, 22 nt, Homo sapiens
aagugguucuaugaguuugcaa

SEQ ID NO: 218979 - RNA, 22 nt, Homo sapiens
aagugucagaguugcuaaugac

SEQ ID NO: 218980 - RNA, 22 nt, Homo sapiens
aaguuaauguuuaagacuccua

SEQ ID NO: 218981 - RNA, 22 nt, Homo sapiens
aaguugcuuuagguaagucaau

SEQ ID NO: 218982 - RNA, 21 nt, Homo sapiens
aauaaagcaaccuuaugccau

SEQ ID NO: 218983 - RNA, 22 nt, Homo sapiens
aauaaaguaggaggugaggaaa

SEQ ID NO: 218984 - RNA, 22 nt, Homo sapiens
aauaaagucugaagugugcuua

SEQ ID NO: 218985 - RNA, 22 nt, Homo sapiens
aauaaguugagaugaggucaua

SEQ ID NO: 218986 - RNA, 22 nt, Homo sapiens
aauaaugucacaggggguuagc

SEQ ID NO: 218987 - RNA, 22 nt, Homo sapiens
aauacucuauaagggaagcugu

SEQ ID NO: 218988 - RNA, 22 nt, Homo sapiens
aauaguggcuuggacuaaauau

SEQ ID NO: 218989 - RNA, 22 nt, Homo sapiens
aauaugguuuuaugaagcaauu

SEQ ID NO: 218990 - RNA, 22 nt, Homo sapiens
aauauguccaguguuuugggag

SEQ ID NO: 218991 - RNA, 22 nt, Homo sapiens
aaucacacuugauguugagcaa

SEQ ID NO: 218992 - RNA, 22 nt, Homo sapiens
aaucacauugaaucugcuaccu

SEQ ID NO: 218993 - RNA, 22 nt, Homo sapiens
aaucagagcccucugagcuuca

SEQ ID NO: 218994 - RNA, 22 nt, Homo sapiens
aaucagauuccagugguuggaa

SEQ ID NO: 218995 - RNA, 17 nt, Homo sapiens
aaucagauuucugagga

SEQ ID NO: 218996 - RNA, 22 nt, Homo sapiens
aauccauuugccgucuauccau

SEQ ID NO: 218997 - RNA, 22 nt, Homo sapiens
aaucccauuucucuguguuuuu

SEQ ID NO: 218998 - RNA, 22 nt, Homo sapiens
aaucccuuuguccagucucuuu

SEQ ID NO: 218999 - RNA, 22 nt, Homo sapiens
aaucgcuuuugguaggcaagga

SEQ ID NO: 219000 - RNA, 20 nt, Homo sapiens
aaucuacuugcccauuuagc

SEQ ID NO: 219001 - RNA, 22 nt, Homo sapiens
aaucugucaguuuuguguuaau

SEQ ID NO: 219002 - RNA, 22 nt, Homo sapiens
aaugacacugagcaucuuucau

SEQ ID NO: 219003 - RNA, 22 nt, Homo sapiens
aaugaucaauguuugaggugau

SEQ ID NO: 219004 - RNA, 22 nt, Homo sapiens
aaugccacugugccugccaagg

SEQ ID NO: 219005 - RNA, 22 nt, Homo sapiens
aauggcacaagacaugaagaag

SEQ ID NO: 219006 - RNA, 22 nt, Homo sapiens
aauggcaguagauggaugggua

SEQ ID NO: 219007 - RNA, 22 nt, Homo sapiens
aauggcucugauguuguuguga

SEQ ID NO: 219008 - RNA, 18 nt, Homo sapiens
aauggcucuggguucuaa

SEQ ID NO: 219009 - RNA, 22 nt, Homo sapiens
aaugggacugacgccucccaga

SEQ ID NO: 219010 - RNA, 22 nt, Homo sapiens
aaugucacugugguccuccagu

SEQ ID NO: 219011 - RNA, 22 nt, Homo sapiens
aaugugcacuauuagggugaua

SEQ ID NO: 219012 - RNA, 22 nt, Homo sapiens
aaugugcuucuggcugugguca

SEQ ID NO: 219013 - RNA, 22 nt, Homo sapiens
aaugugcuuucuuucacacagu

SEQ ID NO: 219014 - RNA, 22 nt, Homo sapiens
aauuacuucuacaccaaccuaa

SEQ ID NO: 219015 - RNA, 22 nt, Homo sapiens
aauuaguugaaagucugcuuuu

SEQ ID NO: 219016 - RNA, 22 nt, Homo sapiens
aauucugugagauggugcagau

SEQ ID NO: 219017 - RNA, 22 nt, Homo sapiens
aauugcauaugcaguagaucua

SEQ ID NO: 219018 - RNA, 22 nt, Homo sapiens
aauuguacucccauaauucccu

SEQ ID NO: 219019 - RNA, 22 nt, Homo sapiens
aauuguacucccaucauuccua

SEQ ID NO: 219020 - RNA, 22 nt, Homo sapiens
acaaagcuagggaauccaucuu

SEQ ID NO: 219021 - RNA, 22 nt, Homo sapiens
acaaagugccuccuuuuagagu

SEQ ID NO: 219022 - RNA, 22 nt, Homo sapiens
acaauguauauuuuacuguagg

SEQ ID NO: 219023 - RNA, 22 nt, Homo sapiens
acacaguaaauauguauugaau

SEQ ID NO: 219024 - RNA, 22 nt, Homo sapiens
acacaguaagcacaguguagau

SEQ ID NO: 219025 - RNA, 22 nt, Homo sapiens
acacagugucuguguauuuaaa

SEQ ID NO: 219026 - RNA, 22 nt, Homo sapiens
acacaugcuccacuguggccuc

SEQ ID NO: 219027 - RNA, 22 nt, Homo sapiens
acaccauugcauuccagccugg

SEQ ID NO: 219028 - RNA, 22 nt, Homo sapiens
acacuuucuggagcugcacaua

SEQ ID NO: 219029 - RNA, 22 nt, Homo sapiens
acagaacugggcuugcuuuugg

SEQ ID NO: 219030 - RNA, 20 nt, Homo sapiens
acagcacugguuucaagcaa

SEQ ID NO: 219031 - RNA, 22 nt, Homo sapiens
acagcagugccccacucuacug

SEQ ID NO: 219032 - RNA, 22 nt, Homo sapiens
acaguacaugauaaauaaggua

SEQ ID NO: 219033 - RNA, 19 nt, Homo sapiens
acaguaccuggcaugaggu

SEQ ID NO: 219034 - RNA, 22 nt, Homo sapiens
acaguacuuuuggauuugugaa

SEQ ID NO: 219035 - RNA, 18 nt, Homo sapiens
cucacaguaacuuuuaag

SEQ ID NO: 219036 - RNA, 22 nt, Homo sapiens
cucacagugacacgaaccccca

SEQ ID NO: 219037 - RNA, 22 nt, Homo sapiens
cucaccuugugauccacccgcc

SEQ ID NO: 219038 - RNA, 22 nt, Homo sapiens
cucacugucaacauguauuugg

SEQ ID NO: 219039 - RNA, 22 nt, Homo sapiens
cucagucuaugauacuuugcua

SEQ ID NO: 219040 - RNA, 22 nt, Homo sapiens
cucaguuuugccuuguuuaagg

SEQ ID NO: 219041 - RNA, 22 nt, Homo sapiens
cucauggagaaccucugcuagg

SEQ ID NO: 219042 - RNA, 22 nt, Homo sapiens
cucauugcaaucucugccuccc

SEQ ID NO: 219043 - RNA, 22 nt, Homo sapiens
cuccauuuaguccuuuuagaag

SEQ ID NO: 219044 - RNA, 22 nt, Homo sapiens
cuccauuuggaacagauguccu

SEQ ID NO: 219045 - RNA, 22 nt, Homo sapiens
cucccacccucauuuuuaggca

SEQ ID NO: 219046 - RNA, 22 nt, Homo sapiens
cucccagagccaguuauaggcu

SEQ ID NO: 219047 - RNA, 22 nt, Homo sapiens
cucccagugacccaggaacagg

SEQ ID NO: 219048 - RNA, 20 nt, Homo sapiens
cucuaguaauaaaguuuccc

SEQ ID NO: 219049 - RNA, 17 nt, Homo sapiens
cucucugguuuaaagca

SEQ ID NO: 219050 - RNA, 22 nt, Homo sapiens
cucucuguuugucuguuauugg

SEQ ID NO: 219051 - RNA, 22 nt, Homo sapiens
cucugagguuauucguaauauu

SEQ ID NO: 219052 - RNA, 22 nt, Homo sapiens
ugaauguacuuaacacuggauu

SEQ ID NO: 219053 - RNA, 22 nt, Homo sapiens
ugaauguauuuauuaccauuca

SEQ ID NO: 219054 - RNA, 22 nt, Homo sapiens
ugaauguuugcuuacuuccaua

SEQ ID NO: 219055 - RNA, 22 nt, Homo sapiens
ugacaacugauuaacuccuuua

SEQ ID NO: 219056 - RNA, 22 nt, Homo sapiens
ugacaagaaagcgucuucuuuu

SEQ ID NO: 219057 - RNA, 22 nt, Homo sapiens
ugacaagaacuuuccauaguaa

SEQ ID NO: 219058 - RNA, 22 nt, Homo sapiens
ugacaagacuacauaucccauu

SEQ ID NO: 219059 - RNA, 22 nt, Homo sapiens
ugacaagaguagagagggugcc

SEQ ID NO: 219060 - RNA, 22 nt, Homo sapiens
ugacaagauauggucuuaucaa

SEQ ID NO: 219061 - RNA, 20 nt, Homo sapiens
ugacaagugagaauuauggg

SEQ ID NO: 219062 - RNA, 22 nt, Homo sapiens
ugacaagugauuaaggcauauu

SEQ ID NO: 219063 - RNA, 19 nt, Homo sapiens
ugacacuguuggugggagg

SEQ ID NO: 219064 - RNA, 17 nt, Homo sapiens
ugacagaaacuuguugu

SEQ ID NO: 219065 - RNA, 22 nt, Homo sapiens
ugacagcugaggcccagaguac

SEQ ID NO: 219066 - RNA, 22 nt, Homo sapiens
ugacaggagauuaugugauguu

SEQ ID NO: 219067 - RNA, 22 nt, Homo sapiens
ugacagguugauaggugcagca

SEQ ID NO: 219068 - RNA, 22 nt, Homo sapiens
ugacagucaccaggacccacag

SEQ ID NO: 219069 - RNA, 22 nt, Homo sapiens
ugacagugaauaagucucuuaa

SEQ ID NO: 219070 - RNA, 22 nt, Homo sapiens
ugacaucugcuugugcccagga

SEQ ID NO: 219071 - RNA, 22 nt, Homo sapiens
ugacauggagggugcggcugca

SEQ ID NO: 219072 - RNA, 22 nt, Homo sapiens
ugacauggugcucuuucaggca

SEQ ID NO: 219073 - RNA, 22 nt, Homo sapiens
ugacauguauuagcucagugcu

SEQ ID NO: 219074 - RNA, 22 nt, Homo sapiens
ugacauguugcauuauauuucc

SEQ ID NO: 219075 - RNA, 22 nt, Homo sapiens
ugacauuacagucacuugcugu

SEQ ID NO: 219076 - RNA, 17 nt, Homo sapiens
ugaccacugauucuacu

SEQ ID NO: 219077 - RNA, 22 nt, Homo sapiens
ugacuacaggucaggaagcugu

SEQ ID NO: 219078 - RNA, 21 nt, Homo sapiens
ugacuagggauaugugccacu

SEQ ID NO: 219079 - RNA, 22 nt, Homo sapiens
ugacuagggcucuaaacagcuc

SEQ ID NO: 219080 - RNA, 22 nt, Homo sapiens
ugacuaggggcccuggcuucuu

SEQ ID NO: 219081 - RNA, 22 nt, Homo sapiens
ugacuccagagacugugcuguc

SEQ ID NO: 219082 - RNA, 22 nt, Homo sapiens
ugacuggaacuuuagugagucu

SEQ ID NO: 219083 - RNA, 23 nt, Homo sapiens
ugacuggagacuguugauccuuu

SEQ ID NO: 219084 - RNA, 18 nt, Homo sapiens
ugacuguccagguggacc

SEQ ID NO: 219085 - RNA, 22 nt, Homo sapiens
ugacuucauuuuuggccaugag

SEQ ID NO: 219086 - RNA, 22 nt, Homo sapiens
ugacuugaguaacuggcucagg

SEQ ID NO: 219087 - RNA, 23 nt, Homo sapiens
ugacuuguccagugauaguucgu

SEQ ID NO: 219088 - RNA, 20 nt, Homo sapiens
ugacuuguccgagguccccc

SEQ ID NO: 219089 - RNA, 21 nt, Homo sapiens
ugagaacaacaggucaagcag

SEQ ID NO: 219090 - RNA, 22 nt, Homo sapiens
ugagaacagauggcuuuauuau

SEQ ID NO: 219091 - RNA, 22 nt, Homo sapiens
ugagaacagcagcuugggacac

SEQ ID NO: 219092 - RNA, 20 nt, Homo sapiens
ugagaacauguggcauuugg

SEQ ID NO: 219093 - RNA, 19 nt, Homo sapiens
ugagaacaugugguauuug

SEQ ID NO: 219094 - RNA, 22 nt, Homo sapiens
ugagaacggauacuaagggcug

SEQ ID NO: 219095 - RNA, 22 nt, Homo sapiens
ugagaacuaaugaagaauuuau

SEQ ID NO: 219096 - RNA, 22 nt, Homo sapiens
ugagaacuagagaacaagguga

SEQ ID NO: 219097 - RNA, 22 nt, Homo sapiens
ugagaacucaugaaucuuucca

SEQ ID NO: 219098 - RNA, 22 nt, Homo sapiens
ugagaagacaucuuugcuuugu

SEQ ID NO: 219099 - RNA, 22 nt, Homo sapiens
ugagaauguagggcucucccag

SEQ ID NO: 219100 - RNA, 22 nt, Homo sapiens
ugagacacuucccagaucccuu

SEQ ID NO: 219101 - RNA, 22 nt, Homo sapiens
ugagacauacuuacaggggaug

SEQ ID NO: 219102 - RNA, 22 nt, Homo sapiens
ugagacaucugagauuuuaagc

SEQ ID NO: 219103 - RNA, 22 nt, Homo sapiens
ugagacaugugaacuguaguuc

SEQ ID NO: 219104 - RNA, 22 nt, Homo sapiens
ugagaccuuucauuucucagug

SEQ ID NO: 219105 - RNA, 22 nt, Homo sapiens
ugagacggagucucacucuguu

SEQ ID NO: 219106 - RNA, 22 nt, Homo sapiens
ugagacggagucucgcucuguc

SEQ ID NO: 219107 - RNA, 22 nt, Homo sapiens
ugagacggagucucgcucuguu

SEQ ID NO: 219108 - RNA, 22 nt, Homo sapiens
ugagacggagucuugcccuguc

SEQ ID NO: 219109 - RNA, 22 nt, Homo sapiens
ugagacggagucuugcuaaguu

SEQ ID NO: 219110 - RNA, 22 nt, Homo sapiens
ugagacggagucuugcucuguc

SEQ ID NO: 219111 - RNA, 22 nt, Homo sapiens
ugagacggaguuauuuauaaua

SEQ ID NO: 219112 - RNA, 22 nt, Homo sapiens
ugagacggaguuucacucuugu

SEQ ID NO: 219113 - RNA, 22 nt, Homo sapiens
ugagacggaguuucgcucuugu

SEQ ID NO: 219114 - RNA, 22 nt, Homo sapiens
ugagacugaguuucacuuuugu

SEQ ID NO: 219115 - RNA, 22 nt, Homo sapiens
ugagacugaguuucucucuugu

SEQ ID NO: 219116 - RNA, 22 nt, Homo sapiens
ugagacugaguuuugcucuugu

SEQ ID NO: 219117 - RNA, 22 nt, Homo sapiens
ugagagacaguuucgucggagg

SEQ ID NO: 219118 - RNA, 22 nt, Homo sapiens
ugagaguagggguugggauugg

SEQ ID NO: 219119 - RNA, 22 nt, Homo sapiens
ugagagucacugaccugguaua

SEQ ID NO: 219120 - RNA, 22 nt, Homo sapiens
ugagaucagugaagaaguguuu

SEQ ID NO: 219121 - RNA, 22 nt, Homo sapiens
ugagaucuuugcuguccucacc

SEQ ID NO: 219122 - RNA, 22 nt, Homo sapiens
ugagaugagaaucaguucuaau

SEQ ID NO: 219123 - RNA, 22 nt, Homo sapiens
ugagaugagagaaugcuugccu

SEQ ID NO: 219124 - RNA, 22 nt, Homo sapiens
ugagaugaguugcuggcucuga

SEQ ID NO: 219125 - RNA, 22 nt, Homo sapiens
ugagaugcauauucuggcuccu

SEQ ID NO: 219126 - RNA, 22 nt, Homo sapiens
ugagaugcuuguaaauucauuu

SEQ ID NO: 219127 - RNA, 22 nt, Homo sapiens
ugagaugguaaauuuuuguugu

SEQ ID NO: 219128 - RNA, 22 nt, Homo sapiens
ugagaugugugcauucaacuca

SEQ ID NO: 219129 - RNA, 22 nt, Homo sapiens
ugagauguuccaaugacuauua

SEQ ID NO: 219130 - RNA, 22 nt, Homo sapiens
ugagauguuuagauuguugucu

SEQ ID NO: 219131 - RNA, 22 nt, Homo sapiens
ugagauuaaucuuuaaguaaga

SEQ ID NO: 219132 - RNA, 23 nt, Homo sapiens
ugagauuauaaucuuuuacuucu

SEQ ID NO: 219133 - RNA, 22 nt, Homo sapiens
ugagauuaucuugaucuugaaa

SEQ ID NO: 219134 - RNA, 22 nt, Homo sapiens
ugagauuguaucugcaaugugu

SEQ ID NO: 219135 - RNA, 22 nt, Homo sapiens
ugagauuguucuaugucugguu

SEQ ID NO: 219136 - RNA, 22 nt, Homo sapiens
ugagcaagaaauagaaacagau

SEQ ID NO: 219137 - RNA, 22 nt, Homo sapiens
ugagcacauuuacaucaguucc

SEQ ID NO: 219138 - RNA, 22 nt, Homo sapiens
ugagcagagaucacggcauugu

SEQ ID NO: 219139 - RNA, 22 nt, Homo sapiens
ugagcagugagugugcugcagg

SEQ ID NO: 219140 - RNA, 22 nt, Homo sapiens
ugagcagugaguguggugcagg

SEQ ID NO: 219141 - RNA, 22 nt, Homo sapiens
ugagcauuguguuugacuguga

SEQ ID NO: 219142 - RNA, 22 nt, Homo sapiens
ugagccaugguuagcuucucau

SEQ ID NO: 219143 - RNA, 22 nt, Homo sapiens
ugagcccauuguccugguuuau

SEQ ID NO: 219144 - RNA, 22 nt, Homo sapiens
ugagcuagggccuggaauaggg

SEQ ID NO: 219145 - RNA, 20 nt, Homo sapiens
ugagcucaauuguugcaagu

SEQ ID NO: 219146 - RNA, 22 nt, Homo sapiens
ugagcugagaucacacuacugu

SEQ ID NO: 219147 - RNA, 22 nt, Homo sapiens
ugaggacugagaggcacugugg

SEQ ID NO: 219148 - RNA, 22 nt, Homo sapiens
ugaggcaagauacugauuucau

SEQ ID NO: 219149 - RNA, 22 nt, Homo sapiens
ugaggcuaggauaggcugauuc

SEQ ID NO: 219150 - RNA, 22 nt, Homo sapiens
ugagggaugcguacccuaugcc

SEQ ID NO: 219151 - RNA, 22 nt, Homo sapiens
ugagggcguauccuucauuaag

SEQ ID NO: 219152 - RNA, 22 nt, Homo sapiens
ugagguaaaacaaggauuggau

SEQ ID NO: 219153 - RNA, 22 nt, Homo sapiens
ugagguaagauguucauuuuuc

SEQ ID NO: 219154 - RNA, 22 nt, Homo sapiens
guucacacuugcaaccccagca

SEQ ID NO: 219155 - RNA, 22 nt, Homo sapiens
guucagcaggggcuucaauggu

SEQ ID NO: 219156 - RNA, 22 nt, Homo sapiens
guucaguaguucauucauuuau

SEQ ID NO: 219157 - RNA, 22 nt, Homo sapiens
guucaucagggacacugguuug

SEQ ID NO: 219158 - RNA, 22 nt, Homo sapiens
guucaucagggauacuggcuua

SEQ ID NO: 219159 - RNA, 20 nt, Homo sapiens
guucccuguaggugugcgga

SEQ ID NO: 219160 - RNA, 22 nt, Homo sapiens
guucucacuggacugugaaaau

SEQ ID NO: 219161 - RNA, 22 nt, Homo sapiens
guugagcaaacagcuuaacagu

SEQ ID NO: 219162 - RNA, 22 nt, Homo sapiens
guugaguuugaccugaacucug

SEQ ID NO: 219163 - RNA, 17 nt, Homo sapiens
guugaguuugagucaag

SEQ ID NO: 219164 - RNA, 22 nt, Homo sapiens
guugcucaggcugaagugcagu

SEQ ID NO: 219165 - RNA, 22 nt, Homo sapiens
guuggcuguuucccccaaguga

SEQ ID NO: 219166 - RNA, 22 nt, Homo sapiens
guugugcuuaagccuauugauu

SEQ ID NO: 219167 - RNA, 22 nt, Homo sapiens
guuugugcuccuaugagaaccu

SEQ ID NO: 219168 - RNA, 22 nt, Homo sapiens
guuuuuggggucacuauuaccg

SEQ ID NO: 219169 - RNA, 21 nt, Homo sapiens
uaaaacuguaacuuuguccug

SEQ ID NO: 219170 - RNA, 22 nt, Homo sapiens
uaaaccuagcauuuugcauaug

SEQ ID NO: 219171 - RNA, 22 nt, Homo sapiens
uaaacugcuugaggguaaguac

SEQ ID NO: 219172 - RNA, 22 nt, Homo sapiens
uaaagauaaggcucgcuuggau

SEQ ID NO: 219173 - RNA, 17 nt, Homo sapiens
uaaagccagucaaguca

SEQ ID NO: 219174 - RNA, 22 nt, Homo sapiens
uaaagcuacagagcggaaaauu

SEQ ID NO: 219175 - RNA, 22 nt, Homo sapiens
uaaagcuuggauuuaggcuaau

SEQ ID NO: 219176 - RNA, 22 nt, Homo sapiens
uaaaguguuuguuauuaaaggu

SEQ ID NO: 219177 - RNA, 22 nt, Homo sapiens
uaaaguucuuuuaugggccggg

SEQ ID NO: 219178 - RNA, 22 nt, Homo sapiens
uaaaugacugucaguagaugaa

SEQ ID NO: 219179 - RNA, 22 nt, Homo sapiens
uaaaugcuugagaugauggaua

SEQ ID NO: 219180 - RNA, 22 nt, Homo sapiens
uaaauggauauugccaucuccu

SEQ ID NO: 219181 - RNA, 22 nt, Homo sapiens
uaacaacauucuaacugacggc

SEQ ID NO: 219182 - RNA, 22 nt, Homo sapiens
uaacacagagcuccuaaucccu

SEQ ID NO: 219183 - RNA, 22 nt, Homo sapiens
uaacacccuucuccagguacau

SEQ ID NO: 219184 - RNA, 22 nt, Homo sapiens
uaacaggcaaggucacaccuug

SEQ ID NO: 219185 - RNA, 22 nt, Homo sapiens
uaacagucuccucaagguguug

SEQ ID NO: 219186 - RNA, 22 nt, Homo sapiens
uaacaguggucugugguaucug

SEQ ID NO: 219187 - RNA, 22 nt, Homo sapiens
uaacaguguauuccuuuggaca

SEQ ID NO: 219188 - RNA, 22 nt, Homo sapiens
uaacauagucauauacuugcuu

SEQ ID NO: 219189 - RNA, 22 nt, Homo sapiens
uaacuaguggaauuugauuuca

SEQ ID NO: 219190 - RNA, 22 nt, Homo sapiens
aaacauugaccucauccuggca

SEQ ID NO: 219191 - RNA, 22 nt, Homo sapiens
aaacgugcagagaucaauagca

SEQ ID NO: 219192 - RNA, 22 nt, Homo sapiens
aaagcagcaggugguuuucaau

SEQ ID NO: 219193 - RNA, 20 nt, Homo sapiens
aaaggcugugagaacgagau

SEQ ID NO: 219194 - RNA, 22 nt, Homo sapiens
aaagggcacugugcuuuggcaa

SEQ ID NO: 219195 - RNA, 22 nt, Homo sapiens
aaagggcuugaauacucuuuuu

SEQ ID NO: 219196 - RNA, 19 nt, Homo sapiens
aaagguaguaaccucugau

SEQ ID NO: 219197 - RNA, 22 nt, Homo sapiens
aaagucacuggagaaggaauau

SEQ ID NO: 219198 - RNA, 22 nt, Homo sapiens
aaagucuagaggaucaugugug

SEQ ID NO: 219199 - RNA, 22 nt, Homo sapiens
aaagucuguuuugucagagacu

SEQ ID NO: 219200 - RNA, 22 nt, Homo sapiens
aaagugacuuagugccccauuu

SEQ ID NO: 219201 - RNA, 22 nt, Homo sapiens
aaagugauugcgguuuuugcca

SEQ ID NO: 219202 - RNA, 22 nt, Homo sapiens
aaagugcacuuggaagagggcc

SEQ ID NO: 219203 - RNA, 22 nt, Homo sapiens
aaagugcaguauuugggcagaa

SEQ ID NO: 219204 - RNA, 22 nt, Homo sapiens
aaagugcugagaguucuaacuu

SEQ ID NO: 219205 - RNA, 22 nt, Homo sapiens
aaagugcugagauuguaggcau

SEQ ID NO: 219206 - RNA, 22 nt, Homo sapiens
aaagugcugggaucacacugaa

SEQ ID NO: 219207 - RNA, 22 nt, Homo sapiens
aaagugcugggauuggccgggc

SEQ ID NO: 219208 - RNA, 22 nt, Homo sapiens
aaaguggugggauuccaggcau

SEQ ID NO: 219209 - RNA, 22 nt, Homo sapiens
aaaguggugugaguauguaucu

SEQ ID NO: 219210 - RNA, 22 nt, Homo sapiens
aaaguguguuuccaaccugugg

SEQ ID NO: 219211 - RNA, 22 nt, Homo sapiens
aaaguucuguugauagugcuga

SEQ ID NO: 219212 - RNA, 22 nt, Homo sapiens
aaauccauuuguucagcuaugc

SEQ ID NO: 219213 - RNA, 22 nt, Homo sapiens
aaaugcacagaaaggaugugga

SEQ ID NO: 219214 - RNA, 22 nt, Homo sapiens
aaaugcaguugguggggauaug

SEQ ID NO: 219215 - RNA, 22 nt, Homo sapiens
aaaugcaucauuaggugauuuu

SEQ ID NO: 219216 - RNA, 22 nt, Homo sapiens
aaaugccucccauucuacugac

SEQ ID NO: 219217 - RNA, 22 nt, Homo sapiens
aaaugcucucuacacguuucug

SEQ ID NO: 219218 - RNA, 20 nt, Homo sapiens
aaaugcuguaauguuuggga

SEQ ID NO: 219219 - RNA, 22 nt, Homo sapiens
aaaugcugucugugagccucau

SEQ ID NO: 219220 - RNA, 22 nt, Homo sapiens
aaauggcuuuuugggcaaggug

SEQ ID NO: 219221 - RNA, 22 nt, Homo sapiens
aaaugucauggaguguuucccc

SEQ ID NO: 219222 - RNA, 22 nt, Homo sapiens
aaauugcuuuugaagacuuagu

SEQ ID NO: 219223 - RNA, 22 nt, Homo sapiens
ggucaggagaaugguaacugag

SEQ ID NO: 219224 - RNA, 22 nt, Homo sapiens
ggucauagagcaagcaaacagc

SEQ ID NO: 219225 - RNA, 22 nt, Homo sapiens
ggucauggagcuuuacuuuaug

SEQ ID NO: 219226 - RNA, 22 nt, Homo sapiens
ggucauggauaagauccagaag

SEQ ID NO: 219227 - RNA, 22 nt, Homo sapiens
ggucugguguugaaauucuuca

SEQ ID NO: 219228 - RNA, 21 nt, Homo sapiens
ggugagaaaggagacauagac

SEQ ID NO: 219229 - RNA, 22 nt, Homo sapiens
ggugagauguucagacgaacug

SEQ ID NO: 219230 - RNA, 22 nt, Homo sapiens
ggugcagcacaccaacauggca

SEQ ID NO: 219231 - RNA, 22 nt, Homo sapiens
gguggugguauuucagaaaaug

SEQ ID NO: 219232 - RNA, 22 nt, Homo sapiens
guaaauaccaguuucuggaaca

SEQ ID NO: 219233 - RNA, 22 nt, Homo sapiens
guaacguaaugucaaaaucuau

SEQ ID NO: 219234 - RNA, 22 nt, Homo sapiens
guaagacuuauuuucuuuauca

SEQ ID NO: 219235 - RNA, 22 nt, Homo sapiens
guaaguagcuuuagauauaaau

SEQ ID NO: 219236 - RNA, 22 nt, Homo sapiens
guaagugauagaauuaggauuc

SEQ ID NO: 219237 - RNA, 22 nt, Homo sapiens
guaauaacuguggaaaaagguu

SEQ ID NO: 219238 - RNA, 22 nt, Homo sapiens
guaaucucaccuacuugggagg

SEQ ID NO: 219239 - RNA, 22 nt, Homo sapiens
guacacauacauauaugugugu

SEQ ID NO: 219240 - RNA, 22 nt, Homo sapiens
guacaggcagcaaacaccauaa

SEQ ID NO: 219241 - RNA, 22 nt, Homo sapiens
guacaguauaguaauaggauuu

SEQ ID NO: 219242 - RNA, 22 nt, Homo sapiens
guacaguggguguagggaccag

SEQ ID NO: 219243 - RNA, 22 nt, Homo sapiens
guacaguucucuuuguugucag

SEQ ID NO: 219244 - RNA, 22 nt, Homo sapiens
guacaguuuagugcuuugagaa

SEQ ID NO: 219245 - RNA, 22 nt, Homo sapiens
guacccaguagauaguuuuuca

SEQ ID NO: 219246 - RNA, 22 nt, Homo sapiens
guacccuggaacaacccaauuu

SEQ ID NO: 219247 - RNA, 22 nt, Homo sapiens
guaccucaguuggaaaugcaga

SEQ ID NO: 219248 - RNA, 22 nt, Homo sapiens
guagaaagcauuucagauuugc

SEQ ID NO: 219249 - RNA, 22 nt, Homo sapiens
guagaaaguuugcugucacaug

SEQ ID NO: 219250 - RNA, 22 nt, Homo sapiens
guagaauguauguauaacgcaa

SEQ ID NO: 219251 - RNA, 22 nt, Homo sapiens
guagaggaauggcuccaccaua

SEQ ID NO: 219252 - RNA, 22 nt, Homo sapiens
guagagugcugggcacuggcuc

SEQ ID NO: 219253 - RNA, 22 nt, Homo sapiens
guagaugcauggauuuacuucu

SEQ ID NO: 219254 - RNA, 18 nt, Homo sapiens
guaggucaguaccaagca

SEQ ID NO: 219255 - RNA, 22 nt, Homo sapiens
guauaaguugacucaaucuuug

SEQ ID NO: 219256 - RNA, 22 nt, Homo sapiens
guauaugccucaguuauagcac

SEQ ID NO: 219257 - RNA, 22 nt, Homo sapiens
guaucaucauguuggccaggcu

SEQ ID NO: 219258 - RNA, 22 nt, Homo sapiens
guaucaugaaguuucuucauuu

SEQ ID NO: 219259 - RNA, 22 nt, Homo sapiens
guaucauuggcauguaaccaga

SEQ ID NO: 219260 - RNA, 22 nt, Homo sapiens
guauccugaaguucucagcacu

SEQ ID NO: 219261 - RNA, 22 nt, Homo sapiens
guaugacacaggaagcuuaacc

SEQ ID NO: 219262 - RNA, 22 nt, Homo sapiens
guaugauacuguaacagugggu

SEQ ID NO: 219263 - RNA, 22 nt, Homo sapiens
guauuuuguuagggugugguau

SEQ ID NO: 219264 - RNA, 22 nt, Homo sapiens
gucaagugaagcagugggagua

SEQ ID NO: 219265 - RNA, 22 nt, Homo sapiens
gucacagaaaaagauaugccaa

SEQ ID NO: 219266 - RNA, 22 nt, Homo sapiens
gucacauugaugcccauggugg

SEQ ID NO: 219267 - RNA, 22 nt, Homo sapiens
gucacugagcagaaggaagcga

SEQ ID NO: 219268 - RNA, 20 nt, Homo sapiens
gucacuggcccagggcuugu

SEQ ID NO: 219269 - RNA, 22 nt, Homo sapiens
gucacuguggagaagaaagugg

SEQ ID NO: 219270 - RNA, 22 nt, Homo sapiens
gucagaaucucagaugacaacg

SEQ ID NO: 219271 - RNA, 22 nt, Homo sapiens
gucagaugcagauuccaguucu

SEQ ID NO: 219272 - RNA, 22 nt, Homo sapiens
gucagcaaaguucuccugcaga

SEQ ID NO: 219273 - RNA, 22 nt, Homo sapiens
gucagguaccugaaagcagcca

SEQ ID NO: 219274 - RNA, 22 nt, Homo sapiens
gucagucugucccugccuggcg

SEQ ID NO: 219275 - RNA, 22 nt, Homo sapiens
gucagugcauguaaacauaaaa

SEQ ID NO: 219276 - RNA, 22 nt, Homo sapiens
gucagugucuuugcagcucaga

SEQ ID NO: 219277 - RNA, 22 nt, Homo sapiens
gucaucaggacgggucaucugc

SEQ ID NO: 219278 - RNA, 22 nt, Homo sapiens
gucaugucuugaaauucaguuu

SEQ ID NO: 219279 - RNA, 22 nt, Homo sapiens
gucauguuuaacuucuugagga

SEQ ID NO: 219280 - RNA, 22 nt, Homo sapiens
gucauugcuuaucugcugacgu

SEQ ID NO: 219281 - RNA, 22 nt, Homo sapiens
guccaguguuggagguuuuacc

SEQ ID NO: 219282 - RNA, 22 nt, Homo sapiens
guccaugagaugaauccacaca

SEQ ID NO: 219283 - RNA, 22 nt, Homo sapiens
guccauuuguuuccagagcacu

SEQ ID NO: 219284 - RNA, 19 nt, Homo sapiens
ucucacagcucuacuaugu

SEQ ID NO: 219285 - RNA, 22 nt, Homo sapiens
ucucagugaauguggaaaaagc

SEQ ID NO: 219286 - RNA, 22 nt, Homo sapiens
ucucaguggcacccccaacacc

SEQ ID NO: 219287 - RNA, 19 nt, Homo sapiens
ucucaguguuggucaggug

SEQ ID NO: 219288 - RNA, 20 nt, Homo sapiens
ucucauggagguagagaaua

SEQ ID NO: 219289 - RNA, 22 nt, Homo sapiens
ucucauggagguagagaguaaa

SEQ ID NO: 219290 - RNA, 22 nt, Homo sapiens
ucucauggagucaggagcagaa

SEQ ID NO: 219291 - RNA, 22 nt, Homo sapiens
ucuccaguuuccuucgucuauc

SEQ ID NO: 219292 - RNA, 22 nt, Homo sapiens
ucuccauugaaauggacauaau

SEQ ID NO: 219293 - RNA, 22 nt, Homo sapiens
ucuccauuuguaaggguuucuc

SEQ ID NO: 219294 - RNA, 22 nt, Homo sapiens
ucucccauccguacacggauug

SEQ ID NO: 219295 - RNA, 22 nt, Homo sapiens
ucucugaaacucuugacauccu

SEQ ID NO: 219296 - RNA, 22 nt, Homo sapiens
ucucugauuaaacaagauagug

SEQ ID NO: 219297 - RNA, 22 nt, Homo sapiens
ucugaaucguucccaugcagga

SEQ ID NO: 219298 - RNA, 22 nt, Homo sapiens
ucugacagugugaauauugacu

SEQ ID NO: 219299 - RNA, 22 nt, Homo sapiens
ucugacucugugaugggcccaa

SEQ ID NO: 219300 - RNA, 22 nt, Homo sapiens
ucugagacuguuucuaacaagc

SEQ ID NO: 219301 - RNA, 22 nt, Homo sapiens
ucugagcaugcaucuugccugg

SEQ ID NO: 219302 - RNA, 22 nt, Homo sapiens
ucugagguuaaauuuuauaguu

SEQ ID NO: 219303 - RNA, 22 nt, Homo sapiens
ucugagucaucacaaaugaugc

SEQ ID NO: 219304 - RNA, 22 nt, Homo sapiens
ucugccacugucauugugugau

SEQ ID NO: 219305 - RNA, 22 nt, Homo sapiens
ucuggcacucagaggccuugcu

SEQ ID NO: 219306 - RNA, 22 nt, Homo sapiens
ucuggcauuuucucugcuugca

SEQ ID NO: 219307 - RNA, 22 nt, Homo sapiens
ucuggccccucccaaaucucau

SEQ ID NO: 219308 - RNA, 22 nt, Homo sapiens
ucuggccuacaucauuuuuccg

SEQ ID NO: 219309 - RNA, 22 nt, Homo sapiens
ucuggcuucugacuuaggggac

SEQ ID NO: 219310 - RNA, 18 nt, Homo sapiens
ucuggcuucuuuguucca

SEQ ID NO: 219311 - RNA, 22 nt, Homo sapiens
ucuggcuugugaacugucuucu

SEQ ID NO: 219312 - RNA, 22 nt, Homo sapiens
ucuggcuuuagcaugugggaag

SEQ ID NO: 219313 - RNA, 22 nt, Homo sapiens
ucuggguuuuuacaauguuuac

SEQ ID NO: 219314 - RNA, 22 nt, Homo sapiens
ucugguguuacugagccuccca

SEQ ID NO: 219315 - RNA, 23 nt, Homo sapiens
ucugguguugucaaaugcugguu

SEQ ID NO: 219316 - RNA, 22 nt, Homo sapiens
ucuguacuuccguaccuaaagu

SEQ ID NO: 219317 - RNA, 19 nt, Homo sapiens
ucugucacuggggguauuc

SEQ ID NO: 219318 - RNA, 22 nt, Homo sapiens
ucugucuugugguuugagugcc

SEQ ID NO: 219319 - RNA, 22 nt, Homo sapiens
ucugucuuugucaggaccagag

SEQ ID NO: 219320 - RNA, 22 nt, Homo sapiens
ucugugaaaucauuuccuguaa

SEQ ID NO: 219321 - RNA, 22 nt, Homo sapiens
ucugugaaugaacacuugaaaa

SEQ ID NO: 219322 - RNA, 22 nt, Homo sapiens
ucugugcauuuucuuuuagacu

SEQ ID NO: 219323 - RNA, 19 nt, Homo sapiens
ucugugcuugucccccugu

SEQ ID NO: 219324 - RNA, 22 nt, Homo sapiens
ucugugguaagaaacgcauguc

SEQ ID NO: 219325 - RNA, 22 nt, Homo sapiens
ucugugguucaaaccagcaacu

SEQ ID NO: 219326 - RNA, 22 nt, Homo sapiens
ucuguguugaucacacugggag

SEQ ID NO: 219327 - RNA, 21 nt, Homo sapiens
ucuguguugaucucacuggga

SEQ ID NO: 219328 - RNA, 22 nt, Homo sapiens
ucuguguuuagacccaggguag

SEQ ID NO: 219329 - RNA, 22 nt, Homo sapiens
ucuguuguuaucauaauauuga

SEQ ID NO: 219330 - RNA, 22 nt, Homo sapiens
ucuuaggauacugaagucgguu

SEQ ID NO: 219331 - RNA, 22 nt, Homo sapiens
ucuuagugcggcugcugcagcc

SEQ ID NO: 219332 - RNA, 22 nt, Homo sapiens
ucuuauuuggggaaaggguccu

SEQ ID NO: 219333 - RNA, 22 nt, Homo sapiens
ucuucaugcuugaaauaauagc

SEQ ID NO: 219334 - RNA, 17 nt, Homo sapiens
ucuucuguuacuguggc

SEQ ID NO: 219335 - RNA, 22 nt, Homo sapiens
ucuugcacacaguaaguguuuu

SEQ ID NO: 219336 - RNA, 19 nt, Homo sapiens
ucuugcacaugugaacuca

SEQ ID NO: 219337 - RNA, 22 nt, Homo sapiens
ucuugcaguucccaaauucaca

SEQ ID NO: 219338 - RNA, 22 nt, Homo sapiens
ucuugccacuucauccccuuuc

SEQ ID NO: 219339 - RNA, 22 nt, Homo sapiens
ucuugcuuuugcagagcuucuc

SEQ ID NO: 219340 - RNA, 22 nt, Homo sapiens
ucuuggcaaagaauuuuuggcu

SEQ ID NO: 219341 - RNA, 22 nt, Homo sapiens
ucuuggcauggcugaagauucc

SEQ ID NO: 219342 - RNA, 22 nt, Homo sapiens
ucuuggguggauucauucuuuc

SEQ ID NO: 219343 - RNA, 22 nt, Homo sapiens
ucuuggguuuguccuucuccua

SEQ ID NO: 219344 - RNA, 22 nt, Homo sapiens
ucuugguuuauugauggagagg

SEQ ID NO: 219345 - RNA, 22 nt, Homo sapiens
ucuugguuuauugugguaugaa

SEQ ID NO: 219346 - RNA, 19 nt, Homo sapiens
ucuuuagucacauuuuuau

SEQ ID NO: 219347 - RNA, 19 nt, Homo sapiens
ucuuugaggcaucgcccuc

SEQ ID NO: 219348 - RNA, 22 nt, Homo sapiens
ucuuugauuaugcagauggguu

SEQ ID NO: 219349 - RNA, 22 nt, Homo sapiens
ucuuugauuuuguuacuaagac

SEQ ID NO: 219350 - RNA, 19 nt, Homo sapiens
ucuuugcuuuucuaagagg

SEQ ID NO: 219351 - RNA, 22 nt, Homo sapiens
ucuuuggaggcgaucuguuuga

SEQ ID NO: 219352 - RNA, 19 nt, Homo sapiens
ucuuugguacgugcuuuga

SEQ ID NO: 219353 - RNA, 22 nt, Homo sapiens
ucuuugguauugugaauagugu

SEQ ID NO: 219354 - RNA, 22 nt, Homo sapiens
ucuuuggucuacuuucauaugu

SEQ ID NO: 219355 - RNA, 22 nt, Homo sapiens
ucuuugguucugugcagccuau

SEQ ID NO: 219356 - RNA, 22 nt, Homo sapiens
ucuuuguguucaggagccacgu

SEQ ID NO: 219357 - RNA, 22 nt, Homo sapiens
ucuuuugggccucuugucagac

SEQ ID NO: 219358 - RNA, 22 nt, Homo sapiens
ucuuuugguuucuagaggccgc

SEQ ID NO: 219359 - RNA, 22 nt, Homo sapiens
ucuuuuguaaaaugaggaggug

SEQ ID NO: 219360 - RNA, 22 nt, Homo sapiens
ugaaacacacauugcccuuuau

SEQ ID NO: 219361 - RNA, 22 nt, Homo sapiens
ugaaacacaccuccucuccauc

SEQ ID NO: 219362 - RNA, 22 nt, Homo sapiens
ugaaacugcagugggcuuggca

SEQ ID NO: 219363 - RNA, 22 nt, Homo sapiens
ugaaagguauagguucuggagg

SEQ ID NO: 219364 - RNA, 22 nt, Homo sapiens
ugaaaguaauugcaguuuuuac

SEQ ID NO: 219365 - RNA, 22 nt, Homo sapiens
ugaaauacuuuggcucuuuguu

SEQ ID NO: 219366 - RNA, 22 nt, Homo sapiens
ugaaaucuaaaauguuccaaga

SEQ ID NO: 219367 - RNA, 21 nt, Homo sapiens
ugaaaugcaugugcacauuaa

SEQ ID NO: 219368 - RNA, 22 nt, Homo sapiens
ugaaaugccuugagauuuugac

SEQ ID NO: 219369 - RNA, 22 nt, Homo sapiens
ugaaauggaaagaguguagacu

SEQ ID NO: 219370 - RNA, 22 nt, Homo sapiens
ugaaaugguuaugugaggagau

SEQ ID NO: 219371 - RNA, 22 nt, Homo sapiens
ugaaauuuuuuauucguuggcu

SEQ ID NO: 219372 - RNA, 22 nt, Homo sapiens
ugaacacuggauaaggagucag

SEQ ID NO: 219373 - RNA, 22 nt, Homo sapiens
ugaacagagaaacacuggccau

SEQ ID NO: 219374 - RNA, 22 nt, Homo sapiens
ugaacagcaccuccuagaguug

SEQ ID NO: 219375 - RNA, 22 nt, Homo sapiens
ugaagaucuuaggagcugaggg

SEQ ID NO: 219376 - RNA, 22 nt, Homo sapiens
ugaaggacauaaggcagaguga

SEQ ID NO: 219377 - RNA, 22 nt, Homo sapiens
ugaagggcauuguuuugccaaa

SEQ ID NO: 219378 - RNA, 22 nt, Homo sapiens
ugaagugggaaaugaguauuaa

SEQ ID NO: 219379 - RNA, 22 nt, Homo sapiens
ugaaguguuuuuucaggcaugu

SEQ ID NO: 219380 - RNA, 22 nt, Homo sapiens
ugaauacugugcaaaggauuug

SEQ ID NO: 219381 - RNA, 22 nt, Homo sapiens
ugaauagacagucacugccucc

SEQ ID NO: 219382 - RNA, 22 nt, Homo sapiens
ugaauauguuucuaaaagugca

SEQ ID NO: 219383 - RNA, 21 nt, Homo sapiens
ugaaugcuuuaaauauuagaa

SEQ ID NO: 219384 - RNA, 22 nt, Homo sapiens
ugaauguaacuaaaggacuuuu

SEQ ID NO: 219385 - RNA, 22 nt, Homo sapiens
ugaauguaagaugucugcuggu

SEQ ID NO: 219386 - RNA, 22 nt, Homo sapiens
augacaagaguguucagggaga

SEQ ID NO: 219387 - RNA, 22 nt, Homo sapiens
augacacugcagagauguccca

SEQ ID NO: 219388 - RNA, 23 nt, Homo sapiens
augacacuguccuugaccauuuc

SEQ ID NO: 219389 - RNA, 22 nt, Homo sapiens
augacauuccacagccguagag

SEQ ID NO: 219390 - RNA, 22 nt, Homo sapiens
augaccagagagugcgcagggu

SEQ ID NO: 219391 - RNA, 22 nt, Homo sapiens
augaccuuggggaaccaugucu

SEQ ID NO: 219392 - RNA, 22 nt, Homo sapiens
augacuaaaggguuuauguuga

SEQ ID NO: 219393 - RNA, 22 nt, Homo sapiens
augacugucuugcagaggcuau

SEQ ID NO: 219394 - RNA, 22 nt, Homo sapiens
augacuuuucugaaaaccacca

SEQ ID NO: 219395 - RNA, 22 nt, Homo sapiens
augagaccagcagaaaaccugu

SEQ ID NO: 219396 - RNA, 22 nt, Homo sapiens
augagacuagaagagaauaaua

SEQ ID NO: 219397 - RNA, 22 nt, Homo sapiens
augagagcaacaccuucacuug

SEQ ID NO: 219398 - RNA, 18 nt, Homo sapiens
augagagccgauuccugg

SEQ ID NO: 219399 - RNA, 22 nt, Homo sapiens
augagagcugacuuuaaggcaa

SEQ ID NO: 219400 - RNA, 22 nt, Homo sapiens
augagaucugugaacaccuguc

SEQ ID NO: 219401 - RNA, 22 nt, Homo sapiens
augagaugaggaauggcccucc

SEQ ID NO: 219402 - RNA, 22 nt, Homo sapiens
augagaugcaagauuagauggg

SEQ ID NO: 219403 - RNA, 21 nt, Homo sapiens
augagauguuagacuuuagac

SEQ ID NO: 219404 - RNA, 22 nt, Homo sapiens
augagcacuuguuuugggcaca

SEQ ID NO: 219405 - RNA, 22 nt, Homo sapiens
augagcagaagagauacacugu

SEQ ID NO: 219406 - RNA, 22 nt, Homo sapiens
augagcuauggagacagggcca

SEQ ID NO: 219407 - RNA, 22 nt, Homo sapiens
augagggcggacgcccuggaga

SEQ ID NO: 219408 - RNA, 22 nt, Homo sapiens
augaggugggagaaucacuuga

SEQ ID NO: 219409 - RNA, 18 nt, Homo sapiens
augagucauuguggaaau

SEQ ID NO: 219410 - RNA, 22 nt, Homo sapiens
augauacuggcuucauagaaug

SEQ ID NO: 219411 - RNA, 22 nt, Homo sapiens
augauaucuuguuuuucaugca

SEQ ID NO: 219412 - RNA, 22 nt, Homo sapiens
augauccagugaguuucaguuc

SEQ ID NO: 219413 - RNA, 22 nt, Homo sapiens
augaugcaguacuuugggaaca

SEQ ID NO: 219414 - RNA, 22 nt, Homo sapiens
augaugcugagguuugggguau

SEQ ID NO: 219415 - RNA, 22 nt, Homo sapiens
augauggaggccgugauggacg

SEQ ID NO: 219416 - RNA, 22 nt, Homo sapiens
augauguguucuguguucccau

SEQ ID NO: 219417 - RNA, 19 nt, Homo sapiens
augauugucuauggaggaa

SEQ ID NO: 219418 - RNA, 22 nt, Homo sapiens
augcaacuugaaauuuuccgga

SEQ ID NO: 219419 - RNA, 22 nt, Homo sapiens
augcacaucagcuccagggacc

SEQ ID NO: 219420 - RNA, 22 nt, Homo sapiens
augcacuguuguuauuggauaa

SEQ ID NO: 219421 - RNA, 22 nt, Homo sapiens
augcagagaaaucuaaaauaug

SEQ ID NO: 219422 - RNA, 22 nt, Homo sapiens
augcagagucccagccccuagc

SEQ ID NO: 219423 - RNA, 22 nt, Homo sapiens
augcagcugaggguaguggagc

SEQ ID NO: 219424 - RNA, 22 nt, Homo sapiens
augcauauuuuaccuagaagag

SEQ ID NO: 219425 - RNA, 22 nt, Homo sapiens
augccucugacaauuggauucu

SEQ ID NO: 219426 - RNA, 22 nt, Homo sapiens
augcuacugauaagcaaucauu

SEQ ID NO: 219427 - RNA, 22 nt, Homo sapiens
augcuacuggacaauggugacu

SEQ ID NO: 219428 - RNA, 22 nt, Homo sapiens
augcuggugguucacaugcgca

SEQ ID NO: 219429 - RNA, 22 nt, Homo sapiens
auggaacauuauagauguaaaa

SEQ ID NO: 219430 - RNA, 22 nt, Homo sapiens
auggaagaaacgauuuucugga

SEQ ID NO: 219431 - RNA, 22 nt, Homo sapiens
auggaagacuccucuuugggua

SEQ ID NO: 219432 - RNA, 22 nt, Homo sapiens
auggaaugccauuuauaaugga

SEQ ID NO: 219433 - RNA, 22 nt, Homo sapiens
auggacagaaaaaaauagaugu

SEQ ID NO: 219434 - RNA, 22 nt, Homo sapiens
auggacagacacuggccuucug

SEQ ID NO: 219435 - RNA, 22 nt, Homo sapiens
auggacuuuuuguucagugucu

SEQ ID NO: 219436 - RNA, 22 nt, Homo sapiens
auggagaugaacuuggguaaag

SEQ ID NO: 219437 - RNA, 22 nt, Homo sapiens
auggagaugugcgaacugagua

SEQ ID NO: 219438 - RNA, 22 nt, Homo sapiens
auggagcaaaacagauuuggga

SEQ ID NO: 219439 - RNA, 22 nt, Homo sapiens
auggagugagaauggagguucc

SEQ ID NO: 219440 - RNA, 22 nt, Homo sapiens
auggaguguaauauugagagcu

SEQ ID NO: 219441 - RNA, 22 nt, Homo sapiens
auggaguguggaacugggaauc

SEQ ID NO: 219442 - RNA, 22 nt, Homo sapiens
auggauagucucacucacauac

SEQ ID NO: 219443 - RNA, 22 nt, Homo sapiens
auggauuuuaggauacaguuga

SEQ ID NO: 219444 - RNA, 22 nt, Homo sapiens
auggcaaaauguuccuaguggu

SEQ ID NO: 219445 - RNA, 22 nt, Homo sapiens
auggcaauaugaugcacuguuu

SEQ ID NO: 219446 - RNA, 22 nt, Homo sapiens
auggcacagaguagaugcucaa

SEQ ID NO: 219447 - RNA, 22 nt, Homo sapiens
auggcaccauguuaugauaaua

SEQ ID NO: 219448 - RNA, 22 nt, Homo sapiens
auggcacuaaguucaacacuua

SEQ ID NO: 219449 - RNA, 22 nt, Homo sapiens
auggcacuaaugggaguuuacu

SEQ ID NO: 219450 - RNA, 22 nt, Homo sapiens
auggcacuacugggaaugucuu

SEQ ID NO: 219451 - RNA, 22 nt, Homo sapiens
auggcagcugguuuuacccuag

SEQ ID NO: 219452 - RNA, 22 nt, Homo sapiens
auggcaguuuauucuaaaucaa

SEQ ID NO: 219453 - RNA, 22 nt, Homo sapiens
auggcaguuucacucugggauu

SEQ ID NO: 219454 - RNA, 22 nt, Homo sapiens
auggcaguuucagcuauaguuu

SEQ ID NO: 219455 - RNA, 20 nt, Homo sapiens
auggcccugcugggaguguc

SEQ ID NO: 219456 - RNA, 22 nt, Homo sapiens
auggccugaugcaccuguccca

SEQ ID NO: 219457 - RNA, 22 nt, Homo sapiens
auggccuuguauaccuggcaaa

SEQ ID NO: 219458 - RNA, 22 nt, Homo sapiens
auggcggugugggcggugcagc

SEQ ID NO: 219459 - RNA, 22 nt, Homo sapiens
auggcuagaaccuguauauuca

SEQ ID NO: 219460 - RNA, 22 nt, Homo sapiens
auggcuauuccauaggcagagc

SEQ ID NO: 219461 - RNA, 22 nt, Homo sapiens
auggcucaauucuuucccugaa

SEQ ID NO: 219462 - RNA, 22 nt, Homo sapiens
auggcucuguuccaugugucuu

SEQ ID NO: 219463 - RNA, 22 nt, Homo sapiens
auggcucuuauuauuugaggua

SEQ ID NO: 219464 - RNA, 22 nt, Homo sapiens
auggcuuuguguucagagcuga

SEQ ID NO: 219465 - RNA, 22 nt, Homo sapiens
auggcuuuucacagaggguucu

SEQ ID NO: 219466 - RNA, 22 nt, Homo sapiens
auggcuuuuuaaaucauguugu

SEQ ID NO: 219467 - RNA, 22 nt, Homo sapiens
augggaaaaucagaaggccugg

SEQ ID NO: 219468 - RNA, 22 nt, Homo sapiens
augggcaaauguuggaaauucc

SEQ ID NO: 219469 - RNA, 22 nt, Homo sapiens
augggugaguaugaguugacuu

SEQ ID NO: 219470 - RNA, 22 nt, Homo sapiens
auggucuuuguuucuaauucug

SEQ ID NO: 219471 - RNA, 22 nt, Homo sapiens
auggucuuuucccuggauuaua

SEQ ID NO: 219472 - RNA, 22 nt, Homo sapiens
augguguccuguuuccccagga

SEQ ID NO: 219473 - RNA, 22 nt, Homo sapiens
augguuagauguauccuuucca

SEQ ID NO: 219474 - RNA, 22 nt, Homo sapiens
auguaaacauuuggucuaaauu

SEQ ID NO: 219475 - RNA, 22 nt, Homo sapiens
auguaacacagugcggcugggc

SEQ ID NO: 219476 - RNA, 21 nt, Homo sapiens
auguaaugaagaagccacugg

SEQ ID NO: 219477 - RNA, 22 nt, Homo sapiens
auguaauguuaaauugcuaauu

SEQ ID NO: 219478 - RNA, 22 nt, Homo sapiens
auguaguugcucugccuguuuu

SEQ ID NO: 219479 - RNA, 17 nt, Homo sapiens
auguauacauccaugua

SEQ ID NO: 219480 - RNA, 22 nt, Homo sapiens
augucacagguccuagccaagu

SEQ ID NO: 219481 - RNA, 22 nt, Homo sapiens
augucugguagccaccuggagg

SEQ ID NO: 219482 - RNA, 22 nt, Homo sapiens
augucuuucauagagacccaga

SEQ ID NO: 219483 - RNA, 22 nt, Homo sapiens
augugaaugugaucggauaguc

SEQ ID NO: 219484 - RNA, 22 nt, Homo sapiens
augugacugauggagaauaugu

SEQ ID NO: 219485 - RNA, 22 nt, Homo sapiens
augugacuuuuuccugugccuu

SEQ ID NO: 219486 - RNA, 22 nt, Homo sapiens
augugcaaagcacuguucagca

SEQ ID NO: 219487 - RNA, 22 nt, Homo sapiens
augugcaacugcuggaacaguc

SEQ ID NO: 219488 - RNA, 22 nt, Homo sapiens
auaaugacuuccaguuccacuc

SEQ ID NO: 219489 - RNA, 22 nt, Homo sapiens
auacaaguuauuugaacugcgg

SEQ ID NO: 219490 - RNA, 22 nt, Homo sapiens
auacacgugcagaacaugcagg

SEQ ID NO: 219491 - RNA, 19 nt, Homo sapiens
auacacguguauacauaca

SEQ ID NO: 219492 - RNA, 22 nt, Homo sapiens
auacagacacagucagaggggu

SEQ ID NO: 219493 - RNA, 22 nt, Homo sapiens
auacaguaaugucuuaggcugu

SEQ ID NO: 219494 - RNA, 22 nt, Homo sapiens
auacagucuguuagauuuccuc

SEQ ID NO: 219495 - RNA, 22 nt, Homo sapiens
auacaguguucugggaagaagu

SEQ ID NO: 219496 - RNA, 22 nt, Homo sapiens
auacaugugcaggucagguuac

SEQ ID NO: 219497 - RNA, 22 nt, Homo sapiens
auacaugugugagcgaagaugu

SEQ ID NO: 219498 - RNA, 22 nt, Homo sapiens
auacauguuucauguuggugug

SEQ ID NO: 219499 - RNA, 22 nt, Homo sapiens
auacccaguaguggaauugcua

SEQ ID NO: 219500 - RNA, 22 nt, Homo sapiens
auacuguuucugaacuuugauu

SEQ ID NO: 219501 - RNA, 21 nt, Homo sapiens
auacuugcauccuuggagaga

SEQ ID NO: 219502 - RNA, 22 nt, Homo sapiens
auagaauguuugcgccagguga

SEQ ID NO: 219503 - RNA, 23 nt, Homo sapiens
auagagcuaggaugcagacagau

SEQ ID NO: 219504 - RNA, 22 nt, Homo sapiens
auagaucauugucauuuuagau

SEQ ID NO: 219505 - RNA, 22 nt, Homo sapiens
auagcaaugccccaauccuugg

SEQ ID NO: 219506 - RNA, 22 nt, Homo sapiens
auagcaaugccccauucccagu

SEQ ID NO: 219507 - RNA, 21 nt, Homo sapiens
auagcacaucagauuuuauua

SEQ ID NO: 219508 - RNA, 22 nt, Homo sapiens
auagcacuuauagauuuggucu

SEQ ID NO: 219509 - RNA, 22 nt, Homo sapiens
auagcagcaccucacucuacug

SEQ ID NO: 219510 - RNA, 20 nt, Homo sapiens
auagcagcaugauuuauaau

SEQ ID NO: 219511 - RNA, 20 nt, Homo sapiens
auagcagcaugauuuauagu

SEQ ID NO: 219512 - RNA, 22 nt, Homo sapiens
auagcagugugaaaacagacua

SEQ ID NO: 219513 - RNA, 22 nt, Homo sapiens
auagcagugugaaaauguacua

SEQ ID NO: 219514 - RNA, 22 nt, Homo sapiens
auagcagugugaaaauugacug

SEQ ID NO: 219515 - RNA, 22 nt, Homo sapiens
auagcauagucagcuucgcuga

SEQ ID NO: 219516 - RNA, 22 nt, Homo sapiens
auagcauaucccacaugucaga

SEQ ID NO: 219517 - RNA, 22 nt, Homo sapiens
auagcaucauuucuugaaaaga

SEQ ID NO: 219518 - RNA, 22 nt, Homo sapiens
auagcccuuuucuaacuaugug

SEQ ID NO: 219519 - RNA, 22 nt, Homo sapiens
auagcugcucaggcuuuccuca

SEQ ID NO: 219520 - RNA, 22 nt, Homo sapiens
auaggagugugcacagaguagg

SEQ ID NO: 219521 - RNA, 22 nt, Homo sapiens
auaggcaagaugagguuuuuau

SEQ ID NO: 219522 - RNA, 22 nt, Homo sapiens
auaguacuauugcaguguuaua

SEQ ID NO: 219523 - RNA, 22 nt, Homo sapiens
auaguauaguugaggauggcau

SEQ ID NO: 219524 - RNA, 22 nt, Homo sapiens
auagucaguagucucauaauga

SEQ ID NO: 219525 - RNA, 21 nt, Homo sapiens
auagugcuagagaguagcagg

SEQ ID NO: 219526 - RNA, 22 nt, Homo sapiens
auagugcugcaacaaauauacg

SEQ ID NO: 219527 - RNA, 22 nt, Homo sapiens
auagugcugcaagaaacauacg

SEQ ID NO: 219528 - RNA, 22 nt, Homo sapiens
auagugcugcaauaaacauacg

SEQ ID NO: 219529 - RNA, 22 nt, Homo sapiens
auagugcugcaaugaacauaca

SEQ ID NO: 219530 - RNA, 22 nt, Homo sapiens
auagugcuguauuaaacauacg

SEQ ID NO: 219531 - RNA, 22 nt, Homo sapiens
auaguggcaugaucauagcuca

SEQ ID NO: 219532 - RNA, 22 nt, Homo sapiens
auauagcaaugaaagagaugaa

SEQ ID NO: 219533 - RNA, 22 nt, Homo sapiens
auauagcucuggcuggaugacu

SEQ ID NO: 219534 - RNA, 22 nt, Homo sapiens
auauaguguuuuuugguacgcu

SEQ ID NO: 219535 - RNA, 22 nt, Homo sapiens
auauaugcacacgugugcauau

SEQ ID NO: 219536 - RNA, 22 nt, Homo sapiens
auaucaagugacuggaguucca

SEQ ID NO: 219537 - RNA, 22 nt, Homo sapiens
auaucacaaacaagucuguacu

SEQ ID NO: 219538 - RNA, 22 nt, Homo sapiens
auaucccaguguguaaacacug

SEQ ID NO: 219539 - RNA, 22 nt, Homo sapiens
auaucugcauugccauuuaugu

SEQ ID NO: 219540 - RNA, 22 nt, Homo sapiens
auaugcaaauccauagagacag

SEQ ID NO: 219541 - RNA, 22 nt, Homo sapiens
auaugcacuauacacacguaua

SEQ ID NO: 219542 - RNA, 20 nt, Homo sapiens
auaugcagacacauacauac

SEQ ID NO: 219543 - RNA, 22 nt, Homo sapiens
auaugcauguacccacacaggc

SEQ ID NO: 219544 - RNA, 22 nt, Homo sapiens
auauggcauucagaacuguaua

SEQ ID NO: 219545 - RNA, 20 nt, Homo sapiens
auaugguugugagugauuuu

SEQ ID NO: 219546 - RNA, 17 nt, Homo sapiens
auaugucugcuggggga

SEQ ID NO: 219547 - RNA, 22 nt, Homo sapiens
auauuacagagaggaccuggga

SEQ ID NO: 219548 - RNA, 22 nt, Homo sapiens
auauuacuggcuauaucgcaag

SEQ ID NO: 219549 - RNA, 21 nt, Homo sapiens
auauuacuguuagaggacugc

SEQ ID NO: 219550 - RNA, 22 nt, Homo sapiens
auauugguuaaauauuauguga

SEQ ID NO: 219551 - RNA, 22 nt, Homo sapiens
aucaaagccaugcucaguuuuc

SEQ ID NO: 219552 - RNA, 22 nt, Homo sapiens
aucaaaguaucucaauauggua

SEQ ID NO: 219553 - RNA, 22 nt, Homo sapiens
aucaaagugaauuaaugagaau

SEQ ID NO: 219554 - RNA, 22 nt, Homo sapiens
aucaaaguuucccagaaguugu

SEQ ID NO: 219555 - RNA, 22 nt, Homo sapiens
aucaagcugcuuguuugaaucu

SEQ ID NO: 219556 - RNA, 22 nt, Homo sapiens
aucaagcuugacuccuuaaagg

SEQ ID NO: 219557 - RNA, 22 nt, Homo sapiens
aucaaguacuguacugaaagug

SEQ ID NO: 219558 - RNA, 22 nt, Homo sapiens
aucacaggucaaaucauuauuu

SEQ ID NO: 219559 - RNA, 22 nt, Homo sapiens
aucacaguuaagaggugaugaa

SEQ ID NO: 219560 - RNA, 22 nt, Homo sapiens
aucacaguuauaacauccuuuu

SEQ ID NO: 219561 - RNA, 22 nt, Homo sapiens
aucacaguuuuaccauuuggua

SEQ ID NO: 219562 - RNA, 22 nt, Homo sapiens
aucacauggccagguaguaauc

SEQ ID NO: 219563 - RNA, 20 nt, Homo sapiens
aucaccacagcucguucaug

SEQ ID NO: 219564 - RNA, 19 nt, Homo sapiens
aucaccauuauuuggaaca

SEQ ID NO: 219565 - RNA, 22 nt, Homo sapiens
aucaccuggaggugaucacuug

SEQ ID NO: 219566 - RNA, 22 nt, Homo sapiens
aucaccuggaguagcccguccc

SEQ ID NO: 219567 - RNA, 22 nt, Homo sapiens
aucacuaugcaggugucucggg

SEQ ID NO: 219568 - RNA, 22 nt, Homo sapiens
aucacuguccacucaucuuucu

SEQ ID NO: 219569 - RNA, 22 nt, Homo sapiens
aucagauggcuaaaacagaaga

SEQ ID NO: 219570 - RNA, 22 nt, Homo sapiens
aucagauguuuguauaggagua

SEQ ID NO: 219571 - RNA, 22 nt, Homo sapiens
aucagauuccacauuuuaucag

SEQ ID NO: 219572 - RNA, 19 nt, Homo sapiens
aucagcacaagugugcuuu

SEQ ID NO: 219573 - RNA, 22 nt, Homo sapiens
aucagcagcaugaaaagcaacu

SEQ ID NO: 219574 - RNA, 22 nt, Homo sapiens
aucagcaugcagaagucggggg

SEQ ID NO: 219575 - RNA, 22 nt, Homo sapiens
aucagugcagugggaacuagaa

SEQ ID NO: 219576 - RNA, 22 nt, Homo sapiens
aucagugcauaguauuuaauga

SEQ ID NO: 219577 - RNA, 22 nt, Homo sapiens
aucauccagccccagaagggag

SEQ ID NO: 219578 - RNA, 22 nt, Homo sapiens
aucauggaguauuugcaagucu

SEQ ID NO: 219579 - RNA, 18 nt, Homo sapiens
aucauugcacugucuugc

SEQ ID NO: 219580 - RNA, 22 nt, Homo sapiens
aucauugugugaguugauggga

SEQ ID NO: 219581 - RNA, 22 nt, Homo sapiens
auccacaugcaguuggaaacag

SEQ ID NO: 219582 - RNA, 22 nt, Homo sapiens
auccaguguuuucuuuugucac

SEQ ID NO: 219583 - RNA, 22 nt, Homo sapiens
auccaguuuuaggagauuucua

SEQ ID NO: 219584 - RNA, 22 nt, Homo sapiens
auccaucagacggcaggcguug

SEQ ID NO: 219585 - RNA, 22 nt, Homo sapiens
aucccugugacgagcaucccua

SEQ ID NO: 219586 - RNA, 22 nt, Homo sapiens
auccucugagagaguuucauaa

SEQ ID NO: 219587 - RNA, 22 nt, Homo sapiens
auccugagacuuuucugaaguu

SEQ ID NO: 219588 - RNA, 21 nt, Homo sapiens
auccuucuuuuucaaccugug

SEQ ID NO: 219589 - RNA, 21 nt, Homo sapiens
aucucacuugaauguaaaagc

SEQ ID NO: 219590 - RNA, 22 nt, Homo sapiens
uugcuagucucuguuucaggau

SEQ ID NO: 219591 - RNA, 22 nt, Homo sapiens
uugcucaggcuagaguucagcu

SEQ ID NO: 219592 - RNA, 22 nt, Homo sapiens
uugcuccucugccaggaccugu

SEQ ID NO: 219593 - RNA, 22 nt, Homo sapiens
uugcuuuguuacugcaguuucc

SEQ ID NO: 219594 - RNA, 22 nt, Homo sapiens
uugcuuuguugucuggggaaua

SEQ ID NO: 219595 - RNA, 22 nt, Homo sapiens
uuggaaacaccuggugagguua

SEQ ID NO: 219596 - RNA, 22 nt, Homo sapiens
uuggaaaguuguuguaguuauu

SEQ ID NO: 219597 - RNA, 22 nt, Homo sapiens
uuggaaauauguuaagugucau

SEQ ID NO: 219598 - RNA, 22 nt, Homo sapiens
uuggaaauguguuugcauucag

SEQ ID NO: 219599 - RNA, 22 nt, Homo sapiens
uuggaagagaagggagauaaac

SEQ ID NO: 219600 - RNA, 22 nt, Homo sapiens
uuggaagauuacuuaguuuucu

SEQ ID NO: 219601 - RNA, 22 nt, Homo sapiens
uuggaaguguguauguauagcu

SEQ ID NO: 219602 - RNA, 22 nt, Homo sapiens
uuggaauauaaccuguuucuaa

SEQ ID NO: 219603 - RNA, 22 nt, Homo sapiens
uuggaaugcacacugagccugc

SEQ ID NO: 219604 - RNA, 22 nt, Homo sapiens
uuggaauuuauuuggaugggag

SEQ ID NO: 219605 - RNA, 18 nt, Homo sapiens
uuggacggagagucaaau

SEQ ID NO: 219606 - RNA, 22 nt, Homo sapiens
uuggacugagaguuccaccauu

SEQ ID NO: 219607 - RNA, 22 nt, Homo sapiens
uuggacuuuaagauagagaugu

SEQ ID NO: 219608 - RNA, 22 nt, Homo sapiens
uuggagagucacuaguuagugc

SEQ ID NO: 219609 - RNA, 22 nt, Homo sapiens
uuggagcacuggggcacugaca

SEQ ID NO: 219610 - RNA, 22 nt, Homo sapiens
uuggcaauauuuacugaaguug

SEQ ID NO: 219611 - RNA, 22 nt, Homo sapiens
uuggcaauucagauucuuuuau

SEQ ID NO: 219612 - RNA, 22 nt, Homo sapiens
uuggcacugagcaagaacaggg

SEQ ID NO: 219613 - RNA, 22 nt, Homo sapiens
uuggcacugggaaaaugaccac

SEQ ID NO: 219614 - RNA, 22 nt, Homo sapiens
uuggcagcauuccagccaagca

SEQ ID NO: 219615 - RNA, 22 nt, Homo sapiens
uuggcaguaucuacuacagcua

SEQ ID NO: 219616 - RNA, 22 nt, Homo sapiens
uuggcauuguggauggaaucau

SEQ ID NO: 219617 - RNA, 22 nt, Homo sapiens
uuggccagugucuuuuuuuccu

SEQ ID NO: 219618 - RNA, 22 nt, Homo sapiens
uuggccccuccaaaucucaugu

SEQ ID NO: 219619 - RNA, 22 nt, Homo sapiens
uuggccccucccaaauuucaug

SEQ ID NO: 219620 - RNA, 19 nt, Homo sapiens
uuggcccugguucucuucu

SEQ ID NO: 219621 - RNA, 23 nt, Homo sapiens
uuggccuccuugugucuagggcu

SEQ ID NO: 219622 - RNA, 21 nt, Homo sapiens
uuggccuggaggccugaaugu

SEQ ID NO: 219623 - RNA, 22 nt, Homo sapiens
uuggccuuucucuaaauacuuu

SEQ ID NO: 219624 - RNA, 22 nt, Homo sapiens
uuggcgacugcugcuaaucagg

SEQ ID NO: 219625 - RNA, 22 nt, Homo sapiens
uugacguaggaggauguugaga

SEQ ID NO: 219626 - RNA, 21 nt, Homo sapiens
uugagaagaauuagcucuucc

SEQ ID NO: 219627 - RNA, 22 nt, Homo sapiens
uugagaagugucuguucauguc

SEQ ID NO: 219628 - RNA, 21 nt, Homo sapiens
uugagacggagucucacucug

SEQ ID NO: 219629 - RNA, 22 nt, Homo sapiens
uugagagagaacauuuguuaca

SEQ ID NO: 219630 - RNA, 22 nt, Homo sapiens
uugagagcugaugaaagauaaa

SEQ ID NO: 219631 - RNA, 22 nt, Homo sapiens
uugagauacauaauuaugaaug

SEQ ID NO: 219632 - RNA, 22 nt, Homo sapiens
uugagauaggaacucacuaugc

SEQ ID NO: 219633 - RNA, 22 nt, Homo sapiens
uugagaucaugcuacugcacuc

SEQ ID NO: 219634 - RNA, 22 nt, Homo sapiens
uugagaucuacuacuguaggag

SEQ ID NO: 219635 - RNA, 20 nt, Homo sapiens
uugagaucuguaucugguuu

SEQ ID NO: 219636 - RNA, 22 nt, Homo sapiens
uugagauggagucucacgcauu

SEQ ID NO: 219637 - RNA, 22 nt, Homo sapiens
uugagauggagucucacucugu

SEQ ID NO: 219638 - RNA, 22 nt, Homo sapiens
uugagauggagucucgcacugu

SEQ ID NO: 219639 - RNA, 22 nt, Homo sapiens
uugagauggagucucgcucugu

SEQ ID NO: 219640 - RNA, 22 nt, Homo sapiens
uugagauggagucucguucugu

SEQ ID NO: 219641 - RNA, 22 nt, Homo sapiens
uugagauggagucuugcacugu

SEQ ID NO: 219642 - RNA, 22 nt, Homo sapiens
uugagauggagucuugcgcugu

SEQ ID NO: 219643 - RNA, 22 nt, Homo sapiens
uugagauggaguuucacucugu

SEQ ID NO: 219644 - RNA, 22 nt, Homo sapiens
uugagauggauagacauagcau

SEQ ID NO: 219645 - RNA, 22 nt, Homo sapiens
uugagauggugccacuguacuc

SEQ ID NO: 219646 - RNA, 22 nt, Homo sapiens
uugagauguaguuucacuccug

SEQ ID NO: 219647 - RNA, 22 nt, Homo sapiens
uugagauguggcaguuuaugag

SEQ ID NO: 219648 - RNA, 22 nt, Homo sapiens
uugagauguggguuggugacuu

SEQ ID NO: 219649 - RNA, 22 nt, Homo sapiens
uugagcuauauacuucagacuu

SEQ ID NO: 219650 - RNA, 22 nt, Homo sapiens
uugaggacugagacagaccaag

SEQ ID NO: 219651 - RNA, 22 nt, Homo sapiens
uugaggaggcagucugcccauu

SEQ ID NO: 219652 - RNA, 22 nt, Homo sapiens
uugaggcuuuugaccucaugug

SEQ ID NO: 219653 - RNA, 22 nt, Homo sapiens
uugagggagcacagauucuuau

SEQ ID NO: 219654 - RNA, 22 nt, Homo sapiens
uugagguauuuugucaacugua

SEQ ID NO: 219655 - RNA, 20 nt, Homo sapiens
uugaggucaggaguuuggga

SEQ ID NO: 219656 - RNA, 22 nt, Homo sapiens
uugaggugaagggcagagcagc

SEQ ID NO: 219657 - RNA, 22 nt, Homo sapiens
uugagugaaggcuguguucuug

SEQ ID NO: 219658 - RNA, 22 nt, Homo sapiens
uugauaagaaaaauauaccaga

SEQ ID NO: 219659 - RNA, 22 nt, Homo sapiens
uugauacuagagucuuucugac

SEQ ID NO: 219660 - RNA, 22 nt, Homo sapiens
uugauagaucagggauuugauu

SEQ ID NO: 219661 - RNA, 22 nt, Homo sapiens
uugauagguuuuauguauaguu

SEQ ID NO: 219662 - RNA, 22 nt, Homo sapiens
uugauaugacuaucuuuuaugu

SEQ ID NO: 219663 - RNA, 22 nt, Homo sapiens
uugauaugguauaagauuucau

SEQ ID NO: 219664 - RNA, 22 nt, Homo sapiens
uugaucaaaucugagugagaau

SEQ ID NO: 219665 - RNA, 22 nt, Homo sapiens
uugaucacuguacuaugacuau

SEQ ID NO: 219666 - RNA, 22 nt, Homo sapiens
uugaucuaugugucuguuuuua

SEQ ID NO: 219667 - RNA, 22 nt, Homo sapiens
uugauguaggcauucaaggcua

SEQ ID NO: 219668 - RNA, 22 nt, Homo sapiens
uugauuagauccaguugauuga

SEQ ID NO: 219669 - RNA, 22 nt, Homo sapiens
uugcaaaucucuuguguuuggu

SEQ ID NO: 219670 - RNA, 22 nt, Homo sapiens
uugcaaggugcagcuuaugcaa

SEQ ID NO: 219671 - RNA, 22 nt, Homo sapiens
uugcaagugccguaacuaccaa

SEQ ID NO: 219672 - RNA, 22 nt, Homo sapiens
uugcacaauccugugagugagu

SEQ ID NO: 219673 - RNA, 20 nt, Homo sapiens
uugcacagagaaggaggcag

SEQ ID NO: 219674 - RNA, 22 nt, Homo sapiens
uugcacagugcuuucuuugccc

SEQ ID NO: 219675 - RNA, 22 nt, Homo sapiens
uugcacaguguguacagcacca

SEQ ID NO: 219676 - RNA, 22 nt, Homo sapiens
uugcaccccuacuauuugccaa

SEQ ID NO: 219677 - RNA, 22 nt, Homo sapiens
uugcaccuugaagccaauagca

SEQ ID NO: 219678 - RNA, 22 nt, Homo sapiens
uugcacuauuaguauagauguc

SEQ ID NO: 219679 - RNA, 22 nt, Homo sapiens
uugcacuccagccuggaugaca

SEQ ID NO: 219680 - RNA, 22 nt, Homo sapiens
uugcacuccagccugggugaca

SEQ ID NO: 219681 - RNA, 18 nt, Homo sapiens
uugcacuccugccugggu

SEQ ID NO: 219682 - RNA, 22 nt, Homo sapiens
uugcacugagauuuugcuuaca

SEQ ID NO: 219683 - RNA, 22 nt, Homo sapiens
uugcacuuccgccugggugaca

SEQ ID NO: 219684 - RNA, 22 nt, Homo sapiens
uugcaguaguaacuccuuaccu

SEQ ID NO: 219685 - RNA, 22 nt, Homo sapiens
uugcauagacaauauuaaucuu

SEQ ID NO: 219686 - RNA, 23 nt, Homo sapiens
uugcauagacauccucauagauu

SEQ ID NO: 219687 - RNA, 19 nt, Homo sapiens
uugcauagguugaaccagc

SEQ ID NO: 219688 - RNA, 22 nt, Homo sapiens
uugcaucagcuccugauguacu

SEQ ID NO: 219689 - RNA, 22 nt, Homo sapiens
uugcauguacguacagagagag

SEQ ID NO: 219690 - RNA, 22 nt, Homo sapiens
uugcauuuucuaggagggcaaa

SEQ ID NO: 219691 - RNA, 22 nt, Homo sapiens
uugcccuuuagguaacuauaua

SEQ ID NO: 219692 - RNA, 22 nt, Homo sapiens
uugccuaggcuggauugcagug

SEQ ID NO: 219693 - RNA, 22 nt, Homo sapiens
uugccuaguuuaggucugugcu

SEQ ID NO: 219694 - RNA, 22 nt, Homo sapiens
uugcgcuuuuccuauguugccc

SEQ ID NO: 219695 - RNA, 22 nt, Homo sapiens
uugcuagaugaaaaugguaccu

SEQ ID NO: 219696 - RNA, 22 nt, Homo sapiens
ugguaauguaauuuggagaagg

SEQ ID NO: 219697 - RNA, 22 nt, Homo sapiens
ugguauguguucuaaaauuaug

SEQ ID NO: 219698 - RNA, 22 nt, Homo sapiens
uggucauggggcagcugacacu

SEQ ID NO: 219699 - RNA, 21 nt, Homo sapiens
uggucccuucagaucggauuu

SEQ ID NO: 219700 - RNA, 22 nt, Homo sapiens
uggucuggagagucccgcccag

SEQ ID NO: 219701 - RNA, 22 nt, Homo sapiens
uggugagaaacuagauauuuuu

SEQ ID NO: 219702 - RNA, 22 nt, Homo sapiens
uggugcccuguccuucuguggc

SEQ ID NO: 219703 - RNA, 22 nt, Homo sapiens
uggugccgugguccuggggcca

SEQ ID NO: 219704 - RNA, 20 nt, Homo sapiens
uggugucuuggaaagagcuc

SEQ ID NO: 219705 - RNA, 22 nt, Homo sapiens
ugguuagucuguguguauauau

SEQ ID NO: 219706 - RNA, 22 nt, Homo sapiens
ugguucaguugcacaggcuguu

SEQ ID NO: 219707 - RNA, 23 nt, Homo sapiens
ugguuuguaagagauggacugga

SEQ ID NO: 219708 - RNA, 23 nt, Homo sapiens
uguaaaagcauuugucagccugg

SEQ ID NO: 219709 - RNA, 22 nt, Homo sapiens
uguaaaccauauauguauguag

SEQ ID NO: 219710 - RNA, 18 nt, Homo sapiens
uguaaacuaccucaaccu

SEQ ID NO: 219711 - RNA, 22 nt, Homo sapiens
uguaaacucaguauguuuuacu

SEQ ID NO: 219712 - RNA, 23 nt, Homo sapiens
uguaaagcuaugaauuauucuuu

SEQ ID NO: 219713 - RNA, 22 nt, Homo sapiens
uguaaaucuuucacaguugaug

SEQ ID NO: 219714 - RNA, 22 nt, Homo sapiens
uguaacacacacuguuuacucc

SEQ ID NO: 219715 - RNA, 22 nt, Homo sapiens
uguaacugcuuagaagguuuua

SEQ ID NO: 219716 - RNA, 20 nt, Homo sapiens
uguaaucuaaguuuuaagcc

SEQ ID NO: 219717 - RNA, 22 nt, Homo sapiens
uguaauguuucaucauuauuaa

SEQ ID NO: 219718 - RNA, 22 nt, Homo sapiens
uguacuagaaauuaaggcaggg

SEQ ID NO: 219719 - RNA, 22 nt, Homo sapiens
uguacuucaagauuaugguuua

SEQ ID NO: 219720 - RNA, 22 nt, Homo sapiens
uguagcaaauaaaagucuggau

SEQ ID NO: 219721 - RNA, 22 nt, Homo sapiens
uguagcaaaucgauacuauugg

SEQ ID NO: 219722 - RNA, 21 nt, Homo sapiens
uguagcagcauaauuuauaau

SEQ ID NO: 219723 - RNA, 22 nt, Homo sapiens
uguagcagccauaaacacagug

SEQ ID NO: 219724 - RNA, 22 nt, Homo sapiens
uguauauguuuguacauauguc

SEQ ID NO: 219725 - RNA, 22 nt, Homo sapiens
uguaugcuuuugagagauauuu

SEQ ID NO: 219726 - RNA, 22 nt, Homo sapiens
uguauguaaagacaggauaaca

SEQ ID NO: 219727 - RNA, 22 nt, Homo sapiens
uguauguaauugaaguuaaguu

SEQ ID NO: 219728 - RNA, 22 nt, Homo sapiens
uguaugucuucuuuagauaagu

SEQ ID NO: 219729 - RNA, 19 nt, Homo sapiens
ugucaaaugucuccugggg

SEQ ID NO: 219730 - RNA, 22 nt, Homo sapiens
ugucaaauucuggguuaaaaca

SEQ ID NO: 219731 - RNA, 22 nt, Homo sapiens
ugucaacauuuaucaaguuauu

SEQ ID NO: 219732 - RNA, 22 nt, Homo sapiens
ugucaaugggaauuuguuuuag

SEQ ID NO: 219733 - RNA, 22 nt, Homo sapiens
ugucaccauuuguaggugagga

SEQ ID NO: 219734 - RNA, 18 nt, Homo sapiens
ugucacuggauaaugguc

SEQ ID NO: 219735 - RNA, 22 nt, Homo sapiens
ugucacugugaguuugacugcu

SEQ ID NO: 219736 - RNA, 22 nt, Homo sapiens
ugucacuuugccuucuggacuu

SEQ ID NO: 219737 - RNA, 22 nt, Homo sapiens
ugucaggagcaaugauaaauuu

SEQ ID NO: 219738 - RNA, 22 nt, Homo sapiens
ugucaguggacugugaaaggca

SEQ ID NO: 219739 - RNA, 22 nt, Homo sapiens
ugucaguggucuggaugcagcc

SEQ ID NO: 219740 - RNA, 22 nt, Homo sapiens
ugucauacaguaacaugguugg

SEQ ID NO: 219741 - RNA, 23 nt, Homo sapiens
ugucaucaagaugaggucacacu

SEQ ID NO: 219742 - RNA, 19 nt, Homo sapiens
ugucaucaucuuuucuugc

SEQ ID NO: 219743 - RNA, 22 nt, Homo sapiens
ugucaucuagguuuuaagccuu

SEQ ID NO: 219744 - RNA, 21 nt, Homo sapiens
ugucaugcagagacccuggag

SEQ ID NO: 219745 - RNA, 22 nt, Homo sapiens
ugucauguaaagaguaaauggu

SEQ ID NO: 219746 - RNA, 22 nt, Homo sapiens
ugucauguagaaauuguccauu

SEQ ID NO: 219747 - RNA, 22 nt, Homo sapiens
ugucaugugagggaacuuguuc

SEQ ID NO: 219748 - RNA, 22 nt, Homo sapiens
ugucauguugguguacugcacc

SEQ ID NO: 219749 - RNA, 20 nt, Homo sapiens
ugucauuaagcacugugcca

SEQ ID NO: 219750 - RNA, 22 nt, Homo sapiens
ugucauuguggugcagauauaa

SEQ ID NO: 219751 - RNA, 22 nt, Homo sapiens
uguccaaaucagagguaccaaa

SEQ ID NO: 219752 - RNA, 22 nt, Homo sapiens
ugucccguuuucgaggcugcag

SEQ ID NO: 219753 - RNA, 18 nt, Homo sapiens
ugucccuuugcuguucau

SEQ ID NO: 219754 - RNA, 19 nt, Homo sapiens
uguccuagaggaguucaca

SEQ ID NO: 219755 - RNA, 22 nt, Homo sapiens
uguccuagagggaugucacccc

SEQ ID NO: 219756 - RNA, 22 nt, Homo sapiens
ugucucagugauuggcuuucug

SEQ ID NO: 219757 - RNA, 22 nt, Homo sapiens
ugucucaguuucuguggguuag

SEQ ID NO: 219758 - RNA, 22 nt, Homo sapiens
ugucuggaguccauagaagugu

SEQ ID NO: 219759 - RNA, 22 nt, Homo sapiens
ugucuguuugcgaaauugcuuc

SEQ ID NO: 219760 - RNA, 22 nt, Homo sapiens
ugucuuagagauaaagaaugaa

SEQ ID NO: 219761 - RNA, 22 nt, Homo sapiens
ugucuuggacuugaaucucauu

SEQ ID NO: 219762 - RNA, 22 nt, Homo sapiens
ugucuuguagacaauguauagu

SEQ ID NO: 219763 - RNA, 22 nt, Homo sapiens
ugugaacaaaauuuguugcaua

SEQ ID NO: 219764 - RNA, 22 nt, Homo sapiens
ugugaacagaauuagucaccua

SEQ ID NO: 219765 - RNA, 19 nt, Homo sapiens
ugugaacaucacagagugu

SEQ ID NO: 219766 - RNA, 21 nt, Homo sapiens
ugugaacauguuggguggcau

SEQ ID NO: 219767 - RNA, 22 nt, Homo sapiens
ugugaauggugcuuccuagaug

SEQ ID NO: 219768 - RNA, 21 nt, Homo sapiens
ugugaccucugucucugaguc

SEQ ID NO: 219769 - RNA, 19 nt, Homo sapiens
ugugacugguugucucgcu

SEQ ID NO: 219770 - RNA, 22 nt, Homo sapiens
ugugagacugacagggcagggu

SEQ ID NO: 219771 - RNA, 22 nt, Homo sapiens
ugugagacugguucugaaccca

SEQ ID NO: 219772 - RNA, 20 nt, Homo sapiens
ugugagacugguuuugaacu

SEQ ID NO: 219773 - RNA, 22 nt, Homo sapiens
ugugaucaaccugcagggcugg

SEQ ID NO: 219774 - RNA, 22 nt, Homo sapiens
ugugaucaugguauuaaucugc

SEQ ID NO: 219775 - RNA, 22 nt, Homo sapiens
ugugauggaguuucauggacug

SEQ ID NO: 219776 - RNA, 22 nt, Homo sapiens
ugugauuggccuggcguggguc

SEQ ID NO: 219777 - RNA, 22 nt, Homo sapiens
ugugcaaaaguaauugcgguuu

SEQ ID NO: 219778 - RNA, 22 nt, Homo sapiens
ugugcaaauuagcacaacccga

SEQ ID NO: 219779 - RNA, 22 nt, Homo sapiens
ugugcaaggcucucaaccugug

SEQ ID NO: 219780 - RNA, 22 nt, Homo sapiens
ugugcaaucagcuucauuacau

SEQ ID NO: 219781 - RNA, 22 nt, Homo sapiens
ugugcacaauguacagguuagu

SEQ ID NO: 219782 - RNA, 22 nt, Homo sapiens
ugugcacaaugugcagguuugu

SEQ ID NO: 219783 - RNA, 22 nt, Homo sapiens
acaucaggcuugugaugauuac

SEQ ID NO: 219784 - RNA, 22 nt, Homo sapiens
acauccauuugcuuuauuugcu

SEQ ID NO: 219785 - RNA, 18 nt, Homo sapiens
acaucccaugcuggggug

SEQ ID NO: 219786 - RNA, 22 nt, Homo sapiens
acaucccuuucccacccuucac

SEQ ID NO: 219787 - RNA, 22 nt, Homo sapiens
acaucuguacaguggguguggu

SEQ ID NO: 219788 - RNA, 22 nt, Homo sapiens
acaugagacuggguuuguaggg

SEQ ID NO: 219789 - RNA, 22 nt, Homo sapiens
acaugcauccaugugaagagac

SEQ ID NO: 219790 - RNA, 22 nt, Homo sapiens
acaugccucccugguccgcugu

SEQ ID NO: 219791 - RNA, 22 nt, Homo sapiens
acauggcacugcgggcuucuug

SEQ ID NO: 219792 - RNA, 22 nt, Homo sapiens
acauguaauugauuuuguguua

SEQ ID NO: 219793 - RNA, 19 nt, Homo sapiens
acauugcauuuguaggcuu

SEQ ID NO: 219794 - RNA, 17 nt, Homo sapiens
accagugcaugugcuuu

SEQ ID NO: 219795 - RNA, 22 nt, Homo sapiens
accauugcacuccuuucugggc

SEQ ID NO: 219796 - RNA, 17 nt, Homo sapiens
accccuaccucagaagc

SEQ ID NO: 219797 - RNA, 20 nt, Homo sapiens
acccucuaggaugauuucuu

SEQ ID NO: 219798 - RNA, 22 nt, Homo sapiens
acccugcuaaacagcccccugc

SEQ ID NO: 219799 - RNA, 22 nt, Homo sapiens
acccugguagcuaugaagucuu

SEQ ID NO: 219800 - RNA, 22 nt, Homo sapiens
acccuguaacauacaagugguu

SEQ ID NO: 219801 - RNA, 22 nt, Homo sapiens
acccuguaggacuauucuaauc

SEQ ID NO: 219802 - RNA, 22 nt, Homo sapiens
acccugucacucccaucaauuu

SEQ ID NO: 219803 - RNA, 19 nt, Homo sapiens
acccuguccccaccuuuac

SEQ ID NO: 219804 - RNA, 22 nt, Homo sapiens
acccuuaagcacuaguucagcu

SEQ ID NO: 219805 - RNA, 22 nt, Homo sapiens
accgggcugagcgcaggccccg

SEQ ID NO: 219806 - RNA, 21 nt, Homo sapiens
accugauguuucaguuggagu

SEQ ID NO: 219807 - RNA, 22 nt, Homo sapiens
accuggacacuuugggcuccuc

SEQ ID NO: 219808 - RNA, 22 nt, Homo sapiens
accuggguguauguucaguuug

SEQ ID NO: 219809 - RNA, 22 nt, Homo sapiens
accuguagcagacuuaauauuu

SEQ ID NO: 219810 - RNA, 23 nt, Homo sapiens
accuucauucauucagcugaagu

SEQ ID NO: 219811 - RNA, 22 nt, Homo sapiens
accuuuacaacuuguuagagua

SEQ ID NO: 219812 - RNA, 22 nt, Homo sapiens
acuaaggcacaauuuucucaua

SEQ ID NO: 219813 - RNA, 22 nt, Homo sapiens
acuagagaugcauuuguaguuu

SEQ ID NO: 219814 - RNA, 22 nt, Homo sapiens
acuagaugauuauguuccauug

SEQ ID NO: 219815 - RNA, 22 nt, Homo sapiens
acuauacugaagcaaauuaaca

SEQ ID NO: 219816 - RNA, 22 nt, Homo sapiens
acuaugagacgaaugcaucagu

SEQ ID NO: 219817 - RNA, 22 nt, Homo sapiens
acucagagagaacugucauuug

SEQ ID NO: 219818 - RNA, 22 nt, Homo sapiens
acucagagauuagcacauguuu

SEQ ID NO: 219819 - RNA, 22 nt, Homo sapiens
acuccacuuucaccacagcgga

SEQ ID NO: 219820 - RNA, 22 nt, Homo sapiens
acucugucuaguuguaaaauuu

SEQ ID NO: 219821 - RNA, 22 nt, Homo sapiens
acucuguugucuggccuuccug

SEQ ID NO: 219822 - RNA, 22 nt, Homo sapiens
acugagacugagaauguuucuu

SEQ ID NO: 219823 - RNA, 22 nt, Homo sapiens
acugagucauugaggcccucuc

SEQ ID NO: 219824 - RNA, 20 nt, Homo sapiens
acugcacuccaaccuuugug

SEQ ID NO: 219825 - RNA, 22 nt, Homo sapiens
acugcacuccagccucaugaca

SEQ ID NO: 219826 - RNA, 22 nt, Homo sapiens
acugcacuccagccuccugaca

SEQ ID NO: 219827 - RNA, 22 nt, Homo sapiens
acugcacuccagccucggcaau

SEQ ID NO: 219828 - RNA, 22 nt, Homo sapiens
acugcacuccagccugaugaaa

SEQ ID NO: 219829 - RNA, 22 nt, Homo sapiens
acugcacuccagccugcuggau

SEQ ID NO: 219830 - RNA, 22 nt, Homo sapiens
acugcacuccagccugcugggu

SEQ ID NO: 219831 - RNA, 22 nt, Homo sapiens
acugcacuccagccuggaccac

SEQ ID NO: 219832 - RNA, 22 nt, Homo sapiens
acugcacuccagccuggacgaa

SEQ ID NO: 219833 - RNA, 22 nt, Homo sapiens
acugcacuccagccuggcggac

SEQ ID NO: 219834 - RNA, 22 nt, Homo sapiens
acugcacuccagccuucaggac

SEQ ID NO: 219835 - RNA, 22 nt, Homo sapiens
acugcacuccagccuuggcaac

SEQ ID NO: 219836 - RNA, 22 nt, Homo sapiens
acugcacuccagccuuggccac

SEQ ID NO: 219837 - RNA, 22 nt, Homo sapiens
acugcacuccaguuccgggcaa

SEQ ID NO: 219838 - RNA, 22 nt, Homo sapiens
acugcacucccgcccgggugac

SEQ ID NO: 219839 - RNA, 22 nt, Homo sapiens
acugcacucuagccuuggcaac

SEQ ID NO: 219840 - RNA, 22 nt, Homo sapiens
acugcacuuauccuccaauguu

SEQ ID NO: 219841 - RNA, 22 nt, Homo sapiens
acugcacuucagccuuggggac

SEQ ID NO: 219842 - RNA, 20 nt, Homo sapiens
acugcauuuaguccucagga

SEQ ID NO: 219843 - RNA, 22 nt, Homo sapiens
acugcauuugucugucucaauu

SEQ ID NO: 219844 - RNA, 22 nt, Homo sapiens
acugccuaaugacuuauguuuu

SEQ ID NO: 219845 - RNA, 22 nt, Homo sapiens
acuggaguuuguucaagaaaua

SEQ ID NO: 219846 - RNA, 22 nt, Homo sapiens
acuggcaauggcagaaauaguu

SEQ ID NO: 219847 - RNA, 22 nt, Homo sapiens
acuggguuaauuugaagguuga

SEQ ID NO: 219848 - RNA, 22 nt, Homo sapiens
acuguacuccauccugggugac

SEQ ID NO: 219849 - RNA, 22 nt, Homo sapiens
acuguacucuacccugggcaac

SEQ ID NO: 219850 - RNA, 22 nt, Homo sapiens
acuuugcuuagagggcauuaaa

SEQ ID NO: 219851 - RNA, 22 nt, Homo sapiens
acuuugcuuaucccaggcacug

SEQ ID NO: 219852 - RNA, 22 nt, Homo sapiens
acuuuguguuacccagcaagga

SEQ ID NO: 219853 - RNA, 22 nt, Homo sapiens
acuuuguuauggcaacccuaag

SEQ ID NO: 219854 - RNA, 21 nt, Homo sapiens
acuuuguugggggcugaggca

SEQ ID NO: 219855 - RNA, 22 nt, Homo sapiens
agaacacugaguucagggucag

SEQ ID NO: 219856 - RNA, 22 nt, Homo sapiens
agaaccauuagagggagauauu

SEQ ID NO: 219857 - RNA, 22 nt, Homo sapiens
agaagacuauucuggguugggc

SEQ ID NO: 219858 - RNA, 19 nt, Homo sapiens
agaaucuaaauuauuucug

SEQ ID NO: 219859 - RNA, 22 nt, Homo sapiens
ggaagagugaauuaucuugacu

SEQ ID NO: 219860 - RNA, 22 nt, Homo sapiens
ggaagugcuguguggaagucug

SEQ ID NO: 219861 - RNA, 22 nt, Homo sapiens
ggaaucugaaccaugggaaugg

SEQ ID NO: 219862 - RNA, 17 nt, Homo sapiens
ggaaugaauuccagccc

SEQ ID NO: 219863 - RNA, 22 nt, Homo sapiens
ggaaugagaaauauuacacaau

SEQ ID NO: 219864 - RNA, 22 nt, Homo sapiens
ggaaugggauuugaagucuggc

SEQ ID NO: 219865 - RNA, 22 nt, Homo sapiens
ggaauguuaaggcgcuguuggu

SEQ ID NO: 219866 - RNA, 22 nt, Homo sapiens
ggacaagaucuuccaccauuca

SEQ ID NO: 219867 - RNA, 22 nt, Homo sapiens
ggacuagaggugaaaagaagac

SEQ ID NO: 219868 - RNA, 22 nt, Homo sapiens
ggacuaggagcuaggaagaucu

SEQ ID NO: 219869 - RNA, 22 nt, Homo sapiens
ggacuggaagcauauuuauuuu

SEQ ID NO: 219870 - RNA, 20 nt, Homo sapiens
ggagagugacauaauucugg

SEQ ID NO: 219871 - RNA, 22 nt, Homo sapiens
ggagagugacauauuucuaggc

SEQ ID NO: 219872 - RNA, 22 nt, Homo sapiens
ggagaucauuuccuauuugaag

SEQ ID NO: 219873 - RNA, 22 nt, Homo sapiens
ggagauguuuaaccuuuuaucu

SEQ ID NO: 219874 - RNA, 22 nt, Homo sapiens
ggagauuauugaaucaugaggg

SEQ ID NO: 219875 - RNA, 22 nt, Homo sapiens
ggagcucaucuagcauagaggu

SEQ ID NO: 219876 - RNA, 22 nt, Homo sapiens
ggagcugugauuugaguccaga

SEQ ID NO: 219877 - RNA, 22 nt, Homo sapiens
ggaggcuaguaaaaagguagaa

SEQ ID NO: 219878 - RNA, 16 nt, Homo sapiens
ggaggucaucugggaa

SEQ ID NO: 219879 - RNA, 22 nt, Homo sapiens
ggaguaaaagaguaggaggaau

SEQ ID NO: 219880 - RNA, 22 nt, Homo sapiens
ggagucugaacuggacaaugac

SEQ ID NO: 219881 - RNA, 22 nt, Homo sapiens
ggagucugauuuuuauguugcu

SEQ ID NO: 219882 - RNA, 23 nt, Homo sapiens
ggaguguaaauuauuucaaccau

SEQ ID NO: 219883 - RNA, 22 nt, Homo sapiens
ggaguguaauggcgccaucuca

SEQ ID NO: 219884 - RNA, 22 nt, Homo sapiens
ggagugucagaaacaguguccu

SEQ ID NO: 219885 - RNA, 22 nt, Homo sapiens
ggagugucugugcuggucaaag

SEQ ID NO: 219886 - RNA, 22 nt, Homo sapiens
ggauacaucuggacagccgaau

SEQ ID NO: 219887 - RNA, 21 nt, Homo sapiens
ggauagaaaacuuggcuguau

SEQ ID NO: 219888 - RNA, 22 nt, Homo sapiens
ggauaucauuauuucuagggcu

SEQ ID NO: 219889 - RNA, 22 nt, Homo sapiens
ggaucacagagcuugggaaagg

SEQ ID NO: 219890 - RNA, 23 nt, Homo sapiens
ggauggaaaguuuugagggccac

SEQ ID NO: 219891 - RNA, 22 nt, Homo sapiens
ggauggcauuucuuuagcuuuu

SEQ ID NO: 219892 - RNA, 22 nt, Homo sapiens
ggauuuguuggcauuagugaug

SEQ ID NO: 219893 - RNA, 22 nt, Homo sapiens
ggcaaaaucgcaauuacuuuug

SEQ ID NO: 219894 - RNA, 22 nt, Homo sapiens
ggcaaaugaagauggagaggcu

SEQ ID NO: 219895 - RNA, 22 nt, Homo sapiens
ggcaagaggagauucugcuccc

SEQ ID NO: 219896 - RNA, 22 nt, Homo sapiens
ggcaaguauguuuuaggaugcu

SEQ ID NO: 219897 - RNA, 22 nt, Homo sapiens
ggcaaguugcuauucuuuaaug

SEQ ID NO: 219898 - RNA, 22 nt, Homo sapiens
ggcaaugucagcuaaugaugga

SEQ ID NO: 219899 - RNA, 22 nt, Homo sapiens
ggcaccauuuuacuccuucccu

SEQ ID NO: 219900 - RNA, 22 nt, Homo sapiens
ggcacugugaugugagggggua

SEQ ID NO: 219901 - RNA, 22 nt, Homo sapiens
ggcagaauugcugaggaugcua

SEQ ID NO: 219902 - RNA, 22 nt, Homo sapiens
ggcaguggaagugccaguuucu

SEQ ID NO: 219903 - RNA, 22 nt, Homo sapiens
ggcaguuuggcaguuucauaaa

SEQ ID NO: 219904 - RNA, 22 nt, Homo sapiens
ggcaugaggccauaaaaguaag

SEQ ID NO: 219905 - RNA, 22 nt, Homo sapiens
ggcaugaugcgcacgccuguag

SEQ ID NO: 219906 - RNA, 22 nt, Homo sapiens
ggcaugauggcugaggcuucug

SEQ ID NO: 219907 - RNA, 22 nt, Homo sapiens
ggcaugcauuguacuaguaugc

SEQ ID NO: 219908 - RNA, 22 nt, Homo sapiens
ggcauguauucuuauuauuccu

SEQ ID NO: 219909 - RNA, 22 nt, Homo sapiens
ggcauguguggguuauuaaaga

SEQ ID NO: 219910 - RNA, 22 nt, Homo sapiens
ggccagaugaucuaugaaggaa

SEQ ID NO: 219911 - RNA, 22 nt, Homo sapiens
ggccuguaaacuagagacccug

SEQ ID NO: 219912 - RNA, 22 nt, Homo sapiens
ggcuagaauagggauagaccuu

SEQ ID NO: 219913 - RNA, 22 nt, Homo sapiens
ggcuagagagcucagggauaug

SEQ ID NO: 219914 - RNA, 19 nt, Homo sapiens
ggcucagucaacugacugu

SEQ ID NO: 219915 - RNA, 22 nt, Homo sapiens
ggcucguguuuucuguccaguu

SEQ ID NO: 219916 - RNA, 22 nt, Homo sapiens
gggaacaugagaaugugaauga

SEQ ID NO: 219917 - RNA, 22 nt, Homo sapiens
gggaacauggaaauucugcucu

SEQ ID NO: 219918 - RNA, 22 nt, Homo sapiens
gggaauggaagacauuaugaug

SEQ ID NO: 219919 - RNA, 22 nt, Homo sapiens
gggagcaaaaaugaugcccaag

SEQ ID NO: 219920 - RNA, 22 nt, Homo sapiens
gggagcacaagaaauguuucau

SEQ ID NO: 219921 - RNA, 22 nt, Homo sapiens
gggagguaggaguuauuauuuu

SEQ ID NO: 219922 - RNA, 22 nt, Homo sapiens
gggagguuguauguaugcgggg

SEQ ID NO: 219923 - RNA, 22 nt, Homo sapiens
gggauuauugugauuucauguu

SEQ ID NO: 219924 - RNA, 22 nt, Homo sapiens
gggcaaaacuguacugccaagg

SEQ ID NO: 219925 - RNA, 19 nt, Homo sapiens
gggcaaaucuggaaauuua

SEQ ID NO: 219926 - RNA, 22 nt, Homo sapiens
gggcauguggacuuguauguuu

SEQ ID NO: 219927 - RNA, 22 nt, Homo sapiens
gggcuagaauccgcgucucuug

SEQ ID NO: 219928 - RNA, 22 nt, Homo sapiens
auacagguauacaaugcauaau

SEQ ID NO: 219929 - RNA, 22 nt, Homo sapiens
auacaguguauguauaguacau

SEQ ID NO: 219930 - RNA, 22 nt, Homo sapiens
auacaugugccaugcuggugug

SEQ ID NO: 219931 - RNA, 22 nt, Homo sapiens
auacaugugccauggugguuug

SEQ ID NO: 219932 - RNA, 22 nt, Homo sapiens
auacaugugccauguucgugug

SEQ ID NO: 219933 - RNA, 20 nt, Homo sapiens
auaccacagacuggguaguu

SEQ ID NO: 219934 - RNA, 22 nt, Homo sapiens
auaccugguagucuugcuacac

SEQ ID NO: 219935 - RNA, 22 nt, Homo sapiens
auacguacauaugcacauaugg

SEQ ID NO: 219936 - RNA, 22 nt, Homo sapiens
auacuagucaagaauguaugag

SEQ ID NO: 219937 - RNA, 22 nt, Homo sapiens
auagaagcugccaacguuucag

SEQ ID NO: 219938 - RNA, 22 nt, Homo sapiens
auagaauguuugcgccagguga

SEQ ID NO: 219939 - RNA, 20 nt, Homo sapiens
auagaccauugguagguagg

SEQ ID NO: 219940 - RNA, 22 nt, Homo sapiens
auagaguuagaaagaaauguuu

SEQ ID NO: 219941 - RNA, 22 nt, Homo sapiens
auagaucuauuuauguaucccu

SEQ ID NO: 219942 - RNA, 22 nt, Homo sapiens
auagauucauuugaggagauuu

SEQ ID NO: 219943 - RNA, 22 nt, Homo sapiens
auagcaaugccccauucccagu

SEQ ID NO: 219944 - RNA, 22 nt, Homo sapiens
auagcacacuauagcuucaaac

SEQ ID NO: 219945 - RNA, 22 nt, Homo sapiens
auagcacaguguguguacacca

SEQ ID NO: 219946 - RNA, 22 nt, Homo sapiens
auagcacauggcauccucucuu

SEQ ID NO: 219947 - RNA, 20 nt, Homo sapiens
auagcaccagacagcccuag

SEQ ID NO: 219948 - RNA, 21 nt, Homo sapiens
auagcacuucacuugguuaga

SEQ ID NO: 219949 - RNA, 22 nt, Homo sapiens
auagcagaauuuggucaagucu

SEQ ID NO: 219950 - RNA, 22 nt, Homo sapiens
auagcagaccaccucucccacu

SEQ ID NO: 219951 - RNA, 22 nt, Homo sapiens
auagcagcagcuaguagugaua

SEQ ID NO: 219952 - RNA, 22 nt, Homo sapiens
auagcagcauauguaauguuga

SEQ ID NO: 219953 - RNA, 22 nt, Homo sapiens
auagcagcucacuuauuuaugg

SEQ ID NO: 219954 - RNA, 22 nt, Homo sapiens
auagcagugccccaaacuccug

SEQ ID NO: 219955 - RNA, 22 nt, Homo sapiens
auagcagugugaaaacagacug

SEQ ID NO: 219956 - RNA, 22 nt, Homo sapiens
auagcagugugagaaugaacua

SEQ ID NO: 219957 - RNA, 22 nt, Homo sapiens
uagagcaaugacucuggaaacc

SEQ ID NO: 219958 - RNA, 18 nt, Homo sapiens
uagagcacaagcuuuggc

SEQ ID NO: 219959 - RNA, 22 nt, Homo sapiens
uagagcacagugauuagaccua

SEQ ID NO: 219960 - RNA, 22 nt, Homo sapiens
uagagcuacagcccucacuguc

SEQ ID NO: 219961 - RNA, 22 nt, Homo sapiens
uagagcuaguuuuuaaucuaac

SEQ ID NO: 219962 - RNA, 22 nt, Homo sapiens
uagaggaaggauuggaaacgca

SEQ ID NO: 219963 - RNA, 22 nt, Homo sapiens
uagaggaaugaauuuggccaga

SEQ ID NO: 219964 - RNA, 22 nt, Homo sapiens
uagagguauguauaguauucuu

SEQ ID NO: 219965 - RNA, 22 nt, Homo sapiens
uagagugcugucaaagacuugu

SEQ ID NO: 219966 - RNA, 22 nt, Homo sapiens
uagaguguaaaccacauaguga

SEQ ID NO: 219967 - RNA, 22 nt, Homo sapiens
uagauaguaaagccauuagcuu

SEQ ID NO: 219968 - RNA, 21 nt, Homo sapiens
uagauaguugguucugaaucu

SEQ ID NO: 219969 - RNA, 22 nt, Homo sapiens
uagaucaauuaauuguuacuug

SEQ ID NO: 219970 - RNA, 21 nt, Homo sapiens
uagaugguguucuagagagaa

SEQ ID NO: 219971 - RNA, 22 nt, Homo sapiens
uagauuaucuguaugugcucuu

SEQ ID NO: 219972 - RNA, 22 nt, Homo sapiens
uagauuaucuuaaggagcauca

SEQ ID NO: 219973 - RNA, 22 nt, Homo sapiens
uagauucauuuuagcaaaaguu

SEQ ID NO: 219974 - RNA, 22 nt, Homo sapiens
uagauuguaauaugcagaaugg

SEQ ID NO: 219975 - RNA, 22 nt, Homo sapiens
uagcaagaugaauuugugcaaa

SEQ ID NO: 219976 - RNA, 22 nt, Homo sapiens
uagcacagggaauugguucucu

SEQ ID NO: 219977 - RNA, 19 nt, Homo sapiens
uagcacagggucccagacu

SEQ ID NO: 219978 - RNA, 22 nt, Homo sapiens
uagcacagugucauucuaggua

SEQ ID NO: 219979 - RNA, 20 nt, Homo sapiens
uagcacaucuggcuguagag

SEQ ID NO: 219980 - RNA, 22 nt, Homo sapiens
uagcaccaggguugacugaccu

SEQ ID NO: 219981 - RNA, 22 nt, Homo sapiens
uagcacccucuccuaguccugc

SEQ ID NO: 219982 - RNA, 22 nt, Homo sapiens
uagcaccucuuuggccuuucgu

SEQ ID NO: 219983 - RNA, 22 nt, Homo sapiens
uagcagcaaagcaggaucugcu

SEQ ID NO: 219984 - RNA, 22 nt, Homo sapiens
uagcagcaccccacucuacugg

SEQ ID NO: 219985 - RNA, 22 nt, Homo sapiens
uagcagcagugguguauuuaga

SEQ ID NO: 219986 - RNA, 22 nt, Homo sapiens
uagcagccaggaagggcuggcu

SEQ ID NO: 219987 - RNA, 22 nt, Homo sapiens
uagcaggaaaccuguguugagg

SEQ ID NO: 219988 - RNA, 22 nt, Homo sapiens
uagcaguaccccaguauccugg

SEQ ID NO: 219989 - RNA, 22 nt, Homo sapiens
uagcagucaagauagucauuau

SEQ ID NO: 219990 - RNA, 22 nt, Homo sapiens
uagcagugugaaaacggacuaa

SEQ ID NO: 219991 - RNA, 22 nt, Homo sapiens
uagcaguuguuguuacuuguau

SEQ ID NO: 219992 - RNA, 21 nt, Homo sapiens
uagcauacauuuugcaucuua

SEQ ID NO: 219993 - RNA, 22 nt, Homo sapiens
uagcauggaggcggccauagug

SEQ ID NO: 219994 - RNA, 22 nt, Homo sapiens
uagcccagugagguugauuugg

SEQ ID NO: 219995 - RNA, 22 nt, Homo sapiens
uagcccauuuguuuagggaaag

SEQ ID NO: 219996 - RNA, 22 nt, Homo sapiens
uagccgggugugguggaacucc

SEQ ID NO: 219997 - RNA, 22 nt, Homo sapiens
uagccucacaaagugcuuaaga

SEQ ID NO: 219998 - RNA, 22 nt, Homo sapiens
uagcuaaauucagcucuaggua

SEQ ID NO: 219999 - RNA, 21 nt, Homo sapiens
uagcuacacugugauucaugg

SEQ ID NO: 220000 - RNA, 21 nt, Homo sapiens
uagcugaugauguaggggaug

SEQ ID NO: 220001 - RNA, 22 nt, Homo sapiens
uagcugcaaaauauagacuucu

SEQ ID NO: 220002 - RNA, 22 nt, Homo sapiens
uagcugcauccugugcacucaa

SEQ ID NO: 220003 - RNA, 22 nt, Homo sapiens
uagcugcuguauguacacggau

SEQ ID NO: 220004 - RNA, 22 nt, Homo sapiens
uaggcaauguacauaucggccc

SEQ ID NO: 220005 - RNA, 22 nt, Homo sapiens
uaggcacugagaauaugaggau

SEQ ID NO: 220006 - RNA, 21 nt, Homo sapiens
uaggccgggugcaggaugcuu

SEQ ID NO: 220007 - RNA, 22 nt, Homo sapiens
uaggccuuuuucagauggguag

SEQ ID NO: 220008 - RNA, 22 nt, Homo sapiens
uaggcgagauguguguuucaug

SEQ ID NO: 220009 - RNA, 22 nt, Homo sapiens
uagggaguuuuggggugcagaa

SEQ ID NO: 220010 - RNA, 22 nt, Homo sapiens
uagggcauguguggaguguaug

SEQ ID NO: 220011 - RNA, 22 nt, Homo sapiens
uagguaaguaugugugaugggg

SEQ ID NO: 220012 - RNA, 22 nt, Homo sapiens
uagguagauuuaaagauuuucu

SEQ ID NO: 220013 - RNA, 22 nt, Homo sapiens
uagguagcuuuggcguuucuug

SEQ ID NO: 220014 - RNA, 22 nt, Homo sapiens
uagguaggaaguguuguuuuua

SEQ ID NO: 220015 - RNA, 22 nt, Homo sapiens
uagguaguugugggcuugaaug

SEQ ID NO: 220016 - RNA, 23 nt, Homo sapiens
uagguuauuugguaaauauaugu

SEQ ID NO: 220017 - RNA, 22 nt, Homo sapiens
auugagcuuuuuaaaauauagu

SEQ ID NO: 220018 - RNA, 22 nt, Homo sapiens
auugagguauaauugcuaugca

SEQ ID NO: 220019 - RNA, 22 nt, Homo sapiens
auugcaacuuccgccuccuggg

SEQ ID NO: 220020 - RNA, 18 nt, Homo sapiens
auugcacaccagccuggg

SEQ ID NO: 220021 - RNA, 22 nt, Homo sapiens
auugcacaccagucugggcaaa

SEQ ID NO: 220022 - RNA, 23 nt, Homo sapiens
auugcacuccagccuaccugggc

SEQ ID NO: 220023 - RNA, 22 nt, Homo sapiens
auugcacuccagccuggcagca

SEQ ID NO: 220024 - RNA, 22 nt, Homo sapiens
auugcacuccagccuggccaac

SEQ ID NO: 220025 - RNA, 22 nt, Homo sapiens
auugcacuccagccugggcuag

SEQ ID NO: 220026 - RNA, 22 nt, Homo sapiens
auugcacuccagccuggggaac

SEQ ID NO: 220027 - RNA, 22 nt, Homo sapiens
auugcacuccagccugggugac

SEQ ID NO: 220028 - RNA, 22 nt, Homo sapiens
auugcacuccagcuuaggcgac

SEQ ID NO: 220029 - RNA, 22 nt, Homo sapiens
auugcacuccauccuaggugac

SEQ ID NO: 220030 - RNA, 18 nt, Homo sapiens
auugcacuccugccuggg

SEQ ID NO: 220031 - RNA, 22 nt, Homo sapiens
auugcacucugaucugcacucc

SEQ ID NO: 220032 - RNA, 22 nt, Homo sapiens
auugcacugcagccugggcaac

SEQ ID NO: 220033 - RNA, 22 nt, Homo sapiens
auugcaguuagaacagaagucu

SEQ ID NO: 220034 - RNA, 22 nt, Homo sapiens
auugcauuuucagguuggucug

SEQ ID NO: 220035 - RNA, 23 nt, Homo sapiens
auugcccuugaaggcuaaacucu

SEQ ID NO: 220036 - RNA, 22 nt, Homo sapiens
auugcucacacaaagccuguuu

SEQ ID NO: 220037 - RNA, 22 nt, Homo sapiens
auugcuuacuaaucaucuucag

SEQ ID NO: 220038 - RNA, 22 nt, Homo sapiens
auuggauagucuuuaucuguug

SEQ ID NO: 220039 - RNA, 22 nt, Homo sapiens
auuggcaauagcuuucuuacua

SEQ ID NO: 220040 - RNA, 22 nt, Homo sapiens
auuggcaauguacauaucuugc

SEQ ID NO: 220041 - RNA, 22 nt, Homo sapiens
auuggcagaaaucuuuauagua

SEQ ID NO: 220042 - RNA, 22 nt, Homo sapiens
auuggccccguuuuaaauguca

SEQ ID NO: 220043 - RNA, 22 nt, Homo sapiens
auuguacuccagccuguggagc

SEQ ID NO: 220044 - RNA, 22 nt, Homo sapiens
auuguacuuaagccugggugaa

SEQ ID NO: 220045 - RNA, 22 nt, Homo sapiens
auugucacuuaaaagugcaugu

SEQ ID NO: 220046 - RNA, 22 nt, Homo sapiens
auugucauuuucugagaaguaa

SEQ ID NO: 220047 - RNA, 22 nt, Homo sapiens
auuguccuacuaggguuccagu

SEQ ID NO: 220048 - RNA, 20 nt, Homo sapiens
auuguccuugauuacacaga

SEQ ID NO: 220049 - RNA, 22 nt, Homo sapiens
auuuagcaauggagguagugua

SEQ ID NO: 220050 - RNA, 15 nt, Homo sapiens
auuucacuuagcaug

SEQ ID NO: 220051 - RNA, 19 nt, Homo sapiens
auuuccuggagcuggucuc

SEQ ID NO: 220052 - RNA, 22 nt, Homo sapiens
auuuccuguaggggcuugcgaa

SEQ ID NO: 220053 - RNA, 20 nt, Homo sapiens
auuugcauuauggagcaccc

SEQ ID NO: 220054 - RNA, 22 nt, Homo sapiens
auuugggaaugugcauuauacu

SEQ ID NO: 220055 - RNA, 22 nt, Homo sapiens
uccaugaggcuacaguaaucuc

SEQ ID NO: 220056 - RNA, 22 nt, Homo sapiens
uccauguaguugagcggcuuug

SEQ ID NO: 220057 - RNA, 22 nt, Homo sapiens
uccauuugucuauguuucuguu

SEQ ID NO: 220058 - RNA, 22 nt, Homo sapiens
ucccaagaugagaugggggcug

SEQ ID NO: 220059 - RNA, 19 nt, Homo sapiens
ucccaagaugcucauacau

SEQ ID NO: 220060 - RNA, 23 nt, Homo sapiens
ucccaagauggaccagaccaagg

SEQ ID NO: 220061 - RNA, 19 nt, Homo sapiens
ucccaauguuuccaggcag

SEQ ID NO: 220062 - RNA, 16 nt, Homo sapiens
ucccaccauugcuugu

SEQ ID NO: 220063 - RNA, 17 nt, Homo sapiens
ucccauguuucuucuac

SEQ ID NO: 220064 - RNA, 22 nt, Homo sapiens
uccccaguaggcaauuaacacc

SEQ ID NO: 220065 - RNA, 19 nt, Homo sapiens
uccccaguuuuccguucag

SEQ ID NO: 220066 - RNA, 22 nt, Homo sapiens
uccccgagcccaggcugugacu

SEQ ID NO: 220067 - RNA, 22 nt, Homo sapiens
uccccugagucaccugcuucuc

SEQ ID NO: 220068 - RNA, 22 nt, Homo sapiens
ucccguuauuaaccccugccuu

SEQ ID NO: 220069 - RNA, 22 nt, Homo sapiens
ucccugaaaauuagcauuuuaa

SEQ ID NO: 220070 - RNA, 22 nt, Homo sapiens
ucccugaaagcugagauuggaa

SEQ ID NO: 220071 - RNA, 22 nt, Homo sapiens
ucccugaacacauguugagaag

SEQ ID NO: 220072 - RNA, 22 nt, Homo sapiens
ucccugacagggucugagcuuu

SEQ ID NO: 220073 - RNA, 18 nt, Homo sapiens
ucccugacucaaauucuu

SEQ ID NO: 220074 - RNA, 22 nt, Homo sapiens
ucccugaguaucuaauguguuu

SEQ ID NO: 220075 - RNA, 22 nt, Homo sapiens
uccgaguguuagagagcugugu

SEQ ID NO: 220076 - RNA, 22 nt, Homo sapiens
uccuacaugcaguacauucaaa

SEQ ID NO: 220077 - RNA, 22 nt, Homo sapiens
uccugagaauagaguugcaugu

SEQ ID NO: 220078 - RNA, 22 nt, Homo sapiens
uccugauacgguugcaguucuc

SEQ ID NO: 220079 - RNA, 22 nt, Homo sapiens
uccuggcuccacuguuuauucc

SEQ ID NO: 220080 - RNA, 19 nt, Homo sapiens
uccuugauugcaccacugc

SEQ ID NO: 220081 - RNA, 22 nt, Homo sapiens
uccuuggucaaaaagaaagugu

SEQ ID NO: 220082 - RNA, 22 nt, Homo sapiens
uccuuggucauggaagagacag

SEQ ID NO: 220083 - RNA, 22 nt, Homo sapiens
uccuugguugauccugugcaga

SEQ ID NO: 220084 - RNA, 22 nt, Homo sapiens
uccuuuagacugaauccugaga

SEQ ID NO: 220085 - RNA, 22 nt, Homo sapiens
uccuuuggcuaacuuucuaagu

SEQ ID NO: 220086 - RNA, 22 nt, Homo sapiens
uccuuugguuauaggcaccucu

SEQ ID NO: 220087 - RNA, 22 nt, Homo sapiens
ucgcaccauugcacuccagcca

SEQ ID NO: 220088 - RNA, 22 nt, Homo sapiens
ucggcucagugcaagcucugcc

SEQ ID NO: 220089 - RNA, 22 nt, Homo sapiens
ucgugcaaacguaauugugguu

SEQ ID NO: 220090 - RNA, 22 nt, Homo sapiens
ucguucuugucaguuuauaaag

SEQ ID NO: 220091 - RNA, 20 nt, Homo sapiens
ucguugguagagagcagggc

SEQ ID NO: 220092 - RNA, 22 nt, Homo sapiens
ucuaaaacuagauugugaugau

SEQ ID NO: 220093 - RNA, 22 nt, Homo sapiens
ucuaaaguacuacuacuguugg

SEQ ID NO: 220094 - RNA, 22 nt, Homo sapiens
ucuaaggcaccuagagucauca

SEQ ID NO: 220095 - RNA, 22 nt, Homo sapiens
ucuacccugugagggacacagu

SEQ ID NO: 220096 - RNA, 18 nt, Homo sapiens
ucuagacacugugucuau

SEQ ID NO: 220097 - RNA, 22 nt, Homo sapiens
ucuagcacuuacuggcugugug

SEQ ID NO: 220098 - RNA, 22 nt, Homo sapiens
ucucaagaugguagaugggaau

SEQ ID NO: 220099 - RNA, 22 nt, Homo sapiens
ucucaaguaacugggacaauaa

SEQ ID NO: 220100 - RNA, 22 nt, Homo sapiens
ucucaaguggucgcaguuagau

SEQ ID NO: 220101 - RNA, 22 nt, Homo sapiens
ucucacaggguuauugaggggg

SEQ ID NO: 220102 - RNA, 22 nt, Homo sapiens
ucucacauuucacagggauggg

SEQ ID NO: 220103 - RNA, 22 nt, Homo sapiens
ucucagugaaauaaauuauuuu

SEQ ID NO: 220104 - RNA, 22 nt, Homo sapiens
ucucaguggcacccccaacacc

SEQ ID NO: 220105 - RNA, 22 nt, Homo sapiens
ucucaguggcuuccucacuuuu

SEQ ID NO: 220106 - RNA, 22 nt, Homo sapiens
ucucagugugguaaaaguuuuu

SEQ ID NO: 220107 - RNA, 22 nt, Homo sapiens
gggggagugugguacccagcau

SEQ ID NO: 220108 - RNA, 22 nt, Homo sapiens
ggggucauuaaauuccgcuggu

SEQ ID NO: 220109 - RNA, 22 nt, Homo sapiens
gggguuuuaccuucguauucuu

SEQ ID NO: 220110 - RNA, 22 nt, Homo sapiens
ggguaaaucucuuuucauggcu

SEQ ID NO: 220111 - RNA, 22 nt, Homo sapiens
gggugguuuuauuaucagugac

SEQ ID NO: 220112 - RNA, 22 nt, Homo sapiens
ggguucaaaucuuggcucuuac

SEQ ID NO: 220113 - RNA, 22 nt, Homo sapiens
ggguucccuucuggcucagggu

SEQ ID NO: 220114 - RNA, 22 nt, Homo sapiens
gguaaacauacugcugucuucu

SEQ ID NO: 220115 - RNA, 22 nt, Homo sapiens
ggucacauuggacuaucaaguu

SEQ ID NO: 220116 - RNA, 22 nt, Homo sapiens
ggucacccugaugcuggugguc

SEQ ID NO: 220117 - RNA, 19 nt, Homo sapiens
ggucagcaaagucuagcug

SEQ ID NO: 220118 - RNA, 22 nt, Homo sapiens
ggucaggagaaugguaacugag

SEQ ID NO: 220119 - RNA, 22 nt, Homo sapiens
ggucagugcauucuaaaggcaa

SEQ ID NO: 220120 - RNA, 22 nt, Homo sapiens
ggucaguguuaucaccgaagga

SEQ ID NO: 220121 - RNA, 22 nt, Homo sapiens
ggucccccuccacucucgcaaa

SEQ ID NO: 220122 - RNA, 22 nt, Homo sapiens
gguccgccugccuuggccuccc

SEQ ID NO: 220123 - RNA, 22 nt, Homo sapiens
ggugaauuguaccccauaggau

SEQ ID NO: 220124 - RNA, 22 nt, Homo sapiens
ggugagaaaaacauagucucag

SEQ ID NO: 220125 - RNA, 22 nt, Homo sapiens
ggugaucauugucucuaguaug

SEQ ID NO: 220126 - RNA, 22 nt, Homo sapiens
ggugauguuugaguugagacag

SEQ ID NO: 220127 - RNA, 22 nt, Homo sapiens
gguuagaaacagguccucagga

SEQ ID NO: 220128 - RNA, 22 nt, Homo sapiens
guaaaucucuguuuucauggac

SEQ ID NO: 220129 - RNA, 22 nt, Homo sapiens
guaaaugcagaugcaugaccuu

SEQ ID NO: 220130 - RNA, 20 nt, Homo sapiens
guaacagcacuuucccaaag

SEQ ID NO: 220131 - RNA, 22 nt, Homo sapiens
guaaggaguaguguaacagugc

SEQ ID NO: 220132 - RNA, 22 nt, Homo sapiens
guaagucucaugagaucugaug

SEQ ID NO: 220133 - RNA, 22 nt, Homo sapiens
guaauaacuguggaaaaagguu

SEQ ID NO: 220134 - RNA, 22 nt, Homo sapiens
guaaucucaccuacuugggagg

SEQ ID NO: 220135 - RNA, 22 nt, Homo sapiens
guaaugcacucccaaagaucca

SEQ ID NO: 220136 - RNA, 22 nt, Homo sapiens
guacaguacugaaugaauguau

SEQ ID NO: 220137 - RNA, 22 nt, Homo sapiens
guacaguucucuuuguugucag

SEQ ID NO: 220138 - RNA, 22 nt, Homo sapiens
gugaggugguacaauauuaacu

SEQ ID NO: 220139 - RNA, 22 nt, Homo sapiens
gugaguaaagguucauugaauu

SEQ ID NO: 220140 - RNA, 22 nt, Homo sapiens
gugaguuauuauuuauguaaac

SEQ ID NO: 220141 - RNA, 22 nt, Homo sapiens
gugaucuuucaggcuugaccau

SEQ ID NO: 220142 - RNA, 22 nt, Homo sapiens
gugaugcaguacguagaggaga

SEQ ID NO: 220143 - RNA, 22 nt, Homo sapiens
gugauugucuaaucaagauaca

SEQ ID NO: 220144 - RNA, 22 nt, Homo sapiens
gugauuuaguagaugcuaguua

SEQ ID NO: 220145 - RNA, 21 nt, Homo sapiens
gugcaaacaucauagaaugua

SEQ ID NO: 220146 - RNA, 22 nt, Homo sapiens
gugcaaauuccagcucaacucc

SEQ ID NO: 220147 - RNA, 22 nt, Homo sapiens
gugcaagagugauugcaguuuu

SEQ ID NO: 220148 - RNA, 22 nt, Homo sapiens
gugcacaacgugcaggcuuguu

SEQ ID NO: 220149 - RNA, 22 nt, Homo sapiens
gugcacaacgugcagguuaguu

SEQ ID NO: 220150 - RNA, 22 nt, Homo sapiens
gugcacaaugugcagguuuguu

SEQ ID NO: 220151 - RNA, 22 nt, Homo sapiens
gugcacauauggugcauaagug

SEQ ID NO: 220152 - RNA, 22 nt, Homo sapiens
gugcacauuguuuaugucuguu

SEQ ID NO: 220153 - RNA, 21 nt, Homo sapiens
gugcagacacacauauaggcu

SEQ ID NO: 220154 - RNA, 22 nt, Homo sapiens
gugcaguguuugcauggaauca

SEQ ID NO: 220155 - RNA, 22 nt, Homo sapiens
gugcauauaaguuguuucuagu

SEQ ID NO: 220156 - RNA, 22 nt, Homo sapiens
gugcauaucugugguuggcuga

SEQ ID NO: 220157 - RNA, 22 nt, Homo sapiens
gugcauaugcaugugcaugcac

SEQ ID NO: 220158 - RNA, 22 nt, Homo sapiens
gugcaugcaucuuuauaguagc

SEQ ID NO: 220159 - RNA, 22 nt, Homo sapiens
gugcauguccacuaguccauau

SEQ ID NO: 220160 - RNA, 22 nt, Homo sapiens
gugccacugcacuccggccugg

SEQ ID NO: 220161 - RNA, 22 nt, Homo sapiens
guggaaaauuauugcuguuuuu

SEQ ID NO: 220162 - RNA, 22 nt, Homo sapiens
guggaagaaaucagguuauuug

SEQ ID NO: 220163 - RNA, 22 nt, Homo sapiens
guggaagauaguguguuaaugu

SEQ ID NO: 220164 - RNA, 22 nt, Homo sapiens
guggaagguaaugcagcuuacu

SEQ ID NO: 220165 - RNA, 22 nt, Homo sapiens
guggaaguuaagugacuuucug

SEQ ID NO: 220166 - RNA, 22 nt, Homo sapiens
guggaauggaaugauuguguau

SEQ ID NO: 220167 - RNA, 22 nt, Homo sapiens
guggacaugaauuuuggaggca

SEQ ID NO: 220168 - RNA, 22 nt, Homo sapiens
guggaggacuggauaaagaaaa

SEQ ID NO: 220169 - RNA, 22 nt, Homo sapiens
guggaggagaaagaagcauuuc

SEQ ID NO: 220170 - RNA, 22 nt, Homo sapiens
guggaguacugagggucacuua

SEQ ID NO: 220171 - RNA, 22 nt, Homo sapiens
guggcaaacucagcaugcccca

SEQ ID NO: 220172 - RNA, 22 nt, Homo sapiens
guggcacgaugaucugggcuca

SEQ ID NO: 220173 - RNA, 22 nt, Homo sapiens
guggcagaacagguaggguucu

SEQ ID NO: 220174 - RNA, 22 nt, Homo sapiens
guggcagugugaggauccugcu

SEQ ID NO: 220175 - RNA, 22 nt, Homo sapiens
guggcuaaagauuuggaaucug

SEQ ID NO: 220176 - RNA, 22 nt, Homo sapiens
guggcuagaaugaagguagcug

SEQ ID NO: 220177 - RNA, 22 nt, Homo sapiens
gugggaagcuggaacucccucc

SEQ ID NO: 220178 - RNA, 22 nt, Homo sapiens
gugggaugaucgcuugagccca

SEQ ID NO: 220179 - RNA, 20 nt, Homo sapiens
gugggcaaauccuuuccucu

SEQ ID NO: 220180 - RNA, 22 nt, Homo sapiens
gugggcaagucacuucaguucu

SEQ ID NO: 220181 - RNA, 22 nt, Homo sapiens
guggggucaucucauuugugga

SEQ ID NO: 220182 - RNA, 22 nt, Homo sapiens
guggugucuuuuuugauuagga

SEQ ID NO: 220183 - RNA, 22 nt, Homo sapiens
gugguuuuaauauucagucuag

SEQ ID NO: 220184 - RNA, 22 nt, Homo sapiens
gugguuuucaacuccaccugca

SEQ ID NO: 220185 - RNA, 22 nt, Homo sapiens
guguaaaacaauuagaggauuu

SEQ ID NO: 220186 - RNA, 22 nt, Homo sapiens
guguaaaucaaucuguugucuu

SEQ ID NO: 220187 - RNA, 22 nt, Homo sapiens
guguaaaucugcugugaacauu

SEQ ID NO: 220188 - RNA, 20 nt, Homo sapiens
guguaagagcaagcuuccua

SEQ ID NO: 220189 - RNA, 22 nt, Homo sapiens
guguaauaaucguggacuaugu

SEQ ID NO: 220190 - RNA, 22 nt, Homo sapiens
guguagagaaauagccugaagg

SEQ ID NO: 220191 - RNA, 22 nt, Homo sapiens
guguauacauagaauuguguau

SEQ ID NO: 220192 - RNA, 18 nt, Homo sapiens
guguauggauggaggcca

SEQ ID NO: 220193 - RNA, 22 nt, Homo sapiens
guguauguuguccauggaugcg

SEQ ID NO: 220194 - RNA, 22 nt, Homo sapiens
gugucacagcuuccaucucggu

SEQ ID NO: 220195 - RNA, 22 nt, Homo sapiens
gugucaguggggagugaucuuc

SEQ ID NO: 220196 - RNA, 22 nt, Homo sapiens
gugucaugaagguuuuaugcag

SEQ ID NO: 220197 - RNA, 22 nt, Homo sapiens
gugucuccugccuucaugcagc

SEQ ID NO: 220198 - RNA, 22 nt, Homo sapiens
gugugguaggauugguuacuca

SEQ ID NO: 220199 - RNA, 22 nt, Homo sapiens
guguguaaauggcagugagcuc

SEQ ID NO: 220200 - RNA, 22 nt, Homo sapiens
guguugcacauucuguggaugu

SEQ ID NO: 220201 - RNA, 22 nt, Homo sapiens
guuaaagacauccacauaggag

SEQ ID NO: 220202 - RNA, 22 nt, Homo sapiens
ugagaugcaaaaugagaauugu

SEQ ID NO: 220203 - RNA, 22 nt, Homo sapiens
ugagauggcuuuauugcugaau

SEQ ID NO: 220204 - RNA, 22 nt, Homo sapiens
ugagauggguucugguccccug

SEQ ID NO: 220205 - RNA, 22 nt, Homo sapiens
ugagauguggcuagagagguug

SEQ ID NO: 220206 - RNA, 22 nt, Homo sapiens
ugagauuaucguaauguaucuc

SEQ ID NO: 220207 - RNA, 22 nt, Homo sapiens
ugagauuaucuguacauaggag

SEQ ID NO: 220208 - RNA, 22 nt, Homo sapiens
ugagauuaucuugaucuugaaa

SEQ ID NO: 220209 - RNA, 22 nt, Homo sapiens
ugagauucucugauuguagguc

SEQ ID NO: 220210 - RNA, 22 nt, Homo sapiens
ugagcaacauuucaaaacucca

SEQ ID NO: 220211 - RNA, 22 nt, Homo sapiens
ugagcagaaguuuugauuggcg

SEQ ID NO: 220212 - RNA, 22 nt, Homo sapiens
ugagcagagggagaaguaaauu

SEQ ID NO: 220213 - RNA, 22 nt, Homo sapiens
ugagcagaguuguuucuccuga

SEQ ID NO: 220214 - RNA, 21 nt, Homo sapiens
ugagcauuaguacaguaggga

SEQ ID NO: 220215 - RNA, 22 nt, Homo sapiens
ugagcauuguguuugacuguga

SEQ ID NO: 220216 - RNA, 22 nt, Homo sapiens
ugagccauggcaccuugucuaa

SEQ ID NO: 220217 - RNA, 22 nt, Homo sapiens
ugagccaugggguaaaugugau

SEQ ID NO: 220218 - RNA, 22 nt, Homo sapiens
ugagcccauuguccugguuuau

SEQ ID NO: 220219 - RNA, 22 nt, Homo sapiens
ugagcuaagugccaauauuaau

SEQ ID NO: 220220 - RNA, 22 nt, Homo sapiens
ugagcuaggaucacaccugcau

SEQ ID NO: 220221 - RNA, 22 nt, Homo sapiens
ugagcucaguauuucauaaaca

SEQ ID NO: 220222 - RNA, 22 nt, Homo sapiens
ugagcucaugcauucuugagga

SEQ ID NO: 220223 - RNA, 22 nt, Homo sapiens
ugagcugagaucaugcuauugu

SEQ ID NO: 220224 - RNA, 22 nt, Homo sapiens
ugagcugagaucgugccauugu

SEQ ID NO: 220225 - RNA, 22 nt, Homo sapiens
ugagcugagaucuuaccacugc

SEQ ID NO: 220226 - RNA, 18 nt, Homo sapiens
ugaggaaaggguuugcua

SEQ ID NO: 220227 - RNA, 22 nt, Homo sapiens
ugaggaacuagcuacccuaaua

SEQ ID NO: 220228 - RNA, 22 nt, Homo sapiens
ugaggaguauguucuguagacc

SEQ ID NO: 220229 - RNA, 22 nt, Homo sapiens
ugaggauaguguugaaggcagg

SEQ ID NO: 220230 - RNA, 22 nt, Homo sapiens
ugaggaucucuaggaauuuauc

SEQ ID NO: 220231 - RNA, 22 nt, Homo sapiens
ugaggcuaggauaggcugauuc

SEQ ID NO: 220232 - RNA, 22 nt, Homo sapiens
ugaggcuagucagaucagauga

SEQ ID NO: 220233 - RNA, 22 nt, Homo sapiens
ugagguaacagaagcgagcauu

SEQ ID NO: 220234 - RNA, 22 nt, Homo sapiens
ugagguaaugcuguagcuguga

SEQ ID NO: 220235 - RNA, 22 nt, Homo sapiens
ugagguagaggugaacuugacc

SEQ ID NO: 220236 - RNA, 22 nt, Homo sapiens
ugagguaugugaugucuuuuag

SEQ ID NO: 220237 - RNA, 19 nt, Homo sapiens
ugagguauuuguugggaga

SEQ ID NO: 220238 - RNA, 22 nt, Homo sapiens
ugaggucacuuguuuuaugcuu

SEQ ID NO: 220239 - RNA, 20 nt, Homo sapiens
ugaggucaggaguuacagac

SEQ ID NO: 220240 - RNA, 22 nt, Homo sapiens
ugaggucuuuauuuagugcuca

SEQ ID NO: 220241 - RNA, 22 nt, Homo sapiens
ugaggugagauggcuaccccaa

SEQ ID NO: 220242 - RNA, 22 nt, Homo sapiens
ugaggugcagcaauccucaugu

SEQ ID NO: 220243 - RNA, 22 nt, Homo sapiens
ugagguguuugugcaccaucug

SEQ ID NO: 220244 - RNA, 22 nt, Homo sapiens
ugagguuggggucagggcuagc

SEQ ID NO: 220245 - RNA, 22 nt, Homo sapiens
ugagguuguccacuauaaucca

SEQ ID NO: 220246 - RNA, 22 nt, Homo sapiens
ugaguacugauuuaagauacac

SEQ ID NO: 220247 - RNA, 22 nt, Homo sapiens
ugaguagaacuagucuagagcu

SEQ ID NO: 220248 - RNA, 22 nt, Homo sapiens
ugaguagcuaagacgauaggca

SEQ ID NO: 220249 - RNA, 22 nt, Homo sapiens
ugaguaggauugguauuucuuc

SEQ ID NO: 220250 - RNA, 23 nt, Homo sapiens
ugaguaggcaguuuuccccucac

SEQ ID NO: 220251 - RNA, 23 nt, Homo sapiens
ugaguaggugguuuuccccucac

SEQ ID NO: 220252 - RNA, 22 nt, Homo sapiens
ugaguagucagugggcaggaag

SEQ ID NO: 220253 - RNA, 22 nt, Homo sapiens
ugaguagucuagaguggaaugu

SEQ ID NO: 220254 - RNA, 22 nt, Homo sapiens
ugagucgagauugcgccacugu

SEQ ID NO: 220255 - RNA, 22 nt, Homo sapiens
ugagugagguucuacucuguga

SEQ ID NO: 220256 - RNA, 22 nt, Homo sapiens
ugagugccuggagggcagggac

SEQ ID NO: 220257 - RNA, 22 nt, Homo sapiens
ugaguggagacuguguguagag

SEQ ID NO: 220258 - RNA, 22 nt, Homo sapiens
ugaguguccaaguaaggugaaa

SEQ ID NO: 220259 - RNA, 22 nt, Homo sapiens
ugagugugaggaagaauuagaa

SEQ ID NO: 220260 - RNA, 22 nt, Homo sapiens
ugaguuaaucucuacgauagaa

SEQ ID NO: 220261 - RNA, 17 nt, Homo sapiens
ugaguuaaucuuugugc

SEQ ID NO: 220262 - RNA, 22 nt, Homo sapiens
ugaguuaggagaguguggcucu

SEQ ID NO: 220263 - RNA, 22 nt, Homo sapiens
ugaguuagguaauaauaaauau

SEQ ID NO: 220264 - RNA, 22 nt, Homo sapiens
ugaguuccuuucccaguccagu

SEQ ID NO: 220265 - RNA, 22 nt, Homo sapiens
ugaguuuaucuaaagaccuggg

SEQ ID NO: 220266 - RNA, 22 nt, Homo sapiens
ugauaacauugggggaagcuga

SEQ ID NO: 220267 - RNA, 22 nt, Homo sapiens
ugauaacugaucuggauuugua

SEQ ID NO: 220268 - RNA, 22 nt, Homo sapiens
ugauaggucacucaacagugag

SEQ ID NO: 220269 - RNA, 22 nt, Homo sapiens
ugauaggucagaugauauugaa

SEQ ID NO: 220270 - RNA, 22 nt, Homo sapiens
ugauaggucuguuuugaaaagg

SEQ ID NO: 220271 - RNA, 22 nt, Homo sapiens
ugauaugugaguauaugguuau

SEQ ID NO: 220272 - RNA, 22 nt, Homo sapiens
ugauauguggauucagcucaaa

SEQ ID NO: 220273 - RNA, 17 nt, Homo sapiens
ugauauuuucccagaua

SEQ ID NO: 220274 - RNA, 20 nt, Homo sapiens
ugauauuuucugagcaggaa

SEQ ID NO: 220275 - RNA, 22 nt, Homo sapiens
ugaucugucacuuaucacauuu

SEQ ID NO: 220276 - RNA, 22 nt, Homo sapiens
ugaugacucuguggccccaggc

SEQ ID NO: 220277 - RNA, 21 nt, Homo sapiens
ugaugcuuuucuuaaccuugc

SEQ ID NO: 220278 - RNA, 22 nt, Homo sapiens
ugauggcacagugaguuccagg

SEQ ID NO: 220279 - RNA, 22 nt, Homo sapiens
ugaugguuuuauuaauaggacc

SEQ ID NO: 220280 - RNA, 22 nt, Homo sapiens
ugauguccaguucauagaaacu

SEQ ID NO: 220281 - RNA, 22 nt, Homo sapiens
ugaugucuugagauggagcuua

SEQ ID NO: 220282 - RNA, 22 nt, Homo sapiens
ugaugucuugcaggcacgagau

SEQ ID NO: 220283 - RNA, 20 nt, Homo sapiens
ugauuaguccacuuggcucu

SEQ ID NO: 220284 - RNA, 18 nt, Homo sapiens
ugauugacuuauuuaggu

SEQ ID NO: 220285 - RNA, 22 nt, Homo sapiens
ugauuuguccauguggcacgug

SEQ ID NO: 220286 - RNA, 18 nt, Homo sapiens
ugcaaacauguguguguu

SEQ ID NO: 220287 - RNA, 22 nt, Homo sapiens
ugcaaacuuccuugggcagcau

SEQ ID NO: 220288 - RNA, 22 nt, Homo sapiens
ugcaaagaaauuuuggugacca

SEQ ID NO: 220289 - RNA, 19 nt, Homo sapiens
ugcaaagucagugaagggu

SEQ ID NO: 220290 - RNA, 22 nt, Homo sapiens
ugcaaaguccucauucuuaccc

SEQ ID NO: 220291 - RNA, 22 nt, Homo sapiens
ugcaaaucuuguguaguuguga

SEQ ID NO: 220292 - RNA, 22 nt, Homo sapiens
ugcaaaugucaaggguuagugu

SEQ ID NO: 220293 - RNA, 22 nt, Homo sapiens
ugcaaauguuaggugucauuau

SEQ ID NO: 220294 - RNA, 19 nt, Homo sapiens
ugcaaauucuaaaaacuga

SEQ ID NO: 220295 - RNA, 22 nt, Homo sapiens
ugcaacauguguaccacucugu

SEQ ID NO: 220296 - RNA, 22 nt, Homo sapiens
ugcaaccauuguuaagugugca

SEQ ID NO: 220297 - RNA, 22 nt, Homo sapiens
ugcaagaaacauauuccacaag

SEQ ID NO: 220298 - RNA, 21 nt, Homo sapiens
ugcaagaaucaggaagcugcc

SEQ ID NO: 220299 - RNA, 22 nt, Homo sapiens
ugcaagacacuguccugggcau

SEQ ID NO: 220300 - RNA, 22 nt, Homo sapiens
aucucaaugcuuuuguaggcca

SEQ ID NO: 220301 - RNA, 16 nt, Homo sapiens
aucucagaccugcuga

SEQ ID NO: 220302 - RNA, 22 nt, Homo sapiens
aucucugagauguucugauuuu

SEQ ID NO: 220303 - RNA, 22 nt, Homo sapiens
aucugauggagagcguguggcu

SEQ ID NO: 220304 - RNA, 22 nt, Homo sapiens
aucugcacaucuguguuuuugu

SEQ ID NO: 220305 - RNA, 22 nt, Homo sapiens
aucugggguuggcaaaguuugg

SEQ ID NO: 220306 - RNA, 22 nt, Homo sapiens
aucugugaaugaaguuauuuug

SEQ ID NO: 220307 - RNA, 22 nt, Homo sapiens
aucuugggugggaacugagaau

SEQ ID NO: 220308 - RNA, 22 nt, Homo sapiens
aucuuguguugaauggugcaga

SEQ ID NO: 220309 - RNA, 22 nt, Homo sapiens
aucuuuggauacuugauauagu

SEQ ID NO: 220310 - RNA, 22 nt, Homo sapiens
augaaaacaugauuugccuguu

SEQ ID NO: 220311 - RNA, 23 nt, Homo sapiens
augaaagcccuugcaaaugcugg

SEQ ID NO: 220312 - RNA, 22 nt, Homo sapiens
augaaaucuuuccugugaggau

SEQ ID NO: 220313 - RNA, 22 nt, Homo sapiens
augaacacuccaauuguacucc

SEQ ID NO: 220314 - RNA, 19 nt, Homo sapiens
augaacucaucauuucuca

SEQ ID NO: 220315 - RNA, 17 nt, Homo sapiens
augaacucaucauuuuu

SEQ ID NO: 220316 - RNA, 19 nt, Homo sapiens
augaacucauucuuuuuau

SEQ ID NO: 220317 - RNA, 22 nt, Homo sapiens
augaagaucucugccuuguguc

SEQ ID NO: 220318 - RNA, 20 nt, Homo sapiens
augaaggcaggugugaguuu

SEQ ID NO: 220319 - RNA, 18 nt, Homo sapiens
augaagucaucacuuuua

SEQ ID NO: 220320 - RNA, 22 nt, Homo sapiens
augaauguaaagaaugugggaa

SEQ ID NO: 220321 - RNA, 23 nt, Homo sapiens
augaauguaaggaguguaagaaa

SEQ ID NO: 220322 - RNA, 20 nt, Homo sapiens
augaauguccuugauggcau

SEQ ID NO: 220323 - RNA, 22 nt, Homo sapiens
augacaagaguguucagggaga

SEQ ID NO: 220324 - RNA, 22 nt, Homo sapiens
augacauuccacagccguagag

SEQ ID NO: 220325 - RNA, 22 nt, Homo sapiens
augacauugaaaagcaagugga

SEQ ID NO: 220326 - RNA, 22 nt, Homo sapiens
augaccaaagaaaugcuauagg

SEQ ID NO: 220327 - RNA, 22 nt, Homo sapiens
augaccagagguaugauguuug

SEQ ID NO: 220328 - RNA, 18 nt, Homo sapiens
augacucuggguguuccu

SEQ ID NO: 220329 - RNA, 22 nt, Homo sapiens
augacuggaacggcacuuuaca

SEQ ID NO: 220330 - RNA, 22 nt, Homo sapiens
augacugucagggcagucauug

SEQ ID NO: 220331 - RNA, 17 nt, Homo sapiens
augacuucuucagugug

SEQ ID NO: 220332 - RNA, 22 nt, Homo sapiens
augacuuuucugaaaaccacca

SEQ ID NO: 220333 - RNA, 19 nt, Homo sapiens
augagaacagacuccauuu

SEQ ID NO: 220334 - RNA, 22 nt, Homo sapiens
augagaaucauuucagcuugua

SEQ ID NO: 220335 - RNA, 22 nt, Homo sapiens
augagaaugaagccuggcgugu

SEQ ID NO: 220336 - RNA, 22 nt, Homo sapiens
augagacuguucuuccucauug

SEQ ID NO: 220337 - RNA, 22 nt, Homo sapiens
augagauaggaacaaacuuaca

SEQ ID NO: 220338 - RNA, 22 nt, Homo sapiens
augagcagaugcuccugccucu

SEQ ID NO: 220339 - RNA, 22 nt, Homo sapiens
augaggaagucaggcccagggg

SEQ ID NO: 220340 - RNA, 22 nt, Homo sapiens
augaggagauauuaaauaccau

SEQ ID NO: 220341 - RNA, 22 nt, Homo sapiens
augagggaagcucacgugucca

SEQ ID NO: 220342 - RNA, 22 nt, Homo sapiens
augagggagggcaccugaccuu

SEQ ID NO: 220343 - RNA, 22 nt, Homo sapiens
augagguauccaagcccagaaa

SEQ ID NO: 220344 - RNA, 22 nt, Homo sapiens
augaggugaguaaauaaaugaa

SEQ ID NO: 220345 - RNA, 22 nt, Homo sapiens
augaggugcagaggaaaugagu

SEQ ID NO: 220346 - RNA, 22 nt, Homo sapiens
augaggugggagaaucacuuga

SEQ ID NO: 220347 - RNA, 22 nt, Homo sapiens
augaguaugagaauacauuaag

SEQ ID NO: 220348 - RNA, 18 nt, Homo sapiens
augagucauuguggaaau

SEQ ID NO: 220349 - RNA, 19 nt, Homo sapiens
augagucugcaagaaccag

SEQ ID NO: 220350 - RNA, 22 nt, Homo sapiens
augaguuccuuccuugccuagg

SEQ ID NO: 220351 - RNA, 22 nt, Homo sapiens
augauacuguucuaagauuuuu

SEQ ID NO: 220352 - RNA, 22 nt, Homo sapiens
augauauggguugucaguugua

SEQ ID NO: 220353 - RNA, 22 nt, Homo sapiens
augaucacuguggaaauucagc

SEQ ID NO: 220354 - RNA, 22 nt, Homo sapiens
augaucaucugaaagcuuuuac

SEQ ID NO: 220355 - RNA, 22 nt, Homo sapiens
augaugcaguacuuugggaaca

SEQ ID NO: 220356 - RNA, 22 nt, Homo sapiens
augaugucauuuuaauuucuaa

SEQ ID NO: 220357 - RNA, 22 nt, Homo sapiens
augauguccacagggguguuca

SEQ ID NO: 220358 - RNA, 22 nt, Homo sapiens
augauucugaucuagagcuugg

SEQ ID NO: 220359 - RNA, 22 nt, Homo sapiens
augcaaacaucauagaguguac

SEQ ID NO: 220360 - RNA, 22 nt, Homo sapiens
augcaaacaucugaagagacau

SEQ ID NO: 220361 - RNA, 22 nt, Homo sapiens
augcaacuugaaauuuuccgga

SEQ ID NO: 220362 - RNA, 22 nt, Homo sapiens
augcaagacaccacgugagaau

SEQ ID NO: 220363 - RNA, 22 nt, Homo sapiens
augcaauucuagauugauagua

SEQ ID NO: 220364 - RNA, 22 nt, Homo sapiens
augcacauauguacugcccuau

SEQ ID NO: 220365 - RNA, 22 nt, Homo sapiens
augcacaugcgaaaacuugugu

SEQ ID NO: 220366 - RNA, 22 nt, Homo sapiens
augcagagaaaucuaaaauaug

SEQ ID NO: 220367 - RNA, 22 nt, Homo sapiens
augcagagucccagccccuagc

SEQ ID NO: 220368 - RNA, 22 nt, Homo sapiens
augcagauauuuuugugguugc

SEQ ID NO: 220369 - RNA, 22 nt, Homo sapiens
augcagcugaggguaguggagc

SEQ ID NO: 220370 - RNA, 22 nt, Homo sapiens
augcagugugcaacagauuaag

SEQ ID NO: 220371 - RNA, 22 nt, Homo sapiens
augcauagugggaugcucugug

SEQ ID NO: 220372 - RNA, 22 nt, Homo sapiens
augcauaugucuuuauaguggc

SEQ ID NO: 220373 - RNA, 22 nt, Homo sapiens
augcauggagucuuucacaagu

SEQ ID NO: 220374 - RNA, 22 nt, Homo sapiens
augcauggcagagucaggguac

SEQ ID NO: 220375 - RNA, 22 nt, Homo sapiens
augccaagagacaaagggaauc

SEQ ID NO: 220376 - RNA, 20 nt, Homo sapiens
augccacugagcagugguga

SEQ ID NO: 220377 - RNA, 22 nt, Homo sapiens
augccacugcacuucagccugc

SEQ ID NO: 220378 - RNA, 22 nt, Homo sapiens
augccaguguccagaguggguu

SEQ ID NO: 220379 - RNA, 22 nt, Homo sapiens
augcccauuuguuuucugaaag

SEQ ID NO: 220380 - RNA, 19 nt, Homo sapiens
augccucaguuuuguacuu

SEQ ID NO: 220381 - RNA, 22 nt, Homo sapiens
augcuacuggacaauggugacu

SEQ ID NO: 220382 - RNA, 22 nt, Homo sapiens
augcuuguguuggggcagugga

SEQ ID NO: 220383 - RNA, 22 nt, Homo sapiens
auggaaacauaagaguauagau

SEQ ID NO: 220384 - RNA, 22 nt, Homo sapiens
auggaaagcuguuccuacacaa

SEQ ID NO: 220385 - RNA, 22 nt, Homo sapiens
auggaacauuauagauguaaaa

SEQ ID NO: 220386 - RNA, 22 nt, Homo sapiens
auggaacugaagugcugcccuu

SEQ ID NO: 220387 - RNA, 22 nt, Homo sapiens
auggaacuggagaugguuauau

SEQ ID NO: 220388 - RNA, 22 nt, Homo sapiens
auggaagaaaguuggguucuug

SEQ ID NO: 220389 - RNA, 22 nt, Homo sapiens
auggaagaauugucggggaugu

SEQ ID NO: 220390 - RNA, 22 nt, Homo sapiens
auggaaggagaauggucuuuga

SEQ ID NO: 220391 - RNA, 22 nt, Homo sapiens
auggaauggcacuuugaagauu

SEQ ID NO: 220392 - RNA, 22 nt, Homo sapiens
auggaaugguugggucauaagg

SEQ ID NO: 220393 - RNA, 22 nt, Homo sapiens
auggaauguaaguuauguuugc

SEQ ID NO: 220394 - RNA, 22 nt, Homo sapiens
auggaauguauagucauguagg

SEQ ID NO: 220395 - RNA, 22 nt, Homo sapiens
auggacagaaaaaaauagaugu

SEQ ID NO: 220396 - RNA, 22 nt, Homo sapiens
auggacauuaaagcgauguaga

SEQ ID NO: 220397 - RNA, 22 nt, Homo sapiens
auggacuuuuuguucagugucu

SEQ ID NO: 220398 - RNA, 20 nt, Homo sapiens
gggaaucguaauagaauauu

SEQ ID NO: 220399 - RNA, 22 nt, Homo sapiens
gggauuguaauacugaguuggu

SEQ ID NO: 220400 - RNA, 18 nt, Homo sapiens
gggcaaguugccuggcuu

SEQ ID NO: 220401 - RNA, 22 nt, Homo sapiens
gggcaguauggucauuuucaca

SEQ ID NO: 220402 - RNA, 22 nt, Homo sapiens
gggcaugauggugcacacaugu

SEQ ID NO: 220403 - RNA, 22 nt, Homo sapiens
gggcaugaugucuuaugccuau

SEQ ID NO: 220404 - RNA, 16 nt, Homo sapiens
gggcaugugaagccua

SEQ ID NO: 220405 - RNA, 22 nt, Homo sapiens
gggcauugugggcagagggcag

SEQ ID NO: 220406 - RNA, 22 nt, Homo sapiens
gggccagaugcauuuguuauuu

SEQ ID NO: 220407 - RNA, 17 nt, Homo sapiens
gggucaccuugcaggua

SEQ ID NO: 220408 - RNA, 19 nt, Homo sapiens
gggucaguuugaaugauua

SEQ ID NO: 220409 - RNA, 22 nt, Homo sapiens
gggucaguuuugagaaagcgug

SEQ ID NO: 220410 - RNA, 22 nt, Homo sapiens
gguagacucuguaagugaucau

SEQ ID NO: 220411 - RNA, 22 nt, Homo sapiens
gguaggcacuggugggaagaga

SEQ ID NO: 220412 - RNA, 22 nt, Homo sapiens
gguauguagcaaaagaggugcu

SEQ ID NO: 220413 - RNA, 22 nt, Homo sapiens
gguauguagugugaaguaggga

SEQ ID NO: 220414 - RNA, 22 nt, Homo sapiens
gguauugguugagauuaacuuu

SEQ ID NO: 220415 - RNA, 22 nt, Homo sapiens
ggucacauugcuagcauggguu

SEQ ID NO: 220416 - RNA, 19 nt, Homo sapiens
ggucccucucaagucauuc

SEQ ID NO: 220417 - RNA, 22 nt, Homo sapiens
ggugacugguuuaucuggcagu

SEQ ID NO: 220418 - RNA, 21 nt, Homo sapiens
ggugagaaaggagacauagac

SEQ ID NO: 220419 - RNA, 22 nt, Homo sapiens
ggugagaaagggauuccuguuc

SEQ ID NO: 220420 - RNA, 23 nt, Homo sapiens
ggugaggaguacagagucuucau

SEQ ID NO: 220421 - RNA, 22 nt, Homo sapiens
ggugagguaggaaaaguuagga

SEQ ID NO: 220422 - RNA, 22 nt, Homo sapiens
ggugaguggugcuuaaguucag

SEQ ID NO: 220423 - RNA, 22 nt, Homo sapiens
ggugcuugaggaacggaggcug

SEQ ID NO: 220424 - RNA, 22 nt, Homo sapiens
gguggcuuuuugugauggcuga

SEQ ID NO: 220425 - RNA, 22 nt, Homo sapiens
gguggucuuccccuggaguucg

SEQ ID NO: 220426 - RNA, 22 nt, Homo sapiens
gguggugguauuucagaaaaug

SEQ ID NO: 220427 - RNA, 22 nt, Homo sapiens
guaaagacacaugcacacguau

SEQ ID NO: 220428 - RNA, 22 nt, Homo sapiens
guaacacaugcugcucucuggu

SEQ ID NO: 220429 - RNA, 22 nt, Homo sapiens
guaacccuguaggccuaaagua

SEQ ID NO: 220430 - RNA, 22 nt, Homo sapiens
guaacguaaugucaaaaucuau

SEQ ID NO: 220431 - RNA, 22 nt, Homo sapiens
guaaggcuucuggucaacagca

SEQ ID NO: 220432 - RNA, 22 nt, Homo sapiens
guaaguauuaggugugagauuc

SEQ ID NO: 220433 - RNA, 23 nt, Homo sapiens
guaauacuagucauaguagcagg

SEQ ID NO: 220434 - RNA, 22 nt, Homo sapiens
guaauacuuuugggauauuaga

SEQ ID NO: 220435 - RNA, 22 nt, Homo sapiens
guaaucucagcuacucgggagg

SEQ ID NO: 220436 - RNA, 22 nt, Homo sapiens
guaaucucagcuacuugggagc

SEQ ID NO: 220437 - RNA, 22 nt, Homo sapiens
guaaucucagcuucuugggagg

SEQ ID NO: 220438 - RNA, 19 nt, Homo sapiens
guaaucucaguacuuuggu

SEQ ID NO: 220439 - RNA, 22 nt, Homo sapiens
guaaugaacuugaaagccuguu

SEQ ID NO: 220440 - RNA, 22 nt, Homo sapiens
guacacaacaugcagguuuguu

SEQ ID NO: 220441 - RNA, 17 nt, Homo sapiens
guacacuucuucuguga

SEQ ID NO: 220442 - RNA, 22 nt, Homo sapiens
guacaggcagcaaacaccauaa

SEQ ID NO: 220443 - RNA, 22 nt, Homo sapiens
guacaggugcaggaugggcagg

SEQ ID NO: 220444 - RNA, 22 nt, Homo sapiens
guacaguggguguagggaccag

SEQ ID NO: 220445 - RNA, 22 nt, Homo sapiens
guacaugcaugcaugggugugc

SEQ ID NO: 220446 - RNA, 22 nt, Homo sapiens
guaccacaguugcucacggguu

SEQ ID NO: 220447 - RNA, 22 nt, Homo sapiens
guacugagagacaguuacuguu

SEQ ID NO: 220448 - RNA, 22 nt, Homo sapiens
guacuguuucauuggagauuaa

SEQ ID NO: 220449 - RNA, 22 nt, Homo sapiens
guacuuagagauagggucuuua

SEQ ID NO: 220450 - RNA, 22 nt, Homo sapiens
guagaaagcauuucagauuugc

SEQ ID NO: 220451 - RNA, 22 nt, Homo sapiens
uaaacugucuuuggagcuuugc

SEQ ID NO: 220452 - RNA, 22 nt, Homo sapiens
uaaagcacuuuuuucugcaugg

SEQ ID NO: 220453 - RNA, 17 nt, Homo sapiens
uaaagccagucaaguca

SEQ ID NO: 220454 - RNA, 22 nt, Homo sapiens
uaaagcuacagagcggaaaauu

SEQ ID NO: 220455 - RNA, 22 nt, Homo sapiens
uaaagcuacaguauaugguauu

SEQ ID NO: 220456 - RNA, 22 nt, Homo sapiens
uaaagcuagaauuguuccagca

SEQ ID NO: 220457 - RNA, 22 nt, Homo sapiens
uaaagcuagagcuggaguggca

SEQ ID NO: 220458 - RNA, 22 nt, Homo sapiens
uaaagcuauuauaguuauguuu

SEQ ID NO: 220459 - RNA, 22 nt, Homo sapiens
uaaagcuuagauccaugguggc

SEQ ID NO: 220460 - RNA, 22 nt, Homo sapiens
uaaaguuauugccccucaguua

SEQ ID NO: 220461 - RNA, 22 nt, Homo sapiens
uaaaguucuuuuaugggccggg

SEQ ID NO: 220462 - RNA, 22 nt, Homo sapiens
uaaauggauauugccaucuccu

SEQ ID NO: 220463 - RNA, 19 nt, Homo sapiens
uaacacaguuguguuugag

SEQ ID NO: 220464 - RNA, 22 nt, Homo sapiens
uaacaguauauuuaccaaaccu

SEQ ID NO: 220465 - RNA, 22 nt, Homo sapiens
uaacccacgcagaauggacaag

SEQ ID NO: 220466 - RNA, 22 nt, Homo sapiens
uaacccagugucugugaugggu

SEQ ID NO: 220467 - RNA, 22 nt, Homo sapiens
uaacccuuacaacuacacucgu

SEQ ID NO: 220468 - RNA, 22 nt, Homo sapiens
uaacuaaagagaagucaauguc

SEQ ID NO: 220469 - RNA, 22 nt, Homo sapiens
uaacuacuucugcuucagagua

SEQ ID NO: 220470 - RNA, 22 nt, Homo sapiens
uaacuauagagaauguugagua

SEQ ID NO: 220471 - RNA, 22 nt, Homo sapiens
uaacuccauuuggacucaguau

SEQ ID NO: 220472 - RNA, 18 nt, Homo sapiens
uaacuggugugagauggu

SEQ ID NO: 220473 - RNA, 22 nt, Homo sapiens
uaacugucucaggccaugggcg

SEQ ID NO: 220474 - RNA, 22 nt, Homo sapiens
uaacuguggaaaugacuuuaaa

SEQ ID NO: 220475 - RNA, 20 nt, Homo sapiens
uaacuguggcuucuuuuggc

SEQ ID NO: 220476 - RNA, 21 nt, Homo sapiens
uaagacugccaguagggcugu

SEQ ID NO: 220477 - RNA, 19 nt, Homo sapiens
uaagaugaagcugucuggg

SEQ ID NO: 220478 - RNA, 22 nt, Homo sapiens
uaagaugcagauuugggcgggg

SEQ ID NO: 220479 - RNA, 22 nt, Homo sapiens
uaagcaguaaaugaagucuugc

SEQ ID NO: 220480 - RNA, 22 nt, Homo sapiens
uaagcuagcauagggguaaauu

SEQ ID NO: 220481 - RNA, 22 nt, Homo sapiens
uaagcuguguggacuaugccuc

SEQ ID NO: 220482 - RNA, 22 nt, Homo sapiens
uaaggcaaaccuuggcugcagu

SEQ ID NO: 220483 - RNA, 22 nt, Homo sapiens
uaaggcaaguuuuuaguggaca

SEQ ID NO: 220484 - RNA, 22 nt, Homo sapiens
uaaggcccggccuuuccaagca

SEQ ID NO: 220485 - RNA, 22 nt, Homo sapiens
uaaggcuugaucuuggugagau

SEQ ID NO: 220486 - RNA, 22 nt, Homo sapiens
uaaggcuugcuucagucuugaa

SEQ ID NO: 220487 - RNA, 22 nt, Homo sapiens
uaaggcuuugucuuaggacuuu

SEQ ID NO: 220488 - RNA, 22 nt, Homo sapiens
uaagggcacuaaucccauuuau

SEQ ID NO: 220489 - RNA, 22 nt, Homo sapiens
ugaauagagcugcaguggacau

SEQ ID NO: 220490 - RNA, 22 nt, Homo sapiens
ugaauaguaauguguuuggucu

SEQ ID NO: 220491 - RNA, 22 nt, Homo sapiens
ugaauauguuaaauaauguucu

SEQ ID NO: 220492 - RNA, 21 nt, Homo sapiens
ugaauauuuggguugugucca

SEQ ID NO: 220493 - RNA, 22 nt, Homo sapiens
ugaaugcaucauguagggcuca

SEQ ID NO: 220494 - RNA, 22 nt, Homo sapiens
ugaaugcuaaaggaaaacagua

SEQ ID NO: 220495 - RNA, 22 nt, Homo sapiens
ugaaugguaauuuaguaggcac

SEQ ID NO: 220496 - RNA, 22 nt, Homo sapiens
ugaauguaacuaaaccugugaa

SEQ ID NO: 220497 - RNA, 22 nt, Homo sapiens
ugaauguaacuaaaggacuuuu

SEQ ID NO: 220498 - RNA, 22 nt, Homo sapiens
ugaauguacuuaacacuggauu

SEQ ID NO: 220499 - RNA, 22 nt, Homo sapiens
ugaauuguuuacgagaugugag

SEQ ID NO: 220500 - RNA, 23 nt, Homo sapiens
ugacaaccucaugcuuugucaug

SEQ ID NO: 220501 - RNA, 22 nt, Homo sapiens
ugacaagacuacauaucccauu

SEQ ID NO: 220502 - RNA, 20 nt, Homo sapiens
ugacaagugagaauuauggg

SEQ ID NO: 220503 - RNA, 22 nt, Homo sapiens
ugacaagugauuaaggcauauu

SEQ ID NO: 220504 - RNA, 22 nt, Homo sapiens
ugacacagugggggauccuuuu

SEQ ID NO: 220505 - RNA, 22 nt, Homo sapiens
ugacacauguagacaucuggug

SEQ ID NO: 220506 - RNA, 22 nt, Homo sapiens
ugacacuugcccuuagaaacau

SEQ ID NO: 220507 - RNA, 22 nt, Homo sapiens
ugacagaggucuuuuaauagcu

SEQ ID NO: 220508 - RNA, 18 nt, Homo sapiens
ugacagcacaugugggga

SEQ ID NO: 220509 - RNA, 22 nt, Homo sapiens
ugacaggauggagaucgguauu

SEQ ID NO: 220510 - RNA, 22 nt, Homo sapiens
ugacaguaaacagucuugauua

SEQ ID NO: 220511 - RNA, 22 nt, Homo sapiens
ugacaguguccucauucccaac

SEQ ID NO: 220512 - RNA, 22 nt, Homo sapiens
ugacagugugagacuuugucuc

SEQ ID NO: 220513 - RNA, 22 nt, Homo sapiens
ugacagugugagauccugucuc

SEQ ID NO: 220514 - RNA, 22 nt, Homo sapiens
ugacaguuuccagggcugucuc

SEQ ID NO: 220515 - RNA, 22 nt, Homo sapiens
ugacaugagauuugggaggggc

SEQ ID NO: 220516 - RNA, 22 nt, Homo sapiens
ugacauggugcucuuucaggca

SEQ ID NO: 220517 - RNA, 22 nt, Homo sapiens
ugacauguauaucuuacgcuau

SEQ ID NO: 220518 - RNA, 22 nt, Homo sapiens
ugacauguauuagcucagugcu

SEQ ID NO: 220519 - RNA, 22 nt, Homo sapiens
ugacauguugcauuauauuucc

SEQ ID NO: 220520 - RNA, 21 nt, Homo sapiens
ugacauguugguguucugcac

SEQ ID NO: 220521 - RNA, 18 nt, Homo sapiens
ugacauugagcugagaaa

SEQ ID NO: 220522 - RNA, 22 nt, Homo sapiens
ugaccaaugacauugaagagcu

SEQ ID NO: 220523 - RNA, 22 nt, Homo sapiens
ugaccacagaaagugagggagc

SEQ ID NO: 220524 - RNA, 19 nt, Homo sapiens
ugaccagggacagaaacca

SEQ ID NO: 220525 - RNA, 22 nt, Homo sapiens
ugaccucugauagcaguaggug

SEQ ID NO: 220526 - RNA, 22 nt, Homo sapiens
ugacuacacacaauuugucaag

SEQ ID NO: 220527 - RNA, 22 nt, Homo sapiens
ugacuagagcaauuggaaacaa

SEQ ID NO: 220528 - RNA, 21 nt, Homo sapiens
ugacuagauuccagauuggcc

SEQ ID NO: 220529 - RNA, 22 nt, Homo sapiens
ugacuagucauaggcauggggg

SEQ ID NO: 220530 - RNA, 22 nt, Homo sapiens
ugacuaguuuugcuguuguuau

SEQ ID NO: 220531 - RNA, 22 nt, Homo sapiens
ugacuauaggauaacaugcauu

SEQ ID NO: 220532 - RNA, 22 nt, Homo sapiens
ugacuauaguaaucacuucaca

SEQ ID NO: 220533 - RNA, 22 nt, Homo sapiens
ugacuccagagacugugcuguc

SEQ ID NO: 220534 - RNA, 22 nt, Homo sapiens
ugacuggaaacaguguuauuug

SEQ ID NO: 220535 - RNA, 18 nt, Homo sapiens
ugacuguccagguggacc

SEQ ID NO: 220536 - RNA, 22 nt, Homo sapiens
ugacugucuagauagagcuugg

SEQ ID NO: 220537 - RNA, 22 nt, Homo sapiens
ugacuugaaguuaccauaugca

SEQ ID NO: 220538 - RNA, 22 nt, Homo sapiens
ugacuugaguaacuggcucagg

SEQ ID NO: 220539 - RNA, 22 nt, Homo sapiens
ugagaacagauggcuuuauuau

SEQ ID NO: 220540 - RNA, 22 nt, Homo sapiens
ugagaacagcagcuugggacac

SEQ ID NO: 220541 - RNA, 20 nt, Homo sapiens
ugagaacauguggcauuugg

SEQ ID NO: 220542 - RNA, 17 nt, Homo sapiens
ugagaacaugugguauu

SEQ ID NO: 220543 - RNA, 20 nt, Homo sapiens
ugagaacaugugguauuugg

SEQ ID NO: 220544 - RNA, 18 nt, Homo sapiens
ugagaacauguguacaca

SEQ ID NO: 220545 - RNA, 22 nt, Homo sapiens
ugagaaccucugugugcccacu

SEQ ID NO: 220546 - RNA, 22 nt, Homo sapiens
ugagaacuuauggugauuuuuu

SEQ ID NO: 220547 - RNA, 22 nt, Homo sapiens
ugagaagaugaacuccuugguc

SEQ ID NO: 220548 - RNA, 22 nt, Homo sapiens
ugagaaugacugggcaugcugc

SEQ ID NO: 220549 - RNA, 22 nt, Homo sapiens
ugagaaugaugauuuccaguuu

SEQ ID NO: 220550 - RNA, 22 nt, Homo sapiens
ugagacaaaguuguuggauguu

SEQ ID NO: 220551 - RNA, 22 nt, Homo sapiens
ugagacacugaauccggccuga

SEQ ID NO: 220552 - RNA, 22 nt, Homo sapiens
ugagacauacuuacaggggaug

SEQ ID NO: 220553 - RNA, 22 nt, Homo sapiens
ugagacaucucuccugagacag

SEQ ID NO: 220554 - RNA, 23 nt, Homo sapiens
ugagacauuggaaaguuaggcag

SEQ ID NO: 220555 - RNA, 22 nt, Homo sapiens
ugagacggagucucgcuguguc

SEQ ID NO: 220556 - RNA, 22 nt, Homo sapiens
ugagacggagucuugcuaaguu

SEQ ID NO: 220557 - RNA, 22 nt, Homo sapiens
ugagacugaguuuugccuuugu

SEQ ID NO: 220558 - RNA, 22 nt, Homo sapiens
ugagacugaguuuugcucguug

SEQ ID NO: 220559 - RNA, 22 nt, Homo sapiens
ugagagaugaacuauucuugaa

SEQ ID NO: 220560 - RNA, 22 nt, Homo sapiens
ugagagaugaacucugauaugu

SEQ ID NO: 220561 - RNA, 22 nt, Homo sapiens
ugagagaugauaaaauguuugu

SEQ ID NO: 220562 - RNA, 19 nt, Homo sapiens
ugagagcacaacugaacaa

SEQ ID NO: 220563 - RNA, 22 nt, Homo sapiens
ugagagcugguuguuuaaagga

SEQ ID NO: 220564 - RNA, 22 nt, Homo sapiens
ugagaggugaauggcaggcuca

SEQ ID NO: 220565 - RNA, 22 nt, Homo sapiens
ugagaggugauaaagcaagggu

SEQ ID NO: 220566 - RNA, 22 nt, Homo sapiens
ugagaguagggguugggauugg

SEQ ID NO: 220567 - RNA, 21 nt, Homo sapiens
ugagaguaguguauuauucuc

SEQ ID NO: 220568 - RNA, 22 nt, Homo sapiens
ugagaguauaaauugaugcagc

SEQ ID NO: 220569 - RNA, 21 nt, Homo sapiens
ugagauaauauguuucugaug

SEQ ID NO: 220570 - RNA, 22 nt, Homo sapiens
ugagauaaucaugugguuuuug

SEQ ID NO: 220571 - RNA, 22 nt, Homo sapiens
ugagauaguuguagauguacau

SEQ ID NO: 220572 - RNA, 22 nt, Homo sapiens
ugagauauugggaguaauguca

SEQ ID NO: 220573 - RNA, 22 nt, Homo sapiens
ugagaucaacugagucagagca

SEQ ID NO: 220574 - RNA, 22 nt, Homo sapiens
ugagaucaaggugggcccuggg

SEQ ID NO: 220575 - RNA, 22 nt, Homo sapiens
ugagaucaagguuaauauaauc

SEQ ID NO: 220576 - RNA, 18 nt, Homo sapiens
ugagaucagcaucaaggg

SEQ ID NO: 220577 - RNA, 19 nt, Homo sapiens
ugagauccacugaagauuc

SEQ ID NO: 220578 - RNA, 22 nt, Homo sapiens
ugagauccugagaguugggacu

SEQ ID NO: 220579 - RNA, 22 nt, Homo sapiens
ugagaucuuaucagaaauggug

SEQ ID NO: 220580 - RNA, 22 nt, Homo sapiens
ugagaucuucgcucuucacaga

SEQ ID NO: 220581 - RNA, 22 nt, Homo sapiens
ugagaucuuuuguggcugagaa

SEQ ID NO: 220582 - RNA, 22 nt, Homo sapiens
ugagaugagggcugcacucaaa

SEQ ID NO: 220583 - RNA, 22 nt, Homo sapiens
ugagaugauaucuuauuguaau

SEQ ID NO: 220584 - RNA, 22 nt, Homo sapiens
ugagaugaucaaaguauaggcu

SEQ ID NO: 220585 - RNA, 21 nt, Homo sapiens
ugagaugauccugcaugcaug

SEQ ID NO: 220586 - RNA, 22 nt, Homo sapiens
ugagaugaugggauaagagggc

SEQ ID NO: 220587 - RNA, 22 nt, Homo sapiens
auacgugcaggucacaggggau

SEQ ID NO: 220588 - RNA, 22 nt, Homo sapiens
auacuccugucucagcugagau

SEQ ID NO: 220589 - RNA, 22 nt, Homo sapiens
auacugguuuuugucaugugga

SEQ ID NO: 220590 - RNA, 20 nt, Homo sapiens
auagaagacuagugcagcag

SEQ ID NO: 220591 - RNA, 22 nt, Homo sapiens
auagaaucaucugugcacuagu

SEQ ID NO: 220592 - RNA, 22 nt, Homo sapiens
auagacugaguggcuuaaacca

SEQ ID NO: 220593 - RNA, 22 nt, Homo sapiens
auagaucauugucauuuuagau

SEQ ID NO: 220594 - RNA, 22 nt, Homo sapiens
auagcaaugccccaauccuugg

SEQ ID NO: 220595 - RNA, 22 nt, Homo sapiens
auagcaauuugggaaucagacu

SEQ ID NO: 220596 - RNA, 22 nt, Homo sapiens
auagcacaugugcaaauggcug

SEQ ID NO: 220597 - RNA, 22 nt, Homo sapiens
auagcacuuaccacaggcugca

SEQ ID NO: 220598 - RNA, 22 nt, Homo sapiens
auagcagaagaagggacaauuc

SEQ ID NO: 220599 - RNA, 22 nt, Homo sapiens
auagcagacauuucaaggcagg

SEQ ID NO: 220600 - RNA, 22 nt, Homo sapiens
auagcagcaccucacucuacug

SEQ ID NO: 220601 - RNA, 20 nt, Homo sapiens
auagcagcaugauuuauaau

SEQ ID NO: 220602 - RNA, 20 nt, Homo sapiens
auagcagcaugauuuauagu

SEQ ID NO: 220603 - RNA, 22 nt, Homo sapiens
auagcagcuugucagggcagac

SEQ ID NO: 220604 - RNA, 22 nt, Homo sapiens
auagcaggagaauggucauggg

SEQ ID NO: 220605 - RNA, 22 nt, Homo sapiens
auagcagugugaaaauguacua

SEQ ID NO: 220606 - RNA, 22 nt, Homo sapiens
auagcauagucagcuucgcuga

SEQ ID NO: 220607 - RNA, 22 nt, Homo sapiens
auagcauaucccacaugucaga

SEQ ID NO: 220608 - RNA, 22 nt, Homo sapiens
auagcuguccuuacuagcuagg

SEQ ID NO: 220609 - RNA, 22 nt, Homo sapiens
auaggagcacgaacucuagugu

SEQ ID NO: 220610 - RNA, 19 nt, Homo sapiens
auagggcuagcauauacug

SEQ ID NO: 220611 - RNA, 22 nt, Homo sapiens
auagguagcauagcaggaauau

SEQ ID NO: 220612 - RNA, 22 nt, Homo sapiens
auagucaaaucucauuaccccc

SEQ ID NO: 220613 - RNA, 22 nt, Homo sapiens
auagucaguagucucauaauga

SEQ ID NO: 220614 - RNA, 22 nt, Homo sapiens
auagugcuauggcagaccuuga

SEQ ID NO: 220615 - RNA, 22 nt, Homo sapiens
auagugcugcaagaaacauacg

SEQ ID NO: 220616 - RNA, 22 nt, Homo sapiens
auagugcugcaauaaacauacg

SEQ ID NO: 220617 - RNA, 22 nt, Homo sapiens
auagugcugcaauaaacauaug

SEQ ID NO: 220618 - RNA, 22 nt, Homo sapiens
auagugcugcaaugaacauaca

SEQ ID NO: 220619 - RNA, 22 nt, Homo sapiens
auagugcugcacuaaacauaca

SEQ ID NO: 220620 - RNA, 22 nt, Homo sapiens
auagugcuuuugaaucuuguug

SEQ ID NO: 220621 - RNA, 22 nt, Homo sapiens
auauagcucuggcuggaugacu

SEQ ID NO: 220622 - RNA, 22 nt, Homo sapiens
auaugcaaauccauagagacag

SEQ ID NO: 220623 - RNA, 22 nt, Homo sapiens
auaugcauacccucaccaacua

SEQ ID NO: 220624 - RNA, 22 nt, Homo sapiens
auaugcauguacccacacaggc

SEQ ID NO: 220625 - RNA, 19 nt, Homo sapiens
auaugggguuugaacugug

SEQ ID NO: 220626 - RNA, 22 nt, Homo sapiens
auauguauuuuaacguguaagg

SEQ ID NO: 220627 - RNA, 17 nt, Homo sapiens
auaugucugcuggggga

SEQ ID NO: 220628 - RNA, 22 nt, Homo sapiens
auaugucuuaguuaccuugggc

SEQ ID NO: 220629 - RNA, 22 nt, Homo sapiens
auaugugacuucaugcaaggcu

SEQ ID NO: 220630 - RNA, 22 nt, Homo sapiens
auauuacagagaggaccuggga

SEQ ID NO: 220631 - RNA, 22 nt, Homo sapiens
auauuacuggccauaucgcagg

SEQ ID NO: 220632 - RNA, 22 nt, Homo sapiens
auauuagcacuaaugucacgau

SEQ ID NO: 220633 - RNA, 22 nt, Homo sapiens
auauucacagguaucagagauu

SEQ ID NO: 220634 - RNA, 18 nt, Homo sapiens
auauugccuucagacuag

SEQ ID NO: 220635 - RNA, 22 nt, Homo sapiens
auauugcuugaggccaggaggu

SEQ ID NO: 220636 - RNA, 22 nt, Homo sapiens
auauuggacucugugcuaggaa

SEQ ID NO: 220637 - RNA, 22 nt, Homo sapiens
auauuguacugcuacugguucu

SEQ ID NO: 220638 - RNA, 22 nt, Homo sapiens
aucaaacugcaaggcagcagca

SEQ ID NO: 220639 - RNA, 19 nt, Homo sapiens
aucaaacugcucuuugagg

SEQ ID NO: 220640 - RNA, 22 nt, Homo sapiens
aucaaagccaugcucaguuuuc

SEQ ID NO: 220641 - RNA, 22 nt, Homo sapiens
aucaaaucuccagaaccugucu

SEQ ID NO: 220642 - RNA, 22 nt, Homo sapiens
aucaaaugcuggcagagugccu

SEQ ID NO: 220643 - RNA, 22 nt, Homo sapiens
aucaagcuacacccuuuggaaa

SEQ ID NO: 220644 - RNA, 22 nt, Homo sapiens
aucaaguaaucugaguaagagu

SEQ ID NO: 220645 - RNA, 22 nt, Homo sapiens
aucacaauuguacguaggagcc

SEQ ID NO: 220646 - RNA, 22 nt, Homo sapiens
aucacagcuacuccucugucuu

SEQ ID NO: 220647 - RNA, 22 nt, Homo sapiens
aucacagguacuauggcugaca

SEQ ID NO: 220648 - RNA, 22 nt, Homo sapiens
aucacaguggucagguauagau

SEQ ID NO: 220649 - RNA, 22 nt, Homo sapiens
aucacaguuauaacauccuuuu

SEQ ID NO: 220650 - RNA, 22 nt, Homo sapiens
aucacaguuuuaccauuuggua

SEQ ID NO: 220651 - RNA, 22 nt, Homo sapiens
aucacauuuauaguggcacgca

SEQ ID NO: 220652 - RNA, 22 nt, Homo sapiens
aucaccauguguacauuagacc

SEQ ID NO: 220653 - RNA, 22 nt, Homo sapiens
aucaccuggaggugaucacuug

SEQ ID NO: 220654 - RNA, 22 nt, Homo sapiens
aucacguguguuuaugcuacgc

SEQ ID NO: 220655 - RNA, 22 nt, Homo sapiens
aucacuggccuuuuuaaaugcu

SEQ ID NO: 220656 - RNA, 22 nt, Homo sapiens
aucacuguaaguuuacacuuug

SEQ ID NO: 220657 - RNA, 22 nt, Homo sapiens
aucagaaucucuugagaguguu

SEQ ID NO: 220658 - RNA, 22 nt, Homo sapiens
aucagauaccuguugggaaaug

SEQ ID NO: 220659 - RNA, 22 nt, Homo sapiens
aucagauggcuaaaacagaaga

SEQ ID NO: 220660 - RNA, 22 nt, Homo sapiens
aucagauguuuguauaggagua

SEQ ID NO: 220661 - RNA, 22 nt, Homo sapiens
aucagcacugaucauacagcuu

SEQ ID NO: 220662 - RNA, 22 nt, Homo sapiens
aucagcagcaugaaaagcaacu

SEQ ID NO: 220663 - RNA, 22 nt, Homo sapiens
aucagcauucccaaaugaugug

SEQ ID NO: 220664 - RNA, 18 nt, Homo sapiens
aucagggugaagagagga

SEQ ID NO: 220665 - RNA, 22 nt, Homo sapiens
aucagugagugguuagugaaug

SEQ ID NO: 220666 - RNA, 22 nt, Homo sapiens
aucauaucaucugcaaacaaag

SEQ ID NO: 220667 - RNA, 22 nt, Homo sapiens
aucaugucuucccagugauucu

SEQ ID NO: 220668 - RNA, 22 nt, Homo sapiens
aucauugugcaucuucauucca

SEQ ID NO: 220669 - RNA, 22 nt, Homo sapiens
auccacagugucaauguuguga

SEQ ID NO: 220670 - RNA, 22 nt, Homo sapiens
auccacaugcaguuggaaacag

SEQ ID NO: 220671 - RNA, 22 nt, Homo sapiens
auccacauucauggaccagucc

SEQ ID NO: 220672 - RNA, 22 nt, Homo sapiens
auccauguggauaaauguguau

SEQ ID NO: 220673 - RNA, 22 nt, Homo sapiens
aucccugagccugacucucaga

SEQ ID NO: 220674 - RNA, 22 nt, Homo sapiens
aucccugaggaauuucugcacu

SEQ ID NO: 220675 - RNA, 22 nt, Homo sapiens
aucccugugacgagcaucccua

SEQ ID NO: 220676 - RNA, 22 nt, Homo sapiens
aucccuuucucuggcuaggggg

SEQ ID NO: 220677 - RNA, 22 nt, Homo sapiens
aucccuuucugauacuuucccu

SEQ ID NO: 220678 - RNA, 22 nt, Homo sapiens
auccuagguuagagaacaaaac

SEQ ID NO: 220679 - RNA, 22 nt, Homo sapiens
auccugaagcuuuacugaauuc

SEQ ID NO: 220680 - RNA, 22 nt, Homo sapiens
auccugagacuuuucugaaguu

SEQ ID NO: 220681 - RNA, 22 nt, Homo sapiens
aucgcgccauuguacuccagcc

SEQ ID NO: 220682 - RNA, 22 nt, Homo sapiens
aucuaaaucucauaugggcaca

SEQ ID NO: 220683 - RNA, 22 nt, Homo sapiens
aucuagagaggcagucuggccg

SEQ ID NO: 220684 - RNA, 22 nt, Homo sapiens
gcccacuguuaaauuuguuuua

SEQ ID NO: 220685 - RNA, 22 nt, Homo sapiens
gcccagauguuuggggucaugg

SEQ ID NO: 220686 - RNA, 22 nt, Homo sapiens
gcccuacuguuuauacauagga

SEQ ID NO: 220687 - RNA, 22 nt, Homo sapiens
gcccuguugcccaggcuggagu

SEQ ID NO: 220688 - RNA, 22 nt, Homo sapiens
gcccuuugugucuggcuggggu

SEQ ID NO: 220689 - RNA, 22 nt, Homo sapiens
gccgagagauuuggaaugggga

SEQ ID NO: 220690 - RNA, 22 nt, Homo sapiens
gccuagagaguuaucaggcugu

SEQ ID NO: 220691 - RNA, 22 nt, Homo sapiens
gccuagggacaaaccguccgac

SEQ ID NO: 220692 - RNA, 22 nt, Homo sapiens
gccucaguuguggccagggauu

SEQ ID NO: 220693 - RNA, 22 nt, Homo sapiens
gccugagaggauaugauccccu

SEQ ID NO: 220694 - RNA, 19 nt, Homo sapiens
gcggcacuggagacacagc

SEQ ID NO: 220695 - RNA, 22 nt, Homo sapiens
gcgguagcauagacugcaggac

SEQ ID NO: 220696 - RNA, 22 nt, Homo sapiens
gcuaguguuugccagcguagcc

SEQ ID NO: 220697 - RNA, 22 nt, Homo sapiens
gcuaugguuuuuagcuccauca

SEQ ID NO: 220698 - RNA, 22 nt, Homo sapiens
gcucaaguaauggcaguuuugc

SEQ ID NO: 220699 - RNA, 22 nt, Homo sapiens
gcuccauuuuccauuucucuaa

SEQ ID NO: 220700 - RNA, 22 nt, Homo sapiens
gcucuuuugggguaauucugag

SEQ ID NO: 220701 - RNA, 22 nt, Homo sapiens
gcugacagugguuauacuuaga

SEQ ID NO: 220702 - RNA, 22 nt, Homo sapiens
gcugcacuuuaaggcauccccu

SEQ ID NO: 220703 - RNA, 22 nt, Homo sapiens
gcuggcaaguggccuacuuugu

SEQ ID NO: 220704 - RNA, 22 nt, Homo sapiens
gcuggguucagagugggcugcg

SEQ ID NO: 220705 - RNA, 21 nt, Homo sapiens
gcugguaaucacuuugccaaa

SEQ ID NO: 220706 - RNA, 22 nt, Homo sapiens
gcugguauuacaggcaugagcc

SEQ ID NO: 220707 - RNA, 22 nt, Homo sapiens
gcuggugaaggcugaaaagugg

SEQ ID NO: 220708 - RNA, 22 nt, Homo sapiens
gcugugauucuguguagauagu

SEQ ID NO: 220709 - RNA, 20 nt, Homo sapiens
gcugugcuuaauacacuuuc

SEQ ID NO: 220710 - RNA, 22 nt, Homo sapiens
gcuguguguuaucagaaauugc

SEQ ID NO: 220711 - RNA, 22 nt, Homo sapiens
gcuguugcuauuauuccgagaa

SEQ ID NO: 220712 - RNA, 22 nt, Homo sapiens
gcuguugguaaaaaggacauga

SEQ ID NO: 220713 - RNA, 19 nt, Homo sapiens
gcuuagagacaaaacauug

SEQ ID NO: 220714 - RNA, 19 nt, Homo sapiens
gcuuguccacgugagauaa

SEQ ID NO: 220715 - RNA, 22 nt, Homo sapiens
gcuuguguuuacuguaguuacu

SEQ ID NO: 220716 - RNA, 22 nt, Homo sapiens
gcuuugcaauggcauugaccau

SEQ ID NO: 220717 - RNA, 19 nt, Homo sapiens
gcuuuguggggaaggagcc

SEQ ID NO: 220718 - RNA, 18 nt, Homo sapiens
ggaaaacuuuucuaagua

SEQ ID NO: 220719 - RNA, 22 nt, Homo sapiens
ggaaagacuauuguaaaggaug

SEQ ID NO: 220720 - RNA, 22 nt, Homo sapiens
ggaaagcuagguguggguguac

SEQ ID NO: 220721 - RNA, 21 nt, Homo sapiens
ggaaaguuaaggaaauacccc

SEQ ID NO: 220722 - RNA, 22 nt, Homo sapiens
ggaaauguaaacaauggggcua

SEQ ID NO: 220723 - RNA, 22 nt, Homo sapiens
ggaacaccauuuuuccugccuu

SEQ ID NO: 220724 - RNA, 22 nt, Homo sapiens
ggaagaauauuaggggauuucg

SEQ ID NO: 220725 - RNA, 22 nt, Homo sapiens
ggaagccugcacucgggcaggg

SEQ ID NO: 220726 - RNA, 22 nt, Homo sapiens
ggaauauaaaacuuuugacagg

SEQ ID NO: 220727 - RNA, 22 nt, Homo sapiens
ggaaugcuaaaauaggaugcug

SEQ ID NO: 220728 - RNA, 19 nt, Homo sapiens
ggaaugcuauucaaccuuu

SEQ ID NO: 220729 - RNA, 22 nt, Homo sapiens
ggaauuaaggcaauugaaagcu

SEQ ID NO: 220730 - RNA, 22 nt, Homo sapiens
ggacagaugggcucccgggucu

SEQ ID NO: 220731 - RNA, 22 nt, Homo sapiens
ggacagugaaugccacuccucc

SEQ ID NO: 220732 - RNA, 22 nt, Homo sapiens
ggacauguauauauaugugugu

SEQ ID NO: 220733 - RNA, 22 nt, Homo sapiens
ggacuagaacugagaaucauau

SEQ ID NO: 220734 - RNA, 22 nt, Homo sapiens
ggacuagggacauggggagcug

SEQ ID NO: 220735 - RNA, 22 nt, Homo sapiens
ggacugagaggacuacagugua

SEQ ID NO: 220736 - RNA, 19 nt, Homo sapiens
ggacugucauggaguaguu

SEQ ID NO: 220737 - RNA, 22 nt, Homo sapiens
ggagaauugcuuggacccggga

SEQ ID NO: 220738 - RNA, 22 nt, Homo sapiens
ggagagcuaggcagagguuugu

SEQ ID NO: 220739 - RNA, 22 nt, Homo sapiens
ggagauaauccagggagggacu

SEQ ID NO: 220740 - RNA, 22 nt, Homo sapiens
ggagaucuuguuaaaguacaga

SEQ ID NO: 220741 - RNA, 22 nt, Homo sapiens
ggagaucuuuaggaguuggacu

SEQ ID NO: 220742 - RNA, 22 nt, Homo sapiens
ggagaucuuuguuaucuuuuga

SEQ ID NO: 220743 - RNA, 22 nt, Homo sapiens
ggagaugugccugcucugcucu

SEQ ID NO: 220744 - RNA, 22 nt, Homo sapiens
ggagauuauuaguguuucaugc

SEQ ID NO: 220745 - RNA, 22 nt, Homo sapiens
ggagguagucuuucccuuauca

SEQ ID NO: 220746 - RNA, 20 nt, Homo sapiens
ggagguguugauuuuucuuu

SEQ ID NO: 220747 - RNA, 20 nt, Homo sapiens
ggagguguuggauuucuagu

SEQ ID NO: 220748 - RNA, 20 nt, Homo sapiens
ggagguuguauaaguacauc

SEQ ID NO: 220749 - RNA, 22 nt, Homo sapiens
ggagucugauguucuaaggcag

SEQ ID NO: 220750 - RNA, 23 nt, Homo sapiens
ggaguguauuggcacgaucucag

SEQ ID NO: 220751 - RNA, 22 nt, Homo sapiens
ggagugucccaaucucagcuca

SEQ ID NO: 220752 - RNA, 22 nt, Homo sapiens
ggaguuuaagucuugugcaucu

SEQ ID NO: 220753 - RNA, 22 nt, Homo sapiens
ggaugcauucaacuuccaguuc

SEQ ID NO: 220754 - RNA, 21 nt, Homo sapiens
ggauucaucccucaugaauuu

SEQ ID NO: 220755 - RNA, 23 nt, Homo sapiens
ggauucaucuguuuguucgcugu

SEQ ID NO: 220756 - RNA, 22 nt, Homo sapiens
ggcaaaauggccagugggucac

SEQ ID NO: 220757 - RNA, 22 nt, Homo sapiens
ggcaacaauuccuacuucuuuu

SEQ ID NO: 220758 - RNA, 22 nt, Homo sapiens
ggcaagaaaaugcaauuacugu

SEQ ID NO: 220759 - RNA, 22 nt, Homo sapiens
ggcaagaacuucacucacuuuu

SEQ ID NO: 220760 - RNA, 22 nt, Homo sapiens
ggcaagaagaacuauaacuuuu

SEQ ID NO: 220761 - RNA, 17 nt, Homo sapiens
ggcaagaaguggaacuc

SEQ ID NO: 220762 - RNA, 20 nt, Homo sapiens
ggcaagacccaaagugugug

SEQ ID NO: 220763 - RNA, 19 nt, Homo sapiens
ggcaagaguuguucugugu

SEQ ID NO: 220764 - RNA, 22 nt, Homo sapiens
ggcaagaucuuggcucacugaa

SEQ ID NO: 220765 - RNA, 22 nt, Homo sapiens
ggcaaguucuaaugauuagaau

SEQ ID NO: 220766 - RNA, 22 nt, Homo sapiens
ggcaaugaggcggaccagcagg

SEQ ID NO: 220767 - RNA, 22 nt, Homo sapiens
ggcacaaugucagcucacugca

SEQ ID NO: 220768 - RNA, 22 nt, Homo sapiens
ggcagacuguggaguucuuucu

SEQ ID NO: 220769 - RNA, 22 nt, Homo sapiens
ggcagagucuugcaucuuuaga

SEQ ID NO: 220770 - RNA, 22 nt, Homo sapiens
ggcagcauugccuuugcaguga

SEQ ID NO: 220771 - RNA, 22 nt, Homo sapiens
ggcagguaaggagugggagccu

SEQ ID NO: 220772 - RNA, 22 nt, Homo sapiens
ggcaugguggugugugccuaua

SEQ ID NO: 220773 - RNA, 23 nt, Homo sapiens
ggcauuguggcucacaucuguaa

SEQ ID NO: 220774 - RNA, 22 nt, Homo sapiens
ggccagaugcaguggcucacac

SEQ ID NO: 220775 - RNA, 22 nt, Homo sapiens
ggccagaugcgguggcucacac

SEQ ID NO: 220776 - RNA, 22 nt, Homo sapiens
ggcccugagacaggaaaaagcu

SEQ ID NO: 220777 - RNA, 22 nt, Homo sapiens
ggccggguggccauggcugccc

SEQ ID NO: 220778 - RNA, 22 nt, Homo sapiens
ggccugaugaaauguuagagua

SEQ ID NO: 220779 - RNA, 22 nt, Homo sapiens
ggcuacauuguuacaauuagua

SEQ ID NO: 220780 - RNA, 22 nt, Homo sapiens
ggcucagugaucuguuucugua

SEQ ID NO: 220781 - RNA, 22 nt, Homo sapiens
ggcucuguugcuaccaauuaag

SEQ ID NO: 220782 - RNA, 22 nt, Homo sapiens
cugguuguucuggaugggcagg

SEQ ID NO: 220783 - RNA, 22 nt, Homo sapiens
cugguuuguaaaguuccugaga

SEQ ID NO: 220784 - RNA, 22 nt, Homo sapiens
cuguaacagaauaaauuuguuu

SEQ ID NO: 220785 - RNA, 23 nt, Homo sapiens
cuguacacauauacaucuaagua

SEQ ID NO: 220786 - RNA, 22 nt, Homo sapiens
cuguagacauuaggccugcacu

SEQ ID NO: 220787 - RNA, 22 nt, Homo sapiens
cuguaugugagaaauaauaagu

SEQ ID NO: 220788 - RNA, 22 nt, Homo sapiens
cugucacuggggcacauguccc

SEQ ID NO: 220789 - RNA, 22 nt, Homo sapiens
cugucuagagggcacaugaugc

SEQ ID NO: 220790 - RNA, 22 nt, Homo sapiens
cugugauagguuagucaugaau

SEQ ID NO: 220791 - RNA, 17 nt, Homo sapiens
cugugaugaucuugucu

SEQ ID NO: 220792 - RNA, 22 nt, Homo sapiens
cugugcaaacaagugaaccccu

SEQ ID NO: 220793 - RNA, 22 nt, Homo sapiens
cugugcacaucuggcggcccga

SEQ ID NO: 220794 - RNA, 22 nt, Homo sapiens
cugugcauaugacuuuauugga

SEQ ID NO: 220795 - RNA, 22 nt, Homo sapiens
cugugcauguuguccaauucuu

SEQ ID NO: 220796 - RNA, 22 nt, Homo sapiens
cugugcuugauuauaugagugu

SEQ ID NO: 220797 - RNA, 22 nt, Homo sapiens
cuguuauguucuagagggugca

SEQ ID NO: 220798 - RNA, 22 nt, Homo sapiens
cuguucaaauuguuugugaagu

SEQ ID NO: 220799 - RNA, 22 nt, Homo sapiens
cuguugguuaaauuccaugcag

SEQ ID NO: 220800 - RNA, 22 nt, Homo sapiens
cuguuugaggguuugcuuucag

SEQ ID NO: 220801 - RNA, 18 nt, Homo sapiens
cuuaacauugggaugaua

SEQ ID NO: 220802 - RNA, 22 nt, Homo sapiens
cuuaaggccagauaauuucuau

SEQ ID NO: 220803 - RNA, 20 nt, Homo sapiens
cuuaaugcagcauuucucag

SEQ ID NO: 220804 - RNA, 22 nt, Homo sapiens
cuuacagucuaucagccacaac

SEQ ID NO: 220805 - RNA, 22 nt, Homo sapiens
cuuagcaaugucguguacucac

SEQ ID NO: 220806 - RNA, 19 nt, Homo sapiens
cuuaggugaccaguuccca

SEQ ID NO: 220807 - RNA, 22 nt, Homo sapiens
cuucaugagacuuuuggaaggc

SEQ ID NO: 220808 - RNA, 22 nt, Homo sapiens
cuuccaaguggggcacgugcca

SEQ ID NO: 220809 - RNA, 22 nt, Homo sapiens
cuuccagcuggguucagucagu

SEQ ID NO: 220810 - RNA, 20 nt, Homo sapiens
cuuccaguggccccaucuuu

SEQ ID NO: 220811 - RNA, 22 nt, Homo sapiens
cuucucagugcucaucuuauuu

SEQ ID NO: 220812 - RNA, 22 nt, Homo sapiens
cuucugauugaaaauggaguag

SEQ ID NO: 220813 - RNA, 22 nt, Homo sapiens
cuucuguuaguucugauaacuu

SEQ ID NO: 220814 - RNA, 22 nt, Homo sapiens
cuucuugcuguguccucacaug

SEQ ID NO: 220815 - RNA, 21 nt, Homo sapiens
cuucuuggggcagggcagggu

SEQ ID NO: 220816 - RNA, 22 nt, Homo sapiens
cuugaacaaagagauuccauua

SEQ ID NO: 220817 - RNA, 22 nt, Homo sapiens
cuugcauuuuggagaaugcuga

SEQ ID NO: 220818 - RNA, 22 nt, Homo sapiens
cuugccuaaucugcaugauuuu

SEQ ID NO: 220819 - RNA, 22 nt, Homo sapiens
cuuggcuagucaaaccuccccg

SEQ ID NO: 220820 - RNA, 22 nt, Homo sapiens
cuugggccccacccaaaucuua

SEQ ID NO: 220821 - RNA, 22 nt, Homo sapiens
cuugucuugcacacgguugcca

SEQ ID NO: 220822 - RNA, 22 nt, Homo sapiens
cuuuacaguuggacucacgagg

SEQ ID NO: 220823 - RNA, 22 nt, Homo sapiens
cuuuccauuguuggagcauaaa

SEQ ID NO: 220824 - RNA, 22 nt, Homo sapiens
cuuucugaggagaauagagaac

SEQ ID NO: 220825 - RNA, 22 nt, Homo sapiens
cuuugauuauaaaaggguguuu

SEQ ID NO: 220826 - RNA, 22 nt, Homo sapiens
cuuugcaaaacauugagaccuc

SEQ ID NO: 220827 - RNA, 21 nt, Homo sapiens
cuuugcacugcuccucagcuc

SEQ ID NO: 220828 - RNA, 22 nt, Homo sapiens
cuuugcuaauccaacccucauc

SEQ ID NO: 220829 - RNA, 22 nt, Homo sapiens
cuuuggccauagcuaaaugauu

SEQ ID NO: 220830 - RNA, 22 nt, Homo sapiens
cuuugggaccgcgguuuauacu

SEQ ID NO: 220831 - RNA, 22 nt, Homo sapiens
cuuuggucaauugcugcgggga

SEQ ID NO: 220832 - RNA, 22 nt, Homo sapiens
cuuuggugauagauaccccaua

SEQ ID NO: 220833 - RNA, 22 nt, Homo sapiens
agagauacauucugagaagugc

SEQ ID NO: 220834 - RNA, 22 nt, Homo sapiens
agagaucacugaaucacggggg

SEQ ID NO: 220835 - RNA, 22 nt, Homo sapiens
agagcaauguuaucagucucug

SEQ ID NO: 220836 - RNA, 18 nt, Homo sapiens
agagcacugaguuuuaga

SEQ ID NO: 220837 - RNA, 22 nt, Homo sapiens
agagcuaguauuuacggagcau

SEQ ID NO: 220838 - RNA, 22 nt, Homo sapiens
agaggaguacuacuccaagucu

SEQ ID NO: 220839 - RNA, 22 nt, Homo sapiens
agagguaagcaguggcaagugc

SEQ ID NO: 220840 - RNA, 22 nt, Homo sapiens
agagguagaagauaggcuacag

SEQ ID NO: 220841 - RNA, 22 nt, Homo sapiens
agagguauacauuugagagcca

SEQ ID NO: 220842 - RNA, 22 nt, Homo sapiens
agagguaugccugggcuggagc

SEQ ID NO: 220843 - RNA, 22 nt, Homo sapiens
agagguuuaacuggcuuauggu

SEQ ID NO: 220844 - RNA, 20 nt, Homo sapiens
agagguuuugauagguucug

SEQ ID NO: 220845 - RNA, 22 nt, Homo sapiens
agagguuuugcacugguucuuu

SEQ ID NO: 220846 - RNA, 22 nt, Homo sapiens
agaguacaggcaaguuagucau

SEQ ID NO: 220847 - RNA, 22 nt, Homo sapiens
agaguaguuucuauauucuuca

SEQ ID NO: 220848 - RNA, 22 nt, Homo sapiens
agaguauacaugugagugagau

SEQ ID NO: 220849 - RNA, 19 nt, Homo sapiens
agaguauugaauuugcccu

SEQ ID NO: 220850 - RNA, 22 nt, Homo sapiens
agagucacaugaggcccuucau

SEQ ID NO: 220851 - RNA, 21 nt, Homo sapiens
agagucaucucuaucuguacc

SEQ ID NO: 220852 - RNA, 22 nt, Homo sapiens
agauacauuggauaaugguggg

SEQ ID NO: 220853 - RNA, 23 nt, Homo sapiens
agaugcaucuggcugcgaggcaa

SEQ ID NO: 220854 - RNA, 22 nt, Homo sapiens
agaugcauugguggcauauuca

SEQ ID NO: 220855 - RNA, 22 nt, Homo sapiens
agaugcauuuuuauuggaauac

SEQ ID NO: 220856 - RNA, 22 nt, Homo sapiens
agaugccuaugaagagaaauua

SEQ ID NO: 220857 - RNA, 22 nt, Homo sapiens
agauggucuucauaaguuuuaa

SEQ ID NO: 220858 - RNA, 22 nt, Homo sapiens
agcaacauagugagacccccau

SEQ ID NO: 220859 - RNA, 22 nt, Homo sapiens
agcaacaucagcagcaggaaaa

SEQ ID NO: 220860 - RNA, 22 nt, Homo sapiens
agcaacauggaguuugugcgca

SEQ ID NO: 220861 - RNA, 22 nt, Homo sapiens
agcaacauugagacugcaguug

SEQ ID NO: 220862 - RNA, 22 nt, Homo sapiens
agcaacauuuuugaccuuucuu

SEQ ID NO: 220863 - RNA, 22 nt, Homo sapiens
agcaaccuugaauagcccuuuc

SEQ ID NO: 220864 - RNA, 22 nt, Homo sapiens
agcaagauccagucgcacagga

SEQ ID NO: 220865 - RNA, 22 nt, Homo sapiens
agcacaguuaaaugaggcuucu

SEQ ID NO: 220866 - RNA, 22 nt, Homo sapiens
agcaccauugcacuccagccug

SEQ ID NO: 220867 - RNA, 22 nt, Homo sapiens
agcacuacugcacuccagccug

SEQ ID NO: 220868 - RNA, 21 nt, Homo sapiens
agcagaguggcagcucuuuug

SEQ ID NO: 220869 - RNA, 22 nt, Homo sapiens
agcagcaccaaacagacuaaga

SEQ ID NO: 220870 - RNA, 22 nt, Homo sapiens
agcagcaucgggaaguuggcca

SEQ ID NO: 220871 - RNA, 22 nt, Homo sapiens
agcagcauggguauaaaucucc

SEQ ID NO: 220872 - RNA, 22 nt, Homo sapiens
agcaggucuuaacuugugaggu

SEQ ID NO: 220873 - RNA, 22 nt, Homo sapiens
agcagguguggcuuauccugaa

SEQ ID NO: 220874 - RNA, 16 nt, Homo sapiens
agcagguguuagguga

SEQ ID NO: 220875 - RNA, 22 nt, Homo sapiens
agcaguagugaaaguagacuua

SEQ ID NO: 220876 - RNA, 22 nt, Homo sapiens
agcagugugaaaugauuuaagg

SEQ ID NO: 220877 - RNA, 22 nt, Homo sapiens
agcaguguggccuuagacccgg

SEQ ID NO: 220878 - RNA, 22 nt, Homo sapiens
agcaucacaugggcugcuuggg

SEQ ID NO: 220879 - RNA, 22 nt, Homo sapiens
agcaucaugcaguugcuauuca

SEQ ID NO: 220880 - RNA, 21 nt, Homo sapiens
ggaauuuagggaaugauuuag

SEQ ID NO: 220881 - RNA, 22 nt, Homo sapiens
ggacaagagacugggacacuga

SEQ ID NO: 220882 - RNA, 22 nt, Homo sapiens
ggacaucauuaccauggaccca

SEQ ID NO: 220883 - RNA, 22 nt, Homo sapiens
ggacauuaacugcaagauagau

SEQ ID NO: 220884 - RNA, 22 nt, Homo sapiens
ggagaucacucuuuguagcgug

SEQ ID NO: 220885 - RNA, 22 nt, Homo sapiens
ggagaugauuaugaaucacuua

SEQ ID NO: 220886 - RNA, 22 nt, Homo sapiens
ggagguaauaaguuccagugua

SEQ ID NO: 220887 - RNA, 22 nt, Homo sapiens
ggagguagguuugugauuugua

SEQ ID NO: 220888 - RNA, 22 nt, Homo sapiens
ggaguaggaaggaaauguuaaa

SEQ ID NO: 220889 - RNA, 22 nt, Homo sapiens
ggaguaugaaacccacuccaau

SEQ ID NO: 220890 - RNA, 22 nt, Homo sapiens
ggagucugacuuauaggaaccu

SEQ ID NO: 220891 - RNA, 22 nt, Homo sapiens
ggagucuugcuauguugccaag

SEQ ID NO: 220892 - RNA, 22 nt, Homo sapiens
ggagugcuguuguuacacaagg

SEQ ID NO: 220893 - RNA, 22 nt, Homo sapiens
ggagugugauuguucucuguua

SEQ ID NO: 220894 - RNA, 22 nt, Homo sapiens
ggaguguguaggagaaagguaa

SEQ ID NO: 220895 - RNA, 22 nt, Homo sapiens
ggauaacagccaggucaaacaa

SEQ ID NO: 220896 - RNA, 22 nt, Homo sapiens
ggauacauuuuuccuccucuuc

SEQ ID NO: 220897 - RNA, 22 nt, Homo sapiens
ggaucacagccagcucccagaa

SEQ ID NO: 220898 - RNA, 22 nt, Homo sapiens
ggaucacugugaaccgugucag

SEQ ID NO: 220899 - RNA, 22 nt, Homo sapiens
ggaucauaugauagcucaauuu

SEQ ID NO: 220900 - RNA, 22 nt, Homo sapiens
ggauugcuuaagaaguuucauu

SEQ ID NO: 220901 - RNA, 22 nt, Homo sapiens
ggcaaaauauugucugguauag

SEQ ID NO: 220902 - RNA, 22 nt, Homo sapiens
ggcaaagaugaccauuacuuuu

SEQ ID NO: 220903 - RNA, 22 nt, Homo sapiens
ggcaacaaagacauuucaacau

SEQ ID NO: 220904 - RNA, 21 nt, Homo sapiens
ggcaagaaacacaaucaagua

SEQ ID NO: 220905 - RNA, 22 nt, Homo sapiens
ggcaagaaccagggauuugcgu

SEQ ID NO: 220906 - RNA, 22 nt, Homo sapiens
ggcaagaaccucaauuaccuuu

SEQ ID NO: 220907 - RNA, 22 nt, Homo sapiens
ggcaagaagagaguuuaaacau

SEQ ID NO: 220908 - RNA, 21 nt, Homo sapiens
ggcaagagaauacaacauaaa

SEQ ID NO: 220909 - RNA, 22 nt, Homo sapiens
ggcaagauagauaucaguguca

SEQ ID NO: 220910 - RNA, 22 nt, Homo sapiens
ggcaagcucaggccucaggugu

SEQ ID NO: 220911 - RNA, 22 nt, Homo sapiens
ggcaaggauguuuuucuggcaa

SEQ ID NO: 220912 - RNA, 22 nt, Homo sapiens
ggcaaggauuagauucuccccu

SEQ ID NO: 220913 - RNA, 22 nt, Homo sapiens
ggcaaggugcuacagacaguga

SEQ ID NO: 220914 - RNA, 22 nt, Homo sapiens
ggcaagugucagcagcaacacc

SEQ ID NO: 220915 - RNA, 19 nt, Homo sapiens
ggcaauacuuucuuguugg

SEQ ID NO: 220916 - RNA, 22 nt, Homo sapiens
ggcaauauauucugaauucagu

SEQ ID NO: 220917 - RNA, 22 nt, Homo sapiens
ggcacaauugcagcaauaaaca

SEQ ID NO: 220918 - RNA, 23 nt, Homo sapiens
ggcacggaauucaaagaggcauu

SEQ ID NO: 220919 - RNA, 22 nt, Homo sapiens
ggcacgguggcucacgccugua

SEQ ID NO: 220920 - RNA, 19 nt, Homo sapiens
ggcacugugugagugagga

SEQ ID NO: 220921 - RNA, 22 nt, Homo sapiens
ggcagaguggacauuuaaaugu

SEQ ID NO: 220922 - RNA, 22 nt, Homo sapiens
ggcagcacaauuuucugaugga

SEQ ID NO: 220923 - RNA, 22 nt, Homo sapiens
ggcagcgugcacuuucgccacu

SEQ ID NO: 220924 - RNA, 17 nt, Homo sapiens
ggcaggaauuaauguca

SEQ ID NO: 220925 - RNA, 17 nt, Homo sapiens
ggcaggauccaggaucc

SEQ ID NO: 220926 - RNA, 22 nt, Homo sapiens
ggcaguguaauaauuuauuaau

SEQ ID NO: 220927 - RNA, 22 nt, Homo sapiens
ggcaguguuauuauauuuuugg

SEQ ID NO: 220928 - RNA, 22 nt, Homo sapiens
ggcaguuucucaggcaggggua

SEQ ID NO: 220929 - RNA, 21 nt, Homo sapiens
ggcaugaauggaaaagugaga

SEQ ID NO: 220930 - RNA, 22 nt, Homo sapiens
ggcauguaauuauucaaagugg

SEQ ID NO: 220931 - RNA, 21 nt, Homo sapiens
ggcauugugcccuugcucuag

SEQ ID NO: 220932 - RNA, 22 nt, Homo sapiens
ggccuguaggguauugguaggg

SEQ ID NO: 220933 - RNA, 18 nt, Homo sapiens
ggcggguguuuuauucac

SEQ ID NO: 220934 - RNA, 22 nt, Homo sapiens
ggcuagagaauagugccacuaa

SEQ ID NO: 220935 - RNA, 22 nt, Homo sapiens
ggcucaguugcaaaucaguuca

SEQ ID NO: 220936 - RNA, 22 nt, Homo sapiens
ggcucaguuuccuccgucugcu

SEQ ID NO: 220937 - RNA, 22 nt, Homo sapiens
ggcuuggaggaaugugagggcu

SEQ ID NO: 220938 - RNA, 22 nt, Homo sapiens
ggcuuuggucacacaggggcaa

SEQ ID NO: 220939 - RNA, 22 nt, Homo sapiens
gggaaauguaaagucauaagau

SEQ ID NO: 220940 - RNA, 22 nt, Homo sapiens
gggaagaaggagugguuuacuc

SEQ ID NO: 220941 - RNA, 22 nt, Homo sapiens
gggaagguaaucauuacuugau

SEQ ID NO: 220942 - RNA, 18 nt, Homo sapiens
gggaauauggggaguuga

SEQ ID NO: 220943 - RNA, 22 nt, Homo sapiens
gggaaugaagagaaccuuccca

SEQ ID NO: 220944 - RNA, 22 nt, Homo sapiens
gggagugugcacacaugguaua

SEQ ID NO: 220945 - RNA, 22 nt, Homo sapiens
gggaucaacuuauacuaaaauu

SEQ ID NO: 220946 - RNA, 22 nt, Homo sapiens
gggauguaaaagugggcacauu

SEQ ID NO: 220947 - RNA, 20 nt, Homo sapiens
gggaugugagguacacucuu

SEQ ID NO: 220948 - RNA, 22 nt, Homo sapiens
gggauguuuuauacugagccug

SEQ ID NO: 220949 - RNA, 20 nt, Homo sapiens
gggcaaguaugugggaaguc

SEQ ID NO: 220950 - RNA, 22 nt, Homo sapiens
gggcagaugucuggacaccuca

SEQ ID NO: 220951 - RNA, 22 nt, Homo sapiens
gggcaugugugugcacacacau

SEQ ID NO: 220952 - RNA, 22 nt, Homo sapiens
ggggaguguggacaucacccug

SEQ ID NO: 220953 - RNA, 22 nt, Homo sapiens
ggggcaaaaugccacgagucuc

SEQ ID NO: 220954 - RNA, 22 nt, Homo sapiens
gggguaggcuacacugaguucc

SEQ ID NO: 220955 - RNA, 22 nt, Homo sapiens
gggguauguaagugagugagug

SEQ ID NO: 220956 - RNA, 22 nt, Homo sapiens
ggguaggcaagcggaugucaga

SEQ ID NO: 220957 - RNA, 22 nt, Homo sapiens
ggguucccugaugagaguuagu

SEQ ID NO: 220958 - RNA, 22 nt, Homo sapiens
gguaacaguggggcuaugcuua

SEQ ID NO: 220959 - RNA, 22 nt, Homo sapiens
gguaaguuuggggcuaauuugu

SEQ ID NO: 220960 - RNA, 22 nt, Homo sapiens
gguagacaucgugcucugugau

SEQ ID NO: 220961 - RNA, 22 nt, Homo sapiens
gguauuauuugccuuuuacuga

SEQ ID NO: 220962 - RNA, 22 nt, Homo sapiens
ggucaacaucaucaugguaagu

SEQ ID NO: 220963 - RNA, 22 nt, Homo sapiens
ggucaagcuagauuuuaaugau

SEQ ID NO: 220964 - RNA, 22 nt, Homo sapiens
ggucagaaagacaggcauucag

SEQ ID NO: 220965 - RNA, 22 nt, Homo sapiens
ggucaguuuucuccaggaucca

SEQ ID NO: 220966 - RNA, 22 nt, Homo sapiens
ggucauagagaauucaccagga

SEQ ID NO: 220967 - RNA, 22 nt, Homo sapiens
ggucauagagcaagcaaacagc

SEQ ID NO: 220968 - RNA, 22 nt, Homo sapiens
ggucauggagcuuuacuuuaug

SEQ ID NO: 220969 - RNA, 22 nt, Homo sapiens
ggucauggauguuuauaguaca

SEQ ID NO: 220970 - RNA, 22 nt, Homo sapiens
ggucauggauugucuuuucuug

SEQ ID NO: 220971 - RNA, 22 nt, Homo sapiens
ggucuagagagagggguggacu

SEQ ID NO: 220972 - RNA, 22 nt, Homo sapiens
ggugagcacagaaugcccugag

SEQ ID NO: 220973 - RNA, 22 nt, Homo sapiens
gguggcaaaucugaguggcgcu

SEQ ID NO: 220974 - RNA, 22 nt, Homo sapiens
ggugucaguuggccccuacugg

SEQ ID NO: 220975 - RNA, 22 nt, Homo sapiens
gguguguaaauuacuuaucucu

SEQ ID NO: 220976 - RNA, 22 nt, Homo sapiens
guaaauaccaguuucuggaaca

SEQ ID NO: 220977 - RNA, 22 nt, Homo sapiens
guaaauguccccugugauauug

SEQ ID NO: 220978 - RNA, 22 nt, Homo sapiens
gugaccaaagauagcucaaguu

SEQ ID NO: 220979 - RNA, 22 nt, Homo sapiens
gugacugcauccauccaggcuu

SEQ ID NO: 220980 - RNA, 22 nt, Homo sapiens
gugagaauauuuuaaauacuaa

SEQ ID NO: 220981 - RNA, 22 nt, Homo sapiens
gugagacugaguuucgcucuug

SEQ ID NO: 220982 - RNA, 22 nt, Homo sapiens
gugagacugguccugaacccag

SEQ ID NO: 220983 - RNA, 16 nt, Homo sapiens
gugagagaugacaaac

SEQ ID NO: 220984 - RNA, 22 nt, Homo sapiens
gugagaggaggcagcuuuuaca

SEQ ID NO: 220985 - RNA, 22 nt, Homo sapiens
gugagauacuagagauauagug

SEQ ID NO: 220986 - RNA, 22 nt, Homo sapiens
gugagaugaggucucacucugu

SEQ ID NO: 220987 - RNA, 22 nt, Homo sapiens
gugagauggagucuugcuuugu

SEQ ID NO: 220988 - RNA, 22 nt, Homo sapiens
gugagauuaccauuuaaaucag

SEQ ID NO: 220989 - RNA, 22 nt, Homo sapiens
gugagauuagcugagauccuug

SEQ ID NO: 220990 - RNA, 22 nt, Homo sapiens
gugagcaaacuuaccuaagguu

SEQ ID NO: 220991 - RNA, 22 nt, Homo sapiens
gugagcaguguccuugggggca

SEQ ID NO: 220992 - RNA, 22 nt, Homo sapiens
gugagcauaacaacagaguuua

SEQ ID NO: 220993 - RNA, 22 nt, Homo sapiens
gugaggcacugcugcuuuccag

SEQ ID NO: 220994 - RNA, 22 nt, Homo sapiens
gugagguauacugggaucacua

SEQ ID NO: 220995 - RNA, 22 nt, Homo sapiens
gugaggucguagucauaggcaa

SEQ ID NO: 220996 - RNA, 17 nt, Homo sapiens
gugagguggguaguauc

SEQ ID NO: 220997 - RNA, 20 nt, Homo sapiens
gugagucauuaguaaccaaa

SEQ ID NO: 220998 - RNA, 22 nt, Homo sapiens
gugauacugcuuauuaauuuaa

SEQ ID NO: 220999 - RNA, 22 nt, Homo sapiens
gugauaucuuacaauucucuuu

SEQ ID NO: 221000 - RNA, 22 nt, Homo sapiens
gugaucauuguauugggguuau

SEQ ID NO: 221001 - RNA, 22 nt, Homo sapiens
gugaucucauuuggaauuagag

SEQ ID NO: 221002 - RNA, 22 nt, Homo sapiens
gugaucuguccuucauagccug

SEQ ID NO: 221003 - RNA, 22 nt, Homo sapiens
gugauugugaaaacauuaagaa

SEQ ID NO: 221004 - RNA, 22 nt, Homo sapiens
gugcaaauguuauugagguuuu

SEQ ID NO: 221005 - RNA, 22 nt, Homo sapiens
gugcaacaucccuccauaauuu

SEQ ID NO: 221006 - RNA, 22 nt, Homo sapiens
gugcaagagugacugcaguuuu

SEQ ID NO: 221007 - RNA, 18 nt, Homo sapiens
gugcaaugaauagcagag

SEQ ID NO: 221008 - RNA, 22 nt, Homo sapiens
gugcaauucacuguuaugucug

SEQ ID NO: 221009 - RNA, 22 nt, Homo sapiens
gugcacaucgugcagguuuguu

SEQ ID NO: 221010 - RNA, 22 nt, Homo sapiens
gugcacaugcgugcgcacauau

SEQ ID NO: 221011 - RNA, 21 nt, Homo sapiens
gugcagaugccacagucacuc

SEQ ID NO: 221012 - RNA, 22 nt, Homo sapiens
gugcagugugauccuuccguau

SEQ ID NO: 221013 - RNA, 22 nt, Homo sapiens
gugcauacgucuuuauaguagc

SEQ ID NO: 221014 - RNA, 22 nt, Homo sapiens
gugcuuguauuuaaaucaugug

SEQ ID NO: 221015 - RNA, 22 nt, Homo sapiens
gugcuuguguuaauauguagcu

SEQ ID NO: 221016 - RNA, 22 nt, Homo sapiens
guggaaagaacacaaaauuagg

SEQ ID NO: 221017 - RNA, 22 nt, Homo sapiens
guggaagcacaggccuccugga

SEQ ID NO: 221018 - RNA, 22 nt, Homo sapiens
guggaaggucaugaauguucuu

SEQ ID NO: 221019 - RNA, 20 nt, Homo sapiens
guggaaguagaaacauaugu

SEQ ID NO: 221020 - RNA, 22 nt, Homo sapiens
guggaagucuuugguauuggua

SEQ ID NO: 221021 - RNA, 22 nt, Homo sapiens
guggaagugucuggggccaggg

SEQ ID NO: 221022 - RNA, 22 nt, Homo sapiens
guggaauauaaagcaucgugua

SEQ ID NO: 221023 - RNA, 22 nt, Homo sapiens
guggaaugauaucucauugugg

SEQ ID NO: 221024 - RNA, 22 nt, Homo sapiens
guggaaugcaguguugauucaa

SEQ ID NO: 221025 - RNA, 22 nt, Homo sapiens
guggacagagacuaaauguugu

SEQ ID NO: 221026 - RNA, 22 nt, Homo sapiens
guggagucaucacucagagugg

SEQ ID NO: 221027 - RNA, 22 nt, Homo sapiens
guggcaagaauguacaaaaggu

SEQ ID NO: 221028 - RNA, 22 nt, Homo sapiens
guggcagcacauauagguuguu

SEQ ID NO: 221029 - RNA, 22 nt, Homo sapiens
guggcaguuuuaaauaugaaaa

SEQ ID NO: 221030 - RNA, 22 nt, Homo sapiens
guggcaugaaagcagauaccac

SEQ ID NO: 221031 - RNA, 22 nt, Homo sapiens
guggcaugaaagcaucugugau

SEQ ID NO: 221032 - RNA, 22 nt, Homo sapiens
guggcgagaucauagcucauug

SEQ ID NO: 221033 - RNA, 22 nt, Homo sapiens
guggcuuuaaguacgauugagg

SEQ ID NO: 221034 - RNA, 22 nt, Homo sapiens
gugggaugcaaguaaaauuguc

SEQ ID NO: 221035 - RNA, 22 nt, Homo sapiens
gugggcaaagcuaguguguaga

SEQ ID NO: 221036 - RNA, 22 nt, Homo sapiens
gugggguaggaggaguacuucc

SEQ ID NO: 221037 - RNA, 22 nt, Homo sapiens
gugguacccucaggcccuuuuc

SEQ ID NO: 221038 - RNA, 22 nt, Homo sapiens
gugguacuaucuuugguuucag

SEQ ID NO: 221039 - RNA, 22 nt, Homo sapiens
gugguaguagaauuucggaaau

SEQ ID NO: 221040 - RNA, 22 nt, Homo sapiens
gugguaucauuuaaccauuaga

SEQ ID NO: 221041 - RNA, 22 nt, Homo sapiens
guggucagaaaucucaguggca

SEQ ID NO: 221042 - RNA, 22 nt, Homo sapiens
gugguguccugcaccuauaguc

SEQ ID NO: 221043 - RNA, 22 nt, Homo sapiens
guggugucuuguuuaauauaua

SEQ ID NO: 221044 - RNA, 22 nt, Homo sapiens
gugguguuugagcugccaggga

SEQ ID NO: 221045 - RNA, 21 nt, Homo sapiens
gugguucuagagaaacagaau

SEQ ID NO: 221046 - RNA, 22 nt, Homo sapiens
gugguuuuacaaagagaaagau

SEQ ID NO: 221047 - RNA, 22 nt, Homo sapiens
gugguuuuuuucugccuuauag

SEQ ID NO: 221048 - RNA, 22 nt, Homo sapiens
guguaaaugagugcugaaggag

SEQ ID NO: 221049 - RNA, 22 nt, Homo sapiens
guguaguuugagguaugggggc

SEQ ID NO: 221050 - RNA, 22 nt, Homo sapiens
guguaugguuguuguagagaga

SEQ ID NO: 221051 - RNA, 22 nt, Homo sapiens
gugucacuguauaauauuuauu

SEQ ID NO: 221052 - RNA, 22 nt, Homo sapiens
gugucacugugaggauauugua

SEQ ID NO: 221053 - RNA, 22 nt, Homo sapiens
gugucaugagggggacaggaag

SEQ ID NO: 221054 - RNA, 22 nt, Homo sapiens
gugucaugggcauguccuuaac

SEQ ID NO: 221055 - RNA, 22 nt, Homo sapiens
guguccucgaguacacaucagg

SEQ ID NO: 221056 - RNA, 22 nt, Homo sapiens
gugucucagcccagaccuauuu

SEQ ID NO: 221057 - RNA, 22 nt, Homo sapiens
gugugaacaucauagaguguau

SEQ ID NO: 221058 - RNA, 22 nt, Homo sapiens
gugugacagcuauagacaugau

SEQ ID NO: 221059 - RNA, 22 nt, Homo sapiens
gugugauguaaagaacugggga

SEQ ID NO: 221060 - RNA, 22 nt, Homo sapiens
gugugauuguuaauuuuaggug

SEQ ID NO: 221061 - RNA, 22 nt, Homo sapiens
gugugcacaaucuggcaugugc

SEQ ID NO: 221062 - RNA, 22 nt, Homo sapiens
gugugcauggagggggcaguga

SEQ ID NO: 221063 - RNA, 21 nt, Homo sapiens
gugugcuugaauucagcuguc

SEQ ID NO: 221064 - RNA, 22 nt, Homo sapiens
gugugguauuauaacuagguau

SEQ ID NO: 221065 - RNA, 22 nt, Homo sapiens
gugugucuugaccaggaucgga

SEQ ID NO: 221066 - RNA, 22 nt, Homo sapiens
guguuauugagaaauagggugu

SEQ ID NO: 221067 - RNA, 22 nt, Homo sapiens
guguuauuuugcugggaaugau

SEQ ID NO: 221068 - RNA, 22 nt, Homo sapiens
guguucaaagcugauugagauu

SEQ ID NO: 221069 - RNA, 22 nt, Homo sapiens
guguucaaauucugacagagag

SEQ ID NO: 221070 - RNA, 22 nt, Homo sapiens
guguuugguugauagagccacu

SEQ ID NO: 221071 - RNA, 22 nt, Homo sapiens
guuaagggaagccuggguaaga

SEQ ID NO: 221072 - RNA, 22 nt, Homo sapiens
guuaaugcuggaauaaguuaag

SEQ ID NO: 221073 - RNA, 22 nt, Homo sapiens
guuacagucuuguguaagguua

SEQ ID NO: 221074 - RNA, 22 nt, Homo sapiens
guuauauguuuggaaugaggaa

SEQ ID NO: 221075 - RNA, 22 nt, Homo sapiens
guuaugcagcuuagaaaaugaa

SEQ ID NO: 221076 - RNA, 22 nt, Homo sapiens
uaauuggaucucaaaaaagugu

SEQ ID NO: 221077 - RNA, 22 nt, Homo sapiens
uacaacacugguucgacaugug

SEQ ID NO: 221078 - RNA, 21 nt, Homo sapiens
uacaaugcacaggagagccuc

SEQ ID NO: 221079 - RNA, 16 nt, Homo sapiens
uacaauguagaaaaca

SEQ ID NO: 221080 - RNA, 22 nt, Homo sapiens
uacacagucaaaaauuuccagg

SEQ ID NO: 221081 - RNA, 22 nt, Homo sapiens
uacaccauuugauucuuuaagc

SEQ ID NO: 221082 - RNA, 22 nt, Homo sapiens
uacaccugcacucuagccuggg

SEQ ID NO: 221083 - RNA, 21 nt, Homo sapiens
uacacuacugguggaaaugca

SEQ ID NO: 221084 - RNA, 22 nt, Homo sapiens
uacagaauauuucugcccugag

SEQ ID NO: 221085 - RNA, 22 nt, Homo sapiens
uacagaauucugucccuugagu

SEQ ID NO: 221086 - RNA, 22 nt, Homo sapiens
uacaggacuauagaacuuuccc

SEQ ID NO: 221087 - RNA, 19 nt, Homo sapiens
uacaggacugagcugaggu

SEQ ID NO: 221088 - RNA, 19 nt, Homo sapiens
uacaguacacaacaccuuu

SEQ ID NO: 221089 - RNA, 22 nt, Homo sapiens
uacaguagaaugucuuucaaaa

SEQ ID NO: 221090 - RNA, 22 nt, Homo sapiens
uacaguauuaugagugauugaa

SEQ ID NO: 221091 - RNA, 22 nt, Homo sapiens
uacaguggcaugucaggugcuu

SEQ ID NO: 221092 - RNA, 22 nt, Homo sapiens
uacauacuguaugguucuguuu

SEQ ID NO: 221093 - RNA, 20 nt, Homo sapiens
uacauaguaaacugagagca

SEQ ID NO: 221094 - RNA, 22 nt, Homo sapiens
uaccacaggcuggguaaucuau

SEQ ID NO: 221095 - RNA, 22 nt, Homo sapiens
uaccacagucauuacacuugua

SEQ ID NO: 221096 - RNA, 22 nt, Homo sapiens
uaccagugaauuccaggggcua

SEQ ID NO: 221097 - RNA, 22 nt, Homo sapiens
uaccaugaagguggagagagaa

SEQ ID NO: 221098 - RNA, 22 nt, Homo sapiens
uaccaugcagguguauguuugu

SEQ ID NO: 221099 - RNA, 22 nt, Homo sapiens
uaccauguaucugggaugcuuu

SEQ ID NO: 221100 - RNA, 19 nt, Homo sapiens
uacccagaagcagcauugu

SEQ ID NO: 221101 - RNA, 22 nt, Homo sapiens
uacccguugaggguuugccagc

SEQ ID NO: 221102 - RNA, 22 nt, Homo sapiens
uaccucaguucaauaacagaua

SEQ ID NO: 221103 - RNA, 22 nt, Homo sapiens
uaccugagacaacuuugaggaa

SEQ ID NO: 221104 - RNA, 23 nt, Homo sapiens
uaccugagacuggguaauuaaua

SEQ ID NO: 221105 - RNA, 22 nt, Homo sapiens
uaccuguagcucuucuaggcug

SEQ ID NO: 221106 - RNA, 16 nt, Homo sapiens
uacuacugccuauuau

SEQ ID NO: 221107 - RNA, 22 nt, Homo sapiens
uacuagaggaaaacuugaagac

SEQ ID NO: 221108 - RNA, 23 nt, Homo sapiens
uacuaguaagcguguucuuugca

SEQ ID NO: 221109 - RNA, 22 nt, Homo sapiens
uacuauugcaucggugauuagg

SEQ ID NO: 221110 - RNA, 22 nt, Homo sapiens
uacucacauucuguuucuugcu

SEQ ID NO: 221111 - RNA, 22 nt, Homo sapiens
uacucugcaguaauuccagccc

SEQ ID NO: 221112 - RNA, 22 nt, Homo sapiens
uacugcacuccacccuggguga

SEQ ID NO: 221113 - RNA, 22 nt, Homo sapiens
uacugcacuccagccuggguga

SEQ ID NO: 221114 - RNA, 22 nt, Homo sapiens
uacugcacuccagcuuaggaga

SEQ ID NO: 221115 - RNA, 22 nt, Homo sapiens
uacugcacuccaggcucaccug

SEQ ID NO: 221116 - RNA, 22 nt, Homo sapiens
uacugcacucuagccuggguga

SEQ ID NO: 221117 - RNA, 18 nt, Homo sapiens
uacugcacucuccagccu

SEQ ID NO: 221118 - RNA, 22 nt, Homo sapiens
uacugcacuugaccuccugggc

SEQ ID NO: 221119 - RNA, 22 nt, Homo sapiens
uacugcaguugcagcuugagga

SEQ ID NO: 221120 - RNA, 22 nt, Homo sapiens
uacugcaucgaaaugcuuuuau

SEQ ID NO: 221121 - RNA, 21 nt, Homo sapiens
uacuggagauacagucugcaa

SEQ ID NO: 221122 - RNA, 22 nt, Homo sapiens
uacuggccuugaacucuggugu

SEQ ID NO: 221123 - RNA, 19 nt, Homo sapiens
uacuggcucgggaauuuuc

SEQ ID NO: 221124 - RNA, 22 nt, Homo sapiens
uacuguguaguuagaccucaga

SEQ ID NO: 221125 - RNA, 22 nt, Homo sapiens
uacuuuguagagugugagaauu

SEQ ID NO: 221126 - RNA, 20 nt, Homo sapiens
uagaaaguagaguggugguu

SEQ ID NO: 221127 - RNA, 22 nt, Homo sapiens
uagaacaauugcuggauccgaa

SEQ ID NO: 221128 - RNA, 22 nt, Homo sapiens
uagaagcacuaucccuccuagu

SEQ ID NO: 221129 - RNA, 22 nt, Homo sapiens
uagaaguaggcuacgugucugg

SEQ ID NO: 221130 - RNA, 18 nt, Homo sapiens
uagaauauaggucauucu

SEQ ID NO: 221131 - RNA, 22 nt, Homo sapiens
uagaaugaaacaagcugugccu

SEQ ID NO: 221132 - RNA, 22 nt, Homo sapiens
uagaauguauaauauuuuacuu

SEQ ID NO: 221133 - RNA, 22 nt, Homo sapiens
uagaaugucagcuucuugaggg

SEQ ID NO: 221134 - RNA, 22 nt, Homo sapiens
uagacacugcauauuuuuuuaa

SEQ ID NO: 221135 - RNA, 22 nt, Homo sapiens
uagaccaauuggcauauaguaa

SEQ ID NO: 221136 - RNA, 22 nt, Homo sapiens
uagacccauuacguaguuucca

SEQ ID NO: 221137 - RNA, 22 nt, Homo sapiens
uagacccauuguucagagagug

SEQ ID NO: 221138 - RNA, 22 nt, Homo sapiens
uagagcacauuaucauuuccaa

SEQ ID NO: 221139 - RNA, 22 nt, Homo sapiens
uagagcaugugccauacguaca

SEQ ID NO: 221140 - RNA, 22 nt, Homo sapiens
uagagccauugcagauguuuga

SEQ ID NO: 221141 - RNA, 22 nt, Homo sapiens
uagagcuagggacucgcaaugu

SEQ ID NO: 221142 - RNA, 22 nt, Homo sapiens
uagagcuugacacuuuccaugg

SEQ ID NO: 221143 - RNA, 22 nt, Homo sapiens
uagagguagagugacuucccca

SEQ ID NO: 221144 - RNA, 22 nt, Homo sapiens
uagagguauuaacaguagaaga

SEQ ID NO: 221145 - RNA, 22 nt, Homo sapiens
uagagguucuaagauucucaga

SEQ ID NO: 221146 - RNA, 22 nt, Homo sapiens
uagauaguuaugauuugaugau

SEQ ID NO: 221147 - RNA, 19 nt, Homo sapiens
uagaugucuuugcauagau

SEQ ID NO: 221148 - RNA, 22 nt, Homo sapiens
uagauuauccggcugggacaau

SEQ ID NO: 221149 - RNA, 22 nt, Homo sapiens
uagauuaucucaccacucgagu

SEQ ID NO: 221150 - RNA, 22 nt, Homo sapiens
uagauuguuuaaguggcacaca

SEQ ID NO: 221151 - RNA, 22 nt, Homo sapiens
uagcaaaucaauggaauugaag

SEQ ID NO: 221152 - RNA, 21 nt, Homo sapiens
uagcaaauugcuauuaaggca

SEQ ID NO: 221153 - RNA, 23 nt, Homo sapiens
uagcaacaguuggaggugaggua

SEQ ID NO: 221154 - RNA, 17 nt, Homo sapiens
uagcacagugccuggua

SEQ ID NO: 221155 - RNA, 22 nt, Homo sapiens
uagcacaguucacccucgauuu

SEQ ID NO: 221156 - RNA, 22 nt, Homo sapiens
uagcacuauuuuucacuauccu

SEQ ID NO: 221157 - RNA, 22 nt, Homo sapiens
uagcagaauaacuugccagccu

SEQ ID NO: 221158 - RNA, 22 nt, Homo sapiens
uagcagaauauaccucuuacuu

SEQ ID NO: 221159 - RNA, 18 nt, Homo sapiens
uagcagacaucauugggg

SEQ ID NO: 221160 - RNA, 22 nt, Homo sapiens
uagcaggaaaggggucagaucu

SEQ ID NO: 221161 - RNA, 22 nt, Homo sapiens
uagcagguguuccacaaauauu

SEQ ID NO: 221162 - RNA, 22 nt, Homo sapiens
uagcaguagacagacuuuggcu

SEQ ID NO: 221163 - RNA, 22 nt, Homo sapiens
uagcaguauugaaagaugaggg

SEQ ID NO: 221164 - RNA, 22 nt, Homo sapiens
uagcaguucauuguugugugaa

SEQ ID NO: 221165 - RNA, 22 nt, Homo sapiens
uagcaucaauucauguuaugau

SEQ ID NO: 221166 - RNA, 22 nt, Homo sapiens
uagcauccuucucuaaacagga

SEQ ID NO: 221167 - RNA, 18 nt, Homo sapiens
uagcaugaugcugagugc

SEQ ID NO: 221168 - RNA, 22 nt, Homo sapiens
uagcaugucagucgccacacgu

SEQ ID NO: 221169 - RNA, 22 nt, Homo sapiens
uagcucagcccagcuaagcuca

SEQ ID NO: 221170 - RNA, 22 nt, Homo sapiens
uagcuccagugggguuacugcu

SEQ ID NO: 221171 - RNA, 22 nt, Homo sapiens
uagcugauguuugucuaguagc

SEQ ID NO: 221172 - RNA, 21 nt, Homo sapiens
uagcugcacccaggccuccuu

SEQ ID NO: 221173 - RNA, 22 nt, Homo sapiens
uagcugcacuuacaagugagaa

SEQ ID NO: 221174 - RNA, 22 nt, Homo sapiens
uagcugcccagcacgaaguugg

SEQ ID NO: 221175 - RNA, 22 nt, Homo sapiens
uaacacagagcuccuaaucccu

SEQ ID NO: 221176 - RNA, 22 nt, Homo sapiens
uaacaccuuugauagcacuuuu

SEQ ID NO: 221177 - RNA, 22 nt, Homo sapiens
uaacagcauuugugucuaguag

SEQ ID NO: 221178 - RNA, 22 nt, Homo sapiens
uaacagcucuacagcugcucuu

SEQ ID NO: 221179 - RNA, 22 nt, Homo sapiens
uaacaggcaaggucacaccuug

SEQ ID NO: 221180 - RNA, 22 nt, Homo sapiens
uaacaguauaugugguaucuau

SEQ ID NO: 221181 - RNA, 18 nt, Homo sapiens
uaacagucucucaggauc

SEQ ID NO: 221182 - RNA, 22 nt, Homo sapiens
uaacauucacaugcugcaaaaa

SEQ ID NO: 221183 - RNA, 22 nt, Homo sapiens
uaacccuuaguaucuguggguu

SEQ ID NO: 221184 - RNA, 22 nt, Homo sapiens
uaacuaguggaauuugauuuca

SEQ ID NO: 221185 - RNA, 22 nt, Homo sapiens
uaacucugccuagugacauggu

SEQ ID NO: 221186 - RNA, 22 nt, Homo sapiens
uaacugcaaccuccgccucccg

SEQ ID NO: 221187 - RNA, 22 nt, Homo sapiens
uaacugccuacugugcaaauau

SEQ ID NO: 221188 - RNA, 22 nt, Homo sapiens
uaagacacauguguucccaggc

SEQ ID NO: 221189 - RNA, 22 nt, Homo sapiens
uaagagcuaggauuuuaaauca

SEQ ID NO: 221190 - RNA, 22 nt, Homo sapiens
uaagaugaaggcucaccuagaa

SEQ ID NO: 221191 - RNA, 18 nt, Homo sapiens
uaagaugcagccuauucc

SEQ ID NO: 221192 - RNA, 22 nt, Homo sapiens
uaagcaguguggauccaccuug

SEQ ID NO: 221193 - RNA, 21 nt, Homo sapiens
uaagcuaaacauucaguuaac

SEQ ID NO: 221194 - RNA, 22 nt, Homo sapiens
uaagcuaauguguuuucucuua

SEQ ID NO: 221195 - RNA, 22 nt, Homo sapiens
uaagcuauagugaauaaauugc

SEQ ID NO: 221196 - RNA, 22 nt, Homo sapiens
uaagcucauuccagccaugucc

SEQ ID NO: 221197 - RNA, 22 nt, Homo sapiens
uaaggaaggcugugugcuuuua

SEQ ID NO: 221198 - RNA, 22 nt, Homo sapiens
uaaggcacuacuuuaggcuuuc

SEQ ID NO: 221199 - RNA, 22 nt, Homo sapiens
uaaggcauuuuuuugaguugca

SEQ ID NO: 221200 - RNA, 22 nt, Homo sapiens
uaaggcucuuguuauuuugagg

SEQ ID NO: 221201 - RNA, 22 nt, Homo sapiens
uaaggcuuugcuggacucaguc

SEQ ID NO: 221202 - RNA, 22 nt, Homo sapiens
uaaggcuuugguagguuugguc

SEQ ID NO: 221203 - RNA, 22 nt, Homo sapiens
uaagggcaugcugcaugagagu

SEQ ID NO: 221204 - RNA, 22 nt, Homo sapiens
uaaguaauugcagcaauuugcc

SEQ ID NO: 221205 - RNA, 22 nt, Homo sapiens
uaaguacaugcuagauggaaug

SEQ ID NO: 221206 - RNA, 19 nt, Homo sapiens
uaaguagaugacugaugcu

SEQ ID NO: 221207 - RNA, 22 nt, Homo sapiens
uaaguauuuuaauuccuggcau

SEQ ID NO: 221208 - RNA, 22 nt, Homo sapiens
uaagucguggaugauucuucgg

SEQ ID NO: 221209 - RNA, 22 nt, Homo sapiens
uaagugaauuugacagguaaug

SEQ ID NO: 221210 - RNA, 22 nt, Homo sapiens
uaaguggaagaugucaaucaua

SEQ ID NO: 221211 - RNA, 22 nt, Homo sapiens
uaaguuagugugagaauuuugc

SEQ ID NO: 221212 - RNA, 23 nt, Homo sapiens
uaaguucaucucuaauaggugga

SEQ ID NO: 221213 - RNA, 22 nt, Homo sapiens
uaaguuguagaacguuuucuua

SEQ ID NO: 221214 - RNA, 22 nt, Homo sapiens
uaauaauguuaggcuuacucaa

SEQ ID NO: 221215 - RNA, 22 nt, Homo sapiens
uaauacugcugugcuugaguug

SEQ ID NO: 221216 - RNA, 22 nt, Homo sapiens
uaauacuguaauggugguuccg

SEQ ID NO: 221217 - RNA, 22 nt, Homo sapiens
uaauagagucauuauuauuguu

SEQ ID NO: 221218 - RNA, 22 nt, Homo sapiens
uaauagcaguguuacuaggacu

SEQ ID NO: 221219 - RNA, 22 nt, Homo sapiens
uaauaguguuaaugcuagagcu

SEQ ID NO: 221220 - RNA, 22 nt, Homo sapiens
uaauaguuggcacuggagaaag

SEQ ID NO: 221221 - RNA, 22 nt, Homo sapiens
uaaucucagcugagcugagauu

SEQ ID NO: 221222 - RNA, 22 nt, Homo sapiens
uaaugcacauuuauuuuaccuu

SEQ ID NO: 221223 - RNA, 22 nt, Homo sapiens
uaaugcauacagaagguguuuu

SEQ ID NO: 221224 - RNA, 22 nt, Homo sapiens
uaaugcaucaugguuggcaaac

SEQ ID NO: 221225 - RNA, 19 nt, Homo sapiens
uaaugccacugccuggcau

SEQ ID NO: 221226 - RNA, 22 nt, Homo sapiens
uaaugcuguggucugguuuaaa

SEQ ID NO: 221227 - RNA, 22 nt, Homo sapiens
uaaugcuugguuguuuggaaaa

SEQ ID NO: 221228 - RNA, 22 nt, Homo sapiens
uaauucuguauguaucagaguu

SEQ ID NO: 221229 - RNA, 22 nt, Homo sapiens
uacaaagugggaaacgaagguu

SEQ ID NO: 221230 - RNA, 22 nt, Homo sapiens
uacaagcaggaaaugguauaug

SEQ ID NO: 221231 - RNA, 22 nt, Homo sapiens
uacaaguggguuugugcaggag

SEQ ID NO: 221232 - RNA, 22 nt, Homo sapiens
uacaccugaguuugugguuuuc

SEQ ID NO: 221233 - RNA, 18 nt, Homo sapiens
uacagaacuggaguagaa

SEQ ID NO: 221234 - RNA, 22 nt, Homo sapiens
uacagaauugcagguguggcag

SEQ ID NO: 221235 - RNA, 22 nt, Homo sapiens
uacagaguagaagauuugcaga

SEQ ID NO: 221236 - RNA, 22 nt, Homo sapiens
uacagaguauccauuugaguuc

SEQ ID NO: 221237 - RNA, 22 nt, Homo sapiens
uacaggaaugucagguugcugu

SEQ ID NO: 221238 - RNA, 20 nt, Homo sapiens
ggaauagucuacacucugac

SEQ ID NO: 221239 - RNA, 23 nt, Homo sapiens
ggaaugaaaccugguuaugauau

SEQ ID NO: 221240 - RNA, 22 nt, Homo sapiens
ggaaugcagugagcauuagaua

SEQ ID NO: 221241 - RNA, 22 nt, Homo sapiens
ggaauggaacaaagucuugaaa

SEQ ID NO: 221242 - RNA, 22 nt, Homo sapiens
ggaauguauuaaggcauugggc

SEQ ID NO: 221243 - RNA, 22 nt, Homo sapiens
ggaauguuaaagacuacacuga

SEQ ID NO: 221244 - RNA, 22 nt, Homo sapiens
ggacaaaguauuuucaaaugua

SEQ ID NO: 221245 - RNA, 22 nt, Homo sapiens
ggacacaucaugugaccaaggu

SEQ ID NO: 221246 - RNA, 22 nt, Homo sapiens
ggacagaaaggguucaccaaac

SEQ ID NO: 221247 - RNA, 22 nt, Homo sapiens
ggagaauguaauugguauuuug

SEQ ID NO: 221248 - RNA, 22 nt, Homo sapiens
ggagaugaaaugagcuacuuaa

SEQ ID NO: 221249 - RNA, 22 nt, Homo sapiens
ggagcaaugccucauucucacu

SEQ ID NO: 221250 - RNA, 22 nt, Homo sapiens
ggagcuuugaaaguuuccgguu

SEQ ID NO: 221251 - RNA, 22 nt, Homo sapiens
ggagggugagaucaauuuggga

SEQ ID NO: 221252 - RNA, 22 nt, Homo sapiens
ggaguaggcuguccggcaccca

SEQ ID NO: 221253 - RNA, 23 nt, Homo sapiens
ggaguguaaugacucgaucucgg

SEQ ID NO: 221254 - RNA, 22 nt, Homo sapiens
ggaguguaguggcuccaucucg

SEQ ID NO: 221255 - RNA, 22 nt, Homo sapiens
ggagugugauucaguauaauau

SEQ ID NO: 221256 - RNA, 22 nt, Homo sapiens
ggaguguguuuuccaacuuggu

SEQ ID NO: 221257 - RNA, 22 nt, Homo sapiens
ggaguguuccauuugucacauu

SEQ ID NO: 221258 - RNA, 22 nt, Homo sapiens
ggauauguagggcauaucuaca

SEQ ID NO: 221259 - RNA, 22 nt, Homo sapiens
ggaucacuugagaccaggaguu

SEQ ID NO: 221260 - RNA, 22 nt, Homo sapiens
ggaugcauuuuugguugucaca

SEQ ID NO: 221261 - RNA, 22 nt, Homo sapiens
ggaugugugcacgcgcacaugc

SEQ ID NO: 221262 - RNA, 22 nt, Homo sapiens
ggauugugauaauuguugcaaa

SEQ ID NO: 221263 - RNA, 22 nt, Homo sapiens
ggcaaagagacaugcaucgggg

SEQ ID NO: 221264 - RNA, 22 nt, Homo sapiens
ggcaaaucugcaauuacuuuug

SEQ ID NO: 221265 - RNA, 22 nt, Homo sapiens
ggcaacaugaugaaaugccauc

SEQ ID NO: 221266 - RNA, 22 nt, Homo sapiens
ggcaacaugccgaaaccacguc

SEQ ID NO: 221267 - RNA, 22 nt, Homo sapiens
ggcaacauggugaaacucuguc

SEQ ID NO: 221268 - RNA, 22 nt, Homo sapiens
ggcaagaaagaaaucaucuguc

SEQ ID NO: 221269 - RNA, 22 nt, Homo sapiens
ggcaagaaccacaauuacuuuu

SEQ ID NO: 221270 - RNA, 23 nt, Homo sapiens
ggcaagaucucagcucacugcaa

SEQ ID NO: 221271 - RNA, 22 nt, Homo sapiens
ggcaaggaggggcacuuucacu

SEQ ID NO: 221272 - RNA, 22 nt, Homo sapiens
ggcaagugggagggaguguuuc

SEQ ID NO: 221273 - RNA, 21 nt, Homo sapiens
ggcaagugugagguuuggggu

SEQ ID NO: 221274 - RNA, 22 nt, Homo sapiens
ggcaauauuauuaacccucugu

SEQ ID NO: 221275 - RNA, 22 nt, Homo sapiens
ggcaccacagacgccaggcgug

SEQ ID NO: 221276 - RNA, 22 nt, Homo sapiens
ggcaccauggaaggacgggagc

SEQ ID NO: 221277 - RNA, 22 nt, Homo sapiens
ggcacuguggcucaagccugua

SEQ ID NO: 221278 - RNA, 22 nt, Homo sapiens
ggcagaucauuggccucaguuu

SEQ ID NO: 221279 - RNA, 22 nt, Homo sapiens
ggcagcaugggugccuuuguga

SEQ ID NO: 221280 - RNA, 22 nt, Homo sapiens
ggcagcucaggccccgcgcuga

SEQ ID NO: 221281 - RNA, 22 nt, Homo sapiens
ggcagcuguguccuucguaagg

SEQ ID NO: 221282 - RNA, 23 nt, Homo sapiens
ggcagguuggucuaggucuauuc

SEQ ID NO: 221283 - RNA, 22 nt, Homo sapiens
ggcaguguauuacuuaggguuc

SEQ ID NO: 221284 - RNA, 22 nt, Homo sapiens
ggcaguguggcugcauauagca

SEQ ID NO: 221285 - RNA, 22 nt, Homo sapiens
ggcaguuuguucuugcuccuuu

SEQ ID NO: 221286 - RNA, 22 nt, Homo sapiens
ggcaguuuguuugugaggucca

SEQ ID NO: 221287 - RNA, 22 nt, Homo sapiens
ggcaugauguauuugagguuug

SEQ ID NO: 221288 - RNA, 22 nt, Homo sapiens
ggcauguugauagguagaugua

SEQ ID NO: 221289 - RNA, 22 nt, Homo sapiens
ggcauguuuaguagaauguggu

SEQ ID NO: 221290 - RNA, 22 nt, Homo sapiens
ggcccaguugcgggugguaccg

SEQ ID NO: 221291 - RNA, 22 nt, Homo sapiens
ggcccugauacaaguaaggucu

SEQ ID NO: 221292 - RNA, 22 nt, Homo sapiens
ggcgccauugcacuccagccug

SEQ ID NO: 221293 - RNA, 22 nt, Homo sapiens
ggcgguguccuccaagugcuuc

SEQ ID NO: 221294 - RNA, 22 nt, Homo sapiens
ggcgguguugauggcccccaca

SEQ ID NO: 221295 - RNA, 22 nt, Homo sapiens
ggcuagagacaaguugcugaga

SEQ ID NO: 221296 - RNA, 22 nt, Homo sapiens
ggcuagauauucacauauggcu

SEQ ID NO: 221297 - RNA, 22 nt, Homo sapiens
ggcucagugggguccugguucu

SEQ ID NO: 221298 - RNA, 21 nt, Homo sapiens
ggcucuguggucucagguuuc

SEQ ID NO: 221299 - RNA, 18 nt, Homo sapiens
ggcugguguuuuaguaua

SEQ ID NO: 221300 - RNA, 22 nt, Homo sapiens
ggcugguuuucaguuacugagu

SEQ ID NO: 221301 - RNA, 22 nt, Homo sapiens
gggaaaaugucuauugaaugaa

SEQ ID NO: 221302 - RNA, 22 nt, Homo sapiens
gggaagauauaggcugggcacc

SEQ ID NO: 221303 - RNA, 22 nt, Homo sapiens
gggaagugugcagaguucucuu

SEQ ID NO: 221304 - RNA, 22 nt, Homo sapiens
gggaagugugguuucuuuacag

SEQ ID NO: 221305 - RNA, 22 nt, Homo sapiens
gggaauguagcaaaucugcaau

SEQ ID NO: 221306 - RNA, 19 nt, Homo sapiens
gggaggaugcgucuucagg

SEQ ID NO: 221307 - RNA, 22 nt, Homo sapiens
gggagguagguauuagcuuuuc

SEQ ID NO: 221308 - RNA, 22 nt, Homo sapiens
gggaggucauuguaaggucuua

SEQ ID NO: 221309 - RNA, 22 nt, Homo sapiens
gggaggucauuguucaaugcug

SEQ ID NO: 221310 - RNA, 22 nt, Homo sapiens
gggaguagagaguuucucugac

SEQ ID NO: 221311 - RNA, 22 nt, Homo sapiens
gggagugucuaaccuguuaaca

SEQ ID NO: 221312 - RNA, 22 nt, Homo sapiens
gggaguguguaggacccagugu

SEQ ID NO: 221313 - RNA, 22 nt, Homo sapiens
gggaugaagaagaauaguucgu

SEQ ID NO: 221314 - RNA, 22 nt, Homo sapiens
gggaugaagcccuaggguuggu

SEQ ID NO: 221315 - RNA, 22 nt, Homo sapiens
gggaugaaguugauguagaaag

SEQ ID NO: 221316 - RNA, 22 nt, Homo sapiens
gggaugaauuagguauguuuau

SEQ ID NO: 221317 - RNA, 22 nt, Homo sapiens
gggaugauuaugguucacuaca

SEQ ID NO: 221318 - RNA, 22 nt, Homo sapiens
uuaagugcucaguuacucaguu

SEQ ID NO: 221319 - RNA, 20 nt, Homo sapiens
uuaagugcuuucugcuuaga

SEQ ID NO: 221320 - RNA, 22 nt, Homo sapiens
uuaagugguagguggugcccaa

SEQ ID NO: 221321 - RNA, 19 nt, Homo sapiens
uuaagugugauaucucagu

SEQ ID NO: 221322 - RNA, 22 nt, Homo sapiens
uucagcacugaaaauaugucau

SEQ ID NO: 221323 - RNA, 22 nt, Homo sapiens
uucaggcuuuuauuuacugaua

SEQ ID NO: 221324 - RNA, 22 nt, Homo sapiens
uucagggagaaggcaaacguug

SEQ ID NO: 221325 - RNA, 22 nt, Homo sapiens
uucagguacuauaggcuguugg

SEQ ID NO: 221326 - RNA, 22 nt, Homo sapiens
uucagguacugggggaguaugg

SEQ ID NO: 221327 - RNA, 22 nt, Homo sapiens
uucagguaucccuugucuauag

SEQ ID NO: 221328 - RNA, 22 nt, Homo sapiens
uucagguucauuugcugcuauu

SEQ ID NO: 221329 - RNA, 22 nt, Homo sapiens
uucaguacacguguucucauuu

SEQ ID NO: 221330 - RNA, 22 nt, Homo sapiens
uucaguggagaggcugaguggu

SEQ ID NO: 221331 - RNA, 22 nt, Homo sapiens
uucagugguuauuugugagauu

SEQ ID NO: 221332 - RNA, 22 nt, Homo sapiens
uucagugucauuaacacaguag

SEQ ID NO: 221333 - RNA, 22 nt, Homo sapiens
uucauagucuaauuuuuuccac

SEQ ID NO: 221334 - RNA, 22 nt, Homo sapiens
uucauaguguuuccuuccagug

SEQ ID NO: 221335 - RNA, 22 nt, Homo sapiens
uucauaguuuauacugauauuu

SEQ ID NO: 221336 - RNA, 22 nt, Homo sapiens
uucaucaggaauauugaccugu

SEQ ID NO: 221337 - RNA, 23 nt, Homo sapiens
uucaucagggauauuggccugaa

SEQ ID NO: 221338 - RNA, 22 nt, Homo sapiens
uucaugcaucuguagugguuaa

SEQ ID NO: 221339 - RNA, 22 nt, Homo sapiens
uucauggaauauugaccauuuu

SEQ ID NO: 221340 - RNA, 22 nt, Homo sapiens
uucauggaguugagaaggcuaa

SEQ ID NO: 221341 - RNA, 22 nt, Homo sapiens
uucauggaguuuaaauuguagu

SEQ ID NO: 221342 - RNA, 22 nt, Homo sapiens
uucauggaugcauuugaggggu

SEQ ID NO: 221343 - RNA, 22 nt, Homo sapiens
uuccacaauggcugaacuaguu

SEQ ID NO: 221344 - RNA, 22 nt, Homo sapiens
uuccacagggauuugcauugau

SEQ ID NO: 221345 - RNA, 22 nt, Homo sapiens
uuccagaugggaguucuauucu

SEQ ID NO: 221346 - RNA, 22 nt, Homo sapiens
uuccaguaauagcacagcauug

SEQ ID NO: 221347 - RNA, 22 nt, Homo sapiens
uuccaguggacuacuucauccu

SEQ ID NO: 221348 - RNA, 22 nt, Homo sapiens
uuccaguguuugacucaccuuu

SEQ ID NO: 221349 - RNA, 22 nt, Homo sapiens
uuccaguuuuauggguauagag

SEQ ID NO: 221350 - RNA, 22 nt, Homo sapiens
uuccauagucauagugcugaug

SEQ ID NO: 221351 - RNA, 22 nt, Homo sapiens
uuccaugugggcuugucaagua

SEQ ID NO: 221352 - RNA, 22 nt, Homo sapiens
uuccauugugucaucuuggugg

SEQ ID NO: 221353 - RNA, 22 nt, Homo sapiens
uucccagagagggacuucuaau

SEQ ID NO: 221354 - RNA, 22 nt, Homo sapiens
uucccaguuggggaaagcgacc

SEQ ID NO: 221355 - RNA, 22 nt, Homo sapiens
uucccuguaucuucugccaugu

SEQ ID NO: 221356 - RNA, 22 nt, Homo sapiens
uucccugugggaguaggaaagu

SEQ ID NO: 221357 - RNA, 23 nt, Homo sapiens
uucccuuagaagaaggggagaaa

SEQ ID NO: 221358 - RNA, 22 nt, Homo sapiens
uucccuuucugccuugaaucuu

SEQ ID NO: 221359 - RNA, 22 nt, Homo sapiens
uucccuuugaauuggaaaggug

SEQ ID NO: 221360 - RNA, 22 nt, Homo sapiens
uucccuuuguuaaauuggaaga

SEQ ID NO: 221361 - RNA, 22 nt, Homo sapiens
uuccguguaguugagcaguuuu

SEQ ID NO: 221362 - RNA, 22 nt, Homo sapiens
uuccuacugcccauuaaaaugg

SEQ ID NO: 221363 - RNA, 22 nt, Homo sapiens
uuccugagccuuguaucuagua

SEQ ID NO: 221364 - RNA, 22 nt, Homo sapiens
uuccuggaggggaaguguccaa

SEQ ID NO: 221365 - RNA, 22 nt, Homo sapiens
uuccugugacccccaagcccac

SEQ ID NO: 221366 - RNA, 20 nt, Homo sapiens
uuccuuaggcauuggaagaa

SEQ ID NO: 221367 - RNA, 22 nt, Homo sapiens
uuccuuaguuauuugguccccu

SEQ ID NO: 221368 - RNA, 22 nt, Homo sapiens
uuccuugagaaaguacaaggcu

SEQ ID NO: 221369 - RNA, 22 nt, Homo sapiens
uucuaaguaagucuguggggaa

SEQ ID NO: 221370 - RNA, 22 nt, Homo sapiens
uucuaaguaauuuugcaugccu

SEQ ID NO: 221371 - RNA, 22 nt, Homo sapiens
uucuacaggcuguucaagaagc

SEQ ID NO: 221372 - RNA, 21 nt, Homo sapiens
uucuacuccggcguuguuuuu

SEQ ID NO: 221373 - RNA, 22 nt, Homo sapiens
uucuaguacucccuggagcugg

SEQ ID NO: 221374 - RNA, 22 nt, Homo sapiens
uucuaugguuaccaggcuaguc

SEQ ID NO: 221375 - RNA, 22 nt, Homo sapiens
uucuauugguaauauuuucugu

SEQ ID NO: 221376 - RNA, 22 nt, Homo sapiens
uucucaauggaugugggaccag

SEQ ID NO: 221377 - RNA, 21 nt, Homo sapiens
uucucagaggcaggggauaaa

SEQ ID NO: 221378 - RNA, 21 nt, Homo sapiens
uucucaggguguguccuaccc

SEQ ID NO: 221379 - RNA, 22 nt, Homo sapiens
uucucaguuccuacuuugguga

SEQ ID NO: 221380 - RNA, 22 nt, Homo sapiens
uucucgcuuuuuccaccuguau

SEQ ID NO: 221381 - RNA, 22 nt, Homo sapiens
uucucugggacauaggucgggu

SEQ ID NO: 221382 - RNA, 22 nt, Homo sapiens
uucuggcucgauucucugaccg

SEQ ID NO: 221383 - RNA, 19 nt, Homo sapiens
uucugguguuuuaagccaa

SEQ ID NO: 221384 - RNA, 22 nt, Homo sapiens
uucugugguugaaaggagagau

SEQ ID NO: 221385 - RNA, 22 nt, Homo sapiens
uucuucaggcauucccagaagc

SEQ ID NO: 221386 - RNA, 22 nt, Homo sapiens
uucuucaggccacaaaaauggu

SEQ ID NO: 221387 - RNA, 22 nt, Homo sapiens
uucuuccagccuugaggggccc

SEQ ID NO: 221388 - RNA, 22 nt, Homo sapiens
uucuugguuuaucgcuuuaaaa

SEQ ID NO: 221389 - RNA, 22 nt, Homo sapiens
uucuuugcaugaucucaaaguc

SEQ ID NO: 221390 - RNA, 22 nt, Homo sapiens
uucuuugcuuggaagcggggga

SEQ ID NO: 221391 - RNA, 19 nt, Homo sapiens
uucuuuguugugggggcug

SEQ ID NO: 221392 - RNA, 23 nt, Homo sapiens
uugaaaagucaguagccucugau

SEQ ID NO: 221393 - RNA, 22 nt, Homo sapiens
uugaaagacagaggggcaaguu

SEQ ID NO: 221394 - RNA, 22 nt, Homo sapiens
uugaaagacaucaccuacugcu

SEQ ID NO: 221395 - RNA, 22 nt, Homo sapiens
uugaaaguaaacaucacaaaga

SEQ ID NO: 221396 - RNA, 22 nt, Homo sapiens
uugaaagucauggcacaggcaa

SEQ ID NO: 221397 - RNA, 22 nt, Homo sapiens
uugaaccauucuuuugauagag

SEQ ID NO: 221398 - RNA, 22 nt, Homo sapiens
uugaagacuaaguuaucaggau

SEQ ID NO: 221399 - RNA, 22 nt, Homo sapiens
uugaagacuaauuuagauaaug

SEQ ID NO: 221400 - RNA, 22 nt, Homo sapiens
uugaagacuauaugauucuuca

SEQ ID NO: 221401 - RNA, 22 nt, Homo sapiens
uugaaguaggaaaggaggaggu

SEQ ID NO: 221402 - RNA, 22 nt, Homo sapiens
uugaaguagguaccguucaauu

SEQ ID NO: 221403 - RNA, 22 nt, Homo sapiens
uugaauagacagccagcuuuaa

SEQ ID NO: 221404 - RNA, 22 nt, Homo sapiens
uugaauagugacuuugauucug

SEQ ID NO: 221405 - RNA, 23 nt, Homo sapiens
uugaauguuuccccucccaaauu

SEQ ID NO: 221406 - RNA, 21 nt, Homo sapiens
uugacagugacagguaaaguu

SEQ ID NO: 221407 - RNA, 22 nt, Homo sapiens
uugacauaaucauuucacagug

SEQ ID NO: 221408 - RNA, 22 nt, Homo sapiens
uugaccucaucacuucccaaag

SEQ ID NO: 221409 - RNA, 22 nt, Homo sapiens
uugaccuggagaguacuuugac

SEQ ID NO: 221410 - RNA, 23 nt, Homo sapiens
uugacuguggguacaaugugaua

SEQ ID NO: 221411 - RNA, 19 nt, Homo sapiens
ggucacagggguuacaagg

SEQ ID NO: 221412 - RNA, 22 nt, Homo sapiens
ggucagauggcagcugggccug

SEQ ID NO: 221413 - RNA, 19 nt, Homo sapiens
ggucauggagguuguguga

SEQ ID NO: 221414 - RNA, 22 nt, Homo sapiens
ggucauggauaagauccagaag

SEQ ID NO: 221415 - RNA, 22 nt, Homo sapiens
ggucugguguugaaauucuuca

SEQ ID NO: 221416 - RNA, 22 nt, Homo sapiens
ggucuuggagaauuguccuggg

SEQ ID NO: 221417 - RNA, 22 nt, Homo sapiens
ggugacagugguuaaaauuugu

SEQ ID NO: 221418 - RNA, 19 nt, Homo sapiens
ggugagaaauuaugggucu

SEQ ID NO: 221419 - RNA, 22 nt, Homo sapiens
ggugagauguucagacgaacug

SEQ ID NO: 221420 - RNA, 22 nt, Homo sapiens
ggugaggaaaguugaguuucua

SEQ ID NO: 221421 - RNA, 22 nt, Homo sapiens
ggugagguaguaagguacaaua

SEQ ID NO: 221422 - RNA, 22 nt, Homo sapiens
ggugcagcacaccaacauggca

SEQ ID NO: 221423 - RNA, 22 nt, Homo sapiens
ggugucuuguuuaauacucauu

SEQ ID NO: 221424 - RNA, 20 nt, Homo sapiens
guaaacucucagcauagaug

SEQ ID NO: 221425 - RNA, 22 nt, Homo sapiens
guaaacuuccccucaugaauga

SEQ ID NO: 221426 - RNA, 22 nt, Homo sapiens
guaaaguaaagcacaucaaggu

SEQ ID NO: 221427 - RNA, 18 nt, Homo sapiens
guaaauguaucuauugcc

SEQ ID NO: 221428 - RNA, 22 nt, Homo sapiens
guaaauguccugcuacagagug

SEQ ID NO: 221429 - RNA, 22 nt, Homo sapiens
guaacagucucaacaguggucu

SEQ ID NO: 221430 - RNA, 22 nt, Homo sapiens
guaacucugucacuuacuaguu

SEQ ID NO: 221431 - RNA, 22 nt, Homo sapiens
guaacugguuuucuucccucuc

SEQ ID NO: 221432 - RNA, 22 nt, Homo sapiens
guaagguuguauuucaagaaac

SEQ ID NO: 221433 - RNA, 22 nt, Homo sapiens
guaauaccuuccccugcuggag

SEQ ID NO: 221434 - RNA, 22 nt, Homo sapiens
guaaucucagcuacgcgggagg

SEQ ID NO: 221435 - RNA, 22 nt, Homo sapiens
guaaucucagcuacucaggagg

SEQ ID NO: 221436 - RNA, 22 nt, Homo sapiens
guaaucucagcuacuugggagg

SEQ ID NO: 221437 - RNA, 22 nt, Homo sapiens
guacaagugcaguuucguuaca

SEQ ID NO: 221438 - RNA, 22 nt, Homo sapiens
guacacauacauauaugugugu

SEQ ID NO: 221439 - RNA, 22 nt, Homo sapiens
guacaguaguaaaagugaauga

SEQ ID NO: 221440 - RNA, 22 nt, Homo sapiens
guacaguauaguaauaggauuu

SEQ ID NO: 221441 - RNA, 22 nt, Homo sapiens
guacagugcucacaaugagagc

SEQ ID NO: 221442 - RNA, 22 nt, Homo sapiens
guacaguuuucaguguucacug

SEQ ID NO: 221443 - RNA, 22 nt, Homo sapiens
guacauagucacacauauacau

SEQ ID NO: 221444 - RNA, 22 nt, Homo sapiens
guacaugcauacaugcacaucu

SEQ ID NO: 221445 - RNA, 22 nt, Homo sapiens
guacauggaaugaaauucaaaa

SEQ ID NO: 221446 - RNA, 22 nt, Homo sapiens
guacccuauggauauagaugaa

SEQ ID NO: 221447 - RNA, 22 nt, Homo sapiens
guaccugggugacaggauuauu

SEQ ID NO: 221448 - RNA, 22 nt, Homo sapiens
guagaaaguuugcugucacaug

SEQ ID NO: 221449 - RNA, 22 nt, Homo sapiens
guagaagcacaggugaguuggu

SEQ ID NO: 221450 - RNA, 22 nt, Homo sapiens
guagcagccacacuugauaacu

SEQ ID NO: 221451 - RNA, 22 nt, Homo sapiens
guagcagcuacuaaguugcugu

SEQ ID NO: 221452 - RNA, 22 nt, Homo sapiens
guaggcacuggcucagcuuauc

SEQ ID NO: 221453 - RNA, 22 nt, Homo sapiens
guagggcaggcugagaaauaua

SEQ ID NO: 221454 - RNA, 22 nt, Homo sapiens
guagugcaguuugagaaucagu

SEQ ID NO: 221455 - RNA, 22 nt, Homo sapiens
guauagaucguagaccaauaaa

SEQ ID NO: 221456 - RNA, 22 nt, Homo sapiens
guauaggcuuucaccacgccau

SEQ ID NO: 221457 - RNA, 22 nt, Homo sapiens
guaucccuugcuaucugaaucu

SEQ ID NO: 221458 - RNA, 22 nt, Homo sapiens
guaugaguuuucugaugugugg

SEQ ID NO: 221459 - RNA, 18 nt, Homo sapiens
guaugcacaugccccugc

SEQ ID NO: 221460 - RNA, 22 nt, Homo sapiens
guauggaauuugugaccuuaua

SEQ ID NO: 221461 - RNA, 21 nt, Homo sapiens
guaugguugaagugacaagcc

SEQ ID NO: 221462 - RNA, 22 nt, Homo sapiens
guauuagguuggggcaaaagua

SEQ ID NO: 221463 - RNA, 22 nt, Homo sapiens
guauugacuaucaaucaugugc

SEQ ID NO: 221464 - RNA, 22 nt, Homo sapiens
guauuguacuacaagcucuuua

SEQ ID NO: 221465 - RNA, 19 nt, Homo sapiens
guauuugacuuucuuguuu

SEQ ID NO: 221466 - RNA, 22 nt, Homo sapiens
guauuugauuauagcaugcuua

SEQ ID NO: 221467 - RNA, 19 nt, Homo sapiens
gucaaagucgguauucaaa

SEQ ID NO: 221468 - RNA, 22 nt, Homo sapiens
gucacagaaaaagauaugccaa

SEQ ID NO: 221469 - RNA, 22 nt, Homo sapiens
gucacagcacuuuuaguaagug

SEQ ID NO: 221470 - RNA, 22 nt, Homo sapiens
gucacagcuggcauugucugca

SEQ ID NO: 221471 - RNA, 22 nt, Homo sapiens
gucaccagcuguguuagccccu

SEQ ID NO: 221472 - RNA, 22 nt, Homo sapiens
gucacugagcaauagaaaguuu

SEQ ID NO: 221473 - RNA, 22 nt, Homo sapiens
gucacuguuuccuauuauauuu

SEQ ID NO: 221474 - RNA, 22 nt, Homo sapiens
gucagagcacugaguugugggc

SEQ ID NO: 221475 - RNA, 22 nt, Homo sapiens
gucagcaaagaggaauaguuug

SEQ ID NO: 221476 - RNA, 22 nt, Homo sapiens
gucagugauugauuuaaagacg

SEQ ID NO: 221477 - RNA, 22 nt, Homo sapiens
gucagugugauaucugcagggg

SEQ ID NO: 221478 - RNA, 18 nt, Homo sapiens
gucauagaaugaugguuc

SEQ ID NO: 221479 - RNA, 22 nt, Homo sapiens
gucaucaggacgggucaucugc

SEQ ID NO: 221480 - RNA, 22 nt, Homo sapiens
gucaucaucaguccucugugca

SEQ ID NO: 221481 - RNA, 22 nt, Homo sapiens
gucauccaggcuggagugaagc

SEQ ID NO: 221482 - RNA, 22 nt, Homo sapiens
gucaugaacuguacuacuccua

SEQ ID NO: 221483 - RNA, 22 nt, Homo sapiens
gucaugaaguuuugaaugaaau

SEQ ID NO: 221484 - RNA, 22 nt, Homo sapiens
gucauggaaaucuacauuguua

SEQ ID NO: 221485 - RNA, 22 nt, Homo sapiens
gucauggacaguuugcuaauug

SEQ ID NO: 221486 - RNA, 22 nt, Homo sapiens
gucauggguuaaagguggauac

SEQ ID NO: 221487 - RNA, 22 nt, Homo sapiens
gucauuguguggacauggagaa

SEQ ID NO: 221488 - RNA, 22 nt, Homo sapiens
guccaaagugggagaggugggg

SEQ ID NO: 221489 - RNA, 22 nt, Homo sapiens
guccaagacuaggaguuggcag

SEQ ID NO: 221490 - RNA, 22 nt, Homo sapiens
guccaguacucuuuccugaaaa

SEQ ID NO: 221491 - RNA, 20 nt, Homo sapiens
guccauuugcugccauugcu

SEQ ID NO: 221492 - RNA, 18 nt, Homo sapiens
guccauuuguugguacac

SEQ ID NO: 221493 - RNA, 22 nt, Homo sapiens
gucccaguggaaccuccaagcu

SEQ ID NO: 221494 - RNA, 22 nt, Homo sapiens
gucccugcgauugugggauccu

SEQ ID NO: 221495 - RNA, 22 nt, Homo sapiens
guccugaagaccuuccucugga

SEQ ID NO: 221496 - RNA, 22 nt, Homo sapiens
gucguggagcucacagugugcc

SEQ ID NO: 221497 - RNA, 22 nt, Homo sapiens
gucuagaacuucugaccuuagg

SEQ ID NO: 221498 - RNA, 22 nt, Homo sapiens
uggcaagaacugcaauugcuuu

SEQ ID NO: 221499 - RNA, 23 nt, Homo sapiens
uggcaagaauucuuaccgugugg

SEQ ID NO: 221500 - RNA, 22 nt, Homo sapiens
uggcaagagaacaacaucucuc

SEQ ID NO: 221501 - RNA, 22 nt, Homo sapiens
uggcaagagauaugugucuaua

SEQ ID NO: 221502 - RNA, 22 nt, Homo sapiens
uggcaagagcugcauucaucug

SEQ ID NO: 221503 - RNA, 22 nt, Homo sapiens
uggcaagagggaugcaagguuu

SEQ ID NO: 221504 - RNA, 18 nt, Homo sapiens
uggcaagugccauacggu

SEQ ID NO: 221505 - RNA, 20 nt, Homo sapiens
uggcaagugggaauuguggg

SEQ ID NO: 221506 - RNA, 22 nt, Homo sapiens
gugaaagacagcauuaauggcu

SEQ ID NO: 221507 - RNA, 22 nt, Homo sapiens
gugaaaugaaacgcuaugucuu

SEQ ID NO: 221508 - RNA, 22 nt, Homo sapiens
gugaaaugaaucuggaaauauu

SEQ ID NO: 221509 - RNA, 22 nt, Homo sapiens
gugaaauguguagaggaucugg

SEQ ID NO: 221510 - RNA, 22 nt, Homo sapiens
gugaagaugugcaucagaucca

SEQ ID NO: 221511 - RNA, 22 nt, Homo sapiens
gugaaguuuuugugaggccuaa

SEQ ID NO: 221512 - RNA, 22 nt, Homo sapiens
gugaauguaaagucaugugacu

SEQ ID NO: 221513 - RNA, 22 nt, Homo sapiens
gugaauguuuucuuacauggua

SEQ ID NO: 221514 - RNA, 22 nt, Homo sapiens
gugacacagcaagacuccgucu

SEQ ID NO: 221515 - RNA, 20 nt, Homo sapiens
gugacacucguuaaccucug

SEQ ID NO: 221516 - RNA, 22 nt, Homo sapiens
gugaccagaugggcaggggugu

SEQ ID NO: 221517 - RNA, 22 nt, Homo sapiens
gugacgucauuguuccuggcuc

SEQ ID NO: 221518 - RNA, 22 nt, Homo sapiens
gugagaacugcuggggccacag

SEQ ID NO: 221519 - RNA, 22 nt, Homo sapiens
gugagaagaaaaauauggcugu

SEQ ID NO: 221520 - RNA, 22 nt, Homo sapiens
gugagaccaauguacuaccuuc

SEQ ID NO: 221521 - RNA, 22 nt, Homo sapiens
gugagaugauggguauguuaau

SEQ ID NO: 221522 - RNA, 22 nt, Homo sapiens
gugagaugguaucucauugugg

SEQ ID NO: 221523 - RNA, 22 nt, Homo sapiens
gugagaugugacuucugccucu

SEQ ID NO: 221524 - RNA, 22 nt, Homo sapiens
gugagcacugaaagaaggcaag

SEQ ID NO: 221525 - RNA, 22 nt, Homo sapiens
gugagcagagaucgcgugauug

SEQ ID NO: 221526 - RNA, 22 nt, Homo sapiens
gugaggaaggaaaccugcuagc

SEQ ID NO: 221527 - RNA, 22 nt, Homo sapiens
gugagggagcuggaauauuuau

SEQ ID NO: 221528 - RNA, 22 nt, Homo sapiens
gugagggaugugaaaaagguca

SEQ ID NO: 221529 - RNA, 22 nt, Homo sapiens
gugagguagagcaugugaaaga

SEQ ID NO: 221530 - RNA, 22 nt, Homo sapiens
gugauagaucugggauucagaa

SEQ ID NO: 221531 - RNA, 22 nt, Homo sapiens
gugauagguugucacugucacu

SEQ ID NO: 221532 - RNA, 22 nt, Homo sapiens
gugaucaugauccugaagcauu

SEQ ID NO: 221533 - RNA, 21 nt, Homo sapiens
gugaucaugucacugcacucc

SEQ ID NO: 221534 - RNA, 22 nt, Homo sapiens
gugaucuucauggaaggugaaa

SEQ ID NO: 221535 - RNA, 22 nt, Homo sapiens
gugaugguaguuuguauuucug

SEQ ID NO: 221536 - RNA, 22 nt, Homo sapiens
gugauguguuucaacagcuccu

SEQ ID NO: 221537 - RNA, 22 nt, Homo sapiens
gugauguguuuguucuaucucu

SEQ ID NO: 221538 - RNA, 22 nt, Homo sapiens
gugauuauccacgucuuuguga

SEQ ID NO: 221539 - RNA, 22 nt, Homo sapiens
gugcaaaucucugaguaucuuu

SEQ ID NO: 221540 - RNA, 22 nt, Homo sapiens
gugcaaguguaauacagcuagg

SEQ ID NO: 221541 - RNA, 22 nt, Homo sapiens
gugcaaugaguguggcaaagcc

SEQ ID NO: 221542 - RNA, 22 nt, Homo sapiens
gugcacaacaugcaguuuuguu

SEQ ID NO: 221543 - RNA, 22 nt, Homo sapiens
gugcacaacgugcaaguuuguu

SEQ ID NO: 221544 - RNA, 22 nt, Homo sapiens
gugcacaacgugcagguuuguu

SEQ ID NO: 221545 - RNA, 22 nt, Homo sapiens
gugcacaaucgugcauuccuug

SEQ ID NO: 221546 - RNA, 21 nt, Homo sapiens
gugcacaguaguguuuaauag

SEQ ID NO: 221547 - RNA, 22 nt, Homo sapiens
gugcacaucuguguuccagcua

SEQ ID NO: 221548 - RNA, 22 nt, Homo sapiens
gugcacuguagaacccuuuguu

SEQ ID NO: 221549 - RNA, 22 nt, Homo sapiens
gugcaguuuacaguuacccagu

SEQ ID NO: 221550 - RNA, 22 nt, Homo sapiens
gugcaguuugaaaguagaaaca

SEQ ID NO: 221551 - RNA, 22 nt, Homo sapiens
gugcaguuuuaagugaguuucu

SEQ ID NO: 221552 - RNA, 23 nt, Homo sapiens
gugcaugagucuuuauaguagca

SEQ ID NO: 221553 - RNA, 22 nt, Homo sapiens
gugcaugucuaugcgagucuaa

SEQ ID NO: 221554 - RNA, 22 nt, Homo sapiens
gugcaugucugugacgacccug

SEQ ID NO: 221555 - RNA, 22 nt, Homo sapiens
gugccacaguguuaagggauuc

SEQ ID NO: 221556 - RNA, 23 nt, Homo sapiens
gugccuucugagccuagucucca

SEQ ID NO: 221557 - RNA, 22 nt, Homo sapiens
gugcuauguuauccagcaagau

SEQ ID NO: 221558 - RNA, 16 nt, Homo sapiens
gugcuguguuguuagg

SEQ ID NO: 221559 - RNA, 22 nt, Homo sapiens
gugcuuauccccauucuggagg

SEQ ID NO: 221560 - RNA, 22 nt, Homo sapiens
gugcuuuguuguggcaguggca

SEQ ID NO: 221561 - RNA, 22 nt, Homo sapiens
guggaaaacauaugcuuguuga

SEQ ID NO: 221562 - RNA, 22 nt, Homo sapiens
guggaaaucucugugugacuua

SEQ ID NO: 221563 - RNA, 20 nt, Homo sapiens
guggaagauaaguagccuga

SEQ ID NO: 221564 - RNA, 22 nt, Homo sapiens
guggaauacuaugaugguggau

SEQ ID NO: 221565 - RNA, 17 nt, Homo sapiens
guggaaugucaugucaa

SEQ ID NO: 221566 - RNA, 22 nt, Homo sapiens
guggaauuauagagacaucuug

SEQ ID NO: 221567 - RNA, 22 nt, Homo sapiens
guggagacaaaggcugagugag

SEQ ID NO: 221568 - RNA, 18 nt, Homo sapiens
guggagugucuuccugga

SEQ ID NO: 221569 - RNA, 17 nt, Homo sapiens
guggauagaacaaugaa

SEQ ID NO: 221570 - RNA, 22 nt, Homo sapiens
guggcaaagaugccuucuccaa

SEQ ID NO: 221571 - RNA, 22 nt, Homo sapiens
guggcagaaaagagaagcaaug

SEQ ID NO: 221572 - RNA, 22 nt, Homo sapiens
guggcauuucccaaaguauucu

SEQ ID NO: 221573 - RNA, 22 nt, Homo sapiens
guggcuauucaccuuuaugaaa

SEQ ID NO: 221574 - RNA, 22 nt, Homo sapiens
guggcuauuguucccugguugc

SEQ ID NO: 221575 - RNA, 22 nt, Homo sapiens
guggcuuguaggggucaaggga

SEQ ID NO: 221576 - RNA, 22 nt, Homo sapiens
guggcuuuauuuagaagcaggg

SEQ ID NO: 221577 - RNA, 22 nt, Homo sapiens
gugggauaauuuuuggugcugu

SEQ ID NO: 221578 - RNA, 22 nt, Homo sapiens
gugggaugaucacaguucacug

SEQ ID NO: 221579 - RNA, 22 nt, Homo sapiens
gugggauggagagaagguauga

SEQ ID NO: 221580 - RNA, 22 nt, Homo sapiens
gugggguagcaggcuccuaucu

SEQ ID NO: 221581 - RNA, 22 nt, Homo sapiens
gugggguaggcaauuccuagug

SEQ ID NO: 221582 - RNA, 22 nt, Homo sapiens
gugguagaaauguagaugcuag

SEQ ID NO: 221583 - RNA, 22 nt, Homo sapiens
gugguaggaaagugcaaaugua

SEQ ID NO: 221584 - RNA, 19 nt, Homo sapiens
gugguauuaccuuuugauu

SEQ ID NO: 221585 - RNA, 22 nt, Homo sapiens
gugguucuagaauugaguaucc

SEQ ID NO: 221586 - RNA, 22 nt, Homo sapiens
gugguuuuaucccagaaauuaa

SEQ ID NO: 221587 - RNA, 22 nt, Homo sapiens
gugguuuuuagauuucuacagu

SEQ ID NO: 221588 - RNA, 22 nt, Homo sapiens
guguaacaacagcacuccacug

SEQ ID NO: 221589 - RNA, 22 nt, Homo sapiens
guguagagaaaaguaccauuuu

SEQ ID NO: 221590 - RNA, 22 nt, Homo sapiens
guguauauccuauuaguucugu

SEQ ID NO: 221591 - RNA, 22 nt, Homo sapiens
guguauucaucuggcugaggua

SEQ ID NO: 221592 - RNA, 22 nt, Homo sapiens
gugucuccuguggagcuaugua

SEQ ID NO: 221593 - RNA, 22 nt, Homo sapiens
gugugacuagucaugccugaau

SEQ ID NO: 221594 - RNA, 22 nt, Homo sapiens
gugugacugcucuauuagggcg

SEQ ID NO: 221595 - RNA, 22 nt, Homo sapiens
gugugauggcgcacacagggug

SEQ ID NO: 221596 - RNA, 23 nt, Homo sapiens
ugaguagguccacguaugugagu

SEQ ID NO: 221597 - RNA, 22 nt, Homo sapiens
ugaguagugccacaauaagcau

SEQ ID NO: 221598 - RNA, 22 nt, Homo sapiens
ugaguagugcugcaauaaacau

SEQ ID NO: 221599 - RNA, 22 nt, Homo sapiens
ugaguauagaucaguucaagug

SEQ ID NO: 221600 - RNA, 22 nt, Homo sapiens
ugaguaugaguucaggaaaggc

SEQ ID NO: 221601 - RNA, 22 nt, Homo sapiens
ugaguauguaggaugugucuua

SEQ ID NO: 221602 - RNA, 22 nt, Homo sapiens
ugaguauguuuaaugugacaau

SEQ ID NO: 221603 - RNA, 22 nt, Homo sapiens
ugaguauguuuagaaguaaagg

SEQ ID NO: 221604 - RNA, 23 nt, Homo sapiens
ugagucacuuugcuggggucucu

SEQ ID NO: 221605 - RNA, 22 nt, Homo sapiens
ugagucaugcuggagucauggc

SEQ ID NO: 221606 - RNA, 22 nt, Homo sapiens
ugagucauguaauaaugcugcu

SEQ ID NO: 221607 - RNA, 22 nt, Homo sapiens
ugagucuguucucacauugcua

SEQ ID NO: 221608 - RNA, 22 nt, Homo sapiens
ugagugaaugugaaggcuaggg

SEQ ID NO: 221609 - RNA, 22 nt, Homo sapiens
ugaguggagaucgcaccauugc

SEQ ID NO: 221610 - RNA, 22 nt, Homo sapiens
ugaguuagguguuuuaaauaua

SEQ ID NO: 221611 - RNA, 22 nt, Homo sapiens
ugaguucaauuguauuuuauua

SEQ ID NO: 221612 - RNA, 22 nt, Homo sapiens
ugaguucauggucauuugucac

SEQ ID NO: 221613 - RNA, 18 nt, Homo sapiens
ugaguucauuagacuucc

SEQ ID NO: 221614 - RNA, 20 nt, Homo sapiens
ugaguuccuuguucagaagc

SEQ ID NO: 221615 - RNA, 22 nt, Homo sapiens
ugaguucuuuguagauucugug

SEQ ID NO: 221616 - RNA, 22 nt, Homo sapiens
ugaguugagauaagguuacauu

SEQ ID NO: 221617 - RNA, 22 nt, Homo sapiens
ugaguuguugcauucuuggugu

SEQ ID NO: 221618 - RNA, 23 nt, Homo sapiens
ugauaacagcauaugaagauucu

SEQ ID NO: 221619 - RNA, 22 nt, Homo sapiens
ugauaacauuucuucugguaca

SEQ ID NO: 221620 - RNA, 22 nt, Homo sapiens
ugauaagaaauuguucauguag

SEQ ID NO: 221621 - RNA, 22 nt, Homo sapiens
ugauaauuuugucagguuuugg

SEQ ID NO: 221622 - RNA, 22 nt, Homo sapiens
ugauacuggcuucauagaauga

SEQ ID NO: 221623 - RNA, 22 nt, Homo sapiens
ugauaggagauuuucaucugua

SEQ ID NO: 221624 - RNA, 22 nt, Homo sapiens
ugauagucuuugcuggugaccu

SEQ ID NO: 221625 - RNA, 22 nt, Homo sapiens
ugauauauugaaugaugaaaca

SEQ ID NO: 221626 - RNA, 22 nt, Homo sapiens
ugauaugaaagggaaauaagug

SEQ ID NO: 221627 - RNA, 22 nt, Homo sapiens
ugauaugaucgcccuagcuuga

SEQ ID NO: 221628 - RNA, 23 nt, Homo sapiens
ugauaugccuaggaguauauuuu

SEQ ID NO: 221629 - RNA, 21 nt, Homo sapiens
ugauaugguagaagagagaca

SEQ ID NO: 221630 - RNA, 21 nt, Homo sapiens
ugauaugguuuggauaugugu

SEQ ID NO: 221631 - RNA, 22 nt, Homo sapiens
ugauauguggcuauugagauug

SEQ ID NO: 221632 - RNA, 22 nt, Homo sapiens
ugaucacagcuugacuaaagga

SEQ ID NO: 221633 - RNA, 21 nt, Homo sapiens
ugaucacaugaaaaccaugca

SEQ ID NO: 221634 - RNA, 22 nt, Homo sapiens
ugaucucagcucacugguugaa

SEQ ID NO: 221635 - RNA, 22 nt, Homo sapiens
ugaucucauuagcaccuuuagc

SEQ ID NO: 221636 - RNA, 22 nt, Homo sapiens
ugaucugucucggguuaucagu

SEQ ID NO: 221637 - RNA, 22 nt, Homo sapiens
ugaucuguguaacauaggaguc

SEQ ID NO: 221638 - RNA, 22 nt, Homo sapiens
ugaugacacugauuucuucaau

SEQ ID NO: 221639 - RNA, 22 nt, Homo sapiens
ugaugacccugcaguucucaag

SEQ ID NO: 221640 - RNA, 21 nt, Homo sapiens
ugaugcaauccgcuaggucgc

SEQ ID NO: 221641 - RNA, 22 nt, Homo sapiens
ugaugcuacuaccugggcugaa

SEQ ID NO: 221642 - RNA, 22 nt, Homo sapiens
ugauggcauuucauguuuguaa

SEQ ID NO: 221643 - RNA, 22 nt, Homo sapiens
ugaugguccauaguucauggua

SEQ ID NO: 221644 - RNA, 22 nt, Homo sapiens
ugaugguuuuaaaaagaggagu

SEQ ID NO: 221645 - RNA, 22 nt, Homo sapiens
ugauguaggacauuauuauuuc

SEQ ID NO: 221646 - RNA, 22 nt, Homo sapiens
ugauguugaauuguucagcguc

SEQ ID NO: 221647 - RNA, 22 nt, Homo sapiens
ugauuagagcccaagcuuugaa

SEQ ID NO: 221648 - RNA, 22 nt, Homo sapiens
ugauuagaggaaugguagauua

SEQ ID NO: 221649 - RNA, 22 nt, Homo sapiens
ugauugacauucuuuggaguau

SEQ ID NO: 221650 - RNA, 22 nt, Homo sapiens
ugauuuccaugagaacaugccu

SEQ ID NO: 221651 - RNA, 22 nt, Homo sapiens
ugauuugucugcaggaauagug

SEQ ID NO: 221652 - RNA, 22 nt, Homo sapiens
ugauuuguuuagugccaaguuu

SEQ ID NO: 221653 - RNA, 22 nt, Homo sapiens
ugcaaauuauugggccccaacu

SEQ ID NO: 221654 - RNA, 22 nt, Homo sapiens
ugcaacacauugccccugcucu

SEQ ID NO: 221655 - RNA, 22 nt, Homo sapiens
ugcaagaaucuuucaggcuagc

SEQ ID NO: 221656 - RNA, 20 nt, Homo sapiens
ugcaaguugccuuuggaggc

SEQ ID NO: 221657 - RNA, 17 nt, Homo sapiens
ugcaauuuaagcuagau

SEQ ID NO: 221658 - RNA, 22 nt, Homo sapiens
ugcaauuuaaugugucccaauu

SEQ ID NO: 221659 - RNA, 22 nt, Homo sapiens
ugcacacucuguaugagaaucu

SEQ ID NO: 221660 - RNA, 22 nt, Homo sapiens
ugcaccacacuccauccugggc

SEQ ID NO: 221661 - RNA, 22 nt, Homo sapiens
ugcaccauggcacuccaggcug

SEQ ID NO: 221662 - RNA, 22 nt, Homo sapiens
ugcaccauugcauacuuaauua

SEQ ID NO: 221663 - RNA, 22 nt, Homo sapiens
ugcaccauugucaccuggguga

SEQ ID NO: 221664 - RNA, 22 nt, Homo sapiens
ugcacugucuugucgcauagca

SEQ ID NO: 221665 - RNA, 22 nt, Homo sapiens
ugcagauucguuuugaggggua

SEQ ID NO: 221666 - RNA, 22 nt, Homo sapiens
ugcagcacugaacuucugggcu

SEQ ID NO: 221667 - RNA, 21 nt, Homo sapiens
ugcagccauucagcccuaugc

SEQ ID NO: 221668 - RNA, 23 nt, Homo sapiens
ugcagcuacauguggccaugugc

SEQ ID NO: 221669 - RNA, 22 nt, Homo sapiens
ugcagguacuugacaacuuggg

SEQ ID NO: 221670 - RNA, 22 nt, Homo sapiens
ugcaguacauucagcauccucu

SEQ ID NO: 221671 - RNA, 22 nt, Homo sapiens
ugcaguacuuugaaauauacug

SEQ ID NO: 221672 - RNA, 22 nt, Homo sapiens
ugcagugucaauaauaauuagu

SEQ ID NO: 221673 - RNA, 22 nt, Homo sapiens
ugcagugugaaagagccugaca

SEQ ID NO: 221674 - RNA, 22 nt, Homo sapiens
ugcagugugcuggggucuccau

SEQ ID NO: 221675 - RNA, 22 nt, Homo sapiens
ugcauaauuccuugcaccagaa

SEQ ID NO: 221676 - RNA, 22 nt, Homo sapiens
ugcauagaauguucuguaaaua

SEQ ID NO: 221677 - RNA, 22 nt, Homo sapiens
ugcauagcaaaauaggauuaga

SEQ ID NO: 221678 - RNA, 22 nt, Homo sapiens
ugcauagcauauauuguagagu

SEQ ID NO: 221679 - RNA, 19 nt, Homo sapiens
ugcauaggguuacauacuc

SEQ ID NO: 221680 - RNA, 23 nt, Homo sapiens
ugccuagaugcugcccugggaca

SEQ ID NO: 221681 - RNA, 22 nt, Homo sapiens
ugccuaggcccaguccucagaa

SEQ ID NO: 221682 - RNA, 22 nt, Homo sapiens
ugccuaggcuggaaugcagugg

SEQ ID NO: 221683 - RNA, 22 nt, Homo sapiens
ugccuagucuauugagagucuu

SEQ ID NO: 221684 - RNA, 22 nt, Homo sapiens
ugccuaguggaaggagagcaaa

SEQ ID NO: 221685 - RNA, 22 nt, Homo sapiens
ugccugcugucuaauauauucu

SEQ ID NO: 221686 - RNA, 22 nt, Homo sapiens
ugccuucuguuaaacgaggaug

SEQ ID NO: 221687 - RNA, 22 nt, Homo sapiens
ugcgccauugcacuccagccug

SEQ ID NO: 221688 - RNA, 22 nt, Homo sapiens
ugcuauagcuauaucaucuccu

SEQ ID NO: 221689 - RNA, 23 nt, Homo sapiens
ugcuauguaagcauuuauuaaau

SEQ ID NO: 221690 - RNA, 22 nt, Homo sapiens
ugcuaugucagccaggcugguc

SEQ ID NO: 221691 - RNA, 22 nt, Homo sapiens
ugcuauguuuucccuccuuauc

SEQ ID NO: 221692 - RNA, 21 nt, Homo sapiens
ugcuccauuuucuagccugaa

SEQ ID NO: 221693 - RNA, 22 nt, Homo sapiens
ugcugcacaguucuuaagauua

SEQ ID NO: 221694 - RNA, 20 nt, Homo sapiens
ugcugcacuuaagcaugggc

SEQ ID NO: 221695 - RNA, 19 nt, Homo sapiens
ugcugcauugugaccuugc

SEQ ID NO: 221696 - RNA, 22 nt, Homo sapiens
ugcugguaguuuaugacuaauu

SEQ ID NO: 221697 - RNA, 18 nt, Homo sapiens
ugcuuagucauuuucaau

SEQ ID NO: 221698 - RNA, 19 nt, Homo sapiens
ugcuuaguuuuauguguaa

SEQ ID NO: 221699 - RNA, 22 nt, Homo sapiens
ugcuucauuggccaccaggaag

SEQ ID NO: 221700 - RNA, 22 nt, Homo sapiens
ugcuuguguucagguaaccuuu

SEQ ID NO: 221701 - RNA, 20 nt, Homo sapiens
uggaaaguaagucaugauau

SEQ ID NO: 221702 - RNA, 22 nt, Homo sapiens
uggaaaguacuugaguuuguau

SEQ ID NO: 221703 - RNA, 22 nt, Homo sapiens
uggaaauaaaugugccaagauc

SEQ ID NO: 221704 - RNA, 19 nt, Homo sapiens
uggaacauaaaaguugguu

SEQ ID NO: 221705 - RNA, 21 nt, Homo sapiens
uggaacgcaaaugagaugaau

SEQ ID NO: 221706 - RNA, 22 nt, Homo sapiens
uggaagauggaguuuuaucauu

SEQ ID NO: 221707 - RNA, 22 nt, Homo sapiens
uggaagccuagauucuuuucuu

SEQ ID NO: 221708 - RNA, 22 nt, Homo sapiens
uggaaggcuucauauguaaaga

SEQ ID NO: 221709 - RNA, 22 nt, Homo sapiens
uggaagguaaguuuugagcauu

SEQ ID NO: 221710 - RNA, 22 nt, Homo sapiens
uggaaguaaucaugagguagca

SEQ ID NO: 221711 - RNA, 23 nt, Homo sapiens
uggaaguauggaggaggcagaau

SEQ ID NO: 221712 - RNA, 22 nt, Homo sapiens
uggaaguuaaaugacucuuucu

SEQ ID NO: 221713 - RNA, 22 nt, Homo sapiens
uggaaucaucaacgaaugaaau

SEQ ID NO: 221714 - RNA, 20 nt, Homo sapiens
uggaaucugaagaucucagu

SEQ ID NO: 221715 - RNA, 22 nt, Homo sapiens
uggaaugguaucuuguuggggu

SEQ ID NO: 221716 - RNA, 22 nt, Homo sapiens
uggaaugguuggugugauuuua

SEQ ID NO: 221717 - RNA, 22 nt, Homo sapiens
uggaauguagcguugacacgag

SEQ ID NO: 221718 - RNA, 22 nt, Homo sapiens
uggaaugucagcuacaagaggg

SEQ ID NO: 221719 - RNA, 22 nt, Homo sapiens
uggaauguuuaucaaaacagua

SEQ ID NO: 221720 - RNA, 18 nt, Homo sapiens
uggaauguuuggguuaau

SEQ ID NO: 221721 - RNA, 22 nt, Homo sapiens
uggacagagagaccggcauuuu

SEQ ID NO: 221722 - RNA, 20 nt, Homo sapiens
uggaccagagagguggggac

SEQ ID NO: 221723 - RNA, 22 nt, Homo sapiens
uggaccccugcucgggagcccu

SEQ ID NO: 221724 - RNA, 19 nt, Homo sapiens
uggaccccuuccuuacacc

SEQ ID NO: 221725 - RNA, 21 nt, Homo sapiens
uggaccccuuucuuacaccgu

SEQ ID NO: 221726 - RNA, 22 nt, Homo sapiens
uggagagcaaagaauuuguuag

SEQ ID NO: 221727 - RNA, 22 nt, Homo sapiens
uggagagugagggccuccuuaa

SEQ ID NO: 221728 - RNA, 19 nt, Homo sapiens
uggagauauccccuucaca

SEQ ID NO: 221729 - RNA, 22 nt, Homo sapiens
uggagcaaaguugaggccaagc

SEQ ID NO: 221730 - RNA, 22 nt, Homo sapiens
uggagcccuaaacuucuaauau

SEQ ID NO: 221731 - RNA, 22 nt, Homo sapiens
uggagguaggugauauguagca

SEQ ID NO: 221732 - RNA, 22 nt, Homo sapiens
uggagucgugcccuugcauuua

SEQ ID NO: 221733 - RNA, 22 nt, Homo sapiens
uggagugcaauggugagaucuu

SEQ ID NO: 221734 - RNA, 22 nt, Homo sapiens
uggaguguguuaacuuuacaag

SEQ ID NO: 221735 - RNA, 22 nt, Homo sapiens
uggaguguguugcagaugaagg

SEQ ID NO: 221736 - RNA, 22 nt, Homo sapiens
uggauaguucuucuacuagagu

SEQ ID NO: 221737 - RNA, 18 nt, Homo sapiens
uggauaugaaauucugga

SEQ ID NO: 221738 - RNA, 21 nt, Homo sapiens
uggaugccuaggcagaaguuu

SEQ ID NO: 221739 - RNA, 22 nt, Homo sapiens
uggauggagaggcuugugaugc

SEQ ID NO: 221740 - RNA, 22 nt, Homo sapiens
uggauggugauuggaucaugga

SEQ ID NO: 221741 - RNA, 22 nt, Homo sapiens
uggauguaauugauucauguug

SEQ ID NO: 221742 - RNA, 22 nt, Homo sapiens
uggauugaaagcuuuaauauug

SEQ ID NO: 221743 - RNA, 22 nt, Homo sapiens
uggauugagaagcuguggcuca

SEQ ID NO: 221744 - RNA, 22 nt, Homo sapiens
uggauuguaacauagaguaaau

SEQ ID NO: 221745 - RNA, 18 nt, Homo sapiens
uggauuguacuguguucu

SEQ ID NO: 221746 - RNA, 22 nt, Homo sapiens
uggauuuuaauuauucugucau

SEQ ID NO: 221747 - RNA, 22 nt, Homo sapiens
uggcaaagugugacgugggggu

SEQ ID NO: 221748 - RNA, 22 nt, Homo sapiens
uggcaaauagcaauaggagggu

SEQ ID NO: 221749 - RNA, 22 nt, Homo sapiens
uggcaaauguaguacccaauag

SEQ ID NO: 221750 - RNA, 22 nt, Homo sapiens
uggcaacaucuggggacauguu

SEQ ID NO: 221751 - RNA, 22 nt, Homo sapiens
uggcaagaaccacaauuacuuu

SEQ ID NO: 221752 - RNA, 22 nt, Homo sapiens
uggcaagaagagcaugagacca

SEQ ID NO: 221753 - RNA, 20 nt, Homo sapiens
uggcaagauggcagaauaga

SEQ ID NO: 221754 - RNA, 22 nt, Homo sapiens
uggcaagauuguuccgguuugg

SEQ ID NO: 221755 - RNA, 22 nt, Homo sapiens
uggcaaguuucaauccgaggga

SEQ ID NO: 221756 - RNA, 22 nt, Homo sapiens
uggcaauauccacaauuacuuu

SEQ ID NO: 221757 - RNA, 22 nt, Homo sapiens
uggcaauguggaaugguccagg

SEQ ID NO: 221758 - RNA, 22 nt, Homo sapiens
uggcaccauccaggugucucua

SEQ ID NO: 221759 - RNA, 21 nt, Homo sapiens
uggcacuauucacaauagcaa

SEQ ID NO: 221760 - RNA, 22 nt, Homo sapiens
uggcagaugagccgcgcuccaa

SEQ ID NO: 221761 - RNA, 22 nt, Homo sapiens
uggcagaugcucuuggugccca

SEQ ID NO: 221762 - RNA, 22 nt, Homo sapiens
uggcagaugggugagcuggaga

SEQ ID NO: 221763 - RNA, 22 nt, Homo sapiens
uggcagauggugacaccauuag

SEQ ID NO: 221764 - RNA, 22 nt, Homo sapiens
uggcagcgcaguugaaaaagaa

SEQ ID NO: 221765 - RNA, 22 nt, Homo sapiens
uggcagcgugaauguggcugaa

SEQ ID NO: 221766 - RNA, 22 nt, Homo sapiens
uggcaggugcacuggcuuugaa

SEQ ID NO: 221767 - RNA, 22 nt, Homo sapiens
uggcaguuuugauguggagaga

SEQ ID NO: 221768 - RNA, 22 nt, Homo sapiens
uggcauaugguauuugauaucu

SEQ ID NO: 221769 - RNA, 22 nt, Homo sapiens
uggcaugaagaccccauccuuu

SEQ ID NO: 221770 - RNA, 19 nt, Homo sapiens
uggcaugaaugugaacuaa

SEQ ID NO: 221771 - RNA, 22 nt, Homo sapiens
uggcauggaacuacuuugaaac

SEQ ID NO: 221772 - RNA, 22 nt, Homo sapiens
uggcauggggcagaacauuaca

SEQ ID NO: 221773 - RNA, 22 nt, Homo sapiens
uggcauggucugcccaaguuuc

SEQ ID NO: 221774 - RNA, 22 nt, Homo sapiens
uggcauguauuuuguguauuaa

SEQ ID NO: 221775 - RNA, 22 nt, Homo sapiens
uggcauuuugugugaauuagaa

SEQ ID NO: 221776 - RNA, 23 nt, Homo sapiens
uggcauuuuuggcaaugccuucu

SEQ ID NO: 221777 - RNA, 23 nt, Homo sapiens
uggccaagauaaucucaguuuuc

SEQ ID NO: 221778 - RNA, 22 nt, Homo sapiens
uugagaugaaguuuugcucuuu

SEQ ID NO: 221779 - RNA, 22 nt, Homo sapiens
uugagaugauggauaugcuaau

SEQ ID NO: 221780 - RNA, 22 nt, Homo sapiens
uugagauggagccucacucugc

SEQ ID NO: 221781 - RNA, 22 nt, Homo sapiens
uugagauggagcuucacucuug

SEQ ID NO: 221782 - RNA, 22 nt, Homo sapiens
uugagauggagucucacgcauu

SEQ ID NO: 221783 - RNA, 22 nt, Homo sapiens
uugagauggagucucacucugu

SEQ ID NO: 221784 - RNA, 22 nt, Homo sapiens
uugagauggagucucacucuug

SEQ ID NO: 221785 - RNA, 22 nt, Homo sapiens
uugagauggagucucgcucugu

SEQ ID NO: 221786 - RNA, 22 nt, Homo sapiens
uugagauggagucucguucugu

SEQ ID NO: 221787 - RNA, 22 nt, Homo sapiens
uugagauggagucuugcacugu

SEQ ID NO: 221788 - RNA, 22 nt, Homo sapiens
uugagauggagucuugcgcugu

SEQ ID NO: 221789 - RNA, 22 nt, Homo sapiens
uugagauggagucuugcucugu

SEQ ID NO: 221790 - RNA, 22 nt, Homo sapiens
uugagauggagucuuguucuuu

SEQ ID NO: 221791 - RNA, 22 nt, Homo sapiens
uugagauggaguuucacucucg

SEQ ID NO: 221792 - RNA, 22 nt, Homo sapiens
uugagauggaguuucgcucuuu

SEQ ID NO: 221793 - RNA, 22 nt, Homo sapiens
uugagauuuuccucaaauauuu

SEQ ID NO: 221794 - RNA, 22 nt, Homo sapiens
uugagcaaaacauuaauauuag

SEQ ID NO: 221795 - RNA, 22 nt, Homo sapiens
uugagcaacauagugagacugu

SEQ ID NO: 221796 - RNA, 22 nt, Homo sapiens
uugagcaaugaacgauucaggg

SEQ ID NO: 221797 - RNA, 22 nt, Homo sapiens
uugagcacaggaguuugagacc

SEQ ID NO: 221798 - RNA, 22 nt, Homo sapiens
uugagcacugucugugugcagu

SEQ ID NO: 221799 - RNA, 22 nt, Homo sapiens
uugagcccuggagguggaggcu

SEQ ID NO: 221800 - RNA, 22 nt, Homo sapiens
uugagcuaguugcaccagcagg

SEQ ID NO: 221801 - RNA, 22 nt, Homo sapiens
uugagcuauauacuucagacuu

SEQ ID NO: 221802 - RNA, 22 nt, Homo sapiens
uugagcucaucuucagggguga

SEQ ID NO: 221803 - RNA, 22 nt, Homo sapiens
uugaggaaugucauuuguguuu

SEQ ID NO: 221804 - RNA, 22 nt, Homo sapiens
uugaggaggcagucuucccauu

SEQ ID NO: 221805 - RNA, 22 nt, Homo sapiens
uugaggaguacugauuagguau

SEQ ID NO: 221806 - RNA, 22 nt, Homo sapiens
uugaggccugauaacacacuga

SEQ ID NO: 221807 - RNA, 22 nt, Homo sapiens
uugagggcugaauaccaaucag

SEQ ID NO: 221808 - RNA, 22 nt, Homo sapiens
uugagguagcuuugauggaggu

SEQ ID NO: 221809 - RNA, 22 nt, Homo sapiens
uugagguauaaagguagguugu

SEQ ID NO: 221810 - RNA, 22 nt, Homo sapiens
uugaguagaaguaugucaguau

SEQ ID NO: 221811 - RNA, 22 nt, Homo sapiens
uugaguauuggacugguaucuu

SEQ ID NO: 221812 - RNA, 22 nt, Homo sapiens
uugaguccccacacuggguccc

SEQ ID NO: 221813 - RNA, 22 nt, Homo sapiens
uugauaacauucugcauccuau

SEQ ID NO: 221814 - RNA, 22 nt, Homo sapiens
uugauaagaaaugccaguuugg

SEQ ID NO: 221815 - RNA, 22 nt, Homo sapiens
uugauagacaucugaguuguug

SEQ ID NO: 221816 - RNA, 22 nt, Homo sapiens
uugauagaucagggauuugauu

SEQ ID NO: 221817 - RNA, 22 nt, Homo sapiens
uugauagguuuuauguauaguu

SEQ ID NO: 221818 - RNA, 22 nt, Homo sapiens
uugauaugguauaagauuucau

SEQ ID NO: 221819 - RNA, 22 nt, Homo sapiens
uugauauguguauagcaugugg

SEQ ID NO: 221820 - RNA, 22 nt, Homo sapiens
uugauauguuguuagauucagu

SEQ ID NO: 221821 - RNA, 22 nt, Homo sapiens
uugauauuaaguacugaagugg

SEQ ID NO: 221822 - RNA, 22 nt, Homo sapiens
uugauauuacucaguaacagau

SEQ ID NO: 221823 - RNA, 22 nt, Homo sapiens
uugauguccaucucuagguaaa

SEQ ID NO: 221824 - RNA, 22 nt, Homo sapiens
uugauugacaugucucuguuca

SEQ ID NO: 221825 - RNA, 23 nt, Homo sapiens
uugcaaagccugaaacucuucag

SEQ ID NO: 221826 - RNA, 22 nt, Homo sapiens
uugcaaaucucuuguguuuggu

SEQ ID NO: 221827 - RNA, 21 nt, Homo sapiens
uugcaaaugcugcugccugau

SEQ ID NO: 221828 - RNA, 22 nt, Homo sapiens
uugcaagaaaugcagauucuca

SEQ ID NO: 221829 - RNA, 22 nt, Homo sapiens
uugcaaggugcucgaagggcuc

SEQ ID NO: 221830 - RNA, 22 nt, Homo sapiens
uugcaagugccguaacuaccaa

SEQ ID NO: 221831 - RNA, 22 nt, Homo sapiens
uugcaaguggagcuuccagggc

SEQ ID NO: 221832 - RNA, 22 nt, Homo sapiens
uugcacaauccugugagugagu

SEQ ID NO: 221833 - RNA, 22 nt, Homo sapiens
uugcacauggcuggggaggccu

SEQ ID NO: 221834 - RNA, 22 nt, Homo sapiens
uugcacauguugaaccagcaaa

SEQ ID NO: 221835 - RNA, 22 nt, Homo sapiens
uugcacauugcaccuuuuguau

SEQ ID NO: 221836 - RNA, 22 nt, Homo sapiens
uugcaccccuacuauuugccaa

SEQ ID NO: 221837 - RNA, 22 nt, Homo sapiens
uugcaccuuaugucuguucucu

SEQ ID NO: 221838 - RNA, 22 nt, Homo sapiens
uugcaccuugaagccaauagca

SEQ ID NO: 221839 - RNA, 22 nt, Homo sapiens
uugcacuauaggaaaauguguc

SEQ ID NO: 221840 - RNA, 22 nt, Homo sapiens
uugcacuccagccuuggggaga

SEQ ID NO: 221841 - RNA, 22 nt, Homo sapiens
uugcacuccagcucuaggugac

SEQ ID NO: 221842 - RNA, 22 nt, Homo sapiens
uugcacuguaauuuauuuaugu

SEQ ID NO: 221843 - RNA, 22 nt, Homo sapiens
uugcagagccccugcaaggguc

SEQ ID NO: 221844 - RNA, 22 nt, Homo sapiens
uugcagaucccacacucacccu

SEQ ID NO: 221845 - RNA, 22 nt, Homo sapiens
uugcagcaaagagggaggggca

SEQ ID NO: 221846 - RNA, 22 nt, Homo sapiens
uugcagcaacauggaugaaacu

SEQ ID NO: 221847 - RNA, 22 nt, Homo sapiens
uugcaguagucugaaagcaaua

SEQ ID NO: 221848 - RNA, 22 nt, Homo sapiens
uugcauagacaauauuaaucuu

SEQ ID NO: 221849 - RNA, 23 nt, Homo sapiens
uugcauagacauccucauagauu

SEQ ID NO: 221850 - RNA, 22 nt, Homo sapiens
uugcauagaccgaugucuugga

SEQ ID NO: 221851 - RNA, 19 nt, Homo sapiens
uugcauauguugaaccagc

SEQ ID NO: 221852 - RNA, 22 nt, Homo sapiens
uugcauauguugaaccagccuu

SEQ ID NO: 221853 - RNA, 22 nt, Homo sapiens
uugcauauucucugaggcagga

SEQ ID NO: 221854 - RNA, 22 nt, Homo sapiens
uugcaucagcaggcauaauugg

SEQ ID NO: 221855 - RNA, 22 nt, Homo sapiens
uugcaugguggaacuuggagcu

SEQ ID NO: 221856 - RNA, 22 nt, Homo sapiens
uugcauuguacuugguacggcu

SEQ ID NO: 221857 - RNA, 22 nt, Homo sapiens
uugccaucaucucuuacucagu

SEQ ID NO: 221858 - RNA, 22 nt, Homo sapiens
uugccuaguuuaggucugugcu

SEQ ID NO: 221859 - RNA, 22 nt, Homo sapiens
uugcuaagucaagagaaaugau

SEQ ID NO: 221860 - RNA, 22 nt, Homo sapiens
uugcuacuuggauguacaugug

SEQ ID NO: 221861 - RNA, 22 nt, Homo sapiens
uugcucaccugagaagaauaga

SEQ ID NO: 221862 - RNA, 22 nt, Homo sapiens
uugcuccucugccaggaccugu

SEQ ID NO: 221863 - RNA, 20 nt, Homo sapiens
uugcugguguuagaggaggc

SEQ ID NO: 221864 - RNA, 22 nt, Homo sapiens
uugcuuagagccaaucuugauu

SEQ ID NO: 221865 - RNA, 22 nt, Homo sapiens
uaucagcacaguggguucaugg

SEQ ID NO: 221866 - RNA, 22 nt, Homo sapiens
uaucagcagcaggggcugcaga

SEQ ID NO: 221867 - RNA, 22 nt, Homo sapiens
uaucaguauggauucauggauu

SEQ ID NO: 221868 - RNA, 22 nt, Homo sapiens
uaucaucauguuuuugcugugu

SEQ ID NO: 221869 - RNA, 22 nt, Homo sapiens
uaucccuuagagcggggugguu

SEQ ID NO: 221870 - RNA, 22 nt, Homo sapiens
uaucucauccuccuugauccca

SEQ ID NO: 221871 - RNA, 22 nt, Homo sapiens
uaucucuuuucauguguaaaug

SEQ ID NO: 221872 - RNA, 22 nt, Homo sapiens
uaucugcacauacacuuauagc

SEQ ID NO: 221873 - RNA, 22 nt, Homo sapiens
uaucugguuauugcugcugauu

SEQ ID NO: 221874 - RNA, 20 nt, Homo sapiens
uaugaaacaguguagagcaa

SEQ ID NO: 221875 - RNA, 22 nt, Homo sapiens
uaugaaacucuaagauucacau

SEQ ID NO: 221876 - RNA, 22 nt, Homo sapiens
uaugaaagcuacuucucacaau

SEQ ID NO: 221877 - RNA, 20 nt, Homo sapiens
uaugaccugucuuuucucuc

SEQ ID NO: 221878 - RNA, 22 nt, Homo sapiens
uaugacugagacuuaaauugug

SEQ ID NO: 221879 - RNA, 22 nt, Homo sapiens
uaugacuuuggaaaaauuacuu

SEQ ID NO: 221880 - RNA, 20 nt, Homo sapiens
uaugagacugggagaaguuc

SEQ ID NO: 221881 - RNA, 22 nt, Homo sapiens
uaugaggaguauaacccgguga

SEQ ID NO: 221882 - RNA, 22 nt, Homo sapiens
uaugauuuuugggagaggucaa

SEQ ID NO: 221883 - RNA, 22 nt, Homo sapiens
uaugcacacguguccaugugca

SEQ ID NO: 221884 - RNA, 22 nt, Homo sapiens
uaugcacacucucccaggaggg

SEQ ID NO: 221885 - RNA, 22 nt, Homo sapiens
uaugcacaugugccugggugug

SEQ ID NO: 221886 - RNA, 22 nt, Homo sapiens
uaugccuuuuggcucaagaaac

SEQ ID NO: 221887 - RNA, 19 nt, Homo sapiens
uaugcuagagagggaagcu

SEQ ID NO: 221888 - RNA, 22 nt, Homo sapiens
uaugcuguuucugauuuaggga

SEQ ID NO: 221889 - RNA, 22 nt, Homo sapiens
uaugcuuauaaacauuugucag

SEQ ID NO: 221890 - RNA, 22 nt, Homo sapiens
uaugcuuauugucucauccacu

SEQ ID NO: 221891 - RNA, 21 nt, Homo sapiens
uauggauuugccuauucugga

SEQ ID NO: 221892 - RNA, 22 nt, Homo sapiens
uauggauuugccuauucuguau

SEQ ID NO: 221893 - RNA, 22 nt, Homo sapiens
uauggcauguauguguggcgca

SEQ ID NO: 221894 - RNA, 22 nt, Homo sapiens
uauggcccuuaaguauugguug

SEQ ID NO: 221895 - RNA, 22 nt, Homo sapiens
uauggcugugacuuaucuuguu

SEQ ID NO: 221896 - RNA, 22 nt, Homo sapiens
uauggguauuuuauacauaacc

SEQ ID NO: 221897 - RNA, 22 nt, Homo sapiens
uauggguguuauugcaugggag

SEQ ID NO: 221898 - RNA, 21 nt, Homo sapiens
uaugguuucuaauucugcagg

SEQ ID NO: 221899 - RNA, 22 nt, Homo sapiens
uaugucacuugguuuggugcua

SEQ ID NO: 221900 - RNA, 22 nt, Homo sapiens
uaugucaugggguuuuugagau

SEQ ID NO: 221901 - RNA, 22 nt, Homo sapiens
uaugucauggguaaagugcccu

SEQ ID NO: 221902 - RNA, 22 nt, Homo sapiens
uaugugcacaugcccuggugac

SEQ ID NO: 221903 - RNA, 22 nt, Homo sapiens
uaugugguuaauaggaauuugu

SEQ ID NO: 221904 - RNA, 22 nt, Homo sapiens
uauguguuuuauggucagggag

SEQ ID NO: 221905 - RNA, 22 nt, Homo sapiens
uauuaagcuaguugucagugcu

SEQ ID NO: 221906 - RNA, 22 nt, Homo sapiens
uauuacacuuuagugucuucca

SEQ ID NO: 221907 - RNA, 22 nt, Homo sapiens
uauuagugucuuuugguuagaa

SEQ ID NO: 221908 - RNA, 22 nt, Homo sapiens
uauuauagugauaggucuacug

SEQ ID NO: 221909 - RNA, 22 nt, Homo sapiens
uauuaugcacuuuauaaaaauu

SEQ ID NO: 221910 - RNA, 22 nt, Homo sapiens
uauuauuguccuucuauaccca

SEQ ID NO: 221911 - RNA, 22 nt, Homo sapiens
uauuccauuugggucaggauga

SEQ ID NO: 221912 - RNA, 22 nt, Homo sapiens
uauuccauuugugaaaggaagu

SEQ ID NO: 221913 - RNA, 22 nt, Homo sapiens
uauugaauuuuuaagcccuuug

SEQ ID NO: 221914 - RNA, 22 nt, Homo sapiens
uauugacauuacagugggucuu

SEQ ID NO: 221915 - RNA, 22 nt, Homo sapiens
uauugauuaauugugauuaggc

SEQ ID NO: 221916 - RNA, 22 nt, Homo sapiens
uauugcaaauggugaucccagg

SEQ ID NO: 221917 - RNA, 22 nt, Homo sapiens
uauugcacaugaggagacauug

SEQ ID NO: 221918 - RNA, 22 nt, Homo sapiens
uauugcacgccagccugagcaa

SEQ ID NO: 221919 - RNA, 22 nt, Homo sapiens
uauugcacuuuuccauaggagu

SEQ ID NO: 221920 - RNA, 22 nt, Homo sapiens
uauugcagauacccaggaaguu

SEQ ID NO: 221921 - RNA, 22 nt, Homo sapiens
cagcucauugcagucucgaccu

SEQ ID NO: 221922 - RNA, 22 nt, Homo sapiens
cagcucuuguuaaaacuaacua

SEQ ID NO: 221923 - RNA, 23 nt, Homo sapiens
cagcuggugauuuuaaguugaag

SEQ ID NO: 221924 - RNA, 22 nt, Homo sapiens
cagcuguguuauaaacuaccau

SEQ ID NO: 221925 - RNA, 22 nt, Homo sapiens
cagcuguuguuccagucuuuua

SEQ ID NO: 221926 - RNA, 22 nt, Homo sapiens
cagcuugugguauugcugguug

SEQ ID NO: 221927 - RNA, 22 nt, Homo sapiens
caggcaaggugaaguguacugg

SEQ ID NO: 221928 - RNA, 22 nt, Homo sapiens
caggcagucuggcucccaagug

SEQ ID NO: 221929 - RNA, 22 nt, Homo sapiens
caggcagucuggggguguaucc

SEQ ID NO: 221930 - RNA, 22 nt, Homo sapiens
caggcauagucuugaguuuuau

SEQ ID NO: 221931 - RNA, 22 nt, Homo sapiens
caggcauuguccaugcugaagg

SEQ ID NO: 221932 - RNA, 22 nt, Homo sapiens
cagguacauuuuaaagggcuca

SEQ ID NO: 221933 - RNA, 22 nt, Homo sapiens
caggugcauuggcugacaccug

SEQ ID NO: 221934 - RNA, 22 nt, Homo sapiens
caggugcuuacuuaauagccau

SEQ ID NO: 221935 - RNA, 22 nt, Homo sapiens
caggugguauuugguuuucugu

SEQ ID NO: 221936 - RNA, 19 nt, Homo sapiens
caguaucauugcacauagu

SEQ ID NO: 221937 - RNA, 22 nt, Homo sapiens
cagugacacugaaaaguucggg

SEQ ID NO: 221938 - RNA, 18 nt, Homo sapiens
cagugcaauacaggagag

SEQ ID NO: 221939 - RNA, 22 nt, Homo sapiens
cagugcauaggaucuaaaauuu

SEQ ID NO: 221940 - RNA, 22 nt, Homo sapiens
cagugcaugacuguauauuauc

SEQ ID NO: 221941 - RNA, 22 nt, Homo sapiens
caguggaugaacaagaagugau

SEQ ID NO: 221942 - RNA, 22 nt, Homo sapiens
caguuacuugacacaaccaauu

SEQ ID NO: 221943 - RNA, 22 nt, Homo sapiens
cauaaugcuaagagcugccccu

SEQ ID NO: 221944 - RNA, 22 nt, Homo sapiens
cauacaguaggcacuauuugua

SEQ ID NO: 221945 - RNA, 18 nt, Homo sapiens
cauagcacuucagcacau

SEQ ID NO: 221946 - RNA, 22 nt, Homo sapiens
cauaguacuugcauaguacuau

SEQ ID NO: 221947 - RNA, 22 nt, Homo sapiens
caucaaaguggagggaaggacc

SEQ ID NO: 221948 - RNA, 21 nt, Homo sapiens
caucaaauugucauggugggu

SEQ ID NO: 221949 - RNA, 23 nt, Homo sapiens
caucacauagaggaaagaggaca

SEQ ID NO: 221950 - RNA, 21 nt, Homo sapiens
caucacauuacucaaaguccu

SEQ ID NO: 221951 - RNA, 20 nt, Homo sapiens
caucaccuggcaggauuugu

SEQ ID NO: 221952 - RNA, 22 nt, Homo sapiens
caucagagugagauauaagauc

SEQ ID NO: 221953 - RNA, 22 nt, Homo sapiens
caucagauugagaucaucuaag

SEQ ID NO: 221954 - RNA, 22 nt, Homo sapiens
caucaggugaggauucaaugca

SEQ ID NO: 221955 - RNA, 22 nt, Homo sapiens
cauccccugcaccaaccuuuac

SEQ ID NO: 221956 - RNA, 21 nt, Homo sapiens
cauccccugccauuguggucu

SEQ ID NO: 221957 - RNA, 22 nt, Homo sapiens
caucccugaaccccagaaaucu

SEQ ID NO: 221958 - RNA, 22 nt, Homo sapiens
caugaacacugugcggcuuccu

SEQ ID NO: 221959 - RNA, 23 nt, Homo sapiens
caugaacuaguuugcagccauga

SEQ ID NO: 221960 - RNA, 19 nt, Homo sapiens
caugauacugcucccucuc

SEQ ID NO: 221961 - RNA, 22 nt, Homo sapiens
caugcacugaguccaccucugg

SEQ ID NO: 221962 - RNA, 22 nt, Homo sapiens
caugcagcacacaugucugugc

SEQ ID NO: 221963 - RNA, 22 nt, Homo sapiens
auggagagaauuauucucucag

SEQ ID NO: 221964 - RNA, 22 nt, Homo sapiens
auggagaugaacuuggguaaag

SEQ ID NO: 221965 - RNA, 22 nt, Homo sapiens
auggagaugaauaucaucuguu

SEQ ID NO: 221966 - RNA, 22 nt, Homo sapiens
auggagaugugcgaacugagua

SEQ ID NO: 221967 - RNA, 19 nt, Homo sapiens
auggauacauuuucugcua

SEQ ID NO: 221968 - RNA, 22 nt, Homo sapiens
auggauagucucacucacauac

SEQ ID NO: 221969 - RNA, 22 nt, Homo sapiens
auggaucauauucuugaggagg

SEQ ID NO: 221970 - RNA, 22 nt, Homo sapiens
auggauuuuaggauacaguuga

SEQ ID NO: 221971 - RNA, 22 nt, Homo sapiens
auggauuuuggggccagaggca

SEQ ID NO: 221972 - RNA, 22 nt, Homo sapiens
auggcaaaaaaugcaauuacuu

SEQ ID NO: 221973 - RNA, 22 nt, Homo sapiens
auggcaauaugaugcacuguuu

SEQ ID NO: 221974 - RNA, 22 nt, Homo sapiens
auggcaauguaagucagaaaaa

SEQ ID NO: 221975 - RNA, 22 nt, Homo sapiens
auggcacagacucuuggucaag

SEQ ID NO: 221976 - RNA, 22 nt, Homo sapiens
auggcacugaagcguauugaca

SEQ ID NO: 221977 - RNA, 22 nt, Homo sapiens
auggcacuuuggacugcuagau

SEQ ID NO: 221978 - RNA, 22 nt, Homo sapiens
auggcagugagucucuaguauu

SEQ ID NO: 221979 - RNA, 20 nt, Homo sapiens
auggcccugcugggaguguc

SEQ ID NO: 221980 - RNA, 22 nt, Homo sapiens
auggccgggugcgguggcucac

SEQ ID NO: 221981 - RNA, 22 nt, Homo sapiens
auggccuuguauaccuggcaaa

SEQ ID NO: 221982 - RNA, 22 nt, Homo sapiens
auggccuuuacaauuugguaug

SEQ ID NO: 221983 - RNA, 22 nt, Homo sapiens
auggccuuucuggcacauuucc

SEQ ID NO: 221984 - RNA, 22 nt, Homo sapiens
auggcuguuucugcaaugucua

SEQ ID NO: 221985 - RNA, 22 nt, Homo sapiens
auggcuuaagacaaccuuucau

SEQ ID NO: 221986 - RNA, 22 nt, Homo sapiens
auggcuucuuacucuucugcau

SEQ ID NO: 221987 - RNA, 22 nt, Homo sapiens
auggcuucuucuaaaagugggg

SEQ ID NO: 221988 - RNA, 22 nt, Homo sapiens
auggcuuguuaugcauuaguac

SEQ ID NO: 221989 - RNA, 22 nt, Homo sapiens
auggcuuugggcugcucugccc

SEQ ID NO: 221990 - RNA, 22 nt, Homo sapiens
auggcuuuucacagaggguucu

SEQ ID NO: 221991 - RNA, 21 nt, Homo sapiens
augggacuaacugaugggucu

SEQ ID NO: 221992 - RNA, 22 nt, Homo sapiens
augggauaguaucaguggaaua

SEQ ID NO: 221993 - RNA, 22 nt, Homo sapiens
augggcacugauguauucugug

SEQ ID NO: 221994 - RNA, 22 nt, Homo sapiens
augggguaggcuuugcugcagu

SEQ ID NO: 221995 - RNA, 22 nt, Homo sapiens
augggucuccugaauacagcac

SEQ ID NO: 221996 - RNA, 18 nt, Homo sapiens
auggguguuggaaaauga

SEQ ID NO: 221997 - RNA, 22 nt, Homo sapiens
augguacucucuugucugcaaa

SEQ ID NO: 221998 - RNA, 22 nt, Homo sapiens
augguguccuguuuccccagga

SEQ ID NO: 221999 - RNA, 22 nt, Homo sapiens
auguaaacagaugugcagcuug

SEQ ID NO: 222000 - RNA, 22 nt, Homo sapiens
auguaacaguauuuggagaugu

SEQ ID NO: 222001 - RNA, 22 nt, Homo sapiens
auguaacugggacacaagccuc

SEQ ID NO: 222002 - RNA, 20 nt, Homo sapiens
auguaauguaugauauguac

SEQ ID NO: 222003 - RNA, 22 nt, Homo sapiens
auguaguugcucugccuguuuu

SEQ ID NO: 222004 - RNA, 22 nt, Homo sapiens
auguauacauagauacgugugu

SEQ ID NO: 222005 - RNA, 22 nt, Homo sapiens
auguaugagaguuccagcugau

SEQ ID NO: 222006 - RNA, 22 nt, Homo sapiens
augucacagguccuagccaagu

SEQ ID NO: 222007 - RNA, 22 nt, Homo sapiens
auguccuagagagauggugguc

SEQ ID NO: 222008 - RNA, 22 nt, Homo sapiens
augugaacaucauagaaugcac

SEQ ID NO: 222009 - RNA, 22 nt, Homo sapiens
augugacuugugaaaaguucag

SEQ ID NO: 222010 - RNA, 22 nt, Homo sapiens
augugcaaaguuaagaucccag

SEQ ID NO: 222011 - RNA, 22 nt, Homo sapiens
augugcaagaucauuaaagcuc

SEQ ID NO: 222012 - RNA, 22 nt, Homo sapiens
augugcacauucugguaaauau

SEQ ID NO: 222013 - RNA, 22 nt, Homo sapiens
augugccaauuaggauuccaag

SEQ ID NO: 222014 - RNA, 22 nt, Homo sapiens
augugcuaguaucaaacgagac

SEQ ID NO: 222015 - RNA, 22 nt, Homo sapiens
augugcuuuuggugagagauuu

SEQ ID NO: 222016 - RNA, 22 nt, Homo sapiens
auguggcuuuccuagaucuuag

SEQ ID NO: 222017 - RNA, 22 nt, Homo sapiens
auguggcuuuucaacuguguga

SEQ ID NO: 222018 - RNA, 22 nt, Homo sapiens
aggugguuuuaggcagagacau

SEQ ID NO: 222019 - RNA, 22 nt, Homo sapiens
aggugguuuuucaacacacacu

SEQ ID NO: 222020 - RNA, 21 nt, Homo sapiens
agguuguguuuccucuuacuu

SEQ ID NO: 222021 - RNA, 22 nt, Homo sapiens
agguuguguuugugauuagaua

SEQ ID NO: 222022 - RNA, 22 nt, Homo sapiens
aguaaacuucagaguucuuccu

SEQ ID NO: 222023 - RNA, 22 nt, Homo sapiens
aguaaauuucugugcuuucaua

SEQ ID NO: 222024 - RNA, 22 nt, Homo sapiens
aguaacauuucuaguagagagu

SEQ ID NO: 222025 - RNA, 22 nt, Homo sapiens
aguaagauggcaacucuccaca

SEQ ID NO: 222026 - RNA, 22 nt, Homo sapiens
aguaaucaucugagggcagaaa

SEQ ID NO: 222027 - RNA, 22 nt, Homo sapiens
aguaccacgugaugccauuuuc

SEQ ID NO: 222028 - RNA, 22 nt, Homo sapiens
aguacugucagcaggguguuga

SEQ ID NO: 222029 - RNA, 16 nt, Homo sapiens
aguaguuuuacagauu

SEQ ID NO: 222030 - RNA, 22 nt, Homo sapiens
aguaucacaagguguacaccca

SEQ ID NO: 222031 - RNA, 20 nt, Homo sapiens
aguauucacuuuuuucaugg

SEQ ID NO: 222032 - RNA, 22 nt, Homo sapiens
agucaagaugagauuugggugg

SEQ ID NO: 222033 - RNA, 22 nt, Homo sapiens
agucaaggaggccuuucagaug

SEQ ID NO: 222034 - RNA, 22 nt, Homo sapiens
agucacagccuuuuacuuuaga

SEQ ID NO: 222035 - RNA, 22 nt, Homo sapiens
agucacagugaccuugucugac

SEQ ID NO: 222036 - RNA, 22 nt, Homo sapiens
agucacaugccagcacacccag

SEQ ID NO: 222037 - RNA, 22 nt, Homo sapiens
agucagugucuguaaggagaac

SEQ ID NO: 222038 - RNA, 20 nt, Homo sapiens
agucaguuuauuuucucucu

SEQ ID NO: 222039 - RNA, 21 nt, Homo sapiens
agucauaggaguacauaaugc

SEQ ID NO: 222040 - RNA, 22 nt, Homo sapiens
agucaugggagagaugugaucg

SEQ ID NO: 222041 - RNA, 22 nt, Homo sapiens
agucaugguaguaaauuuggac

SEQ ID NO: 222042 - RNA, 22 nt, Homo sapiens
agucgguguuacugacagaaug

SEQ ID NO: 222043 - RNA, 23 nt, Homo sapiens
agucuguguuuacaggcucucug

SEQ ID NO: 222044 - RNA, 22 nt, Homo sapiens
agugaacaaagaagugcagaua

SEQ ID NO: 222045 - RNA, 19 nt, Homo sapiens
agugagccaagauccuacc

SEQ ID NO: 222046 - RNA, 22 nt, Homo sapiens
agugagcuggagaaaagaaacu

SEQ ID NO: 222047 - RNA, 22 nt, Homo sapiens
agugaucauuugaauugaugau

SEQ ID NO: 222048 - RNA, 22 nt, Homo sapiens
agugauggagccaggauuuaau

SEQ ID NO: 222049 - RNA, 22 nt, Homo sapiens
agugcaaagccgagguuucuug

SEQ ID NO: 222050 - RNA, 22 nt, Homo sapiens
agugcaauaaggauguagaacu

SEQ ID NO: 222051 - RNA, 22 nt, Homo sapiens
agugcaauggugccaucauagc

SEQ ID NO: 222052 - RNA, 22 nt, Homo sapiens
agugcacuccagccugggcaac

SEQ ID NO: 222053 - RNA, 22 nt, Homo sapiens
agugcaguggcucaaaaugccu

SEQ ID NO: 222054 - RNA, 22 nt, Homo sapiens
agugcauuugcaucucaauaua

SEQ ID NO: 222055 - RNA, 22 nt, Homo sapiens
agugccaaaucgagggcucuga

SEQ ID NO: 222056 - RNA, 22 nt, Homo sapiens
agugccuacuauguagaugcug

SEQ ID NO: 222057 - RNA, 22 nt, Homo sapiens
aguggauguuguggccugggag

SEQ ID NO: 222058 - RNA, 22 nt, Homo sapiens
aguggcacaauuuugacucccc

SEQ ID NO: 222059 - RNA, 22 nt, Homo sapiens
aguggcuuuuuaguggcagaug

SEQ ID NO: 222060 - RNA, 22 nt, Homo sapiens
agugggccccuagaggugaggu

SEQ ID NO: 222061 - RNA, 23 nt, Homo sapiens
aguggucuccugggcccagcugu

SEQ ID NO: 222062 - RNA, 22 nt, Homo sapiens
agugguuuuggaauggaauuca

SEQ ID NO: 222063 - RNA, 22 nt, Homo sapiens
agugucaggagacagguagcug

SEQ ID NO: 222064 - RNA, 22 nt, Homo sapiens
aguuggugauugauugggucug

SEQ ID NO: 222065 - RNA, 22 nt, Homo sapiens
auaaaccuacauuuucacuucu

SEQ ID NO: 222066 - RNA, 22 nt, Homo sapiens
auaaacugucaguggagaguaa

SEQ ID NO: 222067 - RNA, 22 nt, Homo sapiens
auaaagccaugagcuugagaug

SEQ ID NO: 222068 - RNA, 22 nt, Homo sapiens
auaaagguaagcacuauccuga

SEQ ID NO: 222069 - RNA, 22 nt, Homo sapiens
auaaaguguuuaguauaggcaa

SEQ ID NO: 222070 - RNA, 22 nt, Homo sapiens
auaaaugcaaugguauuuuuga

SEQ ID NO: 222071 - RNA, 22 nt, Homo sapiens
auaaaugccuguuguuuuaagc

SEQ ID NO: 222072 - RNA, 22 nt, Homo sapiens
auaaaugcuuccagucauuaaa

SEQ ID NO: 222073 - RNA, 22 nt, Homo sapiens
auaacaggaaauacagggcuuu

SEQ ID NO: 222074 - RNA, 22 nt, Homo sapiens
auaacauggaguuugucauuua

SEQ ID NO: 222075 - RNA, 18 nt, Homo sapiens
auaaccuggugcuuucaa

SEQ ID NO: 222076 - RNA, 22 nt, Homo sapiens
auaacucuguuuuuuucaugca

SEQ ID NO: 222077 - RNA, 22 nt, Homo sapiens
auaagagcaggcuucuggccag

SEQ ID NO: 222078 - RNA, 22 nt, Homo sapiens
auaaggcugguauagacauuca

SEQ ID NO: 222079 - RNA, 22 nt, Homo sapiens
auaagguuagcucugagaaagu

SEQ ID NO: 222080 - RNA, 19 nt, Homo sapiens
auaagugaaucacgggggc

SEQ ID NO: 222081 - RNA, 22 nt, Homo sapiens
auaagugagugauucaguguua

SEQ ID NO: 222082 - RNA, 22 nt, Homo sapiens
auaauaccugccacauuugaau

SEQ ID NO: 222083 - RNA, 22 nt, Homo sapiens
auaaucaugucugaaaccuuug

SEQ ID NO: 222084 - RNA, 22 nt, Homo sapiens
auaaugcuggaacuagagggca

SEQ ID NO: 222085 - RNA, 22 nt, Homo sapiens
auaauugcuaagugaagauggu

SEQ ID NO: 222086 - RNA, 22 nt, Homo sapiens
auacaagugccauguuggugug

SEQ ID NO: 222087 - RNA, 22 nt, Homo sapiens
auacagcuaaaauauuaaguua

SEQ ID NO: 222088 - RNA, 22 nt, Homo sapiens
aauaaagcauggcuacuccaua

SEQ ID NO: 222089 - RNA, 22 nt, Homo sapiens
aauaaagcuuugagcuuugcug

SEQ ID NO: 222090 - RNA, 19 nt, Homo sapiens
aauaaugccagaugucugu

SEQ ID NO: 222091 - RNA, 22 nt, Homo sapiens
aauaaugucacaggggguuagc

SEQ ID NO: 222092 - RNA, 22 nt, Homo sapiens
aauacagcacacagaugggucu

SEQ ID NO: 222093 - RNA, 22 nt, Homo sapiens
aauacucaguccuggugaggcu

SEQ ID NO: 222094 - RNA, 22 nt, Homo sapiens
aauagcacuguagauggaggaa

SEQ ID NO: 222095 - RNA, 22 nt, Homo sapiens
aauagugcugcaaaaacauacg

SEQ ID NO: 222096 - RNA, 22 nt, Homo sapiens
aauauagcuauguacaugucca

SEQ ID NO: 222097 - RNA, 22 nt, Homo sapiens
aauaucuguguauagauggggg

SEQ ID NO: 222098 - RNA, 22 nt, Homo sapiens
aauauguccaguguuuugggag

SEQ ID NO: 222099 - RNA, 22 nt, Homo sapiens
aauauugucaaaauggauucca

SEQ ID NO: 222100 - RNA, 22 nt, Homo sapiens
aaucacacuugauguugagcaa

SEQ ID NO: 222101 - RNA, 22 nt, Homo sapiens
aaucacaggucuuggcugcaug

SEQ ID NO: 222102 - RNA, 22 nt, Homo sapiens
aaucacuaugccaugaaguaca

SEQ ID NO: 222103 - RNA, 22 nt, Homo sapiens
aaucacuuuggcaccaaccuaa

SEQ ID NO: 222104 - RNA, 22 nt, Homo sapiens
aaucauauugucugccaagagg

SEQ ID NO: 222105 - RNA, 22 nt, Homo sapiens
aaucccauuucucuguguuuuu

SEQ ID NO: 222106 - RNA, 22 nt, Homo sapiens
aaucccuggacuuucggaggcu

SEQ ID NO: 222107 - RNA, 20 nt, Homo sapiens
aaucuacuugcccauuuagc

SEQ ID NO: 222108 - RNA, 22 nt, Homo sapiens
aaucuguagaaggugcacauuc

SEQ ID NO: 222109 - RNA, 22 nt, Homo sapiens
aaucugucuagacaaggagucu

SEQ ID NO: 222110 - RNA, 23 nt, Homo sapiens
aaucugucuuuguuauagggguc

SEQ ID NO: 222111 - RNA, 22 nt, Homo sapiens
aaucugucuuuuguuauugagg

SEQ ID NO: 222112 - RNA, 22 nt, Homo sapiens
aaugacacugagcaucuuucau

SEQ ID NO: 222113 - RNA, 22 nt, Homo sapiens
aaugacugugauauuuuucuuc

SEQ ID NO: 222114 - RNA, 17 nt, Homo sapiens
aaugagacauuucugcu

SEQ ID NO: 222115 - RNA, 22 nt, Homo sapiens
aaugccacugugccugccaagg

SEQ ID NO: 222116 - RNA, 22 nt, Homo sapiens
aaugcuaucuggaacauuguug

SEQ ID NO: 222117 - RNA, 22 nt, Homo sapiens
aauggagcuguuuggaugacuu

SEQ ID NO: 222118 - RNA, 22 nt, Homo sapiens
aauggcacaccuagcccuaacc

SEQ ID NO: 222119 - RNA, 22 nt, Homo sapiens
aauggcagaugaaauugucauu

SEQ ID NO: 222120 - RNA, 22 nt, Homo sapiens
aauggcaguagauggaugggua

SEQ ID NO: 222121 - RNA, 22 nt, Homo sapiens
aauggcaucuacguuaaauguc

SEQ ID NO: 222122 - RNA, 22 nt, Homo sapiens
aauggcauugguccuuuuggau

SEQ ID NO: 222123 - RNA, 22 nt, Homo sapiens
aauggccacugaccuguguuga

SEQ ID NO: 222124 - RNA, 22 nt, Homo sapiens
aauggcuauuucaugugguagg

SEQ ID NO: 222125 - RNA, 22 nt, Homo sapiens
aauggcucugauguuguuguga

SEQ ID NO: 222126 - RNA, 22 nt, Homo sapiens
aauggcuucuuauugugguuca

SEQ ID NO: 222127 - RNA, 22 nt, Homo sapiens
aauggcuuucagcuuuucccca

SEQ ID NO: 222128 - RNA, 22 nt, Homo sapiens
aaugguguuuccguuaagcuga

SEQ ID NO: 222129 - RNA, 22 nt, Homo sapiens
aaugucacugugguccuccagu

SEQ ID NO: 222130 - RNA, 22 nt, Homo sapiens
aaugucaugaguccaaccagaa

SEQ ID NO: 222131 - RNA, 22 nt, Homo sapiens
aaugugcacuuggagccuugcu

SEQ ID NO: 222132 - RNA, 22 nt, Homo sapiens
aaugugcuucuggcugugguca

SEQ ID NO: 222133 - RNA, 22 nt, Homo sapiens
aauuaguugucgugagaguggu

SEQ ID NO: 222134 - RNA, 22 nt, Homo sapiens
aauucuguauuguuuagggacu

SEQ ID NO: 222135 - RNA, 22 nt, Homo sapiens
aauucugugagauggugcagau

SEQ ID NO: 222136 - RNA, 22 nt, Homo sapiens
aauugcauaugcaguagaucua

SEQ ID NO: 222137 - RNA, 22 nt, Homo sapiens
aauugcuucuguauuuuggaca

SEQ ID NO: 222138 - RNA, 22 nt, Homo sapiens
aauuguacucccauaauucccu

SEQ ID NO: 222139 - RNA, 22 nt, Homo sapiens
aauuguacucccaucauuccua

SEQ ID NO: 222140 - RNA, 22 nt, Homo sapiens
aauugugcuuguaggccaggca

SEQ ID NO: 222141 - RNA, 22 nt, Homo sapiens
aauuugucaccucucucccuuu

SEQ ID NO: 222142 - RNA, 22 nt, Homo sapiens
acaacaguuuuaucaccccaga

SEQ ID NO: 222143 - RNA, 22 nt, Homo sapiens
acaagugcuuuuccuggagaca

SEQ ID NO: 222144 - RNA, 22 nt, Homo sapiens
acacaguaagcacaguguagau

SEQ ID NO: 222145 - RNA, 22 nt, Homo sapiens
acacauuagcaagugcuguuau

SEQ ID NO: 222146 - RNA, 22 nt, Homo sapiens
acacuauugagguuuguuugca

SEQ ID NO: 222147 - RNA, 22 nt, Homo sapiens
acacugcugaguaaauaauuuu

SEQ ID NO: 222148 - RNA, 22 nt, Homo sapiens
acacuguacuuauguuuugcag

SEQ ID NO: 222149 - RNA, 22 nt, Homo sapiens
acacuguagcugagggcaugcg

SEQ ID NO: 222150 - RNA, 20 nt, Homo sapiens
acacugugcuaaggauuuuc

SEQ ID NO: 222151 - RNA, 22 nt, Homo sapiens
acagagcaaugagcuacggucu

SEQ ID NO: 222152 - RNA, 22 nt, Homo sapiens
acagauagacauauauagcuca

SEQ ID NO: 222153 - RNA, 20 nt, Homo sapiens
acagcacugguuucaagcaa

SEQ ID NO: 222154 - RNA, 22 nt, Homo sapiens
acagcagugccccacucuacug

SEQ ID NO: 222155 - RNA, 20 nt, Homo sapiens
acagcauagccuuuuaaagc

SEQ ID NO: 222156 - RNA, 22 nt, Homo sapiens
acagguacaagggauuaggaug

SEQ ID NO: 222157 - RNA, 22 nt, Homo sapiens
acaggugaaguauuacacuaag

SEQ ID NO: 222158 - RNA, 22 nt, Homo sapiens
acaguacaugauaaauaaggua

SEQ ID NO: 222159 - RNA, 20 nt, Homo sapiens
acaguagaagggauuucaaa

SEQ ID NO: 222160 - RNA, 21 nt, Homo sapiens
acaguaguaauaguguagcca

SEQ ID NO: 222161 - RNA, 22 nt, Homo sapiens
acaguauaaugcuguagggaga

SEQ ID NO: 222162 - RNA, 19 nt, Homo sapiens
acaguauugugcacagguu

SEQ ID NO: 222163 - RNA, 22 nt, Homo sapiens
acagucacaauuuguaccuuuu

SEQ ID NO: 222164 - RNA, 22 nt, Homo sapiens
acagugcuguggucaugggucu

SEQ ID NO: 222165 - RNA, 22 nt, Homo sapiens
acaguggaauguaggguuugag

SEQ ID NO: 222166 - RNA, 22 nt, Homo sapiens
acaguguagugacugccaacuu

SEQ ID NO: 222167 - RNA, 22 nt, Homo sapiens
acaguguguguguucaccuaga

SEQ ID NO: 222168 - RNA, 22 nt, Homo sapiens
acaguguuacuugauaguguau

SEQ ID NO: 222169 - RNA, 22 nt, Homo sapiens
acaguuaugugagggccaccag

SEQ ID NO: 222170 - RNA, 22 nt, Homo sapiens
acauacacuagggauguggugu

SEQ ID NO: 222171 - RNA, 22 nt, Homo sapiens
acauauaaggagacuagggcau

SEQ ID NO: 222172 - RNA, 22 nt, Homo sapiens
acaucacuguuugauugauuga

SEQ ID NO: 222173 - RNA, 22 nt, Homo sapiens
acaugacauugggguggggaua

SEQ ID NO: 222174 - RNA, 22 nt, Homo sapiens
acaugcauauguuggaagaaag

SEQ ID NO: 222175 - RNA, 22 nt, Homo sapiens
acauggcuuaugaauuuggaga

SEQ ID NO: 222176 - RNA, 22 nt, Homo sapiens
acauguauauaaugcauagcga

SEQ ID NO: 222177 - RNA, 22 nt, Homo sapiens
acauucagcuguuguuucaaug

SEQ ID NO: 222178 - RNA, 18 nt, Homo sapiens
acauucagcuugaagaua

SEQ ID NO: 222179 - RNA, 22 nt, Homo sapiens
acauugcauauggcacccucuu

SEQ ID NO: 222180 - RNA, 22 nt, Homo sapiens
accacagugcuuccugcucacg

SEQ ID NO: 222181 - RNA, 22 nt, Homo sapiens
accacuguuucaagaagcuugu

SEQ ID NO: 222182 - RNA, 22 nt, Homo sapiens
accauugcacuccagcccaggc

SEQ ID NO: 222183 - RNA, 22 nt, Homo sapiens
acccacuagaugccaguggcac

SEQ ID NO: 222184 - RNA, 22 nt, Homo sapiens
acccagaguuccuugucuuuca

SEQ ID NO: 222185 - RNA, 22 nt, Homo sapiens
uauugcagugagauccaucugg

SEQ ID NO: 222186 - RNA, 22 nt, Homo sapiens
uauugcauauuauucuaguggc

SEQ ID NO: 222187 - RNA, 22 nt, Homo sapiens
uauugcuaaaacucaugguugc

SEQ ID NO: 222188 - RNA, 22 nt, Homo sapiens
uauugcuaacaucccuuaugua

SEQ ID NO: 222189 - RNA, 22 nt, Homo sapiens
uauugcuccccauaucgcagug

SEQ ID NO: 222190 - RNA, 22 nt, Homo sapiens
uauugggcuucucagaauagag

SEQ ID NO: 222191 - RNA, 22 nt, Homo sapiens
uauuguacauauccucccuuca

SEQ ID NO: 222192 - RNA, 22 nt, Homo sapiens
uauugucaccaucccuguuuua

SEQ ID NO: 222193 - RNA, 22 nt, Homo sapiens
uauuguuaaagauguuaaugau

SEQ ID NO: 222194 - RNA, 22 nt, Homo sapiens
uauuucaguugcguuucccgag

SEQ ID NO: 222195 - RNA, 22 nt, Homo sapiens
uauuuggugaaugaaugcaugu

SEQ ID NO: 222196 - RNA, 22 nt, Homo sapiens
ucaaaaucucuuagcugugucu

SEQ ID NO: 222197 - RNA, 22 nt, Homo sapiens
ucaaaguagaaaaggggcaauu

SEQ ID NO: 222198 - RNA, 22 nt, Homo sapiens
ucaaaugaucugcccgccuugg

SEQ ID NO: 222199 - RNA, 22 nt, Homo sapiens
ucaaauguuuguuuaaggcuua

SEQ ID NO: 222200 - RNA, 20 nt, Homo sapiens
ucaaauucuuggccuccagc

SEQ ID NO: 222201 - RNA, 22 nt, Homo sapiens
ucaacacaguuaaauggggaaa

SEQ ID NO: 222202 - RNA, 22 nt, Homo sapiens
ucaacagugauggaaaguuaua

SEQ ID NO: 222203 - RNA, 22 nt, Homo sapiens
ucaacauugcugucaggcaucu

SEQ ID NO: 222204 - RNA, 22 nt, Homo sapiens
ucaacguauuuauauagcagag

SEQ ID NO: 222205 - RNA, 19 nt, Homo sapiens
ucaagcuauucuccugccu

SEQ ID NO: 222206 - RNA, 22 nt, Homo sapiens
ucaaggcacauuugacauuuuc

SEQ ID NO: 222207 - RNA, 20 nt, Homo sapiens
ucaaggcaggaacuguacau

SEQ ID NO: 222208 - RNA, 22 nt, Homo sapiens
ucaaguaagaagugggcauaaa

SEQ ID NO: 222209 - RNA, 22 nt, Homo sapiens
ucaaugcaaccuccaccucugg

SEQ ID NO: 222210 - RNA, 22 nt, Homo sapiens
ucaaugcaugugacaaagagua

SEQ ID NO: 222211 - RNA, 16 nt, Homo sapiens
ucacaaacucuagcag

SEQ ID NO: 222212 - RNA, 22 nt, Homo sapiens
ucacaaggcaggaaugaaaggg

SEQ ID NO: 222213 - RNA, 21 nt, Homo sapiens
ucacaaugaacagcagcagaa

SEQ ID NO: 222214 - RNA, 22 nt, Homo sapiens
ucacaauggagacucgggcgga

SEQ ID NO: 222215 - RNA, 22 nt, Homo sapiens
ucacaauggcugaacuaauuua

SEQ ID NO: 222216 - RNA, 22 nt, Homo sapiens
ucacaauguaaaugaggguugg

SEQ ID NO: 222217 - RNA, 22 nt, Homo sapiens
ucacaauucucaauuugugaaa

SEQ ID NO: 222218 - RNA, 22 nt, Homo sapiens
ucacacucucaccaacauuugg

SEQ ID NO: 222219 - RNA, 22 nt, Homo sapiens
ucacacugucuugguuacucuu

SEQ ID NO: 222220 - RNA, 22 nt, Homo sapiens
ucacagaggagaagaccuuuaa

SEQ ID NO: 222221 - RNA, 22 nt, Homo sapiens
ucacaggguguuauuagaauua

SEQ ID NO: 222222 - RNA, 18 nt, Homo sapiens
ucacagguaauuaggauu

SEQ ID NO: 222223 - RNA, 22 nt, Homo sapiens
ucacaguagggaacugacaaag

SEQ ID NO: 222224 - RNA, 22 nt, Homo sapiens
ucacagucugcgugaugagaca

SEQ ID NO: 222225 - RNA, 23 nt, Homo sapiens
ucacaguuacuuuugcaucaacc

SEQ ID NO: 222226 - RNA, 22 nt, Homo sapiens
ucacaguuggccuggccuuuua

SEQ ID NO: 222227 - RNA, 18 nt, Homo sapiens
ucacauggccgagagaga

SEQ ID NO: 222228 - RNA, 22 nt, Homo sapiens
ucacaugugcguuuuggcaugu

SEQ ID NO: 222229 - RNA, 22 nt, Homo sapiens
ucacauuguauauguaccuauc

SEQ ID NO: 222230 - RNA, 22 nt, Homo sapiens
acugcacuccagacucugucuc

SEQ ID NO: 222231 - RNA, 22 nt, Homo sapiens
acugcacuccagccuccugggu

SEQ ID NO: 222232 - RNA, 22 nt, Homo sapiens
acugcacuccagccucggggac

SEQ ID NO: 222233 - RNA, 22 nt, Homo sapiens
acugcacuccagccugccgaca

SEQ ID NO: 222234 - RNA, 22 nt, Homo sapiens
acugcacuccagccugcugaca

SEQ ID NO: 222235 - RNA, 22 nt, Homo sapiens
acugcacuccagccuggacgac

SEQ ID NO: 222236 - RNA, 22 nt, Homo sapiens
acugcacuccagccugugcgua

SEQ ID NO: 222237 - RNA, 22 nt, Homo sapiens
acugcacuccagccuguugaca

SEQ ID NO: 222238 - RNA, 22 nt, Homo sapiens
acugcacuccagccuucggaca

SEQ ID NO: 222239 - RNA, 22 nt, Homo sapiens
acugcacuccagccuugagagc

SEQ ID NO: 222240 - RNA, 22 nt, Homo sapiens
acugcacuccagccuugauggc

SEQ ID NO: 222241 - RNA, 22 nt, Homo sapiens
acugcacuccagccuugcgaca

SEQ ID NO: 222242 - RNA, 22 nt, Homo sapiens
acugcacuccagccuuggcggc

SEQ ID NO: 222243 - RNA, 22 nt, Homo sapiens
acugcacuccagccuugugaca

SEQ ID NO: 222244 - RNA, 22 nt, Homo sapiens
acugcacuccagcuccagggug

SEQ ID NO: 222245 - RNA, 22 nt, Homo sapiens
acugcacuccagcuuuggguga

SEQ ID NO: 222246 - RNA, 22 nt, Homo sapiens
acugcacuccagcuuuggugac

SEQ ID NO: 222247 - RNA, 22 nt, Homo sapiens
acugcacuccaucuuagguggc

SEQ ID NO: 222248 - RNA, 22 nt, Homo sapiens
acugcacugucaaccuccuggg

SEQ ID NO: 222249 - RNA, 22 nt, Homo sapiens
acugcacuucaaccucauugac

SEQ ID NO: 222250 - RNA, 20 nt, Homo sapiens
acugcacuucagccugcugg

SEQ ID NO: 222251 - RNA, 22 nt, Homo sapiens
acugcacuucagccuguugaca

SEQ ID NO: 222252 - RNA, 21 nt, Homo sapiens
acuggaccccuuccauacacc

SEQ ID NO: 222253 - RNA, 22 nt, Homo sapiens
acuggacuuaaugaugaauugu

SEQ ID NO: 222254 - RNA, 22 nt, Homo sapiens
acuggcuuaaggaugggccacu

SEQ ID NO: 222255 - RNA, 20 nt, Homo sapiens
acugggcuaccgaaguaagg

SEQ ID NO: 222256 - RNA, 22 nt, Homo sapiens
acugggucaaaguagaaaacua

SEQ ID NO: 222257 - RNA, 22 nt, Homo sapiens
acuguauagauggaguugauuu

SEQ ID NO: 222258 - RNA, 22 nt, Homo sapiens
acugugcuguuuuaauuauuga

SEQ ID NO: 222259 - RNA, 22 nt, Homo sapiens
acuuaguauggggcuuuugaga

SEQ ID NO: 222260 - RNA, 22 nt, Homo sapiens
acuuuuguuauacagugugaua

SEQ ID NO: 222261 - RNA, 22 nt, Homo sapiens
acuuuuugaugaggucguuugu

SEQ ID NO: 222262 - RNA, 21 nt, Homo sapiens
agaaaaucuuaugggaaacau

SEQ ID NO: 222263 - RNA, 22 nt, Homo sapiens
agaaacacagguggaauugcuu

SEQ ID NO: 222264 - RNA, 22 nt, Homo sapiens
agaaacauucucuugccuccuu

SEQ ID NO: 222265 - RNA, 22 nt, Homo sapiens
agaaagcgcuucccuuugcugg

SEQ ID NO: 222266 - RNA, 22 nt, Homo sapiens
agaaagugcuucccuuugguga

SEQ ID NO: 222267 - RNA, 22 nt, Homo sapiens
agaaauguuuacucacccccuu

SEQ ID NO: 222268 - RNA, 22 nt, Homo sapiens
agaaauguuuauucaaacccgu

SEQ ID NO: 222269 - RNA, 22 nt, Homo sapiens
agaaugauccuucucagaggca

SEQ ID NO: 222270 - RNA, 22 nt, Homo sapiens
agaaugugaacaucuugaaagu

SEQ ID NO: 222271 - RNA, 22 nt, Homo sapiens
agacaagauggcuugagguuca

SEQ ID NO: 222272 - RNA, 22 nt, Homo sapiens
agacacugaaauguauugaaga

SEQ ID NO: 222273 - RNA, 22 nt, Homo sapiens
agacacuguugaaaaggcccca

SEQ ID NO: 222274 - RNA, 22 nt, Homo sapiens
agacagcugggaaauggagugu

SEQ ID NO: 222275 - RNA, 22 nt, Homo sapiens
agacagcugguagcacuuccug

SEQ ID NO: 222276 - RNA, 22 nt, Homo sapiens
agaccacuuuagagauuguuca

SEQ ID NO: 222277 - RNA, 22 nt, Homo sapiens
agacuagacagaugaacagcac

SEQ ID NO: 222278 - RNA, 22 nt, Homo sapiens
agacuagagggaaaugaguugg

SEQ ID NO: 222279 - RNA, 22 nt, Homo sapiens
agacucauuuccauagucagcu

SEQ ID NO: 222280 - RNA, 22 nt, Homo sapiens
agagauaaagauuuuaauuuug

SEQ ID NO: 222281 - RNA, 22 nt, Homo sapiens
agagauaauuagguuaaaugag

SEQ ID NO: 222282 - RNA, 22 nt, Homo sapiens
ucagugcaggaauuuccuuaga

SEQ ID NO: 222283 - RNA, 19 nt, Homo sapiens
ucagugcuauguaauguag

SEQ ID NO: 222284 - RNA, 22 nt, Homo sapiens
ucaguggagagcuuccaggauu

SEQ ID NO: 222285 - RNA, 22 nt, Homo sapiens
ucagugggcuauguaauuaacu

SEQ ID NO: 222286 - RNA, 22 nt, Homo sapiens
ucagugucugugcaccgcugga

SEQ ID NO: 222287 - RNA, 22 nt, Homo sapiens
ucaguguugauggcugcugacu

SEQ ID NO: 222288 - RNA, 22 nt, Homo sapiens
ucaguguuuuauccuccagagc

SEQ ID NO: 222289 - RNA, 21 nt, Homo sapiens
ucaguuacugagagagaagug

SEQ ID NO: 222290 - RNA, 22 nt, Homo sapiens
ucaguucauggaggugucugcu

SEQ ID NO: 222291 - RNA, 20 nt, Homo sapiens
ucauacuguggaguaccagg

SEQ ID NO: 222292 - RNA, 22 nt, Homo sapiens
ucauaucauuagaucuacugua

SEQ ID NO: 222293 - RNA, 23 nt, Homo sapiens
ucaucacagcauuuccugguauu

SEQ ID NO: 222294 - RNA, 22 nt, Homo sapiens
ucaucagguaugucagcggagu

SEQ ID NO: 222295 - RNA, 22 nt, Homo sapiens
ucaucagugcuugcaaauuauu

SEQ ID NO: 222296 - RNA, 20 nt, Homo sapiens
ucaucaguuggugcucgcug

SEQ ID NO: 222297 - RNA, 22 nt, Homo sapiens
ucaucaguuuuuuauaugugau

SEQ ID NO: 222298 - RNA, 22 nt, Homo sapiens
ucaucucaguuucuugccguac

SEQ ID NO: 222299 - RNA, 22 nt, Homo sapiens
ucaugaaguaguuaacugguug

SEQ ID NO: 222300 - RNA, 23 nt, Homo sapiens
ucaugaggccauucaaauccauu

SEQ ID NO: 222301 - RNA, 20 nt, Homo sapiens
ucaugccacugcgcuccagc

SEQ ID NO: 222302 - RNA, 22 nt, Homo sapiens
ucauggcacugaugagaguuuc

SEQ ID NO: 222303 - RNA, 22 nt, Homo sapiens
ucauggcauuguuaaggguuuu

SEQ ID NO: 222304 - RNA, 22 nt, Homo sapiens
ucauggcuuuuauuauguugag

SEQ ID NO: 222305 - RNA, 22 nt, Homo sapiens
ucauggggugagcuacaggcac

SEQ ID NO: 222306 - RNA, 22 nt, Homo sapiens
ucauggggugcuuugcuagauu

SEQ ID NO: 222307 - RNA, 22 nt, Homo sapiens
ucauuagagaucuuggggaaaa

SEQ ID NO: 222308 - RNA, 22 nt, Homo sapiens
ucauuagucaccuagccagcuu

SEQ ID NO: 222309 - RNA, 22 nt, Homo sapiens
ucauucauuugcucacuccaca

SEQ ID NO: 222310 - RNA, 22 nt, Homo sapiens
ucauucuuucuguggaggggcu

SEQ ID NO: 222311 - RNA, 22 nt, Homo sapiens
ucauugagacuuguuuuguggc

SEQ ID NO: 222312 - RNA, 22 nt, Homo sapiens
ucauugcacuucuuuaguugca

SEQ ID NO: 222313 - RNA, 22 nt, Homo sapiens
ucauugcauguuaauuaaacag

SEQ ID NO: 222314 - RNA, 22 nt, Homo sapiens
ucauugcauuccagcccaagca

SEQ ID NO: 222315 - RNA, 22 nt, Homo sapiens
ucauugcuuauuuguuggugga

SEQ ID NO: 222316 - RNA, 22 nt, Homo sapiens
ucauuggcuaagcuuguuacac

SEQ ID NO: 222317 - RNA, 18 nt, Homo sapiens
ucauuggugagcaccucc

SEQ ID NO: 222318 - RNA, 22 nt, Homo sapiens
uccaagaugcuggcagcuacag

SEQ ID NO: 222319 - RNA, 22 nt, Homo sapiens
uccacaguggugaggugcagca

SEQ ID NO: 222320 - RNA, 22 nt, Homo sapiens
uccacagugguggaauuguuca

SEQ ID NO: 222321 - RNA, 22 nt, Homo sapiens
uccacagugguugaacuaguaa

SEQ ID NO: 222322 - RNA, 20 nt, Homo sapiens
uccacugagcgucacggcag

SEQ ID NO: 222323 - RNA, 22 nt, Homo sapiens
uccacuuuugugcugaauugga

SEQ ID NO: 222324 - RNA, 17 nt, Homo sapiens
uccagauuucaauugaa

SEQ ID NO: 222325 - RNA, 22 nt, Homo sapiens
uccaguguuucuuccacuauuu

SEQ ID NO: 222326 - RNA, 18 nt, Homo sapiens
uccaguuuucccagcauc

SEQ ID NO: 222327 - RNA, 22 nt, Homo sapiens
uccaguuuuguuaacauauggu

SEQ ID NO: 222328 - RNA, 22 nt, Homo sapiens
gacacagugaagucucuacuug

SEQ ID NO: 222329 - RNA, 22 nt, Homo sapiens
gacaccauuucaguacuagguu

SEQ ID NO: 222330 - RNA, 22 nt, Homo sapiens
gacacuggguguuuguuggcgu

SEQ ID NO: 222331 - RNA, 22 nt, Homo sapiens
gacacugucuucugcucuuaaa

SEQ ID NO: 222332 - RNA, 22 nt, Homo sapiens
gacagguuuucuguuucugaaa

SEQ ID NO: 222333 - RNA, 22 nt, Homo sapiens
gacagugugauacuuagucuca

SEQ ID NO: 222334 - RNA, 18 nt, Homo sapiens
gacaguguggugauuccu

SEQ ID NO: 222335 - RNA, 20 nt, Homo sapiens
gacauagagacucucaaaaa

SEQ ID NO: 222336 - RNA, 22 nt, Homo sapiens
gacauguuuacaguguugagag

SEQ ID NO: 222337 - RNA, 20 nt, Homo sapiens
gacauguuuuguggccuaac

SEQ ID NO: 222338 - RNA, 22 nt, Homo sapiens
gacauguuuuuuaagguuuaug

SEQ ID NO: 222339 - RNA, 22 nt, Homo sapiens
gacauuaucagguuuguuuucu

SEQ ID NO: 222340 - RNA, 21 nt, Homo sapiens
gaccuguaguaagcauucaca

SEQ ID NO: 222341 - RNA, 22 nt, Homo sapiens
gacucagucuuggauuuuuaau

SEQ ID NO: 222342 - RNA, 22 nt, Homo sapiens
gacucuguagacaaucacaucu

SEQ ID NO: 222343 - RNA, 22 nt, Homo sapiens
gacugcagugcagcuguuaggc

SEQ ID NO: 222344 - RNA, 22 nt, Homo sapiens
gacugcauuugccccaucgaau

SEQ ID NO: 222345 - RNA, 22 nt, Homo sapiens
gacuuugguagaggaaaaaucu

SEQ ID NO: 222346 - RNA, 22 nt, Homo sapiens
gagaacagaagcauuccuaauu

SEQ ID NO: 222347 - RNA, 22 nt, Homo sapiens
gagaacagagauaauuuuacuu

SEQ ID NO: 222348 - RNA, 22 nt, Homo sapiens
gagaaccuccagcaagguagua

SEQ ID NO: 222349 - RNA, 22 nt, Homo sapiens
gagaacugagugugcuggcgga

SEQ ID NO: 222350 - RNA, 22 nt, Homo sapiens
gagaacuggcugauucaaggac

SEQ ID NO: 222351 - RNA, 22 nt, Homo sapiens
gagaaguaaauuuauuugcaaa

SEQ ID NO: 222352 - RNA, 22 nt, Homo sapiens
gagaagugcgucguuugaugau

SEQ ID NO: 222353 - RNA, 20 nt, Homo sapiens
gagaccugagauucacucaa

SEQ ID NO: 222354 - RNA, 22 nt, Homo sapiens
gagagcuaggccacuggggcuu

SEQ ID NO: 222355 - RNA, 22 nt, Homo sapiens
gagagucacagugaauguggca

SEQ ID NO: 222356 - RNA, 22 nt, Homo sapiens
gagagugaaguuugcuaccugu

SEQ ID NO: 222357 - RNA, 22 nt, Homo sapiens
gagauaauuugaaucauggggg

SEQ ID NO: 222358 - RNA, 22 nt, Homo sapiens
gagauacacccagugcagaggc

SEQ ID NO: 222359 - RNA, 22 nt, Homo sapiens
gagauaggauucacuuucaugu

SEQ ID NO: 222360 - RNA, 22 nt, Homo sapiens
gagauagguauuucauuuaccc

SEQ ID NO: 222361 - RNA, 22 nt, Homo sapiens
gagaucaaugccuauggcuuuc

SEQ ID NO: 222362 - RNA, 22 nt, Homo sapiens
gagaucaauucauggcauaguu

SEQ ID NO: 222363 - RNA, 22 nt, Homo sapiens
gagaucaucuaaucuggccucu

SEQ ID NO: 222364 - RNA, 23 nt, Homo sapiens
gagaucauucuggaauuagagug

SEQ ID NO: 222365 - RNA, 22 nt, Homo sapiens
gagaucauugugggccaagcug

SEQ ID NO: 222366 - RNA, 22 nt, Homo sapiens
gagaugaaaucuugcucuguca

SEQ ID NO: 222367 - RNA, 22 nt, Homo sapiens
gagauggagacuuggccuuaaa

SEQ ID NO: 222368 - RNA, 22 nt, Homo sapiens
gagauuaacauuugaggagcug

SEQ ID NO: 222369 - RNA, 22 nt, Homo sapiens
gagauuuucagcuugacuggga

SEQ ID NO: 222370 - RNA, 22 nt, Homo sapiens
gagcaaugauugagccacugua

SEQ ID NO: 222371 - RNA, 22 nt, Homo sapiens
gagccauggagaaaacagcuau

SEQ ID NO: 222372 - RNA, 22 nt, Homo sapiens
gagcuaguguaauauuuugggg

SEQ ID NO: 222373 - RNA, 22 nt, Homo sapiens
gagcucaccuuaccucuggagc

SEQ ID NO: 222374 - RNA, 22 nt, Homo sapiens
gagcugaaguuuccauuuguac

SEQ ID NO: 222375 - RNA, 22 nt, Homo sapiens
gagcugaucuuuauguaaauuc

SEQ ID NO: 222376 - RNA, 22 nt, Homo sapiens
gagcuggacuucuuaccuuuuc

SEQ ID NO: 222377 - RNA, 22 nt, Homo sapiens
gagcuguugguuugaaagaauu

SEQ ID NO: 222378 - RNA, 22 nt, Homo sapiens
gaggaaguagcuacugucuuuc

SEQ ID NO: 222379 - RNA, 22 nt, Homo sapiens
gaggaaguuuacaaagcaucug

SEQ ID NO: 222380 - RNA, 22 nt, Homo sapiens
gaggacauuaugcuaaguggaa

SEQ ID NO: 222381 - RNA, 22 nt, Homo sapiens
gaggagauauucugcuggaugg

SEQ ID NO: 222382 - RNA, 22 nt, Homo sapiens
gaggcauuauucccaucuuaca

SEQ ID NO: 222383 - RNA, 22 nt, Homo sapiens
gaggcggugugaugucacaugc

SEQ ID NO: 222384 - RNA, 22 nt, Homo sapiens
gagguagaauguuuuucagcug

SEQ ID NO: 222385 - RNA, 21 nt, Homo sapiens
gagguagggauuaaagaccuc

SEQ ID NO: 222386 - RNA, 22 nt, Homo sapiens
gagguauggauaucuggagagg

SEQ ID NO: 222387 - RNA, 22 nt, Homo sapiens
gaggugauaucucauugugguu

SEQ ID NO: 222388 - RNA, 22 nt, Homo sapiens
gagguugggaugagggauacag

SEQ ID NO: 222389 - RNA, 22 nt, Homo sapiens
gaguaaaugucaaguacuuagg

SEQ ID NO: 222390 - RNA, 22 nt, Homo sapiens
gaguagaacugguuaucuaaua

SEQ ID NO: 222391 - RNA, 22 nt, Homo sapiens
gaguagugcugcaauaaacaua

SEQ ID NO: 222392 - RNA, 22 nt, Homo sapiens
gaguauauuugcacuguuaugu

SEQ ID NO: 222393 - RNA, 22 nt, Homo sapiens
gagugcaauggcaagaucuugg

SEQ ID NO: 222394 - RNA, 22 nt, Homo sapiens
gagugcaauggcagaucuccgc

SEQ ID NO: 222395 - RNA, 22 nt, Homo sapiens
gagugcaauggugccaucucgg

SEQ ID NO: 222396 - RNA, 22 nt, Homo sapiens
gagugcaauggugcuaucucgg

SEQ ID NO: 222397 - RNA, 22 nt, Homo sapiens
gaguucaauuuccagcuguucu

SEQ ID NO: 222398 - RNA, 22 nt, Homo sapiens
gaguuccuuugagccugagagg

SEQ ID NO: 222399 - RNA, 22 nt, Homo sapiens
gaguuuguacuaauuuguugua

SEQ ID NO: 222400 - RNA, 22 nt, Homo sapiens
gauaaaguauuggguacuaugc

SEQ ID NO: 222401 - RNA, 22 nt, Homo sapiens
agaauguaaacagaauagagga

SEQ ID NO: 222402 - RNA, 22 nt, Homo sapiens
agaaugucaguauuggcuaaaa

SEQ ID NO: 222403 - RNA, 22 nt, Homo sapiens
agacaguauuggcaaagugugu

SEQ ID NO: 222404 - RNA, 22 nt, Homo sapiens
agacccuguauguguuuaguuu

SEQ ID NO: 222405 - RNA, 23 nt, Homo sapiens
agacugaaguaucugagacucag

SEQ ID NO: 222406 - RNA, 19 nt, Homo sapiens
agacuggcccaggcgggug

SEQ ID NO: 222407 - RNA, 22 nt, Homo sapiens
agagaacugauuggaugugggc

SEQ ID NO: 222408 - RNA, 22 nt, Homo sapiens
agagaacuggcuucaccauucu

SEQ ID NO: 222409 - RNA, 22 nt, Homo sapiens
agagagcuugggguguuaaauu

SEQ ID NO: 222410 - RNA, 22 nt, Homo sapiens
agagaucaauaugaaggaaaug

SEQ ID NO: 222411 - RNA, 22 nt, Homo sapiens
agagauccucauuuuauagaca

SEQ ID NO: 222412 - RNA, 22 nt, Homo sapiens
agagauuauccuggcuucucug

SEQ ID NO: 222413 - RNA, 20 nt, Homo sapiens
agagcaaagccgcaccccua

SEQ ID NO: 222414 - RNA, 22 nt, Homo sapiens
agagcaaugggugaauauuaaa

SEQ ID NO: 222415 - RNA, 22 nt, Homo sapiens
agagcacuguggguccaaauau

SEQ ID NO: 222416 - RNA, 18 nt, Homo sapiens
agagcuaugaacauaugc

SEQ ID NO: 222417 - RNA, 21 nt, Homo sapiens
agaggacugaccacagcccua

SEQ ID NO: 222418 - RNA, 22 nt, Homo sapiens
agagguguuaaagucucuuuua

SEQ ID NO: 222419 - RNA, 22 nt, Homo sapiens
agagguuuaauugauucacagu

SEQ ID NO: 222420 - RNA, 22 nt, Homo sapiens
agagguuuugcccucgagauaa

SEQ ID NO: 222421 - RNA, 22 nt, Homo sapiens
agaguacugacguuugcaaauu

SEQ ID NO: 222422 - RNA, 22 nt, Homo sapiens
agaguaguuuauuaugcuaagg

SEQ ID NO: 222423 - RNA, 22 nt, Homo sapiens
agagugcaaagguuggggcugg

SEQ ID NO: 222424 - RNA, 22 nt, Homo sapiens
agagugcaauggcaccaucucg

SEQ ID NO: 222425 - RNA, 22 nt, Homo sapiens
agauaugucugcuauuugcugu

SEQ ID NO: 222426 - RNA, 22 nt, Homo sapiens
agauauguuauugauguuaaug

SEQ ID NO: 222427 - RNA, 22 nt, Homo sapiens
agaucaauugcugauucgcucu

SEQ ID NO: 222428 - RNA, 22 nt, Homo sapiens
agaucauaugcaguaaugaacu

SEQ ID NO: 222429 - RNA, 18 nt, Homo sapiens
agaugcaugcucacuaca

SEQ ID NO: 222430 - RNA, 23 nt, Homo sapiens
agauggcauuucaguucuuuagg

SEQ ID NO: 222431 - RNA, 22 nt, Homo sapiens
agauggugauaaaugugguacc

SEQ ID NO: 222432 - RNA, 18 nt, Homo sapiens
agaugguguugcuucugu

SEQ ID NO: 222433 - RNA, 22 nt, Homo sapiens
agaugguguuggcugaguguau

SEQ ID NO: 222434 - RNA, 22 nt, Homo sapiens
agcaaccagaggagaugaggcu

SEQ ID NO: 222435 - RNA, 22 nt, Homo sapiens
agcaagacauggcuuccaaaug

SEQ ID NO: 222436 - RNA, 22 nt, Homo sapiens
agcacauuaguaucuaagaaca

SEQ ID NO: 222437 - RNA, 22 nt, Homo sapiens
agcaccaauaacaguuucuagc

SEQ ID NO: 222438 - RNA, 22 nt, Homo sapiens
agcaccacaauuuccugccuaa

SEQ ID NO: 222439 - RNA, 22 nt, Homo sapiens
agcacgaaaccaaauucuguga

SEQ ID NO: 222440 - RNA, 22 nt, Homo sapiens
agcagagcaguggauuuuguga

SEQ ID NO: 222441 - RNA, 22 nt, Homo sapiens
agcagagcauauucauucgggg

SEQ ID NO: 222442 - RNA, 22 nt, Homo sapiens
agcagcauuccaaaaaucugcu

SEQ ID NO: 222443 - RNA, 17 nt, Homo sapiens
agcagcccauaucccca

SEQ ID NO: 222444 - RNA, 22 nt, Homo sapiens
agcagcgacacccuguggugag

SEQ ID NO: 222445 - RNA, 22 nt, Homo sapiens
agcagcucaagacuuaaauuug

SEQ ID NO: 222446 - RNA, 22 nt, Homo sapiens
agcagcucaugccuuugggagg

SEQ ID NO: 222447 - RNA, 22 nt, Homo sapiens
agcagcuuugcauggccuguga

SEQ ID NO: 222448 - RNA, 22 nt, Homo sapiens
agcaguagaauuccugcaucac

SEQ ID NO: 222449 - RNA, 20 nt, Homo sapiens
agcaucacagagccgggugu

SEQ ID NO: 222450 - RNA, 22 nt, Homo sapiens
agcaucauaccaaucugguccu

SEQ ID NO: 222451 - RNA, 22 nt, Homo sapiens
agcaucauguuuucgagguuca

SEQ ID NO: 222452 - RNA, 20 nt, Homo sapiens
agcaucguuguguuauagcc

SEQ ID NO: 222453 - RNA, 22 nt, Homo sapiens
agcauuacaugguacagagaag

SEQ ID NO: 222454 - RNA, 22 nt, Homo sapiens
agcauuaguugugaagccuuua

SEQ ID NO: 222455 - RNA, 22 nt, Homo sapiens
agccaguauuuuauugaggauu

SEQ ID NO: 222456 - RNA, 21 nt, Homo sapiens
agccaguguuccuuguggcuc

SEQ ID NO: 222457 - RNA, 22 nt, Homo sapiens
agcccauuuugcacugagaugc

SEQ ID NO: 222458 - RNA, 22 nt, Homo sapiens
agcccuuagauggcuccuucca

SEQ ID NO: 222459 - RNA, 22 nt, Homo sapiens
agccuguagugagcugugauug

SEQ ID NO: 222460 - RNA, 22 nt, Homo sapiens
agccuucauucugacaguagga

SEQ ID NO: 222461 - RNA, 22 nt, Homo sapiens
agcgacauugguugcuuugguu

SEQ ID NO: 222462 - RNA, 22 nt, Homo sapiens
agcgccacugcacuccagccug

SEQ ID NO: 222463 - RNA, 22 nt, Homo sapiens
agcgccauugcacuccagccuu

SEQ ID NO: 222464 - RNA, 21 nt, Homo sapiens
agcuaaauuggaaauuucugu

SEQ ID NO: 222465 - RNA, 22 nt, Homo sapiens
agcuaguguucaccagagguca

SEQ ID NO: 222466 - RNA, 22 nt, Homo sapiens
agcuauauugaggaugccauuc

SEQ ID NO: 222467 - RNA, 21 nt, Homo sapiens
agcuccacucguucccaaagc

SEQ ID NO: 222468 - RNA, 22 nt, Homo sapiens
agcuccuuucugcaggcagguc

SEQ ID NO: 222469 - RNA, 22 nt, Homo sapiens
agcugauggucuuguaugaugu

SEQ ID NO: 222470 - RNA, 22 nt, Homo sapiens
agcugcacugguauaggagaaa

SEQ ID NO: 222471 - RNA, 20 nt, Homo sapiens
agcugcagauauaaauccgc

SEQ ID NO: 222472 - RNA, 22 nt, Homo sapiens
agcugccagucuuguaaggccu

SEQ ID NO: 222473 - RNA, 22 nt, Homo sapiens
agcuggacuugauaaaugaaua

SEQ ID NO: 222474 - RNA, 22 nt, Homo sapiens
agcuggauguauguuaagugaa

SEQ ID NO: 222475 - RNA, 22 nt, Homo sapiens
agcuggauuguuuaccuggggc

SEQ ID NO: 222476 - RNA, 22 nt, Homo sapiens
agcuggcuguagcugcaagucu

SEQ ID NO: 222477 - RNA, 22 nt, Homo sapiens
agcugguaugaaaaucucccca

SEQ ID NO: 222478 - RNA, 22 nt, Homo sapiens
agcuggucucaggugcccugcu

SEQ ID NO: 222479 - RNA, 22 nt, Homo sapiens
agcuguuguuaauuaacucauu

SEQ ID NO: 222480 - RNA, 22 nt, Homo sapiens
agcuuaugcuuggaagagauga

SEQ ID NO: 222481 - RNA, 20 nt, Homo sapiens
agcuugguuuggaugaucac

SEQ ID NO: 222482 - RNA, 22 nt, Homo sapiens
agcuuguauuuguagccuguug

SEQ ID NO: 222483 - RNA, 22 nt, Homo sapiens
agcuugugauucuccaucaugu

SEQ ID NO: 222484 - RNA, 22 nt, Homo sapiens
agcuuguuuuauagaaagucaa

SEQ ID NO: 222485 - RNA, 19 nt, Homo sapiens
agcuuuggcuaacuuucuc

SEQ ID NO: 222486 - RNA, 21 nt, Homo sapiens
aggaagacuaugaucaauugg

SEQ ID NO: 222487 - RNA, 16 nt, Homo sapiens
aggaagacuuagagau

SEQ ID NO: 222488 - RNA, 22 nt, Homo sapiens
aggaagcuagcauuuguucagu

SEQ ID NO: 222489 - RNA, 22 nt, Homo sapiens
aggaagguaaacuaacuugccu

SEQ ID NO: 222490 - RNA, 18 nt, Homo sapiens
aggaaugguaauacuuca

SEQ ID NO: 222491 - RNA, 22 nt, Homo sapiens
aggaccaugguauugcuuuggg

SEQ ID NO: 222492 - RNA, 22 nt, Homo sapiens
aggagaucagccucccugcaac

SEQ ID NO: 222493 - RNA, 21 nt, Homo sapiens
aggagauguuuguccuuuuag

SEQ ID NO: 222494 - RNA, 22 nt, Homo sapiens
aggagcacaggacuuugauuau

SEQ ID NO: 222495 - RNA, 22 nt, Homo sapiens
aggagcacuggccuuggaguca

SEQ ID NO: 222496 - RNA, 21 nt, Homo sapiens
aggagcauucucuugcuuugu

SEQ ID NO: 222497 - RNA, 20 nt, Homo sapiens
aggagcauuuacauuggcuc

SEQ ID NO: 222498 - RNA, 23 nt, Homo sapiens
aggagcuuagaaguugccauugc

SEQ ID NO: 222499 - RNA, 22 nt, Homo sapiens
guuauguguuuccuuaauugcu

SEQ ID NO: 222500 - RNA, 22 nt, Homo sapiens
guuauuguccauuuauuuagca

SEQ ID NO: 222501 - RNA, 22 nt, Homo sapiens
guucaagcaauucugcugccuc

SEQ ID NO: 222502 - RNA, 22 nt, Homo sapiens
guucaagugauagcugggauua

SEQ ID NO: 222503 - RNA, 20 nt, Homo sapiens
guucacagagguuaugauua

SEQ ID NO: 222504 - RNA, 22 nt, Homo sapiens
guucaucagggacacugguuug

SEQ ID NO: 222505 - RNA, 22 nt, Homo sapiens
guucaucagggauacuggccuu

SEQ ID NO: 222506 - RNA, 22 nt, Homo sapiens
guucaucagggauacuggcuua

SEQ ID NO: 222507 - RNA, 22 nt, Homo sapiens
guucaucagggauauuggccug

SEQ ID NO: 222508 - RNA, 23 nt, Homo sapiens
guucaucagggauauuggccuga

SEQ ID NO: 222509 - RNA, 20 nt, Homo sapiens
guucccuguaggugugcgga

SEQ ID NO: 222510 - RNA, 22 nt, Homo sapiens
guucuauguugggaguucacua

SEQ ID NO: 222511 - RNA, 22 nt, Homo sapiens
guucucacuggugcugguaagu

SEQ ID NO: 222512 - RNA, 22 nt, Homo sapiens
guucuggagauaaagccaaggu

SEQ ID NO: 222513 - RNA, 20 nt, Homo sapiens
guucuugcucguguaucuuc

SEQ ID NO: 222514 - RNA, 22 nt, Homo sapiens
guugcaauugauguaugucuga

SEQ ID NO: 222515 - RNA, 22 nt, Homo sapiens
guugcucaggcugaagugcagu

SEQ ID NO: 222516 - RNA, 22 nt, Homo sapiens
guuugcacuccuaugagaaucu

SEQ ID NO: 222517 - RNA, 22 nt, Homo sapiens
guuugccuuuuagauaggaaug

SEQ ID NO: 222518 - RNA, 22 nt, Homo sapiens
guuuggcucuuguuucugucaa

SEQ ID NO: 222519 - RNA, 17 nt, Homo sapiens
guuuggguacuggguaa

SEQ ID NO: 222520 - RNA, 22 nt, Homo sapiens
guuugugcuccuaugagaaccu

SEQ ID NO: 222521 - RNA, 15 nt, Homo sapiens
guuuuuggauacaau

SEQ ID NO: 222522 - RNA, 22 nt, Homo sapiens
guuuuuggggucacuauuaccg

SEQ ID NO: 222523 - RNA, 22 nt, Homo sapiens
uaaacugucuugcaguuacaug

SEQ ID NO: 222524 - RNA, 22 nt, Homo sapiens
uaaagcauguaauuagguuaga

SEQ ID NO: 222525 - RNA, 22 nt, Homo sapiens
uaaagccauugucaaguuugua

SEQ ID NO: 222526 - RNA, 22 nt, Homo sapiens
uaaagcuaucacauuggugauu

SEQ ID NO: 222527 - RNA, 22 nt, Homo sapiens
uaaagcugaaaugauuaugaca

SEQ ID NO: 222528 - RNA, 21 nt, Homo sapiens
uaaagcuuagcuauaguggcu

SEQ ID NO: 222529 - RNA, 22 nt, Homo sapiens
uaaagcuuggauuuaggcuaau

SEQ ID NO: 222530 - RNA, 21 nt, Homo sapiens
uaaaggcuccaauuauacccc

SEQ ID NO: 222531 - RNA, 22 nt, Homo sapiens
uaaagugcugagaugaggcugg

SEQ ID NO: 222532 - RNA, 22 nt, Homo sapiens
uaaaugacugucaguagaugaa

SEQ ID NO: 222533 - RNA, 22 nt, Homo sapiens
uaaaugcucuuuaaaagugcuu

SEQ ID NO: 222534 - RNA, 22 nt, Homo sapiens
uaaaugcuuaauugaaugugga

SEQ ID NO: 222535 - RNA, 22 nt, Homo sapiens
uaaaugcuugagaugauggaua

SEQ ID NO: 222536 - RNA, 22 nt, Homo sapiens
uaacaacauucuaacugacggc

SEQ ID NO: 222537 - RNA, 16 nt, Homo sapiens
uaacacaguucccacc

SEQ ID NO: 222538 - RNA, 22 nt, Homo sapiens
uaacaccuugcucugucaauaa

SEQ ID NO: 222539 - RNA, 21 nt, Homo sapiens
uaacagcuccacuccauucuc

SEQ ID NO: 222540 - RNA, 22 nt, Homo sapiens
uaacaguggucugugguaucug

SEQ ID NO: 222541 - RNA, 23 nt, Homo sapiens
uaacauugcaugauuaccugcau

SEQ ID NO: 222542 - RNA, 22 nt, Homo sapiens
uaacauuguugauuauacuaag

SEQ ID NO: 222543 - RNA, 21 nt, Homo sapiens
uaacccugaaggagcucugga

SEQ ID NO: 222544 - RNA, 22 nt, Homo sapiens
uaacuaguagauggcugacaua

SEQ ID NO: 222545 - RNA, 22 nt, Homo sapiens
uaagaauucuguccgguauacu

SEQ ID NO: 222546 - RNA, 22 nt, Homo sapiens
uaagacacuuaaaauguuacau

SEQ ID NO: 222547 - RNA, 22 nt, Homo sapiens
uaagacucuggacucuaauguu

SEQ ID NO: 222548 - RNA, 22 nt, Homo sapiens
uaagacugccccagacagcaag

SEQ ID NO: 222549 - RNA, 22 nt, Homo sapiens
uaagacuguuggcaauuuuugc

SEQ ID NO: 222550 - RNA, 22 nt, Homo sapiens
uaagagagcuccaucuuuuccu

SEQ ID NO: 222551 - RNA, 22 nt, Homo sapiens
uaagcagugcaagaauggaaua

SEQ ID NO: 222552 - RNA, 20 nt, Homo sapiens
uaagcauaguugucaggguc

SEQ ID NO: 222553 - RNA, 22 nt, Homo sapiens
uaagccaccgugccuggccuaa

SEQ ID NO: 222554 - RNA, 22 nt, Homo sapiens
uaaggcacccuucugaguagag

SEQ ID NO: 222555 - RNA, 18 nt, Homo sapiens
uaaggcacuauaggcauu

SEQ ID NO: 222556 - RNA, 22 nt, Homo sapiens
uaaggcacucuucugugugccu

SEQ ID NO: 222557 - RNA, 20 nt, Homo sapiens
uaaggcacugugcuuuuagg

SEQ ID NO: 222558 - RNA, 22 nt, Homo sapiens
uaaggcccgugaguuucauauc

SEQ ID NO: 222559 - RNA, 22 nt, Homo sapiens
uaaggcuucuuggaauacugca

SEQ ID NO: 222560 - RNA, 22 nt, Homo sapiens
uaagggacauguguugccuaag

SEQ ID NO: 222561 - RNA, 22 nt, Homo sapiens
uaaguaauugugguuucugcca

SEQ ID NO: 222562 - RNA, 22 nt, Homo sapiens
uaaguaauuguuaauagggaag

SEQ ID NO: 222563 - RNA, 22 nt, Homo sapiens
uaaguauuaugugcugcauuuu

SEQ ID NO: 222564 - RNA, 23 nt, Homo sapiens
uaagucacacagauuaauuuauu

SEQ ID NO: 222565 - RNA, 22 nt, Homo sapiens
uaagucuuuuuggaguuuauaa

SEQ ID NO: 222566 - RNA, 22 nt, Homo sapiens
uaagugaauguuggcuacugaa

SEQ ID NO: 222567 - RNA, 22 nt, Homo sapiens
uaagugcuugacuuugauguuu

SEQ ID NO: 222568 - RNA, 20 nt, Homo sapiens
uaagugcuugaugaaugaac

SEQ ID NO: 222569 - RNA, 22 nt, Homo sapiens
uaaguggugcauuguuaaaugg

SEQ ID NO: 222570 - RNA, 22 nt, Homo sapiens
uaaguucauucaugaaacuuag

SEQ ID NO: 222571 - RNA, 18 nt, Homo sapiens
uaauaacugugaccuuga

SEQ ID NO: 222572 - RNA, 22 nt, Homo sapiens
uaauacauucaaggugguaguu

SEQ ID NO: 222573 - RNA, 22 nt, Homo sapiens
uaauauguauacagacagauac

SEQ ID NO: 222574 - RNA, 22 nt, Homo sapiens
uaauauguuuugaaaucaggaa

SEQ ID NO: 222575 - RNA, 22 nt, Homo sapiens
uaaucucagcuacucaggaggc

SEQ ID NO: 222576 - RNA, 22 nt, Homo sapiens
uaaugcacuuuccuccaaggcu

SEQ ID NO: 222577 - RNA, 22 nt, Homo sapiens
uaaugcaucagugguaguucuu

SEQ ID NO: 222578 - RNA, 22 nt, Homo sapiens
uaaugcauguaaugggcugaua

SEQ ID NO: 222579 - RNA, 22 nt, Homo sapiens
uaaugcuccauggguuauuaaa

SEQ ID NO: 222580 - RNA, 22 nt, Homo sapiens
uaaugcuguggucuaaugggga

SEQ ID NO: 222581 - RNA, 22 nt, Homo sapiens
uaaugguuuugcaccaucccuc

SEQ ID NO: 222582 - RNA, 22 nt, Homo sapiens
uaauucacauaaagcacuuaga

SEQ ID NO: 222583 - RNA, 22 nt, Homo sapiens
uaauucugacaacaguggcguu

SEQ ID NO: 222584 - RNA, 22 nt, Homo sapiens
uacaaagcuacucgagggcagg

SEQ ID NO: 222585 - RNA, 22 nt, Homo sapiens
uacaaagcuuugaugugucuuu

SEQ ID NO: 222586 - RNA, 16 nt, Homo sapiens
uacaacagugaguaug

SEQ ID NO: 222587 - RNA, 22 nt, Homo sapiens
uacaagcacaggcagcaggcug

SEQ ID NO: 222588 - RNA, 22 nt, Homo sapiens
uacaaguaauaagggaagaauu

SEQ ID NO: 222589 - RNA, 22 nt, Homo sapiens
uacaaguauuuuuauuagugcc

SEQ ID NO: 222590 - RNA, 22 nt, Homo sapiens
uacaauagugacaaaucagcau

SEQ ID NO: 222591 - RNA, 22 nt, Homo sapiens
uacacacguguguauauauaca

SEQ ID NO: 222592 - RNA, 22 nt, Homo sapiens
uacacaugugaguucuuuucua

SEQ ID NO: 222593 - RNA, 22 nt, Homo sapiens
ugucauguagaaauuguccauu

SEQ ID NO: 222594 - RNA, 22 nt, Homo sapiens
ugucaugucuuuguguaucaau

SEQ ID NO: 222595 - RNA, 22 nt, Homo sapiens
ugucauguugguguacugcacc

SEQ ID NO: 222596 - RNA, 22 nt, Homo sapiens
ugucauuggacuucuuucaugg

SEQ ID NO: 222597 - RNA, 22 nt, Homo sapiens
uguccaaauugaaucaucuggu

SEQ ID NO: 222598 - RNA, 20 nt, Homo sapiens
ugucccaaccccauggguuc

SEQ ID NO: 222599 - RNA, 19 nt, Homo sapiens
ugucccagccauagaggca

SEQ ID NO: 222600 - RNA, 22 nt, Homo sapiens
uguccuguaggaggcagaacaa

SEQ ID NO: 222601 - RNA, 22 nt, Homo sapiens
ugucuagaucugaauguaauug

SEQ ID NO: 222602 - RNA, 22 nt, Homo sapiens
ugucuaguuuugaaguauagca

SEQ ID NO: 222603 - RNA, 22 nt, Homo sapiens
ugucuggaaggguggccuccug

SEQ ID NO: 222604 - RNA, 22 nt, Homo sapiens
ugucuuggagaauccuggguuu

SEQ ID NO: 222605 - RNA, 21 nt, Homo sapiens
ugucuuggagccagacgccag

SEQ ID NO: 222606 - RNA, 22 nt, Homo sapiens
ugugaaacauggauagaacugg

SEQ ID NO: 222607 - RNA, 22 nt, Homo sapiens
ugugaaaucagauagccuuuuu

SEQ ID NO: 222608 - RNA, 21 nt, Homo sapiens
ugugaaaucuaggcagagguu

SEQ ID NO: 222609 - RNA, 22 nt, Homo sapiens
ugugaacacagaggcuauggca

SEQ ID NO: 222610 - RNA, 22 nt, Homo sapiens
ugugaacagaauuagucaccua

SEQ ID NO: 222611 - RNA, 22 nt, Homo sapiens
ugugaacagcuccaaaugugga

SEQ ID NO: 222612 - RNA, 22 nt, Homo sapiens
ugugaagaaagucauugguagc

SEQ ID NO: 222613 - RNA, 22 nt, Homo sapiens
ugugaagauggacuaauauagu

SEQ ID NO: 222614 - RNA, 22 nt, Homo sapiens
ugugaaugauggagugucgaau

SEQ ID NO: 222615 - RNA, 22 nt, Homo sapiens
ugugaauggugcugccgugaag

SEQ ID NO: 222616 - RNA, 22 nt, Homo sapiens
ugugacaaauuuaguggacugu

SEQ ID NO: 222617 - RNA, 22 nt, Homo sapiens
ugugacacugaauggcagaacu

SEQ ID NO: 222618 - RNA, 23 nt, Homo sapiens
ugugacacuuccgucaguucauu

SEQ ID NO: 222619 - RNA, 22 nt, Homo sapiens
ugugacagcacgguucaacugc

SEQ ID NO: 222620 - RNA, 22 nt, Homo sapiens
ugugacagguauccuguguucu

SEQ ID NO: 222621 - RNA, 22 nt, Homo sapiens
ugugacaguguuacauuucaug

SEQ ID NO: 222622 - RNA, 18 nt, Homo sapiens
ugugacauugagcauguc

SEQ ID NO: 222623 - RNA, 21 nt, Homo sapiens
ugugaccucugucucugaguc

SEQ ID NO: 222624 - RNA, 22 nt, Homo sapiens
ugugacuaguggugaaugacgc

SEQ ID NO: 222625 - RNA, 22 nt, Homo sapiens
ugugacugguugucccacuuuc

SEQ ID NO: 222626 - RNA, 22 nt, Homo sapiens
ugugagaaaugcagaaucucag

SEQ ID NO: 222627 - RNA, 22 nt, Homo sapiens
ugugauagagaaugguggagaa

SEQ ID NO: 222628 - RNA, 22 nt, Homo sapiens
ugugaugcagggccugggccuc

SEQ ID NO: 222629 - RNA, 22 nt, Homo sapiens
ugugauggaguuucauggacug

SEQ ID NO: 222630 - RNA, 22 nt, Homo sapiens
ugugauguggagggcagaucca

SEQ ID NO: 222631 - RNA, 22 nt, Homo sapiens
ugugcaaauguuaaacuaacuu

SEQ ID NO: 222632 - RNA, 22 nt, Homo sapiens
ugugcaaggcucucaaccugug

SEQ ID NO: 222633 - RNA, 22 nt, Homo sapiens
ugugcaauucgauggagcucau

SEQ ID NO: 222634 - RNA, 22 nt, Homo sapiens
ugugcacaacaugcagguuugu

SEQ ID NO: 222635 - RNA, 22 nt, Homo sapiens
ugugcacaacgugcagguuugu

SEQ ID NO: 222636 - RNA, 23 nt, Homo sapiens
ugugcacauuuacauauauacac

SEQ ID NO: 222637 - RNA, 22 nt, Homo sapiens
ugugcacuggaccuugucuucu

SEQ ID NO: 222638 - RNA, 22 nt, Homo sapiens
ugugcaguuuuagcguauuuua

SEQ ID NO: 222639 - RNA, 22 nt, Homo sapiens
ugugccacuccaaccuggguga

SEQ ID NO: 222640 - RNA, 22 nt, Homo sapiens
ugugccacuccaggaggcuguu

SEQ ID NO: 222641 - RNA, 22 nt, Homo sapiens
ugugccacugcacucuggccug

SEQ ID NO: 222642 - RNA, 22 nt, Homo sapiens
ugugccugagguuaacauuguu

SEQ ID NO: 222643 - RNA, 22 nt, Homo sapiens
ugugccuucuaagaaggagucu

SEQ ID NO: 222644 - RNA, 22 nt, Homo sapiens
ugugcguguaagagaucuaggu

SEQ ID NO: 222645 - RNA, 22 nt, Homo sapiens
ugugcuaaaaugggacuucuaa

SEQ ID NO: 222646 - RNA, 22 nt, Homo sapiens
ugugcugaucgggcacgguguc

SEQ ID NO: 222647 - RNA, 22 nt, Homo sapiens
uguggcaaagucuugugaauau

SEQ ID NO: 222648 - RNA, 21 nt, Homo sapiens
uguggcaauggccucacagau

SEQ ID NO: 222649 - RNA, 22 nt, Homo sapiens
uguggcauuuucagaaaggaug

SEQ ID NO: 222650 - RNA, 22 nt, Homo sapiens
uguggccuuuguuucaguuggg

SEQ ID NO: 222651 - RNA, 22 nt, Homo sapiens
ugugggugguaaaauacaauga

SEQ ID NO: 222652 - RNA, 22 nt, Homo sapiens
ugugguagugcuuaccugcagu

SEQ ID NO: 222653 - RNA, 22 nt, Homo sapiens
ugugguuuuauaaacgugaccu

SEQ ID NO: 222654 - RNA, 22 nt, Homo sapiens
ugugguuuuuuucuccaauagg

SEQ ID NO: 222655 - RNA, 22 nt, Homo sapiens
uguguaaauauauacacacgug

SEQ ID NO: 222656 - RNA, 22 nt, Homo sapiens
uguguaaauaugauagaggaau

SEQ ID NO: 222657 - RNA, 22 nt, Homo sapiens
uguguaauacucuaaugaugca

SEQ ID NO: 222658 - RNA, 22 nt, Homo sapiens
ugugucacugcacuccagcgug

SEQ ID NO: 222659 - RNA, 22 nt, Homo sapiens
uguguuugauaaguccauaguu

SEQ ID NO: 222660 - RNA, 21 nt, Homo sapiens
uguuaacaugcagauuacugg

SEQ ID NO: 222661 - RNA, 22 nt, Homo sapiens
uguuaacauggucucagucugu

SEQ ID NO: 222662 - RNA, 22 nt, Homo sapiens
uguuaagaugucaauuuuccac

SEQ ID NO: 222663 - RNA, 22 nt, Homo sapiens
uguuaagauguguuuuguggcu

SEQ ID NO: 222664 - RNA, 22 nt, Homo sapiens
uguuacagcagaauugaaagag

SEQ ID NO: 222665 - RNA, 22 nt, Homo sapiens
uguucuggagaggcaggccaca

SEQ ID NO: 222666 - RNA, 22 nt, Homo sapiens
uguucuugaguugggaguacaa

SEQ ID NO: 222667 - RNA, 22 nt, Homo sapiens
uguugcacuccagccuggguga

SEQ ID NO: 222668 - RNA, 19 nt, Homo sapiens
uguugcacuccagcuuggg

SEQ ID NO: 222669 - RNA, 22 nt, Homo sapiens
uguuuguuugagauggagucuc

SEQ ID NO: 222670 - RNA, 22 nt, Homo sapiens
uguuuuggaggccagaagucca

SEQ ID NO: 222671 - RNA, 22 nt, Homo sapiens
uuaaacucaucacccagguagu

SEQ ID NO: 222672 - RNA, 22 nt, Homo sapiens
uuaaagcuggcguuacaguuug

SEQ ID NO: 222673 - RNA, 22 nt, Homo sapiens
uuaaaguaauugaaauggccuu

SEQ ID NO: 222674 - RNA, 22 nt, Homo sapiens
uuaaagugaucauaaggauagu

SEQ ID NO: 222675 - RNA, 22 nt, Homo sapiens
uuaaaugcacauacuugagaaa

SEQ ID NO: 222676 - RNA, 22 nt, Homo sapiens
uuaacacugccauugauacugu

SEQ ID NO: 222677 - RNA, 22 nt, Homo sapiens
uuaacagcacaugcugucccuu

SEQ ID NO: 222678 - RNA, 22 nt, Homo sapiens
uuaagaagugauuuuccucauu

SEQ ID NO: 222679 - RNA, 22 nt, Homo sapiens
uuaagcaaagguaacaugagaa

SEQ ID NO: 222680 - RNA, 22 nt, Homo sapiens
uuaagcaguaguuaaggagagg

SEQ ID NO: 222681 - RNA, 22 nt, Homo sapiens
uuaaggaaggagucuuaaaugg

SEQ ID NO: 222682 - RNA, 18 nt, Homo sapiens
uuaaggcaggacuuuaag

SEQ ID NO: 222683 - RNA, 22 nt, Homo sapiens
uuaaggcagugucuaugccagu

SEQ ID NO: 222684 - RNA, 22 nt, Homo sapiens
uuaaggcuuguacuuguuuucu

SEQ ID NO: 222685 - RNA, 22 nt, Homo sapiens
uuaagguuuuuguagcaaggau

SEQ ID NO: 222686 - RNA, 22 nt, Homo sapiens
uuaaguacuucccuguuggaca

SEQ ID NO: 222687 - RNA, 22 nt, Homo sapiens
uuaaguagaugaaugugaaugu

SEQ ID NO: 222688 - RNA, 22 nt, Homo sapiens
uuaagugaauuaucuaacaugu

SEQ ID NO: 222689 - RNA, 22 nt, Homo sapiens
uggacaagauagguucuauauu

SEQ ID NO: 222690 - RNA, 22 nt, Homo sapiens
uggacaagugcccuccaccuca

SEQ ID NO: 222691 - RNA, 18 nt, Homo sapiens
uggacagugauuauccau

SEQ ID NO: 222692 - RNA, 22 nt, Homo sapiens
uggacauguacauauguguaug

SEQ ID NO: 222693 - RNA, 21 nt, Homo sapiens
uggaccccuuccuugcaccau

SEQ ID NO: 222694 - RNA, 22 nt, Homo sapiens
uggacuagagggugggcgaggu

SEQ ID NO: 222695 - RNA, 22 nt, Homo sapiens
uggacugagauuucagcugcca

SEQ ID NO: 222696 - RNA, 22 nt, Homo sapiens
uggacuguaauuuuauaggcau

SEQ ID NO: 222697 - RNA, 22 nt, Homo sapiens
uggacuuuaauaaaagggaaau

SEQ ID NO: 222698 - RNA, 22 nt, Homo sapiens
uggagaacugaugucuccaaga

SEQ ID NO: 222699 - RNA, 22 nt, Homo sapiens
uggagagcaaaaucaauccaaa

SEQ ID NO: 222700 - RNA, 22 nt, Homo sapiens
uggagauguuuaaaauccacug

SEQ ID NO: 222701 - RNA, 23 nt, Homo sapiens
uggaggacaagcauggauaguga

SEQ ID NO: 222702 - RNA, 22 nt, Homo sapiens
uggagggcuagucauuucuuuu

SEQ ID NO: 222703 - RNA, 22 nt, Homo sapiens
uggagguagagaugggaucucc

SEQ ID NO: 222704 - RNA, 22 nt, Homo sapiens
uggagucuugaugauuuucaaa

SEQ ID NO: 222705 - RNA, 22 nt, Homo sapiens
uggagugaaaacacacuaaucu

SEQ ID NO: 222706 - RNA, 21 nt, Homo sapiens
uggagugaagaguuuauugac

SEQ ID NO: 222707 - RNA, 22 nt, Homo sapiens
uggagugagaacuucaaugaug

SEQ ID NO: 222708 - RNA, 22 nt, Homo sapiens
uggagugauaugguuauauggg

SEQ ID NO: 222709 - RNA, 22 nt, Homo sapiens
uggaguguaaauuaguucagcc

SEQ ID NO: 222710 - RNA, 22 nt, Homo sapiens
uggaguguagaagccagccucc

SEQ ID NO: 222711 - RNA, 22 nt, Homo sapiens
uggaguguuggggcaggaucuc

SEQ ID NO: 222712 - RNA, 16 nt, Homo sapiens
uggaguguuuguuaga

SEQ ID NO: 222713 - RNA, 20 nt, Homo sapiens
uggaguuguggcaguuugga

SEQ ID NO: 222714 - RNA, 22 nt, Homo sapiens
uggauagauacuauccaggacu

SEQ ID NO: 222715 - RNA, 22 nt, Homo sapiens
uggauaguuuacugaagagugg

SEQ ID NO: 222716 - RNA, 22 nt, Homo sapiens
uggauauguuuauuacccugaa

SEQ ID NO: 222717 - RNA, 22 nt, Homo sapiens
uggauccaucacgccucuuccc

SEQ ID NO: 222718 - RNA, 22 nt, Homo sapiens
uggaugacuguuauaugcauau

SEQ ID NO: 222719 - RNA, 22 nt, Homo sapiens
uggaugccuaauaaaugcagac

SEQ ID NO: 222720 - RNA, 22 nt, Homo sapiens
uggauggucagaggguuucugu

SEQ ID NO: 222721 - RNA, 19 nt, Homo sapiens
uggauuguuagagcagugu

SEQ ID NO: 222722 - RNA, 22 nt, Homo sapiens
uggcaaaaaaacgcaauuacgu

SEQ ID NO: 222723 - RNA, 22 nt, Homo sapiens
uggcaaaauauuuugguuucug

SEQ ID NO: 222724 - RNA, 22 nt, Homo sapiens
uggcaaaauggaauauguuggg

SEQ ID NO: 222725 - RNA, 22 nt, Homo sapiens
uggcaaaucagaggcauggaca

SEQ ID NO: 222726 - RNA, 22 nt, Homo sapiens
uggcaaaugaagucagcuguac

SEQ ID NO: 222727 - RNA, 22 nt, Homo sapiens
uggcaacuugcaaccucauucu

SEQ ID NO: 222728 - RNA, 22 nt, Homo sapiens
uggcaagaaggauuuauuccuu

SEQ ID NO: 222729 - RNA, 22 nt, Homo sapiens
uggcaagaucacaauuacuuuu

SEQ ID NO: 222730 - RNA, 23 nt, Homo sapiens
uggcaagauuuguauugccugga

SEQ ID NO: 222731 - RNA, 22 nt, Homo sapiens
uggcaagcaggacuaaagcacc

SEQ ID NO: 222732 - RNA, 18 nt, Homo sapiens
uggcaaguuuaguagcac

SEQ ID NO: 222733 - RNA, 22 nt, Homo sapiens
uggcaauaaaaugcaguuacuu

SEQ ID NO: 222734 - RNA, 22 nt, Homo sapiens
uggcaauaaggacuccuuaggu

SEQ ID NO: 222735 - RNA, 19 nt, Homo sapiens
uggcacauguauacuuaug

SEQ ID NO: 222736 - RNA, 22 nt, Homo sapiens
uggcagauagaaaugugguuaa

SEQ ID NO: 222737 - RNA, 22 nt, Homo sapiens
uggcagcgugaaagacuuuuuc

SEQ ID NO: 222738 - RNA, 22 nt, Homo sapiens
uggcaguuuacagcuuuaggag

SEQ ID NO: 222739 - RNA, 22 nt, Homo sapiens
uggcaguuuuaugugguucaac

SEQ ID NO: 222740 - RNA, 22 nt, Homo sapiens
uggcaguuuuugccuucaauac

SEQ ID NO: 222741 - RNA, 22 nt, Homo sapiens
uggcauauaauauagaagacua

SEQ ID NO: 222742 - RNA, 22 nt, Homo sapiens
uggcaucuguucuacacauaaa

SEQ ID NO: 222743 - RNA, 20 nt, Homo sapiens
uggcaugaaauuuuccaagc

SEQ ID NO: 222744 - RNA, 22 nt, Homo sapiens
uggcaugauauauauucguuug

SEQ ID NO: 222745 - RNA, 22 nt, Homo sapiens
uggcauggaguggauggcccca

SEQ ID NO: 222746 - RNA, 22 nt, Homo sapiens
uggcauguagucugggaccugg

SEQ ID NO: 222747 - RNA, 18 nt, Homo sapiens
auuuuugcaguccacaug

SEQ ID NO: 222748 - RNA, 22 nt, Homo sapiens
caaagcuauagcaccagaggga

SEQ ID NO: 222749 - RNA, 22 nt, Homo sapiens
caaaggcuguuauaggccagga

SEQ ID NO: 222750 - RNA, 22 nt, Homo sapiens
caaaguaauuacgguuuuggcc

SEQ ID NO: 222751 - RNA, 22 nt, Homo sapiens
caaaguaauugcuguuuugcca

SEQ ID NO: 222752 - RNA, 22 nt, Homo sapiens
caaagucuauucuacccuuacc

SEQ ID NO: 222753 - RNA, 22 nt, Homo sapiens
caaauacuuucauguugucuug

SEQ ID NO: 222754 - RNA, 22 nt, Homo sapiens
caaaugcuucuauggacugucu

SEQ ID NO: 222755 - RNA, 22 nt, Homo sapiens
caaauugcuuguggaggauaau

SEQ ID NO: 222756 - RNA, 22 nt, Homo sapiens
caacagucagcccauccacaga

SEQ ID NO: 222757 - RNA, 19 nt, Homo sapiens
caacccugcagagaaagga

SEQ ID NO: 222758 - RNA, 22 nt, Homo sapiens
caacucuguaggauccaggugg

SEQ ID NO: 222759 - RNA, 22 nt, Homo sapiens
caacugguuuuauacaguuuag

SEQ ID NO: 222760 - RNA, 22 nt, Homo sapiens
augugcaaagcacuguucagca

SEQ ID NO: 222761 - RNA, 22 nt, Homo sapiens
augugcaauggugucaccacau

SEQ ID NO: 222762 - RNA, 22 nt, Homo sapiens
augugcaauguguacguagccc

SEQ ID NO: 222763 - RNA, 22 nt, Homo sapiens
augugcacaugcuuacauguga

SEQ ID NO: 222764 - RNA, 20 nt, Homo sapiens
augugcaguguggcaaccaa

SEQ ID NO: 222765 - RNA, 20 nt, Homo sapiens
augugcuaauauuaauaugu

SEQ ID NO: 222766 - RNA, 22 nt, Homo sapiens
augugggaggacuuggcuguug

SEQ ID NO: 222767 - RNA, 22 nt, Homo sapiens
auguggugguagccaggacagg

SEQ ID NO: 222768 - RNA, 19 nt, Homo sapiens
augugguuagcaugacugc

SEQ ID NO: 222769 - RNA, 23 nt, Homo sapiens
augugguuuuagguguugaacug

SEQ ID NO: 222770 - RNA, 22 nt, Homo sapiens
auguguaaagcuuuucuuuguu

SEQ ID NO: 222771 - RNA, 22 nt, Homo sapiens
augugugaaucccagaaccugu

SEQ ID NO: 222772 - RNA, 22 nt, Homo sapiens
augugugcuugauguaaaaagu

SEQ ID NO: 222773 - RNA, 20 nt, Homo sapiens
auguucuggaggacagaagc

SEQ ID NO: 222774 - RNA, 22 nt, Homo sapiens
auguuuagagagggugucaaau

SEQ ID NO: 222775 - RNA, 22 nt, Homo sapiens
auguuugguaagaauauuguua

SEQ ID NO: 222776 - RNA, 22 nt, Homo sapiens
auguuugguagugaauauggua

SEQ ID NO: 222777 - RNA, 22 nt, Homo sapiens
auuaagugaaugaaguuguucc

SEQ ID NO: 222778 - RNA, 22 nt, Homo sapiens
auuaauguaauuaguaaaguug

SEQ ID NO: 222779 - RNA, 22 nt, Homo sapiens
auuagguuguugcaaaaguaau

SEQ ID NO: 222780 - RNA, 22 nt, Homo sapiens
auuauauguguaugugcauacc

SEQ ID NO: 222781 - RNA, 22 nt, Homo sapiens
auucaacuaauuauugaagaug

SEQ ID NO: 222782 - RNA, 23 nt, Homo sapiens
auucaaguagugagagugguuau

SEQ ID NO: 222783 - RNA, 20 nt, Homo sapiens
auucaaguaugccuugagaa

SEQ ID NO: 222784 - RNA, 22 nt, Homo sapiens
auucauagugcuaagguguauc

SEQ ID NO: 222785 - RNA, 20 nt, Homo sapiens
auucauggugguacguuguc

SEQ ID NO: 222786 - RNA, 22 nt, Homo sapiens
auuccacuuauaugagguaucu

SEQ ID NO: 222787 - RNA, 22 nt, Homo sapiens
auuccacuuccacuaguuucuc

SEQ ID NO: 222788 - RNA, 21 nt, Homo sapiens
auuccacuuuuccuucaggga

SEQ ID NO: 222789 - RNA, 18 nt, Homo sapiens
auucuacaggccuuuuga

SEQ ID NO: 222790 - RNA, 22 nt, Homo sapiens
auugaacacagaguagcuuucc

SEQ ID NO: 222791 - RNA, 20 nt, Homo sapiens
auugaacucaguauucugaa

SEQ ID NO: 222792 - RNA, 22 nt, Homo sapiens
auugaacuuuugucacugacau

SEQ ID NO: 222793 - RNA, 22 nt, Homo sapiens
auugacacugauuuuucuuuaa

SEQ ID NO: 222794 - RNA, 22 nt, Homo sapiens
auugagucauuucaaauccaag

SEQ ID NO: 222795 - RNA, 22 nt, Homo sapiens
auugauagaucauaugguaggu

SEQ ID NO: 222796 - RNA, 22 nt, Homo sapiens
auugcaaugggaaacuaugaaa

SEQ ID NO: 222797 - RNA, 19 nt, Homo sapiens
auugcacuccaaccugggu

SEQ ID NO: 222798 - RNA, 22 nt, Homo sapiens
auugcacuccagccuagguaac

SEQ ID NO: 222799 - RNA, 22 nt, Homo sapiens
auugcacuccagccuagucaac

SEQ ID NO: 222800 - RNA, 22 nt, Homo sapiens
auugcacuccagccucggugac

SEQ ID NO: 222801 - RNA, 22 nt, Homo sapiens
auugcacuccagccugagcaaa

SEQ ID NO: 222802 - RNA, 22 nt, Homo sapiens
auugcacuccagccugcggaac

SEQ ID NO: 222803 - RNA, 22 nt, Homo sapiens
auugcacuccagccugggcgac

SEQ ID NO: 222804 - RNA, 22 nt, Homo sapiens
auugcacuccagccuggugaca

SEQ ID NO: 222805 - RNA, 22 nt, Homo sapiens
auugcacuccagccuugacaca

SEQ ID NO: 222806 - RNA, 22 nt, Homo sapiens
auugcacuccagucucaccagg

SEQ ID NO: 222807 - RNA, 22 nt, Homo sapiens
auugcacuccauccugggcaau

SEQ ID NO: 222808 - RNA, 22 nt, Homo sapiens
auugcacuccggccugggugac

SEQ ID NO: 222809 - RNA, 22 nt, Homo sapiens
auugcacucuagccugggugac

SEQ ID NO: 222810 - RNA, 23 nt, Homo sapiens
auugcagucuugaacuccugggc

SEQ ID NO: 222811 - RNA, 22 nt, Homo sapiens
auugcauaaacacauuucuuau

SEQ ID NO: 222812 - RNA, 22 nt, Homo sapiens
auugcauugugaucuucccaga

SEQ ID NO: 222813 - RNA, 21 nt, Homo sapiens
auugcccaaaguggaggggaa

SEQ ID NO: 222814 - RNA, 22 nt, Homo sapiens
auugccuagccuggucucaaaa

SEQ ID NO: 222815 - RNA, 22 nt, Homo sapiens
auugccucaauuccaagacugc

SEQ ID NO: 222816 - RNA, 22 nt, Homo sapiens
auugcuauuauuugaccauugu

SEQ ID NO: 222817 - RNA, 22 nt, Homo sapiens
auugcucagucagggagcucgg

SEQ ID NO: 222818 - RNA, 22 nt, Homo sapiens
auugcucuuagaaauauuucuu

SEQ ID NO: 222819 - RNA, 22 nt, Homo sapiens
auugcuucugauuuuaaaugag

SEQ ID NO: 222820 - RNA, 22 nt, Homo sapiens
auugcuuuuacugggagcuuug

SEQ ID NO: 222821 - RNA, 22 nt, Homo sapiens
auuggaacugaaauaauaacuu

SEQ ID NO: 222822 - RNA, 22 nt, Homo sapiens
auuggcaagauagcauaugagg

SEQ ID NO: 222823 - RNA, 22 nt, Homo sapiens
auuggcaauccauauauuuucu

SEQ ID NO: 222824 - RNA, 22 nt, Homo sapiens
auuggggaaugguggcuuuagu

SEQ ID NO: 222825 - RNA, 22 nt, Homo sapiens
auuggguuaaaggauaugaaca

SEQ ID NO: 222826 - RNA, 22 nt, Homo sapiens
auuggugaccugcggcaguaug

SEQ ID NO: 222827 - RNA, 18 nt, Homo sapiens
auuguaagauguauggga

SEQ ID NO: 222828 - RNA, 22 nt, Homo sapiens
auuguaauuuuagagaaagugg

SEQ ID NO: 222829 - RNA, 22 nt, Homo sapiens
auuguaccccaauguacaauau

SEQ ID NO: 222830 - RNA, 22 nt, Homo sapiens
auuguacuccagccugggcagc

SEQ ID NO: 222831 - RNA, 22 nt, Homo sapiens
auuguacuccagccugggcuaa

SEQ ID NO: 222832 - RNA, 22 nt, Homo sapiens
auuguacuccagccugggcugc

SEQ ID NO: 222833 - RNA, 22 nt, Homo sapiens
auuguaguacauuuggugguca

SEQ ID NO: 222834 - RNA, 22 nt, Homo sapiens
auugugcuaaaguaauaaguca

SEQ ID NO: 222835 - RNA, 22 nt, Homo sapiens
auuguguagucuuacugcuugc

SEQ ID NO: 222836 - RNA, 22 nt, Homo sapiens
auugugucuuguagagagauau

SEQ ID NO: 222837 - RNA, 22 nt, Homo sapiens
auuguguuugaaugaggcucca

SEQ ID NO: 222838 - RNA, 22 nt, Homo sapiens
auuuaugguuaauauaggaagu

SEQ ID NO: 222839 - RNA, 22 nt, Homo sapiens
auuucuacuccuguguccagaa

SEQ ID NO: 222840 - RNA, 21 nt, Homo sapiens
auuugcacugagcuccugugc

SEQ ID NO: 222841 - RNA, 22 nt, Homo sapiens
auuuggcaacguagggaggcau

SEQ ID NO: 222842 - RNA, 22 nt, Homo sapiens
auuuggcaauuuugaagaugcc

SEQ ID NO: 222843 - RNA, 22 nt, Homo sapiens
auuugguguuguuuggagccua

SEQ ID NO: 222844 - RNA, 22 nt, Homo sapiens
auuugguuauucaguuguucag

SEQ ID NO: 222845 - RNA, 22 nt, Homo sapiens
auuuguccugccuuuuccuccu

SEQ ID NO: 222846 - RNA, 22 nt, Homo sapiens
accaguagaaucaguggauucu

SEQ ID NO: 222847 - RNA, 22 nt, Homo sapiens
accagucucagguaugucuuua

SEQ ID NO: 222848 - RNA, 22 nt, Homo sapiens
accauugcacuccagccugggc

SEQ ID NO: 222849 - RNA, 22 nt, Homo sapiens
acccagaagucauucaggaaca

SEQ ID NO: 222850 - RNA, 22 nt, Homo sapiens
acccaguagccagauguagcug

SEQ ID NO: 222851 - RNA, 17 nt, Homo sapiens
acccagucuuuuugcac

SEQ ID NO: 222852 - RNA, 22 nt, Homo sapiens
acccaguguugggcagaacugu

SEQ ID NO: 222853 - RNA, 22 nt, Homo sapiens
acccgggaggcaggagucauag

SEQ ID NO: 222854 - RNA, 22 nt, Homo sapiens
acccgugcucacugccucugcc

SEQ ID NO: 222855 - RNA, 22 nt, Homo sapiens
acccucaagggacugacagaau

SEQ ID NO: 222856 - RNA, 22 nt, Homo sapiens
acccucagaccaguuucccugg

SEQ ID NO: 222857 - RNA, 22 nt, Homo sapiens
acccugaagccaugaguggaac

SEQ ID NO: 222858 - RNA, 22 nt, Homo sapiens
acccuggaggucuacagugcag

SEQ ID NO: 222859 - RNA, 22 nt, Homo sapiens
acccuggaguaguaggaaucug

SEQ ID NO: 222860 - RNA, 22 nt, Homo sapiens
acccuggauucguggccuugaa

SEQ ID NO: 222861 - RNA, 22 nt, Homo sapiens
acccugucaaaauagaccaauc

SEQ ID NO: 222862 - RNA, 22 nt, Homo sapiens
acccugugaauauuuaaacuuc

SEQ ID NO: 222863 - RNA, 22 nt, Homo sapiens
acccuguugagcaacuggccau

SEQ ID NO: 222864 - RNA, 18 nt, Homo sapiens
acccuucagcacugggcc

SEQ ID NO: 222865 - RNA, 22 nt, Homo sapiens
acccuuuagguuggaugaggau

SEQ ID NO: 222866 - RNA, 22 nt, Homo sapiens
acccuuugucaaucaguacuaa

SEQ ID NO: 222867 - RNA, 22 nt, Homo sapiens
accucagcccggggaaguugag

SEQ ID NO: 222868 - RNA, 22 nt, Homo sapiens
accugagacuaggcauuuuaua

SEQ ID NO: 222869 - RNA, 22 nt, Homo sapiens
accugagauuacaggugcuggc

SEQ ID NO: 222870 - RNA, 22 nt, Homo sapiens
accugggugcugaugggcuuua

SEQ ID NO: 222871 - RNA, 22 nt, Homo sapiens
accuguauaacaagugggaaau

SEQ ID NO: 222872 - RNA, 22 nt, Homo sapiens
accugugguuacagucugucuc

SEQ ID NO: 222873 - RNA, 23 nt, Homo sapiens
accugugguuauuuuacucuucc

SEQ ID NO: 222874 - RNA, 22 nt, Homo sapiens
accuugcacugagccgagauug

SEQ ID NO: 222875 - RNA, 22 nt, Homo sapiens
accuuguaucuguuaggauugc

SEQ ID NO: 222876 - RNA, 22 nt, Homo sapiens
acggcacugguggaaguguagc

SEQ ID NO: 222877 - RNA, 22 nt, Homo sapiens
acgugguaguacaguauuuuaa

SEQ ID NO: 222878 - RNA, 22 nt, Homo sapiens
acuacauaugacaucuucuuua

SEQ ID NO: 222879 - RNA, 22 nt, Homo sapiens
acuacugucagacugccacuga

SEQ ID NO: 222880 - RNA, 22 nt, Homo sapiens
acucacagcaaccuccgccucc

SEQ ID NO: 222881 - RNA, 22 nt, Homo sapiens
acucagagaacauucccagucu

SEQ ID NO: 222882 - RNA, 22 nt, Homo sapiens
acugaauguaaacacggagugu

SEQ ID NO: 222883 - RNA, 22 nt, Homo sapiens
acugacaugaucaggcauguuc

SEQ ID NO: 222884 - RNA, 21 nt, Homo sapiens
acugagagaucuggggcacau

SEQ ID NO: 222885 - RNA, 21 nt, Homo sapiens
acugauguuugaaauucgcug

SEQ ID NO: 222886 - RNA, 21 nt, Homo sapiens
acugcacuccaaccucaacag

SEQ ID NO: 222887 - RNA, 22 nt, Homo sapiens
acugcacuccacccuuggcagc

SEQ ID NO: 222888 - RNA, 22 nt, Homo sapiens
acugcacuccagcccgggugac

SEQ ID NO: 222889 - RNA, 22 nt, Homo sapiens
acugcacuccagccucguggac

SEQ ID NO: 222890 - RNA, 22 nt, Homo sapiens
acugcacuccagccugagccug

SEQ ID NO: 222891 - RNA, 22 nt, Homo sapiens
acugcacuccagccuucgugac

SEQ ID NO: 222892 - RNA, 22 nt, Homo sapiens
acugcacuccagccuuggagac

SEQ ID NO: 222893 - RNA, 22 nt, Homo sapiens
acugcacuccagcuugggugac

SEQ ID NO: 222894 - RNA, 22 nt, Homo sapiens
acugcacuccaguuugggcagc

SEQ ID NO: 222895 - RNA, 22 nt, Homo sapiens
acugcacuccggccuggcaaca

SEQ ID NO: 222896 - RNA, 19 nt, Homo sapiens
acugcacuccuccuugggu

SEQ ID NO: 222897 - RNA, 18 nt, Homo sapiens
acuggaauuaaacuuuuu

SEQ ID NO: 222898 - RNA, 22 nt, Homo sapiens
acuggcauagggcgggcacagu

SEQ ID NO: 222899 - RNA, 22 nt, Homo sapiens
acuggcuguuaggaauuaccuc

SEQ ID NO: 222900 - RNA, 22 nt, Homo sapiens
acuggcuuauuucacuuagcau

SEQ ID NO: 222901 - RNA, 22 nt, Homo sapiens
acuggcuuuugagaaaaacacu

SEQ ID NO: 222902 - RNA, 22 nt, Homo sapiens
acugggauauuauugguaauau

SEQ ID NO: 222903 - RNA, 22 nt, Homo sapiens
acuguacuacagccugggugac

SEQ ID NO: 222904 - RNA, 22 nt, Homo sapiens
acuguguguuugucuagcacag

SEQ ID NO: 222905 - RNA, 22 nt, Homo sapiens
acuuauuguggcugacccaaac

SEQ ID NO: 222906 - RNA, 21 nt, Homo sapiens
acuuucuguggcaguccauuc

SEQ ID NO: 222907 - RNA, 17 nt, Homo sapiens
acuuuuugaggaggcau

SEQ ID NO: 222908 - RNA, 22 nt, Homo sapiens
acuuuuugcaaccauuuggacc

SEQ ID NO: 222909 - RNA, 22 nt, Homo sapiens
agaaaugcagcaugaggcggca

SEQ ID NO: 222910 - RNA, 23 nt, Homo sapiens
agaaaugucuauucagggucccu

SEQ ID NO: 222911 - RNA, 22 nt, Homo sapiens
agaacccuuugaaauguguuug

SEQ ID NO: 222912 - RNA, 20 nt, Homo sapiens
agaaccuguaguguagaggg

SEQ ID NO: 222913 - RNA, 22 nt, Homo sapiens
agaagaacauagggugacugaa

SEQ ID NO: 222914 - RNA, 20 nt, Homo sapiens
agaagcauugcucucuucag

SEQ ID NO: 222915 - RNA, 22 nt, Homo sapiens
agaauaauguccccccaaggga

SEQ ID NO: 222916 - RNA, 22 nt, Homo sapiens
agaauguaacucuaugaaggca

SEQ ID NO: 222917 - RNA, 22 nt, Homo sapiens
agaauguuuuagaccaauacaa

SEQ ID NO: 222918 - RNA, 22 nt, Homo sapiens
agaauucugucauguuuauauu

SEQ ID NO: 222919 - RNA, 20 nt, Homo sapiens
agacagcugcagcccacauc

SEQ ID NO: 222920 - RNA, 20 nt, Homo sapiens
agacaguguggagauuccuu

SEQ ID NO: 222921 - RNA, 22 nt, Homo sapiens
agacaguguguguauauauggu

SEQ ID NO: 222922 - RNA, 22 nt, Homo sapiens
agacuagagcagagcccucucu

SEQ ID NO: 222923 - RNA, 22 nt, Homo sapiens
agacucauuuuuaucgagcaug

SEQ ID NO: 222924 - RNA, 22 nt, Homo sapiens
agagacauugcuccaacucacc

SEQ ID NO: 222925 - RNA, 19 nt, Homo sapiens
agagacucauuguagcauu

SEQ ID NO: 222926 - RNA, 22 nt, Homo sapiens
agagagcuuuaacuacccauuu

SEQ ID NO: 222927 - RNA, 22 nt, Homo sapiens
agagaucauuuuguuucaaauc

SEQ ID NO: 222928 - RNA, 22 nt, Homo sapiens
agagcaaugacaugcuaugugg

SEQ ID NO: 222929 - RNA, 22 nt, Homo sapiens
agagcaccauuuagcaagguga

SEQ ID NO: 222930 - RNA, 22 nt, Homo sapiens
agagcacugcugcaggguucug

SEQ ID NO: 222931 - RNA, 22 nt, Homo sapiens
agagcauugaguuaaugguuca

SEQ ID NO: 222932 - RNA, 22 nt, Homo sapiens
agagguuuuggggcugagagcu

SEQ ID NO: 222933 - RNA, 22 nt, Homo sapiens
agaguauagcaacuuaguaaaa

SEQ ID NO: 222934 - RNA, 22 nt, Homo sapiens
agagugaagcuuuuuauauucu

SEQ ID NO: 222935 - RNA, 20 nt, Homo sapiens
agagugcuggacugaggagc

SEQ ID NO: 222936 - RNA, 22 nt, Homo sapiens
agauauguuuaguuucaaaaug

SEQ ID NO: 222937 - RNA, 22 nt, Homo sapiens
agaucacucagguuucucccug

SEQ ID NO: 222938 - RNA, 22 nt, Homo sapiens
agaugauguuuacugagcauca

SEQ ID NO: 222939 - RNA, 22 nt, Homo sapiens
agauggauuuuguagccccagc

SEQ ID NO: 222940 - RNA, 22 nt, Homo sapiens
agaugguauuauagguuucugu

SEQ ID NO: 222941 - RNA, 22 nt, Homo sapiens
uuucaguagagacacgguuuug

SEQ ID NO: 222942 - RNA, 22 nt, Homo sapiens
uuucaguguggcaggcauagcu

SEQ ID NO: 222943 - RNA, 22 nt, Homo sapiens
uuucauagaucaugcuuuugga

SEQ ID NO: 222944 - RNA, 16 nt, Homo sapiens
uuucaucaguuuuaau

SEQ ID NO: 222945 - RNA, 22 nt, Homo sapiens
uuucauggaauauagucauuuu

SEQ ID NO: 222946 - RNA, 22 nt, Homo sapiens
uuuccaguuggaagaaggggga

SEQ ID NO: 222947 - RNA, 22 nt, Homo sapiens
uuucccauuguucugcucugug

SEQ ID NO: 222948 - RNA, 19 nt, Homo sapiens
uuucccugcagaccuacua

SEQ ID NO: 222949 - RNA, 21 nt, Homo sapiens
uuuccuggagcguauggcuuc

SEQ ID NO: 222950 - RNA, 22 nt, Homo sapiens
uuucgguuaucuagcuuuauga

SEQ ID NO: 222951 - RNA, 22 nt, Homo sapiens
uuucuacagggcuugccaggua

SEQ ID NO: 222952 - RNA, 15 nt, Homo sapiens
uuucuacugcacuuc

SEQ ID NO: 222953 - RNA, 16 nt, Homo sapiens
uuucuauguuuuacua

SEQ ID NO: 222954 - RNA, 21 nt, Homo sapiens
uuucugggggagcauggcagg

SEQ ID NO: 222955 - RNA, 22 nt, Homo sapiens
uuugaagugugaugccuugaug

SEQ ID NO: 222956 - RNA, 22 nt, Homo sapiens
uuugaauggaaguuuugugaaa

SEQ ID NO: 222957 - RNA, 22 nt, Homo sapiens
uuugacuaccaggaauguucuu

SEQ ID NO: 222958 - RNA, 22 nt, Homo sapiens
uuugacuacugaugguguacgc

SEQ ID NO: 222959 - RNA, 22 nt, Homo sapiens
uuugacucacagccuggcugcc

SEQ ID NO: 222960 - RNA, 22 nt, Homo sapiens
uuugagauaucuuccaucagua

SEQ ID NO: 222961 - RNA, 22 nt, Homo sapiens
uuugagaucuuuagaaucaggc

SEQ ID NO: 222962 - RNA, 22 nt, Homo sapiens
uuugagcaggcuaaucaauaua

SEQ ID NO: 222963 - RNA, 22 nt, Homo sapiens
uuugagcauguaguuuaacccu

SEQ ID NO: 222964 - RNA, 22 nt, Homo sapiens
uuugagcauuagggcaaaggca

SEQ ID NO: 222965 - RNA, 22 nt, Homo sapiens
uuugaguuugaggugcugauga

SEQ ID NO: 222966 - RNA, 22 nt, Homo sapiens
uuugauguugagacuauaaagc

SEQ ID NO: 222967 - RNA, 20 nt, Homo sapiens
uuugcagaaucuaagaagag

SEQ ID NO: 222968 - RNA, 22 nt, Homo sapiens
uuugcaguguaguuggccagca

SEQ ID NO: 222969 - RNA, 19 nt, Homo sapiens
uuugcauagugagaauaua

SEQ ID NO: 222970 - RNA, 22 nt, Homo sapiens
uuugccuuugugauauggucua

SEQ ID NO: 222971 - RNA, 22 nt, Homo sapiens
uuugcugagucugacuucaugg

SEQ ID NO: 222972 - RNA, 22 nt, Homo sapiens
uuuggaaugugcacucagauug

SEQ ID NO: 222973 - RNA, 22 nt, Homo sapiens
uuuggacuucuagccuccagag

SEQ ID NO: 222974 - RNA, 22 nt, Homo sapiens
uuuggcaauaaacuccccuaac

SEQ ID NO: 222975 - RNA, 22 nt, Homo sapiens
uuuggcaauuugacuguauagg

SEQ ID NO: 222976 - RNA, 22 nt, Homo sapiens
uuuggcagaaaacaagaaucug

SEQ ID NO: 222977 - RNA, 22 nt, Homo sapiens
uuuggcauuugaguuuguagga

SEQ ID NO: 222978 - RNA, 22 nt, Homo sapiens
uuuggcucugugucccacccaa

SEQ ID NO: 222979 - RNA, 18 nt, Homo sapiens
uuuggcuguucaugacuc

SEQ ID NO: 222980 - RNA, 22 nt, Homo sapiens
uuuggcuuaagauugacugcaa

SEQ ID NO: 222981 - RNA, 22 nt, Homo sapiens
uuugggccaugcuucccgguca

SEQ ID NO: 222982 - RNA, 22 nt, Homo sapiens
uuugguaauguuucauugcaga

SEQ ID NO: 222983 - RNA, 22 nt, Homo sapiens
uuuggucccaaugugauaaggu

SEQ ID NO: 222984 - RNA, 18 nt, Homo sapiens
uuugguccuuuauaaaca

SEQ ID NO: 222985 - RNA, 22 nt, Homo sapiens
uuugguguauaaaaaugcuagu

SEQ ID NO: 222986 - RNA, 22 nt, Homo sapiens
uuugguugcauucacauauuuc

SEQ ID NO: 222987 - RNA, 22 nt, Homo sapiens
uuuguaagaugcauagauugca

SEQ ID NO: 222988 - RNA, 23 nt, Homo sapiens
uuuguacuaugucaguuuagaua

SEQ ID NO: 222989 - RNA, 22 nt, Homo sapiens
uuuguagcuacaaagugagaug

SEQ ID NO: 222990 - RNA, 21 nt, Homo sapiens
uuuguaguagcaugauuuaua

SEQ ID NO: 222991 - RNA, 23 nt, Homo sapiens
uuuguaguagcaugauuuauaau

SEQ ID NO: 222992 - RNA, 19 nt, Homo sapiens
uuuguauguuuccaguaau

SEQ ID NO: 222993 - RNA, 22 nt, Homo sapiens
uuugucaauaacuaccaacagg

SEQ ID NO: 222994 - RNA, 22 nt, Homo sapiens
uuugucacucuuggagguuguu

SEQ ID NO: 222995 - RNA, 21 nt, Homo sapiens
uuuguccaccuguguucacca

SEQ ID NO: 222996 - RNA, 19 nt, Homo sapiens
uuuguccugcccuuucuca

SEQ ID NO: 222997 - RNA, 22 nt, Homo sapiens
uuugugacuugcuucucagaau

SEQ ID NO: 222998 - RNA, 22 nt, Homo sapiens
uuugugauugcacacucaagau

SEQ ID NO: 222999 - RNA, 22 nt, Homo sapiens
uuugugcaaacuaggauugcga

SEQ ID NO: 223000 - RNA, 22 nt, Homo sapiens
uuugugcaugaagagggggugc

SEQ ID NO: 223001 - RNA, 22 nt, Homo sapiens
uuugugcuaacuuuaacucuua

SEQ ID NO: 223002 - RNA, 22 nt, Homo sapiens
uuugugcuccucucaguaugug

SEQ ID NO: 223003 - RNA, 22 nt, Homo sapiens
uuugugcuccuguugagaaucu

SEQ ID NO: 223004 - RNA, 22 nt, Homo sapiens
uuuguggaaugcccuuauuuau

SEQ ID NO: 223005 - RNA, 22 nt, Homo sapiens
uuugugucccucuaaaauuuau

SEQ ID NO: 223006 - RNA, 16 nt, Homo sapiens
uuugugugugacgaga

SEQ ID NO: 223007 - RNA, 22 nt, Homo sapiens
uuuguucuucguuccugagcca

SEQ ID NO: 223008 - RNA, 22 nt, Homo sapiens
uuuuacacuucgguugugugca

SEQ ID NO: 223009 - RNA, 22 nt, Homo sapiens
uuuuagcaaagagacugguggc

SEQ ID NO: 223010 - RNA, 20 nt, Homo sapiens
uuuuagcuuuuauugaaagc

SEQ ID NO: 223011 - RNA, 22 nt, Homo sapiens
uuuuaguggaauauuuacaguu

SEQ ID NO: 223012 - RNA, 22 nt, Homo sapiens
uuuuaguugcucagguauucuc

SEQ ID NO: 223013 - RNA, 22 nt, Homo sapiens
uuuuauguuuguucccugccaa

SEQ ID NO: 223014 - RNA, 19 nt, Homo sapiens
uuuuccccuuucuuaagac

SEQ ID NO: 223015 - RNA, 21 nt, Homo sapiens
uuuugcacacuaugcagcuuu

SEQ ID NO: 223016 - RNA, 22 nt, Homo sapiens
uuuugcaccauccuaauaguau

SEQ ID NO: 223017 - RNA, 22 nt, Homo sapiens
uuuugcaggucaggggcagaga

SEQ ID NO: 223018 - RNA, 22 nt, Homo sapiens
uuuugcauuggcugaggagugu

SEQ ID NO: 223019 - RNA, 22 nt, Homo sapiens
uuuugcuccuggcaaacucaua

SEQ ID NO: 223020 - RNA, 22 nt, Homo sapiens
uuuugcucuucauagguccugu

SEQ ID NO: 223021 - RNA, 22 nt, Homo sapiens
uuuugcucuucggaagagcuug

SEQ ID NO: 223022 - RNA, 22 nt, Homo sapiens
uuuugcucuugguaaugaaaga

SEQ ID NO: 223023 - RNA, 22 nt, Homo sapiens
uuuuggcuagaaauauaccucc

SEQ ID NO: 223024 - RNA, 22 nt, Homo sapiens
uuuuggcucuugguaggucaga

SEQ ID NO: 223025 - RNA, 22 nt, Homo sapiens
augugcuuauagguguauguuu

SEQ ID NO: 223026 - RNA, 22 nt, Homo sapiens
auguggaaagcagcaugauaug

SEQ ID NO: 223027 - RNA, 22 nt, Homo sapiens
auguggaaauguauaugugucu

SEQ ID NO: 223028 - RNA, 22 nt, Homo sapiens
auguggauaucuauaucuggau

SEQ ID NO: 223029 - RNA, 22 nt, Homo sapiens
augugggaggaauguguuucca

SEQ ID NO: 223030 - RNA, 22 nt, Homo sapiens
augugguaggcccaugagucau

SEQ ID NO: 223031 - RNA, 22 nt, Homo sapiens
augugucaaaucuaggccaaag

SEQ ID NO: 223032 - RNA, 23 nt, Homo sapiens
augugugcuuggagagcaggaug

SEQ ID NO: 223033 - RNA, 22 nt, Homo sapiens
auguuacggaguuuuuauccag

SEQ ID NO: 223034 - RNA, 22 nt, Homo sapiens
auguuguaguaugagucaaaau

SEQ ID NO: 223035 - RNA, 22 nt, Homo sapiens
auuaaggaguggguucauggug

SEQ ID NO: 223036 - RNA, 22 nt, Homo sapiens
auuacauagucaaggugucuca

SEQ ID NO: 223037 - RNA, 22 nt, Homo sapiens
auuacaugucuauccaugaaca

SEQ ID NO: 223038 - RNA, 22 nt, Homo sapiens
auuacccuuagacuccagagug

SEQ ID NO: 223039 - RNA, 20 nt, Homo sapiens
auuagacuugccuuauccuu

SEQ ID NO: 223040 - RNA, 20 nt, Homo sapiens
auuagagcuacauggcuaca

SEQ ID NO: 223041 - RNA, 22 nt, Homo sapiens
auuagguauuuguccuaaauau

SEQ ID NO: 223042 - RNA, 22 nt, Homo sapiens
auuagguuaggcaaacuucugu

SEQ ID NO: 223043 - RNA, 22 nt, Homo sapiens
auuagguuagugcaaaaguaau

SEQ ID NO: 223044 - RNA, 22 nt, Homo sapiens
auuauaugucaucacagacacc

SEQ ID NO: 223045 - RNA, 22 nt, Homo sapiens
auuauguuguauuuccuugcag

SEQ ID NO: 223046 - RNA, 22 nt, Homo sapiens
auuauuagucggccagcuguua

SEQ ID NO: 223047 - RNA, 22 nt, Homo sapiens
auucaaagugcauguucccacu

SEQ ID NO: 223048 - RNA, 22 nt, Homo sapiens
auucaaggagucuucgucccaa

SEQ ID NO: 223049 - RNA, 22 nt, Homo sapiens
auucaagggauuucaggaggcu

SEQ ID NO: 223050 - RNA, 22 nt, Homo sapiens
auucacagcuuuaaaaggcgug

SEQ ID NO: 223051 - RNA, 22 nt, Homo sapiens
auucacagggggagaaggguau

SEQ ID NO: 223052 - RNA, 22 nt, Homo sapiens
auucaccauggaccaggggccu

SEQ ID NO: 223053 - RNA, 22 nt, Homo sapiens
auucacuuuuauagacaggucu

SEQ ID NO: 223054 - RNA, 22 nt, Homo sapiens
auucaucagggauauuggucug

SEQ ID NO: 223055 - RNA, 22 nt, Homo sapiens
auuccacagccgauaccaugac

SEQ ID NO: 223056 - RNA, 22 nt, Homo sapiens
auuccagguggcgccauucaca

SEQ ID NO: 223057 - RNA, 23 nt, Homo sapiens
auuccaguggcaauuggagaaac

SEQ ID NO: 223058 - RNA, 22 nt, Homo sapiens
auuccaguuguaagguuuuuca

SEQ ID NO: 223059 - RNA, 22 nt, Homo sapiens
auuccauagugucuguggcaga

SEQ ID NO: 223060 - RNA, 22 nt, Homo sapiens
auuccuuaggcccuuugguuag

SEQ ID NO: 223061 - RNA, 22 nt, Homo sapiens
auucuauaguccuaggauuggg

SEQ ID NO: 223062 - RNA, 22 nt, Homo sapiens
auucuugcuugaacuuggugca

SEQ ID NO: 223063 - RNA, 22 nt, Homo sapiens
auugaacaugccauauguacca

SEQ ID NO: 223064 - RNA, 22 nt, Homo sapiens
auugaauuugguuugcuaagaa

SEQ ID NO: 223065 - RNA, 21 nt, Homo sapiens
auugagcacaugaaacauggc

SEQ ID NO: 223066 - RNA, 18 nt, Homo sapiens
auugagcaugacagaccu

SEQ ID NO: 223067 - RNA, 22 nt, Homo sapiens
auugcaacaguguugagaggug

SEQ ID NO: 223068 - RNA, 22 nt, Homo sapiens
auugcaauuaguccauagaguu

SEQ ID NO: 223069 - RNA, 21 nt, Homo sapiens
auugcacaauauacccaugua

SEQ ID NO: 223070 - RNA, 22 nt, Homo sapiens
auugcacacagaaucaggguaa

SEQ ID NO: 223071 - RNA, 22 nt, Homo sapiens
auugcacaucugcacuacagcc

SEQ ID NO: 223072 - RNA, 22 nt, Homo sapiens
auugcaccacugcccuccagcc

SEQ ID NO: 223073 - RNA, 22 nt, Homo sapiens
auugcacuccagccccggggac

SEQ ID NO: 223074 - RNA, 22 nt, Homo sapiens
auugcacuccagcccgggugac

SEQ ID NO: 223075 - RNA, 22 nt, Homo sapiens
auugcacuccagccuggccgag

SEQ ID NO: 223076 - RNA, 22 nt, Homo sapiens
auugcacuccagccugggcaac

SEQ ID NO: 223077 - RNA, 22 nt, Homo sapiens
auugcacuccagccugggcagc

SEQ ID NO: 223078 - RNA, 22 nt, Homo sapiens
auugcacuccagccuuggggau

SEQ ID NO: 223079 - RNA, 22 nt, Homo sapiens
auugcacuccagcuugggugac

SEQ ID NO: 223080 - RNA, 22 nt, Homo sapiens
auugcacuccagucugggcaac

SEQ ID NO: 223081 - RNA, 22 nt, Homo sapiens
auugcacucuaaccuaggugac

SEQ ID NO: 223082 - RNA, 23 nt, Homo sapiens
auugcagaaucacagagguagug

SEQ ID NO: 223083 - RNA, 22 nt, Homo sapiens
auugcagauucgcuuuguguug

SEQ ID NO: 223084 - RNA, 22 nt, Homo sapiens
auugcaugucauguuuagugua

SEQ ID NO: 223085 - RNA, 22 nt, Homo sapiens
auugccacaucucagaggcaga

SEQ ID NO: 223086 - RNA, 22 nt, Homo sapiens
auugcccaggcuggagugcagu

SEQ ID NO: 223087 - RNA, 22 nt, Homo sapiens
auugcugagacauugcuaaucu

SEQ ID NO: 223088 - RNA, 22 nt, Homo sapiens
auuggacagcauuucuagacuu

SEQ ID NO: 223089 - RNA, 22 nt, Homo sapiens
auuggaguuguacgcacgcuca

SEQ ID NO: 223090 - RNA, 22 nt, Homo sapiens
auuggcaauggcaaagcagagu

SEQ ID NO: 223091 - RNA, 22 nt, Homo sapiens
auuggcuauuuggugagugauu

SEQ ID NO: 223092 - RNA, 22 nt, Homo sapiens
auuggcuuuauacauaagaaua

SEQ ID NO: 223093 - RNA, 22 nt, Homo sapiens
auuggcuuuugaaagucugcga

SEQ ID NO: 223094 - RNA, 22 nt, Homo sapiens
auuggucuauuaaaccuaaguu

SEQ ID NO: 223095 - RNA, 22 nt, Homo sapiens
auuggucuugaaaccagagaga

SEQ ID NO: 223096 - RNA, 22 nt, Homo sapiens
auuguacuccagccugggcaag

SEQ ID NO: 223097 - RNA, 22 nt, Homo sapiens
auuguacuccagccugggugac

SEQ ID NO: 223098 - RNA, 22 nt, Homo sapiens
auuguacucuagccucugggca

SEQ ID NO: 223099 - RNA, 22 nt, Homo sapiens
auuguaguuugcuauggcaaua

SEQ ID NO: 223100 - RNA, 22 nt, Homo sapiens
auugucacccgggcaguaagca

SEQ ID NO: 223101 - RNA, 22 nt, Homo sapiens
auuguucuuacaugcugucauc

SEQ ID NO: 223102 - RNA, 22 nt, Homo sapiens
auuucacugagacaugugccca

SEQ ID NO: 223103 - RNA, 19 nt, Homo sapiens
auuugaucaucaggcacag

SEQ ID NO: 223104 - RNA, 22 nt, Homo sapiens
auuuggcaguauaaugcuuugg

SEQ ID NO: 223105 - RNA, 20 nt, Homo sapiens
auuuggcauaguuuaagcaa

SEQ ID NO: 223106 - RNA, 22 nt, Homo sapiens
auuuggguaaugagugcaaggg

SEQ ID NO: 223107 - RNA, 22 nt, Homo sapiens
auuuggguuuuacaucaggcua

SEQ ID NO: 223108 - RNA, 22 nt, Homo sapiens
auuugguagaguucgauaccug

SEQ ID NO: 223109 - RNA, 22 nt, Homo sapiens
auuuugcauugcuguaaaggaa

SEQ ID NO: 223110 - RNA, 21 nt, Homo sapiens
auuuuugcagagcugguagug

SEQ ID NO: 223111 - RNA, 22 nt, Homo sapiens
auuuuuggauauagggaaggau

SEQ ID NO: 223112 - RNA, 22 nt, Homo sapiens
auuuuugguugguaggcuauua

SEQ ID NO: 223113 - RNA, 22 nt, Homo sapiens
caaaagugguucuuauccuuuu

SEQ ID NO: 223114 - RNA, 22 nt, Homo sapiens
caaaccuguaggggccaagagg

SEQ ID NO: 223115 - RNA, 22 nt, Homo sapiens
caaagcacuuggcuuggaagau

SEQ ID NO: 223116 - RNA, 22 nt, Homo sapiens
caaaggcuucugaaacugcaga

SEQ ID NO: 223117 - RNA, 22 nt, Homo sapiens
caaaggugcuuuccagguccaa

SEQ ID NO: 223118 - RNA, 22 nt, Homo sapiens
caaagucuucucauuaugucuu

SEQ ID NO: 223119 - RNA, 22 nt, Homo sapiens
caaagugcuggccgggcgcagu

SEQ ID NO: 223120 - RNA, 22 nt, Homo sapiens
caaagugcugggacuggccggg

SEQ ID NO: 223121 - RNA, 19 nt, Homo sapiens
caaaguguucuucuuugcc

SEQ ID NO: 223122 - RNA, 22 nt, Homo sapiens
caaauccucaccucaucaugaa

SEQ ID NO: 223123 - RNA, 21 nt, Homo sapiens
cuaucucaguguuuacauuug

SEQ ID NO: 223124 - RNA, 22 nt, Homo sapiens
cuaugagcuuuuuuaagccuca

SEQ ID NO: 223125 - RNA, 22 nt, Homo sapiens
cuauggauuuacuguauagggu

SEQ ID NO: 223126 - RNA, 22 nt, Homo sapiens
cuauggcagccacggccuggag

SEQ ID NO: 223127 - RNA, 22 nt, Homo sapiens
cuauggcuguagucccugugua

SEQ ID NO: 223128 - RNA, 22 nt, Homo sapiens
cuauggugauagaaaucagaau

SEQ ID NO: 223129 - RNA, 22 nt, Homo sapiens
cuauuugcauucagaggcaugu

SEQ ID NO: 223130 - RNA, 22 nt, Homo sapiens
cuauuugguuggugaaaaaagu

SEQ ID NO: 223131 - RNA, 22 nt, Homo sapiens
cucaaagucaagggaaagcagg

SEQ ID NO: 223132 - RNA, 22 nt, Homo sapiens
cucaaagugcugggacuggcug

SEQ ID NO: 223133 - RNA, 19 nt, Homo sapiens
cucaaagugguauuuggag

SEQ ID NO: 223134 - RNA, 22 nt, Homo sapiens
cucaaaguguggucuguggguu

SEQ ID NO: 223135 - RNA, 22 nt, Homo sapiens
cucaaaugguccagcuaguggu

SEQ ID NO: 223136 - RNA, 18 nt, Homo sapiens
cucaaccucaugcagggc

SEQ ID NO: 223137 - RNA, 22 nt, Homo sapiens
cucaccuugugauccuccugcc

SEQ ID NO: 223138 - RNA, 22 nt, Homo sapiens
cucacggcccugcgcacuggca

SEQ ID NO: 223139 - RNA, 22 nt, Homo sapiens
cucacggugcaggcuucuggga

SEQ ID NO: 223140 - RNA, 17 nt, Homo sapiens
cucacugagaacagcua

SEQ ID NO: 223141 - RNA, 22 nt, Homo sapiens
cucaggcacucugauuccagug

SEQ ID NO: 223142 - RNA, 22 nt, Homo sapiens
cucaguagaaaauacauggacu

SEQ ID NO: 223143 - RNA, 20 nt, Homo sapiens
cucagugcacccccauaaaa

SEQ ID NO: 223144 - RNA, 22 nt, Homo sapiens
cucauugcaaucucugccuccc

SEQ ID NO: 223145 - RNA, 22 nt, Homo sapiens
cuccacgugaaugccaaguauu

SEQ ID NO: 223146 - RNA, 22 nt, Homo sapiens
cuccagugcaaagucaugauca

SEQ ID NO: 223147 - RNA, 22 nt, Homo sapiens
cuccauuuaguccuuuuagaag

SEQ ID NO: 223148 - RNA, 22 nt, Homo sapiens
cucccacccucauuuuuaggca

SEQ ID NO: 223149 - RNA, 22 nt, Homo sapiens
cuccccuuuaguuucuuaauaa

SEQ ID NO: 223150 - RNA, 23 nt, Homo sapiens
cucccugaacaugacacaccaga

SEQ ID NO: 223151 - RNA, 22 nt, Homo sapiens
cuccgggugcgucggcgcccug

SEQ ID NO: 223152 - RNA, 22 nt, Homo sapiens
cuccuguagccccaucaucuuu

SEQ ID NO: 223153 - RNA, 22 nt, Homo sapiens
cuccuugauuagaguauagagu

SEQ ID NO: 223154 - RNA, 22 nt, Homo sapiens
cucgcuccauuucggugaucaa

SEQ ID NO: 223155 - RNA, 20 nt, Homo sapiens
cucuaguaauaaaguuuccc

SEQ ID NO: 223156 - RNA, 22 nt, Homo sapiens
cucucaguugucuaauuaguuu

SEQ ID NO: 223157 - RNA, 22 nt, Homo sapiens
cucugagccugagguuccuacu

SEQ ID NO: 223158 - RNA, 22 nt, Homo sapiens
cucugagguuauucguaauauu

SEQ ID NO: 223159 - RNA, 22 nt, Homo sapiens
cucugguuaaggcugaacuaua

SEQ ID NO: 223160 - RNA, 22 nt, Homo sapiens
cucugguuuuucuuccauuaag

SEQ ID NO: 223161 - RNA, 22 nt, Homo sapiens
cucuuggguagauuuugcagag

SEQ ID NO: 223162 - RNA, 22 nt, Homo sapiens
cucuuugcuucuggcaucauug

SEQ ID NO: 223163 - RNA, 19 nt, Homo sapiens
cucuuuggugucucuucuu

SEQ ID NO: 223164 - RNA, 22 nt, Homo sapiens
cugaaagguauacgcuuguuau

SEQ ID NO: 223165 - RNA, 22 nt, Homo sapiens
cugaaaguuauucaggggcaag

SEQ ID NO: 223166 - RNA, 22 nt, Homo sapiens
cugaaauggaaugugugcacag

SEQ ID NO: 223167 - RNA, 22 nt, Homo sapiens
cugaaauguccaucgacugaug

SEQ ID NO: 223168 - RNA, 22 nt, Homo sapiens
cugaagugugaaagucuuuuuu

SEQ ID NO: 223169 - RNA, 22 nt, Homo sapiens
cugaaucauugcauuaucaagg

SEQ ID NO: 223170 - RNA, 22 nt, Homo sapiens
cugaaucauugguuaugaguac

SEQ ID NO: 223171 - RNA, 22 nt, Homo sapiens
cugaauguccaggcagagguuu

SEQ ID NO: 223172 - RNA, 22 nt, Homo sapiens
cugacagaugacugccacugua

SEQ ID NO: 223173 - RNA, 22 nt, Homo sapiens
cugacauggggauccaccuuag

SEQ ID NO: 223174 - RNA, 22 nt, Homo sapiens
cugacuaguuuuaaugcagauu

SEQ ID NO: 223175 - RNA, 22 nt, Homo sapiens
cugacugugcaugcccagcccc

SEQ ID NO: 223176 - RNA, 22 nt, Homo sapiens
cugagaacaucauucagauauu

SEQ ID NO: 223177 - RNA, 22 nt, Homo sapiens
cugagacuggugauuuaugaag

SEQ ID NO: 223178 - RNA, 22 nt, Homo sapiens
cugagauuaagauauugggagu

SEQ ID NO: 223179 - RNA, 18 nt, Homo sapiens
cugagcacugcuuuauga

SEQ ID NO: 223180 - RNA, 22 nt, Homo sapiens
cugagcaucauggcagaaucuu

SEQ ID NO: 223181 - RNA, 22 nt, Homo sapiens
cugagcaugacaucaugugacu

SEQ ID NO: 223182 - RNA, 22 nt, Homo sapiens
cugagcuagaccacuuggcucc

SEQ ID NO: 223183 - RNA, 22 nt, Homo sapiens
cugaggauauucagccucugug

SEQ ID NO: 223184 - RNA, 22 nt, Homo sapiens
cugaggguagaaggaucacuug

SEQ ID NO: 223185 - RNA, 22 nt, Homo sapiens
cugagguagcucaggguauugc

SEQ ID NO: 223186 - RNA, 22 nt, Homo sapiens
cugaggucugaauccagguauc

SEQ ID NO: 223187 - RNA, 20 nt, Homo sapiens
cugaggugggagaaucgcuu

SEQ ID NO: 223188 - RNA, 20 nt, Homo sapiens
cugauacagccugagcucuc

SEQ ID NO: 223189 - RNA, 22 nt, Homo sapiens
cugaucuguuauacuuuucuau

SEQ ID NO: 223190 - RNA, 22 nt, Homo sapiens
cugaugaaguauuuguucugga

SEQ ID NO: 223191 - RNA, 22 nt, Homo sapiens
cugauugucaucaauauuauua

SEQ ID NO: 223192 - RNA, 22 nt, Homo sapiens
cugauuuguccccagccucaug

SEQ ID NO: 223193 - RNA, 22 nt, Homo sapiens
cugcaaauacuugugggauuuu

SEQ ID NO: 223194 - RNA, 22 nt, Homo sapiens
cugcaagaaucguaguauuuga

SEQ ID NO: 223195 - RNA, 22 nt, Homo sapiens
cugcagucaucugaagauuuug

SEQ ID NO: 223196 - RNA, 22 nt, Homo sapiens
cugcauuagucuguuuaguguu

SEQ ID NO: 223197 - RNA, 22 nt, Homo sapiens
cugccacugacaccucaaggac

SEQ ID NO: 223198 - RNA, 22 nt, Homo sapiens
cugcccuuucuauaugauguaa

SEQ ID NO: 223199 - RNA, 22 nt, Homo sapiens
cugccuaaagaaaaagacguug

SEQ ID NO: 223200 - RNA, 22 nt, Homo sapiens
cugcuggucuuuaaggucuagg

SEQ ID NO: 223201 - RNA, 22 nt, Homo sapiens
cugcuguuguuaacuuuuggag

SEQ ID NO: 223202 - RNA, 18 nt, Homo sapiens
cuggaaggcuacuacagu

SEQ ID NO: 223203 - RNA, 22 nt, Homo sapiens
cuggaaugcagcuuuaggggcu

SEQ ID NO: 223204 - RNA, 22 nt, Homo sapiens
cuggaaugugagccccaaaaag

SEQ ID NO: 223205 - RNA, 22 nt, Homo sapiens
cuggaauuacaggguugagcua

SEQ ID NO: 223206 - RNA, 22 nt, Homo sapiens
cuggaauucaaaaucugaauuu

SEQ ID NO: 223207 - RNA, 22 nt, Homo sapiens
cuggacguugaggcugcaguga

SEQ ID NO: 223208 - RNA, 22 nt, Homo sapiens
cuggagauauuggaagaaagaa

SEQ ID NO: 223209 - RNA, 22 nt, Homo sapiens
cuggagauuaaccaauugccau

SEQ ID NO: 223210 - RNA, 22 nt, Homo sapiens
cuggaguaugaaccauguauca

SEQ ID NO: 223211 - RNA, 22 nt, Homo sapiens
cuggaguuugaggcugcaguga

SEQ ID NO: 223212 - RNA, 22 nt, Homo sapiens
cuggauagucaggagauauaua

SEQ ID NO: 223213 - RNA, 22 nt, Homo sapiens
cuggauauuaacauugaugaaa

SEQ ID NO: 223214 - RNA, 22 nt, Homo sapiens
cuggauggugagauaaagaaaa

SEQ ID NO: 223215 - RNA, 18 nt, Homo sapiens
cuggaugucgaguguguu

SEQ ID NO: 223216 - RNA, 22 nt, Homo sapiens
cuggcaaauaguagagccagga

SEQ ID NO: 223217 - RNA, 22 nt, Homo sapiens
cuggcaccauuuugaucaaagg

SEQ ID NO: 223218 - RNA, 22 nt, Homo sapiens
cuggccagagacauucauuaaa

SEQ ID NO: 223219 - RNA, 22 nt, Homo sapiens
cuggcccaguucugcguuuugc

SEQ ID NO: 223220 - RNA, 22 nt, Homo sapiens
cuggcucugagguguuuagggc

SEQ ID NO: 223221 - RNA, 22 nt, Homo sapiens
ucacugcgaccucugccucccg

SEQ ID NO: 223222 - RNA, 22 nt, Homo sapiens
ucacuggacucuagccugggug

SEQ ID NO: 223223 - RNA, 22 nt, Homo sapiens
ucacuggccaaauucuggguga

SEQ ID NO: 223224 - RNA, 20 nt, Homo sapiens
ucacugugaacuucuugagg

SEQ ID NO: 223225 - RNA, 22 nt, Homo sapiens
ucacugugguuggaaggcuuaa

SEQ ID NO: 223226 - RNA, 22 nt, Homo sapiens
ucacugugguuugggaaagugc

SEQ ID NO: 223227 - RNA, 22 nt, Homo sapiens
ucacugugugucucuguaucug

SEQ ID NO: 223228 - RNA, 22 nt, Homo sapiens
ucacuugguggcaaaguuuaug

SEQ ID NO: 223229 - RNA, 22 nt, Homo sapiens
ucagaaccuccuagcaguguuc

SEQ ID NO: 223230 - RNA, 22 nt, Homo sapiens
ucagaacugaacaaaccagucu

SEQ ID NO: 223231 - RNA, 21 nt, Homo sapiens
ucagaagcucccagggaggac

SEQ ID NO: 223232 - RNA, 22 nt, Homo sapiens
ucagaauguaacuuuaguugga

SEQ ID NO: 223233 - RNA, 22 nt, Homo sapiens
ucagagcaaagacacuuuauca

SEQ ID NO: 223234 - RNA, 22 nt, Homo sapiens
ucagaucacuggcgcuggcgga

SEQ ID NO: 223235 - RNA, 22 nt, Homo sapiens
ucagaucauuaagguagguuua

SEQ ID NO: 223236 - RNA, 22 nt, Homo sapiens
ucagaucuucagcaggggcccc

SEQ ID NO: 223237 - RNA, 19 nt, Homo sapiens
ucagaugcauuagggguua

SEQ ID NO: 223238 - RNA, 22 nt, Homo sapiens
ucagcagucacuccuaugacaa

SEQ ID NO: 223239 - RNA, 20 nt, Homo sapiens
ucagcagucuggagcagagg

SEQ ID NO: 223240 - RNA, 22 nt, Homo sapiens
ucagcaucacaggcagugagug

SEQ ID NO: 223241 - RNA, 22 nt, Homo sapiens
ucaggcacuaguaagaaaaagg

SEQ ID NO: 223242 - RNA, 20 nt, Homo sapiens
ucaggcuccgcauuaacuua

SEQ ID NO: 223243 - RNA, 22 nt, Homo sapiens
ucagggacgcuugacacaagcc

SEQ ID NO: 223244 - RNA, 20 nt, Homo sapiens
ucagguagaucuuugagguc

SEQ ID NO: 223245 - RNA, 20 nt, Homo sapiens
ucagguagggcuucaacauu

SEQ ID NO: 223246 - RNA, 22 nt, Homo sapiens
ucagguauuucuuuuagcugug

SEQ ID NO: 223247 - RNA, 22 nt, Homo sapiens
ucagguauuuuaucacaugaag

SEQ ID NO: 223248 - RNA, 22 nt, Homo sapiens
ucaggugcagagaagaaauggg

SEQ ID NO: 223249 - RNA, 22 nt, Homo sapiens
ucaggugcaguggcucugaccu

SEQ ID NO: 223250 - RNA, 22 nt, Homo sapiens
ucaguaaaugcuguucucuuuu

SEQ ID NO: 223251 - RNA, 22 nt, Homo sapiens
ucaguaaauguuaggacauuuc

SEQ ID NO: 223252 - RNA, 22 nt, Homo sapiens
ucaguaaucuuagcugugcaga

SEQ ID NO: 223253 - RNA, 23 nt, Homo sapiens
ucaguacucuauaagugccagcu

SEQ ID NO: 223254 - RNA, 22 nt, Homo sapiens
ucaguacuuuggagcucacaua

SEQ ID NO: 223255 - RNA, 19 nt, Homo sapiens
ucaguagugcacauaagcc

SEQ ID NO: 223256 - RNA, 22 nt, Homo sapiens
ucaguaguuuuuuuacuaggug

SEQ ID NO: 223257 - RNA, 22 nt, Homo sapiens
ucagucauucaauuguugaaug

SEQ ID NO: 223258 - RNA, 22 nt, Homo sapiens
ucagugaauacauguacucaug

SEQ ID NO: 223259 - RNA, 20 nt, Homo sapiens
ucagugauugguuuaguuau

SEQ ID NO: 223260 - RNA, 21 nt, Homo sapiens
ucagugcaauucuauggggaa

SEQ ID NO: 223261 - RNA, 17 nt, Homo sapiens
ucagugcauuuaagaga

SEQ ID NO: 223262 - RNA, 22 nt, Homo sapiens
ucagugccauugccauaugagu

SEQ ID NO: 223263 - RNA, 22 nt, Homo sapiens
ucagugccucaguuuuuaaaga

SEQ ID NO: 223264 - RNA, 22 nt, Homo sapiens
ucagugcgugcauagccuggau

SEQ ID NO: 223265 - RNA, 22 nt, Homo sapiens
ucagugcuguaccaucuaagga

SEQ ID NO: 223266 - RNA, 22 nt, Homo sapiens
ucagugguuaaaagauucuaga

SEQ ID NO: 223267 - RNA, 22 nt, Homo sapiens
ucaguguuuggaaucucaauuu

SEQ ID NO: 223268 - RNA, 22 nt, Homo sapiens
ucaguuuguauuucagguugca

SEQ ID NO: 223269 - RNA, 20 nt, Homo sapiens
ucauagggugguggcagugg

SEQ ID NO: 223270 - RNA, 22 nt, Homo sapiens
ucauaguagucacuuaauaaau

SEQ ID NO: 223271 - RNA, 16 nt, Homo sapiens
ucauaguaucucuucu

SEQ ID NO: 223272 - RNA, 21 nt, Homo sapiens
ucauauguaucuuugugccuc

SEQ ID NO: 223273 - RNA, 22 nt, Homo sapiens
ucauaugucauaguaugaucuu

SEQ ID NO: 223274 - RNA, 22 nt, Homo sapiens
ucauauugguuaaaauaguggg

SEQ ID NO: 223275 - RNA, 16 nt, Homo sapiens
ucaucacagucucugg

SEQ ID NO: 223276 - RNA, 22 nt, Homo sapiens
ucaucaggaaacuuaugcagug

SEQ ID NO: 223277 - RNA, 22 nt, Homo sapiens
ucaucaguggggaugugguuga

SEQ ID NO: 223278 - RNA, 22 nt, Homo sapiens
ucaucuggcgaaugugaagagu

SEQ ID NO: 223279 - RNA, 22 nt, Homo sapiens
ucaugacacuggcaggagcuaa

SEQ ID NO: 223280 - RNA, 22 nt, Homo sapiens
ucaugaccaugguauagaccac

SEQ ID NO: 223281 - RNA, 22 nt, Homo sapiens
ucaugcaaugagucaggaggca

SEQ ID NO: 223282 - RNA, 22 nt, Homo sapiens
ucaugcaaugcaaggggaaauu

SEQ ID NO: 223283 - RNA, 21 nt, Homo sapiens
ucaugccacugcacuuuagcc

SEQ ID NO: 223284 - RNA, 23 nt, Homo sapiens
ucaugguagcaccaacaauaacu

SEQ ID NO: 223285 - RNA, 22 nt, Homo sapiens
ucauguguugcacugaggaccu

SEQ ID NO: 223286 - RNA, 22 nt, Homo sapiens
ucauucacucccuugaaguuag

SEQ ID NO: 223287 - RNA, 22 nt, Homo sapiens
ucauuggauggaaugcucugua

SEQ ID NO: 223288 - RNA, 22 nt, Homo sapiens
ucauugguugcguaauuugauu

SEQ ID NO: 223289 - RNA, 22 nt, Homo sapiens
uccaauguaaucaucauugaau

SEQ ID NO: 223290 - RNA, 19 nt, Homo sapiens
uccacagugguugaacuag

SEQ ID NO: 223291 - RNA, 18 nt, Homo sapiens
uccacgugcuuuccagau

SEQ ID NO: 223292 - RNA, 22 nt, Homo sapiens
uccagcuuuuucuaauucugug

SEQ ID NO: 223293 - RNA, 22 nt, Homo sapiens
uccagguuuugugaguuuaaau

SEQ ID NO: 223294 - RNA, 22 nt, Homo sapiens
uccaguacaggucucucauuuc

SEQ ID NO: 223295 - RNA, 22 nt, Homo sapiens
uccaguuuggaggcuugaugug

SEQ ID NO: 223296 - RNA, 22 nt, Homo sapiens
uccaguuuucuuuccuagggcu

SEQ ID NO: 223297 - RNA, 19 nt, Homo sapiens
uccaugagcccacagugau

SEQ ID NO: 223298 - RNA, 22 nt, Homo sapiens
uccaugaguccauuagaaaaaa

SEQ ID NO: 223299 - RNA, 22 nt, Homo sapiens
uccauguagaugcuauguuguc

SEQ ID NO: 223300 - RNA, 22 nt, Homo sapiens
uccaugugaaaucuaugaggac

SEQ ID NO: 223301 - RNA, 22 nt, Homo sapiens
uccauuuguucagcuucaggaa

SEQ ID NO: 223302 - RNA, 22 nt, Homo sapiens
ucccagucuagagccggauugg

SEQ ID NO: 223303 - RNA, 22 nt, Homo sapiens
ucccauguagcuaggauuacag

SEQ ID NO: 223304 - RNA, 22 nt, Homo sapiens
ucccauugucucugaccuugcc

SEQ ID NO: 223305 - RNA, 23 nt, Homo sapiens
uccccgggagcaccagcuuguug

SEQ ID NO: 223306 - RNA, 19 nt, Homo sapiens
uccccgggucuagugcagc

SEQ ID NO: 223307 - RNA, 22 nt, Homo sapiens
ucccgaggacaucugggggcaa

SEQ ID NO: 223308 - RNA, 18 nt, Homo sapiens
ucccucagaauuauagaa

SEQ ID NO: 223309 - RNA, 22 nt, Homo sapiens
ucccugaaaaauuggcuuaaca

SEQ ID NO: 223310 - RNA, 22 nt, Homo sapiens
ucccugagcaaaguuuucugua

SEQ ID NO: 223311 - RNA, 22 nt, Homo sapiens
ucccugagguccuggauuauug

SEQ ID NO: 223312 - RNA, 22 nt, Homo sapiens
ucccuguuguuucauaauuuua

SEQ ID NO: 223313 - RNA, 22 nt, Homo sapiens
ucccuugagccuggcuucucac

SEQ ID NO: 223314 - RNA, 22 nt, Homo sapiens
ucccuugguaauucuguuccuu

SEQ ID NO: 223315 - RNA, 19 nt, Homo sapiens
ucccuuuguagguaaccug

SEQ ID NO: 223316 - RNA, 22 nt, Homo sapiens
uccuacugucuucggggcacug

SEQ ID NO: 223317 - RNA, 21 nt, Homo sapiens
uccugagagaggaguaacucu

SEQ ID NO: 223318 - RNA, 22 nt, Homo sapiens
uccugagagcagacccucuaua

SEQ ID NO: 223319 - RNA, 22 nt, Homo sapiens
uccugagucagcauccguuugu

SEQ ID NO: 223320 - RNA, 22 nt, Homo sapiens
ugaacagcacguuuauucagaa

SEQ ID NO: 223321 - RNA, 22 nt, Homo sapiens
ugaacuguugggggaaauucag

SEQ ID NO: 223322 - RNA, 22 nt, Homo sapiens
ugaagcuaacuugauugugaug

SEQ ID NO: 223323 - RNA, 22 nt, Homo sapiens
ugaagcuuguuucuguaccuuu

SEQ ID NO: 223324 - RNA, 22 nt, Homo sapiens
ugaaggacauaaggcagaguga

SEQ ID NO: 223325 - RNA, 22 nt, Homo sapiens
ugaaggaguauggauaagucgu

SEQ ID NO: 223326 - RNA, 22 nt, Homo sapiens
ugaaguaauguuuuauucuauu

SEQ ID NO: 223327 - RNA, 21 nt, Homo sapiens
ugaaguagcauaggaugucaa

SEQ ID NO: 223328 - RNA, 22 nt, Homo sapiens
ugaagugggaaaugaguauuaa

SEQ ID NO: 223329 - RNA, 22 nt, Homo sapiens
ugaauacuucguucaaagauaa

SEQ ID NO: 223330 - RNA, 22 nt, Homo sapiens
ugaauaguuugacagaacucuu

SEQ ID NO: 223331 - RNA, 22 nt, Homo sapiens
ugaaucauuucuugucuucagu

SEQ ID NO: 223332 - RNA, 23 nt, Homo sapiens
ugaauguaucgaaugugggaaag

SEQ ID NO: 223333 - RNA, 22 nt, Homo sapiens
ugaauguccugacgcugcaguu

SEQ ID NO: 223334 - RNA, 22 nt, Homo sapiens
ugaauucaucucacagaguuaa

SEQ ID NO: 223335 - RNA, 22 nt, Homo sapiens
ugaauuguuucauucuuuacau

SEQ ID NO: 223336 - RNA, 22 nt, Homo sapiens
ugacaacugauuaacuccuuua

SEQ ID NO: 223337 - RNA, 22 nt, Homo sapiens
ugacaagagaccccuccgcagg

SEQ ID NO: 223338 - RNA, 22 nt, Homo sapiens
ugacacagcaagauggaaccau

SEQ ID NO: 223339 - RNA, 19 nt, Homo sapiens
ugacacuguuggugggagg

SEQ ID NO: 223340 - RNA, 21 nt, Homo sapiens
ugacagaaaauugaguuugcu

SEQ ID NO: 223341 - RNA, 22 nt, Homo sapiens
ugacagagcaggacuucaucuc

SEQ ID NO: 223342 - RNA, 22 nt, Homo sapiens
ugacagcugaagauguugaacc

SEQ ID NO: 223343 - RNA, 22 nt, Homo sapiens
ugacaggagauuaugugauguu

SEQ ID NO: 223344 - RNA, 22 nt, Homo sapiens
ugacaggucuaauuuacugaca

SEQ ID NO: 223345 - RNA, 22 nt, Homo sapiens
ugacagguuggaauuaugggag

SEQ ID NO: 223346 - RNA, 22 nt, Homo sapiens
ugacagucaccaggacccacag

SEQ ID NO: 223347 - RNA, 23 nt, Homo sapiens
ugacagugcuugaaauugcucuu

SEQ ID NO: 223348 - RNA, 20 nt, Homo sapiens
ugacaucagcaauguaauaa

SEQ ID NO: 223349 - RNA, 22 nt, Homo sapiens
ugacaugaagucucccucuguu

SEQ ID NO: 223350 - RNA, 22 nt, Homo sapiens
ugacaugauguuccuacacugu

SEQ ID NO: 223351 - RNA, 22 nt, Homo sapiens
ugacauggagggugcggcugca

SEQ ID NO: 223352 - RNA, 22 nt, Homo sapiens
ugacauguagagaacuucucau

SEQ ID NO: 223353 - RNA, 21 nt, Homo sapiens
ugacauguuggugugcugcac

SEQ ID NO: 223354 - RNA, 21 nt, Homo sapiens
ugacauuauuucaugucagua

SEQ ID NO: 223355 - RNA, 17 nt, Homo sapiens
ugaccacugauucuacu

SEQ ID NO: 223356 - RNA, 22 nt, Homo sapiens
ugaccuagaacucuaaugccug

SEQ ID NO: 223357 - RNA, 22 nt, Homo sapiens
ugacggaggcauuggaagcuug

SEQ ID NO: 223358 - RNA, 22 nt, Homo sapiens
ugacuaaaacugaguuucauua

SEQ ID NO: 223359 - RNA, 22 nt, Homo sapiens
ugacuagacuugcaagguugca

SEQ ID NO: 223360 - RNA, 22 nt, Homo sapiens
ugacuagagacagaaacuaaaa

SEQ ID NO: 223361 - RNA, 22 nt, Homo sapiens
ugacuagcgauccccuuucuag

SEQ ID NO: 223362 - RNA, 22 nt, Homo sapiens
ugacuaggaaauuagaacuuuu

SEQ ID NO: 223363 - RNA, 22 nt, Homo sapiens
ugacuagggacauucuuccacg

SEQ ID NO: 223364 - RNA, 21 nt, Homo sapiens
ugacuagggauaugugccacu

SEQ ID NO: 223365 - RNA, 22 nt, Homo sapiens
ugacuauaucucuguauaaacu

SEQ ID NO: 223366 - RNA, 22 nt, Homo sapiens
ugacuauugauuuagacgugcu

SEQ ID NO: 223367 - RNA, 22 nt, Homo sapiens
ugacucaagagccugacucauc

SEQ ID NO: 223368 - RNA, 22 nt, Homo sapiens
ugacucagauagguguguauuc

SEQ ID NO: 223369 - RNA, 22 nt, Homo sapiens
ugacucgaggcgccuccagucc

SEQ ID NO: 223370 - RNA, 23 nt, Homo sapiens
ugacugaguauauguuuggugcu

SEQ ID NO: 223371 - RNA, 22 nt, Homo sapiens
ugacuggaacuuuagugagucu

SEQ ID NO: 223372 - RNA, 22 nt, Homo sapiens
ugacuggagaccucaguagggu

SEQ ID NO: 223373 - RNA, 22 nt, Homo sapiens
ugacuggagucuugcucugucg

SEQ ID NO: 223374 - RNA, 22 nt, Homo sapiens
ugacugguguuuaaugagucaa

SEQ ID NO: 223375 - RNA, 23 nt, Homo sapiens
ugacuuaggccucaacuaugacu

SEQ ID NO: 223376 - RNA, 22 nt, Homo sapiens
ugacuucauuuuuggccaugag

SEQ ID NO: 223377 - RNA, 22 nt, Homo sapiens
ugacuugauacauguuuuugaa

SEQ ID NO: 223378 - RNA, 22 nt, Homo sapiens
ugacuugaucacccccuaaggg

SEQ ID NO: 223379 - RNA, 22 nt, Homo sapiens
ugagaacaugugauauuuggug

SEQ ID NO: 223380 - RNA, 22 nt, Homo sapiens
ugagaacauuccucuuccuggc

SEQ ID NO: 223381 - RNA, 22 nt, Homo sapiens
ugagaacugcagggagcugcau

SEQ ID NO: 223382 - RNA, 22 nt, Homo sapiens
ugagaacugccuguauuuaucu

SEQ ID NO: 223383 - RNA, 22 nt, Homo sapiens
ugagaacuguuuugguuugggu

SEQ ID NO: 223384 - RNA, 22 nt, Homo sapiens
ugagaacuuugucuuuuacucu

SEQ ID NO: 223385 - RNA, 22 nt, Homo sapiens
ugagaagacaucuuugcuuugu

SEQ ID NO: 223386 - RNA, 22 nt, Homo sapiens
ugagaagugacgcagcaggguu

SEQ ID NO: 223387 - RNA, 22 nt, Homo sapiens
ugagaauauuugaagauguuag

SEQ ID NO: 223388 - RNA, 22 nt, Homo sapiens
ugagaaugcagaaucucgugca

SEQ ID NO: 223389 - RNA, 22 nt, Homo sapiens
ugagacaaucucaucucaguga

SEQ ID NO: 223390 - RNA, 22 nt, Homo sapiens
ugagacacuucccagaucccuu

SEQ ID NO: 223391 - RNA, 22 nt, Homo sapiens
ugagacauauuauacugcuuuu

SEQ ID NO: 223392 - RNA, 22 nt, Homo sapiens
ugagacaucacaaaauccucaa

SEQ ID NO: 223393 - RNA, 22 nt, Homo sapiens
ugagaccaacagauuccaguuc

SEQ ID NO: 223394 - RNA, 22 nt, Homo sapiens
ugagaccuuucauuucucagug

SEQ ID NO: 223395 - RNA, 22 nt, Homo sapiens
ugagacgaagucuugcucuguu

SEQ ID NO: 223396 - RNA, 22 nt, Homo sapiens
ugagacggagucucgcucucua

SEQ ID NO: 223397 - RNA, 22 nt, Homo sapiens
ugagacggagucuugcccuguc

SEQ ID NO: 223398 - RNA, 22 nt, Homo sapiens
ugagacggaguuauuuauaaua

SEQ ID NO: 223399 - RNA, 22 nt, Homo sapiens
ugagacugagucucgcucuauu

SEQ ID NO: 223400 - RNA, 22 nt, Homo sapiens
ugagacugagucucgcucuugu

SEQ ID NO: 223401 - RNA, 22 nt, Homo sapiens
ugagacugguuaauugauaaag

SEQ ID NO: 223402 - RNA, 22 nt, Homo sapiens
ugagagcuuugaugcacuguuu

SEQ ID NO: 223403 - RNA, 22 nt, Homo sapiens
ugagagucacugaccugguaua

SEQ ID NO: 223404 - RNA, 22 nt, Homo sapiens
ugagauaaucaugugauuucau

SEQ ID NO: 223405 - RNA, 18 nt, Homo sapiens
ugagauacuagaauaggu

SEQ ID NO: 223406 - RNA, 22 nt, Homo sapiens
ugagauagcauaagggacagaa

SEQ ID NO: 223407 - RNA, 22 nt, Homo sapiens
ugagauagggucucacucuguc

SEQ ID NO: 223408 - RNA, 20 nt, Homo sapiens
ugagauaguaauccccuaca

SEQ ID NO: 223409 - RNA, 22 nt, Homo sapiens
ugagaucacuaagagguaaugg

SEQ ID NO: 223410 - RNA, 20 nt, Homo sapiens
ugagaucaggauuaaggcua

SEQ ID NO: 223411 - RNA, 22 nt, Homo sapiens
ugagaucauguguggaccccag

SEQ ID NO: 223412 - RNA, 22 nt, Homo sapiens
ugagauccugugacuacacuga

SEQ ID NO: 223413 - RNA, 23 nt, Homo sapiens
ugagaucuacagaucucagaucu

SEQ ID NO: 223414 - RNA, 22 nt, Homo sapiens
ugagaucucauuaugguuuuaa

SEQ ID NO: 223415 - RNA, 22 nt, Homo sapiens
ugagaucuguaaagucugacau

SEQ ID NO: 223416 - RNA, 22 nt, Homo sapiens
ugagaucuuaccuuccugccuu

SEQ ID NO: 223417 - RNA, 22 nt, Homo sapiens
ugagaucuuggaggcuuuguga

SEQ ID NO: 223418 - RNA, 22 nt, Homo sapiens
uggacuguaagugccuugagua

SEQ ID NO: 223419 - RNA, 22 nt, Homo sapiens
uggacuguaauagagaacagaa

SEQ ID NO: 223420 - RNA, 22 nt, Homo sapiens
uggagaacauucauuugcaaga

SEQ ID NO: 223421 - RNA, 22 nt, Homo sapiens
uggagagucauuuauaguauuu

SEQ ID NO: 223422 - RNA, 22 nt, Homo sapiens
uggagagugauaaguaaaugga

SEQ ID NO: 223423 - RNA, 20 nt, Homo sapiens
uggaggucaucugucacuac

SEQ ID NO: 223424 - RNA, 22 nt, Homo sapiens
uggaggucauuggaucaugggg

SEQ ID NO: 223425 - RNA, 22 nt, Homo sapiens
uggaguaggccuaagaaugaca

SEQ ID NO: 223426 - RNA, 19 nt, Homo sapiens
uggagucaucaugcugcua

SEQ ID NO: 223427 - RNA, 16 nt, Homo sapiens
uggagucauccuugac

SEQ ID NO: 223428 - RNA, 22 nt, Homo sapiens
uggagucuugcucuguugccca

SEQ ID NO: 223429 - RNA, 21 nt, Homo sapiens
uggagugcaacacuagguaua

SEQ ID NO: 223430 - RNA, 22 nt, Homo sapiens
uggagugcgugucugaguuuuu

SEQ ID NO: 223431 - RNA, 20 nt, Homo sapiens
uggagugcuguguugagaag

SEQ ID NO: 223432 - RNA, 22 nt, Homo sapiens
uggaguguagcggcaccuauua

SEQ ID NO: 223433 - RNA, 22 nt, Homo sapiens
uggaguuugacaugccuuuggg

SEQ ID NO: 223434 - RNA, 22 nt, Homo sapiens
uggauagaaauguacuguuuuc

SEQ ID NO: 223435 - RNA, 22 nt, Homo sapiens
uggauaguaauaaacauauagg

SEQ ID NO: 223436 - RNA, 22 nt, Homo sapiens
uggauagugauaagguagauga

SEQ ID NO: 223437 - RNA, 22 nt, Homo sapiens
uggaugaagagaugguaguugc

SEQ ID NO: 223438 - RNA, 22 nt, Homo sapiens
uggaugacauccuuguaugcag

SEQ ID NO: 223439 - RNA, 19 nt, Homo sapiens
uggaugacugucugggucu

SEQ ID NO: 223440 - RNA, 18 nt, Homo sapiens
uggauuggaaaaguuccu

SEQ ID NO: 223441 - RNA, 22 nt, Homo sapiens
uggauugugaagaccaugggaa

SEQ ID NO: 223442 - RNA, 22 nt, Homo sapiens
uggcaaaaaaccgcaguugccu

SEQ ID NO: 223443 - RNA, 22 nt, Homo sapiens
uggcaaaaaucacaaguaccuu

SEQ ID NO: 223444 - RNA, 22 nt, Homo sapiens
uggcaaaugaaagaaagccagu

SEQ ID NO: 223445 - RNA, 22 nt, Homo sapiens
uggcaaauuccaaaguuaauuc

SEQ ID NO: 223446 - RNA, 21 nt, Homo sapiens
uggcaacauggauggauucug

SEQ ID NO: 223447 - RNA, 21 nt, Homo sapiens
uggcaacgaggugugcauuau

SEQ ID NO: 223448 - RNA, 22 nt, Homo sapiens
uggcaagaacaacaauuacuuu

SEQ ID NO: 223449 - RNA, 22 nt, Homo sapiens
uggcaagaacgaaauguagggu

SEQ ID NO: 223450 - RNA, 22 nt, Homo sapiens
uggcaagaccccaucucuacaa

SEQ ID NO: 223451 - RNA, 22 nt, Homo sapiens
uggcaagagcaaaauguacagu

SEQ ID NO: 223452 - RNA, 22 nt, Homo sapiens
uggcaauaauucagugugggcu

SEQ ID NO: 223453 - RNA, 22 nt, Homo sapiens
uggcacaaugacccuugugggc

SEQ ID NO: 223454 - RNA, 22 nt, Homo sapiens
uggcacuggagauacauuaaua

SEQ ID NO: 223455 - RNA, 22 nt, Homo sapiens
uggcagacaaauuugagcauau

SEQ ID NO: 223456 - RNA, 22 nt, Homo sapiens
uggcagauaggauacaggacua

SEQ ID NO: 223457 - RNA, 22 nt, Homo sapiens
uggcaguuuacaaaugccauga

SEQ ID NO: 223458 - RNA, 22 nt, Homo sapiens
uggcauauaaagauguguucaa

SEQ ID NO: 223459 - RNA, 22 nt, Homo sapiens
uggcauggaaagcuuuucauac

SEQ ID NO: 223460 - RNA, 22 nt, Homo sapiens
uggcauguaaugcagaaguugc

SEQ ID NO: 223461 - RNA, 22 nt, Homo sapiens
uggcaugucagguuucuggguu

SEQ ID NO: 223462 - RNA, 22 nt, Homo sapiens
uggcaugugugaagugcccagc

SEQ ID NO: 223463 - RNA, 20 nt, Homo sapiens
uggcauguugguaugcaccc

SEQ ID NO: 223464 - RNA, 23 nt, Homo sapiens
uggcauuuuaguuagcuucagug

SEQ ID NO: 223465 - RNA, 22 nt, Homo sapiens
uggcauuuuguuuuagaauuag

SEQ ID NO: 223466 - RNA, 22 nt, Homo sapiens
uggccagugucggaggccagga

SEQ ID NO: 223467 - RNA, 22 nt, Homo sapiens
uggccaguugaagacaaugcuc

SEQ ID NO: 223468 - RNA, 22 nt, Homo sapiens
uggcgagaugcucgugugcaga

SEQ ID NO: 223469 - RNA, 22 nt, Homo sapiens
uggcggagacauggacuucaga

SEQ ID NO: 223470 - RNA, 22 nt, Homo sapiens
uggcuacugaccugcuaggggg

SEQ ID NO: 223471 - RNA, 19 nt, Homo sapiens
uggcuagaggccaggcguu

SEQ ID NO: 223472 - RNA, 22 nt, Homo sapiens
uggcuagaugagauguacugca

SEQ ID NO: 223473 - RNA, 22 nt, Homo sapiens
uggcucauuucuaaacccagcu

SEQ ID NO: 223474 - RNA, 22 nt, Homo sapiens
uggcuccguuguacaggcugga

SEQ ID NO: 223475 - RNA, 22 nt, Homo sapiens
uggcucuguuuguuaacuagac

SEQ ID NO: 223476 - RNA, 22 nt, Homo sapiens
uggcuguuguuacuaacaguuc

SEQ ID NO: 223477 - RNA, 22 nt, Homo sapiens
uggcuguuuauuucaccuggau

SEQ ID NO: 223478 - RNA, 22 nt, Homo sapiens
uggcuguuuauuucaccugggc

SEQ ID NO: 223479 - RNA, 22 nt, Homo sapiens
uggcuuuguaagguuucauuuu

SEQ ID NO: 223480 - RNA, 22 nt, Homo sapiens
uggcuuuuguuauuuggaagcu

SEQ ID NO: 223481 - RNA, 22 nt, Homo sapiens
ugggaaacauccagcacauacu

SEQ ID NO: 223482 - RNA, 20 nt, Homo sapiens
ugggaacaugugguauaugg

SEQ ID NO: 223483 - RNA, 22 nt, Homo sapiens
ugggaacugaggugaaaagaca

SEQ ID NO: 223484 - RNA, 22 nt, Homo sapiens
ugggaccccuacucuuuccaca

SEQ ID NO: 223485 - RNA, 22 nt, Homo sapiens
ugggagacuacauuuuuaacaa

SEQ ID NO: 223486 - RNA, 22 nt, Homo sapiens
ugggauccaugugguuuaagca

SEQ ID NO: 223487 - RNA, 22 nt, Homo sapiens
ugggaucgucaagugaggcucg

SEQ ID NO: 223488 - RNA, 22 nt, Homo sapiens
ugggaugaaaauagcuucuucc

SEQ ID NO: 223489 - RNA, 22 nt, Homo sapiens
ugggaugaugaaaaggcuuucu

SEQ ID NO: 223490 - RNA, 23 nt, Homo sapiens
ugggauguuuuuggaaacuucug

SEQ ID NO: 223491 - RNA, 22 nt, Homo sapiens
ugggcaaauugugagggaggua

SEQ ID NO: 223492 - RNA, 22 nt, Homo sapiens
ugggccgcugcaggaugguccc

SEQ ID NO: 223493 - RNA, 22 nt, Homo sapiens
uggguaggaccagaaaugcacu

SEQ ID NO: 223494 - RNA, 22 nt, Homo sapiens
uggguaggcccucauuggacag

SEQ ID NO: 223495 - RNA, 19 nt, Homo sapiens
uggguagugaugagacaua

SEQ ID NO: 223496 - RNA, 22 nt, Homo sapiens
uggguaguguaaagcacuccag

SEQ ID NO: 223497 - RNA, 22 nt, Homo sapiens
ugggugaguaucuauuauucag

SEQ ID NO: 223498 - RNA, 22 nt, Homo sapiens
uggguucccugucuguccuuga

SEQ ID NO: 223499 - RNA, 22 nt, Homo sapiens
ugguaaaaugucauuuaccaga

SEQ ID NO: 223500 - RNA, 22 nt, Homo sapiens
ugguaaacaacaggagaacuug

SEQ ID NO: 223501 - RNA, 22 nt, Homo sapiens
ugguaagaggcccugaguuugu

SEQ ID NO: 223502 - RNA, 22 nt, Homo sapiens
ugguaagaucugugagccaggc

SEQ ID NO: 223503 - RNA, 22 nt, Homo sapiens
ugguacuucaugcucacagaua

SEQ ID NO: 223504 - RNA, 22 nt, Homo sapiens
ugguaucauuuuaucugcucua

SEQ ID NO: 223505 - RNA, 22 nt, Homo sapiens
ugguaugucuagauggggaagu

SEQ ID NO: 223506 - RNA, 22 nt, Homo sapiens
ugguauguguucuaaaauuaug

SEQ ID NO: 223507 - RNA, 22 nt, Homo sapiens
uggucaccuucuugcucugucu

SEQ ID NO: 223508 - RNA, 21 nt, Homo sapiens
uggucccauaagauuacaaug

SEQ ID NO: 223509 - RNA, 22 nt, Homo sapiens
ugguccuuuccauuggagacac

SEQ ID NO: 223510 - RNA, 22 nt, Homo sapiens
uggucuucuggccuccagaacc

SEQ ID NO: 223511 - RNA, 22 nt, Homo sapiens
uggugagaaaagaugucuuugu

SEQ ID NO: 223512 - RNA, 22 nt, Homo sapiens
uggugagaaacuagauauuuuu

SEQ ID NO: 223513 - RNA, 22 nt, Homo sapiens
uggugcaaugaagugaucucaa

SEQ ID NO: 223514 - RNA, 22 nt, Homo sapiens
uggugcccuguccuucuguggc

SEQ ID NO: 223515 - RNA, 19 nt, Homo sapiens
uggugccuuguucuuggau

SEQ ID NO: 223516 - RNA, 22 nt, Homo sapiens
uuaguggaugcugaauaaagaa

SEQ ID NO: 223517 - RNA, 22 nt, Homo sapiens
uuaguuuaucagugguuucuga

SEQ ID NO: 223518 - RNA, 22 nt, Homo sapiens
uuauaacagagacuccugugcu

SEQ ID NO: 223519 - RNA, 22 nt, Homo sapiens
uuauacuacuauaaagagguag

SEQ ID NO: 223520 - RNA, 22 nt, Homo sapiens
uuauacucgucugaaugauucu

SEQ ID NO: 223521 - RNA, 22 nt, Homo sapiens
uuauagacacguuguaacaaac

SEQ ID NO: 223522 - RNA, 22 nt, Homo sapiens
uuauagcagugcaggaacagac

SEQ ID NO: 223523 - RNA, 22 nt, Homo sapiens
uuauaggcaggugguguagaug

SEQ ID NO: 223524 - RNA, 22 nt, Homo sapiens
uuauagguuucuacaggacuau

SEQ ID NO: 223525 - RNA, 21 nt, Homo sapiens
uuauaguggcaugauuuauaa

SEQ ID NO: 223526 - RNA, 22 nt, Homo sapiens
uuauauguuacucccucuagca

SEQ ID NO: 223527 - RNA, 22 nt, Homo sapiens
uuauauguuucuguuuggaggc

SEQ ID NO: 223528 - RNA, 22 nt, Homo sapiens
uuauauguuuguacuuaggccu

SEQ ID NO: 223529 - RNA, 22 nt, Homo sapiens
uuaucacauugacugauuugca

SEQ ID NO: 223530 - RNA, 22 nt, Homo sapiens
uuaucagcagcaugaaaauaga

SEQ ID NO: 223531 - RNA, 22 nt, Homo sapiens
uuauccucuagacauagguuua

SEQ ID NO: 223532 - RNA, 22 nt, Homo sapiens
uuaucucaguguuuguaaacaa

SEQ ID NO: 223533 - RNA, 22 nt, Homo sapiens
uuaugaaguagguuaagagcag

SEQ ID NO: 223534 - RNA, 17 nt, Homo sapiens
uuaugagacuucuuagc

SEQ ID NO: 223535 - RNA, 22 nt, Homo sapiens
uuaugcagcaaagugcuugaaa

SEQ ID NO: 223536 - RNA, 22 nt, Homo sapiens
uuauggcuauugaugacaauug

SEQ ID NO: 223537 - RNA, 22 nt, Homo sapiens
uuauuacuccuauuuuguagau

SEQ ID NO: 223538 - RNA, 22 nt, Homo sapiens
uuauucauuaauugcuaagguu

SEQ ID NO: 223539 - RNA, 22 nt, Homo sapiens
uuauugaguaaaaagaaugguu

SEQ ID NO: 223540 - RNA, 22 nt, Homo sapiens
uuauugcacuccagccugggua

SEQ ID NO: 223541 - RNA, 22 nt, Homo sapiens
uuauugcuaaaucaugaccaca

SEQ ID NO: 223542 - RNA, 22 nt, Homo sapiens
uuauugcucauuugggcauucu

SEQ ID NO: 223543 - RNA, 22 nt, Homo sapiens
uuauugcuccagaggcugauuu

SEQ ID NO: 223544 - RNA, 22 nt, Homo sapiens
uuauugcuuaugauuagguguu

SEQ ID NO: 223545 - RNA, 22 nt, Homo sapiens
uuauugcuuuugugcaggugag

SEQ ID NO: 223546 - RNA, 22 nt, Homo sapiens
uuauuguccaaguuucccuuug

SEQ ID NO: 223547 - RNA, 22 nt, Homo sapiens
uuauuugguuauuguaauuggg

SEQ ID NO: 223548 - RNA, 22 nt, Homo sapiens
uuauuugguugcugacuuggaa

SEQ ID NO: 223549 - RNA, 22 nt, Homo sapiens
uucaaaggauagauuaagauca

SEQ ID NO: 223550 - RNA, 23 nt, Homo sapiens
uucaaaggaugcuuuauggaauu

SEQ ID NO: 223551 - RNA, 22 nt, Homo sapiens
uucaaaggauuuagauuagcua

SEQ ID NO: 223552 - RNA, 22 nt, Homo sapiens
uucaaauguucuuucaccaccc

SEQ ID NO: 223553 - RNA, 22 nt, Homo sapiens
uucaagaauuaaaguggcuuuu

SEQ ID NO: 223554 - RNA, 22 nt, Homo sapiens
uucaagucaauuuuugaaugac

SEQ ID NO: 223555 - RNA, 22 nt, Homo sapiens
uucacacuagccacucugguag

SEQ ID NO: 223556 - RNA, 22 nt, Homo sapiens
uucacagagagaacucaaacca

SEQ ID NO: 223557 - RNA, 22 nt, Homo sapiens
uucacagucacccuucuccaug

SEQ ID NO: 223558 - RNA, 22 nt, Homo sapiens
uucacaugacagggugaagcau

SEQ ID NO: 223559 - RNA, 22 nt, Homo sapiens
uucaccuguagcaugcccuugg

SEQ ID NO: 223560 - RNA, 22 nt, Homo sapiens
uucaccuugggucccacuugcu

SEQ ID NO: 223561 - RNA, 22 nt, Homo sapiens
uucacgguguucacgggggucc

SEQ ID NO: 223562 - RNA, 22 nt, Homo sapiens
uucacuguaaaaugaagagggu

SEQ ID NO: 223563 - RNA, 22 nt, Homo sapiens
uucacuguagccucagccucuu

SEQ ID NO: 223564 - RNA, 22 nt, Homo sapiens
uucacuguuaagcaguuaaacu

SEQ ID NO: 223565 - RNA, 20 nt, Homo sapiens
uucagcaaaggaaugggagu

SEQ ID NO: 223566 - RNA, 22 nt, Homo sapiens
uucagcaaugacagccuauaua

SEQ ID NO: 223567 - RNA, 22 nt, Homo sapiens
uucagcaguggccaguggaaau

SEQ ID NO: 223568 - RNA, 22 nt, Homo sapiens
uucagcuaccugggaugcugaa

SEQ ID NO: 223569 - RNA, 22 nt, Homo sapiens
uucagcuacuuggaaacagcaa

SEQ ID NO: 223570 - RNA, 22 nt, Homo sapiens
uucagcuacuugggaggcugaa

SEQ ID NO: 223571 - RNA, 22 nt, Homo sapiens
uucaggcuccgugccagcuccg

SEQ ID NO: 223572 - RNA, 22 nt, Homo sapiens
uucaggcuccugugagaaucua

SEQ ID NO: 223573 - RNA, 22 nt, Homo sapiens
uucagguaauuaugguuugucu

SEQ ID NO: 223574 - RNA, 22 nt, Homo sapiens
uucaguaaauguucuuacuaua

SEQ ID NO: 223575 - RNA, 22 nt, Homo sapiens
uucaguagucaaaagauaaggg

SEQ ID NO: 223576 - RNA, 22 nt, Homo sapiens
uucaguauugcaccuggagucc

SEQ ID NO: 223577 - RNA, 18 nt, Homo sapiens
uucagugaauucuuuuga

SEQ ID NO: 223578 - RNA, 22 nt, Homo sapiens
uucagugagacgaaaacaacaa

SEQ ID NO: 223579 - RNA, 20 nt, Homo sapiens
uucagugcagguaacaaucc

SEQ ID NO: 223580 - RNA, 21 nt, Homo sapiens
uucauaaggcuucucuccugu

SEQ ID NO: 223581 - RNA, 19 nt, Homo sapiens
uucauacagugagagcagc

SEQ ID NO: 223582 - RNA, 22 nt, Homo sapiens
uucauaguaacaguaacuaugg

SEQ ID NO: 223583 - RNA, 21 nt, Homo sapiens
uucauaugcacugagugccca

SEQ ID NO: 223584 - RNA, 18 nt, Homo sapiens
uucauauguugaaccaga

SEQ ID NO: 223585 - RNA, 21 nt, Homo sapiens
uucaucagccagaaaucaagc

SEQ ID NO: 223586 - RNA, 22 nt, Homo sapiens
uucaucagggagaaauaauuuc

SEQ ID NO: 223587 - RNA, 22 nt, Homo sapiens
uucaucagggguauuggccaau

SEQ ID NO: 223588 - RNA, 22 nt, Homo sapiens
uucaucaguuauauuggccuga

SEQ ID NO: 223589 - RNA, 22 nt, Homo sapiens
uucaucaguugagcugguugcu

SEQ ID NO: 223590 - RNA, 21 nt, Homo sapiens
uucaucuggccguauuccagg

SEQ ID NO: 223591 - RNA, 22 nt, Homo sapiens
uucauggauggaaaugauuuug

SEQ ID NO: 223592 - RNA, 22 nt, Homo sapiens
uucauggugguacaaaagcaau

SEQ ID NO: 223593 - RNA, 22 nt, Homo sapiens
uucauguaauauuucacagcuu

SEQ ID NO: 223594 - RNA, 22 nt, Homo sapiens
uucauguagucaucauccugcu

SEQ ID NO: 223595 - RNA, 22 nt, Homo sapiens
uucauuggacuuguguucuuga

SEQ ID NO: 223596 - RNA, 22 nt, Homo sapiens
uuccacaaugguugaacuagcu

SEQ ID NO: 223597 - RNA, 22 nt, Homo sapiens
uuccacaaugguugaacuaguu

SEQ ID NO: 223598 - RNA, 22 nt, Homo sapiens
uuccacuuuuuccuugugcucc

SEQ ID NO: 223599 - RNA, 22 nt, Homo sapiens
uuccaguguguucauccucaga

SEQ ID NO: 223600 - RNA, 22 nt, Homo sapiens
uuccaguuauuauaccucuuaa

SEQ ID NO: 223601 - RNA, 22 nt, Homo sapiens
uucccagagccugggagugagg

SEQ ID NO: 223602 - RNA, 22 nt, Homo sapiens
uucccaguaaacucuaucccuc

SEQ ID NO: 223603 - RNA, 22 nt, Homo sapiens
uucccagucaaacgaaggacuu

SEQ ID NO: 223604 - RNA, 22 nt, Homo sapiens
uucccagugccaggcacuggga

SEQ ID NO: 223605 - RNA, 22 nt, Homo sapiens
uucccuagaacacauggaggga

SEQ ID NO: 223606 - RNA, 22 nt, Homo sapiens
uucccucagaaacacacagccc

SEQ ID NO: 223607 - RNA, 20 nt, Homo sapiens
uucccucagccuugagggua

SEQ ID NO: 223608 - RNA, 22 nt, Homo sapiens
uucccugagcaucuguugagcc

SEQ ID NO: 223609 - RNA, 22 nt, Homo sapiens
uucccugugggcuggugcucca

SEQ ID NO: 223610 - RNA, 22 nt, Homo sapiens
uucccugugguauagaagccgu

SEQ ID NO: 223611 - RNA, 22 nt, Homo sapiens
uucccugugugcagaugggugu

SEQ ID NO: 223612 - RNA, 22 nt, Homo sapiens
uucccuuucuuaaagaguuagg

SEQ ID NO: 223613 - RNA, 22 nt, Homo sapiens
uuccuacuguucaucaggaacc

SEQ ID NO: 223614 - RNA, 22 nt, Homo sapiens
uuguacuauuuuuaucagugau

SEQ ID NO: 223615 - RNA, 20 nt, Homo sapiens
uuguacuccugggcucaagc

SEQ ID NO: 223616 - RNA, 22 nt, Homo sapiens
uuguacuucagacaugccaaag

SEQ ID NO: 223617 - RNA, 22 nt, Homo sapiens
uuguaguguuuauucugucaac

SEQ ID NO: 223618 - RNA, 22 nt, Homo sapiens
uuguauaguucuauguguuuug

SEQ ID NO: 223619 - RNA, 21 nt, Homo sapiens
uuguaugguugaacuugauac

SEQ ID NO: 223620 - RNA, 22 nt, Homo sapiens
uuguaugucuucauuugaaaaa

SEQ ID NO: 223621 - RNA, 22 nt, Homo sapiens
uugucaccucuaaaucucauau

SEQ ID NO: 223622 - RNA, 22 nt, Homo sapiens
uugucacugcacuccagucugg

SEQ ID NO: 223623 - RNA, 22 nt, Homo sapiens
uugucaguguucacucaaagcu

SEQ ID NO: 223624 - RNA, 22 nt, Homo sapiens
uugucccauggggucuuccuuu

SEQ ID NO: 223625 - RNA, 22 nt, Homo sapiens
uuguccccaucugcugccagaa

SEQ ID NO: 223626 - RNA, 22 nt, Homo sapiens
uuguccuggagguucuugcaag

SEQ ID NO: 223627 - RNA, 22 nt, Homo sapiens
uuguccuugagauaguuugcag

SEQ ID NO: 223628 - RNA, 22 nt, Homo sapiens
uugucucacuggaguuuaguaa

SEQ ID NO: 223629 - RNA, 22 nt, Homo sapiens
uugugaagaugugaagcaagca

SEQ ID NO: 223630 - RNA, 22 nt, Homo sapiens
uugugaaugaugccgcaauaaa

SEQ ID NO: 223631 - RNA, 22 nt, Homo sapiens
uugugaauggugccgcaauaaa

SEQ ID NO: 223632 - RNA, 22 nt, Homo sapiens
uugugaauggugccgcaguaaa

SEQ ID NO: 223633 - RNA, 22 nt, Homo sapiens
uugugaauggugccgcgauaaa

SEQ ID NO: 223634 - RNA, 22 nt, Homo sapiens
uugugacacagcugggccuaua

SEQ ID NO: 223635 - RNA, 22 nt, Homo sapiens
uugugagggagcuaagaugagu

SEQ ID NO: 223636 - RNA, 22 nt, Homo sapiens
uugugcaaaguugugguuucug

SEQ ID NO: 223637 - RNA, 22 nt, Homo sapiens
uugugcacauguacccuagaac

SEQ ID NO: 223638 - RNA, 22 nt, Homo sapiens
uugugcaugaugcauacauggu

SEQ ID NO: 223639 - RNA, 22 nt, Homo sapiens
uugugccccuucucagucgggc

SEQ ID NO: 223640 - RNA, 22 nt, Homo sapiens
uugugcuccagagacgggcucg

SEQ ID NO: 223641 - RNA, 22 nt, Homo sapiens
uugugcuucaucaccuagcaga

SEQ ID NO: 223642 - RNA, 22 nt, Homo sapiens
uugugcuugcuguguucuaugc

SEQ ID NO: 223643 - RNA, 22 nt, Homo sapiens
uugugcuuuacuuacuaccaga

SEQ ID NO: 223644 - RNA, 22 nt, Homo sapiens
uugugguaggaguugccauguu

SEQ ID NO: 223645 - RNA, 22 nt, Homo sapiens
uugugguaggcauguaagauga

SEQ ID NO: 223646 - RNA, 22 nt, Homo sapiens
uugugguugauacacguaggaa

SEQ ID NO: 223647 - RNA, 22 nt, Homo sapiens
uugugguuuuuaaaacuaggug

SEQ ID NO: 223648 - RNA, 22 nt, Homo sapiens
uugugucccuacccaaaucuca

SEQ ID NO: 223649 - RNA, 22 nt, Homo sapiens
uugugucccugcccaaaucuca

SEQ ID NO: 223650 - RNA, 22 nt, Homo sapiens
uugugucccugcggcugaggag

SEQ ID NO: 223651 - RNA, 22 nt, Homo sapiens
uuguuaagaugcagauucugga

SEQ ID NO: 223652 - RNA, 22 nt, Homo sapiens
uuguuaugggguggcuugaaag

SEQ ID NO: 223653 - RNA, 22 nt, Homo sapiens
uuguuauguaucucaagauaaa

SEQ ID NO: 223654 - RNA, 22 nt, Homo sapiens
uuuaaaguuagaaggaaagggc

SEQ ID NO: 223655 - RNA, 22 nt, Homo sapiens
uuuaaguguuuguuccugaaaa

SEQ ID NO: 223656 - RNA, 22 nt, Homo sapiens
uuuaaugcacuaggugguguuc

SEQ ID NO: 223657 - RNA, 22 nt, Homo sapiens
uuuaauguuacaguauugguau

SEQ ID NO: 223658 - RNA, 22 nt, Homo sapiens
uuuacagucuuuugugugaguc

SEQ ID NO: 223659 - RNA, 22 nt, Homo sapiens
uuuacugucuucagucccucug

SEQ ID NO: 223660 - RNA, 22 nt, Homo sapiens
uuuaggcaugcaguucuauuua

SEQ ID NO: 223661 - RNA, 22 nt, Homo sapiens
uuuagggcagggacaguucuuc

SEQ ID NO: 223662 - RNA, 22 nt, Homo sapiens
uuuaguacugcuuuaugugugu

SEQ ID NO: 223663 - RNA, 22 nt, Homo sapiens
uuuauagucaggaacuugagga

SEQ ID NO: 223664 - RNA, 22 nt, Homo sapiens
uuuauggcaugcucccucucaa

SEQ ID NO: 223665 - RNA, 22 nt, Homo sapiens
uuuauugcucuaaaguugccau

SEQ ID NO: 223666 - RNA, 22 nt, Homo sapiens
uuucaacuaauuuuuuggugag

SEQ ID NO: 223667 - RNA, 18 nt, Homo sapiens
uuucaagucuuaggugac

SEQ ID NO: 223668 - RNA, 19 nt, Homo sapiens
uuucaauguaaggauggag

SEQ ID NO: 223669 - RNA, 19 nt, Homo sapiens
uuucacacucgccuacuuc

SEQ ID NO: 223670 - RNA, 22 nt, Homo sapiens
uuucacagagggcuucuuucua

SEQ ID NO: 223671 - RNA, 21 nt, Homo sapiens
uuucacugugaguuuuucugu

SEQ ID NO: 223672 - RNA, 23 nt, Homo sapiens
uuucaggcaggugaaagaccagc

SEQ ID NO: 223673 - RNA, 22 nt, Homo sapiens
uuucagguauuuaagggccguu

SEQ ID NO: 223674 - RNA, 23 nt, Homo sapiens
uuucaguaguuguauccuguugc

SEQ ID NO: 223675 - RNA, 22 nt, Homo sapiens
uuucaucagccagggucagucu

SEQ ID NO: 223676 - RNA, 23 nt, Homo sapiens
uuucauggggauuuacucauucc

SEQ ID NO: 223677 - RNA, 18 nt, Homo sapiens
uuucauugagugugauau

SEQ ID NO: 223678 - RNA, 22 nt, Homo sapiens
uuuccacauggacuuaccuucg

SEQ ID NO: 223679 - RNA, 22 nt, Homo sapiens
uuuccagguggccaacauuuua

SEQ ID NO: 223680 - RNA, 22 nt, Homo sapiens
uuuccaguuguucuagaaagcu

SEQ ID NO: 223681 - RNA, 22 nt, Homo sapiens
uuucccagugguacaguuuaua

SEQ ID NO: 223682 - RNA, 22 nt, Homo sapiens
uuuccuggagaaucuuaacaaa

SEQ ID NO: 223683 - RNA, 22 nt, Homo sapiens
uuuccuguagggggcaaggccu

SEQ ID NO: 223684 - RNA, 22 nt, Homo sapiens
uuucuacagugaacgauuucua

SEQ ID NO: 223685 - RNA, 22 nt, Homo sapiens
uuucucaguguuucaggguagg

SEQ ID NO: 223686 - RNA, 22 nt, Homo sapiens
uuucugcuugagagaauugcug

SEQ ID NO: 223687 - RNA, 23 nt, Homo sapiens
uuucuugggcaugcuaugucagu

SEQ ID NO: 223688 - RNA, 22 nt, Homo sapiens
uuugaagcaauugugaauggga

SEQ ID NO: 223689 - RNA, 22 nt, Homo sapiens
uuugaagcuaaggugcuugguu

SEQ ID NO: 223690 - RNA, 22 nt, Homo sapiens
uuugagcauggaaauggcauga

SEQ ID NO: 223691 - RNA, 22 nt, Homo sapiens
uuugagcuugacucagcuggag

SEQ ID NO: 223692 - RNA, 22 nt, Homo sapiens
uuugaguaggcuuauauuuugg

SEQ ID NO: 223693 - RNA, 21 nt, Homo sapiens
uuugaucauuaaaagugaauc

SEQ ID NO: 223694 - RNA, 22 nt, Homo sapiens
uuugauugguguaccugaaagu

SEQ ID NO: 223695 - RNA, 22 nt, Homo sapiens
uuugauuguacuaaaauuguac

SEQ ID NO: 223696 - RNA, 22 nt, Homo sapiens
uuugcaagaugaaaaaguucua

SEQ ID NO: 223697 - RNA, 22 nt, Homo sapiens
uuugcaauagguuguggggagg

SEQ ID NO: 223698 - RNA, 22 nt, Homo sapiens
uuugcacuucugagugugacau

SEQ ID NO: 223699 - RNA, 21 nt, Homo sapiens
uuugcacuuugcaaaucccua

SEQ ID NO: 223700 - RNA, 22 nt, Homo sapiens
uuugcauaauaagauuagggug

SEQ ID NO: 223701 - RNA, 21 nt, Homo sapiens
uuugcauauguugaaccagcc

SEQ ID NO: 223702 - RNA, 22 nt, Homo sapiens
uuugcauauguugaaccagccu

SEQ ID NO: 223703 - RNA, 22 nt, Homo sapiens
uuugccaauauuuuauugagga

SEQ ID NO: 223704 - RNA, 22 nt, Homo sapiens
uuugcuuaguaaauguagaaaa

SEQ ID NO: 223705 - RNA, 22 nt, Homo sapiens
uuugcuucacuguuuggcaaaa

SEQ ID NO: 223706 - RNA, 22 nt, Homo sapiens
uuugcuugaggucuagcuaccc

SEQ ID NO: 223707 - RNA, 22 nt, Homo sapiens
uuuggaagaugccacuguauca

SEQ ID NO: 223708 - RNA, 22 nt, Homo sapiens
uuuggauagugugguccuuuua

SEQ ID NO: 223709 - RNA, 22 nt, Homo sapiens
uuuggcacuguaaauuucucuu

SEQ ID NO: 223710 - RNA, 22 nt, Homo sapiens
uuuggcagaugacccucaaguu

SEQ ID NO: 223711 - RNA, 22 nt, Homo sapiens
uuuggcauuaagaugcuguauc

SEQ ID NO: 223712 - RNA, 22 nt, Homo sapiens
uuuggcauuagagagacuugca

SEQ ID NO: 223713 - RNA, 23 nt, Homo sapiens
uuuggcauuccagaaauuuucau

SEQ ID NO: 223714 - RNA, 22 nt, Homo sapiens
uuuggcauuuaaauaugcaugg

SEQ ID NO: 223715 - RNA, 22 nt, Homo sapiens
uuuggcccccagcucaggacau

SEQ ID NO: 223716 - RNA, 22 nt, Homo sapiens
uuuggcuuugagaagcagugga

SEQ ID NO: 223717 - RNA, 22 nt, Homo sapiens
uuugggaaaugaaguugguaga

SEQ ID NO: 223718 - RNA, 22 nt, Homo sapiens
uuugggaaugguuugucuccca

SEQ ID NO: 223719 - RNA, 22 nt, Homo sapiens
uuugggcuuuuaaucuagagca

SEQ ID NO: 223720 - RNA, 22 nt, Homo sapiens
uuuggucuuuuguaaguuaucu

SEQ ID NO: 223721 - RNA, 22 nt, Homo sapiens
uuugguugccucuaugagccug

SEQ ID NO: 223722 - RNA, 22 nt, Homo sapiens
uuugguugucacaacuggggga

SEQ ID NO: 223723 - RNA, 22 nt, Homo sapiens
uuuguaauaccugaggcugggu

SEQ ID NO: 223724 - RNA, 22 nt, Homo sapiens
uuuguacacuguuggugguuau

SEQ ID NO: 223725 - RNA, 22 nt, Homo sapiens
uuuguacugagccaagauggua

SEQ ID NO: 223726 - RNA, 22 nt, Homo sapiens
uuuguacuucauacaauaacuc

SEQ ID NO: 223727 - RNA, 22 nt, Homo sapiens
uuuguacuugaaacccagggcc

SEQ ID NO: 223728 - RNA, 18 nt, Homo sapiens
uuuguacuuuuucuaaug

SEQ ID NO: 223729 - RNA, 22 nt, Homo sapiens
uuugucacccugaauguaagau

SEQ ID NO: 223730 - RNA, 22 nt, Homo sapiens
uuugucccccguaguucauaua

SEQ ID NO: 223731 - RNA, 22 nt, Homo sapiens
uuuguccugccaugguuuauuu

SEQ ID NO: 223732 - RNA, 22 nt, Homo sapiens
uuugucuccuaagacucugugg

SEQ ID NO: 223733 - RNA, 23 nt, Homo sapiens
uuugugacacucuccaucuccag

SEQ ID NO: 223734 - RNA, 22 nt, Homo sapiens
uuugugacucauggucuagugc

SEQ ID NO: 223735 - RNA, 22 nt, Homo sapiens
uuugugagguggauagauugca

SEQ ID NO: 223736 - RNA, 22 nt, Homo sapiens
uuugugcuaaugcuagauuacu

SEQ ID NO: 223737 - RNA, 18 nt, Homo sapiens
uuugugcuccacaaagga

SEQ ID NO: 223738 - RNA, 22 nt, Homo sapiens
uuugugcugcaauuaauuuccc

SEQ ID NO: 223739 - RNA, 22 nt, Homo sapiens
uuuguggaaugcucauguguag

SEQ ID NO: 223740 - RNA, 22 nt, Homo sapiens
uuuguguccccacccaaacauc

SEQ ID NO: 223741 - RNA, 23 nt, Homo sapiens
uuuguguccccacccaaaucuca

SEQ ID NO: 223742 - RNA, 22 nt, Homo sapiens
uuuguguccccacccacaucuc

SEQ ID NO: 223743 - RNA, 23 nt, Homo sapiens
uuugugucccucuagaauucaug

SEQ ID NO: 223744 - RNA, 22 nt, Homo sapiens
uuuguguggccuuggccuggca

SEQ ID NO: 223745 - RNA, 22 nt, Homo sapiens
uuuguucaccucaaggauggga

SEQ ID NO: 223746 - RNA, 22 nt, Homo sapiens
uuuuaagcuacaagagacauau

SEQ ID NO: 223747 - RNA, 22 nt, Homo sapiens
uuuuacacaucaccgcucgugu

SEQ ID NO: 223748 - RNA, 22 nt, Homo sapiens
uuuuacacuguugguuggaaug

SEQ ID NO: 223749 - RNA, 22 nt, Homo sapiens
uuuuagcagccaugacaaagau

SEQ ID NO: 223750 - RNA, 22 nt, Homo sapiens
uuuucaguuuuccagguagccg

SEQ ID NO: 223751 - RNA, 22 nt, Homo sapiens
uuuuccagugggacucccauua

SEQ ID NO: 223752 - RNA, 23 nt, Homo sapiens
uuuugcaauaagucacuggaaua

SEQ ID NO: 223753 - RNA, 22 nt, Homo sapiens
uuuugcaauauguuccugaaua

SEQ ID NO: 223754 - RNA, 20 nt, Homo sapiens
uuuugcacuccuacuaaggu

SEQ ID NO: 223755 - RNA, 22 nt, Homo sapiens
uuuugcaggcauuggaaguuua

SEQ ID NO: 223756 - RNA, 19 nt, Homo sapiens
uuuugcucuuuauaccuau

SEQ ID NO: 223757 - RNA, 22 nt, Homo sapiens
uuuugcuugugaauagccacau

SEQ ID NO: 223758 - RNA, 22 nt, Homo sapiens
uuuugcuuuuccucggucccac

SEQ ID NO: 223759 - RNA, 19 nt, Homo sapiens
uuuuggaaaugugaacagc

SEQ ID NO: 223760 - RNA, 22 nt, Homo sapiens
uuuuggcuuaaagagaauguau

SEQ ID NO: 223761 - RNA, 20 nt, Homo sapiens
uuuuggcuuaaagcagucug

SEQ ID NO: 223762 - RNA, 22 nt, Homo sapiens
uuuugguaaugaacuuaggaag

SEQ ID NO: 223763 - RNA, 22 nt, Homo sapiens
uuuugguauacacaaggguccu

SEQ ID NO: 223764 - RNA, 22 nt, Homo sapiens
uuuugguauauacggggguccu

SEQ ID NO: 223765 - RNA, 22 nt, Homo sapiens
uuuugguauaugcaggggucuu

SEQ ID NO: 223766 - RNA, 21 nt, Homo sapiens
uuuuggucauucaggaagaaa

SEQ ID NO: 223767 - RNA, 22 nt, Homo sapiens
uuuuggugguuaugugucaaug

SEQ ID NO: 223768 - RNA, 22 nt, Homo sapiens
uuuugguuguuggguaagagua

SEQ ID NO: 223769 - RNA, 22 nt, Homo sapiens
uuuugugcauggcccaguggua

SEQ ID NO: 223770 - RNA, 22 nt, Homo sapiens
uuuuugagaauuggugaaacac

SEQ ID NO: 223771 - RNA, 22 nt, Homo sapiens
uuuuugagguauaguguggcua

SEQ ID NO: 223772 - RNA, 22 nt, Homo sapiens
uuuuugaguaaauauaaauugu

SEQ ID NO: 223773 - RNA, 16 nt, Homo sapiens
uuuuugcagaaaugac

SEQ ID NO: 223774 - RNA, 22 nt, Homo sapiens
uuuuuggguaaugauuaucaau

SEQ ID NO: 223775 - RNA, 22 nt, Homo sapiens
aaugccaucagagaaaacucuu

SEQ ID NO: 223776 - RNA, 22 nt, Homo sapiens
aauggcacaagacaugaagaag

SEQ ID NO: 223777 - RNA, 22 nt, Homo sapiens
aauggcacaagaguaaacuguu

SEQ ID NO: 223778 - RNA, 22 nt, Homo sapiens
aauggcacuuuauaaauguuaa

SEQ ID NO: 223779 - RNA, 22 nt, Homo sapiens
aauggccuuuuucauuauacug

SEQ ID NO: 223780 - RNA, 18 nt, Homo sapiens
aauggcucuggguucuaa

SEQ ID NO: 223781 - RNA, 18 nt, Homo sapiens
aaugggacuacaaagcca

SEQ ID NO: 223782 - RNA, 22 nt, Homo sapiens
aauggguaguacugugguaaca

SEQ ID NO: 223783 - RNA, 22 nt, Homo sapiens
aaugucaucuucaguuguacag

SEQ ID NO: 223784 - RNA, 22 nt, Homo sapiens
aaugugcuguucagaggagucc

SEQ ID NO: 223785 - RNA, 22 nt, Homo sapiens
aaugugcuuucuuucacacagu

SEQ ID NO: 223786 - RNA, 22 nt, Homo sapiens
aauuacuucuacaccaaccuaa

SEQ ID NO: 223787 - RNA, 22 nt, Homo sapiens
aauucacuuguggcagauccuu

SEQ ID NO: 223788 - RNA, 22 nt, Homo sapiens
aauugcacuggaaguaacugag

SEQ ID NO: 223789 - RNA, 22 nt, Homo sapiens
aauuggcagugcucuugccaca

SEQ ID NO: 223790 - RNA, 22 nt, Homo sapiens
acaaaguaggcagugggcugga

SEQ ID NO: 223791 - RNA, 22 nt, Homo sapiens
acaaaguguuuucugaaggccu

SEQ ID NO: 223792 - RNA, 20 nt, Homo sapiens
acaaaugcauucugugacau

SEQ ID NO: 223793 - RNA, 22 nt, Homo sapiens
acaaccauuguaagggcuuugg

SEQ ID NO: 223794 - RNA, 22 nt, Homo sapiens
acaagcacaaaugcauagaugg

SEQ ID NO: 223795 - RNA, 22 nt, Homo sapiens
acacaguaaauauugucuccuc

SEQ ID NO: 223796 - RNA, 22 nt, Homo sapiens
acacaguauaugacaaugcuuu

SEQ ID NO: 223797 - RNA, 22 nt, Homo sapiens
acacagugucuguguauuuaaa

SEQ ID NO: 223798 - RNA, 22 nt, Homo sapiens
acacauacacauaugguguaua

SEQ ID NO: 223799 - RNA, 22 nt, Homo sapiens
acaccaguacuuuauacaagca

SEQ ID NO: 223800 - RNA, 22 nt, Homo sapiens
acaccaugucuguuucugguuu

SEQ ID NO: 223801 - RNA, 22 nt, Homo sapiens
acaccauugcauuccagccugg

SEQ ID NO: 223802 - RNA, 22 nt, Homo sapiens
acacgugcguauauguacguau

SEQ ID NO: 223803 - RNA, 20 nt, Homo sapiens
acacuggaguaucaaggccc

SEQ ID NO: 223804 - RNA, 22 nt, Homo sapiens
acacuggaguuaaaggugauuu

SEQ ID NO: 223805 - RNA, 22 nt, Homo sapiens
acacugucaugucucacaggca

SEQ ID NO: 223806 - RNA, 22 nt, Homo sapiens
acagccauuccagccaaauacu

SEQ ID NO: 223807 - RNA, 19 nt, Homo sapiens
acagcugguuuugguuucu

SEQ ID NO: 223808 - RNA, 19 nt, Homo sapiens
acaguaccuggcaugaggu

SEQ ID NO: 223809 - RNA, 22 nt, Homo sapiens
acaguagcgcaaucucggcuca

SEQ ID NO: 223810 - RNA, 22 nt, Homo sapiens
acaguaugcuuuaaacuuuguu

SEQ ID NO: 223811 - RNA, 23 nt, Homo sapiens
acaguauguggauguggcuaagu

SEQ ID NO: 223812 - RNA, 22 nt, Homo sapiens
acagucauagcagccuuuguua

SEQ ID NO: 223813 - RNA, 22 nt, Homo sapiens
acagugacagaaagcugauuau

SEQ ID NO: 223814 - RNA, 22 nt, Homo sapiens
acagugcuguuguguuuucacg

SEQ ID NO: 223815 - RNA, 22 nt, Homo sapiens
acagugcuuucaauguucagua

SEQ ID NO: 223816 - RNA, 17 nt, Homo sapiens
acagugcuuugcuuucc

SEQ ID NO: 223817 - RNA, 19 nt, Homo sapiens
acagugcuuugucagaagc

SEQ ID NO: 223818 - RNA, 22 nt, Homo sapiens
acagugcuuuuguuccucuccu

SEQ ID NO: 223819 - RNA, 22 nt, Homo sapiens
acaguggugcgaucucggcuca

SEQ ID NO: 223820 - RNA, 18 nt, Homo sapiens
acagugucauggcucaau

SEQ ID NO: 223821 - RNA, 21 nt, Homo sapiens
acaucagaguugugaagguag

SEQ ID NO: 223822 - RNA, 22 nt, Homo sapiens
acaucauugggggcuacaggug

SEQ ID NO: 223823 - RNA, 22 nt, Homo sapiens
acaucccuugcucggggccccu

SEQ ID NO: 223824 - RNA, 17 nt, Homo sapiens
acaugagacuggauucu

SEQ ID NO: 223825 - RNA, 22 nt, Homo sapiens
acaugcaucauuaggugguuua

SEQ ID NO: 223826 - RNA, 19 nt, Homo sapiens
acauggauuuugugcaaac

SEQ ID NO: 223827 - RNA, 23 nt, Homo sapiens
acauguauagacuuuuuuuccuu

SEQ ID NO: 223828 - RNA, 22 nt, Homo sapiens
acauugcagauguguuuaaugu

SEQ ID NO: 223829 - RNA, 22 nt, Homo sapiens
accacaggguaaaguuagauau

SEQ ID NO: 223830 - RNA, 22 nt, Homo sapiens
accaccacucccgcauucuaaa

SEQ ID NO: 223831 - RNA, 19 nt, Homo sapiens
accagauugcauucuugga

SEQ ID NO: 223832 - RNA, 22 nt, Homo sapiens
accaguguuuaccaaguagcau

SEQ ID NO: 223833 - RNA, 22 nt, Homo sapiens
accaguuuuuuauacaucuucu

SEQ ID NO: 223834 - RNA, 22 nt, Homo sapiens
accaugcaguccaauaugcaca

SEQ ID NO: 223835 - RNA, 22 nt, Homo sapiens
acccagaauucagucuuaggcc

SEQ ID NO: 223836 - RNA, 22 nt, Homo sapiens
acccaguguucaacauucacau

SEQ ID NO: 223837 - RNA, 22 nt, Homo sapiens
acccauacacacauauuuaugu

SEQ ID NO: 223838 - RNA, 23 nt, Homo sapiens
accccuacaggcuuguguccugc

SEQ ID NO: 223839 - RNA, 22 nt, Homo sapiens
acccggagagcaggcgagaagg

SEQ ID NO: 223840 - RNA, 22 nt, Homo sapiens
acccgugcugaauauguaggug

SEQ ID NO: 223841 - RNA, 22 nt, Homo sapiens
acccugugagagaguuaauauu

SEQ ID NO: 223842 - RNA, 23 nt, Homo sapiens
accugauguuucuguggggagcc

SEQ ID NO: 223843 - RNA, 22 nt, Homo sapiens
accugcacagccgaacauagac

SEQ ID NO: 223844 - RNA, 22 nt, Homo sapiens
accuggcacuuagcaaaucuga

SEQ ID NO: 223845 - RNA, 22 nt, Homo sapiens
accugguuuucucacaguggcu

SEQ ID NO: 223846 - RNA, 22 nt, Homo sapiens
acgcagcacauucacagcuaug

SEQ ID NO: 223847 - RNA, 22 nt, Homo sapiens
acguaguagguuuauaauauua

SEQ ID NO: 223848 - RNA, 22 nt, Homo sapiens
acuauacuguaacuguauucag

SEQ ID NO: 223849 - RNA, 22 nt, Homo sapiens
acuaugcuuuucuuagaauuaa

SEQ ID NO: 223850 - RNA, 22 nt, Homo sapiens
acuccauuucauuuuagcucuu

SEQ ID NO: 223851 - RNA, 22 nt, Homo sapiens
acuccauuuccagagcagcccc

SEQ ID NO: 223852 - RNA, 22 nt, Homo sapiens
acucuguauaaacauugcugua

SEQ ID NO: 223853 - RNA, 22 nt, Homo sapiens
acugagccuuuaaaugacuuca

SEQ ID NO: 223854 - RNA, 19 nt, Homo sapiens
acugagcuaccugggggca

SEQ ID NO: 223855 - RNA, 22 nt, Homo sapiens
acugagucauugggugcccaga

SEQ ID NO: 223856 - RNA, 19 nt, Homo sapiens
acugcacuccaaccuccug

SEQ ID NO: 223857 - RNA, 22 nt, Homo sapiens
acugcacuccagcccaggugac

SEQ ID NO: 223858 - RNA, 22 nt, Homo sapiens
acugcacuccagccuaggcgac

SEQ ID NO: 223859 - RNA, 22 nt, Homo sapiens
acugcacuccagccucccgucu

SEQ ID NO: 223860 - RNA, 22 nt, Homo sapiens
acugcacuccagccucgcaaca

SEQ ID NO: 223861 - RNA, 22 nt, Homo sapiens
acugcacuccagccucggugac

SEQ ID NO: 223862 - RNA, 22 nt, Homo sapiens
acugcacuccagccucgugaca

SEQ ID NO: 223863 - RNA, 22 nt, Homo sapiens
acugcacuccagccugcccaac

SEQ ID NO: 223864 - RNA, 22 nt, Homo sapiens
acugcacuccagccugcuggca

SEQ ID NO: 223865 - RNA, 22 nt, Homo sapiens
acugcacuccagccugugagac

SEQ ID NO: 223866 - RNA, 22 nt, Homo sapiens
acugcacuccagccuuagugac

SEQ ID NO: 223867 - RNA, 20 nt, Homo sapiens
acugcacuccagccuuccag

SEQ ID NO: 223868 - RNA, 22 nt, Homo sapiens
acugcacuccagccuuugcgau

SEQ ID NO: 223869 - RNA, 20 nt, Homo sapiens
acugcacuccaggcugccca

SEQ ID NO: 223870 - RNA, 20 nt, Homo sapiens
acugcacuccagucucuggg

SEQ ID NO: 223871 - RNA, 18 nt, Homo sapiens
acugcacuccauccuagg

SEQ ID NO: 223872 - RNA, 22 nt, Homo sapiens
acugcacuccggccucgugaca

SEQ ID NO: 223873 - RNA, 22 nt, Homo sapiens
acugcacuccuccuugggugac

SEQ ID NO: 223874 - RNA, 18 nt, Homo sapiens
gauaacaguggacuaugc

SEQ ID NO: 223875 - RNA, 22 nt, Homo sapiens
gauaagagaugauuuugccaug

SEQ ID NO: 223876 - RNA, 22 nt, Homo sapiens
gauagcagccauucuuuuuauu

SEQ ID NO: 223877 - RNA, 22 nt, Homo sapiens
gauagguucuaagcagguguug

SEQ ID NO: 223878 - RNA, 22 nt, Homo sapiens
gauaucuuuuguauggugagcu

SEQ ID NO: 223879 - RNA, 21 nt, Homo sapiens
gauaugacauggguaaaacca

SEQ ID NO: 223880 - RNA, 22 nt, Homo sapiens
gauauguuagggggagaaguua

SEQ ID NO: 223881 - RNA, 22 nt, Homo sapiens
gauauguucugagaaaugcauu

SEQ ID NO: 223882 - RNA, 22 nt, Homo sapiens
gaucacaugggagaaugagagu

SEQ ID NO: 223883 - RNA, 22 nt, Homo sapiens
gaucacauguguacucaaugug

SEQ ID NO: 223884 - RNA, 22 nt, Homo sapiens
gaucacuuugaugccaggaacu

SEQ ID NO: 223885 - RNA, 20 nt, Homo sapiens
gaucaguuuggaguaagugc

SEQ ID NO: 223886 - RNA, 22 nt, Homo sapiens
gaucuggucuuugauuagacac

SEQ ID NO: 223887 - RNA, 22 nt, Homo sapiens
gaucuguguuuguaugcauaag

SEQ ID NO: 223888 - RNA, 22 nt, Homo sapiens
gaucuguuguuuggaaguauca

SEQ ID NO: 223889 - RNA, 22 nt, Homo sapiens
gaugacacugggucaaaucuca

SEQ ID NO: 223890 - RNA, 22 nt, Homo sapiens
gaugacagcugacucccuugcu

SEQ ID NO: 223891 - RNA, 22 nt, Homo sapiens
gaugaggcuagagacaugugua

SEQ ID NO: 223892 - RNA, 22 nt, Homo sapiens
gaugaugcuagguguuagggcu

SEQ ID NO: 223893 - RNA, 22 nt, Homo sapiens
gaugcaguaagaaugcauagcg

SEQ ID NO: 223894 - RNA, 22 nt, Homo sapiens
gaugccuuuuuguccucaguua

SEQ ID NO: 223895 - RNA, 22 nt, Homo sapiens
gauggaguaauguaaucuugag

SEQ ID NO: 223896 - RNA, 22 nt, Homo sapiens
gauggcacuaagccauguagga

SEQ ID NO: 223897 - RNA, 22 nt, Homo sapiens
gauggcacuguagcaacacaaa

SEQ ID NO: 223898 - RNA, 22 nt, Homo sapiens
gauggcauuucuggaucugccc

SEQ ID NO: 223899 - RNA, 22 nt, Homo sapiens
gaugguuuuucuccgauuuaua

SEQ ID NO: 223900 - RNA, 22 nt, Homo sapiens
gauguaggugcauuugcacgug

SEQ ID NO: 223901 - RNA, 22 nt, Homo sapiens
aagaggcuguaggauaaugccu

SEQ ID NO: 223902 - RNA, 22 nt, Homo sapiens
aagagguaauaacaaagcuucu

SEQ ID NO: 223903 - RNA, 22 nt, Homo sapiens
aagagguagcagucacaaaaga

SEQ ID NO: 223904 - RNA, 23 nt, Homo sapiens
aagagguaugacuaugaagugga

SEQ ID NO: 223905 - RNA, 22 nt, Homo sapiens
aagagguuuaacugacucacag

SEQ ID NO: 223906 - RNA, 22 nt, Homo sapiens
aagauauguuaguuauaaacuc

SEQ ID NO: 223907 - RNA, 22 nt, Homo sapiens
aagaugauguucuuuuucuuag

SEQ ID NO: 223908 - RNA, 22 nt, Homo sapiens
aagcaggugucugugucuguaa

SEQ ID NO: 223909 - RNA, 22 nt, Homo sapiens
aagcaucacuggaggcagccau

SEQ ID NO: 223910 - RNA, 20 nt, Homo sapiens
aagcauggguuuuaggguca

SEQ ID NO: 223911 - RNA, 21 nt, Homo sapiens
aagcaugguguaucuuuccau

SEQ ID NO: 223912 - RNA, 22 nt, Homo sapiens
aagcuaccauuuguauauaaag

SEQ ID NO: 223913 - RNA, 22 nt, Homo sapiens
aagcucuuguugaaucuuguca

SEQ ID NO: 223914 - RNA, 22 nt, Homo sapiens
aagcuggcauucauucguucuu

SEQ ID NO: 223915 - RNA, 22 nt, Homo sapiens
aagcuguugguggaucuaccau

SEQ ID NO: 223916 - RNA, 22 nt, Homo sapiens
aaggaagcuagcaggaauuggu

SEQ ID NO: 223917 - RNA, 22 nt, Homo sapiens
aaggaguagaggaauagcaaug

SEQ ID NO: 223918 - RNA, 22 nt, Homo sapiens
aaggcaagaagagaaccaucgg

SEQ ID NO: 223919 - RNA, 22 nt, Homo sapiens
aaggcacugaacuuaaauucug

SEQ ID NO: 223920 - RNA, 22 nt, Homo sapiens
aaggcauucucaaacuaguucu

SEQ ID NO: 223921 - RNA, 22 nt, Homo sapiens
aaggcgguguggauccuacagc

SEQ ID NO: 223922 - RNA, 22 nt, Homo sapiens
aaggcucuuucaacguaaauua

SEQ ID NO: 223923 - RNA, 22 nt, Homo sapiens
aaggcuguucauuuagcacagu

SEQ ID NO: 223924 - RNA, 22 nt, Homo sapiens
aagggagcugcauaaucuugug

SEQ ID NO: 223925 - RNA, 22 nt, Homo sapiens
aagguacuggaaagaggaaugg

SEQ ID NO: 223926 - RNA, 22 nt, Homo sapiens
aagguagguuccaaaauaccua

SEQ ID NO: 223927 - RNA, 22 nt, Homo sapiens
aagguaguuagaaaauauaacu

SEQ ID NO: 223928 - RNA, 22 nt, Homo sapiens
aaggucauugugguuuuugcca

SEQ ID NO: 223929 - RNA, 22 nt, Homo sapiens
aaggugcuguaagcauccaugu

SEQ ID NO: 223930 - RNA, 18 nt, Homo sapiens
aaggugcuucuguucuga

SEQ ID NO: 223931 - RNA, 21 nt, Homo sapiens
aagguuuuuagugcuugacuu

SEQ ID NO: 223932 - RNA, 22 nt, Homo sapiens
aaguaaacauuuuguacaauaa

SEQ ID NO: 223933 - RNA, 22 nt, Homo sapiens
aaguaaaucuuaugucagggag

SEQ ID NO: 223934 - RNA, 22 nt, Homo sapiens
aaguaauugagguuuuugcugu

SEQ ID NO: 223935 - RNA, 22 nt, Homo sapiens
aaguagcagaggcaagacuuga

SEQ ID NO: 223936 - RNA, 22 nt, Homo sapiens
aaguauguaucaagucauacuu

SEQ ID NO: 223937 - RNA, 22 nt, Homo sapiens
aaguauuagugaggauauggaa

SEQ ID NO: 223938 - RNA, 22 nt, Homo sapiens
aagucaaggagagaagcuucag

SEQ ID NO: 223939 - RNA, 22 nt, Homo sapiens
aagucaaggagagaggcgucag

SEQ ID NO: 223940 - RNA, 22 nt, Homo sapiens
aagucauggaggaguaugugag

SEQ ID NO: 223941 - RNA, 22 nt, Homo sapiens
aaguccaugaagucuugugggu

SEQ ID NO: 223942 - RNA, 22 nt, Homo sapiens
aagugaaugugcuggaauagcu

SEQ ID NO: 223943 - RNA, 22 nt, Homo sapiens
aagugaccuaacaaugaaggcc

SEQ ID NO: 223944 - RNA, 22 nt, Homo sapiens
aagugacuagacuaugaaaccu

SEQ ID NO: 223945 - RNA, 22 nt, Homo sapiens
aagugcaaaucuguggcugaaa

SEQ ID NO: 223946 - RNA, 22 nt, Homo sapiens
aagugcccuauuuggcccuuga

SEQ ID NO: 223947 - RNA, 20 nt, Homo sapiens
aagugcuauuucuuuugugg

SEQ ID NO: 223948 - RNA, 22 nt, Homo sapiens
aagugcucuugaaacugccuua

SEQ ID NO: 223949 - RNA, 22 nt, Homo sapiens
aagugcucuugaaacugucuua

SEQ ID NO: 223950 - RNA, 22 nt, Homo sapiens
aagugcuguaugggagccuagg

SEQ ID NO: 223951 - RNA, 22 nt, Homo sapiens
aagugcuguccuaccuuuggga

SEQ ID NO: 223952 - RNA, 22 nt, Homo sapiens
aagugcuuacagggaacaugau

SEQ ID NO: 223953 - RNA, 20 nt, Homo sapiens
aagugcuuccuuuuagaggg

SEQ ID NO: 223954 - RNA, 22 nt, Homo sapiens
aaguggccuagagcgaccauuu

SEQ ID NO: 223955 - RNA, 22 nt, Homo sapiens
aagugguguuuguauuuaugca

SEQ ID NO: 223956 - RNA, 23 nt, Homo sapiens
aaguucaugcucaucuguuacac

SEQ ID NO: 223957 - RNA, 22 nt, Homo sapiens
aaguugcuuuagguaagucaau

SEQ ID NO: 223958 - RNA, 22 nt, Homo sapiens
uagguucuccacagguucucca

SEQ ID NO: 223959 - RNA, 22 nt, Homo sapiens
uagguugucaucagucuccacu

SEQ ID NO: 223960 - RNA, 22 nt, Homo sapiens
uagguuguccaucucuagaagc

SEQ ID NO: 223961 - RNA, 22 nt, Homo sapiens
uagguugucuguucacucugau

SEQ ID NO: 223962 - RNA, 22 nt, Homo sapiens
uaguaaacauuuuucuaucauu

SEQ ID NO: 223963 - RNA, 22 nt, Homo sapiens
uaguacuggcauguauuuccca

SEQ ID NO: 223964 - RNA, 18 nt, Homo sapiens
uaguacuguucucaugau

SEQ ID NO: 223965 - RNA, 22 nt, Homo sapiens
uaguaucacauggucuuaauua

SEQ ID NO: 223966 - RNA, 22 nt, Homo sapiens
uagucccauaugauuuagugaa

SEQ ID NO: 223967 - RNA, 21 nt, Homo sapiens
uagugcagugggguaugacuu

SEQ ID NO: 223968 - RNA, 22 nt, Homo sapiens
uagugcccuuauaagagcagga

SEQ ID NO: 223969 - RNA, 22 nt, Homo sapiens
uagugcuguaauucuaaugaaa

SEQ ID NO: 223970 - RNA, 22 nt, Homo sapiens
uagugcugugauaaacauauau

SEQ ID NO: 223971 - RNA, 22 nt, Homo sapiens
uagugcugugauuaacauaaug

SEQ ID NO: 223972 - RNA, 20 nt, Homo sapiens
uaguggcaugcaccuguagc

SEQ ID NO: 223973 - RNA, 22 nt, Homo sapiens
uaguucauuuuucuugcuuaga

SEQ ID NO: 223974 - RNA, 22 nt, Homo sapiens
uauaacacccacauauagucuu

SEQ ID NO: 223975 - RNA, 22 nt, Homo sapiens
uauaaugcacauucccaaaucu

SEQ ID NO: 223976 - RNA, 22 nt, Homo sapiens
uauacaguaggcacucaguggc

SEQ ID NO: 223977 - RNA, 22 nt, Homo sapiens
uauagagguagguuaauuggaa

SEQ ID NO: 223978 - RNA, 22 nt, Homo sapiens
uauagcacugagaauguaauuc

SEQ ID NO: 223979 - RNA, 22 nt, Homo sapiens
uauagcuugauuauggugaugg

SEQ ID NO: 223980 - RNA, 22 nt, Homo sapiens
uauaguguuuucaaaaguaugu

SEQ ID NO: 223981 - RNA, 22 nt, Homo sapiens
uauauaagcugaugagccacaa

SEQ ID NO: 223982 - RNA, 22 nt, Homo sapiens
uauauagcuaugucuguccauu

SEQ ID NO: 223983 - RNA, 21 nt, Homo sapiens
uauaugacuuacuauugccuc

SEQ ID NO: 223984 - RNA, 22 nt, Homo sapiens
uauaugcauugugggguacuga

SEQ ID NO: 223985 - RNA, 22 nt, Homo sapiens
uaucaacaggguggccagugua

SEQ ID NO: 223986 - RNA, 22 nt, Homo sapiens
uaucaaggccacucauuuuaug

SEQ ID NO: 223987 - RNA, 22 nt, Homo sapiens
uaucaaucuagggaaacuccaa

SEQ ID NO: 223988 - RNA, 22 nt, Homo sapiens
uaucacaaacuuagcaguuuaa

SEQ ID NO: 223989 - RNA, 22 nt, Homo sapiens
uaucacagcauugucuauaaua

SEQ ID NO: 223990 - RNA, 22 nt, Homo sapiens
uaucacagcgggguguacaccc

SEQ ID NO: 223991 - RNA, 22 nt, Homo sapiens
uaucacaggucaggaaccuugu

SEQ ID NO: 223992 - RNA, 22 nt, Homo sapiens
uaucacaguagaacucuuucca

SEQ ID NO: 223993 - RNA, 20 nt, Homo sapiens
uaucacaguucaggaacucu

SEQ ID NO: 223994 - RNA, 20 nt, Homo sapiens
uaucacauggggagaaaccu

SEQ ID NO: 223995 - RNA, 21 nt, Homo sapiens
uaucacauuggugauuaaguu

SEQ ID NO: 223996 - RNA, 22 nt, Homo sapiens
uaucaccuugcaggagcuauga

SEQ ID NO: 223997 - RNA, 19 nt, Homo sapiens
uaucacuucccuggaaaca

SEQ ID NO: 223998 - RNA, 21 nt, Homo sapiens
uaucagagacauugagaggca

SEQ ID NO: 223999 - RNA, 22 nt, Homo sapiens
ucacauuguuauguaaauguuu

SEQ ID NO: 224000 - RNA, 22 nt, Homo sapiens
ucaccaguacuccaaauugagg

SEQ ID NO: 224001 - RNA, 22 nt, Homo sapiens
ucaccagugucagggaacugcu

SEQ ID NO: 224002 - RNA, 22 nt, Homo sapiens
ucacccacacaggagacaggga

SEQ ID NO: 224003 - RNA, 22 nt, Homo sapiens
ucaccgugaauuaacaacacuu

SEQ ID NO: 224004 - RNA, 22 nt, Homo sapiens
ucaccuggggaucuuguuuaca

SEQ ID NO: 224005 - RNA, 21 nt, Homo sapiens
ucaccuguagcugcauguucu

SEQ ID NO: 224006 - RNA, 21 nt, Homo sapiens
ucaccuguugcgaugaagcug

SEQ ID NO: 224007 - RNA, 18 nt, Homo sapiens
ucaccuugaugcuggguc

SEQ ID NO: 224008 - RNA, 18 nt, Homo sapiens
ucacggggagcagcagcc

SEQ ID NO: 224009 - RNA, 19 nt, Homo sapiens
ucacgugcagcagccacac

SEQ ID NO: 224010 - RNA, 22 nt, Homo sapiens
ucacucagaccuggugauaugc

SEQ ID NO: 224011 - RNA, 22 nt, Homo sapiens
ucacugaaaccacugccuccug

SEQ ID NO: 224012 - RNA, 22 nt, Homo sapiens
ucacugaaaccuccaccucucg

SEQ ID NO: 224013 - RNA, 22 nt, Homo sapiens
ucacugaaaccuccgccuucug

SEQ ID NO: 224014 - RNA, 22 nt, Homo sapiens
ucacugaaacuguccuggguua

SEQ ID NO: 224015 - RNA, 21 nt, Homo sapiens
ucacugagcaucaugguuuca

SEQ ID NO: 224016 - RNA, 22 nt, Homo sapiens
ucacugaggucugagcuuuaug

SEQ ID NO: 224017 - RNA, 22 nt, Homo sapiens
ucacuggagauagcaaucuggu

SEQ ID NO: 224018 - RNA, 22 nt, Homo sapiens
ucacuggagguuccugaaguuc

SEQ ID NO: 224019 - RNA, 22 nt, Homo sapiens
ucacuggcaaauauauccguug

SEQ ID NO: 224020 - RNA, 22 nt, Homo sapiens
ucacugggagcauuugagccuu

SEQ ID NO: 224021 - RNA, 20 nt, Homo sapiens
ucacuggguucuugaagucu

SEQ ID NO: 224022 - RNA, 22 nt, Homo sapiens
ucacugugagaguuuauccugu

SEQ ID NO: 224023 - RNA, 22 nt, Homo sapiens
ucacugugguuuugaugugcau

SEQ ID NO: 224024 - RNA, 22 nt, Homo sapiens
ucacuguugaugggcaugcagg

SEQ ID NO: 224025 - RNA, 22 nt, Homo sapiens
ucacuuggugaacacauuaugu

SEQ ID NO: 224026 - RNA, 22 nt, Homo sapiens
ucacuuuggguacuauggaaau

SEQ ID NO: 224027 - RNA, 22 nt, Homo sapiens
ucagaguagagcgacuucuccu

SEQ ID NO: 224028 - RNA, 22 nt, Homo sapiens
ucagaguagcugucugaggugc

SEQ ID NO: 224029 - RNA, 22 nt, Homo sapiens
ucagagucuagaucacucacug

SEQ ID NO: 224030 - RNA, 22 nt, Homo sapiens
ucagagugcagggaguagcagc

SEQ ID NO: 224031 - RNA, 22 nt, Homo sapiens
ucagaucauauucuucgcugcu

SEQ ID NO: 224032 - RNA, 22 nt, Homo sapiens
ucagaugaugucccuguucuaa

SEQ ID NO: 224033 - RNA, 22 nt, Homo sapiens
ucagauguuugagaaguauacu

SEQ ID NO: 224034 - RNA, 22 nt, Homo sapiens
ucagauuggugcaaaaguaauu

SEQ ID NO: 224035 - RNA, 22 nt, Homo sapiens
ucagcacauucaaggccugccu

SEQ ID NO: 224036 - RNA, 22 nt, Homo sapiens
ucagcaccauguaacaauugau

SEQ ID NO: 224037 - RNA, 22 nt, Homo sapiens
ucagcagugccccacucuacug

SEQ ID NO: 224038 - RNA, 22 nt, Homo sapiens
ucagcaguggacagaaugguag

SEQ ID NO: 224039 - RNA, 22 nt, Homo sapiens
ucagcgcauggucgugcggcau

SEQ ID NO: 224040 - RNA, 22 nt, Homo sapiens
ucagguaaucuauuugucuuuu

SEQ ID NO: 224041 - RNA, 22 nt, Homo sapiens
ucagguagcauuuuggaaacag

SEQ ID NO: 224042 - RNA, 22 nt, Homo sapiens
ucagguaguuugugggagauga

SEQ ID NO: 224043 - RNA, 22 nt, Homo sapiens
ucagguccuuacugugcucccu

SEQ ID NO: 224044 - RNA, 22 nt, Homo sapiens
ucaggugccuuggcuaauuguu

SEQ ID NO: 224045 - RNA, 23 nt, Homo sapiens
ucaguacuccacuuucaauagug

SEQ ID NO: 224046 - RNA, 22 nt, Homo sapiens
ucaguagagacaggauuucacc

SEQ ID NO: 224047 - RNA, 22 nt, Homo sapiens
ucaguaguaaauggauuuggaa

SEQ ID NO: 224048 - RNA, 22 nt, Homo sapiens
ucaguauaugaaucuggggcag

SEQ ID NO: 224049 - RNA, 22 nt, Homo sapiens
ucagucuuuuaccauuaaguau

SEQ ID NO: 224050 - RNA, 22 nt, Homo sapiens
ucagugaauguuggccacuacu

SEQ ID NO: 224051 - RNA, 22 nt, Homo sapiens
ucagugacuggguauuaaauca

SEQ ID NO: 224052 - RNA, 22 nt, Homo sapiens
cccagugguuacauaaggagua

SEQ ID NO: 224053 - RNA, 22 nt, Homo sapiens
cccagugugaacuuggcauuuu

SEQ ID NO: 224054 - RNA, 20 nt, Homo sapiens
ccccaguuuuucuauuagcu

SEQ ID NO: 224055 - RNA, 21 nt, Homo sapiens
ccccugauacuuagucaagag

SEQ ID NO: 224056 - RNA, 22 nt, Homo sapiens
cccugagagcagggucuuucuc

SEQ ID NO: 224057 - RNA, 22 nt, Homo sapiens
cccuggacacacacuuuuauuc

SEQ ID NO: 224058 - RNA, 21 nt, Homo sapiens
cccugguguuuggaguuugag

SEQ ID NO: 224059 - RNA, 22 nt, Homo sapiens
cccuuagacuacuaauaugagc

SEQ ID NO: 224060 - RNA, 20 nt, Homo sapiens
ccuaguguucuuaggcugca

SEQ ID NO: 224061 - RNA, 22 nt, Homo sapiens
ccugagaucauacuguuaguaa

SEQ ID NO: 224062 - RNA, 21 nt, Homo sapiens
ccugaguacaacccacuccac

SEQ ID NO: 224063 - RNA, 21 nt, Homo sapiens
ccugaugaccucugagaguua

SEQ ID NO: 224064 - RNA, 22 nt, Homo sapiens
ccugucuugauuaaauuacuua

SEQ ID NO: 224065 - RNA, 18 nt, Homo sapiens
ccuuaguuauagagaguc

SEQ ID NO: 224066 - RNA, 22 nt, Homo sapiens
ccuucauugcaucuuuaagaga

SEQ ID NO: 224067 - RNA, 22 nt, Homo sapiens
ccuucuuuuguaaggcugaaua

SEQ ID NO: 224068 - RNA, 21 nt, Homo sapiens
ccuugagaacaucaauuugcu

SEQ ID NO: 224069 - RNA, 22 nt, Homo sapiens
ccuuggcacuuugccacagugc

SEQ ID NO: 224070 - RNA, 22 nt, Homo sapiens
ccuugguggccacaagacauug

SEQ ID NO: 224071 - RNA, 19 nt, Homo sapiens
ccuuugguuuccaugacau

SEQ ID NO: 224072 - RNA, 22 nt, Homo sapiens
ccuuuguuuaguugaauuguau

SEQ ID NO: 224073 - RNA, 22 nt, Homo sapiens
cgaggaguaucuuugugguguu

SEQ ID NO: 224074 - RNA, 22 nt, Homo sapiens
cgccgggggaugggcaccagcg

SEQ ID NO: 224075 - RNA, 22 nt, Homo sapiens
cggcaguggguaagccaagcuu

SEQ ID NO: 224076 - RNA, 22 nt, Homo sapiens
cggugcaauucuccugucucag

SEQ ID NO: 224077 - RNA, 21 nt, Homo sapiens
cgucauggagauguguuguac

SEQ ID NO: 224078 - RNA, 23 nt, Homo sapiens
cuaaagucugucacugaggacuu

SEQ ID NO: 224079 - RNA, 22 nt, Homo sapiens
cuaaagugcugagauuauaggu

SEQ ID NO: 224080 - RNA, 22 nt, Homo sapiens
cuaaagugcuuaaaaucucauu

SEQ ID NO: 224081 - RNA, 20 nt, Homo sapiens
cuaaucaucccagaagaaau

SEQ ID NO: 224082 - RNA, 22 nt, Homo sapiens
cuaauccugugguagcacucaa

SEQ ID NO: 224083 - RNA, 22 nt, Homo sapiens
cuacagugggucuguaguccuu

SEQ ID NO: 224084 - RNA, 22 nt, Homo sapiens
cuacaguguauuuauggagggu

SEQ ID NO: 224085 - RNA, 22 nt, Homo sapiens
cuacaguuauguuuuaaaugug

SEQ ID NO: 224086 - RNA, 22 nt, Homo sapiens
cuacaguucucaggaguuggcc

SEQ ID NO: 224087 - RNA, 22 nt, Homo sapiens
cuacaguucuuaauuaaguagu

SEQ ID NO: 224088 - RNA, 21 nt, Homo sapiens
cuacccuguauuagagaaaga

SEQ ID NO: 224089 - RNA, 22 nt, Homo sapiens
cuacccuuaaguuucugugggg

SEQ ID NO: 224090 - RNA, 22 nt, Homo sapiens
cuacugacacuacugcaaucau

SEQ ID NO: 224091 - RNA, 22 nt, Homo sapiens
cuacugauuaaaagaacagguc

SEQ ID NO: 224092 - RNA, 22 nt, Homo sapiens
cuagaauguauaaaaccaagcu

SEQ ID NO: 224093 - RNA, 22 nt, Homo sapiens
cuagagagaagcugugugaccu

SEQ ID NO: 224094 - RNA, 22 nt, Homo sapiens
cuagauuauccaacuuauuagc

SEQ ID NO: 224095 - RNA, 22 nt, Homo sapiens
cuagcaacauuucagugaguuu

SEQ ID NO: 224096 - RNA, 22 nt, Homo sapiens
cuagcuuuugauguaaagugag

SEQ ID NO: 224097 - RNA, 22 nt, Homo sapiens
ugcgccauugcauuccagccug

SEQ ID NO: 224098 - RNA, 22 nt, Homo sapiens
ugcguaggcuagagugcagugg

SEQ ID NO: 224099 - RNA, 22 nt, Homo sapiens
ugcuacccuucgucucucuggu

SEQ ID NO: 224100 - RNA, 22 nt, Homo sapiens
ugcuagaugaaguuugaguuuu

SEQ ID NO: 224101 - RNA, 22 nt, Homo sapiens
ugcuaucauugauuagugaugu

SEQ ID NO: 224102 - RNA, 18 nt, Homo sapiens
ugcuaugagauuauuuua

SEQ ID NO: 224103 - RNA, 21 nt, Homo sapiens
ugcuauguuguccaggcuggc

SEQ ID NO: 224104 - RNA, 21 nt, Homo sapiens
ugcucaugaguaaugcaguga

SEQ ID NO: 224105 - RNA, 18 nt, Homo sapiens
ugcuccccugggugagca

SEQ ID NO: 224106 - RNA, 23 nt, Homo sapiens
ugcugagaccuagauccuaaaga

SEQ ID NO: 224107 - RNA, 22 nt, Homo sapiens
ugcugaguguuaccggacaccg

SEQ ID NO: 224108 - RNA, 22 nt, Homo sapiens
ugcugcaaacaugagaggaagu

SEQ ID NO: 224109 - RNA, 22 nt, Homo sapiens
ugcugcuguuaucauuuuacca

SEQ ID NO: 224110 - RNA, 22 nt, Homo sapiens
ugcuggcguuacucuccaucag

SEQ ID NO: 224111 - RNA, 22 nt, Homo sapiens
ugcugguauuauguuauccaga

SEQ ID NO: 224112 - RNA, 22 nt, Homo sapiens
ugcugguauuuggaccagccug

SEQ ID NO: 224113 - RNA, 22 nt, Homo sapiens
ugcugguggucccauaugauua

SEQ ID NO: 224114 - RNA, 22 nt, Homo sapiens
ugcuggugucaucaaggcuuug

SEQ ID NO: 224115 - RNA, 22 nt, Homo sapiens
ugcuguguugcuggcuuaaaga

SEQ ID NO: 224116 - RNA, 17 nt, Homo sapiens
ugcuuagagagccucag

SEQ ID NO: 224117 - RNA, 22 nt, Homo sapiens
ugcuuaggcuaacaaaaauagc

SEQ ID NO: 224118 - RNA, 22 nt, Homo sapiens
ugcuuuguugaaaaucauuugg

SEQ ID NO: 224119 - RNA, 22 nt, Homo sapiens
uggaaacuuauguucuucugug

SEQ ID NO: 224120 - RNA, 22 nt, Homo sapiens
uggaaaguacugagguccaccu

SEQ ID NO: 224121 - RNA, 22 nt, Homo sapiens
uggaaaguaguucuaaucuaag

SEQ ID NO: 224122 - RNA, 22 nt, Homo sapiens
uggaaaguccaagccaaccggg

SEQ ID NO: 224123 - RNA, 22 nt, Homo sapiens
uggaaauuaacagggauugucc

SEQ ID NO: 224124 - RNA, 22 nt, Homo sapiens
uggaacugauauugauggaaaa

SEQ ID NO: 224125 - RNA, 19 nt, Homo sapiens
uggaacugauucaguucug

SEQ ID NO: 224126 - RNA, 22 nt, Homo sapiens
uggaagacauuuuggaccuugg

SEQ ID NO: 224127 - RNA, 22 nt, Homo sapiens
uggaagcaugcaaucugugggg

SEQ ID NO: 224128 - RNA, 20 nt, Homo sapiens
uggaaggcaucugcauuauu

SEQ ID NO: 224129 - RNA, 20 nt, Homo sapiens
uggaaguaagaauauaggug

SEQ ID NO: 224130 - RNA, 22 nt, Homo sapiens
uggaagucauugagguguguua

SEQ ID NO: 224131 - RNA, 22 nt, Homo sapiens
uggaagucuauggcauuugagu

SEQ ID NO: 224132 - RNA, 22 nt, Homo sapiens
uggaagucuucauuauguauag

SEQ ID NO: 224133 - RNA, 22 nt, Homo sapiens
uggaagugaacaaccaaggcag

SEQ ID NO: 224134 - RNA, 21 nt, Homo sapiens
uggaaguguacaauuauaccc

SEQ ID NO: 224135 - RNA, 20 nt, Homo sapiens
uggaaucuaggcggagguuu

SEQ ID NO: 224136 - RNA, 19 nt, Homo sapiens
uggaauggauuuaaaugug

SEQ ID NO: 224137 - RNA, 22 nt, Homo sapiens
uggaaugggauuggaaauuuug

SEQ ID NO: 224138 - RNA, 22 nt, Homo sapiens
uggaauguauaucguuuuuugu

SEQ ID NO: 224139 - RNA, 22 nt, Homo sapiens
uggaaugucuauguuuuugauu

SEQ ID NO: 224140 - RNA, 22 nt, Homo sapiens
uggaauguggacucuuaugggg

SEQ ID NO: 224141 - RNA, 21 nt, Homo sapiens
uggaauguucugacuucaggg

SEQ ID NO: 224142 - RNA, 22 nt, Homo sapiens
agauggugugcuaggaaaugua

SEQ ID NO: 224143 - RNA, 22 nt, Homo sapiens
agaugguguuuucucaccagau

SEQ ID NO: 224144 - RNA, 22 nt, Homo sapiens
agauguuguucaucugauuguu

SEQ ID NO: 224145 - RNA, 22 nt, Homo sapiens
auguauggagauauuuuugguu

SEQ ID NO: 224146 - RNA, 22 nt, Homo sapiens
auguauggaguuuaggggaugg

SEQ ID NO: 224147 - RNA, 22 nt, Homo sapiens
augucaaagaggaaaacuggau

SEQ ID NO: 224148 - RNA, 20 nt, Homo sapiens
augucaggaagggagucagg

SEQ ID NO: 224149 - RNA, 22 nt, Homo sapiens
augucauagaagccugugaacc

SEQ ID NO: 224150 - RNA, 22 nt, Homo sapiens
augucauagauaaggaagugga

SEQ ID NO: 224151 - RNA, 22 nt, Homo sapiens
augucuggcagaagacuucuca

SEQ ID NO: 224152 - RNA, 22 nt, Homo sapiens
augucugguagccaccuggagg

SEQ ID NO: 224153 - RNA, 22 nt, Homo sapiens
augugaacugaauuaauucaca

SEQ ID NO: 224154 - RNA, 17 nt, Homo sapiens
augugaauguucaaaua

SEQ ID NO: 224155 - RNA, 22 nt, Homo sapiens
augugacugauggagaauaugu

SEQ ID NO: 224156 - RNA, 22 nt, Homo sapiens
augugacuggaucauggggacg

SEQ ID NO: 224157 - RNA, 22 nt, Homo sapiens
gugcaaugagaaggggcucugg

SEQ ID NO: 224158 - RNA, 22 nt, Homo sapiens
gugcaaugucaggagaugcagc

SEQ ID NO: 224159 - RNA, 22 nt, Homo sapiens
gugcaauguuaauuacuugacu

SEQ ID NO: 224160 - RNA, 22 nt, Homo sapiens
gugcacaaaucuuaaauguaca

SEQ ID NO: 224161 - RNA, 22 nt, Homo sapiens
gugcacaacaugcagguuuguu

SEQ ID NO: 224162 - RNA, 22 nt, Homo sapiens
gugcacaacguguagguuuguu

SEQ ID NO: 224163 - RNA, 22 nt, Homo sapiens
gugcacaugguagguauugagu

SEQ ID NO: 224164 - RNA, 22 nt, Homo sapiens
gugcagaugucuuuauaguagc

SEQ ID NO: 224165 - RNA, 23 nt, Homo sapiens
gugcaguggcgagauuucggcuc

SEQ ID NO: 224166 - RNA, 22 nt, Homo sapiens
gugcaguuuugagugaguuucu

SEQ ID NO: 224167 - RNA, 18 nt, Homo sapiens
gugcauagccauggcagc

SEQ ID NO: 224168 - RNA, 19 nt, Homo sapiens
gugcauaguuauuaaagag

SEQ ID NO: 224169 - RNA, 22 nt, Homo sapiens
gugccacugcaccuggccuaag

SEQ ID NO: 224170 - RNA, 22 nt, Homo sapiens
gugcccacugucuguccuguag

SEQ ID NO: 224171 - RNA, 22 nt, Homo sapiens
gugccuucuagcuaugguuggc

SEQ ID NO: 224172 - RNA, 22 nt, Homo sapiens
gugccuuuucugagcaaugagc

SEQ ID NO: 224173 - RNA, 22 nt, Homo sapiens
gugcgggaggcgcgccuaggug

SEQ ID NO: 224174 - RNA, 22 nt, Homo sapiens
gugcucauuuagagagaagcac

SEQ ID NO: 224175 - RNA, 22 nt, Homo sapiens
guggaaaaguaguugcgguuuu

SEQ ID NO: 224176 - RNA, 21 nt, Homo sapiens
guggaaauggaauuuacuaau

SEQ ID NO: 224177 - RNA, 22 nt, Homo sapiens
guggaagaccagacuuuccaac

SEQ ID NO: 224178 - RNA, 22 nt, Homo sapiens
guggaaguguaaaagcucuugg

SEQ ID NO: 224179 - RNA, 22 nt, Homo sapiens
guggaaucuagagaggcaguag

SEQ ID NO: 224180 - RNA, 22 nt, Homo sapiens
guggaaugaaaacucucucaca

SEQ ID NO: 224181 - RNA, 22 nt, Homo sapiens
guggacggagguugcagugagc

SEQ ID NO: 224182 - RNA, 22 nt, Homo sapiens
guggacugggagagauaguucc

SEQ ID NO: 224183 - RNA, 22 nt, Homo sapiens
guggagcuguguggccuugggc

SEQ ID NO: 224184 - RNA, 22 nt, Homo sapiens
guggaguaugaaaacugacuuu

SEQ ID NO: 224185 - RNA, 22 nt, Homo sapiens
guggaucacuugaggucaagag

SEQ ID NO: 224186 - RNA, 22 nt, Homo sapiens
guggaucacuugagguuagaag

SEQ ID NO: 224187 - RNA, 22 nt, Homo sapiens
guggcaaguguuccaagaggcg

SEQ ID NO: 224188 - RNA, 22 nt, Homo sapiens
guggcacaauuaaguagcuauu

SEQ ID NO: 224189 - RNA, 22 nt, Homo sapiens
guggcagagucagagggaaaug

SEQ ID NO: 224190 - RNA, 21 nt, Homo sapiens
guggccuuuggagcaugucag

SEQ ID NO: 224191 - RNA, 22 nt, Homo sapiens
gugggagugucccguuuuucca

SEQ ID NO: 224192 - RNA, 22 nt, Homo sapiens
gugggauauaaucaguccugua

SEQ ID NO: 224193 - RNA, 22 nt, Homo sapiens
gugggauggaaaugggcuucag

SEQ ID NO: 224194 - RNA, 22 nt, Homo sapiens
gugggcucguucguguuagaca

SEQ ID NO: 224195 - RNA, 22 nt, Homo sapiens
gugggguaggguaggacucaac

SEQ ID NO: 224196 - RNA, 22 nt, Homo sapiens
gugggguaggugacuugaugag

SEQ ID NO: 224197 - RNA, 22 nt, Homo sapiens
guggguaaaucucuggggcucu

SEQ ID NO: 224198 - RNA, 22 nt, Homo sapiens
uacaccaauuuaaucaaaagca

SEQ ID NO: 224199 - RNA, 22 nt, Homo sapiens
uacacgugcacaacgugcacgu

SEQ ID NO: 224200 - RNA, 20 nt, Homo sapiens
uacacguguagcauucucua

SEQ ID NO: 224201 - RNA, 22 nt, Homo sapiens
uacagcacugugcauagugguu

SEQ ID NO: 224202 - RNA, 22 nt, Homo sapiens
uggcaagugggaccuaguuaaa

SEQ ID NO: 224203 - RNA, 18 nt, Homo sapiens
uggcaauaugguucuacc

SEQ ID NO: 224204 - RNA, 19 nt, Homo sapiens
uggcaaugucagcagagau

SEQ ID NO: 224205 - RNA, 19 nt, Homo sapiens
uggcacauguauacauaug

SEQ ID NO: 224206 - RNA, 20 nt, Homo sapiens
uggcaccugacagauagcca

SEQ ID NO: 224207 - RNA, 22 nt, Homo sapiens
uggcaccugacuccgagaugca

SEQ ID NO: 224208 - RNA, 22 nt, Homo sapiens
uggcacuaugugacaagguuuu

SEQ ID NO: 224209 - RNA, 19 nt, Homo sapiens
uggcacuugacguccggau

SEQ ID NO: 224210 - RNA, 22 nt, Homo sapiens
uggcagcugcuucaugggaugc

SEQ ID NO: 224211 - RNA, 22 nt, Homo sapiens
uggcagugggagauauuuuauu

SEQ ID NO: 224212 - RNA, 22 nt, Homo sapiens
uggcaguuucacauggcucaac

SEQ ID NO: 224213 - RNA, 22 nt, Homo sapiens
uggcaguuucauaugguucaac

SEQ ID NO: 224214 - RNA, 22 nt, Homo sapiens
uggcaugaaguguguuuuaucu

SEQ ID NO: 224215 - RNA, 17 nt, Homo sapiens
uggcaugaggguguggg

SEQ ID NO: 224216 - RNA, 22 nt, Homo sapiens
uggcaugauccuagauucaaca

SEQ ID NO: 224217 - RNA, 22 nt, Homo sapiens
uggcaugauguguucauugaaa

SEQ ID NO: 224218 - RNA, 22 nt, Homo sapiens
uggcaugcauuguggguaauua

SEQ ID NO: 224219 - RNA, 22 nt, Homo sapiens
uggcaugggguaguagcgcugg

SEQ ID NO: 224220 - RNA, 22 nt, Homo sapiens
uggcauuuucucuguucuuaga

SEQ ID NO: 224221 - RNA, 18 nt, Homo sapiens
uggccaauggcaaacaga

SEQ ID NO: 224222 - RNA, 23 nt, Homo sapiens
uggccagaaacuucuuuucaucc

SEQ ID NO: 224223 - RNA, 22 nt, Homo sapiens
uggccuguaacgcugucucagc

SEQ ID NO: 224224 - RNA, 22 nt, Homo sapiens
uggccuuuuccaagaacuacua

SEQ ID NO: 224225 - RNA, 22 nt, Homo sapiens
uggcgggaaaguugggagaaga

SEQ ID NO: 224226 - RNA, 20 nt, Homo sapiens
uggcuaaaugaaugauagca

SEQ ID NO: 224227 - RNA, 22 nt, Homo sapiens
uggcuacagaaaguacuaguga

SEQ ID NO: 224228 - RNA, 20 nt, Homo sapiens
uggcucuuugcugcuaaagu

SEQ ID NO: 224229 - RNA, 22 nt, Homo sapiens
uggcuguguccucucccaaauc

SEQ ID NO: 224230 - RNA, 22 nt, Homo sapiens
uggcuguuuauuucacaugggu

SEQ ID NO: 224231 - RNA, 21 nt, Homo sapiens
uggcuuauuugaaucuggcuu

SEQ ID NO: 224232 - RNA, 22 nt, Homo sapiens
uggcuuuuauuauguugaggua

SEQ ID NO: 224233 - RNA, 22 nt, Homo sapiens
ugggaaauguagccuagcugug

SEQ ID NO: 224234 - RNA, 20 nt, Homo sapiens
ugggaaauguccaggacaua

SEQ ID NO: 224235 - RNA, 22 nt, Homo sapiens
ugggaagaagguuuacuugcca

SEQ ID NO: 224236 - RNA, 22 nt, Homo sapiens
ugggaagcugcauuuuaacaag

SEQ ID NO: 224237 - RNA, 22 nt, Homo sapiens
ugggaauaugauacaggucuuu

SEQ ID NO: 224238 - RNA, 22 nt, Homo sapiens
ugggaaugaaauuacauagcuu

SEQ ID NO: 224239 - RNA, 22 nt, Homo sapiens
ugggagugugcacaauuucagc

SEQ ID NO: 224240 - RNA, 22 nt, Homo sapiens
ugggaugauguuaaacguacuc

SEQ ID NO: 224241 - RNA, 22 nt, Homo sapiens
ugggauguagccuucuauuuuc

SEQ ID NO: 224242 - RNA, 22 nt, Homo sapiens
ugggcaagugacuuggcuucuc

SEQ ID NO: 224243 - RNA, 22 nt, Homo sapiens
ugggcagugggacagcuuugug

SEQ ID NO: 224244 - RNA, 21 nt, Homo sapiens
ugggccccuuccuuacaucau

SEQ ID NO: 224245 - RNA, 22 nt, Homo sapiens
ugggcuagaugcuuugggguca

SEQ ID NO: 224246 - RNA, 22 nt, Homo sapiens
uggggcuuuuucuuguauucuc

SEQ ID NO: 224247 - RNA, 22 nt, Homo sapiens
ugggguagaauagaauugauau

SEQ ID NO: 224248 - RNA, 22 nt, Homo sapiens
uggggucguaggugcccgccag

SEQ ID NO: 224249 - RNA, 22 nt, Homo sapiens
ugggucaguagcauguaugucu

SEQ ID NO: 224250 - RNA, 22 nt, Homo sapiens
ugggugugaccgcucaaggggg

SEQ ID NO: 224251 - RNA, 22 nt, Homo sapiens
ugguaagaaaaccauuauuagc

SEQ ID NO: 224252 - RNA, 22 nt, Homo sapiens
ugguaaguuuaacaugcauccc

SEQ ID NO: 224253 - RNA, 22 nt, Homo sapiens
ugguacugucucuauuuuguag

SEQ ID NO: 224254 - RNA, 22 nt, Homo sapiens
ugguagguuuauaaagaauuua

SEQ ID NO: 224255 - RNA, 17 nt, Homo sapiens
ugguagguuuuucuggc

SEQ ID NO: 224256 - RNA, 22 nt, Homo sapiens
uggucaaaugccaaucuguagu

SEQ ID NO: 224257 - RNA, 20 nt, Homo sapiens
uggucaccuucaggagguuc

SEQ ID NO: 224258 - RNA, 22 nt, Homo sapiens
uggucagaaaauuacuugauau

SEQ ID NO: 224259 - RNA, 19 nt, Homo sapiens
uggucaguucugggagcug

SEQ ID NO: 224260 - RNA, 22 nt, Homo sapiens
uggucaugaggugaggcuucuc

SEQ ID NO: 224261 - RNA, 22 nt, Homo sapiens
ugguccacuaacccucaguauc

SEQ ID NO: 224262 - RNA, 21 nt, Homo sapiens
uggucccauaagauuauaaug

SEQ ID NO: 224263 - RNA, 20 nt, Homo sapiens
ugguccccugagucuggcuu

SEQ ID NO: 224264 - RNA, 22 nt, Homo sapiens
uggucccucugaaaauugggug

SEQ ID NO: 224265 - RNA, 22 nt, Homo sapiens
uggucuccuuuguacccugggc

SEQ ID NO: 224266 - RNA, 22 nt, Homo sapiens
uggucuggagagucccgcccag

SEQ ID NO: 224267 - RNA, 22 nt, Homo sapiens
uggugagaaaugagaugcuuuu

SEQ ID NO: 224268 - RNA, 22 nt, Homo sapiens
uggugcaaauguaauugugguu

SEQ ID NO: 224269 - RNA, 22 nt, Homo sapiens
uggugccgugguccuggggcca

SEQ ID NO: 224270 - RNA, 22 nt, Homo sapiens
uggugcuuaaauaaggcuuuca

SEQ ID NO: 224271 - RNA, 22 nt, Homo sapiens
ugguggcuuuucguagguucac

SEQ ID NO: 224272 - RNA, 20 nt, Homo sapiens
uggugucuuggaaagagcuc

SEQ ID NO: 224273 - RNA, 22 nt, Homo sapiens
ugguugaucccaucacccaggu

SEQ ID NO: 224274 - RNA, 23 nt, Homo sapiens
ugguuuguaagagauggacugga

SEQ ID NO: 224275 - RNA, 23 nt, Homo sapiens
uguaaaagcauuugucagccugg

SEQ ID NO: 224276 - RNA, 22 nt, Homo sapiens
uguaaaccauauauguauguag

SEQ ID NO: 224277 - RNA, 22 nt, Homo sapiens
uguaaagaaagcuguuguugua

SEQ ID NO: 224278 - RNA, 20 nt, Homo sapiens
uguaacaaucuggauguugc

SEQ ID NO: 224279 - RNA, 22 nt, Homo sapiens
uguaagugugcaauucagugau

SEQ ID NO: 224280 - RNA, 22 nt, Homo sapiens
uguagauaucauuagugcugug

SEQ ID NO: 224281 - RNA, 22 nt, Homo sapiens
uguagauauucuuucaguuuuu

SEQ ID NO: 224282 - RNA, 22 nt, Homo sapiens
uguagcaaauaaaagucuggau

SEQ ID NO: 224283 - RNA, 22 nt, Homo sapiens
uguagcaaaucgauacuauugg

SEQ ID NO: 224284 - RNA, 21 nt, Homo sapiens
uguagcagcaugauucauagu

SEQ ID NO: 224285 - RNA, 22 nt, Homo sapiens
uguagcagccauaaacacagug

SEQ ID NO: 224286 - RNA, 22 nt, Homo sapiens
uguagucauuuggaguccagcu

SEQ ID NO: 224287 - RNA, 22 nt, Homo sapiens
uguauacauguguguucacgca

SEQ ID NO: 224288 - RNA, 22 nt, Homo sapiens
uguauauguuuguacauauguc

SEQ ID NO: 224289 - RNA, 22 nt, Homo sapiens
uguaugguuauuuguggauggu

SEQ ID NO: 224290 - RNA, 22 nt, Homo sapiens
uguauguuguaagacuuagacc

SEQ ID NO: 224291 - RNA, 22 nt, Homo sapiens
ugucaaaugcagugauauuuga

SEQ ID NO: 224292 - RNA, 22 nt, Homo sapiens
ugucaaauucuggguuaaaaca

SEQ ID NO: 224293 - RNA, 20 nt, Homo sapiens
ugucaaggaauucccaaauc

SEQ ID NO: 224294 - RNA, 22 nt, Homo sapiens
ugucaggaggguccagagaaaa

SEQ ID NO: 224295 - RNA, 22 nt, Homo sapiens
ugucaggaguuuuagaaucuua

SEQ ID NO: 224296 - RNA, 22 nt, Homo sapiens
ugucaguggacugugaaaggca

SEQ ID NO: 224297 - RNA, 22 nt, Homo sapiens
ugucauauagaauguucuauga

SEQ ID NO: 224298 - RNA, 19 nt, Homo sapiens
ugucaucaucuuuucuugc

SEQ ID NO: 224299 - RNA, 22 nt, Homo sapiens
ugucaucauuccaucagggcuu

SEQ ID NO: 224300 - RNA, 22 nt, Homo sapiens
uacagccacauaauguaugauu

SEQ ID NO: 224301 - RNA, 22 nt, Homo sapiens
uacagcuaugugcaugcaugcu

SEQ ID NO: 224302 - RNA, 20 nt, Homo sapiens
uacaggacugagaaucugug

SEQ ID NO: 224303 - RNA, 22 nt, Homo sapiens
uacaggacuucucagaguuauu

SEQ ID NO: 224304 - RNA, 22 nt, Homo sapiens
uacaggcagguguucccugguu

SEQ ID NO: 224305 - RNA, 22 nt, Homo sapiens
uacagguauagauguguguucu

SEQ ID NO: 224306 - RNA, 22 nt, Homo sapiens
uacaggugcuuauguggacaua

SEQ ID NO: 224307 - RNA, 22 nt, Homo sapiens
uacaguacacagguaccaagcu

SEQ ID NO: 224308 - RNA, 22 nt, Homo sapiens
uacaguagagaucagcaaacua

SEQ ID NO: 224309 - RNA, 22 nt, Homo sapiens
uacaguaggauuuucagggucu

SEQ ID NO: 224310 - RNA, 22 nt, Homo sapiens
uacagucauaaugccuagugac

SEQ ID NO: 224311 - RNA, 22 nt, Homo sapiens
uacagucuagaggagaaucagg

SEQ ID NO: 224312 - RNA, 22 nt, Homo sapiens
uacaguggaaguuaaccccauu

SEQ ID NO: 224313 - RNA, 22 nt, Homo sapiens
uacauaguaagcaucuccugug

SEQ ID NO: 224314 - RNA, 22 nt, Homo sapiens
uacauguauacaggguuuacuu

SEQ ID NO: 224315 - RNA, 22 nt, Homo sapiens
uacauguauccauuguuuuugg

SEQ ID NO: 224316 - RNA, 22 nt, Homo sapiens
uacaugugcacaacgugcaggu

SEQ ID NO: 224317 - RNA, 22 nt, Homo sapiens
uacaugugcaggucuguggggg

SEQ ID NO: 224318 - RNA, 22 nt, Homo sapiens
uacauugucauauucucucucu

SEQ ID NO: 224319 - RNA, 16 nt, Homo sapiens
uacauuuguuacaugg

SEQ ID NO: 224320 - RNA, 22 nt, Homo sapiens
uaccaaaguuucggccucuguu

SEQ ID NO: 224321 - RNA, 23 nt, Homo sapiens
uaccacauuccuucuuuccuguu

SEQ ID NO: 224322 - RNA, 22 nt, Homo sapiens
uaccacugccgagaaaacagau

SEQ ID NO: 224323 - RNA, 22 nt, Homo sapiens
uaccauguauguuucuccauug

SEQ ID NO: 224324 - RNA, 22 nt, Homo sapiens
uacccuuuaguauaaaaucaga

SEQ ID NO: 224325 - RNA, 22 nt, Homo sapiens
uaccucuguaaguaaagauuca

SEQ ID NO: 224326 - RNA, 22 nt, Homo sapiens
uacuagaguagugcagagggga

SEQ ID NO: 224327 - RNA, 18 nt, Homo sapiens
uacuaguaaggcuucuga

SEQ ID NO: 224328 - RNA, 22 nt, Homo sapiens
uacucaauugcagucaccuggc

SEQ ID NO: 224329 - RNA, 22 nt, Homo sapiens
uacucugcagccauaaaacaga

SEQ ID NO: 224330 - RNA, 22 nt, Homo sapiens
uacugaccugaaggccauggaa

SEQ ID NO: 224331 - RNA, 19 nt, Homo sapiens
uacugcaccucaaccuggg

SEQ ID NO: 224332 - RNA, 22 nt, Homo sapiens
uacugcacuccaaccugagaga

SEQ ID NO: 224333 - RNA, 22 nt, Homo sapiens
uacugcacuggaggccucagau

SEQ ID NO: 224334 - RNA, 22 nt, Homo sapiens
uacugcagucagacuccugggc

SEQ ID NO: 224335 - RNA, 22 nt, Homo sapiens
uacugcuuaaaagucaauuacu

SEQ ID NO: 224336 - RNA, 22 nt, Homo sapiens
uacugguuuuauauauuucucc

SEQ ID NO: 224337 - RNA, 22 nt, Homo sapiens
uacugguuuuggugggcaggug

SEQ ID NO: 224338 - RNA, 22 nt, Homo sapiens
uacuuuguagauuguuuccuuu

SEQ ID NO: 224339 - RNA, 22 nt, Homo sapiens
uacuuuguuauagcagcaggaa

SEQ ID NO: 224340 - RNA, 22 nt, Homo sapiens
uagaaagcaugaccuucagaua

SEQ ID NO: 224341 - RNA, 22 nt, Homo sapiens
uagaacauuccaggugauguug

SEQ ID NO: 224342 - RNA, 22 nt, Homo sapiens
uagaauggaagguugagaagaa

SEQ ID NO: 224343 - RNA, 22 nt, Homo sapiens
uagaauguaacaguuaaaagca

SEQ ID NO: 224344 - RNA, 22 nt, Homo sapiens
uagaauguaacuuccaugucau

SEQ ID NO: 224345 - RNA, 22 nt, Homo sapiens
uagacuguaagauccaggagag

SEQ ID NO: 224346 - RNA, 21 nt, Homo sapiens
uagagagcaauaccuccagag

SEQ ID NO: 224347 - RNA, 22 nt, Homo sapiens
uagagagcuguuugaaagcagg

SEQ ID NO: 224348 - RNA, 21 nt, Homo sapiens
uagagcaacacacgcccucuc

SEQ ID NO: 224349 - RNA, 22 nt, Homo sapiens
uagagcacaagguagauuucua

SEQ ID NO: 224350 - RNA, 22 nt, Homo sapiens
uagagcucaucuucuuuaaacu

SEQ ID NO: 224351 - RNA, 22 nt, Homo sapiens
uagagguagccuacuacacacc

SEQ ID NO: 224352 - RNA, 22 nt, Homo sapiens
uagagguauaccaaaaaggcau

SEQ ID NO: 224353 - RNA, 22 nt, Homo sapiens
uagaguguuuuguuaggcagca

SEQ ID NO: 224354 - RNA, 22 nt, Homo sapiens
uagauaauuagaggguuuuaag

SEQ ID NO: 224355 - RNA, 21 nt, Homo sapiens
uagauacuguauuaaaccuag

SEQ ID NO: 224356 - RNA, 22 nt, Homo sapiens
uagaucaacuuugguaagagaa

SEQ ID NO: 224357 - RNA, 22 nt, Homo sapiens
uagaucacucaggcaauaaaag

SEQ ID NO: 224358 - RNA, 22 nt, Homo sapiens
uagaucauauucagugcuuacu

SEQ ID NO: 224359 - RNA, 22 nt, Homo sapiens
uagaucuuuaaaaggugcuaga

SEQ ID NO: 224360 - RNA, 22 nt, Homo sapiens
uagaugauucacuuuacuucca

SEQ ID NO: 224361 - RNA, 22 nt, Homo sapiens
uagauuaucauucauacaggga

SEQ ID NO: 224362 - RNA, 22 nt, Homo sapiens
uagauuaucccugauuugucca

SEQ ID NO: 224363 - RNA, 22 nt, Homo sapiens
uagauuauuccuuugaauggcc

SEQ ID NO: 224364 - RNA, 22 nt, Homo sapiens
uagauuauuggcugauuugauc

SEQ ID NO: 224365 - RNA, 22 nt, Homo sapiens
uagcaacauucagcucagguac

SEQ ID NO: 224366 - RNA, 22 nt, Homo sapiens
uagcacaugucagguaauuugc

SEQ ID NO: 224367 - RNA, 22 nt, Homo sapiens
uagcaccacaaucaagauacag

SEQ ID NO: 224368 - RNA, 22 nt, Homo sapiens
uagcagcaucucuggcuucuac

SEQ ID NO: 224369 - RNA, 19 nt, Homo sapiens
uagcagcaugauuuauaau

SEQ ID NO: 224370 - RNA, 22 nt, Homo sapiens
uagcagcuuuauugagguaaau

SEQ ID NO: 224371 - RNA, 22 nt, Homo sapiens
uagcaguauacguacugggucc

SEQ ID NO: 224372 - RNA, 22 nt, Homo sapiens
uagcaguauaugagagcuauug

SEQ ID NO: 224373 - RNA, 22 nt, Homo sapiens
uagcauaauuuguagaaaauca

SEQ ID NO: 224374 - RNA, 22 nt, Homo sapiens
uagcaucagauuccauauucua

SEQ ID NO: 224375 - RNA, 22 nt, Homo sapiens
uagcauggagucaugcacggcu

SEQ ID NO: 224376 - RNA, 20 nt, Homo sapiens
uagccggguguugugucaug

SEQ ID NO: 224377 - RNA, 21 nt, Homo sapiens
uagcucagugguguugccaua

SEQ ID NO: 224378 - RNA, 22 nt, Homo sapiens
uagcugaucuuuuaaagaauga

SEQ ID NO: 224379 - RNA, 22 nt, Homo sapiens
uagcuguuggugggaagucaga

SEQ ID NO: 224380 - RNA, 22 nt, Homo sapiens
uaggaaguuucuugauuacuua

SEQ ID NO: 224381 - RNA, 22 nt, Homo sapiens
uaggaaugaacgauuuauuggu

SEQ ID NO: 224382 - RNA, 22 nt, Homo sapiens
uaggacacucucuccaccagua

SEQ ID NO: 224383 - RNA, 19 nt, Homo sapiens
uaggacccugguggccccc

SEQ ID NO: 224384 - RNA, 22 nt, Homo sapiens
uaggacuuuucuugagagugac

SEQ ID NO: 224385 - RNA, 22 nt, Homo sapiens
uaggagcauaggauuguuugag

SEQ ID NO: 224386 - RNA, 22 nt, Homo sapiens
uaggagugugaacccuaugaac

SEQ ID NO: 224387 - RNA, 22 nt, Homo sapiens
uaggcacacaucuacuacaaau

SEQ ID NO: 224388 - RNA, 22 nt, Homo sapiens
uaggcauuuuucugauaaacua

SEQ ID NO: 224389 - RNA, 22 nt, Homo sapiens
uaggccuuuuuaugucaauauc

SEQ ID NO: 224390 - RNA, 22 nt, Homo sapiens
uagggaguguccuuucgggaaa

SEQ ID NO: 224391 - RNA, 22 nt, Homo sapiens
uagggagugucuucauuuugua

SEQ ID NO: 224392 - RNA, 22 nt, Homo sapiens
uagggcauuuagaggcuauuaa

SEQ ID NO: 224393 - RNA, 22 nt, Homo sapiens
uagguacuuaagaucucagcua

SEQ ID NO: 224394 - RNA, 22 nt, Homo sapiens
uagguagugugugcaugagagg

SEQ ID NO: 224395 - RNA, 22 nt, Homo sapiens
uagguauguauauacacacaca

SEQ ID NO: 224396 - RNA, 22 nt, Homo sapiens
uaggucacugcucugugucuaa

SEQ ID NO: 224397 - RNA, 21 nt, Homo sapiens
ugucaugcagagacccuggag

SEQ ID NO: 224398 - RNA, 22 nt, Homo sapiens
uuuuggcuuuuccucagcaagc

SEQ ID NO: 224399 - RNA, 22 nt, Homo sapiens
uuuugguguacaauucuaugga

SEQ ID NO: 224400 - RNA, 22 nt, Homo sapiens
uuuugguuuuauccagggucuc

SEQ ID NO: 224401 - RNA, 22 nt, Homo sapiens
uuuuguacgccuguguccauca

SEQ ID NO: 224402 - RNA, 22 nt, Homo sapiens
uuuuuggaggagguuagaucau

SEQ ID NO: 224403 - RNA, 22 nt, Homo sapiens
uuuuuugcuguaugcaaacauc

SEQ ID NO: 224404 - RNA, 22 nt, Homo sapiens
uuuuuugguaauugaacaauga

SEQ ID NO: 224405 - RNA, 20 nt, Homo sapiens
ugacaaggugcaaagaauca

SEQ ID NO: 224406 - RNA, 18 nt, Homo sapiens
ugacaaugcuaguccugg

SEQ ID NO: 224407 - RNA, 17 nt, Homo sapiens
ugacagaaacuuguugu

SEQ ID NO: 224408 - RNA, 23 nt, Homo sapiens
ugacagaccuucuggaagaaguc

SEQ ID NO: 224409 - RNA, 22 nt, Homo sapiens
ugacagagaagcauugaguuca

SEQ ID NO: 224410 - RNA, 22 nt, Homo sapiens
ugacagcaucaggauuggagag

SEQ ID NO: 224411 - RNA, 22 nt, Homo sapiens
ugacagcugaggcccagaguac

SEQ ID NO: 224412 - RNA, 22 nt, Homo sapiens
ugacagcuguugaggcauuuau

SEQ ID NO: 224413 - RNA, 22 nt, Homo sapiens
ugacagguugauaggugcagca

SEQ ID NO: 224414 - RNA, 22 nt, Homo sapiens
ugacaguaucuacagcuucuua

SEQ ID NO: 224415 - RNA, 23 nt, Homo sapiens
ugacagucucccgauggcuaggc

SEQ ID NO: 224416 - RNA, 22 nt, Homo sapiens
ugacagugaauaagucucuuaa

SEQ ID NO: 224417 - RNA, 22 nt, Homo sapiens
ugacaguguccuccuccugaga

SEQ ID NO: 224418 - RNA, 18 nt, Homo sapiens
ugacaguuucuuuauauu

SEQ ID NO: 224419 - RNA, 22 nt, Homo sapiens
ugacaucaccaccuccgucauc

SEQ ID NO: 224420 - RNA, 18 nt, Homo sapiens
ugacaucauuuagaaagg

SEQ ID NO: 224421 - RNA, 22 nt, Homo sapiens
ugacaugaaggcaccucugucc

SEQ ID NO: 224422 - RNA, 22 nt, Homo sapiens
ugacauggaagauguucaugau

SEQ ID NO: 224423 - RNA, 22 nt, Homo sapiens
aguacacuguugaacagaagug

SEQ ID NO: 224424 - RNA, 22 nt, Homo sapiens
aguaccauuagauuaggaugac

SEQ ID NO: 224425 - RNA, 22 nt, Homo sapiens
aguaccauuugacaugggaccc

SEQ ID NO: 224426 - RNA, 23 nt, Homo sapiens
aguacuguaguaauugaggggaa

SEQ ID NO: 224427 - RNA, 22 nt, Homo sapiens
aguacugucugguuaccugaca

SEQ ID NO: 224428 - RNA, 21 nt, Homo sapiens
aguagcacugugucuuacaaa

SEQ ID NO: 224429 - RNA, 22 nt, Homo sapiens
aguaucacaggcaaaacagaau

SEQ ID NO: 224430 - RNA, 22 nt, Homo sapiens
aguauugcuaauaagagauuug

SEQ ID NO: 224431 - RNA, 22 nt, Homo sapiens
agucaaaugcuuauguauaaag

SEQ ID NO: 224432 - RNA, 22 nt, Homo sapiens
agucaagaaucucagcaucuuu

SEQ ID NO: 224433 - RNA, 22 nt, Homo sapiens
agucaagauggcaagguaaggc

SEQ ID NO: 224434 - RNA, 22 nt, Homo sapiens
agucacggugguuugcacuugu

SEQ ID NO: 224435 - RNA, 22 nt, Homo sapiens
agucagauuggcauuuguuggg

SEQ ID NO: 224436 - RNA, 19 nt, Homo sapiens
agucaugugaggacccuug

SEQ ID NO: 224437 - RNA, 22 nt, Homo sapiens
agugaaaugucaccuuuuagga

SEQ ID NO: 224438 - RNA, 22 nt, Homo sapiens
agugaacacagcuucuuugguu

SEQ ID NO: 224439 - RNA, 22 nt, Homo sapiens
agugaauuguucaacaggagga

SEQ ID NO: 224440 - RNA, 22 nt, Homo sapiens
agugacaugggaucaaaucuga

SEQ ID NO: 224441 - RNA, 22 nt, Homo sapiens
agugacuagaauaugaauuuua

SEQ ID NO: 224442 - RNA, 22 nt, Homo sapiens
agugcacucuuuccucucuuac

SEQ ID NO: 224443 - RNA, 22 nt, Homo sapiens
agugcacugcccgcuuccuguc

SEQ ID NO: 224444 - RNA, 22 nt, Homo sapiens
agugcagugguuaggagccagg

SEQ ID NO: 224445 - RNA, 22 nt, Homo sapiens
agugcauugcaucucugcuuca

SEQ ID NO: 224446 - RNA, 22 nt, Homo sapiens
agugccuacuugaauuguagug

SEQ ID NO: 224447 - RNA, 22 nt, Homo sapiens
agugcuuguacaaaccccgagg

SEQ ID NO: 224448 - RNA, 22 nt, Homo sapiens
aguggaaucuguuauacuaacu

SEQ ID NO: 224449 - RNA, 22 nt, Homo sapiens
aguggaauuaagaaacugaauu

SEQ ID NO: 224450 - RNA, 22 nt, Homo sapiens
aguggaguguaaagcgucuuuu

SEQ ID NO: 224451 - RNA, 22 nt, Homo sapiens
aguggauuuuagacugagauuu

SEQ ID NO: 224452 - RNA, 22 nt, Homo sapiens
agugguaguacaggagauaccg

SEQ ID NO: 224453 - RNA, 22 nt, Homo sapiens
agugguguugccuguugaccua

SEQ ID NO: 224454 - RNA, 22 nt, Homo sapiens
agugguuugaucacagcucacu

SEQ ID NO: 224455 - RNA, 20 nt, Homo sapiens
agugguuuucaaauaugucu

SEQ ID NO: 224456 - RNA, 19 nt, Homo sapiens
agugucauggucauuauuu

SEQ ID NO: 224457 - RNA, 22 nt, Homo sapiens
aguguuuuuaucaugaaagggu

SEQ ID NO: 224458 - RNA, 22 nt, Homo sapiens
aguucaaaucgagccuggccau

SEQ ID NO: 224459 - RNA, 22 nt, Homo sapiens
aguucaauggguuuucacucau

SEQ ID NO: 224460 - RNA, 22 nt, Homo sapiens
aguuggccccuacugggaggug

SEQ ID NO: 224461 - RNA, 18 nt, Homo sapiens
aguuguuuuauccugccc

SEQ ID NO: 224462 - RNA, 22 nt, Homo sapiens
aguuuugguugaguuacuagca

SEQ ID NO: 224463 - RNA, 22 nt, Homo sapiens
auaaaagcaggucuaggucagg

SEQ ID NO: 224464 - RNA, 19 nt, Homo sapiens
auaaacuagaacugucccc

SEQ ID NO: 224465 - RNA, 22 nt, Homo sapiens
auaaagcaagucucuggccuca

SEQ ID NO: 224466 - RNA, 22 nt, Homo sapiens
auaaaguucugcuggcauauau

SEQ ID NO: 224467 - RNA, 22 nt, Homo sapiens
auaaaugcuuagaucuguauau

SEQ ID NO: 224468 - RNA, 22 nt, Homo sapiens
auaaauucauuuaagcuccuua

SEQ ID NO: 224469 - RNA, 22 nt, Homo sapiens
auaacauccuuucuuaucguug

SEQ ID NO: 224470 - RNA, 22 nt, Homo sapiens
auaagaagugaaccagacgucu

SEQ ID NO: 224471 - RNA, 22 nt, Homo sapiens
auaagauaguggaagugggauu

SEQ ID NO: 224472 - RNA, 22 nt, Homo sapiens
auaagcuaagaguuucugggcu

SEQ ID NO: 224473 - RNA, 22 nt, Homo sapiens
auaagugcuuguugaauaauag

SEQ ID NO: 224474 - RNA, 22 nt, Homo sapiens
auaauaccugccucagagaguu

SEQ ID NO: 224475 - RNA, 22 nt, Homo sapiens
auaauacuuuuauuuugaggaa

SEQ ID NO: 224476 - RNA, 22 nt, Homo sapiens
auaauagguugauugacauugc

SEQ ID NO: 224477 - RNA, 22 nt, Homo sapiens
auaauaguguuuagauuuggga

SEQ ID NO: 224478 - RNA, 22 nt, Homo sapiens
auaaugacuuccaguuccacuc

SEQ ID NO: 224479 - RNA, 23 nt, Homo sapiens
auaaugcaaguggugguaaucug

SEQ ID NO: 224480 - RNA, 19 nt, Homo sapiens
auaauuagcagugaggaca

SEQ ID NO: 224481 - RNA, 22 nt, Homo sapiens
auacaagcaguccaacuccaua

SEQ ID NO: 224482 - RNA, 22 nt, Homo sapiens
auacaaggaaugaagagauuug

SEQ ID NO: 224483 - RNA, 22 nt, Homo sapiens
auacaaguuauuugaacugcgg

SEQ ID NO: 224484 - RNA, 22 nt, Homo sapiens
auacaguaucuucuggcaagca

SEQ ID NO: 224485 - RNA, 22 nt, Homo sapiens
auacaguguucugggaagaagu

SEQ ID NO: 224486 - RNA, 22 nt, Homo sapiens
auacaguugccauuucuugugc

SEQ ID NO: 224487 - RNA, 22 nt, Homo sapiens
auacauguuucauguuggugug

SEQ ID NO: 224488 - RNA, 22 nt, Homo sapiens
auacccaguaguggaauugcua

SEQ ID NO: 224489 - RNA, 22 nt, Homo sapiens
auacuaugagauaauaaagacu

SEQ ID NO: 224490 - RNA, 22 nt, Homo sapiens
auacuguacugaaguacccauu

SEQ ID NO: 224491 - RNA, 22 nt, Homo sapiens
auacuguauaggauuguagccu

SEQ ID NO: 224492 - RNA, 22 nt, Homo sapiens
auacuguuucugaacuuugauu

SEQ ID NO: 224493 - RNA, 22 nt, Homo sapiens
auagaccuggagaguagauaua

SEQ ID NO: 224494 - RNA, 23 nt, Homo sapiens
auagagcuaggaugcagacagau

SEQ ID NO: 224495 - RNA, 22 nt, Homo sapiens
auagaguccugcucgaguugcu

SEQ ID NO: 224496 - RNA, 22 nt, Homo sapiens
auagagugcuucaucaguagua

SEQ ID NO: 224497 - RNA, 22 nt, Homo sapiens
auagcaaugccccacuccuugg

SEQ ID NO: 224498 - RNA, 21 nt, Homo sapiens
auagcacaucagauuuuauua

SEQ ID NO: 224499 - RNA, 22 nt, Homo sapiens
auagcacugguuuuucuugguu

SEQ ID NO: 224500 - RNA, 22 nt, Homo sapiens
auagcagaacagugucucacug

SEQ ID NO: 224501 - RNA, 22 nt, Homo sapiens
auagcagcaccccacuaccuca

SEQ ID NO: 224502 - RNA, 22 nt, Homo sapiens
auagcagugugaaaauugacug

SEQ ID NO: 224503 - RNA, 22 nt, Homo sapiens
auagcuguugaauggaauauuc

SEQ ID NO: 224504 - RNA, 22 nt, Homo sapiens
auaggacuauugugaggauuaa

SEQ ID NO: 224505 - RNA, 22 nt, Homo sapiens
auaggcaagaugagguuuuuau

SEQ ID NO: 224506 - RNA, 22 nt, Homo sapiens
auagggcacgagaugugagccu

SEQ ID NO: 224507 - RNA, 21 nt, Homo sapiens
auagggcuuguugauaguuaa

SEQ ID NO: 224508 - RNA, 22 nt, Homo sapiens
auagguauguaauacaaaugaa

SEQ ID NO: 224509 - RNA, 22 nt, Homo sapiens
auagguuauuagagcaaagcuu

SEQ ID NO: 224510 - RNA, 22 nt, Homo sapiens
auaguacuauugcaguguuaua

SEQ ID NO: 224511 - RNA, 22 nt, Homo sapiens
auagugcagugaugaaccuagg

SEQ ID NO: 224512 - RNA, 21 nt, Homo sapiens
auagugcuagagaguagcagg

SEQ ID NO: 224513 - RNA, 22 nt, Homo sapiens
auagugcugcaaaaaacauacg

SEQ ID NO: 224514 - RNA, 22 nt, Homo sapiens
auagugcugcaauaaacauaca

SEQ ID NO: 224515 - RNA, 22 nt, Homo sapiens
auagugcugcagucaauguacg

SEQ ID NO: 224516 - RNA, 22 nt, Homo sapiens
auagugcuuuuuagaaccugga

SEQ ID NO: 224517 - RNA, 22 nt, Homo sapiens
auaguggcaugaucauagcuca

SEQ ID NO: 224518 - RNA, 19 nt, Homo sapiens
auauaacauccaggagcag

SEQ ID NO: 224519 - RNA, 22 nt, Homo sapiens
auauagcaaugaaagagaugaa

SEQ ID NO: 224520 - RNA, 22 nt, Homo sapiens
agauucauccaaguuguugcau

SEQ ID NO: 224521 - RNA, 22 nt, Homo sapiens
agcaaaucuaugaauguauauu

SEQ ID NO: 224522 - RNA, 22 nt, Homo sapiens
agcaagaaugaacucucccaga

SEQ ID NO: 224523 - RNA, 22 nt, Homo sapiens
agcacacuggguggcuuaaaca

SEQ ID NO: 224524 - RNA, 22 nt, Homo sapiens
agcacagugaaugguuuacuca

SEQ ID NO: 224525 - RNA, 22 nt, Homo sapiens
agcacauauauuucccaaaaca

SEQ ID NO: 224526 - RNA, 22 nt, Homo sapiens
agcaccaauaaucagaguucuu

SEQ ID NO: 224527 - RNA, 22 nt, Homo sapiens
agcaccacauacuacagagaua

SEQ ID NO: 224528 - RNA, 22 nt, Homo sapiens
agcaccagaaucugaguuauuc

SEQ ID NO: 224529 - RNA, 22 nt, Homo sapiens
agcaccauuuauugaaaagaca

SEQ ID NO: 224530 - RNA, 23 nt, Homo sapiens
agcaccuuuccuccacuaucugc

SEQ ID NO: 224531 - RNA, 19 nt, Homo sapiens
agcagaacaaauguguggg

SEQ ID NO: 224532 - RNA, 22 nt, Homo sapiens
agcagcacaucccuuucuggcc

SEQ ID NO: 224533 - RNA, 22 nt, Homo sapiens
agcagcauauuuuuauaaugua

SEQ ID NO: 224534 - RNA, 22 nt, Homo sapiens
agcagcaugaggggacuucugc

SEQ ID NO: 224535 - RNA, 22 nt, Homo sapiens
agcagcuuugaucugaaugauu

SEQ ID NO: 224536 - RNA, 22 nt, Homo sapiens
agcagcuuugcauggccugugg

SEQ ID NO: 224537 - RNA, 21 nt, Homo sapiens
agcagcuuugguugaagcaga

SEQ ID NO: 224538 - RNA, 22 nt, Homo sapiens
agcaggacaauaugggaucagg

SEQ ID NO: 224539 - RNA, 22 nt, Homo sapiens
agcagguauuuaagaaacucag

SEQ ID NO: 224540 - RNA, 22 nt, Homo sapiens
agcaguacauaaaaagcauccu

SEQ ID NO: 224541 - RNA, 22 nt, Homo sapiens
agcagugucauuuucuggugag

SEQ ID NO: 224542 - RNA, 22 nt, Homo sapiens
agcaucagugauuuuguugaag

SEQ ID NO: 224543 - RNA, 20 nt, Homo sapiens
agcaucagugguaguguugc

SEQ ID NO: 224544 - RNA, 20 nt, Homo sapiens
agcaucauugcaauuuguca

SEQ ID NO: 224545 - RNA, 22 nt, Homo sapiens
agcaucauuugauguucccgag

SEQ ID NO: 224546 - RNA, 22 nt, Homo sapiens
agcaugacauauuguagagaaa

SEQ ID NO: 224547 - RNA, 22 nt, Homo sapiens
agcauggucacuuugggcccca

SEQ ID NO: 224548 - RNA, 17 nt, Homo sapiens
agcauguguuugagauu

SEQ ID NO: 224549 - RNA, 22 nt, Homo sapiens
agccaagacucuguuccccuug

SEQ ID NO: 224550 - RNA, 22 nt, Homo sapiens
agccaguauuuccacagagugg

SEQ ID NO: 224551 - RNA, 22 nt, Homo sapiens
agccaguauuuugaguuggucu

SEQ ID NO: 224552 - RNA, 21 nt, Homo sapiens
agccugugggucauaguugcc

SEQ ID NO: 224553 - RNA, 22 nt, Homo sapiens
agccuguguugaauuauagaaa

SEQ ID NO: 224554 - RNA, 22 nt, Homo sapiens
agcuaacauuuuuccucuucca

SEQ ID NO: 224555 - RNA, 23 nt, Homo sapiens
agcuagagaggcuggggauacag

SEQ ID NO: 224556 - RNA, 19 nt, Homo sapiens
agcuagugcucagcuguca

SEQ ID NO: 224557 - RNA, 22 nt, Homo sapiens
agcuaguggucauucaauccuu

SEQ ID NO: 224558 - RNA, 22 nt, Homo sapiens
agcuccaugauaguaugucugu

SEQ ID NO: 224559 - RNA, 20 nt, Homo sapiens
agcuccauuccugaaggcug

SEQ ID NO: 224560 - RNA, 22 nt, Homo sapiens
agcuccuuugcuuuuuccagga

SEQ ID NO: 224561 - RNA, 22 nt, Homo sapiens
agcucuauuagaagccgugggu

SEQ ID NO: 224562 - RNA, 22 nt, Homo sapiens
agcucuuguuaguauuagcagu

SEQ ID NO: 224563 - RNA, 22 nt, Homo sapiens
agcugcaaagggagagaugauu

SEQ ID NO: 224564 - RNA, 22 nt, Homo sapiens
agcugcacaaauggaugugagg

SEQ ID NO: 224565 - RNA, 21 nt, Homo sapiens
agcugcguuuaggcauuuucc

SEQ ID NO: 224566 - RNA, 22 nt, Homo sapiens
agcuggcuguggagaaaccccu

SEQ ID NO: 224567 - RNA, 23 nt, Homo sapiens
agcugguacuagaggcuugcgcc

SEQ ID NO: 224568 - RNA, 22 nt, Homo sapiens
agcugguucuuugccuuguaga

SEQ ID NO: 224569 - RNA, 21 nt, Homo sapiens
agcugguuuccacagugugcu

SEQ ID NO: 224570 - RNA, 22 nt, Homo sapiens
agcuguaguuuauucauguuaa

SEQ ID NO: 224571 - RNA, 22 nt, Homo sapiens
agcuguguugucugaagucaga

SEQ ID NO: 224572 - RNA, 20 nt, Homo sapiens
agcuguuguuaugagguuua

SEQ ID NO: 224573 - RNA, 22 nt, Homo sapiens
agcuguuguucucagaggcuuu

SEQ ID NO: 224574 - RNA, 22 nt, Homo sapiens
agcuguuuuugugggcauguga

SEQ ID NO: 224575 - RNA, 22 nt, Homo sapiens
agcuucauuccaacuuccuucu

SEQ ID NO: 224576 - RNA, 22 nt, Homo sapiens
agcuugugcuguaugaagggcc

SEQ ID NO: 224577 - RNA, 21 nt, Homo sapiens
agcuuguguguaucacagugu

SEQ ID NO: 224578 - RNA, 22 nt, Homo sapiens
agcuuuggauaccugcuguucc

SEQ ID NO: 224579 - RNA, 22 nt, Homo sapiens
agcuuuuugggaggccuuagga

SEQ ID NO: 224580 - RNA, 22 nt, Homo sapiens
aggaaaucuuagcugaggggau

SEQ ID NO: 224581 - RNA, 22 nt, Homo sapiens
aggaagacugaaauugcuguuc

SEQ ID NO: 224582 - RNA, 22 nt, Homo sapiens
aggaaguaauaaguuugguucu

SEQ ID NO: 224583 - RNA, 22 nt, Homo sapiens
aggaagugucuucuuuuaggca

SEQ ID NO: 224584 - RNA, 23 nt, Homo sapiens
aggaauggaaaaccaaguaucau

SEQ ID NO: 224585 - RNA, 22 nt, Homo sapiens
aggaauguuaguacuucuuagu

SEQ ID NO: 224586 - RNA, 22 nt, Homo sapiens
aggaauuuaauguaugauaaua

SEQ ID NO: 224587 - RNA, 22 nt, Homo sapiens
aggacacugagcaugggagguu

SEQ ID NO: 224588 - RNA, 22 nt, Homo sapiens
aggaccauuguguagcagacau

SEQ ID NO: 224589 - RNA, 22 nt, Homo sapiens
aggaccccucaucagcaccagu

SEQ ID NO: 224590 - RNA, 19 nt, Homo sapiens
aggacuaaagacuagaagu

SEQ ID NO: 224591 - RNA, 21 nt, Homo sapiens
aggagcauucaugacgagguu

SEQ ID NO: 224592 - RNA, 22 nt, Homo sapiens
aggagcuuuggggaaaacagau

SEQ ID NO: 224593 - RNA, 22 nt, Homo sapiens
aggaggauugcuuucaucuuuu

SEQ ID NO: 224594 - RNA, 22 nt, Homo sapiens
aggauacugguaugggcugaau

SEQ ID NO: 224595 - RNA, 21 nt, Homo sapiens
aggcaagauuacuuacgagca

SEQ ID NO: 224596 - RNA, 22 nt, Homo sapiens
aggcaagcaucuugcucccuuc

SEQ ID NO: 224597 - RNA, 22 nt, Homo sapiens
aggcaaugugagaguuuauuca

SEQ ID NO: 224598 - RNA, 22 nt, Homo sapiens
aggcacgguggcucacaccugu

SEQ ID NO: 224599 - RNA, 22 nt, Homo sapiens
aggcagaugagguccucagcug

SEQ ID NO: 224600 - RNA, 22 nt, Homo sapiens
aggcaugaaauacaugcauuga

SEQ ID NO: 224601 - RNA, 23 nt, Homo sapiens
aggcauuguacaguaauggaaaa

SEQ ID NO: 224602 - RNA, 22 nt, Homo sapiens
aggcauugugcaucgaugauuu

SEQ ID NO: 224603 - RNA, 19 nt, Homo sapiens
aggcauugugcucaucugu

SEQ ID NO: 224604 - RNA, 22 nt, Homo sapiens
agggaagugugcuaugcauuua

SEQ ID NO: 224605 - RNA, 22 nt, Homo sapiens
agggcacuguagguccugccuc

SEQ ID NO: 224606 - RNA, 22 nt, Homo sapiens
agggcauuguacaaaucaucau

SEQ ID NO: 224607 - RNA, 22 nt, Homo sapiens
aggguaguaggcuugggauugg

SEQ ID NO: 224608 - RNA, 22 nt, Homo sapiens
agguauauuggacagauguaaa

SEQ ID NO: 224609 - RNA, 22 nt, Homo sapiens
agguauguauguaugggagaaa

SEQ ID NO: 224610 - RNA, 22 nt, Homo sapiens
agguauguaugucuguacagcg

SEQ ID NO: 224611 - RNA, 22 nt, Homo sapiens
agguccauugguauuauagcau

SEQ ID NO: 224612 - RNA, 22 nt, Homo sapiens
aggucccauguccucccugacc

SEQ ID NO: 224613 - RNA, 22 nt, Homo sapiens
aggugcaauggugguuuugugg

SEQ ID NO: 224614 - RNA, 22 nt, Homo sapiens
aggugcucuuccuguaggucac

SEQ ID NO: 224615 - RNA, 22 nt, Homo sapiens
agguuaacaucuauuuuggaug

SEQ ID NO: 224616 - RNA, 22 nt, Homo sapiens
aguaaagccagaccuguuaauu

SEQ ID NO: 224617 - RNA, 22 nt, Homo sapiens
augagaacugucaaugagagcu

SEQ ID NO: 224618 - RNA, 22 nt, Homo sapiens
augagaaugauucuguuauggu

SEQ ID NO: 224619 - RNA, 22 nt, Homo sapiens
augagacaguucccuuuaucuu

SEQ ID NO: 224620 - RNA, 22 nt, Homo sapiens
augagaccagcagaaaaccugu

SEQ ID NO: 224621 - RNA, 22 nt, Homo sapiens
augagagcaacaccuucacuug

SEQ ID NO: 224622 - RNA, 22 nt, Homo sapiens
augagagcuaacuguggguaca

SEQ ID NO: 224623 - RNA, 22 nt, Homo sapiens
augagagugagagcagccccuu

SEQ ID NO: 224624 - RNA, 22 nt, Homo sapiens
augagauaaaccaucucuuaag

SEQ ID NO: 224625 - RNA, 22 nt, Homo sapiens
augagaucaaauuuaagcuguu

SEQ ID NO: 224626 - RNA, 22 nt, Homo sapiens
augagaugaauaccgacgaugu

SEQ ID NO: 224627 - RNA, 22 nt, Homo sapiens
augagaugaggaauggcccucc

SEQ ID NO: 224628 - RNA, 22 nt, Homo sapiens
augagaugauaggcguucuaac

SEQ ID NO: 224629 - RNA, 22 nt, Homo sapiens
augagauuauguaaagagacca

SEQ ID NO: 224630 - RNA, 19 nt, Homo sapiens
augagcaauaguuuuaauc

SEQ ID NO: 224631 - RNA, 20 nt, Homo sapiens
augagcucaucuugaaaacc

SEQ ID NO: 224632 - RNA, 22 nt, Homo sapiens
augagcucauugggugacuggg

SEQ ID NO: 224633 - RNA, 22 nt, Homo sapiens
augaggagguaugauuuucuga

SEQ ID NO: 224634 - RNA, 22 nt, Homo sapiens
augaggauagguuucuauuagg

SEQ ID NO: 224635 - RNA, 22 nt, Homo sapiens
augaggcaggaaaggcguaucu

SEQ ID NO: 224636 - RNA, 22 nt, Homo sapiens
augagggcggacgcccuggaga

SEQ ID NO: 224637 - RNA, 23 nt, Homo sapiens
augagguaucugagcccagaaau

SEQ ID NO: 224638 - RNA, 22 nt, Homo sapiens
augaggugaggucaguaaggua

SEQ ID NO: 224639 - RNA, 21 nt, Homo sapiens
augagguguacuguggugaaa

SEQ ID NO: 224640 - RNA, 22 nt, Homo sapiens
augagugugaccugccaagaga

SEQ ID NO: 224641 - RNA, 22 nt, Homo sapiens
augauacugaguugaguucuca

SEQ ID NO: 224642 - RNA, 22 nt, Homo sapiens
augauacuggcuucauagaaug

SEQ ID NO: 224643 - RNA, 22 nt, Homo sapiens
augauauggucacccuuaugaa

SEQ ID NO: 224644 - RNA, 22 nt, Homo sapiens
augauccagugaguuucaguuc

SEQ ID NO: 224645 - RNA, 22 nt, Homo sapiens
augaucuguagaacuaguccuu

SEQ ID NO: 224646 - RNA, 22 nt, Homo sapiens
augaucuguuuggugaucuugu

SEQ ID NO: 224647 - RNA, 22 nt, Homo sapiens
augaugaaguaagugcuuagga

SEQ ID NO: 224648 - RNA, 22 nt, Homo sapiens
augaugcugcaguuguugccaa

SEQ ID NO: 224649 - RNA, 22 nt, Homo sapiens
augauggagguagauuguccau

SEQ ID NO: 224650 - RNA, 22 nt, Homo sapiens
augauuagaacucauuuccagg

SEQ ID NO: 224651 - RNA, 22 nt, Homo sapiens
augauugaccaucugcugggcu

SEQ ID NO: 224652 - RNA, 19 nt, Homo sapiens
augauugucuauggaggaa

SEQ ID NO: 224653 - RNA, 22 nt, Homo sapiens
augcaaacagcuaucuggcugg

SEQ ID NO: 224654 - RNA, 22 nt, Homo sapiens
augcaaaucuuaaguaugugug

SEQ ID NO: 224655 - RNA, 22 nt, Homo sapiens
augcaagaaauaucucuuuuuc

SEQ ID NO: 224656 - RNA, 22 nt, Homo sapiens
augcaagacaccgauuagcuuu

SEQ ID NO: 224657 - RNA, 22 nt, Homo sapiens
augcaagcacacaagaggaaau

SEQ ID NO: 224658 - RNA, 22 nt, Homo sapiens
augcaauggaaaggacaauuac

SEQ ID NO: 224659 - RNA, 22 nt, Homo sapiens
augcagaucacauuuuucuguc

SEQ ID NO: 224660 - RNA, 22 nt, Homo sapiens
augcauagcaucugcaaauguu

SEQ ID NO: 224661 - RNA, 18 nt, Homo sapiens
augcauauuuuaaguugu

SEQ ID NO: 224662 - RNA, 22 nt, Homo sapiens
augcauggucugaagucaaccu

SEQ ID NO: 224663 - RNA, 22 nt, Homo sapiens
augccacagaaauaaccaaaau

SEQ ID NO: 224664 - RNA, 22 nt, Homo sapiens
augccacugcgcucuagccugg

SEQ ID NO: 224665 - RNA, 22 nt, Homo sapiens
augccacuguacucuagccuag

SEQ ID NO: 224666 - RNA, 22 nt, Homo sapiens
augccacuguuuaugucacuua

SEQ ID NO: 224667 - RNA, 19 nt, Homo sapiens
augccuggagaugguuaua

SEQ ID NO: 224668 - RNA, 22 nt, Homo sapiens
augcuacauucuacaauuaggc

SEQ ID NO: 224669 - RNA, 22 nt, Homo sapiens
augcuacugauaagcaaucauu

SEQ ID NO: 224670 - RNA, 22 nt, Homo sapiens
augcuggugcuagaaacuggaa

SEQ ID NO: 224671 - RNA, 22 nt, Homo sapiens
augcuggugguucacaugcgca

SEQ ID NO: 224672 - RNA, 22 nt, Homo sapiens
auggaaaugaagggcuggcccu

SEQ ID NO: 224673 - RNA, 22 nt, Homo sapiens
auggaacauaacuauuugggga

SEQ ID NO: 224674 - RNA, 22 nt, Homo sapiens
auggaagacuccucuuugggua

SEQ ID NO: 224675 - RNA, 21 nt, Homo sapiens
auggacugugugacccugcac

SEQ ID NO: 224676 - RNA, 22 nt, Homo sapiens
auggagcuugacaguuguagag

SEQ ID NO: 224677 - RNA, 22 nt, Homo sapiens
auggaggacaaugucaccuuca

SEQ ID NO: 224678 - RNA, 22 nt, Homo sapiens
auggaguuuacuuaguguaaua

SEQ ID NO: 224679 - RNA, 22 nt, Homo sapiens
auggaguuugaacaauuuccug

SEQ ID NO: 224680 - RNA, 22 nt, Homo sapiens
auggauuuguaguacaugguug

SEQ ID NO: 224681 - RNA, 22 nt, Homo sapiens
auggauuuugaacuugagaguu

SEQ ID NO: 224682 - RNA, 22 nt, Homo sapiens
auggcaaugcgaugaugacuga

SEQ ID NO: 224683 - RNA, 22 nt, Homo sapiens
auggcacagaguagaugcucaa

SEQ ID NO: 224684 - RNA, 22 nt, Homo sapiens
auggcacucaaucaaguugaga

SEQ ID NO: 224685 - RNA, 22 nt, Homo sapiens
auggcacugccuggcuucaugg

SEQ ID NO: 224686 - RNA, 22 nt, Homo sapiens
auggcagaaucaagccgacagc

SEQ ID NO: 224687 - RNA, 22 nt, Homo sapiens
auggcagcccucuuuauccaug

SEQ ID NO: 224688 - RNA, 22 nt, Homo sapiens
auggcagcugacacuuccgucu

SEQ ID NO: 224689 - RNA, 22 nt, Homo sapiens
auggcaguuucagcuauaguuu

SEQ ID NO: 224690 - RNA, 22 nt, Homo sapiens
auggcaguuuggucucugugcu

SEQ ID NO: 224691 - RNA, 22 nt, Homo sapiens
auggcauggugaagucuuugga

SEQ ID NO: 224692 - RNA, 22 nt, Homo sapiens
auggcauugaagaguugucccu

SEQ ID NO: 224693 - RNA, 22 nt, Homo sapiens
auggcccaguuugcuaucccua

SEQ ID NO: 224694 - RNA, 23 nt, Homo sapiens
auggcccuggugggagugucuuu

SEQ ID NO: 224695 - RNA, 22 nt, Homo sapiens
auggcuagaaccuguauauuca

SEQ ID NO: 224696 - RNA, 22 nt, Homo sapiens
auggcucuuauuauuugaggua

SEQ ID NO: 224697 - RNA, 22 nt, Homo sapiens
auggcugugagaucgacuuauu

SEQ ID NO: 224698 - RNA, 22 nt, Homo sapiens
auggcuguuuaagaguuucauu

SEQ ID NO: 224699 - RNA, 22 nt, Homo sapiens
auggcuugugggaacuuuuaaa

SEQ ID NO: 224700 - RNA, 22 nt, Homo sapiens
auggcuuuguguucagagcuga

SEQ ID NO: 224701 - RNA, 22 nt, Homo sapiens
auggcuuuuccugucuugcaug

SEQ ID NO: 224702 - RNA, 22 nt, Homo sapiens
augggagugugguuagagaccu

SEQ ID NO: 224703 - RNA, 22 nt, Homo sapiens
augggcuaguaaagacaaacuu

SEQ ID NO: 224704 - RNA, 22 nt, Homo sapiens
augguacuggguaaaagugggg

SEQ ID NO: 224705 - RNA, 22 nt, Homo sapiens
augguauuuugugauaccuugu

SEQ ID NO: 224706 - RNA, 22 nt, Homo sapiens
auggucuuuauuguguugagug

SEQ ID NO: 224707 - RNA, 22 nt, Homo sapiens
auggucuuuguuucuaauucug

SEQ ID NO: 224708 - RNA, 22 nt, Homo sapiens
auggucuuuucccuggauuaua

SEQ ID NO: 224709 - RNA, 22 nt, Homo sapiens
auggugugugaauuaaauguua

SEQ ID NO: 224710 - RNA, 22 nt, Homo sapiens
augguuuuacugcaaaauggga

SEQ ID NO: 224711 - RNA, 22 nt, Homo sapiens
auguaagugugcucaaauguua

SEQ ID NO: 224712 - RNA, 22 nt, Homo sapiens
auguaauugagguuuuugccau

SEQ ID NO: 224713 - RNA, 22 nt, Homo sapiens
auguaguagcagaaaauauuuu

SEQ ID NO: 224714 - RNA, 23 nt, Homo sapiens
auauaguagaugugcaguaacau

SEQ ID NO: 224715 - RNA, 22 nt, Homo sapiens
auauaugcuaagugcuaauaaa

SEQ ID NO: 224716 - RNA, 22 nt, Homo sapiens
auaucaaggccauuuucuaaau

SEQ ID NO: 224717 - RNA, 22 nt, Homo sapiens
auaucacaaacaagucuguacu

SEQ ID NO: 224718 - RNA, 22 nt, Homo sapiens
auaucacagguguuuaccugau

SEQ ID NO: 224719 - RNA, 22 nt, Homo sapiens
auaucacucccaauaucgcagg

SEQ ID NO: 224720 - RNA, 22 nt, Homo sapiens
auaucccaguguguaaacacug

SEQ ID NO: 224721 - RNA, 22 nt, Homo sapiens
auaugcacaguggaguacuauu

SEQ ID NO: 224722 - RNA, 22 nt, Homo sapiens
auaugcacuauacacacguaua

SEQ ID NO: 224723 - RNA, 22 nt, Homo sapiens
auaugcauacauguaugcagga

SEQ ID NO: 224724 - RNA, 22 nt, Homo sapiens
auaugcuuauuagcaagaaaua

SEQ ID NO: 224725 - RNA, 22 nt, Homo sapiens
auauggcuuuuauuauguugag

SEQ ID NO: 224726 - RNA, 22 nt, Homo sapiens
auauggguuuuauauuaggcuc

SEQ ID NO: 224727 - RNA, 22 nt, Homo sapiens
auaugguacuuaugcucaaacu

SEQ ID NO: 224728 - RNA, 22 nt, Homo sapiens
auauguaguuucagaaguggaa

SEQ ID NO: 224729 - RNA, 22 nt, Homo sapiens
auauguucucauucauaugugg

SEQ ID NO: 224730 - RNA, 22 nt, Homo sapiens
auauuacuggcuauaucgcaag

SEQ ID NO: 224731 - RNA, 21 nt, Homo sapiens
auauuacuguuagaggacugc

SEQ ID NO: 224732 - RNA, 22 nt, Homo sapiens
auauuggacugugcuaguuaga

SEQ ID NO: 224733 - RNA, 22 nt, Homo sapiens
aucaaauugucauuuuaaggau

SEQ ID NO: 224734 - RNA, 22 nt, Homo sapiens
aucaaguacuguacugaaagug

SEQ ID NO: 224735 - RNA, 22 nt, Homo sapiens
aucacacuguuauuuuaguuaa

SEQ ID NO: 224736 - RNA, 22 nt, Homo sapiens
aucacagauauggguuuaaauc

SEQ ID NO: 224737 - RNA, 22 nt, Homo sapiens
aucacagugagcauaugucuau

SEQ ID NO: 224738 - RNA, 22 nt, Homo sapiens
aucacaguggcucacaagagcc

SEQ ID NO: 224739 - RNA, 22 nt, Homo sapiens
aucacaguuaagaggugaugaa

SEQ ID NO: 224740 - RNA, 22 nt, Homo sapiens
aucacauggccuagccuaaccu

SEQ ID NO: 224741 - RNA, 22 nt, Homo sapiens
aucaccuuucccuuucugaauc

SEQ ID NO: 224742 - RNA, 22 nt, Homo sapiens
aucacuagaucauagguaaaca

SEQ ID NO: 224743 - RNA, 22 nt, Homo sapiens
aucacugggauggaacugcuga

SEQ ID NO: 224744 - RNA, 22 nt, Homo sapiens
aucacugugauuucuacugugc

SEQ ID NO: 224745 - RNA, 22 nt, Homo sapiens
aucagaaucucuagaggacugu

SEQ ID NO: 224746 - RNA, 22 nt, Homo sapiens
aucagaaucucuagugggacca

SEQ ID NO: 224747 - RNA, 22 nt, Homo sapiens
aucagagugaaacaugggagau

SEQ ID NO: 224748 - RNA, 22 nt, Homo sapiens
aucagagugaugguuuaaguau

SEQ ID NO: 224749 - RNA, 22 nt, Homo sapiens
aucagaguggguuuuaaaagug

SEQ ID NO: 224750 - RNA, 23 nt, Homo sapiens
aucagauaguuguagguaugugg

SEQ ID NO: 224751 - RNA, 19 nt, Homo sapiens
aucagcacaagugugcuuu

SEQ ID NO: 224752 - RNA, 22 nt, Homo sapiens
aucagcaguguaaaaacggacu

SEQ ID NO: 224753 - RNA, 22 nt, Homo sapiens
aucaggcacacauuggaguuug

SEQ ID NO: 224754 - RNA, 22 nt, Homo sapiens
aucagucuguuggaauaucgcu

SEQ ID NO: 224755 - RNA, 22 nt, Homo sapiens
aucagugcagugggaacuagaa

SEQ ID NO: 224756 - RNA, 22 nt, Homo sapiens
aucauacuguuuugauuacugu

SEQ ID NO: 224757 - RNA, 22 nt, Homo sapiens
aucaucacaguuguguguaaug

SEQ ID NO: 224758 - RNA, 22 nt, Homo sapiens
aucauccagccccagaagggag

SEQ ID NO: 224759 - RNA, 22 nt, Homo sapiens
aucauggaguauuugcaagucu

SEQ ID NO: 224760 - RNA, 22 nt, Homo sapiens
aucauguaguaagacacauuua

SEQ ID NO: 224761 - RNA, 22 nt, Homo sapiens
auccaagagacugaugacuucc

SEQ ID NO: 224762 - RNA, 22 nt, Homo sapiens
auccaguguuuucuuuugucac

SEQ ID NO: 224763 - RNA, 22 nt, Homo sapiens
auccaguuuuaggagauuucua

SEQ ID NO: 224764 - RNA, 22 nt, Homo sapiens
auccaucagacggcaggcguug

SEQ ID NO: 224765 - RNA, 22 nt, Homo sapiens
aucccagaaacucggguuucuc

SEQ ID NO: 224766 - RNA, 22 nt, Homo sapiens
aucccaguucagccucugacac

SEQ ID NO: 224767 - RNA, 20 nt, Homo sapiens
aucccauuccugaagauacu

SEQ ID NO: 224768 - RNA, 22 nt, Homo sapiens
auccccuugcagugaccggggc

SEQ ID NO: 224769 - RNA, 22 nt, Homo sapiens
aucccgagacuuugcugaaguu

SEQ ID NO: 224770 - RNA, 22 nt, Homo sapiens
aucccugagaacuuuuaauguu

SEQ ID NO: 224771 - RNA, 22 nt, Homo sapiens
aucccuugacguggagucucug

SEQ ID NO: 224772 - RNA, 22 nt, Homo sapiens
auccucaguggcuuaaguauag

SEQ ID NO: 224773 - RNA, 22 nt, Homo sapiens
auccugaugacacagugcugca

SEQ ID NO: 224774 - RNA, 22 nt, Homo sapiens
auccuguagagaugagggugga

SEQ ID NO: 224775 - RNA, 22 nt, Homo sapiens
auccuguaggcuaguagacagu

SEQ ID NO: 224776 - RNA, 22 nt, Homo sapiens
auccuugagaaaauaaaugacc

SEQ ID NO: 224777 - RNA, 22 nt, Homo sapiens
aucgcugagaaagggacuuuca

SEQ ID NO: 224778 - RNA, 22 nt, Homo sapiens
aucuagagacauaguaaagaau

SEQ ID NO: 224779 - RNA, 22 nt, Homo sapiens
aucucaguuaauuccaucuuuc

SEQ ID NO: 224780 - RNA, 22 nt, Homo sapiens
aucucaguucaggcuggccaca

SEQ ID NO: 224781 - RNA, 22 nt, Homo sapiens
aucucauggagguagagaguaa

SEQ ID NO: 224782 - RNA, 22 nt, Homo sapiens
aucucauuccuucugggcugau

SEQ ID NO: 224783 - RNA, 22 nt, Homo sapiens
aucuccaggugccagcugcgcc

SEQ ID NO: 224784 - RNA, 22 nt, Homo sapiens
aucugacuuuuaauuugaaaac

SEQ ID NO: 224785 - RNA, 22 nt, Homo sapiens
aucugcauuagggugaagaccu

SEQ ID NO: 224786 - RNA, 22 nt, Homo sapiens
aucuggcguuuacuuccuuccu

SEQ ID NO: 224787 - RNA, 22 nt, Homo sapiens
aucuggcuccuuuugacaaugc

SEQ ID NO: 224788 - RNA, 22 nt, Homo sapiens
aucugguguggcugugauccuc

SEQ ID NO: 224789 - RNA, 22 nt, Homo sapiens
aucuugcauuugcuaaaaugca

SEQ ID NO: 224790 - RNA, 22 nt, Homo sapiens
aucuuuaguggcuguuuucaga

SEQ ID NO: 224791 - RNA, 22 nt, Homo sapiens
aucuuugauuagacugauggau

SEQ ID NO: 224792 - RNA, 22 nt, Homo sapiens
augaaagucaauccccaagugu

SEQ ID NO: 224793 - RNA, 22 nt, Homo sapiens
augaaagugauaaaugucucua

SEQ ID NO: 224794 - RNA, 22 nt, Homo sapiens
augaacagagccuugagaaccu

SEQ ID NO: 224795 - RNA, 22 nt, Homo sapiens
augaacucaucauuuuuauggc

SEQ ID NO: 224796 - RNA, 22 nt, Homo sapiens
augaacucaucauuuuuuaugg

SEQ ID NO: 224797 - RNA, 22 nt, Homo sapiens
augaagaucaugaagacggcuu

SEQ ID NO: 224798 - RNA, 20 nt, Homo sapiens
augaagugaaguuagggaac

SEQ ID NO: 224799 - RNA, 22 nt, Homo sapiens
augaauacagcuaugcgugcau

SEQ ID NO: 224800 - RNA, 22 nt, Homo sapiens
augaaugcagcacuguuuuucu

SEQ ID NO: 224801 - RNA, 22 nt, Homo sapiens
augaaugcuuuuggauguaucu

SEQ ID NO: 224802 - RNA, 21 nt, Homo sapiens
augaauguaaagaauguggga

SEQ ID NO: 224803 - RNA, 22 nt, Homo sapiens
augaauucaucugguuuuggga

SEQ ID NO: 224804 - RNA, 22 nt, Homo sapiens
augacaagagccuucuuuccuu

SEQ ID NO: 224805 - RNA, 22 nt, Homo sapiens
augacauagaagcaauccccua

SEQ ID NO: 224806 - RNA, 22 nt, Homo sapiens
augaccagagagugcgcagggu

SEQ ID NO: 224807 - RNA, 22 nt, Homo sapiens
augaccaugauccuugccgacc

SEQ ID NO: 224808 - RNA, 22 nt, Homo sapiens
augaccuuguccucagugucau

SEQ ID NO: 224809 - RNA, 22 nt, Homo sapiens
augacuauugcacuuuccuggu

SEQ ID NO: 224810 - RNA, 22 nt, Homo sapiens
augagaacauaucaagugauug

SEQ ID NO: 224811 - RNA, 22 nt, Homo sapiens
aaagugcugggauuaggccagg

SEQ ID NO: 224812 - RNA, 22 nt, Homo sapiens
aaagugcugggauuggcugggc

SEQ ID NO: 224813 - RNA, 22 nt, Homo sapiens
aaagugcuguagacugggcgca

SEQ ID NO: 224814 - RNA, 22 nt, Homo sapiens
aaaguggacuaagugaauauga

SEQ ID NO: 224815 - RNA, 22 nt, Homo sapiens
aaaguggugggauuccaggcau

SEQ ID NO: 224816 - RNA, 22 nt, Homo sapiens
aaagugguuuuucagacuuuga

SEQ ID NO: 224817 - RNA, 22 nt, Homo sapiens
aaagugucuguuccuagcauga

SEQ ID NO: 224818 - RNA, 22 nt, Homo sapiens
aaaguguguuuccaaccugugg

SEQ ID NO: 224819 - RNA, 19 nt, Homo sapiens
aaaguguuuuaaagaggau

SEQ ID NO: 224820 - RNA, 22 nt, Homo sapiens
aaaguucuguugauagugcuga

SEQ ID NO: 224821 - RNA, 19 nt, Homo sapiens
aaaguucuucccuuuggag

SEQ ID NO: 224822 - RNA, 15 nt, Homo sapiens
aaauaugucaguucu

SEQ ID NO: 224823 - RNA, 22 nt, Homo sapiens
aaauccaucucuuggggcauug

SEQ ID NO: 224824 - RNA, 22 nt, Homo sapiens
aaaucccuugcucucucagacc

SEQ ID NO: 224825 - RNA, 22 nt, Homo sapiens
aaaugcaccacucuggugcagg

SEQ ID NO: 224826 - RNA, 22 nt, Homo sapiens
aaaugcacgcuacccagcuaga

SEQ ID NO: 224827 - RNA, 22 nt, Homo sapiens
aaaugcagcacucaagugggaa

SEQ ID NO: 224828 - RNA, 22 nt, Homo sapiens
aaaugcauugagggaaaaggca

SEQ ID NO: 224829 - RNA, 22 nt, Homo sapiens
aaaugcuuucuuggaccauuug

SEQ ID NO: 224830 - RNA, 22 nt, Homo sapiens
aaauugcaaugcgaggcagagg

SEQ ID NO: 224831 - RNA, 22 nt, Homo sapiens
aaauuguccuauugguuuaagc

SEQ ID NO: 224832 - RNA, 23 nt, Homo sapiens
aaauuugccuauuauuccuaugg

SEQ ID NO: 224833 - RNA, 22 nt, Homo sapiens
aacaccguagaaacacaaggga

SEQ ID NO: 224834 - RNA, 22 nt, Homo sapiens
aacacggcccgcagagcaagcu

SEQ ID NO: 224835 - RNA, 22 nt, Homo sapiens
aacagugccugucauuuaguag

SEQ ID NO: 224836 - RNA, 22 nt, Homo sapiens
aacaguguuuuggguuuucugg

SEQ ID NO: 224837 - RNA, 22 nt, Homo sapiens
aacauagucaugggguaauguu

SEQ ID NO: 224838 - RNA, 22 nt, Homo sapiens
aaccacauggcucaguggacau

SEQ ID NO: 224839 - RNA, 22 nt, Homo sapiens
aacccugagucaugagucuaga

SEQ ID NO: 224840 - RNA, 22 nt, Homo sapiens
aaccugaagaaaauauuugcug

SEQ ID NO: 224841 - RNA, 15 nt, Homo sapiens
aaccuggaggagcuu

SEQ ID NO: 224842 - RNA, 22 nt, Homo sapiens
aaccuguaaccauaugaucagu

SEQ ID NO: 224843 - RNA, 22 nt, Homo sapiens
aaccuucauuccuuucccugcc

SEQ ID NO: 224844 - RNA, 22 nt, Homo sapiens
aacuccauuuuagacccuagau

SEQ ID NO: 224845 - RNA, 22 nt, Homo sapiens
aacuggcacuacaucaagagcu

SEQ ID NO: 224846 - RNA, 22 nt, Homo sapiens
aacuggcauaugaacuuguucu

SEQ ID NO: 224847 - RNA, 22 nt, Homo sapiens
aacuggcauauucugguugcgg

SEQ ID NO: 224848 - RNA, 22 nt, Homo sapiens
aacuggccugagaugaaaagug

SEQ ID NO: 224849 - RNA, 22 nt, Homo sapiens
aacugggcaagcauuacauggu

SEQ ID NO: 224850 - RNA, 22 nt, Homo sapiens
aacugguauugaauuuaggaag

SEQ ID NO: 224851 - RNA, 20 nt, Homo sapiens
aagacacuguccccacugga

SEQ ID NO: 224852 - RNA, 22 nt, Homo sapiens
aagagcauuauuuaguaauuuc

SEQ ID NO: 224853 - RNA, 22 nt, Homo sapiens
aagagguagucugucccuuagc

SEQ ID NO: 224854 - RNA, 22 nt, Homo sapiens
aagagguuguaccuaaaguguu

SEQ ID NO: 224855 - RNA, 22 nt, Homo sapiens
aagagugcucgugggacucagc

SEQ ID NO: 224856 - RNA, 22 nt, Homo sapiens
aagauaguaaacauuuucugcu

SEQ ID NO: 224857 - RNA, 22 nt, Homo sapiens
aagaucaucauagagggcauga

SEQ ID NO: 224858 - RNA, 22 nt, Homo sapiens
aagaucauucagggaaggcuga

SEQ ID NO: 224859 - RNA, 22 nt, Homo sapiens
aagaugcagucauacuggagua

SEQ ID NO: 224860 - RNA, 20 nt, Homo sapiens
aagcaagcauuugcaaucau

SEQ ID NO: 224861 - RNA, 22 nt, Homo sapiens
aagcaggugaugagugggugug

SEQ ID NO: 224862 - RNA, 22 nt, Homo sapiens
aagcaguguggacuaaugggaa

SEQ ID NO: 224863 - RNA, 22 nt, Homo sapiens
aagcucauugagaucuauggcu

SEQ ID NO: 224864 - RNA, 22 nt, Homo sapiens
aagcuccauuucugccaugaga

SEQ ID NO: 224865 - RNA, 20 nt, Homo sapiens
aagcugaguguuuuuuuaau

SEQ ID NO: 224866 - RNA, 22 nt, Homo sapiens
aagcugcauuuucuagaugcuu

SEQ ID NO: 224867 - RNA, 22 nt, Homo sapiens
aagcuggauuucgcauccuguu

SEQ ID NO: 224868 - RNA, 22 nt, Homo sapiens
aagcugugucuugucagcuacc

SEQ ID NO: 224869 - RNA, 22 nt, Homo sapiens
aagcuguguguaagcucucaca

SEQ ID NO: 224870 - RNA, 22 nt, Homo sapiens
aaggaaguaauuugguuuauag

SEQ ID NO: 224871 - RNA, 22 nt, Homo sapiens
aaggagcagagagcccuguuuc

SEQ ID NO: 224872 - RNA, 22 nt, Homo sapiens
aaggagcaguggacggguccua

SEQ ID NO: 224873 - RNA, 22 nt, Homo sapiens
aaggagcuaagagaucauacau

SEQ ID NO: 224874 - RNA, 22 nt, Homo sapiens
aaggagcuuaagugacuuguac

SEQ ID NO: 224875 - RNA, 22 nt, Homo sapiens
aaggaguagacaacauggcgcc

SEQ ID NO: 224876 - RNA, 22 nt, Homo sapiens
aaggauuguaaaguugacaaau

SEQ ID NO: 224877 - RNA, 22 nt, Homo sapiens
aaggcaacgugaguuguugauu

SEQ ID NO: 224878 - RNA, 22 nt, Homo sapiens
aaggcagugugcacauaacacu

SEQ ID NO: 224879 - RNA, 22 nt, Homo sapiens
aaggcaugcugaguccuaaaag

SEQ ID NO: 224880 - RNA, 22 nt, Homo sapiens
aaggcuguuguguaauaggauu

SEQ ID NO: 224881 - RNA, 22 nt, Homo sapiens
aagggaaugcgcugccuguguu

SEQ ID NO: 224882 - RNA, 22 nt, Homo sapiens
aagguagcugagugaagugguu

SEQ ID NO: 224883 - RNA, 22 nt, Homo sapiens
aagguauuucuaugggaauaga

SEQ ID NO: 224884 - RNA, 21 nt, Homo sapiens
aaggugguggugauugagaug

SEQ ID NO: 224885 - RNA, 22 nt, Homo sapiens
aagguggugucagagagcuuau

SEQ ID NO: 224886 - RNA, 22 nt, Homo sapiens
aaggugguuuucucuuggaguc

SEQ ID NO: 224887 - RNA, 22 nt, Homo sapiens
aaguaaacauugagagacaaga

SEQ ID NO: 224888 - RNA, 22 nt, Homo sapiens
aaguaaauauccgguaguccca

SEQ ID NO: 224889 - RNA, 19 nt, Homo sapiens
aaguacuugucuuuugaag

SEQ ID NO: 224890 - RNA, 22 nt, Homo sapiens
aagucaguuugggagaagcuau

SEQ ID NO: 224891 - RNA, 22 nt, Homo sapiens
aagucaugaagaggaaaggaca

SEQ ID NO: 224892 - RNA, 22 nt, Homo sapiens
aagucauggagaagguggaggu

SEQ ID NO: 224893 - RNA, 22 nt, Homo sapiens
aagugagaugcaguggaguucc

SEQ ID NO: 224894 - RNA, 20 nt, Homo sapiens
aagugcaucguugugucugc

SEQ ID NO: 224895 - RNA, 22 nt, Homo sapiens
aagugccauguggaugggcccu

SEQ ID NO: 224896 - RNA, 22 nt, Homo sapiens
aagugcucuugugggaagagag

SEQ ID NO: 224897 - RNA, 22 nt, Homo sapiens
aagugcuggccuacucaaucga

SEQ ID NO: 224898 - RNA, 22 nt, Homo sapiens
aagugcuucagaagacaauauu

SEQ ID NO: 224899 - RNA, 22 nt, Homo sapiens
caagaucauuuaugcuaaaauu

SEQ ID NO: 224900 - RNA, 22 nt, Homo sapiens
caagugcuacagagaaaucuuu

SEQ ID NO: 224901 - RNA, 22 nt, Homo sapiens
caagugcuugaugaaugaucaa

SEQ ID NO: 224902 - RNA, 22 nt, Homo sapiens
caagugcuuucuuggggauuua

SEQ ID NO: 224903 - RNA, 22 nt, Homo sapiens
caaugcagcuuuuggagagaaa

SEQ ID NO: 224904 - RNA, 22 nt, Homo sapiens
caaugcauuauucucccacuuc

SEQ ID NO: 224905 - RNA, 21 nt, Homo sapiens
caauggcacgaucuuggcuca

SEQ ID NO: 224906 - RNA, 22 nt, Homo sapiens
cacacugucuucauuacuguag

SEQ ID NO: 224907 - RNA, 22 nt, Homo sapiens
cacaguugccuaucuccugaag

SEQ ID NO: 224908 - RNA, 22 nt, Homo sapiens
cacauagcuagucaguagugaa

SEQ ID NO: 224909 - RNA, 22 nt, Homo sapiens
cacauguuuuagcauggcuguu

SEQ ID NO: 224910 - RNA, 16 nt, Homo sapiens
cacauugcugcauggc

SEQ ID NO: 224911 - RNA, 22 nt, Homo sapiens
caccacuacaccccaggcuggg

SEQ ID NO: 224912 - RNA, 22 nt, Homo sapiens
caccaggugcccagcacggcca

SEQ ID NO: 224913 - RNA, 22 nt, Homo sapiens
caccagguggcugaggccauga

SEQ ID NO: 224914 - RNA, 23 nt, Homo sapiens
caccaguauaauuagcuuuuaaa

SEQ ID NO: 224915 - RNA, 22 nt, Homo sapiens
caccaguuuuucagugauucaa

SEQ ID NO: 224916 - RNA, 22 nt, Homo sapiens
cacccaguaagcaugaggcccu

SEQ ID NO: 224917 - RNA, 22 nt, Homo sapiens
cacccuuagaguuggaaguggg

SEQ ID NO: 224918 - RNA, 22 nt, Homo sapiens
caccgagugugccaucuucuca

SEQ ID NO: 224919 - RNA, 22 nt, Homo sapiens
caccuagacuggagugcagugg

SEQ ID NO: 224920 - RNA, 22 nt, Homo sapiens
caccuguagucccagcugaggc

SEQ ID NO: 224921 - RNA, 18 nt, Homo sapiens
cacugagcccuucacucu

SEQ ID NO: 224922 - RNA, 22 nt, Homo sapiens
cacugcacuccagucugacgac

SEQ ID NO: 224923 - RNA, 22 nt, Homo sapiens
cacugcacuccaguuuggauga

SEQ ID NO: 224924 - RNA, 22 nt, Homo sapiens
cacugcaguguaauuaagguug

SEQ ID NO: 224925 - RNA, 22 nt, Homo sapiens
cacugcauccuccaccuccugg

SEQ ID NO: 224926 - RNA, 22 nt, Homo sapiens
cacugcauccuccauauccugg

SEQ ID NO: 224927 - RNA, 22 nt, Homo sapiens
cacugcauccuugaccuucugg

SEQ ID NO: 224928 - RNA, 22 nt, Homo sapiens
cacugcauggccacccauguua

SEQ ID NO: 224929 - RNA, 22 nt, Homo sapiens
cacuggucucauggcaugagag

SEQ ID NO: 224930 - RNA, 16 nt, Homo sapiens
cacuggucuuaccaug

SEQ ID NO: 224931 - RNA, 21 nt, Homo sapiens
cacugguguugcuauaucaaa

SEQ ID NO: 224932 - RNA, 22 nt, Homo sapiens
cacuguggauggaacuauguga

SEQ ID NO: 224933 - RNA, 18 nt, Homo sapiens
cacuuggcuuugccccuc

SEQ ID NO: 224934 - RNA, 22 nt, Homo sapiens
cacuuugguucaccugaguuuc

SEQ ID NO: 224935 - RNA, 22 nt, Homo sapiens
cagaaguauugguaugcucugu

SEQ ID NO: 224936 - RNA, 22 nt, Homo sapiens
cagacagugucccgagucccug

SEQ ID NO: 224937 - RNA, 22 nt, Homo sapiens
cagagaucaugcaacugcucgc

SEQ ID NO: 224938 - RNA, 22 nt, Homo sapiens
cagagcacuaaagguaaaaggc

SEQ ID NO: 224939 - RNA, 22 nt, Homo sapiens
cagagguaagcaagucagcauu

SEQ ID NO: 224940 - RNA, 22 nt, Homo sapiens
cagagugcauguuuagaugagu

SEQ ID NO: 224941 - RNA, 22 nt, Homo sapiens
cagaguuaguagccuuugacaa

SEQ ID NO: 224942 - RNA, 22 nt, Homo sapiens
cagauaguuguagauaugcagc

SEQ ID NO: 224943 - RNA, 22 nt, Homo sapiens
cagaucaucuugagcuuaggaa

SEQ ID NO: 224944 - RNA, 22 nt, Homo sapiens
cagaugcaugaccugggcuugg

SEQ ID NO: 224945 - RNA, 22 nt, Homo sapiens
cagauggucuuaaggcagccuu

SEQ ID NO: 224946 - RNA, 22 nt, Homo sapiens
cagcaaaucauccuauuugagc

SEQ ID NO: 224947 - RNA, 22 nt, Homo sapiens
cagcacauuacaaguacuuggu

SEQ ID NO: 224948 - RNA, 20 nt, Homo sapiens
cagcacgcacaugagacugu

SEQ ID NO: 224949 - RNA, 22 nt, Homo sapiens
cagccggguggcuccuagggua

SEQ ID NO: 224950 - RNA, 22 nt, Homo sapiens
cagcuaaauuguuaaauccaag

SEQ ID NO: 224951 - RNA, 20 nt, Homo sapiens
cagcuaccugggaaauuugg

SEQ ID NO: 224952 - RNA, 22 nt, Homo sapiens
cagcuagcaugcguaacuuucu

SEQ ID NO: 224953 - RNA, 20 nt, Homo sapiens
cagcuagugguaggagucgg

SEQ ID NO: 224954 - RNA, 22 nt, Homo sapiens
cagcugaugucgaaugcacucu

SEQ ID NO: 224955 - RNA, 22 nt, Homo sapiens
cagcugcuuuggaaaauauuuu

SEQ ID NO: 224956 - RNA, 22 nt, Homo sapiens
cagcuggugcugcaccaguggg

SEQ ID NO: 224957 - RNA, 22 nt, Homo sapiens
cagcugguguuacaaaccagag

SEQ ID NO: 224958 - RNA, 22 nt, Homo sapiens
caggaaugugaggguucccugc

SEQ ID NO: 224959 - RNA, 22 nt, Homo sapiens
caggaccucuugccuggaagcc

SEQ ID NO: 224960 - RNA, 22 nt, Homo sapiens
caggcauuguauuguaaucccc

SEQ ID NO: 224961 - RNA, 22 nt, Homo sapiens
cagggcaugugggucuauuggc

SEQ ID NO: 224962 - RNA, 22 nt, Homo sapiens
cagggcauuggcugguaccugg

SEQ ID NO: 224963 - RNA, 22 nt, Homo sapiens
cagguacaugcaugugugugca

SEQ ID NO: 224964 - RNA, 22 nt, Homo sapiens
cagguacuucugggcugagcag

SEQ ID NO: 224965 - RNA, 19 nt, Homo sapiens
cagguagugugcugacaug

SEQ ID NO: 224966 - RNA, 22 nt, Homo sapiens
cagguaguguguagcacagcag

SEQ ID NO: 224967 - RNA, 22 nt, Homo sapiens
caguacaauguugauuagaagu

SEQ ID NO: 224968 - RNA, 22 nt, Homo sapiens
caguaguagccccuuagaugga

SEQ ID NO: 224969 - RNA, 22 nt, Homo sapiens
cagucacagugacaggaugugg

SEQ ID NO: 224970 - RNA, 22 nt, Homo sapiens
cagucacugggauuauggucau

SEQ ID NO: 224971 - RNA, 22 nt, Homo sapiens
cagugaauuucaggucaagagu

SEQ ID NO: 224972 - RNA, 22 nt, Homo sapiens
cagugcacugggauuauaagug

SEQ ID NO: 224973 - RNA, 20 nt, Homo sapiens
cagugcacuuucccacuggu

SEQ ID NO: 224974 - RNA, 22 nt, Homo sapiens
cagugcauagaugugccacauu

SEQ ID NO: 224975 - RNA, 20 nt, Homo sapiens
cagugcauugcuucugauuu

SEQ ID NO: 224976 - RNA, 22 nt, Homo sapiens
cagugcuuguuauuguucuauu

SEQ ID NO: 224977 - RNA, 22 nt, Homo sapiens
cagugcuuuaucaaguccucca

SEQ ID NO: 224978 - RNA, 22 nt, Homo sapiens
caguggauuggauggauaaugc

SEQ ID NO: 224979 - RNA, 23 nt, Homo sapiens
cagugguguuagagaaaucuuuu

SEQ ID NO: 224980 - RNA, 22 nt, Homo sapiens
cagugguuuucucaguucagca

SEQ ID NO: 224981 - RNA, 22 nt, Homo sapiens
caguguuuuuaacaggugcccg

SEQ ID NO: 224982 - RNA, 22 nt, Homo sapiens
caguugguguacauauauguau

SEQ ID NO: 224983 - RNA, 22 nt, Homo sapiens
caguuguuuuaugacauaagau

SEQ ID NO: 224984 - RNA, 22 nt, Homo sapiens
uauuucccuuaacuuuccugca

SEQ ID NO: 224985 - RNA, 22 nt, Homo sapiens
uauuuggauagucuggaaaaaa

SEQ ID NO: 224986 - RNA, 22 nt, Homo sapiens
uauuugguagcuauuuugcagu

SEQ ID NO: 224987 - RNA, 22 nt, Homo sapiens
uauuugguuacuugaauagcua

SEQ ID NO: 224988 - RNA, 22 nt, Homo sapiens
uauuugguuauaugaguaaguu

SEQ ID NO: 224989 - RNA, 22 nt, Homo sapiens
ucaaacauccccaccagggacu

SEQ ID NO: 224990 - RNA, 22 nt, Homo sapiens
ucaaacugcuugaggccauuua

SEQ ID NO: 224991 - RNA, 22 nt, Homo sapiens
ucaaagacacacaaggagaagg

SEQ ID NO: 224992 - RNA, 20 nt, Homo sapiens
ucaaagacauggcugucaga

SEQ ID NO: 224993 - RNA, 22 nt, Homo sapiens
ucaaagugacaaaguugcagca

SEQ ID NO: 224994 - RNA, 22 nt, Homo sapiens
ucaaagugagcuccuucucacu

SEQ ID NO: 224995 - RNA, 22 nt, Homo sapiens
ucaaaugauucacccaccuuug

SEQ ID NO: 224996 - RNA, 17 nt, Homo sapiens
ucaaaugcucccaguga

SEQ ID NO: 224997 - RNA, 22 nt, Homo sapiens
ucaaaugcucuuugcagagagg

SEQ ID NO: 224998 - RNA, 22 nt, Homo sapiens
ucaaaugguccacgugaacauu

SEQ ID NO: 224999 - RNA, 22 nt, Homo sapiens
ucaacagugggcacuguaaaug

SEQ ID NO: 225000 - RNA, 21 nt, Homo sapiens
ucaacccuugcgucaccaagc

SEQ ID NO: 225001 - RNA, 22 nt, Homo sapiens
ucaagcaauucuccucucagcc

SEQ ID NO: 225002 - RNA, 22 nt, Homo sapiens
ucaagcaauucugcugccucag

SEQ ID NO: 225003 - RNA, 18 nt, Homo sapiens
ucaagcuauugucaugcc

SEQ ID NO: 225004 - RNA, 22 nt, Homo sapiens
ucaaggacuacauggggugaaa

SEQ ID NO: 225005 - RNA, 22 nt, Homo sapiens
ucaaggacucagagagggauua

SEQ ID NO: 225006 - RNA, 22 nt, Homo sapiens
ucaaguaauacucccaucuugg

SEQ ID NO: 225007 - RNA, 22 nt, Homo sapiens
ucaaguacuuauuugauaauua

SEQ ID NO: 225008 - RNA, 18 nt, Homo sapiens
ucaauguggauguucuuu

SEQ ID NO: 225009 - RNA, 18 nt, Homo sapiens
ucacaaccacagugcugu

SEQ ID NO: 225010 - RNA, 22 nt, Homo sapiens
ucacaagugagaggaauuagau

SEQ ID NO: 225011 - RNA, 22 nt, Homo sapiens
ucacacgugaacucaucacaga

SEQ ID NO: 225012 - RNA, 22 nt, Homo sapiens
ucacacugaauuugaagcaaug

SEQ ID NO: 225013 - RNA, 22 nt, Homo sapiens
ucacacugcaucuguuggaauu

SEQ ID NO: 225014 - RNA, 22 nt, Homo sapiens
ucacacuguuuugauuauuaua

SEQ ID NO: 225015 - RNA, 22 nt, Homo sapiens
ucacagacauugaggggaccuu

SEQ ID NO: 225016 - RNA, 19 nt, Homo sapiens
ucacaggguugacuugagg

SEQ ID NO: 225017 - RNA, 18 nt, Homo sapiens
ucacagguaaaguugaca

SEQ ID NO: 225018 - RNA, 22 nt, Homo sapiens
ucacaguaaauccagaagaaau

SEQ ID NO: 225019 - RNA, 22 nt, Homo sapiens
ucacaguagagcuucuuucaga

SEQ ID NO: 225020 - RNA, 22 nt, Homo sapiens
ucacaguagccccucccaucau

SEQ ID NO: 225021 - RNA, 22 nt, Homo sapiens
ucacagucacugucacguugaa

SEQ ID NO: 225022 - RNA, 22 nt, Homo sapiens
ucacagucggugacuucuugcu

SEQ ID NO: 225023 - RNA, 22 nt, Homo sapiens
ucacaguguuaaaccuuucuuu

SEQ ID NO: 225024 - RNA, 22 nt, Homo sapiens
ucacaugaauugucuuguucca

SEQ ID NO: 225025 - RNA, 22 nt, Homo sapiens
ucacauggaaaaguccaguaaa

SEQ ID NO: 225026 - RNA, 21 nt, Homo sapiens
ucacauggccagaguaggaac

SEQ ID NO: 225027 - RNA, 22 nt, Homo sapiens
ucacauguguaaauugguguaa

SEQ ID NO: 225028 - RNA, 22 nt, Homo sapiens
ucacauucaauuguaauccccg

SEQ ID NO: 225029 - RNA, 22 nt, Homo sapiens
ucaccaccugcugauuguagag

SEQ ID NO: 225030 - RNA, 22 nt, Homo sapiens
ucaccaguggcacuccagccug

SEQ ID NO: 225031 - RNA, 20 nt, Homo sapiens
ucacccugacaucugcccag

SEQ ID NO: 225032 - RNA, 22 nt, Homo sapiens
ucaccuggggcacagcugaaga

SEQ ID NO: 225033 - RNA, 22 nt, Homo sapiens
ucaccuuacuugcuucugaacu

SEQ ID NO: 225034 - RNA, 18 nt, Homo sapiens
ucaccuugcuuuuagaac

SEQ ID NO: 225035 - RNA, 22 nt, Homo sapiens
ucacgugcucuuguguguucug

SEQ ID NO: 225036 - RNA, 22 nt, Homo sapiens
ucacuagggagaaacugaggcu

SEQ ID NO: 225037 - RNA, 21 nt, Homo sapiens
ucacuaguaaaaggugaacug

SEQ ID NO: 225038 - RNA, 21 nt, Homo sapiens
ucacugagguuaaauaggguu

SEQ ID NO: 225039 - RNA, 20 nt, Homo sapiens
ucacugagugguccacagua

SEQ ID NO: 225040 - RNA, 22 nt, Homo sapiens
ucacugcgaccuccaccucccg

SEQ ID NO: 225041 - RNA, 19 nt, Homo sapiens
ucacuggacagcacacuca

SEQ ID NO: 225042 - RNA, 22 nt, Homo sapiens
ucacuggaggagaggaagugga

SEQ ID NO: 225043 - RNA, 22 nt, Homo sapiens
ucacugggagaccaaagccauc

SEQ ID NO: 225044 - RNA, 22 nt, Homo sapiens
ucacugugcacauaugauaggu

SEQ ID NO: 225045 - RNA, 22 nt, Homo sapiens
ucacugugcaugaaggaugcug

SEQ ID NO: 225046 - RNA, 22 nt, Homo sapiens
ucacuguggaacucaaaaagcu

SEQ ID NO: 225047 - RNA, 22 nt, Homo sapiens
ucacuguguauguauaugcagg

SEQ ID NO: 225048 - RNA, 22 nt, Homo sapiens
ucacuuuguauagcgacuggcu

SEQ ID NO: 225049 - RNA, 22 nt, Homo sapiens
ucagaaccucugauuuauacuu

SEQ ID NO: 225050 - RNA, 22 nt, Homo sapiens
ucagacacuguggccuuuggac

SEQ ID NO: 225051 - RNA, 18 nt, Homo sapiens
ucagagugcagacuauac

SEQ ID NO: 225052 - RNA, 22 nt, Homo sapiens
ucagaguggagucugcagccuu

SEQ ID NO: 225053 - RNA, 22 nt, Homo sapiens
ucagaguggccucucuugaaga

SEQ ID NO: 225054 - RNA, 22 nt, Homo sapiens
ucagagugguuguaccauuuga

SEQ ID NO: 225055 - RNA, 22 nt, Homo sapiens
ucagauacuggugacaugaaug

SEQ ID NO: 225056 - RNA, 22 nt, Homo sapiens
ucagaucaguuccacaagaacu

SEQ ID NO: 225057 - RNA, 22 nt, Homo sapiens
ucagaucaugcuuaugauggga

SEQ ID NO: 225058 - RNA, 22 nt, Homo sapiens
ucagaugauucuguuguugugu

SEQ ID NO: 225059 - RNA, 22 nt, Homo sapiens
ucagcaaugcugcacucuacug

SEQ ID NO: 225060 - RNA, 19 nt, Homo sapiens
ucagcaguaaucaacuuca

SEQ ID NO: 225061 - RNA, 22 nt, Homo sapiens
ucagcagugagagaccucaccc

SEQ ID NO: 225062 - RNA, 22 nt, Homo sapiens
ucagcagugugaaaacaaacua

SEQ ID NO: 225063 - RNA, 22 nt, Homo sapiens
ucagcaucacgugggcucccgu

SEQ ID NO: 225064 - RNA, 16 nt, Homo sapiens
ucagcgagggagccag

SEQ ID NO: 225065 - RNA, 21 nt, Homo sapiens
ucagcucaucacugccuggag

SEQ ID NO: 225066 - RNA, 22 nt, Homo sapiens
ucaggcuuuucccagagugaug

SEQ ID NO: 225067 - RNA, 21 nt, Homo sapiens
ucaggcuuuuugagugccaau

SEQ ID NO: 225068 - RNA, 21 nt, Homo sapiens
ucagggaccugcuguacugau

SEQ ID NO: 225069 - RNA, 22 nt, Homo sapiens
ucagguagcuagauuaugugag

SEQ ID NO: 225070 - RNA, 23 nt, Homo sapiens
ucagguaggccuagaguauucuu

SEQ ID NO: 225071 - RNA, 22 nt, Homo sapiens
ucagguagugccaugauugauu

SEQ ID NO: 225072 - RNA, 22 nt, Homo sapiens
ucaggugcaguggcucaugcuu

SEQ ID NO: 225073 - RNA, 22 nt, Homo sapiens
uguggcugguggcaccuuuucc

SEQ ID NO: 225074 - RNA, 18 nt, Homo sapiens
uguggcuguuuuccaaua

SEQ ID NO: 225075 - RNA, 23 nt, Homo sapiens
ugugguauuauuccauuuauagg

SEQ ID NO: 225076 - RNA, 22 nt, Homo sapiens
uguggucaucacuugaagguaa

SEQ ID NO: 225077 - RNA, 22 nt, Homo sapiens
ugugguuuuaguaaaacuaugu

SEQ ID NO: 225078 - RNA, 22 nt, Homo sapiens
uguguaaagcuuguuccagaaa

SEQ ID NO: 225079 - RNA, 22 nt, Homo sapiens
uguguaaauacaagugcuugaa

SEQ ID NO: 225080 - RNA, 22 nt, Homo sapiens
uguguacaucucuacacacaug

SEQ ID NO: 225081 - RNA, 22 nt, Homo sapiens
uguguagagaaauauuacuuau

SEQ ID NO: 225082 - RNA, 22 nt, Homo sapiens
uguguuuuuauguaaaauggaa

SEQ ID NO: 225083 - RNA, 22 nt, Homo sapiens
uguuacacugugcacuaaauuu

SEQ ID NO: 225084 - RNA, 22 nt, Homo sapiens
uguuacagcagaauugauugca

SEQ ID NO: 225085 - RNA, 22 nt, Homo sapiens
uguuacagcagcacaaaaugga

SEQ ID NO: 225086 - RNA, 22 nt, Homo sapiens
uguuacagugacuaauguuuua

SEQ ID NO: 225087 - RNA, 22 nt, Homo sapiens
uguuauguucuacuuuuaggug

SEQ ID NO: 225088 - RNA, 22 nt, Homo sapiens
uguuauguuguuugagaaaguc

SEQ ID NO: 225089 - RNA, 22 nt, Homo sapiens
uguuauuuuguguuagggcaca

SEQ ID NO: 225090 - RNA, 22 nt, Homo sapiens
uguucuggagaguuuagucugg

SEQ ID NO: 225091 - RNA, 20 nt, Homo sapiens
uguugcacucuagccugggu

SEQ ID NO: 225092 - RNA, 22 nt, Homo sapiens
uguugccacuguuauuaaccua

SEQ ID NO: 225093 - RNA, 22 nt, Homo sapiens
uguuuaguuaagacauagaauu

SEQ ID NO: 225094 - RNA, 22 nt, Homo sapiens
uguuucuacugucucuguagua

SEQ ID NO: 225095 - RNA, 22 nt, Homo sapiens
uguuugcuguuuucuccaauga

SEQ ID NO: 225096 - RNA, 22 nt, Homo sapiens
uguuuguuugauaugggauaaa

SEQ ID NO: 225097 - RNA, 22 nt, Homo sapiens
uguuuguuugugauacgguaca

SEQ ID NO: 225098 - RNA, 22 nt, Homo sapiens
uguuuugguugucccuggccag

SEQ ID NO: 225099 - RNA, 22 nt, Homo sapiens
uuaaaaguauaggccuggcaua

SEQ ID NO: 225100 - RNA, 22 nt, Homo sapiens
uuaaagugcacacgggucaggc

SEQ ID NO: 225101 - RNA, 22 nt, Homo sapiens
uuaaagugcuguuuuugccggg

SEQ ID NO: 225102 - RNA, 22 nt, Homo sapiens
uuaaauacagcaugguguuucu

SEQ ID NO: 225103 - RNA, 20 nt, Homo sapiens
uuaaaucuagugcagacuca

SEQ ID NO: 225104 - RNA, 22 nt, Homo sapiens
uuaacagcacuacguggggauc

SEQ ID NO: 225105 - RNA, 22 nt, Homo sapiens
uuaacagucacuuagcucauuu

SEQ ID NO: 225106 - RNA, 22 nt, Homo sapiens
uuaacagugucaaucuguagua

SEQ ID NO: 225107 - RNA, 22 nt, Homo sapiens
uuaacaguuaauucuuuggcaa

SEQ ID NO: 225108 - RNA, 22 nt, Homo sapiens
uuaacaguugcaugagacugag

SEQ ID NO: 225109 - RNA, 23 nt, Homo sapiens
uuaagcaacggcugcuuuucaga

SEQ ID NO: 225110 - RNA, 22 nt, Homo sapiens
uuaagccacucaagagauagag

SEQ ID NO: 225111 - RNA, 22 nt, Homo sapiens
uuaaggcauucuuugucuucau

SEQ ID NO: 225112 - RNA, 22 nt, Homo sapiens
uuaaggcuccuguuggcuuuua

SEQ ID NO: 225113 - RNA, 22 nt, Homo sapiens
uuaagguaugugggcauuuugu

SEQ ID NO: 225114 - RNA, 22 nt, Homo sapiens
uuaaguaaucagagaagagaac

SEQ ID NO: 225115 - RNA, 21 nt, Homo sapiens
uuaagugcuuuguaugcacua

SEQ ID NO: 225116 - RNA, 23 nt, Homo sapiens
uuaagugcuuuucugaaacucuu

SEQ ID NO: 225117 - RNA, 22 nt, Homo sapiens
uuaaguuguagcuacaaauaca

SEQ ID NO: 225118 - RNA, 22 nt, Homo sapiens
uuaauacugcuuaacuuuagga

SEQ ID NO: 225119 - RNA, 22 nt, Homo sapiens
uuaaucaggccguuuccuaaga

SEQ ID NO: 225120 - RNA, 22 nt, Homo sapiens
uuaaucugucuaugauuuuggu

SEQ ID NO: 225121 - RNA, 22 nt, Homo sapiens
uuaauguaucuaucacaucaca

SEQ ID NO: 225122 - RNA, 22 nt, Homo sapiens
uuaaugugaaucaggaugcauu

SEQ ID NO: 225123 - RNA, 22 nt, Homo sapiens
uuaauuguaucuauagauguca

SEQ ID NO: 225124 - RNA, 22 nt, Homo sapiens
uuaauuguccaaguucaucucu

SEQ ID NO: 225125 - RNA, 22 nt, Homo sapiens
uuacaaguggcaucucucugga

SEQ ID NO: 225126 - RNA, 22 nt, Homo sapiens
uuacacaguaggucccuaguaa

SEQ ID NO: 225127 - RNA, 22 nt, Homo sapiens
uuacagauggcacacucaaggg

SEQ ID NO: 225128 - RNA, 22 nt, Homo sapiens
uuacagguggagaaguaaggcu

SEQ ID NO: 225129 - RNA, 22 nt, Homo sapiens
uuacaguauugcaaggacuagg

SEQ ID NO: 225130 - RNA, 22 nt, Homo sapiens
uuacagucaaguuacauuucuc

SEQ ID NO: 225131 - RNA, 22 nt, Homo sapiens
uuacagucaccugggggacaua

SEQ ID NO: 225132 - RNA, 22 nt, Homo sapiens
uuacagucucaagagugcugca

SEQ ID NO: 225133 - RNA, 19 nt, Homo sapiens
uuacagugugcccuuuuag

SEQ ID NO: 225134 - RNA, 22 nt, Homo sapiens
uuacaguguuuguucuguuacu

SEQ ID NO: 225135 - RNA, 22 nt, Homo sapiens
uuacaguucugguggagaggua

SEQ ID NO: 225136 - RNA, 19 nt, Homo sapiens
uuacauccauugcauuuca

SEQ ID NO: 225137 - RNA, 22 nt, Homo sapiens
uuacaugagacugucgcuaguu

SEQ ID NO: 225138 - RNA, 22 nt, Homo sapiens
uauacagcaaguuacugugcug

SEQ ID NO: 225139 - RNA, 22 nt, Homo sapiens
uauacaugugggcaucaggaga

SEQ ID NO: 225140 - RNA, 22 nt, Homo sapiens
uauacgugcagaucacagggga

SEQ ID NO: 225141 - RNA, 22 nt, Homo sapiens
uauacugucuuuguaugccuag

SEQ ID NO: 225142 - RNA, 22 nt, Homo sapiens
uauagcacaucuguguguacau

SEQ ID NO: 225143 - RNA, 22 nt, Homo sapiens
uauagcacugcaauauuucccu

SEQ ID NO: 225144 - RNA, 21 nt, Homo sapiens
uauagcagcacgauuuauaau

SEQ ID NO: 225145 - RNA, 22 nt, Homo sapiens
uauagcagccugaacaaaguaa

SEQ ID NO: 225146 - RNA, 22 nt, Homo sapiens
uauagcagugaguauugacuaa

SEQ ID NO: 225147 - RNA, 22 nt, Homo sapiens
uauagcuaugggauguauuugc

SEQ ID NO: 225148 - RNA, 22 nt, Homo sapiens
uauagcuuaaaguuuagauccu

SEQ ID NO: 225149 - RNA, 22 nt, Homo sapiens
uauagcuuuuuagggaauuugg

SEQ ID NO: 225150 - RNA, 22 nt, Homo sapiens
uauaggacuugguguaguuucu

SEQ ID NO: 225151 - RNA, 22 nt, Homo sapiens
uauauguucuugcacuggaaag

SEQ ID NO: 225152 - RNA, 22 nt, Homo sapiens
uaucaagaugacaaacuuugcu

SEQ ID NO: 225153 - RNA, 22 nt, Homo sapiens
uaucaaguguuagggagaugug

SEQ ID NO: 225154 - RNA, 22 nt, Homo sapiens
uaucaaguuggaagagaaguaa

SEQ ID NO: 225155 - RNA, 22 nt, Homo sapiens
uaucacacgccuugcuucauuu

SEQ ID NO: 225156 - RNA, 23 nt, Homo sapiens
uaucacacuuucucugugccaca

SEQ ID NO: 225157 - RNA, 22 nt, Homo sapiens
uaucacagauauuaugggccaa

SEQ ID NO: 225158 - RNA, 22 nt, Homo sapiens
uaucacagauucuccaggguuu

SEQ ID NO: 225159 - RNA, 22 nt, Homo sapiens
uaucacagcaaggacccauuau

SEQ ID NO: 225160 - RNA, 22 nt, Homo sapiens
uaucacagguggacugcacacc

SEQ ID NO: 225161 - RNA, 22 nt, Homo sapiens
uaucacaguaucuagcacagug

SEQ ID NO: 225162 - RNA, 22 nt, Homo sapiens
uaucacagugcuggaguauucc

SEQ ID NO: 225163 - RNA, 22 nt, Homo sapiens
uaucacuguuguuuguuuaagg

SEQ ID NO: 225164 - RNA, 22 nt, Homo sapiens
uaucagagcugucagccuaccu

SEQ ID NO: 225165 - RNA, 22 nt, Homo sapiens
uaucagaguuacacugaagacu

SEQ ID NO: 225166 - RNA, 22 nt, Homo sapiens
uaucauagacaaucaguuauug

SEQ ID NO: 225167 - RNA, 22 nt, Homo sapiens
uaucaucauuggcaggugagaa

SEQ ID NO: 225168 - RNA, 22 nt, Homo sapiens
uaucauggaaagauguugaaau

SEQ ID NO: 225169 - RNA, 22 nt, Homo sapiens
uugcuucauucaacauugaggg

SEQ ID NO: 225170 - RNA, 22 nt, Homo sapiens
uuggaaaugguaaaggguuaau

SEQ ID NO: 225171 - RNA, 22 nt, Homo sapiens
uuggaacacauguuuuucuacc

SEQ ID NO: 225172 - RNA, 22 nt, Homo sapiens
uuggaagguaaucaaaaguucu

SEQ ID NO: 225173 - RNA, 22 nt, Homo sapiens
uuggaauacuuguuaaagucca

SEQ ID NO: 225174 - RNA, 22 nt, Homo sapiens
uuggaauguacucuagccuaug

SEQ ID NO: 225175 - RNA, 22 nt, Homo sapiens
uuggaauuaagagauauuuucu

SEQ ID NO: 225176 - RNA, 22 nt, Homo sapiens
uuggaauuuuaaaauaggcaac

SEQ ID NO: 225177 - RNA, 22 nt, Homo sapiens
uuggaccacuugauuucugguc

SEQ ID NO: 225178 - RNA, 22 nt, Homo sapiens
uuggacugagaguuccaccauu

SEQ ID NO: 225179 - RNA, 22 nt, Homo sapiens
uuggagugugagagcagccugg

SEQ ID NO: 225180 - RNA, 22 nt, Homo sapiens
uuggagugugcucauaacugcu

SEQ ID NO: 225181 - RNA, 22 nt, Homo sapiens
ucucuuggcggaaguugcagug

SEQ ID NO: 225182 - RNA, 19 nt, Homo sapiens
ucugacagccccagucaac

SEQ ID NO: 225183 - RNA, 22 nt, Homo sapiens
ucugagcaauagauguggauau

SEQ ID NO: 225184 - RNA, 22 nt, Homo sapiens
ucugagucaucacaaaugaugc

SEQ ID NO: 225185 - RNA, 22 nt, Homo sapiens
ucugcaagucuaaacuagccau

SEQ ID NO: 225186 - RNA, 22 nt, Homo sapiens
ucugcauaucaugcagaacuau

SEQ ID NO: 225187 - RNA, 23 nt, Homo sapiens
ucugcggguguggacccuagugc

SEQ ID NO: 225188 - RNA, 22 nt, Homo sapiens
ucuggagugugaaguggauaug

SEQ ID NO: 225189 - RNA, 23 nt, Homo sapiens
ucuggaucauucguagugccagc

SEQ ID NO: 225190 - RNA, 22 nt, Homo sapiens
ucuggcaagauauccauugcuu

SEQ ID NO: 225191 - RNA, 22 nt, Homo sapiens
ucuggcauuuucucugcuugca

SEQ ID NO: 225192 - RNA, 22 nt, Homo sapiens
ucuggccuccuaugagaaucga

SEQ ID NO: 225193 - RNA, 15 nt, Homo sapiens
ucuggcucugucacu

SEQ ID NO: 225194 - RNA, 22 nt, Homo sapiens
ucuggcuuuuaacaucuauaaa

SEQ ID NO: 225195 - RNA, 20 nt, Homo sapiens
ucuggguuuuggccacgccc

SEQ ID NO: 225196 - RNA, 22 nt, Homo sapiens
ucuggguuuuuccauugccggu

SEQ ID NO: 225197 - RNA, 22 nt, Homo sapiens
ucuggucccugcacauauuuuc

SEQ ID NO: 225198 - RNA, 22 nt, Homo sapiens
ucuggugugcucuggacuugca

SEQ ID NO: 225199 - RNA, 22 nt, Homo sapiens
ucugguguuauucauguaguuu

SEQ ID NO: 225200 - RNA, 22 nt, Homo sapiens
ucugucaaaucuuauguuguag

SEQ ID NO: 225201 - RNA, 22 nt, Homo sapiens
ucugucuuugccuaaguuuguc

SEQ ID NO: 225202 - RNA, 22 nt, Homo sapiens
ucugugaaaucauuuccuguaa

SEQ ID NO: 225203 - RNA, 22 nt, Homo sapiens
ucugugcauuguaggauguuua

SEQ ID NO: 225204 - RNA, 22 nt, Homo sapiens
ucugugcauuuucuuuuagacu

SEQ ID NO: 225205 - RNA, 22 nt, Homo sapiens
ucugugcuugucauaugcuuug

SEQ ID NO: 225206 - RNA, 19 nt, Homo sapiens
ucugugcuugucccccugu

SEQ ID NO: 225207 - RNA, 18 nt, Homo sapiens
ucugugguguaaauacgu

SEQ ID NO: 225208 - RNA, 22 nt, Homo sapiens
ucugugguucaaaccagcaacu

SEQ ID NO: 225209 - RNA, 22 nt, Homo sapiens
ucugugguucaggcuggagugc

SEQ ID NO: 225210 - RNA, 22 nt, Homo sapiens
ucugugguucuagcuacuuugg

SEQ ID NO: 225211 - RNA, 22 nt, Homo sapiens
ucuguguugaucacacugggag

SEQ ID NO: 225212 - RNA, 21 nt, Homo sapiens
ucuguguugaucucacuggga

SEQ ID NO: 225213 - RNA, 22 nt, Homo sapiens
ucuguugguucuuugaggagga

SEQ ID NO: 225214 - RNA, 22 nt, Homo sapiens
ucuguuguuguuuuaagagaca

SEQ ID NO: 225215 - RNA, 22 nt, Homo sapiens
ucuuagguaagaaauuuuaaca

SEQ ID NO: 225216 - RNA, 22 nt, Homo sapiens
ucuuaggugggccaucacccca

SEQ ID NO: 225217 - RNA, 22 nt, Homo sapiens
ucuuagugcggcugcugcagcc

SEQ ID NO: 225218 - RNA, 22 nt, Homo sapiens
ucuucaugcuugaaauaauagc

SEQ ID NO: 225219 - RNA, 17 nt, Homo sapiens
ucuucuguuacuguggc

SEQ ID NO: 225220 - RNA, 20 nt, Homo sapiens
ucuugaacuuagucaacagg

SEQ ID NO: 225221 - RNA, 22 nt, Homo sapiens
ucuugcacacaguaaguguuuu

SEQ ID NO: 225222 - RNA, 19 nt, Homo sapiens
ucuugcacaugugaacuca

SEQ ID NO: 225223 - RNA, 22 nt, Homo sapiens
ucuugcaguucccaaauucaca

SEQ ID NO: 225224 - RNA, 22 nt, Homo sapiens
ucuugcuuguuguucccuucau

SEQ ID NO: 225225 - RNA, 22 nt, Homo sapiens
ucuuggccaugaauggcaaggc

SEQ ID NO: 225226 - RNA, 22 nt, Homo sapiens
ucuuggguggauucauucuuuc

SEQ ID NO: 225227 - RNA, 21 nt, Homo sapiens
ucuuggguugaauucucccag

SEQ ID NO: 225228 - RNA, 22 nt, Homo sapiens
ucuuggguuguuggcuucuccu

SEQ ID NO: 225229 - RNA, 23 nt, Homo sapiens
ucuuguacuuugagugagcaugg

SEQ ID NO: 225230 - RNA, 19 nt, Homo sapiens
ucuuuagucacauuuuuau

SEQ ID NO: 225231 - RNA, 22 nt, Homo sapiens
ucuuugauuaugcagauggguu

SEQ ID NO: 225232 - RNA, 22 nt, Homo sapiens
ucuuugauuuuguuacuaagac

SEQ ID NO: 225233 - RNA, 22 nt, Homo sapiens
ucuuugccuaacccaaggucau

SEQ ID NO: 225234 - RNA, 19 nt, Homo sapiens
ucuuugcuuuucuaagagg

SEQ ID NO: 225235 - RNA, 22 nt, Homo sapiens
ucuuuggagacaaccccagucu

SEQ ID NO: 225236 - RNA, 22 nt, Homo sapiens
ucuuuggaggcgaucuguuuga

SEQ ID NO: 225237 - RNA, 22 nt, Homo sapiens
ucuuuggauggaaauuggaguc

SEQ ID NO: 225238 - RNA, 22 nt, Homo sapiens
ucuuuggguguauuucacagcc

SEQ ID NO: 225239 - RNA, 22 nt, Homo sapiens
ucuuugguauuuguggggaauu

SEQ ID NO: 225240 - RNA, 21 nt, Homo sapiens
ucuuuggucaccaguuuucau

SEQ ID NO: 225241 - RNA, 22 nt, Homo sapiens
ucuuugguuagguuuaguugau

SEQ ID NO: 225242 - RNA, 22 nt, Homo sapiens
ucuuugguuucugucucuguaa

SEQ ID NO: 225243 - RNA, 22 nt, Homo sapiens
ucuuuguguaggucaaucuggc

SEQ ID NO: 225244 - RNA, 20 nt, Homo sapiens
ucuuuuuguggccccagagu

SEQ ID NO: 225245 - RNA, 22 nt, Homo sapiens
ugaaaucuaaaauguuccaaga

SEQ ID NO: 225246 - RNA, 22 nt, Homo sapiens
ugaaaugccuuuaaugaauuua

SEQ ID NO: 225247 - RNA, 22 nt, Homo sapiens
ugaaaugcuaauucguagcuaa

SEQ ID NO: 225248 - RNA, 22 nt, Homo sapiens
ugaaaugucuuuaggaggcuuc

SEQ ID NO: 225249 - RNA, 22 nt, Homo sapiens
ugaaauguguuaucugggccug

SEQ ID NO: 225250 - RNA, 22 nt, Homo sapiens
ugaaauuauucuuaccaaggug

SEQ ID NO: 225251 - RNA, 22 nt, Homo sapiens
ugaacucagcauccagggccaa

SEQ ID NO: 225252 - RNA, 22 nt, Homo sapiens
ugaacucauccuuucuuauggc

SEQ ID NO: 225253 - RNA, 22 nt, Homo sapiens
ugaagacucaguuugagggaca

SEQ ID NO: 225254 - RNA, 22 nt, Homo sapiens
ugaagacucauacuugaaucag

SEQ ID NO: 225255 - RNA, 22 nt, Homo sapiens
ugaagaucauacugguggaggg

SEQ ID NO: 225256 - RNA, 22 nt, Homo sapiens
ugaagaucuuaggagcugaggg

SEQ ID NO: 225257 - RNA, 20 nt, Homo sapiens
ugaaggaggucauuuauacc

SEQ ID NO: 225258 - RNA, 19 nt, Homo sapiens
ugaaguauagggcuucuga

SEQ ID NO: 225259 - RNA, 22 nt, Homo sapiens
ugaaguguuuauuuuggccuuc

SEQ ID NO: 225260 - RNA, 22 nt, Homo sapiens
ugaaguguuuuuucaggcaugu

SEQ ID NO: 225261 - RNA, 22 nt, Homo sapiens
ugaauagaaguggcaggaguag

SEQ ID NO: 225262 - RNA, 22 nt, Homo sapiens
ugaauagaaguuuacuccuuuu

SEQ ID NO: 225263 - RNA, 22 nt, Homo sapiens
ugaauagugucacaauaaacau

SEQ ID NO: 225264 - RNA, 22 nt, Homo sapiens
ugaauauguuucuaaaagugca

SEQ ID NO: 225265 - RNA, 19 nt, Homo sapiens
ugaaugacaucuaaagucc

SEQ ID NO: 225266 - RNA, 22 nt, Homo sapiens
ugaaugauuuuaaaagccucuc

SEQ ID NO: 225267 - RNA, 22 nt, Homo sapiens
ugaaugcauggggccaagaagg

SEQ ID NO: 225268 - RNA, 21 nt, Homo sapiens
ugaaugcuuuaaauauuagaa

SEQ ID NO: 225269 - RNA, 22 nt, Homo sapiens
ugaauggauccaauucuuagua

SEQ ID NO: 225270 - RNA, 20 nt, Homo sapiens
ugaauguaauuacagaugua

SEQ ID NO: 225271 - RNA, 21 nt, Homo sapiens
ugaaugucuaggcagaaguuu

SEQ ID NO: 225272 - RNA, 22 nt, Homo sapiens
ugaaugugauggguuucaugug

SEQ ID NO: 225273 - RNA, 22 nt, Homo sapiens
ugaauguucuuaaaacccuugu

SEQ ID NO: 225274 - RNA, 22 nt, Homo sapiens
ugaauugucucucacuggguuc

SEQ ID NO: 225275 - RNA, 22 nt, Homo sapiens
ugacaagaaagcgucuucuuuu

SEQ ID NO: 225276 - RNA, 22 nt, Homo sapiens
ugacaagaacuuuccauaguaa

SEQ ID NO: 225277 - RNA, 22 nt, Homo sapiens
ugacaagaguagagagggugcc

SEQ ID NO: 225278 - RNA, 22 nt, Homo sapiens
ugacaagggaaaugcaaaaugu

SEQ ID NO: 225279 - RNA, 22 nt, Homo sapiens
uuuacccugaggaaucuauuuu

SEQ ID NO: 225280 - RNA, 21 nt, Homo sapiens
uuuacuguggacccauugcuu

SEQ ID NO: 225281 - RNA, 22 nt, Homo sapiens
uuuagcaaugcuguggggaagu

SEQ ID NO: 225282 - RNA, 22 nt, Homo sapiens
uuuagcaauggagggugacuuu

SEQ ID NO: 225283 - RNA, 22 nt, Homo sapiens
uuuagcucauucaauuucaguc

SEQ ID NO: 225284 - RNA, 22 nt, Homo sapiens
uuuaggcaauauauucaugucu

SEQ ID NO: 225285 - RNA, 22 nt, Homo sapiens
uuuagguuacauauaauccaaa

SEQ ID NO: 225286 - RNA, 22 nt, Homo sapiens
uuuaguccucugaaaaucuaua

SEQ ID NO: 225287 - RNA, 23 nt, Homo sapiens
uuuauacguugucauuuaucagg

SEQ ID NO: 225288 - RNA, 22 nt, Homo sapiens
uuuaucaggccuuuggaaaaau

SEQ ID NO: 225289 - RNA, 22 nt, Homo sapiens
uuuaugucuguacaucgggcgg

SEQ ID NO: 225290 - RNA, 22 nt, Homo sapiens
uuucaacaggucuggggugguc

SEQ ID NO: 225291 - RNA, 22 nt, Homo sapiens
uuucacagcugucuuccgucuc

SEQ ID NO: 225292 - RNA, 22 nt, Homo sapiens
uuucagagucaucugcccaagu

SEQ ID NO: 225293 - RNA, 22 nt, Homo sapiens
ugucccguuuucgaggcugcag

SEQ ID NO: 225294 - RNA, 22 nt, Homo sapiens
ugucccugagccuggauuccug

SEQ ID NO: 225295 - RNA, 22 nt, Homo sapiens
uguccugcagagguguuugccu

SEQ ID NO: 225296 - RNA, 22 nt, Homo sapiens
ugucuacugaugauguaguuaa

SEQ ID NO: 225297 - RNA, 22 nt, Homo sapiens
ugucucaguucccuucucugga

SEQ ID NO: 225298 - RNA, 22 nt, Homo sapiens
ugucugagacuguuuuacuuuc

SEQ ID NO: 225299 - RNA, 22 nt, Homo sapiens
ugucuggaguccauagaagugu

SEQ ID NO: 225300 - RNA, 22 nt, Homo sapiens
ugucuguuugcgaaauugcuuc

SEQ ID NO: 225301 - RNA, 22 nt, Homo sapiens
ugucuuggaugaggauuaacag

SEQ ID NO: 225302 - RNA, 22 nt, Homo sapiens
ugucuuuguuaguuguccuagu

SEQ ID NO: 225303 - RNA, 19 nt, Homo sapiens
ugugaacaucacagagugu

SEQ ID NO: 225304 - RNA, 22 nt, Homo sapiens
ugugaacauuuuguauauauua

SEQ ID NO: 225305 - RNA, 22 nt, Homo sapiens
ugugaacugagcauuaacuaca

SEQ ID NO: 225306 - RNA, 22 nt, Homo sapiens
ugugaagaugagaugacgcccu

SEQ ID NO: 225307 - RNA, 22 nt, Homo sapiens
ugugaagauguuucuuaauuga

SEQ ID NO: 225308 - RNA, 22 nt, Homo sapiens
ugugaauggugcuuccuagaug

SEQ ID NO: 225309 - RNA, 22 nt, Homo sapiens
ugugaauguaagaaaauccaac

SEQ ID NO: 225310 - RNA, 22 nt, Homo sapiens
ugugaccaaaaucaacauaccu

SEQ ID NO: 225311 - RNA, 21 nt, Homo sapiens
ugugacuguugcauuugucgu

SEQ ID NO: 225312 - RNA, 22 nt, Homo sapiens
ugugaguguguacuaguuauca

SEQ ID NO: 225313 - RNA, 22 nt, Homo sapiens
ugugaucauugcuguuaaagug

SEQ ID NO: 225314 - RNA, 22 nt, Homo sapiens
ugugaugaagaguccaagaaca

SEQ ID NO: 225315 - RNA, 22 nt, Homo sapiens
ugugauuauuuaaauaggacag

SEQ ID NO: 225316 - RNA, 22 nt, Homo sapiens
ugugauuauuuauagacaguca

SEQ ID NO: 225317 - RNA, 22 nt, Homo sapiens
ugugauugauuaaugugugcua

SEQ ID NO: 225318 - RNA, 22 nt, Homo sapiens
ugugcaaaaguaauugcgguuu

SEQ ID NO: 225319 - RNA, 22 nt, Homo sapiens
ugugcaaucagcuucauuacau

SEQ ID NO: 225320 - RNA, 22 nt, Homo sapiens
ugugcaaucuuccauuuuuagg

SEQ ID NO: 225321 - RNA, 22 nt, Homo sapiens
ugugcacaaugugcagguuuga

SEQ ID NO: 225322 - RNA, 22 nt, Homo sapiens
ugugcauagugugugcggggcg

SEQ ID NO: 225323 - RNA, 22 nt, Homo sapiens
ugugcauauaaguguguauaua

SEQ ID NO: 225324 - RNA, 22 nt, Homo sapiens
ugugccacuccagcucuagcuu

SEQ ID NO: 225325 - RNA, 22 nt, Homo sapiens
ugugccacugcacuccugggug

SEQ ID NO: 225326 - RNA, 22 nt, Homo sapiens
ugugcuugaauuuaguagcuua

SEQ ID NO: 225327 - RNA, 22 nt, Homo sapiens
uguggaguguaugugacagaga

SEQ ID NO: 225328 - RNA, 22 nt, Homo sapiens
uguggcauugaauaaccuugga

SEQ ID NO: 225329 - RNA, 22 nt, Homo sapiens
cacugcacuccaguuucgguaa

SEQ ID NO: 225330 - RNA, 21 nt, Homo sapiens
cacugcacuugccuucugggu

SEQ ID NO: 225331 - RNA, 22 nt, Homo sapiens
cacugcauccuccaccugccag

SEQ ID NO: 225332 - RNA, 22 nt, Homo sapiens
cacugcauuacucaugagcaug

SEQ ID NO: 225333 - RNA, 22 nt, Homo sapiens
cacugcauucuccaccucccag

SEQ ID NO: 225334 - RNA, 22 nt, Homo sapiens
cacugcgaccuccaccucccgg

SEQ ID NO: 225335 - RNA, 22 nt, Homo sapiens
cacuggcacuguguuuagaugg

SEQ ID NO: 225336 - RNA, 23 nt, Homo sapiens
cacugggcagcagguguucccag

SEQ ID NO: 225337 - RNA, 22 nt, Homo sapiens
cacugugcaaccuccaccuccc

SEQ ID NO: 225338 - RNA, 22 nt, Homo sapiens
cagagaaugucuuuuuuaacca

SEQ ID NO: 225339 - RNA, 22 nt, Homo sapiens
cagaugguggucccacagccca

SEQ ID NO: 225340 - RNA, 20 nt, Homo sapiens
cagcaaccugcucucuuccu

SEQ ID NO: 225341 - RNA, 22 nt, Homo sapiens
cagcaagucucuaagaguucau

SEQ ID NO: 225342 - RNA, 22 nt, Homo sapiens
cagcagguuuuuaucaguuaag

SEQ ID NO: 225343 - RNA, 22 nt, Homo sapiens
cagcaguuguuucggauuggga

SEQ ID NO: 225344 - RNA, 22 nt, Homo sapiens
cagcccguaaucccagcacuuu

SEQ ID NO: 225345 - RNA, 22 nt, Homo sapiens
cagccgggugagguggcuuguu

SEQ ID NO: 225346 - RNA, 22 nt, Homo sapiens
cagcuaguuuuugguuuacagu

SEQ ID NO: 225347 - RNA, 23 nt, Homo sapiens
cagcucauuuggguccccuuguc

SEQ ID NO: 225348 - RNA, 22 nt, Homo sapiens
cagcugguggcaagaagacaga

SEQ ID NO: 225349 - RNA, 22 nt, Homo sapiens
cagcuguuguuaugucugcagg

SEQ ID NO: 225350 - RNA, 22 nt, Homo sapiens
cagcuguuguugggguauagga

SEQ ID NO: 225351 - RNA, 23 nt, Homo sapiens
cagcuucauugaacauaacuccu

SEQ ID NO: 225352 - RNA, 22 nt, Homo sapiens
caggcacgcuugggagacacac

SEQ ID NO: 225353 - RNA, 22 nt, Homo sapiens
caggcagugggagacaaaacug

SEQ ID NO: 225354 - RNA, 22 nt, Homo sapiens
caggcuuuuccacacauggguu

SEQ ID NO: 225355 - RNA, 20 nt, Homo sapiens
cagggcaaugaggagguaaa

SEQ ID NO: 225356 - RNA, 22 nt, Homo sapiens
caggguccccuaccuuuugaug

SEQ ID NO: 225357 - RNA, 22 nt, Homo sapiens
cagguaagaugcuuucucuuau

SEQ ID NO: 225358 - RNA, 21 nt, Homo sapiens
cagguagugucugaagccaga

SEQ ID NO: 225359 - RNA, 23 nt, Homo sapiens
cagguaguucuuuauaguagugu

SEQ ID NO: 225360 - RNA, 22 nt, Homo sapiens
caggugaaugccucuccuucug

SEQ ID NO: 225361 - RNA, 22 nt, Homo sapiens
caguaaauaucugagcgagguc

SEQ ID NO: 225362 - RNA, 22 nt, Homo sapiens
caguagcaugccucagaaugag

SEQ ID NO: 225363 - RNA, 20 nt, Homo sapiens
cagucauagacaucagaguc

SEQ ID NO: 225364 - RNA, 20 nt, Homo sapiens
cagucaugaagaacugugag

SEQ ID NO: 225365 - RNA, 22 nt, Homo sapiens
cagugauaggugguuguuggca

SEQ ID NO: 225366 - RNA, 22 nt, Homo sapiens
cagugcaaccuccaucucucgg

SEQ ID NO: 225367 - RNA, 23 nt, Homo sapiens
cagugcauuguggcauucagcau

SEQ ID NO: 225368 - RNA, 22 nt, Homo sapiens
caguggacuaaauggggaauau

SEQ ID NO: 225369 - RNA, 22 nt, Homo sapiens
caguuacuuuugcaccaaccua

SEQ ID NO: 225370 - RNA, 22 nt, Homo sapiens
caguucaugguaggcaccauag

SEQ ID NO: 225371 - RNA, 22 nt, Homo sapiens
cauacagcuaguaaguguaaga

SEQ ID NO: 225372 - RNA, 22 nt, Homo sapiens
cauacaugugcuugucuuaugc

SEQ ID NO: 225373 - RNA, 22 nt, Homo sapiens
cauagcacugagcucuacccuc

SEQ ID NO: 225374 - RNA, 22 nt, Homo sapiens
cauauaguaggugcucuguguu

SEQ ID NO: 225375 - RNA, 22 nt, Homo sapiens
caucacagcaaguagggagugg

SEQ ID NO: 225376 - RNA, 22 nt, Homo sapiens
caucacaguacuaaucgucaua

SEQ ID NO: 225377 - RNA, 22 nt, Homo sapiens
caucacaugcuuauuuuccuca

SEQ ID NO: 225378 - RNA, 22 nt, Homo sapiens
caucauugcacccuauagagaa

SEQ ID NO: 225379 - RNA, 22 nt, Homo sapiens
caucccauucgaggggcacagc

SEQ ID NO: 225380 - RNA, 19 nt, Homo sapiens
caucccugagcugaagugg

SEQ ID NO: 225381 - RNA, 22 nt, Homo sapiens
caugacacuggcauguuucuuu

SEQ ID NO: 225382 - RNA, 22 nt, Homo sapiens
caugauauugcagaauguuggu

SEQ ID NO: 225383 - RNA, 22 nt, Homo sapiens
caugaugcuagguauggaugaa

SEQ ID NO: 225384 - RNA, 22 nt, Homo sapiens
cauggcaucuguguggccucca

SEQ ID NO: 225385 - RNA, 22 nt, Homo sapiens
cauggcauuucaagauuuacca

SEQ ID NO: 225386 - RNA, 22 nt, Homo sapiens
cauggcccuggguccauaggaa

SEQ ID NO: 225387 - RNA, 19 nt, Homo sapiens
cauggcuuauaauuuuaau

SEQ ID NO: 225388 - RNA, 22 nt, Homo sapiens
cauggguuuucucaaguaguca

SEQ ID NO: 225389 - RNA, 19 nt, Homo sapiens
caugugcacuacuggcuuc

SEQ ID NO: 225390 - RNA, 22 nt, Homo sapiens
caugugcaugcuuucuuaugug

SEQ ID NO: 225391 - RNA, 20 nt, Homo sapiens
cauuccacuuuccugucagu

SEQ ID NO: 225392 - RNA, 22 nt, Homo sapiens
cauugcaacuucugccucccag

SEQ ID NO: 225393 - RNA, 22 nt, Homo sapiens
cauugcaauccagccugggcaa

SEQ ID NO: 225394 - RNA, 22 nt, Homo sapiens
cauugcacacauuuaccuaugu

SEQ ID NO: 225395 - RNA, 22 nt, Homo sapiens
cauugcacuccaccuuggguaa

SEQ ID NO: 225396 - RNA, 22 nt, Homo sapiens
cauugcacuccagcccuggcaa

SEQ ID NO: 225397 - RNA, 22 nt, Homo sapiens
cauugcacuccagccugccugg

SEQ ID NO: 225398 - RNA, 22 nt, Homo sapiens
cauugcacuccagccugcugac

SEQ ID NO: 225399 - RNA, 20 nt, Homo sapiens
cauugcacuccagcuugggc

SEQ ID NO: 225400 - RNA, 22 nt, Homo sapiens
cauugcacuccagcuugggcaa

SEQ ID NO: 225401 - RNA, 22 nt, Homo sapiens
cauugcacuccagucugggcaa

SEQ ID NO: 225402 - RNA, 22 nt, Homo sapiens
cauugcacucuagccucggcaa

SEQ ID NO: 225403 - RNA, 22 nt, Homo sapiens
cauugcacugcauucugggcaa

SEQ ID NO: 225404 - RNA, 22 nt, Homo sapiens
cauugcacugcuucuugggugu

SEQ ID NO: 225405 - RNA, 22 nt, Homo sapiens
cauugcagauccuucaaaugac

SEQ ID NO: 225406 - RNA, 22 nt, Homo sapiens
cauugcaguaagagugggcucu

SEQ ID NO: 225407 - RNA, 22 nt, Homo sapiens
cauugcaguuuuugguguaucu

SEQ ID NO: 225408 - RNA, 22 nt, Homo sapiens
cauugcaugccagccugggcaa

SEQ ID NO: 225409 - RNA, 22 nt, Homo sapiens
cauugcccuccagccugggcaa

SEQ ID NO: 225410 - RNA, 22 nt, Homo sapiens
cauuggugauuagugaaugaac

SEQ ID NO: 225411 - RNA, 22 nt, Homo sapiens
cauuugguggcuacagaguaac

SEQ ID NO: 225412 - RNA, 22 nt, Homo sapiens
ccaaaucucauguugaaaugug

SEQ ID NO: 225413 - RNA, 22 nt, Homo sapiens
ccaagccucaguuucccucugu

SEQ ID NO: 225414 - RNA, 22 nt, Homo sapiens
ccacaaccuccauauccugggu

SEQ ID NO: 225415 - RNA, 22 nt, Homo sapiens
ccacagucuaugcaacaagguc

SEQ ID NO: 225416 - RNA, 22 nt, Homo sapiens
ccacauuaccuugcuugcucca

SEQ ID NO: 225417 - RNA, 22 nt, Homo sapiens
ccacccuuccacacccugggua

SEQ ID NO: 225418 - RNA, 22 nt, Homo sapiens
ccacugcacuccagcccggcaa

SEQ ID NO: 225419 - RNA, 22 nt, Homo sapiens
ccagaguggagccuuugcgagg

SEQ ID NO: 225420 - RNA, 22 nt, Homo sapiens
ccagaguucuaggcauuggaaa

SEQ ID NO: 225421 - RNA, 22 nt, Homo sapiens
ccagaguuucugauucagcagg

SEQ ID NO: 225422 - RNA, 23 nt, Homo sapiens
ccaguauuuauguaaggaagugu

SEQ ID NO: 225423 - RNA, 22 nt, Homo sapiens
ccagugauuguauggugaaggu

SEQ ID NO: 225424 - RNA, 22 nt, Homo sapiens
ccagugcauggaucccaggggg

SEQ ID NO: 225425 - RNA, 22 nt, Homo sapiens
ccagugguugggccggagacgg

SEQ ID NO: 225426 - RNA, 22 nt, Homo sapiens
uaagguccuuaaauguguaacc

SEQ ID NO: 225427 - RNA, 22 nt, Homo sapiens
uaaguaaaugaaagguugauuu

SEQ ID NO: 225428 - RNA, 22 nt, Homo sapiens
uaaguaauugugguuuuugcca

SEQ ID NO: 225429 - RNA, 22 nt, Homo sapiens
uaaguagcugggaguacaggca

SEQ ID NO: 225430 - RNA, 22 nt, Homo sapiens
uaaguaguccugauuuaaccuu

SEQ ID NO: 225431 - RNA, 22 nt, Homo sapiens
uaaguauagguaacagaagcaa

SEQ ID NO: 225432 - RNA, 22 nt, Homo sapiens
uaaguauuaggccccaggcugg

SEQ ID NO: 225433 - RNA, 22 nt, Homo sapiens
uaagugaauauggacaguuagc

SEQ ID NO: 225434 - RNA, 22 nt, Homo sapiens
uaagugcaacauaaguguuaaa

SEQ ID NO: 225435 - RNA, 20 nt, Homo sapiens
uaagugcauaggauauuucu

SEQ ID NO: 225436 - RNA, 22 nt, Homo sapiens
uaagugcaugauuacaugcaua

SEQ ID NO: 225437 - RNA, 20 nt, Homo sapiens
uaagugcuuuauauugauua

SEQ ID NO: 225438 - RNA, 22 nt, Homo sapiens
uaaguguaaugucugaaguuug

SEQ ID NO: 225439 - RNA, 20 nt, Homo sapiens
uaaguuguauuugucaugaa

SEQ ID NO: 225440 - RNA, 22 nt, Homo sapiens
uaaguuguugacauuaggggaa

SEQ ID NO: 225441 - RNA, 22 nt, Homo sapiens
uaauacuugucauaaaggcauu

SEQ ID NO: 225442 - RNA, 22 nt, Homo sapiens
uaauaguuucagaaguuguuuu

SEQ ID NO: 225443 - RNA, 22 nt, Homo sapiens
uaaucacagagguuuggccuca

SEQ ID NO: 225444 - RNA, 22 nt, Homo sapiens
uaauccuagcacuuuggaagac

SEQ ID NO: 225445 - RNA, 22 nt, Homo sapiens
uaauccugucuugaccaucagg

SEQ ID NO: 225446 - RNA, 22 nt, Homo sapiens
uaaugcacucgaaucauggaau

SEQ ID NO: 225447 - RNA, 22 nt, Homo sapiens
uaaugcucauuagcaggccaau

SEQ ID NO: 225448 - RNA, 21 nt, Homo sapiens
uaauggcaugaucucggcuca

SEQ ID NO: 225449 - RNA, 22 nt, Homo sapiens
uaaugugcuucucuaccauagg

SEQ ID NO: 225450 - RNA, 22 nt, Homo sapiens
uaauugaaugcagacaccaggg

SEQ ID NO: 225451 - RNA, 22 nt, Homo sapiens
uacaaagcuuucugcaaaucau

SEQ ID NO: 225452 - RNA, 22 nt, Homo sapiens
uacaaaguaacaguuccuguau

SEQ ID NO: 225453 - RNA, 22 nt, Homo sapiens
uacaaaucuagguuuguuacug

SEQ ID NO: 225454 - RNA, 21 nt, Homo sapiens
uacaagcuguagcacaugcca

SEQ ID NO: 225455 - RNA, 20 nt, Homo sapiens
uacacguaugagcacaugug

SEQ ID NO: 225456 - RNA, 22 nt, Homo sapiens
uacagcacaggugcagguguug

SEQ ID NO: 225457 - RNA, 23 nt, Homo sapiens
uacagcugcagaaucaggcuaag

SEQ ID NO: 225458 - RNA, 22 nt, Homo sapiens
uacaggugcucuacagacagga

SEQ ID NO: 225459 - RNA, 22 nt, Homo sapiens
uacagugcuugguaucuaguaa

SEQ ID NO: 225460 - RNA, 22 nt, Homo sapiens
uacaguggugugaucucagcuc

SEQ ID NO: 225461 - RNA, 22 nt, Homo sapiens
uacauacuucacagacuuuaaa

SEQ ID NO: 225462 - RNA, 22 nt, Homo sapiens
uacaucagccugaaagagcucg

SEQ ID NO: 225463 - RNA, 22 nt, Homo sapiens
uacauccauccugcugggcagu

SEQ ID NO: 225464 - RNA, 19 nt, Homo sapiens
uacaugcagcaggcacgca

SEQ ID NO: 225465 - RNA, 22 nt, Homo sapiens
uacaugcaugggcaugugugca

SEQ ID NO: 225466 - RNA, 22 nt, Homo sapiens
uacaugugccauguugguuugc

SEQ ID NO: 225467 - RNA, 22 nt, Homo sapiens
uacauugcacuuuauuagauac

SEQ ID NO: 225468 - RNA, 22 nt, Homo sapiens
uaccacauuguagagggcauuc

SEQ ID NO: 225469 - RNA, 22 nt, Homo sapiens
uaccacccuuuuuccagaagcc

SEQ ID NO: 225470 - RNA, 22 nt, Homo sapiens
uaccagcauuucucuuuaagua

SEQ ID NO: 225471 - RNA, 22 nt, Homo sapiens
uaccaguaaugguucuagagga

SEQ ID NO: 225472 - RNA, 22 nt, Homo sapiens
uacccuguaaucugaaacauga

SEQ ID NO: 225473 - RNA, 22 nt, Homo sapiens
uacccuuauguaaucauuauac

SEQ ID NO: 225474 - RNA, 22 nt, Homo sapiens
uaccuaguaggugguuuuucag

SEQ ID NO: 225475 - RNA, 22 nt, Homo sapiens
uaccuaguguugacuucucuuc

SEQ ID NO: 225476 - RNA, 22 nt, Homo sapiens
uaccugagaaagaaagcccucg

SEQ ID NO: 225477 - RNA, 22 nt, Homo sapiens
uaccuguagacuacagcuucag

SEQ ID NO: 225478 - RNA, 22 nt, Homo sapiens
uacgccuguaauaucagcauuu

SEQ ID NO: 225479 - RNA, 22 nt, Homo sapiens
uacguaucagucguuucuguga

SEQ ID NO: 225480 - RNA, 22 nt, Homo sapiens
uacuacuuucucuucugggaaa

SEQ ID NO: 225481 - RNA, 22 nt, Homo sapiens
uacuagaaccuuauucagagug

SEQ ID NO: 225482 - RNA, 22 nt, Homo sapiens
uacuagaggaauugcuauaacu

SEQ ID NO: 225483 - RNA, 22 nt, Homo sapiens
uacucaguagacacucauaugu

SEQ ID NO: 225484 - RNA, 22 nt, Homo sapiens
uacucugcagagaugcauaaca

SEQ ID NO: 225485 - RNA, 22 nt, Homo sapiens
uacugaccugucauucagaguu

SEQ ID NO: 225486 - RNA, 22 nt, Homo sapiens
uacugagagaggaauauugaaa

SEQ ID NO: 225487 - RNA, 20 nt, Homo sapiens
uacugcacuccaaccuaggc

SEQ ID NO: 225488 - RNA, 22 nt, Homo sapiens
uacugcacuccagccugccaac

SEQ ID NO: 225489 - RNA, 22 nt, Homo sapiens
uacugcacuccagccuugccaa

SEQ ID NO: 225490 - RNA, 20 nt, Homo sapiens
uacugcacuccauccugggu

SEQ ID NO: 225491 - RNA, 20 nt, Homo sapiens
uacugcacuuuccucauggu

SEQ ID NO: 225492 - RNA, 23 nt, Homo sapiens
uacugcauccuccgccucuaggg

SEQ ID NO: 225493 - RNA, 22 nt, Homo sapiens
uacugcaucuacuuagagccag

SEQ ID NO: 225494 - RNA, 22 nt, Homo sapiens
uacugcuaccuccagcuucugg

SEQ ID NO: 225495 - RNA, 22 nt, Homo sapiens
uacugcugucagugccaaguag

SEQ ID NO: 225496 - RNA, 22 nt, Homo sapiens
uacugcuuaagggcaugggccc

SEQ ID NO: 225497 - RNA, 22 nt, Homo sapiens
uacuggccccaaaguagguagu

SEQ ID NO: 225498 - RNA, 22 nt, Homo sapiens
uacuggguguucugagaaaaua

SEQ ID NO: 225499 - RNA, 22 nt, Homo sapiens
uacuucauucuugaccuugcau

SEQ ID NO: 225500 - RNA, 21 nt, Homo sapiens
uacuugagacagggucuugcu

SEQ ID NO: 225501 - RNA, 22 nt, Homo sapiens
uagaaaguagggaagguaggau

SEQ ID NO: 225502 - RNA, 22 nt, Homo sapiens
uagaagcuacucuucuuguggc

SEQ ID NO: 225503 - RNA, 22 nt, Homo sapiens
uagaaucuaacucgcaugaaaa

SEQ ID NO: 225504 - RNA, 22 nt, Homo sapiens
uagaaugcauuagguugcccag

SEQ ID NO: 225505 - RNA, 22 nt, Homo sapiens
uagaauguaaauuccaagggca

SEQ ID NO: 225506 - RNA, 22 nt, Homo sapiens
uagacacuagauaugugacuga

SEQ ID NO: 225507 - RNA, 20 nt, Homo sapiens
uagacagcuagauuagauag

SEQ ID NO: 225508 - RNA, 22 nt, Homo sapiens
uagaccauucuauuuccuaugc

SEQ ID NO: 225509 - RNA, 20 nt, Homo sapiens
uagagagauauggggguucc

SEQ ID NO: 225510 - RNA, 22 nt, Homo sapiens
uagagcuaguugcucacugcuu

SEQ ID NO: 225511 - RNA, 21 nt, Homo sapiens
uagagcuuggcacagaguaga

SEQ ID NO: 225512 - RNA, 22 nt, Homo sapiens
uagagguaggucuucgagucuc

SEQ ID NO: 225513 - RNA, 22 nt, Homo sapiens
uagagguagguguaugaacuag

SEQ ID NO: 225514 - RNA, 19 nt, Homo sapiens
uagagguuuaagaaaagaa

SEQ ID NO: 225515 - RNA, 22 nt, Homo sapiens
uagaguaguggcgugaucucgg

SEQ ID NO: 225516 - RNA, 22 nt, Homo sapiens
uagaucauauacuugccaugac

SEQ ID NO: 225517 - RNA, 23 nt, Homo sapiens
uagaucaucaaguuuacugugcu

SEQ ID NO: 225518 - RNA, 20 nt, Homo sapiens
uagaugcauuuagauucauu

SEQ ID NO: 225519 - RNA, 22 nt, Homo sapiens
uagauuaucuaugaggcuucca

SEQ ID NO: 225520 - RNA, 22 nt, Homo sapiens
uagauucaucuguuccuuuuga

SEQ ID NO: 225521 - RNA, 22 nt, Homo sapiens
uagcaaguguuuaagcacuuuu

SEQ ID NO: 225522 - RNA, 20 nt, Homo sapiens
uagcacacauguagaauagu

SEQ ID NO: 225523 - RNA, 22 nt, Homo sapiens
cuggaggccugaacauaaaugg

SEQ ID NO: 225524 - RNA, 22 nt, Homo sapiens
cuggauagagauugaugaugcu

SEQ ID NO: 225525 - RNA, 20 nt, Homo sapiens
cuggaugucgaggcagaggu

SEQ ID NO: 225526 - RNA, 19 nt, Homo sapiens
cuggcaaaugcuuuggcca

SEQ ID NO: 225527 - RNA, 22 nt, Homo sapiens
cuggcaagaggauaaaguccua

SEQ ID NO: 225528 - RNA, 22 nt, Homo sapiens
cuggcagucugccucuucacug

SEQ ID NO: 225529 - RNA, 22 nt, Homo sapiens
cuggcgagacagcuccaucacu

SEQ ID NO: 225530 - RNA, 22 nt, Homo sapiens
cugggaugugacuguugccccc

SEQ ID NO: 225531 - RNA, 22 nt, Homo sapiens
cugggcaaugcggcuggauaga

SEQ ID NO: 225532 - RNA, 22 nt, Homo sapiens
cuggucaagagcaaaggccagg

SEQ ID NO: 225533 - RNA, 22 nt, Homo sapiens
cuggucaugggggcacccucug

SEQ ID NO: 225534 - RNA, 21 nt, Homo sapiens
cugguccccuuuauguaugug

SEQ ID NO: 225535 - RNA, 22 nt, Homo sapiens
cuggugagaugucuuuccucuu

SEQ ID NO: 225536 - RNA, 21 nt, Homo sapiens
cugguguuagcacuucuuccc

SEQ ID NO: 225537 - RNA, 22 nt, Homo sapiens
cuguaaagaucacagagcuggu

SEQ ID NO: 225538 - RNA, 22 nt, Homo sapiens
cuguaaaguucucauuguagcc

SEQ ID NO: 225539 - RNA, 22 nt, Homo sapiens
cuguaagcauuauaaagagaua

SEQ ID NO: 225540 - RNA, 22 nt, Homo sapiens
cugucagugggaguucaggcuu

SEQ ID NO: 225541 - RNA, 22 nt, Homo sapiens
cugucaucauuucuaugugcca

SEQ ID NO: 225542 - RNA, 22 nt, Homo sapiens
cugucucagugaauugguuuua

SEQ ID NO: 225543 - RNA, 22 nt, Homo sapiens
cugucuggaguccuucgugugc

SEQ ID NO: 225544 - RNA, 22 nt, Homo sapiens
cugugaagaaagucauugguag

SEQ ID NO: 225545 - RNA, 22 nt, Homo sapiens
cugugaucuuuuuucauguggu

SEQ ID NO: 225546 - RNA, 22 nt, Homo sapiens
cugugcauaucuuggacugugu

SEQ ID NO: 225547 - RNA, 22 nt, Homo sapiens
cugugcauucuuaaaucaggaa

SEQ ID NO: 225548 - RNA, 19 nt, Homo sapiens
cugugcauuucuguggaag

SEQ ID NO: 225549 - RNA, 22 nt, Homo sapiens
cugugcuaggcaaugugguaga

SEQ ID NO: 225550 - RNA, 20 nt, Homo sapiens
cugugguagggaccaggaau

SEQ ID NO: 225551 - RNA, 18 nt, Homo sapiens
uaucauguagggaaguug

SEQ ID NO: 225552 - RNA, 22 nt, Homo sapiens
uaucauuguguuauuucuucca

SEQ ID NO: 225553 - RNA, 22 nt, Homo sapiens
uauccuagugggguuucaguca

SEQ ID NO: 225554 - RNA, 23 nt, Homo sapiens
uaucucaaugcacagagaggaaa

SEQ ID NO: 225555 - RNA, 22 nt, Homo sapiens
uaugaaccuguuaucuagguuu

SEQ ID NO: 225556 - RNA, 22 nt, Homo sapiens
uaugaagccaggauuuauuauu

SEQ ID NO: 225557 - RNA, 22 nt, Homo sapiens
uaugaauuuuauccaggauaua

SEQ ID NO: 225558 - RNA, 22 nt, Homo sapiens
uaugacuuuugaauacagaugg

SEQ ID NO: 225559 - RNA, 22 nt, Homo sapiens
uaugagcacauauguaucuaug

SEQ ID NO: 225560 - RNA, 22 nt, Homo sapiens
uaugaucauuauguuauugcag

SEQ ID NO: 225561 - RNA, 22 nt, Homo sapiens
uaugaugcuguuuagaaucucu

SEQ ID NO: 225562 - RNA, 19 nt, Homo sapiens
uaugcaacuuauagugcug

SEQ ID NO: 225563 - RNA, 22 nt, Homo sapiens
uaugcacuaggcacuguguuug

SEQ ID NO: 225564 - RNA, 22 nt, Homo sapiens
uaugcagacauuguuccaacca

SEQ ID NO: 225565 - RNA, 22 nt, Homo sapiens
uaugcccauuuaaauugaacaa

SEQ ID NO: 225566 - RNA, 23 nt, Homo sapiens
uaugccuguuucaaacaaacuuu

SEQ ID NO: 225567 - RNA, 22 nt, Homo sapiens
uaugccuuugaccauuuuguga

SEQ ID NO: 225568 - RNA, 22 nt, Homo sapiens
uauggauuugcauuccccaugu

SEQ ID NO: 225569 - RNA, 22 nt, Homo sapiens
uauggauuuucagauucuuauc

SEQ ID NO: 225570 - RNA, 22 nt, Homo sapiens
uauggauuuuggaauauguggg

SEQ ID NO: 225571 - RNA, 22 nt, Homo sapiens
uauggcaaugcauaggaaggaa

SEQ ID NO: 225572 - RNA, 22 nt, Homo sapiens
uauggcacacguuuaccuaugu

SEQ ID NO: 225573 - RNA, 22 nt, Homo sapiens
uauggcauuguuggugaugaua

SEQ ID NO: 225574 - RNA, 22 nt, Homo sapiens
uauggcugcuuucacacuacaa

SEQ ID NO: 225575 - RNA, 22 nt, Homo sapiens
uauggcuucuuuaaauugaggu

SEQ ID NO: 225576 - RNA, 22 nt, Homo sapiens
uauggcuuucuacuugaguucu

SEQ ID NO: 225577 - RNA, 22 nt, Homo sapiens
uauggcuuuuaacugucguaug

SEQ ID NO: 225578 - RNA, 22 nt, Homo sapiens
uauggcuuuucacuuaaguccu

SEQ ID NO: 225579 - RNA, 22 nt, Homo sapiens
uaugucacagguuuuggugaaa

SEQ ID NO: 225580 - RNA, 22 nt, Homo sapiens
uaugugcaaauuaauugcuaga

SEQ ID NO: 225581 - RNA, 20 nt, Homo sapiens
uauuacagaguaauggugga

SEQ ID NO: 225582 - RNA, 22 nt, Homo sapiens
uauuaguuuucuguggauuaca

SEQ ID NO: 225583 - RNA, 22 nt, Homo sapiens
uauucacaggugugggacaaag

SEQ ID NO: 225584 - RNA, 22 nt, Homo sapiens
uauuccacuggcacugcauuug

SEQ ID NO: 225585 - RNA, 22 nt, Homo sapiens
uauugaacgugggauauugaag

SEQ ID NO: 225586 - RNA, 22 nt, Homo sapiens
uauugaauuugagcugucucuu

SEQ ID NO: 225587 - RNA, 22 nt, Homo sapiens
uauugacuugaugagggagggu

SEQ ID NO: 225588 - RNA, 22 nt, Homo sapiens
uauugauuuucaguguucagcu

SEQ ID NO: 225589 - RNA, 22 nt, Homo sapiens
uauugcaauuggcagagugcua

SEQ ID NO: 225590 - RNA, 22 nt, Homo sapiens
uauugcaauuggggaaacuggg

SEQ ID NO: 225591 - RNA, 23 nt, Homo sapiens
uauugcacuaugguaacccuuuu

SEQ ID NO: 225592 - RNA, 22 nt, Homo sapiens
uauugcauuugagguugguuga

SEQ ID NO: 225593 - RNA, 22 nt, Homo sapiens
uauugcccugcuuuguucuaaa

SEQ ID NO: 225594 - RNA, 22 nt, Homo sapiens
uauugccuugccuacuuuucca

SEQ ID NO: 225595 - RNA, 22 nt, Homo sapiens
uauugcuccuaauaucacggug

SEQ ID NO: 225596 - RNA, 22 nt, Homo sapiens
uauugcucugacugauuggaug

SEQ ID NO: 225597 - RNA, 22 nt, Homo sapiens
uauugcugaaaaugcuaaugau

SEQ ID NO: 225598 - RNA, 22 nt, Homo sapiens
uauugcugaugcugaagggaag

SEQ ID NO: 225599 - RNA, 22 nt, Homo sapiens
uauugcuggcucugucuucauu

SEQ ID NO: 225600 - RNA, 22 nt, Homo sapiens
uauugcuuaugaugcugaauua

SEQ ID NO: 225601 - RNA, 22 nt, Homo sapiens
uauugcuugaggaaaugguaau

SEQ ID NO: 225602 - RNA, 18 nt, Homo sapiens
uauugcuugguuuggaga

SEQ ID NO: 225603 - RNA, 22 nt, Homo sapiens
uauugcuuuacucucuuauccu

SEQ ID NO: 225604 - RNA, 22 nt, Homo sapiens
uauugcuuuugauucaaggcag

SEQ ID NO: 225605 - RNA, 22 nt, Homo sapiens
uauuguacauguuauagauuuu

SEQ ID NO: 225606 - RNA, 22 nt, Homo sapiens
uauugucacuaaaggaagcugg

SEQ ID NO: 225607 - RNA, 22 nt, Homo sapiens
uauuguuuuucccaggagucua

SEQ ID NO: 225608 - RNA, 22 nt, Homo sapiens
uauuucaguugugcagguaguu

SEQ ID NO: 225609 - RNA, 22 nt, Homo sapiens
uauuugauuaacaagagccuaa

SEQ ID NO: 225610 - RNA, 22 nt, Homo sapiens
uauuugauugacuuuagcagga

SEQ ID NO: 225611 - RNA, 20 nt, Homo sapiens
uauuugguuauuuccauggu

SEQ ID NO: 225612 - RNA, 22 nt, Homo sapiens
uauuugguuggugcaaaaguaa

SEQ ID NO: 225613 - RNA, 22 nt, Homo sapiens
uauuuguccccuccaaaaguca

SEQ ID NO: 225614 - RNA, 22 nt, Homo sapiens
ucaaaaccucagagaguagagc

SEQ ID NO: 225615 - RNA, 22 nt, Homo sapiens
ucaaacacuccauaucgcgauu

SEQ ID NO: 225616 - RNA, 22 nt, Homo sapiens
ucaaaguaaagccucaggaugg

SEQ ID NO: 225617 - RNA, 20 nt, Homo sapiens
ucaaaguaugcucugcacua

SEQ ID NO: 225618 - RNA, 22 nt, Homo sapiens
ucaaaucaucuuuuccaaagcu

SEQ ID NO: 225619 - RNA, 22 nt, Homo sapiens
ucaaaugauucagaagccaccu

SEQ ID NO: 225620 - RNA, 22 nt, Homo sapiens
ucaaaugcacguagagaaaaua

SEQ ID NO: 225621 - RNA, 22 nt, Homo sapiens
gaacacaucuuugguuagagga

SEQ ID NO: 225622 - RNA, 22 nt, Homo sapiens
gaacuuguguugcuucacaugu

SEQ ID NO: 225623 - RNA, 22 nt, Homo sapiens
gaagagacagguucccacaaaa

SEQ ID NO: 225624 - RNA, 22 nt, Homo sapiens
gaagauaucuaguaccauuguc

SEQ ID NO: 225625 - RNA, 22 nt, Homo sapiens
gaagaucacacuguagaucuau

SEQ ID NO: 225626 - RNA, 22 nt, Homo sapiens
gaagauucaaccaaaccagaac

SEQ ID NO: 225627 - RNA, 22 nt, Homo sapiens
gaagcagcauucugguuuuugg

SEQ ID NO: 225628 - RNA, 22 nt, Homo sapiens
gaaggagcuuaucugccauuuc

SEQ ID NO: 225629 - RNA, 22 nt, Homo sapiens
gaaggcaugcugcauggccaga

SEQ ID NO: 225630 - RNA, 22 nt, Homo sapiens
gaaguaggugcuguuauuaucu

SEQ ID NO: 225631 - RNA, 22 nt, Homo sapiens
gaagugcaguggcacagucaug

SEQ ID NO: 225632 - RNA, 19 nt, Homo sapiens
gaaguguuguccuccagua

SEQ ID NO: 225633 - RNA, 17 nt, Homo sapiens
gaaguguuucagcagcu

SEQ ID NO: 225634 - RNA, 22 nt, Homo sapiens
gaauacugacuauuucaucugg

SEQ ID NO: 225635 - RNA, 22 nt, Homo sapiens
gaauagugcugcaagaaacaua

SEQ ID NO: 225636 - RNA, 22 nt, Homo sapiens
gaauagugcugcaaugaacaua

SEQ ID NO: 225637 - RNA, 22 nt, Homo sapiens
gaaucacugugguaucccaugc

SEQ ID NO: 225638 - RNA, 22 nt, Homo sapiens
gaaugauacuguuaacgaaaga

SEQ ID NO: 225639 - RNA, 22 nt, Homo sapiens
gaaugcaugaggggaucagaug

SEQ ID NO: 225640 - RNA, 22 nt, Homo sapiens
gaaugcuaagcaugugggaauu

SEQ ID NO: 225641 - RNA, 20 nt, Homo sapiens
gacaaaccuagaugguacag

SEQ ID NO: 225642 - RNA, 22 nt, Homo sapiens
gacaagagaacacugcuauauu

SEQ ID NO: 225643 - RNA, 22 nt, Homo sapiens
gacagacacaauugauccauga

SEQ ID NO: 225644 - RNA, 22 nt, Homo sapiens
gacagugagaugucaugugaaa

SEQ ID NO: 225645 - RNA, 22 nt, Homo sapiens
gacaguuuggugaggaagacga

SEQ ID NO: 225646 - RNA, 22 nt, Homo sapiens
gacauagagccuugacuucauu

SEQ ID NO: 225647 - RNA, 22 nt, Homo sapiens
ucacagugcaggaucaguuaau

SEQ ID NO: 225648 - RNA, 22 nt, Homo sapiens
ucacaguucagcauggcugagg

SEQ ID NO: 225649 - RNA, 22 nt, Homo sapiens
ucacaucucagguuucuugaca

SEQ ID NO: 225650 - RNA, 22 nt, Homo sapiens
ucacauggauuaacucauuuau

SEQ ID NO: 225651 - RNA, 22 nt, Homo sapiens
ucacaugggugcaauauaauca

SEQ ID NO: 225652 - RNA, 22 nt, Homo sapiens
ucacauguguaugagcuuugau

SEQ ID NO: 225653 - RNA, 22 nt, Homo sapiens
ucacauuaagcuguuauuucuu

SEQ ID NO: 225654 - RNA, 22 nt, Homo sapiens
ucacauuguacaaacagguaag

SEQ ID NO: 225655 - RNA, 22 nt, Homo sapiens
ucaccaguaauaaagagccugc

SEQ ID NO: 225656 - RNA, 19 nt, Homo sapiens
ucaccaguacacaauacaa

SEQ ID NO: 225657 - RNA, 22 nt, Homo sapiens
ucacccuguguuuugcguuugc

SEQ ID NO: 225658 - RNA, 22 nt, Homo sapiens
ucaccggcagacguggccugau

SEQ ID NO: 225659 - RNA, 22 nt, Homo sapiens
ucaccucgugaucugcccacuu

SEQ ID NO: 225660 - RNA, 22 nt, Homo sapiens
ucaccuggagaagauggaucau

SEQ ID NO: 225661 - RNA, 22 nt, Homo sapiens
ucaccuggagacaugaagacug

SEQ ID NO: 225662 - RNA, 22 nt, Homo sapiens
ucaccuggagccuucacauucu

SEQ ID NO: 225663 - RNA, 19 nt, Homo sapiens
ucaccuugcccugcacaca

SEQ ID NO: 225664 - RNA, 18 nt, Homo sapiens
ucaccuugugagagagag

SEQ ID NO: 225665 - RNA, 22 nt, Homo sapiens
ucacgcugcugcaaccagccug

SEQ ID NO: 225666 - RNA, 23 nt, Homo sapiens
ucacggagaccugcaagaccaau

SEQ ID NO: 225667 - RNA, 22 nt, Homo sapiens
ucacgugguucauaaggcagaa

SEQ ID NO: 225668 - RNA, 23 nt, Homo sapiens
ucacuagaguccuggaguuugag

SEQ ID NO: 225669 - RNA, 22 nt, Homo sapiens
ucacuagaucaagggagagaaa

SEQ ID NO: 225670 - RNA, 22 nt, Homo sapiens
ucacuaggcuggagugcagugg

SEQ ID NO: 225671 - RNA, 22 nt, Homo sapiens
ucacuauugacaacagugugga

SEQ ID NO: 225672 - RNA, 22 nt, Homo sapiens
ucacugcacuccagccuuuaug

SEQ ID NO: 225673 - RNA, 22 nt, Homo sapiens
ucacugcacuucaggcuuucuc

SEQ ID NO: 225674 - RNA, 22 nt, Homo sapiens
ucacugcgaccuccgccucccg

SEQ ID NO: 225675 - RNA, 22 nt, Homo sapiens
ucacuggacagaaauaaaggug

SEQ ID NO: 225676 - RNA, 20 nt, Homo sapiens
ucacuggagcucauuugauu

SEQ ID NO: 225677 - RNA, 22 nt, Homo sapiens
ucacuggucuaaguggaggggg

SEQ ID NO: 225678 - RNA, 18 nt, Homo sapiens
ucacugugugucuugggu

SEQ ID NO: 225679 - RNA, 22 nt, Homo sapiens
ucacuuggccgcagccuucucu

SEQ ID NO: 225680 - RNA, 22 nt, Homo sapiens
ucacuuugacggccaacuucua

SEQ ID NO: 225681 - RNA, 22 nt, Homo sapiens
ucacuuuguuuuuggauaaguu

SEQ ID NO: 225682 - RNA, 22 nt, Homo sapiens
ucagaacugauacuagaacuuu

SEQ ID NO: 225683 - RNA, 22 nt, Homo sapiens
ucagacacugagcaaacgacua

SEQ ID NO: 225684 - RNA, 22 nt, Homo sapiens
ucagacacugcccuccaccugu

SEQ ID NO: 225685 - RNA, 22 nt, Homo sapiens
ucagaccauuucauuacagacu

SEQ ID NO: 225686 - RNA, 22 nt, Homo sapiens
ucagaguagaaacacuuccaua

SEQ ID NO: 225687 - RNA, 22 nt, Homo sapiens
ucagaguaguuccuggcagaaa

SEQ ID NO: 225688 - RNA, 22 nt, Homo sapiens
ucagaguguuuuccaacuuggu

SEQ ID NO: 225689 - RNA, 22 nt, Homo sapiens
ucagaugaucugguaagaacuu

SEQ ID NO: 225690 - RNA, 22 nt, Homo sapiens
ucagaugauuccguugacgaga

SEQ ID NO: 225691 - RNA, 22 nt, Homo sapiens
ucagauguuucuuuaacgcaug

SEQ ID NO: 225692 - RNA, 22 nt, Homo sapiens
ucagauguuuuguuuaucugcu

SEQ ID NO: 225693 - RNA, 22 nt, Homo sapiens
ucagauugaugcauacuuaaau

SEQ ID NO: 225694 - RNA, 22 nt, Homo sapiens
ucagcaaugaccuaagcaaaua

SEQ ID NO: 225695 - RNA, 22 nt, Homo sapiens
ucagcagugugaaaauggacua

SEQ ID NO: 225696 - RNA, 21 nt, Homo sapiens
ucaggaccucuaguuagccag

SEQ ID NO: 225697 - RNA, 22 nt, Homo sapiens
ucaggcaccuuccucuuaucug

SEQ ID NO: 225698 - RNA, 22 nt, Homo sapiens
ucaggcacucagcuuagagucu

SEQ ID NO: 225699 - RNA, 22 nt, Homo sapiens
ucaggcaugcagcaaugcagug

SEQ ID NO: 225700 - RNA, 22 nt, Homo sapiens
ucagggacuuacaaaccagaag

SEQ ID NO: 225701 - RNA, 23 nt, Homo sapiens
ucagguaguuucagaggaccuug

SEQ ID NO: 225702 - RNA, 22 nt, Homo sapiens
ucaggucauuccaggagggcca

SEQ ID NO: 225703 - RNA, 22 nt, Homo sapiens
ucaguagcaugaaaacagacua

SEQ ID NO: 225704 - RNA, 22 nt, Homo sapiens
ucaguagcauugcuuauacagu

SEQ ID NO: 225705 - RNA, 22 nt, Homo sapiens
ucagucauguuuaccagacgua

SEQ ID NO: 225706 - RNA, 22 nt, Homo sapiens
ucagucauucacucacucggac

SEQ ID NO: 225707 - RNA, 22 nt, Homo sapiens
ucagucauugauggaguagguc

SEQ ID NO: 225708 - RNA, 22 nt, Homo sapiens
ucagucuuuuuuuggcaagcau

SEQ ID NO: 225709 - RNA, 23 nt, Homo sapiens
ucagugaaggaacaacuaaauag

SEQ ID NO: 225710 - RNA, 22 nt, Homo sapiens
ucagugacugcugcuuguauac

SEQ ID NO: 225711 - RNA, 22 nt, Homo sapiens
ucagugauugguuauuuuaggc

SEQ ID NO: 225712 - RNA, 21 nt, Homo sapiens
ucagugcugugggcaaggugc

SEQ ID NO: 225713 - RNA, 22 nt, Homo sapiens
ucagugcuguuugcccucguuu

SEQ ID NO: 225714 - RNA, 22 nt, Homo sapiens
ucagugcuuggcacagagagcu

SEQ ID NO: 225715 - RNA, 22 nt, Homo sapiens
ucaguggagccucacucugugg

SEQ ID NO: 225716 - RNA, 22 nt, Homo sapiens
ucaguggauuauuaaagucacc

SEQ ID NO: 225717 - RNA, 22 nt, Homo sapiens
ucaguggauuuaaccugaauca

SEQ ID NO: 225718 - RNA, 22 nt, Homo sapiens
ucagugucugcauucuuauugu

SEQ ID NO: 225719 - RNA, 22 nt, Homo sapiens
gggauguaugauauauguuggu

SEQ ID NO: 225720 - RNA, 23 nt, Homo sapiens
gggauuguaaaauaugagggcag

SEQ ID NO: 225721 - RNA, 21 nt, Homo sapiens
gggcaaaucuuuauccuaagc

SEQ ID NO: 225722 - RNA, 22 nt, Homo sapiens
gggcaaauuauguaucucucag

SEQ ID NO: 225723 - RNA, 22 nt, Homo sapiens
gggcaacauugaguacccugaa

SEQ ID NO: 225724 - RNA, 22 nt, Homo sapiens
gggcauaucacuugaggucagg

SEQ ID NO: 225725 - RNA, 22 nt, Homo sapiens
gggcgagaaucggcugcucagc

SEQ ID NO: 225726 - RNA, 22 nt, Homo sapiens
ggggaauguuaaagaauuugca

SEQ ID NO: 225727 - RNA, 22 nt, Homo sapiens
ggggucaucagagaaucuaccc

SEQ ID NO: 225728 - RNA, 22 nt, Homo sapiens
gggucauggaugugaagcuaga

SEQ ID NO: 225729 - RNA, 22 nt, Homo sapiens
gguaaacauaagagagcugacu

SEQ ID NO: 225730 - RNA, 22 nt, Homo sapiens
gguaauguaacugguauucugu

SEQ ID NO: 225731 - RNA, 17 nt, Homo sapiens
gguacguuuuguucugu

SEQ ID NO: 225732 - RNA, 22 nt, Homo sapiens
gguaucuuggagagagaaguga

SEQ ID NO: 225733 - RNA, 22 nt, Homo sapiens
gguauguaggucuacgguacaa

SEQ ID NO: 225734 - RNA, 22 nt, Homo sapiens
gguauguuuagaccauuuacau

SEQ ID NO: 225735 - RNA, 22 nt, Homo sapiens
gguauuuaaaguaccugucugc

SEQ ID NO: 225736 - RNA, 21 nt, Homo sapiens
ugacauguugguuugcugcac

SEQ ID NO: 225737 - RNA, 22 nt, Homo sapiens
ugacauuacagucacuugcugu

SEQ ID NO: 225738 - RNA, 22 nt, Homo sapiens
ugaccacugucuaagauaggug

SEQ ID NO: 225739 - RNA, 22 nt, Homo sapiens
ugacccauagaaauguggauaa

SEQ ID NO: 225740 - RNA, 22 nt, Homo sapiens
ugacuaaggaaggauuaugugc

SEQ ID NO: 225741 - RNA, 22 nt, Homo sapiens
ugacuacaaccuccaccucccg

SEQ ID NO: 225742 - RNA, 22 nt, Homo sapiens
ugacuacaccacacgguuaagg

SEQ ID NO: 225743 - RNA, 22 nt, Homo sapiens
ugacuagagggcuuuuguguag

SEQ ID NO: 225744 - RNA, 22 nt, Homo sapiens
ugacuagggcucuaaacagcuc

SEQ ID NO: 225745 - RNA, 22 nt, Homo sapiens
ugacuaggggcccuggcuucuu

SEQ ID NO: 225746 - RNA, 22 nt, Homo sapiens
ugacugaguaguauuccacuau

SEQ ID NO: 225747 - RNA, 22 nt, Homo sapiens
ugacuucagacugaaaugauuc

SEQ ID NO: 225748 - RNA, 22 nt, Homo sapiens
ugacuugaacuucuaugucacc

SEQ ID NO: 225749 - RNA, 22 nt, Homo sapiens
ugacuugagcuggagccugccu

SEQ ID NO: 225750 - RNA, 21 nt, Homo sapiens
ugagaacaacaggucaagcag

SEQ ID NO: 225751 - RNA, 22 nt, Homo sapiens
ugagaacaugcacuugagguug

SEQ ID NO: 225752 - RNA, 22 nt, Homo sapiens
ugagaacuaaaaugugguauau

SEQ ID NO: 225753 - RNA, 22 nt, Homo sapiens
ugagaacuaaugaagaauuuau

SEQ ID NO: 225754 - RNA, 22 nt, Homo sapiens
ugagaacucaugggucugcugg

SEQ ID NO: 225755 - RNA, 22 nt, Homo sapiens
ugagaacugguagcacuuguga

SEQ ID NO: 225756 - RNA, 22 nt, Homo sapiens
ugagaagacaucagcuuucgga

SEQ ID NO: 225757 - RNA, 22 nt, Homo sapiens
ugagaagcauaccagugucugu

SEQ ID NO: 225758 - RNA, 22 nt, Homo sapiens
ugagaagugauauagaaguuaa

SEQ ID NO: 225759 - RNA, 22 nt, Homo sapiens
ugagaauauuuuccaugucuca

SEQ ID NO: 225760 - RNA, 19 nt, Homo sapiens
ugagaauguuaccaggucc

SEQ ID NO: 225761 - RNA, 21 nt, Homo sapiens
ugagacaauccuggucaauau

SEQ ID NO: 225762 - RNA, 22 nt, Homo sapiens
ugagaccugaucuugguacugc

SEQ ID NO: 225763 - RNA, 22 nt, Homo sapiens
ugagacggagucuggcacuguc

SEQ ID NO: 225764 - RNA, 22 nt, Homo sapiens
ugagacggaguuuugcucuugu

SEQ ID NO: 225765 - RNA, 22 nt, Homo sapiens
ugagacugaaauuaggaaacug

SEQ ID NO: 225766 - RNA, 22 nt, Homo sapiens
ugagacugagucucccucuguc

SEQ ID NO: 225767 - RNA, 22 nt, Homo sapiens
ugagacugagucuugcucuauu

SEQ ID NO: 225768 - RNA, 22 nt, Homo sapiens
ugagacugagucuugcucuugu

SEQ ID NO: 225769 - RNA, 22 nt, Homo sapiens
ugagacugaguuucacuuuugu

SEQ ID NO: 225770 - RNA, 22 nt, Homo sapiens
ugagacugaguuuugcucuugu

SEQ ID NO: 225771 - RNA, 22 nt, Homo sapiens
ugagacugauaggacauuuucu

SEQ ID NO: 225772 - RNA, 22 nt, Homo sapiens
ugagacugguaauguguagggc

SEQ ID NO: 225773 - RNA, 22 nt, Homo sapiens
ugagagacagacauuaucuuau

SEQ ID NO: 225774 - RNA, 22 nt, Homo sapiens
ugagagucauacaaauaaaaau

SEQ ID NO: 225775 - RNA, 22 nt, Homo sapiens
ugagauaaagcauguacugugu

SEQ ID NO: 225776 - RNA, 22 nt, Homo sapiens
ugagauaacuaaaaacauuuug

SEQ ID NO: 225777 - RNA, 22 nt, Homo sapiens
ugagauaaugcaugugaagauc

SEQ ID NO: 225778 - RNA, 22 nt, Homo sapiens
ugagauaggaucuugcucuguu

SEQ ID NO: 225779 - RNA, 22 nt, Homo sapiens
ugagauaucauuucacacccag

SEQ ID NO: 225780 - RNA, 22 nt, Homo sapiens
ugagaucacgccacugcacucc

SEQ ID NO: 225781 - RNA, 22 nt, Homo sapiens
ugagaucagaaggauuucucug

SEQ ID NO: 225782 - RNA, 22 nt, Homo sapiens
ugagaucaugucauuugcacuc

SEQ ID NO: 225783 - RNA, 20 nt, Homo sapiens
ugagauccacgugaaguaug

SEQ ID NO: 225784 - RNA, 22 nt, Homo sapiens
ugagaucgaguaucgcugucac

SEQ ID NO: 225785 - RNA, 22 nt, Homo sapiens
ugagaucgagucucgcucuguc

SEQ ID NO: 225786 - RNA, 22 nt, Homo sapiens
ugagaucugauaggccuggguu

SEQ ID NO: 225787 - RNA, 22 nt, Homo sapiens
ugagaucuuugcuguccucacc

SEQ ID NO: 225788 - RNA, 22 nt, Homo sapiens
ugagaugaagucuugcucuguu

SEQ ID NO: 225789 - RNA, 22 nt, Homo sapiens
ugagaugaggucucacucuguu

SEQ ID NO: 225790 - RNA, 22 nt, Homo sapiens
ugagaugagucucgcucuguca

SEQ ID NO: 225791 - RNA, 21 nt, Homo sapiens
ugagaugcaaucaccagggag

SEQ ID NO: 225792 - RNA, 22 nt, Homo sapiens
ugagauggaguuucgcccuugu

SEQ ID NO: 225793 - RNA, 22 nt, Homo sapiens
ugagauggaguuucgcucuugu

SEQ ID NO: 225794 - RNA, 22 nt, Homo sapiens
ugagauggaguuucgcuuuugu

SEQ ID NO: 225795 - RNA, 22 nt, Homo sapiens
ugagauggcugaauucagaaua

SEQ ID NO: 225796 - RNA, 22 nt, Homo sapiens
ugagauguaaucucgcucuguc

SEQ ID NO: 225797 - RNA, 22 nt, Homo sapiens
ugagaugugaagaucacaugaa

SEQ ID NO: 225798 - RNA, 22 nt, Homo sapiens
ugagaugugaucaccugaaggg

SEQ ID NO: 225799 - RNA, 22 nt, Homo sapiens
ugagauguguccagaucuaguu

SEQ ID NO: 225800 - RNA, 22 nt, Homo sapiens
ugagaugugugcauucaacuca

SEQ ID NO: 225801 - RNA, 22 nt, Homo sapiens
ugagauguugcucugaaacaag

SEQ ID NO: 225802 - RNA, 22 nt, Homo sapiens
ugagauuauauuucuuaacaga

SEQ ID NO: 225803 - RNA, 19 nt, Homo sapiens
ugagauuguaugaggagau

SEQ ID NO: 225804 - RNA, 22 nt, Homo sapiens
ugagcaaaauuuuggacauaga

SEQ ID NO: 225805 - RNA, 22 nt, Homo sapiens
ugagcaagaaauagaaacagau

SEQ ID NO: 225806 - RNA, 22 nt, Homo sapiens
ugagcaauaaaguuacacaguu

SEQ ID NO: 225807 - RNA, 22 nt, Homo sapiens
ugagcacagagccugggguggc

SEQ ID NO: 225808 - RNA, 22 nt, Homo sapiens
ugagcacaggugcgcgguuacu

SEQ ID NO: 225809 - RNA, 22 nt, Homo sapiens
ugagcagaaagcugcaaggucg

SEQ ID NO: 225810 - RNA, 22 nt, Homo sapiens
ugagcaucucuaaaaggagcaa

SEQ ID NO: 225811 - RNA, 22 nt, Homo sapiens
ugagccaaugauuugaauagag

SEQ ID NO: 225812 - RNA, 22 nt, Homo sapiens
ugagcgaugggaggaagugaua

SEQ ID NO: 225813 - RNA, 22 nt, Homo sapiens
ugagcuaggauccugucacugu

SEQ ID NO: 225814 - RNA, 22 nt, Homo sapiens
ugagcuccuucauaaaaaggca

SEQ ID NO: 225815 - RNA, 22 nt, Homo sapiens
ugagcugagauuaagcugcugc

SEQ ID NO: 225816 - RNA, 20 nt, Homo sapiens
ugagcuuguaaacacuguuu

SEQ ID NO: 225817 - RNA, 22 nt, Homo sapiens
ugcauaucuucuuuugagaaau

SEQ ID NO: 225818 - RNA, 22 nt, Homo sapiens
ugcauauguauacaugugccau

SEQ ID NO: 225819 - RNA, 22 nt, Homo sapiens
ugcauaugucuuuauaguagca

SEQ ID NO: 225820 - RNA, 22 nt, Homo sapiens
ugcauauguucaaaguauucug

SEQ ID NO: 225821 - RNA, 22 nt, Homo sapiens
ugcauauguugaaccagccuug

SEQ ID NO: 225822 - RNA, 22 nt, Homo sapiens
ugcauauucaaggcaggccauu

SEQ ID NO: 225823 - RNA, 22 nt, Homo sapiens
ugcauauucgaguuauuuuggg

SEQ ID NO: 225824 - RNA, 21 nt, Homo sapiens
ugcauauuggaacuuucucuc

SEQ ID NO: 225825 - RNA, 22 nt, Homo sapiens
ugcauauuuuauaaagauggaa

SEQ ID NO: 225826 - RNA, 22 nt, Homo sapiens
ugcaucaggcugcuuauuacaa

SEQ ID NO: 225827 - RNA, 22 nt, Homo sapiens
ugcauccauucuagacucaucu

SEQ ID NO: 225828 - RNA, 22 nt, Homo sapiens
ugcauggagauauacaguuuuu

SEQ ID NO: 225829 - RNA, 22 nt, Homo sapiens
ugcauggauguuugaacacacu

SEQ ID NO: 225830 - RNA, 22 nt, Homo sapiens
ugagcugguacuaauauuauca

SEQ ID NO: 225831 - RNA, 22 nt, Homo sapiens
ugagcuguuugaagaagcauuu

SEQ ID NO: 225832 - RNA, 22 nt, Homo sapiens
ugaggaauguguguuaaagaua

SEQ ID NO: 225833 - RNA, 22 nt, Homo sapiens
ugaggcaagauacugauuucau

SEQ ID NO: 225834 - RNA, 22 nt, Homo sapiens
ugaggcaaggcugaaugaaggc

SEQ ID NO: 225835 - RNA, 17 nt, Homo sapiens
ugaggcacuaguaucac

SEQ ID NO: 225836 - RNA, 22 nt, Homo sapiens
ugaggcaggagaacggcuugaa

SEQ ID NO: 225837 - RNA, 22 nt, Homo sapiens
ugagggaugccugguuuguuuu

SEQ ID NO: 225838 - RNA, 22 nt, Homo sapiens
ugagguaugacuuauuauucuu

SEQ ID NO: 225839 - RNA, 22 nt, Homo sapiens
ugaggucauucaugugggcgca

SEQ ID NO: 225840 - RNA, 22 nt, Homo sapiens
ugaggugaaguaauauucuaag

SEQ ID NO: 225841 - RNA, 22 nt, Homo sapiens
ugaggugagggguuaggugcua

SEQ ID NO: 225842 - RNA, 22 nt, Homo sapiens
ugagguguuaacuuuacuuuua

SEQ ID NO: 225843 - RNA, 22 nt, Homo sapiens
ugagguuauuuguucaagaagu

SEQ ID NO: 225844 - RNA, 22 nt, Homo sapiens
ugagguuggguaauuuaugaag

SEQ ID NO: 225845 - RNA, 22 nt, Homo sapiens
ugagguugucagugucauucuu

SEQ ID NO: 225846 - RNA, 22 nt, Homo sapiens
ugaguaauguugaucuuugaua

SEQ ID NO: 225847 - RNA, 22 nt, Homo sapiens
ugaguagaacuccuggagaugu

SEQ ID NO: 225848 - RNA, 20 nt, Homo sapiens
ugaguagaggaguucuauca

SEQ ID NO: 225849 - RNA, 22 nt, Homo sapiens
ugagucaauggaggcucagagc

SEQ ID NO: 225850 - RNA, 22 nt, Homo sapiens
ugagucaauucuaacaauggca

SEQ ID NO: 225851 - RNA, 22 nt, Homo sapiens
ugagucauuuccuuaugcuacu

SEQ ID NO: 225852 - RNA, 22 nt, Homo sapiens
ucagugcuuuuuguugucauca

SEQ ID NO: 225853 - RNA, 22 nt, Homo sapiens
ucaguggacuuagucuuucccc

SEQ ID NO: 225854 - RNA, 22 nt, Homo sapiens
ucaguggagcuacaauucuggg

SEQ ID NO: 225855 - RNA, 23 nt, Homo sapiens
ucagugucuggauccugcucagu

SEQ ID NO: 225856 - RNA, 22 nt, Homo sapiens
ucagugucugugauggagaggu

SEQ ID NO: 225857 - RNA, 22 nt, Homo sapiens
ucaguuuagguguaacggccac

SEQ ID NO: 225858 - RNA, 21 nt, Homo sapiens
ucauaagcucaacaucuguag

SEQ ID NO: 225859 - RNA, 22 nt, Homo sapiens
ucauacaggccaccagggaagu

SEQ ID NO: 225860 - RNA, 22 nt, Homo sapiens
ucauacuguugugaaacaaaac

SEQ ID NO: 225861 - RNA, 18 nt, Homo sapiens
ucauagaucaugacagug

SEQ ID NO: 225862 - RNA, 19 nt, Homo sapiens
ucauagucuaagaugagaa

SEQ ID NO: 225863 - RNA, 22 nt, Homo sapiens
ucauauguaugugcaauuuugu

SEQ ID NO: 225864 - RNA, 22 nt, Homo sapiens
ucaucagaguuuacaagcucag

SEQ ID NO: 225865 - RNA, 21 nt, Homo sapiens
ucaucagucaaagacaauggu

SEQ ID NO: 225866 - RNA, 22 nt, Homo sapiens
ucaugacacagcauacugacuu

SEQ ID NO: 225867 - RNA, 22 nt, Homo sapiens
ucaugggagcccccaucaugag

SEQ ID NO: 225868 - RNA, 22 nt, Homo sapiens
ucauguacuuguagucccggcu

SEQ ID NO: 225869 - RNA, 22 nt, Homo sapiens
ucaugucuuguuguauuuauuu

SEQ ID NO: 225870 - RNA, 22 nt, Homo sapiens
ucaugugagcacagagcaagau

SEQ ID NO: 225871 - RNA, 22 nt, Homo sapiens
ucaugugaggauaacaauagug

SEQ ID NO: 225872 - RNA, 19 nt, Homo sapiens
ucaugugcauacauuuggg

SEQ ID NO: 225873 - RNA, 22 nt, Homo sapiens
ucauuagagacagggugucacu

SEQ ID NO: 225874 - RNA, 22 nt, Homo sapiens
ucauugcacuccagccugggug

SEQ ID NO: 225875 - RNA, 22 nt, Homo sapiens
ucauugcacucccagacacccu

SEQ ID NO: 225876 - RNA, 22 nt, Homo sapiens
ucauugguagcuugaaggggau

SEQ ID NO: 225877 - RNA, 22 nt, Homo sapiens
ucauugguucuggguguuguug

SEQ ID NO: 225878 - RNA, 21 nt, Homo sapiens
ucauugguuggcugcccugua

SEQ ID NO: 225879 - RNA, 22 nt, Homo sapiens
uccacaauggagaagaguauga

SEQ ID NO: 225880 - RNA, 22 nt, Homo sapiens
uccacaguaaggacccugccuu

SEQ ID NO: 225881 - RNA, 19 nt, Homo sapiens
uccaccgcgugcaccucua

SEQ ID NO: 225882 - RNA, 22 nt, Homo sapiens
uccacugagcuagaccacuugg

SEQ ID NO: 225883 - RNA, 22 nt, Homo sapiens
uccagguacucagggggcugag

SEQ ID NO: 225884 - RNA, 22 nt, Homo sapiens
uccagugcauucagacacuugg

SEQ ID NO: 225885 - RNA, 22 nt, Homo sapiens
uccaguguuauaauaugcgucu

SEQ ID NO: 225886 - RNA, 22 nt, Homo sapiens
uccaguuguuauuuuuauaaag

SEQ ID NO: 225887 - RNA, 22 nt, Homo sapiens
uccaugugaaaaggucgugaua

SEQ ID NO: 225888 - RNA, 22 nt, Homo sapiens
uccauuuguagguagugagaca

SEQ ID NO: 225889 - RNA, 22 nt, Homo sapiens
ucccacugucuucucgugcucg

SEQ ID NO: 225890 - RNA, 22 nt, Homo sapiens
ucccagaaacgcauauguucau

SEQ ID NO: 225891 - RNA, 22 nt, Homo sapiens
ucccaguauucauuuacagaag

SEQ ID NO: 225892 - RNA, 22 nt, Homo sapiens
ucccagugaaaccccaccuuca

SEQ ID NO: 225893 - RNA, 22 nt, Homo sapiens
uccccuuuguaagauggaaacg

SEQ ID NO: 225894 - RNA, 22 nt, Homo sapiens
ucccuacugggguacugccuag

SEQ ID NO: 225895 - RNA, 22 nt, Homo sapiens
ucccugacagucacagagcuac

SEQ ID NO: 225896 - RNA, 19 nt, Homo sapiens
ucccugagucuuagcuuga

SEQ ID NO: 225897 - RNA, 22 nt, Homo sapiens
ucccuguagugccuagaucaga

SEQ ID NO: 225898 - RNA, 22 nt, Homo sapiens
ucccuguguuccuuuugaauug

SEQ ID NO: 225899 - RNA, 18 nt, Homo sapiens
ucccuuuguagaugaccc

SEQ ID NO: 225900 - RNA, 22 nt, Homo sapiens
ucccuuuguccaacggauccac

SEQ ID NO: 225901 - RNA, 22 nt, Homo sapiens
uccucaguggauuggauggugc

SEQ ID NO: 225902 - RNA, 22 nt, Homo sapiens
uccucauggagaaccucugcua

SEQ ID NO: 225903 - RNA, 22 nt, Homo sapiens
uccucugaacuccagacccaua

SEQ ID NO: 225904 - RNA, 22 nt, Homo sapiens
uccugagacugaggagcuuugg

SEQ ID NO: 225905 - RNA, 22 nt, Homo sapiens
uccuucacucuacaucuuuguu

SEQ ID NO: 225906 - RNA, 22 nt, Homo sapiens
uccuucaguccaguggguuuug

SEQ ID NO: 225907 - RNA, 22 nt, Homo sapiens
uccuugagccucccagacucag

SEQ ID NO: 225908 - RNA, 22 nt, Homo sapiens
uccuugagccuuaaauuauaaa

SEQ ID NO: 225909 - RNA, 22 nt, Homo sapiens
uccuugagucugaacuuuggau

SEQ ID NO: 225910 - RNA, 22 nt, Homo sapiens
uccuuugguggagucuuuaggg

SEQ ID NO: 225911 - RNA, 18 nt, Homo sapiens
uccuuuugggguaggaga

SEQ ID NO: 225912 - RNA, 22 nt, Homo sapiens
ucgacacugaccuaguucagca

SEQ ID NO: 225913 - RNA, 23 nt, Homo sapiens
ucgcagcauucaauaccaggcag

SEQ ID NO: 225914 - RNA, 22 nt, Homo sapiens
ucgcauggucuccaggcagcuc

SEQ ID NO: 225915 - RNA, 23 nt, Homo sapiens
ucgguccccuuggcugcccucgg

SEQ ID NO: 225916 - RNA, 19 nt, Homo sapiens
ucuaaaucucuugauagac

SEQ ID NO: 225917 - RNA, 22 nt, Homo sapiens
ucuaaugcucugagaacagugc

SEQ ID NO: 225918 - RNA, 22 nt, Homo sapiens
ucuacagccaguucaggaagaa

SEQ ID NO: 225919 - RNA, 22 nt, Homo sapiens
ucuaucacagccccacacucuc

SEQ ID NO: 225920 - RNA, 22 nt, Homo sapiens
ucuauggaguuugaaugagaaa

SEQ ID NO: 225921 - RNA, 22 nt, Homo sapiens
ucuauggauaaaaugcccucau

SEQ ID NO: 225922 - RNA, 22 nt, Homo sapiens
ucuauguuuuugcuaguagugu

SEQ ID NO: 225923 - RNA, 22 nt, Homo sapiens
ucuauugguaggggcugaggca

SEQ ID NO: 225924 - RNA, 22 nt, Homo sapiens
ucuauugguugaaauugcuuuu

SEQ ID NO: 225925 - RNA, 22 nt, Homo sapiens
ucucacacugaauguguguggg

SEQ ID NO: 225926 - RNA, 22 nt, Homo sapiens
ucucacagaguugaauguuucu

SEQ ID NO: 225927 - RNA, 18 nt, Homo sapiens
ucucacagcaaucuguca

SEQ ID NO: 225928 - RNA, 22 nt, Homo sapiens
ucucagugaauguggaaaaagc

SEQ ID NO: 225929 - RNA, 22 nt, Homo sapiens
ucucagugaauugguuuugucu

SEQ ID NO: 225930 - RNA, 22 nt, Homo sapiens
ucucaguggugcuggcagggga

SEQ ID NO: 225931 - RNA, 22 nt, Homo sapiens
ucucaguguuaucuaucugccu

SEQ ID NO: 225932 - RNA, 21 nt, Homo sapiens
ucucauagaguuucacuuucu

SEQ ID NO: 225933 - RNA, 21 nt, Homo sapiens
ucucauuacugaugagccaga

SEQ ID NO: 225934 - RNA, 23 nt, Homo sapiens
ucucauuccuugaaaauaaugac

SEQ ID NO: 225935 - RNA, 21 nt, Homo sapiens
ucucauugugguuuuaauugg

SEQ ID NO: 225936 - RNA, 22 nt, Homo sapiens
ucucccauccaugaacuucugu

SEQ ID NO: 225937 - RNA, 22 nt, Homo sapiens
ucucuguuuauuuuugguguau

SEQ ID NO: 225938 - RNA, 22 nt, Homo sapiens
ucucuguuugucuguuacuggu

SEQ ID NO: 225939 - RNA, 22 nt, Homo sapiens
uggccaguuuuuaauugggucu

SEQ ID NO: 225940 - RNA, 22 nt, Homo sapiens
uggcccccucccaaaucucaua

SEQ ID NO: 225941 - RNA, 22 nt, Homo sapiens
uggccuguaacccucucauagg

SEQ ID NO: 225942 - RNA, 22 nt, Homo sapiens
uggcuaaguuaaucaaggagau

SEQ ID NO: 225943 - RNA, 22 nt, Homo sapiens
uggcuacugacugaugauuaua

SEQ ID NO: 225944 - RNA, 22 nt, Homo sapiens
uggcuacuguacuugagcuauu

SEQ ID NO: 225945 - RNA, 22 nt, Homo sapiens
uggcuagaccugcauaacagcu

SEQ ID NO: 225946 - RNA, 22 nt, Homo sapiens
uggcuagauauccagaguucug

SEQ ID NO: 225947 - RNA, 22 nt, Homo sapiens
uggcuguuuauuucacgugggu

SEQ ID NO: 225948 - RNA, 22 nt, Homo sapiens
uggcuugauggcacaagguuuc

SEQ ID NO: 225949 - RNA, 22 nt, Homo sapiens
uggcuuuuaucuacucucaacu

SEQ ID NO: 225950 - RNA, 22 nt, Homo sapiens
uggcuuuuccuugaaucugccu

SEQ ID NO: 225951 - RNA, 22 nt, Homo sapiens
ugggaacaugaagguuaaagag

SEQ ID NO: 225952 - RNA, 22 nt, Homo sapiens
ugggaagagggagcgauuuugg

SEQ ID NO: 225953 - RNA, 22 nt, Homo sapiens
ugggaagcugcugaacuacagu

SEQ ID NO: 225954 - RNA, 19 nt, Homo sapiens
ugggaauguaaauuaguuc

SEQ ID NO: 225955 - RNA, 22 nt, Homo sapiens
ugggagcauugcauuagaagcc

SEQ ID NO: 225956 - RNA, 22 nt, Homo sapiens
ugggaucagcugggcucucugu

SEQ ID NO: 225957 - RNA, 22 nt, Homo sapiens
ugggaucagucuggaauauuga

SEQ ID NO: 225958 - RNA, 22 nt, Homo sapiens
ugggaucauucaaugacgaaau

SEQ ID NO: 225959 - RNA, 22 nt, Homo sapiens
ugggaugaugcuugagaauauc

SEQ ID NO: 225960 - RNA, 22 nt, Homo sapiens
ugggcaguauggucauuuucgu

SEQ ID NO: 225961 - RNA, 22 nt, Homo sapiens
ugggcauggaguggccuuaugu

SEQ ID NO: 225962 - RNA, 22 nt, Homo sapiens
ugggcggagacgugcagccgcc

SEQ ID NO: 225963 - RNA, 22 nt, Homo sapiens
ugggguaggcuguauacucugu

SEQ ID NO: 225964 - RNA, 22 nt, Homo sapiens
uggggugugagggagaaagaaa

SEQ ID NO: 225965 - RNA, 22 nt, Homo sapiens
uggguagagaaucaggaucuua

SEQ ID NO: 225966 - RNA, 22 nt, Homo sapiens
uggguagagcacugggggcgag

SEQ ID NO: 225967 - RNA, 23 nt, Homo sapiens
ugguaacauguuguggcagggga

SEQ ID NO: 225968 - RNA, 22 nt, Homo sapiens
ugguaauguaauuuggagaagg

SEQ ID NO: 225969 - RNA, 22 nt, Homo sapiens
ugguaccuuuuaaugacuaauu

SEQ ID NO: 225970 - RNA, 22 nt, Homo sapiens
ugguauguaugauuaacaugga

SEQ ID NO: 225971 - RNA, 22 nt, Homo sapiens
ugguauuuaauauaugagaguu

SEQ ID NO: 225972 - RNA, 22 nt, Homo sapiens
uggucagaugcugaguggaucu

SEQ ID NO: 225973 - RNA, 22 nt, Homo sapiens
uggucaguugaguccuugccaa

SEQ ID NO: 225974 - RNA, 22 nt, Homo sapiens
uggucaguugugccucaauucc

SEQ ID NO: 225975 - RNA, 21 nt, Homo sapiens
uggucaguuuucucacuagga

SEQ ID NO: 225976 - RNA, 22 nt, Homo sapiens
uggucauggggcagcugacacu

SEQ ID NO: 225977 - RNA, 22 nt, Homo sapiens
uggucccaugaacuuuagguca

SEQ ID NO: 225978 - RNA, 22 nt, Homo sapiens
ugguccccaauacuucuauaga

SEQ ID NO: 225979 - RNA, 20 nt, Homo sapiens
ugguccccaccaaaucucau

SEQ ID NO: 225980 - RNA, 22 nt, Homo sapiens
uggucucuuugcuuuagucauc

SEQ ID NO: 225981 - RNA, 22 nt, Homo sapiens
uggugcuugaugaggguggagc

SEQ ID NO: 225982 - RNA, 20 nt, Homo sapiens
uggugguuuuaugugguuua

SEQ ID NO: 225983 - RNA, 20 nt, Homo sapiens
ugguguuugaacagugaaug

SEQ ID NO: 225984 - RNA, 22 nt, Homo sapiens
ugguuaucacuuuccuuccauc

SEQ ID NO: 225985 - RNA, 21 nt, Homo sapiens
ugguucaguucguuacgugug

SEQ ID NO: 225986 - RNA, 22 nt, Homo sapiens
ugguucaguugcacaggcuguu

SEQ ID NO: 225987 - RNA, 22 nt, Homo sapiens
ugguuguuuuaaaugucgucug

SEQ ID NO: 225988 - RNA, 22 nt, Homo sapiens
uguaaacauguauguguuuaug

SEQ ID NO: 225989 - RNA, 22 nt, Homo sapiens
uguaaacuaugagcugauuauu

SEQ ID NO: 225990 - RNA, 16 nt, Homo sapiens
uguaaauguuuugcau

SEQ ID NO: 225991 - RNA, 22 nt, Homo sapiens
uguaacacacacuguuuacucc

SEQ ID NO: 225992 - RNA, 22 nt, Homo sapiens
uguaauguuugguagguuaggu

SEQ ID NO: 225993 - RNA, 22 nt, Homo sapiens
uguacaaaacaagaugggggua

SEQ ID NO: 225994 - RNA, 20 nt, Homo sapiens
uguacacaguguacccacau

SEQ ID NO: 225995 - RNA, 19 nt, Homo sapiens
uguacacuguaaaccugug

SEQ ID NO: 225996 - RNA, 22 nt, Homo sapiens
uguacaugggacaggaggagag

SEQ ID NO: 225997 - RNA, 22 nt, Homo sapiens
uguagauaucuaucaggucaau

SEQ ID NO: 225998 - RNA, 22 nt, Homo sapiens
uguagcacauuugaagagaagc

SEQ ID NO: 225999 - RNA, 22 nt, Homo sapiens
uguagggagagggaguugcacc

SEQ ID NO: 226000 - RNA, 22 nt, Homo sapiens
uguagguagggucuguuuuuga

SEQ ID NO: 226001 - RNA, 22 nt, Homo sapiens
uguaguuugaaagcucccucug

SEQ ID NO: 226002 - RNA, 23 nt, Homo sapiens
uguauacacccugugcaucuggg

SEQ ID NO: 226003 - RNA, 21 nt, Homo sapiens
uguauacauauguuaggugca

SEQ ID NO: 226004 - RNA, 22 nt, Homo sapiens
uguauguaauugaaguuaaguu

SEQ ID NO: 226005 - RNA, 22 nt, Homo sapiens
uguauguugggucaaaguacau

SEQ ID NO: 226006 - RNA, 22 nt, Homo sapiens
ugucaaacauuaugaugcucua

SEQ ID NO: 226007 - RNA, 22 nt, Homo sapiens
ugucaaagagacaucugcacuc

SEQ ID NO: 226008 - RNA, 22 nt, Homo sapiens
ugucaacauuuaucaaguuauu

SEQ ID NO: 226009 - RNA, 22 nt, Homo sapiens
ugucaagaaaucaaggugugag

SEQ ID NO: 226010 - RNA, 22 nt, Homo sapiens
ugucaagaugguuugauguugu

SEQ ID NO: 226011 - RNA, 22 nt, Homo sapiens
ugucaaguugugguucaauuuu

SEQ ID NO: 226012 - RNA, 22 nt, Homo sapiens
ugucacccuuuauccauuuccu

SEQ ID NO: 226013 - RNA, 22 nt, Homo sapiens
ugucaccuugcucauccucgga

SEQ ID NO: 226014 - RNA, 22 nt, Homo sapiens
ugucacugugcagucaugcauu

SEQ ID NO: 226015 - RNA, 22 nt, Homo sapiens
ugucaggaugcuccuuuuggcu

SEQ ID NO: 226016 - RNA, 22 nt, Homo sapiens
ugucaguuucaguguuagccuu

SEQ ID NO: 226017 - RNA, 23 nt, Homo sapiens
ugucaucaagaugaggucacacu

SEQ ID NO: 226018 - RNA, 22 nt, Homo sapiens
ugucaucuagguauuaagcccc

SEQ ID NO: 226019 - RNA, 22 nt, Homo sapiens
ugucaugaacucacauucuggg

SEQ ID NO: 226020 - RNA, 22 nt, Homo sapiens
ugucaugguguuaauuuuccug

SEQ ID NO: 226021 - RNA, 22 nt, Homo sapiens
ugucauguugagaaacuuggau

SEQ ID NO: 226022 - RNA, 22 nt, Homo sapiens
ugucauuguggugcagauauaa

SEQ ID NO: 226023 - RNA, 22 nt, Homo sapiens
ugucccaguuggguauugaauu

SEQ ID NO: 226024 - RNA, 18 nt, Homo sapiens
ugucccuuugcuguucau

SEQ ID NO: 226025 - RNA, 22 nt, Homo sapiens
uguccuagagggaugucacccc

SEQ ID NO: 226026 - RNA, 22 nt, Homo sapiens
ugucuaaagaauggcagacuca

SEQ ID NO: 226027 - RNA, 22 nt, Homo sapiens
ugucucagugauuggcuuucug

SEQ ID NO: 226028 - RNA, 22 nt, Homo sapiens
ugucuuagagauaaagaaugaa

SEQ ID NO: 226029 - RNA, 22 nt, Homo sapiens
ugucuuguagacaauguauagu

SEQ ID NO: 226030 - RNA, 22 nt, Homo sapiens
ugucuuugguucaggcaaggag

SEQ ID NO: 226031 - RNA, 22 nt, Homo sapiens
ugugaaauguuaucccgucgug

SEQ ID NO: 226032 - RNA, 20 nt, Homo sapiens
ugugaacuguagauagucuu

SEQ ID NO: 226033 - RNA, 19 nt, Homo sapiens
ugugaagaaaugcugcaag

SEQ ID NO: 226034 - RNA, 22 nt, Homo sapiens
ugugaaugaagaaugcuaaccu

SEQ ID NO: 226035 - RNA, 22 nt, Homo sapiens
ugugaauggugcugcaaugaac

SEQ ID NO: 226036 - RNA, 22 nt, Homo sapiens
uugaggaggcagucugcccauu

SEQ ID NO: 226037 - RNA, 22 nt, Homo sapiens
uugaggaggcagucuguccguu

SEQ ID NO: 226038 - RNA, 22 nt, Homo sapiens
uugagggagccuguuagucccg

SEQ ID NO: 226039 - RNA, 22 nt, Homo sapiens
uugagggaggcagggcuugucu

SEQ ID NO: 226040 - RNA, 22 nt, Homo sapiens
uugaggucagagguucgagacc

SEQ ID NO: 226041 - RNA, 20 nt, Homo sapiens
uugaggucaggaguuuggga

SEQ ID NO: 226042 - RNA, 20 nt, Homo sapiens
uugaggugugaggggcagag

SEQ ID NO: 226043 - RNA, 22 nt, Homo sapiens
uugagguuggaggccuugccug

SEQ ID NO: 226044 - RNA, 22 nt, Homo sapiens
uugaguaguaagugguucaccg

SEQ ID NO: 226045 - RNA, 22 nt, Homo sapiens
uugaguagugugaugcaugucu

SEQ ID NO: 226046 - RNA, 22 nt, Homo sapiens
uugaguuugaguauucuaaagc

SEQ ID NO: 226047 - RNA, 22 nt, Homo sapiens
uugauaagaaaaauauaccaga

SEQ ID NO: 226048 - RNA, 22 nt, Homo sapiens
uugauaguaccauugggaaauu

SEQ ID NO: 226049 - RNA, 22 nt, Homo sapiens
uugauaguccuguaucuauuuu

SEQ ID NO: 226050 - RNA, 22 nt, Homo sapiens
uugaucacuguacuaugacuau

SEQ ID NO: 226051 - RNA, 22 nt, Homo sapiens
uugaucaucagcuuugucaucu

SEQ ID NO: 226052 - RNA, 22 nt, Homo sapiens
uugauguaggcauucaaggcua

SEQ ID NO: 226053 - RNA, 22 nt, Homo sapiens
uugauguugaggacauaaaccu

SEQ ID NO: 226054 - RNA, 22 nt, Homo sapiens
uugauuagugacuggcuacacg

SEQ ID NO: 226055 - RNA, 22 nt, Homo sapiens
uugcaaagaccucuucacuucc

SEQ ID NO: 226056 - RNA, 18 nt, Homo sapiens
uugcaaauucuucccugu

SEQ ID NO: 226057 - RNA, 22 nt, Homo sapiens
uugcaagauguuaacauuggag

SEQ ID NO: 226058 - RNA, 22 nt, Homo sapiens
uugcacaauggaauuuaucuuu

SEQ ID NO: 226059 - RNA, 22 nt, Homo sapiens
uugcacaguguguacagcacca

SEQ ID NO: 226060 - RNA, 22 nt, Homo sapiens
uugcaccacugcacuccacccu

SEQ ID NO: 226061 - RNA, 22 nt, Homo sapiens
uugcacuccagccugggugaca

SEQ ID NO: 226062 - RNA, 18 nt, Homo sapiens
uugcacuccugccugggu

SEQ ID NO: 226063 - RNA, 22 nt, Homo sapiens
uugcacucuagccugggugaca

SEQ ID NO: 226064 - RNA, 22 nt, Homo sapiens
uugcagagaaauuucugguuua

SEQ ID NO: 226065 - RNA, 20 nt, Homo sapiens
uugcagagcccaacccugga

SEQ ID NO: 226066 - RNA, 22 nt, Homo sapiens
uugcagcaaauaggaaugagga

SEQ ID NO: 226067 - RNA, 22 nt, Homo sapiens
uugcauaaguugaaccagccuu

SEQ ID NO: 226068 - RNA, 22 nt, Homo sapiens
uugcauaauaagagggauacgu

SEQ ID NO: 226069 - RNA, 22 nt, Homo sapiens
uugcauagaggugaguauagua

SEQ ID NO: 226070 - RNA, 18 nt, Homo sapiens
uugcauaguguauccaaa

SEQ ID NO: 226071 - RNA, 22 nt, Homo sapiens
uugcauauguugaaccaagcgu

SEQ ID NO: 226072 - RNA, 22 nt, Homo sapiens
uuuauggagagauauuuauggu

SEQ ID NO: 226073 - RNA, 22 nt, Homo sapiens
uuuauucggcuaggagcuucgg

SEQ ID NO: 226074 - RNA, 23 nt, Homo sapiens
uuucacagaaggauuguagggcc

SEQ ID NO: 226075 - RNA, 23 nt, Homo sapiens
uuucacaguagcuggaucagccu

SEQ ID NO: 226076 - RNA, 22 nt, Homo sapiens
uuucacaguguucucccccaga

SEQ ID NO: 226077 - RNA, 22 nt, Homo sapiens
uuucacguuggggaguugagug

SEQ ID NO: 226078 - RNA, 22 nt, Homo sapiens
uuucacuagccagcccuuuauu

SEQ ID NO: 226079 - RNA, 17 nt, Homo sapiens
uuucagaguggaagugu

SEQ ID NO: 226080 - RNA, 22 nt, Homo sapiens
uuucaggcaagggugacccuga

SEQ ID NO: 226081 - RNA, 18 nt, Homo sapiens
uuucaggguggacaugag

SEQ ID NO: 226082 - RNA, 20 nt, Homo sapiens
uuucaguacuuucuacuggc

SEQ ID NO: 226083 - RNA, 22 nt, Homo sapiens
uuucauaguuugcauagggcau

SEQ ID NO: 226084 - RNA, 22 nt, Homo sapiens
uuucaucaagcacagaguagau

SEQ ID NO: 226085 - RNA, 22 nt, Homo sapiens
uuucauggagaaucuucuuacu

SEQ ID NO: 226086 - RNA, 22 nt, Homo sapiens
uuucauggaggcauuuuagauu

SEQ ID NO: 226087 - RNA, 22 nt, Homo sapiens
uuucauggcaguuuggggccug

SEQ ID NO: 226088 - RNA, 19 nt, Homo sapiens
uuucauguuuuuggugaga

SEQ ID NO: 226089 - RNA, 22 nt, Homo sapiens
uuuccaguuuggaggaugcauu

SEQ ID NO: 226090 - RNA, 22 nt, Homo sapiens
uuucccuuugcuuugucagcca

SEQ ID NO: 226091 - RNA, 22 nt, Homo sapiens
uuuccuguaggaaggaaauaga

SEQ ID NO: 226092 - RNA, 22 nt, Homo sapiens
uuucgugucuggucugugaugg

SEQ ID NO: 226093 - RNA, 22 nt, Homo sapiens
uuucuauguugaccagucuaga

SEQ ID NO: 226094 - RNA, 17 nt, Homo sapiens
uuucucagcccucuucu

SEQ ID NO: 226095 - RNA, 20 nt, Homo sapiens
uuucuccccuauaaaucuca

SEQ ID NO: 226096 - RNA, 22 nt, Homo sapiens
uuucugggggugcugauggaaa

SEQ ID NO: 226097 - RNA, 22 nt, Homo sapiens
uuucugguuaauuucuaagagc

SEQ ID NO: 226098 - RNA, 22 nt, Homo sapiens
uuugaaaguaauuugguuggug

SEQ ID NO: 226099 - RNA, 22 nt, Homo sapiens
uuugaagacuacugggagugaa

SEQ ID NO: 226100 - RNA, 22 nt, Homo sapiens
uuugaaguguggcacugaguuu

SEQ ID NO: 226101 - RNA, 19 nt, Homo sapiens
uuugaauauaaugcagcua

SEQ ID NO: 226102 - RNA, 20 nt, Homo sapiens
uuugaauguaaagcauguca

SEQ ID NO: 226103 - RNA, 22 nt, Homo sapiens
uuugacuagaguguuuuacaac

SEQ ID NO: 226104 - RNA, 18 nt, Homo sapiens
uuugacugguguccuuau

SEQ ID NO: 226105 - RNA, 22 nt, Homo sapiens
uuugacuuuuagaauaugaguu

SEQ ID NO: 226106 - RNA, 22 nt, Homo sapiens
uuugagaaugcuaccagagaag

SEQ ID NO: 226107 - RNA, 22 nt, Homo sapiens
uuugagcaagaggugacauuau

SEQ ID NO: 226108 - RNA, 22 nt, Homo sapiens
uuugagcaugcagauugccagg

SEQ ID NO: 226109 - RNA, 22 nt, Homo sapiens
uuugagcuagagucucacucug

SEQ ID NO: 226110 - RNA, 22 nt, Homo sapiens
uuugagguguauggcaaguuga

SEQ ID NO: 226111 - RNA, 23 nt, Homo sapiens
uuugagugugauaaacacuguca

SEQ ID NO: 226112 - RNA, 22 nt, Homo sapiens
uuugauguccaccucagcccac

SEQ ID NO: 226113 - RNA, 22 nt, Homo sapiens
uuugauguugauacuaccuuca

SEQ ID NO: 226114 - RNA, 22 nt, Homo sapiens
uuugcaauguugugauggugaa

SEQ ID NO: 226115 - RNA, 22 nt, Homo sapiens
uuugcacauauuugggcaaaag

SEQ ID NO: 226116 - RNA, 22 nt, Homo sapiens
uuugcaccuuccuaguggcuga

SEQ ID NO: 226117 - RNA, 22 nt, Homo sapiens
uuugcacucaguaagugggagc

SEQ ID NO: 226118 - RNA, 23 nt, Homo sapiens
uuugcacuugcuccuucuauggc

SEQ ID NO: 226119 - RNA, 22 nt, Homo sapiens
uuugcacuuuuguaauaugguu

SEQ ID NO: 226120 - RNA, 22 nt, Homo sapiens
uuugcagugucagcuucugugu

SEQ ID NO: 226121 - RNA, 22 nt, Homo sapiens
uuugcaguuuauuccuggggcu

SEQ ID NO: 226122 - RNA, 22 nt, Homo sapiens
uuugcaucuuagaaaguucucc

SEQ ID NO: 226123 - RNA, 22 nt, Homo sapiens
uuugcaucuuuugcuuccugga

SEQ ID NO: 226124 - RNA, 22 nt, Homo sapiens
uuugcaugcuccuuaugagaau

SEQ ID NO: 226125 - RNA, 22 nt, Homo sapiens
uuugccaauauuuuacugagga

SEQ ID NO: 226126 - RNA, 22 nt, Homo sapiens
uuugccaaucagaggcaucuug

SEQ ID NO: 226127 - RNA, 22 nt, Homo sapiens
uuugccaaugggaauuuuccua

SEQ ID NO: 226128 - RNA, 23 nt, Homo sapiens
uuugccacuuauuagcugggagg

SEQ ID NO: 226129 - RNA, 18 nt, Homo sapiens
uuugccacuucccagaaa

SEQ ID NO: 226130 - RNA, 22 nt, Homo sapiens
uuugcugagucauuccaugcug

SEQ ID NO: 226131 - RNA, 22 nt, Homo sapiens
uuugcuuaaaucuuaaucagau

SEQ ID NO: 226132 - RNA, 22 nt, Homo sapiens
uucauguaauuccauaagguaa

SEQ ID NO: 226133 - RNA, 22 nt, Homo sapiens
uucaugucuuggcuguuagagu

SEQ ID NO: 226134 - RNA, 22 nt, Homo sapiens
uucauugaaugauuuuuagaag

SEQ ID NO: 226135 - RNA, 22 nt, Homo sapiens
uucauuggauguuacacugugu

SEQ ID NO: 226136 - RNA, 22 nt, Homo sapiens
uuccaagugggaaacaaaaaug

SEQ ID NO: 226137 - RNA, 22 nt, Homo sapiens
uuccaauguuccguguugcagu

SEQ ID NO: 226138 - RNA, 22 nt, Homo sapiens
uuccacaaugguugaacuaauu

SEQ ID NO: 226139 - RNA, 22 nt, Homo sapiens
uuccacaggguugaacuaguuu

SEQ ID NO: 226140 - RNA, 16 nt, Homo sapiens
uuccacagucgaggug

SEQ ID NO: 226141 - RNA, 22 nt, Homo sapiens
uuccacgugaaguauucuaaag

SEQ ID NO: 226142 - RNA, 20 nt, Homo sapiens
uuccagcacauuagggaagc

SEQ ID NO: 226143 - RNA, 22 nt, Homo sapiens
uuccaggugggcgugggccugg

SEQ ID NO: 226144 - RNA, 21 nt, Homo sapiens
uuccagugagccuagaugccu

SEQ ID NO: 226145 - RNA, 22 nt, Homo sapiens
uuccaguugugagcuauccggg

SEQ ID NO: 226146 - RNA, 22 nt, Homo sapiens
uuccauguaguugaacgguuuu

SEQ ID NO: 226147 - RNA, 22 nt, Homo sapiens
uuccauguaguugagcaguuuu

SEQ ID NO: 226148 - RNA, 22 nt, Homo sapiens
uucccaguggaacauguaguca

SEQ ID NO: 226149 - RNA, 22 nt, Homo sapiens
uucccagugguuagcucugguc

SEQ ID NO: 226150 - RNA, 22 nt, Homo sapiens
uucccugaguaucuuaccaugg

SEQ ID NO: 226151 - RNA, 22 nt, Homo sapiens
uucccuuugaaacuaaacuugc

SEQ ID NO: 226152 - RNA, 22 nt, Homo sapiens
uuccucuagacugucgguuucu

SEQ ID NO: 226153 - RNA, 22 nt, Homo sapiens
uuccugaggccuccccagaagc

SEQ ID NO: 226154 - RNA, 22 nt, Homo sapiens
uuccugcacuugcuugccuaug

SEQ ID NO: 226155 - RNA, 22 nt, Homo sapiens
uuccugugacuguguggcaccc

SEQ ID NO: 226156 - RNA, 22 nt, Homo sapiens
uuccuucaugcuugaaggguau

SEQ ID NO: 226157 - RNA, 22 nt, Homo sapiens
uuccuugagaaaggcacaaguu

SEQ ID NO: 226158 - RNA, 22 nt, Homo sapiens
uuccuugagucuuuuuccugag

SEQ ID NO: 226159 - RNA, 20 nt, Homo sapiens
uucuacagucacaggaagau

SEQ ID NO: 226160 - RNA, 22 nt, Homo sapiens
uucuacagugacugcagccaua

SEQ ID NO: 226161 - RNA, 22 nt, Homo sapiens
uucuagcaauggcagagugucu

SEQ ID NO: 226162 - RNA, 20 nt, Homo sapiens
uucuaguacuucuguuucca

SEQ ID NO: 226163 - RNA, 23 nt, Homo sapiens
uucuaucaggcccaggagcccug

SEQ ID NO: 226164 - RNA, 20 nt, Homo sapiens
uucuauggugaugaguccug

SEQ ID NO: 226165 - RNA, 22 nt, Homo sapiens
uucucaauggcaacuuguugcu

SEQ ID NO: 226166 - RNA, 22 nt, Homo sapiens
gucucacagcuagcugcuuuau

SEQ ID NO: 226167 - RNA, 22 nt, Homo sapiens
gucucugguugcuuuuguacca

SEQ ID NO: 226168 - RNA, 22 nt, Homo sapiens
gucucuugguuuagagcauuua

SEQ ID NO: 226169 - RNA, 22 nt, Homo sapiens
gucugagcauggggccggcagg

SEQ ID NO: 226170 - RNA, 22 nt, Homo sapiens
gucugcaugucauaugauagua

SEQ ID NO: 226171 - RNA, 22 nt, Homo sapiens
gucuggcuccugucuaaucacu

SEQ ID NO: 226172 - RNA, 21 nt, Homo sapiens
gucugguguuuuaaugaggac

SEQ ID NO: 226173 - RNA, 22 nt, Homo sapiens
gucuuggcaugugcagcuggga

SEQ ID NO: 226174 - RNA, 22 nt, Homo sapiens
gucuuugagauaggguuauuuu

SEQ ID NO: 226175 - RNA, 22 nt, Homo sapiens
gucuuugcuuuuaaccagaggu

SEQ ID NO: 226176 - RNA, 22 nt, Homo sapiens
gucuuuguuuggucuguaucag

SEQ ID NO: 226177 - RNA, 22 nt, Homo sapiens
aaaacgcauccucacaggucug

SEQ ID NO: 226178 - RNA, 22 nt, Homo sapiens
aaaagucuguagugaaagguga

SEQ ID NO: 226179 - RNA, 22 nt, Homo sapiens
aaaaugcugauauugggcccca

SEQ ID NO: 226180 - RNA, 22 nt, Homo sapiens
aaacgugcagagaucaauagca

SEQ ID NO: 226181 - RNA, 22 nt, Homo sapiens
aaacugaucugaaggccaggcu

SEQ ID NO: 226182 - RNA, 22 nt, Homo sapiens
aaacugccuuccuuguaggugc

SEQ ID NO: 226183 - RNA, 18 nt, Homo sapiens
aaacugcuuccuuggccu

SEQ ID NO: 226184 - RNA, 22 nt, Homo sapiens
aaacugucuucugacaguuucc

SEQ ID NO: 226185 - RNA, 22 nt, Homo sapiens
aaagaguucagguagauuucaa

SEQ ID NO: 226186 - RNA, 22 nt, Homo sapiens
aaagcuaccagauucuguugga

SEQ ID NO: 226187 - RNA, 22 nt, Homo sapiens
aaaggaccacauauaugguggc

SEQ ID NO: 226188 - RNA, 22 nt, Homo sapiens
aaaggcacacacuccuuguuau

SEQ ID NO: 226189 - RNA, 22 nt, Homo sapiens
aaagggcacugugcuuuggcaa

SEQ ID NO: 226190 - RNA, 22 nt, Homo sapiens
aaagucacuggagaaggaauau

SEQ ID NO: 226191 - RNA, 17 nt, Homo sapiens
aaaguccuuugcuaucu

SEQ ID NO: 226192 - RNA, 18 nt, Homo sapiens
aaagugaugucauucuuu

SEQ ID NO: 226193 - RNA, 22 nt, Homo sapiens
aaagugauguccaggcuuucag

SEQ ID NO: 226194 - RNA, 22 nt, Homo sapiens
aaagugauuguaguuuuugcca

SEQ ID NO: 226195 - RNA, 22 nt, Homo sapiens
aaagugcugggaucacacugaa

SEQ ID NO: 226196 - RNA, 22 nt, Homo sapiens
aaagugcugggauuuuaggcau

SEQ ID NO: 226197 - RNA, 22 nt, Homo sapiens
aaaguggugugaguauguaucu

SEQ ID NO: 226198 - RNA, 22 nt, Homo sapiens
aaaguguuucugcaguagguuu

SEQ ID NO: 226199 - RNA, 22 nt, Homo sapiens
aaaugacuuuuuaugcagagua

SEQ ID NO: 226200 - RNA, 22 nt, Homo sapiens
aaaugcacaaagauuuugcacu

SEQ ID NO: 226201 - RNA, 22 nt, Homo sapiens
aaaugcacagaaaggaugugga

SEQ ID NO: 226202 - RNA, 22 nt, Homo sapiens
aaaugcaugaauaagcucgugu

SEQ ID NO: 226203 - RNA, 22 nt, Homo sapiens
aaaugccucccauucuacugac

SEQ ID NO: 226204 - RNA, 23 nt, Homo sapiens
aaaugcucucaggugccaguaga

SEQ ID NO: 226205 - RNA, 22 nt, Homo sapiens
aaaugcucucuacacguuucug

SEQ ID NO: 226206 - RNA, 20 nt, Homo sapiens
aaaugcuguaauguuuggga

SEQ ID NO: 226207 - RNA, 22 nt, Homo sapiens
aaaugcuucuauguggcauguu

SEQ ID NO: 226208 - RNA, 22 nt, Homo sapiens
aaauggauuaaguucacuugcu

SEQ ID NO: 226209 - RNA, 22 nt, Homo sapiens
aaauggcuuugaggguaggaca

SEQ ID NO: 226210 - RNA, 22 nt, Homo sapiens
aaauggcuuuuugggcaaggug

SEQ ID NO: 226211 - RNA, 19 nt, Homo sapiens
aaaugugcacuguuuucca

SEQ ID NO: 226212 - RNA, 18 nt, Homo sapiens
aaauucugucccuucuuc

SEQ ID NO: 226213 - RNA, 22 nt, Homo sapiens
aacaccauucucuguaacaaga

SEQ ID NO: 226214 - RNA, 22 nt, Homo sapiens
aacaccuugcagggauuaugac

SEQ ID NO: 226215 - RNA, 22 nt, Homo sapiens
aacacuaucugccuuacaggga

SEQ ID NO: 226216 - RNA, 22 nt, Homo sapiens
aacacuguuuccagucaugauc

SEQ ID NO: 226217 - RNA, 22 nt, Homo sapiens
aacagaauccucuuuuccuggg

SEQ ID NO: 226218 - RNA, 22 nt, Homo sapiens
aacagcauaguacccgugauaa

SEQ ID NO: 226219 - RNA, 22 nt, Homo sapiens
aacagugcauucagggauauau

SEQ ID NO: 226220 - RNA, 21 nt, Homo sapiens
aacagugcugaacagacaccu

SEQ ID NO: 226221 - RNA, 22 nt, Homo sapiens
aacagugcuguuauaaauguac

SEQ ID NO: 226222 - RNA, 22 nt, Homo sapiens
aacuacaucucuuugaggcagg

SEQ ID NO: 226223 - RNA, 22 nt, Homo sapiens
aacucacauucuuucuugguac

SEQ ID NO: 226224 - RNA, 22 nt, Homo sapiens
aacugcacauauuuguaugggu

SEQ ID NO: 226225 - RNA, 22 nt, Homo sapiens
aacugcauuuucugauugugug

SEQ ID NO: 226226 - RNA, 22 nt, Homo sapiens
acugcacucuagcauggguaau

SEQ ID NO: 226227 - RNA, 22 nt, Homo sapiens
acugcacucuagccccugcgac

SEQ ID NO: 226228 - RNA, 22 nt, Homo sapiens
acugcacucuagcuugggugac

SEQ ID NO: 226229 - RNA, 22 nt, Homo sapiens
acugcacugcagccuggccaac

SEQ ID NO: 226230 - RNA, 22 nt, Homo sapiens
acugcacuguccuagaguccuc

SEQ ID NO: 226231 - RNA, 22 nt, Homo sapiens
acugcacuucagccuuggcuac

SEQ ID NO: 226232 - RNA, 22 nt, Homo sapiens
acugcacuucagccuugggaaa

SEQ ID NO: 226233 - RNA, 22 nt, Homo sapiens
acugcacuucagccuugugaca

SEQ ID NO: 226234 - RNA, 22 nt, Homo sapiens
acugcauaaauauguguaauau

SEQ ID NO: 226235 - RNA, 22 nt, Homo sapiens
acugcauuugguaaagucaaga

SEQ ID NO: 226236 - RNA, 22 nt, Homo sapiens
acugcauuugucccuuuugaac

SEQ ID NO: 226237 - RNA, 18 nt, Homo sapiens
acuggauguaaagggucc

SEQ ID NO: 226238 - RNA, 20 nt, Homo sapiens
acuggcacugguaggugugg

SEQ ID NO: 226239 - RNA, 22 nt, Homo sapiens
acuggcucugcuuuacaaacag

SEQ ID NO: 226240 - RNA, 22 nt, Homo sapiens
acugguuguuuaacugaauuga

SEQ ID NO: 226241 - RNA, 22 nt, Homo sapiens
acuguacuccagccugggcaac

SEQ ID NO: 226242 - RNA, 22 nt, Homo sapiens
acuguacuccagccugggugac

SEQ ID NO: 226243 - RNA, 22 nt, Homo sapiens
acuucauucucuggaucagaau

SEQ ID NO: 226244 - RNA, 22 nt, Homo sapiens
acuugacacuuauauuacucac

SEQ ID NO: 226245 - RNA, 22 nt, Homo sapiens
acuuggcaaaguuuuaaacagc

SEQ ID NO: 226246 - RNA, 19 nt, Homo sapiens
acuuuggugauuagaggga

SEQ ID NO: 226247 - RNA, 22 nt, Homo sapiens
acuuugguuaucauacuuucag

SEQ ID NO: 226248 - RNA, 22 nt, Homo sapiens
acuuugguuuauagaauuuagg

SEQ ID NO: 226249 - RNA, 20 nt, Homo sapiens
acuuuuugaugaggucguuu

SEQ ID NO: 226250 - RNA, 22 nt, Homo sapiens
acuuuuugauggggagaacauu

SEQ ID NO: 226251 - RNA, 22 nt, Homo sapiens
agaaccaaucccacauggauac

SEQ ID NO: 226252 - RNA, 22 nt, Homo sapiens
agaacuguccauucagcaugaa

SEQ ID NO: 226253 - RNA, 19 nt, Homo sapiens
agaagugcauggucuagag

SEQ ID NO: 226254 - RNA, 22 nt, Homo sapiens
agaagugcuggguucaggcugg

SEQ ID NO: 226255 - RNA, 22 nt, Homo sapiens
agaauguauauucuguaguugu

SEQ ID NO: 226256 - RNA, 22 nt, Homo sapiens
agaaugucagcuggauucagcu

SEQ ID NO: 226257 - RNA, 22 nt, Homo sapiens
agaaugugaccuuauuuggaga

SEQ ID NO: 226258 - RNA, 22 nt, Homo sapiens
agacagcuggaguaucauagcu

SEQ ID NO: 226259 - RNA, 22 nt, Homo sapiens
agacaucauuugauggugggag

SEQ ID NO: 226260 - RNA, 20 nt, Homo sapiens
agacuagggagcagaaagcc

SEQ ID NO: 226261 - RNA, 22 nt, Homo sapiens
agacuguaaugcauaauuuacu

SEQ ID NO: 226262 - RNA, 21 nt, Homo sapiens
agagaacugaaacaugugacu

SEQ ID NO: 226263 - RNA, 22 nt, Homo sapiens
agagaacugauucagggaaaau

SEQ ID NO: 226264 - RNA, 22 nt, Homo sapiens
agagaacugauuggaguugggc

SEQ ID NO: 226265 - RNA, 22 nt, Homo sapiens
agagaacuguuuacacguuaau

SEQ ID NO: 226266 - RNA, 22 nt, Homo sapiens
agagaccuguaaaguucaggca

SEQ ID NO: 226267 - RNA, 22 nt, Homo sapiens
agagagcuuuugguugcccuaa

SEQ ID NO: 226268 - RNA, 22 nt, Homo sapiens
agagagguggguggagccccca

SEQ ID NO: 226269 - RNA, 22 nt, Homo sapiens
agagauaguuuccaacucauac

SEQ ID NO: 226270 - RNA, 22 nt, Homo sapiens
agagaucaacugaauuacugga

SEQ ID NO: 226271 - RNA, 20 nt, Homo sapiens
agagaucaguaauucaucaa

SEQ ID NO: 226272 - RNA, 22 nt, Homo sapiens
agagaugaagauggggcucccg

SEQ ID NO: 226273 - RNA, 22 nt, Homo sapiens
agagaugauuaacauuuuggua

SEQ ID NO: 226274 - RNA, 22 nt, Homo sapiens
agagccacacucuccuaacuca

SEQ ID NO: 226275 - RNA, 22 nt, Homo sapiens
agagccacauuaaauaugggaa

SEQ ID NO: 226276 - RNA, 22 nt, Homo sapiens
agagcuguguuuuaacuuuuua

SEQ ID NO: 226277 - RNA, 22 nt, Homo sapiens
agagguaagaauaguaguugga

SEQ ID NO: 226278 - RNA, 22 nt, Homo sapiens
agagguauuggaaggaguguca

SEQ ID NO: 226279 - RNA, 22 nt, Homo sapiens
agaggucuuaucaaacaugcuu

SEQ ID NO: 226280 - RNA, 23 nt, Homo sapiens
agagguuuaaucaggcaguugcu

SEQ ID NO: 226281 - RNA, 22 nt, Homo sapiens
agaguaguaggaugaauggacu

SEQ ID NO: 226282 - RNA, 19 nt, Homo sapiens
agaguauuguuacuucucu

SEQ ID NO: 226283 - RNA, 23 nt, Homo sapiens
agagugcaauggugccaucucgg

SEQ ID NO: 226284 - RNA, 22 nt, Homo sapiens
agagugcuaaggaaguaauuua

SEQ ID NO: 226285 - RNA, 22 nt, Homo sapiens
agagugcuauagauuagauuuc

SEQ ID NO: 226286 - RNA, 20 nt, Homo sapiens
agagugcugucuguccugag

SEQ ID NO: 226287 - RNA, 22 nt, Homo sapiens
agagugcuuuauuagauguagc

SEQ ID NO: 226288 - RNA, 22 nt, Homo sapiens
agauacaucuaugugucugugu

SEQ ID NO: 226289 - RNA, 22 nt, Homo sapiens
agauauuuguuaggucugucag

SEQ ID NO: 226290 - RNA, 22 nt, Homo sapiens
agaucacaguaccguaaggcug

SEQ ID NO: 226291 - RNA, 22 nt, Homo sapiens
agaucacagucuuugguuuuag

SEQ ID NO: 226292 - RNA, 22 nt, Homo sapiens
agaugauguuucuggcacauga

SEQ ID NO: 226293 - RNA, 20 nt, Homo sapiens
agaugcaugcacauaaacac

SEQ ID NO: 226294 - RNA, 23 nt, Homo sapiens
agaugcauucuuguaggauauau

SEQ ID NO: 226295 - RNA, 22 nt, Homo sapiens
agaugccucauguucuagguuc

SEQ ID NO: 226296 - RNA, 22 nt, Homo sapiens
agaugcuguuaucaacuguagc

SEQ ID NO: 226297 - RNA, 22 nt, Homo sapiens
agauggguuuucacauguuggc

SEQ ID NO: 226298 - RNA, 22 nt, Homo sapiens
agaugguuuuguucacagcucu

SEQ ID NO: 226299 - RNA, 23 nt, Homo sapiens
agcaaaugcucuagcacuccaac

SEQ ID NO: 226300 - RNA, 22 nt, Homo sapiens
agcaacauagaaauuugggugg

SEQ ID NO: 226301 - RNA, 22 nt, Homo sapiens
agcaacauuguucauaauagcu

SEQ ID NO: 226302 - RNA, 22 nt, Homo sapiens
agcaagaugaaguugagcuagg

SEQ ID NO: 226303 - RNA, 22 nt, Homo sapiens
agcaagauugauggccugcagg

SEQ ID NO: 226304 - RNA, 22 nt, Homo sapiens
agcaagauuguucccauuuucu

SEQ ID NO: 226305 - RNA, 22 nt, Homo sapiens
agcaauaugacauugcuacauc

SEQ ID NO: 226306 - RNA, 22 nt, Homo sapiens
agcacagccuuguguuuucuug

SEQ ID NO: 226307 - RNA, 22 nt, Homo sapiens
agcacagugguuaaguuucuua

SEQ ID NO: 226308 - RNA, 23 nt, Homo sapiens
agcaccaccccaggucacaagug

SEQ ID NO: 226309 - RNA, 22 nt, Homo sapiens
agcaccaccguugcucuauccc

SEQ ID NO: 226310 - RNA, 22 nt, Homo sapiens
agcaccaugggcugaguaagug

SEQ ID NO: 226311 - RNA, 22 nt, Homo sapiens
agcaccauuagcguugggccgg

SEQ ID NO: 226312 - RNA, 22 nt, Homo sapiens
agcaccauuguacuccagccug

SEQ ID NO: 226313 - RNA, 22 nt, Homo sapiens
agcaccauuucucuaaagcacu

SEQ ID NO: 226314 - RNA, 22 nt, Homo sapiens
agcagauguuuagugagcgccu

SEQ ID NO: 226315 - RNA, 22 nt, Homo sapiens
agcagcaauuuuguaugguuua

SEQ ID NO: 226316 - RNA, 22 nt, Homo sapiens
agcagcaugcaaauggacuaau

SEQ ID NO: 226317 - RNA, 22 nt, Homo sapiens
agcagcauuaguggaaucuugu

SEQ ID NO: 226318 - RNA, 22 nt, Homo sapiens
agcagcauuaugauauaucuua

SEQ ID NO: 226319 - RNA, 20 nt, Homo sapiens
agcagccacagauuccucag

SEQ ID NO: 226320 - RNA, 22 nt, Homo sapiens
agcaggauuguuacaauaguaa

SEQ ID NO: 226321 - RNA, 22 nt, Homo sapiens
agcagguauucgggucaugggg

SEQ ID NO: 226322 - RNA, 22 nt, Homo sapiens
agcagguguccacaauguuugc

SEQ ID NO: 226323 - RNA, 22 nt, Homo sapiens
agcaucacacacuacagggaaa

SEQ ID NO: 226324 - RNA, 22 nt, Homo sapiens
aucacagaguuaaaacuuucuu

SEQ ID NO: 226325 - RNA, 22 nt, Homo sapiens
aucacaggcaaaauuccuucuc

SEQ ID NO: 226326 - RNA, 22 nt, Homo sapiens
aucacauggccagguaguaauc

SEQ ID NO: 226327 - RNA, 19 nt, Homo sapiens
aucaccagucuuuccacug

SEQ ID NO: 226328 - RNA, 22 nt, Homo sapiens
aucaccugagcaguauacacug

SEQ ID NO: 226329 - RNA, 22 nt, Homo sapiens
aucaccuggaguagcccguccc

SEQ ID NO: 226330 - RNA, 22 nt, Homo sapiens
aucacuaugcaggugucucggg

SEQ ID NO: 226331 - RNA, 22 nt, Homo sapiens
aucacugggagcagccauuaau

SEQ ID NO: 226332 - RNA, 22 nt, Homo sapiens
aucacugggcaagauaucauga

SEQ ID NO: 226333 - RNA, 22 nt, Homo sapiens
aucacuguuuugaugcucggac

SEQ ID NO: 226334 - RNA, 22 nt, Homo sapiens
aucacuuucuauuucugugcca

SEQ ID NO: 226335 - RNA, 22 nt, Homo sapiens
aucagaguugucagggagcuuu

SEQ ID NO: 226336 - RNA, 22 nt, Homo sapiens
aucagauuccagaggcagcacc

SEQ ID NO: 226337 - RNA, 22 nt, Homo sapiens
aucagcagcaugaaaacaggcu

SEQ ID NO: 226338 - RNA, 22 nt, Homo sapiens
aucagcagcaugaaaacggacu

SEQ ID NO: 226339 - RNA, 22 nt, Homo sapiens
aucauauccuagauauaacuuc

SEQ ID NO: 226340 - RNA, 22 nt, Homo sapiens
aucauccugucaggagcuguga

SEQ ID NO: 226341 - RNA, 22 nt, Homo sapiens
aucauguuuauguguaggauau

SEQ ID NO: 226342 - RNA, 22 nt, Homo sapiens
aucauugcacaucacagccuca

SEQ ID NO: 226343 - RNA, 23 nt, Homo sapiens
auccacauucuaguccuuuaugc

SEQ ID NO: 226344 - RNA, 22 nt, Homo sapiens
auccagaugggcuuaauguaau

SEQ ID NO: 226345 - RNA, 22 nt, Homo sapiens
auccauugucuaaugcuaagau

SEQ ID NO: 226346 - RNA, 22 nt, Homo sapiens
aucccaguaaaaauggcuucua

SEQ ID NO: 226347 - RNA, 22 nt, Homo sapiens
auccccugcacggggugucauu

SEQ ID NO: 226348 - RNA, 22 nt, Homo sapiens
aucccuguaacuagcagccccu

SEQ ID NO: 226349 - RNA, 22 nt, Homo sapiens
aucccuguaguaauauucuagc

SEQ ID NO: 226350 - RNA, 22 nt, Homo sapiens
aucccuuccuagcacuuggugu

SEQ ID NO: 226351 - RNA, 22 nt, Homo sapiens
auccucugagagaguuucauaa

SEQ ID NO: 226352 - RNA, 21 nt, Homo sapiens
auccuucuuuuucaaccugug

SEQ ID NO: 226353 - RNA, 22 nt, Homo sapiens
aucgcaccauugcacuccagca

SEQ ID NO: 226354 - RNA, 22 nt, Homo sapiens
aucuacuugcugggucucugga

SEQ ID NO: 226355 - RNA, 22 nt, Homo sapiens
aucucagagaaaauuacuaaga

SEQ ID NO: 226356 - RNA, 22 nt, Homo sapiens
aucucagcaacuaaagauccuu

SEQ ID NO: 226357 - RNA, 22 nt, Homo sapiens
aucugcaaauaaugaagauugg

SEQ ID NO: 226358 - RNA, 19 nt, Homo sapiens
aucuggaguuccuggggcu

SEQ ID NO: 226359 - RNA, 22 nt, Homo sapiens
aucugguguauuggugcugggu

SEQ ID NO: 226360 - RNA, 22 nt, Homo sapiens
aucugguguccucgugggaguc

SEQ ID NO: 226361 - RNA, 22 nt, Homo sapiens
aucugguguuuccuucacauug

SEQ ID NO: 226362 - RNA, 22 nt, Homo sapiens
aucuguagauucagcacaagcu

SEQ ID NO: 226363 - RNA, 22 nt, Homo sapiens
aucuguguuuaaggucccagaa

SEQ ID NO: 226364 - RNA, 22 nt, Homo sapiens
aucuuggauuaccugggugggu

SEQ ID NO: 226365 - RNA, 22 nt, Homo sapiens
aucuuguccugagguuuuauug

SEQ ID NO: 226366 - RNA, 22 nt, Homo sapiens
aucuuugauugaagggacccug

SEQ ID NO: 226367 - RNA, 22 nt, Homo sapiens
aucuuugauuguagguacaaug

SEQ ID NO: 226368 - RNA, 22 nt, Homo sapiens
aucuuuggcgggaauaucacag

SEQ ID NO: 226369 - RNA, 22 nt, Homo sapiens
aucuuuggucaucacagcuaga

SEQ ID NO: 226370 - RNA, 22 nt, Homo sapiens
aucuuuggugaguucuuugguc

SEQ ID NO: 226371 - RNA, 22 nt, Homo sapiens
aucuuuggugcaugauacuuug

SEQ ID NO: 226372 - RNA, 22 nt, Homo sapiens
augaaacuggcuaauuuuugua

SEQ ID NO: 226373 - RNA, 22 nt, Homo sapiens
augaaagguugucuuaagccau

SEQ ID NO: 226374 - RNA, 22 nt, Homo sapiens
augaaaguguguggaaacuuga

SEQ ID NO: 226375 - RNA, 22 nt, Homo sapiens
augaaaucacugugaugcccua

SEQ ID NO: 226376 - RNA, 22 nt, Homo sapiens
augaaaugcauguuaaguccgu

SEQ ID NO: 226377 - RNA, 18 nt, Homo sapiens
augaacucaucaguucuu

SEQ ID NO: 226378 - RNA, 23 nt, Homo sapiens
augaacucaucauuuuuuauggc

SEQ ID NO: 226379 - RNA, 22 nt, Homo sapiens
augaagacaucgucugggauua

SEQ ID NO: 226380 - RNA, 22 nt, Homo sapiens
augaagauguugccuuuuuaau

SEQ ID NO: 226381 - RNA, 22 nt, Homo sapiens
augaagcuagcugauugcugau

SEQ ID NO: 226382 - RNA, 22 nt, Homo sapiens
augaaguauuaggacacauuua

SEQ ID NO: 226383 - RNA, 22 nt, Homo sapiens
augaagugcaugauaguugguu

SEQ ID NO: 226384 - RNA, 22 nt, Homo sapiens
augaaguuagcucauuucuuuu

SEQ ID NO: 226385 - RNA, 22 nt, Homo sapiens
augaauagaguuaauugaguac

SEQ ID NO: 226386 - RNA, 22 nt, Homo sapiens
augaauccauuccugccacaga

SEQ ID NO: 226387 - RNA, 22 nt, Homo sapiens
augaaugcaucuaucaaagcau

SEQ ID NO: 226388 - RNA, 23 nt, Homo sapiens
augaauguaaagaaugugggaag

SEQ ID NO: 226389 - RNA, 22 nt, Homo sapiens
augaaugucuuauuuugagaaa

SEQ ID NO: 226390 - RNA, 22 nt, Homo sapiens
augaauuuucugauguugggua

SEQ ID NO: 226391 - RNA, 22 nt, Homo sapiens
augacagagauaugugaauuuu

SEQ ID NO: 226392 - RNA, 22 nt, Homo sapiens
augacagcaucugugaaguugu

SEQ ID NO: 226393 - RNA, 22 nt, Homo sapiens
augacaguaugacuccaaaagu

SEQ ID NO: 226394 - RNA, 22 nt, Homo sapiens
augacaguguggauuauuguaa

SEQ ID NO: 226395 - RNA, 22 nt, Homo sapiens
augacccugaccuaagccaauc

SEQ ID NO: 226396 - RNA, 21 nt, Homo sapiens
augacccuggguguccuuucc

SEQ ID NO: 226397 - RNA, 20 nt, Homo sapiens
augaccuauggugguauaag

SEQ ID NO: 226398 - RNA, 18 nt, Homo sapiens
augaccugcggguuauau

SEQ ID NO: 226399 - RNA, 22 nt, Homo sapiens
augaccuuggggaaccaugucu

SEQ ID NO: 226400 - RNA, 22 nt, Homo sapiens
augacuaaaggguuuauguuga

SEQ ID NO: 226401 - RNA, 20 nt, Homo sapiens
augacuagaggacaugguaa

SEQ ID NO: 226402 - RNA, 22 nt, Homo sapiens
augacucagaucuguuccuggu

SEQ ID NO: 226403 - RNA, 22 nt, Homo sapiens
augacugagacuaacuuacuuu

SEQ ID NO: 226404 - RNA, 22 nt, Homo sapiens
augacugaguagcauuccauua

SEQ ID NO: 226405 - RNA, 22 nt, Homo sapiens
augagacuagaagagaauaaua

SEQ ID NO: 226406 - RNA, 22 nt, Homo sapiens
augagagcugacuuuaaggcaa

SEQ ID NO: 226407 - RNA, 22 nt, Homo sapiens
augagauauuuuauaagaucau

SEQ ID NO: 226408 - RNA, 22 nt, Homo sapiens
augagaucugugaacaccuguc

SEQ ID NO: 226409 - RNA, 22 nt, Homo sapiens
augagaugcaagauuagauggg

SEQ ID NO: 226410 - RNA, 21 nt, Homo sapiens
augagauguuagacuuuagac

SEQ ID NO: 226411 - RNA, 22 nt, Homo sapiens
augagauuguuuguacuccaca

SEQ ID NO: 226412 - RNA, 22 nt, Homo sapiens
augagauuguuugugugaaaua

SEQ ID NO: 226413 - RNA, 22 nt, Homo sapiens
augagcagaagagauacacugu

SEQ ID NO: 226414 - RNA, 22 nt, Homo sapiens
augagcuaggacagaaugucag

SEQ ID NO: 226415 - RNA, 17 nt, Homo sapiens
augagcucaucauuuuu

SEQ ID NO: 226416 - RNA, 22 nt, Homo sapiens
augaggaaggagccuuugucug

SEQ ID NO: 226417 - RNA, 22 nt, Homo sapiens
augaggcacugcgcccuacuga

SEQ ID NO: 226418 - RNA, 22 nt, Homo sapiens
augaggcuauaauuuuuaugua

SEQ ID NO: 226419 - RNA, 22 nt, Homo sapiens
augagucacuuauuauuggggu

SEQ ID NO: 226420 - RNA, 22 nt, Homo sapiens
augauaaguuauuagaagaaga

SEQ ID NO: 226421 - RNA, 22 nt, Homo sapiens
augauaugagaaaggaucaaca

SEQ ID NO: 226422 - RNA, 22 nt, Homo sapiens
cauugcauuccagucugggcaa

SEQ ID NO: 226423 - RNA, 22 nt, Homo sapiens
cauugcuuuuggugguuuagac

SEQ ID NO: 226424 - RNA, 22 nt, Homo sapiens
cauugggugagaacaugcuccu

SEQ ID NO: 226425 - RNA, 22 nt, Homo sapiens
cauugguuaguuaacuuuaaga

SEQ ID NO: 226426 - RNA, 22 nt, Homo sapiens
cauugucccucaaugacuauga

SEQ ID NO: 226427 - RNA, 22 nt, Homo sapiens
cauuuugguuaaauagguagcu

SEQ ID NO: 226428 - RNA, 22 nt, Homo sapiens
ccaaaguauuuucacugauauc

SEQ ID NO: 226429 - RNA, 22 nt, Homo sapiens
ccaaauccauccaaaucauaga

SEQ ID NO: 226430 - RNA, 22 nt, Homo sapiens
ccaaggaauacccucccuuuuu

SEQ ID NO: 226431 - RNA, 22 nt, Homo sapiens
ccaaguguucucauuguucaau

SEQ ID NO: 226432 - RNA, 19 nt, Homo sapiens
ccacaaugguugaacuaga

SEQ ID NO: 226433 - RNA, 23 nt, Homo sapiens
ccacaaugguugaacuagauuac

SEQ ID NO: 226434 - RNA, 22 nt, Homo sapiens
ccacaguugaaauuuugacugu

SEQ ID NO: 226435 - RNA, 22 nt, Homo sapiens
ccacauuggaaaggaucccccc

SEQ ID NO: 226436 - RNA, 22 nt, Homo sapiens
ccacccuggagaauuugagguc

SEQ ID NO: 226437 - RNA, 22 nt, Homo sapiens
ccaccuguacuuaagucacuuu

SEQ ID NO: 226438 - RNA, 22 nt, Homo sapiens
ccacuguuuaaauggcugagga

SEQ ID NO: 226439 - RNA, 22 nt, Homo sapiens
ccaggguuccacgccuggcugu

SEQ ID NO: 226440 - RNA, 22 nt, Homo sapiens
ccaguauugaacacaaugaaag

SEQ ID NO: 226441 - RNA, 18 nt, Homo sapiens
ccagugcaaggaaagccc

SEQ ID NO: 226442 - RNA, 21 nt, Homo sapiens
ccagugguuggaaacuauggg

SEQ ID NO: 226443 - RNA, 22 nt, Homo sapiens
ccaguguuuggauuagggaugc

SEQ ID NO: 226444 - RNA, 22 nt, Homo sapiens
ccaguguuuuugaauuccagga

SEQ ID NO: 226445 - RNA, 22 nt, Homo sapiens
ccaguuuucccagcaccauuaa

SEQ ID NO: 226446 - RNA, 22 nt, Homo sapiens
ccaguuuucucacuguugcagu

SEQ ID NO: 226447 - RNA, 22 nt, Homo sapiens
ccaguuuuucauuuauacuagu

SEQ ID NO: 226448 - RNA, 22 nt, Homo sapiens
ccaugaacuagaauagaacaug

SEQ ID NO: 226449 - RNA, 22 nt, Homo sapiens
ccauugaacaugaaggaaugug

SEQ ID NO: 226450 - RNA, 22 nt, Homo sapiens
ccauugcacuucagccuaggug

SEQ ID NO: 226451 - RNA, 22 nt, Homo sapiens
ccauuugguuauguaucgaaac

SEQ ID NO: 226452 - RNA, 22 nt, Homo sapiens
cccagagacagaaugauaaacu

SEQ ID NO: 226453 - RNA, 22 nt, Homo sapiens
cccaguuuugcuucucaugagg

SEQ ID NO: 226454 - RNA, 22 nt, Homo sapiens
ccccagugguugcaacagcaga

SEQ ID NO: 226455 - RNA, 22 nt, Homo sapiens
ccccaguguguaaaggccuugc

SEQ ID NO: 226456 - RNA, 22 nt, Homo sapiens
ccccauuguugugguuuuaucu

SEQ ID NO: 226457 - RNA, 22 nt, Homo sapiens
ccccugaaacucacucauuauc

SEQ ID NO: 226458 - RNA, 17 nt, Homo sapiens
ccccugagcgaugcagu

SEQ ID NO: 226459 - RNA, 18 nt, Homo sapiens
cccgggugggcuguuccc

SEQ ID NO: 226460 - RNA, 23 nt, Homo sapiens
cccucagaagugcagggagagaa

SEQ ID NO: 226461 - RNA, 22 nt, Homo sapiens
cccucgagaaaccaucugcuga

SEQ ID NO: 226462 - RNA, 22 nt, Homo sapiens
cccugacauucggagauguagu

SEQ ID NO: 226463 - RNA, 19 nt, Homo sapiens
cccuggcacauggaaaaug

SEQ ID NO: 226464 - RNA, 22 nt, Homo sapiens
cccuguguuguucaaggaucug

SEQ ID NO: 226465 - RNA, 22 nt, Homo sapiens
cccuuagaauuuuguaguuauu

SEQ ID NO: 226466 - RNA, 22 nt, Homo sapiens
ccgugcacggaaaggcauauuu

SEQ ID NO: 226467 - RNA, 22 nt, Homo sapiens
ccuaggcacugggguccagccc

SEQ ID NO: 226468 - RNA, 22 nt, Homo sapiens
ccucacaaccuuuauugaagag

SEQ ID NO: 226469 - RNA, 22 nt, Homo sapiens
ccucauggagaaccucugcuag

SEQ ID NO: 226470 - RNA, 22 nt, Homo sapiens
ccuccauuugugucaggaaguc

SEQ ID NO: 226471 - RNA, 21 nt, Homo sapiens
ccucuuugagggaagaaaggg

SEQ ID NO: 226472 - RNA, 22 nt, Homo sapiens
ccugaugacacgggagauguac

SEQ ID NO: 226473 - RNA, 22 nt, Homo sapiens
ccugcauaguucaccgcugaua

SEQ ID NO: 226474 - RNA, 22 nt, Homo sapiens
ccuggcacugagcaguguucua

SEQ ID NO: 226475 - RNA, 22 nt, Homo sapiens
ccuggcacugggccccguggcu

SEQ ID NO: 226476 - RNA, 22 nt, Homo sapiens
ccugguguuuugauggucgggu

SEQ ID NO: 226477 - RNA, 22 nt, Homo sapiens
ccuguagcauccaagaagcugc

SEQ ID NO: 226478 - RNA, 22 nt, Homo sapiens
ccuguguuaugguuucuaaugu

SEQ ID NO: 226479 - RNA, 22 nt, Homo sapiens
ccuuggcaauggcuggggcuga

SEQ ID NO: 226480 - RNA, 22 nt, Homo sapiens
ccuugguugugcuucaacuucu

SEQ ID NO: 226481 - RNA, 22 nt, Homo sapiens
ccuugucacugaguggaaugaa

SEQ ID NO: 226482 - RNA, 22 nt, Homo sapiens
cggaaugaaaauguccuucagu

SEQ ID NO: 226483 - RNA, 22 nt, Homo sapiens
cggucacagugauucaaggguc

SEQ ID NO: 226484 - RNA, 22 nt, Homo sapiens
cggugcaaauguaauugcaguu

SEQ ID NO: 226485 - RNA, 22 nt, Homo sapiens
cgugaggaguauuuuuaggugc

SEQ ID NO: 226486 - RNA, 20 nt, Homo sapiens
cguugcacuccagccugggc

SEQ ID NO: 226487 - RNA, 16 nt, Homo sapiens
cuaaaaugucuacuug

SEQ ID NO: 226488 - RNA, 22 nt, Homo sapiens
cuaaagauagugacaugauuug

SEQ ID NO: 226489 - RNA, 22 nt, Homo sapiens
cuaaaguauugagugguaaaga

SEQ ID NO: 226490 - RNA, 22 nt, Homo sapiens
cuaaaguucuucugagagaaca

SEQ ID NO: 226491 - RNA, 22 nt, Homo sapiens
cuaacacagagguuuauuucuc

SEQ ID NO: 226492 - RNA, 21 nt, Homo sapiens
cuaaggaaagcuaugaacccu

SEQ ID NO: 226493 - RNA, 22 nt, Homo sapiens
cuaaggaaggacugaaaggaca

SEQ ID NO: 226494 - RNA, 22 nt, Homo sapiens
cuaagggaggaagcugugcagg

SEQ ID NO: 226495 - RNA, 22 nt, Homo sapiens
cuaagugaacugucacugagaa

SEQ ID NO: 226496 - RNA, 22 nt, Homo sapiens
cuaaucugugcauagaagaggc

SEQ ID NO: 226497 - RNA, 22 nt, Homo sapiens
cuaaugcagucaggagaaggaa

SEQ ID NO: 226498 - RNA, 22 nt, Homo sapiens
cuacagaguaucuaaagaggua

SEQ ID NO: 226499 - RNA, 22 nt, Homo sapiens
cuacaguaugaaaccuuuacuc

SEQ ID NO: 226500 - RNA, 22 nt, Homo sapiens
cuaccuggguggcucaugacuu

SEQ ID NO: 226501 - RNA, 22 nt, Homo sapiens
cuacugcacaucaucugaguua

SEQ ID NO: 226502 - RNA, 22 nt, Homo sapiens
cuagaagcauauucagaacaga

SEQ ID NO: 226503 - RNA, 22 nt, Homo sapiens
cuagaggcacagccuaggcacu

SEQ ID NO: 226504 - RNA, 22 nt, Homo sapiens
cuagaguagaguuuccuuagga

SEQ ID NO: 226505 - RNA, 22 nt, Homo sapiens
cuagauuguuuccauaaugaca

SEQ ID NO: 226506 - RNA, 22 nt, Homo sapiens
cuagcacauuuaucuuuauaca

SEQ ID NO: 226507 - RNA, 22 nt, Homo sapiens
cuagcagaacaauacaauucgg

SEQ ID NO: 226508 - RNA, 22 nt, Homo sapiens
cuagcagacacuuccagagagu

SEQ ID NO: 226509 - RNA, 22 nt, Homo sapiens
cuagcagacaugggcugaacca

SEQ ID NO: 226510 - RNA, 22 nt, Homo sapiens
cuagccuggagugcaguggugc

SEQ ID NO: 226511 - RNA, 22 nt, Homo sapiens
cuagcuccauauaaagcaggau

SEQ ID NO: 226512 - RNA, 22 nt, Homo sapiens
cuaggaaguauguguuauugcu

SEQ ID NO: 226513 - RNA, 22 nt, Homo sapiens
cuaggcacgccugggucuccag

SEQ ID NO: 226514 - RNA, 22 nt, Homo sapiens
cuaggcacugauaguuguauuu

SEQ ID NO: 226515 - RNA, 22 nt, Homo sapiens
cuagguuauacucugaaauggu

SEQ ID NO: 226516 - RNA, 22 nt, Homo sapiens
cuagucacaggaguugaaggau

SEQ ID NO: 226517 - RNA, 22 nt, Homo sapiens
cuagugcaguuccccugucuua

SEQ ID NO: 226518 - RNA, 22 nt, Homo sapiens
cuauaacagugugguuuggaga

SEQ ID NO: 226519 - RNA, 22 nt, Homo sapiens
cuauaugucuguuuugguacca

SEQ ID NO: 226520 - RNA, 22 nt, Homo sapiens
uauggccacugucuuugaguca

SEQ ID NO: 226521 - RNA, 22 nt, Homo sapiens
uauggccccuacaugugcaaaa

SEQ ID NO: 226522 - RNA, 22 nt, Homo sapiens
uauggcuaugggaacugggagu

SEQ ID NO: 226523 - RNA, 22 nt, Homo sapiens
uauggcuucuauaaggaagcuu

SEQ ID NO: 226524 - RNA, 22 nt, Homo sapiens
uauggcuucuuauucuuucccg

SEQ ID NO: 226525 - RNA, 22 nt, Homo sapiens
uauggcuuuguucaacagccuc

SEQ ID NO: 226526 - RNA, 22 nt, Homo sapiens
uaugggcuuuguuuuguacuag

SEQ ID NO: 226527 - RNA, 22 nt, Homo sapiens
uauggguaguacaaaguguaua

SEQ ID NO: 226528 - RNA, 22 nt, Homo sapiens
uaugggucuuaaaucacuuagu

SEQ ID NO: 226529 - RNA, 22 nt, Homo sapiens
uaugguuuuaagguuaaggacu

SEQ ID NO: 226530 - RNA, 20 nt, Homo sapiens
uaugguuuuagguauagcau

SEQ ID NO: 226531 - RNA, 22 nt, Homo sapiens
uaugguuuucucuuacguguug

SEQ ID NO: 226532 - RNA, 17 nt, Homo sapiens
uauguaguacuuauaaa

SEQ ID NO: 226533 - RNA, 19 nt, Homo sapiens
uauguaguuuucucaauau

SEQ ID NO: 226534 - RNA, 22 nt, Homo sapiens
uaugucuauuauguagcaggaa

SEQ ID NO: 226535 - RNA, 22 nt, Homo sapiens
uaugucuggaguuacugagcug

SEQ ID NO: 226536 - RNA, 22 nt, Homo sapiens
uaugugcuuuguuaaacagaug

SEQ ID NO: 226537 - RNA, 22 nt, Homo sapiens
uauguuaucaaaaagcuaagga

SEQ ID NO: 226538 - RNA, 22 nt, Homo sapiens
uauuacagaccauaucgccggg

SEQ ID NO: 226539 - RNA, 22 nt, Homo sapiens
uauuacauccauaggcucugcu

SEQ ID NO: 226540 - RNA, 22 nt, Homo sapiens
uauuacuugucugugucucaau

SEQ ID NO: 226541 - RNA, 22 nt, Homo sapiens
uauuagugccuaagucuuaggg

SEQ ID NO: 226542 - RNA, 20 nt, Homo sapiens
uauucacucuccagucuugc

SEQ ID NO: 226543 - RNA, 22 nt, Homo sapiens
uauucacuguaucauugauggg

SEQ ID NO: 226544 - RNA, 22 nt, Homo sapiens
uauuccacacuguuggugggau

SEQ ID NO: 226545 - RNA, 22 nt, Homo sapiens
uauuccucuuuguugagguuau

SEQ ID NO: 226546 - RNA, 22 nt, Homo sapiens
uauugaacuggaucagaaggcc

SEQ ID NO: 226547 - RNA, 22 nt, Homo sapiens
uauugcaacagaagaaagaguc

SEQ ID NO: 226548 - RNA, 22 nt, Homo sapiens
uauugcacuccagccuuggcaa

SEQ ID NO: 226549 - RNA, 22 nt, Homo sapiens
uauugcacuccucaugcauuug

SEQ ID NO: 226550 - RNA, 22 nt, Homo sapiens
uauugcagaaugugaguuggca

SEQ ID NO: 226551 - RNA, 22 nt, Homo sapiens
uauugcauguugagcaguaccu

SEQ ID NO: 226552 - RNA, 22 nt, Homo sapiens
uauugccucuuuuguaaaagug

SEQ ID NO: 226553 - RNA, 22 nt, Homo sapiens
uauugccugucuccaaaaauca

SEQ ID NO: 226554 - RNA, 22 nt, Homo sapiens
uauuggcucuguuucucugaag

SEQ ID NO: 226555 - RNA, 22 nt, Homo sapiens
uauuguccaauaggauguuccu

SEQ ID NO: 226556 - RNA, 22 nt, Homo sapiens
uauuguccacuuugcacugugu

SEQ ID NO: 226557 - RNA, 22 nt, Homo sapiens
uauugugcauguugaauaacua

SEQ ID NO: 226558 - RNA, 22 nt, Homo sapiens
uauuugcacucccaucauggug

SEQ ID NO: 226559 - RNA, 22 nt, Homo sapiens
ucaaacugucagguugaccaga

SEQ ID NO: 226560 - RNA, 22 nt, Homo sapiens
ucaaaguauucuucugagaacc

SEQ ID NO: 226561 - RNA, 22 nt, Homo sapiens
ucaaagugcuauggcucagguu

SEQ ID NO: 226562 - RNA, 21 nt, Homo sapiens
ucaaaguguucuuuuguugaa

SEQ ID NO: 226563 - RNA, 18 nt, Homo sapiens
ucaaauacuuugggcagu

SEQ ID NO: 226564 - RNA, 22 nt, Homo sapiens
ucaaaugauucuccugccucag

SEQ ID NO: 226565 - RNA, 22 nt, Homo sapiens
ucaaaugcuguauuguaguaau

SEQ ID NO: 226566 - RNA, 22 nt, Homo sapiens
ucaacaggucaauugcauagaa

SEQ ID NO: 226567 - RNA, 22 nt, Homo sapiens
ucaacugcuugagaucacaaau

SEQ ID NO: 226568 - RNA, 20 nt, Homo sapiens
ucaaggcacgaauaaaaguu

SEQ ID NO: 226569 - RNA, 22 nt, Homo sapiens
ucaaggcaguggccuuccuucu

SEQ ID NO: 226570 - RNA, 22 nt, Homo sapiens
ucaaguaguaacuaacugugac

SEQ ID NO: 226571 - RNA, 22 nt, Homo sapiens
ucaaguagugacucgaguuauu

SEQ ID NO: 226572 - RNA, 22 nt, Homo sapiens
ucaagugcauugauucaguauu

SEQ ID NO: 226573 - RNA, 22 nt, Homo sapiens
ucaaugggcuacacauugagug

SEQ ID NO: 226574 - RNA, 22 nt, Homo sapiens
ucaauguaucuccaagaauuga

SEQ ID NO: 226575 - RNA, 22 nt, Homo sapiens
ucaauugcaucaacaguguaca

SEQ ID NO: 226576 - RNA, 22 nt, Homo sapiens
ucaauugcuuaugaagauacau

SEQ ID NO: 226577 - RNA, 22 nt, Homo sapiens
ucacacugaaacuaggguguga

SEQ ID NO: 226578 - RNA, 23 nt, Homo sapiens
ucacacuuaagagaaaugcagcu

SEQ ID NO: 226579 - RNA, 22 nt, Homo sapiens
ucacagacugagccaaauagag

SEQ ID NO: 226580 - RNA, 22 nt, Homo sapiens
ucacagauaaauaaagaugauu

SEQ ID NO: 226581 - RNA, 22 nt, Homo sapiens
ucacagaugaggcgagaggcag

SEQ ID NO: 226582 - RNA, 22 nt, Homo sapiens
ucacagccuaguuuuauacauu

SEQ ID NO: 226583 - RNA, 22 nt, Homo sapiens
ucacaguaacuuuguugcuuuu

SEQ ID NO: 226584 - RNA, 22 nt, Homo sapiens
ucacaguagcaaauguuagaaa

SEQ ID NO: 226585 - RNA, 22 nt, Homo sapiens
ucacaguauucaugaacaugga

SEQ ID NO: 226586 - RNA, 22 nt, Homo sapiens
ucacagucaaaguaaucauaga

SEQ ID NO: 226587 - RNA, 22 nt, Homo sapiens
ucacaguccuguuuaggagagg

SEQ ID NO: 226588 - RNA, 23 nt, Homo sapiens
ucacaguggcugcuuaauuguga

SEQ ID NO: 226589 - RNA, 17 nt, Homo sapiens
ucacaguguuaggauga

SEQ ID NO: 226590 - RNA, 22 nt, Homo sapiens
ucacaguugauugaaacacagc

SEQ ID NO: 226591 - RNA, 22 nt, Homo sapiens
ucacauagcauaaugucugcaa

SEQ ID NO: 226592 - RNA, 22 nt, Homo sapiens
ucacauagcugaguaaaaugga

SEQ ID NO: 226593 - RNA, 22 nt, Homo sapiens
ucacaugaagauuuuaguauac

SEQ ID NO: 226594 - RNA, 22 nt, Homo sapiens
ucacaugcacaucucuggaacc

SEQ ID NO: 226595 - RNA, 22 nt, Homo sapiens
ucacauggcagagaagaagcuc

SEQ ID NO: 226596 - RNA, 22 nt, Homo sapiens
ucacauggggaagggacuagcu

SEQ ID NO: 226597 - RNA, 22 nt, Homo sapiens
ucacaugucagccguggggaag

SEQ ID NO: 226598 - RNA, 22 nt, Homo sapiens
ucacaugugaagauugggagua

SEQ ID NO: 226599 - RNA, 22 nt, Homo sapiens
ucacaugugacauauauauuug

SEQ ID NO: 226600 - RNA, 22 nt, Homo sapiens
ucacauuguguagccugcucac

SEQ ID NO: 226601 - RNA, 22 nt, Homo sapiens
ucaccaccugcugaucauagag

SEQ ID NO: 226602 - RNA, 22 nt, Homo sapiens
ucaccaccuuccaggaccacug

SEQ ID NO: 226603 - RNA, 16 nt, Homo sapiens
ucaccccuagagaucc

SEQ ID NO: 226604 - RNA, 22 nt, Homo sapiens
ucacccugacaugcggccgaac

SEQ ID NO: 226605 - RNA, 22 nt, Homo sapiens
ucaccuggagagcuugcuaaua

SEQ ID NO: 226606 - RNA, 22 nt, Homo sapiens
ucaccuguagcuaagaccuaau

SEQ ID NO: 226607 - RNA, 22 nt, Homo sapiens
ucaccuugcacaguuguguggg

SEQ ID NO: 226608 - RNA, 22 nt, Homo sapiens
ucacuaaagaaaauggcaugga

SEQ ID NO: 226609 - RNA, 20 nt, Homo sapiens
ucacuauggagcucuuucuu

SEQ ID NO: 226610 - RNA, 22 nt, Homo sapiens
ucacugaaaccgccuccaccuc

SEQ ID NO: 226611 - RNA, 22 nt, Homo sapiens
ucacugagaaugauguuucuga

SEQ ID NO: 226612 - RNA, 22 nt, Homo sapiens
ucacugagcacaggagaugugc

SEQ ID NO: 226613 - RNA, 22 nt, Homo sapiens
ucacugagcuagaucacuugac

SEQ ID NO: 226614 - RNA, 20 nt, Homo sapiens
ucacugaguaucuacgauua

SEQ ID NO: 226615 - RNA, 22 nt, Homo sapiens
ucacugcacuagguaaugccac

SEQ ID NO: 226616 - RNA, 22 nt, Homo sapiens
ucacugcacucuccgccuugcg

SEQ ID NO: 226617 - RNA, 22 nt, Homo sapiens
ucacugcgaccuccaccuccug

SEQ ID NO: 226618 - RNA, 22 nt, Homo sapiens
ugagaugaaagcagaaagacuu

SEQ ID NO: 226619 - RNA, 22 nt, Homo sapiens
ugagaugaagucucacucuguc

SEQ ID NO: 226620 - RNA, 22 nt, Homo sapiens
ugagaugaagugauguaaaaca

SEQ ID NO: 226621 - RNA, 22 nt, Homo sapiens
ugagaugacgacacaccucagu

SEQ ID NO: 226622 - RNA, 22 nt, Homo sapiens
ugagaugagggaagccuaggca

SEQ ID NO: 226623 - RNA, 22 nt, Homo sapiens
ugagaugaguucucgcucuguc

SEQ ID NO: 226624 - RNA, 22 nt, Homo sapiens
ugagaugaguugcgcucugucg

SEQ ID NO: 226625 - RNA, 22 nt, Homo sapiens
ugagaugaguugcuggcucuga

SEQ ID NO: 226626 - RNA, 22 nt, Homo sapiens
ugagaugauagauauguuaauu

SEQ ID NO: 226627 - RNA, 22 nt, Homo sapiens
ugagaugcuccucuugcaaagc

SEQ ID NO: 226628 - RNA, 22 nt, Homo sapiens
ugagaugcucgccggccagcau

SEQ ID NO: 226629 - RNA, 22 nt, Homo sapiens
ugagauggagucuugucgccua

SEQ ID NO: 226630 - RNA, 22 nt, Homo sapiens
ugagauggaucuuggauuugaa

SEQ ID NO: 226631 - RNA, 22 nt, Homo sapiens
ugagauggguaauuaaauggug

SEQ ID NO: 226632 - RNA, 22 nt, Homo sapiens
ugagaugguaaauuuuuguugu

SEQ ID NO: 226633 - RNA, 22 nt, Homo sapiens
ugagauguagauauggauuaga

SEQ ID NO: 226634 - RNA, 23 nt, Homo sapiens
ugagaugucugauugcgaggguc

SEQ ID NO: 226635 - RNA, 22 nt, Homo sapiens
ugagauguuuagauuguugucu

SEQ ID NO: 226636 - RNA, 22 nt, Homo sapiens
ugagauguuuguuucagugccu

SEQ ID NO: 226637 - RNA, 21 nt, Homo sapiens
ugagauuaaguuguuuagaag

SEQ ID NO: 226638 - RNA, 22 nt, Homo sapiens
ugagauuaaucuuuaaguaaga

SEQ ID NO: 226639 - RNA, 23 nt, Homo sapiens
ugagauuacccagaaagaguaua

SEQ ID NO: 226640 - RNA, 22 nt, Homo sapiens
ugagauuguuagaucaaauggu

SEQ ID NO: 226641 - RNA, 22 nt, Homo sapiens
ugagcaagaucuuuauaauuag

SEQ ID NO: 226642 - RNA, 23 nt, Homo sapiens
ugagcaauauucuacuauugagu

SEQ ID NO: 226643 - RNA, 22 nt, Homo sapiens
ugagcacagcgugugggagagc

SEQ ID NO: 226644 - RNA, 22 nt, Homo sapiens
ugagcacauuuacaucaguucc

SEQ ID NO: 226645 - RNA, 22 nt, Homo sapiens
ugagcacuguacuuuaucaggu

SEQ ID NO: 226646 - RNA, 22 nt, Homo sapiens
ugagcagagaucacggcauugu

SEQ ID NO: 226647 - RNA, 22 nt, Homo sapiens
ugagcagugagugugcugcagg

SEQ ID NO: 226648 - RNA, 22 nt, Homo sapiens
ugagcagugaguguggugcagg

SEQ ID NO: 226649 - RNA, 22 nt, Homo sapiens
ugagcaucauucacaccuuggu

SEQ ID NO: 226650 - RNA, 22 nt, Homo sapiens
ugagccaaguucacaccauugc

SEQ ID NO: 226651 - RNA, 23 nt, Homo sapiens
ugagccaugggacuccaagggag

SEQ ID NO: 226652 - RNA, 22 nt, Homo sapiens
ugagccaugguuagcuucucau

SEQ ID NO: 226653 - RNA, 20 nt, Homo sapiens
ugagccccuggacucaagcg

SEQ ID NO: 226654 - RNA, 17 nt, Homo sapiens
ugagcuaagauuacccc

SEQ ID NO: 226655 - RNA, 22 nt, Homo sapiens
ugagcuacuacacccagcuugg

SEQ ID NO: 226656 - RNA, 22 nt, Homo sapiens
ugagcuagggccuggaauaggg

SEQ ID NO: 226657 - RNA, 22 nt, Homo sapiens
ugagcucagcuaguugaggugu

SEQ ID NO: 226658 - RNA, 22 nt, Homo sapiens
ugaggaaugaccccgugugguc

SEQ ID NO: 226659 - RNA, 22 nt, Homo sapiens
ugaggagugaacuauuucugau

SEQ ID NO: 226660 - RNA, 22 nt, Homo sapiens
ugaggaguguauuucauucgcu

SEQ ID NO: 226661 - RNA, 22 nt, Homo sapiens
ugaggcacucccuagcggggug

SEQ ID NO: 226662 - RNA, 22 nt, Homo sapiens
ugaggcacucuagacuuauuca

SEQ ID NO: 226663 - RNA, 17 nt, Homo sapiens
ugagggaugccugguuc

SEQ ID NO: 226664 - RNA, 22 nt, Homo sapiens
ugagggcguauccuucauuaag

SEQ ID NO: 226665 - RNA, 22 nt, Homo sapiens
ugagguaauagauaauauuuuu

SEQ ID NO: 226666 - RNA, 22 nt, Homo sapiens
ugagguacaacauggacugaag

SEQ ID NO: 226667 - RNA, 22 nt, Homo sapiens
ugagguagguaccauuaucacu

SEQ ID NO: 226668 - RNA, 22 nt, Homo sapiens
ugagguaucauugcccaggcug

SEQ ID NO: 226669 - RNA, 22 nt, Homo sapiens
ugaggucauguucugucagguu

SEQ ID NO: 226670 - RNA, 22 nt, Homo sapiens
ugagguguauugggggaaauuc

SEQ ID NO: 226671 - RNA, 22 nt, Homo sapiens
ugagguguuauccagaguucuu

SEQ ID NO: 226672 - RNA, 22 nt, Homo sapiens
ugagguugguauuacugucucu

SEQ ID NO: 226673 - RNA, 22 nt, Homo sapiens
ugaguacuacuaguuacugcua

SEQ ID NO: 226674 - RNA, 22 nt, Homo sapiens
ugaguagaagugaagauagugg

SEQ ID NO: 226675 - RNA, 22 nt, Homo sapiens
ugaguaguauucuaugguaugu

SEQ ID NO: 226676 - RNA, 19 nt, Homo sapiens
ugaguauauuguauucauu

SEQ ID NO: 226677 - RNA, 22 nt, Homo sapiens
ugaguaucuugaugaauuugaa

SEQ ID NO: 226678 - RNA, 22 nt, Homo sapiens
ugagucagucucacucugcugc

SEQ ID NO: 226679 - RNA, 22 nt, Homo sapiens
ugagugaaagaagcacuaagga

SEQ ID NO: 226680 - RNA, 22 nt, Homo sapiens
ugagugaggcugggcagucccu

SEQ ID NO: 226681 - RNA, 21 nt, Homo sapiens
ugagugcugagugaggguuga

SEQ ID NO: 226682 - RNA, 22 nt, Homo sapiens
ugaguguccaccccuuucacag

SEQ ID NO: 226683 - RNA, 22 nt, Homo sapiens
ugaguuaauuuuuguaucaugu

SEQ ID NO: 226684 - RNA, 22 nt, Homo sapiens
ugaguuauuaguagaggcuaug

SEQ ID NO: 226685 - RNA, 22 nt, Homo sapiens
ugaguucaugcuuguaguucua

SEQ ID NO: 226686 - RNA, 22 nt, Homo sapiens
ugaguucuuccaccgggaccag

SEQ ID NO: 226687 - RNA, 22 nt, Homo sapiens
ugaguucuuccuaucucugccu

SEQ ID NO: 226688 - RNA, 22 nt, Homo sapiens
ugaguucuuuuacauuuugaau

SEQ ID NO: 226689 - RNA, 22 nt, Homo sapiens
ugaguuguaggggucaccuggc

SEQ ID NO: 226690 - RNA, 22 nt, Homo sapiens
ugauaagugaaagugcucuauc

SEQ ID NO: 226691 - RNA, 17 nt, Homo sapiens
ugauaagugugagguga

SEQ ID NO: 226692 - RNA, 22 nt, Homo sapiens
ugauaauguuaggcuuuauuca

SEQ ID NO: 226693 - RNA, 22 nt, Homo sapiens
ugauacugugcauuagaggcua

SEQ ID NO: 226694 - RNA, 22 nt, Homo sapiens
ugauagucauucaauuuagcca

SEQ ID NO: 226695 - RNA, 22 nt, Homo sapiens
ugauagugccuuuuauaucucu

SEQ ID NO: 226696 - RNA, 22 nt, Homo sapiens
ugauaucucuugccuccaaaug

SEQ ID NO: 226697 - RNA, 22 nt, Homo sapiens
ugauaugaaguuagcuggcugu

SEQ ID NO: 226698 - RNA, 22 nt, Homo sapiens
ugauauguaugugaccuagaaa

SEQ ID NO: 226699 - RNA, 22 nt, Homo sapiens
ugauaugucacuugaucauggu

SEQ ID NO: 226700 - RNA, 22 nt, Homo sapiens
ugauauguguaaacaauguaua

SEQ ID NO: 226701 - RNA, 22 nt, Homo sapiens
ugauauguuagaaucuugcaag

SEQ ID NO: 226702 - RNA, 20 nt, Homo sapiens
ugauauuucuggaaguggag

SEQ ID NO: 226703 - RNA, 22 nt, Homo sapiens
ugaucaaagugcuggaauuaca

SEQ ID NO: 226704 - RNA, 22 nt, Homo sapiens
ugaucuguccaccucagcuucc

SEQ ID NO: 226705 - RNA, 22 nt, Homo sapiens
ugaucuuuuuaauguccauggg

SEQ ID NO: 226706 - RNA, 22 nt, Homo sapiens
ugaugaaguauaggaagggcuu

SEQ ID NO: 226707 - RNA, 22 nt, Homo sapiens
ugaugacauugucacagucuga

SEQ ID NO: 226708 - RNA, 22 nt, Homo sapiens
ugaugcugaguggcuauuugaa

SEQ ID NO: 226709 - RNA, 22 nt, Homo sapiens
ugauggcaauggcauucauuuu

SEQ ID NO: 226710 - RNA, 22 nt, Homo sapiens
ugauggcauuuggaguugggac

SEQ ID NO: 226711 - RNA, 22 nt, Homo sapiens
ugauggccuguucuccauaugu

SEQ ID NO: 226712 - RNA, 23 nt, Homo sapiens
ugauguccacuuagggucuaggu

SEQ ID NO: 226713 - RNA, 21 nt, Homo sapiens
ugauguugaccuaaguaguga

SEQ ID NO: 226714 - RNA, 22 nt, Homo sapiens
ugauugcacaccugcacucaag

SEQ ID NO: 226715 - RNA, 22 nt, Homo sapiens
ugauuguucuguccccaggggc

SEQ ID NO: 226716 - RNA, 15 nt, Homo sapiens
uggugguguugagac

SEQ ID NO: 226717 - RNA, 22 nt, Homo sapiens
ugguuccauauuaauuuuagga

SEQ ID NO: 226718 - RNA, 22 nt, Homo sapiens
uguaaaaagcccagccgcugag

SEQ ID NO: 226719 - RNA, 18 nt, Homo sapiens
uguaaacuaccucaaccu

SEQ ID NO: 226720 - RNA, 23 nt, Homo sapiens
uguaaagcuaugaauuauucuuu

SEQ ID NO: 226721 - RNA, 22 nt, Homo sapiens
uguaaaucuauuuuuaguguuu

SEQ ID NO: 226722 - RNA, 22 nt, Homo sapiens
uguaacaggaggaaaaugugaa

SEQ ID NO: 226723 - RNA, 22 nt, Homo sapiens
uguaacaguaguuacuauucuu

SEQ ID NO: 226724 - RNA, 22 nt, Homo sapiens
uguaaccauccagagucccagg

SEQ ID NO: 226725 - RNA, 22 nt, Homo sapiens
uguaagcagcagagacuauccu

SEQ ID NO: 226726 - RNA, 22 nt, Homo sapiens
uguaagcauugggcaugcaguc

SEQ ID NO: 226727 - RNA, 20 nt, Homo sapiens
uguaaucuaaguuuuaagcc

SEQ ID NO: 226728 - RNA, 22 nt, Homo sapiens
uguaaugaucaaaucagaguaa

SEQ ID NO: 226729 - RNA, 22 nt, Homo sapiens
uguacaaauuucugugguggug

SEQ ID NO: 226730 - RNA, 22 nt, Homo sapiens
uguacacauaugugggguacau

SEQ ID NO: 226731 - RNA, 19 nt, Homo sapiens
uguaccagcaagucuuuuc

SEQ ID NO: 226732 - RNA, 22 nt, Homo sapiens
uguacccuuagagagugaucga

SEQ ID NO: 226733 - RNA, 22 nt, Homo sapiens
uguacuucaagauuaugguuua

SEQ ID NO: 226734 - RNA, 22 nt, Homo sapiens
uguagacaccaaagacagcaua

SEQ ID NO: 226735 - RNA, 18 nt, Homo sapiens
uguagcaccuuucuugug

SEQ ID NO: 226736 - RNA, 21 nt, Homo sapiens
uguagcagcauaauuuauaau

SEQ ID NO: 226737 - RNA, 22 nt, Homo sapiens
uguagcuuuugagauuuauauu

SEQ ID NO: 226738 - RNA, 20 nt, Homo sapiens
uguagguguacaguaaggag

SEQ ID NO: 226739 - RNA, 22 nt, Homo sapiens
uguauacauauguauguuuugu

SEQ ID NO: 226740 - RNA, 21 nt, Homo sapiens
uguauacauggaagaaugguc

SEQ ID NO: 226741 - RNA, 22 nt, Homo sapiens
uguauagaucugauucaucucc

SEQ ID NO: 226742 - RNA, 22 nt, Homo sapiens
uguaugagagacauggcugcuu

SEQ ID NO: 226743 - RNA, 22 nt, Homo sapiens
uguaugaguuguuuauaaauuu

SEQ ID NO: 226744 - RNA, 22 nt, Homo sapiens
uguaugcuuuugagagauauuu

SEQ ID NO: 226745 - RNA, 22 nt, Homo sapiens
uguauguaaagacaggauaaca

SEQ ID NO: 226746 - RNA, 16 nt, Homo sapiens
uguauugcuaaaaaga

SEQ ID NO: 226747 - RNA, 19 nt, Homo sapiens
ugucaaaugucuccugggg

SEQ ID NO: 226748 - RNA, 21 nt, Homo sapiens
ugucaagugggaaaacaugua

SEQ ID NO: 226749 - RNA, 22 nt, Homo sapiens
ugucaauauguaauaacugaau

SEQ ID NO: 226750 - RNA, 22 nt, Homo sapiens
ugucacagagauuuugguaugu

SEQ ID NO: 226751 - RNA, 22 nt, Homo sapiens
ugucacaguuuguacuuuauag

SEQ ID NO: 226752 - RNA, 22 nt, Homo sapiens
ugucacguugcuuuucuguugu

SEQ ID NO: 226753 - RNA, 18 nt, Homo sapiens
ugucacuggauaaugguc

SEQ ID NO: 226754 - RNA, 22 nt, Homo sapiens
ugucacuuugccuucuggacuu

SEQ ID NO: 226755 - RNA, 22 nt, Homo sapiens
ugucagaaucugagacgacaac

SEQ ID NO: 226756 - RNA, 22 nt, Homo sapiens
ugucaggagcaaugauaaauuu

SEQ ID NO: 226757 - RNA, 22 nt, Homo sapiens
ugucaguguaugagccccggau

SEQ ID NO: 226758 - RNA, 22 nt, Homo sapiens
ugucaguuucccuccucuuccu

SEQ ID NO: 226759 - RNA, 22 nt, Homo sapiens
ugucaguuucuugagauggaac

SEQ ID NO: 226760 - RNA, 22 nt, Homo sapiens
ugucaguuuuaacuagggaaua

SEQ ID NO: 226761 - RNA, 22 nt, Homo sapiens
ugucauacaguaacaugguugg

SEQ ID NO: 226762 - RNA, 22 nt, Homo sapiens
ugucauagaugauuuuuuucgg

SEQ ID NO: 226763 - RNA, 22 nt, Homo sapiens
ugucaucauuggaaucugccuc

SEQ ID NO: 226764 - RNA, 22 nt, Homo sapiens
ugucaucuagguuuuaagccuu

SEQ ID NO: 226765 - RNA, 22 nt, Homo sapiens
ugucaugaaauauguuuuucua

SEQ ID NO: 226766 - RNA, 22 nt, Homo sapiens
ugucauggauucugagucuggg

SEQ ID NO: 226767 - RNA, 22 nt, Homo sapiens
ugucauggucacaggcauuuca

SEQ ID NO: 226768 - RNA, 22 nt, Homo sapiens
ugucauguaaagaguaaauggu

SEQ ID NO: 226769 - RNA, 22 nt, Homo sapiens
ugucauguauauaccacuucca

SEQ ID NO: 226770 - RNA, 22 nt, Homo sapiens
ugucaugucaacuauggaauuu

SEQ ID NO: 226771 - RNA, 22 nt, Homo sapiens
ugucaugugagggaacuuguuc

SEQ ID NO: 226772 - RNA, 22 nt, Homo sapiens
ugucauguuucuacugaccaaa

SEQ ID NO: 226773 - RNA, 22 nt, Homo sapiens
ugucauucaggaaauucuaagu

SEQ ID NO: 226774 - RNA, 16 nt, Homo sapiens
uguccaaauaaauaca

SEQ ID NO: 226775 - RNA, 22 nt, Homo sapiens
uguccaaaucagagguaccaaa

SEQ ID NO: 226776 - RNA, 21 nt, Homo sapiens
uguccagcuuuuggaauauaa

SEQ ID NO: 226777 - RNA, 22 nt, Homo sapiens
uguccauuuuuaugcuuauggu

SEQ ID NO: 226778 - RNA, 22 nt, Homo sapiens
uguccugaagcuuuguuaugua

SEQ ID NO: 226779 - RNA, 22 nt, Homo sapiens
uguccuggugaugcccaaauuc

SEQ ID NO: 226780 - RNA, 21 nt, Homo sapiens
ugucgugcaggaucuguggga

SEQ ID NO: 226781 - RNA, 20 nt, Homo sapiens
ugucuauggggguucucugc

SEQ ID NO: 226782 - RNA, 22 nt, Homo sapiens
ugucucaguuucuguggguuag

SEQ ID NO: 226783 - RNA, 22 nt, Homo sapiens
ugucucccuucccauuaggaag

SEQ ID NO: 226784 - RNA, 21 nt, Homo sapiens
ugucugagagaggagaucuac

SEQ ID NO: 226785 - RNA, 16 nt, Homo sapiens
ugucuguuugggcaca

SEQ ID NO: 226786 - RNA, 22 nt, Homo sapiens
ugucuugagagaggacaugacu

SEQ ID NO: 226787 - RNA, 22 nt, Homo sapiens
ugucuuggacuugaaucucauu

SEQ ID NO: 226788 - RNA, 22 nt, Homo sapiens
ugucuuguagacugaaggcuuc

SEQ ID NO: 226789 - RNA, 22 nt, Homo sapiens
ugugaaacacgaaagucuaaaa

SEQ ID NO: 226790 - RNA, 22 nt, Homo sapiens
ugugaacaaaauuuguugcaua

SEQ ID NO: 226791 - RNA, 22 nt, Homo sapiens
ugugacaguuaguuugguguua

SEQ ID NO: 226792 - RNA, 22 nt, Homo sapiens
ugugacugguugucccgcuuuc

SEQ ID NO: 226793 - RNA, 19 nt, Homo sapiens
ugugacugguugucucgcu

SEQ ID NO: 226794 - RNA, 20 nt, Homo sapiens
ugugagacugguuuugaacu

SEQ ID NO: 226795 - RNA, 19 nt, Homo sapiens
ugugagcauuagcauuuag

SEQ ID NO: 226796 - RNA, 22 nt, Homo sapiens
ugugagcuauggaguuguagag

SEQ ID NO: 226797 - RNA, 22 nt, Homo sapiens
ugugaucaugugugccuuaguc

SEQ ID NO: 226798 - RNA, 16 nt, Homo sapiens
ugugaucuuuuuucuu

SEQ ID NO: 226799 - RNA, 22 nt, Homo sapiens
ugugaugaaggcauagggaugu

SEQ ID NO: 226800 - RNA, 22 nt, Homo sapiens
ugugaugguuuagcauuuucuu

SEQ ID NO: 226801 - RNA, 22 nt, Homo sapiens
ugugaugguuuggaagcuucuu

SEQ ID NO: 226802 - RNA, 22 nt, Homo sapiens
ugugaugugaugagaaguuccu

SEQ ID NO: 226803 - RNA, 22 nt, Homo sapiens
ugugauugauauauuuacagaa

SEQ ID NO: 226804 - RNA, 22 nt, Homo sapiens
ugugcaaauuagcacaacccga

SEQ ID NO: 226805 - RNA, 18 nt, Homo sapiens
ugugcaauauuaaccacc

SEQ ID NO: 226806 - RNA, 22 nt, Homo sapiens
ugugcacaaccugcagguuugu

SEQ ID NO: 226807 - RNA, 22 nt, Homo sapiens
ugugcacaauguacagguuagu

SEQ ID NO: 226808 - RNA, 22 nt, Homo sapiens
ugugcaccucuucacacaggga

SEQ ID NO: 226809 - RNA, 22 nt, Homo sapiens
ugugcauaugucuuuauaguag

SEQ ID NO: 226810 - RNA, 22 nt, Homo sapiens
ugugccaaaucccauaauaaau

SEQ ID NO: 226811 - RNA, 22 nt, Homo sapiens
ugugccacugcacuccugccug

SEQ ID NO: 226812 - RNA, 22 nt, Homo sapiens
ugugccacugcacuucagccug

SEQ ID NO: 226813 - RNA, 22 nt, Homo sapiens
ugugccacuguucuguaaagug

SEQ ID NO: 226814 - RNA, 22 nt, Homo sapiens
ugugccuacugauagagccaag

SEQ ID NO: 226815 - RNA, 22 nt, Homo sapiens
uuccuaguccugagucucugcg

SEQ ID NO: 226816 - RNA, 19 nt, Homo sapiens
uuccuagugguugggaagu

SEQ ID NO: 226817 - RNA, 22 nt, Homo sapiens
uucgucaugagacagaugcuga

SEQ ID NO: 226818 - RNA, 22 nt, Homo sapiens
uucguuuguaauccuuacagca

SEQ ID NO: 226819 - RNA, 22 nt, Homo sapiens
uucuaaacaucuuacaaugcau

SEQ ID NO: 226820 - RNA, 21 nt, Homo sapiens
uucuaaguaaauguuggacau

SEQ ID NO: 226821 - RNA, 22 nt, Homo sapiens
uucuagcacuuugggagacuga

SEQ ID NO: 226822 - RNA, 22 nt, Homo sapiens
uucuauggucacagaugcuuga

SEQ ID NO: 226823 - RNA, 22 nt, Homo sapiens
uucucaaggagccuucguaacu

SEQ ID NO: 226824 - RNA, 22 nt, Homo sapiens
uucucaguaauuccagauuuuu

SEQ ID NO: 226825 - RNA, 22 nt, Homo sapiens
uucucagugaacuccagcuugu

SEQ ID NO: 226826 - RNA, 22 nt, Homo sapiens
uucucagugaaguuuagaacau

SEQ ID NO: 226827 - RNA, 22 nt, Homo sapiens
uucucagugcuaucuuuuaugc

SEQ ID NO: 226828 - RNA, 17 nt, Homo sapiens
uucucaguucugaucuc

SEQ ID NO: 226829 - RNA, 22 nt, Homo sapiens
uucucauggugauggcaaaauc

SEQ ID NO: 226830 - RNA, 22 nt, Homo sapiens
uucucuggucagaggggagguu

SEQ ID NO: 226831 - RNA, 19 nt, Homo sapiens
uucucugguuguacuaccc

SEQ ID NO: 226832 - RNA, 22 nt, Homo sapiens
uucugacuggugugagauggua

SEQ ID NO: 226833 - RNA, 23 nt, Homo sapiens
uucugccacugaaaaugccucag

SEQ ID NO: 226834 - RNA, 22 nt, Homo sapiens
uucugcuagucugucagaucuu

SEQ ID NO: 226835 - RNA, 22 nt, Homo sapiens
uucuggcuuuuaaagaaauguu

SEQ ID NO: 226836 - RNA, 22 nt, Homo sapiens
uucugugcugaaucaaagacug

SEQ ID NO: 226837 - RNA, 22 nt, Homo sapiens
uucuguguuuaggucacggcua

SEQ ID NO: 226838 - RNA, 22 nt, Homo sapiens
uucuuagucauguaauagucca

SEQ ID NO: 226839 - RNA, 22 nt, Homo sapiens
uucuucugguuaugaaauuuga

SEQ ID NO: 226840 - RNA, 22 nt, Homo sapiens
uucuugaggcaugccgcuggga

SEQ ID NO: 226841 - RNA, 20 nt, Homo sapiens
uucuugaguuaacaaguuac

SEQ ID NO: 226842 - RNA, 22 nt, Homo sapiens
uucuugcuguauccucacaugg

SEQ ID NO: 226843 - RNA, 22 nt, Homo sapiens
uucuugguuggcaaccaacagu

SEQ ID NO: 226844 - RNA, 18 nt, Homo sapiens
uucuuguguugauauuuu

SEQ ID NO: 226845 - RNA, 22 nt, Homo sapiens
uucuuuaguucacuugcuccag

SEQ ID NO: 226846 - RNA, 22 nt, Homo sapiens
uucuuuggaaacaguacuaauu

SEQ ID NO: 226847 - RNA, 22 nt, Homo sapiens
uugaaagaugaacuggauugga

SEQ ID NO: 226848 - RNA, 22 nt, Homo sapiens
uugaaagcuaucucaaaucgcu

SEQ ID NO: 226849 - RNA, 22 nt, Homo sapiens
uugaaagucauuucuucuaagu

SEQ ID NO: 226850 - RNA, 22 nt, Homo sapiens
uugaaagucuaggcuuacagua

SEQ ID NO: 226851 - RNA, 22 nt, Homo sapiens
uugaaaguguucacaaugguau

SEQ ID NO: 226852 - RNA, 22 nt, Homo sapiens
uugaaaucuuccacagcccaag

SEQ ID NO: 226853 - RNA, 22 nt, Homo sapiens
uugaacuagaaccugcaaauuu

SEQ ID NO: 226854 - RNA, 22 nt, Homo sapiens
uugaacugguaguuggaaaucu

SEQ ID NO: 226855 - RNA, 22 nt, Homo sapiens
uugaacuguaagggucugugug

SEQ ID NO: 226856 - RNA, 22 nt, Homo sapiens
uugaagguaauugguuuuauga

SEQ ID NO: 226857 - RNA, 22 nt, Homo sapiens
uugaaguagcauuucaugucua

SEQ ID NO: 226858 - RNA, 22 nt, Homo sapiens
uugaauagcauguuuagugcau

SEQ ID NO: 226859 - RNA, 22 nt, Homo sapiens
uugaauaggcucaugcuuauca

SEQ ID NO: 226860 - RNA, 22 nt, Homo sapiens
uugaaugaaauuggugugggga

SEQ ID NO: 226861 - RNA, 22 nt, Homo sapiens
uugaaugaauggaaagaagggu

SEQ ID NO: 226862 - RNA, 17 nt, Homo sapiens
uugaaugcauuacuugg

SEQ ID NO: 226863 - RNA, 22 nt, Homo sapiens
uugacaaguuguccaguaugag

SEQ ID NO: 226864 - RNA, 22 nt, Homo sapiens
uugacaggaugcucagggccca

SEQ ID NO: 226865 - RNA, 22 nt, Homo sapiens
uugacaguggcuuaaauugguu

SEQ ID NO: 226866 - RNA, 20 nt, Homo sapiens
uugacaguggguuguuaaag

SEQ ID NO: 226867 - RNA, 22 nt, Homo sapiens
uugacauugcuguaguguccag

SEQ ID NO: 226868 - RNA, 22 nt, Homo sapiens
uugaccaaagaagagucauugc

SEQ ID NO: 226869 - RNA, 22 nt, Homo sapiens
uugaccacugggcacaguaagu

SEQ ID NO: 226870 - RNA, 22 nt, Homo sapiens
uugacuguaagauggcuauuac

SEQ ID NO: 226871 - RNA, 22 nt, Homo sapiens
uugacuuuuauucacucugcua

SEQ ID NO: 226872 - RNA, 22 nt, Homo sapiens
uugagaagugucuguucauguc

SEQ ID NO: 226873 - RNA, 22 nt, Homo sapiens
uugagacgaagucucacucuug

SEQ ID NO: 226874 - RNA, 22 nt, Homo sapiens
uugagacggagucucacucugu

SEQ ID NO: 226875 - RNA, 22 nt, Homo sapiens
uugagacggaguuuugcucuug

SEQ ID NO: 226876 - RNA, 22 nt, Homo sapiens
uugagagaaaaaauuuauuggu

SEQ ID NO: 226877 - RNA, 22 nt, Homo sapiens
uugagauacauaauuaugaaug

SEQ ID NO: 226878 - RNA, 22 nt, Homo sapiens
uugagauggagucucacucugc

SEQ ID NO: 226879 - RNA, 22 nt, Homo sapiens
uugagauggagucucacugugu

SEQ ID NO: 226880 - RNA, 22 nt, Homo sapiens
uugagauggagucucgcugugu

SEQ ID NO: 226881 - RNA, 22 nt, Homo sapiens
uugagauggaguuucaauauug

SEQ ID NO: 226882 - RNA, 22 nt, Homo sapiens
uugagauggaguuucacucugu

SEQ ID NO: 226883 - RNA, 22 nt, Homo sapiens
uugagauggaguuucgcucuug

SEQ ID NO: 226884 - RNA, 22 nt, Homo sapiens
uugagauggaguuuugcucuug

SEQ ID NO: 226885 - RNA, 22 nt, Homo sapiens
uugagauguggcaguuuaugag

SEQ ID NO: 226886 - RNA, 22 nt, Homo sapiens
uugagauguggguuggugacuu

SEQ ID NO: 226887 - RNA, 21 nt, Homo sapiens
uugagcaacuaggguuauagg

SEQ ID NO: 226888 - RNA, 22 nt, Homo sapiens
uugagcaaugucacugaggcuu

SEQ ID NO: 226889 - RNA, 22 nt, Homo sapiens
uugagcacaggaguuuugagac

SEQ ID NO: 226890 - RNA, 22 nt, Homo sapiens
uugagcauugguauagguuuua

SEQ ID NO: 226891 - RNA, 22 nt, Homo sapiens
uugagcuaugaguuaauaggac

SEQ ID NO: 226892 - RNA, 21 nt, Homo sapiens
uugagcuuuuaguacagacag

SEQ ID NO: 226893 - RNA, 22 nt, Homo sapiens
uugaggaagugguuccccagag

SEQ ID NO: 226894 - RNA, 22 nt, Homo sapiens
uugaggaggcagucucuccauu

SEQ ID NO: 226895 - RNA, 22 nt, Homo sapiens
uugaggcaaugaggagaagcug

SEQ ID NO: 226896 - RNA, 22 nt, Homo sapiens
uugagggaaacauucacaucau

SEQ ID NO: 226897 - RNA, 22 nt, Homo sapiens
uugagguaauaaacagccauuc

SEQ ID NO: 226898 - RNA, 22 nt, Homo sapiens
uugagguaguacuuauuauugg

SEQ ID NO: 226899 - RNA, 22 nt, Homo sapiens
uugagguauuuugucaacugua

SEQ ID NO: 226900 - RNA, 22 nt, Homo sapiens
uugaggucuuugagcaaacgca

SEQ ID NO: 226901 - RNA, 22 nt, Homo sapiens
uugaggugaauuugcaggaugc

SEQ ID NO: 226902 - RNA, 22 nt, Homo sapiens
uugagguguauuguacagcaca

SEQ ID NO: 226903 - RNA, 22 nt, Homo sapiens
uugaguauuugcagucugaaca

SEQ ID NO: 226904 - RNA, 22 nt, Homo sapiens
uugaguccauucgaugcugauu

SEQ ID NO: 226905 - RNA, 22 nt, Homo sapiens
uugagugaaggcuguguucuug

SEQ ID NO: 226906 - RNA, 22 nt, Homo sapiens
uugagugaaugaaugauuaaau

SEQ ID NO: 226907 - RNA, 21 nt, Homo sapiens
uugaguugaagcaaggaggga

SEQ ID NO: 226908 - RNA, 22 nt, Homo sapiens
uugaguuuaucuaaagaccugg

SEQ ID NO: 226909 - RNA, 22 nt, Homo sapiens
uugauagacacauauccaugug

SEQ ID NO: 226910 - RNA, 22 nt, Homo sapiens
uugauaguuuaauuaaugcuag

SEQ ID NO: 226911 - RNA, 22 nt, Homo sapiens
uugauaucugaugccuauggaa

SEQ ID NO: 226912 - RNA, 22 nt, Homo sapiens
uugauauguggaauauuuaucu

SEQ ID NO: 226913 - RNA, 22 nt, Homo sapiens
ugugaauguaaccuuauuugga

SEQ ID NO: 226914 - RNA, 22 nt, Homo sapiens
ugugacagcacagcaucucuuu

SEQ ID NO: 226915 - RNA, 22 nt, Homo sapiens
ugugacagguagguaauuuuug

SEQ ID NO: 226916 - RNA, 17 nt, Homo sapiens
ugugacccugggcuacc

SEQ ID NO: 226917 - RNA, 22 nt, Homo sapiens
ugugacucugcauuuuggguuc

SEQ ID NO: 226918 - RNA, 22 nt, Homo sapiens
ugugacucuggcacauggugag

SEQ ID NO: 226919 - RNA, 19 nt, Homo sapiens
ugugacugggccagccuag

SEQ ID NO: 226920 - RNA, 22 nt, Homo sapiens
ugugagacugacagggcagggu

SEQ ID NO: 226921 - RNA, 22 nt, Homo sapiens
ugugagacugguucugaaccca

SEQ ID NO: 226922 - RNA, 22 nt, Homo sapiens
ugugagaucucagaauugaacu

SEQ ID NO: 226923 - RNA, 19 nt, Homo sapiens
ugugauaguugaaccugcc

SEQ ID NO: 226924 - RNA, 22 nt, Homo sapiens
ugugauaguuggcuaaagcagu

SEQ ID NO: 226925 - RNA, 17 nt, Homo sapiens
ugugaucaucacccuug

SEQ ID NO: 226926 - RNA, 22 nt, Homo sapiens
ugugaucauuucaggaauuuug

SEQ ID NO: 226927 - RNA, 18 nt, Homo sapiens
ugugauggauauguuaau

SEQ ID NO: 226928 - RNA, 20 nt, Homo sapiens
ugugauuauuuaguugcaug

SEQ ID NO: 226929 - RNA, 17 nt, Homo sapiens
ugugauugaagucaucc

SEQ ID NO: 226930 - RNA, 22 nt, Homo sapiens
ugugauuggccuggcguggguc

SEQ ID NO: 226931 - RNA, 22 nt, Homo sapiens
ugugcaaaaacaauugcgguuu

SEQ ID NO: 226932 - RNA, 22 nt, Homo sapiens
ugugcacaaugugcagguuugu

SEQ ID NO: 226933 - RNA, 22 nt, Homo sapiens
ugugcacauaacauuuuuuuag

SEQ ID NO: 226934 - RNA, 22 nt, Homo sapiens
ugugcacaugauauaucacaua

SEQ ID NO: 226935 - RNA, 22 nt, Homo sapiens
ugugcacauugugcagguugau

SEQ ID NO: 226936 - RNA, 22 nt, Homo sapiens
ugugcaguuuugagugaauuuc

SEQ ID NO: 226937 - RNA, 22 nt, Homo sapiens
ugugcaugaaauuuaccuuuaa

SEQ ID NO: 226938 - RNA, 22 nt, Homo sapiens
ugugcaugacagcauacaaacg

SEQ ID NO: 226939 - RNA, 22 nt, Homo sapiens
ugugccaaucauagggcuuggu

SEQ ID NO: 226940 - RNA, 22 nt, Homo sapiens
ugugccacugcacucccgccug

SEQ ID NO: 226941 - RNA, 22 nt, Homo sapiens
ugugccacugcacucugggcaa

SEQ ID NO: 226942 - RNA, 22 nt, Homo sapiens
ugugcgcaucggggccugcuuc

SEQ ID NO: 226943 - RNA, 22 nt, Homo sapiens
ugugcgugugccuguaagaauu

SEQ ID NO: 226944 - RNA, 22 nt, Homo sapiens
uuugcuuguguaaaaaucugga

SEQ ID NO: 226945 - RNA, 20 nt, Homo sapiens
uuuggcaauaggguuuuugu

SEQ ID NO: 226946 - RNA, 22 nt, Homo sapiens
uuuggcacuauagguaaauuug

SEQ ID NO: 226947 - RNA, 20 nt, Homo sapiens
uuuggcacugagugguauaa

SEQ ID NO: 226948 - RNA, 22 nt, Homo sapiens
uuuggcagaaaacuaaaaggua

SEQ ID NO: 226949 - RNA, 22 nt, Homo sapiens
uuuggcaguuauuuacucagug

SEQ ID NO: 226950 - RNA, 22 nt, Homo sapiens
uuuggcauauuuuaagcugguu

SEQ ID NO: 226951 - RNA, 22 nt, Homo sapiens
uuuggcaugggcuauuugcuuu

SEQ ID NO: 226952 - RNA, 21 nt, Homo sapiens
uuuggcauuaugucaccagag

SEQ ID NO: 226953 - RNA, 22 nt, Homo sapiens
uuuggccauguuggucaggcug

SEQ ID NO: 226954 - RNA, 22 nt, Homo sapiens
uuuggcccugagggauggcaua

SEQ ID NO: 226955 - RNA, 22 nt, Homo sapiens
uuuggcuguuucuggacuaaga

SEQ ID NO: 226956 - RNA, 21 nt, Homo sapiens
uuuggcuucucugcugcagcc

SEQ ID NO: 226957 - RNA, 22 nt, Homo sapiens
uuuggcuuuuguaauaacugcc

SEQ ID NO: 226958 - RNA, 22 nt, Homo sapiens
uuugggaaugaguuuaucauuu

SEQ ID NO: 226959 - RNA, 22 nt, Homo sapiens
uuugggccauggcuuuuccacg

SEQ ID NO: 226960 - RNA, 22 nt, Homo sapiens
uuugggccaugguuuguguaua

SEQ ID NO: 226961 - RNA, 22 nt, Homo sapiens
uuugggccucugauuucuuugg

SEQ ID NO: 226962 - RNA, 22 nt, Homo sapiens
uuuggguuaguuuuccaaucuu

SEQ ID NO: 226963 - RNA, 22 nt, Homo sapiens
uuuggguuuuauguaacagcua

SEQ ID NO: 226964 - RNA, 22 nt, Homo sapiens
uuuggucacugccgccgccagc

SEQ ID NO: 226965 - RNA, 22 nt, Homo sapiens
uuugguccaguguucagguccu

SEQ ID NO: 226966 - RNA, 22 nt, Homo sapiens
uuugguguauauguaaacuaug

SEQ ID NO: 226967 - RNA, 22 nt, Homo sapiens
uuugguuauuugaaacuagcau

SEQ ID NO: 226968 - RNA, 22 nt, Homo sapiens
uuugguuuuuguuaucacucau

SEQ ID NO: 226969 - RNA, 22 nt, Homo sapiens
uuuguacacgugggugaauugu

SEQ ID NO: 226970 - RNA, 22 nt, Homo sapiens
uuuguacucccuuuagauaaaa

SEQ ID NO: 226971 - RNA, 22 nt, Homo sapiens
uuuguacuccuuggccagcuuc

SEQ ID NO: 226972 - RNA, 22 nt, Homo sapiens
uuugugacacaaacacauauau

SEQ ID NO: 226973 - RNA, 22 nt, Homo sapiens
uuugugaggugauggauauguc

SEQ ID NO: 226974 - RNA, 23 nt, Homo sapiens
uuugugcuaauuuaugggcucuu

SEQ ID NO: 226975 - RNA, 22 nt, Homo sapiens
uuugugcuccuaugagaaucua

SEQ ID NO: 226976 - RNA, 22 nt, Homo sapiens
uuugugcuccugugagaaucua

SEQ ID NO: 226977 - RNA, 21 nt, Homo sapiens
uuugugguuacugugugagcu

SEQ ID NO: 226978 - RNA, 22 nt, Homo sapiens
uuugugugugauuauaaaaggu

SEQ ID NO: 226979 - RNA, 22 nt, Homo sapiens
uuuguuugaagucgagacaacu

SEQ ID NO: 226980 - RNA, 22 nt, Homo sapiens
uuuuaacagccaggggacggcc

SEQ ID NO: 226981 - RNA, 22 nt, Homo sapiens
uuuuacagaggagguugcugau

SEQ ID NO: 226982 - RNA, 20 nt, Homo sapiens
uuuuagcacuuguuauggug

SEQ ID NO: 226983 - RNA, 22 nt, Homo sapiens
uuuucacggugucccagagagu

SEQ ID NO: 226984 - RNA, 22 nt, Homo sapiens
uuuucaguggccauaguggaga

SEQ ID NO: 226985 - RNA, 20 nt, Homo sapiens
uuuugaacuuggcaaccugu

SEQ ID NO: 226986 - RNA, 22 nt, Homo sapiens
uuuugccggcauguugggcuuc

SEQ ID NO: 226987 - RNA, 22 nt, Homo sapiens
uuuuggacuucaauuugacacu

SEQ ID NO: 226988 - RNA, 22 nt, Homo sapiens
uuuuggacuugcuccccugucc

SEQ ID NO: 226989 - RNA, 17 nt, Homo sapiens
uuuuggauuagaaaucc

SEQ ID NO: 226990 - RNA, 22 nt, Homo sapiens
uuuuggcacuuugucugauucu

SEQ ID NO: 226991 - RNA, 22 nt, Homo sapiens
uuuuggcucugucuguaucuuu

SEQ ID NO: 226992 - RNA, 22 nt, Homo sapiens
uuuugguguauuguauaaggua

SEQ ID NO: 226993 - RNA, 22 nt, Homo sapiens
uuuugucccaugggcuguuccc

SEQ ID NO: 226994 - RNA, 22 nt, Homo sapiens
uuuugugacuauuguaaauggg

SEQ ID NO: 226995 - RNA, 22 nt, Homo sapiens
uuuuucacuuaaguuaggcuca

SEQ ID NO: 226996 - RNA, 21 nt, Homo sapiens
uuuuugguggucauggauaga

SEQ ID NO: 226997 - RNA, 22 nt, Homo sapiens
uuuuugguugguaggcuauuaa

SEQ ID NO: 226998 - RNA, 23 nt, Homo sapiens
uuuuuguguuucauggaaauagg

SEQ ID NO: 226999 - RNA, 22 nt, Homo sapiens
uuuuuuaguuagcugggcauga

SEQ ID NO: 227000 - RNA, 22 nt, Homo sapiens
uugacuuagacauucaguugga

SEQ ID NO: 227001 - RNA, 21 nt, Homo sapiens
uugagaagaauuagcucuucc

SEQ ID NO: 227002 - RNA, 22 nt, Homo sapiens
uugagaaucuuucgaauguucu

SEQ ID NO: 227003 - RNA, 22 nt, Homo sapiens
uugagaaucuuugcuaaaggaa

SEQ ID NO: 227004 - RNA, 22 nt, Homo sapiens
uugagagagaacauuuguuaca

SEQ ID NO: 227005 - RNA, 22 nt, Homo sapiens
uugagauaggaacucacuaugc

SEQ ID NO: 227006 - RNA, 22 nt, Homo sapiens
uugagauaggagcuguuguucu

SEQ ID NO: 227007 - RNA, 22 nt, Homo sapiens
uugagauaucuuggccuuugca

SEQ ID NO: 227008 - RNA, 20 nt, Homo sapiens
uugagaucuguaucugguuu

SEQ ID NO: 227009 - RNA, 22 nt, Homo sapiens
uugagaugaagucuugcucucu

SEQ ID NO: 227010 - RNA, 22 nt, Homo sapiens
uuggagugugucuuauuccauu

SEQ ID NO: 227011 - RNA, 22 nt, Homo sapiens
uuggaugauaaagaagccuaag

SEQ ID NO: 227012 - RNA, 22 nt, Homo sapiens
uuggauuuuaacaaacuaggug

SEQ ID NO: 227013 - RNA, 22 nt, Homo sapiens
uuggcaaauagguuuuauugca

SEQ ID NO: 227014 - RNA, 22 nt, Homo sapiens
uuggcaagaaccuucuuccaag

SEQ ID NO: 227015 - RNA, 22 nt, Homo sapiens
uuggcaaguuucugucagcaaa

SEQ ID NO: 227016 - RNA, 22 nt, Homo sapiens
uuggcaauugcuaugauuugaa

SEQ ID NO: 227017 - RNA, 22 nt, Homo sapiens
uuggcagcacgcaguccagagg

SEQ ID NO: 227018 - RNA, 22 nt, Homo sapiens
uuggcagucugaggcacagacu

SEQ ID NO: 227019 - RNA, 22 nt, Homo sapiens
uuggcagugcccgaugcugggg

SEQ ID NO: 227020 - RNA, 20 nt, Homo sapiens
uuggcauuuagacaagaguu

SEQ ID NO: 227021 - RNA, 22 nt, Homo sapiens
uuggccauaugacuugcuuugg

SEQ ID NO: 227022 - RNA, 22 nt, Homo sapiens
uuggccccuuucauccacagcu

SEQ ID NO: 227023 - RNA, 22 nt, Homo sapiens
uuggcccugcugaccauucccu

SEQ ID NO: 227024 - RNA, 23 nt, Homo sapiens
uuggccuccuugugucuagggcu

SEQ ID NO: 227025 - RNA, 22 nt, Homo sapiens
uuggccuuucucuaaauacuuu

SEQ ID NO: 227026 - RNA, 22 nt, Homo sapiens
uuggcuaagaucacgugagaau

SEQ ID NO: 227027 - RNA, 22 nt, Homo sapiens
uuggcucuggcugggcuccagc

SEQ ID NO: 227028 - RNA, 22 nt, Homo sapiens
uuggcuguguuucccuacaaau

SEQ ID NO: 227029 - RNA, 22 nt, Homo sapiens
uuggcuucuggacuauugugca

SEQ ID NO: 227030 - RNA, 22 nt, Homo sapiens
uuggcuuguaaaaugaaaagcu

SEQ ID NO: 227031 - RNA, 22 nt, Homo sapiens
uuggcuuuuaugcagcuuaggu

SEQ ID NO: 227032 - RNA, 22 nt, Homo sapiens
uugggaaugcuaaaccucuauu

SEQ ID NO: 227033 - RNA, 23 nt, Homo sapiens
uugggcaaaucacuaacgucucc

SEQ ID NO: 227034 - RNA, 17 nt, Homo sapiens
uugggcaagguagguga

SEQ ID NO: 227035 - RNA, 22 nt, Homo sapiens
uugggcaauaggaagcaggugg

SEQ ID NO: 227036 - RNA, 22 nt, Homo sapiens
uugggguagaauugcaacauau

SEQ ID NO: 227037 - RNA, 22 nt, Homo sapiens
uugggguaggaauauggaauga

SEQ ID NO: 227038 - RNA, 22 nt, Homo sapiens
uugguaaucccuagugucuaga

SEQ ID NO: 227039 - RNA, 22 nt, Homo sapiens
uugguaggcuggccucucucag

SEQ ID NO: 227040 - RNA, 22 nt, Homo sapiens
uuggucagcuagauuauucccu

SEQ ID NO: 227041 - RNA, 22 nt, Homo sapiens
uuggucaggcuaaucucgaacg

SEQ ID NO: 227042 - RNA, 22 nt, Homo sapiens
uugguccauuacauugaugaca

SEQ ID NO: 227043 - RNA, 22 nt, Homo sapiens
uuggucucuuaaucacacuuuu

SEQ ID NO: 227044 - RNA, 21 nt, Homo sapiens
uugguucccucugacaggucu

SEQ ID NO: 227045 - RNA, 22 nt, Homo sapiens
uuguaaagucugucucagucag

SEQ ID NO: 227046 - RNA, 22 nt, Homo sapiens
uuguaaaguucuuaggaagcuc

SEQ ID NO: 227047 - RNA, 22 nt, Homo sapiens
uuguaaucaacacaucauuggg

SEQ ID NO: 227048 - RNA, 22 nt, Homo sapiens
uuguaauguuaggguguccaug

SEQ ID NO: 227049 - RNA, 22 nt, Homo sapiens
uuguagcaaauauauuuuggaa

SEQ ID NO: 227050 - RNA, 22 nt, Homo sapiens
uuguagcaaauguguaaacaaa

SEQ ID NO: 227051 - RNA, 22 nt, Homo sapiens
uuguaguagucucguucuuuua

SEQ ID NO: 227052 - RNA, 22 nt, Homo sapiens
uuguauguuguuugucagagaa

SEQ ID NO: 227053 - RNA, 22 nt, Homo sapiens
uuguauguuucugugcacauga

SEQ ID NO: 227054 - RNA, 22 nt, Homo sapiens
uugucaacaugaaacuguguuu

SEQ ID NO: 227055 - RNA, 22 nt, Homo sapiens
uugucaaugggugagugcagag

SEQ ID NO: 227056 - RNA, 22 nt, Homo sapiens
uugucaugguuaauuuuaugua

SEQ ID NO: 227057 - RNA, 22 nt, Homo sapiens
uuguccauggacagcaccacag

SEQ ID NO: 227058 - RNA, 22 nt, Homo sapiens
uuguccccacccaaaugucauc

SEQ ID NO: 227059 - RNA, 23 nt, Homo sapiens
uuguccccuccaaagcucauguu

SEQ ID NO: 227060 - RNA, 22 nt, Homo sapiens
uuguccucuccaaaucucaugu

SEQ ID NO: 227061 - RNA, 22 nt, Homo sapiens
uuguccuugagauaguuugcug

SEQ ID NO: 227062 - RNA, 21 nt, Homo sapiens
uugucuagagaaauauaucuc

SEQ ID NO: 227063 - RNA, 22 nt, Homo sapiens
uugucuagugaauacauuaaug

SEQ ID NO: 227064 - RNA, 22 nt, Homo sapiens
uugucuccuagacgaccaggcg

SEQ ID NO: 227065 - RNA, 19 nt, Homo sapiens
uugucuuagaguugucauu

SEQ ID NO: 227066 - RNA, 22 nt, Homo sapiens
uugucuugcagcuuaggcauca

SEQ ID NO: 227067 - RNA, 22 nt, Homo sapiens
uugugaaaaaccucucguggaa

SEQ ID NO: 227068 - RNA, 22 nt, Homo sapiens
uugugaaaucuaggcagagguu

SEQ ID NO: 227069 - RNA, 22 nt, Homo sapiens
uugugaaugaugucgcaauaaa

SEQ ID NO: 227070 - RNA, 22 nt, Homo sapiens
uugugaaugaugucgcaguaaa

SEQ ID NO: 227071 - RNA, 22 nt, Homo sapiens
uugugauugagugauccuuguu

SEQ ID NO: 227072 - RNA, 20 nt, Homo sapiens
uugugcauugggccauuggg

SEQ ID NO: 227073 - RNA, 22 nt, Homo sapiens
uugugccacugaagcccuccag

SEQ ID NO: 227074 - RNA, 22 nt, Homo sapiens
uugugccugguacauggagaaa

SEQ ID NO: 227075 - RNA, 22 nt, Homo sapiens
uugugcuuaaugaguguaaggu

SEQ ID NO: 227076 - RNA, 18 nt, Homo sapiens
uuguggccccuacaaauu

SEQ ID NO: 227077 - RNA, 22 nt, Homo sapiens
uugugguaaucugugacagcag

SEQ ID NO: 227078 - RNA, 22 nt, Homo sapiens
uugugguuauagagucucccug

SEQ ID NO: 227079 - RNA, 22 nt, Homo sapiens
uugugguugacuaaauuuguaa

SEQ ID NO: 227080 - RNA, 22 nt, Homo sapiens
uugugguugaugaagacugucu

SEQ ID NO: 227081 - RNA, 22 nt, Homo sapiens
uugugguuuucagcuuauauau

SEQ ID NO: 227082 - RNA, 22 nt, Homo sapiens
uuguguacuacaguaugccaca

SEQ ID NO: 227083 - RNA, 22 nt, Homo sapiens
uuguguaguaccucucacauug

SEQ ID NO: 227084 - RNA, 22 nt, Homo sapiens
uugugucaaauggcaauuagca

SEQ ID NO: 227085 - RNA, 22 nt, Homo sapiens
uuguguccccacccaaaucuca

SEQ ID NO: 227086 - RNA, 22 nt, Homo sapiens
uuguguccccacucaaauuaca

SEQ ID NO: 227087 - RNA, 22 nt, Homo sapiens
uuguguuuuuaguagggaaggg

SEQ ID NO: 227088 - RNA, 22 nt, Homo sapiens
uuguuauguuggucaguaaugu

SEQ ID NO: 227089 - RNA, 22 nt, Homo sapiens
uuguucaggagguuggggaugc

SEQ ID NO: 227090 - RNA, 22 nt, Homo sapiens
uuuaaagcaugacgagaagaag

SEQ ID NO: 227091 - RNA, 22 nt, Homo sapiens
uuuaacauuggaugagaucguc

SEQ ID NO: 227092 - RNA, 20 nt, Homo sapiens
uuuaagacaugcugaauuga

SEQ ID NO: 227093 - RNA, 22 nt, Homo sapiens
uuuacagucucauagguggaag

SEQ ID NO: 227094 - RNA, 22 nt, Homo sapiens
uuuacaguuuucuaggcuacca

SEQ ID NO: 227095 - RNA, 22 nt, Homo sapiens
uucaccuggguuggccaucauu

SEQ ID NO: 227096 - RNA, 22 nt, Homo sapiens
uucaccuugcccacagcagucu

SEQ ID NO: 227097 - RNA, 22 nt, Homo sapiens
uucacugggugugguggcucac

SEQ ID NO: 227098 - RNA, 22 nt, Homo sapiens
uucacugugaacucauauucag

SEQ ID NO: 227099 - RNA, 22 nt, Homo sapiens
uucacugugaauaaaggcuccc

SEQ ID NO: 227100 - RNA, 22 nt, Homo sapiens
uucacugugugacccugggcca

SEQ ID NO: 227101 - RNA, 22 nt, Homo sapiens
uucagaguggacagaaauuaag

SEQ ID NO: 227102 - RNA, 22 nt, Homo sapiens
uucagaugcacacuguagucua

SEQ ID NO: 227103 - RNA, 22 nt, Homo sapiens
cugugguauuauuagaaauauc

SEQ ID NO: 227104 - RNA, 22 nt, Homo sapiens
cugugguguaacucuuggggcg

SEQ ID NO: 227105 - RNA, 22 nt, Homo sapiens
cugugguugagcuuugccauga

SEQ ID NO: 227106 - RNA, 22 nt, Homo sapiens
cuguguaguacuagauugagca

SEQ ID NO: 227107 - RNA, 22 nt, Homo sapiens
cuguuaacauguuguggauaau

SEQ ID NO: 227108 - RNA, 22 nt, Homo sapiens
cuguugcaguuauggcugcagg

SEQ ID NO: 227109 - RNA, 22 nt, Homo sapiens
cuguugguguuuaaucacugca

SEQ ID NO: 227110 - RNA, 22 nt, Homo sapiens
cuguuugauuaagugguggaaa

SEQ ID NO: 227111 - RNA, 22 nt, Homo sapiens
cuguuuguuuaggguacucaga

SEQ ID NO: 227112 - RNA, 22 nt, Homo sapiens
cuuaagcauugacuuuggacag

SEQ ID NO: 227113 - RNA, 20 nt, Homo sapiens
cuuaucaguggcaaguauaa

SEQ ID NO: 227114 - RNA, 17 nt, Homo sapiens
cuucaaauaauuucccc

SEQ ID NO: 227115 - RNA, 22 nt, Homo sapiens
cuucaaguguggccaccugacc

SEQ ID NO: 227116 - RNA, 20 nt, Homo sapiens
cuucacagaaguggaaucau

SEQ ID NO: 227117 - RNA, 22 nt, Homo sapiens
cuucacuggagucccuggauuc

SEQ ID NO: 227118 - RNA, 22 nt, Homo sapiens
cuucagcaauauauccccuggg

SEQ ID NO: 227119 - RNA, 22 nt, Homo sapiens
cuuccaguggcagccgggcaug

SEQ ID NO: 227120 - RNA, 18 nt, Homo sapiens
cuuccuuagucugguuaa

SEQ ID NO: 227121 - RNA, 22 nt, Homo sapiens
cuucggugaguagauggguuaa

SEQ ID NO: 227122 - RNA, 20 nt, Homo sapiens
cuugaagacuaugcugcuga

SEQ ID NO: 227123 - RNA, 22 nt, Homo sapiens
cuugaauguaaauaauguacag

SEQ ID NO: 227124 - RNA, 22 nt, Homo sapiens
cuugacaucugucaguuccuca

SEQ ID NO: 227125 - RNA, 22 nt, Homo sapiens
cuugagacauuguuuuccaagu

SEQ ID NO: 227126 - RNA, 22 nt, Homo sapiens
cuugauagugguaaucauuuuu

SEQ ID NO: 227127 - RNA, 22 nt, Homo sapiens
cuugaucaaugugguacuugau

SEQ ID NO: 227128 - RNA, 22 nt, Homo sapiens
cuugcacucagaagauucaguu

SEQ ID NO: 227129 - RNA, 22 nt, Homo sapiens
cuugcacuccacuguucuccug

SEQ ID NO: 227130 - RNA, 22 nt, Homo sapiens
cuugcauagaguuauugcccuu

SEQ ID NO: 227131 - RNA, 22 nt, Homo sapiens
cuugccuacucacugguuuacu

SEQ ID NO: 227132 - RNA, 22 nt, Homo sapiens
cuuggacaccucaugcccaccu

SEQ ID NO: 227133 - RNA, 22 nt, Homo sapiens
cuuggauuauaauggaauauuu

SEQ ID NO: 227134 - RNA, 22 nt, Homo sapiens
cuuggcacgugauagguguuga

SEQ ID NO: 227135 - RNA, 22 nt, Homo sapiens
cuuggcauugccccuggaauuu

SEQ ID NO: 227136 - RNA, 22 nt, Homo sapiens
cuuggcuccgacuccccuccaa

SEQ ID NO: 227137 - RNA, 22 nt, Homo sapiens
cuuggcuugguaucaaauaacc

SEQ ID NO: 227138 - RNA, 20 nt, Homo sapiens
cuuggcuuucuugguguuaa

SEQ ID NO: 227139 - RNA, 22 nt, Homo sapiens
cuuggguugauugauaaugcca

SEQ ID NO: 227140 - RNA, 22 nt, Homo sapiens
cuugguacucugugucccagcu

SEQ ID NO: 227141 - RNA, 22 nt, Homo sapiens
cuugguuacauuuuccuagaaa

SEQ ID NO: 227142 - RNA, 21 nt, Homo sapiens
cuugucuugcuuagaauagac

SEQ ID NO: 227143 - RNA, 22 nt, Homo sapiens
cuugugauugcacggcugccug

SEQ ID NO: 227144 - RNA, 22 nt, Homo sapiens
cuuguucuccuaagaugaaugc

SEQ ID NO: 227145 - RNA, 22 nt, Homo sapiens
cuuuacacauccuaaccagugu

SEQ ID NO: 227146 - RNA, 22 nt, Homo sapiens
cuuuaguuaaaauugggguugu

SEQ ID NO: 227147 - RNA, 21 nt, Homo sapiens
cuuuaugcuguguuagaaaag

SEQ ID NO: 227148 - RNA, 22 nt, Homo sapiens
cuuucucagugagacccgagau

SEQ ID NO: 227149 - RNA, 22 nt, Homo sapiens
cuuugcaaauggccuuuccaag

SEQ ID NO: 227150 - RNA, 22 nt, Homo sapiens
cuuuggagaaaaguucuugggc

SEQ ID NO: 227151 - RNA, 23 nt, Homo sapiens
cuuugguaggaaauuugaauuau

SEQ ID NO: 227152 - RNA, 18 nt, Homo sapiens
cuuugguccccgcacccu

SEQ ID NO: 227153 - RNA, 23 nt, Homo sapiens
cuuuggucucugguugacuucag

SEQ ID NO: 227154 - RNA, 22 nt, Homo sapiens
cuuugguguauuuucagagacc

SEQ ID NO: 227155 - RNA, 22 nt, Homo sapiens
cuuugguucuguuuauaugcug

SEQ ID NO: 227156 - RNA, 22 nt, Homo sapiens
cuuugguugugcucuccacuuu

SEQ ID NO: 227157 - RNA, 22 nt, Homo sapiens
cuuuguaugucaugacaacugu

SEQ ID NO: 227158 - RNA, 20 nt, Homo sapiens
cuuuguccuccugcugugcu

SEQ ID NO: 227159 - RNA, 22 nt, Homo sapiens
cuuuguggggucuuuccucaaa

SEQ ID NO: 227160 - RNA, 22 nt, Homo sapiens
cuuuguguaggugccucuggcu

SEQ ID NO: 227161 - RNA, 23 nt, Homo sapiens
cuuuugcaaugugaucuugccac

SEQ ID NO: 227162 - RNA, 21 nt, Homo sapiens
cuuuugcacuccagccugggu

SEQ ID NO: 227163 - RNA, 22 nt, Homo sapiens
cuuuuggcuuaagauugucuug

SEQ ID NO: 227164 - RNA, 22 nt, Homo sapiens
cuuuuggcuuagaauugucuug

SEQ ID NO: 227165 - RNA, 22 nt, Homo sapiens
cuuuuggugguucugaugcagg

SEQ ID NO: 227166 - RNA, 22 nt, Homo sapiens
cuuuuggugugaagaagcucuu

SEQ ID NO: 227167 - RNA, 22 nt, Homo sapiens
cuuuuugguagagcaggugugc

SEQ ID NO: 227168 - RNA, 22 nt, Homo sapiens
gaaaauccauccccagggagua

SEQ ID NO: 227169 - RNA, 22 nt, Homo sapiens
gaaagauuuccugagcuagaaa

SEQ ID NO: 227170 - RNA, 22 nt, Homo sapiens
gaaagcuaaugacuuuggguga

SEQ ID NO: 227171 - RNA, 22 nt, Homo sapiens
gaaaucucuacuauuuugaucu

SEQ ID NO: 227172 - RNA, 22 nt, Homo sapiens
gaaaugcucauuuuggauccuu

SEQ ID NO: 227173 - RNA, 23 nt, Homo sapiens
gaaaugucuuagugaaauugcuu

SEQ ID NO: 227174 - RNA, 22 nt, Homo sapiens
gaaauguuuuucaugugggcaa

SEQ ID NO: 227175 - RNA, 22 nt, Homo sapiens
ugagucuguuccaaagaaauaa

SEQ ID NO: 227176 - RNA, 22 nt, Homo sapiens
ugagugaacgcugagaccaaau

SEQ ID NO: 227177 - RNA, 22 nt, Homo sapiens
ugagugaaggggcucuguugug

SEQ ID NO: 227178 - RNA, 22 nt, Homo sapiens
ugagugugacuuagcagaagga

SEQ ID NO: 227179 - RNA, 22 nt, Homo sapiens
ugaguguguaugugcauacaca

SEQ ID NO: 227180 - RNA, 22 nt, Homo sapiens
ugaguuaguguggugcuuggaa

SEQ ID NO: 227181 - RNA, 22 nt, Homo sapiens
ugaguucaauguuaaugaagca

SEQ ID NO: 227182 - RNA, 22 nt, Homo sapiens
ugauaagugagauagcaaguga

SEQ ID NO: 227183 - RNA, 22 nt, Homo sapiens
ugauagaucugggcaaaguaaa

SEQ ID NO: 227184 - RNA, 18 nt, Homo sapiens
ugauaucaucacaauuga

SEQ ID NO: 227185 - RNA, 22 nt, Homo sapiens
ugauaucugaauagauacacaa

SEQ ID NO: 227186 - RNA, 22 nt, Homo sapiens
ugauaucugaucauccuugaua

SEQ ID NO: 227187 - RNA, 22 nt, Homo sapiens
ugauaugaaguucaaaccaggu

SEQ ID NO: 227188 - RNA, 22 nt, Homo sapiens
ugauaugacagcucugcugcca

SEQ ID NO: 227189 - RNA, 22 nt, Homo sapiens
ugauaugcuuugaacucucugg

SEQ ID NO: 227190 - RNA, 22 nt, Homo sapiens
ugauauguaacuacuccuuaua

SEQ ID NO: 227191 - RNA, 22 nt, Homo sapiens
ugauaugucccucgacaucagg

SEQ ID NO: 227192 - RNA, 22 nt, Homo sapiens
ugauauuuuugauccuuaaguu

SEQ ID NO: 227193 - RNA, 22 nt, Homo sapiens
ugauccagugcucaguuggagu

SEQ ID NO: 227194 - RNA, 22 nt, Homo sapiens
ugauccccucacauuauuauau

SEQ ID NO: 227195 - RNA, 20 nt, Homo sapiens
ugaugcaaaucuuuaaaagu

SEQ ID NO: 227196 - RNA, 22 nt, Homo sapiens
ugaugcugaugccugccagaag

SEQ ID NO: 227197 - RNA, 22 nt, Homo sapiens
ugaugguaguucagucaaugua

SEQ ID NO: 227198 - RNA, 20 nt, Homo sapiens
ugauguccaggcagagguuu

SEQ ID NO: 227199 - RNA, 22 nt, Homo sapiens
ugaugugucaucugagagagug

SEQ ID NO: 227200 - RNA, 22 nt, Homo sapiens
ugauguguuuuguaguucaacu

SEQ ID NO: 227201 - RNA, 22 nt, Homo sapiens
ugauguugacuguaggcagaga

SEQ ID NO: 227202 - RNA, 22 nt, Homo sapiens
ugauugacauacauaggugugg

SEQ ID NO: 227203 - RNA, 20 nt, Homo sapiens
ugauugaccagagcaguuuu

SEQ ID NO: 227204 - RNA, 22 nt, Homo sapiens
ugauuggagaacaaacugcaua

SEQ ID NO: 227205 - RNA, 19 nt, Homo sapiens
ugauuguaagcuuggugag

SEQ ID NO: 227206 - RNA, 22 nt, Homo sapiens
ugauuuguuucaggaguuuucu

SEQ ID NO: 227207 - RNA, 22 nt, Homo sapiens
ugcaaauguuaguaacaccacu

SEQ ID NO: 227208 - RNA, 22 nt, Homo sapiens
ugcaaauguuauuuugguuucu

SEQ ID NO: 227209 - RNA, 22 nt, Homo sapiens
ugcaagauaggcaguuugcacu

SEQ ID NO: 227210 - RNA, 22 nt, Homo sapiens
ugcaagaugagauuuuggaugg

SEQ ID NO: 227211 - RNA, 22 nt, Homo sapiens
ugcaagaugauuucaauugaua

SEQ ID NO: 227212 - RNA, 22 nt, Homo sapiens
ugcaaugugaaauaagcacauc

SEQ ID NO: 227213 - RNA, 22 nt, Homo sapiens
ugcaccaauucuaaacaguucu

SEQ ID NO: 227214 - RNA, 23 nt, Homo sapiens
ugcaccacuacacacucuugggu

SEQ ID NO: 227215 - RNA, 22 nt, Homo sapiens
ugcaccacuacacuccaggcug

SEQ ID NO: 227216 - RNA, 22 nt, Homo sapiens
ugcaccacugcacuccacccug

SEQ ID NO: 227217 - RNA, 22 nt, Homo sapiens
ugcaccacugcacuccaggcug

SEQ ID NO: 227218 - RNA, 22 nt, Homo sapiens
ugcaccauuacacuccaggcug

SEQ ID NO: 227219 - RNA, 22 nt, Homo sapiens
ugcagaaucccuucagauccga

SEQ ID NO: 227220 - RNA, 20 nt, Homo sapiens
ugcagauucaaccaacugug

SEQ ID NO: 227221 - RNA, 22 nt, Homo sapiens
ugcagcauguaggcacguuauu

SEQ ID NO: 227222 - RNA, 22 nt, Homo sapiens
ugcaggguccauugucccaagu

SEQ ID NO: 227223 - RNA, 23 nt, Homo sapiens
ugcaguagugagaucuaggcuca

SEQ ID NO: 227224 - RNA, 20 nt, Homo sapiens
ugcaguguccucacuuguca

SEQ ID NO: 227225 - RNA, 21 nt, Homo sapiens
ugcagugugguugcccugcug

SEQ ID NO: 227226 - RNA, 22 nt, Homo sapiens
ugcaguguucuuuagaggaaau

SEQ ID NO: 227227 - RNA, 22 nt, Homo sapiens
ugcaguuuaggaacugguaaca

SEQ ID NO: 227228 - RNA, 22 nt, Homo sapiens
ugcauacacaagcauacaugua

SEQ ID NO: 227229 - RNA, 21 nt, Homo sapiens
ugcauacuucucagaugauua

SEQ ID NO: 227230 - RNA, 22 nt, Homo sapiens
ugcauaugcagcauuuaugauu

SEQ ID NO: 227231 - RNA, 18 nt, Homo sapiens
ugcauauguugaaccagc

SEQ ID NO: 227232 - RNA, 22 nt, Homo sapiens
ugcauauguugagaugcauauu

SEQ ID NO: 227233 - RNA, 22 nt, Homo sapiens
ugcaugcaucuuuuauaguagc

SEQ ID NO: 227234 - RNA, 21 nt, Homo sapiens
ugcauggagaacacugagggu

SEQ ID NO: 227235 - RNA, 22 nt, Homo sapiens
ugcauggaggagcuccccgcag

SEQ ID NO: 227236 - RNA, 22 nt, Homo sapiens
ugcauuguauuguugacucgcc

SEQ ID NO: 227237 - RNA, 22 nt, Homo sapiens
ugcauuguuuagaaacacuggg

SEQ ID NO: 227238 - RNA, 22 nt, Homo sapiens
ugcauuguuuuugguucccagg

SEQ ID NO: 227239 - RNA, 19 nt, Homo sapiens
ugccaagaaagucagcuua

SEQ ID NO: 227240 - RNA, 22 nt, Homo sapiens
ugccaagaacauuuucuguuuu

SEQ ID NO: 227241 - RNA, 22 nt, Homo sapiens
ugccagaugcaguguucaacaa

SEQ ID NO: 227242 - RNA, 22 nt, Homo sapiens
ugccaguauuuuacugaggauu

SEQ ID NO: 227243 - RNA, 22 nt, Homo sapiens
ugccaguauuuuauugaagauu

SEQ ID NO: 227244 - RNA, 22 nt, Homo sapiens
ugccaguauuuuauugagcauu

SEQ ID NO: 227245 - RNA, 22 nt, Homo sapiens
ugccaguauuuuguugaagauu

SEQ ID NO: 227246 - RNA, 20 nt, Homo sapiens
ugccagugugucaauuuaua

SEQ ID NO: 227247 - RNA, 22 nt, Homo sapiens
ugccaugucauagguuaagccu

SEQ ID NO: 227248 - RNA, 22 nt, Homo sapiens
ugccuacugaauuuaccuggcu

SEQ ID NO: 227249 - RNA, 18 nt, Homo sapiens
ugccuacugggcucaagc

SEQ ID NO: 227250 - RNA, 22 nt, Homo sapiens
ugccuagagagaaccauaacug

SEQ ID NO: 227251 - RNA, 22 nt, Homo sapiens
uuaauacucuucuaaguagucc

SEQ ID NO: 227252 - RNA, 22 nt, Homo sapiens
uuaauagcaaagaguuuagacu

SEQ ID NO: 227253 - RNA, 22 nt, Homo sapiens
uuaauccugccuuauuucagua

SEQ ID NO: 227254 - RNA, 22 nt, Homo sapiens
uuaaucucaggaguuugggacc

SEQ ID NO: 227255 - RNA, 22 nt, Homo sapiens
uuaaugaacuuuauuuuguaga

SEQ ID NO: 227256 - RNA, 22 nt, Homo sapiens
uuaaugcuuuugggauauuucu

SEQ ID NO: 227257 - RNA, 22 nt, Homo sapiens
uuaauucugucugcccucaucc

SEQ ID NO: 227258 - RNA, 22 nt, Homo sapiens
uuacaacugucuuacugguuau

SEQ ID NO: 227259 - RNA, 21 nt, Homo sapiens
uuacaauggcuccuugaaggu

SEQ ID NO: 227260 - RNA, 22 nt, Homo sapiens
uuacaccuguaauccagcacuu

SEQ ID NO: 227261 - RNA, 22 nt, Homo sapiens
uuacagcagugccccacuccca

SEQ ID NO: 227262 - RNA, 22 nt, Homo sapiens
uuacagcugggugugucuggua

SEQ ID NO: 227263 - RNA, 17 nt, Homo sapiens
uuacaggugcugagagu

SEQ ID NO: 227264 - RNA, 22 nt, Homo sapiens
uuacagucuuaggcagugcuuu

SEQ ID NO: 227265 - RNA, 23 nt, Homo sapiens
uuacaguggcaugaucucugcuc

SEQ ID NO: 227266 - RNA, 22 nt, Homo sapiens
uuacagugguugcuauugugaa

SEQ ID NO: 227267 - RNA, 22 nt, Homo sapiens
uuacauaguguguggguucggg

SEQ ID NO: 227268 - RNA, 22 nt, Homo sapiens
uuacaucaucacauuaguuugc

SEQ ID NO: 227269 - RNA, 22 nt, Homo sapiens
uuacaugcaugacaaggugcca

SEQ ID NO: 227270 - RNA, 22 nt, Homo sapiens
uuacauguuuauggggguacau

SEQ ID NO: 227271 - RNA, 22 nt, Homo sapiens
uuaccagagaagacgaggggga

SEQ ID NO: 227272 - RNA, 22 nt, Homo sapiens
uuacccauuagagaauuuaaga

SEQ ID NO: 227273 - RNA, 22 nt, Homo sapiens
uuacuagaaacagggcuucgcc

SEQ ID NO: 227274 - RNA, 22 nt, Homo sapiens
uuacuauguuucaaagugucuc

SEQ ID NO: 227275 - RNA, 20 nt, Homo sapiens
uuacuccuuaaugagguuuu

SEQ ID NO: 227276 - RNA, 22 nt, Homo sapiens
uuacugcauaauuccugggaag

SEQ ID NO: 227277 - RNA, 22 nt, Homo sapiens
uuacuguauagaaucaucuuga

SEQ ID NO: 227278 - RNA, 22 nt, Homo sapiens
uuagaacaguguuugccucgcu

SEQ ID NO: 227279 - RNA, 17 nt, Homo sapiens
uuagacagacauccugc

SEQ ID NO: 227280 - RNA, 22 nt, Homo sapiens
uuagacaguggugcacugcacu

SEQ ID NO: 227281 - RNA, 22 nt, Homo sapiens
uuagagcacugaucugcucuuu

SEQ ID NO: 227282 - RNA, 17 nt, Homo sapiens
uuagagguagacucauu

SEQ ID NO: 227283 - RNA, 18 nt, Homo sapiens
uuagagugcauuacuuug

SEQ ID NO: 227284 - RNA, 22 nt, Homo sapiens
uuagauaguacuuagggaaaua

SEQ ID NO: 227285 - RNA, 23 nt, Homo sapiens
uuagaucuuuaaggaaucuccac

SEQ ID NO: 227286 - RNA, 22 nt, Homo sapiens
uuagauguuuagaagugggcca

SEQ ID NO: 227287 - RNA, 22 nt, Homo sapiens
uuagcaauugauucucauaagc

SEQ ID NO: 227288 - RNA, 22 nt, Homo sapiens
uuagcacaucuuucuauguaag

SEQ ID NO: 227289 - RNA, 22 nt, Homo sapiens
uuagcacugagaauggcuugcu

SEQ ID NO: 227290 - RNA, 22 nt, Homo sapiens
uuagcagcaccccacucuacug

SEQ ID NO: 227291 - RNA, 20 nt, Homo sapiens
uuagcagcaugauuuauaau

SEQ ID NO: 227292 - RNA, 22 nt, Homo sapiens
uuagcagccuucaagcuccaag

SEQ ID NO: 227293 - RNA, 22 nt, Homo sapiens
uuagcagugugagcacagacua

SEQ ID NO: 227294 - RNA, 22 nt, Homo sapiens
uuagcccagugggugcuucucu

SEQ ID NO: 227295 - RNA, 22 nt, Homo sapiens
uuaggaucacagaaaauccucu

SEQ ID NO: 227296 - RNA, 22 nt, Homo sapiens
uuaggcaaugcucucaaauuug

SEQ ID NO: 227297 - RNA, 21 nt, Homo sapiens
uuaggcagugucagaggugag

SEQ ID NO: 227298 - RNA, 16 nt, Homo sapiens
uuaggcagugugauac

SEQ ID NO: 227299 - RNA, 22 nt, Homo sapiens
uuaggcuaguugauauaguuug

SEQ ID NO: 227300 - RNA, 22 nt, Homo sapiens
uuaggcucuuuaucaguuaacu

SEQ ID NO: 227301 - RNA, 22 nt, Homo sapiens
uuaggcuuuauugaaaacaaua

SEQ ID NO: 227302 - RNA, 22 nt, Homo sapiens
uuaggcuuuguguccccaccca

SEQ ID NO: 227303 - RNA, 18 nt, Homo sapiens
uuagguaggucuuugugu

SEQ ID NO: 227304 - RNA, 22 nt, Homo sapiens
uuagguagucucugucagaggg

SEQ ID NO: 227305 - RNA, 22 nt, Homo sapiens
uuagguauuuuguuaugucagc

SEQ ID NO: 227306 - RNA, 22 nt, Homo sapiens
uuaggugcauggaaguguuuuc

SEQ ID NO: 227307 - RNA, 22 nt, Homo sapiens
uuaggugguacacagccccagu

SEQ ID NO: 227308 - RNA, 22 nt, Homo sapiens
uuaguagcacagaguaucagca

SEQ ID NO: 227309 - RNA, 22 nt, Homo sapiens
uuaguaguugugauagguaccu

SEQ ID NO: 227310 - RNA, 21 nt, Homo sapiens
uuagugcucaguuugacaaaa

SEQ ID NO: 227311 - RNA, 22 nt, Homo sapiens
uuaguucauugugacuggacuc

SEQ ID NO: 227312 - RNA, 22 nt, Homo sapiens
uuauaaacaugaagauuugggg

SEQ ID NO: 227313 - RNA, 20 nt, Homo sapiens
uuauagcuacaucuugacug

SEQ ID NO: 227314 - RNA, 19 nt, Homo sapiens
uuauauaguuucugaggcu

SEQ ID NO: 227315 - RNA, 18 nt, Homo sapiens
uuauaugcauguguagga

SEQ ID NO: 227316 - RNA, 22 nt, Homo sapiens
uuauauguuucuuagggacaga

SEQ ID NO: 227317 - RNA, 22 nt, Homo sapiens
uuaucauagugcaguuuucuga

SEQ ID NO: 227318 - RNA, 22 nt, Homo sapiens
uuauccugucaguaaauauuuu

SEQ ID NO: 227319 - RNA, 22 nt, Homo sapiens
uuaucucagugaacugagugga

SEQ ID NO: 227320 - RNA, 22 nt, Homo sapiens
uuaugacaggcucaggagcccc

SEQ ID NO: 227321 - RNA, 22 nt, Homo sapiens
uuaugccuauugugccuuggau

SEQ ID NO: 227322 - RNA, 22 nt, Homo sapiens
uuaugcuuauugguguacggua

SEQ ID NO: 227323 - RNA, 22 nt, Homo sapiens
uuauggcucuuggggaaguaga

SEQ ID NO: 227324 - RNA, 22 nt, Homo sapiens
uuaugguuguuaucuugguucg

SEQ ID NO: 227325 - RNA, 22 nt, Homo sapiens
uuaugguuuuuagcagaguaau

SEQ ID NO: 227326 - RNA, 22 nt, Homo sapiens
uuauuagguuaaccuauagcua

SEQ ID NO: 227327 - RNA, 22 nt, Homo sapiens
uuauucauuaacagggaccaaa

SEQ ID NO: 227328 - RNA, 22 nt, Homo sapiens
uuauucugucuuuggucucaau

SEQ ID NO: 227329 - RNA, 17 nt, Homo sapiens
uuauugcuauaagcuga

SEQ ID NO: 227330 - RNA, 22 nt, Homo sapiens
uucaaaucuucguuuugccaua

SEQ ID NO: 227331 - RNA, 23 nt, Homo sapiens
uucaaauguucucugguugucag

SEQ ID NO: 227332 - RNA, 22 nt, Homo sapiens
uucaagauggccccagugagcc

SEQ ID NO: 227333 - RNA, 22 nt, Homo sapiens
uucaagcuauggugaucuuuuc

SEQ ID NO: 227334 - RNA, 22 nt, Homo sapiens
uucaagucaacaagcacuugag

SEQ ID NO: 227335 - RNA, 22 nt, Homo sapiens
uucaagucuuggcuuugccacc

SEQ ID NO: 227336 - RNA, 20 nt, Homo sapiens
uucaagugauucucaugccu

SEQ ID NO: 227337 - RNA, 22 nt, Homo sapiens
uucaagugguucagaagucuga

SEQ ID NO: 227338 - RNA, 22 nt, Homo sapiens
uucaauuaauauuauacucuca

SEQ ID NO: 227339 - RNA, 22 nt, Homo sapiens
uucacacugggccuacucugug

SEQ ID NO: 227340 - RNA, 22 nt, Homo sapiens
uucacagccgcaccccaucacu

SEQ ID NO: 227341 - RNA, 16 nt, Homo sapiens
uucacauggcagcagg

SEQ ID NO: 227342 - RNA, 22 nt, Homo sapiens
uucacaugguugccuuuugauc

SEQ ID NO: 227343 - RNA, 22 nt, Homo sapiens
uucaccagggaagucucaacuc

SEQ ID NO: 227344 - RNA, 21 nt, Homo sapiens
uucaccauggcuccacacucu

SEQ ID NO: 227345 - RNA, 22 nt, Homo sapiens
uaggugguuugaaauacucaag

SEQ ID NO: 227346 - RNA, 19 nt, Homo sapiens
uaggugguuuuccccucac

SEQ ID NO: 227347 - RNA, 22 nt, Homo sapiens
uagguugucuucccagaguuuu

SEQ ID NO: 227348 - RNA, 22 nt, Homo sapiens
uaguaaacaccucagguaauuc

SEQ ID NO: 227349 - RNA, 22 nt, Homo sapiens
uaguaacacauugaacgaucgc

SEQ ID NO: 227350 - RNA, 22 nt, Homo sapiens
cugagcaaaguucuauuuaugg

SEQ ID NO: 227351 - RNA, 22 nt, Homo sapiens
cugagcaauauagugagaucuu

SEQ ID NO: 227352 - RNA, 22 nt, Homo sapiens
cugagguaauuuguugccagua

SEQ ID NO: 227353 - RNA, 22 nt, Homo sapiens
cugagguauuuaggugaaagaa

SEQ ID NO: 227354 - RNA, 22 nt, Homo sapiens
cugaggugggagaaucacauaa

SEQ ID NO: 227355 - RNA, 22 nt, Homo sapiens
cugagguuaggaguuugagacc

SEQ ID NO: 227356 - RNA, 20 nt, Homo sapiens
cugagguugggguccuuccc

SEQ ID NO: 227357 - RNA, 22 nt, Homo sapiens
cugagguuguucuucucagugg

SEQ ID NO: 227358 - RNA, 22 nt, Homo sapiens
cugaguauuugaggccgaagga

SEQ ID NO: 227359 - RNA, 22 nt, Homo sapiens
cugauacucuccuuuuagagag

SEQ ID NO: 227360 - RNA, 22 nt, Homo sapiens
cugaucuaugaacacaggauau

SEQ ID NO: 227361 - RNA, 22 nt, Homo sapiens
cugauguagguggucugugauc

SEQ ID NO: 227362 - RNA, 21 nt, Homo sapiens
cugcaaaugcugcugccugau

SEQ ID NO: 227363 - RNA, 22 nt, Homo sapiens
cugcaagaugcauaggaauuuu

SEQ ID NO: 227364 - RNA, 19 nt, Homo sapiens
cugcaagguaauaggucag

SEQ ID NO: 227365 - RNA, 22 nt, Homo sapiens
cugcaauguuugaaauggcaaa

SEQ ID NO: 227366 - RNA, 19 nt, Homo sapiens
cugcacugagaaaaggagg

SEQ ID NO: 227367 - RNA, 22 nt, Homo sapiens
cugcaguaaacuuucccauuca

SEQ ID NO: 227368 - RNA, 22 nt, Homo sapiens
cugcauaaucaucucucugcau

SEQ ID NO: 227369 - RNA, 21 nt, Homo sapiens
cugcauccauuucugagugau

SEQ ID NO: 227370 - RNA, 19 nt, Homo sapiens
cugcaugagacaguugguu

SEQ ID NO: 227371 - RNA, 22 nt, Homo sapiens
cugcauuugaugacguauggug

SEQ ID NO: 227372 - RNA, 18 nt, Homo sapiens
cugccagugugcucuccg

SEQ ID NO: 227373 - RNA, 22 nt, Homo sapiens
cugcccguaauccucuccccag

SEQ ID NO: 227374 - RNA, 22 nt, Homo sapiens
cugcuaagagaaugagacuuag

SEQ ID NO: 227375 - RNA, 20 nt, Homo sapiens
cugcuccccuacaaaucuca

SEQ ID NO: 227376 - RNA, 22 nt, Homo sapiens
cuggaaacaucuuaggaaugca

SEQ ID NO: 227377 - RNA, 22 nt, Homo sapiens
cuggaaagaaucaggcuaaacu

SEQ ID NO: 227378 - RNA, 22 nt, Homo sapiens
cuggaagcacaacgcauuuauu

SEQ ID NO: 227379 - RNA, 22 nt, Homo sapiens
cuggaaggaaaaacaaccacag

SEQ ID NO: 227380 - RNA, 22 nt, Homo sapiens
cuggaaucuagaaaagguaagg

SEQ ID NO: 227381 - RNA, 22 nt, Homo sapiens
cuggagcauugguggauuuguu

SEQ ID NO: 227382 - RNA, 22 nt, Homo sapiens
cuggagucugacugacacaagg

SEQ ID NO: 227383 - RNA, 22 nt, Homo sapiens
cuggauauguugcaacauuucc

SEQ ID NO: 227384 - RNA, 20 nt, Homo sapiens
cuggaucaucaguaaaguua

SEQ ID NO: 227385 - RNA, 22 nt, Homo sapiens
cuggcaaauguuuucuguaaag

SEQ ID NO: 227386 - RNA, 22 nt, Homo sapiens
cuggcaagagugaaccagcugu

SEQ ID NO: 227387 - RNA, 22 nt, Homo sapiens
cuggcacagugucagaaacaca

SEQ ID NO: 227388 - RNA, 22 nt, Homo sapiens
cuggcaccauacacuguuguug

SEQ ID NO: 227389 - RNA, 22 nt, Homo sapiens
cuggcagugcuuguuauccugg

SEQ ID NO: 227390 - RNA, 22 nt, Homo sapiens
cuggcaguguuucuugugggcu

SEQ ID NO: 227391 - RNA, 22 nt, Homo sapiens
cuggcucauuucauuuagcaua

SEQ ID NO: 227392 - RNA, 22 nt, Homo sapiens
cuggcugagugguaaguagagg

SEQ ID NO: 227393 - RNA, 22 nt, Homo sapiens
cugggguaggacuggcuuuuga

SEQ ID NO: 227394 - RNA, 22 nt, Homo sapiens
cugggucaguuucugauuauug

SEQ ID NO: 227395 - RNA, 22 nt, Homo sapiens
cugguaagaaggucuaagucaa

SEQ ID NO: 227396 - RNA, 22 nt, Homo sapiens
cugguaugcuucauaugcaaac

SEQ ID NO: 227397 - RNA, 23 nt, Homo sapiens
cuacagugccugucucuuuggcc

SEQ ID NO: 227398 - RNA, 22 nt, Homo sapiens
cuagaguacuuaccacagcaug

SEQ ID NO: 227399 - RNA, 22 nt, Homo sapiens
cuagcagcaugagaauggacca

SEQ ID NO: 227400 - RNA, 22 nt, Homo sapiens
cuagcaggcaagauaagauuca

SEQ ID NO: 227401 - RNA, 22 nt, Homo sapiens
cuagcccagugcuccuggauca

SEQ ID NO: 227402 - RNA, 22 nt, Homo sapiens
cuagcccugagauaaaugucau

SEQ ID NO: 227403 - RNA, 22 nt, Homo sapiens
cuaggcuuuucuuggauccagg

SEQ ID NO: 227404 - RNA, 22 nt, Homo sapiens
cuaggugauccacugcucucuu

SEQ ID NO: 227405 - RNA, 22 nt, Homo sapiens
cuauauacugccugcugauuag

SEQ ID NO: 227406 - RNA, 22 nt, Homo sapiens
cuaucucauugguuuuugaaag

SEQ ID NO: 227407 - RNA, 22 nt, Homo sapiens
cuaugcauuuuggaggagggaa

SEQ ID NO: 227408 - RNA, 22 nt, Homo sapiens
cuauggccugcuuagaacauac

SEQ ID NO: 227409 - RNA, 22 nt, Homo sapiens
cuauggcucugguuauggcugu

SEQ ID NO: 227410 - RNA, 22 nt, Homo sapiens
cuaugguaggggcuggaggaag

SEQ ID NO: 227411 - RNA, 22 nt, Homo sapiens
cuaugucuuucauauuuugggg

SEQ ID NO: 227412 - RNA, 19 nt, Homo sapiens
cuauugcacauagcugaag

SEQ ID NO: 227413 - RNA, 22 nt, Homo sapiens
cucaaguagugguuuucauuga

SEQ ID NO: 227414 - RNA, 20 nt, Homo sapiens
cucacagacagcuucuuucu

SEQ ID NO: 227415 - RNA, 22 nt, Homo sapiens
cucacagucagaagggacuugc

SEQ ID NO: 227416 - RNA, 22 nt, Homo sapiens
cucacagucucucccuaauuuu

SEQ ID NO: 227417 - RNA, 22 nt, Homo sapiens
cucacagugacacgaaccccca

SEQ ID NO: 227418 - RNA, 22 nt, Homo sapiens
cucacaguucuaaaggcaagaa

SEQ ID NO: 227419 - RNA, 22 nt, Homo sapiens
cucacugggaccacucugaagu

SEQ ID NO: 227420 - RNA, 22 nt, Homo sapiens
cucacuggguguaaaacaugua

SEQ ID NO: 227421 - RNA, 22 nt, Homo sapiens
cucagagcacaguuuaugacag

SEQ ID NO: 227422 - RNA, 22 nt, Homo sapiens
cucagcaguggauuuaccacca

SEQ ID NO: 227423 - RNA, 22 nt, Homo sapiens
cucagcuacuugagaggcuuag

SEQ ID NO: 227424 - RNA, 22 nt, Homo sapiens
cucagucuaugauacuuugcua

SEQ ID NO: 227425 - RNA, 22 nt, Homo sapiens
cucagugguugauuuauuuauc

SEQ ID NO: 227426 - RNA, 22 nt, Homo sapiens
cucagugucuggcacacagaaa

SEQ ID NO: 227427 - RNA, 22 nt, Homo sapiens
cucaguguuaaggccaccucug

SEQ ID NO: 227428 - RNA, 22 nt, Homo sapiens
cucauggagaaccucugcuagg

SEQ ID NO: 227429 - RNA, 22 nt, Homo sapiens
uagcacaucccuaaaaugcugu

SEQ ID NO: 227430 - RNA, 22 nt, Homo sapiens
uagcacaucuucuuggccugca

SEQ ID NO: 227431 - RNA, 22 nt, Homo sapiens
uagcaccaaacauauacucagu

SEQ ID NO: 227432 - RNA, 22 nt, Homo sapiens
uagcaccuuagcauuucuagug

SEQ ID NO: 227433 - RNA, 22 nt, Homo sapiens
uagcacuauguuaucacauacu

SEQ ID NO: 227434 - RNA, 22 nt, Homo sapiens
uagcacuauuuauugaaaagga

SEQ ID NO: 227435 - RNA, 23 nt, Homo sapiens
uagcacuuuuuacauauggacau

SEQ ID NO: 227436 - RNA, 22 nt, Homo sapiens
uagcagacuauuuugugauaau

SEQ ID NO: 227437 - RNA, 20 nt, Homo sapiens
uagcagcagacagagggagg

SEQ ID NO: 227438 - RNA, 22 nt, Homo sapiens
uagcagcauaaauggacuaaga

SEQ ID NO: 227439 - RNA, 22 nt, Homo sapiens
uagcagcauuuuuguagaguau

SEQ ID NO: 227440 - RNA, 22 nt, Homo sapiens
uagcagguggugaccacauuuu

SEQ ID NO: 227441 - RNA, 20 nt, Homo sapiens
uagcaggugucaggugauau

SEQ ID NO: 227442 - RNA, 22 nt, Homo sapiens
uagcaguaaagaaugugauguu

SEQ ID NO: 227443 - RNA, 22 nt, Homo sapiens
uagcaguaagaaacugacauug

SEQ ID NO: 227444 - RNA, 22 nt, Homo sapiens
uagcaguaucccaccaucuggu

SEQ ID NO: 227445 - RNA, 22 nt, Homo sapiens
uagcaguauggagcgaggccca

SEQ ID NO: 227446 - RNA, 22 nt, Homo sapiens
uagcagucucagaaugcauggu

SEQ ID NO: 227447 - RNA, 22 nt, Homo sapiens
uagcagugugaaaacagacuaa

SEQ ID NO: 227448 - RNA, 22 nt, Homo sapiens
uagccuguggugaauguuucug

SEQ ID NO: 227449 - RNA, 19 nt, Homo sapiens
uagcuagauuggguacuua

SEQ ID NO: 227450 - RNA, 22 nt, Homo sapiens
uagcuccacagcuauauauaau

SEQ ID NO: 227451 - RNA, 17 nt, Homo sapiens
uagcucuauuucuagcc

SEQ ID NO: 227452 - RNA, 18 nt, Homo sapiens
uagcucuuguugguccau

SEQ ID NO: 227453 - RNA, 22 nt, Homo sapiens
uagcugagacuacaguaggugc

SEQ ID NO: 227454 - RNA, 22 nt, Homo sapiens
uagcugcugcuaggcuaaggau

SEQ ID NO: 227455 - RNA, 22 nt, Homo sapiens
uagcuggaauuacuugcaccug

SEQ ID NO: 227456 - RNA, 23 nt, Homo sapiens
uagcuucucccagaccugcuccc

SEQ ID NO: 227457 - RNA, 22 nt, Homo sapiens
uaggacaaugguacagcagaaa

SEQ ID NO: 227458 - RNA, 22 nt, Homo sapiens
uaggacuuuuugguaggcggga

SEQ ID NO: 227459 - RNA, 20 nt, Homo sapiens
uaggagcaaugagaguagaa

SEQ ID NO: 227460 - RNA, 22 nt, Homo sapiens
uaggagcacaaacccuacugug

SEQ ID NO: 227461 - RNA, 22 nt, Homo sapiens
uaggagcacagcagcauguggg

SEQ ID NO: 227462 - RNA, 22 nt, Homo sapiens
uaggagugugaacccuguuuug

SEQ ID NO: 227463 - RNA, 22 nt, Homo sapiens
uaggcaaaugcaagaguagaac

SEQ ID NO: 227464 - RNA, 22 nt, Homo sapiens
uaggcaaguugcccaaucucuc

SEQ ID NO: 227465 - RNA, 22 nt, Homo sapiens
uaggcaauggagauagaggaug

SEQ ID NO: 227466 - RNA, 22 nt, Homo sapiens
uaggcacuguguuuguaggagu

SEQ ID NO: 227467 - RNA, 22 nt, Homo sapiens
uaggcagccagcuguggauuga

SEQ ID NO: 227468 - RNA, 22 nt, Homo sapiens
uaggcaguggagaaauaaacag

SEQ ID NO: 227469 - RNA, 22 nt, Homo sapiens
uaggcaguuuuccuuucacagu

SEQ ID NO: 227470 - RNA, 22 nt, Homo sapiens
uagggcaaggaacaguuaaaaa

SEQ ID NO: 227471 - RNA, 22 nt, Homo sapiens
uagggcuuuaguuugcuugugu

SEQ ID NO: 227472 - RNA, 22 nt, Homo sapiens
uagggcuuuccggccugucaga

SEQ ID NO: 227473 - RNA, 22 nt, Homo sapiens
uagggcuuuuccaagcugccac

SEQ ID NO: 227474 - RNA, 22 nt, Homo sapiens
uaggguaguaauaguuguuuca

SEQ ID NO: 227475 - RNA, 22 nt, Homo sapiens
uagguaaguaauauacagauga

SEQ ID NO: 227476 - RNA, 22 nt, Homo sapiens
uagguagaacccagaaaucuga

SEQ ID NO: 227477 - RNA, 22 nt, Homo sapiens
uagguagaaucuugaagccauu

SEQ ID NO: 227478 - RNA, 22 nt, Homo sapiens
uagguaggauagucuuuauuuu

SEQ ID NO: 227479 - RNA, 22 nt, Homo sapiens
uagguaucuugguauaucagga

SEQ ID NO: 227480 - RNA, 22 nt, Homo sapiens
uaggucuuuuagcauaggagcu

SEQ ID NO: 227481 - RNA, 22 nt, Homo sapiens
uaggugauugaagguggaaugu

SEQ ID NO: 227482 - RNA, 22 nt, Homo sapiens
uagguugucucuucacucugau

SEQ ID NO: 227483 - RNA, 22 nt, Homo sapiens
uaguaucacaagguguacaccc

SEQ ID NO: 227484 - RNA, 22 nt, Homo sapiens
uagucacacacucaacuuuuca

SEQ ID NO: 227485 - RNA, 22 nt, Homo sapiens
uaguccauuuucaugcugcuau

SEQ ID NO: 227486 - RNA, 22 nt, Homo sapiens
uagugaauguuggcuauuaaua

SEQ ID NO: 227487 - RNA, 22 nt, Homo sapiens
uagugcaguggcuccaucucag

SEQ ID NO: 227488 - RNA, 20 nt, Homo sapiens
uaguggaaaucagguccucu

SEQ ID NO: 227489 - RNA, 22 nt, Homo sapiens
uaguggauguucagagauuuga

SEQ ID NO: 227490 - RNA, 22 nt, Homo sapiens
uaguggucccccagucccagcu

SEQ ID NO: 227491 - RNA, 22 nt, Homo sapiens
uaguguuuuucauuggcagagg

SEQ ID NO: 227492 - RNA, 22 nt, Homo sapiens
uaguucauuauguguugcucag

SEQ ID NO: 227493 - RNA, 22 nt, Homo sapiens
uauaagguuaggaaaaauuucu

SEQ ID NO: 227494 - RNA, 22 nt, Homo sapiens
uauacacgugugcauauauaca

SEQ ID NO: 227495 - RNA, 22 nt, Homo sapiens
uuccaguggaguaaauggacaa

SEQ ID NO: 227496 - RNA, 22 nt, Homo sapiens
uuccagugggacgagaugugga

SEQ ID NO: 227497 - RNA, 22 nt, Homo sapiens
uuccaugagaugcaucaaagcu

SEQ ID NO: 227498 - RNA, 22 nt, Homo sapiens
uuccauguugauacgugaaguu

SEQ ID NO: 227499 - RNA, 22 nt, Homo sapiens
uuccauuuguucggugucgcca

SEQ ID NO: 227500 - RNA, 22 nt, Homo sapiens
uucccagagaaaaggguuucuu

SEQ ID NO: 227501 - RNA, 22 nt, Homo sapiens
uucccauuguuggccagcaugu

SEQ ID NO: 227502 - RNA, 22 nt, Homo sapiens
uucccgggguggaaugcaguga

SEQ ID NO: 227503 - RNA, 22 nt, Homo sapiens
uucccguugcugugcuccugcc

SEQ ID NO: 227504 - RNA, 22 nt, Homo sapiens
uucccugaaauauucacuuuca

SEQ ID NO: 227505 - RNA, 22 nt, Homo sapiens
uucccugaaguguuacucuaga

SEQ ID NO: 227506 - RNA, 22 nt, Homo sapiens
uucccuugcaggaugaucugga

SEQ ID NO: 227507 - RNA, 22 nt, Homo sapiens
uucccuuucugaaaaucucauu

SEQ ID NO: 227508 - RNA, 22 nt, Homo sapiens
uucccuuugugcauaggauuug

SEQ ID NO: 227509 - RNA, 22 nt, Homo sapiens
uucccuuuuuucuaguagguag

SEQ ID NO: 227510 - RNA, 22 nt, Homo sapiens
uuccuacugugcaaaguugcaa

SEQ ID NO: 227511 - RNA, 19 nt, Homo sapiens
uuccugagaacaagggcuu

SEQ ID NO: 227512 - RNA, 22 nt, Homo sapiens
uuccugagagggcugggugcag

SEQ ID NO: 227513 - RNA, 22 nt, Homo sapiens
uuccugagaucagaauucaaau

SEQ ID NO: 227514 - RNA, 22 nt, Homo sapiens
uuccuguagcgauuuuaguaau

SEQ ID NO: 227515 - RNA, 22 nt, Homo sapiens
uuccugucuuccaagagagauu

SEQ ID NO: 227516 - RNA, 22 nt, Homo sapiens
uuccuugaaacagucaagagaa

SEQ ID NO: 227517 - RNA, 22 nt, Homo sapiens
uuccuugagagcuugauaucac

SEQ ID NO: 227518 - RNA, 22 nt, Homo sapiens
uuccuugguucagggaaggucc

SEQ ID NO: 227519 - RNA, 22 nt, Homo sapiens
uuccuuguagcaaaugcgauga

SEQ ID NO: 227520 - RNA, 22 nt, Homo sapiens
uuccuugugacuaguagugacc

SEQ ID NO: 227521 - RNA, 22 nt, Homo sapiens
uuccuuguuuauuuacaggagg

SEQ ID NO: 227522 - RNA, 22 nt, Homo sapiens
uucgcagcucaguucaacuagg

SEQ ID NO: 227523 - RNA, 22 nt, Homo sapiens
uucuacaugggucgucggugag

SEQ ID NO: 227524 - RNA, 22 nt, Homo sapiens
cucauggagauagagaauagaa

SEQ ID NO: 227525 - RNA, 22 nt, Homo sapiens
cucauuaguuguuuuaagauga

SEQ ID NO: 227526 - RNA, 22 nt, Homo sapiens
cuccaggugucauccaccuccu

SEQ ID NO: 227527 - RNA, 22 nt, Homo sapiens
cuccaguuucagaaucccaugu

SEQ ID NO: 227528 - RNA, 22 nt, Homo sapiens
cuccauagucuucgaagaauga

SEQ ID NO: 227529 - RNA, 22 nt, Homo sapiens
cuccaugagauuguugaaguag

SEQ ID NO: 227530 - RNA, 22 nt, Homo sapiens
cuccauguggcuaacuuuuaaa

SEQ ID NO: 227531 - RNA, 22 nt, Homo sapiens
cucccagagccaguuauaggcu

SEQ ID NO: 227532 - RNA, 22 nt, Homo sapiens
cucccagugacccaggaacagg

SEQ ID NO: 227533 - RNA, 20 nt, Homo sapiens
cucccugacaaauguggaaa

SEQ ID NO: 227534 - RNA, 22 nt, Homo sapiens
cucucugagccccagacaccuu

SEQ ID NO: 227535 - RNA, 22 nt, Homo sapiens
cucugacagugguuagcacugu

SEQ ID NO: 227536 - RNA, 22 nt, Homo sapiens
cucugcuuaaugucccacuuga

SEQ ID NO: 227537 - RNA, 22 nt, Homo sapiens
cucuggauauuccugucuaaaa

SEQ ID NO: 227538 - RNA, 20 nt, Homo sapiens
cucugguugugaauugucuu

SEQ ID NO: 227539 - RNA, 22 nt, Homo sapiens
cucugguuucgcaggaaauaga

SEQ ID NO: 227540 - RNA, 22 nt, Homo sapiens
cucuuuaguaagcaguugauga

SEQ ID NO: 227541 - RNA, 22 nt, Homo sapiens
cucuuuuguuccuaguuugauc

SEQ ID NO: 227542 - RNA, 22 nt, Homo sapiens
cucuuuuguuuagcugagaggg

SEQ ID NO: 227543 - RNA, 22 nt, Homo sapiens
cugaaagagcauguaacacagu

SEQ ID NO: 227544 - RNA, 22 nt, Homo sapiens
cugaaaucagccaguuaguuuc

SEQ ID NO: 227545 - RNA, 22 nt, Homo sapiens
cugaaggcagguagaauagaga

SEQ ID NO: 227546 - RNA, 22 nt, Homo sapiens
cugaagugcuugccacauaaaa

SEQ ID NO: 227547 - RNA, 22 nt, Homo sapiens
cugaauagagcacacugauggg

SEQ ID NO: 227548 - RNA, 22 nt, Homo sapiens
cugaauagucaacgauggacug

SEQ ID NO: 227549 - RNA, 22 nt, Homo sapiens
cugaauguucuggauggaagag

SEQ ID NO: 227550 - RNA, 22 nt, Homo sapiens
cugaauguuucacucugaaaug

SEQ ID NO: 227551 - RNA, 22 nt, Homo sapiens
cugaauguuuucuucuauucug

SEQ ID NO: 227552 - RNA, 22 nt, Homo sapiens
cugacacuucaaaacugccaau

SEQ ID NO: 227553 - RNA, 22 nt, Homo sapiens
cugacagucucauugauuugcu

SEQ ID NO: 227554 - RNA, 22 nt, Homo sapiens
cugacaugcagccacugcaccu

SEQ ID NO: 227555 - RNA, 22 nt, Homo sapiens
cugagacuggguaauguauaaa

SEQ ID NO: 227556 - RNA, 22 nt, Homo sapiens
cugagagaugagaccucucacu

SEQ ID NO: 227557 - RNA, 22 nt, Homo sapiens
cugagagugguauguuuaagug

SEQ ID NO: 227558 - RNA, 22 nt, Homo sapiens
cugagaguugaugaaauauggu

SEQ ID NO: 227559 - RNA, 22 nt, Homo sapiens
cugagauacacuaauagucucu

SEQ ID NO: 227560 - RNA, 22 nt, Homo sapiens
cugagauaggacucugcuggcu

SEQ ID NO: 227561 - RNA, 22 nt, Homo sapiens
cugagcaaaaugaagacacgau

SEQ ID NO: 227562 - RNA, 22 nt, Homo sapiens
cugagcaaagaagugauaauga

SEQ ID NO: 227563 - RNA, 22 nt, Homo sapiens
cugagcaagucauuuuguuaaa

SEQ ID NO: 227564 - RNA, 22 nt, Homo sapiens
cugagcacugagauccucuagc

SEQ ID NO: 227565 - RNA, 22 nt, Homo sapiens
cugagcuaguagcauuguguca

SEQ ID NO: 227566 - RNA, 22 nt, Homo sapiens
cugagcucauuucuuuugcuac

SEQ ID NO: 227567 - RNA, 22 nt, Homo sapiens
cugaggaaguucuuuaacaguu

SEQ ID NO: 227568 - RNA, 22 nt, Homo sapiens
cugaggcacggcgaccuuaagu

SEQ ID NO: 227569 - RNA, 22 nt, Homo sapiens
cugagguaauuuuccagauaau

SEQ ID NO: 227570 - RNA, 22 nt, Homo sapiens
cugagguacccacuucaucuca

SEQ ID NO: 227571 - RNA, 20 nt, Homo sapiens
cugagguacgaggguuaaau

SEQ ID NO: 227572 - RNA, 22 nt, Homo sapiens
cugagguaggugaucagugcuu

SEQ ID NO: 227573 - RNA, 22 nt, Homo sapiens
cugaggugauauauacauauuu

SEQ ID NO: 227574 - RNA, 22 nt, Homo sapiens
cugaggugggaggauuacuuga

SEQ ID NO: 227575 - RNA, 22 nt, Homo sapiens
cugaggugggaggauuggcuug

SEQ ID NO: 227576 - RNA, 22 nt, Homo sapiens
cugaguauaacugaccuuauga

SEQ ID NO: 227577 - RNA, 22 nt, Homo sapiens
cugauaguucucuuuagaguuu

SEQ ID NO: 227578 - RNA, 22 nt, Homo sapiens
cugaucuggaggugucugggga

SEQ ID NO: 227579 - RNA, 22 nt, Homo sapiens
cugauugucuauuuaguucacu

SEQ ID NO: 227580 - RNA, 22 nt, Homo sapiens
cugcagguaggggcagcuuugg

SEQ ID NO: 227581 - RNA, 22 nt, Homo sapiens
cugcaguaaccacuguaggugu

SEQ ID NO: 227582 - RNA, 22 nt, Homo sapiens
cugcauuggguuaugcauuuuu

SEQ ID NO: 227583 - RNA, 22 nt, Homo sapiens
cugccuagaucugaaccuggcu

SEQ ID NO: 227584 - RNA, 22 nt, Homo sapiens
cugccuagauguuguagggggu

SEQ ID NO: 227585 - RNA, 22 nt, Homo sapiens
cugccugagaaaauggagggca

SEQ ID NO: 227586 - RNA, 22 nt, Homo sapiens
cuggaaagcaaagggugcauug

SEQ ID NO: 227587 - RNA, 22 nt, Homo sapiens
cuggaaaguagacaaucuaaaa

SEQ ID NO: 227588 - RNA, 22 nt, Homo sapiens
cuggaauauuagcuggucuuaa

SEQ ID NO: 227589 - RNA, 22 nt, Homo sapiens
cuggaaucuauggauaacaucg

SEQ ID NO: 227590 - RNA, 22 nt, Homo sapiens
cuggaauguuccuaaagauuca

SEQ ID NO: 227591 - RNA, 22 nt, Homo sapiens
cuggacaaaucuggaaagaacc

SEQ ID NO: 227592 - RNA, 22 nt, Homo sapiens
cuggagaucuugacauugaagu

SEQ ID NO: 227593 - RNA, 22 nt, Homo sapiens
ucaaauguucccuguacuggcc

SEQ ID NO: 227594 - RNA, 22 nt, Homo sapiens
ucaaauuccaagucuagguagg

SEQ ID NO: 227595 - RNA, 21 nt, Homo sapiens
ucaaauugaaauuaggucauu

SEQ ID NO: 227596 - RNA, 22 nt, Homo sapiens
ucaagaccucacauagaggaga

SEQ ID NO: 227597 - RNA, 22 nt, Homo sapiens
ucaagcaauucgccugucucag

SEQ ID NO: 227598 - RNA, 22 nt, Homo sapiens
ucaagcaauucuccugccucag

SEQ ID NO: 227599 - RNA, 18 nt, Homo sapiens
ucaagcaauugucaugcc

SEQ ID NO: 227600 - RNA, 21 nt, Homo sapiens
ucaaggaguauacguaugcca

SEQ ID NO: 227601 - RNA, 22 nt, Homo sapiens
ucaaggcacuagcugagcugca

SEQ ID NO: 227602 - RNA, 22 nt, Homo sapiens
ucaaguacuuugcauagugccg

SEQ ID NO: 227603 - RNA, 22 nt, Homo sapiens
ucaagugauucuugugccuuag

SEQ ID NO: 227604 - RNA, 22 nt, Homo sapiens
ucaagugcauaugcuaacgguu

SEQ ID NO: 227605 - RNA, 22 nt, Homo sapiens
ucaaugaaugaugguugguaug

SEQ ID NO: 227606 - RNA, 19 nt, Homo sapiens
ucaauucugucaauggcuu

SEQ ID NO: 227607 - RNA, 22 nt, Homo sapiens
ucacaaagcuuggccugcuucu

SEQ ID NO: 227608 - RNA, 20 nt, Homo sapiens
ucacaagccaagaucacguc

SEQ ID NO: 227609 - RNA, 22 nt, Homo sapiens
ucacaaguguauagacaugucc

SEQ ID NO: 227610 - RNA, 22 nt, Homo sapiens
ucacaauucacuacaggcuuga

SEQ ID NO: 227611 - RNA, 22 nt, Homo sapiens
ucacaccauucuucuacuucag

SEQ ID NO: 227612 - RNA, 19 nt, Homo sapiens
ucacacuguggcuucuuua

SEQ ID NO: 227613 - RNA, 22 nt, Homo sapiens
ucacagaugcuugacccauuuc

SEQ ID NO: 227614 - RNA, 21 nt, Homo sapiens
ucacagccuaggaccugaaga

SEQ ID NO: 227615 - RNA, 22 nt, Homo sapiens
ucacagcuaaaaugaaaguagu

SEQ ID NO: 227616 - RNA, 22 nt, Homo sapiens
ucacaguaucaugggggacaga

SEQ ID NO: 227617 - RNA, 22 nt, Homo sapiens
ucacaguauggggggugguuau

SEQ ID NO: 227618 - RNA, 22 nt, Homo sapiens
ucacagucuccucuagggaggg

SEQ ID NO: 227619 - RNA, 22 nt, Homo sapiens
ucacagugaguggaguggggug

SEQ ID NO: 227620 - RNA, 22 nt, Homo sapiens
uucuacuucauuaggaggauug

SEQ ID NO: 227621 - RNA, 22 nt, Homo sapiens
uucuagagagaagacuuaagcu

SEQ ID NO: 227622 - RNA, 22 nt, Homo sapiens
uucucagcccccugacagucag

SEQ ID NO: 227623 - RNA, 22 nt, Homo sapiens
uucuccugguggacccuaaacg

SEQ ID NO: 227624 - RNA, 22 nt, Homo sapiens
uucugccaaucaacccacaucc

SEQ ID NO: 227625 - RNA, 22 nt, Homo sapiens
uucugcuugaucuaguguguug

SEQ ID NO: 227626 - RNA, 22 nt, Homo sapiens
uucuggccccucccaaucucau

SEQ ID NO: 227627 - RNA, 22 nt, Homo sapiens
uucuggccuccauuuuucuccu

SEQ ID NO: 227628 - RNA, 22 nt, Homo sapiens
uucuggcuaugggauacuaaau

SEQ ID NO: 227629 - RNA, 22 nt, Homo sapiens
uucuggcuuauaaacgugacuu

SEQ ID NO: 227630 - RNA, 22 nt, Homo sapiens
uucugugguagaaaucucaaau

SEQ ID NO: 227631 - RNA, 22 nt, Homo sapiens
uucugugguuucauuuaccugu

SEQ ID NO: 227632 - RNA, 22 nt, Homo sapiens
uucuuagucaaguuguauuuca

SEQ ID NO: 227633 - RNA, 21 nt, Homo sapiens
uucuucaggcagaaggauuau

SEQ ID NO: 227634 - RNA, 22 nt, Homo sapiens
uucuugcacugaucccauaagc

SEQ ID NO: 227635 - RNA, 22 nt, Homo sapiens
uucuugcacuuaacugacauuc

SEQ ID NO: 227636 - RNA, 22 nt, Homo sapiens
uucuugcacuuggcccucauua

SEQ ID NO: 227637 - RNA, 22 nt, Homo sapiens
uucuugcugaauugugcccuuc

SEQ ID NO: 227638 - RNA, 21 nt, Homo sapiens
uucuuugcucaguguuagagu

SEQ ID NO: 227639 - RNA, 22 nt, Homo sapiens
uugaaagaaaggagacugaguu

SEQ ID NO: 227640 - RNA, 22 nt, Homo sapiens
uugaaagcuaucagagauucca

SEQ ID NO: 227641 - RNA, 22 nt, Homo sapiens
uugaagacuaccuaccauacuu

SEQ ID NO: 227642 - RNA, 22 nt, Homo sapiens
uugaagagaaccgcggcuuauu

SEQ ID NO: 227643 - RNA, 22 nt, Homo sapiens
uugaaggaacgcuguucccuug

SEQ ID NO: 227644 - RNA, 19 nt, Homo sapiens
uugaaggccgccuugcaga

SEQ ID NO: 227645 - RNA, 22 nt, Homo sapiens
uugaaguagaaagacgaaauuu

SEQ ID NO: 227646 - RNA, 22 nt, Homo sapiens
uugaaguaguacuuuauuauag

SEQ ID NO: 227647 - RNA, 22 nt, Homo sapiens
uugaauagaagguuuuuuguuc

SEQ ID NO: 227648 - RNA, 22 nt, Homo sapiens
uugaauagaaguguugaaagug

SEQ ID NO: 227649 - RNA, 18 nt, Homo sapiens
uugaauaguguccaaucu

SEQ ID NO: 227650 - RNA, 22 nt, Homo sapiens
uugaaugaaaugaugucauuug

SEQ ID NO: 227651 - RNA, 18 nt, Homo sapiens
uugaaugcgucccagaga

SEQ ID NO: 227652 - RNA, 22 nt, Homo sapiens
uugaauggaauguuggaacuau

SEQ ID NO: 227653 - RNA, 22 nt, Homo sapiens
uugaauguacuuguucucacua

SEQ ID NO: 227654 - RNA, 22 nt, Homo sapiens
uugaaugucuauuaaguuguuu

SEQ ID NO: 227655 - RNA, 22 nt, Homo sapiens
uugacaaugcacugugcuaagu

SEQ ID NO: 227656 - RNA, 22 nt, Homo sapiens
uugacacuaauuauuauaggug

SEQ ID NO: 227657 - RNA, 22 nt, Homo sapiens
uugacacuuuguaagaaagggg

SEQ ID NO: 227658 - RNA, 22 nt, Homo sapiens
uugacaguugggcagggaaguu

SEQ ID NO: 227659 - RNA, 22 nt, Homo sapiens
uugacauaguuucugaaauaga

SEQ ID NO: 227660 - RNA, 22 nt, Homo sapiens
uugacguaggaggauguugaga

SEQ ID NO: 227661 - RNA, 22 nt, Homo sapiens
uugacuagaccaucuuucuaga

SEQ ID NO: 227662 - RNA, 22 nt, Homo sapiens
uugacugggccagacagagauc

SEQ ID NO: 227663 - RNA, 21 nt, Homo sapiens
uugagacggagucucacucug

SEQ ID NO: 227664 - RNA, 22 nt, Homo sapiens
uugagagaaaaggccaugccuu

SEQ ID NO: 227665 - RNA, 22 nt, Homo sapiens
uugagagcugaugaaagauaaa

SEQ ID NO: 227666 - RNA, 17 nt, Homo sapiens
uugagaguauaucuuac

SEQ ID NO: 227667 - RNA, 22 nt, Homo sapiens
uugagauagggucuaccucugu

SEQ ID NO: 227668 - RNA, 22 nt, Homo sapiens
uugagaucaugcuacugcacuc

SEQ ID NO: 227669 - RNA, 22 nt, Homo sapiens
uugagauggagucuugcucuug

SEQ ID NO: 227670 - RNA, 22 nt, Homo sapiens
uugagauggauagacauagcau

SEQ ID NO: 227671 - RNA, 19 nt, Homo sapiens
uugagaugugaacucacac

SEQ ID NO: 227672 - RNA, 22 nt, Homo sapiens
uugagcaccaugccuggccaug

SEQ ID NO: 227673 - RNA, 22 nt, Homo sapiens
uugagccaaggauugucuuucc

SEQ ID NO: 227674 - RNA, 22 nt, Homo sapiens
uugagcuauguacagaugcugu

SEQ ID NO: 227675 - RNA, 22 nt, Homo sapiens
uugagcuuuuuacuuguccaau

SEQ ID NO: 227676 - RNA, 22 nt, Homo sapiens
uugaggaaugugauuucaaaua

SEQ ID NO: 227677 - RNA, 22 nt, Homo sapiens
uugaggacugagacagaccaag

SEQ ID NO: 227678 - RNA, 22 nt, Homo sapiens
uugaggacugcuaagcauuuga

SEQ ID NO: 227679 - RNA, 22 nt, Homo sapiens
uugaggaucauuguuuucggag

SEQ ID NO: 227680 - RNA, 23 nt, Homo sapiens
uugaggcauguaccaucaauauc

SEQ ID NO: 227681 - RNA, 16 nt, Homo sapiens
uugaggcaugucucag

SEQ ID NO: 227682 - RNA, 22 nt, Homo sapiens
uugaggcuuuugaccucaugug

SEQ ID NO: 227683 - RNA, 22 nt, Homo sapiens
uugagggaagccagaggucugc

SEQ ID NO: 227684 - RNA, 22 nt, Homo sapiens
uugagggagcauuuguuuugag

SEQ ID NO: 227685 - RNA, 22 nt, Homo sapiens
uugagggaggccucaguuuaca

SEQ ID NO: 227686 - RNA, 22 nt, Homo sapiens
uugaggguggcauauauugauu

SEQ ID NO: 227687 - RNA, 21 nt, Homo sapiens
uugagguaaaauccuauggga

SEQ ID NO: 227688 - RNA, 22 nt, Homo sapiens
uugagguaggaggagcuuggau

SEQ ID NO: 227689 - RNA, 22 nt, Homo sapiens
uugagguauugauaaaacauuu

SEQ ID NO: 227690 - RNA, 22 nt, Homo sapiens
uugaggugaagggcagagcagc

SEQ ID NO: 227691 - RNA, 22 nt, Homo sapiens
cuacucugugguguauuugcau

SEQ ID NO: 227692 - RNA, 22 nt, Homo sapiens
cuagaacuagaacugcuggggu

SEQ ID NO: 227693 - RNA, 22 nt, Homo sapiens
cuagaagguaagagcuggaugc

SEQ ID NO: 227694 - RNA, 22 nt, Homo sapiens
cuagacacugacguuccuccga

SEQ ID NO: 227695 - RNA, 22 nt, Homo sapiens
cuagcacauaguuauucacuca

SEQ ID NO: 227696 - RNA, 22 nt, Homo sapiens
cuagcagcauaagaaucaccaa

SEQ ID NO: 227697 - RNA, 22 nt, Homo sapiens
cuagcugcacuuccugcuacug

SEQ ID NO: 227698 - RNA, 22 nt, Homo sapiens
cuaggcuguagagaaguucagu

SEQ ID NO: 227699 - RNA, 19 nt, Homo sapiens
cuaguaccacuucuucuga

SEQ ID NO: 227700 - RNA, 18 nt, Homo sapiens
cuaguguuucuugaauca

SEQ ID NO: 227701 - RNA, 22 nt, Homo sapiens
cuaucacuguuuugaugcccgg

SEQ ID NO: 227702 - RNA, 22 nt, Homo sapiens
cuaugagucugcagaucuauua

SEQ ID NO: 227703 - RNA, 22 nt, Homo sapiens
cuaugcuuucugggcccugggu

SEQ ID NO: 227704 - RNA, 22 nt, Homo sapiens
cuauggguuauaauucauuagu

SEQ ID NO: 227705 - RNA, 22 nt, Homo sapiens
cuaugguuucuccauaucauca

SEQ ID NO: 227706 - RNA, 22 nt, Homo sapiens
cuauuagguuggugcaaaagua

SEQ ID NO: 227707 - RNA, 22 nt, Homo sapiens
cuauucacaauggugaagauau

SEQ ID NO: 227708 - RNA, 22 nt, Homo sapiens
cuauucacaggcaauauguaca

SEQ ID NO: 227709 - RNA, 21 nt, Homo sapiens
cucaaaguacugauauuacag

SEQ ID NO: 227710 - RNA, 22 nt, Homo sapiens
cucaaaguacuuugguuauugu

SEQ ID NO: 227711 - RNA, 22 nt, Homo sapiens
cucaaagugcuaagauuaggcu

SEQ ID NO: 227712 - RNA, 22 nt, Homo sapiens
cucaaagugcugggauuggcca

SEQ ID NO: 227713 - RNA, 22 nt, Homo sapiens
cucaaguaauccucccgccuug

SEQ ID NO: 227714 - RNA, 22 nt, Homo sapiens
cucaaguacaugggauuacagg

SEQ ID NO: 227715 - RNA, 22 nt, Homo sapiens
cucaauuuggaauugucaguaa

SEQ ID NO: 227716 - RNA, 18 nt, Homo sapiens
cucacacccuaaucagga

SEQ ID NO: 227717 - RNA, 22 nt, Homo sapiens
cucacaugcucaccugguguuc

SEQ ID NO: 227718 - RNA, 22 nt, Homo sapiens
cucaccuugugauccacccgcc

SEQ ID NO: 227719 - RNA, 22 nt, Homo sapiens
cucacuaggaaguaaaguuugu

SEQ ID NO: 227720 - RNA, 22 nt, Homo sapiens
cucacuaguaaggcuguuuagu

SEQ ID NO: 227721 - RNA, 22 nt, Homo sapiens
cucacugcauuucaguuuuguu

SEQ ID NO: 227722 - RNA, 22 nt, Homo sapiens
cucacugugguguccuuaggua

SEQ ID NO: 227723 - RNA, 22 nt, Homo sapiens
cucagauacuugggagguugag

SEQ ID NO: 227724 - RNA, 22 nt, Homo sapiens
cucagcuacuugggaagcugag

SEQ ID NO: 227725 - RNA, 22 nt, Homo sapiens
cucagggugguggacucuaaua

SEQ ID NO: 227726 - RNA, 20 nt, Homo sapiens
cucagguauuugaggcugca

SEQ ID NO: 227727 - RNA, 22 nt, Homo sapiens
cucagugaagggcaagaggcaa

SEQ ID NO: 227728 - RNA, 22 nt, Homo sapiens
cucaguguucccauucuaccuu

SEQ ID NO: 227729 - RNA, 22 nt, Homo sapiens
cucaguguuucagcugcucaga

SEQ ID NO: 227730 - RNA, 22 nt, Homo sapiens
cucauugcaaucuccaccuccc

SEQ ID NO: 227731 - RNA, 22 nt, Homo sapiens
cucauuggcuacugaggcuugu

SEQ ID NO: 227732 - RNA, 22 nt, Homo sapiens
cuccaggugagguuaagggacu

SEQ ID NO: 227733 - RNA, 23 nt, Homo sapiens
cuccaugagccguccagggccug

SEQ ID NO: 227734 - RNA, 22 nt, Homo sapiens
cuccauuuaucugaaauuuuau

SEQ ID NO: 227735 - RNA, 22 nt, Homo sapiens
cuccauuuggaacagauguccu

SEQ ID NO: 227736 - RNA, 22 nt, Homo sapiens
cucccauugcaaacaacagaag

SEQ ID NO: 227737 - RNA, 22 nt, Homo sapiens
cuccuggugauuggagugugaa

SEQ ID NO: 227738 - RNA, 22 nt, Homo sapiens
cucgagagaaaaugcuucacug

SEQ ID NO: 227739 - RNA, 22 nt, Homo sapiens
cucucaagaugcugggauuaca

SEQ ID NO: 227740 - RNA, 21 nt, Homo sapiens
cucucugcuuaugaauaguga

SEQ ID NO: 227741 - RNA, 22 nt, Homo sapiens
cucucuguuugucuguuauugg

SEQ ID NO: 227742 - RNA, 22 nt, Homo sapiens
cucugauggagauauacaagga

SEQ ID NO: 227743 - RNA, 21 nt, Homo sapiens
cucugguuugcauuggauuau

SEQ ID NO: 227744 - RNA, 22 nt, Homo sapiens
cucuuacaguguguggugaaag

SEQ ID NO: 227745 - RNA, 22 nt, Homo sapiens
cucuuagauuagccauccuaau

SEQ ID NO: 227746 - RNA, 22 nt, Homo sapiens
cugaaaagcaucugcauagcug

SEQ ID NO: 227747 - RNA, 22 nt, Homo sapiens
cugaaagagcauuugaaugggu

SEQ ID NO: 227748 - RNA, 22 nt, Homo sapiens
cugaaaugaauuauuuucuuuc

SEQ ID NO: 227749 - RNA, 20 nt, Homo sapiens
cugaaugucaaggcagaggu

SEQ ID NO: 227750 - RNA, 22 nt, Homo sapiens
cugacaagugaucacagcagca

SEQ ID NO: 227751 - RNA, 22 nt, Homo sapiens
cugacaucuucaagugaggaga

SEQ ID NO: 227752 - RNA, 22 nt, Homo sapiens
cugaccauagacuacucugggc

SEQ ID NO: 227753 - RNA, 22 nt, Homo sapiens
cugacguguuuuccagaccuuu

SEQ ID NO: 227754 - RNA, 22 nt, Homo sapiens
cugacucagacacauguauaug

SEQ ID NO: 227755 - RNA, 22 nt, Homo sapiens
cugacuuauguggacuauuuca

SEQ ID NO: 227756 - RNA, 22 nt, Homo sapiens
cugacuuuagaacccaaaaagu

SEQ ID NO: 227757 - RNA, 22 nt, Homo sapiens
cugagaagaaacagguaaggac

SEQ ID NO: 227758 - RNA, 22 nt, Homo sapiens
cugagagaggagcuaaaacugc

SEQ ID NO: 227759 - RNA, 22 nt, Homo sapiens
cugagauaauuucuagguguca

SEQ ID NO: 227760 - RNA, 22 nt, Homo sapiens
cugagcccauucuggggagaag

SEQ ID NO: 227761 - RNA, 22 nt, Homo sapiens
cugagcuaugccuggaaaggca

SEQ ID NO: 227762 - RNA, 22 nt, Homo sapiens
cugaggacaucagggaagcauc

SEQ ID NO: 227763 - RNA, 22 nt, Homo sapiens
cugagguacugggggccaggau

SEQ ID NO: 227764 - RNA, 22 nt, Homo sapiens
cugagguaggcccugagaauau

SEQ ID NO: 227765 - RNA, 22 nt, Homo sapiens
cugagguauaucccauuagaag

SEQ ID NO: 227766 - RNA, 22 nt, Homo sapiens
cugaggugggaguuuuucucau

SEQ ID NO: 227767 - RNA, 18 nt, Homo sapiens
cugagucauuccuggguc

SEQ ID NO: 227768 - RNA, 22 nt, Homo sapiens
cugagugcaagugauccuccca

SEQ ID NO: 227769 - RNA, 22 nt, Homo sapiens
cugauaaguuuuucuuuauaag

SEQ ID NO: 227770 - RNA, 22 nt, Homo sapiens
cugauacugaaagcuguugguu

SEQ ID NO: 227771 - RNA, 22 nt, Homo sapiens
acacuguccaguuaggcuacau

SEQ ID NO: 227772 - RNA, 22 nt, Homo sapiens
acacuguugacauuuuguagug

SEQ ID NO: 227773 - RNA, 22 nt, Homo sapiens
acacuguuuuaguuauuauagc

SEQ ID NO: 227774 - RNA, 22 nt, Homo sapiens
acacuguuuuguggagaaugua

SEQ ID NO: 227775 - RNA, 22 nt, Homo sapiens
acacuugcuugcaauagccucc

SEQ ID NO: 227776 - RNA, 22 nt, Homo sapiens
acagaauucucagaacugggag

SEQ ID NO: 227777 - RNA, 19 nt, Homo sapiens
acagauagaauguucuaca

SEQ ID NO: 227778 - RNA, 22 nt, Homo sapiens
acagauugcugggccccagccc

SEQ ID NO: 227779 - RNA, 22 nt, Homo sapiens
acaggagugggauuugaguccu

SEQ ID NO: 227780 - RNA, 22 nt, Homo sapiens
acaggguuauuguaauaaugua

SEQ ID NO: 227781 - RNA, 22 nt, Homo sapiens
acaguaaugggccccuuuuccu

SEQ ID NO: 227782 - RNA, 21 nt, Homo sapiens
acaguacuugagaucuuuuga

SEQ ID NO: 227783 - RNA, 20 nt, Homo sapiens
acaguauguuuggaugcaua

SEQ ID NO: 227784 - RNA, 23 nt, Homo sapiens
acagucuaguuugaagucaggua

SEQ ID NO: 227785 - RNA, 18 nt, Homo sapiens
acagugcugucacugcuu

SEQ ID NO: 227786 - RNA, 23 nt, Homo sapiens
acaguggugugaucuuggcucag

SEQ ID NO: 227787 - RNA, 22 nt, Homo sapiens
acaguguacaauagccuuuuaa

SEQ ID NO: 227788 - RNA, 22 nt, Homo sapiens
acagugucaugucguguucccc

SEQ ID NO: 227789 - RNA, 18 nt, Homo sapiens
acaguguguaaggguucu

SEQ ID NO: 227790 - RNA, 22 nt, Homo sapiens
acaguguuccuuuguugugacu

SEQ ID NO: 227791 - RNA, 22 nt, Homo sapiens
acauaaagaagcaggacauugu

SEQ ID NO: 227792 - RNA, 22 nt, Homo sapiens
acauaguagacacugaaaauau

SEQ ID NO: 227793 - RNA, 22 nt, Homo sapiens
guacaguuuagugcuuugagaa

SEQ ID NO: 227794 - RNA, 22 nt, Homo sapiens
guacccaguagauaguuuuuca

SEQ ID NO: 227795 - RNA, 22 nt, Homo sapiens
guagaagcacagggccuguauu

SEQ ID NO: 227796 - RNA, 22 nt, Homo sapiens
guagaauguauguauaacgcaa

SEQ ID NO: 227797 - RNA, 22 nt, Homo sapiens
guagaccauuuaucuggggagu

SEQ ID NO: 227798 - RNA, 22 nt, Homo sapiens
guagaggaauggcuccaccaua

SEQ ID NO: 227799 - RNA, 22 nt, Homo sapiens
guagagguagacuuccuugucu

SEQ ID NO: 227800 - RNA, 22 nt, Homo sapiens
guagagugcugggcacuggcuc

SEQ ID NO: 227801 - RNA, 22 nt, Homo sapiens
guagcagaauaucagauaauuu

SEQ ID NO: 227802 - RNA, 22 nt, Homo sapiens
guagcagucacauagcagauug

SEQ ID NO: 227803 - RNA, 22 nt, Homo sapiens
guagcaugcaauauuauagaga

SEQ ID NO: 227804 - RNA, 22 nt, Homo sapiens
guaguaccauuaggauauuucu

SEQ ID NO: 227805 - RNA, 22 nt, Homo sapiens
guaguuuaucagaaagaauagg

SEQ ID NO: 227806 - RNA, 23 nt, Homo sapiens
guaguuugaugcaauccacuugu

SEQ ID NO: 227807 - RNA, 22 nt, Homo sapiens
guauacaugucaaaacucacau

SEQ ID NO: 227808 - RNA, 22 nt, Homo sapiens
guaugacacaggaagcuuaacc

SEQ ID NO: 227809 - RNA, 22 nt, Homo sapiens
guaugauacuguaacagugggu

SEQ ID NO: 227810 - RNA, 22 nt, Homo sapiens
guauggaagucaguuuguuggc

SEQ ID NO: 227811 - RNA, 22 nt, Homo sapiens
guauggguuuuguuucuucugg

SEQ ID NO: 227812 - RNA, 22 nt, Homo sapiens
guaugguugaagugacaagcca

SEQ ID NO: 227813 - RNA, 22 nt, Homo sapiens
guaugucuuuauagcagugugg

SEQ ID NO: 227814 - RNA, 22 nt, Homo sapiens
guauuaguuaucuacugcugug

SEQ ID NO: 227815 - RNA, 22 nt, Homo sapiens
guauugccacuuuugaacaguu

SEQ ID NO: 227816 - RNA, 19 nt, Homo sapiens
guauuugguaaacucucca

SEQ ID NO: 227817 - RNA, 22 nt, Homo sapiens
guauuugguuauugcagccuga

SEQ ID NO: 227818 - RNA, 22 nt, Homo sapiens
guauuuuguuagggugugguau

SEQ ID NO: 227819 - RNA, 22 nt, Homo sapiens
gucaagauuuguaggacagaga

SEQ ID NO: 227820 - RNA, 22 nt, Homo sapiens
gucaaggaauuuauccauuucu

SEQ ID NO: 227821 - RNA, 22 nt, Homo sapiens
gucacaggaaacuaauaugcgc

SEQ ID NO: 227822 - RNA, 22 nt, Homo sapiens
gucacaguggccagugauguuc

SEQ ID NO: 227823 - RNA, 22 nt, Homo sapiens
gucacauugaugcccauggugg

SEQ ID NO: 227824 - RNA, 22 nt, Homo sapiens
gucacggaauguaaguggaagu

SEQ ID NO: 227825 - RNA, 22 nt, Homo sapiens
gucacugagauugguauuaaug

SEQ ID NO: 227826 - RNA, 22 nt, Homo sapiens
gucacugagcagaaggaagcga

SEQ ID NO: 227827 - RNA, 22 nt, Homo sapiens
gucacugccugaggcugaugca

SEQ ID NO: 227828 - RNA, 22 nt, Homo sapiens
gucacuguggagaagaaagugg

SEQ ID NO: 227829 - RNA, 22 nt, Homo sapiens
gucagauaauuugcauccaucu

SEQ ID NO: 227830 - RNA, 22 nt, Homo sapiens
gucagaugcagauuccaguucu

SEQ ID NO: 227831 - RNA, 22 nt, Homo sapiens
gucagcaucaccaugucuauga

SEQ ID NO: 227832 - RNA, 22 nt, Homo sapiens
gucaggaugauuuggggaggug

SEQ ID NO: 227833 - RNA, 22 nt, Homo sapiens
gucagugccugucccaggcuuu

SEQ ID NO: 227834 - RNA, 22 nt, Homo sapiens
gucaguggagaaaaggacaugu

SEQ ID NO: 227835 - RNA, 22 nt, Homo sapiens
gucaguuucacucagcuggaac

SEQ ID NO: 227836 - RNA, 22 nt, Homo sapiens
gucaguuugguuaaucauucca

SEQ ID NO: 227837 - RNA, 22 nt, Homo sapiens
gucaugcaggguucgccagccc

SEQ ID NO: 227838 - RNA, 22 nt, Homo sapiens
gucauggaggaugaauggccaa

SEQ ID NO: 227839 - RNA, 22 nt, Homo sapiens
gucaugucugcacauaguaaaa

SEQ ID NO: 227840 - RNA, 22 nt, Homo sapiens
gucauucauucagcaagcacug

SEQ ID NO: 227841 - RNA, 22 nt, Homo sapiens
gucauugcuuaaggguucaugc

SEQ ID NO: 227842 - RNA, 22 nt, Homo sapiens
gucauugguucuguuuauguga

SEQ ID NO: 227843 - RNA, 22 nt, Homo sapiens
guccaaauccaugggauguaca

SEQ ID NO: 227844 - RNA, 22 nt, Homo sapiens
guccagagaagucauuacuuca

SEQ ID NO: 227845 - RNA, 22 nt, Homo sapiens
guccaguguuggagguuuuacc

SEQ ID NO: 227846 - RNA, 22 nt, Homo sapiens
gucccugaggaacauccagggc

SEQ ID NO: 227847 - RNA, 22 nt, Homo sapiens
gucgugcagaccucacagcauu

SEQ ID NO: 227848 - RNA, 22 nt, Homo sapiens
gucguggagucucuggcuugua

SEQ ID NO: 227849 - RNA, 22 nt, Homo sapiens
gucucacaggcaugaugccagc

SEQ ID NO: 227850 - RNA, 22 nt, Homo sapiens
gucucccagccuacauauuucu

SEQ ID NO: 227851 - RNA, 22 nt, Homo sapiens
gucucuuguuaucauuucugag

SEQ ID NO: 227852 - RNA, 22 nt, Homo sapiens
gucuggcuccuucuacuacaug

SEQ ID NO: 227853 - RNA, 22 nt, Homo sapiens
gucugguuccugggagauuucu

SEQ ID NO: 227854 - RNA, 22 nt, Homo sapiens
gucugguugacagcauguggcc

SEQ ID NO: 227855 - RNA, 20 nt, Homo sapiens
gucugucuccgaguagaauu

SEQ ID NO: 227856 - RNA, 22 nt, Homo sapiens
gucugugguuccuaugucaccu

SEQ ID NO: 227857 - RNA, 22 nt, Homo sapiens
gucuuuaguugaaacauguggu

SEQ ID NO: 227858 - RNA, 22 nt, Homo sapiens
gucuuugaugucuaugugcuuc

SEQ ID NO: 227859 - RNA, 22 nt, Homo sapiens
auccuuuagacuguccaguuga

SEQ ID NO: 227860 - RNA, 21 nt, Homo sapiens
aucgcacaauauaccccugua

SEQ ID NO: 227861 - RNA, 22 nt, Homo sapiens
aucgcacuccauccugggcaac

SEQ ID NO: 227862 - RNA, 20 nt, Homo sapiens
aucguggccugaggagauac

SEQ ID NO: 227863 - RNA, 22 nt, Homo sapiens
aucgugucuggcccugaaugcu

SEQ ID NO: 227864 - RNA, 22 nt, Homo sapiens
aucuaaucaucgcaaccuucaa

SEQ ID NO: 227865 - RNA, 22 nt, Homo sapiens
aucuacagccagucugguuugu

SEQ ID NO: 227866 - RNA, 21 nt, Homo sapiens
aucucacuugaauguaaaagc

SEQ ID NO: 227867 - RNA, 20 nt, Homo sapiens
aucucugggcaaaggaaaau

SEQ ID NO: 227868 - RNA, 22 nt, Homo sapiens
aucucuugccagucagaauggu

SEQ ID NO: 227869 - RNA, 22 nt, Homo sapiens
aucugcaaagcugggcugagac

SEQ ID NO: 227870 - RNA, 22 nt, Homo sapiens
aucugcauucccauguuuauug

SEQ ID NO: 227871 - RNA, 22 nt, Homo sapiens
aucugcuccuggugaggguuuc

SEQ ID NO: 227872 - RNA, 22 nt, Homo sapiens
aucuggcuucuuuuaguccaca

SEQ ID NO: 227873 - RNA, 22 nt, Homo sapiens
aucugguguuuuucucccucgu

SEQ ID NO: 227874 - RNA, 21 nt, Homo sapiens
aucugugagaccuuggggguu

SEQ ID NO: 227875 - RNA, 22 nt, Homo sapiens
aucugugguuguaugcauauua

SEQ ID NO: 227876 - RNA, 22 nt, Homo sapiens
aucuucucuugaagggugggga

SEQ ID NO: 227877 - RNA, 21 nt, Homo sapiens
aucuugguauagucuuauugg

SEQ ID NO: 227878 - RNA, 22 nt, Homo sapiens
aucuuugcugagaugcauggca

SEQ ID NO: 227879 - RNA, 22 nt, Homo sapiens
augaaaagcauaaacgcugaag

SEQ ID NO: 227880 - RNA, 22 nt, Homo sapiens
augaaacuggagcgccuggagg

SEQ ID NO: 227881 - RNA, 22 nt, Homo sapiens
augaaagguauguuuucuguga

SEQ ID NO: 227882 - RNA, 22 nt, Homo sapiens
augaaaucuuuggcagaucuua

SEQ ID NO: 227883 - RNA, 22 nt, Homo sapiens
augaaauguaugagucuggguu

SEQ ID NO: 227884 - RNA, 22 nt, Homo sapiens
augaaauugcuaucgcaguacu

SEQ ID NO: 227885 - RNA, 22 nt, Homo sapiens
augaacuaugugggauguuuua

SEQ ID NO: 227886 - RNA, 18 nt, Homo sapiens
augaacucaucauuuuua

SEQ ID NO: 227887 - RNA, 18 nt, Homo sapiens
augaacucaucauuuuuu

SEQ ID NO: 227888 - RNA, 17 nt, Homo sapiens
augaacucaucguucuu

SEQ ID NO: 227889 - RNA, 22 nt, Homo sapiens
augaagagaaaguggaucuugg

SEQ ID NO: 227890 - RNA, 22 nt, Homo sapiens
augaagucguuacuaccaauug

SEQ ID NO: 227891 - RNA, 22 nt, Homo sapiens
augaauacugcugcaaugaaca

SEQ ID NO: 227892 - RNA, 22 nt, Homo sapiens
augacagugagugagcucucac

SEQ ID NO: 227893 - RNA, 22 nt, Homo sapiens
augacauugaugcucuggcugg

SEQ ID NO: 227894 - RNA, 22 nt, Homo sapiens
augaccaaugggcagagcuaga

SEQ ID NO: 227895 - RNA, 22 nt, Homo sapiens
augaccauuucaauugauaugg

SEQ ID NO: 227896 - RNA, 22 nt, Homo sapiens
augacuggaacagcaauuuaca

SEQ ID NO: 227897 - RNA, 22 nt, Homo sapiens
augacuggauaauggacacaca

SEQ ID NO: 227898 - RNA, 22 nt, Homo sapiens
augacugucuugcagaggcuau

SEQ ID NO: 227899 - RNA, 22 nt, Homo sapiens
augagaauguaaguuaaugaaa

SEQ ID NO: 227900 - RNA, 22 nt, Homo sapiens
augagacauuaaaguguguuug

SEQ ID NO: 227901 - RNA, 18 nt, Homo sapiens
augagagccgauuccugg

SEQ ID NO: 227902 - RNA, 22 nt, Homo sapiens
augagauacuacaaaugaguuu

SEQ ID NO: 227903 - RNA, 22 nt, Homo sapiens
augagauauguuaaaaguuaaa

SEQ ID NO: 227904 - RNA, 22 nt, Homo sapiens
augagauucuuagagaagucug

SEQ ID NO: 227905 - RNA, 22 nt, Homo sapiens
augagcaaagagaugagacccu

SEQ ID NO: 227906 - RNA, 22 nt, Homo sapiens
augagcuauggagacagggcca

SEQ ID NO: 227907 - RNA, 22 nt, Homo sapiens
augagcucauaaagagugauuu

SEQ ID NO: 227908 - RNA, 22 nt, Homo sapiens
augagcugauuuccuuaccaua

SEQ ID NO: 227909 - RNA, 22 nt, Homo sapiens
augagcuguuuggaagacacuu

SEQ ID NO: 227910 - RNA, 22 nt, Homo sapiens
augagggagggguggugccgca

SEQ ID NO: 227911 - RNA, 22 nt, Homo sapiens
augagguaauaaguccuuggaa

SEQ ID NO: 227912 - RNA, 22 nt, Homo sapiens
augagguaguagaaagucaggu

SEQ ID NO: 227913 - RNA, 20 nt, Homo sapiens
augagguguaugacacugaa

SEQ ID NO: 227914 - RNA, 22 nt, Homo sapiens
augagguguuuauuguauccug

SEQ ID NO: 227915 - RNA, 22 nt, Homo sapiens
augaguaguugcuaaauauuga

SEQ ID NO: 227916 - RNA, 19 nt, Homo sapiens
augaguuaggggaaauuuc

SEQ ID NO: 227917 - RNA, 22 nt, Homo sapiens
augauagguuuagguuuagaca

SEQ ID NO: 227918 - RNA, 22 nt, Homo sapiens
augauagucuugagaagcauuu

SEQ ID NO: 227919 - RNA, 22 nt, Homo sapiens
augauaucuuguuuuucaugca

SEQ ID NO: 227920 - RNA, 22 nt, Homo sapiens
augauauguuuguagcuaucuc

SEQ ID NO: 227921 - RNA, 22 nt, Homo sapiens
augaucacaccacugcacucca

SEQ ID NO: 227922 - RNA, 22 nt, Homo sapiens
augaucauggaaguuuuccugu

SEQ ID NO: 227923 - RNA, 22 nt, Homo sapiens
augaucuagaguaggaaacaga

SEQ ID NO: 227924 - RNA, 22 nt, Homo sapiens
augauguguucuguguucccau

SEQ ID NO: 227925 - RNA, 20 nt, Homo sapiens
augcaaacccugcuuugugg

SEQ ID NO: 227926 - RNA, 22 nt, Homo sapiens
augcaacugcacuccagccugg

SEQ ID NO: 227927 - RNA, 22 nt, Homo sapiens
augcacaguccagcccaugugg

SEQ ID NO: 227928 - RNA, 22 nt, Homo sapiens
augcacaucagcuccagggacc

SEQ ID NO: 227929 - RNA, 22 nt, Homo sapiens
augcacauggcuaacuuuuuuc

SEQ ID NO: 227930 - RNA, 22 nt, Homo sapiens
augcacuguuuucuugaugaga

SEQ ID NO: 227931 - RNA, 22 nt, Homo sapiens
augcacuuggcaggaugauucc

SEQ ID NO: 227932 - RNA, 22 nt, Homo sapiens
augcagacacaaguuauaguaa

SEQ ID NO: 227933 - RNA, 22 nt, Homo sapiens
augcagguguuuugcacugagu

SEQ ID NO: 227934 - RNA, 22 nt, Homo sapiens
augcauauuccugggccucacu

SEQ ID NO: 227935 - RNA, 22 nt, Homo sapiens
augcaugucaaauuuguagguu

SEQ ID NO: 227936 - RNA, 22 nt, Homo sapiens
augccacugcacucuagccugg

SEQ ID NO: 227937 - RNA, 22 nt, Homo sapiens
augccacugcacuucagcuugg

SEQ ID NO: 227938 - RNA, 22 nt, Homo sapiens
augccagggagaauuguucaag

SEQ ID NO: 227939 - RNA, 22 nt, Homo sapiens
augccauugcacuccagccuag

SEQ ID NO: 227940 - RNA, 22 nt, Homo sapiens
augccauugcacuccagccugg

SEQ ID NO: 227941 - RNA, 22 nt, Homo sapiens
augccuaagacccuguggggga

SEQ ID NO: 227942 - RNA, 22 nt, Homo sapiens
augcuacugaccccuacuuaca

SEQ ID NO: 227943 - RNA, 22 nt, Homo sapiens
augcuacuggauuuguauaaau

SEQ ID NO: 227944 - RNA, 22 nt, Homo sapiens
augcuauguagaugagggccca

SEQ ID NO: 227945 - RNA, 22 nt, Homo sapiens
augcuguuuugaauucucuaga

SEQ ID NO: 227946 - RNA, 22 nt, Homo sapiens
augcuguuuuguagcucccucu

SEQ ID NO: 227947 - RNA, 21 nt, Homo sapiens
auggaaagacugccucuucaa

SEQ ID NO: 227948 - RNA, 20 nt, Homo sapiens
auggaacugugagccaauua

SEQ ID NO: 227949 - RNA, 22 nt, Homo sapiens
auggaagaaacgauuuucugga

SEQ ID NO: 227950 - RNA, 22 nt, Homo sapiens
auggaagcauaguauucuauug

SEQ ID NO: 227951 - RNA, 20 nt, Homo sapiens
auggaccuggauuaacagca

SEQ ID NO: 227952 - RNA, 22 nt, Homo sapiens
auggagugagaauggagguucc

SEQ ID NO: 227953 - RNA, 22 nt, Homo sapiens
auggaguguggaacugggaauc

SEQ ID NO: 227954 - RNA, 22 nt, Homo sapiens
auggauaugcuuccaacugccu

SEQ ID NO: 227955 - RNA, 22 nt, Homo sapiens
auggauauugccuaggguagua

SEQ ID NO: 227956 - RNA, 22 nt, Homo sapiens
auggauauuuuuugaacauaga

SEQ ID NO: 227957 - RNA, 22 nt, Homo sapiens
aaaccaccauuacuuuugcacc

SEQ ID NO: 227958 - RNA, 22 nt, Homo sapiens
aaacccauauaccagcugugcu

SEQ ID NO: 227959 - RNA, 22 nt, Homo sapiens
aaacucuguagcagagacagau

SEQ ID NO: 227960 - RNA, 22 nt, Homo sapiens
aaacugcuuuccaugguggcug

SEQ ID NO: 227961 - RNA, 22 nt, Homo sapiens
aaagcacugaauaaauuugcuu

SEQ ID NO: 227962 - RNA, 22 nt, Homo sapiens
aaagcacuggagucaucaucua

SEQ ID NO: 227963 - RNA, 22 nt, Homo sapiens
aaagcagcaggugguuuucaau

SEQ ID NO: 227964 - RNA, 22 nt, Homo sapiens
aaagcugucaaggcaggaggcu

SEQ ID NO: 227965 - RNA, 22 nt, Homo sapiens
aaaggcacugaucuuauccagu

SEQ ID NO: 227966 - RNA, 22 nt, Homo sapiens
aaaggcaucauuaguaccaagu

SEQ ID NO: 227967 - RNA, 20 nt, Homo sapiens
aaaggcugugagaacgagau

SEQ ID NO: 227968 - RNA, 22 nt, Homo sapiens
aaagggcuguuucuugacuugg

SEQ ID NO: 227969 - RNA, 19 nt, Homo sapiens
aaagguaguaaccucugau

SEQ ID NO: 227970 - RNA, 22 nt, Homo sapiens
aaaguacugggauuggccgggu

SEQ ID NO: 227971 - RNA, 20 nt, Homo sapiens
aaaguaggcuaauaccaaaa

SEQ ID NO: 227972 - RNA, 22 nt, Homo sapiens
aaagugcaguacuucguauauu

SEQ ID NO: 227973 - RNA, 22 nt, Homo sapiens
aaagugccugacucauaguuag

SEQ ID NO: 227974 - RNA, 22 nt, Homo sapiens
aaagugcuaggauuaccugggg

SEQ ID NO: 227975 - RNA, 22 nt, Homo sapiens
aaagugcugagacagacuggga

SEQ ID NO: 227976 - RNA, 22 nt, Homo sapiens
aaagugcugagauuguaggcau

SEQ ID NO: 227977 - RNA, 22 nt, Homo sapiens
aaagugcugggauuggccgggc

SEQ ID NO: 227978 - RNA, 22 nt, Homo sapiens
aaagugcuuacuaaguugccaa

SEQ ID NO: 227979 - RNA, 22 nt, Homo sapiens
aaagugcuucucuuuggugggu

SEQ ID NO: 227980 - RNA, 22 nt, Homo sapiens
aaauccauuuguucagcuaugc

SEQ ID NO: 227981 - RNA, 21 nt, Homo sapiens
aaaugcacauuacugcuggug

SEQ ID NO: 227982 - RNA, 22 nt, Homo sapiens
aaaugcagauuccuaggcccca

SEQ ID NO: 227983 - RNA, 22 nt, Homo sapiens
aaaugcagucuuuguucugggc

SEQ ID NO: 227984 - RNA, 22 nt, Homo sapiens
aaaugcauaucaagauugcccu

SEQ ID NO: 227985 - RNA, 22 nt, Homo sapiens
aaaugcaucauuaggugauuuu

SEQ ID NO: 227986 - RNA, 22 nt, Homo sapiens
uacaggauagacaauuuauuaa

SEQ ID NO: 227987 - RNA, 22 nt, Homo sapiens
uacaggcaccuggcuaauuuuu

SEQ ID NO: 227988 - RNA, 22 nt, Homo sapiens
uacagguaugugucuauauaca

SEQ ID NO: 227989 - RNA, 22 nt, Homo sapiens
uacaguaauguuaaucuuugug

SEQ ID NO: 227990 - RNA, 22 nt, Homo sapiens
uacaguacagugacaccauuau

SEQ ID NO: 227991 - RNA, 22 nt, Homo sapiens
uacagucacauuccugaccaua

SEQ ID NO: 227992 - RNA, 22 nt, Homo sapiens
uacagucuggaggccuguguug

SEQ ID NO: 227993 - RNA, 22 nt, Homo sapiens
uacagugcauagaggcaugaua

SEQ ID NO: 227994 - RNA, 22 nt, Homo sapiens
uacagugcuuuuugguggagaa

SEQ ID NO: 227995 - RNA, 22 nt, Homo sapiens
uacagugggcacuggcgcccug

SEQ ID NO: 227996 - RNA, 22 nt, Homo sapiens
uacaguguuuugguauuccaca

SEQ ID NO: 227997 - RNA, 22 nt, Homo sapiens
uacauaguagauauaggguuua

SEQ ID NO: 227998 - RNA, 19 nt, Homo sapiens
uacauaguauuuaguggca

SEQ ID NO: 227999 - RNA, 22 nt, Homo sapiens
uacauaguuacuuccauuucca

SEQ ID NO: 228000 - RNA, 22 nt, Homo sapiens
uacauguauguguuuauggcug

SEQ ID NO: 228001 - RNA, 22 nt, Homo sapiens
uaccaaguauuuucacaugaac

SEQ ID NO: 228002 - RNA, 22 nt, Homo sapiens
uaccaccauuguaguuuggaaa

SEQ ID NO: 228003 - RNA, 22 nt, Homo sapiens
uaccagugucagcuuccugugu

SEQ ID NO: 228004 - RNA, 22 nt, Homo sapiens
uacccgucuacuuugaacaaaa

SEQ ID NO: 228005 - RNA, 22 nt, Homo sapiens
uaccucagccaaugcccagaag

SEQ ID NO: 228006 - RNA, 22 nt, Homo sapiens
uaccugagcccucugcugaguu

SEQ ID NO: 228007 - RNA, 22 nt, Homo sapiens
uaccugagucuagagucuagaa

SEQ ID NO: 228008 - RNA, 22 nt, Homo sapiens
uacuacuuucugacaucuuuaa

SEQ ID NO: 228009 - RNA, 22 nt, Homo sapiens
uacuccccuuguucugugagcu

SEQ ID NO: 228010 - RNA, 22 nt, Homo sapiens
uacucuuuagcuccuuaaggaa

SEQ ID NO: 228011 - RNA, 22 nt, Homo sapiens
uacugcacauaugaagguuccc

SEQ ID NO: 228012 - RNA, 22 nt, Homo sapiens
uacugcacuccagccucgguga

SEQ ID NO: 228013 - RNA, 22 nt, Homo sapiens
uacugcacuccagccugggaga

SEQ ID NO: 228014 - RNA, 19 nt, Homo sapiens
uacugcacuccagucuggg

SEQ ID NO: 228015 - RNA, 22 nt, Homo sapiens
uacugcauuccaaucugggcga

SEQ ID NO: 228016 - RNA, 22 nt, Homo sapiens
uacugcauucuccgccuccggg

SEQ ID NO: 228017 - RNA, 22 nt, Homo sapiens
uacugcauuucacuguuaaaga

SEQ ID NO: 228018 - RNA, 22 nt, Homo sapiens
uacuuagagauuccaggaacuc

SEQ ID NO: 228019 - RNA, 22 nt, Homo sapiens
uagaauggaaggcauguuugcc

SEQ ID NO: 228020 - RNA, 23 nt, Homo sapiens
uagaauguuuuuccauguuucuu

SEQ ID NO: 228021 - RNA, 22 nt, Homo sapiens
uagagauaucaauuucauggug

SEQ ID NO: 228022 - RNA, 22 nt, Homo sapiens
uagagaucuuauauuuuaugac

SEQ ID NO: 228023 - RNA, 22 nt, Homo sapiens
aaaugcauggacagcuggucuu

SEQ ID NO: 228024 - RNA, 22 nt, Homo sapiens
aaaugcccuaaaauggagcauc

SEQ ID NO: 228025 - RNA, 18 nt, Homo sapiens
aaaugcucuucuggaaua

SEQ ID NO: 228026 - RNA, 22 nt, Homo sapiens
aaaugcugcuuuggccucuucu

SEQ ID NO: 228027 - RNA, 22 nt, Homo sapiens
aaaugcugucaaauuguguucu

SEQ ID NO: 228028 - RNA, 22 nt, Homo sapiens
aaaugcugucugugagccucau

SEQ ID NO: 228029 - RNA, 22 nt, Homo sapiens
aaauggcacaguaagggcauuu

SEQ ID NO: 228030 - RNA, 22 nt, Homo sapiens
aaaugggacugggguccuuuga

SEQ ID NO: 228031 - RNA, 22 nt, Homo sapiens
aaauucauuucagcucugggua

SEQ ID NO: 228032 - RNA, 22 nt, Homo sapiens
aaauugcaguuaggaugauggu

SEQ ID NO: 228033 - RNA, 22 nt, Homo sapiens
aacaccaucccuuugaugcuuu

SEQ ID NO: 228034 - RNA, 22 nt, Homo sapiens
aacaccauuuuucugcagccuu

SEQ ID NO: 228035 - RNA, 22 nt, Homo sapiens
aacacuggcugcucgaguucuc

SEQ ID NO: 228036 - RNA, 22 nt, Homo sapiens
aacagaccuagauaguauaguc

SEQ ID NO: 228037 - RNA, 22 nt, Homo sapiens
aacagacugucacauaaaauug

SEQ ID NO: 228038 - RNA, 22 nt, Homo sapiens
aacagagcuggugacuccaggu

SEQ ID NO: 228039 - RNA, 20 nt, Homo sapiens
aacagcacugucugaagcuu

SEQ ID NO: 228040 - RNA, 22 nt, Homo sapiens
aacaggcuccuaggggugcacc

SEQ ID NO: 228041 - RNA, 22 nt, Homo sapiens
aacaggguguuugcaguuucuu

SEQ ID NO: 228042 - RNA, 22 nt, Homo sapiens
aacaguaucuaacgagugauga

SEQ ID NO: 228043 - RNA, 22 nt, Homo sapiens
aacagucaauugcugaugaccu

SEQ ID NO: 228044 - RNA, 22 nt, Homo sapiens
aacagucuccaguuguauccau

SEQ ID NO: 228045 - RNA, 21 nt, Homo sapiens
aacagugcuuaguagauguuc

SEQ ID NO: 228046 - RNA, 22 nt, Homo sapiens
aacaucaaccaugaggguugga

SEQ ID NO: 228047 - RNA, 22 nt, Homo sapiens
aacauugaacuuggcacaccca

SEQ ID NO: 228048 - RNA, 19 nt, Homo sapiens
aaccgggagugcacauguu

SEQ ID NO: 228049 - RNA, 22 nt, Homo sapiens
aaccuauaguauugaaaucaag

SEQ ID NO: 228050 - RNA, 22 nt, Homo sapiens
aaccuguggauuuugguaucug

SEQ ID NO: 228051 - RNA, 22 nt, Homo sapiens
aacucugucuccuucaaguuca

SEQ ID NO: 228052 - RNA, 22 nt, Homo sapiens
aacugcacuaggacagguuuuu

SEQ ID NO: 228053 - RNA, 22 nt, Homo sapiens
aacugccucugacauaggcagg

SEQ ID NO: 228054 - RNA, 22 nt, Homo sapiens
aacugcucuuaccagauggguc

SEQ ID NO: 228055 - RNA, 22 nt, Homo sapiens
aacugcuguuuggguacuggug

SEQ ID NO: 228056 - RNA, 22 nt, Homo sapiens
aacuugcacuugauugagagcu

SEQ ID NO: 228057 - RNA, 22 nt, Homo sapiens
aagacuguaauccaucuugagu

SEQ ID NO: 228058 - RNA, 22 nt, Homo sapiens
aagagaacugacaguaccuggg

SEQ ID NO: 228059 - RNA, 22 nt, Homo sapiens
aagagaugaagguccugacugu

SEQ ID NO: 228060 - RNA, 22 nt, Homo sapiens
aagagcgcugauaacauguuug

SEQ ID NO: 228061 - RNA, 18 nt, Homo sapiens
aagagcucagcacagguu

SEQ ID NO: 228062 - RNA, 22 nt, Homo sapiens
aagagcucucuguagcauguga

SEQ ID NO: 228063 - RNA, 22 nt, Homo sapiens
gucuuuggaaagacaaaguuca

SEQ ID NO: 228064 - RNA, 17 nt, Homo sapiens
gucuuugguugaguuua

SEQ ID NO: 228065 - RNA, 22 nt, Homo sapiens
gucuuuguuauuaugaaucaac

SEQ ID NO: 228066 - RNA, 22 nt, Homo sapiens
gucuuuugcuagccagagagcu

SEQ ID NO: 228067 - RNA, 22 nt, Homo sapiens
gugaaagacauauaugguuuga

SEQ ID NO: 228068 - RNA, 22 nt, Homo sapiens
gugaaauacauaaucccaagug

SEQ ID NO: 228069 - RNA, 22 nt, Homo sapiens
gugaacaagcaaaggcaggagg

SEQ ID NO: 228070 - RNA, 22 nt, Homo sapiens
gugaacaauguuuuauccuggg

SEQ ID NO: 228071 - RNA, 22 nt, Homo sapiens
gugaacagaaccugggaucgaa

SEQ ID NO: 228072 - RNA, 22 nt, Homo sapiens
gugaacuguuugaggaagagaa

SEQ ID NO: 228073 - RNA, 22 nt, Homo sapiens
gugaagugugaccucagcaucu

SEQ ID NO: 228074 - RNA, 20 nt, Homo sapiens
gugaauacauuugguuucau

SEQ ID NO: 228075 - RNA, 22 nt, Homo sapiens
gugaaucauaugccagucaugc

SEQ ID NO: 228076 - RNA, 22 nt, Homo sapiens
gugaauugagagaacuguguua

SEQ ID NO: 228077 - RNA, 22 nt, Homo sapiens
gugacacuggagcuggcacaau

SEQ ID NO: 228078 - RNA, 22 nt, Homo sapiens
gugacagucaaagacaugacuu

SEQ ID NO: 228079 - RNA, 22 nt, Homo sapiens
gugacauuuuuacugaugagag

SEQ ID NO: 228080 - RNA, 22 nt, Homo sapiens
gugacuacaggccacaguuugg

SEQ ID NO: 228081 - RNA, 20 nt, Homo sapiens
gugacugagcacgggcacag

SEQ ID NO: 228082 - RNA, 22 nt, Homo sapiens
gugacugcauauaaguguaugu

SEQ ID NO: 228083 - RNA, 22 nt, Homo sapiens
gugacuggacucugaagaaaau

SEQ ID NO: 228084 - RNA, 22 nt, Homo sapiens
gugagaaucaaacuacauaaau

SEQ ID NO: 228085 - RNA, 18 nt, Homo sapiens
gugagaaugacuguucug

SEQ ID NO: 228086 - RNA, 22 nt, Homo sapiens
gugagacugguucugaacccag

SEQ ID NO: 228087 - RNA, 22 nt, Homo sapiens
gugagauaaugucucauugugg

SEQ ID NO: 228088 - RNA, 19 nt, Homo sapiens
gugagcaaugcauugcacu

SEQ ID NO: 228089 - RNA, 19 nt, Homo sapiens
gugagcacagacaauacaa

SEQ ID NO: 228090 - RNA, 22 nt, Homo sapiens
gugagcauaggaggcuucuguu

SEQ ID NO: 228091 - RNA, 22 nt, Homo sapiens
gugagccaugauuuuaccacug

SEQ ID NO: 228092 - RNA, 22 nt, Homo sapiens
gugagcuauguccugguuuggg

SEQ ID NO: 228093 - RNA, 21 nt, Homo sapiens
gugaggaguuacuggcuuuga

SEQ ID NO: 228094 - RNA, 22 nt, Homo sapiens
gugagguaagaguugcuuugcu

SEQ ID NO: 228095 - RNA, 22 nt, Homo sapiens
gugagguaauuagcucccuuag

SEQ ID NO: 228096 - RNA, 22 nt, Homo sapiens
gugagguacgugucaagaacca

SEQ ID NO: 228097 - RNA, 22 nt, Homo sapiens
auggucccuguuccaugcuccu

SEQ ID NO: 228098 - RNA, 22 nt, Homo sapiens
auggucuuuuuguuaugagaga

SEQ ID NO: 228099 - RNA, 22 nt, Homo sapiens
augguuugugcuccuauaagaa

SEQ ID NO: 228100 - RNA, 22 nt, Homo sapiens
auguaauguuaaauugcuaauu

SEQ ID NO: 228101 - RNA, 22 nt, Homo sapiens
auguagauaucaagaggcauau

SEQ ID NO: 228102 - RNA, 22 nt, Homo sapiens
auguaguagauauuuauggaaa

SEQ ID NO: 228103 - RNA, 22 nt, Homo sapiens
auguaguaugaagaagaugcuu

SEQ ID NO: 228104 - RNA, 22 nt, Homo sapiens
auguaguauuaaugagagauaa

SEQ ID NO: 228105 - RNA, 17 nt, Homo sapiens
auguauacauccaugua

SEQ ID NO: 228106 - RNA, 22 nt, Homo sapiens
augucaaggugaagaaagauca

SEQ ID NO: 228107 - RNA, 22 nt, Homo sapiens
augucacugcacuccugccugg

SEQ ID NO: 228108 - RNA, 20 nt, Homo sapiens
augucagaguguggguacgg

SEQ ID NO: 228109 - RNA, 21 nt, Homo sapiens
augucauggaugacuaauuca

SEQ ID NO: 228110 - RNA, 22 nt, Homo sapiens
augucuagagcaagagaugcug

SEQ ID NO: 228111 - RNA, 22 nt, Homo sapiens
augugaaugugaucggauaguc

SEQ ID NO: 228112 - RNA, 22 nt, Homo sapiens
augugcaaauuuccaaacucuu

SEQ ID NO: 228113 - RNA, 18 nt, Homo sapiens
augugcaauuuuguauuu

SEQ ID NO: 228114 - RNA, 22 nt, Homo sapiens
augugcagauguuacaaauugu

SEQ ID NO: 228115 - RNA, 22 nt, Homo sapiens
augugcauaugaagcacagaca

SEQ ID NO: 228116 - RNA, 22 nt, Homo sapiens
augugcaugcuguucugccaga

SEQ ID NO: 228117 - RNA, 22 nt, Homo sapiens
augugccauucucauggcgcuu

SEQ ID NO: 228118 - RNA, 22 nt, Homo sapiens
augugcuugagggaaaucaguu

SEQ ID NO: 228119 - RNA, 22 nt, Homo sapiens
augugcuuuuuaaacagaugcu

SEQ ID NO: 228120 - RNA, 22 nt, Homo sapiens
auguggcacuugacuuucucgc

SEQ ID NO: 228121 - RNA, 22 nt, Homo sapiens
auguggcauuucucauucauuu

SEQ ID NO: 228122 - RNA, 22 nt, Homo sapiens
auguuaagauggaacaugggaa

SEQ ID NO: 228123 - RNA, 18 nt, Homo sapiens
auguuauguuuguagaag

SEQ ID NO: 228124 - RNA, 22 nt, Homo sapiens
auguugcuugaaggcauuuugu

SEQ ID NO: 228125 - RNA, 22 nt, Homo sapiens
auuaagugcuugcagaagucca

SEQ ID NO: 228126 - RNA, 22 nt, Homo sapiens
auuaaguuaggauuuugagaua

SEQ ID NO: 228127 - RNA, 21 nt, Homo sapiens
auuaaugcucugguuagaggc

SEQ ID NO: 228128 - RNA, 22 nt, Homo sapiens
auuacuuugcaccaaccuaaua

SEQ ID NO: 228129 - RNA, 22 nt, Homo sapiens
auuagaugguuauaggugugag

SEQ ID NO: 228130 - RNA, 22 nt, Homo sapiens
auuagguacugugguuuccaga

SEQ ID NO: 228131 - RNA, 22 nt, Homo sapiens
auuagguagugagaugcugcug

SEQ ID NO: 228132 - RNA, 22 nt, Homo sapiens
auuagguuggugcaaaacuuuc

SEQ ID NO: 228133 - RNA, 22 nt, Homo sapiens
auuagguuggugcaaaaguaau

SEQ ID NO: 228134 - RNA, 22 nt, Homo sapiens
auuagugaaugugaugucuuga

SEQ ID NO: 228135 - RNA, 22 nt, Homo sapiens
auuauaguguauacuugaaauu

SEQ ID NO: 228136 - RNA, 22 nt, Homo sapiens
auuauuaguuguugaaugaagu

SEQ ID NO: 228137 - RNA, 22 nt, Homo sapiens
auucaaggacuggauugcggga

SEQ ID NO: 228138 - RNA, 22 nt, Homo sapiens
auucaagucaucucuccgcauu

SEQ ID NO: 228139 - RNA, 22 nt, Homo sapiens
auucaagugaugcagcuguuuu

SEQ ID NO: 228140 - RNA, 22 nt, Homo sapiens
auucaagugaugugauucuucu

SEQ ID NO: 228141 - RNA, 22 nt, Homo sapiens
auucaccauggcuaccaagggu

SEQ ID NO: 228142 - RNA, 22 nt, Homo sapiens
auucacugugcuuggccaaauu

SEQ ID NO: 228143 - RNA, 22 nt, Homo sapiens
auucacuguggguccuuuggau

SEQ ID NO: 228144 - RNA, 22 nt, Homo sapiens
auucaucagggauacuggccug

SEQ ID NO: 228145 - RNA, 22 nt, Homo sapiens
auuccacuuacaugaaguaccu

SEQ ID NO: 228146 - RNA, 22 nt, Homo sapiens
auuccacuuagugacucauuug

SEQ ID NO: 228147 - RNA, 20 nt, Homo sapiens
auuccacuuauaugaggucc

SEQ ID NO: 228148 - RNA, 22 nt, Homo sapiens
auuccagauggaguugaggguu

SEQ ID NO: 228149 - RNA, 22 nt, Homo sapiens
auuccaguuugugagaagcugu

SEQ ID NO: 228150 - RNA, 22 nt, Homo sapiens
auuccauuuguguggaauggcu

SEQ ID NO: 228151 - RNA, 22 nt, Homo sapiens
auuccauuuguuaucacacccg

SEQ ID NO: 228152 - RNA, 22 nt, Homo sapiens
auucccuuagcugccucagccu

SEQ ID NO: 228153 - RNA, 22 nt, Homo sapiens
auugaacacuucugugugccag

SEQ ID NO: 228154 - RNA, 22 nt, Homo sapiens
auugaacuuaaaagacuugcca

SEQ ID NO: 228155 - RNA, 22 nt, Homo sapiens
auugaacuuacuaucuaaacua

SEQ ID NO: 228156 - RNA, 22 nt, Homo sapiens
auugaaucuaaaaugagucucu

SEQ ID NO: 228157 - RNA, 22 nt, Homo sapiens
auugacaguuggccaguaagug

SEQ ID NO: 228158 - RNA, 22 nt, Homo sapiens
auugagcaaggucuccuaguau

SEQ ID NO: 228159 - RNA, 22 nt, Homo sapiens
auugagcacugacucugugcca

SEQ ID NO: 228160 - RNA, 22 nt, Homo sapiens
guuaagaaguguaacuuaaguu

SEQ ID NO: 228161 - RNA, 22 nt, Homo sapiens
guuacugucuuccugauugcuu

SEQ ID NO: 228162 - RNA, 22 nt, Homo sapiens
guuagguagaaguuuacuuuga

SEQ ID NO: 228163 - RNA, 18 nt, Homo sapiens
guuagguaguaugaugcu

SEQ ID NO: 228164 - RNA, 22 nt, Homo sapiens
guuauccugucuuuacauacaa

SEQ ID NO: 228165 - RNA, 22 nt, Homo sapiens
guuauguuaaauuguuguaugc

SEQ ID NO: 228166 - RNA, 22 nt, Homo sapiens
guuauguuauguuauguuaugu

SEQ ID NO: 228167 - RNA, 21 nt, Homo sapiens
guucaagugauccuccugucu

SEQ ID NO: 228168 - RNA, 22 nt, Homo sapiens
guucaagugauucuacugccuc

SEQ ID NO: 228169 - RNA, 22 nt, Homo sapiens
guucacacuugcaaccccagca

SEQ ID NO: 228170 - RNA, 22 nt, Homo sapiens
guucacagugguugccuuccag

SEQ ID NO: 228171 - RNA, 22 nt, Homo sapiens
guucacaguucagccuguaaca

SEQ ID NO: 228172 - RNA, 22 nt, Homo sapiens
guucacaguuucuaaucccagc

SEQ ID NO: 228173 - RNA, 22 nt, Homo sapiens
guucaguuuuaaagggaaauug

SEQ ID NO: 228174 - RNA, 22 nt, Homo sapiens
guucaucaggaauauuggccua

SEQ ID NO: 228175 - RNA, 22 nt, Homo sapiens
guucaucaggcuuucucuagag

SEQ ID NO: 228176 - RNA, 22 nt, Homo sapiens
guucccaguugaaaugauuagu

SEQ ID NO: 228177 - RNA, 22 nt, Homo sapiens
guugaaaucaucacuuggcaug

SEQ ID NO: 228178 - RNA, 22 nt, Homo sapiens
guugaggcaggagaauuacuug

SEQ ID NO: 228179 - RNA, 22 nt, Homo sapiens
guugaucuauguugcuggcagu

SEQ ID NO: 228180 - RNA, 22 nt, Homo sapiens
guugcccuuagcacuucagccu

SEQ ID NO: 228181 - RNA, 22 nt, Homo sapiens
guugccuaggcuggagugcagu

SEQ ID NO: 228182 - RNA, 22 nt, Homo sapiens
guuggcuguuucccccaaguga

SEQ ID NO: 228183 - RNA, 22 nt, Homo sapiens
guuggugaccugaagagaguaa

SEQ ID NO: 228184 - RNA, 22 nt, Homo sapiens
guugugcuuaagccuauugauu

SEQ ID NO: 228185 - RNA, 22 nt, Homo sapiens
guuuggauauuaggcaagagua

SEQ ID NO: 228186 - RNA, 22 nt, Homo sapiens
guuugugcuccuaugagaaucu

SEQ ID NO: 228187 - RNA, 21 nt, Homo sapiens
uaaaacuguaacuuuguccug

SEQ ID NO: 228188 - RNA, 22 nt, Homo sapiens
uaaacacucacuucauagccau

SEQ ID NO: 228189 - RNA, 22 nt, Homo sapiens
uaaacugcuugaggguaaguac

SEQ ID NO: 228190 - RNA, 22 nt, Homo sapiens
uaaagccuagaacuuucagccc

SEQ ID NO: 228191 - RNA, 16 nt, Homo sapiens
uaaagcuaaucacuuu

SEQ ID NO: 228192 - RNA, 21 nt, Homo sapiens
uaaagcuagaaccuuagcuuu

SEQ ID NO: 228193 - RNA, 21 nt, Homo sapiens
uaaaugucauacaaagcaaug

SEQ ID NO: 228194 - RNA, 22 nt, Homo sapiens
uaacaaugucuuaugggcuuaa

SEQ ID NO: 228195 - RNA, 22 nt, Homo sapiens
cauggcccugggcugggcgaac

SEQ ID NO: 228196 - RNA, 22 nt, Homo sapiens
cauggcucuuugcugcuaaagu

SEQ ID NO: 228197 - RNA, 22 nt, Homo sapiens
cauggcuuucacaguaaagccu

SEQ ID NO: 228198 - RNA, 22 nt, Homo sapiens
cauggcuuuuauaacaagaaau

SEQ ID NO: 228199 - RNA, 22 nt, Homo sapiens
cauggucaccuuccaaguuauu

SEQ ID NO: 228200 - RNA, 22 nt, Homo sapiens
caugucuuuuaaacauucaacu

SEQ ID NO: 228201 - RNA, 20 nt, Homo sapiens
cauuacacuccaaccugggu

SEQ ID NO: 228202 - RNA, 22 nt, Homo sapiens
cauuccacauguaggacaauuu

SEQ ID NO: 228203 - RNA, 22 nt, Homo sapiens
cauugcacuccagccuaggcaa

SEQ ID NO: 228204 - RNA, 22 nt, Homo sapiens
cauugcacuccagccuggccaa

SEQ ID NO: 228205 - RNA, 22 nt, Homo sapiens
cauugcacuccagcuugggcga

SEQ ID NO: 228206 - RNA, 22 nt, Homo sapiens
cauugcacuccaucuugggcaa

SEQ ID NO: 228207 - RNA, 22 nt, Homo sapiens
cauugcacucuagucuggguga

SEQ ID NO: 228208 - RNA, 22 nt, Homo sapiens
cauugcaguggaguggggaaga

SEQ ID NO: 228209 - RNA, 22 nt, Homo sapiens
cauugcaugcauauggcuuggu

SEQ ID NO: 228210 - RNA, 20 nt, Homo sapiens
cauugcccuccagccugggc

SEQ ID NO: 228211 - RNA, 22 nt, Homo sapiens
cauugcuaaaagucauauauaa

SEQ ID NO: 228212 - RNA, 19 nt, Homo sapiens
cauuggacuugcuuuugcc

SEQ ID NO: 228213 - RNA, 22 nt, Homo sapiens
cauugguuccaguuuguccuua

SEQ ID NO: 228214 - RNA, 22 nt, Homo sapiens
cauugguuggacaguucucucu

SEQ ID NO: 228215 - RNA, 22 nt, Homo sapiens
cauugguuuauagauggggaaa

SEQ ID NO: 228216 - RNA, 22 nt, Homo sapiens
cauugguuuuucaggaguauau

SEQ ID NO: 228217 - RNA, 22 nt, Homo sapiens
cauuguacauaaguauggagua

SEQ ID NO: 228218 - RNA, 22 nt, Homo sapiens
cauuguccuccuggggcuauuu

SEQ ID NO: 228219 - RNA, 22 nt, Homo sapiens
cauuuugcaguuucugucucca

SEQ ID NO: 228220 - RNA, 22 nt, Homo sapiens
ccacaaccucaacagcaucuau

SEQ ID NO: 228221 - RNA, 23 nt, Homo sapiens
ccacacuguuuagaauggcauca

SEQ ID NO: 228222 - RNA, 22 nt, Homo sapiens
ccacccuuccauucuuccucuu

SEQ ID NO: 228223 - RNA, 22 nt, Homo sapiens
ccaccgggucccagcucugcuc

SEQ ID NO: 228224 - RNA, 22 nt, Homo sapiens
ccacugggcaguuuauuaucag

SEQ ID NO: 228225 - RNA, 22 nt, Homo sapiens
ccacugggcuagguguuuugga

SEQ ID NO: 228226 - RNA, 22 nt, Homo sapiens
ccacugugguaucugauacugg

SEQ ID NO: 228227 - RNA, 22 nt, Homo sapiens
ccagaguugccucagguuucug

SEQ ID NO: 228228 - RNA, 22 nt, Homo sapiens
ccagcaccauuuguugaauagg

SEQ ID NO: 228229 - RNA, 22 nt, Homo sapiens
ccagccgggugcaguggcucac

SEQ ID NO: 228230 - RNA, 22 nt, Homo sapiens
ccaggguugagacccacugacu

SEQ ID NO: 228231 - RNA, 22 nt, Homo sapiens
ccagugaacugcaagguuuuuc

SEQ ID NO: 228232 - RNA, 22 nt, Homo sapiens
ccagugauggcugccucauuug

SEQ ID NO: 228233 - RNA, 22 nt, Homo sapiens
ccagugguucccuguggccuga

SEQ ID NO: 228234 - RNA, 22 nt, Homo sapiens
ccagugucugacagacacggcg

SEQ ID NO: 228235 - RNA, 17 nt, Homo sapiens
ccaguuuucccucagug

SEQ ID NO: 228236 - RNA, 22 nt, Homo sapiens
ccaguuuuuggcaaugaugaau

SEQ ID NO: 228237 - RNA, 22 nt, Homo sapiens
ccauacugucaaauagauuucc

SEQ ID NO: 228238 - RNA, 22 nt, Homo sapiens
ccaucacaggccucagugggaa

SEQ ID NO: 228239 - RNA, 19 nt, Homo sapiens
ccauggcaaugaucugaug

SEQ ID NO: 228240 - RNA, 21 nt, Homo sapiens
ccauggcaaugguaaacugac

SEQ ID NO: 228241 - RNA, 22 nt, Homo sapiens
ccauggcaauggucagucuauu

SEQ ID NO: 228242 - RNA, 22 nt, Homo sapiens
ccauggcuucugcauucuguca

SEQ ID NO: 228243 - RNA, 21 nt, Homo sapiens
ccaugggacggaaugaauaca

SEQ ID NO: 228244 - RNA, 22 nt, Homo sapiens
ccauugcacuccagccuaggca

SEQ ID NO: 228245 - RNA, 22 nt, Homo sapiens
ccauuucacucuuccugaagga

SEQ ID NO: 228246 - RNA, 22 nt, Homo sapiens
cccagcguucggcauggcugag

SEQ ID NO: 228247 - RNA, 21 nt, Homo sapiens
cccagguucucugaggguaga

SEQ ID NO: 228248 - RNA, 18 nt, Homo sapiens
cccagugacuuauggccu

SEQ ID NO: 228249 - RNA, 22 nt, Homo sapiens
cccagugugcugggugacagcu

SEQ ID NO: 228250 - RNA, 22 nt, Homo sapiens
cccaguguuacgugacagccug

SEQ ID NO: 228251 - RNA, 22 nt, Homo sapiens
cccauuguuaaguugaguaucu

SEQ ID NO: 228252 - RNA, 22 nt, Homo sapiens
ccccauuugaacuccuucaacu

SEQ ID NO: 228253 - RNA, 22 nt, Homo sapiens
ccccggguucugucugcccuug

SEQ ID NO: 228254 - RNA, 20 nt, Homo sapiens
ccccuggaguggggcugcuu

SEQ ID NO: 228255 - RNA, 22 nt, Homo sapiens
ccccuguaaacuggcuucccug

SEQ ID NO: 228256 - RNA, 22 nt, Homo sapiens
cccgugucuuggucuagggccu

SEQ ID NO: 228257 - RNA, 22 nt, Homo sapiens
cccucauucauucauccuaugu

SEQ ID NO: 228258 - RNA, 22 nt, Homo sapiens
cccugaagaaagccuaggacau

SEQ ID NO: 228259 - RNA, 22 nt, Homo sapiens
cccugagaaaacuuuguccuua

SEQ ID NO: 228260 - RNA, 22 nt, Homo sapiens
cccugugaauauuaccuuauuu

SEQ ID NO: 228261 - RNA, 22 nt, Homo sapiens
cccuguguuuagcugaagguuu

SEQ ID NO: 228262 - RNA, 22 nt, Homo sapiens
cccuucauucaaggguugugag

SEQ ID NO: 228263 - RNA, 22 nt, Homo sapiens
ccucauggagaacaucugcuag

SEQ ID NO: 228264 - RNA, 22 nt, Homo sapiens
ccucauugcuaucccaggcuga

SEQ ID NO: 228265 - RNA, 22 nt, Homo sapiens
ccucccuuuguugcaagggaaa

SEQ ID NO: 228266 - RNA, 21 nt, Homo sapiens
ccugaagaagugaccucugag

SEQ ID NO: 228267 - RNA, 22 nt, Homo sapiens
ccugagacugauugacucacaa

SEQ ID NO: 228268 - RNA, 21 nt, Homo sapiens
ccugauguucacuuggccuuc

SEQ ID NO: 228269 - RNA, 22 nt, Homo sapiens
ccuggaucauugucauucccaa

SEQ ID NO: 228270 - RNA, 22 nt, Homo sapiens
ccuggcaagagacugaagauag

SEQ ID NO: 228271 - RNA, 22 nt, Homo sapiens
ccugucuugaagagauccuccu

SEQ ID NO: 228272 - RNA, 22 nt, Homo sapiens
ccuucacaggcacugguucaga

SEQ ID NO: 228273 - RNA, 22 nt, Homo sapiens
ccuucauccuccagcaggcuag

SEQ ID NO: 228274 - RNA, 22 nt, Homo sapiens
ccuuuguggggcgguggguaau

SEQ ID NO: 228275 - RNA, 22 nt, Homo sapiens
ccuuuguuaguuugcugagaau

SEQ ID NO: 228276 - RNA, 22 nt, Homo sapiens
aaggcuauuugagaaugugugu

SEQ ID NO: 228277 - RNA, 20 nt, Homo sapiens
aaggcuuucgaguuccaggg

SEQ ID NO: 228278 - RNA, 22 nt, Homo sapiens
aagggaauguuguggcugguuu

SEQ ID NO: 228279 - RNA, 23 nt, Homo sapiens
aagguaagcuagaaagauguaga

SEQ ID NO: 228280 - RNA, 22 nt, Homo sapiens
aagguauuuuugucuauaucuu

SEQ ID NO: 228281 - RNA, 22 nt, Homo sapiens
aaggugcucucuuauguagaaa

SEQ ID NO: 228282 - RNA, 17 nt, Homo sapiens
aaggugcuucgaccucc

SEQ ID NO: 228283 - RNA, 22 nt, Homo sapiens
aagguggaguugacaauuuuca

SEQ ID NO: 228284 - RNA, 22 nt, Homo sapiens
aaguacuguuuaaauugcagaa

SEQ ID NO: 228285 - RNA, 22 nt, Homo sapiens
aaguagugcuugugcucaucuc

SEQ ID NO: 228286 - RNA, 19 nt, Homo sapiens
aaguaguugugacagaugc

SEQ ID NO: 228287 - RNA, 22 nt, Homo sapiens
aaguauagcuaugauaaacauu

SEQ ID NO: 228288 - RNA, 22 nt, Homo sapiens
aaguaucaggaauaguuauugg

SEQ ID NO: 228289 - RNA, 22 nt, Homo sapiens
aaguauuaugaguccuuguuuu

SEQ ID NO: 228290 - RNA, 22 nt, Homo sapiens
aagucacugagacuuguggcug

SEQ ID NO: 228291 - RNA, 22 nt, Homo sapiens
aaguccccugacagaggggagg

SEQ ID NO: 228292 - RNA, 19 nt, Homo sapiens
aagugaaugcuuuguucac

SEQ ID NO: 228293 - RNA, 22 nt, Homo sapiens
aagugaauguuugguagcagug

SEQ ID NO: 228294 - RNA, 22 nt, Homo sapiens
aagugaauucauuguguuauau

SEQ ID NO: 228295 - RNA, 22 nt, Homo sapiens
aagugacauugugcccauuuga

SEQ ID NO: 228296 - RNA, 22 nt, Homo sapiens
aagugaguaauacgucaguugu

SEQ ID NO: 228297 - RNA, 22 nt, Homo sapiens
aauaaagcaggguccuugcacu

SEQ ID NO: 228298 - RNA, 22 nt, Homo sapiens
aauaagcauaguaccugauagg

SEQ ID NO: 228299 - RNA, 21 nt, Homo sapiens
aauacucuagguuaagagagc

SEQ ID NO: 228300 - RNA, 22 nt, Homo sapiens
aauacucuauaagggaagcugu

SEQ ID NO: 228301 - RNA, 22 nt, Homo sapiens
aauacugaaaguauuuucaaau

SEQ ID NO: 228302 - RNA, 22 nt, Homo sapiens
aauacugcuuugauguaagcua

SEQ ID NO: 228303 - RNA, 22 nt, Homo sapiens
aauacuggcacugaagaccaug

SEQ ID NO: 228304 - RNA, 22 nt, Homo sapiens
aauacuuccaaaucuagucauu

SEQ ID NO: 228305 - RNA, 22 nt, Homo sapiens
aauagcacugcuaugguuugaa

SEQ ID NO: 228306 - RNA, 22 nt, Homo sapiens
aauagcuguuuuuaauuccugc

SEQ ID NO: 228307 - RNA, 22 nt, Homo sapiens
aauagugcugugcagugagugg

SEQ ID NO: 228308 - RNA, 22 nt, Homo sapiens
aauaguggcuuggacuaaauau

SEQ ID NO: 228309 - RNA, 22 nt, Homo sapiens
aauaucacaguuggguguacac

SEQ ID NO: 228310 - RNA, 22 nt, Homo sapiens
aauaugucuugaaauuggguaa

SEQ ID NO: 228311 - RNA, 22 nt, Homo sapiens
aaucaacauuguuuuaagucaa

SEQ ID NO: 228312 - RNA, 22 nt, Homo sapiens
aaucacaguguucuugugaggg

SEQ ID NO: 228313 - RNA, 21 nt, Homo sapiens
aaucacugucuguuuccccuu

SEQ ID NO: 228314 - RNA, 22 nt, Homo sapiens
aaucagauuccagugguuggaa

SEQ ID NO: 228315 - RNA, 22 nt, Homo sapiens
aaucagcacacugugcuuucca

SEQ ID NO: 228316 - RNA, 22 nt, Homo sapiens
aauccauuugccgucuauccau

SEQ ID NO: 228317 - RNA, 22 nt, Homo sapiens
aauccugucuugccauccaaua

SEQ ID NO: 228318 - RNA, 22 nt, Homo sapiens
aaucucaacacuuugggaggcu

SEQ ID NO: 228319 - RNA, 22 nt, Homo sapiens
aaucugggguuguuuggggagu

SEQ ID NO: 228320 - RNA, 22 nt, Homo sapiens
aaugaaguuagauguugagaag

SEQ ID NO: 228321 - RNA, 22 nt, Homo sapiens
aaugacucugccuaaauuucac

SEQ ID NO: 228322 - RNA, 22 nt, Homo sapiens
aaugauacuguguacaagggca

SEQ ID NO: 228323 - RNA, 22 nt, Homo sapiens
aaugcaagauguuaauuauagg

SEQ ID NO: 228324 - RNA, 22 nt, Homo sapiens
aaugcacauauauuuccuuauu

SEQ ID NO: 228325 - RNA, 22 nt, Homo sapiens
aaugcacuccagccugggcgac

SEQ ID NO: 228326 - RNA, 22 nt, Homo sapiens
aaugcauaauuuguaugaggua

SEQ ID NO: 228327 - RNA, 22 nt, Homo sapiens
aaugccuagugugugacaggug

SEQ ID NO: 228328 - RNA, 22 nt, Homo sapiens
aaugcuguucuuugcuuaaguu

SEQ ID NO: 228329 - RNA, 22 nt, Homo sapiens
aauggcaaauguuuucuguuga

SEQ ID NO: 228330 - RNA, 22 nt, Homo sapiens
aauggcaagagccacagaggcg

SEQ ID NO: 228331 - RNA, 22 nt, Homo sapiens
aauggcauuugccagggcaaag

SEQ ID NO: 228332 - RNA, 22 nt, Homo sapiens
aauggcucuguuggcccaagac

SEQ ID NO: 228333 - RNA, 22 nt, Homo sapiens
aauggcuuuuaauauccauaau

SEQ ID NO: 228334 - RNA, 19 nt, Homo sapiens
aauggcuuuuccuguuccc

SEQ ID NO: 228335 - RNA, 22 nt, Homo sapiens
aaugggacugacgccucccaga

SEQ ID NO: 228336 - RNA, 22 nt, Homo sapiens
aaugugccuacuggagcuugca

SEQ ID NO: 228337 - RNA, 22 nt, Homo sapiens
aauuaguuggcugccuaugauu

SEQ ID NO: 228338 - RNA, 22 nt, Homo sapiens
aauucacuucuuuuaggcaggg

SEQ ID NO: 228339 - RNA, 22 nt, Homo sapiens
aauugaaucaugugggcagacu

SEQ ID NO: 228340 - RNA, 22 nt, Homo sapiens
aauugaaugauaugggacauuu

SEQ ID NO: 228341 - RNA, 22 nt, Homo sapiens
aauugcacuaagcauaguccag

SEQ ID NO: 228342 - RNA, 22 nt, Homo sapiens
aauugcuuuuauuuagggccag

SEQ ID NO: 228343 - RNA, 23 nt, Homo sapiens
aauugcuuuugaggacuuaguug

SEQ ID NO: 228344 - RNA, 16 nt, Homo sapiens
acaaagcuggcuaucu

SEQ ID NO: 228345 - RNA, 22 nt, Homo sapiens
acaaaguauggaauguuggugu

SEQ ID NO: 228346 - RNA, 22 nt, Homo sapiens
acaaagugccuccuuuuagagu

SEQ ID NO: 228347 - RNA, 22 nt, Homo sapiens
acaagcacaaauuuaauccugu

SEQ ID NO: 228348 - RNA, 22 nt, Homo sapiens
acaauggaauggaguggaaagu

SEQ ID NO: 228349 - RNA, 22 nt, Homo sapiens
acaauguauauuuuacuguagg

SEQ ID NO: 228350 - RNA, 22 nt, Homo sapiens
acacagucaaauccacuuggcu

SEQ ID NO: 228351 - RNA, 22 nt, Homo sapiens
acacaugcuccacuguggccuc

SEQ ID NO: 228352 - RNA, 22 nt, Homo sapiens
acaccaucuccuuauuucucuu

SEQ ID NO: 228353 - RNA, 22 nt, Homo sapiens
acaccuguggucccaguaacuu

SEQ ID NO: 228354 - RNA, 22 nt, Homo sapiens
acacgugcagauuuauauaaau

SEQ ID NO: 228355 - RNA, 22 nt, Homo sapiens
acacguguugaaauuuaauugc

SEQ ID NO: 228356 - RNA, 22 nt, Homo sapiens
acacuacuggguauauguguuu

SEQ ID NO: 228357 - RNA, 22 nt, Homo sapiens
acacucuaguguucuuaaucag

SEQ ID NO: 228358 - RNA, 22 nt, Homo sapiens
acacucucucauuacuuguuug

SEQ ID NO: 228359 - RNA, 22 nt, Homo sapiens
acacuggguaacauaucuguua

SEQ ID NO: 228360 - RNA, 22 nt, Homo sapiens
acacuguaacucuuugagggca

SEQ ID NO: 228361 - RNA, 22 nt, Homo sapiens
acacuguauccuucuguccuuu

SEQ ID NO: 228362 - RNA, 22 nt, Homo sapiens
acacugucucuugcugaccaug

SEQ ID NO: 228363 - RNA, 22 nt, Homo sapiens
acacugucugaugaaaguaguu

SEQ ID NO: 228364 - RNA, 22 nt, Homo sapiens
acacuguuggugggaguguaaa

SEQ ID NO: 228365 - RNA, 23 nt, Homo sapiens
acacuugcugaguaaaucaaaua

SEQ ID NO: 228366 - RNA, 22 nt, Homo sapiens
acacuuucuagacaagggaaua

SEQ ID NO: 228367 - RNA, 22 nt, Homo sapiens
acacuuucuggagcugcacaua

SEQ ID NO: 228368 - RNA, 22 nt, Homo sapiens
acagaacugggcuugcuuuugg

SEQ ID NO: 228369 - RNA, 22 nt, Homo sapiens
acagaccuauuucaaucauuua

SEQ ID NO: 228370 - RNA, 22 nt, Homo sapiens
acagauagcacuaagggaucug

SEQ ID NO: 228371 - RNA, 22 nt, Homo sapiens
acagaucagagauauuuagguu

SEQ ID NO: 228372 - RNA, 22 nt, Homo sapiens
acagcacugccaagugacccau

SEQ ID NO: 228373 - RNA, 22 nt, Homo sapiens
acaguacucugcucuuuugauu

SEQ ID NO: 228374 - RNA, 22 nt, Homo sapiens
acaguacuguuguuugcugcca

SEQ ID NO: 228375 - RNA, 22 nt, Homo sapiens
acaguacuuuuggauuugugaa

SEQ ID NO: 228376 - RNA, 22 nt, Homo sapiens
acaguagaaaacaauggauuug

SEQ ID NO: 228377 - RNA, 22 nt, Homo sapiens
acaguagugggcuacagaauca

SEQ ID NO: 228378 - RNA, 22 nt, Homo sapiens
acagucuggagaaugggugcuc

SEQ ID NO: 228379 - RNA, 18 nt, Homo sapiens
acagugcuggcaugagau

SEQ ID NO: 228380 - RNA, 22 nt, Homo sapiens
acagugcugucugcuuuggcua

SEQ ID NO: 228381 - RNA, 22 nt, Homo sapiens
acagugcuucugauaugaugcc

SEQ ID NO: 228382 - RNA, 22 nt, Homo sapiens
acagugcuuggcacacaguaau

SEQ ID NO: 228383 - RNA, 17 nt, Homo sapiens
acagugucuaugaaaug

SEQ ID NO: 228384 - RNA, 19 nt, Homo sapiens
acagugucucuauaaugau

SEQ ID NO: 228385 - RNA, 18 nt, Homo sapiens
acagugucuuacaccugu

SEQ ID NO: 228386 - RNA, 22 nt, Homo sapiens
acauagaguagcuaccuguaga

SEQ ID NO: 228387 - RNA, 22 nt, Homo sapiens
acaucccaugccuggguacucc

SEQ ID NO: 228388 - RNA, 22 nt, Homo sapiens
aagugcuuccuuucagaggguu

SEQ ID NO: 228389 - RNA, 22 nt, Homo sapiens
aagugcuuuacacaugcaugau

SEQ ID NO: 228390 - RNA, 22 nt, Homo sapiens
aagugcuuuguacagggguuga

SEQ ID NO: 228391 - RNA, 22 nt, Homo sapiens
aagugcuuuuuagauaugguuu

SEQ ID NO: 228392 - RNA, 22 nt, Homo sapiens
aaguggcauugaggaaaaaaau

SEQ ID NO: 228393 - RNA, 23 nt, Homo sapiens
aagugguuuugaacccggacccu

SEQ ID NO: 228394 - RNA, 22 nt, Homo sapiens
aagugguuuuuacaaagacaga

SEQ ID NO: 228395 - RNA, 22 nt, Homo sapiens
aaguguaaguuaauguuuaggu

SEQ ID NO: 228396 - RNA, 22 nt, Homo sapiens
aagugucuuaccgggagggagu

SEQ ID NO: 228397 - RNA, 22 nt, Homo sapiens
aaguugguguaugagacagaag

SEQ ID NO: 228398 - RNA, 22 nt, Homo sapiens
aaaagcauucagagugcugggc

SEQ ID NO: 228399 - RNA, 22 nt, Homo sapiens
aaaaggcuagcuaguaacagaa

SEQ ID NO: 228400 - RNA, 22 nt, Homo sapiens
aaaagugguguuguuucuaaau

SEQ ID NO: 228401 - RNA, 22 nt, Homo sapiens
aaagcuacaggaccugcucauu

SEQ ID NO: 228402 - RNA, 22 nt, Homo sapiens
aaagcuagagaagcugcuguca

SEQ ID NO: 228403 - RNA, 22 nt, Homo sapiens
aaaggcacuagaaguuaccuuu

SEQ ID NO: 228404 - RNA, 22 nt, Homo sapiens
aaagggcuugaauacucuuuuu

SEQ ID NO: 228405 - RNA, 22 nt, Homo sapiens
aaagguaguacuucuagaaggg

SEQ ID NO: 228406 - RNA, 22 nt, Homo sapiens
aaaguaauugcaguuuuugcaa

SEQ ID NO: 228407 - RNA, 22 nt, Homo sapiens
aaagucuagaggaucaugugug

SEQ ID NO: 228408 - RNA, 22 nt, Homo sapiens
aaagucuguuacagcuauuucu

SEQ ID NO: 228409 - RNA, 22 nt, Homo sapiens
aaagugcaguauuugggcagaa

SEQ ID NO: 228410 - RNA, 22 nt, Homo sapiens
aaagugccuucuauuuuaguga

SEQ ID NO: 228411 - RNA, 22 nt, Homo sapiens
gugugauuauuucaauugaugc

SEQ ID NO: 228412 - RNA, 20 nt, Homo sapiens
gugugcauuucagauuuugg

SEQ ID NO: 228413 - RNA, 21 nt, Homo sapiens
gugugcuugagugaugggauu

SEQ ID NO: 228414 - RNA, 22 nt, Homo sapiens
guguuugauugcaaauaaucua

SEQ ID NO: 228415 - RNA, 22 nt, Homo sapiens
guuaggcagugugguauagcag

SEQ ID NO: 228416 - RNA, 22 nt, Homo sapiens
guuagugcuuauuaaauaguau

SEQ ID NO: 228417 - RNA, 22 nt, Homo sapiens
guuaugcagcaauugauaaucu

SEQ ID NO: 228418 - RNA, 22 nt, Homo sapiens
guuauguaucuugauugggugg

SEQ ID NO: 228419 - RNA, 22 nt, Homo sapiens
ugacauggagagagaagccuuu

SEQ ID NO: 228420 - RNA, 22 nt, Homo sapiens
ugacauguccaggugguccugu

SEQ ID NO: 228421 - RNA, 22 nt, Homo sapiens
ugacauugggagugaagugaag

SEQ ID NO: 228422 - RNA, 22 nt, Homo sapiens
ugaccagaaaacaaauuaguuu

SEQ ID NO: 228423 - RNA, 22 nt, Homo sapiens
ugacccuguggcagcgucuaag

SEQ ID NO: 228424 - RNA, 22 nt, Homo sapiens
ugaccuguuugaaauugccaau

SEQ ID NO: 228425 - RNA, 22 nt, Homo sapiens
ugacuacagauuugcugccaga

SEQ ID NO: 228426 - RNA, 22 nt, Homo sapiens
ugacuacaggucaggaagcugu

SEQ ID NO: 228427 - RNA, 22 nt, Homo sapiens
ugacuacauaaguaaucucaaa

SEQ ID NO: 228428 - RNA, 22 nt, Homo sapiens
ugacuagcagagugagaaacuc

SEQ ID NO: 228429 - RNA, 22 nt, Homo sapiens
ugacuaggaggcuggaggauga

SEQ ID NO: 228430 - RNA, 22 nt, Homo sapiens
ugacucaguuguuagucuucau

SEQ ID NO: 228431 - RNA, 22 nt, Homo sapiens
ugacucaguuucucagguagua

SEQ ID NO: 228432 - RNA, 23 nt, Homo sapiens
ugacuggagacuguugauccuuu

SEQ ID NO: 228433 - RNA, 20 nt, Homo sapiens
ugacuggauacccuuuggcu

SEQ ID NO: 228434 - RNA, 22 nt, Homo sapiens
ugacugugcagcuccaucaggg

SEQ ID NO: 228435 - RNA, 22 nt, Homo sapiens
ugacuucauuugguaauugggu

SEQ ID NO: 228436 - RNA, 22 nt, Homo sapiens
ugacuugaaacgugaacagauc

SEQ ID NO: 228437 - RNA, 22 nt, Homo sapiens
ugacuugaggcucgcacaaguu

SEQ ID NO: 228438 - RNA, 22 nt, Homo sapiens
ugacuugaucauuacacauucu

SEQ ID NO: 228439 - RNA, 22 nt, Homo sapiens
ugacuugauccauggggcucca

SEQ ID NO: 228440 - RNA, 22 nt, Homo sapiens
ugacuuuagaauuuuauccaga

SEQ ID NO: 228441 - RNA, 19 nt, Homo sapiens
ugagaacaugugguauuug

SEQ ID NO: 228442 - RNA, 19 nt, Homo sapiens
ugagaaccucuacagaguc

SEQ ID NO: 228443 - RNA, 22 nt, Homo sapiens
ugagaacuagagaacaagguga

SEQ ID NO: 228444 - RNA, 22 nt, Homo sapiens
ugagaaugaugauugguaaacc

SEQ ID NO: 228445 - RNA, 22 nt, Homo sapiens
ugagaauguagggcucucccag

SEQ ID NO: 228446 - RNA, 22 nt, Homo sapiens
ugagacaucugagauuuuaagc

SEQ ID NO: 228447 - RNA, 22 nt, Homo sapiens
ugagacaugugaacuguaguuc

SEQ ID NO: 228448 - RNA, 22 nt, Homo sapiens
ugagacaugugaauauuuguac

SEQ ID NO: 228449 - RNA, 22 nt, Homo sapiens
ugagacggagucucacucuguu

SEQ ID NO: 228450 - RNA, 22 nt, Homo sapiens
ugagacggagucucgcucuguc

SEQ ID NO: 228451 - RNA, 22 nt, Homo sapiens
ugagacggagucucgcucuguu

SEQ ID NO: 228452 - RNA, 22 nt, Homo sapiens
ugagacggagucuugcucuguc

SEQ ID NO: 228453 - RNA, 22 nt, Homo sapiens
ugagacggaguuucacucuugu

SEQ ID NO: 228454 - RNA, 22 nt, Homo sapiens
ugagacggaguuucgcucuugu

SEQ ID NO: 228455 - RNA, 22 nt, Homo sapiens
ugagacgucuucucuucuucaa

SEQ ID NO: 228456 - RNA, 22 nt, Homo sapiens
ugagacugaguuuccaucuugu

SEQ ID NO: 228457 - RNA, 22 nt, Homo sapiens
ugagacugaguuucgcucuugu

SEQ ID NO: 228458 - RNA, 22 nt, Homo sapiens
ugagacugaguuucucucuugu

SEQ ID NO: 228459 - RNA, 22 nt, Homo sapiens
ugagacuguuuuggggaacuuc

SEQ ID NO: 228460 - RNA, 22 nt, Homo sapiens
ugagagacaguuuguuaaaauu

SEQ ID NO: 228461 - RNA, 22 nt, Homo sapiens
ugagagacauuuguuguagagu

SEQ ID NO: 228462 - RNA, 22 nt, Homo sapiens
ugagagcugcauucuugaaagc

SEQ ID NO: 228463 - RNA, 22 nt, Homo sapiens
ugagagcuuuuuugccugguga

SEQ ID NO: 228464 - RNA, 22 nt, Homo sapiens
ugagauaaggaaauugaggcuc

SEQ ID NO: 228465 - RNA, 22 nt, Homo sapiens
ugagauaauuuacuuguugagg

SEQ ID NO: 228466 - RNA, 22 nt, Homo sapiens
ugagauagaaaacauaggagaa

SEQ ID NO: 228467 - RNA, 22 nt, Homo sapiens
ugagauaguacuuuuuuaaagg

SEQ ID NO: 228468 - RNA, 22 nt, Homo sapiens
ugagauauauauauuugagaca

SEQ ID NO: 228469 - RNA, 22 nt, Homo sapiens
ugagaucagugaagaaguguuu

SEQ ID NO: 228470 - RNA, 22 nt, Homo sapiens
ugagaucaguuguuauaauucu

SEQ ID NO: 228471 - RNA, 22 nt, Homo sapiens
ugagaucaugccacugcacuuc

SEQ ID NO: 228472 - RNA, 22 nt, Homo sapiens
ugagaucgaguuucgcucuugu

SEQ ID NO: 228473 - RNA, 19 nt, Homo sapiens
ugagaucuuuacuggguuu

SEQ ID NO: 228474 - RNA, 22 nt, Homo sapiens
ugagaugaacuugauuguuuua

SEQ ID NO: 228475 - RNA, 19 nt, Homo sapiens
ugagaugaagacagggguu

SEQ ID NO: 228476 - RNA, 22 nt, Homo sapiens
ugagaugaagcuagaagaaugg

SEQ ID NO: 228477 - RNA, 22 nt, Homo sapiens
ugagaugagaaucaguucuaau

SEQ ID NO: 228478 - RNA, 22 nt, Homo sapiens
ugagaugaggucucgcucuguc

SEQ ID NO: 228479 - RNA, 22 nt, Homo sapiens
ugagaugauuuaauggagccca

SEQ ID NO: 228480 - RNA, 22 nt, Homo sapiens
ugagaugcauauucuggcuccu

SEQ ID NO: 228481 - RNA, 20 nt, Homo sapiens
ugagaugcauugggauguuu

SEQ ID NO: 228482 - RNA, 22 nt, Homo sapiens
ugagauggaguuucacuuuugu

SEQ ID NO: 228483 - RNA, 21 nt, Homo sapiens
ugagaugugaccagggcauca

SEQ ID NO: 228484 - RNA, 22 nt, Homo sapiens
ugagauguuccaaugacuauua

SEQ ID NO: 228485 - RNA, 23 nt, Homo sapiens
ugagauuauaaucuuuuacuucu

SEQ ID NO: 228486 - RNA, 21 nt, Homo sapiens
ugagauuauauuaacauggua

SEQ ID NO: 228487 - RNA, 20 nt, Homo sapiens
ugagauuggugugguauaag

SEQ ID NO: 228488 - RNA, 22 nt, Homo sapiens
ugagauuguaucugcaaugugu

SEQ ID NO: 228489 - RNA, 22 nt, Homo sapiens
ugagcagagaagugcccugcgc

SEQ ID NO: 228490 - RNA, 22 nt, Homo sapiens
ugagcauauugugauaccuaaa

SEQ ID NO: 228491 - RNA, 22 nt, Homo sapiens
ugagcuagagaguuuaguguca

SEQ ID NO: 228492 - RNA, 22 nt, Homo sapiens
ugagcuaggucuugcucuguca

SEQ ID NO: 228493 - RNA, 20 nt, Homo sapiens
ugagcucaauuguugcaagu

SEQ ID NO: 228494 - RNA, 22 nt, Homo sapiens
ugagcucagcuuucuuuuucac

SEQ ID NO: 228495 - RNA, 20 nt, Homo sapiens
ugagcucaugacauuuuucu

SEQ ID NO: 228496 - RNA, 22 nt, Homo sapiens
ugagcugagaaaugcagcagcu

SEQ ID NO: 228497 - RNA, 22 nt, Homo sapiens
ugagcugagacaauaaguuuuu

SEQ ID NO: 228498 - RNA, 22 nt, Homo sapiens
ugagcugagaucacacuacugu

SEQ ID NO: 228499 - RNA, 22 nt, Homo sapiens
uuacugcuuaagugauucaaca

SEQ ID NO: 228500 - RNA, 22 nt, Homo sapiens
uuacuugagaugaguuggacaa

SEQ ID NO: 228501 - RNA, 22 nt, Homo sapiens
uuagacacacauacauuuaucu

SEQ ID NO: 228502 - RNA, 22 nt, Homo sapiens
uuagacucauuuuggucaagga

SEQ ID NO: 228503 - RNA, 22 nt, Homo sapiens
uuagaguguagcaggaagaggc

SEQ ID NO: 228504 - RNA, 22 nt, Homo sapiens
uuagauaguacugaaugguucu

SEQ ID NO: 228505 - RNA, 22 nt, Homo sapiens
uuagaugaaugucucuuaaaca

SEQ ID NO: 228506 - RNA, 22 nt, Homo sapiens
uuagauuauugagcauccacug

SEQ ID NO: 228507 - RNA, 22 nt, Homo sapiens
uuagcacaguucauucauguua

SEQ ID NO: 228508 - RNA, 22 nt, Homo sapiens
uuagcagcacaaaagcagacua

SEQ ID NO: 228509 - RNA, 22 nt, Homo sapiens
uuagcagcaugaaaauggacug

SEQ ID NO: 228510 - RNA, 22 nt, Homo sapiens
uuagcagcaugagaauggacua

SEQ ID NO: 228511 - RNA, 22 nt, Homo sapiens
uuagcagcucuggugacaaggu

SEQ ID NO: 228512 - RNA, 22 nt, Homo sapiens
uuagcagugugaaaaaagacua

SEQ ID NO: 228513 - RNA, 21 nt, Homo sapiens
uuagcauccauguucaucaac

SEQ ID NO: 228514 - RNA, 22 nt, Homo sapiens
uuagccggguguguuggcgggc

SEQ ID NO: 228515 - RNA, 21 nt, Homo sapiens
uuagccuguaagcacuuugca

SEQ ID NO: 228516 - RNA, 22 nt, Homo sapiens
uuagcucaguuggugagagcgu

SEQ ID NO: 228517 - RNA, 22 nt, Homo sapiens
uuaggcaggauaguuacauauu

SEQ ID NO: 228518 - RNA, 22 nt, Homo sapiens
uuaggcuaguuucuuaaacucu

SEQ ID NO: 228519 - RNA, 22 nt, Homo sapiens
uuaggcuuuuuaaccaguuguu

SEQ ID NO: 228520 - RNA, 22 nt, Homo sapiens
uuagggaggacaguuacaacag

SEQ ID NO: 228521 - RNA, 22 nt, Homo sapiens
uuagguaauauauugcugcuuu

SEQ ID NO: 228522 - RNA, 22 nt, Homo sapiens
uuagguuauuacugacaauaau

SEQ ID NO: 228523 - RNA, 22 nt, Homo sapiens
uuaguagagacgagcguuccac

SEQ ID NO: 228524 - RNA, 22 nt, Homo sapiens
uuaguaguagcugcaugucagu

SEQ ID NO: 228525 - RNA, 22 nt, Homo sapiens
uuaguaguagugcuguaauuuu

SEQ ID NO: 228526 - RNA, 22 nt, Homo sapiens
uuaguaguaguuugcauuuacc

SEQ ID NO: 228527 - RNA, 22 nt, Homo sapiens
uuaguaguuugaguggggguua

SEQ ID NO: 228528 - RNA, 22 nt, Homo sapiens
uuagucaaguguacugugaaug

SEQ ID NO: 228529 - RNA, 20 nt, Homo sapiens
uuagucuccucugcccuguc

SEQ ID NO: 228530 - RNA, 22 nt, Homo sapiens
uuagugaaugcaccacuucuga

SEQ ID NO: 228531 - RNA, 22 nt, Homo sapiens
uuagugcugaguggaauguucu

SEQ ID NO: 228532 - RNA, 22 nt, Homo sapiens
uuagugcuuacgaugagcuaag

SEQ ID NO: 228533 - RNA, 22 nt, Homo sapiens
uuauaacucugcagccugguau

SEQ ID NO: 228534 - RNA, 22 nt, Homo sapiens
uuauacacugugggaguguaaa

SEQ ID NO: 228535 - RNA, 22 nt, Homo sapiens
uuauagcuaacaucugugaaaa

SEQ ID NO: 228536 - RNA, 22 nt, Homo sapiens
uuauauguuagacauggugggu

SEQ ID NO: 228537 - RNA, 22 nt, Homo sapiens
uuaucaaacccuaggagguggu

SEQ ID NO: 228538 - RNA, 22 nt, Homo sapiens
uuaucccacuuucuguuccugu

SEQ ID NO: 228539 - RNA, 22 nt, Homo sapiens
uuaugcuugugugaauuuuccc

SEQ ID NO: 228540 - RNA, 22 nt, Homo sapiens
uuauggauuuauauucuguagu

SEQ ID NO: 228541 - RNA, 22 nt, Homo sapiens
uuauggccauucuuguaggagu

SEQ ID NO: 228542 - RNA, 23 nt, Homo sapiens
uuauggcuuuuauuauguugagg

SEQ ID NO: 228543 - RNA, 22 nt, Homo sapiens
uuaugguacaugugcacaaugu

SEQ ID NO: 228544 - RNA, 22 nt, Homo sapiens
uuaugguuuuucugugagaugg

SEQ ID NO: 228545 - RNA, 22 nt, Homo sapiens
uuaugucauuuuuggauguuaa

SEQ ID NO: 228546 - RNA, 22 nt, Homo sapiens
uuaugugccuuuuugccauuca

SEQ ID NO: 228547 - RNA, 22 nt, Homo sapiens
uuauuagagauauuugguuagg

SEQ ID NO: 228548 - RNA, 22 nt, Homo sapiens
uuauuauguuggugcaaaggua

SEQ ID NO: 228549 - RNA, 22 nt, Homo sapiens
uuauucagcaccugcuguguuc

SEQ ID NO: 228550 - RNA, 22 nt, Homo sapiens
uucaaaaccucugcuuaagccc

SEQ ID NO: 228551 - RNA, 22 nt, Homo sapiens
uucaaaguaaaaauguguucac

SEQ ID NO: 228552 - RNA, 22 nt, Homo sapiens
uucaaaguaaagggauggagac

SEQ ID NO: 228553 - RNA, 22 nt, Homo sapiens
uucaaaguuggaggacaaacug

SEQ ID NO: 228554 - RNA, 22 nt, Homo sapiens
uucaacagugauggccuuugua

SEQ ID NO: 228555 - RNA, 22 nt, Homo sapiens
uucaaggacuaaggauuuuugg

SEQ ID NO: 228556 - RNA, 22 nt, Homo sapiens
uucaagugaacaaaaugaggag

SEQ ID NO: 228557 - RNA, 22 nt, Homo sapiens
uucaauacuguugauccuuaug

SEQ ID NO: 228558 - RNA, 22 nt, Homo sapiens
uucaauaugucauuggcaggca

SEQ ID NO: 228559 - RNA, 22 nt, Homo sapiens
uucacaaugccuuguugauggu

SEQ ID NO: 228560 - RNA, 22 nt, Homo sapiens
uucacagaaaaaggcgaugagg

SEQ ID NO: 228561 - RNA, 22 nt, Homo sapiens
uucacagacaacuggucccuua

SEQ ID NO: 228562 - RNA, 22 nt, Homo sapiens
uucacaguggugggagacguca

SEQ ID NO: 228563 - RNA, 22 nt, Homo sapiens
uucacaguguguacaccagggg

SEQ ID NO: 228564 - RNA, 23 nt, Homo sapiens
uucaccguguuggccaggcuggu

SEQ ID NO: 228565 - RNA, 22 nt, Homo sapiens
uucacugagccagacuaagaca

SEQ ID NO: 228566 - RNA, 22 nt, Homo sapiens
uucacugcacuccagccugagc

SEQ ID NO: 228567 - RNA, 22 nt, Homo sapiens
uucacugcacuccagccugggu

SEQ ID NO: 228568 - RNA, 22 nt, Homo sapiens
uucacugcaugaaaaggacagc

SEQ ID NO: 228569 - RNA, 22 nt, Homo sapiens
uucacugcauuucagccugggc

SEQ ID NO: 228570 - RNA, 22 nt, Homo sapiens
uucacuggagcccaggaguugg

SEQ ID NO: 228571 - RNA, 22 nt, Homo sapiens
uucagagagggagggauaccua

SEQ ID NO: 228572 - RNA, 22 nt, Homo sapiens
uucagagcauugguuuuuugaa

SEQ ID NO: 228573 - RNA, 22 nt, Homo sapiens
uucagagugaggcucucggaac

SEQ ID NO: 228574 - RNA, 22 nt, Homo sapiens
uucagagugguaugaagugaug

SEQ ID NO: 228575 - RNA, 22 nt, Homo sapiens
uucagcaggccaggcccugacu

SEQ ID NO: 228576 - RNA, 22 nt, Homo sapiens
uucaggcaccauugucauugau

SEQ ID NO: 228577 - RNA, 22 nt, Homo sapiens
uucagggacuuuagacaagaga

SEQ ID NO: 228578 - RNA, 22 nt, Homo sapiens
uucagguaguuuaacuguucca

SEQ ID NO: 228579 - RNA, 22 nt, Homo sapiens
uucaguagucuccauagaaccg

SEQ ID NO: 228580 - RNA, 22 nt, Homo sapiens
uucaguccauuuccuuggucac

SEQ ID NO: 228581 - RNA, 22 nt, Homo sapiens
uucagugccuggaagucgugcu

SEQ ID NO: 228582 - RNA, 22 nt, Homo sapiens
uucaguggguggaugaauauga

SEQ ID NO: 228583 - RNA, 22 nt, Homo sapiens
uucaguucugcacugaucuuag

SEQ ID NO: 228584 - RNA, 22 nt, Homo sapiens
uucaguucugcucugaucuuag

SEQ ID NO: 228585 - RNA, 22 nt, Homo sapiens
uucauacaguggcugcacucca

SEQ ID NO: 228586 - RNA, 18 nt, Homo sapiens
uucauaguagcaugauuu

SEQ ID NO: 228587 - RNA, 22 nt, Homo sapiens
uucauagucuaugcaaguaaga

SEQ ID NO: 228588 - RNA, 22 nt, Homo sapiens
uucaucagcuguagaugucaug

SEQ ID NO: 228589 - RNA, 20 nt, Homo sapiens
uucaucaggauauuggucua

SEQ ID NO: 228590 - RNA, 18 nt, Homo sapiens
uucaucaguccucagcug

SEQ ID NO: 228591 - RNA, 22 nt, Homo sapiens
uucauccccuccaaaucucaug

SEQ ID NO: 228592 - RNA, 22 nt, Homo sapiens
uucaucuggcaauucagagauu

SEQ ID NO: 228593 - RNA, 22 nt, Homo sapiens
uucauggacucaauaguuucgc

SEQ ID NO: 228594 - RNA, 22 nt, Homo sapiens
uucauggguuaauuuguucgau

SEQ ID NO: 228595 - RNA, 22 nt, Homo sapiens
uucauguaaucaaggcagcuaa

SEQ ID NO: 228596 - RNA, 22 nt, Homo sapiens
ugugcuauguuauucacauggg

SEQ ID NO: 228597 - RNA, 22 nt, Homo sapiens
uguggaaauaaaagaaagguua

SEQ ID NO: 228598 - RNA, 22 nt, Homo sapiens
uguggaaauggugcuacgaaca

SEQ ID NO: 228599 - RNA, 20 nt, Homo sapiens
uguggcacuguaucucucag

SEQ ID NO: 228600 - RNA, 22 nt, Homo sapiens
uguggcacuguguccagagaaa

SEQ ID NO: 228601 - RNA, 17 nt, Homo sapiens
uguggcucuuaugcuga

SEQ ID NO: 228602 - RNA, 22 nt, Homo sapiens
uguggcuuuuucuuggcugagg

SEQ ID NO: 228603 - RNA, 22 nt, Homo sapiens
ugugggaggugcuaauguaaau

SEQ ID NO: 228604 - RNA, 22 nt, Homo sapiens
ugugguauuagguguaguaucu

SEQ ID NO: 228605 - RNA, 22 nt, Homo sapiens
ugugguccucugaaggcuuuuc

SEQ ID NO: 228606 - RNA, 22 nt, Homo sapiens
ugugguuuuucacauuuagaga

SEQ ID NO: 228607 - RNA, 22 nt, Homo sapiens
uguguaauaccuuugacuauau

SEQ ID NO: 228608 - RNA, 22 nt, Homo sapiens
uguguacugcagaguauucugu

SEQ ID NO: 228609 - RNA, 22 nt, Homo sapiens
uguguauaucacugcaugagug

SEQ ID NO: 228610 - RNA, 22 nt, Homo sapiens
ugugucacugaggguuagugua

SEQ ID NO: 228611 - RNA, 22 nt, Homo sapiens
ugugucacugcacuccagccug

SEQ ID NO: 228612 - RNA, 22 nt, Homo sapiens
ugugucuccugaaaauucacau

SEQ ID NO: 228613 - RNA, 22 nt, Homo sapiens
ugugucuugagagucucgagaa

SEQ ID NO: 228614 - RNA, 22 nt, Homo sapiens
ugugucuugcuggugccugcau

SEQ ID NO: 228615 - RNA, 22 nt, Homo sapiens
ugugucuuguuuauagcuuucu

SEQ ID NO: 228616 - RNA, 22 nt, Homo sapiens
ugugucuuguuuuuucccaggc

SEQ ID NO: 228617 - RNA, 22 nt, Homo sapiens
uguuaaggcagagauaauacau

SEQ ID NO: 228618 - RNA, 22 nt, Homo sapiens
uguuaucauuacguucuuaguu

SEQ ID NO: 228619 - RNA, 22 nt, Homo sapiens
uguuauguauggagugauccca

SEQ ID NO: 228620 - RNA, 22 nt, Homo sapiens
uguuauugagguuacuuauaag

SEQ ID NO: 228621 - RNA, 22 nt, Homo sapiens
uguucuggagccgguucaaaug

SEQ ID NO: 228622 - RNA, 22 nt, Homo sapiens
uguugcacacacugaaauacac

SEQ ID NO: 228623 - RNA, 22 nt, Homo sapiens
uguugcacugguaauguacuga

SEQ ID NO: 228624 - RNA, 22 nt, Homo sapiens
uguugcauuugucaaggucaag

SEQ ID NO: 228625 - RNA, 18 nt, Homo sapiens
uguugguguucacucacu

SEQ ID NO: 228626 - RNA, 22 nt, Homo sapiens
uguugguuaaaucagguuuuaa

SEQ ID NO: 228627 - RNA, 22 nt, Homo sapiens
uguuugguggucucuucacaug

SEQ ID NO: 228628 - RNA, 22 nt, Homo sapiens
uguuuuggagguccucacuaga

SEQ ID NO: 228629 - RNA, 21 nt, Homo sapiens
uguuuuugcuguguaucucuc

SEQ ID NO: 228630 - RNA, 22 nt, Homo sapiens
uuaaaagcuaucuccaagguca

SEQ ID NO: 228631 - RNA, 22 nt, Homo sapiens
uuaaaggcaugguuagacaugg

SEQ ID NO: 228632 - RNA, 22 nt, Homo sapiens
uuaaaguauaguuccucugguu

SEQ ID NO: 228633 - RNA, 22 nt, Homo sapiens
uuaaaguguuuucaaaauguca

SEQ ID NO: 228634 - RNA, 22 nt, Homo sapiens
uuaaaugcauagaauguguagu

SEQ ID NO: 228635 - RNA, 22 nt, Homo sapiens
uuaaaugcuagaauuuucuuug

SEQ ID NO: 228636 - RNA, 22 nt, Homo sapiens
uuaaaugcucacauaaagguag

SEQ ID NO: 228637 - RNA, 22 nt, Homo sapiens
uuaagacaccaaucauuggauu

SEQ ID NO: 228638 - RNA, 22 nt, Homo sapiens
uuaagagugggaguuggccaca

SEQ ID NO: 228639 - RNA, 22 nt, Homo sapiens
uuaagcaguggauuagaauuuu

SEQ ID NO: 228640 - RNA, 22 nt, Homo sapiens
uuaagccaggugugguggcaca

SEQ ID NO: 228641 - RNA, 22 nt, Homo sapiens
uuaagcucauuuccauucuaca

SEQ ID NO: 228642 - RNA, 22 nt, Homo sapiens
uuaaggaaagcauuuaauucag

SEQ ID NO: 228643 - RNA, 22 nt, Homo sapiens
uuaaggaguagugucugguauu

SEQ ID NO: 228644 - RNA, 22 nt, Homo sapiens
uuaaggcuuuaaguaaacacag

SEQ ID NO: 228645 - RNA, 22 nt, Homo sapiens
uuaagggaggagcuucaagaug

SEQ ID NO: 228646 - RNA, 22 nt, Homo sapiens
uuaaggguuuuagaauuuucca

SEQ ID NO: 228647 - RNA, 22 nt, Homo sapiens
uuaaggugaaguucucagaugc

SEQ ID NO: 228648 - RNA, 23 nt, Homo sapiens
uuaaggugaugucuuugugccuc

SEQ ID NO: 228649 - RNA, 21 nt, Homo sapiens
uuaaguaauuacccaacucuc

SEQ ID NO: 228650 - RNA, 22 nt, Homo sapiens
uuaaguagcugggcaugguggu

SEQ ID NO: 228651 - RNA, 21 nt, Homo sapiens
uuaaugcuaugcagaaaaucu

SEQ ID NO: 228652 - RNA, 22 nt, Homo sapiens
uuaauuguccauuauucuguuc

SEQ ID NO: 228653 - RNA, 22 nt, Homo sapiens
uuacaaccucagcagugcaaag

SEQ ID NO: 228654 - RNA, 22 nt, Homo sapiens
uuacacaguugguaggggcaga

SEQ ID NO: 228655 - RNA, 22 nt, Homo sapiens
uuacaggacuaagcagcuuugc

SEQ ID NO: 228656 - RNA, 22 nt, Homo sapiens
uuacaguaugaguaagaguucu

SEQ ID NO: 228657 - RNA, 20 nt, Homo sapiens
uuacagugggaccuuccuga

SEQ ID NO: 228658 - RNA, 22 nt, Homo sapiens
uuacaguggugaccuuguauug

SEQ ID NO: 228659 - RNA, 22 nt, Homo sapiens
uuacaguugugagccaccaugc

SEQ ID NO: 228660 - RNA, 22 nt, Homo sapiens
uuacauguuguggguuguggcc

SEQ ID NO: 228661 - RNA, 22 nt, Homo sapiens
uuaccacagugccugucuaaug

SEQ ID NO: 228662 - RNA, 22 nt, Homo sapiens
uuaccagucuagggcucaguuu

SEQ ID NO: 228663 - RNA, 22 nt, Homo sapiens
aacuggcauagccagacuucuc

SEQ ID NO: 228664 - RNA, 22 nt, Homo sapiens
aacuggcauguuuuaaggcuua

SEQ ID NO: 228665 - RNA, 22 nt, Homo sapiens
aacuggccuccuugggaaauua

SEQ ID NO: 228666 - RNA, 22 nt, Homo sapiens
aacuggucuuuggaggaggagg

SEQ ID NO: 228667 - RNA, 19 nt, Homo sapiens
aacuggugugagaugauau

SEQ ID NO: 228668 - RNA, 19 nt, Homo sapiens
aacuggugugagaugguau

SEQ ID NO: 228669 - RNA, 22 nt, Homo sapiens
aagaccuaugcaggaagaaaug

SEQ ID NO: 228670 - RNA, 22 nt, Homo sapiens
aagagagccagcugguauauuu

SEQ ID NO: 228671 - RNA, 22 nt, Homo sapiens
aagagagcuaugugcauaauua

SEQ ID NO: 228672 - RNA, 22 nt, Homo sapiens
aagagcauuggauggggagauu

SEQ ID NO: 228673 - RNA, 22 nt, Homo sapiens
aagagcucauccauaguuguca

SEQ ID NO: 228674 - RNA, 22 nt, Homo sapiens
aagagguuauagaguguauacu

SEQ ID NO: 228675 - RNA, 22 nt, Homo sapiens
aagaguaguaguggcacucucu

SEQ ID NO: 228676 - RNA, 22 nt, Homo sapiens
aagagugucuuugugcuggccc

SEQ ID NO: 228677 - RNA, 22 nt, Homo sapiens
aagaguuaguaaaauuuccucu

SEQ ID NO: 228678 - RNA, 22 nt, Homo sapiens
aagaugauguuguguuuucacu

SEQ ID NO: 228679 - RNA, 19 nt, Homo sapiens
aagaugauguuugggcuaa

SEQ ID NO: 228680 - RNA, 22 nt, Homo sapiens
aagaugcagaagcccagauguu

SEQ ID NO: 228681 - RNA, 22 nt, Homo sapiens
aagaugguauuucauuaguuuu

SEQ ID NO: 228682 - RNA, 22 nt, Homo sapiens
aagcaaacaucagcuugguuaa

SEQ ID NO: 228683 - RNA, 22 nt, Homo sapiens
aagcaacacaucugccccgguu

SEQ ID NO: 228684 - RNA, 21 nt, Homo sapiens
aagcacauugaguguguguga

SEQ ID NO: 228685 - RNA, 22 nt, Homo sapiens
aagcacccagccucacgccugc

SEQ ID NO: 228686 - RNA, 22 nt, Homo sapiens
aagcacccuuugucuggacaug

SEQ ID NO: 228687 - RNA, 20 nt, Homo sapiens
aagcagacauuuggaugaaa

SEQ ID NO: 228688 - RNA, 22 nt, Homo sapiens
aagcaggugugggaggaaaugg

SEQ ID NO: 228689 - RNA, 22 nt, Homo sapiens
aagcaucacauaauggaucaug

SEQ ID NO: 228690 - RNA, 23 nt, Homo sapiens
aagcaugcacagcuguuuguggu

SEQ ID NO: 228691 - RNA, 22 nt, Homo sapiens
aagcaugguuuccaggggucac

SEQ ID NO: 228692 - RNA, 22 nt, Homo sapiens
aagcgguguugaauuuuguuga

SEQ ID NO: 228693 - RNA, 22 nt, Homo sapiens
aagcuacauuuuauuuauguca

SEQ ID NO: 228694 - RNA, 22 nt, Homo sapiens
aagcuacuuuggugguuccuua

SEQ ID NO: 228695 - RNA, 22 nt, Homo sapiens
aagcuaguguuccagugaacag

SEQ ID NO: 228696 - RNA, 22 nt, Homo sapiens
aagcugccaggcaugguggcug

SEQ ID NO: 228697 - RNA, 22 nt, Homo sapiens
aagcugccuugcugaggagaaa

SEQ ID NO: 228698 - RNA, 22 nt, Homo sapiens
aagcuggagugcaguggugcga

SEQ ID NO: 228699 - RNA, 22 nt, Homo sapiens
aagcuggauuuaguguggagca

SEQ ID NO: 228700 - RNA, 22 nt, Homo sapiens
aagcugguguugcugcucuguu

SEQ ID NO: 228701 - RNA, 22 nt, Homo sapiens
aagcugguuuuauaucugugag

SEQ ID NO: 228702 - RNA, 22 nt, Homo sapiens
aagcuguugguggauguaccau

SEQ ID NO: 228703 - RNA, 22 nt, Homo sapiens
aagcuguuguucauccugaauu

SEQ ID NO: 228704 - RNA, 22 nt, Homo sapiens
aaggaauucaaauuuucucugg

SEQ ID NO: 228705 - RNA, 22 nt, Homo sapiens
aaggagugugauucuucaguuu

SEQ ID NO: 228706 - RNA, 22 nt, Homo sapiens
aaggauuguaacaccaagguua

SEQ ID NO: 228707 - RNA, 22 nt, Homo sapiens
aaggcaagagaaaauuucgagu

SEQ ID NO: 228708 - RNA, 22 nt, Homo sapiens
aaggcaagguggauaaugaagc

SEQ ID NO: 228709 - RNA, 22 nt, Homo sapiens
aaggcaauuuguugugaggauu

SEQ ID NO: 228710 - RNA, 22 nt, Homo sapiens
aaggcaguggcagaagauguca

SEQ ID NO: 228711 - RNA, 22 nt, Homo sapiens
aaggcauggugacuauuuaggc

SEQ ID NO: 228712 - RNA, 22 nt, Homo sapiens
aaggcuuuuugcugacguccuu

SEQ ID NO: 228713 - RNA, 22 nt, Homo sapiens
aagggaaugcuuccaguuugug

SEQ ID NO: 228714 - RNA, 22 nt, Homo sapiens
aagggaaugugguagcugguuu

SEQ ID NO: 228715 - RNA, 22 nt, Homo sapiens
aagggaauguuguagcugguuu

SEQ ID NO: 228716 - RNA, 22 nt, Homo sapiens
aagggaauguuguggcugguug

SEQ ID NO: 228717 - RNA, 22 nt, Homo sapiens
aagggaauguugugguugguuu

SEQ ID NO: 228718 - RNA, 22 nt, Homo sapiens
aagguucuugcuugcaugacug

SEQ ID NO: 228719 - RNA, 22 nt, Homo sapiens
aagguuguauuuaauauacugu

SEQ ID NO: 228720 - RNA, 22 nt, Homo sapiens
aaguaauggaguuauuuuauga

SEQ ID NO: 228721 - RNA, 22 nt, Homo sapiens
aaguagcuggaugcaguggcac

SEQ ID NO: 228722 - RNA, 22 nt, Homo sapiens
aaguaguuaggaacauucucuc

SEQ ID NO: 228723 - RNA, 18 nt, Homo sapiens
aaguauagagagcccuua

SEQ ID NO: 228724 - RNA, 22 nt, Homo sapiens
aaguauuaagacuaagaggcuu

SEQ ID NO: 228725 - RNA, 22 nt, Homo sapiens
aaguauuagcuaauugugcuua

SEQ ID NO: 228726 - RNA, 23 nt, Homo sapiens
aagucauggaaucaaaugaggug

SEQ ID NO: 228727 - RNA, 22 nt, Homo sapiens
aagugaaugaugugaaguguaa

SEQ ID NO: 228728 - RNA, 23 nt, Homo sapiens
aagugagcuccaauugggugaga

SEQ ID NO: 228729 - RNA, 22 nt, Homo sapiens
aagugagugacaaaaacugggc

SEQ ID NO: 228730 - RNA, 20 nt, Homo sapiens
aagugaguguuaaacugaac

SEQ ID NO: 228731 - RNA, 22 nt, Homo sapiens
aagugauguuauugggugacuc

SEQ ID NO: 228732 - RNA, 22 nt, Homo sapiens
aagugcugggauuggccgggca

SEQ ID NO: 228733 - RNA, 22 nt, Homo sapiens
aagugcuucuuuccucgagaag

SEQ ID NO: 228734 - RNA, 22 nt, Homo sapiens
aagugguagggucaggauugga

SEQ ID NO: 228735 - RNA, 22 nt, Homo sapiens
aagugguucuaugaguuugcaa

SEQ ID NO: 228736 - RNA, 22 nt, Homo sapiens
aagugguuuuaaucuggugagu

SEQ ID NO: 228737 - RNA, 22 nt, Homo sapiens
aaguuguaguuagagaguugcu

SEQ ID NO: 228738 - RNA, 22 nt, Homo sapiens
aaguuguuggaguuccauuguu

SEQ ID NO: 228739 - RNA, 22 nt, Homo sapiens
aauaaagcugaauccuuccuga

SEQ ID NO: 228740 - RNA, 22 nt, Homo sapiens
aauaaaguaggaggugaggaaa

SEQ ID NO: 228741 - RNA, 22 nt, Homo sapiens
aauaagcugagagaauucuaca

SEQ ID NO: 228742 - RNA, 22 nt, Homo sapiens
aauaauggcaccaaagcacaag

SEQ ID NO: 228743 - RNA, 22 nt, Homo sapiens
aauacugugauaucgagcgauu

SEQ ID NO: 228744 - RNA, 22 nt, Homo sapiens
aauagagucaggguuucaccau

SEQ ID NO: 228745 - RNA, 22 nt, Homo sapiens
aauaucacaggguguacacuca

SEQ ID NO: 228746 - RNA, 23 nt, Homo sapiens
aauaucacaguggguguacaccc

SEQ ID NO: 228747 - RNA, 22 nt, Homo sapiens
aauaugguuuuaugaagcaauu

SEQ ID NO: 228748 - RNA, 22 nt, Homo sapiens
aauauguccuugaaauggugcu

SEQ ID NO: 228749 - RNA, 21 nt, Homo sapiens
aaucacaguuguucugccuuc

SEQ ID NO: 228750 - RNA, 22 nt, Homo sapiens
aaucacauugaaucugcuaccu

SEQ ID NO: 228751 - RNA, 22 nt, Homo sapiens
aaucacguagcaguagggagaa

SEQ ID NO: 228752 - RNA, 22 nt, Homo sapiens
aaucacuuugcuacaaggcagu

SEQ ID NO: 228753 - RNA, 22 nt, Homo sapiens
aaucagagcccucugagcuuca

SEQ ID NO: 228754 - RNA, 22 nt, Homo sapiens
aauccuguagauucuaauuccu

SEQ ID NO: 228755 - RNA, 22 nt, Homo sapiens
aaucucagcauuuugggcugag

SEQ ID NO: 228756 - RNA, 22 nt, Homo sapiens
aaucugauguuaucagcuuaag

SEQ ID NO: 228757 - RNA, 22 nt, Homo sapiens
aaugacagccagauucuucucu

SEQ ID NO: 228758 - RNA, 22 nt, Homo sapiens
aaugacagugcuaaagaacccu

SEQ ID NO: 228759 - RNA, 22 nt, Homo sapiens
aaugaucaauguuugaggugau

SEQ ID NO: 228760 - RNA, 22 nt, Homo sapiens
aaugcaucuagaaaggugaauu

SEQ ID NO: 228761 - RNA, 18 nt, Homo sapiens
agcaucacugaucauccu

SEQ ID NO: 228762 - RNA, 19 nt, Homo sapiens
agcaucauuauuguuuugg

SEQ ID NO: 228763 - RNA, 16 nt, Homo sapiens
agccaccauuuacuug

SEQ ID NO: 228764 - RNA, 22 nt, Homo sapiens
agccaguuuggcuaauuuuggc

SEQ ID NO: 228765 - RNA, 22 nt, Homo sapiens
agccauacaacguaugcaugua

SEQ ID NO: 228766 - RNA, 22 nt, Homo sapiens
agcccauguggcugaggcuucu

SEQ ID NO: 228767 - RNA, 22 nt, Homo sapiens
agccccauuuguugaaaagacg

SEQ ID NO: 228768 - RNA, 23 nt, Homo sapiens
agccugguuucccugcuucuccc

SEQ ID NO: 228769 - RNA, 22 nt, Homo sapiens
agcggcuguuccccuggucuau

SEQ ID NO: 228770 - RNA, 22 nt, Homo sapiens
agcuaaaucucauguugaauug

SEQ ID NO: 228771 - RNA, 22 nt, Homo sapiens
agcuaugucugaugccugauua

SEQ ID NO: 228772 - RNA, 18 nt, Homo sapiens
agcucaguguuugcuuac

SEQ ID NO: 228773 - RNA, 22 nt, Homo sapiens
agcuccaucuucagggguucag

SEQ ID NO: 228774 - RNA, 22 nt, Homo sapiens
agcuccauuguaaucaccuggu

SEQ ID NO: 228775 - RNA, 22 nt, Homo sapiens
agcuccuuucugcagguagguu

SEQ ID NO: 228776 - RNA, 22 nt, Homo sapiens
agcugauuuuaaguccuugucc

SEQ ID NO: 228777 - RNA, 22 nt, Homo sapiens
agcugcaauguuuaguauaaua

SEQ ID NO: 228778 - RNA, 22 nt, Homo sapiens
agcugcauucguaucauauugu

SEQ ID NO: 228779 - RNA, 22 nt, Homo sapiens
agcugguaguuuucuaguguuu

SEQ ID NO: 228780 - RNA, 22 nt, Homo sapiens
agcugguauuuguuagggaguu

SEQ ID NO: 228781 - RNA, 22 nt, Homo sapiens
agcuggucugauacuuaccucc

SEQ ID NO: 228782 - RNA, 22 nt, Homo sapiens
agcugguuuaauaugcugucug

SEQ ID NO: 228783 - RNA, 20 nt, Homo sapiens
agcugguuuuaugaaucuuu

SEQ ID NO: 228784 - RNA, 22 nt, Homo sapiens
agcugugucuucuuaaagauuu

SEQ ID NO: 228785 - RNA, 19 nt, Homo sapiens
agcuguguugccugugaga

SEQ ID NO: 228786 - RNA, 20 nt, Homo sapiens
agcuguuguuaaaaaggagg

SEQ ID NO: 228787 - RNA, 22 nt, Homo sapiens
agcuguuguuuuaagauacuaa

SEQ ID NO: 228788 - RNA, 22 nt, Homo sapiens
agcuucauucugaauagguuga

SEQ ID NO: 228789 - RNA, 22 nt, Homo sapiens
agcuucauuguuaugaauguca

SEQ ID NO: 228790 - RNA, 22 nt, Homo sapiens
agcuugugauuuagagugagag

SEQ ID NO: 228791 - RNA, 22 nt, Homo sapiens
agcuuguuuucccauaacuaga

SEQ ID NO: 228792 - RNA, 22 nt, Homo sapiens
agcuuuuugggcagcuauugac

SEQ ID NO: 228793 - RNA, 22 nt, Homo sapiens
aggaacuguaacuaugucucug

SEQ ID NO: 228794 - RNA, 22 nt, Homo sapiens
aggaagacauauagaacuaaaa

SEQ ID NO: 228795 - RNA, 23 nt, Homo sapiens
aggaaguaacuaucuuuucuguc

SEQ ID NO: 228796 - RNA, 22 nt, Homo sapiens
aggaaucuaagguaucagguua

SEQ ID NO: 228797 - RNA, 22 nt, Homo sapiens
aggaaugcuaaguuuuccuccu

SEQ ID NO: 228798 - RNA, 22 nt, Homo sapiens
aggacacugauguaugcugugg

SEQ ID NO: 228799 - RNA, 22 nt, Homo sapiens
aggagaauugguucuucuugau

SEQ ID NO: 228800 - RNA, 21 nt, Homo sapiens
aggagcauuguugugguggag

SEQ ID NO: 228801 - RNA, 22 nt, Homo sapiens
aggagguagaacauugccauuu

SEQ ID NO: 228802 - RNA, 22 nt, Homo sapiens
aggagguugguaccaucuguuu

SEQ ID NO: 228803 - RNA, 21 nt, Homo sapiens
aggauaguagauuaaauauuu

SEQ ID NO: 228804 - RNA, 22 nt, Homo sapiens
aggcaagaaugcuuguuucacc

SEQ ID NO: 228805 - RNA, 21 nt, Homo sapiens
aggcaagguguuauuauugaa

SEQ ID NO: 228806 - RNA, 22 nt, Homo sapiens
aggcacacaacccuggaccuga

SEQ ID NO: 228807 - RNA, 22 nt, Homo sapiens
aggcagcuguuauauacugagu

SEQ ID NO: 228808 - RNA, 22 nt, Homo sapiens
aggcaguuucagugagagguga

SEQ ID NO: 228809 - RNA, 22 nt, Homo sapiens
aggcaugauuguauuuugcucu

SEQ ID NO: 228810 - RNA, 22 nt, Homo sapiens
aggcaugguggcacauacaugu

SEQ ID NO: 228811 - RNA, 22 nt, Homo sapiens
aggccaguuuuuggagggaaac

SEQ ID NO: 228812 - RNA, 22 nt, Homo sapiens
aggcugguauuuacaaaagcuc

SEQ ID NO: 228813 - RNA, 22 nt, Homo sapiens
aggcuuuuggagguggcuuucu

SEQ ID NO: 228814 - RNA, 22 nt, Homo sapiens
agguaaacauggggacugcuac

SEQ ID NO: 228815 - RNA, 22 nt, Homo sapiens
agguaaguauguuauuacuuuu

SEQ ID NO: 228816 - RNA, 22 nt, Homo sapiens
agguaagucucuaauuaugaau

SEQ ID NO: 228817 - RNA, 22 nt, Homo sapiens
agguaauuuuaucauuauguga

SEQ ID NO: 228818 - RNA, 22 nt, Homo sapiens
agguacuugagauucugaacug

SEQ ID NO: 228819 - RNA, 22 nt, Homo sapiens
agguagcauagcgggaauauca

SEQ ID NO: 228820 - RNA, 22 nt, Homo sapiens
agguagguugagaugggcauca

SEQ ID NO: 228821 - RNA, 22 nt, Homo sapiens
agguagugugaugcuccuguuu

SEQ ID NO: 228822 - RNA, 20 nt, Homo sapiens
agguaguuauacaaaugugu

SEQ ID NO: 228823 - RNA, 21 nt, Homo sapiens
agguaguuuuccuuuuggagu

SEQ ID NO: 228824 - RNA, 22 nt, Homo sapiens
agguauuuucaacuuagaaugg

SEQ ID NO: 228825 - RNA, 22 nt, Homo sapiens
agguccauuauuuucauucaug

SEQ ID NO: 228826 - RNA, 22 nt, Homo sapiens
aggugcuaucugguuuuauagu

SEQ ID NO: 228827 - RNA, 22 nt, Homo sapiens
aggugguauuuaaaauuauuug

SEQ ID NO: 228828 - RNA, 22 nt, Homo sapiens
aggugguauuucaaaguggcag

SEQ ID NO: 228829 - RNA, 22 nt, Homo sapiens
aggugguguuggguuccagccc

SEQ ID NO: 228830 - RNA, 22 nt, Homo sapiens
aggugguuuugaugagcaggua

SEQ ID NO: 228831 - RNA, 20 nt, Homo sapiens
agguucaaaucccaaucaug

SEQ ID NO: 228832 - RNA, 22 nt, Homo sapiens
agguucccuuuuggccugggau

SEQ ID NO: 228833 - RNA, 22 nt, Homo sapiens
agguuguugcaugcuccuuagg

SEQ ID NO: 228834 - RNA, 22 nt, Homo sapiens
aguaaagcaucagcuagaugug

SEQ ID NO: 228835 - RNA, 22 nt, Homo sapiens
aguaaagcuacucacugugggc

SEQ ID NO: 228836 - RNA, 22 nt, Homo sapiens
aguaacacaccugcauggugug

SEQ ID NO: 228837 - RNA, 22 nt, Homo sapiens
aguaacaggauccaaagaaugu

SEQ ID NO: 228838 - RNA, 22 nt, Homo sapiens
aguacaauguugaguagaagug

SEQ ID NO: 228839 - RNA, 22 nt, Homo sapiens
aguacaucuggcuggauagaua

SEQ ID NO: 228840 - RNA, 22 nt, Homo sapiens
aguaccauuacucacuuauuuu

SEQ ID NO: 228841 - RNA, 17 nt, Homo sapiens
aguacugucccauccuu

SEQ ID NO: 228842 - RNA, 22 nt, Homo sapiens
aguagguguugguagagguuuc

SEQ ID NO: 228843 - RNA, 22 nt, Homo sapiens
aguaucacaguggguguauacc

SEQ ID NO: 228844 - RNA, 22 nt, Homo sapiens
aguaucaucuuguuggccaggc

SEQ ID NO: 228845 - RNA, 22 nt, Homo sapiens
aguauguagugcaaucagucag

SEQ ID NO: 228846 - RNA, 22 nt, Homo sapiens
aguauguuuugaaaccaagaag

SEQ ID NO: 228847 - RNA, 22 nt, Homo sapiens
agucacaugcauuuucuucaau

SEQ ID NO: 228848 - RNA, 23 nt, Homo sapiens
agucaguaugcuccuuggauccc

SEQ ID NO: 228849 - RNA, 22 nt, Homo sapiens
agucagugcauaagaaugaagu

SEQ ID NO: 228850 - RNA, 22 nt, Homo sapiens
agucaguguguauugauggcac

SEQ ID NO: 228851 - RNA, 22 nt, Homo sapiens
agucauggcagaaggcaccucu

SEQ ID NO: 228852 - RNA, 22 nt, Homo sapiens
aguccaguguuaugaucaguag

SEQ ID NO: 228853 - RNA, 22 nt, Homo sapiens
aguccauuugaugaugauucca

SEQ ID NO: 228854 - RNA, 22 nt, Homo sapiens
agugaaaucugaagaaggucau

SEQ ID NO: 228855 - RNA, 17 nt, Homo sapiens
agugagaucauggcuua

SEQ ID NO: 228856 - RNA, 19 nt, Homo sapiens
agugcaauugccuuugugc

SEQ ID NO: 228857 - RNA, 22 nt, Homo sapiens
agugcauaugucuuuuuggaag

SEQ ID NO: 228858 - RNA, 22 nt, Homo sapiens
agugcauuuguucugugucagg

SEQ ID NO: 228859 - RNA, 22 nt, Homo sapiens
agugccacugcacucuagccug

SEQ ID NO: 228860 - RNA, 22 nt, Homo sapiens
agugccauggcugcuagauggc

SEQ ID NO: 228861 - RNA, 22 nt, Homo sapiens
agugcuuaauagauguccagca

SEQ ID NO: 228862 - RNA, 22 nt, Homo sapiens
aguggcaaugugauguccugaa

SEQ ID NO: 228863 - RNA, 19 nt, Homo sapiens
aguggguguuuucuguuug

SEQ ID NO: 228864 - RNA, 22 nt, Homo sapiens
aguggugucugaguggccaggg

SEQ ID NO: 228865 - RNA, 22 nt, Homo sapiens
agugguuuuaaguagagcauac

SEQ ID NO: 228866 - RNA, 22 nt, Homo sapiens
aguguaaugauauuuggagagg

SEQ ID NO: 228867 - RNA, 22 nt, Homo sapiens
aguguuuuuacaagcacucugg

SEQ ID NO: 228868 - RNA, 22 nt, Homo sapiens
aguguuuuucaugggauacuuu

SEQ ID NO: 228869 - RNA, 22 nt, Homo sapiens
aguuaguguugugauaaaucca

SEQ ID NO: 228870 - RNA, 22 nt, Homo sapiens
aguucaaugcucuuucuacuau

SEQ ID NO: 228871 - RNA, 21 nt, Homo sapiens
aguucacauggcuccuguguu

SEQ ID NO: 228872 - RNA, 22 nt, Homo sapiens
aguuccuacuggcuguaaagaa

SEQ ID NO: 228873 - RNA, 22 nt, Homo sapiens
aguuggcacugagcugugauug

SEQ ID NO: 228874 - RNA, 22 nt, Homo sapiens
aguuuuugcugauagcaugcuu

SEQ ID NO: 228875 - RNA, 22 nt, Homo sapiens
auaaacagcuuauccucuauuc

SEQ ID NO: 228876 - RNA, 22 nt, Homo sapiens
auaaagacacuuggcaugauuu

SEQ ID NO: 228877 - RNA, 22 nt, Homo sapiens
auaaaguagaggugaggugcau

SEQ ID NO: 228878 - RNA, 22 nt, Homo sapiens
auaaauaguaguugugguggcc

SEQ ID NO: 228879 - RNA, 22 nt, Homo sapiens
auaaaugcauugagaacugcug

SEQ ID NO: 228880 - RNA, 20 nt, Homo sapiens
auaaauguauagguguacau

SEQ ID NO: 228881 - RNA, 22 nt, Homo sapiens
auaaggaguaucauauuaaaac

SEQ ID NO: 228882 - RNA, 22 nt, Homo sapiens
auaaggcagcugcuaaaaggca

SEQ ID NO: 228883 - RNA, 22 nt, Homo sapiens
auaaguauuuggacuuuacugu

SEQ ID NO: 228884 - RNA, 22 nt, Homo sapiens
auaagucaauggaacagauuaa

SEQ ID NO: 228885 - RNA, 22 nt, Homo sapiens
auaauacugggaagaugagcau

SEQ ID NO: 228886 - RNA, 22 nt, Homo sapiens
auaauagcugaucauuuagaag

SEQ ID NO: 228887 - RNA, 22 nt, Homo sapiens
auaauaucagguugugaugaug

SEQ ID NO: 228888 - RNA, 22 nt, Homo sapiens
auaauguuugauugagcagaua

SEQ ID NO: 228889 - RNA, 22 nt, Homo sapiens
auacacgguaggcacauauuua

SEQ ID NO: 228890 - RNA, 19 nt, Homo sapiens
auacacguguauacauaca

SEQ ID NO: 228891 - RNA, 22 nt, Homo sapiens
auacacuagggcuccugcagaa

SEQ ID NO: 228892 - RNA, 22 nt, Homo sapiens
auacagacacagucagaggggu

SEQ ID NO: 228893 - RNA, 22 nt, Homo sapiens
auacagugaauaucuggggcag

SEQ ID NO: 228894 - RNA, 22 nt, Homo sapiens
auacaugugcaggucagguuac

SEQ ID NO: 228895 - RNA, 22 nt, Homo sapiens
auacaugugccauguugguuug

SEQ ID NO: 228896 - RNA, 22 nt, Homo sapiens
auacaugugucauguugguuug

SEQ ID NO: 228897 - RNA, 22 nt, Homo sapiens
auacaugugugagcgaagaugu

SEQ ID NO: 228898 - RNA, 16 nt, Homo sapiens
auaccacagugacaca

SEQ ID NO: 228899 - RNA, 22 nt, Homo sapiens
auacugccuuuagcaaaacagu

SEQ ID NO: 228900 - RNA, 22 nt, Homo sapiens
auacuggcuuuccaauugugau

SEQ ID NO: 228901 - RNA, 22 nt, Homo sapiens
auacugucucuugcuccugccc

SEQ ID NO: 228902 - RNA, 21 nt, Homo sapiens
auacuugcauccuuggagaga

SEQ ID NO: 228903 - RNA, 15 nt, Homo sapiens
auagaaugaaaggga

SEQ ID NO: 228904 - RNA, 22 nt, Homo sapiens
auagaauguauuaguaaauuug

SEQ ID NO: 228905 - RNA, 22 nt, Homo sapiens
auagagcuaccauagaauccag

SEQ ID NO: 228906 - RNA, 22 nt, Homo sapiens
auagagcuggcagacacccuua

SEQ ID NO: 228907 - RNA, 22 nt, Homo sapiens
auagaggacugaggugaucuuu

SEQ ID NO: 228908 - RNA, 22 nt, Homo sapiens
auagcaagaugauugauccauu

SEQ ID NO: 228909 - RNA, 22 nt, Homo sapiens
auagcaaugcaagaauggcuua

SEQ ID NO: 228910 - RNA, 22 nt, Homo sapiens
auagcacuuauagauuuggucu

SEQ ID NO: 228911 - RNA, 22 nt, Homo sapiens
auagcagugucccacuccuugg

SEQ ID NO: 228912 - RNA, 22 nt, Homo sapiens
auagcagugugaaaacagacua

SEQ ID NO: 228913 - RNA, 22 nt, Homo sapiens
auagcagugugaggacagacua

SEQ ID NO: 228914 - RNA, 22 nt, Homo sapiens
auagccaguagagagcuguuag

SEQ ID NO: 228915 - RNA, 22 nt, Homo sapiens
auagccuguaggccuuaaggug

SEQ ID NO: 228916 - RNA, 22 nt, Homo sapiens
auaggagcacaaacuauuguga

SEQ ID NO: 228917 - RNA, 22 nt, Homo sapiens
auaggagugugcacagaguagg

SEQ ID NO: 228918 - RNA, 22 nt, Homo sapiens
auaguagagagggcaaaaugcu

SEQ ID NO: 228919 - RNA, 22 nt, Homo sapiens
auaguauaguugaggauggcau

SEQ ID NO: 228920 - RNA, 22 nt, Homo sapiens
auagugaacuuugugagaacaa

SEQ ID NO: 228921 - RNA, 22 nt, Homo sapiens
auagugcugcaauaaccauggg

SEQ ID NO: 228922 - RNA, 22 nt, Homo sapiens
auagugcugcaaucaacauaca

SEQ ID NO: 228923 - RNA, 22 nt, Homo sapiens
auagugcugcauuaaacauacg

SEQ ID NO: 228924 - RNA, 22 nt, Homo sapiens
auagugcugccauaaacauacg

SEQ ID NO: 228925 - RNA, 22 nt, Homo sapiens
auagugcuggaauaaauauacg

SEQ ID NO: 228926 - RNA, 22 nt, Homo sapiens
auauaguguuuuuugguacgcu

SEQ ID NO: 228927 - RNA, 22 nt, Homo sapiens
auauaugcacacgugugcauau

SEQ ID NO: 228928 - RNA, 22 nt, Homo sapiens
auaucaacaucgugucauuagu

SEQ ID NO: 228929 - RNA, 22 nt, Homo sapiens
auaucacaggaaaggaagauac

SEQ ID NO: 228930 - RNA, 22 nt, Homo sapiens
auaucagugucuuacuguuuuu

SEQ ID NO: 228931 - RNA, 22 nt, Homo sapiens
auaucccuguauaagugaaugu

SEQ ID NO: 228932 - RNA, 22 nt, Homo sapiens
auauccuggagcauuuuugcaa

SEQ ID NO: 228933 - RNA, 16 nt, Homo sapiens
auaugacuuuaggagg

SEQ ID NO: 228934 - RNA, 22 nt, Homo sapiens
auaugcacgugcauacacacuu

SEQ ID NO: 228935 - RNA, 20 nt, Homo sapiens
auaugcagacacauacauac

SEQ ID NO: 228936 - RNA, 20 nt, Homo sapiens
auaugcauguguuuucacuu

SEQ ID NO: 228937 - RNA, 22 nt, Homo sapiens
auaugccacugaacuguaccca

SEQ ID NO: 228938 - RNA, 21 nt, Homo sapiens
auauggaacuggugacguguu

SEQ ID NO: 228939 - RNA, 22 nt, Homo sapiens
auauggcauucagaacuguaua

SEQ ID NO: 228940 - RNA, 22 nt, Homo sapiens
auauggucccuguucucaagga

SEQ ID NO: 228941 - RNA, 22 nt, Homo sapiens
auaugguuuuuggaagcauauc

SEQ ID NO: 228942 - RNA, 22 nt, Homo sapiens
auauguaguauggaaacauugu

SEQ ID NO: 228943 - RNA, 22 nt, Homo sapiens
auaugucuauuauuagggcagg

SEQ ID NO: 228944 - RNA, 21 nt, Homo sapiens
auaugugcuguggaagucagc

SEQ ID NO: 228945 - RNA, 22 nt, Homo sapiens
auauucacuauaugcagaacca

SEQ ID NO: 228946 - RNA, 22 nt, Homo sapiens
auauugacuuucucuuagauca

SEQ ID NO: 228947 - RNA, 18 nt, Homo sapiens
auauugcauuggauggau

SEQ ID NO: 228948 - RNA, 22 nt, Homo sapiens
auauugcuccuaauaccacggu

SEQ ID NO: 228949 - RNA, 22 nt, Homo sapiens
auauugcuuagugaugaagucu

SEQ ID NO: 228950 - RNA, 22 nt, Homo sapiens
auauuguuggcugcuggcugau

SEQ ID NO: 228951 - RNA, 22 nt, Homo sapiens
aucaaagcagcauggcccaguc

SEQ ID NO: 228952 - RNA, 22 nt, Homo sapiens
aucaaaguaggcauauguuuuu

SEQ ID NO: 228953 - RNA, 22 nt, Homo sapiens
aucaaaguaucucaauauggua

SEQ ID NO: 228954 - RNA, 22 nt, Homo sapiens
aucaaagugaaauauuaguuau

SEQ ID NO: 228955 - RNA, 22 nt, Homo sapiens
aucaagcuggcauauguaguuc

SEQ ID NO: 228956 - RNA, 22 nt, Homo sapiens
aucacagagucacgggcaacuu

SEQ ID NO: 228957 - RNA, 22 nt, Homo sapiens
augauauuauucuagcccagag

SEQ ID NO: 228958 - RNA, 22 nt, Homo sapiens
augaucauggaagugcacccau

SEQ ID NO: 228959 - RNA, 22 nt, Homo sapiens
augauggaggccgugauggacg

SEQ ID NO: 228960 - RNA, 22 nt, Homo sapiens
augauguaggccauggguuucu

SEQ ID NO: 228961 - RNA, 22 nt, Homo sapiens
augauguguguuuaagaugucu

SEQ ID NO: 228962 - RNA, 22 nt, Homo sapiens
augcaaggaugguuagauauau

SEQ ID NO: 228963 - RNA, 19 nt, Homo sapiens
augcaaugucacaggcugc

SEQ ID NO: 228964 - RNA, 22 nt, Homo sapiens
augcacuguauaggaucuugcg

SEQ ID NO: 228965 - RNA, 22 nt, Homo sapiens
augcacuguuguuauuggauaa

SEQ ID NO: 228966 - RNA, 22 nt, Homo sapiens
augcauauuuuaccuagaagag

SEQ ID NO: 228967 - RNA, 22 nt, Homo sapiens
augccaagaugagcacgcgucu

SEQ ID NO: 228968 - RNA, 19 nt, Homo sapiens
augccacagugaggucaga

SEQ ID NO: 228969 - RNA, 22 nt, Homo sapiens
augccacugcacuccaaccugg

SEQ ID NO: 228970 - RNA, 22 nt, Homo sapiens
augccacugcacuucagccugg

SEQ ID NO: 228971 - RNA, 22 nt, Homo sapiens
augccacuguccuccugccuag

SEQ ID NO: 228972 - RNA, 22 nt, Homo sapiens
augccacuucucuaagucaugu

SEQ ID NO: 228973 - RNA, 22 nt, Homo sapiens
augccucugacaauuggauucu

SEQ ID NO: 228974 - RNA, 22 nt, Homo sapiens
augcuaucauucaggauuuguu

SEQ ID NO: 228975 - RNA, 22 nt, Homo sapiens
augcuaugugugacuucuuaug

SEQ ID NO: 228976 - RNA, 19 nt, Homo sapiens
augcugguguugcucaaac

SEQ ID NO: 228977 - RNA, 22 nt, Homo sapiens
augcuuguugcagccugagccu

SEQ ID NO: 228978 - RNA, 19 nt, Homo sapiens
auggaacugcuggagccac

SEQ ID NO: 228979 - RNA, 22 nt, Homo sapiens
auggaacuggagaucauuaugu

SEQ ID NO: 228980 - RNA, 22 nt, Homo sapiens
auggaagcugauuagauaguac

SEQ ID NO: 228981 - RNA, 22 nt, Homo sapiens
auggaaggagaggaaugaauga

SEQ ID NO: 228982 - RNA, 22 nt, Homo sapiens
auggaagucucuguuaaguuuc

SEQ ID NO: 228983 - RNA, 22 nt, Homo sapiens
auggaaucauccuccugggagc

SEQ ID NO: 228984 - RNA, 22 nt, Homo sapiens
auggaaugccauuuauaaugga

SEQ ID NO: 228985 - RNA, 22 nt, Homo sapiens
auggaauguggaaugguaagua

SEQ ID NO: 228986 - RNA, 22 nt, Homo sapiens
auggacagacacuggccuucug

SEQ ID NO: 228987 - RNA, 21 nt, Homo sapiens
auggacaugguuaggcuuugu

SEQ ID NO: 228988 - RNA, 22 nt, Homo sapiens
auggagcaaaacagauuuggga

SEQ ID NO: 228989 - RNA, 22 nt, Homo sapiens
auggaggaggaagcugaaacaa

SEQ ID NO: 228990 - RNA, 22 nt, Homo sapiens
auggaggccuacagaauuuugg

SEQ ID NO: 228991 - RNA, 22 nt, Homo sapiens
auggagguguggggagugaguu

SEQ ID NO: 228992 - RNA, 22 nt, Homo sapiens
auggaguguaauauugagagcu

SEQ ID NO: 228993 - RNA, 22 nt, Homo sapiens
auggaguguucugaauccuuug

SEQ ID NO: 228994 - RNA, 22 nt, Homo sapiens
auggauguucuagggaugugau

SEQ ID NO: 228995 - RNA, 22 nt, Homo sapiens
auggcaauaauagcuaccauuu

SEQ ID NO: 228996 - RNA, 22 nt, Homo sapiens
auggcaaugcgauggugacuga

SEQ ID NO: 228997 - RNA, 22 nt, Homo sapiens
auggcaccauguuaugauaaua

SEQ ID NO: 228998 - RNA, 22 nt, Homo sapiens
auggcacuaaugggaguuuacu

SEQ ID NO: 228999 - RNA, 22 nt, Homo sapiens
auggcacuccagccugggcaac

SEQ ID NO: 229000 - RNA, 22 nt, Homo sapiens
auggcacuguguccugggguca

SEQ ID NO: 229001 - RNA, 18 nt, Homo sapiens
auggcagaacaauuuaca

SEQ ID NO: 229002 - RNA, 22 nt, Homo sapiens
auggcagcaccccacucuacug

SEQ ID NO: 229003 - RNA, 22 nt, Homo sapiens
auggcagcugguuuuacccuag

SEQ ID NO: 229004 - RNA, 22 nt, Homo sapiens
auggcagugucuagggguguuu

SEQ ID NO: 229005 - RNA, 22 nt, Homo sapiens
auggcauggugcaggguuuaag

SEQ ID NO: 229006 - RNA, 22 nt, Homo sapiens
auggcauuuuuagggcugggug

SEQ ID NO: 229007 - RNA, 22 nt, Homo sapiens
auggccuuuuuaucucaccaag

SEQ ID NO: 229008 - RNA, 22 nt, Homo sapiens
auggcuauuccauaggcagagc

SEQ ID NO: 229009 - RNA, 22 nt, Homo sapiens
auggcucaguguguaucuauca

SEQ ID NO: 229010 - RNA, 22 nt, Homo sapiens
auggcucuggauagaaugcagg

SEQ ID NO: 229011 - RNA, 22 nt, Homo sapiens
auggcucuguuuuuuaugcucu

SEQ ID NO: 229012 - RNA, 22 nt, Homo sapiens
auggcucuuauuauuuugaggu

SEQ ID NO: 229013 - RNA, 22 nt, Homo sapiens
auggcugagugauuucaaacag

SEQ ID NO: 229014 - RNA, 22 nt, Homo sapiens
auggcuguuuuuuauguuacag

SEQ ID NO: 229015 - RNA, 22 nt, Homo sapiens
auggcuuuggucucccagugau

SEQ ID NO: 229016 - RNA, 22 nt, Homo sapiens
auggcuuuuauuguguugaggu

SEQ ID NO: 229017 - RNA, 22 nt, Homo sapiens
auggcuuuugaccugguaggau

SEQ ID NO: 229018 - RNA, 22 nt, Homo sapiens
auggcuuuugcccuaaauggau

SEQ ID NO: 229019 - RNA, 22 nt, Homo sapiens
auggcuuuuuaaaucauguugu

SEQ ID NO: 229020 - RNA, 22 nt, Homo sapiens
auggcuuuuuucuugggcacuc

SEQ ID NO: 229021 - RNA, 22 nt, Homo sapiens
augggcaaauguuggaaauucc

SEQ ID NO: 229022 - RNA, 21 nt, Homo sapiens
augggguagaagagaaggcuu

SEQ ID NO: 229023 - RNA, 22 nt, Homo sapiens
augggguaggcuugcuguagua

SEQ ID NO: 229024 - RNA, 22 nt, Homo sapiens
augggugaguaugaguugacuu

SEQ ID NO: 229025 - RNA, 22 nt, Homo sapiens
augguaagcugaaaauaucgaa

SEQ ID NO: 229026 - RNA, 22 nt, Homo sapiens
augguacuagaguaagaauugu

SEQ ID NO: 229027 - RNA, 21 nt, Homo sapiens
augguacugucucuggagaua

SEQ ID NO: 229028 - RNA, 20 nt, Homo sapiens
augguaguagcaccuuuaca

SEQ ID NO: 229029 - RNA, 21 nt, Homo sapiens
auggugagaaaguagugucaa

SEQ ID NO: 229030 - RNA, 22 nt, Homo sapiens
augguugguuaaaucuguguau

SEQ ID NO: 229031 - RNA, 22 nt, Homo sapiens
auguaaacauuuggucuaaauu

SEQ ID NO: 229032 - RNA, 22 nt, Homo sapiens
auguaaacuacagauuuugggu

SEQ ID NO: 229033 - RNA, 22 nt, Homo sapiens
auguaacacagugcggcugggc

SEQ ID NO: 229034 - RNA, 22 nt, Homo sapiens
auguaacuaucugagccauggg

SEQ ID NO: 229035 - RNA, 21 nt, Homo sapiens
auguaacugggaaugugagag

SEQ ID NO: 229036 - RNA, 17 nt, Homo sapiens
auguaauccucaucucu

SEQ ID NO: 229037 - RNA, 22 nt, Homo sapiens
auguagugugauuuucacuaga

SEQ ID NO: 229038 - RNA, 22 nt, Homo sapiens
auguauacaugcaggucacagg

SEQ ID NO: 229039 - RNA, 22 nt, Homo sapiens
auguauggcagguuugggguuu

SEQ ID NO: 229040 - RNA, 22 nt, Homo sapiens
augucaacauagacaguagagu

SEQ ID NO: 229041 - RNA, 22 nt, Homo sapiens
auguccaugagcacauguauca

SEQ ID NO: 229042 - RNA, 22 nt, Homo sapiens
auguccauggaaucuguagcaa

SEQ ID NO: 229043 - RNA, 22 nt, Homo sapiens
auguccuggacccagacaaagc

SEQ ID NO: 229044 - RNA, 22 nt, Homo sapiens
augucuguuugcugagcccggc

SEQ ID NO: 229045 - RNA, 22 nt, Homo sapiens
augucuuucauagagacccaga

SEQ ID NO: 229046 - RNA, 22 nt, Homo sapiens
augugacagcaacccccagccc

SEQ ID NO: 229047 - RNA, 22 nt, Homo sapiens
augugacagugguuuuaagcgu

SEQ ID NO: 229048 - RNA, 22 nt, Homo sapiens
augugacugauguaaucagaca

SEQ ID NO: 229049 - RNA, 22 nt, Homo sapiens
augugaugguuaauuuuaugug

SEQ ID NO: 229050 - RNA, 22 nt, Homo sapiens
augugcaacugcuggaacaguc

SEQ ID NO: 229051 - RNA, 22 nt, Homo sapiens
augugcacaacgugcagguuug

SEQ ID NO: 229052 - RNA, 21 nt, Homo sapiens
augugcacuaugucauuuaau

SEQ ID NO: 229053 - RNA, 22 nt, Homo sapiens
augugcuagguacuguuuagca

SEQ ID NO: 229054 - RNA, 22 nt, Homo sapiens
augugcuuaaaaaugcagagaa

SEQ ID NO: 229055 - RNA, 22 nt, Homo sapiens
caaaugacaucauuucauucaa

SEQ ID NO: 229056 - RNA, 22 nt, Homo sapiens
caagacuguccaacauauuggg

SEQ ID NO: 229057 - RNA, 22 nt, Homo sapiens
caagagaccugagugucauucu

SEQ ID NO: 229058 - RNA, 22 nt, Homo sapiens
caagaggcuguguauaaagcca

SEQ ID NO: 229059 - RNA, 22 nt, Homo sapiens
caaggugcugagacaggagccc

SEQ ID NO: 229060 - RNA, 22 nt, Homo sapiens
caaguacugggcuauggauauu

SEQ ID NO: 229061 - RNA, 22 nt, Homo sapiens
caaguguuuccuuaaauacuug

SEQ ID NO: 229062 - RNA, 22 nt, Homo sapiens
caauggcacuauuggaaaaggu

SEQ ID NO: 229063 - RNA, 22 nt, Homo sapiens
caaugguacuagauaucuucag

SEQ ID NO: 229064 - RNA, 22 nt, Homo sapiens
cacaaugucuaagauguuucua

SEQ ID NO: 229065 - RNA, 22 nt, Homo sapiens
cacaaugucugguaggccacuu

SEQ ID NO: 229066 - RNA, 22 nt, Homo sapiens
cacagaauucauuggauuaccu

SEQ ID NO: 229067 - RNA, 22 nt, Homo sapiens
cacagcgacuuccgccuaccgg

SEQ ID NO: 229068 - RNA, 22 nt, Homo sapiens
cacagggcuaacauuuuugccc

SEQ ID NO: 229069 - RNA, 22 nt, Homo sapiens
cacagucuugcaauauugagau

SEQ ID NO: 229070 - RNA, 22 nt, Homo sapiens
cacaguguuacugguaugaagu

SEQ ID NO: 229071 - RNA, 21 nt, Homo sapiens
cacauggaggcagagagugua

SEQ ID NO: 229072 - RNA, 22 nt, Homo sapiens
caccagcuggcauugaauaccu

SEQ ID NO: 229073 - RNA, 23 nt, Homo sapiens
caccaguagaaugugugggaggg

SEQ ID NO: 229074 - RNA, 22 nt, Homo sapiens
cacccgugacgcugucugaaau

SEQ ID NO: 229075 - RNA, 22 nt, Homo sapiens
cacccuugcagggacagcuuug

SEQ ID NO: 229076 - RNA, 22 nt, Homo sapiens
caccgagguuggagugcagugg

SEQ ID NO: 229077 - RNA, 22 nt, Homo sapiens
cacugaaugugagguuggggag

SEQ ID NO: 229078 - RNA, 22 nt, Homo sapiens
cacugcacuccagcuugugggc

SEQ ID NO: 229079 - RNA, 22 nt, Homo sapiens
cacugcacuccagcuuugguga

SEQ ID NO: 229080 - RNA, 22 nt, Homo sapiens
cacugcacuccagucuggcgac

SEQ ID NO: 229081 - RNA, 22 nt, Homo sapiens
cacugcaguggaagauuaagaa

SEQ ID NO: 229082 - RNA, 22 nt, Homo sapiens
cacugcauggucuagcuggguu

SEQ ID NO: 229083 - RNA, 22 nt, Homo sapiens
cacugcgaccucugccuaccgg

SEQ ID NO: 229084 - RNA, 22 nt, Homo sapiens
cacugcgacguccgccucccgg

SEQ ID NO: 229085 - RNA, 22 nt, Homo sapiens
cacugggccaucacuuaauauu

SEQ ID NO: 229086 - RNA, 22 nt, Homo sapiens
cacugggugagauccauguuua

SEQ ID NO: 229087 - RNA, 17 nt, Homo sapiens
cacugggugcaagagga

SEQ ID NO: 229088 - RNA, 22 nt, Homo sapiens
cacuggguuagaacaugcuccu

SEQ ID NO: 229089 - RNA, 21 nt, Homo sapiens
cacuggguucaggcuugugga

SEQ ID NO: 229090 - RNA, 22 nt, Homo sapiens
cacuggucagugaaacaguauu

SEQ ID NO: 229091 - RNA, 22 nt, Homo sapiens
cagagaacauucagagcuguag

SEQ ID NO: 229092 - RNA, 22 nt, Homo sapiens
cagagagcuugcccuuguauau

SEQ ID NO: 229093 - RNA, 20 nt, Homo sapiens
cagagcaaagcaguccuggc

SEQ ID NO: 229094 - RNA, 22 nt, Homo sapiens
cagagucaagcucuuguuccau

SEQ ID NO: 229095 - RNA, 22 nt, Homo sapiens
cagauacuggaguccugaaguu

SEQ ID NO: 229096 - RNA, 22 nt, Homo sapiens
cagauguaguauuuuagugaaa

SEQ ID NO: 229097 - RNA, 22 nt, Homo sapiens
cagcccuacacagacugacuca

SEQ ID NO: 229098 - RNA, 22 nt, Homo sapiens
cagcuggugggagcuggguucc

SEQ ID NO: 229099 - RNA, 22 nt, Homo sapiens
cagggaauguuauuuaauagca

SEQ ID NO: 229100 - RNA, 22 nt, Homo sapiens
cagguagucaacgggucuugga

SEQ ID NO: 229101 - RNA, 22 nt, Homo sapiens
caguacaauguggaaaaggagu

SEQ ID NO: 229102 - RNA, 22 nt, Homo sapiens
cagugcaaagccucugcccaga

SEQ ID NO: 229103 - RNA, 20 nt, Homo sapiens
cagugcaccuggcguguuga

SEQ ID NO: 229104 - RNA, 22 nt, Homo sapiens
cagugcauccauguucagcagu

SEQ ID NO: 229105 - RNA, 23 nt, Homo sapiens
cagugcaugacuguauaugcaaa

SEQ ID NO: 229106 - RNA, 22 nt, Homo sapiens
cagugcauguggcacucuccag

SEQ ID NO: 229107 - RNA, 22 nt, Homo sapiens
caguggaugauguuuucugugg

SEQ ID NO: 229108 - RNA, 22 nt, Homo sapiens
cagugguuuucaacccugguug

SEQ ID NO: 229109 - RNA, 22 nt, Homo sapiens
cagugguuuuuagcuugcuggg

SEQ ID NO: 229110 - RNA, 22 nt, Homo sapiens
caguguaugcuucuauuuuugg

SEQ ID NO: 229111 - RNA, 22 nt, Homo sapiens
cagugucugcauuuggaacuca

SEQ ID NO: 229112 - RNA, 22 nt, Homo sapiens
caguugcacuagccccguuuca

SEQ ID NO: 229113 - RNA, 22 nt, Homo sapiens
cauaaagauggaggaggccagg

SEQ ID NO: 229114 - RNA, 22 nt, Homo sapiens
cauaaaucuuguugaauagcac

SEQ ID NO: 229115 - RNA, 21 nt, Homo sapiens
cauaaugcuacuuauuuuaug

SEQ ID NO: 229116 - RNA, 22 nt, Homo sapiens
cauagcacacguauaccuaugu

SEQ ID NO: 229117 - RNA, 22 nt, Homo sapiens
cauagguugggcguuugauuuu

SEQ ID NO: 229118 - RNA, 22 nt, Homo sapiens
cauaugguuuuauguucuucau

SEQ ID NO: 229119 - RNA, 22 nt, Homo sapiens
caucacacuuggauguaagaca

SEQ ID NO: 229120 - RNA, 23 nt, Homo sapiens
caucacagagccuuccuugacuc

SEQ ID NO: 229121 - RNA, 22 nt, Homo sapiens
caucacauucugagauacugag

SEQ ID NO: 229122 - RNA, 22 nt, Homo sapiens
caucacuguugguacaaguaau

SEQ ID NO: 229123 - RNA, 22 nt, Homo sapiens
caucacuuuuccuuuuacagau

SEQ ID NO: 229124 - RNA, 22 nt, Homo sapiens
caucgcacuccagcuugggcaa

SEQ ID NO: 229125 - RNA, 22 nt, Homo sapiens
caucucauugaauugcugagca

SEQ ID NO: 229126 - RNA, 22 nt, Homo sapiens
caugaaagugagaaacuccugg

SEQ ID NO: 229127 - RNA, 22 nt, Homo sapiens
caugccacugcacgccauccug

SEQ ID NO: 229128 - RNA, 22 nt, Homo sapiens
caugccacuguggacaaagaca

SEQ ID NO: 229129 - RNA, 22 nt, Homo sapiens
cauggagcuaggcuugaucccu

SEQ ID NO: 229130 - RNA, 22 nt, Homo sapiens
cauggauuuuuuugaauggcag

SEQ ID NO: 229131 - RNA, 22 nt, Homo sapiens
cauggcacagagaauguguucu

SEQ ID NO: 229132 - RNA, 22 nt, Homo sapiens
cauggcacaucuuuucugacua

SEQ ID NO: 229133 - RNA, 22 nt, Homo sapiens
cauggcacugagcagguaugca

SEQ ID NO: 229134 - RNA, 22 nt, Homo sapiens
cauggcacuggugggagugucu

SEQ ID NO: 229135 - RNA, 22 nt, Homo sapiens
cauggccuuuggaaugugucua

SEQ ID NO: 229136 - RNA, 22 nt, Homo sapiens
cauggcucuuguuuacucccag

SEQ ID NO: 229137 - RNA, 23 nt, Homo sapiens
cauggcuguuaacacuguuugag

SEQ ID NO: 229138 - RNA, 22 nt, Homo sapiens
cauggcuuguauaagauucuca

SEQ ID NO: 229139 - RNA, 22 nt, Homo sapiens
caugggcacugacuugcauucg

SEQ ID NO: 229140 - RNA, 22 nt, Homo sapiens
cauguauagauuccauaguggu

SEQ ID NO: 229141 - RNA, 22 nt, Homo sapiens
caugugcaugagcacauacgug

SEQ ID NO: 229142 - RNA, 22 nt, Homo sapiens
cauuaguugaagugcagggaga

SEQ ID NO: 229143 - RNA, 22 nt, Homo sapiens
cauuccacuggauaaacaaggu

SEQ ID NO: 229144 - RNA, 22 nt, Homo sapiens
cauugcacuccagccuagccaa

SEQ ID NO: 229145 - RNA, 22 nt, Homo sapiens
cauugcacuccagccucggcaa

SEQ ID NO: 229146 - RNA, 22 nt, Homo sapiens
cauugcacuccagccugaggga

SEQ ID NO: 229147 - RNA, 22 nt, Homo sapiens
cauugcacuccagcucugggcg

SEQ ID NO: 229148 - RNA, 22 nt, Homo sapiens
cauugcacuccauccuuggcaa

SEQ ID NO: 229149 - RNA, 16 nt, Homo sapiens
cauugcacucuagccu

SEQ ID NO: 229150 - RNA, 22 nt, Homo sapiens
cauugcacucugcauuccaguc

SEQ ID NO: 229151 - RNA, 22 nt, Homo sapiens
cauugcacugcagcccgggcaa

SEQ ID NO: 229152 - RNA, 22 nt, Homo sapiens
cauugcacuuagacaacuuuug

SEQ ID NO: 229153 - RNA, 22 nt, Homo sapiens
cugggaugauguaaauaggcua

SEQ ID NO: 229154 - RNA, 22 nt, Homo sapiens
cuggguacccuuuaaacaggaa

SEQ ID NO: 229155 - RNA, 22 nt, Homo sapiens
cugguaguguuuauaaggguau

SEQ ID NO: 229156 - RNA, 22 nt, Homo sapiens
cuggugugugacuuuucauuau

SEQ ID NO: 229157 - RNA, 22 nt, Homo sapiens
cugguuguuacaugcuugccag

SEQ ID NO: 229158 - RNA, 22 nt, Homo sapiens
cuguaaaguaagagguaaguua

SEQ ID NO: 229159 - RNA, 22 nt, Homo sapiens
cuguagcuuuuauaugcuuagc

SEQ ID NO: 229160 - RNA, 22 nt, Homo sapiens
cuguauguuucuaugaauguga

SEQ ID NO: 229161 - RNA, 19 nt, Homo sapiens
cugucacugaggaagacug

SEQ ID NO: 229162 - RNA, 22 nt, Homo sapiens
cugucucagccucuccaguagc

SEQ ID NO: 229163 - RNA, 22 nt, Homo sapiens
cugucuguuucaaaagugguua

SEQ ID NO: 229164 - RNA, 22 nt, Homo sapiens
cugugauuauauaguuaaggua

SEQ ID NO: 229165 - RNA, 22 nt, Homo sapiens
cugugcaaagcgcucucggggu

SEQ ID NO: 229166 - RNA, 22 nt, Homo sapiens
cugugcaugcgcggagcugaaa

SEQ ID NO: 229167 - RNA, 22 nt, Homo sapiens
cugugccaagcuugcgaugugc

SEQ ID NO: 229168 - RNA, 22 nt, Homo sapiens
cugugcuuggagucccccuagg

SEQ ID NO: 229169 - RNA, 22 nt, Homo sapiens
cuguggauguauugcacagucu

SEQ ID NO: 229170 - RNA, 19 nt, Homo sapiens
cuguggucauuauuuugcu

SEQ ID NO: 229171 - RNA, 23 nt, Homo sapiens
cuguggugaggcccuagaaucug

SEQ ID NO: 229172 - RNA, 22 nt, Homo sapiens
cugugguuacguucuuugugcu

SEQ ID NO: 229173 - RNA, 22 nt, Homo sapiens
cuguuauguuugauggaugaau

SEQ ID NO: 229174 - RNA, 22 nt, Homo sapiens
cuguucaggaggcauuuggugg

SEQ ID NO: 229175 - RNA, 22 nt, Homo sapiens
cuguuugguaaggaugccucag

SEQ ID NO: 229176 - RNA, 22 nt, Homo sapiens
cuuagcaugucagcaccggguu

SEQ ID NO: 229177 - RNA, 22 nt, Homo sapiens
cuuagguaggugccagguuuuu

SEQ ID NO: 229178 - RNA, 22 nt, Homo sapiens
cuucaaguaauucugauggcua

SEQ ID NO: 229179 - RNA, 22 nt, Homo sapiens
cuucacuuuguuaaacuccaau

SEQ ID NO: 229180 - RNA, 22 nt, Homo sapiens
cuucaucugguuugugaacuuu

SEQ ID NO: 229181 - RNA, 18 nt, Homo sapiens
cuucauugcuguuuugcu

SEQ ID NO: 229182 - RNA, 22 nt, Homo sapiens
cuuccauaguuacacccaggga

SEQ ID NO: 229183 - RNA, 22 nt, Homo sapiens
cuuccauauucuaggacaggcu

SEQ ID NO: 229184 - RNA, 22 nt, Homo sapiens
cuuccugaguccugggcucaca

SEQ ID NO: 229185 - RNA, 22 nt, Homo sapiens
cuugaccaauauggugaaaccc

SEQ ID NO: 229186 - RNA, 22 nt, Homo sapiens
cuugagcaaacaaaggugguag

SEQ ID NO: 229187 - RNA, 22 nt, Homo sapiens
cuugcacuugaaauuccaguuu

SEQ ID NO: 229188 - RNA, 22 nt, Homo sapiens
cuugcagagcccauggauguca

SEQ ID NO: 229189 - RNA, 19 nt, Homo sapiens
cuugccccauucauccucu

SEQ ID NO: 229190 - RNA, 20 nt, Homo sapiens
cuugccuagcccuuugccuc

SEQ ID NO: 229191 - RNA, 22 nt, Homo sapiens
cuugccuuugucuucaaaggcu

SEQ ID NO: 229192 - RNA, 22 nt, Homo sapiens
cuuggcuucuuuauguggcuau

SEQ ID NO: 229193 - RNA, 22 nt, Homo sapiens
cuugggauauguguuacucugu

SEQ ID NO: 229194 - RNA, 22 nt, Homo sapiens
cuuggguaagucauuaaaauua

SEQ ID NO: 229195 - RNA, 19 nt, Homo sapiens
cuuguacucggcgcaguug

SEQ ID NO: 229196 - RNA, 19 nt, Homo sapiens
cuugugccugaagcuuggg

SEQ ID NO: 229197 - RNA, 22 nt, Homo sapiens
cuuguuguggaggggagugcag

SEQ ID NO: 229198 - RNA, 17 nt, Homo sapiens
cuuguugugguaguuug

SEQ ID NO: 229199 - RNA, 22 nt, Homo sapiens
cuuuagcaauugauuaugccau

SEQ ID NO: 229200 - RNA, 22 nt, Homo sapiens
cuuuaguugucuccucaagggu

SEQ ID NO: 229201 - RNA, 22 nt, Homo sapiens
cuuugcacaucucugcuuuccc

SEQ ID NO: 229202 - RNA, 18 nt, Homo sapiens
cuuugcagcuuccagagg

SEQ ID NO: 229203 - RNA, 22 nt, Homo sapiens
cuuuggauggaaccucucuuuc

SEQ ID NO: 229204 - RNA, 20 nt, Homo sapiens
cuuuggcaaugagaacaggg

SEQ ID NO: 229205 - RNA, 21 nt, Homo sapiens
cuuugguagaguuuuuagggu

SEQ ID NO: 229206 - RNA, 22 nt, Homo sapiens
cuuuggucaaaauaaguaaguu

SEQ ID NO: 229207 - RNA, 22 nt, Homo sapiens
cuuuguccuucaagguguguca

SEQ ID NO: 229208 - RNA, 22 nt, Homo sapiens
cuuugugcccuucugcccauca

SEQ ID NO: 229209 - RNA, 22 nt, Homo sapiens
cuuuugcugggucagcgguggu

SEQ ID NO: 229210 - RNA, 22 nt, Homo sapiens
cuuuuggucuaucagagaagca

SEQ ID NO: 229211 - RNA, 21 nt, Homo sapiens
cuuuuuacucguucauaugca

SEQ ID NO: 229212 - RNA, 22 nt, Homo sapiens
cuuuuugcaaauacaacucuga

SEQ ID NO: 229213 - RNA, 22 nt, Homo sapiens
gaaagcugguauagauacauua

SEQ ID NO: 229214 - RNA, 22 nt, Homo sapiens
gaaagguaggaacagggugcag

SEQ ID NO: 229215 - RNA, 22 nt, Homo sapiens
gaaaguaauuaacgauuguugc

SEQ ID NO: 229216 - RNA, 22 nt, Homo sapiens
gaaagugcugcaaggccaugca

SEQ ID NO: 229217 - RNA, 22 nt, Homo sapiens
gaaaugcucagggguuuuccag

SEQ ID NO: 229218 - RNA, 22 nt, Homo sapiens
gaaauggaucagagcaagcuuu

SEQ ID NO: 229219 - RNA, 22 nt, Homo sapiens
gaaauguauuaaugaguugaaa

SEQ ID NO: 229220 - RNA, 22 nt, Homo sapiens
gaaaugucugagauguggcuca

SEQ ID NO: 229221 - RNA, 22 nt, Homo sapiens
gaaauguugauagugggcauug

SEQ ID NO: 229222 - RNA, 22 nt, Homo sapiens
gaacugggguuggguugcgaua

SEQ ID NO: 229223 - RNA, 20 nt, Homo sapiens
gaacugguguauguuuaacu

SEQ ID NO: 229224 - RNA, 22 nt, Homo sapiens
gaacuguaaagaaauucuaagg

SEQ ID NO: 229225 - RNA, 22 nt, Homo sapiens
gaagcauugauccacaggcgug

SEQ ID NO: 229226 - RNA, 22 nt, Homo sapiens
gaagcgaggugauuagcagaca

SEQ ID NO: 229227 - RNA, 22 nt, Homo sapiens
gaagguacgcuuaggaaaugau

SEQ ID NO: 229228 - RNA, 22 nt, Homo sapiens
gaaguaauaaauggauucuuaa

SEQ ID NO: 229229 - RNA, 23 nt, Homo sapiens
gaaguauagcaugcacauggaaa

SEQ ID NO: 229230 - RNA, 22 nt, Homo sapiens
gaauacuguccaagagugaugg

SEQ ID NO: 229231 - RNA, 22 nt, Homo sapiens
gaauagugcugcaauaaacaua

SEQ ID NO: 229232 - RNA, 22 nt, Homo sapiens
gaauagugcugcgauaaacaua

SEQ ID NO: 229233 - RNA, 22 nt, Homo sapiens
gaaucacaguuauuagagcagc

SEQ ID NO: 229234 - RNA, 22 nt, Homo sapiens
gaaucccuugcauuaucccuuu

SEQ ID NO: 229235 - RNA, 22 nt, Homo sapiens
gaaugcagcagugacagggcug

SEQ ID NO: 229236 - RNA, 22 nt, Homo sapiens
gaaugcuaccagcaucuagugg

SEQ ID NO: 229237 - RNA, 22 nt, Homo sapiens
gaaugugcuguuggcugggcgu

SEQ ID NO: 229238 - RNA, 22 nt, Homo sapiens
gacaaguuugauuuauuccaag

SEQ ID NO: 229239 - RNA, 22 nt, Homo sapiens
gacaccugguguggaacuggag

SEQ ID NO: 229240 - RNA, 18 nt, Homo sapiens
gacaguguggcaauuccu

SEQ ID NO: 229241 - RNA, 18 nt, Homo sapiens
gacaguguggcgauuccu

SEQ ID NO: 229242 - RNA, 22 nt, Homo sapiens
gacaguuucucaggcuuccuua

SEQ ID NO: 229243 - RNA, 22 nt, Homo sapiens
gacaucauuaugagauuuaaac

SEQ ID NO: 229244 - RNA, 20 nt, Homo sapiens
gacaugacuaggagauagcc

SEQ ID NO: 229245 - RNA, 20 nt, Homo sapiens
gacauguugguuugcugcac

SEQ ID NO: 229246 - RNA, 22 nt, Homo sapiens
gaccaaagaggcaggcauuaga

SEQ ID NO: 229247 - RNA, 22 nt, Homo sapiens
gaccacagacuggaaagagggc

SEQ ID NO: 229248 - RNA, 21 nt, Homo sapiens
gacuacaccaggaugcuaguu

SEQ ID NO: 229249 - RNA, 22 nt, Homo sapiens
gacuagaaauuauuuagugagc

SEQ ID NO: 229250 - RNA, 22 nt, Homo sapiens
gacuagggaaaauuauuuuguu

SEQ ID NO: 229251 - RNA, 22 nt, Homo sapiens
uccugcauucauccugguguug

SEQ ID NO: 229252 - RNA, 22 nt, Homo sapiens
uccuguaaucccagcuaccaga

SEQ ID NO: 229253 - RNA, 22 nt, Homo sapiens
uccuucaugcaucaauguaucc

SEQ ID NO: 229254 - RNA, 22 nt, Homo sapiens
uccuugagccugggaguuauag

SEQ ID NO: 229255 - RNA, 22 nt, Homo sapiens
uccuugagucuuugcucagaug

SEQ ID NO: 229256 - RNA, 22 nt, Homo sapiens
uccuuggugacauuucuugucu

SEQ ID NO: 229257 - RNA, 22 nt, Homo sapiens
uccuuuggucaguauucuuuug

SEQ ID NO: 229258 - RNA, 22 nt, Homo sapiens
ucgcugggaaccagagguaaag

SEQ ID NO: 229259 - RNA, 22 nt, Homo sapiens
ucguuggcuacuuguucauuuc

SEQ ID NO: 229260 - RNA, 22 nt, Homo sapiens
ucuaaagcauccagauugcuuc

SEQ ID NO: 229261 - RNA, 22 nt, Homo sapiens
ucuaagaauucauuuauaagcc

SEQ ID NO: 229262 - RNA, 22 nt, Homo sapiens
ucuaaguaguagcuggucagaa

SEQ ID NO: 229263 - RNA, 22 nt, Homo sapiens
ucuaauguaaccugcaaauauu

SEQ ID NO: 229264 - RNA, 22 nt, Homo sapiens
ucucaaccuccacacuacaaua

SEQ ID NO: 229265 - RNA, 22 nt, Homo sapiens
ucucaaccucccaaguagcugg

SEQ ID NO: 229266 - RNA, 22 nt, Homo sapiens
ucucaauuugauuacauucaua

SEQ ID NO: 229267 - RNA, 22 nt, Homo sapiens
ucucacaccccucucauauacc

SEQ ID NO: 229268 - RNA, 22 nt, Homo sapiens
ucucagagccuaggguuuuuca

SEQ ID NO: 229269 - RNA, 22 nt, Homo sapiens
ucucagcggacaggccggccag

SEQ ID NO: 229270 - RNA, 19 nt, Homo sapiens
ucucaguguuggucaggug

SEQ ID NO: 229271 - RNA, 22 nt, Homo sapiens
ucucaguuuucuggggaagaaa

SEQ ID NO: 229272 - RNA, 22 nt, Homo sapiens
ucucauagaggcagagaguaaa

SEQ ID NO: 229273 - RNA, 20 nt, Homo sapiens
ucucauggagguagagaaua

SEQ ID NO: 229274 - RNA, 22 nt, Homo sapiens
ucucauggagucaggagcagaa

SEQ ID NO: 229275 - RNA, 22 nt, Homo sapiens
ucuccauugaaauggacauaau

SEQ ID NO: 229276 - RNA, 22 nt, Homo sapiens
ucuccauuguccagaugaggaa

SEQ ID NO: 229277 - RNA, 22 nt, Homo sapiens
ucucuagagagccugguguuca

SEQ ID NO: 229278 - RNA, 22 nt, Homo sapiens
ucucugguuuucaaagcaguau

SEQ ID NO: 229279 - RNA, 22 nt, Homo sapiens
ucucuuggugacuuaaaauguu

SEQ ID NO: 229280 - RNA, 22 nt, Homo sapiens
ucucuugguugaacaguuugga

SEQ ID NO: 229281 - RNA, 22 nt, Homo sapiens
ucugagacuguuucuaacaagc

SEQ ID NO: 229282 - RNA, 22 nt, Homo sapiens
ucugagaucaugucugugcugu

SEQ ID NO: 229283 - RNA, 22 nt, Homo sapiens
ucugagaugagacuuugaauuu

SEQ ID NO: 229284 - RNA, 22 nt, Homo sapiens
ucugagcaauaaacaacauauu

SEQ ID NO: 229285 - RNA, 22 nt, Homo sapiens
ucugagcaugcaucuugccugg

SEQ ID NO: 229286 - RNA, 22 nt, Homo sapiens
ucugagguuaaauuuuauaguu

SEQ ID NO: 229287 - RNA, 21 nt, Homo sapiens
ucugagucauucaguggccug

SEQ ID NO: 229288 - RNA, 23 nt, Homo sapiens
ucugauguuauaaaauucuuugg

SEQ ID NO: 229289 - RNA, 20 nt, Homo sapiens
ucugauugcaacugcaugag

SEQ ID NO: 229290 - RNA, 22 nt, Homo sapiens
ucugccuacugagcacacagug

SEQ ID NO: 229291 - RNA, 22 nt, Homo sapiens
ucuggcaagagccgagggcagu

SEQ ID NO: 229292 - RNA, 22 nt, Homo sapiens
ucuggcacugaugugggaugcu

SEQ ID NO: 229293 - RNA, 20 nt, Homo sapiens
ucuggccccuccaaaucuca

SEQ ID NO: 229294 - RNA, 22 nt, Homo sapiens
ucuggcuucugacuuaggggac

SEQ ID NO: 229295 - RNA, 17 nt, Homo sapiens
ucuggcuuucacaccug

SEQ ID NO: 229296 - RNA, 23 nt, Homo sapiens
ucuggcuuugggaugcucaaggg

SEQ ID NO: 229297 - RNA, 22 nt, Homo sapiens
ucugggguuuccacuuuuacuu

SEQ ID NO: 229298 - RNA, 22 nt, Homo sapiens
ucuggguuuuguaccgugcucg

SEQ ID NO: 229299 - RNA, 22 nt, Homo sapiens
ucuggguuuuuacaauguuuac

SEQ ID NO: 229300 - RNA, 22 nt, Homo sapiens
ucugguguuacugagccuccca

SEQ ID NO: 229301 - RNA, 22 nt, Homo sapiens
ucugguuccugcauucauucaa

SEQ ID NO: 229302 - RNA, 22 nt, Homo sapiens
ucuguaguuaacagcuucagcu

SEQ ID NO: 229303 - RNA, 19 nt, Homo sapiens
ucugucacuggggguauuc

SEQ ID NO: 229304 - RNA, 22 nt, Homo sapiens
ucugucacugguggacgaucac

SEQ ID NO: 229305 - RNA, 22 nt, Homo sapiens
ucugucuuguccucacccuaga

SEQ ID NO: 229306 - RNA, 22 nt, Homo sapiens
ucugucuugugguuugagugcc

SEQ ID NO: 229307 - RNA, 22 nt, Homo sapiens
ucugugaaugaacacuugaaaa

SEQ ID NO: 229308 - RNA, 22 nt, Homo sapiens
ucugugcauuacacuuuucuca

SEQ ID NO: 229309 - RNA, 22 nt, Homo sapiens
ucuguguuuagacccaggguag

SEQ ID NO: 229310 - RNA, 22 nt, Homo sapiens
ucuuaggugaugauugauguga

SEQ ID NO: 229311 - RNA, 22 nt, Homo sapiens
ucuuaguuugggguggggauag

SEQ ID NO: 229312 - RNA, 22 nt, Homo sapiens
ucuuauuuggggaaaggguccu

SEQ ID NO: 229313 - RNA, 22 nt, Homo sapiens
ucuucagucauauuggccugga

SEQ ID NO: 229314 - RNA, 22 nt, Homo sapiens
ucuucuagcggaacccucuugu

SEQ ID NO: 229315 - RNA, 22 nt, Homo sapiens
ucuugcacaaauuauuuuaacu

SEQ ID NO: 229316 - RNA, 22 nt, Homo sapiens
ucuuggacuuuugugagaaauc

SEQ ID NO: 229317 - RNA, 20 nt, Homo sapiens
ucuugggaauguagccuagg

SEQ ID NO: 229318 - RNA, 22 nt, Homo sapiens
ucuugggugaguuugugaauaa

SEQ ID NO: 229319 - RNA, 22 nt, Homo sapiens
ucuuggguuugccuugcugcug

SEQ ID NO: 229320 - RNA, 22 nt, Homo sapiens
ucuugguuuauugugguaugaa

SEQ ID NO: 229321 - RNA, 22 nt, Homo sapiens
ucuugucacugcauccccagcu

SEQ ID NO: 229322 - RNA, 17 nt, Homo sapiens
ucuugugguucuugaau

SEQ ID NO: 229323 - RNA, 22 nt, Homo sapiens
ucuuuagugacaguugugcaag

SEQ ID NO: 229324 - RNA, 20 nt, Homo sapiens
ucuuucgguuaccaggcagu

SEQ ID NO: 229325 - RNA, 22 nt, Homo sapiens
ucuuugagugcccugagucccu

SEQ ID NO: 229326 - RNA, 22 nt, Homo sapiens
ucuuugaguggagcgaggcaga

SEQ ID NO: 229327 - RNA, 22 nt, Homo sapiens
ucuuugauguucugaaagaugg

SEQ ID NO: 229328 - RNA, 19 nt, Homo sapiens
ucuuugguacgugcuuuga

SEQ ID NO: 229329 - RNA, 22 nt, Homo sapiens
ucuuugguagaagcuauuuuau

SEQ ID NO: 229330 - RNA, 22 nt, Homo sapiens
ucuuuggucagaaagauuacac

SEQ ID NO: 229331 - RNA, 22 nt, Homo sapiens
ucuuugguugcacugcaggugu

SEQ ID NO: 229332 - RNA, 22 nt, Homo sapiens
ucuuuguugcauaggcuuguuc

SEQ ID NO: 229333 - RNA, 22 nt, Homo sapiens
ucuuuuggguauggagccauca

SEQ ID NO: 229334 - RNA, 22 nt, Homo sapiens
ucuuuugugagucagccucucc

SEQ ID NO: 229335 - RNA, 18 nt, Homo sapiens
ugaaacacauuuuuuccu

SEQ ID NO: 229336 - RNA, 22 nt, Homo sapiens
ugaaacauacacucugaugggg

SEQ ID NO: 229337 - RNA, 22 nt, Homo sapiens
ugaaagacacagaaguugccca

SEQ ID NO: 229338 - RNA, 22 nt, Homo sapiens
ugaaaguuauauugugaaauuc

SEQ ID NO: 229339 - RNA, 22 nt, Homo sapiens
ugaaauacuuaauuucuccaug

SEQ ID NO: 229340 - RNA, 22 nt, Homo sapiens
ugaaauacuuuggcucuuuguu

SEQ ID NO: 229341 - RNA, 22 nt, Homo sapiens
ugaaaugaucaguuugguuacu

SEQ ID NO: 229342 - RNA, 22 nt, Homo sapiens
ugaaaugauuauaugguguuug

SEQ ID NO: 229343 - RNA, 22 nt, Homo sapiens
ugaaaugcugucuaggggaaau

SEQ ID NO: 229344 - RNA, 22 nt, Homo sapiens
ugaaauggaaagaguguagacu

SEQ ID NO: 229345 - RNA, 22 nt, Homo sapiens
ugaaaugguuaugugaggagau

SEQ ID NO: 229346 - RNA, 22 nt, Homo sapiens
ugaaauguaaguugucuagucu

SEQ ID NO: 229347 - RNA, 22 nt, Homo sapiens
ugaaauuuuuuauucguuggcu

SEQ ID NO: 229348 - RNA, 16 nt, Homo sapiens
ugaacagagaggauuc

SEQ ID NO: 229349 - RNA, 22 nt, Homo sapiens
ugcaaagucgaaacugcaguuu

SEQ ID NO: 229350 - RNA, 19 nt, Homo sapiens
ugcaaagucuuuuccuauu

SEQ ID NO: 229351 - RNA, 22 nt, Homo sapiens
ugcaaaugcugcuauuucucuu

SEQ ID NO: 229352 - RNA, 22 nt, Homo sapiens
ugcaagaaucagccuaucauua

SEQ ID NO: 229353 - RNA, 22 nt, Homo sapiens
ugcaagaggagacuguacucag

SEQ ID NO: 229354 - RNA, 22 nt, Homo sapiens
ugcaagcacacccagggauugu

SEQ ID NO: 229355 - RNA, 22 nt, Homo sapiens
ugcaagucaucuguccuucaga

SEQ ID NO: 229356 - RNA, 22 nt, Homo sapiens
ugcaaguggauuuuuccccaga

SEQ ID NO: 229357 - RNA, 22 nt, Homo sapiens
ugcacaguccagugcccacuga

SEQ ID NO: 229358 - RNA, 22 nt, Homo sapiens
ugcaccacugcaccccagucug

SEQ ID NO: 229359 - RNA, 22 nt, Homo sapiens
ugcaccacugcacuccagcuug

SEQ ID NO: 229360 - RNA, 22 nt, Homo sapiens
ugcaccacugcacugccugggu

SEQ ID NO: 229361 - RNA, 22 nt, Homo sapiens
ugcaccacugcuagccugggua

SEQ ID NO: 229362 - RNA, 22 nt, Homo sapiens
ugcaccaucuugcuucuguggu

SEQ ID NO: 229363 - RNA, 22 nt, Homo sapiens
ugcaccauugcacuccagccug

SEQ ID NO: 229364 - RNA, 22 nt, Homo sapiens
ugcaccauugcauuccagccug

SEQ ID NO: 229365 - RNA, 23 nt, Homo sapiens
ugcagcacacugaugggucuuga

SEQ ID NO: 229366 - RNA, 20 nt, Homo sapiens
ugcagcacugggaaugcagu

SEQ ID NO: 229367 - RNA, 18 nt, Homo sapiens
ugcagcaucaguacccag

SEQ ID NO: 229368 - RNA, 22 nt, Homo sapiens
ugcaguacugucagacuucuua

SEQ ID NO: 229369 - RNA, 22 nt, Homo sapiens
ugcaguaggcccagcgggaggc

SEQ ID NO: 229370 - RNA, 22 nt, Homo sapiens
ugcaguagugugaucuuggcuc

SEQ ID NO: 229371 - RNA, 22 nt, Homo sapiens
ugcagugugauuuucuggcuga

SEQ ID NO: 229372 - RNA, 22 nt, Homo sapiens
ugcauacuguaugcgugcauac

SEQ ID NO: 229373 - RNA, 22 nt, Homo sapiens
ugcauaggcuaaaauccuggcc

SEQ ID NO: 229374 - RNA, 21 nt, Homo sapiens
ugcauaucucuaaugaccagu

SEQ ID NO: 229375 - RNA, 22 nt, Homo sapiens
ugcauaugucuuuauagcagca

SEQ ID NO: 229376 - RNA, 22 nt, Homo sapiens
ugcaucacaguacuccagccug

SEQ ID NO: 229377 - RNA, 22 nt, Homo sapiens
ugcauggaagggagggaaagag

SEQ ID NO: 229378 - RNA, 21 nt, Homo sapiens
ugcaugguagucacaugauuc

SEQ ID NO: 229379 - RNA, 22 nt, Homo sapiens
ugcauuaucagauguuugcuuu

SEQ ID NO: 229380 - RNA, 21 nt, Homo sapiens
ugcauuggagaauguuucuca

SEQ ID NO: 229381 - RNA, 22 nt, Homo sapiens
ugcauuguaggauguuuagcag

SEQ ID NO: 229382 - RNA, 21 nt, Homo sapiens
ugcauugucuugaguuuaaau

SEQ ID NO: 229383 - RNA, 22 nt, Homo sapiens
ugccaaaaugggcuuuauaccg

SEQ ID NO: 229384 - RNA, 22 nt, Homo sapiens
ugccaagauuucaggaauuaag

SEQ ID NO: 229385 - RNA, 22 nt, Homo sapiens
ugccagaugcuggugugagggg

SEQ ID NO: 229386 - RNA, 22 nt, Homo sapiens
ugccaguauuuuauuaagaauu

SEQ ID NO: 229387 - RNA, 22 nt, Homo sapiens
ugccaguuuuuacauuuccugu

SEQ ID NO: 229388 - RNA, 22 nt, Homo sapiens
ugccauagagacucaacagccu

SEQ ID NO: 229389 - RNA, 22 nt, Homo sapiens
ugccauugcacuccagccuggg

SEQ ID NO: 229390 - RNA, 21 nt, Homo sapiens
ugcccaguggcuuggggucag

SEQ ID NO: 229391 - RNA, 22 nt, Homo sapiens
ugccuacucucugccaggaaug

SEQ ID NO: 229392 - RNA, 22 nt, Homo sapiens
ugccuaggcuggagugcagugg

SEQ ID NO: 229393 - RNA, 22 nt, Homo sapiens
ugccugagcccagcccuguagu

SEQ ID NO: 229394 - RNA, 22 nt, Homo sapiens
ugccuggagagcuccuacauau

SEQ ID NO: 229395 - RNA, 22 nt, Homo sapiens
ugcgccauugaacuccaggcug

SEQ ID NO: 229396 - RNA, 21 nt, Homo sapiens
ugcuacugucacuuccuuugu

SEQ ID NO: 229397 - RNA, 22 nt, Homo sapiens
ugcuagaagaucacacacauca

SEQ ID NO: 229398 - RNA, 22 nt, Homo sapiens
ugcuagagaaauauauuugggg

SEQ ID NO: 229399 - RNA, 22 nt, Homo sapiens
ugcuagaugcuguagggauuua

SEQ ID NO: 229400 - RNA, 22 nt, Homo sapiens
ugcuauguaacacauuaccuuu

SEQ ID NO: 229401 - RNA, 22 nt, Homo sapiens
ugcuauguccccacccaaaucu

SEQ ID NO: 229402 - RNA, 22 nt, Homo sapiens
ugcuaugucuucucucacagag

SEQ ID NO: 229403 - RNA, 22 nt, Homo sapiens
ugcucaccugcugcucaccucc

SEQ ID NO: 229404 - RNA, 23 nt, Homo sapiens
ugcuccccucauggaugaauaaa

SEQ ID NO: 229405 - RNA, 22 nt, Homo sapiens
ugcugcacuuauggcucugagg

SEQ ID NO: 229406 - RNA, 21 nt, Homo sapiens
ugcugcacuucuuuugcugug

SEQ ID NO: 229407 - RNA, 22 nt, Homo sapiens
ugcugcauuggggauuaaguuu

SEQ ID NO: 229408 - RNA, 22 nt, Homo sapiens
ugcugcuguuguuguuacuagc

SEQ ID NO: 229409 - RNA, 22 nt, Homo sapiens
ugcuggugauucagauucaaau

SEQ ID NO: 229410 - RNA, 22 nt, Homo sapiens
ugcugguguggucuagccgcuu

SEQ ID NO: 229411 - RNA, 22 nt, Homo sapiens
ugcugguguuuaggaauaagaa

SEQ ID NO: 229412 - RNA, 22 nt, Homo sapiens
ugcugguuuucaucaucagugg

SEQ ID NO: 229413 - RNA, 22 nt, Homo sapiens
ugcuguuguuugaugaaguaau

SEQ ID NO: 229414 - RNA, 22 nt, Homo sapiens
ugcuuaggcuuccuuacaguau

SEQ ID NO: 229415 - RNA, 22 nt, Homo sapiens
ugcuuugguagaaaucuuuggu

SEQ ID NO: 229416 - RNA, 21 nt, Homo sapiens
ugcuuuggucauacuucuucc

SEQ ID NO: 229417 - RNA, 22 nt, Homo sapiens
uggaaaacaugcacauuggauu

SEQ ID NO: 229418 - RNA, 22 nt, Homo sapiens
uggaaaauuaggggagguuaua

SEQ ID NO: 229419 - RNA, 20 nt, Homo sapiens
uggaaauuaaccuuucaggu

SEQ ID NO: 229420 - RNA, 22 nt, Homo sapiens
uggaaauuaagucuuuccugag

SEQ ID NO: 229421 - RNA, 22 nt, Homo sapiens
uggaacacauaaauagcauagu

SEQ ID NO: 229422 - RNA, 23 nt, Homo sapiens
uggaacugaauuucuuagcauuu

SEQ ID NO: 229423 - RNA, 22 nt, Homo sapiens
uggaagacacauaccugauaac

SEQ ID NO: 229424 - RNA, 22 nt, Homo sapiens
uggaagacauugggugaagggu

SEQ ID NO: 229425 - RNA, 22 nt, Homo sapiens
uggaagacucaagguggugaau

SEQ ID NO: 229426 - RNA, 22 nt, Homo sapiens
uggaagacuuuagaggcuuaua

SEQ ID NO: 229427 - RNA, 22 nt, Homo sapiens
uggaagcauagcagcgugugug

SEQ ID NO: 229428 - RNA, 22 nt, Homo sapiens
uggaaggucauuguucauuuga

SEQ ID NO: 229429 - RNA, 22 nt, Homo sapiens
uggaaguauagauaauugaaag

SEQ ID NO: 229430 - RNA, 22 nt, Homo sapiens
uggaagucaugcugcaagaaca

SEQ ID NO: 229431 - RNA, 22 nt, Homo sapiens
uggaagugucugugcccagcuc

SEQ ID NO: 229432 - RNA, 22 nt, Homo sapiens
uggaaguuaaauuaguugauga

SEQ ID NO: 229433 - RNA, 22 nt, Homo sapiens
uggaauacaugucgcugagcug

SEQ ID NO: 229434 - RNA, 22 nt, Homo sapiens
uggaauacuauucugugcugga

SEQ ID NO: 229435 - RNA, 22 nt, Homo sapiens
uggaaucuacuaaagcaaaauc

SEQ ID NO: 229436 - RNA, 21 nt, Homo sapiens
uggaaucuauuauuccaguuu

SEQ ID NO: 229437 - RNA, 19 nt, Homo sapiens
uggaaugaaauguuagggg

SEQ ID NO: 229438 - RNA, 22 nt, Homo sapiens
uggaaugcuaagcaugugggag

SEQ ID NO: 229439 - RNA, 22 nt, Homo sapiens
uggaauggagagagggugcacg

SEQ ID NO: 229440 - RNA, 21 nt, Homo sapiens
uggaauuaauggagagguguu

SEQ ID NO: 229441 - RNA, 22 nt, Homo sapiens
uggaauuuagguugauaguaua

SEQ ID NO: 229442 - RNA, 22 nt, Homo sapiens
uggacaugaagggcacaggagg

SEQ ID NO: 229443 - RNA, 21 nt, Homo sapiens
uggaccccuacuucucaccau

SEQ ID NO: 229444 - RNA, 21 nt, Homo sapiens
uggaccccuuccagucaucau

SEQ ID NO: 229445 - RNA, 22 nt, Homo sapiens
uggaccccuucuccuauuaaaa

SEQ ID NO: 229446 - RNA, 22 nt, Homo sapiens
uggacuguaaauuggggacucu

SEQ ID NO: 229447 - RNA, 22 nt, Homo sapiens
ugugccuaguaauguguccaga

SEQ ID NO: 229448 - RNA, 22 nt, Homo sapiens
ugugcucaucucagucaacugu

SEQ ID NO: 229449 - RNA, 22 nt, Homo sapiens
ugugcuugaaauucaguuuuga

SEQ ID NO: 229450 - RNA, 22 nt, Homo sapiens
ugugcuugcuucuucuccuagu

SEQ ID NO: 229451 - RNA, 22 nt, Homo sapiens
ugugcuuguaaaggccagagca

SEQ ID NO: 229452 - RNA, 22 nt, Homo sapiens
uguggaaauuguuguauuuaau

SEQ ID NO: 229453 - RNA, 22 nt, Homo sapiens
uguggcaaauggucaggaagaa

SEQ ID NO: 229454 - RNA, 22 nt, Homo sapiens
uguggcagugcuuuaugaaacc

SEQ ID NO: 229455 - RNA, 22 nt, Homo sapiens
uguggccccuagcuacuagaga

SEQ ID NO: 229456 - RNA, 22 nt, Homo sapiens
uguggcucuucuguucuccacu

SEQ ID NO: 229457 - RNA, 22 nt, Homo sapiens
uguggcuucuuugguucaguau

SEQ ID NO: 229458 - RNA, 22 nt, Homo sapiens
uguggcuuuacagcaugguuca

SEQ ID NO: 229459 - RNA, 22 nt, Homo sapiens
uguggcuuuguaaccauggguc

SEQ ID NO: 229460 - RNA, 19 nt, Homo sapiens
uguggucauccugggacga

SEQ ID NO: 229461 - RNA, 22 nt, Homo sapiens
uguguaaauagcuacggaucug

SEQ ID NO: 229462 - RNA, 22 nt, Homo sapiens
ugugucuacugagaugaucaug

SEQ ID NO: 229463 - RNA, 22 nt, Homo sapiens
ugugucuugaauuuuguaugua

SEQ ID NO: 229464 - RNA, 22 nt, Homo sapiens
ugugucuuuuaucacacaaugu

SEQ ID NO: 229465 - RNA, 22 nt, Homo sapiens
uguuaacauuuuagagugggaa

SEQ ID NO: 229466 - RNA, 22 nt, Homo sapiens
uguuacaguguaggccuugggu

SEQ ID NO: 229467 - RNA, 22 nt, Homo sapiens
uguuagguuggugcaaaaguga

SEQ ID NO: 229468 - RNA, 22 nt, Homo sapiens
uguuaguuguucauguuaagag

SEQ ID NO: 229469 - RNA, 22 nt, Homo sapiens
uguuaugaagaugccugguaca

SEQ ID NO: 229470 - RNA, 22 nt, Homo sapiens
uguucaauucccaccuaugagu

SEQ ID NO: 229471 - RNA, 22 nt, Homo sapiens
uguucacaguguuucuuugaga

SEQ ID NO: 229472 - RNA, 22 nt, Homo sapiens
uguucaugaguucucauuuuua

SEQ ID NO: 229473 - RNA, 22 nt, Homo sapiens
uguucauggauccaguggcuuc

SEQ ID NO: 229474 - RNA, 22 nt, Homo sapiens
uguucuugagccuuuagaccua

SEQ ID NO: 229475 - RNA, 22 nt, Homo sapiens
uguugcuuaagccacccagucu

SEQ ID NO: 229476 - RNA, 22 nt, Homo sapiens
uguuggacuuacuuggcagauu

SEQ ID NO: 229477 - RNA, 22 nt, Homo sapiens
uguuggcauugcugcugacccu

SEQ ID NO: 229478 - RNA, 22 nt, Homo sapiens
uguuugcuguguggaguagcag

SEQ ID NO: 229479 - RNA, 22 nt, Homo sapiens
uguuugcuuaacguggagccag

SEQ ID NO: 229480 - RNA, 22 nt, Homo sapiens
uguuuuggaguggacuuugcau

SEQ ID NO: 229481 - RNA, 22 nt, Homo sapiens
uguuuuguuagcacucugggaa

SEQ ID NO: 229482 - RNA, 22 nt, Homo sapiens
uuaaacugcuugaauuggguuu

SEQ ID NO: 229483 - RNA, 22 nt, Homo sapiens
uuaaagccauaccugagagagu

SEQ ID NO: 229484 - RNA, 22 nt, Homo sapiens
uuaaaggcauguacacuagagu

SEQ ID NO: 229485 - RNA, 22 nt, Homo sapiens
uuaaaguguuugcagacaggug

SEQ ID NO: 229486 - RNA, 22 nt, Homo sapiens
uuaaaugucuguagaugugcug

SEQ ID NO: 229487 - RNA, 21 nt, Homo sapiens
uuaacagacaagugucuuccc

SEQ ID NO: 229488 - RNA, 22 nt, Homo sapiens
uuaagagcauggugccagguug

SEQ ID NO: 229489 - RNA, 22 nt, Homo sapiens
uuaagaugcauuuugaaguuaa

SEQ ID NO: 229490 - RNA, 22 nt, Homo sapiens
uuaagcuaguuuauucaggaaa

SEQ ID NO: 229491 - RNA, 22 nt, Homo sapiens
uuaaggcagugcaucuggaguu

SEQ ID NO: 229492 - RNA, 22 nt, Homo sapiens
uuaaggccccgcccauucaggc

SEQ ID NO: 229493 - RNA, 22 nt, Homo sapiens
uuaaggcuuucccuauguaaaa

SEQ ID NO: 229494 - RNA, 19 nt, Homo sapiens
uuaagguacuuagaugugu

SEQ ID NO: 229495 - RNA, 19 nt, Homo sapiens
uuaaguaguuagagggucu

SEQ ID NO: 229496 - RNA, 22 nt, Homo sapiens
uuaagucacacuagacaacuga

SEQ ID NO: 229497 - RNA, 22 nt, Homo sapiens
uuaaguguaaguggugugggac

SEQ ID NO: 229498 - RNA, 22 nt, Homo sapiens
uuaaguuaggcuucagcagucu

SEQ ID NO: 229499 - RNA, 22 nt, Homo sapiens
uuaauaccgucacauggcugaa

SEQ ID NO: 229500 - RNA, 22 nt, Homo sapiens
uuaauagugacucauuuuccac

SEQ ID NO: 229501 - RNA, 22 nt, Homo sapiens
uuaaucacagcugaacucaaac

SEQ ID NO: 229502 - RNA, 22 nt, Homo sapiens
uuaaugacaucauaggugaagu

SEQ ID NO: 229503 - RNA, 22 nt, Homo sapiens
uuaauggagaguuucauuggug

SEQ ID NO: 229504 - RNA, 22 nt, Homo sapiens
uuaauguaauugauugauugac

SEQ ID NO: 229505 - RNA, 22 nt, Homo sapiens
uuacaagaugucuguccaacac

SEQ ID NO: 229506 - RNA, 19 nt, Homo sapiens
uuacacaaccuaguggggc

SEQ ID NO: 229507 - RNA, 22 nt, Homo sapiens
uuacagauggauggcagcuggc

SEQ ID NO: 229508 - RNA, 22 nt, Homo sapiens
uuacagcugcuccccaucacuc

SEQ ID NO: 229509 - RNA, 22 nt, Homo sapiens
uuacaguagaugaggguauaau

SEQ ID NO: 229510 - RNA, 21 nt, Homo sapiens
uuacaguugguugugaggugg

SEQ ID NO: 229511 - RNA, 22 nt, Homo sapiens
uuacaugucuugguaagguuag

SEQ ID NO: 229512 - RNA, 22 nt, Homo sapiens
uuaccucagaccugcucugugu

SEQ ID NO: 229513 - RNA, 22 nt, Homo sapiens
uuaccuugcacugagucugaaa

SEQ ID NO: 229514 - RNA, 22 nt, Homo sapiens
uuaccuuuuuaagacagguuag

SEQ ID NO: 229515 - RNA, 22 nt, Homo sapiens
uuacuacucucuaugaccaguu

SEQ ID NO: 229516 - RNA, 22 nt, Homo sapiens
uuacuagaacauuuagggaacu

SEQ ID NO: 229517 - RNA, 20 nt, Homo sapiens
uuacuauguaguauuggcuc

SEQ ID NO: 229518 - RNA, 22 nt, Homo sapiens
uuacugcucuuuugucaugagu

SEQ ID NO: 229519 - RNA, 22 nt, Homo sapiens
uuagaacagugcucaccacaaa

SEQ ID NO: 229520 - RNA, 19 nt, Homo sapiens
uuagagaucaucugcuuca

SEQ ID NO: 229521 - RNA, 22 nt, Homo sapiens
uuagagguaggauuucaccaug

SEQ ID NO: 229522 - RNA, 20 nt, Homo sapiens
uuagaguaguaugauuuaua

SEQ ID NO: 229523 - RNA, 22 nt, Homo sapiens
uuagaucaacauggaacucuau

SEQ ID NO: 229524 - RNA, 22 nt, Homo sapiens
uuagaugaagucacagaaccca

SEQ ID NO: 229525 - RNA, 18 nt, Homo sapiens
uuagaugguuuuaaaacu

SEQ ID NO: 229526 - RNA, 22 nt, Homo sapiens
uuagauuauugguguuuugcaa

SEQ ID NO: 229527 - RNA, 22 nt, Homo sapiens
uuagcaauagccugcaucugca

SEQ ID NO: 229528 - RNA, 22 nt, Homo sapiens
uuagcaccacacacuuuagagg

SEQ ID NO: 229529 - RNA, 22 nt, Homo sapiens
uuagcacuaauucguuggggca

SEQ ID NO: 229530 - RNA, 22 nt, Homo sapiens
uuagcacuugggaguauuuauu

SEQ ID NO: 229531 - RNA, 22 nt, Homo sapiens
uuagcagcaucccuggccugua

SEQ ID NO: 229532 - RNA, 22 nt, Homo sapiens
uuagcagcucuaauaacugcua

SEQ ID NO: 229533 - RNA, 22 nt, Homo sapiens
uuagcaguggauggguggagaa

SEQ ID NO: 229534 - RNA, 22 nt, Homo sapiens
uuagcauccauaggagauuggu

SEQ ID NO: 229535 - RNA, 22 nt, Homo sapiens
uuaggagacuggauaucucuuu

SEQ ID NO: 229536 - RNA, 22 nt, Homo sapiens
uuaggcaguuuauugauuuuca

SEQ ID NO: 229537 - RNA, 22 nt, Homo sapiens
uuaggcuuuucagacacuucau

SEQ ID NO: 229538 - RNA, 22 nt, Homo sapiens
uuagggaggagucccucuuuuu

SEQ ID NO: 229539 - RNA, 22 nt, Homo sapiens
uuagggaguaaucuaaaaaugg

SEQ ID NO: 229540 - RNA, 22 nt, Homo sapiens
uuagggcaggcaugagagaacu

SEQ ID NO: 229541 - RNA, 22 nt, Homo sapiens
uuagguaggugcuuuuuucaca

SEQ ID NO: 229542 - RNA, 23 nt, Homo sapiens
uuaguaaacucaaugacaccaca

SEQ ID NO: 229543 - RNA, 22 nt, Homo sapiens
uuaguaguuugauaggaauagc

SEQ ID NO: 229544 - RNA, 22 nt, Homo sapiens
uuagugaaugggugugauuugu

SEQ ID NO: 229545 - RNA, 22 nt, Homo sapiens
uugauauucuuucuggauccca

SEQ ID NO: 229546 - RNA, 22 nt, Homo sapiens
uugaucaauagaauacaacaga

SEQ ID NO: 229547 - RNA, 22 nt, Homo sapiens
uugauccucugagaaucuaucg

SEQ ID NO: 229548 - RNA, 22 nt, Homo sapiens
uugaucuggagagaggcccgug

SEQ ID NO: 229549 - RNA, 22 nt, Homo sapiens
uugaucugugucccugcccaau

SEQ ID NO: 229550 - RNA, 22 nt, Homo sapiens
uugaugauguuucugccuugcc

SEQ ID NO: 229551 - RNA, 22 nt, Homo sapiens
uugauuuguagaaugccccaac

SEQ ID NO: 229552 - RNA, 22 nt, Homo sapiens
uugcaaaguuugccuccuguag

SEQ ID NO: 229553 - RNA, 22 nt, Homo sapiens
uugcaacauuguaaguuuauau

SEQ ID NO: 229554 - RNA, 22 nt, Homo sapiens
uugcaacuuagaaaaaucauuu

SEQ ID NO: 229555 - RNA, 22 nt, Homo sapiens
uugcaagauguucaugggcugu

SEQ ID NO: 229556 - RNA, 22 nt, Homo sapiens
uugcaaugugaugugauuugga

SEQ ID NO: 229557 - RNA, 22 nt, Homo sapiens
uugcacagucuagcuccaccuu

SEQ ID NO: 229558 - RNA, 22 nt, Homo sapiens
uugcacagugcuuucuuugccc

SEQ ID NO: 229559 - RNA, 22 nt, Homo sapiens
uugcacauggcaggugcucaau

SEQ ID NO: 229560 - RNA, 22 nt, Homo sapiens
uugcacauugauuuuguauccu

SEQ ID NO: 229561 - RNA, 22 nt, Homo sapiens
uugcacauugauuuuguaucuu

SEQ ID NO: 229562 - RNA, 22 nt, Homo sapiens
uugcaccacugcguuccagccu

SEQ ID NO: 229563 - RNA, 22 nt, Homo sapiens
uugcacuccggccuggguaaca

SEQ ID NO: 229564 - RNA, 22 nt, Homo sapiens
uugcacucugaagaccuacugu

SEQ ID NO: 229565 - RNA, 22 nt, Homo sapiens
uugcaggcaugagccaccgugc

SEQ ID NO: 229566 - RNA, 22 nt, Homo sapiens
uugcaggugguuuaugcaagac

SEQ ID NO: 229567 - RNA, 19 nt, Homo sapiens
uugcaguauccuauauguu

SEQ ID NO: 229568 - RNA, 22 nt, Homo sapiens
uugcagugugacgacuauauuu

SEQ ID NO: 229569 - RNA, 22 nt, Homo sapiens
uugcauaagugcauucugugau

SEQ ID NO: 229570 - RNA, 22 nt, Homo sapiens
uugcauaauaagauuggggggg

SEQ ID NO: 229571 - RNA, 22 nt, Homo sapiens
uugcauagugcugagguucggg

SEQ ID NO: 229572 - RNA, 22 nt, Homo sapiens
uugcaucagcuccugauguacu

SEQ ID NO: 229573 - RNA, 18 nt, Homo sapiens
uugcaucauuuuguuguu

SEQ ID NO: 229574 - RNA, 22 nt, Homo sapiens
uugcaugcacaguucucaauag

SEQ ID NO: 229575 - RNA, 22 nt, Homo sapiens
uugcaugggagcugggugaagc

SEQ ID NO: 229576 - RNA, 22 nt, Homo sapiens
uugcaugucugcuucuccuccu

SEQ ID NO: 229577 - RNA, 23 nt, Homo sapiens
uugcauugcccuccauaguacuc

SEQ ID NO: 229578 - RNA, 22 nt, Homo sapiens
uugcauuuucuaggagggcaaa

SEQ ID NO: 229579 - RNA, 22 nt, Homo sapiens
uugcccuuuagguaacuauaua

SEQ ID NO: 229580 - RNA, 22 nt, Homo sapiens
uugccuaggcuggagugcagua

SEQ ID NO: 229581 - RNA, 22 nt, Homo sapiens
uugccuaggcuggauugcagug

SEQ ID NO: 229582 - RNA, 22 nt, Homo sapiens
uugcuacauugauugccucuuu

SEQ ID NO: 229583 - RNA, 22 nt, Homo sapiens
uugcuagaugaaaaugguaccu

SEQ ID NO: 229584 - RNA, 22 nt, Homo sapiens
uugcuagucucuguuucaggau

SEQ ID NO: 229585 - RNA, 22 nt, Homo sapiens
uugcucaggcuggaguacaaug

SEQ ID NO: 229586 - RNA, 22 nt, Homo sapiens
uugcuccccaggaaaggaagca

SEQ ID NO: 229587 - RNA, 22 nt, Homo sapiens
uugcugagucuuucuagguugc

SEQ ID NO: 229588 - RNA, 22 nt, Homo sapiens
uugcuggugguucgagcaacac

SEQ ID NO: 229589 - RNA, 22 nt, Homo sapiens
uugcuucuuucgucuggcccca

SEQ ID NO: 229590 - RNA, 22 nt, Homo sapiens
uuggaaaaauccaccuugaucu

SEQ ID NO: 229591 - RNA, 22 nt, Homo sapiens
uuggaaacauuuaugguaacag

SEQ ID NO: 229592 - RNA, 22 nt, Homo sapiens
uuggaaaccucugcagguguuu

SEQ ID NO: 229593 - RNA, 22 nt, Homo sapiens
uuggaaauauguuaagugucau

SEQ ID NO: 229594 - RNA, 20 nt, Homo sapiens
uuggaaaugugaauugggag

SEQ ID NO: 229595 - RNA, 22 nt, Homo sapiens
uuggaagcaugguuauugacgu

SEQ ID NO: 229596 - RNA, 22 nt, Homo sapiens
uuggaaggcugaauggccucuc

SEQ ID NO: 229597 - RNA, 22 nt, Homo sapiens
uuggaauguauggcaucuugcg

SEQ ID NO: 229598 - RNA, 22 nt, Homo sapiens
uuggaauuuuacuucuguaaga

SEQ ID NO: 229599 - RNA, 22 nt, Homo sapiens
uuggacaagauugcagagaauu

SEQ ID NO: 229600 - RNA, 22 nt, Homo sapiens
uuggacuucucaaggcaauaaa

SEQ ID NO: 229601 - RNA, 22 nt, Homo sapiens
uuggagagaaaggcaguuccug

SEQ ID NO: 229602 - RNA, 22 nt, Homo sapiens
uuggagucaucucuguacugua

SEQ ID NO: 229603 - RNA, 22 nt, Homo sapiens
uuggaguguucugguccgggcu

SEQ ID NO: 229604 - RNA, 22 nt, Homo sapiens
uuggauauucaguuuuuccauc

SEQ ID NO: 229605 - RNA, 22 nt, Homo sapiens
uuggauuauaaacugagauuug

SEQ ID NO: 229606 - RNA, 22 nt, Homo sapiens
uuggauugugaaaguauucucu

SEQ ID NO: 229607 - RNA, 22 nt, Homo sapiens
uuggauuguuucuagauugggg

SEQ ID NO: 229608 - RNA, 22 nt, Homo sapiens
uuggcaaaugucacaaaucagg

SEQ ID NO: 229609 - RNA, 22 nt, Homo sapiens
uuggcaagaauguaugccgauc

SEQ ID NO: 229610 - RNA, 22 nt, Homo sapiens
uuggcaaucaauucugacgucu

SEQ ID NO: 229611 - RNA, 22 nt, Homo sapiens
uuggcacugagcaagaacaggg

SEQ ID NO: 229612 - RNA, 22 nt, Homo sapiens
uuggcagaauguuagaaacuua

SEQ ID NO: 229613 - RNA, 22 nt, Homo sapiens
uuggcagaguuaauuuguugag

SEQ ID NO: 229614 - RNA, 19 nt, Homo sapiens
uuggcagaguugcccccua

SEQ ID NO: 229615 - RNA, 22 nt, Homo sapiens
uuggcagcuguggaaucugggc

SEQ ID NO: 229616 - RNA, 22 nt, Homo sapiens
uuggcagugguucugacggacc

SEQ ID NO: 229617 - RNA, 22 nt, Homo sapiens
uuggcauuuauucuaaggucaa

SEQ ID NO: 229618 - RNA, 22 nt, Homo sapiens
uuggccccuccaaaucucaugu

SEQ ID NO: 229619 - RNA, 22 nt, Homo sapiens
uuggcuaugaguccuaugugca

SEQ ID NO: 229620 - RNA, 22 nt, Homo sapiens
uugggacuggaaggaguaaggg

SEQ ID NO: 229621 - RNA, 22 nt, Homo sapiens
uugggagugucucuggacugca

SEQ ID NO: 229622 - RNA, 23 nt, Homo sapiens
uugggcaaaucacugagggcaga

SEQ ID NO: 229623 - RNA, 22 nt, Homo sapiens
uugggcaaguggcaugaccaug

SEQ ID NO: 229624 - RNA, 22 nt, Homo sapiens
uugggcuugagggugcccaguc

SEQ ID NO: 229625 - RNA, 22 nt, Homo sapiens
uugggucaguuccuugacuccu

SEQ ID NO: 229626 - RNA, 22 nt, Homo sapiens
uugguacuagcugaucgcagag

SEQ ID NO: 229627 - RNA, 22 nt, Homo sapiens
uuggucaaaucugaugggagaa

SEQ ID NO: 229628 - RNA, 22 nt, Homo sapiens
uuggucaggagccucccucuuu

SEQ ID NO: 229629 - RNA, 22 nt, Homo sapiens
uugguccacugugaaauuggga

SEQ ID NO: 229630 - RNA, 22 nt, Homo sapiens
uugguccccuucaaccagcugu

SEQ ID NO: 229631 - RNA, 22 nt, Homo sapiens
uugguccguugugaaaaggccu

SEQ ID NO: 229632 - RNA, 22 nt, Homo sapiens
uugguccucccaugcucaagag

SEQ ID NO: 229633 - RNA, 23 nt, Homo sapiens
uuggucucccaaaguguugagau

SEQ ID NO: 229634 - RNA, 22 nt, Homo sapiens
uuggucuucuaauguaccuguu

SEQ ID NO: 229635 - RNA, 22 nt, Homo sapiens
uugguucucuuuauaugcugga

SEQ ID NO: 229636 - RNA, 19 nt, Homo sapiens
uugguugguuauuucuuac

SEQ ID NO: 229637 - RNA, 22 nt, Homo sapiens
uuguaaagaucauaugcuguuc

SEQ ID NO: 229638 - RNA, 22 nt, Homo sapiens
uuguaaaguucucucccgaaaa

SEQ ID NO: 229639 - RNA, 22 nt, Homo sapiens
uuguaacaguucugcgagcagc

SEQ ID NO: 229640 - RNA, 23 nt, Homo sapiens
uuguaacuggagaguaacauucc

SEQ ID NO: 229641 - RNA, 22 nt, Homo sapiens
uuguaccacagggcaugaagug

SEQ ID NO: 229642 - RNA, 22 nt, Homo sapiens
uuguacuagucauauuuugaaa

SEQ ID NO: 229643 - RNA, 22 nt, Homo sapiens
cuagcuuuuuaugacaaucuug

SEQ ID NO: 229644 - RNA, 22 nt, Homo sapiens
cuagguucucaaaccagcguca

SEQ ID NO: 229645 - RNA, 22 nt, Homo sapiens
cuaguaaugucugucuuaugga

SEQ ID NO: 229646 - RNA, 22 nt, Homo sapiens
cuagucacauuuucaucaaaua

SEQ ID NO: 229647 - RNA, 22 nt, Homo sapiens
cuaucucaggcccaggcccuug

SEQ ID NO: 229648 - RNA, 18 nt, Homo sapiens
cuaugccacuuuauauca

SEQ ID NO: 229649 - RNA, 22 nt, Homo sapiens
cuaugcuucuuaaauuaguuau

SEQ ID NO: 229650 - RNA, 22 nt, Homo sapiens
cuaugguuucucaaacuccuga

SEQ ID NO: 229651 - RNA, 22 nt, Homo sapiens
cuauguaccuggaacuguauua

SEQ ID NO: 229652 - RNA, 22 nt, Homo sapiens
cuauuacuuuuauugaacucag

SEQ ID NO: 229653 - RNA, 22 nt, Homo sapiens
cuauuagguuggugcaaaaguc

SEQ ID NO: 229654 - RNA, 22 nt, Homo sapiens
cucacaaccuuaugaagcauga

SEQ ID NO: 229655 - RNA, 18 nt, Homo sapiens
cucacaguaacuuuuaag

SEQ ID NO: 229656 - RNA, 20 nt, Homo sapiens
cucaccagguguaggcugag

SEQ ID NO: 229657 - RNA, 22 nt, Homo sapiens
cucaccuugugauccacccacc

SEQ ID NO: 229658 - RNA, 22 nt, Homo sapiens
cucacugucaacauguauuugg

SEQ ID NO: 229659 - RNA, 22 nt, Homo sapiens
cucagaguacuuuucccacuuc

SEQ ID NO: 229660 - RNA, 20 nt, Homo sapiens
cucagauuauucugaagcaa

SEQ ID NO: 229661 - RNA, 22 nt, Homo sapiens
cucaggguacuucuccuuugcu

SEQ ID NO: 229662 - RNA, 22 nt, Homo sapiens
cucaguggauuagauaaugcac

SEQ ID NO: 229663 - RNA, 22 nt, Homo sapiens
cucagugucuggggccccaggg

SEQ ID NO: 229664 - RNA, 22 nt, Homo sapiens
cucaguuuugccuuguuuaagg

SEQ ID NO: 229665 - RNA, 21 nt, Homo sapiens
cucauauugcuuuuccauggu

SEQ ID NO: 229666 - RNA, 22 nt, Homo sapiens
cucaugcugucuucugggguaa

SEQ ID NO: 229667 - RNA, 22 nt, Homo sapiens
cucauggaauacuucacagcca

SEQ ID NO: 229668 - RNA, 22 nt, Homo sapiens
cucauggagaacaucugcuagg

SEQ ID NO: 229669 - RNA, 19 nt, Homo sapiens
cucauggagaaggagaaua

SEQ ID NO: 229670 - RNA, 22 nt, Homo sapiens
cucauggauggucuggcagcca

SEQ ID NO: 229671 - RNA, 22 nt, Homo sapiens
cuccacugagcaggugggaggc

SEQ ID NO: 229672 - RNA, 22 nt, Homo sapiens
cucccugagccagggcuuugac

SEQ ID NO: 229673 - RNA, 22 nt, Homo sapiens
cucccuuugcugaauguuuuuc

SEQ ID NO: 229674 - RNA, 20 nt, Homo sapiens
cuccuucauuccuuuggacc

SEQ ID NO: 229675 - RNA, 22 nt, Homo sapiens
cucucaguguggaggccagaaa

SEQ ID NO: 229676 - RNA, 22 nt, Homo sapiens
cucucugagccauggcugcccu

SEQ ID NO: 229677 - RNA, 17 nt, Homo sapiens
cucucugguuuaaagca

SEQ ID NO: 229678 - RNA, 22 nt, Homo sapiens
cucugguggaagcagggggcaa

SEQ ID NO: 229679 - RNA, 22 nt, Homo sapiens
cucuuugaggugagcugcccau

SEQ ID NO: 229680 - RNA, 22 nt, Homo sapiens
cucuuugaguuccuccuggugu

SEQ ID NO: 229681 - RNA, 22 nt, Homo sapiens
cucuuugaugugaaccgugguu

SEQ ID NO: 229682 - RNA, 22 nt, Homo sapiens
cucuuuggaugccuuaggguua

SEQ ID NO: 229683 - RNA, 19 nt, Homo sapiens
cugaaacacagagagggcu

SEQ ID NO: 229684 - RNA, 22 nt, Homo sapiens
cugacaagauucaucacucagu

SEQ ID NO: 229685 - RNA, 22 nt, Homo sapiens
cugacauuguugaucacagcca

SEQ ID NO: 229686 - RNA, 22 nt, Homo sapiens
cugaccucugucaaagacaccc

SEQ ID NO: 229687 - RNA, 22 nt, Homo sapiens
cugacugaggaucaguucauca

SEQ ID NO: 229688 - RNA, 22 nt, Homo sapiens
cugagaaugaugauuuccaguu

SEQ ID NO: 229689 - RNA, 22 nt, Homo sapiens
cugagacacucuuaucugcaua

SEQ ID NO: 229690 - RNA, 22 nt, Homo sapiens
cugagaucaagucuugcucugu

SEQ ID NO: 229691 - RNA, 22 nt, Homo sapiens
cugagaucaugggucagguggu

SEQ ID NO: 229692 - RNA, 22 nt, Homo sapiens
cugagaucguggggcugcuguc

SEQ ID NO: 229693 - RNA, 22 nt, Homo sapiens
cugagaucugaaccaggagugu

SEQ ID NO: 229694 - RNA, 22 nt, Homo sapiens
cugagaucuuauuagaaaugca

SEQ ID NO: 229695 - RNA, 22 nt, Homo sapiens
cugagauggagucucgcauugu

SEQ ID NO: 229696 - RNA, 22 nt, Homo sapiens
acccaguguucagacuaccugu

SEQ ID NO: 229697 - RNA, 22 nt, Homo sapiens
accccauuugcacugagcccuu

SEQ ID NO: 229698 - RNA, 21 nt, Homo sapiens
acccccacaccuccuuaguuc

SEQ ID NO: 229699 - RNA, 22 nt, Homo sapiens
accccugagaucgaaucaugcu

SEQ ID NO: 229700 - RNA, 22 nt, Homo sapiens
accccugugacggguauuugag

SEQ ID NO: 229701 - RNA, 22 nt, Homo sapiens
acccgcccagguguggccggga

SEQ ID NO: 229702 - RNA, 22 nt, Homo sapiens
acccguuacuuagcagaccagg

SEQ ID NO: 229703 - RNA, 22 nt, Homo sapiens
acccguuacuuagcagaccggg

SEQ ID NO: 229704 - RNA, 22 nt, Homo sapiens
acccuacauaguagauccuaca

SEQ ID NO: 229705 - RNA, 21 nt, Homo sapiens
acccucuaguuuucaacaggc

SEQ ID NO: 229706 - RNA, 22 nt, Homo sapiens
acccugacacgauucuucacuu

SEQ ID NO: 229707 - RNA, 22 nt, Homo sapiens
acccuggagagugcuguaguaa

SEQ ID NO: 229708 - RNA, 22 nt, Homo sapiens
acccuguaggugcuggcagaga

SEQ ID NO: 229709 - RNA, 22 nt, Homo sapiens
acccuguaguuagaaacuuuca

SEQ ID NO: 229710 - RNA, 22 nt, Homo sapiens
acccugucaaaacggaccaauc

SEQ ID NO: 229711 - RNA, 22 nt, Homo sapiens
acccugucaaaauggaccaauc

SEQ ID NO: 229712 - RNA, 22 nt, Homo sapiens
acccugucagcuggccugggca

SEQ ID NO: 229713 - RNA, 22 nt, Homo sapiens
acccugucauccacauggugcu

SEQ ID NO: 229714 - RNA, 22 nt, Homo sapiens
acccuguugguggaucagauug

SEQ ID NO: 229715 - RNA, 22 nt, Homo sapiens
acccuguugucagaauguggau

SEQ ID NO: 229716 - RNA, 22 nt, Homo sapiens
acccuuagguuaaaguugaguc

SEQ ID NO: 229717 - RNA, 19 nt, Homo sapiens
accuguagaaaguacaaca

SEQ ID NO: 229718 - RNA, 18 nt, Homo sapiens
accuucauuccuuugccu

SEQ ID NO: 229719 - RNA, 22 nt, Homo sapiens
accuucauuguugccaugucca

SEQ ID NO: 229720 - RNA, 22 nt, Homo sapiens
acgugcaugcacacacaugcgc

SEQ ID NO: 229721 - RNA, 20 nt, Homo sapiens
acuaaaucucauuuuaugca

SEQ ID NO: 229722 - RNA, 22 nt, Homo sapiens
acuacaugugaugucaguauau

SEQ ID NO: 229723 - RNA, 22 nt, Homo sapiens
acuacuucuaaguuuuggaaga

SEQ ID NO: 229724 - RNA, 19 nt, Homo sapiens
acuaggccuacaaagcuau

SEQ ID NO: 229725 - RNA, 22 nt, Homo sapiens
acuagguaguaaucugcagaga

SEQ ID NO: 229726 - RNA, 22 nt, Homo sapiens
acucagagugggccccuagaua

SEQ ID NO: 229727 - RNA, 22 nt, Homo sapiens
acucauugcucauaccuuaucu

SEQ ID NO: 229728 - RNA, 22 nt, Homo sapiens
acuccauuuggacucugggagg

SEQ ID NO: 229729 - RNA, 18 nt, Homo sapiens
acucuguauguggagugg

SEQ ID NO: 229730 - RNA, 22 nt, Homo sapiens
acugagaucuuuaaauaaauaa

SEQ ID NO: 229731 - RNA, 23 nt, Homo sapiens
acugagcaauguuuacauacuug

SEQ ID NO: 229732 - RNA, 22 nt, Homo sapiens
acugaguguugauuuagauuaa

SEQ ID NO: 229733 - RNA, 22 nt, Homo sapiens
acugaucaauguuaaggcuuau

SEQ ID NO: 229734 - RNA, 22 nt, Homo sapiens
acugcaaugucgaauagagaug

SEQ ID NO: 229735 - RNA, 23 nt, Homo sapiens
acugcaauuacguuugcaccaac

SEQ ID NO: 229736 - RNA, 22 nt, Homo sapiens
acugcaauuacuguuguaccaa

SEQ ID NO: 229737 - RNA, 22 nt, Homo sapiens
acugcacuccaaccuguugggc

SEQ ID NO: 229738 - RNA, 22 nt, Homo sapiens
acugcacuccaaccuuggugac

SEQ ID NO: 229739 - RNA, 18 nt, Homo sapiens
acugcacuccaccuuggg

SEQ ID NO: 229740 - RNA, 22 nt, Homo sapiens
acugcacuccaccuugggcaac

SEQ ID NO: 229741 - RNA, 22 nt, Homo sapiens
guagaauguauacaguauacag

SEQ ID NO: 229742 - RNA, 22 nt, Homo sapiens
guagaugcauggauuuacuucu

SEQ ID NO: 229743 - RNA, 22 nt, Homo sapiens
guagcaccagugcucuucucaa

SEQ ID NO: 229744 - RNA, 22 nt, Homo sapiens
guagcaucauuugcaauuucau

SEQ ID NO: 229745 - RNA, 22 nt, Homo sapiens
guauacgugcaggucacagggg

SEQ ID NO: 229746 - RNA, 22 nt, Homo sapiens
guaucaucauguuggccaggcu

SEQ ID NO: 229747 - RNA, 22 nt, Homo sapiens
guaucauugccuaaugcucuca

SEQ ID NO: 229748 - RNA, 22 nt, Homo sapiens
guaucauuggcauguaaccaga

SEQ ID NO: 229749 - RNA, 22 nt, Homo sapiens
guauccugaaguucucagcacu

SEQ ID NO: 229750 - RNA, 22 nt, Homo sapiens
guaugaaaaucggagauugggu

SEQ ID NO: 229751 - RNA, 22 nt, Homo sapiens
guaugguacuuuaugguuagug

SEQ ID NO: 229752 - RNA, 22 nt, Homo sapiens
guauuagaugguauuugaagau

SEQ ID NO: 229753 - RNA, 22 nt, Homo sapiens
guauugccugugugccagccac

SEQ ID NO: 229754 - RNA, 22 nt, Homo sapiens
gucaaagucuauuggcuaauuc

SEQ ID NO: 229755 - RNA, 22 nt, Homo sapiens
gucaagagaacuuucuaucacu

SEQ ID NO: 229756 - RNA, 22 nt, Homo sapiens
gucaaguguuuucaaggcuucc

SEQ ID NO: 229757 - RNA, 22 nt, Homo sapiens
gucaaugcauccaugaauggcu

SEQ ID NO: 229758 - RNA, 22 nt, Homo sapiens
gucacagaggcuaagaccccac

SEQ ID NO: 229759 - RNA, 22 nt, Homo sapiens
gucacaguguuuguucauccca

SEQ ID NO: 229760 - RNA, 21 nt, Homo sapiens
gucacuggggcuggauaauuc

SEQ ID NO: 229761 - RNA, 22 nt, Homo sapiens
gucacugggugcugcgccuguc

SEQ ID NO: 229762 - RNA, 22 nt, Homo sapiens
gucacugucuacuguaauagcc

SEQ ID NO: 229763 - RNA, 22 nt, Homo sapiens
gucacugugaggaggggccagg

SEQ ID NO: 229764 - RNA, 22 nt, Homo sapiens
gucagcuuuuccuuacuuuagg

SEQ ID NO: 229765 - RNA, 22 nt, Homo sapiens
gucaggaccucgguggcauucu

SEQ ID NO: 229766 - RNA, 22 nt, Homo sapiens
gucagggagucucuaucagugg

SEQ ID NO: 229767 - RNA, 22 nt, Homo sapiens
gucagguaccugaaagcagcca

SEQ ID NO: 229768 - RNA, 22 nt, Homo sapiens
gucaggugcuuacgcggagauc

SEQ ID NO: 229769 - RNA, 22 nt, Homo sapiens
gucagucugucccugccuggcg

SEQ ID NO: 229770 - RNA, 22 nt, Homo sapiens
gucagugcauguaaacauaaaa

SEQ ID NO: 229771 - RNA, 22 nt, Homo sapiens
gucagugcuuuaguucaggaug

SEQ ID NO: 229772 - RNA, 21 nt, Homo sapiens
gucauaugucucugauuagug

SEQ ID NO: 229773 - RNA, 22 nt, Homo sapiens
gucauggaacaacuuaaaguca

SEQ ID NO: 229774 - RNA, 22 nt, Homo sapiens
gucauggacaaggugugagcca

SEQ ID NO: 229775 - RNA, 22 nt, Homo sapiens
gucaugggguacuacacauggg

SEQ ID NO: 229776 - RNA, 22 nt, Homo sapiens
gucauggugcuagcgggaaugu

SEQ ID NO: 229777 - RNA, 22 nt, Homo sapiens
gucauugagucagggaguaucu

SEQ ID NO: 229778 - RNA, 22 nt, Homo sapiens
gucauugucaauugacaauugu

SEQ ID NO: 229779 - RNA, 22 nt, Homo sapiens
guccaguuguuuucugagguug

SEQ ID NO: 229780 - RNA, 22 nt, Homo sapiens
guccauuuguuuccagagcacu

SEQ ID NO: 229781 - RNA, 22 nt, Homo sapiens
guccuggagaagcguggaccgg

SEQ ID NO: 229782 - RNA, 22 nt, Homo sapiens
guccuguuuuuaagguucauag

SEQ ID NO: 229783 - RNA, 22 nt, Homo sapiens
gucgguguuuccugagaacgaa

SEQ ID NO: 229784 - RNA, 22 nt, Homo sapiens
gucuaugguucaggguggagug

SEQ ID NO: 229785 - RNA, 18 nt, Homo sapiens
gucucacaugguggaagc

SEQ ID NO: 229786 - RNA, 22 nt, Homo sapiens
ugcaagacuaaaccuuccccuc

SEQ ID NO: 229787 - RNA, 22 nt, Homo sapiens
ugcaaguaauuccagcuacuga

SEQ ID NO: 229788 - RNA, 22 nt, Homo sapiens
ugcaauauccucuacuauaggu

SEQ ID NO: 229789 - RNA, 22 nt, Homo sapiens
ugcaaucaucgcuguuggccac

SEQ ID NO: 229790 - RNA, 22 nt, Homo sapiens
ugcaaucauuuggaggagaaga

SEQ ID NO: 229791 - RNA, 18 nt, Homo sapiens
ugcaauggagaugcagcc

SEQ ID NO: 229792 - RNA, 22 nt, Homo sapiens
ugcaaugucuucugaggggagc

SEQ ID NO: 229793 - RNA, 22 nt, Homo sapiens
ugcacaaccucacccccgcucu

SEQ ID NO: 229794 - RNA, 22 nt, Homo sapiens
ugcaccacugcacuucagccug

SEQ ID NO: 229795 - RNA, 22 nt, Homo sapiens
ugcaccacuguacuccagucug

SEQ ID NO: 229796 - RNA, 18 nt, Homo sapiens
ugcaccaguuuacacuuc

SEQ ID NO: 229797 - RNA, 22 nt, Homo sapiens
ugcacuguggucugagagacag

SEQ ID NO: 229798 - RNA, 22 nt, Homo sapiens
ugcagagaaacauuuuguauuu

SEQ ID NO: 229799 - RNA, 16 nt, Homo sapiens
ugcagaguaggugaau

SEQ ID NO: 229800 - RNA, 22 nt, Homo sapiens
ugcagagucuguccugccugcc

SEQ ID NO: 229801 - RNA, 19 nt, Homo sapiens
ugcagcaauguaaaagaca

SEQ ID NO: 229802 - RNA, 17 nt, Homo sapiens
ugcagcacacugauggg

SEQ ID NO: 229803 - RNA, 22 nt, Homo sapiens
ugcagcacaguagguuugcaau

SEQ ID NO: 229804 - RNA, 20 nt, Homo sapiens
ugcagcacgggcccuuucca

SEQ ID NO: 229805 - RNA, 22 nt, Homo sapiens
ugcagcacuguucacaauagcc

SEQ ID NO: 229806 - RNA, 22 nt, Homo sapiens
ugcagcauugcacuccagccug

SEQ ID NO: 229807 - RNA, 22 nt, Homo sapiens
ugcagcucaaauuccuaacaag

SEQ ID NO: 229808 - RNA, 22 nt, Homo sapiens
ugcagcucagcugcggaguuuu

SEQ ID NO: 229809 - RNA, 22 nt, Homo sapiens
ugcaggauguucaguaauuucc

SEQ ID NO: 229810 - RNA, 22 nt, Homo sapiens
ugcagugcaugacuguguuaug

SEQ ID NO: 229811 - RNA, 22 nt, Homo sapiens
ugcaguguggcucacgccugua

SEQ ID NO: 229812 - RNA, 18 nt, Homo sapiens
ugcauacuaucugauuuu

SEQ ID NO: 229813 - RNA, 22 nt, Homo sapiens
ugcauaggagcagggucuaugu

SEQ ID NO: 229814 - RNA, 23 nt, Homo sapiens
ugcauaguacccaauacuuuauc

SEQ ID NO: 229815 - RNA, 22 nt, Homo sapiens
ugcauauguugaaccaggcuug

SEQ ID NO: 229816 - RNA, 22 nt, Homo sapiens
ugcauauucuaggauuuuguau

SEQ ID NO: 229817 - RNA, 22 nt, Homo sapiens
ugcauggagcucucuuuggacu

SEQ ID NO: 229818 - RNA, 22 nt, Homo sapiens
ugcauggucauacauggcaccc

SEQ ID NO: 229819 - RNA, 22 nt, Homo sapiens
ugcauguucuuacucauacaug

SEQ ID NO: 229820 - RNA, 22 nt, Homo sapiens
ugcauuagucuguucucacacu

SEQ ID NO: 229821 - RNA, 22 nt, Homo sapiens
ugcauugccgugauuacugucu

SEQ ID NO: 229822 - RNA, 22 nt, Homo sapiens
ugccaacaugccuggcuguuuu

SEQ ID NO: 229823 - RNA, 20 nt, Homo sapiens
ugccaagaugacuauagcuc

SEQ ID NO: 229824 - RNA, 22 nt, Homo sapiens
ugccagagacguagggaauauu

SEQ ID NO: 229825 - RNA, 22 nt, Homo sapiens
ugccaugaagagaggaagcagu

SEQ ID NO: 229826 - RNA, 19 nt, Homo sapiens
ugccauguagcacaugguc

SEQ ID NO: 229827 - RNA, 22 nt, Homo sapiens
ugccuacugagacuggguggcc

SEQ ID NO: 229828 - RNA, 22 nt, Homo sapiens
ugccuacugguuguucugggca

SEQ ID NO: 229829 - RNA, 22 nt, Homo sapiens
ugccuaggcuggaaugcaaugg

SEQ ID NO: 229830 - RNA, 22 nt, Homo sapiens
ugccuaggcuggaguguagugg

SEQ ID NO: 229831 - RNA, 22 nt, Homo sapiens
ugccuaguagaaggugaacaug

SEQ ID NO: 229832 - RNA, 22 nt, Homo sapiens
ugccuaguggccuuaugaguau

SEQ ID NO: 229833 - RNA, 20 nt, Homo sapiens
ugccugacacucuuugcuuc

SEQ ID NO: 229834 - RNA, 22 nt, Homo sapiens
ugccuuauuccaacugagcucu

SEQ ID NO: 229835 - RNA, 16 nt, Homo sapiens
ugccuucuucuguauu

SEQ ID NO: 229836 - RNA, 21 nt, Homo sapiens
ugccuuuguaguaggugucuu

SEQ ID NO: 229837 - RNA, 22 nt, Homo sapiens
ugcgaucuuuuuccuuguuccu

SEQ ID NO: 229838 - RNA, 22 nt, Homo sapiens
ugcgccauugaacuccuccugg

SEQ ID NO: 229839 - RNA, 18 nt, Homo sapiens
auguggcuuuugaaggcu

SEQ ID NO: 229840 - RNA, 22 nt, Homo sapiens
augugguaguuauagugauaag

SEQ ID NO: 229841 - RNA, 22 nt, Homo sapiens
auguguauuaccucgauuguga

SEQ ID NO: 229842 - RNA, 22 nt, Homo sapiens
augugugcuugugacacagccu

SEQ ID NO: 229843 - RNA, 22 nt, Homo sapiens
auguguucaucacagcacaauu

SEQ ID NO: 229844 - RNA, 22 nt, Homo sapiens
auguuaacaucuuaguuuucau

SEQ ID NO: 229845 - RNA, 22 nt, Homo sapiens
auguuagcaucaauauucauca

SEQ ID NO: 229846 - RNA, 22 nt, Homo sapiens
auguuagcaucuggcacuaugg

SEQ ID NO: 229847 - RNA, 22 nt, Homo sapiens
auguuauguuaaugauaaugga

SEQ ID NO: 229848 - RNA, 22 nt, Homo sapiens
auguuauguucuucucuguaua

SEQ ID NO: 229849 - RNA, 22 nt, Homo sapiens
auuaaauguuggacguauacau

SEQ ID NO: 229850 - RNA, 22 nt, Homo sapiens
auuaacaucuagaguuuuggug

SEQ ID NO: 229851 - RNA, 22 nt, Homo sapiens
auuaagagcacauguucugggu

SEQ ID NO: 229852 - RNA, 22 nt, Homo sapiens
auuaaguaaugguuccaauaau

SEQ ID NO: 229853 - RNA, 22 nt, Homo sapiens
auuaagugcuugccagugcugg

SEQ ID NO: 229854 - RNA, 22 nt, Homo sapiens
auuaaguugugccugaaaacuu

SEQ ID NO: 229855 - RNA, 22 nt, Homo sapiens
auuaaucaggcaaugcuugcua

SEQ ID NO: 229856 - RNA, 22 nt, Homo sapiens
auuacacuuucuauucaaugag

SEQ ID NO: 229857 - RNA, 22 nt, Homo sapiens
auuagguauuuucuggacaggg

SEQ ID NO: 229858 - RNA, 22 nt, Homo sapiens
auuaucacaguuuugcauaugg

SEQ ID NO: 229859 - RNA, 22 nt, Homo sapiens
auuauugacucauagaaaggau

SEQ ID NO: 229860 - RNA, 22 nt, Homo sapiens
auucacuguggcuuucucugau

SEQ ID NO: 229861 - RNA, 22 nt, Homo sapiens
auucagaggggcagcugucuug

SEQ ID NO: 229862 - RNA, 22 nt, Homo sapiens
auucaucagggauauugguuga

SEQ ID NO: 229863 - RNA, 20 nt, Homo sapiens
auucauggaggagcaauugg

SEQ ID NO: 229864 - RNA, 22 nt, Homo sapiens
auuccacaguuaacacagaccg

SEQ ID NO: 229865 - RNA, 22 nt, Homo sapiens
auuccaguggguuuacauccca

SEQ ID NO: 229866 - RNA, 22 nt, Homo sapiens
auuccauaguacagugaugagu

SEQ ID NO: 229867 - RNA, 22 nt, Homo sapiens
auucccuguagaauaaggaugg

SEQ ID NO: 229868 - RNA, 22 nt, Homo sapiens
auucccuuggucaacggaugca

SEQ ID NO: 229869 - RNA, 23 nt, Homo sapiens
auugaacacuuucauaugugagg

SEQ ID NO: 229870 - RNA, 22 nt, Homo sapiens
auugaacuguuggagagguuuu

SEQ ID NO: 229871 - RNA, 22 nt, Homo sapiens
auugacuugauauauagcugau

SEQ ID NO: 229872 - RNA, 22 nt, Homo sapiens
auugagcaauuccuaugugcuu

SEQ ID NO: 229873 - RNA, 22 nt, Homo sapiens
auugaguaaaaaauagugaugu

SEQ ID NO: 229874 - RNA, 22 nt, Homo sapiens
auugaguaaaugaaaauugccu

SEQ ID NO: 229875 - RNA, 22 nt, Homo sapiens
auugaguaacaauuuuguucaa

SEQ ID NO: 229876 - RNA, 23 nt, Homo sapiens
auugauagugccuuugugcuaau

SEQ ID NO: 229877 - RNA, 22 nt, Homo sapiens
auugauaguuuaauaggaauug

SEQ ID NO: 229878 - RNA, 19 nt, Homo sapiens
auugauuaaguuugcuguc

SEQ ID NO: 229879 - RNA, 22 nt, Homo sapiens
auugcaaagcguagacucuaaa

SEQ ID NO: 229880 - RNA, 22 nt, Homo sapiens
auugcaaucuccgccuccgggg

SEQ ID NO: 229881 - RNA, 22 nt, Homo sapiens
gucucccaaccccugugcccag

SEQ ID NO: 229882 - RNA, 22 nt, Homo sapiens
gucuggcaauggcagacuggca

SEQ ID NO: 229883 - RNA, 22 nt, Homo sapiens
gucuggcacagggaaaguacaa

SEQ ID NO: 229884 - RNA, 23 nt, Homo sapiens
gucuggucccugguuggaaacca

SEQ ID NO: 229885 - RNA, 22 nt, Homo sapiens
gucugguuuuuuauauccucac

SEQ ID NO: 229886 - RNA, 21 nt, Homo sapiens
gucuuacagccagaugccucu

SEQ ID NO: 229887 - RNA, 22 nt, Homo sapiens
gucuugaaggcugaguaccugu

SEQ ID NO: 229888 - RNA, 22 nt, Homo sapiens
gucuuggagaacucagcuuggc

SEQ ID NO: 229889 - RNA, 20 nt, Homo sapiens
gucuuguagcucaaguuauu

SEQ ID NO: 229890 - RNA, 22 nt, Homo sapiens
gucuuuggaaaaaaugucuguu

SEQ ID NO: 229891 - RNA, 22 nt, Homo sapiens
gugaaaagaugagcaccauaca

SEQ ID NO: 229892 - RNA, 22 nt, Homo sapiens
gugaaagcaucugacugugcca

SEQ ID NO: 229893 - RNA, 17 nt, Homo sapiens
gugaaaucaucauuuuu

SEQ ID NO: 229894 - RNA, 22 nt, Homo sapiens
gugaacagcagaugagugagug

SEQ ID NO: 229895 - RNA, 22 nt, Homo sapiens
gugaaugaaugggugaauacau

SEQ ID NO: 229896 - RNA, 22 nt, Homo sapiens
gugaaugcauuaagaaggggga

SEQ ID NO: 229897 - RNA, 22 nt, Homo sapiens
gugacagaguaagacccuguau

SEQ ID NO: 229898 - RNA, 22 nt, Homo sapiens
gugacaguggagacuuacuuca

SEQ ID NO: 229899 - RNA, 22 nt, Homo sapiens
gugaccauuugacauauccuug

SEQ ID NO: 229900 - RNA, 22 nt, Homo sapiens
gugaccucauuacggggccugc

SEQ ID NO: 229901 - RNA, 22 nt, Homo sapiens
gugaccucuguugcugucacua

SEQ ID NO: 229902 - RNA, 22 nt, Homo sapiens
gugacugggaguggugaagaua

SEQ ID NO: 229903 - RNA, 22 nt, Homo sapiens
gugagaacugugucuuauaaac

SEQ ID NO: 229904 - RNA, 22 nt, Homo sapiens
gugagagaaugacuauguguuu

SEQ ID NO: 229905 - RNA, 22 nt, Homo sapiens
gugagauaucuagacuagggaa

SEQ ID NO: 229906 - RNA, 22 nt, Homo sapiens
gugagauccucucuuauauggg

SEQ ID NO: 229907 - RNA, 22 nt, Homo sapiens
gugagauuuucuccagguucag

SEQ ID NO: 229908 - RNA, 22 nt, Homo sapiens
gugagcaauugauacuugaagu

SEQ ID NO: 229909 - RNA, 22 nt, Homo sapiens
gugagcauucaaggaaggagcu

SEQ ID NO: 229910 - RNA, 22 nt, Homo sapiens
gugagcgaggaaacgacggcgc

SEQ ID NO: 229911 - RNA, 22 nt, Homo sapiens
gugagcuaagcaaauaugagcc

SEQ ID NO: 229912 - RNA, 22 nt, Homo sapiens
gugagcuagaccacuuggcucc

SEQ ID NO: 229913 - RNA, 22 nt, Homo sapiens
gugagcuccucucuauguguca

SEQ ID NO: 229914 - RNA, 22 nt, Homo sapiens
gugagcuccucuucugcugcag

SEQ ID NO: 229915 - RNA, 22 nt, Homo sapiens
gugaggcugguccugccuccca

SEQ ID NO: 229916 - RNA, 22 nt, Homo sapiens
gugaggcuuuuccuguuagacu

SEQ ID NO: 229917 - RNA, 20 nt, Homo sapiens
gugagguagaggguuaccug

SEQ ID NO: 229918 - RNA, 17 nt, Homo sapiens
gugagguauccucaaaa

SEQ ID NO: 229919 - RNA, 22 nt, Homo sapiens
gugaggucagggcuguggacag

SEQ ID NO: 229920 - RNA, 21 nt, Homo sapiens
gugaggucauugggcuuucug

SEQ ID NO: 229921 - RNA, 22 nt, Homo sapiens
gugagguguuaaccaaccugug

SEQ ID NO: 229922 - RNA, 22 nt, Homo sapiens
gugagguugaaaauaauggaaa

SEQ ID NO: 229923 - RNA, 22 nt, Homo sapiens
gugagucaaucugagggguuca

SEQ ID NO: 229924 - RNA, 22 nt, Homo sapiens
gugagucagucuguguagggcu

SEQ ID NO: 229925 - RNA, 22 nt, Homo sapiens
gugagucaugucccaucugauu

SEQ ID NO: 229926 - RNA, 22 nt, Homo sapiens
gugaguggacgugaccaauaaa

SEQ ID NO: 229927 - RNA, 22 nt, Homo sapiens
gugauaguucuuacuccaaagu

SEQ ID NO: 229928 - RNA, 22 nt, Homo sapiens
gugauauguuaggaucuaaguc

SEQ ID NO: 229929 - RNA, 23 nt, Homo sapiens
gugaucauuguuguggguugaau

SEQ ID NO: 229930 - RNA, 22 nt, Homo sapiens
gugaucucagcucacuggaacc

SEQ ID NO: 229931 - RNA, 22 nt, Homo sapiens
gugauuauuaugcacugcaugc

SEQ ID NO: 229932 - RNA, 20 nt, Homo sapiens
gugauuggucacugguuguu

SEQ ID NO: 229933 - RNA, 22 nt, Homo sapiens
gugauuguuaaacugccucucu

SEQ ID NO: 229934 - RNA, 22 nt, Homo sapiens
gugcaaacuccaggucucuuca

SEQ ID NO: 229935 - RNA, 22 nt, Homo sapiens
gugcaacaugccuggcuaauuu

SEQ ID NO: 229936 - RNA, 22 nt, Homo sapiens
gugcaaccaucaccacugacuc

SEQ ID NO: 229937 - RNA, 22 nt, Homo sapiens
uggcaugucguuuuucauagga

SEQ ID NO: 229938 - RNA, 22 nt, Homo sapiens
uggcauguguuugaaugaguau

SEQ ID NO: 229939 - RNA, 22 nt, Homo sapiens
uggcauguuggguguugacucc

SEQ ID NO: 229940 - RNA, 22 nt, Homo sapiens
uggcauuguccaauaaaauuuu

SEQ ID NO: 229941 - RNA, 22 nt, Homo sapiens
uggccaagagcacagauauugg

SEQ ID NO: 229942 - RNA, 22 nt, Homo sapiens
uggccagagggcaauuagcugu

SEQ ID NO: 229943 - RNA, 22 nt, Homo sapiens
uggccaguguuuuuccugggcu

SEQ ID NO: 229944 - RNA, 22 nt, Homo sapiens
uggcgagaaaccauaugcuuuc

SEQ ID NO: 229945 - RNA, 23 nt, Homo sapiens
uggcuagacguccuuuccugaug

SEQ ID NO: 229946 - RNA, 22 nt, Homo sapiens
uggcuguuuauuucaccugggu

SEQ ID NO: 229947 - RNA, 21 nt, Homo sapiens
uggcuguuuucaugcuagaac

SEQ ID NO: 229948 - RNA, 20 nt, Homo sapiens
uggcuucuuaauugcaggca

SEQ ID NO: 229949 - RNA, 22 nt, Homo sapiens
uggcuuucuggggcuucuguuc

SEQ ID NO: 229950 - RNA, 22 nt, Homo sapiens
uggcuuuucauccugggacauu

SEQ ID NO: 229951 - RNA, 22 nt, Homo sapiens
uggcuuuuccaggcauuacgau

SEQ ID NO: 229952 - RNA, 18 nt, Homo sapiens
ugggaagaaauucuucuc

SEQ ID NO: 229953 - RNA, 22 nt, Homo sapiens
ugggaagaugcugcuucuuccu

SEQ ID NO: 229954 - RNA, 22 nt, Homo sapiens
ugggaagauucuguguuuuucc

SEQ ID NO: 229955 - RNA, 22 nt, Homo sapiens
ugggaucaugagcaccgcuucc

SEQ ID NO: 229956 - RNA, 22 nt, Homo sapiens
ugggaucauuaugcauagugua

SEQ ID NO: 229957 - RNA, 22 nt, Homo sapiens
ugggaucuuuccuauuagcgag

SEQ ID NO: 229958 - RNA, 22 nt, Homo sapiens
ugggaugaauacaaugggauca

SEQ ID NO: 229959 - RNA, 22 nt, Homo sapiens
ugggaugugagucuucgcuuuc

SEQ ID NO: 229960 - RNA, 22 nt, Homo sapiens
ugggcaaaacuaagagcugugg

SEQ ID NO: 229961 - RNA, 22 nt, Homo sapiens
ugggcaaaugcuuuuuagucaa

SEQ ID NO: 229962 - RNA, 22 nt, Homo sapiens
ugggcaagagagcaugacccug

SEQ ID NO: 229963 - RNA, 22 nt, Homo sapiens
uggggcaaugaacauuuuugca

SEQ ID NO: 229964 - RNA, 22 nt, Homo sapiens
ugggguaggccugguuaugugc

SEQ ID NO: 229965 - RNA, 22 nt, Homo sapiens
uggguaaaucucuguucagggc

SEQ ID NO: 229966 - RNA, 22 nt, Homo sapiens
uggguaaaucuguuuggggcuc

SEQ ID NO: 229967 - RNA, 23 nt, Homo sapiens
ugggucaguuuuucugacaucau

SEQ ID NO: 229968 - RNA, 22 nt, Homo sapiens
uggguccccuacucuuuccaca

SEQ ID NO: 229969 - RNA, 23 nt, Homo sapiens
uggguucauucuugaagucagug

SEQ ID NO: 229970 - RNA, 23 nt, Homo sapiens
uggguucccuaagcgcaugcugc

SEQ ID NO: 229971 - RNA, 22 nt, Homo sapiens
ugguaagaucagaacuggaguc

SEQ ID NO: 229972 - RNA, 22 nt, Homo sapiens
ugguaguuucuguaucucacag

SEQ ID NO: 229973 - RNA, 22 nt, Homo sapiens
ugguaucuaagaugcacguugu

SEQ ID NO: 229974 - RNA, 22 nt, Homo sapiens
ugguauguauacuagcgacacu

SEQ ID NO: 229975 - RNA, 22 nt, Homo sapiens
ugguaugucuuucuuccuguag

SEQ ID NO: 229976 - RNA, 22 nt, Homo sapiens
auugcacaaagagggaaacuga

SEQ ID NO: 229977 - RNA, 22 nt, Homo sapiens
auugcacuccacccugggcaac

SEQ ID NO: 229978 - RNA, 22 nt, Homo sapiens
auugcacuccagcccugcugac

SEQ ID NO: 229979 - RNA, 22 nt, Homo sapiens
auugcacuccagccuaggcaac

SEQ ID NO: 229980 - RNA, 22 nt, Homo sapiens
auugcacuccagccuggaugac

SEQ ID NO: 229981 - RNA, 22 nt, Homo sapiens
auugcacuccagccuggcaaua

SEQ ID NO: 229982 - RNA, 21 nt, Homo sapiens
auugcacuccagccugggcga

SEQ ID NO: 229983 - RNA, 22 nt, Homo sapiens
auugcacuccagccugggggac

SEQ ID NO: 229984 - RNA, 22 nt, Homo sapiens
auugcacuccagccugggugag

SEQ ID NO: 229985 - RNA, 22 nt, Homo sapiens
auugcacuccagccuugggcaa

SEQ ID NO: 229986 - RNA, 22 nt, Homo sapiens
auugcacuccagccuugugaca

SEQ ID NO: 229987 - RNA, 22 nt, Homo sapiens
auugcacucuagccuuggcgac

SEQ ID NO: 229988 - RNA, 22 nt, Homo sapiens
auugcacuggggguuagaauuu

SEQ ID NO: 229989 - RNA, 22 nt, Homo sapiens
auugcagaaaugacagagcgcc

SEQ ID NO: 229990 - RNA, 22 nt, Homo sapiens
auugcagcccacccugggugau

SEQ ID NO: 229991 - RNA, 22 nt, Homo sapiens
auugcagcuugcagggugugua

SEQ ID NO: 229992 - RNA, 22 nt, Homo sapiens
auugcaguuucaacuccagggc

SEQ ID NO: 229993 - RNA, 22 nt, Homo sapiens
auugcccauaaggauauuguca

SEQ ID NO: 229994 - RNA, 18 nt, Homo sapiens
auugcccucauggggcuu

SEQ ID NO: 229995 - RNA, 22 nt, Homo sapiens
auugccuaacauagauguucag

SEQ ID NO: 229996 - RNA, 22 nt, Homo sapiens
auugcuaacugaaauaagacca

SEQ ID NO: 229997 - RNA, 22 nt, Homo sapiens
auugcuaauaugcuucaggcaa

SEQ ID NO: 229998 - RNA, 22 nt, Homo sapiens
auugcucaaaucaguacuugag

SEQ ID NO: 229999 - RNA, 22 nt, Homo sapiens
auugcuuaagucccuguauuag

SEQ ID NO: 230000 - RNA, 22 nt, Homo sapiens
auugcuuacccuguauuagauc

SEQ ID NO: 230001 - RNA, 22 nt, Homo sapiens
auuggcaaucgucuccauuuuu

SEQ ID NO: 230002 - RNA, 22 nt, Homo sapiens
auuggccaaugggacgucagca

SEQ ID NO: 230003 - RNA, 22 nt, Homo sapiens
auuguacauacaccggugugua

SEQ ID NO: 230004 - RNA, 22 nt, Homo sapiens
auuguacuagguccuagggcuu

SEQ ID NO: 230005 - RNA, 22 nt, Homo sapiens
auuguacuccagccuaggcaac

SEQ ID NO: 230006 - RNA, 22 nt, Homo sapiens
auuguacuccagccugggcaaa

SEQ ID NO: 230007 - RNA, 22 nt, Homo sapiens
auuguacuccagccugggcgac

SEQ ID NO: 230008 - RNA, 22 nt, Homo sapiens
auuguacugccccccuguugcu

SEQ ID NO: 230009 - RNA, 22 nt, Homo sapiens
auuguacuuauugccagaauuu

SEQ ID NO: 230010 - RNA, 22 nt, Homo sapiens
auugucauuuauaacuguguag

SEQ ID NO: 230011 - RNA, 22 nt, Homo sapiens
auugugauggucaaaggaaaua

SEQ ID NO: 230012 - RNA, 22 nt, Homo sapiens
auuguuccccggucauuuuugu

SEQ ID NO: 230013 - RNA, 22 nt, Homo sapiens
auuguucuuguguccuuuuccu

SEQ ID NO: 230014 - RNA, 22 nt, Homo sapiens
auuuaacuggucuaggggccca

SEQ ID NO: 230015 - RNA, 22 nt, Homo sapiens
auuucacuucgcaugguguccg

SEQ ID NO: 230016 - RNA, 22 nt, Homo sapiens
auuugacacugagagccucagu

SEQ ID NO: 230017 - RNA, 22 nt, Homo sapiens
auuuggcagugaagggaucaca

SEQ ID NO: 230018 - RNA, 22 nt, Homo sapiens
auuuggcauagaguaucauucu

SEQ ID NO: 230019 - RNA, 22 nt, Homo sapiens
auuugguugggugcgguggcuu

SEQ ID NO: 230020 - RNA, 22 nt, Homo sapiens
auuugucaauacacuucuucca

SEQ ID NO: 230021 - RNA, 22 nt, Homo sapiens
auuugucacuauguggcuaaua

SEQ ID NO: 230022 - RNA, 22 nt, Homo sapiens
auuugucacuuaacagccauua

SEQ ID NO: 230023 - RNA, 22 nt, Homo sapiens
auuuugguuacauaguugagcu

SEQ ID NO: 230024 - RNA, 22 nt, Homo sapiens
caaaagugauugcgguuuuugc

SEQ ID NO: 230025 - RNA, 22 nt, Homo sapiens
caaaggcuuccacugcauccuu

SEQ ID NO: 230026 - RNA, 22 nt, Homo sapiens
caaaguaauugugguuuugcca

SEQ ID NO: 230027 - RNA, 22 nt, Homo sapiens
caaagugcugggaugggccagg

SEQ ID NO: 230028 - RNA, 22 nt, Homo sapiens
caaagugguuuauacaugauug

SEQ ID NO: 230029 - RNA, 22 nt, Homo sapiens
caaaugaucugcuggccucagc

SEQ ID NO: 230030 - RNA, 22 nt, Homo sapiens
caaauugcuugucuguagugga

SEQ ID NO: 230031 - RNA, 20 nt, Homo sapiens
caaauugcuuucuugguuuu

SEQ ID NO: 230032 - RNA, 22 nt, Homo sapiens
caacacagugaaacccgucucu

SEQ ID NO: 230033 - RNA, 22 nt, Homo sapiens
caacaguaaagcauuuuuaagu

SEQ ID NO: 230034 - RNA, 22 nt, Homo sapiens
caacauccaccuccuggguuca

SEQ ID NO: 230035 - RNA, 22 nt, Homo sapiens
caaccaguagcugaguucaaaa

SEQ ID NO: 230036 - RNA, 22 nt, Homo sapiens
caacugcucacuccuggguuca

SEQ ID NO: 230037 - RNA, 22 nt, Homo sapiens
caagagagcugaugguuuuaaa

SEQ ID NO: 230038 - RNA, 22 nt, Homo sapiens
caagguacuuuuacaauuuccc

SEQ ID NO: 230039 - RNA, 22 nt, Homo sapiens
caagugaauaguugcucucaga

SEQ ID NO: 230040 - RNA, 21 nt, Homo sapiens
caagugaugcuucugcuuuaa

SEQ ID NO: 230041 - RNA, 22 nt, Homo sapiens
caagugcucuaggauccugagu

SEQ ID NO: 230042 - RNA, 22 nt, Homo sapiens
caauacuguguugaauaagagu

SEQ ID NO: 230043 - RNA, 22 nt, Homo sapiens
caauacuguuaccugaaauagg

SEQ ID NO: 230044 - RNA, 21 nt, Homo sapiens
caaugacacuguagcugugcu

SEQ ID NO: 230045 - RNA, 22 nt, Homo sapiens
caauggcaaugaaauagugaga

SEQ ID NO: 230046 - RNA, 22 nt, Homo sapiens
caauggcacgaucucgucucac

SEQ ID NO: 230047 - RNA, 22 nt, Homo sapiens
caaugguuuuuuaguauaagua

SEQ ID NO: 230048 - RNA, 22 nt, Homo sapiens
caauugcacucuuagguguaca

SEQ ID NO: 230049 - RNA, 22 nt, Homo sapiens
cacaaaguagauuagucuucca

SEQ ID NO: 230050 - RNA, 22 nt, Homo sapiens
cacacugucuuucagaaugguu

SEQ ID NO: 230051 - RNA, 22 nt, Homo sapiens
cacacuguuuuccauggggguu

SEQ ID NO: 230052 - RNA, 22 nt, Homo sapiens
cacagcacaggcaugaguguca

SEQ ID NO: 230053 - RNA, 22 nt, Homo sapiens
cacagcuaacaacuguuucuuc

SEQ ID NO: 230054 - RNA, 22 nt, Homo sapiens
cacagcuagucaaugguagaca

SEQ ID NO: 230055 - RNA, 22 nt, Homo sapiens
cacaggaagaggcacggucccu

SEQ ID NO: 230056 - RNA, 22 nt, Homo sapiens
cacaguagaauagagcacuagg

SEQ ID NO: 230057 - RNA, 22 nt, Homo sapiens
cacagucugggcuuguuuguac

SEQ ID NO: 230058 - RNA, 22 nt, Homo sapiens
cacagugaacugguggguuuuu

SEQ ID NO: 230059 - RNA, 22 nt, Homo sapiens
cacagugaaugucaucauugcc

SEQ ID NO: 230060 - RNA, 22 nt, Homo sapiens
cacauugaauuucugaugacaa

SEQ ID NO: 230061 - RNA, 22 nt, Homo sapiens
cacauugcaggaaaguucauua

SEQ ID NO: 230062 - RNA, 22 nt, Homo sapiens
caccacauuccauugaucaggc

SEQ ID NO: 230063 - RNA, 22 nt, Homo sapiens
caccagguuggagugcaguggu

SEQ ID NO: 230064 - RNA, 22 nt, Homo sapiens
caccccuaccugagucaggagu

SEQ ID NO: 230065 - RNA, 22 nt, Homo sapiens
caccgagugacaguagccauca

SEQ ID NO: 230066 - RNA, 22 nt, Homo sapiens
caccugagcgggaugcucgccu

SEQ ID NO: 230067 - RNA, 22 nt, Homo sapiens
caccuguacauggcaguguccu

SEQ ID NO: 230068 - RNA, 22 nt, Homo sapiens
cacgugcuuucuuuucauuuag

SEQ ID NO: 230069 - RNA, 22 nt, Homo sapiens
cacuaccucuacaggcagcugg

SEQ ID NO: 230070 - RNA, 22 nt, Homo sapiens
cacuaggcuggagugcaguggc

SEQ ID NO: 230071 - RNA, 22 nt, Homo sapiens
cacugcaauuacuuuugcacca

SEQ ID NO: 230072 - RNA, 22 nt, Homo sapiens
cacugcacuccagucccgucuc

SEQ ID NO: 230073 - RNA, 22 nt, Homo sapiens
gugguaaaauggcauagagcua

SEQ ID NO: 230074 - RNA, 22 nt, Homo sapiens
gugguagaaaguaccaaacuag

SEQ ID NO: 230075 - RNA, 22 nt, Homo sapiens
gugguucuaaaccuuuuuuggu

SEQ ID NO: 230076 - RNA, 22 nt, Homo sapiens
gugguucuagagggacagaaug

SEQ ID NO: 230077 - RNA, 22 nt, Homo sapiens
gugguuguuggaguggcaauuu

SEQ ID NO: 230078 - RNA, 22 nt, Homo sapiens
gugguuuuuaaaguaccugugg

SEQ ID NO: 230079 - RNA, 22 nt, Homo sapiens
guguaaguccugaguuuggaua

SEQ ID NO: 230080 - RNA, 22 nt, Homo sapiens
guguaauacacacauauaugca

SEQ ID NO: 230081 - RNA, 22 nt, Homo sapiens
guguaugguaggaugacggagu

SEQ ID NO: 230082 - RNA, 22 nt, Homo sapiens
guguaugugagaaugcucaugu

SEQ ID NO: 230083 - RNA, 22 nt, Homo sapiens
gugucaaggaugccugucaggc

SEQ ID NO: 230084 - RNA, 21 nt, Homo sapiens
gugucacagacaugacagaug

SEQ ID NO: 230085 - RNA, 22 nt, Homo sapiens
gugucacuguugagaaguccac

SEQ ID NO: 230086 - RNA, 22 nt, Homo sapiens
gugucccagugugcauacaggu

SEQ ID NO: 230087 - RNA, 18 nt, Homo sapiens
gugucugguuaugggagu

SEQ ID NO: 230088 - RNA, 22 nt, Homo sapiens
gugugcaauuuugugggaggca

SEQ ID NO: 230089 - RNA, 19 nt, Homo sapiens
gugugcauaucacagagca

SEQ ID NO: 230090 - RNA, 22 nt, Homo sapiens
gugugcauaugucuuuauagua

SEQ ID NO: 230091 - RNA, 22 nt, Homo sapiens
gugugcaugucuuuuuaguagg

SEQ ID NO: 230092 - RNA, 22 nt, Homo sapiens
guguggcaggugggggcucaga

SEQ ID NO: 230093 - RNA, 23 nt, Homo sapiens
gugugguaggcuauaccaucuag

SEQ ID NO: 230094 - RNA, 22 nt, Homo sapiens
guguuaaucucaaguacucuca

SEQ ID NO: 230095 - RNA, 22 nt, Homo sapiens
guguucauggaauuugcaauug

SEQ ID NO: 230096 - RNA, 23 nt, Homo sapiens
guuaagugaauguguacucuauu

SEQ ID NO: 230097 - RNA, 22 nt, Homo sapiens
guuagaugaagaccaagggcaa

SEQ ID NO: 230098 - RNA, 22 nt, Homo sapiens
guuagcuaguagacaauuuucc

SEQ ID NO: 230099 - RNA, 22 nt, Homo sapiens
guuauggaguauaugugaacug

SEQ ID NO: 230100 - RNA, 22 nt, Homo sapiens
guuauguuaguuacaaggcuag

SEQ ID NO: 230101 - RNA, 22 nt, Homo sapiens
guucaaguuuucucuugugggu

SEQ ID NO: 230102 - RNA, 20 nt, Homo sapiens
guucacaggcuuccuuucag

SEQ ID NO: 230103 - RNA, 22 nt, Homo sapiens
guucacaguuaggacaacugcu

SEQ ID NO: 230104 - RNA, 22 nt, Homo sapiens
guucagguauucuggaacagag

SEQ ID NO: 230105 - RNA, 22 nt, Homo sapiens
guucaguuugcugaugcguuga

SEQ ID NO: 230106 - RNA, 22 nt, Homo sapiens
guucaguuuugaaauguuaauu

SEQ ID NO: 230107 - RNA, 17 nt, Homo sapiens
guucccaguggcauuug

SEQ ID NO: 230108 - RNA, 22 nt, Homo sapiens
guucucacuggacugugaaaau

SEQ ID NO: 230109 - RNA, 22 nt, Homo sapiens
guugaaauccuaacccccuagu

SEQ ID NO: 230110 - RNA, 22 nt, Homo sapiens
guugaacaauagauucauauca

SEQ ID NO: 230111 - RNA, 22 nt, Homo sapiens
guugagcaaacagcuuaacagu

SEQ ID NO: 230112 - RNA, 22 nt, Homo sapiens
guugagcaagcuuuggagccua

SEQ ID NO: 230113 - RNA, 22 nt, Homo sapiens
guugcaaaguaauugugguuuu

SEQ ID NO: 230114 - RNA, 22 nt, Homo sapiens
guugcacagucuuuccuggacu

SEQ ID NO: 230115 - RNA, 22 nt, Homo sapiens
guugcagcacacaggcugucag

SEQ ID NO: 230116 - RNA, 22 nt, Homo sapiens
guugcaugucugggaggccagc

SEQ ID NO: 230117 - RNA, 22 nt, Homo sapiens
guugccuaggcuggucuugaac

SEQ ID NO: 230118 - RNA, 22 nt, Homo sapiens
guugcucaggccggagugcagu

SEQ ID NO: 230119 - RNA, 22 nt, Homo sapiens
guugcugagucccaucaccaga

SEQ ID NO: 230120 - RNA, 22 nt, Homo sapiens
guuggaauguauugcuacuucu

SEQ ID NO: 230121 - RNA, 22 nt, Homo sapiens
guuggcaaguggcugagcuggg

SEQ ID NO: 230122 - RNA, 22 nt, Homo sapiens
guugggcccauagacugccagu

SEQ ID NO: 230123 - RNA, 22 nt, Homo sapiens
guuggguaauggggcgcaccgu

SEQ ID NO: 230124 - RNA, 22 nt, Homo sapiens
guuggucucguauaaaucaagg

SEQ ID NO: 230125 - RNA, 22 nt, Homo sapiens
guugguuuccuguaacuggaca

SEQ ID NO: 230126 - RNA, 22 nt, Homo sapiens
guuguauaggcauggggagaau

SEQ ID NO: 230127 - RNA, 22 nt, Homo sapiens
guuguggagucuucuguucugg

SEQ ID NO: 230128 - RNA, 22 nt, Homo sapiens
guuguggcuugugauuaagcac

SEQ ID NO: 230129 - RNA, 22 nt, Homo sapiens
guuuaacugguacuucaagucu

SEQ ID NO: 230130 - RNA, 22 nt, Homo sapiens
guuugcagaucaugaagaaccc

SEQ ID NO: 230131 - RNA, 22 nt, Homo sapiens
uaaaccacguuuacauuugaga

SEQ ID NO: 230132 - RNA, 22 nt, Homo sapiens
uaaacugcuugaaaugguguca

SEQ ID NO: 230133 - RNA, 22 nt, Homo sapiens
ucaguuaaugcugccugcugga

SEQ ID NO: 230134 - RNA, 22 nt, Homo sapiens
ucauaaaguuguuuuaauggga

SEQ ID NO: 230135 - RNA, 22 nt, Homo sapiens
ucauacaguaguccucacuugu

SEQ ID NO: 230136 - RNA, 22 nt, Homo sapiens
ucauacgucuccuugugccacc

SEQ ID NO: 230137 - RNA, 22 nt, Homo sapiens
ucauacuguccaauucuagugg

SEQ ID NO: 230138 - RNA, 22 nt, Homo sapiens
ucauacuguuaaaugguuuagu

SEQ ID NO: 230139 - RNA, 22 nt, Homo sapiens
ucauagaucaaguaauaagaca

SEQ ID NO: 230140 - RNA, 20 nt, Homo sapiens
ucauagcuuuuuccacuuua

SEQ ID NO: 230141 - RNA, 22 nt, Homo sapiens
ucauaguacuuuguuuugaaaa

SEQ ID NO: 230142 - RNA, 22 nt, Homo sapiens
ucauagucuaagguucuuuugc

SEQ ID NO: 230143 - RNA, 22 nt, Homo sapiens
ucauauugcgguucauugacuu

SEQ ID NO: 230144 - RNA, 21 nt, Homo sapiens
ucaucaagcuguagacaugau

SEQ ID NO: 230145 - RNA, 22 nt, Homo sapiens
ucaucagaaucccuuagggaug

SEQ ID NO: 230146 - RNA, 22 nt, Homo sapiens
ucaucaggcucauucaagcuga

SEQ ID NO: 230147 - RNA, 22 nt, Homo sapiens
ucauccauacaguuagcaaagg

SEQ ID NO: 230148 - RNA, 22 nt, Homo sapiens
ucaugagacacacuggaaagga

SEQ ID NO: 230149 - RNA, 19 nt, Homo sapiens
ucauggcuuuuucagcugu

SEQ ID NO: 230150 - RNA, 22 nt, Homo sapiens
ucauggguuuugguccaagcaa

SEQ ID NO: 230151 - RNA, 22 nt, Homo sapiens
ucauguaauuuugugucuauga

SEQ ID NO: 230152 - RNA, 22 nt, Homo sapiens
ucauguauuaucauuagugggu

SEQ ID NO: 230153 - RNA, 22 nt, Homo sapiens
ucauucauucauccagcuugag

SEQ ID NO: 230154 - RNA, 22 nt, Homo sapiens
ucauugcaaucucugccucccg

SEQ ID NO: 230155 - RNA, 21 nt, Homo sapiens
ucauugggugcagcccacccu

SEQ ID NO: 230156 - RNA, 22 nt, Homo sapiens
ucauugguagcucauggaaccg

SEQ ID NO: 230157 - RNA, 22 nt, Homo sapiens
ucauuguccaacuucuuucagu

SEQ ID NO: 230158 - RNA, 18 nt, Homo sapiens
gauguaguauggugugga

SEQ ID NO: 230159 - RNA, 22 nt, Homo sapiens
gauguguugggaagauuucaag

SEQ ID NO: 230160 - RNA, 22 nt, Homo sapiens
gauuagcacuucaguuacagua

SEQ ID NO: 230161 - RNA, 22 nt, Homo sapiens
gauuccacuuucaaauucaaau

SEQ ID NO: 230162 - RNA, 22 nt, Homo sapiens
gauugguugaaaguagaauacu

SEQ ID NO: 230163 - RNA, 22 nt, Homo sapiens
gauuugagagaggguguuuaua

SEQ ID NO: 230164 - RNA, 22 nt, Homo sapiens
gauuuguauuaaaagugugacg

SEQ ID NO: 230165 - RNA, 22 nt, Homo sapiens
gauuuugguuagggaaggauac

SEQ ID NO: 230166 - RNA, 21 nt, Homo sapiens
gcaaaggaauugccuaagcuu

SEQ ID NO: 230167 - RNA, 22 nt, Homo sapiens
gcaaaguaauuguuguuuuugc

SEQ ID NO: 230168 - RNA, 22 nt, Homo sapiens
gcaaaguguuuuuaggaagucu

SEQ ID NO: 230169 - RNA, 23 nt, Homo sapiens
gcaaauaucguagagugucccug

SEQ ID NO: 230170 - RNA, 22 nt, Homo sapiens
gcaaaugcuaugccauuuuaua

SEQ ID NO: 230171 - RNA, 20 nt, Homo sapiens
gcaacauggccagagugaau

SEQ ID NO: 230172 - RNA, 22 nt, Homo sapiens
gcaagacaugucuaagguuuaa

SEQ ID NO: 230173 - RNA, 22 nt, Homo sapiens
gcaaggacucccugggucauuc

SEQ ID NO: 230174 - RNA, 21 nt, Homo sapiens
gcaaguacuaucaucauuauc

SEQ ID NO: 230175 - RNA, 22 nt, Homo sapiens
gcaaugcugucugugcacagau

SEQ ID NO: 230176 - RNA, 22 nt, Homo sapiens
gcaauggaaucccuugaucaau

SEQ ID NO: 230177 - RNA, 22 nt, Homo sapiens
gcaauguuacugaauguguuuu

SEQ ID NO: 230178 - RNA, 22 nt, Homo sapiens
gcacaggguuacauucuaaggu

SEQ ID NO: 230179 - RNA, 22 nt, Homo sapiens
gcacaguggcucccgucuauaa

SEQ ID NO: 230180 - RNA, 22 nt, Homo sapiens
gcacauggccccaucgugccga

SEQ ID NO: 230181 - RNA, 22 nt, Homo sapiens
gcaccacugcacucucagcuug

SEQ ID NO: 230182 - RNA, 17 nt, Homo sapiens
gcacuggcguaucccac

SEQ ID NO: 230183 - RNA, 22 nt, Homo sapiens
gcagagaaacaggucuaaggag

SEQ ID NO: 230184 - RNA, 22 nt, Homo sapiens
gcagaguauagagggcugggcc

SEQ ID NO: 230185 - RNA, 20 nt, Homo sapiens
gcagcaccauauuucuaaga

SEQ ID NO: 230186 - RNA, 22 nt, Homo sapiens
gcagcaguggcaguuaauauuu

SEQ ID NO: 230187 - RNA, 22 nt, Homo sapiens
gcaggaauuucucugcagaccc

SEQ ID NO: 230188 - RNA, 22 nt, Homo sapiens
gcaggauuggagccucucugaa

SEQ ID NO: 230189 - RNA, 22 nt, Homo sapiens
gcaggcaugacauuucacucuu

SEQ ID NO: 230190 - RNA, 22 nt, Homo sapiens
gcagguauuagagagccugaaa

SEQ ID NO: 230191 - RNA, 22 nt, Homo sapiens
gcaguagugugaucuuggcuca

SEQ ID NO: 230192 - RNA, 22 nt, Homo sapiens
gcaguauuguugaaauguccau

SEQ ID NO: 230193 - RNA, 22 nt, Homo sapiens
gcagucacagggagauggugac

SEQ ID NO: 230194 - RNA, 22 nt, Homo sapiens
gcagucaucugaaggcuuaacu

SEQ ID NO: 230195 - RNA, 22 nt, Homo sapiens
gcagugugaucacagcuuacug

SEQ ID NO: 230196 - RNA, 22 nt, Homo sapiens
gcagugugauguuuuaaucuau

SEQ ID NO: 230197 - RNA, 20 nt, Homo sapiens
gcaguguucacuguauuccu

SEQ ID NO: 230198 - RNA, 22 nt, Homo sapiens
gcaguguugugauccaggucuu

SEQ ID NO: 230199 - RNA, 22 nt, Homo sapiens
gcaguucuguaguugaaauuua

SEQ ID NO: 230200 - RNA, 22 nt, Homo sapiens
gcauaaagcuaauaagacgaag

SEQ ID NO: 230201 - RNA, 20 nt, Homo sapiens
gcauaugucuuuauggcagc

SEQ ID NO: 230202 - RNA, 22 nt, Homo sapiens
gcauauguuuggguguguauau

SEQ ID NO: 230203 - RNA, 22 nt, Homo sapiens
gcauauuuuaaaguguaaccug

SEQ ID NO: 230204 - RNA, 19 nt, Homo sapiens
gcaucauuaguugcuuuuc

SEQ ID NO: 230205 - RNA, 22 nt, Homo sapiens
gcaugaugaauaauaucacaag

SEQ ID NO: 230206 - RNA, 22 nt, Homo sapiens
gcauggagaaggggacugauuc

SEQ ID NO: 230207 - RNA, 22 nt, Homo sapiens
gcauggaguggaaauucuuggg

SEQ ID NO: 230208 - RNA, 22 nt, Homo sapiens
gcaugguaguaaccuacauuug

SEQ ID NO: 230209 - RNA, 22 nt, Homo sapiens
gcauguaguagauguugaauaa

SEQ ID NO: 230210 - RNA, 22 nt, Homo sapiens
gccaagaucugaauaauuaaga

SEQ ID NO: 230211 - RNA, 20 nt, Homo sapiens
gccacaguuaagcuucugcc

SEQ ID NO: 230212 - RNA, 22 nt, Homo sapiens
gccagugugaugugaucauggc

SEQ ID NO: 230213 - RNA, 21 nt, Homo sapiens
gccaguguggcaauuuuucaa

SEQ ID NO: 230214 - RNA, 22 nt, Homo sapiens
gccauagucauagauggcaggg

SEQ ID NO: 230215 - RNA, 22 nt, Homo sapiens
gccauugcacuccagccuaggc

SEQ ID NO: 230216 - RNA, 22 nt, Homo sapiens
gccauugcacuccagccucggg

SEQ ID NO: 230217 - RNA, 22 nt, Homo sapiens
gccauugcacuccagccugagc

SEQ ID NO: 230218 - RNA, 22 nt, Homo sapiens
gccauugcacucuagccuaggu

SEQ ID NO: 230219 - RNA, 22 nt, Homo sapiens
gccauugcacucuagccugagc

SEQ ID NO: 230220 - RNA, 22 nt, Homo sapiens
gccccgggugaugcagccguca

SEQ ID NO: 230221 - RNA, 22 nt, Homo sapiens
gcccugauacauucuucugccu

SEQ ID NO: 230222 - RNA, 22 nt, Homo sapiens
gcccuguugcccugaauacaua

SEQ ID NO: 230223 - RNA, 22 nt, Homo sapiens
gcgcagugggcugugccaucca

SEQ ID NO: 230224 - RNA, 22 nt, Homo sapiens
gcguugcacuccagccugggua

SEQ ID NO: 230225 - RNA, 22 nt, Homo sapiens
gcuaaaugcaugaggcgaugug

SEQ ID NO: 230226 - RNA, 22 nt, Homo sapiens
gcuacugucuaucugugcuucu

SEQ ID NO: 230227 - RNA, 22 nt, Homo sapiens
gcuaggagauccacugcucucu

SEQ ID NO: 230228 - RNA, 22 nt, Homo sapiens
gcuaugucuguugcucuugggc

SEQ ID NO: 230229 - RNA, 22 nt, Homo sapiens
aggagguagggugugaaacagc

SEQ ID NO: 230230 - RNA, 22 nt, Homo sapiens
aggauaguaaugauagagaggc

SEQ ID NO: 230231 - RNA, 22 nt, Homo sapiens
aggaucauugacuauuauaagg

SEQ ID NO: 230232 - RNA, 21 nt, Homo sapiens
aggcaaaugaagcagccgcuc

SEQ ID NO: 230233 - RNA, 22 nt, Homo sapiens
aggcaacaugguaaaacccugu

SEQ ID NO: 230234 - RNA, 22 nt, Homo sapiens
aggcaagagugacuacgugaaa

SEQ ID NO: 230235 - RNA, 22 nt, Homo sapiens
aggcacggugucucaugccugu

SEQ ID NO: 230236 - RNA, 22 nt, Homo sapiens
aggcagucugaguuuugaaagg

SEQ ID NO: 230237 - RNA, 22 nt, Homo sapiens
aggcaugaguucagaggguaug

SEQ ID NO: 230238 - RNA, 22 nt, Homo sapiens
aggcaugauggcuccagaucau

SEQ ID NO: 230239 - RNA, 22 nt, Homo sapiens
aggcauguugcuucgggcuuug

SEQ ID NO: 230240 - RNA, 23 nt, Homo sapiens
aggccaguuuuuccugcuugcug

SEQ ID NO: 230241 - RNA, 22 nt, Homo sapiens
aggcuuauuaagauucccuuau

SEQ ID NO: 230242 - RNA, 22 nt, Homo sapiens
aggcuuuuggagaacacugcac

SEQ ID NO: 230243 - RNA, 22 nt, Homo sapiens
agggaauguaaguuuuaugaga

SEQ ID NO: 230244 - RNA, 22 nt, Homo sapiens
agggcaagacuuguuaagaaca

SEQ ID NO: 230245 - RNA, 22 nt, Homo sapiens
agggccuuuguagauguacuca

SEQ ID NO: 230246 - RNA, 22 nt, Homo sapiens
agggcuuguuuaacuaucauua

SEQ ID NO: 230247 - RNA, 22 nt, Homo sapiens
agggguauuauguaaaucugac

SEQ ID NO: 230248 - RNA, 22 nt, Homo sapiens
agguaauuuucccagagggaaa

SEQ ID NO: 230249 - RNA, 22 nt, Homo sapiens
agguacuuucccaaccauacug

SEQ ID NO: 230250 - RNA, 20 nt, Homo sapiens
agguagauagaugauagaua

SEQ ID NO: 230251 - RNA, 22 nt, Homo sapiens
agguaguguuauuugcagcuga

SEQ ID NO: 230252 - RNA, 22 nt, Homo sapiens
agguauuuuuuauccuccagca

SEQ ID NO: 230253 - RNA, 22 nt, Homo sapiens
aggugacugguuuaucuggcag

SEQ ID NO: 230254 - RNA, 22 nt, Homo sapiens
aggugcugacaggauagguuuc

SEQ ID NO: 230255 - RNA, 22 nt, Homo sapiens
aggugcuugaaucuaugagcuc

SEQ ID NO: 230256 - RNA, 22 nt, Homo sapiens
gcucaugggcagugugauuguu

SEQ ID NO: 230257 - RNA, 22 nt, Homo sapiens
gcucugguuacaaaggcaaauu

SEQ ID NO: 230258 - RNA, 22 nt, Homo sapiens
gcugagaucucuugccugaacu

SEQ ID NO: 230259 - RNA, 22 nt, Homo sapiens
gcugauggugcaguucuagccu

SEQ ID NO: 230260 - RNA, 22 nt, Homo sapiens
gcugauguugaccuugaucacc

SEQ ID NO: 230261 - RNA, 22 nt, Homo sapiens
gcugauguuggccucugggcuu

SEQ ID NO: 230262 - RNA, 17 nt, Homo sapiens
gcugauguuugcauuuu

SEQ ID NO: 230263 - RNA, 17 nt, Homo sapiens
gcugcauucauguagaa

SEQ ID NO: 230264 - RNA, 22 nt, Homo sapiens
gcugcuguggcagauuggauuc

SEQ ID NO: 230265 - RNA, 22 nt, Homo sapiens
gcugcuguuauucaucagaacu

SEQ ID NO: 230266 - RNA, 22 nt, Homo sapiens
gcugcuguuuaguuucuccugg

SEQ ID NO: 230267 - RNA, 22 nt, Homo sapiens
gcuggauguuucaauacaaaua

SEQ ID NO: 230268 - RNA, 22 nt, Homo sapiens
gcuggcaagaugcugaugcaac

SEQ ID NO: 230269 - RNA, 22 nt, Homo sapiens
gcuggcuuucuccugaucucag

SEQ ID NO: 230270 - RNA, 22 nt, Homo sapiens
gcuggucugccguaguaggugc

SEQ ID NO: 230271 - RNA, 22 nt, Homo sapiens
gcugguguagagugcagaaagg

SEQ ID NO: 230272 - RNA, 22 nt, Homo sapiens
gcugucaugagcaacacaugaa

SEQ ID NO: 230273 - RNA, 22 nt, Homo sapiens
gcugugguuuaguagaaagaag

SEQ ID NO: 230274 - RNA, 22 nt, Homo sapiens
gcuguguugugcccagcaucau

SEQ ID NO: 230275 - RNA, 22 nt, Homo sapiens
gcuguugugaacuauacaucua

SEQ ID NO: 230276 - RNA, 22 nt, Homo sapiens
gcuguuugccgccaucgcagac

SEQ ID NO: 230277 - RNA, 22 nt, Homo sapiens
gcuuuggauaaaugucaguuua

SEQ ID NO: 230278 - RNA, 22 nt, Homo sapiens
gcuuuggcauguagauguaugg

SEQ ID NO: 230279 - RNA, 23 nt, Homo sapiens
ggaaacauccagucuuucaccau

SEQ ID NO: 230280 - RNA, 22 nt, Homo sapiens
ggaaagaucagcuaaauguaag

SEQ ID NO: 230281 - RNA, 22 nt, Homo sapiens
ggaaaucucugaggcucccuuc

SEQ ID NO: 230282 - RNA, 19 nt, Homo sapiens
ggaaaugucuauuaagauc

SEQ ID NO: 230283 - RNA, 22 nt, Homo sapiens
ggaagaauaaugggccuuagag

SEQ ID NO: 230284 - RNA, 22 nt, Homo sapiens
ggaagacaguguggugauuccu

SEQ ID NO: 230285 - RNA, 22 nt, Homo sapiens
caugcauagccauucauucguu

SEQ ID NO: 230286 - RNA, 19 nt, Homo sapiens
caugccacugcacuugagu

SEQ ID NO: 230287 - RNA, 22 nt, Homo sapiens
cauggcacauauauaucuaggu

SEQ ID NO: 230288 - RNA, 22 nt, Homo sapiens
cauggcauuugcagaguugaaa

SEQ ID NO: 230289 - RNA, 22 nt, Homo sapiens
cauggcuacugcagauguaggg

SEQ ID NO: 230290 - RNA, 22 nt, Homo sapiens
cauggcuuuaagcaacaccaag

SEQ ID NO: 230291 - RNA, 22 nt, Homo sapiens
cauggcuuuauuuucagcuucu

SEQ ID NO: 230292 - RNA, 22 nt, Homo sapiens
caugggacugucuuggcuauac

SEQ ID NO: 230293 - RNA, 22 nt, Homo sapiens
caugguacugccacagaagagu

SEQ ID NO: 230294 - RNA, 22 nt, Homo sapiens
caugguguuaggcacugggaau

SEQ ID NO: 230295 - RNA, 22 nt, Homo sapiens
cauguaacaucccgcuguagga

SEQ ID NO: 230296 - RNA, 22 nt, Homo sapiens
cauguaguagaaggagccagac

SEQ ID NO: 230297 - RNA, 21 nt, Homo sapiens
caugucacugcacucuagccu

SEQ ID NO: 230298 - RNA, 22 nt, Homo sapiens
caugucacuuccucucugaugg

SEQ ID NO: 230299 - RNA, 22 nt, Homo sapiens
caugucuuuuauucugugugau

SEQ ID NO: 230300 - RNA, 22 nt, Homo sapiens
cauuaagcuacuuagaaggugc

SEQ ID NO: 230301 - RNA, 22 nt, Homo sapiens
cauuacacuuguaagguuuuuc

SEQ ID NO: 230302 - RNA, 22 nt, Homo sapiens
cauugcaaugaggucuugcagu

SEQ ID NO: 230303 - RNA, 19 nt, Homo sapiens
cauugcacuccacccuggg

SEQ ID NO: 230304 - RNA, 22 nt, Homo sapiens
cauugcacuccagccugaccaa

SEQ ID NO: 230305 - RNA, 20 nt, Homo sapiens
cauugcacuccagccugcug

SEQ ID NO: 230306 - RNA, 22 nt, Homo sapiens
cauugcacuccagccuggcaac

SEQ ID NO: 230307 - RNA, 22 nt, Homo sapiens
cauugcacuccagccuuggcaa

SEQ ID NO: 230308 - RNA, 22 nt, Homo sapiens
cauugcacuccagccuugguga

SEQ ID NO: 230309 - RNA, 22 nt, Homo sapiens
cauugcauuuucuuuguaccuu

SEQ ID NO: 230310 - RNA, 22 nt, Homo sapiens
cauugcucuuacagagugagua

SEQ ID NO: 230311 - RNA, 22 nt, Homo sapiens
cauugguugaacagauuguguu

SEQ ID NO: 230312 - RNA, 22 nt, Homo sapiens
cauugucccucaaugucuauga

SEQ ID NO: 230313 - RNA, 22 nt, Homo sapiens
cauuugcacugagacucagcuu

SEQ ID NO: 230314 - RNA, 22 nt, Homo sapiens
cauuuuacuuuccagacgugga

SEQ ID NO: 230315 - RNA, 22 nt, Homo sapiens
ccaaggcacugauucuguacuc

SEQ ID NO: 230316 - RNA, 22 nt, Homo sapiens
ccaagugcuuaaaauuucauuu

SEQ ID NO: 230317 - RNA, 22 nt, Homo sapiens
ccaaguguuuucauuguuccau

SEQ ID NO: 230318 - RNA, 22 nt, Homo sapiens
ccacacugucuuggugggaaac

SEQ ID NO: 230319 - RNA, 22 nt, Homo sapiens
ccacaguagucuugggaugggc

SEQ ID NO: 230320 - RNA, 22 nt, Homo sapiens
ccacaguggauuaaaguuacug

SEQ ID NO: 230321 - RNA, 22 nt, Homo sapiens
ccagaauucucauuggaaggaa

SEQ ID NO: 230322 - RNA, 22 nt, Homo sapiens
ccagauguuuucauucagcaag

SEQ ID NO: 230323 - RNA, 22 nt, Homo sapiens
ccagcaccauuuauuaaauagg

SEQ ID NO: 230324 - RNA, 20 nt, Homo sapiens
ccagcaucauuagauucugg

SEQ ID NO: 230325 - RNA, 22 nt, Homo sapiens
ccaggguugcuuuagauucuga

SEQ ID NO: 230326 - RNA, 22 nt, Homo sapiens
ccagguuucuagaauaauuccu

SEQ ID NO: 230327 - RNA, 22 nt, Homo sapiens
ccaguauuuuauugaggguuuu

SEQ ID NO: 230328 - RNA, 22 nt, Homo sapiens
ccagucuuggugucuguagcac

SEQ ID NO: 230329 - RNA, 17 nt, Homo sapiens
ccagugaucccuuuugu

SEQ ID NO: 230330 - RNA, 22 nt, Homo sapiens
ccagugcugugcaguguaugag

SEQ ID NO: 230331 - RNA, 20 nt, Homo sapiens
ccaguguuauuuauguucua

SEQ ID NO: 230332 - RNA, 19 nt, Homo sapiens
ccaguguucugauugcacu

SEQ ID NO: 230333 - RNA, 22 nt, Homo sapiens
ccaguguucuggaaggcugagu

SEQ ID NO: 230334 - RNA, 22 nt, Homo sapiens
ccaguucaaugauauggaaacu

SEQ ID NO: 230335 - RNA, 22 nt, Homo sapiens
ccaguuuucaagauaaugguuu

SEQ ID NO: 230336 - RNA, 22 nt, Homo sapiens
ccaucacgugcaguggccccac

SEQ ID NO: 230337 - RNA, 22 nt, Homo sapiens
ccaucccuuucugagcaguucc

SEQ ID NO: 230338 - RNA, 22 nt, Homo sapiens
ccauugcacuccauccugggca

SEQ ID NO: 230339 - RNA, 22 nt, Homo sapiens
ccauugcacucuggccuaggug

SEQ ID NO: 230340 - RNA, 22 nt, Homo sapiens
cccagaguucuuaaauacugag

SEQ ID NO: 230341 - RNA, 22 nt, Homo sapiens
uugcacuugcugaggagugauu

SEQ ID NO: 230342 - RNA, 22 nt, Homo sapiens
uugcagagccccacacugggcu

SEQ ID NO: 230343 - RNA, 22 nt, Homo sapiens
uugcagagucaguuauuuugcc

SEQ ID NO: 230344 - RNA, 22 nt, Homo sapiens
uugcagcauucugguuccuggu

SEQ ID NO: 230345 - RNA, 22 nt, Homo sapiens
uugcagugguuucacuggcaaa

SEQ ID NO: 230346 - RNA, 19 nt, Homo sapiens
uugcauagguugaaccagc

SEQ ID NO: 230347 - RNA, 22 nt, Homo sapiens
uugcaugguuuuuaucugaaau

SEQ ID NO: 230348 - RNA, 22 nt, Homo sapiens
uugcauguacguacagagagag

SEQ ID NO: 230349 - RNA, 22 nt, Homo sapiens
uugcaugucauaacugauggaa

SEQ ID NO: 230350 - RNA, 22 nt, Homo sapiens
uugcauuagugugguacauuug

SEQ ID NO: 230351 - RNA, 22 nt, Homo sapiens
uugcauugacacaugaagcuca

SEQ ID NO: 230352 - RNA, 22 nt, Homo sapiens
uugccauggaguagaauugaag

SEQ ID NO: 230353 - RNA, 22 nt, Homo sapiens
uugccuaggcuggagugcagug

SEQ ID NO: 230354 - RNA, 22 nt, Homo sapiens
uugccuaggcuggaguguggug

SEQ ID NO: 230355 - RNA, 22 nt, Homo sapiens
uugccuaggcuggaguucagug

SEQ ID NO: 230356 - RNA, 22 nt, Homo sapiens
uugccuauucacucugaugaua

SEQ ID NO: 230357 - RNA, 21 nt, Homo sapiens
uugccugacacuggaagaaau

SEQ ID NO: 230358 - RNA, 22 nt, Homo sapiens
uugcgcuuuuccuauguugccc

SEQ ID NO: 230359 - RNA, 22 nt, Homo sapiens
uugcucaggcuagaguucagcu

SEQ ID NO: 230360 - RNA, 22 nt, Homo sapiens
uugcugguuuucauaugagcag

SEQ ID NO: 230361 - RNA, 22 nt, Homo sapiens
uuggaaacgucaccuuuuccuu

SEQ ID NO: 230362 - RNA, 22 nt, Homo sapiens
uuggaaagagguguuuaugacu

SEQ ID NO: 230363 - RNA, 22 nt, Homo sapiens
uuggaaaguuguuguaguuauu

SEQ ID NO: 230364 - RNA, 22 nt, Homo sapiens
uuggaagacaaugcugauucuc

SEQ ID NO: 230365 - RNA, 22 nt, Homo sapiens
uuggaagacauucugucugcua

SEQ ID NO: 230366 - RNA, 22 nt, Homo sapiens
uuggaagagaagggagauaaac

SEQ ID NO: 230367 - RNA, 22 nt, Homo sapiens
uuggaagcacauuguuuaauua

SEQ ID NO: 230368 - RNA, 22 nt, Homo sapiens
uuggaaguguguauguauagcu

SEQ ID NO: 230369 - RNA, 22 nt, Homo sapiens
uuggaaugcaacagaaggauaa

SEQ ID NO: 230370 - RNA, 22 nt, Homo sapiens
uuggaaugcacacugagccugc

SEQ ID NO: 230371 - RNA, 22 nt, Homo sapiens
uuggaaugugacugauaauauu

SEQ ID NO: 230372 - RNA, 22 nt, Homo sapiens
uuggaauuuauuuggaugggag

SEQ ID NO: 230373 - RNA, 19 nt, Homo sapiens
uuggaauuuuagaguuuga

SEQ ID NO: 230374 - RNA, 22 nt, Homo sapiens
uuggacugugagguuucguggg

SEQ ID NO: 230375 - RNA, 22 nt, Homo sapiens
uuggacuucuaacugacaugga

SEQ ID NO: 230376 - RNA, 22 nt, Homo sapiens
uuggagagucacuaguuagugc

SEQ ID NO: 230377 - RNA, 22 nt, Homo sapiens
uuggagagugauauucagaugc

SEQ ID NO: 230378 - RNA, 22 nt, Homo sapiens
uuggagcccuaacucucaguac

SEQ ID NO: 230379 - RNA, 22 nt, Homo sapiens
uuggauggugauaugguuugga

SEQ ID NO: 230380 - RNA, 22 nt, Homo sapiens
uuggauuuugguggcaacucau

SEQ ID NO: 230381 - RNA, 22 nt, Homo sapiens
uuggcaaagaggaaugccacuu

SEQ ID NO: 230382 - RNA, 22 nt, Homo sapiens
uuggcaaagugucuggcauuua

SEQ ID NO: 230383 - RNA, 22 nt, Homo sapiens
uuggcaagcuguuaauuauaaa

SEQ ID NO: 230384 - RNA, 22 nt, Homo sapiens
uuggcaauauuuacugaaguug

SEQ ID NO: 230385 - RNA, 21 nt, Homo sapiens
uuggcacucuucucuccuuau

SEQ ID NO: 230386 - RNA, 22 nt, Homo sapiens
uuggcacugggaaaaugaccac

SEQ ID NO: 230387 - RNA, 22 nt, Homo sapiens
uuggcacuugauaauauucugg

SEQ ID NO: 230388 - RNA, 22 nt, Homo sapiens
uuggcagcauuccagccaagca

SEQ ID NO: 230389 - RNA, 22 nt, Homo sapiens
uuggcaguaucuacuacagcua

SEQ ID NO: 230390 - RNA, 22 nt, Homo sapiens
uuggcauaguugcacuuacuag

SEQ ID NO: 230391 - RNA, 22 nt, Homo sapiens
uuggcauugaguuucaaaucau

SEQ ID NO: 230392 - RNA, 22 nt, Homo sapiens
uuggccagugucuuuuuuuccu

SEQ ID NO: 230393 - RNA, 22 nt, Homo sapiens
uuggccccucccaaauuucaug

SEQ ID NO: 230394 - RNA, 19 nt, Homo sapiens
uuggcccugguucucuucu

SEQ ID NO: 230395 - RNA, 21 nt, Homo sapiens
uuggccuggaggccugaaugu

SEQ ID NO: 230396 - RNA, 22 nt, Homo sapiens
uuggcuacagauuaugaauuuc

SEQ ID NO: 230397 - RNA, 21 nt, Homo sapiens
uuggcuacugcuucagaggga

SEQ ID NO: 230398 - RNA, 22 nt, Homo sapiens
uuggcuguguuccucaaggagu

SEQ ID NO: 230399 - RNA, 22 nt, Homo sapiens
uuggcuuaguugaccacagucu

SEQ ID NO: 230400 - RNA, 22 nt, Homo sapiens
uugggccacuuuaguuuccuua

SEQ ID NO: 230401 - RNA, 21 nt, Homo sapiens
uuggggaauggagagguuuuc

SEQ ID NO: 230402 - RNA, 22 nt, Homo sapiens
uuggggcacggccucuguugcc

SEQ ID NO: 230403 - RNA, 22 nt, Homo sapiens
uugguaagguggaugaugaaua

SEQ ID NO: 230404 - RNA, 22 nt, Homo sapiens
uugguaccccugguguacuaau

SEQ ID NO: 230405 - RNA, 22 nt, Homo sapiens
uugguacuacacuucuaaucuu

SEQ ID NO: 230406 - RNA, 22 nt, Homo sapiens
uuggucacugacauguuugaaa

SEQ ID NO: 230407 - RNA, 22 nt, Homo sapiens
uuggucaggcuagaguguggug

SEQ ID NO: 230408 - RNA, 22 nt, Homo sapiens
uuggucaucucccuccuuuuag

SEQ ID NO: 230409 - RNA, 21 nt, Homo sapiens
uugguccacaugucauaguua

SEQ ID NO: 230410 - RNA, 21 nt, Homo sapiens
uuggucuucucugugauucuu

SEQ ID NO: 230411 - RNA, 22 nt, Homo sapiens
uugguuaccuucagaaaugagu

SEQ ID NO: 230412 - RNA, 22 nt, Homo sapiens
uugguucaguuuaacgaguaau

SEQ ID NO: 230413 - RNA, 22 nt, Homo sapiens
uugguuccauuuuaccagcucu

SEQ ID NO: 230414 - RNA, 22 nt, Homo sapiens
uugguucucuuagccaucuuaa

SEQ ID NO: 230415 - RNA, 22 nt, Homo sapiens
uugguuuccuuccugcuuaacu

SEQ ID NO: 230416 - RNA, 22 nt, Homo sapiens
uuguaacaguuuauugacucga

SEQ ID NO: 230417 - RNA, 22 nt, Homo sapiens
uuguaacaugcuuucacuucag

SEQ ID NO: 230418 - RNA, 22 nt, Homo sapiens
uuguaagaaucuagcucuuuau

SEQ ID NO: 230419 - RNA, 22 nt, Homo sapiens
uuguaauguuaccaaauggugu

SEQ ID NO: 230420 - RNA, 22 nt, Homo sapiens
uuguagaucuucaguugcuaca

SEQ ID NO: 230421 - RNA, 22 nt, Homo sapiens
uuguaguagcauuauuuauaau

SEQ ID NO: 230422 - RNA, 22 nt, Homo sapiens
uuguauacucuauuuuagcagu

SEQ ID NO: 230423 - RNA, 22 nt, Homo sapiens
uuguauccaucuuucaggcaac

SEQ ID NO: 230424 - RNA, 22 nt, Homo sapiens
uuguauguuuguucuuucagau

SEQ ID NO: 230425 - RNA, 22 nt, Homo sapiens
uuguauugucuugaugaguuga

SEQ ID NO: 230426 - RNA, 22 nt, Homo sapiens
uugucacccuacauaacaggga

SEQ ID NO: 230427 - RNA, 22 nt, Homo sapiens
uugucacccucucuuggugucu

SEQ ID NO: 230428 - RNA, 22 nt, Homo sapiens
uugucacuauaaauaagcauuu

SEQ ID NO: 230429 - RNA, 22 nt, Homo sapiens
uugucacucuuccuaggguagg

SEQ ID NO: 230430 - RNA, 22 nt, Homo sapiens
uugucauuuucagaguguuacg

SEQ ID NO: 230431 - RNA, 21 nt, Homo sapiens
uuguccccacccaaaucucau

SEQ ID NO: 230432 - RNA, 22 nt, Homo sapiens
uuguccccuuccaaaucucaug

SEQ ID NO: 230433 - RNA, 22 nt, Homo sapiens
uuguccuccacauuugaucagu

SEQ ID NO: 230434 - RNA, 22 nt, Homo sapiens
uugugaauggugccacaauaaa

SEQ ID NO: 230435 - RNA, 22 nt, Homo sapiens
uugugaauggugccucaguaaa

SEQ ID NO: 230436 - RNA, 22 nt, Homo sapiens
uugugaauggugcugcaguaaa

SEQ ID NO: 230437 - RNA, 22 nt, Homo sapiens
uugugaguggugccgcaauaaa

SEQ ID NO: 230438 - RNA, 22 nt, Homo sapiens
gacauagcuagauaaccucaug

SEQ ID NO: 230439 - RNA, 20 nt, Homo sapiens
gacauggaggaggauuauua

SEQ ID NO: 230440 - RNA, 22 nt, Homo sapiens
gacauguuuucaagauuuauaa

SEQ ID NO: 230441 - RNA, 22 nt, Homo sapiens
gacccucuagauggaagcacug

SEQ ID NO: 230442 - RNA, 22 nt, Homo sapiens
gaccuaggaggauugcuugagc

SEQ ID NO: 230443 - RNA, 22 nt, Homo sapiens
gaccuggugguccacccgccuu

SEQ ID NO: 230444 - RNA, 19 nt, Homo sapiens
gacuccagaguugugugcu

SEQ ID NO: 230445 - RNA, 22 nt, Homo sapiens
gacucgagggcauaagagcuuu

SEQ ID NO: 230446 - RNA, 22 nt, Homo sapiens
gacuggauagauaaaguuaguu

SEQ ID NO: 230447 - RNA, 22 nt, Homo sapiens
gacuggccauugauacagaggu

SEQ ID NO: 230448 - RNA, 22 nt, Homo sapiens
gacuggcuguuuucuuuauuau

SEQ ID NO: 230449 - RNA, 16 nt, Homo sapiens
gacugggcugaggaau

SEQ ID NO: 230450 - RNA, 22 nt, Homo sapiens
gacuggguuaguuugaaagacu

SEQ ID NO: 230451 - RNA, 20 nt, Homo sapiens
gacuucagaagcuucagagu

SEQ ID NO: 230452 - RNA, 22 nt, Homo sapiens
gacuucaucauacuaugugugg

SEQ ID NO: 230453 - RNA, 22 nt, Homo sapiens
gacuuugguaaacucgguggca

SEQ ID NO: 230454 - RNA, 22 nt, Homo sapiens
gagaacaguguuguauuuuuuc

SEQ ID NO: 230455 - RNA, 22 nt, Homo sapiens
gagaacauuaauaguuaauuuu

SEQ ID NO: 230456 - RNA, 22 nt, Homo sapiens
gagaacauuuaagccacucagg

SEQ ID NO: 230457 - RNA, 22 nt, Homo sapiens
gagaacugacauuaucguguau

SEQ ID NO: 230458 - RNA, 20 nt, Homo sapiens
gagaacugagaugcguuuga

SEQ ID NO: 230459 - RNA, 22 nt, Homo sapiens
gagaaugaacagacugccucuu

SEQ ID NO: 230460 - RNA, 22 nt, Homo sapiens
gagaaugagauuaugguuacau

SEQ ID NO: 230461 - RNA, 22 nt, Homo sapiens
gagaaugaugauuuccaauuuc

SEQ ID NO: 230462 - RNA, 22 nt, Homo sapiens
gagacagugucagccauugaaa

SEQ ID NO: 230463 - RNA, 23 nt, Homo sapiens
gagaccagcuucagaaagcacga

SEQ ID NO: 230464 - RNA, 22 nt, Homo sapiens
gagacugagucuugcucugucg

SEQ ID NO: 230465 - RNA, 22 nt, Homo sapiens
gagacugagucuugcuuuguca

SEQ ID NO: 230466 - RNA, 22 nt, Homo sapiens
gagagaguacuugauauaauuu

SEQ ID NO: 230467 - RNA, 22 nt, Homo sapiens
gagagugcuuggcaucugcuga

SEQ ID NO: 230468 - RNA, 22 nt, Homo sapiens
gagauaaauaggucacaguucu

SEQ ID NO: 230469 - RNA, 22 nt, Homo sapiens
gagauaauagcuauaggaucuu

SEQ ID NO: 230470 - RNA, 22 nt, Homo sapiens
gagauacuugguuucuguuucu

SEQ ID NO: 230471 - RNA, 22 nt, Homo sapiens
gagaucuucguguggggagaca

SEQ ID NO: 230472 - RNA, 22 nt, Homo sapiens
gagaugaaguuaaggaucuuua

SEQ ID NO: 230473 - RNA, 22 nt, Homo sapiens
gagaugguacacauacgauucu

SEQ ID NO: 230474 - RNA, 22 nt, Homo sapiens
gagaugucuauuucagagaugu

SEQ ID NO: 230475 - RNA, 22 nt, Homo sapiens
gagaugugguucaaggguguuu

SEQ ID NO: 230476 - RNA, 20 nt, Homo sapiens
gagauguugaucagggcuau

SEQ ID NO: 230477 - RNA, 22 nt, Homo sapiens
gagauguuuuguuaucaaagga

SEQ ID NO: 230478 - RNA, 22 nt, Homo sapiens
gagauuauugucucccucacca

SEQ ID NO: 230479 - RNA, 22 nt, Homo sapiens
gagcacauguggagagucuggg

SEQ ID NO: 230480 - RNA, 22 nt, Homo sapiens
gagcaccagucccugucagugc

SEQ ID NO: 230481 - RNA, 20 nt, Homo sapiens
gagcaucacaggccucugcu

SEQ ID NO: 230482 - RNA, 22 nt, Homo sapiens
gagcuacauggauagucugcau

SEQ ID NO: 230483 - RNA, 21 nt, Homo sapiens
gagcuaggugaggcuguaaug

SEQ ID NO: 230484 - RNA, 22 nt, Homo sapiens
gagcuaguagauuuuaaauauu

SEQ ID NO: 230485 - RNA, 22 nt, Homo sapiens
gagcugaauugcugccauuugc

SEQ ID NO: 230486 - RNA, 22 nt, Homo sapiens
gagcugguccuuuaaggaugca

SEQ ID NO: 230487 - RNA, 22 nt, Homo sapiens
gagcuguuuuucacuagaccaa

SEQ ID NO: 230488 - RNA, 22 nt, Homo sapiens
gaggaaguaauuuuaggccugu

SEQ ID NO: 230489 - RNA, 22 nt, Homo sapiens
gaggaguauuuugucgaauguc

SEQ ID NO: 230490 - RNA, 21 nt, Homo sapiens
gaggauauuuuuauguuugga

SEQ ID NO: 230491 - RNA, 22 nt, Homo sapiens
gaggaucucuugagcccagaag

SEQ ID NO: 230492 - RNA, 22 nt, Homo sapiens
gaggcaagaguaguuaaguuag

SEQ ID NO: 230493 - RNA, 22 nt, Homo sapiens
gaggcaauaugagggaggcuuc

SEQ ID NO: 230494 - RNA, 22 nt, Homo sapiens
gaggcagucuguccauucucag

SEQ ID NO: 230495 - RNA, 22 nt, Homo sapiens
gagggcacugcuuuccuuucaa

SEQ ID NO: 230496 - RNA, 22 nt, Homo sapiens
gaggguguuguguugcuuaaua

SEQ ID NO: 230497 - RNA, 22 nt, Homo sapiens
gagguaaguggauuaugagguc

SEQ ID NO: 230498 - RNA, 22 nt, Homo sapiens
gagguaggggccuuaaagaugc

SEQ ID NO: 230499 - RNA, 22 nt, Homo sapiens
gaggucaugucgggccccagga

SEQ ID NO: 230500 - RNA, 22 nt, Homo sapiens
gaggucauguggcaggcagcca

SEQ ID NO: 230501 - RNA, 22 nt, Homo sapiens
gaggucuuacauuuuaauauuu

SEQ ID NO: 230502 - RNA, 22 nt, Homo sapiens
gaggugguagguucacagcagc

SEQ ID NO: 230503 - RNA, 22 nt, Homo sapiens
gagguguaaggacaacagagac

SEQ ID NO: 230504 - RNA, 22 nt, Homo sapiens
gaguaacagcauaaauuuguga

SEQ ID NO: 230505 - RNA, 22 nt, Homo sapiens
gaguaacauugacaacuucaug

SEQ ID NO: 230506 - RNA, 22 nt, Homo sapiens
gaguagugcugcaguaaacaca

SEQ ID NO: 230507 - RNA, 22 nt, Homo sapiens
gaguagugcugcaguaaacaua

SEQ ID NO: 230508 - RNA, 22 nt, Homo sapiens
gagugcaaagguccugaggugg

SEQ ID NO: 230509 - RNA, 21 nt, Homo sapiens
gagugcaaauaaagagagggc

SEQ ID NO: 230510 - RNA, 22 nt, Homo sapiens
gagugcaauggcaugaucuggg

SEQ ID NO: 230511 - RNA, 22 nt, Homo sapiens
gagugcaauggcgcgaucucgg

SEQ ID NO: 230512 - RNA, 22 nt, Homo sapiens
gagugcuguuagcccuggguuu

SEQ ID NO: 230513 - RNA, 22 nt, Homo sapiens
gaguuagguugucaaugucuua

SEQ ID NO: 230514 - RNA, 22 nt, Homo sapiens
gaguucaaaucucagcucuguu

SEQ ID NO: 230515 - RNA, 22 nt, Homo sapiens
gauaaaucuuggcuagucuaag

SEQ ID NO: 230516 - RNA, 22 nt, Homo sapiens
gauaugugauaagaguuaucuu

SEQ ID NO: 230517 - RNA, 22 nt, Homo sapiens
gauauguguaucuauguacaug

SEQ ID NO: 230518 - RNA, 22 nt, Homo sapiens
gauauguguuuuagucaggguu

SEQ ID NO: 230519 - RNA, 22 nt, Homo sapiens
gauauguucuuucacguuggug

SEQ ID NO: 230520 - RNA, 19 nt, Homo sapiens
gauauguugagcacccuuu

SEQ ID NO: 230521 - RNA, 22 nt, Homo sapiens
gaucaauuggcugaagacacgu

SEQ ID NO: 230522 - RNA, 17 nt, Homo sapiens
gaucacagucgucuccu

SEQ ID NO: 230523 - RNA, 22 nt, Homo sapiens
gaucacaguuccucacgggcau

SEQ ID NO: 230524 - RNA, 22 nt, Homo sapiens
gaucaguuucuggagauacgua

SEQ ID NO: 230525 - RNA, 22 nt, Homo sapiens
gaucucaguggauacugugaug

SEQ ID NO: 230526 - RNA, 22 nt, Homo sapiens
gaucugucuuuccuuauagucu

SEQ ID NO: 230527 - RNA, 22 nt, Homo sapiens
gaucugugugauuggaugcauu

SEQ ID NO: 230528 - RNA, 22 nt, Homo sapiens
gaucuguuuuccuauuguuugu

SEQ ID NO: 230529 - RNA, 22 nt, Homo sapiens
gaugaaacaucuuuggaaacug

SEQ ID NO: 230530 - RNA, 22 nt, Homo sapiens
gaugaacugucuuacuacucac

SEQ ID NO: 230531 - RNA, 22 nt, Homo sapiens
gaugagaucauaaguguggagc

SEQ ID NO: 230532 - RNA, 22 nt, Homo sapiens
gaugagaugagcauuugaauug

SEQ ID NO: 230533 - RNA, 22 nt, Homo sapiens
gaugagauguucucauggauug

SEQ ID NO: 230534 - RNA, 22 nt, Homo sapiens
gaugagguaggccugcuuugaa

SEQ ID NO: 230535 - RNA, 22 nt, Homo sapiens
uccacaauggcugaacuagauu

SEQ ID NO: 230536 - RNA, 22 nt, Homo sapiens
uccacagugguugaacuaguuu

SEQ ID NO: 230537 - RNA, 22 nt, Homo sapiens
uccaccgugggcugcggggcuc

SEQ ID NO: 230538 - RNA, 22 nt, Homo sapiens
uccacguggucuaucuguccuu

SEQ ID NO: 230539 - RNA, 22 nt, Homo sapiens
uccagaguggugaugcuggggc

SEQ ID NO: 230540 - RNA, 21 nt, Homo sapiens
uccagcuuugagaguuguggu

SEQ ID NO: 230541 - RNA, 22 nt, Homo sapiens
uccagguuuggcuuuauaacuu

SEQ ID NO: 230542 - RNA, 22 nt, Homo sapiens
uccaguggacagacauaccaug

SEQ ID NO: 230543 - RNA, 22 nt, Homo sapiens
uccagugugcaggcaaguuuga

SEQ ID NO: 230544 - RNA, 22 nt, Homo sapiens
uccaguguuccucagucacccc

SEQ ID NO: 230545 - RNA, 20 nt, Homo sapiens
uccaguuuuggagacauucu

SEQ ID NO: 230546 - RNA, 22 nt, Homo sapiens
uccauagacauuuuaagguagu

SEQ ID NO: 230547 - RNA, 22 nt, Homo sapiens
uccaugagaauaguuaggcucu

SEQ ID NO: 230548 - RNA, 22 nt, Homo sapiens
uccauggagacacauuuuauau

SEQ ID NO: 230549 - RNA, 22 nt, Homo sapiens
uccauguagaagacaggggaga

SEQ ID NO: 230550 - RNA, 22 nt, Homo sapiens
uccauugucuagauguaacaca

SEQ ID NO: 230551 - RNA, 22 nt, Homo sapiens
uccauuuguuguaggguauagu

SEQ ID NO: 230552 - RNA, 22 nt, Homo sapiens
ucccagugcuaugcaaaagccu

SEQ ID NO: 230553 - RNA, 22 nt, Homo sapiens
ucccaguggucuugaaacaggg

SEQ ID NO: 230554 - RNA, 22 nt, Homo sapiens
ucccaguguguagcuugucucu

SEQ ID NO: 230555 - RNA, 22 nt, Homo sapiens
ucccaguuuuucugaauaguca

SEQ ID NO: 230556 - RNA, 22 nt, Homo sapiens
uccccgaggcuggagugcagug

SEQ ID NO: 230557 - RNA, 22 nt, Homo sapiens
uccccugagaacuugcuagaaa

SEQ ID NO: 230558 - RNA, 22 nt, Homo sapiens
uccccugagaccccucagcacu

SEQ ID NO: 230559 - RNA, 22 nt, Homo sapiens
uccccugauaccaaccaccaug

SEQ ID NO: 230560 - RNA, 20 nt, Homo sapiens
ucccuaagagccuuuccuuc

SEQ ID NO: 230561 - RNA, 22 nt, Homo sapiens
ucccuacuggggcacugccuag

SEQ ID NO: 230562 - RNA, 22 nt, Homo sapiens
ucccuagacuccugccuuucag

SEQ ID NO: 230563 - RNA, 20 nt, Homo sapiens
ucccucaaacuuuuccacug

SEQ ID NO: 230564 - RNA, 22 nt, Homo sapiens
ucccugaagcugcagcaacaca

SEQ ID NO: 230565 - RNA, 22 nt, Homo sapiens
ucccugaaucucagguucugua

SEQ ID NO: 230566 - RNA, 22 nt, Homo sapiens
ucccugagugauugaaaauaaa

SEQ ID NO: 230567 - RNA, 22 nt, Homo sapiens
ucccuggacagccuugccuggg

SEQ ID NO: 230568 - RNA, 22 nt, Homo sapiens
ucccuggagcaagagaagaagg

SEQ ID NO: 230569 - RNA, 22 nt, Homo sapiens
ucccugguguuaguuuguucuu

SEQ ID NO: 230570 - RNA, 19 nt, Homo sapiens
ucccuguagaccacagugc

SEQ ID NO: 230571 - RNA, 16 nt, Homo sapiens
ucccugugacaugugc

SEQ ID NO: 230572 - RNA, 22 nt, Homo sapiens
ucccuguguccugggggcaccu

SEQ ID NO: 230573 - RNA, 22 nt, Homo sapiens
ucccuguuaggcacagauuuau

SEQ ID NO: 230574 - RNA, 17 nt, Homo sapiens
ucccuguuuuuucaguc

SEQ ID NO: 230575 - RNA, 22 nt, Homo sapiens
ucccuuaaugaugaacaaugag

SEQ ID NO: 230576 - RNA, 22 nt, Homo sapiens
ucccuuagccaaauccccagcc

SEQ ID NO: 230577 - RNA, 22 nt, Homo sapiens
ucccuuucuggaguuucccaag

SEQ ID NO: 230578 - RNA, 22 nt, Homo sapiens
uccugagacucacaggcucccc

SEQ ID NO: 230579 - RNA, 20 nt, Homo sapiens
uccugagauucccaguucuc

SEQ ID NO: 230580 - RNA, 22 nt, Homo sapiens
uccuucauuugucaacucuagu

SEQ ID NO: 230581 - RNA, 22 nt, Homo sapiens
uccuugaaacaggaagaauuca

SEQ ID NO: 230582 - RNA, 22 nt, Homo sapiens
uccuugagaggacagagccaua

SEQ ID NO: 230583 - RNA, 21 nt, Homo sapiens
uccuuggugaugcccugcagu

SEQ ID NO: 230584 - RNA, 23 nt, Homo sapiens
uccuugguuggcgcccuaugugu

SEQ ID NO: 230585 - RNA, 22 nt, Homo sapiens
uccuuuguuacaguuggcucug

SEQ ID NO: 230586 - RNA, 22 nt, Homo sapiens
ucgcagcacgagcaugcaaggu

SEQ ID NO: 230587 - RNA, 22 nt, Homo sapiens
ucgcagcucacuggagccucga

SEQ ID NO: 230588 - RNA, 19 nt, Homo sapiens
ucgcgccauucuccugccu

SEQ ID NO: 230589 - RNA, 22 nt, Homo sapiens
ucgcugggaagacugaaguguc

SEQ ID NO: 230590 - RNA, 22 nt, Homo sapiens
ucgugccacugcacuccagccu

SEQ ID NO: 230591 - RNA, 22 nt, Homo sapiens
ucgugcugugucaucuuguggc

SEQ ID NO: 230592 - RNA, 22 nt, Homo sapiens
ucguggccugugaguccucccc

SEQ ID NO: 230593 - RNA, 22 nt, Homo sapiens
ucuaagacuaagggcuagcuuc

SEQ ID NO: 230594 - RNA, 17 nt, Homo sapiens
ucuaauaauaugcauuu

SEQ ID NO: 230595 - RNA, 21 nt, Homo sapiens
ucuaccuacugcucacaggcu

SEQ ID NO: 230596 - RNA, 22 nt, Homo sapiens
ucuagccuaugaagcuugucca

SEQ ID NO: 230597 - RNA, 22 nt, Homo sapiens
ucuaguaaugagaggcaggaga

SEQ ID NO: 230598 - RNA, 22 nt, Homo sapiens
ucuaugguuuauuuccaagugu

SEQ ID NO: 230599 - RNA, 22 nt, Homo sapiens
ucucaauggguuguagacaaag

SEQ ID NO: 230600 - RNA, 22 nt, Homo sapiens
ucucacagaguugaacuuucuu

SEQ ID NO: 230601 - RNA, 22 nt, Homo sapiens
ucucacagccauuucucccucu

SEQ ID NO: 230602 - RNA, 19 nt, Homo sapiens
ucucacagcucuacuaugu

SEQ ID NO: 230603 - RNA, 22 nt, Homo sapiens
ucucagcacaaacaaaauugcu

SEQ ID NO: 230604 - RNA, 22 nt, Homo sapiens
ucucagcacagucagggcgccu

SEQ ID NO: 230605 - RNA, 22 nt, Homo sapiens
ucucagugacugcugggucccc

SEQ ID NO: 230606 - RNA, 22 nt, Homo sapiens
ucucaguuuucaagcugucgau

SEQ ID NO: 230607 - RNA, 20 nt, Homo sapiens
ucucauagagguagagaaua

SEQ ID NO: 230608 - RNA, 22 nt, Homo sapiens
ucucaugaagguggagaguagg

SEQ ID NO: 230609 - RNA, 20 nt, Homo sapiens
ucucauggagggaaagagca

SEQ ID NO: 230610 - RNA, 22 nt, Homo sapiens
ucucauggagguagagaguaaa

SEQ ID NO: 230611 - RNA, 22 nt, Homo sapiens
ucucauuggucugagucaccug

SEQ ID NO: 230612 - RNA, 22 nt, Homo sapiens
ucuccauuuguaaggguuucuc

SEQ ID NO: 230613 - RNA, 17 nt, Homo sapiens
ucucccaucccuuucuc

SEQ ID NO: 230614 - RNA, 21 nt, Homo sapiens
ucucucaaccaggaagugggc

SEQ ID NO: 230615 - RNA, 22 nt, Homo sapiens
ucucugagaaaaguuucuccca

SEQ ID NO: 230616 - RNA, 22 nt, Homo sapiens
ucucugagaccacuccaaacuc

SEQ ID NO: 230617 - RNA, 22 nt, Homo sapiens
ucucugauuaaacaagauagug

SEQ ID NO: 230618 - RNA, 22 nt, Homo sapiens
ucucugauuauugcauuucauu

SEQ ID NO: 230619 - RNA, 22 nt, Homo sapiens
ucucuggauaucuacuuauguu

SEQ ID NO: 230620 - RNA, 22 nt, Homo sapiens
ucucugguuaugucauuaagca

SEQ ID NO: 230621 - RNA, 22 nt, Homo sapiens
ucucugguuuguggaaucuuag

SEQ ID NO: 230622 - RNA, 22 nt, Homo sapiens
ucucuguuuagagccagcaauu

SEQ ID NO: 230623 - RNA, 22 nt, Homo sapiens
ucugacacagugauuaguaaau

SEQ ID NO: 230624 - RNA, 22 nt, Homo sapiens
ucugacacuucugcagaauuga

SEQ ID NO: 230625 - RNA, 22 nt, Homo sapiens
ucugacuagacaagcaguguac

SEQ ID NO: 230626 - RNA, 22 nt, Homo sapiens
ucugagguaggugcauggauac

SEQ ID NO: 230627 - RNA, 22 nt, Homo sapiens
ucugaguggcagaaugagcuga

SEQ ID NO: 230628 - RNA, 22 nt, Homo sapiens
ucugccuacugguuggaggaac

SEQ ID NO: 230629 - RNA, 22 nt, Homo sapiens
ucuggauuuuugaggcaauaua

SEQ ID NO: 230630 - RNA, 22 nt, Homo sapiens
ucuggcacucagaggccuugcu

SEQ ID NO: 230631 - RNA, 21 nt, Homo sapiens
ucuggcccccucaaaucucau

SEQ ID NO: 230632 - RNA, 22 nt, Homo sapiens
ucuggccccucccaaaucucau

SEQ ID NO: 230633 - RNA, 22 nt, Homo sapiens
uugugaucauugucaaauagug

SEQ ID NO: 230634 - RNA, 22 nt, Homo sapiens
uugugauggugcauacugagcu

SEQ ID NO: 230635 - RNA, 22 nt, Homo sapiens
uugugcauguauauuaguucac

SEQ ID NO: 230636 - RNA, 21 nt, Homo sapiens
uugugccaaacccuggaggga

SEQ ID NO: 230637 - RNA, 18 nt, Homo sapiens
uugugccugagaaggugg

SEQ ID NO: 230638 - RNA, 22 nt, Homo sapiens
uugugcuuguaacuacauucag

SEQ ID NO: 230639 - RNA, 22 nt, Homo sapiens
uuguggcuuaucucauuuagcg

SEQ ID NO: 230640 - RNA, 16 nt, Homo sapiens
uuguggcuuuugcaca

SEQ ID NO: 230641 - RNA, 22 nt, Homo sapiens
uugugggaggugauuagaucau

SEQ ID NO: 230642 - RNA, 22 nt, Homo sapiens
uugugguaggaugaagagauga

SEQ ID NO: 230643 - RNA, 22 nt, Homo sapiens
uugugguagugaaugagucuca

SEQ ID NO: 230644 - RNA, 19 nt, Homo sapiens
uuguguccccacaaaauuc

SEQ ID NO: 230645 - RNA, 23 nt, Homo sapiens
uuguucccuuccacucagucucc

SEQ ID NO: 230646 - RNA, 22 nt, Homo sapiens
uuuaaagcuccaagcaugucug

SEQ ID NO: 230647 - RNA, 23 nt, Homo sapiens
uuuaagcuucauguccuaacauc

SEQ ID NO: 230648 - RNA, 22 nt, Homo sapiens
uuuaaggcacuucaugguuuca

SEQ ID NO: 230649 - RNA, 22 nt, Homo sapiens
uuuaaggcaggucuggugguga

SEQ ID NO: 230650 - RNA, 22 nt, Homo sapiens
uuuaaggcaugccuguacaugc

SEQ ID NO: 230651 - RNA, 22 nt, Homo sapiens
uuuaauacugcaucuuuacucu

SEQ ID NO: 230652 - RNA, 22 nt, Homo sapiens
uuuaaugcgucucugaguuuug

SEQ ID NO: 230653 - RNA, 22 nt, Homo sapiens
uuuaaugcugcccagucauggg

SEQ ID NO: 230654 - RNA, 18 nt, Homo sapiens
uuuacaguagaaggacuu

SEQ ID NO: 230655 - RNA, 22 nt, Homo sapiens
uuuacugugggguuucuuagag

SEQ ID NO: 230656 - RNA, 19 nt, Homo sapiens
uuuagaucuuuuaugcagc

SEQ ID NO: 230657 - RNA, 22 nt, Homo sapiens
uuuagcaaagcaauuuacacca

SEQ ID NO: 230658 - RNA, 22 nt, Homo sapiens
uuuagcaauucauuuugugucu

SEQ ID NO: 230659 - RNA, 22 nt, Homo sapiens
uuuagcacugugauugacaaaa

SEQ ID NO: 230660 - RNA, 22 nt, Homo sapiens
uuuagcagcaaagagcuguguu

SEQ ID NO: 230661 - RNA, 22 nt, Homo sapiens
uuuagcgaaugcuugcuccugu

SEQ ID NO: 230662 - RNA, 22 nt, Homo sapiens
uuuagguaauauuaaguagcug

SEQ ID NO: 230663 - RNA, 22 nt, Homo sapiens
uuuauccagccucuagcaaggu

SEQ ID NO: 230664 - RNA, 22 nt, Homo sapiens
uuuaugagguagagugguuuau

SEQ ID NO: 230665 - RNA, 22 nt, Homo sapiens
uuuauguggagcacuugacaca

SEQ ID NO: 230666 - RNA, 22 nt, Homo sapiens
uuucaagugcugucuuagcugu

SEQ ID NO: 230667 - RNA, 22 nt, Homo sapiens
uuucaccguguuggccaggcug

SEQ ID NO: 230668 - RNA, 22 nt, Homo sapiens
uuucaggcagggagcuucagug

SEQ ID NO: 230669 - RNA, 15 nt, Homo sapiens
uuucaguacagauuc

SEQ ID NO: 230670 - RNA, 22 nt, Homo sapiens
uuucauagccuucuaaugaguu

SEQ ID NO: 230671 - RNA, 22 nt, Homo sapiens
uuucauagccuuugucgucuga

SEQ ID NO: 230672 - RNA, 22 nt, Homo sapiens
uuucauccggcuguguauuaug

SEQ ID NO: 230673 - RNA, 22 nt, Homo sapiens
uuucauggacgcaaugccuuuu

SEQ ID NO: 230674 - RNA, 22 nt, Homo sapiens
uuucauggaggauuugcuucuu

SEQ ID NO: 230675 - RNA, 22 nt, Homo sapiens
uuucauggcgaggcuucauggg

SEQ ID NO: 230676 - RNA, 22 nt, Homo sapiens
uuucauguuuuucugugaggca

SEQ ID NO: 230677 - RNA, 22 nt, Homo sapiens
uuuccaagaugcuuacuuucuc

SEQ ID NO: 230678 - RNA, 19 nt, Homo sapiens
uuuccaguaaucuuaugug

SEQ ID NO: 230679 - RNA, 22 nt, Homo sapiens
uuuccaguuggaaagccuguuu

SEQ ID NO: 230680 - RNA, 22 nt, Homo sapiens
uuuccauguuggugaaaugagg

SEQ ID NO: 230681 - RNA, 22 nt, Homo sapiens
uuucccugaaggcucugaaguc

SEQ ID NO: 230682 - RNA, 22 nt, Homo sapiens
uuucccuuacuuaaacuuacuc

SEQ ID NO: 230683 - RNA, 22 nt, Homo sapiens
uuucccuuuagcuuagugauuu

SEQ ID NO: 230684 - RNA, 22 nt, Homo sapiens
uuucugagaccaaaacuuguaa

SEQ ID NO: 230685 - RNA, 22 nt, Homo sapiens
uuucugaggccucaccagaagc

SEQ ID NO: 230686 - RNA, 22 nt, Homo sapiens
uuucugugguccucuugaaggu

SEQ ID NO: 230687 - RNA, 22 nt, Homo sapiens
uuucuuggagcucuuagggucg

SEQ ID NO: 230688 - RNA, 22 nt, Homo sapiens
uuucuugguuguauuuagacuu

SEQ ID NO: 230689 - RNA, 22 nt, Homo sapiens
uuugaauguaaugagcaggaag

SEQ ID NO: 230690 - RNA, 22 nt, Homo sapiens
uuugacaaugugugcuuguauu

SEQ ID NO: 230691 - RNA, 22 nt, Homo sapiens
uuugacuguggagucgaugcuu

SEQ ID NO: 230692 - RNA, 22 nt, Homo sapiens
uuugaggaaaggcauaaguagg

SEQ ID NO: 230693 - RNA, 22 nt, Homo sapiens
uuugagugugauaucgauugga

SEQ ID NO: 230694 - RNA, 22 nt, Homo sapiens
uuugaugcaucucuacuuuguu

SEQ ID NO: 230695 - RNA, 22 nt, Homo sapiens
uuugcacuggagauucaauggg

SEQ ID NO: 230696 - RNA, 22 nt, Homo sapiens
uuugcacuugaaaacacucuca

SEQ ID NO: 230697 - RNA, 22 nt, Homo sapiens
uuugcacuuuaauauaauguga

SEQ ID NO: 230698 - RNA, 22 nt, Homo sapiens
uuugcagagacuuguuaggaau

SEQ ID NO: 230699 - RNA, 22 nt, Homo sapiens
uuugccacugcaggcuguuuaa

SEQ ID NO: 230700 - RNA, 22 nt, Homo sapiens
uuugccuguagacacuuacccu

SEQ ID NO: 230701 - RNA, 22 nt, Homo sapiens
uuugcgacuucugaguuaaugu

SEQ ID NO: 230702 - RNA, 22 nt, Homo sapiens
uuugcuauagugaauagugcug

SEQ ID NO: 230703 - RNA, 22 nt, Homo sapiens
uuugcuuaaaguccuuguggga

SEQ ID NO: 230704 - RNA, 22 nt, Homo sapiens
uuuggaaugaaacagcagagcc

SEQ ID NO: 230705 - RNA, 22 nt, Homo sapiens
uuuggcaaagaucaacauguua

SEQ ID NO: 230706 - RNA, 22 nt, Homo sapiens
uuuggcaacguuggaucccuca

SEQ ID NO: 230707 - RNA, 22 nt, Homo sapiens
uuuggcauuagauaauugugua

SEQ ID NO: 230708 - RNA, 22 nt, Homo sapiens
uuuggcauuuuacuacucaaau

SEQ ID NO: 230709 - RNA, 22 nt, Homo sapiens
uuuggcuauguuguaucuuucc

SEQ ID NO: 230710 - RNA, 22 nt, Homo sapiens
uuuggcuuuugugauacguaau

SEQ ID NO: 230711 - RNA, 22 nt, Homo sapiens
uuugggacuguauuaaaugccu

SEQ ID NO: 230712 - RNA, 22 nt, Homo sapiens
uuuggucagcugcgggucagcu

SEQ ID NO: 230713 - RNA, 22 nt, Homo sapiens
uuugguccuccuacagggcagg

SEQ ID NO: 230714 - RNA, 22 nt, Homo sapiens
uuuggucuuuuauuuaaagcag

SEQ ID NO: 230715 - RNA, 22 nt, Homo sapiens
uuugguuauauauauacacucu

SEQ ID NO: 230716 - RNA, 22 nt, Homo sapiens
uuuguaauccuauuccaaagga

SEQ ID NO: 230717 - RNA, 22 nt, Homo sapiens
uuuguacacuguugguaggauu

SEQ ID NO: 230718 - RNA, 22 nt, Homo sapiens
uuuguacuaugguuuuucacua

SEQ ID NO: 230719 - RNA, 22 nt, Homo sapiens
uuuguacuucauugguucuacu

SEQ ID NO: 230720 - RNA, 22 nt, Homo sapiens
uuuguacuugaagaaucuuuau

SEQ ID NO: 230721 - RNA, 22 nt, Homo sapiens
uuuguacuugguguucuggaaa

SEQ ID NO: 230722 - RNA, 20 nt, Homo sapiens
uuuguaucucuggguacugg

SEQ ID NO: 230723 - RNA, 22 nt, Homo sapiens
uuugucauagcagcaggaaugg

SEQ ID NO: 230724 - RNA, 22 nt, Homo sapiens
uuuguccccgcccagaucucau

SEQ ID NO: 230725 - RNA, 22 nt, Homo sapiens
uuugucccucucaccaacgggg

SEQ ID NO: 230726 - RNA, 22 nt, Homo sapiens
uuugucccuuugcaguggcaca

SEQ ID NO: 230727 - RNA, 22 nt, Homo sapiens
uuugugaaugucauaagcucca

SEQ ID NO: 230728 - RNA, 22 nt, Homo sapiens
uuugugcuauguuauauauucu

SEQ ID NO: 230729 - RNA, 21 nt, Homo sapiens
uuuguguccccacccaaaucu

SEQ ID NO: 230730 - RNA, 22 nt, Homo sapiens
uuuguguccccacccaaaucuc

SEQ ID NO: 230731 - RNA, 22 nt, Homo sapiens
gaugauguuggaaacuuggugc

SEQ ID NO: 230732 - RNA, 22 nt, Homo sapiens
gaugauguuugauaaauaauaa

SEQ ID NO: 230733 - RNA, 19 nt, Homo sapiens
gaugcaaugcacugagguc

SEQ ID NO: 230734 - RNA, 22 nt, Homo sapiens
gaugccuauugcuaguccuaaa

SEQ ID NO: 230735 - RNA, 22 nt, Homo sapiens
gauggaguugucgccugggcug

SEQ ID NO: 230736 - RNA, 22 nt, Homo sapiens
gauggauuuuaagugaaugaaa

SEQ ID NO: 230737 - RNA, 22 nt, Homo sapiens
gauggcaucugagaguguuaga

SEQ ID NO: 230738 - RNA, 22 nt, Homo sapiens
gauggcuacugauuaaauauag

SEQ ID NO: 230739 - RNA, 22 nt, Homo sapiens
gauggcucugcaggugagggua

SEQ ID NO: 230740 - RNA, 22 nt, Homo sapiens
gauggguuuuuugaagacagca

SEQ ID NO: 230741 - RNA, 22 nt, Homo sapiens
gauguguuuaucacccaguccu

SEQ ID NO: 230742 - RNA, 22 nt, Homo sapiens
gauguguuuguuucuggaggag

SEQ ID NO: 230743 - RNA, 22 nt, Homo sapiens
gauguuguuuagccuuugaugu

SEQ ID NO: 230744 - RNA, 22 nt, Homo sapiens
gauuagaacagaagucagauua

SEQ ID NO: 230745 - RNA, 22 nt, Homo sapiens
gauuagagaaauacugcugcua

SEQ ID NO: 230746 - RNA, 20 nt, Homo sapiens
gauuagagagaggcugugca

SEQ ID NO: 230747 - RNA, 22 nt, Homo sapiens
gauuagucccauuuuacaggug

SEQ ID NO: 230748 - RNA, 22 nt, Homo sapiens
gauuccacuuucugucucuaug

SEQ ID NO: 230749 - RNA, 22 nt, Homo sapiens
gauuccauuuguggcuauuuac

SEQ ID NO: 230750 - RNA, 22 nt, Homo sapiens
gauuguguucauaggcauguua

SEQ ID NO: 230751 - RNA, 22 nt, Homo sapiens
gauuuguuggccugugagcuag

SEQ ID NO: 230752 - RNA, 22 nt, Homo sapiens
gcaaaaaguagugcugguuagg

SEQ ID NO: 230753 - RNA, 22 nt, Homo sapiens
gcaaaauugagaagggaauaua

SEQ ID NO: 230754 - RNA, 22 nt, Homo sapiens
gcaaagaaugcagauuugccuc

SEQ ID NO: 230755 - RNA, 22 nt, Homo sapiens
gcaaaucuuauguccucacauu

SEQ ID NO: 230756 - RNA, 22 nt, Homo sapiens
gcaagaauggaacaggagagcc

SEQ ID NO: 230757 - RNA, 22 nt, Homo sapiens
gcaaggaugagugcccaugaga

SEQ ID NO: 230758 - RNA, 22 nt, Homo sapiens
gcacaguaggugguaggacuuu

SEQ ID NO: 230759 - RNA, 22 nt, Homo sapiens
gcacagucaacacuuauucacc

SEQ ID NO: 230760 - RNA, 22 nt, Homo sapiens
gcacaguuaaagggucauguga

SEQ ID NO: 230761 - RNA, 22 nt, Homo sapiens
gcaccccuuaccgggcuggguu

SEQ ID NO: 230762 - RNA, 22 nt, Homo sapiens
gcacugggccacauuuauuuuc

SEQ ID NO: 230763 - RNA, 22 nt, Homo sapiens
gcagaauugacucuguuuuuuc

SEQ ID NO: 230764 - RNA, 22 nt, Homo sapiens
gcagaucucuucauuucucuua

SEQ ID NO: 230765 - RNA, 22 nt, Homo sapiens
gcagcauuaccaagacauggca

SEQ ID NO: 230766 - RNA, 22 nt, Homo sapiens
gcaggaaucuugagaaggauuc

SEQ ID NO: 230767 - RNA, 22 nt, Homo sapiens
gcagguaguuucugacuuuuac

SEQ ID NO: 230768 - RNA, 22 nt, Homo sapiens
gcagguguuaugcaaacaacug

SEQ ID NO: 230769 - RNA, 22 nt, Homo sapiens
gcaguacacuguugguaggaau

SEQ ID NO: 230770 - RNA, 19 nt, Homo sapiens
gcaguauugaaggccaguc

SEQ ID NO: 230771 - RNA, 22 nt, Homo sapiens
gcagugacaugugccaguuuau

SEQ ID NO: 230772 - RNA, 22 nt, Homo sapiens
gcagugcaguggcgcgaucucg

SEQ ID NO: 230773 - RNA, 22 nt, Homo sapiens
gcagugcaugacgguauauaua

SEQ ID NO: 230774 - RNA, 22 nt, Homo sapiens
gcagugcuggagcccccgugug

SEQ ID NO: 230775 - RNA, 22 nt, Homo sapiens
gcaguguggguagagggcaaga

SEQ ID NO: 230776 - RNA, 22 nt, Homo sapiens
gcaguguucaaaucaugcccau

SEQ ID NO: 230777 - RNA, 20 nt, Homo sapiens
gcaguguucugaccugaauc

SEQ ID NO: 230778 - RNA, 20 nt, Homo sapiens
gcauaugucuuuauagcaga

SEQ ID NO: 230779 - RNA, 17 nt, Homo sapiens
gcauauguugaaccagc

SEQ ID NO: 230780 - RNA, 22 nt, Homo sapiens
gcaugacaaugauugcucuuca

SEQ ID NO: 230781 - RNA, 20 nt, Homo sapiens
gcaugagucuuuauaguaga

SEQ ID NO: 230782 - RNA, 22 nt, Homo sapiens
gcaugauuuuauaucuauguaa

SEQ ID NO: 230783 - RNA, 22 nt, Homo sapiens
gcaugcacaugugaaaaaauga

SEQ ID NO: 230784 - RNA, 22 nt, Homo sapiens
gcaugcacuguauuuaaguauc

SEQ ID NO: 230785 - RNA, 22 nt, Homo sapiens
gcaugguacuggaugguaguau

SEQ ID NO: 230786 - RNA, 22 nt, Homo sapiens
gcauugcacuuggcauagacug

SEQ ID NO: 230787 - RNA, 22 nt, Homo sapiens
gccaagauuuaauucaucaguu

SEQ ID NO: 230788 - RNA, 22 nt, Homo sapiens
gccagauuguccaguuuuuuau

SEQ ID NO: 230789 - RNA, 22 nt, Homo sapiens
gccauggaggauuuauagaggc

SEQ ID NO: 230790 - RNA, 22 nt, Homo sapiens
gccauggugucuuauuuuugug

SEQ ID NO: 230791 - RNA, 22 nt, Homo sapiens
gccauugcacuccagccuagcg

SEQ ID NO: 230792 - RNA, 22 nt, Homo sapiens
gcccaguagcaguacaucccuu

SEQ ID NO: 230793 - RNA, 22 nt, Homo sapiens
gccccaguacaggcuccuuaga

SEQ ID NO: 230794 - RNA, 22 nt, Homo sapiens
gccccugagacuugccucgggc

SEQ ID NO: 230795 - RNA, 22 nt, Homo sapiens
gcccgugagacuggaagcaaga

SEQ ID NO: 230796 - RNA, 22 nt, Homo sapiens
gccuagagaaguaaauauuauc

SEQ ID NO: 230797 - RNA, 22 nt, Homo sapiens
gccuguagaagaguagaugacc

SEQ ID NO: 230798 - RNA, 22 nt, Homo sapiens
gcgugguguuagaaugagaagu

SEQ ID NO: 230799 - RNA, 22 nt, Homo sapiens
gcuaaggcaggagcauugcuug

SEQ ID NO: 230800 - RNA, 22 nt, Homo sapiens
gcuaaggcagggcaaucauuug

SEQ ID NO: 230801 - RNA, 22 nt, Homo sapiens
gcuagcauucaaaugugcagcc

SEQ ID NO: 230802 - RNA, 23 nt, Homo sapiens
gcuaggagagaugaaacacaggu

SEQ ID NO: 230803 - RNA, 22 nt, Homo sapiens
gcucguccccuccugacucugc

SEQ ID NO: 230804 - RNA, 22 nt, Homo sapiens
gcugaaauguuuaauuugggag

SEQ ID NO: 230805 - RNA, 22 nt, Homo sapiens
gcugaguaguauuucauuguau

SEQ ID NO: 230806 - RNA, 22 nt, Homo sapiens
gcugauguuuucagguaauucu

SEQ ID NO: 230807 - RNA, 22 nt, Homo sapiens
gcuggaauuaacauagaugugc

SEQ ID NO: 230808 - RNA, 22 nt, Homo sapiens
gcuggguugccagguuacuuaa

SEQ ID NO: 230809 - RNA, 22 nt, Homo sapiens
gcuguauugacuuuguaucaua

SEQ ID NO: 230810 - RNA, 22 nt, Homo sapiens
gcugucuggagucuguucaaug

SEQ ID NO: 230811 - RNA, 18 nt, Homo sapiens
gcuguugucagagcacau

SEQ ID NO: 230812 - RNA, 22 nt, Homo sapiens
gcuucauggaggcugggcgcag

SEQ ID NO: 230813 - RNA, 19 nt, Homo sapiens
gcuucuugaggacgaugac

SEQ ID NO: 230814 - RNA, 22 nt, Homo sapiens
gcuuggugugcaagugguacua

SEQ ID NO: 230815 - RNA, 22 nt, Homo sapiens
gcuuguguauuaaaccuugcag

SEQ ID NO: 230816 - RNA, 22 nt, Homo sapiens
gcuuguguucaaggaacaccua

SEQ ID NO: 230817 - RNA, 22 nt, Homo sapiens
gcuuguguuugcuccccagaau

SEQ ID NO: 230818 - RNA, 22 nt, Homo sapiens
gcuuugguucaaccaggcaauu

SEQ ID NO: 230819 - RNA, 22 nt, Homo sapiens
gcuuuguugauggugagucugu

SEQ ID NO: 230820 - RNA, 21 nt, Homo sapiens
gcuuuuucggaagucuuuggc

SEQ ID NO: 230821 - RNA, 22 nt, Homo sapiens
ggaaaguaacccauucucuuac

SEQ ID NO: 230822 - RNA, 22 nt, Homo sapiens
ggaaaguccuucuguaggcucc

SEQ ID NO: 230823 - RNA, 22 nt, Homo sapiens
ggaaaucaucauucucgguaua

SEQ ID NO: 230824 - RNA, 22 nt, Homo sapiens
ggaaauguuggugucaugaguu

SEQ ID NO: 230825 - RNA, 22 nt, Homo sapiens
ggaaauguuuagcauccacuuu

SEQ ID NO: 230826 - RNA, 17 nt, Homo sapiens
ggaagccuuugguuuaa

SEQ ID NO: 230827 - RNA, 22 nt, Homo sapiens
ggaagguaauugucagcucaua

SEQ ID NO: 230828 - RNA, 22 nt, Homo sapiens
ggaaguuaauacagauagagua

SEQ ID NO: 230829 - RNA, 20 nt, Homo sapiens
ucuggccccucuaaaucuca

SEQ ID NO: 230830 - RNA, 22 nt, Homo sapiens
ucuggccuagaacaauuaauua

SEQ ID NO: 230831 - RNA, 22 nt, Homo sapiens
ucuggcuccaaagucuauuuuu

SEQ ID NO: 230832 - RNA, 18 nt, Homo sapiens
ucuggcuucuuuguucca

SEQ ID NO: 230833 - RNA, 22 nt, Homo sapiens
ucuggcuugugaacugucuucu

SEQ ID NO: 230834 - RNA, 22 nt, Homo sapiens
ucuggcuuuagcaugugggaag

SEQ ID NO: 230835 - RNA, 22 nt, Homo sapiens
ucuggcuuugugaguugccaga

SEQ ID NO: 230836 - RNA, 22 nt, Homo sapiens
ucugggguuagucaaagguaug

SEQ ID NO: 230837 - RNA, 22 nt, Homo sapiens
ucuguacuccuugaguagugcu

SEQ ID NO: 230838 - RNA, 22 nt, Homo sapiens
ucugucacugaaucccugucac

SEQ ID NO: 230839 - RNA, 22 nt, Homo sapiens
ucugucuuugucaggaccagag

SEQ ID NO: 230840 - RNA, 22 nt, Homo sapiens
ucugugcauggcagaggaauga

SEQ ID NO: 230841 - RNA, 22 nt, Homo sapiens
ucugugcauuguaacaacuaaa

SEQ ID NO: 230842 - RNA, 22 nt, Homo sapiens
ucugugcugagaguugaaaguu

SEQ ID NO: 230843 - RNA, 22 nt, Homo sapiens
ucuguggucagcauccgccacu

SEQ ID NO: 230844 - RNA, 22 nt, Homo sapiens
ucuguuguuaucauaauauuga

SEQ ID NO: 230845 - RNA, 22 nt, Homo sapiens
ucuuaguuuagauuagcaauuc

SEQ ID NO: 230846 - RNA, 22 nt, Homo sapiens
ucuugcaauuuccuuaguggug

SEQ ID NO: 230847 - RNA, 22 nt, Homo sapiens
ucuugcauuuuuaaauagugcu

SEQ ID NO: 230848 - RNA, 22 nt, Homo sapiens
ucuuggcaaagaauuuuuggcu

SEQ ID NO: 230849 - RNA, 22 nt, Homo sapiens
ucuuggcauggcugaagauucc

SEQ ID NO: 230850 - RNA, 22 nt, Homo sapiens
ucuugguaaugucacauuuccu

SEQ ID NO: 230851 - RNA, 22 nt, Homo sapiens
ucuugguuaggggaaauaggca

SEQ ID NO: 230852 - RNA, 22 nt, Homo sapiens
ucuugguugaaaauucauaaua

SEQ ID NO: 230853 - RNA, 22 nt, Homo sapiens
ucuuuaguuaagggacauuuua

SEQ ID NO: 230854 - RNA, 23 nt, Homo sapiens
ucuuuggcucuaauauaccuugu

SEQ ID NO: 230855 - RNA, 18 nt, Homo sapiens
ucuuuggcugaacuguag

SEQ ID NO: 230856 - RNA, 22 nt, Homo sapiens
ucuuuggcugugaagaauaaug

SEQ ID NO: 230857 - RNA, 22 nt, Homo sapiens
ucuuugggauauucugaaaggg

SEQ ID NO: 230858 - RNA, 22 nt, Homo sapiens
ucuuugguaauggaugucugau

SEQ ID NO: 230859 - RNA, 22 nt, Homo sapiens
ucuuugguaugugcaugugcuu

SEQ ID NO: 230860 - RNA, 22 nt, Homo sapiens
ucuuugguauugugaauagugu

SEQ ID NO: 230861 - RNA, 22 nt, Homo sapiens
ucuuuggucuacuuucauaugu

SEQ ID NO: 230862 - RNA, 22 nt, Homo sapiens
ucuuuggugaauggucauccag

SEQ ID NO: 230863 - RNA, 22 nt, Homo sapiens
ucuuugguucugugcagccuau

SEQ ID NO: 230864 - RNA, 22 nt, Homo sapiens
ucuuugguucuguuuauguaau

SEQ ID NO: 230865 - RNA, 22 nt, Homo sapiens
ucuuuguuggaguccaaggaua

SEQ ID NO: 230866 - RNA, 22 nt, Homo sapiens
ucuuuugggccucuugucagac

SEQ ID NO: 230867 - RNA, 22 nt, Homo sapiens
ucuuuuguucuauucaggccuu

SEQ ID NO: 230868 - RNA, 22 nt, Homo sapiens
ugaaaagucuaagauuaagguu

SEQ ID NO: 230869 - RNA, 22 nt, Homo sapiens
ugaaacacacagagaagggaga

SEQ ID NO: 230870 - RNA, 22 nt, Homo sapiens
ugaaacacacauugcccuuuau

SEQ ID NO: 230871 - RNA, 20 nt, Homo sapiens
ugaaacacauggacuggggu

SEQ ID NO: 230872 - RNA, 22 nt, Homo sapiens
ugaaagacugaagaauaggcau

SEQ ID NO: 230873 - RNA, 22 nt, Homo sapiens
ugaaagguauagguucuggagg

SEQ ID NO: 230874 - RNA, 22 nt, Homo sapiens
ugaaaguaauugcaguuuuuac

SEQ ID NO: 230875 - RNA, 22 nt, Homo sapiens
ugaaauaguuaaguugccuagu

SEQ ID NO: 230876 - RNA, 22 nt, Homo sapiens
ugaaaucauguaguuauugcaa

SEQ ID NO: 230877 - RNA, 22 nt, Homo sapiens
ugaaaucuuugaugguggcauu

SEQ ID NO: 230878 - RNA, 22 nt, Homo sapiens
ugaaaugcagaacuuuaggucu

SEQ ID NO: 230879 - RNA, 22 nt, Homo sapiens
ugaaauggaagaagucccuuuu

SEQ ID NO: 230880 - RNA, 22 nt, Homo sapiens
ugaaauggugcggucugcagca

SEQ ID NO: 230881 - RNA, 22 nt, Homo sapiens
ugaaauguuaaacaaguggcuc

SEQ ID NO: 230882 - RNA, 22 nt, Homo sapiens
ugaacacagccugccucugcca

SEQ ID NO: 230883 - RNA, 22 nt, Homo sapiens
ugaacagagaaacacuggccau

SEQ ID NO: 230884 - RNA, 22 nt, Homo sapiens
ugaacagucaucucucuuguau

SEQ ID NO: 230885 - RNA, 21 nt, Homo sapiens
ugaaccccugcucucaagaaa

SEQ ID NO: 230886 - RNA, 22 nt, Homo sapiens
ugaacuguaagguauaggugau

SEQ ID NO: 230887 - RNA, 22 nt, Homo sapiens
ugaagacauuuuugggugugua

SEQ ID NO: 230888 - RNA, 22 nt, Homo sapiens
ugaagacucaauuauuaugaac

SEQ ID NO: 230889 - RNA, 22 nt, Homo sapiens
ugaagagucuaaaucugucuuc

SEQ ID NO: 230890 - RNA, 22 nt, Homo sapiens
ugaaggccgggcaugguggcuc

SEQ ID NO: 230891 - RNA, 22 nt, Homo sapiens
ugaagggcauuguuuugccaaa

SEQ ID NO: 230892 - RNA, 22 nt, Homo sapiens
ugaagugaagacucacagaagg

SEQ ID NO: 230893 - RNA, 22 nt, Homo sapiens
ugaagugcugugggccaggcgu

SEQ ID NO: 230894 - RNA, 18 nt, Homo sapiens
ugaauacagcguugggaa

SEQ ID NO: 230895 - RNA, 22 nt, Homo sapiens
ugaauagacacuaaagacugua

SEQ ID NO: 230896 - RNA, 22 nt, Homo sapiens
ugaauaggcaguuaaguuuaug

SEQ ID NO: 230897 - RNA, 18 nt, Homo sapiens
ugaauaguguccccauga

SEQ ID NO: 230898 - RNA, 22 nt, Homo sapiens
ugaauauagacagggguagaga

SEQ ID NO: 230899 - RNA, 22 nt, Homo sapiens
ugaauauguuaauuagcaucau

SEQ ID NO: 230900 - RNA, 22 nt, Homo sapiens
ugaauauuugcuacucacucuu

SEQ ID NO: 230901 - RNA, 22 nt, Homo sapiens
ugaaucaugcugcuauaaagac

SEQ ID NO: 230902 - RNA, 22 nt, Homo sapiens
ugaaugcaucuagaaauuuauu

SEQ ID NO: 230903 - RNA, 22 nt, Homo sapiens
ugaaugcuucaugucugggcug

SEQ ID NO: 230904 - RNA, 22 nt, Homo sapiens
ugaaugguaaagaaaagcacug

SEQ ID NO: 230905 - RNA, 22 nt, Homo sapiens
ugaaugguuuuuagagaacaau

SEQ ID NO: 230906 - RNA, 22 nt, Homo sapiens
acaugcauggcaugcauuguac

SEQ ID NO: 230907 - RNA, 22 nt, Homo sapiens
acaugguacugauuuacgaaau

SEQ ID NO: 230908 - RNA, 21 nt, Homo sapiens
acauguacacauguaugcaca

SEQ ID NO: 230909 - RNA, 22 nt, Homo sapiens
acauguagacaacggacaaagu

SEQ ID NO: 230910 - RNA, 22 nt, Homo sapiens
acauugcucuuaccaaguuugu

SEQ ID NO: 230911 - RNA, 22 nt, Homo sapiens
accaccauugcacugaacuuuc

SEQ ID NO: 230912 - RNA, 22 nt, Homo sapiens
ugaggacugagaggcacugugg

SEQ ID NO: 230913 - RNA, 22 nt, Homo sapiens
ugaggagugagaaauugguuuc

SEQ ID NO: 230914 - RNA, 22 nt, Homo sapiens
ugagggaugcguacccuaugcc

SEQ ID NO: 230915 - RNA, 22 nt, Homo sapiens
ugaggguauagccagcccuuag

SEQ ID NO: 230916 - RNA, 22 nt, Homo sapiens
ugagguaaaacaaggauuggau

SEQ ID NO: 230917 - RNA, 22 nt, Homo sapiens
ugagguaacaaacuaugaguua

SEQ ID NO: 230918 - RNA, 22 nt, Homo sapiens
ugagguaagauguucauuuuuc

SEQ ID NO: 230919 - RNA, 22 nt, Homo sapiens
ugagguagaaugauucuaauau

SEQ ID NO: 230920 - RNA, 22 nt, Homo sapiens
ugagguaggugaagaaugcacg

SEQ ID NO: 230921 - RNA, 22 nt, Homo sapiens
ugagguauuuuguuaugcagcc

SEQ ID NO: 230922 - RNA, 21 nt, Homo sapiens
ugaggucaugaugcugcuucc

SEQ ID NO: 230923 - RNA, 22 nt, Homo sapiens
ugaggugaggguaucaaaugcu

SEQ ID NO: 230924 - RNA, 22 nt, Homo sapiens
ugagguugaaggacauuuuuau

SEQ ID NO: 230925 - RNA, 22 nt, Homo sapiens
ugaguagaacaucaagucauac

SEQ ID NO: 230926 - RNA, 22 nt, Homo sapiens
ugaguagagaauucagcuaagg

SEQ ID NO: 230927 - RNA, 22 nt, Homo sapiens
ugaguagauccaagacuguccu

SEQ ID NO: 230928 - RNA, 22 nt, Homo sapiens
ucagguugcuaaguauaauauu

SEQ ID NO: 230929 - RNA, 22 nt, Homo sapiens
ucaguaccugagagugggcaga

SEQ ID NO: 230930 - RNA, 23 nt, Homo sapiens
ucaguagucauugggaaagugug

SEQ ID NO: 230931 - RNA, 20 nt, Homo sapiens
ucaguauauuguuuccacag

SEQ ID NO: 230932 - RNA, 18 nt, Homo sapiens
ucagucacugccuggcuu

SEQ ID NO: 230933 - RNA, 22 nt, Homo sapiens
ucaguccccucgcugagucuac

SEQ ID NO: 230934 - RNA, 22 nt, Homo sapiens
ucagugaacgaggaggagggug

SEQ ID NO: 230935 - RNA, 22 nt, Homo sapiens
ucagugaauauauaacagcgau

SEQ ID NO: 230936 - RNA, 22 nt, Homo sapiens
ucagugauugcuuucauggaaa

SEQ ID NO: 230937 - RNA, 20 nt, Homo sapiens
ucagugcagauuguccaagu

SEQ ID NO: 230938 - RNA, 22 nt, Homo sapiens
ucagugcaggaaucucuagcca

SEQ ID NO: 230939 - RNA, 22 nt, Homo sapiens
uucucacaguacagggagcucu

SEQ ID NO: 230940 - RNA, 22 nt, Homo sapiens
uucucaguucgguggcagugcu

SEQ ID NO: 230941 - RNA, 22 nt, Homo sapiens
uucucauggaacaucuguacug

SEQ ID NO: 230942 - RNA, 22 nt, Homo sapiens
uucucuaguuacuuuaauggag

SEQ ID NO: 230943 - RNA, 22 nt, Homo sapiens
uucucuguggauugggugagag

SEQ ID NO: 230944 - RNA, 22 nt, Homo sapiens
uucugagguuauauucucucaa

SEQ ID NO: 230945 - RNA, 22 nt, Homo sapiens
uucugauggaguaguccacaga

SEQ ID NO: 230946 - RNA, 22 nt, Homo sapiens
uucugcacaucgaucacaagau

SEQ ID NO: 230947 - RNA, 22 nt, Homo sapiens
uucuggaaaucagcagagggug

SEQ ID NO: 230948 - RNA, 22 nt, Homo sapiens
uucuggcucaggucaacacuuc

SEQ ID NO: 230949 - RNA, 22 nt, Homo sapiens
uucugguuaauacuugcaaaaa

SEQ ID NO: 230950 - RNA, 22 nt, Homo sapiens
uucugugcuuguggaugaagug

SEQ ID NO: 230951 - RNA, 22 nt, Homo sapiens
uucuuaguggcaccacuuuuuu

SEQ ID NO: 230952 - RNA, 22 nt, Homo sapiens
uucuucaguuacaacaaggggg

SEQ ID NO: 230953 - RNA, 22 nt, Homo sapiens
uucuugguguaguaguugaaaa

SEQ ID NO: 230954 - RNA, 22 nt, Homo sapiens
uucuuuggauaaaguuuuaugc

SEQ ID NO: 230955 - RNA, 22 nt, Homo sapiens
uucuuugguacaagggccgacc

SEQ ID NO: 230956 - RNA, 22 nt, Homo sapiens
uugaaauguguaagcuccgaaa

SEQ ID NO: 230957 - RNA, 22 nt, Homo sapiens
uugaaauguuuagaaguuugga

SEQ ID NO: 230958 - RNA, 22 nt, Homo sapiens
uugaaggaggugcucacucucg

SEQ ID NO: 230959 - RNA, 22 nt, Homo sapiens
uugaagguaggaugugcuauca

SEQ ID NO: 230960 - RNA, 22 nt, Homo sapiens
uugaaguauagaguuuaagaac

SEQ ID NO: 230961 - RNA, 22 nt, Homo sapiens
uugaaguaugaccgcugagaau

SEQ ID NO: 230962 - RNA, 22 nt, Homo sapiens
uugaagugaagaacaauaucac

SEQ ID NO: 230963 - RNA, 22 nt, Homo sapiens
uugaauaguggugaaaguuuga

SEQ ID NO: 230964 - RNA, 22 nt, Homo sapiens
uugaauguaugcuggguuuacu

SEQ ID NO: 230965 - RNA, 22 nt, Homo sapiens
uugacaaggagccauugcaucu

SEQ ID NO: 230966 - RNA, 22 nt, Homo sapiens
uugacaaggagugggguugaga

SEQ ID NO: 230967 - RNA, 22 nt, Homo sapiens
uugacagaccuuggucauaucc

SEQ ID NO: 230968 - RNA, 22 nt, Homo sapiens
uugacagagaaaagugugacuu

SEQ ID NO: 230969 - RNA, 20 nt, Homo sapiens
uugacagagggaaaguugcu

SEQ ID NO: 230970 - RNA, 22 nt, Homo sapiens
uugacauauguguguccacaua

SEQ ID NO: 230971 - RNA, 22 nt, Homo sapiens
uugacauauuugugcuuaagaa

SEQ ID NO: 230972 - RNA, 22 nt, Homo sapiens
uugacuacaccaugccaggaac

SEQ ID NO: 230973 - RNA, 22 nt, Homo sapiens
uugacugugguaauggaagcug

SEQ ID NO: 230974 - RNA, 22 nt, Homo sapiens
uugacuucagagcugauucaag

SEQ ID NO: 230975 - RNA, 22 nt, Homo sapiens
uugacuuuuaggaggaaaauga

SEQ ID NO: 230976 - RNA, 22 nt, Homo sapiens
uugagacggagucuugcucuuu

SEQ ID NO: 230977 - RNA, 22 nt, Homo sapiens
uugagacugaacauuuguguac

SEQ ID NO: 230978 - RNA, 22 nt, Homo sapiens
uugagacugagucucgcccugu

SEQ ID NO: 230979 - RNA, 22 nt, Homo sapiens
uugagaguggaggcuauaucuu

SEQ ID NO: 230980 - RNA, 22 nt, Homo sapiens
uugagauagaauaggaauggga

SEQ ID NO: 230981 - RNA, 22 nt, Homo sapiens
uugagauauccauaaaugggaa

SEQ ID NO: 230982 - RNA, 22 nt, Homo sapiens
uugagauggaaucucgcuuugu

SEQ ID NO: 230983 - RNA, 22 nt, Homo sapiens
uugagauggagucucacuccuu

SEQ ID NO: 230984 - RNA, 22 nt, Homo sapiens
uugagauggagucucacucuuc

SEQ ID NO: 230985 - RNA, 22 nt, Homo sapiens
uugagauggagucucacucuuu

SEQ ID NO: 230986 - RNA, 22 nt, Homo sapiens
uugagauggagucucgcacugu

SEQ ID NO: 230987 - RNA, 22 nt, Homo sapiens
uugagauggagucucgcucuuu

SEQ ID NO: 230988 - RNA, 22 nt, Homo sapiens
uugagauggagucuugcucucu

SEQ ID NO: 230989 - RNA, 22 nt, Homo sapiens
uugagauggagucuuguucucu

SEQ ID NO: 230990 - RNA, 22 nt, Homo sapiens
uugagauggaguguugcucugu

SEQ ID NO: 230991 - RNA, 22 nt, Homo sapiens
uugagauggaguucauuuuugu

SEQ ID NO: 230992 - RNA, 22 nt, Homo sapiens
uugagauggaguuucacucuug

SEQ ID NO: 230993 - RNA, 22 nt, Homo sapiens
uugagauguaagauguuaauau

SEQ ID NO: 230994 - RNA, 22 nt, Homo sapiens
uugagauguaguuucacuccug

SEQ ID NO: 230995 - RNA, 22 nt, Homo sapiens
uugagauguauguauauaaugu

SEQ ID NO: 230996 - RNA, 22 nt, Homo sapiens
uugagcaauccuccugccaugu

SEQ ID NO: 230997 - RNA, 22 nt, Homo sapiens
uugagcacaguagguuguggcu

SEQ ID NO: 230998 - RNA, 22 nt, Homo sapiens
uugagcccuggaggcagaggcu

SEQ ID NO: 230999 - RNA, 22 nt, Homo sapiens
uugagcuagggagaucgagguc

SEQ ID NO: 231000 - RNA, 22 nt, Homo sapiens
uugagcucaucaagauagagaa

SEQ ID NO: 231001 - RNA, 22 nt, Homo sapiens
uugagcucuuccagccuggagc

SEQ ID NO: 231002 - RNA, 22 nt, Homo sapiens
uuguauguugaaugaugguaua

SEQ ID NO: 231003 - RNA, 22 nt, Homo sapiens
uugucaaacucauucuccaucc

SEQ ID NO: 231004 - RNA, 22 nt, Homo sapiens
uugucacauggggcggcugccc

SEQ ID NO: 231005 - RNA, 22 nt, Homo sapiens
uuguccaagucccauuuguuga

SEQ ID NO: 231006 - RNA, 22 nt, Homo sapiens
uuguccacugcuagccucugca

SEQ ID NO: 231007 - RNA, 19 nt, Homo sapiens
uuguccccucuaaaucuca

SEQ ID NO: 231008 - RNA, 16 nt, Homo sapiens
uugucccuucccaaau

SEQ ID NO: 231009 - RNA, 22 nt, Homo sapiens
uugugaagaaaccagaaaaguu

SEQ ID NO: 231010 - RNA, 22 nt, Homo sapiens
uugugaauggaguagcaggauc

SEQ ID NO: 231011 - RNA, 22 nt, Homo sapiens
uugugccauucuucugccucag

SEQ ID NO: 231012 - RNA, 22 nt, Homo sapiens
uugugcuacugaguuggggugg

SEQ ID NO: 231013 - RNA, 22 nt, Homo sapiens
uugugcuuaauaaaaaguggua

SEQ ID NO: 231014 - RNA, 22 nt, Homo sapiens
uugugcuugauuugccuagcug

SEQ ID NO: 231015 - RNA, 22 nt, Homo sapiens
uugugcuuuugagcugagauga

SEQ ID NO: 231016 - RNA, 22 nt, Homo sapiens
uugugcuuuuuaaauagcuucc

SEQ ID NO: 231017 - RNA, 19 nt, Homo sapiens
uugugggaggacagagggg

SEQ ID NO: 231018 - RNA, 22 nt, Homo sapiens
uugugguuuuagcacuguggau

SEQ ID NO: 231019 - RNA, 22 nt, Homo sapiens
uugugguuuuaucuaccuuugg

SEQ ID NO: 231020 - RNA, 22 nt, Homo sapiens
uuguguuugaugcugacacgca

SEQ ID NO: 231021 - RNA, 22 nt, Homo sapiens
uuguuauguuaaacuacugaaa

SEQ ID NO: 231022 - RNA, 17 nt, Homo sapiens
uuguucccauuaaaaag

SEQ ID NO: 231023 - RNA, 22 nt, Homo sapiens
uuguucccuucuggcuuuuaug

SEQ ID NO: 231024 - RNA, 22 nt, Homo sapiens
uuguuguggauuaaauuugcau

SEQ ID NO: 231025 - RNA, 22 nt, Homo sapiens
uuguuuagagacuggaauuaaa

SEQ ID NO: 231026 - RNA, 22 nt, Homo sapiens
uuguuugguugaguauggaagu

SEQ ID NO: 231027 - RNA, 22 nt, Homo sapiens
uuguuuuggagaugagcuaaaa

SEQ ID NO: 231028 - RNA, 22 nt, Homo sapiens
uuuaaagcacggaguuuguggc

SEQ ID NO: 231029 - RNA, 22 nt, Homo sapiens
uuuaaagcuaaaauauguuuau

SEQ ID NO: 231030 - RNA, 22 nt, Homo sapiens
uuuaagguauguggugaaaauu

SEQ ID NO: 231031 - RNA, 22 nt, Homo sapiens
uuuaaugcaucccaaaauguag

SEQ ID NO: 231032 - RNA, 22 nt, Homo sapiens
uuuagcagcaaagagccaugcu

SEQ ID NO: 231033 - RNA, 22 nt, Homo sapiens
uuuagggcaggccuggugguga

SEQ ID NO: 231034 - RNA, 22 nt, Homo sapiens
uuuagguagucaaagguuaguc

SEQ ID NO: 231035 - RNA, 22 nt, Homo sapiens
uuuagguauuugguauagcagu

SEQ ID NO: 231036 - RNA, 22 nt, Homo sapiens
uuuagugcaucagacacccucu

SEQ ID NO: 231037 - RNA, 22 nt, Homo sapiens
uuuaguucauuaaggaaucucc

SEQ ID NO: 231038 - RNA, 22 nt, Homo sapiens
uuuaucuguuuaaaacuguuca

SEQ ID NO: 231039 - RNA, 22 nt, Homo sapiens
uuuaugcuacauguguuggaaa

SEQ ID NO: 231040 - RNA, 22 nt, Homo sapiens
uuaucagcagcaugaaacugga

SEQ ID NO: 231041 - RNA, 22 nt, Homo sapiens
uuaucagcagugcgaaaacaga

SEQ ID NO: 231042 - RNA, 21 nt, Homo sapiens
uuaucccagugucucugcagg

SEQ ID NO: 231043 - RNA, 22 nt, Homo sapiens
uuaugacauugacaguuuuuag

SEQ ID NO: 231044 - RNA, 22 nt, Homo sapiens
uuaugacuuucagcuaggggau

SEQ ID NO: 231045 - RNA, 22 nt, Homo sapiens
uuaugccagugauuauaagggc

SEQ ID NO: 231046 - RNA, 22 nt, Homo sapiens
uuaugcuguuuucuggagauuu

SEQ ID NO: 231047 - RNA, 22 nt, Homo sapiens
uuauggcaaugccccacuccua

SEQ ID NO: 231048 - RNA, 22 nt, Homo sapiens
uuaugguuuauuagcaggguua

SEQ ID NO: 231049 - RNA, 22 nt, Homo sapiens
uuauguaaaucaaucuggaauc

SEQ ID NO: 231050 - RNA, 22 nt, Homo sapiens
uuauguaggcuauagcucugca

SEQ ID NO: 231051 - RNA, 22 nt, Homo sapiens
uuaugucacuguucagucuccc

SEQ ID NO: 231052 - RNA, 22 nt, Homo sapiens
uuaugucuuugagcaaugcugu

SEQ ID NO: 231053 - RNA, 22 nt, Homo sapiens
uuaugucuuuuguguucagcua

SEQ ID NO: 231054 - RNA, 22 nt, Homo sapiens
uuauguguuuaauguuucugaa

SEQ ID NO: 231055 - RNA, 22 nt, Homo sapiens
uuauuagcacccuaccaugugg

SEQ ID NO: 231056 - RNA, 22 nt, Homo sapiens
uuauuagguugguggaaaagua

SEQ ID NO: 231057 - RNA, 16 nt, Homo sapiens
uuauugcauucuucuc

SEQ ID NO: 231058 - RNA, 22 nt, Homo sapiens
uucaaaguguugguuuugggcu

SEQ ID NO: 231059 - RNA, 22 nt, Homo sapiens
uucaaaucuuuggcucccacua

SEQ ID NO: 231060 - RNA, 22 nt, Homo sapiens
uucaacugcuucagccucccaa

SEQ ID NO: 231061 - RNA, 22 nt, Homo sapiens
uucaagauggcaccagugagug

SEQ ID NO: 231062 - RNA, 22 nt, Homo sapiens
uucaagcuacaguggcaggguu

SEQ ID NO: 231063 - RNA, 22 nt, Homo sapiens
uucaaguaagaaagacaucagg

SEQ ID NO: 231064 - RNA, 22 nt, Homo sapiens
uucaaguagguaggaccacagg

SEQ ID NO: 231065 - RNA, 22 nt, Homo sapiens
uucaaguaguucucaugccuca

SEQ ID NO: 231066 - RNA, 22 nt, Homo sapiens
uucaagucaaggaaagaggucu

SEQ ID NO: 231067 - RNA, 22 nt, Homo sapiens
uucaaguguucaggagcuacag

SEQ ID NO: 231068 - RNA, 21 nt, Homo sapiens
uucacaagggaaguagggggc

SEQ ID NO: 231069 - RNA, 22 nt, Homo sapiens
uucacaauuaaaugugguuauu

SEQ ID NO: 231070 - RNA, 22 nt, Homo sapiens
uucacagaguuauuuuuaugcu

SEQ ID NO: 231071 - RNA, 22 nt, Homo sapiens
uucacagcuuaauaaggcucag

SEQ ID NO: 231072 - RNA, 20 nt, Homo sapiens
uucacaggcagcuucuuucu

SEQ ID NO: 231073 - RNA, 22 nt, Homo sapiens
uucacaguacucccuggaauua

SEQ ID NO: 231074 - RNA, 22 nt, Homo sapiens
uucacagugugaucuaugggca

SEQ ID NO: 231075 - RNA, 22 nt, Homo sapiens
uucacaguguuucucacgguua

SEQ ID NO: 231076 - RNA, 22 nt, Homo sapiens
uucaccaguuuugucacgaaug

SEQ ID NO: 231077 - RNA, 22 nt, Homo sapiens
uucacccugguuguagauggac

SEQ ID NO: 231078 - RNA, 22 nt, Homo sapiens
uucaccuggaguucaggauaag

SEQ ID NO: 231079 - RNA, 23 nt, Homo sapiens
uucaccugguuauuaauagccuc

SEQ ID NO: 231080 - RNA, 20 nt, Homo sapiens
uucacugggcucucuguugg

SEQ ID NO: 231081 - RNA, 21 nt, Homo sapiens
uucacuggucuauuucccuuu

SEQ ID NO: 231082 - RNA, 22 nt, Homo sapiens
uucacuguagcuuggauguuua

SEQ ID NO: 231083 - RNA, 22 nt, Homo sapiens
uucacugugcuuaaauucugcu

SEQ ID NO: 231084 - RNA, 22 nt, Homo sapiens
uucagauugcauaccgaaagua

SEQ ID NO: 231085 - RNA, 22 nt, Homo sapiens
uucagcacaguguggaucauuc

SEQ ID NO: 231086 - RNA, 19 nt, Homo sapiens
uucagcagugucugcucuu

SEQ ID NO: 231087 - RNA, 22 nt, Homo sapiens
uucaggcaccauggucauugau

SEQ ID NO: 231088 - RNA, 22 nt, Homo sapiens
uucagggcauuggaguuucuga

SEQ ID NO: 231089 - RNA, 22 nt, Homo sapiens
uucaguacuucaaaaucuuuaa

SEQ ID NO: 231090 - RNA, 22 nt, Homo sapiens
uucaguaguaaguuggaacucu

SEQ ID NO: 231091 - RNA, 22 nt, Homo sapiens
uucaguggacuuaguagugcuu

SEQ ID NO: 231092 - RNA, 22 nt, Homo sapiens
uucaguugcaucaguugaccag

SEQ ID NO: 231093 - RNA, 18 nt, Homo sapiens
uucaguuuguaucugggg

SEQ ID NO: 231094 - RNA, 22 nt, Homo sapiens
uucauagaggacauuacuggag

SEQ ID NO: 231095 - RNA, 22 nt, Homo sapiens
uucauaguauuuuucuccaaau

SEQ ID NO: 231096 - RNA, 22 nt, Homo sapiens
uucauagucacauucgaugucu

SEQ ID NO: 231097 - RNA, 22 nt, Homo sapiens
uucauagugaaaaauucaaagu

SEQ ID NO: 231098 - RNA, 22 nt, Homo sapiens
uucauaguucuuuuagucauua

SEQ ID NO: 231099 - RNA, 22 nt, Homo sapiens
uucaucacagucuccgaugccc

SEQ ID NO: 231100 - RNA, 22 nt, Homo sapiens
uucauggaacaaguggguucaa

SEQ ID NO: 231101 - RNA, 22 nt, Homo sapiens
uucauggagccauccuuugauc

SEQ ID NO: 231102 - RNA, 20 nt, Homo sapiens
uucaugggagcaaagaggcc

SEQ ID NO: 231103 - RNA, 22 nt, Homo sapiens
uucauguaauauauuucaggcc

SEQ ID NO: 231104 - RNA, 22 nt, Homo sapiens
uucauugcugcuuaucuccaga

SEQ ID NO: 231105 - RNA, 23 nt, Homo sapiens
uuccaccauugacuaguuacaua

SEQ ID NO: 231106 - RNA, 22 nt, Homo sapiens
uuccagagucaccuuucugucg

SEQ ID NO: 231107 - RNA, 22 nt, Homo sapiens
uuccagcugggggcaacucugc

SEQ ID NO: 231108 - RNA, 22 nt, Homo sapiens
uugaggugggaggaucacuuga

SEQ ID NO: 231109 - RNA, 22 nt, Homo sapiens
uugagguggugucuugcucugu

SEQ ID NO: 231110 - RNA, 22 nt, Homo sapiens
uugaguagauaccuaggaauag

SEQ ID NO: 231111 - RNA, 22 nt, Homo sapiens
uugaguaguaagaagaugauag

SEQ ID NO: 231112 - RNA, 22 nt, Homo sapiens
uugaguaguaaggauauuaucu

SEQ ID NO: 231113 - RNA, 22 nt, Homo sapiens
uugagucguuaccuauaacaga

SEQ ID NO: 231114 - RNA, 22 nt, Homo sapiens
uugauaauguuaacuuugguca

SEQ ID NO: 231115 - RNA, 22 nt, Homo sapiens
uugauaguuuuaaaauuaaucu

SEQ ID NO: 231116 - RNA, 22 nt, Homo sapiens
uugauaugcuugucaguccauu

SEQ ID NO: 231117 - RNA, 22 nt, Homo sapiens
uugauauggcugcuuaccauaa

SEQ ID NO: 231118 - RNA, 22 nt, Homo sapiens
uugauauucugagaagcugaag

SEQ ID NO: 231119 - RNA, 22 nt, Homo sapiens
uugaucaaaucugagugagaau

SEQ ID NO: 231120 - RNA, 22 nt, Homo sapiens
uugaucuaugugucuguuuuua

SEQ ID NO: 231121 - RNA, 22 nt, Homo sapiens
uugaucuguguuagaagcuaag

SEQ ID NO: 231122 - RNA, 22 nt, Homo sapiens
uugauguguuuccaggauuugu

SEQ ID NO: 231123 - RNA, 22 nt, Homo sapiens
uugauuagauccaguugauuga

SEQ ID NO: 231124 - RNA, 20 nt, Homo sapiens
uugauucccucuaaacucgc

SEQ ID NO: 231125 - RNA, 22 nt, Homo sapiens
uugcaaacaucuuguuucacau

SEQ ID NO: 231126 - RNA, 22 nt, Homo sapiens
uugcaaaguugccaaggaagga

SEQ ID NO: 231127 - RNA, 22 nt, Homo sapiens
uugcaacauguauucuggugau

SEQ ID NO: 231128 - RNA, 22 nt, Homo sapiens
uugcaagaaaucagagccuucc

SEQ ID NO: 231129 - RNA, 22 nt, Homo sapiens
uugcaaggugcagcuuaugcaa

SEQ ID NO: 231130 - RNA, 20 nt, Homo sapiens
uugcacagagaaggaggcag

SEQ ID NO: 231131 - RNA, 22 nt, Homo sapiens
uugcacagugguuuagagccug

SEQ ID NO: 231132 - RNA, 22 nt, Homo sapiens
uugcacauuuuuucuggcagaa

SEQ ID NO: 231133 - RNA, 22 nt, Homo sapiens
uugcacucuccagccucggcaa

SEQ ID NO: 231134 - RNA, 22 nt, Homo sapiens
uugcacugagauuuugcuuaca

SEQ ID NO: 231135 - RNA, 22 nt, Homo sapiens
uauugacuugagaagggauuag

SEQ ID NO: 231136 - RNA, 22 nt, Homo sapiens
uauugacuuuuuuguuaggagg

SEQ ID NO: 231137 - RNA, 20 nt, Homo sapiens
uauugcacuccagucugggc

SEQ ID NO: 231138 - RNA, 20 nt, Homo sapiens
uauugccuaaauaccagaau

SEQ ID NO: 231139 - RNA, 22 nt, Homo sapiens
uauugcuaaauucuuuuccuag

SEQ ID NO: 231140 - RNA, 22 nt, Homo sapiens
uauugcucaugcauuuaauuuc

SEQ ID NO: 231141 - RNA, 22 nt, Homo sapiens
uauugcuggauguauuacaugu

SEQ ID NO: 231142 - RNA, 22 nt, Homo sapiens
uauugcuggcacauaguagguc

SEQ ID NO: 231143 - RNA, 22 nt, Homo sapiens
uauugcuuuuaacccaaucucu

SEQ ID NO: 231144 - RNA, 19 nt, Homo sapiens
uugcauauguugaaccagg

SEQ ID NO: 231145 - RNA, 22 nt, Homo sapiens
uugcaugcuccuuaugagaauc

SEQ ID NO: 231146 - RNA, 22 nt, Homo sapiens
uugcaugggagcugggugaggc

SEQ ID NO: 231147 - RNA, 22 nt, Homo sapiens
uugccaacauggugaacuccca

SEQ ID NO: 231148 - RNA, 22 nt, Homo sapiens
uugccaauauuuuacugagaag

SEQ ID NO: 231149 - RNA, 22 nt, Homo sapiens
uugccacuucucuugccccauu

SEQ ID NO: 231150 - RNA, 22 nt, Homo sapiens
uugccauagugcugccagauau

SEQ ID NO: 231151 - RNA, 20 nt, Homo sapiens
uugccgagagaaagguguua

SEQ ID NO: 231152 - RNA, 22 nt, Homo sapiens
uugccgggugcaguggcucaug

SEQ ID NO: 231153 - RNA, 22 nt, Homo sapiens
uugccugagaagccaagaauaa

SEQ ID NO: 231154 - RNA, 22 nt, Homo sapiens
uugccuuuguuggaaacaagug

SEQ ID NO: 231155 - RNA, 22 nt, Homo sapiens
uugcuagagaugagggaugugu

SEQ ID NO: 231156 - RNA, 22 nt, Homo sapiens
uugcuaguguuugguugauggu

SEQ ID NO: 231157 - RNA, 22 nt, Homo sapiens
uugcuuuguuacugcaguuucc

SEQ ID NO: 231158 - RNA, 22 nt, Homo sapiens
uuggaaacaccuggugagguua

SEQ ID NO: 231159 - RNA, 22 nt, Homo sapiens
uuggaaauguguuugcauucag

SEQ ID NO: 231160 - RNA, 22 nt, Homo sapiens
uuggaacuguucguauugaaau

SEQ ID NO: 231161 - RNA, 22 nt, Homo sapiens
uuggaagauuacuuaguuuucu

SEQ ID NO: 231162 - RNA, 22 nt, Homo sapiens
uuggaaggcuccuaaugaaugg

SEQ ID NO: 231163 - RNA, 22 nt, Homo sapiens
uuggaauacucaaaagguuggg

SEQ ID NO: 231164 - RNA, 22 nt, Homo sapiens
uuggaauauaaccuguuucuaa

SEQ ID NO: 231165 - RNA, 23 nt, Homo sapiens
uuggaaugagaccuaagaguuuu

SEQ ID NO: 231166 - RNA, 22 nt, Homo sapiens
uuggacagaugguuacauuuuu

SEQ ID NO: 231167 - RNA, 22 nt, Homo sapiens
uuggacuaagaacuuaaaauaa

SEQ ID NO: 231168 - RNA, 22 nt, Homo sapiens
uuggacuacagauuacuucauc

SEQ ID NO: 231169 - RNA, 22 nt, Homo sapiens
uuggacuggaacuauaccauug

SEQ ID NO: 231170 - RNA, 22 nt, Homo sapiens
uuggacugggauggccgaggcu

SEQ ID NO: 231171 - RNA, 22 nt, Homo sapiens
uuggacuuuaagauagagaugu

SEQ ID NO: 231172 - RNA, 22 nt, Homo sapiens
uuggagagagaggacucccggc

SEQ ID NO: 231173 - RNA, 22 nt, Homo sapiens
uuggagcacuggggcacugaca

SEQ ID NO: 231174 - RNA, 22 nt, Homo sapiens
uuggauaguuuaugaaaaaugg

SEQ ID NO: 231175 - RNA, 22 nt, Homo sapiens
uuggauggucuuuauauaguau

SEQ ID NO: 231176 - RNA, 22 nt, Homo sapiens
uuggcaacauagugagaccccc

SEQ ID NO: 231177 - RNA, 22 nt, Homo sapiens
uuggcaauucagauucuuuuau

SEQ ID NO: 231178 - RNA, 22 nt, Homo sapiens
uuggcacgugguggggcucgga

SEQ ID NO: 231179 - RNA, 22 nt, Homo sapiens
uuggcagaaaaggucggggguu

SEQ ID NO: 231180 - RNA, 20 nt, Homo sapiens
uuggcagagucuuuagggua

SEQ ID NO: 231181 - RNA, 22 nt, Homo sapiens
uuggccauggagcacuuuucua

SEQ ID NO: 231182 - RNA, 22 nt, Homo sapiens
uuggccuccuggucauauccag

SEQ ID NO: 231183 - RNA, 22 nt, Homo sapiens
uuggccuuuucaaugccucuuu

SEQ ID NO: 231184 - RNA, 22 nt, Homo sapiens
uuggcuguguuuauaugcugga

SEQ ID NO: 231185 - RNA, 22 nt, Homo sapiens
uugggaauguccuaauaucucg

SEQ ID NO: 231186 - RNA, 22 nt, Homo sapiens
uugggacccuguccuguaacaa

SEQ ID NO: 231187 - RNA, 22 nt, Homo sapiens
uugggauggaaauuuguacccc

SEQ ID NO: 231188 - RNA, 22 nt, Homo sapiens
uugggauggaacuuuucaguga

SEQ ID NO: 231189 - RNA, 22 nt, Homo sapiens
uugggcauugcuauaaauucuu

SEQ ID NO: 231190 - RNA, 22 nt, Homo sapiens
uugggcuuuuagguccuuaaca

SEQ ID NO: 231191 - RNA, 22 nt, Homo sapiens
uuggguccucugguccuugguu

SEQ ID NO: 231192 - RNA, 22 nt, Homo sapiens
uugguaaaaugaccacagacau

SEQ ID NO: 231193 - RNA, 22 nt, Homo sapiens
uugguacuaaaaaguagggugu

SEQ ID NO: 231194 - RNA, 22 nt, Homo sapiens
uugguauguguuucauacucaa

SEQ ID NO: 231195 - RNA, 22 nt, Homo sapiens
uuggucagcucaauggagaggg

SEQ ID NO: 231196 - RNA, 22 nt, Homo sapiens
uuggucucaucaagagcagcuu

SEQ ID NO: 231197 - RNA, 22 nt, Homo sapiens
uuguaaacaucuguacauugcu

SEQ ID NO: 231198 - RNA, 22 nt, Homo sapiens
uuguaacucugaauacauccua

SEQ ID NO: 231199 - RNA, 23 nt, Homo sapiens
uuguacacuaagaaucgcagaug

SEQ ID NO: 231200 - RNA, 22 nt, Homo sapiens
uuguacaggaguguaagcuuca

SEQ ID NO: 231201 - RNA, 22 nt, Homo sapiens
uuguacuggguuuucuggaauu

SEQ ID NO: 231202 - RNA, 22 nt, Homo sapiens
uuguacuuuuaguagagacggg

SEQ ID NO: 231203 - RNA, 22 nt, Homo sapiens
uuguauaggcucaguaagaauc

SEQ ID NO: 231204 - RNA, 22 nt, Homo sapiens
uuguauguaaccauuuggcaaa

SEQ ID NO: 231205 - RNA, 22 nt, Homo sapiens
auggaucuuucugcuuuugaau

SEQ ID NO: 231206 - RNA, 22 nt, Homo sapiens
auggcaaaauguuccuaguggu

SEQ ID NO: 231207 - RNA, 22 nt, Homo sapiens
auggcacuaaguucaacacuua

SEQ ID NO: 231208 - RNA, 22 nt, Homo sapiens
auggcacuacugggaaugucuu

SEQ ID NO: 231209 - RNA, 22 nt, Homo sapiens
auggcacugauggaaguaccuu

SEQ ID NO: 231210 - RNA, 22 nt, Homo sapiens
auggcacuguguauuuuucugu

SEQ ID NO: 231211 - RNA, 22 nt, Homo sapiens
auggcagagucagaaagucagg

SEQ ID NO: 231212 - RNA, 22 nt, Homo sapiens
auggcaguguaugauuauauua

SEQ ID NO: 231213 - RNA, 22 nt, Homo sapiens
auggcaguuuauucuaaaucaa

SEQ ID NO: 231214 - RNA, 22 nt, Homo sapiens
auggcaguuucacucugggauu

SEQ ID NO: 231215 - RNA, 22 nt, Homo sapiens
auggccauuacuaagaauguuu

SEQ ID NO: 231216 - RNA, 22 nt, Homo sapiens
auggcccccuguuugugaacau

SEQ ID NO: 231217 - RNA, 22 nt, Homo sapiens
auggcccugaguucaauauauu

SEQ ID NO: 231218 - RNA, 22 nt, Homo sapiens
auggcccugcuaccacuuuucu

SEQ ID NO: 231219 - RNA, 22 nt, Homo sapiens
auggcccugggaaaggaggcau

SEQ ID NO: 231220 - RNA, 22 nt, Homo sapiens
auggcccuguguggagcugcug

SEQ ID NO: 231221 - RNA, 22 nt, Homo sapiens
auggccugaugcaccuguccca

SEQ ID NO: 231222 - RNA, 22 nt, Homo sapiens
auggcguguggcuuggaggcug

SEQ ID NO: 231223 - RNA, 22 nt, Homo sapiens
auggcuagauuguaugguaguu

SEQ ID NO: 231224 - RNA, 22 nt, Homo sapiens
auggcucaauucuuucccugaa

SEQ ID NO: 231225 - RNA, 22 nt, Homo sapiens
auggcugugaaaugguaggugg

SEQ ID NO: 231226 - RNA, 22 nt, Homo sapiens
auggcuguuccugggaguucua

SEQ ID NO: 231227 - RNA, 22 nt, Homo sapiens
auggcuugugacccaugcuuca

SEQ ID NO: 231228 - RNA, 22 nt, Homo sapiens
auggcuuuaagagugucugaau

SEQ ID NO: 231229 - RNA, 22 nt, Homo sapiens
auggcuuucaggacguggcgag

SEQ ID NO: 231230 - RNA, 22 nt, Homo sapiens
augggaaaaucagaaggccugg

SEQ ID NO: 231231 - RNA, 22 nt, Homo sapiens
augggacugggugccguggagc

SEQ ID NO: 231232 - RNA, 22 nt, Homo sapiens
augggguagguagcucggggaa

SEQ ID NO: 231233 - RNA, 17 nt, Homo sapiens
augggguuguagcccca

SEQ ID NO: 231234 - RNA, 22 nt, Homo sapiens
augguacuccagagaagcagaa

SEQ ID NO: 231235 - RNA, 22 nt, Homo sapiens
augguacuggggucccggaguu

SEQ ID NO: 231236 - RNA, 22 nt, Homo sapiens
augguaucauuacuguuuuauu

SEQ ID NO: 231237 - RNA, 22 nt, Homo sapiens
augguauuuaacagucuuucua

SEQ ID NO: 231238 - RNA, 22 nt, Homo sapiens
auggucccauucauucacguau

SEQ ID NO: 231239 - RNA, 22 nt, Homo sapiens
auuugguaauauuuaaggacuu

SEQ ID NO: 231240 - RNA, 21 nt, Homo sapiens
auuugguggcugugugacacu

SEQ ID NO: 231241 - RNA, 21 nt, Homo sapiens
auuugguguuagaaauaaauu

SEQ ID NO: 231242 - RNA, 22 nt, Homo sapiens
auuugguuauggucauggacac

SEQ ID NO: 231243 - RNA, 22 nt, Homo sapiens
auuuuugguugucagcacuagg

SEQ ID NO: 231244 - RNA, 22 nt, Homo sapiens
auuuuugguuucaccugcacgc

SEQ ID NO: 231245 - RNA, 22 nt, Homo sapiens
caaaggauucauuuccaggagu

SEQ ID NO: 231246 - RNA, 22 nt, Homo sapiens
caaagucuucaguugauucuga

SEQ ID NO: 231247 - RNA, 22 nt, Homo sapiens
caaagugcugaaagaggccagg

SEQ ID NO: 231248 - RNA, 22 nt, Homo sapiens
caaagugcuggaauuggccggg

SEQ ID NO: 231249 - RNA, 22 nt, Homo sapiens
caacacuguuuauuggauagcc

SEQ ID NO: 231250 - RNA, 22 nt, Homo sapiens
caaggaauucucaauagaguua

SEQ ID NO: 231251 - RNA, 22 nt, Homo sapiens
caaggcacagccccuacuuccu

SEQ ID NO: 231252 - RNA, 22 nt, Homo sapiens
caaguguuggcuuguauacaaa

SEQ ID NO: 231253 - RNA, 23 nt, Homo sapiens
caauacugaccucacguuaauag

SEQ ID NO: 231254 - RNA, 19 nt, Homo sapiens
caauacuucuuggcauaca

SEQ ID NO: 231255 - RNA, 21 nt, Homo sapiens
caauggcacaaucucugcuca

SEQ ID NO: 231256 - RNA, 22 nt, Homo sapiens
caaugugcuuggggcacaugag

SEQ ID NO: 231257 - RNA, 22 nt, Homo sapiens
caauugguguuuauggggaagu

SEQ ID NO: 231258 - RNA, 22 nt, Homo sapiens
cacaaccuccgccuccuggguu

SEQ ID NO: 231259 - RNA, 22 nt, Homo sapiens
cacacugucuucaauggguggu

SEQ ID NO: 231260 - RNA, 22 nt, Homo sapiens
cacagagugagacccugucucu

SEQ ID NO: 231261 - RNA, 22 nt, Homo sapiens
cacaggccugucucuuucuaac

SEQ ID NO: 231262 - RNA, 23 nt, Homo sapiens
cacagggugaacaccccuaaucc

SEQ ID NO: 231263 - RNA, 22 nt, Homo sapiens
cacaggucauccuggaucaagg

SEQ ID NO: 231264 - RNA, 22 nt, Homo sapiens
cacagugaacaauauccucugu

SEQ ID NO: 231265 - RNA, 22 nt, Homo sapiens
cacaguguucauagccaucagg

SEQ ID NO: 231266 - RNA, 22 nt, Homo sapiens
cacaguguuccagcuauuugaa

SEQ ID NO: 231267 - RNA, 22 nt, Homo sapiens
cacauagucccugcuaaucuuc

SEQ ID NO: 231268 - RNA, 22 nt, Homo sapiens
cacauguuugcuacauuuuucu

SEQ ID NO: 231269 - RNA, 22 nt, Homo sapiens
caccaaccucaguagcaucugu

SEQ ID NO: 231270 - RNA, 22 nt, Homo sapiens
caccacagccauuauugucccc

SEQ ID NO: 231271 - RNA, 19 nt, Homo sapiens
caccagugcaugcuacuau

SEQ ID NO: 231272 - RNA, 22 nt, Homo sapiens
caccauguguucagaaggauug

SEQ ID NO: 231273 - RNA, 22 nt, Homo sapiens
cacccagucaucuuggguuuuu

SEQ ID NO: 231274 - RNA, 22 nt, Homo sapiens
cacccgugcucccuccagcugc

SEQ ID NO: 231275 - RNA, 19 nt, Homo sapiens
caccgccugcccccugcug

SEQ ID NO: 231276 - RNA, 22 nt, Homo sapiens
caccggauucauggggaagaag

SEQ ID NO: 231277 - RNA, 22 nt, Homo sapiens
cacuagagaauagguaguucug

SEQ ID NO: 231278 - RNA, 22 nt, Homo sapiens
cacucaguuugugguacuuugu

SEQ ID NO: 231279 - RNA, 22 nt, Homo sapiens
cacugcacuccagccuaagagg

SEQ ID NO: 231280 - RNA, 22 nt, Homo sapiens
cacugcacucuucuucugggca

SEQ ID NO: 231281 - RNA, 22 nt, Homo sapiens
cacugcaguaaauugcgucggu

SEQ ID NO: 231282 - RNA, 22 nt, Homo sapiens
cacugcauccucugccuggcgg

SEQ ID NO: 231283 - RNA, 22 nt, Homo sapiens
cacugcauuggaugguuccucc

SEQ ID NO: 231284 - RNA, 22 nt, Homo sapiens
cacuggacauguugaagcuuuu

SEQ ID NO: 231285 - RNA, 22 nt, Homo sapiens
cacugggugccauauguuugcu

SEQ ID NO: 231286 - RNA, 22 nt, Homo sapiens
cagacaugucuuguggccgugg

SEQ ID NO: 231287 - RNA, 22 nt, Homo sapiens
cagagaacugaguuauuuucuu

SEQ ID NO: 231288 - RNA, 21 nt, Homo sapiens
cagagaucaucucuguuuuaa

SEQ ID NO: 231289 - RNA, 22 nt, Homo sapiens
cagagcaaugcuuuugcuuuga

SEQ ID NO: 231290 - RNA, 22 nt, Homo sapiens
cagagcacugauacuggguucu

SEQ ID NO: 231291 - RNA, 22 nt, Homo sapiens
cagagguauugcaaaagccuag

SEQ ID NO: 231292 - RNA, 22 nt, Homo sapiens
cagauacuccuggucucaggag

SEQ ID NO: 231293 - RNA, 22 nt, Homo sapiens
cagauacuggccuggagcugug

SEQ ID NO: 231294 - RNA, 22 nt, Homo sapiens
cagauaguuguagguguguggc

SEQ ID NO: 231295 - RNA, 22 nt, Homo sapiens
cagcacauagcaguugcucagu

SEQ ID NO: 231296 - RNA, 22 nt, Homo sapiens
cagcaucauucaucugggguaa

SEQ ID NO: 231297 - RNA, 22 nt, Homo sapiens
cagcgaggucugcgucacauug

SEQ ID NO: 231298 - RNA, 22 nt, Homo sapiens
cagcuaguaauuuauugaagau

SEQ ID NO: 231299 - RNA, 22 nt, Homo sapiens
ccuuuuuguaguggaaguagga

SEQ ID NO: 231300 - RNA, 22 nt, Homo sapiens
cgcaguguuugugucccugggu

SEQ ID NO: 231301 - RNA, 22 nt, Homo sapiens
cgcccuguagcuagcuagaggu

SEQ ID NO: 231302 - RNA, 22 nt, Homo sapiens
cgccugagcugaggaagcugca

SEQ ID NO: 231303 - RNA, 22 nt, Homo sapiens
cgugaggaaaacagaggguguu

SEQ ID NO: 231304 - RNA, 18 nt, Homo sapiens
cuaagacacuuggcagag

SEQ ID NO: 231305 - RNA, 22 nt, Homo sapiens
cuaagcaccuuaguggggaauc

SEQ ID NO: 231306 - RNA, 17 nt, Homo sapiens
cuaaggcaagagucugc

SEQ ID NO: 231307 - RNA, 22 nt, Homo sapiens
cuaagugaguauaauuuuaaga

SEQ ID NO: 231308 - RNA, 22 nt, Homo sapiens
cuaaucuagccuuauaaguauu

SEQ ID NO: 231309 - RNA, 21 nt, Homo sapiens
cuaaucucacccuuuucuggg

SEQ ID NO: 231310 - RNA, 22 nt, Homo sapiens
cuaauucuguaccuggcacaua

SEQ ID NO: 231311 - RNA, 22 nt, Homo sapiens
cuacagcacugagcugugugca

SEQ ID NO: 231312 - RNA, 22 nt, Homo sapiens
cuacagcagcccaguccccgaa

SEQ ID NO: 231313 - RNA, 22 nt, Homo sapiens
cuacauuguagguauucaaacu

SEQ ID NO: 231314 - RNA, 23 nt, Homo sapiens
cuacuagucaagucuuuuccagu

SEQ ID NO: 231315 - RNA, 22 nt, Homo sapiens
cuacuauguagagauauugaau

SEQ ID NO: 231316 - RNA, 22 nt, Homo sapiens
cuacucuggagagugacaauca

SEQ ID NO: 231317 - RNA, 22 nt, Homo sapiens
gauggcagugcagccccuggcu

SEQ ID NO: 231318 - RNA, 22 nt, Homo sapiens
gauggcaugugcugccaccaag

SEQ ID NO: 231319 - RNA, 22 nt, Homo sapiens
gauggcauuucuggaucugaca

SEQ ID NO: 231320 - RNA, 22 nt, Homo sapiens
gaugguguuuugauaggaauug

SEQ ID NO: 231321 - RNA, 22 nt, Homo sapiens
gaugguuuucaccugcaugcuu

SEQ ID NO: 231322 - RNA, 22 nt, Homo sapiens
gauguguuuccaggauuuguuu

SEQ ID NO: 231323 - RNA, 22 nt, Homo sapiens
gauguguuuuaggaucucagca

SEQ ID NO: 231324 - RNA, 22 nt, Homo sapiens
gauuggccaaacuaaagaacug

SEQ ID NO: 231325 - RNA, 22 nt, Homo sapiens
gauuugguguucuggcucaaga

SEQ ID NO: 231326 - RNA, 22 nt, Homo sapiens
gauuuuccaguggcccugauca

SEQ ID NO: 231327 - RNA, 22 nt, Homo sapiens
gcaaaguguuuuccaacuuggu

SEQ ID NO: 231328 - RNA, 22 nt, Homo sapiens
gcaagaaucugggaguaaaauu

SEQ ID NO: 231329 - RNA, 22 nt, Homo sapiens
gcaagagguaucuuauuuuccc

SEQ ID NO: 231330 - RNA, 22 nt, Homo sapiens
gcaagaguauuucaaggaagau

SEQ ID NO: 231331 - RNA, 22 nt, Homo sapiens
gcaagauuguguggcugaagua

SEQ ID NO: 231332 - RNA, 22 nt, Homo sapiens
gcaagugucugagguuuuguau

SEQ ID NO: 231333 - RNA, 22 nt, Homo sapiens
gcacaaugccugacgaguccug

SEQ ID NO: 231334 - RNA, 22 nt, Homo sapiens
gcacacuuacacgaaccuagau

SEQ ID NO: 231335 - RNA, 22 nt, Homo sapiens
gcacauauguaaauagcugccu

SEQ ID NO: 231336 - RNA, 22 nt, Homo sapiens
gcacauuacaaguauuagcuca

SEQ ID NO: 231337 - RNA, 22 nt, Homo sapiens
gcaccauugacaagaaauaggu

SEQ ID NO: 231338 - RNA, 22 nt, Homo sapiens
gcacccugucaaaauggaccaa

SEQ ID NO: 231339 - RNA, 22 nt, Homo sapiens
gcacgcauuguccuucuaguca

SEQ ID NO: 231340 - RNA, 22 nt, Homo sapiens
gcacuacugcacuccagucuag

SEQ ID NO: 231341 - RNA, 22 nt, Homo sapiens
gcacugagagaagccccaagua

SEQ ID NO: 231342 - RNA, 22 nt, Homo sapiens
gcagaauugguuucuucuaagg

SEQ ID NO: 231343 - RNA, 19 nt, Homo sapiens
gcagagaugugguagcuug

SEQ ID NO: 231344 - RNA, 22 nt, Homo sapiens
gcagaucuucgcgguaaguguu

SEQ ID NO: 231345 - RNA, 23 nt, Homo sapiens
gcagcaaugucacagggguccgg

SEQ ID NO: 231346 - RNA, 22 nt, Homo sapiens
gcagcacauggcagaacauauu

SEQ ID NO: 231347 - RNA, 22 nt, Homo sapiens
gcagcagugcccuggauggaaa

SEQ ID NO: 231348 - RNA, 22 nt, Homo sapiens
gcagcagugugggcugaaccua

SEQ ID NO: 231349 - RNA, 22 nt, Homo sapiens
gcagcaucaaaucacacaagau

SEQ ID NO: 231350 - RNA, 20 nt, Homo sapiens
gcaguacuuuuaguucuaag

SEQ ID NO: 231351 - RNA, 22 nt, Homo sapiens
gcaguagugcgaucucagcuca

SEQ ID NO: 231352 - RNA, 23 nt, Homo sapiens
gcagucauuuggaaaagguugaa

SEQ ID NO: 231353 - RNA, 22 nt, Homo sapiens
gcaguggugugugccagccuag

SEQ ID NO: 231354 - RNA, 22 nt, Homo sapiens
gcagugugugaggaauuugggu

SEQ ID NO: 231355 - RNA, 22 nt, Homo sapiens
gcaguguucugggcaggaagaa

SEQ ID NO: 231356 - RNA, 17 nt, Homo sapiens
gcauaugucgaaccagc

SEQ ID NO: 231357 - RNA, 22 nt, Homo sapiens
gcauaugucuuuauagcagcau

SEQ ID NO: 231358 - RNA, 17 nt, Homo sapiens
gcauauguugaaccagu

SEQ ID NO: 231359 - RNA, 22 nt, Homo sapiens
gcaucaaugucuauaguguuug

SEQ ID NO: 231360 - RNA, 22 nt, Homo sapiens
gcauggagcauacauuucuguu

SEQ ID NO: 231361 - RNA, 22 nt, Homo sapiens
gccaagaugcugcccacagaca

SEQ ID NO: 231362 - RNA, 22 nt, Homo sapiens
gccaguguuuuauugagaauuu

SEQ ID NO: 231363 - RNA, 22 nt, Homo sapiens
gccauugcacuacagccuaggc

SEQ ID NO: 231364 - RNA, 22 nt, Homo sapiens
gccauugcacuccgcccugggc

SEQ ID NO: 231365 - RNA, 20 nt, Homo sapiens
agcauugguuagaacaguag

SEQ ID NO: 231366 - RNA, 19 nt, Homo sapiens
agccaguuuucccagcacc

SEQ ID NO: 231367 - RNA, 22 nt, Homo sapiens
agcccagagacuguguaaauuu

SEQ ID NO: 231368 - RNA, 20 nt, Homo sapiens
agccccauguaaaccacaug

SEQ ID NO: 231369 - RNA, 23 nt, Homo sapiens
agcccugugacucgaacgaggag

SEQ ID NO: 231370 - RNA, 22 nt, Homo sapiens
agcccugugauuacuuuuauaa

SEQ ID NO: 231371 - RNA, 22 nt, Homo sapiens
agccgguguccacgaagaagag

SEQ ID NO: 231372 - RNA, 22 nt, Homo sapiens
agccuagagagccacuuugaga

SEQ ID NO: 231373 - RNA, 22 nt, Homo sapiens
agccucauucuacauguuaaug

SEQ ID NO: 231374 - RNA, 23 nt, Homo sapiens
agccuguugccuaggcagcucau

SEQ ID NO: 231375 - RNA, 22 nt, Homo sapiens
agcgguguuaggaaggugaggg

SEQ ID NO: 231376 - RNA, 22 nt, Homo sapiens
agcuacaucuugcucugggaug

SEQ ID NO: 231377 - RNA, 20 nt, Homo sapiens
agcuaguauuuccaugguua

SEQ ID NO: 231378 - RNA, 22 nt, Homo sapiens
agcuaguauuuucuuaaggauu

SEQ ID NO: 231379 - RNA, 22 nt, Homo sapiens
agcuaguauuuuguuaaggauu

SEQ ID NO: 231380 - RNA, 22 nt, Homo sapiens
agcuagugugauucuuuggggu

SEQ ID NO: 231381 - RNA, 22 nt, Homo sapiens
agcucacagccuagcacuguga

SEQ ID NO: 231382 - RNA, 22 nt, Homo sapiens
agcucauugcuguccuggagga

SEQ ID NO: 231383 - RNA, 22 nt, Homo sapiens
agcuccuacuguuacaucauug

SEQ ID NO: 231384 - RNA, 22 nt, Homo sapiens
agcugaguguuccaagagcgag

SEQ ID NO: 231385 - RNA, 22 nt, Homo sapiens
agcugcacgugguaaauguaaa

SEQ ID NO: 231386 - RNA, 22 nt, Homo sapiens
agcugcauuuacuuuugcacaa

SEQ ID NO: 231387 - RNA, 16 nt, Homo sapiens
agcuggaauuacaggc

SEQ ID NO: 231388 - RNA, 22 nt, Homo sapiens
agcuggaauuuaagguagauag

SEQ ID NO: 231389 - RNA, 22 nt, Homo sapiens
agcuggauguggaugacccugu

SEQ ID NO: 231390 - RNA, 20 nt, Homo sapiens
agcuggguguguuggugcau

SEQ ID NO: 231391 - RNA, 22 nt, Homo sapiens
agcugguauuuugucaaggaua

SEQ ID NO: 231392 - RNA, 22 nt, Homo sapiens
agcugguauuuugucgaggacu

SEQ ID NO: 231393 - RNA, 22 nt, Homo sapiens
agcugguccugugacuugcuuc

SEQ ID NO: 231394 - RNA, 22 nt, Homo sapiens
agcuggucuacguguguaugag

SEQ ID NO: 231395 - RNA, 22 nt, Homo sapiens
agcuggucuuggggaagaguag

SEQ ID NO: 231396 - RNA, 22 nt, Homo sapiens
agcugguuuauuucuauauccu

SEQ ID NO: 231397 - RNA, 22 nt, Homo sapiens
agcugguuuauuucucacaaca

SEQ ID NO: 231398 - RNA, 21 nt, Homo sapiens
agcugguuucuucuuacuccu

SEQ ID NO: 231399 - RNA, 22 nt, Homo sapiens
agcuguaguuugguggauguaa

SEQ ID NO: 231400 - RNA, 22 nt, Homo sapiens
agcuguuguacacuuuaccuuu

SEQ ID NO: 231401 - RNA, 22 nt, Homo sapiens
agcuuguccuccacccacacug

SEQ ID NO: 231402 - RNA, 22 nt, Homo sapiens
agcuugucuuauacuacuucau

SEQ ID NO: 231403 - RNA, 22 nt, Homo sapiens
agcuuguggugaauacugcuag

SEQ ID NO: 231404 - RNA, 22 nt, Homo sapiens
agcuuguguuugucugccuggg

SEQ ID NO: 231405 - RNA, 22 nt, Homo sapiens
agcuuguguuuuucuaaguauc

SEQ ID NO: 231406 - RNA, 22 nt, Homo sapiens
agcuuguuuuccugcaacuaga

SEQ ID NO: 231407 - RNA, 22 nt, Homo sapiens
aggaaauguuggucccauuucu

SEQ ID NO: 231408 - RNA, 22 nt, Homo sapiens
aggaagugugcaauuaauuucu

SEQ ID NO: 231409 - RNA, 22 nt, Homo sapiens
aggaauggaaacuuuugauggu

SEQ ID NO: 231410 - RNA, 22 nt, Homo sapiens
aggaaugucaaugguaguuuaa

SEQ ID NO: 231411 - RNA, 22 nt, Homo sapiens
aggacacugauagucuuuggca

SEQ ID NO: 231412 - RNA, 20 nt, Homo sapiens
aggacuacagaggguaggau

SEQ ID NO: 231413 - RNA, 22 nt, Homo sapiens
aggagaugaagcuuuaucuaaa

SEQ ID NO: 231414 - RNA, 22 nt, Homo sapiens
aggagcacaauggucaugugga

SEQ ID NO: 231415 - RNA, 18 nt, Homo sapiens
aggagcauagugcuauga

SEQ ID NO: 231416 - RNA, 19 nt, Homo sapiens
cuuugguugagcguguugg

SEQ ID NO: 231417 - RNA, 22 nt, Homo sapiens
cuuugguuuacuuggugcuagu

SEQ ID NO: 231418 - RNA, 23 nt, Homo sapiens
cuuuguacagcuugacuacuggg

SEQ ID NO: 231419 - RNA, 22 nt, Homo sapiens
cuuuguguggacauuucaggca

SEQ ID NO: 231420 - RNA, 22 nt, Homo sapiens
cuuuuacacugcuggugggaau

SEQ ID NO: 231421 - RNA, 22 nt, Homo sapiens
cuuuuacacuguuagugggaau

SEQ ID NO: 231422 - RNA, 22 nt, Homo sapiens
cuuuuacacuguuggcaggauu

SEQ ID NO: 231423 - RNA, 22 nt, Homo sapiens
cuuuuugcuagagucuaggguc

SEQ ID NO: 231424 - RNA, 22 nt, Homo sapiens
gaaaacugcuucucuggguuuc

SEQ ID NO: 231425 - RNA, 22 nt, Homo sapiens
gaaacugcauuucuaacaagcu

SEQ ID NO: 231426 - RNA, 22 nt, Homo sapiens
gaaagauuuuaacugggagacu

SEQ ID NO: 231427 - RNA, 22 nt, Homo sapiens
gaaaguguugagauuacaggca

SEQ ID NO: 231428 - RNA, 23 nt, Homo sapiens
gaaauguaagugaugccccacag

SEQ ID NO: 231429 - RNA, 22 nt, Homo sapiens
gaacccuggaggcggagguugc

SEQ ID NO: 231430 - RNA, 22 nt, Homo sapiens
gaacuggcuuagugaaacuucc

SEQ ID NO: 231431 - RNA, 22 nt, Homo sapiens
gaagaacuaggugagaucuaga

SEQ ID NO: 231432 - RNA, 22 nt, Homo sapiens
gaagaaguacaagacaaauuuu

SEQ ID NO: 231433 - RNA, 18 nt, Homo sapiens
gaagaaguaggcauggca

SEQ ID NO: 231434 - RNA, 22 nt, Homo sapiens
gaaggcacugugugccacccug

SEQ ID NO: 231435 - RNA, 22 nt, Homo sapiens
gaagguaguuuauagauguggu

SEQ ID NO: 231436 - RNA, 22 nt, Homo sapiens
gaagguauauucuguuaaugcu

SEQ ID NO: 231437 - RNA, 22 nt, Homo sapiens
gaagugcuuuuggacuaacagu

SEQ ID NO: 231438 - RNA, 22 nt, Homo sapiens
gaaucauuguuucuaaguuugu

SEQ ID NO: 231439 - RNA, 22 nt, Homo sapiens
gaauggaacugacuauagcuga

SEQ ID NO: 231440 - RNA, 20 nt, Homo sapiens
gaaugguuucgggguucuug

SEQ ID NO: 231441 - RNA, 22 nt, Homo sapiens
gaaugucuuauugcucguugua

SEQ ID NO: 231442 - RNA, 22 nt, Homo sapiens
gaauguuuacuuuguuuaauac

SEQ ID NO: 231443 - RNA, 22 nt, Homo sapiens
gaauugcacaaaaacugcuugu

SEQ ID NO: 231444 - RNA, 22 nt, Homo sapiens
gacagagcaagacccuauuuaa

SEQ ID NO: 231445 - RNA, 18 nt, Homo sapiens
gacagugugaagauuccu

SEQ ID NO: 231446 - RNA, 22 nt, Homo sapiens
gacaguguggcgauuccucaag

SEQ ID NO: 231447 - RNA, 17 nt, Homo sapiens
gacauaggaaaaggaga

SEQ ID NO: 231448 - RNA, 21 nt, Homo sapiens
gacauggcgauacuccgucuc

SEQ ID NO: 231449 - RNA, 22 nt, Homo sapiens
gacauguaaggcucucucuguu

SEQ ID NO: 231450 - RNA, 22 nt, Homo sapiens
gacauguuucucucuguuuacu

SEQ ID NO: 231451 - RNA, 22 nt, Homo sapiens
gacauguuuucauguauuugga

SEQ ID NO: 231452 - RNA, 21 nt, Homo sapiens
gaccacagcagggaaugucag

SEQ ID NO: 231453 - RNA, 22 nt, Homo sapiens
gaccacauuccacacaggcuuu

SEQ ID NO: 231454 - RNA, 22 nt, Homo sapiens
gaccccuagagauaggaggaac

SEQ ID NO: 231455 - RNA, 22 nt, Homo sapiens
gacccucuagagggaagcgcuu

SEQ ID NO: 231456 - RNA, 22 nt, Homo sapiens
gacccuuagaaugugaucuuau

SEQ ID NO: 231457 - RNA, 22 nt, Homo sapiens
gaccugagagguacauguauuu

SEQ ID NO: 231458 - RNA, 22 nt, Homo sapiens
gaccuuguagaaucucaugauu

SEQ ID NO: 231459 - RNA, 22 nt, Homo sapiens
gacuacaacuucuauuauucag

SEQ ID NO: 231460 - RNA, 22 nt, Homo sapiens
gacuagauauuguucuauguca

SEQ ID NO: 231461 - RNA, 18 nt, Homo sapiens
gacucaguuucuaaggca

SEQ ID NO: 231462 - RNA, 22 nt, Homo sapiens
gacuugaagaaucuaagggagg

SEQ ID NO: 231463 - RNA, 18 nt, Homo sapiens
gacuuggaguuuacagug

SEQ ID NO: 231464 - RNA, 22 nt, Homo sapiens
gagaacauacggcauuugguuu

SEQ ID NO: 231465 - RNA, 22 nt, Homo sapiens
gagaaccauuuggagaaaaagu

SEQ ID NO: 231466 - RNA, 21 nt, Homo sapiens
gagaaucaucauggcugcaua

SEQ ID NO: 231467 - RNA, 22 nt, Homo sapiens
gagacauguuugccaauaauuu

SEQ ID NO: 231468 - RNA, 22 nt, Homo sapiens
gagacauugacuuuguuccaga

SEQ ID NO: 231469 - RNA, 22 nt, Homo sapiens
gagaccauuuacugccuacuua

SEQ ID NO: 231470 - RNA, 22 nt, Homo sapiens
gagacggagucucgcucuguca

SEQ ID NO: 231471 - RNA, 22 nt, Homo sapiens
gagacuaaagagcuugcccugg

SEQ ID NO: 231472 - RNA, 22 nt, Homo sapiens
gagacugagucucacucuguca

SEQ ID NO: 231473 - RNA, 22 nt, Homo sapiens
gagacugagucuugcccuguca

SEQ ID NO: 231474 - RNA, 22 nt, Homo sapiens
gagacugagucuugcucuguca

SEQ ID NO: 231475 - RNA, 22 nt, Homo sapiens
gagacugaguuuugcucuuguu

SEQ ID NO: 231476 - RNA, 22 nt, Homo sapiens
gagagcauuaagccaucaucau

SEQ ID NO: 231477 - RNA, 22 nt, Homo sapiens
gagagguaguuuuuuggucguc

SEQ ID NO: 231478 - RNA, 22 nt, Homo sapiens
gagaggucguauaugauuucug

SEQ ID NO: 231479 - RNA, 22 nt, Homo sapiens
gagagugcuuuggguguaggcc

SEQ ID NO: 231480 - RNA, 21 nt, Homo sapiens
gagauagguaccgaagcuuag

SEQ ID NO: 231481 - RNA, 22 nt, Homo sapiens
gagauauguuggcagcugguau

SEQ ID NO: 231482 - RNA, 22 nt, Homo sapiens
gagauauuauuucccuuucaca

SEQ ID NO: 231483 - RNA, 22 nt, Homo sapiens
gagauauucugguuuacuaaau

SEQ ID NO: 231484 - RNA, 22 nt, Homo sapiens
gagauauuuagaaauguguucu

SEQ ID NO: 231485 - RNA, 22 nt, Homo sapiens
gagaucaaguauucuccacuaa

SEQ ID NO: 231486 - RNA, 22 nt, Homo sapiens
gagaucaugcugguucucucau

SEQ ID NO: 231487 - RNA, 22 nt, Homo sapiens
gagaucauuaugucagggguca

SEQ ID NO: 231488 - RNA, 22 nt, Homo sapiens
gagaucauucugauccagaguc

SEQ ID NO: 231489 - RNA, 22 nt, Homo sapiens
gagaucuuuaagaacuacugcu

SEQ ID NO: 231490 - RNA, 22 nt, Homo sapiens
gagauggagucuuuuucuguca

SEQ ID NO: 231491 - RNA, 22 nt, Homo sapiens
gagauggaguuucacuucgcuc

SEQ ID NO: 231492 - RNA, 22 nt, Homo sapiens
gagauguagucuugcccuguca

SEQ ID NO: 231493 - RNA, 22 nt, Homo sapiens
gagauguuuguuucacugucac

SEQ ID NO: 231494 - RNA, 22 nt, Homo sapiens
gagauuauuagauguucugcuu

SEQ ID NO: 231495 - RNA, 22 nt, Homo sapiens
gagauucaucuagguccagaga

SEQ ID NO: 231496 - RNA, 22 nt, Homo sapiens
gagauucuucaauauuuauucu

SEQ ID NO: 231497 - RNA, 22 nt, Homo sapiens
gagcaaugagcugccugcugag

SEQ ID NO: 231498 - RNA, 22 nt, Homo sapiens
gagcacauaugacauuuucuuc

SEQ ID NO: 231499 - RNA, 21 nt, Homo sapiens
gagcacauuguccucuaacgc

SEQ ID NO: 231500 - RNA, 22 nt, Homo sapiens
gagcacugaauacugugguggu

SEQ ID NO: 231501 - RNA, 22 nt, Homo sapiens
gagcagacaugaggaccgcugg

SEQ ID NO: 231502 - RNA, 22 nt, Homo sapiens
gagcaucauucaacaaaagucu

SEQ ID NO: 231503 - RNA, 22 nt, Homo sapiens
gagccuguaggaggagaggugg

SEQ ID NO: 231504 - RNA, 22 nt, Homo sapiens
gagcuacacugauucauuuguu

SEQ ID NO: 231505 - RNA, 22 nt, Homo sapiens
gagcuagcauuuagacaucugg

SEQ ID NO: 231506 - RNA, 20 nt, Homo sapiens
gagcucaucuucuuuaccac

SEQ ID NO: 231507 - RNA, 22 nt, Homo sapiens
gagcucauuaaaaauguagaau

SEQ ID NO: 231508 - RNA, 22 nt, Homo sapiens
gagcugaucuuuucugauucca

SEQ ID NO: 231509 - RNA, 22 nt, Homo sapiens
gagcuuggguuaaaguugccuu

SEQ ID NO: 231510 - RNA, 22 nt, Homo sapiens
gagcuuguagugugaaugguau

SEQ ID NO: 231511 - RNA, 22 nt, Homo sapiens
gaggaguagggcacaaagccuu

SEQ ID NO: 231512 - RNA, 22 nt, Homo sapiens
gaggagucagacugugcaaggu

SEQ ID NO: 231513 - RNA, 22 nt, Homo sapiens
gaggcagucugacccuuagcag

SEQ ID NO: 231514 - RNA, 18 nt, Homo sapiens
aaaaagugcucaggccua

SEQ ID NO: 231515 - RNA, 22 nt, Homo sapiens
aaaagagcugagagguauucuu

SEQ ID NO: 231516 - RNA, 22 nt, Homo sapiens
aaaagcuuagaugggcuuguau

SEQ ID NO: 231517 - RNA, 22 nt, Homo sapiens
aaaaguucuuugagccuugaca

SEQ ID NO: 231518 - RNA, 22 nt, Homo sapiens
aaacaccacgcggucccucgga

SEQ ID NO: 231519 - RNA, 22 nt, Homo sapiens
aaacagucuucuccugagggac

SEQ ID NO: 231520 - RNA, 18 nt, Homo sapiens
aaacagugucucuuucug

SEQ ID NO: 231521 - RNA, 22 nt, Homo sapiens
aaacauugaccucauccuggca

SEQ ID NO: 231522 - RNA, 22 nt, Homo sapiens
aaaccacagugugcugcugggg

SEQ ID NO: 231523 - RNA, 15 nt, Homo sapiens
aaacccugucucaag

SEQ ID NO: 231524 - RNA, 20 nt, Homo sapiens
aaacucugucuucuuuauca

SEQ ID NO: 231525 - RNA, 22 nt, Homo sapiens
aaacuugucuaauuauaagcau

SEQ ID NO: 231526 - RNA, 22 nt, Homo sapiens
aaagaagucagccuguccuuug

SEQ ID NO: 231527 - RNA, 23 nt, Homo sapiens
aaagacuagucaggugcaguggu

SEQ ID NO: 231528 - RNA, 22 nt, Homo sapiens
aaagagaucuaugggcacuaug

SEQ ID NO: 231529 - RNA, 22 nt, Homo sapiens
aaagagcugagaccugguggag

SEQ ID NO: 231530 - RNA, 22 nt, Homo sapiens
aaagcaucacuuuuccuacuuu

SEQ ID NO: 231531 - RNA, 22 nt, Homo sapiens
aaagcuaagguagcauuggaga

SEQ ID NO: 231532 - RNA, 22 nt, Homo sapiens
aaaggauucuaauggaaaugcu

SEQ ID NO: 231533 - RNA, 22 nt, Homo sapiens
aaaggcacugugacuuuauagg

SEQ ID NO: 231534 - RNA, 22 nt, Homo sapiens
aaaggcaucugcucggcucccu

SEQ ID NO: 231535 - RNA, 22 nt, Homo sapiens
aaaggcuucggaucagaaggua

SEQ ID NO: 231536 - RNA, 22 nt, Homo sapiens
aaagggcuuuguaaacuucaag

SEQ ID NO: 231537 - RNA, 22 nt, Homo sapiens
aaaguacucaguucaguuccgu

SEQ ID NO: 231538 - RNA, 19 nt, Homo sapiens
aaaguacucugaugccucu

SEQ ID NO: 231539 - RNA, 22 nt, Homo sapiens
aaaguaguagcaguuucugcca

SEQ ID NO: 231540 - RNA, 22 nt, Homo sapiens
aaagucuguuuugucagagacu

SEQ ID NO: 231541 - RNA, 22 nt, Homo sapiens
aaagugaauguaucccguaagu

SEQ ID NO: 231542 - RNA, 22 nt, Homo sapiens
aaagugacuuagugccccauuu

SEQ ID NO: 231543 - RNA, 22 nt, Homo sapiens
aaagugauugcgguuuuugcca

SEQ ID NO: 231544 - RNA, 22 nt, Homo sapiens
aaagugcacuuggaagagggcc

SEQ ID NO: 231545 - RNA, 22 nt, Homo sapiens
aaagugcaguauuugggcagga

SEQ ID NO: 231546 - RNA, 22 nt, Homo sapiens
aaagugcugagaguucuaacuu

SEQ ID NO: 231547 - RNA, 22 nt, Homo sapiens
aaagugcugagucuaggcgggg

SEQ ID NO: 231548 - RNA, 22 nt, Homo sapiens
aaagugcuuccuuuuugagggu

SEQ ID NO: 231549 - RNA, 22 nt, Homo sapiens
aaaguucugcguuagggcuaaa

SEQ ID NO: 231550 - RNA, 22 nt, Homo sapiens
aaaguucuugcugaaggauuau

SEQ ID NO: 231551 - RNA, 22 nt, Homo sapiens
aaauaacugucagguucuggaa

SEQ ID NO: 231552 - RNA, 22 nt, Homo sapiens
aaauaguagcugaaugagggaa

SEQ ID NO: 231553 - RNA, 22 nt, Homo sapiens
aaaugcagauucugcuuagguu

SEQ ID NO: 231554 - RNA, 22 nt, Homo sapiens
aaaugcaguugguggggauaug

SEQ ID NO: 231555 - RNA, 22 nt, Homo sapiens
aaaugcaugaggugggaagaaa

SEQ ID NO: 231556 - RNA, 22 nt, Homo sapiens
aaaugcucuguggguaguaaug

SEQ ID NO: 231557 - RNA, 22 nt, Homo sapiens
aaaugcucuuuaugaaguugga

SEQ ID NO: 231558 - RNA, 22 nt, Homo sapiens
aaaugcuguuccaggaccuauc

SEQ ID NO: 231559 - RNA, 22 nt, Homo sapiens
aaauggcaccggcucuucccuc

SEQ ID NO: 231560 - RNA, 22 nt, Homo sapiens
aaaugguguuaguagaucuuua

SEQ ID NO: 231561 - RNA, 22 nt, Homo sapiens
aaaugucauggaguguuucccc

SEQ ID NO: 231562 - RNA, 21 nt, Homo sapiens
aaaugugcuuuaguacccuca

SEQ ID NO: 231563 - RNA, 22 nt, Homo sapiens
aaauucaucaaaugguuuguau

SEQ ID NO: 231564 - RNA, 22 nt, Homo sapiens
aaauucaugucaccucuaggua

SEQ ID NO: 231565 - RNA, 22 nt, Homo sapiens
aaauugcacaaguggugauuug

SEQ ID NO: 231566 - RNA, 22 nt, Homo sapiens
aaauugcauugagcugcuuauu

SEQ ID NO: 231567 - RNA, 22 nt, Homo sapiens
aaauugcuuuugaagacuuagu

SEQ ID NO: 231568 - RNA, 22 nt, Homo sapiens
aacagauugcugagccccaccc

SEQ ID NO: 231569 - RNA, 22 nt, Homo sapiens
aacagcacacccgcugcuucca

SEQ ID NO: 231570 - RNA, 22 nt, Homo sapiens
aacaggguggugccugguccau

SEQ ID NO: 231571 - RNA, 22 nt, Homo sapiens
aacagugcauuccuguccauau

SEQ ID NO: 231572 - RNA, 22 nt, Homo sapiens
aacagugcuucauucacacauu

SEQ ID NO: 231573 - RNA, 20 nt, Homo sapiens
aacaguguguaaguuuccuu

SEQ ID NO: 231574 - RNA, 22 nt, Homo sapiens
aacauguuuagcagauaccugu

SEQ ID NO: 231575 - RNA, 22 nt, Homo sapiens
aacccugacacaagcagaauuu

SEQ ID NO: 231576 - RNA, 22 nt, Homo sapiens
aaccuacauucuuaacuguugc

SEQ ID NO: 231577 - RNA, 22 nt, Homo sapiens
aaccuuuagucagcucuuagga

SEQ ID NO: 231578 - RNA, 22 nt, Homo sapiens
aacuaugucaaauaaaaugagg

SEQ ID NO: 231579 - RNA, 22 nt, Homo sapiens
aacuggccuggcgugcagaggg

SEQ ID NO: 231580 - RNA, 22 nt, Homo sapiens
aacugguauuucccaugaauuu

SEQ ID NO: 231581 - RNA, 22 nt, Homo sapiens
aacuggucuuaugcaagcacua

SEQ ID NO: 231582 - RNA, 21 nt, Homo sapiens
aacuggugugagaugguaugu

SEQ ID NO: 231583 - RNA, 21 nt, Homo sapiens
aagaaagcuggacuugccgcu

SEQ ID NO: 231584 - RNA, 20 nt, Homo sapiens
aagagcucaccagaauaucu

SEQ ID NO: 231585 - RNA, 22 nt, Homo sapiens
aagaggccuaggaaucuguauu

SEQ ID NO: 231586 - RNA, 22 nt, Homo sapiens
aagagguagaagcuugccuucu

SEQ ID NO: 231587 - RNA, 22 nt, Homo sapiens
aagagguaggaaauggucauuu

SEQ ID NO: 231588 - RNA, 22 nt, Homo sapiens
aagauagcuaagcuucuucuaa

SEQ ID NO: 231589 - RNA, 22 nt, Homo sapiens
aagaugcagucauacuggagga

SEQ ID NO: 231590 - RNA, 22 nt, Homo sapiens
aagcacaauuucaccuucuugu

SEQ ID NO: 231591 - RNA, 22 nt, Homo sapiens
aagcaccaauaggagauuuguc

SEQ ID NO: 231592 - RNA, 22 nt, Homo sapiens
aagcaccguugccuccccugca

SEQ ID NO: 231593 - RNA, 22 nt, Homo sapiens
aagcagacauguucauuuugaa

SEQ ID NO: 231594 - RNA, 22 nt, Homo sapiens
aagcagauguguugaaaguacu

SEQ ID NO: 231595 - RNA, 22 nt, Homo sapiens
aagcaucauuuggaauuugaga

SEQ ID NO: 231596 - RNA, 22 nt, Homo sapiens
aagcauccagcauggaacugaa

SEQ ID NO: 231597 - RNA, 22 nt, Homo sapiens
aagccacuguaccugucucuua

SEQ ID NO: 231598 - RNA, 22 nt, Homo sapiens
aagcuagugagacagugguacu

SEQ ID NO: 231599 - RNA, 22 nt, Homo sapiens
aagcugccuugugaaggcauuc

SEQ ID NO: 231600 - RNA, 22 nt, Homo sapiens
aagcuggagugcaguggugcaa

SEQ ID NO: 231601 - RNA, 22 nt, Homo sapiens
aagcuggcauucaugagauuac

SEQ ID NO: 231602 - RNA, 22 nt, Homo sapiens
aagcuggcuuucauugagugcu

SEQ ID NO: 231603 - RNA, 22 nt, Homo sapiens
aagcugguguguauuauucacu

SEQ ID NO: 231604 - RNA, 22 nt, Homo sapiens
aagcuguauuguguugcuauaa

SEQ ID NO: 231605 - RNA, 22 nt, Homo sapiens
aaggaauacuggugguugcuau

SEQ ID NO: 231606 - RNA, 23 nt, Homo sapiens
aaggacacugaacacuucccagc

SEQ ID NO: 231607 - RNA, 22 nt, Homo sapiens
aaggaguagaauagaugcaccu

SEQ ID NO: 231608 - RNA, 22 nt, Homo sapiens
aaggaguaucuguuuucucacc

SEQ ID NO: 231609 - RNA, 22 nt, Homo sapiens
aaggaguauugaaugaccaagu

SEQ ID NO: 231610 - RNA, 22 nt, Homo sapiens
aaggaguguggugaucuugggc

SEQ ID NO: 231611 - RNA, 22 nt, Homo sapiens
aaggcaagaaaauggauucucc

SEQ ID NO: 231612 - RNA, 22 nt, Homo sapiens
aaggcaagaaugcgugcuuuca

SEQ ID NO: 231613 - RNA, 22 nt, Homo sapiens
aaggcaagauacugguugcuga

SEQ ID NO: 231614 - RNA, 22 nt, Homo sapiens
aaggcagucacuaaauagugag

SEQ ID NO: 231615 - RNA, 22 nt, Homo sapiens
aaggcaugcaaagaacauuuua

SEQ ID NO: 231616 - RNA, 22 nt, Homo sapiens
aaggcaugcaguacguuucuau

SEQ ID NO: 231617 - RNA, 22 nt, Homo sapiens
aaggcuagagaagaagggcauc

SEQ ID NO: 231618 - RNA, 22 nt, Homo sapiens
cauacaagcuacaaucacaaag

SEQ ID NO: 231619 - RNA, 22 nt, Homo sapiens
cauagcacacauuuaccuaugu

SEQ ID NO: 231620 - RNA, 22 nt, Homo sapiens
cauauaguaguacuguuagguu

SEQ ID NO: 231621 - RNA, 22 nt, Homo sapiens
cauauucacuuuacagagcugu

SEQ ID NO: 231622 - RNA, 19 nt, Homo sapiens
caucacagagucuuccauu

SEQ ID NO: 231623 - RNA, 22 nt, Homo sapiens
caucacaucugcaugguaagua

SEQ ID NO: 231624 - RNA, 22 nt, Homo sapiens
caucacuuugccuccgucucua

SEQ ID NO: 231625 - RNA, 22 nt, Homo sapiens
caucagcaauguaugaggguuc

SEQ ID NO: 231626 - RNA, 22 nt, Homo sapiens
caucccugucgucaagucucug

SEQ ID NO: 231627 - RNA, 22 nt, Homo sapiens
caucgcacuccagccugggcaa

SEQ ID NO: 231628 - RNA, 22 nt, Homo sapiens
caugaaagacugaggaauugga

SEQ ID NO: 231629 - RNA, 22 nt, Homo sapiens
caugacacauguuuaccuaugu

SEQ ID NO: 231630 - RNA, 22 nt, Homo sapiens
caugcauuggucuauuauguga

SEQ ID NO: 231631 - RNA, 22 nt, Homo sapiens
caugccacugcacuccaaccug

SEQ ID NO: 231632 - RNA, 22 nt, Homo sapiens
caugccauugcucuccugggug

SEQ ID NO: 231633 - RNA, 22 nt, Homo sapiens
cauggcacuguaugaaaugugc

SEQ ID NO: 231634 - RNA, 22 nt, Homo sapiens
gaacuuucuacauuaccucuuu

SEQ ID NO: 231635 - RNA, 22 nt, Homo sapiens
gaagacauuuacaugggagacc

SEQ ID NO: 231636 - RNA, 22 nt, Homo sapiens
gaagacauuugcugcacguccu

SEQ ID NO: 231637 - RNA, 22 nt, Homo sapiens
gaagauguugcuuaccuuggag

SEQ ID NO: 231638 - RNA, 22 nt, Homo sapiens
gaaggugcuuggugaaugcauu

SEQ ID NO: 231639 - RNA, 23 nt, Homo sapiens
gaaguaauaaauggauucuuaac

SEQ ID NO: 231640 - RNA, 22 nt, Homo sapiens
gaaguaguaaaauuuauugcag

SEQ ID NO: 231641 - RNA, 22 nt, Homo sapiens
gaagugguaggauugcuuuuga

SEQ ID NO: 231642 - RNA, 17 nt, Homo sapiens
gaaguguuucuucauga

SEQ ID NO: 231643 - RNA, 19 nt, Homo sapiens
gaaguguuuguucuccaug

SEQ ID NO: 231644 - RNA, 22 nt, Homo sapiens
gaauaaacuagagaggacugag

SEQ ID NO: 231645 - RNA, 22 nt, Homo sapiens
gaauagugcugcagcaaacaua

SEQ ID NO: 231646 - RNA, 22 nt, Homo sapiens
gaauagugcugcaguaaacaua

SEQ ID NO: 231647 - RNA, 22 nt, Homo sapiens
gaaucaauugaucuaugugucu

SEQ ID NO: 231648 - RNA, 22 nt, Homo sapiens
gaaucacagauuaugaguaucu

SEQ ID NO: 231649 - RNA, 22 nt, Homo sapiens
gaaucauuggguugauucaaga

SEQ ID NO: 231650 - RNA, 22 nt, Homo sapiens
gaaugaauguuuauccuuagau

SEQ ID NO: 231651 - RNA, 22 nt, Homo sapiens
gaaugcuaaguuuccucccuau

SEQ ID NO: 231652 - RNA, 22 nt, Homo sapiens
gaaugcuaaguuuccucccugu

SEQ ID NO: 231653 - RNA, 21 nt, Homo sapiens
gaauggcaccauuagcauaua

SEQ ID NO: 231654 - RNA, 22 nt, Homo sapiens
gaaugguaaacuuccaugacug

SEQ ID NO: 231655 - RNA, 22 nt, Homo sapiens
gaaugguuuacaaguguaaucu

SEQ ID NO: 231656 - RNA, 22 nt, Homo sapiens
gaauucugucgcuuacuagaug

SEQ ID NO: 231657 - RNA, 22 nt, Homo sapiens
gaauuguacugcaaucagggga

SEQ ID NO: 231658 - RNA, 22 nt, Homo sapiens
auagcaucauuucuugaaaaga

SEQ ID NO: 231659 - RNA, 22 nt, Homo sapiens
auagcugcucaggcuuuccuca

SEQ ID NO: 231660 - RNA, 22 nt, Homo sapiens
auaggaguacaaacccuauugg

SEQ ID NO: 231661 - RNA, 22 nt, Homo sapiens
auaggagugugaacccuaucgu

SEQ ID NO: 231662 - RNA, 22 nt, Homo sapiens
auaggcacauuaggaacuuuug

SEQ ID NO: 231663 - RNA, 22 nt, Homo sapiens
auagguauuuuuaaaugacugu

SEQ ID NO: 231664 - RNA, 22 nt, Homo sapiens
auagguuuucacuguagauucu

SEQ ID NO: 231665 - RNA, 22 nt, Homo sapiens
auagugcugcaacaaauauacg

SEQ ID NO: 231666 - RNA, 22 nt, Homo sapiens
auagugcugcaauaaacacacg

SEQ ID NO: 231667 - RNA, 22 nt, Homo sapiens
auagugcugcaauuaacauaca

SEQ ID NO: 231668 - RNA, 22 nt, Homo sapiens
auagugcuguauuaaacauacg

SEQ ID NO: 231669 - RNA, 22 nt, Homo sapiens
auagugcugugaugaacauaca

SEQ ID NO: 231670 - RNA, 19 nt, Homo sapiens
auaguguaggaaaacagcu

SEQ ID NO: 231671 - RNA, 22 nt, Homo sapiens
auauaccuaggcuacaugguuu

SEQ ID NO: 231672 - RNA, 22 nt, Homo sapiens
auaucugcauugccauuuaugu

SEQ ID NO: 231673 - RNA, 17 nt, Homo sapiens
auaugaauuuuggagau

SEQ ID NO: 231674 - RNA, 22 nt, Homo sapiens
auaugacuuuccucuacuuccu

SEQ ID NO: 231675 - RNA, 20 nt, Homo sapiens
auaugguugugagugauuuu

SEQ ID NO: 231676 - RNA, 22 nt, Homo sapiens
auaugucuguuuagucuguaau

SEQ ID NO: 231677 - RNA, 22 nt, Homo sapiens
auauucaagugaggauggcuaa

SEQ ID NO: 231678 - RNA, 22 nt, Homo sapiens
auauuggccuaaaauucucuuu

SEQ ID NO: 231679 - RNA, 22 nt, Homo sapiens
auauuggucuucaagaccugug

SEQ ID NO: 231680 - RNA, 22 nt, Homo sapiens
auauugguuaaauauuauguga

SEQ ID NO: 231681 - RNA, 22 nt, Homo sapiens
auauuugguuaccugugggucu

SEQ ID NO: 231682 - RNA, 20 nt, Homo sapiens
aucaaagacuuagaggggga

SEQ ID NO: 231683 - RNA, 22 nt, Homo sapiens
aucaaagugaauuaaugagaau

SEQ ID NO: 231684 - RNA, 22 nt, Homo sapiens
aucaaaguuucccagaaguugu

SEQ ID NO: 231685 - RNA, 22 nt, Homo sapiens
aucaagccaaagaaaguccuug

SEQ ID NO: 231686 - RNA, 22 nt, Homo sapiens
aucaagcugcuuguuugaaucu

SEQ ID NO: 231687 - RNA, 22 nt, Homo sapiens
aucaaguaguuauacguaaagg

SEQ ID NO: 231688 - RNA, 22 nt, Homo sapiens
aucacacucaccuucuguccuu

SEQ ID NO: 231689 - RNA, 22 nt, Homo sapiens
aucacagaacuuugagcagaga

SEQ ID NO: 231690 - RNA, 22 nt, Homo sapiens
aucacagcccuccucuuggaug

SEQ ID NO: 231691 - RNA, 22 nt, Homo sapiens
aucacagugaaaacagucaauu

SEQ ID NO: 231692 - RNA, 20 nt, Homo sapiens
aucaccacagcucguucaug

SEQ ID NO: 231693 - RNA, 22 nt, Homo sapiens
aucaccagaugcuucaagcaga

SEQ ID NO: 231694 - RNA, 19 nt, Homo sapiens
aucaccauuauuuggaaca

SEQ ID NO: 231695 - RNA, 20 nt, Homo sapiens
aucacuggagaaggaaaccu

SEQ ID NO: 231696 - RNA, 22 nt, Homo sapiens
aucacuggucaugagagaagua

SEQ ID NO: 231697 - RNA, 22 nt, Homo sapiens
aucacuguccacucaucuuucu

SEQ ID NO: 231698 - RNA, 23 nt, Homo sapiens
aucacuguuaacaauuucuuccu

SEQ ID NO: 231699 - RNA, 22 nt, Homo sapiens
aucacuuugcucuccagugugg

SEQ ID NO: 231700 - RNA, 21 nt, Homo sapiens
aucagagacccaggcuuccuc

SEQ ID NO: 231701 - RNA, 20 nt, Homo sapiens
aucagagacuaggauugcca

SEQ ID NO: 231702 - RNA, 20 nt, Homo sapiens
aucagagccggugaaagggc

SEQ ID NO: 231703 - RNA, 22 nt, Homo sapiens
aucagagccugugugcccugaa

SEQ ID NO: 231704 - RNA, 22 nt, Homo sapiens
aucagagugaauaaugacaaaa

SEQ ID NO: 231705 - RNA, 22 nt, Homo sapiens
aucagauuccacauuuuaucag

SEQ ID NO: 231706 - RNA, 22 nt, Homo sapiens
aucaggaaccuuuuuggugugu

SEQ ID NO: 231707 - RNA, 23 nt, Homo sapiens
aucagguuguagaauguguuugc

SEQ ID NO: 231708 - RNA, 22 nt, Homo sapiens
aucagucacugcguuuuuggga

SEQ ID NO: 231709 - RNA, 22 nt, Homo sapiens
aucagugaaagugaaaucuccg

SEQ ID NO: 231710 - RNA, 22 nt, Homo sapiens
aucagugauugauuuaaagacg

SEQ ID NO: 231711 - RNA, 22 nt, Homo sapiens
aucagugcauaguauuuaauga

SEQ ID NO: 231712 - RNA, 22 nt, Homo sapiens
aucagugcauguuuguugagcu

SEQ ID NO: 231713 - RNA, 22 nt, Homo sapiens
aucauagcucacugcagccucg

SEQ ID NO: 231714 - RNA, 22 nt, Homo sapiens
aucauaucauuggugaacagug

SEQ ID NO: 231715 - RNA, 21 nt, Homo sapiens
aucauaugcucacuccuagaa

SEQ ID NO: 231716 - RNA, 22 nt, Homo sapiens
aucaucaugcacuacagccugg

SEQ ID NO: 231717 - RNA, 22 nt, Homo sapiens
aucaugcacaugcauagguaug

SEQ ID NO: 231718 - RNA, 22 nt, Homo sapiens
aucauuaguuguggaauucuug

SEQ ID NO: 231719 - RNA, 22 nt, Homo sapiens
aucauugugugaguugauggga

SEQ ID NO: 231720 - RNA, 22 nt, Homo sapiens
auccauugcucaagagaaguca

SEQ ID NO: 231721 - RNA, 22 nt, Homo sapiens
aucccugugauccaaucacuuc

SEQ ID NO: 231722 - RNA, 22 nt, Homo sapiens
aucccuguguccagcaccugug

SEQ ID NO: 231723 - RNA, 22 nt, Homo sapiens
auccucugagaucuaggcagag

SEQ ID NO: 231724 - RNA, 22 nt, Homo sapiens
auccugagacuuugcugaaguu

SEQ ID NO: 231725 - RNA, 22 nt, Homo sapiens
auccuguacuaagguuuuccca

SEQ ID NO: 231726 - RNA, 22 nt, Homo sapiens
auccuguagucucacagcccca

SEQ ID NO: 231727 - RNA, 22 nt, Homo sapiens
aagugcaaauucccaggcucug

SEQ ID NO: 231728 - RNA, 22 nt, Homo sapiens
aagugcacuguaagugcaggau

SEQ ID NO: 231729 - RNA, 22 nt, Homo sapiens
aagugcauguauuaguguaguc

SEQ ID NO: 231730 - RNA, 21 nt, Homo sapiens
aagugcucugggacucuaaau

SEQ ID NO: 231731 - RNA, 22 nt, Homo sapiens
aagugcuuaggauagugugugg

SEQ ID NO: 231732 - RNA, 22 nt, Homo sapiens
aaguggaauguuuguggcacaa

SEQ ID NO: 231733 - RNA, 17 nt, Homo sapiens
aaguggcuuguucacca

SEQ ID NO: 231734 - RNA, 22 nt, Homo sapiens
aagugguguuugggagcuggac

SEQ ID NO: 231735 - RNA, 19 nt, Homo sapiens
aagugguuuaaacuuguau

SEQ ID NO: 231736 - RNA, 22 nt, Homo sapiens
aaguguaugaaacaguccaugg

SEQ ID NO: 231737 - RNA, 22 nt, Homo sapiens
aaguuaauguuuaagacuccua

SEQ ID NO: 231738 - RNA, 21 nt, Homo sapiens
aauaaagcaaccuuaugccau

SEQ ID NO: 231739 - RNA, 22 nt, Homo sapiens
aauaaagcagcuuuuugggacu

SEQ ID NO: 231740 - RNA, 22 nt, Homo sapiens
aauaaagccugucucuuuagag

SEQ ID NO: 231741 - RNA, 22 nt, Homo sapiens
aauaaagucugaagugugcuua

SEQ ID NO: 231742 - RNA, 20 nt, Homo sapiens
aauaacagccccagggaggu

SEQ ID NO: 231743 - RNA, 22 nt, Homo sapiens
aauaaguugagaugaggucaua

SEQ ID NO: 231744 - RNA, 22 nt, Homo sapiens
aauacugagaugugagguacua

SEQ ID NO: 231745 - RNA, 22 nt, Homo sapiens
aauagcauugaaucuaccaauu

SEQ ID NO: 231746 - RNA, 22 nt, Homo sapiens
aauagcuguccuuagaagugug

SEQ ID NO: 231747 - RNA, 22 nt, Homo sapiens
aauaucacaguggguguacacc

SEQ ID NO: 231748 - RNA, 22 nt, Homo sapiens
aauaugucugcuaauuguuucu

SEQ ID NO: 231749 - RNA, 19 nt, Homo sapiens
aauauugacaguggugucu

SEQ ID NO: 231750 - RNA, 22 nt, Homo sapiens
aaucacagccagcuuccgcuau

SEQ ID NO: 231751 - RNA, 22 nt, Homo sapiens
aaucacaguuaguaagggagaa

SEQ ID NO: 231752 - RNA, 22 nt, Homo sapiens
aaucacauuaaugcucccucag

SEQ ID NO: 231753 - RNA, 17 nt, Homo sapiens
aaucagauuucugagga

SEQ ID NO: 231754 - RNA, 22 nt, Homo sapiens
aauccaugugcuuuaccauuuu

SEQ ID NO: 231755 - RNA, 16 nt, Homo sapiens
aauccauuggcccugc

SEQ ID NO: 231756 - RNA, 22 nt, Homo sapiens
aaucccugagcuagacacaaag

SEQ ID NO: 231757 - RNA, 22 nt, Homo sapiens
aaucccuuuguccagucucuuu

SEQ ID NO: 231758 - RNA, 22 nt, Homo sapiens
aaucgcuuuugguaggcaagga

SEQ ID NO: 231759 - RNA, 22 nt, Homo sapiens
aaucucagagauaucugugucc

SEQ ID NO: 231760 - RNA, 22 nt, Homo sapiens
aaucugucaguuuuguguuaau

SEQ ID NO: 231761 - RNA, 22 nt, Homo sapiens
aaugacccugauuggcaaguug

SEQ ID NO: 231762 - RNA, 22 nt, Homo sapiens
aaugacuaagaugguacauuuu

SEQ ID NO: 231763 - RNA, 22 nt, Homo sapiens
aaugauauguuauguuuagguu

SEQ ID NO: 231764 - RNA, 22 nt, Homo sapiens
aaugcacauaaaauccuccagg

SEQ ID NO: 231765 - RNA, 22 nt, Homo sapiens
aaugcuguguuauuucaugacc

SEQ ID NO: 231766 - RNA, 22 nt, Homo sapiens
aauggagcugaguggccuuggg

SEQ ID NO: 231767 - RNA, 22 nt, Homo sapiens
aauggcacacaccuggucuaac

SEQ ID NO: 231768 - RNA, 22 nt, Homo sapiens
aauggcaucuagaguggugaau

SEQ ID NO: 231769 - RNA, 20 nt, Homo sapiens
aauggcauguuggacaacug

SEQ ID NO: 231770 - RNA, 22 nt, Homo sapiens
aauggcucuuccuggaguugug

SEQ ID NO: 231771 - RNA, 22 nt, Homo sapiens
aauggcucuuuaggcaauagau

SEQ ID NO: 231772 - RNA, 22 nt, Homo sapiens
aaugguuuuaucagcguccaaa

SEQ ID NO: 231773 - RNA, 22 nt, Homo sapiens
aaugugcacuauuagggugaua

SEQ ID NO: 231774 - RNA, 22 nt, Homo sapiens
aaugugccuacagugggcuguu

SEQ ID NO: 231775 - RNA, 22 nt, Homo sapiens
aaugugcuuugaaaagagcuga

SEQ ID NO: 231776 - RNA, 22 nt, Homo sapiens
aauguguuuugaaaucaggaag

SEQ ID NO: 231777 - RNA, 22 nt, Homo sapiens
aauuacauggcaauugggaaau

SEQ ID NO: 231778 - RNA, 22 nt, Homo sapiens
aauuacucgugucuuuacugcu

SEQ ID NO: 231779 - RNA, 22 nt, Homo sapiens
aauuaguaaccuaauuccaucu

SEQ ID NO: 231780 - RNA, 22 nt, Homo sapiens
aauuaguugaaagucugcuuuu

SEQ ID NO: 231781 - RNA, 22 nt, Homo sapiens
aauugaaugcagaugccaggga

SEQ ID NO: 231782 - RNA, 22 nt, Homo sapiens
aauugaccuaaucugauuacug

SEQ ID NO: 231783 - RNA, 22 nt, Homo sapiens
aauugcaauggacaaugcagca

SEQ ID NO: 231784 - RNA, 23 nt, Homo sapiens
aauugcacauuccuugcuggcag

SEQ ID NO: 231785 - RNA, 22 nt, Homo sapiens
aauugcaccaucuagaucaaga

SEQ ID NO: 231786 - RNA, 22 nt, Homo sapiens
aauugcauugaauuuguagcuu

SEQ ID NO: 231787 - RNA, 22 nt, Homo sapiens
aauuggugaccaagggaaggac

SEQ ID NO: 231788 - RNA, 22 nt, Homo sapiens
aauugguuaagauaagaucaua

SEQ ID NO: 231789 - RNA, 22 nt, Homo sapiens
acaaagcuagggaauccaucuu

SEQ ID NO: 231790 - RNA, 21 nt, Homo sapiens
acaaagcuggagggagacugc

SEQ ID NO: 231791 - RNA, 17 nt, Homo sapiens
acaaauugccagcuagg

SEQ ID NO: 231792 - RNA, 22 nt, Homo sapiens
acaagacuucuuguauucuagu

SEQ ID NO: 231793 - RNA, 22 nt, Homo sapiens
acaagugaauacaggauucucu

SEQ ID NO: 231794 - RNA, 22 nt, Homo sapiens
acacaaugguaaguguuugugu

SEQ ID NO: 231795 - RNA, 22 nt, Homo sapiens
acacacgugcauguaugcguau

SEQ ID NO: 231796 - RNA, 23 nt, Homo sapiens
acacaguaaacuaaaagcuagcu

SEQ ID NO: 231797 - RNA, 22 nt, Homo sapiens
acacaguaaauauguauugaau

SEQ ID NO: 231798 - RNA, 22 nt, Homo sapiens
acacaguguuuauugugguuag

SEQ ID NO: 231799 - RNA, 22 nt, Homo sapiens
acacaugugaaaaaaauguuac

SEQ ID NO: 231800 - RNA, 22 nt, Homo sapiens
acacaugugcguagacucuuua

SEQ ID NO: 231801 - RNA, 22 nt, Homo sapiens
acacauuggcaauucuggagca

SEQ ID NO: 231802 - RNA, 22 nt, Homo sapiens
acacuggaggagagcuguugcu

SEQ ID NO: 231803 - RNA, 20 nt, Homo sapiens
acacuggcuuugagauuuag

SEQ ID NO: 231804 - RNA, 22 nt, Homo sapiens
cugauauuuuaaaauuggcugg

SEQ ID NO: 231805 - RNA, 22 nt, Homo sapiens
cugaucuguagcagccaccaca

SEQ ID NO: 231806 - RNA, 22 nt, Homo sapiens
cugauugugcagagguguaauu

SEQ ID NO: 231807 - RNA, 20 nt, Homo sapiens
cugcaaaugcugcugcugau

SEQ ID NO: 231808 - RNA, 20 nt, Homo sapiens
cugcacauccacucuacuuc

SEQ ID NO: 231809 - RNA, 22 nt, Homo sapiens
cugcacugagacccucuuugcu

SEQ ID NO: 231810 - RNA, 22 nt, Homo sapiens
cugcagaucuuggggcuugcca

SEQ ID NO: 231811 - RNA, 22 nt, Homo sapiens
cugccaguuugauucgggccac

SEQ ID NO: 231812 - RNA, 22 nt, Homo sapiens
cuggaaagcaaguccauugcuc

SEQ ID NO: 231813 - RNA, 22 nt, Homo sapiens
cuggaagaaaaucacgccaucu

SEQ ID NO: 231814 - RNA, 22 nt, Homo sapiens
cuggagcaaaggugacucuugu

SEQ ID NO: 231815 - RNA, 22 nt, Homo sapiens
cuggaguaugauguuagcguug

SEQ ID NO: 231816 - RNA, 22 nt, Homo sapiens
cuggcaaaaagagggcaauaau

SEQ ID NO: 231817 - RNA, 22 nt, Homo sapiens
cuggcaauaggcagugucccaa

SEQ ID NO: 231818 - RNA, 22 nt, Homo sapiens
cuggcacccuugcuuaggaaga

SEQ ID NO: 231819 - RNA, 22 nt, Homo sapiens
cuggcaucuaaauacuugaugu

SEQ ID NO: 231820 - RNA, 22 nt, Homo sapiens
cuggcuaagugcuugagugugc

SEQ ID NO: 231821 - RNA, 22 nt, Homo sapiens
cuggcucugggcuaaagaaaua

SEQ ID NO: 231822 - RNA, 22 nt, Homo sapiens
cuggcucuguuagaagaaccag

SEQ ID NO: 231823 - RNA, 22 nt, Homo sapiens
cugggaucaguucuagucagaa

SEQ ID NO: 231824 - RNA, 22 nt, Homo sapiens
cugggauggaggagaauuagag

SEQ ID NO: 231825 - RNA, 22 nt, Homo sapiens
cugguuguuacaaagagccugg

SEQ ID NO: 231826 - RNA, 22 nt, Homo sapiens
cuguaguuagcagaugaugaau

SEQ ID NO: 231827 - RNA, 22 nt, Homo sapiens
cugucacaguuuuggaggccag

SEQ ID NO: 231828 - RNA, 22 nt, Homo sapiens
cugucacugggaggggcagcag

SEQ ID NO: 231829 - RNA, 22 nt, Homo sapiens
cuguccugcagagucagaauga

SEQ ID NO: 231830 - RNA, 22 nt, Homo sapiens
cugugcaaguuauaggccaggu

SEQ ID NO: 231831 - RNA, 22 nt, Homo sapiens
cugugcauggauuuuaagauug

SEQ ID NO: 231832 - RNA, 22 nt, Homo sapiens
cugugcauguaugcgugaguuc

SEQ ID NO: 231833 - RNA, 22 nt, Homo sapiens
cugugcauuggaugucucccug

SEQ ID NO: 231834 - RNA, 22 nt, Homo sapiens
cugugcuugagagaugacacag

SEQ ID NO: 231835 - RNA, 23 nt, Homo sapiens
cuguggauaugaguuguaaaugg

SEQ ID NO: 231836 - RNA, 22 nt, Homo sapiens
cuguggguuuuacuguuuuacu

SEQ ID NO: 231837 - RNA, 22 nt, Homo sapiens
cugugguuuaaggaauuuugac

SEQ ID NO: 231838 - RNA, 22 nt, Homo sapiens
cuguuagguuaaggaauggcaa

SEQ ID NO: 231839 - RNA, 22 nt, Homo sapiens
cuguuugguuaucuuuuccugu

SEQ ID NO: 231840 - RNA, 22 nt, Homo sapiens
cuuaaguaguuguggaaugaau

SEQ ID NO: 231841 - RNA, 22 nt, Homo sapiens
cuuaggguacuuuggugcauca

SEQ ID NO: 231842 - RNA, 18 nt, Homo sapiens
cuuagguagcucauucca

SEQ ID NO: 231843 - RNA, 22 nt, Homo sapiens
cuucaaaguuggcuaggagaca

SEQ ID NO: 231844 - RNA, 22 nt, Homo sapiens
cuucaagucuuuggauaauuag

SEQ ID NO: 231845 - RNA, 22 nt, Homo sapiens
cuucaaguuggaagggaccuaa

SEQ ID NO: 231846 - RNA, 22 nt, Homo sapiens
cuucaccaguuuggcagucuca

SEQ ID NO: 231847 - RNA, 22 nt, Homo sapiens
cuucaguucuguaaggacagca

SEQ ID NO: 231848 - RNA, 22 nt, Homo sapiens
cuucaugggagaaccacaggua

SEQ ID NO: 231849 - RNA, 22 nt, Homo sapiens
cuuccauaguauuuuuacaaaa

SEQ ID NO: 231850 - RNA, 22 nt, Homo sapiens
cuucuugagacuuaggcuuugg

SEQ ID NO: 231851 - RNA, 22 nt, Homo sapiens
cuucuugagggccugcugggaa

SEQ ID NO: 231852 - RNA, 22 nt, Homo sapiens
cuugacacugucacucaggcca

SEQ ID NO: 231853 - RNA, 23 nt, Homo sapiens
cuugagacaaaugcgugugugca

SEQ ID NO: 231854 - RNA, 22 nt, Homo sapiens
cuugagcauauucuauauuaaa

SEQ ID NO: 231855 - RNA, 22 nt, Homo sapiens
cuugagcuugagauccuuucug

SEQ ID NO: 231856 - RNA, 22 nt, Homo sapiens
cuugcacauuacagaucugcau

SEQ ID NO: 231857 - RNA, 22 nt, Homo sapiens
cuugcacuagugcagaggcgcu

SEQ ID NO: 231858 - RNA, 22 nt, Homo sapiens
cuugcacuguuguaagggacuu

SEQ ID NO: 231859 - RNA, 22 nt, Homo sapiens
cuugcagaggcccuggggagag

SEQ ID NO: 231860 - RNA, 22 nt, Homo sapiens
cuugcagagucauucuaauuuc

SEQ ID NO: 231861 - RNA, 22 nt, Homo sapiens
cuuggcacucuguggaguuagg

SEQ ID NO: 231862 - RNA, 22 nt, Homo sapiens
cuuggcacugcucacccuccuu

SEQ ID NO: 231863 - RNA, 22 nt, Homo sapiens
cuuggcauuguguugauagaag

SEQ ID NO: 231864 - RNA, 22 nt, Homo sapiens
cuuggcuuguuguccccugcuc

SEQ ID NO: 231865 - RNA, 22 nt, Homo sapiens
cuugggcagugugcauguguau

SEQ ID NO: 231866 - RNA, 22 nt, Homo sapiens
cuuguacacuguuggugggaau

SEQ ID NO: 231867 - RNA, 18 nt, Homo sapiens
cuugucaaaucuuuccuc

SEQ ID NO: 231868 - RNA, 22 nt, Homo sapiens
cuugucacuguuggcuuuagaa

SEQ ID NO: 231869 - RNA, 22 nt, Homo sapiens
cuuguggugcuuuuacgugggc

SEQ ID NO: 231870 - RNA, 22 nt, Homo sapiens
cuuguguuacauauuuaagaga

SEQ ID NO: 231871 - RNA, 22 nt, Homo sapiens
cuuuaugagguuggauggaucu

SEQ ID NO: 231872 - RNA, 22 nt, Homo sapiens
cuuucacacuguuggugggaau

SEQ ID NO: 231873 - RNA, 22 nt, Homo sapiens
cuuugcguugaacaaagccaua

SEQ ID NO: 231874 - RNA, 22 nt, Homo sapiens
cuuuggcaaugucauuuucaau

SEQ ID NO: 231875 - RNA, 22 nt, Homo sapiens
cuuuggcacuuccuaagugcca

SEQ ID NO: 231876 - RNA, 22 nt, Homo sapiens
cuuuggcauuagccuguauaga

SEQ ID NO: 231877 - RNA, 22 nt, Homo sapiens
cuuuggguauucucccuugggg

SEQ ID NO: 231878 - RNA, 22 nt, Homo sapiens
cuuuggucaauugcugugggga

SEQ ID NO: 231879 - RNA, 22 nt, Homo sapiens
cuuuggugagggauaaauuuca

SEQ ID NO: 231880 - RNA, 20 nt, Homo sapiens
cuuuggugagucaacuccuu

SEQ ID NO: 231881 - RNA, 22 nt, Homo sapiens
cuuugguggagucuuuagguuc

SEQ ID NO: 231882 - RNA, 22 nt, Homo sapiens
cuuugguuaauaggauauggca

SEQ ID NO: 231883 - RNA, 21 nt, Homo sapiens
cuuugguuucugacuugcaua

SEQ ID NO: 231884 - RNA, 23 nt, Homo sapiens
cuuuguccccacccaaaucucau

SEQ ID NO: 231885 - RNA, 22 nt, Homo sapiens
cuuugugugggccaagggcugg

SEQ ID NO: 231886 - RNA, 22 nt, Homo sapiens
cuuuuacacugguggugggaau

SEQ ID NO: 231887 - RNA, 22 nt, Homo sapiens
cuuuuacacuguuggugggaau

SEQ ID NO: 231888 - RNA, 22 nt, Homo sapiens
cuuuugugauuccucaguuacu

SEQ ID NO: 231889 - RNA, 22 nt, Homo sapiens
cuuuugugauucuucaguuacu

SEQ ID NO: 231890 - RNA, 22 nt, Homo sapiens
cuuuugugauucuucaguugcu

SEQ ID NO: 231891 - RNA, 22 nt, Homo sapiens
cuuuuguggaucuucuguugcu

SEQ ID NO: 231892 - RNA, 22 nt, Homo sapiens
cuuuuugcugcagcaauacugg

SEQ ID NO: 231893 - RNA, 20 nt, Homo sapiens
cuuuuugcugugcugggagc

SEQ ID NO: 231894 - RNA, 20 nt, Homo sapiens
gaaacaucuauccucuccuu

SEQ ID NO: 231895 - RNA, 22 nt, Homo sapiens
gaaagacuuucugcuguggaua

SEQ ID NO: 231896 - RNA, 22 nt, Homo sapiens
gaaagugcugcuugacugggau

SEQ ID NO: 231897 - RNA, 21 nt, Homo sapiens
gaaauacugccuuaggagcug

SEQ ID NO: 231898 - RNA, 18 nt, Homo sapiens
gaaaugccucuugcuuac

SEQ ID NO: 231899 - RNA, 22 nt, Homo sapiens
gaaccagcagacuuugacaggu

SEQ ID NO: 231900 - RNA, 22 nt, Homo sapiens
gaacuguuucuggugaaagagu

SEQ ID NO: 231901 - RNA, 22 nt, Homo sapiens
ugaauguaagaugucugcuggu

SEQ ID NO: 231902 - RNA, 22 nt, Homo sapiens
ugaauguacacgcguacuuguu

SEQ ID NO: 231903 - RNA, 22 nt, Homo sapiens
ugaauguauuuauuaccauuca

SEQ ID NO: 231904 - RNA, 22 nt, Homo sapiens
ugaauguccauugauguuuuga

SEQ ID NO: 231905 - RNA, 22 nt, Homo sapiens
ugaauguuguugguugagauau

SEQ ID NO: 231906 - RNA, 22 nt, Homo sapiens
ugaauguuugcagcuuauacca

SEQ ID NO: 231907 - RNA, 22 nt, Homo sapiens
ugaauguuugcuuacuuccaua

SEQ ID NO: 231908 - RNA, 22 nt, Homo sapiens
ugaauucuguccaaaauaacug

SEQ ID NO: 231909 - RNA, 23 nt, Homo sapiens
ugacaagagcgagacuuggucuc

SEQ ID NO: 231910 - RNA, 22 nt, Homo sapiens
ugacaagauauggucuuaucaa

SEQ ID NO: 231911 - RNA, 22 nt, Homo sapiens
ugacaaguaaacagucagcacc

SEQ ID NO: 231912 - RNA, 22 nt, Homo sapiens
ugacagugaacagguuaccacu

SEQ ID NO: 231913 - RNA, 20 nt, Homo sapiens
ugacaguuaagggauagaag

SEQ ID NO: 231914 - RNA, 22 nt, Homo sapiens
ugacaucugcuugugcccagga

SEQ ID NO: 231915 - RNA, 19 nt, Homo sapiens
ugacaugaaacccaagauc

SEQ ID NO: 231916 - RNA, 22 nt, Homo sapiens
ugacaugaagaaaaacagauuu

SEQ ID NO: 231917 - RNA, 22 nt, Homo sapiens
ugacaugaugagcaauaauggc

SEQ ID NO: 231918 - RNA, 22 nt, Homo sapiens
ugacaugauuguauauuuagaa

SEQ ID NO: 231919 - RNA, 22 nt, Homo sapiens
ugacauggaaguagguauacau

SEQ ID NO: 231920 - RNA, 22 nt, Homo sapiens
ugacauggagguggaggaagau

SEQ ID NO: 231921 - RNA, 22 nt, Homo sapiens
uuuuagcuuuucccaggacucc

SEQ ID NO: 231922 - RNA, 22 nt, Homo sapiens
uuuuaguggacaaagguauuua

SEQ ID NO: 231923 - RNA, 22 nt, Homo sapiens
uuuuaugggcuauuugcauuag

SEQ ID NO: 231924 - RNA, 22 nt, Homo sapiens
uuuugcacauugauuugguauc

SEQ ID NO: 231925 - RNA, 22 nt, Homo sapiens
uuuugcacuagaaccagagguu

SEQ ID NO: 231926 - RNA, 22 nt, Homo sapiens
uuuugcacuguuuuaucugaca

SEQ ID NO: 231927 - RNA, 22 nt, Homo sapiens
uuuugcaguuacagagagugag

SEQ ID NO: 231928 - RNA, 18 nt, Homo sapiens
uuuugcuuaacugcgcca

SEQ ID NO: 231929 - RNA, 20 nt, Homo sapiens
uuuuggacuaaaggcauccc

SEQ ID NO: 231930 - RNA, 22 nt, Homo sapiens
uuuuggucuccaguuucugcug

SEQ ID NO: 231931 - RNA, 22 nt, Homo sapiens
uuuugguuaggauggguggcau

SEQ ID NO: 231932 - RNA, 22 nt, Homo sapiens
uuuugguucaauuaauuugcua

SEQ ID NO: 231933 - RNA, 22 nt, Homo sapiens
uuuuguacaacagcucugggga

SEQ ID NO: 231934 - RNA, 19 nt, Homo sapiens
uuuuguacucugugacuug

SEQ ID NO: 231935 - RNA, 21 nt, Homo sapiens
uuuugugcaugugcagccugc

SEQ ID NO: 231936 - RNA, 22 nt, Homo sapiens
uuuuuauggccaauccucagaa

SEQ ID NO: 231937 - RNA, 18 nt, Homo sapiens
uuuuugaggcacagggga

SEQ ID NO: 231938 - RNA, 22 nt, Homo sapiens
uuuuugaguagcuggagagcag

SEQ ID NO: 231939 - RNA, 22 nt, Homo sapiens
uuuuugauuaauggguagacca

SEQ ID NO: 231940 - RNA, 22 nt, Homo sapiens
uuuuuggauaaugguacaugua

SEQ ID NO: 231941 - RNA, 21 nt, Homo sapiens
uuuuugggcuuucauaguguu

SEQ ID NO: 231942 - RNA, 22 nt, Homo sapiens
ugguauguuuauaaguauagga

SEQ ID NO: 231943 - RNA, 22 nt, Homo sapiens
uggucaaaucugaugugagaaa

SEQ ID NO: 231944 - RNA, 22 nt, Homo sapiens
uggucaccugaauuaugcaugu

SEQ ID NO: 231945 - RNA, 22 nt, Homo sapiens
uggucauggaaauagaaugcac

SEQ ID NO: 231946 - RNA, 22 nt, Homo sapiens
ugguccaguucugugauauugc

SEQ ID NO: 231947 - RNA, 19 nt, Homo sapiens
uggucccccgcaaucucau

SEQ ID NO: 231948 - RNA, 22 nt, Homo sapiens
ugguccucugcuuccagaauuc

SEQ ID NO: 231949 - RNA, 22 nt, Homo sapiens
uggucguggagucccuggcuuc

SEQ ID NO: 231950 - RNA, 22 nt, Homo sapiens
uggucuuuucaacaaaugguau

SEQ ID NO: 231951 - RNA, 17 nt, Homo sapiens
uggugcuugaaaguugc

SEQ ID NO: 231952 - RNA, 22 nt, Homo sapiens
ugguguccugucucugcgcuug

SEQ ID NO: 231953 - RNA, 22 nt, Homo sapiens
ugguuagucuguguguauauau

SEQ ID NO: 231954 - RNA, 22 nt, Homo sapiens
uguaaacucaguauguuuuacu

SEQ ID NO: 231955 - RNA, 20 nt, Homo sapiens
uguaaaggagauugcagcug

SEQ ID NO: 231956 - RNA, 22 nt, Homo sapiens
uguaaaucugguuaauuggaua

SEQ ID NO: 231957 - RNA, 20 nt, Homo sapiens
uguaacacauggagaacucu

SEQ ID NO: 231958 - RNA, 21 nt, Homo sapiens
uguaacugcaaaccucagauu

SEQ ID NO: 231959 - RNA, 22 nt, Homo sapiens
uguaacugcuuagaagguuuua

SEQ ID NO: 231960 - RNA, 22 nt, Homo sapiens
uguaagcauuauauaauuguug

SEQ ID NO: 231961 - RNA, 22 nt, Homo sapiens
uguaaggcaguuagagcaaauu

SEQ ID NO: 231962 - RNA, 22 nt, Homo sapiens
uguaauaguaggcucacauuug

SEQ ID NO: 231963 - RNA, 22 nt, Homo sapiens
uguaauguuucaucauuauuaa

SEQ ID NO: 231964 - RNA, 22 nt, Homo sapiens
uguaauuuaaaugauccuugga

SEQ ID NO: 231965 - RNA, 22 nt, Homo sapiens
uguacuagaaauuaaggcaggg

SEQ ID NO: 231966 - RNA, 22 nt, Homo sapiens
uguagacagcacguaguugagu

SEQ ID NO: 231967 - RNA, 21 nt, Homo sapiens
uguagcagcaugauuuauaau

SEQ ID NO: 231968 - RNA, 22 nt, Homo sapiens
uguagguguacauacaugguua

SEQ ID NO: 231969 - RNA, 22 nt, Homo sapiens
uguagucauuccuuuuugcuuu

SEQ ID NO: 231970 - RNA, 22 nt, Homo sapiens
uguagucauuugaaggaugucc

SEQ ID NO: 231971 - RNA, 22 nt, Homo sapiens
uguauaacucacauugaaguuu

SEQ ID NO: 231972 - RNA, 22 nt, Homo sapiens
uguauacugucuaauauguugu

SEQ ID NO: 231973 - RNA, 22 nt, Homo sapiens
uguauaggcaaauuuccucaug

SEQ ID NO: 231974 - RNA, 22 nt, Homo sapiens
uguauaguugagucaaguuuca

SEQ ID NO: 231975 - RNA, 21 nt, Homo sapiens
uguauauguuuauacacacac

SEQ ID NO: 231976 - RNA, 22 nt, Homo sapiens
uguaugagagugaaagcauuuc

SEQ ID NO: 231977 - RNA, 22 nt, Homo sapiens
uguaugucugcucuuuggaacu

SEQ ID NO: 231978 - RNA, 22 nt, Homo sapiens
uguaugucuucuuuagauaagu

SEQ ID NO: 231979 - RNA, 22 nt, Homo sapiens
uguauguugauguuauauucug

SEQ ID NO: 231980 - RNA, 22 nt, Homo sapiens
uguauugcuugaagagugaauu

SEQ ID NO: 231981 - RNA, 22 nt, Homo sapiens
uguauuuguuguuaaauggaga

SEQ ID NO: 231982 - RNA, 20 nt, Homo sapiens
ugucaagaaacauuacuuau

SEQ ID NO: 231983 - RNA, 21 nt, Homo sapiens
ugucaagaugacugcugcggc

SEQ ID NO: 231984 - RNA, 22 nt, Homo sapiens
ugucaaggaaugucauugguuu

SEQ ID NO: 231985 - RNA, 22 nt, Homo sapiens
ugucaaugggaauuuguuuuag

SEQ ID NO: 231986 - RNA, 22 nt, Homo sapiens
ugucacauccaagaaggugcag

SEQ ID NO: 231987 - RNA, 22 nt, Homo sapiens
ugucaccauuuguaggugagga

SEQ ID NO: 231988 - RNA, 22 nt, Homo sapiens
ugucacugugaguuugacugcu

SEQ ID NO: 231989 - RNA, 18 nt, Homo sapiens
ugucagaguggauuguaa

SEQ ID NO: 231990 - RNA, 22 nt, Homo sapiens
ugucagcacaacucagguuccu

SEQ ID NO: 231991 - RNA, 22 nt, Homo sapiens
ugucagggaggcucggccgcac

SEQ ID NO: 231992 - RNA, 22 nt, Homo sapiens
ugucaguggucuggaugcagcc

SEQ ID NO: 231993 - RNA, 22 nt, Homo sapiens
ugucaguguacuguaagaauua

SEQ ID NO: 231994 - RNA, 21 nt, Homo sapiens
ugucaguuuccagaguucaac

SEQ ID NO: 231995 - RNA, 22 nt, Homo sapiens
ugucaugagucuccuccaucuu

SEQ ID NO: 231996 - RNA, 22 nt, Homo sapiens
ugucauggcauuuguaaacugc

SEQ ID NO: 231997 - RNA, 22 nt, Homo sapiens
ugucauggggaaaauaacagac

SEQ ID NO: 231998 - RNA, 22 nt, Homo sapiens
ugucaugguagcaaggacgagg

SEQ ID NO: 231999 - RNA, 22 nt, Homo sapiens
ugucauggugcucugggcccug

SEQ ID NO: 232000 - RNA, 22 nt, Homo sapiens
ugucauguggcuaacgauucau

SEQ ID NO: 232001 - RNA, 20 nt, Homo sapiens
ugucauuaagcacugugcca

SEQ ID NO: 232002 - RNA, 22 nt, Homo sapiens
uguccaguguuccucagaagaa

SEQ ID NO: 232003 - RNA, 22 nt, Homo sapiens
uuacauguggugugaagaagag

SEQ ID NO: 232004 - RNA, 22 nt, Homo sapiens
uuacauugcuucaaauucagug

SEQ ID NO: 232005 - RNA, 22 nt, Homo sapiens
uuaccagucugauuccuguuag

SEQ ID NO: 232006 - RNA, 22 nt, Homo sapiens
uuacccuuuaacccuuuaaagu

SEQ ID NO: 232007 - RNA, 22 nt, Homo sapiens
uuaccucuguggcucucggacu

SEQ ID NO: 232008 - RNA, 22 nt, Homo sapiens
uuaccugagaaggugacauuug

SEQ ID NO: 232009 - RNA, 22 nt, Homo sapiens
uuaccuguguuuugggcccaga

SEQ ID NO: 232010 - RNA, 22 nt, Homo sapiens
uuacguaguuuuggagaucaua

SEQ ID NO: 232011 - RNA, 22 nt, Homo sapiens
uuacugcuagcugugugcucuu

SEQ ID NO: 232012 - RNA, 22 nt, Homo sapiens
uuacuguacugcucuuaaccug

SEQ ID NO: 232013 - RNA, 22 nt, Homo sapiens
uuacuguagugucauaucguau

SEQ ID NO: 232014 - RNA, 22 nt, Homo sapiens
uuagaaaguagaaaagcugguu

SEQ ID NO: 232015 - RNA, 22 nt, Homo sapiens
uuagaacuagaggaguuugagu

SEQ ID NO: 232016 - RNA, 22 nt, Homo sapiens
uuagaguacaggggaaucaagg

SEQ ID NO: 232017 - RNA, 22 nt, Homo sapiens
uuagauguuugacugggccuua

SEQ ID NO: 232018 - RNA, 22 nt, Homo sapiens
uuagcacauuuccagcacaugg

SEQ ID NO: 232019 - RNA, 22 nt, Homo sapiens
uuagcagugucccacuccuugg

SEQ ID NO: 232020 - RNA, 22 nt, Homo sapiens
uuagcaugucuacuaauuugcu

SEQ ID NO: 232021 - RNA, 22 nt, Homo sapiens
uuagcccaucuugaggaaagua

SEQ ID NO: 232022 - RNA, 22 nt, Homo sapiens
uuagcgccuuucuuccucuccu

SEQ ID NO: 232023 - RNA, 22 nt, Homo sapiens
uuaggacaauguucguuuuuug

SEQ ID NO: 232024 - RNA, 22 nt, Homo sapiens
uuaggacacuguggguggguca

SEQ ID NO: 232025 - RNA, 22 nt, Homo sapiens
uuaggcucuuugaggugcccag

SEQ ID NO: 232026 - RNA, 22 nt, Homo sapiens
uuagggaggcucaggacaagag

SEQ ID NO: 232027 - RNA, 22 nt, Homo sapiens
uuagguagaauugauuaaguuu

SEQ ID NO: 232028 - RNA, 22 nt, Homo sapiens
uuaggucaucgcuguccuucag

SEQ ID NO: 232029 - RNA, 22 nt, Homo sapiens
uuagugcaaacucuucaaugcu

SEQ ID NO: 232030 - RNA, 20 nt, Homo sapiens
uuaguucauuuagaagguuu

SEQ ID NO: 232031 - RNA, 22 nt, Homo sapiens
uuaguucccucauucuugacuu

SEQ ID NO: 232032 - RNA, 20 nt, Homo sapiens
uuauaacuuuuguucugggg

SEQ ID NO: 232033 - RNA, 22 nt, Homo sapiens
uuauagcacuaagaagguaaua

SEQ ID NO: 232034 - RNA, 22 nt, Homo sapiens
uuauaguuuuucaccuggagaa

SEQ ID NO: 232035 - RNA, 21 nt, Homo sapiens
ccaguguaaugauagcaggca

SEQ ID NO: 232036 - RNA, 19 nt, Homo sapiens
ccaguguugccagagcuga

SEQ ID NO: 232037 - RNA, 22 nt, Homo sapiens
ccaucacacugugauuauuauc

SEQ ID NO: 232038 - RNA, 20 nt, Homo sapiens
ccaucaguccucucuuguuc

SEQ ID NO: 232039 - RNA, 22 nt, Homo sapiens
ccauggcuauucuguaaggguu

SEQ ID NO: 232040 - RNA, 18 nt, Homo sapiens
ccauucaacagauuuguc

SEQ ID NO: 232041 - RNA, 23 nt, Homo sapiens
ccauugcacuccagccucaguga

SEQ ID NO: 232042 - RNA, 22 nt, Homo sapiens
ccauugcacuccagccucggca

SEQ ID NO: 232043 - RNA, 22 nt, Homo sapiens
cccacaguggccucauauccuu

SEQ ID NO: 232044 - RNA, 22 nt, Homo sapiens
cccagugaagagaaccuuacga

SEQ ID NO: 232045 - RNA, 19 nt, Homo sapiens
cccagugucagagaagggu

SEQ ID NO: 232046 - RNA, 22 nt, Homo sapiens
cccaguguguuguggauauuua

SEQ ID NO: 232047 - RNA, 22 nt, Homo sapiens
cccaguguuuauuuugagccaa

SEQ ID NO: 232048 - RNA, 22 nt, Homo sapiens
cccaguuuugccacuuacuagc

SEQ ID NO: 232049 - RNA, 22 nt, Homo sapiens
ccccagguuucaauaaagccca

SEQ ID NO: 232050 - RNA, 22 nt, Homo sapiens
ccccggguggauguacauguga

SEQ ID NO: 232051 - RNA, 22 nt, Homo sapiens
ccccguuacagccucagugccu

SEQ ID NO: 232052 - RNA, 19 nt, Homo sapiens
ccccuguggauaccgaggg

SEQ ID NO: 232053 - RNA, 22 nt, Homo sapiens
cccuaagacagugaggggugca

SEQ ID NO: 232054 - RNA, 20 nt, Homo sapiens
cccuaagccagaugcugggg

SEQ ID NO: 232055 - RNA, 17 nt, Homo sapiens
cccuaguagcugggacu

SEQ ID NO: 232056 - RNA, 22 nt, Homo sapiens
cccugaagacuccaccgucaug

SEQ ID NO: 232057 - RNA, 22 nt, Homo sapiens
cccugaagauacagaguuuggg

SEQ ID NO: 232058 - RNA, 22 nt, Homo sapiens
cccugagaugcuguuaaucugu

SEQ ID NO: 232059 - RNA, 22 nt, Homo sapiens
cccugagaugugaauuucagag

SEQ ID NO: 232060 - RNA, 22 nt, Homo sapiens
cccugagcagccugaguuuccc

SEQ ID NO: 232061 - RNA, 22 nt, Homo sapiens
cccuggacauucaucauuaugu

SEQ ID NO: 232062 - RNA, 22 nt, Homo sapiens
cccuguagcagcauucuuaaau

SEQ ID NO: 232063 - RNA, 22 nt, Homo sapiens
cccuugcacuucagagcugcau

SEQ ID NO: 232064 - RNA, 22 nt, Homo sapiens
ccggcuguguggagaggccccu

SEQ ID NO: 232065 - RNA, 22 nt, Homo sapiens
ccuaaguaauggcaguuuuugc

SEQ ID NO: 232066 - RNA, 19 nt, Homo sapiens
ccucaaguacuaauauguu

SEQ ID NO: 232067 - RNA, 22 nt, Homo sapiens
ccucaguguuuaucauuauuuu

SEQ ID NO: 232068 - RNA, 21 nt, Homo sapiens
ccuccauuuguauucuugccc

SEQ ID NO: 232069 - RNA, 22 nt, Homo sapiens
ccucuguaguccugcaagagga

SEQ ID NO: 232070 - RNA, 22 nt, Homo sapiens
ccucuuuguugagacuucacca

SEQ ID NO: 232071 - RNA, 22 nt, Homo sapiens
ccugagacgaauggagugaaca

SEQ ID NO: 232072 - RNA, 22 nt, Homo sapiens
ccugagacuugagggggcuucu

SEQ ID NO: 232073 - RNA, 22 nt, Homo sapiens
ccugagguagaguuuauauuga

SEQ ID NO: 232074 - RNA, 19 nt, Homo sapiens
ccugcuguucuuuugcacc

SEQ ID NO: 232075 - RNA, 22 nt, Homo sapiens
ccuggaagaaaggugcuaaaua

SEQ ID NO: 232076 - RNA, 22 nt, Homo sapiens
ccuggguuacaggugugagcca

SEQ ID NO: 232077 - RNA, 22 nt, Homo sapiens
ccugugguuaaccagcuagaug

SEQ ID NO: 232078 - RNA, 22 nt, Homo sapiens
ccuugcacuucccaggugaggc

SEQ ID NO: 232079 - RNA, 22 nt, Homo sapiens
ccuuggcacuacugacauugua

SEQ ID NO: 232080 - RNA, 22 nt, Homo sapiens
ccuugguaauguguuuuauucu

SEQ ID NO: 232081 - RNA, 21 nt, Homo sapiens
ccuugguuaucuucccauuca

SEQ ID NO: 232082 - RNA, 22 nt, Homo sapiens
ccuuuuugaguugccagaguuc

SEQ ID NO: 232083 - RNA, 22 nt, Homo sapiens
cgacuggccuagacuaguguuu

SEQ ID NO: 232084 - RNA, 22 nt, Homo sapiens
cgcuggugaucuagacccccaa

SEQ ID NO: 232085 - RNA, 22 nt, Homo sapiens
cgcuggugucuaagcgacagcu

SEQ ID NO: 232086 - RNA, 22 nt, Homo sapiens
cguugcacuccagccugggcaa

SEQ ID NO: 232087 - RNA, 22 nt, Homo sapiens
cuaaaacuuucugagugcagca

SEQ ID NO: 232088 - RNA, 22 nt, Homo sapiens
cuaaaguagccaggacugcagg

SEQ ID NO: 232089 - RNA, 22 nt, Homo sapiens
cuaaagucacgauuugugggua

SEQ ID NO: 232090 - RNA, 22 nt, Homo sapiens
cuaaaugcacugucaaaggaag

SEQ ID NO: 232091 - RNA, 19 nt, Homo sapiens
cuaaaugggucccuagugg

SEQ ID NO: 232092 - RNA, 22 nt, Homo sapiens
cuaaaugucucuacuaaguuua

SEQ ID NO: 232093 - RNA, 22 nt, Homo sapiens
cuaacuaugucucaggaugucc

SEQ ID NO: 232094 - RNA, 22 nt, Homo sapiens
cuaaggcaguagccugaauaau

SEQ ID NO: 232095 - RNA, 22 nt, Homo sapiens
cuaauacaguuguccaagcugg

SEQ ID NO: 232096 - RNA, 18 nt, Homo sapiens
cuaauacuauucaacaag

SEQ ID NO: 232097 - RNA, 22 nt, Homo sapiens
cuaauucuggccaaagggauaa

SEQ ID NO: 232098 - RNA, 22 nt, Homo sapiens
cuacacaugcaggcucccugcc

SEQ ID NO: 232099 - RNA, 22 nt, Homo sapiens
cuacagguaugaaagggaguau

SEQ ID NO: 232100 - RNA, 22 nt, Homo sapiens
cuacaguagagaggauguagaa

SEQ ID NO: 232101 - RNA, 20 nt, Homo sapiens
ugcauguccucacuuacuug

SEQ ID NO: 232102 - RNA, 22 nt, Homo sapiens
ugcauuaguaaguaauuuuaau

SEQ ID NO: 232103 - RNA, 22 nt, Homo sapiens
ugcauugcacuugcaugagaua

SEQ ID NO: 232104 - RNA, 22 nt, Homo sapiens
ugcauuguggaucuaaaugcau

SEQ ID NO: 232105 - RNA, 22 nt, Homo sapiens
ugcauuguuccgaauguguccu

SEQ ID NO: 232106 - RNA, 21 nt, Homo sapiens
ugcauuguugcugagagcagg

SEQ ID NO: 232107 - RNA, 20 nt, Homo sapiens
ugccaagaaaugaggguauu

SEQ ID NO: 232108 - RNA, 22 nt, Homo sapiens
ugccaaggagucagucccuaga

SEQ ID NO: 232109 - RNA, 22 nt, Homo sapiens
ugccaggaugaggucaauguuu

SEQ ID NO: 232110 - RNA, 22 nt, Homo sapiens
ugccaguauuuuauugaggauu

SEQ ID NO: 232111 - RNA, 22 nt, Homo sapiens
ugccaguauuuuguugaggauu

SEQ ID NO: 232112 - RNA, 22 nt, Homo sapiens
ugccaguguugccuuucacuag

SEQ ID NO: 232113 - RNA, 22 nt, Homo sapiens
ugccaguguuuuguugaagauu

SEQ ID NO: 232114 - RNA, 22 nt, Homo sapiens
ugccaugaagaucccugaaaug

SEQ ID NO: 232115 - RNA, 22 nt, Homo sapiens
ugccaugaaguaauggcaaaaa

SEQ ID NO: 232116 - RNA, 19 nt, Homo sapiens
ugccauguaacaggaaaau

SEQ ID NO: 232117 - RNA, 22 nt, Homo sapiens
ugcccguaauuccagcacuuug

SEQ ID NO: 232118 - RNA, 22 nt, Homo sapiens
ugcccuguaucccacuguuuca

SEQ ID NO: 232119 - RNA, 22 nt, Homo sapiens
ugcccuuugucagaugaguagg

SEQ ID NO: 232120 - RNA, 22 nt, Homo sapiens
ugccuacuuugcaucugucagg

SEQ ID NO: 232121 - RNA, 22 nt, Homo sapiens
ugccuagaaacacuauuucucc

SEQ ID NO: 232122 - RNA, 22 nt, Homo sapiens
ugccuaguguguugagaguuuu

SEQ ID NO: 232123 - RNA, 22 nt, Homo sapiens
ugccugagccagguuuuaggag

SEQ ID NO: 232124 - RNA, 16 nt, Homo sapiens
ugccuuauuccagcuc

SEQ ID NO: 232125 - RNA, 22 nt, Homo sapiens
ugccuuuguucuggaaugggaa

SEQ ID NO: 232126 - RNA, 22 nt, Homo sapiens
ugcgcacugcagauuugaacuc

SEQ ID NO: 232127 - RNA, 22 nt, Homo sapiens
ugcgccauugcacuccagucuu

SEQ ID NO: 232128 - RNA, 22 nt, Homo sapiens
ugcucaguuuaaaacuuuugag

SEQ ID NO: 232129 - RNA, 22 nt, Homo sapiens
ugcugcaaacaggcaucugugg

SEQ ID NO: 232130 - RNA, 22 nt, Homo sapiens
ugcugcaaucucggcacuuugg

SEQ ID NO: 232131 - RNA, 22 nt, Homo sapiens
ugcuggugauuaaauccugaag

SEQ ID NO: 232132 - RNA, 22 nt, Homo sapiens
ugcugguuuaaaaugcaaauuc

SEQ ID NO: 232133 - RNA, 21 nt, Homo sapiens
ugcuuacugaauguuaauuuc

SEQ ID NO: 232134 - RNA, 22 nt, Homo sapiens
ugcuuagucuugcuuuagcuau

SEQ ID NO: 232135 - RNA, 22 nt, Homo sapiens
ugcuuaguuguauguuccacau

SEQ ID NO: 232136 - RNA, 22 nt, Homo sapiens
ugcuuuguuauauggggauucu

SEQ ID NO: 232137 - RNA, 21 nt, Homo sapiens
uggaaacuucuagcuuacgua

SEQ ID NO: 232138 - RNA, 22 nt, Homo sapiens
uggaaauaaaauagaguuugcc

SEQ ID NO: 232139 - RNA, 22 nt, Homo sapiens
uggaacacaucuaaggaagcag

SEQ ID NO: 232140 - RNA, 22 nt, Homo sapiens
uggaacaccaggcuggcguggc

SEQ ID NO: 232141 - RNA, 20 nt, Homo sapiens
uggaacuuaauugauggaca

SEQ ID NO: 232142 - RNA, 22 nt, Homo sapiens
uggaagacaaguguuagcaugg

SEQ ID NO: 232143 - RNA, 22 nt, Homo sapiens
uggaagacaggcuguauuuuaa

SEQ ID NO: 232144 - RNA, 23 nt, Homo sapiens
uggaagacuccucucuuggcugc

SEQ ID NO: 232145 - RNA, 22 nt, Homo sapiens
uggaagacucuagucucuugag

SEQ ID NO: 232146 - RNA, 22 nt, Homo sapiens
uggaagaugggaccucaguuuu

SEQ ID NO: 232147 - RNA, 22 nt, Homo sapiens
uggaagauuacuuuuuguugaa

SEQ ID NO: 232148 - RNA, 22 nt, Homo sapiens
uggaagauucuagaagauucca

SEQ ID NO: 232149 - RNA, 20 nt, Homo sapiens
uggaagccuggugcuaucuu

SEQ ID NO: 232150 - RNA, 22 nt, Homo sapiens
uggaaguaaccaugaauggaau

SEQ ID NO: 232151 - RNA, 22 nt, Homo sapiens
uggaaguagauagauuguguca

SEQ ID NO: 232152 - RNA, 22 nt, Homo sapiens
uggaaucuuaggugaaggcuuu

SEQ ID NO: 232153 - RNA, 21 nt, Homo sapiens
uggaaugaauggccaacaugg

SEQ ID NO: 232154 - RNA, 22 nt, Homo sapiens
uggaauguaacuugaaacuuuu

SEQ ID NO: 232155 - RNA, 17 nt, Homo sapiens
uggaaugucuaagccug

SEQ ID NO: 232156 - RNA, 22 nt, Homo sapiens
uggaaugugaauaacuuccuuc

SEQ ID NO: 232157 - RNA, 22 nt, Homo sapiens
uggaauuaauuaaaauauacug

SEQ ID NO: 232158 - RNA, 22 nt, Homo sapiens
uggaauuuacuuauuuaggggc

SEQ ID NO: 232159 - RNA, 22 nt, Homo sapiens
uggacacuggagauucgucagu

SEQ ID NO: 232160 - RNA, 22 nt, Homo sapiens
uggacacugguggauauggaau

SEQ ID NO: 232161 - RNA, 22 nt, Homo sapiens
uggacagaaacauguuuucagu

SEQ ID NO: 232162 - RNA, 22 nt, Homo sapiens
uggacagacaagguuauagauc

SEQ ID NO: 232163 - RNA, 21 nt, Homo sapiens
uggaccccuuccuuacaucau

SEQ ID NO: 232164 - RNA, 22 nt, Homo sapiens
uggagacaaagauagaaaagca

SEQ ID NO: 232165 - RNA, 22 nt, Homo sapiens
uggagacugaucccucuuuccu

SEQ ID NO: 232166 - RNA, 22 nt, Homo sapiens
uggagcccuaguuccucauaac

SEQ ID NO: 232167 - RNA, 22 nt, Homo sapiens
uggaggacugcagaacugaggc

SEQ ID NO: 232168 - RNA, 22 nt, Homo sapiens
uggagguagacauugggaagag

SEQ ID NO: 232169 - RNA, 22 nt, Homo sapiens
uggagguaggacgaagaacucu

SEQ ID NO: 232170 - RNA, 22 nt, Homo sapiens
uggagguagggccuaggaaucu

SEQ ID NO: 232171 - RNA, 22 nt, Homo sapiens
uggaguauuauguaauuucaau

SEQ ID NO: 232172 - RNA, 20 nt, Homo sapiens
uggagugaagguucuggacc

SEQ ID NO: 232173 - RNA, 22 nt, Homo sapiens
uggagugcaauggcaccaucuu

SEQ ID NO: 232174 - RNA, 22 nt, Homo sapiens
uggagugcgagggugaaacuuu

SEQ ID NO: 232175 - RNA, 22 nt, Homo sapiens
uggaguguaauuagccaucagu

SEQ ID NO: 232176 - RNA, 22 nt, Homo sapiens
uggagugucaguuuccagaguu

SEQ ID NO: 232177 - RNA, 20 nt, Homo sapiens
uggaguuugaguucuuggag

SEQ ID NO: 232178 - RNA, 22 nt, Homo sapiens
uggauaguaaagucagauuccc

SEQ ID NO: 232179 - RNA, 22 nt, Homo sapiens
uggauauguucuuuguguaagg

SEQ ID NO: 232180 - RNA, 22 nt, Homo sapiens
uggauauguuuauauguugucu

SEQ ID NO: 232181 - RNA, 22 nt, Homo sapiens
uggaucaugcgaggccuccccu

SEQ ID NO: 232182 - RNA, 22 nt, Homo sapiens
uggaucauucuuucuugcaggg

SEQ ID NO: 232183 - RNA, 21 nt, Homo sapiens
uggauugagaaccccaggagg

SEQ ID NO: 232184 - RNA, 22 nt, Homo sapiens
uggauugcaaaaucuuuuugag

SEQ ID NO: 232185 - RNA, 21 nt, Homo sapiens
uggauuguacacccuaucauu

SEQ ID NO: 232186 - RNA, 22 nt, Homo sapiens
uggauuguuucucuugguauga

SEQ ID NO: 232187 - RNA, 21 nt, Homo sapiens
uggcaaaaugggcaguggguu

SEQ ID NO: 232188 - RNA, 22 nt, Homo sapiens
uggcaaauauuuuguuuuguaa

SEQ ID NO: 232189 - RNA, 22 nt, Homo sapiens
uggcaaaugugagaugagaacu

SEQ ID NO: 232190 - RNA, 22 nt, Homo sapiens
uggcaagaaccacaguuacuuu

SEQ ID NO: 232191 - RNA, 22 nt, Homo sapiens
uaguagcaccucucaugagcuu

SEQ ID NO: 232192 - RNA, 22 nt, Homo sapiens
uaguagcauaccuaaguauacu

SEQ ID NO: 232193 - RNA, 22 nt, Homo sapiens
uaguagugucccugacuaucac

SEQ ID NO: 232194 - RNA, 22 nt, Homo sapiens
uaguaucauugaaacggcuugu

SEQ ID NO: 232195 - RNA, 22 nt, Homo sapiens
uaguauguuuauagcauugagu

SEQ ID NO: 232196 - RNA, 22 nt, Homo sapiens
uagucaaaucugaaggaaauuu

SEQ ID NO: 232197 - RNA, 20 nt, Homo sapiens
uagucaugagauucuccaag

SEQ ID NO: 232198 - RNA, 22 nt, Homo sapiens
uagucccuuucuauuaaugaga

SEQ ID NO: 232199 - RNA, 22 nt, Homo sapiens
uagugacauugcugggaaugcu

SEQ ID NO: 232200 - RNA, 22 nt, Homo sapiens
uagugcugagauugagaagccc

SEQ ID NO: 232201 - RNA, 22 nt, Homo sapiens
uagugcugugauauuuuuggcc

SEQ ID NO: 232202 - RNA, 22 nt, Homo sapiens
uaguuauggaguaauuuuaagc

SEQ ID NO: 232203 - RNA, 20 nt, Homo sapiens
uaguuggugauacagugcau

SEQ ID NO: 232204 - RNA, 22 nt, Homo sapiens
uaguuguugcagguaggaugua

SEQ ID NO: 232205 - RNA, 22 nt, Homo sapiens
uauaaaguaauuucuaggggcu

SEQ ID NO: 232206 - RNA, 20 nt, Homo sapiens
uauaacaguuuggacccagu

SEQ ID NO: 232207 - RNA, 22 nt, Homo sapiens
uauaagacuagcagcugaauug

SEQ ID NO: 232208 - RNA, 22 nt, Homo sapiens
uauacuguuuucuauaguggcu

SEQ ID NO: 232209 - RNA, 22 nt, Homo sapiens
uauagcacugaccuuccaggac

SEQ ID NO: 232210 - RNA, 17 nt, Homo sapiens
uauagcacuucucacau

SEQ ID NO: 232211 - RNA, 21 nt, Homo sapiens
uauagcagcacgauuuauagu

SEQ ID NO: 232212 - RNA, 22 nt, Homo sapiens
uauagcagugugagaacagacu

SEQ ID NO: 232213 - RNA, 22 nt, Homo sapiens
uauaucacaugcacucauuuuc

SEQ ID NO: 232214 - RNA, 22 nt, Homo sapiens
uauaucuagagcggaccaggcu

SEQ ID NO: 232215 - RNA, 22 nt, Homo sapiens
uauaugcaacauaguguaugug

SEQ ID NO: 232216 - RNA, 22 nt, Homo sapiens
uauaugcacucagguguaugug

SEQ ID NO: 232217 - RNA, 22 nt, Homo sapiens
uauaugcucugggauccugaaa

SEQ ID NO: 232218 - RNA, 22 nt, Homo sapiens
uauaugucugagacugggggau

SEQ ID NO: 232219 - RNA, 22 nt, Homo sapiens
uauauguuuucauaaggcuaga

SEQ ID NO: 232220 - RNA, 22 nt, Homo sapiens
uaucaaacccaaggaggggguu

SEQ ID NO: 232221 - RNA, 19 nt, Homo sapiens
uaucaaguaugcacuguac

SEQ ID NO: 232222 - RNA, 22 nt, Homo sapiens
uaucacacuggaagaaguuaag

SEQ ID NO: 232223 - RNA, 20 nt, Homo sapiens
uaucacaggucagaaacccu

SEQ ID NO: 232224 - RNA, 22 nt, Homo sapiens
uaucacaggucaggaaucuugc

SEQ ID NO: 232225 - RNA, 22 nt, Homo sapiens
uaucacaguaaaucugggugca

SEQ ID NO: 232226 - RNA, 21 nt, Homo sapiens
uaucacaguagaauaggaucu

SEQ ID NO: 232227 - RNA, 22 nt, Homo sapiens
uaucacaguugcauauuuaagg

SEQ ID NO: 232228 - RNA, 22 nt, Homo sapiens
uaucacuuugauaguuuaaaug

SEQ ID NO: 232229 - RNA, 22 nt, Homo sapiens
uaucauaguuuggacuuucauu

SEQ ID NO: 232230 - RNA, 22 nt, Homo sapiens
uaucaugucuguguguaccuag

SEQ ID NO: 232231 - RNA, 22 nt, Homo sapiens
uaucccaauguaauaucacaaa

SEQ ID NO: 232232 - RNA, 23 nt, Homo sapiens
uaucccuugccuuaugaugugag

SEQ ID NO: 232233 - RNA, 22 nt, Homo sapiens
uauccuguagcucauccaccgc

SEQ ID NO: 232234 - RNA, 22 nt, Homo sapiens
uaucuacauguagguauguaug

SEQ ID NO: 232235 - RNA, 20 nt, Homo sapiens
uaucuacuugcaaaugccau

SEQ ID NO: 232236 - RNA, 22 nt, Homo sapiens
uaucucagagaaucagauuuac

SEQ ID NO: 232237 - RNA, 22 nt, Homo sapiens
uaucucaguguacaggaugaua

SEQ ID NO: 232238 - RNA, 18 nt, Homo sapiens
uaucucauuucuuagguc

SEQ ID NO: 232239 - RNA, 22 nt, Homo sapiens
uaucucuguggguagugcugaa

SEQ ID NO: 232240 - RNA, 22 nt, Homo sapiens
uaucugcacuucugucuagguc

SEQ ID NO: 232241 - RNA, 22 nt, Homo sapiens
uaucugcaucccauuuuuauca

SEQ ID NO: 232242 - RNA, 22 nt, Homo sapiens
uaugaacacuuuugggaggcau

SEQ ID NO: 232243 - RNA, 22 nt, Homo sapiens
uaugaaucugagagaucuggaa

SEQ ID NO: 232244 - RNA, 22 nt, Homo sapiens
uaugaaucuggcuacuccaggg

SEQ ID NO: 232245 - RNA, 20 nt, Homo sapiens
uaugacaaagccuagugagu

SEQ ID NO: 232246 - RNA, 20 nt, Homo sapiens
uaugacacugucauaaaaau

SEQ ID NO: 232247 - RNA, 23 nt, Homo sapiens
uaugacagaggaagggggagcug

SEQ ID NO: 232248 - RNA, 22 nt, Homo sapiens
uaugacauaguccuuaacccuc

SEQ ID NO: 232249 - RNA, 22 nt, Homo sapiens
uaugaccuuguccccucucgcc

SEQ ID NO: 232250 - RNA, 22 nt, Homo sapiens
uaugacuguuugcucauucagg

SEQ ID NO: 232251 - RNA, 22 nt, Homo sapiens
uaugacuuguuuucuggucugc

SEQ ID NO: 232252 - RNA, 22 nt, Homo sapiens
uaugagacugguuaauuuuugu

SEQ ID NO: 232253 - RNA, 22 nt, Homo sapiens
uaugagaugaggccacugggua

SEQ ID NO: 232254 - RNA, 22 nt, Homo sapiens
uaugagguagguaugacuauca

SEQ ID NO: 232255 - RNA, 22 nt, Homo sapiens
uaugaucacuacagcagggaug

SEQ ID NO: 232256 - RNA, 22 nt, Homo sapiens
uaugaugcugagguuuggagug

SEQ ID NO: 232257 - RNA, 22 nt, Homo sapiens
uaugcacuauggaaguagcuca

SEQ ID NO: 232258 - RNA, 22 nt, Homo sapiens
uaugccuuuugguucaagcaac

SEQ ID NO: 232259 - RNA, 19 nt, Homo sapiens
uaugcuauuuauuagaagu

SEQ ID NO: 232260 - RNA, 22 nt, Homo sapiens
uaugcuuguuuauuuaagaaac

SEQ ID NO: 232261 - RNA, 22 nt, Homo sapiens
uauggaaaucuuaccuuauggu

SEQ ID NO: 232262 - RNA, 22 nt, Homo sapiens
uauggcauuauuuugauagaca

SEQ ID NO: 232263 - RNA, 22 nt, Homo sapiens
uauggccugcguccagugguau

SEQ ID NO: 232264 - RNA, 22 nt, Homo sapiens
uauggcuacuacgaauaaugcu

SEQ ID NO: 232265 - RNA, 21 nt, Homo sapiens
uauggcuuagucaguguuucc

SEQ ID NO: 232266 - RNA, 22 nt, Homo sapiens
uauggcuuuguuaacauuuucu

SEQ ID NO: 232267 - RNA, 22 nt, Homo sapiens
uauggcuuuuauuauguuguag

SEQ ID NO: 232268 - RNA, 19 nt, Homo sapiens
uaugggauuuuuagggugu

SEQ ID NO: 232269 - RNA, 22 nt, Homo sapiens
uauggguuuauuucuggucuca

SEQ ID NO: 232270 - RNA, 22 nt, Homo sapiens
uauggguuucagagggugauag

SEQ ID NO: 232271 - RNA, 22 nt, Homo sapiens
uaugucacuggacauaaguucu

SEQ ID NO: 232272 - RNA, 23 nt, Homo sapiens
uaugucuauucuaaugccagcac

SEQ ID NO: 232273 - RNA, 22 nt, Homo sapiens
uaugucuucuuuagagaaaugu

SEQ ID NO: 232274 - RNA, 22 nt, Homo sapiens
uaugucuuuugcuugcaaauag

SEQ ID NO: 232275 - RNA, 18 nt, Homo sapiens
uauuaagcuagauauuau

SEQ ID NO: 232276 - RNA, 22 nt, Homo sapiens
uauuacugucaauaucacagaa

SEQ ID NO: 232277 - RNA, 22 nt, Homo sapiens
uauuacuguuauuccuaucaaa

SEQ ID NO: 232278 - RNA, 22 nt, Homo sapiens
uauucaagccaaauucaagcca

SEQ ID NO: 232279 - RNA, 22 nt, Homo sapiens
uauuccacaauaugauuuuuaa

SEQ ID NO: 232280 - RNA, 22 nt, Homo sapiens
uauuccagcccuggugagccag

SEQ ID NO: 232281 - RNA, 18 nt, Homo sapiens
uauuccucuuccucuauc

SEQ ID NO: 232282 - RNA, 22 nt, Homo sapiens
uauuccuuuugcauuuccacau

SEQ ID NO: 232283 - RNA, 17 nt, Homo sapiens
uauugaccuuuguaugu

SEQ ID NO: 232284 - RNA, 22 nt, Homo sapiens
ucucaugaagauagagaauaga

SEQ ID NO: 232285 - RNA, 22 nt, Homo sapiens
ucucauggcucacccugcauag

SEQ ID NO: 232286 - RNA, 22 nt, Homo sapiens
ucuccaguuuccuucgucuauc

SEQ ID NO: 232287 - RNA, 20 nt, Homo sapiens
ucucccaaacagcaggcccu

SEQ ID NO: 232288 - RNA, 22 nt, Homo sapiens
ucucccuaccugagccgagcca

SEQ ID NO: 232289 - RNA, 22 nt, Homo sapiens
ucuccggguggcggcgaaggga

SEQ ID NO: 232290 - RNA, 22 nt, Homo sapiens
ucucugaaacucuugacauccu

SEQ ID NO: 232291 - RNA, 22 nt, Homo sapiens
ucucugacacugaccccaaaaa

SEQ ID NO: 232292 - RNA, 19 nt, Homo sapiens
ucucugguguuggagggga

SEQ ID NO: 232293 - RNA, 22 nt, Homo sapiens
ucugaaucguucccaugcagga

SEQ ID NO: 232294 - RNA, 22 nt, Homo sapiens
ucugacaaugaacaaucuauag

SEQ ID NO: 232295 - RNA, 22 nt, Homo sapiens
ucugacagugagagaaaucuga

SEQ ID NO: 232296 - RNA, 22 nt, Homo sapiens
ucugacagugugaauauugacu

SEQ ID NO: 232297 - RNA, 22 nt, Homo sapiens
ucugacucuggagucucagguu

SEQ ID NO: 232298 - RNA, 22 nt, Homo sapiens
ucugacucugugaugggcccaa

SEQ ID NO: 232299 - RNA, 22 nt, Homo sapiens
ucugagguuacugcuuuguaga

SEQ ID NO: 232300 - RNA, 22 nt, Homo sapiens
ucugcauauucuagggcaccaa

SEQ ID NO: 232301 - RNA, 22 nt, Homo sapiens
ucugccacugucauugugugau

SEQ ID NO: 232302 - RNA, 22 nt, Homo sapiens
ucugccuuuucaugugggaugg

SEQ ID NO: 232303 - RNA, 22 nt, Homo sapiens
ucuggaauguaaaguuuauggg

SEQ ID NO: 232304 - RNA, 21 nt, Homo sapiens
ucuggccccuccaaaucucau

SEQ ID NO: 232305 - RNA, 22 nt, Homo sapiens
ucuggccccucucaaaucucau

SEQ ID NO: 232306 - RNA, 22 nt, Homo sapiens
ucuggccuacaaguaauuuuau

SEQ ID NO: 232307 - RNA, 22 nt, Homo sapiens
ucuggccuacaucauuuuuccg

SEQ ID NO: 232308 - RNA, 22 nt, Homo sapiens
ucuggcuccacacuuuauuaac

SEQ ID NO: 232309 - RNA, 16 nt, Homo sapiens
ucuggcucuacaguuc

SEQ ID NO: 232310 - RNA, 22 nt, Homo sapiens
ucuggcuuauuucacuuagcau

SEQ ID NO: 232311 - RNA, 21 nt, Homo sapiens
ucuggcuuucauuccccuucu

SEQ ID NO: 232312 - RNA, 22 nt, Homo sapiens
ucuggcuuucuuuacuuaaugu

SEQ ID NO: 232313 - RNA, 22 nt, Homo sapiens
ucugguggugaugagagacagu

SEQ ID NO: 232314 - RNA, 23 nt, Homo sapiens
ucugguguugucaaaugcugguu

SEQ ID NO: 232315 - RNA, 22 nt, Homo sapiens
ucuguaacauccaccuucuggg

SEQ ID NO: 232316 - RNA, 22 nt, Homo sapiens
ucuguacugccaaguuucuuua

SEQ ID NO: 232317 - RNA, 19 nt, Homo sapiens
ucuguaguuagggcuacag

SEQ ID NO: 232318 - RNA, 22 nt, Homo sapiens
ucugugaaugugaccuuauuug

SEQ ID NO: 232319 - RNA, 22 nt, Homo sapiens
ucugugguaagaaacgcauguc

SEQ ID NO: 232320 - RNA, 22 nt, Homo sapiens
ucuguggucagaguccuuggcc

SEQ ID NO: 232321 - RNA, 22 nt, Homo sapiens
ucuguggugggcuccacccagu

SEQ ID NO: 232322 - RNA, 22 nt, Homo sapiens
ucugugguuguugcauggaaug

SEQ ID NO: 232323 - RNA, 22 nt, Homo sapiens
ucuguguugaugcucauuaauu

SEQ ID NO: 232324 - RNA, 22 nt, Homo sapiens
ucuguguuugaucaagauugua

SEQ ID NO: 232325 - RNA, 22 nt, Homo sapiens
ucuguguuugguuggcaauuuc

SEQ ID NO: 232326 - RNA, 22 nt, Homo sapiens
ucuuaggauacugaagucgguu

SEQ ID NO: 232327 - RNA, 22 nt, Homo sapiens
ucuuaguuggaaugggauaagg

SEQ ID NO: 232328 - RNA, 22 nt, Homo sapiens
ucuugaacuucauaggucuaga

SEQ ID NO: 232329 - RNA, 22 nt, Homo sapiens
ucuugcaccuacaugcuuuguc

SEQ ID NO: 232330 - RNA, 22 nt, Homo sapiens
ucuugccacuucauccccuuuc

SEQ ID NO: 232331 - RNA, 22 nt, Homo sapiens
ucuugcuuuugcagagcuucuc

SEQ ID NO: 232332 - RNA, 22 nt, Homo sapiens
ucuuggguuuguccuucuccua

SEQ ID NO: 232333 - RNA, 20 nt, Homo sapiens
ucuugguuggaggucuuuua

SEQ ID NO: 232334 - RNA, 22 nt, Homo sapiens
ucuuuagguguuauaguucaag

SEQ ID NO: 232335 - RNA, 22 nt, Homo sapiens
ucuuuaguaauuucuguaaggc

SEQ ID NO: 232336 - RNA, 22 nt, Homo sapiens
ucuuucacuuagcaugauguuu

SEQ ID NO: 232337 - RNA, 19 nt, Homo sapiens
ucuuugaggcaucgcccuc

SEQ ID NO: 232338 - RNA, 22 nt, Homo sapiens
ucuuugaguguauacuuagauu

SEQ ID NO: 232339 - RNA, 22 nt, Homo sapiens
ucuuugaguuauugugcagacu

SEQ ID NO: 232340 - RNA, 22 nt, Homo sapiens
ucuuugauaagauccagaagaa

SEQ ID NO: 232341 - RNA, 22 nt, Homo sapiens
ucuuuggguagauauguagcug

SEQ ID NO: 232342 - RNA, 22 nt, Homo sapiens
ucuuugguaggaguaggaggcc

SEQ ID NO: 232343 - RNA, 22 nt, Homo sapiens
ucuuuggucaucaugggaagca

SEQ ID NO: 232344 - RNA, 22 nt, Homo sapiens
ucuuugguuguuuagggugcau

SEQ ID NO: 232345 - RNA, 22 nt, Homo sapiens
ucuuugucuacauccuguuaaa

SEQ ID NO: 232346 - RNA, 22 nt, Homo sapiens
ucuuuguguucaggagccacgu

SEQ ID NO: 232347 - RNA, 22 nt, Homo sapiens
ucuuuguuagaacccucuccuu

SEQ ID NO: 232348 - RNA, 22 nt, Homo sapiens
ucuuuguucaggagccaacucc

SEQ ID NO: 232349 - RNA, 22 nt, Homo sapiens
ucuuuguuuucugauccugaag

SEQ ID NO: 232350 - RNA, 22 nt, Homo sapiens
ucuuuugguuucuagaggccgc

SEQ ID NO: 232351 - RNA, 22 nt, Homo sapiens
ucuuuuguaaaaugaggaggug

SEQ ID NO: 232352 - RNA, 22 nt, Homo sapiens
ucuuuuugagucaguuucggua

SEQ ID NO: 232353 - RNA, 22 nt, Homo sapiens
ugaaaaguuguugaaggcuuca

SEQ ID NO: 232354 - RNA, 22 nt, Homo sapiens
ugaaacacaccuccucuccauc

SEQ ID NO: 232355 - RNA, 22 nt, Homo sapiens
ugaaacugcagugggcuuggca

SEQ ID NO: 232356 - RNA, 22 nt, Homo sapiens
ugaaagacugaaagcuuuucuu

SEQ ID NO: 232357 - RNA, 22 nt, Homo sapiens
ugaaagcuacaggaaaguauuu

SEQ ID NO: 232358 - RNA, 22 nt, Homo sapiens
ugaaagcuacagucuccuagga

SEQ ID NO: 232359 - RNA, 22 nt, Homo sapiens
ugaaagguuuaauucugugaga

SEQ ID NO: 232360 - RNA, 20 nt, Homo sapiens
ugaaaucuucacuaagucuc

SEQ ID NO: 232361 - RNA, 21 nt, Homo sapiens
ugaaaugcaugugcacauuaa

SEQ ID NO: 232362 - RNA, 22 nt, Homo sapiens
ugaaaugccuugagauuuugac

SEQ ID NO: 232363 - RNA, 22 nt, Homo sapiens
ugaaauguugggugauggaauc

SEQ ID NO: 232364 - RNA, 22 nt, Homo sapiens
ugaaauuguuugcaaggauagg

SEQ ID NO: 232365 - RNA, 22 nt, Homo sapiens
ugaacacaucuccugguaccug

SEQ ID NO: 232366 - RNA, 21 nt, Homo sapiens
ugaacacuggacugagugucc

SEQ ID NO: 232367 - RNA, 22 nt, Homo sapiens
ugaacacuggauaaggagucag

SEQ ID NO: 232368 - RNA, 22 nt, Homo sapiens
ugaacagcaccuccuagaguug

SEQ ID NO: 232369 - RNA, 22 nt, Homo sapiens
ugaacagcuaucuugucagugu

SEQ ID NO: 232370 - RNA, 22 nt, Homo sapiens
ugaacuaguaguuuacuugaug

SEQ ID NO: 232371 - RNA, 22 nt, Homo sapiens
ugaacugagacuagacuuguuc

SEQ ID NO: 232372 - RNA, 20 nt, Homo sapiens
ugaacugguuacuuucuguc

SEQ ID NO: 232373 - RNA, 22 nt, Homo sapiens
ugaagcuaugacuauugagcau

SEQ ID NO: 232374 - RNA, 22 nt, Homo sapiens
ugaaggcaggagggagaaaagu

SEQ ID NO: 232375 - RNA, 22 nt, Homo sapiens
ugaagugaaugguaaguaugcc

SEQ ID NO: 232376 - RNA, 21 nt, Homo sapiens
ugaaguguaaccgugcagggc

SEQ ID NO: 232377 - RNA, 22 nt, Homo sapiens
ugaauacagcacacccaugggu

SEQ ID NO: 232378 - RNA, 22 nt, Homo sapiens
ugaauacugugcaaaggauuug

SEQ ID NO: 232379 - RNA, 22 nt, Homo sapiens
ugaauacuucaaaaaaauagcu

SEQ ID NO: 232380 - RNA, 22 nt, Homo sapiens
ugaauagacagucacugccucc

SEQ ID NO: 232381 - RNA, 22 nt, Homo sapiens
aggagguaggaauugugcuagg

SEQ ID NO: 232382 - RNA, 22 nt, Homo sapiens
aggagguagucugucccuuagc

SEQ ID NO: 232383 - RNA, 22 nt, Homo sapiens
aggaguguguauuaaugaaauu

SEQ ID NO: 232384 - RNA, 22 nt, Homo sapiens
aggcaaaugccagcaaucacac

SEQ ID NO: 232385 - RNA, 16 nt, Homo sapiens
aggcaagaauugaggu

SEQ ID NO: 232386 - RNA, 21 nt, Homo sapiens
aggcaagacuuuuagguuugu

SEQ ID NO: 232387 - RNA, 22 nt, Homo sapiens
aggcaagugggagacagcauuu

SEQ ID NO: 232388 - RNA, 22 nt, Homo sapiens
aggcaaguugcucaaaugcaaa

SEQ ID NO: 232389 - RNA, 22 nt, Homo sapiens
aggcaggugaaagauaguuuua

SEQ ID NO: 232390 - RNA, 22 nt, Homo sapiens
aggcauggagacuaaaauuaua

SEQ ID NO: 232391 - RNA, 22 nt, Homo sapiens
aggcauguggcucuguucugac

SEQ ID NO: 232392 - RNA, 22 nt, Homo sapiens
aggcaugugugcagacugucug

SEQ ID NO: 232393 - RNA, 20 nt, Homo sapiens
aggcauguugguuugcgugu

SEQ ID NO: 232394 - RNA, 22 nt, Homo sapiens
aggcuaagaugacuccaccccc

SEQ ID NO: 232395 - RNA, 22 nt, Homo sapiens
aggcuagaaucuuccaucuugg

SEQ ID NO: 232396 - RNA, 22 nt, Homo sapiens
aggcuagacuuugagaauuuuu

SEQ ID NO: 232397 - RNA, 22 nt, Homo sapiens
aggcuguguggauaauauuggg

SEQ ID NO: 232398 - RNA, 21 nt, Homo sapiens
aggcuguuguuuugggaugga

SEQ ID NO: 232399 - RNA, 22 nt, Homo sapiens
aggcuuuauuacagggucucag

SEQ ID NO: 232400 - RNA, 22 nt, Homo sapiens
aggcuuuuguuuuggucucagg

SEQ ID NO: 232401 - RNA, 22 nt, Homo sapiens
agggagcaaaguggucuuucuc

SEQ ID NO: 232402 - RNA, 22 nt, Homo sapiens
agggcaguguuaggacugucug

SEQ ID NO: 232403 - RNA, 22 nt, Homo sapiens
agggcuuuugagcugagauggu

SEQ ID NO: 232404 - RNA, 22 nt, Homo sapiens
aggguuuuuauuuauguggcau

SEQ ID NO: 232405 - RNA, 22 nt, Homo sapiens
agguaagaugugacuugguguu

SEQ ID NO: 232406 - RNA, 22 nt, Homo sapiens
agguaauagcacaugauaccuu

SEQ ID NO: 232407 - RNA, 20 nt, Homo sapiens
agguacacugacaugccuuc

SEQ ID NO: 232408 - RNA, 22 nt, Homo sapiens
aggucaccucaggaaauacuga

SEQ ID NO: 232409 - RNA, 21 nt, Homo sapiens
aggucaguaagaaugcagcac

SEQ ID NO: 232410 - RNA, 21 nt, Homo sapiens
aggucaugaagauguucuaau

SEQ ID NO: 232411 - RNA, 22 nt, Homo sapiens
agguccacuuacuacuccuguu

SEQ ID NO: 232412 - RNA, 22 nt, Homo sapiens
aggugaaugcucacauucuaau

SEQ ID NO: 232413 - RNA, 22 nt, Homo sapiens
aggugaauggauaaacuguggg

SEQ ID NO: 232414 - RNA, 22 nt, Homo sapiens
aggugcaugcuucacuggauau

SEQ ID NO: 232415 - RNA, 22 nt, Homo sapiens
aggugcugagcagagaauccug

SEQ ID NO: 232416 - RNA, 21 nt, Homo sapiens
aggugucuuggguucccuggc

SEQ ID NO: 232417 - RNA, 22 nt, Homo sapiens
agguuaucccgcauuauuuggu

SEQ ID NO: 232418 - RNA, 20 nt, Homo sapiens
agguuauuauaauuagaaga

SEQ ID NO: 232419 - RNA, 22 nt, Homo sapiens
aguagcacaugccacccugucu

SEQ ID NO: 232420 - RNA, 22 nt, Homo sapiens
aguagcauuggggggcauccuc

SEQ ID NO: 232421 - RNA, 22 nt, Homo sapiens
aguaucaagccacacaugguca

SEQ ID NO: 232422 - RNA, 22 nt, Homo sapiens
aguauuaggugaguguauuuca

SEQ ID NO: 232423 - RNA, 22 nt, Homo sapiens
aguauuuguuggaauaccuguu

SEQ ID NO: 232424 - RNA, 22 nt, Homo sapiens
agucaagugguuucugaguugg

SEQ ID NO: 232425 - RNA, 22 nt, Homo sapiens
agucaaguuuuuucagagaaua

SEQ ID NO: 232426 - RNA, 22 nt, Homo sapiens
agucacagguucuugggauuag

SEQ ID NO: 232427 - RNA, 17 nt, Homo sapiens
agucaguaguuuguauu

SEQ ID NO: 232428 - RNA, 22 nt, Homo sapiens
agucaguggaguaaauguaauu

SEQ ID NO: 232429 - RNA, 22 nt, Homo sapiens
agucauaggagagauaucacug

SEQ ID NO: 232430 - RNA, 22 nt, Homo sapiens
agucauggaucacaguagccuc

SEQ ID NO: 232431 - RNA, 22 nt, Homo sapiens
aguccagguuuuguaauggcaa

SEQ ID NO: 232432 - RNA, 22 nt, Homo sapiens
agucugguguucucacacuagu

SEQ ID NO: 232433 - RNA, 22 nt, Homo sapiens
agugaauguuggaaaguuauuu

SEQ ID NO: 232434 - RNA, 22 nt, Homo sapiens
agugagcugcagucuggggucc

SEQ ID NO: 232435 - RNA, 22 nt, Homo sapiens
agugagcuguuuuuacuuucug

SEQ ID NO: 232436 - RNA, 21 nt, Homo sapiens
agugagucauuuggaaagcaa

SEQ ID NO: 232437 - RNA, 22 nt, Homo sapiens
agugauauguuugccuugaggg

SEQ ID NO: 232438 - RNA, 22 nt, Homo sapiens
agugauuuuaacuuccagcaau

SEQ ID NO: 232439 - RNA, 22 nt, Homo sapiens
agugcaaugauccggugcuggg

SEQ ID NO: 232440 - RNA, 22 nt, Homo sapiens
agugcaauggcgugaucuuggc

SEQ ID NO: 232441 - RNA, 22 nt, Homo sapiens
agugcaguggcacaaucuuggc

SEQ ID NO: 232442 - RNA, 22 nt, Homo sapiens
agugcaguggcauggucauaac

SEQ ID NO: 232443 - RNA, 22 nt, Homo sapiens
agugcaguggugccaucauaac

SEQ ID NO: 232444 - RNA, 22 nt, Homo sapiens
agugcaguugucacgugccuuc

SEQ ID NO: 232445 - RNA, 22 nt, Homo sapiens
agugcauugagacuugugaguu

SEQ ID NO: 232446 - RNA, 23 nt, Homo sapiens
agugccuaguauauaggaggcgc

SEQ ID NO: 232447 - RNA, 22 nt, Homo sapiens
agugccuauugauggaaagaua

SEQ ID NO: 232448 - RNA, 22 nt, Homo sapiens
aguggcacuauucucagaguca

SEQ ID NO: 232449 - RNA, 19 nt, Homo sapiens
agugggcuagaaaucaggg

SEQ ID NO: 232450 - RNA, 22 nt, Homo sapiens
aguggguguuccauuggauaaa

SEQ ID NO: 232451 - RNA, 22 nt, Homo sapiens
agugguauaauauuauuuugaa

SEQ ID NO: 232452 - RNA, 22 nt, Homo sapiens
aguguuuuuaacaagaaagggu

SEQ ID NO: 232453 - RNA, 22 nt, Homo sapiens
aguuagcaaaacucccaaaggu

SEQ ID NO: 232454 - RNA, 22 nt, Homo sapiens
aguuccauuuauucucgucucu

SEQ ID NO: 232455 - RNA, 22 nt, Homo sapiens
aguugcaagucuugaguaaaga

SEQ ID NO: 232456 - RNA, 17 nt, Homo sapiens
auaaacucaucauuuuu

SEQ ID NO: 232457 - RNA, 18 nt, Homo sapiens
auaaacucaucauuuuua

SEQ ID NO: 232458 - RNA, 22 nt, Homo sapiens
auaaagcuauuccucucuuuuu

SEQ ID NO: 232459 - RNA, 22 nt, Homo sapiens
auaaagguaauaauaguugcau

SEQ ID NO: 232460 - RNA, 19 nt, Homo sapiens
auaaaugccuacaagggug

SEQ ID NO: 232461 - RNA, 22 nt, Homo sapiens
auaacagcauuauugcauacgu

SEQ ID NO: 232462 - RNA, 22 nt, Homo sapiens
auaacagcugcaaggcaaaagc

SEQ ID NO: 232463 - RNA, 22 nt, Homo sapiens
auaagaguaguacauaugagac

SEQ ID NO: 232464 - RNA, 22 nt, Homo sapiens
auaaggcuaguguaggagccag

SEQ ID NO: 232465 - RNA, 22 nt, Homo sapiens
auaaucacacccagguuaaaug

SEQ ID NO: 232466 - RNA, 18 nt, Homo sapiens
auacaagcagcagagauu

SEQ ID NO: 232467 - RNA, 22 nt, Homo sapiens
auacacauuccugggccucacc

SEQ ID NO: 232468 - RNA, 22 nt, Homo sapiens
auacacgugcagaacaugcagg

SEQ ID NO: 232469 - RNA, 22 nt, Homo sapiens
auacaguaaugucuuaggcugu

SEQ ID NO: 232470 - RNA, 22 nt, Homo sapiens
auacaguauggagggcccagcu

SEQ ID NO: 232471 - RNA, 22 nt, Homo sapiens
auacagucuguuagauuuccuc

SEQ ID NO: 232472 - RNA, 22 nt, Homo sapiens
auacagugaauacuuacagugu

SEQ ID NO: 232473 - RNA, 22 nt, Homo sapiens
auacaucugccauguuggugug

SEQ ID NO: 232474 - RNA, 22 nt, Homo sapiens
auacaugcauuugcacgagagu

SEQ ID NO: 232475 - RNA, 22 nt, Homo sapiens
auacaugugccauguugguaug

SEQ ID NO: 232476 - RNA, 22 nt, Homo sapiens
auacauguucaagggcauauau

SEQ ID NO: 232477 - RNA, 20 nt, Homo sapiens
auacccaguagcacaacagc

SEQ ID NO: 232478 - RNA, 22 nt, Homo sapiens
auacccugucgugagucagaga

SEQ ID NO: 232479 - RNA, 22 nt, Homo sapiens
gaggcaguguguccguucucgg

SEQ ID NO: 232480 - RNA, 22 nt, Homo sapiens
gaggcuagauggggaugugucc

SEQ ID NO: 232481 - RNA, 22 nt, Homo sapiens
gagguaagaaagucaguccuuc

SEQ ID NO: 232482 - RNA, 22 nt, Homo sapiens
gagguaagaguuuuccauuucu

SEQ ID NO: 232483 - RNA, 22 nt, Homo sapiens
gagguaaguaagaauggcaagc

SEQ ID NO: 232484 - RNA, 21 nt, Homo sapiens
gagguaccucauguaagugga

SEQ ID NO: 232485 - RNA, 22 nt, Homo sapiens
gagguagagacuauguauuaga

SEQ ID NO: 232486 - RNA, 22 nt, Homo sapiens
gagguagagaguuuugauucug

SEQ ID NO: 232487 - RNA, 22 nt, Homo sapiens
gagguaggaauaaacauuugaa

SEQ ID NO: 232488 - RNA, 22 nt, Homo sapiens
gagguaggaggauugcuuaagg

SEQ ID NO: 232489 - RNA, 22 nt, Homo sapiens
gagguagguacaauugccacca

SEQ ID NO: 232490 - RNA, 22 nt, Homo sapiens
gagguagugagcagcugaacua

SEQ ID NO: 232491 - RNA, 22 nt, Homo sapiens
gagguaguuaaugcauucacua

SEQ ID NO: 232492 - RNA, 17 nt, Homo sapiens
gagguaguuuacuuuca

SEQ ID NO: 232493 - RNA, 22 nt, Homo sapiens
gagguaucauuauguugcccag

SEQ ID NO: 232494 - RNA, 22 nt, Homo sapiens
gagguaugauugacauauaaaa

SEQ ID NO: 232495 - RNA, 22 nt, Homo sapiens
gaggugaaggucucaauaaaua

SEQ ID NO: 232496 - RNA, 22 nt, Homo sapiens
gagguggugguggaggcauagc

SEQ ID NO: 232497 - RNA, 22 nt, Homo sapiens
gaguaaaugucacuguugcugu

SEQ ID NO: 232498 - RNA, 22 nt, Homo sapiens
gaguaaauguccuagcuucuug

SEQ ID NO: 232499 - RNA, 22 nt, Homo sapiens
gaguagugcuguaauaaacaua

SEQ ID NO: 232500 - RNA, 22 nt, Homo sapiens
gagugcaagguuuuucugagug

SEQ ID NO: 232501 - RNA, 23 nt, Homo sapiens
gagugcaaugacaugaucucgga

SEQ ID NO: 232502 - RNA, 22 nt, Homo sapiens
gagugcauaugggccuguguca

SEQ ID NO: 232503 - RNA, 23 nt, Homo sapiens
gaguggagacucauugauuuccu

SEQ ID NO: 232504 - RNA, 21 nt, Homo sapiens
gaguggcuuuuguuucaccag

SEQ ID NO: 232505 - RNA, 19 nt, Homo sapiens
gaguugggguuuacuguaa

SEQ ID NO: 232506 - RNA, 22 nt, Homo sapiens
gaguuguuuuaaggcacugacu

SEQ ID NO: 232507 - RNA, 22 nt, Homo sapiens
gaguuuguaaacuauucacuaa

SEQ ID NO: 232508 - RNA, 22 nt, Homo sapiens
gauaaauccagauucugaugua

SEQ ID NO: 232509 - RNA, 22 nt, Homo sapiens
gauacaguaugcaugugguauu

SEQ ID NO: 232510 - RNA, 22 nt, Homo sapiens
gauagaccauccaggauguuug

SEQ ID NO: 232511 - RNA, 22 nt, Homo sapiens
gauagcauucaauuaucuguug

SEQ ID NO: 232512 - RNA, 22 nt, Homo sapiens
gauagguagaagauguuuucau

SEQ ID NO: 232513 - RNA, 22 nt, Homo sapiens
gauaguugugagaacucuuacu

SEQ ID NO: 232514 - RNA, 22 nt, Homo sapiens
gauauguugaguagaguuuuug

SEQ ID NO: 232515 - RNA, 22 nt, Homo sapiens
gaucacauuguuucauacauau

SEQ ID NO: 232516 - RNA, 22 nt, Homo sapiens
gaucagagugaaccuuguuaug

SEQ ID NO: 232517 - RNA, 22 nt, Homo sapiens
gaucugagaaagugucauaaca

SEQ ID NO: 232518 - RNA, 22 nt, Homo sapiens
gaucuggagguuuuccucauga

SEQ ID NO: 232519 - RNA, 19 nt, Homo sapiens
gaucuguugaucaaugugu

SEQ ID NO: 232520 - RNA, 22 nt, Homo sapiens
gaucuguuucaauugucuuagu

SEQ ID NO: 232521 - RNA, 22 nt, Homo sapiens
gaugacuaagaauuuuauaauu

SEQ ID NO: 232522 - RNA, 22 nt, Homo sapiens
gaugauauuugagucauuagaa

SEQ ID NO: 232523 - RNA, 22 nt, Homo sapiens
gaugaucucuggugguaaagac

SEQ ID NO: 232524 - RNA, 22 nt, Homo sapiens
gaugcaaauuaagcuugggaca

SEQ ID NO: 232525 - RNA, 22 nt, Homo sapiens
gauggaauuaaaaucagaauca

SEQ ID NO: 232526 - RNA, 22 nt, Homo sapiens
gauggaguugacuaagacaaca

SEQ ID NO: 232527 - RNA, 22 nt, Homo sapiens
gauggcacuuaagagcaagagc

SEQ ID NO: 232528 - RNA, 22 nt, Homo sapiens
gacuagggaccaugagcaaucc

SEQ ID NO: 232529 - RNA, 22 nt, Homo sapiens
gacucagaacuaaggguguuuc

SEQ ID NO: 232530 - RNA, 18 nt, Homo sapiens
gacuccauuucagccaga

SEQ ID NO: 232531 - RNA, 22 nt, Homo sapiens
gacugaggaagcgcucucuccu

SEQ ID NO: 232532 - RNA, 22 nt, Homo sapiens
gacugaguaagcagaagcaauu

SEQ ID NO: 232533 - RNA, 22 nt, Homo sapiens
gacuggagcuguaugugguuac

SEQ ID NO: 232534 - RNA, 22 nt, Homo sapiens
gacuggccuauaauggcgaauu

SEQ ID NO: 232535 - RNA, 20 nt, Homo sapiens
gacuugagagugggagagua

SEQ ID NO: 232536 - RNA, 22 nt, Homo sapiens
gagaacuaaugguuugauaagg

SEQ ID NO: 232537 - RNA, 22 nt, Homo sapiens
gagaacugagauaagugauauu

SEQ ID NO: 232538 - RNA, 22 nt, Homo sapiens
gagaacuggcgugaacugcacg

SEQ ID NO: 232539 - RNA, 21 nt, Homo sapiens
gagaaucuuuucagggcaaac

SEQ ID NO: 232540 - RNA, 22 nt, Homo sapiens
gagaaugagaggggaaggccac

SEQ ID NO: 232541 - RNA, 22 nt, Homo sapiens
gagacauguuugcuuaucugag

SEQ ID NO: 232542 - RNA, 22 nt, Homo sapiens
gagacggagucacgcccuguca

SEQ ID NO: 232543 - RNA, 22 nt, Homo sapiens
gagacggagucucgcucugucg

SEQ ID NO: 232544 - RNA, 22 nt, Homo sapiens
gagacggagucuugcucuguug

SEQ ID NO: 232545 - RNA, 22 nt, Homo sapiens
gagacucuuagauuggaaaucu

SEQ ID NO: 232546 - RNA, 22 nt, Homo sapiens
gagacugagucucgcucugccg

SEQ ID NO: 232547 - RNA, 22 nt, Homo sapiens
gagagcaugugcuggcaucagu

SEQ ID NO: 232548 - RNA, 21 nt, Homo sapiens
gagaggauucgccagccucuu

SEQ ID NO: 232549 - RNA, 22 nt, Homo sapiens
gagagugugucagaggcugcga

SEQ ID NO: 232550 - RNA, 22 nt, Homo sapiens
gagaucaaugggauggaauuga

SEQ ID NO: 232551 - RNA, 22 nt, Homo sapiens
gagaucaguuaaugaagugagc

SEQ ID NO: 232552 - RNA, 22 nt, Homo sapiens
gagaucauguacuagaacaccu

SEQ ID NO: 232553 - RNA, 22 nt, Homo sapiens
gagaucuauuccucacccuucu

SEQ ID NO: 232554 - RNA, 22 nt, Homo sapiens
gagaucuuggccaaguuucuua

SEQ ID NO: 232555 - RNA, 22 nt, Homo sapiens
gagaugaagugucaauaaggau

SEQ ID NO: 232556 - RNA, 22 nt, Homo sapiens
gagaugaucaugugguuuuguc

SEQ ID NO: 232557 - RNA, 22 nt, Homo sapiens
gagaugauuugccccauguauu

SEQ ID NO: 232558 - RNA, 22 nt, Homo sapiens
gagaugcaccuugucacguuuc

SEQ ID NO: 232559 - RNA, 22 nt, Homo sapiens
gagauggugugcuguuggaagu

SEQ ID NO: 232560 - RNA, 22 nt, Homo sapiens
gagaugguguuccacugccagu

SEQ ID NO: 232561 - RNA, 22 nt, Homo sapiens
gagaugugugugauuauauaau

SEQ ID NO: 232562 - RNA, 22 nt, Homo sapiens
gagauuaauacacaucaaaugc

SEQ ID NO: 232563 - RNA, 22 nt, Homo sapiens
gagauuauuuaaaaggugauuu

SEQ ID NO: 232564 - RNA, 22 nt, Homo sapiens
gagauugucaugauuacauugu

SEQ ID NO: 232565 - RNA, 22 nt, Homo sapiens
gagcaaaaguauguauugguua

SEQ ID NO: 232566 - RNA, 22 nt, Homo sapiens
gagcaacaguggcagugguggg

SEQ ID NO: 232567 - RNA, 22 nt, Homo sapiens
gagcacccuuuguugauugcaa

SEQ ID NO: 232568 - RNA, 18 nt, Homo sapiens
gagcaccuuuuuugcaga

SEQ ID NO: 232569 - RNA, 22 nt, Homo sapiens
gagcaguugagagugcuggcca

SEQ ID NO: 232570 - RNA, 22 nt, Homo sapiens
gagcaucaauggcaugugggaa

SEQ ID NO: 232571 - RNA, 22 nt, Homo sapiens
gagcaucauggggccaaagcgc

SEQ ID NO: 232572 - RNA, 22 nt, Homo sapiens
gagcccauuucacuuguccagc

SEQ ID NO: 232573 - RNA, 22 nt, Homo sapiens
gagcuagaauauuuuguauagu

SEQ ID NO: 232574 - RNA, 22 nt, Homo sapiens
gagcuagggucaugcuacugca

SEQ ID NO: 232575 - RNA, 22 nt, Homo sapiens
gagcuagguuuugaauccagac

SEQ ID NO: 232576 - RNA, 22 nt, Homo sapiens
gagcucauuaaaguaggaccua

SEQ ID NO: 232577 - RNA, 22 nt, Homo sapiens
gagcucauuguugcuaaagaga

SEQ ID NO: 232578 - RNA, 22 nt, Homo sapiens
gagcuccuccccuuggcuuuca

SEQ ID NO: 232579 - RNA, 22 nt, Homo sapiens
gagcugccuugccuaugcaaga

SEQ ID NO: 232580 - RNA, 20 nt, Homo sapiens
gagcugguguacugccgggc

SEQ ID NO: 232581 - RNA, 22 nt, Homo sapiens
gagcuuguggucuucguguuau

SEQ ID NO: 232582 - RNA, 22 nt, Homo sapiens
gaggcaaguggccaccgagucu

SEQ ID NO: 232583 - RNA, 22 nt, Homo sapiens
gaggcaaugugcccggcccaca

SEQ ID NO: 232584 - RNA, 22 nt, Homo sapiens
gaggcacucuguacaaaucugc

SEQ ID NO: 232585 - RNA, 22 nt, Homo sapiens
gaggcagucugucccuuagcag

SEQ ID NO: 232586 - RNA, 22 nt, Homo sapiens
gaggcauugaaauauugcuuau

SEQ ID NO: 232587 - RNA, 22 nt, Homo sapiens
gaggcauugaagauauggaagu

SEQ ID NO: 232588 - RNA, 22 nt, Homo sapiens
gagguaagagaauaaacaguuu

SEQ ID NO: 232589 - RNA, 22 nt, Homo sapiens
gagguagggucccacuauguug

SEQ ID NO: 232590 - RNA, 22 nt, Homo sapiens
gagguagguuugguuacaaaag

SEQ ID NO: 232591 - RNA, 22 nt, Homo sapiens
gagguauaauugacaagcaaaa

SEQ ID NO: 232592 - RNA, 22 nt, Homo sapiens
gagguaugugggcagacauuua

SEQ ID NO: 232593 - RNA, 22 nt, Homo sapiens
gaggucaggacauuuuugcuuu

SEQ ID NO: 232594 - RNA, 22 nt, Homo sapiens
gagguggauacauuaaauaaug

SEQ ID NO: 232595 - RNA, 22 nt, Homo sapiens
gagguguagucaugccaagauc

SEQ ID NO: 232596 - RNA, 22 nt, Homo sapiens
gagguuauuggggugcuugugu

SEQ ID NO: 232597 - RNA, 23 nt, Homo sapiens
gaguacauuaaaagcccagacug

SEQ ID NO: 232598 - RNA, 22 nt, Homo sapiens
gaguaucuuuaaggugguuugg

SEQ ID NO: 232599 - RNA, 22 nt, Homo sapiens
gaguauuuuacaucguguaauu

SEQ ID NO: 232600 - RNA, 22 nt, Homo sapiens
gagucagugucuugcucuguca

SEQ ID NO: 232601 - RNA, 22 nt, Homo sapiens
gagucuauucaauguaguuaga

SEQ ID NO: 232602 - RNA, 22 nt, Homo sapiens
gagugcaauggcaccgucucgg

SEQ ID NO: 232603 - RNA, 22 nt, Homo sapiens
gagugcaauggcaugaucuugg

SEQ ID NO: 232604 - RNA, 22 nt, Homo sapiens
gagugcaauggcgcgaucuggg

SEQ ID NO: 232605 - RNA, 22 nt, Homo sapiens
gagugcaucguggccauuuuaa

SEQ ID NO: 232606 - RNA, 22 nt, Homo sapiens
gagugcauugguggucaggugu

SEQ ID NO: 232607 - RNA, 22 nt, Homo sapiens
gagugcugagcccacuuccuug

SEQ ID NO: 232608 - RNA, 18 nt, Homo sapiens
gaguggugcuucccuugu

SEQ ID NO: 232609 - RNA, 22 nt, Homo sapiens
gaguggugguucugaaacuuuu

SEQ ID NO: 232610 - RNA, 22 nt, Homo sapiens
gaguucauaucuaugagugugc

SEQ ID NO: 232611 - RNA, 22 nt, Homo sapiens
gaguucauuuugaaaccuugau

SEQ ID NO: 232612 - RNA, 22 nt, Homo sapiens
gauaaagauagcaauagggaca

SEQ ID NO: 232613 - RNA, 22 nt, Homo sapiens
gauaacagauaaugucaguuau

SEQ ID NO: 232614 - RNA, 22 nt, Homo sapiens
gauacaccauuuucuagcuauu

SEQ ID NO: 232615 - RNA, 22 nt, Homo sapiens
gauagugaaccaagggguaauu

SEQ ID NO: 232616 - RNA, 19 nt, Homo sapiens
gauaucuagggggagguuc

SEQ ID NO: 232617 - RNA, 21 nt, Homo sapiens
gauaucuuuauucccaagagc

SEQ ID NO: 232618 - RNA, 22 nt, Homo sapiens
gauauguaaaaauuauaucuga

SEQ ID NO: 232619 - RNA, 22 nt, Homo sapiens
gauauguaguaguugaaaaaga

SEQ ID NO: 232620 - RNA, 22 nt, Homo sapiens
gauauguuguuggauucgguua

SEQ ID NO: 232621 - RNA, 22 nt, Homo sapiens
gauauguuucuucaauaccuag

SEQ ID NO: 232622 - RNA, 22 nt, Homo sapiens
gauauuacuuccaauauugcaa

SEQ ID NO: 232623 - RNA, 22 nt, Homo sapiens
gauauugacuuauucuauguuu

SEQ ID NO: 232624 - RNA, 22 nt, Homo sapiens
gaucacauggccauuucuagcu

SEQ ID NO: 232625 - RNA, 22 nt, Homo sapiens
gaugacagugaguaaccccaac

SEQ ID NO: 232626 - RNA, 22 nt, Homo sapiens
gaugagcuaaguucucacagca

SEQ ID NO: 232627 - RNA, 22 nt, Homo sapiens
gaugagguagaagacucagcaa

SEQ ID NO: 232628 - RNA, 22 nt, Homo sapiens
gaugagguaguguaccuagucu

SEQ ID NO: 232629 - RNA, 22 nt, Homo sapiens
gaugguggucuacccuuucccu

SEQ ID NO: 232630 - RNA, 22 nt, Homo sapiens
gauggugucccaggcucaggcu

SEQ ID NO: 232631 - RNA, 22 nt, Homo sapiens
gauguagaaagagugggcugga

SEQ ID NO: 232632 - RNA, 22 nt, Homo sapiens
gaugugaaaucauaguuucuag

SEQ ID NO: 232633 - RNA, 22 nt, Homo sapiens
gauuauagaaguaauggguuua

SEQ ID NO: 232634 - RNA, 22 nt, Homo sapiens
gauuccauugcgaauuuucaga

SEQ ID NO: 232635 - RNA, 22 nt, Homo sapiens
gauuggcauugcugcaccugag

SEQ ID NO: 232636 - RNA, 22 nt, Homo sapiens
gauuucaucuuuagaggaagga

SEQ ID NO: 232637 - RNA, 22 nt, Homo sapiens
gauuuuuggggaagccucuuau

SEQ ID NO: 232638 - RNA, 21 nt, Homo sapiens
gcaaacauccuuugaugccag

SEQ ID NO: 232639 - RNA, 21 nt, Homo sapiens
gcaaaguggcuaccuugcucc

SEQ ID NO: 232640 - RNA, 20 nt, Homo sapiens
gcaaaguuuagcucccacua

SEQ ID NO: 232641 - RNA, 22 nt, Homo sapiens
gcaaaugcuacaccauuuugua

SEQ ID NO: 232642 - RNA, 20 nt, Homo sapiens
gcaaauggaucccacaagcc

SEQ ID NO: 232643 - RNA, 22 nt, Homo sapiens
gcaagaaugagaaggauuaauu

SEQ ID NO: 232644 - RNA, 22 nt, Homo sapiens
gcaauacugacagcauuaguuu

SEQ ID NO: 232645 - RNA, 22 nt, Homo sapiens
gcacacguagaagcaugcauca

SEQ ID NO: 232646 - RNA, 22 nt, Homo sapiens
gcacagaugaggagaggucuca

SEQ ID NO: 232647 - RNA, 22 nt, Homo sapiens
gcacaguguuacuugauauauu

SEQ ID NO: 232648 - RNA, 22 nt, Homo sapiens
gcacauggccacuaggaauaaa

SEQ ID NO: 232649 - RNA, 22 nt, Homo sapiens
gcaccaugguagaauaauggua

SEQ ID NO: 232650 - RNA, 22 nt, Homo sapiens
gcacgugcacccacaugcacgu

SEQ ID NO: 232651 - RNA, 22 nt, Homo sapiens
gcacgugcucauuugaggucuu

SEQ ID NO: 232652 - RNA, 22 nt, Homo sapiens
gcagcacaugacuguauguaua

SEQ ID NO: 232653 - RNA, 22 nt, Homo sapiens
gcagugaugugaucauagcuca

SEQ ID NO: 232654 - RNA, 16 nt, Homo sapiens
gcaguguguuuaauag

SEQ ID NO: 232655 - RNA, 22 nt, Homo sapiens
gcaguguuggggccggaggcug

SEQ ID NO: 232656 - RNA, 22 nt, Homo sapiens
gcaucacagcuccugugcuggc

SEQ ID NO: 232657 - RNA, 22 nt, Homo sapiens
gcaucacagggagacaggccuc

SEQ ID NO: 232658 - RNA, 22 nt, Homo sapiens
gcaugcauuuuccuaacuagaa

SEQ ID NO: 232659 - RNA, 22 nt, Homo sapiens
gcauggauguugauggcugcug

SEQ ID NO: 232660 - RNA, 22 nt, Homo sapiens
gcauggccuuuaaaugucacag

SEQ ID NO: 232661 - RNA, 22 nt, Homo sapiens
gcaugugaauguguaagaaaau

SEQ ID NO: 232662 - RNA, 22 nt, Homo sapiens
gccaaaaugcugggauuacagg

SEQ ID NO: 232663 - RNA, 22 nt, Homo sapiens
gccaacauggcgcuccauucuu

SEQ ID NO: 232664 - RNA, 18 nt, Homo sapiens
gccaacauguaaacaggu

SEQ ID NO: 232665 - RNA, 22 nt, Homo sapiens
gccaagauugguuuaauauucc

SEQ ID NO: 232666 - RNA, 19 nt, Homo sapiens
gccaccuggugcguguucu

SEQ ID NO: 232667 - RNA, 22 nt, Homo sapiens
gccaguauuuuauugagaauuu

SEQ ID NO: 232668 - RNA, 22 nt, Homo sapiens
gccaguauuuuguugagaauuu

SEQ ID NO: 232669 - RNA, 22 nt, Homo sapiens
gccaguguguguuguucuccgc

SEQ ID NO: 232670 - RNA, 22 nt, Homo sapiens
gccauugcacuccagccuaggu

SEQ ID NO: 232671 - RNA, 22 nt, Homo sapiens
gccauugcacuccagccucggc

SEQ ID NO: 232672 - RNA, 22 nt, Homo sapiens
gccauugcacuccagcuugggc

SEQ ID NO: 232673 - RNA, 22 nt, Homo sapiens
gcccagcguucagggaggggcu

SEQ ID NO: 232674 - RNA, 22 nt, Homo sapiens
gcccauuguuccuaggcuacaa

SEQ ID NO: 232675 - RNA, 22 nt, Homo sapiens
gcccugagauucuuggauucug

SEQ ID NO: 232676 - RNA, 22 nt, Homo sapiens
gcccuguaguauaguuugaagu

SEQ ID NO: 232677 - RNA, 22 nt, Homo sapiens
gcccuguguuuggguaugguca

SEQ ID NO: 232678 - RNA, 17 nt, Homo sapiens
gcccuuugugccucuuc

SEQ ID NO: 232679 - RNA, 22 nt, Homo sapiens
gccuagagacuugguaucuugc

SEQ ID NO: 232680 - RNA, 22 nt, Homo sapiens
gccuagauccaaauauggugca

SEQ ID NO: 232681 - RNA, 22 nt, Homo sapiens
gccuuuggugacaggcaugugu

SEQ ID NO: 232682 - RNA, 20 nt, Homo sapiens
gcuaaggcacgggaauuacu

SEQ ID NO: 232683 - RNA, 22 nt, Homo sapiens
gcuagcacauugucaccucuca

SEQ ID NO: 232684 - RNA, 22 nt, Homo sapiens
gcuaggagaucugcugcucucu

SEQ ID NO: 232685 - RNA, 19 nt, Homo sapiens
gcucaccuugcugcuccag

SEQ ID NO: 232686 - RNA, 22 nt, Homo sapiens
gcucaguuuccucagcugcaaa

SEQ ID NO: 232687 - RNA, 22 nt, Homo sapiens
gcucaugagacaagcaggagua

SEQ ID NO: 232688 - RNA, 22 nt, Homo sapiens
gcuccuuugaguagcuucugug

SEQ ID NO: 232689 - RNA, 22 nt, Homo sapiens
gcucguuuuugccucugguugc

SEQ ID NO: 232690 - RNA, 22 nt, Homo sapiens
gcugacacugggcuauagaucu

SEQ ID NO: 232691 - RNA, 22 nt, Homo sapiens
gcugagacauugguuuucuccu

SEQ ID NO: 232692 - RNA, 22 nt, Homo sapiens
gcugagcuaugccauauaugcc

SEQ ID NO: 232693 - RNA, 22 nt, Homo sapiens
gcugagguucaagaagguuaaa

SEQ ID NO: 232694 - RNA, 19 nt, Homo sapiens
gcugauguuacauucuugc

SEQ ID NO: 232695 - RNA, 22 nt, Homo sapiens
gcugcuguaccagaugugguua

SEQ ID NO: 232696 - RNA, 22 nt, Homo sapiens
gcugcuguuucucuuucagcau

SEQ ID NO: 232697 - RNA, 22 nt, Homo sapiens
gcugcuuuugaugacaaaaaca

SEQ ID NO: 232698 - RNA, 22 nt, Homo sapiens
gcuggugacuuuaaguugaagc

SEQ ID NO: 232699 - RNA, 22 nt, Homo sapiens
gcugguguucaggcccucaguc

SEQ ID NO: 232700 - RNA, 22 nt, Homo sapiens
gcugguguugugaaucaggccg

SEQ ID NO: 232701 - RNA, 19 nt, Homo sapiens
gcugguuguccacucucuc

SEQ ID NO: 232702 - RNA, 22 nt, Homo sapiens
gcuguaguugaggauuuuaaga

SEQ ID NO: 232703 - RNA, 22 nt, Homo sapiens
gcuguauuguugaaggaaaugu

SEQ ID NO: 232704 - RNA, 22 nt, Homo sapiens
gcuguguucucgaggcggggga

SEQ ID NO: 232705 - RNA, 22 nt, Homo sapiens
gcuugguccccacccaaaucgc

SEQ ID NO: 232706 - RNA, 22 nt, Homo sapiens
gcuuguguucaagucacccuua

SEQ ID NO: 232707 - RNA, 22 nt, Homo sapiens
gcuuuguuaaaacacagccaca

SEQ ID NO: 232708 - RNA, 22 nt, Homo sapiens
gcuuuguuguugaugggaaauc

SEQ ID NO: 232709 - RNA, 22 nt, Homo sapiens
ggaaagacaccuuacuauguua

SEQ ID NO: 232710 - RNA, 22 nt, Homo sapiens
ggaaagauguaauauuaucuaa

SEQ ID NO: 232711 - RNA, 23 nt, Homo sapiens
ggaaauguuuaagggguugggag

SEQ ID NO: 232712 - RNA, 20 nt, Homo sapiens
ggaagagugacacaagguau

SEQ ID NO: 232713 - RNA, 18 nt, Homo sapiens
ggaagauuggcuaugugc

SEQ ID NO: 232714 - RNA, 18 nt, Homo sapiens
ggaagccuauuuaguaac

SEQ ID NO: 232715 - RNA, 22 nt, Homo sapiens
ggaagccuggaaaaaauuguga

SEQ ID NO: 232716 - RNA, 22 nt, Homo sapiens
ggaagguaauuggguaaugaga

SEQ ID NO: 232717 - RNA, 22 nt, Homo sapiens
ggaaggucaaagggaaagcaga

SEQ ID NO: 232718 - RNA, 22 nt, Homo sapiens
ggaagugugaguaggauuugga

SEQ ID NO: 232719 - RNA, 22 nt, Homo sapiens
ggaauaguauaaauaccacaaa

SEQ ID NO: 232720 - RNA, 22 nt, Homo sapiens
ggaaugugugucaugcuuuugc

SEQ ID NO: 232721 - RNA, 20 nt, Homo sapiens
ggaauguuaaucuccaugau

SEQ ID NO: 232722 - RNA, 21 nt, Homo sapiens
ggaauguugccagcagccaga

SEQ ID NO: 232723 - RNA, 22 nt, Homo sapiens
ggaauugcaucaaaugcaggua

SEQ ID NO: 232724 - RNA, 22 nt, Homo sapiens
guaacuggccuucaauuucuuc

SEQ ID NO: 232725 - RNA, 22 nt, Homo sapiens
guaagagcauguaguggcucua

SEQ ID NO: 232726 - RNA, 22 nt, Homo sapiens
guaaggcuucuggcccuuaacu

SEQ ID NO: 232727 - RNA, 22 nt, Homo sapiens
guaagugauagaauuaggauuc

SEQ ID NO: 232728 - RNA, 22 nt, Homo sapiens
guaagugguagagcugggcuau

SEQ ID NO: 232729 - RNA, 22 nt, Homo sapiens
guaaucucagcuacucgggaga

SEQ ID NO: 232730 - RNA, 22 nt, Homo sapiens
guaaucucagcuacuugggagu

SEQ ID NO: 232731 - RNA, 22 nt, Homo sapiens
guaaucucagcuccucaugagg

SEQ ID NO: 232732 - RNA, 22 nt, Homo sapiens
guaaucuguaguaaagcaccau

SEQ ID NO: 232733 - RNA, 19 nt, Homo sapiens
guaaugugcuucaguagca

SEQ ID NO: 232734 - RNA, 22 nt, Homo sapiens
guacaaguaagaaaauugccca

SEQ ID NO: 232735 - RNA, 16 nt, Homo sapiens
guacacaguaaguaug

SEQ ID NO: 232736 - RNA, 22 nt, Homo sapiens
guacaugcauaguuuauuucug

SEQ ID NO: 232737 - RNA, 22 nt, Homo sapiens
guacauguaugcaugcaugcau

SEQ ID NO: 232738 - RNA, 22 nt, Homo sapiens
guacaugugcacagugugcagg

SEQ ID NO: 232739 - RNA, 22 nt, Homo sapiens
guaccuguauguucauuucaca

SEQ ID NO: 232740 - RNA, 17 nt, Homo sapiens
guacucagugaccaugg

SEQ ID NO: 232741 - RNA, 22 nt, Homo sapiens
guacuuuguuauaacccacagg

SEQ ID NO: 232742 - RNA, 22 nt, Homo sapiens
guagaucucaacacuggaagua

SEQ ID NO: 232743 - RNA, 22 nt, Homo sapiens
guagcagaacauguuccuugua

SEQ ID NO: 232744 - RNA, 22 nt, Homo sapiens
guagcagcaauuuacuccauac

SEQ ID NO: 232745 - RNA, 22 nt, Homo sapiens
guagguaaguacuucuggugag

SEQ ID NO: 232746 - RNA, 18 nt, Homo sapiens
guaggucaguaccaagca

SEQ ID NO: 232747 - RNA, 22 nt, Homo sapiens
guaguggcaugaucuuggcuca

SEQ ID NO: 232748 - RNA, 22 nt, Homo sapiens
guauaaguugacucaaucuuug

SEQ ID NO: 232749 - RNA, 22 nt, Homo sapiens
guauacacccugugauauuauu

SEQ ID NO: 232750 - RNA, 22 nt, Homo sapiens
guauacaguugacccuugaacc

SEQ ID NO: 232751 - RNA, 22 nt, Homo sapiens
guauacuucugaaaauagcuau

SEQ ID NO: 232752 - RNA, 22 nt, Homo sapiens
guauagcacauaauacuugaug

SEQ ID NO: 232753 - RNA, 22 nt, Homo sapiens
guauaguaguacaaaaguuuuu

SEQ ID NO: 232754 - RNA, 22 nt, Homo sapiens
guauaugccucaguuauagcac

SEQ ID NO: 232755 - RNA, 22 nt, Homo sapiens
guaugaccucgcuuuauugcag

SEQ ID NO: 232756 - RNA, 22 nt, Homo sapiens
guaugcaagugauaugacauau

SEQ ID NO: 232757 - RNA, 22 nt, Homo sapiens
guaugcacauauguguauguau

SEQ ID NO: 232758 - RNA, 22 nt, Homo sapiens
guauggcacuauccucucugau

SEQ ID NO: 232759 - RNA, 22 nt, Homo sapiens
guauggcaugcaugagaauuuc

SEQ ID NO: 232760 - RNA, 21 nt, Homo sapiens
guauggcauugauuaguuacu

SEQ ID NO: 232761 - RNA, 22 nt, Homo sapiens
guaugucuugucuauggcugcu

SEQ ID NO: 232762 - RNA, 22 nt, Homo sapiens
guaugugacuggaacaguagga

SEQ ID NO: 232763 - RNA, 22 nt, Homo sapiens
guaugugcauuguaaauuuuga

SEQ ID NO: 232764 - RNA, 18 nt, Homo sapiens
guauuccagccugaguga

SEQ ID NO: 232765 - RNA, 22 nt, Homo sapiens
guauugacauuuuuaaggaacu

SEQ ID NO: 232766 - RNA, 22 nt, Homo sapiens
guauugcuugagcccaggaguu

SEQ ID NO: 232767 - RNA, 22 nt, Homo sapiens
guauuuguugcagcagcacuau

SEQ ID NO: 232768 - RNA, 22 nt, Homo sapiens
gucaaagugauuguaauuaggu

SEQ ID NO: 232769 - RNA, 22 nt, Homo sapiens
gucaaaugcacagaaccauuaa

SEQ ID NO: 232770 - RNA, 22 nt, Homo sapiens
gucaacauauuaauuauguucu

SEQ ID NO: 232771 - RNA, 22 nt, Homo sapiens
gucaagugaagaccugacucuu

SEQ ID NO: 232772 - RNA, 22 nt, Homo sapiens
gucaagugaagcagugggagua

SEQ ID NO: 232773 - RNA, 22 nt, Homo sapiens
gucaauguaucuagcuguauua

SEQ ID NO: 232774 - RNA, 22 nt, Homo sapiens
gucaccauugagucauuuccuc

SEQ ID NO: 232775 - RNA, 22 nt, Homo sapiens
gucacggagauauggauucgga

SEQ ID NO: 232776 - RNA, 22 nt, Homo sapiens
gucacugacaagagagaagaac

SEQ ID NO: 232777 - RNA, 22 nt, Homo sapiens
gucacugagaagguuaguuugu

SEQ ID NO: 232778 - RNA, 20 nt, Homo sapiens
gucacuggcccagggcuugu

SEQ ID NO: 232779 - RNA, 22 nt, Homo sapiens
gucacuggcugucuuguaugau

SEQ ID NO: 232780 - RNA, 22 nt, Homo sapiens
gucacugugacggcaguuacau

SEQ ID NO: 232781 - RNA, 22 nt, Homo sapiens
gucagaaucucagaugacaacg

SEQ ID NO: 232782 - RNA, 22 nt, Homo sapiens
gucagcaaaguucuccugcaga

SEQ ID NO: 232783 - RNA, 22 nt, Homo sapiens
gucagcuuguccagagacucug

SEQ ID NO: 232784 - RNA, 22 nt, Homo sapiens
gucaggcaccgauacaguuuuu

SEQ ID NO: 232785 - RNA, 22 nt, Homo sapiens
gucagggagggauagaugauua

SEQ ID NO: 232786 - RNA, 22 nt, Homo sapiens
gucaguggauacugucucuguc

SEQ ID NO: 232787 - RNA, 22 nt, Homo sapiens
gucagugucuuaacagagauua

SEQ ID NO: 232788 - RNA, 22 nt, Homo sapiens
gucagugucuuugcagcucaga

SEQ ID NO: 232789 - RNA, 22 nt, Homo sapiens
gucaguucuugugguugcauuc

SEQ ID NO: 232790 - RNA, 22 nt, Homo sapiens
gucauaugcucggaaaauguua

SEQ ID NO: 232791 - RNA, 22 nt, Homo sapiens
gucauggagggacauaacuaac

SEQ ID NO: 232792 - RNA, 22 nt, Homo sapiens
gucauugaaguggaaucaucca

SEQ ID NO: 232793 - RNA, 22 nt, Homo sapiens
gucauugcacuccagccuggac

SEQ ID NO: 232794 - RNA, 21 nt, Homo sapiens
guccaaaacaguguccaaugc

SEQ ID NO: 232795 - RNA, 22 nt, Homo sapiens
gucccagagauauugugucuuu

SEQ ID NO: 232796 - RNA, 22 nt, Homo sapiens
gucccugugucuuuauguggcc

SEQ ID NO: 232797 - RNA, 22 nt, Homo sapiens
guccuugaggcuuugacugugg

SEQ ID NO: 232798 - RNA, 22 nt, Homo sapiens
gucucauugcaguuagaccugu

SEQ ID NO: 232799 - RNA, 22 nt, Homo sapiens
gucucccagccuacaucuuucu

SEQ ID NO: 232800 - RNA, 22 nt, Homo sapiens
gucuccgagccguguggagccg

SEQ ID NO: 232801 - RNA, 22 nt, Homo sapiens
gucucugagaugucaacaccua

SEQ ID NO: 232802 - RNA, 22 nt, Homo sapiens
gucuggagacuugggucaucaa

SEQ ID NO: 232803 - RNA, 22 nt, Homo sapiens
gucuggcuuaucucacuuacca

SEQ ID NO: 232804 - RNA, 22 nt, Homo sapiens
gucugguacuuguuuguaaggg

SEQ ID NO: 232805 - RNA, 22 nt, Homo sapiens
gucugguuggaguaguuuucag

SEQ ID NO: 232806 - RNA, 22 nt, Homo sapiens
gucugucuuuugucuuugaaau

SEQ ID NO: 232807 - RNA, 22 nt, Homo sapiens
gucuguuugauccagaucaaaa

SEQ ID NO: 232808 - RNA, 22 nt, Homo sapiens
gucuguuuggggaccuguggcc

SEQ ID NO: 232809 - RNA, 22 nt, Homo sapiens
gucuuagguuuaaucacuucua

SEQ ID NO: 232810 - RNA, 22 nt, Homo sapiens
gucuuccagccuccaucuuucu

SEQ ID NO: 232811 - RNA, 22 nt, Homo sapiens
gucuugcacuuaccuaagaacu

SEQ ID NO: 232812 - RNA, 20 nt, Homo sapiens
gucuugcuccguugcccagg

SEQ ID NO: 232813 - RNA, 22 nt, Homo sapiens
gucuuggagacauugccauuga

SEQ ID NO: 232814 - RNA, 22 nt, Homo sapiens
gucuuugcauguauguucauga

SEQ ID NO: 232815 - RNA, 22 nt, Homo sapiens
gucuuuguuuugauuuaccaga

SEQ ID NO: 232816 - RNA, 22 nt, Homo sapiens
gugaaagauuaaaccagugugu

SEQ ID NO: 232817 - RNA, 22 nt, Homo sapiens
gugaaauauuuaacguccaggu

SEQ ID NO: 232818 - RNA, 22 nt, Homo sapiens
gugaaguuuuuugcugagaguc

SEQ ID NO: 232819 - RNA, 22 nt, Homo sapiens
gugaaucuguuuucuucuguuc

SEQ ID NO: 232820 - RNA, 22 nt, Homo sapiens
gugacaucagcuccagguauaa

SEQ ID NO: 232821 - RNA, 22 nt, Homo sapiens
gugacauuauuucagcuacaug

SEQ ID NO: 232822 - RNA, 22 nt, Homo sapiens
guuauuaguugauauuaaguuc

SEQ ID NO: 232823 - RNA, 22 nt, Homo sapiens
guuauugcucucgaagacucuc

SEQ ID NO: 232824 - RNA, 22 nt, Homo sapiens
guucaaggaauguuggcuucuc

SEQ ID NO: 232825 - RNA, 22 nt, Homo sapiens
guucacucuggagaauauugac

SEQ ID NO: 232826 - RNA, 22 nt, Homo sapiens
guucagcaggggcuucaauggu

SEQ ID NO: 232827 - RNA, 22 nt, Homo sapiens
guucaucagggauacuggccug

SEQ ID NO: 232828 - RNA, 22 nt, Homo sapiens
guucaucagggauauuggcuua

SEQ ID NO: 232829 - RNA, 20 nt, Homo sapiens
guucauguaauuaguucagg

SEQ ID NO: 232830 - RNA, 22 nt, Homo sapiens
guuccuuguagaugcuggauau

SEQ ID NO: 232831 - RNA, 22 nt, Homo sapiens
guugacuaggagcuacuacuac

SEQ ID NO: 232832 - RNA, 18 nt, Homo sapiens
guugagcuuuuccuuuag

SEQ ID NO: 232833 - RNA, 17 nt, Homo sapiens
guugaguuugagucaag

SEQ ID NO: 232834 - RNA, 22 nt, Homo sapiens
guugauguugcagucuugagga

SEQ ID NO: 232835 - RNA, 22 nt, Homo sapiens
guugcucaggcuggagugcagu

SEQ ID NO: 232836 - RNA, 22 nt, Homo sapiens
guuggaguuaagcaguaaugaa

SEQ ID NO: 232837 - RNA, 22 nt, Homo sapiens
guuggcuuuuuaaggaaauugc

SEQ ID NO: 232838 - RNA, 22 nt, Homo sapiens
guuguacuaccucucguauuag

SEQ ID NO: 232839 - RNA, 22 nt, Homo sapiens
guuuacagucgacuugggaaua

SEQ ID NO: 232840 - RNA, 22 nt, Homo sapiens
guuuaggaaugagaauauuuag

SEQ ID NO: 232841 - RNA, 22 nt, Homo sapiens
guuugcauagugcugggagggg

SEQ ID NO: 232842 - RNA, 22 nt, Homo sapiens
guuuggauuuucuaauuucugu

SEQ ID NO: 232843 - RNA, 22 nt, Homo sapiens
guuuggcuuucucucuauccug

SEQ ID NO: 232844 - RNA, 22 nt, Homo sapiens
guuugguugcauggaaaauuua

SEQ ID NO: 232845 - RNA, 22 nt, Homo sapiens
guuuguaacucuagugacuaga

SEQ ID NO: 232846 - RNA, 22 nt, Homo sapiens
guuugugguuaaagccuuucau

SEQ ID NO: 232847 - RNA, 22 nt, Homo sapiens
guuuugguuauauggaucaguu

SEQ ID NO: 232848 - RNA, 22 nt, Homo sapiens
uaaaagucaucacaacuggagu

SEQ ID NO: 232849 - RNA, 22 nt, Homo sapiens
uaaaccuagcauuuugcauaug

SEQ ID NO: 232850 - RNA, 22 nt, Homo sapiens
uaaagagcuuuugaggugucau

SEQ ID NO: 232851 - RNA, 22 nt, Homo sapiens
uaaagauaaggcucgcuuggau

SEQ ID NO: 232852 - RNA, 22 nt, Homo sapiens
uaaagaugcugggaaggcuagg

SEQ ID NO: 232853 - RNA, 22 nt, Homo sapiens
uaaagcacaaguaaagaauacu

SEQ ID NO: 232854 - RNA, 22 nt, Homo sapiens
uaaagccagugauuaugucucu

SEQ ID NO: 232855 - RNA, 22 nt, Homo sapiens
uaaagcgaggucuccuacaaga

SEQ ID NO: 232856 - RNA, 22 nt, Homo sapiens
uaaagcuaugagaacaccguag

SEQ ID NO: 232857 - RNA, 20 nt, Homo sapiens
uaaagcugcucagggggcuc

SEQ ID NO: 232858 - RNA, 18 nt, Homo sapiens
uaaaggcacuguguuguu

SEQ ID NO: 232859 - RNA, 22 nt, Homo sapiens
uaaagugaggauggcaguaggu

SEQ ID NO: 232860 - RNA, 22 nt, Homo sapiens
uaaaguguuuguuauuaaaggu

SEQ ID NO: 232861 - RNA, 20 nt, Homo sapiens
uaaaugccucaugcuuuauu

SEQ ID NO: 232862 - RNA, 22 nt, Homo sapiens
uaaauggauaaaugaauaccua

SEQ ID NO: 232863 - RNA, 22 nt, Homo sapiens
uaaauugcauaaguacaaauga

SEQ ID NO: 232864 - RNA, 18 nt, Homo sapiens
uaaauugcuucaccugag

SEQ ID NO: 232865 - RNA, 22 nt, Homo sapiens
uaacaagagagucagucagucc

SEQ ID NO: 232866 - RNA, 22 nt, Homo sapiens
uaacagucaagguuugaccagg

SEQ ID NO: 232867 - RNA, 22 nt, Homo sapiens
uaacagucuccucaagguguug

SEQ ID NO: 232868 - RNA, 22 nt, Homo sapiens
uaacaguguauuccuuuggaca

SEQ ID NO: 232869 - RNA, 22 nt, Homo sapiens
uaacaguguauuuacuacuucc

SEQ ID NO: 232870 - RNA, 22 nt, Homo sapiens
uaacauagucauauacuugcuu

SEQ ID NO: 232871 - RNA, 23 nt, Homo sapiens
uaacauguuuuuaagggaagcuu

SEQ ID NO: 232872 - RNA, 22 nt, Homo sapiens
uaacauugucuugcuuaguuuu

SEQ ID NO: 232873 - RNA, 22 nt, Homo sapiens
uaacuagaaaggagacaguugc

SEQ ID NO: 232874 - RNA, 22 nt, Homo sapiens
uaacugcaaccucugccugcug

SEQ ID NO: 232875 - RNA, 18 nt, Homo sapiens
uaacugugggaacuaacu

SEQ ID NO: 232876 - RNA, 22 nt, Homo sapiens
uaacuucaucauaagucaagaa

SEQ ID NO: 232877 - RNA, 23 nt, Homo sapiens
uaagacacuaacuuuaugcuuug

SEQ ID NO: 232878 - RNA, 20 nt, Homo sapiens
uaagacaugguccacaugcc

SEQ ID NO: 232879 - RNA, 22 nt, Homo sapiens
uaagacuguguaauuuaugaag

SEQ ID NO: 232880 - RNA, 22 nt, Homo sapiens
uaagacuuuuugggaauauaga

SEQ ID NO: 232881 - RNA, 20 nt, Homo sapiens
uaagccacacagucuaaggu

SEQ ID NO: 232882 - RNA, 22 nt, Homo sapiens
uaaggaguagaauaguaaggca

SEQ ID NO: 232883 - RNA, 22 nt, Homo sapiens
uaaggauuuuggugauuacacu

SEQ ID NO: 232884 - RNA, 22 nt, Homo sapiens
uaaggcaaucagucaugguguu

SEQ ID NO: 232885 - RNA, 22 nt, Homo sapiens
uaaggcacauaggccuggaaac

SEQ ID NO: 232886 - RNA, 22 nt, Homo sapiens
uaaggcccauucuaugaagcag

SEQ ID NO: 232887 - RNA, 22 nt, Homo sapiens
uaaggcuagcaagaugagaaua

SEQ ID NO: 232888 - RNA, 22 nt, Homo sapiens
uaaggcuaggaauucucugaag

SEQ ID NO: 232889 - RNA, 22 nt, Homo sapiens
uaaggcuuaugguaaaguccug

SEQ ID NO: 232890 - RNA, 22 nt, Homo sapiens
uaaggcuuuuguucagcguggg

SEQ ID NO: 232891 - RNA, 22 nt, Homo sapiens
uaagggacgcccccuucucucu

SEQ ID NO: 232892 - RNA, 22 nt, Homo sapiens
uaagguauuuacauuucuguuu

SEQ ID NO: 232893 - RNA, 22 nt, Homo sapiens
uaagguguagacuggucacaag

SEQ ID NO: 232894 - RNA, 22 nt, Homo sapiens
uaagguuuuugauaugcugcug

SEQ ID NO: 232895 - RNA, 22 nt, Homo sapiens
uaaguaauuuguauuuuaccca

SEQ ID NO: 232896 - RNA, 22 nt, Homo sapiens
uaaguacugucagaauuggacu

SEQ ID NO: 232897 - RNA, 22 nt, Homo sapiens
uaaguacuuuacagacauuauc

SEQ ID NO: 232898 - RNA, 22 nt, Homo sapiens
uaaguagaggaaucauuuugug

SEQ ID NO: 232899 - RNA, 22 nt, Homo sapiens
uaaguagugugcauguauguau

SEQ ID NO: 232900 - RNA, 22 nt, Homo sapiens
uaaguaguguugagacaaguuu

SEQ ID NO: 232901 - RNA, 22 nt, Homo sapiens
uaaguaguuucuggauauucuc

SEQ ID NO: 232902 - RNA, 22 nt, Homo sapiens
uaaguaucaguuuagcuaugau

SEQ ID NO: 232903 - RNA, 22 nt, Homo sapiens
uaagucacuccagguuaaagug

SEQ ID NO: 232904 - RNA, 22 nt, Homo sapiens
uaagugaaggaaguguguuuac

SEQ ID NO: 232905 - RNA, 22 nt, Homo sapiens
uaagugaauuucacuacugagu

SEQ ID NO: 232906 - RNA, 22 nt, Homo sapiens
uaagugacuuugagauuccuca

SEQ ID NO: 232907 - RNA, 22 nt, Homo sapiens
uaagugaugucuuuuugugugc

SEQ ID NO: 232908 - RNA, 22 nt, Homo sapiens
uaagugcuguguuguuaccuaa

SEQ ID NO: 232909 - RNA, 20 nt, Homo sapiens
uaagugcuugagacuucuga

SEQ ID NO: 232910 - RNA, 18 nt, Homo sapiens
uaagugcuuuaaacacau

SEQ ID NO: 232911 - RNA, 22 nt, Homo sapiens
uaagugguguucauucuuuuga

SEQ ID NO: 232912 - RNA, 22 nt, Homo sapiens
uaaguugcagguugugauucca

SEQ ID NO: 232913 - RNA, 21 nt, Homo sapiens
uaauaaugucucagacaccua

SEQ ID NO: 232914 - RNA, 22 nt, Homo sapiens
uaauacuagugaauagcaggau

SEQ ID NO: 232915 - RNA, 22 nt, Homo sapiens
uaauagcucggauaaacaugau

SEQ ID NO: 232916 - RNA, 22 nt, Homo sapiens
uaauaugugguugcuugggcac

SEQ ID NO: 232917 - RNA, 22 nt, Homo sapiens
uaauccuggcacuuugggaggc

SEQ ID NO: 232918 - RNA, 22 nt, Homo sapiens
uaaugugaauagugcuguaaug

SEQ ID NO: 232919 - RNA, 22 nt, Homo sapiens
uaauugcaguucuguguuauau

SEQ ID NO: 232920 - RNA, 22 nt, Homo sapiens
uagcuggaguuuuuguuauagg

SEQ ID NO: 232921 - RNA, 22 nt, Homo sapiens
uagcugguucuccaggagcuag

SEQ ID NO: 232922 - RNA, 17 nt, Homo sapiens
uagcuucacauuaggaa

SEQ ID NO: 232923 - RNA, 22 nt, Homo sapiens
uagcuucuccauagcuccaugu

SEQ ID NO: 232924 - RNA, 18 nt, Homo sapiens
uaggaacauugauuggag

SEQ ID NO: 232925 - RNA, 22 nt, Homo sapiens
uaggaaguacaucucagaaucu

SEQ ID NO: 232926 - RNA, 22 nt, Homo sapiens
uaggaaguuuucuugcugggcc

SEQ ID NO: 232927 - RNA, 22 nt, Homo sapiens
uaggacacagaccuggauggaa

SEQ ID NO: 232928 - RNA, 22 nt, Homo sapiens
uaggacacagauggagaaaagc

SEQ ID NO: 232929 - RNA, 22 nt, Homo sapiens
uaggacauugcccuuguggaga

SEQ ID NO: 232930 - RNA, 22 nt, Homo sapiens
uaggagcacaaaccccauugug

SEQ ID NO: 232931 - RNA, 22 nt, Homo sapiens
uaggcaauguggcgaaacucug

SEQ ID NO: 232932 - RNA, 22 nt, Homo sapiens
uaggcaguguucucacuuguaa

SEQ ID NO: 232933 - RNA, 22 nt, Homo sapiens
uaggcuguguggccguggggcu

SEQ ID NO: 232934 - RNA, 22 nt, Homo sapiens
uaggcuuuucugggaugugggc

SEQ ID NO: 232935 - RNA, 22 nt, Homo sapiens
uaggcuuuuggacccugucucu

SEQ ID NO: 232936 - RNA, 19 nt, Homo sapiens
uagggcacgaggcagaguc

SEQ ID NO: 232937 - RNA, 22 nt, Homo sapiens
uagggcuugugaucagguguag

SEQ ID NO: 232938 - RNA, 22 nt, Homo sapiens
uaggggcacacuucgguuagca

SEQ ID NO: 232939 - RNA, 19 nt, Homo sapiens
uagguacauucaagucucc

SEQ ID NO: 232940 - RNA, 22 nt, Homo sapiens
uagguacuuuacauguuaucuc

SEQ ID NO: 232941 - RNA, 22 nt, Homo sapiens
uagguagaacuuuagacccugu

SEQ ID NO: 232942 - RNA, 22 nt, Homo sapiens
uagguaggugucauaauccaug

SEQ ID NO: 232943 - RNA, 22 nt, Homo sapiens
uagguaguuagcauacuacaca

SEQ ID NO: 232944 - RNA, 22 nt, Homo sapiens
uagguaucuuuauagcaguagc

SEQ ID NO: 232945 - RNA, 22 nt, Homo sapiens
uaggucaguuuuggcuuggcuu

SEQ ID NO: 232946 - RNA, 22 nt, Homo sapiens
uaggucccguuucagacugaga

SEQ ID NO: 232947 - RNA, 22 nt, Homo sapiens
uaggucuccuuuuugccuaaau

SEQ ID NO: 232948 - RNA, 22 nt, Homo sapiens
uaggucuuuuaugaaauauauu

SEQ ID NO: 232949 - RNA, 22 nt, Homo sapiens
uaggugaaugcuggaagaaaug

SEQ ID NO: 232950 - RNA, 22 nt, Homo sapiens
uaggugaauguaguaagguguu

SEQ ID NO: 232951 - RNA, 22 nt, Homo sapiens
uaggugauccauuuguauuuua

SEQ ID NO: 232952 - RNA, 22 nt, Homo sapiens
uaggugcacaguaaauauaugu

SEQ ID NO: 232953 - RNA, 22 nt, Homo sapiens
uagguuaucucaaguguaauuu

SEQ ID NO: 232954 - RNA, 22 nt, Homo sapiens
uagguucucaggaaugagcuuc

SEQ ID NO: 232955 - RNA, 22 nt, Homo sapiens
uagguuguguucugagccucag

SEQ ID NO: 232956 - RNA, 20 nt, Homo sapiens
uagguuuucacagaauugcc

SEQ ID NO: 232957 - RNA, 22 nt, Homo sapiens
uaguaaacagcucugccacaau

SEQ ID NO: 232958 - RNA, 23 nt, Homo sapiens
uaguaccauauuguuggcagcac

SEQ ID NO: 232959 - RNA, 22 nt, Homo sapiens
uaguagagauggggcacaugcc

SEQ ID NO: 232960 - RNA, 22 nt, Homo sapiens
uaguaggacaggauuucaguua

SEQ ID NO: 232961 - RNA, 22 nt, Homo sapiens
uaguaguuuuguguauaauaau

SEQ ID NO: 232962 - RNA, 22 nt, Homo sapiens
uagugaaugucacuggcuguug

SEQ ID NO: 232963 - RNA, 21 nt, Homo sapiens
uagugcugaggcaguauggga

SEQ ID NO: 232964 - RNA, 18 nt, Homo sapiens
uagugcuguucucaugau

SEQ ID NO: 232965 - RNA, 22 nt, Homo sapiens
uagugguaguagcaguaauauu

SEQ ID NO: 232966 - RNA, 22 nt, Homo sapiens
uaguuaguagacucugauuauu

SEQ ID NO: 232967 - RNA, 22 nt, Homo sapiens
uaguugcauucaggauaugacg

SEQ ID NO: 232968 - RNA, 22 nt, Homo sapiens
uaguuuaucuucuggauggaca

SEQ ID NO: 232969 - RNA, 22 nt, Homo sapiens
uauaacaaugcaagaauggccu

SEQ ID NO: 232970 - RNA, 23 nt, Homo sapiens
uauaacuuuuaauuuacuggccu

SEQ ID NO: 232971 - RNA, 22 nt, Homo sapiens
uauacaugugccauguuggugu

SEQ ID NO: 232972 - RNA, 20 nt, Homo sapiens
uauagcaauuuuuuucuccu

SEQ ID NO: 232973 - RNA, 22 nt, Homo sapiens
uauagcaguguaagaaucgagu

SEQ ID NO: 232974 - RNA, 22 nt, Homo sapiens
uauagcauuuugauccuguaga

SEQ ID NO: 232975 - RNA, 22 nt, Homo sapiens
uauagcuugaaggaauggucau

SEQ ID NO: 232976 - RNA, 21 nt, Homo sapiens
uauaguaguaugauuuacaau

SEQ ID NO: 232977 - RNA, 22 nt, Homo sapiens
uauaucuguccauggcccugcu

SEQ ID NO: 232978 - RNA, 22 nt, Homo sapiens
uauaugucuuuguuauguugag

SEQ ID NO: 232979 - RNA, 23 nt, Homo sapiens
uauaugugucuaggagcuauggu

SEQ ID NO: 232980 - RNA, 22 nt, Homo sapiens
uauauguucugugucccuuucg

SEQ ID NO: 232981 - RNA, 22 nt, Homo sapiens
uaucaagauggauaaggauaga

SEQ ID NO: 232982 - RNA, 22 nt, Homo sapiens
uaucacagaggguauccuagag

SEQ ID NO: 232983 - RNA, 22 nt, Homo sapiens
uaucaccacccugggaaacaua

SEQ ID NO: 232984 - RNA, 22 nt, Homo sapiens
uaucaccauguccguuuuaaaa

SEQ ID NO: 232985 - RNA, 22 nt, Homo sapiens
uaucaccuugcaguggaugcua

SEQ ID NO: 232986 - RNA, 22 nt, Homo sapiens
uaucaccuugguagucuugggg

SEQ ID NO: 232987 - RNA, 22 nt, Homo sapiens
uaucagauugcugccaucugcu

SEQ ID NO: 232988 - RNA, 22 nt, Homo sapiens
uaucagcagagucauacuucaa

SEQ ID NO: 232989 - RNA, 22 nt, Homo sapiens
uaucagugaaucuuauuuugcc

SEQ ID NO: 232990 - RNA, 22 nt, Homo sapiens
uaucauggaaugagguuggaca

SEQ ID NO: 232991 - RNA, 22 nt, Homo sapiens
uaucauugccucaaucuguauu

SEQ ID NO: 232992 - RNA, 21 nt, Homo sapiens
uauccacuugcaacagagaag

SEQ ID NO: 232993 - RNA, 21 nt, Homo sapiens
uaucccagucacaucuaccca

SEQ ID NO: 232994 - RNA, 22 nt, Homo sapiens
uaucccaguggauguaccccau

SEQ ID NO: 232995 - RNA, 22 nt, Homo sapiens
uaucccuguggacuucccaaca

SEQ ID NO: 232996 - RNA, 22 nt, Homo sapiens
uauccugaagcuuuauuuaagu

SEQ ID NO: 232997 - RNA, 22 nt, Homo sapiens
uaucucacauauucaguagguu

SEQ ID NO: 232998 - RNA, 22 nt, Homo sapiens
uaucucagaguguacaagauua

SEQ ID NO: 232999 - RNA, 22 nt, Homo sapiens
uaucucagaugagacuuguaac

SEQ ID NO: 233000 - RNA, 20 nt, Homo sapiens
uaucucaguuuguccuaaac

SEQ ID NO: 233001 - RNA, 21 nt, Homo sapiens
uaucucaguuuuccuuugugg

SEQ ID NO: 233002 - RNA, 22 nt, Homo sapiens
uaugacucagaaggcacacaca

SEQ ID NO: 233003 - RNA, 22 nt, Homo sapiens
uaugagacugugagugagaaau

SEQ ID NO: 233004 - RNA, 22 nt, Homo sapiens
uaugagcaaaaugaggguuagu

SEQ ID NO: 233005 - RNA, 22 nt, Homo sapiens
uaugcacacacguguuuaugug

SEQ ID NO: 233006 - RNA, 22 nt, Homo sapiens
uaugcacaugcaugcuugaaua

SEQ ID NO: 233007 - RNA, 22 nt, Homo sapiens
uaugcacuauagcauauguggu

SEQ ID NO: 233008 - RNA, 22 nt, Homo sapiens
uaugcaugucucuguacacgug

SEQ ID NO: 233009 - RNA, 22 nt, Homo sapiens
uaugccucuucauaaaguauga

SEQ ID NO: 233010 - RNA, 22 nt, Homo sapiens
uaugccuuucucacuaagcuua

SEQ ID NO: 233011 - RNA, 22 nt, Homo sapiens
uaugcuuauuaaaacagugugu

SEQ ID NO: 233012 - RNA, 22 nt, Homo sapiens
uauggauguuaagguucacagc

SEQ ID NO: 233013 - RNA, 22 nt, Homo sapiens
uauggauucuagcucaguaggu

SEQ ID NO: 233014 - RNA, 22 nt, Homo sapiens
uauggauuucauuagacuugag

SEQ ID NO: 233015 - RNA, 22 nt, Homo sapiens
uauggauuuuuuugacaagagc

SEQ ID NO: 233016 - RNA, 22 nt, Homo sapiens
uauggcacuaguacuggaaagc

SEQ ID NO: 233017 - RNA, 22 nt, Homo sapiens
uauggcauuuuguaagggcuug

SEQ ID NO: 233018 - RNA, 20 nt, Homo sapiens
cauugcccuccagccugggc

SEQ ID NO: 233019 - RNA, 22 nt, Homo sapiens
cauugcccuccagccugggcaa

SEQ ID NO: 233020 - RNA, 22 nt, Homo sapiens
cauuggugauuagugaaugaac

SEQ ID NO: 233021 - RNA, 22 nt, Homo sapiens
cauuuuacuuuccagacgugga

SEQ ID NO: 233022 - RNA, 22 nt, Homo sapiens
ccaaaucucauguugaaaugug

SEQ ID NO: 233023 - RNA, 22 nt, Homo sapiens
ccacacugucuuggugggaaac

SEQ ID NO: 233024 - RNA, 22 nt, Homo sapiens
ccacauuaccuugcuugcucca

SEQ ID NO: 233025 - RNA, 22 nt, Homo sapiens
ccacugggcaguuuauuaucag

SEQ ID NO: 233026 - RNA, 22 nt, Homo sapiens
ccagaauucucauuggaaggaa

SEQ ID NO: 233027 - RNA, 22 nt, Homo sapiens
ccaggguuccacgccuggcugu

SEQ ID NO: 233028 - RNA, 22 nt, Homo sapiens
ccagugucugacagacacggcg

SEQ ID NO: 233029 - RNA, 20 nt, Homo sapiens
ccaguguuauuuauguucua

SEQ ID NO: 233030 - RNA, 19 nt, Homo sapiens
ccaguguucugauugcacu

SEQ ID NO: 233031 - RNA, 22 nt, Homo sapiens
ccaguguucuggaaggcugagu

SEQ ID NO: 233032 - RNA, 22 nt, Homo sapiens
ccauggcaauggucagucuauu

SEQ ID NO: 233033 - RNA, 22 nt, Homo sapiens
ccauuucacucuuccugaagga

SEQ ID NO: 233034 - RNA, 22 nt, Homo sapiens
cccaguuuugcuucucaugagg

SEQ ID NO: 233035 - RNA, 22 nt, Homo sapiens
ccccaguguguaaaggccuugc

SEQ ID NO: 233036 - RNA, 22 nt, Homo sapiens
ccccugaaacucacucauuauc

SEQ ID NO: 233037 - RNA, 22 nt, Homo sapiens
cccugaagaaagccuaggacau

SEQ ID NO: 233038 - RNA, 22 nt, Homo sapiens
cccuugcacuucagagcugcau

SEQ ID NO: 233039 - RNA, 22 nt, Homo sapiens
ccucauggagaacuucugcuag

SEQ ID NO: 233040 - RNA, 22 nt, Homo sapiens
ccuccauuugugucaggaaguc

SEQ ID NO: 233041 - RNA, 21 nt, Homo sapiens
ccucuuugagggaagaaaggg

SEQ ID NO: 233042 - RNA, 22 nt, Homo sapiens
ccuggaucauugucauucccaa

SEQ ID NO: 233043 - RNA, 18 nt, Homo sapiens
ccuuaguuauagagaguc

SEQ ID NO: 233044 - RNA, 22 nt, Homo sapiens
ccuucauccuccagcaggcuag

SEQ ID NO: 233045 - RNA, 22 nt, Homo sapiens
ccuuuuuguaguggaaguagga

SEQ ID NO: 233046 - RNA, 22 nt, Homo sapiens
cuaacacagagguuuauuucuc

SEQ ID NO: 233047 - RNA, 17 nt, Homo sapiens
cuaaggcaagagucugc

SEQ ID NO: 233048 - RNA, 19 nt, Homo sapiens
cuaaguccccuugauuaga

SEQ ID NO: 233049 - RNA, 22 nt, Homo sapiens
cuacagcagcccaguccccgaa

SEQ ID NO: 233050 - RNA, 22 nt, Homo sapiens
cuacauuguagguauucaaacu

SEQ ID NO: 233051 - RNA, 23 nt, Homo sapiens
cuacuagucaagucuuuuccagu

SEQ ID NO: 233052 - RNA, 22 nt, Homo sapiens
cuagacacugacguuccuccga

SEQ ID NO: 233053 - RNA, 22 nt, Homo sapiens
cuagauuauccaacuuauuagc

SEQ ID NO: 233054 - RNA, 22 nt, Homo sapiens
cuauguaccuggaacuguauua

SEQ ID NO: 233055 - RNA, 22 nt, Homo sapiens
cucacuggguguaaaacaugua

SEQ ID NO: 233056 - RNA, 22 nt, Homo sapiens
cucagagcacaguuuaugacag

SEQ ID NO: 233057 - RNA, 22 nt, Homo sapiens
cucagugaagggcaagaggcaa

SEQ ID NO: 233058 - RNA, 21 nt, Homo sapiens
cucauauugcuuuuccauggu

SEQ ID NO: 233059 - RNA, 22 nt, Homo sapiens
cucauuggcuacugaggcuugu

SEQ ID NO: 233060 - RNA, 22 nt, Homo sapiens
cuccacugagcaggugggaggc

SEQ ID NO: 233061 - RNA, 22 nt, Homo sapiens
cucccuuugcugaauguuuuuc

SEQ ID NO: 233062 - RNA, 22 nt, Homo sapiens
cucuuuaguaagcaguugauga

SEQ ID NO: 233063 - RNA, 22 nt, Homo sapiens
cugaaagguauacgcuuguuau

SEQ ID NO: 233064 - RNA, 22 nt, Homo sapiens
cugaagugcuugccacauaaaa

SEQ ID NO: 233065 - RNA, 22 nt, Homo sapiens
cugacauuguugaucacagcca

SEQ ID NO: 233066 - RNA, 22 nt, Homo sapiens
cugagaaugaugauuuccaguu

SEQ ID NO: 233067 - RNA, 22 nt, Homo sapiens
cugagcuagaccacuuggcucc

SEQ ID NO: 233068 - RNA, 22 nt, Homo sapiens
cugaggacaucagggaagcauc

SEQ ID NO: 233069 - RNA, 22 nt, Homo sapiens
cugaggguagaaggaucacuug

SEQ ID NO: 233070 - RNA, 22 nt, Homo sapiens
cugagguaggugaucagugcuu

SEQ ID NO: 233071 - RNA, 22 nt, Homo sapiens
cugaugguuuuacacaagggca

SEQ ID NO: 233072 - RNA, 20 nt, Homo sapiens
cugcaaaugcugcugcugau

SEQ ID NO: 233073 - RNA, 22 nt, Homo sapiens
cugcuguuguuaacuuuuggag

SEQ ID NO: 233074 - RNA, 22 nt, Homo sapiens
cuggaaagcaaagggugcauug

SEQ ID NO: 233075 - RNA, 22 nt, Homo sapiens
cuggaguaugaaccauguauca

SEQ ID NO: 233076 - RNA, 22 nt, Homo sapiens
cuggaguaugauguuagcguug

SEQ ID NO: 233077 - RNA, 22 nt, Homo sapiens
cuggaguuugaggcugcaguga

SEQ ID NO: 233078 - RNA, 22 nt, Homo sapiens
cuggcaaaaagagggcaauaau

SEQ ID NO: 233079 - RNA, 19 nt, Homo sapiens
cuggcaaaugcuuuggcca

SEQ ID NO: 233080 - RNA, 22 nt, Homo sapiens
cugggaugugacuguugccccc

SEQ ID NO: 233081 - RNA, 21 nt, Homo sapiens
cugguccccuuuauguaugug

SEQ ID NO: 233082 - RNA, 22 nt, Homo sapiens
cuguaaaguucucauuguagcc

SEQ ID NO: 233083 - RNA, 23 nt, Homo sapiens
cuguacacauauacaucuaagua

SEQ ID NO: 233084 - RNA, 19 nt, Homo sapiens
cugucacugaggaagacug

SEQ ID NO: 233085 - RNA, 22 nt, Homo sapiens
cuguguaguacuagauugagca

SEQ ID NO: 233086 - RNA, 22 nt, Homo sapiens
cuguuagguuaaggaauggcaa

SEQ ID NO: 233087 - RNA, 18 nt, Homo sapiens
cuuaacauugggaugaua

SEQ ID NO: 233088 - RNA, 22 nt, Homo sapiens
cuucagcaauauauccccuggg

SEQ ID NO: 233089 - RNA, 22 nt, Homo sapiens
cuucccguuauugcccuugggu

SEQ ID NO: 233090 - RNA, 22 nt, Homo sapiens
cuucugauugaaaauggaguag

SEQ ID NO: 233091 - RNA, 22 nt, Homo sapiens
cuucuguuaguucugauaacuu

SEQ ID NO: 233092 - RNA, 22 nt, Homo sapiens
cuugcacauuacagaucugcau

SEQ ID NO: 233093 - RNA, 22 nt, Homo sapiens
cuugcagagcccauggauguca

SEQ ID NO: 233094 - RNA, 22 nt, Homo sapiens
cuugcagaggcccuggggagag

SEQ ID NO: 233095 - RNA, 22 nt, Homo sapiens
cuugguuacauuuuccuagaaa

SEQ ID NO: 233096 - RNA, 22 nt, Homo sapiens
cuuuccauuguuggagcauaaa

SEQ ID NO: 233097 - RNA, 22 nt, Homo sapiens
cuuuuacacuguuggcaggauu

SEQ ID NO: 233098 - RNA, 22 nt, Homo sapiens
cuuuuggcuuagaauugucuug

SEQ ID NO: 233099 - RNA, 22 nt, Homo sapiens
cuuuuggugugaagaagcucuu

SEQ ID NO: 233100 - RNA, 22 nt, Homo sapiens
cuuuugugauuccucaguuacu

SEQ ID NO: 233101 - RNA, 22 nt, Homo sapiens
cuuuugugauucuucaguuacu

SEQ ID NO: 233102 - RNA, 22 nt, Homo sapiens
cuuuugugauucuucaguugcu

SEQ ID NO: 233103 - RNA, 22 nt, Homo sapiens
gaaaguaauuaacgauuguugc

SEQ ID NO: 233104 - RNA, 22 nt, Homo sapiens
gaaauguuuuucaugugggcaa

SEQ ID NO: 233105 - RNA, 22 nt, Homo sapiens
gaacuguaaagaaauucuaagg

SEQ ID NO: 233106 - RNA, 22 nt, Homo sapiens
gaaggcacugugugccacccug

SEQ ID NO: 233107 - RNA, 19 nt, Homo sapiens
guaaucucaguacuuuggu

SEQ ID NO: 233108 - RNA, 22 nt, Homo sapiens
guacccuggaacaacccaauuu

SEQ ID NO: 233109 - RNA, 22 nt, Homo sapiens
guaccuguauguucauuucaca

SEQ ID NO: 233110 - RNA, 22 nt, Homo sapiens
guaugacacaggaagcuuaacc

SEQ ID NO: 233111 - RNA, 21 nt, Homo sapiens
guauggcauugauuaguuacu

SEQ ID NO: 233112 - RNA, 22 nt, Homo sapiens
guaugucuuuauagcagugugg

SEQ ID NO: 233113 - RNA, 22 nt, Homo sapiens
gucacugggugcugcgccuguc

SEQ ID NO: 233114 - RNA, 22 nt, Homo sapiens
gucagcuuuuccuuacuuuagg

SEQ ID NO: 233115 - RNA, 22 nt, Homo sapiens
gucagguaccugaaagcagcca

SEQ ID NO: 233116 - RNA, 22 nt, Homo sapiens
gucauguuuaacuucuugagga

SEQ ID NO: 233117 - RNA, 22 nt, Homo sapiens
gucucccaaccccugugcccag

SEQ ID NO: 233118 - RNA, 22 nt, Homo sapiens
gucuccggcuguccuuugaggu

SEQ ID NO: 233119 - RNA, 22 nt, Homo sapiens
gucuggagacuugggucaucaa

SEQ ID NO: 233120 - RNA, 22 nt, Homo sapiens
gucuuuggaaaaaaugucuguu

SEQ ID NO: 233121 - RNA, 22 nt, Homo sapiens
gucuuuugcuagccagagagcu

SEQ ID NO: 233122 - RNA, 22 nt, Homo sapiens
gugaaagauuaaaccagugugu

SEQ ID NO: 233123 - RNA, 22 nt, Homo sapiens
gugaacagaaccugggaucgaa

SEQ ID NO: 233124 - RNA, 22 nt, Homo sapiens
gugaaugaaugggugaauacau

SEQ ID NO: 233125 - RNA, 22 nt, Homo sapiens
gugagaauugacacccuugucu

SEQ ID NO: 233126 - RNA, 22 nt, Homo sapiens
gugagacugguucugaacccag

SEQ ID NO: 233127 - RNA, 22 nt, Homo sapiens
gugagcacugaaagaaggcaag

SEQ ID NO: 233128 - RNA, 22 nt, Homo sapiens
gugagcagagaucgcgugauug

SEQ ID NO: 233129 - RNA, 22 nt, Homo sapiens
gugagggaugugaaaaagguca

SEQ ID NO: 233130 - RNA, 22 nt, Homo sapiens
gugaggucagggcuguggacag

SEQ ID NO: 233131 - RNA, 22 nt, Homo sapiens
gugcaauguuaauuacuugacu

SEQ ID NO: 233132 - RNA, 22 nt, Homo sapiens
guggaaaacauaugcuuguuga

SEQ ID NO: 233133 - RNA, 22 nt, Homo sapiens
guggaaaaguaguugcgguuuu

SEQ ID NO: 233134 - RNA, 17 nt, Homo sapiens
guggauagaacaaugaa

SEQ ID NO: 233135 - RNA, 22 nt, Homo sapiens
guggaucacuugaggucaagag

SEQ ID NO: 233136 - RNA, 22 nt, Homo sapiens
gugggaagcuggaacucccucc

SEQ ID NO: 233137 - RNA, 22 nt, Homo sapiens
gugggcucguucguguuagaca

SEQ ID NO: 233138 - RNA, 22 nt, Homo sapiens
gugguucuagaauugaguaucc

SEQ ID NO: 233139 - RNA, 22 nt, Homo sapiens
gugugauuauuucaauugaugc

SEQ ID NO: 233140 - RNA, 22 nt, Homo sapiens
guguuauuuugcugggaaugau

SEQ ID NO: 233141 - RNA, 22 nt, Homo sapiens
guuaugcagcuuagaaaaugaa

SEQ ID NO: 233142 - RNA, 22 nt, Homo sapiens
guuauguuauguuauguuaugu

SEQ ID NO: 233143 - RNA, 22 nt, Homo sapiens
guuauuaguugauauuaaguuc

SEQ ID NO: 233144 - RNA, 22 nt, Homo sapiens
guucagguauucuggaacagag

SEQ ID NO: 233145 - RNA, 22 nt, Homo sapiens
guucaguaguucauucauuuau

SEQ ID NO: 233146 - RNA, 22 nt, Homo sapiens
guuggaguuaagcaguaaugaa

SEQ ID NO: 233147 - RNA, 22 nt, Homo sapiens
guuugugcuccuaugagaaucu

SEQ ID NO: 233148 - RNA, 21 nt, Homo sapiens
uaaaacuguaacuuuguccug

SEQ ID NO: 233149 - RNA, 22 nt, Homo sapiens
uaaagccagugauuaugucucu

SEQ ID NO: 233150 - RNA, 22 nt, Homo sapiens
uaaagcuuagauccaugguggc

SEQ ID NO: 233151 - RNA, 22 nt, Homo sapiens
uaaagcuuggauuuaggcuaau

SEQ ID NO: 233152 - RNA, 22 nt, Homo sapiens
uaaaugacugucaguagaugaa

SEQ ID NO: 233153 - RNA, 22 nt, Homo sapiens
uaacaccuugcucugucaauaa

SEQ ID NO: 233154 - RNA, 22 nt, Homo sapiens
uaacagcauuugugucuaguag

SEQ ID NO: 233155 - RNA, 22 nt, Homo sapiens
uaacuguggaaaugacuuuaaa

SEQ ID NO: 233156 - RNA, 22 nt, Homo sapiens
uaagagcuaggauuuuaaauca

SEQ ID NO: 233157 - RNA, 22 nt, Homo sapiens
uaagaugaaggcucaccuagaa

SEQ ID NO: 233158 - RNA, 22 nt, Homo sapiens
uaaggaacucugauaucuggaa

SEQ ID NO: 233159 - RNA, 22 nt, Homo sapiens
uaagucacuccagguuaaagug

SEQ ID NO: 233160 - RNA, 22 nt, Homo sapiens
uaagugaaggaaguguguuuac

SEQ ID NO: 233161 - RNA, 22 nt, Homo sapiens
uaagugaauauggacaguuagc

SEQ ID NO: 233162 - RNA, 22 nt, Homo sapiens
uaagugaauuucacuacugagu

SEQ ID NO: 233163 - RNA, 20 nt, Homo sapiens
uaagugcauaggauauuucu

SEQ ID NO: 233164 - RNA, 21 nt, Homo sapiens
uaauaaugucucagacaccua

SEQ ID NO: 233165 - RNA, 22 nt, Homo sapiens
uaauacauucaaggugguaguu

SEQ ID NO: 233166 - RNA, 22 nt, Homo sapiens
uaaugcaucagugguaguucuu

SEQ ID NO: 233167 - RNA, 22 nt, Homo sapiens
uaaugcuugguuguuuggaaaa

SEQ ID NO: 233168 - RNA, 22 nt, Homo sapiens
uacaaagcuuucugcaaaucau

SEQ ID NO: 233169 - RNA, 22 nt, Homo sapiens
uacaacacugguucgacaugug

SEQ ID NO: 233170 - RNA, 16 nt, Homo sapiens
uacaacagugaguaug

SEQ ID NO: 233171 - RNA, 22 nt, Homo sapiens
uacaaccucugccucccaaguu

SEQ ID NO: 233172 - RNA, 22 nt, Homo sapiens
uacaagcuaaaauggaagauca

SEQ ID NO: 233173 - RNA, 22 nt, Homo sapiens
uacacagucaaaaauuuccagg

SEQ ID NO: 233174 - RNA, 22 nt, Homo sapiens
uacaccaauuuaaucaaaagca

SEQ ID NO: 233175 - RNA, 22 nt, Homo sapiens
uacagaauugcagguguggcag

SEQ ID NO: 233176 - RNA, 19 nt, Homo sapiens
uacauaguauuuaguggca

SEQ ID NO: 233177 - RNA, 22 nt, Homo sapiens
uacucaauugcagucaccuggc

SEQ ID NO: 233178 - RNA, 22 nt, Homo sapiens
uacucaguaagugcuggcugcu

SEQ ID NO: 233179 - RNA, 22 nt, Homo sapiens
uacucugcaguaauuccagccc

SEQ ID NO: 233180 - RNA, 22 nt, Homo sapiens
uacucuuuagcuccuuaaggaa

SEQ ID NO: 233181 - RNA, 22 nt, Homo sapiens
uacugagagaggaauauugaaa

SEQ ID NO: 233182 - RNA, 22 nt, Homo sapiens
uacugcaguugcagcuugagga

SEQ ID NO: 233183 - RNA, 23 nt, Homo sapiens
uacugcauccuccgccucuaggg

SEQ ID NO: 233184 - RNA, 22 nt, Homo sapiens
uagaaugaaacaagcugugccu

SEQ ID NO: 233185 - RNA, 22 nt, Homo sapiens
uagacacugcauauuuuuuuaa

SEQ ID NO: 233186 - RNA, 22 nt, Homo sapiens
uagagcaugugccauacguaca

SEQ ID NO: 233187 - RNA, 22 nt, Homo sapiens
uagaggaaggauuggaaacgca

SEQ ID NO: 233188 - RNA, 22 nt, Homo sapiens
uagagguauuaacaguagaaga

SEQ ID NO: 233189 - RNA, 22 nt, Homo sapiens
uagcagcaccccacucuacugg

SEQ ID NO: 233190 - RNA, 21 nt, Homo sapiens
uagcauacauuuugcaucuua

SEQ ID NO: 233191 - RNA, 22 nt, Homo sapiens
uagcugcauccugugcacucaa

SEQ ID NO: 233192 - RNA, 22 nt, Homo sapiens
uagcugcuguauguacacggau

SEQ ID NO: 233193 - RNA, 22 nt, Homo sapiens
uagcuucuccauagcuccaugu

SEQ ID NO: 233194 - RNA, 23 nt, Homo sapiens
uagcuucucccagaccugcuccc

SEQ ID NO: 233195 - RNA, 22 nt, Homo sapiens
uaggcuuuuggacccugucucu

SEQ ID NO: 233196 - RNA, 22 nt, Homo sapiens
ucagugcaggaauuuccuuaga

SEQ ID NO: 233197 - RNA, 17 nt, Homo sapiens
ucagugcauuuaagaga

SEQ ID NO: 233198 - RNA, 22 nt, Homo sapiens
ucagugccauugccauaugagu

SEQ ID NO: 233199 - RNA, 22 nt, Homo sapiens
ucaguguuuggaaucucaauuu

SEQ ID NO: 233200 - RNA, 21 nt, Homo sapiens
ucaucaagcuguagacaugau

SEQ ID NO: 233201 - RNA, 22 nt, Homo sapiens
ucaucuggcgaaugugaagagu

SEQ ID NO: 233202 - RNA, 19 nt, Homo sapiens
ucauggcuuuuucagcugu

SEQ ID NO: 233203 - RNA, 22 nt, Homo sapiens
ucaugggagcccccaucaugag

SEQ ID NO: 233204 - RNA, 22 nt, Homo sapiens
ucauucauuugcucacuccaca

SEQ ID NO: 233205 - RNA, 22 nt, Homo sapiens
ucauugcacucccagacacccu

SEQ ID NO: 233206 - RNA, 22 nt, Homo sapiens
uccacaauggagaagaguauga

SEQ ID NO: 233207 - RNA, 22 nt, Homo sapiens
uccacagugguugaacuaguuu

SEQ ID NO: 233208 - RNA, 22 nt, Homo sapiens
uccaguuguucucgaagcuccu

SEQ ID NO: 233209 - RNA, 22 nt, Homo sapiens
uccaugaggcuacaguaaucuc

SEQ ID NO: 233210 - RNA, 23 nt, Homo sapiens
ucccaagauggaccagaccaagg

SEQ ID NO: 233211 - RNA, 22 nt, Homo sapiens
ucccaguguguagcuugucucu

SEQ ID NO: 233212 - RNA, 22 nt, Homo sapiens
ucccugaaucucagguucugua

SEQ ID NO: 233213 - RNA, 22 nt, Homo sapiens
ucccugagugauugaaaauaaa

SEQ ID NO: 233214 - RNA, 22 nt, Homo sapiens
ucccuggacagccuugccuggg

SEQ ID NO: 233215 - RNA, 22 nt, Homo sapiens
ucccugguguuaguuuguucuu

SEQ ID NO: 233216 - RNA, 22 nt, Homo sapiens
ucccuuagccaaauccccagcc

SEQ ID NO: 233217 - RNA, 22 nt, Homo sapiens
ucccuugagccuggcuucucac

SEQ ID NO: 233218 - RNA, 22 nt, Homo sapiens
uccugagacugaggagcuuugg

SEQ ID NO: 233219 - RNA, 22 nt, Homo sapiens
uccugagagcagacccucuaua

SEQ ID NO: 233220 - RNA, 22 nt, Homo sapiens
uccuugagccuuaaauuauaaa

SEQ ID NO: 233221 - RNA, 22 nt, Homo sapiens
uccuuuaguuaauaaagacaag

SEQ ID NO: 233222 - RNA, 18 nt, Homo sapiens
uccuuuugggguaggaga

SEQ ID NO: 233223 - RNA, 22 nt, Homo sapiens
ucuaagaauucauuuauaagcc

SEQ ID NO: 233224 - RNA, 22 nt, Homo sapiens
ucuauugguaggggcugaggca

SEQ ID NO: 233225 - RNA, 22 nt, Homo sapiens
ucucaaguaacugggacaauaa

SEQ ID NO: 233226 - RNA, 22 nt, Homo sapiens
ucucaaguggucgcaguuagau

SEQ ID NO: 233227 - RNA, 22 nt, Homo sapiens
ucucacagaguugaauguuucu

SEQ ID NO: 233228 - RNA, 22 nt, Homo sapiens
ucucaguggcacccccaacacc

SEQ ID NO: 233229 - RNA, 22 nt, Homo sapiens
ucucaguguuaucuaucugccu

SEQ ID NO: 233230 - RNA, 21 nt, Homo sapiens
ucucauagaguuucacuuucu

SEQ ID NO: 233231 - RNA, 22 nt, Homo sapiens
ucucaugaagguggagaguagg

SEQ ID NO: 233232 - RNA, 22 nt, Homo sapiens
ucucugagaccacuccaaacuc

SEQ ID NO: 233233 - RNA, 22 nt, Homo sapiens
ucucugguuuucaaagcaguau

SEQ ID NO: 233234 - RNA, 22 nt, Homo sapiens
ucugagaugagacuuugaauuu

SEQ ID NO: 233235 - RNA, 22 nt, Homo sapiens
ucugagcaauaaacaacauauu

SEQ ID NO: 233236 - RNA, 22 nt, Homo sapiens
ucugagguaggugcauggauac

SEQ ID NO: 233237 - RNA, 22 nt, Homo sapiens
ucuggcuccaaagucuauuuuu

SEQ ID NO: 233238 - RNA, 16 nt, Homo sapiens
ucuggcucuacaguuc

SEQ ID NO: 233239 - RNA, 22 nt, Homo sapiens
ucuguaacauccaccuucuggg

SEQ ID NO: 233240 - RNA, 22 nt, Homo sapiens
ucugucacugaaucccugucac

SEQ ID NO: 233241 - RNA, 22 nt, Homo sapiens
ucugucuuugucaggaccagag

SEQ ID NO: 233242 - RNA, 22 nt, Homo sapiens
ucugugaaaucauuuccuguaa

SEQ ID NO: 233243 - RNA, 19 nt, Homo sapiens
ucugugcuugucccccugu

SEQ ID NO: 233244 - RNA, 22 nt, Homo sapiens
ucugugguucuagcuacuuugg

SEQ ID NO: 233245 - RNA, 22 nt, Homo sapiens
ucuguguuuagacccaggguag

SEQ ID NO: 233246 - RNA, 22 nt, Homo sapiens
ucuugaacuucugcacacucag

SEQ ID NO: 233247 - RNA, 22 nt, Homo sapiens
ucuugucacugcauccccagcu

SEQ ID NO: 233248 - RNA, 22 nt, Homo sapiens
ucuuugagugcccugagucccu

SEQ ID NO: 233249 - RNA, 22 nt, Homo sapiens
ucuuugauaagauccagaagaa

SEQ ID NO: 233250 - RNA, 22 nt, Homo sapiens
ucuuuugggccucuugucagac

SEQ ID NO: 233251 - RNA, 22 nt, Homo sapiens
ugaaauacuuuggcucuuuguu

SEQ ID NO: 233252 - RNA, 22 nt, Homo sapiens
ugaaaugcuaauucguagcuaa

SEQ ID NO: 233253 - RNA, 22 nt, Homo sapiens
ugaaaugguuaugugaggagau

SEQ ID NO: 233254 - RNA, 22 nt, Homo sapiens
ugaagcuaacuugauugugaug

SEQ ID NO: 233255 - RNA, 22 nt, Homo sapiens
ugaaggacauaaggcagaguga

SEQ ID NO: 233256 - RNA, 22 nt, Homo sapiens
ugaaggccgggcaugguggcuc

SEQ ID NO: 233257 - RNA, 22 nt, Homo sapiens
ugaauacuucaaaaaaauagcu

SEQ ID NO: 233258 - RNA, 22 nt, Homo sapiens
ugacagagaagcauugaguuca

SEQ ID NO: 233259 - RNA, 22 nt, Homo sapiens
ugacggaggacaccugcggaau

SEQ ID NO: 233260 - RNA, 22 nt, Homo sapiens
ugacucaguuguuagucuucau

SEQ ID NO: 233261 - RNA, 22 nt, Homo sapiens
ugacuggagaccucaguagggu

SEQ ID NO: 233262 - RNA, 18 nt, Homo sapiens
ugacuguccagguggacc

SEQ ID NO: 233263 - RNA, 22 nt, Homo sapiens
ugagaacagauggcuuuauuau

SEQ ID NO: 233264 - RNA, 22 nt, Homo sapiens
ugagaacugcagggagcugcau

SEQ ID NO: 233265 - RNA, 22 nt, Homo sapiens
ugagaauauuugaagauguuag

SEQ ID NO: 233266 - RNA, 22 nt, Homo sapiens
ugagaaugcagaaucucgugca

SEQ ID NO: 233267 - RNA, 22 nt, Homo sapiens
ugagacugaguuuccaucuugu

SEQ ID NO: 233268 - RNA, 22 nt, Homo sapiens
ugagaucuuaccuuccugccuu

SEQ ID NO: 233269 - RNA, 22 nt, Homo sapiens
ugagaucuuggaggcuuuguga

SEQ ID NO: 233270 - RNA, 22 nt, Homo sapiens
ugagaugaguucucgcucuguc

SEQ ID NO: 233271 - RNA, 22 nt, Homo sapiens
ugagaugauuuaauggagccca

SEQ ID NO: 233272 - RNA, 22 nt, Homo sapiens
ugagauuaaucuuuaaguaaga

SEQ ID NO: 233273 - RNA, 23 nt, Homo sapiens
ugagauuacccagaaagaguaua

SEQ ID NO: 233274 - RNA, 22 nt, Homo sapiens
ugagauuauauuucuuaacaga

SEQ ID NO: 233275 - RNA, 22 nt, Homo sapiens
ugagcaauaaaguuacacaguu

SEQ ID NO: 233276 - RNA, 22 nt, Homo sapiens
ugagcacagcgugugggagagc

SEQ ID NO: 233277 - RNA, 22 nt, Homo sapiens
ugagcagaguuguuucuccuga

SEQ ID NO: 233278 - RNA, 22 nt, Homo sapiens
ugagcagugagugugcugcagg

SEQ ID NO: 233279 - RNA, 22 nt, Homo sapiens
ugagguaaaacaaggauuggau

SEQ ID NO: 233280 - RNA, 22 nt, Homo sapiens
ugagguaggugaagaaugcacg

SEQ ID NO: 233281 - RNA, 22 nt, Homo sapiens
ugagguauuuuguuaugcagcc

SEQ ID NO: 233282 - RNA, 22 nt, Homo sapiens
ugagguuggggucagggcuagc

SEQ ID NO: 233283 - RNA, 22 nt, Homo sapiens
ugaguagaacaucaagucauac

SEQ ID NO: 233284 - RNA, 22 nt, Homo sapiens
ugaguagaacuccuggagaugu

SEQ ID NO: 233285 - RNA, 22 nt, Homo sapiens
ugugaacagcuccaaaugugga

SEQ ID NO: 233286 - RNA, 22 nt, Homo sapiens
ugugaacaugacagugggcuag

SEQ ID NO: 233287 - RNA, 18 nt, Homo sapiens
ugugacauugagcauguc

SEQ ID NO: 233288 - RNA, 22 nt, Homo sapiens
ugugaucaugguauuaaucugc

SEQ ID NO: 233289 - RNA, 22 nt, Homo sapiens
ugugccaaucauagggcuuggu

SEQ ID NO: 233290 - RNA, 22 nt, Homo sapiens
ugugguccucugaaggcuuuuc

SEQ ID NO: 233291 - RNA, 22 nt, Homo sapiens
uguguaauaccuuugacuauau

SEQ ID NO: 233292 - RNA, 22 nt, Homo sapiens
ugugucacugcacuccagccug

SEQ ID NO: 233293 - RNA, 22 nt, Homo sapiens
uguuuuguuagcacucugggaa

SEQ ID NO: 233294 - RNA, 22 nt, Homo sapiens
uuaaaagcuaucuccaagguca

SEQ ID NO: 233295 - RNA, 22 nt, Homo sapiens
uuaacagucacuuagcucauuu

SEQ ID NO: 233296 - RNA, 19 nt, Homo sapiens
uuaagguacuuagaugugu

SEQ ID NO: 233297 - RNA, 22 nt, Homo sapiens
uuaagguuuuuguagcaaggau

SEQ ID NO: 233298 - RNA, 22 nt, Homo sapiens
uuaauaccgucacauggcugaa

SEQ ID NO: 233299 - RNA, 22 nt, Homo sapiens
uuaauacugcuuaacuuuagga

SEQ ID NO: 233300 - RNA, 21 nt, Homo sapiens
uuaaugcuaugcagaaaaucu

SEQ ID NO: 233301 - RNA, 22 nt, Homo sapiens
uuaauuguaucuauagauguca

SEQ ID NO: 233302 - RNA, 22 nt, Homo sapiens
uuaauuguccaaguucaucucu

SEQ ID NO: 233303 - RNA, 22 nt, Homo sapiens
uuacagauggauggcagcuggc

SEQ ID NO: 233304 - RNA, 20 nt, Homo sapiens
uuacagugggaccuuccuga

SEQ ID NO: 233305 - RNA, 22 nt, Homo sapiens
uuacaguucugguggagaggua

SEQ ID NO: 233306 - RNA, 22 nt, Homo sapiens
uuacuguauagaaucaucuuga

SEQ ID NO: 233307 - RNA, 22 nt, Homo sapiens
uuagaaaguagaaaagcugguu

SEQ ID NO: 233308 - RNA, 17 nt, Homo sapiens
uuagacagacauccugc

SEQ ID NO: 233309 - RNA, 22 nt, Homo sapiens
uuagagcacugaucugcucuuu

SEQ ID NO: 233310 - RNA, 22 nt, Homo sapiens
uuaguaguagcugcaugucagu

SEQ ID NO: 233311 - RNA, 22 nt, Homo sapiens
uuagucaaguguacugugaaug

SEQ ID NO: 233312 - RNA, 22 nt, Homo sapiens
uuaucacauugacugauuugca

SEQ ID NO: 233313 - RNA, 22 nt, Homo sapiens
uuaucucagugaacugagugga

SEQ ID NO: 233314 - RNA, 22 nt, Homo sapiens
uuaugcagcaaagugcuugaaa

SEQ ID NO: 233315 - RNA, 22 nt, Homo sapiens
uuaugucuuugagcaaugcugu

SEQ ID NO: 233316 - RNA, 22 nt, Homo sapiens
uuaugucuuuuguguucagcua

SEQ ID NO: 233317 - RNA, 22 nt, Homo sapiens
uuauuauguuggugcaaaggua

SEQ ID NO: 233318 - RNA, 22 nt, Homo sapiens
uuauugcacuccagccugggua

SEQ ID NO: 233319 - RNA, 22 nt, Homo sapiens
uucaaaaccucugcuuaagccc

SEQ ID NO: 233320 - RNA, 22 nt, Homo sapiens
uucaaguaagaaagacaucagg

SEQ ID NO: 233321 - RNA, 22 nt, Homo sapiens
uucaauaugucauuggcaggca

SEQ ID NO: 233322 - RNA, 22 nt, Homo sapiens
uucaauuaauauuauacucuca

SEQ ID NO: 233323 - RNA, 22 nt, Homo sapiens
uucacugagccagacuaagaca

SEQ ID NO: 233324 - RNA, 22 nt, Homo sapiens
uucagaguggacagaaauuaag

SEQ ID NO: 233325 - RNA, 22 nt, Homo sapiens
uucagggagaaggcaaacguug

SEQ ID NO: 233326 - RNA, 22 nt, Homo sapiens
uucagguacugggggaguaugg

SEQ ID NO: 233327 - RNA, 22 nt, Homo sapiens
uucaguaaauguucuuacuaua

SEQ ID NO: 233328 - RNA, 22 nt, Homo sapiens
uucaguaguacauucccguguu

SEQ ID NO: 233329 - RNA, 22 nt, Homo sapiens
uucaguggguggaugaauauga

SEQ ID NO: 233330 - RNA, 22 nt, Homo sapiens
uucauacaguggcugcacucca

SEQ ID NO: 233331 - RNA, 22 nt, Homo sapiens
uucauaguaacaguaacuaugg

SEQ ID NO: 233332 - RNA, 22 nt, Homo sapiens
uucauagucacauucgaugucu

SEQ ID NO: 233333 - RNA, 22 nt, Homo sapiens
uucauagucuaugcaaguaaga

SEQ ID NO: 233334 - RNA, 21 nt, Homo sapiens
uucaucuggccguauuccagg

SEQ ID NO: 233335 - RNA, 22 nt, Homo sapiens
uucauggguuaauuuguucgau

SEQ ID NO: 233336 - RNA, 22 nt, Homo sapiens
uuccaugugggcuugucaagua

SEQ ID NO: 233337 - RNA, 22 nt, Homo sapiens
uucccagugguuagcucugguc

SEQ ID NO: 233338 - RNA, 22 nt, Homo sapiens
uucccuagaacacauggaggga

SEQ ID NO: 233339 - RNA, 22 nt, Homo sapiens
uucccugaaauauucacuuuca

SEQ ID NO: 233340 - RNA, 22 nt, Homo sapiens
uucccugagcaucuguugagcc

SEQ ID NO: 233341 - RNA, 22 nt, Homo sapiens
uuccugugacuguguggcaccc

SEQ ID NO: 233342 - RNA, 22 nt, Homo sapiens
uuccuugagaaaguacaaggcu

SEQ ID NO: 233343 - RNA, 22 nt, Homo sapiens
uucuacagugacugcagccaua

SEQ ID NO: 233344 - RNA, 22 nt, Homo sapiens
uucuauggucacagaugcuuga

SEQ ID NO: 233345 - RNA, 22 nt, Homo sapiens
uucucacaguacagggagcucu

SEQ ID NO: 233346 - RNA, 17 nt, Homo sapiens
uucucaguucugaucuc

SEQ ID NO: 233347 - RNA, 22 nt, Homo sapiens
uucugccaaucaacccacaucc

SEQ ID NO: 233348 - RNA, 22 nt, Homo sapiens
uucuggccccucccaaucucau

SEQ ID NO: 233349 - RNA, 22 nt, Homo sapiens
uucugugguagaaaucucaaau

SEQ ID NO: 233350 - RNA, 22 nt, Homo sapiens
uucuuuaguucacuugcuccag

SEQ ID NO: 233351 - RNA, 22 nt, Homo sapiens
uucuuugcaugaucucaaaguc

SEQ ID NO: 233352 - RNA, 23 nt, Homo sapiens
uugaaaagucaguagccucugau

SEQ ID NO: 233353 - RNA, 22 nt, Homo sapiens
uugaacuagaaccugcaaauuu

SEQ ID NO: 233354 - RNA, 22 nt, Homo sapiens
uugaagacuauaugauucuuca

SEQ ID NO: 233355 - RNA, 22 nt, Homo sapiens
uugaaggaacgcuguucccuug

SEQ ID NO: 233356 - RNA, 22 nt, Homo sapiens
uugaagguaauugguuuuauga

SEQ ID NO: 233357 - RNA, 22 nt, Homo sapiens
uugaagguagaaguucucaauu

SEQ ID NO: 233358 - RNA, 22 nt, Homo sapiens
uugaaugaauggaaagaagggu

SEQ ID NO: 233359 - RNA, 22 nt, Homo sapiens
uugaauggaauguuggaacuau

SEQ ID NO: 233360 - RNA, 22 nt, Homo sapiens
uugacaaugcacugugcuaagu

SEQ ID NO: 233361 - RNA, 22 nt, Homo sapiens
uugagaaucuuucgaauguucu

SEQ ID NO: 233362 - RNA, 22 nt, Homo sapiens
uugagagaaaaggccaugccuu

SEQ ID NO: 233363 - RNA, 22 nt, Homo sapiens
uugagcacugucugugugcagu

SEQ ID NO: 233364 - RNA, 22 nt, Homo sapiens
uugagggagccuguuagucccg

SEQ ID NO: 233365 - RNA, 22 nt, Homo sapiens
uugagguaguacuuauuauugg

SEQ ID NO: 233366 - RNA, 22 nt, Homo sapiens
uugaucaaaucugagugagaau

SEQ ID NO: 233367 - RNA, 22 nt, Homo sapiens
uugcacauuuuuucuggcagaa

SEQ ID NO: 233368 - RNA, 22 nt, Homo sapiens
uugcacuauuaguauagauguc

SEQ ID NO: 233369 - RNA, 22 nt, Homo sapiens
uugcagagucaguuauuuugcc

SEQ ID NO: 233370 - RNA, 22 nt, Homo sapiens
uugccacuucucuugccccauu

SEQ ID NO: 233371 - RNA, 22 nt, Homo sapiens
uugcuacuuggauguacaugug

SEQ ID NO: 233372 - RNA, 22 nt, Homo sapiens
uugcucaggcuggaguacaaug

SEQ ID NO: 233373 - RNA, 22 nt, Homo sapiens
uugcuuuguugucuggggaaua

SEQ ID NO: 233374 - RNA, 20 nt, Homo sapiens
uucuauggugaugaguccug

SEQ ID NO: 233375 - RNA, 22 nt, Homo sapiens
uucuauguuugaaaaugccaaa

SEQ ID NO: 233376 - RNA, 21 nt, Homo sapiens
uucucaggguguguccuaccc

SEQ ID NO: 233377 - RNA, 22 nt, Homo sapiens
uucugagguuauauucucucaa

SEQ ID NO: 233378 - RNA, 22 nt, Homo sapiens
uucuugaggcaugccgcuggga

SEQ ID NO: 233379 - RNA, 21 nt, Homo sapiens
gugugcuugagugaugggauu

SEQ ID NO: 233380 - RNA, 22 nt, Homo sapiens
guguggaacucaauacaacgca

SEQ ID NO: 233381 - RNA, 22 nt, Homo sapiens
guguuauugagaaauagggugu

SEQ ID NO: 233382 - RNA, 22 nt, Homo sapiens
guguugcacauucuguggaugu

SEQ ID NO: 233383 - RNA, 22 nt, Homo sapiens
guuaugcagcaauugauaaucu

SEQ ID NO: 233384 - RNA, 22 nt, Homo sapiens
guucagcaggggcuucaauggu

SEQ ID NO: 233385 - RNA, 22 nt, Homo sapiens
guucaguuuugaaauguuaauu

SEQ ID NO: 233386 - RNA, 20 nt, Homo sapiens
guucauguaauuaguucagg

SEQ ID NO: 233387 - RNA, 22 nt, Homo sapiens
guuccuuguagaugcuggauau

SEQ ID NO: 233388 - RNA, 22 nt, Homo sapiens
guucuauguugggaguucacua

SEQ ID NO: 233389 - RNA, 20 nt, Homo sapiens
guugaugcugaaguugcuua

SEQ ID NO: 233390 - RNA, 22 nt, Homo sapiens
guugauguugcagucuugagga

SEQ ID NO: 233391 - RNA, 22 nt, Homo sapiens
guugcccuuagcacuucagccu

SEQ ID NO: 233392 - RNA, 22 nt, Homo sapiens
uaaagccauugucaaguuugua

SEQ ID NO: 233393 - RNA, 22 nt, Homo sapiens
uaacuaaagagaagucaauguc

SEQ ID NO: 233394 - RNA, 20 nt, Homo sapiens
uaagccacacagucuaaggu

SEQ ID NO: 233395 - RNA, 22 nt, Homo sapiens
uaaggcuuaugguaaaguccug

SEQ ID NO: 233396 - RNA, 22 nt, Homo sapiens
uaaggcuucuuggaauacugca

SEQ ID NO: 233397 - RNA, 22 nt, Homo sapiens
uaaggcuugcuucagucuugaa

SEQ ID NO: 233398 - RNA, 22 nt, Homo sapiens
uaaggcuuugcuggacucaguc

SEQ ID NO: 233399 - RNA, 22 nt, Homo sapiens
uaagguccuuaaauguguaacc

SEQ ID NO: 233400 - RNA, 22 nt, Homo sapiens
uaagugaauguuggcuacugaa

SEQ ID NO: 233401 - RNA, 22 nt, Homo sapiens
uaauagcucggauaaacaugau

SEQ ID NO: 233402 - RNA, 22 nt, Homo sapiens
uaauauguauacagacagauac

SEQ ID NO: 233403 - RNA, 22 nt, Homo sapiens
uaaucucagcugagcugagauu

SEQ ID NO: 233404 - RNA, 22 nt, Homo sapiens
uaaugcauacagaagguguuuu

SEQ ID NO: 233405 - RNA, 22 nt, Homo sapiens
uaaugcuguggucuaaugggga

SEQ ID NO: 233406 - RNA, 21 nt, Homo sapiens
uacaaugcacaggagagccuc

SEQ ID NO: 233407 - RNA, 22 nt, Homo sapiens
uacccucuggauacccuuguuc

SEQ ID NO: 233408 - RNA, 22 nt, Homo sapiens
uaccugagaaagaaagcccucg

SEQ ID NO: 233409 - RNA, 22 nt, Homo sapiens
uacucaguagucuguugcuguc

SEQ ID NO: 233410 - RNA, 22 nt, Homo sapiens
uacugcauuccaaucugggcga

SEQ ID NO: 233411 - RNA, 21 nt, Homo sapiens
uacuggagauacagucugcaa

SEQ ID NO: 233412 - RNA, 22 nt, Homo sapiens
uagaauguaacaguuaaaagca

SEQ ID NO: 233413 - RNA, 22 nt, Homo sapiens
uagaauguauaauauuuuacuu

SEQ ID NO: 233414 - RNA, 22 nt, Homo sapiens
uagagguagguguaugaacuag

SEQ ID NO: 233415 - RNA, 22 nt, Homo sapiens
uagcagaauaacuugccagccu

SEQ ID NO: 233416 - RNA, 22 nt, Homo sapiens
uagcagaauauaccucuuacuu

SEQ ID NO: 233417 - RNA, 22 nt, Homo sapiens
uagcagugugaaaacagacuaa

SEQ ID NO: 233418 - RNA, 21 nt, Homo sapiens
uagcucagugguguugccaua

SEQ ID NO: 233419 - RNA, 22 nt, Homo sapiens
uagcugcccagcacgaaguugg

SEQ ID NO: 233420 - RNA, 22 nt, Homo sapiens
uaggacauugcccuuguggaga

SEQ ID NO: 233421 - RNA, 22 nt, Homo sapiens
uagguagcuuuggcguuucuug

SEQ ID NO: 233422 - RNA, 22 nt, Homo sapiens
uaguacccuugaagcagacaua

SEQ ID NO: 233423 - RNA, 22 nt, Homo sapiens
uaguguuuuucauuggcagagg

SEQ ID NO: 233424 - RNA, 22 nt, Homo sapiens
uauaacaaugcaagaauggccu

SEQ ID NO: 233425 - RNA, 22 nt, Homo sapiens
uauacaugugggcaucaggaga

SEQ ID NO: 233426 - RNA, 22 nt, Homo sapiens
uauagcuuuuuagggaauuugg

SEQ ID NO: 233427 - RNA, 22 nt, Homo sapiens
uaucacaggucaggaaccuugu

SEQ ID NO: 233428 - RNA, 21 nt, Homo sapiens
uaucacaguagaauaggaucu

SEQ ID NO: 233429 - RNA, 22 nt, Homo sapiens
uaucaccacccugggaaacaua

SEQ ID NO: 233430 - RNA, 22 nt, Homo sapiens
uaucacuguuguuuguuuaagg

SEQ ID NO: 233431 - RNA, 21 nt, Homo sapiens
uaucauggccauccucuucuc

SEQ ID NO: 233432 - RNA, 22 nt, Homo sapiens
uaucuacauguagguauguaug

SEQ ID NO: 233433 - RNA, 22 nt, Homo sapiens
uaucucagaguguacaagauua

SEQ ID NO: 233434 - RNA, 22 nt, Homo sapiens
uaucugcaucccauuuuuauca

SEQ ID NO: 233435 - RNA, 20 nt, Homo sapiens
uaugaaacaguguagagcaa

SEQ ID NO: 233436 - RNA, 22 nt, Homo sapiens
uaugaaagcuacuucucacaau

SEQ ID NO: 233437 - RNA, 20 nt, Homo sapiens
uaugaccugucuuuucucuc

SEQ ID NO: 233438 - RNA, 22 nt, Homo sapiens
uaugaccuuguccccucucgcc

SEQ ID NO: 233439 - RNA, 22 nt, Homo sapiens
uaugacuguuugcucauucagg

SEQ ID NO: 233440 - RNA, 22 nt, Homo sapiens
uaugaucacuacagcagggaug

SEQ ID NO: 233441 - RNA, 22 nt, Homo sapiens
uaugcacaugugccugggugug

SEQ ID NO: 233442 - RNA, 22 nt, Homo sapiens
uaugccuuucucacuaagcuua

SEQ ID NO: 233443 - RNA, 22 nt, Homo sapiens
uaugcuuauugucucauccacu

SEQ ID NO: 233444 - RNA, 22 nt, Homo sapiens
uaugguuuuaagguuaaggacu

SEQ ID NO: 233445 - RNA, 22 nt, Homo sapiens
uaugucauggguaaagugcccu

SEQ ID NO: 233446 - RNA, 22 nt, Homo sapiens
uauuaguuuucuguggauuaca

SEQ ID NO: 233447 - RNA, 22 nt, Homo sapiens
uauuccacaauaugauuuuuaa

SEQ ID NO: 233448 - RNA, 22 nt, Homo sapiens
uauuccagcccuggugagccag

SEQ ID NO: 233449 - RNA, 22 nt, Homo sapiens
uauugcacaugaggagacauug

SEQ ID NO: 233450 - RNA, 22 nt, Homo sapiens
uauugcacuccagccuuggcaa

SEQ ID NO: 233451 - RNA, 22 nt, Homo sapiens
uauugcacuuuuccauaggagu

SEQ ID NO: 233452 - RNA, 22 nt, Homo sapiens
uauugcagaaugugaguuggca

SEQ ID NO: 233453 - RNA, 22 nt, Homo sapiens
uauugcauuugagguugguuga

SEQ ID NO: 233454 - RNA, 22 nt, Homo sapiens
uauuguuaaagauguuaaugau

SEQ ID NO: 233455 - RNA, 22 nt, Homo sapiens
uauuuguccccuccaaaaguca

SEQ ID NO: 233456 - RNA, 22 nt, Homo sapiens
ucaaacacuccauaucgcgauu

SEQ ID NO: 233457 - RNA, 22 nt, Homo sapiens
ucaaaugauucagaagccaccu

SEQ ID NO: 233458 - RNA, 21 nt, Homo sapiens
ucaaauugaaauuaggucauu

SEQ ID NO: 233459 - RNA, 22 nt, Homo sapiens
ucaagcaauucugcugccucag

SEQ ID NO: 233460 - RNA, 18 nt, Homo sapiens
ucaagcuauugucaugcc

SEQ ID NO: 233461 - RNA, 22 nt, Homo sapiens
ucaaggcacauuugacauuuuc

SEQ ID NO: 233462 - RNA, 22 nt, Homo sapiens
ucaaggcaguggccuuccuucu

SEQ ID NO: 233463 - RNA, 22 nt, Homo sapiens
ucaaguaauacucccaucuugg

SEQ ID NO: 233464 - RNA, 22 nt, Homo sapiens
ucaauugcaucaacaguguaca

SEQ ID NO: 233465 - RNA, 22 nt, Homo sapiens
ucaauugcuuaugaagauacau

SEQ ID NO: 233466 - RNA, 22 nt, Homo sapiens
ucacacugucuugguuacucuu

SEQ ID NO: 233467 - RNA, 22 nt, Homo sapiens
ucacagaggagaagaccuuuaa

SEQ ID NO: 233468 - RNA, 18 nt, Homo sapiens
aaaaagugcucaggccua

SEQ ID NO: 233469 - RNA, 22 nt, Homo sapiens
aaagcagcaggugguuuucaau

SEQ ID NO: 233470 - RNA, 22 nt, Homo sapiens
aaagggcacugugcuuuggcaa

SEQ ID NO: 233471 - RNA, 22 nt, Homo sapiens
aaagggcuugaauacucuuuuu

SEQ ID NO: 233472 - RNA, 22 nt, Homo sapiens
aaagugacuuagugccccauuu

SEQ ID NO: 233473 - RNA, 22 nt, Homo sapiens
aaaugacuuuuuaugcagagua

SEQ ID NO: 233474 - RNA, 22 nt, Homo sapiens
aaaugcagcacucaagugggaa

SEQ ID NO: 233475 - RNA, 22 nt, Homo sapiens
aaaugcagucuuuguucugggc

SEQ ID NO: 233476 - RNA, 22 nt, Homo sapiens
aaaugcaugaauaagcucgugu

SEQ ID NO: 233477 - RNA, 22 nt, Homo sapiens
aaaugcugcuuuggccucuucu

SEQ ID NO: 233478 - RNA, 22 nt, Homo sapiens
aaaugcuuucuuggaccauuug

SEQ ID NO: 233479 - RNA, 22 nt, Homo sapiens
aaaugguguuaguagaucuuua

SEQ ID NO: 233480 - RNA, 22 nt, Homo sapiens
aaauucaugucaccucuaggua

SEQ ID NO: 233481 - RNA, 22 nt, Homo sapiens
aacacuaucugccuuacaggga

SEQ ID NO: 233482 - RNA, 22 nt, Homo sapiens
aacagaccuagauaguauaguc

SEQ ID NO: 233483 - RNA, 22 nt, Homo sapiens
aacagcacacccgcugcuucca

SEQ ID NO: 233484 - RNA, 22 nt, Homo sapiens
aacagugcauuccuguccauau

SEQ ID NO: 233485 - RNA, 22 nt, Homo sapiens
aacagugcuguuauaaauguac

SEQ ID NO: 233486 - RNA, 22 nt, Homo sapiens
aacauguuuagcagauaccugu

SEQ ID NO: 233487 - RNA, 22 nt, Homo sapiens
aacugguauuucccaugaauuu

SEQ ID NO: 233488 - RNA, 21 nt, Homo sapiens
aagaaagcuggacuugccgcu

SEQ ID NO: 233489 - RNA, 22 nt, Homo sapiens
aagagaugaagguccugacugu

SEQ ID NO: 233490 - RNA, 20 nt, Homo sapiens
aagagcucaccagaauaucu

SEQ ID NO: 233491 - RNA, 22 nt, Homo sapiens
aagaguuaguaaaauuuccucu

SEQ ID NO: 233492 - RNA, 22 nt, Homo sapiens
aagauauguuaguuauaaacuc

SEQ ID NO: 233493 - RNA, 22 nt, Homo sapiens
aagcaaacaucagcuugguuaa

SEQ ID NO: 233494 - RNA, 22 nt, Homo sapiens
aagcagauguguugaaaguacu

SEQ ID NO: 233495 - RNA, 22 nt, Homo sapiens
aagcaucacauaauggaucaug

SEQ ID NO: 233496 - RNA, 22 nt, Homo sapiens
aagccacuguaccugucucuua

SEQ ID NO: 233497 - RNA, 22 nt, Homo sapiens
aagcugccuugcugaggagaaa

SEQ ID NO: 233498 - RNA, 22 nt, Homo sapiens
aagcugccuugugaaggcauuc

SEQ ID NO: 233499 - RNA, 22 nt, Homo sapiens
aagcuggagugcaguggugcaa

SEQ ID NO: 233500 - RNA, 22 nt, Homo sapiens
aaggaauucaaauuuucucugg

SEQ ID NO: 233501 - RNA, 22 nt, Homo sapiens
aaggcagucacuaaauagugag

SEQ ID NO: 233502 - RNA, 22 nt, Homo sapiens
aaggcuuuuugcugacguccuu

SEQ ID NO: 233503 - RNA, 23 nt, Homo sapiens
aagguaagcuagaaagauguaga

SEQ ID NO: 233504 - RNA, 22 nt, Homo sapiens
aagguacuggaaagaggaaugg

SEQ ID NO: 233505 - RNA, 22 nt, Homo sapiens
aagguauuuuugucuauaucuu

SEQ ID NO: 233506 - RNA, 22 nt, Homo sapiens
aagguggugucagagagcuuau

SEQ ID NO: 233507 - RNA, 22 nt, Homo sapiens
aagucaaggagagaagcuucag

SEQ ID NO: 233508 - RNA, 22 nt, Homo sapiens
aaguccccugacagaggggagg

SEQ ID NO: 233509 - RNA, 22 nt, Homo sapiens
aagugguagggucaggauugga

SEQ ID NO: 233510 - RNA, 23 nt, Homo sapiens
aaguucaugcucaucuguuacac

SEQ ID NO: 233511 - RNA, 22 nt, Homo sapiens
aauaagaaguggaagggaccgg

SEQ ID NO: 233512 - RNA, 19 nt, Homo sapiens
aauaaugccagaugucugu

SEQ ID NO: 233513 - RNA, 22 nt, Homo sapiens
aauacugugauaucgagcgauu

SEQ ID NO: 233514 - RNA, 22 nt, Homo sapiens
aauauguccuugaaauggugcu

SEQ ID NO: 233515 - RNA, 22 nt, Homo sapiens
aauaugucugcuaauuguuucu

SEQ ID NO: 233516 - RNA, 22 nt, Homo sapiens
aaugacucugccuaaauuucac

SEQ ID NO: 233517 - RNA, 22 nt, Homo sapiens
aaugcaagauguuaauuauagg

SEQ ID NO: 233518 - RNA, 22 nt, Homo sapiens
aauugcauugaauuuguagcuu

SEQ ID NO: 233519 - RNA, 22 nt, Homo sapiens
aauugcuucuguauuuuggaca

SEQ ID NO: 233520 - RNA, 22 nt, Homo sapiens
gcaggaaucuugagaaggauuc

SEQ ID NO: 233521 - RNA, 20 nt, Homo sapiens
gcaguacuuuuaguucuaag

SEQ ID NO: 233522 - RNA, 22 nt, Homo sapiens
gcagugugugaggaauuugggu

SEQ ID NO: 233523 - RNA, 22 nt, Homo sapiens
gcaguguucaaaucaugcccau

SEQ ID NO: 233524 - RNA, 22 nt, Homo sapiens
gcauggauguugauggcugcug

SEQ ID NO: 233525 - RNA, 22 nt, Homo sapiens
gcauugcacuuggcauagacug

SEQ ID NO: 233526 - RNA, 22 nt, Homo sapiens
gccaagaagugucuaagcagga

SEQ ID NO: 233527 - RNA, 22 nt, Homo sapiens
gccuagagaguuaucaggcugu

SEQ ID NO: 233528 - RNA, 22 nt, Homo sapiens
gagauguuuguuucacugucac

SEQ ID NO: 233529 - RNA, 22 nt, Homo sapiens
gagcuguugguuugaaagaauu

SEQ ID NO: 233530 - RNA, 22 nt, Homo sapiens
gagcuguuuuucacuagaccaa

SEQ ID NO: 233531 - RNA, 22 nt, Homo sapiens
gaggugauaucucauugugguu

SEQ ID NO: 233532 - RNA, 22 nt, Homo sapiens
gagguggugguggaggcauagc

SEQ ID NO: 233533 - RNA, 23 nt, Homo sapiens
gaguacauuaaaagcccagacug

SEQ ID NO: 233534 - RNA, 22 nt, Homo sapiens
gaguagugcugcaguaaacaca

SEQ ID NO: 233535 - RNA, 22 nt, Homo sapiens
gaguucaaaucucagcucuguu

SEQ ID NO: 233536 - RNA, 19 nt, Homo sapiens
gaguugggguuuacuguaa

SEQ ID NO: 233537 - RNA, 22 nt, Homo sapiens
gaguuuguacuaauuuguugua

SEQ ID NO: 233538 - RNA, 22 nt, Homo sapiens
gauacaccauuuucuagcuauu

SEQ ID NO: 233539 - RNA, 22 nt, Homo sapiens
gaucauggaguuggguucaagg

SEQ ID NO: 233540 - RNA, 22 nt, Homo sapiens
gaucugagaaagugucauaaca

SEQ ID NO: 233541 - RNA, 22 nt, Homo sapiens
gaugagaucauaaguguggagc

SEQ ID NO: 233542 - RNA, 22 nt, Homo sapiens
gaugaucucuggugguaaagac

SEQ ID NO: 233543 - RNA, 22 nt, Homo sapiens
gaugauguuggaaacuuggugc

SEQ ID NO: 233544 - RNA, 22 nt, Homo sapiens
gauggcaugugcugccaccaag

SEQ ID NO: 233545 - RNA, 22 nt, Homo sapiens
gauuuuccaguggcccugauca

SEQ ID NO: 233546 - RNA, 23 nt, Homo sapiens
gcaaauaucguagagugucccug

SEQ ID NO: 233547 - RNA, 22 nt, Homo sapiens
gcaagaaugagaaggauuaauu

SEQ ID NO: 233548 - RNA, 22 nt, Homo sapiens
gcaagugucugagguuuuguau

SEQ ID NO: 233549 - RNA, 22 nt, Homo sapiens
gcaauacugacagcauuaguuu

SEQ ID NO: 233550 - RNA, 22 nt, Homo sapiens
gcaauggaaucccuugaucaau

SEQ ID NO: 233551 - RNA, 22 nt, Homo sapiens
gcacagaugaggagaggucuca

SEQ ID NO: 233552 - RNA, 22 nt, Homo sapiens
gcacaguguuacuugauauauu

SEQ ID NO: 233553 - RNA, 22 nt, Homo sapiens
gcacauggccccaucgugccga

SEQ ID NO: 233554 - RNA, 22 nt, Homo sapiens
gcaccaugguagaauaauggua

SEQ ID NO: 233555 - RNA, 22 nt, Homo sapiens
gcagaucuucgcgguaaguguu

SEQ ID NO: 233556 - RNA, 22 nt, Homo sapiens
gcagcaucaaaucacacaagau

SEQ ID NO: 233557 - RNA, 22 nt, Homo sapiens
gcaguagugcgaucucagcuca

SEQ ID NO: 233558 - RNA, 22 nt, Homo sapiens
gcaguguugugauccaggucuu

SEQ ID NO: 233559 - RNA, 22 nt, Homo sapiens
gcauaaagcuaauaagacgaag

SEQ ID NO: 233560 - RNA, 22 nt, Homo sapiens
gcauggaaggcgcuuugugacu

SEQ ID NO: 233561 - RNA, 18 nt, Homo sapiens
gccaacauguaaacaggu

SEQ ID NO: 233562 - RNA, 22 nt, Homo sapiens
gccauggugucuuauuuuugug

SEQ ID NO: 233563 - RNA, 22 nt, Homo sapiens
gcccagcguucagggaggggcu

SEQ ID NO: 233564 - RNA, 22 nt, Homo sapiens
gcccugauacauucuucugccu

SEQ ID NO: 233565 - RNA, 22 nt, Homo sapiens
gcccuguaguauaguuugaagu

SEQ ID NO: 233566 - RNA, 22 nt, Homo sapiens
gccucaguuguggccagggauu

SEQ ID NO: 233567 - RNA, 23 nt, Homo sapiens
gcuaggagagaugaaacacaggu

SEQ ID NO: 233568 - RNA, 22 nt, Homo sapiens
gcuaggagauccacugcucucu

SEQ ID NO: 233569 - RNA, 22 nt, Homo sapiens
gcucugguuacaaaggcaaauu

SEQ ID NO: 233570 - RNA, 22 nt, Homo sapiens
gcugcuguaccagaugugguua

SEQ ID NO: 233571 - RNA, 22 nt, Homo sapiens
gcugcuguuuaguuucuccugg

SEQ ID NO: 233572 - RNA, 22 nt, Homo sapiens
gcuggguucagagugggcugcg

SEQ ID NO: 233573 - RNA, 22 nt, Homo sapiens
gcuggucugccguaguaggugc

SEQ ID NO: 233574 - RNA, 22 nt, Homo sapiens
gcugguguucaggcccucaguc

SEQ ID NO: 233575 - RNA, 22 nt, Homo sapiens
gcuguauugacuuuguaucaua

SEQ ID NO: 233576 - RNA, 22 nt, Homo sapiens
gcuuguguucaagucacccuua

SEQ ID NO: 233577 - RNA, 18 nt, Homo sapiens
ggaaaacuuuucuaagua

SEQ ID NO: 233578 - RNA, 22 nt, Homo sapiens
ggaaagacaccuuacuauguua

SEQ ID NO: 233579 - RNA, 22 nt, Homo sapiens
ggaaauguuggugucaugaguu

SEQ ID NO: 233580 - RNA, 22 nt, Homo sapiens
ggaaugagaaauauuacacaau

SEQ ID NO: 233581 - RNA, 22 nt, Homo sapiens
ggaauuaaggcaauugaaagcu

SEQ ID NO: 233582 - RNA, 22 nt, Homo sapiens
ggagaguaauuagacugaaaga

SEQ ID NO: 233583 - RNA, 22 nt, Homo sapiens
ggagaugugccugcucugcucu

SEQ ID NO: 233584 - RNA, 22 nt, Homo sapiens
ggagggugagaucaauuuggga

SEQ ID NO: 233585 - RNA, 22 nt, Homo sapiens
ggagucugacuuauaggaaccu

SEQ ID NO: 233586 - RNA, 22 nt, Homo sapiens
ggaguucaucaggugaggggua

SEQ ID NO: 233587 - RNA, 22 nt, Homo sapiens
ggcaagaggagauucugcuccc

SEQ ID NO: 233588 - RNA, 22 nt, Homo sapiens
ggcagcacaauuuucugaugga

SEQ ID NO: 233589 - RNA, 22 nt, Homo sapiens
ggcccugagacaggaaaaagcu

SEQ ID NO: 233590 - RNA, 22 nt, Homo sapiens
ggcgguguccuccaagugcuuc

SEQ ID NO: 233591 - RNA, 22 nt, Homo sapiens
ggcucagugggguccugguucu

SEQ ID NO: 233592 - RNA, 22 nt, Homo sapiens
ggcuguguguuaaaauaggcuu

SEQ ID NO: 233593 - RNA, 22 nt, Homo sapiens
gggaucaacuuauacuaaaauu

SEQ ID NO: 233594 - RNA, 22 nt, Homo sapiens
gggaugaaguugauguagaaag

SEQ ID NO: 233595 - RNA, 22 nt, Homo sapiens
gggcagaugucuggacaccuca

SEQ ID NO: 233596 - RNA, 22 nt, Homo sapiens
ggguaaaucucuuuucauggcu

SEQ ID NO: 233597 - RNA, 22 nt, Homo sapiens
gguaaacauaagagagcugacu

SEQ ID NO: 233598 - RNA, 22 nt, Homo sapiens
gguagacucuguaagugaucau

SEQ ID NO: 233599 - RNA, 22 nt, Homo sapiens
ggugagaaagggauuccuguuc

SEQ ID NO: 233600 - RNA, 23 nt, Homo sapiens
ggugaggaguacagagucuucau

SEQ ID NO: 233601 - RNA, 22 nt, Homo sapiens
ggugaucauugucucuaguaug

SEQ ID NO: 233602 - RNA, 22 nt, Homo sapiens
gguguuccccuuaccucuuggc

SEQ ID NO: 233603 - RNA, 22 nt, Homo sapiens
guaaaguaaagcacaucaaggu

SEQ ID NO: 233604 - RNA, 22 nt, Homo sapiens
guaagugauagaauuaggauuc

SEQ ID NO: 233605 - RNA, 22 nt, Homo sapiens
guagagguagauucuguuuuga

SEQ ID NO: 233606 - RNA, 22 nt, Homo sapiens
guagcaccagugcucuucucaa

SEQ ID NO: 233607 - RNA, 22 nt, Homo sapiens
guagcagcaauuuacuccauac

SEQ ID NO: 233608 - RNA, 22 nt, Homo sapiens
gucaaaugcacagaaccauuaa

SEQ ID NO: 233609 - RNA, 22 nt, Homo sapiens
gucagugucuuaacagagauua

SEQ ID NO: 233610 - RNA, 22 nt, Homo sapiens
gucagugucuuugcagcucaga

SEQ ID NO: 233611 - RNA, 22 nt, Homo sapiens
gucaguuucacucagcuggaac

SEQ ID NO: 233612 - RNA, 22 nt, Homo sapiens
gucaguuugguuaaucauucca

SEQ ID NO: 233613 - RNA, 22 nt, Homo sapiens
guccaugagaugaauccacaca

SEQ ID NO: 233614 - RNA, 22 nt, Homo sapiens
gucccugaggaacauccagggc

SEQ ID NO: 233615 - RNA, 22 nt, Homo sapiens
gucccugcgauugugggauccu

SEQ ID NO: 233616 - RNA, 22 nt, Homo sapiens
gucuagaacuucugaccuuagg

SEQ ID NO: 233617 - RNA, 22 nt, Homo sapiens
gucuaugagucccugaauuuaa

SEQ ID NO: 233618 - RNA, 22 nt, Homo sapiens
gucuuuaguugaaacauguggu

SEQ ID NO: 233619 - RNA, 22 nt, Homo sapiens
uuagcacugagaauggcuugcu

SEQ ID NO: 233620 - RNA, 23 nt, Homo sapiens
uuaguaaacucaaugacaccaca

SEQ ID NO: 233621 - RNA, 22 nt, Homo sapiens
uuagugaaugggugugauuugu

SEQ ID NO: 233622 - RNA, 22 nt, Homo sapiens
uuauaaacaugaagauuugggg

SEQ ID NO: 233623 - RNA, 22 nt, Homo sapiens
uuauacuacuauaaagagguag

SEQ ID NO: 233624 - RNA, 22 nt, Homo sapiens
uuauaguuuuucaccuggagaa

SEQ ID NO: 233625 - RNA, 22 nt, Homo sapiens
uuauauguuacucccucuagca

SEQ ID NO: 233626 - RNA, 22 nt, Homo sapiens
uuauggccauucuuguaggagu

SEQ ID NO: 233627 - RNA, 22 nt, Homo sapiens
uuauguccuuuaacuucaucac

SEQ ID NO: 233628 - RNA, 22 nt, Homo sapiens
uuauuagagauauuugguuagg

SEQ ID NO: 233629 - RNA, 22 nt, Homo sapiens
uuauugcuaaaucaugaccaca

SEQ ID NO: 233630 - RNA, 22 nt, Homo sapiens
uucaaaggauagauuaagauca

SEQ ID NO: 233631 - RNA, 22 nt, Homo sapiens
uucaaaucuucguuuugccaua

SEQ ID NO: 233632 - RNA, 22 nt, Homo sapiens
uucaaaucuuuggcucccacua

SEQ ID NO: 233633 - RNA, 22 nt, Homo sapiens
uucaaauguucuuucaccaccc

SEQ ID NO: 233634 - RNA, 22 nt, Homo sapiens
uucaagugaacaaaaugaggag

SEQ ID NO: 233635 - RNA, 21 nt, Homo sapiens
uucacaagggaaguagggggc

SEQ ID NO: 233636 - RNA, 22 nt, Homo sapiens
uucacaguguguacaccagggg

SEQ ID NO: 233637 - RNA, 22 nt, Homo sapiens
uucacaugacagggugaagcau

SEQ ID NO: 233638 - RNA, 16 nt, Homo sapiens
uucacauggcagcagg

SEQ ID NO: 233639 - RNA, 22 nt, Homo sapiens
uucaccuggguuggccaucauu

SEQ ID NO: 233640 - RNA, 21 nt, Homo sapiens
uucacuggucuauuucccuuu

SEQ ID NO: 233641 - RNA, 22 nt, Homo sapiens
uucacuguagccucagccucuu

SEQ ID NO: 233642 - RNA, 22 nt, Homo sapiens
uucaggcaccauugucauugau

SEQ ID NO: 233643 - RNA, 22 nt, Homo sapiens
uucagguucauuugcugcuauu

SEQ ID NO: 233644 - RNA, 22 nt, Homo sapiens
uucagugccuggaagucgugcu

SEQ ID NO: 233645 - RNA, 22 nt, Homo sapiens
uucaguggacuuaguagugcuu

SEQ ID NO: 233646 - RNA, 22 nt, Homo sapiens
uucagugucauuaacacaguag

SEQ ID NO: 233647 - RNA, 22 nt, Homo sapiens
uucauagucuaauuuuuuccac

SEQ ID NO: 233648 - RNA, 22 nt, Homo sapiens
uucauaguguuuccuuccagug

SEQ ID NO: 233649 - RNA, 22 nt, Homo sapiens
uucauaguuuauacugauauuu

SEQ ID NO: 233650 - RNA, 22 nt, Homo sapiens
uucaucagggguauuggccaau

SEQ ID NO: 233651 - RNA, 22 nt, Homo sapiens
uucaucuggcaauucagagauu

SEQ ID NO: 233652 - RNA, 22 nt, Homo sapiens
uucaugcaucuguagugguuaa

SEQ ID NO: 233653 - RNA, 22 nt, Homo sapiens
uucauggaguugagaaggcuaa

SEQ ID NO: 233654 - RNA, 20 nt, Homo sapiens
uucaugggagcaaagaggcc

SEQ ID NO: 233655 - RNA, 22 nt, Homo sapiens
uucauggugguacaaaagcaau

SEQ ID NO: 233656 - RNA, 22 nt, Homo sapiens
uucauuggauguuacacugugu

SEQ ID NO: 233657 - RNA, 22 nt, Homo sapiens
uuccacaauggcugaacuaguu

SEQ ID NO: 233658 - RNA, 22 nt, Homo sapiens
uuccacagggauuugcauugau

SEQ ID NO: 233659 - RNA, 22 nt, Homo sapiens
uuccagugggacgagaugugga

SEQ ID NO: 233660 - RNA, 22 nt, Homo sapiens
uuccaguugugagcuauccggg

SEQ ID NO: 233661 - RNA, 22 nt, Homo sapiens
uuccauugugucaucuuggugg

SEQ ID NO: 233662 - RNA, 22 nt, Homo sapiens
uucccugaguaucuuaccaugg

SEQ ID NO: 233663 - RNA, 22 nt, Homo sapiens
uucccugugguauagaagccgu

SEQ ID NO: 233664 - RNA, 23 nt, Homo sapiens
uucccuuagaagaaggggagaaa

SEQ ID NO: 233665 - RNA, 22 nt, Homo sapiens
uucccuugcaggaugaucugga

SEQ ID NO: 233666 - RNA, 19 nt, Homo sapiens
uuccugagaacaagggcuu

SEQ ID NO: 233667 - RNA, 22 nt, Homo sapiens
uuccuggaggggaaguguccaa

SEQ ID NO: 233668 - RNA, 22 nt, Homo sapiens
uuccugucuuccaagagagauu

SEQ ID NO: 233669 - RNA, 22 nt, Homo sapiens
uuccuugagagcuugauaucac

SEQ ID NO: 233670 - RNA, 22 nt, Homo sapiens
uucuaaguaauuuugcaugccu

SEQ ID NO: 233671 - RNA, 23 nt, Homo sapiens
uucuaucaggcccaggagcccug

SEQ ID NO: 233672 - RNA, 21 nt, Homo sapiens
uucucagaggcaggggauaaa

SEQ ID NO: 233673 - RNA, 22 nt, Homo sapiens
uucuggccuccauuuuucuccu

SEQ ID NO: 233674 - RNA, 22 nt, Homo sapiens
uucugugcugaaucaaagacug

SEQ ID NO: 233675 - RNA, 22 nt, Homo sapiens
uucuguguuuaggucacggcua

SEQ ID NO: 233676 - RNA, 22 nt, Homo sapiens
uucuucugguuaugaaauuuga

SEQ ID NO: 233677 - RNA, 20 nt, Homo sapiens
uucuugaguuaacaaguuac

SEQ ID NO: 233678 - RNA, 22 nt, Homo sapiens
uucuugcugaauugugcccuuc

SEQ ID NO: 233679 - RNA, 22 nt, Homo sapiens
uucuugcuguauccucacaugg

SEQ ID NO: 233680 - RNA, 22 nt, Homo sapiens
uugaaauguguaagcuccgaaa

SEQ ID NO: 233681 - RNA, 22 nt, Homo sapiens
uugaagacuaaguuaucaggau

SEQ ID NO: 233682 - RNA, 22 nt, Homo sapiens
uugaagguaggaugugcuauca

SEQ ID NO: 233683 - RNA, 22 nt, Homo sapiens
uugaaguagaaagacgaaauuu

SEQ ID NO: 233684 - RNA, 22 nt, Homo sapiens
uugaauagaagguuuuuuguuc

SEQ ID NO: 233685 - RNA, 22 nt, Homo sapiens
uugacuccagagugaguaaaug

SEQ ID NO: 233686 - RNA, 22 nt, Homo sapiens
uugacuucagagcugauucaag

SEQ ID NO: 233687 - RNA, 22 nt, Homo sapiens
uugagaaucuuugcuaaaggaa

SEQ ID NO: 233688 - RNA, 22 nt, Homo sapiens
uugagagagaacauuuguuaca

SEQ ID NO: 233689 - RNA, 22 nt, Homo sapiens
uugagauacauaauuaugaaug

SEQ ID NO: 233690 - RNA, 22 nt, Homo sapiens
uugagauagaauaggaauggga

SEQ ID NO: 233691 - RNA, 22 nt, Homo sapiens
uugagcucaucuucagggguga

SEQ ID NO: 233692 - RNA, 22 nt, Homo sapiens
uugaggaaugugauuucaaaua

SEQ ID NO: 233693 - RNA, 22 nt, Homo sapiens
uugagggaagccagaggucugc

SEQ ID NO: 233694 - RNA, 22 nt, Homo sapiens
uugagggaggccucaguuuaca

SEQ ID NO: 233695 - RNA, 22 nt, Homo sapiens
uugagggcugaauaccaaucag

SEQ ID NO: 233696 - RNA, 22 nt, Homo sapiens
uugauaguccuguaucuauuuu

SEQ ID NO: 233697 - RNA, 18 nt, Homo sapiens
uugcaaauucuucccugu

SEQ ID NO: 233698 - RNA, 22 nt, Homo sapiens
uugcaacauuguaaguuuauau

SEQ ID NO: 233699 - RNA, 22 nt, Homo sapiens
uugcaaugugaugugauuugga

SEQ ID NO: 233700 - RNA, 22 nt, Homo sapiens
uugcacauggcuggggaggccu

SEQ ID NO: 233701 - RNA, 22 nt, Homo sapiens
uugcacauugauuuuguauccu

SEQ ID NO: 233702 - RNA, 22 nt, Homo sapiens
uugcacauugauuuuguaucuu

SEQ ID NO: 233703 - RNA, 22 nt, Homo sapiens
uugcaccacugcacuccacccu

SEQ ID NO: 233704 - RNA, 22 nt, Homo sapiens
uugcauaagugcauucugugau

SEQ ID NO: 233705 - RNA, 22 nt, Homo sapiens
uugcauagaccgaugucuugga

SEQ ID NO: 233706 - RNA, 22 nt, Homo sapiens
uugcaucagcaggcauaauugg

SEQ ID NO: 233707 - RNA, 23 nt, Homo sapiens
uugcauugcccuccauaguacuc

SEQ ID NO: 233708 - RNA, 22 nt, Homo sapiens
uuugcaauagguuguggggagg

SEQ ID NO: 233709 - RNA, 23 nt, Homo sapiens
uuugcacuugcuccuucuauggc

SEQ ID NO: 233710 - RNA, 22 nt, Homo sapiens
uuugcagagacuuguuaggaau

SEQ ID NO: 233711 - RNA, 19 nt, Homo sapiens
uuugcauagugagaauaua

SEQ ID NO: 233712 - RNA, 21 nt, Homo sapiens
uuugcauauguugaaccagcc

SEQ ID NO: 233713 - RNA, 22 nt, Homo sapiens
uuugccaauauuuuacugagga

SEQ ID NO: 233714 - RNA, 22 nt, Homo sapiens
uuugcuauagugaauagugcug

SEQ ID NO: 233715 - RNA, 22 nt, Homo sapiens
uuugcugagucugacuucaugg

SEQ ID NO: 233716 - RNA, 22 nt, Homo sapiens
uuuggaagaugccacuguauca

SEQ ID NO: 233717 - RNA, 22 nt, Homo sapiens
uuugggccaugcuucccgguca

SEQ ID NO: 233718 - RNA, 22 nt, Homo sapiens
uuuggguuaguuuuccaaucuu

SEQ ID NO: 233719 - RNA, 22 nt, Homo sapiens
uuugguccaguguucagguccu

SEQ ID NO: 233720 - RNA, 22 nt, Homo sapiens
uuuguacacgugggugaauugu

SEQ ID NO: 233721 - RNA, 22 nt, Homo sapiens
uuugugcuccucucaguaugug

SEQ ID NO: 233722 - RNA, 22 nt, Homo sapiens
uuuguguggccuuggccuggca

SEQ ID NO: 233723 - RNA, 16 nt, Homo sapiens
uuugugugugacgaga

SEQ ID NO: 233724 - RNA, 20 nt, Homo sapiens
uuuuagcuuuuauugaaagc

SEQ ID NO: 233725 - RNA, 22 nt, Homo sapiens
uuuugcaauauguuccugaaua

SEQ ID NO: 233726 - RNA, 22 nt, Homo sapiens
uuuugcaguuacagagagugag

SEQ ID NO: 233727 - RNA, 22 nt, Homo sapiens
uuuugcuccuggcaaacucaua

SEQ ID NO: 233728 - RNA, 22 nt, Homo sapiens
uuuugcucuucggaagagcuug

SEQ ID NO: 233729 - RNA, 22 nt, Homo sapiens
uuuugcucuugguaaugaaaga

SEQ ID NO: 233730 - RNA, 22 nt, Homo sapiens
uuuuugauuaauggguagacca

SEQ ID NO: 233731 - RNA, 22 nt, Homo sapiens
uuuuuugguaauugaacaauga

SEQ ID NO: 233732 - RNA, 22 nt, Homo sapiens
ugcaagacuaaaccuuccccuc

SEQ ID NO: 233733 - RNA, 22 nt, Homo sapiens
ugcaagaggagacuguacucag

SEQ ID NO: 233734 - RNA, 22 nt, Homo sapiens
ugcaaguaauuccagcuacuga

SEQ ID NO: 233735 - RNA, 22 nt, Homo sapiens
ugcaauagcuucaggagaaggg

SEQ ID NO: 233736 - RNA, 18 nt, Homo sapiens
ugcaauggagaugcagcc

SEQ ID NO: 233737 - RNA, 18 nt, Homo sapiens
ugcaccaguuuacacuuc

SEQ ID NO: 233738 - RNA, 22 nt, Homo sapiens
ugcagcacaguagguuugcaau

SEQ ID NO: 233739 - RNA, 20 nt, Homo sapiens
ugcaguguccucacuuguca

SEQ ID NO: 233740 - RNA, 22 nt, Homo sapiens
ugcauacugaaauauuuuagag

SEQ ID NO: 233741 - RNA, 22 nt, Homo sapiens
ugcauauucgaguuauuuuggg

SEQ ID NO: 233742 - RNA, 22 nt, Homo sapiens
ugcauccauucuagacucaucu

SEQ ID NO: 233743 - RNA, 21 nt, Homo sapiens
ugcauggagaacacugagggu

SEQ ID NO: 233744 - RNA, 21 nt, Homo sapiens
ugcauuguugcugagagcagg

SEQ ID NO: 233745 - RNA, 20 nt, Homo sapiens
ugccaagaugacuauagcuc

SEQ ID NO: 233746 - RNA, 21 nt, Homo sapiens
ugcuccauuuucuagccugaa

SEQ ID NO: 233747 - RNA, 22 nt, Homo sapiens
ugcugcaaacaggcaucugugg

SEQ ID NO: 233748 - RNA, 22 nt, Homo sapiens
ugcugcaaacaugagaggaagu

SEQ ID NO: 233749 - RNA, 22 nt, Homo sapiens
ugcugcuguuguuguuacuagc

SEQ ID NO: 233750 - RNA, 22 nt, Homo sapiens
ugcuguuguuugaugaaguaau

SEQ ID NO: 233751 - RNA, 23 nt, Homo sapiens
uggaacugaauuucuuagcauuu

SEQ ID NO: 233752 - RNA, 20 nt, Homo sapiens
uggaaucugaagaucucagu

SEQ ID NO: 233753 - RNA, 22 nt, Homo sapiens
uggaaugguaucuuguuggggu

SEQ ID NO: 233754 - RNA, 22 nt, Homo sapiens
uggaaugucagcuacaagaggg

SEQ ID NO: 233755 - RNA, 21 nt, Homo sapiens
uggaauuaauggagagguguu

SEQ ID NO: 233756 - RNA, 22 nt, Homo sapiens
uggacacuggagauucgucagu

SEQ ID NO: 233757 - RNA, 20 nt, Homo sapiens
uggaccagagagguggggac

SEQ ID NO: 233758 - RNA, 21 nt, Homo sapiens
uggaccccuuccuuacaucau

SEQ ID NO: 233759 - RNA, 22 nt, Homo sapiens
uggacuguaauagagaacagaa

SEQ ID NO: 233760 - RNA, 22 nt, Homo sapiens
uggagguaggugauauguagca

SEQ ID NO: 233761 - RNA, 22 nt, Homo sapiens
uggagugucaguuuccagaguu

SEQ ID NO: 233762 - RNA, 20 nt, Homo sapiens
uggaguuugaguucuuggag

SEQ ID NO: 233763 - RNA, 22 nt, Homo sapiens
uggauagauacuauccaggacu

SEQ ID NO: 233764 - RNA, 21 nt, Homo sapiens
uggcaacauggauggauucug

SEQ ID NO: 233765 - RNA, 22 nt, Homo sapiens
uggcaagaucacaauuacuuuu

SEQ ID NO: 233766 - RNA, 22 nt, Homo sapiens
uggcacaaugacccuugugggc

SEQ ID NO: 233767 - RNA, 22 nt, Homo sapiens
agugcacuccagccugggcaac

SEQ ID NO: 233768 - RNA, 22 nt, Homo sapiens
agugcacugcccgcuuccuguc

SEQ ID NO: 233769 - RNA, 22 nt, Homo sapiens
aguggaaucuguuauacuaacu

SEQ ID NO: 233770 - RNA, 22 nt, Homo sapiens
aguuuuugcugauagcaugcuu

SEQ ID NO: 233771 - RNA, 22 nt, Homo sapiens
auaaaagcaggucuaggucagg

SEQ ID NO: 233772 - RNA, 22 nt, Homo sapiens
auaaagccaggagacguaauug

SEQ ID NO: 233773 - RNA, 22 nt, Homo sapiens
auaaaugcaaugguauuuuuga

SEQ ID NO: 233774 - RNA, 22 nt, Homo sapiens
auaacauggaguuugucauuua

SEQ ID NO: 233775 - RNA, 22 nt, Homo sapiens
auaagaagugaaccagacgucu

SEQ ID NO: 233776 - RNA, 22 nt, Homo sapiens
auaagugcuuguugaauaauag

SEQ ID NO: 233777 - RNA, 22 nt, Homo sapiens
auaauaucagguugugaugaug

SEQ ID NO: 233778 - RNA, 23 nt, Homo sapiens
auaaugcaaguggugguaaucug

SEQ ID NO: 233779 - RNA, 22 nt, Homo sapiens
auacacuagggcuccugcagaa

SEQ ID NO: 233780 - RNA, 22 nt, Homo sapiens
auacagugaauacuuacagugu

SEQ ID NO: 233781 - RNA, 22 nt, Homo sapiens
auacuguuucugaacuuugauu

SEQ ID NO: 233782 - RNA, 22 nt, Homo sapiens
auagaaucaucugugcacuagu

SEQ ID NO: 233783 - RNA, 22 nt, Homo sapiens
auagaauguauuaguaaauuug

SEQ ID NO: 233784 - RNA, 23 nt, Homo sapiens
auagagcuaggaugcagacagau

SEQ ID NO: 233785 - RNA, 22 nt, Homo sapiens
auagagugcuucaucaguagua

SEQ ID NO: 233786 - RNA, 22 nt, Homo sapiens
auagcaaugcaagaauggcuua

SEQ ID NO: 233787 - RNA, 22 nt, Homo sapiens
auagcacaugugcaaauggcug

SEQ ID NO: 233788 - RNA, 22 nt, Homo sapiens
auaggagugugcacagaguagg

SEQ ID NO: 233789 - RNA, 22 nt, Homo sapiens
auagguauguaauacaaaugaa

SEQ ID NO: 233790 - RNA, 22 nt, Homo sapiens
auagugcagugaugaaccuagg

SEQ ID NO: 233791 - RNA, 22 nt, Homo sapiens
auauaugcuaagugcuaauaaa

SEQ ID NO: 233792 - RNA, 22 nt, Homo sapiens
auaucacucccaauaucgcagg

SEQ ID NO: 233793 - RNA, 22 nt, Homo sapiens
auaucagugucuuacuguuuuu

SEQ ID NO: 233794 - RNA, 22 nt, Homo sapiens
auauccuggagcauuuuugcaa

SEQ ID NO: 233795 - RNA, 22 nt, Homo sapiens
auaugcacaguggaguacuauu

SEQ ID NO: 233796 - RNA, 20 nt, Homo sapiens
auaugcagacacauacauac

SEQ ID NO: 233797 - RNA, 22 nt, Homo sapiens
auauguaguuucagaaguggaa

SEQ ID NO: 233798 - RNA, 18 nt, Homo sapiens
auauugcauuggauggau

SEQ ID NO: 233799 - RNA, 22 nt, Homo sapiens
auauuggucuucaagaccugug

SEQ ID NO: 233800 - RNA, 22 nt, Homo sapiens
auauugguuaaauauuauguga

SEQ ID NO: 233801 - RNA, 19 nt, Homo sapiens
aucaaacugcucuuugagg

SEQ ID NO: 233802 - RNA, 20 nt, Homo sapiens
aucaaagacuuagaggggga

SEQ ID NO: 233803 - RNA, 22 nt, Homo sapiens
aucaaagccaugcucaguuuuc

SEQ ID NO: 233804 - RNA, 22 nt, Homo sapiens
aucaaagugaaauauuaguuau

SEQ ID NO: 233805 - RNA, 22 nt, Homo sapiens
aucacaauuguacguaggagcc

SEQ ID NO: 233806 - RNA, 22 nt, Homo sapiens
aucacaguggucagguauagau

SEQ ID NO: 233807 - RNA, 22 nt, Homo sapiens
aucacauggccagguaguaauc

SEQ ID NO: 233808 - RNA, 22 nt, Homo sapiens
aucacauggccuagccuaaccu

SEQ ID NO: 233809 - RNA, 22 nt, Homo sapiens
aucaccauguguacauuagacc

SEQ ID NO: 233810 - RNA, 22 nt, Homo sapiens
aucacugggauggaacugcuga

SEQ ID NO: 233811 - RNA, 22 nt, Homo sapiens
aucauacuguuuugauuacugu

SEQ ID NO: 233812 - RNA, 22 nt, Homo sapiens
aucaucacaguuguguguaaug

SEQ ID NO: 233813 - RNA, 22 nt, Homo sapiens
auccaagagacugaugacuucc

SEQ ID NO: 233814 - RNA, 22 nt, Homo sapiens
auccacagugucaauguuguga

SEQ ID NO: 233815 - RNA, 22 nt, Homo sapiens
aucccaguaaaaauggcuucua

SEQ ID NO: 233816 - RNA, 22 nt, Homo sapiens
aucccaguucagccucugacac

SEQ ID NO: 233817 - RNA, 22 nt, Homo sapiens
aucccuagaaaaaucagcacau

SEQ ID NO: 233818 - RNA, 22 nt, Homo sapiens
auccugaagcuuuacugaauuc

SEQ ID NO: 233819 - RNA, 22 nt, Homo sapiens
auccugaugacacagugcugca

SEQ ID NO: 233820 - RNA, 22 nt, Homo sapiens
aucugcauuagggugaagaccu

SEQ ID NO: 233821 - RNA, 21 nt, Homo sapiens
aucugugagaccuuggggguu

SEQ ID NO: 233822 - RNA, 22 nt, Homo sapiens
aucuuggauuaccugggugggu

SEQ ID NO: 233823 - RNA, 22 nt, Homo sapiens
augaaaagcauaaacgcugaag

SEQ ID NO: 233824 - RNA, 22 nt, Homo sapiens
augaaagugauaaaugucucua

SEQ ID NO: 233825 - RNA, 22 nt, Homo sapiens
augaagauguugccuuuuuaau

SEQ ID NO: 233826 - RNA, 22 nt, Homo sapiens
augaagugcaugauaguugguu

SEQ ID NO: 233827 - RNA, 23 nt, Homo sapiens
augaauguaaggaguguaagaaa

SEQ ID NO: 233828 - RNA, 22 nt, Homo sapiens
augacacugcagagauguccca

SEQ ID NO: 233829 - RNA, 22 nt, Homo sapiens
augaccagagagugcgcagggu

SEQ ID NO: 233830 - RNA, 19 nt, Homo sapiens
augaccauuuccauaguau

SEQ ID NO: 233831 - RNA, 22 nt, Homo sapiens
augagaaucauuucagcuugua

SEQ ID NO: 233832 - RNA, 22 nt, Homo sapiens
augagauaggaacaaacuuaca

SEQ ID NO: 233833 - RNA, 22 nt, Homo sapiens
augagaugaggaauggcccucc

SEQ ID NO: 233834 - RNA, 22 nt, Homo sapiens
augagcagaugcuccugccucu

SEQ ID NO: 233835 - RNA, 22 nt, Homo sapiens
augaggaaggagccuuugucug

SEQ ID NO: 233836 - RNA, 22 nt, Homo sapiens
augagggcggacgcccuggaga

SEQ ID NO: 233837 - RNA, 19 nt, Homo sapiens
augagucugcaagaaccag

SEQ ID NO: 233838 - RNA, 22 nt, Homo sapiens
augauacuggcuucauagaaug

SEQ ID NO: 233839 - RNA, 22 nt, Homo sapiens
augauagucuugagaagcauuu

SEQ ID NO: 233840 - RNA, 22 nt, Homo sapiens
augaucacuguggaaauucagc

SEQ ID NO: 233841 - RNA, 22 nt, Homo sapiens
augauuguucucacucaagaga

SEQ ID NO: 233842 - RNA, 22 nt, Homo sapiens
augcaaacaucugaagagacau

SEQ ID NO: 233843 - RNA, 22 nt, Homo sapiens
augcaauggaaaggacaauuac

SEQ ID NO: 233844 - RNA, 19 nt, Homo sapiens
augcaaugucacaggcugc

SEQ ID NO: 233845 - RNA, 22 nt, Homo sapiens
augcagagucccagccccuagc

SEQ ID NO: 233846 - RNA, 22 nt, Homo sapiens
augccaagaugagcacgcgucu

SEQ ID NO: 233847 - RNA, 22 nt, Homo sapiens
augccacugcauaagguuuuca

SEQ ID NO: 233848 - RNA, 22 nt, Homo sapiens
augcuguuuugaauucucuaga

SEQ ID NO: 233849 - RNA, 22 nt, Homo sapiens
auggaagaauugucggggaugu

SEQ ID NO: 233850 - RNA, 22 nt, Homo sapiens
auggaagacuccucuuugggua

SEQ ID NO: 233851 - RNA, 22 nt, Homo sapiens
auggcaaaauguuccuaguggu

SEQ ID NO: 233852 - RNA, 22 nt, Homo sapiens
auggcaaugcgauggugacuga

SEQ ID NO: 233853 - RNA, 22 nt, Homo sapiens
auggcauugaagaguugucccu

SEQ ID NO: 233854 - RNA, 22 nt, Homo sapiens
auggcuauuccauaggcagagc

SEQ ID NO: 233855 - RNA, 21 nt, Homo sapiens
augggguagaagagaaggcuu

SEQ ID NO: 233856 - RNA, 22 nt, Homo sapiens
uucagcaguggccaguggaaau

SEQ ID NO: 233857 - RNA, 22 nt, Homo sapiens
uucaggcaccauggucauugau

SEQ ID NO: 233858 - RNA, 22 nt, Homo sapiens
uucaggguggagaguaugaggu

SEQ ID NO: 233859 - RNA, 22 nt, Homo sapiens
uucauagugaaaaauucaaagu

SEQ ID NO: 233860 - RNA, 22 nt, Homo sapiens
uucauaguguaccugaaggcac

SEQ ID NO: 233861 - RNA, 18 nt, Homo sapiens
uucaucaguccucagcug

SEQ ID NO: 233862 - RNA, 22 nt, Homo sapiens
uucauggaauauugaccauuuu

SEQ ID NO: 233863 - RNA, 22 nt, Homo sapiens
uuccacaaugguugaacuaauu

SEQ ID NO: 233864 - RNA, 22 nt, Homo sapiens
uuccacaaugguugaacuagcu

SEQ ID NO: 233865 - RNA, 22 nt, Homo sapiens
uuccacaaugguugaacuaguu

SEQ ID NO: 233866 - RNA, 22 nt, Homo sapiens
uuccagcugggggcaacucugc

SEQ ID NO: 233867 - RNA, 22 nt, Homo sapiens
uuccaguaauagcacagcauug

SEQ ID NO: 233868 - RNA, 22 nt, Homo sapiens
uucccuguaucuucugccaugu

SEQ ID NO: 233869 - RNA, 22 nt, Homo sapiens
uucccuuucugaaaaucucauu

SEQ ID NO: 233870 - RNA, 22 nt, Homo sapiens
uucccuuucugccuugaaucuu

SEQ ID NO: 233871 - RNA, 22 nt, Homo sapiens
uuccugcacuugcuugccuaug

SEQ ID NO: 233872 - RNA, 22 nt, Homo sapiens
uuccuugguucagggaaggucc

SEQ ID NO: 233873 - RNA, 22 nt, Homo sapiens
uucgucaugagacagaugcuga

SEQ ID NO: 233874 - RNA, 22 nt, Homo sapiens
uucuacaugggucgucggugag

SEQ ID NO: 233875 - RNA, 22 nt, Homo sapiens
uucucagugaaguuuagaacau

SEQ ID NO: 233876 - RNA, 22 nt, Homo sapiens
uucucauggaacaucuguacug

SEQ ID NO: 233877 - RNA, 22 nt, Homo sapiens
uucucauggugauggcaaaauc

SEQ ID NO: 233878 - RNA, 22 nt, Homo sapiens
uucugaguggcuuucaacacug

SEQ ID NO: 233879 - RNA, 22 nt, Homo sapiens
uucugcacaucgaucacaagau

SEQ ID NO: 233880 - RNA, 23 nt, Homo sapiens
uucugccacugaaaaugccucag

SEQ ID NO: 233881 - RNA, 22 nt, Homo sapiens
uucugcuugaucuaguguguug

SEQ ID NO: 233882 - RNA, 22 nt, Homo sapiens
uucuuagucauguaauagucca

SEQ ID NO: 233883 - RNA, 22 nt, Homo sapiens
uugaagacuaauuuagauaaug

SEQ ID NO: 233884 - RNA, 22 nt, Homo sapiens
uugaauagaaguguugaaagug

SEQ ID NO: 233885 - RNA, 18 nt, Homo sapiens
uugaauaguguccaaucu

SEQ ID NO: 233886 - RNA, 22 nt, Homo sapiens
uugaaugaaauuggugugggga

SEQ ID NO: 233887 - RNA, 20 nt, Homo sapiens
uugacaguggguuguuaaag

SEQ ID NO: 233888 - RNA, 22 nt, Homo sapiens
uugacauaaucauuucacagug

SEQ ID NO: 233889 - RNA, 22 nt, Homo sapiens
uugacugggccagacagagauc

SEQ ID NO: 233890 - RNA, 21 nt, Homo sapiens
uugagaagaauuagcucuucc

SEQ ID NO: 233891 - RNA, 22 nt, Homo sapiens
uugagaguggcagagguggaac

SEQ ID NO: 233892 - RNA, 22 nt, Homo sapiens
uugagauauccauaaaugggaa

SEQ ID NO: 233893 - RNA, 22 nt, Homo sapiens
uugaggaaugucauuuguguuu

SEQ ID NO: 233894 - RNA, 22 nt, Homo sapiens
uugaggaguacugauuagguau

SEQ ID NO: 233895 - RNA, 22 nt, Homo sapiens
uugagguaauaaacagccauuc

SEQ ID NO: 233896 - RNA, 20 nt, Homo sapiens
uugaggugugaggggcagag

SEQ ID NO: 233897 - RNA, 22 nt, Homo sapiens
uugauuagauccaguugauuga

SEQ ID NO: 233898 - RNA, 22 nt, Homo sapiens
uugcaaagaccucuucacuucc

SEQ ID NO: 233899 - RNA, 22 nt, Homo sapiens
uugcaacauguauucuggugau

SEQ ID NO: 233900 - RNA, 22 nt, Homo sapiens
uugcaagaaaucagagccuucc

SEQ ID NO: 233901 - RNA, 22 nt, Homo sapiens
uugcaagauguucaugggcugu

SEQ ID NO: 233902 - RNA, 22 nt, Homo sapiens
uugcacauguugaaccagcaaa

SEQ ID NO: 233903 - RNA, 22 nt, Homo sapiens
uugcacauugcaccuuuuguau

SEQ ID NO: 233904 - RNA, 22 nt, Homo sapiens
uugcagagaaauuucugguuua

SEQ ID NO: 233905 - RNA, 22 nt, Homo sapiens
uugccauggaguagaauugaag

SEQ ID NO: 233906 - RNA, 22 nt, Homo sapiens
uugcgcuuuuccuauguugccc

SEQ ID NO: 233907 - RNA, 22 nt, Homo sapiens
uugcuauguugcccagucugga

SEQ ID NO: 233908 - RNA, 22 nt, Homo sapiens
uuggaagacaaugcugauucuc

SEQ ID NO: 233909 - RNA, 22 nt, Homo sapiens
uuggaagacauucugucugcua

SEQ ID NO: 233910 - RNA, 22 nt, Homo sapiens
uuggaagagaagggagauaaac

SEQ ID NO: 233911 - RNA, 22 nt, Homo sapiens
uuggagcccuaacucucaguac

SEQ ID NO: 233912 - RNA, 22 nt, Homo sapiens
uuggcagugcccgaugcugggg

SEQ ID NO: 233913 - RNA, 22 nt, Homo sapiens
uuggcauuguggauggaaucau

SEQ ID NO: 233914 - RNA, 20 nt, Homo sapiens
uuggcauuuagacaagaguu

SEQ ID NO: 233915 - RNA, 22 nt, Homo sapiens
uuggucucuuaaucacacuuuu

SEQ ID NO: 233916 - RNA, 22 nt, Homo sapiens
uuguaaaguucucucccgaaaa

SEQ ID NO: 233917 - RNA, 22 nt, Homo sapiens
uuguacuagaaaauuauucuuu

SEQ ID NO: 233918 - RNA, 20 nt, Homo sapiens
uuguacuccugggcucaagc

SEQ ID NO: 233919 - RNA, 22 nt, Homo sapiens
uugucaaacucauucuccaucc

SEQ ID NO: 233920 - RNA, 22 nt, Homo sapiens
uugucacugcacuccagucugg

SEQ ID NO: 233921 - RNA, 22 nt, Homo sapiens
uuguccaagucccauuuguuga

SEQ ID NO: 233922 - RNA, 22 nt, Homo sapiens
uuguguccccacccaaaucuca

SEQ ID NO: 233923 - RNA, 22 nt, Homo sapiens
uuguguccccacucaaauuaca

SEQ ID NO: 233924 - RNA, 22 nt, Homo sapiens
uugugucccugcccaaaucuca

SEQ ID NO: 233925 - RNA, 22 nt, Homo sapiens
uuguugcacugcuuuccuggcc

SEQ ID NO: 233926 - RNA, 22 nt, Homo sapiens
uuuaaaguuagaaggaaagggc

SEQ ID NO: 233927 - RNA, 21 nt, Homo sapiens
uuuagguagcuuuucugggag

SEQ ID NO: 233928 - RNA, 22 nt, Homo sapiens
uuucaguagagacacgguuuug

SEQ ID NO: 233929 - RNA, 22 nt, Homo sapiens
uuucauagaucaugcuuuugga

SEQ ID NO: 233930 - RNA, 22 nt, Homo sapiens
uuucauagccuuugucgucuga

SEQ ID NO: 233931 - RNA, 22 nt, Homo sapiens
uuucauggagaaucuucuuacu

SEQ ID NO: 233932 - RNA, 23 nt, Homo sapiens
uuucauggggauuuacucauucc

SEQ ID NO: 233933 - RNA, 22 nt, Homo sapiens
uuuccaagaugcuuacuuucuc

SEQ ID NO: 233934 - RNA, 22 nt, Homo sapiens
uuuccaguuguucuagaaagcu

SEQ ID NO: 233935 - RNA, 16 nt, Homo sapiens
uuucccuuugguguuu

SEQ ID NO: 233936 - RNA, 22 nt, Homo sapiens
uuucuauguugaccagucuaga

SEQ ID NO: 233937 - RNA, 22 nt, Homo sapiens
uuugacuagaguguuuuacaac

SEQ ID NO: 233938 - RNA, 22 nt, Homo sapiens
uuugauguugagacuauaaagc

SEQ ID NO: 233939 - RNA, 22 nt, Homo sapiens
uuugcacuuuaauauaauguga

SEQ ID NO: 233940 - RNA, 22 nt, Homo sapiens
uuugcauauguugaaccagccu

SEQ ID NO: 233941 - RNA, 22 nt, Homo sapiens
uuuggcacuguaaauuucucuu

SEQ ID NO: 233942 - RNA, 22 nt, Homo sapiens
uuuggcagaaaacaagaaucug

SEQ ID NO: 233943 - RNA, 22 nt, Homo sapiens
uuuggcauauuuuaagcugguu

SEQ ID NO: 233944 - RNA, 22 nt, Homo sapiens
aaagugcugagacagacuggga

SEQ ID NO: 233945 - RNA, 22 nt, Homo sapiens
aaauaguagcugaaugagggaa

SEQ ID NO: 233946 - RNA, 22 nt, Homo sapiens
aaaugcacaaagauuuugcacu

SEQ ID NO: 233947 - RNA, 22 nt, Homo sapiens
aaaugcaguugguggggauaug

SEQ ID NO: 233948 - RNA, 22 nt, Homo sapiens
aaaugcaugaggugggaagaaa

SEQ ID NO: 233949 - RNA, 19 nt, Homo sapiens
aaaugugcacuguuuucca

SEQ ID NO: 233950 - RNA, 22 nt, Homo sapiens
aaauucaucaaaugguuuguau

SEQ ID NO: 233951 - RNA, 22 nt, Homo sapiens
aaccugaagaaaauauuugcug

SEQ ID NO: 233952 - RNA, 22 nt, Homo sapiens
aacuacaucucuuugaggcagg

SEQ ID NO: 233953 - RNA, 22 nt, Homo sapiens
aacuggccuggcgugcagaggg

SEQ ID NO: 233954 - RNA, 23 nt, Homo sapiens
aagagguaugacuaugaagugga

SEQ ID NO: 233955 - RNA, 22 nt, Homo sapiens
aagagugucuuugugcuggccc

SEQ ID NO: 233956 - RNA, 22 nt, Homo sapiens
aagcaucacuggaggcagccau

SEQ ID NO: 233957 - RNA, 20 nt, Homo sapiens
aagcauggguuuuaggguca

SEQ ID NO: 233958 - RNA, 22 nt, Homo sapiens
aagcuccauuucugccaugaga

SEQ ID NO: 233959 - RNA, 23 nt, Homo sapiens
aaggacacugaacacuucccagc

SEQ ID NO: 233960 - RNA, 22 nt, Homo sapiens
aaggagcuuaagugacuuguac

SEQ ID NO: 233961 - RNA, 22 nt, Homo sapiens
aaggcaagaagagaaccaucgg

SEQ ID NO: 233962 - RNA, 22 nt, Homo sapiens
aaggcagugugcacauaacacu

SEQ ID NO: 233963 - RNA, 20 nt, Homo sapiens
aaggcuuucgaguuccaggg

SEQ ID NO: 233964 - RNA, 22 nt, Homo sapiens
aaggugguuuucucuuggaguc

SEQ ID NO: 233965 - RNA, 22 nt, Homo sapiens
aaguaauggaguuauuuuauga

SEQ ID NO: 233966 - RNA, 22 nt, Homo sapiens
aaguaauugagguuuuugcugu

SEQ ID NO: 233967 - RNA, 22 nt, Homo sapiens
aaguacuguuuaaauugcagaa

SEQ ID NO: 233968 - RNA, 19 nt, Homo sapiens
aaguacuugucuuuugaag

SEQ ID NO: 233969 - RNA, 22 nt, Homo sapiens
aagugacuagacuaugaaaccu

SEQ ID NO: 233970 - RNA, 22 nt, Homo sapiens
aagugagugacaaaaacugggc

SEQ ID NO: 233971 - RNA, 22 nt, Homo sapiens
aagugcuuaggauagugugugg

SEQ ID NO: 233972 - RNA, 22 nt, Homo sapiens
aaguggaauguuuguggcacaa

SEQ ID NO: 233973 - RNA, 21 nt, Homo sapiens
aauaaagcaaccuuaugccau

SEQ ID NO: 233974 - RNA, 22 nt, Homo sapiens
aauaaagcaggguccuugcacu

SEQ ID NO: 233975 - RNA, 22 nt, Homo sapiens
aauaaagccugucucuuuagag

SEQ ID NO: 233976 - RNA, 22 nt, Homo sapiens
aauaaagcugaauccuuccuga

SEQ ID NO: 233977 - RNA, 22 nt, Homo sapiens
aauaauggcaccaaagcacaag

SEQ ID NO: 233978 - RNA, 21 nt, Homo sapiens
aauacucuagguuaagagagc

SEQ ID NO: 233979 - RNA, 22 nt, Homo sapiens
aauagcuguuuuuaauuccugc

SEQ ID NO: 233980 - RNA, 22 nt, Homo sapiens
aauagugcugugcagugagugg

SEQ ID NO: 233981 - RNA, 22 nt, Homo sapiens
aauaucacaggguguacacuca

SEQ ID NO: 233982 - RNA, 19 nt, Homo sapiens
aauauugacaguggugucu

SEQ ID NO: 233983 - RNA, 22 nt, Homo sapiens
aaucccuuuguccagucucuuu

SEQ ID NO: 233984 - RNA, 20 nt, Homo sapiens
aaucuacuugcccauuuagc

SEQ ID NO: 233985 - RNA, 22 nt, Homo sapiens
aaugacccugauuggcaaguug

SEQ ID NO: 233986 - RNA, 22 nt, Homo sapiens
aaugauacuguguacaagggca

SEQ ID NO: 233987 - RNA, 22 nt, Homo sapiens
aaugcacauauauuuccuuauu

SEQ ID NO: 233988 - RNA, 22 nt, Homo sapiens
aauggcaguagauggaugggua

SEQ ID NO: 233989 - RNA, 22 nt, Homo sapiens
aauggcuauuucaugugguagg

SEQ ID NO: 233990 - RNA, 22 nt, Homo sapiens
aaugugcacuauuagggugaua

SEQ ID NO: 233991 - RNA, 22 nt, Homo sapiens
aauuaguugaaagucugcuuuu

SEQ ID NO: 233992 - RNA, 23 nt, Homo sapiens
aauugcacauuccuugcuggcag

SEQ ID NO: 233993 - RNA, 22 nt, Homo sapiens
aauugcacuaagcauaguccag

SEQ ID NO: 233994 - RNA, 22 nt, Homo sapiens
aauugcauaaaauucaacucug

SEQ ID NO: 233995 - RNA, 22 nt, Homo sapiens
aauugcauaugcaguagaucua

SEQ ID NO: 233996 - RNA, 22 nt, Homo sapiens
aauugcucuccuccaaggucuu

SEQ ID NO: 233997 - RNA, 22 nt, Homo sapiens
acacaaugguaaguguuugugu

SEQ ID NO: 233998 - RNA, 22 nt, Homo sapiens
acacauacacauaugguguaua

SEQ ID NO: 233999 - RNA, 22 nt, Homo sapiens
acacauuagcaagugcuguuau

SEQ ID NO: 234000 - RNA, 22 nt, Homo sapiens
acaccaucuccuuauuucucuu

SEQ ID NO: 234001 - RNA, 22 nt, Homo sapiens
acacucuaguguucuuaaucag

SEQ ID NO: 234002 - RNA, 22 nt, Homo sapiens
acacuguugacauuuuguagug

SEQ ID NO: 234003 - RNA, 22 nt, Homo sapiens
acacuguuuuaguuauuauagc

SEQ ID NO: 234004 - RNA, 23 nt, Homo sapiens
acacuugcugaguaaaucaaaua

SEQ ID NO: 234005 - RNA, 22 nt, Homo sapiens
acagcagugccccacucuacug

SEQ ID NO: 234006 - RNA, 22 nt, Homo sapiens
acagguacaagggauuaggaug

SEQ ID NO: 234007 - RNA, 22 nt, Homo sapiens
acagguauagaaagcuaaaggg

SEQ ID NO: 234008 - RNA, 22 nt, Homo sapiens
acaggugaaguauuacacuaag

SEQ ID NO: 234009 - RNA, 22 nt, Homo sapiens
acagugcuguggucaugggucu

SEQ ID NO: 234010 - RNA, 22 nt, Homo sapiens
acaguggaauguaggguuugag

SEQ ID NO: 234011 - RNA, 18 nt, Homo sapiens
acagugucuuacaccugu

SEQ ID NO: 234012 - RNA, 22 nt, Homo sapiens
acaugagacuggguuuguaggg

SEQ ID NO: 234013 - RNA, 22 nt, Homo sapiens
acaugccucccugguccgcugu

SEQ ID NO: 234014 - RNA, 18 nt, Homo sapiens
acauucagcuugaagaua

SEQ ID NO: 234015 - RNA, 22 nt, Homo sapiens
accaguuuuuuauacaucuucu

SEQ ID NO: 234016 - RNA, 21 nt, Homo sapiens
acccccacaccuccuuaguuc

SEQ ID NO: 234017 - RNA, 22 nt, Homo sapiens
acccuguaacauacaagugguu

SEQ ID NO: 234018 - RNA, 22 nt, Homo sapiens
acccuguaggugcuggcagaga

SEQ ID NO: 234019 - RNA, 22 nt, Homo sapiens
accugagauuacaggugcuggc

SEQ ID NO: 234020 - RNA, 22 nt, Homo sapiens
accugggugcugaugggcuuua

SEQ ID NO: 234021 - RNA, 22 nt, Homo sapiens
accuugcacugagccgagauug

SEQ ID NO: 234022 - RNA, 22 nt, Homo sapiens
acuauacugaagcaaauuaaca

SEQ ID NO: 234023 - RNA, 22 nt, Homo sapiens
acucuguauaaacauugcugua

SEQ ID NO: 234024 - RNA, 22 nt, Homo sapiens
acugcaaugucgaauagagaug

SEQ ID NO: 234025 - RNA, 20 nt, Homo sapiens
acugcacuccaggcugccca

SEQ ID NO: 234026 - RNA, 22 nt, Homo sapiens
acugcauuugguaaagucaaga

SEQ ID NO: 234027 - RNA, 22 nt, Homo sapiens
acugguguaugggaggucccaa

SEQ ID NO: 234028 - RNA, 22 nt, Homo sapiens
acugugcuguuuuaauuauuga

SEQ ID NO: 234029 - RNA, 22 nt, Homo sapiens
acuuugcuuaucccaggcacug

SEQ ID NO: 234030 - RNA, 22 nt, Homo sapiens
acuuuguguuacccagcaagga

SEQ ID NO: 234031 - RNA, 22 nt, Homo sapiens
acuuuuugaugaggucguuugu

SEQ ID NO: 234032 - RNA, 22 nt, Homo sapiens
agaaauguuuacucacccccuu

SEQ ID NO: 234033 - RNA, 22 nt, Homo sapiens
uuugggaaugguuugucuccca

SEQ ID NO: 234034 - RNA, 22 nt, Homo sapiens
uuuguagcucacucugagcuga

SEQ ID NO: 234035 - RNA, 22 nt, Homo sapiens
uuugugcaugaagagggggugc

SEQ ID NO: 234036 - RNA, 22 nt, Homo sapiens
uuugugcuaaugcuagauuacu

SEQ ID NO: 234037 - RNA, 22 nt, Homo sapiens
uuugugcuauguuauauauucu

SEQ ID NO: 234038 - RNA, 21 nt, Homo sapiens
uuugugguuacugugugagcu

SEQ ID NO: 234039 - RNA, 22 nt, Homo sapiens
uuugugucccucuaaaauuuau

SEQ ID NO: 234040 - RNA, 22 nt, Homo sapiens
uuugugugugauuauaaaaggu

SEQ ID NO: 234041 - RNA, 20 nt, Homo sapiens
uuuuagcacuuguuauggug

SEQ ID NO: 234042 - RNA, 22 nt, Homo sapiens
uuuuaguggacaaagguauuua

SEQ ID NO: 234043 - RNA, 22 nt, Homo sapiens
uuuugcacuguuuuaucugaca

SEQ ID NO: 234044 - RNA, 22 nt, Homo sapiens
uuuuggcuagaaauauaccucc

SEQ ID NO: 234045 - RNA, 22 nt, Homo sapiens
uuuuggcuuaaagagaauguau

SEQ ID NO: 234046 - RNA, 22 nt, Homo sapiens
uuuugguaaugaacuuaggaag

SEQ ID NO: 234047 - RNA, 22 nt, Homo sapiens
uuuugugacuauuguaaauggg

SEQ ID NO: 234048 - RNA, 22 nt, Homo sapiens
uuuuugaguagcuggagagcag

SEQ ID NO: 234049 - RNA, 22 nt, Homo sapiens
uuuuuggauaaugguacaugua

SEQ ID NO: 234050 - RNA, 22 nt, Homo sapiens
uuuuuggguaaugauuaucaau

SEQ ID NO: 234051 - RNA, 22 nt, Homo sapiens
augauucugaucuagagcuugg

SEQ ID NO: 234052 - RNA, 22 nt, Homo sapiens
augcauagcaucugcaaauguu

SEQ ID NO: 234053 - RNA, 22 nt, Homo sapiens
augccaagagacaaagggaauc

SEQ ID NO: 234054 - RNA, 20 nt, Homo sapiens
augccacugagcagugguga

SEQ ID NO: 234055 - RNA, 22 nt, Homo sapiens
augccacugcacucuagccugg

SEQ ID NO: 234056 - RNA, 22 nt, Homo sapiens
augccacugcacuucagccugc

SEQ ID NO: 234057 - RNA, 22 nt, Homo sapiens
augcuaugugugacuucuuaug

SEQ ID NO: 234058 - RNA, 22 nt, Homo sapiens
auggaaaugaagggcuggcccu

SEQ ID NO: 234059 - RNA, 22 nt, Homo sapiens
auggaagaaacgauuuucugga

SEQ ID NO: 234060 - RNA, 22 nt, Homo sapiens
auggagagaauuauucucucag

SEQ ID NO: 234061 - RNA, 22 nt, Homo sapiens
auggagcuugacaguuguagag

SEQ ID NO: 234062 - RNA, 22 nt, Homo sapiens
auggaggaggaagcugaaacaa

SEQ ID NO: 234063 - RNA, 22 nt, Homo sapiens
auggaucauauucuugaggagg

SEQ ID NO: 234064 - RNA, 22 nt, Homo sapiens
auggcacuccagccugggcaac

SEQ ID NO: 234065 - RNA, 22 nt, Homo sapiens
auggcacugaagcguauugaca

SEQ ID NO: 234066 - RNA, 18 nt, Homo sapiens
auggcagaacaauuuaca

SEQ ID NO: 234067 - RNA, 22 nt, Homo sapiens
auggccuuuacaauuugguaug

SEQ ID NO: 234068 - RNA, 22 nt, Homo sapiens
auggcucaguguguaucuauca

SEQ ID NO: 234069 - RNA, 22 nt, Homo sapiens
auggcuuuaagagugucugaau

SEQ ID NO: 234070 - RNA, 22 nt, Homo sapiens
augggugaguaugaguugacuu

SEQ ID NO: 234071 - RNA, 22 nt, Homo sapiens
augucaaggugggugauaguuu

SEQ ID NO: 234072 - RNA, 21 nt, Homo sapiens
augucauggaugacuaauuca

SEQ ID NO: 234073 - RNA, 22 nt, Homo sapiens
augugggaggacuuggcuguug

SEQ ID NO: 234074 - RNA, 22 nt, Homo sapiens
auguguucaucacagcacaauu

SEQ ID NO: 234075 - RNA, 20 nt, Homo sapiens
auguucuggaggacagaagc

SEQ ID NO: 234076 - RNA, 22 nt, Homo sapiens
auuaaguugugccugaaaacuu

SEQ ID NO: 234077 - RNA, 22 nt, Homo sapiens
auuagguuaggcaaacuucugu

SEQ ID NO: 234078 - RNA, 22 nt, Homo sapiens
auuagguuagugcaaaaguaau

SEQ ID NO: 234079 - RNA, 22 nt, Homo sapiens
auuauaugucaucacagacacc

SEQ ID NO: 234080 - RNA, 22 nt, Homo sapiens
auucaucagggauauugguuga

SEQ ID NO: 234081 - RNA, 20 nt, Homo sapiens
auucauggugguacguuguc

SEQ ID NO: 234082 - RNA, 22 nt, Homo sapiens
auuccagguggcgccauucaca

SEQ ID NO: 234083 - RNA, 22 nt, Homo sapiens
auuccauuuguuaucacacccg

SEQ ID NO: 234084 - RNA, 21 nt, Homo sapiens
auugcacaauauacccaugua

SEQ ID NO: 234085 - RNA, 22 nt, Homo sapiens
auugcacuccagccugggugag

SEQ ID NO: 234086 - RNA, 22 nt, Homo sapiens
auugcacucuagccugggugac

SEQ ID NO: 234087 - RNA, 22 nt, Homo sapiens
auugcagaaaugacagagcgcc

SEQ ID NO: 234088 - RNA, 22 nt, Homo sapiens
auugcuuuuacugggagcuuug

SEQ ID NO: 234089 - RNA, 22 nt, Homo sapiens
auuggggaaugguggcuuuagu

SEQ ID NO: 234090 - RNA, 22 nt, Homo sapiens
auuguacuccagccugggcaag

SEQ ID NO: 234091 - RNA, 22 nt, Homo sapiens
auuguacuccagccugggcugc

SEQ ID NO: 234092 - RNA, 22 nt, Homo sapiens
auuguacuccagccuguggagc

SEQ ID NO: 234093 - RNA, 22 nt, Homo sapiens
auuguacugccccccuguugcu

SEQ ID NO: 234094 - RNA, 22 nt, Homo sapiens
auuguacuuauugccagaauuu

SEQ ID NO: 234095 - RNA, 22 nt, Homo sapiens
auuguguuugaaugaggcucca

SEQ ID NO: 234096 - RNA, 19 nt, Homo sapiens
auuuccuggagcuggucuc

SEQ ID NO: 234097 - RNA, 22 nt, Homo sapiens
auuucuacuccuguguccagaa

SEQ ID NO: 234098 - RNA, 22 nt, Homo sapiens
ccaaguguuuucauuguuccau

SEQ ID NO: 234099 - RNA, 23 nt, Homo sapiens
ccacacuguuuagaauggcauca

SEQ ID NO: 234100 - RNA, 22 nt, Homo sapiens
ccacaguugaaauuuugacugu

SEQ ID NO: 234101 - RNA, 22 nt, Homo sapiens
ccagugcugugcaguguaugag

SEQ ID NO: 234102 - RNA, 22 nt, Homo sapiens
ccaucacaggccucagugggaa

SEQ ID NO: 234103 - RNA, 20 nt, Homo sapiens
ccaucaguccucucuuguuc

SEQ ID NO: 234104 - RNA, 21 nt, Homo sapiens
ccauggcaaugguaaacugac

SEQ ID NO: 234105 - RNA, 22 nt, Homo sapiens
ccauugaacaugaaggaaugug

SEQ ID NO: 234106 - RNA, 21 nt, Homo sapiens
cccagguucucugaggguaga

SEQ ID NO: 234107 - RNA, 18 nt, Homo sapiens
cccagugacuuauggccu

SEQ ID NO: 234108 - RNA, 22 nt, Homo sapiens
ccccauguucucucugcagcuc

SEQ ID NO: 234109 - RNA, 17 nt, Homo sapiens
ccccugagcgaugcagu

SEQ ID NO: 234110 - RNA, 22 nt, Homo sapiens
ccccuguaucucagcgucuuca

SEQ ID NO: 234111 - RNA, 22 nt, Homo sapiens
cccucgagaaaccaucugcuga

SEQ ID NO: 234112 - RNA, 22 nt, Homo sapiens
cccuguguuguucaaggaucug

SEQ ID NO: 234113 - RNA, 22 nt, Homo sapiens
ccucaguguuuaucauuauuuu

SEQ ID NO: 234114 - RNA, 22 nt, Homo sapiens
ccucauggagaacaucugcuag

SEQ ID NO: 234115 - RNA, 22 nt, Homo sapiens
ccucuuuguugagacuucacca

SEQ ID NO: 234116 - RNA, 22 nt, Homo sapiens
ccuggguuacaggugugagcca

SEQ ID NO: 234117 - RNA, 23 nt, Homo sapiens
ccuguagaaugucugugauacuu

SEQ ID NO: 234118 - RNA, 22 nt, Homo sapiens
ccuucacaggcacugguucaga

SEQ ID NO: 234119 - RNA, 22 nt, Homo sapiens
ccuuuguggggcgguggguaau

SEQ ID NO: 234120 - RNA, 22 nt, Homo sapiens
cuaaaguagccaggacugcagg

SEQ ID NO: 234121 - RNA, 22 nt, Homo sapiens
cuaacacagggcaagucaggcu

SEQ ID NO: 234122 - RNA, 22 nt, Homo sapiens
cuaauacguaguauauccauga

SEQ ID NO: 234123 - RNA, 22 nt, Homo sapiens
cuacaguucucaggaguuggcc

SEQ ID NO: 234124 - RNA, 22 nt, Homo sapiens
cuagcagcaugagaauggacca

SEQ ID NO: 234125 - RNA, 22 nt, Homo sapiens
cuaugguuucuccauaucauca

SEQ ID NO: 234126 - RNA, 22 nt, Homo sapiens
cuaugucuuucauauuuugggg

SEQ ID NO: 234127 - RNA, 22 nt, Homo sapiens
cucaauuuggaauugucaguaa

SEQ ID NO: 234128 - RNA, 17 nt, Homo sapiens
cucacugagaacagcua

SEQ ID NO: 234129 - RNA, 22 nt, Homo sapiens
cucaguuuugccuuguuuaagg

SEQ ID NO: 234130 - RNA, 22 nt, Homo sapiens
cucauuaguuguuuuaagauga

SEQ ID NO: 234131 - RNA, 22 nt, Homo sapiens
cuccauagucuucgaagaauga

SEQ ID NO: 234132 - RNA, 22 nt, Homo sapiens
cucccagugacccaggaacagg

SEQ ID NO: 234133 - RNA, 22 nt, Homo sapiens
cuccuugauuagaguauagagu

SEQ ID NO: 234134 - RNA, 22 nt, Homo sapiens
cucucaguugucuaauuaguuu

SEQ ID NO: 234135 - RNA, 21 nt, Homo sapiens
cucucugcuuaugaauaguga

SEQ ID NO: 234136 - RNA, 22 nt, Homo sapiens
cucugacagugguuagcacugu

SEQ ID NO: 234137 - RNA, 22 nt, Homo sapiens
cucuuugaggugagcugcccau

SEQ ID NO: 234138 - RNA, 22 nt, Homo sapiens
cugaaaagcaucugcauagcug

SEQ ID NO: 234139 - RNA, 22 nt, Homo sapiens
cugaagugugaaagucuuuuuu

SEQ ID NO: 234140 - RNA, 22 nt, Homo sapiens
cugaaucauugcauuaucaagg

SEQ ID NO: 234141 - RNA, 22 nt, Homo sapiens
cugacaagugaucacagcagca

SEQ ID NO: 234142 - RNA, 22 nt, Homo sapiens
cugacacuucaaaacugccaau

SEQ ID NO: 234143 - RNA, 22 nt, Homo sapiens
ugaaauuuuuuauucguuggcu

SEQ ID NO: 234144 - RNA, 22 nt, Homo sapiens
ugaacagcuaucuugucagugu

SEQ ID NO: 234145 - RNA, 22 nt, Homo sapiens
ugaaggaguauggauaagucgu

SEQ ID NO: 234146 - RNA, 22 nt, Homo sapiens
ugaagugaaugguaaguaugcc

SEQ ID NO: 234147 - RNA, 22 nt, Homo sapiens
ugaagugggaaaugaguauuaa

SEQ ID NO: 234148 - RNA, 22 nt, Homo sapiens
ugaauauguuucuaaaagugca

SEQ ID NO: 234149 - RNA, 22 nt, Homo sapiens
ugaaugguaaagaaaagcacug

SEQ ID NO: 234150 - RNA, 22 nt, Homo sapiens
ugaaugguaauuuaguaggcac

SEQ ID NO: 234151 - RNA, 23 nt, Homo sapiens
ugacaaccucaugcuuugucaug

SEQ ID NO: 234152 - RNA, 22 nt, Homo sapiens
ugacaagaacuuuccauaguaa

SEQ ID NO: 234153 - RNA, 22 nt, Homo sapiens
ugacaggucuaauuuacugaca

SEQ ID NO: 234154 - RNA, 22 nt, Homo sapiens
ugacauuacagucacuugcugu

SEQ ID NO: 234155 - RNA, 22 nt, Homo sapiens
ugaccacagaaagugagggagc

SEQ ID NO: 234156 - RNA, 22 nt, Homo sapiens
ugacuauaggauaacaugcauu

SEQ ID NO: 234157 - RNA, 23 nt, Homo sapiens
ugacugaguauauguuuggugcu

SEQ ID NO: 234158 - RNA, 22 nt, Homo sapiens
ugacuggaacuuuagugagucu

SEQ ID NO: 234159 - RNA, 23 nt, Homo sapiens
ugacuuaggccucaacuaugacu

SEQ ID NO: 234160 - RNA, 23 nt, Homo sapiens
ugacuuguccagugauaguucgu

SEQ ID NO: 234161 - RNA, 20 nt, Homo sapiens
ugacuuguccgagguccccc

SEQ ID NO: 234162 - RNA, 22 nt, Homo sapiens
ugacuuuagaauuuuauccaga

SEQ ID NO: 234163 - RNA, 22 nt, Homo sapiens
ugagaacauuccucuuccuggc

SEQ ID NO: 234164 - RNA, 22 nt, Homo sapiens
ugagaaccucugugugcccacu

SEQ ID NO: 234165 - RNA, 22 nt, Homo sapiens
ugagaagacaucagcuuucgga

SEQ ID NO: 234166 - RNA, 22 nt, Homo sapiens
ugagaauauuuuccaugucuca

SEQ ID NO: 234167 - RNA, 22 nt, Homo sapiens
ugagacgaagucuugcucuguu

SEQ ID NO: 234168 - RNA, 22 nt, Homo sapiens
ugagacugagucuugcucuauu

SEQ ID NO: 234169 - RNA, 22 nt, Homo sapiens
ugagacugaguuuugcucuugu

SEQ ID NO: 234170 - RNA, 22 nt, Homo sapiens
ugagaucuucgcucuucacaga

SEQ ID NO: 234171 - RNA, 22 nt, Homo sapiens
ugagaugaagcuagaagaaugg

SEQ ID NO: 234172 - RNA, 22 nt, Homo sapiens
ugagaugagaaucaguucuaau

SEQ ID NO: 234173 - RNA, 22 nt, Homo sapiens
ugagaugagagaaugcuugccu

SEQ ID NO: 234174 - RNA, 22 nt, Homo sapiens
ugagaugagucucgcucuguca

SEQ ID NO: 234175 - RNA, 22 nt, Homo sapiens
ugagaugaguugcuggcucuga

SEQ ID NO: 234176 - RNA, 22 nt, Homo sapiens
ugagaugguaaauuuuuguugu

SEQ ID NO: 234177 - RNA, 23 nt, Homo sapiens
ugagaugucugauugcgaggguc

SEQ ID NO: 234178 - RNA, 22 nt, Homo sapiens
ugagaugugaagaucacaugaa

SEQ ID NO: 234179 - RNA, 21 nt, Homo sapiens
ugagauuaaguuguuuagaag

SEQ ID NO: 234180 - RNA, 22 nt, Homo sapiens
ugagauuaucguaauguaucuc

SEQ ID NO: 234181 - RNA, 22 nt, Homo sapiens
ugagcaucauucacaccuuggu

SEQ ID NO: 234182 - RNA, 22 nt, Homo sapiens
ugagccauggcaccuugucuaa

SEQ ID NO: 234183 - RNA, 22 nt, Homo sapiens
ugaggaauguguguuaaagaua

SEQ ID NO: 234184 - RNA, 22 nt, Homo sapiens
ugagguaauagauaauauuuuu

SEQ ID NO: 234185 - RNA, 22 nt, Homo sapiens
ugaguaauguugaucuuugaua

SEQ ID NO: 234186 - RNA, 22 nt, Homo sapiens
ugaguagaacuagucuagagcu

SEQ ID NO: 234187 - RNA, 23 nt, Homo sapiens
ugagucacuuugcuggggucucu

SEQ ID NO: 234188 - RNA, 22 nt, Homo sapiens
ugaguuaauuuuuguaucaugu

SEQ ID NO: 234189 - RNA, 22 nt, Homo sapiens
ugaguugagauaagguuacauu

SEQ ID NO: 234190 - RNA, 23 nt, Homo sapiens
ugauaacagcauaugaagauucu

SEQ ID NO: 234191 - RNA, 20 nt, Homo sapiens
ugauaugguuuggcuguguu

SEQ ID NO: 234192 - RNA, 22 nt, Homo sapiens
ugaucuguguaacauaggaguc

SEQ ID NO: 234193 - RNA, 22 nt, Homo sapiens
ugaugucuugagauggagcuua

SEQ ID NO: 234194 - RNA, 22 nt, Homo sapiens
ugauuuguuuagugccaaguuu

SEQ ID NO: 234195 - RNA, 21 nt, Homo sapiens
ugcaagaaucaggaagcugcc

SEQ ID NO: 234196 - RNA, 22 nt, Homo sapiens
uggcagauaggauacaggacua

SEQ ID NO: 234197 - RNA, 22 nt, Homo sapiens
uggcagaugcucuuggugccca

SEQ ID NO: 234198 - RNA, 22 nt, Homo sapiens
uggcuuuucauccugggacauu

SEQ ID NO: 234199 - RNA, 22 nt, Homo sapiens
ugggaugugagucuucgcuuuc

SEQ ID NO: 234200 - RNA, 23 nt, Homo sapiens
ugggauguuuuuggaaacuucug

SEQ ID NO: 234201 - RNA, 22 nt, Homo sapiens
ugggguaggcuguauacucugu

SEQ ID NO: 234202 - RNA, 23 nt, Homo sapiens
ugggucaguuuuucugacaucau

SEQ ID NO: 234203 - RNA, 22 nt, Homo sapiens
uggguccccuacucuuuccaca

SEQ ID NO: 234204 - RNA, 22 nt, Homo sapiens
ugguccaguucugugauauugc

SEQ ID NO: 234205 - RNA, 21 nt, Homo sapiens
uggucccauaagauuacaaug

SEQ ID NO: 234206 - RNA, 21 nt, Homo sapiens
uggucccauaagauuauaaug

SEQ ID NO: 234207 - RNA, 22 nt, Homo sapiens
uggucccaugaacuuuagguca

SEQ ID NO: 234208 - RNA, 22 nt, Homo sapiens
uggugagaaaugagaugcuuuu

SEQ ID NO: 234209 - RNA, 22 nt, Homo sapiens
uggugcccuguccuucuguggc

SEQ ID NO: 234210 - RNA, 20 nt, Homo sapiens
uggugucuuggaaagagcuc

SEQ ID NO: 234211 - RNA, 22 nt, Homo sapiens
uguagacaccaaagacagcaua

SEQ ID NO: 234212 - RNA, 22 nt, Homo sapiens
uguagacagcacguaguugagu

SEQ ID NO: 234213 - RNA, 18 nt, Homo sapiens
uguagcaccuuucuugug

SEQ ID NO: 234214 - RNA, 16 nt, Homo sapiens
uguauugcuaaaaaga

SEQ ID NO: 234215 - RNA, 22 nt, Homo sapiens
ugucagggaggcucggccgcac

SEQ ID NO: 234216 - RNA, 22 nt, Homo sapiens
ugucauuguggugcagauauaa

SEQ ID NO: 234217 - RNA, 16 nt, Homo sapiens
uguccaaauaaauaca

SEQ ID NO: 234218 - RNA, 22 nt, Homo sapiens
ugucucaguucccuucucugga

SEQ ID NO: 234219 - RNA, 22 nt, Homo sapiens
ugugaagaaagucauugguagc

SEQ ID NO: 234220 - RNA, 22 nt, Homo sapiens
ugugaagaugagaugacgcccu

SEQ ID NO: 234221 - RNA, 19 nt, Homo sapiens
ugugacugggccagccuag

SEQ ID NO: 234222 - RNA, 22 nt, Homo sapiens
ugugcaaucagcuucauuacau

SEQ ID NO: 234223 - RNA, 22 nt, Homo sapiens
ugugcacaaccugcagguuugu

SEQ ID NO: 234224 - RNA, 22 nt, Homo sapiens
ugugcuuguaaaggccagagca

SEQ ID NO: 234225 - RNA, 22 nt, Homo sapiens
uguggaguguaugugacagaga

SEQ ID NO: 234226 - RNA, 22 nt, Homo sapiens
uguggcauuuucagaaaggaug

SEQ ID NO: 234227 - RNA, 22 nt, Homo sapiens
uguggcuuuuucuuggcugagg

SEQ ID NO: 234228 - RNA, 22 nt, Homo sapiens
uguguaaauaugauagaggaau

SEQ ID NO: 234229 - RNA, 22 nt, Homo sapiens
ugugucacugaggguuagugua

SEQ ID NO: 234230 - RNA, 22 nt, Homo sapiens
ugugucuacugagaugaucaug

SEQ ID NO: 234231 - RNA, 22 nt, Homo sapiens
ugugucuuuuaucacacaaugu

SEQ ID NO: 234232 - RNA, 22 nt, Homo sapiens
uguuacacugugcacuaaauuu

SEQ ID NO: 234233 - RNA, 22 nt, Homo sapiens
uguucaugaguucucauuuuua

SEQ ID NO: 234234 - RNA, 19 nt, Homo sapiens
uguugcacauaucaauaug

SEQ ID NO: 234235 - RNA, 18 nt, Homo sapiens
uguugguguucacucacu

SEQ ID NO: 234236 - RNA, 22 nt, Homo sapiens
uguuuuggaguggacuuugcau

SEQ ID NO: 234237 - RNA, 21 nt, Homo sapiens
uguuuuugcuguguaucucuc

SEQ ID NO: 234238 - RNA, 22 nt, Homo sapiens
uuaaagcuggcguuacaguuug

SEQ ID NO: 234239 - RNA, 22 nt, Homo sapiens
uuaagccacucaagagauagag

SEQ ID NO: 234240 - RNA, 22 nt, Homo sapiens
uuaaggaguagugucugguauu

SEQ ID NO: 234241 - RNA, 22 nt, Homo sapiens
uuaauguaauugauugauugac

SEQ ID NO: 234242 - RNA, 22 nt, Homo sapiens
uuaauguaucuaucacaucaca

SEQ ID NO: 234243 - RNA, 22 nt, Homo sapiens
uuacaguaugaguaagaguucu

SEQ ID NO: 234244 - RNA, 23 nt, Homo sapiens
uuacaguggcaugaucucugcuc

SEQ ID NO: 234245 - RNA, 22 nt, Homo sapiens
uuacaguggugaccuuguauug

SEQ ID NO: 234246 - RNA, 22 nt, Homo sapiens
uuacagugguugcuauugugaa

SEQ ID NO: 234247 - RNA, 22 nt, Homo sapiens
uuacauugcuucaaauucagug

SEQ ID NO: 234248 - RNA, 22 nt, Homo sapiens
uuacccauuagagaauuuaaga

SEQ ID NO: 234249 - RNA, 22 nt, Homo sapiens
uuagcacaucuuucuauguaag

SEQ ID NO: 234250 - RNA, 22 nt, Homo sapiens
uugcucaccugagaagaauaga

SEQ ID NO: 234251 - RNA, 22 nt, Homo sapiens
uuggaaaaauccaccuugaucu

SEQ ID NO: 234252 - RNA, 22 nt, Homo sapiens
uuggaauauaaccuguuucuaa

SEQ ID NO: 234253 - RNA, 22 nt, Homo sapiens
uuggaaugcaacagaaggauaa

SEQ ID NO: 234254 - RNA, 22 nt, Homo sapiens
uuggagagucacuaguuagugc

SEQ ID NO: 234255 - RNA, 22 nt, Homo sapiens
uuggagagugauauucagaugc

SEQ ID NO: 234256 - RNA, 22 nt, Homo sapiens
uuggcaaagugucuggcauuua

SEQ ID NO: 234257 - RNA, 22 nt, Homo sapiens
uuggcauugaguuucaaaucau

SEQ ID NO: 234258 - RNA, 22 nt, Homo sapiens
uuggcauuuauucuaaggucaa

SEQ ID NO: 234259 - RNA, 22 nt, Homo sapiens
uuggcauuuuggacacccagga

SEQ ID NO: 234260 - RNA, 22 nt, Homo sapiens
uuggcauuuuuagucaugggaa

SEQ ID NO: 234261 - RNA, 22 nt, Homo sapiens
uuggcuucuggacuauugugca

SEQ ID NO: 234262 - RNA, 22 nt, Homo sapiens
uugguacuacacuucuaaucuu

SEQ ID NO: 234263 - RNA, 22 nt, Homo sapiens
uugguucaguuuaacgaguaau

SEQ ID NO: 234264 - RNA, 22 nt, Homo sapiens
uuguacuccagccugggugaca

SEQ ID NO: 234265 - RNA, 22 nt, Homo sapiens
uuguacuucagacaugccaaag

SEQ ID NO: 234266 - RNA, 22 nt, Homo sapiens
uugugauugagugauccuuguu

SEQ ID NO: 234267 - RNA, 22 nt, Homo sapiens
uugugcacauguacccuagaac

SEQ ID NO: 234268 - RNA, 22 nt, Homo sapiens
uugugguuuuaucuaccuuugg

SEQ ID NO: 234269 - RNA, 22 nt, Homo sapiens
uuguguccccacccaaauuuca

SEQ ID NO: 234270 - RNA, 22 nt, Homo sapiens
uuguucaggagguuggggaugc

SEQ ID NO: 234271 - RNA, 22 nt, Homo sapiens
uuuaaugcgucucugaguuuug

SEQ ID NO: 234272 - RNA, 22 nt, Homo sapiens
uuuagguauuugguauagcagu

SEQ ID NO: 234273 - RNA, 22 nt, Homo sapiens
uuuauccagccucuagcaaggu

SEQ ID NO: 234274 - RNA, 22 nt, Homo sapiens
uuuaucuguuuaaaacuguuca

SEQ ID NO: 234275 - RNA, 22 nt, Homo sapiens
uuucaggcagggagcuucagug

SEQ ID NO: 234276 - RNA, 20 nt, Homo sapiens
uuucaguacuuucuacuggc

SEQ ID NO: 234277 - RNA, 23 nt, Homo sapiens
uuucaguaguuguauccuguugc

SEQ ID NO: 234278 - RNA, 22 nt, Homo sapiens
uuucauggaggauuugcuucuu

SEQ ID NO: 234279 - RNA, 22 nt, Homo sapiens
uuuccaguuggaaagccuguuu

SEQ ID NO: 234280 - RNA, 22 nt, Homo sapiens
uuucugggggugcugauggaaa

SEQ ID NO: 234281 - RNA, 22 nt, Homo sapiens
uuugauguccaccucagcccac

SEQ ID NO: 234282 - RNA, 22 nt, Homo sapiens
uuugauguugauacuaccuuca

SEQ ID NO: 234283 - RNA, 22 nt, Homo sapiens
guuaagaaguguaacuuaaguu

SEQ ID NO: 234284 - RNA, 22 nt, Homo sapiens
guuauguuaaauuguuguaugc

SEQ ID NO: 234285 - RNA, 22 nt, Homo sapiens
guucaucagggacacugguuug

SEQ ID NO: 234286 - RNA, 22 nt, Homo sapiens
guucccaguugaaaugauuagu

SEQ ID NO: 234287 - RNA, 22 nt, Homo sapiens
guucucacuggugcugguaagu

SEQ ID NO: 234288 - RNA, 22 nt, Homo sapiens
guucuggagauaaagccaaggu

SEQ ID NO: 234289 - RNA, 22 nt, Homo sapiens
guuggguaauggggcgcaccgu

SEQ ID NO: 234290 - RNA, 22 nt, Homo sapiens
uaaaagucaucacaacuggagu

SEQ ID NO: 234291 - RNA, 22 nt, Homo sapiens
uaaacacucacuucauagccau

SEQ ID NO: 234292 - RNA, 22 nt, Homo sapiens
uaaacugucuuuggagcuuugc

SEQ ID NO: 234293 - RNA, 22 nt, Homo sapiens
uaaagaugcugggaaggcuagg

SEQ ID NO: 234294 - RNA, 21 nt, Homo sapiens
uaaagcuuagcuauaguggcu

SEQ ID NO: 234295 - RNA, 22 nt, Homo sapiens
uaaaugcuuaauugaaugugga

SEQ ID NO: 234296 - RNA, 22 nt, Homo sapiens
uaaauggauaaaugaauaccua

SEQ ID NO: 234297 - RNA, 22 nt, Homo sapiens
uaaauggauauugccaucuccu

SEQ ID NO: 234298 - RNA, 18 nt, Homo sapiens
uaacagucucucaggauc

SEQ ID NO: 234299 - RNA, 16 nt, Homo sapiens
uaagccccacgugcau

SEQ ID NO: 234300 - RNA, 22 nt, Homo sapiens
uaaggaaggcugugugcuuuua

SEQ ID NO: 234301 - RNA, 22 nt, Homo sapiens
uaaggaguagaauaguaaggca

SEQ ID NO: 234302 - RNA, 22 nt, Homo sapiens
uaaggcacuacuuuaggcuuuc

SEQ ID NO: 234303 - RNA, 22 nt, Homo sapiens
uaaggcacucuucugugugccu

SEQ ID NO: 234304 - RNA, 22 nt, Homo sapiens
uaaggcuugaucuuggugagau

SEQ ID NO: 234305 - RNA, 22 nt, Homo sapiens
uaaguaaaugaaagguugauuu

SEQ ID NO: 234306 - RNA, 23 nt, Homo sapiens
uaaguucaucucuaauaggugga

SEQ ID NO: 234307 - RNA, 22 nt, Homo sapiens
uaauacucuucucauuuuacag

SEQ ID NO: 234308 - RNA, 22 nt, Homo sapiens
uaauagcaguguuacuaggacu

SEQ ID NO: 234309 - RNA, 22 nt, Homo sapiens
uaauaguuucagaaguuguuuu

SEQ ID NO: 234310 - RNA, 22 nt, Homo sapiens
uaauugaaugcagacaccaggg

SEQ ID NO: 234311 - RNA, 22 nt, Homo sapiens
uaauugcaguucuguguuauau

SEQ ID NO: 234312 - RNA, 22 nt, Homo sapiens
uacaaagugggaaacgaagguu

SEQ ID NO: 234313 - RNA, 22 nt, Homo sapiens
uacaagcaggaaaugguauaug

SEQ ID NO: 234314 - RNA, 22 nt, Homo sapiens
uacaccauuugauucuuuaagc

SEQ ID NO: 234315 - RNA, 22 nt, Homo sapiens
uacaccugcacucuagccuggg

SEQ ID NO: 234316 - RNA, 22 nt, Homo sapiens
uacagaguagaagauuugcaga

SEQ ID NO: 234317 - RNA, 22 nt, Homo sapiens
uacagccacauaauguaugauu

SEQ ID NO: 234318 - RNA, 22 nt, Homo sapiens
uacaguccaugcauuauccucc

SEQ ID NO: 234319 - RNA, 22 nt, Homo sapiens
uacaguguuuugguauuccaca

SEQ ID NO: 234320 - RNA, 22 nt, Homo sapiens
uacauccauccugcugggcagu

SEQ ID NO: 234321 - RNA, 22 nt, Homo sapiens
uacauguauguguuuauggcug

SEQ ID NO: 234322 - RNA, 22 nt, Homo sapiens
uaccacaggcuggguaaucuau

SEQ ID NO: 234323 - RNA, 22 nt, Homo sapiens
uaccacccuuuuuccagaagcc

SEQ ID NO: 234324 - RNA, 22 nt, Homo sapiens
uacucagugacugguggaucaa

SEQ ID NO: 234325 - RNA, 22 nt, Homo sapiens
uacugcaucgaaaugcuuuuau

SEQ ID NO: 234326 - RNA, 19 nt, Homo sapiens
uacuggcucgggaauuuuc

SEQ ID NO: 234327 - RNA, 22 nt, Homo sapiens
uacuguacugcaguucugcaaa

SEQ ID NO: 234328 - RNA, 22 nt, Homo sapiens
uagaauguaaauuccaagggca

SEQ ID NO: 234329 - RNA, 22 nt, Homo sapiens
uagaauguaacuuccaugucau

SEQ ID NO: 234330 - RNA, 23 nt, Homo sapiens
uagaauguuuuuccauguuucuu

SEQ ID NO: 234331 - RNA, 22 nt, Homo sapiens
uagauaguaaagccauuagcuu

SEQ ID NO: 234332 - RNA, 22 nt, Homo sapiens
uagaucauauucagugcuuacu

SEQ ID NO: 234333 - RNA, 23 nt, Homo sapiens
uuuugcaauaagucacuggaaua

SEQ ID NO: 234334 - RNA, 22 nt, Homo sapiens
uuuugcaccauccuaauaguau

SEQ ID NO: 234335 - RNA, 22 nt, Homo sapiens
uuuugcaggcauuggaaguuua

SEQ ID NO: 234336 - RNA, 22 nt, Homo sapiens
uuuugcuugugaauagccacau

SEQ ID NO: 234337 - RNA, 17 nt, Homo sapiens
uuuuggauuagaaaucc

SEQ ID NO: 234338 - RNA, 22 nt, Homo sapiens
uuuuugagaauuggugaaacac

SEQ ID NO: 234339 - RNA, 22 nt, Homo sapiens
uuuuuggaggagguuagaucau

SEQ ID NO: 234340 - RNA, 22 nt, Homo sapiens
uuuuuuaguuagcugggcauga

SEQ ID NO: 234341 - RNA, 22 nt, Homo sapiens
aucuguagauucagcacaagcu

SEQ ID NO: 234342 - RNA, 22 nt, Homo sapiens
aucugugguuguaugcauauua

SEQ ID NO: 234343 - RNA, 22 nt, Homo sapiens
aucuguguuuaaggucccagaa

SEQ ID NO: 234344 - RNA, 22 nt, Homo sapiens
aucuuuaguggcuguuuucaga

SEQ ID NO: 234345 - RNA, 22 nt, Homo sapiens
augaaacuggcuaauuuuugua

SEQ ID NO: 234346 - RNA, 22 nt, Homo sapiens
augaaagguugucuuaagccau

SEQ ID NO: 234347 - RNA, 22 nt, Homo sapiens
augaaaugcauguuaaguccgu

SEQ ID NO: 234348 - RNA, 22 nt, Homo sapiens
augaaauugcuaucgcaguacu

SEQ ID NO: 234349 - RNA, 22 nt, Homo sapiens
augaagagaaaguggaucuugg

SEQ ID NO: 234350 - RNA, 22 nt, Homo sapiens
augaagcuagcugauugcugau

SEQ ID NO: 234351 - RNA, 20 nt, Homo sapiens
augaaggcaggugugaguuu

SEQ ID NO: 234352 - RNA, 20 nt, Homo sapiens
augaagugaaguuagggaac

SEQ ID NO: 234353 - RNA, 20 nt, Homo sapiens
augaauguccuugauggcau

SEQ ID NO: 234354 - RNA, 22 nt, Homo sapiens
augaccaaugggcagagcuaga

SEQ ID NO: 234355 - RNA, 22 nt, Homo sapiens
augaccagagguaugauguuug

SEQ ID NO: 234356 - RNA, 22 nt, Homo sapiens
augaccuuguccucagugucau

SEQ ID NO: 234357 - RNA, 17 nt, Homo sapiens
augacuucuucagugug

SEQ ID NO: 234358 - RNA, 22 nt, Homo sapiens
augacuuuucugaaaaccacca

SEQ ID NO: 234359 - RNA, 22 nt, Homo sapiens
augagagugagagcagccccuu

SEQ ID NO: 234360 - RNA, 22 nt, Homo sapiens
augagauauguuaaaaguuaaa

SEQ ID NO: 234361 - RNA, 22 nt, Homo sapiens
augagauucuuagagaagucug

SEQ ID NO: 234362 - RNA, 22 nt, Homo sapiens
augagcaucaccagaaucaaua

SEQ ID NO: 234363 - RNA, 17 nt, Homo sapiens
augagcucaucauuuuu

SEQ ID NO: 234364 - RNA, 22 nt, Homo sapiens
augaggcacugcgcccuacuga

SEQ ID NO: 234365 - RNA, 22 nt, Homo sapiens
augagguaauaaguccuuggaa

SEQ ID NO: 234366 - RNA, 22 nt, Homo sapiens
augagguauccaagcccagaaa

SEQ ID NO: 234367 - RNA, 23 nt, Homo sapiens
augagguaucugagcccagaaau

SEQ ID NO: 234368 - RNA, 22 nt, Homo sapiens
augauaaguuauuagaagaaga

SEQ ID NO: 234369 - RNA, 22 nt, Homo sapiens
augaucaucugaaagcuuuuac

SEQ ID NO: 234370 - RNA, 22 nt, Homo sapiens
augaucuguagaacuaguccuu

SEQ ID NO: 234371 - RNA, 22 nt, Homo sapiens
augaugaaguaagugcuuagga

SEQ ID NO: 234372 - RNA, 22 nt, Homo sapiens
augauugugaauaugugguuuu

SEQ ID NO: 234373 - RNA, 22 nt, Homo sapiens
augauuuuuguaucgccugaug

SEQ ID NO: 234374 - RNA, 22 nt, Homo sapiens
augcaauucuagauugauagua

SEQ ID NO: 234375 - RNA, 22 nt, Homo sapiens
augccacugcacuccaaccugg

SEQ ID NO: 234376 - RNA, 22 nt, Homo sapiens
augccacugcacuucagcuugg

SEQ ID NO: 234377 - RNA, 22 nt, Homo sapiens
augccacugcgcucuagccugg

SEQ ID NO: 234378 - RNA, 22 nt, Homo sapiens
augccacuguuuaugucacuua

SEQ ID NO: 234379 - RNA, 22 nt, Homo sapiens
augccagggagaauuguucaag

SEQ ID NO: 234380 - RNA, 22 nt, Homo sapiens
augcuguuuuguagcucccucu

SEQ ID NO: 234381 - RNA, 22 nt, Homo sapiens
auggaaacauaagaguauagau

SEQ ID NO: 234382 - RNA, 22 nt, Homo sapiens
auggaagcauaguauucuauug

SEQ ID NO: 234383 - RNA, 22 nt, Homo sapiens
auggaaugccauuuauaaugga

SEQ ID NO: 234384 - RNA, 22 nt, Homo sapiens
auggcacugauggaaguaccuu

SEQ ID NO: 234385 - RNA, 22 nt, Homo sapiens
auggcauuuuuagggcugggug

SEQ ID NO: 234386 - RNA, 22 nt, Homo sapiens
auggcccccuguuugugaacau

SEQ ID NO: 234387 - RNA, 22 nt, Homo sapiens
auggcccuguguggagcugcug

SEQ ID NO: 234388 - RNA, 22 nt, Homo sapiens
auggcucaauucuuucccugaa

SEQ ID NO: 234389 - RNA, 22 nt, Homo sapiens
auggcuguuucugcaaugucua

SEQ ID NO: 234390 - RNA, 22 nt, Homo sapiens
auggcuuuggucucccagugau

SEQ ID NO: 234391 - RNA, 22 nt, Homo sapiens
augguauggaaggucuggagga

SEQ ID NO: 234392 - RNA, 22 nt, Homo sapiens
auggucccuguuccaugcuccu

SEQ ID NO: 234393 - RNA, 21 nt, Homo sapiens
auggugagaaaguagugucaa

SEQ ID NO: 234394 - RNA, 22 nt, Homo sapiens
auguaaacauuuggucuaaauu

SEQ ID NO: 234395 - RNA, 22 nt, Homo sapiens
auguaacuaucugagccauggg

SEQ ID NO: 234396 - RNA, 22 nt, Homo sapiens
auguaguagauauuuauggaaa

SEQ ID NO: 234397 - RNA, 22 nt, Homo sapiens
auguagugugauuuucacuaga

SEQ ID NO: 234398 - RNA, 20 nt, Homo sapiens
augucaggaagggagucagg

SEQ ID NO: 234399 - RNA, 22 nt, Homo sapiens
augugacagcaacccccagccc

SEQ ID NO: 234400 - RNA, 22 nt, Homo sapiens
augugcaaagcacuguucagca

SEQ ID NO: 234401 - RNA, 18 nt, Homo sapiens
augugcaauuuuguauuu

SEQ ID NO: 234402 - RNA, 22 nt, Homo sapiens
augugcauaugaagcacagaca

SEQ ID NO: 234403 - RNA, 22 nt, Homo sapiens
auguggcuuuccuagaucuuag

SEQ ID NO: 234404 - RNA, 22 nt, Homo sapiens
augugucaaaucuaggccaaag

SEQ ID NO: 234405 - RNA, 22 nt, Homo sapiens
auguuagcaucaauauucauca

SEQ ID NO: 234406 - RNA, 22 nt, Homo sapiens
auguuauguuaaugauaaugga

SEQ ID NO: 234407 - RNA, 22 nt, Homo sapiens
auguuauguucuucucuguaua

SEQ ID NO: 234408 - RNA, 22 nt, Homo sapiens
auuaacaucuagaguuuuggug

SEQ ID NO: 234409 - RNA, 22 nt, Homo sapiens
auuaaguaaugguuccaauaau

SEQ ID NO: 234410 - RNA, 22 nt, Homo sapiens
auuaaguuaggauuuugagaua

SEQ ID NO: 234411 - RNA, 21 nt, Homo sapiens
auuaaugcucugguuagaggc

SEQ ID NO: 234412 - RNA, 22 nt, Homo sapiens
auuauuaguuguugaaugaagu

SEQ ID NO: 234413 - RNA, 22 nt, Homo sapiens
auuccacaguuaacacagaccg

SEQ ID NO: 234414 - RNA, 22 nt, Homo sapiens
auuccacuuacaugaaguaccu

SEQ ID NO: 234415 - RNA, 22 nt, Homo sapiens
auugcaaugggaaacuaugaaa

SEQ ID NO: 234416 - RNA, 22 nt, Homo sapiens
ggagcuuugaaaguuuccgguu

SEQ ID NO: 234417 - RNA, 22 nt, Homo sapiens
ggagucugaacuggacaaugac

SEQ ID NO: 234418 - RNA, 22 nt, Homo sapiens
ggaguguguaggagaaagguaa

SEQ ID NO: 234419 - RNA, 22 nt, Homo sapiens
ggauggcauuucuuuagcuuuu

SEQ ID NO: 234420 - RNA, 22 nt, Homo sapiens
ggcaaaaucgcaauuacuuuug

SEQ ID NO: 234421 - RNA, 22 nt, Homo sapiens
ggcaagugucagcagcaacacc

SEQ ID NO: 234422 - RNA, 22 nt, Homo sapiens
ggcacaauugcagcaauaaaca

SEQ ID NO: 234423 - RNA, 22 nt, Homo sapiens
ggcaccauuuuacuccuucccu

SEQ ID NO: 234424 - RNA, 22 nt, Homo sapiens
ggcagcucaggccccgcgcuga

SEQ ID NO: 234425 - RNA, 21 nt, Homo sapiens
ggcucuguggucucagguuuc

SEQ ID NO: 234426 - RNA, 22 nt, Homo sapiens
ggcuuuggucacacaggggcaa

SEQ ID NO: 234427 - RNA, 22 nt, Homo sapiens
gggaagugugcagaguucucuu

SEQ ID NO: 234428 - RNA, 22 nt, Homo sapiens
gggaagugugguuucuuuacag

SEQ ID NO: 234429 - RNA, 22 nt, Homo sapiens
gggaaugaagagaaccuuccca

SEQ ID NO: 234430 - RNA, 22 nt, Homo sapiens
gggaugaagcccuaggguuggu

SEQ ID NO: 234431 - RNA, 22 nt, Homo sapiens
ggggcaaaaugccacgagucuc

SEQ ID NO: 234432 - RNA, 22 nt, Homo sapiens
gggggagugugguacccagcau

SEQ ID NO: 234433 - RNA, 22 nt, Homo sapiens
gggugguuuuaucucuucccuu

SEQ ID NO: 234434 - RNA, 22 nt, Homo sapiens
ggucauagagaauucaccagga

SEQ ID NO: 234435 - RNA, 22 nt, Homo sapiens
ggucuuggagaauuguccuggg

SEQ ID NO: 234436 - RNA, 22 nt, Homo sapiens
ggugagaaaaacauagucucag

SEQ ID NO: 234437 - RNA, 22 nt, Homo sapiens
cugcaagaaucguaguauuuga

SEQ ID NO: 234438 - RNA, 22 nt, Homo sapiens
cugcaauggagaaagugagacu

SEQ ID NO: 234439 - RNA, 21 nt, Homo sapiens
cugcauccauuucugagugau

SEQ ID NO: 234440 - RNA, 22 nt, Homo sapiens
cugcauuugaugacguauggug

SEQ ID NO: 234441 - RNA, 22 nt, Homo sapiens
cuggagcaaaggugacucuugu

SEQ ID NO: 234442 - RNA, 22 nt, Homo sapiens
cuggcaaauaguagagccagga

SEQ ID NO: 234443 - RNA, 22 nt, Homo sapiens
cuggcgagacagcuccaucacu

SEQ ID NO: 234444 - RNA, 22 nt, Homo sapiens
cuggcugagugguaaguagagg

SEQ ID NO: 234445 - RNA, 22 nt, Homo sapiens
cuguccugcagagucagaauga

SEQ ID NO: 234446 - RNA, 22 nt, Homo sapiens
cugucucagccucuccaguagc

SEQ ID NO: 234447 - RNA, 22 nt, Homo sapiens
cugugcaaagcgcucucggggu

SEQ ID NO: 234448 - RNA, 22 nt, Homo sapiens
cugugguguaacucuuggggcg

SEQ ID NO: 234449 - RNA, 22 nt, Homo sapiens
cugugguuuaaggaauuuugac

SEQ ID NO: 234450 - RNA, 22 nt, Homo sapiens
cuguuugaggguuugcuuucag

SEQ ID NO: 234451 - RNA, 22 nt, Homo sapiens
cuguuuguuuaggguacucaga

SEQ ID NO: 234452 - RNA, 22 nt, Homo sapiens
cuucaugggagaaccacaggua

SEQ ID NO: 234453 - RNA, 22 nt, Homo sapiens
cuugaauguaaauaauguacag

SEQ ID NO: 234454 - RNA, 20 nt, Homo sapiens
cuuggcuuucuugguguuaa

SEQ ID NO: 234455 - RNA, 21 nt, Homo sapiens
cuugucuugcuuagaauagac

SEQ ID NO: 234456 - RNA, 23 nt, Homo sapiens
cuuuguacagcuugacuacuggg

SEQ ID NO: 234457 - RNA, 22 nt, Homo sapiens
auccauugcucaagagaaguca

SEQ ID NO: 234458 - RNA, 22 nt, Homo sapiens
auccucugagaucuaggcagag

SEQ ID NO: 234459 - RNA, 22 nt, Homo sapiens
auccuugagaaaauaaaugacc

SEQ ID NO: 234460 - RNA, 22 nt, Homo sapiens
aucuagagaggcagucuggccg

SEQ ID NO: 234461 - RNA, 22 nt, Homo sapiens
augaauacugcugcaaugaaca

SEQ ID NO: 234462 - RNA, 22 nt, Homo sapiens
augacaagagccuucuuuccuu

SEQ ID NO: 234463 - RNA, 22 nt, Homo sapiens
augaccuuggggaaccaugucu

SEQ ID NO: 234464 - RNA, 18 nt, Homo sapiens
augacucuggguguuccu

SEQ ID NO: 234465 - RNA, 22 nt, Homo sapiens
augagaaugauucuguuauggu

SEQ ID NO: 234466 - RNA, 22 nt, Homo sapiens
augagaauguaaguuaaugaaa

SEQ ID NO: 234467 - RNA, 22 nt, Homo sapiens
augagagcuaacuguggguaca

SEQ ID NO: 234468 - RNA, 22 nt, Homo sapiens
augagcugauuuccuuaccaua

SEQ ID NO: 234469 - RNA, 22 nt, Homo sapiens
augagggaagcucacgugucca

SEQ ID NO: 234470 - RNA, 22 nt, Homo sapiens
augagggagggcaccugaccuu

SEQ ID NO: 234471 - RNA, 22 nt, Homo sapiens
augagugugaccugccaagaga

SEQ ID NO: 234472 - RNA, 22 nt, Homo sapiens
augaucauggaaguuuuccugu

SEQ ID NO: 234473 - RNA, 22 nt, Homo sapiens
augcacauggcuaacuuuuuuc

SEQ ID NO: 234474 - RNA, 22 nt, Homo sapiens
augcagagaaaucuaaaauaug

SEQ ID NO: 234475 - RNA, 19 nt, Homo sapiens
augccacagugaggucaga

SEQ ID NO: 234476 - RNA, 22 nt, Homo sapiens
augccacugcacuucagccugg

SEQ ID NO: 234477 - RNA, 22 nt, Homo sapiens
augccacuguacucuagccuag

SEQ ID NO: 234478 - RNA, 22 nt, Homo sapiens
augccacuguccuccugccuag

SEQ ID NO: 234479 - RNA, 22 nt, Homo sapiens
augccacuucucuaagucaugu

SEQ ID NO: 234480 - RNA, 22 nt, Homo sapiens
augcuacauucuacaauuaggc

SEQ ID NO: 234481 - RNA, 22 nt, Homo sapiens
auggaagaaaguuggguucuug

SEQ ID NO: 234482 - RNA, 22 nt, Homo sapiens
auggaagcugauuagauaguac

SEQ ID NO: 234483 - RNA, 22 nt, Homo sapiens
auggaaugguugggucauaagg

SEQ ID NO: 234484 - RNA, 22 nt, Homo sapiens
auggagaugaacuuggguaaag

SEQ ID NO: 234485 - RNA, 22 nt, Homo sapiens
auggaucuuucugcuuuugaau

SEQ ID NO: 234486 - RNA, 22 nt, Homo sapiens
auggcaaaaaaugcaauuacuu

SEQ ID NO: 234487 - RNA, 22 nt, Homo sapiens
auggcacugccuggcuucaugg

SEQ ID NO: 234488 - RNA, 22 nt, Homo sapiens
auggcagugucuagggguguuu

SEQ ID NO: 234489 - RNA, 22 nt, Homo sapiens
auggcaucgucaccuuuucagu

SEQ ID NO: 234490 - RNA, 22 nt, Homo sapiens
auggccuaugaccguuauguug

SEQ ID NO: 234491 - RNA, 22 nt, Homo sapiens
auggcguguggcuuggaggcug

SEQ ID NO: 234492 - RNA, 22 nt, Homo sapiens
auggcugagugauuucaaacag

SEQ ID NO: 234493 - RNA, 22 nt, Homo sapiens
auggcuuuuccugucuugcaug

SEQ ID NO: 234494 - RNA, 22 nt, Homo sapiens
augggagugugguuagagaccu

SEQ ID NO: 234495 - RNA, 22 nt, Homo sapiens
augguauuuaacagucuuucua

SEQ ID NO: 234496 - RNA, 22 nt, Homo sapiens
augguugguuaaaucuguguau

SEQ ID NO: 234497 - RNA, 22 nt, Homo sapiens
auguaacacagugcggcugggc

SEQ ID NO: 234498 - RNA, 21 nt, Homo sapiens
auguaaugaagaagccacugg

SEQ ID NO: 234499 - RNA, 20 nt, Homo sapiens
auguaauguaugauauguac

SEQ ID NO: 234500 - RNA, 22 nt, Homo sapiens
auguaguauuaaugagagauaa

SEQ ID NO: 234501 - RNA, 22 nt, Homo sapiens
augucaacauagacaguagagu

SEQ ID NO: 234502 - RNA, 22 nt, Homo sapiens
auuaaggaguggguucauggug

SEQ ID NO: 234503 - RNA, 22 nt, Homo sapiens
auuacacuuucuauucaaugag

SEQ ID NO: 234504 - RNA, 22 nt, Homo sapiens
auuagguauuuucuggacaggg

SEQ ID NO: 234505 - RNA, 22 nt, Homo sapiens
auuagguuggugcaaaaguaau

SEQ ID NO: 234506 - RNA, 22 nt, Homo sapiens
auuauauguguaugugcauacc

SEQ ID NO: 234507 - RNA, 22 nt, Homo sapiens
auuauuagucggccagcuguua

SEQ ID NO: 234508 - RNA, 22 nt, Homo sapiens
auucaaagugcauguucccacu

SEQ ID NO: 234509 - RNA, 22 nt, Homo sapiens
auucagaggggcagcugucuug

SEQ ID NO: 234510 - RNA, 22 nt, Homo sapiens
auucaucagggauacuggccug

SEQ ID NO: 234511 - RNA, 22 nt, Homo sapiens
auucaucagggauauuggucug

SEQ ID NO: 234512 - RNA, 22 nt, Homo sapiens
auugaaucuaaaaugagucucu

SEQ ID NO: 234513 - RNA, 19 nt, Homo sapiens
auugauuaaguuugcuguc

SEQ ID NO: 234514 - RNA, 22 nt, Homo sapiens
auugcaaagcguagacucuaaa

SEQ ID NO: 234515 - RNA, 22 nt, Homo sapiens
auugcacaaagagggaaacuga

SEQ ID NO: 234516 - RNA, 22 nt, Homo sapiens
auugcacacagaaucaggguaa

SEQ ID NO: 234517 - RNA, 18 nt, Homo sapiens
auugcacaccagccuggg

SEQ ID NO: 234518 - RNA, 23 nt, Homo sapiens
auugcagaaucacagagguagug

SEQ ID NO: 234519 - RNA, 20 nt, Homo sapiens
auugcagcaugauuuauaau

SEQ ID NO: 234520 - RNA, 19 nt, Homo sapiens
auugcaguguaaaacuauu

SEQ ID NO: 234521 - RNA, 22 nt, Homo sapiens
auugcauaaacacauuucuuau

SEQ ID NO: 234522 - RNA, 22 nt, Homo sapiens
auugccacaucucagaggcaga

SEQ ID NO: 234523 - RNA, 22 nt, Homo sapiens
auuggaguuguacgcacgcuca

SEQ ID NO: 234524 - RNA, 22 nt, Homo sapiens
auuguacuagguccuagggcuu

SEQ ID NO: 234525 - RNA, 22 nt, Homo sapiens
auuguacuccagccugggcagc

SEQ ID NO: 234526 - RNA, 22 nt, Homo sapiens
auuguacuccagccugggugac

SEQ ID NO: 234527 - RNA, 22 nt, Homo sapiens
aauuggugaccaagggaaggac

SEQ ID NO: 234528 - RNA, 22 nt, Homo sapiens
acaaaguauggaauguuggugu

SEQ ID NO: 234529 - RNA, 22 nt, Homo sapiens
acacuauugagguuuguuugca

SEQ ID NO: 234530 - RNA, 22 nt, Homo sapiens
acacucucucauuacuuguuug

SEQ ID NO: 234531 - RNA, 22 nt, Homo sapiens
acacuguuggugggaguguaaa

SEQ ID NO: 234532 - RNA, 20 nt, Homo sapiens
acagcauagccuuuuaaagc

SEQ ID NO: 234533 - RNA, 22 nt, Homo sapiens
acagugacagaaagcugauuau

SEQ ID NO: 234534 - RNA, 22 nt, Homo sapiens
acaguguuacuugauaguguau

SEQ ID NO: 234535 - RNA, 22 nt, Homo sapiens
acaguguuccuuuguugugacu

SEQ ID NO: 234536 - RNA, 22 nt, Homo sapiens
acauacacuagggauguggugu

SEQ ID NO: 234537 - RNA, 22 nt, Homo sapiens
acauaguagacacugaaaauau

SEQ ID NO: 234538 - RNA, 22 nt, Homo sapiens
acaugcauccaugugaagagac

SEQ ID NO: 234539 - RNA, 22 nt, Homo sapiens
acauguauauaaugcauagcga

SEQ ID NO: 234540 - RNA, 22 nt, Homo sapiens
acauucagcuguuguuucaaug

SEQ ID NO: 234541 - RNA, 22 nt, Homo sapiens
acccuguaggacuauucuaauc

SEQ ID NO: 234542 - RNA, 22 nt, Homo sapiens
acuccauuucauuuuagcucuu

SEQ ID NO: 234543 - RNA, 22 nt, Homo sapiens
acugacaugaucaggcauguuc

SEQ ID NO: 234544 - RNA, 22 nt, Homo sapiens
acugagaucuuuaaauaaauaa

SEQ ID NO: 234545 - RNA, 23 nt, Homo sapiens
acugcaauuacguuugcaccaac

SEQ ID NO: 234546 - RNA, 22 nt, Homo sapiens
acugcacuccagccuuggagac

SEQ ID NO: 234547 - RNA, 22 nt, Homo sapiens
acugcauuugucugucucaauu

SEQ ID NO: 234548 - RNA, 22 nt, Homo sapiens
acuggaguuuguucaagaaaua

SEQ ID NO: 234549 - RNA, 22 nt, Homo sapiens
acuggcuguuaggaauuaccuc

SEQ ID NO: 234550 - RNA, 20 nt, Homo sapiens
acugggcuaccgaaguaagg

SEQ ID NO: 234551 - RNA, 22 nt, Homo sapiens
acuguguguuugucuagcacag

SEQ ID NO: 234552 - RNA, 23 nt, Homo sapiens
agaaaugucuauucagggucccu

SEQ ID NO: 234553 - RNA, 22 nt, Homo sapiens
agaauguaaacagaauagagga

SEQ ID NO: 234554 - RNA, 22 nt, Homo sapiens
agaauguauauucuguaguugu

SEQ ID NO: 234555 - RNA, 21 nt, Homo sapiens
agacacuuggaagguuuuaga

SEQ ID NO: 234556 - RNA, 22 nt, Homo sapiens
agacaguguguguauauauggu

SEQ ID NO: 234557 - RNA, 22 nt, Homo sapiens
agaugauguuucuggcacauga

SEQ ID NO: 234558 - RNA, 22 nt, Homo sapiens
agaugccuaugaagagaaauua

SEQ ID NO: 234559 - RNA, 22 nt, Homo sapiens
agcaacauuguucauaauagcu

SEQ ID NO: 234560 - RNA, 22 nt, Homo sapiens
agcagauguuuagugagcgccu

SEQ ID NO: 234561 - RNA, 22 nt, Homo sapiens
agcagcacaucccuuucuggcc

SEQ ID NO: 234562 - RNA, 22 nt, Homo sapiens
agcagguguccacaauguuugc

SEQ ID NO: 234563 - RNA, 17 nt, Homo sapiens
agcauguguuugagauu

SEQ ID NO: 234564 - RNA, 22 nt, Homo sapiens
agcauuacaugguacagagaag

SEQ ID NO: 234565 - RNA, 22 nt, Homo sapiens
agccuguagugagcugugauug

SEQ ID NO: 234566 - RNA, 22 nt, Homo sapiens
agcggcuguuccccuggucuau

SEQ ID NO: 234567 - RNA, 22 nt, Homo sapiens
agcuccaucuucagggguucag

SEQ ID NO: 234568 - RNA, 22 nt, Homo sapiens
agcuccuuucugcaggcagguc

SEQ ID NO: 234569 - RNA, 22 nt, Homo sapiens
agcugcaaagggagagaugauu

SEQ ID NO: 234570 - RNA, 22 nt, Homo sapiens
agcugccagucuuguaaggccu

SEQ ID NO: 234571 - RNA, 22 nt, Homo sapiens
agcugguauuuguuagggaguu

SEQ ID NO: 234572 - RNA, 22 nt, Homo sapiens
agcugguuuauuucucacaaca

SEQ ID NO: 234573 - RNA, 22 nt, Homo sapiens
agcuguuguacacuuuaccuuu

SEQ ID NO: 234574 - RNA, 20 nt, Homo sapiens
agcuguuguuaugagguuua

SEQ ID NO: 234575 - RNA, 22 nt, Homo sapiens
agcuucauucugaauagguuga

SEQ ID NO: 234576 - RNA, 22 nt, Homo sapiens
aggaaucuaagguaucagguua

SEQ ID NO: 234577 - RNA, 22 nt, Homo sapiens
aggagguagggugugaaacagc

SEQ ID NO: 234578 - RNA, 22 nt, Homo sapiens
aggaucauugacuauuauaagg

SEQ ID NO: 234579 - RNA, 21 nt, Homo sapiens
aggcaaaugaagcagccgcuc

SEQ ID NO: 234580 - RNA, 22 nt, Homo sapiens
aggcaugaguucagaggguaug

SEQ ID NO: 234581 - RNA, 22 nt, Homo sapiens
agggaagugugcuaugcauuua

SEQ ID NO: 234582 - RNA, 21 nt, Homo sapiens
aggucaugaagauguucuaau

SEQ ID NO: 234583 - RNA, 22 nt, Homo sapiens
aggucccauguccucccugacc

SEQ ID NO: 234584 - RNA, 22 nt, Homo sapiens
aggugacugguuuaucuggcag

SEQ ID NO: 234585 - RNA, 22 nt, Homo sapiens
aggugcugacaggauagguuuc

SEQ ID NO: 234586 - RNA, 22 nt, Homo sapiens
agguucccuuuuggccugggau

SEQ ID NO: 234587 - RNA, 22 nt, Homo sapiens
aguacacuguuaaaaagaagug

SEQ ID NO: 234588 - RNA, 23 nt, Homo sapiens
aguacuguaguaauugaggggaa

SEQ ID NO: 234589 - RNA, 22 nt, Homo sapiens
aguccagguuuuguaauggcaa

SEQ ID NO: 234590 - RNA, 22 nt, Homo sapiens
agugaauguuggaaaguuauuu

SEQ ID NO: 234591 - RNA, 22 nt, Homo sapiens
agugcaaagccgagguuucuug

SEQ ID NO: 234592 - RNA, 22 nt, Homo sapiens
agugcaauaaggauguagaacu

SEQ ID NO: 234593 - RNA, 22 nt, Homo sapiens
agugcaguugucacgugccuuc

SEQ ID NO: 234594 - RNA, 22 nt, Homo sapiens
agugguuuuggaauggaauuca

SEQ ID NO: 234595 - RNA, 22 nt, Homo sapiens
auaaagcuauuccucucuuuuu

SEQ ID NO: 234596 - RNA, 22 nt, Homo sapiens
auaaagguaagcacuauccuga

SEQ ID NO: 234597 - RNA, 22 nt, Homo sapiens
auaaaugccuguuguuuuaagc

SEQ ID NO: 234598 - RNA, 22 nt, Homo sapiens
auaaaugcuuagaucuguauau

SEQ ID NO: 234599 - RNA, 22 nt, Homo sapiens
auaaaugcuuccagucauuaaa

SEQ ID NO: 234600 - RNA, 22 nt, Homo sapiens
auaacucuguuuuuuucaugca

SEQ ID NO: 234601 - RNA, 22 nt, Homo sapiens
auaagauaguggaagugggauu

SEQ ID NO: 234602 - RNA, 22 nt, Homo sapiens
auaagaucauuugcuaagaggg

SEQ ID NO: 234603 - RNA, 22 nt, Homo sapiens
auaauguuugauugagcagaua

SEQ ID NO: 234604 - RNA, 22 nt, Homo sapiens
auacaagcaguccaacuccaua

SEQ ID NO: 234605 - RNA, 19 nt, Homo sapiens
auacacguguauacauaca

SEQ ID NO: 234606 - RNA, 22 nt, Homo sapiens
auacaugugccauggugguuug

SEQ ID NO: 234607 - RNA, 22 nt, Homo sapiens
auacuguauaggauuguagccu

SEQ ID NO: 234608 - RNA, 22 nt, Homo sapiens
auacuguuuuacaucauugccu

SEQ ID NO: 234609 - RNA, 22 nt, Homo sapiens
auagcaggagaauggucauggg

SEQ ID NO: 234610 - RNA, 20 nt, Homo sapiens
auagcauugauggacucaaa

SEQ ID NO: 234611 - RNA, 22 nt, Homo sapiens
auagguagcauagcaggaauau

SEQ ID NO: 234612 - RNA, 22 nt, Homo sapiens
auaugacuuuccucuacuuccu

SEQ ID NO: 234613 - RNA, 22 nt, Homo sapiens
auaugcaaauccauagagacag

SEQ ID NO: 234614 - RNA, 22 nt, Homo sapiens
auaugucuauuauuagggcagg

SEQ ID NO: 234615 - RNA, 22 nt, Homo sapiens
auaugucuguuuagucuguaau

SEQ ID NO: 234616 - RNA, 22 nt, Homo sapiens
cuggaauguuccuaaagauuca

SEQ ID NO: 234617 - RNA, 22 nt, Homo sapiens
cuggaauucaaaaucugaauuu

SEQ ID NO: 234618 - RNA, 22 nt, Homo sapiens
cuggagaucuugacauugaagu

SEQ ID NO: 234619 - RNA, 22 nt, Homo sapiens
cuggagucugacugacacaagg

SEQ ID NO: 234620 - RNA, 22 nt, Homo sapiens
cuggauagagauugaugaugcu

SEQ ID NO: 234621 - RNA, 20 nt, Homo sapiens
cuggaugucgaggcagaggu

SEQ ID NO: 234622 - RNA, 18 nt, Homo sapiens
cuggaugucgaguguguu

SEQ ID NO: 234623 - RNA, 22 nt, Homo sapiens
cuggcuaagugcuugagugugc

SEQ ID NO: 234624 - RNA, 22 nt, Homo sapiens
cuguaaagaucacagagcuggu

SEQ ID NO: 234625 - RNA, 22 nt, Homo sapiens
cuguacucaucccauaugcacu

SEQ ID NO: 234626 - RNA, 22 nt, Homo sapiens
cuguaugugagaaauaauaagu

SEQ ID NO: 234627 - RNA, 22 nt, Homo sapiens
cugugaucuuuuuucauguggu

SEQ ID NO: 234628 - RNA, 22 nt, Homo sapiens
cuguggauguauugcacagucu

SEQ ID NO: 234629 - RNA, 19 nt, Homo sapiens
cuguggucauuauuuugcu

SEQ ID NO: 234630 - RNA, 23 nt, Homo sapiens
cuguggugaggcccuagaaucug

SEQ ID NO: 234631 - RNA, 22 nt, Homo sapiens
cugugguuacguucuuugugcu

SEQ ID NO: 234632 - RNA, 22 nt, Homo sapiens
cuucaguucuguaaggacagca

SEQ ID NO: 234633 - RNA, 22 nt, Homo sapiens
cuucucagugcucaucuuauuu

SEQ ID NO: 234634 - RNA, 22 nt, Homo sapiens
cuuggcuucuuuauguggcuau

SEQ ID NO: 234635 - RNA, 22 nt, Homo sapiens
cuuuacacauccuaaccagugu

SEQ ID NO: 234636 - RNA, 22 nt, Homo sapiens
cuuuacaguuggacucacgagg

SEQ ID NO: 234637 - RNA, 22 nt, Homo sapiens
cuuucucagugagacccgagau

SEQ ID NO: 234638 - RNA, 21 nt, Homo sapiens
cuuugcacugcuccucagcuc

SEQ ID NO: 234639 - RNA, 22 nt, Homo sapiens
cuuuggccauagcuaaaugauu

SEQ ID NO: 234640 - RNA, 23 nt, Homo sapiens
cuuuguccccacccaaaucucau

SEQ ID NO: 234641 - RNA, 22 nt, Homo sapiens
cuuuguccuucaagguguguca

SEQ ID NO: 234642 - RNA, 22 nt, Homo sapiens
cuuuuggcuuaagauugucuug

SEQ ID NO: 234643 - RNA, 22 nt, Homo sapiens
cuuuuggucuaucagagaagca

SEQ ID NO: 234644 - RNA, 21 nt, Homo sapiens
cuuuuuacucguucauaugca

SEQ ID NO: 234645 - RNA, 20 nt, Homo sapiens
gaaacaucuauccucuccuu

SEQ ID NO: 234646 - RNA, 22 nt, Homo sapiens
gaaagugcugcuugacugggau

SEQ ID NO: 234647 - RNA, 22 nt, Homo sapiens
gaaccagcagacuuugacaggu

SEQ ID NO: 234648 - RNA, 20 nt, Homo sapiens
gaacugguguauguuuaacu

SEQ ID NO: 234649 - RNA, 22 nt, Homo sapiens
gaagaucacacuguagaucuau

SEQ ID NO: 234650 - RNA, 22 nt, Homo sapiens
gaagcauugauccacaggcgug

SEQ ID NO: 234651 - RNA, 22 nt, Homo sapiens
gaaucccuugcauuaucccuuu

SEQ ID NO: 234652 - RNA, 22 nt, Homo sapiens
gaaugauacuguuaacgaaaga

SEQ ID NO: 234653 - RNA, 22 nt, Homo sapiens
gaaugcaugaggggaucagaug

SEQ ID NO: 234654 - RNA, 22 nt, Homo sapiens
gaauggaacugacuauagcuga

SEQ ID NO: 234655 - RNA, 22 nt, Homo sapiens
gacauuaucagguuuguuuucu

SEQ ID NO: 234656 - RNA, 22 nt, Homo sapiens
gacugaggaagcgcucucuccu

SEQ ID NO: 234657 - RNA, 22 nt, Homo sapiens
gacuggcuguuuucuuuauuau

SEQ ID NO: 234658 - RNA, 20 nt, Homo sapiens
gacuucagaagcuucagagu

SEQ ID NO: 234659 - RNA, 22 nt, Homo sapiens
gacuucaucauacuaugugugg

SEQ ID NO: 234660 - RNA, 22 nt, Homo sapiens
gagaaugaugauuuccaauuuc

SEQ ID NO: 234661 - RNA, 22 nt, Homo sapiens
gagagugaaguuugcuaccugu

SEQ ID NO: 234662 - RNA, 22 nt, Homo sapiens
gagagugcuuuggguguaggcc

SEQ ID NO: 234663 - RNA, 22 nt, Homo sapiens
gagaugaagugucaauaaggau

SEQ ID NO: 234664 - RNA, 22 nt, Homo sapiens
gagaugaaguuaaggaucuuua

SEQ ID NO: 234665 - RNA, 22 nt, Homo sapiens
gagaugaucaugugguuuuguc

SEQ ID NO: 234666 - RNA, 22 nt, Homo sapiens
gagcaccagucccugucagugc

SEQ ID NO: 234667 - RNA, 22 nt, Homo sapiens
gagcuaguagagugcacccggc

SEQ ID NO: 234668 - RNA, 22 nt, Homo sapiens
gagcucaccuuaccucuggagc

SEQ ID NO: 234669 - RNA, 20 nt, Homo sapiens
gagcucaucuucuuuaccac

SEQ ID NO: 234670 - RNA, 22 nt, Homo sapiens
gagcugguccuuuaaggaugca

SEQ ID NO: 234671 - RNA, 22 nt, Homo sapiens
gagcuuguggucuucguguuau

SEQ ID NO: 234672 - RNA, 22 nt, Homo sapiens
gaggagauauucugcuggaugg

SEQ ID NO: 234673 - RNA, 22 nt, Homo sapiens
gagggcacugcuuuccuuucaa

SEQ ID NO: 234674 - RNA, 22 nt, Homo sapiens
gaggugguagguucacagcagc

SEQ ID NO: 234675 - RNA, 22 nt, Homo sapiens
gaguauauuugcacuguuaugu

SEQ ID NO: 234676 - RNA, 22 nt, Homo sapiens
gagucagugucuugcucuguca

SEQ ID NO: 234677 - RNA, 21 nt, Homo sapiens
gagugcaaauaaagagagggc

SEQ ID NO: 234678 - RNA, 22 nt, Homo sapiens
gaguucaauuuccagcuguucu

SEQ ID NO: 234679 - RNA, 22 nt, Homo sapiens
gaguucauaucuaugagugugc

SEQ ID NO: 234680 - RNA, 22 nt, Homo sapiens
gaguucauuuugaaaccuugau

SEQ ID NO: 234681 - RNA, 22 nt, Homo sapiens
gaucugucuuuccuuauagucu

SEQ ID NO: 234682 - RNA, 19 nt, Homo sapiens
gaucuguugaucaaugugu

SEQ ID NO: 234683 - RNA, 22 nt, Homo sapiens
gaugaucaugaccuacagaugg

SEQ ID NO: 234684 - RNA, 22 nt, Homo sapiens
gaugccuuuuuguccucaguua

SEQ ID NO: 234685 - RNA, 22 nt, Homo sapiens
gauggaauuaaaaucagaauca

SEQ ID NO: 234686 - RNA, 22 nt, Homo sapiens
gaugguuuuuuaagaagagccu

SEQ ID NO: 234687 - RNA, 22 nt, Homo sapiens
gauuuugguuagggaaggauac

SEQ ID NO: 234688 - RNA, 22 nt, Homo sapiens
gauuuuuggggaagccucuuau

SEQ ID NO: 234689 - RNA, 21 nt, Homo sapiens
gcaaaguggcuaccuugcucc

SEQ ID NO: 234690 - RNA, 22 nt, Homo sapiens
gcaaaguguuuuuaggaagucu

SEQ ID NO: 234691 - RNA, 22 nt, Homo sapiens
gcaagaaucugggaguaaaauu

SEQ ID NO: 234692 - RNA, 22 nt, Homo sapiens
gcaagagguaucuuauuuuccc

SEQ ID NO: 234693 - RNA, 22 nt, Homo sapiens
gcacaguggcucccgucuauaa

SEQ ID NO: 234694 - RNA, 22 nt, Homo sapiens
gcacccugucaaaauggaccaa

SEQ ID NO: 234695 - RNA, 23 nt, Homo sapiens
gcagcaaugucacagggguccgg

SEQ ID NO: 234696 - RNA, 22 nt, Homo sapiens
ugagcacauuuacaucaguucc

SEQ ID NO: 234697 - RNA, 22 nt, Homo sapiens
ugagcagaaagcugcaaggucg

SEQ ID NO: 234698 - RNA, 22 nt, Homo sapiens
ugaggcaaggcugaaugaaggc

SEQ ID NO: 234699 - RNA, 22 nt, Homo sapiens
ugagguaacaaacuaugaguua

SEQ ID NO: 234700 - RNA, 22 nt, Homo sapiens
ugagguaagauguucauuuuuc

SEQ ID NO: 234701 - RNA, 22 nt, Homo sapiens
ugagguaaugcuguagcuguga

SEQ ID NO: 234702 - RNA, 22 nt, Homo sapiens
ugaggugaggguaucaaaugcu

SEQ ID NO: 234703 - RNA, 22 nt, Homo sapiens
ugaguagaaauaaacgcaaacu

SEQ ID NO: 234704 - RNA, 22 nt, Homo sapiens
ugaguagagaauucagcuaagg

SEQ ID NO: 234705 - RNA, 22 nt, Homo sapiens
ugaguauguuuagaaguaaagg

SEQ ID NO: 234706 - RNA, 22 nt, Homo sapiens
ugagugaaggggcucuguugug

SEQ ID NO: 234707 - RNA, 22 nt, Homo sapiens
ugaguguccaccccuuucacag

SEQ ID NO: 234708 - RNA, 22 nt, Homo sapiens
ugagugugaggaagaauuagaa

SEQ ID NO: 234709 - RNA, 22 nt, Homo sapiens
ugaguuaggagaguguggcucu

SEQ ID NO: 234710 - RNA, 18 nt, Homo sapiens
ugaguucauuagacuucc

SEQ ID NO: 234711 - RNA, 22 nt, Homo sapiens
ugaguuuaucuaaagaccuggg

SEQ ID NO: 234712 - RNA, 22 nt, Homo sapiens
ugauaauguuaggcuuuauuca

SEQ ID NO: 234713 - RNA, 22 nt, Homo sapiens
ugauacuggcuucauagaauga

SEQ ID NO: 234714 - RNA, 22 nt, Homo sapiens
ugauaggagauuuucaucugua

SEQ ID NO: 234715 - RNA, 22 nt, Homo sapiens
ugauauggcuuggcuaugucac

SEQ ID NO: 234716 - RNA, 22 nt, Homo sapiens
ugauaugucccucgacaucagg

SEQ ID NO: 234717 - RNA, 20 nt, Homo sapiens
ugaugcaaaucuuuaaaagu

SEQ ID NO: 234718 - RNA, 22 nt, Homo sapiens
ugauggcauuucauguuuguaa

SEQ ID NO: 234719 - RNA, 22 nt, Homo sapiens
ugauguugaauuguucagcguc

SEQ ID NO: 234720 - RNA, 22 nt, Homo sapiens
ugcaaagucgaaacugcaguuu

SEQ ID NO: 234721 - RNA, 22 nt, Homo sapiens
ugcaaauguuaguaacaccacu

SEQ ID NO: 234722 - RNA, 22 nt, Homo sapiens
ugcaagcacacccagggauugu

SEQ ID NO: 234723 - RNA, 17 nt, Homo sapiens
ugcaauuuaagcuagau

SEQ ID NO: 234724 - RNA, 22 nt, Homo sapiens
ugcagaaucccuucagauccga

SEQ ID NO: 234725 - RNA, 20 nt, Homo sapiens
ugcagcacugggaaugcagu

SEQ ID NO: 234726 - RNA, 21 nt, Homo sapiens
ugcauauuggaacuuucucuc

SEQ ID NO: 234727 - RNA, 22 nt, Homo sapiens
ugcauugccgugauuacugucu

SEQ ID NO: 234728 - RNA, 19 nt, Homo sapiens
ugccaagaaagucagcuua

SEQ ID NO: 234729 - RNA, 22 nt, Homo sapiens
ugccaguauuuuauuaagaauu

SEQ ID NO: 234730 - RNA, 22 nt, Homo sapiens
ugcccguaauuccagcacuuug

SEQ ID NO: 234731 - RNA, 22 nt, Homo sapiens
ugccuacagaaggggcucagca

SEQ ID NO: 234732 - RNA, 22 nt, Homo sapiens
ugccuucuguuaaacgaggaug

SEQ ID NO: 234733 - RNA, 21 nt, Homo sapiens
ugccuuuguaguaggugucuu

SEQ ID NO: 234734 - RNA, 22 nt, Homo sapiens
ugcuagaagaucacacacauca

SEQ ID NO: 234735 - RNA, 22 nt, Homo sapiens
ugcugcaaucucggcacuuugg

SEQ ID NO: 234736 - RNA, 22 nt, Homo sapiens
ugcugcauuggggauuaaguuu

SEQ ID NO: 234737 - RNA, 22 nt, Homo sapiens
uggaaaauuaggggagguuaua

SEQ ID NO: 234738 - RNA, 22 nt, Homo sapiens
uggaagacaaguguuagcaugg

SEQ ID NO: 234739 - RNA, 22 nt, Homo sapiens
uggaagacacauaccugauaac

SEQ ID NO: 234740 - RNA, 22 nt, Homo sapiens
uggaagacucaagguggugaau

SEQ ID NO: 234741 - RNA, 22 nt, Homo sapiens
uggaagaugggaccucaguuuu

SEQ ID NO: 234742 - RNA, 22 nt, Homo sapiens
uggaaucuacuaaagcaaaauc

SEQ ID NO: 234743 - RNA, 22 nt, Homo sapiens
uggaauguagcguugacacgag

SEQ ID NO: 234744 - RNA, 22 nt, Homo sapiens
uggacauguacauauguguaug

SEQ ID NO: 234745 - RNA, 21 nt, Homo sapiens
uggaccccuacuucucaccau

SEQ ID NO: 234746 - RNA, 22 nt, Homo sapiens
uggaccccugcucgggagcccu

SEQ ID NO: 234747 - RNA, 21 nt, Homo sapiens
uggaccccuuccagucaucau

SEQ ID NO: 234748 - RNA, 21 nt, Homo sapiens
uggaccccuuucuuacaccgu

SEQ ID NO: 234749 - RNA, 22 nt, Homo sapiens
uggagacaaagauagaaaagca

SEQ ID NO: 234750 - RNA, 22 nt, Homo sapiens
uggagagcaaaaucaauccaaa

SEQ ID NO: 234751 - RNA, 22 nt, Homo sapiens
uggagggcuagucauuucuuuu

SEQ ID NO: 234752 - RNA, 22 nt, Homo sapiens
uggauagaaauguacuguuuuc

SEQ ID NO: 234753 - RNA, 22 nt, Homo sapiens
uggauaguuuacugaagagugg

SEQ ID NO: 234754 - RNA, 22 nt, Homo sapiens
uggaucuguucuauuuaucuga

SEQ ID NO: 234755 - RNA, 22 nt, Homo sapiens
uggaugaagagaugguaguugc

SEQ ID NO: 234756 - RNA, 22 nt, Homo sapiens
uggaugacauccuuguaugcag

SEQ ID NO: 234757 - RNA, 22 nt, Homo sapiens
uggcaaagugugacgugggggu

SEQ ID NO: 234758 - RNA, 22 nt, Homo sapiens
uggcaaaucagaggcauggaca

SEQ ID NO: 234759 - RNA, 22 nt, Homo sapiens
uggcaaaugaaagaaagccagu

SEQ ID NO: 234760 - RNA, 22 nt, Homo sapiens
uggcaaaugaagucagcuguac

SEQ ID NO: 234761 - RNA, 22 nt, Homo sapiens
uggcaagaacugcaauugcuuu

SEQ ID NO: 234762 - RNA, 22 nt, Homo sapiens
uggcaagugggaccuaguuaaa

SEQ ID NO: 234763 - RNA, 21 nt, Homo sapiens
uggcacuauucacaauagcaa

SEQ ID NO: 234764 - RNA, 22 nt, Homo sapiens
uggcagaugggugagcuggaga

SEQ ID NO: 234765 - RNA, 22 nt, Homo sapiens
uggcagcgugaauguggcugaa

SEQ ID NO: 234766 - RNA, 23 nt, Homo sapiens
uggcauuuuaguuagcuucagug

SEQ ID NO: 234767 - RNA, 22 nt, Homo sapiens
uggcggagacauggacuucaga

SEQ ID NO: 234768 - RNA, 22 nt, Homo sapiens
uggcgggaaaguugggagaaga

SEQ ID NO: 234769 - RNA, 22 nt, Homo sapiens
uggcuuucuggggcuucuguuc

SEQ ID NO: 234770 - RNA, 22 nt, Homo sapiens
uggcuuuuaucuacucucaacu

SEQ ID NO: 234771 - RNA, 22 nt, Homo sapiens
uggcuuuuauuauguugaggua

SEQ ID NO: 234772 - RNA, 22 nt, Homo sapiens
ugggaaacauccagcacauacu

SEQ ID NO: 234773 - RNA, 22 nt, Homo sapiens
ugggaugaauacaaugggauca

SEQ ID NO: 234774 - RNA, 22 nt, Homo sapiens
ugggauguagccuucuauuuuc

SEQ ID NO: 234775 - RNA, 22 nt, Homo sapiens
ugggcuagaugcuuugggguca

SEQ ID NO: 234776 - RNA, 22 nt, Homo sapiens
uggguaaaucucuguucagggc

SEQ ID NO: 234777 - RNA, 20 nt, Homo sapiens
uggucaccuucaggagguuc

SEQ ID NO: 234778 - RNA, 19 nt, Homo sapiens
uggucaguucugggagcug

SEQ ID NO: 234779 - RNA, 22 nt, Homo sapiens
uggucaguugugccucaauucc

SEQ ID NO: 234780 - RNA, 23 nt, Homo sapiens
uggucccguguucuggcuuuagg

SEQ ID NO: 234781 - RNA, 22 nt, Homo sapiens
uggugagaaaagaugucuuugu

SEQ ID NO: 234782 - RNA, 22 nt, Homo sapiens
uggugccgugguccuggggcca

SEQ ID NO: 234783 - RNA, 22 nt, Homo sapiens
uguaaacuuuugagauugacuu

SEQ ID NO: 234784 - RNA, 20 nt, Homo sapiens
uguaacaaucuggauguugc

SEQ ID NO: 234785 - RNA, 22 nt, Homo sapiens
uguaagcagcagagacuauccu

SEQ ID NO: 234786 - RNA, 22 nt, Homo sapiens
uguaaugaucaaaucagaguaa

SEQ ID NO: 234787 - RNA, 22 nt, Homo sapiens
uguaauguuugguagguuaggu

SEQ ID NO: 234788 - RNA, 20 nt, Homo sapiens
uguacacaguguacccacau

SEQ ID NO: 234789 - RNA, 22 nt, Homo sapiens
uguacccuuagagagugaucga

SEQ ID NO: 234790 - RNA, 22 nt, Homo sapiens
uguagcaaauaaaagucuggau

SEQ ID NO: 234791 - RNA, 22 nt, Homo sapiens
uguauacauauguauguuuugu

SEQ ID NO: 234792 - RNA, 22 nt, Homo sapiens
uguauauguuuguacauauguc

SEQ ID NO: 234793 - RNA, 22 nt, Homo sapiens
ugucaaauucuggguuaaaaca

SEQ ID NO: 234794 - RNA, 22 nt, Homo sapiens
ugucaccuugcucauccucgga

SEQ ID NO: 234795 - RNA, 22 nt, Homo sapiens
ugucaguuucaguguuagccuu

SEQ ID NO: 234796 - RNA, 22 nt, Homo sapiens
ugucaugaacucacauucuggg

SEQ ID NO: 234797 - RNA, 22 nt, Homo sapiens
ugucuaaagaauggcagacuca

SEQ ID NO: 234798 - RNA, 22 nt, Homo sapiens
ugucucagugauuggcuuucug

SEQ ID NO: 234799 - RNA, 22 nt, Homo sapiens
ugugaacaaaauuuguugcaua

SEQ ID NO: 234800 - RNA, 19 nt, Homo sapiens
ugugaacaucacagagugu

SEQ ID NO: 234801 - RNA, 21 nt, Homo sapiens
ugugaacauguuggguggcau

SEQ ID NO: 234802 - RNA, 22 nt, Homo sapiens
ugugacagcacagcaucucuuu

SEQ ID NO: 234803 - RNA, 22 nt, Homo sapiens
ugugacucuggcacauggugag

SEQ ID NO: 234804 - RNA, 22 nt, Homo sapiens
ugugagaucucagaauugaacu

SEQ ID NO: 234805 - RNA, 22 nt, Homo sapiens
ugugcaaggcucucaaccugug

SEQ ID NO: 234806 - RNA, 22 nt, Homo sapiens
ugugcacaauguacagguuagu

SEQ ID NO: 234807 - RNA, 22 nt, Homo sapiens
ugugcacaaugugcagguuuga

SEQ ID NO: 234808 - RNA, 22 nt, Homo sapiens
ugugcacaugauauaucacaua

SEQ ID NO: 234809 - RNA, 20 nt, Homo sapiens
uguggcacuguaucucucag

SEQ ID NO: 234810 - RNA, 22 nt, Homo sapiens
uguggcucuucuguucuccacu

SEQ ID NO: 234811 - RNA, 22 nt, Homo sapiens
ugugguuuuauaaacgugaccu

SEQ ID NO: 234812 - RNA, 22 nt, Homo sapiens
uguguaaauacaagugcuugaa

SEQ ID NO: 234813 - RNA, 22 nt, Homo sapiens
uguuauguauggagugauccca

SEQ ID NO: 234814 - RNA, 22 nt, Homo sapiens
uguucaauucccaccuaugagu

SEQ ID NO: 234815 - RNA, 22 nt, Homo sapiens
uguucuggagaguuuagucugg

SEQ ID NO: 234816 - RNA, 22 nt, Homo sapiens
uguucuggagccgguucaaaug

SEQ ID NO: 234817 - RNA, 22 nt, Homo sapiens
uuaaaguguuugcagacaggug

SEQ ID NO: 234818 - RNA, 22 nt, Homo sapiens
uuaacagugucaaucuguagua

SEQ ID NO: 234819 - RNA, 22 nt, Homo sapiens
uuaagagugggaguuggccaca

SEQ ID NO: 234820 - RNA, 22 nt, Homo sapiens
uuaagucacacuagacaacuga

SEQ ID NO: 234821 - RNA, 22 nt, Homo sapiens
uuaauagugacucauuuuccac

SEQ ID NO: 234822 - RNA, 22 nt, Homo sapiens
uuaauucugucugcccucaucc

SEQ ID NO: 234823 - RNA, 21 nt, Homo sapiens
uuacaauggcuccuugaaggu

SEQ ID NO: 234824 - RNA, 22 nt, Homo sapiens
uuacaguauugcaaggacuagg

SEQ ID NO: 234825 - RNA, 19 nt, Homo sapiens
uuacagugugcccuuuuag

SEQ ID NO: 234826 - RNA, 22 nt, Homo sapiens
uuacaguguuuguucuguuacu

SEQ ID NO: 234827 - RNA, 22 nt, Homo sapiens
uuacaucaucacauuaguuugc

SEQ ID NO: 234828 - RNA, 22 nt, Homo sapiens
uuacugcucuuuugucaugagu

SEQ ID NO: 234829 - RNA, 22 nt, Homo sapiens
uuacuguagugucauaucguau

SEQ ID NO: 234830 - RNA, 22 nt, Homo sapiens
uuagauaguacuuagggaaaua

SEQ ID NO: 234831 - RNA, 22 nt, Homo sapiens
uuagcaccacacacuuuagagg

SEQ ID NO: 234832 - RNA, 22 nt, Homo sapiens
uuagcagcucuggugacaaggu

SEQ ID NO: 234833 - RNA, 22 nt, Homo sapiens
uuagccggguguguuggcgggc

SEQ ID NO: 234834 - RNA, 22 nt, Homo sapiens
uuaggcaggauaguuacauauu

SEQ ID NO: 234835 - RNA, 22 nt, Homo sapiens
uuaggcaguuuauugauuuuca

SEQ ID NO: 234836 - RNA, 22 nt, Homo sapiens
uuauagcagugcccaacuccug

SEQ ID NO: 234837 - RNA, 22 nt, Homo sapiens
uuaugguuuuuagcagaguaau

SEQ ID NO: 234838 - RNA, 16 nt, Homo sapiens
uuauugcauucuucuc

SEQ ID NO: 234839 - RNA, 22 nt, Homo sapiens
uucaaaguaaagggauggagac

SEQ ID NO: 234840 - RNA, 22 nt, Homo sapiens
uucacaguguuucucacgguua

SEQ ID NO: 234841 - RNA, 22 nt, Homo sapiens
uucaccuugggucccacuugcu

SEQ ID NO: 234842 - RNA, 22 nt, Homo sapiens
uucacuggagcccaggaguugg

SEQ ID NO: 234843 - RNA, 22 nt, Homo sapiens
uucacugugcuuaaauucugcu

SEQ ID NO: 234844 - RNA, 22 nt, Homo sapiens
uucagagugguaugaagugaug

SEQ ID NO: 234845 - RNA, 22 nt, Homo sapiens
uucagcaggccaggcccugacu

SEQ ID NO: 234846 - RNA, 22 nt, Homo sapiens
aaagcacuggagucaucaucua

SEQ ID NO: 234847 - RNA, 22 nt, Homo sapiens
aaaggaccacauauaugguggc

SEQ ID NO: 234848 - RNA, 22 nt, Homo sapiens
aaagggcuguuucuugacuugg

SEQ ID NO: 234849 - RNA, 22 nt, Homo sapiens
aaagucuguuacagcuauuucu

SEQ ID NO: 234850 - RNA, 22 nt, Homo sapiens
aaagugccuucuauuuuaguga

SEQ ID NO: 234851 - RNA, 22 nt, Homo sapiens
aaaguggacuaagugaauauga

SEQ ID NO: 234852 - RNA, 22 nt, Homo sapiens
aaauccauuuguucagcuaugc

SEQ ID NO: 234853 - RNA, 22 nt, Homo sapiens
aaaugcacgcuacccagcuaga

SEQ ID NO: 234854 - RNA, 22 nt, Homo sapiens
aaaugcauggacagcuggucuu

SEQ ID NO: 234855 - RNA, 22 nt, Homo sapiens
aaaugcucuuuaugaaguugga

SEQ ID NO: 234856 - RNA, 22 nt, Homo sapiens
aaauugcacaaguggugauuug

SEQ ID NO: 234857 - RNA, 22 nt, Homo sapiens
aacaccauucucuguaacaaga

SEQ ID NO: 234858 - RNA, 22 nt, Homo sapiens
aacuggucuuuggaggaggagg

SEQ ID NO: 234859 - RNA, 21 nt, Homo sapiens
aacuggugugagaugguaugu

SEQ ID NO: 234860 - RNA, 22 nt, Homo sapiens
aagacuguaauccaucuugagu

SEQ ID NO: 234861 - RNA, 22 nt, Homo sapiens
aagaggccuaggaaucuguauu

SEQ ID NO: 234862 - RNA, 22 nt, Homo sapiens
aagagguaggaaauggucauuu

SEQ ID NO: 234863 - RNA, 22 nt, Homo sapiens
aagcaggugugggaggaaaugg

SEQ ID NO: 234864 - RNA, 21 nt, Homo sapiens
aagcaugguguaucuuuccau

SEQ ID NO: 234865 - RNA, 22 nt, Homo sapiens
aagcuacauuuuauuuauguca

SEQ ID NO: 234866 - RNA, 22 nt, Homo sapiens
aagcuggagugcaguggugcga

SEQ ID NO: 234867 - RNA, 22 nt, Homo sapiens
aaggcaguggcagaagauguca

SEQ ID NO: 234868 - RNA, 22 nt, Homo sapiens
aaggcuagagaagaagggcauc

SEQ ID NO: 234869 - RNA, 22 nt, Homo sapiens
aagggaauguuguagcugguuu

SEQ ID NO: 234870 - RNA, 21 nt, Homo sapiens
aaggugguggugauugagaug

SEQ ID NO: 234871 - RNA, 22 nt, Homo sapiens
aaguagcagaggcaagacuuga

SEQ ID NO: 234872 - RNA, 19 nt, Homo sapiens
aagugaaugcuuuguucac

SEQ ID NO: 234873 - RNA, 20 nt, Homo sapiens
aagugaguguuaaacugaac

SEQ ID NO: 234874 - RNA, 22 nt, Homo sapiens
aagugcacuguaagugcaggau

SEQ ID NO: 234875 - RNA, 22 nt, Homo sapiens
aagugcuuacagggaacaugau

SEQ ID NO: 234876 - RNA, 22 nt, Homo sapiens
aauaaagcuuugagcuuugcug

SEQ ID NO: 234877 - RNA, 22 nt, Homo sapiens
aauaucuguguauagauggggg

SEQ ID NO: 234878 - RNA, 22 nt, Homo sapiens
aaucaacauuguuuuaagucaa

SEQ ID NO: 234879 - RNA, 22 nt, Homo sapiens
aauccuguagauucuaauuccu

SEQ ID NO: 234880 - RNA, 22 nt, Homo sapiens
aaucucagagauaucugugucc

SEQ ID NO: 234881 - RNA, 22 nt, Homo sapiens
aaucugucaguuuuguguuaau

SEQ ID NO: 234882 - RNA, 22 nt, Homo sapiens
aaugacagugcuaaagaacccu

SEQ ID NO: 234883 - RNA, 22 nt, Homo sapiens
auuguacuuaagccugggugaa

SEQ ID NO: 234884 - RNA, 22 nt, Homo sapiens
auuguaguuugcuauggcaaua

SEQ ID NO: 234885 - RNA, 22 nt, Homo sapiens
auuuggccuuuguaugcaguau

SEQ ID NO: 234886 - RNA, 22 nt, Homo sapiens
auuugucacuuaacagccauua

SEQ ID NO: 234887 - RNA, 22 nt, Homo sapiens
auuuguccugccuuuuccuccu

SEQ ID NO: 234888 - RNA, 22 nt, Homo sapiens
caaaagugguucuuauccuuuu

SEQ ID NO: 234889 - RNA, 22 nt, Homo sapiens
caaaggauucauuuccaggagu

SEQ ID NO: 234890 - RNA, 22 nt, Homo sapiens
caaaggcuuccacugcauccuu

SEQ ID NO: 234891 - RNA, 22 nt, Homo sapiens
caaagucuauucuacccuuacc

SEQ ID NO: 234892 - RNA, 22 nt, Homo sapiens
caaauugcuugucuguagugga

SEQ ID NO: 234893 - RNA, 22 nt, Homo sapiens
caacacuguuuauuggauagcc

SEQ ID NO: 234894 - RNA, 22 nt, Homo sapiens
caauugcacucuuagguguaca

SEQ ID NO: 234895 - RNA, 22 nt, Homo sapiens
cacaguguuacugguaugaagu

SEQ ID NO: 234896 - RNA, 22 nt, Homo sapiens
cacugcacuccagucccgucuc

SEQ ID NO: 234897 - RNA, 22 nt, Homo sapiens
cacuggcacuguguuuagaugg

SEQ ID NO: 234898 - RNA, 21 nt, Homo sapiens
cacuggguucaggcuugugga

SEQ ID NO: 234899 - RNA, 22 nt, Homo sapiens
cagauguaguauuuuagugaaa

SEQ ID NO: 234900 - RNA, 22 nt, Homo sapiens
cagcaucauucaucugggguaa

SEQ ID NO: 234901 - RNA, 22 nt, Homo sapiens
caggcacgcuugggagacacac

SEQ ID NO: 234902 - RNA, 22 nt, Homo sapiens
uccuugagaggacagagccaua

SEQ ID NO: 234903 - RNA, 22 nt, Homo sapiens
uccuugagccugggaguuauag

SEQ ID NO: 234904 - RNA, 22 nt, Homo sapiens
ucgcagcacgagcaugcaaggu

SEQ ID NO: 234905 - RNA, 17 nt, Homo sapiens
ucuaauaauaugcauuu

SEQ ID NO: 234906 - RNA, 22 nt, Homo sapiens
ucuagccuaugaagcuugucca

SEQ ID NO: 234907 - RNA, 22 nt, Homo sapiens
ucucagugaaauaaauuauuuu

SEQ ID NO: 234908 - RNA, 22 nt, Homo sapiens
ucucagugacugcugggucccc

SEQ ID NO: 234909 - RNA, 22 nt, Homo sapiens
ucucaguggcuuccucacuuuu

SEQ ID NO: 234910 - RNA, 22 nt, Homo sapiens
ucucaugaagauagagaauaga

SEQ ID NO: 234911 - RNA, 22 nt, Homo sapiens
ucucauggagguagagaguaaa

SEQ ID NO: 234912 - RNA, 21 nt, Homo sapiens
ucucauuacugaugagccaga

SEQ ID NO: 234913 - RNA, 20 nt, Homo sapiens
ucucccaaacagcaggcccu

SEQ ID NO: 234914 - RNA, 22 nt, Homo sapiens
ucucugagaaaaguuucuccca

SEQ ID NO: 234915 - RNA, 19 nt, Homo sapiens
ucucugguguuggagggga

SEQ ID NO: 234916 - RNA, 22 nt, Homo sapiens
ucucuguuuagagccagcaauu

SEQ ID NO: 234917 - RNA, 22 nt, Homo sapiens
ucucuguuugucuguuacuggu

SEQ ID NO: 234918 - RNA, 22 nt, Homo sapiens
ucugagaucaugucugugcugu

SEQ ID NO: 234919 - RNA, 22 nt, Homo sapiens
ucugccacugucauugugugau

SEQ ID NO: 234920 - RNA, 22 nt, Homo sapiens
ucuggccuacaaguaauuuuau

SEQ ID NO: 234921 - RNA, 22 nt, Homo sapiens
ucuggugugcucuggacuugca

SEQ ID NO: 234922 - RNA, 19 nt, Homo sapiens
ucugucacuggggguauuc

SEQ ID NO: 234923 - RNA, 22 nt, Homo sapiens
ucugugaaugaacacuugaaaa

SEQ ID NO: 234924 - RNA, 22 nt, Homo sapiens
ucuguggucagcauccgccacu

SEQ ID NO: 234925 - RNA, 22 nt, Homo sapiens
ucuguugguucuuugaggagga

SEQ ID NO: 234926 - RNA, 22 nt, Homo sapiens
ucuucagucauauuggccugga

SEQ ID NO: 234927 - RNA, 22 nt, Homo sapiens
ucuugcuuguuguucccuucau

SEQ ID NO: 234928 - RNA, 22 nt, Homo sapiens
ucuugcuuuugcagagcuucuc

SEQ ID NO: 234929 - RNA, 22 nt, Homo sapiens
ucuuuagugacaguugugcaag

SEQ ID NO: 234930 - RNA, 22 nt, Homo sapiens
ucuuugauuaugcagauggguu

SEQ ID NO: 234931 - RNA, 19 nt, Homo sapiens
ucuuugcuuuucuaagagg

SEQ ID NO: 234932 - RNA, 22 nt, Homo sapiens
ucuuuggagacaaccccagucu

SEQ ID NO: 234933 - RNA, 18 nt, Homo sapiens
ugaaacacauuuuuuccu

SEQ ID NO: 234934 - RNA, 22 nt, Homo sapiens
ugaaaucauguaguuauugcaa

SEQ ID NO: 234935 - RNA, 22 nt, Homo sapiens
ugaaauggaagaagucccuuuu

SEQ ID NO: 234936 - RNA, 22 nt, Homo sapiens
ugaaaugucuuuaggaggcuuc

SEQ ID NO: 234937 - RNA, 22 nt, Homo sapiens
ugaaauguuaaacaaguggcuc

SEQ ID NO: 234938 - RNA, 22 nt, Homo sapiens
aagugccauguggaugggcccu

SEQ ID NO: 234939 - RNA, 22 nt, Homo sapiens
aagugcuuuuuagauaugguuu

SEQ ID NO: 234940 - RNA, 22 nt, Homo sapiens
aauaaagcauggcuacuccaua

SEQ ID NO: 234941 - RNA, 22 nt, Homo sapiens
aauaaagucugaagugugcuua

SEQ ID NO: 234942 - RNA, 22 nt, Homo sapiens
aauacugaaaguauuuucaaau

SEQ ID NO: 234943 - RNA, 17 nt, Homo sapiens
aaucagauuucugagga

SEQ ID NO: 234944 - RNA, 22 nt, Homo sapiens
aauccauuugccgucuauccau

SEQ ID NO: 234945 - RNA, 22 nt, Homo sapiens
aauccugucuugccauccaaua

SEQ ID NO: 234946 - RNA, 22 nt, Homo sapiens
aaucugauguuaucagcuuaag

SEQ ID NO: 234947 - RNA, 17 nt, Homo sapiens
aaugagacauuucugcu

SEQ ID NO: 234948 - RNA, 22 nt, Homo sapiens
aauggcuucuuauugugguuca

SEQ ID NO: 234949 - RNA, 22 nt, Homo sapiens
aauugcacuacugcacucccac

SEQ ID NO: 234950 - RNA, 22 nt, Homo sapiens
aauugcacuggaaguaacugag

SEQ ID NO: 234951 - RNA, 22 nt, Homo sapiens
aauuguacucccaucauuccua

SEQ ID NO: 234952 - RNA, 20 nt, Homo sapiens
acaaaugcauucugugacau

SEQ ID NO: 234953 - RNA, 22 nt, Homo sapiens
acaagacuucuuguauucuagu

SEQ ID NO: 234954 - RNA, 22 nt, Homo sapiens
acaauguauauuuuacuguagg

SEQ ID NO: 234955 - RNA, 20 nt, Homo sapiens
acacugugcuaaggauuuuc

SEQ ID NO: 234956 - RNA, 22 nt, Homo sapiens
acacuguuuuguggagaaugua

SEQ ID NO: 234957 - RNA, 22 nt, Homo sapiens
acacuugcuugcaauagccucc

SEQ ID NO: 234958 - RNA, 22 nt, Homo sapiens
acagucuggagaaugggugcuc

SEQ ID NO: 234959 - RNA, 22 nt, Homo sapiens
acaugcauauguuggaagaaag

SEQ ID NO: 234960 - RNA, 22 nt, Homo sapiens
accagucucagguaugucuuua

SEQ ID NO: 234961 - RNA, 22 nt, Homo sapiens
accccauuugcacugagcccuu

SEQ ID NO: 234962 - RNA, 22 nt, Homo sapiens
acccuggauucguggccuugaa

SEQ ID NO: 234963 - RNA, 22 nt, Homo sapiens
accugagacuaggcauuuuaua

SEQ ID NO: 234964 - RNA, 22 nt, Homo sapiens
acgcagcacauucacagcuaug

SEQ ID NO: 234965 - RNA, 22 nt, Homo sapiens
acuaugcuuuucuuagaauuaa

SEQ ID NO: 234966 - RNA, 22 nt, Homo sapiens
acucuguaagcaagcuggggaa

SEQ ID NO: 234967 - RNA, 22 nt, Homo sapiens
acugagccuuuaaaugacuuca

SEQ ID NO: 234968 - RNA, 20 nt, Homo sapiens
acugcauuuaguccucagga

SEQ ID NO: 234969 - RNA, 22 nt, Homo sapiens
acugccuaaugacuuauguuuu

SEQ ID NO: 234970 - RNA, 22 nt, Homo sapiens
acuggacuuaaugaugaauugu

SEQ ID NO: 234971 - RNA, 22 nt, Homo sapiens
acuucauucucuggaucagaau

SEQ ID NO: 234972 - RNA, 22 nt, Homo sapiens
agaaacacagguggaauugcuu

SEQ ID NO: 234973 - RNA, 22 nt, Homo sapiens
agaaauguuuauucaaacccgu

SEQ ID NO: 234974 - RNA, 22 nt, Homo sapiens
agaacacugaguucagggucag

SEQ ID NO: 234975 - RNA, 22 nt, Homo sapiens
agaaugauccuucucagaggca

SEQ ID NO: 234976 - RNA, 22 nt, Homo sapiens
agacagcugguagcacuuccug

SEQ ID NO: 234977 - RNA, 20 nt, Homo sapiens
agacuagggagcagaaagcc

SEQ ID NO: 234978 - RNA, 22 nt, Homo sapiens
agacuuagagagucuauucuau

SEQ ID NO: 234979 - RNA, 22 nt, Homo sapiens
agagagcuugggguguuaaauu

SEQ ID NO: 234980 - RNA, 22 nt, Homo sapiens
agagaucaauaugaaggaaaug

SEQ ID NO: 234981 - RNA, 22 nt, Homo sapiens
agagcuaguauuuacggagcau

SEQ ID NO: 234982 - RNA, 22 nt, Homo sapiens
agaguaguuuauuaugcuaagg

SEQ ID NO: 234983 - RNA, 22 nt, Homo sapiens
agauacaucuaugugucugugu

SEQ ID NO: 234984 - RNA, 22 nt, Homo sapiens
agauauguuuaguuucaaaaug

SEQ ID NO: 234985 - RNA, 22 nt, Homo sapiens
agaucauaugcaguaaugaacu

SEQ ID NO: 234986 - RNA, 22 nt, Homo sapiens
agaugccucauguucuagguuc

SEQ ID NO: 234987 - RNA, 18 nt, Homo sapiens
agaugguguugcuucugu

SEQ ID NO: 234988 - RNA, 23 nt, Homo sapiens
agcaaaugcucuagcacuccaac

SEQ ID NO: 234989 - RNA, 22 nt, Homo sapiens
agcaauaugacauugcuacauc

SEQ ID NO: 234990 - RNA, 22 nt, Homo sapiens
agcaccauuucucuaaagcacu

SEQ ID NO: 234991 - RNA, 22 nt, Homo sapiens
agcagcauuaugauauaucuua

SEQ ID NO: 234992 - RNA, 21 nt, Homo sapiens
agcagcuuugguugaagcaga

SEQ ID NO: 234993 - RNA, 22 nt, Homo sapiens
agcaggucuuaacuugugaggu

SEQ ID NO: 234994 - RNA, 22 nt, Homo sapiens
agcagguguggcuuauccugaa

SEQ ID NO: 234995 - RNA, 16 nt, Homo sapiens
agcagguguuagguga

SEQ ID NO: 234996 - RNA, 20 nt, Homo sapiens
agcaucacagagccgggugu

SEQ ID NO: 234997 - RNA, 22 nt, Homo sapiens
agccuguguugaauuauagaaa

SEQ ID NO: 234998 - RNA, 22 nt, Homo sapiens
agccuucauucugacaguagga

SEQ ID NO: 234999 - RNA, 22 nt, Homo sapiens
agcgccacugcacuccagccug

SEQ ID NO: 235000 - RNA, 22 nt, Homo sapiens
agcucacagccuagcacuguga

SEQ ID NO: 235001 - RNA, 22 nt, Homo sapiens
agcuccaugauaguaugucugu

SEQ ID NO: 235002 - RNA, 22 nt, Homo sapiens
agcugcaauguuuaguauaaua

SEQ ID NO: 235003 - RNA, 22 nt, Homo sapiens
agcuggacuugauaaaugaaua

SEQ ID NO: 235004 - RNA, 22 nt, Homo sapiens
agcugguuuaauaugcugucug

SEQ ID NO: 235005 - RNA, 22 nt, Homo sapiens
agcuguuguuaauuaacucauu

SEQ ID NO: 235006 - RNA, 22 nt, Homo sapiens
agcuucauuccaacuuccuucu

SEQ ID NO: 235007 - RNA, 22 nt, Homo sapiens
agcuucauuguuaugaauguca

SEQ ID NO: 235008 - RNA, 22 nt, Homo sapiens
agcuuuuugggcagcuauugac

SEQ ID NO: 235009 - RNA, 21 nt, Homo sapiens
aggaagacuaugaucaauugg

SEQ ID NO: 235010 - RNA, 22 nt, Homo sapiens
aggaauuuaauguaugauaaua

SEQ ID NO: 235011 - RNA, 21 nt, Homo sapiens
aggagcauucaugacgagguu

SEQ ID NO: 235012 - RNA, 22 nt, Homo sapiens
aggauacugguaugggcugaau

SEQ ID NO: 235013 - RNA, 22 nt, Homo sapiens
aggcaaaugccagcaaucacac

SEQ ID NO: 235014 - RNA, 22 nt, Homo sapiens
aggcaagugggagacagcauuu

SEQ ID NO: 235015 - RNA, 22 nt, Homo sapiens
aggcacggugucucaugccugu

SEQ ID NO: 235016 - RNA, 22 nt, Homo sapiens
aggcagaugagguccucagcug

SEQ ID NO: 235017 - RNA, 22 nt, Homo sapiens
agggaauguaaguuuuaugaga

SEQ ID NO: 235018 - RNA, 22 nt, Homo sapiens
agggccuuuguagauguacuca

SEQ ID NO: 235019 - RNA, 22 nt, Homo sapiens
agguauuuucaacuuagaaugg

SEQ ID NO: 235020 - RNA, 22 nt, Homo sapiens
aggugguguuggguuccagccc

SEQ ID NO: 235021 - RNA, 22 nt, Homo sapiens
aguauuuguuggaauaccuguu

SEQ ID NO: 235022 - RNA, 22 nt, Homo sapiens
agucaaaugcuuauguauaaag

SEQ ID NO: 235023 - RNA, 22 nt, Homo sapiens
agucagugucuguaaggagaac

SEQ ID NO: 235024 - RNA, 22 nt, Homo sapiens
agucgguguuacugacagaaug

SEQ ID NO: 235025 - RNA, 22 nt, Homo sapiens
agugaacacagcuucuuugguu

SEQ ID NO: 235026 - RNA, 19 nt, Homo sapiens
agugagccaagauccuacc

SEQ ID NO: 235027 - RNA, 22 nt, Homo sapiens
aaugaucaauguuugaggugau

SEQ ID NO: 235028 - RNA, 22 nt, Homo sapiens
aaugucaugaguccaaccagaa

SEQ ID NO: 235029 - RNA, 22 nt, Homo sapiens
aauuaguuggcugccuaugauu

SEQ ID NO: 235030 - RNA, 22 nt, Homo sapiens
aauugcaauggacaaugcagca

SEQ ID NO: 235031 - RNA, 22 nt, Homo sapiens
aauugcaccaucuagaucaaga

SEQ ID NO: 235032 - RNA, 22 nt, Homo sapiens
aauugcaucuguucuuugccag

SEQ ID NO: 235033 - RNA, 23 nt, Homo sapiens
aauugcuuuugaggacuuaguug

SEQ ID NO: 235034 - RNA, 22 nt, Homo sapiens
acaaagugccuccuuuuagagu

SEQ ID NO: 235035 - RNA, 22 nt, Homo sapiens
acacaugugaaaaaaauguuac

SEQ ID NO: 235036 - RNA, 20 nt, Homo sapiens
acaguagaagggauuucaaa

SEQ ID NO: 235037 - RNA, 22 nt, Homo sapiens
acagucacaauuuguaccuuuu

SEQ ID NO: 235038 - RNA, 22 nt, Homo sapiens
acaguguacaauagccuuuuaa

SEQ ID NO: 235039 - RNA, 22 nt, Homo sapiens
acauaaagaagcaggacauugu

SEQ ID NO: 235040 - RNA, 22 nt, Homo sapiens
acaucacuguuugauugauuga

SEQ ID NO: 235041 - RNA, 17 nt, Homo sapiens
acaugagacuggauucu

SEQ ID NO: 235042 - RNA, 22 nt, Homo sapiens
acaugguacugauuuacgaaau

SEQ ID NO: 235043 - RNA, 21 nt, Homo sapiens
acauguacacauguaugcaca

SEQ ID NO: 235044 - RNA, 23 nt, Homo sapiens
acauguauagacuuuuuuuccuu

SEQ ID NO: 235045 - RNA, 22 nt, Homo sapiens
acccagaagucauucaggaaca

SEQ ID NO: 235046 - RNA, 23 nt, Homo sapiens
accccuacaggcuuguguccugc

SEQ ID NO: 235047 - RNA, 17 nt, Homo sapiens
accccuaccucagaagc

SEQ ID NO: 235048 - RNA, 20 nt, Homo sapiens
acccucuaggaugauuucuu

SEQ ID NO: 235049 - RNA, 22 nt, Homo sapiens
acccugaagccaugaguggaac

SEQ ID NO: 235050 - RNA, 22 nt, Homo sapiens
acccuggaggucuacagugcag

SEQ ID NO: 235051 - RNA, 22 nt, Homo sapiens
acccuguaguuagaaacuuuca

SEQ ID NO: 235052 - RNA, 23 nt, Homo sapiens
accugugguuauuuuacucuucc

SEQ ID NO: 235053 - RNA, 22 nt, Homo sapiens
accuucauuguugccaugucca

SEQ ID NO: 235054 - RNA, 18 nt, Homo sapiens
acucuguauguggagugg

SEQ ID NO: 235055 - RNA, 22 nt, Homo sapiens
acugaguguugauuuagauuaa

SEQ ID NO: 235056 - RNA, 22 nt, Homo sapiens
acugcacuccagccugugagac

SEQ ID NO: 235057 - RNA, 22 nt, Homo sapiens
acugcacuucagccuugggaaa

SEQ ID NO: 235058 - RNA, 22 nt, Homo sapiens
acuggcuuuugagaaaaacacu

SEQ ID NO: 235059 - RNA, 22 nt, Homo sapiens
acuuugcuuagagggcauuaaa

SEQ ID NO: 235060 - RNA, 22 nt, Homo sapiens
agaaacauucucuugccuccuu

SEQ ID NO: 235061 - RNA, 22 nt, Homo sapiens
agagacauugcuccaacucacc

SEQ ID NO: 235062 - RNA, 22 nt, Homo sapiens
agagagguggguggagccccca

SEQ ID NO: 235063 - RNA, 22 nt, Homo sapiens
agagguaagcaguggcaagugc

SEQ ID NO: 235064 - RNA, 22 nt, Homo sapiens
agagguagaagauaggcuacag

SEQ ID NO: 235065 - RNA, 22 nt, Homo sapiens
agaggucuuaucaaacaugcuu

SEQ ID NO: 235066 - RNA, 22 nt, Homo sapiens
cugagagaugagaccucucacu

SEQ ID NO: 235067 - RNA, 22 nt, Homo sapiens
cugagguacugggggccaggau

SEQ ID NO: 235068 - RNA, 22 nt, Homo sapiens
cugagguaggcccugagaauau

SEQ ID NO: 235069 - RNA, 22 nt, Homo sapiens
cugaggugggaguuuuucucau

SEQ ID NO: 235070 - RNA, 22 nt, Homo sapiens
cugaucuggaggugucugggga

SEQ ID NO: 235071 - RNA, 22 nt, Homo sapiens
cugcaaauacuugugggauuuu

SEQ ID NO: 235072 - RNA, 22 nt, Homo sapiens
cugcaauguuugaaauggcaaa

SEQ ID NO: 235073 - RNA, 19 nt, Homo sapiens
cugcaugagacaguugguu

SEQ ID NO: 235074 - RNA, 18 nt, Homo sapiens
cugccagugugcucuccg

SEQ ID NO: 235075 - RNA, 22 nt, Homo sapiens
cugcccguaauccucuccccag

SEQ ID NO: 235076 - RNA, 22 nt, Homo sapiens
cuggaaagaaacccuuaauucu

SEQ ID NO: 235077 - RNA, 22 nt, Homo sapiens
cuggcucauuucauuuagcaua

SEQ ID NO: 235078 - RNA, 22 nt, Homo sapiens
cuguaaaguaagagguaaguua

SEQ ID NO: 235079 - RNA, 22 nt, Homo sapiens
cuguaauguaaugagacuacau

SEQ ID NO: 235080 - RNA, 22 nt, Homo sapiens
cugucagugggaguucaggcuu

SEQ ID NO: 235081 - RNA, 22 nt, Homo sapiens
cugugcuugauuauaugagugu

SEQ ID NO: 235082 - RNA, 22 nt, Homo sapiens
cuguugguguuuaaucacugca

SEQ ID NO: 235083 - RNA, 22 nt, Homo sapiens
cuguugguuaaauuccaugcag

SEQ ID NO: 235084 - RNA, 22 nt, Homo sapiens
cuucaucugguuugugaacuuu

SEQ ID NO: 235085 - RNA, 22 nt, Homo sapiens
cuuccagcuggguucagucagu

SEQ ID NO: 235086 - RNA, 22 nt, Homo sapiens
cuucuugcuguguccucacaug

SEQ ID NO: 235087 - RNA, 22 nt, Homo sapiens
cuugaacaaagagauuccauua

SEQ ID NO: 235088 - RNA, 22 nt, Homo sapiens
cuugcacucagaagauucaguu

SEQ ID NO: 235089 - RNA, 22 nt, Homo sapiens
cuuggcuuguuguccccugcuc

SEQ ID NO: 235090 - RNA, 22 nt, Homo sapiens
cuuugcacaucucugcuuuccc

SEQ ID NO: 235091 - RNA, 22 nt, Homo sapiens
cuuuggagaaaaguucuugggc

SEQ ID NO: 235092 - RNA, 22 nt, Homo sapiens
cuuugggaccgcgguuuauacu

SEQ ID NO: 235093 - RNA, 20 nt, Homo sapiens
cuuuguccuccugcugugcu

SEQ ID NO: 235094 - RNA, 22 nt, Homo sapiens
cuuuuguggaucuucuguugcu

SEQ ID NO: 235095 - RNA, 22 nt, Homo sapiens
gaaauguauuaaugaguugaaa

SEQ ID NO: 235096 - RNA, 22 nt, Homo sapiens
gaagaacuaggugagaucuaga

SEQ ID NO: 235097 - RNA, 22 nt, Homo sapiens
gaagauaucuaguaccauuguc

SEQ ID NO: 235098 - RNA, 22 nt, Homo sapiens
gaagcagcauucugguuuuugg

SEQ ID NO: 235099 - RNA, 22 nt, Homo sapiens
gaauacuguccaagagugaugg

SEQ ID NO: 235100 - RNA, 22 nt, Homo sapiens
gaaucaauugaucuaugugucu

SEQ ID NO: 235101 - RNA, 22 nt, Homo sapiens
gaaucauuguuucuaaguuugu

SEQ ID NO: 235102 - RNA, 22 nt, Homo sapiens
gaaugaauguuuauccuuagau

SEQ ID NO: 235103 - RNA, 21 nt, Homo sapiens
gaauggcaccauuagcauaua

SEQ ID NO: 235104 - RNA, 22 nt, Homo sapiens
gacacagugaagucucuacuug

SEQ ID NO: 235105 - RNA, 18 nt, Homo sapiens
gacuccauuucagccaga

SEQ ID NO: 235106 - RNA, 22 nt, Homo sapiens
gacugaguaagcagaagcaauu

SEQ ID NO: 235107 - RNA, 22 nt, Homo sapiens
gacuggauagauaaaguuaguu

SEQ ID NO: 235108 - RNA, 22 nt, Homo sapiens
gagaaccauuuggagaaaaagu

SEQ ID NO: 235109 - RNA, 21 nt, Homo sapiens
gagaaucuuuucagggcaaac

SEQ ID NO: 235110 - RNA, 22 nt, Homo sapiens
gagauauuuagaaauguguucu

SEQ ID NO: 235111 - RNA, 20 nt, Homo sapiens
gagauguugaucagggcuau

SEQ ID NO: 235112 - RNA, 22 nt, Homo sapiens
ucaccuuacuugcuucugaacu

SEQ ID NO: 235113 - RNA, 22 nt, Homo sapiens
ucacuguugaugggcaugcagg

SEQ ID NO: 235114 - RNA, 22 nt, Homo sapiens
ucacuuuggguacuauggaaau

SEQ ID NO: 235115 - RNA, 22 nt, Homo sapiens
ucagaugaucugguaagaacuu

SEQ ID NO: 235116 - RNA, 22 nt, Homo sapiens
ucagauguuuuguuuaucugcu

SEQ ID NO: 235117 - RNA, 22 nt, Homo sapiens
ucagcagucacuccuaugacaa

SEQ ID NO: 235118 - RNA, 22 nt, Homo sapiens
ucagcagugccccacucuacug

SEQ ID NO: 235119 - RNA, 22 nt, Homo sapiens
ucagguaaucuauuugucuuuu

SEQ ID NO: 235120 - RNA, 20 nt, Homo sapiens
ucagguagggcuucaacauu

SEQ ID NO: 235121 - RNA, 22 nt, Homo sapiens
ucagguaucuucauagcaaugc

SEQ ID NO: 235122 - RNA, 22 nt, Homo sapiens
ucaguagcaugaaaacagacua

SEQ ID NO: 235123 - RNA, 22 nt, Homo sapiens
ucagugaauguuggccacuacu

SEQ ID NO: 235124 - RNA, 22 nt, Homo sapiens
ucagugauugcuuucauggaaa

SEQ ID NO: 235125 - RNA, 22 nt, Homo sapiens
ucagugcaggaaucucuagcca

SEQ ID NO: 235126 - RNA, 22 nt, Homo sapiens
ucaguucauggaggugucugcu

SEQ ID NO: 235127 - RNA, 22 nt, Homo sapiens
ucauacgucuccuugugccacc

SEQ ID NO: 235128 - RNA, 22 nt, Homo sapiens
ucauaguagucacuuaauaaau

SEQ ID NO: 235129 - RNA, 22 nt, Homo sapiens
ucauauguaugugcaauuuugu

SEQ ID NO: 235130 - RNA, 22 nt, Homo sapiens
ucauauugcgguucauugacuu

SEQ ID NO: 235131 - RNA, 22 nt, Homo sapiens
ucaugagacacacuggaaagga

SEQ ID NO: 235132 - RNA, 23 nt, Homo sapiens
ucaugaggccauucaaauccauu

SEQ ID NO: 235133 - RNA, 22 nt, Homo sapiens
ucauggggugcuuugcuagauu

SEQ ID NO: 235134 - RNA, 22 nt, Homo sapiens
ucauucacucccuugaaguuag

SEQ ID NO: 235135 - RNA, 22 nt, Homo sapiens
ucauugcauguuaauuaaacag

SEQ ID NO: 235136 - RNA, 22 nt, Homo sapiens
ucauugguugcguaauuugauu

SEQ ID NO: 235137 - RNA, 22 nt, Homo sapiens
uccacagugguugaacuaguaa

SEQ ID NO: 235138 - RNA, 22 nt, Homo sapiens
uccagaguggugaugcuggggc

SEQ ID NO: 235139 - RNA, 22 nt, Homo sapiens
uccagcuuuuucuaauucugug

SEQ ID NO: 235140 - RNA, 22 nt, Homo sapiens
uccaguguuucuuccacuauuu

SEQ ID NO: 235141 - RNA, 22 nt, Homo sapiens
uccaguuuggaggcuugaugug

SEQ ID NO: 235142 - RNA, 22 nt, Homo sapiens
uccauugucuagauguaacaca

SEQ ID NO: 235143 - RNA, 22 nt, Homo sapiens
uccauuugucuauguuucuguu

SEQ ID NO: 235144 - RNA, 19 nt, Homo sapiens
ucccaauguuuccaggcag

SEQ ID NO: 235145 - RNA, 22 nt, Homo sapiens
ucccacugucuucucgugcucg

SEQ ID NO: 235146 - RNA, 20 nt, Homo sapiens
ucccaguaggagaaggaagg

SEQ ID NO: 235147 - RNA, 20 nt, Homo sapiens
ucccuaagagccuuuccuuc

SEQ ID NO: 235148 - RNA, 22 nt, Homo sapiens
ucccugaaaauuagcauuuuaa

SEQ ID NO: 235149 - RNA, 22 nt, Homo sapiens
ucccugaacacauguugagaag

SEQ ID NO: 235150 - RNA, 22 nt, Homo sapiens
ucccugaagcugcagcaacaca

SEQ ID NO: 235151 - RNA, 22 nt, Homo sapiens
ucccugaguaucuaauguguuu

SEQ ID NO: 235152 - RNA, 22 nt, Homo sapiens
uccuacaugcaguacauucaaa

SEQ ID NO: 235153 - RNA, 22 nt, Homo sapiens
uccugagacucacaggcucccc

SEQ ID NO: 235154 - RNA, 22 nt, Homo sapiens
uccugcauucauccugguguug

SEQ ID NO: 235155 - RNA, 22 nt, Homo sapiens
uccugcauucugacuugcuuuc

SEQ ID NO: 235156 - RNA, 22 nt, Homo sapiens
uccuugaaacaggaagaauuca

SEQ ID NO: 235157 - RNA, 22 nt, Homo sapiens
uccuuuggguagcuguucagau

SEQ ID NO: 235158 - RNA, 22 nt, Homo sapiens
uccuuuggucaguauucuuuug

SEQ ID NO: 235159 - RNA, 23 nt, Homo sapiens
ucgcagcauucaauaccaggcag

SEQ ID NO: 235160 - RNA, 22 nt, Homo sapiens
ucuacagccaguucaggaagaa

SEQ ID NO: 235161 - RNA, 22 nt, Homo sapiens
ucucagagccuaggguuuuuca

SEQ ID NO: 235162 - RNA, 19 nt, Homo sapiens
ucucaguguuggucaggug

SEQ ID NO: 235163 - RNA, 22 nt, Homo sapiens
ucuccauuguccagaugaggaa

SEQ ID NO: 235164 - RNA, 17 nt, Homo sapiens
ucucccaucccuuucuc

SEQ ID NO: 235165 - RNA, 22 nt, Homo sapiens
ucugagguuaaauuuuauaguu

SEQ ID NO: 235166 - RNA, 22 nt, Homo sapiens
ucugaguggcagaaugagcuga

SEQ ID NO: 235167 - RNA, 22 nt, Homo sapiens
ucugcaagucuaaacuagccau

SEQ ID NO: 235168 - RNA, 22 nt, Homo sapiens
ucuggagugugaaguggauaug

SEQ ID NO: 235169 - RNA, 22 nt, Homo sapiens
ucuggcauuuucucugcuugca

SEQ ID NO: 235170 - RNA, 22 nt, Homo sapiens
ucuggccuacaucauuuuuccg

SEQ ID NO: 235171 - RNA, 22 nt, Homo sapiens
ucuggccuagaacaauuaauua

SEQ ID NO: 235172 - RNA, 22 nt, Homo sapiens
ucuggccuccuaugagaaucga

SEQ ID NO: 235173 - RNA, 22 nt, Homo sapiens
ucugguguuacugagccuccca

SEQ ID NO: 235174 - RNA, 22 nt, Homo sapiens
ucugguguuauucauguaguuu

SEQ ID NO: 235175 - RNA, 19 nt, Homo sapiens
ucuguaguuagggcuacag

SEQ ID NO: 235176 - RNA, 22 nt, Homo sapiens
ucugucacugguggacgaucac

SEQ ID NO: 235177 - RNA, 22 nt, Homo sapiens
ucugugcugagaguugaaaguu

SEQ ID NO: 235178 - RNA, 22 nt, Homo sapiens
ucugugcuugucauaugcuuug

SEQ ID NO: 235179 - RNA, 18 nt, Homo sapiens
ucugugguguaaauacgu

SEQ ID NO: 235180 - RNA, 22 nt, Homo sapiens
ucugugguucaggcuggagugc

SEQ ID NO: 235181 - RNA, 22 nt, Homo sapiens
ucuuauuuggggaaaggguccu

SEQ ID NO: 235182 - RNA, 17 nt, Homo sapiens
ucuucuguuacuguggc

SEQ ID NO: 235183 - RNA, 22 nt, Homo sapiens
ucuugguaaugucacauuuccu

SEQ ID NO: 235184 - RNA, 22 nt, Homo sapiens
ucuuugauguucugaaagaugg

SEQ ID NO: 235185 - RNA, 22 nt, Homo sapiens
ucuuugauuuuguuacuaagac

SEQ ID NO: 235186 - RNA, 22 nt, Homo sapiens
ucuuuggaggcgaucuguuuga

SEQ ID NO: 235187 - RNA, 22 nt, Homo sapiens
ucuuuggguagauauguagcug

SEQ ID NO: 235188 - RNA, 22 nt, Homo sapiens
ucuuuguugcauaggcuuguuc

SEQ ID NO: 235189 - RNA, 22 nt, Homo sapiens
ugaaaguuauauugugaaauuc

SEQ ID NO: 235190 - RNA, 22 nt, Homo sapiens
ugaaauacuuaauuucuccaug

SEQ ID NO: 235191 - RNA, 22 nt, Homo sapiens
ugaaauggugcggucugcagca

SEQ ID NO: 235192 - RNA, 22 nt, Homo sapiens
ugaaauguaaguugucuagucu

SEQ ID NO: 235193 - RNA, 22 nt, Homo sapiens
ugaagugaagcaguaguguggg

SEQ ID NO: 235194 - RNA, 22 nt, Homo sapiens
ugaauacagcacacccaugggu

SEQ ID NO: 235195 - RNA, 18 nt, Homo sapiens
ugaauaguguccccauga

SEQ ID NO: 235196 - RNA, 22 nt, Homo sapiens
ugaauaguuugacagaacucuu

SEQ ID NO: 235197 - RNA, 22 nt, Homo sapiens
ugaaucaugcugcuauaaagac

SEQ ID NO: 235198 - RNA, 21 nt, Homo sapiens
ugaaugcuuuaaauauuagaa

SEQ ID NO: 235199 - RNA, 22 nt, Homo sapiens
ugaaugguuuuuagagaacaau

SEQ ID NO: 235200 - RNA, 22 nt, Homo sapiens
ugacacuugcccuuagaaacau

SEQ ID NO: 235201 - RNA, 22 nt, Homo sapiens
ugacaugagauuugggaggggc

SEQ ID NO: 235202 - RNA, 22 nt, Homo sapiens
ugacucaagagccugacucauc

SEQ ID NO: 235203 - RNA, 22 nt, Homo sapiens
ugacuccagagacugugcuguc

SEQ ID NO: 235204 - RNA, 22 nt, Homo sapiens
ugacuuaugcaacucugaugug

SEQ ID NO: 235205 - RNA, 18 nt, Homo sapiens
ugagaacauguguacaca

SEQ ID NO: 235206 - RNA, 22 nt, Homo sapiens
ugagaacugccuguauuuaucu

SEQ ID NO: 235207 - RNA, 22 nt, Homo sapiens
ugagaagcauaccagugucugu

SEQ ID NO: 235208 - RNA, 22 nt, Homo sapiens
ugagacaaaguuguuggauguu

SEQ ID NO: 235209 - RNA, 22 nt, Homo sapiens
ugagaccaacagauuccaguuc

SEQ ID NO: 235210 - RNA, 22 nt, Homo sapiens
ugagacugaguuuugcucguug

SEQ ID NO: 235211 - RNA, 22 nt, Homo sapiens
ugagagaugaacucugauaugu

SEQ ID NO: 235212 - RNA, 22 nt, Homo sapiens
ugagaguauaaauugaugcagc

SEQ ID NO: 235213 - RNA, 18 nt, Homo sapiens
ugagauacuagaauaggu

SEQ ID NO: 235214 - RNA, 22 nt, Homo sapiens
ugagaucaacugagucagagca

SEQ ID NO: 235215 - RNA, 22 nt, Homo sapiens
ugagaucagugaagaaguguuu

SEQ ID NO: 235216 - RNA, 22 nt, Homo sapiens
ugagaucuuugcuguccucacc

SEQ ID NO: 235217 - RNA, 22 nt, Homo sapiens
ugagaugaaagcagaaagacuu

SEQ ID NO: 235218 - RNA, 19 nt, Homo sapiens
ugagaugaagacagggguu

SEQ ID NO: 235219 - RNA, 22 nt, Homo sapiens
ugagaugaagugauguaaaaca

SEQ ID NO: 235220 - RNA, 22 nt, Homo sapiens
ugagaugacgacacaccucagu

SEQ ID NO: 235221 - RNA, 22 nt, Homo sapiens
ugagaugaggucucgcucuguc

SEQ ID NO: 235222 - RNA, 21 nt, Homo sapiens
ugagaugauccugcaugcaug

SEQ ID NO: 235223 - RNA, 22 nt, Homo sapiens
ugagauguugcucugaaacaag

SEQ ID NO: 235224 - RNA, 21 nt, Homo sapiens
ugagauuauauuaacauggua

SEQ ID NO: 235225 - RNA, 22 nt, Homo sapiens
ugagauuaucuugaucuugaaa

SEQ ID NO: 235226 - RNA, 22 nt, Homo sapiens
cuuuguguaggugccucuggcu

SEQ ID NO: 235227 - RNA, 23 nt, Homo sapiens
cuuuugcaaugugaucuugccac

SEQ ID NO: 235228 - RNA, 22 nt, Homo sapiens
gaaagauuuccugagcuagaaa

SEQ ID NO: 235229 - RNA, 22 nt, Homo sapiens
gaaaugucugagauguggcuca

SEQ ID NO: 235230 - RNA, 22 nt, Homo sapiens
gaaauguugauagugggcauug

SEQ ID NO: 235231 - RNA, 22 nt, Homo sapiens
gaagaaguacaagacaaauuuu

SEQ ID NO: 235232 - RNA, 22 nt, Homo sapiens
gaagacauuuacaugggagacc

SEQ ID NO: 235233 - RNA, 22 nt, Homo sapiens
gacaccauuucaguacuagguu

SEQ ID NO: 235234 - RNA, 22 nt, Homo sapiens
gacaccugguguggaacuggag

SEQ ID NO: 235235 - RNA, 22 nt, Homo sapiens
gacaguuucucaggcuuccuua

SEQ ID NO: 235236 - RNA, 22 nt, Homo sapiens
gacauguuuacaguguugagag

SEQ ID NO: 235237 - RNA, 22 nt, Homo sapiens
gagaacugagauaagugauauu

SEQ ID NO: 235238 - RNA, 22 nt, Homo sapiens
gagaacuggcugauucaaggac

SEQ ID NO: 235239 - RNA, 22 nt, Homo sapiens
gagaagugcgucguuugaugau

SEQ ID NO: 235240 - RNA, 22 nt, Homo sapiens
gagagcaugugcuggcaucagu

SEQ ID NO: 235241 - RNA, 22 nt, Homo sapiens
gagaucauuaugucagggguca

SEQ ID NO: 235242 - RNA, 22 nt, Homo sapiens
gagaugugguucaaggguguuu

SEQ ID NO: 235243 - RNA, 22 nt, Homo sapiens
gagauguuuuguuaucaaagga

SEQ ID NO: 235244 - RNA, 22 nt, Homo sapiens
gagauuuucagcuugacuggga

SEQ ID NO: 235245 - RNA, 22 nt, Homo sapiens
gagcaucaguggccucaucuca

SEQ ID NO: 235246 - RNA, 22 nt, Homo sapiens
gagcuaguguuuacuugccacu

SEQ ID NO: 235247 - RNA, 22 nt, Homo sapiens
gagcuccuccccuuggcuuuca

SEQ ID NO: 235248 - RNA, 22 nt, Homo sapiens
gaggacauuaugcuaaguggaa

SEQ ID NO: 235249 - RNA, 22 nt, Homo sapiens
gaggcauuauucccaucuuaca

SEQ ID NO: 235250 - RNA, 22 nt, Homo sapiens
gaggcuagauggggaugugucc

SEQ ID NO: 235251 - RNA, 22 nt, Homo sapiens
gagguaagaaagucaguccuuc

SEQ ID NO: 235252 - RNA, 22 nt, Homo sapiens
gagguaugauugacauauaaaa

SEQ ID NO: 235253 - RNA, 22 nt, Homo sapiens
gagguaugugggcagacauuua

SEQ ID NO: 235254 - RNA, 22 nt, Homo sapiens
gaggucaggacauuuuugcuuu

SEQ ID NO: 235255 - RNA, 22 nt, Homo sapiens
gagguguagagauauaccugaa

SEQ ID NO: 235256 - RNA, 22 nt, Homo sapiens
gaguagugcugcaguaaacaua

SEQ ID NO: 235257 - RNA, 22 nt, Homo sapiens
gaguagugcuguaauaaacaua

SEQ ID NO: 235258 - RNA, 22 nt, Homo sapiens
gagugcugagcccacuuccuug

SEQ ID NO: 235259 - RNA, 22 nt, Homo sapiens
gauaaaguauuggguacuaugc

SEQ ID NO: 235260 - RNA, 22 nt, Homo sapiens
gauaacagauaaugucaguuau

SEQ ID NO: 235261 - RNA, 22 nt, Homo sapiens
gauagcagccauucuuuuuauu

SEQ ID NO: 235262 - RNA, 22 nt, Homo sapiens
gauauguucugagaaaugcauu

SEQ ID NO: 235263 - RNA, 22 nt, Homo sapiens
gaucacaugggagaaugagagu

SEQ ID NO: 235264 - RNA, 22 nt, Homo sapiens
gauggaguugacuaagacaaca

SEQ ID NO: 235265 - RNA, 22 nt, Homo sapiens
gauggcauuucuggaucugaca

SEQ ID NO: 235266 - RNA, 22 nt, Homo sapiens
gauggguuuuuugaagacagca

SEQ ID NO: 235267 - RNA, 22 nt, Homo sapiens
gauuccacuuacuuagcauucc

SEQ ID NO: 235268 - RNA, 22 nt, Homo sapiens
gcaaaaaguagugcugguuagg

SEQ ID NO: 235269 - RNA, 22 nt, Homo sapiens
gcaaaauugagaagggaauaua

SEQ ID NO: 235270 - RNA, 22 nt, Homo sapiens
gcaaagaaugcagauuugccuc

SEQ ID NO: 235271 - RNA, 22 nt, Homo sapiens
gcaaaguguuuuccaacuuggu

SEQ ID NO: 235272 - RNA, 22 nt, Homo sapiens
gcagaucucuucauuucucuua

SEQ ID NO: 235273 - RNA, 22 nt, Homo sapiens
gcagcacauggcagaacauauu

SEQ ID NO: 235274 - RNA, 22 nt, Homo sapiens
gcagugaugugaucauagcuca

SEQ ID NO: 235275 - RNA, 22 nt, Homo sapiens
gcagugcuggagcccccgugug

SEQ ID NO: 235276 - RNA, 22 nt, Homo sapiens
gcauggccuuuaaaugucacag

SEQ ID NO: 235277 - RNA, 21 nt, Homo sapiens
gccaguguggcaauuuuucaa

SEQ ID NO: 235278 - RNA, 22 nt, Homo sapiens
gccuuuggugacaggcaugugu

SEQ ID NO: 235279 - RNA, 22 nt, Homo sapiens
gcgcagugggcugugccaucca

SEQ ID NO: 235280 - RNA, 19 nt, Homo sapiens
gcucaccuugcugcuccag

SEQ ID NO: 235281 - RNA, 22 nt, Homo sapiens
gcugauguuggccucugggcuu

SEQ ID NO: 235282 - RNA, 17 nt, Homo sapiens
gcugcauucauguagaa

SEQ ID NO: 235283 - RNA, 22 nt, Homo sapiens
gcuguguugugcccagcaucau

SEQ ID NO: 235284 - RNA, 22 nt, Homo sapiens
gcuguugcuauuauuccgagaa

SEQ ID NO: 235285 - RNA, 22 nt, Homo sapiens
gcuguugguaaaaaggacauga

SEQ ID NO: 235286 - RNA, 22 nt, Homo sapiens
gcuucauggaggcugggcgcag

SEQ ID NO: 235287 - RNA, 23 nt, Homo sapiens
ggaaauguuuaagggguugggag

SEQ ID NO: 235288 - RNA, 22 nt, Homo sapiens
ggaaucugaaccaugggaaugg

SEQ ID NO: 235289 - RNA, 22 nt, Homo sapiens
ggaaugggauuugaagucuggc

SEQ ID NO: 235290 - RNA, 22 nt, Homo sapiens
ggaauguuaaagacuacacuga

SEQ ID NO: 235291 - RNA, 22 nt, Homo sapiens
ggacauuaacugcaagauagau

SEQ ID NO: 235292 - RNA, 20 nt, Homo sapiens
ggagagugacauaauucugg

SEQ ID NO: 235293 - RNA, 22 nt, Homo sapiens
ggagauaauccagggagggacu

SEQ ID NO: 235294 - RNA, 22 nt, Homo sapiens
auuguucuuguguccuuuuccu

SEQ ID NO: 235295 - RNA, 22 nt, Homo sapiens
auuuagcaauggagguagugua

SEQ ID NO: 235296 - RNA, 19 nt, Homo sapiens
auuugaucaucaggcacag

SEQ ID NO: 235297 - RNA, 20 nt, Homo sapiens
auuuggcauaguuuaagcaa

SEQ ID NO: 235298 - RNA, 21 nt, Homo sapiens
auuuuugcagagcugguagug

SEQ ID NO: 235299 - RNA, 22 nt, Homo sapiens
auuuuugguugucagcacuagg

SEQ ID NO: 235300 - RNA, 22 nt, Homo sapiens
caaaagugauugcgguuuuugc

SEQ ID NO: 235301 - RNA, 22 nt, Homo sapiens
caaaggcuguuauaggccagga

SEQ ID NO: 235302 - RNA, 22 nt, Homo sapiens
caaaguaauugcuguuuugcca

SEQ ID NO: 235303 - RNA, 22 nt, Homo sapiens
caaaguaauugugguuuugcca

SEQ ID NO: 235304 - RNA, 22 nt, Homo sapiens
caaaugaucugcuggccucagc

SEQ ID NO: 235305 - RNA, 22 nt, Homo sapiens
caauacuguguugaauaagagu

SEQ ID NO: 235306 - RNA, 22 nt, Homo sapiens
cacaggccugucucuuucuaac

SEQ ID NO: 235307 - RNA, 22 nt, Homo sapiens
cacagugaacaauauccucugu

SEQ ID NO: 235308 - RNA, 22 nt, Homo sapiens
cacugcauuggaugguuccucc

SEQ ID NO: 235309 - RNA, 22 nt, Homo sapiens
cagagaaugucuuuuuuaacca

SEQ ID NO: 235310 - RNA, 22 nt, Homo sapiens
cagagcacugauacuggguucu

SEQ ID NO: 235311 - RNA, 22 nt, Homo sapiens
cagaugcaugaccugggcuugg

SEQ ID NO: 235312 - RNA, 22 nt, Homo sapiens
cagcugcuuuggaaaauauuuu

SEQ ID NO: 235313 - RNA, 22 nt, Homo sapiens
cagguauagucacuugcccaag

SEQ ID NO: 235314 - RNA, 22 nt, Homo sapiens
caggugguauuugguuuucugu

SEQ ID NO: 235315 - RNA, 19 nt, Homo sapiens
caguaucauugcacauagu

SEQ ID NO: 235316 - RNA, 22 nt, Homo sapiens
cagugcuuguuauuguucuauu

SEQ ID NO: 235317 - RNA, 22 nt, Homo sapiens
cauaaagauggaggaggccagg

SEQ ID NO: 235318 - RNA, 18 nt, Homo sapiens
cauagcacuucagcacau

SEQ ID NO: 235319 - RNA, 22 nt, Homo sapiens
caucacuguugguacaaguaau

SEQ ID NO: 235320 - RNA, 22 nt, Homo sapiens
caugaaagugagaaacuccugg

SEQ ID NO: 235321 - RNA, 22 nt, Homo sapiens
cauggagcuaggcuugaucccu

SEQ ID NO: 235322 - RNA, 22 nt, Homo sapiens
cauggcuuuauuuucagcuucu

SEQ ID NO: 235323 - RNA, 22 nt, Homo sapiens
cauguauagauuccauaguggu

SEQ ID NO: 235324 - RNA, 21 nt, Homo sapiens
caugucacugcacucuagccu

SEQ ID NO: 235325 - RNA, 22 nt, Homo sapiens
caugucacuuccucucugaugg

SEQ ID NO: 235326 - RNA, 22 nt, Homo sapiens
cauugcacuccaccuuggguaa

SEQ ID NO: 235327 - RNA, 22 nt, Homo sapiens
cauugcacuccagccucggcaa

SEQ ID NO: 235328 - RNA, 22 nt, Homo sapiens
cauugcacuccagccugcacga

SEQ ID NO: 235329 - RNA, 22 nt, Homo sapiens
cauugcacuccagccuggccaa

SEQ ID NO: 235330 - RNA, 22 nt, Homo sapiens
cauugcacuccagcuugggcga

SEQ ID NO: 235331 - RNA, 22 nt, Homo sapiens
cauugcacuccauccuuggcaa

SEQ ID NO: 235332 - RNA, 16 nt, Homo sapiens
cauugcacucuagccu

SEQ ID NO: 235333 - RNA, 22 nt, Homo sapiens
cauugcacucuagccucggcaa

SEQ ID NO: 235334 - RNA, 22 nt, Homo sapiens
cauugcaguuuuugguguaucu

SEQ ID NO: 235335 - RNA, 22 nt, Homo sapiens
cauugguuggacaguucucucu

SEQ ID NO: 235336 - RNA, 22 nt, Homo sapiens
ccaaauccauccaaaucauaga

SEQ ID NO: 235337 - RNA, 22 nt, Homo sapiens
ccaccuguacuuaagucacuuu

SEQ ID NO: 235338 - RNA, 22 nt, Homo sapiens
ccagaguugccucagguuucug

SEQ ID NO: 235339 - RNA, 20 nt, Homo sapiens
ccagcaucauuagauucugg

SEQ ID NO: 235340 - RNA, 19 nt, Homo sapiens
ccaguguugccagagcuga

SEQ ID NO: 235341 - RNA, 22 nt, Homo sapiens
ccaucacacugugauuauuauc

SEQ ID NO: 235342 - RNA, 19 nt, Homo sapiens
ccauggcaaugaucugaug

SEQ ID NO: 235343 - RNA, 22 nt, Homo sapiens
ccauuugguuauguaucgaaac

SEQ ID NO: 235344 - RNA, 22 nt, Homo sapiens
cccagagacagaaugauaaacu

SEQ ID NO: 235345 - RNA, 22 nt, Homo sapiens
cccagaguucuuaaauacugag

SEQ ID NO: 235346 - RNA, 22 nt, Homo sapiens
ccccguuacagccucagugccu

SEQ ID NO: 235347 - RNA, 22 nt, Homo sapiens
ccccuguaaacuggcuucccug

SEQ ID NO: 235348 - RNA, 18 nt, Homo sapiens
cccgggugggcuguuccc

SEQ ID NO: 235349 - RNA, 22 nt, Homo sapiens
cccucauucauucauccuaugu

SEQ ID NO: 235350 - RNA, 23 nt, Homo sapiens
ccgugagagaguucauagaaagc

SEQ ID NO: 235351 - RNA, 22 nt, Homo sapiens
ccucauggagaaccucugcuag

SEQ ID NO: 235352 - RNA, 21 nt, Homo sapiens
ccuccauuuguauucuugccc

SEQ ID NO: 235353 - RNA, 22 nt, Homo sapiens
ccuggaagaaaggugcuaaaua

SEQ ID NO: 235354 - RNA, 22 nt, Homo sapiens
ccugugguuaaccagcuagaug

SEQ ID NO: 235355 - RNA, 22 nt, Homo sapiens
cgccugagcugaggaagcugca

SEQ ID NO: 235356 - RNA, 22 nt, Homo sapiens
cuagcacauaguuauucacuca

SEQ ID NO: 235357 - RNA, 22 nt, Homo sapiens
cuauggcuguaaggauaguaac

SEQ ID NO: 235358 - RNA, 22 nt, Homo sapiens
cucaaaugguccagcuaguggu

SEQ ID NO: 235359 - RNA, 22 nt, Homo sapiens
cucaaguacaugggauuacagg

SEQ ID NO: 235360 - RNA, 20 nt, Homo sapiens
cucagugcacccccauaaaa

SEQ ID NO: 235361 - RNA, 22 nt, Homo sapiens
cucauggaauacuucacagcca

SEQ ID NO: 235362 - RNA, 19 nt, Homo sapiens
cucauggagaaggagaaua

SEQ ID NO: 235363 - RNA, 22 nt, Homo sapiens
cucucugagccccagacaccuu

SEQ ID NO: 235364 - RNA, 22 nt, Homo sapiens
cucugagguuauucguaauauu

SEQ ID NO: 235365 - RNA, 22 nt, Homo sapiens
cugaaagagcauuugaaugggu

SEQ ID NO: 235366 - RNA, 22 nt, Homo sapiens
cugaaggcagguagaauagaga

SEQ ID NO: 235367 - RNA, 22 nt, Homo sapiens
cugacagaugacugccacugua

SEQ ID NO: 235368 - RNA, 22 nt, Homo sapiens
cugaccucugucaaagacaccc

SEQ ID NO: 235369 - RNA, 22 nt, Homo sapiens
cugagagaggagcuaaaacugc

SEQ ID NO: 235370 - RNA, 22 nt, Homo sapiens
cugagaucguggggcugcuguc

SEQ ID NO: 235371 - RNA, 22 nt, Homo sapiens
cugagauggagucucgcauugu

SEQ ID NO: 235372 - RNA, 22 nt, Homo sapiens
gcuaggagaucugcugcucucu

SEQ ID NO: 235373 - RNA, 22 nt, Homo sapiens
gcuaugucuguugcucuugggc

SEQ ID NO: 235374 - RNA, 22 nt, Homo sapiens
gcucaugagacaagcaggagua

SEQ ID NO: 235375 - RNA, 22 nt, Homo sapiens
gcucuuuugggguaauucugag

SEQ ID NO: 235376 - RNA, 22 nt, Homo sapiens
gcugcuuuugaugacaaaaaca

SEQ ID NO: 235377 - RNA, 22 nt, Homo sapiens
gcuggcuuucuccugaucucag

SEQ ID NO: 235378 - RNA, 22 nt, Homo sapiens
gcuggguugccagguuacuuaa

SEQ ID NO: 235379 - RNA, 22 nt, Homo sapiens
gcuggugacuuuaaguugaagc

SEQ ID NO: 235380 - RNA, 22 nt, Homo sapiens
gcugguguagagugcagaaagg

SEQ ID NO: 235381 - RNA, 22 nt, Homo sapiens
gcuguugugaacuauacaucua

SEQ ID NO: 235382 - RNA, 22 nt, Homo sapiens
gcuuguguuugcuccccagaau

SEQ ID NO: 235383 - RNA, 21 nt, Homo sapiens
gcuuuuucggaagucuuuggc

SEQ ID NO: 235384 - RNA, 22 nt, Homo sapiens
ggaaaguaacccauucucuuac

SEQ ID NO: 235385 - RNA, 22 nt, Homo sapiens
ggaagccugcacucgggcaggg

SEQ ID NO: 235386 - RNA, 22 nt, Homo sapiens
ggaauaguauaaauaccacaaa

SEQ ID NO: 235387 - RNA, 22 nt, Homo sapiens
ggagaugauuaugaaucacuua

SEQ ID NO: 235388 - RNA, 22 nt, Homo sapiens
ggaggcuaguaaaaagguagaa

SEQ ID NO: 235389 - RNA, 20 nt, Homo sapiens
ggagguguugauuuuucuuu

SEQ ID NO: 235390 - RNA, 22 nt, Homo sapiens
ggagucugauguucuaaggcag

SEQ ID NO: 235391 - RNA, 22 nt, Homo sapiens
ggagucugauuuuuauguugcu

SEQ ID NO: 235392 - RNA, 22 nt, Homo sapiens
ggagugugauuguucucuguua

SEQ ID NO: 235393 - RNA, 22 nt, Homo sapiens
ggaucauaugauagcucaauuu

SEQ ID NO: 235394 - RNA, 22 nt, Homo sapiens
ggcaaagagacaugcaucgggg

SEQ ID NO: 235395 - RNA, 22 nt, Homo sapiens
ggcaaaugaagauggagaggcu

SEQ ID NO: 235396 - RNA, 21 nt, Homo sapiens
ggcaagaaacacaaucaagua

SEQ ID NO: 235397 - RNA, 17 nt, Homo sapiens
ggcaggaauuaauguca

SEQ ID NO: 235398 - RNA, 17 nt, Homo sapiens
ggcaggauccaggaucc

SEQ ID NO: 235399 - RNA, 22 nt, Homo sapiens
ggccagaugaucuaugaaggaa

SEQ ID NO: 235400 - RNA, 22 nt, Homo sapiens
ggcccugauacaaguaaggucu

SEQ ID NO: 235401 - RNA, 22 nt, Homo sapiens
ggcucguguuuucuguccaguu

SEQ ID NO: 235402 - RNA, 18 nt, Homo sapiens
ggcugguguuuuaguaua

SEQ ID NO: 235403 - RNA, 22 nt, Homo sapiens
gggaaaaugucuauugaaugaa

SEQ ID NO: 235404 - RNA, 22 nt, Homo sapiens
gggagcacaagaaauguuucau

SEQ ID NO: 235405 - RNA, 22 nt, Homo sapiens
gggagugugcacacaugguaua

SEQ ID NO: 235406 - RNA, 22 nt, Homo sapiens
gggauuguaauacugaguuggu

SEQ ID NO: 235407 - RNA, 22 nt, Homo sapiens
gggguaggcuacacugaguucc

SEQ ID NO: 235408 - RNA, 22 nt, Homo sapiens
gggugguuuuauuaucagugac

SEQ ID NO: 235409 - RNA, 19 nt, Homo sapiens
ggucauggagguuguguga

SEQ ID NO: 235410 - RNA, 22 nt, Homo sapiens
ggucauggauaagauccagaag

SEQ ID NO: 235411 - RNA, 19 nt, Homo sapiens
ggugagaaauuaugggucu

SEQ ID NO: 235412 - RNA, 22 nt, Homo sapiens
gguguguaaauuacuuaucucu

SEQ ID NO: 235413 - RNA, 22 nt, Homo sapiens
guacaguucucuuuguugucag

SEQ ID NO: 235414 - RNA, 22 nt, Homo sapiens
guaucauuggcauguaaccaga

SEQ ID NO: 235415 - RNA, 22 nt, Homo sapiens
gucacugagaagguuaguuugu

SEQ ID NO: 235416 - RNA, 22 nt, Homo sapiens
gucaggugcuuacgcggagauc

SEQ ID NO: 235417 - RNA, 22 nt, Homo sapiens
gucaguggagaaaaggacaugu

SEQ ID NO: 235418 - RNA, 22 nt, Homo sapiens
guccaaauccaugggauguaca

SEQ ID NO: 235419 - RNA, 20 nt, Homo sapiens
guccauuugcugccauugcu

SEQ ID NO: 235420 - RNA, 22 nt, Homo sapiens
gucucauugcaguuagaccugu

SEQ ID NO: 235421 - RNA, 23 nt, Homo sapiens
gucuggucccugguuggaaacca

SEQ ID NO: 235422 - RNA, 20 nt, Homo sapiens
gucuugcuccguugcccagg

SEQ ID NO: 235423 - RNA, 22 nt, Homo sapiens
gucuuugcuuuuaaccagaggu

SEQ ID NO: 235424 - RNA, 22 nt, Homo sapiens
gugaccagaugggcaggggugu

SEQ ID NO: 235425 - RNA, 22 nt, Homo sapiens
gugagaaucaaacuacauaaau

SEQ ID NO: 235426 - RNA, 18 nt, Homo sapiens
gugagaaugacuguucug

SEQ ID NO: 235427 - RNA, 22 nt, Homo sapiens
gugagaugguaucucauugugg

SEQ ID NO: 235428 - RNA, 19 nt, Homo sapiens
gugagcacagacaauacaa

SEQ ID NO: 235429 - RNA, 22 nt, Homo sapiens
gugagcuaagcaaauaugagcc

SEQ ID NO: 235430 - RNA, 22 nt, Homo sapiens
gugagucaugucccaucugauu

SEQ ID NO: 235431 - RNA, 22 nt, Homo sapiens
gugcaaaucucugaguaucuuu

SEQ ID NO: 235432 - RNA, 22 nt, Homo sapiens
gugcaaauuccagcucaacucc

SEQ ID NO: 235433 - RNA, 18 nt, Homo sapiens
gugcaaugaauagcagag

SEQ ID NO: 235434 - RNA, 22 nt, Homo sapiens
gugcaaugaguguggcaaagcc

SEQ ID NO: 235435 - RNA, 22 nt, Homo sapiens
gugcacaugguagguauugagu

SEQ ID NO: 235436 - RNA, 22 nt, Homo sapiens
gugcagugugauccuuccguau

SEQ ID NO: 235437 - RNA, 23 nt, Homo sapiens
gugcaugagucuuuauaguagca

SEQ ID NO: 235438 - RNA, 22 nt, Homo sapiens
gugcauguccacuaguccauau

SEQ ID NO: 235439 - RNA, 22 nt, Homo sapiens
gugccacugcacuccggccugg

SEQ ID NO: 235440 - RNA, 22 nt, Homo sapiens
guggaaaauuauugcuguuuuu

SEQ ID NO: 235441 - RNA, 22 nt, Homo sapiens
guggaagcacaggccuccugga

SEQ ID NO: 235442 - RNA, 22 nt, Homo sapiens
guggaagugucuggggccaggg

SEQ ID NO: 235443 - RNA, 22 nt, Homo sapiens
guggaggacuggauaaagaaaa

SEQ ID NO: 235444 - RNA, 22 nt, Homo sapiens
guggcagaaaagagaagcaaug

SEQ ID NO: 235445 - RNA, 22 nt, Homo sapiens
guggcauuucccaaaguauucu

SEQ ID NO: 235446 - RNA, 23 nt, Homo sapiens
guggccuuuggccaguccgaguc

SEQ ID NO: 235447 - RNA, 22 nt, Homo sapiens
gugggguaggcaauuccuagug

SEQ ID NO: 235448 - RNA, 22 nt, Homo sapiens
gugggguaggguaggacucaac

SEQ ID NO: 235449 - RNA, 22 nt, Homo sapiens
gugguuguuggaguggcaauuu

SEQ ID NO: 235450 - RNA, 22 nt, Homo sapiens
gugguuuuaauauucagucuag

SEQ ID NO: 235451 - RNA, 22 nt, Homo sapiens
guguagagaaauagccugaagg

SEQ ID NO: 235452 - RNA, 22 nt, Homo sapiens
guguaugugagaaugcucaugu

SEQ ID NO: 235453 - RNA, 22 nt, Homo sapiens
guguauucaucuggcugaggua

SEQ ID NO: 235454 - RNA, 22 nt, Homo sapiens
gugugauuguuaauuuuaggug

SEQ ID NO: 235455 - RNA, 21 nt, Homo sapiens
uucuuugcucaguguuagagu

SEQ ID NO: 235456 - RNA, 22 nt, Homo sapiens
uugaaagaugaacuggauugga

SEQ ID NO: 235457 - RNA, 22 nt, Homo sapiens
uugaaauguuuagaaguuugga

SEQ ID NO: 235458 - RNA, 22 nt, Homo sapiens
uugaaggaggugcucacucucg

SEQ ID NO: 235459 - RNA, 19 nt, Homo sapiens
uugaaggccgccuugcaga

SEQ ID NO: 235460 - RNA, 22 nt, Homo sapiens
uugaaguguguauacauugugg

SEQ ID NO: 235461 - RNA, 21 nt, Homo sapiens
uugaaugguuuuccuugggag

SEQ ID NO: 235462 - RNA, 22 nt, Homo sapiens
uugacagaccuuggucauaucc

SEQ ID NO: 235463 - RNA, 22 nt, Homo sapiens
uugacugugguaauggaagcug

SEQ ID NO: 235464 - RNA, 22 nt, Homo sapiens
uugagcaaaacauuaauauuag

SEQ ID NO: 235465 - RNA, 22 nt, Homo sapiens
uugagcaccaugccuggccaug

SEQ ID NO: 235466 - RNA, 22 nt, Homo sapiens
uugagcucaucaagauagagaa

SEQ ID NO: 235467 - RNA, 22 nt, Homo sapiens
uugaggacugcuaagcauuuga

SEQ ID NO: 235468 - RNA, 22 nt, Homo sapiens
uugaggcaaugaggagaagcug

SEQ ID NO: 235469 - RNA, 23 nt, Homo sapiens
uugaggcauguaccaucaauauc

SEQ ID NO: 235470 - RNA, 22 nt, Homo sapiens
uugagggaggcagggcuugucu

SEQ ID NO: 235471 - RNA, 22 nt, Homo sapiens
uugaguuugaguauucuaaagc

SEQ ID NO: 235472 - RNA, 22 nt, Homo sapiens
uugauacuagagucuuucugac

SEQ ID NO: 235473 - RNA, 22 nt, Homo sapiens
uugauaguuuaauuaaugcuag

SEQ ID NO: 235474 - RNA, 22 nt, Homo sapiens
uugauaguuuuaaaauuaaucu

SEQ ID NO: 235475 - RNA, 22 nt, Homo sapiens
uugauauuaaguacugaagugg

SEQ ID NO: 235476 - RNA, 22 nt, Homo sapiens
uugauauuacucaguaacagau

SEQ ID NO: 235477 - RNA, 22 nt, Homo sapiens
uugaucaauagaauacaacaga

SEQ ID NO: 235478 - RNA, 22 nt, Homo sapiens
uugauguccaucucuagguaaa

SEQ ID NO: 235479 - RNA, 22 nt, Homo sapiens
uugcaacuuagaaaaaucauuu

SEQ ID NO: 235480 - RNA, 22 nt, Homo sapiens
uugcaagaaaugcagauucuca

SEQ ID NO: 235481 - RNA, 22 nt, Homo sapiens
uugcacaguguguacagcacca

SEQ ID NO: 235482 - RNA, 22 nt, Homo sapiens
uugcacauggcaggugcucaau

SEQ ID NO: 235483 - RNA, 22 nt, Homo sapiens
uugcauuagugugguacauuug

SEQ ID NO: 235484 - RNA, 22 nt, Homo sapiens
uugccaacauggugaacuccca

SEQ ID NO: 235485 - RNA, 22 nt, Homo sapiens
uugcccuuuagguaacuauaua

SEQ ID NO: 235486 - RNA, 22 nt, Homo sapiens
uugccuaggcuggaguucagug

SEQ ID NO: 235487 - RNA, 22 nt, Homo sapiens
uugcucaggcuagaguucagcu

SEQ ID NO: 235488 - RNA, 22 nt, Homo sapiens
uugcuucuuucgucuggcccca

SEQ ID NO: 235489 - RNA, 22 nt, Homo sapiens
uuggaagauuacuuaguuuucu

SEQ ID NO: 235490 - RNA, 22 nt, Homo sapiens
uuggaaguguguauguauagcu

SEQ ID NO: 235491 - RNA, 22 nt, Homo sapiens
uuggaauguacucuagccuaug

SEQ ID NO: 235492 - RNA, 22 nt, Homo sapiens
uuggagagaaaggcaguuccug

SEQ ID NO: 235493 - RNA, 22 nt, Homo sapiens
uuggagagagaggacucccggc

SEQ ID NO: 235494 - RNA, 22 nt, Homo sapiens
uuggaugauaaagaagccuaag

SEQ ID NO: 235495 - RNA, 22 nt, Homo sapiens
uuggcuguguuccucaaggagu

SEQ ID NO: 235496 - RNA, 22 nt, Homo sapiens
uugggcuuuuagguccuuaaca

SEQ ID NO: 235497 - RNA, 22 nt, Homo sapiens
uuggguccucugguccuugguu

SEQ ID NO: 235498 - RNA, 22 nt, Homo sapiens
uugguaguuucugucuuuagau

SEQ ID NO: 235499 - RNA, 22 nt, Homo sapiens
uuggucagcucaauggagaggg

SEQ ID NO: 235500 - RNA, 22 nt, Homo sapiens
uugguccccuucaaccagcugu

SEQ ID NO: 235501 - RNA, 22 nt, Homo sapiens
uugguucucuuagccaucuuaa

SEQ ID NO: 235502 - RNA, 22 nt, Homo sapiens
uuguauguugaaugaugguaua

SEQ ID NO: 235503 - RNA, 22 nt, Homo sapiens
uuguauguuguuugucagagaa

SEQ ID NO: 235504 - RNA, 22 nt, Homo sapiens
uuguauugucuugaugaguuga

SEQ ID NO: 235505 - RNA, 22 nt, Homo sapiens
uugugcaaaaguaauugcgguu

SEQ ID NO: 235506 - RNA, 22 nt, Homo sapiens
uugugcuccugugagaaucuag

SEQ ID NO: 235507 - RNA, 22 nt, Homo sapiens
uugugcuuguaacuacauucag

SEQ ID NO: 235508 - RNA, 22 nt, Homo sapiens
uugugcuuuugagcugagauga

SEQ ID NO: 235509 - RNA, 22 nt, Homo sapiens
uugugcuuuuuaaauagcuucc

SEQ ID NO: 235510 - RNA, 19 nt, Homo sapiens
uugugggaggacagagggg

SEQ ID NO: 235511 - RNA, 22 nt, Homo sapiens
uugugguuuucagcuuauauau

SEQ ID NO: 235512 - RNA, 19 nt, Homo sapiens
uuguguccccacaaaauuc

SEQ ID NO: 235513 - RNA, 22 nt, Homo sapiens
uugugucccuacccaaaucuca

SEQ ID NO: 235514 - RNA, 23 nt, Homo sapiens
uugugucccuacccaaaucucau

SEQ ID NO: 235515 - RNA, 22 nt, Homo sapiens
uuguuauguuggucaguaaugu

SEQ ID NO: 235516 - RNA, 22 nt, Homo sapiens
uuguucccuucuggcuuuuaug

SEQ ID NO: 235517 - RNA, 22 nt, Homo sapiens
uuuaauguuacaguauugguau

SEQ ID NO: 235518 - RNA, 22 nt, Homo sapiens
uuuagcagcaaagagcuguguu

SEQ ID NO: 235519 - RNA, 22 nt, Homo sapiens
uuucaacaggucuggggugguc

SEQ ID NO: 235520 - RNA, 22 nt, Homo sapiens
uuucaucaagcacagaguagau

SEQ ID NO: 235521 - RNA, 22 nt, Homo sapiens
uuucauggaauauagucauuuu

SEQ ID NO: 235522 - RNA, 22 nt, Homo sapiens
uuucauggaggcauuuuagauu

SEQ ID NO: 235523 - RNA, 22 nt, Homo sapiens
uuucauggcgaggcuucauggg

SEQ ID NO: 235524 - RNA, 22 nt, Homo sapiens
uuucccauuguucugcucugug

SEQ ID NO: 235525 - RNA, 22 nt, Homo sapiens
uuuccuguagggggcaaggccu

SEQ ID NO: 235526 - RNA, 22 nt, Homo sapiens
uuugaguaggcuuauauuuugg

SEQ ID NO: 235527 - RNA, 23 nt, Homo sapiens
uuugagugugauaaacacuguca

SEQ ID NO: 235528 - RNA, 22 nt, Homo sapiens
uuuggaaugaaacagcagagcc

SEQ ID NO: 235529 - RNA, 22 nt, Homo sapiens
uuugggccauggcuuuuccacg

SEQ ID NO: 235530 - RNA, 18 nt, Homo sapiens
uuugguccuuuauaaaca

SEQ ID NO: 235531 - RNA, 22 nt, Homo sapiens
uuuguacacuguugguaggauu

SEQ ID NO: 235532 - RNA, 22 nt, Homo sapiens
uuuguacacuguuggugguuau

SEQ ID NO: 235533 - RNA, 22 nt, Homo sapiens
uuugucacccugaauguaagau

SEQ ID NO: 235534 - RNA, 22 nt, Homo sapiens
uuugucccuuugcaguggcaca

SEQ ID NO: 235535 - RNA, 19 nt, Homo sapiens
uuuguccugcccuuucuca

SEQ ID NO: 235536 - RNA, 22 nt, Homo sapiens
uuugugagguggauagauugca

SEQ ID NO: 235537 - RNA, 22 nt, Homo sapiens
uuugugcugcaauuaauuuccc

SEQ ID NO: 235538 - RNA, 22 nt, Homo sapiens
uuuguucuucguuccugagcca

SEQ ID NO: 235539 - RNA, 22 nt, Homo sapiens
uuuuacacuguugguuggaaug

SEQ ID NO: 235540 - RNA, 22 nt, Homo sapiens
uuuuacagaggagguugcugau

SEQ ID NO: 235541 - RNA, 22 nt, Homo sapiens
uuuuaguggaauauuuacaguu

SEQ ID NO: 235542 - RNA, 22 nt, Homo sapiens
uuuucaguuuuccagguagccg

SEQ ID NO: 235543 - RNA, 19 nt, Homo sapiens
uuuuccccuuucuuaagac

SEQ ID NO: 235544 - RNA, 22 nt, Homo sapiens
caggcagucuggcucccaagug

SEQ ID NO: 235545 - RNA, 22 nt, Homo sapiens
cagggaauguuauuuaauagca

SEQ ID NO: 235546 - RNA, 22 nt, Homo sapiens
cagguaguauuugguuacauaa

SEQ ID NO: 235547 - RNA, 22 nt, Homo sapiens
cagugcauaggaucuaaaauuu

SEQ ID NO: 235548 - RNA, 22 nt, Homo sapiens
cagugucugcauuuggaacuca

SEQ ID NO: 235549 - RNA, 21 nt, Homo sapiens
cauaaugcuacuuauuuuaug

SEQ ID NO: 235550 - RNA, 22 nt, Homo sapiens
cauacaugugcuugucuuaugc

SEQ ID NO: 235551 - RNA, 22 nt, Homo sapiens
cauagcacugagcucuacccuc

SEQ ID NO: 235552 - RNA, 22 nt, Homo sapiens
caucacacuuggauguaagaca

SEQ ID NO: 235553 - RNA, 21 nt, Homo sapiens
caucacauuacucaaaguccu

SEQ ID NO: 235554 - RNA, 22 nt, Homo sapiens
caucccugaaccccagaaaucu

SEQ ID NO: 235555 - RNA, 19 nt, Homo sapiens
caucccugagcugaagugg

SEQ ID NO: 235556 - RNA, 22 nt, Homo sapiens
caugccacugcacgccauccug

SEQ ID NO: 235557 - RNA, 22 nt, Homo sapiens
caugccauugcucuccugggug

SEQ ID NO: 235558 - RNA, 22 nt, Homo sapiens
cauggcccuggguccauaggaa

SEQ ID NO: 235559 - RNA, 22 nt, Homo sapiens
caugggacugucuuggcuauac

SEQ ID NO: 235560 - RNA, 22 nt, Homo sapiens
cauugcacuccagccuagccaa

SEQ ID NO: 235561 - RNA, 22 nt, Homo sapiens
cauugcacuccagccugaguga

SEQ ID NO: 235562 - RNA, 20 nt, Homo sapiens
cauugcacuccagccugcug

SEQ ID NO: 235563 - RNA, 22 nt, Homo sapiens
cauugcacuccagccugcugac

SEQ ID NO: 235564 - RNA, 22 nt, Homo sapiens
cauugcacuccagccuuggcaa

SEQ ID NO: 235565 - RNA, 22 nt, Homo sapiens
cauugcacucuagucuggguga

SEQ ID NO: 235566 - RNA, 22 nt, Homo sapiens
cauugcacucugcauuccaguc

SEQ ID NO: 235567 - RNA, 22 nt, Homo sapiens
cauugcacugcauucugggcaa

SEQ ID NO: 235568 - RNA, 22 nt, Homo sapiens
cauugcaguggaguggggaaga

SEQ ID NO: 235569 - RNA, 22 nt, Homo sapiens
cauuuugguuaaauagguagcu

SEQ ID NO: 235570 - RNA, 22 nt, Homo sapiens
ccaaaguauuuucacugauauc

SEQ ID NO: 235571 - RNA, 22 nt, Homo sapiens
ccaaggaauacccucccuuuuu

SEQ ID NO: 235572 - RNA, 22 nt, Homo sapiens
ccaagugcuuaaaauuucauuu

SEQ ID NO: 235573 - RNA, 22 nt, Homo sapiens
ccagugaacugcaagguuuuuc

SEQ ID NO: 235574 - RNA, 21 nt, Homo sapiens
ccaugggacggaaugaauaca

SEQ ID NO: 235575 - RNA, 22 nt, Homo sapiens
ccccauuugaacuccuucaacu

SEQ ID NO: 235576 - RNA, 22 nt, Homo sapiens
cccugagagcagggucuuucuc

SEQ ID NO: 235577 - RNA, 22 nt, Homo sapiens
cccuggacauucaucauuaugu

SEQ ID NO: 235578 - RNA, 22 nt, Homo sapiens
cccuguguuuagcugaagguuu

SEQ ID NO: 235579 - RNA, 22 nt, Homo sapiens
ccuaggcacugggguccagccc

SEQ ID NO: 235580 - RNA, 22 nt, Homo sapiens
ccucccuuuguugcaagggaaa

SEQ ID NO: 235581 - RNA, 22 nt, Homo sapiens
ccuguguuaugguuucuaaugu

SEQ ID NO: 235582 - RNA, 22 nt, Homo sapiens
ccuugguaauguguuuuauucu

SEQ ID NO: 235583 - RNA, 22 nt, Homo sapiens
cgaggaguaucuuugugguguu

SEQ ID NO: 235584 - RNA, 22 nt, Homo sapiens
cuaaagauagugacaugauuug

SEQ ID NO: 235585 - RNA, 22 nt, Homo sapiens
cuaagugaacugucacugagaa

SEQ ID NO: 235586 - RNA, 22 nt, Homo sapiens
cuaagugaguauaauuuuaaga

SEQ ID NO: 235587 - RNA, 22 nt, Homo sapiens
cuaauacaguuguccaagcugg

SEQ ID NO: 235588 - RNA, 18 nt, Homo sapiens
cuaauacuauucaacaag

SEQ ID NO: 235589 - RNA, 22 nt, Homo sapiens
cuaaucugugcauagaagaggc

SEQ ID NO: 235590 - RNA, 22 nt, Homo sapiens
cuaauucuguaccuggcacaua

SEQ ID NO: 235591 - RNA, 22 nt, Homo sapiens
cuacaguuauguuuuaaaugug

SEQ ID NO: 235592 - RNA, 22 nt, Homo sapiens
cuacaguucuuaauuaaguagu

SEQ ID NO: 235593 - RNA, 21 nt, Homo sapiens
cuacccuguauuagagaaaga

SEQ ID NO: 235594 - RNA, 22 nt, Homo sapiens
cuagagagaagcugugugaccu

SEQ ID NO: 235595 - RNA, 22 nt, Homo sapiens
cuauauacugccugcugauuag

SEQ ID NO: 235596 - RNA, 22 nt, Homo sapiens
cuaugcauuuuggaggagggaa

SEQ ID NO: 235597 - RNA, 22 nt, Homo sapiens
cuaugcuuucugggcccugggu

SEQ ID NO: 235598 - RNA, 19 nt, Homo sapiens
cuauugcacauagcugaag

SEQ ID NO: 235599 - RNA, 22 nt, Homo sapiens
cucagguaguuccuuauagcaa

SEQ ID NO: 235600 - RNA, 22 nt, Homo sapiens
cucaguagaaaauacauggacu

SEQ ID NO: 235601 - RNA, 22 nt, Homo sapiens
cucauggauggucuggcagcca

SEQ ID NO: 235602 - RNA, 22 nt, Homo sapiens
cuccauuuaucugaaauuuuau

SEQ ID NO: 235603 - RNA, 20 nt, Homo sapiens
cucuaguaauaaaguuuccc

SEQ ID NO: 235604 - RNA, 22 nt, Homo sapiens
cucugguucugcagugcacccu

SEQ ID NO: 235605 - RNA, 22 nt, Homo sapiens
cucuuuuguuccuaguuugauc

SEQ ID NO: 235606 - RNA, 22 nt, Homo sapiens
cucuuuuguuuagcugagaggg

SEQ ID NO: 235607 - RNA, 22 nt, Homo sapiens
cugacuaguuuuaaugcagauu

SEQ ID NO: 235608 - RNA, 22 nt, Homo sapiens
cugagaauguaaaugaagcuuu

SEQ ID NO: 235609 - RNA, 22 nt, Homo sapiens
cugaggucugaauccagguauc

SEQ ID NO: 235610 - RNA, 22 nt, Homo sapiens
cugauaaguuuuucuuuauaag

SEQ ID NO: 235611 - RNA, 22 nt, Homo sapiens
cugauguagguggucugugauc

SEQ ID NO: 235612 - RNA, 22 nt, Homo sapiens
cugauuguuugccucuaaaauc

SEQ ID NO: 235613 - RNA, 22 nt, Homo sapiens
aaaagagcugagagguauucuu

SEQ ID NO: 235614 - RNA, 22 nt, Homo sapiens
aaagaguucagguagauuucaa

SEQ ID NO: 235615 - RNA, 22 nt, Homo sapiens
aaagcugucaaggcaggaggcu

SEQ ID NO: 235616 - RNA, 22 nt, Homo sapiens
aaaggauucuaauggaaaugcu

SEQ ID NO: 235617 - RNA, 22 nt, Homo sapiens
aaaggcuucggaucagaaggua

SEQ ID NO: 235618 - RNA, 22 nt, Homo sapiens
aaagucacuggagaaggaauau

SEQ ID NO: 235619 - RNA, 17 nt, Homo sapiens
aaaguccuuugcuaucu

SEQ ID NO: 235620 - RNA, 22 nt, Homo sapiens
aaagugcuaggauuaccugggg

SEQ ID NO: 235621 - RNA, 22 nt, Homo sapiens
agaaccauuagagggagauauu

SEQ ID NO: 235622 - RNA, 22 nt, Homo sapiens
agaagaacauagggugacugaa

SEQ ID NO: 235623 - RNA, 22 nt, Homo sapiens
agaauacugucuauucauggua

SEQ ID NO: 235624 - RNA, 19 nt, Homo sapiens
agaaucuaaauuauuucug

SEQ ID NO: 235625 - RNA, 22 nt, Homo sapiens
agacuagagcagagcccucucu

SEQ ID NO: 235626 - RNA, 22 nt, Homo sapiens
agagauaauuagguuaaaugag

SEQ ID NO: 235627 - RNA, 22 nt, Homo sapiens
agagauacauucugagaagugc

SEQ ID NO: 235628 - RNA, 22 nt, Homo sapiens
agagguuuaauugauucacagu

SEQ ID NO: 235629 - RNA, 20 nt, Homo sapiens
agagguuuugauagguucug

SEQ ID NO: 235630 - RNA, 22 nt, Homo sapiens
agagugaagcuuuuuauauucu

SEQ ID NO: 235631 - RNA, 22 nt, Homo sapiens
agagugcaaagguuggggcugg

SEQ ID NO: 235632 - RNA, 20 nt, Homo sapiens
agagugcugucuguccugag

SEQ ID NO: 235633 - RNA, 22 nt, Homo sapiens
agauauuuguuaggucugucag

SEQ ID NO: 235634 - RNA, 22 nt, Homo sapiens
agaugcuguuaucaacuguagc

SEQ ID NO: 235635 - RNA, 22 nt, Homo sapiens
agaugguguuggcugaguguau

SEQ ID NO: 235636 - RNA, 22 nt, Homo sapiens
agcaagaugaaguugagcuagg

SEQ ID NO: 235637 - RNA, 22 nt, Homo sapiens
agcacagccuuguguuuucuug

SEQ ID NO: 235638 - RNA, 22 nt, Homo sapiens
agcagcaugaggggacuucugc

SEQ ID NO: 235639 - RNA, 22 nt, Homo sapiens
agcaguagugaaaguagacuua

SEQ ID NO: 235640 - RNA, 22 nt, Homo sapiens
agcaucacaugggcugcuuggg

SEQ ID NO: 235641 - RNA, 22 nt, Homo sapiens
agcauggucacuuugggcccca

SEQ ID NO: 235642 - RNA, 21 nt, Homo sapiens
agccugugggucauaguugcc

SEQ ID NO: 235643 - RNA, 22 nt, Homo sapiens
agcuaaaucucauguugaauug

SEQ ID NO: 235644 - RNA, 21 nt, Homo sapiens
agcuaaauuggaaauuucugu

SEQ ID NO: 235645 - RNA, 22 nt, Homo sapiens
agcuccuuugcuuuuuccagga

SEQ ID NO: 235646 - RNA, 20 nt, Homo sapiens
agcugcagauauaaauccgc

SEQ ID NO: 235647 - RNA, 22 nt, Homo sapiens
agcuguuguuuuaagauacuaa

SEQ ID NO: 235648 - RNA, 22 nt, Homo sapiens
agcuuuuugggaggccuuagga

SEQ ID NO: 235649 - RNA, 22 nt, Homo sapiens
aggaagacauauagaacuaaaa

SEQ ID NO: 235650 - RNA, 16 nt, Homo sapiens
aggaagacuuagagau

SEQ ID NO: 235651 - RNA, 22 nt, Homo sapiens
aggaagcuagcauuuguucagu

SEQ ID NO: 235652 - RNA, 22 nt, Homo sapiens
aggaccaugguauugcuuuggg

SEQ ID NO: 235653 - RNA, 22 nt, Homo sapiens
aggaccccucaucagcaccagu

SEQ ID NO: 235654 - RNA, 22 nt, Homo sapiens
aggcaacaugguaaaacccugu

SEQ ID NO: 235655 - RNA, 22 nt, Homo sapiens
aggcaagaaugcuuguuucacc

SEQ ID NO: 235656 - RNA, 22 nt, Homo sapiens
aggcaaguugcucaaaugcaaa

SEQ ID NO: 235657 - RNA, 22 nt, Homo sapiens
aggcaggugaaagauaguuuua

SEQ ID NO: 235658 - RNA, 22 nt, Homo sapiens
aggcuguguggauaauauuggg

SEQ ID NO: 235659 - RNA, 22 nt, Homo sapiens
agggagcaaaguggucuuucuc

SEQ ID NO: 235660 - RNA, 23 nt, Homo sapiens
agggcacuauagauguuauucua

SEQ ID NO: 235661 - RNA, 22 nt, Homo sapiens
aggguuuuuauuuauguggcau

SEQ ID NO: 235662 - RNA, 22 nt, Homo sapiens
aggugcugagcagagaauccug

SEQ ID NO: 235663 - RNA, 18 nt, Homo sapiens
agguuauuucccaagacu

SEQ ID NO: 235664 - RNA, 22 nt, Homo sapiens
aguaacaggauccaaagaaugu

SEQ ID NO: 235665 - RNA, 22 nt, Homo sapiens
aguaacauuucuaguagagagu

SEQ ID NO: 235666 - RNA, 22 nt, Homo sapiens
agucaagauggcaagguaaggc

SEQ ID NO: 235667 - RNA, 22 nt, Homo sapiens
agucagugcauaagaaugaagu

SEQ ID NO: 235668 - RNA, 22 nt, Homo sapiens
agucaguggaguaaauguaauu

SEQ ID NO: 235669 - RNA, 22 nt, Homo sapiens
agucauggaucacaguagccuc

SEQ ID NO: 235670 - RNA, 22 nt, Homo sapiens
aguccauuugaugaugauucca

SEQ ID NO: 235671 - RNA, 22 nt, Homo sapiens
agugaaaucugaagaaggucau

SEQ ID NO: 235672 - RNA, 22 nt, Homo sapiens
agugaacaaagaagugcagaua

SEQ ID NO: 235673 - RNA, 22 nt, Homo sapiens
agugcaaggacauuuagguugu

SEQ ID NO: 235674 - RNA, 19 nt, Homo sapiens
aguggguguuuucuguuug

SEQ ID NO: 235675 - RNA, 22 nt, Homo sapiens
agugguuugaucacagcucacu

SEQ ID NO: 235676 - RNA, 22 nt, Homo sapiens
auaaaccuacauuuucacuucu

SEQ ID NO: 235677 - RNA, 22 nt, Homo sapiens
auaaagacacuuggcaugauuu

SEQ ID NO: 235678 - RNA, 22 nt, Homo sapiens
auaaaguguuuaguauaggcaa

SEQ ID NO: 235679 - RNA, 19 nt, Homo sapiens
auaaaugccuacaagggug

SEQ ID NO: 235680 - RNA, 22 nt, Homo sapiens
auaaauucauuuaagcuccuua

SEQ ID NO: 235681 - RNA, 22 nt, Homo sapiens
auaacagcugcaaggcaaaagc

SEQ ID NO: 235682 - RNA, 19 nt, Homo sapiens
auaagugaaucacgggggc

SEQ ID NO: 235683 - RNA, 22 nt, Homo sapiens
auaauacuuuuauuuugaggaa

SEQ ID NO: 235684 - RNA, 22 nt, Homo sapiens
auaaugacuuccaguuccacuc

SEQ ID NO: 235685 - RNA, 22 nt, Homo sapiens
auacacauuccugggccucacc

SEQ ID NO: 235686 - RNA, 22 nt, Homo sapiens
auacacgguaggcacauauuua

SEQ ID NO: 235687 - RNA, 22 nt, Homo sapiens
auacaguguauguauaguacau

SEQ ID NO: 235688 - RNA, 22 nt, Homo sapiens
auacaguugccauuucuugugc

SEQ ID NO: 235689 - RNA, 22 nt, Homo sapiens
auagcugcucaggcuuuccuca

SEQ ID NO: 235690 - RNA, 22 nt, Homo sapiens
auagguauuuuuaaaugacugu

SEQ ID NO: 235691 - RNA, 22 nt, Homo sapiens
auaggucaucaugggaguggga

SEQ ID NO: 235692 - RNA, 22 nt, Homo sapiens
auaugcauacauguaugcagga

SEQ ID NO: 235693 - RNA, 22 nt, Homo sapiens
auaugcuuauuagcaagaaaua

SEQ ID NO: 235694 - RNA, 22 nt, Homo sapiens
ugguaccuuuuaaugacuaauu

SEQ ID NO: 235695 - RNA, 22 nt, Homo sapiens
uggucccucugaaaauugggug

SEQ ID NO: 235696 - RNA, 17 nt, Homo sapiens
auaugucugcuggggga

SEQ ID NO: 235697 - RNA, 22 nt, Homo sapiens
auaugucuuaguuaccuugggc

SEQ ID NO: 235698 - RNA, 22 nt, Homo sapiens
auauuagcacuaaugucacgau

SEQ ID NO: 235699 - RNA, 22 nt, Homo sapiens
auauucaagugaggauggcuaa

SEQ ID NO: 235700 - RNA, 22 nt, Homo sapiens
auauucacagguaucagagauu

SEQ ID NO: 235701 - RNA, 22 nt, Homo sapiens
aucaaaugcuggcagagugccu

SEQ ID NO: 235702 - RNA, 22 nt, Homo sapiens
aucaaguaguuauacguaaagg

SEQ ID NO: 235703 - RNA, 22 nt, Homo sapiens
aucacagagucacgggcaacuu

SEQ ID NO: 235704 - RNA, 22 nt, Homo sapiens
aucacagaguuaaaacuuucuu

SEQ ID NO: 235705 - RNA, 22 nt, Homo sapiens
aucacagcccuccucuuggaug

SEQ ID NO: 235706 - RNA, 22 nt, Homo sapiens
aucacagugagcauaugucuau

SEQ ID NO: 235707 - RNA, 22 nt, Homo sapiens
aucacuagaucauagguaaaca

SEQ ID NO: 235708 - RNA, 22 nt, Homo sapiens
aucacuaugcaggugucucggg

SEQ ID NO: 235709 - RNA, 22 nt, Homo sapiens
aucacuguaaguuuacacuuug

SEQ ID NO: 235710 - RNA, 20 nt, Homo sapiens
aucagagacuaggauugcca

SEQ ID NO: 235711 - RNA, 22 nt, Homo sapiens
aucaucaugcacuacagccugg

SEQ ID NO: 235712 - RNA, 22 nt, Homo sapiens
aucauguuuauguguaggauau

SEQ ID NO: 235713 - RNA, 22 nt, Homo sapiens
auccaucagacggcaggcguug

SEQ ID NO: 235714 - RNA, 22 nt, Homo sapiens
agaguaguaggaugaauggacu

SEQ ID NO: 235715 - RNA, 19 nt, Homo sapiens
agaguauuguuacuucucu

SEQ ID NO: 235716 - RNA, 22 nt, Homo sapiens
agagugcuuuauuagauguagc

SEQ ID NO: 235717 - RNA, 22 nt, Homo sapiens
agaugauguuuacugagcauca

SEQ ID NO: 235718 - RNA, 22 nt, Homo sapiens
agauggguuuucacauguuggc

SEQ ID NO: 235719 - RNA, 22 nt, Homo sapiens
agauggugauaaaugugguacc

SEQ ID NO: 235720 - RNA, 22 nt, Homo sapiens
agcagcauuaguggaaucuugu

SEQ ID NO: 235721 - RNA, 22 nt, Homo sapiens
agcagcucaagacuuaaauuug

SEQ ID NO: 235722 - RNA, 22 nt, Homo sapiens
agcaucauguuuucgagguuca

SEQ ID NO: 235723 - RNA, 21 nt, Homo sapiens
agccaguguuccuuguggcuc

SEQ ID NO: 235724 - RNA, 20 nt, Homo sapiens
agccccauguaaaccacaug

SEQ ID NO: 235725 - RNA, 22 nt, Homo sapiens
agcuggauguauguuaagugaa

SEQ ID NO: 235726 - RNA, 20 nt, Homo sapiens
agcuguuguuaaaaaggagg

SEQ ID NO: 235727 - RNA, 22 nt, Homo sapiens
agcuguuguucucagaggcuuu

SEQ ID NO: 235728 - RNA, 22 nt, Homo sapiens
aggaagacugaaauugcuguuc

SEQ ID NO: 235729 - RNA, 21 nt, Homo sapiens
aggcaagacuuuuagguuugu

SEQ ID NO: 235730 - RNA, 22 nt, Homo sapiens
aggcagcuguuauauacugagu

SEQ ID NO: 235731 - RNA, 22 nt, Homo sapiens
aggcaugugugcagacugucug

SEQ ID NO: 235732 - RNA, 22 nt, Homo sapiens
aggcuuuauuacagggucucag

SEQ ID NO: 235733 - RNA, 22 nt, Homo sapiens
agggcuuuugagcugagauggu

SEQ ID NO: 235734 - RNA, 22 nt, Homo sapiens
agguauguauguaugggagaaa

SEQ ID NO: 235735 - RNA, 22 nt, Homo sapiens
aggugcuugagggaagaaauua

SEQ ID NO: 235736 - RNA, 22 nt, Homo sapiens
agguuguguuugugauuagaua

SEQ ID NO: 235737 - RNA, 22 nt, Homo sapiens
aguaaagccagaccuguuaauu

SEQ ID NO: 235738 - RNA, 22 nt, Homo sapiens
aguauguagugcaaucagucag

SEQ ID NO: 235739 - RNA, 22 nt, Homo sapiens
aguauugcuaauaagagauuug

SEQ ID NO: 235740 - RNA, 20 nt, Homo sapiens
agucaguuuauuuucucucu

SEQ ID NO: 235741 - RNA, 22 nt, Homo sapiens
agugagcuggagaaaagaaacu

SEQ ID NO: 235742 - RNA, 22 nt, Homo sapiens
agugcacucuuuccucucuuac

SEQ ID NO: 235743 - RNA, 22 nt, Homo sapiens
agugcauuuguucugugucagg

SEQ ID NO: 235744 - RNA, 22 nt, Homo sapiens
agugccaaaucgagggcucuga

SEQ ID NO: 235745 - RNA, 22 nt, Homo sapiens
aguggaauuaagaaacugaauu

SEQ ID NO: 235746 - RNA, 22 nt, Homo sapiens
aguggcacaauuuugacucccc

SEQ ID NO: 235747 - RNA, 22 nt, Homo sapiens
agugggccccuagaggugaggu

SEQ ID NO: 235748 - RNA, 22 nt, Homo sapiens
agugguuuuaaguagagcauac

SEQ ID NO: 235749 - RNA, 22 nt, Homo sapiens
aguuuugguugaguuacuagca

SEQ ID NO: 235750 - RNA, 22 nt, Homo sapiens
auaagugagugauucaguguua

SEQ ID NO: 235751 - RNA, 22 nt, Homo sapiens
auaauguuuauccagaggaguu

SEQ ID NO: 235752 - RNA, 22 nt, Homo sapiens
auacaugugcaggucagguuac

SEQ ID NO: 235753 - RNA, 22 nt, Homo sapiens
auacuaugagauaauaaagacu

SEQ ID NO: 235754 - RNA, 22 nt, Homo sapiens
auacuguacugaaguacccauu

SEQ ID NO: 235755 - RNA, 22 nt, Homo sapiens
auacugucucuugcuccugccc

SEQ ID NO: 235756 - RNA, 22 nt, Homo sapiens
auagaucauugucauuuuagau

SEQ ID NO: 235757 - RNA, 22 nt, Homo sapiens
auagcagcaccccacuaccuca

SEQ ID NO: 235758 - RNA, 22 nt, Homo sapiens
auagggcacgagaugugagccu

SEQ ID NO: 235759 - RNA, 19 nt, Homo sapiens
auaguguaggaaaacagcu

SEQ ID NO: 235760 - RNA, 22 nt, Homo sapiens
auaucaaggccauuuucuaaau

SEQ ID NO: 235761 - RNA, 22 nt, Homo sapiens
auaucacaaacaagucuguacu

SEQ ID NO: 235762 - RNA, 22 nt, Homo sapiens
auaugcacgugcauacacacuu

SEQ ID NO: 235763 - RNA, 22 nt, Homo sapiens
auaugcacuauacacacguaua

SEQ ID NO: 235764 - RNA, 22 nt, Homo sapiens
auaugcauguacccacacaggc

SEQ ID NO: 235765 - RNA, 22 nt, Homo sapiens
auauguauuuuaacguguaagg

SEQ ID NO: 235766 - RNA, 22 nt, Homo sapiens
auauguucucauucauaugugg

SEQ ID NO: 235767 - RNA, 22 nt, Homo sapiens
auauuguacugcuacugguucu

SEQ ID NO: 235768 - RNA, 22 nt, Homo sapiens
aucaaaguaggcauauguuuuu

SEQ ID NO: 235769 - RNA, 22 nt, Homo sapiens
aucaagcugcuuguuugaaucu

SEQ ID NO: 235770 - RNA, 22 nt, Homo sapiens
aucaagguaggacuugaacccu

SEQ ID NO: 235771 - RNA, 22 nt, Homo sapiens
aucacagauauggguuuaaauc

SEQ ID NO: 235772 - RNA, 22 nt, Homo sapiens
aucacauuuauaguggcacgca

SEQ ID NO: 235773 - RNA, 19 nt, Homo sapiens
aucaccauuauuuggaaca

SEQ ID NO: 235774 - RNA, 22 nt, Homo sapiens
aucacugggcaagauaucauga

SEQ ID NO: 235775 - RNA, 22 nt, Homo sapiens
aucacugugauuucuacugugc

SEQ ID NO: 235776 - RNA, 22 nt, Homo sapiens
aucagauuccacauuuuaucag

SEQ ID NO: 235777 - RNA, 22 nt, Homo sapiens
aucagcagcaugaaaagcaacu

SEQ ID NO: 235778 - RNA, 18 nt, Homo sapiens
aucagggugaagagagga

SEQ ID NO: 235779 - RNA, 22 nt, Homo sapiens
aucauguaguaagacacauuua

SEQ ID NO: 235780 - RNA, 22 nt, Homo sapiens
auccacaugcaguuggaaacag

SEQ ID NO: 235781 - RNA, 22 nt, Homo sapiens
auccacauucauggaccagucc

SEQ ID NO: 235782 - RNA, 22 nt, Homo sapiens
auccauguggauaaauguguau

SEQ ID NO: 235783 - RNA, 22 nt, Homo sapiens
aucccagaaacucggguuucuc

SEQ ID NO: 235784 - RNA, 22 nt, Homo sapiens
aucccuuucugauacuuucccu

SEQ ID NO: 235785 - RNA, 22 nt, Homo sapiens
auccucugagagaguuucauaa

SEQ ID NO: 235786 - RNA, 22 nt, Homo sapiens
aucucaguucaggcuggccaca

SEQ ID NO: 235787 - RNA, 22 nt, Homo sapiens
aucugcauucccauguuuauug

SEQ ID NO: 235788 - RNA, 19 nt, Homo sapiens
aucuggaguuccuggggcu

SEQ ID NO: 235789 - RNA, 22 nt, Homo sapiens
aucugguguauuggugcugggu

SEQ ID NO: 235790 - RNA, 23 nt, Homo sapiens
augaaagcccuugcaaaugcugg

SEQ ID NO: 235791 - RNA, 22 nt, Homo sapiens
augaaauguaugagucuggguu

SEQ ID NO: 235792 - RNA, 22 nt, Homo sapiens
augaaugcuuuuggauguaucu

SEQ ID NO: 235793 - RNA, 22 nt, Homo sapiens
augacugucagggcagucauug

SEQ ID NO: 235794 - RNA, 19 nt, Homo sapiens
augagaacagacuccauuu

SEQ ID NO: 235795 - RNA, 22 nt, Homo sapiens
augagaaugaagccuggcgugu

SEQ ID NO: 235796 - RNA, 22 nt, Homo sapiens
augagagcaacaccuucacuug

SEQ ID NO: 235797 - RNA, 22 nt, Homo sapiens
augagcaaagagaugagacccu

SEQ ID NO: 235798 - RNA, 22 nt, Homo sapiens
augaggaagucaggcccagggg

SEQ ID NO: 235799 - RNA, 22 nt, Homo sapiens
augaggauagguuucuauuagg

SEQ ID NO: 235800 - RNA, 22 nt, Homo sapiens
augagggagggguggugccgca

SEQ ID NO: 235801 - RNA, 22 nt, Homo sapiens
augauacuguucuaagauuuuu

SEQ ID NO: 235802 - RNA, 22 nt, Homo sapiens
augauauggucacccuuaugaa

SEQ ID NO: 235803 - RNA, 22 nt, Homo sapiens
augaugcaguacuuugggaaca

SEQ ID NO: 235804 - RNA, 18 nt, Homo sapiens
auuuuugcaguccacaug

SEQ ID NO: 235805 - RNA, 22 nt, Homo sapiens
caaaguaauuacgguuuuggcc

SEQ ID NO: 235806 - RNA, 22 nt, Homo sapiens
caaagugguuuauacaugauug

SEQ ID NO: 235807 - RNA, 22 nt, Homo sapiens
caacucuguaggauccaggugg

SEQ ID NO: 235808 - RNA, 22 nt, Homo sapiens
caaggaauucucaauagaguua

SEQ ID NO: 235809 - RNA, 22 nt, Homo sapiens
caagugaauaguugcucucaga

SEQ ID NO: 235810 - RNA, 21 nt, Homo sapiens
caauggcacaaucucugcuca

SEQ ID NO: 235811 - RNA, 22 nt, Homo sapiens
cacaaaguagauuagucuucca

SEQ ID NO: 235812 - RNA, 22 nt, Homo sapiens
cacacugucuucauuacuguag

SEQ ID NO: 235813 - RNA, 22 nt, Homo sapiens
cacagaauucauuggauuaccu

SEQ ID NO: 235814 - RNA, 22 nt, Homo sapiens
cacauguuugcuacauuuuucu

SEQ ID NO: 235815 - RNA, 22 nt, Homo sapiens
cacauguuuuagcauggcuguu

SEQ ID NO: 235816 - RNA, 22 nt, Homo sapiens
cacugcacuccaguuuggauga

SEQ ID NO: 235817 - RNA, 22 nt, Homo sapiens
cacugggugccauauguuugcu

SEQ ID NO: 235818 - RNA, 23 nt, Homo sapiens
cagcuucauugaacauaacuccu

SEQ ID NO: 235819 - RNA, 22 nt, Homo sapiens
caggcagucuggggguguaucc

SEQ ID NO: 235820 - RNA, 22 nt, Homo sapiens
caggcuuuuccacacauggguu

SEQ ID NO: 235821 - RNA, 22 nt, Homo sapiens
caguaaauaucugagcgagguc

SEQ ID NO: 235822 - RNA, 22 nt, Homo sapiens
caguacaauguggaaaaggagu

SEQ ID NO: 235823 - RNA, 23 nt, Homo sapiens
cagugcaugacuguauaugcaaa

SEQ ID NO: 235824 - RNA, 22 nt, Homo sapiens
cauacaagcuacaaucacaaag

SEQ ID NO: 235825 - RNA, 22 nt, Homo sapiens
cauagcacugcacuucagccug

SEQ ID NO: 235826 - RNA, 22 nt, Homo sapiens
caucacagcaaguagggagugg

SEQ ID NO: 235827 - RNA, 22 nt, Homo sapiens
caucccugucgucaagucucug

SEQ ID NO: 235828 - RNA, 22 nt, Homo sapiens
caugcauuggucuauuauguga

SEQ ID NO: 235829 - RNA, 22 nt, Homo sapiens
cauggcacagagaauguguucu

SEQ ID NO: 235830 - RNA, 22 nt, Homo sapiens
cauggcacugagcagguaugca

SEQ ID NO: 235831 - RNA, 22 nt, Homo sapiens
cauggcacuggugggagugucu

SEQ ID NO: 235832 - RNA, 22 nt, Homo sapiens
caugucuuuuauucugugugau

SEQ ID NO: 235833 - RNA, 22 nt, Homo sapiens
cauugcacacauuuaccuaugu

SEQ ID NO: 235834 - RNA, 22 nt, Homo sapiens
cauugcacuccagcccagguga

SEQ ID NO: 235835 - RNA, 22 nt, Homo sapiens
cauugcacuccagccuaggcaa

SEQ ID NO: 235836 - RNA, 22 nt, Homo sapiens
cauugcacuccagccugaccaa

SEQ ID NO: 235837 - RNA, 22 nt, Homo sapiens
cauugcacuccagcucugggcg

SEQ ID NO: 235838 - RNA, 20 nt, Homo sapiens
cauugcacuccagcuugggc

SEQ ID NO: 235839 - RNA, 22 nt, Homo sapiens
cauugcacuccagucugggcaa

SEQ ID NO: 235840 - RNA, 22 nt, Homo sapiens
cauugcacucuaucccgguggg

SEQ ID NO: 235841 - RNA, 22 nt, Homo sapiens
cauugcacugcuucuugggugu

SEQ ID NO: 235842 - RNA, 22 nt, Homo sapiens
cauugcagauccuucaaaugac

SEQ ID NO: 235843 - RNA, 22 nt, Homo sapiens
cauugcaguaagagugggcucu

SEQ ID NO: 235844 - RNA, 22 nt, Homo sapiens
cauugcaugcauauggcuuggu

SEQ ID NO: 235845 - RNA, 22 nt, Homo sapiens
ccaagccucaguuucccucugu

SEQ ID NO: 235846 - RNA, 22 nt, Homo sapiens
ccaaggcacugauucuguacuc

SEQ ID NO: 235847 - RNA, 22 nt, Homo sapiens
aaaagucuguagugaaagguga

SEQ ID NO: 235848 - RNA, 22 nt, Homo sapiens
aaacugaucugaaggccaggcu

SEQ ID NO: 235849 - RNA, 22 nt, Homo sapiens
aaagagaucuaugggcacuaug

SEQ ID NO: 235850 - RNA, 22 nt, Homo sapiens
aaagugaauguaucccguaagu

SEQ ID NO: 235851 - RNA, 22 nt, Homo sapiens
aaagugcugggaucacacugaa

SEQ ID NO: 235852 - RNA, 22 nt, Homo sapiens
aaaugcauaucaagauugcccu

SEQ ID NO: 235853 - RNA, 22 nt, Homo sapiens
aaauugcauugagcugcuuauu

SEQ ID NO: 235854 - RNA, 22 nt, Homo sapiens
aacaccaucccuuugaugcuuu

SEQ ID NO: 235855 - RNA, 22 nt, Homo sapiens
aacagagcuggugacuccaggu

SEQ ID NO: 235856 - RNA, 20 nt, Homo sapiens
aacagcacugucugaagcuu

SEQ ID NO: 235857 - RNA, 22 nt, Homo sapiens
aaccuacauucuuaacuguugc

SEQ ID NO: 235858 - RNA, 19 nt, Homo sapiens
aacuggugugagaugauau

SEQ ID NO: 235859 - RNA, 19 nt, Homo sapiens
aacuggugugagaugguau

SEQ ID NO: 235860 - RNA, 20 nt, Homo sapiens
aagacacuguccccacugga

SEQ ID NO: 235861 - RNA, 22 nt, Homo sapiens
aagagccgcaagggugaagggu

SEQ ID NO: 235862 - RNA, 22 nt, Homo sapiens
aagagcucucuguagcauguga

SEQ ID NO: 235863 - RNA, 22 nt, Homo sapiens
aagcaacacaucugccccgguu

SEQ ID NO: 235864 - RNA, 22 nt, Homo sapiens
aagcacaauuucaccuucuugu

SEQ ID NO: 235865 - RNA, 21 nt, Homo sapiens
aagcacauugaguguguguga

SEQ ID NO: 235866 - RNA, 22 nt, Homo sapiens
aagcaugguuuccaggggucac

SEQ ID NO: 235867 - RNA, 22 nt, Homo sapiens
aagcugccaggcaugguggcug

SEQ ID NO: 235868 - RNA, 22 nt, Homo sapiens
aagcuggauuucgcauccuguu

SEQ ID NO: 235869 - RNA, 22 nt, Homo sapiens
aaggaguagaggaauagcaaug

SEQ ID NO: 235870 - RNA, 22 nt, Homo sapiens
aaggcaagguggauaaugaagc

SEQ ID NO: 235871 - RNA, 22 nt, Homo sapiens
aaggcauucucaaacuaguucu

SEQ ID NO: 235872 - RNA, 22 nt, Homo sapiens
aagggaaugcgcugccuguguu

SEQ ID NO: 235873 - RNA, 22 nt, Homo sapiens
aagggaaugugguagcugguuu

SEQ ID NO: 235874 - RNA, 18 nt, Homo sapiens
aaggugcuucuguucuga

SEQ ID NO: 235875 - RNA, 22 nt, Homo sapiens
aagguggaguugacaauuuuca

SEQ ID NO: 235876 - RNA, 22 nt, Homo sapiens
aaguaaauauccgguaguccca

SEQ ID NO: 235877 - RNA, 23 nt, Homo sapiens
aagugagcuccaauugggugaga

SEQ ID NO: 235878 - RNA, 22 nt, Homo sapiens
aagugcaaauucccaggcucug

SEQ ID NO: 235879 - RNA, 22 nt, Homo sapiens
uuggaaggcugaauggccucuc

SEQ ID NO: 235880 - RNA, 22 nt, Homo sapiens
uuggagucaucucuguacugua

SEQ ID NO: 235881 - RNA, 22 nt, Homo sapiens
uuggagugugagagcagccugg

SEQ ID NO: 235882 - RNA, 22 nt, Homo sapiens
uuggagugugcucauaacugcu

SEQ ID NO: 235883 - RNA, 22 nt, Homo sapiens
uuggagugugucuuauuccauu

SEQ ID NO: 235884 - RNA, 22 nt, Homo sapiens
uuggcagcauuccagccaagca

SEQ ID NO: 235885 - RNA, 22 nt, Homo sapiens
uuggcagucugaggcacagacu

SEQ ID NO: 235886 - RNA, 22 nt, Homo sapiens
uuggcauugccaaacugucaac

SEQ ID NO: 235887 - RNA, 22 nt, Homo sapiens
uuggccauggagcacuuuucua

SEQ ID NO: 235888 - RNA, 22 nt, Homo sapiens
uuggcuaugaguccuaugugca

SEQ ID NO: 235889 - RNA, 22 nt, Homo sapiens
uugggauggaacuuuucaguga

SEQ ID NO: 235890 - RNA, 22 nt, Homo sapiens
uugggucaguuccuugacuccu

SEQ ID NO: 235891 - RNA, 22 nt, Homo sapiens
uugguaagguggaugaugaaua

SEQ ID NO: 235892 - RNA, 19 nt, Homo sapiens
uuggucccuuuggguucuu

SEQ ID NO: 235893 - RNA, 23 nt, Homo sapiens
uuguacacuaagaaucgcagaug

SEQ ID NO: 235894 - RNA, 22 nt, Homo sapiens
uuguacaggaguguaagcuuca

SEQ ID NO: 235895 - RNA, 22 nt, Homo sapiens
uuguacuagucauauuuugaaa

SEQ ID NO: 235896 - RNA, 22 nt, Homo sapiens
uuguacuauuuuuaucagugau

SEQ ID NO: 235897 - RNA, 22 nt, Homo sapiens
uuguacucucaccguaucccag

SEQ ID NO: 235898 - RNA, 21 nt, Homo sapiens
uuguagcagcauaaucccaga

SEQ ID NO: 235899 - RNA, 22 nt, Homo sapiens
uuguauguuuguucuuucagau

SEQ ID NO: 235900 - RNA, 22 nt, Homo sapiens
uuguccccaucugcugccagaa

SEQ ID NO: 235901 - RNA, 22 nt, Homo sapiens
uuguccuccacauuugaucagu

SEQ ID NO: 235902 - RNA, 22 nt, Homo sapiens
uugugcaaaguugugguuucug

SEQ ID NO: 235903 - RNA, 22 nt, Homo sapiens
uugugcauguauauuaguucac

SEQ ID NO: 235904 - RNA, 22 nt, Homo sapiens
uugugcuccuaugagaaucuaa

SEQ ID NO: 235905 - RNA, 22 nt, Homo sapiens
uugugcuucaucaccuagcaga

SEQ ID NO: 235906 - RNA, 22 nt, Homo sapiens
uugugguuauagagucucccug

SEQ ID NO: 235907 - RNA, 22 nt, Homo sapiens
uugugguugaugaagacugucu

SEQ ID NO: 235908 - RNA, 22 nt, Homo sapiens
uugugguuuuuaaaacuaggug

SEQ ID NO: 235909 - RNA, 22 nt, Homo sapiens
uuguuaugggguggcuugaaag

SEQ ID NO: 235910 - RNA, 22 nt, Homo sapiens
uuguuauguaucucaagauaaa

SEQ ID NO: 235911 - RNA, 22 nt, Homo sapiens
uuuaaagcacggaguuuguggc

SEQ ID NO: 235912 - RNA, 22 nt, Homo sapiens
uuuaaagcaugacgagaagaag

SEQ ID NO: 235913 - RNA, 22 nt, Homo sapiens
uuuaacauuggaugagaucguc

SEQ ID NO: 235914 - RNA, 22 nt, Homo sapiens
uuuaaguguuuguuccugaaaa

SEQ ID NO: 235915 - RNA, 22 nt, Homo sapiens
uuuagcagcaaagagccaugcu

SEQ ID NO: 235916 - RNA, 22 nt, Homo sapiens
uuuauagucaggaacuugagga

SEQ ID NO: 235917 - RNA, 22 nt, Homo sapiens
uuuaugcuacauguguuggaaa

SEQ ID NO: 235918 - RNA, 22 nt, Homo sapiens
uuucacagcaauugccuauugu

SEQ ID NO: 235919 - RNA, 22 nt, Homo sapiens
uuucaguguggcaggcauagcu

SEQ ID NO: 235920 - RNA, 22 nt, Homo sapiens
uuucauagccuucuaaugaguu

SEQ ID NO: 235921 - RNA, 22 nt, Homo sapiens
uuucauaguuugcauagggcau

SEQ ID NO: 235922 - RNA, 16 nt, Homo sapiens
uuucaucaguuuuaau

SEQ ID NO: 235923 - RNA, 22 nt, Homo sapiens
uuucauggacgcaaugccuuuu

SEQ ID NO: 235924 - RNA, 22 nt, Homo sapiens
uuucauggcaguuuggggccug

SEQ ID NO: 235925 - RNA, 19 nt, Homo sapiens
uuuccaguaaucuuaugug

SEQ ID NO: 235926 - RNA, 22 nt, Homo sapiens
uuucccugaaggcucugaaguc

SEQ ID NO: 235927 - RNA, 19 nt, Homo sapiens
uuucccugcagaccuacua

SEQ ID NO: 235928 - RNA, 22 nt, Homo sapiens
uuucucaguguuucaggguagg

SEQ ID NO: 235929 - RNA, 22 nt, Homo sapiens
uuucugcuugagagaauugcug

SEQ ID NO: 235930 - RNA, 22 nt, Homo sapiens
uuugaagcuaaggugcuugguu

SEQ ID NO: 235931 - RNA, 18 nt, Homo sapiens
uuugacugguguccuuau

SEQ ID NO: 235932 - RNA, 22 nt, Homo sapiens
uuugcacauauuugggcaaaag

SEQ ID NO: 235933 - RNA, 20 nt, Homo sapiens
uuugcagaaucuaagaagag

SEQ ID NO: 235934 - RNA, 23 nt, Homo sapiens
uuugccacuuauuagcugggagg

SEQ ID NO: 235935 - RNA, 22 nt, Homo sapiens
uuugguaguuuguugggaccca

SEQ ID NO: 235936 - RNA, 22 nt, Homo sapiens
uuugguguauaaaaaugcuagu

SEQ ID NO: 235937 - RNA, 18 nt, Homo sapiens
uuuguacuuuuucuaaug

SEQ ID NO: 235938 - RNA, 22 nt, Homo sapiens
uuuguccccgcccagaucucau

SEQ ID NO: 235939 - RNA, 22 nt, Homo sapiens
uuugugcaaacuaggauugcga

SEQ ID NO: 235940 - RNA, 22 nt, Homo sapiens
uuuuacacuucgguugugugca

SEQ ID NO: 235941 - RNA, 22 nt, Homo sapiens
uuuuaugggcuauuugcauuag

SEQ ID NO: 235942 - RNA, 19 nt, Homo sapiens
uuuugcucuuuauaccuau

SEQ ID NO: 235943 - RNA, 18 nt, Homo sapiens
uuuugcuuaacugcgcca

SEQ ID NO: 235944 - RNA, 22 nt, Homo sapiens
uuuugcuuuuccucggucccac

SEQ ID NO: 235945 - RNA, 22 nt, Homo sapiens
uuuuggcacuuugucugauucu

SEQ ID NO: 235946 - RNA, 20 nt, Homo sapiens
uuuuggcuuaaagcagucug

SEQ ID NO: 235947 - RNA, 22 nt, Homo sapiens
uuuuucacuuaaguuaggcuca

SEQ ID NO: 235948 - RNA, 22 nt, Homo sapiens
ucacauguguaaauugguguaa

SEQ ID NO: 235949 - RNA, 22 nt, Homo sapiens
ucacccacacaggagacaggga

SEQ ID NO: 235950 - RNA, 20 nt, Homo sapiens
ucacugagugguccacagua

SEQ ID NO: 235951 - RNA, 22 nt, Homo sapiens
ucacugggagaccaaagccauc

SEQ ID NO: 235952 - RNA, 22 nt, Homo sapiens
ucagacacugcccuccaccugu

SEQ ID NO: 235953 - RNA, 22 nt, Homo sapiens
ucagaccauuucauuacagacu

SEQ ID NO: 235954 - RNA, 22 nt, Homo sapiens
ucagaguagcugucugaggugc

SEQ ID NO: 235955 - RNA, 22 nt, Homo sapiens
ucagauacuggugacaugaaug

SEQ ID NO: 235956 - RNA, 22 nt, Homo sapiens
ucagcacauucaaggccugccu

SEQ ID NO: 235957 - RNA, 20 nt, Homo sapiens
ucaggcuccgcauuaacuua

SEQ ID NO: 235958 - RNA, 22 nt, Homo sapiens
ucagguagugccaugauugauu

SEQ ID NO: 235959 - RNA, 23 nt, Homo sapiens
ucagguaguuucagaggaccuug

SEQ ID NO: 235960 - RNA, 22 nt, Homo sapiens
ucaguaccugagagugggcaga

SEQ ID NO: 235961 - RNA, 22 nt, Homo sapiens
ucaguagcauugcuuauacagu

SEQ ID NO: 235962 - RNA, 20 nt, Homo sapiens
ucagugcagauuguccaagu

SEQ ID NO: 235963 - RNA, 22 nt, Homo sapiens
ucagugucugugauggagaggu

SEQ ID NO: 235964 - RNA, 22 nt, Homo sapiens
ucauaguacuuuguuuugaaaa

SEQ ID NO: 235965 - RNA, 19 nt, Homo sapiens
ucauagucuaagaugagaa

SEQ ID NO: 235966 - RNA, 22 nt, Homo sapiens
ucauagucuaagguucuuuugc

SEQ ID NO: 235967 - RNA, 21 nt, Homo sapiens
ucaucagucaaagacaauggu

SEQ ID NO: 235968 - RNA, 20 nt, Homo sapiens
ucaucaguuggugcucgcug

SEQ ID NO: 235969 - RNA, 22 nt, Homo sapiens
ucaucucaguuucuugccguac

SEQ ID NO: 235970 - RNA, 22 nt, Homo sapiens
ucauggcacugaugagaguuuc

SEQ ID NO: 235971 - RNA, 22 nt, Homo sapiens
ucauggcauuguuaaggguuuu

SEQ ID NO: 235972 - RNA, 22 nt, Homo sapiens
ucaugugaggauaacaauagug

SEQ ID NO: 235973 - RNA, 22 nt, Homo sapiens
ucauucauucuucaguggguac

SEQ ID NO: 235974 - RNA, 22 nt, Homo sapiens
uccacaauggcugaacuagauu

SEQ ID NO: 235975 - RNA, 22 nt, Homo sapiens
uccacagugguggaauuguuca

SEQ ID NO: 235976 - RNA, 22 nt, Homo sapiens
uccaugagaauaguuaggcucu

SEQ ID NO: 235977 - RNA, 22 nt, Homo sapiens
uccauuuguucagcuucaggaa

SEQ ID NO: 235978 - RNA, 22 nt, Homo sapiens
ucccaagaugagaugggggcug

SEQ ID NO: 235979 - RNA, 22 nt, Homo sapiens
ucccugaaagcugagauuggaa

SEQ ID NO: 235980 - RNA, 19 nt, Homo sapiens
ucccuguagaccacagugc

SEQ ID NO: 235981 - RNA, 22 nt, Homo sapiens
ucccuuucuggaguuucccaag

SEQ ID NO: 235982 - RNA, 22 nt, Homo sapiens
uccucaguggauuggauggugc

SEQ ID NO: 235983 - RNA, 22 nt, Homo sapiens
uccucauggagaaccucugcua

SEQ ID NO: 235984 - RNA, 22 nt, Homo sapiens
uccuugagucuuugcucagaug

SEQ ID NO: 235985 - RNA, 22 nt, Homo sapiens
ucuaauguaaccugcaaauauu

SEQ ID NO: 235986 - RNA, 22 nt, Homo sapiens
ucuaucacagccccacacucuc

SEQ ID NO: 235987 - RNA, 22 nt, Homo sapiens
ucucagugaauguggaaaaagc

SEQ ID NO: 235988 - RNA, 22 nt, Homo sapiens
ucucagugaauugguuuugucu

SEQ ID NO: 235989 - RNA, 22 nt, Homo sapiens
ucucaguggugcuggcagggga

SEQ ID NO: 235990 - RNA, 22 nt, Homo sapiens
ucucagugugguaaaaguuuuu

SEQ ID NO: 235991 - RNA, 23 nt, Homo sapiens
ucucauuccuugaaaauaaugac

SEQ ID NO: 235992 - RNA, 22 nt, Homo sapiens
ucuccaguuuccuucgucuauc

SEQ ID NO: 235993 - RNA, 22 nt, Homo sapiens
ucuccauuuguaaggguuucuc

SEQ ID NO: 235994 - RNA, 22 nt, Homo sapiens
ucucccauccaugaacuucugu

SEQ ID NO: 235995 - RNA, 22 nt, Homo sapiens
ucucugguuaugucauuaagca

SEQ ID NO: 235996 - RNA, 22 nt, Homo sapiens
ucucuguuuauuuuugguguau

SEQ ID NO: 235997 - RNA, 22 nt, Homo sapiens
ucugacacagugauuaguaaau

SEQ ID NO: 235998 - RNA, 22 nt, Homo sapiens
ucugagguuacugcuuuguaga

SEQ ID NO: 235999 - RNA, 21 nt, Homo sapiens
ucuggcuuucauuccccuucu

SEQ ID NO: 236000 - RNA, 22 nt, Homo sapiens
ucugguggugaugagagacagu

SEQ ID NO: 236001 - RNA, 22 nt, Homo sapiens
ucugucaaaucuuauguuguag

SEQ ID NO: 236002 - RNA, 22 nt, Homo sapiens
ucugugcauuguaacaacuaaa

SEQ ID NO: 236003 - RNA, 22 nt, Homo sapiens
ucugugguaagaaacgcauguc

SEQ ID NO: 236004 - RNA, 22 nt, Homo sapiens
ucuguggucagaguccuuggcc

SEQ ID NO: 236005 - RNA, 22 nt, Homo sapiens
ucuguggugggcuccacccagu

SEQ ID NO: 236006 - RNA, 22 nt, Homo sapiens
ucugugguucaaaccagcaacu

SEQ ID NO: 236007 - RNA, 22 nt, Homo sapiens
ucugugguuguugcauggaaug

SEQ ID NO: 236008 - RNA, 22 nt, Homo sapiens
ucuucaugcuugaaauaauagc

SEQ ID NO: 236009 - RNA, 22 nt, Homo sapiens
ucuucguuuaaagcaguggaag

SEQ ID NO: 236010 - RNA, 22 nt, Homo sapiens
ucuugcacaaauuauuuuaacu

SEQ ID NO: 236011 - RNA, 17 nt, Homo sapiens
ucuugugguucuugaau

SEQ ID NO: 236012 - RNA, 22 nt, Homo sapiens
ucuuuggguguauuucacagcc

SEQ ID NO: 236013 - RNA, 22 nt, Homo sapiens
ucuuuguuagaacccucuccuu

SEQ ID NO: 236014 - RNA, 22 nt, Homo sapiens
ucuuuuggguauggagccauca

SEQ ID NO: 236015 - RNA, 22 nt, Homo sapiens
ucuuuugguuucuagaggccgc

SEQ ID NO: 236016 - RNA, 22 nt, Homo sapiens
ugaaauaguuaaguugccuagu

SEQ ID NO: 236017 - RNA, 21 nt, Homo sapiens
ugaaaugcaugugcacauuaa

SEQ ID NO: 236018 - RNA, 22 nt, Homo sapiens
ugaaauuauucuuaccaaggug

SEQ ID NO: 236019 - RNA, 16 nt, Homo sapiens
ugaacagagaggauuc

SEQ ID NO: 236020 - RNA, 20 nt, Homo sapiens
ugaaggaggucauuuauacc

SEQ ID NO: 236021 - RNA, 22 nt, Homo sapiens
ugaagugaagacucacagaagg

SEQ ID NO: 236022 - RNA, 22 nt, Homo sapiens
ugaauacuucguucaaagauaa

SEQ ID NO: 236023 - RNA, 22 nt, Homo sapiens
ugaauaggcaguuaaguuuaug

SEQ ID NO: 236024 - RNA, 22 nt, Homo sapiens
ugaauguccugacgcugcaguu

SEQ ID NO: 236025 - RNA, 22 nt, Homo sapiens
ugacagaggucuuuuaauagcu

SEQ ID NO: 236026 - RNA, 22 nt, Homo sapiens
ugacaguguccuccuccugaga

SEQ ID NO: 236027 - RNA, 22 nt, Homo sapiens
ugacucaguuucucagguagua

SEQ ID NO: 236028 - RNA, 22 nt, Homo sapiens
ugacugaguaguauuccacuau

SEQ ID NO: 236029 - RNA, 22 nt, Homo sapiens
ugacuucagacugaaaugauuc

SEQ ID NO: 236030 - RNA, 22 nt, Homo sapiens
ugacuucauuugguaauugggu

SEQ ID NO: 236031 - RNA, 22 nt, Homo sapiens
ugagaacuagagaacaagguga

SEQ ID NO: 236032 - RNA, 22 nt, Homo sapiens
ugagaagugacgcagcaggguu

SEQ ID NO: 236033 - RNA, 22 nt, Homo sapiens
ugagacugagucuugcucuugu

SEQ ID NO: 236034 - RNA, 22 nt, Homo sapiens
ugagagacaguuucgucggagg

SEQ ID NO: 236035 - RNA, 22 nt, Homo sapiens
ugagauaacuaaaaacauuuug

SEQ ID NO: 236036 - RNA, 22 nt, Homo sapiens
ugagaucuguaaagucugacau

SEQ ID NO: 236037 - RNA, 22 nt, Homo sapiens
ugagaucugucuuuauaguauu

SEQ ID NO: 236038 - RNA, 22 nt, Homo sapiens
ugagaugagggcugcacucaaa

SEQ ID NO: 236039 - RNA, 22 nt, Homo sapiens
ugagaugaguugcgcucugucg

SEQ ID NO: 236040 - RNA, 22 nt, Homo sapiens
ugagaugaugggauaagagggc

SEQ ID NO: 236041 - RNA, 22 nt, Homo sapiens
ugagauguaaucucgcucuguc

SEQ ID NO: 236042 - RNA, 22 nt, Homo sapiens
ugagaugugaucaccugaaggg

SEQ ID NO: 236043 - RNA, 22 nt, Homo sapiens
ugagauguuccaaugacuauua

SEQ ID NO: 236044 - RNA, 23 nt, Homo sapiens
ugagauuauaaucuuuuacuucu

SEQ ID NO: 236045 - RNA, 22 nt, Homo sapiens
ugagcagagaagugcccugcgc

SEQ ID NO: 236046 - RNA, 22 nt, Homo sapiens
ugagcagugaguguggugcagg

SEQ ID NO: 236047 - RNA, 20 nt, Homo sapiens
ugagccccuggacucaagcg

SEQ ID NO: 236048 - RNA, 20 nt, Homo sapiens
ugagcuuguaaacacuguuu

SEQ ID NO: 236049 - RNA, 18 nt, Homo sapiens
ugaggaaaggguuugcua

SEQ ID NO: 236050 - RNA, 22 nt, Homo sapiens
ugagguagaggugaacuugacc

SEQ ID NO: 236051 - RNA, 22 nt, Homo sapiens
ugaguagaagugaagauagugg

SEQ ID NO: 236052 - RNA, 22 nt, Homo sapiens
ugaguaugaguucaggaaaggc

SEQ ID NO: 236053 - RNA, 22 nt, Homo sapiens
ugaguauuugggggaccagaga

SEQ ID NO: 236054 - RNA, 22 nt, Homo sapiens
ugagucuguucucacauugcua

SEQ ID NO: 236055 - RNA, 22 nt, Homo sapiens
ugagugaacgcugagaccaaau

SEQ ID NO: 236056 - RNA, 22 nt, Homo sapiens
ugaguucaugcuuguaguucua

SEQ ID NO: 236057 - RNA, 22 nt, Homo sapiens
ugaguucuuccuaucucugccu

SEQ ID NO: 236058 - RNA, 22 nt, Homo sapiens
ugaguucuuuguagauucugug

SEQ ID NO: 236059 - RNA, 22 nt, Homo sapiens
ugaguucuuuuagggauauugc

SEQ ID NO: 236060 - RNA, 18 nt, Homo sapiens
ugauaucaaugauagcca

SEQ ID NO: 236061 - RNA, 22 nt, Homo sapiens
ugauaugugaguauaugguuau

SEQ ID NO: 236062 - RNA, 22 nt, Homo sapiens
ugaucaaagugcuggaauuaca

SEQ ID NO: 236063 - RNA, 22 nt, Homo sapiens
ugaucugucacuuaucacauuu

SEQ ID NO: 236064 - RNA, 22 nt, Homo sapiens
ugaugaaguauaggaagggcuu

SEQ ID NO: 236065 - RNA, 22 nt, Homo sapiens
ugaugucuugcaggcacgagau

SEQ ID NO: 236066 - RNA, 19 nt, Homo sapiens
ugcaaauucuaaaaacuga

SEQ ID NO: 236067 - RNA, 22 nt, Homo sapiens
ugcacugucuugucgcauagca

SEQ ID NO: 236068 - RNA, 22 nt, Homo sapiens
ugcagcucaaauuccuaacaag

SEQ ID NO: 236069 - RNA, 22 nt, Homo sapiens
ugcagcucagcugcggaguuuu

SEQ ID NO: 236070 - RNA, 18 nt, Homo sapiens
ugcagcuuugugauuggc

SEQ ID NO: 236071 - RNA, 22 nt, Homo sapiens
ugcauacacaagcauacaugua

SEQ ID NO: 236072 - RNA, 22 nt, Homo sapiens
ugcauggaagggagggaaagag

SEQ ID NO: 236073 - RNA, 20 nt, Homo sapiens
ugcauguccucacuuacuug

SEQ ID NO: 236074 - RNA, 22 nt, Homo sapiens
ugcauguucuuacucauacaug

SEQ ID NO: 236075 - RNA, 22 nt, Homo sapiens
ugcauuaucagauguuugcuuu

SEQ ID NO: 236076 - RNA, 22 nt, Homo sapiens
ugccaacaugccuggcuguuuu

SEQ ID NO: 236077 - RNA, 22 nt, Homo sapiens
ugccaacugguuucuuuuaguu

SEQ ID NO: 236078 - RNA, 22 nt, Homo sapiens
ugccaaggagucagucccuaga

SEQ ID NO: 236079 - RNA, 22 nt, Homo sapiens
ugccugagccagguuuuaggag

SEQ ID NO: 236080 - RNA, 22 nt, Homo sapiens
ugccuuuguucuggaaugggaa

SEQ ID NO: 236081 - RNA, 22 nt, Homo sapiens
ugcugcacaguucuuaagauua

SEQ ID NO: 236082 - RNA, 19 nt, Homo sapiens
ugcugcauugugaccuugc

SEQ ID NO: 236083 - RNA, 21 nt, Homo sapiens
ugcuuuggucauacuucuucc

SEQ ID NO: 236084 - RNA, 22 nt, Homo sapiens
uggaacugauauugauggaaaa

SEQ ID NO: 236085 - RNA, 22 nt, Homo sapiens
uggaagacaggcuguauuuuaa

SEQ ID NO: 236086 - RNA, 22 nt, Homo sapiens
uggaagacauuuuggaccuugg

SEQ ID NO: 236087 - RNA, 23 nt, Homo sapiens
uggaagacuccucucuuggcugc

SEQ ID NO: 236088 - RNA, 22 nt, Homo sapiens
uggaagacucuagucucuugag

SEQ ID NO: 236089 - RNA, 22 nt, Homo sapiens
uggaagacuuuagaggcuuaua

SEQ ID NO: 236090 - RNA, 22 nt, Homo sapiens
uggaagccuagauucuuuucuu

SEQ ID NO: 236091 - RNA, 20 nt, Homo sapiens
uggaagccuggugcuaucuu

SEQ ID NO: 236092 - RNA, 22 nt, Homo sapiens
uggaaguauagauaauugaaag

SEQ ID NO: 236093 - RNA, 22 nt, Homo sapiens
uggaagugaacaaccaaggcag

SEQ ID NO: 236094 - RNA, 22 nt, Homo sapiens
uggaaucuagagaaaugcaaac

SEQ ID NO: 236095 - RNA, 20 nt, Homo sapiens
uggaaucuaggcggagguuu

SEQ ID NO: 236096 - RNA, 22 nt, Homo sapiens
uggaaucuuaggugaaggcuuu

SEQ ID NO: 236097 - RNA, 22 nt, Homo sapiens
uggaauggagagagggugcacg

SEQ ID NO: 236098 - RNA, 21 nt, Homo sapiens
uggaauguucugacuucaggg

SEQ ID NO: 236099 - RNA, 22 nt, Homo sapiens
uggacugagauuucagcugcca

SEQ ID NO: 236100 - RNA, 22 nt, Homo sapiens
uggacuguaauuuuauaggcau

SEQ ID NO: 236101 - RNA, 22 nt, Homo sapiens
uggagagugagggccuccuuaa

SEQ ID NO: 236102 - RNA, 19 nt, Homo sapiens
uggagucaucaugcugcua

SEQ ID NO: 236103 - RNA, 22 nt, Homo sapiens
uggagucuugaugauuuucaaa

SEQ ID NO: 236104 - RNA, 22 nt, Homo sapiens
uggaguuugacaugccuuuggg

SEQ ID NO: 236105 - RNA, 21 nt, Homo sapiens
uggauugagaaccccaggagg

SEQ ID NO: 236106 - RNA, 22 nt, Homo sapiens
uggauuuuaauuauucugucau

SEQ ID NO: 236107 - RNA, 22 nt, Homo sapiens
uggcaaauagcaauaggagggu

SEQ ID NO: 236108 - RNA, 22 nt, Homo sapiens
uggcaagagcaaaauguacagu

SEQ ID NO: 236109 - RNA, 19 nt, Homo sapiens
uggcacauguauacauaug

SEQ ID NO: 236110 - RNA, 22 nt, Homo sapiens
uggcagauggugacaccauuag

SEQ ID NO: 236111 - RNA, 22 nt, Homo sapiens
uggcauuuucucuguucuuaga

SEQ ID NO: 236112 - RNA, 22 nt, Homo sapiens
uggcauuuuguuuuagaauuag

SEQ ID NO: 236113 - RNA, 23 nt, Homo sapiens
uggccaagauaaucucaguuuuc

SEQ ID NO: 236114 - RNA, 22 nt, Homo sapiens
uggccagagggcaauuagcugu

SEQ ID NO: 236115 - RNA, 22 nt, Homo sapiens
uggcuguuuauuucacgugggu

SEQ ID NO: 236116 - RNA, 22 nt, Homo sapiens
uggcuuuguaagguuucauuuu

SEQ ID NO: 236117 - RNA, 22 nt, Homo sapiens
uggcuuuuguuauuuggaagcu

SEQ ID NO: 236118 - RNA, 22 nt, Homo sapiens
ugggaugaugcuugagaauauc

SEQ ID NO: 236119 - RNA, 22 nt, Homo sapiens
ugggcaagugacuuggcuucuc

SEQ ID NO: 236120 - RNA, 22 nt, Homo sapiens
uggggugugagggagaaagaaa

SEQ ID NO: 236121 - RNA, 22 nt, Homo sapiens
uggguaaaucuguuuggggcuc

SEQ ID NO: 236122 - RNA, 19 nt, Homo sapiens
uggguagugaugagacaua

SEQ ID NO: 236123 - RNA, 20 nt, Homo sapiens
ugguaauguaagagaggaga

SEQ ID NO: 236124 - RNA, 22 nt, Homo sapiens
ucacagauaaauaaagaugauu

SEQ ID NO: 236125 - RNA, 19 nt, Homo sapiens
ucacaggguugacuugagg

SEQ ID NO: 236126 - RNA, 18 nt, Homo sapiens
ucacagguaaaguugaca

SEQ ID NO: 236127 - RNA, 22 nt, Homo sapiens
ucacaugaauugucuuguucca

SEQ ID NO: 236128 - RNA, 22 nt, Homo sapiens
ggugucuuguuuaauacucauu

SEQ ID NO: 236129 - RNA, 22 nt, Homo sapiens
guaaucucagcuacucaggagg

SEQ ID NO: 236130 - RNA, 22 nt, Homo sapiens
guaaugcacucccaaagaucca

SEQ ID NO: 236131 - RNA, 22 nt, Homo sapiens
guacaguuuagugcuuugagaa

SEQ ID NO: 236132 - RNA, 22 nt, Homo sapiens
guacaguuuucaguguucacug

SEQ ID NO: 236133 - RNA, 22 nt, Homo sapiens
guacaugcauacaugcacaucu

SEQ ID NO: 236134 - RNA, 22 nt, Homo sapiens
guacaugcauaguuuauuucug

SEQ ID NO: 236135 - RNA, 22 nt, Homo sapiens
guagcaucauuugcaauuucau

SEQ ID NO: 236136 - RNA, 22 nt, Homo sapiens
guagugcaguuugagaaucagu

SEQ ID NO: 236137 - RNA, 23 nt, Homo sapiens
guaguuugaugcaauccacuugu

SEQ ID NO: 236138 - RNA, 22 nt, Homo sapiens
guauacaugucaaaacucacau

SEQ ID NO: 236139 - RNA, 22 nt, Homo sapiens
guauacuucugaaaauagcuau

SEQ ID NO: 236140 - RNA, 22 nt, Homo sapiens
guaugucuugucuauggcugcu

SEQ ID NO: 236141 - RNA, 22 nt, Homo sapiens
gucacuggcugucuuguaugau

SEQ ID NO: 236142 - RNA, 22 nt, Homo sapiens
gucaugucugcacauaguaaaa

SEQ ID NO: 236143 - RNA, 22 nt, Homo sapiens
gucauugagucagggaguaucu

SEQ ID NO: 236144 - RNA, 22 nt, Homo sapiens
gucauugguucuguuuauguga

SEQ ID NO: 236145 - RNA, 22 nt, Homo sapiens
guccaaagugggagaggugggg

SEQ ID NO: 236146 - RNA, 22 nt, Homo sapiens
gucccagagauauugugucuuu

SEQ ID NO: 236147 - RNA, 22 nt, Homo sapiens
guccugaagaccuuccucugga

SEQ ID NO: 236148 - RNA, 22 nt, Homo sapiens
gucuguuuggggaccuguggcc

SEQ ID NO: 236149 - RNA, 22 nt, Homo sapiens
gucuuggagaacucagcuuggc

SEQ ID NO: 236150 - RNA, 22 nt, Homo sapiens
gugaaauacauaaucccaagug

SEQ ID NO: 236151 - RNA, 22 nt, Homo sapiens
gugaaguuuuugugaggccuaa

SEQ ID NO: 236152 - RNA, 22 nt, Homo sapiens
gugacauuauuucagcuacaug

SEQ ID NO: 236153 - RNA, 22 nt, Homo sapiens
gugacauuuuuacugaugagag

SEQ ID NO: 236154 - RNA, 22 nt, Homo sapiens
gugacuacaggccacaguuugg

SEQ ID NO: 236155 - RNA, 22 nt, Homo sapiens
gugacuggacucugaagaaaau

SEQ ID NO: 236156 - RNA, 22 nt, Homo sapiens
gugagacugguccugaacccag

SEQ ID NO: 236157 - RNA, 22 nt, Homo sapiens
gugagagaaugacuauguguuu

SEQ ID NO: 236158 - RNA, 22 nt, Homo sapiens
gugagauccucucuuauauggg

SEQ ID NO: 236159 - RNA, 22 nt, Homo sapiens
gugagauggagucuugcuuugu

SEQ ID NO: 236160 - RNA, 22 nt, Homo sapiens
gugagguaauuagcucccuuag

SEQ ID NO: 236161 - RNA, 20 nt, Homo sapiens
gugagguagaggguuaccug

SEQ ID NO: 236162 - RNA, 21 nt, Homo sapiens
gugaucaugucacugcacucc

SEQ ID NO: 236163 - RNA, 22 nt, Homo sapiens
gugaucuguccuucauagccug

SEQ ID NO: 236164 - RNA, 22 nt, Homo sapiens
gugauuauccacgucuuuguga

SEQ ID NO: 236165 - RNA, 22 nt, Homo sapiens
gugauuguuaaacugccucucu

SEQ ID NO: 236166 - RNA, 22 nt, Homo sapiens
gugcaaugucaggagaugcagc

SEQ ID NO: 236167 - RNA, 22 nt, Homo sapiens
gugcacaaaucuuaaauguaca

SEQ ID NO: 236168 - RNA, 22 nt, Homo sapiens
gugcacaacaugcaguuuuguu

SEQ ID NO: 236169 - RNA, 22 nt, Homo sapiens
gugcacaucuguguuccagcua

SEQ ID NO: 236170 - RNA, 22 nt, Homo sapiens
gugcaugucuaugcgagucuaa

SEQ ID NO: 236171 - RNA, 22 nt, Homo sapiens
gugcccacugucuguccuguag

SEQ ID NO: 236172 - RNA, 22 nt, Homo sapiens
gugccuuuucugagcaaugagc

SEQ ID NO: 236173 - RNA, 21 nt, Homo sapiens
gugcuuguagccucacuucug

SEQ ID NO: 236174 - RNA, 22 nt, Homo sapiens
guggaagaaaucagguuauuug

SEQ ID NO: 236175 - RNA, 22 nt, Homo sapiens
guggaagauaguguguuaaugu

SEQ ID NO: 236176 - RNA, 22 nt, Homo sapiens
guggcuuuaaguacgauugagg

SEQ ID NO: 236177 - RNA, 22 nt, Homo sapiens
guggucagaaaucucaguggca

SEQ ID NO: 236178 - RNA, 22 nt, Homo sapiens
gugguuuucaacuccaccugca

SEQ ID NO: 236179 - RNA, 22 nt, Homo sapiens
gugguuuuuagauuucuacagu

SEQ ID NO: 236180 - RNA, 20 nt, Homo sapiens
guguaagagcaagcuuccua

SEQ ID NO: 236181 - RNA, 22 nt, Homo sapiens
guguagagaaaaguaccauuuu

SEQ ID NO: 236182 - RNA, 22 nt, Homo sapiens
guguccucgaguacacaucagg

SEQ ID NO: 236183 - RNA, 22 nt, Homo sapiens
guguuauggagccaaacuacua

SEQ ID NO: 236184 - RNA, 22 nt, Homo sapiens
guguucaaacccaggucugucu

SEQ ID NO: 236185 - RNA, 22 nt, Homo sapiens
guuauguuaguuacaaggcuag

SEQ ID NO: 236186 - RNA, 22 nt, Homo sapiens
guucacaguuucuaaucccagc

SEQ ID NO: 236187 - RNA, 17 nt, Homo sapiens
guucccaguggcauuug

SEQ ID NO: 236188 - RNA, 18 nt, Homo sapiens
guugagcuuuuccuuuag

SEQ ID NO: 236189 - RNA, 22 nt, Homo sapiens
guugcuuauuccuguaauccca

SEQ ID NO: 236190 - RNA, 22 nt, Homo sapiens
uaaacugucuugcaguuacaug

SEQ ID NO: 236191 - RNA, 22 nt, Homo sapiens
uaaagcacuuuuuucugcaugg

SEQ ID NO: 236192 - RNA, 22 nt, Homo sapiens
uaaagcugaaaugauuaugaca

SEQ ID NO: 236193 - RNA, 18 nt, Homo sapiens
uaaaggcacuguguuguu

SEQ ID NO: 236194 - RNA, 22 nt, Homo sapiens
uaaagugaggauggcaguaggu

SEQ ID NO: 236195 - RNA, 22 nt, Homo sapiens
gugaaaagaugagcaccauaca

SEQ ID NO: 236196 - RNA, 17 nt, Homo sapiens
gugaaaucaucauuuuu

SEQ ID NO: 236197 - RNA, 22 nt, Homo sapiens
gugaagugugaccucagcaucu

SEQ ID NO: 236198 - RNA, 22 nt, Homo sapiens
gugaccaaagauagcucaaguu

SEQ ID NO: 236199 - RNA, 20 nt, Homo sapiens
gugacugagcacgggcacag

SEQ ID NO: 236200 - RNA, 22 nt, Homo sapiens
gugacugggaguggugaagaua

SEQ ID NO: 236201 - RNA, 22 nt, Homo sapiens
gugagaagaaaaauauggcugu

SEQ ID NO: 236202 - RNA, 22 nt, Homo sapiens
gugagaauauuuuaaauacuaa

SEQ ID NO: 236203 - RNA, 22 nt, Homo sapiens
gugagacugaguuucgcucuug

SEQ ID NO: 236204 - RNA, 22 nt, Homo sapiens
gugagaggaggcagcuuuuaca

SEQ ID NO: 236205 - RNA, 22 nt, Homo sapiens
gugagguaagaguugcuuugcu

SEQ ID NO: 236206 - RNA, 22 nt, Homo sapiens
gugaguaaagguucauugaauu

SEQ ID NO: 236207 - RNA, 22 nt, Homo sapiens
gugcaaugagaaggggcucugg

SEQ ID NO: 236208 - RNA, 22 nt, Homo sapiens
gugcacaacgugcaggcuuguu

SEQ ID NO: 236209 - RNA, 22 nt, Homo sapiens
gugcacaaucgugcauuccuug

SEQ ID NO: 236210 - RNA, 22 nt, Homo sapiens
gugcacauauggugcauaagug

SEQ ID NO: 236211 - RNA, 22 nt, Homo sapiens
gugcacauuguuuaugucuguu

SEQ ID NO: 236212 - RNA, 22 nt, Homo sapiens
gugcauacucuggagacauugu

SEQ ID NO: 236213 - RNA, 22 nt, Homo sapiens
gugccacugcaccuggccuaag

SEQ ID NO: 236214 - RNA, 22 nt, Homo sapiens
gugcgguauuagcaagccaaca

SEQ ID NO: 236215 - RNA, 22 nt, Homo sapiens
guggaagaccagacuuuccaac

SEQ ID NO: 236216 - RNA, 20 nt, Homo sapiens
guggaagauaaguagccuga

SEQ ID NO: 236217 - RNA, 22 nt, Homo sapiens
guggaauuauagagacaucuug

SEQ ID NO: 236218 - RNA, 22 nt, Homo sapiens
guggagucaucacucagagugg

SEQ ID NO: 236219 - RNA, 18 nt, Homo sapiens
guggagugucuuccugga

SEQ ID NO: 236220 - RNA, 22 nt, Homo sapiens
guggcaugaaagcagauaccac

SEQ ID NO: 236221 - RNA, 21 nt, Homo sapiens
guggccuuuggagcaugucag

SEQ ID NO: 236222 - RNA, 22 nt, Homo sapiens
guggcuaaagauuuggaaucug

SEQ ID NO: 236223 - RNA, 22 nt, Homo sapiens
guggcuagaaugaagguagcug

SEQ ID NO: 236224 - RNA, 22 nt, Homo sapiens
gugggauaauuuuuggugcugu

SEQ ID NO: 236225 - RNA, 22 nt, Homo sapiens
gugggauauaaucaguccugua

SEQ ID NO: 236226 - RNA, 22 nt, Homo sapiens
guggguaaaucucuggggcucu

SEQ ID NO: 236227 - RNA, 22 nt, Homo sapiens
guguaaaacaauuagaggauuu

SEQ ID NO: 236228 - RNA, 22 nt, Homo sapiens
guguauguuguccauggaugcg

SEQ ID NO: 236229 - RNA, 22 nt, Homo sapiens
gugugacagcuauagacaugau

SEQ ID NO: 236230 - RNA, 19 nt, Homo sapiens
gugugcauaucacagagca

SEQ ID NO: 236231 - RNA, 22 nt, Homo sapiens
guguucauggaauuugcaauug

SEQ ID NO: 236232 - RNA, 22 nt, Homo sapiens
guguuugguugauagagccacu

SEQ ID NO: 236233 - RNA, 22 nt, Homo sapiens
guuaaagacauccacauaggag

SEQ ID NO: 236234 - RNA, 22 nt, Homo sapiens
uagauuaucauucauacaggga

SEQ ID NO: 236235 - RNA, 22 nt, Homo sapiens
uagauucaucuguuccuuuuga

SEQ ID NO: 236236 - RNA, 22 nt, Homo sapiens
uagcacagugucauucuaggua

SEQ ID NO: 236237 - RNA, 22 nt, Homo sapiens
uagcauggaggcggccauagug

SEQ ID NO: 236238 - RNA, 22 nt, Homo sapiens
uaggaaugaacgauuuauuggu

SEQ ID NO: 236239 - RNA, 19 nt, Homo sapiens
uagggcacgaggcagaguc

SEQ ID NO: 236240 - RNA, 22 nt, Homo sapiens
uagguagaacuuuagacccugu

SEQ ID NO: 236241 - RNA, 22 nt, Homo sapiens
uaggugguuugaaauacucaag

SEQ ID NO: 236242 - RNA, 19 nt, Homo sapiens
uaggugguuuuccccucac

SEQ ID NO: 236243 - RNA, 22 nt, Homo sapiens
uagucaaaucugaaggaaauuu

SEQ ID NO: 236244 - RNA, 22 nt, Homo sapiens
uagugcuguaauucuaaugaaa

SEQ ID NO: 236245 - RNA, 20 nt, Homo sapiens
uaguggaaaucagguccucu

SEQ ID NO: 236246 - RNA, 19 nt, Homo sapiens
uaucaaguaugcacuguac

SEQ ID NO: 236247 - RNA, 22 nt, Homo sapiens
uaucaaguuggaagagaaguaa

SEQ ID NO: 236248 - RNA, 22 nt, Homo sapiens
uaucacagcaaggacccauuau

SEQ ID NO: 236249 - RNA, 22 nt, Homo sapiens
uaucacaguagaacucuuucca

SEQ ID NO: 236250 - RNA, 20 nt, Homo sapiens
uaucacauggggagaaaccu

SEQ ID NO: 236251 - RNA, 22 nt, Homo sapiens
uaucucagagaaucagauuuac

SEQ ID NO: 236252 - RNA, 20 nt, Homo sapiens
uaucucaguuuguccuaaac

SEQ ID NO: 236253 - RNA, 22 nt, Homo sapiens
uaugacuuuggaaaaauuacuu

SEQ ID NO: 236254 - RNA, 22 nt, Homo sapiens
uaugagcaaaaugaggguuagu

SEQ ID NO: 236255 - RNA, 22 nt, Homo sapiens
uaugcacuauggaaguagcuca

SEQ ID NO: 236256 - RNA, 22 nt, Homo sapiens
uaugcuuauuaaaacagugugu

SEQ ID NO: 236257 - RNA, 22 nt, Homo sapiens
uauggauguuaagguucacagc

SEQ ID NO: 236258 - RNA, 22 nt, Homo sapiens
uauggccugcguccagugguau

SEQ ID NO: 236259 - RNA, 19 nt, Homo sapiens
uaugggauuuuuagggugu

SEQ ID NO: 236260 - RNA, 22 nt, Homo sapiens
uauguuaucaaaaagcuaagga

SEQ ID NO: 236261 - RNA, 22 nt, Homo sapiens
uauucacuguaucauugauggg

SEQ ID NO: 236262 - RNA, 22 nt, Homo sapiens
uauuccuuuugcauuuccacau

SEQ ID NO: 236263 - RNA, 22 nt, Homo sapiens
uauugauuaauugugauuaggc

SEQ ID NO: 236264 - RNA, 22 nt, Homo sapiens
uauugcacgccagccugagcaa

SEQ ID NO: 236265 - RNA, 23 nt, Homo sapiens
uauugcacuaugguaacccuuuu

SEQ ID NO: 236266 - RNA, 20 nt, Homo sapiens
uauugcacuccagucugggc

SEQ ID NO: 236267 - RNA, 22 nt, Homo sapiens
uauuguacauguuauagauuuu

SEQ ID NO: 236268 - RNA, 22 nt, Homo sapiens
ucaaaucaucuuuuccaaagcu

SEQ ID NO: 236269 - RNA, 22 nt, Homo sapiens
ucaaaugcacguagagaaaaua

SEQ ID NO: 236270 - RNA, 22 nt, Homo sapiens
ucaaaugcuguauuguaguaau

SEQ ID NO: 236271 - RNA, 22 nt, Homo sapiens
ucaacaggucaauugcauagaa

SEQ ID NO: 236272 - RNA, 22 nt, Homo sapiens
ucaagcaauucgccugucucag

SEQ ID NO: 236273 - RNA, 20 nt, Homo sapiens
ucaaggcaggaacuguacau

SEQ ID NO: 236274 - RNA, 22 nt, Homo sapiens
ucaagugcauugauucaguauu

SEQ ID NO: 236275 - RNA, 22 nt, Homo sapiens
ucaaugcaugugacaaagagua

SEQ ID NO: 236276 - RNA, 22 nt, Homo sapiens
ucacaaagcuuggccugcuucu

SEQ ID NO: 236277 - RNA, 22 nt, Homo sapiens
ucacaaggcaggaaugaaaggg

SEQ ID NO: 236278 - RNA, 19 nt, Homo sapiens
ucacacuguggcuucuuua

SEQ ID NO: 236279 - RNA, 22 nt, Homo sapiens
ucacacuguuuugauuauuaua

SEQ ID NO: 236280 - RNA, 22 nt, Homo sapiens
ucacagacauugaggggaccuu

SEQ ID NO: 236281 - RNA, 22 nt, Homo sapiens
ucacagccuaguuuuauacauu

SEQ ID NO: 236282 - RNA, 22 nt, Homo sapiens
ucacaguugauugaaacacagc

SEQ ID NO: 236283 - RNA, 22 nt, Homo sapiens
ucacaguuggccuggccuuuua

SEQ ID NO: 236284 - RNA, 22 nt, Homo sapiens
ucacaugaagauuuuaguauac

SEQ ID NO: 236285 - RNA, 21 nt, Homo sapiens
ucacauggccagaguaggaac

SEQ ID NO: 236286 - RNA, 22 nt, Homo sapiens
ucacaugugacauauauauuug

SEQ ID NO: 236287 - RNA, 22 nt, Homo sapiens
ucacauuaagcuguuauuucuu

SEQ ID NO: 236288 - RNA, 22 nt, Homo sapiens
ucacauuguuauguaaauguuu

SEQ ID NO: 236289 - RNA, 22 nt, Homo sapiens
ucaccaccugcugauuguagag

SEQ ID NO: 236290 - RNA, 22 nt, Homo sapiens
ucaccuggagaagauggaucau

SEQ ID NO: 236291 - RNA, 22 nt, Homo sapiens
ucacuagaucaagggagagaaa

SEQ ID NO: 236292 - RNA, 22 nt, Homo sapiens
ucacuguggaacucaaaaagcu

SEQ ID NO: 236293 - RNA, 22 nt, Homo sapiens
ucacuuggugaacacauuaugu

SEQ ID NO: 236294 - RNA, 22 nt, Homo sapiens
ucagaucaugcuuaugauggga

SEQ ID NO: 236295 - RNA, 22 nt, Homo sapiens
ucaggcaccuuccucuuaucug

SEQ ID NO: 236296 - RNA, 22 nt, Homo sapiens
ucagggacuuacaaaccagaag

SEQ ID NO: 236297 - RNA, 20 nt, Homo sapiens
ucagguagaucuuugagguc

SEQ ID NO: 236298 - RNA, 23 nt, Homo sapiens
ucagguaggccuagaguauucuu

SEQ ID NO: 236299 - RNA, 22 nt, Homo sapiens
ucagguauuuuaucacaugaag

SEQ ID NO: 236300 - RNA, 23 nt, Homo sapiens
ucaguacucuauaagugccagcu

SEQ ID NO: 236301 - RNA, 23 nt, Homo sapiens
ucagugaaggaacaacuaaauag

SEQ ID NO: 236302 - RNA, 22 nt, Homo sapiens
ucagugacuggguauuaaauca

SEQ ID NO: 236303 - RNA, 22 nt, Homo sapiens
ucagugcuguaccaucuaagga

SEQ ID NO: 236304 - RNA, 22 nt, Homo sapiens
ucaguguuuuauccuccagagc

SEQ ID NO: 236305 - RNA, 22 nt, Homo sapiens
ucaguuuagguguaacggccac

SEQ ID NO: 236306 - RNA, 22 nt, Homo sapiens
ucauacaggccaccagggaagu

SEQ ID NO: 236307 - RNA, 22 nt, Homo sapiens
ucaugcaaugagucaggaggca

SEQ ID NO: 236308 - RNA, 22 nt, Homo sapiens
ucauggcuuuuauuauguugag

SEQ ID NO: 236309 - RNA, 22 nt, Homo sapiens
ucauggggugagcuacaggcac

SEQ ID NO: 236310 - RNA, 22 nt, Homo sapiens
ucaugguuuuauaacccucuug

SEQ ID NO: 236311 - RNA, 22 nt, Homo sapiens
ucauuagagacagggugucacu

SEQ ID NO: 236312 - RNA, 22 nt, Homo sapiens
ucauucauucauccagcuugag

SEQ ID NO: 236313 - RNA, 22 nt, Homo sapiens
ucauuggaugucugaaaugauu

SEQ ID NO: 236314 - RNA, 22 nt, Homo sapiens
ucauugguagcucauggaaccg

SEQ ID NO: 236315 - RNA, 21 nt, Homo sapiens
uccagcuuugagaguuguggu

SEQ ID NO: 236316 - RNA, 22 nt, Homo sapiens
uccauggagacacauuuuauau

SEQ ID NO: 236317 - RNA, 18 nt, Homo sapiens
uccauuuguaugggaugg

SEQ ID NO: 236318 - RNA, 19 nt, Homo sapiens
ucccaagaugcucauacau

SEQ ID NO: 236319 - RNA, 22 nt, Homo sapiens
uccccuuuguaagauggaaacg

SEQ ID NO: 236320 - RNA, 22 nt, Homo sapiens
ucccugaaaaauuggcuuaaca

SEQ ID NO: 236321 - RNA, 22 nt, Homo sapiens
ucccuguagugccuagaucaga

SEQ ID NO: 236322 - RNA, 22 nt, Homo sapiens
uccuggcuccacuguuuauucc

SEQ ID NO: 236323 - RNA, 22 nt, Homo sapiens
uccuucacucuacaucuuuguu

SEQ ID NO: 236324 - RNA, 22 nt, Homo sapiens
uaaugguuuugcaccaucccuc

SEQ ID NO: 236325 - RNA, 22 nt, Homo sapiens
uacaaagcuuugaugugucuuu

SEQ ID NO: 236326 - RNA, 22 nt, Homo sapiens
uacagaguauccauuugaguuc

SEQ ID NO: 236327 - RNA, 22 nt, Homo sapiens
uacaggacuucucagaguuauu

SEQ ID NO: 236328 - RNA, 22 nt, Homo sapiens
uacagucauaaugccuagugac

SEQ ID NO: 236329 - RNA, 22 nt, Homo sapiens
uacaugcaugggcaugugugca

SEQ ID NO: 236330 - RNA, 22 nt, Homo sapiens
uaccaaaguuucggccucuguu

SEQ ID NO: 236331 - RNA, 22 nt, Homo sapiens
uacgugaauggacaaugccuug

SEQ ID NO: 236332 - RNA, 22 nt, Homo sapiens
uacuccccuuguucugugagcu

SEQ ID NO: 236333 - RNA, 22 nt, Homo sapiens
uacucugcagagaugcauaaca

SEQ ID NO: 236334 - RNA, 22 nt, Homo sapiens
uacucugcagccauaaaacaga

SEQ ID NO: 236335 - RNA, 22 nt, Homo sapiens
uacugcacuccagccugggaga

SEQ ID NO: 236336 - RNA, 22 nt, Homo sapiens
uacugcagucagacuccugggc

SEQ ID NO: 236337 - RNA, 22 nt, Homo sapiens
uacugcauucuccgccuccggg

SEQ ID NO: 236338 - RNA, 22 nt, Homo sapiens
uacuucauucuugaccuugcau

SEQ ID NO: 236339 - RNA, 22 nt, Homo sapiens
uagaagcacuaucccuccuagu

SEQ ID NO: 236340 - RNA, 22 nt, Homo sapiens
uagaugauucacuuuacuucca

SEQ ID NO: 236341 - RNA, 20 nt, Homo sapiens
uagaugcauuuagauucauu

SEQ ID NO: 236342 - RNA, 19 nt, Homo sapiens
uagaugucuuugcauagau

SEQ ID NO: 236343 - RNA, 22 nt, Homo sapiens
uagauuaucuaugaggcuucca

SEQ ID NO: 236344 - RNA, 22 nt, Homo sapiens
uagauucauuuuagcaaaaguu

SEQ ID NO: 236345 - RNA, 22 nt, Homo sapiens
uagcaaaucaauggaauugaag

SEQ ID NO: 236346 - RNA, 22 nt, Homo sapiens
uagcagcuuuauugagguaaau

SEQ ID NO: 236347 - RNA, 22 nt, Homo sapiens
uagcucagcccagcuaagcuca

SEQ ID NO: 236348 - RNA, 22 nt, Homo sapiens
uagcugcugcuaggcuaaggau

SEQ ID NO: 236349 - RNA, 22 nt, Homo sapiens
uagcugguucuccaggagcuag

SEQ ID NO: 236350 - RNA, 22 nt, Homo sapiens
uaggaaguuucuugauuacuua

SEQ ID NO: 236351 - RNA, 22 nt, Homo sapiens
uaggcaguggagaaauaaacag

SEQ ID NO: 236352 - RNA, 22 nt, Homo sapiens
uaggcaguuuuccuuucacagu

SEQ ID NO: 236353 - RNA, 22 nt, Homo sapiens
uaggcauuuuucugauaaacua

SEQ ID NO: 236354 - RNA, 22 nt, Homo sapiens
uaggcuuuucugggaugugggc

SEQ ID NO: 236355 - RNA, 22 nt, Homo sapiens
uaggggcacacuucgguuagca

SEQ ID NO: 236356 - RNA, 22 nt, Homo sapiens
uaguaaacauaguucuuuugcu

SEQ ID NO: 236357 - RNA, 22 nt, Homo sapiens
uaguagagauggggcacaugcc

SEQ ID NO: 236358 - RNA, 22 nt, Homo sapiens
uaguaguuuuguguauaauaau

SEQ ID NO: 236359 - RNA, 22 nt, Homo sapiens
uauacugucuuuguaugccuag

SEQ ID NO: 236360 - RNA, 22 nt, Homo sapiens
uaucaaguguuagggagaugug

SEQ ID NO: 236361 - RNA, 22 nt, Homo sapiens
uaucauuguguuauuucuucca

SEQ ID NO: 236362 - RNA, 22 nt, Homo sapiens
uaucugcacauacacuuauagc

SEQ ID NO: 236363 - RNA, 22 nt, Homo sapiens
uaugaccuuggacaaguuacuu

SEQ ID NO: 236364 - RNA, 19 nt, Homo sapiens
uaugcaacuuauagugcug

SEQ ID NO: 236365 - RNA, 22 nt, Homo sapiens
uaugcacacacguguuuaugug

SEQ ID NO: 236366 - RNA, 22 nt, Homo sapiens
uaugcacacguguccaugugca

SEQ ID NO: 236367 - RNA, 22 nt, Homo sapiens
uaugcagacauuguuccaacca

SEQ ID NO: 236368 - RNA, 22 nt, Homo sapiens
uaugccuuuugguucaagcaac

SEQ ID NO: 236369 - RNA, 22 nt, Homo sapiens
uauggauuuuggaauauguggg

SEQ ID NO: 236370 - RNA, 22 nt, Homo sapiens
uauggcaaugcauaggaaggaa

SEQ ID NO: 236371 - RNA, 17 nt, Homo sapiens
uauguaguacuuauaaa

SEQ ID NO: 236372 - RNA, 22 nt, Homo sapiens
uauugaacuggaucagaaggcc

SEQ ID NO: 236373 - RNA, 22 nt, Homo sapiens
uauugcaaauggugaucccagg

SEQ ID NO: 236374 - RNA, 22 nt, Homo sapiens
uauuguacauauccucccuuca

SEQ ID NO: 236375 - RNA, 22 nt, Homo sapiens
uauuucaguugugcagguaguu

SEQ ID NO: 236376 - RNA, 22 nt, Homo sapiens
uauuugauuaacaagagccuaa

SEQ ID NO: 236377 - RNA, 22 nt, Homo sapiens
uauuuggauagucuggaaaaaa

SEQ ID NO: 236378 - RNA, 22 nt, Homo sapiens
ucaaaugauucacccaccuuug

SEQ ID NO: 236379 - RNA, 17 nt, Homo sapiens
ucaaaugcucccaguga

SEQ ID NO: 236380 - RNA, 22 nt, Homo sapiens
ucaaaugcucuuugcagagagg

SEQ ID NO: 236381 - RNA, 20 nt, Homo sapiens
ucaaggcacgaauaaaaguu

SEQ ID NO: 236382 - RNA, 23 nt, Homo sapiens
ucaagugaugguggccacaaggg

SEQ ID NO: 236383 - RNA, 19 nt, Homo sapiens
ucaauucugucaauggcuu

SEQ ID NO: 236384 - RNA, 22 nt, Homo sapiens
ucacacugaaacuaggguguga

SEQ ID NO: 236385 - RNA, 22 nt, Homo sapiens
ucacacugcaucuguuggaauu

SEQ ID NO: 236386 - RNA, 22 nt, Homo sapiens
ucacagacugagccaaauagag

SEQ ID NO: 236387 - RNA, 21 nt, Homo sapiens
ucacagccuaggaccugaaga

SEQ ID NO: 236388 - RNA, 22 nt, Homo sapiens
ucacaguguuaaaccuuucuuu

SEQ ID NO: 236389 - RNA, 23 nt, Homo sapiens
ucacaguuacuuuugcaucaacc

SEQ ID NO: 236390 - RNA, 22 nt, Homo sapiens
uaacaagagagucagucagucc

SEQ ID NO: 236391 - RNA, 22 nt, Homo sapiens
uaacaguggucugugguaucug

SEQ ID NO: 236392 - RNA, 22 nt, Homo sapiens
uaacccuuacaacuacacucgu

SEQ ID NO: 236393 - RNA, 22 nt, Homo sapiens
uaacuagaaaggagacaguugc

SEQ ID NO: 236394 - RNA, 21 nt, Homo sapiens
uaagcuaaacauucaguuaac

SEQ ID NO: 236395 - RNA, 22 nt, Homo sapiens
uaaggaaccagaaguggguagc

SEQ ID NO: 236396 - RNA, 22 nt, Homo sapiens
uaaggcacauaggccuggaaac

SEQ ID NO: 236397 - RNA, 22 nt, Homo sapiens
uaaggcacccuucugaguagag

SEQ ID NO: 236398 - RNA, 22 nt, Homo sapiens
uaaggcuuugguagguuugguc

SEQ ID NO: 236399 - RNA, 22 nt, Homo sapiens
uaaggcuuugucuuaggacuuu

SEQ ID NO: 236400 - RNA, 22 nt, Homo sapiens
uaaggcuuuuguucagcguggg

SEQ ID NO: 236401 - RNA, 22 nt, Homo sapiens
uaaguagaggaaucauuuugug

SEQ ID NO: 236402 - RNA, 23 nt, Homo sapiens
uaagucacacagauuaauuuauu

SEQ ID NO: 236403 - RNA, 22 nt, Homo sapiens
uaagugaauuugacagguaaug

SEQ ID NO: 236404 - RNA, 22 nt, Homo sapiens
uaagugcaugauuacaugcaua

SEQ ID NO: 236405 - RNA, 22 nt, Homo sapiens
uaaguguaaugucugaaguuug

SEQ ID NO: 236406 - RNA, 22 nt, Homo sapiens
uaauaauguuaggcuuacucaa

SEQ ID NO: 236407 - RNA, 22 nt, Homo sapiens
uaauacuagugaauagcaggau

SEQ ID NO: 236408 - RNA, 22 nt, Homo sapiens
uaauccuagcacuuuggaagac

SEQ ID NO: 236409 - RNA, 22 nt, Homo sapiens
uaauccuggcacuuugggaggc

SEQ ID NO: 236410 - RNA, 22 nt, Homo sapiens
uaaucucagcuacucaggaggc

SEQ ID NO: 236411 - RNA, 22 nt, Homo sapiens
uaaugcuguggucugguuuaaa

SEQ ID NO: 236412 - RNA, 21 nt, Homo sapiens
uggucccuucagaucggauuu

SEQ ID NO: 236413 - RNA, 22 nt, Homo sapiens
ugguccuuuccauuggagacac

SEQ ID NO: 236414 - RNA, 22 nt, Homo sapiens
uggucuucuggccuccagaacc

SEQ ID NO: 236415 - RNA, 15 nt, Homo sapiens
uggugguguugagac

SEQ ID NO: 236416 - RNA, 22 nt, Homo sapiens
uguaacacacacuguuuacucc

SEQ ID NO: 236417 - RNA, 22 nt, Homo sapiens
uguacuagaaauuaaggcaggg

SEQ ID NO: 236418 - RNA, 22 nt, Homo sapiens
uguagcagccauaaacacagug

SEQ ID NO: 236419 - RNA, 22 nt, Homo sapiens
uguagcuuuugagauuuauauu

SEQ ID NO: 236420 - RNA, 22 nt, Homo sapiens
ugucacugugcagucaugcauu

SEQ ID NO: 236421 - RNA, 22 nt, Homo sapiens
ugucaggaguuuuagaaucuua

SEQ ID NO: 236422 - RNA, 22 nt, Homo sapiens
ugucaguguaugagccccggau

SEQ ID NO: 236423 - RNA, 22 nt, Homo sapiens
ugucauggcauuuguaaacugc

SEQ ID NO: 236424 - RNA, 22 nt, Homo sapiens
ugucauggggaaaauaacagac

SEQ ID NO: 236425 - RNA, 22 nt, Homo sapiens
ugucccugagccuggauuccug

SEQ ID NO: 236426 - RNA, 18 nt, Homo sapiens
ugucccuuugcuguucau

SEQ ID NO: 236427 - RNA, 22 nt, Homo sapiens
uguccuggugaugcccaaauuc

SEQ ID NO: 236428 - RNA, 22 nt, Homo sapiens
ugucuugagagaggacaugacu

SEQ ID NO: 236429 - RNA, 22 nt, Homo sapiens
ugugaacacagaggcuauggca

SEQ ID NO: 236430 - RNA, 22 nt, Homo sapiens
ugugaacagaauuagucaccua

SEQ ID NO: 236431 - RNA, 22 nt, Homo sapiens
ugugaacauuuuguauauauua

SEQ ID NO: 236432 - RNA, 22 nt, Homo sapiens
ugugaauguaaccuuauuugga

SEQ ID NO: 236433 - RNA, 22 nt, Homo sapiens
ugugaccaaaaucaacauaccu

SEQ ID NO: 236434 - RNA, 18 nt, Homo sapiens
ugugcaauauuaaccacc

SEQ ID NO: 236435 - RNA, 22 nt, Homo sapiens
ugugcacaacaugcagguuugu

SEQ ID NO: 236436 - RNA, 22 nt, Homo sapiens
ugugcacaacgugcagguuugu

SEQ ID NO: 236437 - RNA, 22 nt, Homo sapiens
ugugcacaaugugcagguuugu

SEQ ID NO: 236438 - RNA, 22 nt, Homo sapiens
ugugcacauugugcagguugau

SEQ ID NO: 236439 - RNA, 22 nt, Homo sapiens
ugugccaaaucccauaauaaau

SEQ ID NO: 236440 - RNA, 22 nt, Homo sapiens
uguggcagugcuuuaugaaacc

SEQ ID NO: 236441 - RNA, 22 nt, Homo sapiens
uguguacugcagaguauucugu

SEQ ID NO: 236442 - RNA, 22 nt, Homo sapiens
ugugucacugcacuccagcgug

SEQ ID NO: 236443 - RNA, 22 nt, Homo sapiens
uguuacagcagaauugaaagag

SEQ ID NO: 236444 - RNA, 22 nt, Homo sapiens
uguuaucauuacguucuuaguu

SEQ ID NO: 236445 - RNA, 22 nt, Homo sapiens
uguucauggauccaguggcuuc

SEQ ID NO: 236446 - RNA, 22 nt, Homo sapiens
uguugcauuugucaaggucaag

SEQ ID NO: 236447 - RNA, 22 nt, Homo sapiens
uguuugguggucucuucacaug

SEQ ID NO: 236448 - RNA, 22 nt, Homo sapiens
uuaaaugcacauacuugagaaa

SEQ ID NO: 236449 - RNA, 22 nt, Homo sapiens
uuaagguaugugggcauuuugu

SEQ ID NO: 236450 - RNA, 22 nt, Homo sapiens
uuaagugaauuaucuaacaugu

SEQ ID NO: 236451 - RNA, 22 nt, Homo sapiens
uuaaugaacuuuauuuuguaga

SEQ ID NO: 236452 - RNA, 22 nt, Homo sapiens
uuacacaguaggucccuaguaa

SEQ ID NO: 236453 - RNA, 22 nt, Homo sapiens
uuacagcagugccccacuccca

SEQ ID NO: 236454 - RNA, 21 nt, Homo sapiens
uuacaguugguugugaggugg

SEQ ID NO: 236455 - RNA, 22 nt, Homo sapiens
uuacaguugugagccaccaugc

SEQ ID NO: 236456 - RNA, 22 nt, Homo sapiens
uuacaugagacugucgcuaguu

SEQ ID NO: 236457 - RNA, 22 nt, Homo sapiens
uuacaugucuugguaagguuag

SEQ ID NO: 236458 - RNA, 22 nt, Homo sapiens
uuaccacagugccugucuaaug

SEQ ID NO: 236459 - RNA, 22 nt, Homo sapiens
uuacuggcuuucacugguguua

SEQ ID NO: 236460 - RNA, 19 nt, Homo sapiens
uuagagaucaucugcuuca

SEQ ID NO: 236461 - RNA, 22 nt, Homo sapiens
uuagaguacaggggaaucaagg

SEQ ID NO: 236462 - RNA, 22 nt, Homo sapiens
uuagauaguacugaaugguucu

SEQ ID NO: 236463 - RNA, 21 nt, Homo sapiens
uuaggcagugucagaggugag

SEQ ID NO: 236464 - RNA, 22 nt, Homo sapiens
uuagguauuaggaaauaugcuu

SEQ ID NO: 236465 - RNA, 22 nt, Homo sapiens
uuaguaguagugcuguaauuuu

SEQ ID NO: 236466 - RNA, 22 nt, Homo sapiens
uuauauguuagacauggugggu

SEQ ID NO: 236467 - RNA, 22 nt, Homo sapiens
uuaugacaggcucaggagcccc

SEQ ID NO: 236468 - RNA, 22 nt, Homo sapiens
uuauggcaaugccccacuccua

SEQ ID NO: 236469 - RNA, 20 nt, Homo sapiens
uuaugucguuucuugcuuau

SEQ ID NO: 236470 - RNA, 22 nt, Homo sapiens
uuauuacuccuauuuuguagau

SEQ ID NO: 236471 - RNA, 22 nt, Homo sapiens
uuauuagcacccuaccaugugg

SEQ ID NO: 236472 - RNA, 22 nt, Homo sapiens
uuauucagcaccugcuguguuc

SEQ ID NO: 236473 - RNA, 23 nt, Homo sapiens
uucaaaggaugcuuuauggaauu

SEQ ID NO: 236474 - RNA, 22 nt, Homo sapiens
uucaaaguaaaaauguguucac

SEQ ID NO: 236475 - RNA, 23 nt, Homo sapiens
uucaaauguucucugguugucag

SEQ ID NO: 236476 - RNA, 22 nt, Homo sapiens
uucaagcugggcaaauaagggg

SEQ ID NO: 236477 - RNA, 22 nt, Homo sapiens
uucacagccgcaccccaucacu

SEQ ID NO: 236478 - RNA, 22 nt, Homo sapiens
uucaccuggaguucaggauaag

SEQ ID NO: 236479 - RNA, 19 nt, Homo sapiens
uucagcagugucugcucuu

SEQ ID NO: 236480 - RNA, 22 nt, Homo sapiens
uucaguaguaaguuggaacucu

SEQ ID NO: 236481 - RNA, 22 nt, Homo sapiens
uucaguagucaaaagauaaggg

SEQ ID NO: 236482 - RNA, 22 nt, Homo sapiens
uucaguagucuccauagaaccg

SEQ ID NO: 236483 - RNA, 22 nt, Homo sapiens
uucaguauugcaccuggagucc

SEQ ID NO: 236484 - RNA, 20 nt, Homo sapiens
uucagugcagguaacaaucc

SEQ ID NO: 236485 - RNA, 19 nt, Homo sapiens
uucauacagugagagcagc

SEQ ID NO: 236486 - RNA, 22 nt, Homo sapiens
uucauaguucuuuuagucauua

SEQ ID NO: 236487 - RNA, 22 nt, Homo sapiens
uucauguaauauuucacagcuu

SEQ ID NO: 236488 - RNA, 22 nt, Homo sapiens
uucccugaaguguuacucuaga

SEQ ID NO: 236489 - RNA, 22 nt, Homo sapiens
uuccugaggccuccccagaagc

SEQ ID NO: 236490 - RNA, 20 nt, Homo sapiens
uuccuuaggcauuggaagaa

SEQ ID NO: 236491 - RNA, 22 nt, Homo sapiens
uuccuucaugcuugaaggguau

SEQ ID NO: 236492 - RNA, 22 nt, Homo sapiens
uuccuugaaacagucaagagaa

SEQ ID NO: 236493 - RNA, 22 nt, Homo sapiens
uuccuugagaaaggcacaaguu

SEQ ID NO: 236494 - RNA, 22 nt, Homo sapiens
uuccuuguagcaaaugcgauga

SEQ ID NO: 236495 - RNA, 22 nt, Homo sapiens
uucuaaacaucuuacaaugcau

SEQ ID NO: 236496 - RNA, 20 nt, Homo sapiens
uucuaguacuucuguuucca

SEQ ID NO: 236497 - RNA, 21 nt, Homo sapiens
uucuauggucagaauucaaua

SEQ ID NO: 236498 - RNA, 22 nt, Homo sapiens
auugcacaccagucugggcaaa

SEQ ID NO: 236499 - RNA, 22 nt, Homo sapiens
auugcacuccagccccggggac

SEQ ID NO: 236500 - RNA, 22 nt, Homo sapiens
auugcacuccagcccgggugac

SEQ ID NO: 236501 - RNA, 22 nt, Homo sapiens
auugcacuccagccuggccaac

SEQ ID NO: 236502 - RNA, 22 nt, Homo sapiens
auugcacuccagccuugugaca

SEQ ID NO: 236503 - RNA, 22 nt, Homo sapiens
auugcacuggggguuagaauuu

SEQ ID NO: 236504 - RNA, 22 nt, Homo sapiens
auugcucuuagaaauauuucuu

SEQ ID NO: 236505 - RNA, 22 nt, Homo sapiens
auuggaacugaaauaauaacuu

SEQ ID NO: 236506 - RNA, 22 nt, Homo sapiens
auuguacuccagccuaggcaac

SEQ ID NO: 236507 - RNA, 22 nt, Homo sapiens
auugucacuuaaaagugcaugu

SEQ ID NO: 236508 - RNA, 22 nt, Homo sapiens
auugucauuuauaacuguguag

SEQ ID NO: 236509 - RNA, 20 nt, Homo sapiens
auuguccuugauuacacaga

SEQ ID NO: 236510 - RNA, 22 nt, Homo sapiens
auuguucuuacaugcugucauc

SEQ ID NO: 236511 - RNA, 22 nt, Homo sapiens
aucaaaguaucucaauauggua

SEQ ID NO: 236512 - RNA, 22 nt, Homo sapiens
aucaaaguuucccagaaguugu

SEQ ID NO: 236513 - RNA, 22 nt, Homo sapiens
aucacagaacuuugagcagaga

SEQ ID NO: 236514 - RNA, 22 nt, Homo sapiens
aucaccugagcaguauacacug

SEQ ID NO: 236515 - RNA, 22 nt, Homo sapiens
aucacuguccacucaucuuucu

SEQ ID NO: 236516 - RNA, 22 nt, Homo sapiens
aucacuuucuauuucugugcca

SEQ ID NO: 236517 - RNA, 21 nt, Homo sapiens
aucagagacccaggcuuccuc

SEQ ID NO: 236518 - RNA, 22 nt, Homo sapiens
aucauccugucaggagcuguga

SEQ ID NO: 236519 - RNA, 22 nt, Homo sapiens
aucauggaguauuugcaagucu

SEQ ID NO: 236520 - RNA, 23 nt, Homo sapiens
auccacauucuaguccuuuaugc

SEQ ID NO: 236521 - RNA, 22 nt, Homo sapiens
aucccuuucucuggcuaggggg

SEQ ID NO: 236522 - RNA, 22 nt, Homo sapiens
aucuaaaucucauaugggcaca

SEQ ID NO: 236523 - RNA, 22 nt, Homo sapiens
aucucugagauguucugauuuu

SEQ ID NO: 236524 - RNA, 22 nt, Homo sapiens
aucucuugccagucagaauggu

SEQ ID NO: 236525 - RNA, 22 nt, Homo sapiens
aucuggcuucuuuuaguccaca

SEQ ID NO: 236526 - RNA, 22 nt, Homo sapiens
aucugguguccucgugggaguc

SEQ ID NO: 236527 - RNA, 22 nt, Homo sapiens
auggucccauucauucacguau

SEQ ID NO: 236528 - RNA, 22 nt, Homo sapiens
augguuugugcuccuauaagaa

SEQ ID NO: 236529 - RNA, 22 nt, Homo sapiens
auguaacaguauuuggagaugu

SEQ ID NO: 236530 - RNA, 22 nt, Homo sapiens
auguaauguuaaauugcuaauu

SEQ ID NO: 236531 - RNA, 22 nt, Homo sapiens
auguaguagcagaaaauauuuu

SEQ ID NO: 236532 - RNA, 22 nt, Homo sapiens
auguauacaugcaggucacagg

SEQ ID NO: 236533 - RNA, 22 nt, Homo sapiens
auguggcuuuucaacuguguga

SEQ ID NO: 236534 - RNA, 18 nt, Homo sapiens
auguggcuuuugaaggcu

SEQ ID NO: 236535 - RNA, 22 nt, Homo sapiens
augugggaggaauguguuucca

SEQ ID NO: 236536 - RNA, 22 nt, Homo sapiens
auguguaaagcuuuucuuuguu

SEQ ID NO: 236537 - RNA, 18 nt, Homo sapiens
auguuauguuuguagaag

SEQ ID NO: 236538 - RNA, 22 nt, Homo sapiens
auguugcuugaaggcauuuugu

SEQ ID NO: 236539 - RNA, 22 nt, Homo sapiens
auguuguaguaugagucaaaau

SEQ ID NO: 236540 - RNA, 22 nt, Homo sapiens
auuaagugcuugcagaagucca

SEQ ID NO: 236541 - RNA, 22 nt, Homo sapiens
auuaagugcuugccagugcugg

SEQ ID NO: 236542 - RNA, 20 nt, Homo sapiens
auuagagcuacauggcuaca

SEQ ID NO: 236543 - RNA, 22 nt, Homo sapiens
auuagguuggugcaaaacuuuc

SEQ ID NO: 236544 - RNA, 22 nt, Homo sapiens
auuagguuguugcaaaaguaau

SEQ ID NO: 236545 - RNA, 22 nt, Homo sapiens
auuauaguguauacuugaaauu

SEQ ID NO: 236546 - RNA, 22 nt, Homo sapiens
auuaucacaguuuugcauaugg

SEQ ID NO: 236547 - RNA, 23 nt, Homo sapiens
auucaaguagugagagugguuau

SEQ ID NO: 236548 - RNA, 22 nt, Homo sapiens
auucaagucaucucuccgcauu

SEQ ID NO: 236549 - RNA, 22 nt, Homo sapiens
auuccacuuagugacucauuug

SEQ ID NO: 236550 - RNA, 22 nt, Homo sapiens
auuccacuuccacuaguuucuc

SEQ ID NO: 236551 - RNA, 22 nt, Homo sapiens
auugaacaugccauauguacca

SEQ ID NO: 236552 - RNA, 22 nt, Homo sapiens
auugaacuguuggagagguuuu

SEQ ID NO: 236553 - RNA, 22 nt, Homo sapiens
auugcacaucugcacuacagcc

SEQ ID NO: 236554 - RNA, 22 nt, Homo sapiens
auugcacuccagccuggaugac

SEQ ID NO: 236555 - RNA, 22 nt, Homo sapiens
auugcacuccagccugggugac

SEQ ID NO: 236556 - RNA, 22 nt, Homo sapiens
auugcacuccggccugggugac

SEQ ID NO: 236557 - RNA, 22 nt, Homo sapiens
auugcaguuagaacagaagucu

SEQ ID NO: 236558 - RNA, 22 nt, Homo sapiens
auuggcaauccauauauuuucu

SEQ ID NO: 236559 - RNA, 22 nt, Homo sapiens
auuguacuccagccugggcaaa

SEQ ID NO: 236560 - RNA, 22 nt, Homo sapiens
auuguacuccagccugggcgac

SEQ ID NO: 236561 - RNA, 22 nt, Homo sapiens
auuguacuccagccugggcuaa

SEQ ID NO: 236562 - RNA, 22 nt, Homo sapiens
auuguacuccagccuuggggac

SEQ ID NO: 236563 - RNA, 22 nt, Homo sapiens
auuguacucuagccucugggca

SEQ ID NO: 236564 - RNA, 22 nt, Homo sapiens
auuuccuguaggggcuugcgaa

SEQ ID NO: 236565 - RNA, 22 nt, Homo sapiens
auuuugguuacauaguugagcu

SEQ ID NO: 236566 - RNA, 22 nt, Homo sapiens
caaaccuguaggggccaagagg

SEQ ID NO: 236567 - RNA, 22 nt, Homo sapiens
caaagucuucaguugauucuga

SEQ ID NO: 236568 - RNA, 22 nt, Homo sapiens
caaagucuucucauuaugucuu

SEQ ID NO: 236569 - RNA, 22 nt, Homo sapiens
caagaggcuguguauaaagcca

SEQ ID NO: 236570 - RNA, 22 nt, Homo sapiens
caauacuguuaccugaaauagg

SEQ ID NO: 236571 - RNA, 22 nt, Homo sapiens
caaugcagcuuuuggagagaaa

SEQ ID NO: 236572 - RNA, 22 nt, Homo sapiens
caauugguguuuauggggaagu

SEQ ID NO: 236573 - RNA, 22 nt, Homo sapiens
cacauguucaggagcacuuaga

SEQ ID NO: 236574 - RNA, 22 nt, Homo sapiens
cacugcauccucugccuggcgg

SEQ ID NO: 236575 - RNA, 22 nt, Homo sapiens
cacugcauccuugaccuucugg

SEQ ID NO: 236576 - RNA, 22 nt, Homo sapiens
cagagaucaugcaacugcucgc

SEQ ID NO: 236577 - RNA, 22 nt, Homo sapiens
cagagguauugcaaaagccuag

SEQ ID NO: 236578 - RNA, 22 nt, Homo sapiens
cagcacauagcaguugcucagu

SEQ ID NO: 236579 - RNA, 22 nt, Homo sapiens
cagcacauuacaaguacuuggu

SEQ ID NO: 236580 - RNA, 22 nt, Homo sapiens
cagcugaugucgaaugcacucu

SEQ ID NO: 236581 - RNA, 22 nt, Homo sapiens
caggcagugggagacaaaacug

SEQ ID NO: 236582 - RNA, 22 nt, Homo sapiens
cagguacaugcaugugugugca

SEQ ID NO: 236583 - RNA, 21 nt, Homo sapiens
cagguagugucugaagccaga

SEQ ID NO: 236584 - RNA, 22 nt, Homo sapiens
cagguaguguguagcacagcag

SEQ ID NO: 236585 - RNA, 22 nt, Homo sapiens
caguacaauguugauuagaagu

SEQ ID NO: 236586 - RNA, 22 nt, Homo sapiens
cagugauaggugguuguuggca

SEQ ID NO: 236587 - RNA, 20 nt, Homo sapiens
cagugcacuuucccacuggu

SEQ ID NO: 236588 - RNA, 22 nt, Homo sapiens
cagugcuuuaucaaguccucca

SEQ ID NO: 236589 - RNA, 22 nt, Homo sapiens
caguggaugaacaagaagugau

SEQ ID NO: 236590 - RNA, 22 nt, Homo sapiens
caguucaugguaggcaccauag

SEQ ID NO: 236591 - RNA, 22 nt, Homo sapiens
caucaaaguggagggaaggacc

SEQ ID NO: 236592 - RNA, 22 nt, Homo sapiens
caucacaugcuuauuuuccuca

SEQ ID NO: 236593 - RNA, 22 nt, Homo sapiens
caucccauucgaggggcacagc

SEQ ID NO: 236594 - RNA, 22 nt, Homo sapiens
caucucauugaauugcugagca

SEQ ID NO: 236595 - RNA, 22 nt, Homo sapiens
caugaaagacugaggaauugga

SEQ ID NO: 236596 - RNA, 22 nt, Homo sapiens
cauggauuuuuuugaauggcag

SEQ ID NO: 236597 - RNA, 22 nt, Homo sapiens
cauggcacuguaugaaaugugc

SEQ ID NO: 236598 - RNA, 22 nt, Homo sapiens
caugucuuuuaaacauucaacu

SEQ ID NO: 236599 - RNA, 22 nt, Homo sapiens
caugugcaugagcacauacgug

SEQ ID NO: 236600 - RNA, 20 nt, Homo sapiens
cauuacacuccaaccugggu

SEQ ID NO: 236601 - RNA, 19 nt, Homo sapiens
cauugcacuccacccuggg

SEQ ID NO: 236602 - RNA, 22 nt, Homo sapiens
cauugcacuccacuccugaaca

SEQ ID NO: 236603 - RNA, 22 nt, Homo sapiens
cauugcacuccagcccuggcaa

SEQ ID NO: 236604 - RNA, 22 nt, Homo sapiens
cauugcacuccagccugaggga

SEQ ID NO: 236605 - RNA, 22 nt, Homo sapiens
cauugcacuccagccugccugg

SEQ ID NO: 236606 - RNA, 22 nt, Homo sapiens
cauugcacuccagccuggcaac

SEQ ID NO: 236607 - RNA, 22 nt, Homo sapiens
cauugcacuccagccuugguga

SEQ ID NO: 236608 - RNA, 22 nt, Homo sapiens
cauugcacuccagcuugggcaa

SEQ ID NO: 236609 - RNA, 22 nt, Homo sapiens
cauugcacuccaucccgggaaa

SEQ ID NO: 236610 - RNA, 22 nt, Homo sapiens
cauugcacuccaucuugggcaa

SEQ ID NO: 236611 - RNA, 22 nt, Homo sapiens
cauugcacugcagcccgggcaa

SEQ ID NO: 236612 - RNA, 22 nt, Homo sapiens
cauugcacuuagacaacuuuug

SEQ ID NO: 236613 - RNA, 22 nt, Homo sapiens
cauugcaugccagccugggcaa

SEQ ID NO: 236614 - RNA, 22 nt, Homo sapiens
cauugcauuccagucugggcaa

SEQ ID NO: 236615 - RNA, 22 nt, Homo sapiens
cauugcauuuucuuuguaccuu

SEQ ID NO: 236616 - RNA, 22 nt, Homo sapiens
gaaggcaugcugcauggccaga

SEQ ID NO: 236617 - RNA, 22 nt, Homo sapiens
gaaugguaaacuuccaugacug

SEQ ID NO: 236618 - RNA, 20 nt, Homo sapiens
gaaugguuucgggguucuug

SEQ ID NO: 236619 - RNA, 22 nt, Homo sapiens
gaauguuuacuuuguuuaauac

SEQ ID NO: 236620 - RNA, 22 nt, Homo sapiens
gacaguuuggugaggaagacga

SEQ ID NO: 236621 - RNA, 17 nt, Homo sapiens
gacauaggaaaaggaga

SEQ ID NO: 236622 - RNA, 22 nt, Homo sapiens
gacauguuucucucuguuuacu

SEQ ID NO: 236623 - RNA, 22 nt, Homo sapiens
gacauguuuucauguauuugga

SEQ ID NO: 236624 - RNA, 21 nt, Homo sapiens
gaccacagcagggaaugucag

SEQ ID NO: 236625 - RNA, 22 nt, Homo sapiens
gaccacauuccacacaggcuuu

SEQ ID NO: 236626 - RNA, 22 nt, Homo sapiens
gacuauguuaccuuacacauca

SEQ ID NO: 236627 - RNA, 22 nt, Homo sapiens
gacucgagggcauaagagcuuu

SEQ ID NO: 236628 - RNA, 22 nt, Homo sapiens
gacucuguagacaaucacaucu

SEQ ID NO: 236629 - RNA, 22 nt, Homo sapiens
gagaaugagaggggaaggccac

SEQ ID NO: 236630 - RNA, 20 nt, Homo sapiens
gagaccugagauucacucaa

SEQ ID NO: 236631 - RNA, 22 nt, Homo sapiens
gagagcuaggccacuggggcuu

SEQ ID NO: 236632 - RNA, 22 nt, Homo sapiens
gagagguaguuuuuuggucguc

SEQ ID NO: 236633 - RNA, 22 nt, Homo sapiens
gagauaaauaggucacaguucu

SEQ ID NO: 236634 - RNA, 22 nt, Homo sapiens
gagauacacccagugcagaggc

SEQ ID NO: 236635 - RNA, 22 nt, Homo sapiens
gagauggagucuuuuucuguca

SEQ ID NO: 236636 - RNA, 22 nt, Homo sapiens
gagaugguacacauacgauucu

SEQ ID NO: 236637 - RNA, 22 nt, Homo sapiens
gagauggugugcuguuggaagu

SEQ ID NO: 236638 - RNA, 22 nt, Homo sapiens
gagcaaugauugagccacugua

SEQ ID NO: 236639 - RNA, 22 nt, Homo sapiens
gagcacauguggagagucuggg

SEQ ID NO: 236640 - RNA, 22 nt, Homo sapiens
gagccuguaggaggagaggugg

SEQ ID NO: 236641 - RNA, 22 nt, Homo sapiens
gagcuaguguaauauuuugggg

SEQ ID NO: 236642 - RNA, 22 nt, Homo sapiens
gagcugaucuuuucugauucca

SEQ ID NO: 236643 - RNA, 22 nt, Homo sapiens
gagcugccuugccuaugcaaga

SEQ ID NO: 236644 - RNA, 22 nt, Homo sapiens
gagcuuguagugugaaugguau

SEQ ID NO: 236645 - RNA, 22 nt, Homo sapiens
gagguaaguggauuaugagguc

SEQ ID NO: 236646 - RNA, 22 nt, Homo sapiens
gaggugaaggucucaauaaaua

SEQ ID NO: 236647 - RNA, 22 nt, Homo sapiens
gaguagugcugcaauaaacaua

SEQ ID NO: 236648 - RNA, 22 nt, Homo sapiens
gaguauguauaugagugugucu

SEQ ID NO: 236649 - RNA, 22 nt, Homo sapiens
gagugcaaagguccugaggugg

SEQ ID NO: 236650 - RNA, 22 nt, Homo sapiens
gagugcaauggcaugaucuggg

SEQ ID NO: 236651 - RNA, 22 nt, Homo sapiens
gagugcaauggcgcgaucuggg

SEQ ID NO: 236652 - RNA, 22 nt, Homo sapiens
gaguuccuuugagccugagagg

SEQ ID NO: 236653 - RNA, 22 nt, Homo sapiens
gauaaagauagcaauagggaca

SEQ ID NO: 236654 - RNA, 22 nt, Homo sapiens
gaucuggagguuuuccucauga

SEQ ID NO: 236655 - RNA, 22 nt, Homo sapiens
gaucuguuguuuggaaguauca

SEQ ID NO: 236656 - RNA, 22 nt, Homo sapiens
gauggcaucugagaguguuaga

SEQ ID NO: 236657 - RNA, 22 nt, Homo sapiens
gauggcauuucuggaucugccc

SEQ ID NO: 236658 - RNA, 22 nt, Homo sapiens
gcaaaugcuacaccauuuugua

SEQ ID NO: 236659 - RNA, 22 nt, Homo sapiens
gcaaaugcuaugccauuuuaua

SEQ ID NO: 236660 - RNA, 22 nt, Homo sapiens
gcaauguuacugaauguguuuu

SEQ ID NO: 236661 - RNA, 22 nt, Homo sapiens
gcacaggguuacauucuaaggu

SEQ ID NO: 236662 - RNA, 22 nt, Homo sapiens
gcacaguuaaagggucauguga

SEQ ID NO: 236663 - RNA, 22 nt, Homo sapiens
gcacauauguaaauagcugccu

SEQ ID NO: 236664 - RNA, 22 nt, Homo sapiens
gcacauuacaaguauuagcuca

SEQ ID NO: 236665 - RNA, 17 nt, Homo sapiens
gcacuggcguaucccac

SEQ ID NO: 236666 - RNA, 22 nt, Homo sapiens
gcagaauugguuucuucuaagg

SEQ ID NO: 236667 - RNA, 22 nt, Homo sapiens
gcagagaaacaggucuaaggag

SEQ ID NO: 236668 - RNA, 22 nt, Homo sapiens
gcagcacaugacuguauguaua

SEQ ID NO: 236669 - RNA, 22 nt, Homo sapiens
gcagcagugcccuggauggaaa

SEQ ID NO: 236670 - RNA, 22 nt, Homo sapiens
gcagguaguuucugacuuuuac

SEQ ID NO: 236671 - RNA, 22 nt, Homo sapiens
gcagugacaugugccaguuuau

SEQ ID NO: 236672 - RNA, 22 nt, Homo sapiens
gcaguguggguagagggcaaga

SEQ ID NO: 236673 - RNA, 22 nt, Homo sapiens
gccauggaggauuuauagaggc

SEQ ID NO: 236674 - RNA, 22 nt, Homo sapiens
gccuguagaagaguagaugacc

SEQ ID NO: 236675 - RNA, 22 nt, Homo sapiens
gcucguccccuccugacucugc

SEQ ID NO: 236676 - RNA, 22 nt, Homo sapiens
gcuggugaaggcugaaaagugg

SEQ ID NO: 236677 - RNA, 19 nt, Homo sapiens
gcugguuguccacucucuc

SEQ ID NO: 236678 - RNA, 22 nt, Homo sapiens
gcuguguucucgaggcggggga

SEQ ID NO: 236679 - RNA, 22 nt, Homo sapiens
gcuuuuggaggaacuuaagauu

SEQ ID NO: 236680 - RNA, 23 nt, Homo sapiens
ggaaacauccagucuuucaccau

SEQ ID NO: 236681 - RNA, 22 nt, Homo sapiens
ggaaagcuagguguggguguac

SEQ ID NO: 236682 - RNA, 19 nt, Homo sapiens
ggaaaugucuauuaagauc

SEQ ID NO: 236683 - RNA, 22 nt, Homo sapiens
ggaaauguuuagcauccacuuu

SEQ ID NO: 236684 - RNA, 20 nt, Homo sapiens
ggaauagucuacacucugac

SEQ ID NO: 236685 - RNA, 17 nt, Homo sapiens
ggaaugaauuccagccc

SEQ ID NO: 236686 - RNA, 22 nt, Homo sapiens
ggagagcuaggcagagguuugu

SEQ ID NO: 236687 - RNA, 22 nt, Homo sapiens
ggagcugugauuugaguccaga

SEQ ID NO: 236688 - RNA, 22 nt, Homo sapiens
ggagguagguuugugauuugua

SEQ ID NO: 236689 - RNA, 22 nt, Homo sapiens
ggaguaaaagaguaggaggaau

SEQ ID NO: 236690 - RNA, 22 nt, Homo sapiens
ggagugcuguuguuacacaagg

SEQ ID NO: 236691 - RNA, 22 nt, Homo sapiens
ggaguguaguggcuccaucucg

SEQ ID NO: 236692 - RNA, 22 nt, Homo sapiens
ggcaaagaugaccauuacuuuu

SEQ ID NO: 236693 - RNA, 22 nt, Homo sapiens
ggcagaauugcugaggaugcua

SEQ ID NO: 236694 - RNA, 22 nt, Homo sapiens
ggcagcuguguccuucguaagg

SEQ ID NO: 236695 - RNA, 22 nt, Homo sapiens
ggcaugaggccauaaaaguaag

SEQ ID NO: 236696 - RNA, 22 nt, Homo sapiens
ggcuuggaggaaugugagggcu

SEQ ID NO: 236697 - RNA, 22 nt, Homo sapiens
gggaguagagaguuucucugac

SEQ ID NO: 236698 - RNA, 20 nt, Homo sapiens
gggaugugagguacacucuu

SEQ ID NO: 236699 - RNA, 22 nt, Homo sapiens
ggguucccuucuggcucagggu

SEQ ID NO: 236700 - RNA, 22 nt, Homo sapiens
ggucaggagaaugguaacugag

SEQ ID NO: 236701 - RNA, 22 nt, Homo sapiens
ggugacugguuuaucuggcagu

SEQ ID NO: 236702 - RNA, 22 nt, Homo sapiens
ggugaggaaaguugaguuucua

SEQ ID NO: 236703 - RNA, 19 nt, Homo sapiens
ggugcuugaauauuccucc

SEQ ID NO: 236704 - RNA, 22 nt, Homo sapiens
guaauacuuuugggauauuaga

SEQ ID NO: 236705 - RNA, 22 nt, Homo sapiens
uagggaguguccuuucgggaaa

SEQ ID NO: 236706 - RNA, 22 nt, Homo sapiens
uagggagugucuucauuuugua

SEQ ID NO: 236707 - RNA, 22 nt, Homo sapiens
uagggaguuuuggggugcagaa

SEQ ID NO: 236708 - RNA, 22 nt, Homo sapiens
uagguagauuuaaagauuuucu

SEQ ID NO: 236709 - RNA, 22 nt, Homo sapiens
uagguaucuugguauaucagga

SEQ ID NO: 236710 - RNA, 22 nt, Homo sapiens
uaguuauggaguaauuuuaagc

SEQ ID NO: 236711 - RNA, 22 nt, Homo sapiens
uaguuuaucuucuggauggaca

SEQ ID NO: 236712 - RNA, 22 nt, Homo sapiens
uauaaccauuucuucucucuuc

SEQ ID NO: 236713 - RNA, 22 nt, Homo sapiens
uauaagacuagcagcugaauug

SEQ ID NO: 236714 - RNA, 22 nt, Homo sapiens
uauacaugugccauguuggugu

SEQ ID NO: 236715 - RNA, 22 nt, Homo sapiens
uauacgugcagaucacagggga

SEQ ID NO: 236716 - RNA, 22 nt, Homo sapiens
uauagcuaugggauguauuugc

SEQ ID NO: 236717 - RNA, 22 nt, Homo sapiens
uaucaagauggauaaggauaga

SEQ ID NO: 236718 - RNA, 22 nt, Homo sapiens
uaucacaaacuuagcaguuuaa

SEQ ID NO: 236719 - RNA, 22 nt, Homo sapiens
uaucacagcgggguguacaccc

SEQ ID NO: 236720 - RNA, 20 nt, Homo sapiens
uaucacaggucagaaacccu

SEQ ID NO: 236721 - RNA, 21 nt, Homo sapiens
uaucacauuggugauuaaguu

SEQ ID NO: 236722 - RNA, 22 nt, Homo sapiens
uaucccuguggacuucccaaca

SEQ ID NO: 236723 - RNA, 22 nt, Homo sapiens
uauccuguagcucauccaccgc

SEQ ID NO: 236724 - RNA, 20 nt, Homo sapiens
uaucuacuugcaaaugccau

SEQ ID NO: 236725 - RNA, 18 nt, Homo sapiens
uaucucauuucuuagguc

SEQ ID NO: 236726 - RNA, 22 nt, Homo sapiens
uaugacugagacuuaaauugug

SEQ ID NO: 236727 - RNA, 22 nt, Homo sapiens
uaugacuuuugaauacagaugg

SEQ ID NO: 236728 - RNA, 22 nt, Homo sapiens
uaugagagcugguagguagaga

SEQ ID NO: 236729 - RNA, 22 nt, Homo sapiens
uaugagcacauauguaucuaug

SEQ ID NO: 236730 - RNA, 22 nt, Homo sapiens
uaugaucauuauguuauugcag

SEQ ID NO: 236731 - RNA, 22 nt, Homo sapiens
uaugaugcuguuuagaaucucu

SEQ ID NO: 236732 - RNA, 22 nt, Homo sapiens
uaugcacuauagcauauguggu

SEQ ID NO: 236733 - RNA, 22 nt, Homo sapiens
uaugccuuuuggcucaagaaac

SEQ ID NO: 236734 - RNA, 19 nt, Homo sapiens
uaugcuagagagggaagcu

SEQ ID NO: 236735 - RNA, 19 nt, Homo sapiens
uaugcuauuuauuagaagu

SEQ ID NO: 236736 - RNA, 22 nt, Homo sapiens
uauggcauuauuuugauagaca

SEQ ID NO: 236737 - RNA, 22 nt, Homo sapiens
uauggcauuguuggugaugaua

SEQ ID NO: 236738 - RNA, 22 nt, Homo sapiens
uaugucuucuuuagagaaaugu

SEQ ID NO: 236739 - RNA, 22 nt, Homo sapiens
uaugucuuuugcuugcaaauag

SEQ ID NO: 236740 - RNA, 22 nt, Homo sapiens
uaugugcaaauuaauugcuaga

SEQ ID NO: 236741 - RNA, 22 nt, Homo sapiens
uaugugguuaauaggaauuugu

SEQ ID NO: 236742 - RNA, 22 nt, Homo sapiens
uauuacugucaauaucacagaa

SEQ ID NO: 236743 - RNA, 22 nt, Homo sapiens
uauuaugcacuuuauaaaaauu

SEQ ID NO: 236744 - RNA, 22 nt, Homo sapiens
uauuccauuugugaaaggaagu

SEQ ID NO: 236745 - RNA, 22 nt, Homo sapiens
uauugcacuccucaugcauuug

SEQ ID NO: 236746 - RNA, 22 nt, Homo sapiens
uauugcauauuauucuaguggc

SEQ ID NO: 236747 - RNA, 22 nt, Homo sapiens
uauugcauguugagcaguaccu

SEQ ID NO: 236748 - RNA, 22 nt, Homo sapiens
uauugcucaugcauuuaauuuc

SEQ ID NO: 236749 - RNA, 22 nt, Homo sapiens
uauuugcacucccaucauggug

SEQ ID NO: 236750 - RNA, 22 nt, Homo sapiens
ucaaaaccucagagaguagagc

SEQ ID NO: 236751 - RNA, 22 nt, Homo sapiens
ucaaagacacacaaggagaagg

SEQ ID NO: 236752 - RNA, 20 nt, Homo sapiens
ucaaagacauggcugucaga

SEQ ID NO: 236753 - RNA, 22 nt, Homo sapiens
ucaaaguaaagccucaggaugg

SEQ ID NO: 236754 - RNA, 22 nt, Homo sapiens
ucaagcaauucuccucucagcc

SEQ ID NO: 236755 - RNA, 22 nt, Homo sapiens
ucaagcaauucuccugccucag

SEQ ID NO: 236756 - RNA, 18 nt, Homo sapiens
ucaagcaauugucaugcc

SEQ ID NO: 236757 - RNA, 22 nt, Homo sapiens
ucaaggcacuagcugagcugca

SEQ ID NO: 236758 - RNA, 22 nt, Homo sapiens
ucaaguacugccuugcucuggc

SEQ ID NO: 236759 - RNA, 22 nt, Homo sapiens
ucaaguacuuauuugauaauua

SEQ ID NO: 236760 - RNA, 22 nt, Homo sapiens
ucaaguaguaacuaacugugac

SEQ ID NO: 236761 - RNA, 22 nt, Homo sapiens
ucaaugaaugaugguugguaug

SEQ ID NO: 236762 - RNA, 22 nt, Homo sapiens
ucaauguaucuccaagaauuga

SEQ ID NO: 236763 - RNA, 16 nt, Homo sapiens
ucacaaacucuagcag

SEQ ID NO: 236764 - RNA, 22 nt, Homo sapiens
ucacaauggcugaacuaauuua

SEQ ID NO: 236765 - RNA, 22 nt, Homo sapiens
ucacacugaauuugaagcaaug

SEQ ID NO: 236766 - RNA, 23 nt, Homo sapiens
ucacacuuaagagaaaugcagcu

SEQ ID NO: 236767 - RNA, 22 nt, Homo sapiens
ucacagaugcuugacccauuuc

SEQ ID NO: 236768 - RNA, 22 nt, Homo sapiens
ucacaguucagcauggcugagg

SEQ ID NO: 236769 - RNA, 22 nt, Homo sapiens
ucacaugcacaucucuggaacc

SEQ ID NO: 236770 - RNA, 22 nt, Homo sapiens
ucacauggcagagaagaagcuc

SEQ ID NO: 236771 - RNA, 22 nt, Homo sapiens
ucacaugugcguuuuggcaugu

SEQ ID NO: 236772 - RNA, 22 nt, Homo sapiens
ucaccuagacucgaucauguag

SEQ ID NO: 236773 - RNA, 22 nt, Homo sapiens
ucaccuggagagcuugcuaaua

SEQ ID NO: 236774 - RNA, 22 nt, Homo sapiens
ucaccuggggcacagcugaaga

SEQ ID NO: 236775 - RNA, 18 nt, Homo sapiens
ucacggggagcagcagcc

SEQ ID NO: 236776 - RNA, 22 nt, Homo sapiens
ucacuauagaaaacagugugga

SEQ ID NO: 236777 - RNA, 22 nt, Homo sapiens
ucacugcacuucaggcuuucuc

SEQ ID NO: 236778 - RNA, 20 nt, Homo sapiens
ucacuggagcucauuugauu

SEQ ID NO: 236779 - RNA, 22 nt, Homo sapiens
ucacuggccaaauucuggguga

SEQ ID NO: 236780 - RNA, 22 nt, Homo sapiens
ucacuugguggcaaaguuuaug

SEQ ID NO: 236781 - RNA, 22 nt, Homo sapiens
ucagacacugagcaaacgacua

SEQ ID NO: 236782 - RNA, 22 nt, Homo sapiens
ucagaugcauccauaccccacu

SEQ ID NO: 236783 - RNA, 19 nt, Homo sapiens
ucagaugcauuagggguua

SEQ ID NO: 236784 - RNA, 19 nt, Homo sapiens
ucagcaguaaucaacuuca

SEQ ID NO: 236785 - RNA, 21 nt, Homo sapiens
ucagggaccugcuguacugau

SEQ ID NO: 236786 - RNA, 22 nt, Homo sapiens
ucagggacgcuugacacaagcc

SEQ ID NO: 236787 - RNA, 22 nt, Homo sapiens
ucaggguacuuguggccaaagu

SEQ ID NO: 236788 - RNA, 22 nt, Homo sapiens
ucagguagcauuuuggaaacag

SEQ ID NO: 236789 - RNA, 22 nt, Homo sapiens
ucagguagcuagauuaugugag

SEQ ID NO: 236790 - RNA, 22 nt, Homo sapiens
ucagguaguuugugggagauga

SEQ ID NO: 236791 - RNA, 22 nt, Homo sapiens
ucagguaucucuauagcaaugu

SEQ ID NO: 236792 - RNA, 23 nt, Homo sapiens
ucaguacuccacuuucaauagug

SEQ ID NO: 236793 - RNA, 21 nt, Homo sapiens
ucagugcaauucuauggggaa

SEQ ID NO: 236794 - RNA, 22 nt, Homo sapiens
ugagucgagauugcgccacugu

SEQ ID NO: 236795 - RNA, 22 nt, Homo sapiens
ugagucuguuccaaagaaauaa

SEQ ID NO: 236796 - RNA, 22 nt, Homo sapiens
ugagugaaagaagcacuaagga

SEQ ID NO: 236797 - RNA, 22 nt, Homo sapiens
ugagugaaugugaaggcuaggg

SEQ ID NO: 236798 - RNA, 22 nt, Homo sapiens
ugagugugacuuagcagaagga

SEQ ID NO: 236799 - RNA, 22 nt, Homo sapiens
ugaguuagguguuuuaaauaua

SEQ ID NO: 236800 - RNA, 20 nt, Homo sapiens
ugaguuccuuguucagaagc

SEQ ID NO: 236801 - RNA, 22 nt, Homo sapiens
ugauaguugucagugggggacc

SEQ ID NO: 236802 - RNA, 22 nt, Homo sapiens
ugauaugaaguuagcuggcugu

SEQ ID NO: 236803 - RNA, 21 nt, Homo sapiens
ugauaugguuuggauaugugu

SEQ ID NO: 236804 - RNA, 22 nt, Homo sapiens
ugauccuguccuuaugauguua

SEQ ID NO: 236805 - RNA, 22 nt, Homo sapiens
ugaugacccugcaguucucaag

SEQ ID NO: 236806 - RNA, 22 nt, Homo sapiens
ugaugcugaguggcuauuugaa

SEQ ID NO: 236807 - RNA, 22 nt, Homo sapiens
ugauggcauuuggaguugggac

SEQ ID NO: 236808 - RNA, 18 nt, Homo sapiens
ugcaaacauguguguguu

SEQ ID NO: 236809 - RNA, 22 nt, Homo sapiens
ugcaaagaaauuuuggugacca

SEQ ID NO: 236810 - RNA, 22 nt, Homo sapiens
ugcaagauaggcaguuugcacu

SEQ ID NO: 236811 - RNA, 22 nt, Homo sapiens
ugcaagaugagauuuuggaugg

SEQ ID NO: 236812 - RNA, 22 nt, Homo sapiens
ugcaaugugaaauaagcacauc

SEQ ID NO: 236813 - RNA, 22 nt, Homo sapiens
ugcagagaaacauuuuguauuu

SEQ ID NO: 236814 - RNA, 22 nt, Homo sapiens
ugcagagucuguccugccugcc

SEQ ID NO: 236815 - RNA, 19 nt, Homo sapiens
ugcagcaauguaaaagaca

SEQ ID NO: 236816 - RNA, 18 nt, Homo sapiens
ugcauacuaucugauuuu

SEQ ID NO: 236817 - RNA, 21 nt, Homo sapiens
ugcauacuucucagaugauua

SEQ ID NO: 236818 - RNA, 22 nt, Homo sapiens
ugccaaaaugggcuuuauaccg

SEQ ID NO: 236819 - RNA, 22 nt, Homo sapiens
ugccaucauuaauauuaggcau

SEQ ID NO: 236820 - RNA, 22 nt, Homo sapiens
ugccugagcccagcccuguagu

SEQ ID NO: 236821 - RNA, 22 nt, Homo sapiens
ugccugcugucuaauauauucu

SEQ ID NO: 236822 - RNA, 22 nt, Homo sapiens
ugcuacccuucgucucucuggu

SEQ ID NO: 236823 - RNA, 20 nt, Homo sapiens
ugcugcacuuaagcaugggc

SEQ ID NO: 236824 - RNA, 22 nt, Homo sapiens
ugcugcacuuauggcucugagg

SEQ ID NO: 236825 - RNA, 22 nt, Homo sapiens
ugcuucauuggccaccaggaag

SEQ ID NO: 236826 - RNA, 22 nt, Homo sapiens
uggaagacauugggugaagggu

SEQ ID NO: 236827 - RNA, 22 nt, Homo sapiens
uggaagauucuagaagauucca

SEQ ID NO: 236828 - RNA, 22 nt, Homo sapiens
uggaagucaugcugcaagaaca

SEQ ID NO: 236829 - RNA, 22 nt, Homo sapiens
uggaagucauugagguguguua

SEQ ID NO: 236830 - RNA, 21 nt, Homo sapiens
uggaaucuauagaggcaguag

SEQ ID NO: 236831 - RNA, 21 nt, Homo sapiens
uggaaucuauuauuccaguuu

SEQ ID NO: 236832 - RNA, 22 nt, Homo sapiens
uggaaugguuggugugauuuua

SEQ ID NO: 236833 - RNA, 17 nt, Homo sapiens
uggaaugucuaagccug

SEQ ID NO: 236834 - RNA, 22 nt, Homo sapiens
uggaauguuuaucaaaacagua

SEQ ID NO: 236835 - RNA, 22 nt, Homo sapiens
uggaauuaauuaaaauauacug

SEQ ID NO: 236836 - RNA, 19 nt, Homo sapiens
uggaccccuuccuuacacc

SEQ ID NO: 236837 - RNA, 21 nt, Homo sapiens
uggaccccuuccuugcaccau

SEQ ID NO: 236838 - RNA, 22 nt, Homo sapiens
uggaccccuucuccuauuaaaa

SEQ ID NO: 236839 - RNA, 22 nt, Homo sapiens
uggagagucauuuauaguauuu

SEQ ID NO: 236840 - RNA, 22 nt, Homo sapiens
uggagagugauaaguaaaugga

SEQ ID NO: 236841 - RNA, 22 nt, Homo sapiens
uggagguagacauugggaagag

SEQ ID NO: 236842 - RNA, 22 nt, Homo sapiens
uggagguaggacgaagaacucu

SEQ ID NO: 236843 - RNA, 22 nt, Homo sapiens
uggagucuugcucuguugccca

SEQ ID NO: 236844 - RNA, 22 nt, Homo sapiens
uggagugcgagggugaaacuuu

SEQ ID NO: 236845 - RNA, 20 nt, Homo sapiens
uggagugcuguguugagaag

SEQ ID NO: 236846 - RNA, 22 nt, Homo sapiens
uggaguguguugcagaugaagg

SEQ ID NO: 236847 - RNA, 22 nt, Homo sapiens
uggcaacaucuggggacauguu

SEQ ID NO: 236848 - RNA, 22 nt, Homo sapiens
uggcagauagaaaugugguuaa

SEQ ID NO: 236849 - RNA, 22 nt, Homo sapiens
uggcagaugagccgcgcuccaa

SEQ ID NO: 236850 - RNA, 22 nt, Homo sapiens
uggcaggugcacuggcuuugaa

SEQ ID NO: 236851 - RNA, 22 nt, Homo sapiens
uggcauuuugugugaauuagaa

SEQ ID NO: 236852 - RNA, 23 nt, Homo sapiens
uggcauuuuuggcaaugccuucu

SEQ ID NO: 236853 - RNA, 22 nt, Homo sapiens
uggccuuuuccaagaacuacua

SEQ ID NO: 236854 - RNA, 22 nt, Homo sapiens
uggcgagaugcucgugugcaga

SEQ ID NO: 236855 - RNA, 22 nt, Homo sapiens
uggcuaagaugcacacuucacu

SEQ ID NO: 236856 - RNA, 22 nt, Homo sapiens
uggcuguguccucucccaaauc

SEQ ID NO: 236857 - RNA, 22 nt, Homo sapiens
ugggaucuuuccuauuagcgag

SEQ ID NO: 236858 - RNA, 22 nt, Homo sapiens
ugggcaaauugugagggaggua

SEQ ID NO: 236859 - RNA, 22 nt, Homo sapiens
uggguagagcacugggggcgag

SEQ ID NO: 236860 - RNA, 23 nt, Homo sapiens
uggguucccuaagcgcaugcugc

SEQ ID NO: 236861 - RNA, 21 nt, Homo sapiens
uggucaguuuucucacuagga

SEQ ID NO: 236862 - RNA, 22 nt, Homo sapiens
ugguccacuaacccucaguauc

SEQ ID NO: 236863 - RNA, 22 nt, Homo sapiens
uggugcuuaaauaaggcuuuca

SEQ ID NO: 236864 - RNA, 22 nt, Homo sapiens
uguaaacucaguauguuuuacu

SEQ ID NO: 236865 - RNA, 22 nt, Homo sapiens
uguaaagaaagcuguuguugua

SEQ ID NO: 236866 - RNA, 20 nt, Homo sapiens
uguaaaggagauugcagcug

SEQ ID NO: 236867 - RNA, 22 nt, Homo sapiens
uguagauaucauuagugcugug

SEQ ID NO: 236868 - RNA, 22 nt, Homo sapiens
uguaugagagugaaagcauuuc

SEQ ID NO: 236869 - RNA, 22 nt, Homo sapiens
ugucaaagagacaucugcacuc

SEQ ID NO: 236870 - RNA, 22 nt, Homo sapiens
ugucaaaugcagugauauuuga

SEQ ID NO: 236871 - RNA, 22 nt, Homo sapiens
ugucaauauguaauaacugaau

SEQ ID NO: 236872 - RNA, 18 nt, Homo sapiens
ugucacuggauaaugguc

SEQ ID NO: 236873 - RNA, 22 nt, Homo sapiens
ugucacugugaguuugacugcu

SEQ ID NO: 236874 - RNA, 19 nt, Homo sapiens
ugucaucaucuuuucuugc

SEQ ID NO: 236875 - RNA, 22 nt, Homo sapiens
ugucaugguguuaauuuuccug

SEQ ID NO: 236876 - RNA, 22 nt, Homo sapiens
ugucauucaggaaauucuaagu

SEQ ID NO: 236877 - RNA, 22 nt, Homo sapiens
uguccaaaucagagguaccaaa

SEQ ID NO: 236878 - RNA, 22 nt, Homo sapiens
uguccaaauugaaucaucuggu

SEQ ID NO: 236879 - RNA, 21 nt, Homo sapiens
uguccagcuuuuggaauauaa

SEQ ID NO: 236880 - RNA, 22 nt, Homo sapiens
uguccugaagcuuuguuaugua

SEQ ID NO: 236881 - RNA, 22 nt, Homo sapiens
ugugaaaucagauagccuuuuu

SEQ ID NO: 236882 - RNA, 22 nt, Homo sapiens
ugugaacagcagcugggcuuug

SEQ ID NO: 236883 - RNA, 22 nt, Homo sapiens
cugaggauauucagccucugug

SEQ ID NO: 236884 - RNA, 22 nt, Homo sapiens
cugagguauuuaggugaaagaa

SEQ ID NO: 236885 - RNA, 22 nt, Homo sapiens
cugagugcaagugauccuccca

SEQ ID NO: 236886 - RNA, 22 nt, Homo sapiens
cugauuguucuugcugggccuu

SEQ ID NO: 236887 - RNA, 21 nt, Homo sapiens
cugcaaaugcugcugccugau

SEQ ID NO: 236888 - RNA, 22 nt, Homo sapiens
cugcaagaugcauaggaauuuu

SEQ ID NO: 236889 - RNA, 22 nt, Homo sapiens
cugccacugacaccucaaggac

SEQ ID NO: 236890 - RNA, 20 nt, Homo sapiens
cugcuccccuacaaaucuca

SEQ ID NO: 236891 - RNA, 22 nt, Homo sapiens
cuggaaagcaaguccauugcuc

SEQ ID NO: 236892 - RNA, 22 nt, Homo sapiens
cuggaagaaaaucacgccaucu

SEQ ID NO: 236893 - RNA, 20 nt, Homo sapiens
ugaaggaggucauuuauacc

SEQ ID NO: 236894 - RNA, 22 nt, Homo sapiens
ugaaggccgggcaugguggcuc

SEQ ID NO: 236895 - RNA, 21 nt, Homo sapiens
ugaaguagcauaggaugucaa

SEQ ID NO: 236896 - RNA, 21 nt, Homo sapiens
ugaaguguaaccgugcagggc

SEQ ID NO: 236897 - RNA, 18 nt, Homo sapiens
ugaauacagcguugggaa

SEQ ID NO: 236898 - RNA, 22 nt, Homo sapiens
ugaauacuucguucaaagauaa

SEQ ID NO: 236899 - RNA, 22 nt, Homo sapiens
ugaauauguuaaauaauguucu

SEQ ID NO: 236900 - RNA, 21 nt, Homo sapiens
ugaauauuuggguugugucca

SEQ ID NO: 236901 - RNA, 19 nt, Homo sapiens
ugaaugacaucuaaagucc

SEQ ID NO: 236902 - RNA, 22 nt, Homo sapiens
ugaauguaagaugucugcuggu

SEQ ID NO: 236903 - RNA, 22 nt, Homo sapiens
ugaauguuguugguugagauau

SEQ ID NO: 236904 - RNA, 22 nt, Homo sapiens
ugaauucaucucacagaguuaa

SEQ ID NO: 236905 - RNA, 22 nt, Homo sapiens
ugaauuguuuacgagaugugag

SEQ ID NO: 236906 - RNA, 22 nt, Homo sapiens
ugacaagaguagagagggugcc

SEQ ID NO: 236907 - RNA, 22 nt, Homo sapiens
ugacaaguaaacagucagcacc

SEQ ID NO: 236908 - RNA, 20 nt, Homo sapiens
ugacaagugagaauuauggg

SEQ ID NO: 236909 - RNA, 19 nt, Homo sapiens
ugacacuguuggugggagg

SEQ ID NO: 236910 - RNA, 23 nt, Homo sapiens
ugacagaccuucuggaagaaguc

SEQ ID NO: 236911 - RNA, 22 nt, Homo sapiens
ugacagcaucaggauuggagag

SEQ ID NO: 236912 - RNA, 22 nt, Homo sapiens
ugacagcuguugaggcauuuau

SEQ ID NO: 236913 - RNA, 22 nt, Homo sapiens
ugacaggauggagaucgguauu

SEQ ID NO: 236914 - RNA, 23 nt, Homo sapiens
ugacagucucccgauggcuaggc

SEQ ID NO: 236915 - RNA, 23 nt, Homo sapiens
ugacagugcuugaaauugcucuu

SEQ ID NO: 236916 - RNA, 22 nt, Homo sapiens
ugacauggaaguagguauacau

SEQ ID NO: 236917 - RNA, 22 nt, Homo sapiens
ugacauggagagagaagccuuu

SEQ ID NO: 236918 - RNA, 22 nt, Homo sapiens
ugacauggagguggaggaagau

SEQ ID NO: 236919 - RNA, 22 nt, Homo sapiens
ugacauggugcucuuucaggca

SEQ ID NO: 236920 - RNA, 21 nt, Homo sapiens
ugacauguugguuugcugcac

SEQ ID NO: 236921 - RNA, 22 nt, Homo sapiens
ugacauuacagucacuugcugu

SEQ ID NO: 236922 - RNA, 22 nt, Homo sapiens
ugacauugggagugaagugaag

SEQ ID NO: 236923 - RNA, 22 nt, Homo sapiens
ugaccacugucuaagauaggug

SEQ ID NO: 236924 - RNA, 22 nt, Homo sapiens
ugacccuguggcagcgucuaag

SEQ ID NO: 236925 - RNA, 22 nt, Homo sapiens
ugaccuguuugaaauugccaau

SEQ ID NO: 236926 - RNA, 22 nt, Homo sapiens
ugacggaggacaccugcggaau

SEQ ID NO: 236927 - RNA, 21 nt, Homo sapiens
ugacuagauuccagauuggcc

SEQ ID NO: 236928 - RNA, 22 nt, Homo sapiens
ugacucaguuguuagucuucau

SEQ ID NO: 236929 - RNA, 22 nt, Homo sapiens
ugacuggagaccucaguagggu

SEQ ID NO: 236930 - RNA, 22 nt, Homo sapiens
ugacugucuagauagagcuugg

SEQ ID NO: 236931 - RNA, 22 nt, Homo sapiens
ugacuucagacugaaaugauuc

SEQ ID NO: 236932 - RNA, 22 nt, Homo sapiens
ugagaacagauggcuuuauuau

SEQ ID NO: 236933 - RNA, 22 nt, Homo sapiens
ugagaacaugugauauuuggug

SEQ ID NO: 236934 - RNA, 19 nt, Homo sapiens
ugagaacaugugguauuug

SEQ ID NO: 236935 - RNA, 20 nt, Homo sapiens
ugagaacaugugguauuugg

SEQ ID NO: 236936 - RNA, 22 nt, Homo sapiens
ugaaugcuaaaggaaaacagua

SEQ ID NO: 236937 - RNA, 22 nt, Homo sapiens
ugaaugguuuuuagagaacaau

SEQ ID NO: 236938 - RNA, 20 nt, Homo sapiens
ugaauguaauuacagaugua

SEQ ID NO: 236939 - RNA, 22 nt, Homo sapiens
ugaaugugauggguuucaugug

SEQ ID NO: 236940 - RNA, 22 nt, Homo sapiens
ugaauugucucucacuggguuc

SEQ ID NO: 236941 - RNA, 22 nt, Homo sapiens
ugacaagacuacauaucccauu

SEQ ID NO: 236942 - RNA, 18 nt, Homo sapiens
ugacaaugcuaguccugg

SEQ ID NO: 236943 - RNA, 22 nt, Homo sapiens
ugacacagugggggauccuuuu

SEQ ID NO: 236944 - RNA, 22 nt, Homo sapiens
ugacacauguagacaucuggug

SEQ ID NO: 236945 - RNA, 21 nt, Homo sapiens
ugacagaaaauugaguuugcu

SEQ ID NO: 236946 - RNA, 22 nt, Homo sapiens
ugacagagaagcauugaguuca

SEQ ID NO: 236947 - RNA, 22 nt, Homo sapiens
ugacagagcaggacuucaucuc

SEQ ID NO: 236948 - RNA, 22 nt, Homo sapiens
ugacagaggucuuuuaauagcu

SEQ ID NO: 236949 - RNA, 22 nt, Homo sapiens
ugacaggagauuaugugauguu

SEQ ID NO: 236950 - RNA, 22 nt, Homo sapiens
ugacaguaaacagucuugauua

SEQ ID NO: 236951 - RNA, 22 nt, Homo sapiens
ugacaguaucuacagcuucuua

SEQ ID NO: 236952 - RNA, 22 nt, Homo sapiens
ugacagugaauaagucucuuaa

SEQ ID NO: 236953 - RNA, 22 nt, Homo sapiens
ugacagugugagacuuugucuc

SEQ ID NO: 236954 - RNA, 22 nt, Homo sapiens
ugacaguuuccagggcugucuc

SEQ ID NO: 236955 - RNA, 18 nt, Homo sapiens
ugacaguuucuuuauauu

SEQ ID NO: 236956 - RNA, 22 nt, Homo sapiens
ugacaugauguuccuacacugu

SEQ ID NO: 236957 - RNA, 23 nt, Homo sapiens
ugacauguaauucaguccagcag

SEQ ID NO: 236958 - RNA, 22 nt, Homo sapiens
ugacauguagagaacuucucau

SEQ ID NO: 236959 - RNA, 18 nt, Homo sapiens
ugacauugagcugagaaa

SEQ ID NO: 236960 - RNA, 22 nt, Homo sapiens
ugaccacagaaagugagggagc

SEQ ID NO: 236961 - RNA, 17 nt, Homo sapiens
ugaccacugauucuacu

SEQ ID NO: 236962 - RNA, 19 nt, Homo sapiens
ugaccagggacagaaacca

SEQ ID NO: 236963 - RNA, 22 nt, Homo sapiens
ugacuaaggaaggauuaugugc

SEQ ID NO: 236964 - RNA, 22 nt, Homo sapiens
ugacuaggaggcuggaggauga

SEQ ID NO: 236965 - RNA, 22 nt, Homo sapiens
ugacuauaggauaacaugcauu

SEQ ID NO: 236966 - RNA, 22 nt, Homo sapiens
ugacucaagagccugacucauc

SEQ ID NO: 236967 - RNA, 22 nt, Homo sapiens
ugacuccagagacugugcuguc

SEQ ID NO: 236968 - RNA, 22 nt, Homo sapiens
ugacuggagucuugcucugucg

SEQ ID NO: 236969 - RNA, 21 nt, Homo sapiens
ugagaacaacaggucaagcag

SEQ ID NO: 236970 - RNA, 22 nt, Homo sapiens
ugagaacagcagcuugggacac

SEQ ID NO: 236971 - RNA, 16 nt, Homo sapiens
ugagaacaugcagcau

SEQ ID NO: 236972 - RNA, 22 nt, Homo sapiens
ugagaacauuccucuuccuggc

SEQ ID NO: 236973 - RNA, 22 nt, Homo sapiens
ugagaacuaaugaagaauuuau

SEQ ID NO: 236974 - RNA, 22 nt, Homo sapiens
ugagaacuagagaacaagguga

SEQ ID NO: 236975 - RNA, 22 nt, Homo sapiens
ugagaacucaugaaucuuucca

SEQ ID NO: 236976 - RNA, 22 nt, Homo sapiens
ugagaacuuugucuuuuacucu

SEQ ID NO: 236977 - RNA, 22 nt, Homo sapiens
ugagaauauuugaagauguuag

SEQ ID NO: 236978 - RNA, 22 nt, Homo sapiens
ugagaaugaugauuuccaguuu

SEQ ID NO: 236979 - RNA, 22 nt, Homo sapiens
ugagacaaaguuguuggauguu

SEQ ID NO: 236980 - RNA, 22 nt, Homo sapiens
ugagacaaucucaucucaguga

SEQ ID NO: 236981 - RNA, 22 nt, Homo sapiens
ugagacacugaauccggccuga

SEQ ID NO: 236982 - RNA, 22 nt, Homo sapiens
ugagacauauuauacugcuuuu

SEQ ID NO: 236983 - RNA, 22 nt, Homo sapiens
ugagacaugugaacuguaguuc

SEQ ID NO: 236984 - RNA, 22 nt, Homo sapiens
ugagaccaacagauuccaguuc

SEQ ID NO: 236985 - RNA, 22 nt, Homo sapiens
ugagacggagucucgcucuguu

SEQ ID NO: 236986 - RNA, 22 nt, Homo sapiens
ugagacggagucuugcucuguc

SEQ ID NO: 236987 - RNA, 22 nt, Homo sapiens
ugagacggaguuuugcucuugu

SEQ ID NO: 236988 - RNA, 22 nt, Homo sapiens
ugagacugagucucgcucuugu

SEQ ID NO: 236989 - RNA, 22 nt, Homo sapiens
ugagacugaguuucacuuuugu

SEQ ID NO: 236990 - RNA, 22 nt, Homo sapiens
ugagacugaguuucgcucuugu

SEQ ID NO: 236991 - RNA, 22 nt, Homo sapiens
ugagacugguuaauugauaaag

SEQ ID NO: 236992 - RNA, 22 nt, Homo sapiens
ugagagacagacauuaucuuau

SEQ ID NO: 236993 - RNA, 21 nt, Homo sapiens
ugagaguaguguauuauucuc

SEQ ID NO: 236994 - RNA, 22 nt, Homo sapiens
ugagagucacugaccugguaua

SEQ ID NO: 236995 - RNA, 21 nt, Homo sapiens
ugagauaauauguuucugaug

SEQ ID NO: 236996 - RNA, 22 nt, Homo sapiens
ugagauaaugcaugugaagauc

SEQ ID NO: 236997 - RNA, 22 nt, Homo sapiens
ugagauagaaaacauaggagaa

SEQ ID NO: 236998 - RNA, 22 nt, Homo sapiens
ugagauaguacuuuuuuaaagg

SEQ ID NO: 236999 - RNA, 22 nt, Homo sapiens
ugagauaucauuucacacccag

SEQ ID NO: 237000 - RNA, 18 nt, Homo sapiens
ugagaucagcaucaaggg

SEQ ID NO: 237001 - RNA, 22 nt, Homo sapiens
ugagaucaugccacugcacuuc

SEQ ID NO: 237002 - RNA, 19 nt, Homo sapiens
ugagauccacugaagauuc

SEQ ID NO: 237003 - RNA, 23 nt, Homo sapiens
ugagaucuacagaucucagaucu

SEQ ID NO: 237004 - RNA, 22 nt, Homo sapiens
ugagaucugauaggccuggguu

SEQ ID NO: 237005 - RNA, 22 nt, Homo sapiens
ugagaucuguaaagucugacau

SEQ ID NO: 237006 - RNA, 22 nt, Homo sapiens
ugagaucuuuuguggcugagaa

SEQ ID NO: 237007 - RNA, 22 nt, Homo sapiens
ugagaugaaagcagaaagacuu

SEQ ID NO: 237008 - RNA, 22 nt, Homo sapiens
ugagaugaagucuugcucuguu

SEQ ID NO: 237009 - RNA, 22 nt, Homo sapiens
ugagaugagaaucaguucuaau

SEQ ID NO: 237010 - RNA, 22 nt, Homo sapiens
ugagaugaggucucacucuguu

SEQ ID NO: 237011 - RNA, 22 nt, Homo sapiens
ugagaugaguucucgcucuguc

SEQ ID NO: 237012 - RNA, 22 nt, Homo sapiens
ugagaugaucaaaguauaggcu

SEQ ID NO: 237013 - RNA, 21 nt, Homo sapiens
ugagaugauccugcaugcaug

SEQ ID NO: 237014 - RNA, 22 nt, Homo sapiens
ugagauggaguuucacuuuugu

SEQ ID NO: 237015 - RNA, 22 nt, Homo sapiens
ugagauggaguuucgcucuugu

SEQ ID NO: 237016 - RNA, 22 nt, Homo sapiens
ugagauggcuuuauugcugaau

SEQ ID NO: 237017 - RNA, 22 nt, Homo sapiens
ugagaugugugcauucaacuca

SEQ ID NO: 237018 - RNA, 22 nt, Homo sapiens
ugagauuauauuucuuaacaga

SEQ ID NO: 237019 - RNA, 22 nt, Homo sapiens
ugagcaaaauuuuggacauaga

SEQ ID NO: 237020 - RNA, 22 nt, Homo sapiens
ugagcaacauuucaaaacucca

SEQ ID NO: 237021 - RNA, 22 nt, Homo sapiens
ugagcacuguacuuuaucaggu

SEQ ID NO: 237022 - RNA, 22 nt, Homo sapiens
ugagcagaaagcugcaaggucg

SEQ ID NO: 237023 - RNA, 22 nt, Homo sapiens
ugagcagagaagugcccugcgc

SEQ ID NO: 237024 - RNA, 22 nt, Homo sapiens
ugagcagugagugugcugcagg

SEQ ID NO: 237025 - RNA, 22 nt, Homo sapiens
ugagcagugaguguggugcagg

SEQ ID NO: 237026 - RNA, 20 nt, Homo sapiens
ugagcucaauuguugcaagu

SEQ ID NO: 237027 - RNA, 22 nt, Homo sapiens
ugagcugagaucacacuacugu

SEQ ID NO: 237028 - RNA, 22 nt, Homo sapiens
ugagcugagauuaagcugcugc

SEQ ID NO: 237029 - RNA, 22 nt, Homo sapiens
ugagcugguacuaauauuauca

SEQ ID NO: 237030 - RNA, 22 nt, Homo sapiens
ugaggagugaacuauuucugau

SEQ ID NO: 237031 - RNA, 22 nt, Homo sapiens
ugaggaguguauuucauucgcu

SEQ ID NO: 237032 - RNA, 22 nt, Homo sapiens
ugaggaucucuaggaauuuauc

SEQ ID NO: 237033 - RNA, 17 nt, Homo sapiens
ugaggcacuaguaucac

SEQ ID NO: 237034 - RNA, 22 nt, Homo sapiens
ugaggcuagucagaucagauga

SEQ ID NO: 237035 - RNA, 22 nt, Homo sapiens
ugaggguauagccagcccuuag

SEQ ID NO: 237036 - RNA, 22 nt, Homo sapiens
ugagguaacagaagcgagcauu

SEQ ID NO: 237037 - RNA, 22 nt, Homo sapiens
ugaggugagggguuaggugcua

SEQ ID NO: 237038 - RNA, 22 nt, Homo sapiens
uggagguagggccuaggaaucu

SEQ ID NO: 237039 - RNA, 22 nt, Homo sapiens
uggagguaggugauauguagca

SEQ ID NO: 237040 - RNA, 20 nt, Homo sapiens
uggaggucaucugucacuac

SEQ ID NO: 237041 - RNA, 20 nt, Homo sapiens
uggagugaagguucuggacc

SEQ ID NO: 237042 - RNA, 22 nt, Homo sapiens
uggagugagaacuucaaugaug

SEQ ID NO: 237043 - RNA, 22 nt, Homo sapiens
uggaguguuggggcaggaucuc

SEQ ID NO: 237044 - RNA, 18 nt, Homo sapiens
uggauaugaaauucugga

SEQ ID NO: 237045 - RNA, 22 nt, Homo sapiens
uggaugaagagaugguaguugc

SEQ ID NO: 237046 - RNA, 22 nt, Homo sapiens
uggaugacuguuauaugcauau

SEQ ID NO: 237047 - RNA, 22 nt, Homo sapiens
uggauggucagaggguuucugu

SEQ ID NO: 237048 - RNA, 22 nt, Homo sapiens
uggauugaaagcuuuaauauug

SEQ ID NO: 237049 - RNA, 22 nt, Homo sapiens
uggcaaaaaucacaaguaccuu

SEQ ID NO: 237050 - RNA, 22 nt, Homo sapiens
uggcaaaauggaauauguuggg

SEQ ID NO: 237051 - RNA, 22 nt, Homo sapiens
uggcaagagggaugcaagguuu

SEQ ID NO: 237052 - RNA, 22 nt, Homo sapiens
uggcagaugagccgcgcuccaa

SEQ ID NO: 237053 - RNA, 22 nt, Homo sapiens
uggcagaugcucuuggugccca

SEQ ID NO: 237054 - RNA, 20 nt, Homo sapiens
uggcaugaaauuuuccaagc

SEQ ID NO: 237055 - RNA, 19 nt, Homo sapiens
uggcaugaaugugaacuaa

SEQ ID NO: 237056 - RNA, 22 nt, Homo sapiens
uggcaugucagguuucuggguu

SEQ ID NO: 237057 - RNA, 22 nt, Homo sapiens
uggccaagagcacagauauugg

SEQ ID NO: 237058 - RNA, 22 nt, Homo sapiens
uggcgagaaaccauaugcuuuc

SEQ ID NO: 237059 - RNA, 22 nt, Homo sapiens
uggcgggaaaguugggagaaga

SEQ ID NO: 237060 - RNA, 22 nt, Homo sapiens
uggcucauuucuaaacccagcu

SEQ ID NO: 237061 - RNA, 22 nt, Homo sapiens
uggcuguuuauuucaccugggc

SEQ ID NO: 237062 - RNA, 22 nt, Homo sapiens
uggcuguuuauuucacgugggu

SEQ ID NO: 237063 - RNA, 22 nt, Homo sapiens
ugggaaauguagccuagcugug

SEQ ID NO: 237064 - RNA, 22 nt, Homo sapiens
ugggaaugaaauuacauagcuu

SEQ ID NO: 237065 - RNA, 22 nt, Homo sapiens
ugggaccccuacucuuuccaca

SEQ ID NO: 237066 - RNA, 22 nt, Homo sapiens
ugggaucauuaugcauagugua

SEQ ID NO: 237067 - RNA, 22 nt, Homo sapiens
ugggaucgucaagugaggcucg

SEQ ID NO: 237068 - RNA, 22 nt, Homo sapiens
ugggaugaaaauagcuucuucc

SEQ ID NO: 237069 - RNA, 22 nt, Homo sapiens
ugggaugaugaaaaggcuuucu

SEQ ID NO: 237070 - RNA, 23 nt, Homo sapiens
ugggauguuuuuggaaacuucug

SEQ ID NO: 237071 - RNA, 21 nt, Homo sapiens
ugggccccuuccuuacaucau

SEQ ID NO: 237072 - RNA, 22 nt, Homo sapiens
ugggcuagaugcuuugggguca

SEQ ID NO: 237073 - RNA, 22 nt, Homo sapiens
uggguaaaucuguuuggggcuc

SEQ ID NO: 237074 - RNA, 22 nt, Homo sapiens
uggguagagcacugggggcgag

SEQ ID NO: 237075 - RNA, 22 nt, Homo sapiens
uggguaguguaaagcacuccag

SEQ ID NO: 237076 - RNA, 22 nt, Homo sapiens
ugggucaguagcauguaugucu

SEQ ID NO: 237077 - RNA, 22 nt, Homo sapiens
ugggugugaccgcucaaggggg

SEQ ID NO: 237078 - RNA, 22 nt, Homo sapiens
ugguauguaugauuaacaugga

SEQ ID NO: 237079 - RNA, 22 nt, Homo sapiens
uggucagaugcugaguggaucu

SEQ ID NO: 237080 - RNA, 22 nt, Homo sapiens
uggucauggggcagcugacacu

SEQ ID NO: 237081 - RNA, 22 nt, Homo sapiens
ugguccucugcuuccagaauuc

SEQ ID NO: 237082 - RNA, 22 nt, Homo sapiens
uggucuggagagucccgcccag

SEQ ID NO: 237083 - RNA, 19 nt, Homo sapiens
uggugccuuguucuuggau

SEQ ID NO: 237084 - RNA, 20 nt, Homo sapiens
ugguguuugaacagugaaug

SEQ ID NO: 237085 - RNA, 22 nt, Homo sapiens
ugguucaguugcacaggcuguu

SEQ ID NO: 237086 - RNA, 23 nt, Homo sapiens
ugguuuguaagagauggacugga

SEQ ID NO: 237087 - RNA, 23 nt, Homo sapiens
uguaaaagcauuugucagccugg

SEQ ID NO: 237088 - RNA, 22 nt, Homo sapiens
uguaaacauguauguguuuaug

SEQ ID NO: 237089 - RNA, 22 nt, Homo sapiens
uguaaacucaguauguuuuacu

SEQ ID NO: 237090 - RNA, 20 nt, Homo sapiens
uguaaaggagauugcagcug

SEQ ID NO: 237091 - RNA, 22 nt, Homo sapiens
uguaacaguaguuacuauucuu

SEQ ID NO: 237092 - RNA, 22 nt, Homo sapiens
uguacaaaacaagaugggggua

SEQ ID NO: 237093 - RNA, 20 nt, Homo sapiens
uguacacaguguacccacau

SEQ ID NO: 237094 - RNA, 22 nt, Homo sapiens
uguacuucaagauuaugguuua

SEQ ID NO: 237095 - RNA, 21 nt, Homo sapiens
uguagcagcaugauuuauaau

SEQ ID NO: 237096 - RNA, 22 nt, Homo sapiens
uguauauguuuguacauauguc

SEQ ID NO: 237097 - RNA, 22 nt, Homo sapiens
uguauguugggucaaaguacau

SEQ ID NO: 237098 - RNA, 19 nt, Homo sapiens
ugucaaaugucuccugggg

SEQ ID NO: 237099 - RNA, 22 nt, Homo sapiens
ugucaccauuuguaggugagga

SEQ ID NO: 237100 - RNA, 22 nt, Homo sapiens
ugucaguuucaguguuagccuu

SEQ ID NO: 237101 - RNA, 22 nt, Homo sapiens
ugucauacaguaacaugguugg

SEQ ID NO: 237102 - RNA, 22 nt, Homo sapiens
ugucaucauuccaucagggcuu

SEQ ID NO: 237103 - RNA, 22 nt, Homo sapiens
ugucaucuagguauuaagcccc

SEQ ID NO: 237104 - RNA, 22 nt, Homo sapiens
ugucauguugguguacugcacc

SEQ ID NO: 237105 - RNA, 22 nt, Homo sapiens
ugucccaguuggguauugaauu

SEQ ID NO: 237106 - RNA, 22 nt, Homo sapiens
uguccuguaggaggcagaacaa

SEQ ID NO: 237107 - RNA, 21 nt, Homo sapiens
ugucuagaccucauccuacag

SEQ ID NO: 237108 - RNA, 22 nt, Homo sapiens
ugucucagugauuggcuuucug

SEQ ID NO: 237109 - RNA, 22 nt, Homo sapiens
ugucuuugguucaggcaaggag

SEQ ID NO: 237110 - RNA, 22 nt, Homo sapiens
ugucuuuguuaguuguccuagu

SEQ ID NO: 237111 - RNA, 22 nt, Homo sapiens
ugugaaacacgaaagucuaaaa

SEQ ID NO: 237112 - RNA, 22 nt, Homo sapiens
ugugaaaucagauagccuuuuu

SEQ ID NO: 237113 - RNA, 22 nt, Homo sapiens
ugugaacagcuccaaaugugga

SEQ ID NO: 237114 - RNA, 22 nt, Homo sapiens
ugugaaccucuggccaagauga

SEQ ID NO: 237115 - RNA, 22 nt, Homo sapiens
ugugaagauggacuaauauagu

SEQ ID NO: 237116 - RNA, 22 nt, Homo sapiens
ugugaaugauggagugucgaau

SEQ ID NO: 237117 - RNA, 22 nt, Homo sapiens
ugugaauggugcuuccuagaug

SEQ ID NO: 237118 - RNA, 22 nt, Homo sapiens
ugugaauguaagaaaauccaac

SEQ ID NO: 237119 - RNA, 22 nt, Homo sapiens
ugugacacugaauggcagaacu

SEQ ID NO: 237120 - RNA, 22 nt, Homo sapiens
ugugacagcacagcaucucuuu

SEQ ID NO: 237121 - RNA, 22 nt, Homo sapiens
ugugacagcacgguucaacugc

SEQ ID NO: 237122 - RNA, 22 nt, Homo sapiens
ugugacagguagguaauuuuug

SEQ ID NO: 237123 - RNA, 17 nt, Homo sapiens
ugugacccugggcuacc

SEQ ID NO: 237124 - RNA, 22 nt, Homo sapiens
ugugauaguuggcuaaagcagu

SEQ ID NO: 237125 - RNA, 20 nt, Homo sapiens
ugugauuauuuaguugcaug

SEQ ID NO: 237126 - RNA, 22 nt, Homo sapiens
ugugcacaacaugcagguuugu

SEQ ID NO: 237127 - RNA, 22 nt, Homo sapiens
ugugcacaaccugcagguuugu

SEQ ID NO: 237128 - RNA, 22 nt, Homo sapiens
ugugcacaaugugcagguuugu

SEQ ID NO: 237129 - RNA, 22 nt, Homo sapiens
ugugcacauaacauuuuuuuag

SEQ ID NO: 237130 - RNA, 22 nt, Homo sapiens
ugugcacaugauauaucacaua

SEQ ID NO: 237131 - RNA, 22 nt, Homo sapiens
ugugcacauugugcagguugau

SEQ ID NO: 237132 - RNA, 22 nt, Homo sapiens
ugugcauaugucuuuauaguag

SEQ ID NO: 237133 - RNA, 22 nt, Homo sapiens
ugugccacuccaggaggcuguu

SEQ ID NO: 237134 - RNA, 22 nt, Homo sapiens
ugugccacugcacuccugccug

SEQ ID NO: 237135 - RNA, 22 nt, Homo sapiens
ugugccacugcacuucagccug

SEQ ID NO: 237136 - RNA, 22 nt, Homo sapiens
ugugccacuguucuguaaagug

SEQ ID NO: 237137 - RNA, 22 nt, Homo sapiens
ugugcucaucucagucaacugu

SEQ ID NO: 237138 - RNA, 22 nt, Homo sapiens
ugugcuugaaauucaguuuuga

SEQ ID NO: 237139 - RNA, 22 nt, Homo sapiens
uguggaaauuguuguauuuaau

SEQ ID NO: 237140 - RNA, 22 nt, Homo sapiens
uucaugcaucuguagugguuaa

SEQ ID NO: 237141 - RNA, 20 nt, Homo sapiens
uucaugggagcaaagaggcc

SEQ ID NO: 237142 - RNA, 22 nt, Homo sapiens
uucauggugguacaaaagcaau

SEQ ID NO: 237143 - RNA, 22 nt, Homo sapiens
uuccacaauggcugaacuaguu

SEQ ID NO: 237144 - RNA, 22 nt, Homo sapiens
uuccacgugaaguauucuaaag

SEQ ID NO: 237145 - RNA, 22 nt, Homo sapiens
uuccagagucaccuuucugucg

SEQ ID NO: 237146 - RNA, 20 nt, Homo sapiens
uuccagcacauuagggaagc

SEQ ID NO: 237147 - RNA, 22 nt, Homo sapiens
uuccaugagaugcaucaaagcu

SEQ ID NO: 237148 - RNA, 22 nt, Homo sapiens
uucccaguaaacucuaucccuc

SEQ ID NO: 237149 - RNA, 22 nt, Homo sapiens
uucccagucaaacgaaggacuu

SEQ ID NO: 237150 - RNA, 22 nt, Homo sapiens
uucccaguggaacauguaguca

SEQ ID NO: 237151 - RNA, 22 nt, Homo sapiens
uucccucagaaacacacagccc

SEQ ID NO: 237152 - RNA, 22 nt, Homo sapiens
uucccugaaauauucacuuuca

SEQ ID NO: 237153 - RNA, 22 nt, Homo sapiens
uucccugugggaguaggaaagu

SEQ ID NO: 237154 - RNA, 22 nt, Homo sapiens
uucccuuucugccuugaaucuu

SEQ ID NO: 237155 - RNA, 22 nt, Homo sapiens
uucccuuugaaacuaaacuugc

SEQ ID NO: 237156 - RNA, 22 nt, Homo sapiens
uuccuacugcccauuaaaaugg

SEQ ID NO: 237157 - RNA, 19 nt, Homo sapiens
uuccugagaacaagggcuu

SEQ ID NO: 237158 - RNA, 22 nt, Homo sapiens
uuccuggaggggaaguguccaa

SEQ ID NO: 237159 - RNA, 22 nt, Homo sapiens
uuccuugagaaaggcacaaguu

SEQ ID NO: 237160 - RNA, 22 nt, Homo sapiens
uuccuugugacuaguagugacc

SEQ ID NO: 237161 - RNA, 22 nt, Homo sapiens
uucuacuucauuaggaggauug

SEQ ID NO: 237162 - RNA, 22 nt, Homo sapiens
uucuagagagaagacuuaagcu

SEQ ID NO: 237163 - RNA, 22 nt, Homo sapiens
uucuauugguaauauuuucugu

SEQ ID NO: 237164 - RNA, 22 nt, Homo sapiens
uucucacaguacagggagcucu

SEQ ID NO: 237165 - RNA, 21 nt, Homo sapiens
uucucagaggcaggggauaaa

SEQ ID NO: 237166 - RNA, 21 nt, Homo sapiens
uucucaggguguguccuaccc

SEQ ID NO: 237167 - RNA, 22 nt, Homo sapiens
uucucaguuccuacuuugguga

SEQ ID NO: 237168 - RNA, 22 nt, Homo sapiens
uucucugggacauaggucgggu

SEQ ID NO: 237169 - RNA, 19 nt, Homo sapiens
uucucugguuguacuaccc

SEQ ID NO: 237170 - RNA, 22 nt, Homo sapiens
uucuggcucgauucucugaccg

SEQ ID NO: 237171 - RNA, 22 nt, Homo sapiens
uucuugaggcaugccgcuggga

SEQ ID NO: 237172 - RNA, 22 nt, Homo sapiens
uucuugcacugaucccauaagc

SEQ ID NO: 237173 - RNA, 22 nt, Homo sapiens
uucuuuaguucacuugcuccag

SEQ ID NO: 237174 - RNA, 22 nt, Homo sapiens
uucuuuggaaacaguacuaauu

SEQ ID NO: 237175 - RNA, 22 nt, Homo sapiens
uugaaagaaaggagacugaguu

SEQ ID NO: 237176 - RNA, 22 nt, Homo sapiens
uugaaagaugaacuggauugga

SEQ ID NO: 237177 - RNA, 22 nt, Homo sapiens
uugaaaguaaacaucacaaaga

SEQ ID NO: 237178 - RNA, 22 nt, Homo sapiens
uugaacuguaagggucugugug

SEQ ID NO: 237179 - RNA, 22 nt, Homo sapiens
uugaauagcauguuuagugcau

SEQ ID NO: 237180 - RNA, 22 nt, Homo sapiens
uugacauaguuucugaaauaga

SEQ ID NO: 237181 - RNA, 22 nt, Homo sapiens
uugacuccagagugaguaaaug

SEQ ID NO: 237182 - RNA, 22 nt, Homo sapiens
uugacuuuuaggaggaaaauga

SEQ ID NO: 237183 - RNA, 21 nt, Homo sapiens
uugagaagaauuagcucuucc

SEQ ID NO: 237184 - RNA, 22 nt, Homo sapiens
uugagacugaacauuuguguac

SEQ ID NO: 237185 - RNA, 22 nt, Homo sapiens
uugagaugaagucuugcucucu

SEQ ID NO: 237186 - RNA, 22 nt, Homo sapiens
uugagaugaaguuuugcucuuu

SEQ ID NO: 237187 - RNA, 22 nt, Homo sapiens
uugagauggaaucucgcuuugu

SEQ ID NO: 237188 - RNA, 22 nt, Homo sapiens
uugagauggagucucacuccuu

SEQ ID NO: 237189 - RNA, 22 nt, Homo sapiens
uugagauggagucucacucuug

SEQ ID NO: 237190 - RNA, 22 nt, Homo sapiens
uugagauggagucucacucuuu

SEQ ID NO: 237191 - RNA, 22 nt, Homo sapiens
uugagauggagucucgcacugu

SEQ ID NO: 237192 - RNA, 22 nt, Homo sapiens
uugagauggagucuugcgcugu

SEQ ID NO: 237193 - RNA, 22 nt, Homo sapiens
uugagauggagucuugcucugu

SEQ ID NO: 237194 - RNA, 22 nt, Homo sapiens
uugagauggagucuuguucuuu

SEQ ID NO: 237195 - RNA, 22 nt, Homo sapiens
uugagauggaguuucaauauug

SEQ ID NO: 237196 - RNA, 22 nt, Homo sapiens
uugagauggaguuucacucucg

SEQ ID NO: 237197 - RNA, 22 nt, Homo sapiens
uugagauggauagacauagcau

SEQ ID NO: 237198 - RNA, 22 nt, Homo sapiens
uugagauuuuccucaaauauuu

SEQ ID NO: 237199 - RNA, 22 nt, Homo sapiens
uugagcaaugucacugaggcuu

SEQ ID NO: 237200 - RNA, 22 nt, Homo sapiens
uugagcacaggaguuugagacc

SEQ ID NO: 237201 - RNA, 22 nt, Homo sapiens
uugagcacaggaguuuugagac

SEQ ID NO: 237202 - RNA, 22 nt, Homo sapiens
uugagcaccaugccuggccaug

SEQ ID NO: 237203 - RNA, 22 nt, Homo sapiens
uugagcauugguauagguuuua

SEQ ID NO: 237204 - RNA, 22 nt, Homo sapiens
uugagccaaggauugucuuucc

SEQ ID NO: 237205 - RNA, 21 nt, Homo sapiens
uugagcuuuuaguacagacag

SEQ ID NO: 237206 - RNA, 22 nt, Homo sapiens
uugaggaaugugauuucaaaua

SEQ ID NO: 237207 - RNA, 22 nt, Homo sapiens
uugaggacugcuaagcauuuga

SEQ ID NO: 237208 - RNA, 22 nt, Homo sapiens
uugaggaguacugauuagguau

SEQ ID NO: 237209 - RNA, 16 nt, Homo sapiens
uugaggcaugucucag

SEQ ID NO: 237210 - RNA, 22 nt, Homo sapiens
uugagggagccuguuagucccg

SEQ ID NO: 237211 - RNA, 22 nt, Homo sapiens
uugagggcugaauaccaaucag

SEQ ID NO: 237212 - RNA, 22 nt, Homo sapiens
uugaggucuucaggaucaggcu

SEQ ID NO: 237213 - RNA, 22 nt, Homo sapiens
uugaggugaagggcagagcagc

SEQ ID NO: 237214 - RNA, 22 nt, Homo sapiens
uugaguagugugaugcaugucu

SEQ ID NO: 237215 - RNA, 22 nt, Homo sapiens
uugaguauuggacugguaucuu

SEQ ID NO: 237216 - RNA, 22 nt, Homo sapiens
uugauauauugcaugggcuacu

SEQ ID NO: 237217 - RNA, 22 nt, Homo sapiens
uugaucaauagaauacaacaga

SEQ ID NO: 237218 - RNA, 22 nt, Homo sapiens
uugauugacaugucucuguuca

SEQ ID NO: 237219 - RNA, 23 nt, Homo sapiens
uugcaaagccugaaacucuucag

SEQ ID NO: 237220 - RNA, 22 nt, Homo sapiens
uugcaaaguuugccuccuguag

SEQ ID NO: 237221 - RNA, 22 nt, Homo sapiens
uugcaacuuagaaaaaucauuu

SEQ ID NO: 237222 - RNA, 22 nt, Homo sapiens
uugcacaauggaauuuaucuuu

SEQ ID NO: 237223 - RNA, 22 nt, Homo sapiens
uugcacauugcaccuuuuguau

SEQ ID NO: 237224 - RNA, 22 nt, Homo sapiens
uugcacauuuuuucuggcagaa

SEQ ID NO: 237225 - RNA, 22 nt, Homo sapiens
uugcaccacugcguuccagccu

SEQ ID NO: 237226 - RNA, 22 nt, Homo sapiens
uugcacuccagcucgggugaca

SEQ ID NO: 237227 - RNA, 22 nt, Homo sapiens
uugcacucuagccugggugaca

SEQ ID NO: 237228 - RNA, 22 nt, Homo sapiens
uugcacucugaagaccuacugu

SEQ ID NO: 237229 - RNA, 22 nt, Homo sapiens
uugcagagaaauuucugguuua

SEQ ID NO: 237230 - RNA, 20 nt, Homo sapiens
uugcagagcccaacccugga

SEQ ID NO: 237231 - RNA, 22 nt, Homo sapiens
uugcagugugacgacuauauuu

SEQ ID NO: 237232 - RNA, 18 nt, Homo sapiens
uugcaucauuuuguuguu

SEQ ID NO: 237233 - RNA, 22 nt, Homo sapiens
uugcccuuuagguaacuauaua

SEQ ID NO: 237234 - RNA, 22 nt, Homo sapiens
uugcuagagaugagggaugugu

SEQ ID NO: 237235 - RNA, 22 nt, Homo sapiens
uugcucaccugagaagaauaga

SEQ ID NO: 237236 - RNA, 22 nt, Homo sapiens
uugcucaggcuagaguucagcu

SEQ ID NO: 237237 - RNA, 22 nt, Homo sapiens
uugcugagucuuucuagguugc

SEQ ID NO: 237238 - RNA, 22 nt, Homo sapiens
uugcuucauucaacauugaggg

SEQ ID NO: 237239 - RNA, 22 nt, Homo sapiens
uugcuuuguuacugcaguuucc

SEQ ID NO: 237240 - RNA, 22 nt, Homo sapiens
uugcuuuguugucuggggaaua

SEQ ID NO: 237241 - RNA, 22 nt, Homo sapiens
uuggaaaaauccaccuugaucu

SEQ ID NO: 237242 - RNA, 22 nt, Homo sapiens
uuuggcaaagaucaacauguua

SEQ ID NO: 237243 - RNA, 20 nt, Homo sapiens
uuuggcaauaggguuuuugu

SEQ ID NO: 237244 - RNA, 22 nt, Homo sapiens
uuuggcacuguaaauuucucuu

SEQ ID NO: 237245 - RNA, 22 nt, Homo sapiens
uuuggcauuagagagacuugca

SEQ ID NO: 237246 - RNA, 22 nt, Homo sapiens
uuuggcauuugaguuuguagga

SEQ ID NO: 237247 - RNA, 22 nt, Homo sapiens
uuuggcuuuugugauacguaau

SEQ ID NO: 237248 - RNA, 22 nt, Homo sapiens
uuugggccucugauuucuuugg

SEQ ID NO: 237249 - RNA, 22 nt, Homo sapiens
uuuggguuuuauguaacagcua

SEQ ID NO: 237250 - RNA, 22 nt, Homo sapiens
uuuggucuuuuauuuaaagcag

SEQ ID NO: 237251 - RNA, 22 nt, Homo sapiens
uuugguguauauguaaacuaug

SEQ ID NO: 237252 - RNA, 22 nt, Homo sapiens
uuugguuauuugaaacuagcau

SEQ ID NO: 237253 - RNA, 22 nt, Homo sapiens
uuugguugcauucacauauuuc

SEQ ID NO: 237254 - RNA, 22 nt, Homo sapiens
uuugguugccucuaugagccug

SEQ ID NO: 237255 - RNA, 22 nt, Homo sapiens
uuuguaauaccugaggcugggu

SEQ ID NO: 237256 - RNA, 22 nt, Homo sapiens
uuuguaauccuauuccaaagga

SEQ ID NO: 237257 - RNA, 22 nt, Homo sapiens
uuuguacacgugggugaauugu

SEQ ID NO: 237258 - RNA, 23 nt, Homo sapiens
uuuguacuaugucaguuuagaua

SEQ ID NO: 237259 - RNA, 22 nt, Homo sapiens
uuuguacuugguguucuggaaa

SEQ ID NO: 237260 - RNA, 22 nt, Homo sapiens
uuugucaauaacuaccaacagg

SEQ ID NO: 237261 - RNA, 22 nt, Homo sapiens
uuugucacucuuggagguuguu

SEQ ID NO: 237262 - RNA, 22 nt, Homo sapiens
uuugugaggugauggauauguc

SEQ ID NO: 237263 - RNA, 22 nt, Homo sapiens
uuugugcaugaagagggggugc

SEQ ID NO: 237264 - RNA, 22 nt, Homo sapiens
uuugugcuaacuuuaacucuua

SEQ ID NO: 237265 - RNA, 22 nt, Homo sapiens
uuugugcuccucucaguaugug

SEQ ID NO: 237266 - RNA, 21 nt, Homo sapiens
uuugugguuacugugugagcu

SEQ ID NO: 237267 - RNA, 22 nt, Homo sapiens
uuuuacacuucgguugugugca

SEQ ID NO: 237268 - RNA, 22 nt, Homo sapiens
uuuuacagaggagguugcugau

SEQ ID NO: 237269 - RNA, 22 nt, Homo sapiens
uuuucacggugucccagagagu

SEQ ID NO: 237270 - RNA, 22 nt, Homo sapiens
uuuuccagugggacucccauua

SEQ ID NO: 237271 - RNA, 20 nt, Homo sapiens
uuuugaacuuggcaaccugu

SEQ ID NO: 237272 - RNA, 22 nt, Homo sapiens
uuuugcacauugauuugguauc

SEQ ID NO: 237273 - RNA, 22 nt, Homo sapiens
uuuugcucuucggaagagcuug

SEQ ID NO: 237274 - RNA, 19 nt, Homo sapiens
uuuugcucuuuauaccuau

SEQ ID NO: 237275 - RNA, 22 nt, Homo sapiens
uuuugcuuuuccucggucccac

SEQ ID NO: 237276 - RNA, 17 nt, Homo sapiens
uuuuggauuagaaaucc

SEQ ID NO: 237277 - RNA, 22 nt, Homo sapiens
uuuuggcuuuuccucagcaagc

SEQ ID NO: 237278 - RNA, 22 nt, Homo sapiens
uuuugguauauacggggguccu

SEQ ID NO: 237279 - RNA, 22 nt, Homo sapiens
uuuuggugguuaugugucaaug

SEQ ID NO: 237280 - RNA, 18 nt, Homo sapiens
uuuuugaggcacagggga

SEQ ID NO: 237281 - RNA, 21 nt, Homo sapiens
uuuuugggcuuucauaguguu

SEQ ID NO: 237282 - RNA, 18 nt, Homo sapiens
aaguauagagagcccuua

SEQ ID NO: 237283 - RNA, 22 nt, Homo sapiens
aaguauguaucaagucauacuu

SEQ ID NO: 237284 - RNA, 22 nt, Homo sapiens
aaguauuagcuaauugugcuua

SEQ ID NO: 237285 - RNA, 22 nt, Homo sapiens
aaguauuagugaggauauggaa

SEQ ID NO: 237286 - RNA, 22 nt, Homo sapiens
aagucaaggagagaagcuucag

SEQ ID NO: 237287 - RNA, 22 nt, Homo sapiens
aaguccccugacagaggggagg

SEQ ID NO: 237288 - RNA, 22 nt, Homo sapiens
aagugacauugugcccauuuga

SEQ ID NO: 237289 - RNA, 22 nt, Homo sapiens
aagugacuagacuaugaaaccu

SEQ ID NO: 237290 - RNA, 22 nt, Homo sapiens
aagugaguaauacgucaguugu

SEQ ID NO: 237291 - RNA, 22 nt, Homo sapiens
gaugaucucuggugguaaagac

SEQ ID NO: 237292 - RNA, 22 nt, Homo sapiens
gaugccuuuuuguccucaguua

SEQ ID NO: 237293 - RNA, 22 nt, Homo sapiens
gauggauuuuaagugaaugaaa

SEQ ID NO: 237294 - RNA, 22 nt, Homo sapiens
gauggauuuuuuaggcagagcu

SEQ ID NO: 237295 - RNA, 22 nt, Homo sapiens
gaugugaaaucauaguuucuag

SEQ ID NO: 237296 - RNA, 22 nt, Homo sapiens
gauuccauuuguggcuauuuac

SEQ ID NO: 237297 - RNA, 22 nt, Homo sapiens
gauuuguuggccugugagcuag

SEQ ID NO: 237298 - RNA, 22 nt, Homo sapiens
gauuuuuggggaagccucuuau

SEQ ID NO: 237299 - RNA, 21 nt, Homo sapiens
gcaaaguggcuaccuugcucc

SEQ ID NO: 237300 - RNA, 22 nt, Homo sapiens
gcaagaaucugggaguaaaauu

SEQ ID NO: 237301 - RNA, 22 nt, Homo sapiens
gcaagaauggaacaggagagcc

SEQ ID NO: 237302 - RNA, 22 nt, Homo sapiens
gcaagauuguguggcugaagua

SEQ ID NO: 237303 - RNA, 22 nt, Homo sapiens
gcacacguagaagcaugcauca

SEQ ID NO: 237304 - RNA, 22 nt, Homo sapiens
gcacagaugaggagaggucuca

SEQ ID NO: 237305 - RNA, 22 nt, Homo sapiens
gcaccaugguagaauaauggua

SEQ ID NO: 237306 - RNA, 17 nt, Homo sapiens
gcacuggcguaucccac

SEQ ID NO: 237307 - RNA, 22 nt, Homo sapiens
gcacugggccacauuuauuuuc

SEQ ID NO: 237308 - RNA, 22 nt, Homo sapiens
gcagcacauggcagaacauauu

SEQ ID NO: 237309 - RNA, 22 nt, Homo sapiens
gcagcagugcccuggauggaaa

SEQ ID NO: 237310 - RNA, 22 nt, Homo sapiens
gcagcauuaccaagacauggca

SEQ ID NO: 237311 - RNA, 22 nt, Homo sapiens
gcagguaguuucugacuuuuac

SEQ ID NO: 237312 - RNA, 22 nt, Homo sapiens
gcagugcaguggcgcgaucucg

SEQ ID NO: 237313 - RNA, 22 nt, Homo sapiens
gcagugugauguuuuaaucuau

SEQ ID NO: 237314 - RNA, 22 nt, Homo sapiens
gcaguguggguagagggcaaga

SEQ ID NO: 237315 - RNA, 22 nt, Homo sapiens
gcaguguucugggcaggaagaa

SEQ ID NO: 237316 - RNA, 22 nt, Homo sapiens
gcaguguugugauccaggucuu

SEQ ID NO: 237317 - RNA, 22 nt, Homo sapiens
gcaguucuguaguugaaauuua

SEQ ID NO: 237318 - RNA, 22 nt, Homo sapiens
acccagaguuccuugucuuuca

SEQ ID NO: 237319 - RNA, 22 nt, Homo sapiens
acccaguguucagacuaccugu

SEQ ID NO: 237320 - RNA, 22 nt, Homo sapiens
acccauacacacauauuuaugu

SEQ ID NO: 237321 - RNA, 22 nt, Homo sapiens
accccuuacaucagcucuggua

SEQ ID NO: 237322 - RNA, 22 nt, Homo sapiens
acccgcccagguguggccggga

SEQ ID NO: 237323 - RNA, 20 nt, Homo sapiens
acccucuaggaugauuucuu

SEQ ID NO: 237324 - RNA, 22 nt, Homo sapiens
acccugcuaaacagcccccugc

SEQ ID NO: 237325 - RNA, 22 nt, Homo sapiens
acccuggaggucuacagugcag

SEQ ID NO: 237326 - RNA, 22 nt, Homo sapiens
acccuggaguaguaggaaucug

SEQ ID NO: 237327 - RNA, 22 nt, Homo sapiens
acccugucaaaauagaccaauc

SEQ ID NO: 237328 - RNA, 22 nt, Homo sapiens
acccugucauccacauggugcu

SEQ ID NO: 237329 - RNA, 19 nt, Homo sapiens
acccuguccccaccuuuac

SEQ ID NO: 237330 - RNA, 22 nt, Homo sapiens
acccuguugguggaucagauug

SEQ ID NO: 237331 - RNA, 22 nt, Homo sapiens
acccuugaguguguuucaggca

SEQ ID NO: 237332 - RNA, 22 nt, Homo sapiens
accugagacuaggcauuuuaua

SEQ ID NO: 237333 - RNA, 22 nt, Homo sapiens
accugggugcugaugggcuuua

SEQ ID NO: 237334 - RNA, 22 nt, Homo sapiens
accuguagcagacuuaauauuu

SEQ ID NO: 237335 - RNA, 20 nt, Homo sapiens
acuaaaucucauuuuaugca

SEQ ID NO: 237336 - RNA, 22 nt, Homo sapiens
acucagagauuagcacauguuu

SEQ ID NO: 237337 - RNA, 22 nt, Homo sapiens
acucauugcucauaccuuaucu

SEQ ID NO: 237338 - RNA, 21 nt, Homo sapiens
acugagagaucuggggcacau

SEQ ID NO: 237339 - RNA, 22 nt, Homo sapiens
acugagaucuuuaaauaaauaa

SEQ ID NO: 237340 - RNA, 23 nt, Homo sapiens
acugagcaauguuuacauacuug

SEQ ID NO: 237341 - RNA, 19 nt, Homo sapiens
acugagcuaccugggggca

SEQ ID NO: 237342 - RNA, 21 nt, Homo sapiens
acugauguuugaaauucgcug

SEQ ID NO: 237343 - RNA, 21 nt, Homo sapiens
acugcacuccaaccucaacag

SEQ ID NO: 237344 - RNA, 22 nt, Homo sapiens
acugcacuccaaccuguugggc

SEQ ID NO: 237345 - RNA, 20 nt, Homo sapiens
acugcacuccaaccuuugug

SEQ ID NO: 237346 - RNA, 22 nt, Homo sapiens
acugcacuccagcccaggugac

SEQ ID NO: 237347 - RNA, 22 nt, Homo sapiens
acugcacuccagccucaugaca

SEQ ID NO: 237348 - RNA, 22 nt, Homo sapiens
acugcacuccagccucccgucu

SEQ ID NO: 237349 - RNA, 22 nt, Homo sapiens
acugcacuccagccucggggac

SEQ ID NO: 237350 - RNA, 22 nt, Homo sapiens
acugcacuccagccugagccug

SEQ ID NO: 237351 - RNA, 22 nt, Homo sapiens
acugcacuccagccugccgaca

SEQ ID NO: 237352 - RNA, 22 nt, Homo sapiens
acugcacuccagccugcugaca

SEQ ID NO: 237353 - RNA, 22 nt, Homo sapiens
acugcacuccagccugcuggca

SEQ ID NO: 237354 - RNA, 22 nt, Homo sapiens
acugcacuccagccuggaccac

SEQ ID NO: 237355 - RNA, 22 nt, Homo sapiens
uuucaggcagggagcuucagug

SEQ ID NO: 237356 - RNA, 23 nt, Homo sapiens
uuucaguaguuguauccuguugc

SEQ ID NO: 237357 - RNA, 22 nt, Homo sapiens
uuucauagaucaugcuuuugga

SEQ ID NO: 237358 - RNA, 22 nt, Homo sapiens
uuucauagccuucuaaugaguu

SEQ ID NO: 237359 - RNA, 22 nt, Homo sapiens
uuucauggacgcaaugccuuuu

SEQ ID NO: 237360 - RNA, 22 nt, Homo sapiens
uuucauggcaguuuggggccug

SEQ ID NO: 237361 - RNA, 22 nt, Homo sapiens
uuucauguuuuucugugaggca

SEQ ID NO: 237362 - RNA, 22 nt, Homo sapiens
uuucccugaaggcucugaaguc

SEQ ID NO: 237363 - RNA, 19 nt, Homo sapiens
uuucccugcagaccuacua

SEQ ID NO: 237364 - RNA, 22 nt, Homo sapiens
uuucccuuugcuuugucagcca

SEQ ID NO: 237365 - RNA, 22 nt, Homo sapiens
uuuccuggagaaucuuaacaaa

SEQ ID NO: 237366 - RNA, 22 nt, Homo sapiens
uuuccuguaggaaggaaauaga

SEQ ID NO: 237367 - RNA, 22 nt, Homo sapiens
uuucgugucuggucugugaugg

SEQ ID NO: 237368 - RNA, 17 nt, Homo sapiens
uuucucagcccucuucu

SEQ ID NO: 237369 - RNA, 22 nt, Homo sapiens
uuucuuggagcucuuagggucg

SEQ ID NO: 237370 - RNA, 22 nt, Homo sapiens
uuugaaccauuugaagaaugau

SEQ ID NO: 237371 - RNA, 22 nt, Homo sapiens
uuugacucacagccuggcugcc

SEQ ID NO: 237372 - RNA, 18 nt, Homo sapiens
uuugacugguguccuuau

SEQ ID NO: 237373 - RNA, 22 nt, Homo sapiens
uuugacuguggagucgaugcuu

SEQ ID NO: 237374 - RNA, 22 nt, Homo sapiens
uuugacuuuuagaauaugaguu

SEQ ID NO: 237375 - RNA, 22 nt, Homo sapiens
uuugagcauguaguuuaacccu

SEQ ID NO: 237376 - RNA, 22 nt, Homo sapiens
uuugcacucaguaagugggagc

SEQ ID NO: 237377 - RNA, 22 nt, Homo sapiens
uuugcacuucugagugugacau

SEQ ID NO: 237378 - RNA, 22 nt, Homo sapiens
uuugcacuuuaauauaauguga

SEQ ID NO: 237379 - RNA, 21 nt, Homo sapiens
uuugcauauguugaaccagcc

SEQ ID NO: 237380 - RNA, 22 nt, Homo sapiens
uuugcaucuuuugcuuccugga

SEQ ID NO: 237381 - RNA, 23 nt, Homo sapiens
uuugccacuuauuagcugggagg

SEQ ID NO: 237382 - RNA, 22 nt, Homo sapiens
uuugccuuugugauauggucua

SEQ ID NO: 237383 - RNA, 22 nt, Homo sapiens
uuugcugagucauuccaugcug

SEQ ID NO: 237384 - RNA, 22 nt, Homo sapiens
uuugcugagucugacuucaugg

SEQ ID NO: 237385 - RNA, 22 nt, Homo sapiens
uuugcuuaaaucuuaaucagau

SEQ ID NO: 237386 - RNA, 22 nt, Homo sapiens
uuugcuugaggucuagcuaccc

SEQ ID NO: 237387 - RNA, 22 nt, Homo sapiens
uuuggauagugugguccuuuua

SEQ ID NO: 237388 - RNA, 22 nt, Homo sapiens
uuuggcaauuugacuguauagg

SEQ ID NO: 237389 - RNA, 22 nt, Homo sapiens
uuuggcagaaaacaagaaucug

SEQ ID NO: 237390 - RNA, 22 nt, Homo sapiens
uuuggcaugggcuauuugcuuu

SEQ ID NO: 237391 - RNA, 23 nt, Homo sapiens
uuuggcauuccagaaauuuucau

SEQ ID NO: 237392 - RNA, 22 nt, Homo sapiens
aucaaagcagcauggcccaguc

SEQ ID NO: 237393 - RNA, 22 nt, Homo sapiens
aucaagcugcuuguuugaaucu

SEQ ID NO: 237394 - RNA, 22 nt, Homo sapiens
aucacagagucacgggcaacuu

SEQ ID NO: 237395 - RNA, 22 nt, Homo sapiens
aucacagaguuaaaacuuucuu

SEQ ID NO: 237396 - RNA, 22 nt, Homo sapiens
aucacagcuacuccucugucuu

SEQ ID NO: 237397 - RNA, 22 nt, Homo sapiens
aucacagguacuauggcugaca

SEQ ID NO: 237398 - RNA, 22 nt, Homo sapiens
aucacagugagcauaugucuau

SEQ ID NO: 237399 - RNA, 22 nt, Homo sapiens
aucacaguggcucacaagagcc

SEQ ID NO: 237400 - RNA, 22 nt, Homo sapiens
aucacaguuuuaccauuuggua

SEQ ID NO: 237401 - RNA, 22 nt, Homo sapiens
aucaccuggaguagcccguccc

SEQ ID NO: 237402 - RNA, 22 nt, Homo sapiens
aucacugggauggaacugcuga

SEQ ID NO: 237403 - RNA, 22 nt, Homo sapiens
aucacuguaaguuuacacuuug

SEQ ID NO: 237404 - RNA, 22 nt, Homo sapiens
aucacuguuuugaugcucggac

SEQ ID NO: 237405 - RNA, 22 nt, Homo sapiens
aucacuuucuauuucugugcca

SEQ ID NO: 237406 - RNA, 22 nt, Homo sapiens
aucagagugaaacaugggagau

SEQ ID NO: 237407 - RNA, 22 nt, Homo sapiens
aucagaguugucagggagcuuu

SEQ ID NO: 237408 - RNA, 22 nt, Homo sapiens
aucagauggcuaaaacagaaga

SEQ ID NO: 237409 - RNA, 22 nt, Homo sapiens
aucagauuccacauuuuaucag

SEQ ID NO: 237410 - RNA, 22 nt, Homo sapiens
aucagcacugaucauacagcuu

SEQ ID NO: 237411 - RNA, 22 nt, Homo sapiens
aucauguaguaagacacauuua

SEQ ID NO: 237412 - RNA, 22 nt, Homo sapiens
aucauugugugaguugauggga

SEQ ID NO: 237413 - RNA, 22 nt, Homo sapiens
auccccugcacggggugucauu

SEQ ID NO: 237414 - RNA, 22 nt, Homo sapiens
aucccugaggaauuucugcacu

SEQ ID NO: 237415 - RNA, 22 nt, Homo sapiens
aucccuguaacuagcagccccu

SEQ ID NO: 237416 - RNA, 22 nt, Homo sapiens
aucccuguguccagcaccugug

SEQ ID NO: 237417 - RNA, 22 nt, Homo sapiens
aucccuugacguggagucucug

SEQ ID NO: 237418 - RNA, 22 nt, Homo sapiens
aucccuuucucuggcuaggggg

SEQ ID NO: 237419 - RNA, 22 nt, Homo sapiens
aucuagagacauaguaaagaau

SEQ ID NO: 237420 - RNA, 20 nt, Homo sapiens
aucucugggcaaaggaaaau

SEQ ID NO: 237421 - RNA, 22 nt, Homo sapiens
aucucuugccagucagaauggu

SEQ ID NO: 237422 - RNA, 22 nt, Homo sapiens
aucugguguuuccuucacauug

SEQ ID NO: 237423 - RNA, 22 nt, Homo sapiens
aucuguguuuaaggucccagaa

SEQ ID NO: 237424 - RNA, 22 nt, Homo sapiens
aucuuugauuguagguacaaug

SEQ ID NO: 237425 - RNA, 22 nt, Homo sapiens
aucuuuggauacuugauauagu

SEQ ID NO: 237426 - RNA, 22 nt, Homo sapiens
augaaacuggcuaauuuuugua

SEQ ID NO: 237427 - RNA, 22 nt, Homo sapiens
augaaagugauaaaugucucua

SEQ ID NO: 237428 - RNA, 22 nt, Homo sapiens
augaaaugcauguuaaguccgu

SEQ ID NO: 237429 - RNA, 22 nt, Homo sapiens
augaaauugcuaucgcaguacu

SEQ ID NO: 237430 - RNA, 22 nt, Homo sapiens
augaacacuccaauuguacucc

SEQ ID NO: 237431 - RNA, 17 nt, Homo sapiens
augaacucaucguucuu

SEQ ID NO: 237432 - RNA, 22 nt, Homo sapiens
augaagaucaugaagacggcuu

SEQ ID NO: 237433 - RNA, 22 nt, Homo sapiens
augaaguauuaggacacauuua

SEQ ID NO: 237434 - RNA, 20 nt, Homo sapiens
augaagugaaguuagggaac

SEQ ID NO: 237435 - RNA, 22 nt, Homo sapiens
augaauacugcugcaaugaaca

SEQ ID NO: 237436 - RNA, 22 nt, Homo sapiens
augacaagaguguucagggaga

SEQ ID NO: 237437 - RNA, 22 nt, Homo sapiens
augacccugaccuaagccaauc

SEQ ID NO: 237438 - RNA, 22 nt, Homo sapiens
augaccuuguccucagugucau

SEQ ID NO: 237439 - RNA, 20 nt, Homo sapiens
augacuagaggacaugguaa

SEQ ID NO: 237440 - RNA, 22 nt, Homo sapiens
augacucagaucuguuccuggu

SEQ ID NO: 237441 - RNA, 22 nt, Homo sapiens
augacuggaacggcacuuuaca

SEQ ID NO: 237442 - RNA, 22 nt, Homo sapiens
augacugucuugcagaggcuau

SEQ ID NO: 237443 - RNA, 22 nt, Homo sapiens
augagauaaaccaucucuuaag

SEQ ID NO: 237444 - RNA, 22 nt, Homo sapiens
augagaugaauaccgacgaugu

SEQ ID NO: 237445 - RNA, 21 nt, Homo sapiens
augagauguuagacuuuagac

SEQ ID NO: 237446 - RNA, 22 nt, Homo sapiens
augagauuauguaaagagacca

SEQ ID NO: 237447 - RNA, 22 nt, Homo sapiens
augagauuguuugugugaaaua

SEQ ID NO: 237448 - RNA, 22 nt, Homo sapiens
augagcuauggagacagggcca

SEQ ID NO: 237449 - RNA, 22 nt, Homo sapiens
augaggacaucuuccuuaugga

SEQ ID NO: 237450 - RNA, 22 nt, Homo sapiens
augaggugauaucuggaaauua

SEQ ID NO: 237451 - RNA, 22 nt, Homo sapiens
augauagucuugagaagcauuu

SEQ ID NO: 237452 - RNA, 22 nt, Homo sapiens
augaugaaguaagugcuuagga

SEQ ID NO: 237453 - RNA, 22 nt, Homo sapiens
augaugcugcaguuguugccaa

SEQ ID NO: 237454 - RNA, 22 nt, Homo sapiens
augauggaggccgugauggacg

SEQ ID NO: 237455 - RNA, 22 nt, Homo sapiens
augauucugaucuagagcuugg

SEQ ID NO: 237456 - RNA, 22 nt, Homo sapiens
augauuuuuguaucgccugaug

SEQ ID NO: 237457 - RNA, 22 nt, Homo sapiens
aggaauggaaacuuuugauggu

SEQ ID NO: 237458 - RNA, 22 nt, Homo sapiens
aggacacugauguaugcugugg

SEQ ID NO: 237459 - RNA, 22 nt, Homo sapiens
aggaccccucaucagcaccagu

SEQ ID NO: 237460 - RNA, 22 nt, Homo sapiens
aggagcacuggccuuggaguca

SEQ ID NO: 237461 - RNA, 21 nt, Homo sapiens
aggagcauucaugacgagguu

SEQ ID NO: 237462 - RNA, 22 nt, Homo sapiens
aggagguagucugucccuuagc

SEQ ID NO: 237463 - RNA, 16 nt, Homo sapiens
aggcaagaauugaggu

SEQ ID NO: 237464 - RNA, 21 nt, Homo sapiens
aggcaagauuacuuacgagca

SEQ ID NO: 237465 - RNA, 22 nt, Homo sapiens
aggcaagugggagacagcauuu

SEQ ID NO: 237466 - RNA, 22 nt, Homo sapiens
aggcagcuguuauauacugagu

SEQ ID NO: 237467 - RNA, 22 nt, Homo sapiens
aggcaguuucagugagagguga

SEQ ID NO: 237468 - RNA, 22 nt, Homo sapiens
gcuucauggaggcugggcgcag

SEQ ID NO: 237469 - RNA, 22 nt, Homo sapiens
gcuugguccccacccaaaucgc

SEQ ID NO: 237470 - RNA, 22 nt, Homo sapiens
gcuuggugugcaagugguacua

SEQ ID NO: 237471 - RNA, 22 nt, Homo sapiens
gcuuguguucaaggaacaccua

SEQ ID NO: 237472 - RNA, 19 nt, Homo sapiens
gcuuuguggggaaggagcc

SEQ ID NO: 237473 - RNA, 22 nt, Homo sapiens
gcuuuguuaaaacacagccaca

SEQ ID NO: 237474 - RNA, 22 nt, Homo sapiens
ggaaagauguaauauuaucuaa

SEQ ID NO: 237475 - RNA, 19 nt, Homo sapiens
ggaaaugucuauuaagauc

SEQ ID NO: 237476 - RNA, 22 nt, Homo sapiens
ggaagccugcacucgggcaggg

SEQ ID NO: 237477 - RNA, 22 nt, Homo sapiens
ggaagguaauuggcuaaugaga

SEQ ID NO: 237478 - RNA, 22 nt, Homo sapiens
ggaagugcuguguggaagucug

SEQ ID NO: 237479 - RNA, 22 nt, Homo sapiens
ggaaugagaaauauuacacaau

SEQ ID NO: 237480 - RNA, 22 nt, Homo sapiens
ggaauggaacaaagucuugaaa

SEQ ID NO: 237481 - RNA, 22 nt, Homo sapiens
ggaaugggauuugaagucuggc

SEQ ID NO: 237482 - RNA, 22 nt, Homo sapiens
ggacaaaguauuuucaaaugua

SEQ ID NO: 237483 - RNA, 22 nt, Homo sapiens
ggagaauguaauugguauuuug

SEQ ID NO: 237484 - RNA, 22 nt, Homo sapiens
ggagaucacucuuuguagcgug

SEQ ID NO: 237485 - RNA, 22 nt, Homo sapiens
ggagaucuuguuaaaguacaga

SEQ ID NO: 237486 - RNA, 22 nt, Homo sapiens
ggagaucuuuaggaguuggacu

SEQ ID NO: 237487 - RNA, 22 nt, Homo sapiens
ggagguaauaaguuccagugua

SEQ ID NO: 237488 - RNA, 22 nt, Homo sapiens
ggagucugauguucuaaggcag

SEQ ID NO: 237489 - RNA, 22 nt, Homo sapiens
ggagucuugcuauguugccaag

SEQ ID NO: 237490 - RNA, 22 nt, Homo sapiens
ggaguguaauggcgccaucuca

SEQ ID NO: 237491 - RNA, 22 nt, Homo sapiens
ggauaucauuauuucuagggcu

SEQ ID NO: 237492 - RNA, 22 nt, Homo sapiens
ggaucacagagcuugggaaagg

SEQ ID NO: 237493 - RNA, 22 nt, Homo sapiens
ggauugcuuaagaaguuucauu

SEQ ID NO: 237494 - RNA, 22 nt, Homo sapiens
ggcaaagaugaccauuacuuuu

SEQ ID NO: 237495 - RNA, 21 nt, Homo sapiens
ggcaagaaacacaaucaagua

SEQ ID NO: 237496 - RNA, 20 nt, Homo sapiens
ggcaagacccaaagugugug

SEQ ID NO: 237497 - RNA, 22 nt, Homo sapiens
ggcaagugggagggaguguuuc

SEQ ID NO: 237498 - RNA, 22 nt, Homo sapiens
ggcagaauugcugaggaugcua

SEQ ID NO: 237499 - RNA, 22 nt, Homo sapiens
ggcagcaugggugccuuuguga

SEQ ID NO: 237500 - RNA, 22 nt, Homo sapiens
ggcagcucaggccccgcgcuga

SEQ ID NO: 237501 - RNA, 22 nt, Homo sapiens
ggcaguguaauaauuuauuaau

SEQ ID NO: 237502 - RNA, 22 nt, Homo sapiens
ggcaugauggcugaggcuucug

SEQ ID NO: 237503 - RNA, 22 nt, Homo sapiens
ggcaugguggugugugccuaua

SEQ ID NO: 237504 - RNA, 22 nt, Homo sapiens
ggcgguguccuccaagugcuuc

SEQ ID NO: 237505 - RNA, 22 nt, Homo sapiens
ggcucagugaucuguuucugua

SEQ ID NO: 237506 - RNA, 22 nt, Homo sapiens
ggcucaguugcaaaucaguuca

SEQ ID NO: 237507 - RNA, 22 nt, Homo sapiens
ggcucguguuuucuguccaguu

SEQ ID NO: 237508 - RNA, 21 nt, Homo sapiens
ggcucuguggucucagguuuc

SEQ ID NO: 237509 - RNA, 22 nt, Homo sapiens
ggcuuggaggaaugugagggcu

SEQ ID NO: 237510 - RNA, 22 nt, Homo sapiens
gggaaaaugucuauugaaugaa

SEQ ID NO: 237511 - RNA, 22 nt, Homo sapiens
gggaagugugguuucuuuacag

SEQ ID NO: 237512 - RNA, 22 nt, Homo sapiens
gggaauguagcaaaucugcaau

SEQ ID NO: 237513 - RNA, 19 nt, Homo sapiens
gggaggaugcgucuucagg

SEQ ID NO: 237514 - RNA, 22 nt, Homo sapiens
gggaugaagcccuaggguuggu

SEQ ID NO: 237515 - RNA, 22 nt, Homo sapiens
gggaugaaguugauguagaaag

SEQ ID NO: 237516 - RNA, 22 nt, Homo sapiens
gggauguaaaagugggcacauu

SEQ ID NO: 237517 - RNA, 23 nt, Homo sapiens
gggauuguaaaauaugagggcag

SEQ ID NO: 237518 - RNA, 20 nt, Homo sapiens
gggcaaguaugugggaaguc

SEQ ID NO: 237519 - RNA, 22 nt, Homo sapiens
gggcaugauggugcacacaugu

SEQ ID NO: 237520 - RNA, 22 nt, Homo sapiens
gggcaugaugucuuaugccuau

SEQ ID NO: 237521 - RNA, 22 nt, Homo sapiens
gggcauugugggcagagggcag

SEQ ID NO: 237522 - RNA, 22 nt, Homo sapiens
ggggaguguggacaucacccug

SEQ ID NO: 237523 - RNA, 22 nt, Homo sapiens
gggguauguaagugagugagug

SEQ ID NO: 237524 - RNA, 22 nt, Homo sapiens
ggggucauuaaauuccgcuggu

SEQ ID NO: 237525 - RNA, 22 nt, Homo sapiens
ggguaaaucucuuuucauggcu

SEQ ID NO: 237526 - RNA, 22 nt, Homo sapiens
ggguaggcaagcggaugucaga

SEQ ID NO: 237527 - RNA, 22 nt, Homo sapiens
gggugguuuuauuaucagugac

SEQ ID NO: 237528 - RNA, 22 nt, Homo sapiens
gguagacaucgugcucugugau

SEQ ID NO: 237529 - RNA, 22 nt, Homo sapiens
ggucacccugaugcuggugguc

SEQ ID NO: 237530 - RNA, 22 nt, Homo sapiens
ggucagugcauucuaaaggcaa

SEQ ID NO: 237531 - RNA, 22 nt, Homo sapiens
ggucccccuccacucucgcaaa

SEQ ID NO: 237532 - RNA, 22 nt, Homo sapiens
ggugacagugguuaaaauuugu

SEQ ID NO: 237533 - RNA, 21 nt, Homo sapiens
ggugagaaaggagacauagac

SEQ ID NO: 237534 - RNA, 22 nt, Homo sapiens
ggugaggaaaguugaguuucua

SEQ ID NO: 237535 - RNA, 22 nt, Homo sapiens
gguggugguauuucagaaaaug

SEQ ID NO: 237536 - RNA, 22 nt, Homo sapiens
gguuagaaacagguccucagga

SEQ ID NO: 237537 - RNA, 22 nt, Homo sapiens
guaagguuguauuucaagaaac

SEQ ID NO: 237538 - RNA, 22 nt, Homo sapiens
uugcaaagaccucuucacuucc

SEQ ID NO: 237539 - RNA, 21 nt, Homo sapiens
uugcaaaugcugcugccugau

SEQ ID NO: 237540 - RNA, 18 nt, Homo sapiens
uugcaaauucuucccugu

SEQ ID NO: 237541 - RNA, 22 nt, Homo sapiens
uugcaacauguauucuggugau

SEQ ID NO: 237542 - RNA, 22 nt, Homo sapiens
uugcaaugugaugugauuugga

SEQ ID NO: 237543 - RNA, 22 nt, Homo sapiens
uugcacagugcuuucuuugccc

SEQ ID NO: 237544 - RNA, 22 nt, Homo sapiens
uugcacuccagccugggugaca

SEQ ID NO: 237545 - RNA, 22 nt, Homo sapiens
uugcacuccagccuuggggaga

SEQ ID NO: 237546 - RNA, 22 nt, Homo sapiens
uugcacuccagcucuaggugac

SEQ ID NO: 237547 - RNA, 22 nt, Homo sapiens
uugcacucuccagccucggcaa

SEQ ID NO: 237548 - RNA, 22 nt, Homo sapiens
uugcacugagauuuugcuuaca

SEQ ID NO: 237549 - RNA, 22 nt, Homo sapiens
uugcagagccccacacugggcu

SEQ ID NO: 237550 - RNA, 22 nt, Homo sapiens
uugcagagccccugcaaggguc

SEQ ID NO: 237551 - RNA, 22 nt, Homo sapiens
uugcagcaacauggaugaaacu

SEQ ID NO: 237552 - RNA, 22 nt, Homo sapiens
uugcaggugguuuaugcaagac

SEQ ID NO: 237553 - RNA, 23 nt, Homo sapiens
uugcauagacauccucauagauu

SEQ ID NO: 237554 - RNA, 19 nt, Homo sapiens
uugcauauguugaaccagc

SEQ ID NO: 237555 - RNA, 22 nt, Homo sapiens
uugcauauguugaaccagccuu

SEQ ID NO: 237556 - RNA, 22 nt, Homo sapiens
uugcauauucucugaggcagga

SEQ ID NO: 237557 - RNA, 22 nt, Homo sapiens
uugcaugcacaguucucaauag

SEQ ID NO: 237558 - RNA, 22 nt, Homo sapiens
uugcauguacguacagagagag

SEQ ID NO: 237559 - RNA, 22 nt, Homo sapiens
uugcauugacacaugaagcuca

SEQ ID NO: 237560 - RNA, 22 nt, Homo sapiens
uugcauuuucuaggagggcaaa

SEQ ID NO: 237561 - RNA, 22 nt, Homo sapiens
uugcuauguugcccagucugga

SEQ ID NO: 237562 - RNA, 22 nt, Homo sapiens
uugcuccucugccaggaccugu

SEQ ID NO: 237563 - RNA, 22 nt, Homo sapiens
uugcuuaggcuggagugcagug

SEQ ID NO: 237564 - RNA, 22 nt, Homo sapiens
uugcuuagucaugaaucacuga

SEQ ID NO: 237565 - RNA, 22 nt, Homo sapiens
uuggaaacgucaccuuuuccuu

SEQ ID NO: 237566 - RNA, 22 nt, Homo sapiens
uuggaaauguguuugcauucag

SEQ ID NO: 237567 - RNA, 22 nt, Homo sapiens
uuggaaggcugaauggccucuc

SEQ ID NO: 237568 - RNA, 23 nt, Homo sapiens
uuggaaugagaccuaagaguuuu

SEQ ID NO: 237569 - RNA, 22 nt, Homo sapiens
uuggaaugcaacagaaggauaa

SEQ ID NO: 237570 - RNA, 22 nt, Homo sapiens
uuggaauuaaccuggugcugga

SEQ ID NO: 237571 - RNA, 19 nt, Homo sapiens
uuggaauuuuagaguuuga

SEQ ID NO: 237572 - RNA, 22 nt, Homo sapiens
uuggaccacuugauuucugguc

SEQ ID NO: 237573 - RNA, 22 nt, Homo sapiens
uuggacuuuaagauagagaugu

SEQ ID NO: 237574 - RNA, 22 nt, Homo sapiens
uuggagagugauauucagaugc

SEQ ID NO: 237575 - RNA, 22 nt, Homo sapiens
uuuggcauuuuacuacucaaau

SEQ ID NO: 237576 - RNA, 22 nt, Homo sapiens
uuugggaaugaguuuaucauuu

SEQ ID NO: 237577 - RNA, 22 nt, Homo sapiens
uuuggguuaguuuuccaaucuu

SEQ ID NO: 237578 - RNA, 22 nt, Homo sapiens
uuuggucacugccgccgccagc

SEQ ID NO: 237579 - RNA, 22 nt, Homo sapiens
uuugguguauaaaaaugcuagu

SEQ ID NO: 237580 - RNA, 22 nt, Homo sapiens
uuugguuuuuguuaucacucau

SEQ ID NO: 237581 - RNA, 22 nt, Homo sapiens
uuuguaagaugcauagauugca

SEQ ID NO: 237582 - RNA, 22 nt, Homo sapiens
uuuguacacuguugguaggauu

SEQ ID NO: 237583 - RNA, 22 nt, Homo sapiens
uuuguacucccuuuagauaaaa

SEQ ID NO: 237584 - RNA, 22 nt, Homo sapiens
uuuguacuccuuggccagcuuc

SEQ ID NO: 237585 - RNA, 22 nt, Homo sapiens
uuuguacuucauacaauaacuc

SEQ ID NO: 237586 - RNA, 22 nt, Homo sapiens
uuugucacccugaauguaagau

SEQ ID NO: 237587 - RNA, 22 nt, Homo sapiens
uuugucuccuaagacucugugg

SEQ ID NO: 237588 - RNA, 22 nt, Homo sapiens
uuugugagguggauagauugca

SEQ ID NO: 237589 - RNA, 18 nt, Homo sapiens
uuugugcuccacaaagga

SEQ ID NO: 237590 - RNA, 22 nt, Homo sapiens
uuugugcuccuguugagaaucu

SEQ ID NO: 237591 - RNA, 22 nt, Homo sapiens
uuuguguccccacccaaacauc

SEQ ID NO: 237592 - RNA, 23 nt, Homo sapiens
uuuguguccccacccaaaucuca

SEQ ID NO: 237593 - RNA, 22 nt, Homo sapiens
uuugugucccucuaaaauuuau

SEQ ID NO: 237594 - RNA, 23 nt, Homo sapiens
uuugugucccucuagaauucaug

SEQ ID NO: 237595 - RNA, 22 nt, Homo sapiens
uuuguguggccuuggccuggca

SEQ ID NO: 237596 - RNA, 22 nt, Homo sapiens
uuugugugugauuauaaaaggu

SEQ ID NO: 237597 - RNA, 22 nt, Homo sapiens
uuuuagcaaagagacugguggc

SEQ ID NO: 237598 - RNA, 20 nt, Homo sapiens
uuuuagcacuuguuauggug

SEQ ID NO: 237599 - RNA, 22 nt, Homo sapiens
uuuuaguggaauauuuacaguu

SEQ ID NO: 237600 - RNA, 22 nt, Homo sapiens
uuuucaguggccauaguggaga

SEQ ID NO: 237601 - RNA, 22 nt, Homo sapiens
uuuucaguuuuccagguagccg

SEQ ID NO: 237602 - RNA, 19 nt, Homo sapiens
uuuuccccuuucuuaagac

SEQ ID NO: 237603 - RNA, 22 nt, Homo sapiens
uuuugcaggucaggggcagaga

SEQ ID NO: 237604 - RNA, 22 nt, Homo sapiens
uuuugcuugugaauagccacau

SEQ ID NO: 237605 - RNA, 19 nt, Homo sapiens
uuuuggaaaugugaacagc

SEQ ID NO: 237606 - RNA, 22 nt, Homo sapiens
uuuuggacuucaauuugacacu

SEQ ID NO: 237607 - RNA, 22 nt, Homo sapiens
uuuuggcucugucuguaucuuu

SEQ ID NO: 237608 - RNA, 22 nt, Homo sapiens
uuuuggcucuugguaggucaga

SEQ ID NO: 237609 - RNA, 22 nt, Homo sapiens
uuuuggcuuaaagagaauguau

SEQ ID NO: 237610 - RNA, 20 nt, Homo sapiens
uuuuggcuuaaagcagucug

SEQ ID NO: 237611 - RNA, 22 nt, Homo sapiens
uuuugguaaugaacuuaggaag

SEQ ID NO: 237612 - RNA, 22 nt, Homo sapiens
uuuugguuguuggguaagagua

SEQ ID NO: 237613 - RNA, 22 nt, Homo sapiens
uuuuguacgccuguguccauca

SEQ ID NO: 237614 - RNA, 22 nt, Homo sapiens
uuuugugacuauuguaaauggg

SEQ ID NO: 237615 - RNA, 22 nt, Homo sapiens
uuuuugaguaaauauaaauugu

SEQ ID NO: 237616 - RNA, 22 nt, Homo sapiens
uuuuugauuaauggguagacca

SEQ ID NO: 237617 - RNA, 21 nt, Homo sapiens
uuuuugguggucauggauaga

SEQ ID NO: 237618 - RNA, 22 nt, Homo sapiens
uuuuuuaguuagcugggcauga

SEQ ID NO: 237619 - RNA, 22 nt, Homo sapiens
gagauuuucagcuugacuggga

SEQ ID NO: 237620 - RNA, 22 nt, Homo sapiens
gagcaaaaguauguauugguua

SEQ ID NO: 237621 - RNA, 22 nt, Homo sapiens
gagcacauaugacauuuucuuc

SEQ ID NO: 237622 - RNA, 18 nt, Homo sapiens
gagcaccuuuuuugcaga

SEQ ID NO: 237623 - RNA, 22 nt, Homo sapiens
gagcacugauuuauuuuugucu

SEQ ID NO: 237624 - RNA, 22 nt, Homo sapiens
gagcaucaguggccucaucuca

SEQ ID NO: 237625 - RNA, 22 nt, Homo sapiens
gagccuguaggaggagaggugg

SEQ ID NO: 237626 - RNA, 21 nt, Homo sapiens
gagcuaggugaggcuguaaug

SEQ ID NO: 237627 - RNA, 22 nt, Homo sapiens
gagcugaucuuuauguaaauuc

SEQ ID NO: 237628 - RNA, 22 nt, Homo sapiens
gagcugccuugccuaugcaaga

SEQ ID NO: 237629 - RNA, 20 nt, Homo sapiens
gagcugguguacugccgggc

SEQ ID NO: 237630 - RNA, 22 nt, Homo sapiens
gaggaaguagcuacugucuuuc

SEQ ID NO: 237631 - RNA, 22 nt, Homo sapiens
gaggaaguuuacaaagcaucug

SEQ ID NO: 237632 - RNA, 22 nt, Homo sapiens
gaggaguauuuugucgaauguc

SEQ ID NO: 237633 - RNA, 22 nt, Homo sapiens
gaggcaauaugagggaggcuuc

SEQ ID NO: 237634 - RNA, 22 nt, Homo sapiens
gaggcuagauggggaugugucc

SEQ ID NO: 237635 - RNA, 22 nt, Homo sapiens
gagguaaguggauuaugagguc

SEQ ID NO: 237636 - RNA, 22 nt, Homo sapiens
gagguaggaauaaacauuugaa

SEQ ID NO: 237637 - RNA, 22 nt, Homo sapiens
gagguagguuugguuacaaaag

SEQ ID NO: 237638 - RNA, 22 nt, Homo sapiens
gagguauggauaucuggagagg

SEQ ID NO: 237639 - RNA, 22 nt, Homo sapiens
gaggucaggacauuuuugcuuu

SEQ ID NO: 237640 - RNA, 22 nt, Homo sapiens
gagguggauacauuaaauaaug

SEQ ID NO: 237641 - RNA, 22 nt, Homo sapiens
gagguggugguggaggcauagc

SEQ ID NO: 237642 - RNA, 22 nt, Homo sapiens
gagguguagucaugccaagauc

SEQ ID NO: 237643 - RNA, 22 nt, Homo sapiens
gagguuuuagugagucccacug

SEQ ID NO: 237644 - RNA, 22 nt, Homo sapiens
gaguauuuuacaucguguaauu

SEQ ID NO: 237645 - RNA, 23 nt, Homo sapiens
gagugcaaugacaugaucucgga

SEQ ID NO: 237646 - RNA, 22 nt, Homo sapiens
gagugcaauggcagaucuccgc

SEQ ID NO: 237647 - RNA, 22 nt, Homo sapiens
gagugcaauggugccaucucgg

SEQ ID NO: 237648 - RNA, 22 nt, Homo sapiens
gaguuagguugucaaugucuua

SEQ ID NO: 237649 - RNA, 22 nt, Homo sapiens
gaguuuguaaacuauucacuaa

SEQ ID NO: 237650 - RNA, 19 nt, Homo sapiens
gauagacaucacagugcca

SEQ ID NO: 237651 - RNA, 22 nt, Homo sapiens
gauagguucuaagcagguguug

SEQ ID NO: 237652 - RNA, 21 nt, Homo sapiens
gauaugacauggguaaaacca

SEQ ID NO: 237653 - RNA, 22 nt, Homo sapiens
gauauguaaaaauuauaucuga

SEQ ID NO: 237654 - RNA, 22 nt, Homo sapiens
gaucacauggccauuucuagcu

SEQ ID NO: 237655 - RNA, 22 nt, Homo sapiens
gaucacauguguacucaaugug

SEQ ID NO: 237656 - RNA, 22 nt, Homo sapiens
gaucugagaaagugucauaaca

SEQ ID NO: 237657 - RNA, 22 nt, Homo sapiens
gaucugugugauuggaugcauu

SEQ ID NO: 237658 - RNA, 22 nt, Homo sapiens
gaucuguguuuguaugcauaag

SEQ ID NO: 237659 - RNA, 19 nt, Homo sapiens
gaucuguugaucaaugugu

SEQ ID NO: 237660 - RNA, 22 nt, Homo sapiens
gaucuguuucaauugucuuagu

SEQ ID NO: 237661 - RNA, 22 nt, Homo sapiens
gaucuguuuuccuauuguuugu

SEQ ID NO: 237662 - RNA, 22 nt, Homo sapiens
gaugacacugggucaaaucuca

SEQ ID NO: 237663 - RNA, 22 nt, Homo sapiens
gaugacagcugacucccuugcu

SEQ ID NO: 237664 - RNA, 22 nt, Homo sapiens
gaugagguaggccugcuuugaa

SEQ ID NO: 237665 - RNA, 22 nt, Homo sapiens
gauggguuuuuugaagacagca

SEQ ID NO: 237666 - RNA, 22 nt, Homo sapiens
gaugguuuucaccugcaugcuu

SEQ ID NO: 237667 - RNA, 22 nt, Homo sapiens
gauguagaaagagugggcugga

SEQ ID NO: 237668 - RNA, 22 nt, Homo sapiens
gauugcaauuuaggugagagag

SEQ ID NO: 237669 - RNA, 22 nt, Homo sapiens
gauuggcauugcugcaccugag

SEQ ID NO: 237670 - RNA, 22 nt, Homo sapiens
gauugguugaaaguagaauacu

SEQ ID NO: 237671 - RNA, 22 nt, Homo sapiens
gauuugguguucuggcucaaga

SEQ ID NO: 237672 - RNA, 21 nt, Homo sapiens
gcaaacauccuuugaugccag

SEQ ID NO: 237673 - RNA, 21 nt, Homo sapiens
gcaaaggaauugccuaagcuu

SEQ ID NO: 237674 - RNA, 22 nt, Homo sapiens
gcaaaguguuuuuaggaagucu

SEQ ID NO: 237675 - RNA, 22 nt, Homo sapiens
gcaaaugcuaugccauuuuaua

SEQ ID NO: 237676 - RNA, 22 nt, Homo sapiens
gcaagauguuaccauuagggaa

SEQ ID NO: 237677 - RNA, 22 nt, Homo sapiens
gcacaguguuacuugauauauu

SEQ ID NO: 237678 - RNA, 22 nt, Homo sapiens
gcacauggccacuaggaauaaa

SEQ ID NO: 237679 - RNA, 22 nt, Homo sapiens
gcaccauugacaagaaauaggu

SEQ ID NO: 237680 - RNA, 22 nt, Homo sapiens
gcacccugucaaaauggaccaa

SEQ ID NO: 237681 - RNA, 22 nt, Homo sapiens
gcacgcauuguccuucuaguca

SEQ ID NO: 237682 - RNA, 22 nt, Homo sapiens
gcagagaaacaggucuaaggag

SEQ ID NO: 237683 - RNA, 22 nt, Homo sapiens
gcagaguauagagggcugggcc

SEQ ID NO: 237684 - RNA, 22 nt, Homo sapiens
gcagaucucuucauuucucuua

SEQ ID NO: 237685 - RNA, 23 nt, Homo sapiens
gcagcaaugucacagggguccgg

SEQ ID NO: 237686 - RNA, 22 nt, Homo sapiens
gcagcagugugggcugaaccua

SEQ ID NO: 237687 - RNA, 22 nt, Homo sapiens
gcaggcaugacauuucacucuu

SEQ ID NO: 237688 - RNA, 22 nt, Homo sapiens
gcaguacuuuauguccuaauua

SEQ ID NO: 237689 - RNA, 22 nt, Homo sapiens
ugaucucagcucacugguugaa

SEQ ID NO: 237690 - RNA, 22 nt, Homo sapiens
ugaucugucucggguuaucagu

SEQ ID NO: 237691 - RNA, 21 nt, Homo sapiens
ugaugcuuuucuuaaccuugc

SEQ ID NO: 237692 - RNA, 22 nt, Homo sapiens
ugauggcacagugaguuccagg

SEQ ID NO: 237693 - RNA, 22 nt, Homo sapiens
ugauguccaguucauagaaacu

SEQ ID NO: 237694 - RNA, 18 nt, Homo sapiens
ugauugacuuauuuaggu

SEQ ID NO: 237695 - RNA, 22 nt, Homo sapiens
ugauugcacaccugcacucaag

SEQ ID NO: 237696 - RNA, 22 nt, Homo sapiens
ugcaaauguuaggugucauuau

SEQ ID NO: 237697 - RNA, 22 nt, Homo sapiens
ugcaaauuauugggccccaacu

SEQ ID NO: 237698 - RNA, 22 nt, Homo sapiens
ugcaagauaggcaguuugcacu

SEQ ID NO: 237699 - RNA, 20 nt, Homo sapiens
ugcaaguugccuuuggaggc

SEQ ID NO: 237700 - RNA, 18 nt, Homo sapiens
ugcaauggagaugcagcc

SEQ ID NO: 237701 - RNA, 22 nt, Homo sapiens
ugcaaugugaaauaagcacauc

SEQ ID NO: 237702 - RNA, 23 nt, Homo sapiens
ugcaccacuacacacucuugggu

SEQ ID NO: 237703 - RNA, 22 nt, Homo sapiens
ugcaccacugcacuccagcuug

SEQ ID NO: 237704 - RNA, 22 nt, Homo sapiens
ugcaccacuguacuccagucug

SEQ ID NO: 237705 - RNA, 22 nt, Homo sapiens
ugcagagaaacauuuuguauuu

SEQ ID NO: 237706 - RNA, 16 nt, Homo sapiens
ugcagaguaggugaau

SEQ ID NO: 237707 - RNA, 22 nt, Homo sapiens
ugcagcacaguagguuugcaau

SEQ ID NO: 237708 - RNA, 22 nt, Homo sapiens
ugcagcacuguucacaauagcc

SEQ ID NO: 237709 - RNA, 22 nt, Homo sapiens
ugcagcauguaggcacguuauu

SEQ ID NO: 237710 - RNA, 22 nt, Homo sapiens
ugcaguacugucagacuucuua

SEQ ID NO: 237711 - RNA, 22 nt, Homo sapiens
ugcaguagugugaucuuggcuc

SEQ ID NO: 237712 - RNA, 22 nt, Homo sapiens
ugcagugcaugacuguguuaug

SEQ ID NO: 237713 - RNA, 20 nt, Homo sapiens
ugcaguguccucacuuguca

SEQ ID NO: 237714 - RNA, 22 nt, Homo sapiens
ugcagugugauuuucuggcuga

SEQ ID NO: 237715 - RNA, 22 nt, Homo sapiens
ugcauggaggagcuccccgcag

SEQ ID NO: 237716 - RNA, 22 nt, Homo sapiens
ugcauggauguuugaacacacu

SEQ ID NO: 237717 - RNA, 22 nt, Homo sapiens
uaccagugaauuccaggggcua

SEQ ID NO: 237718 - RNA, 22 nt, Homo sapiens
uaccauguauguuucuccauug

SEQ ID NO: 237719 - RNA, 22 nt, Homo sapiens
uacccucuggauacccuuguuc

SEQ ID NO: 237720 - RNA, 22 nt, Homo sapiens
uacccuuauguaaucauuauac

SEQ ID NO: 237721 - RNA, 22 nt, Homo sapiens
uaccucagccaaugcccagaag

SEQ ID NO: 237722 - RNA, 22 nt, Homo sapiens
uaccucaguucaauaacagaua

SEQ ID NO: 237723 - RNA, 22 nt, Homo sapiens
uaccuguagacuacagcuucag

SEQ ID NO: 237724 - RNA, 22 nt, Homo sapiens
uacuagaguagugcagagggga

SEQ ID NO: 237725 - RNA, 23 nt, Homo sapiens
uacuaguaagcguguucuuugca

SEQ ID NO: 237726 - RNA, 22 nt, Homo sapiens
uacucaguaagugcuggcugcu

SEQ ID NO: 237727 - RNA, 22 nt, Homo sapiens
uacucugcagagaugcauaaca

SEQ ID NO: 237728 - RNA, 22 nt, Homo sapiens
uacucugcagccauaaaacaga

SEQ ID NO: 237729 - RNA, 22 nt, Homo sapiens
uacucugcaguaauuccagccc

SEQ ID NO: 237730 - RNA, 22 nt, Homo sapiens
uacugcacuccagccugggaga

SEQ ID NO: 237731 - RNA, 22 nt, Homo sapiens
uacugcagucagacuccugggc

SEQ ID NO: 237732 - RNA, 22 nt, Homo sapiens
uacugcaguugcagcuugagga

SEQ ID NO: 237733 - RNA, 23 nt, Homo sapiens
uacugcauccuccgccucuaggg

SEQ ID NO: 237734 - RNA, 22 nt, Homo sapiens
uacugcaucuacuuagagccag

SEQ ID NO: 237735 - RNA, 22 nt, Homo sapiens
uacugcugucagugccaaguag

SEQ ID NO: 237736 - RNA, 22 nt, Homo sapiens
uacuguacugcaguucugcaaa

SEQ ID NO: 237737 - RNA, 22 nt, Homo sapiens
uacuguguaguuagaccucaga

SEQ ID NO: 237738 - RNA, 22 nt, Homo sapiens
uagaauggaaggcauguuugcc

SEQ ID NO: 237739 - RNA, 22 nt, Homo sapiens
uagaauguauaauauuuuacuu

SEQ ID NO: 237740 - RNA, 23 nt, Homo sapiens
uagaauguuuuuccauguuucuu

SEQ ID NO: 237741 - RNA, 22 nt, Homo sapiens
uagacacuagauaugugacuga

SEQ ID NO: 237742 - RNA, 22 nt, Homo sapiens
uagaccauucuauuuccuaugc

SEQ ID NO: 237743 - RNA, 18 nt, Homo sapiens
uagagcacaagcuuuggc

SEQ ID NO: 237744 - RNA, 22 nt, Homo sapiens
uagagcacauuaucauuuccaa

SEQ ID NO: 237745 - RNA, 22 nt, Homo sapiens
uagaggaaugaauuuggccaga

SEQ ID NO: 237746 - RNA, 22 nt, Homo sapiens
uagauaguuaugauuugaugau

SEQ ID NO: 237747 - RNA, 22 nt, Homo sapiens
uucccugugggcuggugcucca

SEQ ID NO: 237748 - RNA, 22 nt, Homo sapiens
uucccuugcaggaugaucugga

SEQ ID NO: 237749 - RNA, 22 nt, Homo sapiens
uucccuuugugcauaggauuug

SEQ ID NO: 237750 - RNA, 22 nt, Homo sapiens
uuccuaguccugagucucugcg

SEQ ID NO: 237751 - RNA, 19 nt, Homo sapiens
uuccuagugguugggaagu

SEQ ID NO: 237752 - RNA, 22 nt, Homo sapiens
uuccugaggccuccccagaagc

SEQ ID NO: 237753 - RNA, 22 nt, Homo sapiens
uuccuugagaaaguacaaggcu

SEQ ID NO: 237754 - RNA, 22 nt, Homo sapiens
uuccuugguucagggaaggucc

SEQ ID NO: 237755 - RNA, 22 nt, Homo sapiens
uuccuuguagcaaaugcgauga

SEQ ID NO: 237756 - RNA, 21 nt, Homo sapiens
uucuaaguaaauguuggacau

SEQ ID NO: 237757 - RNA, 22 nt, Homo sapiens
uucuaaguaauuuugcaugccu

SEQ ID NO: 237758 - RNA, 22 nt, Homo sapiens
uucuacaggcuguucaagaagc

SEQ ID NO: 237759 - RNA, 20 nt, Homo sapiens
uucuacagucacaggaagau

SEQ ID NO: 237760 - RNA, 22 nt, Homo sapiens
uucuacagugacugcagccaua

SEQ ID NO: 237761 - RNA, 20 nt, Homo sapiens
uucuaguacuucuguuucca

SEQ ID NO: 237762 - RNA, 23 nt, Homo sapiens
uucuaucaggcccaggagcccug

SEQ ID NO: 237763 - RNA, 22 nt, Homo sapiens
uucuaugguuuuuaugguguua

SEQ ID NO: 237764 - RNA, 22 nt, Homo sapiens
uucuauguuguuagacccacca

SEQ ID NO: 237765 - RNA, 22 nt, Homo sapiens
uucucaaggagccuucguaacu

SEQ ID NO: 237766 - RNA, 22 nt, Homo sapiens
uucucagugaaguuuagaacau

SEQ ID NO: 237767 - RNA, 22 nt, Homo sapiens
uucucauggaacaucuguacug

SEQ ID NO: 237768 - RNA, 23 nt, Homo sapiens
uucugccacugaaaaugccucag

SEQ ID NO: 237769 - RNA, 22 nt, Homo sapiens
uuggaauacucaaaagguuggg

SEQ ID NO: 237770 - RNA, 22 nt, Homo sapiens
uuggaauacuuguuaaagucca

SEQ ID NO: 237771 - RNA, 22 nt, Homo sapiens
uuggaauguauggcaucuugcg

SEQ ID NO: 237772 - RNA, 22 nt, Homo sapiens
uuggaauuagacaagugguggu

SEQ ID NO: 237773 - RNA, 22 nt, Homo sapiens
uuggaauuuuacuucuguaaga

SEQ ID NO: 237774 - RNA, 22 nt, Homo sapiens
uuggagagagaggacucccggc

SEQ ID NO: 237775 - RNA, 22 nt, Homo sapiens
uuggagagucacuaguuagugc

SEQ ID NO: 237776 - RNA, 22 nt, Homo sapiens
uuggaguguucugguccgggcu

SEQ ID NO: 237777 - RNA, 22 nt, Homo sapiens
uuggauuuugguggcaacucau

SEQ ID NO: 237778 - RNA, 22 nt, Homo sapiens
uuggcaacauagugagaccccc

SEQ ID NO: 237779 - RNA, 21 nt, Homo sapiens
uuggcacucuucucuccuuau

SEQ ID NO: 237780 - RNA, 22 nt, Homo sapiens
uuggcaguaucuacuacagcua

SEQ ID NO: 237781 - RNA, 22 nt, Homo sapiens
uuggcagucugaggcacagacu

SEQ ID NO: 237782 - RNA, 22 nt, Homo sapiens
uuggcauagaggcucucaagcu

SEQ ID NO: 237783 - RNA, 20 nt, Homo sapiens
uuggcauuuagacaagaguu

SEQ ID NO: 237784 - RNA, 22 nt, Homo sapiens
uuggccagugucuuuuuuuccu

SEQ ID NO: 237785 - RNA, 22 nt, Homo sapiens
uuggccccuuucauccacagcu

SEQ ID NO: 237786 - RNA, 22 nt, Homo sapiens
uuggcgacugcugcuaaucagg

SEQ ID NO: 237787 - RNA, 22 nt, Homo sapiens
uuggcuaugaguccuaugugca

SEQ ID NO: 237788 - RNA, 22 nt, Homo sapiens
uuggcucuggcugggcuccagc

SEQ ID NO: 237789 - RNA, 22 nt, Homo sapiens
uuggcuguguuccucaaggagu

SEQ ID NO: 237790 - RNA, 22 nt, Homo sapiens
uuggcuucuggacuauugugca

SEQ ID NO: 237791 - RNA, 23 nt, Homo sapiens
uugggcaaaucacugagggcaga

SEQ ID NO: 237792 - RNA, 22 nt, Homo sapiens
uugggccacuuuaguuuccuua

SEQ ID NO: 237793 - RNA, 22 nt, Homo sapiens
uuggguaguauagaagcaacaa

SEQ ID NO: 237794 - RNA, 22 nt, Homo sapiens
uuggguagugaguuccuccagg

SEQ ID NO: 237795 - RNA, 22 nt, Homo sapiens
uuggucacugacauguuugaaa

SEQ ID NO: 237796 - RNA, 22 nt, Homo sapiens
uuggucagcucaauggagaggg

SEQ ID NO: 237797 - RNA, 22 nt, Homo sapiens
uugguucucuuuauaugcugga

SEQ ID NO: 237798 - RNA, 22 nt, Homo sapiens
uuguacuuuuaguagagacggg

SEQ ID NO: 237799 - RNA, 22 nt, Homo sapiens
uuguauguuguuugucagagaa

SEQ ID NO: 237800 - RNA, 22 nt, Homo sapiens
uugucauggucuugauccauua

SEQ ID NO: 237801 - RNA, 19 nt, Homo sapiens
uugucuuagaguugucauu

SEQ ID NO: 237802 - RNA, 22 nt, Homo sapiens
uugugaaaucuaggcagagguu

SEQ ID NO: 237803 - RNA, 22 nt, Homo sapiens
uugugaaugaugucgcaguaaa

SEQ ID NO: 237804 - RNA, 22 nt, Homo sapiens
uugugaauggaguagcaggauc

SEQ ID NO: 237805 - RNA, 22 nt, Homo sapiens
uugugcaaaaguaauugcgguu

SEQ ID NO: 237806 - RNA, 20 nt, Homo sapiens
uugugcauugggccauuggg

SEQ ID NO: 237807 - RNA, 22 nt, Homo sapiens
uugugccauucuucugccucag

SEQ ID NO: 237808 - RNA, 22 nt, Homo sapiens
uugugccccuucucagucgggc

SEQ ID NO: 237809 - RNA, 22 nt, Homo sapiens
uugugcuccuaugagaaucuaa

SEQ ID NO: 237810 - RNA, 22 nt, Homo sapiens
uugugcuuuacuuacuaccaga

SEQ ID NO: 237811 - RNA, 22 nt, Homo sapiens
uugugguaggcauguaagauga

SEQ ID NO: 237812 - RNA, 22 nt, Homo sapiens
uugugguuuuuaaaacuaggug

SEQ ID NO: 237813 - RNA, 22 nt, Homo sapiens
uugugucccugcccaaaucuca

SEQ ID NO: 237814 - RNA, 22 nt, Homo sapiens
uuguguuuuuaguagggaaggg

SEQ ID NO: 237815 - RNA, 22 nt, Homo sapiens
uuguuauguaucucaagauaaa

SEQ ID NO: 237816 - RNA, 23 nt, Homo sapiens
uuguucccuuccacucagucucc

SEQ ID NO: 237817 - RNA, 22 nt, Homo sapiens
uuguuugguuagaugggcaagu

SEQ ID NO: 237818 - RNA, 22 nt, Homo sapiens
uuuaaggcacuucaugguuuca

SEQ ID NO: 237819 - RNA, 22 nt, Homo sapiens
uuuacagucucauagguggaag

SEQ ID NO: 237820 - RNA, 22 nt, Homo sapiens
uuuacaguuuucuaggcuacca

SEQ ID NO: 237821 - RNA, 22 nt, Homo sapiens
uuuacugugggguuucuuagag

SEQ ID NO: 237822 - RNA, 22 nt, Homo sapiens
uuuagcacugugauugacaaaa

SEQ ID NO: 237823 - RNA, 22 nt, Homo sapiens
uuuagcagcaaagagccaugcu

SEQ ID NO: 237824 - RNA, 22 nt, Homo sapiens
uuuagcagcaaagagcuguguu

SEQ ID NO: 237825 - RNA, 22 nt, Homo sapiens
uuuaggcaauauauucaugucu

SEQ ID NO: 237826 - RNA, 22 nt, Homo sapiens
uuuagguagucaaagguuaguc

SEQ ID NO: 237827 - RNA, 22 nt, Homo sapiens
uuuaguacugcuuuaugugugu

SEQ ID NO: 237828 - RNA, 22 nt, Homo sapiens
uuuauggagagauauuuauggu

SEQ ID NO: 237829 - RNA, 18 nt, Homo sapiens
uuucaagucuuaggugac

SEQ ID NO: 237830 - RNA, 22 nt, Homo sapiens
uuucaccguguuggccaggcug

SEQ ID NO: 237831 - RNA, 22 nt, Homo sapiens
uuucagcguggggugcugaaga

SEQ ID NO: 237832 - RNA, 15 nt, Homo sapiens
uuucaguacagauuc

SEQ ID NO: 237833 - RNA, 20 nt, Homo sapiens
uuucaguacuuucuacuggc

SEQ ID NO: 237834 - RNA, 22 nt, Homo sapiens
uuucaguagagacacgguuuug

SEQ ID NO: 237835 - RNA, 22 nt, Homo sapiens
uuucauaguuugcauagggcau

SEQ ID NO: 237836 - RNA, 22 nt, Homo sapiens
uuucauggaauauagucauuuu

SEQ ID NO: 237837 - RNA, 18 nt, Homo sapiens
uuucauugagugugauau

SEQ ID NO: 237838 - RNA, 19 nt, Homo sapiens
uuuccaguaaucuuaugug

SEQ ID NO: 237839 - RNA, 21 nt, Homo sapiens
uuuccuggagcguauggcuuc

SEQ ID NO: 237840 - RNA, 22 nt, Homo sapiens
uuuccuguagggggcaaggccu

SEQ ID NO: 237841 - RNA, 22 nt, Homo sapiens
uuucugaggccucaccagaagc

SEQ ID NO: 237842 - RNA, 21 nt, Homo sapiens
uuucugggggagcauggcagg

SEQ ID NO: 237843 - RNA, 22 nt, Homo sapiens
uuucugggggugcugauggaaa

SEQ ID NO: 237844 - RNA, 22 nt, Homo sapiens
uuucuugguuguauuuagacuu

SEQ ID NO: 237845 - RNA, 22 nt, Homo sapiens
uuugaagugugaugccuugaug

SEQ ID NO: 237846 - RNA, 22 nt, Homo sapiens
uuugaauggaaguuuugugaaa

SEQ ID NO: 237847 - RNA, 22 nt, Homo sapiens
uuugagcauggaaauggcauga

SEQ ID NO: 237848 - RNA, 22 nt, Homo sapiens
uuugauguccaccucagcccac

SEQ ID NO: 237849 - RNA, 22 nt, Homo sapiens
uuugauguugagacuauaaagc

SEQ ID NO: 237850 - RNA, 22 nt, Homo sapiens
uuugauguugauacuaccuuca

SEQ ID NO: 237851 - RNA, 22 nt, Homo sapiens
uuugauugguguaccugaaagu

SEQ ID NO: 237852 - RNA, 22 nt, Homo sapiens
uuugauuguacuaaaauuguac

SEQ ID NO: 237853 - RNA, 22 nt, Homo sapiens
uuugcaagaugaaaaaguucua

SEQ ID NO: 237854 - RNA, 22 nt, Homo sapiens
uuugcacauauuugggcaaaag

SEQ ID NO: 237855 - RNA, 23 nt, Homo sapiens
uuugcacuugcuccuucuauggc

SEQ ID NO: 237856 - RNA, 20 nt, Homo sapiens
uuugcagaaucuaagaagag

SEQ ID NO: 237857 - RNA, 22 nt, Homo sapiens
uuugcagagucuuucgcugggc

SEQ ID NO: 237858 - RNA, 22 nt, Homo sapiens
uuugcaguguaguuggccagca

SEQ ID NO: 237859 - RNA, 22 nt, Homo sapiens
uuugcagugucagcuucugugu

SEQ ID NO: 237860 - RNA, 22 nt, Homo sapiens
uuugcaguuuauuccuggggcu

SEQ ID NO: 237861 - RNA, 19 nt, Homo sapiens
uuugcauagugagaauaua

SEQ ID NO: 237862 - RNA, 22 nt, Homo sapiens
uuuggaaugugcacucagauug

SEQ ID NO: 237863 - RNA, 22 nt, Homo sapiens
uuuggcaacguuggaucccuca

SEQ ID NO: 237864 - RNA, 22 nt, Homo sapiens
uuuggcaauaaacuccccuaac

SEQ ID NO: 237865 - RNA, 22 nt, Homo sapiens
uuuggcauuaagaugcuguauc

SEQ ID NO: 237866 - RNA, 18 nt, Homo sapiens
uuuggcuguucaugacuc

SEQ ID NO: 237867 - RNA, 22 nt, Homo sapiens
uuuggcuguuucuggacuaaga

SEQ ID NO: 237868 - RNA, 22 nt, Homo sapiens
uuuggcuuaagauugacugcaa

SEQ ID NO: 237869 - RNA, 21 nt, Homo sapiens
uuuggcuucucugcugcagcc

SEQ ID NO: 237870 - RNA, 22 nt, Homo sapiens
uuuggcuuuuguaauaacugcc

SEQ ID NO: 237871 - RNA, 22 nt, Homo sapiens
uuugggaaaugaaguugguaga

SEQ ID NO: 237872 - RNA, 22 nt, Homo sapiens
aaaagagcugagagguauucuu

SEQ ID NO: 237873 - RNA, 22 nt, Homo sapiens
aaaaggcuagcuaguaacagaa

SEQ ID NO: 237874 - RNA, 22 nt, Homo sapiens
aaacugaucugaaggccaggcu

SEQ ID NO: 237875 - RNA, 22 nt, Homo sapiens
aaagagcugagaccugguggag

SEQ ID NO: 237876 - RNA, 22 nt, Homo sapiens
aaagcacugaauaaauuugcuu

SEQ ID NO: 237877 - RNA, 22 nt, Homo sapiens
aaaggauucuaauggaaaugcu

SEQ ID NO: 237878 - RNA, 22 nt, Homo sapiens
aaaggcacugaucuuauccagu

SEQ ID NO: 237879 - RNA, 22 nt, Homo sapiens
aaaggcacugugacuuuauagg

SEQ ID NO: 237880 - RNA, 22 nt, Homo sapiens
aaaggcaucauuaguaccaagu

SEQ ID NO: 237881 - RNA, 20 nt, Homo sapiens
aaaggcugugagaacgagau

SEQ ID NO: 237882 - RNA, 22 nt, Homo sapiens
aaagggcuuuguaaacuucaag

SEQ ID NO: 237883 - RNA, 22 nt, Homo sapiens
aaaguacucaguucaguuccgu

SEQ ID NO: 237884 - RNA, 22 nt, Homo sapiens
aaagucuagaggaucaugugug

SEQ ID NO: 237885 - RNA, 22 nt, Homo sapiens
aaagucuguuacagcuauuucu

SEQ ID NO: 237886 - RNA, 22 nt, Homo sapiens
aaagugauugcgguuuuugcca

SEQ ID NO: 237887 - RNA, 22 nt, Homo sapiens
aaagugcaguauuugggcagaa

SEQ ID NO: 237888 - RNA, 22 nt, Homo sapiens
aaagugcaguauuugggcagga

SEQ ID NO: 237889 - RNA, 22 nt, Homo sapiens
aaagugcugagaguucuaacuu

SEQ ID NO: 237890 - RNA, 22 nt, Homo sapiens
aaauaguagcugaaugagggaa

SEQ ID NO: 237891 - RNA, 22 nt, Homo sapiens
aaaugcacgcuacccagcuaga

SEQ ID NO: 237892 - RNA, 22 nt, Homo sapiens
aaaugccucccauucuacugac

SEQ ID NO: 237893 - RNA, 18 nt, Homo sapiens
aaauucugucccuucuuc

SEQ ID NO: 237894 - RNA, 22 nt, Homo sapiens
aaauugcacaaguggugauuug

SEQ ID NO: 237895 - RNA, 22 nt, Homo sapiens
agcaagaugaaguugagcuagg

SEQ ID NO: 237896 - RNA, 22 nt, Homo sapiens
agcaauaugacauugcuacauc

SEQ ID NO: 237897 - RNA, 22 nt, Homo sapiens
agcacacuggguggcuuaaaca

SEQ ID NO: 237898 - RNA, 22 nt, Homo sapiens
agcacauauauuucccaaaaca

SEQ ID NO: 237899 - RNA, 22 nt, Homo sapiens
agcaccagaaucugaguuauuc

SEQ ID NO: 237900 - RNA, 22 nt, Homo sapiens
agcaccaugggcugaguaagug

SEQ ID NO: 237901 - RNA, 22 nt, Homo sapiens
agcaccauuucucuaaagcacu

SEQ ID NO: 237902 - RNA, 22 nt, Homo sapiens
agcagcacaucccuuucuggcc

SEQ ID NO: 237903 - RNA, 22 nt, Homo sapiens
agcagcauuaugauauaucuua

SEQ ID NO: 237904 - RNA, 22 nt, Homo sapiens
agcagcucaugccuuugggagg

SEQ ID NO: 237905 - RNA, 22 nt, Homo sapiens
agcagguauucgggucaugggg

SEQ ID NO: 237906 - RNA, 16 nt, Homo sapiens
agcagguguuagguga

SEQ ID NO: 237907 - RNA, 22 nt, Homo sapiens
agcaguacauaaaaagcauccu

SEQ ID NO: 237908 - RNA, 22 nt, Homo sapiens
agcaguagaauuccugcaucac

SEQ ID NO: 237909 - RNA, 22 nt, Homo sapiens
agcaguagugaaaguagacuua

SEQ ID NO: 237910 - RNA, 18 nt, Homo sapiens
agcaucacugaucauccu

SEQ ID NO: 237911 - RNA, 22 nt, Homo sapiens
agcaucauaccaaucugguccu

SEQ ID NO: 237912 - RNA, 22 nt, Homo sapiens
agccaagacucuguuccccuug

SEQ ID NO: 237913 - RNA, 22 nt, Homo sapiens
agcccagagacuguguaaauuu

SEQ ID NO: 237914 - RNA, 22 nt, Homo sapiens
agccuucauucugacaguagga

SEQ ID NO: 237915 - RNA, 22 nt, Homo sapiens
agcggcuguuccccuggucuau

SEQ ID NO: 237916 - RNA, 22 nt, Homo sapiens
agcucacagccuagcacuguga

SEQ ID NO: 237917 - RNA, 22 nt, Homo sapiens
agcuccaucuucagggguucag

SEQ ID NO: 237918 - RNA, 22 nt, Homo sapiens
agcuccuacuguuacaucauug

SEQ ID NO: 237919 - RNA, 22 nt, Homo sapiens
agcucuuguuaguauuagcagu

SEQ ID NO: 237920 - RNA, 22 nt, Homo sapiens
agcugaguguuccaagagcgag

SEQ ID NO: 237921 - RNA, 22 nt, Homo sapiens
agcugcaauguuuaguauaaua

SEQ ID NO: 237922 - RNA, 22 nt, Homo sapiens
agcugcacaaauggaugugagg

SEQ ID NO: 237923 - RNA, 22 nt, Homo sapiens
agcugccagucuuguaaggccu

SEQ ID NO: 237924 - RNA, 22 nt, Homo sapiens
agcuggauguggaugacccugu

SEQ ID NO: 237925 - RNA, 22 nt, Homo sapiens
agcuggcuguagcugcaagucu

SEQ ID NO: 237926 - RNA, 22 nt, Homo sapiens
agcugguaugaaaaucucccca

SEQ ID NO: 237927 - RNA, 22 nt, Homo sapiens
agcuggucugauacuuaccucc

SEQ ID NO: 237928 - RNA, 22 nt, Homo sapiens
agcuguguugucugaagucaga

SEQ ID NO: 237929 - RNA, 22 nt, Homo sapiens
agcuguuguacacuuuaccuuu

SEQ ID NO: 237930 - RNA, 22 nt, Homo sapiens
agcuguuguucucagaggcuuu

SEQ ID NO: 237931 - RNA, 22 nt, Homo sapiens
agcuguuuuugugggcauguga

SEQ ID NO: 237932 - RNA, 22 nt, Homo sapiens
agcuuguccuccacccacacug

SEQ ID NO: 237933 - RNA, 22 nt, Homo sapiens
agcuugugauucuccaucaugu

SEQ ID NO: 237934 - RNA, 22 nt, Homo sapiens
agcuuguggugaauacugcuag

SEQ ID NO: 237935 - RNA, 22 nt, Homo sapiens
agcuuuuugggcagcuauugac

SEQ ID NO: 237936 - RNA, 22 nt, Homo sapiens
aggaaaucuuagcugaggggau

SEQ ID NO: 237937 - RNA, 16 nt, Homo sapiens
aggaagacuuagagau

SEQ ID NO: 237938 - RNA, 22 nt, Homo sapiens
aggaagcuagcauuuguucagu

SEQ ID NO: 237939 - RNA, 22 nt, Homo sapiens
aggaagugucuucuuuuaggca

SEQ ID NO: 237940 - RNA, 22 nt, Homo sapiens
aggacacugauagucuuuggca

SEQ ID NO: 237941 - RNA, 19 nt, Homo sapiens
aggacuaaagacuagaagu

SEQ ID NO: 237942 - RNA, 22 nt, Homo sapiens
aggagcacaauggucaugugga

SEQ ID NO: 237943 - RNA, 20 nt, Homo sapiens
aggagcauuuacauuggcuc

SEQ ID NO: 237944 - RNA, 23 nt, Homo sapiens
aggagcuuagaaguugccauugc

SEQ ID NO: 237945 - RNA, 22 nt, Homo sapiens
aggaggauugcuuucaucuuuu

SEQ ID NO: 237946 - RNA, 22 nt, Homo sapiens
aggagguagaacauugccauuu

SEQ ID NO: 237947 - RNA, 22 nt, Homo sapiens
aggagguagggugugaaacagc

SEQ ID NO: 237948 - RNA, 22 nt, Homo sapiens
aggcaagagugacuacgugaaa

SEQ ID NO: 237949 - RNA, 21 nt, Homo sapiens
aggcaagguguuauuauugaa

SEQ ID NO: 237950 - RNA, 22 nt, Homo sapiens
aggcacggugucucaugccugu

SEQ ID NO: 237951 - RNA, 22 nt, Homo sapiens
aggcaugaaauacaugcauuga

SEQ ID NO: 237952 - RNA, 22 nt, Homo sapiens
aggcaugaguucagaggguaug

SEQ ID NO: 237953 - RNA, 22 nt, Homo sapiens
aggcauggagacuaaaauuaua

SEQ ID NO: 237954 - RNA, 22 nt, Homo sapiens
aggcaugguggcacauacaugu

SEQ ID NO: 237955 - RNA, 22 nt, Homo sapiens
aggcuuuauuacagggucucag

SEQ ID NO: 237956 - RNA, 22 nt, Homo sapiens
agguaagaugugacuugguguu

SEQ ID NO: 237957 - RNA, 22 nt, Homo sapiens
agguauguauguaugggagaaa

SEQ ID NO: 237958 - RNA, 22 nt, Homo sapiens
aggucccauguccucccugacc

SEQ ID NO: 237959 - RNA, 22 nt, Homo sapiens
aggugcaauggugguuuugugg

SEQ ID NO: 237960 - RNA, 22 nt, Homo sapiens
aggugcaugcuucacuggauau

SEQ ID NO: 237961 - RNA, 22 nt, Homo sapiens
aggugcugagcagagaauccug

SEQ ID NO: 237962 - RNA, 22 nt, Homo sapiens
aggugcuugaaucuaugagcuc

SEQ ID NO: 237963 - RNA, 22 nt, Homo sapiens
aggugguguuggguuccagccc

SEQ ID NO: 237964 - RNA, 22 nt, Homo sapiens
agguuaacaucuauuuuggaug

SEQ ID NO: 237965 - RNA, 22 nt, Homo sapiens
agguuuucagccccagccuagg

SEQ ID NO: 237966 - RNA, 22 nt, Homo sapiens
aguaacauuucuaguagagagu

SEQ ID NO: 237967 - RNA, 22 nt, Homo sapiens
aguacaucuggcuggauagaua

SEQ ID NO: 237968 - RNA, 22 nt, Homo sapiens
aguaucaagccacacaugguca

SEQ ID NO: 237969 - RNA, 22 nt, Homo sapiens
agucaaaugcuuauguauaaag

SEQ ID NO: 237970 - RNA, 22 nt, Homo sapiens
agucaagaaucucagcaucuuu

SEQ ID NO: 237971 - RNA, 22 nt, Homo sapiens
agucaagaugagauuugggugg

SEQ ID NO: 237972 - RNA, 22 nt, Homo sapiens
agucacagccuuuuacuuuaga

SEQ ID NO: 237973 - RNA, 22 nt, Homo sapiens
agucacaugcauuuucuucaau

SEQ ID NO: 237974 - RNA, 22 nt, Homo sapiens
agucacggugguuugcacuugu

SEQ ID NO: 237975 - RNA, 22 nt, Homo sapiens
aguccagguuuuguaauggcaa

SEQ ID NO: 237976 - RNA, 22 nt, Homo sapiens
aguccaguguuaugaucaguag

SEQ ID NO: 237977 - RNA, 22 nt, Homo sapiens
agugaacaaagaagugcagaua

SEQ ID NO: 237978 - RNA, 22 nt, Homo sapiens
agugcaaugauccggugcuggg

SEQ ID NO: 237979 - RNA, 22 nt, Homo sapiens
agugcaguugucacgugccuuc

SEQ ID NO: 237980 - RNA, 22 nt, Homo sapiens
agugcauuuguucugugucagg

SEQ ID NO: 237981 - RNA, 22 nt, Homo sapiens
aguggauuuuagacugagauuu

SEQ ID NO: 237982 - RNA, 22 nt, Homo sapiens
aguggcaaugugauguccugaa

SEQ ID NO: 237983 - RNA, 22 nt, Homo sapiens
agugggccccuagaggugaggu

SEQ ID NO: 237984 - RNA, 22 nt, Homo sapiens
aguggguguuccauuggauaaa

SEQ ID NO: 237985 - RNA, 19 nt, Homo sapiens
aguggguguuuucuguuug

SEQ ID NO: 237986 - RNA, 23 nt, Homo sapiens
aguggucuccugggcccagcugu

SEQ ID NO: 237987 - RNA, 22 nt, Homo sapiens
agugguguugccuguugaccua

SEQ ID NO: 237988 - RNA, 22 nt, Homo sapiens
aguucaauggguuuucacucau

SEQ ID NO: 237989 - RNA, 18 nt, Homo sapiens
aguuguuuuauccugccc

SEQ ID NO: 237990 - RNA, 22 nt, Homo sapiens
auaaagcaaauaggacuauugc

SEQ ID NO: 237991 - RNA, 22 nt, Homo sapiens
auaaaguucugcuggcauauau

SEQ ID NO: 237992 - RNA, 22 nt, Homo sapiens
auaagaugaaggaagccauauc

SEQ ID NO: 237993 - RNA, 22 nt, Homo sapiens
auaaggcagcugcuaaaaggca

SEQ ID NO: 237994 - RNA, 22 nt, Homo sapiens
auaagugcuuguugaauaauag

SEQ ID NO: 237995 - RNA, 22 nt, Homo sapiens
auaauacugggaagaugagcau

SEQ ID NO: 237996 - RNA, 22 nt, Homo sapiens
auaauagcugaucauuuagaag

SEQ ID NO: 237997 - RNA, 22 nt, Homo sapiens
auugcacuccagccuggccgag

SEQ ID NO: 237998 - RNA, 21 nt, Homo sapiens
auugcacuccagccugggcga

SEQ ID NO: 237999 - RNA, 22 nt, Homo sapiens
auugcacuccagccugggugac

SEQ ID NO: 238000 - RNA, 22 nt, Homo sapiens
auugcacucuaaccuaggugac

SEQ ID NO: 238001 - RNA, 22 nt, Homo sapiens
auugcacucuagccugggugac

SEQ ID NO: 238002 - RNA, 22 nt, Homo sapiens
auugcacucugaucugcacucc

SEQ ID NO: 238003 - RNA, 22 nt, Homo sapiens
auugcacugcagccugggcaac

SEQ ID NO: 238004 - RNA, 22 nt, Homo sapiens
auugcagcccacccugggugau

SEQ ID NO: 238005 - RNA, 22 nt, Homo sapiens
auugcaguuucaacuccagggc

SEQ ID NO: 238006 - RNA, 22 nt, Homo sapiens
auugcauugugaucuucccaga

SEQ ID NO: 238007 - RNA, 23 nt, Homo sapiens
auugcccuugaaggcuaaacucu

SEQ ID NO: 238008 - RNA, 22 nt, Homo sapiens
auugcucagucagggagcucgg

SEQ ID NO: 238009 - RNA, 22 nt, Homo sapiens
auuggcaauggcaaagcagagu

SEQ ID NO: 238010 - RNA, 22 nt, Homo sapiens
auuggccaaugggacgucagca

SEQ ID NO: 238011 - RNA, 22 nt, Homo sapiens
auuggcuuuauacauaagaaua

SEQ ID NO: 238012 - RNA, 22 nt, Homo sapiens
auuguaauuuuagagaaagugg

SEQ ID NO: 238013 - RNA, 22 nt, Homo sapiens
auugucacccgggcaguaagca

SEQ ID NO: 238014 - RNA, 22 nt, Homo sapiens
auugucacugugcuccaccagu

SEQ ID NO: 238015 - RNA, 22 nt, Homo sapiens
auuguccuacuaggguuccagu

SEQ ID NO: 238016 - RNA, 22 nt, Homo sapiens
auugugauggucaaaggaaaua

SEQ ID NO: 238017 - RNA, 22 nt, Homo sapiens
auuguucuuguguccuuuuccu

SEQ ID NO: 238018 - RNA, 22 nt, Homo sapiens
auuuagcaauggagguagugua

SEQ ID NO: 238019 - RNA, 22 nt, Homo sapiens
auuucacugagacaugugccca

SEQ ID NO: 238020 - RNA, 19 nt, Homo sapiens
auuugaucaucaggcacag

SEQ ID NO: 238021 - RNA, 22 nt, Homo sapiens
auuugguuauucaguuguucag

SEQ ID NO: 238022 - RNA, 22 nt, Homo sapiens
auuugguugggugcgguggcuu

SEQ ID NO: 238023 - RNA, 22 nt, Homo sapiens
auuuuuggauauagggaaggau

SEQ ID NO: 238024 - RNA, 22 nt, Homo sapiens
auuuuugguugguaggcuauua

SEQ ID NO: 238025 - RNA, 22 nt, Homo sapiens
caaaggcuuccacugcauccuu

SEQ ID NO: 238026 - RNA, 22 nt, Homo sapiens
caaaggugcuuuccagguccaa

SEQ ID NO: 238027 - RNA, 22 nt, Homo sapiens
caaaguaauugcuguuuugcca

SEQ ID NO: 238028 - RNA, 22 nt, Homo sapiens
caaagugcugggaugggccagg

SEQ ID NO: 238029 - RNA, 22 nt, Homo sapiens
caaauccucaccucaucaugaa

SEQ ID NO: 238030 - RNA, 22 nt, Homo sapiens
caaaugcuucuauggacugucu

SEQ ID NO: 238031 - RNA, 22 nt, Homo sapiens
caaauugcuugucuguagugga

SEQ ID NO: 238032 - RNA, 22 nt, Homo sapiens
caaauugcuuguggaggauaau

SEQ ID NO: 238033 - RNA, 22 nt, Homo sapiens
caacagucagcccauccacaga

SEQ ID NO: 238034 - RNA, 22 nt, Homo sapiens
caagagagcugaugguuuuaaa

SEQ ID NO: 238035 - RNA, 22 nt, Homo sapiens
caaggcacagccccuacuuccu

SEQ ID NO: 238036 - RNA, 22 nt, Homo sapiens
caagugacugagccgccucggc

SEQ ID NO: 238037 - RNA, 22 nt, Homo sapiens
caagugcuacagagaaaucuuu

SEQ ID NO: 238038 - RNA, 22 nt, Homo sapiens
caaguguuggcuuguauacaaa

SEQ ID NO: 238039 - RNA, 23 nt, Homo sapiens
caauacugaccucacguuaauag

SEQ ID NO: 238040 - RNA, 22 nt, Homo sapiens
caauacuguguugaauaagagu

SEQ ID NO: 238041 - RNA, 22 nt, Homo sapiens
caauggcacgaucucgucucac

SEQ ID NO: 238042 - RNA, 22 nt, Homo sapiens
caaugguacuagauaucuucag

SEQ ID NO: 238043 - RNA, 22 nt, Homo sapiens
caaugugcuuggggcacaugag

SEQ ID NO: 238044 - RNA, 22 nt, Homo sapiens
cacaaaguagauuagucuucca

SEQ ID NO: 238045 - RNA, 22 nt, Homo sapiens
cacaaccuccgccuccuggguu

SEQ ID NO: 238046 - RNA, 22 nt, Homo sapiens
cacaaugucugguaggccacuu

SEQ ID NO: 238047 - RNA, 22 nt, Homo sapiens
cacacuguuuuccauggggguu

SEQ ID NO: 238048 - RNA, 22 nt, Homo sapiens
cacagagugagacccugucucu

SEQ ID NO: 238049 - RNA, 22 nt, Homo sapiens
cacaggaagaggcacggucccu

SEQ ID NO: 238050 - RNA, 22 nt, Homo sapiens
cacagugaacaauauccucugu

SEQ ID NO: 238051 - RNA, 22 nt, Homo sapiens
cacagugaaugucaucauugcc

SEQ ID NO: 238052 - RNA, 22 nt, Homo sapiens
cacaguguuacugguaugaagu

SEQ ID NO: 238053 - RNA, 22 nt, Homo sapiens
cacaguugccuaucuccugaag

SEQ ID NO: 238054 - RNA, 22 nt, Homo sapiens
cacauagcuagucaguagugaa

SEQ ID NO: 238055 - RNA, 21 nt, Homo sapiens
cacauggaggcagagagugua

SEQ ID NO: 238056 - RNA, 22 nt, Homo sapiens
cacauguuugcuacauuuuucu

SEQ ID NO: 238057 - RNA, 22 nt, Homo sapiens
caccacauuccauugaucaggc

SEQ ID NO: 238058 - RNA, 22 nt, Homo sapiens
caccagcuggcauugaauaccu

SEQ ID NO: 238059 - RNA, 22 nt, Homo sapiens
cacccaguaagcaugaggcccu

SEQ ID NO: 238060 - RNA, 22 nt, Homo sapiens
cacccagucaucuuggguuuuu

SEQ ID NO: 238061 - RNA, 22 nt, Homo sapiens
cacccuugcagggacagcuuug

SEQ ID NO: 238062 - RNA, 22 nt, Homo sapiens
caccgagguuggagugcagugg

SEQ ID NO: 238063 - RNA, 19 nt, Homo sapiens
caccgccugcccccugcug

SEQ ID NO: 238064 - RNA, 22 nt, Homo sapiens
caccuagacuggagugcagugg

SEQ ID NO: 238065 - RNA, 22 nt, Homo sapiens
cacugcacuccagcuuugguga

SEQ ID NO: 238066 - RNA, 22 nt, Homo sapiens
cacugcacuccagucugacgac

SEQ ID NO: 238067 - RNA, 22 nt, Homo sapiens
cacugcacuccaguuucgguaa

SEQ ID NO: 238068 - RNA, 21 nt, Homo sapiens
cacugcaucacaggacagcau

SEQ ID NO: 238069 - RNA, 22 nt, Homo sapiens
cacugcauccuccauauccugg

SEQ ID NO: 238070 - RNA, 22 nt, Homo sapiens
cacugcauggccacccauguua

SEQ ID NO: 238071 - RNA, 17 nt, Homo sapiens
cacugggugcaagagga

SEQ ID NO: 238072 - RNA, 22 nt, Homo sapiens
cacuggguuagaacaugcuccu

SEQ ID NO: 238073 - RNA, 22 nt, Homo sapiens
cagaaguauugguaugcucugu

SEQ ID NO: 238074 - RNA, 22 nt, Homo sapiens
cagagaaugucuuuuuuaacca

SEQ ID NO: 238075 - RNA, 22 nt, Homo sapiens
cagagaucaugcaacugcucgc

SEQ ID NO: 238076 - RNA, 20 nt, Homo sapiens
cagagcaaagcaguccuggc

SEQ ID NO: 238077 - RNA, 22 nt, Homo sapiens
cagagcaaugcuuuugcuuuga

SEQ ID NO: 238078 - RNA, 22 nt, Homo sapiens
cagagcacuaaagguaaaaggc

SEQ ID NO: 238079 - RNA, 22 nt, Homo sapiens
cagagcacugauacuggguucu

SEQ ID NO: 238080 - RNA, 22 nt, Homo sapiens
cagagugcauguuuagaugagu

SEQ ID NO: 238081 - RNA, 22 nt, Homo sapiens
cagauacuggaguccugaaguu

SEQ ID NO: 238082 - RNA, 22 nt, Homo sapiens
cagaugguggucccacagccca

SEQ ID NO: 238083 - RNA, 22 nt, Homo sapiens
cagcaaaucauccuauuugagc

SEQ ID NO: 238084 - RNA, 20 nt, Homo sapiens
cagcaaccugcucucuuccu

SEQ ID NO: 238085 - RNA, 22 nt, Homo sapiens
cagcacauagcaguugcucagu

SEQ ID NO: 238086 - RNA, 22 nt, Homo sapiens
cagcacauuacaaguacuuggu

SEQ ID NO: 238087 - RNA, 22 nt, Homo sapiens
cagcccguaaucccagcacuuu

SEQ ID NO: 238088 - RNA, 22 nt, Homo sapiens
cagccggguggcuccuagggua

SEQ ID NO: 238089 - RNA, 22 nt, Homo sapiens
cagcuguuguuccagucuuuua

SEQ ID NO: 238090 - RNA, 22 nt, Homo sapiens
caggaaugugaggguucccugc

SEQ ID NO: 238091 - RNA, 22 nt, Homo sapiens
caggcagucuggggguguaucc

SEQ ID NO: 238092 - RNA, 22 nt, Homo sapiens
caggguccccuaccuuuugaug

SEQ ID NO: 238093 - RNA, 22 nt, Homo sapiens
caggugaaugccucuccuucug

SEQ ID NO: 238094 - RNA, 22 nt, Homo sapiens
cagucacagugacaggaugugg

SEQ ID NO: 238095 - RNA, 22 nt, Homo sapiens
cagugauaggugguuguuggca

SEQ ID NO: 238096 - RNA, 22 nt, Homo sapiens
cagugcaaagccucugcccaga

SEQ ID NO: 238097 - RNA, 22 nt, Homo sapiens
cagugcaaccuccaucucucgg

SEQ ID NO: 238098 - RNA, 22 nt, Homo sapiens
cagugcauaggaucuaaaauuu

SEQ ID NO: 238099 - RNA, 22 nt, Homo sapiens
gaagcagcauucugguuuuugg

SEQ ID NO: 238100 - RNA, 22 nt, Homo sapiens
gaagguaguuuauagauguggu

SEQ ID NO: 238101 - RNA, 22 nt, Homo sapiens
gaaguaguaaaauuuauugcag

SEQ ID NO: 238102 - RNA, 22 nt, Homo sapiens
gaagugcaguggcacagucaug

SEQ ID NO: 238103 - RNA, 22 nt, Homo sapiens
gaaucacaguuauuagagcagc

SEQ ID NO: 238104 - RNA, 22 nt, Homo sapiens
gaaugcagcagugacagggcug

SEQ ID NO: 238105 - RNA, 22 nt, Homo sapiens
gaaugcuaccagcaucuagugg

SEQ ID NO: 238106 - RNA, 22 nt, Homo sapiens
gacaagagaacacugcuauauu

SEQ ID NO: 238107 - RNA, 22 nt, Homo sapiens
gacauguaaggcucucucuguu

SEQ ID NO: 238108 - RNA, 22 nt, Homo sapiens
gacauuaucagguuuguuuucu

SEQ ID NO: 238109 - RNA, 17 nt, Homo sapiens
gacgaucaucaggaggc

SEQ ID NO: 238110 - RNA, 22 nt, Homo sapiens
gacuagauauuguucuauguca

SEQ ID NO: 238111 - RNA, 18 nt, Homo sapiens
gacuccauuucagccaga

SEQ ID NO: 238112 - RNA, 22 nt, Homo sapiens
gacucgagggcauaagagcuuu

SEQ ID NO: 238113 - RNA, 22 nt, Homo sapiens
gacuggcuguuuucuuuauuau

SEQ ID NO: 238114 - RNA, 22 nt, Homo sapiens
gagaacagagauaauuuuacuu

SEQ ID NO: 238115 - RNA, 22 nt, Homo sapiens
gagaaccauuuggagaaaaagu

SEQ ID NO: 238116 - RNA, 22 nt, Homo sapiens
gagaacugacauuaucguguau

SEQ ID NO: 238117 - RNA, 22 nt, Homo sapiens
gagaacuggcgugaacugcacg

SEQ ID NO: 238118 - RNA, 22 nt, Homo sapiens
gagaagugcgucguuugaugau

SEQ ID NO: 238119 - RNA, 21 nt, Homo sapiens
gagaaucuuuucagggcaaac

SEQ ID NO: 238120 - RNA, 22 nt, Homo sapiens
gagaaugaacagacugccucuu

SEQ ID NO: 238121 - RNA, 22 nt, Homo sapiens
gagacauugacuuuguuccaga

SEQ ID NO: 238122 - RNA, 22 nt, Homo sapiens
gagacggagucucgcucugucg

SEQ ID NO: 238123 - RNA, 22 nt, Homo sapiens
gagacggagucuugcucuguug

SEQ ID NO: 238124 - RNA, 22 nt, Homo sapiens
gagagucacagugaauguggca

SEQ ID NO: 238125 - RNA, 22 nt, Homo sapiens
gagagugugucagaggcugcga

SEQ ID NO: 238126 - RNA, 22 nt, Homo sapiens
gagaugaaaucuugcucuguca

SEQ ID NO: 238127 - RNA, 22 nt, Homo sapiens
gagauggagucuuuuucuguca

SEQ ID NO: 238128 - RNA, 22 nt, Homo sapiens
gagauguaagaauuuauuuguu

SEQ ID NO: 238129 - RNA, 22 nt, Homo sapiens
gagauguagucuugcccuguca

SEQ ID NO: 238130 - RNA, 22 nt, Homo sapiens
gagauguuuguuucacugucac

SEQ ID NO: 238131 - RNA, 22 nt, Homo sapiens
gagauuaauacacaucaaaugc

SEQ ID NO: 238132 - RNA, 22 nt, Homo sapiens
gagauucuucaauauuuauucu

SEQ ID NO: 238133 - RNA, 22 nt, Homo sapiens
gagcaucaauggcaugugggaa

SEQ ID NO: 238134 - RNA, 22 nt, Homo sapiens
gagcuaguguaauauuuugggg

SEQ ID NO: 238135 - RNA, 22 nt, Homo sapiens
gagcuccuccccuuggcuuuca

SEQ ID NO: 238136 - RNA, 22 nt, Homo sapiens
gagcugaaguuuccauuuguac

SEQ ID NO: 238137 - RNA, 22 nt, Homo sapiens
gagcuguugguuugaaagaauu

SEQ ID NO: 238138 - RNA, 22 nt, Homo sapiens
gaggacauuaugcuaaguggaa

SEQ ID NO: 238139 - RNA, 22 nt, Homo sapiens
gaggagauauucugcuggaugg

SEQ ID NO: 238140 - RNA, 22 nt, Homo sapiens
gaggagucagacugugcaaggu

SEQ ID NO: 238141 - RNA, 22 nt, Homo sapiens
gaggcagucugacccuuagcag

SEQ ID NO: 238142 - RNA, 22 nt, Homo sapiens
gaggcagucuguccauucucag

SEQ ID NO: 238143 - RNA, 22 nt, Homo sapiens
gaggcaguguguccguucucgg

SEQ ID NO: 238144 - RNA, 22 nt, Homo sapiens
gagggcacugcuuuccuuucaa

SEQ ID NO: 238145 - RNA, 22 nt, Homo sapiens
gagguaagagaauaaacaguuu

SEQ ID NO: 238146 - RNA, 21 nt, Homo sapiens
gagguaccucauguaagugga

SEQ ID NO: 238147 - RNA, 17 nt, Homo sapiens
gagguaguuuacuuuca

SEQ ID NO: 238148 - RNA, 22 nt, Homo sapiens
gaggucaugucgggccccagga

SEQ ID NO: 238149 - RNA, 22 nt, Homo sapiens
gaggucauguggcaggcagcca

SEQ ID NO: 238150 - RNA, 22 nt, Homo sapiens
gaggucauucugugguacccag

SEQ ID NO: 238151 - RNA, 22 nt, Homo sapiens
gaggugauaucucauugugguu

SEQ ID NO: 238152 - RNA, 22 nt, Homo sapiens
gaggugguagguucacagcagc

SEQ ID NO: 238153 - RNA, 22 nt, Homo sapiens
gaguaaaugucacuguugcugu

SEQ ID NO: 238154 - RNA, 22 nt, Homo sapiens
gaguaacauugacaacuucaug

SEQ ID NO: 238155 - RNA, 22 nt, Homo sapiens
gaguagaacugguuaucuaaua

SEQ ID NO: 238156 - RNA, 22 nt, Homo sapiens
gaguauguauaugagugugucu

SEQ ID NO: 238157 - RNA, 22 nt, Homo sapiens
gagugcaaagguccugaggugg

SEQ ID NO: 238158 - RNA, 21 nt, Homo sapiens
gagugcaaauaaagagagggc

SEQ ID NO: 238159 - RNA, 22 nt, Homo sapiens
gagugcaagguuuuucugagug

SEQ ID NO: 238160 - RNA, 22 nt, Homo sapiens
gagugcaauggcaagaucuugg

SEQ ID NO: 238161 - RNA, 22 nt, Homo sapiens
gagugcaauggcaugaucuugg

SEQ ID NO: 238162 - RNA, 22 nt, Homo sapiens
gagugcaauggcgcgaucuggg

SEQ ID NO: 238163 - RNA, 21 nt, Homo sapiens
gaguggcuuuuguuucaccag

SEQ ID NO: 238164 - RNA, 22 nt, Homo sapiens
gaguuacauuguaauugccgag

SEQ ID NO: 238165 - RNA, 22 nt, Homo sapiens
gaguuccuuugagccugagagg

SEQ ID NO: 238166 - RNA, 22 nt, Homo sapiens
gauaaaucuuggcuagucuaag

SEQ ID NO: 238167 - RNA, 22 nt, Homo sapiens
gauacuguauccuaaaagcuuu

SEQ ID NO: 238168 - RNA, 22 nt, Homo sapiens
gauaugucuauuagcuugauug

SEQ ID NO: 238169 - RNA, 22 nt, Homo sapiens
gauauguucuuucacguuggug

SEQ ID NO: 238170 - RNA, 19 nt, Homo sapiens
gauauguugagcacccuuu

SEQ ID NO: 238171 - RNA, 22 nt, Homo sapiens
gaucacaugggagaaugagagu

SEQ ID NO: 238172 - RNA, 22 nt, Homo sapiens
gaucacauuguuucauacauau

SEQ ID NO: 238173 - RNA, 22 nt, Homo sapiens
gaucucaguggauacugugaug

SEQ ID NO: 238174 - RNA, 22 nt, Homo sapiens
gaugagauguucucauggauug

SEQ ID NO: 238175 - RNA, 22 nt, Homo sapiens
gaugagguaguguaccuagucu

SEQ ID NO: 238176 - RNA, 22 nt, Homo sapiens
gauggaauuaaaaucagaauca

SEQ ID NO: 238177 - RNA, 22 nt, Homo sapiens
gauggcacuaagccauguagga

SEQ ID NO: 238178 - RNA, 22 nt, Homo sapiens
gauggcacuuaagagcaagagc

SEQ ID NO: 238179 - RNA, 22 nt, Homo sapiens
gauggcagugcagccccuggcu

SEQ ID NO: 238180 - RNA, 22 nt, Homo sapiens
gaugguuuuucuccgauuuaua

SEQ ID NO: 238181 - RNA, 22 nt, Homo sapiens
gauguguuuguuucuggaggag

SEQ ID NO: 238182 - RNA, 22 nt, Homo sapiens
gauuucaucuuuagaggaagga

SEQ ID NO: 238183 - RNA, 22 nt, Homo sapiens
gcaaaaaguagugcugguuagg

SEQ ID NO: 238184 - RNA, 20 nt, Homo sapiens
gcaaauggaucccacaagcc

SEQ ID NO: 238185 - RNA, 20 nt, Homo sapiens
gcaacauggccagagugaau

SEQ ID NO: 238186 - RNA, 22 nt, Homo sapiens
gcaauacugacagcauuaguuu

SEQ ID NO: 238187 - RNA, 22 nt, Homo sapiens
gcaauguuacugaauguguuuu

SEQ ID NO: 238188 - RNA, 22 nt, Homo sapiens
gcacacuuacacgaaccuagau

SEQ ID NO: 238189 - RNA, 22 nt, Homo sapiens
gcacauggccccaucgugccga

SEQ ID NO: 238190 - RNA, 22 nt, Homo sapiens
gcaccacugcacucucagcuug

SEQ ID NO: 238191 - RNA, 22 nt, Homo sapiens
gcacugagagaagccccaagua

SEQ ID NO: 238192 - RNA, 22 nt, Homo sapiens
gcagaauugacucuguuuuuuc

SEQ ID NO: 238193 - RNA, 22 nt, Homo sapiens
gcagcacaugacuguauguaua

SEQ ID NO: 238194 - RNA, 22 nt, Homo sapiens
gcaggaaucuugagaaggauuc

SEQ ID NO: 238195 - RNA, 22 nt, Homo sapiens
gcaggaauuucucugcagaccc

SEQ ID NO: 238196 - RNA, 22 nt, Homo sapiens
gcaggauuggagccucucugaa

SEQ ID NO: 238197 - RNA, 17 nt, Homo sapiens
gcaguacuuaguaagga

SEQ ID NO: 238198 - RNA, 22 nt, Homo sapiens
gcaguagugcgaucucagcuca

SEQ ID NO: 238199 - RNA, 22 nt, Homo sapiens
gcaguauuguugaaauguccau

SEQ ID NO: 238200 - RNA, 20 nt, Homo sapiens
gcaguguucugaccugaauc

SEQ ID NO: 238201 - RNA, 22 nt, Homo sapiens
cuugaauguaaauaauguacag

SEQ ID NO: 238202 - RNA, 23 nt, Homo sapiens
cuugagacaaaugcgugugugca

SEQ ID NO: 238203 - RNA, 22 nt, Homo sapiens
cuugcacauuacagaucugcau

SEQ ID NO: 238204 - RNA, 22 nt, Homo sapiens
cuugcacuccacuguucuccug

SEQ ID NO: 238205 - RNA, 22 nt, Homo sapiens
cuuggcauugccccuggaauuu

SEQ ID NO: 238206 - RNA, 22 nt, Homo sapiens
cuuguuguggaggggagugcag

SEQ ID NO: 238207 - RNA, 22 nt, Homo sapiens
cuuucucagugagacccgagau

SEQ ID NO: 238208 - RNA, 22 nt, Homo sapiens
cuuugaugagaaaauacuuugu

SEQ ID NO: 238209 - RNA, 22 nt, Homo sapiens
cuuugcaaauggccuuuccaag

SEQ ID NO: 238210 - RNA, 22 nt, Homo sapiens
cuuugcuaauccaacccucauc

SEQ ID NO: 238211 - RNA, 22 nt, Homo sapiens
cuuuggguauucucccuugggg

SEQ ID NO: 238212 - RNA, 22 nt, Homo sapiens
cuuuggucaaaauaaguaaguu

SEQ ID NO: 238213 - RNA, 22 nt, Homo sapiens
cuuuggucaauugcugugggga

SEQ ID NO: 238214 - RNA, 23 nt, Homo sapiens
cuuuguacagcuugacuacuggg

SEQ ID NO: 238215 - RNA, 22 nt, Homo sapiens
cuuuguguggacauuucaggca

SEQ ID NO: 238216 - RNA, 22 nt, Homo sapiens
cuuuuacacugcuggugggaau

SEQ ID NO: 238217 - RNA, 22 nt, Homo sapiens
cuuuuacacuguuagugggaau

SEQ ID NO: 238218 - RNA, 21 nt, Homo sapiens
cuuuuuacucguucauaugca

SEQ ID NO: 238219 - RNA, 22 nt, Homo sapiens
gaaaacugcuucucuggguuuc

SEQ ID NO: 238220 - RNA, 18 nt, Homo sapiens
gaaaugccucuugcuuac

SEQ ID NO: 238221 - RNA, 22 nt, Homo sapiens
gaaauguauuaaugaguugaaa

SEQ ID NO: 238222 - RNA, 22 nt, Homo sapiens
gaaaugucugagauguggcuca

SEQ ID NO: 238223 - RNA, 23 nt, Homo sapiens
gaaaugucuuagugaaauugcuu

SEQ ID NO: 238224 - RNA, 22 nt, Homo sapiens
gaacacaucuuugguuagagga

SEQ ID NO: 238225 - RNA, 22 nt, Homo sapiens
gaaccagcagacuuugacaggu

SEQ ID NO: 238226 - RNA, 22 nt, Homo sapiens
gaagaacuaggugagaucuaga

SEQ ID NO: 238227 - RNA, 22 nt, Homo sapiens
gaagacauuuacaugggagacc

SEQ ID NO: 238228 - RNA, 22 nt, Homo sapiens
gaagcauugauccacaggcgug

SEQ ID NO: 238229 - RNA, 22 nt, Homo sapiens
gaaggagcuuaucugccauuuc

SEQ ID NO: 238230 - RNA, 22 nt, Homo sapiens
gaaguaggugcuguuauuaucu

SEQ ID NO: 238231 - RNA, 22 nt, Homo sapiens
gaaucacugugguaucccaugc

SEQ ID NO: 238232 - RNA, 22 nt, Homo sapiens
gaaucauuguuucuaaguuugu

SEQ ID NO: 238233 - RNA, 22 nt, Homo sapiens
gaaugcaugaggggaucagaug

SEQ ID NO: 238234 - RNA, 22 nt, Homo sapiens
gaauucugucgcuuacuagaug

SEQ ID NO: 238235 - RNA, 22 nt, Homo sapiens
gaauuguacugcaaucagggga

SEQ ID NO: 238236 - RNA, 22 nt, Homo sapiens
gacacuggguguuuguuggcgu

SEQ ID NO: 238237 - RNA, 22 nt, Homo sapiens
gacagacacaauugauccauga

SEQ ID NO: 238238 - RNA, 22 nt, Homo sapiens
gacagugagaugucaugugaaa

SEQ ID NO: 238239 - RNA, 18 nt, Homo sapiens
gacaguguggcgauuccu

SEQ ID NO: 238240 - RNA, 22 nt, Homo sapiens
gacauagcuagauaaccucaug

SEQ ID NO: 238241 - RNA, 22 nt, Homo sapiens
gacauguuuucaagauuuauaa

SEQ ID NO: 238242 - RNA, 20 nt, Homo sapiens
gacauguuuuguggccuaac

SEQ ID NO: 238243 - RNA, 21 nt, Homo sapiens
gaccacagcagggaaugucag

SEQ ID NO: 238244 - RNA, 19 nt, Homo sapiens
gacuccagaguugugugcu

SEQ ID NO: 238245 - RNA, 22 nt, Homo sapiens
gacugcauuugccccaucgaau

SEQ ID NO: 238246 - RNA, 16 nt, Homo sapiens
gacugggcugaggaau

SEQ ID NO: 238247 - RNA, 22 nt, Homo sapiens
gacuucaucauacuaugugugg

SEQ ID NO: 238248 - RNA, 22 nt, Homo sapiens
gagaacaguguuguauuuuuuc

SEQ ID NO: 238249 - RNA, 22 nt, Homo sapiens
gagaacuaaugauguacuaggc

SEQ ID NO: 238250 - RNA, 22 nt, Homo sapiens
gagaaguaaauuuauuugcaaa

SEQ ID NO: 238251 - RNA, 21 nt, Homo sapiens
gagaaucaucauggcugcaua

SEQ ID NO: 238252 - RNA, 22 nt, Homo sapiens
gagaaugaugauuuccaauuuc

SEQ ID NO: 238253 - RNA, 22 nt, Homo sapiens
gagacauguuugcuuaucugag

SEQ ID NO: 238254 - RNA, 22 nt, Homo sapiens
gagacggagucacgcccuguca

SEQ ID NO: 238255 - RNA, 19 nt, Homo sapiens
uuguccccucuaaaucuca

SEQ ID NO: 238256 - RNA, 22 nt, Homo sapiens
uugucuugcagcuuaggcauca

SEQ ID NO: 238257 - RNA, 22 nt, Homo sapiens
uugugaaaaaccucucguggaa

SEQ ID NO: 238258 - RNA, 22 nt, Homo sapiens
uugugaagaaaccagaaaaguu

SEQ ID NO: 238259 - RNA, 22 nt, Homo sapiens
uugugaaugaugccgcaauaaa

SEQ ID NO: 238260 - RNA, 22 nt, Homo sapiens
uugugaauggugccacaauaaa

SEQ ID NO: 238261 - RNA, 22 nt, Homo sapiens
uugugaauggugccgcaguaaa

SEQ ID NO: 238262 - RNA, 22 nt, Homo sapiens
uugugaauggugccucaguaaa

SEQ ID NO: 238263 - RNA, 22 nt, Homo sapiens
uugugaauggugcugcaguaaa

SEQ ID NO: 238264 - RNA, 22 nt, Homo sapiens
uugugagggagcuaagaugagu

SEQ ID NO: 238265 - RNA, 22 nt, Homo sapiens
uugugaucuucagaaaguggcu

SEQ ID NO: 238266 - RNA, 22 nt, Homo sapiens
uugugcaaaguugugguuucug

SEQ ID NO: 238267 - RNA, 22 nt, Homo sapiens
uugugcauaucagagguuugcu

SEQ ID NO: 238268 - RNA, 22 nt, Homo sapiens
uugugccacugaagcccuccag

SEQ ID NO: 238269 - RNA, 22 nt, Homo sapiens
uugugcuuaauaaaaaguggua

SEQ ID NO: 238270 - RNA, 22 nt, Homo sapiens
uugugcuuaaugaguguaaggu

SEQ ID NO: 238271 - RNA, 22 nt, Homo sapiens
uugugcuucaucaccuagcaga

SEQ ID NO: 238272 - RNA, 22 nt, Homo sapiens
uugugcuuuuuaaauagcuucc

SEQ ID NO: 238273 - RNA, 22 nt, Homo sapiens
uugugguuuuaucuaccuuugg

SEQ ID NO: 238274 - RNA, 22 nt, Homo sapiens
uugugucaaauggcaauuagca

SEQ ID NO: 238275 - RNA, 19 nt, Homo sapiens
uuguguccccacaaaauuc

SEQ ID NO: 238276 - RNA, 22 nt, Homo sapiens
uuguguccccacccaaaucuca

SEQ ID NO: 238277 - RNA, 22 nt, Homo sapiens
uuguuaugggguggcuugaaag

SEQ ID NO: 238278 - RNA, 22 nt, Homo sapiens
uuguuauguuggucaguaaugu

SEQ ID NO: 238279 - RNA, 22 nt, Homo sapiens
uuguuuagagacuggaauuaaa

SEQ ID NO: 238280 - RNA, 22 nt, Homo sapiens
uuguuuuggagaugagcuaaaa

SEQ ID NO: 238281 - RNA, 22 nt, Homo sapiens
uuuaaagcuaaaauauguuuau

SEQ ID NO: 238282 - RNA, 22 nt, Homo sapiens
uuuaacauuggaugagaucguc

SEQ ID NO: 238283 - RNA, 22 nt, Homo sapiens
uuuaagguauguggugaaaauu

SEQ ID NO: 238284 - RNA, 22 nt, Homo sapiens
uuuaauacugcaucuuuacucu

SEQ ID NO: 238285 - RNA, 18 nt, Homo sapiens
uuuacaguagaaggacuu

SEQ ID NO: 238286 - RNA, 22 nt, Homo sapiens
uuuacagucuuuugugugaguc

SEQ ID NO: 238287 - RNA, 22 nt, Homo sapiens
uuuagcaaugcuguggggaagu

SEQ ID NO: 238288 - RNA, 22 nt, Homo sapiens
uuuagcaauucauuuugugucu

SEQ ID NO: 238289 - RNA, 22 nt, Homo sapiens
uuuaggcaugcaguucuauuua

SEQ ID NO: 238290 - RNA, 22 nt, Homo sapiens
uuuagggcaggccuggugguga

SEQ ID NO: 238291 - RNA, 22 nt, Homo sapiens
uuuauagucaggaacuugagga

SEQ ID NO: 238292 - RNA, 22 nt, Homo sapiens
uuuaucuguuuaaaacuguuca

SEQ ID NO: 238293 - RNA, 22 nt, Homo sapiens
uuuaugguuuucugggagauug

SEQ ID NO: 238294 - RNA, 22 nt, Homo sapiens
uuuauguggagcacuugacaca

SEQ ID NO: 238295 - RNA, 22 nt, Homo sapiens
uuucaacaggucuggggugguc

SEQ ID NO: 238296 - RNA, 22 nt, Homo sapiens
uuucaagugcugucuuagcugu

SEQ ID NO: 238297 - RNA, 23 nt, Homo sapiens
uuucacagaaggauuguagggcc

SEQ ID NO: 238298 - RNA, 22 nt, Homo sapiens
uuucacagcugucuuccgucuc

SEQ ID NO: 238299 - RNA, 22 nt, Homo sapiens
uuucacaguguucucccccaga

SEQ ID NO: 238300 - RNA, 22 nt, Homo sapiens
uuucacuagccagcccuuuauu

SEQ ID NO: 238301 - RNA, 22 nt, Homo sapiens
uuucauggcgaggcuucauggg

SEQ ID NO: 238302 - RNA, 22 nt, Homo sapiens
uuuccaagaugcuuacuuucuc

SEQ ID NO: 238303 - RNA, 22 nt, Homo sapiens
gaguuguuuuaaggcacugacu

SEQ ID NO: 238304 - RNA, 22 nt, Homo sapiens
gaguuuguacuaauuuguugua

SEQ ID NO: 238305 - RNA, 22 nt, Homo sapiens
gauaaagauagcaauagggaca

SEQ ID NO: 238306 - RNA, 22 nt, Homo sapiens
gauaaauccagauucugaugua

SEQ ID NO: 238307 - RNA, 22 nt, Homo sapiens
gauaauucuagcagauacaggc

SEQ ID NO: 238308 - RNA, 22 nt, Homo sapiens
gauacaguaugcaugugguauu

SEQ ID NO: 238309 - RNA, 21 nt, Homo sapiens
gauaucuuuauucccaagagc

SEQ ID NO: 238310 - RNA, 22 nt, Homo sapiens
gauauguuagggggagaaguua

SEQ ID NO: 238311 - RNA, 22 nt, Homo sapiens
gauauguugaguagaguuuuug

SEQ ID NO: 238312 - RNA, 22 nt, Homo sapiens
gauauguuguuggauucgguua

SEQ ID NO: 238313 - RNA, 22 nt, Homo sapiens
gauauguuucuucaauaccuag

SEQ ID NO: 238314 - RNA, 22 nt, Homo sapiens
gauauuacuuccaauauugcaa

SEQ ID NO: 238315 - RNA, 22 nt, Homo sapiens
gaucuguuguuuggaaguauca

SEQ ID NO: 238316 - RNA, 22 nt, Homo sapiens
gaugagcuaaguucucacagca

SEQ ID NO: 238317 - RNA, 22 nt, Homo sapiens
gaugagguagaagacucagcaa

SEQ ID NO: 238318 - RNA, 22 nt, Homo sapiens
gaugauauuugagucauuagaa

SEQ ID NO: 238319 - RNA, 22 nt, Homo sapiens
gaugcaguaagaaugcauagcg

SEQ ID NO: 238320 - RNA, 22 nt, Homo sapiens
gauggaguugucgccugggcug

SEQ ID NO: 238321 - RNA, 22 nt, Homo sapiens
gauggcaucugagaguguuaga

SEQ ID NO: 238322 - RNA, 22 nt, Homo sapiens
gauggcauuucuggaucugccc

SEQ ID NO: 238323 - RNA, 22 nt, Homo sapiens
gauuccauugcgaauuuucaga

SEQ ID NO: 238324 - RNA, 22 nt, Homo sapiens
gauuuugguuagggaaggauac

SEQ ID NO: 238325 - RNA, 22 nt, Homo sapiens
gcaaagaaugcagauuugccuc

SEQ ID NO: 238326 - RNA, 22 nt, Homo sapiens
gcaaaucuuauguccucacauu

SEQ ID NO: 238327 - RNA, 22 nt, Homo sapiens
gcaagaaugagaaggauuaauu

SEQ ID NO: 238328 - RNA, 22 nt, Homo sapiens
gcaagacaugucuaagguuuaa

SEQ ID NO: 238329 - RNA, 22 nt, Homo sapiens
gcaagaguauuucaaggaagau

SEQ ID NO: 238330 - RNA, 20 nt, Homo sapiens
gcaagcaugaagaguagaga

SEQ ID NO: 238331 - RNA, 22 nt, Homo sapiens
gcaaggacucccugggucauuc

SEQ ID NO: 238332 - RNA, 22 nt, Homo sapiens
gcaauggaaucccuugaucaau

SEQ ID NO: 238333 - RNA, 22 nt, Homo sapiens
gcacaggguuacauucuaaggu

SEQ ID NO: 238334 - RNA, 22 nt, Homo sapiens
gcacaguggcucccgucuauaa

SEQ ID NO: 238335 - RNA, 22 nt, Homo sapiens
gcacauuacaaguauuagcuca

SEQ ID NO: 238336 - RNA, 22 nt, Homo sapiens
gcaccccuuaccgggcuggguu

SEQ ID NO: 238337 - RNA, 22 nt, Homo sapiens
gcacgugcacccacaugcacgu

SEQ ID NO: 238338 - RNA, 22 nt, Homo sapiens
gcagguguuaugcaaacaacug

SEQ ID NO: 238339 - RNA, 20 nt, Homo sapiens
gcaguacuuuuaguucuaag

SEQ ID NO: 238340 - RNA, 22 nt, Homo sapiens
gcaguagugugaucuuggcuca

SEQ ID NO: 238341 - RNA, 23 nt, Homo sapiens
gcagucauuuggaaaagguugaa

SEQ ID NO: 238342 - RNA, 22 nt, Homo sapiens
gcauauuuuaaaguguaaccug

SEQ ID NO: 238343 - RNA, 22 nt, Homo sapiens
gcauggagaaggggacugauuc

SEQ ID NO: 238344 - RNA, 22 nt, Homo sapiens
gcauggagcauacauuucuguu

SEQ ID NO: 238345 - RNA, 22 nt, Homo sapiens
gcauugcacuuggcauagacug

SEQ ID NO: 238346 - RNA, 22 nt, Homo sapiens
gccaacauggcgcuccauucuu

SEQ ID NO: 238347 - RNA, 22 nt, Homo sapiens
gccauugcacuccagccuagcg

SEQ ID NO: 238348 - RNA, 22 nt, Homo sapiens
gccauugcacuccagccuaggu

SEQ ID NO: 238349 - RNA, 22 nt, Homo sapiens
gccauugcacuccgcccugggc

SEQ ID NO: 238350 - RNA, 22 nt, Homo sapiens
gcccaguagcaguacaucccuu

SEQ ID NO: 238351 - RNA, 22 nt, Homo sapiens
gccccaguacaggcuccuuaga

SEQ ID NO: 238352 - RNA, 22 nt, Homo sapiens
gccccgggugaugcagccguca

SEQ ID NO: 238353 - RNA, 22 nt, Homo sapiens
gcccuguguuuggguaugguca

SEQ ID NO: 238354 - RNA, 22 nt, Homo sapiens
gccuagagaaguaaauauuauc

SEQ ID NO: 238355 - RNA, 22 nt, Homo sapiens
gccuagauccaaauauggugca

SEQ ID NO: 238356 - RNA, 22 nt, Homo sapiens
uucuugcacuuggcccucauua

SEQ ID NO: 238357 - RNA, 22 nt, Homo sapiens
uucuugcugaauugugcccuuc

SEQ ID NO: 238358 - RNA, 22 nt, Homo sapiens
uucuuugcaugaucucaaaguc

SEQ ID NO: 238359 - RNA, 21 nt, Homo sapiens
uucuuugcucaguguuagagu

SEQ ID NO: 238360 - RNA, 22 nt, Homo sapiens
uugaaagacagaggggcaaguu

SEQ ID NO: 238361 - RNA, 22 nt, Homo sapiens
uugaaagucuaggcuuacagua

SEQ ID NO: 238362 - RNA, 22 nt, Homo sapiens
uugaaggaacgcuguucccuug

SEQ ID NO: 238363 - RNA, 22 nt, Homo sapiens
uugaaguaugaccgcugagaau

SEQ ID NO: 238364 - RNA, 18 nt, Homo sapiens
uugaauagagccaagcac

SEQ ID NO: 238365 - RNA, 22 nt, Homo sapiens
uugaaugaaaugaugucauuug

SEQ ID NO: 238366 - RNA, 22 nt, Homo sapiens
uugacacuaauuauuauaggug

SEQ ID NO: 238367 - RNA, 22 nt, Homo sapiens
uugacaguggcuuaaauugguu

SEQ ID NO: 238368 - RNA, 22 nt, Homo sapiens
uugacuucagagcugauucaag

SEQ ID NO: 238369 - RNA, 21 nt, Homo sapiens
uugagacggagucucacucug

SEQ ID NO: 238370 - RNA, 22 nt, Homo sapiens
uugagacggagucuugcucuuu

SEQ ID NO: 238371 - RNA, 22 nt, Homo sapiens
uugagaguggcagagguggaac

SEQ ID NO: 238372 - RNA, 22 nt, Homo sapiens
uugagauacauaauuaugaaug

SEQ ID NO: 238373 - RNA, 22 nt, Homo sapiens
uugagauggagccucacucugc

SEQ ID NO: 238374 - RNA, 22 nt, Homo sapiens
uugagauggagcuucacucuug

SEQ ID NO: 238375 - RNA, 22 nt, Homo sapiens
uugagauggagucucacgcauu

SEQ ID NO: 238376 - RNA, 22 nt, Homo sapiens
uugagauggagucucacucuuc

SEQ ID NO: 238377 - RNA, 22 nt, Homo sapiens
uugagauggagucucacugugu

SEQ ID NO: 238378 - RNA, 22 nt, Homo sapiens
uugagauggagucucgcucuuu

SEQ ID NO: 238379 - RNA, 22 nt, Homo sapiens
uugagauggagucucguucugu

SEQ ID NO: 238380 - RNA, 22 nt, Homo sapiens
uugagauggagucuugcucucu

SEQ ID NO: 238381 - RNA, 22 nt, Homo sapiens
uugagauggagucuugcucuug

SEQ ID NO: 238382 - RNA, 22 nt, Homo sapiens
uugagauggaguguugcucugu

SEQ ID NO: 238383 - RNA, 22 nt, Homo sapiens
uugagauggaguuucacucugu

SEQ ID NO: 238384 - RNA, 22 nt, Homo sapiens
uugagauggugccacuguacuc

SEQ ID NO: 238385 - RNA, 22 nt, Homo sapiens
uugagauguauguauauaaugu

SEQ ID NO: 238386 - RNA, 22 nt, Homo sapiens
uugagcaauccuccugccaugu

SEQ ID NO: 238387 - RNA, 22 nt, Homo sapiens
uugagcuccucucaaccuaagg

SEQ ID NO: 238388 - RNA, 22 nt, Homo sapiens
uugaggaggcagucuucccauu

SEQ ID NO: 238389 - RNA, 22 nt, Homo sapiens
uugaggucagagguucgagacc

SEQ ID NO: 238390 - RNA, 22 nt, Homo sapiens
uugaggugaauuugcaggaugc

SEQ ID NO: 238391 - RNA, 22 nt, Homo sapiens
uugagguggugucuugcucugu

SEQ ID NO: 238392 - RNA, 22 nt, Homo sapiens
uugaguagauaccuaggaauag

SEQ ID NO: 238393 - RNA, 22 nt, Homo sapiens
uugagugaaugaaugauuaaau

SEQ ID NO: 238394 - RNA, 22 nt, Homo sapiens
uugauaagaaaaauauaccaga

SEQ ID NO: 238395 - RNA, 22 nt, Homo sapiens
uugauagacacauauccaugug

SEQ ID NO: 238396 - RNA, 22 nt, Homo sapiens
uugauauggcugcuuaccauaa

SEQ ID NO: 238397 - RNA, 22 nt, Homo sapiens
uugauauucugagaagcugaag

SEQ ID NO: 238398 - RNA, 22 nt, Homo sapiens
uugaucaaaucugagugagaau

SEQ ID NO: 238399 - RNA, 22 nt, Homo sapiens
uugaugauguuucugccuugcc

SEQ ID NO: 238400 - RNA, 22 nt, Homo sapiens
uugauguugaggacauaaaccu

SEQ ID NO: 238401 - RNA, 20 nt, Homo sapiens
uugauucccucuaaacucgc

SEQ ID NO: 238402 - RNA, 22 nt, Homo sapiens
cuacaguagagaggauguagaa

SEQ ID NO: 238403 - RNA, 22 nt, Homo sapiens
cuacugacacuacugcaaucau

SEQ ID NO: 238404 - RNA, 22 nt, Homo sapiens
cuacugcacaucaucugaguua

SEQ ID NO: 238405 - RNA, 22 nt, Homo sapiens
cuagaacuagaacugcuggggu

SEQ ID NO: 238406 - RNA, 22 nt, Homo sapiens
cuagaagcauauucagaacaga

SEQ ID NO: 238407 - RNA, 22 nt, Homo sapiens
cuagaagguaagagcuggaugc

SEQ ID NO: 238408 - RNA, 22 nt, Homo sapiens
cuagcacauaguuauucacuca

SEQ ID NO: 238409 - RNA, 22 nt, Homo sapiens
cuagcagcaugagaauggacca

SEQ ID NO: 238410 - RNA, 22 nt, Homo sapiens
cuauggugauagaaaucagaau

SEQ ID NO: 238411 - RNA, 22 nt, Homo sapiens
cuaugguuucucaaacuccuga

SEQ ID NO: 238412 - RNA, 22 nt, Homo sapiens
cuaugucuuucauauuuugggg

SEQ ID NO: 238413 - RNA, 19 nt, Homo sapiens
cuauugcacauagcugaag

SEQ ID NO: 238414 - RNA, 22 nt, Homo sapiens
cucaaagugcugggauuggcca

SEQ ID NO: 238415 - RNA, 22 nt, Homo sapiens
cucacaaccuuaugaagcauga

SEQ ID NO: 238416 - RNA, 18 nt, Homo sapiens
cucacacccuaaucagga

SEQ ID NO: 238417 - RNA, 18 nt, Homo sapiens
cucacaguaacuuuuaag

SEQ ID NO: 238418 - RNA, 22 nt, Homo sapiens
cucacagucagaagggacuugc

SEQ ID NO: 238419 - RNA, 22 nt, Homo sapiens
cucaccuugugauccuccugcc

SEQ ID NO: 238420 - RNA, 22 nt, Homo sapiens
cucacuaguaaggcuguuuagu

SEQ ID NO: 238421 - RNA, 22 nt, Homo sapiens
cucagggugguggacucuaaua

SEQ ID NO: 238422 - RNA, 22 nt, Homo sapiens
cucagucuaugauacuuugcua

SEQ ID NO: 238423 - RNA, 22 nt, Homo sapiens
cucaguggauuagauaaugcac

SEQ ID NO: 238424 - RNA, 22 nt, Homo sapiens
cucaguguucccauucuaccuu

SEQ ID NO: 238425 - RNA, 21 nt, Homo sapiens
cucauauugcuuuuccauggu

SEQ ID NO: 238426 - RNA, 22 nt, Homo sapiens
cucaugcugucuucugggguaa

SEQ ID NO: 238427 - RNA, 22 nt, Homo sapiens
cucauugcaaucuccaccuccc

SEQ ID NO: 238428 - RNA, 22 nt, Homo sapiens
cucccugagccagggcuuugac

SEQ ID NO: 238429 - RNA, 20 nt, Homo sapiens
cuccuucauuccuuuggacc

SEQ ID NO: 238430 - RNA, 20 nt, Homo sapiens
cucuaguaauaaaguuuccc

SEQ ID NO: 238431 - RNA, 22 nt, Homo sapiens
cucucugagccccagacaccuu

SEQ ID NO: 238432 - RNA, 21 nt, Homo sapiens
cucucugcuuaugaauaguga

SEQ ID NO: 238433 - RNA, 22 nt, Homo sapiens
cucucuguuugucuguuauugg

SEQ ID NO: 238434 - RNA, 22 nt, Homo sapiens
cucugacagugguuagcacugu

SEQ ID NO: 238435 - RNA, 22 nt, Homo sapiens
cucugauggagauauacaagga

SEQ ID NO: 238436 - RNA, 22 nt, Homo sapiens
cucugguuucgcaggaaauaga

SEQ ID NO: 238437 - RNA, 22 nt, Homo sapiens
cucuuugaggugagcugcccau

SEQ ID NO: 238438 - RNA, 22 nt, Homo sapiens
cucuuugaugugaaccgugguu

SEQ ID NO: 238439 - RNA, 22 nt, Homo sapiens
cucuuuuguuuagcugagaggg

SEQ ID NO: 238440 - RNA, 22 nt, Homo sapiens
cugaaagagcauguaacacagu

SEQ ID NO: 238441 - RNA, 22 nt, Homo sapiens
cugaagugugaaagucuuuuuu

SEQ ID NO: 238442 - RNA, 22 nt, Homo sapiens
cugaauguucuauagaagccgc

SEQ ID NO: 238443 - RNA, 22 nt, Homo sapiens
cugacauggggauccaccuuag

SEQ ID NO: 238444 - RNA, 22 nt, Homo sapiens
cugacauuguugaucacagcca

SEQ ID NO: 238445 - RNA, 22 nt, Homo sapiens
cugacugaggaucaguucauca

SEQ ID NO: 238446 - RNA, 22 nt, Homo sapiens
cugacuuauguggacuauuuca

SEQ ID NO: 238447 - RNA, 22 nt, Homo sapiens
cugagaacaucauucagauauu

SEQ ID NO: 238448 - RNA, 22 nt, Homo sapiens
cugagaagaaacagguaaggac

SEQ ID NO: 238449 - RNA, 22 nt, Homo sapiens
cugagacacucuuaucugcaua

SEQ ID NO: 238450 - RNA, 22 nt, Homo sapiens
cugagauaauuucuagguguca

SEQ ID NO: 238451 - RNA, 22 nt, Homo sapiens
cugagcaaaaugaagacacgau

SEQ ID NO: 238452 - RNA, 22 nt, Homo sapiens
cugagcacugagauccucuagc

SEQ ID NO: 238453 - RNA, 22 nt, Homo sapiens
cugaggguagaaggaucacuug

SEQ ID NO: 238454 - RNA, 22 nt, Homo sapiens
cugagguaggcccugagaauau

SEQ ID NO: 238455 - RNA, 22 nt, Homo sapiens
cugagguauaucccauuagaag

SEQ ID NO: 238456 - RNA, 22 nt, Homo sapiens
cugaggucugaauccagguauc

SEQ ID NO: 238457 - RNA, 22 nt, Homo sapiens
aaaggcacacacuccuuguuau

SEQ ID NO: 238458 - RNA, 19 nt, Homo sapiens
aaaguacucugaugccucu

SEQ ID NO: 238459 - RNA, 22 nt, Homo sapiens
aaaguacugggauuggccgggu

SEQ ID NO: 238460 - RNA, 20 nt, Homo sapiens
aaaguaggcuaauaccaaaa

SEQ ID NO: 238461 - RNA, 22 nt, Homo sapiens
aaagucacuggagaaggaauau

SEQ ID NO: 238462 - RNA, 22 nt, Homo sapiens
aaagucuguuuugucagagacu

SEQ ID NO: 238463 - RNA, 18 nt, Homo sapiens
aaagugaugucauucuuu

SEQ ID NO: 238464 - RNA, 22 nt, Homo sapiens
aaagugcaguacuucguauauu

SEQ ID NO: 238465 - RNA, 22 nt, Homo sapiens
aaagugccugacucauaguuag

SEQ ID NO: 238466 - RNA, 22 nt, Homo sapiens
aaagugcuaggauuaccugggg

SEQ ID NO: 238467 - RNA, 22 nt, Homo sapiens
aaagugcugagacagacuggga

SEQ ID NO: 238468 - RNA, 22 nt, Homo sapiens
aaagugcugagauuguaggcau

SEQ ID NO: 238469 - RNA, 22 nt, Homo sapiens
aaagugcugggaucacacugaa

SEQ ID NO: 238470 - RNA, 22 nt, Homo sapiens
aaagugcugggauuaggccagg

SEQ ID NO: 238471 - RNA, 22 nt, Homo sapiens
aaagugcugggauuuuaggcau

SEQ ID NO: 238472 - RNA, 22 nt, Homo sapiens
aaagugcuuccuuuuugagggu

SEQ ID NO: 238473 - RNA, 22 nt, Homo sapiens
aaaucccuugcucucucagacc

SEQ ID NO: 238474 - RNA, 22 nt, Homo sapiens
aaaugcacagaaaggaugugga

SEQ ID NO: 238475 - RNA, 22 nt, Homo sapiens
aaaugcagucuuuguucugggc

SEQ ID NO: 238476 - RNA, 22 nt, Homo sapiens
aaaugcaucauuaggugauuuu

SEQ ID NO: 238477 - RNA, 22 nt, Homo sapiens
aaaugcauggacagcuggucuu

SEQ ID NO: 238478 - RNA, 22 nt, Homo sapiens
aaaugcucuguggguaguaaug

SEQ ID NO: 238479 - RNA, 22 nt, Homo sapiens
aaaugcucuuuaugaaguugga

SEQ ID NO: 238480 - RNA, 20 nt, Homo sapiens
aaaugcuguaauguuuggga

SEQ ID NO: 238481 - RNA, 22 nt, Homo sapiens
aaaugcugucaaauuguguucu

SEQ ID NO: 238482 - RNA, 22 nt, Homo sapiens
aaaugcugucugugagccucau

SEQ ID NO: 238483 - RNA, 22 nt, Homo sapiens
aaaugcuucuauguggcauguu

SEQ ID NO: 238484 - RNA, 22 nt, Homo sapiens
aaauggcacaguaagggcauuu

SEQ ID NO: 238485 - RNA, 22 nt, Homo sapiens
aaauggcaccggcucuucccuc

SEQ ID NO: 238486 - RNA, 22 nt, Homo sapiens
aaaugggacugggguccuuuga

SEQ ID NO: 238487 - RNA, 22 nt, Homo sapiens
aaauucaucaaaugguuuguau

SEQ ID NO: 238488 - RNA, 22 nt, Homo sapiens
aaauucauuucagcucugggua

SEQ ID NO: 238489 - RNA, 22 nt, Homo sapiens
aaauugcaaugcgaggcagagg

SEQ ID NO: 238490 - RNA, 22 nt, Homo sapiens
aacaccguagaaacacaaggga

SEQ ID NO: 238491 - RNA, 22 nt, Homo sapiens
aacaccuugcagggauuaugac

SEQ ID NO: 238492 - RNA, 22 nt, Homo sapiens
aacagacugucacauaaaauug

SEQ ID NO: 238493 - RNA, 22 nt, Homo sapiens
aacagauugcugagccccaccc

SEQ ID NO: 238494 - RNA, 22 nt, Homo sapiens
aacaggcuccuaggggugcacc

SEQ ID NO: 238495 - RNA, 22 nt, Homo sapiens
aacagucuccaguuguauccau

SEQ ID NO: 238496 - RNA, 21 nt, Homo sapiens
aacagugcuuaguagauguuc

SEQ ID NO: 238497 - RNA, 22 nt, Homo sapiens
aacagugcuucauucacacauu

SEQ ID NO: 238498 - RNA, 22 nt, Homo sapiens
aacauagucaugggguaauguu

SEQ ID NO: 238499 - RNA, 22 nt, Homo sapiens
aaccacauggcucaguggacau

SEQ ID NO: 238500 - RNA, 22 nt, Homo sapiens
aacuccauuuuagacccuagau

SEQ ID NO: 238501 - RNA, 22 nt, Homo sapiens
aacuggcauaugaacuuguucu

SEQ ID NO: 238502 - RNA, 22 nt, Homo sapiens
aacuggccuggcgugcagaggg

SEQ ID NO: 238503 - RNA, 22 nt, Homo sapiens
aacugggcaagcauuacauggu

SEQ ID NO: 238504 - RNA, 22 nt, Homo sapiens
aacuggugauccacccgccuca

SEQ ID NO: 238505 - RNA, 19 nt, Homo sapiens
aacuggugugagaugguau

SEQ ID NO: 238506 - RNA, 21 nt, Homo sapiens
aacuggugugagaugguaugu

SEQ ID NO: 238507 - RNA, 22 nt, Homo sapiens
aagagcgcugauaacauguuug

SEQ ID NO: 238508 - RNA, 20 nt, Homo sapiens
aagagcucaccagaauaucu

SEQ ID NO: 238509 - RNA, 18 nt, Homo sapiens
aagagcucagcacagguu

SEQ ID NO: 238510 - RNA, 22 nt, Homo sapiens
aagaugauguuguguuuucacu

SEQ ID NO: 238511 - RNA, 22 nt, Homo sapiens
aagcagacauguucauuuugaa

SEQ ID NO: 238512 - RNA, 22 nt, Homo sapiens
aagcagauguguugaaaguacu

SEQ ID NO: 238513 - RNA, 22 nt, Homo sapiens
aagcaggugucugugucuguaa

SEQ ID NO: 238514 - RNA, 22 nt, Homo sapiens
aagccacuguaccugucucuua

SEQ ID NO: 238515 - RNA, 22 nt, Homo sapiens
aagcuaguguuccagugaacag

SEQ ID NO: 238516 - RNA, 22 nt, Homo sapiens
aagcuccauuucugccaugaga

SEQ ID NO: 238517 - RNA, 20 nt, Homo sapiens
aagcugaguguuuuuuuaau

SEQ ID NO: 238518 - RNA, 22 nt, Homo sapiens
aagcuggauuuaguguggagca

SEQ ID NO: 238519 - RNA, 22 nt, Homo sapiens
aagcugugucuugucagcuacc

SEQ ID NO: 238520 - RNA, 22 nt, Homo sapiens
aagcuguugguggauguaccau

SEQ ID NO: 238521 - RNA, 22 nt, Homo sapiens
aagcuuucaacuguuugccauu

SEQ ID NO: 238522 - RNA, 22 nt, Homo sapiens
aaggaagcuagcaggaauuggu

SEQ ID NO: 238523 - RNA, 23 nt, Homo sapiens
aaggacacugaacacuucccagc

SEQ ID NO: 238524 - RNA, 22 nt, Homo sapiens
ucagauacuggugacaugaaug

SEQ ID NO: 238525 - RNA, 22 nt, Homo sapiens
ucagaugaugucccuguucuaa

SEQ ID NO: 238526 - RNA, 22 nt, Homo sapiens
ucagauguuucuuuaacgcaug

SEQ ID NO: 238527 - RNA, 22 nt, Homo sapiens
ucagauguuugagaaguauacu

SEQ ID NO: 238528 - RNA, 19 nt, Homo sapiens
ucagcaguaaucaacuuca

SEQ ID NO: 238529 - RNA, 20 nt, Homo sapiens
ucagcagucuggagcagagg

SEQ ID NO: 238530 - RNA, 22 nt, Homo sapiens
ucagcaucacaggcagugagug

SEQ ID NO: 238531 - RNA, 22 nt, Homo sapiens
ucagggacgcuugacacaagcc

SEQ ID NO: 238532 - RNA, 22 nt, Homo sapiens
ucagggacuuacaaaccagaag

SEQ ID NO: 238533 - RNA, 22 nt, Homo sapiens
ucagguaaucuauuugucuuuu

SEQ ID NO: 238534 - RNA, 23 nt, Homo sapiens
ucagguaguuucagaggaccuug

SEQ ID NO: 238535 - RNA, 22 nt, Homo sapiens
ucagguaucuuuauagcgaugc

SEQ ID NO: 238536 - RNA, 22 nt, Homo sapiens
ucaggugcaguggcucugaccu

SEQ ID NO: 238537 - RNA, 22 nt, Homo sapiens
ucaguaaaugcuguucucuuuu

SEQ ID NO: 238538 - RNA, 22 nt, Homo sapiens
ucaguaguaaauggauuuggaa

SEQ ID NO: 238539 - RNA, 22 nt, Homo sapiens
ucagucauugauggaguagguc

SEQ ID NO: 238540 - RNA, 22 nt, Homo sapiens
ucagugaauguuggccacuacu

SEQ ID NO: 238541 - RNA, 22 nt, Homo sapiens
ucagugccauugccauaugagu

SEQ ID NO: 238542 - RNA, 22 nt, Homo sapiens
ucagugcuguaccaucuaagga

SEQ ID NO: 238543 - RNA, 22 nt, Homo sapiens
ucagugcuuuuuguugucauca

SEQ ID NO: 238544 - RNA, 22 nt, Homo sapiens
ucaguggacuuagucuuucccc

SEQ ID NO: 238545 - RNA, 21 nt, Homo sapiens
ucauaagcucaacaucuguag

SEQ ID NO: 238546 - RNA, 20 nt, Homo sapiens
ucauacuguggaguaccagg

SEQ ID NO: 238547 - RNA, 19 nt, Homo sapiens
ucauagucuaagaugagaa

SEQ ID NO: 238548 - RNA, 22 nt, Homo sapiens
ucauaugucauaguaugaucuu

SEQ ID NO: 238549 - RNA, 23 nt, Homo sapiens
ucaucacagcauuuccugguauu

SEQ ID NO: 238550 - RNA, 22 nt, Homo sapiens
ucaucaggaaacuuaugcagug

SEQ ID NO: 238551 - RNA, 22 nt, Homo sapiens
ucaucagguaugucagcggagu

SEQ ID NO: 238552 - RNA, 22 nt, Homo sapiens
ucaucaguuuuuuauaugugau

SEQ ID NO: 238553 - RNA, 22 nt, Homo sapiens
ucaugaaguaguuaacugguug

SEQ ID NO: 238554 - RNA, 23 nt, Homo sapiens
ucaugaggccauucaaauccauu

SEQ ID NO: 238555 - RNA, 19 nt, Homo sapiens
ucauggcuuuuucagcugu

SEQ ID NO: 238556 - RNA, 22 nt, Homo sapiens
ucaugggagcccccaucaugag

SEQ ID NO: 238557 - RNA, 22 nt, Homo sapiens
ucauggggugcuuugcuagauu

SEQ ID NO: 238558 - RNA, 22 nt, Homo sapiens
ucauggguuuugguccaagcaa

SEQ ID NO: 238559 - RNA, 22 nt, Homo sapiens
ucauguaauuuugugucuauga

SEQ ID NO: 238560 - RNA, 19 nt, Homo sapiens
ucaugugcauacauuuggg

SEQ ID NO: 238561 - RNA, 22 nt, Homo sapiens
ucauucacucccuugaaguuag

SEQ ID NO: 238562 - RNA, 22 nt, Homo sapiens
ucauugcaaucucugccucccg

SEQ ID NO: 238563 - RNA, 22 nt, Homo sapiens
ucauugcacuucuuuaguugca

SEQ ID NO: 238564 - RNA, 22 nt, Homo sapiens
uccaauguaaucaucauugaau

SEQ ID NO: 238565 - RNA, 18 nt, Homo sapiens
uccacgugcuuuccagau

SEQ ID NO: 238566 - RNA, 22 nt, Homo sapiens
uccacugagcuagaccacuugg

SEQ ID NO: 238567 - RNA, 22 nt, Homo sapiens
uccagguuuugugaguuuaaau

SEQ ID NO: 238568 - RNA, 22 nt, Homo sapiens
uccaguacaggucucucauuuc

SEQ ID NO: 238569 - RNA, 22 nt, Homo sapiens
uccagugcauucagacacuugg

SEQ ID NO: 238570 - RNA, 22 nt, Homo sapiens
uccauagacauuuuaagguagu

SEQ ID NO: 238571 - RNA, 22 nt, Homo sapiens
uccauaguacuagaaacugacc

SEQ ID NO: 238572 - RNA, 22 nt, Homo sapiens
uccaugaggcuacaguaaucuc

SEQ ID NO: 238573 - RNA, 22 nt, Homo sapiens
uccauggagacacauuuuauau

SEQ ID NO: 238574 - RNA, 22 nt, Homo sapiens
uccauuuguagguagugagaca

SEQ ID NO: 238575 - RNA, 22 nt, Homo sapiens
ucccaagaugagaugggggcug

SEQ ID NO: 238576 - RNA, 19 nt, Homo sapiens
ucccaagaugcucauacau

SEQ ID NO: 238577 - RNA, 22 nt, Homo sapiens
ucccaguauucauuuacagaag

SEQ ID NO: 238578 - RNA, 22 nt, Homo sapiens
ucccagugaaaccccaccuuca

SEQ ID NO: 238579 - RNA, 22 nt, Homo sapiens
ucccuagacuccugccuuucag

SEQ ID NO: 238580 - RNA, 22 nt, Homo sapiens
ucccugagcaaaguuuucugua

SEQ ID NO: 238581 - RNA, 22 nt, Homo sapiens
ucccuggacagccuugccuggg

SEQ ID NO: 238582 - RNA, 19 nt, Homo sapiens
ucccuguagaccacagugc

SEQ ID NO: 238583 - RNA, 22 nt, Homo sapiens
ucccuguguuccuuuugaauug

SEQ ID NO: 238584 - RNA, 21 nt, Homo sapiens
uccugagagaggaguaacucu

SEQ ID NO: 238585 - RNA, 22 nt, Homo sapiens
uccuucacucuacaucuuuguu

SEQ ID NO: 238586 - RNA, 22 nt, Homo sapiens
uccuugaaacaggaagaauuca

SEQ ID NO: 238587 - RNA, 22 nt, Homo sapiens
uccuugagccucccagacucag

SEQ ID NO: 238588 - RNA, 21 nt, Homo sapiens
uccuuggugaugcccugcagu

SEQ ID NO: 238589 - RNA, 22 nt, Homo sapiens
uccuuugguuauaggcaccucu

SEQ ID NO: 238590 - RNA, 18 nt, Homo sapiens
uccuuuugggguaggaga

SEQ ID NO: 238591 - RNA, 22 nt, Homo sapiens
ucgcaccauugcacuccagcca

SEQ ID NO: 238592 - RNA, 22 nt, Homo sapiens
ucgcauuucccucuguagcuuc

SEQ ID NO: 238593 - RNA, 22 nt, Homo sapiens
ucgugccacugcacuccagccu

SEQ ID NO: 238594 - RNA, 22 nt, Homo sapiens
ucguggccugugaguccucccc

SEQ ID NO: 238595 - RNA, 22 nt, Homo sapiens
ucuaguaaugagaggcaggaga

SEQ ID NO: 238596 - RNA, 22 nt, Homo sapiens
ucuauggaguuugaaugagaaa

SEQ ID NO: 238597 - RNA, 22 nt, Homo sapiens
ucuauggauaaaaugcccucau

SEQ ID NO: 238598 - RNA, 22 nt, Homo sapiens
ucuauuugggguaccuguggua

SEQ ID NO: 238599 - RNA, 22 nt, Homo sapiens
ucucaaccuccacacuacaaua

SEQ ID NO: 238600 - RNA, 22 nt, Homo sapiens
ucucaaguaacugggacaauaa

SEQ ID NO: 238601 - RNA, 22 nt, Homo sapiens
ucucaauggguuguagacaaag

SEQ ID NO: 238602 - RNA, 22 nt, Homo sapiens
ucucagugaaauaaauuauuuu

SEQ ID NO: 238603 - RNA, 22 nt, Homo sapiens
ucucagugacugcugggucccc

SEQ ID NO: 238604 - RNA, 22 nt, Homo sapiens
ucucaguguuaucuaucugccu

SEQ ID NO: 238605 - RNA, 19 nt, Homo sapiens
ucucaguguuggucaggug

SEQ ID NO: 238606 - RNA, 22 nt, Homo sapiens
ucucaguuuucuggggaagaaa

SEQ ID NO: 238607 - RNA, 22 nt, Homo sapiens
ucuccauugaaauggacauaau

SEQ ID NO: 238608 - RNA, 22 nt, Homo sapiens
ucuccauuguccagaugaggaa

SEQ ID NO: 238609 - RNA, 20 nt, Homo sapiens
ucucccaaacagcaggcccu

SEQ ID NO: 238610 - RNA, 17 nt, Homo sapiens
ucucccaucccuuucuc

SEQ ID NO: 238611 - RNA, 22 nt, Homo sapiens
ucuccggguggcggcgaaggga

SEQ ID NO: 238612 - RNA, 21 nt, Homo sapiens
ucucucaaccaggaagugggc

SEQ ID NO: 238613 - RNA, 22 nt, Homo sapiens
ucucugaaacucuugacauccu

SEQ ID NO: 238614 - RNA, 22 nt, Homo sapiens
ucucugagaaaaguuucuccca

SEQ ID NO: 238615 - RNA, 22 nt, Homo sapiens
ucucugagaccacuccaaacuc

SEQ ID NO: 238616 - RNA, 22 nt, Homo sapiens
ucucugguuaugucauuaagca

SEQ ID NO: 238617 - RNA, 22 nt, Homo sapiens
ucucugguuuucaaagcaguau

SEQ ID NO: 238618 - RNA, 22 nt, Homo sapiens
ucucuguuuagagccagcaauu

SEQ ID NO: 238619 - RNA, 22 nt, Homo sapiens
ucucuuggcggaaguugcagug

SEQ ID NO: 238620 - RNA, 22 nt, Homo sapiens
ucucuugguugaacaguuugga

SEQ ID NO: 238621 - RNA, 22 nt, Homo sapiens
ucugacucugugaugggcccaa

SEQ ID NO: 238622 - RNA, 22 nt, Homo sapiens
ucugagaugagacuuugaauuu

SEQ ID NO: 238623 - RNA, 22 nt, Homo sapiens
ucugagcaauaaacaacauauu

SEQ ID NO: 238624 - RNA, 22 nt, Homo sapiens
ucugagcaugcaucuugccugg

SEQ ID NO: 238625 - RNA, 22 nt, Homo sapiens
ucugccacugucauugugugau

SEQ ID NO: 238626 - RNA, 22 nt, Homo sapiens
aaggagcuaagagaucauacau

SEQ ID NO: 238627 - RNA, 22 nt, Homo sapiens
aaggagcuuaagugacuuguac

SEQ ID NO: 238628 - RNA, 22 nt, Homo sapiens
aaggaguagaauagaugcaccu

SEQ ID NO: 238629 - RNA, 22 nt, Homo sapiens
aaggcaagaagagaaccaucgg

SEQ ID NO: 238630 - RNA, 22 nt, Homo sapiens
aaggcaagguggauaaugaagc

SEQ ID NO: 238631 - RNA, 22 nt, Homo sapiens
aaggcauucucaaacuaguucu

SEQ ID NO: 238632 - RNA, 22 nt, Homo sapiens
aaggcucuuucaacguaaauua

SEQ ID NO: 238633 - RNA, 22 nt, Homo sapiens
aaggcuguuguguaauaggauu

SEQ ID NO: 238634 - RNA, 20 nt, Homo sapiens
aaggcuuucgaguuccaggg

SEQ ID NO: 238635 - RNA, 22 nt, Homo sapiens
aagggaaugcgcugccuguguu

SEQ ID NO: 238636 - RNA, 22 nt, Homo sapiens
aagguacuggaaagaggaaugg

SEQ ID NO: 238637 - RNA, 21 nt, Homo sapiens
aaggugguggugauugagaug

SEQ ID NO: 238638 - RNA, 21 nt, Homo sapiens
aagguuuuuagugcuugacuu

SEQ ID NO: 238639 - RNA, 22 nt, Homo sapiens
aaguaauggaguuauuuuauga

SEQ ID NO: 238640 - RNA, 22 nt, Homo sapiens
aaguauuaagacuaagaggcuu

SEQ ID NO: 238641 - RNA, 22 nt, Homo sapiens
aagucacugagacuuguggcug

SEQ ID NO: 238642 - RNA, 22 nt, Homo sapiens
aagucauggaggaguaugugag

SEQ ID NO: 238643 - RNA, 19 nt, Homo sapiens
aagugaaugcuuuguucac

SEQ ID NO: 238644 - RNA, 22 nt, Homo sapiens
aagugaaugugcuggaauagcu

SEQ ID NO: 238645 - RNA, 22 nt, Homo sapiens
aagugauguuauugggugacuc

SEQ ID NO: 238646 - RNA, 22 nt, Homo sapiens
aagugcucuugaaacugccuua

SEQ ID NO: 238647 - RNA, 22 nt, Homo sapiens
aagugcucuugaaacugucuua

SEQ ID NO: 238648 - RNA, 22 nt, Homo sapiens
aagugcugggauuggccgggca

SEQ ID NO: 238649 - RNA, 22 nt, Homo sapiens
aagugcuguaugggagccuagg

SEQ ID NO: 238650 - RNA, 22 nt, Homo sapiens
aagugguagggucaggauugga

SEQ ID NO: 238651 - RNA, 22 nt, Homo sapiens
aagugguucuaugaguuugcaa

SEQ ID NO: 238652 - RNA, 19 nt, Homo sapiens
aagugguuuaaacuuguau

SEQ ID NO: 238653 - RNA, 22 nt, Homo sapiens
aaguguaaguuaauguuuaggu

SEQ ID NO: 238654 - RNA, 22 nt, Homo sapiens
aagugucagaguugcuaaugac

SEQ ID NO: 238655 - RNA, 22 nt, Homo sapiens
aaguuguaguuagagaguugcu

SEQ ID NO: 238656 - RNA, 22 nt, Homo sapiens
aauaaagcauggcuacuccaua

SEQ ID NO: 238657 - RNA, 22 nt, Homo sapiens
aauaaagccugucucuuuagag

SEQ ID NO: 238658 - RNA, 22 nt, Homo sapiens
aauacucaguccuggugaggcu

SEQ ID NO: 238659 - RNA, 21 nt, Homo sapiens
aauacucuagguuaagagagc

SEQ ID NO: 238660 - RNA, 22 nt, Homo sapiens
aauacugaaaguauuuucaaau

SEQ ID NO: 238661 - RNA, 22 nt, Homo sapiens
aauacugcuuugauguaagcua

SEQ ID NO: 238662 - RNA, 22 nt, Homo sapiens
aauacuuccaaaucuagucauu

SEQ ID NO: 238663 - RNA, 22 nt, Homo sapiens
aauaugucugcuaauuguuucu

SEQ ID NO: 238664 - RNA, 22 nt, Homo sapiens
aauaugucuugaaauuggguaa

SEQ ID NO: 238665 - RNA, 22 nt, Homo sapiens
aaucacacuugauguugagcaa

SEQ ID NO: 238666 - RNA, 22 nt, Homo sapiens
aaucagagcccucugagcuuca

SEQ ID NO: 238667 - RNA, 17 nt, Homo sapiens
aaucagauuucugagga

SEQ ID NO: 238668 - RNA, 22 nt, Homo sapiens
aaucagcacacugugcuuucca

SEQ ID NO: 238669 - RNA, 22 nt, Homo sapiens
aaucccuuuguccagucucuuu

SEQ ID NO: 238670 - RNA, 22 nt, Homo sapiens
aaucucagcauuuugggcugag

SEQ ID NO: 238671 - RNA, 22 nt, Homo sapiens
aaugacacugagcaucuuucau

SEQ ID NO: 238672 - RNA, 22 nt, Homo sapiens
aaugaucaauguuugaggugau

SEQ ID NO: 238673 - RNA, 22 nt, Homo sapiens
aaugcacauauauuuccuuauu

SEQ ID NO: 238674 - RNA, 22 nt, Homo sapiens
aaugccuagugugugacaggug

SEQ ID NO: 238675 - RNA, 22 nt, Homo sapiens
aaugcuaucuggaacauuguug

SEQ ID NO: 238676 - RNA, 22 nt, Homo sapiens
aauggcaaauguuuucuguuga

SEQ ID NO: 238677 - RNA, 22 nt, Homo sapiens
aauggcacuuuauaaauguuaa

SEQ ID NO: 238678 - RNA, 22 nt, Homo sapiens
aauggcauugguccuuuuggau

SEQ ID NO: 238679 - RNA, 22 nt, Homo sapiens
aauggcucuuuaggcaauagau

SEQ ID NO: 238680 - RNA, 22 nt, Homo sapiens
aaugguuuuaucagcguccaaa

SEQ ID NO: 238681 - RNA, 22 nt, Homo sapiens
aaugugcacuuggagccuugcu

SEQ ID NO: 238682 - RNA, 22 nt, Homo sapiens
aaugugcuguucagaggagucc

SEQ ID NO: 238683 - RNA, 22 nt, Homo sapiens
aauuacucgugucuuuacugcu

SEQ ID NO: 238684 - RNA, 22 nt, Homo sapiens
acaaaguaggcagugggcugga

SEQ ID NO: 238685 - RNA, 22 nt, Homo sapiens
acaagugcuuuuccuggagaca

SEQ ID NO: 238686 - RNA, 22 nt, Homo sapiens
acacaguaaauauguauugaau

SEQ ID NO: 238687 - RNA, 22 nt, Homo sapiens
acacaguguuuauugugguuag

SEQ ID NO: 238688 - RNA, 22 nt, Homo sapiens
acaccaucuccuuauuucucuu

SEQ ID NO: 238689 - RNA, 22 nt, Homo sapiens
acacgggugccggcaucagcac

SEQ ID NO: 238690 - RNA, 22 nt, Homo sapiens
acacuggguaacauaucuguua

SEQ ID NO: 238691 - RNA, 22 nt, Homo sapiens
acacugucaugucucacaggca

SEQ ID NO: 238692 - RNA, 22 nt, Homo sapiens
acacuuucuagacaagggaaua

SEQ ID NO: 238693 - RNA, 22 nt, Homo sapiens
acagaacugggcuugcuuuugg

SEQ ID NO: 238694 - RNA, 22 nt, Homo sapiens
acagauagacauauauagcuca

SEQ ID NO: 238695 - RNA, 22 nt, Homo sapiens
acagcacugccaagugacccau

SEQ ID NO: 238696 - RNA, 20 nt, Homo sapiens
acagcacugguuucaagcaa

SEQ ID NO: 238697 - RNA, 19 nt, Homo sapiens
acagcugguuuugguuucu

SEQ ID NO: 238698 - RNA, 22 nt, Homo sapiens
acaguaaugggccccuuuuccu

SEQ ID NO: 238699 - RNA, 20 nt, Homo sapiens
acaguauguuuggaugcaua

SEQ ID NO: 238700 - RNA, 22 nt, Homo sapiens
acagucacaauuuguaccuuuu

SEQ ID NO: 238701 - RNA, 22 nt, Homo sapiens
acagugcuguggucaugggucu

SEQ ID NO: 238702 - RNA, 22 nt, Homo sapiens
acagugcuuucaauguucagua

SEQ ID NO: 238703 - RNA, 22 nt, Homo sapiens
acaguggugcgaucucggcuca

SEQ ID NO: 238704 - RNA, 17 nt, Homo sapiens
acagugucuaugaaaug

SEQ ID NO: 238705 - RNA, 22 nt, Homo sapiens
acauagaguaguggugaggaug

SEQ ID NO: 238706 - RNA, 22 nt, Homo sapiens
acauaguagacacugaaaauau

SEQ ID NO: 238707 - RNA, 21 nt, Homo sapiens
acaucagaguugugaagguag

SEQ ID NO: 238708 - RNA, 18 nt, Homo sapiens
acaucccaugcuggggug

SEQ ID NO: 238709 - RNA, 22 nt, Homo sapiens
acaucccuugcucggggccccu

SEQ ID NO: 238710 - RNA, 22 nt, Homo sapiens
acaugccucccugguccgcugu

SEQ ID NO: 238711 - RNA, 22 nt, Homo sapiens
acauggcuuaugaauuuggaga

SEQ ID NO: 238712 - RNA, 22 nt, Homo sapiens
acaugguacugauuuacgaaau

SEQ ID NO: 238713 - RNA, 22 nt, Homo sapiens
acauguauauaaugcauagcga

SEQ ID NO: 238714 - RNA, 22 nt, Homo sapiens
accauugcacuccaaccugggc

SEQ ID NO: 238715 - RNA, 22 nt, Homo sapiens
acccaguguucaacauucacau

SEQ ID NO: 238716 - RNA, 21 nt, Homo sapiens
acccccacaccuccuuaguuc

SEQ ID NO: 238717 - RNA, 23 nt, Homo sapiens
accccuacaggcuuguguccugc

SEQ ID NO: 238718 - RNA, 22 nt, Homo sapiens
accccugagaucgaaucaugcu

SEQ ID NO: 238719 - RNA, 22 nt, Homo sapiens
acccucaagggacugacagaau

SEQ ID NO: 238720 - RNA, 22 nt, Homo sapiens
acccuggauucguggccuugaa

SEQ ID NO: 238721 - RNA, 22 nt, Homo sapiens
acccugguagcuaugaagucuu

SEQ ID NO: 238722 - RNA, 22 nt, Homo sapiens
acccuuuagguuggaugaggau

SEQ ID NO: 238723 - RNA, 22 nt, Homo sapiens
accugagauuacaggugcuggc

SEQ ID NO: 238724 - RNA, 22 nt, Homo sapiens
accugcacagccgaacauagac

SEQ ID NO: 238725 - RNA, 23 nt, Homo sapiens
accugugguuauuuuacucuucc

SEQ ID NO: 238726 - RNA, 22 nt, Homo sapiens
acgugcaugcacacacaugcgc

SEQ ID NO: 238727 - RNA, 22 nt, Homo sapiens
acuacaugugaugucaguauau

SEQ ID NO: 238728 - RNA, 22 nt, Homo sapiens
ucuggagugugaaguggauaug

SEQ ID NO: 238729 - RNA, 23 nt, Homo sapiens
ucuggaucauucguagugccagc

SEQ ID NO: 238730 - RNA, 22 nt, Homo sapiens
ucuggcaagagccgagggcagu

SEQ ID NO: 238731 - RNA, 21 nt, Homo sapiens
ucuggccccuccaaaucucau

SEQ ID NO: 238732 - RNA, 18 nt, Homo sapiens
ucuggcuucuuuguucca

SEQ ID NO: 238733 - RNA, 22 nt, Homo sapiens
ucuggcuugugaacugucuucu

SEQ ID NO: 238734 - RNA, 23 nt, Homo sapiens
ucuggcuuugggaugcucaaggg

SEQ ID NO: 238735 - RNA, 22 nt, Homo sapiens
ucuggcuuuuaacaucuauaaa

SEQ ID NO: 238736 - RNA, 23 nt, Homo sapiens
ucugguguugucaaaugcugguu

SEQ ID NO: 238737 - RNA, 22 nt, Homo sapiens
ucugguuccuuggcuucggguc

SEQ ID NO: 238738 - RNA, 22 nt, Homo sapiens
ucuguaguuaacagcuucagcu

SEQ ID NO: 238739 - RNA, 22 nt, Homo sapiens
ucugucaaaucuuauguuguag

SEQ ID NO: 238740 - RNA, 22 nt, Homo sapiens
ucugucacugguggacgaucac

SEQ ID NO: 238741 - RNA, 22 nt, Homo sapiens
ucugucuuguccucacccuaga

SEQ ID NO: 238742 - RNA, 22 nt, Homo sapiens
ucugucuuugucaggaccagag

SEQ ID NO: 238743 - RNA, 19 nt, Homo sapiens
ucugugcuugucccccugu

SEQ ID NO: 238744 - RNA, 22 nt, Homo sapiens
ucugugguaagaaacgcauguc

SEQ ID NO: 238745 - RNA, 22 nt, Homo sapiens
ucuguggucagcauccgccacu

SEQ ID NO: 238746 - RNA, 22 nt, Homo sapiens
ucuguugguucuuugaggagga

SEQ ID NO: 238747 - RNA, 22 nt, Homo sapiens
ucuguuguuguuuuaagagaca

SEQ ID NO: 238748 - RNA, 22 nt, Homo sapiens
ucuuagugcggcugcugcagcc

SEQ ID NO: 238749 - RNA, 22 nt, Homo sapiens
ucuuauuuggggaaaggguccu

SEQ ID NO: 238750 - RNA, 22 nt, Homo sapiens
ucuugcacaaauuauuuuaacu

SEQ ID NO: 238751 - RNA, 22 nt, Homo sapiens
ucuugccacuucauccccuuuc

SEQ ID NO: 238752 - RNA, 22 nt, Homo sapiens
ucuugcuuguuguucccuucau

SEQ ID NO: 238753 - RNA, 20 nt, Homo sapiens
ucuugggaauguagccuagg

SEQ ID NO: 238754 - RNA, 22 nt, Homo sapiens
ucuugggugaguuugugaauaa

SEQ ID NO: 238755 - RNA, 23 nt, Homo sapiens
ucuuguacuuugagugagcaugg

SEQ ID NO: 238756 - RNA, 22 nt, Homo sapiens
ucuuuaguuaagggacauuuua

SEQ ID NO: 238757 - RNA, 22 nt, Homo sapiens
ucuuucacuuagcaugauguuu

SEQ ID NO: 238758 - RNA, 22 nt, Homo sapiens
ucuuugagugcccugagucccu

SEQ ID NO: 238759 - RNA, 22 nt, Homo sapiens
ucuuugccuaacccaaggucau

SEQ ID NO: 238760 - RNA, 22 nt, Homo sapiens
ucuuuggguagauauguagcug

SEQ ID NO: 238761 - RNA, 22 nt, Homo sapiens
ucuuugguagaagcuauuuuau

SEQ ID NO: 238762 - RNA, 22 nt, Homo sapiens
ucuuuggucagaaagauuacac

SEQ ID NO: 238763 - RNA, 22 nt, Homo sapiens
auggccuuguauaccuggcaaa

SEQ ID NO: 238764 - RNA, 22 nt, Homo sapiens
auggcucuggauagaaugcagg

SEQ ID NO: 238765 - RNA, 22 nt, Homo sapiens
auggcugagugauuucaaacag

SEQ ID NO: 238766 - RNA, 22 nt, Homo sapiens
auggcuugugggaacuuuuaaa

SEQ ID NO: 238767 - RNA, 22 nt, Homo sapiens
auggcuuuggucucccagugau

SEQ ID NO: 238768 - RNA, 22 nt, Homo sapiens
auggcuuuucacagaggguucu

SEQ ID NO: 238769 - RNA, 22 nt, Homo sapiens
augggcacugauguauucugug

SEQ ID NO: 238770 - RNA, 22 nt, Homo sapiens
augggucuccugaauacagcac

SEQ ID NO: 238771 - RNA, 18 nt, Homo sapiens
auggguguuggaaaauga

SEQ ID NO: 238772 - RNA, 22 nt, Homo sapiens
augguagacucucgggucaugg

SEQ ID NO: 238773 - RNA, 22 nt, Homo sapiens
auggucuuuuuguuaugagaga

SEQ ID NO: 238774 - RNA, 21 nt, Homo sapiens
auggugagaaaguagugucaa

SEQ ID NO: 238775 - RNA, 22 nt, Homo sapiens
auguaaacagaugugcagcuug

SEQ ID NO: 238776 - RNA, 22 nt, Homo sapiens
auguaugagaguuccagcugau

SEQ ID NO: 238777 - RNA, 22 nt, Homo sapiens
augucaacauagacaguagagu

SEQ ID NO: 238778 - RNA, 22 nt, Homo sapiens
auguccauggaaucuguagcaa

SEQ ID NO: 238779 - RNA, 22 nt, Homo sapiens
augugaacaucauagaaugcac

SEQ ID NO: 238780 - RNA, 17 nt, Homo sapiens
augugaauguucaaaua

SEQ ID NO: 238781 - RNA, 22 nt, Homo sapiens
augugacugauggagaauaugu

SEQ ID NO: 238782 - RNA, 22 nt, Homo sapiens
augugcaauguguacguagccc

SEQ ID NO: 238783 - RNA, 22 nt, Homo sapiens
augugcacaacgugcagguuug

SEQ ID NO: 238784 - RNA, 22 nt, Homo sapiens
augugcaugcuguucugccaga

SEQ ID NO: 238785 - RNA, 22 nt, Homo sapiens
auguggaaagcagcaugauaug

SEQ ID NO: 238786 - RNA, 22 nt, Homo sapiens
augugguaguuauagugauaag

SEQ ID NO: 238787 - RNA, 19 nt, Homo sapiens
augugguuagcaugacugc

SEQ ID NO: 238788 - RNA, 22 nt, Homo sapiens
auguuugguaagaauauuguua

SEQ ID NO: 238789 - RNA, 23 nt, Homo sapiens
auuaagguuacuacaguaugagg

SEQ ID NO: 238790 - RNA, 22 nt, Homo sapiens
auuaagugcuugcagaagucca

SEQ ID NO: 238791 - RNA, 22 nt, Homo sapiens
auucaacuaauuauugaagaug

SEQ ID NO: 238792 - RNA, 22 nt, Homo sapiens
auucaagggauuucaggaggcu

SEQ ID NO: 238793 - RNA, 23 nt, Homo sapiens
auucaaguagugagagugguuau

SEQ ID NO: 238794 - RNA, 22 nt, Homo sapiens
auucaagugaugugauucuucu

SEQ ID NO: 238795 - RNA, 22 nt, Homo sapiens
auucacuguggcuuucucugau

SEQ ID NO: 238796 - RNA, 22 nt, Homo sapiens
auucaucagggauauugguuga

SEQ ID NO: 238797 - RNA, 22 nt, Homo sapiens
auuccagauggaguugaggguu

SEQ ID NO: 238798 - RNA, 18 nt, Homo sapiens
auucuacaggccuuuuga

SEQ ID NO: 238799 - RNA, 22 nt, Homo sapiens
auucuauaguccuaggauuggg

SEQ ID NO: 238800 - RNA, 22 nt, Homo sapiens
auucuugcuugaacuuggugca

SEQ ID NO: 238801 - RNA, 22 nt, Homo sapiens
auugaacuuaaaagacuugcca

SEQ ID NO: 238802 - RNA, 22 nt, Homo sapiens
auugacacugauuuuucuuuaa

SEQ ID NO: 238803 - RNA, 22 nt, Homo sapiens
auugacaguuggccaguaagug

SEQ ID NO: 238804 - RNA, 22 nt, Homo sapiens
auugcaacaguguugagaggug

SEQ ID NO: 238805 - RNA, 22 nt, Homo sapiens
auugcaacuuccgccuccuggg

SEQ ID NO: 238806 - RNA, 22 nt, Homo sapiens
auugcaaugggaaacuaugaaa

SEQ ID NO: 238807 - RNA, 18 nt, Homo sapiens
auugcacaccagccuggg

SEQ ID NO: 238808 - RNA, 22 nt, Homo sapiens
auugcacuccagccugagcaaa

SEQ ID NO: 238809 - RNA, 22 nt, Homo sapiens
auugcacuccagccugcggaac

SEQ ID NO: 238810 - RNA, 22 nt, Homo sapiens
auugcacuccagccugggcgac

SEQ ID NO: 238811 - RNA, 22 nt, Homo sapiens
auugcacuccagccugggcuag

SEQ ID NO: 238812 - RNA, 22 nt, Homo sapiens
auugcacuccagccugggugag

SEQ ID NO: 238813 - RNA, 22 nt, Homo sapiens
auugcacuccagccuggugaca

SEQ ID NO: 238814 - RNA, 22 nt, Homo sapiens
auugcacuccagcuuaggcgac

SEQ ID NO: 238815 - RNA, 23 nt, Homo sapiens
auugcagaaucacagagguagug

SEQ ID NO: 238816 - RNA, 18 nt, Homo sapiens
auugcccucauggggcuu

SEQ ID NO: 238817 - RNA, 22 nt, Homo sapiens
auugccuaacauagauguucag

SEQ ID NO: 238818 - RNA, 22 nt, Homo sapiens
auugcuaauaugcuucaggcaa

SEQ ID NO: 238819 - RNA, 22 nt, Homo sapiens
auugcuuacccuguauuagauc

SEQ ID NO: 238820 - RNA, 22 nt, Homo sapiens
auuggacagcauuucuagacuu

SEQ ID NO: 238821 - RNA, 22 nt, Homo sapiens
auuggcaagauagcauaugagg

SEQ ID NO: 238822 - RNA, 22 nt, Homo sapiens
auuggguuaaaggauaugaaca

SEQ ID NO: 238823 - RNA, 22 nt, Homo sapiens
auuguacauacaccggugugua

SEQ ID NO: 238824 - RNA, 22 nt, Homo sapiens
auuguacucuagccucugggca

SEQ ID NO: 238825 - RNA, 22 nt, Homo sapiens
auuucuacuccuguguccagaa

SEQ ID NO: 238826 - RNA, 22 nt, Homo sapiens
auuuggcaauuuugaagaugcc

SEQ ID NO: 238827 - RNA, 22 nt, Homo sapiens
auuuggguuuuacaucaggcua

SEQ ID NO: 238828 - RNA, 22 nt, Homo sapiens
auuuuugguugucagcacuagg

SEQ ID NO: 238829 - RNA, 22 nt, Homo sapiens
auuuuugguuucaccugcacgc

SEQ ID NO: 238830 - RNA, 22 nt, Homo sapiens
caaaggcuguuauaggccagga

SEQ ID NO: 238831 - RNA, 22 nt, Homo sapiens
caaaugacaucauuucauucaa

SEQ ID NO: 238832 - RNA, 22 nt, Homo sapiens
caacauccaccuccuggguuca

SEQ ID NO: 238833 - RNA, 22 nt, Homo sapiens
caagagaccugagugucauucu

SEQ ID NO: 238834 - RNA, 22 nt, Homo sapiens
caagguacuuuuacaauuuccc

SEQ ID NO: 238835 - RNA, 21 nt, Homo sapiens
caagugaugcuucugcuuuaa

SEQ ID NO: 238836 - RNA, 19 nt, Homo sapiens
caauacuucuuggcauaca

SEQ ID NO: 238837 - RNA, 21 nt, Homo sapiens
caaugacacuguagcugugcu

SEQ ID NO: 238838 - RNA, 22 nt, Homo sapiens
caauggcaaugaaauagugaga

SEQ ID NO: 238839 - RNA, 21 nt, Homo sapiens
caauggcacaaucucugcuca

SEQ ID NO: 238840 - RNA, 22 nt, Homo sapiens
cacagcuagucaaugguagaca

SEQ ID NO: 238841 - RNA, 23 nt, Homo sapiens
cacagggugaacaccccuaaucc

SEQ ID NO: 238842 - RNA, 22 nt, Homo sapiens
cacaguguuccagcuauuugaa

SEQ ID NO: 238843 - RNA, 22 nt, Homo sapiens
cacauguuuuagcauggcuguu

SEQ ID NO: 238844 - RNA, 23 nt, Homo sapiens
caccaguagaaugugugggaggg

SEQ ID NO: 238845 - RNA, 22 nt, Homo sapiens
caccaguuuuucagugauucaa

SEQ ID NO: 238846 - RNA, 22 nt, Homo sapiens
cacugaaugugagguuggggag

SEQ ID NO: 238847 - RNA, 22 nt, Homo sapiens
cacugcacuccagcuugugggc

SEQ ID NO: 238848 - RNA, 22 nt, Homo sapiens
cacugcaguggaagauuaagaa

SEQ ID NO: 238849 - RNA, 22 nt, Homo sapiens
caggucaucugaguuuaguucu

SEQ ID NO: 238850 - RNA, 22 nt, Homo sapiens
caguaaauaucugagcgagguc

SEQ ID NO: 238851 - RNA, 22 nt, Homo sapiens
caguacaauguggaaaaggagu

SEQ ID NO: 238852 - RNA, 19 nt, Homo sapiens
caguaucauugcacauagu

SEQ ID NO: 238853 - RNA, 22 nt, Homo sapiens
cagucacugggauuauggucau

SEQ ID NO: 238854 - RNA, 22 nt, Homo sapiens
cagugaauuucaggucaagagu

SEQ ID NO: 238855 - RNA, 18 nt, Homo sapiens
cagugcaauacaggagag

SEQ ID NO: 238856 - RNA, 22 nt, Homo sapiens
cagugcauagaugugccacauu

SEQ ID NO: 238857 - RNA, 22 nt, Homo sapiens
cagugcuuguuauuguucuauu

SEQ ID NO: 238858 - RNA, 22 nt, Homo sapiens
caguggacuaaauggggaauau

SEQ ID NO: 238859 - RNA, 23 nt, Homo sapiens
cagugguguuagagaaaucuuuu

SEQ ID NO: 238860 - RNA, 22 nt, Homo sapiens
cagugguuuucaacccugguug

SEQ ID NO: 238861 - RNA, 22 nt, Homo sapiens
cagugguuuuuagcuugcuggg

SEQ ID NO: 238862 - RNA, 22 nt, Homo sapiens
cagugucugcauuuggaacuca

SEQ ID NO: 238863 - RNA, 22 nt, Homo sapiens
cauaaagauggaggaggccagg

SEQ ID NO: 238864 - RNA, 22 nt, Homo sapiens
cauaaaucuuguugaauagcac

SEQ ID NO: 238865 - RNA, 22 nt, Homo sapiens
cauacagcuaguaaguguaaga

SEQ ID NO: 238866 - RNA, 18 nt, Homo sapiens
cauagcacuucagcacau

SEQ ID NO: 238867 - RNA, 22 nt, Homo sapiens
caucacagcaaguagggagugg

SEQ ID NO: 238868 - RNA, 22 nt, Homo sapiens
caucacauucugagauacugag

SEQ ID NO: 238869 - RNA, 20 nt, Homo sapiens
caucaccuggcaggauuugu

SEQ ID NO: 238870 - RNA, 22 nt, Homo sapiens
caucacuuugccuccgucucua

SEQ ID NO: 238871 - RNA, 22 nt, Homo sapiens
caucagagugagauauaagauc

SEQ ID NO: 238872 - RNA, 22 nt, Homo sapiens
caucagauugagaucaucuaag

SEQ ID NO: 238873 - RNA, 22 nt, Homo sapiens
caucauugcacccuauagagaa

SEQ ID NO: 238874 - RNA, 22 nt, Homo sapiens
cauccccugcaccaaccuuuac

SEQ ID NO: 238875 - RNA, 22 nt, Homo sapiens
caugaaagacugaggaauugga

SEQ ID NO: 238876 - RNA, 22 nt, Homo sapiens
caugaaagugagaaacuccugg

SEQ ID NO: 238877 - RNA, 22 nt, Homo sapiens
caugccacugcacuccaaccug

SEQ ID NO: 238878 - RNA, 22 nt, Homo sapiens
cauggcacaucuuuucugacua

SEQ ID NO: 238879 - RNA, 22 nt, Homo sapiens
cauggccuuuggaaugugucua

SEQ ID NO: 238880 - RNA, 22 nt, Homo sapiens
caugguguuaggcacugggaau

SEQ ID NO: 238881 - RNA, 20 nt, Homo sapiens
cauugcacuccagcuugggc

SEQ ID NO: 238882 - RNA, 22 nt, Homo sapiens
cauugcacuccagucugggcaa

SEQ ID NO: 238883 - RNA, 22 nt, Homo sapiens
cauugcacugcagcccgggcaa

SEQ ID NO: 238884 - RNA, 22 nt, Homo sapiens
cauugcccuccagccugggcaa

SEQ ID NO: 238885 - RNA, 22 nt, Homo sapiens
cauuguacauaaguauggagua

SEQ ID NO: 238886 - RNA, 22 nt, Homo sapiens
cauuuugguuaaauagguagcu

SEQ ID NO: 238887 - RNA, 19 nt, Homo sapiens
ccacaaugguugaacuaga

SEQ ID NO: 238888 - RNA, 22 nt, Homo sapiens
ccacacugucuuggugggaaac

SEQ ID NO: 238889 - RNA, 23 nt, Homo sapiens
ccacacuguuuagaauggcauca

SEQ ID NO: 238890 - RNA, 22 nt, Homo sapiens
ccacccuuccauucuuccucuu

SEQ ID NO: 238891 - RNA, 22 nt, Homo sapiens
ccacugcacuccagcccggcaa

SEQ ID NO: 238892 - RNA, 22 nt, Homo sapiens
ccagaguuucugauucagcagg

SEQ ID NO: 238893 - RNA, 20 nt, Homo sapiens
ccagcaucauuagauucugg

SEQ ID NO: 238894 - RNA, 22 nt, Homo sapiens
ccaggguuccacgccuggcugu

SEQ ID NO: 238895 - RNA, 22 nt, Homo sapiens
ccaguuuucccagcaccauuaa

SEQ ID NO: 238896 - RNA, 22 nt, Homo sapiens
ccaucacacugugauuauuauc

SEQ ID NO: 238897 - RNA, 20 nt, Homo sapiens
ccaucaguccucucuuguuc

SEQ ID NO: 238898 - RNA, 21 nt, Homo sapiens
ccauggcaaugguaaacugac

SEQ ID NO: 238899 - RNA, 22 nt, Homo sapiens
ccauggcaauggucagucuauu

SEQ ID NO: 238900 - RNA, 21 nt, Homo sapiens
ccaugggacggaaugaauaca

SEQ ID NO: 238901 - RNA, 22 nt, Homo sapiens
ccauuucacucuuccugaagga

SEQ ID NO: 238902 - RNA, 22 nt, Homo sapiens
ccauuugguuauguaucgaaac

SEQ ID NO: 238903 - RNA, 22 nt, Homo sapiens
cccacaguggccucauauccuu

SEQ ID NO: 238904 - RNA, 22 nt, Homo sapiens
cccagagacagaaugauaaacu

SEQ ID NO: 238905 - RNA, 22 nt, Homo sapiens
cccaguaaucuugccaguuuuc

SEQ ID NO: 238906 - RNA, 18 nt, Homo sapiens
cccagugacuuauggccu

SEQ ID NO: 238907 - RNA, 22 nt, Homo sapiens
cccaguguuacgugacagccug

SEQ ID NO: 238908 - RNA, 22 nt, Homo sapiens
cccaguuuugcuucucaugagg

SEQ ID NO: 238909 - RNA, 22 nt, Homo sapiens
ccccagugguugcaacagcaga

SEQ ID NO: 238910 - RNA, 22 nt, Homo sapiens
ccccggguggauguacauguga

SEQ ID NO: 238911 - RNA, 22 nt, Homo sapiens
ccccguuacagccucagugccu

SEQ ID NO: 238912 - RNA, 17 nt, Homo sapiens
cccuaguagcugggacu

SEQ ID NO: 238913 - RNA, 22 nt, Homo sapiens
cccugaagauacagaguuuggg

SEQ ID NO: 238914 - RNA, 22 nt, Homo sapiens
cccugagaugugaauuucagag

SEQ ID NO: 238915 - RNA, 21 nt, Homo sapiens
cccugguguuuggaguuugag

SEQ ID NO: 238916 - RNA, 22 nt, Homo sapiens
ccucccuuuguugcaagggaaa

SEQ ID NO: 238917 - RNA, 21 nt, Homo sapiens
ccugauguucacuuggccuuc

SEQ ID NO: 238918 - RNA, 22 nt, Homo sapiens
ccuggaaugaagcuuauauugc

SEQ ID NO: 238919 - RNA, 22 nt, Homo sapiens
ccuggguuacaggugugagcca

SEQ ID NO: 238920 - RNA, 22 nt, Homo sapiens
ccugguguuuugauggucgggu

SEQ ID NO: 238921 - RNA, 22 nt, Homo sapiens
ccuucacaggcacugguucaga

SEQ ID NO: 238922 - RNA, 22 nt, Homo sapiens
ccuucauucauuaauuuagccc

SEQ ID NO: 238923 - RNA, 22 nt, Homo sapiens
ccuucauugcaucuuuaagaga

SEQ ID NO: 238924 - RNA, 22 nt, Homo sapiens
ccuugcacuucccaagugaggc

SEQ ID NO: 238925 - RNA, 22 nt, Homo sapiens
ccuuggcacuacugacauugua

SEQ ID NO: 238926 - RNA, 22 nt, Homo sapiens
ccuuggcacuuugccacagugc

SEQ ID NO: 238927 - RNA, 22 nt, Homo sapiens
ccuugguaauguguuuuauucu

SEQ ID NO: 238928 - RNA, 22 nt, Homo sapiens
ccuugucacugaguggaaugaa

SEQ ID NO: 238929 - RNA, 22 nt, Homo sapiens
ccuuuuuguaguggaaguagga

SEQ ID NO: 238930 - RNA, 22 nt, Homo sapiens
cgcuggugaucuagacccccaa

SEQ ID NO: 238931 - RNA, 22 nt, Homo sapiens
cgugaggaaaacagaggguguu

SEQ ID NO: 238932 - RNA, 22 nt, Homo sapiens
aucaagcuugacuccuuaaagg

SEQ ID NO: 238933 - RNA, 22 nt, Homo sapiens
aucacaauuguacguaggagcc

SEQ ID NO: 238934 - RNA, 22 nt, Homo sapiens
aucacaggucaaaucauuauuu

SEQ ID NO: 238935 - RNA, 22 nt, Homo sapiens
aucacauggccagguaguaauc

SEQ ID NO: 238936 - RNA, 22 nt, Homo sapiens
aucaccuggaggugaucacuug

SEQ ID NO: 238937 - RNA, 22 nt, Homo sapiens
aucacuggccuuuuuaaaugcu

SEQ ID NO: 238938 - RNA, 22 nt, Homo sapiens
aucacugugauuucuacugugc

SEQ ID NO: 238939 - RNA, 20 nt, Homo sapiens
aucagagccggugaaagggc

SEQ ID NO: 238940 - RNA, 22 nt, Homo sapiens
aucagaguggguuuuaaaagug

SEQ ID NO: 238941 - RNA, 23 nt, Homo sapiens
aucagauaguuguagguaugugg

SEQ ID NO: 238942 - RNA, 22 nt, Homo sapiens
aucagcagcaugaaaagcaacu

SEQ ID NO: 238943 - RNA, 22 nt, Homo sapiens
aucagcauucccaaaugaugug

SEQ ID NO: 238944 - RNA, 22 nt, Homo sapiens
aucagucuguuggaauaucgcu

SEQ ID NO: 238945 - RNA, 22 nt, Homo sapiens
aucagugaaagugaaaucuccg

SEQ ID NO: 238946 - RNA, 22 nt, Homo sapiens
aucagugcagugggaacuagaa

SEQ ID NO: 238947 - RNA, 22 nt, Homo sapiens
aucauacuguuuugauuacugu

SEQ ID NO: 238948 - RNA, 22 nt, Homo sapiens
aucaucacaguuguguguaaug

SEQ ID NO: 238949 - RNA, 22 nt, Homo sapiens
aucauguuuauguguaggauau

SEQ ID NO: 238950 - RNA, 22 nt, Homo sapiens
auccaagagacugaugacuucc

SEQ ID NO: 238951 - RNA, 22 nt, Homo sapiens
auccaucagacggcaggcguug

SEQ ID NO: 238952 - RNA, 22 nt, Homo sapiens
aucccagaaacucggguuucuc

SEQ ID NO: 238953 - RNA, 22 nt, Homo sapiens
aucccaguaaaaauggcuucua

SEQ ID NO: 238954 - RNA, 22 nt, Homo sapiens
aucccuuccuagcacuuggugu

SEQ ID NO: 238955 - RNA, 22 nt, Homo sapiens
auccuugagaaaauaaaugacc

SEQ ID NO: 238956 - RNA, 22 nt, Homo sapiens
aucgcaccauugcacuccagca

SEQ ID NO: 238957 - RNA, 22 nt, Homo sapiens
aucgcgccauuguacuccagcc

SEQ ID NO: 238958 - RNA, 22 nt, Homo sapiens
aucuagagaggcagucuggccg

SEQ ID NO: 238959 - RNA, 21 nt, Homo sapiens
aucucacuugaauguaaaagc

SEQ ID NO: 238960 - RNA, 22 nt, Homo sapiens
aucucagcaacuaaagauccuu

SEQ ID NO: 238961 - RNA, 22 nt, Homo sapiens
aucuccaggugccagcugcgcc

SEQ ID NO: 238962 - RNA, 22 nt, Homo sapiens
aucucugagauguucugauuuu

SEQ ID NO: 238963 - RNA, 22 nt, Homo sapiens
aucugcaaauaaugaagauugg

SEQ ID NO: 238964 - RNA, 22 nt, Homo sapiens
aucuugcauuugcuaaaaugca

SEQ ID NO: 238965 - RNA, 22 nt, Homo sapiens
aucuuuggugaguucuuugguc

SEQ ID NO: 238966 - RNA, 22 nt, Homo sapiens
augaaagguugucuuaagccau

SEQ ID NO: 238967 - RNA, 22 nt, Homo sapiens
augaaaucuuuccugugaggau

SEQ ID NO: 238968 - RNA, 22 nt, Homo sapiens
augaacagagccuugagaaccu

SEQ ID NO: 238969 - RNA, 17 nt, Homo sapiens
augaacucaucauuuuu

SEQ ID NO: 238970 - RNA, 23 nt, Homo sapiens
augaacucaucauuuuuuauggc

SEQ ID NO: 238971 - RNA, 22 nt, Homo sapiens
augaagagaaaguggaucuugg

SEQ ID NO: 238972 - RNA, 22 nt, Homo sapiens
augaagaucucugccuuguguc

SEQ ID NO: 238973 - RNA, 20 nt, Homo sapiens
augaaggcaggugugaguuu

SEQ ID NO: 238974 - RNA, 18 nt, Homo sapiens
augaagucaucacuuuua

SEQ ID NO: 238975 - RNA, 22 nt, Homo sapiens
augaaguuagcucauuucuuuu

SEQ ID NO: 238976 - RNA, 22 nt, Homo sapiens
augaauacagcuaugcgugcau

SEQ ID NO: 238977 - RNA, 22 nt, Homo sapiens
augaauguaaagaaugugggaa

SEQ ID NO: 238978 - RNA, 22 nt, Homo sapiens
augaaugucuuauuuugagaaa

SEQ ID NO: 238979 - RNA, 22 nt, Homo sapiens
augacaagagccuucuuuccuu

SEQ ID NO: 238980 - RNA, 22 nt, Homo sapiens
augacaguaugacuccaaaagu

SEQ ID NO: 238981 - RNA, 22 nt, Homo sapiens
augacagugagugagcucucac

SEQ ID NO: 238982 - RNA, 22 nt, Homo sapiens
augacaguguggauuauuguaa

SEQ ID NO: 238983 - RNA, 22 nt, Homo sapiens
augacauguauuuccaggauuu

SEQ ID NO: 238984 - RNA, 22 nt, Homo sapiens
augaccagagagugcgcagggu

SEQ ID NO: 238985 - RNA, 18 nt, Homo sapiens
augaccugcggguuauau

SEQ ID NO: 238986 - RNA, 22 nt, Homo sapiens
augaccuuggggaaccaugucu

SEQ ID NO: 238987 - RNA, 22 nt, Homo sapiens
augacuaaaggguuuauguuga

SEQ ID NO: 238988 - RNA, 22 nt, Homo sapiens
augagaaugaagccuggcgugu

SEQ ID NO: 238989 - RNA, 22 nt, Homo sapiens
augagacaguucccuuuaucuu

SEQ ID NO: 238990 - RNA, 22 nt, Homo sapiens
augagacuagaagagaauaaua

SEQ ID NO: 238991 - RNA, 22 nt, Homo sapiens
augagagcaacaccuucacuug

SEQ ID NO: 238992 - RNA, 22 nt, Homo sapiens
augagauaggaacaaacuuaca

SEQ ID NO: 238993 - RNA, 22 nt, Homo sapiens
augagaucaaauuuaagcuguu

SEQ ID NO: 238994 - RNA, 22 nt, Homo sapiens
augagaugaggaauggcccucc

SEQ ID NO: 238995 - RNA, 22 nt, Homo sapiens
augagaugauaggcguucuaac

SEQ ID NO: 238996 - RNA, 22 nt, Homo sapiens
augagaugcaagauuagauggg

SEQ ID NO: 238997 - RNA, 22 nt, Homo sapiens
augaggagguaugauuuucuga

SEQ ID NO: 238998 - RNA, 22 nt, Homo sapiens
augaggauagguuucuauuagg

SEQ ID NO: 238999 - RNA, 22 nt, Homo sapiens
augaggcaggaaaggcguaucu

SEQ ID NO: 239000 - RNA, 22 nt, Homo sapiens
augagggaagcucacgugucca

SEQ ID NO: 239001 - RNA, 22 nt, Homo sapiens
augagggagggcaccugaccuu

SEQ ID NO: 239002 - RNA, 22 nt, Homo sapiens
augagggagggguggugccgca

SEQ ID NO: 239003 - RNA, 22 nt, Homo sapiens
augaggugaguaaauaaaugaa

SEQ ID NO: 239004 - RNA, 21 nt, Homo sapiens
augagguguacuguggugaaa

SEQ ID NO: 239005 - RNA, 22 nt, Homo sapiens
augaguaugagaauacauuaag

SEQ ID NO: 239006 - RNA, 22 nt, Homo sapiens
augauccagugaguuucaguuc

SEQ ID NO: 239007 - RNA, 19 nt, Homo sapiens
augauugucuauggaggaa

SEQ ID NO: 239008 - RNA, 22 nt, Homo sapiens
augcaaacaucugaagagacau

SEQ ID NO: 239009 - RNA, 22 nt, Homo sapiens
augcaagaaauaucucuuuuuc

SEQ ID NO: 239010 - RNA, 19 nt, Homo sapiens
augcaaugucacaggcugc

SEQ ID NO: 239011 - RNA, 22 nt, Homo sapiens
augcacauauguacugcccuau

SEQ ID NO: 239012 - RNA, 22 nt, Homo sapiens
augcacaugcgaaaacuugugu

SEQ ID NO: 239013 - RNA, 18 nt, Homo sapiens
augcauauuuuaaguugu

SEQ ID NO: 239014 - RNA, 22 nt, Homo sapiens
augccacugcacuccaaccugg

SEQ ID NO: 239015 - RNA, 22 nt, Homo sapiens
augccagggagaauuguucaag

SEQ ID NO: 239016 - RNA, 22 nt, Homo sapiens
augccauugcacuccagccuag

SEQ ID NO: 239017 - RNA, 22 nt, Homo sapiens
augcuacugaccccuacuuaca

SEQ ID NO: 239018 - RNA, 22 nt, Homo sapiens
augcuuguguuggggcagugga

SEQ ID NO: 239019 - RNA, 22 nt, Homo sapiens
auggaaacauaagaguauagau

SEQ ID NO: 239020 - RNA, 22 nt, Homo sapiens
accuggguguauguucaguuug

SEQ ID NO: 239021 - RNA, 22 nt, Homo sapiens
accuucauuguugccaugucca

SEQ ID NO: 239022 - RNA, 22 nt, Homo sapiens
acuauacugaagcaaauuaaca

SEQ ID NO: 239023 - RNA, 22 nt, Homo sapiens
acuccacuuucaccacagcgga

SEQ ID NO: 239024 - RNA, 22 nt, Homo sapiens
acuccauuucauuuuagcucuu

SEQ ID NO: 239025 - RNA, 22 nt, Homo sapiens
acuccauuuggacucugggagg

SEQ ID NO: 239026 - RNA, 22 nt, Homo sapiens
acucuguugucuggccuuccug

SEQ ID NO: 239027 - RNA, 22 nt, Homo sapiens
acugaauguaaacacggagugu

SEQ ID NO: 239028 - RNA, 22 nt, Homo sapiens
acugaguguugauuuagauuaa

SEQ ID NO: 239029 - RNA, 22 nt, Homo sapiens
acugcaaugucgaauagagaug

SEQ ID NO: 239030 - RNA, 22 nt, Homo sapiens
cuugcacucagaagauucaguu

SEQ ID NO: 239031 - RNA, 22 nt, Homo sapiens
cuugcacuugaaauuccaguuu

SEQ ID NO: 239032 - RNA, 22 nt, Homo sapiens
cuugcagagcccauggauguca

SEQ ID NO: 239033 - RNA, 19 nt, Homo sapiens
cuugccccauucauccucu

SEQ ID NO: 239034 - RNA, 22 nt, Homo sapiens
cuuggcuugguaucaaauaacc

SEQ ID NO: 239035 - RNA, 22 nt, Homo sapiens
cuugggcagugugcauguguau

SEQ ID NO: 239036 - RNA, 22 nt, Homo sapiens
cuuggguaagucauuaaaauua

SEQ ID NO: 239037 - RNA, 22 nt, Homo sapiens
cuugucacuguuggcuuuagaa

SEQ ID NO: 239038 - RNA, 17 nt, Homo sapiens
cuuguugugguaguuug

SEQ ID NO: 239039 - RNA, 22 nt, Homo sapiens
cuuuacaguuggacucacgagg

SEQ ID NO: 239040 - RNA, 22 nt, Homo sapiens
cuuucugaggagaauagagaac

SEQ ID NO: 239041 - RNA, 22 nt, Homo sapiens
cuuugcaaaacauugagaccuc

SEQ ID NO: 239042 - RNA, 22 nt, Homo sapiens
cuuuggauggaaccucucuuuc

SEQ ID NO: 239043 - RNA, 20 nt, Homo sapiens
cuuuggcaaugagaacaggg

SEQ ID NO: 239044 - RNA, 22 nt, Homo sapiens
cuuuggcauuagccuguauaga

SEQ ID NO: 239045 - RNA, 22 nt, Homo sapiens
cuuuggugauagauaccccaua

SEQ ID NO: 239046 - RNA, 22 nt, Homo sapiens
cuuuguguaggugccucuggcu

SEQ ID NO: 239047 - RNA, 23 nt, Homo sapiens
cuuuugcaaugugaucuugccac

SEQ ID NO: 239048 - RNA, 22 nt, Homo sapiens
cuuuugcugggucagcgguggu

SEQ ID NO: 239049 - RNA, 22 nt, Homo sapiens
cuuuuggcuuaagauugucuug

SEQ ID NO: 239050 - RNA, 20 nt, Homo sapiens
gaaacaucuauccucuccuu

SEQ ID NO: 239051 - RNA, 22 nt, Homo sapiens
gaaagauuuccugagcuagaaa

SEQ ID NO: 239052 - RNA, 23 nt, Homo sapiens
gaaauguaagugaugccccacag

SEQ ID NO: 239053 - RNA, 22 nt, Homo sapiens
gaaauguugauagugggcauug

SEQ ID NO: 239054 - RNA, 22 nt, Homo sapiens
gugccuucuagcuaugguuggc

SEQ ID NO: 239055 - RNA, 22 nt, Homo sapiens
gugcuuguguuaauauguagcu

SEQ ID NO: 239056 - RNA, 20 nt, Homo sapiens
guggaagauaaguagccuga

SEQ ID NO: 239057 - RNA, 22 nt, Homo sapiens
guggagacaaaggcugagugag

SEQ ID NO: 239058 - RNA, 22 nt, Homo sapiens
guggaguacugagggucacuua

SEQ ID NO: 239059 - RNA, 22 nt, Homo sapiens
guggaguaugaaaacugacuuu

SEQ ID NO: 239060 - RNA, 22 nt, Homo sapiens
guggcaagaauguacaaaaggu

SEQ ID NO: 239061 - RNA, 22 nt, Homo sapiens
guggcaaggaaaugcugcucac

SEQ ID NO: 239062 - RNA, 22 nt, Homo sapiens
guggcuaaagauuuggaaucug

SEQ ID NO: 239063 - RNA, 22 nt, Homo sapiens
guggcuuuaaguacgauugagg

SEQ ID NO: 239064 - RNA, 22 nt, Homo sapiens
guggcuuuauuuagaagcaggg

SEQ ID NO: 239065 - RNA, 20 nt, Homo sapiens
gugggcaaauccuuuccucu

SEQ ID NO: 239066 - RNA, 22 nt, Homo sapiens
guggguaaaucucuggggcucu

SEQ ID NO: 239067 - RNA, 22 nt, Homo sapiens
gugguagaaauguagaugcuag

SEQ ID NO: 239068 - RNA, 22 nt, Homo sapiens
gugguguccugcaccuauaguc

SEQ ID NO: 239069 - RNA, 22 nt, Homo sapiens
guggugucuuuuuugauuagga

SEQ ID NO: 239070 - RNA, 22 nt, Homo sapiens
gugguucuaaaccuuuuuuggu

SEQ ID NO: 239071 - RNA, 22 nt, Homo sapiens
gugguuuuaauauucagucuag

SEQ ID NO: 239072 - RNA, 22 nt, Homo sapiens
gugguuuuaucccagaaauuaa

SEQ ID NO: 239073 - RNA, 22 nt, Homo sapiens
gugguuuuuuucugccuuauag

SEQ ID NO: 239074 - RNA, 22 nt, Homo sapiens
guguauauccuauuaguucugu

SEQ ID NO: 239075 - RNA, 18 nt, Homo sapiens
guguauggauggaggcca

SEQ ID NO: 239076 - RNA, 22 nt, Homo sapiens
guguaugugagaaugcucaugu

SEQ ID NO: 239077 - RNA, 22 nt, Homo sapiens
guguauguuguccauggaugcg

SEQ ID NO: 239078 - RNA, 21 nt, Homo sapiens
gugucacagacaugacagaug

SEQ ID NO: 239079 - RNA, 22 nt, Homo sapiens
gugucacagcuuccaucucggu

SEQ ID NO: 239080 - RNA, 22 nt, Homo sapiens
gugucaguggggagugaucuuc

SEQ ID NO: 239081 - RNA, 22 nt, Homo sapiens
gugucaugggcauguccuuaac

SEQ ID NO: 239082 - RNA, 22 nt, Homo sapiens
guguccucgaguacacaucagg

SEQ ID NO: 239083 - RNA, 22 nt, Homo sapiens
gugugcacaaucuggcaugugc

SEQ ID NO: 239084 - RNA, 19 nt, Homo sapiens
gugugcauaucacagagca

SEQ ID NO: 239085 - RNA, 20 nt, Homo sapiens
gugugcauuucagauuuugg

SEQ ID NO: 239086 - RNA, 21 nt, Homo sapiens
gugugcuugagugaugggauu

SEQ ID NO: 239087 - RNA, 22 nt, Homo sapiens
guguggcaggugggggcucaga

SEQ ID NO: 239088 - RNA, 22 nt, Homo sapiens
guguuauugagaaauagggugu

SEQ ID NO: 239089 - RNA, 22 nt, Homo sapiens
guuauccugucuuuacauacaa

SEQ ID NO: 239090 - RNA, 22 nt, Homo sapiens
guuauuguccauuuauuuagca

SEQ ID NO: 239091 - RNA, 22 nt, Homo sapiens
guucaagcaauucugcugccuc

SEQ ID NO: 239092 - RNA, 22 nt, Homo sapiens
guucaaguuuucucuugugggu

SEQ ID NO: 239093 - RNA, 20 nt, Homo sapiens
guucacaggcuuccuuucag

SEQ ID NO: 239094 - RNA, 22 nt, Homo sapiens
guucacaguuucuaaucccagc

SEQ ID NO: 239095 - RNA, 22 nt, Homo sapiens
guucaucaggcuuucucuagag

SEQ ID NO: 239096 - RNA, 20 nt, Homo sapiens
guucauguaauuaguucagg

SEQ ID NO: 239097 - RNA, 22 nt, Homo sapiens
guuccuuguagaugcuggauau

SEQ ID NO: 239098 - RNA, 22 nt, Homo sapiens
guucucacuggacugugaaaau

SEQ ID NO: 239099 - RNA, 22 nt, Homo sapiens
guugaaauccuaacccccuagu

SEQ ID NO: 239100 - RNA, 18 nt, Homo sapiens
guugagcuuuuccuuuag

SEQ ID NO: 239101 - RNA, 17 nt, Homo sapiens
guugaguuugagucaag

SEQ ID NO: 239102 - RNA, 22 nt, Homo sapiens
guugcacagucuuuccuggacu

SEQ ID NO: 239103 - RNA, 22 nt, Homo sapiens
guugcucaggccggagugcagu

SEQ ID NO: 239104 - RNA, 22 nt, Homo sapiens
guugcucaggcugaagugcagu

SEQ ID NO: 239105 - RNA, 22 nt, Homo sapiens
guuggcuguuucccccaaguga

SEQ ID NO: 239106 - RNA, 22 nt, Homo sapiens
guugguuuccuguaacuggaca

SEQ ID NO: 239107 - RNA, 22 nt, Homo sapiens
guuugcacuccuaugagaaucu

SEQ ID NO: 239108 - RNA, 22 nt, Homo sapiens
guuugcagaucaugaagaaccc

SEQ ID NO: 239109 - RNA, 22 nt, Homo sapiens
guuuggauauuaggcaagagua

SEQ ID NO: 239110 - RNA, 22 nt, Homo sapiens
guuuggcucuuguuucugucaa

SEQ ID NO: 239111 - RNA, 22 nt, Homo sapiens
guuugguugcauggaaaauuua

SEQ ID NO: 239112 - RNA, 22 nt, Homo sapiens
guuuuuggggucacuauuaccg

SEQ ID NO: 239113 - RNA, 22 nt, Homo sapiens
uaaacugcuugaaaugguguca

SEQ ID NO: 239114 - RNA, 22 nt, Homo sapiens
uaaagcacaaguaaagaauacu

SEQ ID NO: 239115 - RNA, 22 nt, Homo sapiens
uaaagcacuuuuuucugcaugg

SEQ ID NO: 239116 - RNA, 22 nt, Homo sapiens
uaaagccauugucaaguuugua

SEQ ID NO: 239117 - RNA, 22 nt, Homo sapiens
uaaagugcugagaugaggcugg

SEQ ID NO: 239118 - RNA, 22 nt, Homo sapiens
uaaaguuauugccccucaguua

SEQ ID NO: 239119 - RNA, 22 nt, Homo sapiens
uaaaugcuuaauugaaugugga

SEQ ID NO: 239120 - RNA, 22 nt, Homo sapiens
uaaaugcuugagaugauggaua

SEQ ID NO: 239121 - RNA, 21 nt, Homo sapiens
uaaaugucauacaaagcaaug

SEQ ID NO: 239122 - RNA, 22 nt, Homo sapiens
uaaauugcauaaguacaaauga

SEQ ID NO: 239123 - RNA, 22 nt, Homo sapiens
uaacaagagagucagucagucc

SEQ ID NO: 239124 - RNA, 22 nt, Homo sapiens
uaacaguauaugugguaucuau

SEQ ID NO: 239125 - RNA, 22 nt, Homo sapiens
uaacccuuaguaucuguggguu

SEQ ID NO: 239126 - RNA, 22 nt, Homo sapiens
uaacuaaagagaagucaauguc

SEQ ID NO: 239127 - RNA, 22 nt, Homo sapiens
uaacuacuucugcuucagagua

SEQ ID NO: 239128 - RNA, 22 nt, Homo sapiens
uaacuagaaaggagacaguugc

SEQ ID NO: 239129 - RNA, 22 nt, Homo sapiens
uaacuguggaaaugacuuuaaa

SEQ ID NO: 239130 - RNA, 22 nt, Homo sapiens
uaagaauucuguccgguauacu

SEQ ID NO: 239131 - RNA, 22 nt, Homo sapiens
uaagacucuggacucuaauguu

SEQ ID NO: 239132 - RNA, 22 nt, Homo sapiens
uaagacuuuuugggaauauaga

SEQ ID NO: 239133 - RNA, 22 nt, Homo sapiens
uaagccaccgugccuggccuaa

SEQ ID NO: 239134 - RNA, 22 nt, Homo sapiens
uaagcuagcauagggguaaauu

SEQ ID NO: 239135 - RNA, 22 nt, Homo sapiens
uaagcuauagugaauaaauugc

SEQ ID NO: 239136 - RNA, 22 nt, Homo sapiens
uaaggcaaaccuuggcugcagu

SEQ ID NO: 239137 - RNA, 22 nt, Homo sapiens
uaaggcuugaucuuggugagau

SEQ ID NO: 239138 - RNA, 22 nt, Homo sapiens
uaaggcuuugcuggacucaguc

SEQ ID NO: 239139 - RNA, 22 nt, Homo sapiens
uaagggcaugcugcaugagagu

SEQ ID NO: 239140 - RNA, 22 nt, Homo sapiens
uaaguacaugcuagauggaaug

SEQ ID NO: 239141 - RNA, 22 nt, Homo sapiens
uaaguacuuuacagacauuauc

SEQ ID NO: 239142 - RNA, 22 nt, Homo sapiens
uaagucacuccagguuaaagug

SEQ ID NO: 239143 - RNA, 22 nt, Homo sapiens
uaagugaauuucacuacugagu

SEQ ID NO: 239144 - RNA, 22 nt, Homo sapiens
uaagugaauuugacagguaaug

SEQ ID NO: 239145 - RNA, 22 nt, Homo sapiens
uaagugcuguguuguuaccuaa

SEQ ID NO: 239146 - RNA, 20 nt, Homo sapiens
uaagugcuuuauauugauua

SEQ ID NO: 239147 - RNA, 20 nt, Homo sapiens
uaaguuguauuugucaugaa

SEQ ID NO: 239148 - RNA, 22 nt, Homo sapiens
uaauacauucaaggugguaguu

SEQ ID NO: 239149 - RNA, 22 nt, Homo sapiens
uaauacuugucauaaaggcauu

SEQ ID NO: 239150 - RNA, 22 nt, Homo sapiens
uaauaugugguugcuugggcac

SEQ ID NO: 239151 - RNA, 22 nt, Homo sapiens
uaaucucagcugagcugagauu

SEQ ID NO: 239152 - RNA, 22 nt, Homo sapiens
uaaugcuugguuguuuggaaaa

SEQ ID NO: 239153 - RNA, 22 nt, Homo sapiens
uaaugugaauagugcuguaaug

SEQ ID NO: 239154 - RNA, 22 nt, Homo sapiens
uaaugugcuucucuaccauagg

SEQ ID NO: 239155 - RNA, 22 nt, Homo sapiens
uaauucuguauguaucagaguu

SEQ ID NO: 239156 - RNA, 22 nt, Homo sapiens
gguguuccccuuaccucuuggc

SEQ ID NO: 239157 - RNA, 22 nt, Homo sapiens
guaaacuuccccucaugaauga

SEQ ID NO: 239158 - RNA, 22 nt, Homo sapiens
guaaaguaaagcacaucaaggu

SEQ ID NO: 239159 - RNA, 22 nt, Homo sapiens
guaaauaccaguuucuggaaca

SEQ ID NO: 239160 - RNA, 22 nt, Homo sapiens
guaaaucucuguuuucauggac

SEQ ID NO: 239161 - RNA, 18 nt, Homo sapiens
guaaauguaucuauugcc

SEQ ID NO: 239162 - RNA, 22 nt, Homo sapiens
guaaccuauaguuaccaauagu

SEQ ID NO: 239163 - RNA, 22 nt, Homo sapiens
guaaggaguaguguaacagugc

SEQ ID NO: 239164 - RNA, 22 nt, Homo sapiens
guaaucucagcuacucgggaga

SEQ ID NO: 239165 - RNA, 22 nt, Homo sapiens
guaaucucagcuacuugggagg

SEQ ID NO: 239166 - RNA, 22 nt, Homo sapiens
guaaucucagcuacuugggagu

SEQ ID NO: 239167 - RNA, 22 nt, Homo sapiens
guacaggugcaggaugggcagg

SEQ ID NO: 239168 - RNA, 22 nt, Homo sapiens
guacaguaguaaaagugaauga

SEQ ID NO: 239169 - RNA, 22 nt, Homo sapiens
guacauggaaugaaauucaaaa

SEQ ID NO: 239170 - RNA, 22 nt, Homo sapiens
guacuuuguuauaacccacagg

SEQ ID NO: 239171 - RNA, 22 nt, Homo sapiens
guagaaaguuugcugucacaug

SEQ ID NO: 239172 - RNA, 22 nt, Homo sapiens
guagagagaaauacaaagcugu

SEQ ID NO: 239173 - RNA, 22 nt, Homo sapiens
guagcagaauaucagauaauuu

SEQ ID NO: 239174 - RNA, 22 nt, Homo sapiens
guagcagucacauagcagauug

SEQ ID NO: 239175 - RNA, 22 nt, Homo sapiens
guauacacccugugauauuauu

SEQ ID NO: 239176 - RNA, 22 nt, Homo sapiens
guaucauugccuaaugcucuca

SEQ ID NO: 239177 - RNA, 22 nt, Homo sapiens
guauccugaaguucucagcacu

SEQ ID NO: 239178 - RNA, 22 nt, Homo sapiens
guaugacacaggaagcuuaacc

SEQ ID NO: 239179 - RNA, 22 nt, Homo sapiens
gucacagcacuuuuaguaagug

SEQ ID NO: 239180 - RNA, 22 nt, Homo sapiens
gucacaguggccagugauguuc

SEQ ID NO: 239181 - RNA, 22 nt, Homo sapiens
gucacaguguuuguucauccca

SEQ ID NO: 239182 - RNA, 22 nt, Homo sapiens
gucacauugaugcccauggugg

SEQ ID NO: 239183 - RNA, 22 nt, Homo sapiens
gucaccauugagucauuuccuc

SEQ ID NO: 239184 - RNA, 22 nt, Homo sapiens
gucacugagaagguuaguuugu

SEQ ID NO: 239185 - RNA, 22 nt, Homo sapiens
gucacugagcaauagaaaguuu

SEQ ID NO: 239186 - RNA, 22 nt, Homo sapiens
gucacugggugcugcgccuguc

SEQ ID NO: 239187 - RNA, 22 nt, Homo sapiens
gucagggagucucuaucagugg

SEQ ID NO: 239188 - RNA, 22 nt, Homo sapiens
gucagugcauguaaacauaaaa

SEQ ID NO: 239189 - RNA, 22 nt, Homo sapiens
gucagugcuuuaguucaggaug

SEQ ID NO: 239190 - RNA, 22 nt, Homo sapiens
gucaguggagaaaaggacaugu

SEQ ID NO: 239191 - RNA, 22 nt, Homo sapiens
gucagugucuuaacagagauua

SEQ ID NO: 239192 - RNA, 22 nt, Homo sapiens
gucauggguuaaagguggauac

SEQ ID NO: 239193 - RNA, 22 nt, Homo sapiens
guccagagaagucauuacuuca

SEQ ID NO: 239194 - RNA, 22 nt, Homo sapiens
gucccugcgauugugggauccu

SEQ ID NO: 239195 - RNA, 22 nt, Homo sapiens
guccuggagaagcguggaccgg

SEQ ID NO: 239196 - RNA, 22 nt, Homo sapiens
gucguggagcucacagugugcc

SEQ ID NO: 239197 - RNA, 22 nt, Homo sapiens
gucucagugcgaaucucaaaga

SEQ ID NO: 239198 - RNA, 22 nt, Homo sapiens
gucucccagccuacauauuucu

SEQ ID NO: 239199 - RNA, 22 nt, Homo sapiens
gucucuugguuuagagcauuua

SEQ ID NO: 239200 - RNA, 22 nt, Homo sapiens
gucucuuguuaucauuucugag

SEQ ID NO: 239201 - RNA, 22 nt, Homo sapiens
gucuggcaauggcagacuggca

SEQ ID NO: 239202 - RNA, 22 nt, Homo sapiens
gucuggcacagggaaaguacaa

SEQ ID NO: 239203 - RNA, 22 nt, Homo sapiens
gucuuuguuauuaugaaucaac

SEQ ID NO: 239204 - RNA, 22 nt, Homo sapiens
gucuuuugcuagccagagagcu

SEQ ID NO: 239205 - RNA, 22 nt, Homo sapiens
gugaaagauuaaaccagugugu

SEQ ID NO: 239206 - RNA, 17 nt, Homo sapiens
gugaaaucaucauuuuu

SEQ ID NO: 239207 - RNA, 22 nt, Homo sapiens
gugaaauguguagaggaucugg

SEQ ID NO: 239208 - RNA, 22 nt, Homo sapiens
gugaagugugaccucagcaucu

SEQ ID NO: 239209 - RNA, 20 nt, Homo sapiens
gugaauacauuugguuucau

SEQ ID NO: 239210 - RNA, 22 nt, Homo sapiens
gugacagucaaagacaugacuu

SEQ ID NO: 239211 - RNA, 22 nt, Homo sapiens
gugacugcauauaaguguaugu

SEQ ID NO: 239212 - RNA, 20 nt, Homo sapiens
gugagaacaugugguauuug

SEQ ID NO: 239213 - RNA, 22 nt, Homo sapiens
gugagacugaguuucgcucuug

SEQ ID NO: 239214 - RNA, 22 nt, Homo sapiens
gugagaugaggucucacucugu

SEQ ID NO: 239215 - RNA, 22 nt, Homo sapiens
gugagauggagucuugcuuugu

SEQ ID NO: 239216 - RNA, 22 nt, Homo sapiens
gugagcuccucucuauguguca

SEQ ID NO: 239217 - RNA, 21 nt, Homo sapiens
gugaggaguuacuggcuuuga

SEQ ID NO: 239218 - RNA, 22 nt, Homo sapiens
gugagucaugucccaucugauu

SEQ ID NO: 239219 - RNA, 22 nt, Homo sapiens
gugaguggacgugaccaauaaa

SEQ ID NO: 239220 - RNA, 22 nt, Homo sapiens
gugaugguaguuuguauuucug

SEQ ID NO: 239221 - RNA, 22 nt, Homo sapiens
gugcaaacuccaggucucuuca

SEQ ID NO: 239222 - RNA, 22 nt, Homo sapiens
gugcaacaugccuggcuaauuu

SEQ ID NO: 239223 - RNA, 22 nt, Homo sapiens
gugcaaugaguguggcaaagcc

SEQ ID NO: 239224 - RNA, 22 nt, Homo sapiens
gugcaaugucaggagaugcagc

SEQ ID NO: 239225 - RNA, 22 nt, Homo sapiens
gugcaauguuaauuacuugacu

SEQ ID NO: 239226 - RNA, 22 nt, Homo sapiens
gugcacauuguuuaugucuguu

SEQ ID NO: 239227 - RNA, 23 nt, Homo sapiens
gugcaugagucuuuauaguagca

SEQ ID NO: 239228 - RNA, 22 nt, Homo sapiens
gugcaugucuaugcgagucuaa

SEQ ID NO: 239229 - RNA, 22 nt, Homo sapiens
gugccacaguguuaagggauuc

SEQ ID NO: 239230 - RNA, 22 nt, Homo sapiens
gugccuagugcuauugugcccu

SEQ ID NO: 239231 - RNA, 22 nt, Homo sapiens
ucuuugguucuguuuauguaau

SEQ ID NO: 239232 - RNA, 22 nt, Homo sapiens
ucuuugguuucugucucuguaa

SEQ ID NO: 239233 - RNA, 22 nt, Homo sapiens
ucuuuuugagucaguuucggua

SEQ ID NO: 239234 - RNA, 22 nt, Homo sapiens
ugaaaaguuguugaaggcuuca

SEQ ID NO: 239235 - RNA, 22 nt, Homo sapiens
ugaaacacaccuccucuccauc

SEQ ID NO: 239236 - RNA, 22 nt, Homo sapiens
ugaaagacugaagaauaggcau

SEQ ID NO: 239237 - RNA, 22 nt, Homo sapiens
ugaaauacuuuggcucuuuguu

SEQ ID NO: 239238 - RNA, 22 nt, Homo sapiens
ugaaaugaucaguuugguuacu

SEQ ID NO: 239239 - RNA, 21 nt, Homo sapiens
ugaaaugcaugugcacauuaa

SEQ ID NO: 239240 - RNA, 22 nt, Homo sapiens
ugaaauggugcggucugcagca

SEQ ID NO: 239241 - RNA, 22 nt, Homo sapiens
ugaaaugguuaugugaggagau

SEQ ID NO: 239242 - RNA, 22 nt, Homo sapiens
ugaaaugucuuuaggaggcuuc

SEQ ID NO: 239243 - RNA, 22 nt, Homo sapiens
ugaaauuuuuuauucguuggcu

SEQ ID NO: 239244 - RNA, 16 nt, Homo sapiens
ugaacagagaggauuc

SEQ ID NO: 239245 - RNA, 22 nt, Homo sapiens
ugaacagcacguuuauucagaa

SEQ ID NO: 239246 - RNA, 22 nt, Homo sapiens
ugaaggaguauggauaagucgu

SEQ ID NO: 239247 - RNA, 22 nt, Homo sapiens
ugaaggcaggagggagaaaagu

SEQ ID NO: 239248 - RNA, 22 nt, Homo sapiens
ugaagugaagacucacagaagg

SEQ ID NO: 239249 - RNA, 22 nt, Homo sapiens
ugaagugggaaaugaguauuaa

SEQ ID NO: 239250 - RNA, 22 nt, Homo sapiens
ugaauagaaguuuacuccuuuu

SEQ ID NO: 239251 - RNA, 22 nt, Homo sapiens
ugaauagacacuaaagacugua

SEQ ID NO: 239252 - RNA, 22 nt, Homo sapiens
ugaauagacagucacugccucc

SEQ ID NO: 239253 - RNA, 22 nt, Homo sapiens
ugaauggauccaauucuuagua

SEQ ID NO: 239254 - RNA, 22 nt, Homo sapiens
ugaaugguaaagaaaagcacug

SEQ ID NO: 239255 - RNA, 22 nt, Homo sapiens
ugaauguccauugauguuuuga

SEQ ID NO: 239256 - RNA, 22 nt, Homo sapiens
ugaauguucuuaaaacccuugu

SEQ ID NO: 239257 - RNA, 23 nt, Homo sapiens
ugaauguuuauucucggugcaga

SEQ ID NO: 239258 - RNA, 22 nt, Homo sapiens
ugaauguuugcuuacuuccaua

SEQ ID NO: 239259 - RNA, 22 nt, Homo sapiens
ugaauuguuucauucuuuacau

SEQ ID NO: 239260 - RNA, 22 nt, Homo sapiens
ugacaacugauuaacuccuuua

SEQ ID NO: 239261 - RNA, 22 nt, Homo sapiens
ugacaagugauuaaggcauauu

SEQ ID NO: 239262 - RNA, 22 nt, Homo sapiens
ugacacagcaagauggaaccau

SEQ ID NO: 239263 - RNA, 22 nt, Homo sapiens
ugacagcugaagauguugaacc

SEQ ID NO: 239264 - RNA, 22 nt, Homo sapiens
ugacagugugagauccugucuc

SEQ ID NO: 239265 - RNA, 22 nt, Homo sapiens
ugacaugauuguauauuuagaa

SEQ ID NO: 239266 - RNA, 22 nt, Homo sapiens
ugaccuagaacucuaaugccug

SEQ ID NO: 239267 - RNA, 22 nt, Homo sapiens
ugaccucugauagcaguaggug

SEQ ID NO: 239268 - RNA, 22 nt, Homo sapiens
ugacuacauaaguaaucucaaa

SEQ ID NO: 239269 - RNA, 22 nt, Homo sapiens
ugacucagauagguguguauuc

SEQ ID NO: 239270 - RNA, 22 nt, Homo sapiens
ugacucaguuucucagguagua

SEQ ID NO: 239271 - RNA, 20 nt, Homo sapiens
ugacuggauacccuuuggcu

SEQ ID NO: 239272 - RNA, 18 nt, Homo sapiens
ugacuguccagguggacc

SEQ ID NO: 239273 - RNA, 22 nt, Homo sapiens
ugacuugaaacgugaacagauc

SEQ ID NO: 239274 - RNA, 22 nt, Homo sapiens
ugacuugaucauuacacauucu

SEQ ID NO: 239275 - RNA, 17 nt, Homo sapiens
ugagaacaugugguauu

SEQ ID NO: 239276 - RNA, 18 nt, Homo sapiens
ugagaacauguguacaca

SEQ ID NO: 239277 - RNA, 22 nt, Homo sapiens
ugagaacugccuguauuuaucu

SEQ ID NO: 239278 - RNA, 22 nt, Homo sapiens
ugagaacuuauggugauuuuuu

SEQ ID NO: 239279 - RNA, 22 nt, Homo sapiens
ugagaagacaucuuugcuuugu

SEQ ID NO: 239280 - RNA, 22 nt, Homo sapiens
ugagaagugauauagaaguuaa

SEQ ID NO: 239281 - RNA, 22 nt, Homo sapiens
ugagaauauuuuccaugucuca

SEQ ID NO: 239282 - RNA, 22 nt, Homo sapiens
ugagaaugacugggcaugcugc

SEQ ID NO: 239283 - RNA, 21 nt, Homo sapiens
ugagacaauccuggucaauau

SEQ ID NO: 239284 - RNA, 22 nt, Homo sapiens
ugagacgaagucuugcucuguu

SEQ ID NO: 239285 - RNA, 22 nt, Homo sapiens
ugagacggagucucgcucuguc

SEQ ID NO: 239286 - RNA, 22 nt, Homo sapiens
ugagacggagucuggcacuguc

SEQ ID NO: 239287 - RNA, 22 nt, Homo sapiens
ugagacggagucuugcccuguc

SEQ ID NO: 239288 - RNA, 22 nt, Homo sapiens
ugagacggaguuucgcucuugu

SEQ ID NO: 239289 - RNA, 22 nt, Homo sapiens
ugagacugagucucccucuguc

SEQ ID NO: 239290 - RNA, 22 nt, Homo sapiens
ugagacugagucucgcucuauu

SEQ ID NO: 239291 - RNA, 22 nt, Homo sapiens
ugagacugagucuugcucuauu

SEQ ID NO: 239292 - RNA, 22 nt, Homo sapiens
ugagacugaguuuccaucuugu

SEQ ID NO: 239293 - RNA, 22 nt, Homo sapiens
ugagacugaguuucucucuugu

SEQ ID NO: 239294 - RNA, 22 nt, Homo sapiens
ugagacugaguuuugcucguug

SEQ ID NO: 239295 - RNA, 22 nt, Homo sapiens
ugagagacaguuuguuaaaauu

SEQ ID NO: 239296 - RNA, 22 nt, Homo sapiens
ugagagcuuugaugcacuguuu

SEQ ID NO: 239297 - RNA, 22 nt, Homo sapiens
ugagaggugauaaagcaagggu

SEQ ID NO: 239298 - RNA, 22 nt, Homo sapiens
aguauguuuugaaaccaagaag

SEQ ID NO: 239299 - RNA, 22 nt, Homo sapiens
aguauugcuaauaagagauuug

SEQ ID NO: 239300 - RNA, 22 nt, Homo sapiens
agucacagugaccuugucugac

SEQ ID NO: 239301 - RNA, 22 nt, Homo sapiens
agucagauuggcauuuguuggg

SEQ ID NO: 239302 - RNA, 22 nt, Homo sapiens
agucaguguguauugauggcac

SEQ ID NO: 239303 - RNA, 22 nt, Homo sapiens
agugaauuguucaacaggagga

SEQ ID NO: 239304 - RNA, 22 nt, Homo sapiens
agugagcuggagaaaagaaacu

SEQ ID NO: 239305 - RNA, 22 nt, Homo sapiens
agugcaaagccgagguuucuug

SEQ ID NO: 239306 - RNA, 22 nt, Homo sapiens
agugcaauggcgugaucuuggc

SEQ ID NO: 239307 - RNA, 22 nt, Homo sapiens
agugcaauggugccaucauagc

SEQ ID NO: 239308 - RNA, 22 nt, Homo sapiens
agugcaguggcacaaucuuggc

SEQ ID NO: 239309 - RNA, 22 nt, Homo sapiens
agugcaguggugccaucauaac

SEQ ID NO: 239310 - RNA, 22 nt, Homo sapiens
agugcauuugcaucucaauaua

SEQ ID NO: 239311 - RNA, 22 nt, Homo sapiens
agugccacugcacucuagccug

SEQ ID NO: 239312 - RNA, 22 nt, Homo sapiens
aguggaauuaagaaacugaauu

SEQ ID NO: 239313 - RNA, 22 nt, Homo sapiens
aguggauguuguggccugggag

SEQ ID NO: 239314 - RNA, 22 nt, Homo sapiens
aguguuuuuacaagcacucugg

SEQ ID NO: 239315 - RNA, 22 nt, Homo sapiens
auaaacagcuuauccucuauuc

SEQ ID NO: 239316 - RNA, 19 nt, Homo sapiens
auaaacuagaacugucccc

SEQ ID NO: 239317 - RNA, 18 nt, Homo sapiens
auaaacucaucauuuuua

SEQ ID NO: 239318 - RNA, 22 nt, Homo sapiens
auaaagcuauuccucucuuuuu

SEQ ID NO: 239319 - RNA, 22 nt, Homo sapiens
auaaagguaauaauaguugcau

SEQ ID NO: 239320 - RNA, 22 nt, Homo sapiens
auaaaguguuuaguauaggcaa

SEQ ID NO: 239321 - RNA, 22 nt, Homo sapiens
auaagauaguggaagugggauu

SEQ ID NO: 239322 - RNA, 22 nt, Homo sapiens
auaagguuagcucugagaaagu

SEQ ID NO: 239323 - RNA, 22 nt, Homo sapiens
auaaguagaaugauggucaaaa

SEQ ID NO: 239324 - RNA, 22 nt, Homo sapiens
auaaucaugucugaaaccuuug

SEQ ID NO: 239325 - RNA, 22 nt, Homo sapiens
auaaugacuuccaguuccacuc

SEQ ID NO: 239326 - RNA, 22 nt, Homo sapiens
auacaaggaaugaagagauuug

SEQ ID NO: 239327 - RNA, 22 nt, Homo sapiens
auacagugaauacuuacagugu

SEQ ID NO: 239328 - RNA, 22 nt, Homo sapiens
auacaguguauguauaguacau

SEQ ID NO: 239329 - RNA, 22 nt, Homo sapiens
auacauguucaagggcauauau

SEQ ID NO: 239330 - RNA, 20 nt, Homo sapiens
auagaagacuagugcagcag

SEQ ID NO: 239331 - RNA, 22 nt, Homo sapiens
auagaagcuauguauaggggcc

SEQ ID NO: 239332 - RNA, 22 nt, Homo sapiens
auagaaucaucugugcacuagu

SEQ ID NO: 239333 - RNA, 22 nt, Homo sapiens
auagagcuggcagacacccuua

SEQ ID NO: 239334 - RNA, 21 nt, Homo sapiens
auagcacaucagauuuuauua

SEQ ID NO: 239335 - RNA, 22 nt, Homo sapiens
auagcagcaccccacuaccuca

SEQ ID NO: 239336 - RNA, 22 nt, Homo sapiens
auagcagcuugucagggcagac

SEQ ID NO: 239337 - RNA, 22 nt, Homo sapiens
auagcaggagaauggucauggg

SEQ ID NO: 239338 - RNA, 22 nt, Homo sapiens
auagcagugugaaaacagacua

SEQ ID NO: 239339 - RNA, 22 nt, Homo sapiens
auagcagugugaaaauugacug

SEQ ID NO: 239340 - RNA, 22 nt, Homo sapiens
auagcauaucccacaugucaga

SEQ ID NO: 239341 - RNA, 22 nt, Homo sapiens
auagcuguugaauggaauauuc

SEQ ID NO: 239342 - RNA, 22 nt, Homo sapiens
auagguauguaauacaaaugaa

SEQ ID NO: 239343 - RNA, 22 nt, Homo sapiens
auagucaguagucucauaauga

SEQ ID NO: 239344 - RNA, 21 nt, Homo sapiens
auagugcuagagaguagcagg

SEQ ID NO: 239345 - RNA, 22 nt, Homo sapiens
auagugcugcaaucaacauaca

SEQ ID NO: 239346 - RNA, 22 nt, Homo sapiens
auagugcugcacuaaacauaca

SEQ ID NO: 239347 - RNA, 22 nt, Homo sapiens
auagugcugccauaaacauacg

SEQ ID NO: 239348 - RNA, 23 nt, Homo sapiens
auauaguagaugugcaguaacau

SEQ ID NO: 239349 - RNA, 22 nt, Homo sapiens
auaucacaaacaagucuguacu

SEQ ID NO: 239350 - RNA, 17 nt, Homo sapiens
auaugaauuuuggagau

SEQ ID NO: 239351 - RNA, 22 nt, Homo sapiens
auaugcacgugcauacacacuu

SEQ ID NO: 239352 - RNA, 22 nt, Homo sapiens
auaugcacuauacacacguaua

SEQ ID NO: 239353 - RNA, 22 nt, Homo sapiens
auaugcauacccucaccaacua

SEQ ID NO: 239354 - RNA, 22 nt, Homo sapiens
auaugguguuugcuauucagcu

SEQ ID NO: 239355 - RNA, 20 nt, Homo sapiens
auaugguugugagugauuuu

SEQ ID NO: 239356 - RNA, 22 nt, Homo sapiens
auaugucuauuauuagggcagg

SEQ ID NO: 239357 - RNA, 21 nt, Homo sapiens
auaugugcuguggaagucagc

SEQ ID NO: 239358 - RNA, 22 nt, Homo sapiens
auauuacuggccauaucgcagg

SEQ ID NO: 239359 - RNA, 22 nt, Homo sapiens
auauuacuggcuauaucgcaag

SEQ ID NO: 239360 - RNA, 22 nt, Homo sapiens
aucaaagccaugcucaguuuuc

SEQ ID NO: 239361 - RNA, 22 nt, Homo sapiens
ugcuaugucuucucucacagag

SEQ ID NO: 239362 - RNA, 22 nt, Homo sapiens
ugcucaccugcugcucaccucc

SEQ ID NO: 239363 - RNA, 21 nt, Homo sapiens
ugcuccauuuucuagccugaa

SEQ ID NO: 239364 - RNA, 23 nt, Homo sapiens
ugcuccccucauggaugaauaaa

SEQ ID NO: 239365 - RNA, 22 nt, Homo sapiens
ugcugcaaacaggcaucugugg

SEQ ID NO: 239366 - RNA, 20 nt, Homo sapiens
ugcugcacuuaagcaugggc

SEQ ID NO: 239367 - RNA, 22 nt, Homo sapiens
ugcugcuguuguuguuacuagc

SEQ ID NO: 239368 - RNA, 22 nt, Homo sapiens
ugcuggugauucagauucaaau

SEQ ID NO: 239369 - RNA, 22 nt, Homo sapiens
ugcuggugucaucaaggcuuug

SEQ ID NO: 239370 - RNA, 22 nt, Homo sapiens
ugcuguguugcuggcuuaaaga

SEQ ID NO: 239371 - RNA, 22 nt, Homo sapiens
ugcuuuguugaaaaucauuugg

SEQ ID NO: 239372 - RNA, 22 nt, Homo sapiens
uggaaaguccaagccaaccggg

SEQ ID NO: 239373 - RNA, 22 nt, Homo sapiens
uggaaauaaaugugccaagauc

SEQ ID NO: 239374 - RNA, 22 nt, Homo sapiens
uggaaauuaagucuuuccugag

SEQ ID NO: 239375 - RNA, 19 nt, Homo sapiens
uggaacauaaaaguugguu

SEQ ID NO: 239376 - RNA, 22 nt, Homo sapiens
uggaagcaugcaaucugugggg

SEQ ID NO: 239377 - RNA, 22 nt, Homo sapiens
uggaagccuagauucuuuucuu

SEQ ID NO: 239378 - RNA, 22 nt, Homo sapiens
uggaaguuaaauuaguugauga

SEQ ID NO: 239379 - RNA, 22 nt, Homo sapiens
uggaaucuagagaaaugcaaac

SEQ ID NO: 239380 - RNA, 20 nt, Homo sapiens
uggaaucuaggcggagguuu

SEQ ID NO: 239381 - RNA, 21 nt, Homo sapiens
uggaaucuauuauuccaguuu

SEQ ID NO: 239382 - RNA, 20 nt, Homo sapiens
uggaaucugaagaucucagu

SEQ ID NO: 239383 - RNA, 22 nt, Homo sapiens
uggaauggagagagggugcacg

SEQ ID NO: 239384 - RNA, 22 nt, Homo sapiens
uggaauguauaucguuuuuugu

SEQ ID NO: 239385 - RNA, 21 nt, Homo sapiens
uggaccccuuccagucaucau

SEQ ID NO: 239386 - RNA, 21 nt, Homo sapiens
uggaccccuuccuuacaucau

SEQ ID NO: 239387 - RNA, 21 nt, Homo sapiens
uggaccccuuccuugcaccau

SEQ ID NO: 239388 - RNA, 22 nt, Homo sapiens
uggacuguaaauuggggacucu

SEQ ID NO: 239389 - RNA, 22 nt, Homo sapiens
uggagaacauucauuugcaaga

SEQ ID NO: 239390 - RNA, 22 nt, Homo sapiens
uggagagugauaaguaaaugga

SEQ ID NO: 239391 - RNA, 23 nt, Homo sapiens
uggaggacaagcauggauaguga

SEQ ID NO: 239392 - RNA, 22 nt, Homo sapiens
uggagguaggacgaagaacucu

SEQ ID NO: 239393 - RNA, 22 nt, Homo sapiens
uggagugcaauggugagaucuu

SEQ ID NO: 239394 - RNA, 22 nt, Homo sapiens
uggagugcgugucugaguuuuu

SEQ ID NO: 239395 - RNA, 22 nt, Homo sapiens
uggaguuugacaugccuuuggg

SEQ ID NO: 239396 - RNA, 20 nt, Homo sapiens
uggaguuugaguucuuggag

SEQ ID NO: 239397 - RNA, 22 nt, Homo sapiens
uggaugccuaauaaaugcagac

SEQ ID NO: 239398 - RNA, 22 nt, Homo sapiens
uggauguaauugauucauguug

SEQ ID NO: 239399 - RNA, 21 nt, Homo sapiens
uggauugagaaccccaggagg

SEQ ID NO: 239400 - RNA, 22 nt, Homo sapiens
uggugccgugguccuggggcca

SEQ ID NO: 239401 - RNA, 22 nt, Homo sapiens
uggugcuuaaauaaggcuuuca

SEQ ID NO: 239402 - RNA, 22 nt, Homo sapiens
ugguguccugucucugcgcuug

SEQ ID NO: 239403 - RNA, 22 nt, Homo sapiens
ugguuguuuuaaaugucgucug

SEQ ID NO: 239404 - RNA, 22 nt, Homo sapiens
uguaaaccauauauguauguag

SEQ ID NO: 239405 - RNA, 16 nt, Homo sapiens
uguaaauguuuugcau

SEQ ID NO: 239406 - RNA, 20 nt, Homo sapiens
uguaacacauggagaacucu

SEQ ID NO: 239407 - RNA, 22 nt, Homo sapiens
uguaagcauugggcaugcaguc

SEQ ID NO: 239408 - RNA, 22 nt, Homo sapiens
uguaauaguaggcucacauuug

SEQ ID NO: 239409 - RNA, 22 nt, Homo sapiens
uguaauuuaaaugauccuugga

SEQ ID NO: 239410 - RNA, 22 nt, Homo sapiens
uguagauaucuaucaggucaau

SEQ ID NO: 239411 - RNA, 22 nt, Homo sapiens
uguagcaaaucgauacuauugg

SEQ ID NO: 239412 - RNA, 22 nt, Homo sapiens
uguagcagccauaaacacagug

SEQ ID NO: 239413 - RNA, 22 nt, Homo sapiens
uguagcuuuugagauuuauauu

SEQ ID NO: 239414 - RNA, 22 nt, Homo sapiens
uguaguuugaaagcucccucug

SEQ ID NO: 239415 - RNA, 22 nt, Homo sapiens
uguauagaucugauucaucucc

SEQ ID NO: 239416 - RNA, 22 nt, Homo sapiens
uguauguugauguuauauucug

SEQ ID NO: 239417 - RNA, 22 nt, Homo sapiens
ugucaaauucuggguuaaaaca

SEQ ID NO: 239418 - RNA, 21 nt, Homo sapiens
ugucaagaugacugcugcggc

SEQ ID NO: 239419 - RNA, 22 nt, Homo sapiens
ugucaagaugguuugauguugu

SEQ ID NO: 239420 - RNA, 22 nt, Homo sapiens
ugucaauauguaauaacugaau

SEQ ID NO: 239421 - RNA, 22 nt, Homo sapiens
ugucacaguuuguacuuuauag

SEQ ID NO: 239422 - RNA, 22 nt, Homo sapiens
ugucacccuuuauccauuuccu

SEQ ID NO: 239423 - RNA, 22 nt, Homo sapiens
ugucagcacaacucagguuccu

SEQ ID NO: 239424 - RNA, 22 nt, Homo sapiens
ugucaggagcaaugauaaauuu

SEQ ID NO: 239425 - RNA, 22 nt, Homo sapiens
ugucaguuuuaacuagggaaua

SEQ ID NO: 239426 - RNA, 22 nt, Homo sapiens
ugucauagauugcuuggaaaaa

SEQ ID NO: 239427 - RNA, 22 nt, Homo sapiens
ugucaugguagcaaggacgagg

SEQ ID NO: 239428 - RNA, 22 nt, Homo sapiens
ugucauggugcucugggcccug

SEQ ID NO: 239429 - RNA, 22 nt, Homo sapiens
ugucauguaaagaguaaauggu

SEQ ID NO: 239430 - RNA, 22 nt, Homo sapiens
uguccaaauugaaucaucuggu

SEQ ID NO: 239431 - RNA, 22 nt, Homo sapiens
uguccugcagagguguuugccu

SEQ ID NO: 239432 - RNA, 22 nt, Homo sapiens
ugucuaaagaauggcagacuca

SEQ ID NO: 239433 - RNA, 22 nt, Homo sapiens
ugucuagaucugaauguaauug

SEQ ID NO: 239434 - RNA, 22 nt, Homo sapiens
ugucuaguuuugaaguauagca

SEQ ID NO: 239435 - RNA, 22 nt, Homo sapiens
ugucucaguuacggcaauucca

SEQ ID NO: 239436 - RNA, 22 nt, Homo sapiens
ugucugagacuguuuuacuuuc

SEQ ID NO: 239437 - RNA, 22 nt, Homo sapiens
ugucuuggagaauccuggguuu

SEQ ID NO: 239438 - RNA, 22 nt, Homo sapiens
ugugaacagcagcugggcuuug

SEQ ID NO: 239439 - RNA, 22 nt, Homo sapiens
ugugaacaugacagugggcuag

SEQ ID NO: 239440 - RNA, 22 nt, Homo sapiens
cacugcauuggaugguuccucc

SEQ ID NO: 239441 - RNA, 22 nt, Homo sapiens
cacugcgaccuccaccucccgg

SEQ ID NO: 239442 - RNA, 22 nt, Homo sapiens
cacugcgacguccgccucccgg

SEQ ID NO: 239443 - RNA, 22 nt, Homo sapiens
cacuggucagugaaacaguauu

SEQ ID NO: 239444 - RNA, 22 nt, Homo sapiens
cacuggucucauggcaugagag

SEQ ID NO: 239445 - RNA, 22 nt, Homo sapiens
cacuguggauggaacuauguga

SEQ ID NO: 239446 - RNA, 22 nt, Homo sapiens
cagauacuccuggucucaggag

SEQ ID NO: 239447 - RNA, 22 nt, Homo sapiens
cagaugcaugaccugggcuugg

SEQ ID NO: 239448 - RNA, 22 nt, Homo sapiens
cagcagguuuuuaucaguuaag

SEQ ID NO: 239449 - RNA, 22 nt, Homo sapiens
cagcgaggucugcgucacauug

SEQ ID NO: 239450 - RNA, 22 nt, Homo sapiens
cagcucuuguuaaaacuaacua

SEQ ID NO: 239451 - RNA, 23 nt, Homo sapiens
cagcuggugauuuuaaguugaag

SEQ ID NO: 239452 - RNA, 22 nt, Homo sapiens
caggaccucuugccuggaagcc

SEQ ID NO: 239453 - RNA, 22 nt, Homo sapiens
caggcaaggugaaguguacugg

SEQ ID NO: 239454 - RNA, 22 nt, Homo sapiens
cagguacuucugggcugagcag

SEQ ID NO: 239455 - RNA, 22 nt, Homo sapiens
cagguagucaacgggucuugga

SEQ ID NO: 239456 - RNA, 19 nt, Homo sapiens
cagguagugugcugacaug

SEQ ID NO: 239457 - RNA, 22 nt, Homo sapiens
caggugcauuggcugacaccug

SEQ ID NO: 239458 - RNA, 23 nt, Homo sapiens
cagugcaugacuguauaugcaaa

SEQ ID NO: 239459 - RNA, 22 nt, Homo sapiens
cagugcaugacuguauauuauc

SEQ ID NO: 239460 - RNA, 22 nt, Homo sapiens
cagugcauguggcacucuccag

SEQ ID NO: 239461 - RNA, 22 nt, Homo sapiens
cagugcuuuaucaaguccucca

SEQ ID NO: 239462 - RNA, 22 nt, Homo sapiens
cagugguuuucucaguucagca

SEQ ID NO: 239463 - RNA, 22 nt, Homo sapiens
caguuguuuuaugacauaagau

SEQ ID NO: 239464 - RNA, 22 nt, Homo sapiens
cauacaguaggcacuauuugua

SEQ ID NO: 239465 - RNA, 22 nt, Homo sapiens
cauaguacuugcauaguacuau

SEQ ID NO: 239466 - RNA, 21 nt, Homo sapiens
caucaaauugucauggugggu

SEQ ID NO: 239467 - RNA, 22 nt, Homo sapiens
caucacacuuggauguaagaca

SEQ ID NO: 239468 - RNA, 22 nt, Homo sapiens
caucacaguacuaaucgucaua

SEQ ID NO: 239469 - RNA, 23 nt, Homo sapiens
caucacauagaggaaagaggaca

SEQ ID NO: 239470 - RNA, 21 nt, Homo sapiens
caucacauuacucaaaguccu

SEQ ID NO: 239471 - RNA, 22 nt, Homo sapiens
caucccugaaccccagaaaucu

SEQ ID NO: 239472 - RNA, 23 nt, Homo sapiens
caugaacuaguuugcagccauga

SEQ ID NO: 239473 - RNA, 22 nt, Homo sapiens
caugauauugcagaauguuggu

SEQ ID NO: 239474 - RNA, 22 nt, Homo sapiens
caugaugcuagguauggaugaa

SEQ ID NO: 239475 - RNA, 19 nt, Homo sapiens
caugccacugcacuugagu

SEQ ID NO: 239476 - RNA, 22 nt, Homo sapiens
caugccacuguggacaaagaca

SEQ ID NO: 239477 - RNA, 22 nt, Homo sapiens
cauggagcuaggcuugaucccu

SEQ ID NO: 239478 - RNA, 22 nt, Homo sapiens
cauggauuuuuuugaauggcag

SEQ ID NO: 239479 - RNA, 22 nt, Homo sapiens
cauggcccugggcugggcgaac

SEQ ID NO: 239480 - RNA, 22 nt, Homo sapiens
cauggcucuuugcugcuaaagu

SEQ ID NO: 239481 - RNA, 22 nt, Homo sapiens
cauggcuuuauuuucagcuucu

SEQ ID NO: 239482 - RNA, 22 nt, Homo sapiens
caugggacugucuuggcuauac

SEQ ID NO: 239483 - RNA, 21 nt, Homo sapiens
caugucacugcacucuagccu

SEQ ID NO: 239484 - RNA, 22 nt, Homo sapiens
cauugcacuccagccugcugac

SEQ ID NO: 239485 - RNA, 22 nt, Homo sapiens
cauugcacucuagucuggguga

SEQ ID NO: 239486 - RNA, 22 nt, Homo sapiens
cauuggugauuagugaaugaac

SEQ ID NO: 239487 - RNA, 22 nt, Homo sapiens
cauugguuuauagauggggaaa

SEQ ID NO: 239488 - RNA, 22 nt, Homo sapiens
cauugguuuuucaggaguauau

SEQ ID NO: 239489 - RNA, 22 nt, Homo sapiens
cauugucccucaaugucuauga

SEQ ID NO: 239490 - RNA, 22 nt, Homo sapiens
cauuugcacugagacucagcuu

SEQ ID NO: 239491 - RNA, 22 nt, Homo sapiens
cauuugguggcuacagaguaac

SEQ ID NO: 239492 - RNA, 22 nt, Homo sapiens
cauuuuacuuuccagacgugga

SEQ ID NO: 239493 - RNA, 22 nt, Homo sapiens
ccaaaguauuuucacugauauc

SEQ ID NO: 239494 - RNA, 22 nt, Homo sapiens
ccaaggcacugauucuguacuc

SEQ ID NO: 239495 - RNA, 22 nt, Homo sapiens
ccacagucuaugcaacaagguc

SEQ ID NO: 239496 - RNA, 22 nt, Homo sapiens
ccacaguggauuaaaguuacug

SEQ ID NO: 239497 - RNA, 22 nt, Homo sapiens
ccacccuggagaauuugagguc

SEQ ID NO: 239498 - RNA, 22 nt, Homo sapiens
uuagagguaggauuucaccaug

SEQ ID NO: 239499 - RNA, 22 nt, Homo sapiens
uuagaugaaugucucuuaaaca

SEQ ID NO: 239500 - RNA, 22 nt, Homo sapiens
uuagcagcacaaaagcagacua

SEQ ID NO: 239501 - RNA, 22 nt, Homo sapiens
uuagcagccuucaagcuccaag

SEQ ID NO: 239502 - RNA, 22 nt, Homo sapiens
uuagcucaguuggugagagcgu

SEQ ID NO: 239503 - RNA, 22 nt, Homo sapiens
uuaggcaggauaguuacauauu

SEQ ID NO: 239504 - RNA, 22 nt, Homo sapiens
uuagggaggcucaggacaagag

SEQ ID NO: 239505 - RNA, 22 nt, Homo sapiens
uuaguaguagugcuguaauuuu

SEQ ID NO: 239506 - RNA, 22 nt, Homo sapiens
uuaguaguugugauagguaccu

SEQ ID NO: 239507 - RNA, 22 nt, Homo sapiens
uuaguucauugugacuggacuc

SEQ ID NO: 239508 - RNA, 22 nt, Homo sapiens
uuaguucccucauucuugacuu

SEQ ID NO: 239509 - RNA, 22 nt, Homo sapiens
uuaguuuaucagugguuucuga

SEQ ID NO: 239510 - RNA, 18 nt, Homo sapiens
uuauacuccccaggcaau

SEQ ID NO: 239511 - RNA, 22 nt, Homo sapiens
uuauagcagugcaggaacagac

SEQ ID NO: 239512 - RNA, 22 nt, Homo sapiens
uuauagcuaacaucugugaaaa

SEQ ID NO: 239513 - RNA, 20 nt, Homo sapiens
uuauagcuacaucuugacug

SEQ ID NO: 239514 - RNA, 22 nt, Homo sapiens
uuaucacauugacugauuugca

SEQ ID NO: 239515 - RNA, 22 nt, Homo sapiens
uuaucauagugcaguuuucuga

SEQ ID NO: 239516 - RNA, 22 nt, Homo sapiens
uuauccucuagacauagguuua

SEQ ID NO: 239517 - RNA, 22 nt, Homo sapiens
uuaugacaggcucaggagcccc

SEQ ID NO: 239518 - RNA, 22 nt, Homo sapiens
uuaugacauugacaguuuuuag

SEQ ID NO: 239519 - RNA, 22 nt, Homo sapiens
uuaugcuguuuucuggagauuu

SEQ ID NO: 239520 - RNA, 22 nt, Homo sapiens
uuaugcuugugugaauuuuccc

SEQ ID NO: 239521 - RNA, 22 nt, Homo sapiens
uuauggauuuauauucuguagu

SEQ ID NO: 239522 - RNA, 22 nt, Homo sapiens
uuauggcuuugcgguguuagca

SEQ ID NO: 239523 - RNA, 22 nt, Homo sapiens
uuaugguacaugugcacaaugu

SEQ ID NO: 239524 - RNA, 22 nt, Homo sapiens
uuauguccuuuaacuucaucac

SEQ ID NO: 239525 - RNA, 22 nt, Homo sapiens
uuauuagcacccuaccaugugg

SEQ ID NO: 239526 - RNA, 22 nt, Homo sapiens
uuauucugucuuuggucucaau

SEQ ID NO: 239527 - RNA, 17 nt, Homo sapiens
uuauugcuauaagcuga

SEQ ID NO: 239528 - RNA, 22 nt, Homo sapiens
uuauuugguuauuguaauuggg

SEQ ID NO: 239529 - RNA, 22 nt, Homo sapiens
uucaagaauuaaaguggcuuuu

SEQ ID NO: 239530 - RNA, 22 nt, Homo sapiens
uucaagucaacaagcacuugag

SEQ ID NO: 239531 - RNA, 22 nt, Homo sapiens
uucaagucuuggcuuugccacc

SEQ ID NO: 239532 - RNA, 21 nt, Homo sapiens
uucacaagggaaguagggggc

SEQ ID NO: 239533 - RNA, 22 nt, Homo sapiens
uucacaaugccuuguugauggu

SEQ ID NO: 239534 - RNA, 22 nt, Homo sapiens
uucacacuagccacucugguag

SEQ ID NO: 239535 - RNA, 22 nt, Homo sapiens
uucacagucacccuucuccaug

SEQ ID NO: 239536 - RNA, 22 nt, Homo sapiens
uucacccugguuguagauggac

SEQ ID NO: 239537 - RNA, 22 nt, Homo sapiens
uucaccggggaccccuggcugu

SEQ ID NO: 239538 - RNA, 22 nt, Homo sapiens
uucaccuggaguucaggauaag

SEQ ID NO: 239539 - RNA, 23 nt, Homo sapiens
uucaccugguuauuaauagccuc

SEQ ID NO: 239540 - RNA, 22 nt, Homo sapiens
uucacugagccagacuaagaca

SEQ ID NO: 239541 - RNA, 22 nt, Homo sapiens
uucacugugaauaaaggcuccc

SEQ ID NO: 239542 - RNA, 22 nt, Homo sapiens
uucagagugaggcucucggaac

SEQ ID NO: 239543 - RNA, 22 nt, Homo sapiens
uucagaguggacagaaauuaag

SEQ ID NO: 239544 - RNA, 22 nt, Homo sapiens
uucagagugguaugaagugaug

SEQ ID NO: 239545 - RNA, 20 nt, Homo sapiens
uucagcaaaggaaugggagu

SEQ ID NO: 239546 - RNA, 22 nt, Homo sapiens
uucagcacugaaaauaugucau

SEQ ID NO: 239547 - RNA, 22 nt, Homo sapiens
uucagcuacuuggaaacagcaa

SEQ ID NO: 239548 - RNA, 22 nt, Homo sapiens
uucaggcuuuuauuuacugaua

SEQ ID NO: 239549 - RNA, 22 nt, Homo sapiens
uucagggcauuggaguuucuga

SEQ ID NO: 239550 - RNA, 22 nt, Homo sapiens
uucaguggacuuaguagugcuu

SEQ ID NO: 239551 - RNA, 22 nt, Homo sapiens
uucaguggagaggcugaguggu

SEQ ID NO: 239552 - RNA, 22 nt, Homo sapiens
uucagugguuauuugugagauu

SEQ ID NO: 239553 - RNA, 22 nt, Homo sapiens
uucagugucauuaacacaguag

SEQ ID NO: 239554 - RNA, 22 nt, Homo sapiens
uucauaguaacaguaacuaugg

SEQ ID NO: 239555 - RNA, 22 nt, Homo sapiens
uucauagucuaugcaaguaaga

SEQ ID NO: 239556 - RNA, 22 nt, Homo sapiens
uucauaguucuuuuagucauua

SEQ ID NO: 239557 - RNA, 22 nt, Homo sapiens
uucauaguuuauacugauauuu

SEQ ID NO: 239558 - RNA, 22 nt, Homo sapiens
uucaucagggguauuggccaau

SEQ ID NO: 239559 - RNA, 22 nt, Homo sapiens
uucauggacucaauaguuucgc

SEQ ID NO: 239560 - RNA, 22 nt, Homo sapiens
uucauggaguugagaaggcuaa

SEQ ID NO: 239561 - RNA, 22 nt, Homo sapiens
uucauggaguuuaaauuguagu

SEQ ID NO: 239562 - RNA, 22 nt, Homo sapiens
uucauguaauauauuucaggcc

SEQ ID NO: 239563 - RNA, 22 nt, Homo sapiens
uucauguaauauuucacagcuu

SEQ ID NO: 239564 - RNA, 22 nt, Homo sapiens
uucauguaauuccauaagguaa

SEQ ID NO: 239565 - RNA, 22 nt, Homo sapiens
uucaugugagucuguauuaacu

SEQ ID NO: 239566 - RNA, 22 nt, Homo sapiens
uucauuggacuuguguucuuga

SEQ ID NO: 239567 - RNA, 23 nt, Homo sapiens
uuccaccauugacuaguuacaua

SEQ ID NO: 239568 - RNA, 22 nt, Homo sapiens
uuccacuuuuuccuugugcucc

SEQ ID NO: 239569 - RNA, 22 nt, Homo sapiens
uuccaguugugagcuauccggg

SEQ ID NO: 239570 - RNA, 22 nt, Homo sapiens
uuccaugugggcuugucaagua

SEQ ID NO: 239571 - RNA, 22 nt, Homo sapiens
uucccagagccugggagugagg

SEQ ID NO: 239572 - RNA, 22 nt, Homo sapiens
uucccugaaguguuacucuaga

SEQ ID NO: 239573 - RNA, 22 nt, Homo sapiens
uucccugagcaucuguugagcc

SEQ ID NO: 239574 - RNA, 22 nt, Homo sapiens
uucccuguaucuucugccaugu

SEQ ID NO: 239575 - RNA, 22 nt, Homo sapiens
uucccugugguauagaagccgu

SEQ ID NO: 239576 - RNA, 22 nt, Homo sapiens
uucccuuucugaaaaucucauu

SEQ ID NO: 239577 - RNA, 22 nt, Homo sapiens
uucccuuucuuaaagaguuagg

SEQ ID NO: 239578 - RNA, 22 nt, Homo sapiens
uucccuuuguuaaauuggaaga

SEQ ID NO: 239579 - RNA, 22 nt, Homo sapiens
uucccuuuuuucuaguagguag

SEQ ID NO: 239580 - RNA, 22 nt, Homo sapiens
uuccuacuguucaucaggaacc

SEQ ID NO: 239581 - RNA, 22 nt, Homo sapiens
uuccugucuuccaagagagauu

SEQ ID NO: 239582 - RNA, 22 nt, Homo sapiens
uuccuuguuuauuuacaggagg

SEQ ID NO: 239583 - RNA, 20 nt, Homo sapiens
uucuauggugaugaguccug

SEQ ID NO: 239584 - RNA, 22 nt, Homo sapiens
uucucagugaacuccagcuugu

SEQ ID NO: 239585 - RNA, 22 nt, Homo sapiens
uucuccugguggacccuaaacg

SEQ ID NO: 239586 - RNA, 22 nt, Homo sapiens
uucucuggucagaggggagguu

SEQ ID NO: 239587 - RNA, 22 nt, Homo sapiens
uucugagguuauauucucucaa

SEQ ID NO: 239588 - RNA, 22 nt, Homo sapiens
uucugaguggcuuucaacacug

SEQ ID NO: 239589 - RNA, 22 nt, Homo sapiens
uucugauggaguaguccacaga

SEQ ID NO: 239590 - RNA, 22 nt, Homo sapiens
uucugcuugaucuaguguguug

SEQ ID NO: 239591 - RNA, 22 nt, Homo sapiens
uucuggccuccauuuuucuccu

SEQ ID NO: 239592 - RNA, 22 nt, Homo sapiens
uucuggcuaugggauacuaaau

SEQ ID NO: 239593 - RNA, 22 nt, Homo sapiens
uucuggcucaggucaacacuuc

SEQ ID NO: 239594 - RNA, 22 nt, Homo sapiens
uucugugcugaaucaaagacug

SEQ ID NO: 239595 - RNA, 22 nt, Homo sapiens
uucugugcuuguggaugaagug

SEQ ID NO: 239596 - RNA, 22 nt, Homo sapiens
uucuuagucaaguuguauuuca

SEQ ID NO: 239597 - RNA, 21 nt, Homo sapiens
uucuucaggcagaaggauuau

SEQ ID NO: 239598 - RNA, 22 nt, Homo sapiens
uucuugcacuuaacugacauuc

SEQ ID NO: 239599 - RNA, 22 nt, Homo sapiens
ggcaguguuauuauauuuuugg

SEQ ID NO: 239600 - RNA, 22 nt, Homo sapiens
ggcaguuucucaggcaggggua

SEQ ID NO: 239601 - RNA, 22 nt, Homo sapiens
ggcaguuuggcaguuucauaaa

SEQ ID NO: 239602 - RNA, 22 nt, Homo sapiens
ggcaguuuguuugugaggucca

SEQ ID NO: 239603 - RNA, 21 nt, Homo sapiens
ggcaugaauggaaaagugaga

SEQ ID NO: 239604 - RNA, 22 nt, Homo sapiens
ggccggguggccauggcugccc

SEQ ID NO: 239605 - RNA, 22 nt, Homo sapiens
ggccugaugaaauguuagagua

SEQ ID NO: 239606 - RNA, 22 nt, Homo sapiens
ggcucaguuuccuccgucugcu

SEQ ID NO: 239607 - RNA, 22 nt, Homo sapiens
gggaagauauaggcugggcacc

SEQ ID NO: 239608 - RNA, 22 nt, Homo sapiens
gggaagguaaucauuacuugau

SEQ ID NO: 239609 - RNA, 22 nt, Homo sapiens
gggaagugugcagaguucucuu

SEQ ID NO: 239610 - RNA, 22 nt, Homo sapiens
gggaaugaagagaaccuuccca

SEQ ID NO: 239611 - RNA, 22 nt, Homo sapiens
gggagcacaagaaauguuucau

SEQ ID NO: 239612 - RNA, 22 nt, Homo sapiens
gggagguaggaguuauuauuuu

SEQ ID NO: 239613 - RNA, 22 nt, Homo sapiens
gggaggucauuguaaggucuua

SEQ ID NO: 239614 - RNA, 22 nt, Homo sapiens
gggcagaugucuggacaccuca

SEQ ID NO: 239615 - RNA, 17 nt, Homo sapiens
gggucaccuugcaggua

SEQ ID NO: 239616 - RNA, 22 nt, Homo sapiens
ggguucccuucuggcucagggu

SEQ ID NO: 239617 - RNA, 22 nt, Homo sapiens
gguaaacauaagagagcugacu

SEQ ID NO: 239618 - RNA, 22 nt, Homo sapiens
gguauugguugagauuaacuuu

SEQ ID NO: 239619 - RNA, 22 nt, Homo sapiens
ggucaacaucaucaugguaagu

SEQ ID NO: 239620 - RNA, 22 nt, Homo sapiens
ggucauggagcuuuacuuuaug

SEQ ID NO: 239621 - RNA, 22 nt, Homo sapiens
ggucugguguugaaauucuuca

SEQ ID NO: 239622 - RNA, 22 nt, Homo sapiens
ggucuuggagaauuguccuggg

SEQ ID NO: 239623 - RNA, 22 nt, Homo sapiens
ggugagaaaaacauagucucag

SEQ ID NO: 239624 - RNA, 22 nt, Homo sapiens
ggugagauguucagacgaacug

SEQ ID NO: 239625 - RNA, 22 nt, Homo sapiens
ggugagcacagaaugcccugag

SEQ ID NO: 239626 - RNA, 22 nt, Homo sapiens
guaaaugcagaugcaugaccuu

SEQ ID NO: 239627 - RNA, 22 nt, Homo sapiens
guaacacaugcugcucucuggu

SEQ ID NO: 239628 - RNA, 22 nt, Homo sapiens
guaagugauagaauuaggauuc

SEQ ID NO: 239629 - RNA, 22 nt, Homo sapiens
guaagugguagagcugggcuau

SEQ ID NO: 239630 - RNA, 22 nt, Homo sapiens
guaaucucagcuucuugggagg

SEQ ID NO: 239631 - RNA, 22 nt, Homo sapiens
guagagugcugggcacuggcuc

SEQ ID NO: 239632 - RNA, 22 nt, Homo sapiens
guagcagccacacuugauaacu

SEQ ID NO: 239633 - RNA, 22 nt, Homo sapiens
guaguggcaugaucuuggcuca

SEQ ID NO: 239634 - RNA, 22 nt, Homo sapiens
guauacaugucaaaacucacau

SEQ ID NO: 239635 - RNA, 22 nt, Homo sapiens
guauacuucugaaaauagcuau

SEQ ID NO: 239636 - RNA, 22 nt, Homo sapiens
guauagaucguagaccaauaaa

SEQ ID NO: 239637 - RNA, 22 nt, Homo sapiens
guaugauacuguaacagugggu

SEQ ID NO: 239638 - RNA, 22 nt, Homo sapiens
guaugguugaagugacaagcca

SEQ ID NO: 239639 - RNA, 18 nt, Homo sapiens
guauuccagccugaguga

SEQ ID NO: 239640 - RNA, 22 nt, Homo sapiens
gucaaaugcacagaaccauuaa

SEQ ID NO: 239641 - RNA, 22 nt, Homo sapiens
gucacaggaaacuaauaugcgc

SEQ ID NO: 239642 - RNA, 22 nt, Homo sapiens
gucacugagcagaaggaagcga

SEQ ID NO: 239643 - RNA, 20 nt, Homo sapiens
gucacuggcccagggcuugu

SEQ ID NO: 239644 - RNA, 22 nt, Homo sapiens
gucacuguuuccuauuauauuu

SEQ ID NO: 239645 - RNA, 22 nt, Homo sapiens
gucagcaaaguucuccugcaga

SEQ ID NO: 239646 - RNA, 22 nt, Homo sapiens
gucagcaucaccaugucuauga

SEQ ID NO: 239647 - RNA, 22 nt, Homo sapiens
gucagggagggauagaugauua

SEQ ID NO: 239648 - RNA, 22 nt, Homo sapiens
ugaguguccaaguaaggugaaa

SEQ ID NO: 239649 - RNA, 22 nt, Homo sapiens
ugaguucaauuguauuuuauua

SEQ ID NO: 239650 - RNA, 22 nt, Homo sapiens
ugaguucauggucauuugucac

SEQ ID NO: 239651 - RNA, 20 nt, Homo sapiens
ugaguuccuuguucagaagc

SEQ ID NO: 239652 - RNA, 22 nt, Homo sapiens
ugaguuccuuucccaguccagu

SEQ ID NO: 239653 - RNA, 22 nt, Homo sapiens
ugaguucuuuguagauucugug

SEQ ID NO: 239654 - RNA, 22 nt, Homo sapiens
ugaguucuuuuagggauauugc

SEQ ID NO: 239655 - RNA, 22 nt, Homo sapiens
ugauaacauugggggaagcuga

SEQ ID NO: 239656 - RNA, 18 nt, Homo sapiens
ugauaucaaugauagcca

SEQ ID NO: 239657 - RNA, 18 nt, Homo sapiens
ugauaucaucacaauuga

SEQ ID NO: 239658 - RNA, 22 nt, Homo sapiens
ugauaugaaagggaaauaagug

SEQ ID NO: 239659 - RNA, 22 nt, Homo sapiens
ugauauguaugugaccuagaaa

SEQ ID NO: 239660 - RNA, 22 nt, Homo sapiens
ugaucucauuagcaccuuuagc

SEQ ID NO: 239661 - RNA, 22 nt, Homo sapiens
ugaugcugaugccugccagaag

SEQ ID NO: 239662 - RNA, 22 nt, Homo sapiens
ugauggcaauggcauucauuuu

SEQ ID NO: 239663 - RNA, 22 nt, Homo sapiens
ugauggcauuucauguuuguaa

SEQ ID NO: 239664 - RNA, 22 nt, Homo sapiens
ugaugguccauaguucauggua

SEQ ID NO: 239665 - RNA, 22 nt, Homo sapiens
ugaugucuugagauggagcuua

SEQ ID NO: 239666 - RNA, 22 nt, Homo sapiens
ugaugucuugcaggcacgagau

SEQ ID NO: 239667 - RNA, 18 nt, Homo sapiens
ugcaaacauguguguguu

SEQ ID NO: 239668 - RNA, 22 nt, Homo sapiens
ugcaaacuuccuugggcagcau

SEQ ID NO: 239669 - RNA, 22 nt, Homo sapiens
ugcaaagucgaaacugcaguuu

SEQ ID NO: 239670 - RNA, 22 nt, Homo sapiens
ugcaaauguuaguaacaccacu

SEQ ID NO: 239671 - RNA, 22 nt, Homo sapiens
ugcaaccauuguuaagugugca

SEQ ID NO: 239672 - RNA, 21 nt, Homo sapiens
ugcaagaaucaggaagcugcc

SEQ ID NO: 239673 - RNA, 22 nt, Homo sapiens
ugcaauauccucuacuauaggu

SEQ ID NO: 239674 - RNA, 22 nt, Homo sapiens
ugcaaucauuuggaggagaaga

SEQ ID NO: 239675 - RNA, 22 nt, Homo sapiens
ugcaaugucuucugaggggagc

SEQ ID NO: 239676 - RNA, 22 nt, Homo sapiens
ugcacaguccagugcccacuga

SEQ ID NO: 239677 - RNA, 22 nt, Homo sapiens
ugcaccacacuccauccugggc

SEQ ID NO: 239678 - RNA, 22 nt, Homo sapiens
ugcaccacuacacuccaggcug

SEQ ID NO: 239679 - RNA, 22 nt, Homo sapiens
ugcagaaucccuucagauccga

SEQ ID NO: 239680 - RNA, 22 nt, Homo sapiens
ugcagagucuguccugccugcc

SEQ ID NO: 239681 - RNA, 17 nt, Homo sapiens
ugcagcacacugauggg

SEQ ID NO: 239682 - RNA, 23 nt, Homo sapiens
ugcagcacacugaugggucuuga

SEQ ID NO: 239683 - RNA, 20 nt, Homo sapiens
ugcagcacgggcccuuucca

SEQ ID NO: 239684 - RNA, 20 nt, Homo sapiens
ugcagcacugggaaugcagu

SEQ ID NO: 239685 - RNA, 22 nt, Homo sapiens
ugcagcauugcacuccagccug

SEQ ID NO: 239686 - RNA, 19 nt, Homo sapiens
ugcauaggguuacauacuc

SEQ ID NO: 239687 - RNA, 22 nt, Homo sapiens
ugcauauguugagaugcauauu

SEQ ID NO: 239688 - RNA, 22 nt, Homo sapiens
ugcauauucaaggcaggccauu

SEQ ID NO: 239689 - RNA, 22 nt, Homo sapiens
ugcauauucgaguuauuuuggg

SEQ ID NO: 239690 - RNA, 22 nt, Homo sapiens
ugcauauuuuauaaagauggaa

SEQ ID NO: 239691 - RNA, 22 nt, Homo sapiens
ugcaugaugcugagauuuggga

SEQ ID NO: 239692 - RNA, 22 nt, Homo sapiens
ugcauggucauacauggcaccc

SEQ ID NO: 239693 - RNA, 22 nt, Homo sapiens
ugcauguucuuacucauacaug

SEQ ID NO: 239694 - RNA, 22 nt, Homo sapiens
ugcauuguggaucuaaaugcau

SEQ ID NO: 239695 - RNA, 20 nt, Homo sapiens
ugccaagaaaugaggguauu

SEQ ID NO: 239696 - RNA, 22 nt, Homo sapiens
ugccaaggagucagucccuaga

SEQ ID NO: 239697 - RNA, 22 nt, Homo sapiens
ugccagagacguagggaauauu

SEQ ID NO: 239698 - RNA, 22 nt, Homo sapiens
ugccagaugcaguguucaacaa

SEQ ID NO: 239699 - RNA, 22 nt, Homo sapiens
ugccagaugcuggugugagggg

SEQ ID NO: 239700 - RNA, 22 nt, Homo sapiens
ugccagaugugcccucuccacc

SEQ ID NO: 239701 - RNA, 22 nt, Homo sapiens
ugccaguauuuuguugaagauu

SEQ ID NO: 239702 - RNA, 22 nt, Homo sapiens
ugccaguauuuuguugaggauu

SEQ ID NO: 239703 - RNA, 19 nt, Homo sapiens
ugccauguagcacaugguc

SEQ ID NO: 239704 - RNA, 22 nt, Homo sapiens
ugcccuuugucagaugaguagg

SEQ ID NO: 239705 - RNA, 22 nt, Homo sapiens
ugccuacagaaggggcucagca

SEQ ID NO: 239706 - RNA, 22 nt, Homo sapiens
ugccuaggcuggaaugcagugg

SEQ ID NO: 239707 - RNA, 22 nt, Homo sapiens
ugccuaguagaaggugaacaug

SEQ ID NO: 239708 - RNA, 20 nt, Homo sapiens
ugccugacacucuuugcuuc

SEQ ID NO: 239709 - RNA, 22 nt, Homo sapiens
ugccuucuguuaaacgaggaug

SEQ ID NO: 239710 - RNA, 21 nt, Homo sapiens
ugccuuuguaguaggugucuu

SEQ ID NO: 239711 - RNA, 21 nt, Homo sapiens
ugcuacugucacuuccuuugu

SEQ ID NO: 239712 - RNA, 22 nt, Homo sapiens
ugcuaugucagccaggcugguc

SEQ ID NO: 239713 - RNA, 22 nt, Homo sapiens
agcagauguuuagugagcgccu

SEQ ID NO: 239714 - RNA, 22 nt, Homo sapiens
agcagcauauuuuuauaaugua

SEQ ID NO: 239715 - RNA, 22 nt, Homo sapiens
agcagcaucgggaaguuggcca

SEQ ID NO: 239716 - RNA, 22 nt, Homo sapiens
agcagcaugaggggacuucugc

SEQ ID NO: 239717 - RNA, 22 nt, Homo sapiens
agcagcaugcaaauggacuaau

SEQ ID NO: 239718 - RNA, 22 nt, Homo sapiens
agcagcuuugaucugaaugauu

SEQ ID NO: 239719 - RNA, 22 nt, Homo sapiens
agcagcuuugcauggccugugg

SEQ ID NO: 239720 - RNA, 22 nt, Homo sapiens
agcaggacaauaugggaucagg

SEQ ID NO: 239721 - RNA, 22 nt, Homo sapiens
agcagguguggcuuauccugaa

SEQ ID NO: 239722 - RNA, 22 nt, Homo sapiens
agcagugucauuuucuggugag

SEQ ID NO: 239723 - RNA, 22 nt, Homo sapiens
agcagugugaaaauggacuaau

SEQ ID NO: 239724 - RNA, 20 nt, Homo sapiens
agcaucacagagccgggugu

SEQ ID NO: 239725 - RNA, 22 nt, Homo sapiens
agcaucacaugggcugcuuggg

SEQ ID NO: 239726 - RNA, 22 nt, Homo sapiens
agcaucaugcaguugcuauuca

SEQ ID NO: 239727 - RNA, 20 nt, Homo sapiens
agcaucguuguguuauagcc

SEQ ID NO: 239728 - RNA, 22 nt, Homo sapiens
agcauggucacuuugggcccca

SEQ ID NO: 239729 - RNA, 17 nt, Homo sapiens
agcauguguuugagauu

SEQ ID NO: 239730 - RNA, 16 nt, Homo sapiens
agccaccauuuacuug

SEQ ID NO: 239731 - RNA, 22 nt, Homo sapiens
agcccauguggcugaggcuucu

SEQ ID NO: 239732 - RNA, 23 nt, Homo sapiens
agccugguuucccugcuucuccc

SEQ ID NO: 239733 - RNA, 22 nt, Homo sapiens
agcuacaucuugcucugggaug

SEQ ID NO: 239734 - RNA, 22 nt, Homo sapiens
agcuaguguucaccagagguca

SEQ ID NO: 239735 - RNA, 22 nt, Homo sapiens
agcuccaugauaguaugucugu

SEQ ID NO: 239736 - RNA, 20 nt, Homo sapiens
agcuccauuccugaaggcug

SEQ ID NO: 239737 - RNA, 22 nt, Homo sapiens
agcuccuuugcuuuuuccagga

SEQ ID NO: 239738 - RNA, 22 nt, Homo sapiens
agcugcaaagggagagaugauu

SEQ ID NO: 239739 - RNA, 22 nt, Homo sapiens
agcugcacugguauaggagaaa

SEQ ID NO: 239740 - RNA, 17 nt, Homo sapiens
agcuggaauuacgggag

SEQ ID NO: 239741 - RNA, 22 nt, Homo sapiens
agcuggaauuuaagguagauag

SEQ ID NO: 239742 - RNA, 22 nt, Homo sapiens
agcuggauguauguuaagugaa

SEQ ID NO: 239743 - RNA, 22 nt, Homo sapiens
agcuggucuacguguguaugag

SEQ ID NO: 239744 - RNA, 22 nt, Homo sapiens
agcuggucucaggugcccugcu

SEQ ID NO: 239745 - RNA, 22 nt, Homo sapiens
agcuguaguuugguggauguaa

SEQ ID NO: 239746 - RNA, 19 nt, Homo sapiens
agcuguguugccugugaga

SEQ ID NO: 239747 - RNA, 20 nt, Homo sapiens
agcuguuguuaaaaaggagg

SEQ ID NO: 239748 - RNA, 22 nt, Homo sapiens
agcuugugcuguaugaagggcc

SEQ ID NO: 239749 - RNA, 22 nt, Homo sapiens
agcuuguguuuuucuaaguauc

SEQ ID NO: 239750 - RNA, 22 nt, Homo sapiens
uucucaguaauuccagauuuuu

SEQ ID NO: 239751 - RNA, 17 nt, Homo sapiens
uucucaguucugaucuc

SEQ ID NO: 239752 - RNA, 22 nt, Homo sapiens
uucucauggugauggcaaaauc

SEQ ID NO: 239753 - RNA, 22 nt, Homo sapiens
uucucuguggauugggugagag

SEQ ID NO: 239754 - RNA, 22 nt, Homo sapiens
uucuggaaaucagcagagggug

SEQ ID NO: 239755 - RNA, 22 nt, Homo sapiens
uucuggcuuuuaaagaaauguu

SEQ ID NO: 239756 - RNA, 19 nt, Homo sapiens
uucugguguuuuaagccaa

SEQ ID NO: 239757 - RNA, 22 nt, Homo sapiens
uucuuagucauguaauagucca

SEQ ID NO: 239758 - RNA, 22 nt, Homo sapiens
uucuucugguuaugaaauuuga

SEQ ID NO: 239759 - RNA, 20 nt, Homo sapiens
uucuugaguuaacaaguuac

SEQ ID NO: 239760 - RNA, 22 nt, Homo sapiens
uucuugcuguauccucacaugg

SEQ ID NO: 239761 - RNA, 18 nt, Homo sapiens
uucuuguguugauauuuu

SEQ ID NO: 239762 - RNA, 22 nt, Homo sapiens
uucuuugcuuggaagcggggga

SEQ ID NO: 239763 - RNA, 19 nt, Homo sapiens
uucuuuguugugggggcug

SEQ ID NO: 239764 - RNA, 22 nt, Homo sapiens
uugaaagacaucaccuacugcu

SEQ ID NO: 239765 - RNA, 22 nt, Homo sapiens
uugaaagcuaucagagauucca

SEQ ID NO: 239766 - RNA, 22 nt, Homo sapiens
uugaaagucauuucuucuaagu

SEQ ID NO: 239767 - RNA, 22 nt, Homo sapiens
uugaaaguguucacaaugguau

SEQ ID NO: 239768 - RNA, 22 nt, Homo sapiens
uugaaaucuuccacagcccaag

SEQ ID NO: 239769 - RNA, 22 nt, Homo sapiens
uugaacuagaaccugcaaauuu

SEQ ID NO: 239770 - RNA, 22 nt, Homo sapiens
uugaacugguaguuggaaaucu

SEQ ID NO: 239771 - RNA, 22 nt, Homo sapiens
uugaagacuaccuaccauacuu

SEQ ID NO: 239772 - RNA, 22 nt, Homo sapiens
uugaagacuauaugauucuuca

SEQ ID NO: 239773 - RNA, 19 nt, Homo sapiens
uugaaggccgccuugcaga

SEQ ID NO: 239774 - RNA, 22 nt, Homo sapiens
uugaaguauagaguuuaagaac

SEQ ID NO: 239775 - RNA, 22 nt, Homo sapiens
uugaaguguguauacauugugg

SEQ ID NO: 239776 - RNA, 22 nt, Homo sapiens
uugaauagaagguuuuuuguuc

SEQ ID NO: 239777 - RNA, 22 nt, Homo sapiens
uugaauagugacuuugauucug

SEQ ID NO: 239778 - RNA, 18 nt, Homo sapiens
uugaaugcgucccagaga

SEQ ID NO: 239779 - RNA, 22 nt, Homo sapiens
uugaauguacuuguucucacua

SEQ ID NO: 239780 - RNA, 22 nt, Homo sapiens
uugacacuuuguaagaaagggg

SEQ ID NO: 239781 - RNA, 22 nt, Homo sapiens
uugagaaucuuucgaauguucu

SEQ ID NO: 239782 - RNA, 22 nt, Homo sapiens
uugagaaucuuugcuaaaggaa

SEQ ID NO: 239783 - RNA, 22 nt, Homo sapiens
uugagacggaguuuugcucuug

SEQ ID NO: 239784 - RNA, 22 nt, Homo sapiens
uugagagaaaaggccaugccuu

SEQ ID NO: 239785 - RNA, 17 nt, Homo sapiens
uugagaguauaucuuac

SEQ ID NO: 239786 - RNA, 22 nt, Homo sapiens
uugagauagaauaggaauggga

SEQ ID NO: 239787 - RNA, 22 nt, Homo sapiens
uugagaucaugcuacugcacuc

SEQ ID NO: 239788 - RNA, 22 nt, Homo sapiens
uugagaugauggauaugcuaau

SEQ ID NO: 239789 - RNA, 22 nt, Homo sapiens
uugagauggagucucacucugu

SEQ ID NO: 239790 - RNA, 22 nt, Homo sapiens
uugagauggagucucgcugugu

SEQ ID NO: 239791 - RNA, 22 nt, Homo sapiens
uugagauggaguucauuuuugu

SEQ ID NO: 239792 - RNA, 22 nt, Homo sapiens
uugagauggaguuucgcucuug

SEQ ID NO: 239793 - RNA, 22 nt, Homo sapiens
uugagauggaguuucgcucuuu

SEQ ID NO: 239794 - RNA, 22 nt, Homo sapiens
uugagauggaguuuugcucuug

SEQ ID NO: 239795 - RNA, 22 nt, Homo sapiens
uugagauguaagauguuaauau

SEQ ID NO: 239796 - RNA, 22 nt, Homo sapiens
uugagauguaguuucacuccug

SEQ ID NO: 239797 - RNA, 22 nt, Homo sapiens
uugagauguggguuggugacuu

SEQ ID NO: 239798 - RNA, 22 nt, Homo sapiens
uugagcaaugaacgauucaggg

SEQ ID NO: 239799 - RNA, 22 nt, Homo sapiens
uugagcccuggagguggaggcu

SEQ ID NO: 239800 - RNA, 22 nt, Homo sapiens
uugaggaaugucauuuguguuu

SEQ ID NO: 239801 - RNA, 22 nt, Homo sapiens
uugaggaggcagucugcccauu

SEQ ID NO: 239802 - RNA, 22 nt, Homo sapiens
uugagggagcacagauucuuau

SEQ ID NO: 239803 - RNA, 22 nt, Homo sapiens
uugagggagcauuuguuuugag

SEQ ID NO: 239804 - RNA, 22 nt, Homo sapiens
uugagggaggcagggcuugucu

SEQ ID NO: 239805 - RNA, 22 nt, Homo sapiens
uugaggguggcauauauugauu

SEQ ID NO: 239806 - RNA, 20 nt, Homo sapiens
uugaggucaggaguuuggga

SEQ ID NO: 239807 - RNA, 20 nt, Homo sapiens
uugaggugugaggggcagag

SEQ ID NO: 239808 - RNA, 22 nt, Homo sapiens
uugauaagaaaugccaguuugg

SEQ ID NO: 239809 - RNA, 22 nt, Homo sapiens
uugauaauguuaacuuugguca

SEQ ID NO: 239810 - RNA, 22 nt, Homo sapiens
uugauacuagagucuuucugac

SEQ ID NO: 239811 - RNA, 22 nt, Homo sapiens
uugauagaucagggauuugauu

SEQ ID NO: 239812 - RNA, 22 nt, Homo sapiens
uugauaguuuuaaaauuaaucu

SEQ ID NO: 239813 - RNA, 22 nt, Homo sapiens
uugauauguggaauauuuaucu

SEQ ID NO: 239814 - RNA, 22 nt, Homo sapiens
uugaucugugucccugcccaau

SEQ ID NO: 239815 - RNA, 22 nt, Homo sapiens
auacaagugccauguuggugug

SEQ ID NO: 239816 - RNA, 22 nt, Homo sapiens
auacaaguuauuugaacugcgg

SEQ ID NO: 239817 - RNA, 22 nt, Homo sapiens
auacacauuccugggccucacc

SEQ ID NO: 239818 - RNA, 22 nt, Homo sapiens
auacagguauacaaugcauaau

SEQ ID NO: 239819 - RNA, 22 nt, Homo sapiens
auacaguguucugggaagaagu

SEQ ID NO: 239820 - RNA, 22 nt, Homo sapiens
auacaugcauuugcacgagagu

SEQ ID NO: 239821 - RNA, 22 nt, Homo sapiens
auacuaugagauaauaaagacu

SEQ ID NO: 239822 - RNA, 22 nt, Homo sapiens
auacugguuuuugucaugugga

SEQ ID NO: 239823 - RNA, 22 nt, Homo sapiens
auacuguuuuacaucauugccu

SEQ ID NO: 239824 - RNA, 22 nt, Homo sapiens
auagacugaguggcuuaaacca

SEQ ID NO: 239825 - RNA, 22 nt, Homo sapiens
auagaucauugucauuuuagau

SEQ ID NO: 239826 - RNA, 21 nt, Homo sapiens
auagcacuucacuugguuaga

SEQ ID NO: 239827 - RNA, 20 nt, Homo sapiens
auagcagcaugauuuauaau

SEQ ID NO: 239828 - RNA, 22 nt, Homo sapiens
auagcagugugaaaauguacua

SEQ ID NO: 239829 - RNA, 22 nt, Homo sapiens
auagcccuuuucuaacuaugug

SEQ ID NO: 239830 - RNA, 22 nt, Homo sapiens
auagggcacgagaugugagccu

SEQ ID NO: 239831 - RNA, 22 nt, Homo sapiens
auagugcugcaauaaacacacg

SEQ ID NO: 239832 - RNA, 22 nt, Homo sapiens
auagugcugcaauuaacauaca

SEQ ID NO: 239833 - RNA, 22 nt, Homo sapiens
auagugcuguauuaaacauacg

SEQ ID NO: 239834 - RNA, 22 nt, Homo sapiens
auagugcuuuugaaucuuguug

SEQ ID NO: 239835 - RNA, 22 nt, Homo sapiens
auagugcuuuuuagaaccugga

SEQ ID NO: 239836 - RNA, 22 nt, Homo sapiens
auauaugcuaagugcuaauaaa

SEQ ID NO: 239837 - RNA, 22 nt, Homo sapiens
auaucaacaucgugucauuagu

SEQ ID NO: 239838 - RNA, 22 nt, Homo sapiens
auaucaaggccauuuucuaaau

SEQ ID NO: 239839 - RNA, 22 nt, Homo sapiens
auaucaagugacuggaguucca

SEQ ID NO: 239840 - RNA, 22 nt, Homo sapiens
auaucacagguguuuaccugau

SEQ ID NO: 239841 - RNA, 22 nt, Homo sapiens
auaugcacaguggaguacuauu

SEQ ID NO: 239842 - RNA, 22 nt, Homo sapiens
auaugcauacauguaugcagga

SEQ ID NO: 239843 - RNA, 22 nt, Homo sapiens
auaugcuuauuagcaagaaaua

SEQ ID NO: 239844 - RNA, 21 nt, Homo sapiens
auauggaacuggugacguguu

SEQ ID NO: 239845 - RNA, 17 nt, Homo sapiens
auaugucugcuggggga

SEQ ID NO: 239846 - RNA, 22 nt, Homo sapiens
auaugucuguuuagucuguaau

SEQ ID NO: 239847 - RNA, 22 nt, Homo sapiens
auauucacagguaucagagauu

SEQ ID NO: 239848 - RNA, 22 nt, Homo sapiens
auauucacuauaugcagaacca

SEQ ID NO: 239849 - RNA, 22 nt, Homo sapiens
auauugcuuagugaugaagucu

SEQ ID NO: 239850 - RNA, 22 nt, Homo sapiens
auauugcuugaggccaggaggu

SEQ ID NO: 239851 - RNA, 22 nt, Homo sapiens
auauuggccuaaaauucucuuu

SEQ ID NO: 239852 - RNA, 22 nt, Homo sapiens
uuggagcccuaacucucaguac

SEQ ID NO: 239853 - RNA, 22 nt, Homo sapiens
uuggauuguuucuagauugggg

SEQ ID NO: 239854 - RNA, 22 nt, Homo sapiens
uuggcaaagaggaaugccacuu

SEQ ID NO: 239855 - RNA, 22 nt, Homo sapiens
uuggcagaauguuagaaacuua

SEQ ID NO: 239856 - RNA, 19 nt, Homo sapiens
uuggcagaguugcccccua

SEQ ID NO: 239857 - RNA, 22 nt, Homo sapiens
uuggcagcauuccagccaagca

SEQ ID NO: 239858 - RNA, 22 nt, Homo sapiens
uuggcagcuguggaaucugggc

SEQ ID NO: 239859 - RNA, 22 nt, Homo sapiens
uuggcagugguucugacggacc

SEQ ID NO: 239860 - RNA, 22 nt, Homo sapiens
uuggcccugcugaccauucccu

SEQ ID NO: 239861 - RNA, 22 nt, Homo sapiens
uuggccuccuggucauauccag

SEQ ID NO: 239862 - RNA, 22 nt, Homo sapiens
uugggagugucucuggacugca

SEQ ID NO: 239863 - RNA, 23 nt, Homo sapiens
uugggcaaaucacuaacgucucc

SEQ ID NO: 239864 - RNA, 22 nt, Homo sapiens
uugggcaaguggcaugaccaug

SEQ ID NO: 239865 - RNA, 22 nt, Homo sapiens
uugggcuugagggugcccaguc

SEQ ID NO: 239866 - RNA, 22 nt, Homo sapiens
uugggcuuuuagguccuuaaca

SEQ ID NO: 239867 - RNA, 22 nt, Homo sapiens
uugguaguaaucccucacaaaa

SEQ ID NO: 239868 - RNA, 22 nt, Homo sapiens
uugguauguaauuuauauugua

SEQ ID NO: 239869 - RNA, 22 nt, Homo sapiens
uuggucaggcuagaguguggug

SEQ ID NO: 239870 - RNA, 23 nt, Homo sapiens
uuggucucccaaaguguugagau

SEQ ID NO: 239871 - RNA, 22 nt, Homo sapiens
uuggucucuuaaucacacuuuu

SEQ ID NO: 239872 - RNA, 21 nt, Homo sapiens
uugguucccucugacaggucu

SEQ ID NO: 239873 - RNA, 22 nt, Homo sapiens
uugguucucuuagccaucuuaa

SEQ ID NO: 239874 - RNA, 22 nt, Homo sapiens
uuguaaagaucauaugcuguuc

SEQ ID NO: 239875 - RNA, 22 nt, Homo sapiens
uuguaccacagggcaugaagug

SEQ ID NO: 239876 - RNA, 22 nt, Homo sapiens
uuguacuucagacaugccaaag

SEQ ID NO: 239877 - RNA, 22 nt, Homo sapiens
uuguaguguuuauucugucaac

SEQ ID NO: 239878 - RNA, 22 nt, Homo sapiens
uuguauguaaccauuuggcaaa

SEQ ID NO: 239879 - RNA, 22 nt, Homo sapiens
uuguauguugaaugaugguaua

SEQ ID NO: 239880 - RNA, 22 nt, Homo sapiens
uugucaacaugaaacuguguuu

SEQ ID NO: 239881 - RNA, 22 nt, Homo sapiens
uugucaaugggugagugcagag

SEQ ID NO: 239882 - RNA, 22 nt, Homo sapiens
uugucacccuacauaacaggga

SEQ ID NO: 239883 - RNA, 22 nt, Homo sapiens
uugucacccucucuuggugucu

SEQ ID NO: 239884 - RNA, 22 nt, Homo sapiens
uugucaccucuaaaucucauau

SEQ ID NO: 239885 - RNA, 23 nt, Homo sapiens
uuguccccuccaaagcucauguu

SEQ ID NO: 239886 - RNA, 22 nt, Homo sapiens
uuguccccuuccaaaucucaug

SEQ ID NO: 239887 - RNA, 16 nt, Homo sapiens
uugucccuucccaaau

SEQ ID NO: 239888 - RNA, 22 nt, Homo sapiens
uuguccuccacauuugaucagu

SEQ ID NO: 239889 - RNA, 22 nt, Homo sapiens
uuguccuggagguucuugcaag

SEQ ID NO: 239890 - RNA, 22 nt, Homo sapiens
uugucucacuggaguuuaguaa

SEQ ID NO: 239891 - RNA, 22 nt, Homo sapiens
uugucuccuagacgaccaggcg

SEQ ID NO: 239892 - RNA, 22 nt, Homo sapiens
uugugaagaugugaagcaagca

SEQ ID NO: 239893 - RNA, 22 nt, Homo sapiens
uugugaauggugccgcgauaaa

SEQ ID NO: 239894 - RNA, 22 nt, Homo sapiens
uugugaucauugucaaauagug

SEQ ID NO: 239895 - RNA, 22 nt, Homo sapiens
uugugauugagugauccuuguu

SEQ ID NO: 239896 - RNA, 22 nt, Homo sapiens
uugugcaugaugcauacauggu

SEQ ID NO: 239897 - RNA, 22 nt, Homo sapiens
uugugcuccugugagaaucuag

SEQ ID NO: 239898 - RNA, 22 nt, Homo sapiens
uugugcuuuugagcugagauga

SEQ ID NO: 239899 - RNA, 16 nt, Homo sapiens
uuguggcuuuugcaca

SEQ ID NO: 239900 - RNA, 22 nt, Homo sapiens
uugugguugacuaaauuuguaa

SEQ ID NO: 239901 - RNA, 22 nt, Homo sapiens
uugugucccuacccaaaucuca

SEQ ID NO: 239902 - RNA, 22 nt, Homo sapiens
uuguguuugaugcugacacgca

SEQ ID NO: 239903 - RNA, 22 nt, Homo sapiens
uuuaaagcuccaagcaugucug

SEQ ID NO: 239904 - RNA, 22 nt, Homo sapiens
uuuaaggcaggucuggugguga

SEQ ID NO: 239905 - RNA, 22 nt, Homo sapiens
uuuaaggcaugccuguacaugc

SEQ ID NO: 239906 - RNA, 22 nt, Homo sapiens
uuuaaguguuuguuccugaaaa

SEQ ID NO: 239907 - RNA, 22 nt, Homo sapiens
uuuacccugaggaaucuauuuu

SEQ ID NO: 239908 - RNA, 22 nt, Homo sapiens
uuuagcucauucaauuucaguc

SEQ ID NO: 239909 - RNA, 23 nt, Homo sapiens
uuuaguccccuaugagcuggugu

SEQ ID NO: 239910 - RNA, 22 nt, Homo sapiens
uuuaugcuacauguguuggaaa

SEQ ID NO: 239911 - RNA, 22 nt, Homo sapiens
uuuauugcucuaaaguugccau

SEQ ID NO: 239912 - RNA, 22 nt, Homo sapiens
uuucacagagggcuucuuucua

SEQ ID NO: 239913 - RNA, 22 nt, Homo sapiens
uuucacagcaauugccuauugu

SEQ ID NO: 239914 - RNA, 23 nt, Homo sapiens
uuucacaguagcuggaucagccu

SEQ ID NO: 239915 - RNA, 22 nt, Homo sapiens
uuucagagucaucugcccaagu

SEQ ID NO: 239916 - RNA, 22 nt, Homo sapiens
uuucaggcaagggugacccuga

SEQ ID NO: 239917 - RNA, 22 nt, Homo sapiens
augcaaaucuuaaguaugugug

SEQ ID NO: 239918 - RNA, 22 nt, Homo sapiens
augcaagacaccgauuagcuuu

SEQ ID NO: 239919 - RNA, 22 nt, Homo sapiens
augcacaguccagcccaugugg

SEQ ID NO: 239920 - RNA, 22 nt, Homo sapiens
augcacauggcuaacuuuuuuc

SEQ ID NO: 239921 - RNA, 22 nt, Homo sapiens
augcacuguauaggaucuugcg

SEQ ID NO: 239922 - RNA, 22 nt, Homo sapiens
augcacuguuuucuugaugaga

SEQ ID NO: 239923 - RNA, 22 nt, Homo sapiens
augcacuuggcaggaugauucc

SEQ ID NO: 239924 - RNA, 22 nt, Homo sapiens
augcagagaaaucuaaaauaug

SEQ ID NO: 239925 - RNA, 22 nt, Homo sapiens
augcagagucccagccccuagc

SEQ ID NO: 239926 - RNA, 22 nt, Homo sapiens
augcagcugaggguaguggagc

SEQ ID NO: 239927 - RNA, 22 nt, Homo sapiens
augcauggcagagucaggguac

SEQ ID NO: 239928 - RNA, 22 nt, Homo sapiens
augcuacauucuacaauuaggc

SEQ ID NO: 239929 - RNA, 22 nt, Homo sapiens
augcuggugcuagaaacuggaa

SEQ ID NO: 239930 - RNA, 19 nt, Homo sapiens
augcugguguugcucaaac

SEQ ID NO: 239931 - RNA, 22 nt, Homo sapiens
augcuguuuuguagcucccucu

SEQ ID NO: 239932 - RNA, 22 nt, Homo sapiens
auggaagaaaguuggguucuug

SEQ ID NO: 239933 - RNA, 22 nt, Homo sapiens
auggaaggagaauggucuuuga

SEQ ID NO: 239934 - RNA, 22 nt, Homo sapiens
auggacguagauucucaaggau

SEQ ID NO: 239935 - RNA, 22 nt, Homo sapiens
auggaggaggaagcugaaacaa

SEQ ID NO: 239936 - RNA, 22 nt, Homo sapiens
auggauauuuuuugaacauaga

SEQ ID NO: 239937 - RNA, 22 nt, Homo sapiens
auggcaaugcgauggugacuga

SEQ ID NO: 239938 - RNA, 22 nt, Homo sapiens
auggcacuacugggaaugucuu

SEQ ID NO: 239939 - RNA, 22 nt, Homo sapiens
auggcagcugacacuuccgucu

SEQ ID NO: 239940 - RNA, 22 nt, Homo sapiens
auggcagugucuagggguguuu

SEQ ID NO: 239941 - RNA, 22 nt, Homo sapiens
auggcaguuucacucugggauu

SEQ ID NO: 239942 - RNA, 22 nt, Homo sapiens
auggcaguuuggucucugugcu

SEQ ID NO: 239943 - RNA, 22 nt, Homo sapiens
auggcccugcuaccacuuuucu

SEQ ID NO: 239944 - RNA, 22 nt, Homo sapiens
auggcguggagauauggucagc

SEQ ID NO: 239945 - RNA, 22 nt, Homo sapiens
auggcucuguuccaugugucuu

SEQ ID NO: 239946 - RNA, 22 nt, Homo sapiens
auggcugugaaaugguaggugg

SEQ ID NO: 239947 - RNA, 22 nt, Homo sapiens
auggcuguuccugggaguucua

SEQ ID NO: 239948 - RNA, 22 nt, Homo sapiens
auggcuucuucuaaaagugggg

SEQ ID NO: 239949 - RNA, 22 nt, Homo sapiens
auggcuuuaagagugucugaau

SEQ ID NO: 239950 - RNA, 22 nt, Homo sapiens
auggcuuugggcugcucugccc

SEQ ID NO: 239951 - RNA, 22 nt, Homo sapiens
auggcuuuguguucagagcuga

SEQ ID NO: 239952 - RNA, 22 nt, Homo sapiens
auggcuuuuauuguguugaggu

SEQ ID NO: 239953 - RNA, 22 nt, Homo sapiens
uaaagcuacagagcggaaaauu

SEQ ID NO: 239954 - RNA, 22 nt, Homo sapiens
uaaagcuacaguauaugguauu

SEQ ID NO: 239955 - RNA, 21 nt, Homo sapiens
uaaaggcuccaauuauacccc

SEQ ID NO: 239956 - RNA, 22 nt, Homo sapiens
uaaagugaggauggcaguaggu

SEQ ID NO: 239957 - RNA, 22 nt, Homo sapiens
uaaaguguuuguuauuaaaggu

SEQ ID NO: 239958 - RNA, 22 nt, Homo sapiens
uaaaugcucuuuaaaagugcuu

SEQ ID NO: 239959 - RNA, 22 nt, Homo sapiens
uaacaacauucuaacugacggc

SEQ ID NO: 239960 - RNA, 22 nt, Homo sapiens
uaacaaugucuuaugggcuuaa

SEQ ID NO: 239961 - RNA, 22 nt, Homo sapiens
uaacagcauuugugucuaguag

SEQ ID NO: 239962 - RNA, 22 nt, Homo sapiens
uaacagcucuacagcugcucuu

SEQ ID NO: 239963 - RNA, 22 nt, Homo sapiens
uaacccagugucugugaugggu

SEQ ID NO: 239964 - RNA, 22 nt, Homo sapiens
uaacuauagagaauguugagua

SEQ ID NO: 239965 - RNA, 18 nt, Homo sapiens
uaacuggugugagauggu

SEQ ID NO: 239966 - RNA, 22 nt, Homo sapiens
uaagagagcuccaucuuuuccu

SEQ ID NO: 239967 - RNA, 22 nt, Homo sapiens
uaagagcuaggauuuuaaauca

SEQ ID NO: 239968 - RNA, 22 nt, Homo sapiens
uaagcucauuccagccaugucc

SEQ ID NO: 239969 - RNA, 22 nt, Homo sapiens
uaaggauuuuggugauuacacu

SEQ ID NO: 239970 - RNA, 18 nt, Homo sapiens
uaaggcacuauaggcauu

SEQ ID NO: 239971 - RNA, 22 nt, Homo sapiens
uaaggcauuuuuuugaguugca

SEQ ID NO: 239972 - RNA, 22 nt, Homo sapiens
uaaggcuagcaagaugagaaua

SEQ ID NO: 239973 - RNA, 22 nt, Homo sapiens
uaaggcuuaugguaaaguccug

SEQ ID NO: 239974 - RNA, 22 nt, Homo sapiens
uaaggcuugcuucagucuugaa

SEQ ID NO: 239975 - RNA, 22 nt, Homo sapiens
uaaggcuuuuguucagcguggg

SEQ ID NO: 239976 - RNA, 22 nt, Homo sapiens
uaagggacgcccccuucucucu

SEQ ID NO: 239977 - RNA, 22 nt, Homo sapiens
uaagguuuuugauaugcugcug

SEQ ID NO: 239978 - RNA, 22 nt, Homo sapiens
uaaguagaggaaucauuuugug

SEQ ID NO: 239979 - RNA, 22 nt, Homo sapiens
uaaguaguguugagacaaguuu

SEQ ID NO: 239980 - RNA, 22 nt, Homo sapiens
uaaguauuaugugcugcauuuu

SEQ ID NO: 239981 - RNA, 22 nt, Homo sapiens
uaagugcaacauaaguguuaaa

SEQ ID NO: 239982 - RNA, 23 nt, Homo sapiens
uaaguucaucucuaauaggugga

SEQ ID NO: 239983 - RNA, 22 nt, Homo sapiens
uaauacuguaauggugguuccg

SEQ ID NO: 239984 - RNA, 22 nt, Homo sapiens
uaauagcucggauaaacaugau

SEQ ID NO: 239985 - RNA, 22 nt, Homo sapiens
uaauaguuucagaaguuguuuu

SEQ ID NO: 239986 - RNA, 22 nt, Homo sapiens
uaauauguuuugaaaucaggaa

SEQ ID NO: 239987 - RNA, 22 nt, Homo sapiens
uaaugcacauuuauuuuaccuu

SEQ ID NO: 239988 - RNA, 19 nt, Homo sapiens
uaaugccacugccuggcau

SEQ ID NO: 239989 - RNA, 22 nt, Homo sapiens
uaaugcuccauggguuauuaaa

SEQ ID NO: 239990 - RNA, 22 nt, Homo sapiens
uaauucacauaaagcacuuaga

SEQ ID NO: 239991 - RNA, 22 nt, Homo sapiens
uaauugcaguucuguguuauau

SEQ ID NO: 239992 - RNA, 22 nt, Homo sapiens
uacaaagcuacucgagggcagg

SEQ ID NO: 239993 - RNA, 22 nt, Homo sapiens
uacaaagcuuucugcaaaucau

SEQ ID NO: 239994 - RNA, 22 nt, Homo sapiens
uacaagcuaaaauggaagauca

SEQ ID NO: 239995 - RNA, 22 nt, Homo sapiens
uacagaauucugucccuugagu

SEQ ID NO: 239996 - RNA, 22 nt, Homo sapiens
uacagaucaguuauuuuguaga

SEQ ID NO: 239997 - RNA, 22 nt, Homo sapiens
uacagcacaggugcagguguug

SEQ ID NO: 239998 - RNA, 23 nt, Homo sapiens
uacagcugcagaaucaggcuaag

SEQ ID NO: 239999 - RNA, 22 nt, Homo sapiens
uacaggaaugucagguugcugu

SEQ ID NO: 240000 - RNA, 22 nt, Homo sapiens
uacaggauagacaauuuauuaa

SEQ ID NO: 240001 - RNA, 22 nt, Homo sapiens
uacaguaauguuaaucuuugug

SEQ ID NO: 240002 - RNA, 22 nt, Homo sapiens
uacagucuggaggccuguguug

SEQ ID NO: 240003 - RNA, 22 nt, Homo sapiens
uacagugcauagaggcaugaua

SEQ ID NO: 240004 - RNA, 22 nt, Homo sapiens
uacaguggaaguuaaccccauu

SEQ ID NO: 240005 - RNA, 22 nt, Homo sapiens
uacauagucuucuuuugguuau

SEQ ID NO: 240006 - RNA, 22 nt, Homo sapiens
uacauccauccugcugggcagu

SEQ ID NO: 240007 - RNA, 22 nt, Homo sapiens
uaccacugccgagaaaacagau

SEQ ID NO: 240008 - RNA, 22 nt, Homo sapiens
uaccaguaaugguucuagagga

SEQ ID NO: 240009 - RNA, 22 nt, Homo sapiens
auggcuuuugaccugguaggau

SEQ ID NO: 240010 - RNA, 22 nt, Homo sapiens
auggcuuuuuaaaucauguugu

SEQ ID NO: 240011 - RNA, 22 nt, Homo sapiens
augggcaaauguuggaaauucc

SEQ ID NO: 240012 - RNA, 17 nt, Homo sapiens
augggguuguagcccca

SEQ ID NO: 240013 - RNA, 22 nt, Homo sapiens
augguuuauuuguaagcagagu

SEQ ID NO: 240014 - RNA, 22 nt, Homo sapiens
auguaacaguauuuggagaugu

SEQ ID NO: 240015 - RNA, 22 nt, Homo sapiens
auguaagugugcucaaauguua

SEQ ID NO: 240016 - RNA, 22 nt, Homo sapiens
auguaguagauauuuauggaaa

SEQ ID NO: 240017 - RNA, 22 nt, Homo sapiens
auguaguagcagaaaauauuuu

SEQ ID NO: 240018 - RNA, 22 nt, Homo sapiens
auguauacauagauacgugugu

SEQ ID NO: 240019 - RNA, 22 nt, Homo sapiens
auguauacaugcaggucacagg

SEQ ID NO: 240020 - RNA, 22 nt, Homo sapiens
auguccaugagcacauguauca

SEQ ID NO: 240021 - RNA, 22 nt, Homo sapiens
augugacugauguaaucagaca

SEQ ID NO: 240022 - RNA, 22 nt, Homo sapiens
augugacuggaucauggggacg

SEQ ID NO: 240023 - RNA, 22 nt, Homo sapiens
augugacuugugaaaaguucag

SEQ ID NO: 240024 - RNA, 22 nt, Homo sapiens
augugcaagaucauuaaagcuc

SEQ ID NO: 240025 - RNA, 22 nt, Homo sapiens
augugcagauguuacaaauugu

SEQ ID NO: 240026 - RNA, 22 nt, Homo sapiens
augugcuugagggaaaucaguu

SEQ ID NO: 240027 - RNA, 22 nt, Homo sapiens
auguggcuuuccuagaucuuag

SEQ ID NO: 240028 - RNA, 18 nt, Homo sapiens
auguggcuuuugaaggcu

SEQ ID NO: 240029 - RNA, 22 nt, Homo sapiens
augugguaggcccaugagucau

SEQ ID NO: 240030 - RNA, 22 nt, Homo sapiens
auguggugguagccaggacagg

SEQ ID NO: 240031 - RNA, 22 nt, Homo sapiens
auguuauguuaaugauaaugga

SEQ ID NO: 240032 - RNA, 22 nt, Homo sapiens
auuaaauguuggacguauacau

SEQ ID NO: 240033 - RNA, 22 nt, Homo sapiens
auuaacaucuagaguuuuggug

SEQ ID NO: 240034 - RNA, 22 nt, Homo sapiens
auuaauguaauuaguaaaguug

SEQ ID NO: 240035 - RNA, 22 nt, Homo sapiens
auucaaggagucuucgucccaa

SEQ ID NO: 240036 - RNA, 22 nt, Homo sapiens
auucacagggggagaaggguau

SEQ ID NO: 240037 - RNA, 22 nt, Homo sapiens
auucacugugcuuggccaaauu

SEQ ID NO: 240038 - RNA, 22 nt, Homo sapiens
auucaugggagcuacuuuaaaa

SEQ ID NO: 240039 - RNA, 20 nt, Homo sapiens
auucauggugguacguuguc

SEQ ID NO: 240040 - RNA, 22 nt, Homo sapiens
auuccacuuacaugaaguaccu

SEQ ID NO: 240041 - RNA, 22 nt, Homo sapiens
auuccacuuagugacucauuug

SEQ ID NO: 240042 - RNA, 22 nt, Homo sapiens
auuccacuuauaugagguaucu

SEQ ID NO: 240043 - RNA, 21 nt, Homo sapiens
auuccacuuuuccuucaggga

SEQ ID NO: 240044 - RNA, 23 nt, Homo sapiens
auuccaguggcaauuggagaaac

SEQ ID NO: 240045 - RNA, 22 nt, Homo sapiens
auucccuuggucaacggaugca

SEQ ID NO: 240046 - RNA, 22 nt, Homo sapiens
auugaacuguuggagagguuuu

SEQ ID NO: 240047 - RNA, 22 nt, Homo sapiens
auugaacuuacuaucuaaacua

SEQ ID NO: 240048 - RNA, 22 nt, Homo sapiens
auugacuugauauauagcugau

SEQ ID NO: 240049 - RNA, 18 nt, Homo sapiens
auugagcaugacagaccu

SEQ ID NO: 240050 - RNA, 23 nt, Homo sapiens
auugauagugccuuugugcuaau

SEQ ID NO: 240051 - RNA, 22 nt, Homo sapiens
auugcaauuaguccauagaguu

SEQ ID NO: 240052 - RNA, 22 nt, Homo sapiens
auugcacacagaaucaggguaa

SEQ ID NO: 240053 - RNA, 22 nt, Homo sapiens
auugcacaucugcacuacagcc

SEQ ID NO: 240054 - RNA, 22 nt, Homo sapiens
auugcacuccacccugggcaac

SEQ ID NO: 240055 - RNA, 22 nt, Homo sapiens
auugcacuccagccuagucaac

SEQ ID NO: 240056 - RNA, 22 nt, Homo sapiens
auugcacuccagccugggcagc

SEQ ID NO: 240057 - RNA, 22 nt, Homo sapiens
auugcacuccagccuggggaac

SEQ ID NO: 240058 - RNA, 22 nt, Homo sapiens
auugcacuccagccuugacaca

SEQ ID NO: 240059 - RNA, 22 nt, Homo sapiens
auugcacuccagccuugggcaa

SEQ ID NO: 240060 - RNA, 22 nt, Homo sapiens
auugcacuccagccuuggggau

SEQ ID NO: 240061 - RNA, 22 nt, Homo sapiens
auugcacuccagcuugggugac

SEQ ID NO: 240062 - RNA, 22 nt, Homo sapiens
auugcacuccggccugggugac

SEQ ID NO: 240063 - RNA, 18 nt, Homo sapiens
auugcacuccugccuggg

SEQ ID NO: 240064 - RNA, 22 nt, Homo sapiens
auugcacuggggguuagaauuu

SEQ ID NO: 240065 - RNA, 22 nt, Homo sapiens
auugcauaaacacauuucuuau

SEQ ID NO: 240066 - RNA, 22 nt, Homo sapiens
auugcccaggcuggagugcagu

SEQ ID NO: 240067 - RNA, 22 nt, Homo sapiens
auugcucacacaaagccuguuu

SEQ ID NO: 240068 - RNA, 22 nt, Homo sapiens
auugcuuuuacugggagcuuug

SEQ ID NO: 240069 - RNA, 22 nt, Homo sapiens
auuguaccccaauguacaauau

SEQ ID NO: 240070 - RNA, 21 nt, Homo sapiens
auuguauguaaaccaaaugag

SEQ ID NO: 240071 - RNA, 15 nt, Homo sapiens
auuucacuuagcaug

SEQ ID NO: 240072 - RNA, 22 nt, Homo sapiens
auuucacuucgcaugguguccg

SEQ ID NO: 240073 - RNA, 19 nt, Homo sapiens
auuuccuggagcuggucuc

SEQ ID NO: 240074 - RNA, 22 nt, Homo sapiens
auuugacacugagagccucagu

SEQ ID NO: 240075 - RNA, 22 nt, Homo sapiens
auuuggccuuuguaugcaguau

SEQ ID NO: 240076 - RNA, 22 nt, Homo sapiens
auuuggguaaugagugcaaggg

SEQ ID NO: 240077 - RNA, 23 nt, Homo sapiens
ucacacuuaagagaaaugcagcu

SEQ ID NO: 240078 - RNA, 22 nt, Homo sapiens
ucacagaggagaagaccuuuaa

SEQ ID NO: 240079 - RNA, 22 nt, Homo sapiens
ucacagaugcuugacccauuuc

SEQ ID NO: 240080 - RNA, 22 nt, Homo sapiens
ucacaggguguuauuagaauua

SEQ ID NO: 240081 - RNA, 22 nt, Homo sapiens
ucacaguaacuuuguugcuuuu

SEQ ID NO: 240082 - RNA, 22 nt, Homo sapiens
ucacaguagagcuucuuucaga

SEQ ID NO: 240083 - RNA, 22 nt, Homo sapiens
ucacaguccuguuuaggagagg

SEQ ID NO: 240084 - RNA, 22 nt, Homo sapiens
ucacagugcaggaucaguuaau

SEQ ID NO: 240085 - RNA, 22 nt, Homo sapiens
ucacaguguuaaaccuuucuuu

SEQ ID NO: 240086 - RNA, 23 nt, Homo sapiens
ucacaguuacuuuugcaucaacc

SEQ ID NO: 240087 - RNA, 22 nt, Homo sapiens
ucacaguucagcauggcugagg

SEQ ID NO: 240088 - RNA, 22 nt, Homo sapiens
ucacauagcugaguaaaaugga

SEQ ID NO: 240089 - RNA, 22 nt, Homo sapiens
ucacaugcacaucucuggaacc

SEQ ID NO: 240090 - RNA, 22 nt, Homo sapiens
ucacauggaggugauaguugaa

SEQ ID NO: 240091 - RNA, 22 nt, Homo sapiens
ucacauuaagcuguuauuucuu

SEQ ID NO: 240092 - RNA, 22 nt, Homo sapiens
ucacauuguacaaacagguaag

SEQ ID NO: 240093 - RNA, 19 nt, Homo sapiens
ucaccaguacacaauacaa

SEQ ID NO: 240094 - RNA, 16 nt, Homo sapiens
ucaccccuagagaucc

SEQ ID NO: 240095 - RNA, 22 nt, Homo sapiens
ucaccuggagacaugaagacug

SEQ ID NO: 240096 - RNA, 22 nt, Homo sapiens
ucaccuggggcacagcugaaga

SEQ ID NO: 240097 - RNA, 19 nt, Homo sapiens
ucaccuugcccugcacaca

SEQ ID NO: 240098 - RNA, 23 nt, Homo sapiens
ucacggagaccugcaagaccaau

SEQ ID NO: 240099 - RNA, 22 nt, Homo sapiens
ucacucagaccuggugauaugc

SEQ ID NO: 240100 - RNA, 22 nt, Homo sapiens
ucacugaaacuguccuggguua

SEQ ID NO: 240101 - RNA, 22 nt, Homo sapiens
ucacugaggucugagcuuuaug

SEQ ID NO: 240102 - RNA, 22 nt, Homo sapiens
ucacugcacuucaggcuuucuc

SEQ ID NO: 240103 - RNA, 22 nt, Homo sapiens
ucacugcgaccuccgccucccg

SEQ ID NO: 240104 - RNA, 22 nt, Homo sapiens
ucacuggcaaauauauccguug

SEQ ID NO: 240105 - RNA, 22 nt, Homo sapiens
ucacugggagcauuugagccuu

SEQ ID NO: 240106 - RNA, 22 nt, Homo sapiens
ucacugugguuuugaugugcau

SEQ ID NO: 240107 - RNA, 22 nt, Homo sapiens
ucacuuuguuuuuggauaaguu

SEQ ID NO: 240108 - RNA, 22 nt, Homo sapiens
ucagacacugagcaaacgacua

SEQ ID NO: 240109 - RNA, 22 nt, Homo sapiens
ucagaguaguuccuggcagaaa

SEQ ID NO: 240110 - RNA, 22 nt, Homo sapiens
ucagcaaugaccuaagcaaaua

SEQ ID NO: 240111 - RNA, 22 nt, Homo sapiens
ucagcaaugcugcacucuacug

SEQ ID NO: 240112 - RNA, 22 nt, Homo sapiens
ucagcacauucaaggccugccu

SEQ ID NO: 240113 - RNA, 22 nt, Homo sapiens
ucagcagucacuccuaugacaa

SEQ ID NO: 240114 - RNA, 22 nt, Homo sapiens
ucagcagugugaaaacaaacua

SEQ ID NO: 240115 - RNA, 22 nt, Homo sapiens
ucaggcaccuuccucuuaucug

SEQ ID NO: 240116 - RNA, 22 nt, Homo sapiens
ucaggcaugcagcaaugcagug

SEQ ID NO: 240117 - RNA, 20 nt, Homo sapiens
ucagguagggcuucaacauu

SEQ ID NO: 240118 - RNA, 22 nt, Homo sapiens
ucagguaugucuuuaacagcag

SEQ ID NO: 240119 - RNA, 22 nt, Homo sapiens
ucaggugcaguggcucaugcuu

SEQ ID NO: 240120 - RNA, 22 nt, Homo sapiens
ucaggugccuuggcuaauuguu

SEQ ID NO: 240121 - RNA, 22 nt, Homo sapiens
ucaguaaauguuaggacauuuc

SEQ ID NO: 240122 - RNA, 23 nt, Homo sapiens
ucaguacuccacuuucaauagug

SEQ ID NO: 240123 - RNA, 22 nt, Homo sapiens
ucaguacuuuggagcucacaua

SEQ ID NO: 240124 - RNA, 23 nt, Homo sapiens
ucaguagucauugggaaagugug

SEQ ID NO: 240125 - RNA, 18 nt, Homo sapiens
ucagucacugccuggcuu

SEQ ID NO: 240126 - RNA, 22 nt, Homo sapiens
ucagucauucaauuguugaaug

SEQ ID NO: 240127 - RNA, 22 nt, Homo sapiens
ucagugaauacauguacucaug

SEQ ID NO: 240128 - RNA, 22 nt, Homo sapiens
ucagugacugcugcuuguauac

SEQ ID NO: 240129 - RNA, 22 nt, Homo sapiens
ucagugauugcuuucauggaaa

SEQ ID NO: 240130 - RNA, 21 nt, Homo sapiens
ucagugcaauucuauggggaa

SEQ ID NO: 240131 - RNA, 22 nt, Homo sapiens
ucagugcuuggcacagagagcu

SEQ ID NO: 240132 - RNA, 22 nt, Homo sapiens
ucaguggagcuacaauucuggg

SEQ ID NO: 240133 - RNA, 22 nt, Homo sapiens
ucagugguuaaaagauucuaga

SEQ ID NO: 240134 - RNA, 22 nt, Homo sapiens
aagacuguaauccaucuugagu

SEQ ID NO: 240135 - RNA, 22 nt, Homo sapiens
aagagagccagcugguauauuu

SEQ ID NO: 240136 - RNA, 22 nt, Homo sapiens
aagagagcuaugugcauaauua

SEQ ID NO: 240137 - RNA, 22 nt, Homo sapiens
aagagguaggaaauggucauuu

SEQ ID NO: 240138 - RNA, 22 nt, Homo sapiens
aagagguuguaccuaaaguguu

SEQ ID NO: 240139 - RNA, 22 nt, Homo sapiens
aagagguuuaacugacucacag

SEQ ID NO: 240140 - RNA, 22 nt, Homo sapiens
aagaugcagaagcccagauguu

SEQ ID NO: 240141 - RNA, 22 nt, Homo sapiens
aagaugcagucauacuggagua

SEQ ID NO: 240142 - RNA, 22 nt, Homo sapiens
aagcaaacaucagcuugguuaa

SEQ ID NO: 240143 - RNA, 22 nt, Homo sapiens
aagcacccagccucacgccugc

SEQ ID NO: 240144 - RNA, 22 nt, Homo sapiens
aagcaggugugggaggaaaugg

SEQ ID NO: 240145 - RNA, 22 nt, Homo sapiens
aagcaguguggacuaaugggaa

SEQ ID NO: 240146 - RNA, 21 nt, Homo sapiens
aagcaugguguaucuuuccau

SEQ ID NO: 240147 - RNA, 22 nt, Homo sapiens
aagcuggagugcaguggugcaa

SEQ ID NO: 240148 - RNA, 22 nt, Homo sapiens
aagcuggagugcaguggugcga

SEQ ID NO: 240149 - RNA, 22 nt, Homo sapiens
aagcugguguugcugcucuguu

SEQ ID NO: 240150 - RNA, 22 nt, Homo sapiens
aagcuguugguggaucuaccau

SEQ ID NO: 240151 - RNA, 22 nt, Homo sapiens
aagcuguuguucauccugaauu

SEQ ID NO: 240152 - RNA, 22 nt, Homo sapiens
aaggaguaucuguuuucucacc

SEQ ID NO: 240153 - RNA, 22 nt, Homo sapiens
aaggcaacgugaguuguugauu

SEQ ID NO: 240154 - RNA, 22 nt, Homo sapiens
aaggcaauuuguugugaggauu

SEQ ID NO: 240155 - RNA, 22 nt, Homo sapiens
aagggaaugcuuccaguuugug

SEQ ID NO: 240156 - RNA, 22 nt, Homo sapiens
aagggaaugugguagcugguuu

SEQ ID NO: 240157 - RNA, 22 nt, Homo sapiens
aagggaauguuguagcugguuu

SEQ ID NO: 240158 - RNA, 23 nt, Homo sapiens
aagguaagcuagaaagauguaga

SEQ ID NO: 240159 - RNA, 18 nt, Homo sapiens
aaggugcuucuguucuga

SEQ ID NO: 240160 - RNA, 22 nt, Homo sapiens
aaguaauugagguuuuugcugu

SEQ ID NO: 240161 - RNA, 22 nt, Homo sapiens
aaguagcuggaugcaguggcac

SEQ ID NO: 240162 - RNA, 22 nt, Homo sapiens
aagugaauguuugguagcagug

SEQ ID NO: 240163 - RNA, 22 nt, Homo sapiens
aagugagaugcaguggaguucc

SEQ ID NO: 240164 - RNA, 23 nt, Homo sapiens
aagugagcuccaauugggugaga

SEQ ID NO: 240165 - RNA, 22 nt, Homo sapiens
aagugcccuauuuggcccuuga

SEQ ID NO: 240166 - RNA, 21 nt, Homo sapiens
aagugcucugggacucuaaau

SEQ ID NO: 240167 - RNA, 22 nt, Homo sapiens
aagugcuuaggauagugugugg

SEQ ID NO: 240168 - RNA, 20 nt, Homo sapiens
aagugcuuccuuuuagaggg

SEQ ID NO: 240169 - RNA, 22 nt, Homo sapiens
aagugcuuuacacaugcaugau

SEQ ID NO: 240170 - RNA, 22 nt, Homo sapiens
aagugguguuuguauuuaugca

SEQ ID NO: 240171 - RNA, 22 nt, Homo sapiens
guggaucacuugaggucaagag

SEQ ID NO: 240172 - RNA, 22 nt, Homo sapiens
guggcaaguguuccaagaggcg

SEQ ID NO: 240173 - RNA, 22 nt, Homo sapiens
guggcagaacagguaggguucu

SEQ ID NO: 240174 - RNA, 22 nt, Homo sapiens
guggcagagucagagggaaaug

SEQ ID NO: 240175 - RNA, 21 nt, Homo sapiens
guggccuuuggagcaugucag

SEQ ID NO: 240176 - RNA, 22 nt, Homo sapiens
guggcgagaucauagcucauug

SEQ ID NO: 240177 - RNA, 22 nt, Homo sapiens
guggcuuguaggggucaaggga

SEQ ID NO: 240178 - RNA, 22 nt, Homo sapiens
gugggauaauuuuuggugcugu

SEQ ID NO: 240179 - RNA, 22 nt, Homo sapiens
gugggaugaucgcuugagccca

SEQ ID NO: 240180 - RNA, 22 nt, Homo sapiens
gugggauggagagaagguauga

SEQ ID NO: 240181 - RNA, 22 nt, Homo sapiens
gugggcaaagcuaguguguaga

SEQ ID NO: 240182 - RNA, 22 nt, Homo sapiens
guggguaaaucucuguuugagg

SEQ ID NO: 240183 - RNA, 22 nt, Homo sapiens
guggucagaaaucucaguggca

SEQ ID NO: 240184 - RNA, 22 nt, Homo sapiens
gugguuuuacaaagagaaagau

SEQ ID NO: 240185 - RNA, 22 nt, Homo sapiens
gugguuuuuagauuucuacagu

SEQ ID NO: 240186 - RNA, 22 nt, Homo sapiens
guguauguuucucccugucccu

SEQ ID NO: 240187 - RNA, 22 nt, Homo sapiens
gugucaugagggggacaggaag

SEQ ID NO: 240188 - RNA, 18 nt, Homo sapiens
gugucugguuaugggagu

SEQ ID NO: 240189 - RNA, 22 nt, Homo sapiens
gugugaacaucauagaguguau

SEQ ID NO: 240190 - RNA, 22 nt, Homo sapiens
gugugacagcuauagacaugau

SEQ ID NO: 240191 - RNA, 22 nt, Homo sapiens
gugugcaacuuucauuaauauu

SEQ ID NO: 240192 - RNA, 22 nt, Homo sapiens
gugugcaauuuugugggaggca

SEQ ID NO: 240193 - RNA, 22 nt, Homo sapiens
gugugcauggagggggcaguga

SEQ ID NO: 240194 - RNA, 21 nt, Homo sapiens
gugugcuugaauucagcuguc

SEQ ID NO: 240195 - RNA, 22 nt, Homo sapiens
guguuugguugauagagccacu

SEQ ID NO: 240196 - RNA, 22 nt, Homo sapiens
guuacugucuuccugauugcuu

SEQ ID NO: 240197 - RNA, 22 nt, Homo sapiens
guucaagugauucuacugccuc

SEQ ID NO: 240198 - RNA, 22 nt, Homo sapiens
guucacacuugcaaccccagca

SEQ ID NO: 240199 - RNA, 22 nt, Homo sapiens
guucacagugguugccuuccag

SEQ ID NO: 240200 - RNA, 22 nt, Homo sapiens
guucagguauucuggaacagag

SEQ ID NO: 240201 - RNA, 22 nt, Homo sapiens
uagaugauucacuuuacuucca

SEQ ID NO: 240202 - RNA, 21 nt, Homo sapiens
uagaugguguucuagagagaa

SEQ ID NO: 240203 - RNA, 22 nt, Homo sapiens
uagauuaucccugauuugucca

SEQ ID NO: 240204 - RNA, 22 nt, Homo sapiens
uagcaaaucaauggaauugaag

SEQ ID NO: 240205 - RNA, 20 nt, Homo sapiens
uagcacacauguagaauagu

SEQ ID NO: 240206 - RNA, 22 nt, Homo sapiens
uagcaccugugcacaccaggca

SEQ ID NO: 240207 - RNA, 22 nt, Homo sapiens
uagcacugucuugcaccugugc

SEQ ID NO: 240208 - RNA, 22 nt, Homo sapiens
uagcagaauaacuugccagccu

SEQ ID NO: 240209 - RNA, 22 nt, Homo sapiens
uagcagcauaaauggacuaaga

SEQ ID NO: 240210 - RNA, 22 nt, Homo sapiens
uagcagcaucucuggcuucuac

SEQ ID NO: 240211 - RNA, 22 nt, Homo sapiens
uagcaguaagaaacugacauug

SEQ ID NO: 240212 - RNA, 22 nt, Homo sapiens
uagcagugucuagguaggccau

SEQ ID NO: 240213 - RNA, 22 nt, Homo sapiens
uagcauaauuuguagaaaauca

SEQ ID NO: 240214 - RNA, 22 nt, Homo sapiens
uagcaucagauuccauauucua

SEQ ID NO: 240215 - RNA, 22 nt, Homo sapiens
uagcauccuucucuaaacagga

SEQ ID NO: 240216 - RNA, 21 nt, Homo sapiens
uagcucagugguguugccaua

SEQ ID NO: 240217 - RNA, 23 nt, Homo sapiens
uagcuucucccagaccugcuccc

SEQ ID NO: 240218 - RNA, 18 nt, Homo sapiens
uaggaacauugauuggag

SEQ ID NO: 240219 - RNA, 22 nt, Homo sapiens
uaggaaguuuucuugcugggcc

SEQ ID NO: 240220 - RNA, 22 nt, Homo sapiens
uaggacacagaccuggauggaa

SEQ ID NO: 240221 - RNA, 22 nt, Homo sapiens
uaggagcacaaaccccauugug

SEQ ID NO: 240222 - RNA, 22 nt, Homo sapiens
uaggauaguccuccugagaccu

SEQ ID NO: 240223 - RNA, 22 nt, Homo sapiens
uaggaucauuuuauguugccca

SEQ ID NO: 240224 - RNA, 22 nt, Homo sapiens
uaggcaauggagauagaggaug

SEQ ID NO: 240225 - RNA, 22 nt, Homo sapiens
uaggcagccagcuguggauuga

SEQ ID NO: 240226 - RNA, 22 nt, Homo sapiens
uaggccuuuuucagauggguag

SEQ ID NO: 240227 - RNA, 22 nt, Homo sapiens
uagggcauguguggaguguaug

SEQ ID NO: 240228 - RNA, 22 nt, Homo sapiens
uaggggcacacuucgguuagca

SEQ ID NO: 240229 - RNA, 19 nt, Homo sapiens
uagguacauucaagucucc

SEQ ID NO: 240230 - RNA, 22 nt, Homo sapiens
uagguagauuuaaagauuuucu

SEQ ID NO: 240231 - RNA, 22 nt, Homo sapiens
uagguaucuuuauagcaguagc

SEQ ID NO: 240232 - RNA, 22 nt, Homo sapiens
uagguauguauauacacacaca

SEQ ID NO: 240233 - RNA, 22 nt, Homo sapiens
uagguuguccaucucuagaagc

SEQ ID NO: 240234 - RNA, 22 nt, Homo sapiens
uaguaacacauugaacgaucgc

SEQ ID NO: 240235 - RNA, 23 nt, Homo sapiens
uaguaccauauuguuggcagcac

SEQ ID NO: 240236 - RNA, 22 nt, Homo sapiens
uaguaucacauggucuuaauua

SEQ ID NO: 240237 - RNA, 22 nt, Homo sapiens
uagucacacacucaacuuuuca

SEQ ID NO: 240238 - RNA, 18 nt, Homo sapiens
uagugcuguucucaugau

SEQ ID NO: 240239 - RNA, 22 nt, Homo sapiens
uaguguuuuucauuggcagagg

SEQ ID NO: 240240 - RNA, 22 nt, Homo sapiens
uauaaaguaauuucuaggggcu

SEQ ID NO: 240241 - RNA, 23 nt, Homo sapiens
uauaacuuuuaauuuacuggccu

SEQ ID NO: 240242 - RNA, 22 nt, Homo sapiens
uauagcaaugccccacuccuga

SEQ ID NO: 240243 - RNA, 22 nt, Homo sapiens
uauagcaaugugccacucucug

SEQ ID NO: 240244 - RNA, 22 nt, Homo sapiens
uauagcacugcaauauuucccu

SEQ ID NO: 240245 - RNA, 22 nt, Homo sapiens
uaucaagauggauaaggauaga

SEQ ID NO: 240246 - RNA, 21 nt, Homo sapiens
uaucacaguagaauaggaucu

SEQ ID NO: 240247 - RNA, 20 nt, Homo sapiens
uaucacaguucaggaacucu

SEQ ID NO: 240248 - RNA, 22 nt, Homo sapiens
uaucacaguugcauauuuaagg

SEQ ID NO: 240249 - RNA, 20 nt, Homo sapiens
uaucacauggggagaaaccu

SEQ ID NO: 240250 - RNA, 21 nt, Homo sapiens
uaucacauuggugauuaaguu

SEQ ID NO: 240251 - RNA, 22 nt, Homo sapiens
uaucaccacccugggaaacaua

SEQ ID NO: 240252 - RNA, 22 nt, Homo sapiens
uaucaccuugguagucuugggg

SEQ ID NO: 240253 - RNA, 22 nt, Homo sapiens
uaucagcagagucauacuucaa

SEQ ID NO: 240254 - RNA, 22 nt, Homo sapiens
uaucaugucuguguguaccuag

SEQ ID NO: 240255 - RNA, 21 nt, Homo sapiens
uaucccagucacaucuaccca

SEQ ID NO: 240256 - RNA, 22 nt, Homo sapiens
uaucucagagaaucagauuuac

SEQ ID NO: 240257 - RNA, 22 nt, Homo sapiens
uaucucauccuccuugauccca

SEQ ID NO: 240258 - RNA, 22 nt, Homo sapiens
uaucugcacauacacuuauagc

SEQ ID NO: 240259 - RNA, 22 nt, Homo sapiens
uaugaaccuguuaucuagguuu

SEQ ID NO: 240260 - RNA, 22 nt, Homo sapiens
uaugaugcuguuuagaaucucu

SEQ ID NO: 240261 - RNA, 22 nt, Homo sapiens
uaugcacacucucccaggaggg

SEQ ID NO: 240262 - RNA, 22 nt, Homo sapiens
uaugcacaugugccugggugug

SEQ ID NO: 240263 - RNA, 22 nt, Homo sapiens
uaugcagacauuguuccaacca

SEQ ID NO: 240264 - RNA, 22 nt, Homo sapiens
uaugccuuugaccauuuuguga

SEQ ID NO: 240265 - RNA, 22 nt, Homo sapiens
uaugccuuuugguucaagcaac

SEQ ID NO: 240266 - RNA, 22 nt, Homo sapiens
uaugcuuguuuauuuaagaaac

SEQ ID NO: 240267 - RNA, 22 nt, Homo sapiens
uauggauuugcauuccccaugu

SEQ ID NO: 240268 - RNA, 22 nt, Homo sapiens
uauggauuuuggaauauguggg

SEQ ID NO: 240269 - RNA, 22 nt, Homo sapiens
uauggcccuuaaguauugguug

SEQ ID NO: 240270 - RNA, 22 nt, Homo sapiens
uauggcuacuacgaauaaugcu

SEQ ID NO: 240271 - RNA, 22 nt, Homo sapiens
uauggcuuuguucaacagccuc

SEQ ID NO: 240272 - RNA, 17 nt, Homo sapiens
uauguaguacuuauaaa

SEQ ID NO: 240273 - RNA, 22 nt, Homo sapiens
guucaguaguucauucauuuau

SEQ ID NO: 240274 - RNA, 22 nt, Homo sapiens
guucaguuuuaaagggaaauug

SEQ ID NO: 240275 - RNA, 22 nt, Homo sapiens
guucccaguugaaaugauuagu

SEQ ID NO: 240276 - RNA, 22 nt, Homo sapiens
guugaguuugaccugaacucug

SEQ ID NO: 240277 - RNA, 22 nt, Homo sapiens
guugcucaggcuggagugcagu

SEQ ID NO: 240278 - RNA, 22 nt, Homo sapiens
guugcugagucccaucaccaga

SEQ ID NO: 240279 - RNA, 22 nt, Homo sapiens
guuggaauguauugcuacuucu

SEQ ID NO: 240280 - RNA, 22 nt, Homo sapiens
guuggugaccugaagagaguaa

SEQ ID NO: 240281 - RNA, 22 nt, Homo sapiens
guuguggagucuucuguucugg

SEQ ID NO: 240282 - RNA, 22 nt, Homo sapiens
guuuacagucgacuugggaaua

SEQ ID NO: 240283 - RNA, 22 nt, Homo sapiens
guuuaggaaugagaauauuuag

SEQ ID NO: 240284 - RNA, 17 nt, Homo sapiens
guuuggguacuggguaa

SEQ ID NO: 240285 - RNA, 22 nt, Homo sapiens
guuuugguuauauggaucaguu

SEQ ID NO: 240286 - RNA, 15 nt, Homo sapiens
guuuuuggauacaau

SEQ ID NO: 240287 - RNA, 22 nt, Homo sapiens
uaaacugcuugaggguaaguac

SEQ ID NO: 240288 - RNA, 22 nt, Homo sapiens
uaaagcauguaauuagguuaga

SEQ ID NO: 240289 - RNA, 17 nt, Homo sapiens
uaaagccagucaaguca

SEQ ID NO: 240290 - RNA, 22 nt, Homo sapiens
uaaagccagugauuaugucucu

SEQ ID NO: 240291 - RNA, 22 nt, Homo sapiens
uaaagcuuagauccaugguggc

SEQ ID NO: 240292 - RNA, 21 nt, Homo sapiens
uaaagcuuagcuauaguggcu

SEQ ID NO: 240293 - RNA, 22 nt, Homo sapiens
uaaaguucuuuuaugggccggg

SEQ ID NO: 240294 - RNA, 20 nt, Homo sapiens
uaaaugccucaugcuuuauu

SEQ ID NO: 240295 - RNA, 22 nt, Homo sapiens
uaaauggauaaaugaauaccua

SEQ ID NO: 240296 - RNA, 22 nt, Homo sapiens
uaacacagagcuccuaaucccu

SEQ ID NO: 240297 - RNA, 22 nt, Homo sapiens
uaacauagucauauacuugcuu

SEQ ID NO: 240298 - RNA, 23 nt, Homo sapiens
uaacauguuuuuaagggaagcuu

SEQ ID NO: 240299 - RNA, 22 nt, Homo sapiens
uaacauucacaugcugcaaaaa

SEQ ID NO: 240300 - RNA, 22 nt, Homo sapiens
uaacccuuacaacuacacucgu

SEQ ID NO: 240301 - RNA, 22 nt, Homo sapiens
uaacugucucaggccaugggcg

SEQ ID NO: 240302 - RNA, 18 nt, Homo sapiens
uaacugugggaacuaacu

SEQ ID NO: 240303 - RNA, 22 nt, Homo sapiens
uaagacacuuaaaauguuacau

SEQ ID NO: 240304 - RNA, 22 nt, Homo sapiens
uaagcaguaaaugaagucuugc

SEQ ID NO: 240305 - RNA, 20 nt, Homo sapiens
uaagccacacagucuaaggu

SEQ ID NO: 240306 - RNA, 22 nt, Homo sapiens
uaaggaaggcugugugcuuuua

SEQ ID NO: 240307 - RNA, 20 nt, Homo sapiens
uaaggcacugugcuuuuagg

SEQ ID NO: 240308 - RNA, 22 nt, Homo sapiens
uaaggcuuugucuuaggacuuu

SEQ ID NO: 240309 - RNA, 22 nt, Homo sapiens
uaagggcacuaaucccauuuau

SEQ ID NO: 240310 - RNA, 22 nt, Homo sapiens
uaagguacuuuggagaaaacug

SEQ ID NO: 240311 - RNA, 22 nt, Homo sapiens
uaagguccuuaaauguguaacc

SEQ ID NO: 240312 - RNA, 22 nt, Homo sapiens
uaaguauuaggccccaggcugg

SEQ ID NO: 240313 - RNA, 23 nt, Homo sapiens
uaagucacacagauuaauuuauu

SEQ ID NO: 240314 - RNA, 22 nt, Homo sapiens
uaagugaauauggacaguuagc

SEQ ID NO: 240315 - RNA, 22 nt, Homo sapiens
uaagugcuugacuuugauguuu

SEQ ID NO: 240316 - RNA, 20 nt, Homo sapiens
uaagugcuugaugaaugaac

SEQ ID NO: 240317 - RNA, 22 nt, Homo sapiens
uaaguugcagguugugauucca

SEQ ID NO: 240318 - RNA, 22 nt, Homo sapiens
uaaguuguagaacguuuucuua

SEQ ID NO: 240319 - RNA, 21 nt, Homo sapiens
uaauaaugucucagacaccua

SEQ ID NO: 240320 - RNA, 22 nt, Homo sapiens
uaauacugcugugcuugaguug

SEQ ID NO: 240321 - RNA, 22 nt, Homo sapiens
uaauccugucuugaccaucagg

SEQ ID NO: 240322 - RNA, 22 nt, Homo sapiens
uaaucucagcuacucaggaggc

SEQ ID NO: 240323 - RNA, 22 nt, Homo sapiens
uaauugaaugcagacaccaggg

SEQ ID NO: 240324 - RNA, 22 nt, Homo sapiens
uacaaaguaacaguuccuguau

SEQ ID NO: 240325 - RNA, 22 nt, Homo sapiens
uacacagucaaaaauuuccagg

SEQ ID NO: 240326 - RNA, 22 nt, Homo sapiens
uacacaugugaguucuuuucua

SEQ ID NO: 240327 - RNA, 22 nt, Homo sapiens
uacaccugcacucuagccuggg

SEQ ID NO: 240328 - RNA, 18 nt, Homo sapiens
uacagaacuggaguagaa

SEQ ID NO: 240329 - RNA, 22 nt, Homo sapiens
uacagaauauuucugcccugag

SEQ ID NO: 240330 - RNA, 22 nt, Homo sapiens
uacagccacauaauguaugauu

SEQ ID NO: 240331 - RNA, 19 nt, Homo sapiens
uacaggacugagcugaggu

SEQ ID NO: 240332 - RNA, 22 nt, Homo sapiens
uacaggugcucuacagacagga

SEQ ID NO: 240333 - RNA, 22 nt, Homo sapiens
uacaggugcuuauguggacaua

SEQ ID NO: 240334 - RNA, 19 nt, Homo sapiens
uacaguacacaacaccuuu

SEQ ID NO: 240335 - RNA, 22 nt, Homo sapiens
uacaguacacagguaccaagcu

SEQ ID NO: 240336 - RNA, 22 nt, Homo sapiens
uacaguacagugacaccauuau

SEQ ID NO: 240337 - RNA, 22 nt, Homo sapiens
uacaguauuaugagugauugaa

SEQ ID NO: 240338 - RNA, 22 nt, Homo sapiens
uacagugcuugguaucuaguaa

SEQ ID NO: 240339 - RNA, 22 nt, Homo sapiens
uacagugcuuuuugguggagaa

SEQ ID NO: 240340 - RNA, 22 nt, Homo sapiens
uacaguguuuugguauuccaca

SEQ ID NO: 240341 - RNA, 22 nt, Homo sapiens
uacaugcaugggcaugugugca

SEQ ID NO: 240342 - RNA, 22 nt, Homo sapiens
uacauguauccauuguuuuugg

SEQ ID NO: 240343 - RNA, 22 nt, Homo sapiens
uaccacaggcuggguaaucuau

SEQ ID NO: 240344 - RNA, 22 nt, Homo sapiens
uaccacauuguagagggcauuc

SEQ ID NO: 240345 - RNA, 22 nt, Homo sapiens
uggucaccugaauuaugcaugu

SEQ ID NO: 240346 - RNA, 22 nt, Homo sapiens
uggucaccuucuugcucugucu

SEQ ID NO: 240347 - RNA, 22 nt, Homo sapiens
uggucagaaaauuacuugauau

SEQ ID NO: 240348 - RNA, 19 nt, Homo sapiens
uggucaguucugggagcug

SEQ ID NO: 240349 - RNA, 22 nt, Homo sapiens
uggucaguugugccucaauucc

SEQ ID NO: 240350 - RNA, 21 nt, Homo sapiens
uggucaguuuucucacuagga

SEQ ID NO: 240351 - RNA, 22 nt, Homo sapiens
uggucaugaggugaggcuucuc

SEQ ID NO: 240352 - RNA, 21 nt, Homo sapiens
uggucccauaagauuacaaug

SEQ ID NO: 240353 - RNA, 20 nt, Homo sapiens
ugguccccaccaaaucucau

SEQ ID NO: 240354 - RNA, 22 nt, Homo sapiens
uggucccucugaaaauugggug

SEQ ID NO: 240355 - RNA, 22 nt, Homo sapiens
uggucuccuuuguacccugggc

SEQ ID NO: 240356 - RNA, 22 nt, Homo sapiens
uggucucuuugcuuuagucauc

SEQ ID NO: 240357 - RNA, 22 nt, Homo sapiens
ugguggcuuuucguagguucac

SEQ ID NO: 240358 - RNA, 15 nt, Homo sapiens
uggugguguugagac

SEQ ID NO: 240359 - RNA, 20 nt, Homo sapiens
uggugucuuggaaagagcuc

SEQ ID NO: 240360 - RNA, 22 nt, Homo sapiens
ugguuccauauuaauuuuagga

SEQ ID NO: 240361 - RNA, 22 nt, Homo sapiens
uguaaaucuauuuuuaguguuu

SEQ ID NO: 240362 - RNA, 22 nt, Homo sapiens
uguaaaucugguuaauuggaua

SEQ ID NO: 240363 - RNA, 20 nt, Homo sapiens
uguaacaaucuggauguugc

SEQ ID NO: 240364 - RNA, 22 nt, Homo sapiens
uguaacacacacuguuuacucc

SEQ ID NO: 240365 - RNA, 22 nt, Homo sapiens
uguaagcauuauauaauuguug

SEQ ID NO: 240366 - RNA, 20 nt, Homo sapiens
uguaaucuaaguuuuaagcc

SEQ ID NO: 240367 - RNA, 22 nt, Homo sapiens
uguaauguuucaucauuauuaa

SEQ ID NO: 240368 - RNA, 19 nt, Homo sapiens
uguaccagcaagucuuuuc

SEQ ID NO: 240369 - RNA, 23 nt, Homo sapiens
uguauacacccugugcaucuggg

SEQ ID NO: 240370 - RNA, 22 nt, Homo sapiens
uguaugcuuuugagagauauuu

SEQ ID NO: 240371 - RNA, 22 nt, Homo sapiens
uguaugucugcucuuuggaacu

SEQ ID NO: 240372 - RNA, 22 nt, Homo sapiens
uguauguuguaagacuuagacc

SEQ ID NO: 240373 - RNA, 22 nt, Homo sapiens
ugucaaacauuaugaugcucua

SEQ ID NO: 240374 - RNA, 22 nt, Homo sapiens
ugucaagaaaucaaggugugag

SEQ ID NO: 240375 - RNA, 21 nt, Homo sapiens
ugucaagugggaaaacaugua

SEQ ID NO: 240376 - RNA, 22 nt, Homo sapiens
ugucaccuugcucauccucgga

SEQ ID NO: 240377 - RNA, 22 nt, Homo sapiens
ugucacugugaguuugacugcu

SEQ ID NO: 240378 - RNA, 22 nt, Homo sapiens
ugucacugugcagucaugcauu

SEQ ID NO: 240379 - RNA, 22 nt, Homo sapiens
ugucagaaucuagaggcugcua

SEQ ID NO: 240380 - RNA, 22 nt, Homo sapiens
ugucaguguacuguaagaauua

SEQ ID NO: 240381 - RNA, 21 nt, Homo sapiens
ugucaguuuccagaguucaac

SEQ ID NO: 240382 - RNA, 22 nt, Homo sapiens
ugucaguuucccuccucuuccu

SEQ ID NO: 240383 - RNA, 19 nt, Homo sapiens
ugucaucaucuuuucuugc

SEQ ID NO: 240384 - RNA, 22 nt, Homo sapiens
ugucauguagaaauuguccauu

SEQ ID NO: 240385 - RNA, 22 nt, Homo sapiens
ugucaugugagggaacuuguuc

SEQ ID NO: 240386 - RNA, 22 nt, Homo sapiens
ugucauguuucuacugaccaaa

SEQ ID NO: 240387 - RNA, 20 nt, Homo sapiens
ugucauuaagcacugugcca

SEQ ID NO: 240388 - RNA, 16 nt, Homo sapiens
uguccaaauaaauaca

SEQ ID NO: 240389 - RNA, 20 nt, Homo sapiens
ugucccaaccccauggguuc

SEQ ID NO: 240390 - RNA, 19 nt, Homo sapiens
ugucccagccauagaggca

SEQ ID NO: 240391 - RNA, 22 nt, Homo sapiens
ugucucaguuucuguggguuag

SEQ ID NO: 240392 - RNA, 21 nt, Homo sapiens
ugucugagagaggagaucuac

SEQ ID NO: 240393 - RNA, 22 nt, Homo sapiens
ugucuggaaggguggccuccug

SEQ ID NO: 240394 - RNA, 22 nt, Homo sapiens
ugucuguuugcgaaauugcuuc

SEQ ID NO: 240395 - RNA, 16 nt, Homo sapiens
ugucuguuugggcaca

SEQ ID NO: 240396 - RNA, 22 nt, Homo sapiens
ugucuugagagaggacaugacu

SEQ ID NO: 240397 - RNA, 22 nt, Homo sapiens
ugucuuguagacaauguauagu

SEQ ID NO: 240398 - RNA, 22 nt, Homo sapiens
ugucuuguagacugaaggcuuc

SEQ ID NO: 240399 - RNA, 22 nt, Homo sapiens
ugugaaacauggauagaacugg

SEQ ID NO: 240400 - RNA, 21 nt, Homo sapiens
ugugaaaucuaggcagagguu

SEQ ID NO: 240401 - RNA, 19 nt, Homo sapiens
ugugaacaucacagagugu

SEQ ID NO: 240402 - RNA, 22 nt, Homo sapiens
ugugaacauuuuguauauauua

SEQ ID NO: 240403 - RNA, 22 nt, Homo sapiens
ugugaauggugcugccgugaag

SEQ ID NO: 240404 - RNA, 22 nt, Homo sapiens
ugugacaguguuacauuucaug

SEQ ID NO: 240405 - RNA, 22 nt, Homo sapiens
ugugaccaaaaucaacauaccu

SEQ ID NO: 240406 - RNA, 19 nt, Homo sapiens
ugugacugggccagccuag

SEQ ID NO: 240407 - RNA, 22 nt, Homo sapiens
ugugagaaaugcagaaucucag

SEQ ID NO: 240408 - RNA, 22 nt, Homo sapiens
ugugaguguguacuaguuauca

SEQ ID NO: 240409 - RNA, 22 nt, Homo sapiens
ugugaucaaccugcagggcugg

SEQ ID NO: 240410 - RNA, 17 nt, Homo sapiens
ugugaucaucacccuug

SEQ ID NO: 240411 - RNA, 22 nt, Homo sapiens
ugugaugguuuggaagcuucuu

SEQ ID NO: 240412 - RNA, 22 nt, Homo sapiens
ugugcaaauguuaaacuaacuu

SEQ ID NO: 240413 - RNA, 22 nt, Homo sapiens
ugugcaaucuuccauuuuuagg

SEQ ID NO: 240414 - RNA, 22 nt, Homo sapiens
ugugccaaucauagggcuuggu

SEQ ID NO: 240415 - RNA, 22 nt, Homo sapiens
ugugccacuccagcucuagcuu

SEQ ID NO: 240416 - RNA, 22 nt, Homo sapiens
ugugccacugcacucccgccug

SEQ ID NO: 240417 - RNA, 22 nt, Homo sapiens
ugugccacugcacuccugggug

SEQ ID NO: 240418 - RNA, 22 nt, Homo sapiens
ugugccuacugugggagcguca

SEQ ID NO: 240419 - RNA, 22 nt, Homo sapiens
ugugcgcaucggggccugcuuc

SEQ ID NO: 240420 - RNA, 22 nt, Homo sapiens
ugugcuaaaaugggacuucuaa

SEQ ID NO: 240421 - RNA, 22 nt, Homo sapiens
uguggaaauaaaagaaagguua

SEQ ID NO: 240422 - RNA, 22 nt, Homo sapiens
uguggaguguaugugacagaga

SEQ ID NO: 240423 - RNA, 22 nt, Homo sapiens
uuaaguuguagcuacaaauaca

SEQ ID NO: 240424 - RNA, 22 nt, Homo sapiens
uuaaucacagcugaacucaaac

SEQ ID NO: 240425 - RNA, 22 nt, Homo sapiens
uuaaugacaucauaggugaagu

SEQ ID NO: 240426 - RNA, 21 nt, Homo sapiens
uuaaugcuaugcagaaaaucu

SEQ ID NO: 240427 - RNA, 22 nt, Homo sapiens
uuaauguaucuaucacaucaca

SEQ ID NO: 240428 - RNA, 22 nt, Homo sapiens
uuaauuguccauuauucuguuc

SEQ ID NO: 240429 - RNA, 22 nt, Homo sapiens
uuacaacugucuuacugguuau

SEQ ID NO: 240430 - RNA, 22 nt, Homo sapiens
uuacugcuagcugugugcucuu

SEQ ID NO: 240431 - RNA, 22 nt, Homo sapiens
uuagaacagugcucaccacaaa

SEQ ID NO: 240432 - RNA, 23 nt, Homo sapiens
uuagaucuuuaaggaaucuccac

SEQ ID NO: 240433 - RNA, 22 nt, Homo sapiens
uuagaugaagucacagaaccca

SEQ ID NO: 240434 - RNA, 18 nt, Homo sapiens
uuagaugguuuuaaaacu

SEQ ID NO: 240435 - RNA, 22 nt, Homo sapiens
uuagauuauugagcauccacug

SEQ ID NO: 240436 - RNA, 22 nt, Homo sapiens
uuagcaauugauucucauaagc

SEQ ID NO: 240437 - RNA, 22 nt, Homo sapiens
uuagcagcaucccuggccugua

SEQ ID NO: 240438 - RNA, 22 nt, Homo sapiens
uuagcagcaugaaaauggacug

SEQ ID NO: 240439 - RNA, 22 nt, Homo sapiens
uuagcagcaugagaauggacua

SEQ ID NO: 240440 - RNA, 21 nt, Homo sapiens
uuagcauccauguucaucaac

SEQ ID NO: 240441 - RNA, 22 nt, Homo sapiens
uuaggcucuuuaucaguuaacu

SEQ ID NO: 240442 - RNA, 22 nt, Homo sapiens
uuaggcuuuauugaaaacaaua

SEQ ID NO: 240443 - RNA, 22 nt, Homo sapiens
uuagguagaauugauuaaguuu

SEQ ID NO: 240444 - RNA, 18 nt, Homo sapiens
uuagguaggucuuugugu

SEQ ID NO: 240445 - RNA, 22 nt, Homo sapiens
uuaggugcauggaaguguuuuc

SEQ ID NO: 240446 - RNA, 23 nt, Homo sapiens
uuaguaaacucaaugacaccaca

SEQ ID NO: 240447 - RNA, 22 nt, Homo sapiens
uuaguaguaguuugcauuuacc

SEQ ID NO: 240448 - RNA, 22 nt, Homo sapiens
uuagugcugaguggaauguucu

SEQ ID NO: 240449 - RNA, 22 nt, Homo sapiens
uuauacuacuauaaagagguag

SEQ ID NO: 240450 - RNA, 22 nt, Homo sapiens
uuauagcacuaagaagguaaua

SEQ ID NO: 240451 - RNA, 22 nt, Homo sapiens
uuauaugcuaaacaaggggugg

SEQ ID NO: 240452 - RNA, 21 nt, Homo sapiens
uuaucccagugucucugcagg

SEQ ID NO: 240453 - RNA, 22 nt, Homo sapiens
uuauguaaaucaaucuggaauc

SEQ ID NO: 240454 - RNA, 22 nt, Homo sapiens
uuauuacuccuauuuuguagau

SEQ ID NO: 240455 - RNA, 22 nt, Homo sapiens
uuauuagagauauuugguuagg

SEQ ID NO: 240456 - RNA, 22 nt, Homo sapiens
uuauucauuaauugcuaagguu

SEQ ID NO: 240457 - RNA, 22 nt, Homo sapiens
uuauuguccaaguuucccuuug

SEQ ID NO: 240458 - RNA, 23 nt, Homo sapiens
uucaaaggaugcuuuauggaauu

SEQ ID NO: 240459 - RNA, 22 nt, Homo sapiens
uucaaaucuucguuuugccaua

SEQ ID NO: 240460 - RNA, 22 nt, Homo sapiens
uucaacagugauggccuuugua

SEQ ID NO: 240461 - RNA, 22 nt, Homo sapiens
uucaagcuacaguggcaggguu

SEQ ID NO: 240462 - RNA, 22 nt, Homo sapiens
uucaagcuauggugaucuuuuc

SEQ ID NO: 240463 - RNA, 22 nt, Homo sapiens
uucaagcugggcaaauaagggg

SEQ ID NO: 240464 - RNA, 22 nt, Homo sapiens
uucaauacuguugauccuuaug

SEQ ID NO: 240465 - RNA, 22 nt, Homo sapiens
uucaauuaauauuauacucuca

SEQ ID NO: 240466 - RNA, 22 nt, Homo sapiens
uucacaauuaaaugugguuauu

SEQ ID NO: 240467 - RNA, 22 nt, Homo sapiens
uucacacugggccuacucugug

SEQ ID NO: 240468 - RNA, 22 nt, Homo sapiens
uucacagaguuauuuuuaugcu

SEQ ID NO: 240469 - RNA, 22 nt, Homo sapiens
uucacaguguuucucacgguua

SEQ ID NO: 240470 - RNA, 22 nt, Homo sapiens
uucacaugacagggugaagcau

SEQ ID NO: 240471 - RNA, 22 nt, Homo sapiens
uucaccagggaagucucaacuc

SEQ ID NO: 240472 - RNA, 22 nt, Homo sapiens
uucaccuugcccacagcagucu

SEQ ID NO: 240473 - RNA, 22 nt, Homo sapiens
uucaccuugggucccacuugcu

SEQ ID NO: 240474 - RNA, 22 nt, Homo sapiens
uucacugcacuccagccugagc

SEQ ID NO: 240475 - RNA, 22 nt, Homo sapiens
uucacuguagccucagccucuu

SEQ ID NO: 240476 - RNA, 22 nt, Homo sapiens
uucacuguagcuuggauguuua

SEQ ID NO: 240477 - RNA, 22 nt, Homo sapiens
uucacugugcuuaaauucugcu

SEQ ID NO: 240478 - RNA, 22 nt, Homo sapiens
uucacugugugacccugggcca

SEQ ID NO: 240479 - RNA, 22 nt, Homo sapiens
uucagcacaguguggaucauuc

SEQ ID NO: 240480 - RNA, 22 nt, Homo sapiens
uucagcaggccaggcccugacu

SEQ ID NO: 240481 - RNA, 22 nt, Homo sapiens
uucaggcaccauugucauugau

SEQ ID NO: 240482 - RNA, 22 nt, Homo sapiens
uucagggacuuuagacaagaga

SEQ ID NO: 240483 - RNA, 22 nt, Homo sapiens
uucagggagaaggcaaacguug

SEQ ID NO: 240484 - RNA, 22 nt, Homo sapiens
uucagguacuauaggcuguugg

SEQ ID NO: 240485 - RNA, 22 nt, Homo sapiens
uucaguggguggaugaauauga

SEQ ID NO: 240486 - RNA, 22 nt, Homo sapiens
uucaguugcaucaguugaccag

SEQ ID NO: 240487 - RNA, 18 nt, Homo sapiens
uucaguuuguaucugggg

SEQ ID NO: 240488 - RNA, 22 nt, Homo sapiens
uucauagucuaauuuuuuccac

SEQ ID NO: 240489 - RNA, 21 nt, Homo sapiens
uucaucagccagaaaucaagc

SEQ ID NO: 240490 - RNA, 22 nt, Homo sapiens
uucauggauggaaaugauuuug

SEQ ID NO: 240491 - RNA, 22 nt, Homo sapiens
uuccacaaugguugaacuaauu

SEQ ID NO: 240492 - RNA, 22 nt, Homo sapiens
uuccacaggguugaacuaguuu

SEQ ID NO: 240493 - RNA, 22 nt, Homo sapiens
uuccaggugggcgugggccugg

SEQ ID NO: 240494 - RNA, 22 nt, Homo sapiens
uuccaguaauagcacagcauug

SEQ ID NO: 240495 - RNA, 22 nt, Homo sapiens
uuccaguuauuauaccucuuaa

SEQ ID NO: 240496 - RNA, 22 nt, Homo sapiens
uuccauguaguugagcaguuuu

SEQ ID NO: 240497 - RNA, 22 nt, Homo sapiens
uucccagagagggacuucuaau

SEQ ID NO: 240498 - RNA, 22 nt, Homo sapiens
uucccagugguuagcucugguc

SEQ ID NO: 240499 - RNA, 22 nt, Homo sapiens
uucccaguuggggaaagcgacc

SEQ ID NO: 240500 - RNA, 22 nt, Homo sapiens
uucccauuguuggccagcaugu

SEQ ID NO: 240501 - RNA, 22 nt, Homo sapiens
uucccuagaacacauggaggga

SEQ ID NO: 240502 - RNA, 20 nt, Homo sapiens
uucccucagccuugagggua

SEQ ID NO: 240503 - RNA, 22 nt, Homo sapiens
uucugcuagucugucagaucuu

SEQ ID NO: 240504 - RNA, 22 nt, Homo sapiens
uucuggccccucccaaucucau

SEQ ID NO: 240505 - RNA, 22 nt, Homo sapiens
uucuggcuuauaaacgugacuu

SEQ ID NO: 240506 - RNA, 22 nt, Homo sapiens
uucugugguugaaaggagagau

SEQ ID NO: 240507 - RNA, 22 nt, Homo sapiens
uucuguguuuaggucacggcua

SEQ ID NO: 240508 - RNA, 22 nt, Homo sapiens
uucuucaggcauucccagaagc

SEQ ID NO: 240509 - RNA, 22 nt, Homo sapiens
uucuucaggccacaaaaauggu

SEQ ID NO: 240510 - RNA, 22 nt, Homo sapiens
uucuucaguuacaacaaggggg

SEQ ID NO: 240511 - RNA, 22 nt, Homo sapiens
uucuuuggauaaaguuuuaugc

SEQ ID NO: 240512 - RNA, 22 nt, Homo sapiens
uugaaagcuaucucaaaucgcu

SEQ ID NO: 240513 - RNA, 22 nt, Homo sapiens
uugaaagucauggcacaggcaa

SEQ ID NO: 240514 - RNA, 22 nt, Homo sapiens
uugaaauguguaagcuccgaaa

SEQ ID NO: 240515 - RNA, 22 nt, Homo sapiens
uugaaauguuuagaaguuugga

SEQ ID NO: 240516 - RNA, 22 nt, Homo sapiens
uugaaccauucuuuugauagag

SEQ ID NO: 240517 - RNA, 22 nt, Homo sapiens
uugaagacuaaguuaucaggau

SEQ ID NO: 240518 - RNA, 22 nt, Homo sapiens
uugaagacuaauuuagauaaug

SEQ ID NO: 240519 - RNA, 22 nt, Homo sapiens
uugaaguagcauuucaugucua

SEQ ID NO: 240520 - RNA, 22 nt, Homo sapiens
uugaagugaagaacaauaucac

SEQ ID NO: 240521 - RNA, 22 nt, Homo sapiens
uugaauagacagccagcuuuaa

SEQ ID NO: 240522 - RNA, 22 nt, Homo sapiens
uugaaugcguuguguggcccgu

SEQ ID NO: 240523 - RNA, 22 nt, Homo sapiens
uugaaugucuauuaaguuguuu

SEQ ID NO: 240524 - RNA, 22 nt, Homo sapiens
uugacaaguuguccaguaugag

SEQ ID NO: 240525 - RNA, 22 nt, Homo sapiens
uugacaguugggcagggaaguu

SEQ ID NO: 240526 - RNA, 22 nt, Homo sapiens
uugacauaaucauuucacagug

SEQ ID NO: 240527 - RNA, 22 nt, Homo sapiens
uugacauugcuguaguguccag

SEQ ID NO: 240528 - RNA, 22 nt, Homo sapiens
uugacguaggaggauguugaga

SEQ ID NO: 240529 - RNA, 23 nt, Homo sapiens
uugacuguggguacaaugugaua

SEQ ID NO: 240530 - RNA, 22 nt, Homo sapiens
uugacugugguaauggaagcug

SEQ ID NO: 240531 - RNA, 22 nt, Homo sapiens
uugagacgaagucucacucuug

SEQ ID NO: 240532 - RNA, 22 nt, Homo sapiens
uugagacggagucucacucugu

SEQ ID NO: 240533 - RNA, 22 nt, Homo sapiens
uugagaguggaggcuauaucuu

SEQ ID NO: 240534 - RNA, 22 nt, Homo sapiens
uugagauaggaacucacuaugc

SEQ ID NO: 240535 - RNA, 22 nt, Homo sapiens
uugagauaggagcuguuguucu

SEQ ID NO: 240536 - RNA, 22 nt, Homo sapiens
uugagauggagucucacucugc

SEQ ID NO: 240537 - RNA, 22 nt, Homo sapiens
uugagauggagucucgcucugu

SEQ ID NO: 240538 - RNA, 22 nt, Homo sapiens
uugagauggagucuugcacugu

SEQ ID NO: 240539 - RNA, 22 nt, Homo sapiens
uugagauggagucuuguucucu

SEQ ID NO: 240540 - RNA, 22 nt, Homo sapiens
uugagauggaguuucacucuug

SEQ ID NO: 240541 - RNA, 19 nt, Homo sapiens
uugagaugugaacucacac

SEQ ID NO: 240542 - RNA, 22 nt, Homo sapiens
uugagauguggcaguuuaugag

SEQ ID NO: 240543 - RNA, 22 nt, Homo sapiens
uugagcaucauguuagcacuca

SEQ ID NO: 240544 - RNA, 22 nt, Homo sapiens
uugagcuuuuuacuuguccaau

SEQ ID NO: 240545 - RNA, 22 nt, Homo sapiens
uugaggacugagacagaccaag

SEQ ID NO: 240546 - RNA, 22 nt, Homo sapiens
uugaggaggcagucucuccauu

SEQ ID NO: 240547 - RNA, 22 nt, Homo sapiens
uugaggaucauuguuuucggag

SEQ ID NO: 240548 - RNA, 22 nt, Homo sapiens
uugaggcuuuugaccucaugug

SEQ ID NO: 240549 - RNA, 22 nt, Homo sapiens
uugagguaauaaacagccauuc

SEQ ID NO: 240550 - RNA, 22 nt, Homo sapiens
uugaggugggaggaucacuuga

SEQ ID NO: 240551 - RNA, 22 nt, Homo sapiens
uugaguaguaagugguucaccg

SEQ ID NO: 240552 - RNA, 22 nt, Homo sapiens
uugauaacauucugcauccuau

SEQ ID NO: 240553 - RNA, 22 nt, Homo sapiens
uugauaguccuguaucuauuuu

SEQ ID NO: 240554 - RNA, 22 nt, Homo sapiens
uugauaugguauaagauuucau

SEQ ID NO: 240555 - RNA, 22 nt, Homo sapiens
uugauauguuguuagauucagu

SEQ ID NO: 240556 - RNA, 22 nt, Homo sapiens
uugauauuaaguacugaagugg

SEQ ID NO: 240557 - RNA, 22 nt, Homo sapiens
uugauuagauccaguugauuga

SEQ ID NO: 240558 - RNA, 22 nt, Homo sapiens
uugcaaaguugccaaggaagga

SEQ ID NO: 240559 - RNA, 22 nt, Homo sapiens
uugcaaaucucuuguguuuggu

SEQ ID NO: 240560 - RNA, 22 nt, Homo sapiens
uugcaacauuguaaguuuauau

SEQ ID NO: 240561 - RNA, 22 nt, Homo sapiens
uugcaagaaaugcagauucuca

SEQ ID NO: 240562 - RNA, 22 nt, Homo sapiens
uugcacagugguuuagagccug

SEQ ID NO: 240563 - RNA, 22 nt, Homo sapiens
uugcacaguguguacagcacca

SEQ ID NO: 240564 - RNA, 22 nt, Homo sapiens
uugcaccacugcacuccacccu

SEQ ID NO: 240565 - RNA, 22 nt, Homo sapiens
uugcacuccagucuggggggca

SEQ ID NO: 240566 - RNA, 22 nt, Homo sapiens
uugcacuccggccuggguaaca

SEQ ID NO: 240567 - RNA, 22 nt, Homo sapiens
uugcacuguaauuuauuuaugu

SEQ ID NO: 240568 - RNA, 22 nt, Homo sapiens
uugcagcauucugguuccuggu

SEQ ID NO: 240569 - RNA, 22 nt, Homo sapiens
uugcaggcaugagccaccgugc

SEQ ID NO: 240570 - RNA, 19 nt, Homo sapiens
uugcaguauccuauauguu

SEQ ID NO: 240571 - RNA, 19 nt, Homo sapiens
uugcauagguugaaccagc

SEQ ID NO: 240572 - RNA, 22 nt, Homo sapiens
uugcauauguugaaccaagcgu

SEQ ID NO: 240573 - RNA, 19 nt, Homo sapiens
uugcauauguugaaccagg

SEQ ID NO: 240574 - RNA, 22 nt, Homo sapiens
uugcaucagcaggcauaauugg

SEQ ID NO: 240575 - RNA, 22 nt, Homo sapiens
uugcaugguggaacuuggagcu

SEQ ID NO: 240576 - RNA, 22 nt, Homo sapiens
uugccuaggcuggaguguggug

SEQ ID NO: 240577 - RNA, 22 nt, Homo sapiens
uugccuauucacucugaugaua

SEQ ID NO: 240578 - RNA, 22 nt, Homo sapiens
uugcucaggcuggaguacaaug

SEQ ID NO: 240579 - RNA, 22 nt, Homo sapiens
uugcuggugguucgagcaacac

SEQ ID NO: 240580 - RNA, 22 nt, Homo sapiens
uugcugguuuucauaugagcag

SEQ ID NO: 240581 - RNA, 22 nt, Homo sapiens
uuggaacuguucguauugaaau

SEQ ID NO: 240582 - RNA, 22 nt, Homo sapiens
uuggaagagaagggagauaaac

SEQ ID NO: 240583 - RNA, 22 nt, Homo sapiens
uuggaaggcuccuaaugaaugg

SEQ ID NO: 240584 - RNA, 22 nt, Homo sapiens
uuugggaaugguuugucuccca

SEQ ID NO: 240585 - RNA, 22 nt, Homo sapiens
uuuggucagcugcgggucagcu

SEQ ID NO: 240586 - RNA, 22 nt, Homo sapiens
uuugguccuccuacagggcagg

SEQ ID NO: 240587 - RNA, 22 nt, Homo sapiens
uuuggucuuuuguaaguuaucu

SEQ ID NO: 240588 - RNA, 22 nt, Homo sapiens
uuuguacuugaagaaucuuuau

SEQ ID NO: 240589 - RNA, 18 nt, Homo sapiens
uuuguacuuuuucuaaug

SEQ ID NO: 240590 - RNA, 19 nt, Homo sapiens
uuuguauguuuccaguaau

SEQ ID NO: 240591 - RNA, 22 nt, Homo sapiens
uuuguccccgcccagaucucau

SEQ ID NO: 240592 - RNA, 22 nt, Homo sapiens
uuugucccuuugcaguggcaca

SEQ ID NO: 240593 - RNA, 22 nt, Homo sapiens
uuugugaaugucauaagcucca

SEQ ID NO: 240594 - RNA, 22 nt, Homo sapiens
uuugugacacaaacacauauau

SEQ ID NO: 240595 - RNA, 22 nt, Homo sapiens
uuugugacuugcuucucagaau

SEQ ID NO: 240596 - RNA, 22 nt, Homo sapiens
uuugugauugcacacucaagau

SEQ ID NO: 240597 - RNA, 22 nt, Homo sapiens
uuugugcuauguuauauauucu

SEQ ID NO: 240598 - RNA, 22 nt, Homo sapiens
uuuguggaaugcccuuauuuau

SEQ ID NO: 240599 - RNA, 22 nt, Homo sapiens
uuuguggaaugcucauguguag

SEQ ID NO: 240600 - RNA, 16 nt, Homo sapiens
uuugugugugacgaga

SEQ ID NO: 240601 - RNA, 22 nt, Homo sapiens
uuuuaagcuacaagagacauau

SEQ ID NO: 240602 - RNA, 20 nt, Homo sapiens
uuuuagcuuuuauugaaagc

SEQ ID NO: 240603 - RNA, 22 nt, Homo sapiens
aaauugcuuuugaagacuuagu

SEQ ID NO: 240604 - RNA, 22 nt, Homo sapiens
aacacuguuuccagucaugauc

SEQ ID NO: 240605 - RNA, 22 nt, Homo sapiens
aacagaccuagauaguauaguc

SEQ ID NO: 240606 - RNA, 20 nt, Homo sapiens
aacagcacugucugaagcuu

SEQ ID NO: 240607 - RNA, 22 nt, Homo sapiens
aacaguaucuaacgagugauga

SEQ ID NO: 240608 - RNA, 22 nt, Homo sapiens
aacagucaauugcugaugaccu

SEQ ID NO: 240609 - RNA, 22 nt, Homo sapiens
aacagugccugucauuuaguag

SEQ ID NO: 240610 - RNA, 22 nt, Homo sapiens
aaccuauaguauugaaaucaag

SEQ ID NO: 240611 - RNA, 22 nt, Homo sapiens
aaccugaagaaaauauuugcug

SEQ ID NO: 240612 - RNA, 22 nt, Homo sapiens
aacuacaucucuuugaggcagg

SEQ ID NO: 240613 - RNA, 22 nt, Homo sapiens
aacugccucugacauaggcagg

SEQ ID NO: 240614 - RNA, 22 nt, Homo sapiens
aacugcuguuuggguacuggug

SEQ ID NO: 240615 - RNA, 22 nt, Homo sapiens
aacuggcauagccagacuucuc

SEQ ID NO: 240616 - RNA, 22 nt, Homo sapiens
aacuggccugagaugaaaagug

SEQ ID NO: 240617 - RNA, 22 nt, Homo sapiens
aacuggucuuaugcaagcacua

SEQ ID NO: 240618 - RNA, 19 nt, Homo sapiens
aacuggugugagaugauau

SEQ ID NO: 240619 - RNA, 22 nt, Homo sapiens
aagagaugaagguccugacugu

SEQ ID NO: 240620 - RNA, 22 nt, Homo sapiens
aagagcauuggauggggagauu

SEQ ID NO: 240621 - RNA, 22 nt, Homo sapiens
aagagcucucuguagcauguga

SEQ ID NO: 240622 - RNA, 22 nt, Homo sapiens
aagagguaauaacaaagcuucu

SEQ ID NO: 240623 - RNA, 22 nt, Homo sapiens
aagagguagaagcuugccuucu

SEQ ID NO: 240624 - RNA, 22 nt, Homo sapiens
aagagguagucugucccuuagc

SEQ ID NO: 240625 - RNA, 22 nt, Homo sapiens
aagaguuaguaaaauuuccucu

SEQ ID NO: 240626 - RNA, 19 nt, Homo sapiens
aagaugauguuugggcuaa

SEQ ID NO: 240627 - RNA, 22 nt, Homo sapiens
aagaugcagucauacuggagga

SEQ ID NO: 240628 - RNA, 20 nt, Homo sapiens
aagcaagcauuugcaaucau

SEQ ID NO: 240629 - RNA, 22 nt, Homo sapiens
aagcacaauuucaccuucuugu

SEQ ID NO: 240630 - RNA, 21 nt, Homo sapiens
aagcacauugaguguguguga

SEQ ID NO: 240631 - RNA, 22 nt, Homo sapiens
aagcaccaauaggagauuuguc

SEQ ID NO: 240632 - RNA, 22 nt, Homo sapiens
aagcuacauuuuauuuauguca

SEQ ID NO: 240633 - RNA, 22 nt, Homo sapiens
aagcuaccauuuguauauaaag

SEQ ID NO: 240634 - RNA, 22 nt, Homo sapiens
aagcugccuugcugaggagaaa

SEQ ID NO: 240635 - RNA, 22 nt, Homo sapiens
aagcuggauuucgcauccuguu

SEQ ID NO: 240636 - RNA, 22 nt, Homo sapiens
aagcugguuuuauaucugugag

SEQ ID NO: 240637 - RNA, 22 nt, Homo sapiens
aaggagcaguggacggguccua

SEQ ID NO: 240638 - RNA, 22 nt, Homo sapiens
aaggaguguggugaucuugggc

SEQ ID NO: 240639 - RNA, 22 nt, Homo sapiens
aaggcaagaaaauggauucucc

SEQ ID NO: 240640 - RNA, 22 nt, Homo sapiens
aaggcaagaaugcgugcuuuca

SEQ ID NO: 240641 - RNA, 22 nt, Homo sapiens
aaggcaagagaaaauuucgagu

SEQ ID NO: 240642 - RNA, 22 nt, Homo sapiens
aaggcaagauacugguugcuga

SEQ ID NO: 240643 - RNA, 22 nt, Homo sapiens
aaggcacugaacuuaaauucug

SEQ ID NO: 240644 - RNA, 22 nt, Homo sapiens
aaggcaugcugaguccuaaaag

SEQ ID NO: 240645 - RNA, 22 nt, Homo sapiens
aaggcauggugacuauuuaggc

SEQ ID NO: 240646 - RNA, 22 nt, Homo sapiens
aaggcuuuuugcugacguccuu

SEQ ID NO: 240647 - RNA, 22 nt, Homo sapiens
aagggagcugcauaaucuugug

SEQ ID NO: 240648 - RNA, 22 nt, Homo sapiens
aagguauuucuaugggaauaga

SEQ ID NO: 240649 - RNA, 22 nt, Homo sapiens
aaggucauugugguuuuugcca

SEQ ID NO: 240650 - RNA, 22 nt, Homo sapiens
aaggugguuuucucuuggaguc

SEQ ID NO: 240651 - RNA, 22 nt, Homo sapiens
aaguaaauauccgguaguccca

SEQ ID NO: 240652 - RNA, 22 nt, Homo sapiens
aaguaaaucuuaugucagggag

SEQ ID NO: 240653 - RNA, 19 nt, Homo sapiens
aaguacuugucuuuugaag

SEQ ID NO: 240654 - RNA, 22 nt, Homo sapiens
aaguaguuaggaacauucucuc

SEQ ID NO: 240655 - RNA, 22 nt, Homo sapiens
aaguauagcuaugauaaacauu

SEQ ID NO: 240656 - RNA, 22 nt, Homo sapiens
aaguaucaggaauaguuauugg

SEQ ID NO: 240657 - RNA, 22 nt, Homo sapiens
aaguauuaugaguccuuguuuu

SEQ ID NO: 240658 - RNA, 22 nt, Homo sapiens
aagucaugaagaggaaaggaca

SEQ ID NO: 240659 - RNA, 22 nt, Homo sapiens
aagugaccuaacaaugaaggcc

SEQ ID NO: 240660 - RNA, 22 nt, Homo sapiens
aagugcaaaucuguggcugaaa

SEQ ID NO: 240661 - RNA, 22 nt, Homo sapiens
aagugcauguauuaguguaguc

SEQ ID NO: 240662 - RNA, 22 nt, Homo sapiens
aagugcuguccuaccuuuggga

SEQ ID NO: 240663 - RNA, 22 nt, Homo sapiens
aagugcuuacagggaacaugau

SEQ ID NO: 240664 - RNA, 22 nt, Homo sapiens
aagugcuuccuuucagaggguu

SEQ ID NO: 240665 - RNA, 17 nt, Homo sapiens
aaguggcuuguucacca

SEQ ID NO: 240666 - RNA, 23 nt, Homo sapiens
aagugguuuugaacccggacccu

SEQ ID NO: 240667 - RNA, 22 nt, Homo sapiens
aaguuaauguuuaagacuccua

SEQ ID NO: 240668 - RNA, 23 nt, Homo sapiens
aaguucaugcucaucuguuacac

SEQ ID NO: 240669 - RNA, 21 nt, Homo sapiens
aauaaagcaaccuuaugccau

SEQ ID NO: 240670 - RNA, 22 nt, Homo sapiens
aauaaagcagcuuuuugggacu

SEQ ID NO: 240671 - RNA, 22 nt, Homo sapiens
aauaaaguaggaggugaggaaa

SEQ ID NO: 240672 - RNA, 22 nt, Homo sapiens
aauaagcugagagaauucuaca

SEQ ID NO: 240673 - RNA, 22 nt, Homo sapiens
aauagcuguuuuuaauuccugc

SEQ ID NO: 240674 - RNA, 22 nt, Homo sapiens
aauaucacaguuggguguacac

SEQ ID NO: 240675 - RNA, 19 nt, Homo sapiens
aauauugacaguggugucu

SEQ ID NO: 240676 - RNA, 22 nt, Homo sapiens
aaucaacauuguuuuaagucaa

SEQ ID NO: 240677 - RNA, 22 nt, Homo sapiens
aaucacauugaaucugcuaccu

SEQ ID NO: 240678 - RNA, 22 nt, Homo sapiens
aaucacuaugccaugaaguaca

SEQ ID NO: 240679 - RNA, 22 nt, Homo sapiens
aaucacuuugcuacaaggcagu

SEQ ID NO: 240680 - RNA, 22 nt, Homo sapiens
aaucagauuccagugguuggaa

SEQ ID NO: 240681 - RNA, 22 nt, Homo sapiens
aauccaugugcuuuaccauuuu

SEQ ID NO: 240682 - RNA, 22 nt, Homo sapiens
aaucccuggacuuucggaggcu

SEQ ID NO: 240683 - RNA, 22 nt, Homo sapiens
aaucucagagauaucugugucc

SEQ ID NO: 240684 - RNA, 22 nt, Homo sapiens
aaucugucaguuuuguguuaau

SEQ ID NO: 240685 - RNA, 22 nt, Homo sapiens
aaugcacuccagccugggcgac

SEQ ID NO: 240686 - RNA, 22 nt, Homo sapiens
aaugcauaauuuguaugaggua

SEQ ID NO: 240687 - RNA, 22 nt, Homo sapiens
aauggcagaugaaauugucauu

SEQ ID NO: 240688 - RNA, 22 nt, Homo sapiens
aauggcaucuacguuaaauguc

SEQ ID NO: 240689 - RNA, 18 nt, Homo sapiens
aauggcucuggguucuaa

SEQ ID NO: 240690 - RNA, 22 nt, Homo sapiens
aauggcucuuccuggaguugug

SEQ ID NO: 240691 - RNA, 22 nt, Homo sapiens
aauggcuucuuauugugguuca

SEQ ID NO: 240692 - RNA, 22 nt, Homo sapiens
aauggguaguacugugguaaca

SEQ ID NO: 240693 - RNA, 21 nt, Homo sapiens
aaugguguugccaacaaggug

SEQ ID NO: 240694 - RNA, 22 nt, Homo sapiens
aaugugccuacagugggcuguu

SEQ ID NO: 240695 - RNA, 22 nt, Homo sapiens
aaugugcuucuggcugugguca

SEQ ID NO: 240696 - RNA, 22 nt, Homo sapiens
aaugugcuuucuuucacacagu

SEQ ID NO: 240697 - RNA, 22 nt, Homo sapiens
aauuaguaaccuaauuccaucu

SEQ ID NO: 240698 - RNA, 22 nt, Homo sapiens
aauuaguuggcugccuaugauu

SEQ ID NO: 240699 - RNA, 22 nt, Homo sapiens
aauugaaucaugugggcagacu

SEQ ID NO: 240700 - RNA, 22 nt, Homo sapiens
aauugcaauggacaaugcagca

SEQ ID NO: 240701 - RNA, 22 nt, Homo sapiens
aauugcauaugcaguagaucua

SEQ ID NO: 240702 - RNA, 22 nt, Homo sapiens
aauugcauugaauuuguagcuu

SEQ ID NO: 240703 - RNA, 23 nt, Homo sapiens
aauugcuuuugaggacuuaguug

SEQ ID NO: 240704 - RNA, 22 nt, Homo sapiens
aauugguuaagauaagaucaua

SEQ ID NO: 240705 - RNA, 22 nt, Homo sapiens
auaauaucagguugugaugaug

SEQ ID NO: 240706 - RNA, 18 nt, Homo sapiens
auacaagcagcagagauu

SEQ ID NO: 240707 - RNA, 22 nt, Homo sapiens
auacacgugcagaacaugcagg

SEQ ID NO: 240708 - RNA, 22 nt, Homo sapiens
auacacguguauauguguaucu

SEQ ID NO: 240709 - RNA, 22 nt, Homo sapiens
auacaguugccauuucuugugc

SEQ ID NO: 240710 - RNA, 22 nt, Homo sapiens
auacuagucaagaauguaugag

SEQ ID NO: 240711 - RNA, 22 nt, Homo sapiens
auacuggcuuuccaauugugau

SEQ ID NO: 240712 - RNA, 22 nt, Homo sapiens
auacugucucuugcuccugccc

SEQ ID NO: 240713 - RNA, 22 nt, Homo sapiens
auacuguuucugaacuuugauu

SEQ ID NO: 240714 - RNA, 21 nt, Homo sapiens
auacuugcauccuuggagaga

SEQ ID NO: 240715 - RNA, 22 nt, Homo sapiens
auagaauguuugcgccagguga

SEQ ID NO: 240716 - RNA, 22 nt, Homo sapiens
auagcacaguguguguacacca

SEQ ID NO: 240717 - RNA, 22 nt, Homo sapiens
auagcacaugugcaaauggcug

SEQ ID NO: 240718 - RNA, 22 nt, Homo sapiens
auagcacuuauagauuuggucu

SEQ ID NO: 240719 - RNA, 22 nt, Homo sapiens
auagcagaagaagggacaauuc

SEQ ID NO: 240720 - RNA, 22 nt, Homo sapiens
auagcagcaccucacucuacug

SEQ ID NO: 240721 - RNA, 22 nt, Homo sapiens
auagcagcagcuaguagugaua

SEQ ID NO: 240722 - RNA, 22 nt, Homo sapiens
auagcagcauauguaauguuga

SEQ ID NO: 240723 - RNA, 22 nt, Homo sapiens
auagcagcucacuuauuuaugg

SEQ ID NO: 240724 - RNA, 22 nt, Homo sapiens
auagcagugugagaaugaacua

SEQ ID NO: 240725 - RNA, 22 nt, Homo sapiens
auagcagugugaggacagacua

SEQ ID NO: 240726 - RNA, 22 nt, Homo sapiens
auagcauagucagcuucgcuga

SEQ ID NO: 240727 - RNA, 22 nt, Homo sapiens
auaggagcacaaacuauuguga

SEQ ID NO: 240728 - RNA, 22 nt, Homo sapiens
auaggagcagaaaccguauuuu

SEQ ID NO: 240729 - RNA, 22 nt, Homo sapiens
auagugaacuuugugagaacaa

SEQ ID NO: 240730 - RNA, 22 nt, Homo sapiens
auagugcuauggcagaccuuga

SEQ ID NO: 240731 - RNA, 22 nt, Homo sapiens
auagugcugcaagaaacauacg

SEQ ID NO: 240732 - RNA, 22 nt, Homo sapiens
auagugcugcaauaaacauaca

SEQ ID NO: 240733 - RNA, 22 nt, Homo sapiens
auagugcugcaauaaccauggg

SEQ ID NO: 240734 - RNA, 22 nt, Homo sapiens
auagugcugcagucaauguacg

SEQ ID NO: 240735 - RNA, 22 nt, Homo sapiens
auagugcuggaauaaauauacg

SEQ ID NO: 240736 - RNA, 22 nt, Homo sapiens
auagugcugugaugaacauaca

SEQ ID NO: 240737 - RNA, 19 nt, Homo sapiens
auauaacauccaggagcag

SEQ ID NO: 240738 - RNA, 22 nt, Homo sapiens
auauagcucuggcuggaugacu

SEQ ID NO: 240739 - RNA, 22 nt, Homo sapiens
auauaugcacacgugugcauau

SEQ ID NO: 240740 - RNA, 22 nt, Homo sapiens
auaucacucccaauaucgcagg

SEQ ID NO: 240741 - RNA, 22 nt, Homo sapiens
auaugcauguacccacacaggc

SEQ ID NO: 240742 - RNA, 20 nt, Homo sapiens
auaugcauguguuuucacuu

SEQ ID NO: 240743 - RNA, 22 nt, Homo sapiens
auauggcuaugugagcauacca

SEQ ID NO: 240744 - RNA, 22 nt, Homo sapiens
auaugguuuuuggaagcauauc

SEQ ID NO: 240745 - RNA, 22 nt, Homo sapiens
auauguaguauggaaacauugu

SEQ ID NO: 240746 - RNA, 21 nt, Homo sapiens
auauuacuguuagaggacugc

SEQ ID NO: 240747 - RNA, 22 nt, Homo sapiens
auauugacuuucucuuagauca

SEQ ID NO: 240748 - RNA, 18 nt, Homo sapiens
auauugccuucagacuag

SEQ ID NO: 240749 - RNA, 22 nt, Homo sapiens
auauuggacugugcuaguuaga

SEQ ID NO: 240750 - RNA, 22 nt, Homo sapiens
auauuguacugcuacugguucu

SEQ ID NO: 240751 - RNA, 22 nt, Homo sapiens
aucaaacugcaaggcagcagca

SEQ ID NO: 240752 - RNA, 19 nt, Homo sapiens
aucaaacugcucuuugagg

SEQ ID NO: 240753 - RNA, 22 nt, Homo sapiens
aucaaaguuucccagaaguugu

SEQ ID NO: 240754 - RNA, 22 nt, Homo sapiens
aucaaaugcuggcagagugccu

SEQ ID NO: 240755 - RNA, 22 nt, Homo sapiens
aucaaauugucauuuuaaggau

SEQ ID NO: 240756 - RNA, 22 nt, Homo sapiens
aucaaguaaucugaguaagagu

SEQ ID NO: 240757 - RNA, 22 nt, Homo sapiens
aucacagaacuuugagcagaga

SEQ ID NO: 240758 - RNA, 22 nt, Homo sapiens
aucacagauauggguuuaaauc

SEQ ID NO: 240759 - RNA, 22 nt, Homo sapiens
aucacagugaaaacagucaauu

SEQ ID NO: 240760 - RNA, 22 nt, Homo sapiens
aucacaguggucagguauagau

SEQ ID NO: 240761 - RNA, 19 nt, Homo sapiens
aucaccauuauuuggaaca

SEQ ID NO: 240762 - RNA, 22 nt, Homo sapiens
aucacuggucaugagagaagua

SEQ ID NO: 240763 - RNA, 22 nt, Homo sapiens
aucacuuugcucuccagugugg

SEQ ID NO: 240764 - RNA, 22 nt, Homo sapiens
aucagaaucucuagaggacugu

SEQ ID NO: 240765 - RNA, 22 nt, Homo sapiens
aucagaaucucuagugggacca

SEQ ID NO: 240766 - RNA, 22 nt, Homo sapiens
aucagagccugugugcccugaa

SEQ ID NO: 240767 - RNA, 22 nt, Homo sapiens
aucagagugaugguuuaaguau

SEQ ID NO: 240768 - RNA, 22 nt, Homo sapiens
aucagcagcaugaaaacaggcu

SEQ ID NO: 240769 - RNA, 18 nt, Homo sapiens
aucagggugaagagagga

SEQ ID NO: 240770 - RNA, 22 nt, Homo sapiens
aucauccagccccagaagggag

SEQ ID NO: 240771 - RNA, 22 nt, Homo sapiens
aucauugugcaucuucauucca

SEQ ID NO: 240772 - RNA, 23 nt, Homo sapiens
auccacauucuaguccuuuaugc

SEQ ID NO: 240773 - RNA, 22 nt, Homo sapiens
auccauguggauaaauguguau

SEQ ID NO: 240774 - RNA, 22 nt, Homo sapiens
aucccaguucagccucugacac

SEQ ID NO: 240775 - RNA, 22 nt, Homo sapiens
auccccuugcagugaccggggc

SEQ ID NO: 240776 - RNA, 22 nt, Homo sapiens
aucccugugacgagcaucccua

SEQ ID NO: 240777 - RNA, 22 nt, Homo sapiens
aucccuuucugauacuuucccu

SEQ ID NO: 240778 - RNA, 22 nt, Homo sapiens
auccuacaguccauucuuugug

SEQ ID NO: 240779 - RNA, 22 nt, Homo sapiens
auccucugagagaguuucauaa

SEQ ID NO: 240780 - RNA, 22 nt, Homo sapiens
auccuguacuaagguuuuccca

SEQ ID NO: 240781 - RNA, 21 nt, Homo sapiens
aucgcacaauauaccccugua

SEQ ID NO: 240782 - RNA, 22 nt, Homo sapiens
aucugcaaagcugggcugagac

SEQ ID NO: 240783 - RNA, 19 nt, Homo sapiens
aucuggaguuccuggggcu

SEQ ID NO: 240784 - RNA, 22 nt, Homo sapiens
aucugguguauuggugcugggu

SEQ ID NO: 240785 - RNA, 22 nt, Homo sapiens
aucugguguggcugugauccuc

SEQ ID NO: 240786 - RNA, 22 nt, Homo sapiens
aucuguagauucagcacaagcu

SEQ ID NO: 240787 - RNA, 22 nt, Homo sapiens
aucugugguuguaugcauauua

SEQ ID NO: 240788 - RNA, 22 nt, Homo sapiens
aucuucucuugaagggugggga

SEQ ID NO: 240789 - RNA, 21 nt, Homo sapiens
aucuugguauagucuuauugg

SEQ ID NO: 240790 - RNA, 22 nt, Homo sapiens
aucuuugauuagacugauggau

SEQ ID NO: 240791 - RNA, 22 nt, Homo sapiens
aucuuugauugaagggacccug

SEQ ID NO: 240792 - RNA, 22 nt, Homo sapiens
augaaacuggagcgccuggagg

SEQ ID NO: 240793 - RNA, 23 nt, Homo sapiens
augaaagcccuugcaaaugcugg

SEQ ID NO: 240794 - RNA, 22 nt, Homo sapiens
augaaagguauguuuucuguga

SEQ ID NO: 240795 - RNA, 22 nt, Homo sapiens
augaaagucaauccccaagugu

SEQ ID NO: 240796 - RNA, 22 nt, Homo sapiens
augaacgugugcauauaagcag

SEQ ID NO: 240797 - RNA, 22 nt, Homo sapiens
augaagacaucgucugggauua

SEQ ID NO: 240798 - RNA, 17 nt, Homo sapiens
augaagucaucauuuuu

SEQ ID NO: 240799 - RNA, 22 nt, Homo sapiens
augacauuccacagccguagag

SEQ ID NO: 240800 - RNA, 22 nt, Homo sapiens
augacauugaugcucuggcugg

SEQ ID NO: 240801 - RNA, 22 nt, Homo sapiens
augaccagagguaugauguuug

SEQ ID NO: 240802 - RNA, 19 nt, Homo sapiens
augaccauuuccauaguau

SEQ ID NO: 240803 - RNA, 21 nt, Homo sapiens
augacccuggguguccuuucc

SEQ ID NO: 240804 - RNA, 22 nt, Homo sapiens
augacugucagggcagucauug

SEQ ID NO: 240805 - RNA, 17 nt, Homo sapiens
augacuucuucagugug

SEQ ID NO: 240806 - RNA, 22 nt, Homo sapiens
augagaauguaaguuaaugaaa

SEQ ID NO: 240807 - RNA, 22 nt, Homo sapiens
caguguuuuuaacaggugcccg

SEQ ID NO: 240808 - RNA, 22 nt, Homo sapiens
caguuacuugacacaaccaauu

SEQ ID NO: 240809 - RNA, 22 nt, Homo sapiens
cauacaugugcuugucuuaugc

SEQ ID NO: 240810 - RNA, 19 nt, Homo sapiens
caucacagagucuuccauu

SEQ ID NO: 240811 - RNA, 22 nt, Homo sapiens
caucacaugcuuauuuuccuca

SEQ ID NO: 240812 - RNA, 22 nt, Homo sapiens
caucagcaauguaugaggguuc

SEQ ID NO: 240813 - RNA, 19 nt, Homo sapiens
caucccugagcugaagugg

SEQ ID NO: 240814 - RNA, 22 nt, Homo sapiens
caucccugucgucaagucucug

SEQ ID NO: 240815 - RNA, 22 nt, Homo sapiens
caugacacuggcauguuucuuu

SEQ ID NO: 240816 - RNA, 22 nt, Homo sapiens
caugcacugagagggucucggc

SEQ ID NO: 240817 - RNA, 22 nt, Homo sapiens
caugcacugaguccaccucugg

SEQ ID NO: 240818 - RNA, 22 nt, Homo sapiens
cauggcacauauauaucuaggu

SEQ ID NO: 240819 - RNA, 22 nt, Homo sapiens
cauggcacuguaugaaaugugc

SEQ ID NO: 240820 - RNA, 22 nt, Homo sapiens
cauggcauuugcagaguugaaa

SEQ ID NO: 240821 - RNA, 22 nt, Homo sapiens
cauggcucuuguuuacucccag

SEQ ID NO: 240822 - RNA, 23 nt, Homo sapiens
cauggcuguuaacacuguuugag

SEQ ID NO: 240823 - RNA, 19 nt, Homo sapiens
cauggcuuauaauuuuaau

SEQ ID NO: 240824 - RNA, 22 nt, Homo sapiens
cauggcuuuuauaacaagaaau

SEQ ID NO: 240825 - RNA, 22 nt, Homo sapiens
cauguauagauuccauaguggu

SEQ ID NO: 240826 - RNA, 22 nt, Homo sapiens
caugucacuuccucucugaugg

SEQ ID NO: 240827 - RNA, 19 nt, Homo sapiens
caugugcacuacuggcuuc

SEQ ID NO: 240828 - RNA, 22 nt, Homo sapiens
cauuaguugaagugcagggaga

SEQ ID NO: 240829 - RNA, 22 nt, Homo sapiens
cauugcaauccagccugggcaa

SEQ ID NO: 240830 - RNA, 19 nt, Homo sapiens
cauugcacuccacccuggg

SEQ ID NO: 240831 - RNA, 22 nt, Homo sapiens
cauugcaugcauauggcuuggu

SEQ ID NO: 240832 - RNA, 22 nt, Homo sapiens
cauugcuaaaagucauauauaa

SEQ ID NO: 240833 - RNA, 22 nt, Homo sapiens
cauugcucuuacagagugagua

SEQ ID NO: 240834 - RNA, 22 nt, Homo sapiens
cauugguugaacagauuguguu

SEQ ID NO: 240835 - RNA, 22 nt, Homo sapiens
cauugguuggacaguucucucu

SEQ ID NO: 240836 - RNA, 22 nt, Homo sapiens
ccacccuuccacacccugggua

SEQ ID NO: 240837 - RNA, 22 nt, Homo sapiens
ccaccuguacuuaagucacuuu

SEQ ID NO: 240838 - RNA, 22 nt, Homo sapiens
ccacuguuuaaauggcugagga

SEQ ID NO: 240839 - RNA, 22 nt, Homo sapiens
ccagaauucucauuggaaggaa

SEQ ID NO: 240840 - RNA, 22 nt, Homo sapiens
ccagaguucuaggcauuggaaa

SEQ ID NO: 240841 - RNA, 22 nt, Homo sapiens
ccagaguugccucagguuucug

SEQ ID NO: 240842 - RNA, 22 nt, Homo sapiens
ccagcaccauuuguugaauagg

SEQ ID NO: 240843 - RNA, 22 nt, Homo sapiens
ccagccgggugcaguggcucac

SEQ ID NO: 240844 - RNA, 22 nt, Homo sapiens
ccagguuucuagaauaauuccu

SEQ ID NO: 240845 - RNA, 22 nt, Homo sapiens
ccagugauuguauggugaaggu

SEQ ID NO: 240846 - RNA, 19 nt, Homo sapiens
ccaguguugccagagcuga

SEQ ID NO: 240847 - RNA, 22 nt, Homo sapiens
ccaguuuucucacuguugcagu

SEQ ID NO: 240848 - RNA, 22 nt, Homo sapiens
ccaguuuuuggcaaugaugaau

SEQ ID NO: 240849 - RNA, 22 nt, Homo sapiens
ccaucacaggccucagugggaa

SEQ ID NO: 240850 - RNA, 22 nt, Homo sapiens
ccaucccuuucugagcaguucc

SEQ ID NO: 240851 - RNA, 22 nt, Homo sapiens
cccagugguuacauaaggagua

SEQ ID NO: 240852 - RNA, 22 nt, Homo sapiens
cccaguuuugccacuuacuagc

SEQ ID NO: 240853 - RNA, 22 nt, Homo sapiens
cccugaagaaagccuaggacau

SEQ ID NO: 240854 - RNA, 22 nt, Homo sapiens
cccugagaugcuguuaaucugu

SEQ ID NO: 240855 - RNA, 19 nt, Homo sapiens
cccuggcacauggaaaaug

SEQ ID NO: 240856 - RNA, 22 nt, Homo sapiens
cccuguguuguucaaggaucug

SEQ ID NO: 240857 - RNA, 22 nt, Homo sapiens
ccucacaaccuuuauugaagag

SEQ ID NO: 240858 - RNA, 22 nt, Homo sapiens
ccucauugcuaucccaggcuga

SEQ ID NO: 240859 - RNA, 22 nt, Homo sapiens
ccugagacgaauggagugaaca

SEQ ID NO: 240860 - RNA, 22 nt, Homo sapiens
ccugagaucauacuguuaguaa

SEQ ID NO: 240861 - RNA, 22 nt, Homo sapiens
ccuggaagaaaggugcuaaaua

SEQ ID NO: 240862 - RNA, 22 nt, Homo sapiens
ccuggaucauugucauucccaa

SEQ ID NO: 240863 - RNA, 22 nt, Homo sapiens
ccuucuuuuguaaggcugaaua

SEQ ID NO: 240864 - RNA, 22 nt, Homo sapiens
ccuugcacuucccaggugaggc

SEQ ID NO: 240865 - RNA, 22 nt, Homo sapiens
ccuuuuugaguugccagaguuc

SEQ ID NO: 240866 - RNA, 22 nt, Homo sapiens
cgaggaguaucuuugugguguu

SEQ ID NO: 240867 - RNA, 22 nt, Homo sapiens
cuaaagugcugagauuauaggu

SEQ ID NO: 240868 - RNA, 22 nt, Homo sapiens
cuaaaguucuucugagagaaca

SEQ ID NO: 240869 - RNA, 22 nt, Homo sapiens
cuaagguacuguuaacauugua

SEQ ID NO: 240870 - RNA, 22 nt, Homo sapiens
cuacagaguaucuaaagaggua

SEQ ID NO: 240871 - RNA, 22 nt, Homo sapiens
cuacaguucuuaauuaaguagu

SEQ ID NO: 240872 - RNA, 22 nt, Homo sapiens
cuacucuggagagugacaauca

SEQ ID NO: 240873 - RNA, 22 nt, Homo sapiens
cuagaguacuuaccacagcaug

SEQ ID NO: 240874 - RNA, 22 nt, Homo sapiens
cuagcagacaggcugggagcag

SEQ ID NO: 240875 - RNA, 22 nt, Homo sapiens
cuagcagacaugggcugaacca

SEQ ID NO: 240876 - RNA, 22 nt, Homo sapiens
cuagcagcauaagaaucaccaa

SEQ ID NO: 240877 - RNA, 22 nt, Homo sapiens
cuagcugcacuuccugcuacug

SEQ ID NO: 240878 - RNA, 22 nt, Homo sapiens
cuagcuuuuuaugacaaucuug

SEQ ID NO: 240879 - RNA, 22 nt, Homo sapiens
cuaggcuguagagaaguucagu

SEQ ID NO: 240880 - RNA, 22 nt, Homo sapiens
cuagguuauacucugaaauggu

SEQ ID NO: 240881 - RNA, 22 nt, Homo sapiens
cuagucacaggaguugaaggau

SEQ ID NO: 240882 - RNA, 22 nt, Homo sapiens
cuaugagucugcagaucuauua

SEQ ID NO: 240883 - RNA, 22 nt, Homo sapiens
cuaugcuucuuaaauuaguuau

SEQ ID NO: 240884 - RNA, 22 nt, Homo sapiens
cuaugcuuucugggcccugggu

SEQ ID NO: 240885 - RNA, 22 nt, Homo sapiens
cuaugguuucuccauaucauca

SEQ ID NO: 240886 - RNA, 22 nt, Homo sapiens
cuauucacaauagccaagauuu

SEQ ID NO: 240887 - RNA, 22 nt, Homo sapiens
cuauucacaauggugaagauau

SEQ ID NO: 240888 - RNA, 22 nt, Homo sapiens
cuauucacaggcaauauguaca

SEQ ID NO: 240889 - RNA, 18 nt, Homo sapiens
cucaaccucaugcagggc

SEQ ID NO: 240890 - RNA, 22 nt, Homo sapiens
cucaaguacaugggauuacagg

SEQ ID NO: 240891 - RNA, 22 nt, Homo sapiens
cucaauuuggaauugucaguaa

SEQ ID NO: 240892 - RNA, 20 nt, Homo sapiens
cucaccagguguaggcugag

SEQ ID NO: 240893 - RNA, 22 nt, Homo sapiens
cucacuaggaaguaaaguuugu

SEQ ID NO: 240894 - RNA, 22 nt, Homo sapiens
cucacuggguguaaaacaugua

SEQ ID NO: 240895 - RNA, 22 nt, Homo sapiens
cucacugugguguccuuaggua

SEQ ID NO: 240896 - RNA, 22 nt, Homo sapiens
cucagauacuugggagguugag

SEQ ID NO: 240897 - RNA, 22 nt, Homo sapiens
cucagcaguggauuuaccacca

SEQ ID NO: 240898 - RNA, 22 nt, Homo sapiens
cucagguaguuccuuauagcaa

SEQ ID NO: 240899 - RNA, 20 nt, Homo sapiens
cucagguauuugaggcugca

SEQ ID NO: 240900 - RNA, 20 nt, Homo sapiens
cucagugcacccccauaaaa

SEQ ID NO: 240901 - RNA, 22 nt, Homo sapiens
cucagugguugauuuauuuauc

SEQ ID NO: 240902 - RNA, 22 nt, Homo sapiens
cucaguguuaaggccaccucug

SEQ ID NO: 240903 - RNA, 22 nt, Homo sapiens
cucauggagauagagaauagaa

SEQ ID NO: 240904 - RNA, 22 nt, Homo sapiens
cuccaguuucagaaucccaugu

SEQ ID NO: 240905 - RNA, 23 nt, Homo sapiens
cuccaugagccguccagggccug

SEQ ID NO: 240906 - RNA, 22 nt, Homo sapiens
cuccauuuggaacagauguccu

SEQ ID NO: 240907 - RNA, 22 nt, Homo sapiens
cucccacccucauuuuuaggca

SEQ ID NO: 240908 - RNA, 22 nt, Homo sapiens
cucccagugacccaggaacagg

SEQ ID NO: 240909 - RNA, 20 nt, Homo sapiens
gcaugagucuuuauaguaga

SEQ ID NO: 240910 - RNA, 22 nt, Homo sapiens
gcaugaugaauaauaucacaag

SEQ ID NO: 240911 - RNA, 22 nt, Homo sapiens
gcaugauuuuauaucuauguaa

SEQ ID NO: 240912 - RNA, 22 nt, Homo sapiens
gcaugugaauguguaagaaaau

SEQ ID NO: 240913 - RNA, 18 nt, Homo sapiens
gccaacauguaaacaggu

SEQ ID NO: 240914 - RNA, 22 nt, Homo sapiens
gccaagaagugucuaagcagga

SEQ ID NO: 240915 - RNA, 22 nt, Homo sapiens
gccaagaugcugcccacagaca

SEQ ID NO: 240916 - RNA, 22 nt, Homo sapiens
gccauggaggauuuauagaggc

SEQ ID NO: 240917 - RNA, 22 nt, Homo sapiens
gccauugcacuacagccuaggc

SEQ ID NO: 240918 - RNA, 22 nt, Homo sapiens
gccauugcacuccagccucggc

SEQ ID NO: 240919 - RNA, 22 nt, Homo sapiens
gccauugcacucuagccuaggu

SEQ ID NO: 240920 - RNA, 22 nt, Homo sapiens
gcccugagauucuuggauucug

SEQ ID NO: 240921 - RNA, 22 nt, Homo sapiens
gcccuuugugucuggcuggggu

SEQ ID NO: 240922 - RNA, 22 nt, Homo sapiens
gccuagagaguuaucaggcugu

SEQ ID NO: 240923 - RNA, 22 nt, Homo sapiens
gccugagaggauaugauccccu

SEQ ID NO: 240924 - RNA, 22 nt, Homo sapiens
gccuuuggugacaggcaugugu

SEQ ID NO: 240925 - RNA, 22 nt, Homo sapiens
gcuagcauucaaaugugcagcc

SEQ ID NO: 240926 - RNA, 22 nt, Homo sapiens
gcucaugggcagugugauuguu

SEQ ID NO: 240927 - RNA, 22 nt, Homo sapiens
gcugaaauguuuaauuugggag

SEQ ID NO: 240928 - RNA, 22 nt, Homo sapiens
gcugaguaguauuucauuguau

SEQ ID NO: 240929 - RNA, 22 nt, Homo sapiens
gcugauguugaccuugaucacc

SEQ ID NO: 240930 - RNA, 22 nt, Homo sapiens
gcugauguuggccucugggcuu

SEQ ID NO: 240931 - RNA, 22 nt, Homo sapiens
gcuggaauuaacauagaugugc

SEQ ID NO: 240932 - RNA, 22 nt, Homo sapiens
gcuggguucagagugggcugcg

SEQ ID NO: 240933 - RNA, 22 nt, Homo sapiens
gcugguauuacaggcaugagcc

SEQ ID NO: 240934 - RNA, 22 nt, Homo sapiens
gcuguaguugaggauuuuaaga

SEQ ID NO: 240935 - RNA, 22 nt, Homo sapiens
gcuguauuguugaaggaaaugu

SEQ ID NO: 240936 - RNA, 22 nt, Homo sapiens
gcugugguuuaguagaaagaag

SEQ ID NO: 240937 - RNA, 22 nt, Homo sapiens
gcuguguugugcccagcaucau

SEQ ID NO: 240938 - RNA, 19 nt, Homo sapiens
gcuuguccacgugagauaa

SEQ ID NO: 240939 - RNA, 22 nt, Homo sapiens
gcuuguguucaagucacccuua

SEQ ID NO: 240940 - RNA, 22 nt, Homo sapiens
gcuuguguuuacuguaguuacu

SEQ ID NO: 240941 - RNA, 22 nt, Homo sapiens
gcuuugcaauggcauugaccau

SEQ ID NO: 240942 - RNA, 21 nt, Homo sapiens
gcuuuuucggaagucuuuggc

SEQ ID NO: 240943 - RNA, 23 nt, Homo sapiens
ggaaacauccagucuuucaccau

SEQ ID NO: 240944 - RNA, 22 nt, Homo sapiens
ggaaagacaccuuacuauguua

SEQ ID NO: 240945 - RNA, 22 nt, Homo sapiens
ggaaagaucagcuaaauguaag

SEQ ID NO: 240946 - RNA, 22 nt, Homo sapiens
ggaagaauaaugggccuuagag

SEQ ID NO: 240947 - RNA, 18 nt, Homo sapiens
ggaagccuauuuaguaac

SEQ ID NO: 240948 - RNA, 22 nt, Homo sapiens
ggaagguaauugucagcucaua

SEQ ID NO: 240949 - RNA, 22 nt, Homo sapiens
ggaaggucaaagggaaagcaga

SEQ ID NO: 240950 - RNA, 22 nt, Homo sapiens
ggaaguuaauacagauagagua

SEQ ID NO: 240951 - RNA, 19 nt, Homo sapiens
ggaaugcaccaguccuugc

SEQ ID NO: 240952 - RNA, 22 nt, Homo sapiens
ggaaugcagugagcauuagaua

SEQ ID NO: 240953 - RNA, 22 nt, Homo sapiens
ggaauuaaggcaauugaaagcu

SEQ ID NO: 240954 - RNA, 22 nt, Homo sapiens
ggacacaucaugugaccaaggu

SEQ ID NO: 240955 - RNA, 22 nt, Homo sapiens
ggacaucauuaccauggaccca

SEQ ID NO: 240956 - RNA, 22 nt, Homo sapiens
ggagagcuaggcagagguuugu

SEQ ID NO: 240957 - RNA, 22 nt, Homo sapiens
ggagcucaucuagcauagaggu

SEQ ID NO: 240958 - RNA, 22 nt, Homo sapiens
ggaggcuaguaaaaagguagaa

SEQ ID NO: 240959 - RNA, 22 nt, Homo sapiens
ggagggugagaucaauuuggga

SEQ ID NO: 240960 - RNA, 22 nt, Homo sapiens
ggagguagguuugugauuugua

SEQ ID NO: 240961 - RNA, 22 nt, Homo sapiens
ggaguaggaaggaaauguuaaa

SEQ ID NO: 240962 - RNA, 22 nt, Homo sapiens
ggagucugaacuggacaaugac

SEQ ID NO: 240963 - RNA, 22 nt, Homo sapiens
ggagucugacuuauaggaaccu

SEQ ID NO: 240964 - RNA, 22 nt, Homo sapiens
ggagugcuguuguuacacaagg

SEQ ID NO: 240965 - RNA, 23 nt, Homo sapiens
ggaguguaaugacucgaucucgg

SEQ ID NO: 240966 - RNA, 22 nt, Homo sapiens
ggaguguaguggcuccaucucg

SEQ ID NO: 240967 - RNA, 22 nt, Homo sapiens
ggagugucugugcuggucaaag

SEQ ID NO: 240968 - RNA, 22 nt, Homo sapiens
ggaguguguuuuccaacuuggu

SEQ ID NO: 240969 - RNA, 22 nt, Homo sapiens
ggaguucaucaggugaggggua

SEQ ID NO: 240970 - RNA, 22 nt, Homo sapiens
ggcaaauucuuguaugccuacu

SEQ ID NO: 240971 - RNA, 22 nt, Homo sapiens
ggcaacaaagacauuucaacau

SEQ ID NO: 240972 - RNA, 22 nt, Homo sapiens
ggcaacaauuccuacuucuuuu

SEQ ID NO: 240973 - RNA, 22 nt, Homo sapiens
ggcaacaugccgaaaccacguc

SEQ ID NO: 240974 - RNA, 21 nt, Homo sapiens
ggcaagagaauacaacauaaa

SEQ ID NO: 240975 - RNA, 22 nt, Homo sapiens
ggcaagaggagauucugcuccc

SEQ ID NO: 240976 - RNA, 23 nt, Homo sapiens
ggcaagaucucagcucacugcaa

SEQ ID NO: 240977 - RNA, 22 nt, Homo sapiens
ggcaaggugaugaaugucuaca

SEQ ID NO: 240978 - RNA, 22 nt, Homo sapiens
ggcaagugucagcagcaacacc

SEQ ID NO: 240979 - RNA, 22 nt, Homo sapiens
ggcaaguugcuauucuuuaaug

SEQ ID NO: 240980 - RNA, 23 nt, Homo sapiens
ggcacggaauucaaagaggcauu

SEQ ID NO: 240981 - RNA, 22 nt, Homo sapiens
ggcacugugaugugagggggua

SEQ ID NO: 240982 - RNA, 19 nt, Homo sapiens
ggcacugugugagugagga

SEQ ID NO: 240983 - RNA, 22 nt, Homo sapiens
ggcagcacaauuuucugaugga

SEQ ID NO: 240984 - RNA, 22 nt, Homo sapiens
ggcagcauugccuuugcaguga

SEQ ID NO: 240985 - RNA, 22 nt, Homo sapiens
ggcagcgugcacuuucgccacu

SEQ ID NO: 240986 - RNA, 22 nt, Homo sapiens
ggcagcgugguggauugaaaau

SEQ ID NO: 240987 - RNA, 22 nt, Homo sapiens
ggcagcuguguccuucguaagg

SEQ ID NO: 240988 - RNA, 22 nt, Homo sapiens
ggcaguggaagugccaguuucu

SEQ ID NO: 240989 - RNA, 22 nt, Homo sapiens
ggcaguguauuacuuaggguuc

SEQ ID NO: 240990 - RNA, 22 nt, Homo sapiens
ggcaugaggccauaaaaguaag

SEQ ID NO: 240991 - RNA, 22 nt, Homo sapiens
ggcauguaauuauucaaagugg

SEQ ID NO: 240992 - RNA, 22 nt, Homo sapiens
ggcccaguugcgggugguaccg

SEQ ID NO: 240993 - RNA, 22 nt, Homo sapiens
ggcuacauuguuacaauuagua

SEQ ID NO: 240994 - RNA, 22 nt, Homo sapiens
ggcuagaauagggauagaccuu

SEQ ID NO: 240995 - RNA, 22 nt, Homo sapiens
ggcuagagaauagugccacuaa

SEQ ID NO: 240996 - RNA, 22 nt, Homo sapiens
ggcuagagagcucagggauaug

SEQ ID NO: 240997 - RNA, 22 nt, Homo sapiens
gggagguagguauuagcuuuuc

SEQ ID NO: 240998 - RNA, 22 nt, Homo sapiens
gggaguagagaguuucucugac

SEQ ID NO: 240999 - RNA, 22 nt, Homo sapiens
gggcaacauugaguacccugaa

SEQ ID NO: 241000 - RNA, 22 nt, Homo sapiens
ggggcaaaaugccacgagucuc

SEQ ID NO: 241001 - RNA, 22 nt, Homo sapiens
gggggagugugguacccagcau

SEQ ID NO: 241002 - RNA, 22 nt, Homo sapiens
gggguaggcuacacugaguucc

SEQ ID NO: 241003 - RNA, 22 nt, Homo sapiens
gguaucuuggagagagaaguga

SEQ ID NO: 241004 - RNA, 22 nt, Homo sapiens
gguauuauuugccuuuuacuga

SEQ ID NO: 241005 - RNA, 19 nt, Homo sapiens
ggucauggagguuguguga

SEQ ID NO: 241006 - RNA, 22 nt, Homo sapiens
ggugacugguuuaucuggcagu

SEQ ID NO: 241007 - RNA, 19 nt, Homo sapiens
ggugagaaauuaugggucu

SEQ ID NO: 241008 - RNA, 23 nt, Homo sapiens
ggugaggaguacagagucuucau

SEQ ID NO: 241009 - RNA, 22 nt, Homo sapiens
gguggcuuuuugugauggcuga

SEQ ID NO: 241010 - RNA, 22 nt, Homo sapiens
guaacccuguaggccuaaagua

SEQ ID NO: 241011 - RNA, 22 nt, Homo sapiens
gugguaggaaagugcaaaugua

SEQ ID NO: 241012 - RNA, 21 nt, Homo sapiens
gugguucuagagaaacagaau

SEQ ID NO: 241013 - RNA, 22 nt, Homo sapiens
guguaaaucugcugugaacauu

SEQ ID NO: 241014 - RNA, 22 nt, Homo sapiens
guguaaaugagugcugaaggag

SEQ ID NO: 241015 - RNA, 22 nt, Homo sapiens
guguauacauagaauuguguau

SEQ ID NO: 241016 - RNA, 22 nt, Homo sapiens
guguaugguaggaugacggagu

SEQ ID NO: 241017 - RNA, 22 nt, Homo sapiens
gugucacuguugagaaguccac

SEQ ID NO: 241018 - RNA, 21 nt, Homo sapiens
gugucaugguugacuuuggca

SEQ ID NO: 241019 - RNA, 22 nt, Homo sapiens
gugucccagugugcauacaggu

SEQ ID NO: 241020 - RNA, 22 nt, Homo sapiens
gugucucagcccagaccuauuu

SEQ ID NO: 241021 - RNA, 22 nt, Homo sapiens
gugugacuagucaugccugaau

SEQ ID NO: 241022 - RNA, 22 nt, Homo sapiens
gugugauuauuucaauugaugc

SEQ ID NO: 241023 - RNA, 22 nt, Homo sapiens
gugugcaaauguguaccuacau

SEQ ID NO: 241024 - RNA, 22 nt, Homo sapiens
guguuauuuugcugggaaugau

SEQ ID NO: 241025 - RNA, 22 nt, Homo sapiens
guguucaaagcugauugagauu

SEQ ID NO: 241026 - RNA, 22 nt, Homo sapiens
guuaaagacauccacauaggag

SEQ ID NO: 241027 - RNA, 22 nt, Homo sapiens
guuauauguuuggaaugaggaa

SEQ ID NO: 241028 - RNA, 22 nt, Homo sapiens
guuaugcagcaauugauaaucu

SEQ ID NO: 241029 - RNA, 22 nt, Homo sapiens
guucaagugauagcugggauua

SEQ ID NO: 241030 - RNA, 20 nt, Homo sapiens
guucacagagguuaugauua

SEQ ID NO: 241031 - RNA, 22 nt, Homo sapiens
guucacaguuaggacaacugcu

SEQ ID NO: 241032 - RNA, 22 nt, Homo sapiens
guucacucuggagaauauugac

SEQ ID NO: 241033 - RNA, 22 nt, Homo sapiens
guucaguuuugaaauguuaauu

SEQ ID NO: 241034 - RNA, 20 nt, Homo sapiens
guucccuguaggugugcgga

SEQ ID NO: 241035 - RNA, 22 nt, Homo sapiens
guucucacuggugcugguaagu

SEQ ID NO: 241036 - RNA, 22 nt, Homo sapiens
guugaaaucaucacuuggcaug

SEQ ID NO: 241037 - RNA, 22 nt, Homo sapiens
guugaacaauagauucauauca

SEQ ID NO: 241038 - RNA, 22 nt, Homo sapiens
guugagcaagcuuuggagccua

SEQ ID NO: 241039 - RNA, 22 nt, Homo sapiens
guugcaaaguaauugugguuuu

SEQ ID NO: 241040 - RNA, 22 nt, Homo sapiens
guuggcuuuuuaaggaaauugc

SEQ ID NO: 241041 - RNA, 22 nt, Homo sapiens
guuggguaauggggcgcaccgu

SEQ ID NO: 241042 - RNA, 22 nt, Homo sapiens
guuuggcuuucucucuauccug

SEQ ID NO: 241043 - RNA, 22 nt, Homo sapiens
uaaaccacguuuacauuugaga

SEQ ID NO: 241044 - RNA, 22 nt, Homo sapiens
uaaacugucuugcaguuacaug

SEQ ID NO: 241045 - RNA, 22 nt, Homo sapiens
uaaagaugcugggaaggcuagg

SEQ ID NO: 241046 - RNA, 21 nt, Homo sapiens
uaaagcuagaaccuuagcuuu

SEQ ID NO: 241047 - RNA, 18 nt, Homo sapiens
uaaaggcacuguguuguu

SEQ ID NO: 241048 - RNA, 22 nt, Homo sapiens
uaaauggauauugccaucuccu

SEQ ID NO: 241049 - RNA, 22 nt, Homo sapiens
uaacaccuuugauagcacuuuu

SEQ ID NO: 241050 - RNA, 21 nt, Homo sapiens
uaacagcuccacuccauucuc

SEQ ID NO: 241051 - RNA, 22 nt, Homo sapiens
uaacaggcaaggucacaccuug

SEQ ID NO: 241052 - RNA, 22 nt, Homo sapiens
uaacagucaagguuugaccagg

SEQ ID NO: 241053 - RNA, 22 nt, Homo sapiens
uaacaguguauuccuuuggaca

SEQ ID NO: 241054 - RNA, 22 nt, Homo sapiens
uaacaguguauuuacuacuucc

SEQ ID NO: 241055 - RNA, 22 nt, Homo sapiens
uaacauuguugauuauacuaag

SEQ ID NO: 241056 - RNA, 22 nt, Homo sapiens
uaacccacgcagaauggacaag

SEQ ID NO: 241057 - RNA, 22 nt, Homo sapiens
uaacuucaucauaagucaagaa

SEQ ID NO: 241058 - RNA, 23 nt, Homo sapiens
uaagacacuaacuuuaugcuuug

SEQ ID NO: 241059 - RNA, 21 nt, Homo sapiens
uaagacugccaguagggcugu

SEQ ID NO: 241060 - RNA, 22 nt, Homo sapiens
uaagcagugcaagaauggaaua

SEQ ID NO: 241061 - RNA, 22 nt, Homo sapiens
uaagcaguguggauccaccuug

SEQ ID NO: 241062 - RNA, 16 nt, Homo sapiens
uaagccccacgugcau

SEQ ID NO: 241063 - RNA, 22 nt, Homo sapiens
uaagcuguguggacuaugccuc

SEQ ID NO: 241064 - RNA, 22 nt, Homo sapiens
uaaggcaaguuuuuaguggaca

SEQ ID NO: 241065 - RNA, 22 nt, Homo sapiens
uaaggcccauucuaugaagcag

SEQ ID NO: 241066 - RNA, 22 nt, Homo sapiens
uaaggcuucuuggaauacugca

SEQ ID NO: 241067 - RNA, 22 nt, Homo sapiens
uaaggcuuugguagguuugguc

SEQ ID NO: 241068 - RNA, 22 nt, Homo sapiens
uaagguguagacuggucacaag

SEQ ID NO: 241069 - RNA, 22 nt, Homo sapiens
uaaguaaaugaaagguugauuu

SEQ ID NO: 241070 - RNA, 22 nt, Homo sapiens
uaaguacugucagaauuggacu

SEQ ID NO: 241071 - RNA, 19 nt, Homo sapiens
uaaguagaugacugaugcu

SEQ ID NO: 241072 - RNA, 22 nt, Homo sapiens
uaaguaucaguuuagcuaugau

SEQ ID NO: 241073 - RNA, 22 nt, Homo sapiens
uaagugaaggaaguguguuuac

SEQ ID NO: 241074 - RNA, 22 nt, Homo sapiens
uaagugaugucuuuuugugugc

SEQ ID NO: 241075 - RNA, 22 nt, Homo sapiens
uaagugcaugauuacaugcaua

SEQ ID NO: 241076 - RNA, 20 nt, Homo sapiens
uaagugcuugagacuucuga

SEQ ID NO: 241077 - RNA, 18 nt, Homo sapiens
uaagugcuuuaaacacau

SEQ ID NO: 241078 - RNA, 22 nt, Homo sapiens
uaagugguguucauucuuuuga

SEQ ID NO: 241079 - RNA, 22 nt, Homo sapiens
uaaguuagugugagaauuuugc

SEQ ID NO: 241080 - RNA, 22 nt, Homo sapiens
uaaguucauucaugaaacuuag

SEQ ID NO: 241081 - RNA, 18 nt, Homo sapiens
uaauaacugugaccuuga

SEQ ID NO: 241082 - RNA, 22 nt, Homo sapiens
uaauaauguuaggcuuacucaa

SEQ ID NO: 241083 - RNA, 22 nt, Homo sapiens
uaauagagucauuauuauuguu

SEQ ID NO: 241084 - RNA, 22 nt, Homo sapiens
uaauaguuggcacuggagaaag

SEQ ID NO: 241085 - RNA, 22 nt, Homo sapiens
uaauauguauacagacagauac

SEQ ID NO: 241086 - RNA, 22 nt, Homo sapiens
uaauccuagcacuuuggaagac

SEQ ID NO: 241087 - RNA, 21 nt, Homo sapiens
uaauggcaugaucucggcuca

SEQ ID NO: 241088 - RNA, 22 nt, Homo sapiens
uaauucugacaacaguggcguu

SEQ ID NO: 241089 - RNA, 22 nt, Homo sapiens
uacaaagcuuugaugugucuuu

SEQ ID NO: 241090 - RNA, 22 nt, Homo sapiens
uacaaaucuagguuuguuacug

SEQ ID NO: 241091 - RNA, 22 nt, Homo sapiens
uacaaccucugccucccaaguu

SEQ ID NO: 241092 - RNA, 21 nt, Homo sapiens
uacaagcuguagcacaugcca

SEQ ID NO: 241093 - RNA, 22 nt, Homo sapiens
uacaaguauuuuuauuagugcc

SEQ ID NO: 241094 - RNA, 21 nt, Homo sapiens
uacaaugcacaggagagccuc

SEQ ID NO: 241095 - RNA, 22 nt, Homo sapiens
uacaccugaguuugugguuuuc

SEQ ID NO: 241096 - RNA, 22 nt, Homo sapiens
uacagaauugcagguguggcag

SEQ ID NO: 241097 - RNA, 22 nt, Homo sapiens
uacagaguauccauuugaguuc

SEQ ID NO: 241098 - RNA, 23 nt, Homo sapiens
uacagcacacugaugggucuuga

SEQ ID NO: 241099 - RNA, 22 nt, Homo sapiens
uacaggacuauagaacuuuccc

SEQ ID NO: 241100 - RNA, 22 nt, Homo sapiens
uacaggcaccuggcuaauuuuu

SEQ ID NO: 241101 - RNA, 22 nt, Homo sapiens
uacagucuagaggagaaucagg

SEQ ID NO: 241102 - RNA, 22 nt, Homo sapiens
uacaguggugugaucucagcuc

SEQ ID NO: 241103 - RNA, 22 nt, Homo sapiens
uacauacuguaugguucuguuu

SEQ ID NO: 241104 - RNA, 22 nt, Homo sapiens
uacauaguaagcaucuccugug

SEQ ID NO: 241105 - RNA, 19 nt, Homo sapiens
uacaugcagcaggcacgca

SEQ ID NO: 241106 - RNA, 22 nt, Homo sapiens
uacauuggcuagguuuggaggc

SEQ ID NO: 241107 - RNA, 22 nt, Homo sapiens
uacauugucauauucucucucu

SEQ ID NO: 241108 - RNA, 22 nt, Homo sapiens
uaccaccauuguaguuuggaaa

SEQ ID NO: 241109 - RNA, 22 nt, Homo sapiens
uaccaguaaugggucaaaggca

SEQ ID NO: 241110 - RNA, 22 nt, Homo sapiens
uaccaugaagguggagagagaa

SEQ ID NO: 241111 - RNA, 23 nt, Homo sapiens
uacuacacuuuucccaagguuuu

SEQ ID NO: 241112 - RNA, 22 nt, Homo sapiens
uacuacuuucugacaucuuuaa

SEQ ID NO: 241113 - RNA, 22 nt, Homo sapiens
uaugugcuuuguuaaacagaug

SEQ ID NO: 241114 - RNA, 22 nt, Homo sapiens
uaugugguuaauaggaauuugu

SEQ ID NO: 241115 - RNA, 20 nt, Homo sapiens
uauuacagaguaauggugga

SEQ ID NO: 241116 - RNA, 22 nt, Homo sapiens
uauuauagugauaggucuacug

SEQ ID NO: 241117 - RNA, 22 nt, Homo sapiens
uauucaagccaaauucaagcca

SEQ ID NO: 241118 - RNA, 22 nt, Homo sapiens
uauugaacgugggauauugaag

SEQ ID NO: 241119 - RNA, 22 nt, Homo sapiens
uauugaauuugagcugucucuu

SEQ ID NO: 241120 - RNA, 17 nt, Homo sapiens
uauugaccuuuguaugu

SEQ ID NO: 241121 - RNA, 22 nt, Homo sapiens
uauugauuaauugugauuaggc

SEQ ID NO: 241122 - RNA, 22 nt, Homo sapiens
uauugauuuucaguguucagcu

SEQ ID NO: 241123 - RNA, 22 nt, Homo sapiens
uauugcaauuggcagagugcua

SEQ ID NO: 241124 - RNA, 22 nt, Homo sapiens
uauugcaauuggggaaacuggg

SEQ ID NO: 241125 - RNA, 22 nt, Homo sapiens
uauugccugucuccaaaaauca

SEQ ID NO: 241126 - RNA, 22 nt, Homo sapiens
uauugcucaugcauuuaauuuc

SEQ ID NO: 241127 - RNA, 22 nt, Homo sapiens
uauugcuuaugaugcugaauua

SEQ ID NO: 241128 - RNA, 22 nt, Homo sapiens
uauugcuuuacucucuuauccu

SEQ ID NO: 241129 - RNA, 22 nt, Homo sapiens
uauuuggugaaugaaugcaugu

SEQ ID NO: 241130 - RNA, 20 nt, Homo sapiens
uauuugguuauuuccauggu

SEQ ID NO: 241131 - RNA, 22 nt, Homo sapiens
uauuugguuggugcaaaaguaa

SEQ ID NO: 241132 - RNA, 22 nt, Homo sapiens
ucaaacugucagguugaccaga

SEQ ID NO: 241133 - RNA, 20 nt, Homo sapiens
ucaaagacauggcugucaga

SEQ ID NO: 241134 - RNA, 22 nt, Homo sapiens
ucaaaugauucuccugccucag

SEQ ID NO: 241135 - RNA, 22 nt, Homo sapiens
ucaaaugcacguagagaaaaua

SEQ ID NO: 241136 - RNA, 20 nt, Homo sapiens
ucaaauucuuggccuccagc

SEQ ID NO: 241137 - RNA, 22 nt, Homo sapiens
ucaaguaauacucccaucuugg

SEQ ID NO: 241138 - RNA, 22 nt, Homo sapiens
ucaaguacuuauuugauaauua

SEQ ID NO: 241139 - RNA, 22 nt, Homo sapiens
ucaagugcauugauucaguauu

SEQ ID NO: 241140 - RNA, 18 nt, Homo sapiens
ucaauguggauguucuuu

SEQ ID NO: 241141 - RNA, 18 nt, Homo sapiens
ucacaaccacagugcugu

SEQ ID NO: 241142 - RNA, 22 nt, Homo sapiens
ucacaagcuccugccuuugcuu

SEQ ID NO: 241143 - RNA, 22 nt, Homo sapiens
ucacaagugagaggaauuagau

SEQ ID NO: 241144 - RNA, 22 nt, Homo sapiens
ucacacgugaacucaucacaga

SEQ ID NO: 241145 - RNA, 22 nt, Homo sapiens
ucacagacauugaggggaccuu

SEQ ID NO: 241146 - RNA, 22 nt, Homo sapiens
ucacagauaaauaaagaugauu

SEQ ID NO: 241147 - RNA, 22 nt, Homo sapiens
ucacagcuaaaaugaaaguagu

SEQ ID NO: 241148 - RNA, 22 nt, Homo sapiens
ucacaguagcaaauguuagaaa

SEQ ID NO: 241149 - RNA, 22 nt, Homo sapiens
ucacaguugauugaaacacagc

SEQ ID NO: 241150 - RNA, 20 nt, Homo sapiens
ucacauccucucccaacaug

SEQ ID NO: 241151 - RNA, 22 nt, Homo sapiens
ucacaucucagguuucuugaca

SEQ ID NO: 241152 - RNA, 22 nt, Homo sapiens
ucacauggauuaacucauuuau

SEQ ID NO: 241153 - RNA, 22 nt, Homo sapiens
ucacauggcagagaagaagcuc

SEQ ID NO: 241154 - RNA, 22 nt, Homo sapiens
ucacaugugaagauugggagua

SEQ ID NO: 241155 - RNA, 22 nt, Homo sapiens
ucacauuguguagccugcucac

SEQ ID NO: 241156 - RNA, 22 nt, Homo sapiens
ucaccaguaauaaagagccugc

SEQ ID NO: 241157 - RNA, 22 nt, Homo sapiens
ucacccuguguuuugcguuugc

SEQ ID NO: 241158 - RNA, 22 nt, Homo sapiens
ucaccuggagaagauggaucau

SEQ ID NO: 241159 - RNA, 22 nt, Homo sapiens
ucaccuggagccuucacauucu

SEQ ID NO: 241160 - RNA, 23 nt, Homo sapiens
ucacuagaguccuggaguuugag
